United States Patent 7,888,497 (BIOINFORMATICALLY DETECTABLE GROUP OF NOVEL REGULATORY OLIGONUCLEOTIDES AND USES THEREOF) - sequence listing, part 119

SEQ ID NO: 5039608 - DNA, 14 bp, Homo sapiens
gtacctgaaaagta

SEQ ID NO: 5039609 - DNA, 18 bp, Homo sapiens
gtacctgaaaagtaactt

SEQ ID NO: 5039610 - DNA, 18 bp, Homo sapiens
gtagacgaacagctgaca

SEQ ID NO: 5039611 - DNA, 19 bp, Homo sapiens
gtagattctgtggaacaag

SEQ ID NO: 5039612 - DNA, 17 bp, Homo sapiens
gtagcttaccagaagct

SEQ ID NO: 5039613 - DNA, 18 bp, Homo sapiens
gtatgttgtccaattgtt

SEQ ID NO: 5039614 - DNA, 20 bp, Homo sapiens
gtcacccctccaggaatgat

SEQ ID NO: 5039615 - DNA, 23 bp, Homo sapiens
gtcagaaaccattgttcagaaga

SEQ ID NO: 5039616 - DNA, 14 bp, Homo sapiens
gtccactgtgtata

SEQ ID NO: 5039617 - DNA, 13 bp, Homo sapiens
gtcctttatgtgg

SEQ ID NO: 5039618 - DNA, 20 bp, Homo sapiens
gtcctttccaaggcttctcc

SEQ ID NO: 5039619 - DNA, 22 bp, Homo sapiens
gtcctttccaaggcttctccaa

SEQ ID NO: 5039620 - DNA, 20 bp, Homo sapiens
gtctgaaccaccctggaaat

SEQ ID NO: 5039621 - DNA, 22 bp, Homo sapiens
gtctggccaatatggagaaacc

SEQ ID NO: 5039622 - DNA, 12 bp, Homo sapiens
gtcttgaaagat

SEQ ID NO: 5039623 - DNA, 15 bp, Homo sapiens
gtcttgaatgtcttt

SEQ ID NO: 5039624 - DNA, 19 bp, Homo sapiens
gtcttgaatgtcttttgaa

SEQ ID NO: 5039625 - DNA, 15 bp, Homo sapiens
gtgagttctgttgtg

SEQ ID NO: 5039626 - DNA, 17 bp, Homo sapiens
gtgcctgtacaagctga

SEQ ID NO: 5039627 - DNA, 22 bp, Homo sapiens
gtggaactctcctgctcctcag

SEQ ID NO: 5039628 - DNA, 23 bp, Homo sapiens
gtggaactctcctgctcctcagg

SEQ ID NO: 5039629 - DNA, 22 bp, Homo sapiens
gtgtctgaaccaccctggaaat

SEQ ID NO: 5039630 - DNA, 19 bp, Homo sapiens
gtgtgtagacaaatatttg

SEQ ID NO: 5039631 - DNA, 13 bp, Homo sapiens
gtgtgttgtcttg

SEQ ID NO: 5039632 - DNA, 18 bp, Homo sapiens
gtgtgttgtcttgaaaga

SEQ ID NO: 5039633 - DNA, 18 bp, Homo sapiens
gtgttgtcttgaaagatt

SEQ ID NO: 5039634 - DNA, 13 bp, Homo sapiens
gttcaaaaagaaa

SEQ ID NO: 5039635 - DNA, 14 bp, Homo sapiens
gttcatacatttga

SEQ ID NO: 5039636 - DNA, 22 bp, Homo sapiens
gttgtccaattgttgacagttc

SEQ ID NO: 5039637 - DNA, 22 bp, Homo sapiens
gtttacctgaataaatggtagt

SEQ ID NO: 5039638 - DNA, 16 bp, Homo sapiens
gtttcgtttctgtata

SEQ ID NO: 5039639 - DNA, 16 bp, Homo sapiens
gtttgaaggaaacagt

SEQ ID NO: 5039640 - DNA, 17 bp, Homo sapiens
gtttgctattagagcat

SEQ ID NO: 5039641 - DNA, 20 bp, Homo sapiens
gtttggattcttatgtagca

SEQ ID NO: 5039642 - DNA, 17 bp, Homo sapiens
taaaatatgatgtttaa

SEQ ID NO: 5039643 - DNA, 17 bp, Homo sapiens
taaaggatgttggtgtt

SEQ ID NO: 5039644 - DNA, 16 bp, Homo sapiens
taaattttacccttta

SEQ ID NO: 5039645 - DNA, 14 bp, Homo sapiens
taaccatttgcact

SEQ ID NO: 5039646 - DNA, 14 bp, Homo sapiens
taactgggttcaaa

SEQ ID NO: 5039647 - DNA, 15 bp, Homo sapiens
taacttggctttcat

SEQ ID NO: 5039648 - DNA, 22 bp, Homo sapiens
taagagccatataagtttgaag

SEQ ID NO: 5039649 - DNA, 11 bp, Homo sapiens
taaggaaacaa

SEQ ID NO: 5039650 - DNA, 22 bp, Homo sapiens
taaggtttcgtttctgtataca

SEQ ID NO: 5039651 - DNA, 15 bp, Homo sapiens
taagtcctttatgtg

SEQ ID NO: 5039652 - DNA, 17 bp, Homo sapiens
taagtcctttatgtgga

SEQ ID NO: 5039653 - DNA, 20 bp, Homo sapiens
taagtcctttatgtggaaaa

SEQ ID NO: 5039654 - DNA, 19 bp, Homo sapiens
aaaaattcctttgtgtttc

SEQ ID NO: 5039655 - DNA, 11 bp, Homo sapiens
aaaagaaggaa

SEQ ID NO: 5039656 - DNA, 16 bp, Homo sapiens
aaaaggcaaatgtgta

SEQ ID NO: 5039657 - DNA, 12 bp, Homo sapiens
aaaagtaacttg

SEQ ID NO: 5039658 - DNA, 20 bp, Homo sapiens
aaaatattttttatatatac

SEQ ID NO: 5039659 - DNA, 13 bp, Homo sapiens
aaacactgccatc

SEQ ID NO: 5039660 - DNA, 19 bp, Homo sapiens
aaacctaagtcctttatgt

SEQ ID NO: 5039661 - DNA, 16 bp, Homo sapiens
aaactagtaaagacat

SEQ ID NO: 5039662 - DNA, 10 bp, Homo sapiens
aaacttcttg

SEQ ID NO: 5039663 - DNA, 13 bp, Homo sapiens
aaagagagagaga

SEQ ID NO: 5039664 - DNA, 20 bp, Homo sapiens
aaagttagagtacagatcct

SEQ ID NO: 5039665 - DNA, 21 bp, Homo sapiens
aaatatgatgtttaaaagcat

SEQ ID NO: 5039666 - DNA, 12 bp, Homo sapiens
aaatatttggag

SEQ ID NO: 5039667 - DNA, 21 bp, Homo sapiens
aaatgtaccatcaaatgttaa

SEQ ID NO: 5039668 - DNA, 21 bp, Homo sapiens
aaatgttaacagagtttgata

SEQ ID NO: 5039669 - DNA, 19 bp, Homo sapiens
aaattgaggttcagcaagg

SEQ ID NO: 5039670 - DNA, 19 bp, Homo sapiens
aacagaaaacattctgatt

SEQ ID NO: 5039671 - DNA, 12 bp, Homo sapiens
aacagagcaaga

SEQ ID NO: 5039672 - DNA, 16 bp, Homo sapiens
caggcaggcacctggg

SEQ ID NO: 5039673 - DNA, 16 bp, Homo sapiens
caggggtcaccttgag

SEQ ID NO: 5039674 - DNA, 16 bp, Homo sapiens
cagtaactttatgtgt

SEQ ID NO: 5039675 - DNA, 19 bp, Homo sapiens
cagtaactttatgtgtaaa

SEQ ID NO: 5039676 - DNA, 22 bp, Homo sapiens
cagtatctatatatgtgtatgt

SEQ ID NO: 5039677 - DNA, 16 bp, Homo sapiens
cagttcacctgcactt

SEQ ID NO: 5039678 - DNA, 15 bp, Homo sapiens
cataaggtttcgttt

SEQ ID NO: 5039679 - DNA, 15 bp, Homo sapiens
cataatgctactgtc

SEQ ID NO: 5039680 - DNA, 11 bp, Homo sapiens
catagccatac

SEQ ID NO: 5039681 - DNA, 15 bp, Homo sapiens
cataggaacatgtag

SEQ ID NO: 5039682 - DNA, 15 bp, Homo sapiens
catagtggtgcagag

SEQ ID NO: 5039683 - DNA, 20 bp, Homo sapiens
catatggagtgcctgtacaa

SEQ ID NO: 5039684 - DNA, 15 bp, Homo sapiens
catattttctccgaa

SEQ ID NO: 5039685 - DNA, 15 bp, Homo sapiens
catccaactccagga

SEQ ID NO: 5039686 - DNA, 15 bp, Homo sapiens
catcctcaaaagaaa

SEQ ID NO: 5039687 - DNA, 14 bp, Homo sapiens
catctataaattgt

SEQ ID NO: 5039688 - DNA, 22 bp, Homo sapiens
catcttactgtacctgttcctt

SEQ ID NO: 5039689 - DNA, 14 bp, Homo sapiens
catgacagctgttc

SEQ ID NO: 5039690 - DNA, 14 bp, Homo sapiens
catgagcttttata

SEQ ID NO: 5039691 - DNA, 18 bp, Homo sapiens
catgagtccttgaaaata

SEQ ID NO: 5039692 - DNA, 16 bp, Homo sapiens
cattctcactctgctt

SEQ ID NO: 5039693 - DNA, 18 bp, Homo sapiens
cattgagagttttgtctt

SEQ ID NO: 5039694 - DNA, 18 bp, Homo sapiens
cattttttaaggaaacaa

SEQ ID NO: 5039695 - DNA, 20 bp, Homo sapiens
ccaagtgcatttttatctgt

SEQ ID NO: 5039696 - DNA, 14 bp, Homo sapiens
ccaagtgtgaacaa

SEQ ID NO: 5039697 - DNA, 21 bp, Homo sapiens
ccaattgttgacagttctgaa

SEQ ID NO: 5039698 - DNA, 20 bp, Homo sapiens
ccacaggagtgggaaaacac

SEQ ID NO: 5039699 - DNA, 20 bp, Homo sapiens
ccactgcactccagcctggg

SEQ ID NO: 5039700 - DNA, 12 bp, Homo sapiens
ccactgtgtata

SEQ ID NO: 5039701 - DNA, 15 bp, Homo sapiens
ccaggcaggcacctg

SEQ ID NO: 5039702 - DNA, 18 bp, Homo sapiens
ccatagaagaacagcaga

SEQ ID NO: 5039703 - DNA, 14 bp, Homo sapiens
ccatagtagtatga

SEQ ID NO: 5039704 - DNA, 19 bp, Homo sapiens
ccatataagtttgaaggaa

SEQ ID NO: 5039705 - DNA, 22 bp, Homo sapiens
ccatataagtttgaaggaaaca

SEQ ID NO: 5039706 - DNA, 17 bp, Homo sapiens
ccatgagtccttgaaaa

SEQ ID NO: 5039707 - DNA, 15 bp, Homo sapiens
ccattgttcagaaga

SEQ ID NO: 5039708 - DNA, 11 bp, Homo sapiens
cccctccagga

SEQ ID NO: 5039709 - DNA, 17 bp, Homo sapiens
ccctagccagcacttgt

SEQ ID NO: 5039710 - DNA, 18 bp, Homo sapiens
ccctggaaattctgcctt

SEQ ID NO: 5039711 - DNA, 21 bp, Homo sapiens
cccttccaggggtcaccttga

SEQ ID NO: 5039712 - DNA, 22 bp, Homo sapiens
cctattgcaaaggttccaactg

SEQ ID NO: 5039713 - DNA, 12 bp, Homo sapiens
cctcaaaagaaa

SEQ ID NO: 5039714 - DNA, 15 bp, Homo sapiens
cctccctagccagca

SEQ ID NO: 5039715 - DNA, 14 bp, Homo sapiens
cctgctcctcagga

SEQ ID NO: 5039716 - DNA, 22 bp, Homo sapiens
cctggatattattcttgtagtt

SEQ ID NO: 5039717 - DNA, 16 bp, Homo sapiens
cctgggcaacagagca

SEQ ID NO: 5039718 - DNA, 12 bp, Homo sapiens
cctgggctttct

SEQ ID NO: 5039719 - DNA, 22 bp, Homo sapiens
cctggtttttaaatagagtttg

SEQ ID NO: 5039720 - DNA, 20 bp, Homo sapiens
cctgtgtgttgccaggcagg

SEQ ID NO: 5039721 - DNA, 21 bp, Homo sapiens
cctgtgtgttgccaggcaggc

SEQ ID NO: 5039722 - DNA, 14 bp, Homo sapiens
ccttcctcactgcc

SEQ ID NO: 5039723 - DNA, 15 bp, Homo sapiens
ccttgaaaatatttt

SEQ ID NO: 5039724 - DNA, 18 bp, Homo sapiens
ccttgtctctactaaaaa

SEQ ID NO: 5039725 - DNA, 19 bp, Homo sapiens
cctttagtacctgaaaagt

SEQ ID NO: 5039726 - DNA, 11 bp, Homo sapiens
cctttctgagt

SEQ ID NO: 5039727 - DNA, 13 bp, Homo sapiens
cctttgtgtttct

SEQ ID NO: 5039728 - DNA, 19 bp, Homo sapiens
ccttttggccgggcatggt

SEQ ID NO: 5039729 - DNA, 21 bp, Homo sapiens
cggaaggggacgctttgaagg

SEQ ID NO: 5039730 - DNA, 15 bp, Homo sapiens
cggtgatcagcagag

SEQ ID NO: 5039731 - DNA, 14 bp, Homo sapiens
cggtttcagaagct

SEQ ID NO: 5039732 - DNA, 22 bp, Homo sapiens
cgtagcttctaccatgaacaga

SEQ ID NO: 5039733 - DNA, 21 bp, Homo sapiens
cgtgttttattcctgtatgtt

SEQ ID NO: 5039734 - DNA, 21 bp, Homo sapiens
ctaactctagtttgcagagga

SEQ ID NO: 5039735 - DNA, 20 bp, Homo sapiens
ctactgtctcactgaaacat

SEQ ID NO: 5039736 - DNA, 18 bp, Homo sapiens
ctagggttccactggaga

SEQ ID NO: 5039737 - DNA, 19 bp, Homo sapiens
ctagggttccactggagaa

SEQ ID NO: 5039738 - DNA, 21 bp, Homo sapiens
ctagtaaagacataggaacat

SEQ ID NO: 5039739 - DNA, 21 bp, Homo sapiens
ctagtatttcatgctgggaat

SEQ ID NO: 5039740 - DNA, 13 bp, Homo sapiens
ctatcccttctca

SEQ ID NO: 5039741 - DNA, 15 bp, Homo sapiens
ctatgggagcctcag

SEQ ID NO: 5039742 - DNA, 22 bp, Homo sapiens
ctatgtatttgcagttcacctg

SEQ ID NO: 5039743 - DNA, 13 bp, Homo sapiens
ctattgacttcaa

SEQ ID NO: 5039744 - DNA, 22 bp, Homo sapiens
ctattgcaaaggttccaactgt

SEQ ID NO: 5039745 - DNA, 21 bp, Homo sapiens
ctcaaaatgatatgtttgagt

SEQ ID NO: 5039746 - DNA, 19 bp, Homo sapiens
ctcaggaccaaagaacact

SEQ ID NO: 5039747 - DNA, 18 bp, Homo sapiens
ctcatcacatttgtaaat

SEQ ID NO: 5039748 - DNA, 13 bp, Homo sapiens
ctcatcttactgt

SEQ ID NO: 5039749 - DNA, 16 bp, Homo sapiens
ctccctgtgagagagt

SEQ ID NO: 5039750 - DNA, 16 bp, Homo sapiens
ctcctggaatggagct

SEQ ID NO: 5039751 - DNA, 17 bp, Homo sapiens
ctctcctgctcctcagg

SEQ ID NO: 5039752 - DNA, 19 bp, Homo sapiens
ctctcgcacctttccaaag

SEQ ID NO: 5039753 - DNA, 11 bp, Homo sapiens
ctcttctgagc

SEQ ID NO: 5039754 - DNA, 13 bp, Homo sapiens
ctctttaaaaaca

SEQ ID NO: 5039755 - DNA, 15 bp, Homo sapiens
ctgaaaaattccttt

SEQ ID NO: 5039756 - DNA, 14 bp, Homo sapiens
ctgaataaatggta

SEQ ID NO: 5039757 - DNA, 14 bp, Homo sapiens
ctgacatggagttc

SEQ ID NO: 5039758 - DNA, 21 bp, Homo sapiens
ctgagtccaagagggtccttt

SEQ ID NO: 5039759 - DNA, 18 bp, Homo sapiens
ctgatgttttgtattttg

SEQ ID NO: 5039760 - DNA, 20 bp, Homo sapiens
ctggagaattgaaaaggact

SEQ ID NO: 5039761 - DNA, 16 bp, Homo sapiens
ctgtccccttccaggg

SEQ ID NO: 5039762 - DNA, 12 bp, Homo sapiens
ctgtctagagta

SEQ ID NO: 5039763 - DNA, 22 bp, Homo sapiens
ctgtgagagagttgctcctcag

SEQ ID NO: 5039764 - DNA, 20 bp, Homo sapiens
ctgtggccgttatctggaag

SEQ ID NO: 5039765 - DNA, 21 bp, Homo sapiens
ctgtggccgttatctggaagt

SEQ ID NO: 5039766 - DNA, 15 bp, Homo sapiens
ctgttccttagacct

SEQ ID NO: 5039767 - DNA, 22 bp, Homo sapiens
cttagtttggattcttatgtag

SEQ ID NO: 5039768 - DNA, 15 bp, Homo sapiens
cttattgtagcatat

SEQ ID NO: 5039769 - DNA, 17 bp, Homo sapiens
cttcaggggcacttcat

SEQ ID NO: 5039770 - DNA, 14 bp, Homo sapiens
cttcattgagagtt

SEQ ID NO: 5039771 - DNA, 21 bp, Homo sapiens
cttccaggggtcaccttgaga

SEQ ID NO: 5039772 - DNA, 18 bp, Homo sapiens
cttccataatgctactgt

SEQ ID NO: 5039773 - DNA, 22 bp, Homo sapiens
cttccataatgctactgtctca

SEQ ID NO: 5039774 - DNA, 17 bp, Homo sapiens
cttctaccatgaacaga

SEQ ID NO: 5039775 - DNA, 23 bp, Homo sapiens
cttgaaaatattttttatatata

SEQ ID NO: 5039776 - DNA, 14 bp, Homo sapiens
cttgaacccgggag

SEQ ID NO: 5039777 - DNA, 20 bp, Homo sapiens
cttgagaggcatgacagctg

SEQ ID NO: 5039778 - DNA, 15 bp, Homo sapiens
cttgcatccaactcc

SEQ ID NO: 5039779 - DNA, 21 bp, Homo sapiens
cttgtagtttacctctttaaa

SEQ ID NO: 5039780 - DNA, 15 bp, Homo sapiens
ctttccaaggcttct

SEQ ID NO: 5039781 - DNA, 13 bp, Homo sapiens
ctttctctttggt

SEQ ID NO: 5039782 - DNA, 18 bp, Homo sapiens
ctttgcatgatctgtcaa

SEQ ID NO: 5039783 - DNA, 19 bp, Homo sapiens
ctttgcatgatctgtcaaa

SEQ ID NO: 5039784 - DNA, 15 bp, Homo sapiens
ctttgtctgaaaaat

SEQ ID NO: 5039785 - DNA, 20 bp, Homo sapiens
cttttcacatagctgtctag

SEQ ID NO: 5039786 - DNA, 22 bp, Homo sapiens
cttttggccgggcatggtagct

SEQ ID NO: 5039787 - DNA, 17 bp, Homo sapiens
gaaaccattgttcagaa

SEQ ID NO: 5039788 - DNA, 13 bp, Homo sapiens
gaaatatttttga

SEQ ID NO: 5039789 - DNA, 15 bp, Homo sapiens
gaaatctagtatttc

SEQ ID NO: 5039790 - DNA, 20 bp, Homo sapiens
gaaatgtaccatcaaatgtt

SEQ ID NO: 5039791 - DNA, 15 bp, Homo sapiens
gaaccagtgtctgaa

SEQ ID NO: 5039792 - DNA, 18 bp, Homo sapiens
gaaccagtgtctgaacca

SEQ ID NO: 5039793 - DNA, 16 bp, Homo sapiens
gaactttgaggaggaa

SEQ ID NO: 5039794 - DNA, 13 bp, Homo sapiens
gaagaacagcaga

SEQ ID NO: 5039795 - DNA, 18 bp, Homo sapiens
gaagctgcagctggtctg

SEQ ID NO: 5039796 - DNA, 18 bp, Homo sapiens
gaatattcccaagcccat

SEQ ID NO: 5039797 - DNA, 16 bp, Homo sapiens
gaatcagacctgggtg

SEQ ID NO: 5039798 - DNA, 14 bp, Homo sapiens
gacagctgttccac

SEQ ID NO: 5039799 - DNA, 14 bp, Homo sapiens
gaccagtctggcca

SEQ ID NO: 5039800 - DNA, 17 bp, Homo sapiens
gacctccctgtgagaga

SEQ ID NO: 5039801 - DNA, 14 bp, Homo sapiens
gactacatttagag

SEQ ID NO: 5039802 - DNA, 15 bp, Homo sapiens
gagaactgtggccgt

SEQ ID NO: 5039803 - DNA, 15 bp, Homo sapiens
tttgatgctgtttga

SEQ ID NO: 5039804 - DNA, 21 bp, Homo sapiens
tttgcatcccccaaacttctt

SEQ ID NO: 5039805 - DNA, 13 bp, Homo sapiens
tttgtatgtgtgt

SEQ ID NO: 5039806 - DNA, 17 bp, Homo sapiens
tttgtcatcagccacca

SEQ ID NO: 5039807 - DNA, 14 bp, Homo sapiens
tttgtctgaaaaat

SEQ ID NO: 5039808 - DNA, 16 bp, Homo sapiens
tttgtcttgaatgtct

SEQ ID NO: 5039809 - DNA, 15 bp, Homo sapiens
tttgtgtgttgtctt

SEQ ID NO: 5039810 - DNA, 17 bp, Homo sapiens
tttgtgtgttgtcttga

SEQ ID NO: 5039811 - DNA, 12 bp, Homo sapiens
ttttaaggaaac

SEQ ID NO: 5039812 - DNA, 15 bp, Homo sapiens
ttttatatatacagt

SEQ ID NO: 5039813 - DNA, 19 bp, Homo sapiens
ttttggggttgtgttgtca

SEQ ID NO: 5039814 - DNA, 12 bp, Homo sapiens
ttttgtcttgaa

SEQ ID NO: 5039815 - DNA, 17 bp, Homo sapiens
ttccaggtcagaaacca

SEQ ID NO: 5039816 - DNA, 21 bp, Homo sapiens
ttcccaagagtggtggcagct

SEQ ID NO: 5039817 - DNA, 15 bp, Homo sapiens
ttcctctttgcatga

SEQ ID NO: 5039818 - DNA, 20 bp, Homo sapiens
ttctaactctagtttgcaga

SEQ ID NO: 5039819 - DNA, 17 bp, Homo sapiens
ttctacatttcttagac

SEQ ID NO: 5039820 - DNA, 22 bp, Homo sapiens
ttctccagaaccagtgtctgaa

SEQ ID NO: 5039821 - DNA, 21 bp, Homo sapiens
ttctccgaaaggcaaaaatgt

SEQ ID NO: 5039822 - DNA, 21 bp, Homo sapiens
ttctgtatacaaccctggcat

SEQ ID NO: 5039823 - DNA, 19 bp, Homo sapiens
ttctgttgtgtttgtcaaa

SEQ ID NO: 5039824 - DNA, 11 bp, Homo sapiens
ttgaaatgtac

SEQ ID NO: 5039825 - DNA, 14 bp, Homo sapiens
ttgaaggaaacagt

SEQ ID NO: 5039826 - DNA, 12 bp, Homo sapiens
ttgaatgtcttt

SEQ ID NO: 5039827 - DNA, 18 bp, Homo sapiens
ttgacagttctgaagaat

SEQ ID NO: 5039828 - DNA, 17 bp, Homo sapiens
ttgagaggcatgacagc

SEQ ID NO: 5039829 - DNA, 18 bp, Homo sapiens
ttgagaggcatgacagct

SEQ ID NO: 5039830 - DNA, 22 bp, Homo sapiens
ttgagccctcctggaatggagc

SEQ ID NO: 5039831 - DNA, 16 bp, Homo sapiens
ttgatatgggctttct

SEQ ID NO: 5039832 - DNA, 17 bp, Homo sapiens
ttgctgtccccttccag

SEQ ID NO: 5039833 - DNA, 15 bp, Homo sapiens
ttggattcttatgta

SEQ ID NO: 5039834 - DNA, 17 bp, Homo sapiens
ttgtagtttacctcttt

SEQ ID NO: 5039835 - DNA, 13 bp, Homo sapiens
ttgtcttgaaaga

SEQ ID NO: 5039836 - DNA, 13 bp, Homo sapiens
ttgtgtgttgtct

SEQ ID NO: 5039837 - DNA, 22 bp, Homo sapiens
tttaaattttaccctttagact

SEQ ID NO: 5039838 - DNA, 17 bp, Homo sapiens
tttcagaagctgcagct

SEQ ID NO: 5039839 - DNA, 13 bp, Homo sapiens
tttcattattagt

SEQ ID NO: 5039840 - DNA, 15 bp, Homo sapiens
tttctacctttctga

SEQ ID NO: 5039841 - DNA, 13 bp, Homo sapiens
tttcttactcaaa

SEQ ID NO: 5039842 - DNA, 13 bp, Homo sapiens
tttctttcaactt

SEQ ID NO: 5039843 - DNA, 13 bp, Homo sapiens
tttgaaggaaaca

SEQ ID NO: 5039844 - DNA, 23 bp, Homo sapiens
tttgcatcccccaaacttcttgt

SEQ ID NO: 5039845 - DNA, 22 bp, Homo sapiens
tttggctattaaaaaagtggtg

SEQ ID NO: 5039846 - DNA, 14 bp, Homo sapiens
tttggcttccatga

SEQ ID NO: 5039847 - DNA, 18 bp, Homo sapiens
tttgtgtgttgtcttgaa

SEQ ID NO: 5039848 - DNA, 19 bp, Homo sapiens
tttgtgtgttgtcttgaaa

SEQ ID NO: 5039849 - DNA, 20 bp, Homo sapiens
ttttagctgatgaacttatt

SEQ ID NO: 5039850 - DNA, 21 bp, Homo sapiens
ttttagctgatgaacttattc

SEQ ID NO: 5039851 - DNA, 15 bp, Homo sapiens
ttttattcctgtatg

SEQ ID NO: 5039852 - DNA, 18 bp, Homo sapiens
ttttattcctgtatgttg

SEQ ID NO: 5039853 - DNA, 13 bp, Homo sapiens
ttttgtcttgaat

SEQ ID NO: 5039854 - DNA, 17 bp, Homo sapiens
ttttgtgttcctctttg

SEQ ID NO: 5039855 - DNA, 12 bp, Homo sapiens
tttttgtcatca

SEQ ID NO: 5039856 - DNA, 18 bp, Homo sapiens
agctgttccacaggggct

SEQ ID NO: 5039857 - DNA, 17 bp, Homo sapiens
agcttctaccatgaaca

SEQ ID NO: 5039858 - DNA, 18 bp, Homo sapiens
agcttctaccatgaacag

SEQ ID NO: 5039859 - DNA, 13 bp, Homo sapiens
agctttctccaga

SEQ ID NO: 5039860 - DNA, 15 bp, Homo sapiens
aggaggaagcagaat

SEQ ID NO: 5039861 - DNA, 14 bp, Homo sapiens
aggatttacttttt

SEQ ID NO: 5039862 - DNA, 13 bp, Homo sapiens
aggcaaatgtgta

SEQ ID NO: 5039863 - DNA, 13 bp, Homo sapiens
aggcaggcacctg

SEQ ID NO: 5039864 - DNA, 20 bp, Homo sapiens
aggcatcagtccctatgtat

SEQ ID NO: 5039865 - DNA, 14 bp, Homo sapiens
aggcatgtcctgga

SEQ ID NO: 5039866 - DNA, 15 bp, Homo sapiens
aggccaggagttcaa

SEQ ID NO: 5039867 - DNA, 15 bp, Homo sapiens
aggcctccctagcca

SEQ ID NO: 5039868 - DNA, 19 bp, Homo sapiens
aggggacgctttgaaggaa

SEQ ID NO: 5039869 - DNA, 15 bp, Homo sapiens
aggggctatcccttc

SEQ ID NO: 5039870 - DNA, 17 bp, Homo sapiens
aggggtcaccttgagag

SEQ ID NO: 5039871 - DNA, 16 bp, Homo sapiens
agggtaattttctaac

SEQ ID NO: 5039872 - DNA, 18 bp, Homo sapiens
aggtacccaaggtcacat

SEQ ID NO: 5039873 - DNA, 14 bp, Homo sapiens
aggtatgttgcctt

SEQ ID NO: 5039874 - DNA, 17 bp, Homo sapiens
aggttgccgtgagccaa

SEQ ID NO: 5039875 - DNA, 14 bp, Homo sapiens
agtaacttggcttt

SEQ ID NO: 5039876 - DNA, 16 bp, Homo sapiens
agtaactttatgtgta

SEQ ID NO: 5039877 - DNA, 20 bp, Homo sapiens
agtaactttatgtgtaaata

SEQ ID NO: 5039878 - DNA, 15 bp, Homo sapiens
agtacctgaaaagta

SEQ ID NO: 5039879 - DNA, 17 bp, Homo sapiens
agtactgctcttgtttc

SEQ ID NO: 5039880 - DNA, 18 bp, Homo sapiens
agtatctatatatgtgta

SEQ ID NO: 5039881 - DNA, 19 bp, Homo sapiens
agtatctatatatgtgtat

SEQ ID NO: 5039882 - DNA, 22 bp, Homo sapiens
agtatctatatatgtgtatgta

SEQ ID NO: 5039883 - DNA, 16 bp, Homo sapiens
agtcattgtaatcttt

SEQ ID NO: 5039884 - DNA, 19 bp, Homo sapiens
agtccaagagggtccttta

SEQ ID NO: 5039885 - DNA, 14 bp, Homo sapiens
agtccttgaaaata

SEQ ID NO: 5039886 - DNA, 17 bp, Homo sapiens
agtccttgaaaatattt

SEQ ID NO: 5039887 - DNA, 20 bp, Homo sapiens
agtgcatttttatctgtgag

SEQ ID NO: 5039888 - DNA, 14 bp, Homo sapiens
agtggtggcagctc

SEQ ID NO: 5039889 - DNA, 15 bp, Homo sapiens
agttatagatgtcta

SEQ ID NO: 5039890 - DNA, 15 bp, Homo sapiens
agtttgaaggaaaca

SEQ ID NO: 5039891 - DNA, 20 bp, Homo sapiens
agtttgatatgggctttctc

SEQ ID NO: 5039892 - DNA, 13 bp, Homo sapiens
agtttgcagagga

SEQ ID NO: 5039893 - DNA, 18 bp, Homo sapiens
agtttgtgtgttgtcttg

SEQ ID NO: 5039894 - DNA, 20 bp, Homo sapiens
agtttgtgtgttgtcttgaa

SEQ ID NO: 5039895 - DNA, 13 bp, Homo sapiens
agttttgtcttga

SEQ ID NO: 5039896 - DNA, 14 bp, Homo sapiens
agttttgtcttgaa

SEQ ID NO: 5039897 - DNA, 23 bp, Homo sapiens
ataaccacaaagcacagtttgaa

SEQ ID NO: 5039898 - DNA, 21 bp, Homo sapiens
atacataagcggcgtaagttt

SEQ ID NO: 5039899 - DNA, 16 bp, Homo sapiens
atagaagaacagcaga

SEQ ID NO: 5039900 - DNA, 20 bp, Homo sapiens
atagtgggcaccccactgca

SEQ ID NO: 5039901 - DNA, 23 bp, Homo sapiens
atataaaaggcaaatgtgtacat

SEQ ID NO: 5039902 - DNA, 14 bp, Homo sapiens
atataagtttgaag

SEQ ID NO: 5039903 - DNA, 19 bp, Homo sapiens
atataagtttgaaggaaac

SEQ ID NO: 5039904 - DNA, 21 bp, Homo sapiens
atatatacagtaactttatgt

SEQ ID NO: 5039905 - DNA, 18 bp, Homo sapiens
atatgatgtttaaaagca

SEQ ID NO: 5039906 - DNA, 19 bp, Homo sapiens
atatgggctttctctttgg

SEQ ID NO: 5039907 - DNA, 17 bp, Homo sapiens
atcccggtttcagaagc

SEQ ID NO: 5039908 - DNA, 20 bp, Homo sapiens
atctcttcttttggcttcca

SEQ ID NO: 5039909 - DNA, 14 bp, Homo sapiens
atgacagctgttcc

SEQ ID NO: 5039910 - DNA, 16 bp, Homo sapiens
atgagtccttgaaaat

SEQ ID NO: 5039911 - DNA, 14 bp, Homo sapiens
atgctactgtctca

SEQ ID NO: 5039912 - DNA, 13 bp, Homo sapiens
atgctcttctgtg

SEQ ID NO: 5039913 - DNA, 23 bp, Homo sapiens
atggagctgtataactgtgcaga

SEQ ID NO: 5039914 - DNA, 17 bp, Homo sapiens
atggatttgatgctgtt

SEQ ID NO: 5039915 - DNA, 20 bp, Homo sapiens
atggcggtgatcagcagaga

SEQ ID NO: 5039916 - DNA, 16 bp, Homo sapiens
atgtccactgtgtata

SEQ ID NO: 5039917 - DNA, 18 bp, Homo sapiens
atgtcttttcaaaaggat

SEQ ID NO: 5039918 - DNA, 16 bp, Homo sapiens
atgtcttttgaatatt

SEQ ID NO: 5039919 - DNA, 20 bp, Homo sapiens
atgtgatttatttatttcta

SEQ ID NO: 5039920 - DNA, 22 bp, Homo sapiens
atgtgtacatggcagagtttgt

SEQ ID NO: 5039921 - DNA, 19 bp, Homo sapiens
atgtgtgtagacaaatatt

SEQ ID NO: 5039922 - DNA, 14 bp, Homo sapiens
attagagcattgaa

SEQ ID NO: 5039923 - DNA, 17 bp, Homo sapiens
attcaggtatgttgcct

SEQ ID NO: 5039924 - DNA, 18 bp, Homo sapiens
attcctttgtgtttctat

SEQ ID NO: 5039925 - DNA, 16 bp, Homo sapiens
attctcactctgcttt

SEQ ID NO: 5039926 - DNA, 18 bp, Homo sapiens
attctgcccaaaaatatg

SEQ ID NO: 5039927 - DNA, 17 bp, Homo sapiens
attctgtagattctgtg

SEQ ID NO: 5039928 - DNA, 20 bp, Homo sapiens
attgacaactgaagagacac

SEQ ID NO: 5039929 - DNA, 14 bp, Homo sapiens
attgacttcaatga

SEQ ID NO: 5039930 - DNA, 14 bp, Homo sapiens
attgagagttttgt

SEQ ID NO: 5039931 - DNA, 21 bp, Homo sapiens
attgtaatctttcatagccat

SEQ ID NO: 5039932 - DNA, 22 bp, Homo sapiens
attgtactcaatggatttgatg

SEQ ID NO: 5039933 - DNA, 13 bp, Homo sapiens
attgttcagaaga

SEQ ID NO: 5039934 - DNA, 22 bp, Homo sapiens
attgttgacagttctgaagaat

SEQ ID NO: 5039935 - DNA, 19 bp, Homo sapiens
attgttgtttgccatactt

SEQ ID NO: 5039936 - DNA, 16 bp, Homo sapiens
caaagcacagtttgaa

SEQ ID NO: 5039937 - DNA, 15 bp, Homo sapiens
caactgaagagacac

SEQ ID NO: 5039938 - DNA, 22 bp, Homo sapiens
caacttgcatccaactccagga

SEQ ID NO: 5039939 - DNA, 14 bp, Homo sapiens
caagactctgtctc

SEQ ID NO: 5039940 - DNA, 18 bp, Homo sapiens
caagagtggtggcagctc

SEQ ID NO: 5039941 - DNA, 20 bp, Homo sapiens
caagtgattgacaactgaag

SEQ ID NO: 5039942 - DNA, 14 bp, Homo sapiens
caagtgtgaacaaa

SEQ ID NO: 5039943 - DNA, 19 bp, Homo sapiens
caatagcaacgtagcttct

SEQ ID NO: 5039944 - DNA, 17 bp, Homo sapiens
caatcctgtctttctga

SEQ ID NO: 5039945 - DNA, 20 bp, Homo sapiens
caatgatagtaagaaaagtg

SEQ ID NO: 5039946 - DNA, 17 bp, Homo sapiens
caatggatttgatgctg

SEQ ID NO: 5039947 - DNA, 21 bp, Homo sapiens
caattgttgacagttctgaag

SEQ ID NO: 5039948 - DNA, 12 bp, Homo sapiens
cacaggagggta

SEQ ID NO: 5039949 - DNA, 12 bp, Homo sapiens
cacagttggcct

SEQ ID NO: 5039950 - DNA, 12 bp, Homo sapiens
cacagtttgaac

SEQ ID NO: 5039951 - DNA, 21 bp, Homo sapiens
cacatagctagttatgtgaga

SEQ ID NO: 5039952 - DNA, 13 bp, Homo sapiens
caccatagaagaa

SEQ ID NO: 5039953 - DNA, 20 bp, Homo sapiens
caccatagaagaacagcaga

SEQ ID NO: 5039954 - DNA, 19 bp, Homo sapiens
cacccaagagattgttgtt

SEQ ID NO: 5039955 - DNA, 22 bp, Homo sapiens
caccccactgcaatcctgtctt

SEQ ID NO: 5039956 - DNA, 17 bp, Homo sapiens
cacctgggctttctgga

SEQ ID NO: 5039957 - DNA, 20 bp, Homo sapiens
cacggtattcccaagagtgg

SEQ ID NO: 5039958 - DNA, 15 bp, Homo sapiens
cactctgctttgcat

SEQ ID NO: 5039959 - DNA, 20 bp, Homo sapiens
cactctgttatttagactca

SEQ ID NO: 5039960 - DNA, 20 bp, Homo sapiens
cactgccatcttagtttgga

SEQ ID NO: 5039961 - DNA, 22 bp, Homo sapiens
cactgccatcttagtttggatt

SEQ ID NO: 5039962 - DNA, 18 bp, Homo sapiens
cagaacatcattagaaca

SEQ ID NO: 5039963 - DNA, 20 bp, Homo sapiens
cagaaccagtgtctgaacca

SEQ ID NO: 5039964 - DNA, 22 bp, Homo sapiens
cagacaagtggctaagtgtcca

SEQ ID NO: 5039965 - DNA, 17 bp, Homo sapiens
cagagtttgtgtgttgt

SEQ ID NO: 5039966 - DNA, 22 bp, Homo sapiens
cagagtttgtgtgttgtcttga

SEQ ID NO: 5039967 - DNA, 23 bp, Homo sapiens
cagattttggggttgtgttgtca

SEQ ID NO: 5039968 - DNA, 14 bp, Homo sapiens
cagctggtctgttt

SEQ ID NO: 5039969 - DNA, 14 bp, Homo sapiens
caggcaggcacctg

SEQ ID NO: 5039970 - DNA, 15 bp, Homo sapiens
caggcaggcacctgg

SEQ ID NO: 5039971 - DNA, 23 bp, Homo sapiens
caggggctatcccttctcagaaa

SEQ ID NO: 5039972 - DNA, 15 bp, Homo sapiens
cagggtccctcagga

SEQ ID NO: 5039973 - DNA, 14 bp, Homo sapiens
caggtatgttgcct

SEQ ID NO: 5039974 - DNA, 15 bp, Homo sapiens
caggtatgttgcctt

SEQ ID NO: 5039975 - DNA, 18 bp, Homo sapiens
taagtttgaaggaaacag

SEQ ID NO: 5039976 - DNA, 15 bp, Homo sapiens
taatgctactgtctc

SEQ ID NO: 5039977 - DNA, 16 bp, Homo sapiens
tacatggcagagtttg

SEQ ID NO: 5039978 - DNA, 20 bp, Homo sapiens
taccctttagactgtagcct

SEQ ID NO: 5039979 - DNA, 19 bp, Homo sapiens
tacttcaggggcacttcat

SEQ ID NO: 5039980 - DNA, 18 bp, Homo sapiens
tactttttgtaaaaagct

SEQ ID NO: 5039981 - DNA, 15 bp, Homo sapiens
tagaagaacagcaga

SEQ ID NO: 5039982 - DNA, 18 bp, Homo sapiens
tagactcatcttactgta

SEQ ID NO: 5039983 - DNA, 19 bp, Homo sapiens
tagactcatcttactgtac

SEQ ID NO: 5039984 - DNA, 16 bp, Homo sapiens
tagagaactgtggccg

SEQ ID NO: 5039985 - DNA, 22 bp, Homo sapiens
tagcctggatattattcttgta

SEQ ID NO: 5039986 - DNA, 18 bp, Homo sapiens
tagctagttatgtgagaa

SEQ ID NO: 5039987 - DNA, 20 bp, Homo sapiens
tagctagttatgtgagaaag

SEQ ID NO: 5039988 - DNA, 23 bp, Homo sapiens
tagctgatgaacttattctgtag

SEQ ID NO: 5039989 - DNA, 15 bp, Homo sapiens
tagctgtctagagta

SEQ ID NO: 5039990 - DNA, 16 bp, Homo sapiens
tagcttaccagaagct

SEQ ID NO: 5039991 - DNA, 21 bp, Homo sapiens
tagcttctaccatgaacagaa

SEQ ID NO: 5039992 - DNA, 11 bp, Homo sapiens
taggagacttt

SEQ ID NO: 5039993 - DNA, 20 bp, Homo sapiens
taggccatgaaaaaaatgat

SEQ ID NO: 5039994 - DNA, 15 bp, Homo sapiens
tagtacctgaaaagt

SEQ ID NO: 5039995 - DNA, 18 bp, Homo sapiens
tagtagtatgatgataca

SEQ ID NO: 5039996 - DNA, 22 bp, Homo sapiens
tagtttacctgaataaatggta

SEQ ID NO: 5039997 - DNA, 11 bp, Homo sapiens
tagtttggatt

SEQ ID NO: 5039998 - DNA, 20 bp, Homo sapiens
tataaaaggcaaatgtgtac

SEQ ID NO: 5039999 - DNA, 12 bp, Homo sapiens
tatagatgtcta

SEQ ID NO: 5040000 - DNA, 22 bp, Homo sapiens
tatatacagtaactttatgtgt

SEQ ID NO: 5040001 - DNA, 23 bp, Homo sapiens
tatatacagtaactttatgtgta

SEQ ID NO: 5040002 - DNA, 12 bp, Homo sapiens
tatatatgtgta

SEQ ID NO: 5040003 - DNA, 15 bp, Homo sapiens
tatcccttctcagaa

SEQ ID NO: 5040004 - DNA, 22 bp, Homo sapiens
tatctatatatgtgtatgtacg

SEQ ID NO: 5040005 - DNA, 15 bp, Homo sapiens
aaaaagtcattgtaa

SEQ ID NO: 5040006 - DNA, 18 bp, Homo sapiens
aaaacagaacatcattag

SEQ ID NO: 5040007 - DNA, 20 bp, Homo sapiens
aaaacctaagtcctttatgt

SEQ ID NO: 5040008 - DNA, 14 bp, Homo sapiens
aaaaggactcttga

SEQ ID NO: 5040009 - DNA, 13 bp, Homo sapiens
aaacagaacatca

SEQ ID NO: 5040010 - DNA, 22 bp, Homo sapiens
aaagagcacttcacacagacaa

SEQ ID NO: 5040011 - DNA, 17 bp, Homo sapiens
aaagcacagtttgaaca

SEQ ID NO: 5040012 - DNA, 19 bp, Homo sapiens
aaaggacagagtatgaaca

SEQ ID NO: 5040013 - DNA, 16 bp, Homo sapiens
aaaggcaaatgtgtac

SEQ ID NO: 5040014 - DNA, 20 bp, Homo sapiens
aaagtggtggcaaaagacat

SEQ ID NO: 5040015 - DNA, 14 bp, Homo sapiens
aaagtggttgttag

SEQ ID NO: 5040016 - DNA, 22 bp, Homo sapiens
aaagttactgattcactgcatg

SEQ ID NO: 5040017 - DNA, 22 bp, Homo sapiens
aaatctagtatttcatgctggg

SEQ ID NO: 5040018 - DNA, 22 bp, Homo sapiens
aaatgatccccaagtgtgaaca

SEQ ID NO: 5040019 - DNA, 13 bp, Homo sapiens
aaattaaaagaag

SEQ ID NO: 5040020 - DNA, 23 bp, Homo sapiens
aaattgtccgtgttcatacattt

SEQ ID NO: 5040021 - DNA, 18 bp, Homo sapiens
aacactcgaaaagagcac

SEQ ID NO: 5040022 - DNA, 14 bp, Homo sapiens
aacagaaaacattc

SEQ ID NO: 5040023 - DNA, 14 bp, Homo sapiens
aacatcattagaac

SEQ ID NO: 5040024 - DNA, 16 bp, Homo sapiens
aaccagtgtctgaacc

SEQ ID NO: 5040025 - DNA, 14 bp, Homo sapiens
aactgtatatattc

SEQ ID NO: 5040026 - DNA, 13 bp, Homo sapiens
aacttattctgta

SEQ ID NO: 5040027 - DNA, 14 bp, Homo sapiens
aacttattctgtag

SEQ ID NO: 5040028 - DNA, 12 bp, Homo sapiens
aagaacagcaga

SEQ ID NO: 5040029 - DNA, 17 bp, Homo sapiens
aagactctgtctcaaaa

SEQ ID NO: 5040030 - DNA, 17 bp, Homo sapiens
aagagattgttgtttgc

SEQ ID NO: 5040031 - DNA, 22 bp, Homo sapiens
aagatcacgccactgcactcca

SEQ ID NO: 5040032 - DNA, 11 bp, Homo sapiens
aagattagaag

SEQ ID NO: 5040033 - DNA, 13 bp, Homo sapiens
aagattagaagct

SEQ ID NO: 5040034 - DNA, 15 bp, Homo sapiens
aagattcaggtatgt

SEQ ID NO: 5040035 - DNA, 20 bp, Homo sapiens
aagcccatgagtccttgaaa

SEQ ID NO: 5040036 - DNA, 18 bp, Homo sapiens
aaggttccaactgtatat

SEQ ID NO: 5040037 - DNA, 22 bp, Homo sapiens
aataccattttttaaggaaaca

SEQ ID NO: 5040038 - DNA, 22 bp, Homo sapiens
aatagagtttgctattagagca

SEQ ID NO: 5040039 - DNA, 22 bp, Homo sapiens
aatataaaaggcaaatgtgtac

SEQ ID NO: 5040040 - DNA, 18 bp, Homo sapiens
aatcccggtttcagaagc

SEQ ID NO: 5040041 - DNA, 15 bp, Homo sapiens
aattatctgggcatg

SEQ ID NO: 5040042 - DNA, 20 bp, Homo sapiens
aattgttgacagttctgaag

SEQ ID NO: 5040043 - DNA, 17 bp, Homo sapiens
aattttaccctttagac

SEQ ID NO: 5040044 - DNA, 15 bp, Homo sapiens
acaaaaaactcccct

SEQ ID NO: 5040045 - DNA, 17 bp, Homo sapiens
acacctgggcttaagaa

SEQ ID NO: 5040046 - DNA, 20 bp, Homo sapiens
acagattttggggttgtgtt

SEQ ID NO: 5040047 - DNA, 20 bp, Homo sapiens
acaggggctatcccttctca

SEQ ID NO: 5040048 - DNA, 16 bp, Homo sapiens
acagtaactttatgtg

SEQ ID NO: 5040049 - DNA, 18 bp, Homo sapiens
acagtaactttatgtgta

SEQ ID NO: 5040050 - DNA, 13 bp, Homo sapiens
acagttctgaaga

SEQ ID NO: 5040051 - DNA, 15 bp, Homo sapiens
acagttctgaagaat

SEQ ID NO: 5040052 - DNA, 16 bp, Homo sapiens
acatcctcaaaagaaa

SEQ ID NO: 5040053 - DNA, 14 bp, Homo sapiens
acatggagttcccg

SEQ ID NO: 5040054 - DNA, 23 bp, Homo sapiens
acatttaaattttaccctttaga

SEQ ID NO: 5040055 - DNA, 23 bp, Homo sapiens
acatttcttagactacatttaga

SEQ ID NO: 5040056 - DNA, 16 bp, Homo sapiens
accagtgtctgaacca

SEQ ID NO: 5040057 - DNA, 18 bp, Homo sapiens
accatgaacagaaaacat

SEQ ID NO: 5040058 - DNA, 16 bp, Homo sapiens
accattgttcagaaga

SEQ ID NO: 5040059 - DNA, 20 bp, Homo sapiens
accattttttaaggaaacaa

SEQ ID NO: 5040060 - DNA, 22 bp, Homo sapiens
accattttttaaggaaacaata

SEQ ID NO: 5040061 - DNA, 15 bp, Homo sapiens
accctggcattatgt

SEQ ID NO: 5040062 - DNA, 14 bp, Homo sapiens
acctccctgtgaga

SEQ ID NO: 5040063 - DNA, 22 bp, Homo sapiens
acctgcctaaaatatgatgttt

SEQ ID NO: 5040064 - DNA, 23 bp, Homo sapiens
acctttccaaagttaacagattt

SEQ ID NO: 5040065 - DNA, 24 bp, Homo sapiens
acgtagcttctaccatgaacagaa

SEQ ID NO: 5040066 - DNA, 22 bp, Homo sapiens
acgtgttttattcctgtatgtt

SEQ ID NO: 5040067 - DNA, 20 bp, Homo sapiens
actaagaagatgttttgaaa

SEQ ID NO: 5040068 - DNA, 15 bp, Homo sapiens
actccagcctgggca

SEQ ID NO: 5040069 - DNA, 15 bp, Homo sapiens
actcgaaaagagcac

SEQ ID NO: 5040070 - DNA, 13 bp, Homo sapiens
actctgtctcaaa

SEQ ID NO: 5040071 - DNA, 15 bp, Homo sapiens
actctgttatttaga

SEQ ID NO: 5040072 - DNA, 20 bp, Homo sapiens
actgcactccagcctgggca

SEQ ID NO: 5040073 - DNA, 15 bp, Homo sapiens
actgctcttgtttct

SEQ ID NO: 5040074 - DNA, 18 bp, Homo sapiens
actgctcttgtttctttt

SEQ ID NO: 5040075 - DNA, 13 bp, Homo sapiens
actggagttctat

SEQ ID NO: 5040076 - DNA, 19 bp, Homo sapiens
actgggttcaaaaagaaaa

SEQ ID NO: 5040077 - DNA, 12 bp, Homo sapiens
actgtgtataga

SEQ ID NO: 5040078 - DNA, 16 bp, Homo sapiens
acttctcttctgagcc

SEQ ID NO: 5040079 - DNA, 17 bp, Homo sapiens
actttgtctgaaaaatt

SEQ ID NO: 5040080 - DNA, 14 bp, Homo sapiens
agaaagtcagacct

SEQ ID NO: 5040081 - DNA, 23 bp, Homo sapiens
agaaatctagtatttcatgctgg

SEQ ID NO: 5040082 - DNA, 18 bp, Homo sapiens
agaacatcattagaacaa

SEQ ID NO: 5040083 - DNA, 22 bp, Homo sapiens
agaatgccatatttttgagggc

SEQ ID NO: 5040084 - DNA, 12 bp, Homo sapiens
agacaaatattt

SEQ ID NO: 5040085 - DNA, 15 bp, Homo sapiens
agacaaatatttgga

SEQ ID NO: 5040086 - DNA, 19 bp, Homo sapiens
agacataggccatgaaaaa

SEQ ID NO: 5040087 - DNA, 14 bp, Homo sapiens
agaccagtctggcc

SEQ ID NO: 5040088 - DNA, 15 bp, Homo sapiens
agaccagtctggcca

SEQ ID NO: 5040089 - DNA, 17 bp, Homo sapiens
agactcatcttactgta

SEQ ID NO: 5040090 - DNA, 18 bp, Homo sapiens
agactcatcttactgtac

SEQ ID NO: 5040091 - DNA, 18 bp, Homo sapiens
agactgtagcctggatat

SEQ ID NO: 5040092 - DNA, 18 bp, Homo sapiens
agagaaggcctccctagc

SEQ ID NO: 5040093 - DNA, 20 bp, Homo sapiens
agagccatataagtttgaag

SEQ ID NO: 5040094 - DNA, 22 bp, Homo sapiens
agagccatataagtttgaagga

SEQ ID NO: 5040095 - DNA, 18 bp, Homo sapiens
agaggagcaaattgaggt

SEQ ID NO: 5040096 - DNA, 18 bp, Homo sapiens
agaggtacccaaggtcac

SEQ ID NO: 5040097 - DNA, 22 bp, Homo sapiens
agagtttgatatgggctttctc

SEQ ID NO: 5040098 - DNA, 13 bp, Homo sapiens
agagtttgtgtgt

SEQ ID NO: 5040099 - DNA, 18 bp, Homo sapiens
agagtttgtgtgttgtct

SEQ ID NO: 5040100 - DNA, 22 bp, Homo sapiens
agagtttgtgtgttgtcttgaa

SEQ ID NO: 5040101 - DNA, 13 bp, Homo sapiens
agagttttgtctt

SEQ ID NO: 5040102 - DNA, 15 bp, Homo sapiens
agatgctcttctgtg

SEQ ID NO: 5040103 - DNA, 22 bp, Homo sapiens
agatggcggtgatcagcagaga

SEQ ID NO: 5040104 - DNA, 16 bp, Homo sapiens
agattaagagccatat

SEQ ID NO: 5040105 - DNA, 14 bp, Homo sapiens
agcacagtttgaac

SEQ ID NO: 5040106 - DNA, 17 bp, Homo sapiens
agcacttcacacagaca

SEQ ID NO: 5040107 - DNA, 13 bp, Homo sapiens
agcacttgtatat

SEQ ID NO: 5040108 - DNA, 21 bp, Homo sapiens
agcatatggagtgcctgtaca

SEQ ID NO: 5040109 - DNA, 17 bp, Homo sapiens
agcccatgagtccttga

SEQ ID NO: 5040110 - DNA, 21 bp, Homo sapiens
agccctcctggaatggagctg

SEQ ID NO: 5040111 - DNA, 17 bp, Homo sapiens
agcctcagactcattgt

SEQ ID NO: 5040112 - DNA, 18 bp, Homo sapiens
agcctgggcaacagagca

SEQ ID NO: 5040113 - DNA, 14 bp, Homo sapiens
aggaggaagcagaa

SEQ ID NO: 5040114 - DNA, 20 bp, Homo sapiens
aggcaactagtggagagaac

SEQ ID NO: 5040115 - DNA, 22 bp, Homo sapiens
aggcaactagtggagagaactg

SEQ ID NO: 5040116 - DNA, 16 bp, Homo sapiens
aggcaccatagaagaa

SEQ ID NO: 5040117 - DNA, 19 bp, Homo sapiens
aggcaccatagaagaacag

SEQ ID NO: 5040118 - DNA, 16 bp, Homo sapiens
aggcactctgttattt

SEQ ID NO: 5040119 - DNA, 20 bp, Homo sapiens
aggcactctgttatttagac

SEQ ID NO: 5040120 - DNA, 22 bp, Homo sapiens
aggcaggcacctgggctttctg

SEQ ID NO: 5040121 - DNA, 14 bp, Homo sapiens
aggcatgacagctg

SEQ ID NO: 5040122 - DNA, 19 bp, Homo sapiens
aggcatgacagctgttcca

SEQ ID NO: 5040123 - DNA, 19 bp, Homo sapiens
aggccatgaaaaaaatgat

SEQ ID NO: 5040124 - DNA, 18 bp, Homo sapiens
agggtcctttagtacctg

SEQ ID NO: 5040125 - DNA, 20 bp, Homo sapiens
agggtcctttagtacctgaa

SEQ ID NO: 5040126 - DNA, 17 bp, Homo sapiens
agggttccactggagaa

SEQ ID NO: 5040127 - DNA, 22 bp, Homo sapiens
aggttcagcaaggtgagagagg

SEQ ID NO: 5040128 - DNA, 18 bp, Homo sapiens
aggttccaactgtatata

SEQ ID NO: 5040129 - DNA, 17 bp, Homo sapiens
agtaactttatgtgtaa

SEQ ID NO: 5040130 - DNA, 23 bp, Homo sapiens
agtatctatatatgtgtatgtac

SEQ ID NO: 5040131 - DNA, 16 bp, Homo sapiens
agtatttcatgctggg

SEQ ID NO: 5040132 - DNA, 20 bp, Homo sapiens
agtccctatgtatttgcagt

SEQ ID NO: 5040133 - DNA, 22 bp, Homo sapiens
agtccttgaaaatattttttat

SEQ ID NO: 5040134 - DNA, 14 bp, Homo sapiens
agtcctttatgtgg

SEQ ID NO: 5040135 - DNA, 19 bp, Homo sapiens
agtctggccaatatggaga

SEQ ID NO: 5040136 - DNA, 23 bp, Homo sapiens
agtgcatttttatctgtgagttc

SEQ ID NO: 5040137 - DNA, 19 bp, Homo sapiens
agtggttgttagttataga

SEQ ID NO: 5040138 - DNA, 17 bp, Homo sapiens
agttatagatgtctagg

SEQ ID NO: 5040139 - DNA, 16 bp, Homo sapiens
agttgctgtccccttc

SEQ ID NO: 5040140 - DNA, 20 bp, Homo sapiens
agttgctgtccccttccagg

SEQ ID NO: 5040141 - DNA, 20 bp, Homo sapiens
agtttacctctttaaaaaca

SEQ ID NO: 5040142 - DNA, 18 bp, Homo sapiens
agtttggattcttatgta

SEQ ID NO: 5040143 - DNA, 16 bp, Homo sapiens
agtttgtgtgttgtct

SEQ ID NO: 5040144 - DNA, 16 bp, Homo sapiens
ataaaaataaaagaga

SEQ ID NO: 5040145 - DNA, 19 bp, Homo sapiens
ataaaaggcaaatgtgtac

SEQ ID NO: 5040146 - DNA, 19 bp, Homo sapiens
ataaggtttcgtttctgta

SEQ ID NO: 5040147 - DNA, 19 bp, Homo sapiens
ataagtttgaaggaaacag

SEQ ID NO: 5040148 - DNA, 20 bp, Homo sapiens
ataagtttgaaggaaacagt

SEQ ID NO: 5040149 - DNA, 22 bp, Homo sapiens
atacaaccctggcattatgtcc

SEQ ID NO: 5040150 - DNA, 19 bp, Homo sapiens
atacagtaactttatgtgt

SEQ ID NO: 5040151 - DNA, 15 bp, Homo sapiens
atagagtttgctatt

SEQ ID NO: 5040152 - DNA, 22 bp, Homo sapiens
atatacagtaactttatgtgta

SEQ ID NO: 5040153 - DNA, 18 bp, Homo sapiens
atatatacagtaacttta

SEQ ID NO: 5040154 - DNA, 15 bp, Homo sapiens
atatatgtgtatgta

SEQ ID NO: 5040155 - DNA, 15 bp, Homo sapiens
atatattcccaatag

SEQ ID NO: 5040156 - DNA, 14 bp, Homo sapiens
atatgatgtttaaa

SEQ ID NO: 5040157 - DNA, 22 bp, Homo sapiens
atatgtgtatgtacgtttgtat

SEQ ID NO: 5040158 - DNA, 20 bp, Homo sapiens
atcagacctgggtggaactc

SEQ ID NO: 5040159 - DNA, 13 bp, Homo sapiens
atcagcagagaga

SEQ ID NO: 5040160 - DNA, 11 bp, Homo sapiens
atcattagaac

SEQ ID NO: 5040161 - DNA, 14 bp, Homo sapiens
atccaactccagga

SEQ ID NO: 5040162 - DNA, 16 bp, Homo sapiens
atccatagtagtatga

SEQ ID NO: 5040163 - DNA, 16 bp, Homo sapiens
atcccggtttcagaag

SEQ ID NO: 5040164 - DNA, 18 bp, Homo sapiens
atcccggtttcagaagct

SEQ ID NO: 5040165 - DNA, 13 bp, Homo sapiens
atcctcaaaagaa

SEQ ID NO: 5040166 - DNA, 19 bp, Homo sapiens
atctatatatgtgtatgta

SEQ ID NO: 5040167 - DNA, 14 bp, Homo sapiens
atcttagtttggat

SEQ ID NO: 5040168 - DNA, 20 bp, Homo sapiens
atctttgcaagaaagtcaga

SEQ ID NO: 5040169 - DNA, 17 bp, Homo sapiens
atgaacttattctgtag

SEQ ID NO: 5040170 - DNA, 18 bp, Homo sapiens
atgagtccttgaaaatat

SEQ ID NO: 5040171 - DNA, 22 bp, Homo sapiens
atgatctcttcttttggcttcc

SEQ ID NO: 5040172 - DNA, 13 bp, Homo sapiens
atgatctgtcaaa

SEQ ID NO: 5040173 - DNA, 20 bp, Homo sapiens
atgctactgtctcactgaaa

SEQ ID NO: 5040174 - DNA, 14 bp, Homo sapiens
atgctcttctgtgg

SEQ ID NO: 5040175 - DNA, 19 bp, Homo sapiens
atggatttgatgctgtttg

SEQ ID NO: 5040176 - DNA, 20 bp, Homo sapiens
atggcagagtttgtgtgttg

SEQ ID NO: 5040177 - DNA, 22 bp, Homo sapiens
atggcagagtttgtgtgttgtc

SEQ ID NO: 5040178 - DNA, 14 bp, Homo sapiens
atgtacgtttgtat

SEQ ID NO: 5040179 - DNA, 17 bp, Homo sapiens
atgtccactgtgtatag

SEQ ID NO: 5040180 - DNA, 14 bp, Homo sapiens
atgtgtacatggca

SEQ ID NO: 5040181 - DNA, 20 bp, Homo sapiens
atgtgtgtagacaaatattt

SEQ ID NO: 5040182 - DNA, 14 bp, Homo sapiens
atgttggtgttcca

SEQ ID NO: 5040183 - DNA, 13 bp, Homo sapiens
attattcttgtag

SEQ ID NO: 5040184 - DNA, 23 bp, Homo sapiens
attcccaagagtggtggcagctc

SEQ ID NO: 5040185 - DNA, 19 bp, Homo sapiens
attctgatttggaaaaaga

SEQ ID NO: 5040186 - DNA, 17 bp, Homo sapiens
attctgtggaacaagcc

SEQ ID NO: 5040187 - DNA, 12 bp, Homo sapiens
attgaaaaggac

SEQ ID NO: 5040188 - DNA, 12 bp, Homo sapiens
attgttcagaag

SEQ ID NO: 5040189 - DNA, 21 bp, Homo sapiens
attgttcagaagacctccctg

SEQ ID NO: 5040190 - DNA, 17 bp, Homo sapiens
attgttgacagttctga

SEQ ID NO: 5040191 - DNA, 21 bp, Homo sapiens
attgttgacagttctgaagaa

SEQ ID NO: 5040192 - DNA, 19 bp, Homo sapiens
atttaaattttacccttta

SEQ ID NO: 5040193 - DNA, 14 bp, Homo sapiens
atttaccttgaaca

SEQ ID NO: 5040194 - DNA, 20 bp, Homo sapiens
atttagagaactgtggccgt

SEQ ID NO: 5040195 - DNA, 17 bp, Homo sapiens
atttctacctttctgag

SEQ ID NO: 5040196 - DNA, 14 bp, Homo sapiens
atttcttactcaaa

SEQ ID NO: 5040197 - DNA, 16 bp, Homo sapiens
atttgatgctgtttga

SEQ ID NO: 5040198 - DNA, 16 bp, Homo sapiens
attttttaaggaaaca

SEQ ID NO: 5040199 - DNA, 13 bp, Homo sapiens
attttttatatat

SEQ ID NO: 5040200 - DNA, 18 bp, Homo sapiens
attttttatatatacagt

SEQ ID NO: 5040201 - DNA, 16 bp, Homo sapiens
caaaagaaagagaaat

SEQ ID NO: 5040202 - DNA, 23 bp, Homo sapiens
caaacatgtttagagtggataga

SEQ ID NO: 5040203 - DNA, 15 bp, Homo sapiens
caaagttaacagatt

SEQ ID NO: 5040204 - DNA, 13 bp, Homo sapiens
caaatatttggag

SEQ ID NO: 5040205 - DNA, 15 bp, Homo sapiens
caacaaggaaataga

SEQ ID NO: 5040206 - DNA, 15 bp, Homo sapiens
caacaccccacagga

SEQ ID NO: 5040207 - DNA, 18 bp, Homo sapiens
caacaccccacaggaggg

SEQ ID NO: 5040208 - DNA, 14 bp, Homo sapiens
caacagagcaagac

SEQ ID NO: 5040209 - DNA, 15 bp, Homo sapiens
caactagtggagaga

SEQ ID NO: 5040210 - DNA, 22 bp, Homo sapiens
caagagggtcctttagtacctg

SEQ ID NO: 5040211 - DNA, 18 bp, Homo sapiens
caagatcacgccactgca

SEQ ID NO: 5040212 - DNA, 23 bp, Homo sapiens
caaggcaactagtggagagaact

SEQ ID NO: 5040213 - DNA, 14 bp, Homo sapiens
caaggtgagagagg

SEQ ID NO: 5040214 - DNA, 21 bp, Homo sapiens
caagtgattgacaactgaaga

SEQ ID NO: 5040215 - DNA, 19 bp, Homo sapiens
caatggatttgatgctgtt

SEQ ID NO: 5040216 - DNA, 22 bp, Homo sapiens
caatggatttgatgctgtttga

SEQ ID NO: 5040217 - DNA, 11 bp, Homo sapiens
caatgtgccct

SEQ ID NO: 5040218 - DNA, 14 bp, Homo sapiens
caattgttgacagt

SEQ ID NO: 5040219 - DNA, 24 bp, Homo sapiens
caattgttgacagttctgaagaat

SEQ ID NO: 5040220 - DNA, 18 bp, Homo sapiens
cacaggagtgggaaaaca

SEQ ID NO: 5040221 - DNA, 23 bp, Homo sapiens
cacaggggctatcccttctcaga

SEQ ID NO: 5040222 - DNA, 16 bp, Homo sapiens
cacatagctgtctaga

SEQ ID NO: 5040223 - DNA, 19 bp, Homo sapiens
cacctgggcttaagaaatc

SEQ ID NO: 5040224 - DNA, 16 bp, Homo sapiens
cacctgggctttctgg

SEQ ID NO: 5040225 - DNA, 13 bp, Homo sapiens
cactctgttattt

SEQ ID NO: 5040226 - DNA, 17 bp, Homo sapiens
cactctgttatttagac

SEQ ID NO: 5040227 - DNA, 22 bp, Homo sapiens
cactgcatgagcttttatacta

SEQ ID NO: 5040228 - DNA, 17 bp, Homo sapiens
cacttaaggcactctgt

SEQ ID NO: 5040229 - DNA, 15 bp, Homo sapiens
cacttacttgggagg

SEQ ID NO: 5040230 - DNA, 16 bp, Homo sapiens
cacttcattgagagtt

SEQ ID NO: 5040231 - DNA, 13 bp, Homo sapiens
cacttgtatatac

SEQ ID NO: 5040232 - DNA, 16 bp, Homo sapiens
cagaacatcattagaa

SEQ ID NO: 5040233 - DNA, 17 bp, Homo sapiens
cagaacatcattagaac

SEQ ID NO: 5040234 - DNA, 20 bp, Homo sapiens
cagaagacctccctgtgaga

SEQ ID NO: 5040235 - DNA, 21 bp, Homo sapiens
cagaagacctccctgtgagag

SEQ ID NO: 5040236 - DNA, 22 bp, Homo sapiens
cagaagacctccctgtgagaga

SEQ ID NO: 5040237 - DNA, 16 bp, Homo sapiens
cagaagctgcagctgg

SEQ ID NO: 5040238 - DNA, 21 bp, Homo sapiens
cagagcaagactctgtctcaa

SEQ ID NO: 5040239 - DNA, 23 bp, Homo sapiens
cagaggagcaaattgaggttcag

SEQ ID NO: 5040240 - DNA, 14 bp, Homo sapiens
cagagtcctttcca

SEQ ID NO: 5040241 - DNA, 15 bp, Homo sapiens
cagagtcctttccaa

SEQ ID NO: 5040242 - DNA, 22 bp, Homo sapiens
cagatggcggtgatcagcagag

SEQ ID NO: 5040243 - DNA, 23 bp, Homo sapiens
cagatggcggtgatcagcagaga

SEQ ID NO: 5040244 - DNA, 19 bp, Homo sapiens
cagctgttccacaggggct

SEQ ID NO: 5040245 - DNA, 13 bp, Homo sapiens
caggaaataaagt

SEQ ID NO: 5040246 - DNA, 14 bp, Homo sapiens
caggaatgatctct

SEQ ID NO: 5040247 - DNA, 22 bp, Homo sapiens
caggagtgggaaaacactgcca

SEQ ID NO: 5040248 - DNA, 14 bp, Homo sapiens
caggcacctgggct

SEQ ID NO: 5040249 - DNA, 21 bp, Homo sapiens
caggggctatcccttctcaga

SEQ ID NO: 5040250 - DNA, 14 bp, Homo sapiens
caggggtcaccttg

SEQ ID NO: 5040251 - DNA, 17 bp, Homo sapiens
cagtaactttatgtgta

SEQ ID NO: 5040252 - DNA, 16 bp, Homo sapiens
cagtatctatatatgt

SEQ ID NO: 5040253 - DNA, 18 bp, Homo sapiens
cagtatctatatatgtgt

SEQ ID NO: 5040254 - DNA, 20 bp, Homo sapiens
cagtatctatatatgtgtat

SEQ ID NO: 5040255 - DNA, 16 bp, Homo sapiens
cagttggccttcagaa

SEQ ID NO: 5040256 - DNA, 12 bp, Homo sapiens
catactttgtct

SEQ ID NO: 5040257 - DNA, 13 bp, Homo sapiens
catactttgtctg

SEQ ID NO: 5040258 - DNA, 18 bp, Homo sapiens
catagaagaacagcagat

SEQ ID NO: 5040259 - DNA, 15 bp, Homo sapiens
catagctgtctagag

SEQ ID NO: 5040260 - DNA, 20 bp, Homo sapiens
catagtagtatgatgataca

SEQ ID NO: 5040261 - DNA, 15 bp, Homo sapiens
catataagtttgaag

SEQ ID NO: 5040262 - DNA, 20 bp, Homo sapiens
catataagtttgaaggaaac

SEQ ID NO: 5040263 - DNA, 21 bp, Homo sapiens
catataagtttgaaggaaaca

SEQ ID NO: 5040264 - DNA, 23 bp, Homo sapiens
catataagtttgaaggaaacagt

SEQ ID NO: 5040265 - DNA, 15 bp, Homo sapiens
catcagtccctatgt

SEQ ID NO: 5040266 - DNA, 13 bp, Homo sapiens
catcattagaaca

SEQ ID NO: 5040267 - DNA, 22 bp, Homo sapiens
catgaacagaaaacattctgat

SEQ ID NO: 5040268 - DNA, 20 bp, Homo sapiens
catgagtccttgaaaatatt

SEQ ID NO: 5040269 - DNA, 22 bp, Homo sapiens
catgatggttattttcttttct

SEQ ID NO: 5040270 - DNA, 20 bp, Homo sapiens
catgccaatagttgctgtcc

SEQ ID NO: 5040271 - DNA, 18 bp, Homo sapiens
catggcagagtttgtgtg

SEQ ID NO: 5040272 - DNA, 20 bp, Homo sapiens
cattatgtccactgtgtata

SEQ ID NO: 5040273 - DNA, 13 bp, Homo sapiens
cattgttcagaag

SEQ ID NO: 5040274 - DNA, 14 bp, Homo sapiens
cattgttcagaaga

SEQ ID NO: 5040275 - DNA, 18 bp, Homo sapiens
cattgttcagaagacctc

SEQ ID NO: 5040276 - DNA, 16 bp, Homo sapiens
ccaacaaggaaataga

SEQ ID NO: 5040277 - DNA, 19 bp, Homo sapiens
ccaagagggtcctttagta

SEQ ID NO: 5040278 - DNA, 22 bp, Homo sapiens
ccaattgttgacagttctgaag

SEQ ID NO: 5040279 - DNA, 20 bp, Homo sapiens
ccacaaagcacagtttgaac

SEQ ID NO: 5040280 - DNA, 24 bp, Homo sapiens
ccacaggggctatcccttctcaga

SEQ ID NO: 5040281 - DNA, 19 bp, Homo sapiens
ccactgcactccagcctgg

SEQ ID NO: 5040282 - DNA, 15 bp, Homo sapiens
ccagaagcttccata

SEQ ID NO: 5040283 - DNA, 16 bp, Homo sapiens
ccagagtcctttccaa

SEQ ID NO: 5040284 - DNA, 21 bp, Homo sapiens
ccagagtcctttccaaggctt

SEQ ID NO: 5040285 - DNA, 23 bp, Homo sapiens
ccaggatagtgggcaccccactg

SEQ ID NO: 5040286 - DNA, 22 bp, Homo sapiens
ccagtgtctgaaccaccctgga

SEQ ID NO: 5040287 - DNA, 21 bp, Homo sapiens
ccataatgctactgtctcact

SEQ ID NO: 5040288 - DNA, 16 bp, Homo sapiens
ccatataagtttgaag

SEQ ID NO: 5040289 - DNA, 15 bp, Homo sapiens
ccatcttagtttgga

SEQ ID NO: 5040290 - DNA, 22 bp, Homo sapiens
ccatgaacagaaaacattctga

SEQ ID NO: 5040291 - DNA, 22 bp, Homo sapiens
ccatgccaatagttgctgtccc

SEQ ID NO: 5040292 - DNA, 19 bp, Homo sapiens
ccattttttaaggaaacaa

SEQ ID NO: 5040293 - DNA, 19 bp, Homo sapiens
cccaagagtggtggcagct

SEQ ID NO: 5040294 - DNA, 15 bp, Homo sapiens
cccaagtgtgaacaa

SEQ ID NO: 5040295 - DNA, 21 bp, Homo sapiens
ccccttctacatttcttagac

SEQ ID NO: 5040296 - DNA, 15 bp, Homo sapiens
cccggtttcagaagc

SEQ ID NO: 5040297 - DNA, 22 bp, Homo sapiens
cccggtttcagaagctgcagct

SEQ ID NO: 5040298 - DNA, 22 bp, Homo sapiens
cccttctcagaaaacttctctt

SEQ ID NO: 5040299 - DNA, 16 bp, Homo sapiens
cctaagtcctttatgt

SEQ ID NO: 5040300 - DNA, 15 bp, Homo sapiens
cctcagactcattgt

SEQ ID NO: 5040301 - DNA, 22 bp, Homo sapiens
cctccaggaatgatctcttctt

SEQ ID NO: 5040302 - DNA, 22 bp, Homo sapiens
cctgaaaagtaacttggctttc

SEQ ID NO: 5040303 - DNA, 15 bp, Homo sapiens
cctggaaattctgcc

SEQ ID NO: 5040304 - DNA, 19 bp, Homo sapiens
cctggcattatgtccactg

SEQ ID NO: 5040305 - DNA, 15 bp, Homo sapiens
cctgggctttctgga

SEQ ID NO: 5040306 - DNA, 23 bp, Homo sapiens
ccttccaggggtcaccttgagag

SEQ ID NO: 5040307 - DNA, 20 bp, Homo sapiens
ccttgagaggcatgacagct

SEQ ID NO: 5040308 - DNA, 23 bp, Homo sapiens
cctttatgtggaaaacagaacat

SEQ ID NO: 5040309 - DNA, 17 bp, Homo sapiens
cggtgatcagcagagag

SEQ ID NO: 5040310 - DNA, 16 bp, Homo sapiens
cgtaagtttaaaggat

SEQ ID NO: 5040311 - DNA, 23 bp, Homo sapiens
cgtggctagggttccactggaga

SEQ ID NO: 5040312 - DNA, 14 bp, Homo sapiens
cgtttgtatgtgtg

SEQ ID NO: 5040313 - DNA, 15 bp, Homo sapiens
cgtttgtatgtgtgt

SEQ ID NO: 5040314 - DNA, 15 bp, Homo sapiens
ctaagtcctttatgt

SEQ ID NO: 5040315 - DNA, 20 bp, Homo sapiens
ctagccagcacttgtatata

SEQ ID NO: 5040316 - DNA, 21 bp, Homo sapiens
ctaggtttatctcatttaagc

SEQ ID NO: 5040317 - DNA, 15 bp, Homo sapiens
ctatatatgtgtatg

SEQ ID NO: 5040318 - DNA, 15 bp, Homo sapiens
ctatcccttctcaga

SEQ ID NO: 5040319 - DNA, 16 bp, Homo sapiens
ctattgacttcaatga

SEQ ID NO: 5040320 - DNA, 20 bp, Homo sapiens
ctcagggtccctcaggacca

SEQ ID NO: 5040321 - DNA, 19 bp, Homo sapiens
ctccccttcctcactgccc

SEQ ID NO: 5040322 - DNA, 21 bp, Homo sapiens
ctccctagccagcacttgtat

SEQ ID NO: 5040323 - DNA, 20 bp, Homo sapiens
ctcctcagggtccctcagga

SEQ ID NO: 5040324 - DNA, 16 bp, Homo sapiens
ctcctgctcctcagga

SEQ ID NO: 5040325 - DNA, 15 bp, Homo sapiens
ctcgcacctttccaa

SEQ ID NO: 5040326 - DNA, 17 bp, Homo sapiens
ctctcgcacctttccaa

SEQ ID NO: 5040327 - DNA, 13 bp, Homo sapiens
ctctgctttgcat

SEQ ID NO: 5040328 - DNA, 20 bp, Homo sapiens
ctcttgagccctcctggaat

SEQ ID NO: 5040329 - DNA, 15 bp, Homo sapiens
ctgaaccaccctgga

SEQ ID NO: 5040330 - DNA, 17 bp, Homo sapiens
ctgaataaatggtagta

SEQ ID NO: 5040331 - DNA, 18 bp, Homo sapiens
ctgacatggagttcccgt

SEQ ID NO: 5040332 - DNA, 17 bp, Homo sapiens
ctgagcacactttagtg

SEQ ID NO: 5040333 - DNA, 14 bp, Homo sapiens
ctgatttggaaaaa

SEQ ID NO: 5040334 - DNA, 14 bp, Homo sapiens
ctgctcctcaggaa

SEQ ID NO: 5040335 - DNA, 14 bp, Homo sapiens
ctgctcttgtttct

SEQ ID NO: 5040336 - DNA, 17 bp, Homo sapiens
ctggacaccgggccagt

SEQ ID NO: 5040337 - DNA, 21 bp, Homo sapiens
ctggcattatgtccactgtgt

SEQ ID NO: 5040338 - DNA, 16 bp, Homo sapiens
ctgggcaacagagcaa

SEQ ID NO: 5040339 - DNA, 12 bp, Homo sapiens
ctggtaagcaaa

SEQ ID NO: 5040340 - DNA, 21 bp, Homo sapiens
ctgtacctgttccttagacct

SEQ ID NO: 5040341 - DNA, 18 bp, Homo sapiens
ctgtatgttgtccaattg

SEQ ID NO: 5040342 - DNA, 14 bp, Homo sapiens
ctgtgagagagttg

SEQ ID NO: 5040343 - DNA, 12 bp, Homo sapiens
ctgtgcagagac

SEQ ID NO: 5040344 - DNA, 19 bp, Homo sapiens
ctgtggccgttatctggaa

SEQ ID NO: 5040345 - DNA, 16 bp, Homo sapiens
ctgttatttagactca

SEQ ID NO: 5040346 - DNA, 16 bp, Homo sapiens
ctgttccttagacctt

SEQ ID NO: 5040347 - DNA, 17 bp, Homo sapiens
ctgttgtgtttgtcaaa

SEQ ID NO: 5040348 - DNA, 16 bp, Homo sapiens
cttaaggcactctgtt

SEQ ID NO: 5040349 - DNA, 19 bp, Homo sapiens
cttagtttggattcttatg

SEQ ID NO: 5040350 - DNA, 14 bp, Homo sapiens
cttattctgtagat

SEQ ID NO: 5040351 - DNA, 19 bp, Homo sapiens
cttctccaattctgcccaa

SEQ ID NO: 5040352 - DNA, 15 bp, Homo sapiens
cttcttttggcttcc

SEQ ID NO: 5040353 - DNA, 15 bp, Homo sapiens
ctttaacagctttct

SEQ ID NO: 5040354 - DNA, 16 bp, Homo sapiens
ctttaacagctttctc

SEQ ID NO: 5040355 - DNA, 20 bp, Homo sapiens
ctttaacagctttctccaga

SEQ ID NO: 5040356 - DNA, 23 bp, Homo sapiens
ctttatgtggaaaacagaacatc

SEQ ID NO: 5040357 - DNA, 12 bp, Homo sapiens
ctttatgtgtaa

SEQ ID NO: 5040358 - DNA, 21 bp, Homo sapiens
ctttctgagcacactttagtg

SEQ ID NO: 5040359 - DNA, 16 bp, Homo sapiens
ctttgaggaggaagca

SEQ ID NO: 5040360 - DNA, 19 bp, Homo sapiens
ctttgaggaggaagcagaa

SEQ ID NO: 5040361 - DNA, 14 bp, Homo sapiens
cttttggcttccat

SEQ ID NO: 5040362 - DNA, 22 bp, Homo sapiens
gaaatgtaccatcaaatgttaa

SEQ ID NO: 5040363 - DNA, 17 bp, Homo sapiens
gaactatgggagcctca

SEQ ID NO: 5040364 - DNA, 20 bp, Homo sapiens
gaaggcctccctagccagca

SEQ ID NO: 5040365 - DNA, 16 bp, Homo sapiens
gaatgatctcttcttt

SEQ ID NO: 5040366 - DNA, 17 bp, Homo sapiens
gaatgatctcttctttt

SEQ ID NO: 5040367 - DNA, 16 bp, Homo sapiens
gacaactgaagagaca

SEQ ID NO: 5040368 - DNA, 16 bp, Homo sapiens
gacagagtatgaacac

SEQ ID NO: 5040369 - DNA, 13 bp, Homo sapiens
gacagctgttcca

SEQ ID NO: 5040370 - DNA, 18 bp, Homo sapiens
gacagctgttccacaggg

SEQ ID NO: 5040371 - DNA, 22 bp, Homo sapiens
gaccttccataatgctactgtc

SEQ ID NO: 5040372 - DNA, 22 bp, Homo sapiens
gactcttgagccctcctggaat

SEQ ID NO: 5040373 - DNA, 14 bp, Homo sapiens
gactgggggccaga

SEQ ID NO: 5040374 - DNA, 23 bp, Homo sapiens
gagaaagttagagtacagatcct

SEQ ID NO: 5040375 - DNA, 14 bp, Homo sapiens
gagagagaatcaga

SEQ ID NO: 5040376 - DNA, 17 bp, Homo sapiens
gagagttttgtcttgaa

SEQ ID NO: 5040377 - DNA, 23 bp, Homo sapiens
gagcacttcacacagacaagtgg

SEQ ID NO: 5040378 - DNA, 19 bp, Homo sapiens
gagccatataagtttgaag

SEQ ID NO: 5040379 - DNA, 23 bp, Homo sapiens
gagccatataagtttgaaggaaa

SEQ ID NO: 5040380 - DNA, 15 bp, Homo sapiens
gagccctcctggaat

SEQ ID NO: 5040381 - DNA, 21 bp, Homo sapiens
gagccctcctggaatggagct

SEQ ID NO: 5040382 - DNA, 14 bp, Homo sapiens
gaggaggaagcaga

SEQ ID NO: 5040383 - DNA, 20 bp, Homo sapiens
gaggcatgacagctgttcca

SEQ ID NO: 5040384 - DNA, 17 bp, Homo sapiens
gaggtacccaaggtcac

SEQ ID NO: 5040385 - DNA, 13 bp, Homo sapiens
gagtggtggcagc

SEQ ID NO: 5040386 - DNA, 15 bp, Homo sapiens
gagtggtggcagctc

SEQ ID NO: 5040387 - DNA, 14 bp, Homo sapiens
gagttcaagaccag

SEQ ID NO: 5040388 - DNA, 14 bp, Homo sapiens
gatgtccaacaagg

SEQ ID NO: 5040389 - DNA, 13 bp, Homo sapiens
gattaagagccat

SEQ ID NO: 5040390 - DNA, 17 bp, Homo sapiens
gattagaagctgaaaac

SEQ ID NO: 5040391 - DNA, 17 bp, Homo sapiens
gattgacaactgaagag

SEQ ID NO: 5040392 - DNA, 18 bp, Homo sapiens
gatttgatgctgtttgac

SEQ ID NO: 5040393 - DNA, 21 bp, Homo sapiens
gattttggggttgtgttgtca

SEQ ID NO: 5040394 - DNA, 19 bp, Homo sapiens
gcaaaggttccaactgtat

SEQ ID NO: 5040395 - DNA, 17 bp, Homo sapiens
gcacagatacacataca

SEQ ID NO: 5040396 - DNA, 13 bp, Homo sapiens
gcacagtttgaac

SEQ ID NO: 5040397 - DNA, 15 bp, Homo sapiens
gcacagtttgaacaa

SEQ ID NO: 5040398 - DNA, 21 bp, Homo sapiens
gcaccatagaagaacagcaga

SEQ ID NO: 5040399 - DNA, 16 bp, Homo sapiens
gcacctgggctttctg

SEQ ID NO: 5040400 - DNA, 14 bp, Homo sapiens
gcactctgttattt

SEQ ID NO: 5040401 - DNA, 16 bp, Homo sapiens
gcaggcacctgggctt

SEQ ID NO: 5040402 - DNA, 21 bp, Homo sapiens
gcatatggagtgcctgtacaa

SEQ ID NO: 5040403 - DNA, 19 bp, Homo sapiens
gcatcagtccctatgtatt

SEQ ID NO: 5040404 - DNA, 14 bp, Homo sapiens
gcatgacagctgtt

SEQ ID NO: 5040405 - DNA, 15 bp, Homo sapiens
gcatgttgagaggct

SEQ ID NO: 5040406 - DNA, 19 bp, Homo sapiens
gcattatgtccactgtgta

SEQ ID NO: 5040407 - DNA, 21 bp, Homo sapiens
gcattatgtccactgtgtata

SEQ ID NO: 5040408 - DNA, 22 bp, Homo sapiens
gcattatgtccactgtgtatag

SEQ ID NO: 5040409 - DNA, 18 bp, Homo sapiens
gccaccatcctattgcaa

SEQ ID NO: 5040410 - DNA, 16 bp, Homo sapiens
gccagcacttgtatat

SEQ ID NO: 5040411 - DNA, 21 bp, Homo sapiens
gccagtatctatatatgtgta

SEQ ID NO: 5040412 - DNA, 22 bp, Homo sapiens
gccagtatctatatatgtgtat

SEQ ID NO: 5040413 - DNA, 16 bp, Homo sapiens
gccatataagtttgaa

SEQ ID NO: 5040414 - DNA, 23 bp, Homo sapiens
gccatataagtttgaaggaaaca

SEQ ID NO: 5040415 - DNA, 18 bp, Homo sapiens
gcccaaaaatatggttga

SEQ ID NO: 5040416 - DNA, 17 bp, Homo sapiens
gcccatgagtccttgaa

SEQ ID NO: 5040417 - DNA, 20 bp, Homo sapiens
gcctataatcccagcatgtt

SEQ ID NO: 5040418 - DNA, 16 bp, Homo sapiens
gcctccctagccagca

SEQ ID NO: 5040419 - DNA, 17 bp, Homo sapiens
gcctctttaacagcttt

SEQ ID NO: 5040420 - DNA, 20 bp, Homo sapiens
gcctctttaacagctttctc

SEQ ID NO: 5040421 - DNA, 21 bp, Homo sapiens
gcctggatattattcttgtag

SEQ ID NO: 5040422 - DNA, 16 bp, Homo sapiens
gcggtgatcagcagag

SEQ ID NO: 5040423 - DNA, 16 bp, Homo sapiens
gctactgtctcactga

SEQ ID NO: 5040424 - DNA, 21 bp, Homo sapiens
gctgatgaacttattctgtag

SEQ ID NO: 5040425 - DNA, 16 bp, Homo sapiens
gctggtctgtttccag

SEQ ID NO: 5040426 - DNA, 20 bp, Homo sapiens
gcttaagaaatctagtattt

SEQ ID NO: 5040427 - DNA, 19 bp, Homo sapiens
gcttctaccatgaacagaa

SEQ ID NO: 5040428 - DNA, 19 bp, Homo sapiens
gctttctccagaaccagtg

SEQ ID NO: 5040429 - DNA, 22 bp, Homo sapiens
gctttctctttggtttctcatc

SEQ ID NO: 5040430 - DNA, 19 bp, Homo sapiens
gctttgaaggaaccaagtg

SEQ ID NO: 5040431 - DNA, 12 bp, Homo sapiens
ggaatggagctg

SEQ ID NO: 5040432 - DNA, 20 bp, Homo sapiens
ggaggtggaggttgccgtga

SEQ ID NO: 5040433 - DNA, 16 bp, Homo sapiens
ggagttctatgctctc

SEQ ID NO: 5040434 - DNA, 22 bp, Homo sapiens
ggatagaaaattatgcagcttg

SEQ ID NO: 5040435 - DNA, 12 bp, Homo sapiens
ggcaaaagacat

SEQ ID NO: 5040436 - DNA, 20 bp, Homo sapiens
ggcaacagagcaagactctg

SEQ ID NO: 5040437 - DNA, 20 bp, Homo sapiens
ggcaccatagaagaacagca

SEQ ID NO: 5040438 - DNA, 22 bp, Homo sapiens
ggcactctgttatttagactca

SEQ ID NO: 5040439 - DNA, 15 bp, Homo sapiens
ggccgaggcacgaga

SEQ ID NO: 5040440 - DNA, 22 bp, Homo sapiens
ggcctgtgtgttgccaggcagg

SEQ ID NO: 5040441 - DNA, 23 bp, Homo sapiens
ggcctgtgtgttgccaggcaggc

SEQ ID NO: 5040442 - DNA, 19 bp, Homo sapiens
ggcttaagaaatctagtat

SEQ ID NO: 5040443 - DNA, 22 bp, Homo sapiens
ggctttcattattagtactgct

SEQ ID NO: 5040444 - DNA, 13 bp, Homo sapiens
ggctttctggaat

SEQ ID NO: 5040445 - DNA, 15 bp, Homo sapiens
ggggttgtgttgtca

SEQ ID NO: 5040446 - DNA, 14 bp, Homo sapiens
ggtttcagaagctg

SEQ ID NO: 5040447 - DNA, 17 bp, Homo sapiens
gtaactgggttcaaaaa

SEQ ID NO: 5040448 - DNA, 15 bp, Homo sapiens
gtaactttatgtgta

SEQ ID NO: 5040449 - DNA, 16 bp, Homo sapiens
gtaactttatgtgtaa

SEQ ID NO: 5040450 - DNA, 12 bp, Homo sapiens
gtacctgaaaag

SEQ ID NO: 5040451 - DNA, 23 bp, Homo sapiens
gtacctgaaaagtaacttggctt

SEQ ID NO: 5040452 - DNA, 17 bp, Homo sapiens
gtacgtttgtatgtgtg

SEQ ID NO: 5040453 - DNA, 13 bp, Homo sapiens
gtagattctgtgg

SEQ ID NO: 5040454 - DNA, 22 bp, Homo sapiens
gtagcctggatattattcttgt

SEQ ID NO: 5040455 - DNA, 16 bp, Homo sapiens
gtatatacgcatctat

SEQ ID NO: 5040456 - DNA, 13 bp, Homo sapiens
gtatatattccca

SEQ ID NO: 5040457 - DNA, 20 bp, Homo sapiens
gtatctatatatgtgtatgt

SEQ ID NO: 5040458 - DNA, 13 bp, Homo sapiens
gtatttgcagttc

SEQ ID NO: 5040459 - DNA, 21 bp, Homo sapiens
gtattttgtgttcctctttgc

SEQ ID NO: 5040460 - DNA, 21 bp, Homo sapiens
gtcagaaaccattgttcagaa

SEQ ID NO: 5040461 - DNA, 22 bp, Homo sapiens
gtccctatgtatttgcagttca

SEQ ID NO: 5040462 - DNA, 14 bp, Homo sapiens
gtcctttagtacct

SEQ ID NO: 5040463 - DNA, 16 bp, Homo sapiens
gtcctttatgtggaaa

SEQ ID NO: 5040464 - DNA, 20 bp, Homo sapiens
gtcctttatgtggaaaacag

SEQ ID NO: 5040465 - DNA, 22 bp, Homo sapiens
gtcctttatgtggaaaacagaa

SEQ ID NO: 5040466 - DNA, 15 bp, Homo sapiens
gtgattgacaactga

SEQ ID NO: 5040467 - DNA, 20 bp, Homo sapiens
gtggaaggcatcagtcccta

SEQ ID NO: 5040468 - DNA, 16 bp, Homo sapiens
gtgttcctctttgcat

SEQ ID NO: 5040469 - DNA, 15 bp, Homo sapiens
gtgttgccaggcagg

SEQ ID NO: 5040470 - DNA, 21 bp, Homo sapiens
gtgtttgggtcacccctccag

SEQ ID NO: 5040471 - DNA, 21 bp, Homo sapiens
gttaaaaattaaaagaaggaa

SEQ ID NO: 5040472 - DNA, 12 bp, Homo sapiens
gttaacagattt

SEQ ID NO: 5040473 - DNA, 12 bp, Homo sapiens
gttatttagact

SEQ ID NO: 5040474 - DNA, 23 bp, Homo sapiens
gttccactggagaattgaaaagg

SEQ ID NO: 5040475 - DNA, 22 bp, Homo sapiens
gttcttaggcaccatagaagaa

SEQ ID NO: 5040476 - DNA, 16 bp, Homo sapiens
gttgacagttctgaag

SEQ ID NO: 5040477 - DNA, 22 bp, Homo sapiens
gttgccgtgagccaagatcacg

SEQ ID NO: 5040478 - DNA, 14 bp, Homo sapiens
gttgtgttgtcacc

SEQ ID NO: 5040479 - DNA, 17 bp, Homo sapiens
gtttgaaggaaacagtt

SEQ ID NO: 5040480 - DNA, 23 bp, Homo sapiens
gtttgatatgggctttctctttg

SEQ ID NO: 5040481 - DNA, 16 bp, Homo sapiens
gtttgcagaggagcaa

SEQ ID NO: 5040482 - DNA, 21 bp, Homo sapiens
gtttgtgtgttgtcttgaaag

SEQ ID NO: 5040483 - DNA, 20 bp, Homo sapiens
gttttattcctgtatgttgt

SEQ ID NO: 5040484 - DNA, 19 bp, Homo sapiens
taaaaggcaaatgtgtaca

SEQ ID NO: 5040485 - DNA, 18 bp, Homo sapiens
taaatagagtttgctatt

SEQ ID NO: 5040486 - DNA, 16 bp, Homo sapiens
taaatgtcttttcaaa

SEQ ID NO: 5040487 - DNA, 23 bp, Homo sapiens
taaattgtccgtgttcatacatt

SEQ ID NO: 5040488 - DNA, 14 bp, Homo sapiens
taactgtgcagaga

SEQ ID NO: 5040489 - DNA, 19 bp, Homo sapiens
taaggtttcgtttctgtat

SEQ ID NO: 5040490 - DNA, 20 bp, Homo sapiens
taagtgtgcacagatacaca

SEQ ID NO: 5040491 - DNA, 18 bp, Homo sapiens
taataaaaataaaagaga

SEQ ID NO: 5040492 - DNA, 22 bp, Homo sapiens
taataccattttttaaggaaac

SEQ ID NO: 5040493 - DNA, 18 bp, Homo sapiens
taatcccggtttcagaag

SEQ ID NO: 5040494 - DNA, 19 bp, Homo sapiens
taatcccggtttcagaagc

SEQ ID NO: 5040495 - DNA, 13 bp, Homo sapiens
taatgctactgtc

SEQ ID NO: 5040496 - DNA, 13 bp, Homo sapiens
tacaagattagaa

SEQ ID NO: 5040497 - DNA, 22 bp, Homo sapiens
tacataagcggcgtaagtttaa

SEQ ID NO: 5040498 - DNA, 19 bp, Homo sapiens
tacatggcagagtttgtgt

SEQ ID NO: 5040499 - DNA, 22 bp, Homo sapiens
tacatggcagagtttgtgtgtt

SEQ ID NO: 5040500 - DNA, 22 bp, Homo sapiens
tacatttcttagactacattta

SEQ ID NO: 5040501 - DNA, 20 bp, Homo sapiens
taccattttttaaggaaaca

SEQ ID NO: 5040502 - DNA, 12 bp, Homo sapiens
tacctttctgag

SEQ ID NO: 5040503 - DNA, 20 bp, Homo sapiens
tacctttctgagtctcttgg

SEQ ID NO: 5040504 - DNA, 13 bp, Homo sapiens
tacgtttgtatgt

SEQ ID NO: 5040505 - DNA, 14 bp, Homo sapiens
tactcaatggattt

SEQ ID NO: 5040506 - DNA, 17 bp, Homo sapiens
tactctatgtgatttat

SEQ ID NO: 5040507 - DNA, 18 bp, Homo sapiens
tactgattcactgcatgg

SEQ ID NO: 5040508 - DNA, 15 bp, Homo sapiens
tactttttgtaaaaa

SEQ ID NO: 5040509 - DNA, 19 bp, Homo sapiens
tagacaaatatttggaggg

SEQ ID NO: 5040510 - DNA, 17 bp, Homo sapiens
tagagtttgctattaga

SEQ ID NO: 5040511 - DNA, 14 bp, Homo sapiens
tagctcaagcctat

SEQ ID NO: 5040512 - DNA, 17 bp, Homo sapiens
tagctgtctagagtagc

SEQ ID NO: 5040513 - DNA, 21 bp, Homo sapiens
taggagactttaatcccggtt

SEQ ID NO: 5040514 - DNA, 15 bp, Homo sapiens
tagtactgctcttgt

SEQ ID NO: 5040515 - DNA, 14 bp, Homo sapiens
tagtggagagaact

SEQ ID NO: 5040516 - DNA, 20 bp, Homo sapiens
tataaccacaaagcacagtt

SEQ ID NO: 5040517 - DNA, 16 bp, Homo sapiens
tatacagtaactttat

SEQ ID NO: 5040518 - DNA, 22 bp, Homo sapiens
tatacagtaactttatgtgtaa

SEQ ID NO: 5040519 - DNA, 14 bp, Homo sapiens
tatatacagtaact

SEQ ID NO: 5040520 - DNA, 17 bp, Homo sapiens
tatatacagtaacttta

SEQ ID NO: 5040521 - DNA, 16 bp, Homo sapiens
tatatatgtgtatgta

SEQ ID NO: 5040522 - DNA, 18 bp, Homo sapiens
tatattcccaatagcaac

SEQ ID NO: 5040523 - DNA, 14 bp, Homo sapiens
tatcagcttcagaa

SEQ ID NO: 5040524 - DNA, 17 bp, Homo sapiens
tatcccttctcagaaaa

SEQ ID NO: 5040525 - DNA, 15 bp, Homo sapiens
tatctatatatgtgt

SEQ ID NO: 5040526 - DNA, 22 bp, Homo sapiens
tatgatgatacaagattagaag

SEQ ID NO: 5040527 - DNA, 16 bp, Homo sapiens
tatgtacgtttgtatg

SEQ ID NO: 5040528 - DNA, 19 bp, Homo sapiens
tatgtacgtttgtatgtgt

SEQ ID NO: 5040529 - DNA, 21 bp, Homo sapiens
tatgtacgtttgtatgtgtgt

SEQ ID NO: 5040530 - DNA, 22 bp, Homo sapiens
tatgtacgtttgtatgtgtgta

SEQ ID NO: 5040531 - DNA, 21 bp, Homo sapiens
tatgtagcaggaaataaagta

SEQ ID NO: 5040532 - DNA, 14 bp, Homo sapiens
tatgtgtaaataca

SEQ ID NO: 5040533 - DNA, 13 bp, Homo sapiens
tatgtgtatgtac

SEQ ID NO: 5040534 - DNA, 21 bp, Homo sapiens
tatgttgtccaattgttgaca

SEQ ID NO: 5040535 - DNA, 21 bp, Homo sapiens
tattagtactgctcttgtttc

SEQ ID NO: 5040536 - DNA, 19 bp, Homo sapiens
tattctgtagattctgtgg

SEQ ID NO: 5040537 - DNA, 19 bp, Homo sapiens
tattgacttcaatgatagt

SEQ ID NO: 5040538 - DNA, 22 bp, Homo sapiens
tattttaaagcttggtgctaaa

SEQ ID NO: 5040539 - DNA, 16 bp, Homo sapiens
tattttttatatatac

SEQ ID NO: 5040540 - DNA, 14 bp, Homo sapiens
tcaaaagaaagaga

SEQ ID NO: 5040541 - DNA, 20 bp, Homo sapiens
tcagaaaacttctcttctga

SEQ ID NO: 5040542 - DNA, 12 bp, Homo sapiens
tcagacctgggt

SEQ ID NO: 5040543 - DNA, 23 bp, Homo sapiens
tcagcaaggtgagagaggtaccc

SEQ ID NO: 5040544 - DNA, 23 bp, Homo sapiens
tcagccaccatcctattgcaaag

SEQ ID NO: 5040545 - DNA, 21 bp, Homo sapiens
tcaggtatgttgcctttatgg

SEQ ID NO: 5040546 - DNA, 18 bp, Homo sapiens
tcagtccctatgtatttg

SEQ ID NO: 5040547 - DNA, 16 bp, Homo sapiens
tcatcagccaccatcc

SEQ ID NO: 5040548 - DNA, 18 bp, Homo sapiens
tcatcagccaccatccta

SEQ ID NO: 5040549 - DNA, 18 bp, Homo sapiens
tcattgagagttttgtct

SEQ ID NO: 5040550 - DNA, 13 bp, Homo sapiens
tccaactccagga

SEQ ID NO: 5040551 - DNA, 16 bp, Homo sapiens
tccaattgttgacagt

SEQ ID NO: 5040552 - DNA, 22 bp, Homo sapiens
tccacaggggctatcccttctc

SEQ ID NO: 5040553 - DNA, 12 bp, Homo sapiens
tccactggagaa

SEQ ID NO: 5040554 - DNA, 23 bp, Homo sapiens
tccaggggtcaccttgagaggca

SEQ ID NO: 5040555 - DNA, 13 bp, Homo sapiens
tcctgtatgttgt

SEQ ID NO: 5040556 - DNA, 17 bp, Homo sapiens
tcctttccaaggcttct

SEQ ID NO: 5040557 - DNA, 20 bp, Homo sapiens
tcctttgtgtttctattgac

SEQ ID NO: 5040558 - DNA, 14 bp, Homo sapiens
tcgaaaagagcact

SEQ ID NO: 5040559 - DNA, 12 bp, Homo sapiens
tcgtttctgtat

SEQ ID NO: 5040560 - DNA, 22 bp, Homo sapiens
tctactaaaaacacaaaaatta

SEQ ID NO: 5040561 - DNA, 14 bp, Homo sapiens
tctatatatgtgta

SEQ ID NO: 5040562 - DNA, 12 bp, Homo sapiens
tctatgctctcg

SEQ ID NO: 5040563 - DNA, 15 bp, Homo sapiens
tctcactctgctttg

SEQ ID NO: 5040564 - DNA, 23 bp, Homo sapiens
tctcagaaaacttctcttctgag

SEQ ID NO: 5040565 - DNA, 21 bp, Homo sapiens
tctccagaaccagtgtctgaa

SEQ ID NO: 5040566 - DNA, 18 bp, Homo sapiens
tctcttcttttggcttcc

SEQ ID NO: 5040567 - DNA, 19 bp, Homo sapiens
tctgtagattctgtggaac

SEQ ID NO: 5040568 - DNA, 15 bp, Homo sapiens
tctgtatacaaccct

SEQ ID NO: 5040569 - DNA, 14 bp, Homo sapiens
tctgtgagttctgt

SEQ ID NO: 5040570 - DNA, 13 bp, Homo sapiens
tcttaggggcttg

SEQ ID NO: 5040571 - DNA, 21 bp, Homo sapiens
tcttagtttggattcttatgt

SEQ ID NO: 5040572 - DNA, 12 bp, Homo sapiens
tcttctgagcct

SEQ ID NO: 5040573 - DNA, 16 bp, Homo sapiens
tcttcttttggcttcc

SEQ ID NO: 5040574 - DNA, 18 bp, Homo sapiens
tcttcttttggcttccat

SEQ ID NO: 5040575 - DNA, 23 bp, Homo sapiens
tcttgaaagattcaggtatgttg

SEQ ID NO: 5040576 - DNA, 16 bp, Homo sapiens
tcttgagccctcctgg

SEQ ID NO: 5040577 - DNA, 17 bp, Homo sapiens
tctttaacagctttctc

SEQ ID NO: 5040578 - DNA, 18 bp, Homo sapiens
tctttctgagcacacttt

SEQ ID NO: 5040579 - DNA, 21 bp, Homo sapiens
tctttctgagcacactttagt

SEQ ID NO: 5040580 - DNA, 22 bp, Homo sapiens
tcttttcacatagctgtctaga

SEQ ID NO: 5040581 - DNA, 13 bp, Homo sapiens
tcttttggcttcc

SEQ ID NO: 5040582 - DNA, 19 bp, Homo sapiens
tgaaaaattcctttgtgtt

SEQ ID NO: 5040583 - DNA, 16 bp, Homo sapiens
tgaaaaggactcttga

SEQ ID NO: 5040584 - DNA, 19 bp, Homo sapiens
tgaaaaggactcttgagcc

SEQ ID NO: 5040585 - DNA, 21 bp, Homo sapiens
tgaaaatattttttatatata

SEQ ID NO: 5040586 - DNA, 21 bp, Homo sapiens
tgaaagattcaggtatgttgc

SEQ ID NO: 5040587 - DNA, 20 bp, Homo sapiens
tgaacagaaaacattctgat

SEQ ID NO: 5040588 - DNA, 14 bp, Homo sapiens
tgacaactgaagag

SEQ ID NO: 5040589 - DNA, 17 bp, Homo sapiens
tgacaactgaagagaca

SEQ ID NO: 5040590 - DNA, 18 bp, Homo sapiens
tgacaactgaagagacac

SEQ ID NO: 5040591 - DNA, 16 bp, Homo sapiens
tgacagttctgaagaa

SEQ ID NO: 5040592 - DNA, 23 bp, Homo sapiens
tgacttcaatgatagtaagaaaa

SEQ ID NO: 5040593 - DNA, 15 bp, Homo sapiens
tgagaggcatgacag

SEQ ID NO: 5040594 - DNA, 18 bp, Homo sapiens
tgagaggcatgacagctg

SEQ ID NO: 5040595 - DNA, 18 bp, Homo sapiens
tgagagttttgtcttgaa

SEQ ID NO: 5040596 - DNA, 13 bp, Homo sapiens
tgagcacacttta

SEQ ID NO: 5040597 - DNA, 14 bp, Homo sapiens
tgaggaggaagcag

SEQ ID NO: 5040598 - DNA, 15 bp, Homo sapiens
tgaggaggaagcaga

SEQ ID NO: 5040599 - DNA, 14 bp, Homo sapiens
tgaggttcagcaag

SEQ ID NO: 5040600 - DNA, 13 bp, Homo sapiens
tgatcagcagaga

SEQ ID NO: 5040601 - DNA, 18 bp, Homo sapiens
tgatccttatgatgtcca

SEQ ID NO: 5040602 - DNA, 19 bp, Homo sapiens
tgcaatcctgtctttctga

SEQ ID NO: 5040603 - DNA, 21 bp, Homo sapiens
tgcacttaaggcactctgtta

SEQ ID NO: 5040604 - DNA, 22 bp, Homo sapiens
tgcagctggtctgtttccaggt

SEQ ID NO: 5040605 - DNA, 16 bp, Homo sapiens
tgcatgatctgtcaaa

SEQ ID NO: 5040606 - DNA, 19 bp, Homo sapiens
tgcatttttatctgtgagt

SEQ ID NO: 5040607 - DNA, 11 bp, Homo sapiens
tgccaggcagg

SEQ ID NO: 5040608 - DNA, 15 bp, Homo sapiens
tgccatactttgtct

SEQ ID NO: 5040609 - DNA, 14 bp, Homo sapiens
tgccatatttttga

SEQ ID NO: 5040610 - DNA, 16 bp, Homo sapiens
tgcctgtacaagctga

SEQ ID NO: 5040611 - DNA, 12 bp, Homo sapiens
tgctcctcaggg

SEQ ID NO: 5040612 - DNA, 13 bp, Homo sapiens
tgctcctcagggt

SEQ ID NO: 5040613 - DNA, 23 bp, Homo sapiens
tgctcttctgtggaccactgcat

SEQ ID NO: 5040614 - DNA, 22 bp, Homo sapiens
tggaactctcctgctcctcagg

SEQ ID NO: 5040615 - DNA, 20 bp, Homo sapiens
tggaccactgcatgagcttt

SEQ ID NO: 5040616 - DNA, 13 bp, Homo sapiens
tggactaagaaga

SEQ ID NO: 5040617 - DNA, 22 bp, Homo sapiens
tggagagaactgattgtgagct

SEQ ID NO: 5040618 - DNA, 21 bp, Homo sapiens
tggaggttgccgtgagccaag

SEQ ID NO: 5040619 - DNA, 15 bp, Homo sapiens
tggagttcccgtgca

SEQ ID NO: 5040620 - DNA, 22 bp, Homo sapiens
tggatagaaaattatgcagctt

SEQ ID NO: 5040621 - DNA, 18 bp, Homo sapiens
tggcattatgtccactgt

SEQ ID NO: 5040622 - DNA, 13 bp, Homo sapiens
tggctattaaaaa

SEQ ID NO: 5040623 - DNA, 17 bp, Homo sapiens
tggctttcattattagt

SEQ ID NO: 5040624 - DNA, 22 bp, Homo sapiens
tgggcagatcatttgaggccag

SEQ ID NO: 5040625 - DNA, 14 bp, Homo sapiens
tggggttgtgttgt

SEQ ID NO: 5040626 - DNA, 21 bp, Homo sapiens
tggttgttagttatagatgtc

SEQ ID NO: 5040627 - DNA, 13 bp, Homo sapiens
tgtaaatacataa

SEQ ID NO: 5040628 - DNA, 16 bp, Homo sapiens
tgtaactgggttcaaa

SEQ ID NO: 5040629 - DNA, 19 bp, Homo sapiens
tgtacatggcagagtttgt

SEQ ID NO: 5040630 - DNA, 23 bp, Homo sapiens
tgtagcctggatattattcttgt

SEQ ID NO: 5040631 - DNA, 16 bp, Homo sapiens
tgtagttttacttggt

SEQ ID NO: 5040632 - DNA, 23 bp, Homo sapiens
tgtccaattgttgacagttctga

SEQ ID NO: 5040633 - DNA, 22 bp, Homo sapiens
tgtctgaaaaattcctttgtgt

SEQ ID NO: 5040634 - DNA, 12 bp, Homo sapiens
tgtctttctgag

SEQ ID NO: 5040635 - DNA, 13 bp, Homo sapiens
tgtcttttgaata

SEQ ID NO: 5040636 - DNA, 18 bp, Homo sapiens
tgtgtgttgtcttgaaag

SEQ ID NO: 5040637 - DNA, 11 bp, Homo sapiens
tgttcagaaga

SEQ ID NO: 5040638 - DNA, 12 bp, Homo sapiens
tgttcatacatt

SEQ ID NO: 5040639 - DNA, 19 bp, Homo sapiens
tgttccttagaccttccat

SEQ ID NO: 5040640 - DNA, 17 bp, Homo sapiens
tgtttccaggtcagaaa

SEQ ID NO: 5040641 - DNA, 15 bp, Homo sapiens
tgttttattcctgta

SEQ ID NO: 5040642 - DNA, 17 bp, Homo sapiens
ttaaaggatgttggtgt

SEQ ID NO: 5040643 - DNA, 14 bp, Homo sapiens
ttaaggaaacaata

SEQ ID NO: 5040644 - DNA, 17 bp, Homo sapiens
ttaccagaagcttccat

SEQ ID NO: 5040645 - DNA, 16 bp, Homo sapiens
ttaccctttagactgt

SEQ ID NO: 5040646 - DNA, 12 bp, Homo sapiens
ttacctctttaa

SEQ ID NO: 5040647 - DNA, 18 bp, Homo sapiens
ttagactacatttagaga

SEQ ID NO: 5040648 - DNA, 19 bp, Homo sapiens
ttagactcatcttactgta

SEQ ID NO: 5040649 - DNA, 14 bp, Homo sapiens
ttagactgtagcct

SEQ ID NO: 5040650 - DNA, 23 bp, Homo sapiens
ttagctgatgaacttattctgta

SEQ ID NO: 5040651 - DNA, 15 bp, Homo sapiens
ttatatatacagtaa

SEQ ID NO: 5040652 - DNA, 20 bp, Homo sapiens
ttatattttaaagcttggtg

SEQ ID NO: 5040653 - DNA, 15 bp, Homo sapiens
ttattcctgtatgtt

SEQ ID NO: 5040654 - DNA, 17 bp, Homo sapiens
ttatttagactcatctt

SEQ ID NO: 5040655 - DNA, 18 bp, Homo sapiens
ttatttagactcatctta

SEQ ID NO: 5040656 - DNA, 16 bp, Homo sapiens
ttcaatgatagtaaga

SEQ ID NO: 5040657 - DNA, 13 bp, Homo sapiens
ttcacacagacaa

SEQ ID NO: 5040658 - DNA, 18 bp, Homo sapiens
ttcacatagctgtctaga

SEQ ID NO: 5040659 - DNA, 20 bp, Homo sapiens
ttcactgcatggctcccaca

SEQ ID NO: 5040660 - DNA, 16 bp, Homo sapiens
ttcaggtatgttgcct

SEQ ID NO: 5040661 - DNA, 17 bp, Homo sapiens
ttcattgagagttttgt

SEQ ID NO: 5040662 - DNA, 20 bp, Homo sapiens
ttcccaatagcaacgtagct

SEQ ID NO: 5040663 - DNA, 16 bp, Homo sapiens
ttcgtttctgtataca

SEQ ID NO: 5040664 - DNA, 17 bp, Homo sapiens
ttctattgacttcaatg

SEQ ID NO: 5040665 - DNA, 23 bp, Homo sapiens
ttctattgacttcaatgatagta

SEQ ID NO: 5040666 - DNA, 20 bp, Homo sapiens
ttcttaggcaccatagaaga

SEQ ID NO: 5040667 - DNA, 14 bp, Homo sapiens
ttcttttggcttcc

SEQ ID NO: 5040668 - DNA, 15 bp, Homo sapiens
ttgaaagattcaggt

SEQ ID NO: 5040669 - DNA, 11 bp, Homo sapiens
ttgaaggaaac

SEQ ID NO: 5040670 - DNA, 18 bp, Homo sapiens
ttgaaggaaccaagtgca

SEQ ID NO: 5040671 - DNA, 16 bp, Homo sapiens
ttgaatgtcttttgaa

SEQ ID NO: 5040672 - DNA, 17 bp, Homo sapiens
ttgaatgtcttttgaat

SEQ ID NO: 5040673 - DNA, 18 bp, Homo sapiens
ttgagagttttgtcttga

SEQ ID NO: 5040674 - DNA, 12 bp, Homo sapiens
ttgaggaggaag

SEQ ID NO: 5040675 - DNA, 17 bp, Homo sapiens
ttgcacgttaaaaatta

SEQ ID NO: 5040676 - DNA, 13 bp, Homo sapiens
ttgcagttcacct

SEQ ID NO: 5040677 - DNA, 22 bp, Homo sapiens
ttgccatactttgtctgaaaaa

SEQ ID NO: 5040678 - DNA, 19 bp, Homo sapiens
ttgtccaattgttgacagt

SEQ ID NO: 5040679 - DNA, 15 bp, Homo sapiens
ttgtcttgaatgtct

SEQ ID NO: 5040680 - DNA, 18 bp, Homo sapiens
ttgttgacagttctgaag

SEQ ID NO: 5040681 - DNA, 23 bp, Homo sapiens
ttgttgtttgccatactttgtct

SEQ ID NO: 5040682 - DNA, 16 bp, Homo sapiens
ttgtttgccatacttt

SEQ ID NO: 5040683 - DNA, 15 bp, Homo sapiens
tttaacagctttctc

SEQ ID NO: 5040684 - DNA, 21 bp, Homo sapiens
tttaatcccggtttcagaagc

SEQ ID NO: 5040685 - DNA, 19 bp, Homo sapiens
tttaccttgaacaatcaag

SEQ ID NO: 5040686 - DNA, 23 bp, Homo sapiens
tttagctgatgaacttattctgt

SEQ ID NO: 5040687 - DNA, 21 bp, Homo sapiens
tttatggtttcccccttctac

SEQ ID NO: 5040688 - DNA, 23 bp, Homo sapiens
tttctccagaaccagtgtctgaa

SEQ ID NO: 5040689 - DNA, 20 bp, Homo sapiens
tttgaaggaaacagttaata

SEQ ID NO: 5040690 - DNA, 22 bp, Homo sapiens
tttgatatgggctttctctttg

SEQ ID NO: 5040691 - DNA, 20 bp, Homo sapiens
tttgcactggagttctatgc

SEQ ID NO: 5040692 - DNA, 18 bp, Homo sapiens
tttggattcttatgtagc

SEQ ID NO: 5040693 - DNA, 21 bp, Homo sapiens
tttgtgttcctctttgcatga

SEQ ID NO: 5040694 - DNA, 14 bp, Homo sapiens
tttttatatataca

SEQ ID NO: 5040695 - DNA, 18 bp, Homo sapiens
aaatccacaccagtccac

SEQ ID NO: 5040696 - DNA, 15 bp, Homo sapiens
aacaggagtgactct

SEQ ID NO: 5040697 - DNA, 20 bp, Homo sapiens
aacaggagtgactctggctg

SEQ ID NO: 5040698 - DNA, 16 bp, Homo sapiens
aacgctgacttgcaga

SEQ ID NO: 5040699 - DNA, 21 bp, Homo sapiens
aagaaccaggaggcctgggag

SEQ ID NO: 5040700 - DNA, 17 bp, Homo sapiens
aagacaccttcccagct

SEQ ID NO: 5040701 - DNA, 15 bp, Homo sapiens
aagccaggccctctc

SEQ ID NO: 5040702 - DNA, 19 bp, Homo sapiens
aagccaggccctctctgca

SEQ ID NO: 5040703 - DNA, 13 bp, Homo sapiens
acacaggctgccg

SEQ ID NO: 5040704 - DNA, 14 bp, Homo sapiens
accacgtctccctg

SEQ ID NO: 5040705 - DNA, 17 bp, Homo sapiens
accagtccacgccgggt

SEQ ID NO: 5040706 - DNA, 19 bp, Homo sapiens
accccaccctgtctgcagg

SEQ ID NO: 5040707 - DNA, 20 bp, Homo sapiens
accccaccctgtctgcaggc

SEQ ID NO: 5040708 - DNA, 17 bp, Homo sapiens
acccccacctccctgca

SEQ ID NO: 5040709 - DNA, 18 bp, Homo sapiens
acccccacctccctgcag

SEQ ID NO: 5040710 - DNA, 19 bp, Homo sapiens
acccccacctccctgcagc

SEQ ID NO: 5040711 - DNA, 19 bp, Homo sapiens
acccctgaactggccccag

SEQ ID NO: 5040712 - DNA, 23 bp, Homo sapiens
acccctgaactggccccagctcc

SEQ ID NO: 5040713 - DNA, 12 bp, Homo sapiens
accctcccaggt

SEQ ID NO: 5040714 - DNA, 23 bp, Homo sapiens
accctgtctgcaggccaccccca

SEQ ID NO: 5040715 - DNA, 13 bp, Homo sapiens
accgggcttcctc

SEQ ID NO: 5040716 - DNA, 18 bp, Homo sapiens
accgggtggcagcgccca

SEQ ID NO: 5040717 - DNA, 20 bp, Homo sapiens
accgggtggcagcgcccagc

SEQ ID NO: 5040718 - DNA, 15 bp, Homo sapiens
acctgccccaggctc

SEQ ID NO: 5040719 - DNA, 16 bp, Homo sapiens
acctgccccaggctca

SEQ ID NO: 5040720 - DNA, 12 bp, Homo sapiens
accttcccagct

SEQ ID NO: 5040721 - DNA, 17 bp, Homo sapiens
accttcccagctgctcc

SEQ ID NO: 5040722 - DNA, 19 bp, Homo sapiens
acgtcctgggtgctgtcat

SEQ ID NO: 5040723 - DNA, 16 bp, Homo sapiens
acgtggccgctgccca

SEQ ID NO: 5040724 - DNA, 17 bp, Homo sapiens
acgtggccgctgcccac

SEQ ID NO: 5040725 - DNA, 14 bp, Homo sapiens
actcagtcagccca

SEQ ID NO: 5040726 - DNA, 14 bp, Homo sapiens
actctgaccgggct

SEQ ID NO: 5040727 - DNA, 14 bp, Homo sapiens
acttcccaggccga

SEQ ID NO: 5040728 - DNA, 16 bp, Homo sapiens
agaaggccccagggca

SEQ ID NO: 5040729 - DNA, 21 bp, Homo sapiens
agaccccaccctgtctgcagg

SEQ ID NO: 5040730 - DNA, 12 bp, Homo sapiens
agaccctgccag

SEQ ID NO: 5040731 - DNA, 14 bp, Homo sapiens
agaccctgccaggg

SEQ ID NO: 5040732 - DNA, 11 bp, Homo sapiens
agagcctgggc

SEQ ID NO: 5040733 - DNA, 19 bp, Homo sapiens
agaggggacaagccaggcc

SEQ ID NO: 5040734 - DNA, 15 bp, Homo sapiens
agcaggagcatggcc

SEQ ID NO: 5040735 - DNA, 19 bp, Homo sapiens
agcagggctgggcgcctct

SEQ ID NO: 5040736 - DNA, 21 bp, Homo sapiens
agccaggccctctctgcagtc

SEQ ID NO: 5040737 - DNA, 17 bp, Homo sapiens
atggggcggcctgcaga

SEQ ID NO: 5040738 - DNA, 18 bp, Homo sapiens
atggggtgggagccacag

SEQ ID NO: 5040739 - DNA, 14 bp, Homo sapiens
caaaccaggctgca

SEQ ID NO: 5040740 - DNA, 16 bp, Homo sapiens
caaaccaggctgcagg

SEQ ID NO: 5040741 - DNA, 16 bp, Homo sapiens
caacttcccaggccga

SEQ ID NO: 5040742 - DNA, 21 bp, Homo sapiens
cacagccccaaacaagcgcca

SEQ ID NO: 5040743 - DNA, 14 bp, Homo sapiens
cacaggctgccgct

SEQ ID NO: 5040744 - DNA, 17 bp, Homo sapiens
cacagggacgacccggg

SEQ ID NO: 5040745 - DNA, 18 bp, Homo sapiens
caccagtccacgccgggt

SEQ ID NO: 5040746 - DNA, 19 bp, Homo sapiens
caccagtccacgccgggtc

SEQ ID NO: 5040747 - DNA, 16 bp, Homo sapiens
caccctgtctgcaggc

SEQ ID NO: 5040748 - DNA, 13 bp, Homo sapiens
cacctccctgcag

SEQ ID NO: 5040749 - DNA, 12 bp, Homo sapiens
cacctgccaggc

SEQ ID NO: 5040750 - DNA, 15 bp, Homo sapiens
cacctgccaggctgc

SEQ ID NO: 5040751 - DNA, 13 bp, Homo sapiens
cacctgccccagg

SEQ ID NO: 5040752 - DNA, 14 bp, Homo sapiens
cacctgccccaggc

SEQ ID NO: 5040753 - DNA, 22 bp, Homo sapiens
cacctgccccaggctcaggctg

SEQ ID NO: 5040754 - DNA, 16 bp, Homo sapiens
cacgtcccgggcactg

SEQ ID NO: 5040755 - DNA, 16 bp, Homo sapiens
cacgtctccctggccc

SEQ ID NO: 5040756 - DNA, 15 bp, Homo sapiens
cactctgaccgggct

SEQ ID NO: 5040757 - DNA, 18 bp, Homo sapiens
cactgagaaggccccagg

SEQ ID NO: 5040758 - DNA, 21 bp, Homo sapiens
cactgagaaggccccagggca

SEQ ID NO: 5040759 - DNA, 16 bp, Homo sapiens
cactgcccacctgcca

SEQ ID NO: 5040760 - DNA, 19 bp, Homo sapiens
cactgcccacctgccaggc

SEQ ID NO: 5040761 - DNA, 22 bp, Homo sapiens
cactgcccacctgccaggctgc

SEQ ID NO: 5040762 - DNA, 23 bp, Homo sapiens
cactggccggcccacgtcctggg

SEQ ID NO: 5040763 - DNA, 23 bp, Homo sapiens
cacttccctgcaaggtgcacctg

SEQ ID NO: 5040764 - DNA, 13 bp, Homo sapiens
cactttggccaca

SEQ ID NO: 5040765 - DNA, 21 bp, Homo sapiens
cagaccccaccctgtctgcag

SEQ ID NO: 5040766 - DNA, 23 bp, Homo sapiens
cagaccccaccctgtctgcaggc

SEQ ID NO: 5040767 - DNA, 13 bp, Homo sapiens
cagaccctgccag

SEQ ID NO: 5040768 - DNA, 13 bp, Homo sapiens
cagagcctgggcg

SEQ ID NO: 5040769 - DNA, 13 bp, Homo sapiens
cagcctggcccca

SEQ ID NO: 5040770 - DNA, 16 bp, Homo sapiens
cagcgcccagcctggc

SEQ ID NO: 5040771 - DNA, 17 bp, Homo sapiens
cagcggctcttcctgga

SEQ ID NO: 5040772 - DNA, 21 bp, Homo sapiens
cagctccggaaggacacagtc

SEQ ID NO: 5040773 - DNA, 14 bp, Homo sapiens
cagcttggagtgcc

SEQ ID NO: 5040774 - DNA, 17 bp, Homo sapiens
caggacagatcaggtca

SEQ ID NO: 5040775 - DNA, 23 bp, Homo sapiens
caggagcatggccgcaacttccc

SEQ ID NO: 5040776 - DNA, 18 bp, Homo sapiens
caggcggtcactgcccac

SEQ ID NO: 5040777 - DNA, 14 bp, Homo sapiens
caggctcaggctgc

SEQ ID NO: 5040778 - DNA, 18 bp, Homo sapiens
caggctcaggctgcccag

SEQ ID NO: 5040779 - DNA, 19 bp, Homo sapiens
caggctcaggctgcccagc

SEQ ID NO: 5040780 - DNA, 22 bp, Homo sapiens
caggctgccgctgctctcccag

SEQ ID NO: 5040781 - DNA, 21 bp, Homo sapiens
cagggctgggcgcctctgtcc

SEQ ID NO: 5040782 - DNA, 18 bp, Homo sapiens
caggggcccctcctccag

SEQ ID NO: 5040783 - DNA, 16 bp, Homo sapiens
caggtcagagcccagg

SEQ ID NO: 5040784 - DNA, 17 bp, Homo sapiens
caggtgttttccttcac

SEQ ID NO: 5040785 - DNA, 14 bp, Homo sapiens
cagtaaatccacag

SEQ ID NO: 5040786 - DNA, 17 bp, Homo sapiens
cagtaaatccacagtga

SEQ ID NO: 5040787 - DNA, 18 bp, Homo sapiens
cagtcattctagagggat

SEQ ID NO: 5040788 - DNA, 13 bp, Homo sapiens
cagtgagagcagg

SEQ ID NO: 5040789 - DNA, 15 bp, Homo sapiens
cagttgggtgtgaga

SEQ ID NO: 5040790 - DNA, 15 bp, Homo sapiens
catgcccagcttgga

SEQ ID NO: 5040791 - DNA, 17 bp, Homo sapiens
catggccgcaacttccc

SEQ ID NO: 5040792 - DNA, 12 bp, Homo sapiens
catggcttgggc

SEQ ID NO: 5040793 - DNA, 20 bp, Homo sapiens
cattgaagggggatgcaggc

SEQ ID NO: 5040794 - DNA, 16 bp, Homo sapiens
ccaccctgtctgcagg

SEQ ID NO: 5040795 - DNA, 18 bp, Homo sapiens
ccacctgccaggctgcag

SEQ ID NO: 5040796 - DNA, 15 bp, Homo sapiens
ccacgtctccctggc

SEQ ID NO: 5040797 - DNA, 16 bp, Homo sapiens
ccacttccctgcaagg

SEQ ID NO: 5040798 - DNA, 17 bp, Homo sapiens
ccacttccctgcaaggt

SEQ ID NO: 5040799 - DNA, 16 bp, Homo sapiens
ccagagcctgggcgca

SEQ ID NO: 5040800 - DNA, 17 bp, Homo sapiens
ccaggccctctctgcag

SEQ ID NO: 5040801 - DNA, 15 bp, Homo sapiens
ccaggctcaggctgc

SEQ ID NO: 5040802 - DNA, 18 bp, Homo sapiens
ccaggctcaggctgccca

SEQ ID NO: 5040803 - DNA, 13 bp, Homo sapiens
ccaggctgcaggg

SEQ ID NO: 5040804 - DNA, 18 bp, Homo sapiens
ccaggtttcccactgcgg

SEQ ID NO: 5040805 - DNA, 18 bp, Homo sapiens
ccatggccaggagtgggt

SEQ ID NO: 5040806 - DNA, 21 bp, Homo sapiens
ccattgaagggggatgcaggc

SEQ ID NO: 5040807 - DNA, 16 bp, Homo sapiens
cccacctccctgcagc

SEQ ID NO: 5040808 - DNA, 17 bp, Homo sapiens
cccagcggctcttcctg

SEQ ID NO: 5040809 - DNA, 22 bp, Homo sapiens
gtcttagggtacagcccaggcg

SEQ ID NO: 5040810 - DNA, 23 bp, Homo sapiens
gtgacaggcagtgttcttggggg

SEQ ID NO: 5040811 - DNA, 18 bp, Homo sapiens
gtgaccgggggaagctga

SEQ ID NO: 5040812 - DNA, 21 bp, Homo sapiens
gtgaccgggggaagctgagcc

SEQ ID NO: 5040813 - DNA, 13 bp, Homo sapiens
gtgactctggctg

SEQ ID NO: 5040814 - DNA, 16 bp, Homo sapiens
gtgactctggctgcca

SEQ ID NO: 5040815 - DNA, 17 bp, Homo sapiens
gtgactctggctgccaa

SEQ ID NO: 5040816 - DNA, 15 bp, Homo sapiens
gtgagttggggcgac

SEQ ID NO: 5040817 - DNA, 16 bp, Homo sapiens
gtgcacctgccccagg

SEQ ID NO: 5040818 - DNA, 17 bp, Homo sapiens
gtgcacctgccccaggc

SEQ ID NO: 5040819 - DNA, 23 bp, Homo sapiens
gtgggatcttacccacttccctg

SEQ ID NO: 5040820 - DNA, 14 bp, Homo sapiens
gtggggctgcatcc

SEQ ID NO: 5040821 - DNA, 18 bp, Homo sapiens
gtggggttttcacttcct

SEQ ID NO: 5040822 - DNA, 19 bp, Homo sapiens
gtggggttttcacttccta

SEQ ID NO: 5040823 - DNA, 20 bp, Homo sapiens
gtgggtccctgcgtctcctg

SEQ ID NO: 5040824 - DNA, 17 bp, Homo sapiens
gtgggtttccctgcgtc

SEQ ID NO: 5040825 - DNA, 18 bp, Homo sapiens
gtgtcgtaacagcaggag

SEQ ID NO: 5040826 - DNA, 14 bp, Homo sapiens
gtgtgagggcaaac

SEQ ID NO: 5040827 - DNA, 20 bp, Homo sapiens
gtgtgagggcaaaccaggct

SEQ ID NO: 5040828 - DNA, 15 bp, Homo sapiens
gtgttcttgggggtg

SEQ ID NO: 5040829 - DNA, 19 bp, Homo sapiens
gttcacccagcgccctcta

SEQ ID NO: 5040830 - DNA, 18 bp, Homo sapiens
gttggctagtctgtgcct

SEQ ID NO: 5040831 - DNA, 15 bp, Homo sapiens
taaatccacagtgag

SEQ ID NO: 5040832 - DNA, 16 bp, Homo sapiens
tactcagtcagcccag

SEQ ID NO: 5040833 - DNA, 21 bp, Homo sapiens
tactcagtcagcccagtggga

SEQ ID NO: 5040834 - DNA, 19 bp, Homo sapiens
tactttgtcttgatcctca

SEQ ID NO: 5040835 - DNA, 20 bp, Homo sapiens
tagaggggacaagccaggcc

SEQ ID NO: 5040836 - DNA, 18 bp, Homo sapiens
tagggtacagcccaggcg

SEQ ID NO: 5040837 - DNA, 16 bp, Homo sapiens
tagtctgtgcctcagt

SEQ ID NO: 5040838 - DNA, 14 bp, Homo sapiens
tagtgccatggcca

SEQ ID NO: 5040839 - DNA, 15 bp, Homo sapiens
tagtgccatggccag

SEQ ID NO: 5040840 - DNA, 16 bp, Homo sapiens
tagtgccatggccagg

SEQ ID NO: 5040841 - DNA, 17 bp, Homo sapiens
tcaaagaaccaggaggc

SEQ ID NO: 5040842 - DNA, 22 bp, Homo sapiens
tcactgagaaggccccagggca

SEQ ID NO: 5040843 - DNA, 17 bp, Homo sapiens
tcactgcccacctgcca

SEQ ID NO: 5040844 - DNA, 18 bp, Homo sapiens
tcactgcccacctgccag

SEQ ID NO: 5040845 - DNA, 14 bp, Homo sapiens
tcacttcctagggt

SEQ ID NO: 5040846 - DNA, 14 bp, Homo sapiens
tcaggctgcccagc

SEQ ID NO: 5040847 - DNA, 16 bp, Homo sapiens
tcaggtcagagcccag

SEQ ID NO: 5040848 - DNA, 14 bp, Homo sapiens
tcagtcagcccagt

SEQ ID NO: 5040849 - DNA, 13 bp, Homo sapiens
tcagtcagctccg

SEQ ID NO: 5040850 - DNA, 13 bp, Homo sapiens
tcccccatgggct

SEQ ID NO: 5040851 - DNA, 19 bp, Homo sapiens
tcccgagggcgcctgggtc

SEQ ID NO: 5040852 - DNA, 20 bp, Homo sapiens
tccctgcaaggtgcacctgc

SEQ ID NO: 5040853 - DNA, 18 bp, Homo sapiens
tccggaaaaatggggttt

SEQ ID NO: 5040854 - DNA, 22 bp, Homo sapiens
tcctagaggggacaagccaggc

SEQ ID NO: 5040855 - DNA, 20 bp, Homo sapiens
tcctcactgagaaggcccca

SEQ ID NO: 5040856 - DNA, 23 bp, Homo sapiens
tcctcactgagaaggccccaggg

SEQ ID NO: 5040857 - DNA, 18 bp, Homo sapiens
tcctccagagcctgggcg

SEQ ID NO: 5040858 - DNA, 13 bp, Homo sapiens
tcctcggcagctc

SEQ ID NO: 5040859 - DNA, 17 bp, Homo sapiens
tcctcttcctgcctctc

SEQ ID NO: 5040860 - DNA, 19 bp, Homo sapiens
tcctggacagtgagagcag

SEQ ID NO: 5040861 - DNA, 16 bp, Homo sapiens
tcctgggtgctgtcat

SEQ ID NO: 5040862 - DNA, 22 bp, Homo sapiens
tcctgggtgctgtcatgcccag

SEQ ID NO: 5040863 - DNA, 16 bp, Homo sapiens
tccttctgatctgaga

SEQ ID NO: 5040864 - DNA, 21 bp, Homo sapiens
tctccctacttagacccagtc

SEQ ID NO: 5040865 - DNA, 16 bp, Homo sapiens
tctctggacctgacca

SEQ ID NO: 5040866 - DNA, 15 bp, Homo sapiens
tctggacctgaccag

SEQ ID NO: 5040867 - DNA, 13 bp, Homo sapiens
tctgtcccgggta

SEQ ID NO: 5040868 - DNA, 14 bp, Homo sapiens
tctgtgcctcagtg

SEQ ID NO: 5040869 - DNA, 15 bp, Homo sapiens
tctgtggcctggggc

SEQ ID NO: 5040870 - DNA, 15 bp, Homo sapiens
tcttacccacttccc

SEQ ID NO: 5040871 - DNA, 19 bp, Homo sapiens
tcttagggtacagcccagg

SEQ ID NO: 5040872 - DNA, 21 bp, Homo sapiens
tcttagggtacagcccaggcg

SEQ ID NO: 5040873 - DNA, 17 bp, Homo sapiens
tcttcctgcctctctca

SEQ ID NO: 5040874 - DNA, 18 bp, Homo sapiens
tcttcctggacagtgaga

SEQ ID NO: 5040875 - DNA, 23 bp, Homo sapiens
tcttcctggacagtgagagcagg

SEQ ID NO: 5040876 - DNA, 14 bp, Homo sapiens
tcttgagagcccca

SEQ ID NO: 5040877 - DNA, 22 bp, Homo sapiens
tgaccagactgtgggtccctgc

SEQ ID NO: 5040878 - DNA, 23 bp, Homo sapiens
tgacggcagtaaatccacagtga

SEQ ID NO: 5040879 - DNA, 18 bp, Homo sapiens
tgactctggctgccaaga

SEQ ID NO: 5040880 - DNA, 14 bp, Homo sapiens
tgagaaggccccag

SEQ ID NO: 5040881 - DNA, 14 bp, Homo sapiens
tgagagcagggctg

SEQ ID NO: 5040882 - DNA, 19 bp, Homo sapiens
tgagagcagggctgggcgc

SEQ ID NO: 5040883 - DNA, 16 bp, Homo sapiens
tgaggaccctcccagg

SEQ ID NO: 5040884 - DNA, 17 bp, Homo sapiens
tgaggaccctcccaggt

SEQ ID NO: 5040885 - DNA, 19 bp, Homo sapiens
tgaggctggcggggtctgc

SEQ ID NO: 5040886 - DNA, 20 bp, Homo sapiens
tgagggcaaaccaggctgca

SEQ ID NO: 5040887 - DNA, 17 bp, Homo sapiens
tgcaaggtgcacctgcc

SEQ ID NO: 5040888 - DNA, 18 bp, Homo sapiens
tgcaaggtgcacctgccc

SEQ ID NO: 5040889 - DNA, 16 bp, Homo sapiens
tgcagaccctgccagg

SEQ ID NO: 5040890 - DNA, 21 bp, Homo sapiens
tgcaggccacccccacctccc

SEQ ID NO: 5040891 - DNA, 15 bp, Homo sapiens
tgcagggacagttgg

SEQ ID NO: 5040892 - DNA, 20 bp, Homo sapiens
tgcagggacagttgggtgtg

SEQ ID NO: 5040893 - DNA, 23 bp, Homo sapiens
tgcaggtggggttttcacttcct

SEQ ID NO: 5040894 - DNA, 17 bp, Homo sapiens
tgccacatggccgctgc

SEQ ID NO: 5040895 - DNA, 17 bp, Homo sapiens
tgccacgtggccgctgc

SEQ ID NO: 5040896 - DNA, 13 bp, Homo sapiens
tgccaggctgcag

SEQ ID NO: 5040897 - DNA, 15 bp, Homo sapiens
tgccaggctgcaggg

SEQ ID NO: 5040898 - DNA, 19 bp, Homo sapiens
tgcccacgtcccgggcact

SEQ ID NO: 5040899 - DNA, 18 bp, Homo sapiens
ctcggcctcttgagagcc

SEQ ID NO: 5040900 - DNA, 16 bp, Homo sapiens
ctctcatggcttgggc

SEQ ID NO: 5040901 - DNA, 22 bp, Homo sapiens
ctctctggacctgaccagactg

SEQ ID NO: 5040902 - DNA, 20 bp, Homo sapiens
ctctgcagtcctcggcagct

SEQ ID NO: 5040903 - DNA, 17 bp, Homo sapiens
ctctggacctgaccaga

SEQ ID NO: 5040904 - DNA, 15 bp, Homo sapiens
ctgaactggccccag

SEQ ID NO: 5040905 - DNA, 16 bp, Homo sapiens
ctgagaaggccccagg

SEQ ID NO: 5040906 - DNA, 17 bp, Homo sapiens
ctgagaaggccccaggg

SEQ ID NO: 5040907 - DNA, 18 bp, Homo sapiens
ctgagcccctccctcctg

SEQ ID NO: 5040908 - DNA, 23 bp, Homo sapiens
ctgagctactgcttctaacacct

SEQ ID NO: 5040909 - DNA, 19 bp, Homo sapiens
ctgcagctttgaggctggc

SEQ ID NO: 5040910 - DNA, 14 bp, Homo sapiens
ctgcatccaaggct

SEQ ID NO: 5040911 - DNA, 13 bp, Homo sapiens
ctgccaggctgca

SEQ ID NO: 5040912 - DNA, 19 bp, Homo sapiens
ctgccaggctgcagggaca

SEQ ID NO: 5040913 - DNA, 13 bp, Homo sapiens
ctgcccacctgcc

SEQ ID NO: 5040914 - DNA, 15 bp, Homo sapiens
ctgcccacctgccag

SEQ ID NO: 5040915 - DNA, 22 bp, Homo sapiens
ctgcccactctgaccgggcttc

SEQ ID NO: 5040916 - DNA, 21 bp, Homo sapiens
ctgcccagcggctcttcctgg

SEQ ID NO: 5040917 - DNA, 12 bp, Homo sapiens
ctgccccaggct

SEQ ID NO: 5040918 - DNA, 22 bp, Homo sapiens
ctgccccaggctcaggctgccc

SEQ ID NO: 5040919 - DNA, 17 bp, Homo sapiens
ctgcctctctcatggct

SEQ ID NO: 5040920 - DNA, 12 bp, Homo sapiens
ctgctcctggga

SEQ ID NO: 5040921 - DNA, 13 bp, Homo sapiens
ctgctctcccagg

SEQ ID NO: 5040922 - DNA, 18 bp, Homo sapiens
ctggacagtgagagcagg

SEQ ID NO: 5040923 - DNA, 21 bp, Homo sapiens
ctggaccacgtctccctggcc

SEQ ID NO: 5040924 - DNA, 15 bp, Homo sapiens
ctggacctgaccaga

SEQ ID NO: 5040925 - DNA, 23 bp, Homo sapiens
ctggccccagctcctcttcctgc

SEQ ID NO: 5040926 - DNA, 14 bp, Homo sapiens
ctggccccagtgac

SEQ ID NO: 5040927 - DNA, 17 bp, Homo sapiens
ctggcccgggagccgca

SEQ ID NO: 5040928 - DNA, 23 bp, Homo sapiens
ctggccggcccacgtcctgggtg

SEQ ID NO: 5040929 - DNA, 20 bp, Homo sapiens
ctggcggggtctgctcctgg

SEQ ID NO: 5040930 - DNA, 23 bp, Homo sapiens
ctggctttgggtagtgccatggc

SEQ ID NO: 5040931 - DNA, 15 bp, Homo sapiens
ctgggagatgcagct

SEQ ID NO: 5040932 - DNA, 19 bp, Homo sapiens
ctgggagatgcagctggat

SEQ ID NO: 5040933 - DNA, 18 bp, Homo sapiens
ctgggcgcctctgtcctg

SEQ ID NO: 5040934 - DNA, 16 bp, Homo sapiens
ctgggtcctcccagct

SEQ ID NO: 5040935 - DNA, 17 bp, Homo sapiens
ctgggtcctcccagctg

SEQ ID NO: 5040936 - DNA, 19 bp, Homo sapiens
ctggtcccccatgggctgc

SEQ ID NO: 5040937 - DNA, 16 bp, Homo sapiens
ctgtcatgcccagctt

SEQ ID NO: 5040938 - DNA, 13 bp, Homo sapiens
ctgtcctggcccg

SEQ ID NO: 5040939 - DNA, 23 bp, Homo sapiens
ctgtcctggcccgggagccgcag

SEQ ID NO: 5040940 - DNA, 14 bp, Homo sapiens
ctgtctgcaggcca

SEQ ID NO: 5040941 - DNA, 23 bp, Homo sapiens
ctgtgggtccctgcgtctcctgc

SEQ ID NO: 5040942 - DNA, 22 bp, Homo sapiens
cttacccacttccctgcaaggt

SEQ ID NO: 5040943 - DNA, 18 bp, Homo sapiens
cttagggtacagcccagg

SEQ ID NO: 5040944 - DNA, 17 bp, Homo sapiens
cttcaccgccgtggggt

SEQ ID NO: 5040945 - DNA, 14 bp, Homo sapiens
cttctaacacctct

SEQ ID NO: 5040946 - DNA, 19 bp, Homo sapiens
cttcttgggggcagaccag

SEQ ID NO: 5040947 - DNA, 16 bp, Homo sapiens
cttgggggcagaccag

SEQ ID NO: 5040948 - DNA, 21 bp, Homo sapiens
ctttgataattactttccagc

SEQ ID NO: 5040949 - DNA, 21 bp, Homo sapiens
ctttgggtagtgccatggcca

SEQ ID NO: 5040950 - DNA, 20 bp, Homo sapiens
gaacaggagtgactctggct

SEQ ID NO: 5040951 - DNA, 16 bp, Homo sapiens
gaactggccccagctc

SEQ ID NO: 5040952 - DNA, 13 bp, Homo sapiens
gaaggccccaggg

SEQ ID NO: 5040953 - DNA, 18 bp, Homo sapiens
gacaagccaggccctctc

SEQ ID NO: 5040954 - DNA, 16 bp, Homo sapiens
gacacaggctgccgct

SEQ ID NO: 5040955 - DNA, 16 bp, Homo sapiens
gacacagtcaggggcc

SEQ ID NO: 5040956 - DNA, 12 bp, Homo sapiens
gacaccttccca

SEQ ID NO: 5040957 - DNA, 17 bp, Homo sapiens
gacagttgggtgtgaga

SEQ ID NO: 5040958 - DNA, 19 bp, Homo sapiens
gacatgaacgttttctctt

SEQ ID NO: 5040959 - DNA, 22 bp, Homo sapiens
gacatgaacgttttctcttcac

SEQ ID NO: 5040960 - DNA, 20 bp, Homo sapiens
gaccccaccctgtctgcagg

SEQ ID NO: 5040961 - DNA, 13 bp, Homo sapiens
gaccctcccaggt

SEQ ID NO: 5040962 - DNA, 13 bp, Homo sapiens
gacgacccggggc

SEQ ID NO: 5040963 - DNA, 17 bp, Homo sapiens
gagaaggccccagggca

SEQ ID NO: 5040964 - DNA, 13 bp, Homo sapiens
gagagcagggctg

SEQ ID NO: 5040965 - DNA, 16 bp, Homo sapiens
gagagcagggctgggc

SEQ ID NO: 5040966 - DNA, 23 bp, Homo sapiens
gagagccccacccctgaactggc

SEQ ID NO: 5040967 - DNA, 19 bp, Homo sapiens
gagagctcaagtttcagag

SEQ ID NO: 5040968 - DNA, 14 bp, Homo sapiens
gagatgcagctgga

SEQ ID NO: 5040969 - DNA, 21 bp, Homo sapiens
gagatgcatctgtggcctggg

SEQ ID NO: 5040970 - DNA, 20 bp, Homo sapiens
gagcatggccgcaacttccc

SEQ ID NO: 5040971 - DNA, 21 bp, Homo sapiens
gagcatggccgcaacttccca

SEQ ID NO: 5040972 - DNA, 14 bp, Homo sapiens
gagccacagggacg

SEQ ID NO: 5040973 - DNA, 22 bp, Homo sapiens
gagccccacccctgaactggcc

SEQ ID NO: 5040974 - DNA, 13 bp, Homo sapiens
gagccgcaggggc

SEQ ID NO: 5040975 - DNA, 18 bp, Homo sapiens
gagccgcaggggcccctc

SEQ ID NO: 5040976 - DNA, 13 bp, Homo sapiens
gaggaccctccca

SEQ ID NO: 5040977 - DNA, 16 bp, Homo sapiens
gaggaccctcccaggt

SEQ ID NO: 5040978 - DNA, 14 bp, Homo sapiens
gaggctgctgtcac

SEQ ID NO: 5040979 - DNA, 20 bp, Homo sapiens
gagggcaaaccaggctgcag

SEQ ID NO: 5040980 - DNA, 21 bp, Homo sapiens
gagggcaaaccaggctgcagg

SEQ ID NO: 5040981 - DNA, 15 bp, Homo sapiens
gagtgccacgtggcc

SEQ ID NO: 5040982 - DNA, 18 bp, Homo sapiens
gagtgccacgtggccgct

SEQ ID NO: 5040983 - DNA, 19 bp, Homo sapiens
gagtgccacgtggccgctg

SEQ ID NO: 5040984 - DNA, 16 bp, Homo sapiens
gatcttacccacttcc

SEQ ID NO: 5040985 - DNA, 20 bp, Homo sapiens
gatgcatctgtggcctgggg

SEQ ID NO: 5040986 - DNA, 14 bp, Homo sapiens
gcaaaccaggctgc

SEQ ID NO: 5040987 - DNA, 16 bp, Homo sapiens
gcaaaccaggctgcag

SEQ ID NO: 5040988 - DNA, 15 bp, Homo sapiens
gcaacttcccaggcc

SEQ ID NO: 5040989 - DNA, 19 bp, Homo sapiens
gcaagacaccttcccagct

SEQ ID NO: 5040990 - DNA, 23 bp, Homo sapiens
gcaaggtgcacctgccccaggct

SEQ ID NO: 5040991 - DNA, 20 bp, Homo sapiens
gcactgtcatgcccagcttg

SEQ ID NO: 5040992 - DNA, 23 bp, Homo sapiens
gcacttggagcgtttttgctggc

SEQ ID NO: 5040993 - DNA, 22 bp, Homo sapiens
gcagaccccaccctgtctgcag

SEQ ID NO: 5040994 - DNA, 15 bp, Homo sapiens
agcgacacaggctgc

SEQ ID NO: 5040995 - DNA, 16 bp, Homo sapiens
agcgacacaggctgcc

SEQ ID NO: 5040996 - DNA, 18 bp, Homo sapiens
agcgacacaggctgccgc

SEQ ID NO: 5040997 - DNA, 12 bp, Homo sapiens
agctgctcctag

SEQ ID NO: 5040998 - DNA, 15 bp, Homo sapiens
agctggatggggcgg

SEQ ID NO: 5040999 - DNA, 17 bp, Homo sapiens
agcttggagtgccacgt

SEQ ID NO: 5041000 - DNA, 23 bp, Homo sapiens
aggaagggcccccggctcggcct

SEQ ID NO: 5041001 - DNA, 14 bp, Homo sapiens
aggaccctcccagg

SEQ ID NO: 5041002 - DNA, 12 bp, Homo sapiens
aggagaggctgc

SEQ ID NO: 5041003 - DNA, 15 bp, Homo sapiens
aggaggcctgggaga

SEQ ID NO: 5041004 - DNA, 22 bp, Homo sapiens
aggagtgactctggctgccaag

SEQ ID NO: 5041005 - DNA, 16 bp, Homo sapiens
aggccacccccacctc

SEQ ID NO: 5041006 - DNA, 15 bp, Homo sapiens
aggcccggagatgca

SEQ ID NO: 5041007 - DNA, 18 bp, Homo sapiens
aggctcaggctgcccagc

SEQ ID NO: 5041008 - DNA, 18 bp, Homo sapiens
aggctgcccagcggctct

SEQ ID NO: 5041009 - DNA, 21 bp, Homo sapiens
aggctgcccagcggctcttcc

SEQ ID NO: 5041010 - DNA, 18 bp, Homo sapiens
aggctgccgctgctctcc

SEQ ID NO: 5041011 - DNA, 23 bp, Homo sapiens
aggctgccgctgctctcccaggt

SEQ ID NO: 5041012 - DNA, 16 bp, Homo sapiens
agggcaaaccaggctg

SEQ ID NO: 5041013 - DNA, 13 bp, Homo sapiens
agggcgcctgggt

SEQ ID NO: 5041014 - DNA, 19 bp, Homo sapiens
agggctgggcgcctctgtc

SEQ ID NO: 5041015 - DNA, 18 bp, Homo sapiens
aggggcccctcctccaga

SEQ ID NO: 5041016 - DNA, 17 bp, Homo sapiens
agggtacagcccaggcg

SEQ ID NO: 5041017 - DNA, 16 bp, Homo sapiens
agggtctgtcccgggt

SEQ ID NO: 5041018 - DNA, 15 bp, Homo sapiens
aggtgcacctgcccc

SEQ ID NO: 5041019 - DNA, 18 bp, Homo sapiens
aggtgcacctgccccagg

SEQ ID NO: 5041020 - DNA, 18 bp, Homo sapiens
agtaaatccacagtgagt

SEQ ID NO: 5041021 - DNA, 14 bp, Homo sapiens
agtcagcccagtgg

SEQ ID NO: 5041022 - DNA, 17 bp, Homo sapiens
agtcattctagagggat

SEQ ID NO: 5041023 - DNA, 22 bp, Homo sapiens
agtccacgccgggtcgcctgcc

SEQ ID NO: 5041024 - DNA, 15 bp, Homo sapiens
agtcctcggcagctc

SEQ ID NO: 5041025 - DNA, 14 bp, Homo sapiens
agtctgtgcctcag

SEQ ID NO: 5041026 - DNA, 15 bp, Homo sapiens
agtctgtgcctcagt

SEQ ID NO: 5041027 - DNA, 16 bp, Homo sapiens
agtgactctggctgcc

SEQ ID NO: 5041028 - DNA, 17 bp, Homo sapiens
agtgactctggctgcca

SEQ ID NO: 5041029 - DNA, 18 bp, Homo sapiens
agtgactctggctgccaa

SEQ ID NO: 5041030 - DNA, 23 bp, Homo sapiens
agtgccacatggccgctgcccac

SEQ ID NO: 5041031 - DNA, 17 bp, Homo sapiens
agtgccacgtggccgct

SEQ ID NO: 5041032 - DNA, 18 bp, Homo sapiens
agtgccacgtggccgctg

SEQ ID NO: 5041033 - DNA, 23 bp, Homo sapiens
agtgccacgtggccgctgcccac

SEQ ID NO: 5041034 - DNA, 17 bp, Homo sapiens
atcaggtcagagcccag

SEQ ID NO: 5041035 - DNA, 22 bp, Homo sapiens
atcctcactgagaaggccccag

SEQ ID NO: 5041036 - DNA, 13 bp, Homo sapiens
atcgccctgagct

SEQ ID NO: 5041037 - DNA, 14 bp, Homo sapiens
atctgtggcctggg

SEQ ID NO: 5041038 - DNA, 20 bp, Homo sapiens
atgcccagcttggagtgcca

SEQ ID NO: 5041039 - DNA, 21 bp, Homo sapiens
atggccgcaacttcccaggcc

SEQ ID NO: 5041040 - DNA, 22 bp, Homo sapiens
atggccgcaacttcccaggccg

SEQ ID NO: 5041041 - DNA, 18 bp, Homo sapiens
atggggcggcctgcagac

SEQ ID NO: 5041042 - DNA, 16 bp, Homo sapiens
atgtcttcttgggggc

SEQ ID NO: 5041043 - DNA, 19 bp, Homo sapiens
attgactggtcccccatgg

SEQ ID NO: 5041044 - DNA, 12 bp, Homo sapiens
caaaatgcagga

SEQ ID NO: 5041045 - DNA, 15 bp, Homo sapiens
caaaccaggctgcag

SEQ ID NO: 5041046 - DNA, 15 bp, Homo sapiens
caaagaaccaggagg

SEQ ID NO: 5041047 - DNA, 14 bp, Homo sapiens
caaccattgaaggg

SEQ ID NO: 5041048 - DNA, 22 bp, Homo sapiens
caacccctaatcgccctgagct

SEQ ID NO: 5041049 - DNA, 15 bp, Homo sapiens
caacttcccaggccg

SEQ ID NO: 5041050 - DNA, 17 bp, Homo sapiens
caagacaccttcccagc

SEQ ID NO: 5041051 - DNA, 18 bp, Homo sapiens
caagacaccttcccagct

SEQ ID NO: 5041052 - DNA, 12 bp, Homo sapiens
caagccaggccc

SEQ ID NO: 5041053 - DNA, 17 bp, Homo sapiens
caagcgacacaggctgc

SEQ ID NO: 5041054 - DNA, 18 bp, Homo sapiens
caagcgacacaggctgcc

SEQ ID NO: 5041055 - DNA, 21 bp, Homo sapiens
caatgttggctagtctgtgcc

SEQ ID NO: 5041056 - DNA, 23 bp, Homo sapiens
cacatggccgctgcccacgtccc

SEQ ID NO: 5041057 - DNA, 16 bp, Homo sapiens
caccagtccacgccgg

SEQ ID NO: 5041058 - DNA, 18 bp, Homo sapiens
cacctccctgcagctttg

SEQ ID NO: 5041059 - DNA, 14 bp, Homo sapiens
cacctgccaggctg

SEQ ID NO: 5041060 - DNA, 15 bp, Homo sapiens
cacctgccccaggct

SEQ ID NO: 5041061 - DNA, 18 bp, Homo sapiens
cacctgccccaggctcag

SEQ ID NO: 5041062 - DNA, 19 bp, Homo sapiens
caccttcccagctgctcct

SEQ ID NO: 5041063 - DNA, 20 bp, Homo sapiens
cacgcttagggtctgtcccg

SEQ ID NO: 5041064 - DNA, 13 bp, Homo sapiens
cacgtcctgggtg

SEQ ID NO: 5041065 - DNA, 13 bp, Homo sapiens
cactctgaccggg

SEQ ID NO: 5041066 - DNA, 17 bp, Homo sapiens
cactgcccacctgccag

SEQ ID NO: 5041067 - DNA, 18 bp, Homo sapiens
cactgcggaacaggagtg

SEQ ID NO: 5041068 - DNA, 19 bp, Homo sapiens
cactgcggaacaggagtga

SEQ ID NO: 5041069 - DNA, 13 bp, Homo sapiens
cactggctttggg

SEQ ID NO: 5041070 - DNA, 20 bp, Homo sapiens
cactgtcatgcccagcttgg

SEQ ID NO: 5041071 - DNA, 22 bp, Homo sapiens
cactgtcatgcccagcttggag

SEQ ID NO: 5041072 - DNA, 13 bp, Homo sapiens
cacttccctgcaa

SEQ ID NO: 5041073 - DNA, 14 bp, Homo sapiens
cactttggccacag

SEQ ID NO: 5041074 - DNA, 22 bp, Homo sapiens
cagaccccaccctgtctgcagg

SEQ ID NO: 5041075 - DNA, 15 bp, Homo sapiens
cagaccctgccaggg

SEQ ID NO: 5041076 - DNA, 21 bp, Homo sapiens
cagactgtgggtccctgcgtc

SEQ ID NO: 5041077 - DNA, 23 bp, Homo sapiens
cagagcccaggaattctcacagg

SEQ ID NO: 5041078 - DNA, 19 bp, Homo sapiens
cagcgcccagcctggcccc

SEQ ID NO: 5041079 - DNA, 15 bp, Homo sapiens
cagcggctcttcctg

SEQ ID NO: 5041080 - DNA, 15 bp, Homo sapiens
cagctcctcttcctg

SEQ ID NO: 5041081 - DNA, 21 bp, Homo sapiens
cagctcctcttcctgcctctc

SEQ ID NO: 5041082 - DNA, 16 bp, Homo sapiens
caggaggcctgggaga

SEQ ID NO: 5041083 - DNA, 23 bp, Homo sapiens
caggaggcctgggagatgcagct

SEQ ID NO: 5041084 - DNA, 17 bp, Homo sapiens
caggcaagacaccttcc

SEQ ID NO: 5041085 - DNA, 17 bp, Homo sapiens
caggccctctctgcagt

SEQ ID NO: 5041086 - DNA, 12 bp, Homo sapiens
caggctgcccag

SEQ ID NO: 5041087 - DNA, 17 bp, Homo sapiens
cagggacagttgggtgt

SEQ ID NO: 5041088 - DNA, 14 bp, Homo sapiens
cagggacgacccgg

SEQ ID NO: 5041089 - DNA, 18 bp, Homo sapiens
cagggcagcggtcttctc

SEQ ID NO: 5041090 - DNA, 18 bp, Homo sapiens
cagggctgggcgcctctg

SEQ ID NO: 5041091 - DNA, 23 bp, Homo sapiens
cagggctgggcgcctctgtcctg

SEQ ID NO: 5041092 - DNA, 15 bp, Homo sapiens
caggggcccctcctc

SEQ ID NO: 5041093 - DNA, 20 bp, Homo sapiens
cagggggtttgaggaccctc

SEQ ID NO: 5041094 - DNA, 13 bp, Homo sapiens
caggtcagagccc

SEQ ID NO: 5041095 - DNA, 18 bp, Homo sapiens
caggtcagagcccaggaa

SEQ ID NO: 5041096 - DNA, 16 bp, Homo sapiens
cagtcagcccagtggg

SEQ ID NO: 5041097 - DNA, 17 bp, Homo sapiens
cagtgagagcagggctg

SEQ ID NO: 5041098 - DNA, 22 bp, Homo sapiens
cagtgggatcttacccacttcc

SEQ ID NO: 5041099 - DNA, 12 bp, Homo sapiens
catgcccagctt

SEQ ID NO: 5041100 - DNA, 13 bp, Homo sapiens
catggccaggagt

SEQ ID NO: 5041101 - DNA, 17 bp, Homo sapiens
catggccaggagtgggt

SEQ ID NO: 5041102 - DNA, 14 bp, Homo sapiens
catggccgctgccc

SEQ ID NO: 5041103 - DNA, 15 bp, Homo sapiens
catggcttgggctgg

SEQ ID NO: 5041104 - DNA, 19 bp, Homo sapiens
cattactcaaaatgcagga

SEQ ID NO: 5041105 - DNA, 21 bp, Homo sapiens
cattactcaaaatgcaggaca

SEQ ID NO: 5041106 - DNA, 14 bp, Homo sapiens
ccacaccagtccac

SEQ ID NO: 5041107 - DNA, 11 bp, Homo sapiens
ccacagggacg

SEQ ID NO: 5041108 - DNA, 18 bp, Homo sapiens
ccacatggccgctgccca

SEQ ID NO: 5041109 - DNA, 14 bp, Homo sapiens
ccacctccctgcag

SEQ ID NO: 5041110 - DNA, 15 bp, Homo sapiens
ccacctccctgcagc

SEQ ID NO: 5041111 - DNA, 17 bp, Homo sapiens
ccacctccctgcagctt

SEQ ID NO: 5041112 - DNA, 13 bp, Homo sapiens
ccacctgccaggc

SEQ ID NO: 5041113 - DNA, 17 bp, Homo sapiens
ccacctgccaggctgca

SEQ ID NO: 5041114 - DNA, 14 bp, Homo sapiens
ccacgtcccgggca

SEQ ID NO: 5041115 - DNA, 14 bp, Homo sapiens
ccacgtcctgggtg

SEQ ID NO: 5041116 - DNA, 15 bp, Homo sapiens
ccacgtcctgggtgc

SEQ ID NO: 5041117 - DNA, 19 bp, Homo sapiens
ccacgtggccgctgctgtg

SEQ ID NO: 5041118 - DNA, 18 bp, Homo sapiens
ccacttccctgcaaggtg

SEQ ID NO: 5041119 - DNA, 14 bp, Homo sapiens
ccagagcctgggcg

SEQ ID NO: 5041120 - DNA, 15 bp, Homo sapiens
ccagagcctgggcgc

SEQ ID NO: 5041121 - DNA, 14 bp, Homo sapiens
ccagcctggcccca

SEQ ID NO: 5041122 - DNA, 22 bp, Homo sapiens
ccagcggctcttcctggacagt

SEQ ID NO: 5041123 - DNA, 13 bp, Homo sapiens
ccaggaggcctgg

SEQ ID NO: 5041124 - DNA, 15 bp, Homo sapiens
ccaggaggcctggga

SEQ ID NO: 5041125 - DNA, 19 bp, Homo sapiens
ccaggccctctctgcagtc

SEQ ID NO: 5041126 - DNA, 20 bp, Homo sapiens
ccaggccctctctgcagtcc

SEQ ID NO: 5041127 - DNA, 14 bp, Homo sapiens
ccaggctcaggctg

SEQ ID NO: 5041128 - DNA, 20 bp, Homo sapiens
ccaggctcaggctgcccagc

SEQ ID NO: 5041129 - DNA, 18 bp, Homo sapiens
ccaggctgcagggacagt

SEQ ID NO: 5041130 - DNA, 14 bp, Homo sapiens
ccaggctgcaggtg

SEQ ID NO: 5041131 - DNA, 14 bp, Homo sapiens
ccatggccaggagt

SEQ ID NO: 5041132 - DNA, 13 bp, Homo sapiens
cccacctgccagg

SEQ ID NO: 5041133 - DNA, 22 bp, Homo sapiens
cccacctgccaggctgcaggga

SEQ ID NO: 5041134 - DNA, 18 bp, Homo sapiens
cccacgtcccgggcactg

SEQ ID NO: 5041135 - DNA, 16 bp, Homo sapiens
cccacgtcctgggtgc

SEQ ID NO: 5041136 - DNA, 17 bp, Homo sapiens
cccacttccctgcaagg

SEQ ID NO: 5041137 - DNA, 19 bp, Homo sapiens
cccagcctggccccaagca

SEQ ID NO: 5041138 - DNA, 14 bp, Homo sapiens
cccagcgccctcta

SEQ ID NO: 5041139 - DNA, 16 bp, Homo sapiens
cccagctcctcttcct

SEQ ID NO: 5041140 - DNA, 19 bp, Homo sapiens
cccagctcctcttcctgcc

SEQ ID NO: 5041141 - DNA, 17 bp, Homo sapiens
cccagcttggagtgcca

SEQ ID NO: 5041142 - DNA, 15 bp, Homo sapiens
cccaggccgaggaag

SEQ ID NO: 5041143 - DNA, 20 bp, Homo sapiens
cccaggctcaggctgcccag

SEQ ID NO: 5041144 - DNA, 21 bp, Homo sapiens
cccaggctcaggctgcccagc

SEQ ID NO: 5041145 - DNA, 12 bp, Homo sapiens
cccagggcagcg

SEQ ID NO: 5041146 - DNA, 17 bp, Homo sapiens
ccccacctccctgcagc

SEQ ID NO: 5041147 - DNA, 22 bp, Homo sapiens
ccccaggctcaggctgcccagc

SEQ ID NO: 5041148 - DNA, 22 bp, Homo sapiens
cccccggctcggcctcttgaga

SEQ ID NO: 5041149 - DNA, 22 bp, Homo sapiens
cccctcctccagagcctgggcg

SEQ ID NO: 5041150 - DNA, 21 bp, Homo sapiens
cccctgaactggccccagctc

SEQ ID NO: 5041151 - DNA, 23 bp, Homo sapiens
cccctgaactggccccagctcct

SEQ ID NO: 5041152 - DNA, 18 bp, Homo sapiens
cccgggcactgtcatgcc

SEQ ID NO: 5041153 - DNA, 19 bp, Homo sapiens
cccgggcactgtcatgccc

SEQ ID NO: 5041154 - DNA, 23 bp, Homo sapiens
cccgggtactcagtcagcccagt

SEQ ID NO: 5041155 - DNA, 12 bp, Homo sapiens
ccctctctgcag

SEQ ID NO: 5041156 - DNA, 18 bp, Homo sapiens
ccctgaactggccccagc

SEQ ID NO: 5041157 - DNA, 15 bp, Homo sapiens
ccctgcaaggtgcac

SEQ ID NO: 5041158 - DNA, 15 bp, Homo sapiens
ccctgcagctttgag

SEQ ID NO: 5041159 - DNA, 14 bp, Homo sapiens
ccctgtctgcaggc

SEQ ID NO: 5041160 - DNA, 14 bp, Homo sapiens
ccgcaggggcccct

SEQ ID NO: 5041161 - DNA, 17 bp, Homo sapiens
ccgctgctgtgacaggc

SEQ ID NO: 5041162 - DNA, 17 bp, Homo sapiens
ccgctgttttggggtct

SEQ ID NO: 5041163 - DNA, 21 bp, Homo sapiens
ccgggtactcagtcagcccag

SEQ ID NO: 5041164 - DNA, 18 bp, Homo sapiens
ccgggtggcagcgcccag

SEQ ID NO: 5041165 - DNA, 17 bp, Homo sapiens
cctaatcgccctgagct

SEQ ID NO: 5041166 - DNA, 21 bp, Homo sapiens
cctagaggggacaagccaggc

SEQ ID NO: 5041167 - DNA, 23 bp, Homo sapiens
cctagaggggacaagccaggccc

SEQ ID NO: 5041168 - DNA, 20 bp, Homo sapiens
cctcagtgagatcagtcagc

SEQ ID NO: 5041169 - DNA, 23 bp, Homo sapiens
cctcagtgagatcagtcagctcc

SEQ ID NO: 5041170 - DNA, 12 bp, Homo sapiens
cctccctgcagc

SEQ ID NO: 5041171 - DNA, 13 bp, Homo sapiens
cctccctgcagct

SEQ ID NO: 5041172 - DNA, 19 bp, Homo sapiens
cctcctccagagcctgggc

SEQ ID NO: 5041173 - DNA, 21 bp, Homo sapiens
cctcctccagagcctgggcgc

SEQ ID NO: 5041174 - DNA, 22 bp, Homo sapiens
cctcgtcccgagggcgcctggg

SEQ ID NO: 5041175 - DNA, 15 bp, Homo sapiens
cctctctgcagtcct

SEQ ID NO: 5041176 - DNA, 13 bp, Homo sapiens
cctctgtcctggc

SEQ ID NO: 5041177 - DNA, 19 bp, Homo sapiens
cctctgtcctggcccggga

SEQ ID NO: 5041178 - DNA, 21 bp, Homo sapiens
cctgccaggctgcagggacag

SEQ ID NO: 5041179 - DNA, 13 bp, Homo sapiens
cctgccccaggct

SEQ ID NO: 5041180 - DNA, 17 bp, Homo sapiens
cctgcctctctcatggc

SEQ ID NO: 5041181 - DNA, 14 bp, Homo sapiens
cctggccccagtga

SEQ ID NO: 5041182 - DNA, 19 bp, Homo sapiens
cctggcccgggagccgcag

SEQ ID NO: 5041183 - DNA, 16 bp, Homo sapiens
cctgggagatgcagct

SEQ ID NO: 5041184 - DNA, 17 bp, Homo sapiens
cctgggagatgcagctg

SEQ ID NO: 5041185 - DNA, 18 bp, Homo sapiens
cctgggagatgcagctgg

SEQ ID NO: 5041186 - DNA, 19 bp, Homo sapiens
cctgggagatgcagctgga

SEQ ID NO: 5041187 - DNA, 22 bp, Homo sapiens
cctgggcgcaagcgacacaggc

SEQ ID NO: 5041188 - DNA, 16 bp, Homo sapiens
cctgggtcctcccagc

SEQ ID NO: 5041189 - DNA, 20 bp, Homo sapiens
cctgggtgctgtcatgccca

SEQ ID NO: 5041190 - DNA, 22 bp, Homo sapiens
cctgggtgctgtcatgcccagc

SEQ ID NO: 5041191 - DNA, 23 bp, Homo sapiens
cctgtctccctacttagacccag

SEQ ID NO: 5041192 - DNA, 13 bp, Homo sapiens
cctgtctgcaggc

SEQ ID NO: 5041193 - DNA, 18 bp, Homo sapiens
cgagggcgcctgggtcct

SEQ ID NO: 5041194 - DNA, 22 bp, Homo sapiens
cgcaagcgacacaggctgccgc

SEQ ID NO: 5041195 - DNA, 16 bp, Homo sapiens
cgcccagcctggcccc

SEQ ID NO: 5041196 - DNA, 19 bp, Homo sapiens
cgcctctgtcctggcccgg

SEQ ID NO: 5041197 - DNA, 18 bp, Homo sapiens
cgcctgggtcctcccagc

SEQ ID NO: 5041198 - DNA, 21 bp, Homo sapiens
cgcctgggtcctcccagctga

SEQ ID NO: 5041199 - DNA, 14 bp, Homo sapiens
cgctgctctcccag

SEQ ID NO: 5041200 - DNA, 17 bp, Homo sapiens
cggaaggacacagtcag

SEQ ID NO: 5041201 - DNA, 20 bp, Homo sapiens
cggaaggacacagtcagggg

SEQ ID NO: 5041202 - DNA, 18 bp, Homo sapiens
cggagatgcatctgtggc

SEQ ID NO: 5041203 - DNA, 20 bp, Homo sapiens
cggagatgcatctgtggcct

SEQ ID NO: 5041204 - DNA, 17 bp, Homo sapiens
cggcccacgtcctgggt

SEQ ID NO: 5041205 - DNA, 13 bp, Homo sapiens
cggcctcttgaga

SEQ ID NO: 5041206 - DNA, 19 bp, Homo sapiens
cggcctcttgagagcccca

SEQ ID NO: 5041207 - DNA, 20 bp, Homo sapiens
cggcctgcagaccctgccag

SEQ ID NO: 5041208 - DNA, 21 bp, Homo sapiens
cggcctgcagaccctgccagg

SEQ ID NO: 5041209 - DNA, 16 bp, Homo sapiens
cgggagccgcaggggc

SEQ ID NO: 5041210 - DNA, 21 bp, Homo sapiens
cgggcactgtcatgcccagct

SEQ ID NO: 5041211 - DNA, 21 bp, Homo sapiens
aaacactttggccacagcccc

SEQ ID NO: 5041212 - DNA, 21 bp, Homo sapiens
aagctgagcccctccctcctg

SEQ ID NO: 5041213 - DNA, 22 bp, Homo sapiens
aagggcccccggctcggcctct

SEQ ID NO: 5041214 - DNA, 18 bp, Homo sapiens
aaggtgcacctgccccag

SEQ ID NO: 5041215 - DNA, 13 bp, Homo sapiens
aatacgcttgagc

SEQ ID NO: 5041216 - DNA, 14 bp, Homo sapiens
acaagccaggccct

SEQ ID NO: 5041217 - DNA, 17 bp, Homo sapiens
acaagccaggccctctc

SEQ ID NO: 5041218 - DNA, 14 bp, Homo sapiens
acacaggctgccgc

SEQ ID NO: 5041219 - DNA, 14 bp, Homo sapiens
acaccttcccagct

SEQ ID NO: 5041220 - DNA, 22 bp, Homo sapiens
acaccttcccagctgctcctag

SEQ ID NO: 5041221 - DNA, 23 bp, Homo sapiens
acactggctttgggtagtgccat

SEQ ID NO: 5041222 - DNA, 16 bp, Homo sapiens
acagcaggagcatggc

SEQ ID NO: 5041223 - DNA, 12 bp, Homo sapiens
acagcccaggcg

SEQ ID NO: 5041224 - DNA, 23 bp, Homo sapiens
acaggagtgactctggctgccaa

SEQ ID NO: 5041225 - DNA, 16 bp, Homo sapiens
acatggccgctgccca

SEQ ID NO: 5041226 - DNA, 24 bp, Homo sapiens
accacgtctccctggccccagtga

SEQ ID NO: 5041227 - DNA, 14 bp, Homo sapiens
accaggctgcaggt

SEQ ID NO: 5041228 - DNA, 21 bp, Homo sapiens
accagtccacgccgggtcgcc

SEQ ID NO: 5041229 - DNA, 17 bp, Homo sapiens
acccacttccctgcaag

SEQ ID NO: 5041230 - DNA, 20 bp, Homo sapiens
acccctaatcgccctgagct

SEQ ID NO: 5041231 - DNA, 11 bp, Homo sapiens
accctgccagg

SEQ ID NO: 5041232 - DNA, 12 bp, Homo sapiens
accctgccaggg

SEQ ID NO: 5041233 - DNA, 13 bp, Homo sapiens
accctgccagggg

SEQ ID NO: 5041234 - DNA, 17 bp, Homo sapiens
accctgtctgcaggcca

SEQ ID NO: 5041235 - DNA, 13 bp, Homo sapiens
acctccctgcagc

SEQ ID NO: 5041236 - DNA, 15 bp, Homo sapiens
acctgccaggctgca

SEQ ID NO: 5041237 - DNA, 14 bp, Homo sapiens
acctgccccaggct

SEQ ID NO: 5041238 - DNA, 14 bp, Homo sapiens
accttcccagctgc

SEQ ID NO: 5041239 - DNA, 18 bp, Homo sapiens
acgccgggtcgcctgccc

SEQ ID NO: 5041240 - DNA, 15 bp, Homo sapiens
acgtggccgctgccc

SEQ ID NO: 5041241 - DNA, 15 bp, Homo sapiens
actcaaaatgcagga

SEQ ID NO: 5041242 - DNA, 15 bp, Homo sapiens
actcagtcagcccag

SEQ ID NO: 5041243 - DNA, 18 bp, Homo sapiens
actcagtcagcccagtgg

SEQ ID NO: 5041244 - DNA, 14 bp, Homo sapiens
actctggctgccaa

SEQ ID NO: 5041245 - DNA, 15 bp, Homo sapiens
actctggctgccaag

SEQ ID NO: 5041246 - DNA, 16 bp, Homo sapiens
actgagaaggccccag

SEQ ID NO: 5041247 - DNA, 16 bp, Homo sapiens
actgcccacctgccag

SEQ ID NO: 5041248 - DNA, 18 bp, Homo sapiens
actgcccacctgccaggc

SEQ ID NO: 5041249 - DNA, 16 bp, Homo sapiens
actgcggaacaggagt

SEQ ID NO: 5041250 - DNA, 24 bp, Homo sapiens
actggctttgggtagtgccatggc

SEQ ID NO: 5041251 - DNA, 18 bp, Homo sapiens
actggtcccccatgggct

SEQ ID NO: 5041252 - DNA, 18 bp, Homo sapiens
actgtcatgcccagcttg

SEQ ID NO: 5041253 - DNA, 14 bp, Homo sapiens
acttccctgcaagg

SEQ ID NO: 5041254 - DNA, 18 bp, Homo sapiens
agaaccaggaggcctggg

SEQ ID NO: 5041255 - DNA, 19 bp, Homo sapiens
agacaccttcccagctgct

SEQ ID NO: 5041256 - DNA, 21 bp, Homo sapiens
agactgtgggtccctgcgtct

SEQ ID NO: 5041257 - DNA, 16 bp, Homo sapiens
agagcctgggcgcaag

SEQ ID NO: 5041258 - DNA, 15 bp, Homo sapiens
agaggctgctgtcac

SEQ ID NO: 5041259 - DNA, 23 bp, Homo sapiens
agagggatccaccgccacactgg

SEQ ID NO: 5041260 - DNA, 13 bp, Homo sapiens
agatgcatctgtg

SEQ ID NO: 5041261 - DNA, 15 bp, Homo sapiens
agatgcatctgtggc

SEQ ID NO: 5041262 - DNA, 18 bp, Homo sapiens
agatgcatctgtggcctg

SEQ ID NO: 5041263 - DNA, 21 bp, Homo sapiens
agatgcatctgtggcctgggg

SEQ ID NO: 5041264 - DNA, 19 bp, Homo sapiens
agccaggccctctctgcag

SEQ ID NO: 5041265 - DNA, 20 bp, Homo sapiens
agccaggccctctctgcagt

SEQ ID NO: 5041266 - DNA, 20 bp, Homo sapiens
agctgagcccctccctcctg

SEQ ID NO: 5041267 - DNA, 13 bp, Homo sapiens
agctgctcctaga

SEQ ID NO: 5041268 - DNA, 15 bp, Homo sapiens
agctttgaggctggc

SEQ ID NO: 5041269 - DNA, 15 bp, Homo sapiens
aggagtgactctggc

SEQ ID NO: 5041270 - DNA, 15 bp, Homo sapiens
aggccctctctgcag

SEQ ID NO: 5041271 - DNA, 16 bp, Homo sapiens
aggccctctctgcagt

SEQ ID NO: 5041272 - DNA, 17 bp, Homo sapiens
aggccctctctgcagtc

SEQ ID NO: 5041273 - DNA, 18 bp, Homo sapiens
aggccctctctgcagtcc

SEQ ID NO: 5041274 - DNA, 11 bp, Homo sapiens
aggctgcccag

SEQ ID NO: 5041275 - DNA, 21 bp, Homo sapiens
aggctgccgctgctctcccag

SEQ ID NO: 5041276 - DNA, 13 bp, Homo sapiens
aggctgctgtcac

SEQ ID NO: 5041277 - DNA, 18 bp, Homo sapiens
aggctggcggggtctgct

SEQ ID NO: 5041278 - DNA, 20 bp, Homo sapiens
agggacagttgggtgtgaga

SEQ ID NO: 5041279 - DNA, 15 bp, Homo sapiens
agggcaaaccaggct

SEQ ID NO: 5041280 - DNA, 18 bp, Homo sapiens
agggcccccggctcggcc

SEQ ID NO: 5041281 - DNA, 12 bp, Homo sapiens
agggcgcctggg

SEQ ID NO: 5041282 - DNA, 14 bp, Homo sapiens
aggggcccctcctc

SEQ ID NO: 5041283 - DNA, 16 bp, Homo sapiens
agtcagcccagtggga

SEQ ID NO: 5041284 - DNA, 16 bp, Homo sapiens
agtcattctagaggga

SEQ ID NO: 5041285 - DNA, 12 bp, Homo sapiens
agtctgtgcctc

SEQ ID NO: 5041286 - DNA, 16 bp, Homo sapiens
agtgagagcagggctg

SEQ ID NO: 5041287 - DNA, 17 bp, Homo sapiens
agtgccacatggccgct

SEQ ID NO: 5041288 - DNA, 18 bp, Homo sapiens
agtgccacatggccgctg

SEQ ID NO: 5041289 - DNA, 15 bp, Homo sapiens
agtgccatggccagg

SEQ ID NO: 5041290 - DNA, 16 bp, Homo sapiens
agtgccatggccagga

SEQ ID NO: 5041291 - DNA, 21 bp, Homo sapiens
atcctcactgagaaggcccca

SEQ ID NO: 5041292 - DNA, 23 bp, Homo sapiens
atgcagaccccaccctgtctgca

SEQ ID NO: 5041293 - DNA, 18 bp, Homo sapiens
atgcatctgtggcctggg

SEQ ID NO: 5041294 - DNA, 19 bp, Homo sapiens
atgcccagcttggagtgcc

SEQ ID NO: 5041295 - DNA, 21 bp, Homo sapiens
atgcccagcttggagtgccac

SEQ ID NO: 5041296 - DNA, 23 bp, Homo sapiens
atgcccagcttggagtgccacgt

SEQ ID NO: 5041297 - DNA, 13 bp, Homo sapiens
atggccaggagtg

SEQ ID NO: 5041298 - DNA, 15 bp, Homo sapiens
atggccgctgcccac

SEQ ID NO: 5041299 - DNA, 22 bp, Homo sapiens
atgtcttcttgggggcagacca

SEQ ID NO: 5041300 - DNA, 16 bp, Homo sapiens
attgactggtccccca

SEQ ID NO: 5041301 - DNA, 13 bp, Homo sapiens
caaaccaggctgc

SEQ ID NO: 5041302 - DNA, 17 bp, Homo sapiens
caaaccaggctgcaggt

SEQ ID NO: 5041303 - DNA, 20 bp, Homo sapiens
caagcgacacaggctgccgc

SEQ ID NO: 5041304 - DNA, 20 bp, Homo sapiens
caaggtgcacctgccccagg

SEQ ID NO: 5041305 - DNA, 15 bp, Homo sapiens
caagtttcagagtca

SEQ ID NO: 5041306 - DNA, 21 bp, Homo sapiens
caataaacgctgacttgcaga

SEQ ID NO: 5041307 - DNA, 22 bp, Homo sapiens
caatgttggctagtctgtgcct

SEQ ID NO: 5041308 - DNA, 16 bp, Homo sapiens
cacaggttcacccagc

SEQ ID NO: 5041309 - DNA, 18 bp, Homo sapiens
cacccctgaactggcccc

SEQ ID NO: 5041310 - DNA, 19 bp, Homo sapiens
cacccctgaactggcccca

SEQ ID NO: 5041311 - DNA, 18 bp, Homo sapiens
caccgccacactggccgg

SEQ ID NO: 5041312 - DNA, 16 bp, Homo sapiens
cacctccctgcagctt

SEQ ID NO: 5041313 - DNA, 17 bp, Homo sapiens
cacctgccaggctgcag

SEQ ID NO: 5041314 - DNA, 12 bp, Homo sapiens
cacctgccccag

SEQ ID NO: 5041315 - DNA, 17 bp, Homo sapiens
cacctgccccaggctca

SEQ ID NO: 5041316 - DNA, 14 bp, Homo sapiens
caccttcccagctg

SEQ ID NO: 5041317 - DNA, 14 bp, Homo sapiens
cactctgaccgggc

SEQ ID NO: 5041318 - DNA, 16 bp, Homo sapiens
cactgagaaggcccca

SEQ ID NO: 5041319 - DNA, 19 bp, Homo sapiens
cactgagaaggccccaggg

SEQ ID NO: 5041320 - DNA, 14 bp, Homo sapiens
cactggccggccca

SEQ ID NO: 5041321 - DNA, 21 bp, Homo sapiens
cactggctttgggtagtgcca

SEQ ID NO: 5041322 - DNA, 17 bp, Homo sapiens
cactgtcatgcccagct

SEQ ID NO: 5041323 - DNA, 12 bp, Homo sapiens
cagagcctgggc

SEQ ID NO: 5041324 - DNA, 17 bp, Homo sapiens
cagcctggccccaagca

SEQ ID NO: 5041325 - DNA, 20 bp, Homo sapiens
cagcgcccagcctggcccca

SEQ ID NO: 5041326 - DNA, 23 bp, Homo sapiens
cagcgccctctacctcctagcaa

SEQ ID NO: 5041327 - DNA, 19 bp, Homo sapiens
cagctccggaaggacacag

SEQ ID NO: 5041328 - DNA, 16 bp, Homo sapiens
cagctcctcttcctgc

SEQ ID NO: 5041329 - DNA, 17 bp, Homo sapiens
cagctcctcttcctgcc

SEQ ID NO: 5041330 - DNA, 14 bp, Homo sapiens
cagctgctcctaga

SEQ ID NO: 5041331 - DNA, 17 bp, Homo sapiens
cagcttggagtgccaca

SEQ ID NO: 5041332 - DNA, 15 bp, Homo sapiens
cagctttgaggctgg

SEQ ID NO: 5041333 - DNA, 16 bp, Homo sapiens
cagctttgaggctggc

SEQ ID NO: 5041334 - DNA, 14 bp, Homo sapiens
caggaggcctggga

SEQ ID NO: 5041335 - DNA, 14 bp, Homo sapiens
caggagtgactctg

SEQ ID NO: 5041336 - DNA, 15 bp, Homo sapiens
caggagtgactctgg

SEQ ID NO: 5041337 - DNA, 21 bp, Homo sapiens
caggagtgactctggctgcca

SEQ ID NO: 5041338 - DNA, 23 bp, Homo sapiens
caggagtgactctggctgccaag

SEQ ID NO: 5041339 - DNA, 23 bp, Homo sapiens
caggcaagacaccttcccagctg

SEQ ID NO: 5041340 - DNA, 16 bp, Homo sapiens
caggcggtcactgccc

SEQ ID NO: 5041341 - DNA, 15 bp, Homo sapiens
caggctcaggctgcc

SEQ ID NO: 5041342 - DNA, 17 bp, Homo sapiens
caggctcaggctgccca

SEQ ID NO: 5041343 - DNA, 15 bp, Homo sapiens
cagggacagttgggt

SEQ ID NO: 5041344 - DNA, 16 bp, Homo sapiens
cagggctgggcgcctc

SEQ ID NO: 5041345 - DNA, 15 bp, Homo sapiens
cagggggtttgagga

SEQ ID NO: 5041346 - DNA, 14 bp, Homo sapiens
caggtcagagccca

SEQ ID NO: 5041347 - DNA, 15 bp, Homo sapiens
caggtcagagcccag

SEQ ID NO: 5041348 - DNA, 21 bp, Homo sapiens
caggtgaaatccacaccagtc

SEQ ID NO: 5041349 - DNA, 22 bp, Homo sapiens
caggtggggttttcacttccta

SEQ ID NO: 5041350 - DNA, 15 bp, Homo sapiens
caggttcacccagcg

SEQ ID NO: 5041351 - DNA, 15 bp, Homo sapiens
cagtcagcccagtgg

SEQ ID NO: 5041352 - DNA, 18 bp, Homo sapiens
cagtcctcggcagctccg

SEQ ID NO: 5041353 - DNA, 20 bp, Homo sapiens
cagtgagagcagggctgggc

SEQ ID NO: 5041354 - DNA, 22 bp, Homo sapiens
cagtgagagcagggctgggcgc

SEQ ID NO: 5041355 - DNA, 23 bp, Homo sapiens
cagtgggatcttacccacttccc

SEQ ID NO: 5041356 - DNA, 15 bp, Homo sapiens
catctgtggcctggg

SEQ ID NO: 5041357 - DNA, 21 bp, Homo sapiens
catggccgcaacttcccaggc

SEQ ID NO: 5041358 - DNA, 15 bp, Homo sapiens
catggccgctgccca

SEQ ID NO: 5041359 - DNA, 16 bp, Homo sapiens
catggccgctgcccac

SEQ ID NO: 5041360 - DNA, 21 bp, Homo sapiens
catggccgctgcccacgtccc

SEQ ID NO: 5041361 - DNA, 15 bp, Homo sapiens
ccaccctgtctgcag

SEQ ID NO: 5041362 - DNA, 16 bp, Homo sapiens
ccacctccctgcagct

SEQ ID NO: 5041363 - DNA, 15 bp, Homo sapiens
ccacctgccaggctg

SEQ ID NO: 5041364 - DNA, 14 bp, Homo sapiens
ccacgtctccctgg

SEQ ID NO: 5041365 - DNA, 17 bp, Homo sapiens
ccactgcggaacaggag

SEQ ID NO: 5041366 - DNA, 20 bp, Homo sapiens
ccagacgcggaaaccgggtg

SEQ ID NO: 5041367 - DNA, 18 bp, Homo sapiens
ccagcggctcttcctgga

SEQ ID NO: 5041368 - DNA, 16 bp, Homo sapiens
ccagcttggagtgcca

SEQ ID NO: 5041369 - DNA, 17 bp, Homo sapiens
ccagcttggagtgccac

SEQ ID NO: 5041370 - DNA, 20 bp, Homo sapiens
ccagcttggagtgccacgtg

SEQ ID NO: 5041371 - DNA, 23 bp, Homo sapiens
ccagcttggagtgccacgtggcc

SEQ ID NO: 5041372 - DNA, 16 bp, Homo sapiens
ccaggaattctcacag

SEQ ID NO: 5041373 - DNA, 14 bp, Homo sapiens
ccaggccgaggaag

SEQ ID NO: 5041374 - DNA, 19 bp, Homo sapiens
ccaggcggtcactgcccac

SEQ ID NO: 5041375 - DNA, 16 bp, Homo sapiens
ccaggctcaggctgcc

SEQ ID NO: 5041376 - DNA, 17 bp, Homo sapiens
ccaggctcaggctgccc

SEQ ID NO: 5041377 - DNA, 11 bp, Homo sapiens
ccaggctgcag

SEQ ID NO: 5041378 - DNA, 12 bp, Homo sapiens
ccaggctgcagg

SEQ ID NO: 5041379 - DNA, 14 bp, Homo sapiens
ccatctccgctgtt

SEQ ID NO: 5041380 - DNA, 19 bp, Homo sapiens
ccatctccgctgttttggg

SEQ ID NO: 5041381 - DNA, 14 bp, Homo sapiens
ccatgggctgctgg

SEQ ID NO: 5041382 - DNA, 18 bp, Homo sapiens
cccaccctgtctgcaggc

SEQ ID NO: 5041383 - DNA, 15 bp, Homo sapiens
cccacctgccaggct

SEQ ID NO: 5041384 - DNA, 15 bp, Homo sapiens
cccacgtcccgggca

SEQ ID NO: 5041385 - DNA, 14 bp, Homo sapiens
cccacgtcctgggt

SEQ ID NO: 5041386 - DNA, 15 bp, Homo sapiens
cccacgtcctgggtg

SEQ ID NO: 5041387 - DNA, 16 bp, Homo sapiens
cccagcggctcttcct

SEQ ID NO: 5041388 - DNA, 17 bp, Homo sapiens
cccagctcctcttcctg

SEQ ID NO: 5041389 - DNA, 18 bp, Homo sapiens
cccagctcctcttcctgc

SEQ ID NO: 5041390 - DNA, 13 bp, Homo sapiens
cccagcttggagt

SEQ ID NO: 5041391 - DNA, 14 bp, Homo sapiens
cccatgggctgctg

SEQ ID NO: 5041392 - DNA, 21 bp, Homo sapiens
cccattactcaaaatgcagga

SEQ ID NO: 5041393 - DNA, 13 bp, Homo sapiens
cccccatgggctg

SEQ ID NO: 5041394 - DNA, 18 bp, Homo sapiens
cccctgaactggccccag

SEQ ID NO: 5041395 - DNA, 18 bp, Homo sapiens
cccgagggcgcctgggtc

SEQ ID NO: 5041396 - DNA, 20 bp, Homo sapiens
cccgggcactgtcatgccca

SEQ ID NO: 5041397 - DNA, 22 bp, Homo sapiens
cccgggcactgtcatgcccagc

SEQ ID NO: 5041398 - DNA, 17 bp, Homo sapiens
ccctgaactggccccag

SEQ ID NO: 5041399 - DNA, 18 bp, Homo sapiens
ccctgccagggggtttga

SEQ ID NO: 5041400 - DNA, 18 bp, Homo sapiens
ccctgcgtctcctcgtcc

SEQ ID NO: 5041401 - DNA, 16 bp, Homo sapiens
ccctgcgtctcctgcc

SEQ ID NO: 5041402 - DNA, 12 bp, Homo sapiens
ccctggccccag

SEQ ID NO: 5041403 - DNA, 20 bp, Homo sapiens
ccctggccccagtgaccggg

SEQ ID NO: 5041404 - DNA, 15 bp, Homo sapiens
ccctgtctgcaggcc

SEQ ID NO: 5041405 - DNA, 16 bp, Homo sapiens
ccctgtctgcaggcca

SEQ ID NO: 5041406 - DNA, 16 bp, Homo sapiens
ccgagggcgcctgggt

SEQ ID NO: 5041407 - DNA, 16 bp, Homo sapiens
ccgcaacttcccaggc

SEQ ID NO: 5041408 - DNA, 17 bp, Homo sapiens
ccgcaacttcccaggcc

SEQ ID NO: 5041409 - DNA, 23 bp, Homo sapiens
ccgcaggggcccctcctccagag

SEQ ID NO: 5041410 - DNA, 21 bp, Homo sapiens
ccggagatgcatctgtggcct

SEQ ID NO: 5041411 - DNA, 19 bp, Homo sapiens
ccggctcggcctcttgaga

SEQ ID NO: 5041412 - DNA, 21 bp, Homo sapiens
ccgggcactgtcatgcccagc

SEQ ID NO: 5041413 - DNA, 20 bp, Homo sapiens
ccgggtactcagtcagccca

SEQ ID NO: 5041414 - DNA, 13 bp, Homo sapiens
ccgggtggcagcg

SEQ ID NO: 5041415 - DNA, 21 bp, Homo sapiens
ccgtgggagaggagaggctgc

SEQ ID NO: 5041416 - DNA, 19 bp, Homo sapiens
cctcagtgagatcagtcag

SEQ ID NO: 5041417 - DNA, 18 bp, Homo sapiens
cctccagagcctgggcgc

SEQ ID NO: 5041418 - DNA, 19 bp, Homo sapiens
cctccctgcagctttgagg

SEQ ID NO: 5041419 - DNA, 18 bp, Homo sapiens
cctcggcagctccggaag

SEQ ID NO: 5041420 - DNA, 20 bp, Homo sapiens
cctgaactggccccagctcc

SEQ ID NO: 5041421 - DNA, 16 bp, Homo sapiens
cctgcaaggtgcacct

SEQ ID NO: 5041422 - DNA, 23 bp, Homo sapiens
cctgcaaggtgcacctgccccag

SEQ ID NO: 5041423 - DNA, 15 bp, Homo sapiens
cctgcagaccctgcc

SEQ ID NO: 5041424 - DNA, 18 bp, Homo sapiens
cctgcagaccctgccagg

SEQ ID NO: 5041425 - DNA, 19 bp, Homo sapiens
cctgcagaccctgccaggg

SEQ ID NO: 5041426 - DNA, 14 bp, Homo sapiens
cctgcgtctcctgc

SEQ ID NO: 5041427 - DNA, 15 bp, Homo sapiens
cctggccccagtgac

SEQ ID NO: 5041428 - DNA, 16 bp, Homo sapiens
cctggccccagtgacc

SEQ ID NO: 5041429 - DNA, 17 bp, Homo sapiens
cctgggtcctcccagct

SEQ ID NO: 5041430 - DNA, 15 bp, Homo sapiens
cctgtctgcaggcca

SEQ ID NO: 5041431 - DNA, 21 bp, Homo sapiens
ccttctgatctgagaagacat

SEQ ID NO: 5041432 - DNA, 16 bp, Homo sapiens
cgagggcgcctgggtc

SEQ ID NO: 5041433 - DNA, 21 bp, Homo sapiens
cgcaggggcccctcctccaga

SEQ ID NO: 5041434 - DNA, 15 bp, Homo sapiens
cgcctctgtcctggc

SEQ ID NO: 5041435 - DNA, 14 bp, Homo sapiens
cgctgacttgcaga

SEQ ID NO: 5041436 - DNA, 18 bp, Homo sapiens
cgctgctctcccaggtga

SEQ ID NO: 5041437 - DNA, 13 bp, Homo sapiens
cggaacaggagtg

SEQ ID NO: 5041438 - DNA, 14 bp, Homo sapiens
cggcctgcagaccc

SEQ ID NO: 5041439 - DNA, 15 bp, Homo sapiens
cggctcttcctggac

SEQ ID NO: 5041440 - DNA, 18 bp, Homo sapiens
cggctggaccacgtctcc

SEQ ID NO: 5041441 - DNA, 22 bp, Homo sapiens
cggtcactgcccacctgccagg

SEQ ID NO: 5041442 - DNA, 23 bp, Homo sapiens
cggtcactgcccacctgccaggc

SEQ ID NO: 5041443 - DNA, 20 bp, Homo sapiens
cgtcccgagggcgcctgggt

SEQ ID NO: 5041444 - DNA, 18 bp, Homo sapiens
cgtcccgggcactgtcat

SEQ ID NO: 5041445 - DNA, 12 bp, Homo sapiens
cgtcctgggtgc

SEQ ID NO: 5041446 - DNA, 24 bp, Homo sapiens
cgtcctgggtgctgtcatgcccag

SEQ ID NO: 5041447 - DNA, 16 bp, Homo sapiens
cgtctccctggcccca

SEQ ID NO: 5041448 - DNA, 14 bp, Homo sapiens
cgtggccgctgccc

SEQ ID NO: 5041449 - DNA, 16 bp, Homo sapiens
ctacatttttgtttaa

SEQ ID NO: 5041450 - DNA, 16 bp, Homo sapiens
ctacttagacccagtc

SEQ ID NO: 5041451 - DNA, 17 bp, Homo sapiens
ctagagggatccaccgc

SEQ ID NO: 5041452 - DNA, 13 bp, Homo sapiens
ctcaggctgccca

SEQ ID NO: 5041453 - DNA, 22 bp, Homo sapiens
ctcagtgagatcagtcagctcc

SEQ ID NO: 5041454 - DNA, 20 bp, Homo sapiens
ctcatggcttgggctggagt

SEQ ID NO: 5041455 - DNA, 13 bp, Homo sapiens
ctccctgcagctt

SEQ ID NO: 5041456 - DNA, 14 bp, Homo sapiens
ctccctggccccag

SEQ ID NO: 5041457 - DNA, 16 bp, Homo sapiens
ctccctggccccagtg

SEQ ID NO: 5041458 - DNA, 18 bp, Homo sapiens
ctccctggccccagtgac

SEQ ID NO: 5041459 - DNA, 23 bp, Homo sapiens
ctcctagaggggacaagccaggc

SEQ ID NO: 5041460 - DNA, 19 bp, Homo sapiens
ctcctccagagcctgggcg

SEQ ID NO: 5041461 - DNA, 19 bp, Homo sapiens
ctcgtcccgagggcgcctg

SEQ ID NO: 5041462 - DNA, 23 bp, Homo sapiens
ctcgtcccgagggcgcctgggtc

SEQ ID NO: 5041463 - DNA, 23 bp, Homo sapiens
ctctctgcagtcctcggcagctc

SEQ ID NO: 5041464 - DNA, 15 bp, Homo sapiens
ctctggctgccaaga

SEQ ID NO: 5041465 - DNA, 19 bp, Homo sapiens
ctcttcaccgccgtggggt

SEQ ID NO: 5041466 - DNA, 14 bp, Homo sapiens
ctcttcctgcctct

SEQ ID NO: 5041467 - DNA, 12 bp, Homo sapiens
ctgacttgcaga

SEQ ID NO: 5041468 - DNA, 15 bp, Homo sapiens
ctgagaaggccccag

SEQ ID NO: 5041469 - DNA, 19 bp, Homo sapiens
ctgagaaggccccagggca

SEQ ID NO: 5041470 - DNA, 21 bp, Homo sapiens
ctgagaaggccccagggcagc

SEQ ID NO: 5041471 - DNA, 18 bp, Homo sapiens
ctgcagaccctgccaggg

SEQ ID NO: 5041472 - DNA, 18 bp, Homo sapiens
ctgcagggacagttgggt

SEQ ID NO: 5041473 - DNA, 20 bp, Homo sapiens
ctgcagggacagttgggtgt

SEQ ID NO: 5041474 - DNA, 19 bp, Homo sapiens
ctgcagtcctcggcagctc

SEQ ID NO: 5041475 - DNA, 21 bp, Homo sapiens
ctgcagtcctcggcagctccg

SEQ ID NO: 5041476 - DNA, 22 bp, Homo sapiens
ctgcagtcctcggcagctccgg

SEQ ID NO: 5041477 - DNA, 23 bp, Homo sapiens
ctgccagggggtttgaggaccct

SEQ ID NO: 5041478 - DNA, 14 bp, Homo sapiens
ctgcccacctgcca

SEQ ID NO: 5041479 - DNA, 18 bp, Homo sapiens
ctgcccacctgccaggct

SEQ ID NO: 5041480 - DNA, 18 bp, Homo sapiens
ctgcccacgtcccgggca

SEQ ID NO: 5041481 - DNA, 23 bp, Homo sapiens
ctgcccacgtcccgggcactgtc

SEQ ID NO: 5041482 - DNA, 20 bp, Homo sapiens
ctgcccagcggctcttcctg

SEQ ID NO: 5041483 - DNA, 18 bp, Homo sapiens
ctgccccaggctcaggct

SEQ ID NO: 5041484 - DNA, 18 bp, Homo sapiens
ctgccgctgctctcccag

SEQ ID NO: 5041485 - DNA, 21 bp, Homo sapiens
ctgcggaacaggagtgactct

SEQ ID NO: 5041486 - DNA, 22 bp, Homo sapiens
ctggacagtgagagcagggctg

SEQ ID NO: 5041487 - DNA, 14 bp, Homo sapiens
ctggacctgaccag

SEQ ID NO: 5041488 - DNA, 20 bp, Homo sapiens
ctggatggggcggcctgcag

SEQ ID NO: 5041489 - DNA, 13 bp, Homo sapiens
ctggccccagctc

SEQ ID NO: 5041490 - DNA, 14 bp, Homo sapiens
ctggccccagctcc

SEQ ID NO: 5041491 - DNA, 22 bp, Homo sapiens
ctggccccagctcctcttcctg

SEQ ID NO: 5041492 - DNA, 19 bp, Homo sapiens
ctggccggcccacgtcctg

SEQ ID NO: 5041493 - DNA, 20 bp, Homo sapiens
ctggccggcccacgtcctgg

SEQ ID NO: 5041494 - DNA, 22 bp, Homo sapiens
ctggccggcccacgtcctgggt

SEQ ID NO: 5041495 - DNA, 22 bp, Homo sapiens
ctggcggggtctgctcctggga

SEQ ID NO: 5041496 - DNA, 19 bp, Homo sapiens
ctgggcgcaagcgacacag

SEQ ID NO: 5041497 - DNA, 21 bp, Homo sapiens
ctgtcatgcccagcttggagt

SEQ ID NO: 5041498 - DNA, 18 bp, Homo sapiens
ctgtcctggcccgggagc

SEQ ID NO: 5041499 - DNA, 20 bp, Homo sapiens
ctgtcctggcccgggagccg

SEQ ID NO: 5041500 - DNA, 14 bp, Homo sapiens
ctgtgggtccctgc

SEQ ID NO: 5041501 - DNA, 22 bp, Homo sapiens
ctgtgggtccctgcgtctcctg

SEQ ID NO: 5041502 - DNA, 14 bp, Homo sapiens
cttagacccagtca

SEQ ID NO: 5041503 - DNA, 14 bp, Homo sapiens
cttagggtctgtcc

SEQ ID NO: 5041504 - DNA, 19 bp, Homo sapiens
cttattttcttattttaga

SEQ ID NO: 5041505 - DNA, 14 bp, Homo sapiens
cttccctgcaaggt

SEQ ID NO: 5041506 - DNA, 21 bp, Homo sapiens
cttccctgcaaggtgcacctg

SEQ ID NO: 5041507 - DNA, 22 bp, Homo sapiens
cttcctggacagtgagagcagg

SEQ ID NO: 5041508 - DNA, 13 bp, Homo sapiens
cttcttgggggca

SEQ ID NO: 5041509 - DNA, 22 bp, Homo sapiens
cttggagcgtttttgctggctt

SEQ ID NO: 5041510 - DNA, 20 bp, Homo sapiens
cttggagtgccacatggccg

SEQ ID NO: 5041511 - DNA, 16 bp, Homo sapiens
cttgggggtggggctg

SEQ ID NO: 5041512 - DNA, 19 bp, Homo sapiens
cttgggggtggggctgcat

SEQ ID NO: 5041513 - DNA, 21 bp, Homo sapiens
cttgggggtggggctgcatcc

SEQ ID NO: 5041514 - DNA, 12 bp, Homo sapiens
cttgtgtgaggg

SEQ ID NO: 5041515 - DNA, 14 bp, Homo sapiens
cttgtgtgagggca

SEQ ID NO: 5041516 - DNA, 19 bp, Homo sapiens
ctttccttctgatctgaga

SEQ ID NO: 5041517 - DNA, 21 bp, Homo sapiens
ctttgtaaaccggctggacca

SEQ ID NO: 5041518 - DNA, 15 bp, Homo sapiens
gaaccaggaggcctg

SEQ ID NO: 5041519 - DNA, 13 bp, Homo sapiens
gaactggccccag

SEQ ID NO: 5041520 - DNA, 18 bp, Homo sapiens
gacaccttcccagctgct

SEQ ID NO: 5041521 - DNA, 14 bp, Homo sapiens
gacagttgggtgtg

SEQ ID NO: 5041522 - DNA, 16 bp, Homo sapiens
gaccacgtctccctgg

SEQ ID NO: 5041523 - DNA, 20 bp, Homo sapiens
gaccagactgtgggtccctg

SEQ ID NO: 5041524 - DNA, 19 bp, Homo sapiens
gaccccaccctgtctgcag

SEQ ID NO: 5041525 - DNA, 21 bp, Homo sapiens
gaccccaccctgtctgcaggc

SEQ ID NO: 5041526 - DNA, 13 bp, Homo sapiens
gaccctgccaggg

SEQ ID NO: 5041527 - DNA, 14 bp, Homo sapiens
gactctggctgcca

SEQ ID NO: 5041528 - DNA, 19 bp, Homo sapiens
gactggtcccccatgggct

SEQ ID NO: 5041529 - DNA, 20 bp, Homo sapiens
gagaaggccccagggcagcg

SEQ ID NO: 5041530 - DNA, 22 bp, Homo sapiens
gagatgcatctgtggcctgggg

SEQ ID NO: 5041531 - DNA, 19 bp, Homo sapiens
gagcagggctgggcgcctc

SEQ ID NO: 5041532 - DNA, 16 bp, Homo sapiens
gagcccctccctcctg

SEQ ID NO: 5041533 - DNA, 20 bp, Homo sapiens
gagcccctccctcctgtgtt

SEQ ID NO: 5041534 - DNA, 15 bp, Homo sapiens
gaggaagggcccccg

SEQ ID NO: 5041535 - DNA, 16 bp, Homo sapiens
gaggaagggcccccgg

SEQ ID NO: 5041536 - DNA, 13 bp, Homo sapiens
gagggcgcctggg

SEQ ID NO: 5041537 - DNA, 15 bp, Homo sapiens
gagggcgcctgggtc

SEQ ID NO: 5041538 - DNA, 22 bp, Homo sapiens
gagggcgcctgggtcctcccag

SEQ ID NO: 5041539 - DNA, 23 bp, Homo sapiens
gagtgccacatggccgctgccca

SEQ ID NO: 5041540 - DNA, 14 bp, Homo sapiens
gagtggctcccgtg

SEQ ID NO: 5041541 - DNA, 20 bp, Homo sapiens
gatccaccgccacactggcc

SEQ ID NO: 5041542 - DNA, 22 bp, Homo sapiens
gatgcaggcaagacaccttccc

SEQ ID NO: 5041543 - DNA, 14 bp, Homo sapiens
gcaacttcccaggc

SEQ ID NO: 5041544 - DNA, 16 bp, Homo sapiens
gcaagcgacacaggct

SEQ ID NO: 5041545 - DNA, 19 bp, Homo sapiens
gcaagcgacacaggctgcc

SEQ ID NO: 5041546 - DNA, 14 bp, Homo sapiens
gcacctgccccagg

SEQ ID NO: 5041547 - DNA, 18 bp, Homo sapiens
gcactgtcatgcccagct

SEQ ID NO: 5041548 - DNA, 21 bp, Homo sapiens
gcactgtcatgcccagcttgg

SEQ ID NO: 5041549 - DNA, 14 bp, Homo sapiens
gcagaccagagagc

SEQ ID NO: 5041550 - DNA, 15 bp, Homo sapiens
gcagcgcccagcctg

SEQ ID NO: 5041551 - DNA, 17 bp, Homo sapiens
gcagcgcccagcctggc

SEQ ID NO: 5041552 - DNA, 21 bp, Homo sapiens
gcagctccggaaggacacagt

SEQ ID NO: 5041553 - DNA, 21 bp, Homo sapiens
gcagctggatggggcggcctg

SEQ ID NO: 5041554 - DNA, 20 bp, Homo sapiens
gcaggcaagacaccttccca

SEQ ID NO: 5041555 - DNA, 22 bp, Homo sapiens
gcaggcaagacaccttcccagc

SEQ ID NO: 5041556 - DNA, 20 bp, Homo sapiens
gcaggggcccctcctccaga

SEQ ID NO: 5041557 - DNA, 15 bp, Homo sapiens
gcagtaaatccacag

SEQ ID NO: 5041558 - DNA, 17 bp, Homo sapiens
gcatctgtggcctgggg

SEQ ID NO: 5041559 - DNA, 18 bp, Homo sapiens
gccacatggccgctgccc

SEQ ID NO: 5041560 - DNA, 15 bp, Homo sapiens
gccacgtggccgctg

SEQ ID NO: 5041561 - DNA, 13 bp, Homo sapiens
gccaggccctctc

SEQ ID NO: 5041562 - DNA, 17 bp, Homo sapiens
gccaggccctctctgca

SEQ ID NO: 5041563 - DNA, 12 bp, Homo sapiens
gccaggctgcag

SEQ ID NO: 5041564 - DNA, 14 bp, Homo sapiens
gccaggctgcaggg

SEQ ID NO: 5041565 - DNA, 16 bp, Homo sapiens
gccaggctgcagggac

SEQ ID NO: 5041566 - DNA, 17 bp, Homo sapiens
gccaggctgcagggaca

SEQ ID NO: 5041567 - DNA, 18 bp, Homo sapiens
gcccacctgccaggctgc

SEQ ID NO: 5041568 - DNA, 19 bp, Homo sapiens
gcccacctgccaggctgca

SEQ ID NO: 5041569 - DNA, 23 bp, Homo sapiens
gcccacctgccaggctgcaggga

SEQ ID NO: 5041570 - DNA, 16 bp, Homo sapiens
gcccacgtcccgggca

SEQ ID NO: 5041571 - DNA, 16 bp, Homo sapiens
gcccacgtcctgggtg

SEQ ID NO: 5041572 - DNA, 22 bp, Homo sapiens
gcccacgtcctgggtgctgtca

SEQ ID NO: 5041573 - DNA, 23 bp, Homo sapiens
gcccacgtcctgggtgctgtcat

SEQ ID NO: 5041574 - DNA, 14 bp, Homo sapiens
gcccactctgaccg

SEQ ID NO: 5041575 - DNA, 20 bp, Homo sapiens
gcccagcggctcttcctgga

SEQ ID NO: 5041576 - DNA, 17 bp, Homo sapiens
gcccagcttggagtgcc

SEQ ID NO: 5041577 - DNA, 15 bp, Homo sapiens
gcccaggcggtcact

SEQ ID NO: 5041578 - DNA, 23 bp, Homo sapiens
gccccacccctgaactggcccca

SEQ ID NO: 5041579 - DNA, 16 bp, Homo sapiens
gccccagctcctcttc

SEQ ID NO: 5041580 - DNA, 22 bp, Homo sapiens
gccccaggctcaggctgcccag

SEQ ID NO: 5041581 - DNA, 12 bp, Homo sapiens
gccccagggcag

SEQ ID NO: 5041582 - DNA, 22 bp, Homo sapiens
gcccggagatgcatctgtggcc

SEQ ID NO: 5041583 - DNA, 14 bp, Homo sapiens
gccctctctgcagt

SEQ ID NO: 5041584 - DNA, 22 bp, Homo sapiens
gccctctctgcagtcctcggca

SEQ ID NO: 5041585 - DNA, 14 bp, Homo sapiens
gccgctgcccacgt

SEQ ID NO: 5041586 - DNA, 19 bp, Homo sapiens
gccggcccacgtcctgggt

SEQ ID NO: 5041587 - DNA, 14 bp, Homo sapiens
gcctctgtcctggc

SEQ ID NO: 5041588 - DNA, 18 bp, Homo sapiens
gcctcttgagagccccac

SEQ ID NO: 5041589 - DNA, 19 bp, Homo sapiens
gcctgggagatgcagctgg

SEQ ID NO: 5041590 - DNA, 12 bp, Homo sapiens
gcctgggtcctc

SEQ ID NO: 5041591 - DNA, 20 bp, Homo sapiens
gcggaaaccgggtggcagcg

SEQ ID NO: 5041592 - DNA, 14 bp, Homo sapiens
gcggcctgcagacc

SEQ ID NO: 5041593 - DNA, 21 bp, Homo sapiens
gcggcctgcagaccctgccag

SEQ ID NO: 5041594 - DNA, 14 bp, Homo sapiens
gcggctcttcctgg

SEQ ID NO: 5041595 - DNA, 15 bp, Homo sapiens
gcggtcactgcccac

SEQ ID NO: 5041596 - DNA, 16 bp, Homo sapiens
gctagtctgtgcctca

SEQ ID NO: 5041597 - DNA, 13 bp, Homo sapiens
gctcaggctgccc

SEQ ID NO: 5041598 - DNA, 20 bp, Homo sapiens
gctccgagtggctcccgtgt

SEQ ID NO: 5041599 - DNA, 13 bp, Homo sapiens
gctcggcctcttg

SEQ ID NO: 5041600 - DNA, 23 bp, Homo sapiens
gctcggcctcttgagagccccac

SEQ ID NO: 5041601 - DNA, 12 bp, Homo sapiens
gctctcccaggt

SEQ ID NO: 5041602 - DNA, 19 bp, Homo sapiens
gctgagcccctccctcctg

SEQ ID NO: 5041603 - DNA, 16 bp, Homo sapiens
gctgcccagcggctct

SEQ ID NO: 5041604 - DNA, 20 bp, Homo sapiens
gctgcccagcggctcttcct

SEQ ID NO: 5041605 - DNA, 14 bp, Homo sapiens
gctgccgctgctct

SEQ ID NO: 5041606 - DNA, 14 bp, Homo sapiens
gctgctctcccagg

SEQ ID NO: 5041607 - DNA, 18 bp, Homo sapiens
gctggagtgggctctctg

SEQ ID NO: 5041608 - DNA, 19 bp, Homo sapiens
gctgggcgcctctgtcctg

SEQ ID NO: 5041609 - DNA, 21 bp, Homo sapiens
gctgtcatgcccagcttggag

SEQ ID NO: 5041610 - DNA, 20 bp, Homo sapiens
ggaatggggtgggagccaca

SEQ ID NO: 5041611 - DNA, 13 bp, Homo sapiens
ggaccctcccagg

SEQ ID NO: 5041612 - DNA, 22 bp, Homo sapiens
ggaccctcccaggtttcccact

SEQ ID NO: 5041613 - DNA, 19 bp, Homo sapiens
ggagatgcatctgtggcct

SEQ ID NO: 5041614 - DNA, 22 bp, Homo sapiens
ggagatgcatctgtggcctggg

SEQ ID NO: 5041615 - DNA, 14 bp, Homo sapiens
ggagccacagggac

SEQ ID NO: 5041616 - DNA, 13 bp, Homo sapiens
ggaggcctgggag

SEQ ID NO: 5041617 - DNA, 14 bp, Homo sapiens
ggagtgactctggc

SEQ ID NO: 5041618 - DNA, 20 bp, Homo sapiens
ggagtgactctggctgccaa

SEQ ID NO: 5041619 - DNA, 22 bp, Homo sapiens
ggagtgactctggctgccaaga

SEQ ID NO: 5041620 - DNA, 12 bp, Homo sapiens
ggagtgccacat

SEQ ID NO: 5041621 - DNA, 17 bp, Homo sapiens
ggatcttacccacttcc

SEQ ID NO: 5041622 - DNA, 22 bp, Homo sapiens
ggatcttacccacttccctgca

SEQ ID NO: 5041623 - DNA, 17 bp, Homo sapiens
ggcaaaccaggctgcag

SEQ ID NO: 5041624 - DNA, 19 bp, Homo sapiens
ggcaaaccaggctgcaggt

SEQ ID NO: 5041625 - DNA, 20 bp, Homo sapiens
ggcactgtcatgcccagctt

SEQ ID NO: 5041626 - DNA, 15 bp, Homo sapiens
ggcagaccagagagc

SEQ ID NO: 5041627 - DNA, 18 bp, Homo sapiens
ggcagaccagagagctca

SEQ ID NO: 5041628 - DNA, 23 bp, Homo sapiens
ggcagcgcccagcctggccccaa

SEQ ID NO: 5041629 - DNA, 21 bp, Homo sapiens
ggccacccccacctccctgca

SEQ ID NO: 5041630 - DNA, 12 bp, Homo sapiens
ggccccagctcc

SEQ ID NO: 5041631 - DNA, 19 bp, Homo sapiens
ggccggcccacgtcctggg

SEQ ID NO: 5041632 - DNA, 19 bp, Homo sapiens
ggcctcttgagagccccac

SEQ ID NO: 5041633 - DNA, 18 bp, Homo sapiens
ggcgcctgggtcctccca

SEQ ID NO: 5041634 - DNA, 18 bp, Homo sapiens
ggcggcctgcagaccctg

SEQ ID NO: 5041635 - DNA, 16 bp, Homo sapiens
ggcggtcactgcccac

SEQ ID NO: 5041636 - DNA, 13 bp, Homo sapiens
ggctcaggctgcc

SEQ ID NO: 5041637 - DNA, 14 bp, Homo sapiens
ggctcggcctcttg

SEQ ID NO: 5041638 - DNA, 15 bp, Homo sapiens
ggctctctggacctg

SEQ ID NO: 5041639 - DNA, 21 bp, Homo sapiens
ggctctctggacctgaccaga

SEQ ID NO: 5041640 - DNA, 15 bp, Homo sapiens
ggctgatgtcttctt

SEQ ID NO: 5041641 - DNA, 20 bp, Homo sapiens
ggctgatgtcttcttggggg

SEQ ID NO: 5041642 - DNA, 23 bp, Homo sapiens
ggctgcccagcggctcttcctgg

SEQ ID NO: 5041643 - DNA, 20 bp, Homo sapiens
ggctgccgctgctctcccag

SEQ ID NO: 5041644 - DNA, 21 bp, Homo sapiens
ggctgccgctgctctcccagg

SEQ ID NO: 5041645 - DNA, 20 bp, Homo sapiens
ggctgctggaaaggcccgga

SEQ ID NO: 5041646 - DNA, 12 bp, Homo sapiens
ggctgctgtcac

SEQ ID NO: 5041647 - DNA, 14 bp, Homo sapiens
ggctggagtgggct

SEQ ID NO: 5041648 - DNA, 20 bp, Homo sapiens
ggctggcggggtctgctcct

SEQ ID NO: 5041649 - DNA, 22 bp, Homo sapiens
ggctgggcgcctctgtcctggc

SEQ ID NO: 5041650 - DNA, 19 bp, Homo sapiens
ggcttcctccctccacgct

SEQ ID NO: 5041651 - DNA, 19 bp, Homo sapiens
gggaagctgagcccctccc

SEQ ID NO: 5041652 - DNA, 20 bp, Homo sapiens
gggaagctgagcccctccct

SEQ ID NO: 5041653 - DNA, 19 bp, Homo sapiens
gggagccgcaggggcccct

SEQ ID NO: 5041654 - DNA, 20 bp, Homo sapiens
gggatccaccgccacactgg

SEQ ID NO: 5041655 - DNA, 19 bp, Homo sapiens
gggatcttacccacttccc

SEQ ID NO: 5041656 - DNA, 21 bp, Homo sapiens
gggcgcaagcgacacaggctg

SEQ ID NO: 5041657 - DNA, 13 bp, Homo sapiens
gggcgcctgggtc

SEQ ID NO: 5041658 - DNA, 15 bp, Homo sapiens
gggcggcctgcagac

SEQ ID NO: 5041659 - DNA, 15 bp, Homo sapiens
gggctctctggacct

SEQ ID NO: 5041660 - DNA, 12 bp, Homo sapiens
ggggatgcaggc

SEQ ID NO: 5041661 - DNA, 17 bp, Homo sapiens
gggtactcagtcagccc

SEQ ID NO: 5041662 - DNA, 22 bp, Homo sapiens
gggtccctgcgtctcctgccca

SEQ ID NO: 5041663 - DNA, 14 bp, Homo sapiens
gggtcgcctgccct

SEQ ID NO: 5041664 - DNA, 15 bp, Homo sapiens
gggtctgtcccgggt

SEQ ID NO: 5041665 - DNA, 19 bp, Homo sapiens
gggtcttagggtacagccc

SEQ ID NO: 5041666 - DNA, 19 bp, Homo sapiens
gggtgggagccacagggac

SEQ ID NO: 5041667 - DNA, 15 bp, Homo sapiens
gggttttcacttcct

SEQ ID NO: 5041668 - DNA, 18 bp, Homo sapiens
ggtactcagtcagcccag

SEQ ID NO: 5041669 - DNA, 23 bp, Homo sapiens
ggtctgtcccgggtactcagtca

SEQ ID NO: 5041670 - DNA, 19 bp, Homo sapiens
ggtgcacctgccccaggct

SEQ ID NO: 5041671 - DNA, 18 bp, Homo sapiens
ggtgctgtcatgcccagc

SEQ ID NO: 5041672 - DNA, 15 bp, Homo sapiens
ggtggcagcgcccag

SEQ ID NO: 5041673 - DNA, 18 bp, Homo sapiens
ggtggcagcgcccagcct

SEQ ID NO: 5041674 - DNA, 19 bp, Homo sapiens
ggtgggagccacagggacg

SEQ ID NO: 5041675 - DNA, 14 bp, Homo sapiens
ggttttcacttcct

SEQ ID NO: 5041676 - DNA, 14 bp, Homo sapiens
gtacagcccaggcg

SEQ ID NO: 5041677 - DNA, 12 bp, Homo sapiens
gtcactgcccac

SEQ ID NO: 5041678 - DNA, 15 bp, Homo sapiens
gtcactgcccacctg

SEQ ID NO: 5041679 - DNA, 20 bp, Homo sapiens
gtcactgcccacctgccagg

SEQ ID NO: 5041680 - DNA, 23 bp, Homo sapiens
gtcactggtaccggatgcagacc

SEQ ID NO: 5041681 - DNA, 14 bp, Homo sapiens
gtcagagcccagga

SEQ ID NO: 5041682 - DNA, 15 bp, Homo sapiens
gtcatgcccagcttg

SEQ ID NO: 5041683 - DNA, 22 bp, Homo sapiens
gtcccgggtactcagtcagccc

SEQ ID NO: 5041684 - DNA, 15 bp, Homo sapiens
gtcctcccagctgac

SEQ ID NO: 5041685 - DNA, 23 bp, Homo sapiens
gtcctggcccgggagccgcaggg

SEQ ID NO: 5041686 - DNA, 10 bp, Homo sapiens
gtcctgggtg

SEQ ID NO: 5041687 - DNA, 17 bp, Homo sapiens
gtcctgggtgctgtcat

SEQ ID NO: 5041688 - DNA, 20 bp, Homo sapiens
gtctccctacttagacccag

SEQ ID NO: 5041689 - DNA, 15 bp, Homo sapiens
gtctccctggcccca

SEQ ID NO: 5041690 - DNA, 15 bp, Homo sapiens
gtctcctgcccactc

SEQ ID NO: 5041691 - DNA, 14 bp, Homo sapiens
gtctgctcctggga

SEQ ID NO: 5041692 - DNA, 15 bp, Homo sapiens
gtctgctcctgggaa

SEQ ID NO: 5041693 - DNA, 12 bp, Homo sapiens
gtcttctccatc

SEQ ID NO: 5041694 - DNA, 13 bp, Homo sapiens
gtgacaggcagtg

SEQ ID NO: 5041695 - DNA, 20 bp, Homo sapiens
gtgaccgggggaagctgagc

SEQ ID NO: 5041696 - DNA, 15 bp, Homo sapiens
gtgactctggctgcc

SEQ ID NO: 5041697 - DNA, 18 bp, Homo sapiens
gtgactctggctgccaag

SEQ ID NO: 5041698 - DNA, 13 bp, Homo sapiens
gtgagatcagtca

SEQ ID NO: 5041699 - DNA, 17 bp, Homo sapiens
gtgagatcagtcagctc

SEQ ID NO: 5041700 - DNA, 17 bp, Homo sapiens
gtgccacgtggccgctg

SEQ ID NO: 5041701 - DNA, 21 bp, Homo sapiens
gtgccacgtggccgctgccca

SEQ ID NO: 5041702 - DNA, 15 bp, Homo sapiens
gtgccatggccagga

SEQ ID NO: 5041703 - DNA, 17 bp, Homo sapiens
gtgctgtcatgcccagc

SEQ ID NO: 5041704 - DNA, 21 bp, Homo sapiens
gtgctgtcatgcccagcttgg

SEQ ID NO: 5041705 - DNA, 19 bp, Homo sapiens
gtggcagcgcccagcctgg

SEQ ID NO: 5041706 - DNA, 21 bp, Homo sapiens
gtgggatcttacccacttccc

SEQ ID NO: 5041707 - DNA, 24 bp, Homo sapiens
gtgggctctctggacctgaccaga

SEQ ID NO: 5041708 - DNA, 19 bp, Homo sapiens
gttggctagtctgtgcctc

SEQ ID NO: 5041709 - DNA, 18 bp, Homo sapiens
gtttgaggaccctcccag

SEQ ID NO: 5041710 - DNA, 18 bp, Homo sapiens
taacacctcttttccctt

SEQ ID NO: 5041711 - DNA, 15 bp, Homo sapiens
tacccacttccctgc

SEQ ID NO: 5041712 - DNA, 17 bp, Homo sapiens
tagaggggacaagccag

SEQ ID NO: 5041713 - DNA, 16 bp, Homo sapiens
tcaccgccgtggggtg

SEQ ID NO: 5041714 - DNA, 19 bp, Homo sapiens
tcactgagaaggccccagg

SEQ ID NO: 5041715 - DNA, 20 bp, Homo sapiens
tcactgagaaggccccaggg

SEQ ID NO: 5041716 - DNA, 11 bp, Homo sapiens
tcactgcccac

SEQ ID NO: 5041717 - DNA, 20 bp, Homo sapiens
tcactgcccacctgccaggc

SEQ ID NO: 5041718 - DNA, 12 bp, Homo sapiens
tcagagcccagg

SEQ ID NO: 5041719 - DNA, 16 bp, Homo sapiens
tcaggctgcccagcgg

SEQ ID NO: 5041720 - DNA, 21 bp, Homo sapiens
tcaggctgcccagcggctctt

SEQ ID NO: 5041721 - DNA, 17 bp, Homo sapiens
tcaggtcagagcccagg

SEQ ID NO: 5041722 - DNA, 19 bp, Homo sapiens
tcaggtcagagcccaggaa

SEQ ID NO: 5041723 - DNA, 20 bp, Homo sapiens
tcaggtcagagcccaggaat

SEQ ID NO: 5041724 - DNA, 15 bp, Homo sapiens
tcatgcccagcttgg

SEQ ID NO: 5041725 - DNA, 19 bp, Homo sapiens
tccagcaggtgttttcctt

SEQ ID NO: 5041726 - DNA, 17 bp, Homo sapiens
tcccagctgctcctaga

SEQ ID NO: 5041727 - DNA, 22 bp, Homo sapiens
tcccattactcaaaatgcagga

SEQ ID NO: 5041728 - DNA, 18 bp, Homo sapiens
tcccgagggcgcctgggt

SEQ ID NO: 5041729 - DNA, 20 bp, Homo sapiens
tcccgtgtcgtaacagcagg

SEQ ID NO: 5041730 - DNA, 21 bp, Homo sapiens
tcccgtgtcgtaacagcagga

SEQ ID NO: 5041731 - DNA, 21 bp, Homo sapiens
tccctccacgcttagggtctg

SEQ ID NO: 5041732 - DNA, 12 bp, Homo sapiens
tccctgcaaggt

SEQ ID NO: 5041733 - DNA, 14 bp, Homo sapiens
tccctgcaaggtgc

SEQ ID NO: 5041734 - DNA, 11 bp, Homo sapiens
tccctgcagct

SEQ ID NO: 5041735 - DNA, 12 bp, Homo sapiens
tccctgcagctt

SEQ ID NO: 5041736 - DNA, 17 bp, Homo sapiens
tccctgcgtctcctgcc

SEQ ID NO: 5041737 - DNA, 20 bp, Homo sapiens
tcctcttcctgcctctctca

SEQ ID NO: 5041738 - DNA, 18 bp, Homo sapiens
tcctggacagtgagagca

SEQ ID NO: 5041739 - DNA, 18 bp, Homo sapiens
tctcacaggttcacccag

SEQ ID NO: 5041740 - DNA, 13 bp, Homo sapiens
tctcccaggtgaa

SEQ ID NO: 5041741 - DNA, 14 bp, Homo sapiens
tctccctggcccca

SEQ ID NO: 5041742 - DNA, 23 bp, Homo sapiens
tctctcatggcttgggctggagt

SEQ ID NO: 5041743 - DNA, 13 bp, Homo sapiens
tctctggacctga

SEQ ID NO: 5041744 - DNA, 13 bp, Homo sapiens
tctgctcctggga

SEQ ID NO: 5041745 - DNA, 17 bp, Homo sapiens
tctgtgcctcagtgaga

SEQ ID NO: 5041746 - DNA, 14 bp, Homo sapiens
tcttagggtacagc

SEQ ID NO: 5041747 - DNA, 23 bp, Homo sapiens
tcttgggggcagaccagagagct

SEQ ID NO: 5041748 - DNA, 20 bp, Homo sapiens
tgacaggcagtgttcttggg

SEQ ID NO: 5041749 - DNA, 16 bp, Homo sapiens
tgactctggctgccaa

SEQ ID NO: 5041750 - DNA, 17 bp, Homo sapiens
tgactctggctgccaag

SEQ ID NO: 5041751 - DNA, 17 bp, Homo sapiens
tgactggtcccccatgg

SEQ ID NO: 5041752 - DNA, 16 bp, Homo sapiens
tgagaaggccccaggg

SEQ ID NO: 5041753 - DNA, 20 bp, Homo sapiens
tgagcccctccctcctgtgt

SEQ ID NO: 5041754 - DNA, 19 bp, Homo sapiens
tgagggcaaaccaggctgc

SEQ ID NO: 5041755 - DNA, 16 bp, Homo sapiens
tgcaaggtgcacctgc

SEQ ID NO: 5041756 - DNA, 12 bp, Homo sapiens
tgcagaccctgc

SEQ ID NO: 5041757 - DNA, 17 bp, Homo sapiens
tgcagaccctgccaggg

SEQ ID NO: 5041758 - DNA, 15 bp, Homo sapiens
tgcaggacagatcag

SEQ ID NO: 5041759 - DNA, 20 bp, Homo sapiens
tgcaggcaagacaccttccc

SEQ ID NO: 5041760 - DNA, 18 bp, Homo sapiens
tgcatctgtggcctgggg

SEQ ID NO: 5041761 - DNA, 19 bp, Homo sapiens
tgcatctgtggcctggggc

SEQ ID NO: 5041762 - DNA, 21 bp, Homo sapiens
tgccacatggccgctgcccac

SEQ ID NO: 5041763 - DNA, 17 bp, Homo sapiens
tgccaggctgcagggac

SEQ ID NO: 5041764 - DNA, 19 bp, Homo sapiens
tgccaggctgcagggacag

SEQ ID NO: 5041765 - DNA, 23 bp, Homo sapiens
tgccagggggtttgaggaccctc

SEQ ID NO: 5041766 - DNA, 17 bp, Homo sapiens
tgcccacctgccaggct

SEQ ID NO: 5041767 - DNA, 18 bp, Homo sapiens
tgcccacctgccaggctg

SEQ ID NO: 5041768 - DNA, 16 bp, Homo sapiens
tgcccacgtcccgggc

SEQ ID NO: 5041769 - DNA, 18 bp, Homo sapiens
tgcccactctgaccgggc

SEQ ID NO: 5041770 - DNA, 15 bp, Homo sapiens
tgcccagcttggagt

SEQ ID NO: 5041771 - DNA, 18 bp, Homo sapiens
tgccgctgctctcccagg

SEQ ID NO: 5041772 - DNA, 13 bp, Homo sapiens
tgctctcccaggt

SEQ ID NO: 5041773 - DNA, 14 bp, Homo sapiens
tgctgtcatgccca

SEQ ID NO: 5041774 - DNA, 17 bp, Homo sapiens
tgctgtcatgcccagct

SEQ ID NO: 5041775 - DNA, 17 bp, Homo sapiens
tgctgtgacaggcagtg

SEQ ID NO: 5041776 - DNA, 13 bp, Homo sapiens
tggacctgaccag

SEQ ID NO: 5041777 - DNA, 20 bp, Homo sapiens
tggagcgtttttgctggctt

SEQ ID NO: 5041778 - DNA, 20 bp, Homo sapiens
tggccgcaacttcccaggcc

SEQ ID NO: 5041779 - DNA, 20 bp, Homo sapiens
tggccgctgctgtgacaggc

SEQ ID NO: 5041780 - DNA, 19 bp, Homo sapiens
tggcggggtctgctcctgg

SEQ ID NO: 5041781 - DNA, 15 bp, Homo sapiens
tggctagtctgtgcc

SEQ ID NO: 5041782 - DNA, 15 bp, Homo sapiens
tgggagaggagaggc

SEQ ID NO: 5041783 - DNA, 19 bp, Homo sapiens
tgggagaggagaggctgct

SEQ ID NO: 5041784 - DNA, 14 bp, Homo sapiens
tgggagatgcagct

SEQ ID NO: 5041785 - DNA, 15 bp, Homo sapiens
tgggagatgcagctg

SEQ ID NO: 5041786 - DNA, 17 bp, Homo sapiens
tgggagatgcagctgga

SEQ ID NO: 5041787 - DNA, 13 bp, Homo sapiens
tgggagccacagg

SEQ ID NO: 5041788 - DNA, 22 bp, Homo sapiens
tgggcgcctctgtcctggcccg

SEQ ID NO: 5041789 - DNA, 23 bp, Homo sapiens
tgggctctctggacctgaccaga

SEQ ID NO: 5041790 - DNA, 14 bp, Homo sapiens
tgggctggagtggg

SEQ ID NO: 5041791 - DNA, 18 bp, Homo sapiens
tggggtgggagccacagg

SEQ ID NO: 5041792 - DNA, 18 bp, Homo sapiens
tggggttttcacttccta

SEQ ID NO: 5041793 - DNA, 19 bp, Homo sapiens
tggggttttcacttcctag

SEQ ID NO: 5041794 - DNA, 16 bp, Homo sapiens
tgggtagtgccatggc

SEQ ID NO: 5041795 - DNA, 16 bp, Homo sapiens
tgggtcctcccagctg

SEQ ID NO: 5041796 - DNA, 19 bp, Homo sapiens
tgtcatgcccagcttggag

SEQ ID NO: 5041797 - DNA, 13 bp, Homo sapiens
tgtgggtccctgc

SEQ ID NO: 5041798 - DNA, 17 bp, Homo sapiens
tgtttaatacgcttgag

SEQ ID NO: 5041799 - DNA, 17 bp, Homo sapiens
tgtttctttccttctga

SEQ ID NO: 5041800 - DNA, 14 bp, Homo sapiens
tgttttccttcaca

SEQ ID NO: 5041801 - DNA, 19 bp, Homo sapiens
ttagggtacagcccaggcg

SEQ ID NO: 5041802 - DNA, 13 bp, Homo sapiens
ttagggtctgtcc

SEQ ID NO: 5041803 - DNA, 18 bp, Homo sapiens
ttcccagctgctcctaga

SEQ ID NO: 5041804 - DNA, 16 bp, Homo sapiens
ttcctggacagtgaga

SEQ ID NO: 5041805 - DNA, 17 bp, Homo sapiens
ttcctggacagtgagag

SEQ ID NO: 5041806 - DNA, 16 bp, Homo sapiens
ttgaagggggatgcag

SEQ ID NO: 5041807 - DNA, 23 bp, Homo sapiens
ttggagtgccacatggccgctgc

SEQ ID NO: 5041808 - DNA, 16 bp, Homo sapiens
ttggctagtctgtgcc

SEQ ID NO: 5041809 - DNA, 12 bp, Homo sapiens
ttgggggcagac

SEQ ID NO: 5041810 - DNA, 17 bp, Homo sapiens
ttgtcttgatcctcact

SEQ ID NO: 5041811 - DNA, 17 bp, Homo sapiens
tttgaggaccctcccag

SEQ ID NO: 5041812 - DNA, 13 bp, Homo sapiens
aaacaagcgccac

SEQ ID NO: 5041813 - DNA, 15 bp, Homo sapiens
aaaccaggctgcagg

SEQ ID NO: 5041814 - DNA, 16 bp, Homo sapiens
aaaccaggctgcaggt

SEQ ID NO: 5041815 - DNA, 15 bp, Homo sapiens
aaagaaccaggaggc

SEQ ID NO: 5041816 - DNA, 17 bp, Homo sapiens
aaccaggaggcctggga

SEQ ID NO: 5041817 - DNA, 18 bp, Homo sapiens
aagcgacacaggctgccg

SEQ ID NO: 5041818 - DNA, 21 bp, Homo sapiens
aaggtgcacctgccccaggct

SEQ ID NO: 5041819 - DNA, 23 bp, Homo sapiens
aatgttggctagtctgtgcctca

SEQ ID NO: 5041820 - DNA, 18 bp, Homo sapiens
acactggccggcccacgt

SEQ ID NO: 5041821 - DNA, 17 bp, Homo sapiens
acagcaggagcatggcc

SEQ ID NO: 5041822 - DNA, 22 bp, Homo sapiens
acagcccaggcggtcactgccc

SEQ ID NO: 5041823 - DNA, 20 bp, Homo sapiens
acagccccaaacaagcgcca

SEQ ID NO: 5041824 - DNA, 16 bp, Homo sapiens
accacgtctccctggc

SEQ ID NO: 5041825 - DNA, 18 bp, Homo sapiens
accagactgtgggtccct

SEQ ID NO: 5041826 - DNA, 15 bp, Homo sapiens
accaggaggcctggg

SEQ ID NO: 5041827 - DNA, 18 bp, Homo sapiens
accaggaggcctgggaga

SEQ ID NO: 5041828 - DNA, 15 bp, Homo sapiens
acccacttccctgca

SEQ ID NO: 5041829 - DNA, 18 bp, Homo sapiens
acccacttccctgcaagg

SEQ ID NO: 5041830 - DNA, 19 bp, Homo sapiens
acccacttccctgcaaggt

SEQ ID NO: 5041831 - DNA, 17 bp, Homo sapiens
accccaccctgtctgca

SEQ ID NO: 5041832 - DNA, 16 bp, Homo sapiens
accctgccagggggtt

SEQ ID NO: 5041833 - DNA, 15 bp, Homo sapiens
accctgtctgcaggc

SEQ ID NO: 5041834 - DNA, 14 bp, Homo sapiens
acctccctgcagct

SEQ ID NO: 5041835 - DNA, 15 bp, Homo sapiens
acctccctgcagctt

SEQ ID NO: 5041836 - DNA, 14 bp, Homo sapiens
acctgaccagactg

SEQ ID NO: 5041837 - DNA, 11 bp, Homo sapiens
acctgccaggc

SEQ ID NO: 5041838 - DNA, 16 bp, Homo sapiens
acctgccaggctgcag

SEQ ID NO: 5041839 - DNA, 18 bp, Homo sapiens
acctgccaggctgcaggg

SEQ ID NO: 5041840 - DNA, 13 bp, Homo sapiens
acctgccccaggc

SEQ ID NO: 5041841 - DNA, 23 bp, Homo sapiens
acggcagtaaatccacagtgagt

SEQ ID NO: 5041842 - DNA, 20 bp, Homo sapiens
acgtggccgctgctgtgaca

SEQ ID NO: 5041843 - DNA, 16 bp, Homo sapiens
actctggctgccaaga

SEQ ID NO: 5041844 - DNA, 15 bp, Homo sapiens
actgcccacctgcca

SEQ ID NO: 5041845 - DNA, 17 bp, Homo sapiens
actgcccacctgccagg

SEQ ID NO: 5041846 - DNA, 15 bp, Homo sapiens
actggccccagctcc

SEQ ID NO: 5041847 - DNA, 20 bp, Homo sapiens
actggtcccccatgggctgc

SEQ ID NO: 5041848 - DNA, 15 bp, Homo sapiens
actgtcatgcccagc

SEQ ID NO: 5041849 - DNA, 16 bp, Homo sapiens
actgtcatgcccagct

SEQ ID NO: 5041850 - DNA, 19 bp, Homo sapiens
actgtcatgcccagcttgg

SEQ ID NO: 5041851 - DNA, 18 bp, Homo sapiens
actgtgggtccctgcgtc

SEQ ID NO: 5041852 - DNA, 15 bp, Homo sapiens
acttagacccagtca

SEQ ID NO: 5041853 - DNA, 12 bp, Homo sapiens
acttcccaggcc

SEQ ID NO: 5041854 - DNA, 18 bp, Homo sapiens
actttggccacagcccca

SEQ ID NO: 5041855 - DNA, 16 bp, Homo sapiens
agacaccttcccagct

SEQ ID NO: 5041856 - DNA, 12 bp, Homo sapiens
agagagctcaag

SEQ ID NO: 5041857 - DNA, 23 bp, Homo sapiens
agagagctcaagtttcagagtca

SEQ ID NO: 5041858 - DNA, 14 bp, Homo sapiens
agaggagaggctgc

SEQ ID NO: 5041859 - DNA, 13 bp, Homo sapiens
agaggctgctgtc

SEQ ID NO: 5041860 - DNA, 20 bp, Homo sapiens
agatcaggtcagagcccagg

SEQ ID NO: 5041861 - DNA, 21 bp, Homo sapiens
agatcaggtcagagcccagga

SEQ ID NO: 5041862 - DNA, 16 bp, Homo sapiens
agatgcagctggatgg

SEQ ID NO: 5041863 - DNA, 20 bp, Homo sapiens
agatgcatctgtggcctggg

SEQ ID NO: 5041864 - DNA, 16 bp, Homo sapiens
agcaggagcatggccg

SEQ ID NO: 5041865 - DNA, 15 bp, Homo sapiens
agcagggctgggcgc

SEQ ID NO: 5041866 - DNA, 20 bp, Homo sapiens
agcccaggaattctcacagg

SEQ ID NO: 5041867 - DNA, 14 bp, Homo sapiens
agcctggccccaag

SEQ ID NO: 5041868 - DNA, 13 bp, Homo sapiens
agcgacacaggct

SEQ ID NO: 5041869 - DNA, 15 bp, Homo sapiens
agcggctcttcctgg

SEQ ID NO: 5041870 - DNA, 21 bp, Homo sapiens
agctccgagtggctcccgtgt

SEQ ID NO: 5041871 - DNA, 17 bp, Homo sapiens
agctgctcctagagggg

SEQ ID NO: 5041872 - DNA, 22 bp, Homo sapiens
agctggatggggcggcctgcag

SEQ ID NO: 5041873 - DNA, 19 bp, Homo sapiens
agcttggagtgccacgtgg

SEQ ID NO: 5041874 - DNA, 13 bp, Homo sapiens
aggaagggccccc

SEQ ID NO: 5041875 - DNA, 15 bp, Homo sapiens
aggaattctcacagg

SEQ ID NO: 5041876 - DNA, 14 bp, Homo sapiens
aggagaggctgctg

SEQ ID NO: 5041877 - DNA, 14 bp, Homo sapiens
aggaggcctgggag

SEQ ID NO: 5041878 - DNA, 20 bp, Homo sapiens
aggagtgactctggctgcca

SEQ ID NO: 5041879 - DNA, 21 bp, Homo sapiens
aggcaagacaccttcccagct

SEQ ID NO: 5041880 - DNA, 16 bp, Homo sapiens
aggcctgggagatgca

SEQ ID NO: 5041881 - DNA, 20 bp, Homo sapiens
aggcctgggagatgcagctg

SEQ ID NO: 5041882 - DNA, 16 bp, Homo sapiens
aggctgccgctgctct

SEQ ID NO: 5041883 - DNA, 22 bp, Homo sapiens
aggctgccgctgctctcccagg

SEQ ID NO: 5041884 - DNA, 14 bp, Homo sapiens
aggctggcggggtc

SEQ ID NO: 5041885 - DNA, 23 bp, Homo sapiens
agggacagttgggtgtgagaata

SEQ ID NO: 5041886 - DNA, 19 bp, Homo sapiens
agggcaaaccaggctgcag

SEQ ID NO: 5041887 - DNA, 21 bp, Homo sapiens
agggcaaaccaggctgcaggt

SEQ ID NO: 5041888 - DNA, 21 bp, Homo sapiens
agggcccccggctcggcctct

SEQ ID NO: 5041889 - DNA, 14 bp, Homo sapiens
agggcgcctgggtc

SEQ ID NO: 5041890 - DNA, 21 bp, Homo sapiens
agggcgcctgggtcctcccag

SEQ ID NO: 5041891 - DNA, 22 bp, Homo sapiens
agggcgcctgggtcctcccagc

SEQ ID NO: 5041892 - DNA, 22 bp, Homo sapiens
agggctgggcgcctctgtcctg

SEQ ID NO: 5041893 - DNA, 18 bp, Homo sapiens
aggggacaagccaggccc

SEQ ID NO: 5041894 - DNA, 15 bp, Homo sapiens
aggtcagagcccagg

SEQ ID NO: 5041895 - DNA, 20 bp, Homo sapiens
aggtgcacctgccccaggct

SEQ ID NO: 5041896 - DNA, 21 bp, Homo sapiens
aggtgcacctgccccaggctc

SEQ ID NO: 5041897 - DNA, 15 bp, Homo sapiens
aggttcacccagcgc

SEQ ID NO: 5041898 - DNA, 22 bp, Homo sapiens
agtcagctccgagtggctcccg

SEQ ID NO: 5041899 - DNA, 16 bp, Homo sapiens
agtcctcggcagctcc

SEQ ID NO: 5041900 - DNA, 22 bp, Homo sapiens
agtgaccgggggaagctgagcc

SEQ ID NO: 5041901 - DNA, 19 bp, Homo sapiens
agtgactctggctgccaag

SEQ ID NO: 5041902 - DNA, 20 bp, Homo sapiens
agtgactctggctgccaaga

SEQ ID NO: 5041903 - DNA, 19 bp, Homo sapiens
agtgagagcagggctgggc

SEQ ID NO: 5041904 - DNA, 20 bp, Homo sapiens
agtgttcttgggggtggggc

SEQ ID NO: 5041905 - DNA, 22 bp, Homo sapiens
atcaagatcaaagaaccaggag

SEQ ID NO: 5041906 - DNA, 18 bp, Homo sapiens
atcaggtcagagcccagg

SEQ ID NO: 5041907 - DNA, 17 bp, Homo sapiens
atccacagtgagttggg

SEQ ID NO: 5041908 - DNA, 19 bp, Homo sapiens
atcgccctgagctactgct

SEQ ID NO: 5041909 - DNA, 17 bp, Homo sapiens
atggaaacgcacaaccc

SEQ ID NO: 5041910 - DNA, 15 bp, Homo sapiens
atggccaggagtggg

SEQ ID NO: 5041911 - DNA, 13 bp, Homo sapiens
atggccgctgccc

SEQ ID NO: 5041912 - DNA, 20 bp, Homo sapiens
atggcttgggctggagtggg

SEQ ID NO: 5041913 - DNA, 20 bp, Homo sapiens
atggggtgggagccacaggg

SEQ ID NO: 5041914 - DNA, 22 bp, Homo sapiens
attctagagggatccaccgcca

SEQ ID NO: 5041915 - DNA, 20 bp, Homo sapiens
attctcacaggttcacccag

SEQ ID NO: 5041916 - DNA, 20 bp, Homo sapiens
cctcactgagaaggccccag

SEQ ID NO: 5041917 - DNA, 23 bp, Homo sapiens
cctcactgagaaggccccagggc

SEQ ID NO: 5041918 - DNA, 16 bp, Homo sapiens
cctccagagcctgggc

SEQ ID NO: 5041919 - DNA, 17 bp, Homo sapiens
cctccagagcctgggcg

SEQ ID NO: 5041920 - DNA, 11 bp, Homo sapiens
cctccctgcag

SEQ ID NO: 5041921 - DNA, 14 bp, Homo sapiens
cctccctgcagctt

SEQ ID NO: 5041922 - DNA, 23 bp, Homo sapiens
cctcgtcccgagggcgcctgggt

SEQ ID NO: 5041923 - DNA, 14 bp, Homo sapiens
cctctctcatggct

SEQ ID NO: 5041924 - DNA, 21 bp, Homo sapiens
cctcttttcccttgtgtgagg

SEQ ID NO: 5041925 - DNA, 18 bp, Homo sapiens
cctgaactggccccagct

SEQ ID NO: 5041926 - DNA, 17 bp, Homo sapiens
cctgcaaggtgcacctg

SEQ ID NO: 5041927 - DNA, 16 bp, Homo sapiens
cctgcagaccctgcca

SEQ ID NO: 5041928 - DNA, 14 bp, Homo sapiens
cctgccaggctgca

SEQ ID NO: 5041929 - DNA, 15 bp, Homo sapiens
cctgccccaggctca

SEQ ID NO: 5041930 - DNA, 23 bp, Homo sapiens
cctgcctctctcatggcttgggc

SEQ ID NO: 5041931 - DNA, 14 bp, Homo sapiens
cctggacagtgaga

SEQ ID NO: 5041932 - DNA, 15 bp, Homo sapiens
cctggacagtgagag

SEQ ID NO: 5041933 - DNA, 19 bp, Homo sapiens
cctggccccagtgaccggg

SEQ ID NO: 5041934 - DNA, 19 bp, Homo sapiens
cctgggtcctcccagctga

SEQ ID NO: 5041935 - DNA, 16 bp, Homo sapiens
cctgggtgctgtcatg

SEQ ID NO: 5041936 - DNA, 18 bp, Homo sapiens
ccttcccagctgctccta

SEQ ID NO: 5041937 - DNA, 15 bp, Homo sapiens
cgacacaggctgccg

SEQ ID NO: 5041938 - DNA, 16 bp, Homo sapiens
cgacacaggctgccgc

SEQ ID NO: 5041939 - DNA, 15 bp, Homo sapiens
cgagggcgcctgggt

SEQ ID NO: 5041940 - DNA, 17 bp, Homo sapiens
cgcaagcgacacaggct

SEQ ID NO: 5041941 - DNA, 16 bp, Homo sapiens
cgccacactggccggc

SEQ ID NO: 5041942 - DNA, 13 bp, Homo sapiens
cgcccagcctggc

SEQ ID NO: 5041943 - DNA, 16 bp, Homo sapiens
cgccctctacctccta

SEQ ID NO: 5041944 - DNA, 14 bp, Homo sapiens
cgcctctgtcctgg

SEQ ID NO: 5041945 - DNA, 19 bp, Homo sapiens
cgcctgggtcctcccagct

SEQ ID NO: 5041946 - DNA, 13 bp, Homo sapiens
cgctgctctccca

SEQ ID NO: 5041947 - DNA, 15 bp, Homo sapiens
cggcccacgtcctgg

SEQ ID NO: 5041948 - DNA, 18 bp, Homo sapiens
cggcccacgtcctgggtg

SEQ ID NO: 5041949 - DNA, 17 bp, Homo sapiens
cggcctcttgagagccc

SEQ ID NO: 5041950 - DNA, 19 bp, Homo sapiens
cggcctgcagaccctgcca

SEQ ID NO: 5041951 - DNA, 24 bp, Homo sapiens
cggctcggcctcttgagagcccca

SEQ ID NO: 5041952 - DNA, 17 bp, Homo sapiens
cgggtggcagcgcccag

SEQ ID NO: 5041953 - DNA, 21 bp, Homo sapiens
cgtcccgagggcgcctgggtc

SEQ ID NO: 5041954 - DNA, 17 bp, Homo sapiens
cgtctccctggccccag

SEQ ID NO: 5041955 - DNA, 16 bp, Homo sapiens
cgtggccgctgcccac

SEQ ID NO: 5041956 - DNA, 19 bp, Homo sapiens
cgtttttgctggcttgcac

SEQ ID NO: 5041957 - DNA, 16 bp, Homo sapiens
ctaatcgccctgagct

SEQ ID NO: 5041958 - DNA, 17 bp, Homo sapiens
ctaatcgccctgagcta

SEQ ID NO: 5041959 - DNA, 15 bp, Homo sapiens
ctacttagacccagt

SEQ ID NO: 5041960 - DNA, 15 bp, Homo sapiens
ctagtctgtgcctca

SEQ ID NO: 5041961 - DNA, 16 bp, Homo sapiens
ctagtctgtgcctcag

SEQ ID NO: 5041962 - DNA, 17 bp, Homo sapiens
ctcacaggttcacccag

SEQ ID NO: 5041963 - DNA, 22 bp, Homo sapiens
ctcactgagaaggccccagggc

SEQ ID NO: 5041964 - DNA, 12 bp, Homo sapiens
ctcaggctgccc

SEQ ID NO: 5041965 - DNA, 14 bp, Homo sapiens
ctcaggctgcccag

SEQ ID NO: 5041966 - DNA, 15 bp, Homo sapiens
ctcaggctgcccagc

SEQ ID NO: 5041967 - DNA, 14 bp, Homo sapiens
ctcagtcagcccag

SEQ ID NO: 5041968 - DNA, 15 bp, Homo sapiens
ctcagtcagcccagt

SEQ ID NO: 5041969 - DNA, 17 bp, Homo sapiens
ctcagtcagcccagtgg

SEQ ID NO: 5041970 - DNA, 13 bp, Homo sapiens
ctcatggcttggg

SEQ ID NO: 5041971 - DNA, 18 bp, Homo sapiens
ctccagagcctgggcgca

SEQ ID NO: 5041972 - DNA, 13 bp, Homo sapiens
ctccctcctgtgt

SEQ ID NO: 5041973 - DNA, 16 bp, Homo sapiens
ctccggaaggacacag

SEQ ID NO: 5041974 - DNA, 15 bp, Homo sapiens
ctcctgcccactctg

SEQ ID NO: 5041975 - DNA, 13 bp, Homo sapiens
ctctctgcagtcc

SEQ ID NO: 5041976 - DNA, 15 bp, Homo sapiens
ctctctggacctgac

SEQ ID NO: 5041977 - DNA, 21 bp, Homo sapiens
ctctgcagtcctcggcagctc

SEQ ID NO: 5041978 - DNA, 20 bp, Homo sapiens
ctctggacctgaccagactg

SEQ ID NO: 5041979 - DNA, 12 bp, Homo sapiens
ctctggctgcca

SEQ ID NO: 5041980 - DNA, 16 bp, Homo sapiens
ctctggctgccaagat

SEQ ID NO: 5041981 - DNA, 14 bp, Homo sapiens
ctctgtcctggccc

SEQ ID NO: 5041982 - DNA, 19 bp, Homo sapiens
ctgaactggccccagctcc

SEQ ID NO: 5041983 - DNA, 18 bp, Homo sapiens
ctgagaaggccccagggc

SEQ ID NO: 5041984 - DNA, 23 bp, Homo sapiens
ctgatgtcttcttgggggcagac

SEQ ID NO: 5041985 - DNA, 18 bp, Homo sapiens
ctgcaaggtgcacctgcc

SEQ ID NO: 5041986 - DNA, 17 bp, Homo sapiens
ctgcagctttgaggctg

SEQ ID NO: 5041987 - DNA, 14 bp, Homo sapiens
ctgcaggccacccc

SEQ ID NO: 5041988 - DNA, 20 bp, Homo sapiens
ctgcagtcctcggcagctcc

SEQ ID NO: 5041989 - DNA, 17 bp, Homo sapiens
ctgcccacctgccaggc

SEQ ID NO: 5041990 - DNA, 19 bp, Homo sapiens
ctgcccacctgccaggctg

SEQ ID NO: 5041991 - DNA, 22 bp, Homo sapiens
ctgcccacgtcccgggcactgt

SEQ ID NO: 5041992 - DNA, 14 bp, Homo sapiens
ctgcgtctcctgcc

SEQ ID NO: 5041993 - DNA, 17 bp, Homo sapiens
ctgcgtctcctgcccac

SEQ ID NO: 5041994 - DNA, 15 bp, Homo sapiens
ctggaaaggcccgga

SEQ ID NO: 5041995 - DNA, 20 bp, Homo sapiens
ctggaccacgtctccctggc

SEQ ID NO: 5041996 - DNA, 23 bp, Homo sapiens
ctggacctgaccagactgtgggt

SEQ ID NO: 5041997 - DNA, 16 bp, Homo sapiens
ctggagtgggctctct

SEQ ID NO: 5041998 - DNA, 23 bp, Homo sapiens
ctggagtgggctctctggacctg

SEQ ID NO: 5041999 - DNA, 13 bp, Homo sapiens
ctggccccagtga

SEQ ID NO: 5042000 - DNA, 18 bp, Homo sapiens
ctggccccagtgaccggg

SEQ ID NO: 5042001 - DNA, 14 bp, Homo sapiens
ctgggagatgcagc

SEQ ID NO: 5042002 - DNA, 16 bp, Homo sapiens
ctgggagatgcagctg

SEQ ID NO: 5042003 - DNA, 14 bp, Homo sapiens
ctgggcgcctctgt

SEQ ID NO: 5042004 - DNA, 20 bp, Homo sapiens
ctgggcgcctctgtcctggc

SEQ ID NO: 5042005 - DNA, 19 bp, Homo sapiens
ctgggtcctcccagctgac

SEQ ID NO: 5042006 - DNA, 11 bp, Homo sapiens
ctgtctgcagg

SEQ ID NO: 5042007 - DNA, 20 bp, Homo sapiens
ctgtctgcaggccaccccca

SEQ ID NO: 5042008 - DNA, 13 bp, Homo sapiens
ctgtgcctcagtg

SEQ ID NO: 5042009 - DNA, 16 bp, Homo sapiens
ctgtgcctcagtgaga

SEQ ID NO: 5042010 - DNA, 13 bp, Homo sapiens
ctgtggcctgggg

SEQ ID NO: 5042011 - DNA, 17 bp, Homo sapiens
ctgtgggtccctgcgtc

SEQ ID NO: 5042012 - DNA, 14 bp, Homo sapiens
cttacccacttccc

SEQ ID NO: 5042013 - DNA, 17 bp, Homo sapiens
cttagggtacagcccag

SEQ ID NO: 5042014 - DNA, 15 bp, Homo sapiens
cttcccagctgctcc

SEQ ID NO: 5042015 - DNA, 13 bp, Homo sapiens
cttcctgcctctc

SEQ ID NO: 5042016 - DNA, 17 bp, Homo sapiens
cttcctggacagtgaga

SEQ ID NO: 5042017 - DNA, 17 bp, Homo sapiens
cttgagagccccacccc

SEQ ID NO: 5042018 - DNA, 20 bp, Homo sapiens
cttggagtgccacgtggccg

SEQ ID NO: 5042019 - DNA, 12 bp, Homo sapiens
ctttggccacag

SEQ ID NO: 5042020 - DNA, 14 bp, Homo sapiens
cttttcccttgtgt

SEQ ID NO: 5042021 - DNA, 17 bp, Homo sapiens
gaacaggagtgactctg

SEQ ID NO: 5042022 - DNA, 19 bp, Homo sapiens
gaacaggagtgactctggc

SEQ ID NO: 5042023 - DNA, 20 bp, Homo sapiens
gaaccaggaggcctgggaga

SEQ ID NO: 5042024 - DNA, 14 bp, Homo sapiens
gaactggccccagc

SEQ ID NO: 5042025 - DNA, 19 bp, Homo sapiens
gaaggacacagtcaggggc

SEQ ID NO: 5042026 - DNA, 16 bp, Homo sapiens
gaaggccccagggcag

SEQ ID NO: 5042027 - DNA, 15 bp, Homo sapiens
gaagggcccccggct

SEQ ID NO: 5042028 - DNA, 12 bp, Homo sapiens
gacacaggctgc

SEQ ID NO: 5042029 - DNA, 16 bp, Homo sapiens
gacaccttcccagctg

SEQ ID NO: 5042030 - DNA, 17 bp, Homo sapiens
gaccacgtctccctggc

SEQ ID NO: 5042031 - DNA, 21 bp, Homo sapiens
gaccacgtctccctggcccca

SEQ ID NO: 5042032 - DNA, 14 bp, Homo sapiens
tgcaggtggggttt

SEQ ID NO: 5042033 - DNA, 15 bp, Homo sapiens
tgccacatggccgct

SEQ ID NO: 5042034 - DNA, 19 bp, Homo sapiens
tgccacgtggccgctgccc

SEQ ID NO: 5042035 - DNA, 21 bp, Homo sapiens
tgccacgtggccgctgcccac

SEQ ID NO: 5042036 - DNA, 16 bp, Homo sapiens
tgccaggctgcaggga

SEQ ID NO: 5042037 - DNA, 15 bp, Homo sapiens
tgccatggccaggag

SEQ ID NO: 5042038 - DNA, 15 bp, Homo sapiens
tgcccacctgccagg

SEQ ID NO: 5042039 - DNA, 17 bp, Homo sapiens
tgcccacgtcccgggca

SEQ ID NO: 5042040 - DNA, 15 bp, Homo sapiens
tgcccactctgaccg

SEQ ID NO: 5042041 - DNA, 18 bp, Homo sapiens
tgccccaggctcaggctg

SEQ ID NO: 5042042 - DNA, 21 bp, Homo sapiens
tgccccaggctcaggctgccc

SEQ ID NO: 5042043 - DNA, 19 bp, Homo sapiens
tgccgctgctctcccaggt

SEQ ID NO: 5042044 - DNA, 23 bp, Homo sapiens
tgcctctctcatggcttgggctg

SEQ ID NO: 5042045 - DNA, 15 bp, Homo sapiens
tgctctcccaggtga

SEQ ID NO: 5042046 - DNA, 13 bp, Homo sapiens
tgctggcttgcac

SEQ ID NO: 5042047 - DNA, 12 bp, Homo sapiens
tggacagtgaga

SEQ ID NO: 5042048 - DNA, 18 bp, Homo sapiens
tggagtgccacatggccg

SEQ ID NO: 5042049 - DNA, 21 bp, Homo sapiens
tggagtgccacatggccgctg

SEQ ID NO: 5042050 - DNA, 19 bp, Homo sapiens
tggatggggcggcctgcag

SEQ ID NO: 5042051 - DNA, 14 bp, Homo sapiens
tggccaggagtggg

SEQ ID NO: 5042052 - DNA, 22 bp, Homo sapiens
tggccccagctcctcttcctgc

SEQ ID NO: 5042053 - DNA, 12 bp, Homo sapiens
tggccccagtga

SEQ ID NO: 5042054 - DNA, 16 bp, Homo sapiens
tggccgcaacttccca

SEQ ID NO: 5042055 - DNA, 19 bp, Homo sapiens
tggccgcaacttcccaggc

SEQ ID NO: 5042056 - DNA, 21 bp, Homo sapiens
tggccgcaacttcccaggccg

SEQ ID NO: 5042057 - DNA, 18 bp, Homo sapiens
tggccgctgctgtgacag

SEQ ID NO: 5042058 - DNA, 21 bp, Homo sapiens
tggcggggtctgctcctggga

SEQ ID NO: 5042059 - DNA, 16 bp, Homo sapiens
tggctagtctgtgcct

SEQ ID NO: 5042060 - DNA, 13 bp, Homo sapiens
tgggaatggggtg

SEQ ID NO: 5042061 - DNA, 18 bp, Homo sapiens
tgggagaggagaggctgc

SEQ ID NO: 5042062 - DNA, 16 bp, Homo sapiens
tgggagatgcagctgg

SEQ ID NO: 5042063 - DNA, 19 bp, Homo sapiens
tgggctctctggacctgac

SEQ ID NO: 5042064 - DNA, 13 bp, Homo sapiens
tggggcggcctgc

SEQ ID NO: 5042065 - DNA, 13 bp, Homo sapiens
tggggctgcatcc

SEQ ID NO: 5042066 - DNA, 21 bp, Homo sapiens
tggggtcttagggtacagccc

SEQ ID NO: 5042067 - DNA, 20 bp, Homo sapiens
tggggttttcacttcctagg

SEQ ID NO: 5042068 - DNA, 18 bp, Homo sapiens
tgggtagtgccatggcca

SEQ ID NO: 5042069 - DNA, 21 bp, Homo sapiens
tgggtagtgccatggccagga

SEQ ID NO: 5042070 - DNA, 22 bp, Homo sapiens
tgggtagtgccatggccaggag

SEQ ID NO: 5042071 - DNA, 20 bp, Homo sapiens
tgggtccctgcgtctcctgc

SEQ ID NO: 5042072 - DNA, 19 bp, Homo sapiens
tgggtgctgtcatgcccag

SEQ ID NO: 5042073 - DNA, 14 bp, Homo sapiens
tgggtttccctgcg

SEQ ID NO: 5042074 - DNA, 18 bp, Homo sapiens
tgtcatgcccagcttgga

SEQ ID NO: 5042075 - DNA, 18 bp, Homo sapiens
tgtcccgggtactcagtc

SEQ ID NO: 5042076 - DNA, 19 bp, Homo sapiens
tgtcccgggtactcagtca

SEQ ID NO: 5042077 - DNA, 21 bp, Homo sapiens
tgttcttgggggtggggctgc

SEQ ID NO: 5042078 - DNA, 16 bp, Homo sapiens
ttcaaccattgaaggg

SEQ ID NO: 5042079 - DNA, 12 bp, Homo sapiens
ttcctccctcca

SEQ ID NO: 5042080 - DNA, 17 bp, Homo sapiens
ttccttctgatctgaga

SEQ ID NO: 5042081 - DNA, 18 bp, Homo sapiens
ttgaggaccctcccaggt

SEQ ID NO: 5042082 - DNA, 14 bp, Homo sapiens
ttggagtgccacgt

SEQ ID NO: 5042083 - DNA, 23 bp, Homo sapiens
ttggagtgccacgtggccgctgc

SEQ ID NO: 5042084 - DNA, 18 bp, Homo sapiens
tttccttctgatctgaga

SEQ ID NO: 5042085 - DNA, 21 bp, Homo sapiens
tttgaggctggcggggtctgc

SEQ ID NO: 5042086 - DNA, 21 bp, Homo sapiens
ttttgctggcttgcactttct

SEQ ID NO: 5042087 - DNA, 17 bp, Homo sapiens
cccaggaattctcacag

SEQ ID NO: 5042088 - DNA, 22 bp, Homo sapiens
cccaggccgaggaagggccccc

SEQ ID NO: 5042089 - DNA, 21 bp, Homo sapiens
cccagtgaccgggggaagctg

SEQ ID NO: 5042090 - DNA, 11 bp, Homo sapiens
ccccagctcct

SEQ ID NO: 5042091 - DNA, 19 bp, Homo sapiens
ccccagctcctcttcctgc

SEQ ID NO: 5042092 - DNA, 13 bp, Homo sapiens
ccccatgggctgc

SEQ ID NO: 5042093 - DNA, 13 bp, Homo sapiens
cccctcctccaga

SEQ ID NO: 5042094 - DNA, 21 bp, Homo sapiens
cccctcctccagagcctgggc

SEQ ID NO: 5042095 - DNA, 20 bp, Homo sapiens
cccggctcggcctcttgaga

SEQ ID NO: 5042096 - DNA, 21 bp, Homo sapiens
cccgggtactcagtcagccca

SEQ ID NO: 5042097 - DNA, 16 bp, Homo sapiens
ccctacttagacccag

SEQ ID NO: 5042098 - DNA, 10 bp, Homo sapiens
ccctcccagg

SEQ ID NO: 5042099 - DNA, 16 bp, Homo sapiens
ccctccctcctgtgtt

SEQ ID NO: 5042100 - DNA, 12 bp, Homo sapiens
ccctcctccaga

SEQ ID NO: 5042101 - DNA, 13 bp, Homo sapiens
ccctctctgcagt

SEQ ID NO: 5042102 - DNA, 20 bp, Homo sapiens
ccctgcagctttgaggctgg

SEQ ID NO: 5042103 - DNA, 13 bp, Homo sapiens
ccctgtctgcagg

SEQ ID NO: 5042104 - DNA, 15 bp, Homo sapiens
ccgagggcgcctggg

SEQ ID NO: 5042105 - DNA, 17 bp, Homo sapiens
ccgagggcgcctgggtc

SEQ ID NO: 5042106 - DNA, 18 bp, Homo sapiens
ccgcaggggcccctcctc

SEQ ID NO: 5042107 - DNA, 19 bp, Homo sapiens
ccgctgcccacgtcccggg

SEQ ID NO: 5042108 - DNA, 18 bp, Homo sapiens
ccgctgctctcccaggtg

SEQ ID NO: 5042109 - DNA, 18 bp, Homo sapiens
ccggaaggacacagtcag

SEQ ID NO: 5042110 - DNA, 15 bp, Homo sapiens
ccggagatgcatctg

SEQ ID NO: 5042111 - DNA, 15 bp, Homo sapiens
ccggcccacgtcctg

SEQ ID NO: 5042112 - DNA, 19 bp, Homo sapiens
ccggcccacgtcctgggtg

SEQ ID NO: 5042113 - DNA, 19 bp, Homo sapiens
ccggctggaccacgtctcc

SEQ ID NO: 5042114 - DNA, 19 bp, Homo sapiens
ccgggcactgtcatgccca

SEQ ID NO: 5042115 - DNA, 17 bp, Homo sapiens
ccgggggaagctgagcc

SEQ ID NO: 5042116 - DNA, 17 bp, Homo sapiens
ccgggtactcagtcagc

SEQ ID NO: 5042117 - DNA, 17 bp, Homo sapiens
ccgggtggcagcgccca

SEQ ID NO: 5042118 - DNA, 14 bp, Homo sapiens
cctcactgagaagg

SEQ ID NO: 5042119 - DNA, 21 bp, Homo sapiens
cctcactgagaaggccccagg

SEQ ID NO: 5042120 - DNA, 15 bp, Homo sapiens
cctccagagcctggg

SEQ ID NO: 5042121 - DNA, 14 bp, Homo sapiens
cctccctcctgtgt

SEQ ID NO: 5042122 - DNA, 16 bp, Homo sapiens
cctcctccagagcctg

SEQ ID NO: 5042123 - DNA, 13 bp, Homo sapiens
cctcggcagctcc

SEQ ID NO: 5042124 - DNA, 12 bp, Homo sapiens
cctctctgcagt

SEQ ID NO: 5042125 - DNA, 13 bp, Homo sapiens
cctctctgcagtc

SEQ ID NO: 5042126 - DNA, 21 bp, Homo sapiens
cctcttgagagccccacccct

SEQ ID NO: 5042127 - DNA, 14 bp, Homo sapiens
cctgaactggcccc

SEQ ID NO: 5042128 - DNA, 17 bp, Homo sapiens
cctgcagaccctgccag

SEQ ID NO: 5042129 - DNA, 20 bp, Homo sapiens
cctgcagctttgaggctggc

SEQ ID NO: 5042130 - DNA, 22 bp, Homo sapiens
cctgcagctttgaggctggcgg

SEQ ID NO: 5042131 - DNA, 13 bp, Homo sapiens
cctgccaggctgc

SEQ ID NO: 5042132 - DNA, 16 bp, Homo sapiens
cctgccaggctgcagg

SEQ ID NO: 5042133 - DNA, 20 bp, Homo sapiens
ctgctggaaaggcccggaga

SEQ ID NO: 5042134 - DNA, 17 bp, Homo sapiens
ctggagtgggctctctg

SEQ ID NO: 5042135 - DNA, 22 bp, Homo sapiens
ctggagtgggctctctggacct

SEQ ID NO: 5042136 - DNA, 22 bp, Homo sapiens
ctggatggggcggcctgcagac

SEQ ID NO: 5042137 - DNA, 14 bp, Homo sapiens
ctggcggggtctgc

SEQ ID NO: 5042138 - DNA, 13 bp, Homo sapiens
ctggcttgcactt

SEQ ID NO: 5042139 - DNA, 22 bp, Homo sapiens
ctgggaatggggtgggagccac

SEQ ID NO: 5042140 - DNA, 23 bp, Homo sapiens
ctgggaatggggtgggagccaca

SEQ ID NO: 5042141 - DNA, 24 bp, Homo sapiens
ctgggaatggggtgggagccacag

SEQ ID NO: 5042142 - DNA, 18 bp, Homo sapiens
ctgggagatgcagctgga

SEQ ID NO: 5042143 - DNA, 16 bp, Homo sapiens
ctgggcgcctctgtcc

SEQ ID NO: 5042144 - DNA, 15 bp, Homo sapiens
ctgggtcctcccagc

SEQ ID NO: 5042145 - DNA, 15 bp, Homo sapiens
ctggtcccccatggg

SEQ ID NO: 5042146 - DNA, 18 bp, Homo sapiens
ctggtcccccatgggctg

SEQ ID NO: 5042147 - DNA, 12 bp, Homo sapiens
ctgtctgcaggc

SEQ ID NO: 5042148 - DNA, 14 bp, Homo sapiens
ctgtggcctggggc

SEQ ID NO: 5042149 - DNA, 19 bp, Homo sapiens
cttagggtacagcccaggc

SEQ ID NO: 5042150 - DNA, 20 bp, Homo sapiens
cttagggtacagcccaggcg

SEQ ID NO: 5042151 - DNA, 11 bp, Homo sapiens
cttcccaggcc

SEQ ID NO: 5042152 - DNA, 14 bp, Homo sapiens
cttctgatctgaga

SEQ ID NO: 5042153 - DNA, 18 bp, Homo sapiens
cttcttgggggcagacca

SEQ ID NO: 5042154 - DNA, 13 bp, Homo sapiens
cttgagagcccca

SEQ ID NO: 5042155 - DNA, 22 bp, Homo sapiens
cttgagcaataaacgctgactt

SEQ ID NO: 5042156 - DNA, 20 bp, Homo sapiens
cttggagcgtttttgctggc

SEQ ID NO: 5042157 - DNA, 13 bp, Homo sapiens
ctttggccacagc

SEQ ID NO: 5042158 - DNA, 23 bp, Homo sapiens
ctttgggtagtgccatggccagg

SEQ ID NO: 5042159 - DNA, 17 bp, Homo sapiens
ctttgtcttgatcctca

SEQ ID NO: 5042160 - DNA, 22 bp, Homo sapiens
gaacaggagtgactctggctgc

SEQ ID NO: 5042161 - DNA, 18 bp, Homo sapiens
gaaccaggaggcctggga

SEQ ID NO: 5042162 - DNA, 12 bp, Homo sapiens
gaactggcccca

SEQ ID NO: 5042163 - DNA, 15 bp, Homo sapiens
gaactggccccagct

SEQ ID NO: 5042164 - DNA, 23 bp, Homo sapiens
gaagacatgaacgttttctcttc

SEQ ID NO: 5042165 - DNA, 11 bp, Homo sapiens
gaaggccccag

SEQ ID NO: 5042166 - DNA, 16 bp, Homo sapiens
gaagggggatgcaggc

SEQ ID NO: 5042167 - DNA, 19 bp, Homo sapiens
gaatggggtgggagccaca

SEQ ID NO: 5042168 - DNA, 22 bp, Homo sapiens
gaatggggtgggagccacaggg

SEQ ID NO: 5042169 - DNA, 13 bp, Homo sapiens
gacaagccaggcc

SEQ ID NO: 5042170 - DNA, 14 bp, Homo sapiens
gacacaggctgccg

SEQ ID NO: 5042171 - DNA, 15 bp, Homo sapiens
gacacaggctgccgc

SEQ ID NO: 5042172 - DNA, 15 bp, Homo sapiens
gacaccttcccagct

SEQ ID NO: 5042173 - DNA, 12 bp, Homo sapiens
gaccctgccagg

SEQ ID NO: 5042174 - DNA, 15 bp, Homo sapiens
gactctggctgccaa

SEQ ID NO: 5042175 - DNA, 17 bp, Homo sapiens
gactctggctgccaaga

SEQ ID NO: 5042176 - DNA, 19 bp, Homo sapiens
gactgtgggtccctgcgtc

SEQ ID NO: 5042177 - DNA, 18 bp, Homo sapiens
gagaaggccccagggcag

SEQ ID NO: 5042178 - DNA, 19 bp, Homo sapiens
gagaaggccccagggcagc

SEQ ID NO: 5042179 - DNA, 23 bp, Homo sapiens
gagatgcatctgtggcctggggc

SEQ ID NO: 5042180 - DNA, 22 bp, Homo sapiens
gagcatggccgcaacttcccag

SEQ ID NO: 5042181 - DNA, 14 bp, Homo sapiens
gagccgcaggggcc

SEQ ID NO: 5042182 - DNA, 21 bp, Homo sapiens
gagccgcaggggcccctcctc

SEQ ID NO: 5042183 - DNA, 15 bp, Homo sapiens
gaggaccctcccagg

SEQ ID NO: 5042184 - DNA, 17 bp, Homo sapiens
gcggaaaccgggtggca

SEQ ID NO: 5042185 - DNA, 23 bp, Homo sapiens
gcggaacaggagtgactctggct

SEQ ID NO: 5042186 - DNA, 22 bp, Homo sapiens
gcggtcactgcccacctgccag

SEQ ID NO: 5042187 - DNA, 12 bp, Homo sapiens
gctcaggctgcc

SEQ ID NO: 5042188 - DNA, 14 bp, Homo sapiens
gctcctcttcctgc

SEQ ID NO: 5042189 - DNA, 15 bp, Homo sapiens
gctcggcctcttgag

SEQ ID NO: 5042190 - DNA, 20 bp, Homo sapiens
gctctctggacctgaccaga

SEQ ID NO: 5042191 - DNA, 15 bp, Homo sapiens
gctgacttgcagacg

SEQ ID NO: 5042192 - DNA, 20 bp, Homo sapiens
gctgccaagataccttcatg

SEQ ID NO: 5042193 - DNA, 21 bp, Homo sapiens
gctgccaagataccttcatgg

SEQ ID NO: 5042194 - DNA, 15 bp, Homo sapiens
gctgctcctagaggg

SEQ ID NO: 5042195 - DNA, 15 bp, Homo sapiens
gctgctctcccaggt

SEQ ID NO: 5042196 - DNA, 21 bp, Homo sapiens
gctggaccacgtctccctggc

SEQ ID NO: 5042197 - DNA, 12 bp, Homo sapiens
gctggcttgcac

SEQ ID NO: 5042198 - DNA, 20 bp, Homo sapiens
gctgggcgcctctgtcctgg

SEQ ID NO: 5042199 - DNA, 23 bp, Homo sapiens
gctgggcgcctctgtcctggccc

SEQ ID NO: 5042200 - DNA, 18 bp, Homo sapiens
gctgtcatgcccagcttg

SEQ ID NO: 5042201 - DNA, 16 bp, Homo sapiens
gctgttttggggtctt

SEQ ID NO: 5042202 - DNA, 18 bp, Homo sapiens
ggaaaccgggtggcagcg

SEQ ID NO: 5042203 - DNA, 22 bp, Homo sapiens
ggaacaggagtgactctggctg

SEQ ID NO: 5042204 - DNA, 12 bp, Homo sapiens
ggaagctgagcc

SEQ ID NO: 5042205 - DNA, 15 bp, Homo sapiens
ggacaagccaggccc

SEQ ID NO: 5042206 - DNA, 22 bp, Homo sapiens
ggaccacgtctccctggcccca

SEQ ID NO: 5042207 - DNA, 18 bp, Homo sapiens
ggagaggagaggctgctg

SEQ ID NO: 5042208 - DNA, 17 bp, Homo sapiens
ggagaggctgctgtcac

SEQ ID NO: 5042209 - DNA, 14 bp, Homo sapiens
ggagccgcaggggc

SEQ ID NO: 5042210 - DNA, 21 bp, Homo sapiens
ggagtgactctggctgccaag

SEQ ID NO: 5042211 - DNA, 20 bp, Homo sapiens
ggagtgccacatggccgctg

SEQ ID NO: 5042212 - DNA, 16 bp, Homo sapiens
ggagtgccacgtggcc

SEQ ID NO: 5042213 - DNA, 23 bp, Homo sapiens
ggagtgggctctctggacctgac

SEQ ID NO: 5042214 - DNA, 17 bp, Homo sapiens
ggatggggcggcctgca

SEQ ID NO: 5042215 - DNA, 19 bp, Homo sapiens
ggatggggcggcctgcaga

SEQ ID NO: 5042216 - DNA, 20 bp, Homo sapiens
ggcaagacaccttcccagct

SEQ ID NO: 5042217 - DNA, 22 bp, Homo sapiens
ggcaagacaccttcccagctgc

SEQ ID NO: 5042218 - DNA, 15 bp, Homo sapiens
ggcagcgcccagcct

SEQ ID NO: 5042219 - DNA, 14 bp, Homo sapiens
ggccacagccccaa

SEQ ID NO: 5042220 - DNA, 22 bp, Homo sapiens
ggccaggagtgggtttccctgc

SEQ ID NO: 5042221 - DNA, 16 bp, Homo sapiens
ggcccacgtcctgggt

SEQ ID NO: 5042222 - DNA, 11 bp, Homo sapiens
ggccccagctc

SEQ ID NO: 5042223 - DNA, 14 bp, Homo sapiens
ggcccctcctccag

SEQ ID NO: 5042224 - DNA, 24 bp, Homo sapiens
ggcccggagatgcatctgtggcct

SEQ ID NO: 5042225 - DNA, 15 bp, Homo sapiens
ggccgcaacttccca

SEQ ID NO: 5042226 - DNA, 16 bp, Homo sapiens
ggccgctgctgtgaca

SEQ ID NO: 5042227 - DNA, 18 bp, Homo sapiens
ggcctgcagaccctgcca

SEQ ID NO: 5042228 - DNA, 21 bp, Homo sapiens
ggcctgcagaccctgccaggg

SEQ ID NO: 5042229 - DNA, 18 bp, Homo sapiens
ggcctgggagatgcagct

SEQ ID NO: 5042230 - DNA, 20 bp, Homo sapiens
ggcctgggagatgcagctgg

SEQ ID NO: 5042231 - DNA, 22 bp, Homo sapiens
ggcctgggagatgcagctggat

SEQ ID NO: 5042232 - DNA, 19 bp, Homo sapiens
ggcgcaagcgacacaggct

SEQ ID NO: 5042233 - DNA, 15 bp, Homo sapiens
ggcgggctgatgtct

SEQ ID NO: 5042234 - DNA, 16 bp, Homo sapiens
ggctcaggctgcccag

SEQ ID NO: 5042235 - DNA, 12 bp, Homo sapiens
ggctcttcctgg

SEQ ID NO: 5042236 - DNA, 12 bp, Homo sapiens
ggctgcagggac

SEQ ID NO: 5042237 - DNA, 13 bp, Homo sapiens
ggctgcccagcgg

SEQ ID NO: 5042238 - DNA, 15 bp, Homo sapiens
ggctggaccacgtct

SEQ ID NO: 5042239 - DNA, 17 bp, Homo sapiens
ggctgggcgcctctgtc

SEQ ID NO: 5042240 - DNA, 22 bp, Homo sapiens
gaccacgtctccctggccccag

SEQ ID NO: 5042241 - DNA, 23 bp, Homo sapiens
gaccacgtctccctggccccagt

SEQ ID NO: 5042242 - DNA, 18 bp, Homo sapiens
gaccccaccctgtctgca

SEQ ID NO: 5042243 - DNA, 12 bp, Homo sapiens
gaccctcccagg

SEQ ID NO: 5042244 - DNA, 18 bp, Homo sapiens
gacctgaccagactgtgg

SEQ ID NO: 5042245 - DNA, 16 bp, Homo sapiens
gactctggctgccaag

SEQ ID NO: 5042246 - DNA, 20 bp, Homo sapiens
gactggtcccccatgggctg

SEQ ID NO: 5042247 - DNA, 23 bp, Homo sapiens
gactggtcccccatgggctgctg

SEQ ID NO: 5042248 - DNA, 17 bp, Homo sapiens
gaggcctgggagatgca

SEQ ID NO: 5042249 - DNA, 17 bp, Homo sapiens
gaggctggcggggtctg

SEQ ID NO: 5042250 - DNA, 12 bp, Homo sapiens
gagggcaaacca

SEQ ID NO: 5042251 - DNA, 21 bp, Homo sapiens
gagggcgcctgggtcctccca

SEQ ID NO: 5042252 - DNA, 23 bp, Homo sapiens
gagggcgcctgggtcctcccagc

SEQ ID NO: 5042253 - DNA, 18 bp, Homo sapiens
gagtgactctggctgcca

SEQ ID NO: 5042254 - DNA, 23 bp, Homo sapiens
gagtgccacgtggccgctgccca

SEQ ID NO: 5042255 - DNA, 13 bp, Homo sapiens
gagtggctcccgt

SEQ ID NO: 5042256 - DNA, 23 bp, Homo sapiens
gagtgggctctctggacctgacc

SEQ ID NO: 5042257 - DNA, 20 bp, Homo sapiens
gatcaggtcagagcccagga

SEQ ID NO: 5042258 - DNA, 15 bp, Homo sapiens
gatgcatctgtggcc

SEQ ID NO: 5042259 - DNA, 17 bp, Homo sapiens
gatgcatctgtggcctg

SEQ ID NO: 5042260 - DNA, 23 bp, Homo sapiens
gatggggcggcctgcagaccctg

SEQ ID NO: 5042261 - DNA, 17 bp, Homo sapiens
gcaaaccaggctgcagg

SEQ ID NO: 5042262 - DNA, 15 bp, Homo sapiens
gcaagacaccttccc

SEQ ID NO: 5042263 - DNA, 22 bp, Homo sapiens
gcaagcgacacaggctgccgct

SEQ ID NO: 5042264 - DNA, 21 bp, Homo sapiens
gcaaggtgcacctgccccagg

SEQ ID NO: 5042265 - DNA, 13 bp, Homo sapiens
gcacctgccccag

SEQ ID NO: 5042266 - DNA, 16 bp, Homo sapiens
gcacctgccccaggct

SEQ ID NO: 5042267 - DNA, 15 bp, Homo sapiens
gcactgtcatgccca

SEQ ID NO: 5042268 - DNA, 16 bp, Homo sapiens
gcactgtcatgcccag

SEQ ID NO: 5042269 - DNA, 17 bp, Homo sapiens
gcactgtcatgcccagc

SEQ ID NO: 5042270 - DNA, 14 bp, Homo sapiens
gcagaccctgccag

SEQ ID NO: 5042271 - DNA, 16 bp, Homo sapiens
gcagaccctgccaggg

SEQ ID NO: 5042272 - DNA, 20 bp, Homo sapiens
gcagctggatggggcggcct

SEQ ID NO: 5042273 - DNA, 21 bp, Homo sapiens
gcaggcaagacaccttcccag

SEQ ID NO: 5042274 - DNA, 15 bp, Homo sapiens
gcagggacagttggg

SEQ ID NO: 5042275 - DNA, 16 bp, Homo sapiens
gcagggctgggcgcct

SEQ ID NO: 5042276 - DNA, 13 bp, Homo sapiens
gcaggggcccctc

SEQ ID NO: 5042277 - DNA, 16 bp, Homo sapiens
gcagtcctcggcagct

SEQ ID NO: 5042278 - DNA, 14 bp, Homo sapiens
gcatctgtggcctg

SEQ ID NO: 5042279 - DNA, 16 bp, Homo sapiens
gcatctgtggcctggg

SEQ ID NO: 5042280 - DNA, 20 bp, Homo sapiens
gcatggccgcaacttcccag

SEQ ID NO: 5042281 - DNA, 14 bp, Homo sapiens
gccacactggccgg

SEQ ID NO: 5042282 - DNA, 15 bp, Homo sapiens
gccacatggccgctg

SEQ ID NO: 5042283 - DNA, 19 bp, Homo sapiens
gccacgtggccgctgccca

SEQ ID NO: 5042284 - DNA, 15 bp, Homo sapiens
gccaggccctctctg

SEQ ID NO: 5042285 - DNA, 19 bp, Homo sapiens
gccaggccctctctgcagt

SEQ ID NO: 5042286 - DNA, 17 bp, Homo sapiens
gccagggggtttgagga

SEQ ID NO: 5042287 - DNA, 13 bp, Homo sapiens
gccatggccagga

SEQ ID NO: 5042288 - DNA, 15 bp, Homo sapiens
gcccacctgccaggc

SEQ ID NO: 5042289 - DNA, 20 bp, Homo sapiens
gcccacctgccaggctgcag

SEQ ID NO: 5042290 - DNA, 22 bp, Homo sapiens
gcccacctgccaggctgcaggg

SEQ ID NO: 5042291 - DNA, 17 bp, Homo sapiens
gcccactctgaccgggc

SEQ ID NO: 5042292 - DNA, 17 bp, Homo sapiens
gcccagcctggccccaa

SEQ ID NO: 5042293 - DNA, 17 bp, Homo sapiens
gccccaggctcaggctg

SEQ ID NO: 5042294 - DNA, 23 bp, Homo sapiens
gccccaggctcaggctgcccagc

SEQ ID NO: 5042295 - DNA, 18 bp, Homo sapiens
gcccccggctcggcctct

SEQ ID NO: 5042296 - DNA, 14 bp, Homo sapiens
gcccctccctcctg

SEQ ID NO: 5042297 - DNA, 17 bp, Homo sapiens
gcccctccctcctgtgt

SEQ ID NO: 5042298 - DNA, 14 bp, Homo sapiens
gcccctcctccaga

SEQ ID NO: 5042299 - DNA, 18 bp, Homo sapiens
gcccctcctccagagcct

SEQ ID NO: 5042300 - DNA, 20 bp, Homo sapiens
gcccggagatgcatctgtgg

SEQ ID NO: 5042301 - DNA, 21 bp, Homo sapiens
gccctctctgcagtcctcggc

SEQ ID NO: 5042302 - DNA, 15 bp, Homo sapiens
gccggcccacgtcct

SEQ ID NO: 5042303 - DNA, 22 bp, Homo sapiens
gcctctctcatggcttgggctg

SEQ ID NO: 5042304 - DNA, 20 bp, Homo sapiens
gcctgcagaccctgccaggg

SEQ ID NO: 5042305 - DNA, 11 bp, Homo sapiens
gcctggcccca

SEQ ID NO: 5042306 - DNA, 15 bp, Homo sapiens
gcctggccccaagca

SEQ ID NO: 5042307 - DNA, 17 bp, Homo sapiens
gcgacacaggctgccgc

SEQ ID NO: 5042308 - DNA, 23 bp, Homo sapiens
gcgcaagcgacacaggctgccgc

SEQ ID NO: 5042309 - DNA, 16 bp, Homo sapiens
gcgccaccgtgggaga

SEQ ID NO: 5042310 - DNA, 11 bp, Homo sapiens
gcgcctgggtc

SEQ ID NO: 5042311 - DNA, 14 bp, Homo sapiens
gcgcctgggtcctc

SEQ ID NO: 5042312 - DNA, 19 bp, Homo sapiens
gcgcctgggtcctcccagc

SEQ ID NO: 5042313 - DNA, 22 bp, Homo sapiens
gcgcctgggtcctcccagctga

SEQ ID NO: 5042314 - DNA, 14 bp, Homo sapiens
gcggaaaccgggtg

SEQ ID NO: 5042315 - DNA, 13 bp, Homo sapiens
gcggcctgcagac

SEQ ID NO: 5042316 - DNA, 18 bp, Homo sapiens
gcggcctgcagaccctgc

SEQ ID NO: 5042317 - DNA, 13 bp, Homo sapiens
gctagtctgtgcc

SEQ ID NO: 5042318 - DNA, 14 bp, Homo sapiens
gctagtctgtgcct

SEQ ID NO: 5042319 - DNA, 15 bp, Homo sapiens
gctagtctgtgcctc

SEQ ID NO: 5042320 - DNA, 18 bp, Homo sapiens
gctctctggacctgacca

SEQ ID NO: 5042321 - DNA, 15 bp, Homo sapiens
gctgcatccaaggct

SEQ ID NO: 5042322 - DNA, 16 bp, Homo sapiens
gctgcatccaaggctt

SEQ ID NO: 5042323 - DNA, 19 bp, Homo sapiens
gctgcccacgtcccgggca

SEQ ID NO: 5042324 - DNA, 13 bp, Homo sapiens
gctgctctcccag

SEQ ID NO: 5042325 - DNA, 14 bp, Homo sapiens
gctggaaaggcccg

SEQ ID NO: 5042326 - DNA, 16 bp, Homo sapiens
gctggatggggcggcc

SEQ ID NO: 5042327 - DNA, 22 bp, Homo sapiens
gctggatggggcggcctgcaga

SEQ ID NO: 5042328 - DNA, 16 bp, Homo sapiens
gctgggcgcctctgtc

SEQ ID NO: 5042329 - DNA, 14 bp, Homo sapiens
gctgtcatgcccag

SEQ ID NO: 5042330 - DNA, 19 bp, Homo sapiens
gctgtcatgcccagcttgg

SEQ ID NO: 5042331 - DNA, 14 bp, Homo sapiens
gcttggagtgccac

SEQ ID NO: 5042332 - DNA, 21 bp, Homo sapiens
gctttgtaaaccggctggacc

SEQ ID NO: 5042333 - DNA, 17 bp, Homo sapiens
ggaacaggagtgactct

SEQ ID NO: 5042334 - DNA, 21 bp, Homo sapiens
ggaaggacacagtcaggggcc

SEQ ID NO: 5042335 - DNA, 20 bp, Homo sapiens
ggacagtgagagcagggctg

SEQ ID NO: 5042336 - DNA, 18 bp, Homo sapiens
ggacagttgggtgtgaga

SEQ ID NO: 5042337 - DNA, 18 bp, Homo sapiens
ggaccacgtctccctggc

SEQ ID NO: 5042338 - DNA, 22 bp, Homo sapiens
ggagccgcaggggcccctcctc

SEQ ID NO: 5042339 - DNA, 21 bp, Homo sapiens
ggaggcctgggagatgcagct

SEQ ID NO: 5042340 - DNA, 13 bp, Homo sapiens
ggagtgggctctc

SEQ ID NO: 5042341 - DNA, 17 bp, Homo sapiens
ggagtgggctctctgga

SEQ ID NO: 5042342 - DNA, 18 bp, Homo sapiens
ggagtgggtttccctgcg

SEQ ID NO: 5042343 - DNA, 22 bp, Homo sapiens
ggcaaacactttggccacagcc

SEQ ID NO: 5042344 - DNA, 16 bp, Homo sapiens
ggcaaaccaggctgca

SEQ ID NO: 5042345 - DNA, 18 bp, Homo sapiens
ggcagcgcccagcctggc

SEQ ID NO: 5042346 - DNA, 22 bp, Homo sapiens
ggcagcgcccagcctggcccca

SEQ ID NO: 5042347 - DNA, 22 bp, Homo sapiens
ggccacccccacctccctgcag

SEQ ID NO: 5042348 - DNA, 17 bp, Homo sapiens
ggccaggagtgggtttc

SEQ ID NO: 5042349 - DNA, 20 bp, Homo sapiens
ggcccctcctccagagcctg

SEQ ID NO: 5042350 - DNA, 13 bp, Homo sapiens
ggccctctctgca

SEQ ID NO: 5042351 - DNA, 19 bp, Homo sapiens
ggccgcaacttcccaggcc

SEQ ID NO: 5042352 - DNA, 19 bp, Homo sapiens
ggccgctgctgtgacaggc

SEQ ID NO: 5042353 - DNA, 21 bp, Homo sapiens
ggccggcccacgtcctgggtg

SEQ ID NO: 5042354 - DNA, 23 bp, Homo sapiens
gcagaccccaccctgtctgcagg

SEQ ID NO: 5042355 - DNA, 23 bp, Homo sapiens
gcagctttgaggctggcggggtc

SEQ ID NO: 5042356 - DNA, 23 bp, Homo sapiens
gcaggccacccccacctccctgc

SEQ ID NO: 5042357 - DNA, 17 bp, Homo sapiens
gcagtcctcggcagctc

SEQ ID NO: 5042358 - DNA, 18 bp, Homo sapiens
gcagtcctcggcagctcc

SEQ ID NO: 5042359 - DNA, 19 bp, Homo sapiens
gcatctgtggcctggggcc

SEQ ID NO: 5042360 - DNA, 21 bp, Homo sapiens
gcatggccgcaacttcccagg

SEQ ID NO: 5042361 - DNA, 23 bp, Homo sapiens
gcatggccgcaacttcccaggcc

SEQ ID NO: 5042362 - DNA, 13 bp, Homo sapiens
gccacagccccaa

SEQ ID NO: 5042363 - DNA, 19 bp, Homo sapiens
gccacatggccgctgccca

SEQ ID NO: 5042364 - DNA, 23 bp, Homo sapiens
gccacccccacctccctgcagct

SEQ ID NO: 5042365 - DNA, 14 bp, Homo sapiens
gccacgtggccgct

SEQ ID NO: 5042366 - DNA, 21 bp, Homo sapiens
gccaggagtgggtttccctgc

SEQ ID NO: 5042367 - DNA, 18 bp, Homo sapiens
gccaggccctctctgcag

SEQ ID NO: 5042368 - DNA, 13 bp, Homo sapiens
gccaggctgcagg

SEQ ID NO: 5042369 - DNA, 22 bp, Homo sapiens
gccagggggtttgaggaccctc

SEQ ID NO: 5042370 - DNA, 13 bp, Homo sapiens
gcccacctgccag

SEQ ID NO: 5042371 - DNA, 21 bp, Homo sapiens
gcccacctgccaggctgcagg

SEQ ID NO: 5042372 - DNA, 15 bp, Homo sapiens
gcccacgtcctgggt

SEQ ID NO: 5042373 - DNA, 17 bp, Homo sapiens
gcccacgtcctgggtgc

SEQ ID NO: 5042374 - DNA, 20 bp, Homo sapiens
gcccagcctggccccaagca

SEQ ID NO: 5042375 - DNA, 21 bp, Homo sapiens
gcccagcttggagtgccacgt

SEQ ID NO: 5042376 - DNA, 18 bp, Homo sapiens
gccccaggctcaggctgc

SEQ ID NO: 5042377 - DNA, 21 bp, Homo sapiens
gccccaggctcaggctgccca

SEQ ID NO: 5042378 - DNA, 19 bp, Homo sapiens
gcccctcctccagagcctg

SEQ ID NO: 5042379 - DNA, 22 bp, Homo sapiens
gcccctcctccagagcctgggc

SEQ ID NO: 5042380 - DNA, 15 bp, Homo sapiens
gcccgggagccgcag

SEQ ID NO: 5042381 - DNA, 19 bp, Homo sapiens
gccctgagctactgcttct

SEQ ID NO: 5042382 - DNA, 15 bp, Homo sapiens
gccctgtctccctac

SEQ ID NO: 5042383 - DNA, 18 bp, Homo sapiens
gccgcaacttcccaggcc

SEQ ID NO: 5042384 - DNA, 18 bp, Homo sapiens
gccgctgctgtgacaggc

SEQ ID NO: 5042385 - DNA, 16 bp, Homo sapiens
gccggcccacgtcctg

SEQ ID NO: 5042386 - DNA, 23 bp, Homo sapiens
gccggcccacgtcctgggtgctg

SEQ ID NO: 5042387 - DNA, 18 bp, Homo sapiens
gccgggtcgcctgccctg

SEQ ID NO: 5042388 - DNA, 23 bp, Homo sapiens
gcctcagtgagatcagtcagctc

SEQ ID NO: 5042389 - DNA, 15 bp, Homo sapiens
gcctctgtcctggcc

SEQ ID NO: 5042390 - DNA, 15 bp, Homo sapiens
gcctgcagaccctgc

SEQ ID NO: 5042391 - DNA, 19 bp, Homo sapiens
gcctgcagaccctgccagg

SEQ ID NO: 5042392 - DNA, 16 bp, Homo sapiens
gcctgggagatgcagc

SEQ ID NO: 5042393 - DNA, 18 bp, Homo sapiens
gcctgggagatgcagctg

SEQ ID NO: 5042394 - DNA, 16 bp, Homo sapiens
gcctgggtcctcccag

SEQ ID NO: 5042395 - DNA, 17 bp, Homo sapiens
gcctgggtcctcccagc

SEQ ID NO: 5042396 - DNA, 18 bp, Homo sapiens
gcctgggtcctcccagct

SEQ ID NO: 5042397 - DNA, 19 bp, Homo sapiens
gcctgggtcctcccagctg

SEQ ID NO: 5042398 - DNA, 22 bp, Homo sapiens
gcgcaagcgacacaggctgccg

SEQ ID NO: 5042399 - DNA, 17 bp, Homo sapiens
gcggaacaggagtgact

SEQ ID NO: 5042400 - DNA, 15 bp, Homo sapiens
gcggctcttcctgga

SEQ ID NO: 5042401 - DNA, 17 bp, Homo sapiens
gcggggtctgctcctgg

SEQ ID NO: 5042402 - DNA, 23 bp, Homo sapiens
gcggtcactgcccacctgccagg

SEQ ID NO: 5042403 - DNA, 20 bp, Homo sapiens
gcgtctcctcgtcccgaggg

SEQ ID NO: 5042404 - DNA, 18 bp, Homo sapiens
gctagtctgtgcctcagt

SEQ ID NO: 5042405 - DNA, 19 bp, Homo sapiens
gctagtctgtgcctcagtg

SEQ ID NO: 5042406 - DNA, 18 bp, Homo sapiens
gctcaagtttcagagtca

SEQ ID NO: 5042407 - DNA, 15 bp, Homo sapiens
gctcaggctgcccag

SEQ ID NO: 5042408 - DNA, 16 bp, Homo sapiens
gctcaggctgcccagc

SEQ ID NO: 5042409 - DNA, 12 bp, Homo sapiens
gctctctggacc

SEQ ID NO: 5042410 - DNA, 13 bp, Homo sapiens
gctgacttgcaga

SEQ ID NO: 5042411 - DNA, 21 bp, Homo sapiens
gctgagcccctccctcctgtg

SEQ ID NO: 5042412 - DNA, 23 bp, Homo sapiens
gctggaccacgtctccctggccc

SEQ ID NO: 5042413 - DNA, 14 bp, Homo sapiens
gctggagtgggctc

SEQ ID NO: 5042414 - DNA, 14 bp, Homo sapiens
gctggcggggtctg

SEQ ID NO: 5042415 - DNA, 21 bp, Homo sapiens
gctgggcgcctctgtcctggc

SEQ ID NO: 5042416 - DNA, 16 bp, Homo sapiens
gctgtcatgcccagct

SEQ ID NO: 5042417 - DNA, 16 bp, Homo sapiens
gctttgaggctggcgg

SEQ ID NO: 5042418 - DNA, 20 bp, Homo sapiens
gctttgggtagtgccatggc

SEQ ID NO: 5042419 - DNA, 15 bp, Homo sapiens
ggaaggacacagtca

SEQ ID NO: 5042420 - DNA, 17 bp, Homo sapiens
ggacaagccaggccctc

SEQ ID NO: 5042421 - DNA, 14 bp, Homo sapiens
ggaccctcccaggt

SEQ ID NO: 5042422 - DNA, 20 bp, Homo sapiens
ggacgacccggggcgggctg

SEQ ID NO: 5042423 - DNA, 17 bp, Homo sapiens
ggagaggagaggctgct

SEQ ID NO: 5042424 - DNA, 14 bp, Homo sapiens
ggagatgcagctgg

SEQ ID NO: 5042425 - DNA, 20 bp, Homo sapiens
ggagtgccacgtggccgctg

SEQ ID NO: 5042426 - DNA, 23 bp, Homo sapiens
ggatcttacccacttccctgcaa

SEQ ID NO: 5042427 - DNA, 13 bp, Homo sapiens
ggcaaaccaggct

SEQ ID NO: 5042428 - DNA, 19 bp, Homo sapiens
ggcactgtcatgcccagct

SEQ ID NO: 5042429 - DNA, 21 bp, Homo sapiens
ggcactgtcatgcccagcttg

SEQ ID NO: 5042430 - DNA, 19 bp, Homo sapiens
ggcagtgttcttgggggtg

SEQ ID NO: 5042431 - DNA, 20 bp, Homo sapiens
ggccacccccacctccctgc

SEQ ID NO: 5042432 - DNA, 17 bp, Homo sapiens
ggcccacgtcctgggtg

SEQ ID NO: 5042433 - DNA, 15 bp, Homo sapiens
ggcccctcctccaga

SEQ ID NO: 5042434 - DNA, 20 bp, Homo sapiens
ggcccggagatgcatctgtg

SEQ ID NO: 5042435 - DNA, 14 bp, Homo sapiens
ggccctctctgcag

SEQ ID NO: 5042436 - DNA, 15 bp, Homo sapiens
ggccctctctgcagt

SEQ ID NO: 5042437 - DNA, 16 bp, Homo sapiens
ggccgcaacttcccag

SEQ ID NO: 5042438 - DNA, 18 bp, Homo sapiens
ggccgcaacttcccaggc

SEQ ID NO: 5042439 - DNA, 20 bp, Homo sapiens
ggccggcccacgtcctgggt

SEQ ID NO: 5042440 - DNA, 20 bp, Homo sapiens
ggcctgcagaccctgccagg

SEQ ID NO: 5042441 - DNA, 22 bp, Homo sapiens
ggcctgcagaccctgccagggg

SEQ ID NO: 5042442 - DNA, 13 bp, Homo sapiens
ggcgcctctgtcc

SEQ ID NO: 5042443 - DNA, 12 bp, Homo sapiens
ggcgcctgggtc

SEQ ID NO: 5042444 - DNA, 14 bp, Homo sapiens
ggcggcctgcagac

SEQ ID NO: 5042445 - DNA, 15 bp, Homo sapiens
ggctagtctgtgcct

SEQ ID NO: 5042446 - DNA, 17 bp, Homo sapiens
ggctagtctgtgcctca

SEQ ID NO: 5042447 - DNA, 19 bp, Homo sapiens
ggctgccgctgctctccca

SEQ ID NO: 5042448 - DNA, 22 bp, Homo sapiens
ggctggaccacgtctccctggc

SEQ ID NO: 5042449 - DNA, 13 bp, Homo sapiens
ggctggagtgggc

SEQ ID NO: 5042450 - DNA, 18 bp, Homo sapiens
ggctggcggggtctgctc

SEQ ID NO: 5042451 - DNA, 23 bp, Homo sapiens
gggacaagccaggccctctctgc

SEQ ID NO: 5042452 - DNA, 15 bp, Homo sapiens
gggagccgcaggggc

SEQ ID NO: 5042453 - DNA, 16 bp, Homo sapiens
gggagccgcaggggcc

SEQ ID NO: 5042454 - DNA, 14 bp, Homo sapiens
gggcaaaccaggct

SEQ ID NO: 5042455 - DNA, 22 bp, Homo sapiens
gggcactgtcatgcccagcttg

SEQ ID NO: 5042456 - DNA, 16 bp, Homo sapiens
gggcccctcctccaga

SEQ ID NO: 5042457 - DNA, 22 bp, Homo sapiens
gggcccctcctccagagcctgg

SEQ ID NO: 5042458 - DNA, 23 bp, Homo sapiens
gggcccctcctccagagcctggg

SEQ ID NO: 5042459 - DNA, 15 bp, Homo sapiens
gggctgggcgcctct

SEQ ID NO: 5042460 - DNA, 16 bp, Homo sapiens
ggggcagaccagagag

SEQ ID NO: 5042461 - DNA, 23 bp, Homo sapiens
gggggtttgaggaccctcccagg

SEQ ID NO: 5042462 - DNA, 16 bp, Homo sapiens
ggggtgggagccacag

SEQ ID NO: 5042463 - DNA, 16 bp, Homo sapiens
gggtacagcccaggcg

SEQ ID NO: 5042464 - DNA, 13 bp, Homo sapiens
gggtcctcccagc

SEQ ID NO: 5042465 - DNA, 21 bp, Homo sapiens
gggtgctgtcatgcccagctt

SEQ ID NO: 5042466 - DNA, 22 bp, Homo sapiens
gggtggcagcgcccagcctggc

SEQ ID NO: 5042467 - DNA, 14 bp, Homo sapiens
ggtacagcccaggc

SEQ ID NO: 5042468 - DNA, 19 bp, Homo sapiens
ggtagtgccatggccagga

SEQ ID NO: 5042469 - DNA, 22 bp, Homo sapiens
ggtcactgcccacctgccaggc

SEQ ID NO: 5042470 - DNA, 23 bp, Homo sapiens
ggtcactgcccacctgccaggct

SEQ ID NO: 5042471 - DNA, 18 bp, Homo sapiens
ggtccctgcgtctcctgc

SEQ ID NO: 5042472 - DNA, 13 bp, Homo sapiens
ggtcctcccagct

SEQ ID NO: 5042473 - DNA, 20 bp, Homo sapiens
ggtcttagggtacagcccag

SEQ ID NO: 5042474 - DNA, 13 bp, Homo sapiens
ggtcttctccatc

SEQ ID NO: 5042475 - DNA, 15 bp, Homo sapiens
ggtgggagccacagg

SEQ ID NO: 5042476 - DNA, 22 bp, Homo sapiens
ggtgtgagaataacactggctt

SEQ ID NO: 5042477 - DNA, 20 bp, Homo sapiens
ggtgttcatgacaagtggaa

SEQ ID NO: 5042478 - DNA, 23 bp, Homo sapiens
ggtttgaggaccctcccaggttt

SEQ ID NO: 5042479 - DNA, 21 bp, Homo sapiens
ggttttgtttctttccttctg

SEQ ID NO: 5042480 - DNA, 21 bp, Homo sapiens
gtaacagcaggagcatggccg

SEQ ID NO: 5042481 - DNA, 13 bp, Homo sapiens
gtacagcccaggc

SEQ ID NO: 5042482 - DNA, 12 bp, Homo sapiens
gtaccggatgca

SEQ ID NO: 5042483 - DNA, 18 bp, Homo sapiens
gtcactgcccacctgcca

SEQ ID NO: 5042484 - DNA, 12 bp, Homo sapiens
gtcatgcccagc

SEQ ID NO: 5042485 - DNA, 19 bp, Homo sapiens
gtcccgagggcgcctgggt

SEQ ID NO: 5042486 - DNA, 17 bp, Homo sapiens
gtccctgcgtctcctgc

SEQ ID NO: 5042487 - DNA, 14 bp, Homo sapiens
gtcctcggcagctc

SEQ ID NO: 5042488 - DNA, 16 bp, Homo sapiens
gtctccctggccccag

SEQ ID NO: 5042489 - DNA, 13 bp, Homo sapiens
gtctcctgcccac

SEQ ID NO: 5042490 - DNA, 20 bp, Homo sapiens
gtcttagggtacagcccagg

SEQ ID NO: 5042491 - DNA, 19 bp, Homo sapiens
agcgacacaggctgccgct

SEQ ID NO: 5042492 - DNA, 21 bp, Homo sapiens
agcgccaccgtgggagaggag

SEQ ID NO: 5042493 - DNA, 18 bp, Homo sapiens
agcgccctctacctccta

SEQ ID NO: 5042494 - DNA, 23 bp, Homo sapiens
agctggatggggcggcctgcaga

SEQ ID NO: 5042495 - DNA, 15 bp, Homo sapiens
agcttggagtgccac

SEQ ID NO: 5042496 - DNA, 15 bp, Homo sapiens
aggaccctcccaggt

SEQ ID NO: 5042497 - DNA, 23 bp, Homo sapiens
aggagtgactctggctgccaaga

SEQ ID NO: 5042498 - DNA, 22 bp, Homo sapiens
aggagtgggtttccctgcgtct

SEQ ID NO: 5042499 - DNA, 12 bp, Homo sapiens
aggccaccccca

SEQ ID NO: 5042500 - DNA, 19 bp, Homo sapiens
aggcctgggagatgcagct

SEQ ID NO: 5042501 - DNA, 17 bp, Homo sapiens
aggcggtcactgcccac

SEQ ID NO: 5042502 - DNA, 23 bp, Homo sapiens
aggcggtcactgcccacctgcca

SEQ ID NO: 5042503 - DNA, 14 bp, Homo sapiens
aggctcaggctgcc

SEQ ID NO: 5042504 - DNA, 15 bp, Homo sapiens
aggctcaggctgccc

SEQ ID NO: 5042505 - DNA, 17 bp, Homo sapiens
aggctcaggctgcccag

SEQ ID NO: 5042506 - DNA, 14 bp, Homo sapiens
aggctgcagggaca

SEQ ID NO: 5042507 - DNA, 12 bp, Homo sapiens
aggctgcccagc

SEQ ID NO: 5042508 - DNA, 20 bp, Homo sapiens
aggctgccgctgctctccca

SEQ ID NO: 5042509 - DNA, 22 bp, Homo sapiens
agggacgacccggggcgggctg

SEQ ID NO: 5042510 - DNA, 17 bp, Homo sapiens
agggcaaaccaggctgc

SEQ ID NO: 5042511 - DNA, 18 bp, Homo sapiens
agggcaaaccaggctgca

SEQ ID NO: 5042512 - DNA, 20 bp, Homo sapiens
agggcgcctgggtcctccca

SEQ ID NO: 5042513 - DNA, 23 bp, Homo sapiens
agggcgcctgggtcctcccagct

SEQ ID NO: 5042514 - DNA, 20 bp, Homo sapiens
agggctgggcgcctctgtcc

SEQ ID NO: 5042515 - DNA, 14 bp, Homo sapiens
agggtacagcccag

SEQ ID NO: 5042516 - DNA, 15 bp, Homo sapiens
agggtacagcccagg

SEQ ID NO: 5042517 - DNA, 22 bp, Homo sapiens
agggtagtttaattttaaaata

SEQ ID NO: 5042518 - DNA, 14 bp, Homo sapiens
aggtcagagcccag

SEQ ID NO: 5042519 - DNA, 16 bp, Homo sapiens
aggtcagagcccagga

SEQ ID NO: 5042520 - DNA, 17 bp, Homo sapiens
aggtgcacctgccccag

SEQ ID NO: 5042521 - DNA, 19 bp, Homo sapiens
agtcagctccgagtggctc

SEQ ID NO: 5042522 - DNA, 16 bp, Homo sapiens
agtctgtgcctcagtg

SEQ ID NO: 5042523 - DNA, 20 bp, Homo sapiens
agtgagagcagggctgggcg

SEQ ID NO: 5042524 - DNA, 15 bp, Homo sapiens
agtgagttggggcga

SEQ ID NO: 5042525 - DNA, 18 bp, Homo sapiens
agtgccatggccaggagt

SEQ ID NO: 5042526 - DNA, 22 bp, Homo sapiens
agtgggatcttacccacttccc

SEQ ID NO: 5042527 - DNA, 16 bp, Homo sapiens
atctgtggcctggggc

SEQ ID NO: 5042528 - DNA, 18 bp, Homo sapiens
atgaacgttttctcttca

SEQ ID NO: 5042529 - DNA, 19 bp, Homo sapiens
atgcatctgtggcctgggg

SEQ ID NO: 5042530 - DNA, 15 bp, Homo sapiens
gaggagaggctgctg

SEQ ID NO: 5042531 - DNA, 13 bp, Homo sapiens
gaggcctgggaga

SEQ ID NO: 5042532 - DNA, 22 bp, Homo sapiens
gaggcctgggagatgcagctgg

SEQ ID NO: 5042533 - DNA, 16 bp, Homo sapiens
gagggcaaaccaggct

SEQ ID NO: 5042534 - DNA, 14 bp, Homo sapiens
gagggcgcctgggt

SEQ ID NO: 5042535 - DNA, 14 bp, Homo sapiens
gagtgactctggct

SEQ ID NO: 5042536 - DNA, 16 bp, Homo sapiens
gagtgactctggctgc

SEQ ID NO: 5042537 - DNA, 19 bp, Homo sapiens
gagtgactctggctgccaa

SEQ ID NO: 5042538 - DNA, 18 bp, Homo sapiens
gagtgccacatggccgct

SEQ ID NO: 5042539 - DNA, 19 bp, Homo sapiens
gagtgccacatggccgctg

SEQ ID NO: 5042540 - DNA, 17 bp, Homo sapiens
gagtgggctctctggac

SEQ ID NO: 5042541 - DNA, 19 bp, Homo sapiens
gatggggcggcctgcagac

SEQ ID NO: 5042542 - DNA, 20 bp, Homo sapiens
gcaaacactttggccacagc

SEQ ID NO: 5042543 - DNA, 16 bp, Homo sapiens
gcaacttcccaggccg

SEQ ID NO: 5042544 - DNA, 19 bp, Homo sapiens
gcactgtcatgcccagctt

SEQ ID NO: 5042545 - DNA, 22 bp, Homo sapiens
gcactgtcatgcccagcttgga

SEQ ID NO: 5042546 - DNA, 17 bp, Homo sapiens
gcagaccagagagctca

SEQ ID NO: 5042547 - DNA, 15 bp, Homo sapiens
gcagaccctgccagg

SEQ ID NO: 5042548 - DNA, 17 bp, Homo sapiens
gcagaccctgccagggg

SEQ ID NO: 5042549 - DNA, 23 bp, Homo sapiens
gcaggcaagacaccttcccagct

SEQ ID NO: 5042550 - DNA, 16 bp, Homo sapiens
gcagggacagttgggt

SEQ ID NO: 5042551 - DNA, 14 bp, Homo sapiens
gcagggctgggcgc

SEQ ID NO: 5042552 - DNA, 23 bp, Homo sapiens
gcagggctgggcgcctctgtcct

SEQ ID NO: 5042553 - DNA, 16 bp, Homo sapiens
gcaggggcccctcctc

SEQ ID NO: 5042554 - DNA, 22 bp, Homo sapiens
gcaggtggggttttcacttcct

SEQ ID NO: 5042555 - DNA, 18 bp, Homo sapiens
gcatctgtggcctggggc

SEQ ID NO: 5042556 - DNA, 22 bp, Homo sapiens
gcatggccgcaacttcccaggc

SEQ ID NO: 5042557 - DNA, 21 bp, Homo sapiens
gccacactggccggcccacgt

SEQ ID NO: 5042558 - DNA, 22 bp, Homo sapiens
gccacatggccgctgcccacgt

SEQ ID NO: 5042559 - DNA, 21 bp, Homo sapiens
gccacgtggccgctgcccacg

SEQ ID NO: 5042560 - DNA, 13 bp, Homo sapiens
gccaggagtgggt

SEQ ID NO: 5042561 - DNA, 20 bp, Homo sapiens
gccaggagtgggtttccctg

SEQ ID NO: 5042562 - DNA, 16 bp, Homo sapiens
gccaggccctctctgc

SEQ ID NO: 5042563 - DNA, 20 bp, Homo sapiens
gccaggccctctctgcagtc

SEQ ID NO: 5042564 - DNA, 23 bp, Homo sapiens
gccaggccctctctgcagtcctc

SEQ ID NO: 5042565 - DNA, 14 bp, Homo sapiens
gcccacctgccagg

SEQ ID NO: 5042566 - DNA, 16 bp, Homo sapiens
gcccacctgccaggct

SEQ ID NO: 5042567 - DNA, 17 bp, Homo sapiens
gcccacctgccaggctg

SEQ ID NO: 5042568 - DNA, 13 bp, Homo sapiens
gcccagcggctct

SEQ ID NO: 5042569 - DNA, 13 bp, Homo sapiens
gcccagcttggag

SEQ ID NO: 5042570 - DNA, 19 bp, Homo sapiens
gcccagcttggagtgccac

SEQ ID NO: 5042571 - DNA, 20 bp, Homo sapiens
gccccagctcctcttcctgc

SEQ ID NO: 5042572 - DNA, 14 bp, Homo sapiens
gcccgggagccgca

SEQ ID NO: 5042573 - DNA, 13 bp, Homo sapiens
gccctctctgcag

SEQ ID NO: 5042574 - DNA, 19 bp, Homo sapiens
gccgaggaagggcccccgg

SEQ ID NO: 5042575 - DNA, 17 bp, Homo sapiens
gccgcaacttcccaggc

SEQ ID NO: 5042576 - DNA, 19 bp, Homo sapiens
gccgcaggggcccctcctc

SEQ ID NO: 5042577 - DNA, 12 bp, Homo sapiens
gccgctgcccac

SEQ ID NO: 5042578 - DNA, 17 bp, Homo sapiens
gccgctgctctcccagg

SEQ ID NO: 5042579 - DNA, 18 bp, Homo sapiens
gccggcccacgtcctggg

SEQ ID NO: 5042580 - DNA, 20 bp, Homo sapiens
gccggcccacgtcctgggtg

SEQ ID NO: 5042581 - DNA, 12 bp, Homo sapiens
gcctctgtcctg

SEQ ID NO: 5042582 - DNA, 20 bp, Homo sapiens
gcctctgtcctggcccggga

SEQ ID NO: 5042583 - DNA, 18 bp, Homo sapiens
gcctgcagaccctgccag

SEQ ID NO: 5042584 - DNA, 17 bp, Homo sapiens
gcctgggagatgcagct

SEQ ID NO: 5042585 - DNA, 20 bp, Homo sapiens
gcctgggagatgcagctgga

SEQ ID NO: 5042586 - DNA, 15 bp, Homo sapiens
gcgacacaggctgcc

SEQ ID NO: 5042587 - DNA, 18 bp, Homo sapiens
gcgactgtgaaactggaa

SEQ ID NO: 5042588 - DNA, 18 bp, Homo sapiens
gcgcccagcctggcccca

SEQ ID NO: 5042589 - DNA, 18 bp, Homo sapiens
gcgcctgggtcctcccag

SEQ ID NO: 5042590 - DNA, 17 bp, Homo sapiens
tggatggggcggcctgc

SEQ ID NO: 5042591 - DNA, 20 bp, Homo sapiens
tggatggggcggcctgcaga

SEQ ID NO: 5042592 - DNA, 18 bp, Homo sapiens
tggcagcgcccagcctgg

SEQ ID NO: 5042593 - DNA, 23 bp, Homo sapiens
tggccggcccacgtcctgggtgc

SEQ ID NO: 5042594 - DNA, 22 bp, Homo sapiens
tgggctctctggacctgaccag

SEQ ID NO: 5042595 - DNA, 23 bp, Homo sapiens
tgggctgctggaaaggcccggag

SEQ ID NO: 5042596 - DNA, 15 bp, Homo sapiens
tggggcggcctgcag

SEQ ID NO: 5042597 - DNA, 16 bp, Homo sapiens
tgggggtggggctgca

SEQ ID NO: 5042598 - DNA, 14 bp, Homo sapiens
tggggttttcactt

SEQ ID NO: 5042599 - DNA, 13 bp, Homo sapiens
tgggtcctcccag

SEQ ID NO: 5042600 - DNA, 15 bp, Homo sapiens
tggtaccggatgcag

SEQ ID NO: 5042601 - DNA, 17 bp, Homo sapiens
tggtcccccatgggctg

SEQ ID NO: 5042602 - DNA, 13 bp, Homo sapiens
tgtcatgcccagc

SEQ ID NO: 5042603 - DNA, 22 bp, Homo sapiens
tgtcatgcccagcttggagtgc

SEQ ID NO: 5042604 - DNA, 19 bp, Homo sapiens
tgtcgtaacagcaggagca

SEQ ID NO: 5042605 - DNA, 16 bp, Homo sapiens
tgtgagggcaaaccag

SEQ ID NO: 5042606 - DNA, 13 bp, Homo sapiens
tgtggcctggggc

SEQ ID NO: 5042607 - DNA, 23 bp, Homo sapiens
tgtgtgagggcaaaccaggctgc

SEQ ID NO: 5042608 - DNA, 15 bp, Homo sapiens
tgtgtttgctcccat

SEQ ID NO: 5042609 - DNA, 22 bp, Homo sapiens
ttcccactgcggaacaggagtg

SEQ ID NO: 5042610 - DNA, 17 bp, Homo sapiens
ttgaggaccctcccagg

SEQ ID NO: 5042611 - DNA, 19 bp, Homo sapiens
ttggctagtctgtgcctca

SEQ ID NO: 5042612 - DNA, 18 bp, Homo sapiens
tttcccttgtgtgagggc

SEQ ID NO: 5042613 - DNA, 18 bp, Homo sapiens
tttgaggaccctcccagg

SEQ ID NO: 5042614 - DNA, 16 bp, Homo sapiens
ggcttcctccctccac

SEQ ID NO: 5042615 - DNA, 14 bp, Homo sapiens
gggacaagccaggc

SEQ ID NO: 5042616 - DNA, 23 bp, Homo sapiens
gggagccacagggacgacccggg

SEQ ID NO: 5042617 - DNA, 13 bp, Homo sapiens
gggcgactgtgaa

SEQ ID NO: 5042618 - DNA, 22 bp, Homo sapiens
gggcgcaagcgacacaggctgc

SEQ ID NO: 5042619 - DNA, 23 bp, Homo sapiens
gggcgcaagcgacacaggctgcc

SEQ ID NO: 5042620 - DNA, 16 bp, Homo sapiens
gggcgcctctgtcctg

SEQ ID NO: 5042621 - DNA, 17 bp, Homo sapiens
gggctgggcgcctctgt

SEQ ID NO: 5042622 - DNA, 21 bp, Homo sapiens
gggggcagaccagagagctca

SEQ ID NO: 5042623 - DNA, 22 bp, Homo sapiens
gggtactcagtcagcccagtgg

SEQ ID NO: 5042624 - DNA, 16 bp, Homo sapiens
gggtggcagcgcccag

SEQ ID NO: 5042625 - DNA, 21 bp, Homo sapiens
gggtggcagcgcccagcctgg

SEQ ID NO: 5042626 - DNA, 15 bp, Homo sapiens
gggtgggagccacag

SEQ ID NO: 5042627 - DNA, 21 bp, Homo sapiens
gggtttgaggaccctcccagg

SEQ ID NO: 5042628 - DNA, 15 bp, Homo sapiens
ggtacagcccaggcg

SEQ ID NO: 5042629 - DNA, 13 bp, Homo sapiens
ggtcactgcccac

SEQ ID NO: 5042630 - DNA, 21 bp, Homo sapiens
ggtcactgcccacctgccagg

SEQ ID NO: 5042631 - DNA, 13 bp, Homo sapiens
ggtcagagcccag

SEQ ID NO: 5042632 - DNA, 15 bp, Homo sapiens
ggtcagagcccagga

SEQ ID NO: 5042633 - DNA, 16 bp, Homo sapiens
ggtcccccatgggctg

SEQ ID NO: 5042634 - DNA, 12 bp, Homo sapiens
ggtcctcccagc

SEQ ID NO: 5042635 - DNA, 15 bp, Homo sapiens
ggtctgctcctggga

SEQ ID NO: 5042636 - DNA, 15 bp, Homo sapiens
ggtggggctgcatcc

SEQ ID NO: 5042637 - DNA, 21 bp, Homo sapiens
ggtggggctgcatccaaggct

SEQ ID NO: 5042638 - DNA, 22 bp, Homo sapiens
ggtgttttccttcacaatggtt

SEQ ID NO: 5042639 - DNA, 21 bp, Homo sapiens
ggtttgaggaccctcccaggt

SEQ ID NO: 5042640 - DNA, 16 bp, Homo sapiens
gtagtgccatggccag

SEQ ID NO: 5042641 - DNA, 21 bp, Homo sapiens
gtcactgcccacctgccaggc

SEQ ID NO: 5042642 - DNA, 15 bp, Homo sapiens
gtcaggggccgggca

SEQ ID NO: 5042643 - DNA, 20 bp, Homo sapiens
gtcccgagggcgcctgggtc

SEQ ID NO: 5042644 - DNA, 19 bp, Homo sapiens
gtcccgggtactcagtcag

SEQ ID NO: 5042645 - DNA, 17 bp, Homo sapiens
gtcctggcccgggagcc

SEQ ID NO: 5042646 - DNA, 14 bp, Homo sapiens
gtcgtaacagcagg

SEQ ID NO: 5042647 - DNA, 17 bp, Homo sapiens
gtctccctggccccagt

SEQ ID NO: 5042648 - DNA, 19 bp, Homo sapiens
gtgagggcaaaccaggctg

SEQ ID NO: 5042649 - DNA, 20 bp, Homo sapiens
gtgagggcaaaccaggctgc

SEQ ID NO: 5042650 - DNA, 23 bp, Homo sapiens
gtgagggcaaaccaggctgcagg

SEQ ID NO: 5042651 - DNA, 18 bp, Homo sapiens
gtgcacctgccccaggct

SEQ ID NO: 5042652 - DNA, 21 bp, Homo sapiens
gtgcacctgccccaggctcag

SEQ ID NO: 5042653 - DNA, 17 bp, Homo sapiens
gtgccacatggccgctg

SEQ ID NO: 5042654 - DNA, 20 bp, Homo sapiens
gtgccacatggccgctgccc

SEQ ID NO: 5042655 - DNA, 21 bp, Homo sapiens
gtgccacatggccgctgccca

SEQ ID NO: 5042656 - DNA, 22 bp, Homo sapiens
gtgccacatggccgctgcccac

SEQ ID NO: 5042657 - DNA, 18 bp, Homo sapiens
gtgccatggccaggagtg

SEQ ID NO: 5042658 - DNA, 23 bp, Homo sapiens
gtgctgtcatgcccagcttggag

SEQ ID NO: 5042659 - DNA, 15 bp, Homo sapiens
gtggcagcgcccagc

SEQ ID NO: 5042660 - DNA, 13 bp, Homo sapiens
gtggccgctgccc

SEQ ID NO: 5042661 - DNA, 15 bp, Homo sapiens
gtggccgctgcccac

SEQ ID NO: 5042662 - DNA, 14 bp, Homo sapiens
gtgggagccacagg

SEQ ID NO: 5042663 - DNA, 13 bp, Homo sapiens
gtttttgctggct

SEQ ID NO: 5042664 - DNA, 16 bp, Homo sapiens
taccggatgcagaccc

SEQ ID NO: 5042665 - DNA, 16 bp, Homo sapiens
tactcaaaatgcagga

SEQ ID NO: 5042666 - DNA, 18 bp, Homo sapiens
tactcaaaatgcaggaca

SEQ ID NO: 5042667 - DNA, 16 bp, Homo sapiens
tagggtctgtcccggg

SEQ ID NO: 5042668 - DNA, 15 bp, Homo sapiens
tcaccgccgtggggt

SEQ ID NO: 5042669 - DNA, 23 bp, Homo sapiens
tcactgagaaggccccagggcag

SEQ ID NO: 5042670 - DNA, 19 bp, Homo sapiens
tcactgcccacctgccagg

SEQ ID NO: 5042671 - DNA, 21 bp, Homo sapiens
tcactgcccacctgccaggct

SEQ ID NO: 5042672 - DNA, 21 bp, Homo sapiens
tcatgcccagcttggagtgcc

SEQ ID NO: 5042673 - DNA, 22 bp, Homo sapiens
tcccgggcactgtcatgcccag

SEQ ID NO: 5042674 - DNA, 20 bp, Homo sapiens
tccctacttagacccagtca

SEQ ID NO: 5042675 - DNA, 22 bp, Homo sapiens
tccctccacgcttagggtctgt

SEQ ID NO: 5042676 - DNA, 20 bp, Homo sapiens
tccggaaggacacagtcagg

SEQ ID NO: 5042677 - DNA, 21 bp, Homo sapiens
tcctagaggggacaagccagg

SEQ ID NO: 5042678 - DNA, 21 bp, Homo sapiens
tcctcactgagaaggccccag

SEQ ID NO: 5042679 - DNA, 15 bp, Homo sapiens
tcctccagagcctgg

SEQ ID NO: 5042680 - DNA, 17 bp, Homo sapiens
tcctccagagcctgggc

SEQ ID NO: 5042681 - DNA, 14 bp, Homo sapiens
tcctgcccactctg

SEQ ID NO: 5042682 - DNA, 22 bp, Homo sapiens
tcctggacagtgagagcagggc

SEQ ID NO: 5042683 - DNA, 18 bp, Homo sapiens
tcctggcccgggagccgc

SEQ ID NO: 5042684 - DNA, 19 bp, Homo sapiens
tcctggcccgggagccgca

SEQ ID NO: 5042685 - DNA, 18 bp, Homo sapiens
tcctgtgtttgctcccat

SEQ ID NO: 5042686 - DNA, 16 bp, Homo sapiens
tcgtaacagcaggagc

SEQ ID NO: 5042687 - DNA, 14 bp, Homo sapiens
tctccatctccgct

SEQ ID NO: 5042688 - DNA, 15 bp, Homo sapiens
tctccctggccccag

SEQ ID NO: 5042689 - DNA, 16 bp, Homo sapiens
tctcctgcccactctg

SEQ ID NO: 5042690 - DNA, 23 bp, Homo sapiens
tctgaccgggcttcctccctcca

SEQ ID NO: 5042691 - DNA, 23 bp, Homo sapiens
tctgcaggccacccccacctccc

SEQ ID NO: 5042692 - DNA, 21 bp, Homo sapiens
tctgcagtcctcggcagctcc

SEQ ID NO: 5042693 - DNA, 22 bp, Homo sapiens
tctgcagtcctcggcagctccg

SEQ ID NO: 5042694 - DNA, 12 bp, Homo sapiens
tctggctgccaa

SEQ ID NO: 5042695 - DNA, 17 bp, Homo sapiens
tcttgggggcagaccag

SEQ ID NO: 5042696 - DNA, 16 bp, Homo sapiens
tgaccagactgtgggt

SEQ ID NO: 5042697 - DNA, 15 bp, Homo sapiens
tgactctggctgcca

SEQ ID NO: 5042698 - DNA, 21 bp, Homo sapiens
tgagcccctccctcctgtgtt

SEQ ID NO: 5042699 - DNA, 18 bp, Homo sapiens
tgagggcaaaccaggctg

SEQ ID NO: 5042700 - DNA, 15 bp, Homo sapiens
tgcacctgccccagg

SEQ ID NO: 5042701 - DNA, 16 bp, Homo sapiens
tgcacctgccccaggc

SEQ ID NO: 5042702 - DNA, 17 bp, Homo sapiens
tgcacctgccccaggct

SEQ ID NO: 5042703 - DNA, 15 bp, Homo sapiens
tgcagaccctgccag

SEQ ID NO: 5042704 - DNA, 17 bp, Homo sapiens
tgcagctttgaggctgg

SEQ ID NO: 5042705 - DNA, 16 bp, Homo sapiens
tgcaggcaagacacct

SEQ ID NO: 5042706 - DNA, 18 bp, Homo sapiens
tgcagtcctcggcagctc

SEQ ID NO: 5042707 - DNA, 19 bp, Homo sapiens
tgcagtcctcggcagctcc

SEQ ID NO: 5042708 - DNA, 20 bp, Homo sapiens
tgcagtcctcggcagctccg

SEQ ID NO: 5042709 - DNA, 13 bp, Homo sapiens
tgcatctgtggcc

SEQ ID NO: 5042710 - DNA, 19 bp, Homo sapiens
tgccacatggccgctgccc

SEQ ID NO: 5042711 - DNA, 15 bp, Homo sapiens
tgccacgtggccgct

SEQ ID NO: 5042712 - DNA, 12 bp, Homo sapiens
tgccaggctgca

SEQ ID NO: 5042713 - DNA, 14 bp, Homo sapiens
tgccaggctgcagg

SEQ ID NO: 5042714 - DNA, 15 bp, Homo sapiens
tgccagggggtttga

SEQ ID NO: 5042715 - DNA, 14 bp, Homo sapiens
tgcccacctgccag

SEQ ID NO: 5042716 - DNA, 16 bp, Homo sapiens
tgcccacctgccaggc

SEQ ID NO: 5042717 - DNA, 19 bp, Homo sapiens
tgcccacctgccaggctgc

SEQ ID NO: 5042718 - DNA, 24 bp, Homo sapiens
tgcccagcggctcttcctggacag

SEQ ID NO: 5042719 - DNA, 19 bp, Homo sapiens
tgcccagcttggagtgcca

SEQ ID NO: 5042720 - DNA, 15 bp, Homo sapiens
tgcggaacaggagtg

SEQ ID NO: 5042721 - DNA, 11 bp, Homo sapiens
tgctcctggga

SEQ ID NO: 5042722 - DNA, 12 bp, Homo sapiens
tgctctcccagg

SEQ ID NO: 5042723 - DNA, 13 bp, Homo sapiens
tgctgtgacaggc

SEQ ID NO: 5042724 - DNA, 22 bp, Homo sapiens
tgctgtgacaggcagtgttctt

SEQ ID NO: 5042725 - DNA, 11 bp, Homo sapiens
tggacagtgag

SEQ ID NO: 5042726 - DNA, 21 bp, Homo sapiens
tggacagtgagagcagggctg

SEQ ID NO: 5042727 - DNA, 14 bp, Homo sapiens
tggacctgaccaga

SEQ ID NO: 5042728 - DNA, 17 bp, Homo sapiens
tggacctgaccagactg

SEQ ID NO: 5042729 - DNA, 21 bp, Homo sapiens
tggagtgccacgtggccgctg

SEQ ID NO: 5042730 - DNA, 16 bp, Homo sapiens
cctgcccactctgacc

SEQ ID NO: 5042731 - DNA, 12 bp, Homo sapiens
cctgccccaggc

SEQ ID NO: 5042732 - DNA, 23 bp, Homo sapiens
cctggacagtgagagcagggctg

SEQ ID NO: 5042733 - DNA, 21 bp, Homo sapiens
cctgggtgctgtcatgcccag

SEQ ID NO: 5042734 - DNA, 12 bp, Homo sapiens
cctgtctgcagg

SEQ ID NO: 5042735 - DNA, 17 bp, Homo sapiens
cctgtgtttgctcccat

SEQ ID NO: 5042736 - DNA, 14 bp, Homo sapiens
ccttcccagctgct

SEQ ID NO: 5042737 - DNA, 16 bp, Homo sapiens
ccttcccagctgctcc

SEQ ID NO: 5042738 - DNA, 13 bp, Homo sapiens
cgacacaggctgc

SEQ ID NO: 5042739 - DNA, 17 bp, Homo sapiens
cgacacaggctgccgct

SEQ ID NO: 5042740 - DNA, 17 bp, Homo sapiens
cgacccggggcgggctg

SEQ ID NO: 5042741 - DNA, 17 bp, Homo sapiens
cgactgtgaaactggaa

SEQ ID NO: 5042742 - DNA, 16 bp, Homo sapiens
cgcaacttcccaggcc

SEQ ID NO: 5042743 - DNA, 21 bp, Homo sapiens
cgcaagcgacacaggctgccg

SEQ ID NO: 5042744 - DNA, 21 bp, Homo sapiens
cgcctctgtcctggcccggga

SEQ ID NO: 5042745 - DNA, 15 bp, Homo sapiens
cgctgctctcccagg

SEQ ID NO: 5042746 - DNA, 18 bp, Homo sapiens
cgctgctgtgacaggcag

SEQ ID NO: 5042747 - DNA, 21 bp, Homo sapiens
cgcttagggtctgtcccgggt

SEQ ID NO: 5042748 - DNA, 22 bp, Homo sapiens
cggcctgcagaccctgccaggg

SEQ ID NO: 5042749 - DNA, 17 bp, Homo sapiens
cgggggaagctgagccc

SEQ ID NO: 5042750 - DNA, 20 bp, Homo sapiens
cgggtggcagcgcccagcct

SEQ ID NO: 5042751 - DNA, 19 bp, Homo sapiens
cgtaacagcaggagcatgg

SEQ ID NO: 5042752 - DNA, 17 bp, Homo sapiens
cgtcccgagggcgcctg

SEQ ID NO: 5042753 - DNA, 11 bp, Homo sapiens
cgtcctgggtg

SEQ ID NO: 5042754 - DNA, 22 bp, Homo sapiens
cgtcctgggtgctgtcatgccc

SEQ ID NO: 5042755 - DNA, 15 bp, Homo sapiens
cgtctccctggcccc

SEQ ID NO: 5042756 - DNA, 15 bp, Homo sapiens
cgtggccgctgccca

SEQ ID NO: 5042757 - DNA, 21 bp, Homo sapiens
cgtggccgctgcccacgtccc

SEQ ID NO: 5042758 - DNA, 15 bp, Homo sapiens
cgtgggagaggagag

SEQ ID NO: 5042759 - DNA, 21 bp, Homo sapiens
cgtgggagaggagaggctgct

SEQ ID NO: 5042760 - DNA, 12 bp, Homo sapiens
ctagtctgtgcc

SEQ ID NO: 5042761 - DNA, 18 bp, Homo sapiens
ctcaagtttcagagtcag

SEQ ID NO: 5042762 - DNA, 21 bp, Homo sapiens
ctcacaggttcacccagcgcc

SEQ ID NO: 5042763 - DNA, 13 bp, Homo sapiens
ctcactgagaagg

SEQ ID NO: 5042764 - DNA, 20 bp, Homo sapiens
ctcactgagaaggccccagg

SEQ ID NO: 5042765 - DNA, 18 bp, Homo sapiens
ctcagtgagatcagtcag

SEQ ID NO: 5042766 - DNA, 15 bp, Homo sapiens
ctccagagcctgggc

SEQ ID NO: 5042767 - DNA, 23 bp, Homo sapiens
ctcccaggtgaaatccacaccag

SEQ ID NO: 5042768 - DNA, 14 bp, Homo sapiens
ctccctcctgtgtt

SEQ ID NO: 5042769 - DNA, 12 bp, Homo sapiens
ctccctgcagct

SEQ ID NO: 5042770 - DNA, 17 bp, Homo sapiens
ctccctggccccagtga

SEQ ID NO: 5042771 - DNA, 13 bp, Homo sapiens
ctcctccagagcc

SEQ ID NO: 5042772 - DNA, 18 bp, Homo sapiens
ctcctccagagcctgggc

SEQ ID NO: 5042773 - DNA, 23 bp, Homo sapiens
ctcctcttcctgcctctctcatg

SEQ ID NO: 5042774 - DNA, 23 bp, Homo sapiens
ctcctgggaatggggtgggagcc

SEQ ID NO: 5042775 - DNA, 22 bp, Homo sapiens
ctcggcctcttgagagccccac

SEQ ID NO: 5042776 - DNA, 22 bp, Homo sapiens
ctcgtcccgagggcgcctgggt

SEQ ID NO: 5042777 - DNA, 13 bp, Homo sapiens
ctctctggacctg

SEQ ID NO: 5042778 - DNA, 13 bp, Homo sapiens
ctctggctgccaa

SEQ ID NO: 5042779 - DNA, 21 bp, Homo sapiens
ctctgtcctggcccgggagcc

SEQ ID NO: 5042780 - DNA, 14 bp, Homo sapiens
ctctttcagtctac

SEQ ID NO: 5042781 - DNA, 12 bp, Homo sapiens
ctcttttccctt

SEQ ID NO: 5042782 - DNA, 22 bp, Homo sapiens
ctgaccgggcttcctccctcca

SEQ ID NO: 5042783 - DNA, 23 bp, Homo sapiens
ctgacggcagtaaatccacagtg

SEQ ID NO: 5042784 - DNA, 12 bp, Homo sapiens
ctgcagaccctg

SEQ ID NO: 5042785 - DNA, 15 bp, Homo sapiens
ctgcagaccctgcca

SEQ ID NO: 5042786 - DNA, 17 bp, Homo sapiens
ctgcagaccctgccagg

SEQ ID NO: 5042787 - DNA, 18 bp, Homo sapiens
ctgcagtcctcggcagct

SEQ ID NO: 5042788 - DNA, 22 bp, Homo sapiens
ctgccaagataccttcatggtg

SEQ ID NO: 5042789 - DNA, 16 bp, Homo sapiens
ctgcccacctgccagg

SEQ ID NO: 5042790 - DNA, 17 bp, Homo sapiens
ctgcccacgtcccgggc

SEQ ID NO: 5042791 - DNA, 19 bp, Homo sapiens
ctgccgctgctctcccagg

SEQ ID NO: 5042792 - DNA, 23 bp, Homo sapiens
ctgcctctctcatggcttgggct

SEQ ID NO: 5042793 - DNA, 16 bp, Homo sapiens
ctgcgtctcctcgtcc

SEQ ID NO: 5042794 - DNA, 13 bp, Homo sapiens
ctgcgtctcctgc

SEQ ID NO: 5042795 - DNA, 15 bp, Homo sapiens
ctgctctcccaggtg

SEQ ID NO: 5042796 - DNA, 14 bp, Homo sapiens
caaaatgcaggaca

SEQ ID NO: 5042797 - DNA, 22 bp, Homo sapiens
caaagaaccaggaggcctggga

SEQ ID NO: 5042798 - DNA, 13 bp, Homo sapiens
caacttcccaggc

SEQ ID NO: 5042799 - DNA, 14 bp, Homo sapiens
caacttcccaggcc

SEQ ID NO: 5042800 - DNA, 20 bp, Homo sapiens
caagacaccttcccagctgc

SEQ ID NO: 5042801 - DNA, 22 bp, Homo sapiens
caagccaggccctctctgcagt

SEQ ID NO: 5042802 - DNA, 22 bp, Homo sapiens
caaggtgcacctgccccaggct

SEQ ID NO: 5042803 - DNA, 20 bp, Homo sapiens
cacaccagtccacgccgggt

SEQ ID NO: 5042804 - DNA, 12 bp, Homo sapiens
cacaggctgccg

SEQ ID NO: 5042805 - DNA, 19 bp, Homo sapiens
cacaggctgccgctgctct

SEQ ID NO: 5042806 - DNA, 14 bp, Homo sapiens
caccctgtctgcag

SEQ ID NO: 5042807 - DNA, 15 bp, Homo sapiens
caccctgtctgcagg

SEQ ID NO: 5042808 - DNA, 15 bp, Homo sapiens
cacctccctgcagct

SEQ ID NO: 5042809 - DNA, 13 bp, Homo sapiens
cacctgccaggct

SEQ ID NO: 5042810 - DNA, 21 bp, Homo sapiens
cacctgccaggctgcagggac

SEQ ID NO: 5042811 - DNA, 19 bp, Homo sapiens
cacgccgggtcgcctgccc

SEQ ID NO: 5042812 - DNA, 14 bp, Homo sapiens
cacgtcccgggcac

SEQ ID NO: 5042813 - DNA, 19 bp, Homo sapiens
cacgtcccgggcactgtca

SEQ ID NO: 5042814 - DNA, 14 bp, Homo sapiens
cacgtcctgggtgc

SEQ ID NO: 5042815 - DNA, 18 bp, Homo sapiens
cacgtctccctggcccca

SEQ ID NO: 5042816 - DNA, 17 bp, Homo sapiens
cactgagaaggccccag

SEQ ID NO: 5042817 - DNA, 18 bp, Homo sapiens
cactgcccacctgccagg

SEQ ID NO: 5042818 - DNA, 20 bp, Homo sapiens
cactgcccacctgccaggct

SEQ ID NO: 5042819 - DNA, 14 bp, Homo sapiens
cactgtcatgccca

SEQ ID NO: 5042820 - DNA, 21 bp, Homo sapiens
cactgtcatgcccagcttgga

SEQ ID NO: 5042821 - DNA, 23 bp, Homo sapiens
cacttggagcgtttttgctggct

SEQ ID NO: 5042822 - DNA, 14 bp, Homo sapiens
cagaccctgccagg

SEQ ID NO: 5042823 - DNA, 16 bp, Homo sapiens
cagaccctgccagggg

SEQ ID NO: 5042824 - DNA, 20 bp, Homo sapiens
cagacgcggaaaccgggtgg

SEQ ID NO: 5042825 - DNA, 12 bp, Homo sapiens
cagagcccagga

SEQ ID NO: 5042826 - DNA, 14 bp, Homo sapiens
cagagcccaggaat

SEQ ID NO: 5042827 - DNA, 22 bp, Homo sapiens
cagagtcagaattaggcacttg

SEQ ID NO: 5042828 - DNA, 16 bp, Homo sapiens
cagcaggagcatggcc

SEQ ID NO: 5042829 - DNA, 20 bp, Homo sapiens
cagcggtcttctccatctcc

SEQ ID NO: 5042830 - DNA, 14 bp, Homo sapiens
cagctgacggcagt

SEQ ID NO: 5042831 - DNA, 22 bp, Homo sapiens
cagctggatggggcggcctgca

SEQ ID NO: 5042832 - DNA, 22 bp, Homo sapiens
cagcttggagtgccacgtggcc

SEQ ID NO: 5042833 - DNA, 20 bp, Homo sapiens
caggaattctcacaggttca

SEQ ID NO: 5042834 - DNA, 24 bp, Homo sapiens
caggacagatcaggtcagagccca

SEQ ID NO: 5042835 - DNA, 22 bp, Homo sapiens
caggagtgactctggctgccaa

SEQ ID NO: 5042836 - DNA, 22 bp, Homo sapiens
caggagtgggtttccctgcgtc

SEQ ID NO: 5042837 - DNA, 18 bp, Homo sapiens
caggccacccccacctcc

SEQ ID NO: 5042838 - DNA, 19 bp, Homo sapiens
caggccgaggaagggcccc

SEQ ID NO: 5042839 - DNA, 16 bp, Homo sapiens
caggctcaggctgccc

SEQ ID NO: 5042840 - DNA, 13 bp, Homo sapiens
caggctgcaggga

SEQ ID NO: 5042841 - DNA, 16 bp, Homo sapiens
caggctgcccagcggc

SEQ ID NO: 5042842 - DNA, 19 bp, Homo sapiens
caggctgcccagcggctct

SEQ ID NO: 5042843 - DNA, 23 bp, Homo sapiens
caggctgccgctgctctcccagg

SEQ ID NO: 5042844 - DNA, 21 bp, Homo sapiens
cagggacagttgggtgtgaga

SEQ ID NO: 5042845 - DNA, 14 bp, Homo sapiens
cagggctgggcgcc

SEQ ID NO: 5042846 - DNA, 17 bp, Homo sapiens
cagggctgggcgcctct

SEQ ID NO: 5042847 - DNA, 17 bp, Homo sapiens
caggtcagagcccagga

SEQ ID NO: 5042848 - DNA, 17 bp, Homo sapiens
caggtgaaatccacacc

SEQ ID NO: 5042849 - DNA, 20 bp, Homo sapiens
caggtggggttttcacttcc

SEQ ID NO: 5042850 - DNA, 21 bp, Homo sapiens
caggtggggttttcacttcct

SEQ ID NO: 5042851 - DNA, 12 bp, Homo sapiens
cagtcagcccag

SEQ ID NO: 5042852 - DNA, 14 bp, Homo sapiens
cagtcagcccagtg

SEQ ID NO: 5042853 - DNA, 12 bp, Homo sapiens
cagtcaggggcc

SEQ ID NO: 5042854 - DNA, 16 bp, Homo sapiens
cagtccacgccgggtc

SEQ ID NO: 5042855 - DNA, 12 bp, Homo sapiens
cagtgggatctt

SEQ ID NO: 5042856 - DNA, 16 bp, Homo sapiens
catctgtggcctgggg

SEQ ID NO: 5042857 - DNA, 17 bp, Homo sapiens
catctgtggcctggggc

SEQ ID NO: 5042858 - DNA, 12 bp, Homo sapiens
catgacaagtgg

SEQ ID NO: 5042859 - DNA, 13 bp, Homo sapiens
catgcccagcttg

SEQ ID NO: 5042860 - DNA, 22 bp, Homo sapiens
catgcccagcttggagtgccac

SEQ ID NO: 5042861 - DNA, 12 bp, Homo sapiens
catggccaggag

SEQ ID NO: 5042862 - DNA, 17 bp, Homo sapiens
catggtgttcatgacaa

SEQ ID NO: 5042863 - DNA, 20 bp, Homo sapiens
cattctagagggatccaccg

SEQ ID NO: 5042864 - DNA, 22 bp, Homo sapiens
cattgaagggggatgcaggcaa

SEQ ID NO: 5042865 - DNA, 15 bp, Homo sapiens
ccaaacaagcgccac

SEQ ID NO: 5042866 - DNA, 12 bp, Homo sapiens
ccacagccccaa

SEQ ID NO: 5042867 - DNA, 17 bp, Homo sapiens
ccacatggccgctgccc

SEQ ID NO: 5042868 - DNA, 21 bp, Homo sapiens
ccacccctgaactggccccag

SEQ ID NO: 5042869 - DNA, 15 bp, Homo sapiens
ccaccgtgggagagg

SEQ ID NO: 5042870 - DNA, 12 bp, Homo sapiens
ccacctgccagg

SEQ ID NO: 5042871 - DNA, 20 bp, Homo sapiens
ccacctgccaggctgcaggg

SEQ ID NO: 5042872 - DNA, 21 bp, Homo sapiens
ccacctgccaggctgcaggga

SEQ ID NO: 5042873 - DNA, 22 bp, Homo sapiens
ccacgccgggtcgcctgccctg

SEQ ID NO: 5042874 - DNA, 18 bp, Homo sapiens
ccacgtggccgctgccca

SEQ ID NO: 5042875 - DNA, 13 bp, Homo sapiens
ccagagcctgggc

SEQ ID NO: 5042876 - DNA, 18 bp, Homo sapiens
ccagcctggccccaagca

SEQ ID NO: 5042877 - DNA, 17 bp, Homo sapiens
ccagctcctcttcctgc

SEQ ID NO: 5042878 - DNA, 19 bp, Homo sapiens
ccagcttggagtgccacat

SEQ ID NO: 5042879 - DNA, 19 bp, Homo sapiens
ccagcttggagtgccacgt

SEQ ID NO: 5042880 - DNA, 17 bp, Homo sapiens
ccaggaattctcacagg

SEQ ID NO: 5042881 - DNA, 14 bp, Homo sapiens
ccaggaggcctggg

SEQ ID NO: 5042882 - DNA, 17 bp, Homo sapiens
ccaggaggcctgggaga

SEQ ID NO: 5042883 - DNA, 12 bp, Homo sapiens
ccaggccctctc

SEQ ID NO: 5042884 - DNA, 18 bp, Homo sapiens
ccaggccctctctgcagt

SEQ ID NO: 5042885 - DNA, 17 bp, Homo sapiens
ccaggcggtcactgccc

SEQ ID NO: 5042886 - DNA, 19 bp, Homo sapiens
ccaggctcaggctgcccag

SEQ ID NO: 5042887 - DNA, 21 bp, Homo sapiens
ccaggctcaggctgcccagcg

SEQ ID NO: 5042888 - DNA, 15 bp, Homo sapiens
ccaggctgcagggac

SEQ ID NO: 5042889 - DNA, 13 bp, Homo sapiens
ccaggctgcaggt

SEQ ID NO: 5042890 - DNA, 13 bp, Homo sapiens
ccatggccaggag

SEQ ID NO: 5042891 - DNA, 17 bp, Homo sapiens
cccacctccctgcagct

SEQ ID NO: 5042892 - DNA, 14 bp, Homo sapiens
cccacctgccaggc

SEQ ID NO: 5042893 - DNA, 19 bp, Homo sapiens
cccagcggctcttcctgga

SEQ ID NO: 5042894 - DNA, 19 bp, Homo sapiens
cccaggctcaggctgccca

SEQ ID NO: 5042895 - DNA, 18 bp, Homo sapiens
ccccacccctgaactggc

SEQ ID NO: 5042896 - DNA, 19 bp, Homo sapiens
ccccaccctgtctgcaggc

SEQ ID NO: 5042897 - DNA, 21 bp, Homo sapiens
ccccaccctgtctgcaggcca

SEQ ID NO: 5042898 - DNA, 19 bp, Homo sapiens
ccccacctccctgcagctt

SEQ ID NO: 5042899 - DNA, 19 bp, Homo sapiens
cccccacctccctgcagct

SEQ ID NO: 5042900 - DNA, 17 bp, Homo sapiens
cccccatgggctgctgg

SEQ ID NO: 5042901 - DNA, 19 bp, Homo sapiens
cccctgaactggccccagc

SEQ ID NO: 5042902 - DNA, 17 bp, Homo sapiens
cccgagggcgcctgggt

SEQ ID NO: 5042903 - DNA, 19 bp, Homo sapiens
cccgggtactcagtcagcc

SEQ ID NO: 5042904 - DNA, 19 bp, Homo sapiens
ccctcctccagagcctggg

SEQ ID NO: 5042905 - DNA, 13 bp, Homo sapiens
ccctggccccagt

SEQ ID NO: 5042906 - DNA, 15 bp, Homo sapiens
ccctggccccagtga

SEQ ID NO: 5042907 - DNA, 15 bp, Homo sapiens
ccgcaacttcccagg

SEQ ID NO: 5042908 - DNA, 16 bp, Homo sapiens
ccgctgctctcccagg

SEQ ID NO: 5042909 - DNA, 14 bp, Homo sapiens
ccgctgctgtgaca

SEQ ID NO: 5042910 - DNA, 20 bp, Homo sapiens
ccggcccacgtcctgggtgc

SEQ ID NO: 5042911 - DNA, 18 bp, Homo sapiens
ggcctcttgagagcccca

SEQ ID NO: 5042912 - DNA, 19 bp, Homo sapiens
ggcctgcagaccctgccag

SEQ ID NO: 5042913 - DNA, 12 bp, Homo sapiens
ggcgactgtgaa

SEQ ID NO: 5042914 - DNA, 22 bp, Homo sapiens
ggcgcaagcgacacaggctgcc

SEQ ID NO: 5042915 - DNA, 17 bp, Homo sapiens
ggcgcctctgtcctggc

SEQ ID NO: 5042916 - DNA, 13 bp, Homo sapiens
ggctagtctgtgc

SEQ ID NO: 5042917 - DNA, 13 bp, Homo sapiens
ggctcttcctgga

SEQ ID NO: 5042918 - DNA, 14 bp, Homo sapiens
ggctgggcgcctct

SEQ ID NO: 5042919 - DNA, 14 bp, Homo sapiens
ggctttgggtagtg

SEQ ID NO: 5042920 - DNA, 20 bp, Homo sapiens
ggctttgggtagtgccatgg

SEQ ID NO: 5042921 - DNA, 20 bp, Homo sapiens
gggacaagccaggccctctc

SEQ ID NO: 5042922 - DNA, 21 bp, Homo sapiens
gggacgacccggggcgggctg

SEQ ID NO: 5042923 - DNA, 17 bp, Homo sapiens
gggagaggagaggctgc

SEQ ID NO: 5042924 - DNA, 14 bp, Homo sapiens
gggagatgcagctg

SEQ ID NO: 5042925 - DNA, 13 bp, Homo sapiens
gggagccacaggg

SEQ ID NO: 5042926 - DNA, 16 bp, Homo sapiens
gggatcttacccactt

SEQ ID NO: 5042927 - DNA, 21 bp, Homo sapiens
gggcactgtcatgcccagctt

SEQ ID NO: 5042928 - DNA, 16 bp, Homo sapiens
gggcagaccagagagc

SEQ ID NO: 5042929 - DNA, 18 bp, Homo sapiens
gggcagaccagagagctc

SEQ ID NO: 5042930 - DNA, 19 bp, Homo sapiens
gggcagaccagagagctca

SEQ ID NO: 5042931 - DNA, 15 bp, Homo sapiens
gggcccctcctccag

SEQ ID NO: 5042932 - DNA, 15 bp, Homo sapiens
gggcgcctctgtcct

SEQ ID NO: 5042933 - DNA, 20 bp, Homo sapiens
gggcgcctgggtcctcccag

SEQ ID NO: 5042934 - DNA, 20 bp, Homo sapiens
gggcggcctgcagaccctgc

SEQ ID NO: 5042935 - DNA, 13 bp, Homo sapiens
gggggatgcaggc

SEQ ID NO: 5042936 - DNA, 14 bp, Homo sapiens
gggtagtgccatgg

SEQ ID NO: 5042937 - DNA, 23 bp, Homo sapiens
gggtccctgcgtctcctgcccac

SEQ ID NO: 5042938 - DNA, 15 bp, Homo sapiens
gggtcctcccagctg

SEQ ID NO: 5042939 - DNA, 16 bp, Homo sapiens
gggtcctcccagctga

SEQ ID NO: 5042940 - DNA, 15 bp, Homo sapiens
gggtcgcctgccctg

SEQ ID NO: 5042941 - DNA, 16 bp, Homo sapiens
gggtctgctcctggga

SEQ ID NO: 5042942 - DNA, 23 bp, Homo sapiens
gggtcttagggtacagcccaggc

SEQ ID NO: 5042943 - DNA, 20 bp, Homo sapiens
gggttttcacttcctagggt

SEQ ID NO: 5042944 - DNA, 20 bp, Homo sapiens
ggtagtgccatggccaggag

SEQ ID NO: 5042945 - DNA, 12 bp, Homo sapiens
ggtcgcctgccc

SEQ ID NO: 5042946 - DNA, 13 bp, Homo sapiens
ggtctgctcctgg

SEQ ID NO: 5042947 - DNA, 22 bp, Homo sapiens
ggtcttagggtacagcccaggc

SEQ ID NO: 5042948 - DNA, 23 bp, Homo sapiens
ggtcttagggtacagcccaggcg

SEQ ID NO: 5042949 - DNA, 19 bp, Homo sapiens
ggtgctgtcatgcccagct

SEQ ID NO: 5042950 - DNA, 20 bp, Homo sapiens
ggtgctgtcatgcccagctt

SEQ ID NO: 5042951 - DNA, 18 bp, Homo sapiens
gtactcagtcagcccagt

SEQ ID NO: 5042952 - DNA, 21 bp, Homo sapiens
gtactcagtcagcccagtggg

SEQ ID NO: 5042953 - DNA, 19 bp, Homo sapiens
gtagtgccatggccaggag

SEQ ID NO: 5042954 - DNA, 13 bp, Homo sapiens
gtcagagcccagg

SEQ ID NO: 5042955 - DNA, 13 bp, Homo sapiens
gtcagcccagtgg

SEQ ID NO: 5042956 - DNA, 14 bp, Homo sapiens
gtcagcccagtggg

SEQ ID NO: 5042957 - DNA, 16 bp, Homo sapiens
gtcatgcccagcttgg

SEQ ID NO: 5042958 - DNA, 22 bp, Homo sapiens
gtcatgcccagcttggagtgcc

SEQ ID NO: 5042959 - DNA, 22 bp, Homo sapiens
gtccacgccgggtcgcctgccc

SEQ ID NO: 5042960 - DNA, 16 bp, Homo sapiens
gtcccgggcactgtca

SEQ ID NO: 5042961 - DNA, 14 bp, Homo sapiens
gtcctcccagctga

SEQ ID NO: 5042962 - DNA, 19 bp, Homo sapiens
gtcctcccagctgacggca

SEQ ID NO: 5042963 - DNA, 15 bp, Homo sapiens
gtcctcggcagctcc

SEQ ID NO: 5042964 - DNA, 19 bp, Homo sapiens
gtctcctcgtcccgagggc

SEQ ID NO: 5042965 - DNA, 23 bp, Homo sapiens
gtctcctgcccactctgaccggg

SEQ ID NO: 5042966 - DNA, 14 bp, Homo sapiens
gtctgtgcctcagt

SEQ ID NO: 5042967 - DNA, 15 bp, Homo sapiens
gtctgtgcctcagtg

SEQ ID NO: 5042968 - DNA, 14 bp, Homo sapiens
gtgagatcagtcag

SEQ ID NO: 5042969 - DNA, 15 bp, Homo sapiens
gtgcacctgccccag

SEQ ID NO: 5042970 - DNA, 13 bp, Homo sapiens
gtgccacgtggcc

SEQ ID NO: 5042971 - DNA, 14 bp, Homo sapiens
gtgcctcagtgaga

SEQ ID NO: 5042972 - DNA, 21 bp, Homo sapiens
gtgggagaggagaggctgctg

SEQ ID NO: 5042973 - DNA, 19 bp, Homo sapiens
gtttgaggaccctcccagg

SEQ ID NO: 5042974 - DNA, 13 bp, Homo sapiens
gttttcacttcct

SEQ ID NO: 5042975 - DNA, 13 bp, Homo sapiens
tacagcccaggcg

SEQ ID NO: 5042976 - DNA, 19 bp, Homo sapiens
tacccacttccctgcaagg

SEQ ID NO: 5042977 - DNA, 21 bp, Homo sapiens
tagaggggacaagccaggccc

SEQ ID NO: 5042978 - DNA, 22 bp, Homo sapiens
tcaaccattgaagggggatgca

SEQ ID NO: 5042979 - DNA, 18 bp, Homo sapiens
tcactgagaaggccccag

SEQ ID NO: 5042980 - DNA, 24 bp, Homo sapiens
tcactgagaaggccccagggcagc

SEQ ID NO: 5042981 - DNA, 22 bp, Homo sapiens
tcactgcccacctgccaggctg

SEQ ID NO: 5042982 - DNA, 13 bp, Homo sapiens
tcagagcccagga

SEQ ID NO: 5042983 - DNA, 13 bp, Homo sapiens
tcaggctgcccag

SEQ ID NO: 5042984 - DNA, 15 bp, Homo sapiens
tcaggtcagagccca

SEQ ID NO: 5042985 - DNA, 19 bp, Homo sapiens
tcagtgagatcagtcagct

SEQ ID NO: 5042986 - DNA, 14 bp, Homo sapiens
tcatgcccagcttg

SEQ ID NO: 5042987 - DNA, 22 bp, Homo sapiens
tcatgcccagcttggagtgcca

SEQ ID NO: 5042988 - DNA, 18 bp, Homo sapiens
tccacgcttagggtctgt

SEQ ID NO: 5042989 - DNA, 22 bp, Homo sapiens
tccacgcttagggtctgtcccg

SEQ ID NO: 5042990 - DNA, 15 bp, Homo sapiens
tccagagcctgggcg

SEQ ID NO: 5042991 - DNA, 11 bp, Homo sapiens
tcccagctgct

SEQ ID NO: 5042992 - DNA, 12 bp, Homo sapiens
tcccgggcactg

SEQ ID NO: 5042993 - DNA, 21 bp, Homo sapiens
tccctgcagctttgaggctgg

SEQ ID NO: 5042994 - DNA, 12 bp, Homo sapiens
tccctggcccca

SEQ ID NO: 5042995 - DNA, 13 bp, Homo sapiens
tccctggccccag

SEQ ID NO: 5042996 - DNA, 15 bp, Homo sapiens
tccctggccccagtg

SEQ ID NO: 5042997 - DNA, 17 bp, Homo sapiens
tccctggccccagtgac

SEQ ID NO: 5042998 - DNA, 22 bp, Homo sapiens
tcctcactgagaaggccccagg

SEQ ID NO: 5042999 - DNA, 14 bp, Homo sapiens
tcctccagagcctg

SEQ ID NO: 5043000 - DNA, 19 bp, Homo sapiens
tcctccagagcctgggcgc

SEQ ID NO: 5043001 - DNA, 15 bp, Homo sapiens
tcctcggcagctccg

SEQ ID NO: 5043002 - DNA, 22 bp, Homo sapiens
tcctgcccactctgaccgggct

SEQ ID NO: 5043003 - DNA, 20 bp, Homo sapiens
tcggcctcttgagagcccca

SEQ ID NO: 5043004 - DNA, 14 bp, Homo sapiens
tctacatttttgtt

SEQ ID NO: 5043005 - DNA, 20 bp, Homo sapiens
tctagagggatccaccgcca

SEQ ID NO: 5043006 - DNA, 17 bp, Homo sapiens
tctctggacctgaccag

SEQ ID NO: 5043007 - DNA, 13 bp, Homo sapiens
tctggacctgacc

SEQ ID NO: 5043008 - DNA, 13 bp, Homo sapiens
tctgtgcctcagt

SEQ ID NO: 5043009 - DNA, 14 bp, Homo sapiens
tcttacccacttcc

SEQ ID NO: 5043010 - DNA, 20 bp, Homo sapiens
tcttacccacttccctgcaa

SEQ ID NO: 5043011 - DNA, 21 bp, Homo sapiens
tcttacccacttccctgcaag

SEQ ID NO: 5043012 - DNA, 22 bp, Homo sapiens
tcttacccacttccctgcaagg

SEQ ID NO: 5043013 - DNA, 18 bp, Homo sapiens
tcttagggtacagcccag

SEQ ID NO: 5043014 - DNA, 19 bp, Homo sapiens
tcttcttgggggcagacca

SEQ ID NO: 5043015 - DNA, 20 bp, Homo sapiens
tcttgggggtggggctgcat

SEQ ID NO: 5043016 - DNA, 22 bp, Homo sapiens
tcttgggggtggggctgcatcc

SEQ ID NO: 5043017 - DNA, 14 bp, Homo sapiens
tgaactggccccag

SEQ ID NO: 5043018 - DNA, 16 bp, Homo sapiens
tgaactggccccagct

SEQ ID NO: 5043019 - DNA, 15 bp, Homo sapiens
tgaccagactgtggg

SEQ ID NO: 5043020 - DNA, 21 bp, Homo sapiens
tgaccagactgtgggtccctg

SEQ ID NO: 5043021 - DNA, 17 bp, Homo sapiens
tgagggcaaaccaggct

SEQ ID NO: 5043022 - DNA, 14 bp, Homo sapiens
tgcacctgccccag

SEQ ID NO: 5043023 - DNA, 14 bp, Homo sapiens
tgcagaccctgcca

SEQ ID NO: 5043024 - DNA, 17 bp, Homo sapiens
tgcagggacagttgggt

SEQ ID NO: 5043025 - DNA, 23 bp, Homo sapiens
tgcagggacagttgggtgtgaga

SEQ ID NO: 5043026 - DNA, 21 bp, Homo sapiens
aaagaaccaggaggcctggga

SEQ ID NO: 5043027 - DNA, 12 bp, Homo sapiens
aacagcaggagc

SEQ ID NO: 5043028 - DNA, 21 bp, Homo sapiens
aacccctaatcgccctgagct

SEQ ID NO: 5043029 - DNA, 14 bp, Homo sapiens
aactggccccagct

SEQ ID NO: 5043030 - DNA, 13 bp, Homo sapiens
aacttcccaggcc

SEQ ID NO: 5043031 - DNA, 14 bp, Homo sapiens
aaggccccagggca

SEQ ID NO: 5043032 - DNA, 16 bp, Homo sapiens
aaggcccggagatgca

SEQ ID NO: 5043033 - DNA, 15 bp, Homo sapiens
aagggggatgcaggc

SEQ ID NO: 5043034 - DNA, 23 bp, Homo sapiens
acaagccaggccctctctgcagt

SEQ ID NO: 5043035 - DNA, 15 bp, Homo sapiens
acactggccggccca

SEQ ID NO: 5043036 - DNA, 22 bp, Homo sapiens
acactggctttgggtagtgcca

SEQ ID NO: 5043037 - DNA, 15 bp, Homo sapiens
acactttggccacag

SEQ ID NO: 5043038 - DNA, 21 bp, Homo sapiens
acagccccaaacaagcgccac

SEQ ID NO: 5043039 - DNA, 22 bp, Homo sapiens
acaggagtgactctggctgcca

SEQ ID NO: 5043040 - DNA, 22 bp, Homo sapiens
acaggctgccgctgctctccca

SEQ ID NO: 5043041 - DNA, 21 bp, Homo sapiens
acagtgagagcagggctgggc

SEQ ID NO: 5043042 - DNA, 15 bp, Homo sapiens
acatggccgctgccc

SEQ ID NO: 5043043 - DNA, 21 bp, Homo sapiens
accacgtctccctggccccag

SEQ ID NO: 5043044 - DNA, 16 bp, Homo sapiens
accaggaggcctggga

SEQ ID NO: 5043045 - DNA, 12 bp, Homo sapiens
accaggctgcag

SEQ ID NO: 5043046 - DNA, 13 bp, Homo sapiens
accaggctgcagg

SEQ ID NO: 5043047 - DNA, 20 bp, Homo sapiens
accaggctgcaggtggggtt

SEQ ID NO: 5043048 - DNA, 18 bp, Homo sapiens
accccaccctgtctgcag

SEQ ID NO: 5043049 - DNA, 13 bp, Homo sapiens
acccccacctccc

SEQ ID NO: 5043050 - DNA, 18 bp, Homo sapiens
acccctgaactggcccca

SEQ ID NO: 5043051 - DNA, 21 bp, Homo sapiens
acccctgaactggccccagct

SEQ ID NO: 5043052 - DNA, 11 bp, Homo sapiens
accctcccagg

SEQ ID NO: 5043053 - DNA, 22 bp, Homo sapiens
accctcccaggtttcccactgc

SEQ ID NO: 5043054 - DNA, 14 bp, Homo sapiens
accctgtctgcagg

SEQ ID NO: 5043055 - DNA, 19 bp, Homo sapiens
accgggtggcagcgcccag

SEQ ID NO: 5043056 - DNA, 13 bp, Homo sapiens
acctgccaggctg

SEQ ID NO: 5043057 - DNA, 17 bp, Homo sapiens
acctgccaggctgcagg

SEQ ID NO: 5043058 - DNA, 21 bp, Homo sapiens
accttcccagctgctcctaga

SEQ ID NO: 5043059 - DNA, 12 bp, Homo sapiens
acgtcctgggtg

SEQ ID NO: 5043060 - DNA, 22 bp, Homo sapiens
acgtggccgctgctgtgacagg

SEQ ID NO: 5043061 - DNA, 16 bp, Homo sapiens
actctgaccgggcttc

SEQ ID NO: 5043062 - DNA, 19 bp, Homo sapiens
actgcccacctgccaggct

SEQ ID NO: 5043063 - DNA, 22 bp, Homo sapiens
actggccggcccacgtcctggg

SEQ ID NO: 5043064 - DNA, 23 bp, Homo sapiens
actggccggcccacgtcctgggt

SEQ ID NO: 5043065 - DNA, 21 bp, Homo sapiens
actggctttgggtagtgccat

SEQ ID NO: 5043066 - DNA, 13 bp, Homo sapiens
actttccagcagg

SEQ ID NO: 5043067 - DNA, 13 bp, Homo sapiens
agaaggccccagg

SEQ ID NO: 5043068 - DNA, 12 bp, Homo sapiens
agaccagagagc

SEQ ID NO: 5043069 - DNA, 13 bp, Homo sapiens
agaccctgccagg

SEQ ID NO: 5043070 - DNA, 13 bp, Homo sapiens
agagcctgggcgc

SEQ ID NO: 5043071 - DNA, 15 bp, Homo sapiens
agaggagaggctgct

SEQ ID NO: 5043072 - DNA, 16 bp, Homo sapiens
agcaagtactttgtct

SEQ ID NO: 5043073 - DNA, 20 bp, Homo sapiens
agccgcaggggcccctcctc

SEQ ID NO: 5043074 - DNA, 16 bp, Homo sapiens
cgggggaagctgagcc

SEQ ID NO: 5043075 - DNA, 18 bp, Homo sapiens
cggggtctgctcctggga

SEQ ID NO: 5043076 - DNA, 20 bp, Homo sapiens
cggtcactgcccacctgcca

SEQ ID NO: 5043077 - DNA, 24 bp, Homo sapiens
cgtcccgggcactgtcatgcccag

SEQ ID NO: 5043078 - DNA, 19 bp, Homo sapiens
cgtggccgctgctgtgaca

SEQ ID NO: 5043079 - DNA, 23 bp, Homo sapiens
ctagaggggacaagccaggccct

SEQ ID NO: 5043080 - DNA, 20 bp, Homo sapiens
ctcacaggttcacccagcgc

SEQ ID NO: 5043081 - DNA, 16 bp, Homo sapiens
ctcagtcagcccagtg

SEQ ID NO: 5043082 - DNA, 18 bp, Homo sapiens
ctccacgcttagggtctg

SEQ ID NO: 5043083 - DNA, 16 bp, Homo sapiens
ctcccagctgacggca

SEQ ID NO: 5043084 - DNA, 19 bp, Homo sapiens
ctcccaggtttcccactgc

SEQ ID NO: 5043085 - DNA, 18 bp, Homo sapiens
ctccctacttagacccag

SEQ ID NO: 5043086 - DNA, 21 bp, Homo sapiens
ctccctacttagacccagtca

SEQ ID NO: 5043087 - DNA, 15 bp, Homo sapiens
ctcctccagagcctg

SEQ ID NO: 5043088 - DNA, 21 bp, Homo sapiens
ctcctcgtcccgagggcgcct

SEQ ID NO: 5043089 - DNA, 13 bp, Homo sapiens
ctcctgcccactc

SEQ ID NO: 5043090 - DNA, 20 bp, Homo sapiens
tgcccagcggctcttcctgg

SEQ ID NO: 5043091 - DNA, 16 bp, Homo sapiens
tgcccagcttggagtg

SEQ ID NO: 5043092 - DNA, 22 bp, Homo sapiens
tgcccagcttggagtgccacgt

SEQ ID NO: 5043093 - DNA, 23 bp, Homo sapiens
tgccccaggctcaggctgcccag

SEQ ID NO: 5043094 - DNA, 24 bp, Homo sapiens
tgccccaggctcaggctgcccagc

SEQ ID NO: 5043095 - DNA, 16 bp, Homo sapiens
tgcgtctcctgcccac

SEQ ID NO: 5043096 - DNA, 22 bp, Homo sapiens
tgctggaaaggcccggagatgc

SEQ ID NO: 5043097 - DNA, 19 bp, Homo sapiens
tgctgtcatgcccagcttg

SEQ ID NO: 5043098 - DNA, 14 bp, Homo sapiens
tggcagcgcccagc

SEQ ID NO: 5043099 - DNA, 16 bp, Homo sapiens
tggcagcgcccagcct

SEQ ID NO: 5043100 - DNA, 13 bp, Homo sapiens
tggccccagtgac

SEQ ID NO: 5043101 - DNA, 14 bp, Homo sapiens
tggccgctgcccac

SEQ ID NO: 5043102 - DNA, 20 bp, Homo sapiens
tggccggcccacgtcctggg

SEQ ID NO: 5043103 - DNA, 16 bp, Homo sapiens
tgggagccacagggac

SEQ ID NO: 5043104 - DNA, 19 bp, Homo sapiens
tgggcgcctctgtcctggc

SEQ ID NO: 5043105 - DNA, 22 bp, Homo sapiens
tggggcggcctgcagaccctgc

SEQ ID NO: 5043106 - DNA, 17 bp, Homo sapiens
tggggttttcacttcct

SEQ ID NO: 5043107 - DNA, 12 bp, Homo sapiens
tgggtccctgcg

SEQ ID NO: 5043108 - DNA, 14 bp, Homo sapiens
tgggtcctcccagc

SEQ ID NO: 5043109 - DNA, 21 bp, Homo sapiens
tgggtcctcccagctgacggc

SEQ ID NO: 5043110 - DNA, 23 bp, Homo sapiens
tgggtgctgtcatgcccagcttg

SEQ ID NO: 5043111 - DNA, 12 bp, Homo sapiens
tgggtttccctg

SEQ ID NO: 5043112 - DNA, 21 bp, Homo sapiens
tggtcccccatgggctgctgg

SEQ ID NO: 5043113 - DNA, 13 bp, Homo sapiens
tgtctgcaggcca

SEQ ID NO: 5043114 - DNA, 21 bp, Homo sapiens
tgtcttcttgggggcagacca

SEQ ID NO: 5043115 - DNA, 22 bp, Homo sapiens
tgtgagggcaaaccaggctgca

SEQ ID NO: 5043116 - DNA, 18 bp, Homo sapiens
ttactcaaaatgcaggac

SEQ ID NO: 5043117 - DNA, 20 bp, Homo sapiens
ttactcaaaatgcaggacag

SEQ ID NO: 5043118 - DNA, 17 bp, Homo sapiens
ttagggtacagcccagg

SEQ ID NO: 5043119 - DNA, 23 bp, Homo sapiens
ttcccactgcggaacaggagtga

SEQ ID NO: 5043120 - DNA, 17 bp, Homo sapiens
ttggagcgtttttgctg

SEQ ID NO: 5043121 - DNA, 22 bp, Homo sapiens
ttgtgtgagggcaaaccaggct

SEQ ID NO: 5043122 - DNA, 11 bp, Homo sapiens
tttcacttcct

SEQ ID NO: 5043123 - DNA, 16 bp, Homo sapiens
aaagggatggtcaggc

SEQ ID NO: 5043124 - DNA, 20 bp, Homo sapiens
aaatcctatttttgtagatc

SEQ ID NO: 5043125 - DNA, 13 bp, Homo sapiens
aacatagagaact

SEQ ID NO: 5043126 - DNA, 19 bp, Homo sapiens
aacccatgcccctgacaga

SEQ ID NO: 5043127 - DNA, 22 bp, Homo sapiens
aacccttagcttttagcctggc

SEQ ID NO: 5043128 - DNA, 13 bp, Homo sapiens
aacctggcaggcc

SEQ ID NO: 5043129 - DNA, 20 bp, Homo sapiens
aacctggcaggccctgccca

SEQ ID NO: 5043130 - DNA, 23 bp, Homo sapiens
aacctggcaggccctgcccagcc

SEQ ID NO: 5043131 - DNA, 21 bp, Homo sapiens
aactggcgatctcccagggct

SEQ ID NO: 5043132 - DNA, 12 bp, Homo sapiens
aactgtcccagc

SEQ ID NO: 5043133 - DNA, 13 bp, Homo sapiens
aactgtcccagcg

SEQ ID NO: 5043134 - DNA, 17 bp, Homo sapiens
aagaaatgggcctcagc

SEQ ID NO: 5043135 - DNA, 18 bp, Homo sapiens
aagaagttcaccagccct

SEQ ID NO: 5043136 - DNA, 20 bp, Homo sapiens
aagaagttcaccagccctga

SEQ ID NO: 5043137 - DNA, 18 bp, Homo sapiens
aagagtgtctatggagca

SEQ ID NO: 5043138 - DNA, 19 bp, Homo sapiens
aagcaacttcatcccagct

SEQ ID NO: 5043139 - DNA, 20 bp, Homo sapiens
aagcagcctttttcaccatg

SEQ ID NO: 5043140 - DNA, 21 bp, Homo sapiens
aagccccattcacggcctggc

SEQ ID NO: 5043141 - DNA, 22 bp, Homo sapiens
aagccccattcacggcctggca

SEQ ID NO: 5043142 - DNA, 23 bp, Homo sapiens
aagccccattcacggcctggcat

SEQ ID NO: 5043143 - DNA, 14 bp, Homo sapiens
aagcctgagcaggc

SEQ ID NO: 5043144 - DNA, 15 bp, Homo sapiens
aagcctgagcaggca

SEQ ID NO: 5043145 - DNA, 14 bp, Homo sapiens
aagggagacaggcc

SEQ ID NO: 5043146 - DNA, 18 bp, Homo sapiens
aagtattatgtttcttct

SEQ ID NO: 5043147 - DNA, 18 bp, Homo sapiens
aagtgccagatgttgtct

SEQ ID NO: 5043148 - DNA, 15 bp, Homo sapiens
aagttcaccagccct

SEQ ID NO: 5043149 - DNA, 15 bp, Homo sapiens
aatcacccccaggac

SEQ ID NO: 5043150 - DNA, 14 bp, Homo sapiens
acaaaccagcctgg

SEQ ID NO: 5043151 - DNA, 16 bp, Homo sapiens
acaaaccagcctgggg

SEQ ID NO: 5043152 - DNA, 18 bp, Homo sapiens
acaatgaccagcaggagg

SEQ ID NO: 5043153 - DNA, 23 bp, Homo sapiens
acacaggccgtgggacccaggct

SEQ ID NO: 5043154 - DNA, 20 bp, Homo sapiens
acacagtcctcacacacgga

SEQ ID NO: 5043155 - DNA, 14 bp, Homo sapiens
acacggaggccaga

SEQ ID NO: 5043156 - DNA, 18 bp, Homo sapiens
acacggtttaactgtccc

SEQ ID NO: 5043157 - DNA, 21 bp, Homo sapiens
acacggtttaactgtcccagc

SEQ ID NO: 5043158 - DNA, 21 bp, Homo sapiens
acagccggagcagttggcctg

SEQ ID NO: 5043159 - DNA, 23 bp, Homo sapiens
acaggcctttccctgccggcccc

SEQ ID NO: 5043160 - DNA, 23 bp, Homo sapiens
acagggtcaactggcgaagcctg

SEQ ID NO: 5043161 - DNA, 14 bp, Homo sapiens
acaggtgcctgggg

SEQ ID NO: 5043162 - DNA, 23 bp, Homo sapiens
acagtcctcacacacggaggcca

SEQ ID NO: 5043163 - DNA, 15 bp, Homo sapiens
acatcaagtgccaga

SEQ ID NO: 5043164 - DNA, 12 bp, Homo sapiens
acatgggagtgg

SEQ ID NO: 5043165 - DNA, 19 bp, Homo sapiens
accagccctgagccatggc

SEQ ID NO: 5043166 - DNA, 15 bp, Homo sapiens
accagcctggggcct

SEQ ID NO: 5043167 - DNA, 17 bp, Homo sapiens
acccacacagaggacct

SEQ ID NO: 5043168 - DNA, 16 bp, Homo sapiens
acccaggctcccagcc

SEQ ID NO: 5043169 - DNA, 17 bp, Homo sapiens
acccaggctcccagcct

SEQ ID NO: 5043170 - DNA, 14 bp, Homo sapiens
acccatgcccctga

SEQ ID NO: 5043171 - DNA, 16 bp, Homo sapiens
accccagttcccttgg

SEQ ID NO: 5043172 - DNA, 21 bp, Homo sapiens
accccagttcccttggtggca

SEQ ID NO: 5043173 - DNA, 16 bp, Homo sapiens
acctgagatgctggga

SEQ ID NO: 5043174 - DNA, 19 bp, Homo sapiens
acctgccggctctgggctg

SEQ ID NO: 5043175 - DNA, 12 bp, Homo sapiens
acctggcaggcc

SEQ ID NO: 5043176 - DNA, 16 bp, Homo sapiens
acctggcaggccctgc

SEQ ID NO: 5043177 - DNA, 19 bp, Homo sapiens
acctggcaggccctgccca

SEQ ID NO: 5043178 - DNA, 20 bp, Homo sapiens
acctggcaggccctgcccag

SEQ ID NO: 5043179 - DNA, 23 bp, Homo sapiens
acctggcaggccctgcccagcca

SEQ ID NO: 5043180 - DNA, 19 bp, Homo sapiens
acctggtctggtcaggcaa

SEQ ID NO: 5043181 - DNA, 15 bp, Homo sapiens
acctgtgacctggtc

SEQ ID NO: 5043182 - DNA, 18 bp, Homo sapiens
acctgtgacctggtctgg

SEQ ID NO: 5043183 - DNA, 11 bp, Homo sapiens
acggcctggca

SEQ ID NO: 5043184 - DNA, 18 bp, Homo sapiens
acggcctggcatgcagct

SEQ ID NO: 5043185 - DNA, 20 bp, Homo sapiens
acggcctggcatgcagcttg

SEQ ID NO: 5043186 - DNA, 14 bp, Homo sapiens
actgaaaagcagcc

SEQ ID NO: 5043187 - DNA, 23 bp, Homo sapiens
actgatagttgccttttcttccc

SEQ ID NO: 5043188 - DNA, 17 bp, Homo sapiens
actggcgatctcccagg

SEQ ID NO: 5043189 - DNA, 15 bp, Homo sapiens
actgtcaccctgagg

SEQ ID NO: 5043190 - DNA, 15 bp, Homo sapiens
actgtggtcaggccc

SEQ ID NO: 5043191 - DNA, 20 bp, Homo sapiens
actgtggtcaggcccagcct

SEQ ID NO: 5043192 - DNA, 16 bp, Homo sapiens
acttcatcccagctgc

SEQ ID NO: 5043193 - DNA, 21 bp, Homo sapiens
acttcatcccagctgctgagg

SEQ ID NO: 5043194 - DNA, 15 bp, Homo sapiens
agaaatgggcctcag

SEQ ID NO: 5043195 - DNA, 17 bp, Homo sapiens
agaaatgggcctcagcc

SEQ ID NO: 5043196 - DNA, 18 bp, Homo sapiens
tgctctcaaggcttggag

SEQ ID NO: 5043197 - DNA, 14 bp, Homo sapiens
tgctgggagggctg

SEQ ID NO: 5043198 - DNA, 15 bp, Homo sapiens
tgctgggagggctga

SEQ ID NO: 5043199 - DNA, 22 bp, Homo sapiens
tgctttgctctcaaggcttgga

SEQ ID NO: 5043200 - DNA, 15 bp, Homo sapiens
tggaacctggcaggc

SEQ ID NO: 5043201 - DNA, 16 bp, Homo sapiens
tggaacctggcaggcc

SEQ ID NO: 5043202 - DNA, 20 bp, Homo sapiens
tggaacctggcaggccctgc

SEQ ID NO: 5043203 - DNA, 22 bp, Homo sapiens
tggaacctggcaggccctgccc

SEQ ID NO: 5043204 - DNA, 17 bp, Homo sapiens
tggagaggtatgtgccc

SEQ ID NO: 5043205 - DNA, 12 bp, Homo sapiens
tggagcagccgg

SEQ ID NO: 5043206 - DNA, 15 bp, Homo sapiens
tggagcagccggaag

SEQ ID NO: 5043207 - DNA, 19 bp, Homo sapiens
tggcacccacacagaggac

SEQ ID NO: 5043208 - DNA, 14 bp, Homo sapiens
tggcaggccctgcc

SEQ ID NO: 5043209 - DNA, 19 bp, Homo sapiens
tggcaggccctgcccagcc

SEQ ID NO: 5043210 - DNA, 21 bp, Homo sapiens
tggcaggccctgcccagccag

SEQ ID NO: 5043211 - DNA, 22 bp, Homo sapiens
tggcaggccctgcccagccagc

SEQ ID NO: 5043212 - DNA, 15 bp, Homo sapiens
tggcagtgctgaagg

SEQ ID NO: 5043213 - DNA, 18 bp, Homo sapiens
tggcagtgctgaaggggg

SEQ ID NO: 5043214 - DNA, 16 bp, Homo sapiens
tggccaggacacactg

SEQ ID NO: 5043215 - DNA, 18 bp, Homo sapiens
tggcctgggtcccagggc

SEQ ID NO: 5043216 - DNA, 19 bp, Homo sapiens
tggcctgggtcccagggct

SEQ ID NO: 5043217 - DNA, 20 bp, Homo sapiens
tggcctgggtcccagggctg

SEQ ID NO: 5043218 - DNA, 23 bp, Homo sapiens
tggcctgggtcccagggctggcc

SEQ ID NO: 5043219 - DNA, 12 bp, Homo sapiens
tggcctgtgctt

SEQ ID NO: 5043220 - DNA, 17 bp, Homo sapiens
tggcctgtgcttggagg

SEQ ID NO: 5043221 - DNA, 22 bp, Homo sapiens
tggcctgtgcttggaggcctca

SEQ ID NO: 5043222 - DNA, 23 bp, Homo sapiens
tggcgatctcccagggctctctg

SEQ ID NO: 5043223 - DNA, 18 bp, Homo sapiens
tggcgccgcgtggacagc

SEQ ID NO: 5043224 - DNA, 21 bp, Homo sapiens
tggcgccgcgtggacagccgg

SEQ ID NO: 5043225 - DNA, 14 bp, Homo sapiens
tggctcagcccggg

SEQ ID NO: 5043226 - DNA, 19 bp, Homo sapiens
tggctgccccattccagct

SEQ ID NO: 5043227 - DNA, 22 bp, Homo sapiens
tgggacacggtttaactgtccc

SEQ ID NO: 5043228 - DNA, 14 bp, Homo sapiens
tgggacccaggctc

SEQ ID NO: 5043229 - DNA, 17 bp, Homo sapiens
tgggacccaggctccca

SEQ ID NO: 5043230 - DNA, 16 bp, Homo sapiens
tgggagggctgaaccc

SEQ ID NO: 5043231 - DNA, 19 bp, Homo sapiens
tgggaggtgagctagaccc

SEQ ID NO: 5043232 - DNA, 13 bp, Homo sapiens
tgggagtggggag

SEQ ID NO: 5043233 - DNA, 14 bp, Homo sapiens
tgggcctcagcccc

SEQ ID NO: 5043234 - DNA, 16 bp, Homo sapiens
tggggagcggagcttg

SEQ ID NO: 5043235 - DNA, 23 bp, Homo sapiens
tggggagcggagcttggccctgc

SEQ ID NO: 5043236 - DNA, 15 bp, Homo sapiens
tggggcaagatccag

SEQ ID NO: 5043237 - DNA, 16 bp, Homo sapiens
tggggcaagatccagg

SEQ ID NO: 5043238 - DNA, 15 bp, Homo sapiens
tggggctggctgcag

SEQ ID NO: 5043239 - DNA, 13 bp, Homo sapiens
tggggtccccctc

SEQ ID NO: 5043240 - DNA, 14 bp, Homo sapiens
tgggtcccagggct

SEQ ID NO: 5043241 - DNA, 15 bp, Homo sapiens
tgggtcccagggctg

SEQ ID NO: 5043242 - DNA, 19 bp, Homo sapiens
tgggtcccagggctggccc

SEQ ID NO: 5043243 - DNA, 21 bp, Homo sapiens
tgggtcccagggctggcccta

SEQ ID NO: 5043244 - DNA, 22 bp, Homo sapiens
tgggtcccagggctggccctag

SEQ ID NO: 5043245 - DNA, 19 bp, Homo sapiens
tgggtgctcaccgcctgct

SEQ ID NO: 5043246 - DNA, 19 bp, Homo sapiens
tggtcaggcaatgccctgc

SEQ ID NO: 5043247 - DNA, 12 bp, Homo sapiens
tggtcaggccca

SEQ ID NO: 5043248 - DNA, 17 bp, Homo sapiens
tggtcaggcccagcctc

SEQ ID NO: 5043249 - DNA, 22 bp, Homo sapiens
ggcgccgcgtggacagccggag

SEQ ID NO: 5043250 - DNA, 15 bp, Homo sapiens
ggcggcccctcagcc

SEQ ID NO: 5043251 - DNA, 16 bp, Homo sapiens
ggcggcccctcagcct

SEQ ID NO: 5043252 - DNA, 18 bp, Homo sapiens
ggctaagaagttcaccag

SEQ ID NO: 5043253 - DNA, 21 bp, Homo sapiens
ggctaagaagttcaccagccc

SEQ ID NO: 5043254 - DNA, 14 bp, Homo sapiens
ggctcactctggcc

SEQ ID NO: 5043255 - DNA, 15 bp, Homo sapiens
ggctcactctggccc

SEQ ID NO: 5043256 - DNA, 21 bp, Homo sapiens
ggctcagcccgggatcctgat

SEQ ID NO: 5043257 - DNA, 21 bp, Homo sapiens
ggctcccacaggtcttcactg

SEQ ID NO: 5043258 - DNA, 15 bp, Homo sapiens
ggctcccagcctaag

SEQ ID NO: 5043259 - DNA, 12 bp, Homo sapiens
ggctctctggac

SEQ ID NO: 5043260 - DNA, 14 bp, Homo sapiens
ggctctctggacca

SEQ ID NO: 5043261 - DNA, 17 bp, Homo sapiens
ggctctgggctggctgc

SEQ ID NO: 5043262 - DNA, 13 bp, Homo sapiens
ggctgccagccca

SEQ ID NO: 5043263 - DNA, 16 bp, Homo sapiens
ggctgccagcccagct

SEQ ID NO: 5043264 - DNA, 18 bp, Homo sapiens
ggctgccccattccagct

SEQ ID NO: 5043265 - DNA, 23 bp, Homo sapiens
ggctgccccattccagctctccc

SEQ ID NO: 5043266 - DNA, 20 bp, Homo sapiens
ggctgctcctaacctacctc

SEQ ID NO: 5043267 - DNA, 12 bp, Homo sapiens
ggctggccagga

SEQ ID NO: 5043268 - DNA, 15 bp, Homo sapiens
ggctggccctaggca

SEQ ID NO: 5043269 - DNA, 14 bp, Homo sapiens
ggcttccagaggag

SEQ ID NO: 5043270 - DNA, 12 bp, Homo sapiens
ggcttggagagg

SEQ ID NO: 5043271 - DNA, 22 bp, Homo sapiens
ggcttggagaggtatgtgcccc

SEQ ID NO: 5043272 - DNA, 18 bp, Homo sapiens
gggaaagggatggtcagg

SEQ ID NO: 5043273 - DNA, 22 bp, Homo sapiens
gggacacggtttaactgtccca

SEQ ID NO: 5043274 - DNA, 13 bp, Homo sapiens
gggagacaggcct

SEQ ID NO: 5043275 - DNA, 15 bp, Homo sapiens
gggagcggagcttgg

SEQ ID NO: 5043276 - DNA, 11 bp, Homo sapiens
gggaggcaggt

SEQ ID NO: 5043277 - DNA, 22 bp, Homo sapiens
gggagtaagaaatgggcctcag

SEQ ID NO: 5043278 - DNA, 23 bp, Homo sapiens
gggagtaagaaatgggcctcagc

SEQ ID NO: 5043279 - DNA, 13 bp, Homo sapiens
gggcactgtggtc

SEQ ID NO: 5043280 - DNA, 14 bp, Homo sapiens
gggcactgtggtca

SEQ ID NO: 5043281 - DNA, 16 bp, Homo sapiens
gggcactgtggtcagg

SEQ ID NO: 5043282 - DNA, 14 bp, Homo sapiens
gggccttcctggct

SEQ ID NO: 5043283 - DNA, 20 bp, Homo sapiens
gggcgcatgcctcccaggcc

SEQ ID NO: 5043284 - DNA, 21 bp, Homo sapiens
gggcgcatgcctcccaggcca

SEQ ID NO: 5043285 - DNA, 12 bp, Homo sapiens
gggctcactctg

SEQ ID NO: 5043286 - DNA, 13 bp, Homo sapiens
gggctgagccatg

SEQ ID NO: 5043287 - DNA, 15 bp, Homo sapiens
gggctgagccatggg

SEQ ID NO: 5043288 - DNA, 19 bp, Homo sapiens
gggctgccagcccagctgg

SEQ ID NO: 5043289 - DNA, 15 bp, Homo sapiens
gggcttggctgcccc

SEQ ID NO: 5043290 - DNA, 18 bp, Homo sapiens
ggggcaagatccaggtgg

SEQ ID NO: 5043291 - DNA, 16 bp, Homo sapiens
ggggctcactctggcc

SEQ ID NO: 5043292 - DNA, 16 bp, Homo sapiens
ggggcttggctgcccc

SEQ ID NO: 5043293 - DNA, 19 bp, Homo sapiens
gggggcactgtggtcaggc

SEQ ID NO: 5043294 - DNA, 17 bp, Homo sapiens
ggggtcgaatggggtcc

SEQ ID NO: 5043295 - DNA, 22 bp, Homo sapiens
ggggttcttgtccacggggctc

SEQ ID NO: 5043296 - DNA, 19 bp, Homo sapiens
gggtccccctcccacttga

SEQ ID NO: 5043297 - DNA, 19 bp, Homo sapiens
ggtcaggcaatgccctgcg

SEQ ID NO: 5043298 - DNA, 20 bp, Homo sapiens
ggtcccagggctggccctag

SEQ ID NO: 5043299 - DNA, 16 bp, Homo sapiens
ggtcgggctgccagcc

SEQ ID NO: 5043300 - DNA, 21 bp, Homo sapiens
ggtcgggctgccagcccagct

SEQ ID NO: 5043301 - DNA, 18 bp, Homo sapiens
ggtcttcactgcccaggg

SEQ ID NO: 5043302 - DNA, 19 bp, Homo sapiens
ggtgcctggggctggctgc

SEQ ID NO: 5043303 - DNA, 19 bp, Homo sapiens
ggtggcaaccccagaccca

SEQ ID NO: 5043304 - DNA, 18 bp, Homo sapiens
gtatgtgcccctcctggg

SEQ ID NO: 5043305 - DNA, 16 bp, Homo sapiens
gtcacaaaccagcctg

SEQ ID NO: 5043306 - DNA, 18 bp, Homo sapiens
gtcacaaaccagcctggg

SEQ ID NO: 5043307 - DNA, 21 bp, Homo sapiens
gtcacaaaccagcctggggcc

SEQ ID NO: 5043308 - DNA, 15 bp, Homo sapiens
gtcaccccagttccc

SEQ ID NO: 5043309 - DNA, 12 bp, Homo sapiens
gtcaccctgagg

SEQ ID NO: 5043310 - DNA, 19 bp, Homo sapiens
gtcaggcccagcctctctg

SEQ ID NO: 5043311 - DNA, 15 bp, Homo sapiens
gtcagtcacaaacca

SEQ ID NO: 5043312 - DNA, 19 bp, Homo sapiens
gtccaatcacccccaggac

SEQ ID NO: 5043313 - DNA, 19 bp, Homo sapiens
gtccacggggctcactctg

SEQ ID NO: 5043314 - DNA, 13 bp, Homo sapiens
gtcccagggctgg

SEQ ID NO: 5043315 - DNA, 20 bp, Homo sapiens
gtcccagggctggccctagg

SEQ ID NO: 5043316 - DNA, 22 bp, Homo sapiens
gtcccagggctggccctaggca

SEQ ID NO: 5043317 - DNA, 22 bp, Homo sapiens
gtcccataggtcttgtgaaaag

SEQ ID NO: 5043318 - DNA, 21 bp, Homo sapiens
gtcccattttccccctgtgtt

SEQ ID NO: 5043319 - DNA, 18 bp, Homo sapiens
gtcctcacacacggaggc

SEQ ID NO: 5043320 - DNA, 22 bp, Homo sapiens
gtccttgctcctggaacctggc

SEQ ID NO: 5043321 - DNA, 15 bp, Homo sapiens
gtcggagggctggac

SEQ ID NO: 5043322 - DNA, 15 bp, Homo sapiens
gtcgggctgccagcc

SEQ ID NO: 5043323 - DNA, 14 bp, Homo sapiens
gtctatggagcagc

SEQ ID NO: 5043324 - DNA, 16 bp, Homo sapiens
gtctatggagcagccg

SEQ ID NO: 5043325 - DNA, 21 bp, Homo sapiens
gtctggtcaggcaatgccctg

SEQ ID NO: 5043326 - DNA, 14 bp, Homo sapiens
gtcttcactgccca

SEQ ID NO: 5043327 - DNA, 15 bp, Homo sapiens
gtcttcactgcccag

SEQ ID NO: 5043328 - DNA, 17 bp, Homo sapiens
gtgacctggtctggtca

SEQ ID NO: 5043329 - DNA, 23 bp, Homo sapiens
gtgacctggtctggtcaggcaat

SEQ ID NO: 5043330 - DNA, 22 bp, Homo sapiens
gtgcagggaaagggatggtcag

SEQ ID NO: 5043331 - DNA, 17 bp, Homo sapiens
gtgcccctcctgggtgc

SEQ ID NO: 5043332 - DNA, 20 bp, Homo sapiens
gtgcccctcctgggtgctca

SEQ ID NO: 5043333 - DNA, 14 bp, Homo sapiens
gtgcctggggctgg

SEQ ID NO: 5043334 - DNA, 14 bp, Homo sapiens
gtggctcccacagg

SEQ ID NO: 5043335 - DNA, 17 bp, Homo sapiens
gtggctcccacaggtct

SEQ ID NO: 5043336 - DNA, 14 bp, Homo sapiens
gtgggacccaggct

SEQ ID NO: 5043337 - DNA, 16 bp, Homo sapiens
gtgggacccaggctcc

SEQ ID NO: 5043338 - DNA, 13 bp, Homo sapiens
gtggtcaggccca

SEQ ID NO: 5043339 - DNA, 12 bp, Homo sapiens
gtggtctccagc

SEQ ID NO: 5043340 - DNA, 13 bp, Homo sapiens
gtggtctccagct

SEQ ID NO: 5043341 - DNA, 22 bp, Homo sapiens
gtggtctccagctcctctccag

SEQ ID NO: 5043342 - DNA, 18 bp, Homo sapiens
gtgtctatggagcagccg

SEQ ID NO: 5043343 - DNA, 19 bp, Homo sapiens
gtgtggtctccagctcctc

SEQ ID NO: 5043344 - DNA, 12 bp, Homo sapiens
gttcaccagccc

SEQ ID NO: 5043345 - DNA, 15 bp, Homo sapiens
gttcaccagccctga

SEQ ID NO: 5043346 - DNA, 17 bp, Homo sapiens
gttcaccagccctgagc

SEQ ID NO: 5043347 - DNA, 23 bp, Homo sapiens
gttcaccagccctgagccatggc

SEQ ID NO: 5043348 - DNA, 17 bp, Homo sapiens
gttggcctgtgcttgga

SEQ ID NO: 5043349 - DNA, 15 bp, Homo sapiens
gttgggggtgggagg

SEQ ID NO: 5043350 - DNA, 16 bp, Homo sapiens
gttgggggtgggaggt

SEQ ID NO: 5043351 - DNA, 23 bp, Homo sapiens
taaatgcagtcagtcacaaacca

SEQ ID NO: 5043352 - DNA, 13 bp, Homo sapiens
taactgtcccagc

SEQ ID NO: 5043353 - DNA, 21 bp, Homo sapiens
taagaagttcaccagccctga

SEQ ID NO: 5043354 - DNA, 16 bp, Homo sapiens
taagggagacaggcct

SEQ ID NO: 5043355 - DNA, 13 bp, Homo sapiens
tacacaggcagga

SEQ ID NO: 5043356 - DNA, 13 bp, Homo sapiens
tagagaactgtca

SEQ ID NO: 5043357 - DNA, 20 bp, Homo sapiens
tagagaactgtcaccctgag

SEQ ID NO: 5043358 - DNA, 23 bp, Homo sapiens
tagagaactgtcaccctgaggta

SEQ ID NO: 5043359 - DNA, 15 bp, Homo sapiens
tagcttttagcctgg

SEQ ID NO: 5043360 - DNA, 17 bp, Homo sapiens
tagcttttagcctggct

SEQ ID NO: 5043361 - DNA, 19 bp, Homo sapiens
tagttctcttctcctgtgt

SEQ ID NO: 5043362 - DNA, 22 bp, Homo sapiens
tatggagcagccggaagtctgt

SEQ ID NO: 5043363 - DNA, 16 bp, Homo sapiens
tatgtgcccctcctgg

SEQ ID NO: 5043364 - DNA, 12 bp, Homo sapiens
tatgtttcttct

SEQ ID NO: 5043365 - DNA, 14 bp, Homo sapiens
tattgtcagtccta

SEQ ID NO: 5043366 - DNA, 18 bp, Homo sapiens
tatttttttacttgagca

SEQ ID NO: 5043367 - DNA, 16 bp, Homo sapiens
tcaactggcgaagcct

SEQ ID NO: 5043368 - DNA, 17 bp, Homo sapiens
tcaaggcttggagaggt

SEQ ID NO: 5043369 - DNA, 17 bp, Homo sapiens
tcacaaaccagcctggg

SEQ ID NO: 5043370 - DNA, 22 bp, Homo sapiens
tcacacacggaggccagacaca

SEQ ID NO: 5043371 - DNA, 13 bp, Homo sapiens
tcaccagccctga

SEQ ID NO: 5043372 - DNA, 21 bp, Homo sapiens
tcaccagccctgagccatggc

SEQ ID NO: 5043373 - DNA, 13 bp, Homo sapiens
tcacccccaggac

SEQ ID NO: 5043374 - DNA, 21 bp, Homo sapiens
tcaccgcctgctacacaggca

SEQ ID NO: 5043375 - DNA, 22 bp, Homo sapiens
tcaccgcctgctacacaggcag

SEQ ID NO: 5043376 - DNA, 23 bp, Homo sapiens
tcaccgcctgctacacaggcagg

SEQ ID NO: 5043377 - DNA, 17 bp, Homo sapiens
tcacctgccggctctgg

SEQ ID NO: 5043378 - DNA, 23 bp, Homo sapiens
tcacctgccggctctgggctggc

SEQ ID NO: 5043379 - DNA, 16 bp, Homo sapiens
tcacggcctggcatgc

SEQ ID NO: 5043380 - DNA, 19 bp, Homo sapiens
tcacggcctggcatgcagc

SEQ ID NO: 5043381 - DNA, 13 bp, Homo sapiens
tcactctggcccc

SEQ ID NO: 5043382 - DNA, 21 bp, Homo sapiens
tcagcccgggatcctgatggc

SEQ ID NO: 5043383 - DNA, 14 bp, Homo sapiens
tcagcctgcctgaa

SEQ ID NO: 5043384 - DNA, 16 bp, Homo sapiens
tcagcctgcctgaaga

SEQ ID NO: 5043385 - DNA, 20 bp, Homo sapiens
tcagcctgcctgaagagagg

SEQ ID NO: 5043386 - DNA, 19 bp, Homo sapiens
tcaggcccagttctcgtgc

SEQ ID NO: 5043387 - DNA, 18 bp, Homo sapiens
tcagtcacaaaccagcct

SEQ ID NO: 5043388 - DNA, 20 bp, Homo sapiens
tcagtcacaaaccagcctgg

SEQ ID NO: 5043389 - DNA, 20 bp, Homo sapiens
tcagtctcacctgccggctc

SEQ ID NO: 5043390 - DNA, 23 bp, Homo sapiens
tcagtctcacctgccggctctgg

SEQ ID NO: 5043391 - DNA, 13 bp, Homo sapiens
tcatcccagctgc

SEQ ID NO: 5043392 - DNA, 13 bp, Homo sapiens
tccagaggagagt

SEQ ID NO: 5043393 - DNA, 20 bp, Homo sapiens
tccagctctcccatggagcc

SEQ ID NO: 5043394 - DNA, 13 bp, Homo sapiens
tccaggtggtccc

SEQ ID NO: 5043395 - DNA, 14 bp, Homo sapiens
tccagtgtggctcc

SEQ ID NO: 5043396 - DNA, 19 bp, Homo sapiens
tccagtgtggctcccacag

SEQ ID NO: 5043397 - DNA, 20 bp, Homo sapiens
tccatgctttgctctcaagg

SEQ ID NO: 5043398 - DNA, 22 bp, Homo sapiens
tccatgctttgctctcaaggct

SEQ ID NO: 5043399 - DNA, 17 bp, Homo sapiens
tccatggacatgggcag

SEQ ID NO: 5043400 - DNA, 20 bp, Homo sapiens
tcccacaggtcttcactgcc

SEQ ID NO: 5043401 - DNA, 21 bp, Homo sapiens
tcccacttgacctgagatgct

SEQ ID NO: 5043402 - DNA, 12 bp, Homo sapiens
tcccaggccacc

SEQ ID NO: 5043403 - DNA, 14 bp, Homo sapiens
tcccagggctctct

SEQ ID NO: 5043404 - DNA, 16 bp, Homo sapiens
tcccagggctggccct

SEQ ID NO: 5043405 - DNA, 21 bp, Homo sapiens
tcccagggctggccctaggca

SEQ ID NO: 5043406 - DNA, 14 bp, Homo sapiens
tcccctcctgtaag

SEQ ID NO: 5043407 - DNA, 17 bp, Homo sapiens
tcctcacacacggaggc

SEQ ID NO: 5043408 - DNA, 20 bp, Homo sapiens
tcctcacacacggaggccag

SEQ ID NO: 5043409 - DNA, 13 bp, Homo sapiens
tcctctccagaca

SEQ ID NO: 5043410 - DNA, 14 bp, Homo sapiens
tcctgatggcaccc

SEQ ID NO: 5043411 - DNA, 20 bp, Homo sapiens
tcctggaacctggcaggccc

SEQ ID NO: 5043412 - DNA, 15 bp, Homo sapiens
tccttgctcctggaa

SEQ ID NO: 5043413 - DNA, 16 bp, Homo sapiens
tccttgctcctggaac

SEQ ID NO: 5043414 - DNA, 18 bp, Homo sapiens
tcgggctgccagcccagc

SEQ ID NO: 5043415 - DNA, 21 bp, Homo sapiens
tcgggctgccagcccagctgg

SEQ ID NO: 5043416 - DNA, 14 bp, Homo sapiens
tctcaaagcagaag

SEQ ID NO: 5043417 - DNA, 15 bp, Homo sapiens
tctcaaggcttggag

SEQ ID NO: 5043418 - DNA, 17 bp, Homo sapiens
tctcacctgccggctct

SEQ ID NO: 5043419 - DNA, 19 bp, Homo sapiens
tctcacctgccggctctgg

SEQ ID NO: 5043420 - DNA, 12 bp, Homo sapiens
tctccagacaca

SEQ ID NO: 5043421 - DNA, 18 bp, Homo sapiens
tctccagctcctctccag

SEQ ID NO: 5043422 - DNA, 16 bp, Homo sapiens
tctccatgctttgctc

SEQ ID NO: 5043423 - DNA, 18 bp, Homo sapiens
tctcccagggctctctgg

SEQ ID NO: 5043424 - DNA, 14 bp, Homo sapiens
tctcttctcctgtg

SEQ ID NO: 5043425 - DNA, 16 bp, Homo sapiens
tctggccccctattgt

SEQ ID NO: 5043426 - DNA, 13 bp, Homo sapiens
tctggtcaggcaa

SEQ ID NO: 5043427 - DNA, 21 bp, Homo sapiens
tctgtggcgccgcgtggacag

SEQ ID NO: 5043428 - DNA, 18 bp, Homo sapiens
tctgtgtggtctccagct

SEQ ID NO: 5043429 - DNA, 17 bp, Homo sapiens
tcttaaccctgaacaag

SEQ ID NO: 5043430 - DNA, 17 bp, Homo sapiens
tgaccagcaggagggaa

SEQ ID NO: 5043431 - DNA, 18 bp, Homo sapiens
tgaccagcaggagggaag

SEQ ID NO: 5043432 - DNA, 20 bp, Homo sapiens
tgacctgagatgctgggagg

SEQ ID NO: 5043433 - DNA, 13 bp, Homo sapiens
tgacctggtctgg

SEQ ID NO: 5043434 - DNA, 17 bp, Homo sapiens
tgacctggtctggtcag

SEQ ID NO: 5043435 - DNA, 21 bp, Homo sapiens
tgacctggtctggtcaggcaa

SEQ ID NO: 5043436 - DNA, 15 bp, Homo sapiens
tgagatgctgggagg

SEQ ID NO: 5043437 - DNA, 16 bp, Homo sapiens
tgagatgctgggaggg

SEQ ID NO: 5043438 - DNA, 20 bp, Homo sapiens
tgagatgctgggagggctga

SEQ ID NO: 5043439 - DNA, 12 bp, Homo sapiens
tgagcaggcagg

SEQ ID NO: 5043440 - DNA, 13 bp, Homo sapiens
tgagcaggcaggg

SEQ ID NO: 5043441 - DNA, 23 bp, Homo sapiens
tgagccatgggggtttggggcta

SEQ ID NO: 5043442 - DNA, 23 bp, Homo sapiens
tgagctagacccaacccttagct

SEQ ID NO: 5043443 - DNA, 15 bp, Homo sapiens
tgatggcacccacac

SEQ ID NO: 5043444 - DNA, 23 bp, Homo sapiens
tgcagggaaagggatggtcaggc

SEQ ID NO: 5043445 - DNA, 13 bp, Homo sapiens
tgcagtcagtcac

SEQ ID NO: 5043446 - DNA, 22 bp, Homo sapiens
tgccagatgttgtctgaactaa

SEQ ID NO: 5043447 - DNA, 13 bp, Homo sapiens
tgccagcccagct

SEQ ID NO: 5043448 - DNA, 12 bp, Homo sapiens
tgcccctcctgg

SEQ ID NO: 5043449 - DNA, 20 bp, Homo sapiens
tgccctgcggctctggaaag

SEQ ID NO: 5043450 - DNA, 12 bp, Homo sapiens
tgccggctctgg

SEQ ID NO: 5043451 - DNA, 21 bp, Homo sapiens
tgccggctctgggctggctgc

SEQ ID NO: 5043452 - DNA, 13 bp, Homo sapiens
tgcctcccaggcc

SEQ ID NO: 5043453 - DNA, 21 bp, Homo sapiens
tgcctggggctggctgcagac

SEQ ID NO: 5043454 - DNA, 22 bp, Homo sapiens
tgccttttcttcccctcctgta

SEQ ID NO: 5043455 - DNA, 15 bp, Homo sapiens
tgctacacaggcagg

SEQ ID NO: 5043456 - DNA, 16 bp, Homo sapiens
tgctacacaggcagga

SEQ ID NO: 5043457 - DNA, 19 bp, Homo sapiens
tgctcctggaacctggcag

SEQ ID NO: 5043458 - DNA, 16 bp, Homo sapiens
tgctctcaaggcttgg

SEQ ID NO: 5043459 - DNA, 15 bp, Homo sapiens
ctgagccatggcggc

SEQ ID NO: 5043460 - DNA, 20 bp, Homo sapiens
ctgatggcacccacacagag

SEQ ID NO: 5043461 - DNA, 21 bp, Homo sapiens
ctgatggcacccacacagagg

SEQ ID NO: 5043462 - DNA, 13 bp, Homo sapiens
ctgccagcccagc

SEQ ID NO: 5043463 - DNA, 14 bp, Homo sapiens
ctgccagcccagct

SEQ ID NO: 5043464 - DNA, 21 bp, Homo sapiens
ctgccagcccagctggccgga

SEQ ID NO: 5043465 - DNA, 17 bp, Homo sapiens
ctgccccattccagctc

SEQ ID NO: 5043466 - DNA, 16 bp, Homo sapiens
ctgccggccccccaag

SEQ ID NO: 5043467 - DNA, 13 bp, Homo sapiens
ctgccggctctgg

SEQ ID NO: 5043468 - DNA, 14 bp, Homo sapiens
ctgccggctctggg

SEQ ID NO: 5043469 - DNA, 13 bp, Homo sapiens
ctgcctgaagaga

SEQ ID NO: 5043470 - DNA, 14 bp, Homo sapiens
ctgcctgaagagag

SEQ ID NO: 5043471 - DNA, 14 bp, Homo sapiens
ctgcgccctgtgca

SEQ ID NO: 5043472 - DNA, 16 bp, Homo sapiens
ctgcgccctgtgcagg

SEQ ID NO: 5043473 - DNA, 17 bp, Homo sapiens
ctgcggctctggaaagc

SEQ ID NO: 5043474 - DNA, 15 bp, Homo sapiens
ctgctacacaggcag

SEQ ID NO: 5043475 - DNA, 16 bp, Homo sapiens
ctgctacacaggcagg

SEQ ID NO: 5043476 - DNA, 14 bp, Homo sapiens
ctgctgacaatcct

SEQ ID NO: 5043477 - DNA, 23 bp, Homo sapiens
ctggaaagcaacttcatcccagc

SEQ ID NO: 5043478 - DNA, 15 bp, Homo sapiens
ctggaacctggcagg

SEQ ID NO: 5043479 - DNA, 19 bp, Homo sapiens
ctggaacctggcaggccct

SEQ ID NO: 5043480 - DNA, 20 bp, Homo sapiens
ctggaacctggcaggccctg

SEQ ID NO: 5043481 - DNA, 21 bp, Homo sapiens
ctggaacctggcaggccctgc

SEQ ID NO: 5043482 - DNA, 22 bp, Homo sapiens
ctggaacctggcaggccctgcc

SEQ ID NO: 5043483 - DNA, 20 bp, Homo sapiens
ctggacatttgtggcagtgc

SEQ ID NO: 5043484 - DNA, 22 bp, Homo sapiens
ctggacatttgtggcagtgctg

SEQ ID NO: 5043485 - DNA, 23 bp, Homo sapiens
ctggacatttgtggcagtgctga

SEQ ID NO: 5043486 - DNA, 13 bp, Homo sapiens
ctggcaggccctg

SEQ ID NO: 5043487 - DNA, 19 bp, Homo sapiens
ctggcaggccctgcccagc

SEQ ID NO: 5043488 - DNA, 12 bp, Homo sapiens
ctggccctaggc

SEQ ID NO: 5043489 - DNA, 14 bp, Homo sapiens
ctggcgaagcctga

SEQ ID NO: 5043490 - DNA, 15 bp, Homo sapiens
ctggcgaagcctgag

SEQ ID NO: 5043491 - DNA, 18 bp, Homo sapiens
ctggcgaagcctgagcag

SEQ ID NO: 5043492 - DNA, 13 bp, Homo sapiens
ctggcgatctccc

SEQ ID NO: 5043493 - DNA, 15 bp, Homo sapiens
ctggcgatctcccag

SEQ ID NO: 5043494 - DNA, 17 bp, Homo sapiens
ctggcgatctcccaggg

SEQ ID NO: 5043495 - DNA, 24 bp, Homo sapiens
ctggcgatctcccagggctctctg

SEQ ID NO: 5043496 - DNA, 15 bp, Homo sapiens
ctggctgctcctaac

SEQ ID NO: 5043497 - DNA, 14 bp, Homo sapiens
ctggctggccagga

SEQ ID NO: 5043498 - DNA, 21 bp, Homo sapiens
ctggggccttcctggctttgg

SEQ ID NO: 5043499 - DNA, 16 bp, Homo sapiens
ctggggctggctgcag

SEQ ID NO: 5043500 - DNA, 21 bp, Homo sapiens
ctggtcaggcaatgccctgcg

SEQ ID NO: 5043501 - DNA, 14 bp, Homo sapiens
ctggtctggtcagg

SEQ ID NO: 5043502 - DNA, 17 bp, Homo sapiens
ctggtctggtcaggcaa

SEQ ID NO: 5043503 - DNA, 15 bp, Homo sapiens
ctgtcaccctgaggt

SEQ ID NO: 5043504 - DNA, 15 bp, Homo sapiens
ctgtgacctggtctg

SEQ ID NO: 5043505 - DNA, 16 bp, Homo sapiens
ctgtgcagggaaaggg

SEQ ID NO: 5043506 - DNA, 15 bp, Homo sapiens
ctgtgcttggaggcc

SEQ ID NO: 5043507 - DNA, 16 bp, Homo sapiens
ctgtgcttggaggcct

SEQ ID NO: 5043508 - DNA, 17 bp, Homo sapiens
ctgtgcttggaggcctc

SEQ ID NO: 5043509 - DNA, 18 bp, Homo sapiens
ctgtggcgccgcgtggac

SEQ ID NO: 5043510 - DNA, 17 bp, Homo sapiens
ctgtggtcaggcccagc

SEQ ID NO: 5043511 - DNA, 22 bp, Homo sapiens
ctgtggtcaggcccagcctctc

SEQ ID NO: 5043512 - DNA, 24 bp, Homo sapiens
ctgtggtcaggcccagcctctctg

SEQ ID NO: 5043513 - DNA, 14 bp, Homo sapiens
ctgtgtggtctcca

SEQ ID NO: 5043514 - DNA, 17 bp, Homo sapiens
ctgttctcaaagcagaa

SEQ ID NO: 5043515 - DNA, 17 bp, Homo sapiens
cttagcttttagcctgg

SEQ ID NO: 5043516 - DNA, 13 bp, Homo sapiens
cttcactgcccag

SEQ ID NO: 5043517 - DNA, 15 bp, Homo sapiens
cttcactgcccaggg

SEQ ID NO: 5043518 - DNA, 18 bp, Homo sapiens
cttcatcccagctgctga

SEQ ID NO: 5043519 - DNA, 20 bp, Homo sapiens
cttcatcccagctgctgagg

SEQ ID NO: 5043520 - DNA, 20 bp, Homo sapiens
cttccagaggagagtggcct

SEQ ID NO: 5043521 - DNA, 14 bp, Homo sapiens
cttcctggctttgg

SEQ ID NO: 5043522 - DNA, 21 bp, Homo sapiens
cttcttaaccctgaacaagag

SEQ ID NO: 5043523 - DNA, 15 bp, Homo sapiens
cttggaggcctcaga

SEQ ID NO: 5043524 - DNA, 12 bp, Homo sapiens
cttggccctgcg

SEQ ID NO: 5043525 - DNA, 13 bp, Homo sapiens
cttgtcaccccag

SEQ ID NO: 5043526 - DNA, 16 bp, Homo sapiens
caaaccagcctggggc

SEQ ID NO: 5043527 - DNA, 17 bp, Homo sapiens
caaacctaaatgcagtc

SEQ ID NO: 5043528 - DNA, 21 bp, Homo sapiens
caaagaactaaggatttttcc

SEQ ID NO: 5043529 - DNA, 14 bp, Homo sapiens
caaccaggcagagt

SEQ ID NO: 5043530 - DNA, 15 bp, Homo sapiens
caacccatgcccctg

SEQ ID NO: 5043531 - DNA, 18 bp, Homo sapiens
caacccatgcccctgaca

SEQ ID NO: 5043532 - DNA, 21 bp, Homo sapiens
caacccatgcccctgacagat

SEQ ID NO: 5043533 - DNA, 22 bp, Homo sapiens
caacccttagcttttagcctgg

SEQ ID NO: 5043534 - DNA, 19 bp, Homo sapiens
caactggcgaagcctgagc

SEQ ID NO: 5043535 - DNA, 20 bp, Homo sapiens
caactggcgaagcctgagca

SEQ ID NO: 5043536 - DNA, 15 bp, Homo sapiens
caacttcatcccagc

SEQ ID NO: 5043537 - DNA, 22 bp, Homo sapiens
caagcacacacacacagtcctc

SEQ ID NO: 5043538 - DNA, 15 bp, Homo sapiens
caagccccattcacg

SEQ ID NO: 5043539 - DNA, 21 bp, Homo sapiens
caagccccattcacggcctgg

SEQ ID NO: 5043540 - DNA, 14 bp, Homo sapiens
caagggtgcaagcc

SEQ ID NO: 5043541 - DNA, 21 bp, Homo sapiens
caatcacccccaggacctctt

SEQ ID NO: 5043542 - DNA, 18 bp, Homo sapiens
caatgaccagcaggaggg

SEQ ID NO: 5043543 - DNA, 19 bp, Homo sapiens
caatgccctgcggctctgg

SEQ ID NO: 5043544 - DNA, 20 bp, Homo sapiens
caatgccctgcggctctgga

SEQ ID NO: 5043545 - DNA, 13 bp, Homo sapiens
cacagaggacctc

SEQ ID NO: 5043546 - DNA, 16 bp, Homo sapiens
cacagaggacctcttt

SEQ ID NO: 5043547 - DNA, 15 bp, Homo sapiens
cacaggccgtgggac

SEQ ID NO: 5043548 - DNA, 20 bp, Homo sapiens
cacaggccgtgggacccagg

SEQ ID NO: 5043549 - DNA, 18 bp, Homo sapiens
cacagtcctcacacacgg

SEQ ID NO: 5043550 - DNA, 22 bp, Homo sapiens
cacagtcctcacacacggaggc

SEQ ID NO: 5043551 - DNA, 12 bp, Homo sapiens
caccagccctga

SEQ ID NO: 5043552 - DNA, 15 bp, Homo sapiens
caccagccctgagcc

SEQ ID NO: 5043553 - DNA, 13 bp, Homo sapiens
caccatggcaaac

SEQ ID NO: 5043554 - DNA, 20 bp, Homo sapiens
cacccccaggacctcttcag

SEQ ID NO: 5043555 - DNA, 22 bp, Homo sapiens
caccgggcgcatgcctcccagg

SEQ ID NO: 5043556 - DNA, 16 bp, Homo sapiens
cacctgccggctctgg

SEQ ID NO: 5043557 - DNA, 18 bp, Homo sapiens
cacctgccggctctgggc

SEQ ID NO: 5043558 - DNA, 17 bp, Homo sapiens
cacggaggccagacaca

SEQ ID NO: 5043559 - DNA, 20 bp, Homo sapiens
cacggaggccagacacaggc

SEQ ID NO: 5043560 - DNA, 17 bp, Homo sapiens
cacggcctggcatgcag

SEQ ID NO: 5043561 - DNA, 21 bp, Homo sapiens
cacggtttaactgtcccagcg

SEQ ID NO: 5043562 - DNA, 16 bp, Homo sapiens
cactgaaaagcagcct

SEQ ID NO: 5043563 - DNA, 16 bp, Homo sapiens
cactgtggtcaggccc

SEQ ID NO: 5043564 - DNA, 18 bp, Homo sapiens
cactgtggtcaggcccag

SEQ ID NO: 5043565 - DNA, 20 bp, Homo sapiens
cactgtggtcaggcccagcc

SEQ ID NO: 5043566 - DNA, 14 bp, Homo sapiens
cacttgacctgaga

SEQ ID NO: 5043567 - DNA, 14 bp, Homo sapiens
cagacacaggccgt

SEQ ID NO: 5043568 - DNA, 16 bp, Homo sapiens
cagacccaacccatgc

SEQ ID NO: 5043569 - DNA, 21 bp, Homo sapiens
cagacccaacccatgcccctg

SEQ ID NO: 5043570 - DNA, 16 bp, Homo sapiens
cagagttctgtggcgc

SEQ ID NO: 5043571 - DNA, 21 bp, Homo sapiens
cagatctagttctcttctcct

SEQ ID NO: 5043572 - DNA, 13 bp, Homo sapiens
cagcaggagggaa

SEQ ID NO: 5043573 - DNA, 23 bp, Homo sapiens
cagccatcggaagagagggctga

SEQ ID NO: 5043574 - DNA, 17 bp, Homo sapiens
cagcccagctggccgga

SEQ ID NO: 5043575 - DNA, 17 bp, Homo sapiens
cagccctgagccatggc

SEQ ID NO: 5043576 - DNA, 23 bp, Homo sapiens
cagccggagcagttggcctgtgc

SEQ ID NO: 5043577 - DNA, 14 bp, Homo sapiens
cagcctaagggaga

SEQ ID NO: 5043578 - DNA, 20 bp, Homo sapiens
cagcctaagggagacaggcc

SEQ ID NO: 5043579 - DNA, 20 bp, Homo sapiens
cagcctgcctgaagagagga

SEQ ID NO: 5043580 - DNA, 13 bp, Homo sapiens
cagcctggggcct

SEQ ID NO: 5043581 - DNA, 14 bp, Homo sapiens
cagcctggggcctt

SEQ ID NO: 5043582 - DNA, 16 bp, Homo sapiens
cagcctggggccttcc

SEQ ID NO: 5043583 - DNA, 19 bp, Homo sapiens
cagcctttttcaccatggc

SEQ ID NO: 5043584 - DNA, 14 bp, Homo sapiens
cagctcctctccag

SEQ ID NO: 5043585 - DNA, 17 bp, Homo sapiens
cagctctcccatggagc

SEQ ID NO: 5043586 - DNA, 15 bp, Homo sapiens
cagctggccggaagg

SEQ ID NO: 5043587 - DNA, 16 bp, Homo sapiens
cagcttgtccttgctc

SEQ ID NO: 5043588 - DNA, 18 bp, Homo sapiens
cagcttgtccttgctcct

SEQ ID NO: 5043589 - DNA, 23 bp, Homo sapiens
caggaatgcggttgggaggcagg

SEQ ID NO: 5043590 - DNA, 13 bp, Homo sapiens
caggacacactga

SEQ ID NO: 5043591 - DNA, 19 bp, Homo sapiens
caggacctcttcagctgct

SEQ ID NO: 5043592 - DNA, 20 bp, Homo sapiens
caggacctcttcagctgctg

SEQ ID NO: 5043593 - DNA, 21 bp, Homo sapiens
caggacctcttcagctgctga

SEQ ID NO: 5043594 - DNA, 13 bp, Homo sapiens
caggagggaagga

SEQ ID NO: 5043595 - DNA, 17 bp, Homo sapiens
caggcaatgccctgcgg

SEQ ID NO: 5043596 - DNA, 21 bp, Homo sapiens
caggcaatgccctgcggctct

SEQ ID NO: 5043597 - DNA, 23 bp, Homo sapiens
caggcaatgccctgcggctctgg

SEQ ID NO: 5043598 - DNA, 23 bp, Homo sapiens
caggcaggaatgcggttgggagg

SEQ ID NO: 5043599 - DNA, 22 bp, Homo sapiens
caggcaggggcttggctgcccc

SEQ ID NO: 5043600 - DNA, 19 bp, Homo sapiens
agtaagaaatgggcctcag

SEQ ID NO: 5043601 - DNA, 21 bp, Homo sapiens
agtcagtcacaaaccagcctg

SEQ ID NO: 5043602 - DNA, 21 bp, Homo sapiens
agtccaatcacccccaggacc

SEQ ID NO: 5043603 - DNA, 19 bp, Homo sapiens
agtctcacctgccggctct

SEQ ID NO: 5043604 - DNA, 20 bp, Homo sapiens
agtctcacctgccggctctg

SEQ ID NO: 5043605 - DNA, 21 bp, Homo sapiens
agtctcacctgccggctctgg

SEQ ID NO: 5043606 - DNA, 18 bp, Homo sapiens
agtggaatccagtgtggc

SEQ ID NO: 5043607 - DNA, 12 bp, Homo sapiens
agtggcctgggt

SEQ ID NO: 5043608 - DNA, 13 bp, Homo sapiens
agtggcctgggtc

SEQ ID NO: 5043609 - DNA, 19 bp, Homo sapiens
agtggcctgggtcccaggg

SEQ ID NO: 5043610 - DNA, 16 bp, Homo sapiens
agtggggagcggagct

SEQ ID NO: 5043611 - DNA, 15 bp, Homo sapiens
agtgtctatggagca

SEQ ID NO: 5043612 - DNA, 13 bp, Homo sapiens
agtgtggctccca

SEQ ID NO: 5043613 - DNA, 18 bp, Homo sapiens
agttcaccagccctgagc

SEQ ID NO: 5043614 - DNA, 19 bp, Homo sapiens
agttcaccagccctgagcc

SEQ ID NO: 5043615 - DNA, 19 bp, Homo sapiens
agttggcctgtgcttggag

SEQ ID NO: 5043616 - DNA, 23 bp, Homo sapiens
agttggcctgtgcttggaggcct

SEQ ID NO: 5043617 - DNA, 18 bp, Homo sapiens
atagttgccttttcttcc

SEQ ID NO: 5043618 - DNA, 15 bp, Homo sapiens
atatttttttacttg

SEQ ID NO: 5043619 - DNA, 16 bp, Homo sapiens
atcacccccaggacct

SEQ ID NO: 5043620 - DNA, 10 bp, Homo sapiens
atccaggtgg

SEQ ID NO: 5043621 - DNA, 15 bp, Homo sapiens
atccaggtggtccca

SEQ ID NO: 5043622 - DNA, 20 bp, Homo sapiens
atcccagctgctgaggcgaa

SEQ ID NO: 5043623 - DNA, 13 bp, Homo sapiens
atcggaagagagg

SEQ ID NO: 5043624 - DNA, 11 bp, Homo sapiens
atctcccaggg

SEQ ID NO: 5043625 - DNA, 15 bp, Homo sapiens
atctcccagggctct

SEQ ID NO: 5043626 - DNA, 19 bp, Homo sapiens
atctcccagggctctctgg

SEQ ID NO: 5043627 - DNA, 22 bp, Homo sapiens
atctcccagggctctctggacc

SEQ ID NO: 5043628 - DNA, 16 bp, Homo sapiens
atgaaccatggcacct

SEQ ID NO: 5043629 - DNA, 15 bp, Homo sapiens
atgccctgcggctct

SEQ ID NO: 5043630 - DNA, 16 bp, Homo sapiens
atgccctgcggctctg

SEQ ID NO: 5043631 - DNA, 13 bp, Homo sapiens
atgcctcccaggc

SEQ ID NO: 5043632 - DNA, 15 bp, Homo sapiens
atgctgggagggctg

SEQ ID NO: 5043633 - DNA, 21 bp, Homo sapiens
atgctttgctctcaaggcttg

SEQ ID NO: 5043634 - DNA, 14 bp, Homo sapiens
atggacatgggcag

SEQ ID NO: 5043635 - DNA, 12 bp, Homo sapiens
atgggcctcagc

SEQ ID NO: 5043636 - DNA, 18 bp, Homo sapiens
atgtgcccctcctgggtg

SEQ ID NO: 5043637 - DNA, 14 bp, Homo sapiens
attcacggcctggc

SEQ ID NO: 5043638 - DNA, 16 bp, Homo sapiens
attcacggcctggcat

SEQ ID NO: 5043639 - DNA, 20 bp, Homo sapiens
attccagctctcccatggag

SEQ ID NO: 5043640 - DNA, 17 bp, Homo sapiens
atttttaaaacaaacca

SEQ ID NO: 5043641 - DNA, 13 bp, Homo sapiens
caaaccagcctgg

SEQ ID NO: 5043642 - DNA, 19 bp, Homo sapiens
caaagcagaagtggaatcc

SEQ ID NO: 5043643 - DNA, 17 bp, Homo sapiens
caaaggacacaagggtg

SEQ ID NO: 5043644 - DNA, 16 bp, Homo sapiens
caactggcgaagcctg

SEQ ID NO: 5043645 - DNA, 21 bp, Homo sapiens
caactggcgaagcctgagcag

SEQ ID NO: 5043646 - DNA, 19 bp, Homo sapiens
caacttcatcccagctgct

SEQ ID NO: 5043647 - DNA, 21 bp, Homo sapiens
caacttcatcccagctgctga

SEQ ID NO: 5043648 - DNA, 17 bp, Homo sapiens
caagagtgtctatggag

SEQ ID NO: 5043649 - DNA, 20 bp, Homo sapiens
caagagtgtctatggagcag

SEQ ID NO: 5043650 - DNA, 13 bp, Homo sapiens
caagatccaggtg

SEQ ID NO: 5043651 - DNA, 17 bp, Homo sapiens
caagatccaggtggtcc

SEQ ID NO: 5043652 - DNA, 22 bp, Homo sapiens
caagccccattcacggcctggc

SEQ ID NO: 5043653 - DNA, 13 bp, Homo sapiens
caatgaccagcag

SEQ ID NO: 5043654 - DNA, 15 bp, Homo sapiens
caatgaccagcagga

SEQ ID NO: 5043655 - DNA, 17 bp, Homo sapiens
caatgaccagcaggagg

SEQ ID NO: 5043656 - DNA, 11 bp, Homo sapiens
caatgccctgc

SEQ ID NO: 5043657 - DNA, 22 bp, Homo sapiens
caatgccctgcggctctggaaa

SEQ ID NO: 5043658 - DNA, 17 bp, Homo sapiens
cacaagggtgcaagccc

SEQ ID NO: 5043659 - DNA, 15 bp, Homo sapiens
cacacacacagtcct

SEQ ID NO: 5043660 - DNA, 18 bp, Homo sapiens
cacacacagtcctcacac

SEQ ID NO: 5043661 - DNA, 17 bp, Homo sapiens
cacacagaggacctctt

SEQ ID NO: 5043662 - DNA, 12 bp, Homo sapiens
cacacagtcctc

SEQ ID NO: 5043663 - DNA, 24 bp, Homo sapiens
cacagagacatgggagtggggagc

SEQ ID NO: 5043664 - DNA, 22 bp, Homo sapiens
cacaggccgtgggacccaggct

SEQ ID NO: 5043665 - DNA, 20 bp, Homo sapiens
cacaggtcttcactgcccag

SEQ ID NO: 5043666 - DNA, 22 bp, Homo sapiens
cacaggtcttcactgcccaggg

SEQ ID NO: 5043667 - DNA, 13 bp, Homo sapiens
caccagccctgag

SEQ ID NO: 5043668 - DNA, 14 bp, Homo sapiens
caccagccctgagc

SEQ ID NO: 5043669 - DNA, 18 bp, Homo sapiens
cacccacacagaggacct

SEQ ID NO: 5043670 - DNA, 12 bp, Homo sapiens
cacccccaggac

SEQ ID NO: 5043671 - DNA, 18 bp, Homo sapiens
caccgggcgcatgcctcc

SEQ ID NO: 5043672 - DNA, 17 bp, Homo sapiens
cacctgccggctctggg

SEQ ID NO: 5043673 - DNA, 21 bp, Homo sapiens
cacctgccggctctgggctgg

SEQ ID NO: 5043674 - DNA, 14 bp, Homo sapiens
cacctttgagagag

SEQ ID NO: 5043675 - DNA, 13 bp, Homo sapiens
cacgctgtctctt

SEQ ID NO: 5043676 - DNA, 19 bp, Homo sapiens
cacggcctggcatgcagct

SEQ ID NO: 5043677 - DNA, 18 bp, Homo sapiens
cacggggctcactctggc

SEQ ID NO: 5043678 - DNA, 21 bp, Homo sapiens
cactgatagttgccttttctt

SEQ ID NO: 5043679 - DNA, 12 bp, Homo sapiens
cactgtggtcag

SEQ ID NO: 5043680 - DNA, 14 bp, Homo sapiens
cactgtggtcaggc

SEQ ID NO: 5043681 - DNA, 15 bp, Homo sapiens
cactgtggtcaggcc

SEQ ID NO: 5043682 - DNA, 24 bp, Homo sapiens
cacttgacctgagatgctgggagg

SEQ ID NO: 5043683 - DNA, 13 bp, Homo sapiens
cagacacaggccg

SEQ ID NO: 5043684 - DNA, 16 bp, Homo sapiens
cagacacaggccgtgg

SEQ ID NO: 5043685 - DNA, 17 bp, Homo sapiens
cagacccaacccatgcc

SEQ ID NO: 5043686 - DNA, 14 bp, Homo sapiens
cagagacatgggag

SEQ ID NO: 5043687 - DNA, 12 bp, Homo sapiens
cagaggacctct

SEQ ID NO: 5043688 - DNA, 16 bp, Homo sapiens
cagaggagagtggcct

SEQ ID NO: 5043689 - DNA, 21 bp, Homo sapiens
cagaggagagtggcctgggtc

SEQ ID NO: 5043690 - DNA, 13 bp, Homo sapiens
cagatagacctgt

SEQ ID NO: 5043691 - DNA, 23 bp, Homo sapiens
cagatctagttctcttctcctgt

SEQ ID NO: 5043692 - DNA, 20 bp, Homo sapiens
cagcaattcacgctgtctct

SEQ ID NO: 5043693 - DNA, 19 bp, Homo sapiens
cagccatcggaagagaggg

SEQ ID NO: 5043694 - DNA, 18 bp, Homo sapiens
cagcccagctggccggaa

SEQ ID NO: 5043695 - DNA, 22 bp, Homo sapiens
cagcccagctggccggaaggag

SEQ ID NO: 5043696 - DNA, 22 bp, Homo sapiens
cagcccgggagctttgagacag

SEQ ID NO: 5043697 - DNA, 16 bp, Homo sapiens
cagccctgagccatgg

SEQ ID NO: 5043698 - DNA, 17 bp, Homo sapiens
cagcctaagggagacag

SEQ ID NO: 5043699 - DNA, 21 bp, Homo sapiens
cagcctaagggagacaggcct

SEQ ID NO: 5043700 - DNA, 14 bp, Homo sapiens
cagcctctctggct

SEQ ID NO: 5043701 - DNA, 16 bp, Homo sapiens
cagcctctctggctca

SEQ ID NO: 5043702 - DNA, 18 bp, Homo sapiens
cagcctctctggctcagc

SEQ ID NO: 5043703 - DNA, 12 bp, Homo sapiens
cagcctgcctga

SEQ ID NO: 5043704 - DNA, 18 bp, Homo sapiens
gaactgtcaccctgaggt

SEQ ID NO: 5043705 - DNA, 13 bp, Homo sapiens
gaagcctgagcag

SEQ ID NO: 5043706 - DNA, 14 bp, Homo sapiens
gaagcctgagcagg

SEQ ID NO: 5043707 - DNA, 18 bp, Homo sapiens
gaagcctgagcaggcagg

SEQ ID NO: 5043708 - DNA, 19 bp, Homo sapiens
gaatccagtgtggctccca

SEQ ID NO: 5043709 - DNA, 21 bp, Homo sapiens
gaatccagtgtggctcccaca

SEQ ID NO: 5043710 - DNA, 13 bp, Homo sapiens
gacacaagggtgc

SEQ ID NO: 5043711 - DNA, 17 bp, Homo sapiens
gacacaagggtgcaagc

SEQ ID NO: 5043712 - DNA, 23 bp, Homo sapiens
gacacaggccgtgggacccaggc

SEQ ID NO: 5043713 - DNA, 22 bp, Homo sapiens
gacacggtttaactgtcccagc

SEQ ID NO: 5043714 - DNA, 24 bp, Homo sapiens
gacacggtttaactgtcccagcga

SEQ ID NO: 5043715 - DNA, 22 bp, Homo sapiens
gacagccggagcagttggcctg

SEQ ID NO: 5043716 - DNA, 22 bp, Homo sapiens
gacaggcctttccctgccggcc

SEQ ID NO: 5043717 - DNA, 21 bp, Homo sapiens
gacaggtgcctggggctggct

SEQ ID NO: 5043718 - DNA, 17 bp, Homo sapiens
gacatcaagtgccagat

SEQ ID NO: 5043719 - DNA, 17 bp, Homo sapiens
gaccagcaggagggaag

SEQ ID NO: 5043720 - DNA, 19 bp, Homo sapiens
gaccagcaggagggaagga

SEQ ID NO: 5043721 - DNA, 17 bp, Homo sapiens
gaccatacgcggaggag

SEQ ID NO: 5043722 - DNA, 17 bp, Homo sapiens
gacccaacccatgcccc

SEQ ID NO: 5043723 - DNA, 20 bp, Homo sapiens
gacccaacccatgcccctga

SEQ ID NO: 5043724 - DNA, 16 bp, Homo sapiens
gacccaacccttagct

SEQ ID NO: 5043725 - DNA, 13 bp, Homo sapiens
gacccaggctccc

SEQ ID NO: 5043726 - DNA, 17 bp, Homo sapiens
gacccaggctcccagcc

SEQ ID NO: 5043727 - DNA, 16 bp, Homo sapiens
gacctcttcagctgct

SEQ ID NO: 5043728 - DNA, 23 bp, Homo sapiens
gacctctttggggcaagatccag

SEQ ID NO: 5043729 - DNA, 16 bp, Homo sapiens
gacctgagatgctggg

SEQ ID NO: 5043730 - DNA, 15 bp, Homo sapiens
gacctggtctggtca

SEQ ID NO: 5043731 - DNA, 17 bp, Homo sapiens
gacctggtctggtcagg

SEQ ID NO: 5043732 - DNA, 19 bp, Homo sapiens
gacctggtctggtcaggca

SEQ ID NO: 5043733 - DNA, 21 bp, Homo sapiens
gacctggtctggtcaggcaat

SEQ ID NO: 5043734 - DNA, 18 bp, Homo sapiens
gacctgtgacctggtctg

SEQ ID NO: 5043735 - DNA, 19 bp, Homo sapiens
gagaactgtcaccctgagg

SEQ ID NO: 5043736 - DNA, 23 bp, Homo sapiens
gagacaggtgcctggggctggct

SEQ ID NO: 5043737 - DNA, 14 bp, Homo sapiens
gagagggctgagcc

SEQ ID NO: 5043738 - DNA, 17 bp, Homo sapiens
gagagggctgagccatg

SEQ ID NO: 5043739 - DNA, 23 bp, Homo sapiens
gagagggggcactgtggtcaggc

SEQ ID NO: 5043740 - DNA, 13 bp, Homo sapiens
gagagtggcctgg

SEQ ID NO: 5043741 - DNA, 16 bp, Homo sapiens
gagagtggcctgggtc

SEQ ID NO: 5043742 - DNA, 13 bp, Homo sapiens
gagatgctgggag

SEQ ID NO: 5043743 - DNA, 23 bp, Homo sapiens
gagatgctgggagggctgaaccc

SEQ ID NO: 5043744 - DNA, 12 bp, Homo sapiens
gagcaggcaggg

SEQ ID NO: 5043745 - DNA, 23 bp, Homo sapiens
gagcaggcaggggcttggctgcc

SEQ ID NO: 5043746 - DNA, 14 bp, Homo sapiens
gagcagttggcctg

SEQ ID NO: 5043747 - DNA, 16 bp, Homo sapiens
gagccatggcggcccc

SEQ ID NO: 5043748 - DNA, 15 bp, Homo sapiens
gagctgtcggagggc

SEQ ID NO: 5043749 - DNA, 18 bp, Homo sapiens
gagctgtcggagggctgg

SEQ ID NO: 5043750 - DNA, 19 bp, Homo sapiens
gagctgtcggagggctgga

SEQ ID NO: 5043751 - DNA, 12 bp, Homo sapiens
gagcttggccct

SEQ ID NO: 5043752 - DNA, 22 bp, Homo sapiens
gagctttgagacaggtgcctgg

SEQ ID NO: 5043753 - DNA, 16 bp, Homo sapiens
gaggagagtggcctgg

SEQ ID NO: 5043754 - DNA, 21 bp, Homo sapiens
gaggcaggtcgggctgccagc

SEQ ID NO: 5043755 - DNA, 13 bp, Homo sapiens
gagggctgaaccc

SEQ ID NO: 5043756 - DNA, 16 bp, Homo sapiens
gagggctgagccatgg

SEQ ID NO: 5043757 - DNA, 22 bp, Homo sapiens
gagggggcactgtggtcaggcc

SEQ ID NO: 5043758 - DNA, 20 bp, Homo sapiens
gaggtatgtgcccctcctgg

SEQ ID NO: 5043759 - DNA, 20 bp, Homo sapiens
gagtaagaaatgggcctcag

SEQ ID NO: 5043760 - DNA, 20 bp, Homo sapiens
gagtggcctgggtcccaggg

SEQ ID NO: 5043761 - DNA, 19 bp, Homo sapiens
gagtggggagcggagcttg

SEQ ID NO: 5043762 - DNA, 20 bp, Homo sapiens
gagtggggagcggagcttgg

SEQ ID NO: 5043763 - DNA, 17 bp, Homo sapiens
gagtgtctatggagcag

SEQ ID NO: 5043764 - DNA, 21 bp, Homo sapiens
gagttttctgtgtggtctcca

SEQ ID NO: 5043765 - DNA, 18 bp, Homo sapiens
gatagacctgtgacctgg

SEQ ID NO: 5043766 - DNA, 15 bp, Homo sapiens
gatcaaccaggcaga

SEQ ID NO: 5043767 - DNA, 23 bp, Homo sapiens
gatcctgatggcacccacacaga

SEQ ID NO: 5043768 - DNA, 19 bp, Homo sapiens
gatctagttctcttctcct

SEQ ID NO: 5043769 - DNA, 12 bp, Homo sapiens
gatctcccaggg

SEQ ID NO: 5043770 - DNA, 14 bp, Homo sapiens
gatctcccagggct

SEQ ID NO: 5043771 - DNA, 20 bp, Homo sapiens
gatctcccagggctctctgg

SEQ ID NO: 5043772 - DNA, 12 bp, Homo sapiens
gatggtcaggcc

SEQ ID NO: 5043773 - DNA, 15 bp, Homo sapiens
gatggtcaggcccag

SEQ ID NO: 5043774 - DNA, 22 bp, Homo sapiens
gatggtcaggcccagttctcgt

SEQ ID NO: 5043775 - DNA, 19 bp, Homo sapiens
gcaacttcatcccagctgc

SEQ ID NO: 5043776 - DNA, 20 bp, Homo sapiens
gcaacttcatcccagctgct

SEQ ID NO: 5043777 - DNA, 20 bp, Homo sapiens
gcaagccccattcacggcct

SEQ ID NO: 5043778 - DNA, 12 bp, Homo sapiens
gcaatgccctgc

SEQ ID NO: 5043779 - DNA, 22 bp, Homo sapiens
gcaatgccctgcggctctggaa

SEQ ID NO: 5043780 - DNA, 19 bp, Homo sapiens
gcacctttgagagaggggg

SEQ ID NO: 5043781 - DNA, 15 bp, Homo sapiens
gcactgtggtcaggc

SEQ ID NO: 5043782 - DNA, 22 bp, Homo sapiens
gcaggaatgcggttgggaggca

SEQ ID NO: 5043783 - DNA, 18 bp, Homo sapiens
gcaggagggaaggacaga

SEQ ID NO: 5043784 - DNA, 19 bp, Homo sapiens
gcaggcaggggcttggctg

SEQ ID NO: 5043785 - DNA, 21 bp, Homo sapiens
gcaggcaggggcttggctgcc

SEQ ID NO: 5043786 - DNA, 23 bp, Homo sapiens
gcaggcaggggcttggctgcccc

SEQ ID NO: 5043787 - DNA, 18 bp, Homo sapiens
gcaggccctgcccagcca

SEQ ID NO: 5043788 - DNA, 21 bp, Homo sapiens
gcaggccctgcccagccagcc

SEQ ID NO: 5043789 - DNA, 22 bp, Homo sapiens
gcagggaaagggatggtcaggc

SEQ ID NO: 5043790 - DNA, 23 bp, Homo sapiens
gcagggaaagggatggtcaggcc

SEQ ID NO: 5043791 - DNA, 18 bp, Homo sapiens
gcaggggcttggctgccc

SEQ ID NO: 5043792 - DNA, 16 bp, Homo sapiens
gcaggtcgggctgcca

SEQ ID NO: 5043793 - DNA, 18 bp, Homo sapiens
gcaggtcgggctgccagc

SEQ ID NO: 5043794 - DNA, 22 bp, Homo sapiens
gcagtcagtcacaaaccagcct

SEQ ID NO: 5043795 - DNA, 17 bp, Homo sapiens
gcagtgctgaagggggc

SEQ ID NO: 5043796 - DNA, 19 bp, Homo sapiens
gcagtgctgaagggggcat

SEQ ID NO: 5043797 - DNA, 12 bp, Homo sapiens
gcagttggcctg

SEQ ID NO: 5043798 - DNA, 13 bp, Homo sapiens
gcagttggcctgt

SEQ ID NO: 5043799 - DNA, 15 bp, Homo sapiens
gcagttggcctgtgc

SEQ ID NO: 5043800 - DNA, 16 bp, Homo sapiens
gcagttggcctgtgct

SEQ ID NO: 5043801 - DNA, 21 bp, Homo sapiens
gccacctcagtctcacctgcc

SEQ ID NO: 5043802 - DNA, 19 bp, Homo sapiens
gccagccatcggaagagag

SEQ ID NO: 5043803 - DNA, 16 bp, Homo sapiens
gccagcccagctggcc

SEQ ID NO: 5043804 - DNA, 22 bp, Homo sapiens
gccagcccagctggccggaagg

SEQ ID NO: 5043805 - DNA, 14 bp, Homo sapiens
gccaggacacactg

SEQ ID NO: 5043806 - DNA, 20 bp, Homo sapiens
gccatcggaagagagggctg

SEQ ID NO: 5043807 - DNA, 21 bp, Homo sapiens
ggtcaactggcgaagcctgag

SEQ ID NO: 5043808 - DNA, 22 bp, Homo sapiens
ggtcaactggcgaagcctgagc

SEQ ID NO: 5043809 - DNA, 13 bp, Homo sapiens
ggtcaggcccagc

SEQ ID NO: 5043810 - DNA, 14 bp, Homo sapiens
ggtcaggcccagcc

SEQ ID NO: 5043811 - DNA, 15 bp, Homo sapiens
ggtcaggcccagcct

SEQ ID NO: 5043812 - DNA, 18 bp, Homo sapiens
ggtcaggcccagcctctc

SEQ ID NO: 5043813 - DNA, 21 bp, Homo sapiens
ggtcccagggctggccctagg

SEQ ID NO: 5043814 - DNA, 18 bp, Homo sapiens
ggtcccattttccccctg

SEQ ID NO: 5043815 - DNA, 22 bp, Homo sapiens
ggtcgggctgccagcccagctg

SEQ ID NO: 5043816 - DNA, 23 bp, Homo sapiens
ggtctggtcaggcaatgccctgc

SEQ ID NO: 5043817 - DNA, 12 bp, Homo sapiens
ggtgcctggggc

SEQ ID NO: 5043818 - DNA, 18 bp, Homo sapiens
ggtgcctggggctggctg

SEQ ID NO: 5043819 - DNA, 21 bp, Homo sapiens
ggtgcctggggctggctgcag

SEQ ID NO: 5043820 - DNA, 13 bp, Homo sapiens
ggttgggaggcag

SEQ ID NO: 5043821 - DNA, 18 bp, Homo sapiens
ggtttaactgtcccagcg

SEQ ID NO: 5043822 - DNA, 19 bp, Homo sapiens
gtaagaaatgggcctcagc

SEQ ID NO: 5043823 - DNA, 16 bp, Homo sapiens
gtatgtgcccctcctg

SEQ ID NO: 5043824 - DNA, 22 bp, Homo sapiens
gtcaactggcgaagcctgagca

SEQ ID NO: 5043825 - DNA, 15 bp, Homo sapiens
gtcacaaaccagcct

SEQ ID NO: 5043826 - DNA, 13 bp, Homo sapiens
gtcaccctgaggt

SEQ ID NO: 5043827 - DNA, 17 bp, Homo sapiens
gtcaggcaatgccctgc

SEQ ID NO: 5043828 - DNA, 22 bp, Homo sapiens
gtcagtcacaaaccagcctggg

SEQ ID NO: 5043829 - DNA, 22 bp, Homo sapiens
gtccacggggctcactctggcc

SEQ ID NO: 5043830 - DNA, 19 bp, Homo sapiens
gtcccagcgacatttctcc

SEQ ID NO: 5043831 - DNA, 12 bp, Homo sapiens
gtcccagggctg

SEQ ID NO: 5043832 - DNA, 15 bp, Homo sapiens
gtcccagggctggcc

SEQ ID NO: 5043833 - DNA, 14 bp, Homo sapiens
gtccccctcccact

SEQ ID NO: 5043834 - DNA, 22 bp, Homo sapiens
gtcctacaaaaataaaaggctt

SEQ ID NO: 5043835 - DNA, 15 bp, Homo sapiens
gtcctcacacacgga

SEQ ID NO: 5043836 - DNA, 17 bp, Homo sapiens
gtccttgctcctggaac

SEQ ID NO: 5043837 - DNA, 13 bp, Homo sapiens
gtcggagggctgg

SEQ ID NO: 5043838 - DNA, 13 bp, Homo sapiens
gtcgggctgccag

SEQ ID NO: 5043839 - DNA, 21 bp, Homo sapiens
gtctcacctgccggctctggg

SEQ ID NO: 5043840 - DNA, 13 bp, Homo sapiens
gtgacctggtctg

SEQ ID NO: 5043841 - DNA, 15 bp, Homo sapiens
gtgacctggtctggt

SEQ ID NO: 5043842 - DNA, 15 bp, Homo sapiens
gtgcccctcctgggt

SEQ ID NO: 5043843 - DNA, 17 bp, Homo sapiens
gtgctcaccgcctgcta

SEQ ID NO: 5043844 - DNA, 23 bp, Homo sapiens
gtgctcaccgcctgctacacagg

SEQ ID NO: 5043845 - DNA, 15 bp, Homo sapiens
gtgcttggaggcctc

SEQ ID NO: 5043846 - DNA, 17 bp, Homo sapiens
gtgcttggaggcctcag

SEQ ID NO: 5043847 - DNA, 15 bp, Homo sapiens
gtggaatccagtgtg

SEQ ID NO: 5043848 - DNA, 14 bp, Homo sapiens
gtggacagcccggg

SEQ ID NO: 5043849 - DNA, 18 bp, Homo sapiens
gtggacagcccgggagct

SEQ ID NO: 5043850 - DNA, 19 bp, Homo sapiens
gtggacagcccgggagctt

SEQ ID NO: 5043851 - DNA, 17 bp, Homo sapiens
gtggcagtgctgaaggg

SEQ ID NO: 5043852 - DNA, 13 bp, Homo sapiens
gtggcctgggtcc

SEQ ID NO: 5043853 - DNA, 18 bp, Homo sapiens
gtggcctgggtcccaggg

SEQ ID NO: 5043854 - DNA, 21 bp, Homo sapiens
gtggcctgggtcccagggctg

SEQ ID NO: 5043855 - DNA, 15 bp, Homo sapiens
gtgggacccaggctc

SEQ ID NO: 5043856 - DNA, 17 bp, Homo sapiens
gtgggacccaggctccc

SEQ ID NO: 5043857 - DNA, 18 bp, Homo sapiens
gtgggacccaggctccca

SEQ ID NO: 5043858 - DNA, 19 bp, Homo sapiens
gtggggagcggagcttggc

SEQ ID NO: 5043859 - DNA, 17 bp, Homo sapiens
gtggtcaggcccagcct

SEQ ID NO: 5043860 - DNA, 21 bp, Homo sapiens
gtggtctccagctcctctcca

SEQ ID NO: 5043861 - DNA, 18 bp, Homo sapiens
gttcaccagccctgagcc

SEQ ID NO: 5043862 - DNA, 14 bp, Homo sapiens
gttctcgtgccctt

SEQ ID NO: 5043863 - DNA, 23 bp, Homo sapiens
gttctgtggcgccgcgtggacag

SEQ ID NO: 5043864 - DNA, 13 bp, Homo sapiens
gttggcctgtgct

SEQ ID NO: 5043865 - DNA, 18 bp, Homo sapiens
gttggcctgtgcttggag

SEQ ID NO: 5043866 - DNA, 22 bp, Homo sapiens
gttttctgtgtggtctccagct

SEQ ID NO: 5043867 - DNA, 15 bp, Homo sapiens
taaaactgagactgt

SEQ ID NO: 5043868 - DNA, 14 bp, Homo sapiens
taactgtcccagcg

SEQ ID NO: 5043869 - DNA, 14 bp, Homo sapiens
tacctcgccgagct

SEQ ID NO: 5043870 - DNA, 16 bp, Homo sapiens
tagcttttagcctggc

SEQ ID NO: 5043871 - DNA, 16 bp, Homo sapiens
tagttctcttctcctg

SEQ ID NO: 5043872 - DNA, 20 bp, Homo sapiens
tagttgccttttcttcccct

SEQ ID NO: 5043873 - DNA, 14 bp, Homo sapiens
tcaaccaggcagag

SEQ ID NO: 5043874 - DNA, 21 bp, Homo sapiens
tcaactggcgaagcctgagca

SEQ ID NO: 5043875 - DNA, 13 bp, Homo sapiens
tcacacaagcaca

SEQ ID NO: 5043876 - DNA, 23 bp, Homo sapiens
tcaccccagttcccttggtggca

SEQ ID NO: 5043877 - DNA, 16 bp, Homo sapiens
tcacctgccggctctg

SEQ ID NO: 5043878 - DNA, 20 bp, Homo sapiens
tcacctgccggctctgggct

SEQ ID NO: 5043879 - DNA, 13 bp, Homo sapiens
tcacggcctggca

SEQ ID NO: 5043880 - DNA, 14 bp, Homo sapiens
tcagatagacctgt

SEQ ID NO: 5043881 - DNA, 17 bp, Homo sapiens
tcagcctgcctgaagag

SEQ ID NO: 5043882 - DNA, 16 bp, Homo sapiens
tcaggcaatgccctgc

SEQ ID NO: 5043883 - DNA, 17 bp, Homo sapiens
tcaggcaatgccctgcg

SEQ ID NO: 5043884 - DNA, 21 bp, Homo sapiens
tcaggcaatgccctgcggctc

SEQ ID NO: 5043885 - DNA, 22 bp, Homo sapiens
tcaggcaatgccctgcggctct

SEQ ID NO: 5043886 - DNA, 13 bp, Homo sapiens
tcaggcccagcct

SEQ ID NO: 5043887 - DNA, 20 bp, Homo sapiens
tcaggcccagcctctctggc

SEQ ID NO: 5043888 - DNA, 24 bp, Homo sapiens
tcaggcccagcctctctggctcag

SEQ ID NO: 5043889 - DNA, 17 bp, Homo sapiens
tcaggcccagttctcgt

SEQ ID NO: 5043890 - DNA, 22 bp, Homo sapiens
tcaggcccagttctcgtgccct

SEQ ID NO: 5043891 - DNA, 19 bp, Homo sapiens
tcagtcacaaaccagcctg

SEQ ID NO: 5043892 - DNA, 21 bp, Homo sapiens
tcagtcacaaaccagcctggg

SEQ ID NO: 5043893 - DNA, 15 bp, Homo sapiens
tcatattgtcagtcc

SEQ ID NO: 5043894 - DNA, 17 bp, Homo sapiens
tcatcccagctgctgag

SEQ ID NO: 5043895 - DNA, 19 bp, Homo sapiens
tcatcccagctgctgaggc

SEQ ID NO: 5043896 - DNA, 20 bp, Homo sapiens
tccaaggtcccattttcccc

SEQ ID NO: 5043897 - DNA, 17 bp, Homo sapiens
tccaccgggcgcatgcc

SEQ ID NO: 5043898 - DNA, 20 bp, Homo sapiens
tccacggggctcactctggc

SEQ ID NO: 5043899 - DNA, 19 bp, Homo sapiens
tccagaggagagtggcctg

SEQ ID NO: 5043900 - DNA, 22 bp, Homo sapiens
tccagaggagagtggcctgggt

SEQ ID NO: 5043901 - DNA, 14 bp, Homo sapiens
tccagctcctctcc

SEQ ID NO: 5043902 - DNA, 21 bp, Homo sapiens
tccagctcctctccagacaca

SEQ ID NO: 5043903 - DNA, 16 bp, Homo sapiens
tccagctctcccatgg

SEQ ID NO: 5043904 - DNA, 17 bp, Homo sapiens
tccagtgtggctcccac

SEQ ID NO: 5043905 - DNA, 18 bp, Homo sapiens
tccatgctttgctctcaa

SEQ ID NO: 5043906 - DNA, 16 bp, Homo sapiens
tcccagcctaagggag

SEQ ID NO: 5043907 - DNA, 19 bp, Homo sapiens
tcccaggccacctcagtct

SEQ ID NO: 5043908 - DNA, 13 bp, Homo sapiens
tcccagggctctc

SEQ ID NO: 5043909 - DNA, 16 bp, Homo sapiens
tcccagggctctctgg

SEQ ID NO: 5043910 - DNA, 18 bp, Homo sapiens
tcccagggctctctggac

SEQ ID NO: 5043911 - DNA, 20 bp, Homo sapiens
tgtggttgggggtgggaggt

SEQ ID NO: 5043912 - DNA, 22 bp, Homo sapiens
tgtggtttttgtgtgtgtggac

SEQ ID NO: 5043913 - DNA, 12 bp, Homo sapiens
tgtgtggacagc

SEQ ID NO: 5043914 - DNA, 13 bp, Homo sapiens
tgtgtggacagcc

SEQ ID NO: 5043915 - DNA, 18 bp, Homo sapiens
ttagcatatgcaaatctt

SEQ ID NO: 5043916 - DNA, 15 bp, Homo sapiens
ttcacggcctggcat

SEQ ID NO: 5043917 - DNA, 16 bp, Homo sapiens
ttccagctctcccatg

SEQ ID NO: 5043918 - DNA, 16 bp, Homo sapiens
ttcccctcctgtaaga

SEQ ID NO: 5043919 - DNA, 14 bp, Homo sapiens
ttctcgtgccctta

SEQ ID NO: 5043920 - DNA, 14 bp, Homo sapiens
ttctcttctcctgt

SEQ ID NO: 5043921 - DNA, 19 bp, Homo sapiens
ttcttgtcaccccagttcc

SEQ ID NO: 5043922 - DNA, 11 bp, Homo sapiens
ttgagagaggg

SEQ ID NO: 5043923 - DNA, 14 bp, Homo sapiens
ttgagtccagtgtg

SEQ ID NO: 5043924 - DNA, 23 bp, Homo sapiens
ttgccttttcttcccctcctgta

SEQ ID NO: 5043925 - DNA, 20 bp, Homo sapiens
ttgctcctggaacctggcag

SEQ ID NO: 5043926 - DNA, 22 bp, Homo sapiens
ttggaggcctcagatagacctg

SEQ ID NO: 5043927 - DNA, 13 bp, Homo sapiens
ttgggaggcaggt

SEQ ID NO: 5043928 - DNA, 22 bp, Homo sapiens
ttgggaggcaggtcgggctgcc

SEQ ID NO: 5043929 - DNA, 23 bp, Homo sapiens
ttgtccacggggctcactctggc

SEQ ID NO: 5043930 - DNA, 16 bp, Homo sapiens
ttgtccttgctcctgg

SEQ ID NO: 5043931 - DNA, 15 bp, Homo sapiens
ttgtggcagtgctga

SEQ ID NO: 5043932 - DNA, 12 bp, Homo sapiens
tttagcctggct

SEQ ID NO: 5043933 - DNA, 22 bp, Homo sapiens
tttcagggaaaaatattttact

SEQ ID NO: 5043934 - DNA, 18 bp, Homo sapiens
tttccagaactgcacaat

SEQ ID NO: 5043935 - DNA, 13 bp, Homo sapiens
tttttccatggac

SEQ ID NO: 5043936 - DNA, 22 bp, Homo sapiens
aaagcaacttcatcccagctgc

SEQ ID NO: 5043937 - DNA, 19 bp, Homo sapiens
aaataaaaggcttccagag

SEQ ID NO: 5043938 - DNA, 13 bp, Homo sapiens
aaccagcctgggg

SEQ ID NO: 5043939 - DNA, 22 bp, Homo sapiens
aaccagcctggggccttcctgg

SEQ ID NO: 5043940 - DNA, 22 bp, Homo sapiens
aaccccagacccaacccatgcc

SEQ ID NO: 5043941 - DNA, 23 bp, Homo sapiens
aacccttagcttttagcctggct

SEQ ID NO: 5043942 - DNA, 15 bp, Homo sapiens
aactgtcaccctgag

SEQ ID NO: 5043943 - DNA, 16 bp, Homo sapiens
aactgtcaccctgagg

SEQ ID NO: 5043944 - DNA, 14 bp, Homo sapiens
aacttcatcccagc

SEQ ID NO: 5043945 - DNA, 18 bp, Homo sapiens
aacttcatcccagctgct

SEQ ID NO: 5043946 - DNA, 19 bp, Homo sapiens
aagaaatgggcctcagccc

SEQ ID NO: 5043947 - DNA, 22 bp, Homo sapiens
aagaactaaggatttttccatg

SEQ ID NO: 5043948 - DNA, 17 bp, Homo sapiens
aagaagttcaccagccc

SEQ ID NO: 5043949 - DNA, 16 bp, Homo sapiens
aagagtgtctatggag

SEQ ID NO: 5043950 - DNA, 18 bp, Homo sapiens
aagcaacttcatcccagc

SEQ ID NO: 5043951 - DNA, 12 bp, Homo sapiens
aagcacacacac

SEQ ID NO: 5043952 - DNA, 24 bp, Homo sapiens
aagccccattcacggcctggcatg

SEQ ID NO: 5043953 - DNA, 13 bp, Homo sapiens
aagtctgttctca

SEQ ID NO: 5043954 - DNA, 16 bp, Homo sapiens
aagttcaccagccctg

SEQ ID NO: 5043955 - DNA, 17 bp, Homo sapiens
aagttcaccagccctga

SEQ ID NO: 5043956 - DNA, 11 bp, Homo sapiens
aatgccctgcg

SEQ ID NO: 5043957 - DNA, 20 bp, Homo sapiens
aatgccctgcggctctggaa

SEQ ID NO: 5043958 - DNA, 16 bp, Homo sapiens
aatgcggttgggaggc

SEQ ID NO: 5043959 - DNA, 16 bp, Homo sapiens
aatgggcctcagcccc

SEQ ID NO: 5043960 - DNA, 12 bp, Homo sapiens
acaaaccagcct

SEQ ID NO: 5043961 - DNA, 20 bp, Homo sapiens
agctggccggaaggagactg

SEQ ID NO: 5043962 - DNA, 20 bp, Homo sapiens
agctgtcggagggctggaca

SEQ ID NO: 5043963 - DNA, 12 bp, Homo sapiens
agcttggccctg

SEQ ID NO: 5043964 - DNA, 17 bp, Homo sapiens
agcttgtccttgctcct

SEQ ID NO: 5043965 - DNA, 21 bp, Homo sapiens
agctttgagacaggtgcctgg

SEQ ID NO: 5043966 - DNA, 18 bp, Homo sapiens
agcttttagcctggctgt

SEQ ID NO: 5043967 - DNA, 13 bp, Homo sapiens
aggaaactggcga

SEQ ID NO: 5043968 - DNA, 22 bp, Homo sapiens
aggaaactggcgatctcccagg

SEQ ID NO: 5043969 - DNA, 23 bp, Homo sapiens
aggaaactggcgatctcccaggg

SEQ ID NO: 5043970 - DNA, 15 bp, Homo sapiens
aggacctcttcagct

SEQ ID NO: 5043971 - DNA, 17 bp, Homo sapiens
aggacctctttggggca

SEQ ID NO: 5043972 - DNA, 14 bp, Homo sapiens
aggagactgtggtt

SEQ ID NO: 5043973 - DNA, 14 bp, Homo sapiens
aggagagtggcctg

SEQ ID NO: 5043974 - DNA, 22 bp, Homo sapiens
aggagagtggcctgggtcccag

SEQ ID NO: 5043975 - DNA, 15 bp, Homo sapiens
aggagttttctgtgt

SEQ ID NO: 5043976 - DNA, 17 bp, Homo sapiens
aggagttttctgtgtgg

SEQ ID NO: 5043977 - DNA, 18 bp, Homo sapiens
aggatttttccatggaca

SEQ ID NO: 5043978 - DNA, 13 bp, Homo sapiens
aggcaatgccctg

SEQ ID NO: 5043979 - DNA, 18 bp, Homo sapiens
aggcaatgccctgcggct

SEQ ID NO: 5043980 - DNA, 21 bp, Homo sapiens
aggcaatgccctgcggctctg

SEQ ID NO: 5043981 - DNA, 23 bp, Homo sapiens
aggcaatgccctgcggctctgga

SEQ ID NO: 5043982 - DNA, 20 bp, Homo sapiens
aggcaggggcttggctgccc

SEQ ID NO: 5043983 - DNA, 21 bp, Homo sapiens
aggcaggggcttggctgcccc

SEQ ID NO: 5043984 - DNA, 20 bp, Homo sapiens
aggcaggtcgggctgccagc

SEQ ID NO: 5043985 - DNA, 22 bp, Homo sapiens
aggcaggtcgggctgccagccc

SEQ ID NO: 5043986 - DNA, 14 bp, Homo sapiens
aggccagacacagg

SEQ ID NO: 5043987 - DNA, 16 bp, Homo sapiens
aggccagacacaggcc

SEQ ID NO: 5043988 - DNA, 17 bp, Homo sapiens
aggccagacacaggccg

SEQ ID NO: 5043989 - DNA, 19 bp, Homo sapiens
aggccagacacaggccgtg

SEQ ID NO: 5043990 - DNA, 13 bp, Homo sapiens
aggcccagcctct

SEQ ID NO: 5043991 - DNA, 17 bp, Homo sapiens
aggcccagcctctctgg

SEQ ID NO: 5043992 - DNA, 18 bp, Homo sapiens
aggcccagcctctctggc

SEQ ID NO: 5043993 - DNA, 19 bp, Homo sapiens
aggcccagcctctctggct

SEQ ID NO: 5043994 - DNA, 22 bp, Homo sapiens
aggcccagttctcgtgccctta

SEQ ID NO: 5043995 - DNA, 13 bp, Homo sapiens
aggccctgcccag

SEQ ID NO: 5043996 - DNA, 14 bp, Homo sapiens
aggccctgcccagc

SEQ ID NO: 5043997 - DNA, 16 bp, Homo sapiens
aggccctgcccagcca

SEQ ID NO: 5043998 - DNA, 21 bp, Homo sapiens
aggccctgcccagccagccat

SEQ ID NO: 5043999 - DNA, 18 bp, Homo sapiens
aggccgtgggacccaggc

SEQ ID NO: 5044000 - DNA, 21 bp, Homo sapiens
aggccgtgggacccaggctcc

SEQ ID NO: 5044001 - DNA, 19 bp, Homo sapiens
aggcctcagatagacctgt

SEQ ID NO: 5044002 - DNA, 21 bp, Homo sapiens
aggcctcagatagacctgtga

SEQ ID NO: 5044003 - DNA, 16 bp, Homo sapiens
aggctcccagcctaag

SEQ ID NO: 5044004 - DNA, 24 bp, Homo sapiens
aggcttccagaggagagtggcctg

SEQ ID NO: 5044005 - DNA, 23 bp, Homo sapiens
agggaaagggatggtcaggccca

SEQ ID NO: 5044006 - DNA, 15 bp, Homo sapiens
agggatggtcaggcc

SEQ ID NO: 5044007 - DNA, 18 bp, Homo sapiens
agggatggtcaggcccag

SEQ ID NO: 5044008 - DNA, 14 bp, Homo sapiens
agggctctctggac

SEQ ID NO: 5044009 - DNA, 12 bp, Homo sapiens
agggctggccct

SEQ ID NO: 5044010 - DNA, 14 bp, Homo sapiens
aggggaatgaacca

SEQ ID NO: 5044011 - DNA, 20 bp, Homo sapiens
aggtatgtgcccctcctggg

SEQ ID NO: 5044012 - DNA, 15 bp, Homo sapiens
aggtcgggctgccag

SEQ ID NO: 5044013 - DNA, 18 bp, Homo sapiens
aggtcttcactgcccagg

SEQ ID NO: 5044014 - DNA, 13 bp, Homo sapiens
aggtgcctggggc

SEQ ID NO: 5044015 - DNA, 20 bp, Homo sapiens
agtcagtcacaaaccagcct

SEQ ID NO: 5044016 - DNA, 23 bp, Homo sapiens
agtcagtcacaaaccagcctggg

SEQ ID NO: 5044017 - DNA, 20 bp, Homo sapiens
agtgccagatgttgtctgaa

SEQ ID NO: 5044018 - DNA, 17 bp, Homo sapiens
agtggaatccagtgtgg

SEQ ID NO: 5044019 - DNA, 11 bp, Homo sapiens
agtggcctggg

SEQ ID NO: 5044020 - DNA, 17 bp, Homo sapiens
agtggcctgggtcccag

SEQ ID NO: 5044021 - DNA, 18 bp, Homo sapiens
agtggcctgggtcccagg

SEQ ID NO: 5044022 - DNA, 16 bp, Homo sapiens
agtgtggctcccacag

SEQ ID NO: 5044023 - DNA, 13 bp, Homo sapiens
cacacggaggcca

SEQ ID NO: 5044024 - DNA, 16 bp, Homo sapiens
cacacggaggccagac

SEQ ID NO: 5044025 - DNA, 18 bp, Homo sapiens
cacaggtcttcactgccc

SEQ ID NO: 5044026 - DNA, 21 bp, Homo sapiens
cacaggtcttcactgcccagg

SEQ ID NO: 5044027 - DNA, 16 bp, Homo sapiens
caccagccctgagcca

SEQ ID NO: 5044028 - DNA, 14 bp, Homo sapiens
cacccccaggacct

SEQ ID NO: 5044029 - DNA, 22 bp, Homo sapiens
caccgcctgctacacaggcagg

SEQ ID NO: 5044030 - DNA, 23 bp, Homo sapiens
caccgggcgcatgcctcccaggc

SEQ ID NO: 5044031 - DNA, 18 bp, Homo sapiens
cacctcagtctcacctgc

SEQ ID NO: 5044032 - DNA, 22 bp, Homo sapiens
cacctgccggctctgggctggc

SEQ ID NO: 5044033 - DNA, 15 bp, Homo sapiens
cacctttgagagagg

SEQ ID NO: 5044034 - DNA, 16 bp, Homo sapiens
cacctttgagagaggg

SEQ ID NO: 5044035 - DNA, 23 bp, Homo sapiens
cacctttgagagagggggcactg

SEQ ID NO: 5044036 - DNA, 23 bp, Homo sapiens
cacgctgtctcttcttaaccctg

SEQ ID NO: 5044037 - DNA, 13 bp, Homo sapiens
cacggaggccaga

SEQ ID NO: 5044038 - DNA, 16 bp, Homo sapiens
cacggaggccagacac

SEQ ID NO: 5044039 - DNA, 21 bp, Homo sapiens
cacggaggccagacacaggcc

SEQ ID NO: 5044040 - DNA, 11 bp, Homo sapiens
cacggcctggc

SEQ ID NO: 5044041 - DNA, 13 bp, Homo sapiens
cacggcctggcat

SEQ ID NO: 5044042 - DNA, 16 bp, Homo sapiens
cacggcctggcatgca

SEQ ID NO: 5044043 - DNA, 20 bp, Homo sapiens
cacggggctcactctggccc

SEQ ID NO: 5044044 - DNA, 19 bp, Homo sapiens
cacggtttaactgtcccag

SEQ ID NO: 5044045 - DNA, 22 bp, Homo sapiens
cacggtttaactgtcccagcga

SEQ ID NO: 5044046 - DNA, 13 bp, Homo sapiens
cactgtggtcagg

SEQ ID NO: 5044047 - DNA, 19 bp, Homo sapiens
cactgtggtcaggcccagc

SEQ ID NO: 5044048 - DNA, 20 bp, Homo sapiens
cagaagtggaatccagtgtg

SEQ ID NO: 5044049 - DNA, 15 bp, Homo sapiens
cagacacagagacat

SEQ ID NO: 5044050 - DNA, 22 bp, Homo sapiens
cagacccaacccatgcccctga

SEQ ID NO: 5044051 - DNA, 17 bp, Homo sapiens
cagaggagagtggcctg

SEQ ID NO: 5044052 - DNA, 18 bp, Homo sapiens
cagaggagagtggcctgg

SEQ ID NO: 5044053 - DNA, 20 bp, Homo sapiens
cagaggagagtggcctgggt

SEQ ID NO: 5044054 - DNA, 14 bp, Homo sapiens
cagagttctgtggc

SEQ ID NO: 5044055 - DNA, 24 bp, Homo sapiens
cagatagacctgtgacctggtctg

SEQ ID NO: 5044056 - DNA, 19 bp, Homo sapiens
cagatctagttctcttctc

SEQ ID NO: 5044057 - DNA, 19 bp, Homo sapiens
cagatgttgtctgaactaa

SEQ ID NO: 5044058 - DNA, 19 bp, Homo sapiens
cagcaattcacgctgtctc

SEQ ID NO: 5044059 - DNA, 18 bp, Homo sapiens
cagccagccatcggaaga

SEQ ID NO: 5044060 - DNA, 22 bp, Homo sapiens
cagccagccatcggaagagagg

SEQ ID NO: 5044061 - DNA, 17 bp, Homo sapiens
cagccatcggaagagag

SEQ ID NO: 5044062 - DNA, 22 bp, Homo sapiens
cagccatcggaagagagggctg

SEQ ID NO: 5044063 - DNA, 13 bp, Homo sapiens
cagcccagctggc

SEQ ID NO: 5044064 - DNA, 21 bp, Homo sapiens
cagcccagctggccggaagga

SEQ ID NO: 5044065 - DNA, 23 bp, Homo sapiens
cagccccgcggatcaaccaggca

SEQ ID NO: 5044066 - DNA, 17 bp, Homo sapiens
cagcccgggagctttga

SEQ ID NO: 5044067 - DNA, 15 bp, Homo sapiens
cagcccgggatcctg

SEQ ID NO: 5044068 - DNA, 16 bp, Homo sapiens
cagcccgggatcctga

SEQ ID NO: 5044069 - DNA, 12 bp, Homo sapiens
cagccctgagcc

SEQ ID NO: 5044070 - DNA, 19 bp, Homo sapiens
cagcctaagggagacaggc

SEQ ID NO: 5044071 - DNA, 13 bp, Homo sapiens
cagcctctctggc

SEQ ID NO: 5044072 - DNA, 15 bp, Homo sapiens
cagcctctctggctc

SEQ ID NO: 5044073 - DNA, 23 bp, Homo sapiens
cagcctctctggctcagcccggg

SEQ ID NO: 5044074 - DNA, 13 bp, Homo sapiens
cagctcctctcca

SEQ ID NO: 5044075 - DNA, 22 bp, Homo sapiens
cagctcctctccagacacagag

SEQ ID NO: 5044076 - DNA, 15 bp, Homo sapiens
cagctctcccatgga

SEQ ID NO: 5044077 - DNA, 21 bp, Homo sapiens
cagctggccggaaggagactg

SEQ ID NO: 5044078 - DNA, 15 bp, Homo sapiens
cagcttgtccttgct

SEQ ID NO: 5044079 - DNA, 18 bp, Homo sapiens
caggagggaaggacagac

SEQ ID NO: 5044080 - DNA, 16 bp, Homo sapiens
caggcaatgccctgcg

SEQ ID NO: 5044081 - DNA, 15 bp, Homo sapiens
caggcagagttctgt

SEQ ID NO: 5044082 - DNA, 14 bp, Homo sapiens
caggcaggggcttg

SEQ ID NO: 5044083 - DNA, 16 bp, Homo sapiens
caggcaggggcttggc

SEQ ID NO: 5044084 - DNA, 17 bp, Homo sapiens
caggcaggggcttggct

SEQ ID NO: 5044085 - DNA, 19 bp, Homo sapiens
caggcaggggcttggctgc

SEQ ID NO: 5044086 - DNA, 23 bp, Homo sapiens
caggcaggggcttggctgcccca

SEQ ID NO: 5044087 - DNA, 16 bp, Homo sapiens
caggccacctcagtct

SEQ ID NO: 5044088 - DNA, 19 bp, Homo sapiens
caggccctgcccagccagc

SEQ ID NO: 5044089 - DNA, 21 bp, Homo sapiens
caggccctgcccagccagcca

SEQ ID NO: 5044090 - DNA, 20 bp, Homo sapiens
caggccgtgggacccaggct

SEQ ID NO: 5044091 - DNA, 21 bp, Homo sapiens
caggccgtgggacccaggctc

SEQ ID NO: 5044092 - DNA, 22 bp, Homo sapiens
caggccgtgggacccaggctcc

SEQ ID NO: 5044093 - DNA, 17 bp, Homo sapiens
caggcctttccctgccg

SEQ ID NO: 5044094 - DNA, 21 bp, Homo sapiens
caggctcccagcctaagggag

SEQ ID NO: 5044095 - DNA, 22 bp, Homo sapiens
cagggaaagggatggtcaggcc

SEQ ID NO: 5044096 - DNA, 15 bp, Homo sapiens
cagggctggccctag

SEQ ID NO: 5044097 - DNA, 14 bp, Homo sapiens
caggggcttggctg

SEQ ID NO: 5044098 - DNA, 16 bp, Homo sapiens
caggtcttcactgccc

SEQ ID NO: 5044099 - DNA, 20 bp, Homo sapiens
caggtcttcactgcccaggg

SEQ ID NO: 5044100 - DNA, 13 bp, Homo sapiens
caggtgcctgggg

SEQ ID NO: 5044101 - DNA, 17 bp, Homo sapiens
cagtcacaaaccagcct

SEQ ID NO: 5044102 - DNA, 18 bp, Homo sapiens
cagtcacaaaccagcctg

SEQ ID NO: 5044103 - DNA, 19 bp, Homo sapiens
cagtcacaaaccagcctgg

SEQ ID NO: 5044104 - DNA, 20 bp, Homo sapiens
cagtcacaaaccagcctggg

SEQ ID NO: 5044105 - DNA, 24 bp, Homo sapiens
cagtcctcacacacggaggccaga

SEQ ID NO: 5044106 - DNA, 20 bp, Homo sapiens
cagtctcacctgccggctct

SEQ ID NO: 5044107 - DNA, 13 bp, Homo sapiens
cagtgctgaaggg

SEQ ID NO: 5044108 - DNA, 24 bp, Homo sapiens
cagtgtggctcccacaggtcttca

SEQ ID NO: 5044109 - DNA, 20 bp, Homo sapiens
cagttggcctgtgcttggag

SEQ ID NO: 5044110 - DNA, 15 bp, Homo sapiens
catacgcggaggagt

SEQ ID NO: 5044111 - DNA, 17 bp, Homo sapiens
catagagaactgtcacc

SEQ ID NO: 5044112 - DNA, 14 bp, Homo sapiens
catcaagtgccaga

SEQ ID NO: 5044113 - DNA, 13 bp, Homo sapiens
catcccagctgct

SEQ ID NO: 5044114 - DNA, 13 bp, Homo sapiens
catcggaagagag

SEQ ID NO: 5044115 - DNA, 18 bp, Homo sapiens
catcggaagagagggctg

SEQ ID NO: 5044116 - DNA, 12 bp, Homo sapiens
catgcagcttgt

SEQ ID NO: 5044117 - DNA, 20 bp, Homo sapiens
catgcagcttgtccttgctc

SEQ ID NO: 5044118 - DNA, 14 bp, Homo sapiens
catgcccctgacag

SEQ ID NO: 5044119 - DNA, 15 bp, Homo sapiens
catgcccctgacaga

SEQ ID NO: 5044120 - DNA, 16 bp, Homo sapiens
catggacatgggcagc

SEQ ID NO: 5044121 - DNA, 17 bp, Homo sapiens
catggacatgggcagca

SEQ ID NO: 5044122 - DNA, 20 bp, Homo sapiens
catggcacctttgagagagg

SEQ ID NO: 5044123 - DNA, 19 bp, Homo sapiens
ggcccagcctctctggctc

SEQ ID NO: 5044124 - DNA, 21 bp, Homo sapiens
ggcccagcctctctggctcag

SEQ ID NO: 5044125 - DNA, 21 bp, Homo sapiens
ggcccagttctcgtgccctta

SEQ ID NO: 5044126 - DNA, 13 bp, Homo sapiens
ggccctaggcact

SEQ ID NO: 5044127 - DNA, 14 bp, Homo sapiens
ggccctgcccagcc

SEQ ID NO: 5044128 - DNA, 16 bp, Homo sapiens
ggccctgcccagccag

SEQ ID NO: 5044129 - DNA, 16 bp, Homo sapiens
ggccctgcgccctgtg

SEQ ID NO: 5044130 - DNA, 17 bp, Homo sapiens
ggccgtgggacccaggc

SEQ ID NO: 5044131 - DNA, 20 bp, Homo sapiens
ggccgtgggacccaggctcc

SEQ ID NO: 5044132 - DNA, 15 bp, Homo sapiens
ggcctggctggccag

SEQ ID NO: 5044133 - DNA, 16 bp, Homo sapiens
ggcctggctggccagg

SEQ ID NO: 5044134 - DNA, 17 bp, Homo sapiens
ggcctgggtcccagggc

SEQ ID NO: 5044135 - DNA, 15 bp, Homo sapiens
ggcctgtgcttggag

SEQ ID NO: 5044136 - DNA, 19 bp, Homo sapiens
ggcctgtgcttggaggcct

SEQ ID NO: 5044137 - DNA, 20 bp, Homo sapiens
ggcgaagcctgagcaggcag

SEQ ID NO: 5044138 - DNA, 13 bp, Homo sapiens
ggcgatctcccag

SEQ ID NO: 5044139 - DNA, 17 bp, Homo sapiens
ggcgatctcccagggct

SEQ ID NO: 5044140 - DNA, 18 bp, Homo sapiens
ggcgatctcccagggctc

SEQ ID NO: 5044141 - DNA, 24 bp, Homo sapiens
ggcgatctcccagggctctctgga

SEQ ID NO: 5044142 - DNA, 16 bp, Homo sapiens
ggcgcatgcctcccag

SEQ ID NO: 5044143 - DNA, 17 bp, Homo sapiens
ggcgcatgcctcccagg

SEQ ID NO: 5044144 - DNA, 17 bp, Homo sapiens
ggcggcccctcagcctg

SEQ ID NO: 5044145 - DNA, 20 bp, Homo sapiens
ggcggcccctcagcctgcct

SEQ ID NO: 5044146 - DNA, 16 bp, Homo sapiens
ggctcccagcctaagg

SEQ ID NO: 5044147 - DNA, 21 bp, Homo sapiens
ggctcccagcctaagggagac

SEQ ID NO: 5044148 - DNA, 23 bp, Homo sapiens
ggctcccagcctaagggagacag

SEQ ID NO: 5044149 - DNA, 13 bp, Homo sapiens
ggctctgggctgg

SEQ ID NO: 5044150 - DNA, 14 bp, Homo sapiens
ggctctgggctggc

SEQ ID NO: 5044151 - DNA, 16 bp, Homo sapiens
ggctctgggctggctg

SEQ ID NO: 5044152 - DNA, 12 bp, Homo sapiens
ggctgccagccc

SEQ ID NO: 5044153 - DNA, 22 bp, Homo sapiens
ggctgccagcccagctggccgg

SEQ ID NO: 5044154 - DNA, 20 bp, Homo sapiens
ggctgccccattccagctct

SEQ ID NO: 5044155 - DNA, 21 bp, Homo sapiens
ggctgccccattccagctctc

SEQ ID NO: 5044156 - DNA, 22 bp, Homo sapiens
ggctgccccattccagctctcc

SEQ ID NO: 5044157 - DNA, 21 bp, Homo sapiens
ggctggacatttgtggcagtg

SEQ ID NO: 5044158 - DNA, 13 bp, Homo sapiens
ggctggccaggac

SEQ ID NO: 5044159 - DNA, 14 bp, Homo sapiens
ggctggctgcagac

SEQ ID NO: 5044160 - DNA, 14 bp, Homo sapiens
ggcttggagaggta

SEQ ID NO: 5044161 - DNA, 14 bp, Homo sapiens
ggcttggctgcccc

SEQ ID NO: 5044162 - DNA, 16 bp, Homo sapiens
ggctttgggagtaaga

SEQ ID NO: 5044163 - DNA, 18 bp, Homo sapiens
gggaatgaaccatggcac

SEQ ID NO: 5044164 - DNA, 19 bp, Homo sapiens
gggacccaggctcccagcc

SEQ ID NO: 5044165 - DNA, 12 bp, Homo sapiens
gggaggcaggtc

SEQ ID NO: 5044166 - DNA, 15 bp, Homo sapiens
gggaggtgagctaga

SEQ ID NO: 5044167 - DNA, 17 bp, Homo sapiens
gggatggtcaggcccag

SEQ ID NO: 5044168 - DNA, 20 bp, Homo sapiens
gggcactgtggtcaggccca

SEQ ID NO: 5044169 - DNA, 21 bp, Homo sapiens
gggcactgtggtcaggcccag

SEQ ID NO: 5044170 - DNA, 23 bp, Homo sapiens
gggcagcaattcacgctgtctct

SEQ ID NO: 5044171 - DNA, 15 bp, Homo sapiens
gggccttcctggctt

SEQ ID NO: 5044172 - DNA, 18 bp, Homo sapiens
gggcgcatgcctcccagg

SEQ ID NO: 5044173 - DNA, 14 bp, Homo sapiens
gggctgccagccca

SEQ ID NO: 5044174 - DNA, 18 bp, Homo sapiens
ggggagcggagcttggcc

SEQ ID NO: 5044175 - DNA, 22 bp, Homo sapiens
ggggagcggagcttggccctgc

SEQ ID NO: 5044176 - DNA, 14 bp, Homo sapiens
ggggcactgtggtc

SEQ ID NO: 5044177 - DNA, 18 bp, Homo sapiens
ggggccttcctggctttg

SEQ ID NO: 5044178 - DNA, 19 bp, Homo sapiens
ggggccttcctggctttgg

SEQ ID NO: 5044179 - DNA, 15 bp, Homo sapiens
ggggctcactctggc

SEQ ID NO: 5044180 - DNA, 17 bp, Homo sapiens
ggggctcactctggccc

SEQ ID NO: 5044181 - DNA, 13 bp, Homo sapiens
gggggcactgtgg

SEQ ID NO: 5044182 - DNA, 22 bp, Homo sapiens
gggtcaactggcgaagcctgag

SEQ ID NO: 5044183 - DNA, 17 bp, Homo sapiens
gggtcccagggctggcc

SEQ ID NO: 5044184 - DNA, 23 bp, Homo sapiens
gggtcccagggctggccctaggc

SEQ ID NO: 5044185 - DNA, 17 bp, Homo sapiens
gggtccccctcccactt

SEQ ID NO: 5044186 - DNA, 18 bp, Homo sapiens
ggtcaggcaatgccctgc

SEQ ID NO: 5044187 - DNA, 21 bp, Homo sapiens
ggtcccattttccccctgtgt

SEQ ID NO: 5044188 - DNA, 23 bp, Homo sapiens
ggtccccctcccacttgacctga

SEQ ID NO: 5044189 - DNA, 13 bp, Homo sapiens
ggtctggtcaggc

SEQ ID NO: 5044190 - DNA, 16 bp, Homo sapiens
ggtcttcactgcccag

SEQ ID NO: 5044191 - DNA, 14 bp, Homo sapiens
ggtgcctggggctg

SEQ ID NO: 5044192 - DNA, 16 bp, Homo sapiens
ggtgcctggggctggc

SEQ ID NO: 5044193 - DNA, 20 bp, Homo sapiens
gtaagaaatgggcctcagcc

SEQ ID NO: 5044194 - DNA, 20 bp, Homo sapiens
gtatgtgcccctcctgggtg

SEQ ID NO: 5044195 - DNA, 17 bp, Homo sapiens
gtcacaaaccagcctgg

SEQ ID NO: 5044196 - DNA, 20 bp, Homo sapiens
gtcacaaaccagcctggggc

SEQ ID NO: 5044197 - DNA, 20 bp, Homo sapiens
gtcacctttttaatttccag

SEQ ID NO: 5044198 - DNA, 19 bp, Homo sapiens
gtcaggcaatgccctgcgg

SEQ ID NO: 5044199 - DNA, 13 bp, Homo sapiens
gtcaggcccagcc

SEQ ID NO: 5044200 - DNA, 14 bp, Homo sapiens
gtcaggcccagcct

SEQ ID NO: 5044201 - DNA, 16 bp, Homo sapiens
gtcaggcccagcctct

SEQ ID NO: 5044202 - DNA, 21 bp, Homo sapiens
gtcaggcccagcctctctggc

SEQ ID NO: 5044203 - DNA, 20 bp, Homo sapiens
gtccaatcacccccaggacc

SEQ ID NO: 5044204 - DNA, 16 bp, Homo sapiens
gtcccagggctggccc

SEQ ID NO: 5044205 - DNA, 21 bp, Homo sapiens
gtcccagggctggccctaggc

SEQ ID NO: 5044206 - DNA, 19 bp, Homo sapiens
gtcccattttccccctgtg

SEQ ID NO: 5044207 - DNA, 22 bp, Homo sapiens
gtcctcacacacggaggccaga

SEQ ID NO: 5044208 - DNA, 17 bp, Homo sapiens
gtcggagggctggacat

SEQ ID NO: 5044209 - DNA, 13 bp, Homo sapiens
gtctatggagcag

SEQ ID NO: 5044210 - DNA, 18 bp, Homo sapiens
gtctcacctgccggctct

SEQ ID NO: 5044211 - DNA, 21 bp, Homo sapiens
gtggtcccataggtcttgtga

SEQ ID NO: 5044212 - DNA, 16 bp, Homo sapiens
gtgtctatggagcagc

SEQ ID NO: 5044213 - DNA, 22 bp, Homo sapiens
gtgtggctcccacaggtcttca

SEQ ID NO: 5044214 - DNA, 13 bp, Homo sapiens
gtgtgtggacagc

SEQ ID NO: 5044215 - DNA, 14 bp, Homo sapiens
gtgtgtgtggacag

SEQ ID NO: 5044216 - DNA, 15 bp, Homo sapiens
gttctcgtgccctta

SEQ ID NO: 5044217 - DNA, 12 bp, Homo sapiens
gttctcttctcc

SEQ ID NO: 5044218 - DNA, 16 bp, Homo sapiens
gttctcttctcctgtg

SEQ ID NO: 5044219 - DNA, 16 bp, Homo sapiens
taacagggtcaactgg

SEQ ID NO: 5044220 - DNA, 13 bp, Homo sapiens
taaccctgaacaa

SEQ ID NO: 5044221 - DNA, 18 bp, Homo sapiens
taagaaatgggcctcagc

SEQ ID NO: 5044222 - DNA, 19 bp, Homo sapiens
taagaaatgggcctcagcc

SEQ ID NO: 5044223 - DNA, 18 bp, Homo sapiens
taagaagttcaccagccc

SEQ ID NO: 5044224 - DNA, 12 bp, Homo sapiens
tacacaggcagg

SEQ ID NO: 5044225 - DNA, 23 bp, Homo sapiens
tactagtccaatcacccccagga

SEQ ID NO: 5044226 - DNA, 16 bp, Homo sapiens
tagacctgtgacctgg

SEQ ID NO: 5044227 - DNA, 18 bp, Homo sapiens
tagagaactgtcaccctg

SEQ ID NO: 5044228 - DNA, 21 bp, Homo sapiens
tagagaactgtcaccctgagg

SEQ ID NO: 5044229 - DNA, 12 bp, Homo sapiens
tagcctggctgt

SEQ ID NO: 5044230 - DNA, 14 bp, Homo sapiens
tagcctggctgtca

SEQ ID NO: 5044231 - DNA, 19 bp, Homo sapiens
tatgtgcccctcctgggtg

SEQ ID NO: 5044232 - DNA, 12 bp, Homo sapiens
tcaaccaggcag

SEQ ID NO: 5044233 - DNA, 13 bp, Homo sapiens
tcaaccaggcaga

SEQ ID NO: 5044234 - DNA, 20 bp, Homo sapiens
tcaaccaggcagagttctgt

SEQ ID NO: 5044235 - DNA, 16 bp, Homo sapiens
tcacaaaccagcctgg

SEQ ID NO: 5044236 - DNA, 18 bp, Homo sapiens
tcacaaaccagcctgggg

SEQ ID NO: 5044237 - DNA, 23 bp, Homo sapiens
tcacacaagcacacacacacagt

SEQ ID NO: 5044238 - DNA, 15 bp, Homo sapiens
tcaccagccctgagc

SEQ ID NO: 5044239 - DNA, 20 bp, Homo sapiens
tcaccccagttcccttggtg

SEQ ID NO: 5044240 - DNA, 12 bp, Homo sapiens
tcacggcctggc

SEQ ID NO: 5044241 - DNA, 15 bp, Homo sapiens
tcagcctgcctgaag

SEQ ID NO: 5044242 - DNA, 19 bp, Homo sapiens
tcaggcccagcctctctgg

SEQ ID NO: 5044243 - DNA, 22 bp, Homo sapiens
tcaggcccagcctctctggctc

SEQ ID NO: 5044244 - DNA, 22 bp, Homo sapiens
tcagtcacaaaccagcctgggg

SEQ ID NO: 5044245 - DNA, 15 bp, Homo sapiens
tcagtctcacctgcc

SEQ ID NO: 5044246 - DNA, 16 bp, Homo sapiens
tcatcccagctgctga

SEQ ID NO: 5044247 - DNA, 23 bp, Homo sapiens
tccaaggtcccattttccccctg

SEQ ID NO: 5044248 - DNA, 18 bp, Homo sapiens
tccaatcacccccaggac

SEQ ID NO: 5044249 - DNA, 21 bp, Homo sapiens
tccaccgggcgcatgcctccc

SEQ ID NO: 5044250 - DNA, 12 bp, Homo sapiens
tccagaggagag

SEQ ID NO: 5044251 - DNA, 15 bp, Homo sapiens
tccagaggagagtgg

SEQ ID NO: 5044252 - DNA, 21 bp, Homo sapiens
tccagaggagagtggcctggg

SEQ ID NO: 5044253 - DNA, 16 bp, Homo sapiens
tccagctcctctccag

SEQ ID NO: 5044254 - DNA, 17 bp, Homo sapiens
tccagctctcccatgga

SEQ ID NO: 5044255 - DNA, 18 bp, Homo sapiens
tccaggtggtcccatagg

SEQ ID NO: 5044256 - DNA, 20 bp, Homo sapiens
tccagtgtggctcccacagg

SEQ ID NO: 5044257 - DNA, 18 bp, Homo sapiens
tccatggacatgggcagc

SEQ ID NO: 5044258 - DNA, 18 bp, Homo sapiens
tcccaggccacctcagtc

SEQ ID NO: 5044259 - DNA, 17 bp, Homo sapiens
tcccagggctctctgga

SEQ ID NO: 5044260 - DNA, 13 bp, Homo sapiens
tcccatggagccc

SEQ ID NO: 5044261 - DNA, 16 bp, Homo sapiens
tcccattttccccctg

SEQ ID NO: 5044262 - DNA, 18 bp, Homo sapiens
tcccattttccccctgtg

SEQ ID NO: 5044263 - DNA, 20 bp, Homo sapiens
tccctgccggccccccaagg

SEQ ID NO: 5044264 - DNA, 22 bp, Homo sapiens
tcccttggtggcaaccccagac

SEQ ID NO: 5044265 - DNA, 14 bp, Homo sapiens
tcctcacacacgga

SEQ ID NO: 5044266 - DNA, 15 bp, Homo sapiens
tcctggaacctggca

SEQ ID NO: 5044267 - DNA, 17 bp, Homo sapiens
tcctggaacctggcagg

SEQ ID NO: 5044268 - DNA, 22 bp, Homo sapiens
tcctggaacctggcaggccctg

SEQ ID NO: 5044269 - DNA, 13 bp, Homo sapiens
tcctgtgttccct

SEQ ID NO: 5044270 - DNA, 14 bp, Homo sapiens
tccttgctcctgga

SEQ ID NO: 5044271 - DNA, 23 bp, Homo sapiens
tccttgctcctggaacctggcag

SEQ ID NO: 5044272 - DNA, 12 bp, Homo sapiens
tcggaagagagg

SEQ ID NO: 5044273 - DNA, 21 bp, Homo sapiens
tcggaagagagggctgagcca

SEQ ID NO: 5044274 - DNA, 17 bp, Homo sapiens
tcggcctggctggccag

SEQ ID NO: 5044275 - DNA, 19 bp, Homo sapiens
tcggcctggctggccagga

SEQ ID NO: 5044276 - DNA, 12 bp, Homo sapiens
tcgggctgccag

SEQ ID NO: 5044277 - DNA, 16 bp, Homo sapiens
tcgggctgccagccca

SEQ ID NO: 5044278 - DNA, 19 bp, Homo sapiens
tcgggctgccagcccagct

SEQ ID NO: 5044279 - DNA, 13 bp, Homo sapiens
tctatggagcagc

SEQ ID NO: 5044280 - DNA, 18 bp, Homo sapiens
tctcaaggcttggagagg

SEQ ID NO: 5044281 - DNA, 18 bp, Homo sapiens
tctcacctgccggctctg

SEQ ID NO: 5044282 - DNA, 14 bp, Homo sapiens
tctcccagggctct

SEQ ID NO: 5044283 - DNA, 20 bp, Homo sapiens
tctcccagggctctctggac

SEQ ID NO: 5044284 - DNA, 22 bp, Homo sapiens
tctggctcagcccgggatcctg

SEQ ID NO: 5044285 - DNA, 14 bp, Homo sapiens
tctgggctggctgc

SEQ ID NO: 5044286 - DNA, 23 bp, Homo sapiens
tctggtcaggcaatgccctgcgg

SEQ ID NO: 5044287 - DNA, 19 bp, Homo sapiens
tctgttctcaaagcagaag

SEQ ID NO: 5044288 - DNA, 16 bp, Homo sapiens
tcttaaccctgaacaa

SEQ ID NO: 5044289 - DNA, 15 bp, Homo sapiens
tcttcactgcccagg

SEQ ID NO: 5044290 - DNA, 17 bp, Homo sapiens
tcttcagctgctgacaa

SEQ ID NO: 5044291 - DNA, 15 bp, Homo sapiens
tcttcccctcctgta

SEQ ID NO: 5044292 - DNA, 12 bp, Homo sapiens
tcttctcctgtg

SEQ ID NO: 5044293 - DNA, 18 bp, Homo sapiens
tcttcttaaccctgaaca

SEQ ID NO: 5044294 - DNA, 19 bp, Homo sapiens
tcttcttaaccctgaacaa

SEQ ID NO: 5044295 - DNA, 14 bp, Homo sapiens
tgaccagcaggagg

SEQ ID NO: 5044296 - DNA, 15 bp, Homo sapiens
tgacctggtctggtc

SEQ ID NO: 5044297 - DNA, 19 bp, Homo sapiens
tgacctggtctggtcaggc

SEQ ID NO: 5044298 - DNA, 15 bp, Homo sapiens
tgagacaggtgcctg

SEQ ID NO: 5044299 - DNA, 16 bp, Homo sapiens
tgagacaggtgcctgg

SEQ ID NO: 5044300 - DNA, 18 bp, Homo sapiens
tgagacaggtgcctgggg

SEQ ID NO: 5044301 - DNA, 22 bp, Homo sapiens
tgagacaggtgcctggggctgg

SEQ ID NO: 5044302 - DNA, 21 bp, Homo sapiens
tgaggtaacagggtcaactgg

SEQ ID NO: 5044303 - DNA, 18 bp, Homo sapiens
tgcacaatgaccagcagg

SEQ ID NO: 5044304 - DNA, 18 bp, Homo sapiens
tgcagcttgtccttgctc

SEQ ID NO: 5044305 - DNA, 20 bp, Homo sapiens
tgcagcttgtccttgctcct

SEQ ID NO: 5044306 - DNA, 22 bp, Homo sapiens
tgcagcttgtccttgctcctgg

SEQ ID NO: 5044307 - DNA, 22 bp, Homo sapiens
tgccagcccagctggccggaag

SEQ ID NO: 5044308 - DNA, 22 bp, Homo sapiens
tgcccagccagccatcggaaga

SEQ ID NO: 5044309 - DNA, 16 bp, Homo sapiens
tgccccattccagctc

SEQ ID NO: 5044310 - DNA, 13 bp, Homo sapiens
tgcccctcctggg

SEQ ID NO: 5044311 - DNA, 19 bp, Homo sapiens
tgccctgcggctctggaaa

SEQ ID NO: 5044312 - DNA, 22 bp, Homo sapiens
tgccctgcggctctggaaagca

SEQ ID NO: 5044313 - DNA, 15 bp, Homo sapiens
tgcccttagagggga

SEQ ID NO: 5044314 - DNA, 13 bp, Homo sapiens
tgccggctctggg

SEQ ID NO: 5044315 - DNA, 17 bp, Homo sapiens
cataaatttattatatt

SEQ ID NO: 5044316 - DNA, 13 bp, Homo sapiens
catacgcggagga

SEQ ID NO: 5044317 - DNA, 22 bp, Homo sapiens
catagagaactgtcaccctgag

SEQ ID NO: 5044318 - DNA, 16 bp, Homo sapiens
catcccagctgctgag

SEQ ID NO: 5044319 - DNA, 24 bp, Homo sapiens
catgcagcttgtccttgctcctgg

SEQ ID NO: 5044320 - DNA, 16 bp, Homo sapiens
catgcctcccaggcca

SEQ ID NO: 5044321 - DNA, 20 bp, Homo sapiens
catgctttgctctcaaggct

SEQ ID NO: 5044322 - DNA, 14 bp, Homo sapiens
catggagcccctcc

SEQ ID NO: 5044323 - DNA, 12 bp, Homo sapiens
catgggcagcaa

SEQ ID NO: 5044324 - DNA, 16 bp, Homo sapiens
cattcacggcctggca

SEQ ID NO: 5044325 - DNA, 18 bp, Homo sapiens
cattcacggcctggcatg

SEQ ID NO: 5044326 - DNA, 21 bp, Homo sapiens
cattcacggcctggcatgcag

SEQ ID NO: 5044327 - DNA, 20 bp, Homo sapiens
cattccagctctcccatgga

SEQ ID NO: 5044328 - DNA, 16 bp, Homo sapiens
ccaacccatgcccctg

SEQ ID NO: 5044329 - DNA, 23 bp, Homo sapiens
ccaaggtcccattttccccctgt

SEQ ID NO: 5044330 - DNA, 19 bp, Homo sapiens
ccaagtggaaatcctattt

SEQ ID NO: 5044331 - DNA, 20 bp, Homo sapiens
ccaatcacccccaggacctc

SEQ ID NO: 5044332 - DNA, 15 bp, Homo sapiens
ccacacagaggacct

SEQ ID NO: 5044333 - DNA, 13 bp, Homo sapiens
ccacttgacctga

SEQ ID NO: 5044334 - DNA, 14 bp, Homo sapiens
ccagaactgcacaa

SEQ ID NO: 5044335 - DNA, 22 bp, Homo sapiens
ccagaactgcacaatgaccagc

SEQ ID NO: 5044336 - DNA, 16 bp, Homo sapiens
ccagacacagagacat

SEQ ID NO: 5044337 - DNA, 20 bp, Homo sapiens
ccagacacagagacatggga

SEQ ID NO: 5044338 - DNA, 20 bp, Homo sapiens
ccagaggagagtggcctggg

SEQ ID NO: 5044339 - DNA, 17 bp, Homo sapiens
ccagatgttgtctgaac

SEQ ID NO: 5044340 - DNA, 18 bp, Homo sapiens
ccagcaggagggaaggac

SEQ ID NO: 5044341 - DNA, 12 bp, Homo sapiens
ccagcccagctg

SEQ ID NO: 5044342 - DNA, 11 bp, Homo sapiens
ccagccctgag

SEQ ID NO: 5044343 - DNA, 12 bp, Homo sapiens
ccagccctgagc

SEQ ID NO: 5044344 - DNA, 16 bp, Homo sapiens
ccagccctgagccatg

SEQ ID NO: 5044345 - DNA, 23 bp, Homo sapiens
ccagcctaagggagacaggcctt

SEQ ID NO: 5044346 - DNA, 14 bp, Homo sapiens
ccagcctggggcct

SEQ ID NO: 5044347 - DNA, 23 bp, Homo sapiens
ccagcctggggccttcctggctt

SEQ ID NO: 5044348 - DNA, 16 bp, Homo sapiens
ccagctctcccatgga

SEQ ID NO: 5044349 - DNA, 14 bp, Homo sapiens
ccagctgctgaggc

SEQ ID NO: 5044350 - DNA, 15 bp, Homo sapiens
ccaggacacactgaa

SEQ ID NO: 5044351 - DNA, 13 bp, Homo sapiens
ccaggctcccagc

SEQ ID NO: 5044352 - DNA, 15 bp, Homo sapiens
ccagggctctctgga

SEQ ID NO: 5044353 - DNA, 13 bp, Homo sapiens
ccagggctggccc

SEQ ID NO: 5044354 - DNA, 19 bp, Homo sapiens
ccagggctggccctaggca

SEQ ID NO: 5044355 - DNA, 17 bp, Homo sapiens
ccagttctcgtgccctt

SEQ ID NO: 5044356 - DNA, 18 bp, Homo sapiens
ccattcacggcctggcat

SEQ ID NO: 5044357 - DNA, 18 bp, Homo sapiens
cccaacccatgcccctga

SEQ ID NO: 5044358 - DNA, 16 bp, Homo sapiens
cccacacagaggacct

SEQ ID NO: 5044359 - DNA, 21 bp, Homo sapiens
cccacaggtcttcactgccca

SEQ ID NO: 5044360 - DNA, 22 bp, Homo sapiens
cccacaggtcttcactgcccag

SEQ ID NO: 5044361 - DNA, 23 bp, Homo sapiens
cccagacccaacccatgcccctg

SEQ ID NO: 5044362 - DNA, 19 bp, Homo sapiens
cccagcctaagggagacag

SEQ ID NO: 5044363 - DNA, 23 bp, Homo sapiens
cccagcctaagggagacaggcct

SEQ ID NO: 5044364 - DNA, 15 bp, Homo sapiens
cccagcctctctggc

SEQ ID NO: 5044365 - DNA, 18 bp, Homo sapiens
cccagcctctctggctca

SEQ ID NO: 5044366 - DNA, 14 bp, Homo sapiens
cccagctggccgga

SEQ ID NO: 5044367 - DNA, 20 bp, Homo sapiens
cccagctggccggaaggaga

SEQ ID NO: 5044368 - DNA, 12 bp, Homo sapiens
cccaggacctct

SEQ ID NO: 5044369 - DNA, 17 bp, Homo sapiens
cccaggacctcttcagc

SEQ ID NO: 5044370 - DNA, 20 bp, Homo sapiens
cccaggacctcttcagctgc

SEQ ID NO: 5044371 - DNA, 23 bp, Homo sapiens
cccaggccacctcagtctcacct

SEQ ID NO: 5044372 - DNA, 12 bp, Homo sapiens
cccaggctccca

SEQ ID NO: 5044373 - DNA, 12 bp, Homo sapiens
cccagggctctc

SEQ ID NO: 5044374 - DNA, 15 bp, Homo sapiens
cccagggctctctgg

SEQ ID NO: 5044375 - DNA, 16 bp, Homo sapiens
cccagggctctctgga

SEQ ID NO: 5044376 - DNA, 17 bp, Homo sapiens
cccagggctctctggac

SEQ ID NO: 5044377 - DNA, 15 bp, Homo sapiens
cccagggctggccct

SEQ ID NO: 5044378 - DNA, 18 bp, Homo sapiens
cccagggctggccctagg

SEQ ID NO: 5044379 - DNA, 23 bp, Homo sapiens
cccagggctggccctaggcactg

SEQ ID NO: 5044380 - DNA, 18 bp, Homo sapiens
cccagttctcgtgccctt

SEQ ID NO: 5044381 - DNA, 14 bp, Homo sapiens
cccatggagcccct

SEQ ID NO: 5044382 - DNA, 20 bp, Homo sapiens
cccattccagctctcccatg

SEQ ID NO: 5044383 - DNA, 17 bp, Homo sapiens
cccattttccccctgtg

SEQ ID NO: 5044384 - DNA, 13 bp, Homo sapiens
ccccactcacaca

SEQ ID NO: 5044385 - DNA, 21 bp, Homo sapiens
ccccagttcccttggtggcaa

SEQ ID NO: 5044386 - DNA, 20 bp, Homo sapiens
ccccattcacggcctggcat

SEQ ID NO: 5044387 - DNA, 13 bp, Homo sapiens
cccccactcacac

SEQ ID NO: 5044388 - DNA, 14 bp, Homo sapiens
cccctccaccgggc

SEQ ID NO: 5044389 - DNA, 10 bp, Homo sapiens
cccctcctgt

SEQ ID NO: 5044390 - DNA, 13 bp, Homo sapiens
cccctcctgtaag

SEQ ID NO: 5044391 - DNA, 13 bp, Homo sapiens
ccctaggcactga

SEQ ID NO: 5044392 - DNA, 13 bp, Homo sapiens
ccctcagcctgcc

SEQ ID NO: 5044393 - DNA, 16 bp, Homo sapiens
ccctcagcctgcctga

SEQ ID NO: 5044394 - DNA, 20 bp, Homo sapiens
ccctcagcctgcctgaagag

SEQ ID NO: 5044395 - DNA, 13 bp, Homo sapiens
ccctcctgtaaga

SEQ ID NO: 5044396 - DNA, 22 bp, Homo sapiens
ccctgacagatctagttctctt

SEQ ID NO: 5044397 - DNA, 15 bp, Homo sapiens
ccctgcccagccagc

SEQ ID NO: 5044398 - DNA, 18 bp, Homo sapiens
ccctgcccagccagccat

SEQ ID NO: 5044399 - DNA, 14 bp, Homo sapiens
ccctgcgccctgtg

SEQ ID NO: 5044400 - DNA, 15 bp, Homo sapiens
ccctgcgccctgtgc

SEQ ID NO: 5044401 - DNA, 14 bp, Homo sapiens
ccctgcggctctgg

SEQ ID NO: 5044402 - DNA, 17 bp, Homo sapiens
ccctgcggctctggaaa

SEQ ID NO: 5044403 - DNA, 21 bp, Homo sapiens
ccctgtgcagggaaagggatg

SEQ ID NO: 5044404 - DNA, 21 bp, Homo sapiens
cccttagcttttagcctggct

SEQ ID NO: 5044405 - DNA, 21 bp, Homo sapiens
ccgagctgtcggagggctgga

SEQ ID NO: 5044406 - DNA, 22 bp, Homo sapiens
ccgcggatcaaccaggcagagt

SEQ ID NO: 5044407 - DNA, 16 bp, Homo sapiens
ccgtgggacccaggct

SEQ ID NO: 5044408 - DNA, 12 bp, Homo sapiens
cctcacacacgg

SEQ ID NO: 5044409 - DNA, 18 bp, Homo sapiens
cctcacacacggaggcca

SEQ ID NO: 5044410 - DNA, 22 bp, Homo sapiens
cctcagatagacctgtgacctg

SEQ ID NO: 5044411 - DNA, 15 bp, Homo sapiens
cctcagcctgcctga

SEQ ID NO: 5044412 - DNA, 23 bp, Homo sapiens
cctcagcctgcctgaagagagga

SEQ ID NO: 5044413 - DNA, 19 bp, Homo sapiens
cctcccacttgacctgaga

SEQ ID NO: 5044414 - DNA, 12 bp, Homo sapiens
cctcctgggtgc

SEQ ID NO: 5044415 - DNA, 20 bp, Homo sapiens
cctcgccgagctgtcggagg

SEQ ID NO: 5044416 - DNA, 16 bp, Homo sapiens
cctcggcctggctggc

SEQ ID NO: 5044417 - DNA, 20 bp, Homo sapiens
cctcggcctggctggccagg

SEQ ID NO: 5044418 - DNA, 21 bp, Homo sapiens
cctcggcctggctggccagga

SEQ ID NO: 5044419 - DNA, 12 bp, Homo sapiens
cctctccagaca

SEQ ID NO: 5044420 - DNA, 17 bp, Homo sapiens
agaagttcaccagccct

SEQ ID NO: 5044421 - DNA, 18 bp, Homo sapiens
agaagttcaccagccctg

SEQ ID NO: 5044422 - DNA, 19 bp, Homo sapiens
agaagttcaccagccctga

SEQ ID NO: 5044423 - DNA, 16 bp, Homo sapiens
agacacagagacatgg

SEQ ID NO: 5044424 - DNA, 14 bp, Homo sapiens
agacacaggccgtg

SEQ ID NO: 5044425 - DNA, 17 bp, Homo sapiens
agacaggcctttccctg

SEQ ID NO: 5044426 - DNA, 18 bp, Homo sapiens
agacaggcctttccctgc

SEQ ID NO: 5044427 - DNA, 22 bp, Homo sapiens
agacaggtgcctggggctggct

SEQ ID NO: 5044428 - DNA, 21 bp, Homo sapiens
agacccaacccatgcccctga

SEQ ID NO: 5044429 - DNA, 23 bp, Homo sapiens
agacccaacccatgcccctgaca

SEQ ID NO: 5044430 - DNA, 16 bp, Homo sapiens
agagagggggcactgt

SEQ ID NO: 5044431 - DNA, 19 bp, Homo sapiens
agagagggggcactgtggt

SEQ ID NO: 5044432 - DNA, 22 bp, Homo sapiens
agaggaaactggcgatctccca

SEQ ID NO: 5044433 - DNA, 16 bp, Homo sapiens
agaggagagtggcctg

SEQ ID NO: 5044434 - DNA, 13 bp, Homo sapiens
agagggggcactg

SEQ ID NO: 5044435 - DNA, 18 bp, Homo sapiens
agagggggcactgtggtc

SEQ ID NO: 5044436 - DNA, 21 bp, Homo sapiens
agagggggcactgtggtcagg

SEQ ID NO: 5044437 - DNA, 14 bp, Homo sapiens
agaggtatgtgccc

SEQ ID NO: 5044438 - DNA, 20 bp, Homo sapiens
agaggtatgtgcccctcctg

SEQ ID NO: 5044439 - DNA, 13 bp, Homo sapiens
agagtggcctggg

SEQ ID NO: 5044440 - DNA, 14 bp, Homo sapiens
agagtggcctgggt

SEQ ID NO: 5044441 - DNA, 14 bp, Homo sapiens
agatgctgggaggg

SEQ ID NO: 5044442 - DNA, 15 bp, Homo sapiens
agcaacttcatccca

SEQ ID NO: 5044443 - DNA, 17 bp, Homo sapiens
agcaacttcatcccagc

SEQ ID NO: 5044444 - DNA, 20 bp, Homo sapiens
agcaattcacgctgtctctt

SEQ ID NO: 5044445 - DNA, 15 bp, Homo sapiens
agcacacacacacag

SEQ ID NO: 5044446 - DNA, 17 bp, Homo sapiens
agcagaagtggaatcca

SEQ ID NO: 5044447 - DNA, 17 bp, Homo sapiens
agcagttggcctgtgct

SEQ ID NO: 5044448 - DNA, 22 bp, Homo sapiens
agccagccatcggaagagaggg

SEQ ID NO: 5044449 - DNA, 23 bp, Homo sapiens
agccagccatcggaagagagggc

SEQ ID NO: 5044450 - DNA, 19 bp, Homo sapiens
agccatggcggcccctcag

SEQ ID NO: 5044451 - DNA, 19 bp, Homo sapiens
agcccagctggccggaagg

SEQ ID NO: 5044452 - DNA, 19 bp, Homo sapiens
agccccattcacggcctgg

SEQ ID NO: 5044453 - DNA, 22 bp, Homo sapiens
agcccgggagctttgagacagg

SEQ ID NO: 5044454 - DNA, 19 bp, Homo sapiens
agccggagcagttggcctg

SEQ ID NO: 5044455 - DNA, 16 bp, Homo sapiens
agcctctctggctcag

SEQ ID NO: 5044456 - DNA, 15 bp, Homo sapiens
agcctgagcaggcag

SEQ ID NO: 5044457 - DNA, 12 bp, Homo sapiens
agcctgcctgaa

SEQ ID NO: 5044458 - DNA, 14 bp, Homo sapiens
agcctgcctgaaga

SEQ ID NO: 5044459 - DNA, 10 bp, Homo sapiens
agcctggctg

SEQ ID NO: 5044460 - DNA, 11 bp, Homo sapiens
agcctggctgt

SEQ ID NO: 5044461 - DNA, 15 bp, Homo sapiens
agcgacatttctcca

SEQ ID NO: 5044462 - DNA, 16 bp, Homo sapiens
agcggagcttggccct

SEQ ID NO: 5044463 - DNA, 18 bp, Homo sapiens
agcggagcttggccctgc

SEQ ID NO: 5044464 - DNA, 14 bp, Homo sapiens
agctctcccatgga

SEQ ID NO: 5044465 - DNA, 13 bp, Homo sapiens
agctgctgaggcg

SEQ ID NO: 5044466 - DNA, 14 bp, Homo sapiens
agctgtcggagggc

SEQ ID NO: 5044467 - DNA, 18 bp, Homo sapiens
agctgtcggagggctgga

SEQ ID NO: 5044468 - DNA, 13 bp, Homo sapiens
agcttggccctgc

SEQ ID NO: 5044469 - DNA, 20 bp, Homo sapiens
agcttggccctgcgccctgt

SEQ ID NO: 5044470 - DNA, 21 bp, Homo sapiens
agcttggccctgcgccctgtg

SEQ ID NO: 5044471 - DNA, 15 bp, Homo sapiens
agcttgtccttgctc

SEQ ID NO: 5044472 - DNA, 19 bp, Homo sapiens
agcttgtccttgctcctgg

SEQ ID NO: 5044473 - DNA, 22 bp, Homo sapiens
agcttgtccttgctcctggaac

SEQ ID NO: 5044474 - DNA, 13 bp, Homo sapiens
agcttttagcctg

SEQ ID NO: 5044475 - DNA, 15 bp, Homo sapiens
agcttttagcctggc

SEQ ID NO: 5044476 - DNA, 16 bp, Homo sapiens
agcttttagcctggct

SEQ ID NO: 5044477 - DNA, 22 bp, Homo sapiens
agcttttagcctggctgtcacc

SEQ ID NO: 5044478 - DNA, 12 bp, Homo sapiens
aggacacactga

SEQ ID NO: 5044479 - DNA, 13 bp, Homo sapiens
aggagactgtggt

SEQ ID NO: 5044480 - DNA, 15 bp, Homo sapiens
aggagagtggcctgg

SEQ ID NO: 5044481 - DNA, 17 bp, Homo sapiens
aggagagtggcctgggt

SEQ ID NO: 5044482 - DNA, 18 bp, Homo sapiens
aggagagtggcctgggtc

SEQ ID NO: 5044483 - DNA, 14 bp, Homo sapiens
aggcaatgccctgc

SEQ ID NO: 5044484 - DNA, 15 bp, Homo sapiens
aggcaatgccctgcg

SEQ ID NO: 5044485 - DNA, 22 bp, Homo sapiens
aggcaggggcttggctgcccca

SEQ ID NO: 5044486 - DNA, 16 bp, Homo sapiens
aggcaggtcgggctgc

SEQ ID NO: 5044487 - DNA, 19 bp, Homo sapiens
aggcaggtcgggctgccag

SEQ ID NO: 5044488 - DNA, 23 bp, Homo sapiens
aggcaggtcgggctgccagccca

SEQ ID NO: 5044489 - DNA, 21 bp, Homo sapiens
aggcccagcctctctggctca

SEQ ID NO: 5044490 - DNA, 18 bp, Homo sapiens
aggccctgcccagccagc

SEQ ID NO: 5044491 - DNA, 20 bp, Homo sapiens
aggccctgcccagccagcca

SEQ ID NO: 5044492 - DNA, 22 bp, Homo sapiens
aggccgtgggacccaggctccc

SEQ ID NO: 5044493 - DNA, 12 bp, Homo sapiens
aggctcccagcc

SEQ ID NO: 5044494 - DNA, 16 bp, Homo sapiens
aggcttccagaggaga

SEQ ID NO: 5044495 - DNA, 21 bp, Homo sapiens
aggcttccagaggagagtggc

SEQ ID NO: 5044496 - DNA, 14 bp, Homo sapiens
agggagacaggcct

SEQ ID NO: 5044497 - DNA, 13 bp, Homo sapiens
agggatggtcagg

SEQ ID NO: 5044498 - DNA, 19 bp, Homo sapiens
agggatggtcaggcccagt

SEQ ID NO: 5044499 - DNA, 24 bp, Homo sapiens
agggctggacatttgtggcagtgc

SEQ ID NO: 5044500 - DNA, 13 bp, Homo sapiens
agggctggcccta

SEQ ID NO: 5044501 - DNA, 16 bp, Homo sapiens
agggctggccctaggc

SEQ ID NO: 5044502 - DNA, 23 bp, Homo sapiens
agggggcactgtggtcaggccca

SEQ ID NO: 5044503 - DNA, 15 bp, Homo sapiens
agggggcattgccgg

SEQ ID NO: 5044504 - DNA, 15 bp, Homo sapiens
agggtcaactggcga

SEQ ID NO: 5044505 - DNA, 21 bp, Homo sapiens
agggtcaactggcgaagcctg

SEQ ID NO: 5044506 - DNA, 22 bp, Homo sapiens
aggtatgtgcccctcctgggtg

SEQ ID NO: 5044507 - DNA, 19 bp, Homo sapiens
aggtcgggctgccagccca

SEQ ID NO: 5044508 - DNA, 22 bp, Homo sapiens
aggtcgggctgccagcccagct

SEQ ID NO: 5044509 - DNA, 12 bp, Homo sapiens
aggtggtcccat

SEQ ID NO: 5044510 - DNA, 17 bp, Homo sapiens
agtaagaaatgggcctc

SEQ ID NO: 5044511 - DNA, 20 bp, Homo sapiens
agtaagaaatgggcctcagc

SEQ ID NO: 5044512 - DNA, 14 bp, Homo sapiens
agtattatgtttct

SEQ ID NO: 5044513 - DNA, 19 bp, Homo sapiens
agtcacaaaccagcctggg

SEQ ID NO: 5044514 - DNA, 20 bp, Homo sapiens
agtcacaaaccagcctgggg

SEQ ID NO: 5044515 - DNA, 22 bp, Homo sapiens
agtcagtcacaaaccagcctgg

SEQ ID NO: 5044516 - DNA, 19 bp, Homo sapiens
agtccaatcacccccagga

SEQ ID NO: 5044517 - DNA, 23 bp, Homo sapiens
agtccaatcacccccaggacctc

SEQ ID NO: 5044518 - DNA, 22 bp, Homo sapiens
agtcctcacacacggaggccag

SEQ ID NO: 5044519 - DNA, 17 bp, Homo sapiens
agtctcacctgccggct

SEQ ID NO: 5044520 - DNA, 23 bp, Homo sapiens
agtgccagatgttgtctgaacta

SEQ ID NO: 5044521 - DNA, 21 bp, Homo sapiens
agtgtctatggagcagccgga

SEQ ID NO: 5044522 - DNA, 12 bp, Homo sapiens
agtgtggctccc

SEQ ID NO: 5044523 - DNA, 20 bp, Homo sapiens
agtgtggctcccacaggtct

SEQ ID NO: 5044524 - DNA, 14 bp, Homo sapiens
agttctcttctcct

SEQ ID NO: 5044525 - DNA, 14 bp, Homo sapiens
ataaaatacatatt

SEQ ID NO: 5044526 - DNA, 14 bp, Homo sapiens
atacgcggaggagt

SEQ ID NO: 5044527 - DNA, 13 bp, Homo sapiens
atcaaccaggcag

SEQ ID NO: 5044528 - DNA, 14 bp, Homo sapiens
atcaaccaggcaga

SEQ ID NO: 5044529 - DNA, 16 bp, Homo sapiens
atcaaccaggcagagt

SEQ ID NO: 5044530 - DNA, 17 bp, Homo sapiens
atcacccccaggacctc

SEQ ID NO: 5044531 - DNA, 22 bp, Homo sapiens
atcctgatggcacccacacaga

SEQ ID NO: 5044532 - DNA, 19 bp, Homo sapiens
atctagttctcttctcctg

SEQ ID NO: 5044533 - DNA, 19 bp, Homo sapiens
atctccatgctttgctctc

SEQ ID NO: 5044534 - DNA, 21 bp, Homo sapiens
atctccatgctttgctctcaa

SEQ ID NO: 5044535 - DNA, 13 bp, Homo sapiens
atctcccagggct

SEQ ID NO: 5044536 - DNA, 16 bp, Homo sapiens
atctcccagggctctc

SEQ ID NO: 5044537 - DNA, 16 bp, Homo sapiens
atgcagcttgtccttg

SEQ ID NO: 5044538 - DNA, 23 bp, Homo sapiens
atgcagcttgtccttgctcctgg

SEQ ID NO: 5044539 - DNA, 18 bp, Homo sapiens
atgccctgcggctctgga

SEQ ID NO: 5044540 - DNA, 16 bp, Homo sapiens
atgcggttgggaggca

SEQ ID NO: 5044541 - DNA, 16 bp, Homo sapiens
atggacatgggcagca

SEQ ID NO: 5044542 - DNA, 16 bp, Homo sapiens
atggcacccacacaga

SEQ ID NO: 5044543 - DNA, 17 bp, Homo sapiens
atggcggcccctcagcc

SEQ ID NO: 5044544 - DNA, 22 bp, Homo sapiens
atggcggcccctcagcctgcct

SEQ ID NO: 5044545 - DNA, 18 bp, Homo sapiens
atgggcagcaattcacgc

SEQ ID NO: 5044546 - DNA, 11 bp, Homo sapiens
atggtcaggcc

SEQ ID NO: 5044547 - DNA, 15 bp, Homo sapiens
atgtgcccctcctgg

SEQ ID NO: 5044548 - DNA, 15 bp, Homo sapiens
attcacggcctggca

SEQ ID NO: 5044549 - DNA, 18 bp, Homo sapiens
atttccagaactgcacaa

SEQ ID NO: 5044550 - DNA, 18 bp, Homo sapiens
gcctggggctggctgcag

SEQ ID NO: 5044551 - DNA, 16 bp, Homo sapiens
gcctgggtcccagggc

SEQ ID NO: 5044552 - DNA, 17 bp, Homo sapiens
gcctgggtcccagggct

SEQ ID NO: 5044553 - DNA, 20 bp, Homo sapiens
gcctgggtcccagggctggc

SEQ ID NO: 5044554 - DNA, 22 bp, Homo sapiens
gcctgggtcccagggctggccc

SEQ ID NO: 5044555 - DNA, 22 bp, Homo sapiens
gcctgtgcttggaggcctcaga

SEQ ID NO: 5044556 - DNA, 21 bp, Homo sapiens
gccttttcttcccctcctgta

SEQ ID NO: 5044557 - DNA, 23 bp, Homo sapiens
gccttttcttcccctcctgtaag

SEQ ID NO: 5044558 - DNA, 18 bp, Homo sapiens
gcctttttcaccatggca

SEQ ID NO: 5044559 - DNA, 23 bp, Homo sapiens
gcctttttcaccatggcaaacct

SEQ ID NO: 5044560 - DNA, 14 bp, Homo sapiens
gcgaagcctgagca

SEQ ID NO: 5044561 - DNA, 14 bp, Homo sapiens
gcgatctcccaggg

SEQ ID NO: 5044562 - DNA, 20 bp, Homo sapiens
gcgatctcccagggctctct

SEQ ID NO: 5044563 - DNA, 16 bp, Homo sapiens
gcgcatgcctcccagg

SEQ ID NO: 5044564 - DNA, 18 bp, Homo sapiens
gcgcatgcctcccaggcc

SEQ ID NO: 5044565 - DNA, 20 bp, Homo sapiens
gcgcatgcctcccaggccac

SEQ ID NO: 5044566 - DNA, 14 bp, Homo sapiens
gcgccctgtgcagg

SEQ ID NO: 5044567 - DNA, 15 bp, Homo sapiens
gcggagcttggccct

SEQ ID NO: 5044568 - DNA, 18 bp, Homo sapiens
gcggatcaaccaggcaga

SEQ ID NO: 5044569 - DNA, 20 bp, Homo sapiens
gcggatcaaccaggcagagt

SEQ ID NO: 5044570 - DNA, 14 bp, Homo sapiens
gcggttgggaggca

SEQ ID NO: 5044571 - DNA, 16 bp, Homo sapiens
gcggttgggaggcagg

SEQ ID NO: 5044572 - DNA, 15 bp, Homo sapiens
gcgtggacagccgga

SEQ ID NO: 5044573 - DNA, 16 bp, Homo sapiens
gctacacaggcaggaa

SEQ ID NO: 5044574 - DNA, 16 bp, Homo sapiens
gctcctaacctacctc

SEQ ID NO: 5044575 - DNA, 17 bp, Homo sapiens
gctcctggaacctggca

SEQ ID NO: 5044576 - DNA, 13 bp, Homo sapiens
gctctcccatgga

SEQ ID NO: 5044577 - DNA, 13 bp, Homo sapiens
gctctgggctggc

SEQ ID NO: 5044578 - DNA, 18 bp, Homo sapiens
gctctgggctggctgctc

SEQ ID NO: 5044579 - DNA, 23 bp, Homo sapiens
gctgccccattccagctctccca

SEQ ID NO: 5044580 - DNA, 13 bp, Homo sapiens
gctgctgaggcga

SEQ ID NO: 5044581 - DNA, 18 bp, Homo sapiens
gctggacatttgtggcag

SEQ ID NO: 5044582 - DNA, 19 bp, Homo sapiens
gctggccaggacacactga

SEQ ID NO: 5044583 - DNA, 14 bp, Homo sapiens
gctggccggaagga

SEQ ID NO: 5044584 - DNA, 19 bp, Homo sapiens
gctggccggaaggagactg

SEQ ID NO: 5044585 - DNA, 16 bp, Homo sapiens
gctgtcggagggctgg

SEQ ID NO: 5044586 - DNA, 17 bp, Homo sapiens
gctgtcggagggctgga

SEQ ID NO: 5044587 - DNA, 23 bp, Homo sapiens
gctgtctcttcttaaccctgaac

SEQ ID NO: 5044588 - DNA, 13 bp, Homo sapiens
gcttccagaggag

SEQ ID NO: 5044589 - DNA, 14 bp, Homo sapiens
gcttggaggcctca

SEQ ID NO: 5044590 - DNA, 14 bp, Homo sapiens
gcttggccctgcgc

SEQ ID NO: 5044591 - DNA, 23 bp, Homo sapiens
gcttggccctgcgccctgtgcag

SEQ ID NO: 5044592 - DNA, 21 bp, Homo sapiens
gcttgtccttgctcctggaac

SEQ ID NO: 5044593 - DNA, 13 bp, Homo sapiens
gctttgagacagg

SEQ ID NO: 5044594 - DNA, 22 bp, Homo sapiens
ggaaactggcgatctcccaggg

SEQ ID NO: 5044595 - DNA, 21 bp, Homo sapiens
ggaaagcaacttcatcccagc

SEQ ID NO: 5044596 - DNA, 21 bp, Homo sapiens
ggaaagggatggtcaggccca

SEQ ID NO: 5044597 - DNA, 19 bp, Homo sapiens
ggaacctggcaggccctgc

SEQ ID NO: 5044598 - DNA, 20 bp, Homo sapiens
ggaacctggcaggccctgcc

SEQ ID NO: 5044599 - DNA, 13 bp, Homo sapiens
ggaagagagggct

SEQ ID NO: 5044600 - DNA, 15 bp, Homo sapiens
ggaaggagactgtgg

SEQ ID NO: 5044601 - DNA, 24 bp, Homo sapiens
ggaatccagtgtggctcccacagg

SEQ ID NO: 5044602 - DNA, 19 bp, Homo sapiens
ggaatgaaccatggcacct

SEQ ID NO: 5044603 - DNA, 14 bp, Homo sapiens
ggacatgggcagca

SEQ ID NO: 5044604 - DNA, 18 bp, Homo sapiens
ggacctcttcagctgctg

SEQ ID NO: 5044605 - DNA, 19 bp, Homo sapiens
ggagacaggcctttccctg

SEQ ID NO: 5044606 - DNA, 14 bp, Homo sapiens
ggagagtggcctgg

SEQ ID NO: 5044607 - DNA, 16 bp, Homo sapiens
ggagagtggcctgggt

SEQ ID NO: 5044608 - DNA, 23 bp, Homo sapiens
ggagagtggcctgggtcccaggg

SEQ ID NO: 5044609 - DNA, 17 bp, Homo sapiens
ggagcccctccaccggg

SEQ ID NO: 5044610 - DNA, 14 bp, Homo sapiens
tggtctccagctcc

SEQ ID NO: 5044611 - DNA, 18 bp, Homo sapiens
tgtagatctccatgcttt

SEQ ID NO: 5044612 - DNA, 16 bp, Homo sapiens
tgtccttgctcctgga

SEQ ID NO: 5044613 - DNA, 19 bp, Homo sapiens
tgtgacctggtctggtcag

SEQ ID NO: 5044614 - DNA, 23 bp, Homo sapiens
tgtgacctggtctggtcaggcaa

SEQ ID NO: 5044615 - DNA, 18 bp, Homo sapiens
tgtggctcccacaggtct

SEQ ID NO: 5044616 - DNA, 16 bp, Homo sapiens
tgtggtctccagctcc

SEQ ID NO: 5044617 - DNA, 19 bp, Homo sapiens
tgtggttgggggtgggagg

SEQ ID NO: 5044618 - DNA, 19 bp, Homo sapiens
tgtgtggacagcccgggag

SEQ ID NO: 5044619 - DNA, 19 bp, Homo sapiens
ttaaccctgaacaagagtg

SEQ ID NO: 5044620 - DNA, 18 bp, Homo sapiens
ttagcttttagcctggct

SEQ ID NO: 5044621 - DNA, 12 bp, Homo sapiens
ttcaccagccct

SEQ ID NO: 5044622 - DNA, 13 bp, Homo sapiens
ttcatcccagctg

SEQ ID NO: 5044623 - DNA, 14 bp, Homo sapiens
ttcatcccagctgc

SEQ ID NO: 5044624 - DNA, 16 bp, Homo sapiens
ttcatcccagctgctg

SEQ ID NO: 5044625 - DNA, 22 bp, Homo sapiens
ttccagaggagagtggcctggg

SEQ ID NO: 5044626 - DNA, 22 bp, Homo sapiens
ttccctgccggccccccaagga

SEQ ID NO: 5044627 - DNA, 13 bp, Homo sapiens
ttcctggctttgg

SEQ ID NO: 5044628 - DNA, 12 bp, Homo sapiens
ttctccaagtgg

SEQ ID NO: 5044629 - DNA, 15 bp, Homo sapiens
ttcttaaccctgaac

SEQ ID NO: 5044630 - DNA, 19 bp, Homo sapiens
ttgctcctggaacctggca

SEQ ID NO: 5044631 - DNA, 13 bp, Homo sapiens
ttggaggcctcag

SEQ ID NO: 5044632 - DNA, 15 bp, Homo sapiens
ttgtcaccccagttc

SEQ ID NO: 5044633 - DNA, 19 bp, Homo sapiens
ttgtccttgctcctggaac

SEQ ID NO: 5044634 - DNA, 20 bp, Homo sapiens
ttgtggcagtgctgaagggg

SEQ ID NO: 5044635 - DNA, 20 bp, Homo sapiens
tttccagaactgcacaatga

SEQ ID NO: 5044636 - DNA, 22 bp, Homo sapiens
tttcttcttgtcaccccagttc

SEQ ID NO: 5044637 - DNA, 14 bp, Homo sapiens
ttttacttgagcaa

SEQ ID NO: 5044638 - DNA, 17 bp, Homo sapiens
gacctcttcagctgctg

SEQ ID NO: 5044639 - DNA, 21 bp, Homo sapiens
gacctcttcagctgctgacaa

SEQ ID NO: 5044640 - DNA, 18 bp, Homo sapiens
gacctgagatgctgggag

SEQ ID NO: 5044641 - DNA, 13 bp, Homo sapiens
gacctggtctggt

SEQ ID NO: 5044642 - DNA, 16 bp, Homo sapiens
gacctggtctggtcag

SEQ ID NO: 5044643 - DNA, 15 bp, Homo sapiens
gacctgtgacctggt

SEQ ID NO: 5044644 - DNA, 19 bp, Homo sapiens
gacctgtgacctggtctgg

SEQ ID NO: 5044645 - DNA, 13 bp, Homo sapiens
gagacaggccttt

SEQ ID NO: 5044646 - DNA, 21 bp, Homo sapiens
gagacaggcctttccctgccg

SEQ ID NO: 5044647 - DNA, 19 bp, Homo sapiens
gagacaggtgcctggggct

SEQ ID NO: 5044648 - DNA, 24 bp, Homo sapiens
gagacatgggagtggggagcggag

SEQ ID NO: 5044649 - DNA, 13 bp, Homo sapiens
gagagagggggca

SEQ ID NO: 5044650 - DNA, 22 bp, Homo sapiens
gagagtggcctgggtcccaggg

SEQ ID NO: 5044651 - DNA, 20 bp, Homo sapiens
gagcaggcaggggcttggct

SEQ ID NO: 5044652 - DNA, 15 bp, Homo sapiens
gagcagttggcctgt

SEQ ID NO: 5044653 - DNA, 17 bp, Homo sapiens
gagcagttggcctgtgc

SEQ ID NO: 5044654 - DNA, 13 bp, Homo sapiens
gagccatggcggc

SEQ ID NO: 5044655 - DNA, 20 bp, Homo sapiens
gagccatggcggcccctcag

SEQ ID NO: 5044656 - DNA, 17 bp, Homo sapiens
gagcggagcttggccct

SEQ ID NO: 5044657 - DNA, 13 bp, Homo sapiens
gagcttggccctg

SEQ ID NO: 5044658 - DNA, 15 bp, Homo sapiens
gagctttgagacagg

SEQ ID NO: 5044659 - DNA, 22 bp, Homo sapiens
gaggaaactggcgatctcccag

SEQ ID NO: 5044660 - DNA, 17 bp, Homo sapiens
gaggcaggtcgggctgc

SEQ ID NO: 5044661 - DNA, 20 bp, Homo sapiens
gaggcaggtcgggctgccag

SEQ ID NO: 5044662 - DNA, 20 bp, Homo sapiens
gaggccagacacaggccgtg

SEQ ID NO: 5044663 - DNA, 18 bp, Homo sapiens
gagggctgaacccccact

SEQ ID NO: 5044664 - DNA, 13 bp, Homo sapiens
gagggctgagcca

SEQ ID NO: 5044665 - DNA, 15 bp, Homo sapiens
gagggctgagccatg

SEQ ID NO: 5044666 - DNA, 19 bp, Homo sapiens
gagggctgagccatggggg

SEQ ID NO: 5044667 - DNA, 23 bp, Homo sapiens
gaggggaatgaaccatggcacct

SEQ ID NO: 5044668 - DNA, 18 bp, Homo sapiens
gagtaagaaatgggcctc

SEQ ID NO: 5044669 - DNA, 18 bp, Homo sapiens
gagtccagtgtgggacac

SEQ ID NO: 5044670 - DNA, 12 bp, Homo sapiens
gagtggcctggg

SEQ ID NO: 5044671 - DNA, 14 bp, Homo sapiens
gagtggcctgggtc

SEQ ID NO: 5044672 - DNA, 16 bp, Homo sapiens
gagtgtctatggagca

SEQ ID NO: 5044673 - DNA, 20 bp, Homo sapiens
gagtgtctatggagcagccg

SEQ ID NO: 5044674 - DNA, 19 bp, Homo sapiens
gatatttttttacttgagc

SEQ ID NO: 5044675 - DNA, 21 bp, Homo sapiens
gatctagttctcttctcctgt

SEQ ID NO: 5044676 - DNA, 22 bp, Homo sapiens
gatctagttctcttctcctgtg

SEQ ID NO: 5044677 - DNA, 21 bp, Homo sapiens
gatctccatgctttgctctca

SEQ ID NO: 5044678 - DNA, 16 bp, Homo sapiens
gatgctgggagggctg

SEQ ID NO: 5044679 - DNA, 23 bp, Homo sapiens
gcaacttcatcccagctgctgag

SEQ ID NO: 5044680 - DNA, 20 bp, Homo sapiens
gcaatgccctgcggctctgg

SEQ ID NO: 5044681 - DNA, 16 bp, Homo sapiens
gcacctttgagagagg

SEQ ID NO: 5044682 - DNA, 19 bp, Homo sapiens
gcactgtggtcaggcccag

SEQ ID NO: 5044683 - DNA, 22 bp, Homo sapiens
gcactgtggtcaggcccagcct

SEQ ID NO: 5044684 - DNA, 14 bp, Homo sapiens
gcagccggaagtct

SEQ ID NO: 5044685 - DNA, 20 bp, Homo sapiens
gcagcctttttcaccatggc

SEQ ID NO: 5044686 - DNA, 21 bp, Homo sapiens
gcagcctttttcaccatggca

SEQ ID NO: 5044687 - DNA, 22 bp, Homo sapiens
gcagcctttttcaccatggcaa

SEQ ID NO: 5044688 - DNA, 16 bp, Homo sapiens
gcaggccctgcccagc

SEQ ID NO: 5044689 - DNA, 20 bp, Homo sapiens
gcaggccctgcccagccagc

SEQ ID NO: 5044690 - DNA, 12 bp, Homo sapiens
gcaggggcttgg

SEQ ID NO: 5044691 - DNA, 21 bp, Homo sapiens
gcaggtcgggctgccagccca

SEQ ID NO: 5044692 - DNA, 13 bp, Homo sapiens
gcagtgctgaagg

SEQ ID NO: 5044693 - DNA, 14 bp, Homo sapiens
gcatgcctcccagg

SEQ ID NO: 5044694 - DNA, 18 bp, Homo sapiens
gcatgcctcccaggccac

SEQ ID NO: 5044695 - DNA, 18 bp, Homo sapiens
gccagacacaggccgtgg

SEQ ID NO: 5044696 - DNA, 21 bp, Homo sapiens
gccagacacaggccgtgggac

SEQ ID NO: 5044697 - DNA, 21 bp, Homo sapiens
gccagccatcggaagagaggg

SEQ ID NO: 5044698 - DNA, 15 bp, Homo sapiens
gccaggacacactga

SEQ ID NO: 5044699 - DNA, 21 bp, Homo sapiens
gccatcggaagagagggctga

SEQ ID NO: 5044700 - DNA, 13 bp, Homo sapiens
gcccagccagcca

SEQ ID NO: 5044701 - DNA, 14 bp, Homo sapiens
caggcccagcctct

SEQ ID NO: 5044702 - DNA, 18 bp, Homo sapiens
caggcccagcctctctgg

SEQ ID NO: 5044703 - DNA, 22 bp, Homo sapiens
caggcccagcctctctggctca

SEQ ID NO: 5044704 - DNA, 23 bp, Homo sapiens
caggcccagcctctctggctcag

SEQ ID NO: 5044705 - DNA, 14 bp, Homo sapiens
caggccctgcccag

SEQ ID NO: 5044706 - DNA, 18 bp, Homo sapiens
caggccctgcccagccag

SEQ ID NO: 5044707 - DNA, 20 bp, Homo sapiens
caggctcccagcctaaggga

SEQ ID NO: 5044708 - DNA, 20 bp, Homo sapiens
cagggaaagggatggtcagg

SEQ ID NO: 5044709 - DNA, 21 bp, Homo sapiens
cagggaaagggatggtcaggc

SEQ ID NO: 5044710 - DNA, 12 bp, Homo sapiens
cagggctggccc

SEQ ID NO: 5044711 - DNA, 13 bp, Homo sapiens
cagggctggccct

SEQ ID NO: 5044712 - DNA, 14 bp, Homo sapiens
cagggctggcccta

SEQ ID NO: 5044713 - DNA, 21 bp, Homo sapiens
cagggctggccctaggcactg

SEQ ID NO: 5044714 - DNA, 18 bp, Homo sapiens
caggggcttggctgcccc

SEQ ID NO: 5044715 - DNA, 14 bp, Homo sapiens
cagggtcaactggc

SEQ ID NO: 5044716 - DNA, 15 bp, Homo sapiens
caggtcgggctgcca

SEQ ID NO: 5044717 - DNA, 17 bp, Homo sapiens
caggtcgggctgccagc

SEQ ID NO: 5044718 - DNA, 23 bp, Homo sapiens
caggtcgggctgccagcccagct

SEQ ID NO: 5044719 - DNA, 19 bp, Homo sapiens
caggtcttcactgcccagg

SEQ ID NO: 5044720 - DNA, 14 bp, Homo sapiens
caggtgcctggggc

SEQ ID NO: 5044721 - DNA, 18 bp, Homo sapiens
caggtgcctggggctggc

SEQ ID NO: 5044722 - DNA, 22 bp, Homo sapiens
caggtgcctggggctggctgca

SEQ ID NO: 5044723 - DNA, 21 bp, Homo sapiens
caggtggtcccataggtcttg

SEQ ID NO: 5044724 - DNA, 21 bp, Homo sapiens
cagtcacaaaccagcctgggg

SEQ ID NO: 5044725 - DNA, 17 bp, Homo sapiens
cagtcagtcacaaacca

SEQ ID NO: 5044726 - DNA, 21 bp, Homo sapiens
cagtcctcacacacggaggcc

SEQ ID NO: 5044727 - DNA, 16 bp, Homo sapiens
cagtctcacctgccgg

SEQ ID NO: 5044728 - DNA, 17 bp, Homo sapiens
cagtgctgaagggggca

SEQ ID NO: 5044729 - DNA, 18 bp, Homo sapiens
cagtgctgaagggggcat

SEQ ID NO: 5044730 - DNA, 15 bp, Homo sapiens
cagttggcctgtgct

SEQ ID NO: 5044731 - DNA, 14 bp, Homo sapiens
cctctctggctcag

SEQ ID NO: 5044732 - DNA, 21 bp, Homo sapiens
cctctctggctcagcccggga

SEQ ID NO: 5044733 - DNA, 14 bp, Homo sapiens
cctcttcagctgct

SEQ ID NO: 5044734 - DNA, 22 bp, Homo sapiens
cctgagatgctgggagggctga

SEQ ID NO: 5044735 - DNA, 13 bp, Homo sapiens
cctgagcaggcag

SEQ ID NO: 5044736 - DNA, 16 bp, Homo sapiens
cctgccggccccccaa

SEQ ID NO: 5044737 - DNA, 16 bp, Homo sapiens
cctgccggctctgggc

SEQ ID NO: 5044738 - DNA, 19 bp, Homo sapiens
cctgccggctctgggctgg

SEQ ID NO: 5044739 - DNA, 17 bp, Homo sapiens
cctgcggctctggaaag

SEQ ID NO: 5044740 - DNA, 16 bp, Homo sapiens
cctgctacacaggcag

SEQ ID NO: 5044741 - DNA, 18 bp, Homo sapiens
cctggaacctggcaggcc

SEQ ID NO: 5044742 - DNA, 14 bp, Homo sapiens
cctggcaggccctg

SEQ ID NO: 5044743 - DNA, 21 bp, Homo sapiens
cctggcaggccctgcccagcc

SEQ ID NO: 5044744 - DNA, 22 bp, Homo sapiens
cctggcaggccctgcccagcca

SEQ ID NO: 5044745 - DNA, 13 bp, Homo sapiens
cctggcatgcagc

SEQ ID NO: 5044746 - DNA, 16 bp, Homo sapiens
cctggctggccaggac

SEQ ID NO: 5044747 - DNA, 18 bp, Homo sapiens
cctggggccttcctggct

SEQ ID NO: 5044748 - DNA, 12 bp, Homo sapiens
cctggggctggc

SEQ ID NO: 5044749 - DNA, 13 bp, Homo sapiens
cctggggctggct

SEQ ID NO: 5044750 - DNA, 13 bp, Homo sapiens
cctgggtcccagg

SEQ ID NO: 5044751 - DNA, 14 bp, Homo sapiens
cctgggtcccaggg

SEQ ID NO: 5044752 - DNA, 13 bp, Homo sapiens
cctgtgcttggag

SEQ ID NO: 5044753 - DNA, 15 bp, Homo sapiens
cctgtgcttggaggc

SEQ ID NO: 5044754 - DNA, 16 bp, Homo sapiens
cctgtgcttggaggcc

SEQ ID NO: 5044755 - DNA, 18 bp, Homo sapiens
cctgtgcttggaggcctc

SEQ ID NO: 5044756 - DNA, 19 bp, Homo sapiens
cctgtgttttcacgcaggt

SEQ ID NO: 5044757 - DNA, 18 bp, Homo sapiens
ccttagcttttagcctgg

SEQ ID NO: 5044758 - DNA, 19 bp, Homo sapiens
ccttagcttttagcctggc

SEQ ID NO: 5044759 - DNA, 18 bp, Homo sapiens
ccttgctcctggaacctg

SEQ ID NO: 5044760 - DNA, 22 bp, Homo sapiens
ccttgctcctggaacctggcag

SEQ ID NO: 5044761 - DNA, 15 bp, Homo sapiens
cctttgagagagggg

SEQ ID NO: 5044762 - DNA, 14 bp, Homo sapiens
cgagctgtcggagg

SEQ ID NO: 5044763 - DNA, 20 bp, Homo sapiens
cgagctgtcggagggctgga

SEQ ID NO: 5044764 - DNA, 17 bp, Homo sapiens
cgatctcccagggctct

SEQ ID NO: 5044765 - DNA, 19 bp, Homo sapiens
cgatctcccagggctctct

SEQ ID NO: 5044766 - DNA, 23 bp, Homo sapiens
cgcaggtcatattgtcagtccta

SEQ ID NO: 5044767 - DNA, 17 bp, Homo sapiens
cgcggaggagttttctg

SEQ ID NO: 5044768 - DNA, 17 bp, Homo sapiens
cgcggatcaaccaggca

SEQ ID NO: 5044769 - DNA, 16 bp, Homo sapiens
cgcgtggacagccgga

SEQ ID NO: 5044770 - DNA, 16 bp, Homo sapiens
cggaaggagactgtgg

SEQ ID NO: 5044771 - DNA, 18 bp, Homo sapiens
cggagcagttggcctgtg

SEQ ID NO: 5044772 - DNA, 19 bp, Homo sapiens
cggagcagttggcctgtgc

SEQ ID NO: 5044773 - DNA, 20 bp, Homo sapiens
cggagcagttggcctgtgct

SEQ ID NO: 5044774 - DNA, 15 bp, Homo sapiens
cggagcttggccctg

SEQ ID NO: 5044775 - DNA, 11 bp, Homo sapiens
cggaggccaga

SEQ ID NO: 5044776 - DNA, 17 bp, Homo sapiens
cggatcaaccaggcaga

SEQ ID NO: 5044777 - DNA, 15 bp, Homo sapiens
cggcccctcagcctg

SEQ ID NO: 5044778 - DNA, 16 bp, Homo sapiens
cggcctggctggccag

SEQ ID NO: 5044779 - DNA, 17 bp, Homo sapiens
cggctctgggctggctg

SEQ ID NO: 5044780 - DNA, 23 bp, Homo sapiens
cggctctgggctggctgctccta

SEQ ID NO: 5044781 - DNA, 20 bp, Homo sapiens
cgggatcctgatggcaccca

SEQ ID NO: 5044782 - DNA, 21 bp, Homo sapiens
cgggcgcatgcctcccaggcc

SEQ ID NO: 5044783 - DNA, 15 bp, Homo sapiens
cgggctgccagccca

SEQ ID NO: 5044784 - DNA, 17 bp, Homo sapiens
cgggctgccagcccagc

SEQ ID NO: 5044785 - DNA, 14 bp, Homo sapiens
cggggctcactctg

SEQ ID NO: 5044786 - DNA, 15 bp, Homo sapiens
cggggctcactctgg

SEQ ID NO: 5044787 - DNA, 19 bp, Homo sapiens
cggggctcactctggcccc

SEQ ID NO: 5044788 - DNA, 14 bp, Homo sapiens
cggtttaactgtcc

SEQ ID NO: 5044789 - DNA, 21 bp, Homo sapiens
cggtttaactgtcccagcgac

SEQ ID NO: 5044790 - DNA, 14 bp, Homo sapiens
cgtgggacccaggc

SEQ ID NO: 5044791 - DNA, 18 bp, Homo sapiens
cgtgggacccaggctccc

SEQ ID NO: 5044792 - DNA, 23 bp, Homo sapiens
cgtgggacccaggctcccagcct

SEQ ID NO: 5044793 - DNA, 21 bp, Homo sapiens
ctaagaagttcaccagccctg

SEQ ID NO: 5044794 - DNA, 23 bp, Homo sapiens
ctaagaagttcaccagccctgag

SEQ ID NO: 5044795 - DNA, 18 bp, Homo sapiens
ctaagggagacaggcctt

SEQ ID NO: 5044796 - DNA, 14 bp, Homo sapiens
ctacacaggcagga

SEQ ID NO: 5044797 - DNA, 16 bp, Homo sapiens
ctacacaggcaggaat

SEQ ID NO: 5044798 - DNA, 19 bp, Homo sapiens
ctagttctcttctcctgtg

SEQ ID NO: 5044799 - DNA, 11 bp, Homo sapiens
ctatggagcag

SEQ ID NO: 5044800 - DNA, 22 bp, Homo sapiens
ctatggagcagccggaagtctg

SEQ ID NO: 5044801 - DNA, 17 bp, Homo sapiens
acctgccggctctgggc

SEQ ID NO: 5044802 - DNA, 17 bp, Homo sapiens
acctggcaggccctgcc

SEQ ID NO: 5044803 - DNA, 13 bp, Homo sapiens
acctgtgacctgg

SEQ ID NO: 5044804 - DNA, 17 bp, Homo sapiens
acctgtgacctggtctg

SEQ ID NO: 5044805 - DNA, 16 bp, Homo sapiens
acctttgagagagggg

SEQ ID NO: 5044806 - DNA, 22 bp, Homo sapiens
acctttgagagagggggcactg

SEQ ID NO: 5044807 - DNA, 19 bp, Homo sapiens
acctttttaatttccagaa

SEQ ID NO: 5044808 - DNA, 21 bp, Homo sapiens
acctttttaatttccagaact

SEQ ID NO: 5044809 - DNA, 16 bp, Homo sapiens
acggaggccagacaca

SEQ ID NO: 5044810 - DNA, 15 bp, Homo sapiens
acggcctggcatgca

SEQ ID NO: 5044811 - DNA, 19 bp, Homo sapiens
acggggctcactctggccc

SEQ ID NO: 5044812 - DNA, 20 bp, Homo sapiens
acggtttaactgtcccagcg

SEQ ID NO: 5044813 - DNA, 13 bp, Homo sapiens
actaatcgagcac

SEQ ID NO: 5044814 - DNA, 21 bp, Homo sapiens
actagtccaatcacccccagg

SEQ ID NO: 5044815 - DNA, 12 bp, Homo sapiens
actgcccagggg

SEQ ID NO: 5044816 - DNA, 14 bp, Homo sapiens
actggcgaagcctg

SEQ ID NO: 5044817 - DNA, 19 bp, Homo sapiens
actggcgaagcctgagcag

SEQ ID NO: 5044818 - DNA, 21 bp, Homo sapiens
actggcgaagcctgagcaggc

SEQ ID NO: 5044819 - DNA, 22 bp, Homo sapiens
actggcgaagcctgagcaggca

SEQ ID NO: 5044820 - DNA, 18 bp, Homo sapiens
actggcgatctcccaggg

SEQ ID NO: 5044821 - DNA, 19 bp, Homo sapiens
actggcgatctcccagggc

SEQ ID NO: 5044822 - DNA, 18 bp, Homo sapiens
acttcatcccagctgctg

SEQ ID NO: 5044823 - DNA, 21 bp, Homo sapiens
agaactaaggatttttccatg

SEQ ID NO: 5044824 - DNA, 22 bp, Homo sapiens
agaactgcacaatgaccagcag

SEQ ID NO: 5044825 - DNA, 15 bp, Homo sapiens
agaagttcaccagcc

SEQ ID NO: 5044826 - DNA, 16 bp, Homo sapiens
agacaggtgcctgggg

SEQ ID NO: 5044827 - DNA, 17 bp, Homo sapiens
agacaggtgcctggggc

SEQ ID NO: 5044828 - DNA, 15 bp, Homo sapiens
agagaactgtcaccc

SEQ ID NO: 5044829 - DNA, 12 bp, Homo sapiens
agagagggggca

SEQ ID NO: 5044830 - DNA, 18 bp, Homo sapiens
agagagggggcactgtgg

SEQ ID NO: 5044831 - DNA, 19 bp, Homo sapiens
agaggagagtggcctgggt

SEQ ID NO: 5044832 - DNA, 13 bp, Homo sapiens
agagggctgagcc

SEQ ID NO: 5044833 - DNA, 22 bp, Homo sapiens
agagggctgagccatgggggtt

SEQ ID NO: 5044834 - DNA, 22 bp, Homo sapiens
agagggggcactgtggtcaggc

SEQ ID NO: 5044835 - DNA, 22 bp, Homo sapiens
agaggtatgtgcccctcctggg

SEQ ID NO: 5044836 - DNA, 19 bp, Homo sapiens
agagtggcctgggtcccag

SEQ ID NO: 5044837 - DNA, 24 bp, Homo sapiens
agagtggcctgggtcccagggctg

SEQ ID NO: 5044838 - DNA, 16 bp, Homo sapiens
agatagacctgtgacc

SEQ ID NO: 5044839 - DNA, 22 bp, Homo sapiens
agatctccatgctttgctctca

SEQ ID NO: 5044840 - DNA, 15 bp, Homo sapiens
agatgttgtctgaac

SEQ ID NO: 5044841 - DNA, 19 bp, Homo sapiens
agcaacttcatcccagctg

SEQ ID NO: 5044842 - DNA, 23 bp, Homo sapiens
agcagcctttttcaccatggcaa

SEQ ID NO: 5044843 - DNA, 15 bp, Homo sapiens
agcaggagggaagga

SEQ ID NO: 5044844 - DNA, 20 bp, Homo sapiens
agcaggcaggggcttggctg

SEQ ID NO: 5044845 - DNA, 14 bp, Homo sapiens
agcagttggcctgt

SEQ ID NO: 5044846 - DNA, 20 bp, Homo sapiens
agccagccatcggaagagag

SEQ ID NO: 5044847 - DNA, 17 bp, Homo sapiens
agccatcggaagagagg

SEQ ID NO: 5044848 - DNA, 21 bp, Homo sapiens
agccatcggaagagagggctg

SEQ ID NO: 5044849 - DNA, 20 bp, Homo sapiens
agccatggcggcccctcagc

SEQ ID NO: 5044850 - DNA, 16 bp, Homo sapiens
agccatgggggtttgg

SEQ ID NO: 5044851 - DNA, 23 bp, Homo sapiens
agccccattcacggcctggcatg

SEQ ID NO: 5044852 - DNA, 22 bp, Homo sapiens
agccccgcggatcaaccaggca

SEQ ID NO: 5044853 - DNA, 23 bp, Homo sapiens
agccccgcggatcaaccaggcag

SEQ ID NO: 5044854 - DNA, 18 bp, Homo sapiens
agcccgggagctttgaga

SEQ ID NO: 5044855 - DNA, 11 bp, Homo sapiens
agccctgagcc

SEQ ID NO: 5044856 - DNA, 23 bp, Homo sapiens
agccggagcagttggcctgtgct

SEQ ID NO: 5044857 - DNA, 13 bp, Homo sapiens
agcctaagggaga

SEQ ID NO: 5044858 - DNA, 21 bp, Homo sapiens
agcctaagggagacaggcctt

SEQ ID NO: 5044859 - DNA, 14 bp, Homo sapiens
agcctctctggctc

SEQ ID NO: 5044860 - DNA, 14 bp, Homo sapiens
agcctgagcaggca

SEQ ID NO: 5044861 - DNA, 20 bp, Homo sapiens
agcctggggccttcctggct

SEQ ID NO: 5044862 - DNA, 19 bp, Homo sapiens
agcgacatttctccaagtg

SEQ ID NO: 5044863 - DNA, 17 bp, Homo sapiens
agctcctctccagacac

SEQ ID NO: 5044864 - DNA, 18 bp, Homo sapiens
agctctcccatggagccc

SEQ ID NO: 5044865 - DNA, 16 bp, Homo sapiens
agctggccggaaggag

SEQ ID NO: 5044866 - DNA, 17 bp, Homo sapiens
agctgtcggagggctgg

SEQ ID NO: 5044867 - DNA, 14 bp, Homo sapiens
agcttggccctgcg

SEQ ID NO: 5044868 - DNA, 17 bp, Homo sapiens
agcttggccctgcgccc

SEQ ID NO: 5044869 - DNA, 18 bp, Homo sapiens
agcttggccctgcgccct

SEQ ID NO: 5044870 - DNA, 21 bp, Homo sapiens
aggacacaagggtgcaagccc

SEQ ID NO: 5044871 - DNA, 22 bp, Homo sapiens
aggacagacatcaagtgccaga

SEQ ID NO: 5044872 - DNA, 18 bp, Homo sapiens
aggacctcttcagctgct

SEQ ID NO: 5044873 - DNA, 19 bp, Homo sapiens
aggacctcttcagctgctg

SEQ ID NO: 5044874 - DNA, 16 bp, Homo sapiens
aggagagtggcctggg

SEQ ID NO: 5044875 - DNA, 18 bp, Homo sapiens
aggatggggttcttgtcc

SEQ ID NO: 5044876 - DNA, 14 bp, Homo sapiens
aggatttttccatg

SEQ ID NO: 5044877 - DNA, 16 bp, Homo sapiens
aggcagagttctgtgg

SEQ ID NO: 5044878 - DNA, 14 bp, Homo sapiens
aggcaggggcttgg

SEQ ID NO: 5044879 - DNA, 16 bp, Homo sapiens
aggcaggggcttggct

SEQ ID NO: 5044880 - DNA, 17 bp, Homo sapiens
aggcaggtcgggctgcc

SEQ ID NO: 5044881 - DNA, 21 bp, Homo sapiens
aggccacctcagtctcacctg

SEQ ID NO: 5044882 - DNA, 20 bp, Homo sapiens
aggccagacacaggccgtgg

SEQ ID NO: 5044883 - DNA, 22 bp, Homo sapiens
aggcccagcctctctggctcag

SEQ ID NO: 5044884 - DNA, 17 bp, Homo sapiens
aggccctgcccagccag

SEQ ID NO: 5044885 - DNA, 16 bp, Homo sapiens
aggccgtgggacccag

SEQ ID NO: 5044886 - DNA, 19 bp, Homo sapiens
aggccgtgggacccaggct

SEQ ID NO: 5044887 - DNA, 16 bp, Homo sapiens
aggcctttccctgccg

SEQ ID NO: 5044888 - DNA, 17 bp, Homo sapiens
aggctcccagcctaagg

SEQ ID NO: 5044889 - DNA, 23 bp, Homo sapiens
aggctcccagcctaagggagaca

SEQ ID NO: 5044890 - DNA, 13 bp, Homo sapiens
agggagacaggcc

SEQ ID NO: 5044891 - DNA, 16 bp, Homo sapiens
agggctctctggacca

SEQ ID NO: 5044892 - DNA, 20 bp, Homo sapiens
agggctggccctaggcactg

SEQ ID NO: 5044893 - DNA, 17 bp, Homo sapiens
aggggcttggctgcccc

SEQ ID NO: 5044894 - DNA, 14 bp, Homo sapiens
agggggcactgtgg

SEQ ID NO: 5044895 - DNA, 23 bp, Homo sapiens
agggtgcaagccccattcacggc

SEQ ID NO: 5044896 - DNA, 19 bp, Homo sapiens
aggtatgtgcccctcctgg

SEQ ID NO: 5044897 - DNA, 21 bp, Homo sapiens
aggtatgtgcccctcctgggt

SEQ ID NO: 5044898 - DNA, 21 bp, Homo sapiens
aggtcccattttccccctgtg

SEQ ID NO: 5044899 - DNA, 16 bp, Homo sapiens
aggtcgggctgccagc

SEQ ID NO: 5044900 - DNA, 23 bp, Homo sapiens
aggtcgggctgccagcccagctg

SEQ ID NO: 5044901 - DNA, 19 bp, Homo sapiens
aggtgcctggggctggctg

SEQ ID NO: 5044902 - DNA, 20 bp, Homo sapiens
aggtgcctggggctggctgc

SEQ ID NO: 5044903 - DNA, 18 bp, Homo sapiens
agtaagaaatgggcctca

SEQ ID NO: 5044904 - DNA, 15 bp, Homo sapiens
cggcctggcatgcag

SEQ ID NO: 5044905 - DNA, 22 bp, Homo sapiens
cggcctggcatgcagcttgtcc

SEQ ID NO: 5044906 - DNA, 17 bp, Homo sapiens
cggcctggctggccagg

SEQ ID NO: 5044907 - DNA, 19 bp, Homo sapiens
cgggcgcatgcctcccagg

SEQ ID NO: 5044908 - DNA, 16 bp, Homo sapiens
cggggctcactctggc

SEQ ID NO: 5044909 - DNA, 17 bp, Homo sapiens
cggggctcactctggcc

SEQ ID NO: 5044910 - DNA, 15 bp, Homo sapiens
cggttgggaggcagg

SEQ ID NO: 5044911 - DNA, 16 bp, Homo sapiens
cggttgggaggcaggt

SEQ ID NO: 5044912 - DNA, 19 bp, Homo sapiens
cggtttaactgtcccagcg

SEQ ID NO: 5044913 - DNA, 18 bp, Homo sapiens
cgtggacagccggagcag

SEQ ID NO: 5044914 - DNA, 17 bp, Homo sapiens
cgtgggacccaggctcc

SEQ ID NO: 5044915 - DNA, 22 bp, Homo sapiens
ctaagaagttcaccagccctga

SEQ ID NO: 5044916 - DNA, 19 bp, Homo sapiens
ctaagggagacaggccttt

SEQ ID NO: 5044917 - DNA, 23 bp, Homo sapiens
ctaagggagacaggcctttccct

SEQ ID NO: 5044918 - DNA, 23 bp, Homo sapiens
ctacaaaaataaaaggcttccag

SEQ ID NO: 5044919 - DNA, 15 bp, Homo sapiens
ctagacccaaccctt

SEQ ID NO: 5044920 - DNA, 21 bp, Homo sapiens
ctagtccaatcacccccagga

SEQ ID NO: 5044921 - DNA, 22 bp, Homo sapiens
ctatttttgtagatctccatgc

SEQ ID NO: 5044922 - DNA, 17 bp, Homo sapiens
ctcacacacggaggcca

SEQ ID NO: 5044923 - DNA, 13 bp, Homo sapiens
ctcaccgcctgct

SEQ ID NO: 5044924 - DNA, 23 bp, Homo sapiens
ctcacctgccggctctgggctgg

SEQ ID NO: 5044925 - DNA, 18 bp, Homo sapiens
ctcagcccgggatcctga

SEQ ID NO: 5044926 - DNA, 16 bp, Homo sapiens
ctcagcctgcctgaag

SEQ ID NO: 5044927 - DNA, 21 bp, Homo sapiens
ctcagcctgcctgaagagagg

SEQ ID NO: 5044928 - DNA, 22 bp, Homo sapiens
ctccagctcctctccagacaca

SEQ ID NO: 5044929 - DNA, 18 bp, Homo sapiens
ctcccacttgacctgaga

SEQ ID NO: 5044930 - DNA, 21 bp, Homo sapiens
ctcctctccagacacagagac

SEQ ID NO: 5044931 - DNA, 12 bp, Homo sapiens
ctcctggaacct

SEQ ID NO: 5044932 - DNA, 17 bp, Homo sapiens
ctcctggaacctggcag

SEQ ID NO: 5044933 - DNA, 20 bp, Homo sapiens
ctcctggaacctggcaggcc

SEQ ID NO: 5044934 - DNA, 23 bp, Homo sapiens
ctcctggaacctggcaggccctg

SEQ ID NO: 5044935 - DNA, 22 bp, Homo sapiens
ctcgccgagctgtcggagggct

SEQ ID NO: 5044936 - DNA, 23 bp, Homo sapiens
ctcggcctggctggccaggacac

SEQ ID NO: 5044937 - DNA, 12 bp, Homo sapiens
ctctggctcagc

SEQ ID NO: 5044938 - DNA, 18 bp, Homo sapiens
ctctggctcagcccggga

SEQ ID NO: 5044939 - DNA, 15 bp, Homo sapiens
ctctgggctggctgc

SEQ ID NO: 5044940 - DNA, 22 bp, Homo sapiens
ctcttcagctgctgacaatcct

SEQ ID NO: 5044941 - DNA, 12 bp, Homo sapiens
ctctttggggca

SEQ ID NO: 5044942 - DNA, 16 bp, Homo sapiens
ctgaagggggcattgc

SEQ ID NO: 5044943 - DNA, 15 bp, Homo sapiens
ctgacagatctagtt

SEQ ID NO: 5044944 - DNA, 14 bp, Homo sapiens
ctgagatgctggga

SEQ ID NO: 5044945 - DNA, 19 bp, Homo sapiens
ctgagatgctgggagggct

SEQ ID NO: 5044946 - DNA, 14 bp, Homo sapiens
ctgagcaggcaggg

SEQ ID NO: 5044947 - DNA, 23 bp, Homo sapiens
ctgatggcacccacacagaggac

SEQ ID NO: 5044948 - DNA, 16 bp, Homo sapiens
ctgccagcccagctgg

SEQ ID NO: 5044949 - DNA, 18 bp, Homo sapiens
ctgccccattccagctct

SEQ ID NO: 5044950 - DNA, 23 bp, Homo sapiens
ctgccggctctgggctggctgct

SEQ ID NO: 5044951 - DNA, 23 bp, Homo sapiens
ctgcctgaagagaggaaactggc

SEQ ID NO: 5044952 - DNA, 12 bp, Homo sapiens
ctgcggctctgg

SEQ ID NO: 5044953 - DNA, 14 bp, Homo sapiens
ctgcggctctggaa

SEQ ID NO: 5044954 - DNA, 14 bp, Homo sapiens
ctgctacacaggca

SEQ ID NO: 5044955 - DNA, 18 bp, Homo sapiens
ctgctacacaggcaggaa

SEQ ID NO: 5044956 - DNA, 17 bp, Homo sapiens
ctggaacctggcaggcc

SEQ ID NO: 5044957 - DNA, 17 bp, Homo sapiens
ctggacatttgtggcag

SEQ ID NO: 5044958 - DNA, 19 bp, Homo sapiens
ctggaccatacgcggagga

SEQ ID NO: 5044959 - DNA, 15 bp, Homo sapiens
ctggcaggccctgcc

SEQ ID NO: 5044960 - DNA, 22 bp, Homo sapiens
ctggcaggccctgcccagccag

SEQ ID NO: 5044961 - DNA, 17 bp, Homo sapiens
ctggccggaaggagact

SEQ ID NO: 5044962 - DNA, 16 bp, Homo sapiens
ctggcgaagcctgagc

SEQ ID NO: 5044963 - DNA, 20 bp, Homo sapiens
ctggcgatctcccagggctc

SEQ ID NO: 5044964 - DNA, 15 bp, Homo sapiens
ctgggctggctgctc

SEQ ID NO: 5044965 - DNA, 17 bp, Homo sapiens
ctggggccttcctggct

SEQ ID NO: 5044966 - DNA, 12 bp, Homo sapiens
ctgggtcccagg

SEQ ID NO: 5044967 - DNA, 15 bp, Homo sapiens
ctggtcaggcaatgc

SEQ ID NO: 5044968 - DNA, 16 bp, Homo sapiens
ctggtctggtcaggca

SEQ ID NO: 5044969 - DNA, 15 bp, Homo sapiens
ctgtatatgttgtga

SEQ ID NO: 5044970 - DNA, 11 bp, Homo sapiens
ctgtcccagcg

SEQ ID NO: 5044971 - DNA, 17 bp, Homo sapiens
ctgtcggagggctggac

SEQ ID NO: 5044972 - DNA, 19 bp, Homo sapiens
ctgtctcttcttaaccctg

SEQ ID NO: 5044973 - DNA, 21 bp, Homo sapiens
ctgtggcgccgcgtggacagc

SEQ ID NO: 5044974 - DNA, 14 bp, Homo sapiens
ctgtggtcaggccc

SEQ ID NO: 5044975 - DNA, 15 bp, Homo sapiens
ctgtggtcaggccca

SEQ ID NO: 5044976 - DNA, 18 bp, Homo sapiens
ctgtggtcaggcccagcc

SEQ ID NO: 5044977 - DNA, 19 bp, Homo sapiens
ctgtggtcaggcccagcct

SEQ ID NO: 5044978 - DNA, 16 bp, Homo sapiens
ctgtgttccctttgag

SEQ ID NO: 5044979 - DNA, 17 bp, Homo sapiens
ctgtgttttcacgcagg

SEQ ID NO: 5044980 - DNA, 13 bp, Homo sapiens
cttaaccctgaac

SEQ ID NO: 5044981 - DNA, 23 bp, Homo sapiens
cttaaccctgaacaagagtgtct

SEQ ID NO: 5044982 - DNA, 19 bp, Homo sapiens
cttagaggggaatgaacca

SEQ ID NO: 5044983 - DNA, 19 bp, Homo sapiens
cttagcttttagcctggct

SEQ ID NO: 5044984 - DNA, 16 bp, Homo sapiens
cttcagctgctgacaa

SEQ ID NO: 5044985 - DNA, 20 bp, Homo sapiens
cttcagctgctgacaatcct

SEQ ID NO: 5044986 - DNA, 15 bp, Homo sapiens
cttcatcccagctgc

SEQ ID NO: 5044987 - DNA, 17 bp, Homo sapiens
cttcatcccagctgctg

SEQ ID NO: 5044988 - DNA, 13 bp, Homo sapiens
cttccagaggaga

SEQ ID NO: 5044989 - DNA, 14 bp, Homo sapiens
cttccagaggagag

SEQ ID NO: 5044990 - DNA, 22 bp, Homo sapiens
cttccagaggagagtggcctgg

SEQ ID NO: 5044991 - DNA, 11 bp, Homo sapiens
cttcctggctt

SEQ ID NO: 5044992 - DNA, 13 bp, Homo sapiens
cttcctggctttg

SEQ ID NO: 5044993 - DNA, 18 bp, Homo sapiens
cttgctcctggaacctgg

SEQ ID NO: 5044994 - DNA, 13 bp, Homo sapiens
cttggaggcctca

SEQ ID NO: 5044995 - DNA, 16 bp, Homo sapiens
cttggccctgcgccct

SEQ ID NO: 5044996 - DNA, 23 bp, Homo sapiens
cttggccctgcgccctgtgcagg

SEQ ID NO: 5044997 - DNA, 20 bp, Homo sapiens
cttggctgccccattccagc

SEQ ID NO: 5044998 - DNA, 23 bp, Homo sapiens
cttggctgccccattccagctct

SEQ ID NO: 5044999 - DNA, 23 bp, Homo sapiens
cttgtccttgctcctggaacctg

SEQ ID NO: 5045000 - DNA, 16 bp, Homo sapiens
ctttgagacaggtgcc

SEQ ID NO: 5045001 - DNA, 15 bp, Homo sapiens
ctttgagtccagtgt

SEQ ID NO: 5045002 - DNA, 20 bp, Homo sapiens
ctttgctctcaaggcttgga

SEQ ID NO: 5045003 - DNA, 15 bp, Homo sapiens
cttttagcctggctg

SEQ ID NO: 5045004 - DNA, 13 bp, Homo sapiens
gaaaagcagcctt

SEQ ID NO: 5045005 - DNA, 22 bp, Homo sapiens
gaaagcaacttcatcccagctg

SEQ ID NO: 5045006 - DNA, 12 bp, Homo sapiens
gaacctggcagg

SEQ ID NO: 5045007 - DNA, 23 bp, Homo sapiens
gaactgcacaatgaccagcagga

SEQ ID NO: 5045008 - DNA, 13 bp, Homo sapiens
ggacatgggcagc

SEQ ID NO: 5045009 - DNA, 17 bp, Homo sapiens
ggacatttgtggcagtg

SEQ ID NO: 5045010 - DNA, 19 bp, Homo sapiens
ggaccatacgcggaggagt

SEQ ID NO: 5045011 - DNA, 12 bp, Homo sapiens
ggacccaggctc

SEQ ID NO: 5045012 - DNA, 13 bp, Homo sapiens
ggacccaggctcc

SEQ ID NO: 5045013 - DNA, 18 bp, Homo sapiens
ggacccaggctcccagcc

SEQ ID NO: 5045014 - DNA, 17 bp, Homo sapiens
ggacctcttcagctgct

SEQ ID NO: 5045015 - DNA, 19 bp, Homo sapiens
ggacctcttcagctgctga

SEQ ID NO: 5045016 - DNA, 19 bp, Homo sapiens
ggagcagccggaagtctgt

SEQ ID NO: 5045017 - DNA, 16 bp, Homo sapiens
ggagcagttggcctgt

SEQ ID NO: 5045018 - DNA, 15 bp, Homo sapiens
ggagcggagcttggc

SEQ ID NO: 5045019 - DNA, 16 bp, Homo sapiens
ggagcggagcttggcc

SEQ ID NO: 5045020 - DNA, 13 bp, Homo sapiens
ggagcttggccct

SEQ ID NO: 5045021 - DNA, 14 bp, Homo sapiens
ggagcttggccctg

SEQ ID NO: 5045022 - DNA, 22 bp, Homo sapiens
ggagctttgagacaggtgcctg

SEQ ID NO: 5045023 - DNA, 18 bp, Homo sapiens
ggaggagttttctgtgtg

SEQ ID NO: 5045024 - DNA, 12 bp, Homo sapiens
ggaggccagaca

SEQ ID NO: 5045025 - DNA, 21 bp, Homo sapiens
ggaggccagacacaggccgtg

SEQ ID NO: 5045026 - DNA, 22 bp, Homo sapiens
ggaggccagacacaggccgtgg

SEQ ID NO: 5045027 - DNA, 12 bp, Homo sapiens
ggagtggggagc

SEQ ID NO: 5045028 - DNA, 15 bp, Homo sapiens
ggatcaaccaggcag

SEQ ID NO: 5045029 - DNA, 11 bp, Homo sapiens
ggatggtcagg

SEQ ID NO: 5045030 - DNA, 18 bp, Homo sapiens
ggcaatgccctgcggctc

SEQ ID NO: 5045031 - DNA, 20 bp, Homo sapiens
ggcaatgccctgcggctctg

SEQ ID NO: 5045032 - DNA, 15 bp, Homo sapiens
ggcactgtggtcagg

SEQ ID NO: 5045033 - DNA, 17 bp, Homo sapiens
ggcactgtggtcaggcc

SEQ ID NO: 5045034 - DNA, 20 bp, Homo sapiens
ggcactgtggtcaggcccag

SEQ ID NO: 5045035 - DNA, 21 bp, Homo sapiens
ggcaggccctgcccagccagc

SEQ ID NO: 5045036 - DNA, 16 bp, Homo sapiens
ggcaggggcttggctg

SEQ ID NO: 5045037 - DNA, 22 bp, Homo sapiens
ggcaggtcgggctgccagccca

SEQ ID NO: 5045038 - DNA, 15 bp, Homo sapiens
ggcagtgctgaaggg

SEQ ID NO: 5045039 - DNA, 20 bp, Homo sapiens
ggcccagcctctctggctca

SEQ ID NO: 5045040 - DNA, 23 bp, Homo sapiens
ggcccagcctctctggctcagcc

SEQ ID NO: 5045041 - DNA, 19 bp, Homo sapiens
ggcccagttctcgtgccct

SEQ ID NO: 5045042 - DNA, 19 bp, Homo sapiens
ggcccctcagcctgcctga

SEQ ID NO: 5045043 - DNA, 19 bp, Homo sapiens
ggccctgcccagccagcca

SEQ ID NO: 5045044 - DNA, 18 bp, Homo sapiens
ggccctgcgccctgtgca

SEQ ID NO: 5045045 - DNA, 16 bp, Homo sapiens
ggccggaaggagactg

SEQ ID NO: 5045046 - DNA, 16 bp, Homo sapiens
ggccgtgggacccagg

SEQ ID NO: 5045047 - DNA, 19 bp, Homo sapiens
ggccgtgggacccaggctc

SEQ ID NO: 5045048 - DNA, 21 bp, Homo sapiens
ggcctcagatagacctgtgac

SEQ ID NO: 5045049 - DNA, 14 bp, Homo sapiens
ggcctggctggcca

SEQ ID NO: 5045050 - DNA, 17 bp, Homo sapiens
ggcctggctggccagga

SEQ ID NO: 5045051 - DNA, 18 bp, Homo sapiens
ggcctgggtcccagggct

SEQ ID NO: 5045052 - DNA, 19 bp, Homo sapiens
ggcctgggtcccagggctg

SEQ ID NO: 5045053 - DNA, 24 bp, Homo sapiens
ggcctgggtcccagggctggccct

SEQ ID NO: 5045054 - DNA, 20 bp, Homo sapiens
ggcctgtgcttggaggcctc

SEQ ID NO: 5045055 - DNA, 22 bp, Homo sapiens
ggcctgtgcttggaggcctcag

SEQ ID NO: 5045056 - DNA, 14 bp, Homo sapiens
ggccttcctggctt

SEQ ID NO: 5045057 - DNA, 16 bp, Homo sapiens
ggccttcctggctttg

SEQ ID NO: 5045058 - DNA, 13 bp, Homo sapiens
ggcctttccctgc

SEQ ID NO: 5045059 - DNA, 14 bp, Homo sapiens
ggcctttccctgcc

SEQ ID NO: 5045060 - DNA, 14 bp, Homo sapiens
ggcgaagcctgagc

SEQ ID NO: 5045061 - DNA, 21 bp, Homo sapiens
ggcgaagcctgagcaggcagg

SEQ ID NO: 5045062 - DNA, 22 bp, Homo sapiens
ggcgaagcctgagcaggcaggg

SEQ ID NO: 5045063 - DNA, 15 bp, Homo sapiens
ggcgatctcccaggg

SEQ ID NO: 5045064 - DNA, 16 bp, Homo sapiens
ggcgatctcccagggc

SEQ ID NO: 5045065 - DNA, 18 bp, Homo sapiens
ggcgcatgcctcccaggc

SEQ ID NO: 5045066 - DNA, 20 bp, Homo sapiens
ggcgcatgcctcccaggcca

SEQ ID NO: 5045067 - DNA, 18 bp, Homo sapiens
ggcggcccctcagcctgc

SEQ ID NO: 5045068 - DNA, 21 bp, Homo sapiens
ggcggcccctcagcctgcctg

SEQ ID NO: 5045069 - DNA, 22 bp, Homo sapiens
ggcggcccctcagcctgcctga

SEQ ID NO: 5045070 - DNA, 22 bp, Homo sapiens
ggctaagaagttcaccagccct

SEQ ID NO: 5045071 - DNA, 13 bp, Homo sapiens
ggctcactctggc

SEQ ID NO: 5045072 - DNA, 16 bp, Homo sapiens
ggctcactctggcccc

SEQ ID NO: 5045073 - DNA, 15 bp, Homo sapiens
ggctcccacaggtct

SEQ ID NO: 5045074 - DNA, 13 bp, Homo sapiens
ggctctctggacc

SEQ ID NO: 5045075 - DNA, 17 bp, Homo sapiens
ggctctggaaagcaact

SEQ ID NO: 5045076 - DNA, 12 bp, Homo sapiens
ggctctgggctg

SEQ ID NO: 5045077 - DNA, 22 bp, Homo sapiens
ggctctgggctggctgctccta

SEQ ID NO: 5045078 - DNA, 15 bp, Homo sapiens
ggctgccagcccagc

SEQ ID NO: 5045079 - DNA, 19 bp, Homo sapiens
ggctggacatttgtggcag

SEQ ID NO: 5045080 - DNA, 15 bp, Homo sapiens
ggctggccaggacac

SEQ ID NO: 5045081 - DNA, 16 bp, Homo sapiens
ggctggccaggacaca

SEQ ID NO: 5045082 - DNA, 19 bp, Homo sapiens
ggctggccaggacacactg

SEQ ID NO: 5045083 - DNA, 20 bp, Homo sapiens
ggctggccaggacacactga

SEQ ID NO: 5045084 - DNA, 18 bp, Homo sapiens
ggctggccctaggcactg

SEQ ID NO: 5045085 - DNA, 14 bp, Homo sapiens
ggctggctgctcct

SEQ ID NO: 5045086 - DNA, 20 bp, Homo sapiens
ggctggctgctcctaaccta

SEQ ID NO: 5045087 - DNA, 15 bp, Homo sapiens
ggcttccagaggaga

SEQ ID NO: 5045088 - DNA, 14 bp, Homo sapiens
gggacccaggctcc

SEQ ID NO: 5045089 - DNA, 16 bp, Homo sapiens
gggacccaggctccca

SEQ ID NO: 5045090 - DNA, 18 bp, Homo sapiens
gggacccaggctcccagc

SEQ ID NO: 5045091 - DNA, 20 bp, Homo sapiens
gggagcggagcttggccctg

SEQ ID NO: 5045092 - DNA, 21 bp, Homo sapiens
gggagcggagcttggccctgc

SEQ ID NO: 5045093 - DNA, 17 bp, Homo sapiens
gggagctttgagacagg

SEQ ID NO: 5045094 - DNA, 22 bp, Homo sapiens
gggaggcaggtcgggctgccag

SEQ ID NO: 5045095 - DNA, 13 bp, Homo sapiens
gggcctcagcccc

SEQ ID NO: 5045096 - DNA, 17 bp, Homo sapiens
gggcgcatgcctcccag

SEQ ID NO: 5045097 - DNA, 22 bp, Homo sapiens
gggcgcatgcctcccaggccac

SEQ ID NO: 5045098 - DNA, 14 bp, Homo sapiens
gggctcactctggc

SEQ ID NO: 5045099 - DNA, 16 bp, Homo sapiens
gggctcactctggccc

SEQ ID NO: 5045100 - DNA, 15 bp, Homo sapiens
gggctctctggacca

SEQ ID NO: 5045101 - DNA, 11 bp, Homo sapiens
gggctggccct

SEQ ID NO: 5045102 - DNA, 20 bp, Homo sapiens
gggctggccctaggcactga

SEQ ID NO: 5045103 - DNA, 16 bp, Homo sapiens
gggctggctgctccta

SEQ ID NO: 5045104 - DNA, 22 bp, Homo sapiens
gggcttggctgccccattccag

SEQ ID NO: 5045105 - DNA, 21 bp, Homo sapiens
ggggcactgtggtcaggccca

SEQ ID NO: 5045106 - DNA, 13 bp, Homo sapiens
ggggctggctgca

SEQ ID NO: 5045107 - DNA, 20 bp, Homo sapiens
gggggcactgtggtcaggcc

SEQ ID NO: 5045108 - DNA, 24 bp, Homo sapiens
gggtcaactggcgaagcctgagca

SEQ ID NO: 5045109 - DNA, 21 bp, Homo sapiens
gggtcccagggctggccctag

SEQ ID NO: 5045110 - DNA, 18 bp, Homo sapiens
gggtgctcaccgcctgct

SEQ ID NO: 5045111 - DNA, 21 bp, Homo sapiens
ggtatgtgcccctcctgggtg

SEQ ID NO: 5045112 - DNA, 17 bp, Homo sapiens
ccaacccatgcccctga

SEQ ID NO: 5045113 - DNA, 23 bp, Homo sapiens
ccaacccttagcttttagcctgg

SEQ ID NO: 5045114 - DNA, 18 bp, Homo sapiens
ccaatcacccccaggacc

SEQ ID NO: 5045115 - DNA, 13 bp, Homo sapiens
ccagaactgcaca

SEQ ID NO: 5045116 - DNA, 22 bp, Homo sapiens
ccagcaggagggaaggacagac

SEQ ID NO: 5045117 - DNA, 19 bp, Homo sapiens
ccagccatcggaagagagg

SEQ ID NO: 5045118 - DNA, 13 bp, Homo sapiens
ccagccctgagcc

SEQ ID NO: 5045119 - DNA, 15 bp, Homo sapiens
ccagcctctctggct

SEQ ID NO: 5045120 - DNA, 17 bp, Homo sapiens
ccagcctctctggctca

SEQ ID NO: 5045121 - DNA, 16 bp, Homo sapiens
ccagctgctgaggcga

SEQ ID NO: 5045122 - DNA, 13 bp, Homo sapiens
ccagctggccgga

SEQ ID NO: 5045123 - DNA, 14 bp, Homo sapiens
ccaggacacactga

SEQ ID NO: 5045124 - DNA, 15 bp, Homo sapiens
ccaggcagagttctg

SEQ ID NO: 5045125 - DNA, 16 bp, Homo sapiens
ccagggctctctggac

SEQ ID NO: 5045126 - DNA, 18 bp, Homo sapiens
ccagggctctctggacca

SEQ ID NO: 5045127 - DNA, 14 bp, Homo sapiens
ccagggctggccct

SEQ ID NO: 5045128 - DNA, 17 bp, Homo sapiens
ccagggctggccctagg

SEQ ID NO: 5045129 - DNA, 18 bp, Homo sapiens
ccagttctcgtgccctta

SEQ ID NO: 5045130 - DNA, 15 bp, Homo sapiens
ccatacgcggaggag

SEQ ID NO: 5045131 - DNA, 14 bp, Homo sapiens
ccatcggaagagag

SEQ ID NO: 5045132 - DNA, 15 bp, Homo sapiens
ccatcggaagagagg

SEQ ID NO: 5045133 - DNA, 17 bp, Homo sapiens
ccatcggaagagagggc

SEQ ID NO: 5045134 - DNA, 15 bp, Homo sapiens
ccatgcccctgacag

SEQ ID NO: 5045135 - DNA, 19 bp, Homo sapiens
ccatgctttgctctcaagg

SEQ ID NO: 5045136 - DNA, 18 bp, Homo sapiens
ccatggacatgggcagca

SEQ ID NO: 5045137 - DNA, 13 bp, Homo sapiens
ccatggagcccct

SEQ ID NO: 5045138 - DNA, 18 bp, Homo sapiens
ccatggcggcccctcagc

SEQ ID NO: 5045139 - DNA, 22 bp, Homo sapiens
ccatggcggcccctcagcctgc

SEQ ID NO: 5045140 - DNA, 16 bp, Homo sapiens
ccattttccccctgtg

SEQ ID NO: 5045141 - DNA, 21 bp, Homo sapiens
cccagccagccatcggaagag

SEQ ID NO: 5045142 - DNA, 22 bp, Homo sapiens
cccagccagccatcggaagaga

SEQ ID NO: 5045143 - DNA, 20 bp, Homo sapiens
cccagcctctctggctcagc

SEQ ID NO: 5045144 - DNA, 20 bp, Homo sapiens
cccagcgacatttctccaag

SEQ ID NO: 5045145 - DNA, 11 bp, Homo sapiens
cccaggacctc

SEQ ID NO: 5045146 - DNA, 10 bp, Homo sapiens
cccaggctcc

SEQ ID NO: 5045147 - DNA, 13 bp, Homo sapiens
cccagggctctct

SEQ ID NO: 5045148 - DNA, 14 bp, Homo sapiens
cccagggctctctg

SEQ ID NO: 5045149 - DNA, 22 bp, Homo sapiens
cccattccagctctcccatgga

SEQ ID NO: 5045150 - DNA, 24 bp, Homo sapiens
ccccaggacctcttcagctgctga

SEQ ID NO: 5045151 - DNA, 15 bp, Homo sapiens
ccccattcacggcct

SEQ ID NO: 5045152 - DNA, 17 bp, Homo sapiens
ccccattcacggcctgg

SEQ ID NO: 5045153 - DNA, 19 bp, Homo sapiens
ccccattcacggcctggca

SEQ ID NO: 5045154 - DNA, 19 bp, Homo sapiens
ccccgcggatcaaccaggc

SEQ ID NO: 5045155 - DNA, 21 bp, Homo sapiens
ccccgcggatcaaccaggcag

SEQ ID NO: 5045156 - DNA, 16 bp, Homo sapiens
ccctattgtctccaag

SEQ ID NO: 5045157 - DNA, 12 bp, Homo sapiens
ccctcagcctgc

SEQ ID NO: 5045158 - DNA, 14 bp, Homo sapiens
ccctgagccatggc

SEQ ID NO: 5045159 - DNA, 17 bp, Homo sapiens
ccctgagccatggcggc

SEQ ID NO: 5045160 - DNA, 16 bp, Homo sapiens
ccctgcgccctgtgca

SEQ ID NO: 5045161 - DNA, 18 bp, Homo sapiens
ccctgcggctctggaaag

SEQ ID NO: 5045162 - DNA, 14 bp, Homo sapiens
cccttagaggggaa

SEQ ID NO: 5045163 - DNA, 20 bp, Homo sapiens
cccttagcttttagcctggc

SEQ ID NO: 5045164 - DNA, 14 bp, Homo sapiens
cccttggtggcaac

SEQ ID NO: 5045165 - DNA, 18 bp, Homo sapiens
ccgagctgtcggagggct

SEQ ID NO: 5045166 - DNA, 23 bp, Homo sapiens
ccgagctgtcggagggctggaca

SEQ ID NO: 5045167 - DNA, 19 bp, Homo sapiens
ccgcctgctacacaggcag

SEQ ID NO: 5045168 - DNA, 18 bp, Homo sapiens
ccgcggatcaaccaggca

SEQ ID NO: 5045169 - DNA, 21 bp, Homo sapiens
ccgcggatcaaccaggcagag

SEQ ID NO: 5045170 - DNA, 19 bp, Homo sapiens
ccggagcagttggcctgtg

SEQ ID NO: 5045171 - DNA, 21 bp, Homo sapiens
ccggagcagttggcctgtgct

SEQ ID NO: 5045172 - DNA, 13 bp, Homo sapiens
ccgggcgcatgcc

SEQ ID NO: 5045173 - DNA, 14 bp, Homo sapiens
ccgggcgcatgcct

SEQ ID NO: 5045174 - DNA, 20 bp, Homo sapiens
ccgggcgcatgcctcccagg

SEQ ID NO: 5045175 - DNA, 21 bp, Homo sapiens
ccgggcgcatgcctcccaggc

SEQ ID NO: 5045176 - DNA, 22 bp, Homo sapiens
ccgggcgcatgcctcccaggcc

SEQ ID NO: 5045177 - DNA, 17 bp, Homo sapiens
cctcacacacggaggcc

SEQ ID NO: 5045178 - DNA, 21 bp, Homo sapiens
cctcacacacggaggccagac

SEQ ID NO: 5045179 - DNA, 22 bp, Homo sapiens
cctcacacacggaggccagaca

SEQ ID NO: 5045180 - DNA, 23 bp, Homo sapiens
cctcacacacggaggccagacac

SEQ ID NO: 5045181 - DNA, 17 bp, Homo sapiens
cctcagatagacctgtg

SEQ ID NO: 5045182 - DNA, 21 bp, Homo sapiens
cctcagtctcacctgccggct

SEQ ID NO: 5045183 - DNA, 12 bp, Homo sapiens
cctcccaggcca

SEQ ID NO: 5045184 - DNA, 13 bp, Homo sapiens
cctctctggctca

SEQ ID NO: 5045185 - DNA, 19 bp, Homo sapiens
cctcttcagctgctgacaa

SEQ ID NO: 5045186 - DNA, 21 bp, Homo sapiens
cctgacagatctagttctctt

SEQ ID NO: 5045187 - DNA, 16 bp, Homo sapiens
cctgagatgctgggag

SEQ ID NO: 5045188 - DNA, 20 bp, Homo sapiens
cctgagatgctgggagggct

SEQ ID NO: 5045189 - DNA, 12 bp, Homo sapiens
cctgagcaggca

SEQ ID NO: 5045190 - DNA, 15 bp, Homo sapiens
cctgagcaggcaggg

SEQ ID NO: 5045191 - DNA, 20 bp, Homo sapiens
cctgagcaggcaggggcttg

SEQ ID NO: 5045192 - DNA, 22 bp, Homo sapiens
cctgagcaggcaggggcttggc

SEQ ID NO: 5045193 - DNA, 13 bp, Homo sapiens
cctgagccatggc

SEQ ID NO: 5045194 - DNA, 17 bp, Homo sapiens
cctgagccatggcggcc

SEQ ID NO: 5045195 - DNA, 16 bp, Homo sapiens
cctgcccagccagcca

SEQ ID NO: 5045196 - DNA, 14 bp, Homo sapiens
cctgccggctctgg

SEQ ID NO: 5045197 - DNA, 14 bp, Homo sapiens
cctgcctgaagaga

SEQ ID NO: 5045198 - DNA, 14 bp, Homo sapiens
cctgcgccctgtgc

SEQ ID NO: 5045199 - DNA, 17 bp, Homo sapiens
cctgcgccctgtgcagg

SEQ ID NO: 5045200 - DNA, 12 bp, Homo sapiens
cctgcggctctg

SEQ ID NO: 5045201 - DNA, 15 bp, Homo sapiens
cctgcggctctggaa

SEQ ID NO: 5045202 - DNA, 18 bp, Homo sapiens
cctgctacacaggcagga

SEQ ID NO: 5045203 - DNA, 14 bp, Homo sapiens
cctggaacctggca

SEQ ID NO: 5045204 - DNA, 15 bp, Homo sapiens
cctggaacctggcag

SEQ ID NO: 5045205 - DNA, 16 bp, Homo sapiens
cctggaacctggcagg

SEQ ID NO: 5045206 - DNA, 21 bp, Homo sapiens
cctggaacctggcaggccctg

SEQ ID NO: 5045207 - DNA, 15 bp, Homo sapiens
cctggcaggccctgc

SEQ ID NO: 5045208 - DNA, 16 bp, Homo sapiens
cctggcaggccctgcc

SEQ ID NO: 5045209 - DNA, 19 bp, Homo sapiens
cctggcaggccctgcccag

SEQ ID NO: 5045210 - DNA, 14 bp, Homo sapiens
cctggctggccagg

SEQ ID NO: 5045211 - DNA, 15 bp, Homo sapiens
cctggctggccagga

SEQ ID NO: 5045212 - DNA, 22 bp, Homo sapiens
cctgggtcccagggctggccct

SEQ ID NO: 5045213 - DNA, 12 bp, Homo sapiens
ctgaagagagga

SEQ ID NO: 5045214 - DNA, 15 bp, Homo sapiens
ctgaagagaggaaac

SEQ ID NO: 5045215 - DNA, 16 bp, Homo sapiens
ctgagatgctgggagg

SEQ ID NO: 5045216 - DNA, 16 bp, Homo sapiens
ctgagcaggcaggggc

SEQ ID NO: 5045217 - DNA, 23 bp, Homo sapiens
ctgccagcccagctggccggaag

SEQ ID NO: 5045218 - DNA, 13 bp, Homo sapiens
ctgcccagccagc

SEQ ID NO: 5045219 - DNA, 18 bp, Homo sapiens
ctgccggccccccaagga

SEQ ID NO: 5045220 - DNA, 15 bp, Homo sapiens
ctgccggctctgggc

SEQ ID NO: 5045221 - DNA, 17 bp, Homo sapiens
ctgccggctctgggctg

SEQ ID NO: 5045222 - DNA, 19 bp, Homo sapiens
ctgccggctctgggctggc

SEQ ID NO: 5045223 - DNA, 15 bp, Homo sapiens
ctgcctgaagagagg

SEQ ID NO: 5045224 - DNA, 13 bp, Homo sapiens
ctgcggctctgga

SEQ ID NO: 5045225 - DNA, 16 bp, Homo sapiens
ctgcggctctggaaag

SEQ ID NO: 5045226 - DNA, 13 bp, Homo sapiens
ctggaacctggca

SEQ ID NO: 5045227 - DNA, 16 bp, Homo sapiens
ctggaacctggcaggc

SEQ ID NO: 5045228 - DNA, 18 bp, Homo sapiens
ctggaacctggcaggccc

SEQ ID NO: 5045229 - DNA, 21 bp, Homo sapiens
ctggcaggccctgcccagcca

SEQ ID NO: 5045230 - DNA, 23 bp, Homo sapiens
ctggcaggccctgcccagccagc

SEQ ID NO: 5045231 - DNA, 22 bp, Homo sapiens
ctggccaggacacactgaaaag

SEQ ID NO: 5045232 - DNA, 23 bp, Homo sapiens
ctggccccctattgtctccaagg

SEQ ID NO: 5045233 - DNA, 13 bp, Homo sapiens
ctggccctaggca

SEQ ID NO: 5045234 - DNA, 15 bp, Homo sapiens
ctggccggaaggaga

SEQ ID NO: 5045235 - DNA, 18 bp, Homo sapiens
ctggccggaaggagactg

SEQ ID NO: 5045236 - DNA, 17 bp, Homo sapiens
ctggcgaagcctgagca

SEQ ID NO: 5045237 - DNA, 21 bp, Homo sapiens
ctggcgaagcctgagcaggca

SEQ ID NO: 5045238 - DNA, 21 bp, Homo sapiens
ctggcgatctcccagggctct

SEQ ID NO: 5045239 - DNA, 16 bp, Homo sapiens
ctggctcagcccggga

SEQ ID NO: 5045240 - DNA, 21 bp, Homo sapiens
ctggctcagcccgggatcctg

SEQ ID NO: 5045241 - DNA, 13 bp, Homo sapiens
ctggctgctccta

SEQ ID NO: 5045242 - DNA, 13 bp, Homo sapiens
ctggctggccagg

SEQ ID NO: 5045243 - DNA, 15 bp, Homo sapiens
ctggctggccaggac

SEQ ID NO: 5045244 - DNA, 15 bp, Homo sapiens
ctgggagggctgaac

SEQ ID NO: 5045245 - DNA, 12 bp, Homo sapiens
ctgggctggctg

SEQ ID NO: 5045246 - DNA, 14 bp, Homo sapiens
ctggggctggctgc

SEQ ID NO: 5045247 - DNA, 13 bp, Homo sapiens
ctgggtcccaggg

SEQ ID NO: 5045248 - DNA, 15 bp, Homo sapiens
ctgggtcccagggct

SEQ ID NO: 5045249 - DNA, 18 bp, Homo sapiens
ctgggtcccagggctggc

SEQ ID NO: 5045250 - DNA, 20 bp, Homo sapiens
ctgggtcccagggctggccc

SEQ ID NO: 5045251 - DNA, 22 bp, Homo sapiens
ctgggtcccagggctggcccta

SEQ ID NO: 5045252 - DNA, 12 bp, Homo sapiens
ctggtcaggcaa

SEQ ID NO: 5045253 - DNA, 19 bp, Homo sapiens
ctggtcaggcaatgccctg

SEQ ID NO: 5045254 - DNA, 20 bp, Homo sapiens
ctggtcaggcaatgccctgc

SEQ ID NO: 5045255 - DNA, 23 bp, Homo sapiens
ctggtcaggcaatgccctgcggc

SEQ ID NO: 5045256 - DNA, 14 bp, Homo sapiens
ctgtcaccctgagg

SEQ ID NO: 5045257 - DNA, 14 bp, Homo sapiens
ctgtcggagggctg

SEQ ID NO: 5045258 - DNA, 15 bp, Homo sapiens
ctgtcggagggctgg

SEQ ID NO: 5045259 - DNA, 14 bp, Homo sapiens
ctgtgacctggtct

SEQ ID NO: 5045260 - DNA, 16 bp, Homo sapiens
ctgtgacctggtctgg

SEQ ID NO: 5045261 - DNA, 23 bp, Homo sapiens
ctgtgacctggtctggtcaggca

SEQ ID NO: 5045262 - DNA, 12 bp, Homo sapiens
ctgtgcttggag

SEQ ID NO: 5045263 - DNA, 18 bp, Homo sapiens
ctgtgcttggaggcctca

SEQ ID NO: 5045264 - DNA, 13 bp, Homo sapiens
ctgtggtcaggcc

SEQ ID NO: 5045265 - DNA, 16 bp, Homo sapiens
ctgtgtggtctccagc

SEQ ID NO: 5045266 - DNA, 17 bp, Homo sapiens
ctgtgtggtctccagct

SEQ ID NO: 5045267 - DNA, 18 bp, Homo sapiens
ctgtgtggtctccagctc

SEQ ID NO: 5045268 - DNA, 19 bp, Homo sapiens
ctgtgtggtctccagctcc

SEQ ID NO: 5045269 - DNA, 21 bp, Homo sapiens
cttagcttttagcctggctgt

SEQ ID NO: 5045270 - DNA, 12 bp, Homo sapiens
cttcagctgctg

SEQ ID NO: 5045271 - DNA, 13 bp, Homo sapiens
cttcatcccagct

SEQ ID NO: 5045272 - DNA, 19 bp, Homo sapiens
cttcatcccagctgctgag

SEQ ID NO: 5045273 - DNA, 20 bp, Homo sapiens
cttctcaccaaacttcatgt

SEQ ID NO: 5045274 - DNA, 11 bp, Homo sapiens
cttctcctgtg

SEQ ID NO: 5045275 - DNA, 23 bp, Homo sapiens
cttcttgtcaccccagttccctt

SEQ ID NO: 5045276 - DNA, 14 bp, Homo sapiens
cttgacctgagatg

SEQ ID NO: 5045277 - DNA, 19 bp, Homo sapiens
cttgagcaaagaactaagg

SEQ ID NO: 5045278 - DNA, 14 bp, Homo sapiens
cttgctcctggaac

SEQ ID NO: 5045279 - DNA, 22 bp, Homo sapiens
cttgctcctggaacctggcagg

SEQ ID NO: 5045280 - DNA, 23 bp, Homo sapiens
cttgctcctggaacctggcaggc

SEQ ID NO: 5045281 - DNA, 14 bp, Homo sapiens
cttggaggcctcag

SEQ ID NO: 5045282 - DNA, 19 bp, Homo sapiens
cttggccctgcgccctgtg

SEQ ID NO: 5045283 - DNA, 11 bp, Homo sapiens
cttggtggcaa

SEQ ID NO: 5045284 - DNA, 19 bp, Homo sapiens
cttgtccttgctcctggaa

SEQ ID NO: 5045285 - DNA, 19 bp, Homo sapiens
ctttgagacaggtgcctgg

SEQ ID NO: 5045286 - DNA, 22 bp, Homo sapiens
ctttgagacaggtgcctggggc

SEQ ID NO: 5045287 - DNA, 13 bp, Homo sapiens
ctttgagagaggg

SEQ ID NO: 5045288 - DNA, 21 bp, Homo sapiens
ctttgagagagggggcactgt

SEQ ID NO: 5045289 - DNA, 23 bp, Homo sapiens
cttttaacatagagaactgtcac

SEQ ID NO: 5045290 - DNA, 14 bp, Homo sapiens
cttttagcctggct

SEQ ID NO: 5045291 - DNA, 18 bp, Homo sapiens
cttttagcctggctgtca

SEQ ID NO: 5045292 - DNA, 21 bp, Homo sapiens
gaaactggcgatctcccaggg

SEQ ID NO: 5045293 - DNA, 20 bp, Homo sapiens
gaaagcaacttcatcccagc

SEQ ID NO: 5045294 - DNA, 21 bp, Homo sapiens
gaaagcaacttcatcccagct

SEQ ID NO: 5045295 - DNA, 16 bp, Homo sapiens
gaaagggatggtcagg

SEQ ID NO: 5045296 - DNA, 22 bp, Homo sapiens
gaaagggatggtcaggcccagt

SEQ ID NO: 5045297 - DNA, 13 bp, Homo sapiens
gaaatgggcctca

SEQ ID NO: 5045298 - DNA, 15 bp, Homo sapiens
gaaatgggcctcagc

SEQ ID NO: 5045299 - DNA, 20 bp, Homo sapiens
gaacaagagtgtctatggag

SEQ ID NO: 5045300 - DNA, 12 bp, Homo sapiens
gaacccccactc

SEQ ID NO: 5045301 - DNA, 15 bp, Homo sapiens
gaacccccactcaca

SEQ ID NO: 5045302 - DNA, 18 bp, Homo sapiens
gaacctggcaggccctgc

SEQ ID NO: 5045303 - DNA, 19 bp, Homo sapiens
gaactgcacaatgaccagc

SEQ ID NO: 5045304 - DNA, 22 bp, Homo sapiens
gaactgcacaatgaccagcagg

SEQ ID NO: 5045305 - DNA, 17 bp, Homo sapiens
gaactgtcaccctgagg

SEQ ID NO: 5045306 - DNA, 20 bp, Homo sapiens
gaagagagggctgagccatg

SEQ ID NO: 5045307 - DNA, 21 bp, Homo sapiens
gaagagagggctgagccatgg

SEQ ID NO: 5045308 - DNA, 11 bp, Homo sapiens
gaagcctgagc

SEQ ID NO: 5045309 - DNA, 16 bp, Homo sapiens
gaagcctgagcaggca

SEQ ID NO: 5045310 - DNA, 19 bp, Homo sapiens
gaagcctgagcaggcaggg

SEQ ID NO: 5045311 - DNA, 14 bp, Homo sapiens
gaagtctgttctca

SEQ ID NO: 5045312 - DNA, 19 bp, Homo sapiens
gaatgggctttcataaatt

SEQ ID NO: 5045313 - DNA, 23 bp, Homo sapiens
gacacggtttaactgtcccagcg

SEQ ID NO: 5045314 - DNA, 13 bp, Homo sapiens
gacaggtgcctgg

SEQ ID NO: 5045315 - DNA, 14 bp, Homo sapiens
gacaggtgcctggg

SEQ ID NO: 5045316 - DNA, 15 bp, Homo sapiens
gacaggtgcctgggg

SEQ ID NO: 5045317 - DNA, 14 bp, Homo sapiens
gaccagcaggaggg

SEQ ID NO: 5045318 - DNA, 16 bp, Homo sapiens
gaccagcaggagggaa

SEQ ID NO: 5045319 - DNA, 22 bp, Homo sapiens
gaccagcaggagggaaggacag

SEQ ID NO: 5045320 - DNA, 15 bp, Homo sapiens
gacccaggctcccag

SEQ ID NO: 5045321 - DNA, 18 bp, Homo sapiens
gacccaggctcccagcct

SEQ ID NO: 5045322 - DNA, 18 bp, Homo sapiens
gacctcttcagctgctga

SEQ ID NO: 5045323 - DNA, 14 bp, Homo sapiens
gacctgagatgctg

SEQ ID NO: 5045324 - DNA, 19 bp, Homo sapiens
gacctgagatgctgggagg

SEQ ID NO: 5045325 - DNA, 20 bp, Homo sapiens
gacctggtctggtcaggcaa

SEQ ID NO: 5045326 - DNA, 21 bp, Homo sapiens
gagacaggtgcctggggctgg

SEQ ID NO: 5045327 - DNA, 16 bp, Homo sapiens
gagagagggggcactg

SEQ ID NO: 5045328 - DNA, 22 bp, Homo sapiens
gagagggggcactgtggtcagg

SEQ ID NO: 5045329 - DNA, 15 bp, Homo sapiens
gagagtggcctgggt

SEQ ID NO: 5045330 - DNA, 17 bp, Homo sapiens
gagagtggcctgggtcc

SEQ ID NO: 5045331 - DNA, 14 bp, Homo sapiens
gagatgctgggagg

SEQ ID NO: 5045332 - DNA, 19 bp, Homo sapiens
gagcaggcaggggcttggc

SEQ ID NO: 5045333 - DNA, 18 bp, Homo sapiens
gagcagttggcctgtgct

SEQ ID NO: 5045334 - DNA, 18 bp, Homo sapiens
gagccatggcggcccctc

SEQ ID NO: 5045335 - DNA, 18 bp, Homo sapiens
gagcggagcttggccctg

SEQ ID NO: 5045336 - DNA, 17 bp, Homo sapiens
tgccggctctgggctgg

SEQ ID NO: 5045337 - DNA, 16 bp, Homo sapiens
tgcctcccaggccacc

SEQ ID NO: 5045338 - DNA, 17 bp, Homo sapiens
tgcctggggctggctgc

SEQ ID NO: 5045339 - DNA, 19 bp, Homo sapiens
tgcctggggctggctgcag

SEQ ID NO: 5045340 - DNA, 12 bp, Homo sapiens
tgcggctctgga

SEQ ID NO: 5045341 - DNA, 13 bp, Homo sapiens
tgcggctctggaa

SEQ ID NO: 5045342 - DNA, 16 bp, Homo sapiens
tgcggctctggaaagc

SEQ ID NO: 5045343 - DNA, 13 bp, Homo sapiens
tgcggttgggagg

SEQ ID NO: 5045344 - DNA, 14 bp, Homo sapiens
tgcggttgggaggc

SEQ ID NO: 5045345 - DNA, 21 bp, Homo sapiens
tgctcctggaacctggcaggc

SEQ ID NO: 5045346 - DNA, 22 bp, Homo sapiens
tgctcctggaacctggcaggcc

SEQ ID NO: 5045347 - DNA, 10 bp, Homo sapiens
tgctgaggcg

SEQ ID NO: 5045348 - DNA, 13 bp, Homo sapiens
tgctgggagggct

SEQ ID NO: 5045349 - DNA, 14 bp, Homo sapiens
tgcttggaggcctc

SEQ ID NO: 5045350 - DNA, 18 bp, Homo sapiens
tgcttggaggcctcagat

SEQ ID NO: 5045351 - DNA, 21 bp, Homo sapiens
tggaacctggcaggccctgcc

SEQ ID NO: 5045352 - DNA, 14 bp, Homo sapiens
tggaatccagtgtg

SEQ ID NO: 5045353 - DNA, 13 bp, Homo sapiens
tggacagcccggg

SEQ ID NO: 5045354 - DNA, 12 bp, Homo sapiens
tggacagccgga

SEQ ID NO: 5045355 - DNA, 16 bp, Homo sapiens
tggacatttgtggcag

SEQ ID NO: 5045356 - DNA, 21 bp, Homo sapiens
tggacatttgtggcagtgctg

SEQ ID NO: 5045357 - DNA, 17 bp, Homo sapiens
tggaccatacgcggagg

SEQ ID NO: 5045358 - DNA, 13 bp, Homo sapiens
tggagcccctcca

SEQ ID NO: 5045359 - DNA, 22 bp, Homo sapiens
tggcacccacacagaggacctc

SEQ ID NO: 5045360 - DNA, 17 bp, Homo sapiens
tggcacctttgagagag

SEQ ID NO: 5045361 - DNA, 12 bp, Homo sapiens
tggcaggccctg

SEQ ID NO: 5045362 - DNA, 13 bp, Homo sapiens
tggcaggccctgc

SEQ ID NO: 5045363 - DNA, 17 bp, Homo sapiens
tggcaggccctgcccag

SEQ ID NO: 5045364 - DNA, 20 bp, Homo sapiens
tggcaggccctgcccagcca

SEQ ID NO: 5045365 - DNA, 14 bp, Homo sapiens
tggccaggacacac

SEQ ID NO: 5045366 - DNA, 14 bp, Homo sapiens
tggccctaggcact

SEQ ID NO: 5045367 - DNA, 17 bp, Homo sapiens
tggcctgggtcccaggg

SEQ ID NO: 5045368 - DNA, 21 bp, Homo sapiens
tggcctgggtcccagggctgg

SEQ ID NO: 5045369 - DNA, 23 bp, Homo sapiens
tggcctgtgcttggaggcctcag

SEQ ID NO: 5045370 - DNA, 15 bp, Homo sapiens
tggcgaagcctgagc

SEQ ID NO: 5045371 - DNA, 16 bp, Homo sapiens
tggcgatctcccaggg

SEQ ID NO: 5045372 - DNA, 18 bp, Homo sapiens
tggcgatctcccagggct

SEQ ID NO: 5045373 - DNA, 17 bp, Homo sapiens
tggcgccgcgtggacag

SEQ ID NO: 5045374 - DNA, 20 bp, Homo sapiens
tggctcagcccgggatcctg

SEQ ID NO: 5045375 - DNA, 15 bp, Homo sapiens
tggctggccaggaca

SEQ ID NO: 5045376 - DNA, 15 bp, Homo sapiens
tgggacccaggctcc

SEQ ID NO: 5045377 - DNA, 23 bp, Homo sapiens
tgggagtaagaaatgggcctcag

SEQ ID NO: 5045378 - DNA, 14 bp, Homo sapiens
tgggagtggggagc

SEQ ID NO: 5045379 - DNA, 16 bp, Homo sapiens
tgggcctcagccccgc

SEQ ID NO: 5045380 - DNA, 22 bp, Homo sapiens
tggggagcggagcttggccctg

SEQ ID NO: 5045381 - DNA, 16 bp, Homo sapiens
tggggccttcctggct

SEQ ID NO: 5045382 - DNA, 20 bp, Homo sapiens
tggggccttcctggctttgg

SEQ ID NO: 5045383 - DNA, 14 bp, Homo sapiens
tgggggtgggaggt

SEQ ID NO: 5045384 - DNA, 23 bp, Homo sapiens
tggggttcttgtccacggggctc

SEQ ID NO: 5045385 - DNA, 18 bp, Homo sapiens
tgggtcccagggctggcc

SEQ ID NO: 5045386 - DNA, 20 bp, Homo sapiens
tgggtcccagggctggccct

SEQ ID NO: 5045387 - DNA, 11 bp, Homo sapiens
tggtcaggccc

SEQ ID NO: 5045388 - DNA, 13 bp, Homo sapiens
tggtcaggcccag

SEQ ID NO: 5045389 - DNA, 15 bp, Homo sapiens
tggtcaggcccagcc

SEQ ID NO: 5045390 - DNA, 16 bp, Homo sapiens
tggtcaggcccagcct

SEQ ID NO: 5045391 - DNA, 16 bp, Homo sapiens
tggtcaggcccagttc

SEQ ID NO: 5045392 - DNA, 20 bp, Homo sapiens
tggtctccagctcctctcca

SEQ ID NO: 5045393 - DNA, 13 bp, Homo sapiens
tggtctggtcagg

SEQ ID NO: 5045394 - DNA, 15 bp, Homo sapiens
tggtctggtcaggca

SEQ ID NO: 5045395 - DNA, 17 bp, Homo sapiens
tgtgacctggtctggtc

SEQ ID NO: 5045396 - DNA, 21 bp, Homo sapiens
tgtgacctggtctggtcaggc

SEQ ID NO: 5045397 - DNA, 15 bp, Homo sapiens
tgtgcttggaggcct

SEQ ID NO: 5045398 - DNA, 21 bp, Homo sapiens
tgtggcgccgcgtggacagcc

SEQ ID NO: 5045399 - DNA, 12 bp, Homo sapiens
tgtggtcaggcc

SEQ ID NO: 5045400 - DNA, 14 bp, Homo sapiens
tgtggtcaggccca

SEQ ID NO: 5045401 - DNA, 18 bp, Homo sapiens
tgtggttgggggtgggag

SEQ ID NO: 5045402 - DNA, 18 bp, Homo sapiens
tgtgtggtctccagctcc

SEQ ID NO: 5045403 - DNA, 14 bp, Homo sapiens
tgtgtgtggacagc

SEQ ID NO: 5045404 - DNA, 20 bp, Homo sapiens
tgttctcaaagcagaagtgg

SEQ ID NO: 5045405 - DNA, 15 bp, Homo sapiens
tgttgtctgaactaa

SEQ ID NO: 5045406 - DNA, 13 bp, Homo sapiens
ttaaaacaaacca

SEQ ID NO: 5045407 - DNA, 14 bp, Homo sapiens
ttaaccctgaacaa

SEQ ID NO: 5045408 - DNA, 12 bp, Homo sapiens
ttagcctggctg

SEQ ID NO: 5045409 - DNA, 17 bp, Homo sapiens
ttagcttttagcctggc

SEQ ID NO: 5045410 - DNA, 18 bp, Homo sapiens
ttcaccagccctgagcca

SEQ ID NO: 5045411 - DNA, 18 bp, Homo sapiens
ttcacgctgtctcttctt

SEQ ID NO: 5045412 - DNA, 15 bp, Homo sapiens
ttcagctgctgacaa

SEQ ID NO: 5045413 - DNA, 18 bp, Homo sapiens
ttccagctctcccatgga

SEQ ID NO: 5045414 - DNA, 17 bp, Homo sapiens
ttcccttggtggcaacc

SEQ ID NO: 5045415 - DNA, 21 bp, Homo sapiens
ttctgtgtggtctccagctcc

SEQ ID NO: 5045416 - DNA, 22 bp, Homo sapiens
ttctgtgtggtctccagctcct

SEQ ID NO: 5045417 - DNA, 22 bp, Homo sapiens
ttgctcctggaacctggcaggc

SEQ ID NO: 5045418 - DNA, 14 bp, Homo sapiens
ttggaggcctcaga

SEQ ID NO: 5045419 - DNA, 15 bp, Homo sapiens
ttggccctgcgccct

SEQ ID NO: 5045420 - DNA, 20 bp, Homo sapiens
ttggggcaagatccaggtgg

SEQ ID NO: 5045421 - DNA, 17 bp, Homo sapiens
tttaactgtcccagcga

SEQ ID NO: 5045422 - DNA, 13 bp, Homo sapiens
tttagcctggctg

SEQ ID NO: 5045423 - DNA, 16 bp, Homo sapiens
tttcttcccctcctgt

SEQ ID NO: 5045424 - DNA, 19 bp, Homo sapiens
tttgagacaggtgcctggg

SEQ ID NO: 5045425 - DNA, 12 bp, Homo sapiens
tttgagagaggg

SEQ ID NO: 5045426 - DNA, 15 bp, Homo sapiens
tttgagtccagtgtg

SEQ ID NO: 5045427 - DNA, 19 bp, Homo sapiens
tttgctctcaaggcttgga

SEQ ID NO: 5045428 - DNA, 15 bp, Homo sapiens
ttttacttgagcaaa

SEQ ID NO: 5045429 - DNA, 15 bp, Homo sapiens
ttttcttcccctcct

SEQ ID NO: 5045430 - DNA, 18 bp, Homo sapiens
agaggagagtggcctggg

SEQ ID NO: 5045431 - DNA, 17 bp, Homo sapiens
agagggctgagccatgg

SEQ ID NO: 5045432 - DNA, 19 bp, Homo sapiens
agagggggcactgtggtca

SEQ ID NO: 5045433 - DNA, 19 bp, Homo sapiens
agaggtatgtgcccctcct

SEQ ID NO: 5045434 - DNA, 18 bp, Homo sapiens
agagtggcctgggtccca

SEQ ID NO: 5045435 - DNA, 20 bp, Homo sapiens
agagtggcctgggtcccagg

SEQ ID NO: 5045436 - DNA, 21 bp, Homo sapiens
agagtggcctgggtcccaggg

SEQ ID NO: 5045437 - DNA, 15 bp, Homo sapiens
agatagacctgtgac

SEQ ID NO: 5045438 - DNA, 16 bp, Homo sapiens
agatgctgggagggct

SEQ ID NO: 5045439 - DNA, 17 bp, Homo sapiens
agatgctgggagggctg

SEQ ID NO: 5045440 - DNA, 18 bp, Homo sapiens
agatgctgggagggctga

SEQ ID NO: 5045441 - DNA, 16 bp, Homo sapiens
agcaacttcatcccag

SEQ ID NO: 5045442 - DNA, 21 bp, Homo sapiens
agcaacttcatcccagctgct

SEQ ID NO: 5045443 - DNA, 23 bp, Homo sapiens
agcaacttcatcccagctgctga

SEQ ID NO: 5045444 - DNA, 22 bp, Homo sapiens
agcagccggaagtctgttctca

SEQ ID NO: 5045445 - DNA, 20 bp, Homo sapiens
agcagcctttttcaccatgg

SEQ ID NO: 5045446 - DNA, 23 bp, Homo sapiens
agcaggagggaaggacagacatc

SEQ ID NO: 5045447 - DNA, 21 bp, Homo sapiens
agcagttggcctgtgcttgga

SEQ ID NO: 5045448 - DNA, 14 bp, Homo sapiens
agccatcggaagag

SEQ ID NO: 5045449 - DNA, 24 bp, Homo sapiens
agccatggcggcccctcagcctgc

SEQ ID NO: 5045450 - DNA, 16 bp, Homo sapiens
agcccagctggccgga

SEQ ID NO: 5045451 - DNA, 21 bp, Homo sapiens
agcccagctggccggaaggag

SEQ ID NO: 5045452 - DNA, 17 bp, Homo sapiens
agccccattcacggcct

SEQ ID NO: 5045453 - DNA, 20 bp, Homo sapiens
agccccattcacggcctggc

SEQ ID NO: 5045454 - DNA, 21 bp, Homo sapiens
agccccattcacggcctggca

SEQ ID NO: 5045455 - DNA, 24 bp, Homo sapiens
agccccattcacggcctggcatgc

SEQ ID NO: 5045456 - DNA, 17 bp, Homo sapiens
agccctgagccatggcg

SEQ ID NO: 5045457 - DNA, 19 bp, Homo sapiens
agccctgagccatggcggc

SEQ ID NO: 5045458 - DNA, 20 bp, Homo sapiens
agccggagcagttggcctgt

SEQ ID NO: 5045459 - DNA, 12 bp, Homo sapiens
agcctctctggc

SEQ ID NO: 5045460 - DNA, 13 bp, Homo sapiens
agcctctctggct

SEQ ID NO: 5045461 - DNA, 15 bp, Homo sapiens
agcctctctggctca

SEQ ID NO: 5045462 - DNA, 17 bp, Homo sapiens
agcctgagcaggcaggg

SEQ ID NO: 5045463 - DNA, 17 bp, Homo sapiens
agcctgcctgaagagag

SEQ ID NO: 5045464 - DNA, 18 bp, Homo sapiens
agcctgcctgaagagagg

SEQ ID NO: 5045465 - DNA, 21 bp, Homo sapiens
agcctgcctgaagagaggaaa

SEQ ID NO: 5045466 - DNA, 13 bp, Homo sapiens
agcctggctgtca

SEQ ID NO: 5045467 - DNA, 19 bp, Homo sapiens
agcctttttcaccatggca

SEQ ID NO: 5045468 - DNA, 17 bp, Homo sapiens
agcggagcttggccctg

SEQ ID NO: 5045469 - DNA, 16 bp, Homo sapiens
agctagacccaaccct

SEQ ID NO: 5045470 - DNA, 13 bp, Homo sapiens
agctcctctccag

SEQ ID NO: 5045471 - DNA, 17 bp, Homo sapiens
agctggccggaaggaga

SEQ ID NO: 5045472 - DNA, 14 bp, Homo sapiens
acacacagtcctca

SEQ ID NO: 5045473 - DNA, 12 bp, Homo sapiens
acacaggcagga

SEQ ID NO: 5045474 - DNA, 13 bp, Homo sapiens
acacaggcaggaa

SEQ ID NO: 5045475 - DNA, 16 bp, Homo sapiens
acacggaggccagaca

SEQ ID NO: 5045476 - DNA, 20 bp, Homo sapiens
acaggccgtgggacccaggc

SEQ ID NO: 5045477 - DNA, 14 bp, Homo sapiens
acagggtcaactgg

SEQ ID NO: 5045478 - DNA, 19 bp, Homo sapiens
acaggtcttcactgcccag

SEQ ID NO: 5045479 - DNA, 20 bp, Homo sapiens
acaggtcttcactgcccagg

SEQ ID NO: 5045480 - DNA, 16 bp, Homo sapiens
acaggtgcctggggct

SEQ ID NO: 5045481 - DNA, 14 bp, Homo sapiens
accagcaggaggga

SEQ ID NO: 5045482 - DNA, 11 bp, Homo sapiens
accagccctga

SEQ ID NO: 5045483 - DNA, 14 bp, Homo sapiens
accagccctgagcc

SEQ ID NO: 5045484 - DNA, 17 bp, Homo sapiens
accagccctgagccatg

SEQ ID NO: 5045485 - DNA, 17 bp, Homo sapiens
accagcctggggccttc

SEQ ID NO: 5045486 - DNA, 23 bp, Homo sapiens
accagcctggggccttcctggct

SEQ ID NO: 5045487 - DNA, 20 bp, Homo sapiens
accatggcacctttgagaga

SEQ ID NO: 5045488 - DNA, 15 bp, Homo sapiens
acccaacccatgccc

SEQ ID NO: 5045489 - DNA, 15 bp, Homo sapiens
acccaggctcccagc

SEQ ID NO: 5045490 - DNA, 21 bp, Homo sapiens
acccaggctcccagcctaagg

SEQ ID NO: 5045491 - DNA, 16 bp, Homo sapiens
accctgaggtaacagg

SEQ ID NO: 5045492 - DNA, 21 bp, Homo sapiens
acccttagcttttagcctggc

SEQ ID NO: 5045493 - DNA, 18 bp, Homo sapiens
accgcctgctacacaggc

SEQ ID NO: 5045494 - DNA, 21 bp, Homo sapiens
accgggcgcatgcctcccagg

SEQ ID NO: 5045495 - DNA, 20 bp, Homo sapiens
acctacctcgccgagctgtc

SEQ ID NO: 5045496 - DNA, 14 bp, Homo sapiens
acctctttggggca

SEQ ID NO: 5045497 - DNA, 21 bp, Homo sapiens
acctgagatgctgggagggct

SEQ ID NO: 5045498 - DNA, 15 bp, Homo sapiens
acctgccggctctgg

SEQ ID NO: 5045499 - DNA, 18 bp, Homo sapiens
acctgccggctctgggct

SEQ ID NO: 5045500 - DNA, 15 bp, Homo sapiens
acctggcaggccctg

SEQ ID NO: 5045501 - DNA, 16 bp, Homo sapiens
acctggtctggtcagg

SEQ ID NO: 5045502 - DNA, 17 bp, Homo sapiens
acctggtctggtcaggc

SEQ ID NO: 5045503 - DNA, 16 bp, Homo sapiens
acctgtgacctggtct

SEQ ID NO: 5045504 - DNA, 12 bp, Homo sapiens
acggcctggcat

SEQ ID NO: 5045505 - DNA, 16 bp, Homo sapiens
acggcctggcatgcag

SEQ ID NO: 5045506 - DNA, 16 bp, Homo sapiens
acggtttaactgtccc

SEQ ID NO: 5045507 - DNA, 22 bp, Homo sapiens
actctggccccctattgtctcc

SEQ ID NO: 5045508 - DNA, 16 bp, Homo sapiens
actggcgaagcctgag

SEQ ID NO: 5045509 - DNA, 20 bp, Homo sapiens
actggcgaagcctgagcagg

SEQ ID NO: 5045510 - DNA, 23 bp, Homo sapiens
actggcgaagcctgagcaggcag

SEQ ID NO: 5045511 - DNA, 22 bp, Homo sapiens
actgtcaccctgaggtaacagg

SEQ ID NO: 5045512 - DNA, 15 bp, Homo sapiens
actgtcccagcgaca

SEQ ID NO: 5045513 - DNA, 12 bp, Homo sapiens
actgtggtcagg

SEQ ID NO: 5045514 - DNA, 19 bp, Homo sapiens
actgtggtcaggcccagcc

SEQ ID NO: 5045515 - DNA, 14 bp, Homo sapiens
acttcatcccagct

SEQ ID NO: 5045516 - DNA, 17 bp, Homo sapiens
acttcatcccagctgct

SEQ ID NO: 5045517 - DNA, 23 bp, Homo sapiens
acttgacctgagatgctgggagg

SEQ ID NO: 5045518 - DNA, 19 bp, Homo sapiens
agaaatgggcctcagcccc

SEQ ID NO: 5045519 - DNA, 15 bp, Homo sapiens
agaactgcacaatga

SEQ ID NO: 5045520 - DNA, 21 bp, Homo sapiens
agaactgcacaatgaccagca

SEQ ID NO: 5045521 - DNA, 16 bp, Homo sapiens
agaactgtcaccctga

SEQ ID NO: 5045522 - DNA, 21 bp, Homo sapiens
agaagtggaatccagtgtggc

SEQ ID NO: 5045523 - DNA, 21 bp, Homo sapiens
agaagttcaccagccctgagc

SEQ ID NO: 5045524 - DNA, 22 bp, Homo sapiens
agaagttcaccagccctgagcc

SEQ ID NO: 5045525 - DNA, 15 bp, Homo sapiens
agacaggtgcctggg

SEQ ID NO: 5045526 - DNA, 13 bp, Homo sapiens
agacccaaccctt

SEQ ID NO: 5045527 - DNA, 23 bp, Homo sapiens
agacctgtgacctggtctggtca

SEQ ID NO: 5045528 - DNA, 13 bp, Homo sapiens
agacggtgtggtt

SEQ ID NO: 5045529 - DNA, 17 bp, Homo sapiens
agagaactgtcaccctg

SEQ ID NO: 5045530 - DNA, 13 bp, Homo sapiens
agttcaccagccc

SEQ ID NO: 5045531 - DNA, 16 bp, Homo sapiens
agttcaccagccctga

SEQ ID NO: 5045532 - DNA, 16 bp, Homo sapiens
agttctcttctcctgt

SEQ ID NO: 5045533 - DNA, 14 bp, Homo sapiens
agttgccttttctt

SEQ ID NO: 5045534 - DNA, 23 bp, Homo sapiens
ataaaactgagactgtatatgtt

SEQ ID NO: 5045535 - DNA, 23 bp, Homo sapiens
atacgcggaggagttttctgtgt

SEQ ID NO: 5045536 - DNA, 22 bp, Homo sapiens
atagacctgtgacctggtctgg

SEQ ID NO: 5045537 - DNA, 17 bp, Homo sapiens
atccagtgtggctccca

SEQ ID NO: 5045538 - DNA, 22 bp, Homo sapiens
atcctatttttgtagatctcca

SEQ ID NO: 5045539 - DNA, 20 bp, Homo sapiens
atcggaagagagggctgagc

SEQ ID NO: 5045540 - DNA, 21 bp, Homo sapiens
atctagttctcttctcctgtg

SEQ ID NO: 5045541 - DNA, 21 bp, Homo sapiens
atctcccagggctctctggac

SEQ ID NO: 5045542 - DNA, 17 bp, Homo sapiens
atgaccagcaggaggga

SEQ ID NO: 5045543 - DNA, 17 bp, Homo sapiens
atgcagcttgtccttgc

SEQ ID NO: 5045544 - DNA, 22 bp, Homo sapiens
atgcagcttgtccttgctcctg

SEQ ID NO: 5045545 - DNA, 24 bp, Homo sapiens
atgcagcttgtccttgctcctgga

SEQ ID NO: 5045546 - DNA, 17 bp, Homo sapiens
atgccctgcggctctgg

SEQ ID NO: 5045547 - DNA, 19 bp, Homo sapiens
atgccctgcggctctggaa

SEQ ID NO: 5045548 - DNA, 19 bp, Homo sapiens
atgcggttgggaggcaggt

SEQ ID NO: 5045549 - DNA, 14 bp, Homo sapiens
atgctttgctctca

SEQ ID NO: 5045550 - DNA, 15 bp, Homo sapiens
atggtcaggcccagt

SEQ ID NO: 5045551 - DNA, 19 bp, Homo sapiens
attccagctctcccatgga

SEQ ID NO: 5045552 - DNA, 16 bp, Homo sapiens
attgtcagtcctacaa

SEQ ID NO: 5045553 - DNA, 14 bp, Homo sapiens
atttgtggcagtgc

SEQ ID NO: 5045554 - DNA, 12 bp, Homo sapiens
caaccaggcaga

SEQ ID NO: 5045555 - DNA, 19 bp, Homo sapiens
caaccaggcagagttctgt

SEQ ID NO: 5045556 - DNA, 19 bp, Homo sapiens
caacccatgcccctgacag

SEQ ID NO: 5045557 - DNA, 16 bp, Homo sapiens
caacttcatcccagct

SEQ ID NO: 5045558 - DNA, 17 bp, Homo sapiens
caacttcatcccagctg

SEQ ID NO: 5045559 - DNA, 23 bp, Homo sapiens
caagccccattcacggcctggca

SEQ ID NO: 5045560 - DNA, 19 bp, Homo sapiens
caaggatggggttcttgtc

SEQ ID NO: 5045561 - DNA, 15 bp, Homo sapiens
caaggcttggagagg

SEQ ID NO: 5045562 - DNA, 23 bp, Homo sapiens
caaggtcccattttccccctgtg

SEQ ID NO: 5045563 - DNA, 15 bp, Homo sapiens
caatcacccccagga

SEQ ID NO: 5045564 - DNA, 18 bp, Homo sapiens
caatgccctgcggctctg

SEQ ID NO: 5045565 - DNA, 13 bp, Homo sapiens
caattcacgctgt

SEQ ID NO: 5045566 - DNA, 16 bp, Homo sapiens
cacaaaccagcctggg

SEQ ID NO: 5045567 - DNA, 15 bp, Homo sapiens
cacacagaggacctc

SEQ ID NO: 5045568 - DNA, 18 bp, Homo sapiens
cctgggtgctcaccgcct

SEQ ID NO: 5045569 - DNA, 21 bp, Homo sapiens
cctggtctggtcaggcaatgc

SEQ ID NO: 5045570 - DNA, 20 bp, Homo sapiens
cctgtaagagtattaacaaa

SEQ ID NO: 5045571 - DNA, 16 bp, Homo sapiens
cctgtgacctggtctg

SEQ ID NO: 5045572 - DNA, 14 bp, Homo sapiens
cctgtgcttggagg

SEQ ID NO: 5045573 - DNA, 20 bp, Homo sapiens
ccttagcttttagcctggct

SEQ ID NO: 5045574 - DNA, 13 bp, Homo sapiens
ccttgctcctgga

SEQ ID NO: 5045575 - DNA, 22 bp, Homo sapiens
cgaatggggtccccctcccact

SEQ ID NO: 5045576 - DNA, 23 bp, Homo sapiens
cgaatggggtccccctcccactt

SEQ ID NO: 5045577 - DNA, 18 bp, Homo sapiens
cgagctgtcggagggctg

SEQ ID NO: 5045578 - DNA, 15 bp, Homo sapiens
cgccctgtgcaggga

SEQ ID NO: 5045579 - DNA, 22 bp, Homo sapiens
cgccgcgtggacagccggagca

SEQ ID NO: 5045580 - DNA, 14 bp, Homo sapiens
cgcctgctacacag

SEQ ID NO: 5045581 - DNA, 19 bp, Homo sapiens
cgcctgctacacaggcagg

SEQ ID NO: 5045582 - DNA, 19 bp, Homo sapiens
cgcggatcaaccaggcaga

SEQ ID NO: 5045583 - DNA, 20 bp, Homo sapiens
cgcggatcaaccaggcagag

SEQ ID NO: 5045584 - DNA, 17 bp, Homo sapiens
cgcgtggacagccggag

SEQ ID NO: 5045585 - DNA, 18 bp, Homo sapiens
cggaagagagggctgagc

SEQ ID NO: 5045586 - DNA, 12 bp, Homo sapiens
cggagcttggcc

SEQ ID NO: 5045587 - DNA, 13 bp, Homo sapiens
cggagcttggccc

SEQ ID NO: 5045588 - DNA, 14 bp, Homo sapiens
cggagcttggccct

SEQ ID NO: 5045589 - DNA, 17 bp, Homo sapiens
cggagcttggccctgcg

SEQ ID NO: 5045590 - DNA, 21 bp, Homo sapiens
cggagcttggccctgcgccct

SEQ ID NO: 5045591 - DNA, 14 bp, Homo sapiens
cggaggccagacac

SEQ ID NO: 5045592 - DNA, 21 bp, Homo sapiens
cggaggccagacacaggccgt

SEQ ID NO: 5045593 - DNA, 16 bp, Homo sapiens
cggatcaaccaggcag

SEQ ID NO: 5045594 - DNA, 18 bp, Homo sapiens
cggatcaaccaggcagag

SEQ ID NO: 5045595 - DNA, 13 bp, Homo sapiens
cggcccctcagcc

SEQ ID NO: 5045596 - DNA, 17 bp, Homo sapiens
cggcccctcagcctgcc

SEQ ID NO: 5045597 - DNA, 16 bp, Homo sapiens
cggcctggcatgcagc

SEQ ID NO: 5045598 - DNA, 19 bp, Homo sapiens
cggcctggcatgcagcttg

SEQ ID NO: 5045599 - DNA, 20 bp, Homo sapiens
cggcctggctggccaggaca

SEQ ID NO: 5045600 - DNA, 14 bp, Homo sapiens
cggctctgggctgg

SEQ ID NO: 5045601 - DNA, 19 bp, Homo sapiens
cggctctgggctggctgct

SEQ ID NO: 5045602 - DNA, 20 bp, Homo sapiens
cgggcgcatgcctcccaggc

SEQ ID NO: 5045603 - DNA, 23 bp, Homo sapiens
cgggcgcatgcctcccaggccac

SEQ ID NO: 5045604 - DNA, 20 bp, Homo sapiens
cgggctgccagcccagctgg

SEQ ID NO: 5045605 - DNA, 21 bp, Homo sapiens
cggtgtggttgggggtgggag

SEQ ID NO: 5045606 - DNA, 20 bp, Homo sapiens
cggtttaactgtcccagcga

SEQ ID NO: 5045607 - DNA, 15 bp, Homo sapiens
cgtgggacccaggct

SEQ ID NO: 5045608 - DNA, 19 bp, Homo sapiens
ctaaggatttttccatgga

SEQ ID NO: 5045609 - DNA, 16 bp, Homo sapiens
ctaagggagacaggcc

SEQ ID NO: 5045610 - DNA, 22 bp, Homo sapiens
ctagtccaatcacccccaggac

SEQ ID NO: 5045611 - DNA, 18 bp, Homo sapiens
ctagttctcttctcctgt

SEQ ID NO: 5045612 - DNA, 21 bp, Homo sapiens
ctagttctcttctcctgtgtt

SEQ ID NO: 5045613 - DNA, 14 bp, Homo sapiens
ctcacctgccggct

SEQ ID NO: 5045614 - DNA, 16 bp, Homo sapiens
ctcacctgccggctct

SEQ ID NO: 5045615 - DNA, 17 bp, Homo sapiens
ctcacctgccggctctg

SEQ ID NO: 5045616 - DNA, 19 bp, Homo sapiens
ctcacctgccggctctggg

SEQ ID NO: 5045617 - DNA, 12 bp, Homo sapiens
ctcactctggcc

SEQ ID NO: 5045618 - DNA, 13 bp, Homo sapiens
ctcagcctgcctg

SEQ ID NO: 5045619 - DNA, 22 bp, Homo sapiens
ctcagcctgcctgaagagagga

SEQ ID NO: 5045620 - DNA, 22 bp, Homo sapiens
ctcagtctcacctgccggctct

SEQ ID NO: 5045621 - DNA, 16 bp, Homo sapiens
ctccagacacagagac

SEQ ID NO: 5045622 - DNA, 14 bp, Homo sapiens
ctccagctcctctc

SEQ ID NO: 5045623 - DNA, 15 bp, Homo sapiens
ctccagctcctctcc

SEQ ID NO: 5045624 - DNA, 21 bp, Homo sapiens
ctccatgctttgctctcaagg

SEQ ID NO: 5045625 - DNA, 15 bp, Homo sapiens
ctcccagcctaaggg

SEQ ID NO: 5045626 - DNA, 21 bp, Homo sapiens
ctcccagcctaagggagacag

SEQ ID NO: 5045627 - DNA, 17 bp, Homo sapiens
ctcccagggctctctgg

SEQ ID NO: 5045628 - DNA, 21 bp, Homo sapiens
ctcccagggctctctggacca

SEQ ID NO: 5045629 - DNA, 15 bp, Homo sapiens
ctcctctccagacac

SEQ ID NO: 5045630 - DNA, 16 bp, Homo sapiens
ctcctctccagacaca

SEQ ID NO: 5045631 - DNA, 18 bp, Homo sapiens
ctcctggaacctggcagg

SEQ ID NO: 5045632 - DNA, 19 bp, Homo sapiens
ctcctggaacctggcaggc

SEQ ID NO: 5045633 - DNA, 22 bp, Homo sapiens
ctcctggaacctggcaggccct

SEQ ID NO: 5045634 - DNA, 18 bp, Homo sapiens
ctcggcctggctggccag

SEQ ID NO: 5045635 - DNA, 15 bp, Homo sapiens
ctcgtgcccttagag

SEQ ID NO: 5045636 - DNA, 13 bp, Homo sapiens
ctctcaaggcttg

SEQ ID NO: 5045637 - DNA, 14 bp, Homo sapiens
ctctccagacacag

SEQ ID NO: 5045638 - DNA, 20 bp, Homo sapiens
ctctggaccatacgcggagg

SEQ ID NO: 5045639 - DNA, 20 bp, Homo sapiens
ctctggccccctattgtctc

SEQ ID NO: 5045640 - DNA, 15 bp, Homo sapiens
ctcttcagctgctga

SEQ ID NO: 5045641 - DNA, 20 bp, Homo sapiens
ctcttctcctgtgttccctt

SEQ ID NO: 5045642 - DNA, 15 bp, Homo sapiens
gagcttggccctgcg

SEQ ID NO: 5045643 - DNA, 22 bp, Homo sapiens
gagcttggccctgcgccctgtg

SEQ ID NO: 5045644 - DNA, 21 bp, Homo sapiens
gagctttgagacaggtgcctg

SEQ ID NO: 5045645 - DNA, 23 bp, Homo sapiens
gagctttgagacaggtgcctggg

SEQ ID NO: 5045646 - DNA, 22 bp, Homo sapiens
gaggcaggtcgggctgccagcc

SEQ ID NO: 5045647 - DNA, 21 bp, Homo sapiens
gaggccagacacaggccgtgg

SEQ ID NO: 5045648 - DNA, 18 bp, Homo sapiens
gaggcgaaatataaaact

SEQ ID NO: 5045649 - DNA, 14 bp, Homo sapiens
gagggaaggacaga

SEQ ID NO: 5045650 - DNA, 22 bp, Homo sapiens
gagggctggacatttgtggcag

SEQ ID NO: 5045651 - DNA, 13 bp, Homo sapiens
gagtccagtgtgg

SEQ ID NO: 5045652 - DNA, 13 bp, Homo sapiens
gagtggcctgggt

SEQ ID NO: 5045653 - DNA, 17 bp, Homo sapiens
gagtggcctgggtccca

SEQ ID NO: 5045654 - DNA, 22 bp, Homo sapiens
gagtggcctgggtcccagggct

SEQ ID NO: 5045655 - DNA, 20 bp, Homo sapiens
gatagttgccttttcttccc

SEQ ID NO: 5045656 - DNA, 14 bp, Homo sapiens
gatcaaccaggcag

SEQ ID NO: 5045657 - DNA, 16 bp, Homo sapiens
gatcaaccaggcagag

SEQ ID NO: 5045658 - DNA, 16 bp, Homo sapiens
gatctcccagggctct

SEQ ID NO: 5045659 - DNA, 19 bp, Homo sapiens
gatctcccagggctctctg

SEQ ID NO: 5045660 - DNA, 21 bp, Homo sapiens
gatctcccagggctctctgga

SEQ ID NO: 5045661 - DNA, 13 bp, Homo sapiens
gatgctgggaggg

SEQ ID NO: 5045662 - DNA, 14 bp, Homo sapiens
gatgctgggagggc

SEQ ID NO: 5045663 - DNA, 23 bp, Homo sapiens
gatggcacccacacagaggacct

SEQ ID NO: 5045664 - DNA, 16 bp, Homo sapiens
gcaacttcatcccagc

SEQ ID NO: 5045665 - DNA, 14 bp, Homo sapiens
gcaagatccaggtg

SEQ ID NO: 5045666 - DNA, 16 bp, Homo sapiens
gcacacacacacagtc

SEQ ID NO: 5045667 - DNA, 12 bp, Homo sapiens
gcacccacacag

SEQ ID NO: 5045668 - DNA, 19 bp, Homo sapiens
gcacccacacagaggacct

SEQ ID NO: 5045669 - DNA, 15 bp, Homo sapiens
gcacctttgagagag

SEQ ID NO: 5045670 - DNA, 22 bp, Homo sapiens
gcacctttgagagagggggcac

SEQ ID NO: 5045671 - DNA, 16 bp, Homo sapiens
gcactgtggtcaggcc

SEQ ID NO: 5045672 - DNA, 18 bp, Homo sapiens
gcactgtggtcaggccca

SEQ ID NO: 5045673 - DNA, 20 bp, Homo sapiens
gcactgtggtcaggcccagc

SEQ ID NO: 5045674 - DNA, 21 bp, Homo sapiens
gcactgtggtcaggcccagcc

SEQ ID NO: 5045675 - DNA, 22 bp, Homo sapiens
gcagcaattcacgctgtctctt

SEQ ID NO: 5045676 - DNA, 21 bp, Homo sapiens
gcagcttgtccttgctcctgg

SEQ ID NO: 5045677 - DNA, 22 bp, Homo sapiens
gcagcttgtccttgctcctgga

SEQ ID NO: 5045678 - DNA, 23 bp, Homo sapiens
gcaggaatgcggttgggaggcag

SEQ ID NO: 5045679 - DNA, 19 bp, Homo sapiens
gcaggagggaaggacagac

SEQ ID NO: 5045680 - DNA, 11 bp, Homo sapiens
gcaggccctgc

SEQ ID NO: 5045681 - DNA, 15 bp, Homo sapiens
gcaggccctgcccag

SEQ ID NO: 5045682 - DNA, 13 bp, Homo sapiens
gcaggggcttggc

SEQ ID NO: 5045683 - DNA, 22 bp, Homo sapiens
gcaggtcatattgtcagtccta

SEQ ID NO: 5045684 - DNA, 15 bp, Homo sapiens
gcaggtcgggctgcc

SEQ ID NO: 5045685 - DNA, 17 bp, Homo sapiens
gcaggtcgggctgccag

SEQ ID NO: 5045686 - DNA, 19 bp, Homo sapiens
gcaggtcgggctgccagcc

SEQ ID NO: 5045687 - DNA, 20 bp, Homo sapiens
gcaggtcgggctgccagccc

SEQ ID NO: 5045688 - DNA, 22 bp, Homo sapiens
gcaggtcgggctgccagcccag

SEQ ID NO: 5045689 - DNA, 15 bp, Homo sapiens
gcatgcctcccaggc

SEQ ID NO: 5045690 - DNA, 16 bp, Homo sapiens
gcatgcctcccaggcc

SEQ ID NO: 5045691 - DNA, 16 bp, Homo sapiens
gccagacacaggccgt

SEQ ID NO: 5045692 - DNA, 23 bp, Homo sapiens
gccagccatcggaagagagggct

SEQ ID NO: 5045693 - DNA, 20 bp, Homo sapiens
gccagcccagctggccggaa

SEQ ID NO: 5045694 - DNA, 18 bp, Homo sapiens
gccatggcggcccctcag

SEQ ID NO: 5045695 - DNA, 22 bp, Homo sapiens
gccatggcggcccctcagcctg

SEQ ID NO: 5045696 - DNA, 21 bp, Homo sapiens
gcccagcctctctggctcagc

SEQ ID NO: 5045697 - DNA, 16 bp, Homo sapiens
gcccagctggccggaa

SEQ ID NO: 5045698 - DNA, 17 bp, Homo sapiens
gcccagctggccggaag

SEQ ID NO: 5045699 - DNA, 21 bp, Homo sapiens
gcccagctggccggaaggaga

SEQ ID NO: 5045700 - DNA, 18 bp, Homo sapiens
gcccagttctcgtgccct

SEQ ID NO: 5045701 - DNA, 18 bp, Homo sapiens
gccccattcacggcctgg

SEQ ID NO: 5045702 - DNA, 20 bp, Homo sapiens
gccccattcacggcctggca

SEQ ID NO: 5045703 - DNA, 12 bp, Homo sapiens
gccccattccag

SEQ ID NO: 5045704 - DNA, 15 bp, Homo sapiens
gccccccaaggatgg

SEQ ID NO: 5045705 - DNA, 20 bp, Homo sapiens
gccccctattgtctccaagg

SEQ ID NO: 5045706 - DNA, 21 bp, Homo sapiens
gccccgcggatcaaccaggca

SEQ ID NO: 5045707 - DNA, 14 bp, Homo sapiens
gcccctcctgggtg

SEQ ID NO: 5045708 - DNA, 18 bp, Homo sapiens
gcccgggatcctgatggc

SEQ ID NO: 5045709 - DNA, 20 bp, Homo sapiens
gcccgggatcctgatggcac

SEQ ID NO: 5045710 - DNA, 14 bp, Homo sapiens
gccctgcccagcca

SEQ ID NO: 5045711 - DNA, 16 bp, Homo sapiens
gccctgcccagccagc

SEQ ID NO: 5045712 - DNA, 18 bp, Homo sapiens
gccctgcccagccagcca

SEQ ID NO: 5045713 - DNA, 14 bp, Homo sapiens
gccctgcgccctgt

SEQ ID NO: 5045714 - DNA, 16 bp, Homo sapiens
gccctgcgccctgtgc

SEQ ID NO: 5045715 - DNA, 16 bp, Homo sapiens
gccctgcggctctgga

SEQ ID NO: 5045716 - DNA, 17 bp, Homo sapiens
gccctgcggctctggaa

SEQ ID NO: 5045717 - DNA, 23 bp, Homo sapiens
gccctgtgcagggaaagggatgg

SEQ ID NO: 5045718 - DNA, 21 bp, Homo sapiens
gccgagctgtcggagggctgg

SEQ ID NO: 5045719 - DNA, 22 bp, Homo sapiens
gccgagctgtcggagggctgga

SEQ ID NO: 5045720 - DNA, 20 bp, Homo sapiens
gccgcgtggacagccggagc

SEQ ID NO: 5045721 - DNA, 18 bp, Homo sapiens
gccggagcagttggcctg

SEQ ID NO: 5045722 - DNA, 20 bp, Homo sapiens
gccggagcagttggcctgtg

SEQ ID NO: 5045723 - DNA, 14 bp, Homo sapiens
gccggctctgggct

SEQ ID NO: 5045724 - DNA, 15 bp, Homo sapiens
gccgtgggacccagg

SEQ ID NO: 5045725 - DNA, 19 bp, Homo sapiens
gccgtgggacccaggctcc

SEQ ID NO: 5045726 - DNA, 17 bp, Homo sapiens
gcctcggcctggctggc

SEQ ID NO: 5045727 - DNA, 21 bp, Homo sapiens
gcctcggcctggctggccagg

SEQ ID NO: 5045728 - DNA, 22 bp, Homo sapiens
gcctcggcctggctggccagga

SEQ ID NO: 5045729 - DNA, 15 bp, Homo sapiens
gcctctctggctcag

SEQ ID NO: 5045730 - DNA, 14 bp, Homo sapiens
gcctgagcaggcag

SEQ ID NO: 5045731 - DNA, 15 bp, Homo sapiens
gcctgagcaggcagg

SEQ ID NO: 5045732 - DNA, 22 bp, Homo sapiens
gcctgagcaggcaggggcttgg

SEQ ID NO: 5045733 - DNA, 12 bp, Homo sapiens
gcctgcctgaag

SEQ ID NO: 5045734 - DNA, 14 bp, Homo sapiens
gcctgctacacagg

SEQ ID NO: 5045735 - DNA, 16 bp, Homo sapiens
gcctgctacacaggca

SEQ ID NO: 5045736 - DNA, 19 bp, Homo sapiens
gcctgctacacaggcagga

SEQ ID NO: 5045737 - DNA, 20 bp, Homo sapiens
gcctgctacacaggcaggaa

SEQ ID NO: 5045738 - DNA, 14 bp, Homo sapiens
gcctggctgtcacc

SEQ ID NO: 5045739 - DNA, 18 bp, Homo sapiens
gcctggggccttcctggc

SEQ ID NO: 5045740 - DNA, 22 bp, Homo sapiens
gcctggggccttcctggctttg

SEQ ID NO: 5045741 - DNA, 20 bp, Homo sapiens
gcctggggctggctgcagac

SEQ ID NO: 5045742 - DNA, 14 bp, Homo sapiens
gcctgggtcccagg

SEQ ID NO: 5045743 - DNA, 18 bp, Homo sapiens
gcctgggtcccagggctg

SEQ ID NO: 5045744 - DNA, 19 bp, Homo sapiens
gcctgggtcccagggctgg

SEQ ID NO: 5045745 - DNA, 23 bp, Homo sapiens
gcctgggtcccagggctggccct

SEQ ID NO: 5045746 - DNA, 24 bp, Homo sapiens
gcctgggtcccagggctggcccta

SEQ ID NO: 5045747 - DNA, 12 bp, Homo sapiens
gcctgtgcttgg

SEQ ID NO: 5045748 - DNA, 17 bp, Homo sapiens
gcctttttcaccatggc

SEQ ID NO: 5045749 - DNA, 13 bp, Homo sapiens
gcgaagcctgagc

SEQ ID NO: 5045750 - DNA, 19 bp, Homo sapiens
gcgaagcctgagcaggcag

SEQ ID NO: 5045751 - DNA, 21 bp, Homo sapiens
gcgaagcctgagcaggcaggg

SEQ ID NO: 5045752 - DNA, 14 bp, Homo sapiens
gcgcatgcctccca

SEQ ID NO: 5045753 - DNA, 15 bp, Homo sapiens
gcgccctgtgcaggg

SEQ ID NO: 5045754 - DNA, 16 bp, Homo sapiens
gcgccgcgtggacagc

SEQ ID NO: 5045755 - DNA, 16 bp, Homo sapiens
gcggagcttggccctg

SEQ ID NO: 5045756 - DNA, 17 bp, Homo sapiens
gcggatcaaccaggcag

SEQ ID NO: 5045757 - DNA, 18 bp, Homo sapiens
gcggcccctcagcctgcc

SEQ ID NO: 5045758 - DNA, 17 bp, Homo sapiens
gcggttgggaggcaggt

SEQ ID NO: 5045759 - DNA, 13 bp, Homo sapiens
gcgtggacagccg

SEQ ID NO: 5045760 - DNA, 17 bp, Homo sapiens
gcgtggacagccggagc

SEQ ID NO: 5045761 - DNA, 18 bp, Homo sapiens
gcgtggacagccggagca

SEQ ID NO: 5045762 - DNA, 15 bp, Homo sapiens
gctacacaggcagga

SEQ ID NO: 5045763 - DNA, 14 bp, Homo sapiens
gctcaccgcctgct

SEQ ID NO: 5045764 - DNA, 14 bp, Homo sapiens
gctcactctggccc

SEQ ID NO: 5045765 - DNA, 15 bp, Homo sapiens
gctcactctggcccc

SEQ ID NO: 5045766 - DNA, 23 bp, Homo sapiens
gctcagcccgggatcctgatggc

SEQ ID NO: 5045767 - DNA, 19 bp, Homo sapiens
gctcctctccagacacaga

SEQ ID NO: 5045768 - DNA, 13 bp, Homo sapiens
gctcctggaacct

SEQ ID NO: 5045769 - DNA, 14 bp, Homo sapiens
gctcctggaacctg

SEQ ID NO: 5045770 - DNA, 22 bp, Homo sapiens
gctcctggaacctggcaggccc

SEQ ID NO: 5045771 - DNA, 13 bp, Homo sapiens
gctctcaaggctt

SEQ ID NO: 5045772 - DNA, 15 bp, Homo sapiens
gctctcaaggcttgg

SEQ ID NO: 5045773 - DNA, 21 bp, Homo sapiens
gctctcaaggcttggagaggt

SEQ ID NO: 5045774 - DNA, 12 bp, Homo sapiens
gctctgggctgg

SEQ ID NO: 5045775 - DNA, 21 bp, Homo sapiens
gctctgggctggctgctccta

SEQ ID NO: 5045776 - DNA, 15 bp, Homo sapiens
gctgccagcccagct

SEQ ID NO: 5045777 - DNA, 13 bp, Homo sapiens
gctggccaggaca

SEQ ID NO: 5045778 - DNA, 14 bp, Homo sapiens
gctggccaggacac

SEQ ID NO: 5045779 - DNA, 14 bp, Homo sapiens
gctggccctaggca

SEQ ID NO: 5045780 - DNA, 15 bp, Homo sapiens
gctggccctaggcac

SEQ ID NO: 5045781 - DNA, 18 bp, Homo sapiens
gctggccctaggcactga

SEQ ID NO: 5045782 - DNA, 14 bp, Homo sapiens
gctgggagggctga

SEQ ID NO: 5045783 - DNA, 20 bp, Homo sapiens
gcttccagaggagagtggcc

SEQ ID NO: 5045784 - DNA, 13 bp, Homo sapiens
gcttggaggcctc

SEQ ID NO: 5045785 - DNA, 15 bp, Homo sapiens
gcttggaggcctcag

SEQ ID NO: 5045786 - DNA, 19 bp, Homo sapiens
gcttggccctgcgccctgt

SEQ ID NO: 5045787 - DNA, 24 bp, Homo sapiens
gcttggccctgcgccctgtgcagg

SEQ ID NO: 5045788 - DNA, 13 bp, Homo sapiens
gcttggctgcccc

SEQ ID NO: 5045789 - DNA, 19 bp, Homo sapiens
gctttgagacaggtgcctg

SEQ ID NO: 5045790 - DNA, 23 bp, Homo sapiens
gctttgagacaggtgcctggggc

SEQ ID NO: 5045791 - DNA, 14 bp, Homo sapiens
gcttttagcctggc

SEQ ID NO: 5045792 - DNA, 17 bp, Homo sapiens
gcttttagcctggctgt

SEQ ID NO: 5045793 - DNA, 21 bp, Homo sapiens
ggaacctggcaggccctgccc

SEQ ID NO: 5045794 - DNA, 24 bp, Homo sapiens
ggaacctggcaggccctgcccagc

SEQ ID NO: 5045795 - DNA, 20 bp, Homo sapiens
ggaatgcggttgggaggcag

SEQ ID NO: 5045796 - DNA, 21 bp, Homo sapiens
ggaatgcggttgggaggcagg

SEQ ID NO: 5045797 - DNA, 22 bp, Homo sapiens
ggacacggtttaactgtcccag

SEQ ID NO: 5045798 - DNA, 12 bp, Homo sapiens
ggacagcccggg

SEQ ID NO: 5045799 - DNA, 15 bp, Homo sapiens
ggacagccggagcag

SEQ ID NO: 5045800 - DNA, 18 bp, Homo sapiens
ggacatttgtggcagtgc

SEQ ID NO: 5045801 - DNA, 18 bp, Homo sapiens
ggaccatacgcggaggag

SEQ ID NO: 5045802 - DNA, 11 bp, Homo sapiens
ggacccaggct

SEQ ID NO: 5045803 - DNA, 17 bp, Homo sapiens
ggacccaggctcccagc

SEQ ID NO: 5045804 - DNA, 19 bp, Homo sapiens
ggacccaggctcccagcct

SEQ ID NO: 5045805 - DNA, 15 bp, Homo sapiens
ggacctcttcagctg

SEQ ID NO: 5045806 - DNA, 20 bp, Homo sapiens
ggagacaggcctttccctgc

SEQ ID NO: 5045807 - DNA, 13 bp, Homo sapiens
ggagagtggcctg

SEQ ID NO: 5045808 - DNA, 17 bp, Homo sapiens
ggagagtggcctgggtc

SEQ ID NO: 5045809 - DNA, 15 bp, Homo sapiens
ggagcagttggcctg

SEQ ID NO: 5045810 - DNA, 17 bp, Homo sapiens
ggagcagttggcctgtg

SEQ ID NO: 5045811 - DNA, 18 bp, Homo sapiens
ggagcagttggcctgtgc

SEQ ID NO: 5045812 - DNA, 19 bp, Homo sapiens
ggagcagttggcctgtgct

SEQ ID NO: 5045813 - DNA, 14 bp, Homo sapiens
ggagcggagcttgg

SEQ ID NO: 5045814 - DNA, 18 bp, Homo sapiens
ggagcttggccctgcgcc

SEQ ID NO: 5045815 - DNA, 19 bp, Homo sapiens
ggagcttggccctgcgccc

SEQ ID NO: 5045816 - DNA, 21 bp, Homo sapiens
ggagcttggccctgcgccctg

SEQ ID NO: 5045817 - DNA, 16 bp, Homo sapiens
ggagctttgagacagg

SEQ ID NO: 5045818 - DNA, 20 bp, Homo sapiens
ggaggagttttctgtgtggt

SEQ ID NO: 5045819 - DNA, 15 bp, Homo sapiens
ggaggcaggtcgggc

SEQ ID NO: 5045820 - DNA, 20 bp, Homo sapiens
ggaggccagacacaggccgt

SEQ ID NO: 5045821 - DNA, 21 bp, Homo sapiens
ggagtaagaaatgggcctcag

SEQ ID NO: 5045822 - DNA, 18 bp, Homo sapiens
ggagtggggagcggagct

SEQ ID NO: 5045823 - DNA, 20 bp, Homo sapiens
ggagttttctgtgtggtctc

SEQ ID NO: 5045824 - DNA, 23 bp, Homo sapiens
ggatcaaccaggcagagttctgt

SEQ ID NO: 5045825 - DNA, 16 bp, Homo sapiens
ggatggtcaggcccag

SEQ ID NO: 5045826 - DNA, 15 bp, Homo sapiens
ggcaatgccctgcgg

SEQ ID NO: 5045827 - DNA, 17 bp, Homo sapiens
ggcaatgccctgcggct

SEQ ID NO: 5045828 - DNA, 22 bp, Homo sapiens
ggcaatgccctgcggctctgga

SEQ ID NO: 5045829 - DNA, 23 bp, Homo sapiens
ggcaatgccctgcggctctggaa

SEQ ID NO: 5045830 - DNA, 21 bp, Homo sapiens
ggcacccacacagaggacctc

SEQ ID NO: 5045831 - DNA, 18 bp, Homo sapiens
ggcacctttgagagaggg

SEQ ID NO: 5045832 - DNA, 19 bp, Homo sapiens
ggcactgtggtcaggccca

SEQ ID NO: 5045833 - DNA, 22 bp, Homo sapiens
ggcactgtggtcaggcccagcc

SEQ ID NO: 5045834 - DNA, 23 bp, Homo sapiens
ggcactgtggtcaggcccagcct

SEQ ID NO: 5045835 - DNA, 13 bp, Homo sapiens
ggcagagttctgt

SEQ ID NO: 5045836 - DNA, 11 bp, Homo sapiens
ggcaggccctg

SEQ ID NO: 5045837 - DNA, 12 bp, Homo sapiens
ggcaggccctgc

SEQ ID NO: 5045838 - DNA, 14 bp, Homo sapiens
ggcaggccctgccc

SEQ ID NO: 5045839 - DNA, 15 bp, Homo sapiens
ggcaggccctgccca

SEQ ID NO: 5045840 - DNA, 19 bp, Homo sapiens
ggcaggccctgcccagcca

SEQ ID NO: 5045841 - DNA, 20 bp, Homo sapiens
ggcaggccctgcccagccag

SEQ ID NO: 5045842 - DNA, 22 bp, Homo sapiens
ggcaggccctgcccagccagcc

SEQ ID NO: 5045843 - DNA, 19 bp, Homo sapiens
ggcaggggcttggctgccc

SEQ ID NO: 5045844 - DNA, 20 bp, Homo sapiens
ggcaggggcttggctgcccc

SEQ ID NO: 5045845 - DNA, 18 bp, Homo sapiens
ggcaggtcgggctgccag

SEQ ID NO: 5045846 - DNA, 13 bp, Homo sapiens
ggcatgcagcttg

SEQ ID NO: 5045847 - DNA, 20 bp, Homo sapiens
ggccagacacaggccgtggg

SEQ ID NO: 5045848 - DNA, 16 bp, Homo sapiens
ggccaggacacactga

SEQ ID NO: 5045849 - DNA, 20 bp, Homo sapiens
gtctcacctgccggctctgg

SEQ ID NO: 5045850 - DNA, 15 bp, Homo sapiens
gtctccagctcctct

SEQ ID NO: 5045851 - DNA, 22 bp, Homo sapiens
gtctcttcttaaccctgaacaa

SEQ ID NO: 5045852 - DNA, 13 bp, Homo sapiens
gtctggtcaggca

SEQ ID NO: 5045853 - DNA, 22 bp, Homo sapiens
gtctggtcaggcaatgccctgc

SEQ ID NO: 5045854 - DNA, 14 bp, Homo sapiens
gtgcccctcctggg

SEQ ID NO: 5045855 - DNA, 17 bp, Homo sapiens
gtgcctggggctggctg

SEQ ID NO: 5045856 - DNA, 18 bp, Homo sapiens
gtgcctggggctggctgc

SEQ ID NO: 5045857 - DNA, 20 bp, Homo sapiens
gtgcctggggctggctgcag

SEQ ID NO: 5045858 - DNA, 15 bp, Homo sapiens
gtggcaaccccagac

SEQ ID NO: 5045859 - DNA, 19 bp, Homo sapiens
gtgggacccaggctcccag

SEQ ID NO: 5045860 - DNA, 21 bp, Homo sapiens
gtgggacccaggctcccagcc

SEQ ID NO: 5045861 - DNA, 13 bp, Homo sapiens
gtggggagcggag

SEQ ID NO: 5045862 - DNA, 19 bp, Homo sapiens
gtggtcaggcccagcctct

SEQ ID NO: 5045863 - DNA, 18 bp, Homo sapiens
aaactggcgatctcccag

SEQ ID NO: 5045864 - DNA, 20 bp, Homo sapiens
aaagcaacttcatcccagct

SEQ ID NO: 5045865 - DNA, 18 bp, Homo sapiens
aaaggcttccagaggaga

SEQ ID NO: 5045866 - DNA, 19 bp, Homo sapiens
aaagggatggtcaggccca

SEQ ID NO: 5045867 - DNA, 22 bp, Homo sapiens
aaagtattatgtttcttcttgt

SEQ ID NO: 5045868 - DNA, 15 bp, Homo sapiens
aacctggcaggccct

SEQ ID NO: 5045869 - DNA, 17 bp, Homo sapiens
aacctggcaggccctgc

SEQ ID NO: 5045870 - DNA, 21 bp, Homo sapiens
aacctggcaggccctgcccag

SEQ ID NO: 5045871 - DNA, 16 bp, Homo sapiens
aactggcgaagcctga

SEQ ID NO: 5045872 - DNA, 18 bp, Homo sapiens
aactggcgaagcctgagc

SEQ ID NO: 5045873 - DNA, 19 bp, Homo sapiens
aactggcgatctcccaggg

SEQ ID NO: 5045874 - DNA, 17 bp, Homo sapiens
aactgtcaccctgaggt

SEQ ID NO: 5045875 - DNA, 15 bp, Homo sapiens
aacttcatcccagct

SEQ ID NO: 5045876 - DNA, 17 bp, Homo sapiens
aacttcatcccagctgc

SEQ ID NO: 5045877 - DNA, 19 bp, Homo sapiens
aagaagttcaccagccctg

SEQ ID NO: 5045878 - DNA, 13 bp, Homo sapiens
aagagtgtctatg

SEQ ID NO: 5045879 - DNA, 19 bp, Homo sapiens
aagcacacacacacagtcc

SEQ ID NO: 5045880 - DNA, 22 bp, Homo sapiens
aagcagaagtggaatccagtgt

SEQ ID NO: 5045881 - DNA, 21 bp, Homo sapiens
aagcagcctttttcaccatgg

SEQ ID NO: 5045882 - DNA, 17 bp, Homo sapiens
aagcctgagcaggcagg

SEQ ID NO: 5045883 - DNA, 13 bp, Homo sapiens
aagggagacaggc

SEQ ID NO: 5045884 - DNA, 20 bp, Homo sapiens
aagggatggtcaggcccagt

SEQ ID NO: 5045885 - DNA, 17 bp, Homo sapiens
aagtattatgtttcttc

SEQ ID NO: 5045886 - DNA, 19 bp, Homo sapiens
aagttcaccagccctgagc

SEQ ID NO: 5045887 - DNA, 23 bp, Homo sapiens
aatattttactagtccaatcacc

SEQ ID NO: 5045888 - DNA, 18 bp, Homo sapiens
aatgcggttgggaggcag

SEQ ID NO: 5045889 - DNA, 14 bp, Homo sapiens
aatgggcctcagcc

SEQ ID NO: 5045890 - DNA, 22 bp, Homo sapiens
aatttccagaactgcacaatga

SEQ ID NO: 5045891 - DNA, 15 bp, Homo sapiens
acaaaccagcctggg

SEQ ID NO: 5045892 - DNA, 15 bp, Homo sapiens
acacacggaggccag

SEQ ID NO: 5045893 - DNA, 19 bp, Homo sapiens
acacacggaggccagacac

SEQ ID NO: 5045894 - DNA, 13 bp, Homo sapiens
acacactgaaaag

SEQ ID NO: 5045895 - DNA, 15 bp, Homo sapiens
acacggaggccagac

SEQ ID NO: 5045896 - DNA, 22 bp, Homo sapiens
acacggtttaactgtcccagcg

SEQ ID NO: 5045897 - DNA, 22 bp, Homo sapiens
acagatctagttctcttctcct

SEQ ID NO: 5045898 - DNA, 21 bp, Homo sapiens
acaggccgtgggacccaggct

SEQ ID NO: 5045899 - DNA, 18 bp, Homo sapiens
acaggtcttcactgccca

SEQ ID NO: 5045900 - DNA, 13 bp, Homo sapiens
acaggtgcctggg

SEQ ID NO: 5045901 - DNA, 21 bp, Homo sapiens
acaggtgcctggggctggctg

SEQ ID NO: 5045902 - DNA, 23 bp, Homo sapiens
acatagagaactgtcaccctgag

SEQ ID NO: 5045903 - DNA, 23 bp, Homo sapiens
acatcaagtgccagatgttgtct

SEQ ID NO: 5045904 - DNA, 12 bp, Homo sapiens
accagcctgggg

SEQ ID NO: 5045905 - DNA, 21 bp, Homo sapiens
accagcctggggccttcctgg

SEQ ID NO: 5045906 - DNA, 22 bp, Homo sapiens
accatggcacctttgagagagg

SEQ ID NO: 5045907 - DNA, 23 bp, Homo sapiens
acccaacccatgcccctgacaga

SEQ ID NO: 5045908 - DNA, 14 bp, Homo sapiens
acccaggctcccag

SEQ ID NO: 5045909 - DNA, 19 bp, Homo sapiens
acccccaggacctcttcag

SEQ ID NO: 5045910 - DNA, 20 bp, Homo sapiens
accgcctgctacacaggcag

SEQ ID NO: 5045911 - DNA, 22 bp, Homo sapiens
accgcctgctacacaggcagga

SEQ ID NO: 5045912 - DNA, 22 bp, Homo sapiens
accgggcgcatgcctcccaggc

SEQ ID NO: 5045913 - DNA, 16 bp, Homo sapiens
acctcttcagctgctg

SEQ ID NO: 5045914 - DNA, 18 bp, Homo sapiens
acctgagatgctgggagg

SEQ ID NO: 5045915 - DNA, 20 bp, Homo sapiens
acctgagatgctgggagggc

SEQ ID NO: 5045916 - DNA, 14 bp, Homo sapiens
cagcctgcctgaag

SEQ ID NO: 5045917 - DNA, 15 bp, Homo sapiens
cagcctgcctgaaga

SEQ ID NO: 5045918 - DNA, 19 bp, Homo sapiens
cagcctgcctgaagagagg

SEQ ID NO: 5045919 - DNA, 21 bp, Homo sapiens
cagcctgcctgaagagaggaa

SEQ ID NO: 5045920 - DNA, 21 bp, Homo sapiens
cagcctggggccttcctggct

SEQ ID NO: 5045921 - DNA, 22 bp, Homo sapiens
cagcctggggccttcctggctt

SEQ ID NO: 5045922 - DNA, 20 bp, Homo sapiens
cagcctttttcaccatggca

SEQ ID NO: 5045923 - DNA, 14 bp, Homo sapiens
cagctctcccatgg

SEQ ID NO: 5045924 - DNA, 14 bp, Homo sapiens
cagctgctgaggcg

SEQ ID NO: 5045925 - DNA, 14 bp, Homo sapiens
cagctggccggaag

SEQ ID NO: 5045926 - DNA, 19 bp, Homo sapiens
cagctggccggaaggagac

SEQ ID NO: 5045927 - DNA, 21 bp, Homo sapiens
cagcttgtccttgctcctgga

SEQ ID NO: 5045928 - DNA, 20 bp, Homo sapiens
caggcaatgccctgcggctc

SEQ ID NO: 5045929 - DNA, 24 bp, Homo sapiens
caggcaatgccctgcggctctgga

SEQ ID NO: 5045930 - DNA, 14 bp, Homo sapiens
caggcagagttctg

SEQ ID NO: 5045931 - DNA, 18 bp, Homo sapiens
caggcaggggcttggctg

SEQ ID NO: 5045932 - DNA, 18 bp, Homo sapiens
caggccacctcagtctca

SEQ ID NO: 5045933 - DNA, 12 bp, Homo sapiens
caggcccagcct

SEQ ID NO: 5045934 - DNA, 20 bp, Homo sapiens
caggcccagcctctctggct

SEQ ID NO: 5045935 - DNA, 15 bp, Homo sapiens
caggccctgcccagc

SEQ ID NO: 5045936 - DNA, 17 bp, Homo sapiens
caggccctgcccagcca

SEQ ID NO: 5045937 - DNA, 13 bp, Homo sapiens
caggctcccagcc

SEQ ID NO: 5045938 - DNA, 11 bp, Homo sapiens
cagggctctct

SEQ ID NO: 5045939 - DNA, 13 bp, Homo sapiens
cagggctctctgg

SEQ ID NO: 5045940 - DNA, 15 bp, Homo sapiens
cagggctctctggac

SEQ ID NO: 5045941 - DNA, 16 bp, Homo sapiens
cagggctctctggacc

SEQ ID NO: 5045942 - DNA, 19 bp, Homo sapiens
cagggctggccctaggcac

SEQ ID NO: 5045943 - DNA, 20 bp, Homo sapiens
cagggctggccctaggcact

SEQ ID NO: 5045944 - DNA, 19 bp, Homo sapiens
caggggcttggctgcccca

SEQ ID NO: 5045945 - DNA, 16 bp, Homo sapiens
caggtcgggctgccag

SEQ ID NO: 5045946 - DNA, 20 bp, Homo sapiens
caggtcgggctgccagccca

SEQ ID NO: 5045947 - DNA, 18 bp, Homo sapiens
caggtcttcactgcccag

SEQ ID NO: 5045948 - DNA, 16 bp, Homo sapiens
caggtgcctggggctg

SEQ ID NO: 5045949 - DNA, 21 bp, Homo sapiens
caggtgcctggggctggctgc

SEQ ID NO: 5045950 - DNA, 16 bp, Homo sapiens
caggtggtcccatagg

SEQ ID NO: 5045951 - DNA, 22 bp, Homo sapiens
cagtcacaaaccagcctggggc

SEQ ID NO: 5045952 - DNA, 23 bp, Homo sapiens
cagtcacaaaccagcctggggcc

SEQ ID NO: 5045953 - DNA, 19 bp, Homo sapiens
cagtctcacctgccggctc

SEQ ID NO: 5045954 - DNA, 21 bp, Homo sapiens
cagtctcacctgccggctctg

SEQ ID NO: 5045955 - DNA, 13 bp, Homo sapiens
cagtgtggctccc

SEQ ID NO: 5045956 - DNA, 16 bp, Homo sapiens
cagttctcgtgccctt

SEQ ID NO: 5045957 - DNA, 19 bp, Homo sapiens
cagttctcgtgcccttaga

SEQ ID NO: 5045958 - DNA, 22 bp, Homo sapiens
cagttggcctgtgcttggaggc

SEQ ID NO: 5045959 - DNA, 23 bp, Homo sapiens
cagttggcctgtgcttggaggcc

SEQ ID NO: 5045960 - DNA, 20 bp, Homo sapiens
catagagaactgtcaccctg

SEQ ID NO: 5045961 - DNA, 23 bp, Homo sapiens
catagagaactgtcaccctgagg

SEQ ID NO: 5045962 - DNA, 20 bp, Homo sapiens
catatttttaaaacaaacca

SEQ ID NO: 5045963 - DNA, 15 bp, Homo sapiens
catcccagctgctga

SEQ ID NO: 5045964 - DNA, 17 bp, Homo sapiens
catcggaagagagggct

SEQ ID NO: 5045965 - DNA, 13 bp, Homo sapiens
catgcccctgaca

SEQ ID NO: 5045966 - DNA, 15 bp, Homo sapiens
catgcctcccaggcc

SEQ ID NO: 5045967 - DNA, 15 bp, Homo sapiens
catggacatgggcag

SEQ ID NO: 5045968 - DNA, 24 bp, Homo sapiens
catggacatgggcagcaattcacg

SEQ ID NO: 5045969 - DNA, 13 bp, Homo sapiens
catggcggcccct

SEQ ID NO: 5045970 - DNA, 18 bp, Homo sapiens
catggcggcccctcagcc

SEQ ID NO: 5045971 - DNA, 15 bp, Homo sapiens
catgggagtggggag

SEQ ID NO: 5045972 - DNA, 16 bp, Homo sapiens
catgggagtggggagc

SEQ ID NO: 5045973 - DNA, 17 bp, Homo sapiens
cattccagctctcccat

SEQ ID NO: 5045974 - DNA, 14 bp, Homo sapiens
cattgccggcgagt

SEQ ID NO: 5045975 - DNA, 15 bp, Homo sapiens
cattttccccctgtg

SEQ ID NO: 5045976 - DNA, 16 bp, Homo sapiens
ccaatcacccccagga

SEQ ID NO: 5045977 - DNA, 13 bp, Homo sapiens
ccacacagaggac

SEQ ID NO: 5045978 - DNA, 16 bp, Homo sapiens
ccacacagaggacctc

SEQ ID NO: 5045979 - DNA, 22 bp, Homo sapiens
ccaccgggcgcatgcctcccag

SEQ ID NO: 5045980 - DNA, 12 bp, Homo sapiens
ccagacacagag

SEQ ID NO: 5045981 - DNA, 13 bp, Homo sapiens
ccagacacaggcc

SEQ ID NO: 5045982 - DNA, 16 bp, Homo sapiens
ccagacacaggccgtg

SEQ ID NO: 5045983 - DNA, 22 bp, Homo sapiens
ccagaggagagtggcctgggtc

SEQ ID NO: 5045984 - DNA, 14 bp, Homo sapiens
ccagatgttgtctg

SEQ ID NO: 5045985 - DNA, 18 bp, Homo sapiens
ccagatgttgtctgaact

SEQ ID NO: 5045986 - DNA, 17 bp, Homo sapiens
ccagcccagctggccgg

SEQ ID NO: 5045987 - DNA, 14 bp, Homo sapiens
ccagcctaagggag

SEQ ID NO: 5045988 - DNA, 20 bp, Homo sapiens
ccagcctaagggagacaggc

SEQ ID NO: 5045989 - DNA, 18 bp, Homo sapiens
ccagcctctctggctcag

SEQ ID NO: 5045990 - DNA, 15 bp, Homo sapiens
ccagcctggggcctt

SEQ ID NO: 5045991 - DNA, 17 bp, Homo sapiens
ccagcctggggccttcc

SEQ ID NO: 5045992 - DNA, 21 bp, Homo sapiens
ccagcctggggccttcctggc

SEQ ID NO: 5045993 - DNA, 12 bp, Homo sapiens
ccagctcctctc

SEQ ID NO: 5045994 - DNA, 18 bp, Homo sapiens
ccagctcctctccagaca

SEQ ID NO: 5045995 - DNA, 19 bp, Homo sapiens
ccagctcctctccagacac

SEQ ID NO: 5045996 - DNA, 17 bp, Homo sapiens
ccaggcagagttctgtg

SEQ ID NO: 5045997 - DNA, 19 bp, Homo sapiens
ccaggcagagttctgtggc

SEQ ID NO: 5045998 - DNA, 19 bp, Homo sapiens
ccaggctcccagcctaagg

SEQ ID NO: 5045999 - DNA, 12 bp, Homo sapiens
ccagggctggcc

SEQ ID NO: 5046000 - DNA, 22 bp, Homo sapiens
ccagggctggccctaggcactg

SEQ ID NO: 5046001 - DNA, 13 bp, Homo sapiens
ccagtgtggctcc

SEQ ID NO: 5046002 - DNA, 17 bp, Homo sapiens
ccagtgtggctcccaca

SEQ ID NO: 5046003 - DNA, 16 bp, Homo sapiens
ccatacgcggaggagt

SEQ ID NO: 5046004 - DNA, 22 bp, Homo sapiens
ccatcggaagagagggctgagc

SEQ ID NO: 5046005 - DNA, 14 bp, Homo sapiens
ccatgcccctgaca

SEQ ID NO: 5046006 - DNA, 14 bp, Homo sapiens
ccatggacatgggc

SEQ ID NO: 5046007 - DNA, 20 bp, Homo sapiens
ccatggagcccctccaccgg

SEQ ID NO: 5046008 - DNA, 22 bp, Homo sapiens
ccatgggggtttggggctaaga

SEQ ID NO: 5046009 - DNA, 17 bp, Homo sapiens
ccattcacggcctggca

SEQ ID NO: 5046010 - DNA, 23 bp, Homo sapiens
ccattcacggcctggcatgcagc

SEQ ID NO: 5046011 - DNA, 13 bp, Homo sapiens
ccattccagctct

SEQ ID NO: 5046012 - DNA, 17 bp, Homo sapiens
ccattccagctctccca

SEQ ID NO: 5046013 - DNA, 18 bp, Homo sapiens
cccacacagaggacctct

SEQ ID NO: 5046014 - DNA, 23 bp, Homo sapiens
cccacaggtcttcactgcccagg

SEQ ID NO: 5046015 - DNA, 12 bp, Homo sapiens
cccacttgacct

SEQ ID NO: 5046016 - DNA, 14 bp, Homo sapiens
cccacttgacctga

SEQ ID NO: 5046017 - DNA, 20 bp, Homo sapiens
cccagccagccatcggaaga

SEQ ID NO: 5046018 - DNA, 13 bp, Homo sapiens
cccagcctctctg

SEQ ID NO: 5046019 - DNA, 16 bp, Homo sapiens
cccagctgctgaggcg

SEQ ID NO: 5046020 - DNA, 13 bp, Homo sapiens
cccagctggccgg

SEQ ID NO: 5046021 - DNA, 21 bp, Homo sapiens
cccaggacctcttcagctgct

SEQ ID NO: 5046022 - DNA, 23 bp, Homo sapiens
cccaggacctcttcagctgctga

SEQ ID NO: 5046023 - DNA, 16 bp, Homo sapiens
cccaggctcccagcct

SEQ ID NO: 5046024 - DNA, 19 bp, Homo sapiens
cccaggctcccagcctaag

SEQ ID NO: 5046025 - DNA, 13 bp, Homo sapiens
cccagggctggcc

SEQ ID NO: 5046026 - DNA, 20 bp, Homo sapiens
cccagggctggccctaggca

SEQ ID NO: 5046027 - DNA, 17 bp, Homo sapiens
cccattcacggcctggc

SEQ ID NO: 5046028 - DNA, 18 bp, Homo sapiens
cccattcacggcctggca

SEQ ID NO: 5046029 - DNA, 22 bp, Homo sapiens
cccattcacggcctggcatgca

SEQ ID NO: 5046030 - DNA, 15 bp, Homo sapiens
cccattttccccctg

SEQ ID NO: 5046031 - DNA, 17 bp, Homo sapiens
ccccaaggatggggttc

SEQ ID NO: 5046032 - DNA, 15 bp, Homo sapiens
ccccagttcccttgg

SEQ ID NO: 5046033 - DNA, 20 bp, Homo sapiens
ccccgcggatcaaccaggca

SEQ ID NO: 5046034 - DNA, 11 bp, Homo sapiens
cccctcctgta

SEQ ID NO: 5046035 - DNA, 24 bp, Homo sapiens
cccctgacagatctagttctcttc

SEQ ID NO: 5046036 - DNA, 13 bp, Homo sapiens
cccgggagctttg

SEQ ID NO: 5046037 - DNA, 13 bp, Homo sapiens
cccgggatcctga

SEQ ID NO: 5046038 - DNA, 14 bp, Homo sapiens
ccctcagcctgcct

SEQ ID NO: 5046039 - DNA, 19 bp, Homo sapiens
ccctcagcctgcctgaaga

SEQ ID NO: 5046040 - DNA, 20 bp, Homo sapiens
ccctcccacttgacctgaga

SEQ ID NO: 5046041 - DNA, 22 bp, Homo sapiens
ccctgaacaagagtgtctatgg

SEQ ID NO: 5046042 - DNA, 13 bp, Homo sapiens
ccctgcccagcca

SEQ ID NO: 5046043 - DNA, 17 bp, Homo sapiens
ccctgcccagccagcca

SEQ ID NO: 5046044 - DNA, 20 bp, Homo sapiens
ccctgccggccccccaagga

SEQ ID NO: 5046045 - DNA, 15 bp, Homo sapiens
ccctgcggctctgga

SEQ ID NO: 5046046 - DNA, 16 bp, Homo sapiens
ccctgcggctctggaa

SEQ ID NO: 5046047 - DNA, 19 bp, Homo sapiens
cccttagcttttagcctgg

SEQ ID NO: 5046048 - DNA, 23 bp, Homo sapiens
cccttagcttttagcctggctgt

SEQ ID NO: 5046049 - DNA, 19 bp, Homo sapiens
ccgagctgtcggagggctg

SEQ ID NO: 5046050 - DNA, 20 bp, Homo sapiens
ccgcctgctacacaggcagg

SEQ ID NO: 5046051 - DNA, 21 bp, Homo sapiens
ccgcctgctacacaggcagga

SEQ ID NO: 5046052 - DNA, 19 bp, Homo sapiens
ccgcggatcaaccaggcag

SEQ ID NO: 5046053 - DNA, 20 bp, Homo sapiens
ccgcggatcaaccaggcaga

SEQ ID NO: 5046054 - DNA, 14 bp, Homo sapiens
ccggctctgggctg

SEQ ID NO: 5046055 - DNA, 23 bp, Homo sapiens
ccgggcgcatgcctcccaggcca

SEQ ID NO: 5046056 - DNA, 17 bp, Homo sapiens
ccgtgggacccaggctc

SEQ ID NO: 5046057 - DNA, 23 bp, Homo sapiens
ccgtgggacccaggctcccagcc

SEQ ID NO: 5046058 - DNA, 15 bp, Homo sapiens
cctaagggagacagg

SEQ ID NO: 5046059 - DNA, 18 bp, Homo sapiens
cctaagggagacaggcct

SEQ ID NO: 5046060 - DNA, 22 bp, Homo sapiens
cctatttttgtagatctccatg

SEQ ID NO: 5046061 - DNA, 19 bp, Homo sapiens
cctcacacacggaggccag

SEQ ID NO: 5046062 - DNA, 18 bp, Homo sapiens
cctcagcctgcctgaaga

SEQ ID NO: 5046063 - DNA, 19 bp, Homo sapiens
cctcagcctgcctgaagag

SEQ ID NO: 5046064 - DNA, 20 bp, Homo sapiens
cctcagcctgcctgaagaga

SEQ ID NO: 5046065 - DNA, 22 bp, Homo sapiens
cctcagcctgcctgaagagagg

SEQ ID NO: 5046066 - DNA, 22 bp, Homo sapiens
cctcagtctcacctgccggctc

SEQ ID NO: 5046067 - DNA, 23 bp, Homo sapiens
cctcagtctcacctgccggctct

SEQ ID NO: 5046068 - DNA, 11 bp, Homo sapiens
cctcccaggcc

SEQ ID NO: 5046069 - DNA, 19 bp, Homo sapiens
cctcctgggtgctcaccgc

SEQ ID NO: 5046070 - DNA, 13 bp, Homo sapiens
cctctccagacac

SEQ ID NO: 5046071 - DNA, 21 bp, Homo sapiens
cctctccagacacagagacat

SEQ ID NO: 5046072 - DNA, 16 bp, Homo sapiens
cctcttcagctgctga

SEQ ID NO: 5046073 - DNA, 17 bp, Homo sapiens
cctgagatgctgggagg

SEQ ID NO: 5046074 - DNA, 19 bp, Homo sapiens
cctgagatgctgggagggc

SEQ ID NO: 5046075 - DNA, 14 bp, Homo sapiens
cctgagcaggcagg

SEQ ID NO: 5046076 - DNA, 19 bp, Homo sapiens
cctgatggcacccacacag

SEQ ID NO: 5046077 - DNA, 12 bp, Homo sapiens
cctgcccagcca

SEQ ID NO: 5046078 - DNA, 13 bp, Homo sapiens
cctgcccagccag

SEQ ID NO: 5046079 - DNA, 15 bp, Homo sapiens
cctgccggctctggg

SEQ ID NO: 5046080 - DNA, 20 bp, Homo sapiens
cctgccggctctgggctggc

SEQ ID NO: 5046081 - DNA, 16 bp, Homo sapiens
cctgcctgaagagagg

SEQ ID NO: 5046082 - DNA, 13 bp, Homo sapiens
cctgcgccctgtg

SEQ ID NO: 5046083 - DNA, 15 bp, Homo sapiens
cctgcgccctgtgca

SEQ ID NO: 5046084 - DNA, 13 bp, Homo sapiens
cctgcggctctgg

SEQ ID NO: 5046085 - DNA, 14 bp, Homo sapiens
cctgcggctctgga

SEQ ID NO: 5046086 - DNA, 18 bp, Homo sapiens
cctgcggctctggaaagc

SEQ ID NO: 5046087 - DNA, 17 bp, Homo sapiens
cctgctacacaggcagg

SEQ ID NO: 5046088 - DNA, 20 bp, Homo sapiens
cctggaacctggcaggccct

SEQ ID NO: 5046089 - DNA, 22 bp, Homo sapiens
cctggaacctggcaggccctgc

SEQ ID NO: 5046090 - DNA, 23 bp, Homo sapiens
cctggaacctggcaggccctgcc

SEQ ID NO: 5046091 - DNA, 20 bp, Homo sapiens
cctggcaggccctgcccagc

SEQ ID NO: 5046092 - DNA, 13 bp, Homo sapiens
cctggctggccag

SEQ ID NO: 5046093 - DNA, 23 bp, Homo sapiens
cctggctggccaggacacactga

SEQ ID NO: 5046094 - DNA, 21 bp, Homo sapiens
cctggggccttcctggctttg

SEQ ID NO: 5046095 - DNA, 15 bp, Homo sapiens
cctggggctggctgc

SEQ ID NO: 5046096 - DNA, 16 bp, Homo sapiens
cctggggctggctgca

SEQ ID NO: 5046097 - DNA, 17 bp, Homo sapiens
cctgggtcccagggctg

SEQ ID NO: 5046098 - DNA, 18 bp, Homo sapiens
cctgggtcccagggctgg

SEQ ID NO: 5046099 - DNA, 19 bp, Homo sapiens
cctgggtcccagggctggc

SEQ ID NO: 5046100 - DNA, 19 bp, Homo sapiens
cctgtgacctggtctggtc

SEQ ID NO: 5046101 - DNA, 20 bp, Homo sapiens
cctgtgcttggaggcctcag

SEQ ID NO: 5046102 - DNA, 22 bp, Homo sapiens
ccttagcttttagcctggctgt

SEQ ID NO: 5046103 - DNA, 12 bp, Homo sapiens
ccttgctcctgg

SEQ ID NO: 5046104 - DNA, 16 bp, Homo sapiens
ccttgctcctggaacc

SEQ ID NO: 5046105 - DNA, 21 bp, Homo sapiens
ccttgctcctggaacctggca

SEQ ID NO: 5046106 - DNA, 12 bp, Homo sapiens
cgaagcctgagc

SEQ ID NO: 5046107 - DNA, 18 bp, Homo sapiens
cgaagcctgagcaggcag

SEQ ID NO: 5046108 - DNA, 18 bp, Homo sapiens
cgatctcccagggctctc

SEQ ID NO: 5046109 - DNA, 16 bp, Homo sapiens
cgcatgcctcccaggc

SEQ ID NO: 5046110 - DNA, 19 bp, Homo sapiens
cgcatgcctcccaggccac

SEQ ID NO: 5046111 - DNA, 19 bp, Homo sapiens
cgccctgtgcagggaaagg

SEQ ID NO: 5046112 - DNA, 23 bp, Homo sapiens
cgccgagctgtcggagggctgga

SEQ ID NO: 5046113 - DNA, 14 bp, Homo sapiens
cgccgcgtggacag

SEQ ID NO: 5046114 - DNA, 16 bp, Homo sapiens
cgcctgctacacaggc

SEQ ID NO: 5046115 - DNA, 20 bp, Homo sapiens
cgcctgctacacaggcagga

SEQ ID NO: 5046116 - DNA, 15 bp, Homo sapiens
cggaagagagggctg

SEQ ID NO: 5046117 - DNA, 19 bp, Homo sapiens
cggaagagagggctgagcc

SEQ ID NO: 5046118 - DNA, 20 bp, Homo sapiens
cggaagagagggctgagcca

SEQ ID NO: 5046119 - DNA, 22 bp, Homo sapiens
cggaagagagggctgagccatg

SEQ ID NO: 5046120 - DNA, 14 bp, Homo sapiens
cggaagtctgttct

SEQ ID NO: 5046121 - DNA, 16 bp, Homo sapiens
cggagcagttggcctg

SEQ ID NO: 5046122 - DNA, 20 bp, Homo sapiens
cggagcttggccctgcgccc

SEQ ID NO: 5046123 - DNA, 22 bp, Homo sapiens
gccatcggaagagagggctgag

SEQ ID NO: 5046124 - DNA, 23 bp, Homo sapiens
gcccagccagccatcggaagaga

SEQ ID NO: 5046125 - DNA, 15 bp, Homo sapiens
gcccagcctctctgg

SEQ ID NO: 5046126 - DNA, 16 bp, Homo sapiens
gcccagcctctctggc

SEQ ID NO: 5046127 - DNA, 18 bp, Homo sapiens
gcccagcctctctggctc

SEQ ID NO: 5046128 - DNA, 22 bp, Homo sapiens
gcccagttctcgtgcccttaga

SEQ ID NO: 5046129 - DNA, 15 bp, Homo sapiens
gccccattccagctc

SEQ ID NO: 5046130 - DNA, 23 bp, Homo sapiens
gccccattccagctctcccatgg

SEQ ID NO: 5046131 - DNA, 19 bp, Homo sapiens
gccccctattgtctccaag

SEQ ID NO: 5046132 - DNA, 21 bp, Homo sapiens
gccccctattgtctccaaggt

SEQ ID NO: 5046133 - DNA, 13 bp, Homo sapiens
gcccctcagcctg

SEQ ID NO: 5046134 - DNA, 18 bp, Homo sapiens
gcccctcagcctgcctga

SEQ ID NO: 5046135 - DNA, 19 bp, Homo sapiens
gcccctcctgggtgctcac

SEQ ID NO: 5046136 - DNA, 21 bp, Homo sapiens
gcccgggagctttgagacagg

SEQ ID NO: 5046137 - DNA, 13 bp, Homo sapiens
gccctgagccatg

SEQ ID NO: 5046138 - DNA, 13 bp, Homo sapiens
gccctgcccagcc

SEQ ID NO: 5046139 - DNA, 17 bp, Homo sapiens
gccctgcgccctgtgca

SEQ ID NO: 5046140 - DNA, 20 bp, Homo sapiens
gccctgcggctctggaaagc

SEQ ID NO: 5046141 - DNA, 14 bp, Homo sapiens
gccctgtgcaggga

SEQ ID NO: 5046142 - DNA, 15 bp, Homo sapiens
gcccttagaggggaa

SEQ ID NO: 5046143 - DNA, 17 bp, Homo sapiens
gccggctctgggctggc

SEQ ID NO: 5046144 - DNA, 20 bp, Homo sapiens
gccggctctgggctggctgc

SEQ ID NO: 5046145 - DNA, 16 bp, Homo sapiens
gccgtgggacccaggc

SEQ ID NO: 5046146 - DNA, 18 bp, Homo sapiens
gccgtgggacccaggctc

SEQ ID NO: 5046147 - DNA, 22 bp, Homo sapiens
gccgtgggacccaggctcccag

SEQ ID NO: 5046148 - DNA, 19 bp, Homo sapiens
gcctaagggagacaggcct

SEQ ID NO: 5046149 - DNA, 13 bp, Homo sapiens
gcctcccaggcca

SEQ ID NO: 5046150 - DNA, 14 bp, Homo sapiens
gcctcccaggccac

SEQ ID NO: 5046151 - DNA, 22 bp, Homo sapiens
gcctctctggctcagcccggga

SEQ ID NO: 5046152 - DNA, 13 bp, Homo sapiens
gcctgagcaggca

SEQ ID NO: 5046153 - DNA, 16 bp, Homo sapiens
gcctgcctgaagagag

SEQ ID NO: 5046154 - DNA, 22 bp, Homo sapiens
gcctgcctgaagagaggaaact

SEQ ID NO: 5046155 - DNA, 18 bp, Homo sapiens
gcctgctacacaggcagg

SEQ ID NO: 5046156 - DNA, 13 bp, Homo sapiens
gcctggggctggc

SEQ ID NO: 5046157 - DNA, 19 bp, Homo sapiens
gcctggggctggctgcaga

SEQ ID NO: 5046158 - DNA, 15 bp, Homo sapiens
gcctgggtcccaggg

SEQ ID NO: 5046159 - DNA, 13 bp, Homo sapiens
gcctgtgcttgga

SEQ ID NO: 5046160 - DNA, 16 bp, Homo sapiens
gcctgtgcttggaggc

SEQ ID NO: 5046161 - DNA, 18 bp, Homo sapiens
gcctgtgcttggaggcct

SEQ ID NO: 5046162 - DNA, 17 bp, Homo sapiens
gccttcctggctttggg

SEQ ID NO: 5046163 - DNA, 18 bp, Homo sapiens
gcgaagcctgagcaggca

SEQ ID NO: 5046164 - DNA, 16 bp, Homo sapiens
gcgacatttctccaag

SEQ ID NO: 5046165 - DNA, 12 bp, Homo sapiens
gcgatctcccag

SEQ ID NO: 5046166 - DNA, 17 bp, Homo sapiens
gcgcatgcctcccaggc

SEQ ID NO: 5046167 - DNA, 15 bp, Homo sapiens
gcgccgcgtggacag

SEQ ID NO: 5046168 - DNA, 17 bp, Homo sapiens
gcgccgcgtggacagcc

SEQ ID NO: 5046169 - DNA, 17 bp, Homo sapiens
gcggagcttggccctgc

SEQ ID NO: 5046170 - DNA, 18 bp, Homo sapiens
gcggagcttggccctgcg

SEQ ID NO: 5046171 - DNA, 16 bp, Homo sapiens
gcggatcaaccaggca

SEQ ID NO: 5046172 - DNA, 19 bp, Homo sapiens
gcggatcaaccaggcagag

SEQ ID NO: 5046173 - DNA, 15 bp, Homo sapiens
gcggcccctcagcct

SEQ ID NO: 5046174 - DNA, 21 bp, Homo sapiens
gctaagaagttcaccagccct

SEQ ID NO: 5046175 - DNA, 23 bp, Homo sapiens
gctaagaagttcaccagccctga

SEQ ID NO: 5046176 - DNA, 13 bp, Homo sapiens
gctcactctggcc

SEQ ID NO: 5046177 - DNA, 11 bp, Homo sapiens
gctcccagcct

SEQ ID NO: 5046178 - DNA, 16 bp, Homo sapiens
gctcctctccagacac

SEQ ID NO: 5046179 - DNA, 19 bp, Homo sapiens
gctcctggaacctggcagg

SEQ ID NO: 5046180 - DNA, 19 bp, Homo sapiens
gctctcaaggcttggagag

SEQ ID NO: 5046181 - DNA, 15 bp, Homo sapiens
gctctgggctggctg

SEQ ID NO: 5046182 - DNA, 19 bp, Homo sapiens
gctctgggctggctgctcc

SEQ ID NO: 5046183 - DNA, 13 bp, Homo sapiens
gctgaagggggca

SEQ ID NO: 5046184 - DNA, 16 bp, Homo sapiens
gctgccagcccagctg

SEQ ID NO: 5046185 - DNA, 19 bp, Homo sapiens
gctgccagcccagctggcc

SEQ ID NO: 5046186 - DNA, 21 bp, Homo sapiens
gctgccagcccagctggccgg

SEQ ID NO: 5046187 - DNA, 20 bp, Homo sapiens
gctggacatttgtggcagtg

SEQ ID NO: 5046188 - DNA, 12 bp, Homo sapiens
gctggccaggac

SEQ ID NO: 5046189 - DNA, 16 bp, Homo sapiens
gctggccaggacacac

SEQ ID NO: 5046190 - DNA, 12 bp, Homo sapiens
gctggccctagg

SEQ ID NO: 5046191 - DNA, 17 bp, Homo sapiens
gctggccctaggcactg

SEQ ID NO: 5046192 - DNA, 17 bp, Homo sapiens
gctggccggaaggagac

SEQ ID NO: 5046193 - DNA, 16 bp, Homo sapiens
gctgggagggctgaac

SEQ ID NO: 5046194 - DNA, 15 bp, Homo sapiens
gctgtcggagggctg

SEQ ID NO: 5046195 - DNA, 22 bp, Homo sapiens
gcttccagaggagagtggcctg

SEQ ID NO: 5046196 - DNA, 12 bp, Homo sapiens
gcttggaggcct

SEQ ID NO: 5046197 - DNA, 16 bp, Homo sapiens
gcttggaggcctcaga

SEQ ID NO: 5046198 - DNA, 13 bp, Homo sapiens
gcttggccctgcg

SEQ ID NO: 5046199 - DNA, 15 bp, Homo sapiens
gcttggccctgcgcc

SEQ ID NO: 5046200 - DNA, 17 bp, Homo sapiens
gcttgtccttgctcctg

SEQ ID NO: 5046201 - DNA, 22 bp, Homo sapiens
gctttgagacaggtgcctgggg

SEQ ID NO: 5046202 - DNA, 16 bp, Homo sapiens
gctttgctctcaaggc

SEQ ID NO: 5046203 - DNA, 21 bp, Homo sapiens
gctttgctctcaaggcttgga

SEQ ID NO: 5046204 - DNA, 22 bp, Homo sapiens
gctttgctctcaaggcttggag

SEQ ID NO: 5046205 - DNA, 15 bp, Homo sapiens
gcttttagcctggct

SEQ ID NO: 5046206 - DNA, 21 bp, Homo sapiens
ggaaactggcgatctcccagg

SEQ ID NO: 5046207 - DNA, 22 bp, Homo sapiens
ggaaagcaacttcatcccagct

SEQ ID NO: 5046208 - DNA, 18 bp, Homo sapiens
ggaaagggatggtcaggc

SEQ ID NO: 5046209 - DNA, 22 bp, Homo sapiens
ggaaagggatggtcaggcccag

SEQ ID NO: 5046210 - DNA, 12 bp, Homo sapiens
ggaaatcctatt

SEQ ID NO: 5046211 - DNA, 12 bp, Homo sapiens
ggaacctggcag

SEQ ID NO: 5046212 - DNA, 13 bp, Homo sapiens
ggaacctggcagg

SEQ ID NO: 5046213 - DNA, 18 bp, Homo sapiens
ggaacctggcaggccctg

SEQ ID NO: 5046214 - DNA, 15 bp, Homo sapiens
ggaagagagggctga

SEQ ID NO: 5046215 - DNA, 21 bp, Homo sapiens
ggaagagagggctgagccatg

SEQ ID NO: 5046216 - DNA, 22 bp, Homo sapiens
ggaagagagggctgagccatgg

SEQ ID NO: 5046217 - DNA, 16 bp, Homo sapiens
ggaatgaaccatggca

SEQ ID NO: 5046218 - DNA, 17 bp, Homo sapiens
ggaatgaaccatggcac

SEQ ID NO: 5046219 - DNA, 17 bp, Homo sapiens
ggacacaagggtgcaag

SEQ ID NO: 5046220 - DNA, 21 bp, Homo sapiens
ggacacaagggtgcaagcccc

SEQ ID NO: 5046221 - DNA, 21 bp, Homo sapiens
ggacacggtttaactgtccca

SEQ ID NO: 5046222 - DNA, 23 bp, Homo sapiens
ggacacggtttaactgtcccagc

SEQ ID NO: 5046223 - DNA, 20 bp, Homo sapiens
ggacagacatcaagtgccag

SEQ ID NO: 5046224 - DNA, 15 bp, Homo sapiens
ggacagcccgggagc

SEQ ID NO: 5046225 - DNA, 16 bp, Homo sapiens
ggacagcccgggagct

SEQ ID NO: 5046226 - DNA, 13 bp, Homo sapiens
ggacagccggagc

SEQ ID NO: 5046227 - DNA, 17 bp, Homo sapiens
tcccagggctggcccta

SEQ ID NO: 5046228 - DNA, 12 bp, Homo sapiens
tcccctcctgta

SEQ ID NO: 5046229 - DNA, 24 bp, Homo sapiens
tcctatttttgtagatctccatgc

SEQ ID NO: 5046230 - DNA, 18 bp, Homo sapiens
tcctggaacctggcaggc

SEQ ID NO: 5046231 - DNA, 15 bp, Homo sapiens
tcctgggtgctcacc

SEQ ID NO: 5046232 - DNA, 22 bp, Homo sapiens
tcctgggtgctcaccgcctgct

SEQ ID NO: 5046233 - DNA, 13 bp, Homo sapiens
tccttgctcctgg

SEQ ID NO: 5046234 - DNA, 19 bp, Homo sapiens
tcggaagagagggctgagc

SEQ ID NO: 5046235 - DNA, 13 bp, Homo sapiens
tcggagggctgga

SEQ ID NO: 5046236 - DNA, 18 bp, Homo sapiens
tcggcctggctggccagg

SEQ ID NO: 5046237 - DNA, 16 bp, Homo sapiens
tctagttctcttctcc

SEQ ID NO: 5046238 - DNA, 18 bp, Homo sapiens
tctagttctcttctcctg

SEQ ID NO: 5046239 - DNA, 19 bp, Homo sapiens
tctagttctcttctcctgt

SEQ ID NO: 5046240 - DNA, 19 bp, Homo sapiens
tctatggagcagccggaag

SEQ ID NO: 5046241 - DNA, 21 bp, Homo sapiens
tctcacctgccggctctgggc

SEQ ID NO: 5046242 - DNA, 12 bp, Homo sapiens
tctcccagggct

SEQ ID NO: 5046243 - DNA, 15 bp, Homo sapiens
tctcccatggagccc

SEQ ID NO: 5046244 - DNA, 21 bp, Homo sapiens
tctcttcttaaccctgaacaa

SEQ ID NO: 5046245 - DNA, 22 bp, Homo sapiens
tctggaccatacgcggaggagt

SEQ ID NO: 5046246 - DNA, 24 bp, Homo sapiens
tctggccccctattgtctccaagg

SEQ ID NO: 5046247 - DNA, 23 bp, Homo sapiens
tctgtgtggtctccagctcctct

SEQ ID NO: 5046248 - DNA, 14 bp, Homo sapiens
tcttcactgcccag

SEQ ID NO: 5046249 - DNA, 18 bp, Homo sapiens
tcttcagctgctgacaat

SEQ ID NO: 5046250 - DNA, 15 bp, Homo sapiens
tcttcttaaccctga

SEQ ID NO: 5046251 - DNA, 22 bp, Homo sapiens
tcttgtccacggggctcactct

SEQ ID NO: 5046252 - DNA, 22 bp, Homo sapiens
tctttggggcaagatccaggtg

SEQ ID NO: 5046253 - DNA, 17 bp, Homo sapiens
tgaaaaggctttttcag

SEQ ID NO: 5046254 - DNA, 14 bp, Homo sapiens
tgacaatcctattt

SEQ ID NO: 5046255 - DNA, 18 bp, Homo sapiens
tgacagatctagttctct

SEQ ID NO: 5046256 - DNA, 18 bp, Homo sapiens
tgacctggtctggtcagg

SEQ ID NO: 5046257 - DNA, 18 bp, Homo sapiens
tgagagagggggcactgt

SEQ ID NO: 5046258 - DNA, 19 bp, Homo sapiens
tgagagagggggcactgtg

SEQ ID NO: 5046259 - DNA, 18 bp, Homo sapiens
tgagcaaagaactaagga

SEQ ID NO: 5046260 - DNA, 12 bp, Homo sapiens
tgagtccagtgt

SEQ ID NO: 5046261 - DNA, 13 bp, Homo sapiens
tgagtccagtgtg

SEQ ID NO: 5046262 - DNA, 15 bp, Homo sapiens
tgcacaatgaccagc

SEQ ID NO: 5046263 - DNA, 21 bp, Homo sapiens
tgcagcttgtccttgctcctg

SEQ ID NO: 5046264 - DNA, 23 bp, Homo sapiens
tgcagcttgtccttgctcctgga

SEQ ID NO: 5046265 - DNA, 24 bp, Homo sapiens
tgcagcttgtccttgctcctggaa

SEQ ID NO: 5046266 - DNA, 15 bp, Homo sapiens
tgccagatgttgtct

SEQ ID NO: 5046267 - DNA, 19 bp, Homo sapiens
tgccagcccagctggccgg

SEQ ID NO: 5046268 - DNA, 17 bp, Homo sapiens
tgccctgcggctctgga

SEQ ID NO: 5046269 - DNA, 14 bp, Homo sapiens
tgccggctctgggc

SEQ ID NO: 5046270 - DNA, 16 bp, Homo sapiens
tgccggctctgggctg

SEQ ID NO: 5046271 - DNA, 20 bp, Homo sapiens
tgccggctctgggctggctg

SEQ ID NO: 5046272 - DNA, 13 bp, Homo sapiens
tgcctggggctgg

SEQ ID NO: 5046273 - DNA, 20 bp, Homo sapiens
tgcctggggctggctgcaga

SEQ ID NO: 5046274 - DNA, 15 bp, Homo sapiens
tgccttttcttcccc

SEQ ID NO: 5046275 - DNA, 16 bp, Homo sapiens
tgcggttgggaggcag

SEQ ID NO: 5046276 - DNA, 14 bp, Homo sapiens
tgctacacaggcag

SEQ ID NO: 5046277 - DNA, 15 bp, Homo sapiens
tgctcaccgcctgct

SEQ ID NO: 5046278 - DNA, 18 bp, Homo sapiens
tgctcctggaacctggca

SEQ ID NO: 5046279 - DNA, 15 bp, Homo sapiens
tgcttggaggcctca

SEQ ID NO: 5046280 - DNA, 13 bp, Homo sapiens
tggaacctggcag

SEQ ID NO: 5046281 - DNA, 21 bp, Homo sapiens
tggaatccagtgtggctccca

SEQ ID NO: 5046282 - DNA, 12 bp, Homo sapiens
tggacagcccgg

SEQ ID NO: 5046283 - DNA, 16 bp, Homo sapiens
tggacagccggagcag

SEQ ID NO: 5046284 - DNA, 17 bp, Homo sapiens
tggacagccggagcagt

SEQ ID NO: 5046285 - DNA, 14 bp, Homo sapiens
tggacatgggcagc

SEQ ID NO: 5046286 - DNA, 16 bp, Homo sapiens
tggacatgggcagcaa

SEQ ID NO: 5046287 - DNA, 13 bp, Homo sapiens
tggagcagccgga

SEQ ID NO: 5046288 - DNA, 21 bp, Homo sapiens
tggcacccacacagaggacct

SEQ ID NO: 5046289 - DNA, 16 bp, Homo sapiens
tggcagtgctgaaggg

SEQ ID NO: 5046290 - DNA, 22 bp, Homo sapiens
tggccaggacacactgaaaagc

SEQ ID NO: 5046291 - DNA, 15 bp, Homo sapiens
tggccctaggcactg

SEQ ID NO: 5046292 - DNA, 22 bp, Homo sapiens
tggcctgggtcccagggctggc

SEQ ID NO: 5046293 - DNA, 18 bp, Homo sapiens
tggcctgtgcttggaggc

SEQ ID NO: 5046294 - DNA, 19 bp, Homo sapiens
tggcctgtgcttggaggcc

SEQ ID NO: 5046295 - DNA, 17 bp, Homo sapiens
tggcgaagcctgagcag

SEQ ID NO: 5046296 - DNA, 22 bp, Homo sapiens
tggcgaagcctgagcaggcagg

SEQ ID NO: 5046297 - DNA, 19 bp, Homo sapiens
tggcgccgcgtggacagcc

SEQ ID NO: 5046298 - DNA, 13 bp, Homo sapiens
tggctcagcccgg

SEQ ID NO: 5046299 - DNA, 15 bp, Homo sapiens
tggctcagcccggga

SEQ ID NO: 5046300 - DNA, 18 bp, Homo sapiens
tggctgccccattccagc

SEQ ID NO: 5046301 - DNA, 12 bp, Homo sapiens
tgggaggcaggt

SEQ ID NO: 5046302 - DNA, 19 bp, Homo sapiens
tgggaggcaggtcgggctg

SEQ ID NO: 5046303 - DNA, 19 bp, Homo sapiens
tgggcagcaattcacgctg

SEQ ID NO: 5046304 - DNA, 12 bp, Homo sapiens
tgggcctcagcc

SEQ ID NO: 5046305 - DNA, 13 bp, Homo sapiens
tgggctggctgct

SEQ ID NO: 5046306 - DNA, 18 bp, Homo sapiens
tggggcaagatccaggtg

SEQ ID NO: 5046307 - DNA, 17 bp, Homo sapiens
tggggccttcctggctt

SEQ ID NO: 5046308 - DNA, 14 bp, Homo sapiens
tggggctggctgca

SEQ ID NO: 5046309 - DNA, 20 bp, Homo sapiens
tggtcaggcaatgccctgcg

SEQ ID NO: 5046310 - DNA, 16 bp, Homo sapiens
tggtctggtcaggcaa

SEQ ID NO: 5046311 - DNA, 19 bp, Homo sapiens
tggtggcaaccccagaccc

SEQ ID NO: 5046312 - DNA, 18 bp, Homo sapiens
tgtaagagtattaacaaa

SEQ ID NO: 5046313 - DNA, 15 bp, Homo sapiens
tgtcacctttttaat

SEQ ID NO: 5046314 - DNA, 23 bp, Homo sapiens
tgtccacggggctcactctggcc

SEQ ID NO: 5046315 - DNA, 14 bp, Homo sapiens
tgtccttgctcctg

SEQ ID NO: 5046316 - DNA, 15 bp, Homo sapiens
tgtccttgctcctgg

SEQ ID NO: 5046317 - DNA, 14 bp, Homo sapiens
tgtcggagggctgg

SEQ ID NO: 5046318 - DNA, 19 bp, Homo sapiens
tgtctcttcttaaccctga

SEQ ID NO: 5046319 - DNA, 15 bp, Homo sapiens
tgtgacctggtctgg

SEQ ID NO: 5046320 - DNA, 17 bp, Homo sapiens
tgtgcccctcctgggtg

SEQ ID NO: 5046321 - DNA, 19 bp, Homo sapiens
tgtgcttggaggcctcaga

SEQ ID NO: 5046322 - DNA, 16 bp, Homo sapiens
tgtggacagcccggga

SEQ ID NO: 5046323 - DNA, 13 bp, Homo sapiens
tgtggcagtgctg

SEQ ID NO: 5046324 - DNA, 18 bp, Homo sapiens
tgtggcagtgctgaaggg

SEQ ID NO: 5046325 - DNA, 17 bp, Homo sapiens
tgtggcgccgcgtggac

SEQ ID NO: 5046326 - DNA, 19 bp, Homo sapiens
tgtggcgccgcgtggacag

SEQ ID NO: 5046327 - DNA, 20 bp, Homo sapiens
tgtggcgccgcgtggacagc

SEQ ID NO: 5046328 - DNA, 17 bp, Homo sapiens
tgtggtcaggcccagcc

SEQ ID NO: 5046329 - DNA, 19 bp, Homo sapiens
tgtggtcaggcccagcctc

SEQ ID NO: 5046330 - DNA, 14 bp, Homo sapiens
tgtggtctccagct

SEQ ID NO: 5046331 - DNA, 13 bp, Homo sapiens
gcccagctggccg

SEQ ID NO: 5046332 - DNA, 14 bp, Homo sapiens
gcccagctggccgg

SEQ ID NO: 5046333 - DNA, 19 bp, Homo sapiens
gcccagctggccggaagga

SEQ ID NO: 5046334 - DNA, 21 bp, Homo sapiens
gccccattcacggcctggcat

SEQ ID NO: 5046335 - DNA, 23 bp, Homo sapiens
gccccgcggatcaaccaggcaga

SEQ ID NO: 5046336 - DNA, 21 bp, Homo sapiens
gcccctcagcctgcctgaaga

SEQ ID NO: 5046337 - DNA, 13 bp, Homo sapiens
gcccgggatcctg

SEQ ID NO: 5046338 - DNA, 15 bp, Homo sapiens
gccctgagccatggc

SEQ ID NO: 5046339 - DNA, 20 bp, Homo sapiens
gccctgagccatggcggccc

SEQ ID NO: 5046340 - DNA, 12 bp, Homo sapiens
gccctgcccagc

SEQ ID NO: 5046341 - DNA, 18 bp, Homo sapiens
gccctgcgccctgtgcag

SEQ ID NO: 5046342 - DNA, 14 bp, Homo sapiens
gccctgcggctctg

SEQ ID NO: 5046343 - DNA, 15 bp, Homo sapiens
gccctgcggctctgg

SEQ ID NO: 5046344 - DNA, 19 bp, Homo sapiens
gccctgcggctctggaaag

SEQ ID NO: 5046345 - DNA, 20 bp, Homo sapiens
gccgagctgtcggagggctg

SEQ ID NO: 5046346 - DNA, 13 bp, Homo sapiens
gccgcgtggacag

SEQ ID NO: 5046347 - DNA, 14 bp, Homo sapiens
gccgcgtggacagc

SEQ ID NO: 5046348 - DNA, 15 bp, Homo sapiens
gccggaaggagactg

SEQ ID NO: 5046349 - DNA, 16 bp, Homo sapiens
gccggaagtctgttct

SEQ ID NO: 5046350 - DNA, 16 bp, Homo sapiens
gccggctctgggctgg

SEQ ID NO: 5046351 - DNA, 21 bp, Homo sapiens
gccggctctgggctggctgct

SEQ ID NO: 5046352 - DNA, 24 bp, Homo sapiens
gccggctctgggctggctgctcct

SEQ ID NO: 5046353 - DNA, 21 bp, Homo sapiens
gccgtgggacccaggctccca

SEQ ID NO: 5046354 - DNA, 16 bp, Homo sapiens
gcctaagggagacagg

SEQ ID NO: 5046355 - DNA, 22 bp, Homo sapiens
gcctcagatagacctgtgacct

SEQ ID NO: 5046356 - DNA, 12 bp, Homo sapiens
gcctcccaggcc

SEQ ID NO: 5046357 - DNA, 14 bp, Homo sapiens
gcctctctggctca

SEQ ID NO: 5046358 - DNA, 14 bp, Homo sapiens
gcctgaagagagga

SEQ ID NO: 5046359 - DNA, 18 bp, Homo sapiens
gcctgaagagaggaaact

SEQ ID NO: 5046360 - DNA, 16 bp, Homo sapiens
gcctgagcaggcaggg

SEQ ID NO: 5046361 - DNA, 19 bp, Homo sapiens
gcctgagcaggcaggggct

SEQ ID NO: 5046362 - DNA, 13 bp, Homo sapiens
gcctgcctgaaga

SEQ ID NO: 5046363 - DNA, 14 bp, Homo sapiens
gcctgcctgaagag

SEQ ID NO: 5046364 - DNA, 18 bp, Homo sapiens
gcctgcctgaagagagga

SEQ ID NO: 5046365 - DNA, 19 bp, Homo sapiens
gcctgcctgaagagaggaa

SEQ ID NO: 5046366 - DNA, 14 bp, Homo sapiens
gcctggctggccag

SEQ ID NO: 5046367 - DNA, 16 bp, Homo sapiens
gcctggctggccagga

SEQ ID NO: 5046368 - DNA, 17 bp, Homo sapiens
gcctggctggccaggac

SEQ ID NO: 5046369 - DNA, 18 bp, Homo sapiens
gcctggctggccaggaca

SEQ ID NO: 5046370 - DNA, 16 bp, Homo sapiens
gcctggggccttcctg

SEQ ID NO: 5046371 - DNA, 17 bp, Homo sapiens
gcctggggccttcctgg

SEQ ID NO: 5046372 - DNA, 19 bp, Homo sapiens
gcctggggccttcctggct

SEQ ID NO: 5046373 - DNA, 18 bp, Homo sapiens
ctttgagacaggtgcctg

SEQ ID NO: 5046374 - DNA, 20 bp, Homo sapiens
ctttgagacaggtgcctggg

SEQ ID NO: 5046375 - DNA, 21 bp, Homo sapiens
ctttgctctcaaggcttggag

SEQ ID NO: 5046376 - DNA, 16 bp, Homo sapiens
cttttagcctggctgt

SEQ ID NO: 5046377 - DNA, 13 bp, Homo sapiens
cttttcttcccct

SEQ ID NO: 5046378 - DNA, 18 bp, Homo sapiens
gaaagggatggtcaggcc

SEQ ID NO: 5046379 - DNA, 21 bp, Homo sapiens
gaaagggatggtcaggcccag

SEQ ID NO: 5046380 - DNA, 14 bp, Homo sapiens
gaaatgggcctcag

SEQ ID NO: 5046381 - DNA, 13 bp, Homo sapiens
gaaccatggcacc

SEQ ID NO: 5046382 - DNA, 11 bp, Homo sapiens
gaacctggcag

SEQ ID NO: 5046383 - DNA, 13 bp, Homo sapiens
gaacctggcaggc

SEQ ID NO: 5046384 - DNA, 15 bp, Homo sapiens
gaacctggcaggccc

SEQ ID NO: 5046385 - DNA, 16 bp, Homo sapiens
gaacctggcaggccct

SEQ ID NO: 5046386 - DNA, 17 bp, Homo sapiens
gaacctggcaggccctg

SEQ ID NO: 5046387 - DNA, 19 bp, Homo sapiens
gaacctggcaggccctgcc

SEQ ID NO: 5046388 - DNA, 17 bp, Homo sapiens
gaagcctgagcaggcag

SEQ ID NO: 5046389 - DNA, 16 bp, Homo sapiens
gaagttcaccagccct

SEQ ID NO: 5046390 - DNA, 17 bp, Homo sapiens
gaagttcaccagccctg

SEQ ID NO: 5046391 - DNA, 18 bp, Homo sapiens
gaagttcaccagccctga

SEQ ID NO: 5046392 - DNA, 21 bp, Homo sapiens
gaagttcaccagccctgagcc

SEQ ID NO: 5046393 - DNA, 24 bp, Homo sapiens
gaagttcaccagccctgagccatg

SEQ ID NO: 5046394 - DNA, 18 bp, Homo sapiens
gaatccagtgtggctccc

SEQ ID NO: 5046395 - DNA, 19 bp, Homo sapiens
gaatgcggttgggaggcag

SEQ ID NO: 5046396 - DNA, 20 bp, Homo sapiens
gaatgcggttgggaggcagg

SEQ ID NO: 5046397 - DNA, 17 bp, Homo sapiens
gaatggggtccccctcc

SEQ ID NO: 5046398 - DNA, 12 bp, Homo sapiens
gacaatcctatt

SEQ ID NO: 5046399 - DNA, 20 bp, Homo sapiens
gacacaagggtgcaagcccc

SEQ ID NO: 5046400 - DNA, 13 bp, Homo sapiens
gacacaggccgtg

SEQ ID NO: 5046401 - DNA, 21 bp, Homo sapiens
gacacaggccgtgggacccag

SEQ ID NO: 5046402 - DNA, 20 bp, Homo sapiens
gacacggtttaactgtccca

SEQ ID NO: 5046403 - DNA, 13 bp, Homo sapiens
gacagcccgggag

SEQ ID NO: 5046404 - DNA, 16 bp, Homo sapiens
gacaggtgcctggggc

SEQ ID NO: 5046405 - DNA, 23 bp, Homo sapiens
gacaggtgcctggggctggctgc

SEQ ID NO: 5046406 - DNA, 18 bp, Homo sapiens
gacatgggagtggggagc

SEQ ID NO: 5046407 - DNA, 11 bp, Homo sapiens
gacatgggcag

SEQ ID NO: 5046408 - DNA, 12 bp, Homo sapiens
gacccaggctcc

SEQ ID NO: 5046409 - DNA, 14 bp, Homo sapiens
gacccaggctccca

SEQ ID NO: 5046410 - DNA, 16 bp, Homo sapiens
gacccaggctcccagc

SEQ ID NO: 5046411 - DNA, 22 bp, Homo sapiens
ctcaaagcagaagtggaatcca

SEQ ID NO: 5046412 - DNA, 14 bp, Homo sapiens
ctcaaggcttggag

SEQ ID NO: 5046413 - DNA, 13 bp, Homo sapiens
ctcacacacggag

SEQ ID NO: 5046414 - DNA, 18 bp, Homo sapiens
ctcacacacggaggccag

SEQ ID NO: 5046415 - DNA, 19 bp, Homo sapiens
ctcacacacggaggccaga

SEQ ID NO: 5046416 - DNA, 18 bp, Homo sapiens
ctcacctgccggctctgg

SEQ ID NO: 5046417 - DNA, 20 bp, Homo sapiens
ctcagatagacctgtgacct

SEQ ID NO: 5046418 - DNA, 12 bp, Homo sapiens
ctcagcccggga

SEQ ID NO: 5046419 - DNA, 16 bp, Homo sapiens
ctcagcccgggatcct

SEQ ID NO: 5046420 - DNA, 23 bp, Homo sapiens
ctcagcccgggatcctgatggca

SEQ ID NO: 5046421 - DNA, 15 bp, Homo sapiens
ctcagtctcacctgc

SEQ ID NO: 5046422 - DNA, 21 bp, Homo sapiens
ctcagtctcacctgccggctc

SEQ ID NO: 5046423 - DNA, 14 bp, Homo sapiens
ctccagacacagag

SEQ ID NO: 5046424 - DNA, 15 bp, Homo sapiens
ctccagacacagaga

SEQ ID NO: 5046425 - DNA, 21 bp, Homo sapiens
ctccagctcctctccagacac

SEQ ID NO: 5046426 - DNA, 13 bp, Homo sapiens
ctcccacaggtct

SEQ ID NO: 5046427 - DNA, 19 bp, Homo sapiens
ctcccacttgacctgagat

SEQ ID NO: 5046428 - DNA, 14 bp, Homo sapiens
ctcccagggctctc

SEQ ID NO: 5046429 - DNA, 16 bp, Homo sapiens
ctcctggaacctggca

SEQ ID NO: 5046430 - DNA, 21 bp, Homo sapiens
ctcctggaacctggcaggccc

SEQ ID NO: 5046431 - DNA, 19 bp, Homo sapiens
ctcctgtgttccctttgag

SEQ ID NO: 5046432 - DNA, 24 bp, Homo sapiens
ctcgccgagctgtcggagggctgg

SEQ ID NO: 5046433 - DNA, 14 bp, Homo sapiens
ctctcaaggcttgg

SEQ ID NO: 5046434 - DNA, 23 bp, Homo sapiens
ctctcaaggcttggagaggtatg

SEQ ID NO: 5046435 - DNA, 23 bp, Homo sapiens
ctctggaccatacgcggaggagt

SEQ ID NO: 5046436 - DNA, 14 bp, Homo sapiens
ctctgggctggctg

SEQ ID NO: 5046437 - DNA, 14 bp, Homo sapiens
ctcttcagctgctg

SEQ ID NO: 5046438 - DNA, 18 bp, Homo sapiens
ctcttcagctgctgacaa

SEQ ID NO: 5046439 - DNA, 13 bp, Homo sapiens
ctcttctcctgtg

SEQ ID NO: 5046440 - DNA, 20 bp, Homo sapiens
ctcttcttaaccctgaacaa

SEQ ID NO: 5046441 - DNA, 15 bp, Homo sapiens
ctgacaatcctattt

SEQ ID NO: 5046442 - DNA, 13 bp, Homo sapiens
ctgagactgtata

SEQ ID NO: 5046443 - DNA, 15 bp, Homo sapiens
ctgagcaggcagggg

SEQ ID NO: 5046444 - DNA, 20 bp, Homo sapiens
ctgagcaggcaggggcttgg

SEQ ID NO: 5046445 - DNA, 21 bp, Homo sapiens
ctgagcaggcaggggcttggc

SEQ ID NO: 5046446 - DNA, 17 bp, Homo sapiens
ggagcggagcttggccc

SEQ ID NO: 5046447 - DNA, 21 bp, Homo sapiens
ggagcggagcttggccctgcg

SEQ ID NO: 5046448 - DNA, 17 bp, Homo sapiens
ggagcttggccctgcgc

SEQ ID NO: 5046449 - DNA, 12 bp, Homo sapiens
ggaggcctcaga

SEQ ID NO: 5046450 - DNA, 16 bp, Homo sapiens
ggagggaaggacagac

SEQ ID NO: 5046451 - DNA, 14 bp, Homo sapiens
ggagggctgaaccc

SEQ ID NO: 5046452 - DNA, 19 bp, Homo sapiens
ggagtaagaaatgggcctc

SEQ ID NO: 5046453 - DNA, 17 bp, Homo sapiens
ggatcaaccaggcagag

SEQ ID NO: 5046454 - DNA, 15 bp, Homo sapiens
ggatcctgatggcac

SEQ ID NO: 5046455 - DNA, 21 bp, Homo sapiens
ggcaaacctaaatgcagtcag

SEQ ID NO: 5046456 - DNA, 14 bp, Homo sapiens
ggcaaccccagacc

SEQ ID NO: 5046457 - DNA, 15 bp, Homo sapiens
ggcaaccccagaccc

SEQ ID NO: 5046458 - DNA, 13 bp, Homo sapiens
ggcaatgccctgc

SEQ ID NO: 5046459 - DNA, 20 bp, Homo sapiens
ggcacccacacagaggacct

SEQ ID NO: 5046460 - DNA, 13 bp, Homo sapiens
ggcaggaatgcgg

SEQ ID NO: 5046461 - DNA, 13 bp, Homo sapiens
ggcaggccctgcc

SEQ ID NO: 5046462 - DNA, 16 bp, Homo sapiens
ggcaggccctgcccag

SEQ ID NO: 5046463 - DNA, 18 bp, Homo sapiens
ggcaggccctgcccagcc

SEQ ID NO: 5046464 - DNA, 18 bp, Homo sapiens
ggcaggggcttggctgcc

SEQ ID NO: 5046465 - DNA, 19 bp, Homo sapiens
ggcaggtcgggctgccagc

SEQ ID NO: 5046466 - DNA, 18 bp, Homo sapiens
ggcagtgctgaagggggc

SEQ ID NO: 5046467 - DNA, 17 bp, Homo sapiens
ggccagacacaggccgt

SEQ ID NO: 5046468 - DNA, 19 bp, Homo sapiens
ggccagacacaggccgtgg

SEQ ID NO: 5046469 - DNA, 17 bp, Homo sapiens
ggcccagcctctctggc

SEQ ID NO: 5046470 - DNA, 18 bp, Homo sapiens
ggcccagcctctctggct

SEQ ID NO: 5046471 - DNA, 16 bp, Homo sapiens
ggcccctcagcctgcc

SEQ ID NO: 5046472 - DNA, 18 bp, Homo sapiens
ggcccctcagcctgcctg

SEQ ID NO: 5046473 - DNA, 13 bp, Homo sapiens
ggccctgcccagc

SEQ ID NO: 5046474 - DNA, 15 bp, Homo sapiens
ggccctgcccagcca

SEQ ID NO: 5046475 - DNA, 12 bp, Homo sapiens
ggccctgcgccc

SEQ ID NO: 5046476 - DNA, 14 bp, Homo sapiens
ggccctgcgccctg

SEQ ID NO: 5046477 - DNA, 20 bp, Homo sapiens
ggccctgcgccctgtgcagg

SEQ ID NO: 5046478 - DNA, 19 bp, Homo sapiens
ggcctcagatagacctgtg

SEQ ID NO: 5046479 - DNA, 14 bp, Homo sapiens
ggcctggcatgcag

SEQ ID NO: 5046480 - DNA, 15 bp, Homo sapiens
ggcctggcatgcagc

SEQ ID NO: 5046481 - DNA, 10 bp, Homo sapiens
ggcctggctg

SEQ ID NO: 5046482 - DNA, 19 bp, Homo sapiens
ggcctggctggccaggaca

SEQ ID NO: 5046483 - DNA, 20 bp, Homo sapiens
ggcctggctggccaggacac

SEQ ID NO: 5046484 - DNA, 16 bp, Homo sapiens
ggcctgggtcccaggg

SEQ ID NO: 5046485 - DNA, 17 bp, Homo sapiens
ggcctgtgcttggaggc

SEQ ID NO: 5046486 - DNA, 23 bp, Homo sapiens
ggcctgtgcttggaggcctcaga

SEQ ID NO: 5046487 - DNA, 15 bp, Homo sapiens
ggcctttccctgccg

SEQ ID NO: 5046488 - DNA, 19 bp, Homo sapiens
ggcgcatgcctcccaggcc

SEQ ID NO: 5046489 - DNA, 16 bp, Homo sapiens
ggcgccgcgtggacag

SEQ ID NO: 5046490 - DNA, 17 bp, Homo sapiens
ggcgccgcgtggacagc

SEQ ID NO: 5046491 - DNA, 21 bp, Homo sapiens
aaaccagcctggggccttcct

SEQ ID NO: 5046492 - DNA, 20 bp, Homo sapiens
aaactggcgatctcccaggg

SEQ ID NO: 5046493 - DNA, 23 bp, Homo sapiens
aacatagagaactgtcaccctga

SEQ ID NO: 5046494 - DNA, 15 bp, Homo sapiens
aacccatgcccctga

SEQ ID NO: 5046495 - DNA, 21 bp, Homo sapiens
aacccttagcttttagcctgg

SEQ ID NO: 5046496 - DNA, 16 bp, Homo sapiens
aacctggcaggccctg

SEQ ID NO: 5046497 - DNA, 17 bp, Homo sapiens
aactggcgaagcctgag

SEQ ID NO: 5046498 - DNA, 19 bp, Homo sapiens
aactggcgaagcctgagca

SEQ ID NO: 5046499 - DNA, 17 bp, Homo sapiens
aactggcgatctcccag

SEQ ID NO: 5046500 - DNA, 20 bp, Homo sapiens
aactggcgatctcccagggc

SEQ ID NO: 5046501 - DNA, 22 bp, Homo sapiens
aagcaacttcatcccagctgct

SEQ ID NO: 5046502 - DNA, 13 bp, Homo sapiens
aaggagactgtgg

SEQ ID NO: 5046503 - DNA, 12 bp, Homo sapiens
aaggatggggtt

SEQ ID NO: 5046504 - DNA, 16 bp, Homo sapiens
aaggatttttccatgg

SEQ ID NO: 5046505 - DNA, 14 bp, Homo sapiens
aagggatggtcagg

SEQ ID NO: 5046506 - DNA, 15 bp, Homo sapiens
aagggatggtcaggc

SEQ ID NO: 5046507 - DNA, 16 bp, Homo sapiens
aagggatggtcaggcc

SEQ ID NO: 5046508 - DNA, 19 bp, Homo sapiens
aagggatggtcaggcccag

SEQ ID NO: 5046509 - DNA, 14 bp, Homo sapiens
aagggtgcaagccc

SEQ ID NO: 5046510 - DNA, 15 bp, Homo sapiens
aagggtgcaagcccc

SEQ ID NO: 5046511 - DNA, 14 bp, Homo sapiens
aatcacccccagga

SEQ ID NO: 5046512 - DNA, 22 bp, Homo sapiens
aatgaaccatggcacctttgag

SEQ ID NO: 5046513 - DNA, 17 bp, Homo sapiens
aatgccctgcggctctg

SEQ ID NO: 5046514 - DNA, 23 bp, Homo sapiens
acaagagtgtctatggagcagcc

SEQ ID NO: 5046515 - DNA, 11 bp, Homo sapiens
acacaggcagg

SEQ ID NO: 5046516 - DNA, 22 bp, Homo sapiens
acacaggccgtgggacccaggc

SEQ ID NO: 5046517 - DNA, 20 bp, Homo sapiens
acacggtttaactgtcccag

SEQ ID NO: 5046518 - DNA, 18 bp, Homo sapiens
acagacatcaagtgccag

SEQ ID NO: 5046519 - DNA, 13 bp, Homo sapiens
acagcccgggagc

SEQ ID NO: 5046520 - DNA, 22 bp, Homo sapiens
acaggccgtgggacccaggctc

SEQ ID NO: 5046521 - DNA, 20 bp, Homo sapiens
acaggcctttccctgccggc

SEQ ID NO: 5046522 - DNA, 16 bp, Homo sapiens
acaggtcttcactgcc

SEQ ID NO: 5046523 - DNA, 12 bp, Homo sapiens
acaggtgcctgg

SEQ ID NO: 5046524 - DNA, 20 bp, Homo sapiens
acaggtgcctggggctggct

SEQ ID NO: 5046525 - DNA, 22 bp, Homo sapiens
acagtcctcacacacggaggcc

SEQ ID NO: 5046526 - DNA, 19 bp, Homo sapiens
acatagagaactgtcaccc

SEQ ID NO: 5046527 - DNA, 13 bp, Homo sapiens
accagcctggggc

SEQ ID NO: 5046528 - DNA, 14 bp, Homo sapiens
accagcctggggcc

SEQ ID NO: 5046529 - DNA, 16 bp, Homo sapiens
accagcctggggcctt

SEQ ID NO: 5046530 - DNA, 16 bp, Homo sapiens
accatacgcggaggag

SEQ ID NO: 5046531 - DNA, 17 bp, Homo sapiens
accatggcacctttgag

SEQ ID NO: 5046532 - DNA, 19 bp, Homo sapiens
acccaacccatgcccctga

SEQ ID NO: 5046533 - DNA, 18 bp, Homo sapiens
acccacacagaggacctc

SEQ ID NO: 5046534 - DNA, 13 bp, Homo sapiens
acccaggctccca

SEQ ID NO: 5046535 - DNA, 17 bp, Homo sapiens
acccatgcccctgacag

SEQ ID NO: 5046536 - DNA, 17 bp, Homo sapiens
accccagacccaaccca

SEQ ID NO: 5046537 - DNA, 12 bp, Homo sapiens
acccccaggacc

SEQ ID NO: 5046538 - DNA, 13 bp, Homo sapiens
acccccaggacct

SEQ ID NO: 5046539 - DNA, 23 bp, Homo sapiens
acccttagcttttagcctggctg

SEQ ID NO: 5046540 - DNA, 23 bp, Homo sapiens
accgggcgcatgcctcccaggcc

SEQ ID NO: 5046541 - DNA, 20 bp, Homo sapiens
acctcagtctcacctgccgg

SEQ ID NO: 5046542 - DNA, 15 bp, Homo sapiens
acctcttcagctgct

SEQ ID NO: 5046543 - DNA, 19 bp, Homo sapiens
acctcttcagctgctgaca

SEQ ID NO: 5046544 - DNA, 23 bp, Homo sapiens
acctgagatgctgggagggctga

SEQ ID NO: 5046545 - DNA, 14 bp, Homo sapiens
acctgccggctctg

SEQ ID NO: 5046546 - DNA, 23 bp, Homo sapiens
acctgccggctctgggctggctg

SEQ ID NO: 5046547 - DNA, 14 bp, Homo sapiens
acctggcaggccct

SEQ ID NO: 5046548 - DNA, 22 bp, Homo sapiens
acctggcaggccctgcccagcc

SEQ ID NO: 5046549 - DNA, 18 bp, Homo sapiens
acctggtctggtcaggca

SEQ ID NO: 5046550 - DNA, 23 bp, Homo sapiens
acctttgagagagggggcactgt

SEQ ID NO: 5046551 - DNA, 12 bp, Homo sapiens
acggaggccaga

SEQ ID NO: 5046552 - DNA, 19 bp, Homo sapiens
acggaggccagacacaggc

SEQ ID NO: 5046553 - DNA, 17 bp, Homo sapiens
acggggctcactctggc

SEQ ID NO: 5046554 - DNA, 18 bp, Homo sapiens
acggtttaactgtcccag

SEQ ID NO: 5046555 - DNA, 22 bp, Homo sapiens
actagtccaatcacccccagga

SEQ ID NO: 5046556 - DNA, 11 bp, Homo sapiens
actctggcccc

SEQ ID NO: 5046557 - DNA, 16 bp, Homo sapiens
actgaaaagcagcctt

SEQ ID NO: 5046558 - DNA, 19 bp, Homo sapiens
actgcacaatgaccagcag

SEQ ID NO: 5046559 - DNA, 15 bp, Homo sapiens
actggcgaagcctga

SEQ ID NO: 5046560 - DNA, 17 bp, Homo sapiens
actggcgaagcctgagc

SEQ ID NO: 5046561 - DNA, 18 bp, Homo sapiens
actggcgaagcctgagca

SEQ ID NO: 5046562 - DNA, 16 bp, Homo sapiens
actggcgatctcccag

SEQ ID NO: 5046563 - DNA, 20 bp, Homo sapiens
actggcgatctcccagggct

SEQ ID NO: 5046564 - DNA, 13 bp, Homo sapiens
actgtcaccctga

SEQ ID NO: 5046565 - DNA, 14 bp, Homo sapiens
actgtcaccctgag

SEQ ID NO: 5046566 - DNA, 16 bp, Homo sapiens
actgtggtcaggccca

SEQ ID NO: 5046567 - DNA, 18 bp, Homo sapiens
actgtggtcaggcccagc

SEQ ID NO: 5046568 - DNA, 19 bp, Homo sapiens
acttcatcccagctgctga

SEQ ID NO: 5046569 - DNA, 17 bp, Homo sapiens
agacacaggccgtggga

SEQ ID NO: 5046570 - DNA, 20 bp, Homo sapiens
agacaggcctttccctgccg

SEQ ID NO: 5046571 - DNA, 19 bp, Homo sapiens
agacctgtgacctggtctg

SEQ ID NO: 5046572 - DNA, 20 bp, Homo sapiens
agacctgtgacctggtctgg

SEQ ID NO: 5046573 - DNA, 20 bp, Homo sapiens
agagaactgtcaccctgagg

SEQ ID NO: 5046574 - DNA, 18 bp, Homo sapiens
agagagggctgagccatg

SEQ ID NO: 5046575 - DNA, 20 bp, Homo sapiens
agagagggctgagccatggg

SEQ ID NO: 5046576 - DNA, 22 bp, Homo sapiens
agagagggggcactgtggtcag

SEQ ID NO: 5046577 - DNA, 23 bp, Homo sapiens
agagagggggcactgtggtcagg

SEQ ID NO: 5046578 - DNA, 19 bp, Homo sapiens
agaggacctctttggggca

SEQ ID NO: 5046579 - DNA, 23 bp, Homo sapiens
agagggggcactgtggtcaggcc

SEQ ID NO: 5046580 - DNA, 15 bp, Homo sapiens
agaggtatgtgcccc

SEQ ID NO: 5046581 - DNA, 21 bp, Homo sapiens
agaggtatgtgcccctcctgg

SEQ ID NO: 5046582 - DNA, 15 bp, Homo sapiens
agagtggcctgggtc

SEQ ID NO: 5046583 - DNA, 15 bp, Homo sapiens
agagtgtctatggag

SEQ ID NO: 5046584 - DNA, 20 bp, Homo sapiens
agatccaggtggtcccatag

SEQ ID NO: 5046585 - DNA, 21 bp, Homo sapiens
agatctagttctcttctcctg

SEQ ID NO: 5046586 - DNA, 21 bp, Homo sapiens
agatgctgggagggctgaacc

SEQ ID NO: 5046587 - DNA, 18 bp, Homo sapiens
agcaacttcatcccagct

SEQ ID NO: 5046588 - DNA, 22 bp, Homo sapiens
agcaacttcatcccagctgctg

SEQ ID NO: 5046589 - DNA, 19 bp, Homo sapiens
agcacacacacacagtcct

SEQ ID NO: 5046590 - DNA, 20 bp, Homo sapiens
agcagaagtggaatccagtg

SEQ ID NO: 5046591 - DNA, 18 bp, Homo sapiens
agcaggagggaaggacag

SEQ ID NO: 5046592 - DNA, 19 bp, Homo sapiens
agcaggcaggggcttggct

SEQ ID NO: 5046593 - DNA, 15 bp, Homo sapiens
agcagttggcctgtg

SEQ ID NO: 5046594 - DNA, 16 bp, Homo sapiens
agcagttggcctgtgc

SEQ ID NO: 5046595 - DNA, 22 bp, Homo sapiens
agcagttggcctgtgcttggag

SEQ ID NO: 5046596 - DNA, 17 bp, Homo sapiens
agccagccatcggaaga

SEQ ID NO: 5046597 - DNA, 21 bp, Homo sapiens
agccagccatcggaagagagg

SEQ ID NO: 5046598 - DNA, 15 bp, Homo sapiens
agccatcggaagaga

SEQ ID NO: 5046599 - DNA, 20 bp, Homo sapiens
agccatcggaagagagggct

SEQ ID NO: 5046600 - DNA, 22 bp, Homo sapiens
agccatcggaagagagggctga

SEQ ID NO: 5046601 - DNA, 15 bp, Homo sapiens
agcccagctggccgg

SEQ ID NO: 5046602 - DNA, 18 bp, Homo sapiens
agccccattcacggcctg

SEQ ID NO: 5046603 - DNA, 22 bp, Homo sapiens
agccccattcacggcctggcat

SEQ ID NO: 5046604 - DNA, 14 bp, Homo sapiens
agccctgagccatg

SEQ ID NO: 5046605 - DNA, 15 bp, Homo sapiens
agccctgagccatgg

SEQ ID NO: 5046606 - DNA, 17 bp, Homo sapiens
agcctctctggctcagc

SEQ ID NO: 5046607 - DNA, 21 bp, Homo sapiens
agcctctctggctcagcccgg

SEQ ID NO: 5046608 - DNA, 16 bp, Homo sapiens
agcctgagcaggcagg

SEQ ID NO: 5046609 - DNA, 15 bp, Homo sapiens
agcctgcctgaagag

SEQ ID NO: 5046610 - DNA, 19 bp, Homo sapiens
agcctgcctgaagagagga

SEQ ID NO: 5046611 - DNA, 19 bp, Homo sapiens
agcctggggccttcctggc

SEQ ID NO: 5046612 - DNA, 21 bp, Homo sapiens
agcctggggccttcctggctt

SEQ ID NO: 5046613 - DNA, 23 bp, Homo sapiens
agcctggggccttcctggctttg

SEQ ID NO: 5046614 - DNA, 20 bp, Homo sapiens
agcctttttcaccatggcaa

SEQ ID NO: 5046615 - DNA, 14 bp, Homo sapiens
agcggagcttggcc

SEQ ID NO: 5046616 - DNA, 19 bp, Homo sapiens
agcggagcttggccctgcg

SEQ ID NO: 5046617 - DNA, 22 bp, Homo sapiens
agcggagcttggccctgcgccc

SEQ ID NO: 5046618 - DNA, 21 bp, Homo sapiens
agctcctctccagacacagag

SEQ ID NO: 5046619 - DNA, 19 bp, Homo sapiens
agctggccggaaggagact

SEQ ID NO: 5046620 - DNA, 13 bp, Homo sapiens
agctgtcggaggg

SEQ ID NO: 5046621 - DNA, 16 bp, Homo sapiens
agctgtcggagggctg

SEQ ID NO: 5046622 - DNA, 19 bp, Homo sapiens
agctttgagacaggtgcct

SEQ ID NO: 5046623 - DNA, 20 bp, Homo sapiens
agctttgagacaggtgcctg

SEQ ID NO: 5046624 - DNA, 17 bp, Homo sapiens
agcttttagcctggctg

SEQ ID NO: 5046625 - DNA, 20 bp, Homo sapiens
aggaatgcggttgggaggca

SEQ ID NO: 5046626 - DNA, 22 bp, Homo sapiens
aggaatgcggttgggaggcagg

SEQ ID NO: 5046627 - DNA, 22 bp, Homo sapiens
aggacacactgaaaagcagcct

SEQ ID NO: 5046628 - DNA, 19 bp, Homo sapiens
aggagttttctgtgtggtc

SEQ ID NO: 5046629 - DNA, 23 bp, Homo sapiens
aggagttttctgtgtggtctcca

SEQ ID NO: 5046630 - DNA, 16 bp, Homo sapiens
aggcaatgccctgcgg

SEQ ID NO: 5046631 - DNA, 22 bp, Homo sapiens
aggcaatgccctgcggctctgg

SEQ ID NO: 5046632 - DNA, 19 bp, Homo sapiens
aggcaggggcttggctgcc

SEQ ID NO: 5046633 - DNA, 14 bp, Homo sapiens
aggccacctcagtc

SEQ ID NO: 5046634 - DNA, 18 bp, Homo sapiens
aggccagacacaggccgt

SEQ ID NO: 5046635 - DNA, 12 bp, Homo sapiens
aggccctgccca

SEQ ID NO: 5046636 - DNA, 15 bp, Homo sapiens
aggccctgcccagcc

SEQ ID NO: 5046637 - DNA, 20 bp, Homo sapiens
aggccgtgggacccaggctc

SEQ ID NO: 5046638 - DNA, 23 bp, Homo sapiens
aggccgtgggacccaggctccca

SEQ ID NO: 5046639 - DNA, 13 bp, Homo sapiens
aggctcccagcct

SEQ ID NO: 5046640 - DNA, 22 bp, Homo sapiens
aggcttggagaggtatgtgccc

SEQ ID NO: 5046641 - DNA, 19 bp, Homo sapiens
agggaaagggatggtcagg

SEQ ID NO: 5046642 - DNA, 15 bp, Homo sapiens
agggagacaggcctt

SEQ ID NO: 5046643 - DNA, 21 bp, Homo sapiens
agggagacaggcctttccctg

SEQ ID NO: 5046644 - DNA, 17 bp, Homo sapiens
agggatggtcaggccca

SEQ ID NO: 5046645 - DNA, 14 bp, Homo sapiens
agggctgagccatg

SEQ ID NO: 5046646 - DNA, 15 bp, Homo sapiens
agggctgagccatgg

SEQ ID NO: 5046647 - DNA, 15 bp, Homo sapiens
agggctggccctagg

SEQ ID NO: 5046648 - DNA, 17 bp, Homo sapiens
agggctggccctaggca

SEQ ID NO: 5046649 - DNA, 21 bp, Homo sapiens
agggctggccctaggcactga

SEQ ID NO: 5046650 - DNA, 23 bp, Homo sapiens
aggggaatgaaccatggcacctt

SEQ ID NO: 5046651 - DNA, 18 bp, Homo sapiens
aggggcttggctgcccca

SEQ ID NO: 5046652 - DNA, 22 bp, Homo sapiens
aggtcccattttccccctgtgt

SEQ ID NO: 5046653 - DNA, 17 bp, Homo sapiens
aggtcttcactgcccag

SEQ ID NO: 5046654 - DNA, 20 bp, Homo sapiens
aggtcttgtgaaaaggcttt

SEQ ID NO: 5046655 - DNA, 21 bp, Homo sapiens
aggtgagctagacccaaccct

SEQ ID NO: 5046656 - DNA, 16 bp, Homo sapiens
aggtgcctggggctgg

SEQ ID NO: 5046657 - DNA, 21 bp, Homo sapiens
agtcctcacacacggaggcca

SEQ ID NO: 5046658 - DNA, 22 bp, Homo sapiens
agtctcacctgccggctctggg

SEQ ID NO: 5046659 - DNA, 23 bp, Homo sapiens
agtctcacctgccggctctgggc

SEQ ID NO: 5046660 - DNA, 16 bp, Homo sapiens
agtgctgaagggggca

SEQ ID NO: 5046661 - DNA, 16 bp, Homo sapiens
agtggaatccagtgtg

SEQ ID NO: 5046662 - DNA, 22 bp, Homo sapiens
agtggaatccagtgtggctccc

SEQ ID NO: 5046663 - DNA, 23 bp, Homo sapiens
agtggcctgggtcccagggctgg

SEQ ID NO: 5046664 - DNA, 21 bp, Homo sapiens
agtggggagcggagcttggcc

SEQ ID NO: 5046665 - DNA, 18 bp, Homo sapiens
agtgtctatggagcagcc

SEQ ID NO: 5046666 - DNA, 14 bp, Homo sapiens
agttcaccagccct

SEQ ID NO: 5046667 - DNA, 17 bp, Homo sapiens
agttcaccagccctgag

SEQ ID NO: 5046668 - DNA, 16 bp, Homo sapiens
agttcccttggtggca

SEQ ID NO: 5046669 - DNA, 14 bp, Homo sapiens
agttctcgtgccct

SEQ ID NO: 5046670 - DNA, 17 bp, Homo sapiens
agttctcttctcctgtg

SEQ ID NO: 5046671 - DNA, 16 bp, Homo sapiens
agttgccttttcttcc

SEQ ID NO: 5046672 - DNA, 22 bp, Homo sapiens
agttggcctgtgcttggaggcc

SEQ ID NO: 5046673 - DNA, 23 bp, Homo sapiens
atagagaactgtcaccctgaggt

SEQ ID NO: 5046674 - DNA, 23 bp, Homo sapiens
atcaaccaggcagagttctgtgg

SEQ ID NO: 5046675 - DNA, 13 bp, Homo sapiens
atcaagtgccaga

SEQ ID NO: 5046676 - DNA, 18 bp, Homo sapiens
atcgagcacttctcacca

SEQ ID NO: 5046677 - DNA, 18 bp, Homo sapiens
atctagttctcttctcct

SEQ ID NO: 5046678 - DNA, 14 bp, Homo sapiens
atctcccagggctc

SEQ ID NO: 5046679 - DNA, 17 bp, Homo sapiens
atctcccagggctctct

SEQ ID NO: 5046680 - DNA, 21 bp, Homo sapiens
atgaccagcaggagggaagga

SEQ ID NO: 5046681 - DNA, 13 bp, Homo sapiens
atgcccctgacag

SEQ ID NO: 5046682 - DNA, 21 bp, Homo sapiens
atgccctgcggctctggaaag

SEQ ID NO: 5046683 - DNA, 14 bp, Homo sapiens
atgcctcccaggcc

SEQ ID NO: 5046684 - DNA, 17 bp, Homo sapiens
atgcggttgggaggcag

SEQ ID NO: 5046685 - DNA, 20 bp, Homo sapiens
atgctgggagggctgaaccc

SEQ ID NO: 5046686 - DNA, 14 bp, Homo sapiens
atggagcccctcca

SEQ ID NO: 5046687 - DNA, 21 bp, Homo sapiens
atggcacccacacagaggacc

SEQ ID NO: 5046688 - DNA, 22 bp, Homo sapiens
atggcacccacacagaggacct

SEQ ID NO: 5046689 - DNA, 15 bp, Homo sapiens
atggcacctttgaga

SEQ ID NO: 5046690 - DNA, 15 bp, Homo sapiens
atgggcctcagcccc

SEQ ID NO: 5046691 - DNA, 12 bp, Homo sapiens
atggtcaggccc

SEQ ID NO: 5046692 - DNA, 17 bp, Homo sapiens
attatgtttcttcttgt

SEQ ID NO: 5046693 - DNA, 13 bp, Homo sapiens
attcacggcctgg

SEQ ID NO: 5046694 - DNA, 21 bp, Homo sapiens
attcacggcctggcatgcagc

SEQ ID NO: 5046695 - DNA, 11 bp, Homo sapiens
attccagctct

SEQ ID NO: 5046696 - DNA, 14 bp, Homo sapiens
attccagctctccc

SEQ ID NO: 5046697 - DNA, 19 bp, Homo sapiens
attgtctccaaggtcccat

SEQ ID NO: 5046698 - DNA, 14 bp, Homo sapiens
caaaccagcctggg

SEQ ID NO: 5046699 - DNA, 15 bp, Homo sapiens
caaaccagcctgggg

SEQ ID NO: 5046700 - DNA, 18 bp, Homo sapiens
caaaccagcctggggcct

SEQ ID NO: 5046701 - DNA, 12 bp, Homo sapiens
caaaggacacaa

SEQ ID NO: 5046702 - DNA, 11 bp, Homo sapiens
caaccaggcag

SEQ ID NO: 5046703 - DNA, 13 bp, Homo sapiens
caaccaggcagag

SEQ ID NO: 5046704 - DNA, 16 bp, Homo sapiens
caacccatgcccctga

SEQ ID NO: 5046705 - DNA, 23 bp, Homo sapiens
caacccttagcttttagcctggc

SEQ ID NO: 5046706 - DNA, 23 bp, Homo sapiens
caaggcttggagaggtatgtgcc

SEQ ID NO: 5046707 - DNA, 13 bp, Homo sapiens
caatcacccccag

SEQ ID NO: 5046708 - DNA, 17 bp, Homo sapiens
caatcacccccaggacc

SEQ ID NO: 5046709 - DNA, 21 bp, Homo sapiens
caatgccctgcggctctggaa

SEQ ID NO: 5046710 - DNA, 15 bp, Homo sapiens
cacaaaccagcctgg

SEQ ID NO: 5046711 - DNA, 17 bp, Homo sapiens
cacaaaccagcctgggg

SEQ ID NO: 5046712 - DNA, 16 bp, Homo sapiens
cacaatgaccagcagg

SEQ ID NO: 5046713 - DNA, 17 bp, Homo sapiens
cacacacggaggccaga

SEQ ID NO: 5046714 - DNA, 14 bp, Homo sapiens
cacacagaggacct

SEQ ID NO: 5046715 - DNA, 16 bp, Homo sapiens
cacacagtcctcacac

SEQ ID NO: 5046716 - DNA, 22 bp, Homo sapiens
cacacagtcctcacacacggag

SEQ ID NO: 5046717 - DNA, 15 bp, Homo sapiens
cacacggaggccaga

SEQ ID NO: 5046718 - DNA, 22 bp, Homo sapiens
cacacggaggccagacacaggc

SEQ ID NO: 5046719 - DNA, 23 bp, Homo sapiens
cacacggaggccagacacaggcc

SEQ ID NO: 5046720 - DNA, 18 bp, Homo sapiens
cacactgaaaagcagcct

SEQ ID NO: 5046721 - DNA, 13 bp, Homo sapiens
cacccccaggacc

SEQ ID NO: 5046722 - DNA, 15 bp, Homo sapiens
cacctgccggctctg

SEQ ID NO: 5046723 - DNA, 12 bp, Homo sapiens
cacggcctggca

SEQ ID NO: 5046724 - DNA, 15 bp, Homo sapiens
cacggcctggcatgc

SEQ ID NO: 5046725 - DNA, 18 bp, Homo sapiens
cacggtttaactgtccca

SEQ ID NO: 5046726 - DNA, 21 bp, Homo sapiens
cactgtggtcaggcccagcct

SEQ ID NO: 5046727 - DNA, 13 bp, Homo sapiens
cacttgacctgag

SEQ ID NO: 5046728 - DNA, 13 bp, Homo sapiens
cagaactgcacaa

SEQ ID NO: 5046729 - DNA, 17 bp, Homo sapiens
cagacatcaagtgccag

SEQ ID NO: 5046730 - DNA, 20 bp, Homo sapiens
cagacatcaagtgccagatg

SEQ ID NO: 5046731 - DNA, 15 bp, Homo sapiens
cagacccaacccatg

SEQ ID NO: 5046732 - DNA, 19 bp, Homo sapiens
cagaggagagtggcctggg

SEQ ID NO: 5046733 - DNA, 13 bp, Homo sapiens
cagagttctgtgg

SEQ ID NO: 5046734 - DNA, 15 bp, Homo sapiens
cagatctagttctct

SEQ ID NO: 5046735 - DNA, 22 bp, Homo sapiens
cagatctagttctcttctcctg

SEQ ID NO: 5046736 - DNA, 14 bp, Homo sapiens
cagcaggagggaag

SEQ ID NO: 5046737 - DNA, 16 bp, Homo sapiens
cagcaggagggaagga

SEQ ID NO: 5046738 - DNA, 16 bp, Homo sapiens
cagccatcggaagaga

SEQ ID NO: 5046739 - DNA, 18 bp, Homo sapiens
cagccatcggaagagagg

SEQ ID NO: 5046740 - DNA, 20 bp, Homo sapiens
cagccatcggaagagagggc

SEQ ID NO: 5046741 - DNA, 21 bp, Homo sapiens
cagccatcggaagagagggct

SEQ ID NO: 5046742 - DNA, 16 bp, Homo sapiens
cagcccagctggccgg

SEQ ID NO: 5046743 - DNA, 21 bp, Homo sapiens
cagccccgcggatcaaccagg

SEQ ID NO: 5046744 - DNA, 18 bp, Homo sapiens
cagcccgggagctttgag

SEQ ID NO: 5046745 - DNA, 13 bp, Homo sapiens
cagccctgagcca

SEQ ID NO: 5046746 - DNA, 22 bp, Homo sapiens
cagccctgagccatggcggccc

SEQ ID NO: 5046747 - DNA, 19 bp, Homo sapiens
cagccggaagtctgttctc

SEQ ID NO: 5046748 - DNA, 20 bp, Homo sapiens
cagccggagcagttggcctg

SEQ ID NO: 5046749 - DNA, 22 bp, Homo sapiens
cagccggagcagttggcctgtg

SEQ ID NO: 5046750 - DNA, 24 bp, Homo sapiens
cagccggagcagttggcctgtgct

SEQ ID NO: 5046751 - DNA, 18 bp, Homo sapiens
cagcctaagggagacagg

SEQ ID NO: 5046752 - DNA, 22 bp, Homo sapiens
cagcctaagggagacaggcctt

SEQ ID NO: 5046753 - DNA, 21 bp, Homo sapiens
cagcctctctggctcagcccg

SEQ ID NO: 5046754 - DNA, 22 bp, Homo sapiens
cagcctctctggctcagcccgg

SEQ ID NO: 5046755 - DNA, 16 bp, Homo sapiens
cagcctgcctgaagag

SEQ ID NO: 5046756 - DNA, 18 bp, Homo sapiens
cagcctgcctgaagagag

SEQ ID NO: 5046757 - DNA, 19 bp, Homo sapiens
cagcctggggccttcctgg

SEQ ID NO: 5046758 - DNA, 23 bp, Homo sapiens
cagcctttttcaccatggcaaac

SEQ ID NO: 5046759 - DNA, 18 bp, Homo sapiens
cagctcctctccagacac

SEQ ID NO: 5046760 - DNA, 19 bp, Homo sapiens
cagctctcccatggagccc

SEQ ID NO: 5046761 - DNA, 17 bp, Homo sapiens
cagctgctgacaatcct

SEQ ID NO: 5046762 - DNA, 13 bp, Homo sapiens
cagctgctgaggc

SEQ ID NO: 5046763 - DNA, 17 bp, Homo sapiens
cagctggccggaaggag

SEQ ID NO: 5046764 - DNA, 20 bp, Homo sapiens
cagcttgtccttgctcctgg

SEQ ID NO: 5046765 - DNA, 23 bp, Homo sapiens
cagcttgtccttgctcctggaac

SEQ ID NO: 5046766 - DNA, 19 bp, Homo sapiens
caggaatgcggttgggagg

SEQ ID NO: 5046767 - DNA, 20 bp, Homo sapiens
caggaatgcggttgggaggc

SEQ ID NO: 5046768 - DNA, 21 bp, Homo sapiens
caggaatgcggttgggaggca

SEQ ID NO: 5046769 - DNA, 14 bp, Homo sapiens
caggcaatgccctg

SEQ ID NO: 5046770 - DNA, 15 bp, Homo sapiens
caggcaatgccctgc

SEQ ID NO: 5046771 - DNA, 22 bp, Homo sapiens
caggcaatgccctgcggctctg

SEQ ID NO: 5046772 - DNA, 18 bp, Homo sapiens
caggcagagttctgtggc

SEQ ID NO: 5046773 - DNA, 12 bp, Homo sapiens
caggccacctca

SEQ ID NO: 5046774 - DNA, 23 bp, Homo sapiens
caggccacctcagtctcacctgc

SEQ ID NO: 5046775 - DNA, 19 bp, Homo sapiens
caggcccagcctctctggc

SEQ ID NO: 5046776 - DNA, 19 bp, Homo sapiens
caggcccagttctcgtgcc

SEQ ID NO: 5046777 - DNA, 19 bp, Homo sapiens
caggccgtgggacccaggc

SEQ ID NO: 5046778 - DNA, 15 bp, Homo sapiens
caggcctttccctgc

SEQ ID NO: 5046779 - DNA, 14 bp, Homo sapiens
caggctcccagcct

SEQ ID NO: 5046780 - DNA, 17 bp, Homo sapiens
cagggctggccctaggc

SEQ ID NO: 5046781 - DNA, 15 bp, Homo sapiens
caggtggtcccatag

SEQ ID NO: 5046782 - DNA, 22 bp, Homo sapiens
cagtctcacctgccggctctgg

SEQ ID NO: 5046783 - DNA, 14 bp, Homo sapiens
cagtgtggctccca

SEQ ID NO: 5046784 - DNA, 17 bp, Homo sapiens
cagttctcgtgccctta

SEQ ID NO: 5046785 - DNA, 18 bp, Homo sapiens
catcccagctgctgaggc

SEQ ID NO: 5046786 - DNA, 14 bp, Homo sapiens
catcggaagagagg

SEQ ID NO: 5046787 - DNA, 15 bp, Homo sapiens
catcggaagagaggg

SEQ ID NO: 5046788 - DNA, 14 bp, Homo sapiens
catgcctcccaggc

SEQ ID NO: 5046789 - DNA, 18 bp, Homo sapiens
catggacatgggcagcaa

SEQ ID NO: 5046790 - DNA, 19 bp, Homo sapiens
catggcacctttgagagag

SEQ ID NO: 5046791 - DNA, 21 bp, Homo sapiens
catggcacctttgagagaggg

SEQ ID NO: 5046792 - DNA, 19 bp, Homo sapiens
catggcggcccctcagcct

SEQ ID NO: 5046793 - DNA, 22 bp, Homo sapiens
catggcggcccctcagcctgcc

SEQ ID NO: 5046794 - DNA, 14 bp, Homo sapiens
cattcacggcctgg

SEQ ID NO: 5046795 - DNA, 15 bp, Homo sapiens
cattcacggcctggc

SEQ ID NO: 5046796 - DNA, 19 bp, Homo sapiens
cattccagctctcccatgg

SEQ ID NO: 5046797 - DNA, 12 bp, Homo sapiens
ccaaaggacaca

SEQ ID NO: 5046798 - DNA, 17 bp, Homo sapiens
ccaaaggacacaagggt

SEQ ID NO: 5046799 - DNA, 22 bp, Homo sapiens
ccaaggtcccattttccccctg

SEQ ID NO: 5046800 - DNA, 18 bp, Homo sapiens
ccaagtggaaatcctatt

SEQ ID NO: 5046801 - DNA, 17 bp, Homo sapiens
ccaatcacccccaggac

SEQ ID NO: 5046802 - DNA, 20 bp, Homo sapiens
ccacaggtcttcactgccca

SEQ ID NO: 5046803 - DNA, 22 bp, Homo sapiens
ccacaggtcttcactgcccagg

SEQ ID NO: 5046804 - DNA, 19 bp, Homo sapiens
ccacctcagtctcacctgc

SEQ ID NO: 5046805 - DNA, 15 bp, Homo sapiens
ccacttgacctgaga

SEQ ID NO: 5046806 - DNA, 17 bp, Homo sapiens
ccagacacaggccgtgg

SEQ ID NO: 5046807 - DNA, 16 bp, Homo sapiens
ccagacccaacccatg

SEQ ID NO: 5046808 - DNA, 18 bp, Homo sapiens
ccagaggagagtggcctg

SEQ ID NO: 5046809 - DNA, 19 bp, Homo sapiens
ccagaggagagtggcctgg

SEQ ID NO: 5046810 - DNA, 21 bp, Homo sapiens
ccagaggagagtggcctgggt

SEQ ID NO: 5046811 - DNA, 20 bp, Homo sapiens
ccagccatcggaagagaggg

SEQ ID NO: 5046812 - DNA, 22 bp, Homo sapiens
ccagccatcggaagagagggct

SEQ ID NO: 5046813 - DNA, 23 bp, Homo sapiens
ccagccatcggaagagagggctg

SEQ ID NO: 5046814 - DNA, 15 bp, Homo sapiens
ccagcccagctggcc

SEQ ID NO: 5046815 - DNA, 14 bp, Homo sapiens
ccagcctctctggc

SEQ ID NO: 5046816 - DNA, 19 bp, Homo sapiens
ccagcctctctggctcagc

SEQ ID NO: 5046817 - DNA, 13 bp, Homo sapiens
ccagcctggggcc

SEQ ID NO: 5046818 - DNA, 15 bp, Homo sapiens
ccagcgacatttctc

SEQ ID NO: 5046819 - DNA, 14 bp, Homo sapiens
ccagctcctctcca

SEQ ID NO: 5046820 - DNA, 15 bp, Homo sapiens
ccagctcctctccag

SEQ ID NO: 5046821 - DNA, 16 bp, Homo sapiens
ccagctcctctccaga

SEQ ID NO: 5046822 - DNA, 20 bp, Homo sapiens
ccagctcctctccagacaca

SEQ ID NO: 5046823 - DNA, 13 bp, Homo sapiens
ccagctctcccat

SEQ ID NO: 5046824 - DNA, 19 bp, Homo sapiens
ccagctctcccatggagcc

SEQ ID NO: 5046825 - DNA, 22 bp, Homo sapiens
ccagctggccggaaggagactg

SEQ ID NO: 5046826 - DNA, 14 bp, Homo sapiens
ccaggacctcttca

SEQ ID NO: 5046827 - DNA, 14 bp, Homo sapiens
ccaggctcccagcc

SEQ ID NO: 5046828 - DNA, 15 bp, Homo sapiens
ccaggctcccagcct

SEQ ID NO: 5046829 - DNA, 14 bp, Homo sapiens
ccagggctctctgg

SEQ ID NO: 5046830 - DNA, 15 bp, Homo sapiens
ccagggctggcccta

SEQ ID NO: 5046831 - DNA, 14 bp, Homo sapiens
ccagtgtggctccc

SEQ ID NO: 5046832 - DNA, 18 bp, Homo sapiens
ccagtgtggctcccacag

SEQ ID NO: 5046833 - DNA, 17 bp, Homo sapiens
ccagtgtgggacacggt

SEQ ID NO: 5046834 - DNA, 16 bp, Homo sapiens
ccatcggaagagaggg

SEQ ID NO: 5046835 - DNA, 19 bp, Homo sapiens
ccatcggaagagagggctg

SEQ ID NO: 5046836 - DNA, 13 bp, Homo sapiens
ccatgcccctgac

SEQ ID NO: 5046837 - DNA, 15 bp, Homo sapiens
ccatgctttgctctc

SEQ ID NO: 5046838 - DNA, 17 bp, Homo sapiens
ccatggacatgggcagc

SEQ ID NO: 5046839 - DNA, 21 bp, Homo sapiens
ccatggcacctttgagagagg

SEQ ID NO: 5046840 - DNA, 22 bp, Homo sapiens
ccatggcacctttgagagaggg

SEQ ID NO: 5046841 - DNA, 21 bp, Homo sapiens
ccatggcggcccctcagcctg

SEQ ID NO: 5046842 - DNA, 15 bp, Homo sapiens
ccattcacggcctgg

SEQ ID NO: 5046843 - DNA, 16 bp, Homo sapiens
ccattcacggcctggc

SEQ ID NO: 5046844 - DNA, 14 bp, Homo sapiens
cccagcctctctgg

SEQ ID NO: 5046845 - DNA, 16 bp, Homo sapiens
cccagctggccggaag

SEQ ID NO: 5046846 - DNA, 22 bp, Homo sapiens
cccaggacctcttcagctgctg

SEQ ID NO: 5046847 - DNA, 24 bp, Homo sapiens
cccaggccacctcagtctcacctg

SEQ ID NO: 5046848 - DNA, 20 bp, Homo sapiens
cccagggctctctggaccat

SEQ ID NO: 5046849 - DNA, 11 bp, Homo sapiens
cccagggctgg

SEQ ID NO: 5046850 - DNA, 16 bp, Homo sapiens
cccagggctggcccta

SEQ ID NO: 5046851 - DNA, 19 bp, Homo sapiens
cccagttctcgtgccctta

SEQ ID NO: 5046852 - DNA, 13 bp, Homo sapiens
cccataggtcttg

SEQ ID NO: 5046853 - DNA, 17 bp, Homo sapiens
cccatgcccctgacaga

SEQ ID NO: 5046854 - DNA, 19 bp, Homo sapiens
cccattcacggcctggcat

SEQ ID NO: 5046855 - DNA, 13 bp, Homo sapiens
cccattccagctc

SEQ ID NO: 5046856 - DNA, 20 bp, Homo sapiens
ccccaaggatggggttcttg

SEQ ID NO: 5046857 - DNA, 18 bp, Homo sapiens
ccccattcacggcctggc

SEQ ID NO: 5046858 - DNA, 15 bp, Homo sapiens
ccccattccagctct

SEQ ID NO: 5046859 - DNA, 23 bp, Homo sapiens
cccccaggacctcttcagctgct

SEQ ID NO: 5046860 - DNA, 13 bp, Homo sapiens
cccctcctgggtg

SEQ ID NO: 5046861 - DNA, 19 bp, Homo sapiens
cccgcggatcaaccaggca

SEQ ID NO: 5046862 - DNA, 20 bp, Homo sapiens
cccgcggatcaaccaggcag

SEQ ID NO: 5046863 - DNA, 21 bp, Homo sapiens
cccgcggatcaaccaggcaga

SEQ ID NO: 5046864 - DNA, 18 bp, Homo sapiens
ccctcagcctgcctgaag

SEQ ID NO: 5046865 - DNA, 12 bp, Homo sapiens
ccctcctgggtg

SEQ ID NO: 5046866 - DNA, 12 bp, Homo sapiens
ccctgcccagcc

SEQ ID NO: 5046867 - DNA, 14 bp, Homo sapiens
ccctgcccagccag

SEQ ID NO: 5046868 - DNA, 17 bp, Homo sapiens
ccctgcgccctgtgcag

SEQ ID NO: 5046869 - DNA, 13 bp, Homo sapiens
ccctgcggctctg

SEQ ID NO: 5046870 - DNA, 19 bp, Homo sapiens
ccctgcggctctggaaagc

SEQ ID NO: 5046871 - DNA, 22 bp, Homo sapiens
cccttagaggggaatgaaccat

SEQ ID NO: 5046872 - DNA, 15 bp, Homo sapiens
ccgagctgtcggagg

SEQ ID NO: 5046873 - DNA, 16 bp, Homo sapiens
ccgagctgtcggaggg

SEQ ID NO: 5046874 - DNA, 17 bp, Homo sapiens
ccgagctgtcggagggc

SEQ ID NO: 5046875 - DNA, 17 bp, Homo sapiens
ccgcctgctacacaggc

SEQ ID NO: 5046876 - DNA, 17 bp, Homo sapiens
ccggagcagttggcctg

SEQ ID NO: 5046877 - DNA, 18 bp, Homo sapiens
ccggagcagttggcctgt

SEQ ID NO: 5046878 - DNA, 16 bp, Homo sapiens
ccggctctgggctggc

SEQ ID NO: 5046879 - DNA, 20 bp, Homo sapiens
ccggctctgggctggctgct

SEQ ID NO: 5046880 - DNA, 19 bp, Homo sapiens
ccgggagctttgagacagg

SEQ ID NO: 5046881 - DNA, 14 bp, Homo sapiens
ccgtgggacccagg

SEQ ID NO: 5046882 - DNA, 18 bp, Homo sapiens
ccgtgggacccaggctcc

SEQ ID NO: 5046883 - DNA, 21 bp, Homo sapiens
cctaagggagacaggcctttc

SEQ ID NO: 5046884 - DNA, 23 bp, Homo sapiens
cctatttttgtagatctccatgc

SEQ ID NO: 5046885 - DNA, 20 bp, Homo sapiens
cctcacacacggaggccaga

SEQ ID NO: 5046886 - DNA, 23 bp, Homo sapiens
cctcagatagacctgtgacctgg

SEQ ID NO: 5046887 - DNA, 18 bp, Homo sapiens
cctcccacttgacctgag

SEQ ID NO: 5046888 - DNA, 15 bp, Homo sapiens
cctcgccgagctgtc

SEQ ID NO: 5046889 - DNA, 23 bp, Homo sapiens
cctcggcctggctggccaggaca

SEQ ID NO: 5046890 - DNA, 19 bp, Homo sapiens
cctctctggctcagcccgg

SEQ ID NO: 5046891 - DNA, 13 bp, Homo sapiens
cctcttcagctgc

SEQ ID NO: 5046892 - DNA, 21 bp, Homo sapiens
cctgagatgctgggagggctg

SEQ ID NO: 5046893 - DNA, 23 bp, Homo sapiens
cctgagcaggcaggggcttggct

SEQ ID NO: 5046894 - DNA, 14 bp, Homo sapiens
cctgaggtaacagg

SEQ ID NO: 5046895 - DNA, 14 bp, Homo sapiens
cctgcccagccagc

SEQ ID NO: 5046896 - DNA, 13 bp, Homo sapiens
cctgccggctctg

SEQ ID NO: 5046897 - DNA, 23 bp, Homo sapiens
cctgccggctctgggctggctgc

SEQ ID NO: 5046898 - DNA, 13 bp, Homo sapiens
cctgcctgaagag

SEQ ID NO: 5046899 - DNA, 15 bp, Homo sapiens
cctgcctgaagagag

SEQ ID NO: 5046900 - DNA, 20 bp, Homo sapiens
cctgctacacaggcaggaat

SEQ ID NO: 5046901 - DNA, 17 bp, Homo sapiens
cctggaacctggcaggc

SEQ ID NO: 5046902 - DNA, 18 bp, Homo sapiens
cctggcaggccctgccca

SEQ ID NO: 5046903 - DNA, 17 bp, Homo sapiens
cctggctggccaggaca

SEQ ID NO: 5046904 - DNA, 18 bp, Homo sapiens
cctggctggccaggacac

SEQ ID NO: 5046905 - DNA, 15 bp, Homo sapiens
cctggctgtcacctt

SEQ ID NO: 5046906 - DNA, 19 bp, Homo sapiens
cctggggccttcctggctt

SEQ ID NO: 5046907 - DNA, 19 bp, Homo sapiens
cctggggctggctgcagac

SEQ ID NO: 5046908 - DNA, 23 bp, Homo sapiens
cctgggtcccagggctggcccta

SEQ ID NO: 5046909 - DNA, 21 bp, Homo sapiens
cctgggtgctcaccgcctgct

SEQ ID NO: 5046910 - DNA, 14 bp, Homo sapiens
cctggtctggtcag

SEQ ID NO: 5046911 - DNA, 15 bp, Homo sapiens
cctggtctggtcagg

SEQ ID NO: 5046912 - DNA, 16 bp, Homo sapiens
cctggtctggtcaggc

SEQ ID NO: 5046913 - DNA, 17 bp, Homo sapiens
cctggtctggtcaggca

SEQ ID NO: 5046914 - DNA, 17 bp, Homo sapiens
cctgtgacctggtctgg

SEQ ID NO: 5046915 - DNA, 21 bp, Homo sapiens
cctgtgacctggtctggtcag

SEQ ID NO: 5046916 - DNA, 17 bp, Homo sapiens
cctgtgcttggaggcct

SEQ ID NO: 5046917 - DNA, 21 bp, Homo sapiens
cctgtgcttggaggcctcaga

SEQ ID NO: 5046918 - DNA, 21 bp, Homo sapiens
ccttagcttttagcctggctg

SEQ ID NO: 5046919 - DNA, 14 bp, Homo sapiens
ccttgctcctggaa

SEQ ID NO: 5046920 - DNA, 15 bp, Homo sapiens
ccttgctcctggaac

SEQ ID NO: 5046921 - DNA, 17 bp, Homo sapiens
ccttgctcctggaacct

SEQ ID NO: 5046922 - DNA, 21 bp, Homo sapiens
ccttggtggcaaccccagacc

SEQ ID NO: 5046923 - DNA, 14 bp, Homo sapiens
cctttgagagaggg

SEQ ID NO: 5046924 - DNA, 23 bp, Homo sapiens
cctttgagtccagtgtgggacac

SEQ ID NO: 5046925 - DNA, 20 bp, Homo sapiens
ccttttcttcccctcctgta

SEQ ID NO: 5046926 - DNA, 14 bp, Homo sapiens
cgaagcctgagcag

SEQ ID NO: 5046927 - DNA, 15 bp, Homo sapiens
cgaagcctgagcagg

SEQ ID NO: 5046928 - DNA, 16 bp, Homo sapiens
cgaagcctgagcaggc

SEQ ID NO: 5046929 - DNA, 19 bp, Homo sapiens
cgaagcctgagcaggcagg

SEQ ID NO: 5046930 - DNA, 14 bp, Homo sapiens
cgaatggggtcccc

SEQ ID NO: 5046931 - DNA, 19 bp, Homo sapiens
cgagctgtcggagggctgg

SEQ ID NO: 5046932 - DNA, 13 bp, Homo sapiens
cgatctcccaggg

SEQ ID NO: 5046933 - DNA, 18 bp, Homo sapiens
cgcaggtcatattgtcag

SEQ ID NO: 5046934 - DNA, 17 bp, Homo sapiens
cgcatgcctcccaggcc

SEQ ID NO: 5046935 - DNA, 15 bp, Homo sapiens
cgccgcgtggacagc

SEQ ID NO: 5046936 - DNA, 19 bp, Homo sapiens
cgccgcgtggacagccgga

SEQ ID NO: 5046937 - DNA, 15 bp, Homo sapiens
cgcctgctacacagg

SEQ ID NO: 5046938 - DNA, 18 bp, Homo sapiens
cgcggatcaaccaggcag

SEQ ID NO: 5046939 - DNA, 18 bp, Homo sapiens
cgcgtggacagccggagc

SEQ ID NO: 5046940 - DNA, 11 bp, Homo sapiens
cggaagagagg

SEQ ID NO: 5046941 - DNA, 12 bp, Homo sapiens
cggaagagaggg

SEQ ID NO: 5046942 - DNA, 16 bp, Homo sapiens
cggaagtctgttctca

SEQ ID NO: 5046943 - DNA, 16 bp, Homo sapiens
cggagcttggccctgc

SEQ ID NO: 5046944 - DNA, 19 bp, Homo sapiens
cggaggagttttctgtgtg

SEQ ID NO: 5046945 - DNA, 19 bp, Homo sapiens
cggaggccagacacaggcc

SEQ ID NO: 5046946 - DNA, 15 bp, Homo sapiens
cggatcaaccaggca

SEQ ID NO: 5046947 - DNA, 16 bp, Homo sapiens
cggcccctcagcctgc

SEQ ID NO: 5046948 - DNA, 11 bp, Homo sapiens
cggcctggcat

SEQ ID NO: 5046949 - DNA, 18 bp, Homo sapiens
cggcctggctggccagga

SEQ ID NO: 5046950 - DNA, 15 bp, Homo sapiens
cggctctgggctggc

SEQ ID NO: 5046951 - DNA, 18 bp, Homo sapiens
cgggagctttgagacagg

SEQ ID NO: 5046952 - DNA, 18 bp, Homo sapiens
cgggctgccagcccagct

SEQ ID NO: 5046953 - DNA, 18 bp, Homo sapiens
cggggctcactctggccc

SEQ ID NO: 5046954 - DNA, 22 bp, Homo sapiens
cggtgtggttgggggtgggagg

SEQ ID NO: 5046955 - DNA, 14 bp, Homo sapiens
cggttgggaggcag

SEQ ID NO: 5046956 - DNA, 17 bp, Homo sapiens
cggtttaactgtcccag

SEQ ID NO: 5046957 - DNA, 14 bp, Homo sapiens
cgtggacagccgga

SEQ ID NO: 5046958 - DNA, 19 bp, Homo sapiens
cgtgggacccaggctccca

SEQ ID NO: 5046959 - DNA, 20 bp, Homo sapiens
cgtgggacccaggctcccag

SEQ ID NO: 5046960 - DNA, 22 bp, Homo sapiens
cgtgggacccaggctcccagcc

SEQ ID NO: 5046961 - DNA, 20 bp, Homo sapiens
ctaagaagttcaccagccct

SEQ ID NO: 5046962 - DNA, 14 bp, Homo sapiens
ctaagggagacagg

SEQ ID NO: 5046963 - DNA, 13 bp, Homo sapiens
ctacacaggcagg

SEQ ID NO: 5046964 - DNA, 16 bp, Homo sapiens
ctacctcgccgagctg

SEQ ID NO: 5046965 - DNA, 19 bp, Homo sapiens
ctagtccaatcacccccag

SEQ ID NO: 5046966 - DNA, 16 bp, Homo sapiens
ctatggagcagccgga

SEQ ID NO: 5046967 - DNA, 15 bp, Homo sapiens
ctatttttgtagatc

SEQ ID NO: 5046968 - DNA, 23 bp, Homo sapiens
ctcaccgcctgctacacaggcag

SEQ ID NO: 5046969 - DNA, 22 bp, Homo sapiens
ctcacctgccggctctgggctg

SEQ ID NO: 5046970 - DNA, 14 bp, Homo sapiens
ctcactctggcccc

SEQ ID NO: 5046971 - DNA, 16 bp, Homo sapiens
ctcagatagacctgtg

SEQ ID NO: 5046972 - DNA, 17 bp, Homo sapiens
ctcagcctgcctgaaga

SEQ ID NO: 5046973 - DNA, 18 bp, Homo sapiens
ctcagcctgcctgaagag

SEQ ID NO: 5046974 - DNA, 23 bp, Homo sapiens
ctcagtctcacctgccggctctg

SEQ ID NO: 5046975 - DNA, 20 bp, Homo sapiens
ctccaccgggcgcatgcctc

SEQ ID NO: 5046976 - DNA, 17 bp, Homo sapiens
ctcccacttgacctgag

SEQ ID NO: 5046977 - DNA, 21 bp, Homo sapiens
ctcccaggccacctcagtctc

SEQ ID NO: 5046978 - DNA, 18 bp, Homo sapiens
ctcccagggctctctgga

SEQ ID NO: 5046979 - DNA, 19 bp, Homo sapiens
ctcccagggctctctggac

SEQ ID NO: 5046980 - DNA, 15 bp, Homo sapiens
ctcctggaacctggc

SEQ ID NO: 5046981 - DNA, 19 bp, Homo sapiens
ctcggcctggctggccagg

SEQ ID NO: 5046982 - DNA, 21 bp, Homo sapiens
ctcggcctggctggccaggac

SEQ ID NO: 5046983 - DNA, 15 bp, Homo sapiens
ctctcaaggcttgga

SEQ ID NO: 5046984 - DNA, 22 bp, Homo sapiens
ctctggaccatacgcggaggag

SEQ ID NO: 5046985 - DNA, 15 bp, Homo sapiens
ctctggccccctatt

SEQ ID NO: 5046986 - DNA, 12 bp, Homo sapiens
ctcttcagctgc

SEQ ID NO: 5046987 - DNA, 13 bp, Homo sapiens
ctcttcagctgct

SEQ ID NO: 5046988 - DNA, 12 bp, Homo sapiens
ctcttctcctgt

SEQ ID NO: 5046989 - DNA, 17 bp, Homo sapiens
ctcttcttaaccctgaa

SEQ ID NO: 5046990 - DNA, 19 bp, Homo sapiens
ctcttcttaaccctgaaca

SEQ ID NO: 5046991 - DNA, 21 bp, Homo sapiens
ctgaaaagcagcctttttcac

SEQ ID NO: 5046992 - DNA, 17 bp, Homo sapiens
ctgaacaagagtgtcta

SEQ ID NO: 5046993 - DNA, 17 bp, Homo sapiens
ctgagatgctgggaggg

SEQ ID NO: 5046994 - DNA, 20 bp, Homo sapiens
ctgagatgctgggagggctg

SEQ ID NO: 5046995 - DNA, 22 bp, Homo sapiens
ctgagatgctgggagggctgaa

SEQ ID NO: 5046996 - DNA, 13 bp, Homo sapiens
ctgagcaggcagg

SEQ ID NO: 5046997 - DNA, 13 bp, Homo sapiens
ctgagccatggcg

SEQ ID NO: 5046998 - DNA, 12 bp, Homo sapiens
ctgagccatggg

SEQ ID NO: 5046999 - DNA, 22 bp, Homo sapiens
ctgatggcacccacacagagga

SEQ ID NO: 5047000 - DNA, 11 bp, Homo sapiens
ctgccagccca

SEQ ID NO: 5047001 - DNA, 15 bp, Homo sapiens
ctgccagcccagctg

SEQ ID NO: 5047002 - DNA, 19 bp, Homo sapiens
ctgccagcccagctggccg

SEQ ID NO: 5047003 - DNA, 19 bp, Homo sapiens
ctgccccattccagctctc

SEQ ID NO: 5047004 - DNA, 23 bp, Homo sapiens
ctgccggccccccaaggatgggg

SEQ ID NO: 5047005 - DNA, 18 bp, Homo sapiens
ctgccggctctgggctgg

SEQ ID NO: 5047006 - DNA, 16 bp, Homo sapiens
ctgcctgaagagagga

SEQ ID NO: 5047007 - DNA, 12 bp, Homo sapiens
ctgcgccctgtg

SEQ ID NO: 5047008 - DNA, 18 bp, Homo sapiens
ctgcgccctgtgcaggga

SEQ ID NO: 5047009 - DNA, 17 bp, Homo sapiens
ctgctacacaggcagga

SEQ ID NO: 5047010 - DNA, 14 bp, Homo sapiens
ctggaacctggcag

SEQ ID NO: 5047011 - DNA, 14 bp, Homo sapiens
ctggcaggccctgc

SEQ ID NO: 5047012 - DNA, 18 bp, Homo sapiens
ctggcaggccctgcccag

SEQ ID NO: 5047013 - DNA, 20 bp, Homo sapiens
ctggcaggccctgcccagcc

SEQ ID NO: 5047014 - DNA, 21 bp, Homo sapiens
ctggccaggacacactgaaaa

SEQ ID NO: 5047015 - DNA, 16 bp, Homo sapiens
ctggccctaggcactg

SEQ ID NO: 5047016 - DNA, 22 bp, Homo sapiens
ctggccggaaggagactgtggt

SEQ ID NO: 5047017 - DNA, 23 bp, Homo sapiens
ctggccggaaggagactgtggtt

SEQ ID NO: 5047018 - DNA, 19 bp, Homo sapiens
ctggcgaagcctgagcagg

SEQ ID NO: 5047019 - DNA, 22 bp, Homo sapiens
ctggcgaagcctgagcaggcag

SEQ ID NO: 5047020 - DNA, 23 bp, Homo sapiens
ctggcgaagcctgagcaggcagg

SEQ ID NO: 5047021 - DNA, 16 bp, Homo sapiens
ctggcgatctcccagg

SEQ ID NO: 5047022 - DNA, 22 bp, Homo sapiens
ctggcgatctcccagggctctc

SEQ ID NO: 5047023 - DNA, 14 bp, Homo sapiens
ctggctcagcccgg

SEQ ID NO: 5047024 - DNA, 22 bp, Homo sapiens
ctggctgctcctaacctacctc

SEQ ID NO: 5047025 - DNA, 13 bp, Homo sapiens
ctgggctggctgc

SEQ ID NO: 5047026 - DNA, 17 bp, Homo sapiens
ctgggctggctgctcct

SEQ ID NO: 5047027 - DNA, 14 bp, Homo sapiens
ctggggccttcctg

SEQ ID NO: 5047028 - DNA, 15 bp, Homo sapiens
ctggggccttcctgg

SEQ ID NO: 5047029 - DNA, 18 bp, Homo sapiens
ctggggccttcctggctt

SEQ ID NO: 5047030 - DNA, 13 bp, Homo sapiens
ctggggctggctg

SEQ ID NO: 5047031 - DNA, 21 bp, Homo sapiens
ctgggtcccagggctggccct

SEQ ID NO: 5047032 - DNA, 17 bp, Homo sapiens
ctgggtgctcaccgcct

SEQ ID NO: 5047033 - DNA, 13 bp, Homo sapiens
ctggtcaggcaat

SEQ ID NO: 5047034 - DNA, 22 bp, Homo sapiens
ctggtcaggcaatgccctgcgg

SEQ ID NO: 5047035 - DNA, 15 bp, Homo sapiens
ctggtctggtcaggc

SEQ ID NO: 5047036 - DNA, 13 bp, Homo sapiens
ctgtcaccctgag

SEQ ID NO: 5047037 - DNA, 22 bp, Homo sapiens
ctgtctcttcttaaccctgaac

SEQ ID NO: 5047038 - DNA, 23 bp, Homo sapiens
ctgtctcttcttaaccctgaaca

SEQ ID NO: 5047039 - DNA, 13 bp, Homo sapiens
ctgtgacctggtc

SEQ ID NO: 5047040 - DNA, 19 bp, Homo sapiens
ctgtgcagggaaagggatg

SEQ ID NO: 5047041 - DNA, 19 bp, Homo sapiens
ctgtgcttggaggcctcag

SEQ ID NO: 5047042 - DNA, 20 bp, Homo sapiens
ctgtgcttggaggcctcaga

SEQ ID NO: 5047043 - DNA, 22 bp, Homo sapiens
ctgtggcgccgcgtggacagcc

SEQ ID NO: 5047044 - DNA, 11 bp, Homo sapiens
ctgtggtcagg

SEQ ID NO: 5047045 - DNA, 16 bp, Homo sapiens
ctgtggtcaggcccag

SEQ ID NO: 5047046 - DNA, 23 bp, Homo sapiens
cttagaggggaatgaaccatggc

SEQ ID NO: 5047047 - DNA, 18 bp, Homo sapiens
cttagcttttagcctggc

SEQ ID NO: 5047048 - DNA, 20 bp, Homo sapiens
cttagcttttagcctggctg

SEQ ID NO: 5047049 - DNA, 13 bp, Homo sapiens
cttcagctgctga

SEQ ID NO: 5047050 - DNA, 12 bp, Homo sapiens
cttcatcccagc

SEQ ID NO: 5047051 - DNA, 16 bp, Homo sapiens
cttcatcccagctgct

SEQ ID NO: 5047052 - DNA, 12 bp, Homo sapiens
cttccagaggag

SEQ ID NO: 5047053 - DNA, 21 bp, Homo sapiens
cttccagaggagagtggcctg

SEQ ID NO: 5047054 - DNA, 23 bp, Homo sapiens
cttccagaggagagtggcctggg

SEQ ID NO: 5047055 - DNA, 13 bp, Homo sapiens
cttcccctcctgt

SEQ ID NO: 5047056 - DNA, 14 bp, Homo sapiens
cttcccctcctgta

SEQ ID NO: 5047057 - DNA, 17 bp, Homo sapiens
cttcttaaccctgaaca

SEQ ID NO: 5047058 - DNA, 18 bp, Homo sapiens
cttcttaaccctgaacaa

SEQ ID NO: 5047059 - DNA, 19 bp, Homo sapiens
cttcttaaccctgaacaag

SEQ ID NO: 5047060 - DNA, 12 bp, Homo sapiens
cttgacctgaga

SEQ ID NO: 5047061 - DNA, 17 bp, Homo sapiens
cttgacctgagatgctg

SEQ ID NO: 5047062 - DNA, 22 bp, Homo sapiens
cttgacctgagatgctgggagg

SEQ ID NO: 5047063 - DNA, 21 bp, Homo sapiens
cttgctcctggaacctggcag

SEQ ID NO: 5047064 - DNA, 12 bp, Homo sapiens
cttggaggcctc

SEQ ID NO: 5047065 - DNA, 11 bp, Homo sapiens
cttggccctgc

SEQ ID NO: 5047066 - DNA, 17 bp, Homo sapiens
cttggccctgcgccctg

SEQ ID NO: 5047067 - DNA, 22 bp, Homo sapiens
cttggccctgcgccctgtgcag

SEQ ID NO: 5047068 - DNA, 12 bp, Homo sapiens
cttggctgcccc

SEQ ID NO: 5047069 - DNA, 21 bp, Homo sapiens
cttggctgccccattccagct

SEQ ID NO: 5047070 - DNA, 15 bp, Homo sapiens
cttgtccttgctcct

SEQ ID NO: 5047071 - DNA, 17 bp, Homo sapiens
cttgtccttgctcctgg

SEQ ID NO: 5047072 - DNA, 18 bp, Homo sapiens
cttgtccttgctcctgga

SEQ ID NO: 5047073 - DNA, 21 bp, Homo sapiens
ctttgagacaggtgcctgggg

SEQ ID NO: 5047074 - DNA, 20 bp, Homo sapiens
ctttgagagagggggcactg

SEQ ID NO: 5047075 - DNA, 19 bp, Homo sapiens
cttttagcctggctgtcac

SEQ ID NO: 5047076 - DNA, 23 bp, Homo sapiens
gaaactggcgatctcccagggct

SEQ ID NO: 5047077 - DNA, 20 bp, Homo sapiens
gaaagggatggtcaggccca

SEQ ID NO: 5047078 - DNA, 14 bp, Homo sapiens
gaacctggcaggcc

SEQ ID NO: 5047079 - DNA, 21 bp, Homo sapiens
gaacctggcaggccctgccca

SEQ ID NO: 5047080 - DNA, 22 bp, Homo sapiens
gaacctggcaggccctgcccag

SEQ ID NO: 5047081 - DNA, 14 bp, Homo sapiens
gaactgcacaatga

SEQ ID NO: 5047082 - DNA, 21 bp, Homo sapiens
gaactgcacaatgaccagcag

SEQ ID NO: 5047083 - DNA, 15 bp, Homo sapiens
gaactgtcaccctga

SEQ ID NO: 5047084 - DNA, 13 bp, Homo sapiens
gaagagagggctg

SEQ ID NO: 5047085 - DNA, 14 bp, Homo sapiens
gaagagagggctga

SEQ ID NO: 5047086 - DNA, 19 bp, Homo sapiens
gaagtggaatccagtgtgg

SEQ ID NO: 5047087 - DNA, 20 bp, Homo sapiens
gaagttcaccagccctgagc

SEQ ID NO: 5047088 - DNA, 22 bp, Homo sapiens
gaagttcaccagccctgagcca

SEQ ID NO: 5047089 - DNA, 15 bp, Homo sapiens
gaatgaaccatggca

SEQ ID NO: 5047090 - DNA, 20 bp, Homo sapiens
gacacactgaaaagcagcct

SEQ ID NO: 5047091 - DNA, 19 bp, Homo sapiens
gacagacatcaagtgccag

SEQ ID NO: 5047092 - DNA, 17 bp, Homo sapiens
gacagatctagttctct

SEQ ID NO: 5047093 - DNA, 12 bp, Homo sapiens
gacatgggcagc

SEQ ID NO: 5047094 - DNA, 23 bp, Homo sapiens
gaccagcaggagggaaggacaga

SEQ ID NO: 5047095 - DNA, 14 bp, Homo sapiens
gacccaacccatgc

SEQ ID NO: 5047096 - DNA, 22 bp, Homo sapiens
gacccaacccatgcccctgaca

SEQ ID NO: 5047097 - DNA, 23 bp, Homo sapiens
gacccaacccatgcccctgacag

SEQ ID NO: 5047098 - DNA, 14 bp, Homo sapiens
gacctgtgacctgg

SEQ ID NO: 5047099 - DNA, 18 bp, Homo sapiens
gagaactgtcaccctgag

SEQ ID NO: 5047100 - DNA, 14 bp, Homo sapiens
gagacaggtgcctg

SEQ ID NO: 5047101 - DNA, 15 bp, Homo sapiens
gagacaggtgcctgg

SEQ ID NO: 5047102 - DNA, 15 bp, Homo sapiens
gagacatgggagtgg

SEQ ID NO: 5047103 - DNA, 19 bp, Homo sapiens
gagactgtggtttttgtgt

SEQ ID NO: 5047104 - DNA, 12 bp, Homo sapiens
gagagagggggc

SEQ ID NO: 5047105 - DNA, 22 bp, Homo sapiens
gagagggctgagccatgggggt

SEQ ID NO: 5047106 - DNA, 19 bp, Homo sapiens
gagagggggcactgtggtc

SEQ ID NO: 5047107 - DNA, 23 bp, Homo sapiens
gagaggtatgtgcccctcctggg

SEQ ID NO: 5047108 - DNA, 14 bp, Homo sapiens
gagagtggcctggg

SEQ ID NO: 5047109 - DNA, 18 bp, Homo sapiens
gagatgctgggagggctg

SEQ ID NO: 5047110 - DNA, 18 bp, Homo sapiens
gagcaggcaggggcttgg

SEQ ID NO: 5047111 - DNA, 17 bp, Homo sapiens
gagctgtcggagggctg

SEQ ID NO: 5047112 - DNA, 14 bp, Homo sapiens
gagcttggccctgc

SEQ ID NO: 5047113 - DNA, 19 bp, Homo sapiens
gaggaaactggcgatctcc

SEQ ID NO: 5047114 - DNA, 15 bp, Homo sapiens
gaggagagtggcctg

SEQ ID NO: 5047115 - DNA, 18 bp, Homo sapiens
gaggagagtggcctgggt

SEQ ID NO: 5047116 - DNA, 16 bp, Homo sapiens
gaggagttttctgtgt

SEQ ID NO: 5047117 - DNA, 21 bp, Homo sapiens
gaggagttttctgtgtggtct

SEQ ID NO: 5047118 - DNA, 19 bp, Homo sapiens
gaggcaggtcgggctgcca

SEQ ID NO: 5047119 - DNA, 18 bp, Homo sapiens
gaggccagacacaggccg

SEQ ID NO: 5047120 - DNA, 15 bp, Homo sapiens
gaggtaacagggtca

SEQ ID NO: 5047121 - DNA, 22 bp, Homo sapiens
gaggtatgtgcccctcctgggt

SEQ ID NO: 5047122 - DNA, 22 bp, Homo sapiens
gaggtgagctagacccaaccct

SEQ ID NO: 5047123 - DNA, 21 bp, Homo sapiens
gagtaagaaatgggcctcagc

SEQ ID NO: 5047124 - DNA, 23 bp, Homo sapiens
gatagacctgtgacctggtctgg

SEQ ID NO: 5047125 - DNA, 21 bp, Homo sapiens
gatatttttttacttgagcaa

SEQ ID NO: 5047126 - DNA, 23 bp, Homo sapiens
gatctagttctcttctcctgtgt

SEQ ID NO: 5047127 - DNA, 22 bp, Homo sapiens
gatctcccagggctctctggac

SEQ ID NO: 5047128 - DNA, 17 bp, Homo sapiens
gatggcacccacacaga

SEQ ID NO: 5047129 - DNA, 15 bp, Homo sapiens
gcaaccccagaccca

SEQ ID NO: 5047130 - DNA, 15 bp, Homo sapiens
gcaacttcatcccag

SEQ ID NO: 5047131 - DNA, 17 bp, Homo sapiens
gcaacttcatcccagct

SEQ ID NO: 5047132 - DNA, 21 bp, Homo sapiens
gcaacttcatcccagctgctg

SEQ ID NO: 5047133 - DNA, 22 bp, Homo sapiens
gcaagccccattcacggcctgg

SEQ ID NO: 5047134 - DNA, 23 bp, Homo sapiens
gcaagccccattcacggcctggc

SEQ ID NO: 5047135 - DNA, 19 bp, Homo sapiens
gcaatgccctgcggctctg

SEQ ID NO: 5047136 - DNA, 21 bp, Homo sapiens
gcaatgccctgcggctctgga

SEQ ID NO: 5047137 - DNA, 18 bp, Homo sapiens
gcaattcacgctgtctct

SEQ ID NO: 5047138 - DNA, 19 bp, Homo sapiens
gcacaatgaccagcaggag

SEQ ID NO: 5047139 - DNA, 16 bp, Homo sapiens
gcacccacacagagga

SEQ ID NO: 5047140 - DNA, 17 bp, Homo sapiens
gcacctttgagagaggg

SEQ ID NO: 5047141 - DNA, 14 bp, Homo sapiens
gcactgtggtcagg

SEQ ID NO: 5047142 - DNA, 21 bp, Homo sapiens
gcagacggtgtggttgggggt

SEQ ID NO: 5047143 - DNA, 12 bp, Homo sapiens
gcagagttctgt

SEQ ID NO: 5047144 - DNA, 19 bp, Homo sapiens
gcagcttgtccttgctcct

SEQ ID NO: 5047145 - DNA, 17 bp, Homo sapiens
gcaggcaggggcttggc

SEQ ID NO: 5047146 - DNA, 20 bp, Homo sapiens
gcaggcaggggcttggctgc

SEQ ID NO: 5047147 - DNA, 14 bp, Homo sapiens
gcaggccctgccca

SEQ ID NO: 5047148 - DNA, 17 bp, Homo sapiens
gcaggccctgcccagcc

SEQ ID NO: 5047149 - DNA, 19 bp, Homo sapiens
gcaggccctgcccagccag

SEQ ID NO: 5047150 - DNA, 22 bp, Homo sapiens
gcaggccctgcccagccagcca

SEQ ID NO: 5047151 - DNA, 21 bp, Homo sapiens
gcagggaaagggatggtcagg

SEQ ID NO: 5047152 - DNA, 15 bp, Homo sapiens
gcaggggcttggctg

SEQ ID NO: 5047153 - DNA, 21 bp, Homo sapiens
gcatgcagcttgtccttgctc

SEQ ID NO: 5047154 - DNA, 17 bp, Homo sapiens
gcatgcctcccaggcca

SEQ ID NO: 5047155 - DNA, 20 bp, Homo sapiens
gccacctcagtctcacctgc

SEQ ID NO: 5047156 - DNA, 14 bp, Homo sapiens
gccagacacaggcc

SEQ ID NO: 5047157 - DNA, 15 bp, Homo sapiens
gccagacacaggccg

SEQ ID NO: 5047158 - DNA, 17 bp, Homo sapiens
gccagacacaggccgtg

SEQ ID NO: 5047159 - DNA, 13 bp, Homo sapiens
gccagcccagctg

SEQ ID NO: 5047160 - DNA, 14 bp, Homo sapiens
gccagcccagctgg

SEQ ID NO: 5047161 - DNA, 21 bp, Homo sapiens
gccagcccagctggccggaag

SEQ ID NO: 5047162 - DNA, 14 bp, Homo sapiens
gccatcggaagaga

SEQ ID NO: 5047163 - DNA, 17 bp, Homo sapiens
gccatcggaagagaggg

SEQ ID NO: 5047164 - DNA, 23 bp, Homo sapiens
gccatcggaagagagggctgagc

SEQ ID NO: 5047165 - DNA, 20 bp, Homo sapiens
gcccagcctctctggctcag

SEQ ID NO: 5047166 - DNA, 15 bp, Homo sapiens
gcccagctggccgga

SEQ ID NO: 5047167 - DNA, 23 bp, Homo sapiens
gcccagctggccggaaggagact

SEQ ID NO: 5047168 - DNA, 17 bp, Homo sapiens
gccccattcacggcctg

SEQ ID NO: 5047169 - DNA, 19 bp, Homo sapiens
gccccattcacggcctggc

SEQ ID NO: 5047170 - DNA, 17 bp, Homo sapiens
gccccattccagctctc

SEQ ID NO: 5047171 - DNA, 21 bp, Homo sapiens
gccccattccagctctcccat

SEQ ID NO: 5047172 - DNA, 20 bp, Homo sapiens
gccccgcggatcaaccaggc

SEQ ID NO: 5047173 - DNA, 22 bp, Homo sapiens
gccccgcggatcaaccaggcag

SEQ ID NO: 5047174 - DNA, 22 bp, Homo sapiens
gcccctcagcctgcctgaagag

SEQ ID NO: 5047175 - DNA, 15 bp, Homo sapiens
gcccctccaccgggc

SEQ ID NO: 5047176 - DNA, 12 bp, Homo sapiens
gcccctcctggg

SEQ ID NO: 5047177 - DNA, 13 bp, Homo sapiens
gcccctcctgggt

SEQ ID NO: 5047178 - DNA, 22 bp, Homo sapiens
gcccctgacagatctagttctc

SEQ ID NO: 5047179 - DNA, 23 bp, Homo sapiens
gcccctgacagatctagttctct

SEQ ID NO: 5047180 - DNA, 17 bp, Homo sapiens
gccctgcccagccagcc

SEQ ID NO: 5047181 - DNA, 15 bp, Homo sapiens
gccctgcgccctgtg

SEQ ID NO: 5047182 - DNA, 13 bp, Homo sapiens
gccctgcggctct

SEQ ID NO: 5047183 - DNA, 19 bp, Homo sapiens
gccgagctgtcggagggct

SEQ ID NO: 5047184 - DNA, 19 bp, Homo sapiens
gccgcgtggacagccggag

SEQ ID NO: 5047185 - DNA, 11 bp, Homo sapiens
gccggctctgg

SEQ ID NO: 5047186 - DNA, 12 bp, Homo sapiens
gccggctctggg

SEQ ID NO: 5047187 - DNA, 13 bp, Homo sapiens
gccggctctgggc

SEQ ID NO: 5047188 - DNA, 15 bp, Homo sapiens
gccggctctgggctg

SEQ ID NO: 5047189 - DNA, 18 bp, Homo sapiens
gccggctctgggctggct

SEQ ID NO: 5047190 - DNA, 17 bp, Homo sapiens
gccgtgggacccaggct

SEQ ID NO: 5047191 - DNA, 11 bp, Homo sapiens
gcctcccaggc

SEQ ID NO: 5047192 - DNA, 17 bp, Homo sapiens
gcctctctggctcagcc

SEQ ID NO: 5047193 - DNA, 21 bp, Homo sapiens
gcctctctggctcagcccggg

SEQ ID NO: 5047194 - DNA, 13 bp, Homo sapiens
gcctgaagagagg

SEQ ID NO: 5047195 - DNA, 17 bp, Homo sapiens
gcctgctacacaggcag

SEQ ID NO: 5047196 - DNA, 15 bp, Homo sapiens
gcctggctggccagg

SEQ ID NO: 5047197 - DNA, 20 bp, Homo sapiens
gcctggggccttcctggctt

SEQ ID NO: 5047198 - DNA, 16 bp, Homo sapiens
gcctggggctggctgc

SEQ ID NO: 5047199 - DNA, 15 bp, Homo sapiens
gcctgtgcttggagg

SEQ ID NO: 5047200 - DNA, 19 bp, Homo sapiens
gcctgtgcttggaggcctc

SEQ ID NO: 5047201 - DNA, 20 bp, Homo sapiens
gcctgtgcttggaggcctca

SEQ ID NO: 5047202 - DNA, 13 bp, Homo sapiens
gccttcctggctt

SEQ ID NO: 5047203 - DNA, 14 bp, Homo sapiens
gcctttccctgccg

SEQ ID NO: 5047204 - DNA, 16 bp, Homo sapiens
gcgaagcctgagcagg

SEQ ID NO: 5047205 - DNA, 20 bp, Homo sapiens
gcgaagcctgagcaggcagg

SEQ ID NO: 5047206 - DNA, 13 bp, Homo sapiens
gcgatctcccagg

SEQ ID NO: 5047207 - DNA, 23 bp, Homo sapiens
gcgatctcccagggctctctgga

SEQ ID NO: 5047208 - DNA, 22 bp, Homo sapiens
gcgccgcgtggacagccggagc

SEQ ID NO: 5047209 - DNA, 21 bp, Homo sapiens
gcggaggagttttctgtgtgg

SEQ ID NO: 5047210 - DNA, 14 bp, Homo sapiens
gcggcccctcagcc

SEQ ID NO: 5047211 - DNA, 19 bp, Homo sapiens
gcggcccctcagcctgcct

SEQ ID NO: 5047212 - DNA, 14 bp, Homo sapiens
gcggctctggaaag

SEQ ID NO: 5047213 - DNA, 15 bp, Homo sapiens
gcggttgggaggcag

SEQ ID NO: 5047214 - DNA, 18 bp, Homo sapiens
gctaagaagttcaccagc

SEQ ID NO: 5047215 - DNA, 14 bp, Homo sapiens
gctacacaggcagg

SEQ ID NO: 5047216 - DNA, 15 bp, Homo sapiens
gctagacccaaccct

SEQ ID NO: 5047217 - DNA, 24 bp, Homo sapiens
gctcaccgcctgctacacaggcag

SEQ ID NO: 5047218 - DNA, 14 bp, Homo sapiens
gctcctctccagac

SEQ ID NO: 5047219 - DNA, 17 bp, Homo sapiens
gctcctctccagacaca

SEQ ID NO: 5047220 - DNA, 18 bp, Homo sapiens
gctcctggaacctggcag

SEQ ID NO: 5047221 - DNA, 20 bp, Homo sapiens
gctcctggaacctggcaggc

SEQ ID NO: 5047222 - DNA, 21 bp, Homo sapiens
gctcctggaacctggcaggcc

SEQ ID NO: 5047223 - DNA, 16 bp, Homo sapiens
gctctcaaggcttgga

SEQ ID NO: 5047224 - DNA, 16 bp, Homo sapiens
gctctgggctggctgc

SEQ ID NO: 5047225 - DNA, 20 bp, Homo sapiens
gctgagccatgggggtttgg

SEQ ID NO: 5047226 - DNA, 12 bp, Homo sapiens
gctgccagccca

SEQ ID NO: 5047227 - DNA, 18 bp, Homo sapiens
gctgccagcccagctggc

SEQ ID NO: 5047228 - DNA, 22 bp, Homo sapiens
gctgccagcccagctggccgga

SEQ ID NO: 5047229 - DNA, 17 bp, Homo sapiens
gctgccccattccagct

SEQ ID NO: 5047230 - DNA, 20 bp, Homo sapiens
gctgccccattccagctctc

SEQ ID NO: 5047231 - DNA, 14 bp, Homo sapiens
gctgtcggagggct

SEQ ID NO: 5047232 - DNA, 20 bp, Homo sapiens
gctgtcggagggctggacat

SEQ ID NO: 5047233 - DNA, 14 bp, Homo sapiens
gcttccagaggaga

SEQ ID NO: 5047234 - DNA, 21 bp, Homo sapiens
gcttggagaggtatgtgcccc

SEQ ID NO: 5047235 - DNA, 18 bp, Homo sapiens
gcttggccctgcgccctg

SEQ ID NO: 5047236 - DNA, 22 bp, Homo sapiens
gcttggccctgcgccctgtgca

SEQ ID NO: 5047237 - DNA, 18 bp, Homo sapiens
gcttgtccttgctcctgg

SEQ ID NO: 5047238 - DNA, 19 bp, Homo sapiens
gcttgtccttgctcctgga

SEQ ID NO: 5047239 - DNA, 23 bp, Homo sapiens
gcttgtccttgctcctggaacct

SEQ ID NO: 5047240 - DNA, 21 bp, Homo sapiens
gctttgagacaggtgcctggg

SEQ ID NO: 5047241 - DNA, 15 bp, Homo sapiens
gctttgctctcaagg

SEQ ID NO: 5047242 - DNA, 19 bp, Homo sapiens
gctttgctctcaaggcttg

SEQ ID NO: 5047243 - DNA, 16 bp, Homo sapiens
gcttttagcctggctg

SEQ ID NO: 5047244 - DNA, 17 bp, Homo sapiens
ggaaagggatggtcagg

SEQ ID NO: 5047245 - DNA, 14 bp, Homo sapiens
ggaacctggcaggc

SEQ ID NO: 5047246 - DNA, 15 bp, Homo sapiens
ggaacctggcaggcc

SEQ ID NO: 5047247 - DNA, 17 bp, Homo sapiens
ggaacctggcaggccct

SEQ ID NO: 5047248 - DNA, 19 bp, Homo sapiens
ggaagagagggctgagcca

SEQ ID NO: 5047249 - DNA, 19 bp, Homo sapiens
ggaatccagtgtggctccc

SEQ ID NO: 5047250 - DNA, 19 bp, Homo sapiens
ggaatgcggttgggaggca

SEQ ID NO: 5047251 - DNA, 23 bp, Homo sapiens
ggaatgcggttgggaggcaggtc

SEQ ID NO: 5047252 - DNA, 14 bp, Homo sapiens
ggacagcccgggag

SEQ ID NO: 5047253 - DNA, 16 bp, Homo sapiens
ggacagccggagcagt

SEQ ID NO: 5047254 - DNA, 15 bp, Homo sapiens
ggacatgggcagcaa

SEQ ID NO: 5047255 - DNA, 24 bp, Homo sapiens
ggacatgggcagcaattcacgctg

SEQ ID NO: 5047256 - DNA, 19 bp, Homo sapiens
ggacatttgtggcagtgct

SEQ ID NO: 5047257 - DNA, 12 bp, Homo sapiens
ggagacaggcct

SEQ ID NO: 5047258 - DNA, 15 bp, Homo sapiens
ggagagtggcctggg

SEQ ID NO: 5047259 - DNA, 14 bp, Homo sapiens
ggagcagccggaag

SEQ ID NO: 5047260 - DNA, 13 bp, Homo sapiens
ggagcagttggcc

SEQ ID NO: 5047261 - DNA, 20 bp, Homo sapiens
ggagcagttggcctgtgctt

SEQ ID NO: 5047262 - DNA, 19 bp, Homo sapiens
ggagcggagcttggccctg

SEQ ID NO: 5047263 - DNA, 15 bp, Homo sapiens
ggagcttggccctgc

SEQ ID NO: 5047264 - DNA, 16 bp, Homo sapiens
ggagcttggccctgcg

SEQ ID NO: 5047265 - DNA, 18 bp, Homo sapiens
ggagctttgagacaggtg

SEQ ID NO: 5047266 - DNA, 22 bp, Homo sapiens
ggaggcaggtcgggctgccagc

SEQ ID NO: 5047267 - DNA, 22 bp, Homo sapiens
ggagtaagaaatgggcctcagc

SEQ ID NO: 5047268 - DNA, 16 bp, Homo sapiens
ggatcaaccaggcaga

SEQ ID NO: 5047269 - DNA, 22 bp, Homo sapiens
ggatggggttcttgtccacggg

SEQ ID NO: 5047270 - DNA, 13 bp, Homo sapiens
ggatggtcaggcc

SEQ ID NO: 5047271 - DNA, 15 bp, Homo sapiens
ggatggtcaggccca

SEQ ID NO: 5047272 - DNA, 23 bp, Homo sapiens
ggatggtcaggcccagttctcgt

SEQ ID NO: 5047273 - DNA, 16 bp, Homo sapiens
ggcaagatccaggtgg

SEQ ID NO: 5047274 - DNA, 14 bp, Homo sapiens
ggcaatgccctgcg

SEQ ID NO: 5047275 - DNA, 21 bp, Homo sapiens
ggcaatgccctgcggctctgg

SEQ ID NO: 5047276 - DNA, 14 bp, Homo sapiens
ggcacccacacaga

SEQ ID NO: 5047277 - DNA, 14 bp, Homo sapiens
ggcactgtggtcag

SEQ ID NO: 5047278 - DNA, 16 bp, Homo sapiens
ggcactgtggtcaggc

SEQ ID NO: 5047279 - DNA, 17 bp, Homo sapiens
ggcagcaattcacgctg

SEQ ID NO: 5047280 - DNA, 22 bp, Homo sapiens
ggcaggaatgcggttgggaggc

SEQ ID NO: 5047281 - DNA, 21 bp, Homo sapiens
ggcaggggcttggctgcccca

SEQ ID NO: 5047282 - DNA, 20 bp, Homo sapiens
ggcaggtcgggctgccagcc

SEQ ID NO: 5047283 - DNA, 14 bp, Homo sapiens
ggccacctcagtct

SEQ ID NO: 5047284 - DNA, 20 bp, Homo sapiens
ggccacctcagtctcacctg

SEQ ID NO: 5047285 - DNA, 18 bp, Homo sapiens
ggccagacacaggccgtg

SEQ ID NO: 5047286 - DNA, 22 bp, Homo sapiens
ggccagacacaggccgtgggac

SEQ ID NO: 5047287 - DNA, 20 bp, Homo sapiens
ggcccagttctcgtgccctt

SEQ ID NO: 5047288 - DNA, 23 bp, Homo sapiens
ggccccctattgtctccaaggtc

SEQ ID NO: 5047289 - DNA, 14 bp, Homo sapiens
ggcccctcagcctg

SEQ ID NO: 5047290 - DNA, 15 bp, Homo sapiens
ggcccctcagcctgc

SEQ ID NO: 5047291 - DNA, 21 bp, Homo sapiens
ggcccctcagcctgcctgaag

SEQ ID NO: 5047292 - DNA, 14 bp, Homo sapiens
ggccctaggcactg

SEQ ID NO: 5047293 - DNA, 13 bp, Homo sapiens
ggccctgcgccct

SEQ ID NO: 5047294 - DNA, 18 bp, Homo sapiens
ggccgtgggacccaggct

SEQ ID NO: 5047295 - DNA, 14 bp, Homo sapiens
ggcctcagccccgc

SEQ ID NO: 5047296 - DNA, 16 bp, Homo sapiens
ggcctggcatgcagct

SEQ ID NO: 5047297 - DNA, 15 bp, Homo sapiens
ggcctgggtcccagg

SEQ ID NO: 5047298 - DNA, 13 bp, Homo sapiens
ggccttcctggct

SEQ ID NO: 5047299 - DNA, 15 bp, Homo sapiens
ggcgaagcctgagca

SEQ ID NO: 5047300 - DNA, 18 bp, Homo sapiens
ggcgaagcctgagcaggc

SEQ ID NO: 5047301 - DNA, 19 bp, Homo sapiens
ggcgatctcccagggctct

SEQ ID NO: 5047302 - DNA, 22 bp, Homo sapiens
ggcgatctcccagggctctctg

SEQ ID NO: 5047303 - DNA, 15 bp, Homo sapiens
ggcgcatgcctccca

SEQ ID NO: 5047304 - DNA, 14 bp, Homo sapiens
ggcggcccctcagc

SEQ ID NO: 5047305 - DNA, 19 bp, Homo sapiens
ggctcagcccgggatcctg

SEQ ID NO: 5047306 - DNA, 20 bp, Homo sapiens
ggctcagcccgggatcctga

SEQ ID NO: 5047307 - DNA, 13 bp, Homo sapiens
ggctcccacaggt

SEQ ID NO: 5047308 - DNA, 12 bp, Homo sapiens
ggctcccagcct

SEQ ID NO: 5047309 - DNA, 14 bp, Homo sapiens
ggctgagccatggg

SEQ ID NO: 5047310 - DNA, 19 bp, Homo sapiens
ggctgccccattccagctc

SEQ ID NO: 5047311 - DNA, 11 bp, Homo sapiens
ggctggcccta

SEQ ID NO: 5047312 - DNA, 10 bp, Homo sapiens
ggctggctgc

SEQ ID NO: 5047313 - DNA, 21 bp, Homo sapiens
ggcttggagaggtatgtgccc

SEQ ID NO: 5047314 - DNA, 13 bp, Homo sapiens
ggcttggctgccc

SEQ ID NO: 5047315 - DNA, 15 bp, Homo sapiens
ggcttggctgcccca

SEQ ID NO: 5047316 - DNA, 21 bp, Homo sapiens
gggaatgaaccatggcacctt

SEQ ID NO: 5047317 - DNA, 23 bp, Homo sapiens
gggacacggtttaactgtcccag

SEQ ID NO: 5047318 - DNA, 24 bp, Homo sapiens
gggacacggtttaactgtcccagc

SEQ ID NO: 5047319 - DNA, 12 bp, Homo sapiens
gggacccaggct

SEQ ID NO: 5047320 - DNA, 17 bp, Homo sapiens
gggacccaggctcccag

SEQ ID NO: 5047321 - DNA, 15 bp, Homo sapiens
gggagacaggccttt

SEQ ID NO: 5047322 - DNA, 14 bp, Homo sapiens
gggagcggagcttg

SEQ ID NO: 5047323 - DNA, 23 bp, Homo sapiens
gggagctttgagacaggtgcctg

SEQ ID NO: 5047324 - DNA, 24 bp, Homo sapiens
gggagtaagaaatgggcctcagcc

SEQ ID NO: 5047325 - DNA, 12 bp, Homo sapiens
gggatggtcagg

SEQ ID NO: 5047326 - DNA, 13 bp, Homo sapiens
gggatggtcaggc

SEQ ID NO: 5047327 - DNA, 16 bp, Homo sapiens
gggatggtcaggccca

SEQ ID NO: 5047328 - DNA, 17 bp, Homo sapiens
gggcaagatccaggtgg

SEQ ID NO: 5047329 - DNA, 21 bp, Homo sapiens
gggcaagatccaggtggtccc

SEQ ID NO: 5047330 - DNA, 17 bp, Homo sapiens
gggcactgtggtcaggc

SEQ ID NO: 5047331 - DNA, 22 bp, Homo sapiens
gggcactgtggtcaggcccagc

SEQ ID NO: 5047332 - DNA, 18 bp, Homo sapiens
gggcagcaattcacgctg

SEQ ID NO: 5047333 - DNA, 14 bp, Homo sapiens
gggctctctggacc

SEQ ID NO: 5047334 - DNA, 14 bp, Homo sapiens
gggctgagccatgg

SEQ ID NO: 5047335 - DNA, 15 bp, Homo sapiens
gggctgccagcccag

SEQ ID NO: 5047336 - DNA, 16 bp, Homo sapiens
gggctgccagcccagc

SEQ ID NO: 5047337 - DNA, 18 bp, Homo sapiens
gggctgccagcccagctg

SEQ ID NO: 5047338 - DNA, 21 bp, Homo sapiens
gggctgccagcccagctggcc

SEQ ID NO: 5047339 - DNA, 12 bp, Homo sapiens
gggctggcccta

SEQ ID NO: 5047340 - DNA, 14 bp, Homo sapiens
gggctggctgcaga

SEQ ID NO: 5047341 - DNA, 15 bp, Homo sapiens
gggctggctgcagac

SEQ ID NO: 5047342 - DNA, 15 bp, Homo sapiens
gggctggctgctcct

SEQ ID NO: 5047343 - DNA, 19 bp, Homo sapiens
ggggcactgtggtcaggcc

SEQ ID NO: 5047344 - DNA, 12 bp, Homo sapiens
ggggccttcctg

SEQ ID NO: 5047345 - DNA, 18 bp, Homo sapiens
ggggctcactctggcccc

SEQ ID NO: 5047346 - DNA, 18 bp, Homo sapiens
gggggcactgtggtcagg

SEQ ID NO: 5047347 - DNA, 20 bp, Homo sapiens
gggtcaactggcgaagcctg

SEQ ID NO: 5047348 - DNA, 18 bp, Homo sapiens
gggtcccagggctggccc

SEQ ID NO: 5047349 - DNA, 12 bp, Homo sapiens
gggtgggaggtg

SEQ ID NO: 5047350 - DNA, 22 bp, Homo sapiens
ggtatgtgcccctcctgggtgc

SEQ ID NO: 5047351 - DNA, 23 bp, Homo sapiens
ggtcaactggcgaagcctgagca

SEQ ID NO: 5047352 - DNA, 14 bp, Homo sapiens
ggtcccagggctgg

SEQ ID NO: 5047353 - DNA, 18 bp, Homo sapiens
ggtcccagggctggccct

SEQ ID NO: 5047354 - DNA, 19 bp, Homo sapiens
ggtcccagggctggcccta

SEQ ID NO: 5047355 - DNA, 15 bp, Homo sapiens
ggtcgggctgccagc

SEQ ID NO: 5047356 - DNA, 14 bp, Homo sapiens
ggtctccagctcct

SEQ ID NO: 5047357 - DNA, 21 bp, Homo sapiens
ggtctccagctcctctccaga

SEQ ID NO: 5047358 - DNA, 12 bp, Homo sapiens
ggtctggtcagg

SEQ ID NO: 5047359 - DNA, 14 bp, Homo sapiens
ggtctggtcaggca

SEQ ID NO: 5047360 - DNA, 15 bp, Homo sapiens
ggtctggtcaggcaa

SEQ ID NO: 5047361 - DNA, 16 bp, Homo sapiens
ggtctggtcaggcaat

SEQ ID NO: 5047362 - DNA, 22 bp, Homo sapiens
ggtctggtcaggcaatgccctg

SEQ ID NO: 5047363 - DNA, 17 bp, Homo sapiens
ggtcttcactgcccagg

SEQ ID NO: 5047364 - DNA, 19 bp, Homo sapiens
ggtcttgtgaaaaggcttt

SEQ ID NO: 5047365 - DNA, 17 bp, Homo sapiens
ggtgctcaccgcctgct

SEQ ID NO: 5047366 - DNA, 23 bp, Homo sapiens
ggttgggaggcaggtcgggctgc

SEQ ID NO: 5047367 - DNA, 16 bp, Homo sapiens
gtaagaaatgggcctc

SEQ ID NO: 5047368 - DNA, 17 bp, Homo sapiens
gtatgtgcccctcctgg

SEQ ID NO: 5047369 - DNA, 21 bp, Homo sapiens
gtatgtgcccctcctgggtgc

SEQ ID NO: 5047370 - DNA, 18 bp, Homo sapiens
gtcaactggcgaagcctg

SEQ ID NO: 5047371 - DNA, 20 bp, Homo sapiens
gtcaactggcgaagcctgag

SEQ ID NO: 5047372 - DNA, 20 bp, Homo sapiens
gtcaccccagttcccttggt

SEQ ID NO: 5047373 - DNA, 15 bp, Homo sapiens
gtcaggcaatgccct

SEQ ID NO: 5047374 - DNA, 16 bp, Homo sapiens
gtcaggcaatgccctg

SEQ ID NO: 5047375 - DNA, 18 bp, Homo sapiens
gtcaggcaatgccctgcg

SEQ ID NO: 5047376 - DNA, 20 bp, Homo sapiens
gtcagtcacaaaccagcctg

SEQ ID NO: 5047377 - DNA, 21 bp, Homo sapiens
gtcagtcacaaaccagcctgg

SEQ ID NO: 5047378 - DNA, 20 bp, Homo sapiens
gtccacggggctcactctgg

SEQ ID NO: 5047379 - DNA, 17 bp, Homo sapiens
gtcccagggctggccct

SEQ ID NO: 5047380 - DNA, 20 bp, Homo sapiens
gtcccataggtcttgtgaaa

SEQ ID NO: 5047381 - DNA, 23 bp, Homo sapiens
gtcctacaaaaataaaaggcttc

SEQ ID NO: 5047382 - DNA, 20 bp, Homo sapiens
gtcctcacacacggaggcca

SEQ ID NO: 5047383 - DNA, 21 bp, Homo sapiens
gtcctcacacacggaggccag

SEQ ID NO: 5047384 - DNA, 14 bp, Homo sapiens
gtccttgctcctgg

SEQ ID NO: 5047385 - DNA, 15 bp, Homo sapiens
gtccttgctcctgga

SEQ ID NO: 5047386 - DNA, 23 bp, Homo sapiens
gtccttgctcctggaacctggca

SEQ ID NO: 5047387 - DNA, 17 bp, Homo sapiens
gtcgggctgccagccca

SEQ ID NO: 5047388 - DNA, 19 bp, Homo sapiens
gtcgggctgccagcccagc

SEQ ID NO: 5047389 - DNA, 20 bp, Homo sapiens
gtcgggctgccagcccagct

SEQ ID NO: 5047390 - DNA, 22 bp, Homo sapiens
gtctcacctgccggctctgggc

SEQ ID NO: 5047391 - DNA, 12 bp, Homo sapiens
gtctccagctcc

SEQ ID NO: 5047392 - DNA, 19 bp, Homo sapiens
gtctccagctcctctccag

SEQ ID NO: 5047393 - DNA, 11 bp, Homo sapiens
gtctggtcagg

SEQ ID NO: 5047394 - DNA, 16 bp, Homo sapiens
gtcttcactgcccagg

SEQ ID NO: 5047395 - DNA, 19 bp, Homo sapiens
gtgacctggtctggtcagg

SEQ ID NO: 5047396 - DNA, 20 bp, Homo sapiens
gtgacctggtctggtcaggc

SEQ ID NO: 5047397 - DNA, 23 bp, Homo sapiens
gtgcagggaaagggatggtcagg

SEQ ID NO: 5047398 - DNA, 13 bp, Homo sapiens
gtgcccctcctgg

SEQ ID NO: 5047399 - DNA, 19 bp, Homo sapiens
gtgcctggggctggctgca

SEQ ID NO: 5047400 - DNA, 20 bp, Homo sapiens
gtgctgaagggggcattgcc

SEQ ID NO: 5047401 - DNA, 12 bp, Homo sapiens
gtgcttggaggc

SEQ ID NO: 5047402 - DNA, 13 bp, Homo sapiens
gtgcttggaggcc

SEQ ID NO: 5047403 - DNA, 16 bp, Homo sapiens
gtgcttggaggcctca

SEQ ID NO: 5047404 - DNA, 22 bp, Homo sapiens
gtggaatccagtgtggctccca

SEQ ID NO: 5047405 - DNA, 17 bp, Homo sapiens
gtggacagccggagcag

SEQ ID NO: 5047406 - DNA, 12 bp, Homo sapiens
gtggcagtgctg

SEQ ID NO: 5047407 - DNA, 17 bp, Homo sapiens
gtggcctgggtcccagg

SEQ ID NO: 5047408 - DNA, 19 bp, Homo sapiens
gtggcctgggtcccagggc

SEQ ID NO: 5047409 - DNA, 23 bp, Homo sapiens
gtggcctgggtcccagggctggc

SEQ ID NO: 5047410 - DNA, 19 bp, Homo sapiens
gtggcgccgcgtggacagc

SEQ ID NO: 5047411 - DNA, 15 bp, Homo sapiens
gtggggagcggagct

SEQ ID NO: 5047412 - DNA, 21 bp, Homo sapiens
gtggggagcggagcttggccc

SEQ ID NO: 5047413 - DNA, 23 bp, Homo sapiens
gtggggagcggagcttggccctg

SEQ ID NO: 5047414 - DNA, 14 bp, Homo sapiens
gtggtcaggcccag

SEQ ID NO: 5047415 - DNA, 15 bp, Homo sapiens
gtggtcaggcccagc

SEQ ID NO: 5047416 - DNA, 16 bp, Homo sapiens
gtggtcaggcccagcc

SEQ ID NO: 5047417 - DNA, 15 bp, Homo sapiens
gtggtctccagctcc

SEQ ID NO: 5047418 - DNA, 20 bp, Homo sapiens
gtggttgggggtgggaggtg

SEQ ID NO: 5047419 - DNA, 15 bp, Homo sapiens
gtgtctatggagcag

SEQ ID NO: 5047420 - DNA, 15 bp, Homo sapiens
gtgtggctcccacag

SEQ ID NO: 5047421 - DNA, 16 bp, Homo sapiens
gtgtggctcccacagg

SEQ ID NO: 5047422 - DNA, 23 bp, Homo sapiens
gtgtggtctccagctcctctcca

SEQ ID NO: 5047423 - DNA, 14 bp, Homo sapiens
gtgtgtggacagcc

SEQ ID NO: 5047424 - DNA, 15 bp, Homo sapiens
gtgtgtgtggacagc

SEQ ID NO: 5047425 - DNA, 13 bp, Homo sapiens
gttcaccagccct

SEQ ID NO: 5047426 - DNA, 16 bp, Homo sapiens
gttcaccagccctgag

SEQ ID NO: 5047427 - DNA, 15 bp, Homo sapiens
gttctcttctcctgt

SEQ ID NO: 5047428 - DNA, 19 bp, Homo sapiens
gttgccttttcttcccctc

SEQ ID NO: 5047429 - DNA, 23 bp, Homo sapiens
gttggcctgtgcttggaggcctc

SEQ ID NO: 5047430 - DNA, 14 bp, Homo sapiens
gttgggaggcaggt

SEQ ID NO: 5047431 - DNA, 17 bp, Homo sapiens
gtttaactgtcccagcg

SEQ ID NO: 5047432 - DNA, 20 bp, Homo sapiens
gtttcttcttgtcaccccag

SEQ ID NO: 5047433 - DNA, 15 bp, Homo sapiens
taactgtcccagcga

SEQ ID NO: 5047434 - DNA, 22 bp, Homo sapiens
taagaagttcaccagccctgag

SEQ ID NO: 5047435 - DNA, 18 bp, Homo sapiens
tagacctgtgacctggtc

SEQ ID NO: 5047436 - DNA, 20 bp, Homo sapiens
tagacctgtgacctggtctg

SEQ ID NO: 5047437 - DNA, 22 bp, Homo sapiens
tagaggggaatgaaccatggca

SEQ ID NO: 5047438 - DNA, 18 bp, Homo sapiens
tagcttttagcctggctg

SEQ ID NO: 5047439 - DNA, 20 bp, Homo sapiens
tagtccaatcacccccagga

SEQ ID NO: 5047440 - DNA, 21 bp, Homo sapiens
tagtccaatcacccccaggac

SEQ ID NO: 5047441 - DNA, 15 bp, Homo sapiens
tatggagcagccgga

SEQ ID NO: 5047442 - DNA, 17 bp, Homo sapiens
tattgtcagtcctacaa

SEQ ID NO: 5047443 - DNA, 20 bp, Homo sapiens
tatttttttacttgagcaaa

SEQ ID NO: 5047444 - DNA, 15 bp, Homo sapiens
tcaaccaggcagagt

SEQ ID NO: 5047445 - DNA, 18 bp, Homo sapiens
tcaactggcgaagcctga

SEQ ID NO: 5047446 - DNA, 12 bp, Homo sapiens
tcaaggcttgga

SEQ ID NO: 5047447 - DNA, 14 bp, Homo sapiens
tcaaggcttggaga

SEQ ID NO: 5047448 - DNA, 14 bp, Homo sapiens
tcacaaaccagcct

SEQ ID NO: 5047449 - DNA, 19 bp, Homo sapiens
tcacacacggaggccagac

SEQ ID NO: 5047450 - DNA, 14 bp, Homo sapiens
tcaccagccctgag

SEQ ID NO: 5047451 - DNA, 16 bp, Homo sapiens
tcaccagccctgagcc

SEQ ID NO: 5047452 - DNA, 12 bp, Homo sapiens
tcacccccagga

SEQ ID NO: 5047453 - DNA, 16 bp, Homo sapiens
tcacccccaggacctc

SEQ ID NO: 5047454 - DNA, 17 bp, Homo sapiens
tcacccccaggacctct

SEQ ID NO: 5047455 - DNA, 14 bp, Homo sapiens
tcacctgccggctc

SEQ ID NO: 5047456 - DNA, 18 bp, Homo sapiens
tcacctgccggctctggg

SEQ ID NO: 5047457 - DNA, 15 bp, Homo sapiens
tcagatagacctgtg

SEQ ID NO: 5047458 - DNA, 21 bp, Homo sapiens
tcagcctgcctgaagagagga

SEQ ID NO: 5047459 - DNA, 15 bp, Homo sapiens
tcaggcccagcctct

SEQ ID NO: 5047460 - DNA, 14 bp, Homo sapiens
tcagtcacaaacca

SEQ ID NO: 5047461 - DNA, 19 bp, Homo sapiens
tcagtctcacctgccggct

SEQ ID NO: 5047462 - DNA, 21 bp, Homo sapiens
tcagtctcacctgccggctct

SEQ ID NO: 5047463 - DNA, 14 bp, Homo sapiens
tcatcccagctgct

SEQ ID NO: 5047464 - DNA, 17 bp, Homo sapiens
tccaatcacccccagga

SEQ ID NO: 5047465 - DNA, 23 bp, Homo sapiens
tccaccgggcgcatgcctcccag

SEQ ID NO: 5047466 - DNA, 19 bp, Homo sapiens
tccacggggctcactctgg

SEQ ID NO: 5047467 - DNA, 23 bp, Homo sapiens
tccacggggctcactctggcccc

SEQ ID NO: 5047468 - DNA, 14 bp, Homo sapiens
tccagaactgcaca

SEQ ID NO: 5047469 - DNA, 20 bp, Homo sapiens
tccagaggagagtggcctgg

SEQ ID NO: 5047470 - DNA, 23 bp, Homo sapiens
tccagaggagagtggcctgggtc

SEQ ID NO: 5047471 - DNA, 13 bp, Homo sapiens
tccagctcctctc

SEQ ID NO: 5047472 - DNA, 23 bp, Homo sapiens
tccagctctcccatggagcccct

SEQ ID NO: 5047473 - DNA, 18 bp, Homo sapiens
tccagtgtggctcccaca

SEQ ID NO: 5047474 - DNA, 23 bp, Homo sapiens
tcccacaggtcttcactgcccag

SEQ ID NO: 5047475 - DNA, 13 bp, Homo sapiens
tcccagctgctga

SEQ ID NO: 5047476 - DNA, 19 bp, Homo sapiens
tcccagggctctctggacc

SEQ ID NO: 5047477 - DNA, 22 bp, Homo sapiens
tcctacaaaaataaaaggcttc

SEQ ID NO: 5047478 - DNA, 23 bp, Homo sapiens
tcctacaaaaataaaaggcttcc

SEQ ID NO: 5047479 - DNA, 16 bp, Homo sapiens
tcctggaacctggcag

SEQ ID NO: 5047480 - DNA, 23 bp, Homo sapiens
tcctggaacctggcaggccctgc

SEQ ID NO: 5047481 - DNA, 21 bp, Homo sapiens
tcctgtaagagtattaacaaa

SEQ ID NO: 5047482 - DNA, 18 bp, Homo sapiens
tccttgctcctggaacct

SEQ ID NO: 5047483 - DNA, 16 bp, Homo sapiens
tcggaagagagggctg

SEQ ID NO: 5047484 - DNA, 17 bp, Homo sapiens
tcggaagagagggctga

SEQ ID NO: 5047485 - DNA, 12 bp, Homo sapiens
tcggagggctgg

SEQ ID NO: 5047486 - DNA, 14 bp, Homo sapiens
tcgggctgccagcc

SEQ ID NO: 5047487 - DNA, 20 bp, Homo sapiens
tcgggctgccagcccagctg

SEQ ID NO: 5047488 - DNA, 20 bp, Homo sapiens
tctcacctgccggctctggg

SEQ ID NO: 5047489 - DNA, 22 bp, Homo sapiens
tctccaagtggaaatcctattt

SEQ ID NO: 5047490 - DNA, 13 bp, Homo sapiens
tctctggctcagc

SEQ ID NO: 5047491 - DNA, 18 bp, Homo sapiens
tctctggctcagcccggg

SEQ ID NO: 5047492 - DNA, 13 bp, Homo sapiens
tctcttctcctgt

SEQ ID NO: 5047493 - DNA, 22 bp, Homo sapiens
tctcttcttaaccctgaacaag

SEQ ID NO: 5047494 - DNA, 17 bp, Homo sapiens
tctggctcagcccggga

SEQ ID NO: 5047495 - DNA, 18 bp, Homo sapiens
tctgggctggctgctcct

SEQ ID NO: 5047496 - DNA, 20 bp, Homo sapiens
tctggtcaggcaatgccctg

SEQ ID NO: 5047497 - DNA, 17 bp, Homo sapiens
tcttcccctcctgtaag

SEQ ID NO: 5047498 - DNA, 21 bp, Homo sapiens
tctttggggcaagatccaggt

SEQ ID NO: 5047499 - DNA, 22 bp, Homo sapiens
tgacctggtctggtcaggcaat

SEQ ID NO: 5047500 - DNA, 23 bp, Homo sapiens
tgacctggtctggtcaggcaatg

SEQ ID NO: 5047501 - DNA, 21 bp, Homo sapiens
tgagacaggtgcctggggctg

SEQ ID NO: 5047502 - DNA, 18 bp, Homo sapiens
tgagatgctgggagggct

SEQ ID NO: 5047503 - DNA, 23 bp, Homo sapiens
tgagcaggcaggggcttggctgc

SEQ ID NO: 5047504 - DNA, 22 bp, Homo sapiens
tgatagttgccttttcttcccc

SEQ ID NO: 5047505 - DNA, 16 bp, Homo sapiens
tgcacaatgaccagca

SEQ ID NO: 5047506 - DNA, 22 bp, Homo sapiens
tgcagggaaagggatggtcagg

SEQ ID NO: 5047507 - DNA, 17 bp, Homo sapiens
tgccagcccagctggcc

SEQ ID NO: 5047508 - DNA, 23 bp, Homo sapiens
tgccagcccagctggccggaagg

SEQ ID NO: 5047509 - DNA, 14 bp, Homo sapiens
tgccctgcggctct

SEQ ID NO: 5047510 - DNA, 15 bp, Homo sapiens
tgccctgcggctctg

SEQ ID NO: 5047511 - DNA, 16 bp, Homo sapiens
tgccctgcggctctgg

SEQ ID NO: 5047512 - DNA, 18 bp, Homo sapiens
tgccctgcggctctggaa

SEQ ID NO: 5047513 - DNA, 12 bp, Homo sapiens
tgcctcccaggc

SEQ ID NO: 5047514 - DNA, 14 bp, Homo sapiens
tgcctgaagagagg

SEQ ID NO: 5047515 - DNA, 15 bp, Homo sapiens
tgcctgaagagagga

SEQ ID NO: 5047516 - DNA, 16 bp, Homo sapiens
tgcctgaagagaggaa

SEQ ID NO: 5047517 - DNA, 14 bp, Homo sapiens
tgcctggggctggc

SEQ ID NO: 5047518 - DNA, 15 bp, Homo sapiens
tgcggttgggaggca

SEQ ID NO: 5047519 - DNA, 13 bp, Homo sapiens
tgctacacaggca

SEQ ID NO: 5047520 - DNA, 14 bp, Homo sapiens
tgctcctggaacct

SEQ ID NO: 5047521 - DNA, 20 bp, Homo sapiens
tgctcctggaacctggcagg

SEQ ID NO: 5047522 - DNA, 20 bp, Homo sapiens
tgctctcaaggcttggagag

SEQ ID NO: 5047523 - DNA, 16 bp, Homo sapiens
tgctgggagggctgaa

SEQ ID NO: 5047524 - DNA, 17 bp, Homo sapiens
tgcttggaggcctcaga

SEQ ID NO: 5047525 - DNA, 14 bp, Homo sapiens
tggaacctggcagg

SEQ ID NO: 5047526 - DNA, 18 bp, Homo sapiens
tggaacctggcaggccct

SEQ ID NO: 5047527 - DNA, 14 bp, Homo sapiens
tggacagcccggga

SEQ ID NO: 5047528 - DNA, 13 bp, Homo sapiens
tggacagccggag

SEQ ID NO: 5047529 - DNA, 15 bp, Homo sapiens
tggacatgggcagca

SEQ ID NO: 5047530 - DNA, 18 bp, Homo sapiens
tggacatttgtggcagtg

SEQ ID NO: 5047531 - DNA, 16 bp, Homo sapiens
tggcaaccccagaccc

SEQ ID NO: 5047532 - DNA, 19 bp, Homo sapiens
tggcacctttgagagaggg

SEQ ID NO: 5047533 - DNA, 21 bp, Homo sapiens
tggcacctttgagagaggggg

SEQ ID NO: 5047534 - DNA, 16 bp, Homo sapiens
tggcaggccctgccca

SEQ ID NO: 5047535 - DNA, 18 bp, Homo sapiens
tggcaggccctgcccagc

SEQ ID NO: 5047536 - DNA, 13 bp, Homo sapiens
tggccaggacaca

SEQ ID NO: 5047537 - DNA, 17 bp, Homo sapiens
tggccaggacacactga

SEQ ID NO: 5047538 - DNA, 17 bp, Homo sapiens
tggccctgcgccctgtg

SEQ ID NO: 5047539 - DNA, 13 bp, Homo sapiens
tggccggaaggag

SEQ ID NO: 5047540 - DNA, 15 bp, Homo sapiens
tggcctgggtcccag

SEQ ID NO: 5047541 - DNA, 15 bp, Homo sapiens
tggcctgtgcttgga

SEQ ID NO: 5047542 - DNA, 20 bp, Homo sapiens
tggcctgtgcttggaggcct

SEQ ID NO: 5047543 - DNA, 14 bp, Homo sapiens
tggcgaagcctgag

SEQ ID NO: 5047544 - DNA, 21 bp, Homo sapiens
tggcgaagcctgagcaggcag

SEQ ID NO: 5047545 - DNA, 23 bp, Homo sapiens
tggcgaagcctgagcaggcaggg

SEQ ID NO: 5047546 - DNA, 17 bp, Homo sapiens
tggcgatctcccagggc

SEQ ID NO: 5047547 - DNA, 18 bp, Homo sapiens
tggcggcccctcagcctg

SEQ ID NO: 5047548 - DNA, 20 bp, Homo sapiens
tggcggcccctcagcctgcc

SEQ ID NO: 5047549 - DNA, 21 bp, Homo sapiens
tggcggcccctcagcctgcct

SEQ ID NO: 5047550 - DNA, 23 bp, Homo sapiens
tggctcccacaggtcttcactgc

SEQ ID NO: 5047551 - DNA, 21 bp, Homo sapiens
tggctgccccattccagctct

SEQ ID NO: 5047552 - DNA, 12 bp, Homo sapiens
tggctggccagg

SEQ ID NO: 5047553 - DNA, 13 bp, Homo sapiens
tgggacccaggct

SEQ ID NO: 5047554 - DNA, 20 bp, Homo sapiens
tgggacccaggctcccagcc

SEQ ID NO: 5047555 - DNA, 21 bp, Homo sapiens
tgggacccaggctcccagcct

SEQ ID NO: 5047556 - DNA, 22 bp, Homo sapiens
tgggaggcaggtcgggctgcca

SEQ ID NO: 5047557 - DNA, 11 bp, Homo sapiens
tgggcctcagc

SEQ ID NO: 5047558 - DNA, 13 bp, Homo sapiens
tgggggtgggagg

SEQ ID NO: 5047559 - DNA, 18 bp, Homo sapiens
tggggtccccctcccact

SEQ ID NO: 5047560 - DNA, 12 bp, Homo sapiens
tgggtcccaggg

SEQ ID NO: 5047561 - DNA, 17 bp, Homo sapiens
tgggtcccagggctggc

SEQ ID NO: 5047562 - DNA, 10 bp, Homo sapiens
tggtcaggcc

SEQ ID NO: 5047563 - DNA, 14 bp, Homo sapiens
tggtcaggcccagc

SEQ ID NO: 5047564 - DNA, 13 bp, Homo sapiens
tggtctccagctc

SEQ ID NO: 5047565 - DNA, 14 bp, Homo sapiens
tggtctggtcaggc

SEQ ID NO: 5047566 - DNA, 18 bp, Homo sapiens
tggtggcaaccccagacc

SEQ ID NO: 5047567 - DNA, 20 bp, Homo sapiens
tgtccacggggctcactctg

SEQ ID NO: 5047568 - DNA, 18 bp, Homo sapiens
tgtcggagggctggacat

SEQ ID NO: 5047569 - DNA, 14 bp, Homo sapiens
tgtgaaaaggcttt

SEQ ID NO: 5047570 - DNA, 14 bp, Homo sapiens
tgtgacctggtctg

SEQ ID NO: 5047571 - DNA, 20 bp, Homo sapiens
tgtgacctggtctggtcagg

SEQ ID NO: 5047572 - DNA, 14 bp, Homo sapiens
tgtgcccctcctgg

SEQ ID NO: 5047573 - DNA, 16 bp, Homo sapiens
tgtgcttggaggcctc

SEQ ID NO: 5047574 - DNA, 18 bp, Homo sapiens
tgtgcttggaggcctcag

SEQ ID NO: 5047575 - DNA, 17 bp, Homo sapiens
tgtggacagcccgggag

SEQ ID NO: 5047576 - DNA, 18 bp, Homo sapiens
tgtggtcaggcccagcct

SEQ ID NO: 5047577 - DNA, 15 bp, Homo sapiens
tgtggtctccagctc

SEQ ID NO: 5047578 - DNA, 18 bp, Homo sapiens
tgtggtctccagctcctc

SEQ ID NO: 5047579 - DNA, 13 bp, Homo sapiens
tgtgtgtggacag

SEQ ID NO: 5047580 - DNA, 15 bp, Homo sapiens
tgtgtgtgtggacag

SEQ ID NO: 5047581 - DNA, 15 bp, Homo sapiens
tgttccctttgagtc

SEQ ID NO: 5047582 - DNA, 13 bp, Homo sapiens
ttacttgagcaaa

SEQ ID NO: 5047583 - DNA, 13 bp, Homo sapiens
ttagcctggctgt

SEQ ID NO: 5047584 - DNA, 13 bp, Homo sapiens
ttcaccagccctg

SEQ ID NO: 5047585 - DNA, 16 bp, Homo sapiens
ttcaccatggcaaacc

SEQ ID NO: 5047586 - DNA, 13 bp, Homo sapiens
ttcacggcctggc

SEQ ID NO: 5047587 - DNA, 14 bp, Homo sapiens
ttcacggcctggca

SEQ ID NO: 5047588 - DNA, 19 bp, Homo sapiens
ttccatggacatgggcagc

SEQ ID NO: 5047589 - DNA, 15 bp, Homo sapiens
ttcccttggtggcaa

SEQ ID NO: 5047590 - DNA, 18 bp, Homo sapiens
ttccctttgagtccagtg

SEQ ID NO: 5047591 - DNA, 16 bp, Homo sapiens
ttcttcccctcctgta

SEQ ID NO: 5047592 - DNA, 13 bp, Homo sapiens
ttgagtccagtgt

SEQ ID NO: 5047593 - DNA, 18 bp, Homo sapiens
ttgctcctggaacctggc

SEQ ID NO: 5047594 - DNA, 11 bp, Homo sapiens
ttggccctgcg

SEQ ID NO: 5047595 - DNA, 24 bp, Homo sapiens
ttggctgccccattccagctctcc

SEQ ID NO: 5047596 - DNA, 17 bp, Homo sapiens
ttgggggtgggaggtga

SEQ ID NO: 5047597 - DNA, 20 bp, Homo sapiens
tttgagagagggggcactgt

SEQ ID NO: 5047598 - DNA, 23 bp, Homo sapiens
tttgagagagggggcactgtggt

SEQ ID NO: 5047599 - DNA, 17 bp, Homo sapiens
tttgatatttttttact

SEQ ID NO: 5047600 - DNA, 15 bp, Homo sapiens
tttgtggcagtgctg

SEQ ID NO: 5047601 - DNA, 23 bp, Homo sapiens
ttttaacatagagaactgtcacc

SEQ ID NO: 5047602 - DNA, 13 bp, Homo sapiens
ttttagcctggct

SEQ ID NO: 5047603 - DNA, 23 bp, Homo sapiens
tctccagcctggacccccagctt

SEQ ID NO: 5047604 - DNA, 19 bp, Homo sapiens
tctcccaaggctgcgtctg

SEQ ID NO: 5047605 - DNA, 20 bp, Homo sapiens
tctccctcctggtgaagtgt

SEQ ID NO: 5047606 - DNA, 15 bp, Homo sapiens
tctccttgccctggg

SEQ ID NO: 5047607 - DNA, 20 bp, Homo sapiens
tctctgcccaagttgctctg

SEQ ID NO: 5047608 - DNA, 19 bp, Homo sapiens
tctctgctgcttctgggcc

SEQ ID NO: 5047609 - DNA, 23 bp, Homo sapiens
tctctttgttctcagctccccct

SEQ ID NO: 5047610 - DNA, 17 bp, Homo sapiens
tctgagcccccacctgc

SEQ ID NO: 5047611 - DNA, 23 bp, Homo sapiens
tctgagccctccttcttgccctg

SEQ ID NO: 5047612 - DNA, 14 bp, Homo sapiens
tctgccactgggac

SEQ ID NO: 5047613 - DNA, 19 bp, Homo sapiens
tctgcccaagttgctctgt

SEQ ID NO: 5047614 - DNA, 18 bp, Homo sapiens
tctgccccacacccagcc

SEQ ID NO: 5047615 - DNA, 16 bp, Homo sapiens
tctgcctgcctgggaa

SEQ ID NO: 5047616 - DNA, 16 bp, Homo sapiens
tctgggcctgatggag

SEQ ID NO: 5047617 - DNA, 13 bp, Homo sapiens
tctggggaaggac

SEQ ID NO: 5047618 - DNA, 22 bp, Homo sapiens
tctgtatgtgttcgtcagtgtt

SEQ ID NO: 5047619 - DNA, 15 bp, Homo sapiens
tctgtcattaaactc

SEQ ID NO: 5047620 - DNA, 21 bp, Homo sapiens
tctgtgcagatgctttgccca

SEQ ID NO: 5047621 - DNA, 23 bp, Homo sapiens
tctgtgtcagcatctttgccctt

SEQ ID NO: 5047622 - DNA, 16 bp, Homo sapiens
tctgttagctgctcac

SEQ ID NO: 5047623 - DNA, 15 bp, Homo sapiens
tcttgatcagtgtgc

SEQ ID NO: 5047624 - DNA, 11 bp, Homo sapiens
tcttgccctga

SEQ ID NO: 5047625 - DNA, 12 bp, Homo sapiens
tcttgccctgag

SEQ ID NO: 5047626 - DNA, 15 bp, Homo sapiens
tcttgccctgagctt

SEQ ID NO: 5047627 - DNA, 16 bp, Homo sapiens
tcttgttcgcacaatc

SEQ ID NO: 5047628 - DNA, 22 bp, Homo sapiens
tcttgttcgcacaatctacact

SEQ ID NO: 5047629 - DNA, 21 bp, Homo sapiens
tctttgattatgacagtaaca

SEQ ID NO: 5047630 - DNA, 21 bp, Homo sapiens
tgaagccacctctctgcctgt

SEQ ID NO: 5047631 - DNA, 15 bp, Homo sapiens
tgacagctttctaac

SEQ ID NO: 5047632 - DNA, 18 bp, Homo sapiens
tgacagctttctaactca

SEQ ID NO: 5047633 - DNA, 23 bp, Homo sapiens
tgacagtaacaaaattgacagct

SEQ ID NO: 5047634 - DNA, 16 bp, Homo sapiens
tgaccttttaatcaga

SEQ ID NO: 5047635 - DNA, 21 bp, Homo sapiens
tgactgtaggcgcccctgggg

SEQ ID NO: 5047636 - DNA, 14 bp, Homo sapiens
tgactgtcacggaa

SEQ ID NO: 5047637 - DNA, 20 bp, Homo sapiens
tgagacgccaccattcctgg

SEQ ID NO: 5047638 - DNA, 18 bp, Homo sapiens
tgagacggatggaaggag

SEQ ID NO: 5047639 - DNA, 21 bp, Homo sapiens
tgagacggatggaaggagaga

SEQ ID NO: 5047640 - DNA, 23 bp, Homo sapiens
tgagccagttacctttgctgtca

SEQ ID NO: 5047641 - DNA, 19 bp, Homo sapiens
tgagcccccacctgcctga

SEQ ID NO: 5047642 - DNA, 22 bp, Homo sapiens
tgagcctgccccagctgggctg

SEQ ID NO: 5047643 - DNA, 14 bp, Homo sapiens
tgagctgtctaaaa

SEQ ID NO: 5047644 - DNA, 15 bp, Homo sapiens
tgaggcaggggagtc

SEQ ID NO: 5047645 - DNA, 21 bp, Homo sapiens
tgagggcagttctgcacccag

SEQ ID NO: 5047646 - DNA, 15 bp, Homo sapiens
tgagtctcccaaggc

SEQ ID NO: 5047647 - DNA, 15 bp, Homo sapiens
tgatggagaggagaa

SEQ ID NO: 5047648 - DNA, 16 bp, Homo sapiens
tgatggagaggagaac

SEQ ID NO: 5047649 - DNA, 17 bp, Homo sapiens
tgattaaagtgccttca

SEQ ID NO: 5047650 - DNA, 18 bp, Homo sapiens
tgcacccagccaaacaca

SEQ ID NO: 5047651 - DNA, 18 bp, Homo sapiens
tgcactaaccccagctgc

SEQ ID NO: 5047652 - DNA, 19 bp, Homo sapiens
tgcactaaccccagctgcc

SEQ ID NO: 5047653 - DNA, 23 bp, Homo sapiens
tgcactggcctgttctgtaggag

SEQ ID NO: 5047654 - DNA, 17 bp, Homo sapiens
tgcagaggagccacctg

SEQ ID NO: 5047655 - DNA, 12 bp, Homo sapiens
tgcagcaggcag

SEQ ID NO: 5047656 - DNA, 16 bp, Homo sapiens
tgcagcaggcagagga

SEQ ID NO: 5047657 - DNA, 18 bp, Homo sapiens
tgcagccccaggaccaag

SEQ ID NO: 5047658 - DNA, 16 bp, Homo sapiens
tgcaggaggcctggga

SEQ ID NO: 5047659 - DNA, 17 bp, Homo sapiens
tgccaactcgggagcat

SEQ ID NO: 5047660 - DNA, 13 bp, Homo sapiens
tgccaagcctgga

SEQ ID NO: 5047661 - DNA, 14 bp, Homo sapiens
tgccaagcctggag

SEQ ID NO: 5047662 - DNA, 18 bp, Homo sapiens
tgccaagcctggagcccc

SEQ ID NO: 5047663 - DNA, 20 bp, Homo sapiens
tgccaagcctggagcccctg

SEQ ID NO: 5047664 - DNA, 11 bp, Homo sapiens
tgccacaggcc

SEQ ID NO: 5047665 - DNA, 13 bp, Homo sapiens
tgccacaggcctc

SEQ ID NO: 5047666 - DNA, 15 bp, Homo sapiens
tgccacaggcctccc

SEQ ID NO: 5047667 - DNA, 18 bp, Homo sapiens
tgccacaggcctccctgt

SEQ ID NO: 5047668 - DNA, 22 bp, Homo sapiens
tgccacaggcctccctgtttga

SEQ ID NO: 5047669 - DNA, 16 bp, Homo sapiens
tgcccaacaccagccc

SEQ ID NO: 5047670 - DNA, 17 bp, Homo sapiens
tgcccaagttgctctgt

SEQ ID NO: 5047671 - DNA, 18 bp, Homo sapiens
tgcccagtcccccaaccc

SEQ ID NO: 5047672 - DNA, 23 bp, Homo sapiens
tgcccagtcccccaaccccagcc

SEQ ID NO: 5047673 - DNA, 13 bp, Homo sapiens
tgccccagcccaa

SEQ ID NO: 5047674 - DNA, 17 bp, Homo sapiens
tgccccagcccaagtcc

SEQ ID NO: 5047675 - DNA, 19 bp, Homo sapiens
tgcccgctgtcccaggggt

SEQ ID NO: 5047676 - DNA, 15 bp, Homo sapiens
tgcccgttgccgggc

SEQ ID NO: 5047677 - DNA, 24 bp, Homo sapiens
tgcccgttgccgggcctggactgt

SEQ ID NO: 5047678 - DNA, 19 bp, Homo sapiens
tgccctgagctttccgggg

SEQ ID NO: 5047679 - DNA, 23 bp, Homo sapiens
tgccctgagctttccggggagga

SEQ ID NO: 5047680 - DNA, 22 bp, Homo sapiens
agtctcacatattcatcagcag

SEQ ID NO: 5047681 - DNA, 19 bp, Homo sapiens
agtgcactaaccccagctg

SEQ ID NO: 5047682 - DNA, 20 bp, Homo sapiens
agtgcactaaccccagctgc

SEQ ID NO: 5047683 - DNA, 16 bp, Homo sapiens
agtgccttcagccaag

SEQ ID NO: 5047684 - DNA, 12 bp, Homo sapiens
agtgttctgagc

SEQ ID NO: 5047685 - DNA, 14 bp, Homo sapiens
agtgttctgagccc

SEQ ID NO: 5047686 - DNA, 14 bp, Homo sapiens
ataattttctaatt

SEQ ID NO: 5047687 - DNA, 21 bp, Homo sapiens
atatcactatgaacttggata

SEQ ID NO: 5047688 - DNA, 16 bp, Homo sapiens
atattcaagcctttgg

SEQ ID NO: 5047689 - DNA, 16 bp, Homo sapiens
atattcatcagcagga

SEQ ID NO: 5047690 - DNA, 18 bp, Homo sapiens
atattctcatggctttgt

SEQ ID NO: 5047691 - DNA, 23 bp, Homo sapiens
atatttgctggagtgctggctcc

SEQ ID NO: 5047692 - DNA, 12 bp, Homo sapiens
atcacagcaccc

SEQ ID NO: 5047693 - DNA, 15 bp, Homo sapiens
atcacgctccccgcc

SEQ ID NO: 5047694 - DNA, 15 bp, Homo sapiens
atcagtgtgctaacc

SEQ ID NO: 5047695 - DNA, 22 bp, Homo sapiens
atcagttgggatccctcctcca

SEQ ID NO: 5047696 - DNA, 21 bp, Homo sapiens
atcatctcttttcccactccc

SEQ ID NO: 5047697 - DNA, 22 bp, Homo sapiens
atcccacttagcagggacagga

SEQ ID NO: 5047698 - DNA, 10 bp, Homo sapiens
atcctggagc

SEQ ID NO: 5047699 - DNA, 11 bp, Homo sapiens
atcctggagcc

SEQ ID NO: 5047700 - DNA, 22 bp, Homo sapiens
atctctgctgcttctgggcctg

SEQ ID NO: 5047701 - DNA, 17 bp, Homo sapiens
atctcttgttcgcacaa

SEQ ID NO: 5047702 - DNA, 18 bp, Homo sapiens
atctcttttcccactccc

SEQ ID NO: 5047703 - DNA, 23 bp, Homo sapiens
atctgaagccacctctctgcctg

SEQ ID NO: 5047704 - DNA, 22 bp, Homo sapiens
atctggaagaaagccctgtgct

SEQ ID NO: 5047705 - DNA, 17 bp, Homo sapiens
atctggggaaggaccaa

SEQ ID NO: 5047706 - DNA, 15 bp, Homo sapiens
atcttgttctttgct

SEQ ID NO: 5047707 - DNA, 19 bp, Homo sapiens
atgagtgtcaactccagga

SEQ ID NO: 5047708 - DNA, 18 bp, Homo sapiens
atgcactggcctgttctg

SEQ ID NO: 5047709 - DNA, 23 bp, Homo sapiens
atgcactggcctgttctgtagga

SEQ ID NO: 5047710 - DNA, 16 bp, Homo sapiens
atgccaactcgggagc

SEQ ID NO: 5047711 - DNA, 18 bp, Homo sapiens
atgccaactcgggagcat

SEQ ID NO: 5047712 - DNA, 18 bp, Homo sapiens
atgcccgctgtcccaggg

SEQ ID NO: 5047713 - DNA, 12 bp, Homo sapiens
atggaaggagag

SEQ ID NO: 5047714 - DNA, 14 bp, Homo sapiens
atggaaggagagag

SEQ ID NO: 5047715 - DNA, 12 bp, Homo sapiens
atggagaggaga

SEQ ID NO: 5047716 - DNA, 18 bp, Homo sapiens
atggagagggcttgaaat

SEQ ID NO: 5047717 - DNA, 15 bp, Homo sapiens
atggctgctgctcac

SEQ ID NO: 5047718 - DNA, 16 bp, Homo sapiens
atggctgctgctcacc

SEQ ID NO: 5047719 - DNA, 13 bp, Homo sapiens
atgggggaggctc

SEQ ID NO: 5047720 - DNA, 15 bp, Homo sapiens
atgggggaggctctg

SEQ ID NO: 5047721 - DNA, 20 bp, Homo sapiens
atgtaaaataaaggctctgt

SEQ ID NO: 5047722 - DNA, 18 bp, Homo sapiens
atgtagtagcctttcctg

SEQ ID NO: 5047723 - DNA, 23 bp, Homo sapiens
atgtgggggaaggccttgctgtc

SEQ ID NO: 5047724 - DNA, 15 bp, Homo sapiens
attaaagattgcttt

SEQ ID NO: 5047725 - DNA, 17 bp, Homo sapiens
attaaagtgccttcagc

SEQ ID NO: 5047726 - DNA, 14 bp, Homo sapiens
attaactctccagt

SEQ ID NO: 5047727 - DNA, 14 bp, Homo sapiens
attcatcagcagga

SEQ ID NO: 5047728 - DNA, 13 bp, Homo sapiens
attctctctgccc

SEQ ID NO: 5047729 - DNA, 14 bp, Homo sapiens
attctgcctgcctg

SEQ ID NO: 5047730 - DNA, 18 bp, Homo sapiens
attctgcctgcctgggaa

SEQ ID NO: 5047731 - DNA, 17 bp, Homo sapiens
attctgttagctgctca

SEQ ID NO: 5047732 - DNA, 20 bp, Homo sapiens
attgacagctttctaactca

SEQ ID NO: 5047733 - DNA, 19 bp, Homo sapiens
attgctttatccagcagtc

SEQ ID NO: 5047734 - DNA, 14 bp, Homo sapiens
attgtcttgttctg

SEQ ID NO: 5047735 - DNA, 17 bp, Homo sapiens
atttcaggttgtgcatt

SEQ ID NO: 5047736 - DNA, 22 bp, Homo sapiens
atttgctggagtgctggctcca

SEQ ID NO: 5047737 - DNA, 13 bp, Homo sapiens
atttttctgatgg

SEQ ID NO: 5047738 - DNA, 19 bp, Homo sapiens
caaaattgacagctttcta

SEQ ID NO: 5047739 - DNA, 16 bp, Homo sapiens
caaacacataacaata

SEQ ID NO: 5047740 - DNA, 18 bp, Homo sapiens
caaaggaaaaagcacaag

SEQ ID NO: 5047741 - DNA, 12 bp, Homo sapiens
caaatgcctttt

SEQ ID NO: 5047742 - DNA, 17 bp, Homo sapiens
caaattttttgaaaata

SEQ ID NO: 5047743 - DNA, 13 bp, Homo sapiens
caacaccagcccc

SEQ ID NO: 5047744 - DNA, 18 bp, Homo sapiens
caacagagtggtgtctag

SEQ ID NO: 5047745 - DNA, 16 bp, Homo sapiens
caacagtgttctgagc

SEQ ID NO: 5047746 - DNA, 15 bp, Homo sapiens
caacccatgccctgc

SEQ ID NO: 5047747 - DNA, 20 bp, Homo sapiens
caactccaaacaattctgat

SEQ ID NO: 5047748 - DNA, 21 bp, Homo sapiens
caactccaaacaattctgatg

SEQ ID NO: 5047749 - DNA, 22 bp, Homo sapiens
caactcgggagcattctgcctg

SEQ ID NO: 5047750 - DNA, 19 bp, Homo sapiens
caagaagatcacgctcccc

SEQ ID NO: 5047751 - DNA, 23 bp, Homo sapiens
caagaagatcacgctccccgcct

SEQ ID NO: 5047752 - DNA, 14 bp, Homo sapiens
caagagccatctga

SEQ ID NO: 5047753 - DNA, 16 bp, Homo sapiens
caagaggccagggtgg

SEQ ID NO: 5047754 - DNA, 13 bp, Homo sapiens
caagcaattctgc

SEQ ID NO: 5047755 - DNA, 21 bp, Homo sapiens
caagcctggagcccctgtgtt

SEQ ID NO: 5047756 - DNA, 20 bp, Homo sapiens
caagcttaaggagaggagag

SEQ ID NO: 5047757 - DNA, 23 bp, Homo sapiens
caagcttaaggagaggagagcat

SEQ ID NO: 5047758 - DNA, 23 bp, Homo sapiens
caaggagcctccgttcccacctc

SEQ ID NO: 5047759 - DNA, 14 bp, Homo sapiens
caaggctgcgtctg

SEQ ID NO: 5047760 - DNA, 10 bp, Homo sapiens
caagggaggc

SEQ ID NO: 5047761 - DNA, 11 bp, Homo sapiens
caaggtgctca

SEQ ID NO: 5047762 - DNA, 18 bp, Homo sapiens
caagtgatggtcattcat

SEQ ID NO: 5047763 - DNA, 14 bp, Homo sapiens
caagtttacttgtc

SEQ ID NO: 5047764 - DNA, 17 bp, Homo sapiens
caagtttacttgtcttt

SEQ ID NO: 5047765 - DNA, 19 bp, Homo sapiens
caagtttacttgtctttga

SEQ ID NO: 5047766 - DNA, 21 bp, Homo sapiens
caatctggaagaaagccctgt

SEQ ID NO: 5047767 - DNA, 18 bp, Homo sapiens
caattctgccccacaccc

SEQ ID NO: 5047768 - DNA, 14 bp, Homo sapiens
cacaaggtgctcag

SEQ ID NO: 5047769 - DNA, 17 bp, Homo sapiens
cacaaggtggcagcaag

SEQ ID NO: 5047770 - DNA, 19 bp, Homo sapiens
cacaatctacactgcctta

SEQ ID NO: 5047771 - DNA, 18 bp, Homo sapiens
cacaattggccagggcaa

SEQ ID NO: 5047772 - DNA, 14 bp, Homo sapiens
cacacaaggtgctc

SEQ ID NO: 5047773 - DNA, 15 bp, Homo sapiens
cacacacacctgtct

SEQ ID NO: 5047774 - DNA, 16 bp, Homo sapiens
cacacacctgtctgtg

SEQ ID NO: 5047775 - DNA, 20 bp, Homo sapiens
cacacacctgtctgtgcaga

SEQ ID NO: 5047776 - DNA, 23 bp, Homo sapiens
cacacacctgtctgtgcagatgc

SEQ ID NO: 5047777 - DNA, 18 bp, Homo sapiens
cacagcacccactaccat

SEQ ID NO: 5047778 - DNA, 17 bp, Homo sapiens
cacaggcatagagtgac

SEQ ID NO: 5047779 - DNA, 11 bp, Homo sapiens
cacaggcctcc

SEQ ID NO: 5047780 - DNA, 21 bp, Homo sapiens
cacatattcatcagcaggagt

SEQ ID NO: 5047781 - DNA, 17 bp, Homo sapiens
cacatgctgagtctccc

SEQ ID NO: 5047782 - DNA, 21 bp, Homo sapiens
cacatgctgagtctcccaagg

SEQ ID NO: 5047783 - DNA, 20 bp, Homo sapiens
caccagcccacatccagtgg

SEQ ID NO: 5047784 - DNA, 20 bp, Homo sapiens
caccagctccactggcctgc

SEQ ID NO: 5047785 - DNA, 11 bp, Homo sapiens
caccatcattt

SEQ ID NO: 5047786 - DNA, 18 bp, Homo sapiens
catggtacccccttctgg

SEQ ID NO: 5047787 - DNA, 14 bp, Homo sapiens
catgtgggggaagg

SEQ ID NO: 5047788 - DNA, 22 bp, Homo sapiens
catgtgggggaaggccttgctg

SEQ ID NO: 5047789 - DNA, 18 bp, Homo sapiens
cattcagcaaatgccttt

SEQ ID NO: 5047790 - DNA, 12 bp, Homo sapiens
cattctgcctgc

SEQ ID NO: 5047791 - DNA, 16 bp, Homo sapiens
cattttgtgtgatgca

SEQ ID NO: 5047792 - DNA, 20 bp, Homo sapiens
cattttgtgtgatgcatgta

SEQ ID NO: 5047793 - DNA, 13 bp, Homo sapiens
ccaaactctgtgt

SEQ ID NO: 5047794 - DNA, 18 bp, Homo sapiens
ccaaatgtttacagggag

SEQ ID NO: 5047795 - DNA, 19 bp, Homo sapiens
ccaaatgtttacagggagc

SEQ ID NO: 5047796 - DNA, 22 bp, Homo sapiens
ccaacaccagcccctgccccag

SEQ ID NO: 5047797 - DNA, 16 bp, Homo sapiens
ccaacccatgccctgc

SEQ ID NO: 5047798 - DNA, 23 bp, Homo sapiens
ccaactccaaacaattctgatga

SEQ ID NO: 5047799 - DNA, 22 bp, Homo sapiens
ccaagaccatctctccctcctg

SEQ ID NO: 5047800 - DNA, 14 bp, Homo sapiens
ccaagcctggagcc

SEQ ID NO: 5047801 - DNA, 20 bp, Homo sapiens
ccaagcttaaggagaggaga

SEQ ID NO: 5047802 - DNA, 13 bp, Homo sapiens
ccaagttgctctg

SEQ ID NO: 5047803 - DNA, 16 bp, Homo sapiens
ccaagttgctctgtat

SEQ ID NO: 5047804 - DNA, 16 bp, Homo sapiens
ccacacacacaaggtg

SEQ ID NO: 5047805 - DNA, 21 bp, Homo sapiens
ccacacacacaaggtgctcag

SEQ ID NO: 5047806 - DNA, 13 bp, Homo sapiens
ccacaggcctccc

SEQ ID NO: 5047807 - DNA, 21 bp, Homo sapiens
ccaccagctccactggcctgc

SEQ ID NO: 5047808 - DNA, 15 bp, Homo sapiens
ccacctctctgcctg

SEQ ID NO: 5047809 - DNA, 18 bp, Homo sapiens
ccacctctctgcctgttc

SEQ ID NO: 5047810 - DNA, 13 bp, Homo sapiens
ccacctctgagga

SEQ ID NO: 5047811 - DNA, 12 bp, Homo sapiens
ccacctgcctga

SEQ ID NO: 5047812 - DNA, 12 bp, Homo sapiens
ccacctgggctg

SEQ ID NO: 5047813 - DNA, 16 bp, Homo sapiens
ccacctgggctgggag

SEQ ID NO: 5047814 - DNA, 20 bp, Homo sapiens
ccacgaggtggtagctctga

SEQ ID NO: 5047815 - DNA, 21 bp, Homo sapiens
ccacgaggtggtagctctgag

SEQ ID NO: 5047816 - DNA, 14 bp, Homo sapiens
ccacgccctgggga

SEQ ID NO: 5047817 - DNA, 21 bp, Homo sapiens
ccactaccatacagacagcac

SEQ ID NO: 5047818 - DNA, 14 bp, Homo sapiens
ccacttagcaggga

SEQ ID NO: 5047819 - DNA, 19 bp, Homo sapiens
ccagagcttcagggctggg

SEQ ID NO: 5047820 - DNA, 18 bp, Homo sapiens
ccagcccctgccccagcc

SEQ ID NO: 5047821 - DNA, 17 bp, Homo sapiens
ccagctccactggcctg

SEQ ID NO: 5047822 - DNA, 12 bp, Homo sapiens
ccagctcctttc

SEQ ID NO: 5047823 - DNA, 20 bp, Homo sapiens
ccagctcctttcccttttcc

SEQ ID NO: 5047824 - DNA, 21 bp, Homo sapiens
ccagctcctttcccttttcca

SEQ ID NO: 5047825 - DNA, 17 bp, Homo sapiens
ccagctgccggcagtgc

SEQ ID NO: 5047826 - DNA, 21 bp, Homo sapiens
ccagctgccggcagtgctggt

SEQ ID NO: 5047827 - DNA, 18 bp, Homo sapiens
ccagctgggctgttggct

SEQ ID NO: 5047828 - DNA, 15 bp, Homo sapiens
ccagctttgcccaac

SEQ ID NO: 5047829 - DNA, 20 bp, Homo sapiens
ccaggattgtacgtgggaga

SEQ ID NO: 5047830 - DNA, 23 bp, Homo sapiens
ccaggattgtacgtgggagaggc

SEQ ID NO: 5047831 - DNA, 13 bp, Homo sapiens
ccaggccatacca

SEQ ID NO: 5047832 - DNA, 17 bp, Homo sapiens
ccaggggtctccctgag

SEQ ID NO: 5047833 - DNA, 20 bp, Homo sapiens
ccaggggtctccctgagcct

SEQ ID NO: 5047834 - DNA, 13 bp, Homo sapiens
ccaggggtggtga

SEQ ID NO: 5047835 - DNA, 23 bp, Homo sapiens
ccagtcccccaaccccagccgct

SEQ ID NO: 5047836 - DNA, 19 bp, Homo sapiens
ccagtcctcacatgcccgc

SEQ ID NO: 5047837 - DNA, 20 bp, Homo sapiens
ccagtcctcacatgcccgct

SEQ ID NO: 5047838 - DNA, 12 bp, Homo sapiens
ccagttaccttt

SEQ ID NO: 5047839 - DNA, 17 bp, Homo sapiens
ccagttacctttgctgt

SEQ ID NO: 5047840 - DNA, 15 bp, Homo sapiens
ccataccaggtgcta

SEQ ID NO: 5047841 - DNA, 23 bp, Homo sapiens
ccatcatttctagtatattagga

SEQ ID NO: 5047842 - DNA, 22 bp, Homo sapiens
ccatctctccctcctggtgaag

SEQ ID NO: 5047843 - DNA, 22 bp, Homo sapiens
ccatctctgctgcttctgggcc

SEQ ID NO: 5047844 - DNA, 21 bp, Homo sapiens
ccatctgaagccacctctctg

SEQ ID NO: 5047845 - DNA, 15 bp, Homo sapiens
ccatgccctgccaag

SEQ ID NO: 5047846 - DNA, 23 bp, Homo sapiens
ccatgccctgccaagcctggagc

SEQ ID NO: 5047847 - DNA, 16 bp, Homo sapiens
ccatggtacccccttc

SEQ ID NO: 5047848 - DNA, 20 bp, Homo sapiens
ccattgtcttgttctgtgat

SEQ ID NO: 5047849 - DNA, 17 bp, Homo sapiens
cccaaaggaaaaagcac

SEQ ID NO: 5047850 - DNA, 13 bp, Homo sapiens
cccaacccctgag

SEQ ID NO: 5047851 - DNA, 14 bp, Homo sapiens
cccaacccctgagg

SEQ ID NO: 5047852 - DNA, 19 bp, Homo sapiens
cccaaggctgcgtctggag

SEQ ID NO: 5047853 - DNA, 22 bp, Homo sapiens
cccaaggctgcgtctggagggg

SEQ ID NO: 5047854 - DNA, 15 bp, Homo sapiens
cccaagttgctctgt

SEQ ID NO: 5047855 - DNA, 12 bp, Homo sapiens
cccagctgggct

SEQ ID NO: 5047856 - DNA, 23 bp, Homo sapiens
cccaggaccaagcttaaggagag

SEQ ID NO: 5047857 - DNA, 15 bp, Homo sapiens
cccaggcttctcacc

SEQ ID NO: 5047858 - DNA, 14 bp, Homo sapiens
cccaggggtctccc

SEQ ID NO: 5047859 - DNA, 17 bp, Homo sapiens
cccaggggtctccctga

SEQ ID NO: 5047860 - DNA, 22 bp, Homo sapiens
cccagtcccccaaccccagccg

SEQ ID NO: 5047861 - DNA, 20 bp, Homo sapiens
cccatgccctgccaagcctg

SEQ ID NO: 5047862 - DNA, 13 bp, Homo sapiens
ccccaaccccagc

SEQ ID NO: 5047863 - DNA, 13 bp, Homo sapiens
ccccaacccctga

SEQ ID NO: 5047864 - DNA, 17 bp, Homo sapiens
ccccaacccctgaggaa

SEQ ID NO: 5047865 - DNA, 15 bp, Homo sapiens
ccccagcccaagtcc

SEQ ID NO: 5047866 - DNA, 13 bp, Homo sapiens
ccccagctgggct

SEQ ID NO: 5047867 - DNA, 24 bp, Homo sapiens
ccccagctttgcccaacaccagcc

SEQ ID NO: 5047868 - DNA, 17 bp, Homo sapiens
ccccaggaccaagctta

SEQ ID NO: 5047869 - DNA, 22 bp, Homo sapiens
ccccatctctgctgcttctggg

SEQ ID NO: 5047870 - DNA, 18 bp, Homo sapiens
cccccaacccctgaggaa

SEQ ID NO: 5047871 - DNA, 11 bp, Homo sapiens
cccccctgaga

SEQ ID NO: 5047872 - DNA, 15 bp, Homo sapiens
ccccctgtcccctca

SEQ ID NO: 5047873 - DNA, 18 bp, Homo sapiens
ccccctgtcccctcagct

SEQ ID NO: 5047874 - DNA, 19 bp, Homo sapiens
ccccctgtcccctcagctc

SEQ ID NO: 5047875 - DNA, 21 bp, Homo sapiens
ccccctgtcccctcagctcca

SEQ ID NO: 5047876 - DNA, 13 bp, Homo sapiens
cccctgccccagc

SEQ ID NO: 5047877 - DNA, 19 bp, Homo sapiens
cccctgcttctccagcctg

SEQ ID NO: 5047878 - DNA, 20 bp, Homo sapiens
cccctgtcccctcagctcca

SEQ ID NO: 5047879 - DNA, 17 bp, Homo sapiens
cccctgtgtgggagggc

SEQ ID NO: 5047880 - DNA, 18 bp, Homo sapiens
cccctgtgtgggagggcg

SEQ ID NO: 5047881 - DNA, 22 bp, Homo sapiens
ccccttctgggcatctgttctg

SEQ ID NO: 5047882 - DNA, 20 bp, Homo sapiens
cccgccgcttttctcctctt

SEQ ID NO: 5047883 - DNA, 17 bp, Homo sapiens
cccgttgccgggcctgg

SEQ ID NO: 5047884 - DNA, 19 bp, Homo sapiens
ccctacacctctgggccct

SEQ ID NO: 5047885 - DNA, 20 bp, Homo sapiens
ccctacacctctgggccctg

SEQ ID NO: 5047886 - DNA, 18 bp, Homo sapiens
ccctagtatctggctggg

SEQ ID NO: 5047887 - DNA, 14 bp, Homo sapiens
ccctccactaggag

SEQ ID NO: 5047888 - DNA, 21 bp, Homo sapiens
ccctccttcttgccctgagct

SEQ ID NO: 5047889 - DNA, 22 bp, Homo sapiens
ccctccttcttgccctgagctt

SEQ ID NO: 5047890 - DNA, 13 bp, Homo sapiens
ccctgagcctgcc

SEQ ID NO: 5047891 - DNA, 18 bp, Homo sapiens
ccctgagctttccgggga

SEQ ID NO: 5047892 - DNA, 19 bp, Homo sapiens
ccctgagctttccggggag

SEQ ID NO: 5047893 - DNA, 18 bp, Homo sapiens
ccctgattaaagtgcctt

SEQ ID NO: 5047894 - DNA, 19 bp, Homo sapiens
ccctgcaggaggcctggga

SEQ ID NO: 5047895 - DNA, 20 bp, Homo sapiens
ccctgcaggaggcctgggag

SEQ ID NO: 5047896 - DNA, 16 bp, Homo sapiens
ccctgccaagcctgga

SEQ ID NO: 5047897 - DNA, 23 bp, Homo sapiens
ccctgccaagcctggagcccctg

SEQ ID NO: 5047898 - DNA, 21 bp, Homo sapiens
ccctgcttctccagcctggac

SEQ ID NO: 5047899 - DNA, 18 bp, Homo sapiens
ccctggctcccaagggag

SEQ ID NO: 5047900 - DNA, 18 bp, Homo sapiens
ccctgggccagcccagga

SEQ ID NO: 5047901 - DNA, 19 bp, Homo sapiens
ccctgggccagcccaggat

SEQ ID NO: 5047902 - DNA, 23 bp, Homo sapiens
ccctgtgtgggagggcgaggcgg

SEQ ID NO: 5047903 - DNA, 14 bp, Homo sapiens
cccttccctctgtt

SEQ ID NO: 5047904 - DNA, 16 bp, Homo sapiens
cccttctctgtagctg

SEQ ID NO: 5047905 - DNA, 19 bp, Homo sapiens
cccttctctgtagctgcta

SEQ ID NO: 5047906 - DNA, 22 bp, Homo sapiens
cccttctgggcatctgttctgg

SEQ ID NO: 5047907 - DNA, 23 bp, Homo sapiens
cccttgtctgagatgctggtaat

SEQ ID NO: 5047908 - DNA, 18 bp, Homo sapiens
ccctttgcgtcaggagca

SEQ ID NO: 5047909 - DNA, 19 bp, Homo sapiens
ccctttgcgtcaggagcag

SEQ ID NO: 5047910 - DNA, 18 bp, Homo sapiens
ccgccgcttttctcctct

SEQ ID NO: 5047911 - DNA, 15 bp, Homo sapiens
ccgctcggaggcccc

SEQ ID NO: 5047912 - DNA, 21 bp, Homo sapiens
ccgctcggaggccccaaagga

SEQ ID NO: 5047913 - DNA, 17 bp, Homo sapiens
ccggcagtgctggttct

SEQ ID NO: 5047914 - DNA, 20 bp, Homo sapiens
ccggcagtgctggttctcca

SEQ ID NO: 5047915 - DNA, 14 bp, Homo sapiens
ccgggcctggactg

SEQ ID NO: 5047916 - DNA, 19 bp, Homo sapiens
ccgttcccacctctgagga

SEQ ID NO: 5047917 - DNA, 15 bp, Homo sapiens
ccgttgccgggcctg

SEQ ID NO: 5047918 - DNA, 16 bp, Homo sapiens
cctacacctctgggcc

SEQ ID NO: 5047919 - DNA, 21 bp, Homo sapiens
cctacacctctgggccctgca

SEQ ID NO: 5047920 - DNA, 14 bp, Homo sapiens
cctcacatgcccgc

SEQ ID NO: 5047921 - DNA, 11 bp, Homo sapiens
cctcagctcca

SEQ ID NO: 5047922 - DNA, 23 bp, Homo sapiens
cctcatggcatcatccattctct

SEQ ID NO: 5047923 - DNA, 23 bp, Homo sapiens
cctccatacctcgaacatcagtt

SEQ ID NO: 5047924 - DNA, 14 bp, Homo sapiens
cctccctgtttgaa

SEQ ID NO: 5047925 - DNA, 21 bp, Homo sapiens
cctccgttcccacctctgagg

SEQ ID NO: 5047926 - DNA, 19 bp, Homo sapiens
cctcctgcccagtccccca

SEQ ID NO: 5047927 - DNA, 20 bp, Homo sapiens
cctctctttgttctcagctc

SEQ ID NO: 5047928 - DNA, 21 bp, Homo sapiens
cctctctttgttctcagctcc

SEQ ID NO: 5047929 - DNA, 14 bp, Homo sapiens
cctctgggccctgc

SEQ ID NO: 5047930 - DNA, 16 bp, Homo sapiens
cctctgggccctgcag

SEQ ID NO: 5047931 - DNA, 17 bp, Homo sapiens
cctctgggccctgcagg

SEQ ID NO: 5047932 - DNA, 19 bp, Homo sapiens
cctctgggccctgcaggag

SEQ ID NO: 5047933 - DNA, 21 bp, Homo sapiens
cctctgggccctgcaggaggc

SEQ ID NO: 5047934 - DNA, 11 bp, Homo sapiens
cctctttcccc

SEQ ID NO: 5047935 - DNA, 18 bp, Homo sapiens
cctgaacatggcagtcta

SEQ ID NO: 5047936 - DNA, 19 bp, Homo sapiens
cctgagagcatgtggggga

SEQ ID NO: 5047937 - DNA, 17 bp, Homo sapiens
cctgagcctgccccagc

SEQ ID NO: 5047938 - DNA, 17 bp, Homo sapiens
cctgagctttccgggga

SEQ ID NO: 5047939 - DNA, 20 bp, Homo sapiens
cctgattaaagtgccttcag

SEQ ID NO: 5047940 - DNA, 12 bp, Homo sapiens
cctgcaggaggc

SEQ ID NO: 5047941 - DNA, 15 bp, Homo sapiens
cctgcaggaggcctg

SEQ ID NO: 5047942 - DNA, 20 bp, Homo sapiens
cctgcaggaggcctgggagg

SEQ ID NO: 5047943 - DNA, 22 bp, Homo sapiens
cctgcaggaggcctgggagggc

SEQ ID NO: 5047944 - DNA, 14 bp, Homo sapiens
cctgccaagcctgg

SEQ ID NO: 5047945 - DNA, 15 bp, Homo sapiens
cctgccaagcctgga

SEQ ID NO: 5047946 - DNA, 16 bp, Homo sapiens
cctgcccagtccccca

SEQ ID NO: 5047947 - DNA, 21 bp, Homo sapiens
cctgcccagtcccccaacccc

SEQ ID NO: 5047948 - DNA, 17 bp, Homo sapiens
cctgccccagcccaagt

SEQ ID NO: 5047949 - DNA, 18 bp, Homo sapiens
cctgccccagcccaagtc

SEQ ID NO: 5047950 - DNA, 14 bp, Homo sapiens
cctgccccagctgg

SEQ ID NO: 5047951 - DNA, 22 bp, Homo sapiens
cctgcccgttgccgggcctgga

SEQ ID NO: 5047952 - DNA, 23 bp, Homo sapiens
cctgcccgttgccgggcctggac

SEQ ID NO: 5047953 - DNA, 21 bp, Homo sapiens
cctgctctccttgccctgggc

SEQ ID NO: 5047954 - DNA, 14 bp, Homo sapiens
cctgctctgccact

SEQ ID NO: 5047955 - DNA, 15 bp, Homo sapiens
cctgctctgccactg

SEQ ID NO: 5047956 - DNA, 16 bp, Homo sapiens
cctgcttctccagcct

SEQ ID NO: 5047957 - DNA, 17 bp, Homo sapiens
cctgcttctccagcctg

SEQ ID NO: 5047958 - DNA, 17 bp, Homo sapiens
cctgcttttggggctct

SEQ ID NO: 5047959 - DNA, 17 bp, Homo sapiens
cctggaaaccacagtcc

SEQ ID NO: 5047960 - DNA, 15 bp, Homo sapiens
cctggacccccagct

SEQ ID NO: 5047961 - DNA, 14 bp, Homo sapiens
cctggactgtccta

SEQ ID NO: 5047962 - DNA, 21 bp, Homo sapiens
cctggagcccctgtgttgggg

SEQ ID NO: 5047963 - DNA, 21 bp, Homo sapiens
cctggcgggatgggccaccgc

SEQ ID NO: 5047964 - DNA, 18 bp, Homo sapiens
cctggctcccaagggagg

SEQ ID NO: 5047965 - DNA, 20 bp, Homo sapiens
cctgggagggcaagggtcct

SEQ ID NO: 5047966 - DNA, 14 bp, Homo sapiens
cctgggccagccca

SEQ ID NO: 5047967 - DNA, 17 bp, Homo sapiens
cctgggccagcccagga

SEQ ID NO: 5047968 - DNA, 13 bp, Homo sapiens
cctgggctgggag

SEQ ID NO: 5047969 - DNA, 22 bp, Homo sapiens
cctgggctgggagaaggtgctt

SEQ ID NO: 5047970 - DNA, 15 bp, Homo sapiens
cctggggaggctgag

SEQ ID NO: 5047971 - DNA, 17 bp, Homo sapiens
cctgtcatctgggccac

SEQ ID NO: 5047972 - DNA, 14 bp, Homo sapiens
cctgtcccctcagc

SEQ ID NO: 5047973 - DNA, 18 bp, Homo sapiens
cctgtcccctcagctcca

SEQ ID NO: 5047974 - DNA, 18 bp, Homo sapiens
cctgtctgtgcagatgct

SEQ ID NO: 5047975 - DNA, 15 bp, Homo sapiens
cctgtgttggggggc

SEQ ID NO: 5047976 - DNA, 22 bp, Homo sapiens
cctgttcccccgccgcttttct

SEQ ID NO: 5047977 - DNA, 18 bp, Homo sapiens
cctgtttgaagcctgccc

SEQ ID NO: 5047978 - DNA, 23 bp, Homo sapiens
ccttagggagggactgggatgag

SEQ ID NO: 5047979 - DNA, 22 bp, Homo sapiens
ccttcaaaaagcaatctggaag

SEQ ID NO: 5047980 - DNA, 16 bp, Homo sapiens
ccttccgctcccacca

SEQ ID NO: 5047981 - DNA, 17 bp, Homo sapiens
ccttccgctcccaccag

SEQ ID NO: 5047982 - DNA, 17 bp, Homo sapiens
ccttcttgccctgagct

SEQ ID NO: 5047983 - DNA, 12 bp, Homo sapiens
ccttgccctggg

SEQ ID NO: 5047984 - DNA, 11 bp, Homo sapiens
ccttgctgtca

SEQ ID NO: 5047985 - DNA, 22 bp, Homo sapiens
cctttgcgtcaggagcagcatc

SEQ ID NO: 5047986 - DNA, 14 bp, Homo sapiens
cctttgctgtcact

SEQ ID NO: 5047987 - DNA, 20 bp, Homo sapiens
ccttttaatcagagcccagg

SEQ ID NO: 5047988 - DNA, 18 bp, Homo sapiens
ccttttcaaatgcagcaa

SEQ ID NO: 5047989 - DNA, 18 bp, Homo sapiens
ccttttccatcatctctt

SEQ ID NO: 5047990 - DNA, 17 bp, Homo sapiens
cgactttgtacccccca

SEQ ID NO: 5047991 - DNA, 20 bp, Homo sapiens
cgaggcgggggagcctggag

SEQ ID NO: 5047992 - DNA, 22 bp, Homo sapiens
cgaggcgggggagcctggagcc

SEQ ID NO: 5047993 - DNA, 15 bp, Homo sapiens
cgaggcgggggatcc

SEQ ID NO: 5047994 - DNA, 19 bp, Homo sapiens
cgaggcgggggatcctgga

SEQ ID NO: 5047995 - DNA, 22 bp, Homo sapiens
cgaggcgggggatcctggagcc

SEQ ID NO: 5047996 - DNA, 15 bp, Homo sapiens
cgagggaggggaggt

SEQ ID NO: 5047997 - DNA, 19 bp, Homo sapiens
cgcacaatctacactgcct

SEQ ID NO: 5047998 - DNA, 11 bp, Homo sapiens
cgccaccattc

SEQ ID NO: 5047999 - DNA, 15 bp, Homo sapiens
cgccaccattcctgg

SEQ ID NO: 5048000 - DNA, 12 bp, Homo sapiens
cgcccctggggt

SEQ ID NO: 5048001 - DNA, 21 bp, Homo sapiens
cgccctggggagtgagcttgg

SEQ ID NO: 5048002 - DNA, 17 bp, Homo sapiens
cgccgcttttctcctct

SEQ ID NO: 5048003 - DNA, 15 bp, Homo sapiens
cgcctgttcccccgc

SEQ ID NO: 5048004 - DNA, 17 bp, Homo sapiens
cgctccccgcctgttcc

SEQ ID NO: 5048005 - DNA, 12 bp, Homo sapiens
cgctcggaggcc

SEQ ID NO: 5048006 - DNA, 14 bp, Homo sapiens
cgctcggaggcccc

SEQ ID NO: 5048007 - DNA, 19 bp, Homo sapiens
cgctcggaggccccaaagg

SEQ ID NO: 5048008 - DNA, 20 bp, Homo sapiens
cgctcggaggccccaaagga

SEQ ID NO: 5048009 - DNA, 15 bp, Homo sapiens
cggaggccccaaagg

SEQ ID NO: 5048010 - DNA, 13 bp, Homo sapiens
cggatggaaggag

SEQ ID NO: 5048011 - DNA, 23 bp, Homo sapiens
cggcactgggtttgctccctgat

SEQ ID NO: 5048012 - DNA, 18 bp, Homo sapiens
cgggagcattctgcctgc

SEQ ID NO: 5048013 - DNA, 13 bp, Homo sapiens
cgggcctggactg

SEQ ID NO: 5048014 - DNA, 15 bp, Homo sapiens
cggggaggagccttg

SEQ ID NO: 5048015 - DNA, 17 bp, Homo sapiens
cggggaggagccttgga

SEQ ID NO: 5048016 - DNA, 18 bp, Homo sapiens
cggggaggagccttggag

SEQ ID NO: 5048017 - DNA, 16 bp, Homo sapiens
cgggggagcctggagc

SEQ ID NO: 5048018 - DNA, 17 bp, Homo sapiens
cgggggagcctggagcc

SEQ ID NO: 5048019 - DNA, 18 bp, Homo sapiens
cgggggagcctggagccc

SEQ ID NO: 5048020 - DNA, 19 bp, Homo sapiens
cgggggatcctggagcccc

SEQ ID NO: 5048021 - DNA, 19 bp, Homo sapiens
cggggtggacgagggagtg

SEQ ID NO: 5048022 - DNA, 12 bp, Homo sapiens
cggtaggtgctg

SEQ ID NO: 5048023 - DNA, 15 bp, Homo sapiens
cggtaggtgctggcc

SEQ ID NO: 5048024 - DNA, 20 bp, Homo sapiens
cgtctggaggggcccctgct

SEQ ID NO: 5048025 - DNA, 16 bp, Homo sapiens
cgtgggagaggcagaa

SEQ ID NO: 5048026 - DNA, 17 bp, Homo sapiens
cgttcccacctctgagg

SEQ ID NO: 5048027 - DNA, 16 bp, Homo sapiens
cgttgccgggcctgga

SEQ ID NO: 5048028 - DNA, 15 bp, Homo sapiens
ctaaccccagctgcc

SEQ ID NO: 5048029 - DNA, 17 bp, Homo sapiens
ctaaccccagctgccgg

SEQ ID NO: 5048030 - DNA, 20 bp, Homo sapiens
ctaaccccagctgccggcag

SEQ ID NO: 5048031 - DNA, 15 bp, Homo sapiens
ctacacctctgggcc

SEQ ID NO: 5048032 - DNA, 19 bp, Homo sapiens
ctacacctctgggccctgc

SEQ ID NO: 5048033 - DNA, 20 bp, Homo sapiens
ctacacctctgggccctgca

SEQ ID NO: 5048034 - DNA, 11 bp, Homo sapiens
ctacactgcct

SEQ ID NO: 5048035 - DNA, 18 bp, Homo sapiens
ctacactgccttaccttc

SEQ ID NO: 5048036 - DNA, 14 bp, Homo sapiens
ctaccatacagaca

SEQ ID NO: 5048037 - DNA, 18 bp, Homo sapiens
ctacggagggaccaggtg

SEQ ID NO: 5048038 - DNA, 21 bp, Homo sapiens
ctagaggcaacagtgttctga

SEQ ID NO: 5048039 - DNA, 23 bp, Homo sapiens
ctagaggcaacagtgttctgagc

SEQ ID NO: 5048040 - DNA, 18 bp, Homo sapiens
ctagcctgctctgccact

SEQ ID NO: 5048041 - DNA, 17 bp, Homo sapiens
ctaggactttagggatc

SEQ ID NO: 5048042 - DNA, 18 bp, Homo sapiens
ctaggactttagggatct

SEQ ID NO: 5048043 - DNA, 16 bp, Homo sapiens
ctagggtgcctgctct

SEQ ID NO: 5048044 - DNA, 16 bp, Homo sapiens
ctagtgagccttccca

SEQ ID NO: 5048045 - DNA, 18 bp, Homo sapiens
ctcaccctcctagcctgc

SEQ ID NO: 5048046 - DNA, 10 bp, Homo sapiens
ctcagctccc

SEQ ID NO: 5048047 - DNA, 11 bp, Homo sapiens
ctcagctcccc

SEQ ID NO: 5048048 - DNA, 20 bp, Homo sapiens
ctcagctccccctgtcccct

SEQ ID NO: 5048049 - DNA, 23 bp, Homo sapiens
ctcattgtataagccccgaggcc

SEQ ID NO: 5048050 - DNA, 16 bp, Homo sapiens
ctccaaacaattctga

SEQ ID NO: 5048051 - DNA, 17 bp, Homo sapiens
ctccaaacaattctgat

SEQ ID NO: 5048052 - DNA, 13 bp, Homo sapiens
ctccacgccctgg

SEQ ID NO: 5048053 - DNA, 12 bp, Homo sapiens
ctccactggcct

SEQ ID NO: 5048054 - DNA, 20 bp, Homo sapiens
ctcccaagaggccagggtgg

SEQ ID NO: 5048055 - DNA, 22 bp, Homo sapiens
ctcccaaggctgcgtctggagg

SEQ ID NO: 5048056 - DNA, 14 bp, Homo sapiens
ctcccaagggaggc

SEQ ID NO: 5048057 - DNA, 22 bp, Homo sapiens
ctcccaagggaggcccatgtga

SEQ ID NO: 5048058 - DNA, 20 bp, Homo sapiens
ggagcagcatcattcagcaa

SEQ ID NO: 5048059 - DNA, 23 bp, Homo sapiens
ggagccacctgggctgggagaag

SEQ ID NO: 5048060 - DNA, 19 bp, Homo sapiens
ggagcccctgtgtgggagg

SEQ ID NO: 5048061 - DNA, 15 bp, Homo sapiens
ggaggccccaaagga

SEQ ID NO: 5048062 - DNA, 14 bp, Homo sapiens
ggaggctgagactg

SEQ ID NO: 5048063 - DNA, 20 bp, Homo sapiens
ggaggctgagactgcagagg

SEQ ID NO: 5048064 - DNA, 12 bp, Homo sapiens
ggagggaccagg

SEQ ID NO: 5048065 - DNA, 17 bp, Homo sapiens
ggagggaccaggtgtct

SEQ ID NO: 5048066 - DNA, 20 bp, Homo sapiens
ggagggcgaggcgggggatc

SEQ ID NO: 5048067 - DNA, 22 bp, Homo sapiens
ggaggggttgccacaggcctcc

SEQ ID NO: 5048068 - DNA, 12 bp, Homo sapiens
ggagtgctggct

SEQ ID NO: 5048069 - DNA, 22 bp, Homo sapiens
ggagtgctggctccacgccctg

SEQ ID NO: 5048070 - DNA, 17 bp, Homo sapiens
ggatcctggagcccctg

SEQ ID NO: 5048071 - DNA, 21 bp, Homo sapiens
ggatctgaataccccttctct

SEQ ID NO: 5048072 - DNA, 15 bp, Homo sapiens
ggatgcactggcctg

SEQ ID NO: 5048073 - DNA, 14 bp, Homo sapiens
ggatggaaggagag

SEQ ID NO: 5048074 - DNA, 14 bp, Homo sapiens
ggatgggccaccgc

SEQ ID NO: 5048075 - DNA, 18 bp, Homo sapiens
ggattgtacgtgggagag

SEQ ID NO: 5048076 - DNA, 17 bp, Homo sapiens
ggcaggaatcaaggagc

SEQ ID NO: 5048077 - DNA, 18 bp, Homo sapiens
ggcaggtcctggggaggc

SEQ ID NO: 5048078 - DNA, 22 bp, Homo sapiens
ggcatcatccattctctctgcc

SEQ ID NO: 5048079 - DNA, 14 bp, Homo sapiens
ggcatgggggaggc

SEQ ID NO: 5048080 - DNA, 16 bp, Homo sapiens
ggcatgggggaggctc

SEQ ID NO: 5048081 - DNA, 18 bp, Homo sapiens
ggccaccagctccactgg

SEQ ID NO: 5048082 - DNA, 13 bp, Homo sapiens
ggccagaggcagc

SEQ ID NO: 5048083 - DNA, 14 bp, Homo sapiens
ggccagaggcagct

SEQ ID NO: 5048084 - DNA, 13 bp, Homo sapiens
ggccataccaggt

SEQ ID NO: 5048085 - DNA, 17 bp, Homo sapiens
ggccataccaggtgcta

SEQ ID NO: 5048086 - DNA, 19 bp, Homo sapiens
ggcccctgcttctccagcc

SEQ ID NO: 5048087 - DNA, 20 bp, Homo sapiens
ggcctgatggagaggagaac

SEQ ID NO: 5048088 - DNA, 15 bp, Homo sapiens
ggcctggactgtcct

SEQ ID NO: 5048089 - DNA, 12 bp, Homo sapiens
ggcctgggaggg

SEQ ID NO: 5048090 - DNA, 18 bp, Homo sapiens
ggcgaggcgggggagcct

SEQ ID NO: 5048091 - DNA, 18 bp, Homo sapiens
ggcgaggcgggggatcct

SEQ ID NO: 5048092 - DNA, 17 bp, Homo sapiens
ggctcaaccacacacac

SEQ ID NO: 5048093 - DNA, 16 bp, Homo sapiens
ggctccacgccctggg

SEQ ID NO: 5048094 - DNA, 18 bp, Homo sapiens
ggctccacgccctgggga

SEQ ID NO: 5048095 - DNA, 15 bp, Homo sapiens
ggctgcagcaggcag

SEQ ID NO: 5048096 - DNA, 17 bp, Homo sapiens
ggctgggagaaggtgct

SEQ ID NO: 5048097 - DNA, 21 bp, Homo sapiens
ggctgggcaggtcctggggag

SEQ ID NO: 5048098 - DNA, 19 bp, Homo sapiens
ggctgggttttcaggggct

SEQ ID NO: 5048099 - DNA, 23 bp, Homo sapiens
ggctgggttttcaggggctttgg

SEQ ID NO: 5048100 - DNA, 14 bp, Homo sapiens
ggctgttggctggg

SEQ ID NO: 5048101 - DNA, 20 bp, Homo sapiens
ggcttctgcggtgaggcagg

SEQ ID NO: 5048102 - DNA, 11 bp, Homo sapiens
gggagaggcag

SEQ ID NO: 5048103 - DNA, 18 bp, Homo sapiens
gggagcattctgcctgcc

SEQ ID NO: 5048104 - DNA, 19 bp, Homo sapiens
gggagcattctgcctgcct

SEQ ID NO: 5048105 - DNA, 17 bp, Homo sapiens
gggagcctcctgcccag

SEQ ID NO: 5048106 - DNA, 17 bp, Homo sapiens
gggagcctggagcccct

SEQ ID NO: 5048107 - DNA, 21 bp, Homo sapiens
gggagcctggagcccctgtgt

SEQ ID NO: 5048108 - DNA, 12 bp, Homo sapiens
gggaggagcctt

SEQ ID NO: 5048109 - DNA, 22 bp, Homo sapiens
gggaggagccttggagtgtaat

SEQ ID NO: 5048110 - DNA, 23 bp, Homo sapiens
gggagtaagaatgtgtgtgcaga

SEQ ID NO: 5048111 - DNA, 13 bp, Homo sapiens
gggatcctggagc

SEQ ID NO: 5048112 - DNA, 18 bp, Homo sapiens
gggatcctggagcccctg

SEQ ID NO: 5048113 - DNA, 21 bp, Homo sapiens
gggatcctggagcccctgtgt

SEQ ID NO: 5048114 - DNA, 16 bp, Homo sapiens
gggatctggggaagga

SEQ ID NO: 5048115 - DNA, 13 bp, Homo sapiens
gggatgggccacc

SEQ ID NO: 5048116 - DNA, 14 bp, Homo sapiens
gggatgggccaccg

SEQ ID NO: 5048117 - DNA, 23 bp, Homo sapiens
gggcaaggtgggggagcctggag

SEQ ID NO: 5048118 - DNA, 23 bp, Homo sapiens
gggcacatgctgagtctcccaag

SEQ ID NO: 5048119 - DNA, 18 bp, Homo sapiens
gggcaggaatcaaggagc

SEQ ID NO: 5048120 - DNA, 19 bp, Homo sapiens
gggcaggaatcaaggagcc

SEQ ID NO: 5048121 - DNA, 23 bp, Homo sapiens
gggcaggtcctggggaggctgag

SEQ ID NO: 5048122 - DNA, 19 bp, Homo sapiens
gggccaccagctccactgg

SEQ ID NO: 5048123 - DNA, 23 bp, Homo sapiens
gggccaccagctccactggcctg

SEQ ID NO: 5048124 - DNA, 21 bp, Homo sapiens
gggcccctgcttctccagcct

SEQ ID NO: 5048125 - DNA, 10 bp, Homo sapiens
gggccctgca

SEQ ID NO: 5048126 - DNA, 13 bp, Homo sapiens
gggccctgcagga

SEQ ID NO: 5048127 - DNA, 20 bp, Homo sapiens
gggccctgcaggaggcctgg

SEQ ID NO: 5048128 - DNA, 22 bp, Homo sapiens
gggccctgcaggaggcctggga

SEQ ID NO: 5048129 - DNA, 21 bp, Homo sapiens
gggcgaggcgggggagcctgg

SEQ ID NO: 5048130 - DNA, 11 bp, Homo sapiens
gggctgggaga

SEQ ID NO: 5048131 - DNA, 19 bp, Homo sapiens
gggctgggcaggtcctggg

SEQ ID NO: 5048132 - DNA, 20 bp, Homo sapiens
gggctgggcaggtcctgggg

SEQ ID NO: 5048133 - DNA, 23 bp, Homo sapiens
gggctgggcaggtcctggggagg

SEQ ID NO: 5048134 - DNA, 17 bp, Homo sapiens
ggggaaggccttgctgt

SEQ ID NO: 5048135 - DNA, 12 bp, Homo sapiens
ggggagcctgga

SEQ ID NO: 5048136 - DNA, 13 bp, Homo sapiens
ggggagcctggag

SEQ ID NO: 5048137 - DNA, 18 bp, Homo sapiens
ggggagcctggagcccct

SEQ ID NO: 5048138 - DNA, 14 bp, Homo sapiens
ggggaggctctgaa

SEQ ID NO: 5048139 - DNA, 13 bp, Homo sapiens
ggggaggctgaga

SEQ ID NO: 5048140 - DNA, 20 bp, Homo sapiens
ggggcaaggtgggggagcct

SEQ ID NO: 5048141 - DNA, 21 bp, Homo sapiens
ggggcaggaatcaaggagcct

SEQ ID NO: 5048142 - DNA, 12 bp, Homo sapiens
ggggcgagggag

SEQ ID NO: 5048143 - DNA, 17 bp, Homo sapiens
gggggaaggccttgctg

SEQ ID NO: 5048144 - DNA, 13 bp, Homo sapiens
gggggaggctctg

SEQ ID NO: 5048145 - DNA, 23 bp, Homo sapiens
gggggcaagaagatcacgctccc

SEQ ID NO: 5048146 - DNA, 20 bp, Homo sapiens
gggggcaaggtgggggagcc

SEQ ID NO: 5048147 - DNA, 17 bp, Homo sapiens
ggggtctccctgagcct

SEQ ID NO: 5048148 - DNA, 15 bp, Homo sapiens
gggtggacgagggag

SEQ ID NO: 5048149 - DNA, 13 bp, Homo sapiens
gggtgtgccctgg

SEQ ID NO: 5048150 - DNA, 20 bp, Homo sapiens
gggttgccacaggcctccct

SEQ ID NO: 5048151 - DNA, 19 bp, Homo sapiens
gggtttagcaggctgcagc

SEQ ID NO: 5048152 - DNA, 13 bp, Homo sapiens
ggtagctctgagc

SEQ ID NO: 5048153 - DNA, 15 bp, Homo sapiens
ggtagctctgagccc

SEQ ID NO: 5048154 - DNA, 15 bp, Homo sapiens
ggtaggtgctggcct

SEQ ID NO: 5048155 - DNA, 12 bp, Homo sapiens
ggtgaggcaggg

SEQ ID NO: 5048156 - DNA, 17 bp, Homo sapiens
ggtgaggcaggggagtc

SEQ ID NO: 5048157 - DNA, 23 bp, Homo sapiens
ggtgcctgctctccttgccctgg

SEQ ID NO: 5048158 - DNA, 18 bp, Homo sapiens
ggtgctagggtgcctgct

SEQ ID NO: 5048159 - DNA, 17 bp, Homo sapiens
ggtgggtttagcaggct

SEQ ID NO: 5048160 - DNA, 17 bp, Homo sapiens
ggtggtgcagccccagg

SEQ ID NO: 5048161 - DNA, 16 bp, Homo sapiens
ggtgtctagaggcaac

SEQ ID NO: 5048162 - DNA, 15 bp, Homo sapiens
ggtgtgccctggctc

SEQ ID NO: 5048163 - DNA, 16 bp, Homo sapiens
ggtgtgccctggctcc

SEQ ID NO: 5048164 - DNA, 12 bp, Homo sapiens
ggttgccacagg

SEQ ID NO: 5048165 - DNA, 18 bp, Homo sapiens
gtaaaataaaggctctgt

SEQ ID NO: 5048166 - DNA, 15 bp, Homo sapiens
gtaacgagaagacaa

SEQ ID NO: 5048167 - DNA, 21 bp, Homo sapiens
gtacacagagggacttgagcc

SEQ ID NO: 5048168 - DNA, 14 bp, Homo sapiens
gtaccccccaaccc

SEQ ID NO: 5048169 - DNA, 14 bp, Homo sapiens
gtacccccctgaga

SEQ ID NO: 5048170 - DNA, 13 bp, Homo sapiens
gtacgtgggagag

SEQ ID NO: 5048171 - DNA, 14 bp, Homo sapiens
gtagctctgagccc

SEQ ID NO: 5048172 - DNA, 15 bp, Homo sapiens
gtagctctgagccct

SEQ ID NO: 5048173 - DNA, 16 bp, Homo sapiens
gtagctctgagccctc

SEQ ID NO: 5048174 - DNA, 20 bp, Homo sapiens
gtagctgctagtgagccttc

SEQ ID NO: 5048175 - DNA, 17 bp, Homo sapiens
gtaggagagactggcca

SEQ ID NO: 5048176 - DNA, 16 bp, Homo sapiens
gtaggcgcccctgggg

SEQ ID NO: 5048177 - DNA, 20 bp, Homo sapiens
gtaggcgcccctggggtggg

SEQ ID NO: 5048178 - DNA, 13 bp, Homo sapiens
gtaggtgctggcc

SEQ ID NO: 5048179 - DNA, 15 bp, Homo sapiens
gtaggtgctggcctc

SEQ ID NO: 5048180 - DNA, 16 bp, Homo sapiens
gtaggtgctggcctca

SEQ ID NO: 5048181 - DNA, 18 bp, Homo sapiens
gtagtagcctttcctgat

SEQ ID NO: 5048182 - DNA, 13 bp, Homo sapiens
gtataagccccga

SEQ ID NO: 5048183 - DNA, 14 bp, Homo sapiens
gtatctggctgggt

SEQ ID NO: 5048184 - DNA, 15 bp, Homo sapiens
gtcaactccaggact

SEQ ID NO: 5048185 - DNA, 14 bp, Homo sapiens
gtcaccatcatttc

SEQ ID NO: 5048186 - DNA, 16 bp, Homo sapiens
gtcaccatcatttcta

SEQ ID NO: 5048187 - DNA, 16 bp, Homo sapiens
gtcactttctctctta

SEQ ID NO: 5048188 - DNA, 19 bp, Homo sapiens
gtcatggcagtgcctgaac

SEQ ID NO: 5048189 - DNA, 20 bp, Homo sapiens
gtcccaggggtctccctgag

SEQ ID NO: 5048190 - DNA, 23 bp, Homo sapiens
gtcccaggggtctccctgagcct

SEQ ID NO: 5048191 - DNA, 20 bp, Homo sapiens
gtcccccaaccccagccgct

SEQ ID NO: 5048192 - DNA, 18 bp, Homo sapiens
gtcccctcagctccagac

SEQ ID NO: 5048193 - DNA, 16 bp, Homo sapiens
gtccctccactaggag

SEQ ID NO: 5048194 - DNA, 14 bp, Homo sapiens
gtcctacggaggga

SEQ ID NO: 5048195 - DNA, 22 bp, Homo sapiens
gtcctaggtgaccccatctctg

SEQ ID NO: 5048196 - DNA, 14 bp, Homo sapiens
gtcctggggaggct

SEQ ID NO: 5048197 - DNA, 15 bp, Homo sapiens
gtcctggggaggctg

SEQ ID NO: 5048198 - DNA, 20 bp, Homo sapiens
gtcctggggaggctgagact

SEQ ID NO: 5048199 - DNA, 22 bp, Homo sapiens
gtcctggggaggctgagactgc

SEQ ID NO: 5048200 - DNA, 23 bp, Homo sapiens
gtcctggggaggctgagactgca

SEQ ID NO: 5048201 - DNA, 20 bp, Homo sapiens
gtctagaggcaacagtgttc

SEQ ID NO: 5048202 - DNA, 19 bp, Homo sapiens
gtctagatttatcagagta

SEQ ID NO: 5048203 - DNA, 12 bp, Homo sapiens
gtctccctgagc

SEQ ID NO: 5048204 - DNA, 21 bp, Homo sapiens
gtgaccccatctctgctgctt

SEQ ID NO: 5048205 - DNA, 23 bp, Homo sapiens
gtgacttcgaattagtttgcact

SEQ ID NO: 5048206 - DNA, 20 bp, Homo sapiens
gtgaggcaggggagtctgct

SEQ ID NO: 5048207 - DNA, 15 bp, Homo sapiens
gtgatgaggggaggg

SEQ ID NO: 5048208 - DNA, 20 bp, Homo sapiens
gtgcactaaccccagctgcc

SEQ ID NO: 5048209 - DNA, 19 bp, Homo sapiens
gtgcagccccaggaccaag

SEQ ID NO: 5048210 - DNA, 21 bp, Homo sapiens
gtgcagtataattttctaatt

SEQ ID NO: 5048211 - DNA, 10 bp, Homo sapiens
gtgccctggc

SEQ ID NO: 5048212 - DNA, 14 bp, Homo sapiens
gtgccctggctccc

SEQ ID NO: 5048213 - DNA, 22 bp, Homo sapiens
gtgcctgctctccttgccctgg

SEQ ID NO: 5048214 - DNA, 19 bp, Homo sapiens
gtgccttcagccaagacca

SEQ ID NO: 5048215 - DNA, 17 bp, Homo sapiens
gtgcggtaggtgctggc

SEQ ID NO: 5048216 - DNA, 18 bp, Homo sapiens
gtgcggtaggtgctggcc

SEQ ID NO: 5048217 - DNA, 17 bp, Homo sapiens
gtgctaacctcactgcc

SEQ ID NO: 5048218 - DNA, 19 bp, Homo sapiens
gtgctagggtgcctgctct

SEQ ID NO: 5048219 - DNA, 11 bp, Homo sapiens
gtgctggctcc

SEQ ID NO: 5048220 - DNA, 14 bp, Homo sapiens
gtgggacctggtgg

SEQ ID NO: 5048221 - DNA, 13 bp, Homo sapiens
gtgggagaggcag

SEQ ID NO: 5048222 - DNA, 12 bp, Homo sapiens
gtgggggagcct

SEQ ID NO: 5048223 - DNA, 15 bp, Homo sapiens
gtggtagctctgagc

SEQ ID NO: 5048224 - DNA, 19 bp, Homo sapiens
gtggtagctctgagccctc

SEQ ID NO: 5048225 - DNA, 15 bp, Homo sapiens
gtggtgcagccccag

SEQ ID NO: 5048226 - DNA, 18 bp, Homo sapiens
gtggtgcagccccaggac

SEQ ID NO: 5048227 - DNA, 21 bp, Homo sapiens
gtggtgcagccccaggaccaa

SEQ ID NO: 5048228 - DNA, 16 bp, Homo sapiens
gtgtccgggggtctag

SEQ ID NO: 5048229 - DNA, 18 bp, Homo sapiens
gtgtctgtaaggactcag

SEQ ID NO: 5048230 - DNA, 13 bp, Homo sapiens
gtgtgccctggct

SEQ ID NO: 5048231 - DNA, 16 bp, Homo sapiens
gtgtgccctggctccc

SEQ ID NO: 5048232 - DNA, 20 bp, Homo sapiens
gtgtgctaacctcactgcct

SEQ ID NO: 5048233 - DNA, 20 bp, Homo sapiens
gtgtgggagggcgaggcggg

SEQ ID NO: 5048234 - DNA, 15 bp, Homo sapiens
gttcatgtctctgat

SEQ ID NO: 5048235 - DNA, 19 bp, Homo sapiens
gttcctcccaagaggccag

SEQ ID NO: 5048236 - DNA, 22 bp, Homo sapiens
gttcgcacaatctacactgcct

SEQ ID NO: 5048237 - DNA, 12 bp, Homo sapiens
ctgggccctgca

SEQ ID NO: 5048238 - DNA, 17 bp, Homo sapiens
ctgggccctgcaggagg

SEQ ID NO: 5048239 - DNA, 20 bp, Homo sapiens
ctgggccctgcaggaggcct

SEQ ID NO: 5048240 - DNA, 22 bp, Homo sapiens
ctgggccctgcaggaggcctgg

SEQ ID NO: 5048241 - DNA, 19 bp, Homo sapiens
ctgggcctgatggagagga

SEQ ID NO: 5048242 - DNA, 23 bp, Homo sapiens
ctgggcctgatggagaggagaac

SEQ ID NO: 5048243 - DNA, 13 bp, Homo sapiens
ctgggctgggaga

SEQ ID NO: 5048244 - DNA, 15 bp, Homo sapiens
ctgggctgttggctg

SEQ ID NO: 5048245 - DNA, 18 bp, Homo sapiens
ctgggctgttggctgggg

SEQ ID NO: 5048246 - DNA, 20 bp, Homo sapiens
ctgggctgttggctgggggc

SEQ ID NO: 5048247 - DNA, 15 bp, Homo sapiens
ctggggaaggaccaa

SEQ ID NO: 5048248 - DNA, 20 bp, Homo sapiens
ctggggaggctgagactgca

SEQ ID NO: 5048249 - DNA, 22 bp, Homo sapiens
ctggggaggctgagactgcaga

SEQ ID NO: 5048250 - DNA, 14 bp, Homo sapiens
ctggggagtgagct

SEQ ID NO: 5048251 - DNA, 19 bp, Homo sapiens
ctgggggcatgggggaggc

SEQ ID NO: 5048252 - DNA, 23 bp, Homo sapiens
ctgggggcatgggggaggctctg

SEQ ID NO: 5048253 - DNA, 22 bp, Homo sapiens
ctggggtgggtttagcaggctg

SEQ ID NO: 5048254 - DNA, 20 bp, Homo sapiens
ctgggttttcaggggctttg

SEQ ID NO: 5048255 - DNA, 18 bp, Homo sapiens
ctggtgggctcaaccaca

SEQ ID NO: 5048256 - DNA, 19 bp, Homo sapiens
ctgtaaggactcagtgttg

SEQ ID NO: 5048257 - DNA, 22 bp, Homo sapiens
ctgtaggagagactggccagag

SEQ ID NO: 5048258 - DNA, 14 bp, Homo sapiens
ctgtcactttctct

SEQ ID NO: 5048259 - DNA, 16 bp, Homo sapiens
ctgtcactttctctct

SEQ ID NO: 5048260 - DNA, 17 bp, Homo sapiens
ctgtcactttctctctt

SEQ ID NO: 5048261 - DNA, 13 bp, Homo sapiens
ctgtcatctgggc

SEQ ID NO: 5048262 - DNA, 14 bp, Homo sapiens
ctgtcatctgggcc

SEQ ID NO: 5048263 - DNA, 15 bp, Homo sapiens
ctgtcatctgggcca

SEQ ID NO: 5048264 - DNA, 20 bp, Homo sapiens
ctgtcattaaactcatattt

SEQ ID NO: 5048265 - DNA, 22 bp, Homo sapiens
ctgtcccaggggtctccctgag

SEQ ID NO: 5048266 - DNA, 23 bp, Homo sapiens
ctgtcccaggggtctccctgagc

SEQ ID NO: 5048267 - DNA, 14 bp, Homo sapiens
ctgtcccctcagct

SEQ ID NO: 5048268 - DNA, 16 bp, Homo sapiens
ctgtcccctcagctcc

SEQ ID NO: 5048269 - DNA, 20 bp, Homo sapiens
ctgtcccctcagctccagac

SEQ ID NO: 5048270 - DNA, 15 bp, Homo sapiens
ctgtcctaggtgacc

SEQ ID NO: 5048271 - DNA, 11 bp, Homo sapiens
ctgtctgtgca

SEQ ID NO: 5048272 - DNA, 17 bp, Homo sapiens
ctgtctgtgcagatgct

SEQ ID NO: 5048273 - DNA, 22 bp, Homo sapiens
ctgtgatgaggggaggggggca

SEQ ID NO: 5048274 - DNA, 21 bp, Homo sapiens
ctgtgcagatgctttgcccag

SEQ ID NO: 5048275 - DNA, 23 bp, Homo sapiens
ctgtgcagatgctttgcccaggc

SEQ ID NO: 5048276 - DNA, 24 bp, Homo sapiens
ctgtgtcagcatctttgcccttct

SEQ ID NO: 5048277 - DNA, 20 bp, Homo sapiens
gccctgcaggaggcctggga

SEQ ID NO: 5048278 - DNA, 22 bp, Homo sapiens
gccctgcaggaggcctgggagg

SEQ ID NO: 5048279 - DNA, 19 bp, Homo sapiens
gccctgccaagcctggagc

SEQ ID NO: 5048280 - DNA, 13 bp, Homo sapiens
gccctggctccca

SEQ ID NO: 5048281 - DNA, 19 bp, Homo sapiens
gccctggctcccaagggag

SEQ ID NO: 5048282 - DNA, 20 bp, Homo sapiens
gccctgggccagcccaggat

SEQ ID NO: 5048283 - DNA, 18 bp, Homo sapiens
gccctggggagtgagctt

SEQ ID NO: 5048284 - DNA, 11 bp, Homo sapiens
gccctgtgctt

SEQ ID NO: 5048285 - DNA, 15 bp, Homo sapiens
gccgctcggaggccc

SEQ ID NO: 5048286 - DNA, 18 bp, Homo sapiens
gccgctcggaggccccaa

SEQ ID NO: 5048287 - DNA, 15 bp, Homo sapiens
gccgggcctggactg

SEQ ID NO: 5048288 - DNA, 15 bp, Homo sapiens
gcctagagtggcagc

SEQ ID NO: 5048289 - DNA, 19 bp, Homo sapiens
gcctcaaacagccacgagg

SEQ ID NO: 5048290 - DNA, 15 bp, Homo sapiens
gcctccgttcccacc

SEQ ID NO: 5048291 - DNA, 16 bp, Homo sapiens
gcctccgttcccacct

SEQ ID NO: 5048292 - DNA, 17 bp, Homo sapiens
gcctcctgcccagtccc

SEQ ID NO: 5048293 - DNA, 19 bp, Homo sapiens
gcctcgctcagtcagtgca

SEQ ID NO: 5048294 - DNA, 17 bp, Homo sapiens
gcctgatggagaggaga

SEQ ID NO: 5048295 - DNA, 21 bp, Homo sapiens
gcctgcccgttgccgggcctg

SEQ ID NO: 5048296 - DNA, 19 bp, Homo sapiens
gcctgctctccttgccctg

SEQ ID NO: 5048297 - DNA, 13 bp, Homo sapiens
gcctgctctgcca

SEQ ID NO: 5048298 - DNA, 14 bp, Homo sapiens
gcctgctctgccac

SEQ ID NO: 5048299 - DNA, 15 bp, Homo sapiens
gcctgctctgccact

SEQ ID NO: 5048300 - DNA, 19 bp, Homo sapiens
gcctgctctgccactggga

SEQ ID NO: 5048301 - DNA, 13 bp, Homo sapiens
gcctggaccccca

SEQ ID NO: 5048302 - DNA, 16 bp, Homo sapiens
gcctggagcccctgtg

SEQ ID NO: 5048303 - DNA, 21 bp, Homo sapiens
gcctggagcccctgtgtggga

SEQ ID NO: 5048304 - DNA, 23 bp, Homo sapiens
gcctggagcccctgtgtgggagg

SEQ ID NO: 5048305 - DNA, 18 bp, Homo sapiens
gcctggagcccctgtgtt

SEQ ID NO: 5048306 - DNA, 23 bp, Homo sapiens
gcctggcgggatgggccaccgcc

SEQ ID NO: 5048307 - DNA, 18 bp, Homo sapiens
gcctgttcctcccaagag

SEQ ID NO: 5048308 - DNA, 16 bp, Homo sapiens
gccttccgctcccacc

SEQ ID NO: 5048309 - DNA, 17 bp, Homo sapiens
gccttccgctcccacca

SEQ ID NO: 5048310 - DNA, 20 bp, Homo sapiens
gccttccgctcccaccagcc

SEQ ID NO: 5048311 - DNA, 21 bp, Homo sapiens
gccttccgctcccaccagccc

SEQ ID NO: 5048312 - DNA, 12 bp, Homo sapiens
gccttgctgtca

SEQ ID NO: 5048313 - DNA, 22 bp, Homo sapiens
gcgaggcgggggagcctggagc

SEQ ID NO: 5048314 - DNA, 24 bp, Homo sapiens
gcgaggcgggggatcctggagccc

SEQ ID NO: 5048315 - DNA, 14 bp, Homo sapiens
gcgggatgggccac

SEQ ID NO: 5048316 - DNA, 15 bp, Homo sapiens
gcgggatgggccacc

SEQ ID NO: 5048317 - DNA, 19 bp, Homo sapiens
gcgtcaggagcagcatcat

SEQ ID NO: 5048318 - DNA, 19 bp, Homo sapiens
gctaacctcactgcctcat

SEQ ID NO: 5048319 - DNA, 15 bp, Homo sapiens
gctaactaattctgt

SEQ ID NO: 5048320 - DNA, 16 bp, Homo sapiens
gctaactaattctgtc

SEQ ID NO: 5048321 - DNA, 13 bp, Homo sapiens
gctagggtgcctg

SEQ ID NO: 5048322 - DNA, 14 bp, Homo sapiens
gctagggtgcctgc

SEQ ID NO: 5048323 - DNA, 18 bp, Homo sapiens
gctagggtgcctgctctc

SEQ ID NO: 5048324 - DNA, 14 bp, Homo sapiens
gctagtgagccttc

SEQ ID NO: 5048325 - DNA, 22 bp, Homo sapiens
gctcacttaaacaatgtcctct

SEQ ID NO: 5048326 - DNA, 16 bp, Homo sapiens
gctccacgccctgggg

SEQ ID NO: 5048327 - DNA, 14 bp, Homo sapiens
gctccactggcctg

SEQ ID NO: 5048328 - DNA, 15 bp, Homo sapiens
gctcccaagggaggc

SEQ ID NO: 5048329 - DNA, 12 bp, Homo sapiens
gctcccaccagc

SEQ ID NO: 5048330 - DNA, 18 bp, Homo sapiens
gctcccaccagcccacat

SEQ ID NO: 5048331 - DNA, 13 bp, Homo sapiens
gctccccctgtcc

SEQ ID NO: 5048332 - DNA, 14 bp, Homo sapiens
gctccccctgtccc

SEQ ID NO: 5048333 - DNA, 18 bp, Homo sapiens
gctccccctgtcccctca

SEQ ID NO: 5048334 - DNA, 11 bp, Homo sapiens
gctctgagccc

SEQ ID NO: 5048335 - DNA, 13 bp, Homo sapiens
gctctgagccctc

SEQ ID NO: 5048336 - DNA, 14 bp, Homo sapiens
gctctgtgcttgac

SEQ ID NO: 5048337 - DNA, 18 bp, Homo sapiens
gctgagactgcagaggag

SEQ ID NO: 5048338 - DNA, 21 bp, Homo sapiens
gctgagactgcagaggagcca

SEQ ID NO: 5048339 - DNA, 22 bp, Homo sapiens
gctgcgtctggaggggcccctg

SEQ ID NO: 5048340 - DNA, 14 bp, Homo sapiens
gctgcttctgggcc

SEQ ID NO: 5048341 - DNA, 15 bp, Homo sapiens
gctgcttctgggcct

SEQ ID NO: 5048342 - DNA, 13 bp, Homo sapiens
gctggagtgctgg

SEQ ID NO: 5048343 - DNA, 14 bp, Homo sapiens
gctggagtgctggc

SEQ ID NO: 5048344 - DNA, 18 bp, Homo sapiens
gctggctccacgccctgg

SEQ ID NO: 5048345 - DNA, 12 bp, Homo sapiens
gctgggagaagg

SEQ ID NO: 5048346 - DNA, 16 bp, Homo sapiens
gctgggcaggtcctgg

SEQ ID NO: 5048347 - DNA, 19 bp, Homo sapiens
ctccccctgtcccctcagc

SEQ ID NO: 5048348 - DNA, 14 bp, Homo sapiens
ctccccgcctgttc

SEQ ID NO: 5048349 - DNA, 16 bp, Homo sapiens
ctccccgcctgttccc

SEQ ID NO: 5048350 - DNA, 18 bp, Homo sapiens
ctccccgcctgttccccc

SEQ ID NO: 5048351 - DNA, 14 bp, Homo sapiens
ctccctcctggtga

SEQ ID NO: 5048352 - DNA, 14 bp, Homo sapiens
ctccctgagcctgc

SEQ ID NO: 5048353 - DNA, 20 bp, Homo sapiens
ctccctgagcctgccccagc

SEQ ID NO: 5048354 - DNA, 22 bp, Homo sapiens
ctccctgagcctgccccagctg

SEQ ID NO: 5048355 - DNA, 20 bp, Homo sapiens
ctccctttgcgtcaggagca

SEQ ID NO: 5048356 - DNA, 22 bp, Homo sapiens
ctccggcactgggtttgctccc

SEQ ID NO: 5048357 - DNA, 19 bp, Homo sapiens
ctccgttcccacctctgag

SEQ ID NO: 5048358 - DNA, 15 bp, Homo sapiens
ctcctagcctgctct

SEQ ID NO: 5048359 - DNA, 16 bp, Homo sapiens
ctcctagcctgctctg

SEQ ID NO: 5048360 - DNA, 18 bp, Homo sapiens
ctcctagcctgctctgcc

SEQ ID NO: 5048361 - DNA, 20 bp, Homo sapiens
ctcctagcctgctctgccac

SEQ ID NO: 5048362 - DNA, 18 bp, Homo sapiens
ctccttcttgccctgagc

SEQ ID NO: 5048363 - DNA, 20 bp, Homo sapiens
ctccttcttgccctgagctt

SEQ ID NO: 5048364 - DNA, 14 bp, Homo sapiens
ctccttgccctggg

SEQ ID NO: 5048365 - DNA, 16 bp, Homo sapiens
ctcgctcagtcagtgc

SEQ ID NO: 5048366 - DNA, 15 bp, Homo sapiens
ctctccagttatcag

SEQ ID NO: 5048367 - DNA, 21 bp, Homo sapiens
ctctccctcctggtgaagtgt

SEQ ID NO: 5048368 - DNA, 15 bp, Homo sapiens
ctctccttgccctgg

SEQ ID NO: 5048369 - DNA, 16 bp, Homo sapiens
ctctccttgccctggg

SEQ ID NO: 5048370 - DNA, 20 bp, Homo sapiens
ctctctgcccaagttgctct

SEQ ID NO: 5048371 - DNA, 23 bp, Homo sapiens
ctctctgcccaagttgctctgta

SEQ ID NO: 5048372 - DNA, 12 bp, Homo sapiens
ctctctgcctgt

SEQ ID NO: 5048373 - DNA, 20 bp, Homo sapiens
ctctctttgttctcagctcc

SEQ ID NO: 5048374 - DNA, 21 bp, Homo sapiens
ctctgattgggtcagctggct

SEQ ID NO: 5048375 - DNA, 21 bp, Homo sapiens
ctctgcccaagttgctctgta

SEQ ID NO: 5048376 - DNA, 10 bp, Homo sapiens
ctctgtgtca

SEQ ID NO: 5048377 - DNA, 18 bp, Homo sapiens
ctcttgatcagtgtgcta

SEQ ID NO: 5048378 - DNA, 12 bp, Homo sapiens
ctctttccccag

SEQ ID NO: 5048379 - DNA, 22 bp, Homo sapiens
ctgaacatgagtgtcaactcca

SEQ ID NO: 5048380 - DNA, 16 bp, Homo sapiens
ctgaagagatacccac

SEQ ID NO: 5048381 - DNA, 18 bp, Homo sapiens
ctgaccatcccatgagca

SEQ ID NO: 5048382 - DNA, 19 bp, Homo sapiens
ctgagacggatggaaggag

SEQ ID NO: 5048383 - DNA, 17 bp, Homo sapiens
ctgagactgcagaggag

SEQ ID NO: 5048384 - DNA, 23 bp, Homo sapiens
ctgagagcatgtgggggaaggcc

SEQ ID NO: 5048385 - DNA, 22 bp, Homo sapiens
ctgagccctccttcttgccctg

SEQ ID NO: 5048386 - DNA, 23 bp, Homo sapiens
ctgagccctccttcttgccctga

SEQ ID NO: 5048387 - DNA, 23 bp, Homo sapiens
ctgagctttccggggaggagcct

SEQ ID NO: 5048388 - DNA, 18 bp, Homo sapiens
ctgaggaagatgggggca

SEQ ID NO: 5048389 - DNA, 13 bp, Homo sapiens
acacacctgtctg

SEQ ID NO: 5048390 - DNA, 18 bp, Homo sapiens
acacacctgtctgtgcag

SEQ ID NO: 5048391 - DNA, 23 bp, Homo sapiens
acacagagggacttgagccagtt

SEQ ID NO: 5048392 - DNA, 14 bp, Homo sapiens
acacagatctcttg

SEQ ID NO: 5048393 - DNA, 15 bp, Homo sapiens
acacagatctcttgt

SEQ ID NO: 5048394 - DNA, 22 bp, Homo sapiens
acaccagcccctgccccagccc

SEQ ID NO: 5048395 - DNA, 17 bp, Homo sapiens
acacctctgggccctgc

SEQ ID NO: 5048396 - DNA, 16 bp, Homo sapiens
acacctgtctgtgcag

SEQ ID NO: 5048397 - DNA, 16 bp, Homo sapiens
acagagtgtggtccct

SEQ ID NO: 5048398 - DNA, 20 bp, Homo sapiens
acagatcttgttctttgctg

SEQ ID NO: 5048399 - DNA, 16 bp, Homo sapiens
acagccacgaggtggt

SEQ ID NO: 5048400 - DNA, 21 bp, Homo sapiens
acagctttctaactcacaggc

SEQ ID NO: 5048401 - DNA, 14 bp, Homo sapiens
acagggagcctcct

SEQ ID NO: 5048402 - DNA, 18 bp, Homo sapiens
acagggagcctcctgccc

SEQ ID NO: 5048403 - DNA, 19 bp, Homo sapiens
acagggagcctcctgccca

SEQ ID NO: 5048404 - DNA, 14 bp, Homo sapiens
acagtgttctgagc

SEQ ID NO: 5048405 - DNA, 17 bp, Homo sapiens
acagtgttctgagcccc

SEQ ID NO: 5048406 - DNA, 22 bp, Homo sapiens
acatcagttgggatccctcctc

SEQ ID NO: 5048407 - DNA, 13 bp, Homo sapiens
acatttttctgat

SEQ ID NO: 5048408 - DNA, 14 bp, Homo sapiens
acatttttctgatg

SEQ ID NO: 5048409 - DNA, 13 bp, Homo sapiens
accaaactctgtg

SEQ ID NO: 5048410 - DNA, 14 bp, Homo sapiens
accaaactctgtgt

SEQ ID NO: 5048411 - DNA, 18 bp, Homo sapiens
accaagcttaaggagagg

SEQ ID NO: 5048412 - DNA, 12 bp, Homo sapiens
accagcccctgc

SEQ ID NO: 5048413 - DNA, 18 bp, Homo sapiens
accagcccctgccccagc

SEQ ID NO: 5048414 - DNA, 18 bp, Homo sapiens
accagctccactggcctg

SEQ ID NO: 5048415 - DNA, 18 bp, Homo sapiens
accatctctccctcctgg

SEQ ID NO: 5048416 - DNA, 20 bp, Homo sapiens
accatctctccctcctggtg

SEQ ID NO: 5048417 - DNA, 21 bp, Homo sapiens
accattgtcttgttctgtgat

SEQ ID NO: 5048418 - DNA, 16 bp, Homo sapiens
acccacagagtgtggt

SEQ ID NO: 5048419 - DNA, 11 bp, Homo sapiens
acccagccaaa

SEQ ID NO: 5048420 - DNA, 12 bp, Homo sapiens
acccatgccctg

SEQ ID NO: 5048421 - DNA, 17 bp, Homo sapiens
accccagctgccggcag

SEQ ID NO: 5048422 - DNA, 22 bp, Homo sapiens
acccccagctttgcccaacacc

SEQ ID NO: 5048423 - DNA, 14 bp, Homo sapiens
acccccttctgggc

SEQ ID NO: 5048424 - DNA, 17 bp, Homo sapiens
acccccttctgggcatc

SEQ ID NO: 5048425 - DNA, 23 bp, Homo sapiens
accctacacctctgggccctgca

SEQ ID NO: 5048426 - DNA, 20 bp, Homo sapiens
accctcctagcctgctctgc

SEQ ID NO: 5048427 - DNA, 14 bp, Homo sapiens
acctcactgcctca

SEQ ID NO: 5048428 - DNA, 17 bp, Homo sapiens
acctctctgcctgttcc

SEQ ID NO: 5048429 - DNA, 21 bp, Homo sapiens
acctctctgcctgttcctccc

SEQ ID NO: 5048430 - DNA, 16 bp, Homo sapiens
acctctgggccctgca

SEQ ID NO: 5048431 - DNA, 18 bp, Homo sapiens
acctctgggccctgcagg

SEQ ID NO: 5048432 - DNA, 15 bp, Homo sapiens
acctgggctgggaga

SEQ ID NO: 5048433 - DNA, 16 bp, Homo sapiens
acctgggctgggagaa

SEQ ID NO: 5048434 - DNA, 18 bp, Homo sapiens
acctgggctgggagaagg

SEQ ID NO: 5048435 - DNA, 13 bp, Homo sapiens
acctgtcatctgg

SEQ ID NO: 5048436 - DNA, 17 bp, Homo sapiens
acctgtcatctgggcca

SEQ ID NO: 5048437 - DNA, 15 bp, Homo sapiens
acctgtctgtgcaga

SEQ ID NO: 5048438 - DNA, 19 bp, Homo sapiens
accttctgaacatgagtgt

SEQ ID NO: 5048439 - DNA, 15 bp, Homo sapiens
acctttgctgtcact

SEQ ID NO: 5048440 - DNA, 19 bp, Homo sapiens
acctttgctgtcactttct

SEQ ID NO: 5048441 - DNA, 14 bp, Homo sapiens
acgctccccgcctg

SEQ ID NO: 5048442 - DNA, 16 bp, Homo sapiens
acggatggaaggagag

SEQ ID NO: 5048443 - DNA, 16 bp, Homo sapiens
aaaacttttacatttt

SEQ ID NO: 5048444 - DNA, 15 bp, Homo sapiens
aaaattattcccatg

SEQ ID NO: 5048445 - DNA, 13 bp, Homo sapiens
aaacaattctgat

SEQ ID NO: 5048446 - DNA, 15 bp, Homo sapiens
aaactgggatgggag

SEQ ID NO: 5048447 - DNA, 22 bp, Homo sapiens
aaacttataaatcatattctca

SEQ ID NO: 5048448 - DNA, 21 bp, Homo sapiens
aaacttttacatttttctgat

SEQ ID NO: 5048449 - DNA, 19 bp, Homo sapiens
aaaggaaaaagcacaagaa

SEQ ID NO: 5048450 - DNA, 11 bp, Homo sapiens
aaagtgccttc

SEQ ID NO: 5048451 - DNA, 15 bp, Homo sapiens
aaagtgccttctgag

SEQ ID NO: 5048452 - DNA, 19 bp, Homo sapiens
aaattctgttagctgctca

SEQ ID NO: 5048453 - DNA, 19 bp, Homo sapiens
aacaataaaaaccaaactc

SEQ ID NO: 5048454 - DNA, 16 bp, Homo sapiens
aacaatcccctaacac

SEQ ID NO: 5048455 - DNA, 17 bp, Homo sapiens
aacacagatctcttgtt

SEQ ID NO: 5048456 - DNA, 12 bp, Homo sapiens
aacatgagtgtc

SEQ ID NO: 5048457 - DNA, 20 bp, Homo sapiens
aaccacacacacaaggtgct

SEQ ID NO: 5048458 - DNA, 15 bp, Homo sapiens
aaccattgtcttgtt

SEQ ID NO: 5048459 - DNA, 12 bp, Homo sapiens
aactaattctgt

SEQ ID NO: 5048460 - DNA, 21 bp, Homo sapiens
aacttggatattcaagccttt

SEQ ID NO: 5048461 - DNA, 22 bp, Homo sapiens
aacttttacatttttctgatgg

SEQ ID NO: 5048462 - DNA, 15 bp, Homo sapiens
aagaaagccctgtgc

SEQ ID NO: 5048463 - DNA, 22 bp, Homo sapiens
aagaagatcacgctccccgcct

SEQ ID NO: 5048464 - DNA, 18 bp, Homo sapiens
aagaatgtgtgtgcagaa

SEQ ID NO: 5048465 - DNA, 14 bp, Homo sapiens
aagcaatctggaag

SEQ ID NO: 5048466 - DNA, 15 bp, Homo sapiens
aagcaatctggaaga

SEQ ID NO: 5048467 - DNA, 12 bp, Homo sapiens
aagcaattctgc

SEQ ID NO: 5048468 - DNA, 13 bp, Homo sapiens
aagccccgaggcc

SEQ ID NO: 5048469 - DNA, 15 bp, Homo sapiens
aagcctgcccttgtc

SEQ ID NO: 5048470 - DNA, 17 bp, Homo sapiens
aagcctgcccttgtctg

SEQ ID NO: 5048471 - DNA, 20 bp, Homo sapiens
aagcctgcccttgtctgaga

SEQ ID NO: 5048472 - DNA, 12 bp, Homo sapiens
aagcctggagcc

SEQ ID NO: 5048473 - DNA, 16 bp, Homo sapiens
aagcctggagcccctg

SEQ ID NO: 5048474 - DNA, 21 bp, Homo sapiens
aagcctttggatggctatgga

SEQ ID NO: 5048475 - DNA, 13 bp, Homo sapiens
aagcttaaggaga

SEQ ID NO: 5048476 - DNA, 18 bp, Homo sapiens
aaggaactcaaggtggct

SEQ ID NO: 5048477 - DNA, 21 bp, Homo sapiens
aaggaccaacccatgccctgc

SEQ ID NO: 5048478 - DNA, 22 bp, Homo sapiens
aaggagcctccgttcccacctc

SEQ ID NO: 5048479 - DNA, 11 bp, Homo sapiens
aaggctctgtg

SEQ ID NO: 5048480 - DNA, 14 bp, Homo sapiens
aaggctgcgtctgg

SEQ ID NO: 5048481 - DNA, 21 bp, Homo sapiens
aaggggcaggaatcaaggagc

SEQ ID NO: 5048482 - DNA, 13 bp, Homo sapiens
aaggtagagccca

SEQ ID NO: 5048483 - DNA, 18 bp, Homo sapiens
aaggtagagcccactgct

SEQ ID NO: 5048484 - DNA, 19 bp, Homo sapiens
aaggtgcttgggcttctgc

SEQ ID NO: 5048485 - DNA, 22 bp, Homo sapiens
aaggtgcttgggcttctgcggt

SEQ ID NO: 5048486 - DNA, 23 bp, Homo sapiens
aaggtggctggagatggctgctg

SEQ ID NO: 5048487 - DNA, 16 bp, Homo sapiens
aaggtgggggagcctg

SEQ ID NO: 5048488 - DNA, 20 bp, Homo sapiens
aaggtgggggagcctggagc

SEQ ID NO: 5048489 - DNA, 21 bp, Homo sapiens
aaggtgggggagcctggagcc

SEQ ID NO: 5048490 - DNA, 18 bp, Homo sapiens
aagtgatggtcattcata

SEQ ID NO: 5048491 - DNA, 21 bp, Homo sapiens
aagtgccttcagccaagacca

SEQ ID NO: 5048492 - DNA, 18 bp, Homo sapiens
aagtttacttgtctttga

SEQ ID NO: 5048493 - DNA, 14 bp, Homo sapiens
aataaaggctctgt

SEQ ID NO: 5048494 - DNA, 16 bp, Homo sapiens
aataccccttctctgt

SEQ ID NO: 5048495 - DNA, 17 bp, Homo sapiens
aatactttttgtggaat

SEQ ID NO: 5048496 - DNA, 16 bp, Homo sapiens
aatcagagcccaggga

SEQ ID NO: 5048497 - DNA, 15 bp, Homo sapiens
aatcatattctcatg

SEQ ID NO: 5048498 - DNA, 19 bp, Homo sapiens
aatgatttagctccctcca

SEQ ID NO: 5048499 - DNA, 15 bp, Homo sapiens
aatgcagcaatccca

SEQ ID NO: 5048500 - DNA, 21 bp, Homo sapiens
aatgtaaaataaaggctctgt

SEQ ID NO: 5048501 - DNA, 14 bp, Homo sapiens
aatgtcctctttga

SEQ ID NO: 5048502 - DNA, 14 bp, Homo sapiens
aatgtgtgtgcaga

SEQ ID NO: 5048503 - DNA, 21 bp, Homo sapiens
aattaactctccagttatcag

SEQ ID NO: 5048504 - DNA, 19 bp, Homo sapiens
aattctgttagctgctcac

SEQ ID NO: 5048505 - DNA, 15 bp, Homo sapiens
aattcttgcttgagg

SEQ ID NO: 5048506 - DNA, 14 bp, Homo sapiens
acaaggtgctcaga

SEQ ID NO: 5048507 - DNA, 16 bp, Homo sapiens
acaaggtggcagcaag

SEQ ID NO: 5048508 - DNA, 19 bp, Homo sapiens
acaagtttacttgtctttg

SEQ ID NO: 5048509 - DNA, 14 bp, Homo sapiens
acacacctgtctgt

SEQ ID NO: 5048510 - DNA, 17 bp, Homo sapiens
acacacctgtctgtgca

SEQ ID NO: 5048511 - DNA, 19 bp, Homo sapiens
acacacctgtctgtgcaga

SEQ ID NO: 5048512 - DNA, 15 bp, Homo sapiens
acaccagcccctgcc

SEQ ID NO: 5048513 - DNA, 17 bp, Homo sapiens
acaccagcccctgcccc

SEQ ID NO: 5048514 - DNA, 12 bp, Homo sapiens
acacctctgggc

SEQ ID NO: 5048515 - DNA, 15 bp, Homo sapiens
acacctctgggccct

SEQ ID NO: 5048516 - DNA, 18 bp, Homo sapiens
acacctctgggccctgca

SEQ ID NO: 5048517 - DNA, 14 bp, Homo sapiens
acacctgtctgtgc

SEQ ID NO: 5048518 - DNA, 17 bp, Homo sapiens
acacctgtctgtgcaga

SEQ ID NO: 5048519 - DNA, 21 bp, Homo sapiens
acacctgtctgtgcagatgct

SEQ ID NO: 5048520 - DNA, 20 bp, Homo sapiens
acagagtgtggtccctccac

SEQ ID NO: 5048521 - DNA, 19 bp, Homo sapiens
acagcacaaggtggcagca

SEQ ID NO: 5048522 - DNA, 22 bp, Homo sapiens
acagcacaaggtggcagcaagc

SEQ ID NO: 5048523 - DNA, 13 bp, Homo sapiens
acagggagcctcc

SEQ ID NO: 5048524 - DNA, 15 bp, Homo sapiens
acagtgttctgagcc

SEQ ID NO: 5048525 - DNA, 16 bp, Homo sapiens
acagtgttctgagccc

SEQ ID NO: 5048526 - DNA, 16 bp, Homo sapiens
acatattcatcagcag

SEQ ID NO: 5048527 - DNA, 17 bp, Homo sapiens
acatccagtggggtctc

SEQ ID NO: 5048528 - DNA, 21 bp, Homo sapiens
acatgcccgctgtcccagggg

SEQ ID NO: 5048529 - DNA, 18 bp, Homo sapiens
accaaactctgtgtcagc

SEQ ID NO: 5048530 - DNA, 17 bp, Homo sapiens
accaacccatgccctgc

SEQ ID NO: 5048531 - DNA, 17 bp, Homo sapiens
accaagcttaaggagag

SEQ ID NO: 5048532 - DNA, 20 bp, Homo sapiens
accaagcttaaggagaggag

SEQ ID NO: 5048533 - DNA, 21 bp, Homo sapiens
accaagcttaaggagaggaga

SEQ ID NO: 5048534 - DNA, 19 bp, Homo sapiens
accacacacacaaggtgct

SEQ ID NO: 5048535 - DNA, 15 bp, Homo sapiens
accagcccctgcccc

SEQ ID NO: 5048536 - DNA, 19 bp, Homo sapiens
accagctccactggcctgc

SEQ ID NO: 5048537 - DNA, 22 bp, Homo sapiens
accaggtgctagggtgcctgct

SEQ ID NO: 5048538 - DNA, 16 bp, Homo sapiens
acccactaccatacag

SEQ ID NO: 5048539 - DNA, 13 bp, Homo sapiens
acccagccagctc

SEQ ID NO: 5048540 - DNA, 13 bp, Homo sapiens
acccatgccctgc

SEQ ID NO: 5048541 - DNA, 22 bp, Homo sapiens
accccagctgccggcagtgctg

SEQ ID NO: 5048542 - DNA, 16 bp, Homo sapiens
accccatctctgctgc

SEQ ID NO: 5048543 - DNA, 22 bp, Homo sapiens
accccatctctgctgcttctgg

SEQ ID NO: 5048544 - DNA, 20 bp, Homo sapiens
accccccaacccctgaggaa

SEQ ID NO: 5048545 - DNA, 13 bp, Homo sapiens
acccccctgagag

SEQ ID NO: 5048546 - DNA, 15 bp, Homo sapiens
acccccttctgggca

SEQ ID NO: 5048547 - DNA, 16 bp, Homo sapiens
acccccttctgggcat

SEQ ID NO: 5048548 - DNA, 17 bp, Homo sapiens
accctacacctctgggc

SEQ ID NO: 5048549 - DNA, 18 bp, Homo sapiens
accctacacctctgggcc

SEQ ID NO: 5048550 - DNA, 10 bp, Homo sapiens
acctctgagg

SEQ ID NO: 5048551 - DNA, 12 bp, Homo sapiens
acctctgaggac

SEQ ID NO: 5048552 - DNA, 14 bp, Homo sapiens
acctctgggccctg

SEQ ID NO: 5048553 - DNA, 15 bp, Homo sapiens
acctctgggccctgc

SEQ ID NO: 5048554 - DNA, 22 bp, Homo sapiens
acctgcctgaccatcccatgag

SEQ ID NO: 5048555 - DNA, 17 bp, Homo sapiens
acctgggctgggagaag

SEQ ID NO: 5048556 - DNA, 16 bp, Homo sapiens
acctgtcatctgggcc

SEQ ID NO: 5048557 - DNA, 14 bp, Homo sapiens
acctgtctgtgcag

SEQ ID NO: 5048558 - DNA, 14 bp, Homo sapiens
acctttgctgtcac

SEQ ID NO: 5048559 - DNA, 17 bp, Homo sapiens
acgaggtggtagctctg

SEQ ID NO: 5048560 - DNA, 17 bp, Homo sapiens
acgctccccgcctgttc

SEQ ID NO: 5048561 - DNA, 22 bp, Homo sapiens
acgctccccgcctgttcccccg

SEQ ID NO: 5048562 - DNA, 17 bp, Homo sapiens
acggatggaaggagaga

SEQ ID NO: 5048563 - DNA, 16 bp, Homo sapiens
actaccatacagacag

SEQ ID NO: 5048564 - DNA, 19 bp, Homo sapiens
actaccatacagacagcac

SEQ ID NO: 5048565 - DNA, 19 bp, Homo sapiens
actagctaactaattctgt

SEQ ID NO: 5048566 - DNA, 20 bp, Homo sapiens
actccaaacaattctgatga

SEQ ID NO: 5048567 - DNA, 21 bp, Homo sapiens
actcccacaattggccagggc

SEQ ID NO: 5048568 - DNA, 18 bp, Homo sapiens
actccctttgcgtcagga

SEQ ID NO: 5048569 - DNA, 23 bp, Homo sapiens
actgcagaggagccacctgggct

SEQ ID NO: 5048570 - DNA, 19 bp, Homo sapiens
actgccttaccttcactta

SEQ ID NO: 5048571 - DNA, 16 bp, Homo sapiens
actgggacggctcctg

SEQ ID NO: 5048572 - DNA, 20 bp, Homo sapiens
actgtaggcgcccctggggt

SEQ ID NO: 5048573 - DNA, 19 bp, Homo sapiens
actgtcacggaacagatct

SEQ ID NO: 5048574 - DNA, 23 bp, Homo sapiens
acttaaaccacacacacaaggtg

SEQ ID NO: 5048575 - DNA, 22 bp, Homo sapiens
acttcgaattagtttgcacttc

SEQ ID NO: 5048576 - DNA, 23 bp, Homo sapiens
acttgagccagttacctttgctg

SEQ ID NO: 5048577 - DNA, 18 bp, Homo sapiens
actttgtaccccccaacc

SEQ ID NO: 5048578 - DNA, 19 bp, Homo sapiens
acttttacatttttctgat

SEQ ID NO: 5048579 - DNA, 14 bp, Homo sapiens
agaaagccctgtgc

SEQ ID NO: 5048580 - DNA, 16 bp, Homo sapiens
agaaggtgcttgggct

SEQ ID NO: 5048581 - DNA, 18 bp, Homo sapiens
agacatgccaactcggga

SEQ ID NO: 5048582 - DNA, 15 bp, Homo sapiens
agacgccaccattcc

SEQ ID NO: 5048583 - DNA, 15 bp, Homo sapiens
agacggatggaagga

SEQ ID NO: 5048584 - DNA, 17 bp, Homo sapiens
agacggatggaaggaga

SEQ ID NO: 5048585 - DNA, 14 bp, Homo sapiens
agactgcagaggag

SEQ ID NO: 5048586 - DNA, 15 bp, Homo sapiens
agactggccagaggc

SEQ ID NO: 5048587 - DNA, 18 bp, Homo sapiens
agagaaagtgggacctgg

SEQ ID NO: 5048588 - DNA, 17 bp, Homo sapiens
agagcaatactttttgt

SEQ ID NO: 5048589 - DNA, 14 bp, Homo sapiens
agagcatctgctct

SEQ ID NO: 5048590 - DNA, 19 bp, Homo sapiens
agagcatgtgggggaaggc

SEQ ID NO: 5048591 - DNA, 22 bp, Homo sapiens
agagcttcagggctgggcaggt

SEQ ID NO: 5048592 - DNA, 21 bp, Homo sapiens
agaggagagcatctgctctga

SEQ ID NO: 5048593 - DNA, 20 bp, Homo sapiens
agaggcagctaaggggcagg

SEQ ID NO: 5048594 - DNA, 18 bp, Homo sapiens
agaggccagggtggccag

SEQ ID NO: 5048595 - DNA, 13 bp, Homo sapiens
agagggacttgag

SEQ ID NO: 5048596 - DNA, 17 bp, Homo sapiens
agagtacccccctgaga

SEQ ID NO: 5048597 - DNA, 22 bp, Homo sapiens
agagtacccccctgagagcatg

SEQ ID NO: 5048598 - DNA, 17 bp, Homo sapiens
agatgatccttcttaga

SEQ ID NO: 5048599 - DNA, 13 bp, Homo sapiens
agatgctttgccc

SEQ ID NO: 5048600 - DNA, 17 bp, Homo sapiens
agatgctttgcccaggc

SEQ ID NO: 5048601 - DNA, 16 bp, Homo sapiens
agatggctgctgctca

SEQ ID NO: 5048602 - DNA, 15 bp, Homo sapiens
agatgggggcaagaa

SEQ ID NO: 5048603 - DNA, 17 bp, Homo sapiens
agattaaagattgcttt

SEQ ID NO: 5048604 - DNA, 15 bp, Homo sapiens
agcaaatgccttttc

SEQ ID NO: 5048605 - DNA, 11 bp, Homo sapiens
agcacaagaag

SEQ ID NO: 5048606 - DNA, 12 bp, Homo sapiens
agcacaagaagc

SEQ ID NO: 5048607 - DNA, 20 bp, Homo sapiens
agcaccttagggagggactg

SEQ ID NO: 5048608 - DNA, 14 bp, Homo sapiens
agcagcatcattca

SEQ ID NO: 5048609 - DNA, 13 bp, Homo sapiens
agcaggcagagga

SEQ ID NO: 5048610 - DNA, 20 bp, Homo sapiens
agcaggctgcagcaggcaga

SEQ ID NO: 5048611 - DNA, 14 bp, Homo sapiens
agcatctgctctga

SEQ ID NO: 5048612 - DNA, 16 bp, Homo sapiens
agcatctgctctgaga

SEQ ID NO: 5048613 - DNA, 16 bp, Homo sapiens
agcatgtgggggaagg

SEQ ID NO: 5048614 - DNA, 20 bp, Homo sapiens
agcatttcaggttgtgcatt

SEQ ID NO: 5048615 - DNA, 20 bp, Homo sapiens
agccagctcctttccctttt

SEQ ID NO: 5048616 - DNA, 14 bp, Homo sapiens
agcccaagtccaaa

SEQ ID NO: 5048617 - DNA, 12 bp, Homo sapiens
agcccctgcccc

SEQ ID NO: 5048618 - DNA, 18 bp, Homo sapiens
agcccctgccccagccca

SEQ ID NO: 5048619 - DNA, 12 bp, Homo sapiens
agcccctgtgtc

SEQ ID NO: 5048620 - DNA, 13 bp, Homo sapiens
agcccctgtgttg

SEQ ID NO: 5048621 - DNA, 18 bp, Homo sapiens
agccctccttcttgccct

SEQ ID NO: 5048622 - DNA, 11 bp, Homo sapiens
agcctcctgcc

SEQ ID NO: 5048623 - DNA, 14 bp, Homo sapiens
agcctcctgcccag

SEQ ID NO: 5048624 - DNA, 15 bp, Homo sapiens
agcctgccccagctg

SEQ ID NO: 5048625 - DNA, 19 bp, Homo sapiens
agcctgccccagctgggct

SEQ ID NO: 5048626 - DNA, 20 bp, Homo sapiens
agcctgccccagctgggctg

SEQ ID NO: 5048627 - DNA, 13 bp, Homo sapiens
agcctgcccttgt

SEQ ID NO: 5048628 - DNA, 17 bp, Homo sapiens
agcctgcccttgtctga

SEQ ID NO: 5048629 - DNA, 23 bp, Homo sapiens
agcctgcccttgtctgagatgct

SEQ ID NO: 5048630 - DNA, 16 bp, Homo sapiens
agcctgctctgccact

SEQ ID NO: 5048631 - DNA, 17 bp, Homo sapiens
agcctggacccccagct

SEQ ID NO: 5048632 - DNA, 18 bp, Homo sapiens
agcctggacccccagctt

SEQ ID NO: 5048633 - DNA, 10 bp, Homo sapiens
agcctggagc

SEQ ID NO: 5048634 - DNA, 13 bp, Homo sapiens
agcctggagcccc

SEQ ID NO: 5048635 - DNA, 14 bp, Homo sapiens
agcctggagcccct

SEQ ID NO: 5048636 - DNA, 13 bp, Homo sapiens
agctccccctgtc

SEQ ID NO: 5048637 - DNA, 19 bp, Homo sapiens
agctccccctgtcccctca

SEQ ID NO: 5048638 - DNA, 21 bp, Homo sapiens
agctccccctgtcccctcagc

SEQ ID NO: 5048639 - DNA, 13 bp, Homo sapiens
agctctgagccct

SEQ ID NO: 5048640 - DNA, 16 bp, Homo sapiens
agctgccggcagtgct

SEQ ID NO: 5048641 - DNA, 17 bp, Homo sapiens
agctgccggcagtgctg

SEQ ID NO: 5048642 - DNA, 11 bp, Homo sapiens
agctgctcact

SEQ ID NO: 5048643 - DNA, 10 bp, Homo sapiens
agctgggctg

SEQ ID NO: 5048644 - DNA, 15 bp, Homo sapiens
agcttaaggagagga

SEQ ID NO: 5048645 - DNA, 17 bp, Homo sapiens
agcttcagggctgggca

SEQ ID NO: 5048646 - DNA, 19 bp, Homo sapiens
aggaccaacccatgccctg

SEQ ID NO: 5048647 - DNA, 20 bp, Homo sapiens
aggaccaacccatgccctgc

SEQ ID NO: 5048648 - DNA, 20 bp, Homo sapiens
aggaccaagcttaaggagag

SEQ ID NO: 5048649 - DNA, 17 bp, Homo sapiens
aggactttagggatctg

SEQ ID NO: 5048650 - DNA, 21 bp, Homo sapiens
aggagagcatctgctctgaga

SEQ ID NO: 5048651 - DNA, 19 bp, Homo sapiens
aggagagtacccccctgag

SEQ ID NO: 5048652 - DNA, 23 bp, Homo sapiens
aggagagtacccccctgagagca

SEQ ID NO: 5048653 - DNA, 12 bp, Homo sapiens
aggagcagcatc

SEQ ID NO: 5048654 - DNA, 16 bp, Homo sapiens
aggagtggagggtggg

SEQ ID NO: 5048655 - DNA, 16 bp, Homo sapiens
aggatgcactggcctg

SEQ ID NO: 5048656 - DNA, 17 bp, Homo sapiens
aggatgcactggcctgt

SEQ ID NO: 5048657 - DNA, 21 bp, Homo sapiens
aggattgtacgtgggagaggc

SEQ ID NO: 5048658 - DNA, 15 bp, Homo sapiens
aggcagaggagagta

SEQ ID NO: 5048659 - DNA, 21 bp, Homo sapiens
aggcaggaaggaactcaaggt

SEQ ID NO: 5048660 - DNA, 17 bp, Homo sapiens
aggcctagagtggcagc

SEQ ID NO: 5048661 - DNA, 12 bp, Homo sapiens
aggcctgggagg

SEQ ID NO: 5048662 - DNA, 13 bp, Homo sapiens
aggcctgggaggg

SEQ ID NO: 5048663 - DNA, 18 bp, Homo sapiens
aggcgcccctggggtggg

SEQ ID NO: 5048664 - DNA, 17 bp, Homo sapiens
aggcgggggagcctgga

SEQ ID NO: 5048665 - DNA, 22 bp, Homo sapiens
aggcgggggagcctggagcccc

SEQ ID NO: 5048666 - DNA, 13 bp, Homo sapiens
aggctcagccttg

SEQ ID NO: 5048667 - DNA, 14 bp, Homo sapiens
aggctcagccttgg

SEQ ID NO: 5048668 - DNA, 14 bp, Homo sapiens
aggctgagactgca

SEQ ID NO: 5048669 - DNA, 20 bp, Homo sapiens
aggctgcagcaggcagagga

SEQ ID NO: 5048670 - DNA, 17 bp, Homo sapiens
aggctgcgtctggaggg

SEQ ID NO: 5048671 - DNA, 12 bp, Homo sapiens
aggcttctcacc

SEQ ID NO: 5048672 - DNA, 18 bp, Homo sapiens
agggactgggatgagaga

SEQ ID NO: 5048673 - DNA, 11 bp, Homo sapiens
agggagcctcc

SEQ ID NO: 5048674 - DNA, 17 bp, Homo sapiens
agggagcctcctgccca

SEQ ID NO: 5048675 - DNA, 11 bp, Homo sapiens
agggaggggag

SEQ ID NO: 5048676 - DNA, 16 bp, Homo sapiens
agggaggggaggtggc

SEQ ID NO: 5048677 - DNA, 16 bp, Homo sapiens
agggcgaggcggggga

SEQ ID NO: 5048678 - DNA, 20 bp, Homo sapiens
agggcgaggcgggggagcct

SEQ ID NO: 5048679 - DNA, 21 bp, Homo sapiens
agggcgaggcgggggagcctg

SEQ ID NO: 5048680 - DNA, 16 bp, Homo sapiens
aggggaggggggcaca

SEQ ID NO: 5048681 - DNA, 12 bp, Homo sapiens
aggggaggtggc

SEQ ID NO: 5048682 - DNA, 20 bp, Homo sapiens
aggggcccctgcttctccag

SEQ ID NO: 5048683 - DNA, 15 bp, Homo sapiens
aggggtctccctgag

SEQ ID NO: 5048684 - DNA, 20 bp, Homo sapiens
aggggtctccctgagcctgc

SEQ ID NO: 5048685 - DNA, 22 bp, Homo sapiens
aggtcctggggaggctgagact

SEQ ID NO: 5048686 - DNA, 17 bp, Homo sapiens
aggtgctagggtgcctg

SEQ ID NO: 5048687 - DNA, 17 bp, Homo sapiens
aggtgcttgggcttctg

SEQ ID NO: 5048688 - DNA, 20 bp, Homo sapiens
aggtgcttgggcttctgcgg

SEQ ID NO: 5048689 - DNA, 13 bp, Homo sapiens
aggtggcagcaag

SEQ ID NO: 5048690 - DNA, 18 bp, Homo sapiens
aggtgggggagcctggag

SEQ ID NO: 5048691 - DNA, 19 bp, Homo sapiens
aggtgggggagcctggagc

SEQ ID NO: 5048692 - DNA, 16 bp, Homo sapiens
aggtggtagctctgag

SEQ ID NO: 5048693 - DNA, 18 bp, Homo sapiens
aggttgaggatgcactgg

SEQ ID NO: 5048694 - DNA, 19 bp, Homo sapiens
agtaagaatgtgtgtgcag

SEQ ID NO: 5048695 - DNA, 13 bp, Homo sapiens
agtataattttct

SEQ ID NO: 5048696 - DNA, 15 bp, Homo sapiens
agtatctggctgggt

SEQ ID NO: 5048697 - DNA, 16 bp, Homo sapiens
agtatctggctgggtt

SEQ ID NO: 5048698 - DNA, 21 bp, Homo sapiens
agtcagtgcactaaccccagc

SEQ ID NO: 5048699 - DNA, 19 bp, Homo sapiens
agtccaaatgtttacaggg

SEQ ID NO: 5048700 - DNA, 17 bp, Homo sapiens
agtcctcacatgcccgc

SEQ ID NO: 5048701 - DNA, 20 bp, Homo sapiens
agtctgcttgtcttagatgt

SEQ ID NO: 5048702 - DNA, 20 bp, Homo sapiens
agtgatggtcattcatatca

SEQ ID NO: 5048703 - DNA, 19 bp, Homo sapiens
agtgctggttctccaacag

SEQ ID NO: 5048704 - DNA, 17 bp, Homo sapiens
agtggcagccaagagcc

SEQ ID NO: 5048705 - DNA, 23 bp, Homo sapiens
agtggcagccaagagccatctga

SEQ ID NO: 5048706 - DNA, 19 bp, Homo sapiens
agtgtaattacctgtcatc

SEQ ID NO: 5048707 - DNA, 15 bp, Homo sapiens
agtgtctgtaaggac

SEQ ID NO: 5048708 - DNA, 13 bp, Homo sapiens
agtgtggtccctc

SEQ ID NO: 5048709 - DNA, 13 bp, Homo sapiens
agtgttctgagcc

SEQ ID NO: 5048710 - DNA, 15 bp, Homo sapiens
agttacctttgctgt

SEQ ID NO: 5048711 - DNA, 13 bp, Homo sapiens
agttcatactgat

SEQ ID NO: 5048712 - DNA, 19 bp, Homo sapiens
agttcatactgatgccctg

SEQ ID NO: 5048713 - DNA, 20 bp, Homo sapiens
agttcatactgatgccctga

SEQ ID NO: 5048714 - DNA, 12 bp, Homo sapiens
ataaaggctctg

SEQ ID NO: 5048715 - DNA, 13 bp, Homo sapiens
ataaaggctctgt

SEQ ID NO: 5048716 - DNA, 12 bp, Homo sapiens
atacagacagca

SEQ ID NO: 5048717 - DNA, 17 bp, Homo sapiens
atacctcgaacatcagt

SEQ ID NO: 5048718 - DNA, 17 bp, Homo sapiens
atattctcatggctttg

SEQ ID NO: 5048719 - DNA, 14 bp, Homo sapiens
atatttgctggagt

SEQ ID NO: 5048720 - DNA, 21 bp, Homo sapiens
atatttgctggagtgctggct

SEQ ID NO: 5048721 - DNA, 22 bp, Homo sapiens
atatttgctggagtgctggctc

SEQ ID NO: 5048722 - DNA, 14 bp, Homo sapiens
atcaaggagcctcc

SEQ ID NO: 5048723 - DNA, 14 bp, Homo sapiens
atcagtactcccac

SEQ ID NO: 5048724 - DNA, 21 bp, Homo sapiens
atcatccattctctctgccca

SEQ ID NO: 5048725 - DNA, 17 bp, Homo sapiens
atccattctctctgccc

SEQ ID NO: 5048726 - DNA, 14 bp, Homo sapiens
atcctggagcccct

SEQ ID NO: 5048727 - DNA, 15 bp, Homo sapiens
atcctggagcccctg

SEQ ID NO: 5048728 - DNA, 13 bp, Homo sapiens
atctacactgcct

SEQ ID NO: 5048729 - DNA, 16 bp, Homo sapiens
atctacactgccttac

SEQ ID NO: 5048730 - DNA, 18 bp, Homo sapiens
atctacactgccttacct

SEQ ID NO: 5048731 - DNA, 15 bp, Homo sapiens
atctctccctcctgg

SEQ ID NO: 5048732 - DNA, 16 bp, Homo sapiens
atctctgctgcttctg

SEQ ID NO: 5048733 - DNA, 18 bp, Homo sapiens
atctctgctgcttctggg

SEQ ID NO: 5048734 - DNA, 15 bp, Homo sapiens
atctcttttcccact

SEQ ID NO: 5048735 - DNA, 16 bp, Homo sapiens
atctcttttcccactc

SEQ ID NO: 5048736 - DNA, 22 bp, Homo sapiens
atctgaataccccttctctgta

SEQ ID NO: 5048737 - DNA, 12 bp, Homo sapiens
atctgctctgag

SEQ ID NO: 5048738 - DNA, 15 bp, Homo sapiens
atctggaagaaagcc

SEQ ID NO: 5048739 - DNA, 11 bp, Homo sapiens
atctgggccac

SEQ ID NO: 5048740 - DNA, 18 bp, Homo sapiens
atctggggaaggaccaac

SEQ ID NO: 5048741 - DNA, 14 bp, Homo sapiens
atgaaatgtacatg

SEQ ID NO: 5048742 - DNA, 16 bp, Homo sapiens
atgacagaacacagat

SEQ ID NO: 5048743 - DNA, 13 bp, Homo sapiens
atgcactggcctg

SEQ ID NO: 5048744 - DNA, 14 bp, Homo sapiens
atgcccgctgtccc

SEQ ID NO: 5048745 - DNA, 19 bp, Homo sapiens
atgccctgccaagcctgga

SEQ ID NO: 5048746 - DNA, 20 bp, Homo sapiens
atgccctgccaagcctggag

SEQ ID NO: 5048747 - DNA, 21 bp, Homo sapiens
atgccctgccaagcctggagc

SEQ ID NO: 5048748 - DNA, 18 bp, Homo sapiens
atgctgagtctcccaagg

SEQ ID NO: 5048749 - DNA, 16 bp, Homo sapiens
atgctttgcccaggct

SEQ ID NO: 5048750 - DNA, 14 bp, Homo sapiens
atggagaggagaac

SEQ ID NO: 5048751 - DNA, 13 bp, Homo sapiens
atgggccaccgcc

SEQ ID NO: 5048752 - DNA, 14 bp, Homo sapiens
atgggggaggctct

SEQ ID NO: 5048753 - DNA, 12 bp, Homo sapiens
atgtgtgtgcag

SEQ ID NO: 5048754 - DNA, 21 bp, Homo sapiens
atgtttacagggagcctcctg

SEQ ID NO: 5048755 - DNA, 19 bp, Homo sapiens
attaaactcatattttgaa

SEQ ID NO: 5048756 - DNA, 21 bp, Homo sapiens
attaaagattgctttatccag

SEQ ID NO: 5048757 - DNA, 15 bp, Homo sapiens
attaaagtgccttca

SEQ ID NO: 5048758 - DNA, 15 bp, Homo sapiens
attagtttgcacttc

SEQ ID NO: 5048759 - DNA, 12 bp, Homo sapiens
attattcccatg

SEQ ID NO: 5048760 - DNA, 15 bp, Homo sapiens
attcagcaaatgcct

SEQ ID NO: 5048761 - DNA, 15 bp, Homo sapiens
attctctctgcccaa

SEQ ID NO: 5048762 - DNA, 20 bp, Homo sapiens
attctgtcattaaactcata

SEQ ID NO: 5048763 - DNA, 21 bp, Homo sapiens
attctgttagctgctcactta

SEQ ID NO: 5048764 - DNA, 22 bp, Homo sapiens
attctgttagctgctcacttaa

SEQ ID NO: 5048765 - DNA, 15 bp, Homo sapiens
attgctttatccagc

SEQ ID NO: 5048766 - DNA, 13 bp, Homo sapiens
attgggtgtgccc

SEQ ID NO: 5048767 - DNA, 16 bp, Homo sapiens
attgggtgtgccctgg

SEQ ID NO: 5048768 - DNA, 19 bp, Homo sapiens
attgggtgtgccctggctc

SEQ ID NO: 5048769 - DNA, 15 bp, Homo sapiens
caaaatcacagcacc

SEQ ID NO: 5048770 - DNA, 15 bp, Homo sapiens
caaacaattctgatg

SEQ ID NO: 5048771 - DNA, 16 bp, Homo sapiens
caaacaattctgatga

SEQ ID NO: 5048772 - DNA, 21 bp, Homo sapiens
caaaggaaaaagcacaagaag

SEQ ID NO: 5048773 - DNA, 22 bp, Homo sapiens
caaaggaaaaagcacaagaagc

SEQ ID NO: 5048774 - DNA, 17 bp, Homo sapiens
caaagtgccttctgagc

SEQ ID NO: 5048775 - DNA, 19 bp, Homo sapiens
caaatgcagcaatcccact

SEQ ID NO: 5048776 - DNA, 20 bp, Homo sapiens
caaatgcagcaatcccactt

SEQ ID NO: 5048777 - DNA, 18 bp, Homo sapiens
caaatgtttacagggagc

SEQ ID NO: 5048778 - DNA, 14 bp, Homo sapiens
caacaccagcccct

SEQ ID NO: 5048779 - DNA, 17 bp, Homo sapiens
caacagtgttctgagcc

SEQ ID NO: 5048780 - DNA, 18 bp, Homo sapiens
caacagtgttctgagccc

SEQ ID NO: 5048781 - DNA, 21 bp, Homo sapiens
caaccacacacacctgtctgt

SEQ ID NO: 5048782 - DNA, 14 bp, Homo sapiens
caacccatgccctg

SEQ ID NO: 5048783 - DNA, 15 bp, Homo sapiens
caaccccagccgctc

SEQ ID NO: 5048784 - DNA, 10 bp, Homo sapiens
caacccctga

SEQ ID NO: 5048785 - DNA, 12 bp, Homo sapiens
caacccctgagg

SEQ ID NO: 5048786 - DNA, 19 bp, Homo sapiens
caactccaaacaattctga

SEQ ID NO: 5048787 - DNA, 23 bp, Homo sapiens
caactcgggagcattctgcctgc

SEQ ID NO: 5048788 - DNA, 20 bp, Homo sapiens
caagaagatcacgctccccg

SEQ ID NO: 5048789 - DNA, 21 bp, Homo sapiens
caagaagatcacgctccccgc

SEQ ID NO: 5048790 - DNA, 19 bp, Homo sapiens
caagatgatccttcttaga

SEQ ID NO: 5048791 - DNA, 19 bp, Homo sapiens
caagcccttccctctgttg

SEQ ID NO: 5048792 - DNA, 12 bp, Homo sapiens
caagcctggagc

SEQ ID NO: 5048793 - DNA, 17 bp, Homo sapiens
caagcttaaggagagga

SEQ ID NO: 5048794 - DNA, 19 bp, Homo sapiens
caagcttaaggagaggaga

SEQ ID NO: 5048795 - DNA, 21 bp, Homo sapiens
caagcttaaggagaggagagc

SEQ ID NO: 5048796 - DNA, 22 bp, Homo sapiens
caagggtcctacggagggacca

SEQ ID NO: 5048797 - DNA, 15 bp, Homo sapiens
caaggtgggggagcc

SEQ ID NO: 5048798 - DNA, 19 bp, Homo sapiens
caaggtgggggagcctgga

SEQ ID NO: 5048799 - DNA, 21 bp, Homo sapiens
caaggtgggggagcctggagc

SEQ ID NO: 5048800 - DNA, 18 bp, Homo sapiens
caagtctcacatattcat

SEQ ID NO: 5048801 - DNA, 15 bp, Homo sapiens
caagtgatggtcatt

SEQ ID NO: 5048802 - DNA, 13 bp, Homo sapiens
caagttgctctgt

SEQ ID NO: 5048803 - DNA, 14 bp, Homo sapiens
caataaaaaccaaa

SEQ ID NO: 5048804 - DNA, 19 bp, Homo sapiens
caatcccacttagcaggga

SEQ ID NO: 5048805 - DNA, 15 bp, Homo sapiens
caatgtcctctttga

SEQ ID NO: 5048806 - DNA, 12 bp, Homo sapiens
caattctgatga

SEQ ID NO: 5048807 - DNA, 16 bp, Homo sapiens
cacaaggtggcagcaa

SEQ ID NO: 5048808 - DNA, 18 bp, Homo sapiens
cacaaggtggcagcaagc

SEQ ID NO: 5048809 - DNA, 23 bp, Homo sapiens
cacaagtttacttgtctttgatt

SEQ ID NO: 5048810 - DNA, 15 bp, Homo sapiens
cacaatctacactgc

SEQ ID NO: 5048811 - DNA, 13 bp, Homo sapiens
cacacaaggtgct

SEQ ID NO: 5048812 - DNA, 19 bp, Homo sapiens
cacacaaggtgctcagaca

SEQ ID NO: 5048813 - DNA, 13 bp, Homo sapiens
cacacacacctgt

SEQ ID NO: 5048814 - DNA, 14 bp, Homo sapiens
cacacccagccagc

SEQ ID NO: 5048815 - DNA, 14 bp, Homo sapiens
cacacctgtctgtg

SEQ ID NO: 5048816 - DNA, 15 bp, Homo sapiens
cacacctgtctgtgc

SEQ ID NO: 5048817 - DNA, 16 bp, Homo sapiens
cacacctgtctgtgca

SEQ ID NO: 5048818 - DNA, 23 bp, Homo sapiens
cacacctgtctgtgcagatgctt

SEQ ID NO: 5048819 - DNA, 22 bp, Homo sapiens
cacagagtgtggtccctccact

SEQ ID NO: 5048820 - DNA, 13 bp, Homo sapiens
cacagcacccact

SEQ ID NO: 5048821 - DNA, 12 bp, Homo sapiens
cacaggcctccc

SEQ ID NO: 5048822 - DNA, 13 bp, Homo sapiens
cacatgcccgctg

SEQ ID NO: 5048823 - DNA, 18 bp, Homo sapiens
cacatgctgagtctccca

SEQ ID NO: 5048824 - DNA, 22 bp, Homo sapiens
cacatgctgagtctcccaaggc

SEQ ID NO: 5048825 - DNA, 14 bp, Homo sapiens
caccagcccctgcc

SEQ ID NO: 5048826 - DNA, 16 bp, Homo sapiens
caccagcccctgcccc

SEQ ID NO: 5048827 - DNA, 17 bp, Homo sapiens
caccagcccctgcccca

SEQ ID NO: 5048828 - DNA, 14 bp, Homo sapiens
caccattcctggaa

SEQ ID NO: 5048829 - DNA, 23 bp, Homo sapiens
cacccactaccatacagacagca

SEQ ID NO: 5048830 - DNA, 16 bp, Homo sapiens
caccctcctagcctgc

SEQ ID NO: 5048831 - DNA, 22 bp, Homo sapiens
caccctcctagcctgctctgcc

SEQ ID NO: 5048832 - DNA, 23 bp, Homo sapiens
caccctcctagcctgctctgcca

SEQ ID NO: 5048833 - DNA, 19 bp, Homo sapiens
caccgccgactttgtaccc

SEQ ID NO: 5048834 - DNA, 15 bp, Homo sapiens
cacctctctgcctgt

SEQ ID NO: 5048835 - DNA, 16 bp, Homo sapiens
cacctctgggccctgc

SEQ ID NO: 5048836 - DNA, 19 bp, Homo sapiens
cacctctgggccctgcagg

SEQ ID NO: 5048837 - DNA, 11 bp, Homo sapiens
cacctgcctga

SEQ ID NO: 5048838 - DNA, 11 bp, Homo sapiens
cacctgggctg

SEQ ID NO: 5048839 - DNA, 14 bp, Homo sapiens
cacctgggctggga

SEQ ID NO: 5048840 - DNA, 18 bp, Homo sapiens
cacctgtctgtgcagatg

SEQ ID NO: 5048841 - DNA, 24 bp, Homo sapiens
caccttagggagggactgggatga

SEQ ID NO: 5048842 - DNA, 22 bp, Homo sapiens
cacgaggtggtagctctgagcc

SEQ ID NO: 5048843 - DNA, 23 bp, Homo sapiens
cacgaggtggtagctctgagccc

SEQ ID NO: 5048844 - DNA, 12 bp, Homo sapiens
cacgccctgggg

SEQ ID NO: 5048845 - DNA, 15 bp, Homo sapiens
cactaaccccagctg

SEQ ID NO: 5048846 - DNA, 15 bp, Homo sapiens
cactgcctcatggca

SEQ ID NO: 5048847 - DNA, 18 bp, Homo sapiens
cactgccttaccttcact

SEQ ID NO: 5048848 - DNA, 17 bp, Homo sapiens
cacttaaacaatgtcct

SEQ ID NO: 5048849 - DNA, 14 bp, Homo sapiens
cactttctctctta

SEQ ID NO: 5048850 - DNA, 19 bp, Homo sapiens
cagaattctaggcagcacc

SEQ ID NO: 5048851 - DNA, 15 bp, Homo sapiens
cagagcttcagggct

SEQ ID NO: 5048852 - DNA, 18 bp, Homo sapiens
cagaggagccacctgggc

SEQ ID NO: 5048853 - DNA, 21 bp, Homo sapiens
cagaggagccacctgggctgg

SEQ ID NO: 5048854 - DNA, 19 bp, Homo sapiens
cagaggcagctaaggggca

SEQ ID NO: 5048855 - DNA, 17 bp, Homo sapiens
cagagggacttgagcca

SEQ ID NO: 5048856 - DNA, 15 bp, Homo sapiens
cagagtgtggtccct

SEQ ID NO: 5048857 - DNA, 23 bp, Homo sapiens
cagatctcttgttcgcacaatct

SEQ ID NO: 5048858 - DNA, 20 bp, Homo sapiens
cagatgctttgcccaggctt

SEQ ID NO: 5048859 - DNA, 16 bp, Homo sapiens
cagcaaatgccttttc

SEQ ID NO: 5048860 - DNA, 17 bp, Homo sapiens
cagcaatcccacttagc

SEQ ID NO: 5048861 - DNA, 22 bp, Homo sapiens
cagcacaaggtggcagcaagca

SEQ ID NO: 5048862 - DNA, 13 bp, Homo sapiens
cagcacccactac

SEQ ID NO: 5048863 - DNA, 14 bp, Homo sapiens
cagcaggcagagga

SEQ ID NO: 5048864 - DNA, 23 bp, Homo sapiens
cagcagtcaattaactctccagt

SEQ ID NO: 5048865 - DNA, 14 bp, Homo sapiens
cagccaagagccat

SEQ ID NO: 5048866 - DNA, 21 bp, Homo sapiens
cagccacgaggtggtagctct

SEQ ID NO: 5048867 - DNA, 22 bp, Homo sapiens
cagccacgaggtggtagctctg

SEQ ID NO: 5048868 - DNA, 10 bp, Homo sapiens
cagcccaagt

SEQ ID NO: 5048869 - DNA, 12 bp, Homo sapiens
cagccccaggac

SEQ ID NO: 5048870 - DNA, 13 bp, Homo sapiens
cagcctggacccc

SEQ ID NO: 5048871 - DNA, 17 bp, Homo sapiens
cagcctggacccccagc

SEQ ID NO: 5048872 - DNA, 20 bp, Homo sapiens
cagcggggcctggcgggatg

SEQ ID NO: 5048873 - DNA, 10 bp, Homo sapiens
cagctccccc

SEQ ID NO: 5048874 - DNA, 15 bp, Homo sapiens
cagctccccctgtcc

SEQ ID NO: 5048875 - DNA, 17 bp, Homo sapiens
cagctccccctgtcccc

SEQ ID NO: 5048876 - DNA, 23 bp, Homo sapiens
cagctgggctgttggctgggggc

SEQ ID NO: 5048877 - DNA, 22 bp, Homo sapiens
cagctttgcccaacaccagccc

SEQ ID NO: 5048878 - DNA, 23 bp, Homo sapiens
cagctttgcccaacaccagcccc

SEQ ID NO: 5048879 - DNA, 19 bp, Homo sapiens
caggaatcaaggagcctcc

SEQ ID NO: 5048880 - DNA, 22 bp, Homo sapiens
caggaccaagcttaaggagagg

SEQ ID NO: 5048881 - DNA, 14 bp, Homo sapiens
caggaggcctggga

SEQ ID NO: 5048882 - DNA, 15 bp, Homo sapiens
caggaggcctgggag

SEQ ID NO: 5048883 - DNA, 19 bp, Homo sapiens
caggaggcctgggagggca

SEQ ID NO: 5048884 - DNA, 23 bp, Homo sapiens
caggaggcctgggagggcaaggg

SEQ ID NO: 5048885 - DNA, 19 bp, Homo sapiens
caggattgtacgtgggaga

SEQ ID NO: 5048886 - DNA, 13 bp, Homo sapiens
caggcagaggaga

SEQ ID NO: 5048887 - DNA, 14 bp, Homo sapiens
caggcctccctgtt

SEQ ID NO: 5048888 - DNA, 13 bp, Homo sapiens
caggctgcagcag

SEQ ID NO: 5048889 - DNA, 15 bp, Homo sapiens
caggctgcagcaggc

SEQ ID NO: 5048890 - DNA, 13 bp, Homo sapiens
caggcttctcacc

SEQ ID NO: 5048891 - DNA, 14 bp, Homo sapiens
cagggagcctcctg

SEQ ID NO: 5048892 - DNA, 22 bp, Homo sapiens
cagggctgggcaggtcctgggg

SEQ ID NO: 5048893 - DNA, 17 bp, Homo sapiens
caggggctttggaagct

SEQ ID NO: 5048894 - DNA, 20 bp, Homo sapiens
caggggctttggaagctctg

SEQ ID NO: 5048895 - DNA, 16 bp, Homo sapiens
caggggtctccctgag

SEQ ID NO: 5048896 - DNA, 19 bp, Homo sapiens
caggggtctccctgagcct

SEQ ID NO: 5048897 - DNA, 20 bp, Homo sapiens
caggggtctccctgagcctg

SEQ ID NO: 5048898 - DNA, 21 bp, Homo sapiens
caggggtctccctgagcctgc

SEQ ID NO: 5048899 - DNA, 18 bp, Homo sapiens
caggtcctggggaggctg

SEQ ID NO: 5048900 - DNA, 19 bp, Homo sapiens
caggtcctggggaggctga

SEQ ID NO: 5048901 - DNA, 18 bp, Homo sapiens
caggtgctagggtgcctg

SEQ ID NO: 5048902 - DNA, 18 bp, Homo sapiens
cagtcccccaaccccagc

SEQ ID NO: 5048903 - DNA, 18 bp, Homo sapiens
cagtcctcacatgcccgc

SEQ ID NO: 5048904 - DNA, 15 bp, Homo sapiens
cagtgcctgaacatg

SEQ ID NO: 5048905 - DNA, 16 bp, Homo sapiens
cagtgctggttctcca

SEQ ID NO: 5048906 - DNA, 14 bp, Homo sapiens
cagtgttctgagcc

SEQ ID NO: 5048907 - DNA, 16 bp, Homo sapiens
cagttacctttgctgt

SEQ ID NO: 5048908 - DNA, 13 bp, Homo sapiens
catacagacagca

SEQ ID NO: 5048909 - DNA, 23 bp, Homo sapiens
cataccaggtgctagggtgcctg

SEQ ID NO: 5048910 - DNA, 15 bp, Homo sapiens
catacctcgaacatc

SEQ ID NO: 5048911 - DNA, 23 bp, Homo sapiens
catactgatgccctgaggcactg

SEQ ID NO: 5048912 - DNA, 18 bp, Homo sapiens
catattctcatggctttg

SEQ ID NO: 5048913 - DNA, 18 bp, Homo sapiens
catcaagggtcatggcag

SEQ ID NO: 5048914 - DNA, 20 bp, Homo sapiens
catcaagggtcatggcagtg

SEQ ID NO: 5048915 - DNA, 13 bp, Homo sapiens
catcatctctttt

SEQ ID NO: 5048916 - DNA, 19 bp, Homo sapiens
catcatctcttttcccact

SEQ ID NO: 5048917 - DNA, 15 bp, Homo sapiens
catccagtggggtct

SEQ ID NO: 5048918 - DNA, 23 bp, Homo sapiens
catccagtggggtctcagtccag

SEQ ID NO: 5048919 - DNA, 11 bp, Homo sapiens
catctctgctg

SEQ ID NO: 5048920 - DNA, 13 bp, Homo sapiens
catctctgctgct

SEQ ID NO: 5048921 - DNA, 16 bp, Homo sapiens
catctcttttcccact

SEQ ID NO: 5048922 - DNA, 18 bp, Homo sapiens
catctcttttcccactcc

SEQ ID NO: 5048923 - DNA, 22 bp, Homo sapiens
catctcttttcccactcccttt

SEQ ID NO: 5048924 - DNA, 23 bp, Homo sapiens
catctcttttcccactccctttg

SEQ ID NO: 5048925 - DNA, 17 bp, Homo sapiens
catctgaagccacctct

SEQ ID NO: 5048926 - DNA, 22 bp, Homo sapiens
catctgaagccacctctctgcc

SEQ ID NO: 5048927 - DNA, 16 bp, Homo sapiens
catctgctctgagacg

SEQ ID NO: 5048928 - DNA, 17 bp, Homo sapiens
catgccaactcgggagc

SEQ ID NO: 5048929 - DNA, 19 bp, Homo sapiens
catgcccgctgtcccaggg

SEQ ID NO: 5048930 - DNA, 21 bp, Homo sapiens
catgcctcgctcagtcagtgc

SEQ ID NO: 5048931 - DNA, 22 bp, Homo sapiens
catgcctcgctcagtcagtgca

SEQ ID NO: 5048932 - DNA, 21 bp, Homo sapiens
catgctgagtctcccaaggct

SEQ ID NO: 5048933 - DNA, 18 bp, Homo sapiens
catggcatcatccattct

SEQ ID NO: 5048934 - DNA, 17 bp, Homo sapiens
catgggggaggctctga

SEQ ID NO: 5048935 - DNA, 12 bp, Homo sapiens
catgtctctgat

SEQ ID NO: 5048936 - DNA, 23 bp, Homo sapiens
catgtgggggaaggccttgctgt

SEQ ID NO: 5048937 - DNA, 17 bp, Homo sapiens
cattcctggaaaccaca

SEQ ID NO: 5048938 - DNA, 21 bp, Homo sapiens
cattcctggaaaccacagtcc

SEQ ID NO: 5048939 - DNA, 15 bp, Homo sapiens
cattctgcctgcctg

SEQ ID NO: 5048940 - DNA, 15 bp, Homo sapiens
cattgtcttgttctg

SEQ ID NO: 5048941 - DNA, 20 bp, Homo sapiens
catttctgatatttgctgga

SEQ ID NO: 5048942 - DNA, 11 bp, Homo sapiens
cattttgtgtg

SEQ ID NO: 5048943 - DNA, 16 bp, Homo sapiens
ccaaacaattctgatg

SEQ ID NO: 5048944 - DNA, 15 bp, Homo sapiens
ccaaactctgtgtca

SEQ ID NO: 5048945 - DNA, 15 bp, Homo sapiens
ccaacaccagcccct

SEQ ID NO: 5048946 - DNA, 16 bp, Homo sapiens
ccaacaccagcccctg

SEQ ID NO: 5048947 - DNA, 14 bp, Homo sapiens
ccaacagagtggtg

SEQ ID NO: 5048948 - DNA, 18 bp, Homo sapiens
ccaacccctgaggaagat

SEQ ID NO: 5048949 - DNA, 19 bp, Homo sapiens
ccaagcccttccctctgtt

SEQ ID NO: 5048950 - DNA, 12 bp, Homo sapiens
ccaagcctggag

SEQ ID NO: 5048951 - DNA, 19 bp, Homo sapiens
ccaagcttaaggagaggag

SEQ ID NO: 5048952 - DNA, 18 bp, Homo sapiens
ccaaggctgcgtctggag

SEQ ID NO: 5048953 - DNA, 19 bp, Homo sapiens
ccaaggctgcgtctggagg

SEQ ID NO: 5048954 - DNA, 20 bp, Homo sapiens
ccaaggctgcgtctggaggg

SEQ ID NO: 5048955 - DNA, 11 bp, Homo sapiens
ccaagggaggc

SEQ ID NO: 5048956 - DNA, 14 bp, Homo sapiens
ccaagtccaaatgt

SEQ ID NO: 5048957 - DNA, 19 bp, Homo sapiens
ccacacacacaaggtgctc

SEQ ID NO: 5048958 - DNA, 14 bp, Homo sapiens
ccacacacacctgt

SEQ ID NO: 5048959 - DNA, 12 bp, Homo sapiens
ccacacccagcc

SEQ ID NO: 5048960 - DNA, 15 bp, Homo sapiens
ccacacccagccagc

SEQ ID NO: 5048961 - DNA, 12 bp, Homo sapiens
ccacaggcctcc

SEQ ID NO: 5048962 - DNA, 18 bp, Homo sapiens
ccacaggcctccctgttt

SEQ ID NO: 5048963 - DNA, 16 bp, Homo sapiens
ccaccattcctggaaa

SEQ ID NO: 5048964 - DNA, 16 bp, Homo sapiens
ccacctctctgcctgt

SEQ ID NO: 5048965 - DNA, 23 bp, Homo sapiens
ccacctctctgcctgttcctccc

SEQ ID NO: 5048966 - DNA, 15 bp, Homo sapiens
ccacctgcctgacca

SEQ ID NO: 5048967 - DNA, 13 bp, Homo sapiens
ccacgccctgggg

SEQ ID NO: 5048968 - DNA, 18 bp, Homo sapiens
ccactaccatacagacag

SEQ ID NO: 5048969 - DNA, 21 bp, Homo sapiens
ccactccctttgcgtcaggag

SEQ ID NO: 5048970 - DNA, 11 bp, Homo sapiens
ccactggcctg

SEQ ID NO: 5048971 - DNA, 16 bp, Homo sapiens
ccactggcctgcccgt

SEQ ID NO: 5048972 - DNA, 21 bp, Homo sapiens
ccactgggacggctcctgctt

SEQ ID NO: 5048973 - DNA, 17 bp, Homo sapiens
ccacttagcagggacag

SEQ ID NO: 5048974 - DNA, 21 bp, Homo sapiens
ccagaggcagctaaggggcag

SEQ ID NO: 5048975 - DNA, 12 bp, Homo sapiens
ccagcccaagtc

SEQ ID NO: 5048976 - DNA, 13 bp, Homo sapiens
ccagcccaagtcc

SEQ ID NO: 5048977 - DNA, 14 bp, Homo sapiens
ccagcccaagtcca

SEQ ID NO: 5048978 - DNA, 22 bp, Homo sapiens
ccagcccctgccccagcccaag

SEQ ID NO: 5048979 - DNA, 16 bp, Homo sapiens
ccagccgctcggaggc

SEQ ID NO: 5048980 - DNA, 18 bp, Homo sapiens
ccagctccactggcctgc

SEQ ID NO: 5048981 - DNA, 22 bp, Homo sapiens
ccagctccactggcctgcccgt

SEQ ID NO: 5048982 - DNA, 18 bp, Homo sapiens
ccagctgccggcagtgct

SEQ ID NO: 5048983 - DNA, 20 bp, Homo sapiens
ccagctgccggcagtgctgg

SEQ ID NO: 5048984 - DNA, 21 bp, Homo sapiens
ccaggaccaagcttaaggaga

SEQ ID NO: 5048985 - DNA, 22 bp, Homo sapiens
ccaggaccaagcttaaggagag

SEQ ID NO: 5048986 - DNA, 18 bp, Homo sapiens
ccaggccataccaggtgc

SEQ ID NO: 5048987 - DNA, 18 bp, Homo sapiens
ccaggggtctccctgagc

SEQ ID NO: 5048988 - DNA, 15 bp, Homo sapiens
ccaggtgtctagagg

SEQ ID NO: 5048989 - DNA, 16 bp, Homo sapiens
ccagtcccccaacccc

SEQ ID NO: 5048990 - DNA, 18 bp, Homo sapiens
ccagttacctttgctgtc

SEQ ID NO: 5048991 - DNA, 20 bp, Homo sapiens
ccagttacctttgctgtcac

SEQ ID NO: 5048992 - DNA, 18 bp, Homo sapiens
ccatctctccctcctggt

SEQ ID NO: 5048993 - DNA, 21 bp, Homo sapiens
ccatctctgctgcttctgggc

SEQ ID NO: 5048994 - DNA, 11 bp, Homo sapiens
ccatgccctgc

SEQ ID NO: 5048995 - DNA, 12 bp, Homo sapiens
ccatgccctgcc

SEQ ID NO: 5048996 - DNA, 20 bp, Homo sapiens
ccatggtacccccttctggg

SEQ ID NO: 5048997 - DNA, 14 bp, Homo sapiens
ccattctctctgcc

SEQ ID NO: 5048998 - DNA, 16 bp, Homo sapiens
ccattgtcttgttctg

SEQ ID NO: 5048999 - DNA, 17 bp, Homo sapiens
ccattgtcttgttctgt

SEQ ID NO: 5049000 - DNA, 16 bp, Homo sapiens
cccaacaccagcccct

SEQ ID NO: 5049001 - DNA, 22 bp, Homo sapiens
cccaaccccagccgctcggagg

SEQ ID NO: 5049002 - DNA, 21 bp, Homo sapiens
cccaaggctgcgtctggaggg

SEQ ID NO: 5049003 - DNA, 12 bp, Homo sapiens
cccaagtccaaa

SEQ ID NO: 5049004 - DNA, 21 bp, Homo sapiens
cccacagagtgtggtccctcc

SEQ ID NO: 5049005 - DNA, 15 bp, Homo sapiens
cccacatccagtggg

SEQ ID NO: 5049006 - DNA, 13 bp, Homo sapiens
cccacctctgagg

SEQ ID NO: 5049007 - DNA, 15 bp, Homo sapiens
cccacctctgaggac

SEQ ID NO: 5049008 - DNA, 16 bp, Homo sapiens
cccacctctgaggact

SEQ ID NO: 5049009 - DNA, 13 bp, Homo sapiens
cccagcccaagtc

SEQ ID NO: 5049010 - DNA, 20 bp, Homo sapiens
cccagctgccggcagtgctg

SEQ ID NO: 5049011 - DNA, 18 bp, Homo sapiens
cccagctttgcccaacac

SEQ ID NO: 5049012 - DNA, 23 bp, Homo sapiens
cccaggattgtacgtgggagagg

SEQ ID NO: 5049013 - DNA, 13 bp, Homo sapiens
cccaggcttctca

SEQ ID NO: 5049014 - DNA, 20 bp, Homo sapiens
cccagtcccccaaccccagc

SEQ ID NO: 5049015 - DNA, 15 bp, Homo sapiens
cccatctctgctgct

SEQ ID NO: 5049016 - DNA, 13 bp, Homo sapiens
ccccagcccaagt

SEQ ID NO: 5049017 - DNA, 20 bp, Homo sapiens
ccccagctgccggcagtgct

SEQ ID NO: 5049018 - DNA, 13 bp, Homo sapiens
ccccagctttgcc

SEQ ID NO: 5049019 - DNA, 17 bp, Homo sapiens
ccccatctctgctgctt

SEQ ID NO: 5049020 - DNA, 20 bp, Homo sapiens
ccccatctctgctgcttctg

SEQ ID NO: 5049021 - DNA, 16 bp, Homo sapiens
cccccaacccctgagg

SEQ ID NO: 5049022 - DNA, 18 bp, Homo sapiens
cccccagctttgcccaac

SEQ ID NO: 5049023 - DNA, 12 bp, Homo sapiens
ccccctgtcccc

SEQ ID NO: 5049024 - DNA, 14 bp, Homo sapiens
cccccttctgggca

SEQ ID NO: 5049025 - DNA, 18 bp, Homo sapiens
cccctagtatctggctgg

SEQ ID NO: 5049026 - DNA, 12 bp, Homo sapiens
cccctcagctcc

SEQ ID NO: 5049027 - DNA, 23 bp, Homo sapiens
cccctgtgtgggagggcgaggcg

SEQ ID NO: 5049028 - DNA, 23 bp, Homo sapiens
ccccttctgggcatctgttctgg

SEQ ID NO: 5049029 - DNA, 16 bp, Homo sapiens
cccgctgtcccagggg

SEQ ID NO: 5049030 - DNA, 17 bp, Homo sapiens
ccctagtatctggctgg

SEQ ID NO: 5049031 - DNA, 12 bp, Homo sapiens
ccctcagctcca

SEQ ID NO: 5049032 - DNA, 23 bp, Homo sapiens
ccctcctagcctgctctgccact

SEQ ID NO: 5049033 - DNA, 18 bp, Homo sapiens
ccctccttcttgccctga

SEQ ID NO: 5049034 - DNA, 22 bp, Homo sapiens
ccctgagctttccggggaggag

SEQ ID NO: 5049035 - DNA, 18 bp, Homo sapiens
ccctgcaggaggcctggg

SEQ ID NO: 5049036 - DNA, 17 bp, Homo sapiens
ccctgccaagcctggag

SEQ ID NO: 5049037 - DNA, 18 bp, Homo sapiens
ccctgccaagcctggagc

SEQ ID NO: 5049038 - DNA, 21 bp, Homo sapiens
ccctgccaagcctggagcccc

SEQ ID NO: 5049039 - DNA, 19 bp, Homo sapiens
ccctgccccagcccaagtc

SEQ ID NO: 5049040 - DNA, 12 bp, Homo sapiens
ccctgcttctcc

SEQ ID NO: 5049041 - DNA, 15 bp, Homo sapiens
ccctgcttctccagc

SEQ ID NO: 5049042 - DNA, 17 bp, Homo sapiens
ccctgcttctccagcct

SEQ ID NO: 5049043 - DNA, 14 bp, Homo sapiens
ccctggctcccaag

SEQ ID NO: 5049044 - DNA, 15 bp, Homo sapiens
ccctggctcccaagg

SEQ ID NO: 5049045 - DNA, 11 bp, Homo sapiens
ccctgggccag

SEQ ID NO: 5049046 - DNA, 17 bp, Homo sapiens
ccctgggccagcccagg

SEQ ID NO: 5049047 - DNA, 13 bp, Homo sapiens
ccctgtcccctca

SEQ ID NO: 5049048 - DNA, 18 bp, Homo sapiens
ccctgtcccctcagctcc

SEQ ID NO: 5049049 - DNA, 16 bp, Homo sapiens
ccctgtgtgggagggc

SEQ ID NO: 5049050 - DNA, 23 bp, Homo sapiens
ccctgtgttggggggcaaggtgg

SEQ ID NO: 5049051 - DNA, 13 bp, Homo sapiens
ccgccgcttttct

SEQ ID NO: 5049052 - DNA, 17 bp, Homo sapiens
ccgcctgttcccccgcc

SEQ ID NO: 5049053 - DNA, 16 bp, Homo sapiens
ccgctcggaggcccca

SEQ ID NO: 5049054 - DNA, 22 bp, Homo sapiens
ccgctcggaggccccaaaggaa

SEQ ID NO: 5049055 - DNA, 23 bp, Homo sapiens
ccgctcggaggccccaaaggaaa

SEQ ID NO: 5049056 - DNA, 15 bp, Homo sapiens
ccgctgtcccagggg

SEQ ID NO: 5049057 - DNA, 17 bp, Homo sapiens
ccgctgtcccaggggtc

SEQ ID NO: 5049058 - DNA, 23 bp, Homo sapiens
ccggcactgggtttgctccctga

SEQ ID NO: 5049059 - DNA, 17 bp, Homo sapiens
ccggggaggagccttgg

SEQ ID NO: 5049060 - DNA, 18 bp, Homo sapiens
ccgttgccgggcctggac

SEQ ID NO: 5049061 - DNA, 20 bp, Homo sapiens
ccgttgccgggcctggactg

SEQ ID NO: 5049062 - DNA, 15 bp, Homo sapiens
cctagcctgctctgc

SEQ ID NO: 5049063 - DNA, 16 bp, Homo sapiens
cctagcctgctctgcc

SEQ ID NO: 5049064 - DNA, 18 bp, Homo sapiens
cctagcctgctctgccac

SEQ ID NO: 5049065 - DNA, 16 bp, Homo sapiens
cctcaatacccctagt

SEQ ID NO: 5049066 - DNA, 15 bp, Homo sapiens
cctcacatgcccgct

SEQ ID NO: 5049067 - DNA, 13 bp, Homo sapiens
cctcactgcctca

SEQ ID NO: 5049068 - DNA, 13 bp, Homo sapiens
cctccagccaaga

SEQ ID NO: 5049069 - DNA, 15 bp, Homo sapiens
cctcccaagaggcca

SEQ ID NO: 5049070 - DNA, 20 bp, Homo sapiens
cctccgttcccacctctgag

SEQ ID NO: 5049071 - DNA, 18 bp, Homo sapiens
cctcctagcctgctctgc

SEQ ID NO: 5049072 - DNA, 16 bp, Homo sapiens
cctccttcttgccctg

SEQ ID NO: 5049073 - DNA, 20 bp, Homo sapiens
cctcgctcagtcagtgcact

SEQ ID NO: 5049074 - DNA, 13 bp, Homo sapiens
cctctctgcctgt

SEQ ID NO: 5049075 - DNA, 22 bp, Homo sapiens
cctctctttgttctcagctccc

SEQ ID NO: 5049076 - DNA, 23 bp, Homo sapiens
cctctttcctctctttgttctca

SEQ ID NO: 5049077 - DNA, 12 bp, Homo sapiens
cctgagcctgcc

SEQ ID NO: 5049078 - DNA, 15 bp, Homo sapiens
cctgagcctgcccca

SEQ ID NO: 5049079 - DNA, 21 bp, Homo sapiens
cctgagctttccggggaggag

SEQ ID NO: 5049080 - DNA, 14 bp, Homo sapiens
cctgatggagagga

SEQ ID NO: 5049081 - DNA, 15 bp, Homo sapiens
cctgatggagaggag

SEQ ID NO: 5049082 - DNA, 16 bp, Homo sapiens
cctgatggagaggaga

SEQ ID NO: 5049083 - DNA, 16 bp, Homo sapiens
cctgattaaagtgcct

SEQ ID NO: 5049084 - DNA, 13 bp, Homo sapiens
cctgcaggaggcc

SEQ ID NO: 5049085 - DNA, 19 bp, Homo sapiens
cctgcaggaggcctgggag

SEQ ID NO: 5049086 - DNA, 23 bp, Homo sapiens
cctgcaggaggcctgggagggca

SEQ ID NO: 5049087 - DNA, 18 bp, Homo sapiens
cctgccaagcctggagcc

SEQ ID NO: 5049088 - DNA, 12 bp, Homo sapiens
cctgcccagtcc

SEQ ID NO: 5049089 - DNA, 22 bp, Homo sapiens
cctgcccagtcccccaacccca

SEQ ID NO: 5049090 - DNA, 19 bp, Homo sapiens
cctgccccagcccaagtcc

SEQ ID NO: 5049091 - DNA, 16 bp, Homo sapiens
cctgccccagctgggc

SEQ ID NO: 5049092 - DNA, 21 bp, Homo sapiens
cctgcccgttgccgggcctgg

SEQ ID NO: 5049093 - DNA, 19 bp, Homo sapiens
cctgctctccttgccctgg

SEQ ID NO: 5049094 - DNA, 13 bp, Homo sapiens
cctgctctgccac

SEQ ID NO: 5049095 - DNA, 20 bp, Homo sapiens
cctgcttttggggctcttga

SEQ ID NO: 5049096 - DNA, 15 bp, Homo sapiens
cctggaaaccacagt

SEQ ID NO: 5049097 - DNA, 20 bp, Homo sapiens
cctggagcccctgtgtggga

SEQ ID NO: 5049098 - DNA, 22 bp, Homo sapiens
cctggagcccctgtgtgggagg

SEQ ID NO: 5049099 - DNA, 13 bp, Homo sapiens
cctggcgggatgg

SEQ ID NO: 5049100 - DNA, 19 bp, Homo sapiens
cctggcgggatgggccacc

SEQ ID NO: 5049101 - DNA, 15 bp, Homo sapiens
cctgggctgggagaa

SEQ ID NO: 5049102 - DNA, 16 bp, Homo sapiens
cctgggctgggagaag

SEQ ID NO: 5049103 - DNA, 21 bp, Homo sapiens
cctgggctgggagaaggtgct

SEQ ID NO: 5049104 - DNA, 18 bp, Homo sapiens
cctggggaggctgagact

SEQ ID NO: 5049105 - DNA, 18 bp, Homo sapiens
cctggggagtgagcttgg

SEQ ID NO: 5049106 - DNA, 22 bp, Homo sapiens
cctggggtgggtttagcaggct

SEQ ID NO: 5049107 - DNA, 15 bp, Homo sapiens
cctgtcccctcagct

SEQ ID NO: 5049108 - DNA, 17 bp, Homo sapiens
cctgtcccctcagctcc

SEQ ID NO: 5049109 - DNA, 15 bp, Homo sapiens
cctgtgtgggagggc

SEQ ID NO: 5049110 - DNA, 17 bp, Homo sapiens
cctgtgttggggggcaa

SEQ ID NO: 5049111 - DNA, 12 bp, Homo sapiens
cctgttcctccc

SEQ ID NO: 5049112 - DNA, 14 bp, Homo sapiens
cctgttctgtagga

SEQ ID NO: 5049113 - DNA, 17 bp, Homo sapiens
ccttaccttcacttaaa

SEQ ID NO: 5049114 - DNA, 12 bp, Homo sapiens
ccttccctctgt

SEQ ID NO: 5049115 - DNA, 19 bp, Homo sapiens
ccttctgggcatctgttct

SEQ ID NO: 5049116 - DNA, 12 bp, Homo sapiens
ccttcttgccct

SEQ ID NO: 5049117 - DNA, 13 bp, Homo sapiens
ccttcttgccctg

SEQ ID NO: 5049118 - DNA, 14 bp, Homo sapiens
ccttcttgccctga

SEQ ID NO: 5049119 - DNA, 11 bp, Homo sapiens
ccttgccctgg

SEQ ID NO: 5049120 - DNA, 15 bp, Homo sapiens
ccttgccctgggcca

SEQ ID NO: 5049121 - DNA, 13 bp, Homo sapiens
ccttgtctgagat

SEQ ID NO: 5049122 - DNA, 22 bp, Homo sapiens
cctttgctgtcactttctctct

SEQ ID NO: 5049123 - DNA, 23 bp, Homo sapiens
cctttgctgtcactttctctctt

SEQ ID NO: 5049124 - DNA, 14 bp, Homo sapiens
ccttttccatcatc

SEQ ID NO: 5049125 - DNA, 18 bp, Homo sapiens
cgaggcctagagtggcag

SEQ ID NO: 5049126 - DNA, 19 bp, Homo sapiens
cgaggcctagagtggcagc

SEQ ID NO: 5049127 - DNA, 18 bp, Homo sapiens
cgaggcgggggagcctgg

SEQ ID NO: 5049128 - DNA, 19 bp, Homo sapiens
cgaggcgggggagcctgga

SEQ ID NO: 5049129 - DNA, 21 bp, Homo sapiens
cgaggcgggggatcctggagc

SEQ ID NO: 5049130 - DNA, 18 bp, Homo sapiens
cgagggaggggaggtggc

SEQ ID NO: 5049131 - DNA, 16 bp, Homo sapiens
cgaggtggtagctctg

SEQ ID NO: 5049132 - DNA, 16 bp, Homo sapiens
cgccaccattcctgga

SEQ ID NO: 5049133 - DNA, 13 bp, Homo sapiens
cgcccctggggtg

SEQ ID NO: 5049134 - DNA, 21 bp, Homo sapiens
cgcctgttcccccgccgcttt

SEQ ID NO: 5049135 - DNA, 17 bp, Homo sapiens
cgccttccgctcccacc

SEQ ID NO: 5049136 - DNA, 16 bp, Homo sapiens
cgctccccgcctgttc

SEQ ID NO: 5049137 - DNA, 18 bp, Homo sapiens
cgctccccgcctgttccc

SEQ ID NO: 5049138 - DNA, 15 bp, Homo sapiens
cgctcggaggcccca

SEQ ID NO: 5049139 - DNA, 14 bp, Homo sapiens
cggaggccccaaag

SEQ ID NO: 5049140 - DNA, 18 bp, Homo sapiens
cggaggccccaaaggaaa

SEQ ID NO: 5049141 - DNA, 22 bp, Homo sapiens
cggagggaccaggtgtctagag

SEQ ID NO: 5049142 - DNA, 19 bp, Homo sapiens
cggcagtgctggttctcca

SEQ ID NO: 5049143 - DNA, 23 bp, Homo sapiens
cgggagcattctgcctgcctggg

SEQ ID NO: 5049144 - DNA, 18 bp, Homo sapiens
cgggatattaaacctctt

SEQ ID NO: 5049145 - DNA, 21 bp, Homo sapiens
cgggcctggactgtcctaggt

SEQ ID NO: 5049146 - DNA, 13 bp, Homo sapiens
cgggggagcctgg

SEQ ID NO: 5049147 - DNA, 15 bp, Homo sapiens
cgggggagcctggag

SEQ ID NO: 5049148 - DNA, 19 bp, Homo sapiens
cgggggagcctggagcccc

SEQ ID NO: 5049149 - DNA, 16 bp, Homo sapiens
cgggggatcctggagc

SEQ ID NO: 5049150 - DNA, 18 bp, Homo sapiens
cgggggatcctggagccc

SEQ ID NO: 5049151 - DNA, 15 bp, Homo sapiens
cggggggcgagggag

SEQ ID NO: 5049152 - DNA, 17 bp, Homo sapiens
cggtaggtgctggcctc

SEQ ID NO: 5049153 - DNA, 14 bp, Homo sapiens
cgtaggggaggggt

SEQ ID NO: 5049154 - DNA, 23 bp, Homo sapiens
cgtaggggaggggttgccacagg

SEQ ID NO: 5049155 - DNA, 11 bp, Homo sapiens
cgtcaggagca

SEQ ID NO: 5049156 - DNA, 14 bp, Homo sapiens
cgtcaggagcagca

SEQ ID NO: 5049157 - DNA, 20 bp, Homo sapiens
cgtcaggagcagcatcattc

SEQ ID NO: 5049158 - DNA, 21 bp, Homo sapiens
cgtgagacgccaccattcctg

SEQ ID NO: 5049159 - DNA, 18 bp, Homo sapiens
cgttgccgggcctggact

SEQ ID NO: 5049160 - DNA, 16 bp, Homo sapiens
ctaaccccagctgccg

SEQ ID NO: 5049161 - DNA, 18 bp, Homo sapiens
ctaacctcactgcctcat

SEQ ID NO: 5049162 - DNA, 14 bp, Homo sapiens
ctaactaattctgt

SEQ ID NO: 5049163 - DNA, 17 bp, Homo sapiens
ctaaggggcaggaatca

SEQ ID NO: 5049164 - DNA, 22 bp, Homo sapiens
ctaaggggcaggaatcaaggag

SEQ ID NO: 5049165 - DNA, 23 bp, Homo sapiens
ctaaggggcaggaatcaaggagc

SEQ ID NO: 5049166 - DNA, 14 bp, Homo sapiens
ctaattctgtcatt

SEQ ID NO: 5049167 - DNA, 14 bp, Homo sapiens
ctacacctctgggc

SEQ ID NO: 5049168 - DNA, 12 bp, Homo sapiens
ctacactgcctt

SEQ ID NO: 5049169 - DNA, 15 bp, Homo sapiens
ctacggagggaccag

SEQ ID NO: 5049170 - DNA, 14 bp, Homo sapiens
ctagagtggcagcc

SEQ ID NO: 5049171 - DNA, 12 bp, Homo sapiens
ctagcctgctct

SEQ ID NO: 5049172 - DNA, 19 bp, Homo sapiens
ctagctaactaattctgtc

SEQ ID NO: 5049173 - DNA, 15 bp, Homo sapiens
ctagggtgaacaatc

SEQ ID NO: 5049174 - DNA, 14 bp, Homo sapiens
ctagtatctggctg

SEQ ID NO: 5049175 - DNA, 22 bp, Homo sapiens
ctcaaccacacacacctgtctg

SEQ ID NO: 5049176 - DNA, 18 bp, Homo sapiens
ctcaaggtggctggagat

SEQ ID NO: 5049177 - DNA, 17 bp, Homo sapiens
ctcacatattcatcagc

SEQ ID NO: 5049178 - DNA, 15 bp, Homo sapiens
ctcacatgcccgctg

SEQ ID NO: 5049179 - DNA, 22 bp, Homo sapiens
ctcacatgcccgctgtcccagg

SEQ ID NO: 5049180 - DNA, 23 bp, Homo sapiens
ctcacatgcccgctgtcccaggg

SEQ ID NO: 5049181 - DNA, 22 bp, Homo sapiens
ctcaccctcctagcctgctctg

SEQ ID NO: 5049182 - DNA, 23 bp, Homo sapiens
ctcaccctcctagcctgctctgc

SEQ ID NO: 5049183 - DNA, 22 bp, Homo sapiens
ctcagctccagacgtaggggag

SEQ ID NO: 5049184 - DNA, 17 bp, Homo sapiens
ctcagctccccctgtcc

SEQ ID NO: 5049185 - DNA, 18 bp, Homo sapiens
ctcagctccccctgtccc

SEQ ID NO: 5049186 - DNA, 16 bp, Homo sapiens
ctcagtcagtgcacta

SEQ ID NO: 5049187 - DNA, 14 bp, Homo sapiens
ctccacgccctggg

SEQ ID NO: 5049188 - DNA, 13 bp, Homo sapiens
ctccactggcctg

SEQ ID NO: 5049189 - DNA, 20 bp, Homo sapiens
ctccagacgtaggggagggg

SEQ ID NO: 5049190 - DNA, 17 bp, Homo sapiens
ctccaggacttgcttcc

SEQ ID NO: 5049191 - DNA, 23 bp, Homo sapiens
ctccaggacttgcttccaagccc

SEQ ID NO: 5049192 - DNA, 19 bp, Homo sapiens
ctcccaagaggccagggtg

SEQ ID NO: 5049193 - DNA, 23 bp, Homo sapiens
ctcccaaggctgcgtctggaggg

SEQ ID NO: 5049194 - DNA, 12 bp, Homo sapiens
ctccccctgtcc

SEQ ID NO: 5049195 - DNA, 15 bp, Homo sapiens
ctccccgcctgttcc

SEQ ID NO: 5049196 - DNA, 17 bp, Homo sapiens
ctccccgcctgttcccc

SEQ ID NO: 5049197 - DNA, 13 bp, Homo sapiens
ctccctcctggtg

SEQ ID NO: 5049198 - DNA, 12 bp, Homo sapiens
ctccctgagcct

SEQ ID NO: 5049199 - DNA, 20 bp, Homo sapiens
ctccctgattaaagtgcctt

SEQ ID NO: 5049200 - DNA, 22 bp, Homo sapiens
ctccctgattaaagtgccttca

SEQ ID NO: 5049201 - DNA, 23 bp, Homo sapiens
ctccctgtttgaagcctgccctt

SEQ ID NO: 5049202 - DNA, 23 bp, Homo sapiens
ctccctttgcgtcaggagcagca

SEQ ID NO: 5049203 - DNA, 15 bp, Homo sapiens
ctccgttcccacctc

SEQ ID NO: 5049204 - DNA, 13 bp, Homo sapiens
ctcctagcctgct

SEQ ID NO: 5049205 - DNA, 15 bp, Homo sapiens
ctcctccagccaaga

SEQ ID NO: 5049206 - DNA, 22 bp, Homo sapiens
ctcctctttcctctctttgttc

SEQ ID NO: 5049207 - DNA, 14 bp, Homo sapiens
ctcctgcccagtcc

SEQ ID NO: 5049208 - DNA, 15 bp, Homo sapiens
ctcctgcccagtccc

SEQ ID NO: 5049209 - DNA, 20 bp, Homo sapiens
ctcctggtgaagtgtgactt

SEQ ID NO: 5049210 - DNA, 21 bp, Homo sapiens
ctcctggtgaagtgtgacttc

SEQ ID NO: 5049211 - DNA, 16 bp, Homo sapiens
ctccttcttgccctga

SEQ ID NO: 5049212 - DNA, 13 bp, Homo sapiens
ctccttgccctgg

SEQ ID NO: 5049213 - DNA, 23 bp, Homo sapiens
ctcctttcccttttccatcatct

SEQ ID NO: 5049214 - DNA, 18 bp, Homo sapiens
ctcggaggccccaaagga

SEQ ID NO: 5049215 - DNA, 20 bp, Homo sapiens
ctcgggagcattctgcctgc

SEQ ID NO: 5049216 - DNA, 21 bp, Homo sapiens
ctctaaacttccctctagttg

SEQ ID NO: 5049217 - DNA, 13 bp, Homo sapiens
ctctccctcctgg

SEQ ID NO: 5049218 - DNA, 16 bp, Homo sapiens
ctctccctcctggtga

SEQ ID NO: 5049219 - DNA, 17 bp, Homo sapiens
ctctccttgccctgggc

SEQ ID NO: 5049220 - DNA, 18 bp, Homo sapiens
ctctccttgccctgggcc

SEQ ID NO: 5049221 - DNA, 22 bp, Homo sapiens
ctctctgcccaagttgctctgt

SEQ ID NO: 5049222 - DNA, 13 bp, Homo sapiens
ctctctgcctgtt

SEQ ID NO: 5049223 - DNA, 15 bp, Homo sapiens
ctctctgcctgttcc

SEQ ID NO: 5049224 - DNA, 18 bp, Homo sapiens
ctctctttgttctcagct

SEQ ID NO: 5049225 - DNA, 23 bp, Homo sapiens
ctctgagacggatggaaggagag

SEQ ID NO: 5049226 - DNA, 11 bp, Homo sapiens
ctctgagccct

SEQ ID NO: 5049227 - DNA, 19 bp, Homo sapiens
ctctgaggactctggaccc

SEQ ID NO: 5049228 - DNA, 18 bp, Homo sapiens
ctctgattgggtcagctg

SEQ ID NO: 5049229 - DNA, 20 bp, Homo sapiens
ctctgattgggtcagctggc

SEQ ID NO: 5049230 - DNA, 18 bp, Homo sapiens
ctctgcccaagttgctct

SEQ ID NO: 5049231 - DNA, 20 bp, Homo sapiens
ctctgcccaagttgctctgt

SEQ ID NO: 5049232 - DNA, 17 bp, Homo sapiens
ctctgcctgttcctccc

SEQ ID NO: 5049233 - DNA, 19 bp, Homo sapiens
ctctgggccctgcaggagg

SEQ ID NO: 5049234 - DNA, 23 bp, Homo sapiens
ctctgtatgtgttcgtcagtgtt

SEQ ID NO: 5049235 - DNA, 11 bp, Homo sapiens
ctctgtgcttg

SEQ ID NO: 5049236 - DNA, 19 bp, Homo sapiens
ctctgttgcaggtgtccgg

SEQ ID NO: 5049237 - DNA, 19 bp, Homo sapiens
ctctttgttctcagctccc

SEQ ID NO: 5049238 - DNA, 19 bp, Homo sapiens
ctcttttcccactcccttt

SEQ ID NO: 5049239 - DNA, 16 bp, Homo sapiens
ctgaagccacctctct

SEQ ID NO: 5049240 - DNA, 21 bp, Homo sapiens
ctgaagccacctctctgcctg

SEQ ID NO: 5049241 - DNA, 19 bp, Homo sapiens
ctgaataccccttctctgt

SEQ ID NO: 5049242 - DNA, 19 bp, Homo sapiens
ctgaccatcccatgagcag

SEQ ID NO: 5049243 - DNA, 15 bp, Homo sapiens
ctgagactgcagagg

SEQ ID NO: 5049244 - DNA, 19 bp, Homo sapiens
ctgagactgcagaggagcc

SEQ ID NO: 5049245 - DNA, 22 bp, Homo sapiens
ctgagagcatgtgggggaaggc

SEQ ID NO: 5049246 - DNA, 20 bp, Homo sapiens
ctgagcccccacctgcctga

SEQ ID NO: 5049247 - DNA, 23 bp, Homo sapiens
ctgagcctgccccagctgggctg

SEQ ID NO: 5049248 - DNA, 20 bp, Homo sapiens
ctgagctttccggggaggag

SEQ ID NO: 5049249 - DNA, 22 bp, Homo sapiens
ctgatgaaaacaaaatcacagc

SEQ ID NO: 5049250 - DNA, 13 bp, Homo sapiens
ctgatggagagga

SEQ ID NO: 5049251 - DNA, 15 bp, Homo sapiens
ctgatggagaggaga

SEQ ID NO: 5049252 - DNA, 17 bp, Homo sapiens
ctgatggagaggagaac

SEQ ID NO: 5049253 - DNA, 21 bp, Homo sapiens
ctgcagaggagccacctgggc

SEQ ID NO: 5049254 - DNA, 18 bp, Homo sapiens
ctgcagcaggcagaggag

SEQ ID NO: 5049255 - DNA, 16 bp, Homo sapiens
ctgcaggaggcctggg

SEQ ID NO: 5049256 - DNA, 17 bp, Homo sapiens
ctgccaagcctggagcc

SEQ ID NO: 5049257 - DNA, 21 bp, Homo sapiens
ctgccaagcctggagcccctg

SEQ ID NO: 5049258 - DNA, 20 bp, Homo sapiens
ctgccactgggacggctcct

SEQ ID NO: 5049259 - DNA, 14 bp, Homo sapiens
ctgcccagtccccc

SEQ ID NO: 5049260 - DNA, 14 bp, Homo sapiens
ctgccccacaccca

SEQ ID NO: 5049261 - DNA, 18 bp, Homo sapiens
ctgccccagctgggctgt

SEQ ID NO: 5049262 - DNA, 20 bp, Homo sapiens
ctgcccgttgccgggcctgg

SEQ ID NO: 5049263 - DNA, 23 bp, Homo sapiens
ctgcccgttgccgggcctggact

SEQ ID NO: 5049264 - DNA, 14 bp, Homo sapiens
ctgccggcagtgct

SEQ ID NO: 5049265 - DNA, 15 bp, Homo sapiens
ctgccggcagtgctg

SEQ ID NO: 5049266 - DNA, 11 bp, Homo sapiens
ctgcctgggaa

SEQ ID NO: 5049267 - DNA, 12 bp, Homo sapiens
ctgcctgggaac

SEQ ID NO: 5049268 - DNA, 15 bp, Homo sapiens
ctgcggtgaggcagg

SEQ ID NO: 5049269 - DNA, 18 bp, Homo sapiens
ctgcggtgaggcagggga

SEQ ID NO: 5049270 - DNA, 23 bp, Homo sapiens
ctgcgtctggaggggcccctgct

SEQ ID NO: 5049271 - DNA, 13 bp, Homo sapiens
ctgctcacttaaa

SEQ ID NO: 5049272 - DNA, 20 bp, Homo sapiens
ctgctcattgtataagcccc

SEQ ID NO: 5049273 - DNA, 17 bp, Homo sapiens
ctgctctccttgccctg

SEQ ID NO: 5049274 - DNA, 19 bp, Homo sapiens
ctgctctccttgccctggg

SEQ ID NO: 5049275 - DNA, 20 bp, Homo sapiens
ctgctctccttgccctgggc

SEQ ID NO: 5049276 - DNA, 22 bp, Homo sapiens
ctgctctccttgccctgggcca

SEQ ID NO: 5049277 - DNA, 13 bp, Homo sapiens
ctgctctgagacg

SEQ ID NO: 5049278 - DNA, 12 bp, Homo sapiens
ctgctctgccac

SEQ ID NO: 5049279 - DNA, 17 bp, Homo sapiens
ctgctgcttctgggcct

SEQ ID NO: 5049280 - DNA, 16 bp, Homo sapiens
ctgcttctccagcctg

SEQ ID NO: 5049281 - DNA, 18 bp, Homo sapiens
ctgcttttggggctcttg

SEQ ID NO: 5049282 - DNA, 20 bp, Homo sapiens
ctgcttttggggctcttgat

SEQ ID NO: 5049283 - DNA, 19 bp, Homo sapiens
ctggaagaaagccctgtgc

SEQ ID NO: 5049284 - DNA, 14 bp, Homo sapiens
ctggactgtcctag

SEQ ID NO: 5049285 - DNA, 16 bp, Homo sapiens
ctggagcccctgtgtg

SEQ ID NO: 5049286 - DNA, 20 bp, Homo sapiens
ctggagcccctgtgtgggag

SEQ ID NO: 5049287 - DNA, 16 bp, Homo sapiens
ctggagcccctgtgtt

SEQ ID NO: 5049288 - DNA, 12 bp, Homo sapiens
ctggaggggccc

SEQ ID NO: 5049289 - DNA, 15 bp, Homo sapiens
ctggaggggcccctg

SEQ ID NO: 5049290 - DNA, 17 bp, Homo sapiens
ctggaggggcccctgct

SEQ ID NO: 5049291 - DNA, 13 bp, Homo sapiens
ctggagtgctggc

SEQ ID NO: 5049292 - DNA, 16 bp, Homo sapiens
ctggagtgctggctcc

SEQ ID NO: 5049293 - DNA, 16 bp, Homo sapiens
ctggccagaggcagct

SEQ ID NO: 5049294 - DNA, 15 bp, Homo sapiens
ctggctcccaaggga

SEQ ID NO: 5049295 - DNA, 18 bp, Homo sapiens
ctggctgggttttcaggg

SEQ ID NO: 5049296 - DNA, 14 bp, Homo sapiens
ctgggacggctcct

SEQ ID NO: 5049297 - DNA, 16 bp, Homo sapiens
ctgggacggctcctgc

SEQ ID NO: 5049298 - DNA, 17 bp, Homo sapiens
ctgggacggctcctgct

SEQ ID NO: 5049299 - DNA, 19 bp, Homo sapiens
ctgggagaaggtgcttggg

SEQ ID NO: 5049300 - DNA, 21 bp, Homo sapiens
ctgggagaaggtgcttgggct

SEQ ID NO: 5049301 - DNA, 19 bp, Homo sapiens
ctgggagggcaagggtcct

SEQ ID NO: 5049302 - DNA, 21 bp, Homo sapiens
ctgggcaggtcctggggaggc

SEQ ID NO: 5049303 - DNA, 17 bp, Homo sapiens
ctgggcatctgttctgg

SEQ ID NO: 5049304 - DNA, 15 bp, Homo sapiens
ctgggccctgcagga

SEQ ID NO: 5049305 - DNA, 16 bp, Homo sapiens
ctgggccctgcaggag

SEQ ID NO: 5049306 - DNA, 18 bp, Homo sapiens
ctgggccctgcaggaggc

SEQ ID NO: 5049307 - DNA, 15 bp, Homo sapiens
ctgggcctgatggag

SEQ ID NO: 5049308 - DNA, 21 bp, Homo sapiens
ctgggcctgatggagaggaga

SEQ ID NO: 5049309 - DNA, 22 bp, Homo sapiens
ctgggcctgatggagaggagaa

SEQ ID NO: 5049310 - DNA, 14 bp, Homo sapiens
ctgggctgggagaa

SEQ ID NO: 5049311 - DNA, 16 bp, Homo sapiens
ctgggctgggagaagg

SEQ ID NO: 5049312 - DNA, 17 bp, Homo sapiens
ctgggctgttggctggg

SEQ ID NO: 5049313 - DNA, 12 bp, Homo sapiens
ctggggaaggac

SEQ ID NO: 5049314 - DNA, 16 bp, Homo sapiens
ctggggaaggaccaac

SEQ ID NO: 5049315 - DNA, 15 bp, Homo sapiens
ctggggaggctgaga

SEQ ID NO: 5049316 - DNA, 21 bp, Homo sapiens
ctgggggcatgggggaggctc

SEQ ID NO: 5049317 - DNA, 14 bp, Homo sapiens
ctgggtttgctccc

SEQ ID NO: 5049318 - DNA, 17 bp, Homo sapiens
ctgggttttcaggggct

SEQ ID NO: 5049319 - DNA, 20 bp, Homo sapiens
ctggtttttaaccattgtct

SEQ ID NO: 5049320 - DNA, 15 bp, Homo sapiens
ctgtaaggactcagt

SEQ ID NO: 5049321 - DNA, 18 bp, Homo sapiens
ctgtaggcgcccctgggg

SEQ ID NO: 5049322 - DNA, 15 bp, Homo sapiens
ctgtcacggaacaga

SEQ ID NO: 5049323 - DNA, 19 bp, Homo sapiens
ctgtctgtgcagatgcttt

SEQ ID NO: 5049324 - DNA, 14 bp, Homo sapiens
ctgtcttgactgtc

SEQ ID NO: 5049325 - DNA, 22 bp, Homo sapiens
ctgtgtcggggggcgagggagg

SEQ ID NO: 5049326 - DNA, 22 bp, Homo sapiens
ctgttctggtttttaaccattg

SEQ ID NO: 5049327 - DNA, 13 bp, Homo sapiens
ctgttctgtagga

SEQ ID NO: 5049328 - DNA, 21 bp, Homo sapiens
ctgttggaaggtagagcccac

SEQ ID NO: 5049329 - DNA, 14 bp, Homo sapiens
cttaaggagaggag

SEQ ID NO: 5049330 - DNA, 20 bp, Homo sapiens
cttagagaaggctcagcctt

SEQ ID NO: 5049331 - DNA, 14 bp, Homo sapiens
cttagcagggacag

SEQ ID NO: 5049332 - DNA, 17 bp, Homo sapiens
cttagcagggacaggag

SEQ ID NO: 5049333 - DNA, 21 bp, Homo sapiens
cttataaattctgttagctgc

SEQ ID NO: 5049334 - DNA, 21 bp, Homo sapiens
cttcagggctgggcaggtcct

SEQ ID NO: 5049335 - DNA, 23 bp, Homo sapiens
cttcctgttggaaggtagagccc

SEQ ID NO: 5049336 - DNA, 23 bp, Homo sapiens
cttcgaattagtttgcacttcct

SEQ ID NO: 5049337 - DNA, 23 bp, Homo sapiens
cttctctgtagctgctagtgagc

SEQ ID NO: 5049338 - DNA, 18 bp, Homo sapiens
cttctgcggtgaggcagg

SEQ ID NO: 5049339 - DNA, 15 bp, Homo sapiens
cttcttgccctgagc

SEQ ID NO: 5049340 - DNA, 17 bp, Homo sapiens
cttgagccagttacctt

SEQ ID NO: 5049341 - DNA, 23 bp, Homo sapiens
cttgagccagttacctttgctgt

SEQ ID NO: 5049342 - DNA, 13 bp, Homo sapiens
cttgccctgagct

SEQ ID NO: 5049343 - DNA, 23 bp, Homo sapiens
cttggatattcaagcctttggat

SEQ ID NO: 5049344 - DNA, 12 bp, Homo sapiens
cttgtctgagat

SEQ ID NO: 5049345 - DNA, 15 bp, Homo sapiens
ctttccggggaggag

SEQ ID NO: 5049346 - DNA, 14 bp, Homo sapiens
ctttctaactcaca

SEQ ID NO: 5049347 - DNA, 16 bp, Homo sapiens
ctttgcccaacaccag

SEQ ID NO: 5049348 - DNA, 17 bp, Homo sapiens
ctttgctgtcactttct

SEQ ID NO: 5049349 - DNA, 20 bp, Homo sapiens
ctttgttctcagctccccct

SEQ ID NO: 5049350 - DNA, 17 bp, Homo sapiens
cttttacatttttctga

SEQ ID NO: 5049351 - DNA, 19 bp, Homo sapiens
cttttacatttttctgatg

SEQ ID NO: 5049352 - DNA, 18 bp, Homo sapiens
cttttcaaatgcagcaat

SEQ ID NO: 5049353 - DNA, 19 bp, Homo sapiens
cttttcaaatgcagcaatc

SEQ ID NO: 5049354 - DNA, 13 bp, Homo sapiens
cttttccatcatc

SEQ ID NO: 5049355 - DNA, 21 bp, Homo sapiens
cttttccatcatctcttttcc

SEQ ID NO: 5049356 - DNA, 17 bp, Homo sapiens
gaaaaattattcccatg

SEQ ID NO: 5049357 - DNA, 23 bp, Homo sapiens
gaaaatgtaaaataaaggctctg

SEQ ID NO: 5049358 - DNA, 17 bp, Homo sapiens
gaaacttcggttgcaga

SEQ ID NO: 5049359 - DNA, 13 bp, Homo sapiens
gaaagccctgtgc

SEQ ID NO: 5049360 - DNA, 17 bp, Homo sapiens
gaaattgggtgtgccct

SEQ ID NO: 5049361 - DNA, 18 bp, Homo sapiens
gaaattgggtgtgccctg

SEQ ID NO: 5049362 - DNA, 20 bp, Homo sapiens
gaaattgggtgtgccctggc

SEQ ID NO: 5049363 - DNA, 18 bp, Homo sapiens
gaacacagatctcttgtt

SEQ ID NO: 5049364 - DNA, 17 bp, Homo sapiens
gaacagatcttgttctt

SEQ ID NO: 5049365 - DNA, 18 bp, Homo sapiens
gaagatcacgctccccgc

SEQ ID NO: 5049366 - DNA, 18 bp, Homo sapiens
gaagatgggggcaagaag

SEQ ID NO: 5049367 - DNA, 16 bp, Homo sapiens
gaagcctgcccttgtc

SEQ ID NO: 5049368 - DNA, 23 bp, Homo sapiens
gaaggaccaacccatgccctgcc

SEQ ID NO: 5049369 - DNA, 14 bp, Homo sapiens
gaatgtgtgtgcag

SEQ ID NO: 5049370 - DNA, 23 bp, Homo sapiens
gacagcacaaggtggcagcaagc

SEQ ID NO: 5049371 - DNA, 24 bp, Homo sapiens
gacagcacaaggtggcagcaagca

SEQ ID NO: 5049372 - DNA, 23 bp, Homo sapiens
gacagctttctaactcacaggca

SEQ ID NO: 5049373 - DNA, 18 bp, Homo sapiens
gaccaagcttaaggagag

SEQ ID NO: 5049374 - DNA, 21 bp, Homo sapiens
gaccaggtgtctagaggcaac

SEQ ID NO: 5049375 - DNA, 22 bp, Homo sapiens
gaccatctctccctcctggtga

SEQ ID NO: 5049376 - DNA, 18 bp, Homo sapiens
gacctttcttttcttaga

SEQ ID NO: 5049377 - DNA, 16 bp, Homo sapiens
gacgagggagtgtctg

SEQ ID NO: 5049378 - DNA, 15 bp, Homo sapiens
gacggatggaaggag

SEQ ID NO: 5049379 - DNA, 15 bp, Homo sapiens
gactgcagaggagcc

SEQ ID NO: 5049380 - DNA, 13 bp, Homo sapiens
gactggccagagg

SEQ ID NO: 5049381 - DNA, 23 bp, Homo sapiens
gactttagggatctggggaagga

SEQ ID NO: 5049382 - DNA, 16 bp, Homo sapiens
gagaaggctcagcctt

SEQ ID NO: 5049383 - DNA, 17 bp, Homo sapiens
gagaaggctcagccttg

SEQ ID NO: 5049384 - DNA, 14 bp, Homo sapiens
gagactgcagagga

SEQ ID NO: 5049385 - DNA, 20 bp, Homo sapiens
gagactggccagaggcagct

SEQ ID NO: 5049386 - DNA, 14 bp, Homo sapiens
gagagactggccag

SEQ ID NO: 5049387 - DNA, 17 bp, Homo sapiens
gagagactggccagagg

SEQ ID NO: 5049388 - DNA, 15 bp, Homo sapiens
gagagcatctgctct

SEQ ID NO: 5049389 - DNA, 14 bp, Homo sapiens
gagaggagagcatc

SEQ ID NO: 5049390 - DNA, 11 bp, Homo sapiens
gagaggcagaa

SEQ ID NO: 5049391 - DNA, 22 bp, Homo sapiens
gagaggttgaggatgcactggc

SEQ ID NO: 5049392 - DNA, 18 bp, Homo sapiens
gagagtacccccctgaga

SEQ ID NO: 5049393 - DNA, 19 bp, Homo sapiens
gagagtacccccctgagag

SEQ ID NO: 5049394 - DNA, 19 bp, Homo sapiens
gagatacccacagagtgtg

SEQ ID NO: 5049395 - DNA, 17 bp, Homo sapiens
gagatggctgctgctca

SEQ ID NO: 5049396 - DNA, 13 bp, Homo sapiens
gagcagtccagag

SEQ ID NO: 5049397 - DNA, 14 bp, Homo sapiens
gagcatctgctctg

SEQ ID NO: 5049398 - DNA, 22 bp, Homo sapiens
gagccacctgggctgggagaag

SEQ ID NO: 5049399 - DNA, 20 bp, Homo sapiens
gagccctccttcttgccctg

SEQ ID NO: 5049400 - DNA, 22 bp, Homo sapiens
gagccctccttcttgccctgag

SEQ ID NO: 5049401 - DNA, 15 bp, Homo sapiens
gagcctcctgcccag

SEQ ID NO: 5049402 - DNA, 17 bp, Homo sapiens
gagcctcctgcccagtc

SEQ ID NO: 5049403 - DNA, 16 bp, Homo sapiens
gagcctgccccagctg

SEQ ID NO: 5049404 - DNA, 17 bp, Homo sapiens
gagctttccggggagga

SEQ ID NO: 5049405 - DNA, 22 bp, Homo sapiens
gagctttccggggaggagcctt

SEQ ID NO: 5049406 - DNA, 21 bp, Homo sapiens
gaggaaacttcggttgcagat

SEQ ID NO: 5049407 - DNA, 21 bp, Homo sapiens
gaggagagcatctgctctgag

SEQ ID NO: 5049408 - DNA, 19 bp, Homo sapiens
gaggcaacagtgttctgag

SEQ ID NO: 5049409 - DNA, 21 bp, Homo sapiens
gaggcaggggagtctgcttgt

SEQ ID NO: 5049410 - DNA, 17 bp, Homo sapiens
gaggcctagagtggcag

SEQ ID NO: 5049411 - DNA, 14 bp, Homo sapiens
gaggcctgggaggg

SEQ ID NO: 5049412 - DNA, 17 bp, Homo sapiens
gaggcgggggagcctgg

SEQ ID NO: 5049413 - DNA, 19 bp, Homo sapiens
gaggcgggggagcctggag

SEQ ID NO: 5049414 - DNA, 18 bp, Homo sapiens
gaggcgggggatcctgga

SEQ ID NO: 5049415 - DNA, 19 bp, Homo sapiens
gaggcgggggatcctggag

SEQ ID NO: 5049416 - DNA, 20 bp, Homo sapiens
gaggcgggggatcctggagc

SEQ ID NO: 5049417 - DNA, 12 bp, Homo sapiens
gaggctctgaag

SEQ ID NO: 5049418 - DNA, 22 bp, Homo sapiens
gagggaccaggtgtctagaggc

SEQ ID NO: 5049419 - DNA, 14 bp, Homo sapiens
gagggaggggaggt

SEQ ID NO: 5049420 - DNA, 15 bp, Homo sapiens
gagggcagttctgca

SEQ ID NO: 5049421 - DNA, 14 bp, Homo sapiens
gagggcgaggcggg

SEQ ID NO: 5049422 - DNA, 22 bp, Homo sapiens
gaggggcccctgcttctccagc

SEQ ID NO: 5049423 - DNA, 18 bp, Homo sapiens
gaggggttgccacaggcc

SEQ ID NO: 5049424 - DNA, 17 bp, Homo sapiens
gaggtggtagctctgag

SEQ ID NO: 5049425 - DNA, 19 bp, Homo sapiens
gaggtggtagctctgagcc

SEQ ID NO: 5049426 - DNA, 20 bp, Homo sapiens
gaggtggtagctctgagccc

SEQ ID NO: 5049427 - DNA, 17 bp, Homo sapiens
gaggttgaggatgcact

SEQ ID NO: 5049428 - DNA, 21 bp, Homo sapiens
gaggttgatttgctctctaaa

SEQ ID NO: 5049429 - DNA, 17 bp, Homo sapiens
gagtgagcttggtgcgg

SEQ ID NO: 5049430 - DNA, 18 bp, Homo sapiens
gagtggcagccaagagcc

SEQ ID NO: 5049431 - DNA, 19 bp, Homo sapiens
gagtggcagccaagagcca

SEQ ID NO: 5049432 - DNA, 17 bp, Homo sapiens
gagttgaccttctgaac

SEQ ID NO: 5049433 - DNA, 15 bp, Homo sapiens
gatattaaacctctt

SEQ ID NO: 5049434 - DNA, 22 bp, Homo sapiens
gatcacgctccccgcctgttcc

SEQ ID NO: 5049435 - DNA, 16 bp, Homo sapiens
gatcctggagcccctg

SEQ ID NO: 5049436 - DNA, 17 bp, Homo sapiens
gatgctggtaatggcca

SEQ ID NO: 5049437 - DNA, 18 bp, Homo sapiens
gatgctttgcccaggctt

SEQ ID NO: 5049438 - DNA, 20 bp, Homo sapiens
gatgctttgcccaggcttct

SEQ ID NO: 5049439 - DNA, 15 bp, Homo sapiens
gattaaagtgccttc

SEQ ID NO: 5049440 - DNA, 16 bp, Homo sapiens
gattgggtcagctggc

SEQ ID NO: 5049441 - DNA, 19 bp, Homo sapiens
gattgtacgtgggagaggc

SEQ ID NO: 5049442 - DNA, 15 bp, Homo sapiens
gcaacagtgttctga

SEQ ID NO: 5049443 - DNA, 19 bp, Homo sapiens
gcaacagtgttctgagccc

SEQ ID NO: 5049444 - DNA, 20 bp, Homo sapiens
gcaacagtgttctgagcccc

SEQ ID NO: 5049445 - DNA, 21 bp, Homo sapiens
gcaaggtgggggagcctggag

SEQ ID NO: 5049446 - DNA, 21 bp, Homo sapiens
gcaatctggaagaaagccctg

SEQ ID NO: 5049447 - DNA, 24 bp, Homo sapiens
gcacaagaagcgtgagacgccacc

SEQ ID NO: 5049448 - DNA, 22 bp, Homo sapiens
gcacatgctgagtctcccaagg

SEQ ID NO: 5049449 - DNA, 21 bp, Homo sapiens
gcagaattctaggcagcacct

SEQ ID NO: 5049450 - DNA, 19 bp, Homo sapiens
gcagaggagccacctgggc

SEQ ID NO: 5049451 - DNA, 21 bp, Homo sapiens
gcagaggagccacctgggctg

SEQ ID NO: 5049452 - DNA, 22 bp, Homo sapiens
gcagatgctttgcccaggcttc

SEQ ID NO: 5049453 - DNA, 23 bp, Homo sapiens
gcagatgctttgcccaggcttct

SEQ ID NO: 5049454 - DNA, 14 bp, Homo sapiens
gcagccaagagcca

SEQ ID NO: 5049455 - DNA, 15 bp, Homo sapiens
gcagccaagagccat

SEQ ID NO: 5049456 - DNA, 15 bp, Homo sapiens
gcagctaaggggcag

SEQ ID NO: 5049457 - DNA, 22 bp, Homo sapiens
gcaggaaggaactcaaggtggc

SEQ ID NO: 5049458 - DNA, 19 bp, Homo sapiens
gcaggaatcaaggagcctc

SEQ ID NO: 5049459 - DNA, 20 bp, Homo sapiens
gcaggaatcaaggagcctcc

SEQ ID NO: 5049460 - DNA, 14 bp, Homo sapiens
gcaggaggcctggg

SEQ ID NO: 5049461 - DNA, 16 bp, Homo sapiens
gcaggaggcctgggag

SEQ ID NO: 5049462 - DNA, 19 bp, Homo sapiens
gcaggaggcctgggagggc

SEQ ID NO: 5049463 - DNA, 15 bp, Homo sapiens
gcaggcagaggagag

SEQ ID NO: 5049464 - DNA, 15 bp, Homo sapiens
gcaggtcctggggag

SEQ ID NO: 5049465 - DNA, 22 bp, Homo sapiens
gcagtccagagcttcagggctg

SEQ ID NO: 5049466 - DNA, 16 bp, Homo sapiens
gcagtgctggttctcc

SEQ ID NO: 5049467 - DNA, 22 bp, Homo sapiens
gcatcattcagcaaatgccttt

SEQ ID NO: 5049468 - DNA, 23 bp, Homo sapiens
gcatcattcagcaaatgcctttt

SEQ ID NO: 5049469 - DNA, 18 bp, Homo sapiens
gcatctgctctgagacgg

SEQ ID NO: 5049470 - DNA, 13 bp, Homo sapiens
gcatctgttctgg

SEQ ID NO: 5049471 - DNA, 17 bp, Homo sapiens
gcatgggggaggctctg

SEQ ID NO: 5049472 - DNA, 18 bp, Homo sapiens
gcatgggggaggctctga

SEQ ID NO: 5049473 - DNA, 16 bp, Homo sapiens
gcatgtgggggaaggc

SEQ ID NO: 5049474 - DNA, 23 bp, Homo sapiens
gcatgtgggggaaggccttgctg

SEQ ID NO: 5049475 - DNA, 16 bp, Homo sapiens
gcattctgcctgcctg

SEQ ID NO: 5049476 - DNA, 15 bp, Homo sapiens
gccaactcgggagca

SEQ ID NO: 5049477 - DNA, 12 bp, Homo sapiens
gccaagcctgga

SEQ ID NO: 5049478 - DNA, 14 bp, Homo sapiens
gccaccattcctgg

SEQ ID NO: 5049479 - DNA, 16 bp, Homo sapiens
gccaccattcctggaa

SEQ ID NO: 5049480 - DNA, 22 bp, Homo sapiens
gccaccattcctggaaaccaca

SEQ ID NO: 5049481 - DNA, 13 bp, Homo sapiens
gccacctctctgc

SEQ ID NO: 5049482 - DNA, 21 bp, Homo sapiens
gccacgaggtggtagctctga

SEQ ID NO: 5049483 - DNA, 21 bp, Homo sapiens
gccactgggacggctcctgct

SEQ ID NO: 5049484 - DNA, 15 bp, Homo sapiens
gccagcccaggattg

SEQ ID NO: 5049485 - DNA, 20 bp, Homo sapiens
gccagctcctttcccttttc

SEQ ID NO: 5049486 - DNA, 20 bp, Homo sapiens
gccaggggtggtgagggcag

SEQ ID NO: 5049487 - DNA, 14 bp, Homo sapiens
gccatggtaccccc

SEQ ID NO: 5049488 - DNA, 18 bp, Homo sapiens
gcccaagttgctctgtat

SEQ ID NO: 5049489 - DNA, 17 bp, Homo sapiens
gcccaggcttctcacca

SEQ ID NO: 5049490 - DNA, 21 bp, Homo sapiens
gcccagtcccccaaccccagc

SEQ ID NO: 5049491 - DNA, 13 bp, Homo sapiens
gccccgaggccta

SEQ ID NO: 5049492 - DNA, 21 bp, Homo sapiens
gcccctgccccagcccaagtc

SEQ ID NO: 5049493 - DNA, 14 bp, Homo sapiens
gcccctgcttctcc

SEQ ID NO: 5049494 - DNA, 16 bp, Homo sapiens
gcccctgcttctccag

SEQ ID NO: 5049495 - DNA, 16 bp, Homo sapiens
gcccctgtgtgggagg

SEQ ID NO: 5049496 - DNA, 17 bp, Homo sapiens
gcccgctgtcccagggg

SEQ ID NO: 5049497 - DNA, 15 bp, Homo sapiens
gccctgccaagcctg

SEQ ID NO: 5049498 - DNA, 16 bp, Homo sapiens
gccctgccaagcctgg

SEQ ID NO: 5049499 - DNA, 17 bp, Homo sapiens
gccctgccaagcctgga

SEQ ID NO: 5049500 - DNA, 22 bp, Homo sapiens
gccctgccaagcctggagcccc

SEQ ID NO: 5049501 - DNA, 11 bp, Homo sapiens
gccctggctcc

SEQ ID NO: 5049502 - DNA, 20 bp, Homo sapiens
gccctggctcccaagggagg

SEQ ID NO: 5049503 - DNA, 23 bp, Homo sapiens
gccctggctcccaagggaggccc

SEQ ID NO: 5049504 - DNA, 19 bp, Homo sapiens
gccctggggagtgagcttg

SEQ ID NO: 5049505 - DNA, 13 bp, Homo sapiens
gccctgtgctttg

SEQ ID NO: 5049506 - DNA, 14 bp, Homo sapiens
gccctgtgctttgg

SEQ ID NO: 5049507 - DNA, 15 bp, Homo sapiens
gcccttccctctgtt

SEQ ID NO: 5049508 - DNA, 21 bp, Homo sapiens
gccgactttgtaccccccaac

SEQ ID NO: 5049509 - DNA, 23 bp, Homo sapiens
gccgactttgtaccccccaaccc

SEQ ID NO: 5049510 - DNA, 22 bp, Homo sapiens
gccgctcggaggccccaaagga

SEQ ID NO: 5049511 - DNA, 14 bp, Homo sapiens
gcctagagtggcag

SEQ ID NO: 5049512 - DNA, 23 bp, Homo sapiens
gcctcaaacagccacgaggtggt

SEQ ID NO: 5049513 - DNA, 22 bp, Homo sapiens
gcctccgttcccacctctgagg

SEQ ID NO: 5049514 - DNA, 15 bp, Homo sapiens
gcctcctgcccagtc

SEQ ID NO: 5049515 - DNA, 14 bp, Homo sapiens
gcctgccccagctg

SEQ ID NO: 5049516 - DNA, 15 bp, Homo sapiens
gcctgccccagctgg

SEQ ID NO: 5049517 - DNA, 16 bp, Homo sapiens
gcctgccccagctggg

SEQ ID NO: 5049518 - DNA, 22 bp, Homo sapiens
gcctgcccgttgccgggcctgg

SEQ ID NO: 5049519 - DNA, 13 bp, Homo sapiens
gcctgcccttgtc

SEQ ID NO: 5049520 - DNA, 12 bp, Homo sapiens
gcctgcctggga

SEQ ID NO: 5049521 - DNA, 13 bp, Homo sapiens
gcctgcctgggaa

SEQ ID NO: 5049522 - DNA, 20 bp, Homo sapiens
gcctgctctccttgccctgg

SEQ ID NO: 5049523 - DNA, 22 bp, Homo sapiens
gcctgctctccttgccctgggc

SEQ ID NO: 5049524 - DNA, 15 bp, Homo sapiens
gcctggacccccagc

SEQ ID NO: 5049525 - DNA, 17 bp, Homo sapiens
gcctggacccccagctt

SEQ ID NO: 5049526 - DNA, 17 bp, Homo sapiens
gcctggagcccctgtgt

SEQ ID NO: 5049527 - DNA, 15 bp, Homo sapiens
gcctggcgggatggg

SEQ ID NO: 5049528 - DNA, 20 bp, Homo sapiens
gcctggcgggatgggccacc

SEQ ID NO: 5049529 - DNA, 21 bp, Homo sapiens
gcctggcgggatgggccaccg

SEQ ID NO: 5049530 - DNA, 20 bp, Homo sapiens
gcctgttcccccgccgcttt

SEQ ID NO: 5049531 - DNA, 22 bp, Homo sapiens
gcctgttcctcccaagaggcca

SEQ ID NO: 5049532 - DNA, 15 bp, Homo sapiens
gcctgttctgtagga

SEQ ID NO: 5049533 - DNA, 17 bp, Homo sapiens
gcctgttctgtaggaga

SEQ ID NO: 5049534 - DNA, 12 bp, Homo sapiens
gccttcagccaa

SEQ ID NO: 5049535 - DNA, 18 bp, Homo sapiens
gcgaggcgggggagcctg

SEQ ID NO: 5049536 - DNA, 21 bp, Homo sapiens
gcgaggcgggggagcctggag

SEQ ID NO: 5049537 - DNA, 11 bp, Homo sapiens
gcgagggaggg

SEQ ID NO: 5049538 - DNA, 19 bp, Homo sapiens
gcgagggaggggaggtggc

SEQ ID NO: 5049539 - DNA, 13 bp, Homo sapiens
gcgcccctggggt

SEQ ID NO: 5049540 - DNA, 15 bp, Homo sapiens
gcggtaggtgctggc

SEQ ID NO: 5049541 - DNA, 17 bp, Homo sapiens
gcggtaggtgctggcct

SEQ ID NO: 5049542 - DNA, 13 bp, Homo sapiens
gcggtgaggcagg

SEQ ID NO: 5049543 - DNA, 17 bp, Homo sapiens
gcggtgaggcaggggag

SEQ ID NO: 5049544 - DNA, 12 bp, Homo sapiens
gcgtcaggagca

SEQ ID NO: 5049545 - DNA, 17 bp, Homo sapiens
gcgtctggaggggcccc

SEQ ID NO: 5049546 - DNA, 18 bp, Homo sapiens
gcgtctggaggggcccct

SEQ ID NO: 5049547 - DNA, 21 bp, Homo sapiens
gcgtctggaggggcccctgct

SEQ ID NO: 5049548 - DNA, 23 bp, Homo sapiens
gcgtctggaggggcccctgcttc

SEQ ID NO: 5049549 - DNA, 11 bp, Homo sapiens
gcgtgagacgc

SEQ ID NO: 5049550 - DNA, 17 bp, Homo sapiens
gctaacctcactgcctc

SEQ ID NO: 5049551 - DNA, 18 bp, Homo sapiens
gctagtgagccttcccat

SEQ ID NO: 5049552 - DNA, 13 bp, Homo sapiens
gctcagccttgga

SEQ ID NO: 5049553 - DNA, 16 bp, Homo sapiens
gctcagtcagtgcact

SEQ ID NO: 5049554 - DNA, 19 bp, Homo sapiens
gctcattgtataagccccg

SEQ ID NO: 5049555 - DNA, 17 bp, Homo sapiens
gctccacgccctgggga

SEQ ID NO: 5049556 - DNA, 18 bp, Homo sapiens
gctccacgccctggggag

SEQ ID NO: 5049557 - DNA, 15 bp, Homo sapiens
gctccactggcctgc

SEQ ID NO: 5049558 - DNA, 18 bp, Homo sapiens
gctccactggcctgcccg

SEQ ID NO: 5049559 - DNA, 16 bp, Homo sapiens
gctccccgcctgttcc

SEQ ID NO: 5049560 - DNA, 14 bp, Homo sapiens
gctcggaggcccca

SEQ ID NO: 5049561 - DNA, 18 bp, Homo sapiens
gctcggaggccccaaagg

SEQ ID NO: 5049562 - DNA, 15 bp, Homo sapiens
gctctccttgccctg

SEQ ID NO: 5049563 - DNA, 18 bp, Homo sapiens
gctctccttgccctgggc

SEQ ID NO: 5049564 - DNA, 19 bp, Homo sapiens
gctctccttgccctgggcc

SEQ ID NO: 5049565 - DNA, 23 bp, Homo sapiens
gctctgagacggatggaaggaga

SEQ ID NO: 5049566 - DNA, 14 bp, Homo sapiens
gctctgttgcaggt

SEQ ID NO: 5049567 - DNA, 13 bp, Homo sapiens
gctgagtctccca

SEQ ID NO: 5049568 - DNA, 16 bp, Homo sapiens
gctgagtctcccaagg

SEQ ID NO: 5049569 - DNA, 17 bp, Homo sapiens
gctgagtctcccaaggc

SEQ ID NO: 5049570 - DNA, 14 bp, Homo sapiens
gctgcagcaggcag

SEQ ID NO: 5049571 - DNA, 18 bp, Homo sapiens
gctgcagcaggcagagga

SEQ ID NO: 5049572 - DNA, 16 bp, Homo sapiens
gctgccggcagtgctg

SEQ ID NO: 5049573 - DNA, 21 bp, Homo sapiens
gctgccggcagtgctggttct

SEQ ID NO: 5049574 - DNA, 13 bp, Homo sapiens
gctgcttctgggc

SEQ ID NO: 5049575 - DNA, 19 bp, Homo sapiens
gctggagatggctgctgct

SEQ ID NO: 5049576 - DNA, 21 bp, Homo sapiens
gctggagatggctgctgctca

SEQ ID NO: 5049577 - DNA, 22 bp, Homo sapiens
gctggagatggctgctgctcac

SEQ ID NO: 5049578 - DNA, 23 bp, Homo sapiens
gctggcctcaaacagccacgagg

SEQ ID NO: 5049579 - DNA, 19 bp, Homo sapiens
gctggctccacgccctggg

SEQ ID NO: 5049580 - DNA, 22 bp, Homo sapiens
gctggctccacgccctggggag

SEQ ID NO: 5049581 - DNA, 19 bp, Homo sapiens
gctgggggcatgggggagg

SEQ ID NO: 5049582 - DNA, 20 bp, Homo sapiens
gctgggggcatgggggaggc

SEQ ID NO: 5049583 - DNA, 21 bp, Homo sapiens
gctgggggcatgggggaggct

SEQ ID NO: 5049584 - DNA, 22 bp, Homo sapiens
gctgggttttcaggggctttgg

SEQ ID NO: 5049585 - DNA, 18 bp, Homo sapiens
gctggttctccaacagag

SEQ ID NO: 5049586 - DNA, 22 bp, Homo sapiens
gctgtcccaggggtctccctga

SEQ ID NO: 5049587 - DNA, 16 bp, Homo sapiens
gcttcagggctgggca

SEQ ID NO: 5049588 - DNA, 12 bp, Homo sapiens
gcttccaagccc

SEQ ID NO: 5049589 - DNA, 11 bp, Homo sapiens
gctttatccag

SEQ ID NO: 5049590 - DNA, 20 bp, Homo sapiens
gctttgcccaacaccagccc

SEQ ID NO: 5049591 - DNA, 22 bp, Homo sapiens
gctttgcccaacaccagcccct

SEQ ID NO: 5049592 - DNA, 13 bp, Homo sapiens
gcttttctcctct

SEQ ID NO: 5049593 - DNA, 22 bp, Homo sapiens
ggaaggaccaacccatgccctg

SEQ ID NO: 5049594 - DNA, 14 bp, Homo sapiens
ggaatcaaggagcc

SEQ ID NO: 5049595 - DNA, 19 bp, Homo sapiens
ggaccaacccatgccctgc

SEQ ID NO: 5049596 - DNA, 21 bp, Homo sapiens
ggaccaagcttaaggagagga

SEQ ID NO: 5049597 - DNA, 20 bp, Homo sapiens
ggaccaggtgtctagaggca

SEQ ID NO: 5049598 - DNA, 17 bp, Homo sapiens
ggactctggaccccagg

SEQ ID NO: 5049599 - DNA, 16 bp, Homo sapiens
ggagaaggtgcttggg

SEQ ID NO: 5049600 - DNA, 14 bp, Homo sapiens
ggagagaggttgag

SEQ ID NO: 5049601 - DNA, 12 bp, Homo sapiens
ggagaggcagaa

SEQ ID NO: 5049602 - DNA, 13 bp, Homo sapiens
ggagatggctgct

SEQ ID NO: 5049603 - DNA, 15 bp, Homo sapiens
ggagcattctgcctg

SEQ ID NO: 5049604 - DNA, 16 bp, Homo sapiens
ggagcattctgcctgc

SEQ ID NO: 5049605 - DNA, 22 bp, Homo sapiens
ggagcattctgcctgcctggga

SEQ ID NO: 5049606 - DNA, 23 bp, Homo sapiens
ggagcattctgcctgcctgggaa

SEQ ID NO: 5049607 - DNA, 13 bp, Homo sapiens
ggagccacctggg

SEQ ID NO: 5049608 - DNA, 15 bp, Homo sapiens
ggagccacctgggct

SEQ ID NO: 5049609 - DNA, 16 bp, Homo sapiens
ggagccacctgggctg

SEQ ID NO: 5049610 - DNA, 13 bp, Homo sapiens
ggagcccctgtgt

SEQ ID NO: 5049611 - DNA, 22 bp, Homo sapiens
ggagcccctgtgtgggagggcg

SEQ ID NO: 5049612 - DNA, 11 bp, Homo sapiens
ggagcctcctg

SEQ ID NO: 5049613 - DNA, 15 bp, Homo sapiens
ggagcctcctgccca

SEQ ID NO: 5049614 - DNA, 11 bp, Homo sapiens
ggagcctggag

SEQ ID NO: 5049615 - DNA, 17 bp, Homo sapiens
ggagcctggagcccctg

SEQ ID NO: 5049616 - DNA, 15 bp, Homo sapiens
ggaggagccttggag

SEQ ID NO: 5049617 - DNA, 13 bp, Homo sapiens
ggaggcctgggag

SEQ ID NO: 5049618 - DNA, 19 bp, Homo sapiens
ggaggggttgccacaggcc

SEQ ID NO: 5049619 - DNA, 23 bp, Homo sapiens
ggaggtggccgtcgagttgacct

SEQ ID NO: 5049620 - DNA, 22 bp, Homo sapiens
ggagtaagaatgtgtgtgcaga

SEQ ID NO: 5049621 - DNA, 23 bp, Homo sapiens
ggagtgctggctccacgccctgg

SEQ ID NO: 5049622 - DNA, 21 bp, Homo sapiens
ggagtgtaattacctgtcatc

SEQ ID NO: 5049623 - DNA, 16 bp, Homo sapiens
ggatccctcctccagc

SEQ ID NO: 5049624 - DNA, 12 bp, Homo sapiens
ggatcctggagc

SEQ ID NO: 5049625 - DNA, 15 bp, Homo sapiens
ggatcctggagcccc

SEQ ID NO: 5049626 - DNA, 15 bp, Homo sapiens
ggatggaaggagaga

SEQ ID NO: 5049627 - DNA, 18 bp, Homo sapiens
ggcaacagtgttctgagc

SEQ ID NO: 5049628 - DNA, 19 bp, Homo sapiens
ggcacatgctgagtctccc

SEQ ID NO: 5049629 - DNA, 12 bp, Homo sapiens
ggcactgggttt

SEQ ID NO: 5049630 - DNA, 13 bp, Homo sapiens
ggcagaggagagt

SEQ ID NO: 5049631 - DNA, 18 bp, Homo sapiens
ggcaggaatcaaggagcc

SEQ ID NO: 5049632 - DNA, 15 bp, Homo sapiens
ggcagtgctggttct

SEQ ID NO: 5049633 - DNA, 14 bp, Homo sapiens
ggcatagagtgacc

SEQ ID NO: 5049634 - DNA, 20 bp, Homo sapiens
ggcatcatccattctctctg

SEQ ID NO: 5049635 - DNA, 15 bp, Homo sapiens
ggcatgggggaggct

SEQ ID NO: 5049636 - DNA, 19 bp, Homo sapiens
ggcatgggggaggctctga

SEQ ID NO: 5049637 - DNA, 12 bp, Homo sapiens
ggccaccagctc

SEQ ID NO: 5049638 - DNA, 22 bp, Homo sapiens
ggccaccagctccactggcctg

SEQ ID NO: 5049639 - DNA, 23 bp, Homo sapiens
ggccaccagctccactggcctgc

SEQ ID NO: 5049640 - DNA, 15 bp, Homo sapiens
ggccagaggcagcta

SEQ ID NO: 5049641 - DNA, 13 bp, Homo sapiens
ggccagcccagga

SEQ ID NO: 5049642 - DNA, 14 bp, Homo sapiens
ggccagcccaggat

SEQ ID NO: 5049643 - DNA, 19 bp, Homo sapiens
ggccatggtacccccttct

SEQ ID NO: 5049644 - DNA, 21 bp, Homo sapiens
ggcccctgcttctccagcctg

SEQ ID NO: 5049645 - DNA, 14 bp, Homo sapiens
ggccctgcaggagg

SEQ ID NO: 5049646 - DNA, 22 bp, Homo sapiens
ggccctgcaggaggcctgggag

SEQ ID NO: 5049647 - DNA, 23 bp, Homo sapiens
ggccctgcaggaggcctgggagg

SEQ ID NO: 5049648 - DNA, 15 bp, Homo sapiens
ggcctagagtggcag

SEQ ID NO: 5049649 - DNA, 22 bp, Homo sapiens
ggcctagagtggcagccaagag

SEQ ID NO: 5049650 - DNA, 22 bp, Homo sapiens
ggcctgcccgttgccgggcctg

SEQ ID NO: 5049651 - DNA, 13 bp, Homo sapiens
ggcctgggagggc

SEQ ID NO: 5049652 - DNA, 20 bp, Homo sapiens
ggcctgttctgtaggagaga

SEQ ID NO: 5049653 - DNA, 23 bp, Homo sapiens
ggcctgttctgtaggagagactg

SEQ ID NO: 5049654 - DNA, 13 bp, Homo sapiens
ggccttgctgtca

SEQ ID NO: 5049655 - DNA, 14 bp, Homo sapiens
ggccttgctgtcat

SEQ ID NO: 5049656 - DNA, 15 bp, Homo sapiens
ggccttgctgtcatg

SEQ ID NO: 5049657 - DNA, 19 bp, Homo sapiens
ggcgaggcgggggagcctg

SEQ ID NO: 5049658 - DNA, 12 bp, Homo sapiens
ggcgagggaggg

SEQ ID NO: 5049659 - DNA, 20 bp, Homo sapiens
ggcgagggaggggaggtggc

SEQ ID NO: 5049660 - DNA, 13 bp, Homo sapiens
ggcgggggagcct

SEQ ID NO: 5049661 - DNA, 15 bp, Homo sapiens
ggcgggggagcctgg

SEQ ID NO: 5049662 - DNA, 15 bp, Homo sapiens
ggctccacgccctgg

SEQ ID NO: 5049663 - DNA, 17 bp, Homo sapiens
ggctccacgccctgggg

SEQ ID NO: 5049664 - DNA, 21 bp, Homo sapiens
ggctccacgccctggggagtg

SEQ ID NO: 5049665 - DNA, 17 bp, Homo sapiens
ggctcccaagggaggcc

SEQ ID NO: 5049666 - DNA, 22 bp, Homo sapiens
ggctcctgcttttggggctctt

SEQ ID NO: 5049667 - DNA, 11 bp, Homo sapiens
ggctctgtgct

SEQ ID NO: 5049668 - DNA, 16 bp, Homo sapiens
ggctcttgatcagtgt

SEQ ID NO: 5049669 - DNA, 21 bp, Homo sapiens
ggctgcgtctggaggggcccc

SEQ ID NO: 5049670 - DNA, 13 bp, Homo sapiens
ggctgctgctcac

SEQ ID NO: 5049671 - DNA, 13 bp, Homo sapiens
ggctgggagaagg

SEQ ID NO: 5049672 - DNA, 23 bp, Homo sapiens
ggctgggcaggtcctggggaggc

SEQ ID NO: 5049673 - DNA, 17 bp, Homo sapiens
ggctgggggcatggggg

SEQ ID NO: 5049674 - DNA, 18 bp, Homo sapiens
ggctgggggcatggggga

SEQ ID NO: 5049675 - DNA, 19 bp, Homo sapiens
ggctgggggcatgggggag

SEQ ID NO: 5049676 - DNA, 21 bp, Homo sapiens
ggctgggggcatgggggaggc

SEQ ID NO: 5049677 - DNA, 12 bp, Homo sapiens
gggagaggcaga

SEQ ID NO: 5049678 - DNA, 21 bp, Homo sapiens
gggagcattctgcctgcctgg

SEQ ID NO: 5049679 - DNA, 14 bp, Homo sapiens
gggagcctcctgcc

SEQ ID NO: 5049680 - DNA, 21 bp, Homo sapiens
gggagcctcctgcccagtccc

SEQ ID NO: 5049681 - DNA, 12 bp, Homo sapiens
gggagcctggag

SEQ ID NO: 5049682 - DNA, 18 bp, Homo sapiens
gggagcctggagcccctg

SEQ ID NO: 5049683 - DNA, 16 bp, Homo sapiens
gggaggctgagactgc

SEQ ID NO: 5049684 - DNA, 17 bp, Homo sapiens
gggaggggggcacatgc

SEQ ID NO: 5049685 - DNA, 13 bp, Homo sapiens
gggagtgagcttg

SEQ ID NO: 5049686 - DNA, 15 bp, Homo sapiens
gggatctggggaagg

SEQ ID NO: 5049687 - DNA, 15 bp, Homo sapiens
gggatgggccaccgc

SEQ ID NO: 5049688 - DNA, 20 bp, Homo sapiens
gggcaagaagatcacgctcc

SEQ ID NO: 5049689 - DNA, 22 bp, Homo sapiens
gggcacatgctgagtctcccaa

SEQ ID NO: 5049690 - DNA, 15 bp, Homo sapiens
gggcaggtcctgggg

SEQ ID NO: 5049691 - DNA, 19 bp, Homo sapiens
gggcaggtcctggggaggc

SEQ ID NO: 5049692 - DNA, 19 bp, Homo sapiens
gggcccctgcttctccagc

SEQ ID NO: 5049693 - DNA, 16 bp, Homo sapiens
gggccctgcaggaggc

SEQ ID NO: 5049694 - DNA, 18 bp, Homo sapiens
gggccctgcaggaggcct

SEQ ID NO: 5049695 - DNA, 11 bp, Homo sapiens
gggcctggact

SEQ ID NO: 5049696 - DNA, 12 bp, Homo sapiens
gggcctggactg

SEQ ID NO: 5049697 - DNA, 22 bp, Homo sapiens
gggcctggcgggatgggccacc

SEQ ID NO: 5049698 - DNA, 21 bp, Homo sapiens
gggctgggagaaggtgcttgg

SEQ ID NO: 5049699 - DNA, 15 bp, Homo sapiens
ggggagcctggagcc

SEQ ID NO: 5049700 - DNA, 13 bp, Homo sapiens
ggggaggagcctt

SEQ ID NO: 5049701 - DNA, 21 bp, Homo sapiens
ggggagtctgcttgtcttaga

SEQ ID NO: 5049702 - DNA, 12 bp, Homo sapiens
ggggagtgagct

SEQ ID NO: 5049703 - DNA, 22 bp, Homo sapiens
ggggcaaggtgggggagcctgg

SEQ ID NO: 5049704 - DNA, 23 bp, Homo sapiens
ggggcaggaatcaaggagcctcc

SEQ ID NO: 5049705 - DNA, 17 bp, Homo sapiens
ggggcatgggggaggct

SEQ ID NO: 5049706 - DNA, 22 bp, Homo sapiens
ggggcctggcgggatgggccac

SEQ ID NO: 5049707 - DNA, 14 bp, Homo sapiens
ggggcgagggaggg

SEQ ID NO: 5049708 - DNA, 15 bp, Homo sapiens
ggggctttggaagct

SEQ ID NO: 5049709 - DNA, 14 bp, Homo sapiens
gggggcaaggtggg

SEQ ID NO: 5049710 - DNA, 23 bp, Homo sapiens
gggggcacatgctgagtctccca

SEQ ID NO: 5049711 - DNA, 21 bp, Homo sapiens
ggggtctcagtccagtcctca

SEQ ID NO: 5049712 - DNA, 12 bp, Homo sapiens
ggggtctccctg

SEQ ID NO: 5049713 - DNA, 18 bp, Homo sapiens
ggggtctccctgagcctg

SEQ ID NO: 5049714 - DNA, 20 bp, Homo sapiens
ggggtctccctgagcctgcc

SEQ ID NO: 5049715 - DNA, 16 bp, Homo sapiens
gggtcctacggaggga

SEQ ID NO: 5049716 - DNA, 16 bp, Homo sapiens
gggtctccctgagcct

SEQ ID NO: 5049717 - DNA, 17 bp, Homo sapiens
gggtctccctgagcctg

SEQ ID NO: 5049718 - DNA, 12 bp, Homo sapiens
gggtgtgccctg

SEQ ID NO: 5049719 - DNA, 17 bp, Homo sapiens
gggtgtgccctggctcc

SEQ ID NO: 5049720 - DNA, 12 bp, Homo sapiens
ggtagctctgag

SEQ ID NO: 5049721 - DNA, 19 bp, Homo sapiens
ggtgaccccatctctgctg

SEQ ID NO: 5049722 - DNA, 19 bp, Homo sapiens
ggtgcggtaggtgctggcc

SEQ ID NO: 5049723 - DNA, 15 bp, Homo sapiens
ggtgctagggtgcct

SEQ ID NO: 5049724 - DNA, 11 bp, Homo sapiens
ggtggcagcaa

SEQ ID NO: 5049725 - DNA, 13 bp, Homo sapiens
ggtggctggagat

SEQ ID NO: 5049726 - DNA, 13 bp, Homo sapiens
ggtgggggagcct

SEQ ID NO: 5049727 - DNA, 15 bp, Homo sapiens
ggtgggggagcctgg

SEQ ID NO: 5049728 - DNA, 23 bp, Homo sapiens
ggtggtgcagccccaggaccaag

SEQ ID NO: 5049729 - DNA, 11 bp, Homo sapiens
ggtgtgccctg

SEQ ID NO: 5049730 - DNA, 14 bp, Homo sapiens
ggttgccacaggcc

SEQ ID NO: 5049731 - DNA, 20 bp, Homo sapiens
ggttgccacaggcctccctg

SEQ ID NO: 5049732 - DNA, 16 bp, Homo sapiens
gtaacgagaagacaaa

SEQ ID NO: 5049733 - DNA, 19 bp, Homo sapiens
gtaagaatgtgtgtgcaga

SEQ ID NO: 5049734 - DNA, 19 bp, Homo sapiens
gtacacagagggacttgag

SEQ ID NO: 5049735 - DNA, 12 bp, Homo sapiens
gtacccccttct

SEQ ID NO: 5049736 - DNA, 14 bp, Homo sapiens
gtacgtgggagagg

SEQ ID NO: 5049737 - DNA, 16 bp, Homo sapiens
gtacgtgggagaggca

SEQ ID NO: 5049738 - DNA, 19 bp, Homo sapiens
gtagcctttcctgatgaca

SEQ ID NO: 5049739 - DNA, 12 bp, Homo sapiens
gtagctctgagc

SEQ ID NO: 5049740 - DNA, 21 bp, Homo sapiens
gtaggagagactggccagagg

SEQ ID NO: 5049741 - DNA, 22 bp, Homo sapiens
gtaggggaggggttgccacagg

SEQ ID NO: 5049742 - DNA, 12 bp, Homo sapiens
gtaggtgctggc

SEQ ID NO: 5049743 - DNA, 12 bp, Homo sapiens
gtatctggctgg

SEQ ID NO: 5049744 - DNA, 22 bp, Homo sapiens
gtcaactccaggacttgcttcc

SEQ ID NO: 5049745 - DNA, 15 bp, Homo sapiens
gtcaccatcatttct

SEQ ID NO: 5049746 - DNA, 22 bp, Homo sapiens
gtcagcatctttgcccttctgg

SEQ ID NO: 5049747 - DNA, 13 bp, Homo sapiens
gtcaggagcagca

SEQ ID NO: 5049748 - DNA, 13 bp, Homo sapiens
gtcatctgggcca

SEQ ID NO: 5049749 - DNA, 22 bp, Homo sapiens
gtccagagcttcagggctgggc

SEQ ID NO: 5049750 - DNA, 22 bp, Homo sapiens
gtcccaggggtctccctgagcc

SEQ ID NO: 5049751 - DNA, 13 bp, Homo sapiens
gtcccctcagctc

SEQ ID NO: 5049752 - DNA, 14 bp, Homo sapiens
gtcccctcagctcc

SEQ ID NO: 5049753 - DNA, 15 bp, Homo sapiens
gtcccctcagctcca

SEQ ID NO: 5049754 - DNA, 18 bp, Homo sapiens
gtcggggggcgagggagg

SEQ ID NO: 5049755 - DNA, 19 bp, Homo sapiens
gtcggggggcgagggaggg

SEQ ID NO: 5049756 - DNA, 20 bp, Homo sapiens
gtcggggggcgagggagggg

SEQ ID NO: 5049757 - DNA, 22 bp, Homo sapiens
gtcggggggcgagggaggggag

SEQ ID NO: 5049758 - DNA, 12 bp, Homo sapiens
gtctcagtccag

SEQ ID NO: 5049759 - DNA, 17 bp, Homo sapiens
gtctggaggggcccctg

SEQ ID NO: 5049760 - DNA, 11 bp, Homo sapiens
gtctgtgcaga

SEQ ID NO: 5049761 - DNA, 17 bp, Homo sapiens
gtgaccccatctctgct

SEQ ID NO: 5049762 - DNA, 15 bp, Homo sapiens
gtgatggtcattcat

SEQ ID NO: 5049763 - DNA, 16 bp, Homo sapiens
gtgcaaattttttgaa

SEQ ID NO: 5049764 - DNA, 14 bp, Homo sapiens
gtgcagccccagga

SEQ ID NO: 5049765 - DNA, 15 bp, Homo sapiens
gtgcagccccaggac

SEQ ID NO: 5049766 - DNA, 18 bp, Homo sapiens
gtgcagtataattttcta

SEQ ID NO: 5049767 - DNA, 21 bp, Homo sapiens
gtgcattttgtgtgatgcatg

SEQ ID NO: 5049768 - DNA, 12 bp, Homo sapiens
gtgccctggctc

SEQ ID NO: 5049769 - DNA, 14 bp, Homo sapiens
gtgcctgctctcct

SEQ ID NO: 5049770 - DNA, 23 bp, Homo sapiens
gtgcctgctctccttgccctggg

SEQ ID NO: 5049771 - DNA, 20 bp, Homo sapiens
gtgccttcagccaagaccat

SEQ ID NO: 5049772 - DNA, 15 bp, Homo sapiens
gtgctagggtgcctg

SEQ ID NO: 5049773 - DNA, 12 bp, Homo sapiens
gtgggagaggca

SEQ ID NO: 5049774 - DNA, 17 bp, Homo sapiens
gtggggtctcagtccag

SEQ ID NO: 5049775 - DNA, 16 bp, Homo sapiens
gtgggtttagcaggct

SEQ ID NO: 5049776 - DNA, 17 bp, Homo sapiens
gtgggtttagcaggctg

SEQ ID NO: 5049777 - DNA, 16 bp, Homo sapiens
gtggtgcagccccagg

SEQ ID NO: 5049778 - DNA, 13 bp, Homo sapiens
gtgtcaccatcat

SEQ ID NO: 5049779 - DNA, 19 bp, Homo sapiens
gtgtcagcatctttgccct

SEQ ID NO: 5049780 - DNA, 12 bp, Homo sapiens
gtgtgccctggc

SEQ ID NO: 5049781 - DNA, 14 bp, Homo sapiens
gtgtgccctggctc

SEQ ID NO: 5049782 - DNA, 13 bp, Homo sapiens
gtgtgggagggcg

SEQ ID NO: 5049783 - DNA, 21 bp, Homo sapiens
gtgttcatgcgaattcttgct

SEQ ID NO: 5049784 - DNA, 14 bp, Homo sapiens
gtgttcgtcagtgt

SEQ ID NO: 5049785 - DNA, 15 bp, Homo sapiens
gttacctttgctgtc

SEQ ID NO: 5049786 - DNA, 16 bp, Homo sapiens
gttacctttgctgtca

SEQ ID NO: 5049787 - DNA, 22 bp, Homo sapiens
gttcatgcgaattcttgcttga

SEQ ID NO: 5049788 - DNA, 18 bp, Homo sapiens
gttcatgtctctgattgg

SEQ ID NO: 5049789 - DNA, 18 bp, Homo sapiens
gttcctcccaagaggcca

SEQ ID NO: 5049790 - DNA, 13 bp, Homo sapiens
gttctcagctccc

SEQ ID NO: 5049791 - DNA, 15 bp, Homo sapiens
gttctcagctccccc

SEQ ID NO: 5049792 - DNA, 20 bp, Homo sapiens
gttctcagctccccctgtcc

SEQ ID NO: 5049793 - DNA, 22 bp, Homo sapiens
gttgcagattgaagcatttcag

SEQ ID NO: 5049794 - DNA, 17 bp, Homo sapiens
gttgccacaggcctccc

SEQ ID NO: 5049795 - DNA, 16 bp, Homo sapiens
gttgccgggcctggac

SEQ ID NO: 5049796 - DNA, 23 bp, Homo sapiens
gtttacagggagcctcctgccca

SEQ ID NO: 5049797 - DNA, 17 bp, Homo sapiens
gtttacttgtctttgat

SEQ ID NO: 5049798 - DNA, 23 bp, Homo sapiens
gtttacttgtctttgattatgac

SEQ ID NO: 5049799 - DNA, 14 bp, Homo sapiens
gtttagcaggctgc

SEQ ID NO: 5049800 - DNA, 15 bp, Homo sapiens
gtttgaagcctgccc

SEQ ID NO: 5049801 - DNA, 23 bp, Homo sapiens
taaaaaccaaactctgtgtcagc

SEQ ID NO: 5049802 - DNA, 18 bp, Homo sapiens
taaaagttacattgtgct

SEQ ID NO: 5049803 - DNA, 13 bp, Homo sapiens
taaactcatattt

SEQ ID NO: 5049804 - DNA, 17 bp, Homo sapiens
taaaggctctgtgcttg

SEQ ID NO: 5049805 - DNA, 22 bp, Homo sapiens
taaagtgccttcagccaagacc

SEQ ID NO: 5049806 - DNA, 22 bp, Homo sapiens
taacaaaattgacagctttcta

SEQ ID NO: 5049807 - DNA, 19 bp, Homo sapiens
taaccattgtcttgttctg

SEQ ID NO: 5049808 - DNA, 22 bp, Homo sapiens
taactctccagttatcagtact

SEQ ID NO: 5049809 - DNA, 16 bp, Homo sapiens
taatggccatggtacc

SEQ ID NO: 5049810 - DNA, 17 bp, Homo sapiens
taattctgtcattaaac

SEQ ID NO: 5049811 - DNA, 13 bp, Homo sapiens
taatttattttct

SEQ ID NO: 5049812 - DNA, 21 bp, Homo sapiens
tacacctctgggccctgcagg

SEQ ID NO: 5049813 - DNA, 20 bp, Homo sapiens
tacactgccttaccttcact

SEQ ID NO: 5049814 - DNA, 16 bp, Homo sapiens
tacagggagcctcctg

SEQ ID NO: 5049815 - DNA, 18 bp, Homo sapiens
tacaggtgtcaccatcat

SEQ ID NO: 5049816 - DNA, 13 bp, Homo sapiens
tacccccctgaga

SEQ ID NO: 5049817 - DNA, 23 bp, Homo sapiens
tacccccttctgggcatctgttc

SEQ ID NO: 5049818 - DNA, 20 bp, Homo sapiens
tacccctagtatctggctgg

SEQ ID NO: 5049819 - DNA, 15 bp, Homo sapiens
tacctttgctgtcac

SEQ ID NO: 5049820 - DNA, 16 bp, Homo sapiens
tacctttgctgtcact

SEQ ID NO: 5049821 - DNA, 16 bp, Homo sapiens
tacgtgggagaggcag

SEQ ID NO: 5049822 - DNA, 14 bp, Homo sapiens
tacttgtctttgat

SEQ ID NO: 5049823 - DNA, 16 bp, Homo sapiens
tagagcccactgctca

SEQ ID NO: 5049824 - DNA, 22 bp, Homo sapiens
tagagtggcagccaagagccat

SEQ ID NO: 5049825 - DNA, 20 bp, Homo sapiens
tagcacatgtgtaagacact

SEQ ID NO: 5049826 - DNA, 22 bp, Homo sapiens
tagcaggctgcagcaggcagag

SEQ ID NO: 5049827 - DNA, 16 bp, Homo sapiens
tagcagggacaggaga

SEQ ID NO: 5049828 - DNA, 12 bp, Homo sapiens
tagctctgagcc

SEQ ID NO: 5049829 - DNA, 13 bp, Homo sapiens
tagctctgagccc

SEQ ID NO: 5049830 - DNA, 14 bp, Homo sapiens
tagctctgagccct

SEQ ID NO: 5049831 - DNA, 20 bp, Homo sapiens
tagctctgagccctccttct

SEQ ID NO: 5049832 - DNA, 11 bp, Homo sapiens
tagctgctcac

SEQ ID NO: 5049833 - DNA, 13 bp, Homo sapiens
tagctgctcactt

SEQ ID NO: 5049834 - DNA, 19 bp, Homo sapiens
taggactttagggatctgg

SEQ ID NO: 5049835 - DNA, 19 bp, Homo sapiens
tagggatctggggaaggac

SEQ ID NO: 5049836 - DNA, 22 bp, Homo sapiens
tagggatctggggaaggaccaa

SEQ ID NO: 5049837 - DNA, 23 bp, Homo sapiens
taggggaggggttgccacaggcc

SEQ ID NO: 5049838 - DNA, 22 bp, Homo sapiens
taggtgaccccatctctgctgc

SEQ ID NO: 5049839 - DNA, 12 bp, Homo sapiens
taggtgctggcc

SEQ ID NO: 5049840 - DNA, 17 bp, Homo sapiens
tagtagcctttcctgat

SEQ ID NO: 5049841 - DNA, 16 bp, Homo sapiens
tagtatctggctgggt

SEQ ID NO: 5049842 - DNA, 16 bp, Homo sapiens
tattcaagcctttgga

SEQ ID NO: 5049843 - DNA, 20 bp, Homo sapiens
tcaaacagccacgaggtggt

SEQ ID NO: 5049844 - DNA, 21 bp, Homo sapiens
tcaaatgcagcaatcccactt

SEQ ID NO: 5049845 - DNA, 13 bp, Homo sapiens
tcaaccacacaca

SEQ ID NO: 5049846 - DNA, 17 bp, Homo sapiens
tcaaccacacacacctg

SEQ ID NO: 5049847 - DNA, 15 bp, Homo sapiens
tcaactccaggactt

SEQ ID NO: 5049848 - DNA, 20 bp, Homo sapiens
tcaagtgatggtcattcata

SEQ ID NO: 5049849 - DNA, 22 bp, Homo sapiens
tcaatttctctgctctcttgga

SEQ ID NO: 5049850 - DNA, 14 bp, Homo sapiens
tcacagcacccact

SEQ ID NO: 5049851 - DNA, 17 bp, Homo sapiens
tcacaggcatagagtga

SEQ ID NO: 5049852 - DNA, 21 bp, Homo sapiens
tcacatgcccgctgtcccagg

SEQ ID NO: 5049853 - DNA, 21 bp, Homo sapiens
tcacgctccccgcctgttccc

SEQ ID NO: 5049854 - DNA, 16 bp, Homo sapiens
tcactgcctcatggca

SEQ ID NO: 5049855 - DNA, 17 bp, Homo sapiens
tcactttctctcttata

SEQ ID NO: 5049856 - DNA, 17 bp, Homo sapiens
tcagcaaatgccttttc

SEQ ID NO: 5049857 - DNA, 13 bp, Homo sapiens
tcagcaggagtgg

SEQ ID NO: 5049858 - DNA, 19 bp, Homo sapiens
tcagcatctttgcccttct

SEQ ID NO: 5049859 - DNA, 23 bp, Homo sapiens
tcagctccagacgtaggggaggg

SEQ ID NO: 5049860 - DNA, 13 bp, Homo sapiens
tcagctccccctg

SEQ ID NO: 5049861 - DNA, 18 bp, Homo sapiens
tcagctccccctgtcccc

SEQ ID NO: 5049862 - DNA, 15 bp, Homo sapiens
tcagtcagtgcacta

SEQ ID NO: 5049863 - DNA, 21 bp, Homo sapiens
tcagtgcactaaccccagctg

SEQ ID NO: 5049864 - DNA, 23 bp, Homo sapiens
tcagttgggatccctcctccagc

SEQ ID NO: 5049865 - DNA, 16 bp, Homo sapiens
tcatccattctctctg

SEQ ID NO: 5049866 - DNA, 18 bp, Homo sapiens
tcatccattctctctgcc

SEQ ID NO: 5049867 - DNA, 21 bp, Homo sapiens
tcatctgggccaccagctcca

SEQ ID NO: 5049868 - DNA, 22 bp, Homo sapiens
tcatgcctcgctcagtcagtgc

SEQ ID NO: 5049869 - DNA, 15 bp, Homo sapiens
tccacgccctgggga

SEQ ID NO: 5049870 - DNA, 17 bp, Homo sapiens
tccactggcctgcccgt

SEQ ID NO: 5049871 - DNA, 22 bp, Homo sapiens
tccagagcttcagggctgggca

SEQ ID NO: 5049872 - DNA, 23 bp, Homo sapiens
tccagcagtcaattaactctcca

SEQ ID NO: 5049873 - DNA, 12 bp, Homo sapiens
tccagcctggac

SEQ ID NO: 5049874 - DNA, 17 bp, Homo sapiens
tccagcctggaccccca

SEQ ID NO: 5049875 - DNA, 21 bp, Homo sapiens
tccagcctggacccccagctt

SEQ ID NO: 5049876 - DNA, 22 bp, Homo sapiens
tccagcctggacccccagcttt

SEQ ID NO: 5049877 - DNA, 21 bp, Homo sapiens
tccagtcctcacatgcccgct

SEQ ID NO: 5049878 - DNA, 18 bp, Homo sapiens
tccatcatctcttttccc

SEQ ID NO: 5049879 - DNA, 14 bp, Homo sapiens
tccattctctctgc

SEQ ID NO: 5049880 - DNA, 17 bp, Homo sapiens
tccattctctctgccca

SEQ ID NO: 5049881 - DNA, 14 bp, Homo sapiens
tcccaaagtgcctt

SEQ ID NO: 5049882 - DNA, 16 bp, Homo sapiens
tcccacctctgaggac

SEQ ID NO: 5049883 - DNA, 23 bp, Homo sapiens
tcccaggggtctccctgagcctg

SEQ ID NO: 5049884 - DNA, 19 bp, Homo sapiens
tcccccgccgcttttctcc

SEQ ID NO: 5049885 - DNA, 15 bp, Homo sapiens
tcccctcagctccag

SEQ ID NO: 5049886 - DNA, 13 bp, Homo sapiens
tccctccatacct

SEQ ID NO: 5049887 - DNA, 14 bp, Homo sapiens
tccctgagcctgcc

SEQ ID NO: 5049888 - DNA, 16 bp, Homo sapiens
tccctgagcctgcccc

SEQ ID NO: 5049889 - DNA, 22 bp, Homo sapiens
tccctgagcctgccccagctgg

SEQ ID NO: 5049890 - DNA, 18 bp, Homo sapiens
tccctgattaaagtgcct

SEQ ID NO: 5049891 - DNA, 20 bp, Homo sapiens
tccctgattaaagtgccttc

SEQ ID NO: 5049892 - DNA, 19 bp, Homo sapiens
tccctttgcgtcaggagca

SEQ ID NO: 5049893 - DNA, 16 bp, Homo sapiens
tcccttttccatcatc

SEQ ID NO: 5049894 - DNA, 20 bp, Homo sapiens
tccggggaggagccttggag

SEQ ID NO: 5049895 - DNA, 19 bp, Homo sapiens
tccgttcccacctctgagg

SEQ ID NO: 5049896 - DNA, 19 bp, Homo sapiens
tcctagcctgctctgccac

SEQ ID NO: 5049897 - DNA, 20 bp, Homo sapiens
tcctagcctgctctgccact

SEQ ID NO: 5049898 - DNA, 19 bp, Homo sapiens
tcctaggtgaccccatctc

SEQ ID NO: 5049899 - DNA, 16 bp, Homo sapiens
tcctcacatgcccgct

SEQ ID NO: 5049900 - DNA, 20 bp, Homo sapiens
tcctctctttgttctcagct

SEQ ID NO: 5049901 - DNA, 23 bp, Homo sapiens
tcctctctttgttctcagctccc

SEQ ID NO: 5049902 - DNA, 21 bp, Homo sapiens
tcctgcccagtcccccaaccc

SEQ ID NO: 5049903 - DNA, 23 bp, Homo sapiens
tccttcaaaaagcaatctggaag

SEQ ID NO: 5049904 - DNA, 15 bp, Homo sapiens
tccttcttgccctga

SEQ ID NO: 5049905 - DNA, 13 bp, Homo sapiens
tccttgccctggg

SEQ ID NO: 5049906 - DNA, 22 bp, Homo sapiens
tccttgccctgggccagcccag

SEQ ID NO: 5049907 - DNA, 17 bp, Homo sapiens
tcgaattagtttgcact

SEQ ID NO: 5049908 - DNA, 20 bp, Homo sapiens
tcggaggccccaaaggaaaa

SEQ ID NO: 5049909 - DNA, 22 bp, Homo sapiens
tctacactgccttaccttcact

SEQ ID NO: 5049910 - DNA, 21 bp, Homo sapiens
tctcacatattcatcagcagg

SEQ ID NO: 5049911 - DNA, 19 bp, Homo sapiens
tctcagctccccctgtccc

SEQ ID NO: 5049912 - DNA, 14 bp, Homo sapiens
tctccagcctggac

SEQ ID NO: 5049913 - DNA, 15 bp, Homo sapiens
tctccagcctggacc

SEQ ID NO: 5049914 - DNA, 14 bp, Homo sapiens
tctccctcctggtg

SEQ ID NO: 5049915 - DNA, 14 bp, Homo sapiens
tctccctgagcctg

SEQ ID NO: 5049916 - DNA, 23 bp, Homo sapiens
tctccctgagcctgccccagctg

SEQ ID NO: 5049917 - DNA, 17 bp, Homo sapiens
tctctaaacttccctct

SEQ ID NO: 5049918 - DNA, 13 bp, Homo sapiens
tctctctgcccaa

SEQ ID NO: 5049919 - DNA, 19 bp, Homo sapiens
tctctgcccaagttgctct

SEQ ID NO: 5049920 - DNA, 11 bp, Homo sapiens
tctctgcctgt

SEQ ID NO: 5049921 - DNA, 20 bp, Homo sapiens
tctctgctgcttctgggcct

SEQ ID NO: 5049922 - DNA, 12 bp, Homo sapiens
tctctgtagctg

SEQ ID NO: 5049923 - DNA, 14 bp, Homo sapiens
tctctttgttctca

SEQ ID NO: 5049924 - DNA, 17 bp, Homo sapiens
tctctttgttctcagct

SEQ ID NO: 5049925 - DNA, 19 bp, Homo sapiens
tctctttgttctcagctcc

SEQ ID NO: 5049926 - DNA, 21 bp, Homo sapiens
tctctttgttctcagctcccc

SEQ ID NO: 5049927 - DNA, 14 bp, Homo sapiens
tctcttttcccact

SEQ ID NO: 5049928 - DNA, 21 bp, Homo sapiens
tctgaagccacctctctgcct

SEQ ID NO: 5049929 - DNA, 22 bp, Homo sapiens
tctgagacggatggaaggagag

SEQ ID NO: 5049930 - DNA, 16 bp, Homo sapiens
tctgcggtgaggcagg

SEQ ID NO: 5049931 - DNA, 20 bp, Homo sapiens
tctgcggtgaggcaggggag

SEQ ID NO: 5049932 - DNA, 13 bp, Homo sapiens
tctgctctgagac

SEQ ID NO: 5049933 - DNA, 17 bp, Homo sapiens
tctgctgcttctgggcc

SEQ ID NO: 5049934 - DNA, 18 bp, Homo sapiens
tctgctgcttctgggcct

SEQ ID NO: 5049935 - DNA, 17 bp, Homo sapiens
tctggaagaaagccctg

SEQ ID NO: 5049936 - DNA, 20 bp, Homo sapiens
tctggaagaaagccctgtgc

SEQ ID NO: 5049937 - DNA, 22 bp, Homo sapiens
tctggaagaaagccctgtgctt

SEQ ID NO: 5049938 - DNA, 16 bp, Homo sapiens
tctggaccccaggcca

SEQ ID NO: 5049939 - DNA, 19 bp, Homo sapiens
tctgggccctgcaggaggc

SEQ ID NO: 5049940 - DNA, 12 bp, Homo sapiens
tctggggaagga

SEQ ID NO: 5049941 - DNA, 17 bp, Homo sapiens
tctgtaggagagactgg

SEQ ID NO: 5049942 - DNA, 13 bp, Homo sapiens
tctgtgcagatgc

SEQ ID NO: 5049943 - DNA, 23 bp, Homo sapiens
tcttgttcgcacaatctacactg

SEQ ID NO: 5049944 - DNA, 13 bp, Homo sapiens
tcttttcccactc

SEQ ID NO: 5049945 - DNA, 20 bp, Homo sapiens
tgaaaaaaaaaaaaatccca

SEQ ID NO: 5049946 - DNA, 22 bp, Homo sapiens
tgaacttggatattcaagcctt

SEQ ID NO: 5049947 - DNA, 23 bp, Homo sapiens
tgaacttggatattcaagccttt

SEQ ID NO: 5049948 - DNA, 13 bp, Homo sapiens
tgaagcctgccct

SEQ ID NO: 5049949 - DNA, 19 bp, Homo sapiens
tgaataccccttctctgta

SEQ ID NO: 5049950 - DNA, 14 bp, Homo sapiens
tgacagctttctaa

SEQ ID NO: 5049951 - DNA, 14 bp, Homo sapiens
tgaccatcccatga

SEQ ID NO: 5049952 - DNA, 15 bp, Homo sapiens
tgaccatcccatgag

SEQ ID NO: 5049953 - DNA, 21 bp, Homo sapiens
tgaccttctgaacatgagtgt

SEQ ID NO: 5049954 - DNA, 22 bp, Homo sapiens
tgactaataaaaaactgtgaac

SEQ ID NO: 5049955 - DNA, 18 bp, Homo sapiens
tgactgtaggcgcccctg

SEQ ID NO: 5049956 - DNA, 22 bp, Homo sapiens
tgactgtaggcgcccctggggt

SEQ ID NO: 5049957 - DNA, 21 bp, Homo sapiens
tgactgtcacggaacagatct

SEQ ID NO: 5049958 - DNA, 21 bp, Homo sapiens
tgagacgccaccattcctgga

SEQ ID NO: 5049959 - DNA, 17 bp, Homo sapiens
tgagacggatggaagga

SEQ ID NO: 5049960 - DNA, 20 bp, Homo sapiens
tgagacggatggaaggagag

SEQ ID NO: 5049961 - DNA, 23 bp, Homo sapiens
tgagacggatggaaggagagagg

SEQ ID NO: 5049962 - DNA, 17 bp, Homo sapiens
tgagactgcagaggagc

SEQ ID NO: 5049963 - DNA, 24 bp, Homo sapiens
tgagccagttacctttgctgtcac

SEQ ID NO: 5049964 - DNA, 17 bp, Homo sapiens
tgagcccccacctgcct

SEQ ID NO: 5049965 - DNA, 18 bp, Homo sapiens
tgagcccccacctgcctg

SEQ ID NO: 5049966 - DNA, 22 bp, Homo sapiens
tgagccctccttcttgccctga

SEQ ID NO: 5049967 - DNA, 14 bp, Homo sapiens
tgagcctgccccag

SEQ ID NO: 5049968 - DNA, 18 bp, Homo sapiens
tgagcctgccccagctgg

SEQ ID NO: 5049969 - DNA, 18 bp, Homo sapiens
tgagctttccggggagga

SEQ ID NO: 5049970 - DNA, 22 bp, Homo sapiens
tgaggaaacttcggttgcagat

SEQ ID NO: 5049971 - DNA, 23 bp, Homo sapiens
tgaggaagatgggggcaagaaga

SEQ ID NO: 5049972 - DNA, 14 bp, Homo sapiens
tgaggcaggggagt

SEQ ID NO: 5049973 - DNA, 21 bp, Homo sapiens
tgaggcaggggagtctgcttg

SEQ ID NO: 5049974 - DNA, 15 bp, Homo sapiens
tgaggggaggggggc

SEQ ID NO: 5049975 - DNA, 13 bp, Homo sapiens
tgatcagtgtgct

SEQ ID NO: 5049976 - DNA, 20 bp, Homo sapiens
tgatgaaaacaaaatcacag

SEQ ID NO: 5049977 - DNA, 12 bp, Homo sapiens
tgatggagagga

SEQ ID NO: 5049978 - DNA, 21 bp, Homo sapiens
tgatgggttcatgtctctgat

SEQ ID NO: 5049979 - DNA, 15 bp, Homo sapiens
tgattaaagtgcctt

SEQ ID NO: 5049980 - DNA, 15 bp, Homo sapiens
tgcaaattttttgaa

SEQ ID NO: 5049981 - DNA, 20 bp, Homo sapiens
tgcactaaccccagctgccg

SEQ ID NO: 5049982 - DNA, 12 bp, Homo sapiens
tgcactggcctg

SEQ ID NO: 5049983 - DNA, 16 bp, Homo sapiens
tgcagatgctttgccc

SEQ ID NO: 5049984 - DNA, 20 bp, Homo sapiens
tgcagatgctttgcccaggc

SEQ ID NO: 5049985 - DNA, 13 bp, Homo sapiens
tgcaggaggcctg

SEQ ID NO: 5049986 - DNA, 14 bp, Homo sapiens
tgcaggaggcctgg

SEQ ID NO: 5049987 - DNA, 15 bp, Homo sapiens
tgcaggaggcctggg

SEQ ID NO: 5049988 - DNA, 18 bp, Homo sapiens
tgcagtataattttctaa

SEQ ID NO: 5049989 - DNA, 20 bp, Homo sapiens
tgcagtataattttctaatt

SEQ ID NO: 5049990 - DNA, 21 bp, Homo sapiens
tgcattttgtgtgatgcatgt

SEQ ID NO: 5049991 - DNA, 15 bp, Homo sapiens
tgccaactcgggagc

SEQ ID NO: 5049992 - DNA, 22 bp, Homo sapiens
tgccaagcctggagcccctgtg

SEQ ID NO: 5049993 - DNA, 17 bp, Homo sapiens
tgccacaggcctccctg

SEQ ID NO: 5049994 - DNA, 23 bp, Homo sapiens
tgccactgggacggctcctgctt

SEQ ID NO: 5049995 - DNA, 14 bp, Homo sapiens
tgcccaacaccagc

SEQ ID NO: 5049996 - DNA, 17 bp, Homo sapiens
tgcccaacaccagcccc

SEQ ID NO: 5049997 - DNA, 18 bp, Homo sapiens
tgcccaacaccagcccct

SEQ ID NO: 5049998 - DNA, 22 bp, Homo sapiens
tgcccaacaccagcccctgccc

SEQ ID NO: 5049999 - DNA, 23 bp, Homo sapiens
tgcccaacaccagcccctgcccc

SEQ ID NO: 5050000 - DNA, 15 bp, Homo sapiens
tgcccaagttgctct

SEQ ID NO: 5050001 - DNA, 16 bp, Homo sapiens
tgccccagcccaagtc

SEQ ID NO: 5050002 - DNA, 16 bp, Homo sapiens
tgccccagctgggctg

SEQ ID NO: 5050003 - DNA, 13 bp, Homo sapiens
tgcccgctgtccc

SEQ ID NO: 5050004 - DNA, 17 bp, Homo sapiens
tgcccgctgtcccaggg

SEQ ID NO: 5050005 - DNA, 21 bp, Homo sapiens
tgcccgttgccgggcctggac

SEQ ID NO: 5050006 - DNA, 16 bp, Homo sapiens
tgccctgccaagcctg

SEQ ID NO: 5050007 - DNA, 13 bp, Homo sapiens
tgccctgggccag

SEQ ID NO: 5050008 - DNA, 14 bp, Homo sapiens
tgcccttgtctgag

SEQ ID NO: 5050009 - DNA, 14 bp, Homo sapiens
tgccggcagtgctg

SEQ ID NO: 5050010 - DNA, 22 bp, Homo sapiens
tgcctgaccatcccatgagcag

SEQ ID NO: 5050011 - DNA, 12 bp, Homo sapiens
tgcctgcctggg

SEQ ID NO: 5050012 - DNA, 13 bp, Homo sapiens
tgcctgcctggga

SEQ ID NO: 5050013 - DNA, 21 bp, Homo sapiens
tgcctgctctccttgccctgg

SEQ ID NO: 5050014 - DNA, 18 bp, Homo sapiens
tgccttaccttcacttaa

SEQ ID NO: 5050015 - DNA, 14 bp, Homo sapiens
tgcggtgaggcagg

SEQ ID NO: 5050016 - DNA, 16 bp, Homo sapiens
tgcgtcaggagcagca

SEQ ID NO: 5050017 - DNA, 18 bp, Homo sapiens
tgctaacctcactgcctc

SEQ ID NO: 5050018 - DNA, 15 bp, Homo sapiens
tgctagggtgcctgc

SEQ ID NO: 5050019 - DNA, 21 bp, Homo sapiens
tgctctccttgccctgggcca

SEQ ID NO: 5050020 - DNA, 13 bp, Homo sapiens
tgctctctaaact

SEQ ID NO: 5050021 - DNA, 23 bp, Homo sapiens
tgctctgagacggatggaaggag

SEQ ID NO: 5050022 - DNA, 12 bp, Homo sapiens
tgctctgccact

SEQ ID NO: 5050023 - DNA, 14 bp, Homo sapiens
tgctctgccactgg

SEQ ID NO: 5050024 - DNA, 17 bp, Homo sapiens
tgctgctcaccctccta

SEQ ID NO: 5050025 - DNA, 15 bp, Homo sapiens
tgctgcttctgggcc

SEQ ID NO: 5050026 - DNA, 18 bp, Homo sapiens
tgctggttctccaacaga

SEQ ID NO: 5050027 - DNA, 16 bp, Homo sapiens
tgctgtcactttctct

SEQ ID NO: 5050028 - DNA, 19 bp, Homo sapiens
tgcttccaagcccttccct

SEQ ID NO: 5050029 - DNA, 15 bp, Homo sapiens
tgcttctccagcctg

SEQ ID NO: 5050030 - DNA, 18 bp, Homo sapiens
tgcttttggggctcttga

SEQ ID NO: 5050031 - DNA, 21 bp, Homo sapiens
tggaaattgggtgtgccctgg

SEQ ID NO: 5050032 - DNA, 21 bp, Homo sapiens
tggaagaaagccctgtgcttt

SEQ ID NO: 5050033 - DNA, 14 bp, Homo sapiens
tggaaggagagagg

SEQ ID NO: 5050034 - DNA, 13 bp, Homo sapiens
tggagaggagaac

SEQ ID NO: 5050035 - DNA, 21 bp, Homo sapiens
tggagatggctgctgctcacc

SEQ ID NO: 5050036 - DNA, 14 bp, Homo sapiens
tggagcccctgtgt

SEQ ID NO: 5050037 - DNA, 15 bp, Homo sapiens
tggagtgctggctcc

SEQ ID NO: 5050038 - DNA, 15 bp, Homo sapiens
tggccagaggcagct

SEQ ID NO: 5050039 - DNA, 16 bp, Homo sapiens
tggccatggtaccccc

SEQ ID NO: 5050040 - DNA, 22 bp, Homo sapiens
tggccatggtacccccttctgg

SEQ ID NO: 5050041 - DNA, 19 bp, Homo sapiens
tggcgggatgggccaccgc

SEQ ID NO: 5050042 - DNA, 15 bp, Homo sapiens
tggctccacgccctg

SEQ ID NO: 5050043 - DNA, 18 bp, Homo sapiens
tggctccacgccctgggg

SEQ ID NO: 5050044 - DNA, 19 bp, Homo sapiens
tggctccacgccctgggga

SEQ ID NO: 5050045 - DNA, 17 bp, Homo sapiens
tggctcccaagggaggc

SEQ ID NO: 5050046 - DNA, 22 bp, Homo sapiens
tggctcccaagggaggcccatg

SEQ ID NO: 5050047 - DNA, 13 bp, Homo sapiens
tggctgctgctca

SEQ ID NO: 5050048 - DNA, 15 bp, Homo sapiens
tggctgctgctcacc

SEQ ID NO: 5050049 - DNA, 23 bp, Homo sapiens
tggctggagatggctgctgctca

SEQ ID NO: 5050050 - DNA, 19 bp, Homo sapiens
tggctgggttttcaggggc

SEQ ID NO: 5050051 - DNA, 13 bp, Homo sapiens
tgggagaggcaga

SEQ ID NO: 5050052 - DNA, 14 bp, Homo sapiens
tgggagggcaaggg

SEQ ID NO: 5050053 - DNA, 23 bp, Homo sapiens
tgggagggcgaggcgggggagcc

SEQ ID NO: 5050054 - DNA, 13 bp, Homo sapiens
tgggcaggtcctg

SEQ ID NO: 5050055 - DNA, 19 bp, Homo sapiens
tgggcaggtcctggggagg

SEQ ID NO: 5050056 - DNA, 21 bp, Homo sapiens
tgggcaggtcctggggaggct

SEQ ID NO: 5050057 - DNA, 21 bp, Homo sapiens
tgggccaccagctccactggc

SEQ ID NO: 5050058 - DNA, 15 bp, Homo sapiens
tgggccctgcaggag

SEQ ID NO: 5050059 - DNA, 17 bp, Homo sapiens
tgggcctgatggagagg

SEQ ID NO: 5050060 - DNA, 18 bp, Homo sapiens
tgggctgggagaaggtgc

SEQ ID NO: 5050061 - DNA, 17 bp, Homo sapiens
tggggaggctgagactg

SEQ ID NO: 5050062 - DNA, 13 bp, Homo sapiens
tgggggagcctgg

SEQ ID NO: 5050063 - DNA, 16 bp, Homo sapiens
tgggggagcctggagc

SEQ ID NO: 5050064 - DNA, 20 bp, Homo sapiens
tgggggagcctggagcccct

SEQ ID NO: 5050065 - DNA, 13 bp, Homo sapiens
tgggggaggctct

SEQ ID NO: 5050066 - DNA, 14 bp, Homo sapiens
tgggggaggctctg

SEQ ID NO: 5050067 - DNA, 13 bp, Homo sapiens
tgggggcaagaag

SEQ ID NO: 5050068 - DNA, 22 bp, Homo sapiens
tgggggcatgggggaggctctg

SEQ ID NO: 5050069 - DNA, 20 bp, Homo sapiens
tggggggcaaggtgggggag

SEQ ID NO: 5050070 - DNA, 14 bp, Homo sapiens
tgggtgtgccctgg

SEQ ID NO: 5050071 - DNA, 15 bp, Homo sapiens
tgggtgtgccctggc

SEQ ID NO: 5050072 - DNA, 16 bp, Homo sapiens
tgggtgtgccctggct

SEQ ID NO: 5050073 - DNA, 23 bp, Homo sapiens
tgggtttagcaggctgcagcagg

SEQ ID NO: 5050074 - DNA, 18 bp, Homo sapiens
tggtagctctgagccctc

SEQ ID NO: 5050075 - DNA, 15 bp, Homo sapiens
tggtgaagtgtgact

SEQ ID NO: 5050076 - DNA, 21 bp, Homo sapiens
tggtgcggtaggtgctggcct

SEQ ID NO: 5050077 - DNA, 22 bp, Homo sapiens
tggtgcggtaggtgctggcctc

SEQ ID NO: 5050078 - DNA, 23 bp, Homo sapiens
tgtaattacctgtcatctgggcc

SEQ ID NO: 5050079 - DNA, 14 bp, Homo sapiens
tgtaccccccaacc

SEQ ID NO: 5050080 - DNA, 16 bp, Homo sapiens
tgtaccccccaacccc

SEQ ID NO: 5050081 - DNA, 23 bp, Homo sapiens
tgtaccccccaacccctgaggaa

SEQ ID NO: 5050082 - DNA, 14 bp, Homo sapiens
tgtacgtgggagag

SEQ ID NO: 5050083 - DNA, 16 bp, Homo sapiens
tgtacgtgggagaggc

SEQ ID NO: 5050084 - DNA, 20 bp, Homo sapiens
tgtagtagcctttcctgatg

SEQ ID NO: 5050085 - DNA, 18 bp, Homo sapiens
tgtcagcatctttgccct

SEQ ID NO: 5050086 - DNA, 20 bp, Homo sapiens
tgtcatctgggccaccagct

SEQ ID NO: 5050087 - DNA, 14 bp, Homo sapiens
tgtcccctcagctc

SEQ ID NO: 5050088 - DNA, 20 bp, Homo sapiens
tgtcggggggcgagggaggg

SEQ ID NO: 5050089 - DNA, 14 bp, Homo sapiens
tgtctagaggcaac

SEQ ID NO: 5050090 - DNA, 15 bp, Homo sapiens
tgtctgtgcagatgc

SEQ ID NO: 5050091 - DNA, 17 bp, Homo sapiens
tgtgcaaattttttgaa

SEQ ID NO: 5050092 - DNA, 15 bp, Homo sapiens
tgtgcagatgctttg

SEQ ID NO: 5050093 - DNA, 16 bp, Homo sapiens
tgtgcagatgctttgc

SEQ ID NO: 5050094 - DNA, 20 bp, Homo sapiens
tgtggtccctccactaggag

SEQ ID NO: 5050095 - DNA, 13 bp, Homo sapiens
tgtgtaagacact

SEQ ID NO: 5050096 - DNA, 20 bp, Homo sapiens
tgtgtcggggggcgagggag

SEQ ID NO: 5050097 - DNA, 21 bp, Homo sapiens
tgttcccccgccgcttttctc

SEQ ID NO: 5050098 - DNA, 23 bp, Homo sapiens
tgttcctcccaagaggccagggt

SEQ ID NO: 5050099 - DNA, 23 bp, Homo sapiens
tgtttacagggagcctcctgccc

SEQ ID NO: 5050100 - DNA, 17 bp, Homo sapiens
tgtttgaagcctgccct

SEQ ID NO: 5050101 - DNA, 21 bp, Homo sapiens
ttaaaccacacacacaaggtg

SEQ ID NO: 5050102 - DNA, 15 bp, Homo sapiens
ttaaggagaggagag

SEQ ID NO: 5050103 - DNA, 15 bp, Homo sapiens
ttacagggagcctcc

SEQ ID NO: 5050104 - DNA, 17 bp, Homo sapiens
ttacctttgctgtcact

SEQ ID NO: 5050105 - DNA, 22 bp, Homo sapiens
ttatcagagtaacgagaagaca

SEQ ID NO: 5050106 - DNA, 17 bp, Homo sapiens
ttcaaaaagcaatctgg

SEQ ID NO: 5050107 - DNA, 23 bp, Homo sapiens
ttccatcatctcttttcccactc

SEQ ID NO: 5050108 - DNA, 17 bp, Homo sapiens
ttcccttttccatcatc

SEQ ID NO: 5050109 - DNA, 18 bp, Homo sapiens
ttcccttttccatcatct

SEQ ID NO: 5050110 - DNA, 18 bp, Homo sapiens
ttcctgatgacagaacac

SEQ ID NO: 5050111 - DNA, 21 bp, Homo sapiens
ttcctgatgacagaacacaga

SEQ ID NO: 5050112 - DNA, 12 bp, Homo sapiens
ttcgcacaatct

SEQ ID NO: 5050113 - DNA, 16 bp, Homo sapiens
ttcgtcagtgttcatg

SEQ ID NO: 5050114 - DNA, 18 bp, Homo sapiens
ttctaatttattttctca

SEQ ID NO: 5050115 - DNA, 13 bp, Homo sapiens
ttctcagctcccc

SEQ ID NO: 5050116 - DNA, 17 bp, Homo sapiens
ttctccagcctggaccc

SEQ ID NO: 5050117 - DNA, 11 bp, Homo sapiens
ttctctctgcc

SEQ ID NO: 5050118 - DNA, 14 bp, Homo sapiens
ttctctctgcccaa

SEQ ID NO: 5050119 - DNA, 11 bp, Homo sapiens
ttctgagcccc

SEQ ID NO: 5050120 - DNA, 21 bp, Homo sapiens
ttctgagcccccacctgcctg

SEQ ID NO: 5050121 - DNA, 22 bp, Homo sapiens
ttctgagcccccacctgcctga

SEQ ID NO: 5050122 - DNA, 9 bp, Homo sapiens
ttctgatga

SEQ ID NO: 5050123 - DNA, 16 bp, Homo sapiens
ttctgcctgcctggga

SEQ ID NO: 5050124 - DNA, 19 bp, Homo sapiens
ttctgggcatctgttctgg

SEQ ID NO: 5050125 - DNA, 23 bp, Homo sapiens
ttctgggcctgatggagaggaga

SEQ ID NO: 5050126 - DNA, 19 bp, Homo sapiens
ttctgttagctgctcactt

SEQ ID NO: 5050127 - DNA, 12 bp, Homo sapiens
ttcttgccctga

SEQ ID NO: 5050128 - DNA, 22 bp, Homo sapiens
ttgactgtcacggaacagatct

SEQ ID NO: 5050129 - DNA, 23 bp, Homo sapiens
ttgagccagttacctttgctgtc

SEQ ID NO: 5050130 - DNA, 11 bp, Homo sapiens
ttgccacaggc

SEQ ID NO: 5050131 - DNA, 16 bp, Homo sapiens
ttgccacaggcctccc

SEQ ID NO: 5050132 - DNA, 20 bp, Homo sapiens
ttgcccaacaccagcccctg

SEQ ID NO: 5050133 - DNA, 12 bp, Homo sapiens
ttgccctgagct

SEQ ID NO: 5050134 - DNA, 18 bp, Homo sapiens
ttgccgggcctggactgt

SEQ ID NO: 5050135 - DNA, 23 bp, Homo sapiens
ttgccgggcctggactgtcctag

SEQ ID NO: 5050136 - DNA, 22 bp, Homo sapiens
ttgctccctgattaaagtgcct

SEQ ID NO: 5050137 - DNA, 13 bp, Homo sapiens
ttgctctgtatgt

SEQ ID NO: 5050138 - DNA, 18 bp, Homo sapiens
ttggatattcaagccttt

SEQ ID NO: 5050139 - DNA, 23 bp, Homo sapiens
ttggctgggggcatgggggaggc

SEQ ID NO: 5050140 - DNA, 20 bp, Homo sapiens
ttgggatccctcctccagcc

SEQ ID NO: 5050141 - DNA, 17 bp, Homo sapiens
ttgggtgtgccctggct

SEQ ID NO: 5050142 - DNA, 20 bp, Homo sapiens
ttgggtgtgccctggctccc

SEQ ID NO: 5050143 - DNA, 21 bp, Homo sapiens
ttggtgcggtaggtgctggcc

SEQ ID NO: 5050144 - DNA, 13 bp, Homo sapiens
ttgtacgtgggag

SEQ ID NO: 5050145 - DNA, 14 bp, Homo sapiens
ttgtcttgttctgt

SEQ ID NO: 5050146 - DNA, 17 bp, Homo sapiens
ttgtgcattttgtgtga

SEQ ID NO: 5050147 - DNA, 23 bp, Homo sapiens
ttgttcgcacaatctacactgcc

SEQ ID NO: 5050148 - DNA, 15 bp, Homo sapiens
tttacttgtctttga

SEQ ID NO: 5050149 - DNA, 15 bp, Homo sapiens
tttagggatctgggg

SEQ ID NO: 5050150 - DNA, 21 bp, Homo sapiens
tttagggatctggggaaggac

SEQ ID NO: 5050151 - DNA, 17 bp, Homo sapiens
tttccatcatctctttt

SEQ ID NO: 5050152 - DNA, 21 bp, Homo sapiens
tttccggggaggagccttgga

SEQ ID NO: 5050153 - DNA, 22 bp, Homo sapiens
tttcctctctttgttctcagct

SEQ ID NO: 5050154 - DNA, 23 bp, Homo sapiens
tttcctctctttgttctcagctc

SEQ ID NO: 5050155 - DNA, 14 bp, Homo sapiens
tttgcccaacacca

SEQ ID NO: 5050156 - DNA, 21 bp, Homo sapiens
tttgcccaacaccagcccctg

SEQ ID NO: 5050157 - DNA, 19 bp, Homo sapiens
tttgctggagtgctggctc

SEQ ID NO: 5050158 - DNA, 21 bp, Homo sapiens
tttgctgtcactttctctctt

SEQ ID NO: 5050159 - DNA, 18 bp, Homo sapiens
tttgtaccccccaacccc

SEQ ID NO: 5050160 - DNA, 16 bp, Homo sapiens
tttgtgtgatgcatgt

SEQ ID NO: 5050161 - DNA, 11 bp, Homo sapiens
ttttctgatgg

SEQ ID NO: 5050162 - DNA, 15 bp, Homo sapiens
agcaggcagaggaga

SEQ ID NO: 5050163 - DNA, 16 bp, Homo sapiens
agcaggcagaggagag

SEQ ID NO: 5050164 - DNA, 18 bp, Homo sapiens
agcaggcagaggagagta

SEQ ID NO: 5050165 - DNA, 13 bp, Homo sapiens
agcagtcaattaa

SEQ ID NO: 5050166 - DNA, 14 bp, Homo sapiens
agcagtccagagct

SEQ ID NO: 5050167 - DNA, 14 bp, Homo sapiens
agcattctgcctgc

SEQ ID NO: 5050168 - DNA, 16 bp, Homo sapiens
agcattctgcctgcct

SEQ ID NO: 5050169 - DNA, 21 bp, Homo sapiens
agcattctgcctgcctgggaa

SEQ ID NO: 5050170 - DNA, 19 bp, Homo sapiens
agccacctgggctgggaga

SEQ ID NO: 5050171 - DNA, 22 bp, Homo sapiens
agccacctgggctgggagaagg

SEQ ID NO: 5050172 - DNA, 23 bp, Homo sapiens
agccacgaggtggtagctctgag

SEQ ID NO: 5050173 - DNA, 16 bp, Homo sapiens
agccagctcctttccc

SEQ ID NO: 5050174 - DNA, 19 bp, Homo sapiens
agccagttacctttgctgt

SEQ ID NO: 5050175 - DNA, 23 bp, Homo sapiens
agccatctgaagccacctctctg

SEQ ID NO: 5050176 - DNA, 10 bp, Homo sapiens
agcccaagtc

SEQ ID NO: 5050177 - DNA, 16 bp, Homo sapiens
agcccacatccagtgg

SEQ ID NO: 5050178 - DNA, 10 bp, Homo sapiens
agcccaggat

SEQ ID NO: 5050179 - DNA, 22 bp, Homo sapiens
agcccaggattgtacgtgggag

SEQ ID NO: 5050180 - DNA, 11 bp, Homo sapiens
agccccaggac

SEQ ID NO: 5050181 - DNA, 12 bp, Homo sapiens
agcccccacctg

SEQ ID NO: 5050182 - DNA, 17 bp, Homo sapiens
agcccccacctgcctga

SEQ ID NO: 5050183 - DNA, 13 bp, Homo sapiens
agcccctgcccca

SEQ ID NO: 5050184 - DNA, 16 bp, Homo sapiens
agcccctgccccagcc

SEQ ID NO: 5050185 - DNA, 23 bp, Homo sapiens
agcccctgccccagcccaagtcc

SEQ ID NO: 5050186 - DNA, 11 bp, Homo sapiens
agcccctgtgt

SEQ ID NO: 5050187 - DNA, 23 bp, Homo sapiens
agcccctgtgtgggagggcgagg

SEQ ID NO: 5050188 - DNA, 19 bp, Homo sapiens
agccctccttcttgccctg

SEQ ID NO: 5050189 - DNA, 20 bp, Homo sapiens
agccctccttcttgccctga

SEQ ID NO: 5050190 - DNA, 23 bp, Homo sapiens
agccctccttcttgccctgagct

SEQ ID NO: 5050191 - DNA, 13 bp, Homo sapiens
agcctcctgccca

SEQ ID NO: 5050192 - DNA, 18 bp, Homo sapiens
agcctcctgcccagtccc

SEQ ID NO: 5050193 - DNA, 14 bp, Homo sapiens
agcctgcccttgtc

SEQ ID NO: 5050194 - DNA, 12 bp, Homo sapiens
agcctgctctgc

SEQ ID NO: 5050195 - DNA, 15 bp, Homo sapiens
agcctgctctgccac

SEQ ID NO: 5050196 - DNA, 17 bp, Homo sapiens
agcctggagcccctgtg

SEQ ID NO: 5050197 - DNA, 18 bp, Homo sapiens
agcctggagcccctgtgt

SEQ ID NO: 5050198 - DNA, 13 bp, Homo sapiens
agcctttcctgat

SEQ ID NO: 5050199 - DNA, 23 bp, Homo sapiens
agcctttggatggctatggagag

SEQ ID NO: 5050200 - DNA, 22 bp, Homo sapiens
agcgtgagacgccaccattcct

SEQ ID NO: 5050201 - DNA, 16 bp, Homo sapiens
agctaactaattctgt

SEQ ID NO: 5050202 - DNA, 15 bp, Homo sapiens
agctccactggcctg

SEQ ID NO: 5050203 - DNA, 16 bp, Homo sapiens
agctccactggcctgc

SEQ ID NO: 5050204 - DNA, 20 bp, Homo sapiens
agctccactggcctgcccgt

SEQ ID NO: 5050205 - DNA, 17 bp, Homo sapiens
agctctgagccctcctt

SEQ ID NO: 5050206 - DNA, 15 bp, Homo sapiens
agctgccggcagtgc

SEQ ID NO: 5050207 - DNA, 22 bp, Homo sapiens
agctgctcacttaaacaatgtc

SEQ ID NO: 5050208 - DNA, 14 bp, Homo sapiens
agcttaaggagagg

SEQ ID NO: 5050209 - DNA, 14 bp, Homo sapiens
agcttcagggctgg

SEQ ID NO: 5050210 - DNA, 22 bp, Homo sapiens
agctttccggggaggagccttg

SEQ ID NO: 5050211 - DNA, 17 bp, Homo sapiens
agctttctaactcacag

SEQ ID NO: 5050212 - DNA, 15 bp, Homo sapiens
agctttgcccaacac

SEQ ID NO: 5050213 - DNA, 17 bp, Homo sapiens
aggaaaaagcacaagaa

SEQ ID NO: 5050214 - DNA, 18 bp, Homo sapiens
aggaaaaagcacaagaag

SEQ ID NO: 5050215 - DNA, 23 bp, Homo sapiens
aggaactcaaggtggctggagat

SEQ ID NO: 5050216 - DNA, 19 bp, Homo sapiens
aggaagatgggggcaagaa

SEQ ID NO: 5050217 - DNA, 20 bp, Homo sapiens
aggaagatgggggcaagaag

SEQ ID NO: 5050218 - DNA, 21 bp, Homo sapiens
aggaccaacccatgccctgcc

SEQ ID NO: 5050219 - DNA, 19 bp, Homo sapiens
aggaccaagcttaaggaga

SEQ ID NO: 5050220 - DNA, 17 bp, Homo sapiens
aggagaaaaattattcc

SEQ ID NO: 5050221 - DNA, 23 bp, Homo sapiens
aggagagactggccagaggcagc

SEQ ID NO: 5050222 - DNA, 24 bp, Homo sapiens
aggagagaggttgaggatgcactg

SEQ ID NO: 5050223 - DNA, 17 bp, Homo sapiens
aggagcagcatcattca

SEQ ID NO: 5050224 - DNA, 17 bp, Homo sapiens
aggagccacctgggctg

SEQ ID NO: 5050225 - DNA, 21 bp, Homo sapiens
aggagccacctgggctgggag

SEQ ID NO: 5050226 - DNA, 15 bp, Homo sapiens
aggaggcctgggagg

SEQ ID NO: 5050227 - DNA, 18 bp, Homo sapiens
aggaggcctgggagggca

SEQ ID NO: 5050228 - DNA, 16 bp, Homo sapiens
aggattgtacgtggga

SEQ ID NO: 5050229 - DNA, 18 bp, Homo sapiens
aggattgtacgtgggaga

SEQ ID NO: 5050230 - DNA, 20 bp, Homo sapiens
aggcaacagtgttctgagcc

SEQ ID NO: 5050231 - DNA, 21 bp, Homo sapiens
aggcaacagtgttctgagccc

SEQ ID NO: 5050232 - DNA, 16 bp, Homo sapiens
aggcagctaaggggca

SEQ ID NO: 5050233 - DNA, 17 bp, Homo sapiens
aggcagctaaggggcag

SEQ ID NO: 5050234 - DNA, 13 bp, Homo sapiens
aggccccaaagga

SEQ ID NO: 5050235 - DNA, 21 bp, Homo sapiens
aggccccaaaggaaaaagcac

SEQ ID NO: 5050236 - DNA, 15 bp, Homo sapiens
aggcctagagtggca

SEQ ID NO: 5050237 - DNA, 12 bp, Homo sapiens
aggccttgctgt

SEQ ID NO: 5050238 - DNA, 16 bp, Homo sapiens
aggcgggggagcctgg

SEQ ID NO: 5050239 - DNA, 23 bp, Homo sapiens
aggcgggggagcctggagcccct

SEQ ID NO: 5050240 - DNA, 19 bp, Homo sapiens
aggcgggggatcctggagc

SEQ ID NO: 5050241 - DNA, 12 bp, Homo sapiens
aggctcagcctt

SEQ ID NO: 5050242 - DNA, 15 bp, Homo sapiens
aggctcagccttgga

SEQ ID NO: 5050243 - DNA, 19 bp, Homo sapiens
aggctcagccttggaagca

SEQ ID NO: 5050244 - DNA, 22 bp, Homo sapiens
aggctgcagcaggcagaggaga

SEQ ID NO: 5050245 - DNA, 16 bp, Homo sapiens
aggctgcgtctggagg

SEQ ID NO: 5050246 - DNA, 13 bp, Homo sapiens
agggagcctcctg

SEQ ID NO: 5050247 - DNA, 14 bp, Homo sapiens
agggagcctcctgc

SEQ ID NO: 5050248 - DNA, 15 bp, Homo sapiens
agggaggcccatgtg

SEQ ID NO: 5050249 - DNA, 17 bp, Homo sapiens
agggatctggggaagga

SEQ ID NO: 5050250 - DNA, 16 bp, Homo sapiens
agggcagttctgcacc

SEQ ID NO: 5050251 - DNA, 18 bp, Homo sapiens
agggcagttctgcaccca

SEQ ID NO: 5050252 - DNA, 22 bp, Homo sapiens
agggcgaggcgggggagcctgg

SEQ ID NO: 5050253 - DNA, 22 bp, Homo sapiens
agggcgaggcgggggatcctgg

SEQ ID NO: 5050254 - DNA, 20 bp, Homo sapiens
agggctgggcaggtcctggg

SEQ ID NO: 5050255 - DNA, 22 bp, Homo sapiens
agggctgggcaggtcctgggga

SEQ ID NO: 5050256 - DNA, 13 bp, Homo sapiens
aggggagtctgct

SEQ ID NO: 5050257 - DNA, 23 bp, Homo sapiens
aggggggcacatgctgagtctcc

SEQ ID NO: 5050258 - DNA, 16 bp, Homo sapiens
aggggttgccacaggc

SEQ ID NO: 5050259 - DNA, 20 bp, Homo sapiens
aggggttgccacaggcctcc

SEQ ID NO: 5050260 - DNA, 21 bp, Homo sapiens
aggggttgccacaggcctccc

SEQ ID NO: 5050261 - DNA, 23 bp, Homo sapiens
aggggttgccacaggcctccctg

SEQ ID NO: 5050262 - DNA, 20 bp, Homo sapiens
agggtcctacggagggacca

SEQ ID NO: 5050263 - DNA, 22 bp, Homo sapiens
aggtgaccccatctctgctgct

SEQ ID NO: 5050264 - DNA, 18 bp, Homo sapiens
aggtgctagggtgcctgc

SEQ ID NO: 5050265 - DNA, 22 bp, Homo sapiens
aggtgctagggtgcctgctctc

SEQ ID NO: 5050266 - DNA, 14 bp, Homo sapiens
aggtgctcagacat

SEQ ID NO: 5050267 - DNA, 19 bp, Homo sapiens
aggtgctcagacatgaaat

SEQ ID NO: 5050268 - DNA, 16 bp, Homo sapiens
aggtgggggagcctgg

SEQ ID NO: 5050269 - DNA, 20 bp, Homo sapiens
aggtggtagctctgagccct

SEQ ID NO: 5050270 - DNA, 18 bp, Homo sapiens
aggtgtcaccatcatttc

SEQ ID NO: 5050271 - DNA, 18 bp, Homo sapiens
aggttgtgcattttgtgt

SEQ ID NO: 5050272 - DNA, 20 bp, Homo sapiens
agtaagaatgtgtgtgcaga

SEQ ID NO: 5050273 - DNA, 15 bp, Homo sapiens
agtacccccctgaga

SEQ ID NO: 5050274 - DNA, 16 bp, Homo sapiens
agtacccccctgagag

SEQ ID NO: 5050275 - DNA, 18 bp, Homo sapiens
agtcccccaaccccagcc

SEQ ID NO: 5050276 - DNA, 16 bp, Homo sapiens
agtctcacatattcat

SEQ ID NO: 5050277 - DNA, 14 bp, Homo sapiens
agtctcccaaggct

SEQ ID NO: 5050278 - DNA, 16 bp, Homo sapiens
agtgaccttttaatca

SEQ ID NO: 5050279 - DNA, 16 bp, Homo sapiens
agtgagccttcccatt

SEQ ID NO: 5050280 - DNA, 20 bp, Homo sapiens
agtgccttcagccaagacca

SEQ ID NO: 5050281 - DNA, 21 bp, Homo sapiens
agtgccttcagccaagaccat

SEQ ID NO: 5050282 - DNA, 12 bp, Homo sapiens
agtgctggctcc

SEQ ID NO: 5050283 - DNA, 13 bp, Homo sapiens
agtgctggctcca

SEQ ID NO: 5050284 - DNA, 19 bp, Homo sapiens
agtgctggctccacgccct

SEQ ID NO: 5050285 - DNA, 22 bp, Homo sapiens
agtgctggctccacgccctggg

SEQ ID NO: 5050286 - DNA, 16 bp, Homo sapiens
agtggcagccaagagc

SEQ ID NO: 5050287 - DNA, 18 bp, Homo sapiens
agtggcagccaagagcca

SEQ ID NO: 5050288 - DNA, 22 bp, Homo sapiens
agtggcagccaagagccatctg

SEQ ID NO: 5050289 - DNA, 17 bp, Homo sapiens
agtgtcaactccaggac

SEQ ID NO: 5050290 - DNA, 22 bp, Homo sapiens
agtgtgctaacctcactgcctc

SEQ ID NO: 5050291 - DNA, 13 bp, Homo sapiens
agttacctttgct

SEQ ID NO: 5050292 - DNA, 17 bp, Homo sapiens
agttctgcacccagcca

SEQ ID NO: 5050293 - DNA, 12 bp, Homo sapiens
agttgctctgta

SEQ ID NO: 5050294 - DNA, 23 bp, Homo sapiens
agttggcaagtctcacatattca

SEQ ID NO: 5050295 - DNA, 19 bp, Homo sapiens
agtttacttgtctttgatt

SEQ ID NO: 5050296 - DNA, 16 bp, Homo sapiens
agtttgcacttcctgt

SEQ ID NO: 5050297 - DNA, 22 bp, Homo sapiens
ataaattctgttagctgctcac

SEQ ID NO: 5050298 - DNA, 15 bp, Homo sapiens
atattcaagcctttg

SEQ ID NO: 5050299 - DNA, 17 bp, Homo sapiens
atattcaagcctttgga

SEQ ID NO: 5050300 - DNA, 16 bp, Homo sapiens
atattctcatggcttt

SEQ ID NO: 5050301 - DNA, 13 bp, Homo sapiens
atcaaggagcctc

SEQ ID NO: 5050302 - DNA, 18 bp, Homo sapiens
atcacagcacccactacc

SEQ ID NO: 5050303 - DNA, 12 bp, Homo sapiens
atcacgctcccc

SEQ ID NO: 5050304 - DNA, 13 bp, Homo sapiens
atcacgctccccg

SEQ ID NO: 5050305 - DNA, 23 bp, Homo sapiens
atcacgctccccgcctgttcccc

SEQ ID NO: 5050306 - DNA, 21 bp, Homo sapiens
atcagagtaacgagaagacaa

SEQ ID NO: 5050307 - DNA, 23 bp, Homo sapiens
atcagtgtgctaacctcactgcc

SEQ ID NO: 5050308 - DNA, 22 bp, Homo sapiens
atcatccattctctctgcccaa

SEQ ID NO: 5050309 - DNA, 18 bp, Homo sapiens
atcatctcttttcccact

SEQ ID NO: 5050310 - DNA, 20 bp, Homo sapiens
atcattcagcaaatgccttt

SEQ ID NO: 5050311 - DNA, 21 bp, Homo sapiens
atcattcagcaaatgcctttt

SEQ ID NO: 5050312 - DNA, 12 bp, Homo sapiens
atcatttctagt

SEQ ID NO: 5050313 - DNA, 19 bp, Homo sapiens
atccattctctctgcccaa

SEQ ID NO: 5050314 - DNA, 15 bp, Homo sapiens
atcccaaagtgcctt

SEQ ID NO: 5050315 - DNA, 21 bp, Homo sapiens
atcccaaagtgccttctgagc

SEQ ID NO: 5050316 - DNA, 20 bp, Homo sapiens
atcccacttagcagggacag

SEQ ID NO: 5050317 - DNA, 14 bp, Homo sapiens
atctctgctgcttc

SEQ ID NO: 5050318 - DNA, 17 bp, Homo sapiens
atctctgctgcttctgg

SEQ ID NO: 5050319 - DNA, 19 bp, Homo sapiens
atctctgctgcttctgggc

SEQ ID NO: 5050320 - DNA, 20 bp, Homo sapiens
atctgaagccacctctctgc

SEQ ID NO: 5050321 - DNA, 22 bp, Homo sapiens
atctgaagccacctctctgcct

SEQ ID NO: 5050322 - DNA, 21 bp, Homo sapiens
atctgaataccccttctctgt

SEQ ID NO: 5050323 - DNA, 13 bp, Homo sapiens
atctgctctgaga

SEQ ID NO: 5050324 - DNA, 21 bp, Homo sapiens
atctggaagaaagccctgtgc

SEQ ID NO: 5050325 - DNA, 14 bp, Homo sapiens
atctggggaaggac

SEQ ID NO: 5050326 - DNA, 16 bp, Homo sapiens
atcttgttctttgctg

SEQ ID NO: 5050327 - DNA, 16 bp, Homo sapiens
atgagagaaagtggga

SEQ ID NO: 5050328 - DNA, 14 bp, Homo sapiens
atgaggggaggggg

SEQ ID NO: 5050329 - DNA, 21 bp, Homo sapiens
atgagtgtcaactccaggact

SEQ ID NO: 5050330 - DNA, 19 bp, Homo sapiens
atgcatgtagtagcctttc

SEQ ID NO: 5050331 - DNA, 22 bp, Homo sapiens
atgcatgtagtagcctttcctg

SEQ ID NO: 5050332 - DNA, 23 bp, Homo sapiens
atgcccgctgtcccaggggtctc

SEQ ID NO: 5050333 - DNA, 22 bp, Homo sapiens
atgcctcgctcagtcagtgcac

SEQ ID NO: 5050334 - DNA, 24 bp, Homo sapiens
atgccttttcaaatgcagcaatcc

SEQ ID NO: 5050335 - DNA, 14 bp, Homo sapiens
atgctgagtctccc

SEQ ID NO: 5050336 - DNA, 15 bp, Homo sapiens
atggaaggagagagg

SEQ ID NO: 5050337 - DNA, 16 bp, Homo sapiens
atggaaggagagaggt

SEQ ID NO: 5050338 - DNA, 18 bp, Homo sapiens
atgggggaggctctgaag

SEQ ID NO: 5050339 - DNA, 15 bp, Homo sapiens
atgggggcaagaaga

SEQ ID NO: 5050340 - DNA, 14 bp, Homo sapiens
atggtacccccttc

SEQ ID NO: 5050341 - DNA, 17 bp, Homo sapiens
atggtacccccttctgg

SEQ ID NO: 5050342 - DNA, 19 bp, Homo sapiens
atgtaaaataaaggctctg

SEQ ID NO: 5050343 - DNA, 16 bp, Homo sapiens
atgttgactgtcttga

SEQ ID NO: 5050344 - DNA, 17 bp, Homo sapiens
attcagcaaatgccttt

SEQ ID NO: 5050345 - DNA, 18 bp, Homo sapiens
attcagcaaatgcctttt

SEQ ID NO: 5050346 - DNA, 18 bp, Homo sapiens
attcctggaaaccacagt

SEQ ID NO: 5050347 - DNA, 10 bp, Homo sapiens
attctgatga

SEQ ID NO: 5050348 - DNA, 23 bp, Homo sapiens
attctgccccacacccagccagc

SEQ ID NO: 5050349 - DNA, 16 bp, Homo sapiens
attctgcctgcctggg

SEQ ID NO: 5050350 - DNA, 15 bp, Homo sapiens
attctgttagctgct

SEQ ID NO: 5050351 - DNA, 19 bp, Homo sapiens
attctgttagctgctcact

SEQ ID NO: 5050352 - DNA, 19 bp, Homo sapiens
atttgctggagtgctggct

SEQ ID NO: 5050353 - DNA, 19 bp, Homo sapiens
attttgtgtgatgcatgta

SEQ ID NO: 5050354 - DNA, 12 bp, Homo sapiens
atttttctgatg

SEQ ID NO: 5050355 - DNA, 19 bp, Homo sapiens
caaacagccacgaggtggt

SEQ ID NO: 5050356 - DNA, 13 bp, Homo sapiens
caaactctgtgtc

SEQ ID NO: 5050357 - DNA, 17 bp, Homo sapiens
caaatgcagcaatccca

SEQ ID NO: 5050358 - DNA, 17 bp, Homo sapiens
caaatgtttacagggag

SEQ ID NO: 5050359 - DNA, 17 bp, Homo sapiens
caacaccagcccctgcc

SEQ ID NO: 5050360 - DNA, 18 bp, Homo sapiens
caacaccagcccctgccc

SEQ ID NO: 5050361 - DNA, 14 bp, Homo sapiens
caacagagtggtgt

SEQ ID NO: 5050362 - DNA, 12 bp, Homo sapiens
caaccccagccg

SEQ ID NO: 5050363 - DNA, 14 bp, Homo sapiens
caaccccagccgct

SEQ ID NO: 5050364 - DNA, 23 bp, Homo sapiens
caaccccagccgctcggaggccc

SEQ ID NO: 5050365 - DNA, 13 bp, Homo sapiens
caacccctgagga

SEQ ID NO: 5050366 - DNA, 18 bp, Homo sapiens
caactccaggacttgctt

SEQ ID NO: 5050367 - DNA, 20 bp, Homo sapiens
caactcgggagcattctgcc

SEQ ID NO: 5050368 - DNA, 18 bp, Homo sapiens
caagaagatcacgctccc

SEQ ID NO: 5050369 - DNA, 20 bp, Homo sapiens
caagaccatctctccctcct

SEQ ID NO: 5050370 - DNA, 20 bp, Homo sapiens
caagaggccagggtggccag

SEQ ID NO: 5050371 - DNA, 18 bp, Homo sapiens
caagcccttccctctgtt

SEQ ID NO: 5050372 - DNA, 22 bp, Homo sapiens
cccagctttgcccaacaccagc

SEQ ID NO: 5050373 - DNA, 19 bp, Homo sapiens
cccaggccataccaggtgc

SEQ ID NO: 5050374 - DNA, 21 bp, Homo sapiens
cccaggggtctccctgagcct

SEQ ID NO: 5050375 - DNA, 23 bp, Homo sapiens
cccaggggtctccctgagcctgc

SEQ ID NO: 5050376 - DNA, 14 bp, Homo sapiens
cccagtcccccaac

SEQ ID NO: 5050377 - DNA, 12 bp, Homo sapiens
cccatgccctgc

SEQ ID NO: 5050378 - DNA, 17 bp, Homo sapiens
cccatgccctgccaagc

SEQ ID NO: 5050379 - DNA, 21 bp, Homo sapiens
cccatgccctgccaagcctgg

SEQ ID NO: 5050380 - DNA, 16 bp, Homo sapiens
cccatgttgactgtct

SEQ ID NO: 5050381 - DNA, 15 bp, Homo sapiens
ctctctttgttctca

SEQ ID NO: 5050382 - DNA, 19 bp, Homo sapiens
ctctctttgttctcagctc

SEQ ID NO: 5050383 - DNA, 22 bp, Homo sapiens
ctctctttgttctcagctcccc

SEQ ID NO: 5050384 - DNA, 22 bp, Homo sapiens
ctctgagacggatggaaggaga

SEQ ID NO: 5050385 - DNA, 14 bp, Homo sapiens
ctctgccactggga

SEQ ID NO: 5050386 - DNA, 15 bp, Homo sapiens
ctctgcctgttcctc

SEQ ID NO: 5050387 - DNA, 15 bp, Homo sapiens
ctctggaccccaggc

SEQ ID NO: 5050388 - DNA, 16 bp, Homo sapiens
ctctggaccccaggcc

SEQ ID NO: 5050389 - DNA, 18 bp, Homo sapiens
ctctgggccctgcaggag

SEQ ID NO: 5050390 - DNA, 24 bp, Homo sapiens
ctctgggccctgcaggaggcctgg

SEQ ID NO: 5050391 - DNA, 20 bp, Homo sapiens
ctctgtagctgctagtgagc

SEQ ID NO: 5050392 - DNA, 22 bp, Homo sapiens
ctctgtgtcagcatctttgccc

SEQ ID NO: 5050393 - DNA, 20 bp, Homo sapiens
ctctgttggaaattgggtgt

SEQ ID NO: 5050394 - DNA, 18 bp, Homo sapiens
ctcttgttcgcacaatct

SEQ ID NO: 5050395 - DNA, 20 bp, Homo sapiens
ctctttgagaaaatgtaaaa

SEQ ID NO: 5050396 - DNA, 14 bp, Homo sapiens
ctgaagccacctct

SEQ ID NO: 5050397 - DNA, 16 bp, Homo sapiens
ctgagacggatggaag

SEQ ID NO: 5050398 - DNA, 22 bp, Homo sapiens
ctgagacggatggaaggagaga

SEQ ID NO: 5050399 - DNA, 18 bp, Homo sapiens
ctgagactgcagaggagc

SEQ ID NO: 5050400 - DNA, 21 bp, Homo sapiens
ctgagactgcagaggagccac

SEQ ID NO: 5050401 - DNA, 17 bp, Homo sapiens
ctgagagcatgtggggg

SEQ ID NO: 5050402 - DNA, 21 bp, Homo sapiens
ctgagccctccttcttgccct

SEQ ID NO: 5050403 - DNA, 18 bp, Homo sapiens
ctgagcctgccccagctg

SEQ ID NO: 5050404 - DNA, 22 bp, Homo sapiens
ctgagcctgccccagctgggct

SEQ ID NO: 5050405 - DNA, 19 bp, Homo sapiens
ctgagctttccggggagga

SEQ ID NO: 5050406 - DNA, 21 bp, Homo sapiens
ctgagctttccggggaggagc

SEQ ID NO: 5050407 - DNA, 22 bp, Homo sapiens
ctgagctttccggggaggagcc

SEQ ID NO: 5050408 - DNA, 15 bp, Homo sapiens
ctgaggactctggac

SEQ ID NO: 5050409 - DNA, 17 bp, Homo sapiens
ctgagtctcccaaggct

SEQ ID NO: 5050410 - DNA, 21 bp, Homo sapiens
ctgatatttgctggagtgctg

SEQ ID NO: 5050411 - DNA, 23 bp, Homo sapiens
ctgatgaaaacaaaatcacagca

SEQ ID NO: 5050412 - DNA, 18 bp, Homo sapiens
ctgattaaagtgccttca

SEQ ID NO: 5050413 - DNA, 20 bp, Homo sapiens
ctgattgggtcagctggctt

SEQ ID NO: 5050414 - DNA, 14 bp, Homo sapiens
ctgcagaggagcca

SEQ ID NO: 5050415 - DNA, 18 bp, Homo sapiens
ctgcagaggagccacctg

SEQ ID NO: 5050416 - DNA, 14 bp, Homo sapiens
ctgcaggaggcctg

SEQ ID NO: 5050417 - DNA, 21 bp, Homo sapiens
ctgcaggaggcctgggagggc

SEQ ID NO: 5050418 - DNA, 14 bp, Homo sapiens
ctgccaagcctgga

SEQ ID NO: 5050419 - DNA, 15 bp, Homo sapiens
ctgccaagcctggag

SEQ ID NO: 5050420 - DNA, 16 bp, Homo sapiens
ctgccaagcctggagc

SEQ ID NO: 5050421 - DNA, 13 bp, Homo sapiens
ctgcccagtcccc

SEQ ID NO: 5050422 - DNA, 18 bp, Homo sapiens
ctgcccagtcccccaacc

SEQ ID NO: 5050423 - DNA, 19 bp, Homo sapiens
ctgcccagtcccccaaccc

SEQ ID NO: 5050424 - DNA, 20 bp, Homo sapiens
ctgccccacacccagccagc

SEQ ID NO: 5050425 - DNA, 13 bp, Homo sapiens
ctgccccagccca

SEQ ID NO: 5050426 - DNA, 17 bp, Homo sapiens
ctgccccagcccaagtc

SEQ ID NO: 5050427 - DNA, 18 bp, Homo sapiens
ctgccccagcccaagtcc

SEQ ID NO: 5050428 - DNA, 16 bp, Homo sapiens
ctgccccagctgggct

SEQ ID NO: 5050429 - DNA, 22 bp, Homo sapiens
ctgcccgttgccgggcctggac

SEQ ID NO: 5050430 - DNA, 16 bp, Homo sapiens
ctgcccttgtctgaga

SEQ ID NO: 5050431 - DNA, 19 bp, Homo sapiens
ctgccggcagtgctggttc

SEQ ID NO: 5050432 - DNA, 20 bp, Homo sapiens
ctgccggcagtgctggttct

SEQ ID NO: 5050433 - DNA, 23 bp, Homo sapiens
ctgccggcagtgctggttctcca

SEQ ID NO: 5050434 - DNA, 13 bp, Homo sapiens
ctgcctgcctggg

SEQ ID NO: 5050435 - DNA, 15 bp, Homo sapiens
ctgcctgcctgggaa

SEQ ID NO: 5050436 - DNA, 16 bp, Homo sapiens
ctgcctgcctgggaac

SEQ ID NO: 5050437 - DNA, 14 bp, Homo sapiens
ctgcctgttcctcc

SEQ ID NO: 5050438 - DNA, 14 bp, Homo sapiens
ctgcggtgaggcag

SEQ ID NO: 5050439 - DNA, 14 bp, Homo sapiens
ctgcgtctggaggg

SEQ ID NO: 5050440 - DNA, 16 bp, Homo sapiens
ctgcgtctggaggggc

SEQ ID NO: 5050441 - DNA, 18 bp, Homo sapiens
ctgcgtctggaggggccc

SEQ ID NO: 5050442 - DNA, 20 bp, Homo sapiens
ctgctagtgagccttcccat

SEQ ID NO: 5050443 - DNA, 22 bp, Homo sapiens
ctgctcaccctcctagcctgct

SEQ ID NO: 5050444 - DNA, 20 bp, Homo sapiens
ctgctcacttaaacaatgtc

SEQ ID NO: 5050445 - DNA, 18 bp, Homo sapiens
ctgctctccttgccctgg

SEQ ID NO: 5050446 - DNA, 11 bp, Homo sapiens
ctgctctgcca

SEQ ID NO: 5050447 - DNA, 13 bp, Homo sapiens
ctgcttctgggcc

SEQ ID NO: 5050448 - DNA, 14 bp, Homo sapiens
ctgcttgtcttaga

SEQ ID NO: 5050449 - DNA, 16 bp, Homo sapiens
ctgcttttggggctct

SEQ ID NO: 5050450 - DNA, 19 bp, Homo sapiens
ctgcttttggggctcttga

SEQ ID NO: 5050451 - DNA, 21 bp, Homo sapiens
ctgcttttggggctcttgatc

SEQ ID NO: 5050452 - DNA, 20 bp, Homo sapiens
ctggaagaaagccctgtgct

SEQ ID NO: 5050453 - DNA, 22 bp, Homo sapiens
ctggaccatcaagggtcatggc

SEQ ID NO: 5050454 - DNA, 14 bp, Homo sapiens
ctggacccccagct

SEQ ID NO: 5050455 - DNA, 17 bp, Homo sapiens
ctggagatggctgctgc

SEQ ID NO: 5050456 - DNA, 21 bp, Homo sapiens
ctggagatggctgctgctcac

SEQ ID NO: 5050457 - DNA, 14 bp, Homo sapiens
ctggagcccctgtg

SEQ ID NO: 5050458 - DNA, 17 bp, Homo sapiens
ctggagcccctgtgtgg

SEQ ID NO: 5050459 - DNA, 14 bp, Homo sapiens
ctggaggggcccct

SEQ ID NO: 5050460 - DNA, 15 bp, Homo sapiens
ctggagtgctggctc

SEQ ID NO: 5050461 - DNA, 14 bp, Homo sapiens
ctggccagaggcag

SEQ ID NO: 5050462 - DNA, 17 bp, Homo sapiens
ctggcctgttctgtagg

SEQ ID NO: 5050463 - DNA, 18 bp, Homo sapiens
ctggcctgttctgtagga

SEQ ID NO: 5050464 - DNA, 19 bp, Homo sapiens
ctggcgggatgggccaccg

SEQ ID NO: 5050465 - DNA, 18 bp, Homo sapiens
ctggctccacgccctggg

SEQ ID NO: 5050466 - DNA, 19 bp, Homo sapiens
ctggctccacgccctgggg

SEQ ID NO: 5050467 - DNA, 22 bp, Homo sapiens
ctggctccacgccctggggagt

SEQ ID NO: 5050468 - DNA, 18 bp, Homo sapiens
ctgggacggctcctgctt

SEQ ID NO: 5050469 - DNA, 16 bp, Homo sapiens
ctgggcaggtcctggg

SEQ ID NO: 5050470 - DNA, 22 bp, Homo sapiens
ctgggcaggtcctggggaggct

SEQ ID NO: 5050471 - DNA, 23 bp, Homo sapiens
ctgggcaggtcctggggaggctg

SEQ ID NO: 5050472 - DNA, 15 bp, Homo sapiens
ctgggcatctgttct

SEQ ID NO: 5050473 - DNA, 13 bp, Homo sapiens
ctgggccaccagc

SEQ ID NO: 5050474 - DNA, 14 bp, Homo sapiens
ctgggccctgcagg

SEQ ID NO: 5050475 - DNA, 19 bp, Homo sapiens
ctgggccctgcaggaggcc

SEQ ID NO: 5050476 - DNA, 18 bp, Homo sapiens
ctgtcactttctctctta

SEQ ID NO: 5050477 - DNA, 15 bp, Homo sapiens
ctgtcccctcagctc

SEQ ID NO: 5050478 - DNA, 18 bp, Homo sapiens
ctgtgcagatgctttgcc

SEQ ID NO: 5050479 - DNA, 19 bp, Homo sapiens
ctgtgcagatgctttgccc

SEQ ID NO: 5050480 - DNA, 16 bp, Homo sapiens
ctgtgtcagcatcttt

SEQ ID NO: 5050481 - DNA, 19 bp, Homo sapiens
ctgtgttggggggcaaggt

SEQ ID NO: 5050482 - DNA, 14 bp, Homo sapiens
ctgttagctgctca

SEQ ID NO: 5050483 - DNA, 16 bp, Homo sapiens
cttcagggctgggcag

SEQ ID NO: 5050484 - DNA, 18 bp, Homo sapiens
cttcgaattagtttgcac

SEQ ID NO: 5050485 - DNA, 17 bp, Homo sapiens
cttctgcggtgaggcag

SEQ ID NO: 5050486 - DNA, 18 bp, Homo sapiens
cttctgggcctgatggag

SEQ ID NO: 5050487 - DNA, 21 bp, Homo sapiens
cttctgggcctgatggagagg

SEQ ID NO: 5050488 - DNA, 19 bp, Homo sapiens
cttgactgtcacggaacag

SEQ ID NO: 5050489 - DNA, 20 bp, Homo sapiens
cttgactgtcacggaacaga

SEQ ID NO: 5050490 - DNA, 12 bp, Homo sapiens
cttgccctgagc

SEQ ID NO: 5050491 - DNA, 14 bp, Homo sapiens
cttgccctgagctt

SEQ ID NO: 5050492 - DNA, 22 bp, Homo sapiens
cttggtgcggtaggtgctggcc

SEQ ID NO: 5050493 - DNA, 12 bp, Homo sapiens
cttgtctttgat

SEQ ID NO: 5050494 - DNA, 13 bp, Homo sapiens
cttgtctttgatt

SEQ ID NO: 5050495 - DNA, 21 bp, Homo sapiens
cttgttcgcacaatctacact

SEQ ID NO: 5050496 - DNA, 21 bp, Homo sapiens
ctttagggatctggggaagga

SEQ ID NO: 5050497 - DNA, 12 bp, Homo sapiens
ctttatccagca

SEQ ID NO: 5050498 - DNA, 15 bp, Homo sapiens
ctttatccagcagtc

SEQ ID NO: 5050499 - DNA, 15 bp, Homo sapiens
ctttcccttttccat

SEQ ID NO: 5050500 - DNA, 20 bp, Homo sapiens
ctttcccttttccatcatct

SEQ ID NO: 5050501 - DNA, 18 bp, Homo sapiens
ctttgcccaacaccagcc

SEQ ID NO: 5050502 - DNA, 22 bp, Homo sapiens
ctttgcccaacaccagcccctg

SEQ ID NO: 5050503 - DNA, 21 bp, Homo sapiens
ctttgcgtcaggagcagcatc

SEQ ID NO: 5050504 - DNA, 12 bp, Homo sapiens
ctttgtaccccc

SEQ ID NO: 5050505 - DNA, 14 bp, Homo sapiens
ctttgtacccccca

SEQ ID NO: 5050506 - DNA, 19 bp, Homo sapiens
ctttgtaccccccaacccc

SEQ ID NO: 5050507 - DNA, 23 bp, Homo sapiens
ctttgttctcagctccccctgtc

SEQ ID NO: 5050508 - DNA, 21 bp, Homo sapiens
cttttacatttttctgatggg

SEQ ID NO: 5050509 - DNA, 14 bp, Homo sapiens
cttttccatcatct

SEQ ID NO: 5050510 - DNA, 16 bp, Homo sapiens
cttttggggctcttga

SEQ ID NO: 5050511 - DNA, 21 bp, Homo sapiens
cttttggggctcttgatcagt

SEQ ID NO: 5050512 - DNA, 17 bp, Homo sapiens
gaaaaagcacaagaagc

SEQ ID NO: 5050513 - DNA, 16 bp, Homo sapiens
gaaagccctgtgcttt

SEQ ID NO: 5050514 - DNA, 18 bp, Homo sapiens
gaaagccctgtgctttgg

SEQ ID NO: 5050515 - DNA, 22 bp, Homo sapiens
gaaattgggtgtgccctggctc

SEQ ID NO: 5050516 - DNA, 18 bp, Homo sapiens
gaacagatcttgttcttt

SEQ ID NO: 5050517 - DNA, 20 bp, Homo sapiens
gaacggggtggacgagggag

SEQ ID NO: 5050518 - DNA, 18 bp, Homo sapiens
gaagaaagccctgtgctt

SEQ ID NO: 5050519 - DNA, 16 bp, Homo sapiens
gaagatcacgctcccc

SEQ ID NO: 5050520 - DNA, 14 bp, Homo sapiens
gaagcatttcaggt

SEQ ID NO: 5050521 - DNA, 22 bp, Homo sapiens
gaagccacctctctgcctgttc

SEQ ID NO: 5050522 - DNA, 13 bp, Homo sapiens
gaaggccttgctg

SEQ ID NO: 5050523 - DNA, 15 bp, Homo sapiens
gaattagtttgcact

SEQ ID NO: 5050524 - DNA, 23 bp, Homo sapiens
gacaggagaaaaattattcccat

SEQ ID NO: 5050525 - DNA, 17 bp, Homo sapiens
gacatgaaatgtacatg

SEQ ID NO: 5050526 - DNA, 19 bp, Homo sapiens
gacatgccaactcgggagc

SEQ ID NO: 5050527 - DNA, 23 bp, Homo sapiens
gacatgccaactcgggagcattc

SEQ ID NO: 5050528 - DNA, 17 bp, Homo sapiens
gaccaacccatgccctg

SEQ ID NO: 5050529 - DNA, 22 bp, Homo sapiens
gaccaagcttaaggagaggaga

SEQ ID NO: 5050530 - DNA, 23 bp, Homo sapiens
gaccaagcttaaggagaggagag

SEQ ID NO: 5050531 - DNA, 16 bp, Homo sapiens
gaccatcaagggtcat

SEQ ID NO: 5050532 - DNA, 20 bp, Homo sapiens
gaccatcccatgagcagtcc

SEQ ID NO: 5050533 - DNA, 18 bp, Homo sapiens
gacggatggaaggagaga

SEQ ID NO: 5050534 - DNA, 21 bp, Homo sapiens
gacggatggaaggagagaggt

SEQ ID NO: 5050535 - DNA, 15 bp, Homo sapiens
gacgtaggggagggg

SEQ ID NO: 5050536 - DNA, 12 bp, Homo sapiens
gactcagtgttg

SEQ ID NO: 5050537 - DNA, 12 bp, Homo sapiens
gactgcagagga

SEQ ID NO: 5050538 - DNA, 14 bp, Homo sapiens
gactgcagaggagc

SEQ ID NO: 5050539 - DNA, 17 bp, Homo sapiens
gactggccagaggcagc

SEQ ID NO: 5050540 - DNA, 22 bp, Homo sapiens
gactttgtaccccccaacccct

SEQ ID NO: 5050541 - DNA, 17 bp, Homo sapiens
gagacggatggaaggag

SEQ ID NO: 5050542 - DNA, 19 bp, Homo sapiens
gagacggatggaaggagag

SEQ ID NO: 5050543 - DNA, 15 bp, Homo sapiens
gagactgcagaggag

SEQ ID NO: 5050544 - DNA, 16 bp, Homo sapiens
gagactggccagaggc

SEQ ID NO: 5050545 - DNA, 22 bp, Homo sapiens
gagagaaagtgggacctggtgg

SEQ ID NO: 5050546 - DNA, 21 bp, Homo sapiens
gagagactggccagaggcagc

SEQ ID NO: 5050547 - DNA, 19 bp, Homo sapiens
gagagcatctgctctgaga

SEQ ID NO: 5050548 - DNA, 19 bp, Homo sapiens
gagagcatgtgggggaagg

SEQ ID NO: 5050549 - DNA, 15 bp, Homo sapiens
gagaggagagcatct

SEQ ID NO: 5050550 - DNA, 14 bp, Homo sapiens
gagagggcttgaaa

SEQ ID NO: 5050551 - DNA, 13 bp, Homo sapiens
gagaggttgagga

SEQ ID NO: 5050552 - DNA, 16 bp, Homo sapiens
gagcatctgctctgag

SEQ ID NO: 5050553 - DNA, 15 bp, Homo sapiens
gagccacctgggctg

SEQ ID NO: 5050554 - DNA, 20 bp, Homo sapiens
gagccacctgggctgggaga

SEQ ID NO: 5050555 - DNA, 17 bp, Homo sapiens
gagccatctgaagccac

SEQ ID NO: 5050556 - DNA, 21 bp, Homo sapiens
gagcccctgtgtgggagggcg

SEQ ID NO: 5050557 - DNA, 11 bp, Homo sapiens
gagccctcctt

SEQ ID NO: 5050558 - DNA, 14 bp, Homo sapiens
gagcctcctgccca

SEQ ID NO: 5050559 - DNA, 19 bp, Homo sapiens
gagcctcctgcccagtccc

SEQ ID NO: 5050560 - DNA, 19 bp, Homo sapiens
gagcttcagggctgggcag

SEQ ID NO: 5050561 - DNA, 20 bp, Homo sapiens
gagctttccggggaggagcc

SEQ ID NO: 5050562 - DNA, 20 bp, Homo sapiens
gaggagagtacccccctgag

SEQ ID NO: 5050563 - DNA, 17 bp, Homo sapiens
gaggcaggggagtctgc

SEQ ID NO: 5050564 - DNA, 13 bp, Homo sapiens
gaggccccaaagg

SEQ ID NO: 5050565 - DNA, 14 bp, Homo sapiens
gaggccccaaagga

SEQ ID NO: 5050566 - DNA, 13 bp, Homo sapiens
gaggcctgggagg

SEQ ID NO: 5050567 - DNA, 14 bp, Homo sapiens
gcgaattcttgctt

SEQ ID NO: 5050568 - DNA, 18 bp, Homo sapiens
gcgaattcttgcttgagg

SEQ ID NO: 5050569 - DNA, 14 bp, Homo sapiens
gcgaggcgggggag

SEQ ID NO: 5050570 - DNA, 24 bp, Homo sapiens
gcgaggcgggggagcctggagccc

SEQ ID NO: 5050571 - DNA, 12 bp, Homo sapiens
gcgagggagggg

SEQ ID NO: 5050572 - DNA, 11 bp, Homo sapiens
gcgggggagcc

SEQ ID NO: 5050573 - DNA, 13 bp, Homo sapiens
gcgggggagcctg

SEQ ID NO: 5050574 - DNA, 16 bp, Homo sapiens
gcggtaggtgctggcc

SEQ ID NO: 5050575 - DNA, 15 bp, Homo sapiens
gcgtcaggagcagca

SEQ ID NO: 5050576 - DNA, 15 bp, Homo sapiens
gctccacgccctggg

SEQ ID NO: 5050577 - DNA, 16 bp, Homo sapiens
gctcccaccagcccac

SEQ ID NO: 5050578 - DNA, 17 bp, Homo sapiens
gctccccgcctgttccc

SEQ ID NO: 5050579 - DNA, 21 bp, Homo sapiens
gctcctgcttttggggctctt

SEQ ID NO: 5050580 - DNA, 19 bp, Homo sapiens
gctcggaggccccaaagga

SEQ ID NO: 5050581 - DNA, 17 bp, Homo sapiens
gctctccttgccctggg

SEQ ID NO: 5050582 - DNA, 21 bp, Homo sapiens
gctctgagacggatggaagga

SEQ ID NO: 5050583 - DNA, 18 bp, Homo sapiens
gctctgttgcaggtgtcc

SEQ ID NO: 5050584 - DNA, 19 bp, Homo sapiens
gctctgttgcaggtgtccg

SEQ ID NO: 5050585 - DNA, 16 bp, Homo sapiens
gctcttgatcagtgtg

SEQ ID NO: 5050586 - DNA, 19 bp, Homo sapiens
gctgagactgcagaggagc

SEQ ID NO: 5050587 - DNA, 14 bp, Homo sapiens
gctgagtctcccaa

SEQ ID NO: 5050588 - DNA, 15 bp, Homo sapiens
gctgagtctcccaag

SEQ ID NO: 5050589 - DNA, 12 bp, Homo sapiens
gctgcagcaggc

SEQ ID NO: 5050590 - DNA, 15 bp, Homo sapiens
gctgcagcaggcaga

SEQ ID NO: 5050591 - DNA, 22 bp, Homo sapiens
gctgcagcaggcagaggagagt

SEQ ID NO: 5050592 - DNA, 14 bp, Homo sapiens
gctgccggcagtgc

SEQ ID NO: 5050593 - DNA, 16 bp, Homo sapiens
gctgcgtctggagggg

SEQ ID NO: 5050594 - DNA, 16 bp, Homo sapiens
gctgcttctgggcctg

SEQ ID NO: 5050595 - DNA, 17 bp, Homo sapiens
gctggagatggctgctg

SEQ ID NO: 5050596 - DNA, 15 bp, Homo sapiens
gctggagtgctggct

SEQ ID NO: 5050597 - DNA, 18 bp, Homo sapiens
gctggagtgctggctcca

SEQ ID NO: 5050598 - DNA, 21 bp, Homo sapiens
gctggctccacgccctgggga

SEQ ID NO: 5050599 - DNA, 13 bp, Homo sapiens
gctgggagaaggt

SEQ ID NO: 5050600 - DNA, 17 bp, Homo sapiens
gctgggcaggtcctggg

SEQ ID NO: 5050601 - DNA, 19 bp, Homo sapiens
gctgggcaggtcctgggga

SEQ ID NO: 5050602 - DNA, 22 bp, Homo sapiens
gctgggcaggtcctggggaggc

SEQ ID NO: 5050603 - DNA, 23 bp, Homo sapiens
gctgggcaggtcctggggaggct

SEQ ID NO: 5050604 - DNA, 15 bp, Homo sapiens
gctgggctgttggct

SEQ ID NO: 5050605 - DNA, 19 bp, Homo sapiens
gctgggctgttggctgggg

SEQ ID NO: 5050606 - DNA, 18 bp, Homo sapiens
gctgtcactttctctctt

SEQ ID NO: 5050607 - DNA, 18 bp, Homo sapiens
gctgttggctgggggcat

SEQ ID NO: 5050608 - DNA, 17 bp, Homo sapiens
gcttcagggctgggcag

SEQ ID NO: 5050609 - DNA, 12 bp, Homo sapiens
gcttctcaccac

SEQ ID NO: 5050610 - DNA, 13 bp, Homo sapiens
gcttctccagcct

SEQ ID NO: 5050611 - DNA, 18 bp, Homo sapiens
gcttctgcggtgaggcag

SEQ ID NO: 5050612 - DNA, 21 bp, Homo sapiens
gcttctgcggtgaggcagggg

SEQ ID NO: 5050613 - DNA, 23 bp, Homo sapiens
gcttctgcggtgaggcaggggag

SEQ ID NO: 5050614 - DNA, 23 bp, Homo sapiens
gcttggtgcggtaggtgctggcc

SEQ ID NO: 5050615 - DNA, 13 bp, Homo sapiens
gctttatccagca

SEQ ID NO: 5050616 - DNA, 17 bp, Homo sapiens
gctttgcccaggcttct

SEQ ID NO: 5050617 - DNA, 15 bp, Homo sapiens
gcttttggggctctt

SEQ ID NO: 5050618 - DNA, 21 bp, Homo sapiens
ggaaattgggtgtgccctggc

SEQ ID NO: 5050619 - DNA, 22 bp, Homo sapiens
ggaaattgggtgtgccctggct

SEQ ID NO: 5050620 - DNA, 12 bp, Homo sapiens
ggaaggaccaac

SEQ ID NO: 5050621 - DNA, 11 bp, Homo sapiens
ggaaggagaga

SEQ ID NO: 5050622 - DNA, 18 bp, Homo sapiens
ggaccaacccatgccctg

SEQ ID NO: 5050623 - DNA, 19 bp, Homo sapiens
ggaccaagcttaaggagag

SEQ ID NO: 5050624 - DNA, 22 bp, Homo sapiens
ggaccaagcttaaggagaggag

SEQ ID NO: 5050625 - DNA, 11 bp, Homo sapiens
ggactgtccta

SEQ ID NO: 5050626 - DNA, 20 bp, Homo sapiens
ggactgtcctaggtgacccc

SEQ ID NO: 5050627 - DNA, 13 bp, Homo sapiens
ggagaaggtgctt

SEQ ID NO: 5050628 - DNA, 22 bp, Homo sapiens
ggagaaggtgcttgggcttctg

SEQ ID NO: 5050629 - DNA, 16 bp, Homo sapiens
ggagagactggccaga

SEQ ID NO: 5050630 - DNA, 18 bp, Homo sapiens
ggagagcatctgctctga

SEQ ID NO: 5050631 - DNA, 19 bp, Homo sapiens
ggagagcatctgctctgag

SEQ ID NO: 5050632 - DNA, 20 bp, Homo sapiens
ggagagcatctgctctgaga

SEQ ID NO: 5050633 - DNA, 15 bp, Homo sapiens
ggagaggcagaaagg

SEQ ID NO: 5050634 - DNA, 15 bp, Homo sapiens
ggagatggctgctgc

SEQ ID NO: 5050635 - DNA, 16 bp, Homo sapiens
ggagatggctgctgct

SEQ ID NO: 5050636 - DNA, 21 bp, Homo sapiens
ggagcattctgcctgcctggg

SEQ ID NO: 5050637 - DNA, 20 bp, Homo sapiens
ggagcccctgtgtgggaggg

SEQ ID NO: 5050638 - DNA, 12 bp, Homo sapiens
ggagcctggagc

SEQ ID NO: 5050639 - DNA, 14 bp, Homo sapiens
ggagcctggagccc

SEQ ID NO: 5050640 - DNA, 18 bp, Homo sapiens
ggagcctggagcccctgt

SEQ ID NO: 5050641 - DNA, 14 bp, Homo sapiens
ggaggagccttgga

SEQ ID NO: 5050642 - DNA, 12 bp, Homo sapiens
ggaggggaggtg

SEQ ID NO: 5050643 - DNA, 13 bp, Homo sapiens
ggaggggcccctg

SEQ ID NO: 5050644 - DNA, 21 bp, Homo sapiens
ggaggggcccctgcttctcca

SEQ ID NO: 5050645 - DNA, 14 bp, Homo sapiens
ggaggggttgccac

SEQ ID NO: 5050646 - DNA, 16 bp, Homo sapiens
ggaggggttgccacag

SEQ ID NO: 5050647 - DNA, 23 bp, Homo sapiens
ggagtctgcttgtcttagatgtt

SEQ ID NO: 5050648 - DNA, 14 bp, Homo sapiens
ggatattcaagcct

SEQ ID NO: 5050649 - DNA, 16 bp, Homo sapiens
ggatctggggaaggac

SEQ ID NO: 5050650 - DNA, 20 bp, Homo sapiens
ggattgtacgtgggagaggc

SEQ ID NO: 5050651 - DNA, 20 bp, Homo sapiens
ggcaacagtgttctgagccc

SEQ ID NO: 5050652 - DNA, 19 bp, Homo sapiens
ggcaaggtgggggagcctg

SEQ ID NO: 5050653 - DNA, 20 bp, Homo sapiens
ggcaaggtgggggagcctgg

SEQ ID NO: 5050654 - DNA, 22 bp, Homo sapiens
ggcaaggtgggggagcctggag

SEQ ID NO: 5050655 - DNA, 20 bp, Homo sapiens
ggcactgggtttgctccctg

SEQ ID NO: 5050656 - DNA, 16 bp, Homo sapiens
ggcaggggagtctgct

SEQ ID NO: 5050657 - DNA, 19 bp, Homo sapiens
ggcaggtcctggggaggct

SEQ ID NO: 5050658 - DNA, 14 bp, Homo sapiens
ggcagtgctggttc

SEQ ID NO: 5050659 - DNA, 19 bp, Homo sapiens
ggcatcatccattctctct

SEQ ID NO: 5050660 - DNA, 20 bp, Homo sapiens
ggcatgggggaggctctgaa

SEQ ID NO: 5050661 - DNA, 21 bp, Homo sapiens
ggccaccagctccactggcct

SEQ ID NO: 5050662 - DNA, 20 bp, Homo sapiens
ggccatggtacccccttctg

SEQ ID NO: 5050663 - DNA, 20 bp, Homo sapiens
ggcccctgcttctccagcct

SEQ ID NO: 5050664 - DNA, 16 bp, Homo sapiens
ggccctgcaggaggcc

SEQ ID NO: 5050665 - DNA, 18 bp, Homo sapiens
ggccctgcaggaggcctg

SEQ ID NO: 5050666 - DNA, 19 bp, Homo sapiens
ggccctgcaggaggcctgg

SEQ ID NO: 5050667 - DNA, 21 bp, Homo sapiens
ggccctgcaggaggcctggga

SEQ ID NO: 5050668 - DNA, 14 bp, Homo sapiens
ggcctgatggagag

SEQ ID NO: 5050669 - DNA, 15 bp, Homo sapiens
ggcctgatggagagg

SEQ ID NO: 5050670 - DNA, 19 bp, Homo sapiens
ggcctgatggagaggagaa

SEQ ID NO: 5050671 - DNA, 14 bp, Homo sapiens
ggcctgttctgtag

SEQ ID NO: 5050672 - DNA, 19 bp, Homo sapiens
ggcctgttctgtaggagag

SEQ ID NO: 5050673 - DNA, 16 bp, Homo sapiens
aggcctagagtggcag

SEQ ID NO: 5050674 - DNA, 21 bp, Homo sapiens
aggcctagagtggcagccaag

SEQ ID NO: 5050675 - DNA, 12 bp, Homo sapiens
aggcctccctgt

SEQ ID NO: 5050676 - DNA, 14 bp, Homo sapiens
aggcctccctgttt

SEQ ID NO: 5050677 - DNA, 14 bp, Homo sapiens
aggcctgggagggc

SEQ ID NO: 5050678 - DNA, 16 bp, Homo sapiens
aggcctgggagggcaa

SEQ ID NO: 5050679 - DNA, 13 bp, Homo sapiens
aggcgcccctggg

SEQ ID NO: 5050680 - DNA, 14 bp, Homo sapiens
aggcgcccctgggg

SEQ ID NO: 5050681 - DNA, 14 bp, Homo sapiens
aggcgggggagcct

SEQ ID NO: 5050682 - DNA, 15 bp, Homo sapiens
aggcgggggagcctg

SEQ ID NO: 5050683 - DNA, 19 bp, Homo sapiens
aggcgggggagcctggagc

SEQ ID NO: 5050684 - DNA, 21 bp, Homo sapiens
aggcgggggatcctggagccc

SEQ ID NO: 5050685 - DNA, 23 bp, Homo sapiens
aggcgggggatcctggagcccct

SEQ ID NO: 5050686 - DNA, 20 bp, Homo sapiens
aggctcagccttggaagcaa

SEQ ID NO: 5050687 - DNA, 10 bp, Homo sapiens
aggctctgtg

SEQ ID NO: 5050688 - DNA, 21 bp, Homo sapiens
aggctgagactgcagaggagc

SEQ ID NO: 5050689 - DNA, 20 bp, Homo sapiens
agggaccaggtgtctagagg

SEQ ID NO: 5050690 - DNA, 15 bp, Homo sapiens
agggagcctcctgcc

SEQ ID NO: 5050691 - DNA, 16 bp, Homo sapiens
agggagcctcctgccc

SEQ ID NO: 5050692 - DNA, 22 bp, Homo sapiens
agggagcctcctgcccagtccc

SEQ ID NO: 5050693 - DNA, 18 bp, Homo sapiens
agggatctggggaaggac

SEQ ID NO: 5050694 - DNA, 22 bp, Homo sapiens
agggatctggggaaggaccaac

SEQ ID NO: 5050695 - DNA, 20 bp, Homo sapiens
agggcagttctgcacccagc

SEQ ID NO: 5050696 - DNA, 13 bp, Homo sapiens
aggggcccctgct

SEQ ID NO: 5050697 - DNA, 13 bp, Homo sapiens
aggggtctccctg

SEQ ID NO: 5050698 - DNA, 14 bp, Homo sapiens
aggggtctccctga

SEQ ID NO: 5050699 - DNA, 18 bp, Homo sapiens
aggggtctccctgagcct

SEQ ID NO: 5050700 - DNA, 21 bp, Homo sapiens
aggggtggtgagggcagttct

SEQ ID NO: 5050701 - DNA, 19 bp, Homo sapiens
aggggttgccacaggcctc

SEQ ID NO: 5050702 - DNA, 22 bp, Homo sapiens
aggggttgccacaggcctccct

SEQ ID NO: 5050703 - DNA, 15 bp, Homo sapiens
agggtgcctgctctc

SEQ ID NO: 5050704 - DNA, 16 bp, Homo sapiens
aggtagagcccactgc

SEQ ID NO: 5050705 - DNA, 17 bp, Homo sapiens
aggtcctggggaggctg

SEQ ID NO: 5050706 - DNA, 20 bp, Homo sapiens
aggtgaccccatctctgctg

SEQ ID NO: 5050707 - DNA, 19 bp, Homo sapiens
aggtgctagggtgcctgct

SEQ ID NO: 5050708 - DNA, 11 bp, Homo sapiens
aggtgctggcc

SEQ ID NO: 5050709 - DNA, 14 bp, Homo sapiens
aggtgggggagcct

SEQ ID NO: 5050710 - DNA, 17 bp, Homo sapiens
aggtgggggagcctgga

SEQ ID NO: 5050711 - DNA, 21 bp, Homo sapiens
aggtgggggagcctggagccc

SEQ ID NO: 5050712 - DNA, 22 bp, Homo sapiens
aggtgggggagcctggagcccc

SEQ ID NO: 5050713 - DNA, 15 bp, Homo sapiens
aggtggtagctctga

SEQ ID NO: 5050714 - DNA, 19 bp, Homo sapiens
aggtggtagctctgagccc

SEQ ID NO: 5050715 - DNA, 21 bp, Homo sapiens
aggtggtagctctgagccctc

SEQ ID NO: 5050716 - DNA, 21 bp, Homo sapiens
aggttgaggatgcactggcct

SEQ ID NO: 5050717 - DNA, 23 bp, Homo sapiens
aggttgaggatgcactggcctgt

SEQ ID NO: 5050718 - DNA, 14 bp, Homo sapiens
agtatctggctggg

SEQ ID NO: 5050719 - DNA, 14 bp, Homo sapiens
agtcaattaactct

SEQ ID NO: 5050720 - DNA, 16 bp, Homo sapiens
agtcctcacatgcccg

SEQ ID NO: 5050721 - DNA, 18 bp, Homo sapiens
agtctcacatattcatca

SEQ ID NO: 5050722 - DNA, 13 bp, Homo sapiens
agtctcccaaggc

SEQ ID NO: 5050723 - DNA, 21 bp, Homo sapiens
agtgcactaaccccagctgcc

SEQ ID NO: 5050724 - DNA, 14 bp, Homo sapiens
agtgcctgaacatg

SEQ ID NO: 5050725 - DNA, 19 bp, Homo sapiens
agtgccttcagccaagacc

SEQ ID NO: 5050726 - DNA, 14 bp, Homo sapiens
agtgccttctgagc

SEQ ID NO: 5050727 - DNA, 21 bp, Homo sapiens
agtgctggctccacgccctgg

SEQ ID NO: 5050728 - DNA, 23 bp, Homo sapiens
agtgctggctccacgccctgggg

SEQ ID NO: 5050729 - DNA, 12 bp, Homo sapiens
agtgctggttct

SEQ ID NO: 5050730 - DNA, 22 bp, Homo sapiens
agtgtgcagtataattttctaa

SEQ ID NO: 5050731 - DNA, 18 bp, Homo sapiens
agtgtgctaacctcactg

SEQ ID NO: 5050732 - DNA, 15 bp, Homo sapiens
agtgtggtccctcca

SEQ ID NO: 5050733 - DNA, 15 bp, Homo sapiens
agtgttctgagcccc

SEQ ID NO: 5050734 - DNA, 19 bp, Homo sapiens
agttacctttgctgtcact

SEQ ID NO: 5050735 - DNA, 20 bp, Homo sapiens
agttacctttgctgtcactt

SEQ ID NO: 5050736 - DNA, 11 bp, Homo sapiens
agttgctctgt

SEQ ID NO: 5050737 - DNA, 18 bp, Homo sapiens
ataaaaaccaaactctgt

SEQ ID NO: 5050738 - DNA, 15 bp, Homo sapiens
atcacagcacccact

SEQ ID NO: 5050739 - DNA, 19 bp, Homo sapiens
atcagagtaacgagaagac

SEQ ID NO: 5050740 - DNA, 13 bp, Homo sapiens
atcagtactccca

SEQ ID NO: 5050741 - DNA, 23 bp, Homo sapiens
atcatattctcatggctttgtta

SEQ ID NO: 5050742 - DNA, 17 bp, Homo sapiens
atcatccattctctctg

SEQ ID NO: 5050743 - DNA, 19 bp, Homo sapiens
atcattcagcaaatgcctt

SEQ ID NO: 5050744 - DNA, 23 bp, Homo sapiens
atcattcagcaaatgccttttca

SEQ ID NO: 5050745 - DNA, 14 bp, Homo sapiens
atccattctctctg

SEQ ID NO: 5050746 - DNA, 15 bp, Homo sapiens
atccattctctctgc

SEQ ID NO: 5050747 - DNA, 18 bp, Homo sapiens
atcccacttagcagggac

SEQ ID NO: 5050748 - DNA, 13 bp, Homo sapiens
atcctggagcccc

SEQ ID NO: 5050749 - DNA, 16 bp, Homo sapiens
atcctggagcccctgt

SEQ ID NO: 5050750 - DNA, 21 bp, Homo sapiens
atctctgctgcttctgggcct

SEQ ID NO: 5050751 - DNA, 23 bp, Homo sapiens
atctggaagaaagccctgtgctt

SEQ ID NO: 5050752 - DNA, 23 bp, Homo sapiens
atctggggaaggaccaacccatg

SEQ ID NO: 5050753 - DNA, 15 bp, Homo sapiens
atgagcagtccagag

SEQ ID NO: 5050754 - DNA, 13 bp, Homo sapiens
atgaggggagggg

SEQ ID NO: 5050755 - DNA, 14 bp, Homo sapiens
atgcactggcctgt

SEQ ID NO: 5050756 - DNA, 24 bp, Homo sapiens
atgcactggcctgttctgtaggag

SEQ ID NO: 5050757 - DNA, 17 bp, Homo sapiens
atgcagcaatcccactt

SEQ ID NO: 5050758 - DNA, 17 bp, Homo sapiens
atgccctgccaagcctg

SEQ ID NO: 5050759 - DNA, 22 bp, Homo sapiens
atgccttttcaaatgcagcaat

SEQ ID NO: 5050760 - DNA, 17 bp, Homo sapiens
atggcagtctagggtga

SEQ ID NO: 5050761 - DNA, 22 bp, Homo sapiens
atggcatcatccattctctctg

SEQ ID NO: 5050762 - DNA, 23 bp, Homo sapiens
atggcatcatccattctctctgc

SEQ ID NO: 5050763 - DNA, 15 bp, Homo sapiens
atggccatggtaccc

SEQ ID NO: 5050764 - DNA, 12 bp, Homo sapiens
atggctgctgct

SEQ ID NO: 5050765 - DNA, 12 bp, Homo sapiens
atgggccaccgc

SEQ ID NO: 5050766 - DNA, 14 bp, Homo sapiens
atgggggcaagaag

SEQ ID NO: 5050767 - DNA, 15 bp, Homo sapiens
atggtacccccttct

SEQ ID NO: 5050768 - DNA, 22 bp, Homo sapiens
atgtaaaataaaggctctgtgc

SEQ ID NO: 5050769 - DNA, 11 bp, Homo sapiens
atgtctctgat

SEQ ID NO: 5050770 - DNA, 14 bp, Homo sapiens
atgtgggggaaggc

SEQ ID NO: 5050771 - DNA, 21 bp, Homo sapiens
attaaagtgccttcagccaag

SEQ ID NO: 5050772 - DNA, 21 bp, Homo sapiens
attcagcaaatgccttttcaa

SEQ ID NO: 5050773 - DNA, 18 bp, Homo sapiens
attctgttagctgctcac

SEQ ID NO: 5050774 - DNA, 23 bp, Homo sapiens
attctgttagctgctcacttaaa

SEQ ID NO: 5050775 - DNA, 16 bp, Homo sapiens
attcttgcttgaggaa

SEQ ID NO: 5050776 - DNA, 15 bp, Homo sapiens
attgggtgtgccctg

SEQ ID NO: 5050777 - DNA, 17 bp, Homo sapiens
attgggtgtgccctggc

SEQ ID NO: 5050778 - DNA, 12 bp, Homo sapiens
cccaagggaggc

SEQ ID NO: 5050779 - DNA, 20 bp, Homo sapiens
cccaagtccaaatgtttaca

SEQ ID NO: 5050780 - DNA, 13 bp, Homo sapiens
cccacacccagcc

SEQ ID NO: 5050781 - DNA, 14 bp, Homo sapiens
cctggagcccctgt

SEQ ID NO: 5050782 - DNA, 17 bp, Homo sapiens
cctggcgggatgggcca

SEQ ID NO: 5050783 - DNA, 19 bp, Homo sapiens
cctggctcccaagggaggc

SEQ ID NO: 5050784 - DNA, 21 bp, Homo sapiens
cctgggaacggggtggacgag

SEQ ID NO: 5050785 - DNA, 14 bp, Homo sapiens
cctgggctgggaga

SEQ ID NO: 5050786 - DNA, 17 bp, Homo sapiens
cctgggctgggagaagg

SEQ ID NO: 5050787 - DNA, 13 bp, Homo sapiens
cctggggaggctg

SEQ ID NO: 5050788 - DNA, 19 bp, Homo sapiens
cctggggaggctgagactg

SEQ ID NO: 5050789 - DNA, 20 bp, Homo sapiens
cctggggaggctgagactgc

SEQ ID NO: 5050790 - DNA, 21 bp, Homo sapiens
cctggggtgggtttagcaggc

SEQ ID NO: 5050791 - DNA, 23 bp, Homo sapiens
cctggggtgggtttagcaggctg

SEQ ID NO: 5050792 - DNA, 15 bp, Homo sapiens
cctggtgaagtgtga

SEQ ID NO: 5050793 - DNA, 15 bp, Homo sapiens
cctgtcatctgggcc

SEQ ID NO: 5050794 - DNA, 22 bp, Homo sapiens
cctgtgtcggggggcgagggag

SEQ ID NO: 5050795 - DNA, 18 bp, Homo sapiens
cctgtgtgggagggcgag

SEQ ID NO: 5050796 - DNA, 21 bp, Homo sapiens
cctgttcctcccaagaggcca

SEQ ID NO: 5050797 - DNA, 15 bp, Homo sapiens
cctgttctgtaggag

SEQ ID NO: 5050798 - DNA, 16 bp, Homo sapiens
cctgttctgtaggaga

SEQ ID NO: 5050799 - DNA, 18 bp, Homo sapiens
cctgttctgtaggagaga

SEQ ID NO: 5050800 - DNA, 23 bp, Homo sapiens
cctgtttgaagcctgcccttgtc

SEQ ID NO: 5050801 - DNA, 17 bp, Homo sapiens
ccttagggagggactgg

SEQ ID NO: 5050802 - DNA, 15 bp, Homo sapiens
ccttctctgtagctg

SEQ ID NO: 5050803 - DNA, 18 bp, Homo sapiens
ccttctgaacatgagtgt

SEQ ID NO: 5050804 - DNA, 23 bp, Homo sapiens
ccttctgaacatgagtgtcaact

SEQ ID NO: 5050805 - DNA, 20 bp, Homo sapiens
ccttctgggcatctgttctg

SEQ ID NO: 5050806 - DNA, 22 bp, Homo sapiens
ccttctgggcatctgttctggt

SEQ ID NO: 5050807 - DNA, 13 bp, Homo sapiens
ccttgccctgggc

SEQ ID NO: 5050808 - DNA, 14 bp, Homo sapiens
ccttgccctgggcc

SEQ ID NO: 5050809 - DNA, 21 bp, Homo sapiens
ccttgccctgggccagcccag

SEQ ID NO: 5050810 - DNA, 20 bp, Homo sapiens
cctttcccttttccatcatc

SEQ ID NO: 5050811 - DNA, 17 bp, Homo sapiens
cctttgcgtcaggagca

SEQ ID NO: 5050812 - DNA, 13 bp, Homo sapiens
ccttttaatcaga

SEQ ID NO: 5050813 - DNA, 20 bp, Homo sapiens
ccttttcaaatgcagcaatc

SEQ ID NO: 5050814 - DNA, 15 bp, Homo sapiens
ccttttccatcatct

SEQ ID NO: 5050815 - DNA, 17 bp, Homo sapiens
cgaggcctagagtggca

SEQ ID NO: 5050816 - DNA, 23 bp, Homo sapiens
cgaggcctagagtggcagccaag

SEQ ID NO: 5050817 - DNA, 15 bp, Homo sapiens
cgaggcgggggagcc

SEQ ID NO: 5050818 - DNA, 21 bp, Homo sapiens
cgaggcgggggagcctggagc

SEQ ID NO: 5050819 - DNA, 20 bp, Homo sapiens
cgaggcgggggatcctggag

SEQ ID NO: 5050820 - DNA, 17 bp, Homo sapiens
cgagggaggggaggtgg

SEQ ID NO: 5050821 - DNA, 18 bp, Homo sapiens
cgaggtggtagctctgag

SEQ ID NO: 5050822 - DNA, 17 bp, Homo sapiens
cgcacaatctacactgc

SEQ ID NO: 5050823 - DNA, 18 bp, Homo sapiens
cgccgactttgtaccccc

SEQ ID NO: 5050824 - DNA, 13 bp, Homo sapiens
cgcctgttccccc

SEQ ID NO: 5050825 - DNA, 19 bp, Homo sapiens
cgcctgttcccccgccgct

SEQ ID NO: 5050826 - DNA, 15 bp, Homo sapiens
cggatggaaggagag

SEQ ID NO: 5050827 - DNA, 21 bp, Homo sapiens
cggcactgggtttgctccctg

SEQ ID NO: 5050828 - DNA, 23 bp, Homo sapiens
cggctcctgcttttggggctctt

SEQ ID NO: 5050829 - DNA, 23 bp, Homo sapiens
cgggatattaaacctctttcccc

SEQ ID NO: 5050830 - DNA, 17 bp, Homo sapiens
cgggggatcctggagcc

SEQ ID NO: 5050831 - DNA, 17 bp, Homo sapiens
cggggtggacgagggag

SEQ ID NO: 5050832 - DNA, 18 bp, Homo sapiens
cggggtggacgagggagt

SEQ ID NO: 5050833 - DNA, 16 bp, Homo sapiens
cggtaggtgctggcct

SEQ ID NO: 5050834 - DNA, 12 bp, Homo sapiens
cggtgaggcagg

SEQ ID NO: 5050835 - DNA, 17 bp, Homo sapiens
cggtgaggcaggggagt

SEQ ID NO: 5050836 - DNA, 19 bp, Homo sapiens
cgtacacagagggacttga

SEQ ID NO: 5050837 - DNA, 17 bp, Homo sapiens
cgtaggggaggggttgc

SEQ ID NO: 5050838 - DNA, 15 bp, Homo sapiens
cgtcaggagcagcat

SEQ ID NO: 5050839 - DNA, 17 bp, Homo sapiens
cgtcaggagcagcatca

SEQ ID NO: 5050840 - DNA, 24 bp, Homo sapiens
cgtctggaggggcccctgcttctc

SEQ ID NO: 5050841 - DNA, 19 bp, Homo sapiens
cgttgccgggcctggactg

SEQ ID NO: 5050842 - DNA, 14 bp, Homo sapiens
ctaacctcactgcc

SEQ ID NO: 5050843 - DNA, 15 bp, Homo sapiens
ctaacctcactgcct

SEQ ID NO: 5050844 - DNA, 21 bp, Homo sapiens
ctacacctctgggccctgcag

SEQ ID NO: 5050845 - DNA, 16 bp, Homo sapiens
ctaccctacacctctg

SEQ ID NO: 5050846 - DNA, 18 bp, Homo sapiens
ctaccctacacctctggg

SEQ ID NO: 5050847 - DNA, 21 bp, Homo sapiens
ctacggagggaccaggtgtct

SEQ ID NO: 5050848 - DNA, 16 bp, Homo sapiens
ctagaaagatgaaaac

SEQ ID NO: 5050849 - DNA, 23 bp, Homo sapiens
ctagagtggcagccaagagccat

SEQ ID NO: 5050850 - DNA, 14 bp, Homo sapiens
ctagcctgctctgc

SEQ ID NO: 5050851 - DNA, 16 bp, Homo sapiens
ctagcctgctctgcca

SEQ ID NO: 5050852 - DNA, 17 bp, Homo sapiens
ctagcctgctctgccac

SEQ ID NO: 5050853 - DNA, 18 bp, Homo sapiens
ctagctaactaattctgt

SEQ ID NO: 5050854 - DNA, 18 bp, Homo sapiens
ctagtatctggctgggtt

SEQ ID NO: 5050855 - DNA, 20 bp, Homo sapiens
ctatgaacttggatattcaa

SEQ ID NO: 5050856 - DNA, 23 bp, Homo sapiens
ctcaaccacacacacctgtctgt

SEQ ID NO: 5050857 - DNA, 13 bp, Homo sapiens
ctcaaggtggctg

SEQ ID NO: 5050858 - DNA, 13 bp, Homo sapiens
ctcacatgcccgc

SEQ ID NO: 5050859 - DNA, 16 bp, Homo sapiens
ctcagccttggaagca

SEQ ID NO: 5050860 - DNA, 19 bp, Homo sapiens
ctcagtgttgactgtaggc

SEQ ID NO: 5050861 - DNA, 18 bp, Homo sapiens
ctccaaacaattctgatg

SEQ ID NO: 5050862 - DNA, 17 bp, Homo sapiens
ctccaacagagtggtgt

SEQ ID NO: 5050863 - DNA, 14 bp, Homo sapiens
ctccactggcctgc

SEQ ID NO: 5050864 - DNA, 19 bp, Homo sapiens
ctccagcctggacccccag

SEQ ID NO: 5050865 - DNA, 21 bp, Homo sapiens
ctccagcctggacccccagct

SEQ ID NO: 5050866 - DNA, 22 bp, Homo sapiens
ctccagcctggacccccagctt

SEQ ID NO: 5050867 - DNA, 20 bp, Homo sapiens
ctccaggacttgcttccaag

SEQ ID NO: 5050868 - DNA, 18 bp, Homo sapiens
ctcccaaggctgcgtctg

SEQ ID NO: 5050869 - DNA, 13 bp, Homo sapiens
ctccccctgtccc

SEQ ID NO: 5050870 - DNA, 13 bp, Homo sapiens
ctccctgagcctg

SEQ ID NO: 5050871 - DNA, 15 bp, Homo sapiens
ctccctgagcctgcc

SEQ ID NO: 5050872 - DNA, 23 bp, Homo sapiens
ctccctgagcctgccccagctgg

SEQ ID NO: 5050873 - DNA, 12 bp, Homo sapiens
ctccctgtttga

SEQ ID NO: 5050874 - DNA, 16 bp, Homo sapiens
ctccggcactgggttt

SEQ ID NO: 5050875 - DNA, 21 bp, Homo sapiens
ctccgttcccacctctgagga

SEQ ID NO: 5050876 - DNA, 17 bp, Homo sapiens
ctcctctttcctctctt

SEQ ID NO: 5050877 - DNA, 17 bp, Homo sapiens
ctcctgcccagtccccc

SEQ ID NO: 5050878 - DNA, 17 bp, Homo sapiens
ctcctggtgaagtgtga

SEQ ID NO: 5050879 - DNA, 14 bp, Homo sapiens
ctccttcttgccct

SEQ ID NO: 5050880 - DNA, 16 bp, Homo sapiens
ctccttgccctgggcc

SEQ ID NO: 5050881 - DNA, 17 bp, Homo sapiens
ctcgctcagtcagtgca

SEQ ID NO: 5050882 - DNA, 19 bp, Homo sapiens
ctcgctcagtcagtgcact

SEQ ID NO: 5050883 - DNA, 20 bp, Homo sapiens
ctcgctcagtcagtgcacta

SEQ ID NO: 5050884 - DNA, 12 bp, Homo sapiens
ctcggaggcccc

SEQ ID NO: 5050885 - DNA, 15 bp, Homo sapiens
ctcggaggccccaaa

SEQ ID NO: 5050886 - DNA, 18 bp, Homo sapiens
gtgggagggcgaggcggg

SEQ ID NO: 5050887 - DNA, 11 bp, Homo sapiens
gtgggggagcc

SEQ ID NO: 5050888 - DNA, 13 bp, Homo sapiens
gtgggggagcctg

SEQ ID NO: 5050889 - DNA, 16 bp, Homo sapiens
gtgggggagcctggag

SEQ ID NO: 5050890 - DNA, 13 bp, Homo sapiens
gtggggtctcagt

SEQ ID NO: 5050891 - DNA, 17 bp, Homo sapiens
gtggtagctctgagccc

SEQ ID NO: 5050892 - DNA, 18 bp, Homo sapiens
gtggtagctctgagccct

SEQ ID NO: 5050893 - DNA, 14 bp, Homo sapiens
gtgtcaactccagg

SEQ ID NO: 5050894 - DNA, 20 bp, Homo sapiens
gtgtcggggggcgagggagg

SEQ ID NO: 5050895 - DNA, 21 bp, Homo sapiens
gtgtgcagaattctaggcagc

SEQ ID NO: 5050896 - DNA, 23 bp, Homo sapiens
gtgtgccctggctcccaagggag

SEQ ID NO: 5050897 - DNA, 13 bp, Homo sapiens
gtgttctgagccc

SEQ ID NO: 5050898 - DNA, 13 bp, Homo sapiens
gttagctgctcac

SEQ ID NO: 5050899 - DNA, 14 bp, Homo sapiens
gttagctgctcact

SEQ ID NO: 5050900 - DNA, 14 bp, Homo sapiens
gttctcagctcccc

SEQ ID NO: 5050901 - DNA, 19 bp, Homo sapiens
gttctcagctccccctgtc

SEQ ID NO: 5050902 - DNA, 22 bp, Homo sapiens
gttctgcacccagccaaacaca

SEQ ID NO: 5050903 - DNA, 22 bp, Homo sapiens
gttctggtttttaaccattgtc

SEQ ID NO: 5050904 - DNA, 20 bp, Homo sapiens
gttctttgctggaccatcaa

SEQ ID NO: 5050905 - DNA, 16 bp, Homo sapiens
gttgaggatgcactgg

SEQ ID NO: 5050906 - DNA, 19 bp, Homo sapiens
gttgaggatgcactggcct

SEQ ID NO: 5050907 - DNA, 12 bp, Homo sapiens
gttgccacaggc

SEQ ID NO: 5050908 - DNA, 22 bp, Homo sapiens
gttgccgggcctggactgtcct

SEQ ID NO: 5050909 - DNA, 11 bp, Homo sapiens
gttgctctgta

SEQ ID NO: 5050910 - DNA, 18 bp, Homo sapiens
gttggaaggtagagccca

SEQ ID NO: 5050911 - DNA, 16 bp, Homo sapiens
gttggtggtgcagccc

SEQ ID NO: 5050912 - DNA, 16 bp, Homo sapiens
gtttacagggagcctc

SEQ ID NO: 5050913 - DNA, 17 bp, Homo sapiens
gtttacagggagcctcc

SEQ ID NO: 5050914 - DNA, 22 bp, Homo sapiens
taaaccacacacacaaggtgct

SEQ ID NO: 5050915 - DNA, 23 bp, Homo sapiens
taaaccacacacacaaggtgctc

SEQ ID NO: 5050916 - DNA, 20 bp, Homo sapiens
taaattctgttagctgctca

SEQ ID NO: 5050917 - DNA, 21 bp, Homo sapiens
taaattctgttagctgctcac

SEQ ID NO: 5050918 - DNA, 14 bp, Homo sapiens
taacctcactgcct

SEQ ID NO: 5050919 - DNA, 15 bp, Homo sapiens
taacctcactgcctc

SEQ ID NO: 5050920 - DNA, 17 bp, Homo sapiens
taacctcactgcctcat

SEQ ID NO: 5050921 - DNA, 12 bp, Homo sapiens
taactctccagt

SEQ ID NO: 5050922 - DNA, 16 bp, Homo sapiens
taaggagaggagagca

SEQ ID NO: 5050923 - DNA, 15 bp, Homo sapiens
taatcagagcccagg

SEQ ID NO: 5050924 - DNA, 21 bp, Homo sapiens
taatggccatggtaccccctt

SEQ ID NO: 5050925 - DNA, 21 bp, Homo sapiens
taattacctgtcatctgggcc

SEQ ID NO: 5050926 - DNA, 22 bp, Homo sapiens
tacacagagggacttgagccag

SEQ ID NO: 5050927 - DNA, 13 bp, Homo sapiens
tacacctctgggc

SEQ ID NO: 5050928 - DNA, 17 bp, Homo sapiens
tacactgccttaccttc

SEQ ID NO: 5050929 - DNA, 13 bp, Homo sapiens
tacagggagcctc

SEQ ID NO: 5050930 - DNA, 19 bp, Homo sapiens
tacaggtgtcaccatcatt

SEQ ID NO: 5050931 - DNA, 13 bp, Homo sapiens
tacatttttctga

SEQ ID NO: 5050932 - DNA, 22 bp, Homo sapiens
taccaggtgctagggtgcctgc

SEQ ID NO: 5050933 - DNA, 15 bp, Homo sapiens
taccatacagacagc

SEQ ID NO: 5050934 - DNA, 15 bp, Homo sapiens
tacccccctgagagc

SEQ ID NO: 5050935 - DNA, 13 bp, Homo sapiens
tacccccttctgg

SEQ ID NO: 5050936 - DNA, 17 bp, Homo sapiens
tacccccttctgggcat

SEQ ID NO: 5050937 - DNA, 17 bp, Homo sapiens
tacctgtcatctgggcc

SEQ ID NO: 5050938 - DNA, 15 bp, Homo sapiens
tacggagggaccagg

SEQ ID NO: 5050939 - DNA, 18 bp, Homo sapiens
tacgtgggagaggcagaa

SEQ ID NO: 5050940 - DNA, 20 bp, Homo sapiens
tactagctaactaattctgt

SEQ ID NO: 5050941 - DNA, 23 bp, Homo sapiens
tagaggcaacagtgttctgagcc

SEQ ID NO: 5050942 - DNA, 12 bp, Homo sapiens
tagcctgctctg

SEQ ID NO: 5050943 - DNA, 12 bp, Homo sapiens
tagctgctcact

SEQ ID NO: 5050944 - DNA, 22 bp, Homo sapiens
taggactttagggatctgggga

SEQ ID NO: 5050945 - DNA, 15 bp, Homo sapiens
taggtgctggcctca

SEQ ID NO: 5050946 - DNA, 21 bp, Homo sapiens
tagtagcctttcctgatgaca

SEQ ID NO: 5050947 - DNA, 15 bp, Homo sapiens
tataattttctaatt

SEQ ID NO: 5050948 - DNA, 14 bp, Homo sapiens
tattcaagcctttg

SEQ ID NO: 5050949 - DNA, 15 bp, Homo sapiens
tattctcatggcttt

SEQ ID NO: 5050950 - DNA, 21 bp, Homo sapiens
tatttgctggagtgctggctc

SEQ ID NO: 5050951 - DNA, 16 bp, Homo sapiens
tcaattaactctccag

SEQ ID NO: 5050952 - DNA, 11 bp, Homo sapiens
tcaccatcatt

SEQ ID NO: 5050953 - DNA, 12 bp, Homo sapiens
tcaccatcattt

SEQ ID NO: 5050954 - DNA, 17 bp, Homo sapiens
tcaccatcatttctagt

SEQ ID NO: 5050955 - DNA, 15 bp, Homo sapiens
tcactttctctctta

SEQ ID NO: 5050956 - DNA, 16 bp, Homo sapiens
tcagcaaatgcctttt

SEQ ID NO: 5050957 - DNA, 22 bp, Homo sapiens
tcagcaaatgccttttcaaatg

SEQ ID NO: 5050958 - DNA, 15 bp, Homo sapiens
tcagcaggagtggag

SEQ ID NO: 5050959 - DNA, 17 bp, Homo sapiens
tcagcatctttgccctt

SEQ ID NO: 5050960 - DNA, 20 bp, Homo sapiens
tcagcatctttgcccttctg

SEQ ID NO: 5050961 - DNA, 15 bp, Homo sapiens
tcagctccccctgtc

SEQ ID NO: 5050962 - DNA, 12 bp, Homo sapiens
tcagggctgggc

SEQ ID NO: 5050963 - DNA, 13 bp, Homo sapiens
tcagggctgggca

SEQ ID NO: 5050964 - DNA, 19 bp, Homo sapiens
tcagggctgggcaggtcct

SEQ ID NO: 5050965 - DNA, 13 bp, Homo sapiens
tcaggggctttgg

SEQ ID NO: 5050966 - DNA, 17 bp, Homo sapiens
tcatattctcatggctt

SEQ ID NO: 5050967 - DNA, 14 bp, Homo sapiens
aaaaagcacaagaa

SEQ ID NO: 5050968 - DNA, 15 bp, Homo sapiens
aaaaagcacaagaag

SEQ ID NO: 5050969 - DNA, 22 bp, Homo sapiens
aaaagcaatctggaagaaagcc

SEQ ID NO: 5050970 - DNA, 19 bp, Homo sapiens
aaaatcccaaagtgccttc

SEQ ID NO: 5050971 - DNA, 23 bp, Homo sapiens
aaacttttacatttttctgatgg

SEQ ID NO: 5050972 - DNA, 16 bp, Homo sapiens
aaagcaatctggaaga

SEQ ID NO: 5050973 - DNA, 23 bp, Homo sapiens
aaagcaatctggaagaaagccct

SEQ ID NO: 5050974 - DNA, 13 bp, Homo sapiens
aaaggctctgtgc

SEQ ID NO: 5050975 - DNA, 13 bp, Homo sapiens
aaataaaggctct

SEQ ID NO: 5050976 - DNA, 14 bp, Homo sapiens
aaataaaggctctg

SEQ ID NO: 5050977 - DNA, 23 bp, Homo sapiens
aaatgtaaaataaaggctctgtg

SEQ ID NO: 5050978 - DNA, 17 bp, Homo sapiens
acgtgggagaggcagaa

SEQ ID NO: 5050979 - DNA, 18 bp, Homo sapiens
actaaccccagctgccgg

SEQ ID NO: 5050980 - DNA, 23 bp, Homo sapiens
actaataaaaaactgtgaaccct

SEQ ID NO: 5050981 - DNA, 11 bp, Homo sapiens
actaattctgt

SEQ ID NO: 5050982 - DNA, 11 bp, Homo sapiens
actcagtgttg

SEQ ID NO: 5050983 - DNA, 14 bp, Homo sapiens
actcatattttgaa

SEQ ID NO: 5050984 - DNA, 20 bp, Homo sapiens
actccctttgcgtcaggagc

SEQ ID NO: 5050985 - DNA, 21 bp, Homo sapiens
actctccagttatcagtactc

SEQ ID NO: 5050986 - DNA, 22 bp, Homo sapiens
actgaaaaaaaaaaaaatccca

SEQ ID NO: 5050987 - DNA, 20 bp, Homo sapiens
actgcagaggagccacctgg

SEQ ID NO: 5050988 - DNA, 16 bp, Homo sapiens
actggccagaggcagc

SEQ ID NO: 5050989 - DNA, 18 bp, Homo sapiens
acttagcagggacaggag

SEQ ID NO: 5050990 - DNA, 19 bp, Homo sapiens
acttcgaattagtttgcac

SEQ ID NO: 5050991 - DNA, 17 bp, Homo sapiens
acttgcttccaagccct

SEQ ID NO: 5050992 - DNA, 19 bp, Homo sapiens
acttgcttccaagcccttc

SEQ ID NO: 5050993 - DNA, 13 bp, Homo sapiens
acttgtctttgat

SEQ ID NO: 5050994 - DNA, 21 bp, Homo sapiens
acttttacatttttctgatgg

SEQ ID NO: 5050995 - DNA, 16 bp, Homo sapiens
agaaagccctgtgctt

SEQ ID NO: 5050996 - DNA, 19 bp, Homo sapiens
agaagatcacgctccccgc

SEQ ID NO: 5050997 - DNA, 23 bp, Homo sapiens
agaagatcacgctccccgcctgt

SEQ ID NO: 5050998 - DNA, 21 bp, Homo sapiens
agaaggtgcttgggcttctgc

SEQ ID NO: 5050999 - DNA, 19 bp, Homo sapiens
agacaaactccggcactgg

SEQ ID NO: 5051000 - DNA, 23 bp, Homo sapiens
agacactgtgcaaattttttgaa

SEQ ID NO: 5051001 - DNA, 17 bp, Homo sapiens
agacagcacaaggtggc

SEQ ID NO: 5051002 - DNA, 18 bp, Homo sapiens
agacatgaaatgtacatg

SEQ ID NO: 5051003 - DNA, 20 bp, Homo sapiens
agaccatctctccctcctgg

SEQ ID NO: 5051004 - DNA, 16 bp, Homo sapiens
agacggatggaaggag

SEQ ID NO: 5051005 - DNA, 18 bp, Homo sapiens
agacggatggaaggagag

SEQ ID NO: 5051006 - DNA, 17 bp, Homo sapiens
agacgtaggggaggggt

SEQ ID NO: 5051007 - DNA, 12 bp, Homo sapiens
agagactggcca

SEQ ID NO: 5051008 - DNA, 19 bp, Homo sapiens
agagactggccagaggcag

SEQ ID NO: 5051009 - DNA, 16 bp, Homo sapiens
agagcatctgctctga

SEQ ID NO: 5051010 - DNA, 18 bp, Homo sapiens
agagcatctgctctgaga

SEQ ID NO: 5051011 - DNA, 20 bp, Homo sapiens
agagcatctgctctgagacg

SEQ ID NO: 5051012 - DNA, 18 bp, Homo sapiens
agagcatgtgggggaagg

SEQ ID NO: 5051013 - DNA, 22 bp, Homo sapiens
agaggagagcatctgctctgag

SEQ ID NO: 5051014 - DNA, 23 bp, Homo sapiens
agaggagagcatctgctctgaga

SEQ ID NO: 5051015 - DNA, 22 bp, Homo sapiens
agaggagagtacccccctgaga

SEQ ID NO: 5051016 - DNA, 19 bp, Homo sapiens
agaggagccacctgggctg

SEQ ID NO: 5051017 - DNA, 23 bp, Homo sapiens
agaggcaacagtgttctgagccc

SEQ ID NO: 5051018 - DNA, 19 bp, Homo sapiens
agaggccagggtggccagg

SEQ ID NO: 5051019 - DNA, 16 bp, Homo sapiens
agagtacccccctgag

SEQ ID NO: 5051020 - DNA, 15 bp, Homo sapiens
agatcacgctccccg

SEQ ID NO: 5051021 - DNA, 21 bp, Homo sapiens
agatcacgctccccgcctgtt

SEQ ID NO: 5051022 - DNA, 22 bp, Homo sapiens
agatcacgctccccgcctgttc

SEQ ID NO: 5051023 - DNA, 23 bp, Homo sapiens
agatcacgctccccgcctgttcc

SEQ ID NO: 5051024 - DNA, 18 bp, Homo sapiens
agcaaacttataaatcat

SEQ ID NO: 5051025 - DNA, 15 bp, Homo sapiens
agcaagcaattctgc

SEQ ID NO: 5051026 - DNA, 11 bp, Homo sapiens
agcaattctgc

SEQ ID NO: 5051027 - DNA, 21 bp, Homo sapiens
agcaggctgcagcaggcagag

SEQ ID NO: 5051028 - DNA, 14 bp, Homo sapiens
agcatcattcagca

SEQ ID NO: 5051029 - DNA, 22 bp, Homo sapiens
agcatgtgggggaaggccttgc

SEQ ID NO: 5051030 - DNA, 23 bp, Homo sapiens
agcatgtgggggaaggccttgct

SEQ ID NO: 5051031 - DNA, 15 bp, Homo sapiens
agcattctgcctgcc

SEQ ID NO: 5051032 - DNA, 23 bp, Homo sapiens
agccaagaccatctctccctcct

SEQ ID NO: 5051033 - DNA, 16 bp, Homo sapiens
agccacctctctgcct

SEQ ID NO: 5051034 - DNA, 12 bp, Homo sapiens
agccacctgggc

SEQ ID NO: 5051035 - DNA, 14 bp, Homo sapiens
agccacctgggctg

SEQ ID NO: 5051036 - DNA, 21 bp, Homo sapiens
agccacctgggctgggagaag

SEQ ID NO: 5051037 - DNA, 22 bp, Homo sapiens
agccagctcctttcccttttcc

SEQ ID NO: 5051038 - DNA, 20 bp, Homo sapiens
agccagttacctttgctgtc

SEQ ID NO: 5051039 - DNA, 23 bp, Homo sapiens
agccagttacctttgctgtcact

SEQ ID NO: 5051040 - DNA, 15 bp, Homo sapiens
agccccaggaccaag

SEQ ID NO: 5051041 - DNA, 21 bp, Homo sapiens
agccctccttcttgccctgag

SEQ ID NO: 5051042 - DNA, 22 bp, Homo sapiens
agccctccttcttgccctgagc

SEQ ID NO: 5051043 - DNA, 12 bp, Homo sapiens
agccctgtgctt

SEQ ID NO: 5051044 - DNA, 12 bp, Homo sapiens
agccgctcggag

SEQ ID NO: 5051045 - DNA, 18 bp, Homo sapiens
agcctccgttcccacctc

SEQ ID NO: 5051046 - DNA, 15 bp, Homo sapiens
agcctcctgcccagt

SEQ ID NO: 5051047 - DNA, 16 bp, Homo sapiens
agcctcctgcccagtc

SEQ ID NO: 5051048 - DNA, 11 bp, Homo sapiens
agcctgctctg

SEQ ID NO: 5051049 - DNA, 14 bp, Homo sapiens
agcctgctctgcca

SEQ ID NO: 5051050 - DNA, 16 bp, Homo sapiens
agcctggacccccagc

SEQ ID NO: 5051051 - DNA, 16 bp, Homo sapiens
agcctggagcccctgt

SEQ ID NO: 5051052 - DNA, 20 bp, Homo sapiens
agcctggagcccctgtgtgg

SEQ ID NO: 5051053 - DNA, 22 bp, Homo sapiens
agcctggagcccctgtgtggga

SEQ ID NO: 5051054 - DNA, 12 bp, Homo sapiens
agccttcccatt

SEQ ID NO: 5051055 - DNA, 13 bp, Homo sapiens
agccttcccattt

SEQ ID NO: 5051056 - DNA, 14 bp, Homo sapiens
agctccccctgtcc

SEQ ID NO: 5051057 - DNA, 16 bp, Homo sapiens
agctccccctgtcccc

SEQ ID NO: 5051058 - DNA, 11 bp, Homo sapiens
agctctgagcc

SEQ ID NO: 5051059 - DNA, 14 bp, Homo sapiens
agctctgagccctc

SEQ ID NO: 5051060 - DNA, 16 bp, Homo sapiens
agcttaaggagaggag

SEQ ID NO: 5051061 - DNA, 17 bp, Homo sapiens
agcttaaggagaggaga

SEQ ID NO: 5051062 - DNA, 21 bp, Homo sapiens
agctttccggggaggagcctt

SEQ ID NO: 5051063 - DNA, 11 bp, Homo sapiens
agctttctaac

SEQ ID NO: 5051064 - DNA, 16 bp, Homo sapiens
agctttctaactcaca

SEQ ID NO: 5051065 - DNA, 15 bp, Homo sapiens
aggaaaaagcacaag

SEQ ID NO: 5051066 - DNA, 18 bp, Homo sapiens
aggaagatgggggcaaga

SEQ ID NO: 5051067 - DNA, 18 bp, Homo sapiens
aggaccaacccatgccct

SEQ ID NO: 5051068 - DNA, 23 bp, Homo sapiens
aggaccaagcttaaggagaggag

SEQ ID NO: 5051069 - DNA, 22 bp, Homo sapiens
aggacttgcttccaagcccttc

SEQ ID NO: 5051070 - DNA, 18 bp, Homo sapiens
aggactttagggatctgg

SEQ ID NO: 5051071 - DNA, 15 bp, Homo sapiens
aggagagcatctgct

SEQ ID NO: 5051072 - DNA, 20 bp, Homo sapiens
aggagagcatctgctctgag

SEQ ID NO: 5051073 - DNA, 13 bp, Homo sapiens
aggagaggagagc

SEQ ID NO: 5051074 - DNA, 15 bp, Homo sapiens
aggagaggagagcat

SEQ ID NO: 5051075 - DNA, 13 bp, Homo sapiens
aggagcagcatca

SEQ ID NO: 5051076 - DNA, 13 bp, Homo sapiens
aggagccttggag

SEQ ID NO: 5051077 - DNA, 19 bp, Homo sapiens
aggattgtacgtgggagag

SEQ ID NO: 5051078 - DNA, 15 bp, Homo sapiens
aggcaggggagtctg

SEQ ID NO: 5051079 - DNA, 14 bp, Homo sapiens
aggcatagagtgac

SEQ ID NO: 5051080 - DNA, 22 bp, Homo sapiens
aggccccaaaggaaaaagcaca

SEQ ID NO: 5051081 - DNA, 14 bp, Homo sapiens
atttattttctcaa

SEQ ID NO: 5051082 - DNA, 21 bp, Homo sapiens
atttgctggagtgctggctcc

SEQ ID NO: 5051083 - DNA, 14 bp, Homo sapiens
caaacaattctgat

SEQ ID NO: 5051084 - DNA, 14 bp, Homo sapiens
caaactctgtgtca

SEQ ID NO: 5051085 - DNA, 14 bp, Homo sapiens
caaatgccttttca

SEQ ID NO: 5051086 - DNA, 20 bp, Homo sapiens
caaatgtttacagggagcct

SEQ ID NO: 5051087 - DNA, 22 bp, Homo sapiens
caaatgtttacagggagcctcc

SEQ ID NO: 5051088 - DNA, 22 bp, Homo sapiens
caacaccagcccctgccccagc

SEQ ID NO: 5051089 - DNA, 17 bp, Homo sapiens
caaccacacacacctgt

SEQ ID NO: 5051090 - DNA, 19 bp, Homo sapiens
caaccacacacacctgtct

SEQ ID NO: 5051091 - DNA, 16 bp, Homo sapiens
caacccatgccctgcc

SEQ ID NO: 5051092 - DNA, 16 bp, Homo sapiens
caacccctgaggaaga

SEQ ID NO: 5051093 - DNA, 21 bp, Homo sapiens
caagaagcgtgagacgccacc

SEQ ID NO: 5051094 - DNA, 21 bp, Homo sapiens
caagcaattctgccccacacc

SEQ ID NO: 5051095 - DNA, 17 bp, Homo sapiens
caagcctggagcccctg

SEQ ID NO: 5051096 - DNA, 18 bp, Homo sapiens
caagcttaaggagaggag

SEQ ID NO: 5051097 - DNA, 15 bp, Homo sapiens
caaggtggcagcaag

SEQ ID NO: 5051098 - DNA, 16 bp, Homo sapiens
caaggtggcagcaagc

SEQ ID NO: 5051099 - DNA, 20 bp, Homo sapiens
caaggtgggggagcctggag

SEQ ID NO: 5051100 - DNA, 22 bp, Homo sapiens
caaggtgggggagcctggagcc

SEQ ID NO: 5051101 - DNA, 15 bp, Homo sapiens
caagtccaaatgttt

SEQ ID NO: 5051102 - DNA, 22 bp, Homo sapiens
caatacccctagtatctggctg

SEQ ID NO: 5051103 - DNA, 22 bp, Homo sapiens
caatcccacttagcagggacag

SEQ ID NO: 5051104 - DNA, 15 bp, Homo sapiens
caatctacactgcct

SEQ ID NO: 5051105 - DNA, 16 bp, Homo sapiens
caatctacactgcctt

SEQ ID NO: 5051106 - DNA, 13 bp, Homo sapiens
caatctggaagaa

SEQ ID NO: 5051107 - DNA, 22 bp, Homo sapiens
caatctggaagaaagccctgtg

SEQ ID NO: 5051108 - DNA, 14 bp, Homo sapiens
caattaactctcca

SEQ ID NO: 5051109 - DNA, 16 bp, Homo sapiens
caattaactctccagt

SEQ ID NO: 5051110 - DNA, 22 bp, Homo sapiens
caattaactctccagttatcag

SEQ ID NO: 5051111 - DNA, 11 bp, Homo sapiens
caattctgatg

SEQ ID NO: 5051112 - DNA, 20 bp, Homo sapiens
cacaaggtggcagcaagcaa

SEQ ID NO: 5051113 - DNA, 12 bp, Homo sapiens
cacacaaggtgc

SEQ ID NO: 5051114 - DNA, 16 bp, Homo sapiens
cacacaaggtgctcag

SEQ ID NO: 5051115 - DNA, 17 bp, Homo sapiens
cacacacctgtctgtgc

SEQ ID NO: 5051116 - DNA, 13 bp, Homo sapiens
cacacccagccag

SEQ ID NO: 5051117 - DNA, 13 bp, Homo sapiens
cacagatctcttg

SEQ ID NO: 5051118 - DNA, 13 bp, Homo sapiens
cacaggcctccct

SEQ ID NO: 5051119 - DNA, 14 bp, Homo sapiens
cacaggcctccctg

SEQ ID NO: 5051120 - DNA, 16 bp, Homo sapiens
cacatgctgagtctcc

SEQ ID NO: 5051121 - DNA, 13 bp, Homo sapiens
caccagcccctgc

SEQ ID NO: 5051122 - DNA, 15 bp, Homo sapiens
caccagcccctgccc

SEQ ID NO: 5051123 - DNA, 19 bp, Homo sapiens
caccagcccctgccccagc

SEQ ID NO: 5051124 - DNA, 21 bp, Homo sapiens
caccagcccctgccccagccc

SEQ ID NO: 5051125 - DNA, 15 bp, Homo sapiens
caccagctccactgg

SEQ ID NO: 5051126 - DNA, 13 bp, Homo sapiens
caccattcctgga

SEQ ID NO: 5051127 - DNA, 17 bp, Homo sapiens
cacccactaccatacag

SEQ ID NO: 5051128 - DNA, 21 bp, Homo sapiens
caccctcctagcctgctctgc

SEQ ID NO: 5051129 - DNA, 18 bp, Homo sapiens
cacctctctgcctgttcc

SEQ ID NO: 5051130 - DNA, 12 bp, Homo sapiens
cacctctgggcc

SEQ ID NO: 5051131 - DNA, 17 bp, Homo sapiens
cacctctgggccctgca

SEQ ID NO: 5051132 - DNA, 22 bp, Homo sapiens
cacctgggctgggagaaggtgc

SEQ ID NO: 5051133 - DNA, 20 bp, Homo sapiens
cacgaggtggtagctctgag

SEQ ID NO: 5051134 - DNA, 15 bp, Homo sapiens
cacgctccccgcctg

SEQ ID NO: 5051135 - DNA, 16 bp, Homo sapiens
cacgctccccgcctgt

SEQ ID NO: 5051136 - DNA, 20 bp, Homo sapiens
cacgctccccgcctgttccc

SEQ ID NO: 5051137 - DNA, 21 bp, Homo sapiens
cactccctttgcgtcaggagc

SEQ ID NO: 5051138 - DNA, 22 bp, Homo sapiens
cactccctttgcgtcaggagca

SEQ ID NO: 5051139 - DNA, 23 bp, Homo sapiens
cactccctttgcgtcaggagcag

SEQ ID NO: 5051140 - DNA, 23 bp, Homo sapiens
cactgctcattgtataagccccg

SEQ ID NO: 5051141 - DNA, 19 bp, Homo sapiens
cagaacacagatctcttgt

SEQ ID NO: 5051142 - DNA, 11 bp, Homo sapiens
cagacagcaca

SEQ ID NO: 5051143 - DNA, 17 bp, Homo sapiens
cagacgtaggggagggg

SEQ ID NO: 5051144 - DNA, 16 bp, Homo sapiens
cagagcccagggaaga

SEQ ID NO: 5051145 - DNA, 22 bp, Homo sapiens
cagagcccagggaagacacatg

SEQ ID NO: 5051146 - DNA, 17 bp, Homo sapiens
cagaggagagtaccccc

SEQ ID NO: 5051147 - DNA, 16 bp, Homo sapiens
cagaggagccacctgg

SEQ ID NO: 5051148 - DNA, 23 bp, Homo sapiens
cagaggagccacctgggctggga

SEQ ID NO: 5051149 - DNA, 19 bp, Homo sapiens
cagagtaacgagaagacaa

SEQ ID NO: 5051150 - DNA, 20 bp, Homo sapiens
cagagtaacgagaagacaaa

SEQ ID NO: 5051151 - DNA, 19 bp, Homo sapiens
cagatgctttgcccaggct

SEQ ID NO: 5051152 - DNA, 21 bp, Homo sapiens
cagatgctttgcccaggcttc

SEQ ID NO: 5051153 - DNA, 17 bp, Homo sapiens
cagcaagcaattctgcc

SEQ ID NO: 5051154 - DNA, 22 bp, Homo sapiens
cagcaatcccacttagcaggga

SEQ ID NO: 5051155 - DNA, 16 bp, Homo sapiens
cagcaggcagaggaga

SEQ ID NO: 5051156 - DNA, 18 bp, Homo sapiens
cagcaggcagaggagagt

SEQ ID NO: 5051157 - DNA, 17 bp, Homo sapiens
cagcagtcaattaactc

SEQ ID NO: 5051158 - DNA, 17 bp, Homo sapiens
cagcatctttgcccttc

SEQ ID NO: 5051159 - DNA, 18 bp, Homo sapiens
cagccaagagccatctga

SEQ ID NO: 5051160 - DNA, 15 bp, Homo sapiens
cagccacgaggtggt

SEQ ID NO: 5051161 - DNA, 16 bp, Homo sapiens
cagccagctcctttcc

SEQ ID NO: 5051162 - DNA, 19 bp, Homo sapiens
cagccagctcctttccctt

SEQ ID NO: 5051163 - DNA, 23 bp, Homo sapiens
cagcggggcctggcgggatgggc

SEQ ID NO: 5051164 - DNA, 19 bp, Homo sapiens
cagctaaggggcaggaatc

SEQ ID NO: 5051165 - DNA, 15 bp, Homo sapiens
cagctccactggcct

SEQ ID NO: 5051166 - DNA, 16 bp, Homo sapiens
cagctccactggcctg

SEQ ID NO: 5051167 - DNA, 17 bp, Homo sapiens
cagctccactggcctgc

SEQ ID NO: 5051168 - DNA, 14 bp, Homo sapiens
cagctccccctgtc

SEQ ID NO: 5051169 - DNA, 18 bp, Homo sapiens
cagctccccctgtcccct

SEQ ID NO: 5051170 - DNA, 21 bp, Homo sapiens
cagctccccctgtcccctcag

SEQ ID NO: 5051171 - DNA, 22 bp, Homo sapiens
cagctccccctgtcccctcagc

SEQ ID NO: 5051172 - DNA, 15 bp, Homo sapiens
cagctgccggcagtg

SEQ ID NO: 5051173 - DNA, 18 bp, Homo sapiens
cagctgccggcagtgctg

SEQ ID NO: 5051174 - DNA, 11 bp, Homo sapiens
cagctgggctg

SEQ ID NO: 5051175 - DNA, 17 bp, Homo sapiens
cagctgggctgttggct

SEQ ID NO: 5051176 - DNA, 20 bp, Homo sapiens
cagctgggctgttggctggg

SEQ ID NO: 5051177 - DNA, 22 bp, Homo sapiens
caggaaggaactcaaggtggct

SEQ ID NO: 5051178 - DNA, 18 bp, Homo sapiens
caggaatcaaggagcctc

SEQ ID NO: 5051179 - DNA, 20 bp, Homo sapiens
caggaccaagcttaaggaga

SEQ ID NO: 5051180 - DNA, 21 bp, Homo sapiens
caggaccaagcttaaggagag

SEQ ID NO: 5051181 - DNA, 13 bp, Homo sapiens
caggaggcctggg

SEQ ID NO: 5051182 - DNA, 16 bp, Homo sapiens
caggaggcctgggagg

SEQ ID NO: 5051183 - DNA, 15 bp, Homo sapiens
caggccataccaggt

SEQ ID NO: 5051184 - DNA, 20 bp, Homo sapiens
caggctgcagcaggcagagg

SEQ ID NO: 5051185 - DNA, 12 bp, Homo sapiens
cagggagcctcc

SEQ ID NO: 5051186 - DNA, 13 bp, Homo sapiens
cagggagcctcct

SEQ ID NO: 5051187 - DNA, 15 bp, Homo sapiens
cagggagcctcctgc

SEQ ID NO: 5051188 - DNA, 18 bp, Homo sapiens
cagggagcctcctgccca

SEQ ID NO: 5051189 - DNA, 17 bp, Homo sapiens
caggggagtctgcttgt

SEQ ID NO: 5051190 - DNA, 18 bp, Homo sapiens
caggggtctccctgagcc

SEQ ID NO: 5051191 - DNA, 16 bp, Homo sapiens
cagggtggccaggggt

SEQ ID NO: 5051192 - DNA, 12 bp, Homo sapiens
caggtcctgggg

SEQ ID NO: 5051193 - DNA, 14 bp, Homo sapiens
caggtcctggggag

SEQ ID NO: 5051194 - DNA, 17 bp, Homo sapiens
caggtcctggggaggct

SEQ ID NO: 5051195 - DNA, 21 bp, Homo sapiens
caggtcctggggaggctgaga

SEQ ID NO: 5051196 - DNA, 16 bp, Homo sapiens
caggtgctagggtgcc

SEQ ID NO: 5051197 - DNA, 19 bp, Homo sapiens
caggtgctagggtgcctgc

SEQ ID NO: 5051198 - DNA, 22 bp, Homo sapiens
caggtgctagggtgcctgctct

SEQ ID NO: 5051199 - DNA, 17 bp, Homo sapiens
caggtgtcaccatcatt

SEQ ID NO: 5051200 - DNA, 18 bp, Homo sapiens
caggtgtctagaggcaac

SEQ ID NO: 5051201 - DNA, 21 bp, Homo sapiens
cagtaacaaaattgacagctt

SEQ ID NO: 5051202 - DNA, 16 bp, Homo sapiens
cagtcccccaacccca

SEQ ID NO: 5051203 - DNA, 15 bp, Homo sapiens
cagtggggtctcagt

SEQ ID NO: 5051204 - DNA, 22 bp, Homo sapiens
cagtgtgctaacctcactgcct

SEQ ID NO: 5051205 - DNA, 14 bp, Homo sapiens
cagtgttcatgcga

SEQ ID NO: 5051206 - DNA, 17 bp, Homo sapiens
cagttacctttgctgtc

SEQ ID NO: 5051207 - DNA, 18 bp, Homo sapiens
cagttacctttgctgtca

SEQ ID NO: 5051208 - DNA, 19 bp, Homo sapiens
cagttacctttgctgtcac

SEQ ID NO: 5051209 - DNA, 13 bp, Homo sapiens
catcaagggtcat

SEQ ID NO: 5051210 - DNA, 10 bp, Homo sapiens
catcatctct

SEQ ID NO: 5051211 - DNA, 14 bp, Homo sapiens
catcatctcttttc

SEQ ID NO: 5051212 - DNA, 17 bp, Homo sapiens
catccattctctctgcc

SEQ ID NO: 5051213 - DNA, 14 bp, Homo sapiens
catctctgctgctt

SEQ ID NO: 5051214 - DNA, 13 bp, Homo sapiens
catctgaagccac

SEQ ID NO: 5051215 - DNA, 13 bp, Homo sapiens
catctgctctgag

SEQ ID NO: 5051216 - DNA, 16 bp, Homo sapiens
catctgggccaccagc

SEQ ID NO: 5051217 - DNA, 12 bp, Homo sapiens
catctgttctgg

SEQ ID NO: 5051218 - DNA, 15 bp, Homo sapiens
catctttgcccttct

SEQ ID NO: 5051219 - DNA, 22 bp, Homo sapiens
catgccctgccaagcctggagc

SEQ ID NO: 5051220 - DNA, 24 bp, Homo sapiens
catgcctcgctcagtcagtgcact

SEQ ID NO: 5051221 - DNA, 14 bp, Homo sapiens
catgctgagtctcc

SEQ ID NO: 5051222 - DNA, 14 bp, Homo sapiens
catggcagtgcctg

SEQ ID NO: 5051223 - DNA, 18 bp, Homo sapiens
catgggggaggctctgaa

SEQ ID NO: 5051224 - DNA, 21 bp, Homo sapiens
catgggggaggctctgaagag

SEQ ID NO: 5051225 - DNA, 21 bp, Homo sapiens
catggtacccccttctgggca

SEQ ID NO: 5051226 - DNA, 19 bp, Homo sapiens
catgtagtagcctttcctg

SEQ ID NO: 5051227 - DNA, 17 bp, Homo sapiens
catgttgactgtcttga

SEQ ID NO: 5051228 - DNA, 19 bp, Homo sapiens
cattcagcaaatgcctttt

SEQ ID NO: 5051229 - DNA, 19 bp, Homo sapiens
cattcctggaaaccacagt

SEQ ID NO: 5051230 - DNA, 12 bp, Homo sapiens
cattctctctgc

SEQ ID NO: 5051231 - DNA, 15 bp, Homo sapiens
cattctctctgccca

SEQ ID NO: 5051232 - DNA, 16 bp, Homo sapiens
cattctgcctgcctgg

SEQ ID NO: 5051233 - DNA, 17 bp, Homo sapiens
cattctgcctgcctggg

SEQ ID NO: 5051234 - DNA, 18 bp, Homo sapiens
cattctgcctgcctggga

SEQ ID NO: 5051235 - DNA, 14 bp, Homo sapiens
cattgtataagccc

SEQ ID NO: 5051236 - DNA, 14 bp, Homo sapiens
catttttctgatgg

SEQ ID NO: 5051237 - DNA, 14 bp, Homo sapiens
ccaaacaattctga

SEQ ID NO: 5051238 - DNA, 17 bp, Homo sapiens
ccaaaggaaaaagcaca

SEQ ID NO: 5051239 - DNA, 23 bp, Homo sapiens
ccaaaggaaaaagcacaagaagc

SEQ ID NO: 5051240 - DNA, 23 bp, Homo sapiens
ccaaatgtttacagggagcctcc

SEQ ID NO: 5051241 - DNA, 17 bp, Homo sapiens
ccaacaccagcccctgc

SEQ ID NO: 5051242 - DNA, 16 bp, Homo sapiens
ccaagaggccagggtg

SEQ ID NO: 5051243 - DNA, 16 bp, Homo sapiens
ccaagcctggagcccc

SEQ ID NO: 5051244 - DNA, 22 bp, Homo sapiens
ccaagcctggagcccctgtgtt

SEQ ID NO: 5051245 - DNA, 16 bp, Homo sapiens
ccaagcttaaggagag

SEQ ID NO: 5051246 - DNA, 22 bp, Homo sapiens
ccaagcttaaggagaggagagc

SEQ ID NO: 5051247 - DNA, 17 bp, Homo sapiens
ccaaggctgcgtctgga

SEQ ID NO: 5051248 - DNA, 19 bp, Homo sapiens
ccaagggaggcccatgtga

SEQ ID NO: 5051249 - DNA, 15 bp, Homo sapiens
ccaagttgctctgta

SEQ ID NO: 5051250 - DNA, 17 bp, Homo sapiens
ccacagagtgtggtccc

SEQ ID NO: 5051251 - DNA, 16 bp, Homo sapiens
ccacaggcctccctgt

SEQ ID NO: 5051252 - DNA, 19 bp, Homo sapiens
ccaccagctccactggcct

SEQ ID NO: 5051253 - DNA, 14 bp, Homo sapiens
ccaccattcctgga

SEQ ID NO: 5051254 - DNA, 15 bp, Homo sapiens
ccaccattcctggaa

SEQ ID NO: 5051255 - DNA, 14 bp, Homo sapiens
ccacctgggctggg

SEQ ID NO: 5051256 - DNA, 23 bp, Homo sapiens
ccacgaggtggtagctctgagcc

SEQ ID NO: 5051257 - DNA, 12 bp, Homo sapiens
ccacgccctggg

SEQ ID NO: 5051258 - DNA, 15 bp, Homo sapiens
ccacgccctggggag

SEQ ID NO: 5051259 - DNA, 18 bp, Homo sapiens
ccacgccctggggagtga

SEQ ID NO: 5051260 - DNA, 19 bp, Homo sapiens
ccacgccctggggagtgag

SEQ ID NO: 5051261 - DNA, 17 bp, Homo sapiens
ccagacgtaggggaggg

SEQ ID NO: 5051262 - DNA, 17 bp, Homo sapiens
ccagagcttcagggctg

SEQ ID NO: 5051263 - DNA, 23 bp, Homo sapiens
ccagaggcagctaaggggcagga

SEQ ID NO: 5051264 - DNA, 12 bp, Homo sapiens
ccagcccaggat

SEQ ID NO: 5051265 - DNA, 20 bp, Homo sapiens
ccagcccctgccccagccca

SEQ ID NO: 5051266 - DNA, 19 bp, Homo sapiens
ccagccgctcggaggcccc

SEQ ID NO: 5051267 - DNA, 18 bp, Homo sapiens
ccagcctggacccccagc

SEQ ID NO: 5051268 - DNA, 19 bp, Homo sapiens
ccagcctggacccccagct

SEQ ID NO: 5051269 - DNA, 19 bp, Homo sapiens
ccagctttgcccaacacca

SEQ ID NO: 5051270 - DNA, 22 bp, Homo sapiens
ccagctttgcccaacaccagcc

SEQ ID NO: 5051271 - DNA, 19 bp, Homo sapiens
ccaggattgtacgtgggag

SEQ ID NO: 5051272 - DNA, 22 bp, Homo sapiens
ccaggggtctccctgagcctgc

SEQ ID NO: 5051273 - DNA, 22 bp, Homo sapiens
ccaggggtggtgagggcagttc

SEQ ID NO: 5051274 - DNA, 18 bp, Homo sapiens
ccaggtgtctagaggcaa

SEQ ID NO: 5051275 - DNA, 15 bp, Homo sapiens
ccagtcccccaaccc

SEQ ID NO: 5051276 - DNA, 20 bp, Homo sapiens
ccagtcccccaaccccagcc

SEQ ID NO: 5051277 - DNA, 22 bp, Homo sapiens
ccagtcctcacatgcccgctgt

SEQ ID NO: 5051278 - DNA, 13 bp, Homo sapiens
ccatacagacagc

SEQ ID NO: 5051279 - DNA, 14 bp, Homo sapiens
ccatacagacagca

SEQ ID NO: 5051280 - DNA, 21 bp, Homo sapiens
ccatcatctcttttcccactc

SEQ ID NO: 5051281 - DNA, 22 bp, Homo sapiens
ccatcatctcttttcccactcc

SEQ ID NO: 5051282 - DNA, 16 bp, Homo sapiens
ccatctctccctcctg

SEQ ID NO: 5051283 - DNA, 20 bp, Homo sapiens
ccatctctgctgcttctggg

SEQ ID NO: 5051284 - DNA, 18 bp, Homo sapiens
ccatgccctgccaagcct

SEQ ID NO: 5051285 - DNA, 14 bp, Homo sapiens
ccatggtaccccct

SEQ ID NO: 5051286 - DNA, 15 bp, Homo sapiens
ccatggtaccccctt

SEQ ID NO: 5051287 - DNA, 18 bp, Homo sapiens
ccatggtacccccttctg

SEQ ID NO: 5051288 - DNA, 15 bp, Homo sapiens
ccattgtcttgttct

SEQ ID NO: 5051289 - DNA, 12 bp, Homo sapiens
cccaaccccagc

SEQ ID NO: 5051290 - DNA, 12 bp, Homo sapiens
cccaacccctga

SEQ ID NO: 5051291 - DNA, 15 bp, Homo sapiens
cccaacccctgagga

SEQ ID NO: 5051292 - DNA, 14 bp, Homo sapiens
ttacagggagcctc

SEQ ID NO: 5051293 - DNA, 16 bp, Homo sapiens
ttacagggagcctcct

SEQ ID NO: 5051294 - DNA, 19 bp, Homo sapiens
ttacagggagcctcctgcc

SEQ ID NO: 5051295 - DNA, 14 bp, Homo sapiens
ttacatttttctga

SEQ ID NO: 5051296 - DNA, 13 bp, Homo sapiens
ttacctttgctgt

SEQ ID NO: 5051297 - DNA, 15 bp, Homo sapiens
ttacctttgctgtca

SEQ ID NO: 5051298 - DNA, 16 bp, Homo sapiens
ttacttgtctttgatt

SEQ ID NO: 5051299 - DNA, 17 bp, Homo sapiens
ttagagaaggctcagcc

SEQ ID NO: 5051300 - DNA, 15 bp, Homo sapiens
ttagctgctcactta

SEQ ID NO: 5051301 - DNA, 18 bp, Homo sapiens
ttagctgctcacttaaac

SEQ ID NO: 5051302 - DNA, 12 bp, Homo sapiens
ttagtttgcact

SEQ ID NO: 5051303 - DNA, 20 bp, Homo sapiens
ttcaagtgatggtcattcat

SEQ ID NO: 5051304 - DNA, 18 bp, Homo sapiens
ttcagcaaatgccttttc

SEQ ID NO: 5051305 - DNA, 19 bp, Homo sapiens
ttcatatcactatgaactt

SEQ ID NO: 5051306 - DNA, 13 bp, Homo sapiens
ttccaagcccttc

SEQ ID NO: 5051307 - DNA, 13 bp, Homo sapiens
ttcccccgccgct

SEQ ID NO: 5051308 - DNA, 12 bp, Homo sapiens
ttctcagctccc

SEQ ID NO: 5051309 - DNA, 15 bp, Homo sapiens
ttctcagctccccct

SEQ ID NO: 5051310 - DNA, 18 bp, Homo sapiens
ttctcagctccccctgtc

SEQ ID NO: 5051311 - DNA, 20 bp, Homo sapiens
ttctcagctccccctgtccc

SEQ ID NO: 5051312 - DNA, 13 bp, Homo sapiens
ttctctctgccca

SEQ ID NO: 5051313 - DNA, 17 bp, Homo sapiens
ttctgcacccagccaaa

SEQ ID NO: 5051314 - DNA, 15 bp, Homo sapiens
ttctgcctgcctggg

SEQ ID NO: 5051315 - DNA, 17 bp, Homo sapiens
ttctgttagctgctcac

SEQ ID NO: 5051316 - DNA, 18 bp, Homo sapiens
ttctgttagctgctcact

SEQ ID NO: 5051317 - DNA, 16 bp, Homo sapiens
ttcttgccctgagctt

SEQ ID NO: 5051318 - DNA, 13 bp, Homo sapiens
ttgaagcctgccc

SEQ ID NO: 5051319 - DNA, 22 bp, Homo sapiens
ttgactgtaggcgcccctgggg

SEQ ID NO: 5051320 - DNA, 18 bp, Homo sapiens
ttgaggatgcactggcct

SEQ ID NO: 5051321 - DNA, 19 bp, Homo sapiens
ttgccacaggcctccctgt

SEQ ID NO: 5051322 - DNA, 13 bp, Homo sapiens
ttgcccaacacca

SEQ ID NO: 5051323 - DNA, 18 bp, Homo sapiens
ttgcccaacaccagcccc

SEQ ID NO: 5051324 - DNA, 21 bp, Homo sapiens
ttgcccaacaccagcccctgc

SEQ ID NO: 5051325 - DNA, 20 bp, Homo sapiens
ttgccctgagctttccgggg

SEQ ID NO: 5051326 - DNA, 17 bp, Homo sapiens
ttgctggagtgctggct

SEQ ID NO: 5051327 - DNA, 18 bp, Homo sapiens
ttgctggagtgctggctc

SEQ ID NO: 5051328 - DNA, 13 bp, Homo sapiens
ttgctgtcacttt

SEQ ID NO: 5051329 - DNA, 20 bp, Homo sapiens
ttgctgtcactttctctctt

SEQ ID NO: 5051330 - DNA, 22 bp, Homo sapiens
ttggaaattgggtgtgccctgg

SEQ ID NO: 5051331 - DNA, 14 bp, Homo sapiens
ttggaagctctgtt

SEQ ID NO: 5051332 - DNA, 20 bp, Homo sapiens
ttggaaggtagagcccactg

SEQ ID NO: 5051333 - DNA, 21 bp, Homo sapiens
ttgtacgtgggagaggcagaa

SEQ ID NO: 5051334 - DNA, 17 bp, Homo sapiens
ttgtggaatactagcta

SEQ ID NO: 5051335 - DNA, 18 bp, Homo sapiens
tttacatttttctgatgg

SEQ ID NO: 5051336 - DNA, 16 bp, Homo sapiens
tttacttgtctttgat

SEQ ID NO: 5051337 - DNA, 20 bp, Homo sapiens
tttagattaaagattgcttt

SEQ ID NO: 5051338 - DNA, 22 bp, Homo sapiens
tttcaaatgcagcaatcccact

SEQ ID NO: 5051339 - DNA, 21 bp, Homo sapiens
tttccatcatctcttttccca

SEQ ID NO: 5051340 - DNA, 14 bp, Homo sapiens
tttctcaatctttt

SEQ ID NO: 5051341 - DNA, 18 bp, Homo sapiens
tttgcccaacaccagccc

SEQ ID NO: 5051342 - DNA, 13 bp, Homo sapiens
tttgcccttctgg

SEQ ID NO: 5051343 - DNA, 19 bp, Homo sapiens
tttgttctcagctccccct

SEQ ID NO: 5051344 - DNA, 21 bp, Homo sapiens
ttttaaccattgtcttgttct

SEQ ID NO: 5051345 - DNA, 12 bp, Homo sapiens
ttttaatcagag

SEQ ID NO: 5051346 - DNA, 17 bp, Homo sapiens
ttttcaaatgcagcaat

SEQ ID NO: 5051347 - DNA, 22 bp, Homo sapiens
tgccccacacccagccagctcc

SEQ ID NO: 5051348 - DNA, 17 bp, Homo sapiens
tgccccagctgggctgt

SEQ ID NO: 5051349 - DNA, 15 bp, Homo sapiens
tgccctgccaagcct

SEQ ID NO: 5051350 - DNA, 22 bp, Homo sapiens
tgccctggctcccaagggaggc

SEQ ID NO: 5051351 - DNA, 11 bp, Homo sapiens
tgccctgggcc

SEQ ID NO: 5051352 - DNA, 14 bp, Homo sapiens
tgccgggcctggac

SEQ ID NO: 5051353 - DNA, 16 bp, Homo sapiens
tgccgggcctggactg

SEQ ID NO: 5051354 - DNA, 21 bp, Homo sapiens
tgccgggcctggactgtccta

SEQ ID NO: 5051355 - DNA, 17 bp, Homo sapiens
tgcctcgctcagtcagt

SEQ ID NO: 5051356 - DNA, 23 bp, Homo sapiens
tgcctcgctcagtcagtgcacta

SEQ ID NO: 5051357 - DNA, 20 bp, Homo sapiens
tgcctgaccatcccatgagc

SEQ ID NO: 5051358 - DNA, 20 bp, Homo sapiens
tgcctgctctccttgccctg

SEQ ID NO: 5051359 - DNA, 22 bp, Homo sapiens
tgcctgctctccttgccctggg

SEQ ID NO: 5051360 - DNA, 23 bp, Homo sapiens
tgcctgctctccttgccctgggc

SEQ ID NO: 5051361 - DNA, 23 bp, Homo sapiens
tgcctgttcctcccaagaggcca

SEQ ID NO: 5051362 - DNA, 15 bp, Homo sapiens
tgcggtgaggcaggg

SEQ ID NO: 5051363 - DNA, 19 bp, Homo sapiens
tgctaacctcactgcctca

SEQ ID NO: 5051364 - DNA, 19 bp, Homo sapiens
tgctagggtgcctgctctc

SEQ ID NO: 5051365 - DNA, 20 bp, Homo sapiens
tgctcattgtataagccccg

SEQ ID NO: 5051366 - DNA, 23 bp, Homo sapiens
tgctcattgtataagccccgagg

SEQ ID NO: 5051367 - DNA, 15 bp, Homo sapiens
tgctctccttgccct

SEQ ID NO: 5051368 - DNA, 16 bp, Homo sapiens
tgctgcttctgggcct

SEQ ID NO: 5051369 - DNA, 24 bp, Homo sapiens
tgctgcttctgggcctgatggaga

SEQ ID NO: 5051370 - DNA, 15 bp, Homo sapiens
tgctggagtgctggc

SEQ ID NO: 5051371 - DNA, 17 bp, Homo sapiens
tgctggctccacgccct

SEQ ID NO: 5051372 - DNA, 21 bp, Homo sapiens
tgctggctccacgccctgggg

SEQ ID NO: 5051373 - DNA, 22 bp, Homo sapiens
tgctggctccacgccctgggga

SEQ ID NO: 5051374 - DNA, 17 bp, Homo sapiens
tgctgtcactttctctc

SEQ ID NO: 5051375 - DNA, 12 bp, Homo sapiens
tgcttctgggcc

SEQ ID NO: 5051376 - DNA, 22 bp, Homo sapiens
tggaaattgggtgtgccctggc

SEQ ID NO: 5051377 - DNA, 15 bp, Homo sapiens
tggaagaaagccctg

SEQ ID NO: 5051378 - DNA, 12 bp, Homo sapiens
tggaagctctgt

SEQ ID NO: 5051379 - DNA, 15 bp, Homo sapiens
tggaaggagagaggt

SEQ ID NO: 5051380 - DNA, 20 bp, Homo sapiens
tggaaggtagagcccactgc

SEQ ID NO: 5051381 - DNA, 22 bp, Homo sapiens
tggaccatcaagggtcatggca

SEQ ID NO: 5051382 - DNA, 15 bp, Homo sapiens
tggagatggctgctg

SEQ ID NO: 5051383 - DNA, 15 bp, Homo sapiens
tggagcccctgtgtc

SEQ ID NO: 5051384 - DNA, 21 bp, Homo sapiens
tggagcccctgtgtgggaggg

SEQ ID NO: 5051385 - DNA, 22 bp, Homo sapiens
tggagcccctgtgtgggagggc

SEQ ID NO: 5051386 - DNA, 12 bp, Homo sapiens
tggagtgctggc

SEQ ID NO: 5051387 - DNA, 12 bp, Homo sapiens
tggcagcaagca

SEQ ID NO: 5051388 - DNA, 19 bp, Homo sapiens
tggcagcaagcaattctgc

SEQ ID NO: 5051389 - DNA, 18 bp, Homo sapiens
tggcctgttctgtaggag

SEQ ID NO: 5051390 - DNA, 23 bp, Homo sapiens
tggcctgttctgtaggagagact

SEQ ID NO: 5051391 - DNA, 16 bp, Homo sapiens
tggcgggatgggccac

SEQ ID NO: 5051392 - DNA, 16 bp, Homo sapiens
tggctccacgccctgg

SEQ ID NO: 5051393 - DNA, 17 bp, Homo sapiens
tggctccacgccctggg

SEQ ID NO: 5051394 - DNA, 16 bp, Homo sapiens
tggctcccaagggagg

SEQ ID NO: 5051395 - DNA, 21 bp, Homo sapiens
tggctggagatggctgctgct

SEQ ID NO: 5051396 - DNA, 22 bp, Homo sapiens
tggctggagatggctgctgctc

SEQ ID NO: 5051397 - DNA, 19 bp, Homo sapiens
tggctgggggcatggggga

SEQ ID NO: 5051398 - DNA, 22 bp, Homo sapiens
tggctgggggcatgggggaggc

SEQ ID NO: 5051399 - DNA, 13 bp, Homo sapiens
tgggacctggtgg

SEQ ID NO: 5051400 - DNA, 14 bp, Homo sapiens
tgggagaaggtgct

SEQ ID NO: 5051401 - DNA, 18 bp, Homo sapiens
tgggagggcgaggcgggg

SEQ ID NO: 5051402 - DNA, 18 bp, Homo sapiens
tgggcaggtcctggggag

SEQ ID NO: 5051403 - DNA, 13 bp, Homo sapiens
tgggccctgcagg

SEQ ID NO: 5051404 - DNA, 17 bp, Homo sapiens
tgggccctgcaggaggc

SEQ ID NO: 5051405 - DNA, 21 bp, Homo sapiens
tgggccctgcaggaggcctgg

SEQ ID NO: 5051406 - DNA, 23 bp, Homo sapiens
tgggccctgcaggaggcctggga

SEQ ID NO: 5051407 - DNA, 14 bp, Homo sapiens
tgggcctgatggag

SEQ ID NO: 5051408 - DNA, 18 bp, Homo sapiens
tgggcctgatggagagga

SEQ ID NO: 5051409 - DNA, 20 bp, Homo sapiens
tgggcctgatggagaggaga

SEQ ID NO: 5051410 - DNA, 21 bp, Homo sapiens
tgggcctgatggagaggagaa

SEQ ID NO: 5051411 - DNA, 13 bp, Homo sapiens
tgggctgggagaa

SEQ ID NO: 5051412 - DNA, 23 bp, Homo sapiens
tgggcttctgcggtgaggcaggg

SEQ ID NO: 5051413 - DNA, 10 bp, Homo sapiens
tggggctctt

SEQ ID NO: 5051414 - DNA, 19 bp, Homo sapiens
tgggggagcctggagcccc

SEQ ID NO: 5051415 - DNA, 12 bp, Homo sapiens
tgggggaggctc

SEQ ID NO: 5051416 - DNA, 13 bp, Homo sapiens
tgggtgtgccctg

SEQ ID NO: 5051417 - DNA, 18 bp, Homo sapiens
tgggtgtgccctggctcc

SEQ ID NO: 5051418 - DNA, 18 bp, Homo sapiens
tggtgagggcagttctgc

SEQ ID NO: 5051419 - DNA, 20 bp, Homo sapiens
tggtgagggcagttctgcac

SEQ ID NO: 5051420 - DNA, 19 bp, Homo sapiens
tgtaaaataaaggctctgt

SEQ ID NO: 5051421 - DNA, 20 bp, Homo sapiens
tgtaaaataaaggctctgtg

SEQ ID NO: 5051422 - DNA, 20 bp, Homo sapiens
tgtaaggactcagtgttgac

SEQ ID NO: 5051423 - DNA, 20 bp, Homo sapiens
tgtaccccccaacccctgag

SEQ ID NO: 5051424 - DNA, 17 bp, Homo sapiens
tgtacgtgggagaggca

SEQ ID NO: 5051425 - DNA, 16 bp, Homo sapiens
tgtaggcgcccctggg

SEQ ID NO: 5051426 - DNA, 19 bp, Homo sapiens
tgtagtagcctttcctgat

SEQ ID NO: 5051427 - DNA, 13 bp, Homo sapiens
tgtcaccatcatt

SEQ ID NO: 5051428 - DNA, 16 bp, Homo sapiens
tgtcactttctctctt

SEQ ID NO: 5051429 - DNA, 21 bp, Homo sapiens
tgtcagcatctttgcccttct

SEQ ID NO: 5051430 - DNA, 19 bp, Homo sapiens
tgtctagatttatcagagt

SEQ ID NO: 5051431 - DNA, 16 bp, Homo sapiens
tgtctgagatgctggt

SEQ ID NO: 5051432 - DNA, 21 bp, Homo sapiens
tgtctgtgcagatgctttgcc

SEQ ID NO: 5051433 - DNA, 20 bp, Homo sapiens
tgtgcagtataattttctaa

SEQ ID NO: 5051434 - DNA, 11 bp, Homo sapiens
tgtgccctggc

SEQ ID NO: 5051435 - DNA, 15 bp, Homo sapiens
tgtgccctggctccc

SEQ ID NO: 5051436 - DNA, 18 bp, Homo sapiens
tgtgctaacctcactgcc

SEQ ID NO: 5051437 - DNA, 19 bp, Homo sapiens
tgtgctaacctcactgcct

SEQ ID NO: 5051438 - DNA, 20 bp, Homo sapiens
tgtgctaacctcactgcctc

SEQ ID NO: 5051439 - DNA, 13 bp, Homo sapiens
tgtgggggaaggc

SEQ ID NO: 5051440 - DNA, 17 bp, Homo sapiens
tgtgggggaaggccttg

SEQ ID NO: 5051441 - DNA, 19 bp, Homo sapiens
tgtgtcagcatctttgccc

SEQ ID NO: 5051442 - DNA, 23 bp, Homo sapiens
tgtgtcagcatctttgcccttct

SEQ ID NO: 5051443 - DNA, 21 bp, Homo sapiens
tgtgtcggggggcgagggagg

SEQ ID NO: 5051444 - DNA, 14 bp, Homo sapiens
tgtgtgatgcatgt

SEQ ID NO: 5051445 - DNA, 14 bp, Homo sapiens
tgtgtgggagggcg

SEQ ID NO: 5051446 - DNA, 16 bp, Homo sapiens
tgttcccccgccgctt

SEQ ID NO: 5051447 - DNA, 14 bp, Homo sapiens
tgttctcagctccc

SEQ ID NO: 5051448 - DNA, 13 bp, Homo sapiens
tgttctgagcccc

SEQ ID NO: 5051449 - DNA, 23 bp, Homo sapiens
tgttctgtgatgaggggaggggg

SEQ ID NO: 5051450 - DNA, 17 bp, Homo sapiens
tgtttacagggagcctc

SEQ ID NO: 5051451 - DNA, 19 bp, Homo sapiens
ttaaccattgtcttgttct

SEQ ID NO: 5051452 - DNA, 12 bp, Homo sapiens
tccctgagcctg

SEQ ID NO: 5051453 - DNA, 21 bp, Homo sapiens
tccctgattaaagtgccttca

SEQ ID NO: 5051454 - DNA, 19 bp, Homo sapiens
tccctgtttgaagcctgcc

SEQ ID NO: 5051455 - DNA, 22 bp, Homo sapiens
tccctttgcgtcaggagcagca

SEQ ID NO: 5051456 - DNA, 15 bp, Homo sapiens
tcccttttccatcat

SEQ ID NO: 5051457 - DNA, 20 bp, Homo sapiens
tccgttcccacctctgagga

SEQ ID NO: 5051458 - DNA, 21 bp, Homo sapiens
tccgttcccacctctgaggac

SEQ ID NO: 5051459 - DNA, 14 bp, Homo sapiens
tcctagcctgctct

SEQ ID NO: 5051460 - DNA, 15 bp, Homo sapiens
tcctaggtgacccca

SEQ ID NO: 5051461 - DNA, 15 bp, Homo sapiens
tcctctctttgttct

SEQ ID NO: 5051462 - DNA, 17 bp, Homo sapiens
tcctctctttgttctca

SEQ ID NO: 5051463 - DNA, 21 bp, Homo sapiens
tcctctctttgttctcagctc

SEQ ID NO: 5051464 - DNA, 23 bp, Homo sapiens
tcctgatgacagaacacagatct

SEQ ID NO: 5051465 - DNA, 19 bp, Homo sapiens
tcctgcttttggggctctt

SEQ ID NO: 5051466 - DNA, 10 bp, Homo sapiens
tcctggagcc

SEQ ID NO: 5051467 - DNA, 17 bp, Homo sapiens
tcctggggaggctgaga

SEQ ID NO: 5051468 - DNA, 20 bp, Homo sapiens
tcctggggaggctgagactg

SEQ ID NO: 5051469 - DNA, 21 bp, Homo sapiens
tcctggggaggctgagactgc

SEQ ID NO: 5051470 - DNA, 17 bp, Homo sapiens
tccttcttgccctgagc

SEQ ID NO: 5051471 - DNA, 18 bp, Homo sapiens
tccttcttgccctgagct

SEQ ID NO: 5051472 - DNA, 12 bp, Homo sapiens
tccttgccctgg

SEQ ID NO: 5051473 - DNA, 14 bp, Homo sapiens
tccttgccctgggc

SEQ ID NO: 5051474 - DNA, 15 bp, Homo sapiens
tcgtcagtgttcatg

SEQ ID NO: 5051475 - DNA, 12 bp, Homo sapiens
tctacactgcct

SEQ ID NO: 5051476 - DNA, 11 bp, Homo sapiens
tctcagctccc

SEQ ID NO: 5051477 - DNA, 16 bp, Homo sapiens
tctcatggctttgtta

SEQ ID NO: 5051478 - DNA, 22 bp, Homo sapiens
tctccagcctggacccccagct

SEQ ID NO: 5051479 - DNA, 12 bp, Homo sapiens
tctcccaaggct

SEQ ID NO: 5051480 - DNA, 13 bp, Homo sapiens
tctccctgagcct

SEQ ID NO: 5051481 - DNA, 21 bp, Homo sapiens
tctccctgagcctgccccagc

SEQ ID NO: 5051482 - DNA, 13 bp, Homo sapiens
tctccttgccctg

SEQ ID NO: 5051483 - DNA, 14 bp, Homo sapiens
tctccttgccctgg

SEQ ID NO: 5051484 - DNA, 16 bp, Homo sapiens
tctccttgccctgggc

SEQ ID NO: 5051485 - DNA, 18 bp, Homo sapiens
tctccttgccctgggcca

SEQ ID NO: 5051486 - DNA, 23 bp, Homo sapiens
tctctctgcccaagttgctctgt

SEQ ID NO: 5051487 - DNA, 22 bp, Homo sapiens
tctctgcccaagttgctctgta

SEQ ID NO: 5051488 - DNA, 17 bp, Homo sapiens
tctctgctgcttctggg

SEQ ID NO: 5051489 - DNA, 13 bp, Homo sapiens
tctctttgttctc

SEQ ID NO: 5051490 - DNA, 16 bp, Homo sapiens
tctgagcccccacctg

SEQ ID NO: 5051491 - DNA, 21 bp, Homo sapiens
tctgagcccccacctgcctga

SEQ ID NO: 5051492 - DNA, 18 bp, Homo sapiens
tctgatatttgctggagt

SEQ ID NO: 5051493 - DNA, 20 bp, Homo sapiens
tctgcccaagttgctctgta

SEQ ID NO: 5051494 - DNA, 11 bp, Homo sapiens
tctgctctgag

SEQ ID NO: 5051495 - DNA, 16 bp, Homo sapiens
tctgctgcttctgggc

SEQ ID NO: 5051496 - DNA, 19 bp, Homo sapiens
tctgctgcttctgggcctg

SEQ ID NO: 5051497 - DNA, 21 bp, Homo sapiens
tctggaagaaagccctgtgct

SEQ ID NO: 5051498 - DNA, 17 bp, Homo sapiens
tctggaccccaggccat

SEQ ID NO: 5051499 - DNA, 15 bp, Homo sapiens
tctggaggggcccct

SEQ ID NO: 5051500 - DNA, 23 bp, Homo sapiens
tctggaggggcccctgcttctcc

SEQ ID NO: 5051501 - DNA, 18 bp, Homo sapiens
tctgggcatctgttctgg

SEQ ID NO: 5051502 - DNA, 16 bp, Homo sapiens
tctgggccaccagctc

SEQ ID NO: 5051503 - DNA, 17 bp, Homo sapiens
tctgggccctgcaggag

SEQ ID NO: 5051504 - DNA, 20 bp, Homo sapiens
tctgggcctgatggagagga

SEQ ID NO: 5051505 - DNA, 13 bp, Homo sapiens
tctgtaggagaga

SEQ ID NO: 5051506 - DNA, 14 bp, Homo sapiens
tctgtgcagatgct

SEQ ID NO: 5051507 - DNA, 12 bp, Homo sapiens
tctgtgcttgac

SEQ ID NO: 5051508 - DNA, 13 bp, Homo sapiens
tctgttagctgct

SEQ ID NO: 5051509 - DNA, 17 bp, Homo sapiens
tctgttagctgctcact

SEQ ID NO: 5051510 - DNA, 17 bp, Homo sapiens
tcttataaattctgtta

SEQ ID NO: 5051511 - DNA, 21 bp, Homo sapiens
tcttataaattctgttagctg

SEQ ID NO: 5051512 - DNA, 22 bp, Homo sapiens
tcttataaattctgttagctgc

SEQ ID NO: 5051513 - DNA, 17 bp, Homo sapiens
tcttgatcagtgtgcta

SEQ ID NO: 5051514 - DNA, 13 bp, Homo sapiens
tcttgccctgagc

SEQ ID NO: 5051515 - DNA, 14 bp, Homo sapiens
tcttgccctgagct

SEQ ID NO: 5051516 - DNA, 22 bp, Homo sapiens
tcttgttctttgctggaccatc

SEQ ID NO: 5051517 - DNA, 12 bp, Homo sapiens
tctttgttctca

SEQ ID NO: 5051518 - DNA, 16 bp, Homo sapiens
tctttgttctcagctc

SEQ ID NO: 5051519 - DNA, 17 bp, Homo sapiens
tctttgttctcagctcc

SEQ ID NO: 5051520 - DNA, 22 bp, Homo sapiens
tctttgttctcagctccccctg

SEQ ID NO: 5051521 - DNA, 23 bp, Homo sapiens
tgaaaacttttacatttttctga

SEQ ID NO: 5051522 - DNA, 18 bp, Homo sapiens
tgaataccccttctctgt

SEQ ID NO: 5051523 - DNA, 23 bp, Homo sapiens
tgactaataaaaaactgtgaacc

SEQ ID NO: 5051524 - DNA, 20 bp, Homo sapiens
tgactgtaggcgcccctggg

SEQ ID NO: 5051525 - DNA, 16 bp, Homo sapiens
tgagactgcagaggag

SEQ ID NO: 5051526 - DNA, 17 bp, Homo sapiens
tgagagcatgtggggga

SEQ ID NO: 5051527 - DNA, 21 bp, Homo sapiens
tgagatgctggtaatggccat

SEQ ID NO: 5051528 - DNA, 12 bp, Homo sapiens
tgagcagtccag

SEQ ID NO: 5051529 - DNA, 14 bp, Homo sapiens
tgagcagtccagag

SEQ ID NO: 5051530 - DNA, 20 bp, Homo sapiens
tgagccagttacctttgctg

SEQ ID NO: 5051531 - DNA, 23 bp, Homo sapiens
tgagccctccttcttgccctgag

SEQ ID NO: 5051532 - DNA, 17 bp, Homo sapiens
tgagctttccggggagg

SEQ ID NO: 5051533 - DNA, 20 bp, Homo sapiens
tgagctttccggggaggagc

SEQ ID NO: 5051534 - DNA, 17 bp, Homo sapiens
tgaggatgcactggcct

SEQ ID NO: 5051535 - DNA, 23 bp, Homo sapiens
tgaggatgcactggcctgttctg

SEQ ID NO: 5051536 - DNA, 23 bp, Homo sapiens
tgaggcaggggagtctgcttgtc

SEQ ID NO: 5051537 - DNA, 10 bp, Homo sapiens
tgagtgtcaa

SEQ ID NO: 5051538 - DNA, 15 bp, Homo sapiens
tgatgaggggagggg

SEQ ID NO: 5051539 - DNA, 19 bp, Homo sapiens
tgcacccagccaaacacat

SEQ ID NO: 5051540 - DNA, 18 bp, Homo sapiens
tgcagaggagccacctgg

SEQ ID NO: 5051541 - DNA, 19 bp, Homo sapiens
tgcagaggagccacctggg

SEQ ID NO: 5051542 - DNA, 22 bp, Homo sapiens
tgcagaggagccacctgggctg

SEQ ID NO: 5051543 - DNA, 16 bp, Homo sapiens
tgcagcaatcccactt

SEQ ID NO: 5051544 - DNA, 14 bp, Homo sapiens
tgcagcaggcagag

SEQ ID NO: 5051545 - DNA, 17 bp, Homo sapiens
tgcagcaggcagaggag

SEQ ID NO: 5051546 - DNA, 18 bp, Homo sapiens
tgcagcaggcagaggaga

SEQ ID NO: 5051547 - DNA, 11 bp, Homo sapiens
tgcagccccag

SEQ ID NO: 5051548 - DNA, 18 bp, Homo sapiens
tgcaggaggcctgggagg

SEQ ID NO: 5051549 - DNA, 19 bp, Homo sapiens
tgcaggaggcctgggaggg

SEQ ID NO: 5051550 - DNA, 16 bp, Homo sapiens
tgcattttgtgtgatg

SEQ ID NO: 5051551 - DNA, 22 bp, Homo sapiens
tgcattttgtgtgatgcatgta

SEQ ID NO: 5051552 - DNA, 12 bp, Homo sapiens
tgccacaggcct

SEQ ID NO: 5051553 - DNA, 14 bp, Homo sapiens
tgccacaggcctcc

SEQ ID NO: 5051554 - DNA, 19 bp, Homo sapiens
tgcccaacaccagcccctg

SEQ ID NO: 5051555 - DNA, 21 bp, Homo sapiens
tgcccaacaccagcccctgcc

SEQ ID NO: 5051556 - DNA, 16 bp, Homo sapiens
tgcccaagttgctctg

SEQ ID NO: 5051557 - DNA, 14 bp, Homo sapiens
tgcccagtccccca

SEQ ID NO: 5051558 - DNA, 23 bp, Homo sapiens
cccacacccagccagctcctttc

SEQ ID NO: 5051559 - DNA, 14 bp, Homo sapiens
cccacatccagtgg

SEQ ID NO: 5051560 - DNA, 14 bp, Homo sapiens
cccaccagcccaca

SEQ ID NO: 5051561 - DNA, 13 bp, Homo sapiens
cccacctgcctga

SEQ ID NO: 5051562 - DNA, 20 bp, Homo sapiens
cccactaccatacagacagc

SEQ ID NO: 5051563 - DNA, 20 bp, Homo sapiens
cccacttagcagggacagga

SEQ ID NO: 5051564 - DNA, 22 bp, Homo sapiens
cccacttagcagggacaggaga

SEQ ID NO: 5051565 - DNA, 17 bp, Homo sapiens
cccagccagctcctttc

SEQ ID NO: 5051566 - DNA, 13 bp, Homo sapiens
cccagctgggctg

SEQ ID NO: 5051567 - DNA, 22 bp, Homo sapiens
cccagctgggctgttggctggg

SEQ ID NO: 5051568 - DNA, 23 bp, Homo sapiens
cccagctgggctgttggctgggg

SEQ ID NO: 5051569 - DNA, 13 bp, Homo sapiens
cccagctttgccc

SEQ ID NO: 5051570 - DNA, 12 bp, Homo sapiens
cccaggaccaag

SEQ ID NO: 5051571 - DNA, 20 bp, Homo sapiens
cccaggccataccaggtgct

SEQ ID NO: 5051572 - DNA, 19 bp, Homo sapiens
cccaggggtctccctgagc

SEQ ID NO: 5051573 - DNA, 22 bp, Homo sapiens
cccaggggtctccctgagcctg

SEQ ID NO: 5051574 - DNA, 13 bp, Homo sapiens
cccatctctgctg

SEQ ID NO: 5051575 - DNA, 16 bp, Homo sapiens
cccatgagcagtccag

SEQ ID NO: 5051576 - DNA, 13 bp, Homo sapiens
cccatgccctgcc

SEQ ID NO: 5051577 - DNA, 22 bp, Homo sapiens
cccatgccctgccaagcctgga

SEQ ID NO: 5051578 - DNA, 23 bp, Homo sapiens
cccatgccctgccaagcctggag

SEQ ID NO: 5051579 - DNA, 14 bp, Homo sapiens
ccccaaccccagcc

SEQ ID NO: 5051580 - DNA, 14 bp, Homo sapiens
ccccacctgcctga

SEQ ID NO: 5051581 - DNA, 15 bp, Homo sapiens
ccccacctgcctgac

SEQ ID NO: 5051582 - DNA, 14 bp, Homo sapiens
ccccagcccaagtc

SEQ ID NO: 5051583 - DNA, 16 bp, Homo sapiens
ccccagccgctcggag

SEQ ID NO: 5051584 - DNA, 14 bp, Homo sapiens
ccccagctgggctg

SEQ ID NO: 5051585 - DNA, 15 bp, Homo sapiens
ccccagctgggctgt

SEQ ID NO: 5051586 - DNA, 14 bp, Homo sapiens
ccccatctctgctg

SEQ ID NO: 5051587 - DNA, 14 bp, Homo sapiens
cccccaaccccagc

SEQ ID NO: 5051588 - DNA, 14 bp, Homo sapiens
cccccaacccctga

SEQ ID NO: 5051589 - DNA, 15 bp, Homo sapiens
cccccacctgcctga

SEQ ID NO: 5051590 - DNA, 12 bp, Homo sapiens
cccccttctggg

SEQ ID NO: 5051591 - DNA, 23 bp, Homo sapiens
cccccttctgggcatctgttctg

SEQ ID NO: 5051592 - DNA, 19 bp, Homo sapiens
cccctagtatctggctggg

SEQ ID NO: 5051593 - DNA, 13 bp, Homo sapiens
cccctcagctcca

SEQ ID NO: 5051594 - DNA, 17 bp, Homo sapiens
cccctcagctccagacg

SEQ ID NO: 5051595 - DNA, 14 bp, Homo sapiens
cccctgccccagcc

SEQ ID NO: 5051596 - DNA, 16 bp, Homo sapiens
cccctgccccagccca

SEQ ID NO: 5051597 - DNA, 11 bp, Homo sapiens
cccctgcttct

SEQ ID NO: 5051598 - DNA, 13 bp, Homo sapiens
cccctgcttctcc

SEQ ID NO: 5051599 - DNA, 17 bp, Homo sapiens
ccccttctctgtagctg

SEQ ID NO: 5051600 - DNA, 14 bp, Homo sapiens
ccccttctgggcat

SEQ ID NO: 5051601 - DNA, 19 bp, Homo sapiens
cccgccgcttttctcctct

SEQ ID NO: 5051602 - DNA, 14 bp, Homo sapiens
cccgcctgttcccc

SEQ ID NO: 5051603 - DNA, 19 bp, Homo sapiens
cccgttgccgggcctggac

SEQ ID NO: 5051604 - DNA, 16 bp, Homo sapiens
ccctagtatctggctg

SEQ ID NO: 5051605 - DNA, 23 bp, Homo sapiens
ccctgagagcatgtgggggaagg

SEQ ID NO: 5051606 - DNA, 12 bp, Homo sapiens
ccctgagcctgc

SEQ ID NO: 5051607 - DNA, 21 bp, Homo sapiens
ccctgagcctgccccagctgg

SEQ ID NO: 5051608 - DNA, 17 bp, Homo sapiens
ccctgcaggaggcctgg

SEQ ID NO: 5051609 - DNA, 15 bp, Homo sapiens
ccctgccaagcctgg

SEQ ID NO: 5051610 - DNA, 17 bp, Homo sapiens
ccctgccccagcccaag

SEQ ID NO: 5051611 - DNA, 16 bp, Homo sapiens
ccctgcttctccagcc

SEQ ID NO: 5051612 - DNA, 11 bp, Homo sapiens
ccctggctccc

SEQ ID NO: 5051613 - DNA, 18 bp, Homo sapiens
ccctggggagtgagcttg

SEQ ID NO: 5051614 - DNA, 20 bp, Homo sapiens
ccctgtttgaagcctgccct

SEQ ID NO: 5051615 - DNA, 21 bp, Homo sapiens
cccttctgggcatctgttctg

SEQ ID NO: 5051616 - DNA, 22 bp, Homo sapiens
ccgactttgtaccccccaaccc

SEQ ID NO: 5051617 - DNA, 15 bp, Homo sapiens
ccgccgactttgtac

SEQ ID NO: 5051618 - DNA, 20 bp, Homo sapiens
ccgccgactttgtacccccc

SEQ ID NO: 5051619 - DNA, 18 bp, Homo sapiens
ccgctcccaccagcccac

SEQ ID NO: 5051620 - DNA, 20 bp, Homo sapiens
ccgctcggaggccccaaagg

SEQ ID NO: 5051621 - DNA, 14 bp, Homo sapiens
ccgctgtcccaggg

SEQ ID NO: 5051622 - DNA, 13 bp, Homo sapiens
ccggggaggagcc

SEQ ID NO: 5051623 - DNA, 16 bp, Homo sapiens
ccggggaggagccttg

SEQ ID NO: 5051624 - DNA, 19 bp, Homo sapiens
ccgttgccgggcctggact

SEQ ID NO: 5051625 - DNA, 14 bp, Homo sapiens
cctacacctctggg

SEQ ID NO: 5051626 - DNA, 15 bp, Homo sapiens
cctacacctctgggc

SEQ ID NO: 5051627 - DNA, 18 bp, Homo sapiens
cctcactgcctcatggca

SEQ ID NO: 5051628 - DNA, 20 bp, Homo sapiens
cctcccaagaggccagggtg

SEQ ID NO: 5051629 - DNA, 15 bp, Homo sapiens
cctccgttcccacct

SEQ ID NO: 5051630 - DNA, 18 bp, Homo sapiens
cctccgttcccacctctg

SEQ ID NO: 5051631 - DNA, 16 bp, Homo sapiens
cctcctagcctgctct

SEQ ID NO: 5051632 - DNA, 17 bp, Homo sapiens
cctccttcttgccctga

SEQ ID NO: 5051633 - DNA, 19 bp, Homo sapiens
cctccttcttgccctgagc

SEQ ID NO: 5051634 - DNA, 20 bp, Homo sapiens
cctccttcttgccctgagct

SEQ ID NO: 5051635 - DNA, 18 bp, Homo sapiens
cctctctttgttctcagc

SEQ ID NO: 5051636 - DNA, 23 bp, Homo sapiens
cctctctttgttctcagctcccc

SEQ ID NO: 5051637 - DNA, 20 bp, Homo sapiens
cctctgggccctgcaggagg

SEQ ID NO: 5051638 - DNA, 23 bp, Homo sapiens
cctctgggccctgcaggaggcct

SEQ ID NO: 5051639 - DNA, 21 bp, Homo sapiens
cctctgttggaaattgggtgt

SEQ ID NO: 5051640 - DNA, 15 bp, Homo sapiens
cctctttcctctctt

SEQ ID NO: 5051641 - DNA, 12 bp, Homo sapiens
cctctttgagaa

SEQ ID NO: 5051642 - DNA, 18 bp, Homo sapiens
cctgagcctgccccagct

SEQ ID NO: 5051643 - DNA, 22 bp, Homo sapiens
cctgagctttccggggaggagc

SEQ ID NO: 5051644 - DNA, 17 bp, Homo sapiens
cctgcaggaggcctggg

SEQ ID NO: 5051645 - DNA, 22 bp, Homo sapiens
cctgccaagcctggagcccctg

SEQ ID NO: 5051646 - DNA, 15 bp, Homo sapiens
cctgcccagtccccc

SEQ ID NO: 5051647 - DNA, 12 bp, Homo sapiens
cctgccccagcc

SEQ ID NO: 5051648 - DNA, 14 bp, Homo sapiens
cctgccccagccca

SEQ ID NO: 5051649 - DNA, 15 bp, Homo sapiens
cctgccccagctggg

SEQ ID NO: 5051650 - DNA, 13 bp, Homo sapiens
cctgcccttgtct

SEQ ID NO: 5051651 - DNA, 17 bp, Homo sapiens
cctgctctccttgccct

SEQ ID NO: 5051652 - DNA, 22 bp, Homo sapiens
cctgcttctccagcctggaccc

SEQ ID NO: 5051653 - DNA, 18 bp, Homo sapiens
cctgcttttggggctctt

SEQ ID NO: 5051654 - DNA, 22 bp, Homo sapiens
cctgcttttggggctcttgatc

SEQ ID NO: 5051655 - DNA, 12 bp, Homo sapiens
cctggaaaccac

SEQ ID NO: 5051656 - DNA, 16 bp, Homo sapiens
cctggaaaccacagtc

SEQ ID NO: 5051657 - DNA, 12 bp, Homo sapiens
cctggaccccca

SEQ ID NO: 5051658 - DNA, 17 bp, Homo sapiens
cctggacccccagcttt

SEQ ID NO: 5051659 - DNA, 20 bp, Homo sapiens
acacccagccagctcctttc

SEQ ID NO: 5051660 - DNA, 16 bp, Homo sapiens
acacctctgggccctg

SEQ ID NO: 5051661 - DNA, 13 bp, Homo sapiens
acagatctcttgt

SEQ ID NO: 5051662 - DNA, 21 bp, Homo sapiens
acagcacaaggtggcagcaag

SEQ ID NO: 5051663 - DNA, 23 bp, Homo sapiens
acagcacaaggtggcagcaagca

SEQ ID NO: 5051664 - DNA, 18 bp, Homo sapiens
acagctttctaactcaca

SEQ ID NO: 5051665 - DNA, 22 bp, Homo sapiens
acagctttctaactcacaggca

SEQ ID NO: 5051666 - DNA, 23 bp, Homo sapiens
acagctttctaactcacaggcat

SEQ ID NO: 5051667 - DNA, 21 bp, Homo sapiens
acaggagaaaaattattccca

SEQ ID NO: 5051668 - DNA, 16 bp, Homo sapiens
acagggagcctcctgc

SEQ ID NO: 5051669 - DNA, 17 bp, Homo sapiens
acagggagcctcctgcc

SEQ ID NO: 5051670 - DNA, 14 bp, Homo sapiens
acatattcatcagc

SEQ ID NO: 5051671 - DNA, 14 bp, Homo sapiens
acatgattaatgat

SEQ ID NO: 5051672 - DNA, 21 bp, Homo sapiens
acatgctgagtctcccaaggc

SEQ ID NO: 5051673 - DNA, 24 bp, Homo sapiens
acatgtgtaagacactgtgcaaat

SEQ ID NO: 5051674 - DNA, 16 bp, Homo sapiens
acatttttctgatggg

SEQ ID NO: 5051675 - DNA, 18 bp, Homo sapiens
accaacccatgccctgcc

SEQ ID NO: 5051676 - DNA, 19 bp, Homo sapiens
accaagcttaaggagagga

SEQ ID NO: 5051677 - DNA, 16 bp, Homo sapiens
accacacacacaaggt

SEQ ID NO: 5051678 - DNA, 18 bp, Homo sapiens
accacacacacctgtctg

SEQ ID NO: 5051679 - DNA, 19 bp, Homo sapiens
accacacacacctgtctgt

SEQ ID NO: 5051680 - DNA, 22 bp, Homo sapiens
accacacacacctgtctgtgca

SEQ ID NO: 5051681 - DNA, 17 bp, Homo sapiens
accagctccactggcct

SEQ ID NO: 5051682 - DNA, 18 bp, Homo sapiens
accaggtgtctagaggca

SEQ ID NO: 5051683 - DNA, 14 bp, Homo sapiens
accatacagacagc

SEQ ID NO: 5051684 - DNA, 14 bp, Homo sapiens
accattgtcttgtt

SEQ ID NO: 5051685 - DNA, 12 bp, Homo sapiens
acccagccagct

SEQ ID NO: 5051686 - DNA, 14 bp, Homo sapiens
acccatgccctgcc

SEQ ID NO: 5051687 - DNA, 23 bp, Homo sapiens
accccagccgctcggaggcccca

SEQ ID NO: 5051688 - DNA, 12 bp, Homo sapiens
accccagctgcc

SEQ ID NO: 5051689 - DNA, 21 bp, Homo sapiens
accccaggccataccaggtgc

SEQ ID NO: 5051690 - DNA, 22 bp, Homo sapiens
accccaggccataccaggtgct

SEQ ID NO: 5051691 - DNA, 20 bp, Homo sapiens
accccttctctgtagctgct

SEQ ID NO: 5051692 - DNA, 15 bp, Homo sapiens
accctacacctctgg

SEQ ID NO: 5051693 - DNA, 22 bp, Homo sapiens
accctacacctctgggccctgc

SEQ ID NO: 5051694 - DNA, 18 bp, Homo sapiens
accctcctagcctgctct

SEQ ID NO: 5051695 - DNA, 12 bp, Homo sapiens
acctcactgcct

SEQ ID NO: 5051696 - DNA, 14 bp, Homo sapiens
acctctctgcctgt

SEQ ID NO: 5051697 - DNA, 17 bp, Homo sapiens
acctctgaggactctgg

SEQ ID NO: 5051698 - DNA, 22 bp, Homo sapiens
acctctgggccctgcaggaggc

SEQ ID NO: 5051699 - DNA, 14 bp, Homo sapiens
acctctttccccag

SEQ ID NO: 5051700 - DNA, 13 bp, Homo sapiens
acctgtctgtgca

SEQ ID NO: 5051701 - DNA, 18 bp, Homo sapiens
acctgtctgtgcagatgc

SEQ ID NO: 5051702 - DNA, 12 bp, Homo sapiens
acctttgctgtc

SEQ ID NO: 5051703 - DNA, 20 bp, Homo sapiens
acgaggtggtagctctgagc

SEQ ID NO: 5051704 - DNA, 12 bp, Homo sapiens
acgccctgggga

SEQ ID NO: 5051705 - DNA, 19 bp, Homo sapiens
acgctccccgcctgttccc

SEQ ID NO: 5051706 - DNA, 20 bp, Homo sapiens
acgctccccgcctgttcccc

SEQ ID NO: 5051707 - DNA, 13 bp, Homo sapiens
acggaacagatct

SEQ ID NO: 5051708 - DNA, 17 bp, Homo sapiens
acggagggaccaggtgt

SEQ ID NO: 5051709 - DNA, 14 bp, Homo sapiens
acggatggaaggag

SEQ ID NO: 5051710 - DNA, 15 bp, Homo sapiens
acggatggaaggaga

SEQ ID NO: 5051711 - DNA, 13 bp, Homo sapiens
acgtgggagaggc

SEQ ID NO: 5051712 - DNA, 18 bp, Homo sapiens
acgtgggagaggcagaaa

SEQ ID NO: 5051713 - DNA, 19 bp, Homo sapiens
actaataaaaaactgtgaa

SEQ ID NO: 5051714 - DNA, 20 bp, Homo sapiens
actaccctacacctctgggc

SEQ ID NO: 5051715 - DNA, 23 bp, Homo sapiens
actaccctacacctctgggccct

SEQ ID NO: 5051716 - DNA, 19 bp, Homo sapiens
actccaaacaattctgatg

SEQ ID NO: 5051717 - DNA, 18 bp, Homo sapiens
actctggaccccaggcca

SEQ ID NO: 5051718 - DNA, 22 bp, Homo sapiens
actctgtgtcagcatctttgcc

SEQ ID NO: 5051719 - DNA, 13 bp, Homo sapiens
actgcagaggagc

SEQ ID NO: 5051720 - DNA, 21 bp, Homo sapiens
actgcagaggagccacctggg

SEQ ID NO: 5051721 - DNA, 22 bp, Homo sapiens
actgcagaggagccacctgggc

SEQ ID NO: 5051722 - DNA, 17 bp, Homo sapiens
actgccttaccttcact

SEQ ID NO: 5051723 - DNA, 14 bp, Homo sapiens
actggccagaggca

SEQ ID NO: 5051724 - DNA, 17 bp, Homo sapiens
actggccagaggcagct

SEQ ID NO: 5051725 - DNA, 13 bp, Homo sapiens
actggcctgcccg

SEQ ID NO: 5051726 - DNA, 22 bp, Homo sapiens
actggcctgttctgtaggagag

SEQ ID NO: 5051727 - DNA, 23 bp, Homo sapiens
actggcctgttctgtaggagaga

SEQ ID NO: 5051728 - DNA, 19 bp, Homo sapiens
actgtaggcgcccctgggg

SEQ ID NO: 5051729 - DNA, 21 bp, Homo sapiens
actgtaggcgcccctggggtg

SEQ ID NO: 5051730 - DNA, 20 bp, Homo sapiens
actgtcttgactgtcacgga

SEQ ID NO: 5051731 - DNA, 14 bp, Homo sapiens
acttggatattcaa

SEQ ID NO: 5051732 - DNA, 19 bp, Homo sapiens
acttggatattcaagcctt

SEQ ID NO: 5051733 - DNA, 23 bp, Homo sapiens
actttagggatctggggaaggac

SEQ ID NO: 5051734 - DNA, 12 bp, Homo sapiens
actttctctctt

SEQ ID NO: 5051735 - DNA, 22 bp, Homo sapiens
agaagacaaactccggcactgg

SEQ ID NO: 5051736 - DNA, 18 bp, Homo sapiens
agaaggctcagccttgga

SEQ ID NO: 5051737 - DNA, 15 bp, Homo sapiens
agaaggtgcttgggc

SEQ ID NO: 5051738 - DNA, 14 bp, Homo sapiens
agaatgtgtgtgca

SEQ ID NO: 5051739 - DNA, 20 bp, Homo sapiens
agaattctaggcagcacctt

SEQ ID NO: 5051740 - DNA, 20 bp, Homo sapiens
agagactggccagaggcagc

SEQ ID NO: 5051741 - DNA, 14 bp, Homo sapiens
agagaggttgagga

SEQ ID NO: 5051742 - DNA, 20 bp, Homo sapiens
agagatacccacagagtgtg

SEQ ID NO: 5051743 - DNA, 13 bp, Homo sapiens
agagcccactgct

SEQ ID NO: 5051744 - DNA, 15 bp, Homo sapiens
agagcccactgctca

SEQ ID NO: 5051745 - DNA, 17 bp, Homo sapiens
agaggagagcatctgct

SEQ ID NO: 5051746 - DNA, 20 bp, Homo sapiens
agaggagagcatctgctctg

SEQ ID NO: 5051747 - DNA, 21 bp, Homo sapiens
agaggagagtacccccctgag

SEQ ID NO: 5051748 - DNA, 15 bp, Homo sapiens
agaggagccacctgg

SEQ ID NO: 5051749 - DNA, 17 bp, Homo sapiens
agaggagccacctgggc

SEQ ID NO: 5051750 - DNA, 18 bp, Homo sapiens
agaggagccacctgggct

SEQ ID NO: 5051751 - DNA, 22 bp, Homo sapiens
agaggcaacagtgttctgagcc

SEQ ID NO: 5051752 - DNA, 21 bp, Homo sapiens
agaggcagctaaggggcagga

SEQ ID NO: 5051753 - DNA, 17 bp, Homo sapiens
agagtgaccttttaatc

SEQ ID NO: 5051754 - DNA, 20 bp, Homo sapiens
agagtgaccttttaatcaga

SEQ ID NO: 5051755 - DNA, 24 bp, Homo sapiens
agagtggcagccaagagccatctg

SEQ ID NO: 5051756 - DNA, 16 bp, Homo sapiens
agatcttgttctttgc

SEQ ID NO: 5051757 - DNA, 16 bp, Homo sapiens
agatgctttgcccagg

SEQ ID NO: 5051758 - DNA, 12 bp, Homo sapiens
agatggctgctg

SEQ ID NO: 5051759 - DNA, 18 bp, Homo sapiens
agatgggggcaagaagat

SEQ ID NO: 5051760 - DNA, 17 bp, Homo sapiens
agatgttggtggtgcag

SEQ ID NO: 5051761 - DNA, 17 bp, Homo sapiens
agcaaatgccttttcaa

SEQ ID NO: 5051762 - DNA, 23 bp, Homo sapiens
agcaagcaattctgccccacacc

SEQ ID NO: 5051763 - DNA, 15 bp, Homo sapiens
agcaatctggaagaa

SEQ ID NO: 5051764 - DNA, 22 bp, Homo sapiens
catctgggccaccagctccact

SEQ ID NO: 5051765 - DNA, 17 bp, Homo sapiens
catctttgcccttctgg

SEQ ID NO: 5051766 - DNA, 18 bp, Homo sapiens
catctttgcccttctggt

SEQ ID NO: 5051767 - DNA, 17 bp, Homo sapiens
catgcccgctgtcccag

SEQ ID NO: 5051768 - DNA, 21 bp, Homo sapiens
catgccctgccaagcctggag

SEQ ID NO: 5051769 - DNA, 23 bp, Homo sapiens
catgccctgccaagcctggagcc

SEQ ID NO: 5051770 - DNA, 17 bp, Homo sapiens
catgcgaattcttgctt

SEQ ID NO: 5051771 - DNA, 15 bp, Homo sapiens
catgctgagtctccc

SEQ ID NO: 5051772 - DNA, 20 bp, Homo sapiens
catgctgagtctcccaaggc

SEQ ID NO: 5051773 - DNA, 20 bp, Homo sapiens
catggcatcatccattctct

SEQ ID NO: 5051774 - DNA, 21 bp, Homo sapiens
catggcatcatccattctctc

SEQ ID NO: 5051775 - DNA, 23 bp, Homo sapiens
catggcatcatccattctctctg

SEQ ID NO: 5051776 - DNA, 19 bp, Homo sapiens
catggtacccccttctggg

SEQ ID NO: 5051777 - DNA, 15 bp, Homo sapiens
catgtgggggaaggc

SEQ ID NO: 5051778 - DNA, 13 bp, Homo sapiens
catgtgtaagaca

SEQ ID NO: 5051779 - DNA, 20 bp, Homo sapiens
cattaaactcatattttgaa

SEQ ID NO: 5051780 - DNA, 17 bp, Homo sapiens
cattcagcaaatgcctt

SEQ ID NO: 5051781 - DNA, 22 bp, Homo sapiens
cattcatatcactatgaacttg

SEQ ID NO: 5051782 - DNA, 13 bp, Homo sapiens
cattctctctgcc

SEQ ID NO: 5051783 - DNA, 14 bp, Homo sapiens
cattctctctgccc

SEQ ID NO: 5051784 - DNA, 19 bp, Homo sapiens
cattctgcctgcctgggaa

SEQ ID NO: 5051785 - DNA, 13 bp, Homo sapiens
cattgtcttgttc

SEQ ID NO: 5051786 - DNA, 22 bp, Homo sapiens
catttcaggttgtgcattttgt

SEQ ID NO: 5051787 - DNA, 19 bp, Homo sapiens
cattttgtgtgatgcatgt

SEQ ID NO: 5051788 - DNA, 13 bp, Homo sapiens
catttttctgatg

SEQ ID NO: 5051789 - DNA, 17 bp, Homo sapiens
ccaaacaattctgatga

SEQ ID NO: 5051790 - DNA, 12 bp, Homo sapiens
ccaaaggaaaaa

SEQ ID NO: 5051791 - DNA, 22 bp, Homo sapiens
ccaaaggaaaaagcacaagaag

SEQ ID NO: 5051792 - DNA, 18 bp, Homo sapiens
ccaaagtgccttctgagc

SEQ ID NO: 5051793 - DNA, 13 bp, Homo sapiens
ccaacaccagccc

SEQ ID NO: 5051794 - DNA, 13 bp, Homo sapiens
ccaacagagtggt

SEQ ID NO: 5051795 - DNA, 14 bp, Homo sapiens
ccaacccatgccct

SEQ ID NO: 5051796 - DNA, 15 bp, Homo sapiens
ccaacccatgccctg

SEQ ID NO: 5051797 - DNA, 13 bp, Homo sapiens
ccaaccccagccg

SEQ ID NO: 5051798 - DNA, 22 bp, Homo sapiens
ccaactccaaacaattctgatg

SEQ ID NO: 5051799 - DNA, 15 bp, Homo sapiens
ccaactcgggagcat

SEQ ID NO: 5051800 - DNA, 21 bp, Homo sapiens
ccaagaccatctctccctcct

SEQ ID NO: 5051801 - DNA, 17 bp, Homo sapiens
ccaagcttaaggagagg

SEQ ID NO: 5051802 - DNA, 14 bp, Homo sapiens
ccaagttgctctgt

SEQ ID NO: 5051803 - DNA, 18 bp, Homo sapiens
ccacacacacctgtctgt

SEQ ID NO: 5051804 - DNA, 21 bp, Homo sapiens
ccacacacacctgtctgtgca

SEQ ID NO: 5051805 - DNA, 17 bp, Homo sapiens
ccacacccagccagctc

SEQ ID NO: 5051806 - DNA, 21 bp, Homo sapiens
ccacacccagccagctccttt

SEQ ID NO: 5051807 - DNA, 18 bp, Homo sapiens
ccacagagtgtggtccct

SEQ ID NO: 5051808 - DNA, 15 bp, Homo sapiens
ccacaggcctccctg

SEQ ID NO: 5051809 - DNA, 21 bp, Homo sapiens
ccaccattcctggaaaccaca

SEQ ID NO: 5051810 - DNA, 19 bp, Homo sapiens
ccacctctctgcctgttcc

SEQ ID NO: 5051811 - DNA, 13 bp, Homo sapiens
ccacctgggctgg

SEQ ID NO: 5051812 - DNA, 17 bp, Homo sapiens
ccacctgggctgggaga

SEQ ID NO: 5051813 - DNA, 22 bp, Homo sapiens
ccacgaggtggtagctctgagc

SEQ ID NO: 5051814 - DNA, 23 bp, Homo sapiens
ccactccctttgcgtcaggagca

SEQ ID NO: 5051815 - DNA, 24 bp, Homo sapiens
ccactccctttgcgtcaggagcag

SEQ ID NO: 5051816 - DNA, 18 bp, Homo sapiens
ccactgggacggctcctg

SEQ ID NO: 5051817 - DNA, 21 bp, Homo sapiens
ccacttagcagggacaggaga

SEQ ID NO: 5051818 - DNA, 17 bp, Homo sapiens
ccagcccacatccagtg

SEQ ID NO: 5051819 - DNA, 15 bp, Homo sapiens
ccagcccctgcccca

SEQ ID NO: 5051820 - DNA, 16 bp, Homo sapiens
ccagctccactggcct

SEQ ID NO: 5051821 - DNA, 22 bp, Homo sapiens
ccagctcctttcccttttccat

SEQ ID NO: 5051822 - DNA, 12 bp, Homo sapiens
ccagctgggctg

SEQ ID NO: 5051823 - DNA, 13 bp, Homo sapiens
ccagctgggctgt

SEQ ID NO: 5051824 - DNA, 18 bp, Homo sapiens
ccagctttgcccaacacc

SEQ ID NO: 5051825 - DNA, 21 bp, Homo sapiens
ccaggattgtacgtgggagag

SEQ ID NO: 5051826 - DNA, 21 bp, Homo sapiens
ccaggggtctccctgagcctg

SEQ ID NO: 5051827 - DNA, 20 bp, Homo sapiens
ccaggtgctagggtgcctgc

SEQ ID NO: 5051828 - DNA, 21 bp, Homo sapiens
ccagtcccccaaccccagccg

SEQ ID NO: 5051829 - DNA, 18 bp, Homo sapiens
ccagtcctcacatgcccg

SEQ ID NO: 5051830 - DNA, 21 bp, Homo sapiens
ccagtcctcacatgcccgctg

SEQ ID NO: 5051831 - DNA, 21 bp, Homo sapiens
ccagttacctttgctgtcact

SEQ ID NO: 5051832 - DNA, 16 bp, Homo sapiens
ccatacagacagcaca

SEQ ID NO: 5051833 - DNA, 16 bp, Homo sapiens
ccatcatttctagtat

SEQ ID NO: 5051834 - DNA, 14 bp, Homo sapiens
ccatctctgctgct

SEQ ID NO: 5051835 - DNA, 18 bp, Homo sapiens
ccatctgaagccacctct

SEQ ID NO: 5051836 - DNA, 19 bp, Homo sapiens
ccatggtacccccttctgg

SEQ ID NO: 5051837 - DNA, 16 bp, Homo sapiens
ccatgttgactgtctt

SEQ ID NO: 5051838 - DNA, 22 bp, Homo sapiens
ccattcctggaaaccacagtcc

SEQ ID NO: 5051839 - DNA, 12 bp, Homo sapiens
ccattctctctg

SEQ ID NO: 5051840 - DNA, 16 bp, Homo sapiens
ccattctctctgccca

SEQ ID NO: 5051841 - DNA, 17 bp, Homo sapiens
cccaacaccagcccctg

SEQ ID NO: 5051842 - DNA, 20 bp, Homo sapiens
cccaacaccagcccctgccc

SEQ ID NO: 5051843 - DNA, 16 bp, Homo sapiens
cccaacccctgaggaa

SEQ ID NO: 5051844 - DNA, 15 bp, Homo sapiens
cccaaggctgcgtct

SEQ ID NO: 5051845 - DNA, 20 bp, Homo sapiens
cccaaggctgcgtctggagg

SEQ ID NO: 5051846 - DNA, 14 bp, Homo sapiens
cccaagttgctctg

SEQ ID NO: 5051847 - DNA, 16 bp, Homo sapiens
cccaagttgctctgta

SEQ ID NO: 5051848 - DNA, 16 bp, Homo sapiens
cccacacccagccagc

SEQ ID NO: 5051849 - DNA, 14 bp, Homo sapiens
cccacctctgagga

SEQ ID NO: 5051850 - DNA, 17 bp, Homo sapiens
cccacttagcagggaca

SEQ ID NO: 5051851 - DNA, 19 bp, Homo sapiens
cccagccagctcctttccc

SEQ ID NO: 5051852 - DNA, 12 bp, Homo sapiens
cccagcccaagt

SEQ ID NO: 5051853 - DNA, 14 bp, Homo sapiens
cccagcccaagtcc

SEQ ID NO: 5051854 - DNA, 14 bp, Homo sapiens
cccagccgctcgga

SEQ ID NO: 5051855 - DNA, 18 bp, Homo sapiens
cccagctgccggcagtgc

SEQ ID NO: 5051856 - DNA, 19 bp, Homo sapiens
cctgcttttggggctcttg

SEQ ID NO: 5051857 - DNA, 16 bp, Homo sapiens
cctggacccccagctt

SEQ ID NO: 5051858 - DNA, 15 bp, Homo sapiens
cctggagcccctgtg

SEQ ID NO: 5051859 - DNA, 20 bp, Homo sapiens
cctggcgggatgggccaccg

SEQ ID NO: 5051860 - DNA, 14 bp, Homo sapiens
cctggggagtgagc

SEQ ID NO: 5051861 - DNA, 14 bp, Homo sapiens
cctgtcatctgggc

SEQ ID NO: 5051862 - DNA, 16 bp, Homo sapiens
cctgtcccctcagctc

SEQ ID NO: 5051863 - DNA, 21 bp, Homo sapiens
cctgtcccctcagctccagac

SEQ ID NO: 5051864 - DNA, 14 bp, Homo sapiens
cctgtctgtgcaga

SEQ ID NO: 5051865 - DNA, 12 bp, Homo sapiens
cctgtgctttgg

SEQ ID NO: 5051866 - DNA, 17 bp, Homo sapiens
cctgtgctttgggggag

SEQ ID NO: 5051867 - DNA, 15 bp, Homo sapiens
cctgtgtcggggggc

SEQ ID NO: 5051868 - DNA, 14 bp, Homo sapiens
cctgtgtgggaggg

SEQ ID NO: 5051869 - DNA, 13 bp, Homo sapiens
cctgttctgtagg

SEQ ID NO: 5051870 - DNA, 17 bp, Homo sapiens
cctgttctgtaggagag

SEQ ID NO: 5051871 - DNA, 18 bp, Homo sapiens
ccttctgggcatctgttc

SEQ ID NO: 5051872 - DNA, 15 bp, Homo sapiens
ccttcttgccctgag

SEQ ID NO: 5051873 - DNA, 12 bp, Homo sapiens
cctttcctgatg

SEQ ID NO: 5051874 - DNA, 15 bp, Homo sapiens
cctttgctgtcactt

SEQ ID NO: 5051875 - DNA, 16 bp, Homo sapiens
cgaattagtttgcact

SEQ ID NO: 5051876 - DNA, 22 bp, Homo sapiens
cgaattagtttgcacttcctgt

SEQ ID NO: 5051877 - DNA, 23 bp, Homo sapiens
cgactttgtaccccccaacccct

SEQ ID NO: 5051878 - DNA, 15 bp, Homo sapiens
cgaggcctagagtgg

SEQ ID NO: 5051879 - DNA, 17 bp, Homo sapiens
cgaggcgggggagcctg

SEQ ID NO: 5051880 - DNA, 10 bp, Homo sapiens
cgagggaggg

SEQ ID NO: 5051881 - DNA, 11 bp, Homo sapiens
cgagggagggg

SEQ ID NO: 5051882 - DNA, 14 bp, Homo sapiens
cgagggaggggagg

SEQ ID NO: 5051883 - DNA, 16 bp, Homo sapiens
cgagggaggggaggtg

SEQ ID NO: 5051884 - DNA, 21 bp, Homo sapiens
cgaggtggtagctctgagccc

SEQ ID NO: 5051885 - DNA, 11 bp, Homo sapiens
cgcccctgggg

SEQ ID NO: 5051886 - DNA, 14 bp, Homo sapiens
cgctccccgcctgt

SEQ ID NO: 5051887 - DNA, 19 bp, Homo sapiens
cgctccccgcctgttcccc

SEQ ID NO: 5051888 - DNA, 16 bp, Homo sapiens
cgctcggaggccccaa

SEQ ID NO: 5051889 - DNA, 12 bp, Homo sapiens
cggagggaccag

SEQ ID NO: 5051890 - DNA, 16 bp, Homo sapiens
cggatggaaggagaga

SEQ ID NO: 5051891 - DNA, 19 bp, Homo sapiens
cggatggaaggagagaggt

SEQ ID NO: 5051892 - DNA, 15 bp, Homo sapiens
cggcagtgctggttc

SEQ ID NO: 5051893 - DNA, 12 bp, Homo sapiens
cgggcctggact

SEQ ID NO: 5051894 - DNA, 22 bp, Homo sapiens
cggggcctggcgggatgggcca

SEQ ID NO: 5051895 - DNA, 14 bp, Homo sapiens
cgggggagcctgga

SEQ ID NO: 5051896 - DNA, 15 bp, Homo sapiens
cgggggatcctggag

SEQ ID NO: 5051897 - DNA, 17 bp, Homo sapiens
cggggggcgagggaggg

SEQ ID NO: 5051898 - DNA, 13 bp, Homo sapiens
cggtgaggcaggg

SEQ ID NO: 5051899 - DNA, 14 bp, Homo sapiens
cggtgaggcagggg

SEQ ID NO: 5051900 - DNA, 14 bp, Homo sapiens
cgtcagtgttcatg

SEQ ID NO: 5051901 - DNA, 17 bp, Homo sapiens
cgtcagtgttcatgcga

SEQ ID NO: 5051902 - DNA, 14 bp, Homo sapiens
cgtctggaggggcc

SEQ ID NO: 5051903 - DNA, 18 bp, Homo sapiens
cgtctggaggggcccctg

SEQ ID NO: 5051904 - DNA, 23 bp, Homo sapiens
cgtgagacgccaccattcctgga

SEQ ID NO: 5051905 - DNA, 14 bp, Homo sapiens
cgtgggagaggcag

SEQ ID NO: 5051906 - DNA, 15 bp, Homo sapiens
cgtgggagaggcaga

SEQ ID NO: 5051907 - DNA, 17 bp, Homo sapiens
cgttgccgggcctggac

SEQ ID NO: 5051908 - DNA, 12 bp, Homo sapiens
ctaaacttccct

SEQ ID NO: 5051909 - DNA, 16 bp, Homo sapiens
ctaacctcactgcctc

SEQ ID NO: 5051910 - DNA, 17 bp, Homo sapiens
ctaacctcactgcctca

SEQ ID NO: 5051911 - DNA, 16 bp, Homo sapiens
ctaccatacagacagc

SEQ ID NO: 5051912 - DNA, 19 bp, Homo sapiens
ctaccctacacctctgggc

SEQ ID NO: 5051913 - DNA, 22 bp, Homo sapiens
ctaccctacacctctgggccct

SEQ ID NO: 5051914 - DNA, 18 bp, Homo sapiens
ctagaggcaacagtgttc

SEQ ID NO: 5051915 - DNA, 13 bp, Homo sapiens
ctagcctgctctg

SEQ ID NO: 5051916 - DNA, 15 bp, Homo sapiens
ctagcctgctctgcc

SEQ ID NO: 5051917 - DNA, 20 bp, Homo sapiens
ctaggactttagggatctgg

SEQ ID NO: 5051918 - DNA, 20 bp, Homo sapiens
ctaggagttaactaccctac

SEQ ID NO: 5051919 - DNA, 15 bp, Homo sapiens
ctagggtgcctgctc

SEQ ID NO: 5051920 - DNA, 21 bp, Homo sapiens
ctatggagagggcttgaaatg

SEQ ID NO: 5051921 - DNA, 16 bp, Homo sapiens
ctcacatgcccgctgt

SEQ ID NO: 5051922 - DNA, 21 bp, Homo sapiens
ctcacttaaacaatgtcctct

SEQ ID NO: 5051923 - DNA, 12 bp, Homo sapiens
ctcagctccccc

SEQ ID NO: 5051924 - DNA, 14 bp, Homo sapiens
ctcagctccccctg

SEQ ID NO: 5051925 - DNA, 15 bp, Homo sapiens
ctcagctccccctgt

SEQ ID NO: 5051926 - DNA, 16 bp, Homo sapiens
ctcagctccccctgtc

SEQ ID NO: 5051927 - DNA, 19 bp, Homo sapiens
ctcagctccccctgtcccc

SEQ ID NO: 5051928 - DNA, 15 bp, Homo sapiens
ctcagtcagtgcact

SEQ ID NO: 5051929 - DNA, 18 bp, Homo sapiens
ctcagtccagtcctcaca

SEQ ID NO: 5051930 - DNA, 18 bp, Homo sapiens
ctcattgtataagccccg

SEQ ID NO: 5051931 - DNA, 14 bp, Homo sapiens
ctccaacagagtgg

SEQ ID NO: 5051932 - DNA, 15 bp, Homo sapiens
ctccacgccctgggg

SEQ ID NO: 5051933 - DNA, 16 bp, Homo sapiens
ctccacgccctgggga

SEQ ID NO: 5051934 - DNA, 18 bp, Homo sapiens
ctccactggcctgcccgt

SEQ ID NO: 5051935 - DNA, 19 bp, Homo sapiens
ctccagacgtaggggaggg

SEQ ID NO: 5051936 - DNA, 12 bp, Homo sapiens
ctccagccaaga

SEQ ID NO: 5051937 - DNA, 20 bp, Homo sapiens
ctccagcctggacccccagc

SEQ ID NO: 5051938 - DNA, 15 bp, Homo sapiens
ctccaggacttgctt

SEQ ID NO: 5051939 - DNA, 21 bp, Homo sapiens
ctcccaaggctgcgtctggag

SEQ ID NO: 5051940 - DNA, 21 bp, Homo sapiens
ctcccacaattggccagggca

SEQ ID NO: 5051941 - DNA, 19 bp, Homo sapiens
ctccctgagcctgccccag

SEQ ID NO: 5051942 - DNA, 21 bp, Homo sapiens
ctccctgagcctgccccagct

SEQ ID NO: 5051943 - DNA, 19 bp, Homo sapiens
ctccctgattaaagtgcct

SEQ ID NO: 5051944 - DNA, 21 bp, Homo sapiens
ctccctgtttgaagcctgccc

SEQ ID NO: 5051945 - DNA, 22 bp, Homo sapiens
ctccctgtttgaagcctgccct

SEQ ID NO: 5051946 - DNA, 20 bp, Homo sapiens
ctccgttcccacctctgagg

SEQ ID NO: 5051947 - DNA, 17 bp, Homo sapiens
ctcctagcctgctctgc

SEQ ID NO: 5051948 - DNA, 19 bp, Homo sapiens
ctcctagcctgctctgcca

SEQ ID NO: 5051949 - DNA, 21 bp, Homo sapiens
ctcctagcctgctctgccact

SEQ ID NO: 5051950 - DNA, 15 bp, Homo sapiens
ctcctctttcctctc

SEQ ID NO: 5051951 - DNA, 11 bp, Homo sapiens
ctcctgcccag

SEQ ID NO: 5051952 - DNA, 13 bp, Homo sapiens
ctcctgcccagtc

SEQ ID NO: 5051953 - DNA, 18 bp, Homo sapiens
ctcctgcccagtccccca

SEQ ID NO: 5051954 - DNA, 20 bp, Homo sapiens
ctcctgcttttggggctctt

SEQ ID NO: 5051955 - DNA, 19 bp, Homo sapiens
ctccttcttgccctgagct

SEQ ID NO: 5051956 - DNA, 15 bp, Homo sapiens
ctccttgccctgggc

SEQ ID NO: 5051957 - DNA, 13 bp, Homo sapiens
ctcggaggcccca

SEQ ID NO: 5051958 - DNA, 19 bp, Homo sapiens
ctctccttgccctgggcca

SEQ ID NO: 5051959 - DNA, 12 bp, Homo sapiens
ctctctgcccaa

SEQ ID NO: 5051960 - DNA, 21 bp, Homo sapiens
ctctctttgttctcagctccc

SEQ ID NO: 5051961 - DNA, 18 bp, Homo sapiens
ctctgaagagatacccac

SEQ ID NO: 5051962 - DNA, 21 bp, Homo sapiens
ctctgagacggatggaaggag

SEQ ID NO: 5051963 - DNA, 15 bp, Homo sapiens
cttctgagctgtcta

SEQ ID NO: 5051964 - DNA, 19 bp, Homo sapiens
cttctgggcatctgttctg

SEQ ID NO: 5051965 - DNA, 20 bp, Homo sapiens
cttctgggcatctgttctgg

SEQ ID NO: 5051966 - DNA, 13 bp, Homo sapiens
cttcttgccctga

SEQ ID NO: 5051967 - DNA, 20 bp, Homo sapiens
cttgccctgagctttccggg

SEQ ID NO: 5051968 - DNA, 15 bp, Homo sapiens
cttgccctgggccag

SEQ ID NO: 5051969 - DNA, 22 bp, Homo sapiens
cttgccctgggccagcccagga

SEQ ID NO: 5051970 - DNA, 18 bp, Homo sapiens
cttggatattcaagcctt

SEQ ID NO: 5051971 - DNA, 13 bp, Homo sapiens
cttgggcttctgc

SEQ ID NO: 5051972 - DNA, 20 bp, Homo sapiens
cttgttctgtgatgagggga

SEQ ID NO: 5051973 - DNA, 21 bp, Homo sapiens
cttgttctgtgatgaggggag

SEQ ID NO: 5051974 - DNA, 13 bp, Homo sapiens
cttgttctttgct

SEQ ID NO: 5051975 - DNA, 19 bp, Homo sapiens
ctttccggggaggagcctt

SEQ ID NO: 5051976 - DNA, 23 bp, Homo sapiens
ctttccggggaggagccttggag

SEQ ID NO: 5051977 - DNA, 13 bp, Homo sapiens
ctttcctgatgac

SEQ ID NO: 5051978 - DNA, 19 bp, Homo sapiens
ctttgcccaacaccagccc

SEQ ID NO: 5051979 - DNA, 16 bp, Homo sapiens
ctttgcccaggcttct

SEQ ID NO: 5051980 - DNA, 16 bp, Homo sapiens
ctttgcgtcaggagca

SEQ ID NO: 5051981 - DNA, 14 bp, Homo sapiens
ctttgttctcagct

SEQ ID NO: 5051982 - DNA, 16 bp, Homo sapiens
cttttcaaatgcagca

SEQ ID NO: 5051983 - DNA, 16 bp, Homo sapiens
gaaaaagcacaagaag

SEQ ID NO: 5051984 - DNA, 20 bp, Homo sapiens
gaaaacttttacatttttct

SEQ ID NO: 5051985 - DNA, 15 bp, Homo sapiens
gaaagccctgtgctt

SEQ ID NO: 5051986 - DNA, 20 bp, Homo sapiens
gaaagtgggacctggtgggc

SEQ ID NO: 5051987 - DNA, 13 bp, Homo sapiens
gaaattgggtgtg

SEQ ID NO: 5051988 - DNA, 16 bp, Homo sapiens
gaactcaaggtggctg

SEQ ID NO: 5051989 - DNA, 20 bp, Homo sapiens
gaactcaaggtggctggaga

SEQ ID NO: 5051990 - DNA, 22 bp, Homo sapiens
gaacttggatattcaagccttt

SEQ ID NO: 5051991 - DNA, 21 bp, Homo sapiens
gaagacaaactccggcactgg

SEQ ID NO: 5051992 - DNA, 12 bp, Homo sapiens
gaagatgggggc

SEQ ID NO: 5051993 - DNA, 15 bp, Homo sapiens
gaagccacctctctg

SEQ ID NO: 5051994 - DNA, 12 bp, Homo sapiens
gaagcctgccct

SEQ ID NO: 5051995 - DNA, 17 bp, Homo sapiens
gaaggccttgctgtcat

SEQ ID NO: 5051996 - DNA, 15 bp, Homo sapiens
gaatgtgtgtgcaga

SEQ ID NO: 5051997 - DNA, 16 bp, Homo sapiens
gacagctttctaactc

SEQ ID NO: 5051998 - DNA, 20 bp, Homo sapiens
gacagctttctaactcacag

SEQ ID NO: 5051999 - DNA, 22 bp, Homo sapiens
gacagctttctaactcacaggc

SEQ ID NO: 5052000 - DNA, 18 bp, Homo sapiens
gaccaacccatgccctgc

SEQ ID NO: 5052001 - DNA, 19 bp, Homo sapiens
gaccaacccatgccctgcc

SEQ ID NO: 5052002 - DNA, 18 bp, Homo sapiens
gaccccatctctgctgct

SEQ ID NO: 5052003 - DNA, 22 bp, Homo sapiens
gacgagggagtgtctgtaagga

SEQ ID NO: 5052004 - DNA, 15 bp, Homo sapiens
gacgccaccattcct

SEQ ID NO: 5052005 - DNA, 16 bp, Homo sapiens
gacgccaccattcctg

SEQ ID NO: 5052006 - DNA, 14 bp, Homo sapiens
gacggatggaagga

SEQ ID NO: 5052007 - DNA, 16 bp, Homo sapiens
gacggatggaaggaga

SEQ ID NO: 5052008 - DNA, 16 bp, Homo sapiens
gactggccagaggcag

SEQ ID NO: 5052009 - DNA, 20 bp, Homo sapiens
gactgtaggcgcccctgggg

SEQ ID NO: 5052010 - DNA, 18 bp, Homo sapiens
gacttgagccagttacct

SEQ ID NO: 5052011 - DNA, 22 bp, Homo sapiens
gagaagacaaactccggcactg

SEQ ID NO: 5052012 - DNA, 14 bp, Homo sapiens
gagaaggtgcttgg

SEQ ID NO: 5052013 - DNA, 12 bp, Homo sapiens
gagatggctgct

SEQ ID NO: 5052014 - DNA, 13 bp, Homo sapiens
gagcatctgctct

SEQ ID NO: 5052015 - DNA, 19 bp, Homo sapiens
gagcatgtgggggaaggcc

SEQ ID NO: 5052016 - DNA, 15 bp, Homo sapiens
gagcattctgcctgc

SEQ ID NO: 5052017 - DNA, 19 bp, Homo sapiens
gagcattctgcctgcctgg

SEQ ID NO: 5052018 - DNA, 20 bp, Homo sapiens
gagcattctgcctgcctggg

SEQ ID NO: 5052019 - DNA, 22 bp, Homo sapiens
gagcattctgcctgcctgggaa

SEQ ID NO: 5052020 - DNA, 13 bp, Homo sapiens
gagccacctgggc

SEQ ID NO: 5052021 - DNA, 18 bp, Homo sapiens
gagccacctgggctggga

SEQ ID NO: 5052022 - DNA, 18 bp, Homo sapiens
gagccctccttcttgccc

SEQ ID NO: 5052023 - DNA, 21 bp, Homo sapiens
gagccctccttcttgccctga

SEQ ID NO: 5052024 - DNA, 20 bp, Homo sapiens
gagcctgccccagctgggct

SEQ ID NO: 5052025 - DNA, 21 bp, Homo sapiens
gagcctgccccagctgggctg

SEQ ID NO: 5052026 - DNA, 19 bp, Homo sapiens
gagcctggagcccctgtgt

SEQ ID NO: 5052027 - DNA, 13 bp, Homo sapiens
gagcttcagggct

SEQ ID NO: 5052028 - DNA, 21 bp, Homo sapiens
gagctttccggggaggagcct

SEQ ID NO: 5052029 - DNA, 23 bp, Homo sapiens
gagctttccggggaggagccttg

SEQ ID NO: 5052030 - DNA, 19 bp, Homo sapiens
gaggagagcatctgctctg

SEQ ID NO: 5052031 - DNA, 21 bp, Homo sapiens
gaggagagtacccccctgaga

SEQ ID NO: 5052032 - DNA, 18 bp, Homo sapiens
gaggagccacctgggctg

SEQ ID NO: 5052033 - DNA, 12 bp, Homo sapiens
gaggatgcactg

SEQ ID NO: 5052034 - DNA, 16 bp, Homo sapiens
gaggatgcactggcct

SEQ ID NO: 5052035 - DNA, 22 bp, Homo sapiens
gaggcaacagtgttctgagccc

SEQ ID NO: 5052036 - DNA, 15 bp, Homo sapiens
gaggcaggggagtct

SEQ ID NO: 5052037 - DNA, 17 bp, Homo sapiens
gaggccagggtggccag

SEQ ID NO: 5052038 - DNA, 14 bp, Homo sapiens
gaggcgggggagcc

SEQ ID NO: 5052039 - DNA, 15 bp, Homo sapiens
gaggctctgaagaga

SEQ ID NO: 5052040 - DNA, 21 bp, Homo sapiens
gaggctgagactgcagaggag

SEQ ID NO: 5052041 - DNA, 21 bp, Homo sapiens
gagggaccaggtgtctagagg

SEQ ID NO: 5052042 - DNA, 17 bp, Homo sapiens
gagggaggggaggtggc

SEQ ID NO: 5052043 - DNA, 13 bp, Homo sapiens
gagggcgaggcgg

SEQ ID NO: 5052044 - DNA, 15 bp, Homo sapiens
gaggggggcacatgc

SEQ ID NO: 5052045 - DNA, 17 bp, Homo sapiens
gaggggttgccacaggc

SEQ ID NO: 5052046 - DNA, 13 bp, Homo sapiens
gagtctgcttgtc

SEQ ID NO: 5052047 - DNA, 22 bp, Homo sapiens
gagtctgcttgtcttagatgtt

SEQ ID NO: 5052048 - DNA, 13 bp, Homo sapiens
gagtgctggctcc

SEQ ID NO: 5052049 - DNA, 14 bp, Homo sapiens
gagtgctggctcca

SEQ ID NO: 5052050 - DNA, 20 bp, Homo sapiens
gagttcatactgatgccctg

SEQ ID NO: 5052051 - DNA, 21 bp, Homo sapiens
gatattaaacctctttcccca

SEQ ID NO: 5052052 - DNA, 18 bp, Homo sapiens
gatattcaagcctttgga

SEQ ID NO: 5052053 - DNA, 20 bp, Homo sapiens
gatatttgctggagtgctgg

SEQ ID NO: 5052054 - DNA, 22 bp, Homo sapiens
gatatttgctggagtgctggct

SEQ ID NO: 5052055 - DNA, 15 bp, Homo sapiens
gatcagtgtgctaac

SEQ ID NO: 5052056 - DNA, 11 bp, Homo sapiens
gatcctggagc

SEQ ID NO: 5052057 - DNA, 14 bp, Homo sapiens
gatcctggagcccc

SEQ ID NO: 5052058 - DNA, 15 bp, Homo sapiens
gatcctggagcccct

SEQ ID NO: 5052059 - DNA, 13 bp, Homo sapiens
gatctggggaagg

SEQ ID NO: 5052060 - DNA, 15 bp, Homo sapiens
gatctggggaaggac

SEQ ID NO: 5052061 - DNA, 16 bp, Homo sapiens
gatggctgctgctcac

SEQ ID NO: 5052062 - DNA, 16 bp, Homo sapiens
gatgggaggttgattt

SEQ ID NO: 5052063 - DNA, 13 bp, Homo sapiens
gatgggccaccgc

SEQ ID NO: 5052064 - DNA, 13 bp, Homo sapiens
gatgggttcatgt

SEQ ID NO: 5052065 - DNA, 19 bp, Homo sapiens
gatgggttcatgtctctga

SEQ ID NO: 5052066 - DNA, 18 bp, Homo sapiens
gattgggtcagctggctt

SEQ ID NO: 5052067 - DNA, 23 bp, Homo sapiens
gattgtacgtgggagaggcagaa

SEQ ID NO: 5052068 - DNA, 21 bp, Homo sapiens
gcaaatgccttttcaaatgca

SEQ ID NO: 5052069 - DNA, 19 bp, Homo sapiens
gcaagaagatcacgctccc

SEQ ID NO: 5052070 - DNA, 21 bp, Homo sapiens
gcaagaagatcacgctccccg

SEQ ID NO: 5052071 - DNA, 22 bp, Homo sapiens
gcaagggtcctacggagggacc

SEQ ID NO: 5052072 - DNA, 16 bp, Homo sapiens
gcaaggtgggggagcc

SEQ ID NO: 5052073 - DNA, 22 bp, Homo sapiens
gcaaggtgggggagcctggagc

SEQ ID NO: 5052074 - DNA, 22 bp, Homo sapiens
gcaatctggaagaaagccctgt

SEQ ID NO: 5052075 - DNA, 17 bp, Homo sapiens
gcacaagaagcgtgaga

SEQ ID NO: 5052076 - DNA, 17 bp, Homo sapiens
gcacaaggtggcagcaa

SEQ ID NO: 5052077 - DNA, 23 bp, Homo sapiens
gcacaatctacactgccttacct

SEQ ID NO: 5052078 - DNA, 19 bp, Homo sapiens
gcacatgctgagtctccca

SEQ ID NO: 5052079 - DNA, 20 bp, Homo sapiens
gcacatgctgagtctcccaa

SEQ ID NO: 5052080 - DNA, 23 bp, Homo sapiens
gcacccactaccatacagacagc

SEQ ID NO: 5052081 - DNA, 16 bp, Homo sapiens
gcactgggtttgctcc

SEQ ID NO: 5052082 - DNA, 20 bp, Homo sapiens
gcactgggtttgctccctga

SEQ ID NO: 5052083 - DNA, 18 bp, Homo sapiens
gcagcaggcagaggagag

SEQ ID NO: 5052084 - DNA, 18 bp, Homo sapiens
gcaggaatcaaggagcct

SEQ ID NO: 5052085 - DNA, 23 bp, Homo sapiens
gcaggaggcctgggagggcaagg

SEQ ID NO: 5052086 - DNA, 17 bp, Homo sapiens
gcaggctgcagcaggca

SEQ ID NO: 5052087 - DNA, 13 bp, Homo sapiens
gcaggtcctgggg

SEQ ID NO: 5052088 - DNA, 19 bp, Homo sapiens
gcaggtcctggggaggctg

SEQ ID NO: 5052089 - DNA, 21 bp, Homo sapiens
gcaggtcctggggaggctgag

SEQ ID NO: 5052090 - DNA, 19 bp, Homo sapiens
gcatcatccattctctctg

SEQ ID NO: 5052091 - DNA, 20 bp, Homo sapiens
gcatcatccattctctctgc

SEQ ID NO: 5052092 - DNA, 23 bp, Homo sapiens
gcatcatccattctctctgccca

SEQ ID NO: 5052093 - DNA, 12 bp, Homo sapiens
gcatctgctctg

SEQ ID NO: 5052094 - DNA, 14 bp, Homo sapiens
gcatctgctctgag

SEQ ID NO: 5052095 - DNA, 14 bp, Homo sapiens
gcatgggggaggct

SEQ ID NO: 5052096 - DNA, 20 bp, Homo sapiens
gcattctgcctgcctgggaa

SEQ ID NO: 5052097 - DNA, 19 bp, Homo sapiens
gccaagcctggagcccctg

SEQ ID NO: 5052098 - DNA, 12 bp, Homo sapiens
gccacaggcctc

SEQ ID NO: 5052099 - DNA, 13 bp, Homo sapiens
gccacaggcctcc

SEQ ID NO: 5052100 - DNA, 21 bp, Homo sapiens
gccaccagctccactggcctg

SEQ ID NO: 5052101 - DNA, 14 bp, Homo sapiens
gccacctgggctgg

SEQ ID NO: 5052102 - DNA, 20 bp, Homo sapiens
gccacctgggctgggagaag

SEQ ID NO: 5052103 - DNA, 13 bp, Homo sapiens
gccacgaggtggt

SEQ ID NO: 5052104 - DNA, 23 bp, Homo sapiens
gccacgaggtggtagctctgagc

SEQ ID NO: 5052105 - DNA, 19 bp, Homo sapiens
gccactgggacggctcctg

SEQ ID NO: 5052106 - DNA, 13 bp, Homo sapiens
gccagcccaggat

SEQ ID NO: 5052107 - DNA, 13 bp, Homo sapiens
gccagctcctttc

SEQ ID NO: 5052108 - DNA, 19 bp, Homo sapiens
gccaggggtggtgagggca

SEQ ID NO: 5052109 - DNA, 20 bp, Homo sapiens
gccagttacctttgctgtca

SEQ ID NO: 5052110 - DNA, 22 bp, Homo sapiens
gccatctgaagccacctctctg

SEQ ID NO: 5052111 - DNA, 16 bp, Homo sapiens
gccatggtaccccctt

SEQ ID NO: 5052112 - DNA, 14 bp, Homo sapiens
gcccaacaccagcc

SEQ ID NO: 5052113 - DNA, 19 bp, Homo sapiens
gcccaagtccaaatgttta

SEQ ID NO: 5052114 - DNA, 17 bp, Homo sapiens
gcccaagttgctctgta

SEQ ID NO: 5052115 - DNA, 16 bp, Homo sapiens
gcccacatccagtggg

SEQ ID NO: 5052116 - DNA, 19 bp, Homo sapiens
gcccagggaagacacatga

SEQ ID NO: 5052117 - DNA, 13 bp, Homo sapiens
gcccagtccccca

SEQ ID NO: 5052118 - DNA, 14 bp, Homo sapiens
gcccagtcccccaa

SEQ ID NO: 5052119 - DNA, 20 bp, Homo sapiens
gccccaaaggaaaaagcaca

SEQ ID NO: 5052120 - DNA, 12 bp, Homo sapiens
gccccagcccaa

SEQ ID NO: 5052121 - DNA, 16 bp, Homo sapiens
gccccagcccaagtcc

SEQ ID NO: 5052122 - DNA, 16 bp, Homo sapiens
gcccccacctgcctga

SEQ ID NO: 5052123 - DNA, 18 bp, Homo sapiens
gcccctgcttctccagcc

SEQ ID NO: 5052124 - DNA, 18 bp, Homo sapiens
gcccctgtgtcggggggc

SEQ ID NO: 5052125 - DNA, 17 bp, Homo sapiens
gcccctgtgtgggaggg

SEQ ID NO: 5052126 - DNA, 18 bp, Homo sapiens
gcccctgtgtgggagggc

SEQ ID NO: 5052127 - DNA, 21 bp, Homo sapiens
gcccctgtgtgggagggcgag

SEQ ID NO: 5052128 - DNA, 14 bp, Homo sapiens
gcccctgtgttggg

SEQ ID NO: 5052129 - DNA, 18 bp, Homo sapiens
gcccctgtgttggggggc

SEQ ID NO: 5052130 - DNA, 22 bp, Homo sapiens
gcccctgtgttggggggcaagg

SEQ ID NO: 5052131 - DNA, 16 bp, Homo sapiens
gcccgctgtcccaggg

SEQ ID NO: 5052132 - DNA, 18 bp, Homo sapiens
gcccgttgccgggcctgg

SEQ ID NO: 5052133 - DNA, 19 bp, Homo sapiens
gccctccttcttgccctga

SEQ ID NO: 5052134 - DNA, 14 bp, Homo sapiens
gccctgcaggaggc

SEQ ID NO: 5052135 - DNA, 16 bp, Homo sapiens
gccctgcaggaggcct

SEQ ID NO: 5052136 - DNA, 21 bp, Homo sapiens
gccctgcaggaggcctgggag

SEQ ID NO: 5052137 - DNA, 23 bp, Homo sapiens
gccctgcaggaggcctgggaggg

SEQ ID NO: 5052138 - DNA, 14 bp, Homo sapiens
gccctgccaagcct

SEQ ID NO: 5052139 - DNA, 18 bp, Homo sapiens
gccctgccaagcctggag

SEQ ID NO: 5052140 - DNA, 12 bp, Homo sapiens
gccctgggccag

SEQ ID NO: 5052141 - DNA, 16 bp, Homo sapiens
gccctggggagtgagc

SEQ ID NO: 5052142 - DNA, 20 bp, Homo sapiens
gccctggggagtgagcttgg

SEQ ID NO: 5052143 - DNA, 20 bp, Homo sapiens
gccgctcggaggccccaaag

SEQ ID NO: 5052144 - DNA, 21 bp, Homo sapiens
gccgctcggaggccccaaagg

SEQ ID NO: 5052145 - DNA, 16 bp, Homo sapiens
gccgcttttctcctct

SEQ ID NO: 5052146 - DNA, 21 bp, Homo sapiens
gccggcagtgctggttctcca

SEQ ID NO: 5052147 - DNA, 23 bp, Homo sapiens
gcctccgttcccacctctgagga

SEQ ID NO: 5052148 - DNA, 20 bp, Homo sapiens
gcctcctgcccagtccccca

SEQ ID NO: 5052149 - DNA, 21 bp, Homo sapiens
gcctgaccatcccatgagcag

SEQ ID NO: 5052150 - DNA, 16 bp, Homo sapiens
gcctgatggagaggag

SEQ ID NO: 5052151 - DNA, 14 bp, Homo sapiens
gcctgcccttgtct

SEQ ID NO: 5052152 - DNA, 21 bp, Homo sapiens
gcctgcccttgtctgagatgc

SEQ ID NO: 5052153 - DNA, 23 bp, Homo sapiens
gcctggactgtcctaggtgaccc

SEQ ID NO: 5052154 - DNA, 18 bp, Homo sapiens
gcctgttctgtaggagag

SEQ ID NO: 5052155 - DNA, 23 bp, Homo sapiens
gcctgttctgtaggagagactgg

SEQ ID NO: 5052156 - DNA, 18 bp, Homo sapiens
gccttcagccaagaccat

SEQ ID NO: 5052157 - DNA, 19 bp, Homo sapiens
gcgaggcgggggagcctgg

SEQ ID NO: 5052158 - DNA, 20 bp, Homo sapiens
gcgaggcgggggagcctgga

SEQ ID NO: 5052159 - DNA, 21 bp, Homo sapiens
gcgaggcgggggatcctggag

SEQ ID NO: 5052160 - DNA, 22 bp, Homo sapiens
gcgaggcgggggatcctggagc

SEQ ID NO: 5052161 - DNA, 10 bp, Homo sapiens
gcgagggagg

SEQ ID NO: 5052162 - DNA, 16 bp, Homo sapiens
gcgagggaggggaggt

SEQ ID NO: 5052163 - DNA, 12 bp, Homo sapiens
gcgcccctgggg

SEQ ID NO: 5052164 - DNA, 16 bp, Homo sapiens
gcgggatgggccaccg

SEQ ID NO: 5052165 - DNA, 14 bp, Homo sapiens
gcgggggagcctgg

SEQ ID NO: 5052166 - DNA, 16 bp, Homo sapiens
gcgggggagcctggag

SEQ ID NO: 5052167 - DNA, 20 bp, Homo sapiens
gcgtctggaggggcccctgc

SEQ ID NO: 5052168 - DNA, 15 bp, Homo sapiens
gcgtgagacgccacc

SEQ ID NO: 5052169 - DNA, 16 bp, Homo sapiens
gctaacctcactgcct

SEQ ID NO: 5052170 - DNA, 18 bp, Homo sapiens
gctaactaattctgtcat

SEQ ID NO: 5052171 - DNA, 14 bp, Homo sapiens
gctaaggggcagga

SEQ ID NO: 5052172 - DNA, 15 bp, Homo sapiens
gctagggtgcctgct

SEQ ID NO: 5052173 - DNA, 22 bp, Homo sapiens
gctcagacatgaaatgtacatg

SEQ ID NO: 5052174 - DNA, 23 bp, Homo sapiens
gctccacgccctggggagtgagc

SEQ ID NO: 5052175 - DNA, 22 bp, Homo sapiens
gctccagacgtaggggaggggt

SEQ ID NO: 5052176 - DNA, 14 bp, Homo sapiens
gctcccaagggagg

SEQ ID NO: 5052177 - DNA, 12 bp, Homo sapiens
gctccccctgtc

SEQ ID NO: 5052178 - DNA, 20 bp, Homo sapiens
gctccccgcctgttcccccg

SEQ ID NO: 5052179 - DNA, 22 bp, Homo sapiens
gctccccgcctgttcccccgcc

SEQ ID NO: 5052180 - DNA, 20 bp, Homo sapiens
gctccctgattaaagtgcct

SEQ ID NO: 5052181 - DNA, 23 bp, Homo sapiens
gctcctgcttttggggctcttga

SEQ ID NO: 5052182 - DNA, 17 bp, Homo sapiens
gctcctttcccttttcc

SEQ ID NO: 5052183 - DNA, 21 bp, Homo sapiens
gctcggaggccccaaaggaaa

SEQ ID NO: 5052184 - DNA, 16 bp, Homo sapiens
gctctccttgccctgg

SEQ ID NO: 5052185 - DNA, 20 bp, Homo sapiens
gctctccttgccctgggcca

SEQ ID NO: 5052186 - DNA, 21 bp, Homo sapiens
gctctccttgccctgggccag

SEQ ID NO: 5052187 - DNA, 20 bp, Homo sapiens
gctctgagacggatggaagg

SEQ ID NO: 5052188 - DNA, 16 bp, Homo sapiens
gctctgttgcaggtgt

SEQ ID NO: 5052189 - DNA, 20 bp, Homo sapiens
gctctgttgcaggtgtccgg

SEQ ID NO: 5052190 - DNA, 15 bp, Homo sapiens
gctcttgatcagtgt

SEQ ID NO: 5052191 - DNA, 20 bp, Homo sapiens
gctgagactgcagaggagcc

SEQ ID NO: 5052192 - DNA, 16 bp, Homo sapiens
gctgcagcaggcagag

SEQ ID NO: 5052193 - DNA, 21 bp, Homo sapiens
gctgcagcaggcagaggagag

SEQ ID NO: 5052194 - DNA, 15 bp, Homo sapiens
gctgccggcagtgct

SEQ ID NO: 5052195 - DNA, 14 bp, Homo sapiens
gctgctagtgagcc

SEQ ID NO: 5052196 - DNA, 21 bp, Homo sapiens
gctgctcacttaaacaatgtc

SEQ ID NO: 5052197 - DNA, 12 bp, Homo sapiens
gctgctgctcac

SEQ ID NO: 5052198 - DNA, 13 bp, Homo sapiens
gctgctgctcacc

SEQ ID NO: 5052199 - DNA, 16 bp, Homo sapiens
gctggagtgctggctc

SEQ ID NO: 5052200 - DNA, 20 bp, Homo sapiens
gctggctccacgccctgggg

SEQ ID NO: 5052201 - DNA, 15 bp, Homo sapiens
gctgggagaaggtgc

SEQ ID NO: 5052202 - DNA, 19 bp, Homo sapiens
gctgggagaaggtgcttgg

SEQ ID NO: 5052203 - DNA, 20 bp, Homo sapiens
gctgggagaaggtgcttggg

SEQ ID NO: 5052204 - DNA, 21 bp, Homo sapiens
gctgggagaaggtgcttgggc

SEQ ID NO: 5052205 - DNA, 13 bp, Homo sapiens
gctgtcccagggg

SEQ ID NO: 5052206 - DNA, 14 bp, Homo sapiens
gctgtcccaggggt

SEQ ID NO: 5052207 - DNA, 17 bp, Homo sapiens
gcttctccagcctggac

SEQ ID NO: 5052208 - DNA, 22 bp, Homo sapiens
gcttctgcggtgaggcagggga

SEQ ID NO: 5052209 - DNA, 19 bp, Homo sapiens
gcttctgggcctgatggag

SEQ ID NO: 5052210 - DNA, 19 bp, Homo sapiens
gcttggtgcggtaggtgct

SEQ ID NO: 5052211 - DNA, 14 bp, Homo sapiens
gctttccggggagg

SEQ ID NO: 5052212 - DNA, 16 bp, Homo sapiens
gctttccggggaggag

SEQ ID NO: 5052213 - DNA, 18 bp, Homo sapiens
gctttccggggaggagcc

SEQ ID NO: 5052214 - DNA, 19 bp, Homo sapiens
gctttctaactcacaggca

SEQ ID NO: 5052215 - DNA, 20 bp, Homo sapiens
gctttggaagctctgttgca

SEQ ID NO: 5052216 - DNA, 17 bp, Homo sapiens
gcttttctcctctttcc

SEQ ID NO: 5052217 - DNA, 17 bp, Homo sapiens
gcttttggggctcttga

SEQ ID NO: 5052218 - DNA, 18 bp, Homo sapiens
ggaagatgggggcaagaa

SEQ ID NO: 5052219 - DNA, 20 bp, Homo sapiens
ggaagatgggggcaagaaga

SEQ ID NO: 5052220 - DNA, 22 bp, Homo sapiens
ggaagatgggggcaagaagatc

SEQ ID NO: 5052221 - DNA, 23 bp, Homo sapiens
ggaccaagcttaaggagaggaga

SEQ ID NO: 5052222 - DNA, 13 bp, Homo sapiens
ggacccccagctt

SEQ ID NO: 5052223 - DNA, 14 bp, Homo sapiens
ggactgtcctaggt

SEQ ID NO: 5052224 - DNA, 18 bp, Homo sapiens
ggactgtcctaggtgacc

SEQ ID NO: 5052225 - DNA, 19 bp, Homo sapiens
ggactgtcctaggtgaccc

SEQ ID NO: 5052226 - DNA, 12 bp, Homo sapiens
ggagagaggttg

SEQ ID NO: 5052227 - DNA, 12 bp, Homo sapiens
ggagaggagaac

SEQ ID NO: 5052228 - DNA, 14 bp, Homo sapiens
ggagaggagagcat

SEQ ID NO: 5052229 - DNA, 23 bp, Homo sapiens
ggagaggagagcatctgctctga

SEQ ID NO: 5052230 - DNA, 20 bp, Homo sapiens
ggagagtacccccctgagag

SEQ ID NO: 5052231 - DNA, 15 bp, Homo sapiens
ggagcagcatcattc

SEQ ID NO: 5052232 - DNA, 20 bp, Homo sapiens
ggagcattctgcctgcctgg

SEQ ID NO: 5052233 - DNA, 19 bp, Homo sapiens
ggagccacctgggctggga

SEQ ID NO: 5052234 - DNA, 12 bp, Homo sapiens
ggagcctcctgc

SEQ ID NO: 5052235 - DNA, 13 bp, Homo sapiens
ggagcctcctgcc

SEQ ID NO: 5052236 - DNA, 15 bp, Homo sapiens
ggagcctggagcccc

SEQ ID NO: 5052237 - DNA, 14 bp, Homo sapiens
ggaggcctgggagg

SEQ ID NO: 5052238 - DNA, 15 bp, Homo sapiens
ggaggcctgggaggg

SEQ ID NO: 5052239 - DNA, 20 bp, Homo sapiens
ggagggcgaggcgggggagc

SEQ ID NO: 5052240 - DNA, 21 bp, Homo sapiens
ggagggcgaggcgggggagcc

SEQ ID NO: 5052241 - DNA, 22 bp, Homo sapiens
ggagggcgaggcgggggagcct

SEQ ID NO: 5052242 - DNA, 17 bp, Homo sapiens
ggaggggttgccacagg

SEQ ID NO: 5052243 - DNA, 18 bp, Homo sapiens
ggaggggttgccacaggc

SEQ ID NO: 5052244 - DNA, 21 bp, Homo sapiens
ggaggggttgccacaggcctc

SEQ ID NO: 5052245 - DNA, 15 bp, Homo sapiens
ggagtctgcttgtct

SEQ ID NO: 5052246 - DNA, 14 bp, Homo sapiens
ggagtgagcttggt

SEQ ID NO: 5052247 - DNA, 13 bp, Homo sapiens
ggagtgctggctc

SEQ ID NO: 5052248 - DNA, 13 bp, Homo sapiens
ggagtggagggtg

SEQ ID NO: 5052249 - DNA, 14 bp, Homo sapiens
ggatgcactggcct

SEQ ID NO: 5052250 - DNA, 12 bp, Homo sapiens
ggatggaaggag

SEQ ID NO: 5052251 - DNA, 19 bp, Homo sapiens
ggatggaaggagagaggtt

SEQ ID NO: 5052252 - DNA, 13 bp, Homo sapiens
ggatgggaggttg

SEQ ID NO: 5052253 - DNA, 17 bp, Homo sapiens
ggattgtacgtgggaga

SEQ ID NO: 5052254 - DNA, 16 bp, Homo sapiens
ggcaacagtgttctga

SEQ ID NO: 5052255 - DNA, 14 bp, Homo sapiens
ggcaaggtggggga

SEQ ID NO: 5052256 - DNA, 17 bp, Homo sapiens
ggcaaggtgggggagcc

SEQ ID NO: 5052257 - DNA, 18 bp, Homo sapiens
ggcaaggtgggggagcct

SEQ ID NO: 5052258 - DNA, 21 bp, Homo sapiens
ggcaggaaggaactcaaggtg

SEQ ID NO: 5052259 - DNA, 19 bp, Homo sapiens
ggcaggaatcaaggagcct

SEQ ID NO: 5052260 - DNA, 20 bp, Homo sapiens
ggcaggaatcaaggagcctc

SEQ ID NO: 5052261 - DNA, 14 bp, Homo sapiens
ggcaggggagtctg

SEQ ID NO: 5052262 - DNA, 15 bp, Homo sapiens
ggcaggggagtctgc

SEQ ID NO: 5052263 - DNA, 20 bp, Homo sapiens
ggcaggtcctggggaggctg

SEQ ID NO: 5052264 - DNA, 21 bp, Homo sapiens
ggcagtgctggttctccaaca

SEQ ID NO: 5052265 - DNA, 18 bp, Homo sapiens
ggcatgggggaggctctg

SEQ ID NO: 5052266 - DNA, 15 bp, Homo sapiens
ggccataccaggtgc

SEQ ID NO: 5052267 - DNA, 20 bp, Homo sapiens
ggccataccaggtgctaggg

SEQ ID NO: 5052268 - DNA, 16 bp, Homo sapiens
ggcccctgcttctcca

SEQ ID NO: 5052269 - DNA, 13 bp, Homo sapiens
ggccctgcaggag

SEQ ID NO: 5052270 - DNA, 17 bp, Homo sapiens
ggccctgcaggaggcct

SEQ ID NO: 5052271 - DNA, 16 bp, Homo sapiens
ggcctgatggagagga

SEQ ID NO: 5052272 - DNA, 23 bp, Homo sapiens
ggcctggcgggatgggccaccgc

SEQ ID NO: 5052273 - DNA, 16 bp, Homo sapiens
ggcctgttctgtagga

SEQ ID NO: 5052274 - DNA, 22 bp, Homo sapiens
ggcctgttctgtaggagagact

SEQ ID NO: 5052275 - DNA, 17 bp, Homo sapiens
ggcgaggcgggggagcc

SEQ ID NO: 5052276 - DNA, 20 bp, Homo sapiens
ggcgaggcgggggagcctgg

SEQ ID NO: 5052277 - DNA, 22 bp, Homo sapiens
ggcgaggcgggggagcctggag

SEQ ID NO: 5052278 - DNA, 15 bp, Homo sapiens
ggcgagggaggggag

SEQ ID NO: 5052279 - DNA, 16 bp, Homo sapiens
ggcgggatgggccacc

SEQ ID NO: 5052280 - DNA, 14 bp, Homo sapiens
ggcgggggagcctg

SEQ ID NO: 5052281 - DNA, 17 bp, Homo sapiens
ggcgggggagcctggag

SEQ ID NO: 5052282 - DNA, 14 bp, Homo sapiens
ggcgggggatcctg

SEQ ID NO: 5052283 - DNA, 15 bp, Homo sapiens
ggctcaaccacacac

SEQ ID NO: 5052284 - DNA, 22 bp, Homo sapiens
ggctcaaccacacacacctgtc

SEQ ID NO: 5052285 - DNA, 16 bp, Homo sapiens
ggctcccaagggaggc

SEQ ID NO: 5052286 - DNA, 23 bp, Homo sapiens
ggctcctgcttttggggctcttg

SEQ ID NO: 5052287 - DNA, 12 bp, Homo sapiens
ggctctgtgctt

SEQ ID NO: 5052288 - DNA, 18 bp, Homo sapiens
ggctgcagcaggcagagg

SEQ ID NO: 5052289 - DNA, 22 bp, Homo sapiens
ggctggagatggctgctgctca

SEQ ID NO: 5052290 - DNA, 18 bp, Homo sapiens
ggctgggagaaggtgctt

SEQ ID NO: 5052291 - DNA, 18 bp, Homo sapiens
ggctgggttttcaggggc

SEQ ID NO: 5052292 - DNA, 15 bp, Homo sapiens
ggctgttggctgggg

SEQ ID NO: 5052293 - DNA, 21 bp, Homo sapiens
ggcttctgcggtgaggcaggg

SEQ ID NO: 5052294 - DNA, 13 bp, Homo sapiens
gggacggctcctg

SEQ ID NO: 5052295 - DNA, 13 bp, Homo sapiens
gggagaggcagaa

SEQ ID NO: 5052296 - DNA, 11 bp, Homo sapiens
gggagcctcct

SEQ ID NO: 5052297 - DNA, 13 bp, Homo sapiens
gggagcctggagc

SEQ ID NO: 5052298 - DNA, 13 bp, Homo sapiens
gggaggagccttg

SEQ ID NO: 5052299 - DNA, 17 bp, Homo sapiens
gggaggagccttggagt

SEQ ID NO: 5052300 - DNA, 14 bp, Homo sapiens
gggaggctgagact

SEQ ID NO: 5052301 - DNA, 19 bp, Homo sapiens
gggaggctgagactgcaga

SEQ ID NO: 5052302 - DNA, 14 bp, Homo sapiens
gggagtgagcttgg

SEQ ID NO: 5052303 - DNA, 21 bp, Homo sapiens
gggcaagaagatcacgctccc

SEQ ID NO: 5052304 - DNA, 21 bp, Homo sapiens
gggcaaggtgggggagcctgg

SEQ ID NO: 5052305 - DNA, 13 bp, Homo sapiens
gggcaggtcctgg

SEQ ID NO: 5052306 - DNA, 21 bp, Homo sapiens
gggcaggtcctggggaggctg

SEQ ID NO: 5052307 - DNA, 21 bp, Homo sapiens
gggcatgggggaggctctgaa

SEQ ID NO: 5052308 - DNA, 22 bp, Homo sapiens
gggcatgggggaggctctgaag

SEQ ID NO: 5052309 - DNA, 22 bp, Homo sapiens
gggccaccagctccactggcct

SEQ ID NO: 5052310 - DNA, 12 bp, Homo sapiens
gggccagcccag

SEQ ID NO: 5052311 - DNA, 14 bp, Homo sapiens
gggccagcccagga

SEQ ID NO: 5052312 - DNA, 15 bp, Homo sapiens
gggccagcccaggat

SEQ ID NO: 5052313 - DNA, 15 bp, Homo sapiens
gggccctgcaggagg

SEQ ID NO: 5052314 - DNA, 16 bp, Homo sapiens
gggcctgatggagagg

SEQ ID NO: 5052315 - DNA, 18 bp, Homo sapiens
gggcctgatggagaggag

SEQ ID NO: 5052316 - DNA, 13 bp, Homo sapiens
gggcgagggaggg

SEQ ID NO: 5052317 - DNA, 18 bp, Homo sapiens
gggctcttgatcagtgtg

SEQ ID NO: 5052318 - DNA, 17 bp, Homo sapiens
gggctgttggctggggg

SEQ ID NO: 5052319 - DNA, 16 bp, Homo sapiens
ggggagcctggagccc

SEQ ID NO: 5052320 - DNA, 13 bp, Homo sapiens
ggggaggctctga

SEQ ID NO: 5052321 - DNA, 16 bp, Homo sapiens
ggggatcctggagccc

SEQ ID NO: 5052322 - DNA, 17 bp, Homo sapiens
ggggcaaggtgggggag

SEQ ID NO: 5052323 - DNA, 21 bp, Homo sapiens
ggggcacatgctgagtctccc

SEQ ID NO: 5052324 - DNA, 15 bp, Homo sapiens
ggggcatgggggagg

SEQ ID NO: 5052325 - DNA, 11 bp, Homo sapiens
ggggctcttga

SEQ ID NO: 5052326 - DNA, 18 bp, Homo sapiens
gggggcatgggggaggct

SEQ ID NO: 5052327 - DNA, 18 bp, Homo sapiens
gggtcctacggagggacc

SEQ ID NO: 5052328 - DNA, 13 bp, Homo sapiens
gggtctccctgag

SEQ ID NO: 5052329 - DNA, 18 bp, Homo sapiens
gggtctccctgagcctgc

SEQ ID NO: 5052330 - DNA, 16 bp, Homo sapiens
gggtgtgccctggctc

SEQ ID NO: 5052331 - DNA, 18 bp, Homo sapiens
gggttgccacaggcctcc

SEQ ID NO: 5052332 - DNA, 22 bp, Homo sapiens
gggtttagcaggctgcagcagg

SEQ ID NO: 5052333 - DNA, 16 bp, Homo sapiens
ggtacccccttctggg

SEQ ID NO: 5052334 - DNA, 14 bp, Homo sapiens
ggtagagcccactg

SEQ ID NO: 5052335 - DNA, 17 bp, Homo sapiens
ggtagctctgagccctc

SEQ ID NO: 5052336 - DNA, 16 bp, Homo sapiens
ggtaggtgctggcctc

SEQ ID NO: 5052337 - DNA, 14 bp, Homo sapiens
ggtcctacggaggg

SEQ ID NO: 5052338 - DNA, 19 bp, Homo sapiens
ggtcctacggagggaccag

SEQ ID NO: 5052339 - DNA, 15 bp, Homo sapiens
ggtcctggggaggct

SEQ ID NO: 5052340 - DNA, 22 bp, Homo sapiens
ggtctaggactttagggatctg

SEQ ID NO: 5052341 - DNA, 15 bp, Homo sapiens
ggtctccctgagcct

SEQ ID NO: 5052342 - DNA, 18 bp, Homo sapiens
ggtctccctgagcctgcc

SEQ ID NO: 5052343 - DNA, 16 bp, Homo sapiens
ggtgcggtaggtgctg

SEQ ID NO: 5052344 - DNA, 21 bp, Homo sapiens
ggtgcggtaggtgctggcctc

SEQ ID NO: 5052345 - DNA, 16 bp, Homo sapiens
ggtgctagggtgcctg

SEQ ID NO: 5052346 - DNA, 17 bp, Homo sapiens
ggtgctagggtgcctgc

SEQ ID NO: 5052347 - DNA, 13 bp, Homo sapiens
ggtgcttgggctt

SEQ ID NO: 5052348 - DNA, 14 bp, Homo sapiens
ggtgcttgggcttc

SEQ ID NO: 5052349 - DNA, 15 bp, Homo sapiens
ggtggacgagggagt

SEQ ID NO: 5052350 - DNA, 14 bp, Homo sapiens
ggtgggggagcctg

SEQ ID NO: 5052351 - DNA, 16 bp, Homo sapiens
ggtggtagctctgagc

SEQ ID NO: 5052352 - DNA, 18 bp, Homo sapiens
ggtggtagctctgagccc

SEQ ID NO: 5052353 - DNA, 12 bp, Homo sapiens
ggtgtgccctgg

SEQ ID NO: 5052354 - DNA, 13 bp, Homo sapiens
ggtgtgccctggc

SEQ ID NO: 5052355 - DNA, 14 bp, Homo sapiens
ggtgtgccctggct

SEQ ID NO: 5052356 - DNA, 17 bp, Homo sapiens
ggtgtgccctggctccc

SEQ ID NO: 5052357 - DNA, 15 bp, Homo sapiens
ggttctccaacagag

SEQ ID NO: 5052358 - DNA, 13 bp, Homo sapiens
ggttgccacaggc

SEQ ID NO: 5052359 - DNA, 15 bp, Homo sapiens
ggttttcaggggctt

SEQ ID NO: 5052360 - DNA, 17 bp, Homo sapiens
gtaaaataaaggctctg

SEQ ID NO: 5052361 - DNA, 19 bp, Homo sapiens
gtaaaataaaggctctgtg

SEQ ID NO: 5052362 - DNA, 20 bp, Homo sapiens
gtaaaataaaggctctgtgc

SEQ ID NO: 5052363 - DNA, 17 bp, Homo sapiens
gtaacaaaattgacagc

SEQ ID NO: 5052364 - DNA, 21 bp, Homo sapiens
gtaacaaaattgacagctttc

SEQ ID NO: 5052365 - DNA, 22 bp, Homo sapiens
gtaattacctgtcatctgggcc

SEQ ID NO: 5052366 - DNA, 23 bp, Homo sapiens
gtaattacctgtcatctgggcca

SEQ ID NO: 5052367 - DNA, 20 bp, Homo sapiens
gtacacagagggacttgagc

SEQ ID NO: 5052368 - DNA, 21 bp, Homo sapiens
gtaccccccaacccctgagga

SEQ ID NO: 5052369 - DNA, 14 bp, Homo sapiens
gtacccccttctgg

SEQ ID NO: 5052370 - DNA, 14 bp, Homo sapiens
gtaggagagactgg

SEQ ID NO: 5052371 - DNA, 15 bp, Homo sapiens
gtatctggctgggtt

SEQ ID NO: 5052372 - DNA, 15 bp, Homo sapiens
gtcactttctctctt

SEQ ID NO: 5052373 - DNA, 16 bp, Homo sapiens
gtcaggagcagcatca

SEQ ID NO: 5052374 - DNA, 19 bp, Homo sapiens
gtccagagcttcagggctg

SEQ ID NO: 5052375 - DNA, 17 bp, Homo sapiens
gtcccaggggtctccct

SEQ ID NO: 5052376 - DNA, 21 bp, Homo sapiens
gtcccaggggtctccctgagc

SEQ ID NO: 5052377 - DNA, 17 bp, Homo sapiens
gtcccccaaccccagcc

SEQ ID NO: 5052378 - DNA, 22 bp, Homo sapiens
gtcctcacatgcccgctgtccc

SEQ ID NO: 5052379 - DNA, 21 bp, Homo sapiens
gtcctggggaggctgagactg

SEQ ID NO: 5052380 - DNA, 22 bp, Homo sapiens
gtctagaggcaacagtgttctg

SEQ ID NO: 5052381 - DNA, 22 bp, Homo sapiens
gtctaggactttagggatctgg

SEQ ID NO: 5052382 - DNA, 21 bp, Homo sapiens
gtctcacatattcatcagcag

SEQ ID NO: 5052383 - DNA, 14 bp, Homo sapiens
gtctccctgagcct

SEQ ID NO: 5052384 - DNA, 16 bp, Homo sapiens
gtctccctgagcctgc

SEQ ID NO: 5052385 - DNA, 18 bp, Homo sapiens
gtctggaggggcccctgc

SEQ ID NO: 5052386 - DNA, 23 bp, Homo sapiens
gtctggaggggcccctgcttctc

SEQ ID NO: 5052387 - DNA, 19 bp, Homo sapiens
gtctgtaaggactcagtgt

SEQ ID NO: 5052388 - DNA, 18 bp, Homo sapiens
gtctgtgcagatgctttg

SEQ ID NO: 5052389 - DNA, 12 bp, Homo sapiens
gtcttgttctgt

SEQ ID NO: 5052390 - DNA, 13 bp, Homo sapiens
gtgaatccctcaa

SEQ ID NO: 5052391 - DNA, 20 bp, Homo sapiens
gtgaccccatctctgctgct

SEQ ID NO: 5052392 - DNA, 18 bp, Homo sapiens
gtgaccttttaatcagag

SEQ ID NO: 5052393 - DNA, 24 bp, Homo sapiens
gtgacttcgaattagtttgcactt

SEQ ID NO: 5052394 - DNA, 19 bp, Homo sapiens
gtgcactaaccccagctgc

SEQ ID NO: 5052395 - DNA, 21 bp, Homo sapiens
gtgcctgctctccttgccctg

SEQ ID NO: 5052396 - DNA, 14 bp, Homo sapiens
gtgccttcagccaa

SEQ ID NO: 5052397 - DNA, 18 bp, Homo sapiens
gtgctaacctcactgcct

SEQ ID NO: 5052398 - DNA, 16 bp, Homo sapiens
gtgctagggtgcctgc

SEQ ID NO: 5052399 - DNA, 20 bp, Homo sapiens
gtgctggctccacgccctgg

SEQ ID NO: 5052400 - DNA, 13 bp, Homo sapiens
gtggcagcaagca

SEQ ID NO: 5052401 - DNA, 17 bp, Homo sapiens
gtggcagccaagagcca

SEQ ID NO: 5052402 - DNA, 18 bp, Homo sapiens
gtggcagccaagagccat

SEQ ID NO: 5052403 - DNA, 14 bp, Homo sapiens
gtggtagctctgag

SEQ ID NO: 5052404 - DNA, 17 bp, Homo sapiens
gtggtccctccactagg

SEQ ID NO: 5052405 - DNA, 20 bp, Homo sapiens
gtggtccctccactaggagt

SEQ ID NO: 5052406 - DNA, 22 bp, Homo sapiens
gtggtgcagccccaggaccaag

SEQ ID NO: 5052407 - DNA, 17 bp, Homo sapiens
gtgtcaccatcatttct

SEQ ID NO: 5052408 - DNA, 21 bp, Homo sapiens
gtgtcggggggcgagggaggg

SEQ ID NO: 5052409 - DNA, 11 bp, Homo sapiens
gtgtgccctgg

SEQ ID NO: 5052410 - DNA, 15 bp, Homo sapiens
gtgtgccctggctcc

SEQ ID NO: 5052411 - DNA, 12 bp, Homo sapiens
gtgtgggagggc

SEQ ID NO: 5052412 - DNA, 12 bp, Homo sapiens
gtgtggtccctc

SEQ ID NO: 5052413 - DNA, 13 bp, Homo sapiens
gtgtggtccctcc

SEQ ID NO: 5052414 - DNA, 11 bp, Homo sapiens
gtgtgtgcaga

SEQ ID NO: 5052415 - DNA, 22 bp, Homo sapiens
gtgtgtgcagaattctaggcag

SEQ ID NO: 5052416 - DNA, 21 bp, Homo sapiens
gtgttctgagcccccacctgc

SEQ ID NO: 5052417 - DNA, 12 bp, Homo sapiens
gttagctgctca

SEQ ID NO: 5052418 - DNA, 14 bp, Homo sapiens
gttcatgtctctga

SEQ ID NO: 5052419 - DNA, 16 bp, Homo sapiens
gttcccacctctgagg

SEQ ID NO: 5052420 - DNA, 18 bp, Homo sapiens
gttctcagctccccctgt

SEQ ID NO: 5052421 - DNA, 19 bp, Homo sapiens
gttctgagcccccacctgc

SEQ ID NO: 5052422 - DNA, 17 bp, Homo sapiens
gttctgcacccagccaa

SEQ ID NO: 5052423 - DNA, 14 bp, Homo sapiens
gttctgtaggagag

SEQ ID NO: 5052424 - DNA, 22 bp, Homo sapiens
gttgactgtaggcgcccctggg

SEQ ID NO: 5052425 - DNA, 16 bp, Homo sapiens
gttgccacaggcctcc

SEQ ID NO: 5052426 - DNA, 18 bp, Homo sapiens
gttgccgggcctggactg

SEQ ID NO: 5052427 - DNA, 23 bp, Homo sapiens
gttggaaattgggtgtgccctgg

SEQ ID NO: 5052428 - DNA, 22 bp, Homo sapiens
gttggctgggggcatgggggag

SEQ ID NO: 5052429 - DNA, 23 bp, Homo sapiens
gttggctgggggcatgggggagg

SEQ ID NO: 5052430 - DNA, 13 bp, Homo sapiens
gttgtgcattttg

SEQ ID NO: 5052431 - DNA, 20 bp, Homo sapiens
gtttagcaggctgcagcagg

SEQ ID NO: 5052432 - DNA, 16 bp, Homo sapiens
taaaataaaggctctg

SEQ ID NO: 5052433 - DNA, 19 bp, Homo sapiens
taaacaatgtcctctttga

SEQ ID NO: 5052434 - DNA, 17 bp, Homo sapiens
taaagattgctttatcc

SEQ ID NO: 5052435 - DNA, 19 bp, Homo sapiens
taacaaaattgacagcttt

SEQ ID NO: 5052436 - DNA, 18 bp, Homo sapiens
taaccattgtcttgttct

SEQ ID NO: 5052437 - DNA, 23 bp, Homo sapiens
taaccattgtcttgttctgtgat

SEQ ID NO: 5052438 - DNA, 13 bp, Homo sapiens
taactaattctgt

SEQ ID NO: 5052439 - DNA, 13 bp, Homo sapiens
taaggggcaggaa

SEQ ID NO: 5052440 - DNA, 14 bp, Homo sapiens
tacacctctgggcc

SEQ ID NO: 5052441 - DNA, 18 bp, Homo sapiens
tacagggagcctcctgcc

SEQ ID NO: 5052442 - DNA, 15 bp, Homo sapiens
tacatttttctgatg

SEQ ID NO: 5052443 - DNA, 14 bp, Homo sapiens
taccatacagacag

SEQ ID NO: 5052444 - DNA, 16 bp, Homo sapiens
taccatacagacagca

SEQ ID NO: 5052445 - DNA, 16 bp, Homo sapiens
taccccttctctgtag

SEQ ID NO: 5052446 - DNA, 19 bp, Homo sapiens
taccctacacctctgggcc

SEQ ID NO: 5052447 - DNA, 16 bp, Homo sapiens
tacctgtcatctgggc

SEQ ID NO: 5052448 - DNA, 14 bp, Homo sapiens
tacctttgctgtca

SEQ ID NO: 5052449 - DNA, 14 bp, Homo sapiens
tacgtgggagaggc

SEQ ID NO: 5052450 - DNA, 16 bp, Homo sapiens
tagagtgaccttttaa

SEQ ID NO: 5052451 - DNA, 17 bp, Homo sapiens
tagagtgaccttttaat

SEQ ID NO: 5052452 - DNA, 12 bp, Homo sapiens
tagagtggcagc

SEQ ID NO: 5052453 - DNA, 19 bp, Homo sapiens
tagagtggcagccaagagc

SEQ ID NO: 5052454 - DNA, 15 bp, Homo sapiens
tagctctgagccctc

SEQ ID NO: 5052455 - DNA, 18 bp, Homo sapiens
tagctgctcacttaaaca

SEQ ID NO: 5052456 - DNA, 16 bp, Homo sapiens
taggagagactggcca

SEQ ID NO: 5052457 - DNA, 15 bp, Homo sapiens
taggcgcccctgggg

SEQ ID NO: 5052458 - DNA, 13 bp, Homo sapiens
tagggatctgggg

SEQ ID NO: 5052459 - DNA, 23 bp, Homo sapiens
tagggatctggggaaggaccaac

SEQ ID NO: 5052460 - DNA, 18 bp, Homo sapiens
tataaatcatattctcat

SEQ ID NO: 5052461 - DNA, 23 bp, Homo sapiens
tataaatcatattctcatggctt

SEQ ID NO: 5052462 - DNA, 13 bp, Homo sapiens
tataattttctaa

SEQ ID NO: 5052463 - DNA, 21 bp, Homo sapiens
tatcagagtaacgagaagaca

SEQ ID NO: 5052464 - DNA, 13 bp, Homo sapiens
tatccagcagtca

SEQ ID NO: 5052465 - DNA, 16 bp, Homo sapiens
tcaaggtggctggaga

SEQ ID NO: 5052466 - DNA, 13 bp, Homo sapiens
tcaatcttttagc

SEQ ID NO: 5052467 - DNA, 14 bp, Homo sapiens
tcacatattcatca

SEQ ID NO: 5052468 - DNA, 20 bp, Homo sapiens
tcacatattcatcagcagga

SEQ ID NO: 5052469 - DNA, 14 bp, Homo sapiens
tcacatgcccgctg

SEQ ID NO: 5052470 - DNA, 22 bp, Homo sapiens
tcacatgcccgctgtcccaggg

SEQ ID NO: 5052471 - DNA, 21 bp, Homo sapiens
tcaccctcctagcctgctctg

SEQ ID NO: 5052472 - DNA, 12 bp, Homo sapiens
tcacgctccccg

SEQ ID NO: 5052473 - DNA, 19 bp, Homo sapiens
tcacttaaacaatgtcctc

SEQ ID NO: 5052474 - DNA, 21 bp, Homo sapiens
tcacttaaacaatgtcctctt

SEQ ID NO: 5052475 - DNA, 14 bp, Homo sapiens
tcactttctctctt

SEQ ID NO: 5052476 - DNA, 20 bp, Homo sapiens
tcagacatgaaatgtacatg

SEQ ID NO: 5052477 - DNA, 12 bp, Homo sapiens
tcagagcccagg

SEQ ID NO: 5052478 - DNA, 23 bp, Homo sapiens
tcagagcccagggaagacacatg

SEQ ID NO: 5052479 - DNA, 19 bp, Homo sapiens
tcagcaaatgccttttcaa

SEQ ID NO: 5052480 - DNA, 16 bp, Homo sapiens
tcagcatctttgccct

SEQ ID NO: 5052481 - DNA, 13 bp, Homo sapiens
tcagccttggaag

SEQ ID NO: 5052482 - DNA, 20 bp, Homo sapiens
tcagctccccctgtcccctc

SEQ ID NO: 5052483 - DNA, 15 bp, Homo sapiens
tcagctggcttccta

SEQ ID NO: 5052484 - DNA, 12 bp, Homo sapiens
tcaggagcagca

SEQ ID NO: 5052485 - DNA, 13 bp, Homo sapiens
tcaggagcagcat

SEQ ID NO: 5052486 - DNA, 14 bp, Homo sapiens
tcaggttgtgcatt

SEQ ID NO: 5052487 - DNA, 21 bp, Homo sapiens
tcaggttgtgcattttgtgtg

SEQ ID NO: 5052488 - DNA, 23 bp, Homo sapiens
tcagtgcactaaccccagctgcc

SEQ ID NO: 5052489 - DNA, 20 bp, Homo sapiens
tcatgcgaattcttgcttga

SEQ ID NO: 5052490 - DNA, 18 bp, Homo sapiens
tcattcagcaaatgcctt

SEQ ID NO: 5052491 - DNA, 18 bp, Homo sapiens
tccaaacaattctgatga

SEQ ID NO: 5052492 - DNA, 13 bp, Homo sapiens
tccacgccctggg

SEQ ID NO: 5052493 - DNA, 13 bp, Homo sapiens
tccagcctggacc

SEQ ID NO: 5052494 - DNA, 14 bp, Homo sapiens
tccagcctggaccc

SEQ ID NO: 5052495 - DNA, 18 bp, Homo sapiens
tccagcctggacccccag

SEQ ID NO: 5052496 - DNA, 23 bp, Homo sapiens
tccagtcctcacatgcccgctgt

SEQ ID NO: 5052497 - DNA, 22 bp, Homo sapiens
tccatacctcgaacatcagttg

SEQ ID NO: 5052498 - DNA, 21 bp, Homo sapiens
tccatcatctcttttcccact

SEQ ID NO: 5052499 - DNA, 16 bp, Homo sapiens
tccattctctctgccc

SEQ ID NO: 5052500 - DNA, 18 bp, Homo sapiens
tcccaagaggccagggtg

SEQ ID NO: 5052501 - DNA, 20 bp, Homo sapiens
tcccaaggctgcgtctggag

SEQ ID NO: 5052502 - DNA, 13 bp, Homo sapiens
tcccaagggaggc

SEQ ID NO: 5052503 - DNA, 20 bp, Homo sapiens
tcccacaattggccagggca

SEQ ID NO: 5052504 - DNA, 13 bp, Homo sapiens
tcccaccagccca

SEQ ID NO: 5052505 - DNA, 13 bp, Homo sapiens
tcccactcccttt

SEQ ID NO: 5052506 - DNA, 14 bp, Homo sapiens
tcccactccctttg

SEQ ID NO: 5052507 - DNA, 18 bp, Homo sapiens
tcccacttagcagggaca

SEQ ID NO: 5052508 - DNA, 21 bp, Homo sapiens
tcccaggggtctccctgagcc

SEQ ID NO: 5052509 - DNA, 19 bp, Homo sapiens
tccccctgtcccctcagct

SEQ ID NO: 5052510 - DNA, 23 bp, Homo sapiens
tccctcctggtgaagtgtgactt

SEQ ID NO: 5052511 - DNA, 19 bp, Homo sapiens
tccctgagcctgccccagc

SEQ ID NO: 5052512 - DNA, 20 bp, Homo sapiens
tccctgagcctgccccagct

SEQ ID NO: 5052513 - DNA, 16 bp, Homo sapiens
tccctgattaaagtgc

SEQ ID NO: 5052514 - DNA, 22 bp, Homo sapiens
tccctgattaaagtgccttcag

SEQ ID NO: 5052515 - DNA, 20 bp, Homo sapiens
tccctgtttgaagcctgccc

SEQ ID NO: 5052516 - DNA, 20 bp, Homo sapiens
tccctttgcgtcaggagcag

SEQ ID NO: 5052517 - DNA, 17 bp, Homo sapiens
tcctagcctgctctgcc

SEQ ID NO: 5052518 - DNA, 15 bp, Homo sapiens
tcctcacatgcccgc

SEQ ID NO: 5052519 - DNA, 14 bp, Homo sapiens
tcctccagccaaga

SEQ ID NO: 5052520 - DNA, 13 bp, Homo sapiens
tcctgcccagtcc

SEQ ID NO: 5052521 - DNA, 16 bp, Homo sapiens
tcctgcccagtccccc

SEQ ID NO: 5052522 - DNA, 14 bp, Homo sapiens
tcctggaaaccaca

SEQ ID NO: 5052523 - DNA, 14 bp, Homo sapiens
tcctggggaggctg

SEQ ID NO: 5052524 - DNA, 19 bp, Homo sapiens
tcctggggaggctgagact

SEQ ID NO: 5052525 - DNA, 13 bp, Homo sapiens
tccttcttgccct

SEQ ID NO: 5052526 - DNA, 15 bp, Homo sapiens
tccttgccctgggcc

SEQ ID NO: 5052527 - DNA, 17 bp, Homo sapiens
tcgcacaatctacactg

SEQ ID NO: 5052528 - DNA, 18 bp, Homo sapiens
tcggggggcgagggaggg

SEQ ID NO: 5052529 - DNA, 18 bp, Homo sapiens
tctaatttattttctcaa

SEQ ID NO: 5052530 - DNA, 13 bp, Homo sapiens
tctacactgcctt

SEQ ID NO: 5052531 - DNA, 18 bp, Homo sapiens
tctcagctccccctgtcc

SEQ ID NO: 5052532 - DNA, 21 bp, Homo sapiens
tctcagctccccctgtcccct

SEQ ID NO: 5052533 - DNA, 22 bp, Homo sapiens
tctcagctccccctgtcccctc

SEQ ID NO: 5052534 - DNA, 15 bp, Homo sapiens
tctccaacagagtgg

SEQ ID NO: 5052535 - DNA, 21 bp, Homo sapiens
tctccagcctggacccccagc

SEQ ID NO: 5052536 - DNA, 20 bp, Homo sapiens
tctccctgagcctgccccag

SEQ ID NO: 5052537 - DNA, 23 bp, Homo sapiens
tctccttgccctgggccagccca

SEQ ID NO: 5052538 - DNA, 13 bp, Homo sapiens
tctctccctcctg

SEQ ID NO: 5052539 - DNA, 19 bp, Homo sapiens
tctctgattgggtcagctg

SEQ ID NO: 5052540 - DNA, 21 bp, Homo sapiens
tctctgcccaagttgctctgt

SEQ ID NO: 5052541 - DNA, 18 bp, Homo sapiens
tctctgcctgttcctccc

SEQ ID NO: 5052542 - DNA, 14 bp, Homo sapiens
tctctgctgcttct

SEQ ID NO: 5052543 - DNA, 15 bp, Homo sapiens
tctgaagccacctct

SEQ ID NO: 5052544 - DNA, 19 bp, Homo sapiens
tctgaagccacctctctgc

SEQ ID NO: 5052545 - DNA, 20 bp, Homo sapiens
tctgagacggatggaaggag

SEQ ID NO: 5052546 - DNA, 23 bp, Homo sapiens
tctgagacggatggaaggagaga

SEQ ID NO: 5052547 - DNA, 14 bp, Homo sapiens
tctgagctgtctaa

SEQ ID NO: 5052548 - DNA, 19 bp, Homo sapiens
tctgatatttgctggagtg

SEQ ID NO: 5052549 - DNA, 23 bp, Homo sapiens
tctgatgggttcatgtctctgat

SEQ ID NO: 5052550 - DNA, 14 bp, Homo sapiens
tctgcctgcctggg

SEQ ID NO: 5052551 - DNA, 15 bp, Homo sapiens
tctgcctgcctggga

SEQ ID NO: 5052552 - DNA, 15 bp, Homo sapiens
tctgcggtgaggcag

SEQ ID NO: 5052553 - DNA, 17 bp, Homo sapiens
tctggaggggcccctgc

SEQ ID NO: 5052554 - DNA, 19 bp, Homo sapiens
tctgggcatctgttctggt

SEQ ID NO: 5052555 - DNA, 14 bp, Homo sapiens
tctgggccctgcag

SEQ ID NO: 5052556 - DNA, 15 bp, Homo sapiens
tctgggccctgcagg

SEQ ID NO: 5052557 - DNA, 22 bp, Homo sapiens
tctgggccctgcaggaggcctg

SEQ ID NO: 5052558 - DNA, 23 bp, Homo sapiens
tctgggccctgcaggaggcctgg

SEQ ID NO: 5052559 - DNA, 14 bp, Homo sapiens
tctgttagctgctc

SEQ ID NO: 5052560 - DNA, 15 bp, Homo sapiens
tctgttagctgctca

SEQ ID NO: 5052561 - DNA, 18 bp, Homo sapiens
tctgttagctgctcactt

SEQ ID NO: 5052562 - DNA, 19 bp, Homo sapiens
tcttgactgtcacggaaca

SEQ ID NO: 5052563 - DNA, 14 bp, Homo sapiens
tctttgattatgac

SEQ ID NO: 5052564 - DNA, 15 bp, Homo sapiens
tctttgcccttctgg

SEQ ID NO: 5052565 - DNA, 18 bp, Homo sapiens
tctttgttctcagctccc

SEQ ID NO: 5052566 - DNA, 19 bp, Homo sapiens
tctttgttctcagctcccc

SEQ ID NO: 5052567 - DNA, 20 bp, Homo sapiens
tctttgttctcagctccccc

SEQ ID NO: 5052568 - DNA, 12 bp, Homo sapiens
tgaaatgtacat

SEQ ID NO: 5052569 - DNA, 19 bp, Homo sapiens
tgaacaatcccctaacaca

SEQ ID NO: 5052570 - DNA, 20 bp, Homo sapiens
tgaagccacctctctgcctg

SEQ ID NO: 5052571 - DNA, 17 bp, Homo sapiens
tgacagaacacagatct

SEQ ID NO: 5052572 - DNA, 19 bp, Homo sapiens
tgacagctttctaactcac

SEQ ID NO: 5052573 - DNA, 13 bp, Homo sapiens
tgaccatcccatg

SEQ ID NO: 5052574 - DNA, 18 bp, Homo sapiens
tgaccccatctctgctgc

SEQ ID NO: 5052575 - DNA, 14 bp, Homo sapiens
tgaccttctgaaca

SEQ ID NO: 5052576 - DNA, 23 bp, Homo sapiens
tgaccttttaatcagagcccagg

SEQ ID NO: 5052577 - DNA, 23 bp, Homo sapiens
tgagaaaatgtaaaataaaggct

SEQ ID NO: 5052578 - DNA, 19 bp, Homo sapiens
tgagacggatggaaggaga

SEQ ID NO: 5052579 - DNA, 13 bp, Homo sapiens
tgagcagtccaga

SEQ ID NO: 5052580 - DNA, 22 bp, Homo sapiens
tgagccagttacctttgctgtc

SEQ ID NO: 5052581 - DNA, 21 bp, Homo sapiens
tgagccctccttcttgccctg

SEQ ID NO: 5052582 - DNA, 19 bp, Homo sapiens
tgagctttccggggaggag

SEQ ID NO: 5052583 - DNA, 13 bp, Homo sapiens
tgaggactctgga

SEQ ID NO: 5052584 - DNA, 15 bp, Homo sapiens
tgaggatgcactggc

SEQ ID NO: 5052585 - DNA, 18 bp, Homo sapiens
tgaggatgcactggcctg

SEQ ID NO: 5052586 - DNA, 17 bp, Homo sapiens
tgaggcaggggagtctg

SEQ ID NO: 5052587 - DNA, 16 bp, Homo sapiens
tgagtctcccaaggct

SEQ ID NO: 5052588 - DNA, 23 bp, Homo sapiens
tgagtctcccaaggctgcgtctg

SEQ ID NO: 5052589 - DNA, 23 bp, Homo sapiens
tgatgaaaacaaaatcacagcac

SEQ ID NO: 5052590 - DNA, 14 bp, Homo sapiens
tgatgaggggaggg

SEQ ID NO: 5052591 - DNA, 14 bp, Homo sapiens
tgatggagaggaga

SEQ ID NO: 5052592 - DNA, 20 bp, Homo sapiens
tgattaaagtgccttcagcc

SEQ ID NO: 5052593 - DNA, 17 bp, Homo sapiens
tgatttgctctctaaac

SEQ ID NO: 5052594 - DNA, 21 bp, Homo sapiens
tgcagaggagccacctgggct

SEQ ID NO: 5052595 - DNA, 17 bp, Homo sapiens
tgcagatgctttgccca

SEQ ID NO: 5052596 - DNA, 18 bp, Homo sapiens
tgcagatgctttgcccag

SEQ ID NO: 5052597 - DNA, 13 bp, Homo sapiens
tgcagcaggcaga

SEQ ID NO: 5052598 - DNA, 19 bp, Homo sapiens
tgcagcaggcagaggagag

SEQ ID NO: 5052599 - DNA, 14 bp, Homo sapiens
tgcagccccaggac

SEQ ID NO: 5052600 - DNA, 17 bp, Homo sapiens
tgcagccccaggaccaa

SEQ ID NO: 5052601 - DNA, 12 bp, Homo sapiens
tgcaggaggcct

SEQ ID NO: 5052602 - DNA, 17 bp, Homo sapiens
tgcaggaggcctgggag

SEQ ID NO: 5052603 - DNA, 16 bp, Homo sapiens
tgccaactcgggagca

SEQ ID NO: 5052604 - DNA, 15 bp, Homo sapiens
tgccaagcctggagc

SEQ ID NO: 5052605 - DNA, 23 bp, Homo sapiens
tgccacaggcctccctgtttgaa

SEQ ID NO: 5052606 - DNA, 15 bp, Homo sapiens
tgcccaacaccagcc

SEQ ID NO: 5052607 - DNA, 18 bp, Homo sapiens
tgcccaagttgctctgta

SEQ ID NO: 5052608 - DNA, 15 bp, Homo sapiens
tgcccaggcttctca

SEQ ID NO: 5052609 - DNA, 16 bp, Homo sapiens
tgcccagtcccccaac

SEQ ID NO: 5052610 - DNA, 20 bp, Homo sapiens
tgcccagtcccccaacccca

SEQ ID NO: 5052611 - DNA, 22 bp, Homo sapiens
tgcccagtcccccaaccccagc

SEQ ID NO: 5052612 - DNA, 12 bp, Homo sapiens
tgccccagctgg

SEQ ID NO: 5052613 - DNA, 15 bp, Homo sapiens
tgcccgctgtcccag

SEQ ID NO: 5052614 - DNA, 18 bp, Homo sapiens
tgcccgctgtcccagggg

SEQ ID NO: 5052615 - DNA, 12 bp, Homo sapiens
tgccctgagctt

SEQ ID NO: 5052616 - DNA, 18 bp, Homo sapiens
tgccctgccaagcctgga

SEQ ID NO: 5052617 - DNA, 20 bp, Homo sapiens
tgccctgggccagcccagga

SEQ ID NO: 5052618 - DNA, 21 bp, Homo sapiens
tgccctgggccagcccaggat

SEQ ID NO: 5052619 - DNA, 13 bp, Homo sapiens
tgcccttgtctga

SEQ ID NO: 5052620 - DNA, 15 bp, Homo sapiens
tgcccttgtctgaga

SEQ ID NO: 5052621 - DNA, 15 bp, Homo sapiens
tgccgggcctggact

SEQ ID NO: 5052622 - DNA, 20 bp, Homo sapiens
tgccgggcctggactgtcct

SEQ ID NO: 5052623 - DNA, 14 bp, Homo sapiens
tgcctgcctgggaa

SEQ ID NO: 5052624 - DNA, 19 bp, Homo sapiens
tgcctgctctccttgccct

SEQ ID NO: 5052625 - DNA, 20 bp, Homo sapiens
tgcctgttcctcccaagagg

SEQ ID NO: 5052626 - DNA, 17 bp, Homo sapiens
tgccttctgagctgtct

SEQ ID NO: 5052627 - DNA, 16 bp, Homo sapiens
tgcggtaggtgctggc

SEQ ID NO: 5052628 - DNA, 14 bp, Homo sapiens
tgcgtcaggagcag

SEQ ID NO: 5052629 - DNA, 15 bp, Homo sapiens
tgcgtctggaggggc

SEQ ID NO: 5052630 - DNA, 20 bp, Homo sapiens
tgcgtctggaggggcccctg

SEQ ID NO: 5052631 - DNA, 21 bp, Homo sapiens
tgcgtctggaggggcccctgc

SEQ ID NO: 5052632 - DNA, 22 bp, Homo sapiens
tgcgtctggaggggcccctgct

SEQ ID NO: 5052633 - DNA, 14 bp, Homo sapiens
tgctaacctcactg

SEQ ID NO: 5052634 - DNA, 16 bp, Homo sapiens
tgctaacctcactgcc

SEQ ID NO: 5052635 - DNA, 20 bp, Homo sapiens
tgctagggtgcctgctctcc

SEQ ID NO: 5052636 - DNA, 16 bp, Homo sapiens
tgctctccttgccctg

SEQ ID NO: 5052637 - DNA, 19 bp, Homo sapiens
tgctctccttgccctgggc

SEQ ID NO: 5052638 - DNA, 15 bp, Homo sapiens
tgctgagtctcccaa

SEQ ID NO: 5052639 - DNA, 24 bp, Homo sapiens
tgctgctcaccctcctagcctgct

SEQ ID NO: 5052640 - DNA, 16 bp, Homo sapiens
tgctggagtgctggct

SEQ ID NO: 5052641 - DNA, 23 bp, Homo sapiens
tgctggcctcaaacagccacgag

SEQ ID NO: 5052642 - DNA, 16 bp, Homo sapiens
tgctggctccacgccc

SEQ ID NO: 5052643 - DNA, 19 bp, Homo sapiens
tgctggctccacgccctgg

SEQ ID NO: 5052644 - DNA, 20 bp, Homo sapiens
tgctggctccacgccctggg

SEQ ID NO: 5052645 - DNA, 19 bp, Homo sapiens
tgctgtcactttctctctt

SEQ ID NO: 5052646 - DNA, 14 bp, Homo sapiens
tgcttccaagccct

SEQ ID NO: 5052647 - DNA, 22 bp, Homo sapiens
tgcttccaagcccttccctctg

SEQ ID NO: 5052648 - DNA, 13 bp, Homo sapiens
tgcttctccagcc

SEQ ID NO: 5052649 - DNA, 15 bp, Homo sapiens
tgcttctgggcctga

SEQ ID NO: 5052650 - DNA, 19 bp, Homo sapiens
tgcttctgggcctgatgga

SEQ ID NO: 5052651 - DNA, 23 bp, Homo sapiens
tgcttgggcttctgcggtgaggc

SEQ ID NO: 5052652 - DNA, 14 bp, Homo sapiens
tgctttatccagca

SEQ ID NO: 5052653 - DNA, 15 bp, Homo sapiens
tgctttatccagcag

SEQ ID NO: 5052654 - DNA, 15 bp, Homo sapiens
tgcttttggggctct

SEQ ID NO: 5052655 - DNA, 17 bp, Homo sapiens
tggaagaaagccctgtg

SEQ ID NO: 5052656 - DNA, 19 bp, Homo sapiens
tggaagaaagccctgtgct

SEQ ID NO: 5052657 - DNA, 20 bp, Homo sapiens
tggaagaaagccctgtgctt

SEQ ID NO: 5052658 - DNA, 22 bp, Homo sapiens
tggaagaaagccctgtgctttg

SEQ ID NO: 5052659 - DNA, 23 bp, Homo sapiens
tggaagctctgttgcaggtgtcc

SEQ ID NO: 5052660 - DNA, 16 bp, Homo sapiens
tggaaggtagagccca

SEQ ID NO: 5052661 - DNA, 14 bp, Homo sapiens
tggacccccagctt

SEQ ID NO: 5052662 - DNA, 15 bp, Homo sapiens
tggactgtcctaggt

SEQ ID NO: 5052663 - DNA, 12 bp, Homo sapiens
tggagaggagaa

SEQ ID NO: 5052664 - DNA, 19 bp, Homo sapiens
tggagatggctgctgctca

SEQ ID NO: 5052665 - DNA, 16 bp, Homo sapiens
tggagcccctgtgtgg

SEQ ID NO: 5052666 - DNA, 14 bp, Homo sapiens
tggagtgctggctc

SEQ ID NO: 5052667 - DNA, 22 bp, Homo sapiens
tggcatcatccattctctctgc

SEQ ID NO: 5052668 - DNA, 22 bp, Homo sapiens
tggccaggggtggtgagggcag

SEQ ID NO: 5052669 - DNA, 23 bp, Homo sapiens
tggccaggggtggtgagggcagt

SEQ ID NO: 5052670 - DNA, 12 bp, Homo sapiens
tggctgctgctc

SEQ ID NO: 5052671 - DNA, 19 bp, Homo sapiens
tgggaacggggtggacgag

SEQ ID NO: 5052672 - DNA, 14 bp, Homo sapiens
tgggacggctcctg

SEQ ID NO: 5052673 - DNA, 16 bp, Homo sapiens
tgggacggctcctgct

SEQ ID NO: 5052674 - DNA, 19 bp, Homo sapiens
tgggagaaggtgcttgggc

SEQ ID NO: 5052675 - DNA, 16 bp, Homo sapiens
tgggagaggcagaaag

SEQ ID NO: 5052676 - DNA, 17 bp, Homo sapiens
tgggcaggtcctgggga

SEQ ID NO: 5052677 - DNA, 20 bp, Homo sapiens
tgggcaggtcctggggaggc

SEQ ID NO: 5052678 - DNA, 16 bp, Homo sapiens
tgggcatctgttctgg

SEQ ID NO: 5052679 - DNA, 17 bp, Homo sapiens
tgggcatctgttctggt

SEQ ID NO: 5052680 - DNA, 11 bp, Homo sapiens
tgggccctgca

SEQ ID NO: 5052681 - DNA, 18 bp, Homo sapiens
tgggccctgcaggaggcc

SEQ ID NO: 5052682 - DNA, 20 bp, Homo sapiens
tgggccctgcaggaggcctg

SEQ ID NO: 5052683 - DNA, 12 bp, Homo sapiens
tgggctgggaga

SEQ ID NO: 5052684 - DNA, 23 bp, Homo sapiens
tgggctgggagaaggtgcttggg

SEQ ID NO: 5052685 - DNA, 19 bp, Homo sapiens
tgggctgttggctgggggc

SEQ ID NO: 5052686 - DNA, 15 bp, Homo sapiens
tggggaaggaccaac

SEQ ID NO: 5052687 - DNA, 12 bp, Homo sapiens
tgggggagcctg

SEQ ID NO: 5052688 - DNA, 14 bp, Homo sapiens
tgggggagcctgga

SEQ ID NO: 5052689 - DNA, 16 bp, Homo sapiens
tgggggcatgggggag

SEQ ID NO: 5052690 - DNA, 18 bp, Homo sapiens
tgggggcatgggggaggc

SEQ ID NO: 5052691 - DNA, 23 bp, Homo sapiens
tgggggcatgggggaggctctga

SEQ ID NO: 5052692 - DNA, 16 bp, Homo sapiens
tggggtctcagtccag

SEQ ID NO: 5052693 - DNA, 17 bp, Homo sapiens
tgggttcatgtctctga

SEQ ID NO: 5052694 - DNA, 16 bp, Homo sapiens
tgggtttgctccctga

SEQ ID NO: 5052695 - DNA, 20 bp, Homo sapiens
tgggttttcaggggctttgg

SEQ ID NO: 5052696 - DNA, 16 bp, Homo sapiens
tggtagctctgagccc

SEQ ID NO: 5052697 - DNA, 19 bp, Homo sapiens
tggtgagggcagttctgca

SEQ ID NO: 5052698 - DNA, 21 bp, Homo sapiens
tggtgagggcagttctgcacc

SEQ ID NO: 5052699 - DNA, 19 bp, Homo sapiens
tggtgcggtaggtgctggc

SEQ ID NO: 5052700 - DNA, 16 bp, Homo sapiens
tgtaaggactcagtgt

SEQ ID NO: 5052701 - DNA, 13 bp, Homo sapiens
tgtaggagagact

SEQ ID NO: 5052702 - DNA, 15 bp, Homo sapiens
tgtaggagagactgg

SEQ ID NO: 5052703 - DNA, 18 bp, Homo sapiens
tgtaggagagactggcca

SEQ ID NO: 5052704 - DNA, 17 bp, Homo sapiens
tgtaggcgcccctgggg

SEQ ID NO: 5052705 - DNA, 15 bp, Homo sapiens
tgtcaccatcatttc

SEQ ID NO: 5052706 - DNA, 17 bp, Homo sapiens
tgtcacggaacagatct

SEQ ID NO: 5052707 - DNA, 14 bp, Homo sapiens
tgtcatctgggcca

SEQ ID NO: 5052708 - DNA, 23 bp, Homo sapiens
tgtctagaggcaacagtgttctg

SEQ ID NO: 5052709 - DNA, 11 bp, Homo sapiens
tgtctgtgcag

SEQ ID NO: 5052710 - DNA, 12 bp, Homo sapiens
tgtctgtgcaga

SEQ ID NO: 5052711 - DNA, 22 bp, Homo sapiens
tgtctgtgcagatgctttgccc

SEQ ID NO: 5052712 - DNA, 13 bp, Homo sapiens
tgtcttgttctgt

SEQ ID NO: 5052713 - DNA, 16 bp, Homo sapiens
tgtgatgaggggaggg

SEQ ID NO: 5052714 - DNA, 13 bp, Homo sapiens
tgtgccctggctc

SEQ ID NO: 5052715 - DNA, 14 bp, Homo sapiens
tgtgccctggctcc

SEQ ID NO: 5052716 - DNA, 22 bp, Homo sapiens
tgtgctaacctcactgcctcat

SEQ ID NO: 5052717 - DNA, 19 bp, Homo sapiens
tgtgtcggggggcgaggga

SEQ ID NO: 5052718 - DNA, 22 bp, Homo sapiens
tgtgtcggggggcgagggaggg

SEQ ID NO: 5052719 - DNA, 23 bp, Homo sapiens
tgtgtgcagaattctaggcagca

SEQ ID NO: 5052720 - DNA, 12 bp, Homo sapiens
tgtgtgggaggg

SEQ ID NO: 5052721 - DNA, 18 bp, Homo sapiens
tgtgttggggggcaaggt

SEQ ID NO: 5052722 - DNA, 18 bp, Homo sapiens
tgttagctgctcacttaa

SEQ ID NO: 5052723 - DNA, 15 bp, Homo sapiens
tgttctcagctcccc

SEQ ID NO: 5052724 - DNA, 18 bp, Homo sapiens
tgttctcagctccccctg

SEQ ID NO: 5052725 - DNA, 20 bp, Homo sapiens
tgttctcagctccccctgtc

SEQ ID NO: 5052726 - DNA, 12 bp, Homo sapiens
tgttctgagccc

SEQ ID NO: 5052727 - DNA, 23 bp, Homo sapiens
tgttggaaattgggtgtgccctg

SEQ ID NO: 5052728 - DNA, 20 bp, Homo sapiens
tgtttacagggagcctcctg

SEQ ID NO: 5052729 - DNA, 22 bp, Homo sapiens
tgtttacagggagcctcctgcc

SEQ ID NO: 5052730 - DNA, 12 bp, Homo sapiens
ttaaagtgcctt

SEQ ID NO: 5052731 - DNA, 17 bp, Homo sapiens
ttacagggagcctcctg

SEQ ID NO: 5052732 - DNA, 15 bp, Homo sapiens
ttacatttttctgat

SEQ ID NO: 5052733 - DNA, 14 bp, Homo sapiens
ttacctttgctgtc

SEQ ID NO: 5052734 - DNA, 17 bp, Homo sapiens
ttagattaaagattgct

SEQ ID NO: 5052735 - DNA, 20 bp, Homo sapiens
ttatcagagtaacgagaaga

SEQ ID NO: 5052736 - DNA, 22 bp, Homo sapiens
ttcaaaaagcaatctggaagaa

SEQ ID NO: 5052737 - DNA, 15 bp, Homo sapiens
ttcaaatgcagcaat

SEQ ID NO: 5052738 - DNA, 22 bp, Homo sapiens
ttcaaatgcagcaatcccactt

SEQ ID NO: 5052739 - DNA, 17 bp, Homo sapiens
ttcagcaaatgcctttt

SEQ ID NO: 5052740 - DNA, 22 bp, Homo sapiens
ttcaggttgtgcattttgtgtg

SEQ ID NO: 5052741 - DNA, 14 bp, Homo sapiens
ttcatgtctctgat

SEQ ID NO: 5052742 - DNA, 16 bp, Homo sapiens
ttccatcatctctttt

SEQ ID NO: 5052743 - DNA, 17 bp, Homo sapiens
ttcccacctctgaggac

SEQ ID NO: 5052744 - DNA, 17 bp, Homo sapiens
ttcctcccaagaggcca

SEQ ID NO: 5052745 - DNA, 21 bp, Homo sapiens
ttcctctctttgttctcagct

SEQ ID NO: 5052746 - DNA, 23 bp, Homo sapiens
ttcctgttggaaggtagagccca

SEQ ID NO: 5052747 - DNA, 22 bp, Homo sapiens
ttcgcacaatctacactgcctt

SEQ ID NO: 5052748 - DNA, 22 bp, Homo sapiens
ttctccagcctggacccccagc

SEQ ID NO: 5052749 - DNA, 23 bp, Homo sapiens
ttctccagcctggacccccagct

SEQ ID NO: 5052750 - DNA, 12 bp, Homo sapiens
ttctctctgccc

SEQ ID NO: 5052751 - DNA, 15 bp, Homo sapiens
ttctctgtagctgct

SEQ ID NO: 5052752 - DNA, 21 bp, Homo sapiens
ttctgaacatgagtgtcaact

SEQ ID NO: 5052753 - DNA, 23 bp, Homo sapiens
ttctgccccacacccagccagct

SEQ ID NO: 5052754 - DNA, 14 bp, Homo sapiens
ttctgcctgcctgg

SEQ ID NO: 5052755 - DNA, 13 bp, Homo sapiens
ttcttgccctgag

SEQ ID NO: 5052756 - DNA, 17 bp, Homo sapiens
ttgagccagttaccttt

SEQ ID NO: 5052757 - DNA, 16 bp, Homo sapiens
ttgaggatgcactggc

SEQ ID NO: 5052758 - DNA, 15 bp, Homo sapiens
ttgcagattgaagca

SEQ ID NO: 5052759 - DNA, 18 bp, Homo sapiens
ttgcagattgaagcattt

SEQ ID NO: 5052760 - DNA, 18 bp, Homo sapiens
ttgccacaggcctccctg

SEQ ID NO: 5052761 - DNA, 21 bp, Homo sapiens
ttgccctgagctttccgggga

SEQ ID NO: 5052762 - DNA, 21 bp, Homo sapiens
ttgccctgggccagcccagga

SEQ ID NO: 5052763 - DNA, 14 bp, Homo sapiens
ttgccgggcctgga

SEQ ID NO: 5052764 - DNA, 15 bp, Homo sapiens
ttgccgggcctggac

SEQ ID NO: 5052765 - DNA, 20 bp, Homo sapiens
ttgcgtcaggagcagcatca

SEQ ID NO: 5052766 - DNA, 19 bp, Homo sapiens
ttgctggagtgctggctcc

SEQ ID NO: 5052767 - DNA, 20 bp, Homo sapiens
ttgctggagtgctggctcca

SEQ ID NO: 5052768 - DNA, 19 bp, Homo sapiens
ttgctgtcactttctctct

SEQ ID NO: 5052769 - DNA, 22 bp, Homo sapiens
ttgctgtcatgtgaatccctca

SEQ ID NO: 5052770 - DNA, 21 bp, Homo sapiens
ttgctttatccagcagtcaat

SEQ ID NO: 5052771 - DNA, 22 bp, Homo sapiens
ttggatggctatggagagggct

SEQ ID NO: 5052772 - DNA, 18 bp, Homo sapiens
ttgggtgtgccctggctc

SEQ ID NO: 5052773 - DNA, 21 bp, Homo sapiens
ttggtggtgcagccccaggac

SEQ ID NO: 5052774 - DNA, 22 bp, Homo sapiens
ttgtacgtgggagaggcagaaa

SEQ ID NO: 5052775 - DNA, 13 bp, Homo sapiens
ttgttctcagctc

SEQ ID NO: 5052776 - DNA, 18 bp, Homo sapiens
tttacagggagcctcctg

SEQ ID NO: 5052777 - DNA, 23 bp, Homo sapiens
tttacagggagcctcctgcccag

SEQ ID NO: 5052778 - DNA, 19 bp, Homo sapiens
tttcctctctttgttctca

SEQ ID NO: 5052779 - DNA, 17 bp, Homo sapiens
tttctaactcacaggca

SEQ ID NO: 5052780 - DNA, 22 bp, Homo sapiens
tttgaaaatagagcaatacttt

SEQ ID NO: 5052781 - DNA, 15 bp, Homo sapiens
tttgaagcctgccct

SEQ ID NO: 5052782 - DNA, 16 bp, Homo sapiens
tttgcccaacaccagc

SEQ ID NO: 5052783 - DNA, 17 bp, Homo sapiens
tttggaagctctgttgc

SEQ ID NO: 5052784 - DNA, 20 bp, Homo sapiens
tttgtaccccccaacccctg

SEQ ID NO: 5052785 - DNA, 11 bp, Homo sapiens
tttttctgatg

SEQ ID NO: 5052786 - DNA, 16 bp, Homo sapiens
aaaaattattcccatg

SEQ ID NO: 5052787 - DNA, 13 bp, Homo sapiens
aaaataaaggctc

SEQ ID NO: 5052788 - DNA, 15 bp, Homo sapiens
aaaataaaggctctg

SEQ ID NO: 5052789 - DNA, 18 bp, Homo sapiens
aaaatcccaaagtgcctt

SEQ ID NO: 5052790 - DNA, 22 bp, Homo sapiens
aaaatcccaaagtgccttctga

SEQ ID NO: 5052791 - DNA, 13 bp, Homo sapiens
aaaattattccca

SEQ ID NO: 5052792 - DNA, 13 bp, Homo sapiens
aaactcatatttt

SEQ ID NO: 5052793 - DNA, 15 bp, Homo sapiens
aaactcatattttga

SEQ ID NO: 5052794 - DNA, 20 bp, Homo sapiens
aaacttttacatttttctga

SEQ ID NO: 5052795 - DNA, 22 bp, Homo sapiens
aaacttttacatttttctgatg

SEQ ID NO: 5052796 - DNA, 13 bp, Homo sapiens
aaagcacaagaag

SEQ ID NO: 5052797 - DNA, 16 bp, Homo sapiens
aaaggaaaaagcacaa

SEQ ID NO: 5052798 - DNA, 16 bp, Homo sapiens
aaagtgccttctgagc

SEQ ID NO: 5052799 - DNA, 17 bp, Homo sapiens
aaagtgggacctggtgg

SEQ ID NO: 5052800 - DNA, 15 bp, Homo sapiens
aaataaaggctctgt

SEQ ID NO: 5052801 - DNA, 16 bp, Homo sapiens
aaatcatattctcatg

SEQ ID NO: 5052802 - DNA, 17 bp, Homo sapiens
aaatcccaaagtgcctt

SEQ ID NO: 5052803 - DNA, 20 bp, Homo sapiens
aaatgtttacagggagcctc

SEQ ID NO: 5052804 - DNA, 21 bp, Homo sapiens
aaatgtttacagggagcctcc

SEQ ID NO: 5052805 - DNA, 21 bp, Homo sapiens
aaattctgttagctgctcact

SEQ ID NO: 5052806 - DNA, 23 bp, Homo sapiens
aaattgacagctttctaactcac

SEQ ID NO: 5052807 - DNA, 18 bp, Homo sapiens
aaattgggtgtgccctgg

SEQ ID NO: 5052808 - DNA, 19 bp, Homo sapiens
aaattgggtgtgccctggc

SEQ ID NO: 5052809 - DNA, 22 bp, Homo sapiens
aaattgggtgtgccctggctcc

SEQ ID NO: 5052810 - DNA, 13 bp, Homo sapiens
aacaattctgatg

SEQ ID NO: 5052811 - DNA, 16 bp, Homo sapiens
aacaccagcccctgcc

SEQ ID NO: 5052812 - DNA, 19 bp, Homo sapiens
aacaccagcccctgcccca

SEQ ID NO: 5052813 - DNA, 16 bp, Homo sapiens
aacagatcttgttctt

SEQ ID NO: 5052814 - DNA, 16 bp, Homo sapiens
aaccaaactctgtgtc

SEQ ID NO: 5052815 - DNA, 17 bp, Homo sapiens
aaccacacacacaaggt

SEQ ID NO: 5052816 - DNA, 18 bp, Homo sapiens
aaccattgtcttgttctg

SEQ ID NO: 5052817 - DNA, 14 bp, Homo sapiens
aacccatgccctgc

SEQ ID NO: 5052818 - DNA, 11 bp, Homo sapiens
aaccccagccg

SEQ ID NO: 5052819 - DNA, 16 bp, Homo sapiens
aaccccagctgccggc

SEQ ID NO: 5052820 - DNA, 13 bp, Homo sapiens
aacgagaagacaa

SEQ ID NO: 5052821 - DNA, 17 bp, Homo sapiens
aacgagaagacaaactc

SEQ ID NO: 5052822 - DNA, 21 bp, Homo sapiens
aacggggtggacgagggagtg

SEQ ID NO: 5052823 - DNA, 14 bp, Homo sapiens
aactcaaggtggct

SEQ ID NO: 5052824 - DNA, 19 bp, Homo sapiens
aactcaaggtggctggaga

SEQ ID NO: 5052825 - DNA, 15 bp, Homo sapiens
aactcatattttgaa

SEQ ID NO: 5052826 - DNA, 20 bp, Homo sapiens
aactccaaacaattctgatg

SEQ ID NO: 5052827 - DNA, 13 bp, Homo sapiens
aactcgggagcat

SEQ ID NO: 5052828 - DNA, 20 bp, Homo sapiens
aacttggatattcaagcctt

SEQ ID NO: 5052829 - DNA, 17 bp, Homo sapiens
aagaagatcacgctccc

SEQ ID NO: 5052830 - DNA, 19 bp, Homo sapiens
aagagccatctgaagccac

SEQ ID NO: 5052831 - DNA, 19 bp, Homo sapiens
aagatcacgctccccgcct

SEQ ID NO: 5052832 - DNA, 22 bp, Homo sapiens
aagccacctctctgcctgttcc

SEQ ID NO: 5052833 - DNA, 12 bp, Homo sapiens
aagccctgtgct

SEQ ID NO: 5052834 - DNA, 11 bp, Homo sapiens
aagcctggagc

SEQ ID NO: 5052835 - DNA, 15 bp, Homo sapiens
aagcctggagcccct

SEQ ID NO: 5052836 - DNA, 11 bp, Homo sapiens
aagctctgttg

SEQ ID NO: 5052837 - DNA, 16 bp, Homo sapiens
aaggaaaaagcacaag

SEQ ID NO: 5052838 - DNA, 19 bp, Homo sapiens
aaggaaaaagcacaagaag

SEQ ID NO: 5052839 - DNA, 16 bp, Homo sapiens
aaggctgcgtctggag

SEQ ID NO: 5052840 - DNA, 19 bp, Homo sapiens
aaggctgcgtctggagggg

SEQ ID NO: 5052841 - DNA, 15 bp, Homo sapiens
aaggggcaggaatca

SEQ ID NO: 5052842 - DNA, 14 bp, Homo sapiens
aaggtgcttgggct

SEQ ID NO: 5052843 - DNA, 16 bp, Homo sapiens
aaggtggcagcaagca

SEQ ID NO: 5052844 - DNA, 19 bp, Homo sapiens
aagtctcacatattcatca

SEQ ID NO: 5052845 - DNA, 22 bp, Homo sapiens
aagtgccttcagccaagaccat

SEQ ID NO: 5052846 - DNA, 13 bp, Homo sapiens
aagttgctctgta

SEQ ID NO: 5052847 - DNA, 14 bp, Homo sapiens
aagttgctctgtat

SEQ ID NO: 5052848 - DNA, 17 bp, Homo sapiens
aataccccttctctgta

SEQ ID NO: 5052849 - DNA, 20 bp, Homo sapiens
aatcatattctcatggcttt

SEQ ID NO: 5052850 - DNA, 14 bp, Homo sapiens
aatctacactgcct

SEQ ID NO: 5052851 - DNA, 20 bp, Homo sapiens
aatgtaaaataaaggctctg

SEQ ID NO: 5052852 - DNA, 22 bp, Homo sapiens
aatgtaaaataaaggctctgtg

SEQ ID NO: 5052853 - DNA, 22 bp, Homo sapiens
aatgtttacagggagcctcctg

SEQ ID NO: 5052854 - DNA, 18 bp, Homo sapiens
aattctgttagctgctca

SEQ ID NO: 5052855 - DNA, 16 bp, Homo sapiens
acaaaattgacagctt

SEQ ID NO: 5052856 - DNA, 17 bp, Homo sapiens
acaaggtgctcagacat

SEQ ID NO: 5052857 - DNA, 23 bp, Homo sapiens
acaataaaaaccaaactctgtgt

SEQ ID NO: 5052858 - DNA, 16 bp, Homo sapiens
acaatgtcctctttga

SEQ ID NO: 5052859 - DNA, 16 bp, Homo sapiens
acacaaggtgctcaga

SEQ ID NO: 5052860 - DNA, 18 bp, Homo sapiens
acacacaaggtgctcaga

SEQ ID NO: 5052861 - DNA, 15 bp, Homo sapiens
acacacacctgtctg

SEQ ID NO: 5052862 - DNA, 20 bp, Homo sapiens
acacacacctgtctgtgcag

SEQ ID NO: 5052863 - DNA, 17 bp, Homo sapiens
actaaccccagctgccg

SEQ ID NO: 5052864 - DNA, 21 bp, Homo sapiens
actaataaaaaactgtgaacc

SEQ ID NO: 5052865 - DNA, 13 bp, Homo sapiens
actaccatacaga

SEQ ID NO: 5052866 - DNA, 15 bp, Homo sapiens
actatgaacttggat

SEQ ID NO: 5052867 - DNA, 14 bp, Homo sapiens
actcagtgttgact

SEQ ID NO: 5052868 - DNA, 20 bp, Homo sapiens
actcagtgttgactgtaggc

SEQ ID NO: 5052869 - DNA, 18 bp, Homo sapiens
actccaaacaattctgat

SEQ ID NO: 5052870 - DNA, 21 bp, Homo sapiens
actccctttgcgtcaggagca

SEQ ID NO: 5052871 - DNA, 21 bp, Homo sapiens
actcgggagcattctgcctgc

SEQ ID NO: 5052872 - DNA, 11 bp, Homo sapiens
actctgtgtca

SEQ ID NO: 5052873 - DNA, 20 bp, Homo sapiens
actgccttaccttcacttaa

SEQ ID NO: 5052874 - DNA, 21 bp, Homo sapiens
actggcctgttctgtaggaga

SEQ ID NO: 5052875 - DNA, 15 bp, Homo sapiens
actgggacggctcct

SEQ ID NO: 5052876 - DNA, 18 bp, Homo sapiens
actgggacggctcctgct

SEQ ID NO: 5052877 - DNA, 14 bp, Homo sapiens
actgggtttgctcc

SEQ ID NO: 5052878 - DNA, 16 bp, Homo sapiens
actgggtttgctccct

SEQ ID NO: 5052879 - DNA, 18 bp, Homo sapiens
actgtaggcgcccctggg

SEQ ID NO: 5052880 - DNA, 21 bp, Homo sapiens
acttgtctttgattatgacag

SEQ ID NO: 5052881 - DNA, 22 bp, Homo sapiens
actttgtaccccccaacccctg

SEQ ID NO: 5052882 - DNA, 20 bp, Homo sapiens
acttttacatttttctgatg

SEQ ID NO: 5052883 - DNA, 19 bp, Homo sapiens
agaaagtgggacctggtgg

SEQ ID NO: 5052884 - DNA, 19 bp, Homo sapiens
agaagcgtgagacgccacc

SEQ ID NO: 5052885 - DNA, 17 bp, Homo sapiens
agaatgtgtgtgcagaa

SEQ ID NO: 5052886 - DNA, 22 bp, Homo sapiens
agacagcacaaggtggcagcaa

SEQ ID NO: 5052887 - DNA, 12 bp, Homo sapiens
agaccatctctc

SEQ ID NO: 5052888 - DNA, 23 bp, Homo sapiens
agaccatctctccctcctggtga

SEQ ID NO: 5052889 - DNA, 17 bp, Homo sapiens
agacgccaccattcctg

SEQ ID NO: 5052890 - DNA, 20 bp, Homo sapiens
agacgccaccattcctggaa

SEQ ID NO: 5052891 - DNA, 14 bp, Homo sapiens
agacggatggaagg

SEQ ID NO: 5052892 - DNA, 20 bp, Homo sapiens
agacggatggaaggagagag

SEQ ID NO: 5052893 - DNA, 13 bp, Homo sapiens
agactgcagagga

SEQ ID NO: 5052894 - DNA, 13 bp, Homo sapiens
agagactggccag

SEQ ID NO: 5052895 - DNA, 16 bp, Homo sapiens
agagactggccagagg

SEQ ID NO: 5052896 - DNA, 17 bp, Homo sapiens
agagcatctgctctgag

SEQ ID NO: 5052897 - DNA, 17 bp, Homo sapiens
agagccatctgaagcca

SEQ ID NO: 5052898 - DNA, 14 bp, Homo sapiens
agaggagagcatct

SEQ ID NO: 5052899 - DNA, 16 bp, Homo sapiens
agaggagagcatctgc

SEQ ID NO: 5052900 - DNA, 16 bp, Homo sapiens
agaggcaacagtgttc

SEQ ID NO: 5052901 - DNA, 16 bp, Homo sapiens
agatcacgctccccgc

SEQ ID NO: 5052902 - DNA, 21 bp, Homo sapiens
agatgctttgcccaggcttct

SEQ ID NO: 5052903 - DNA, 13 bp, Homo sapiens
agatggctgctgc

SEQ ID NO: 5052904 - DNA, 14 bp, Homo sapiens
agatggctgctgct

SEQ ID NO: 5052905 - DNA, 17 bp, Homo sapiens
agatggctgctgctcac

SEQ ID NO: 5052906 - DNA, 16 bp, Homo sapiens
agatgggggcaagaag

SEQ ID NO: 5052907 - DNA, 17 bp, Homo sapiens
agatgggggcaagaaga

SEQ ID NO: 5052908 - DNA, 19 bp, Homo sapiens
agcaatctggaagaaagcc

SEQ ID NO: 5052909 - DNA, 13 bp, Homo sapiens
agcacaagaagcg

SEQ ID NO: 5052910 - DNA, 18 bp, Homo sapiens
agcacaagaagcgtgaga

SEQ ID NO: 5052911 - DNA, 22 bp, Homo sapiens
agcacccactaccatacagaca

SEQ ID NO: 5052912 - DNA, 18 bp, Homo sapiens
agcaggctgcagcaggca

SEQ ID NO: 5052913 - DNA, 15 bp, Homo sapiens
agcagggacaggaga

SEQ ID NO: 5052914 - DNA, 14 bp, Homo sapiens
cacccagccagctc

SEQ ID NO: 5052915 - DNA, 19 bp, Homo sapiens
cacccagccagctcctttc

SEQ ID NO: 5052916 - DNA, 21 bp, Homo sapiens
cacccagccagctcctttccc

SEQ ID NO: 5052917 - DNA, 19 bp, Homo sapiens
caccctcctagcctgctct

SEQ ID NO: 5052918 - DNA, 11 bp, Homo sapiens
cacctctgagg

SEQ ID NO: 5052919 - DNA, 17 bp, Homo sapiens
cacctctgaggactctg

SEQ ID NO: 5052920 - DNA, 19 bp, Homo sapiens
cacctctgaggactctgga

SEQ ID NO: 5052921 - DNA, 14 bp, Homo sapiens
cacctctgggccct

SEQ ID NO: 5052922 - DNA, 15 bp, Homo sapiens
cacctctgggccctg

SEQ ID NO: 5052923 - DNA, 22 bp, Homo sapiens
cacctctgggccctgcaggagg

SEQ ID NO: 5052924 - DNA, 12 bp, Homo sapiens
cacctgcctgac

SEQ ID NO: 5052925 - DNA, 16 bp, Homo sapiens
cacctgggctgggaga

SEQ ID NO: 5052926 - DNA, 16 bp, Homo sapiens
cacctgtctgtgcaga

SEQ ID NO: 5052927 - DNA, 21 bp, Homo sapiens
cacgaggtggtagctctgagc

SEQ ID NO: 5052928 - DNA, 19 bp, Homo sapiens
cacgctccccgcctgttcc

SEQ ID NO: 5052929 - DNA, 21 bp, Homo sapiens
cacgctccccgcctgttcccc

SEQ ID NO: 5052930 - DNA, 17 bp, Homo sapiens
cactaaccccagctgcc

SEQ ID NO: 5052931 - DNA, 20 bp, Homo sapiens
cactaaccccagctgccggc

SEQ ID NO: 5052932 - DNA, 21 bp, Homo sapiens
cactaccatacagacagcaca

SEQ ID NO: 5052933 - DNA, 11 bp, Homo sapiens
cactggcctgt

SEQ ID NO: 5052934 - DNA, 23 bp, Homo sapiens
cacttaaacaatgtcctctttga

SEQ ID NO: 5052935 - DNA, 23 bp, Homo sapiens
cagacagcacaaggtggcagcaa

SEQ ID NO: 5052936 - DNA, 19 bp, Homo sapiens
cagacatgaaatgtacatg

SEQ ID NO: 5052937 - DNA, 17 bp, Homo sapiens
cagagcttcagggctgg

SEQ ID NO: 5052938 - DNA, 19 bp, Homo sapiens
cagagcttcagggctgggc

SEQ ID NO: 5052939 - DNA, 23 bp, Homo sapiens
cagaggagagtacccccctgaga

SEQ ID NO: 5052940 - DNA, 21 bp, Homo sapiens
cagagtgtggtccctccacta

SEQ ID NO: 5052941 - DNA, 19 bp, Homo sapiens
cagatctcttgttcgcaca

SEQ ID NO: 5052942 - DNA, 15 bp, Homo sapiens
cagatcttgttcttt

SEQ ID NO: 5052943 - DNA, 14 bp, Homo sapiens
cagcaaatgccttt

SEQ ID NO: 5052944 - DNA, 14 bp, Homo sapiens
cagcaatcccactt

SEQ ID NO: 5052945 - DNA, 16 bp, Homo sapiens
cagcacaaggtggcag

SEQ ID NO: 5052946 - DNA, 19 bp, Homo sapiens
cagcacaaggtggcagcaa

SEQ ID NO: 5052947 - DNA, 20 bp, Homo sapiens
cagcacaaggtggcagcaag

SEQ ID NO: 5052948 - DNA, 17 bp, Homo sapiens
cagcatcattcagcaaa

SEQ ID NO: 5052949 - DNA, 13 bp, Homo sapiens
cagccaagaccat

SEQ ID NO: 5052950 - DNA, 16 bp, Homo sapiens
cagccaagaccatctc

SEQ ID NO: 5052951 - DNA, 23 bp, Homo sapiens
cagccaagatgatccttcttaga

SEQ ID NO: 5052952 - DNA, 15 bp, Homo sapiens
cagccagctcctttc

SEQ ID NO: 5052953 - DNA, 11 bp, Homo sapiens
cagcccaggat

SEQ ID NO: 5052954 - DNA, 16 bp, Homo sapiens
cagccccaggaccaag

SEQ ID NO: 5052955 - DNA, 15 bp, Homo sapiens
cagcccctgccccag

SEQ ID NO: 5052956 - DNA, 17 bp, Homo sapiens
cagcccctgccccagcc

SEQ ID NO: 5052957 - DNA, 19 bp, Homo sapiens
cagcccctgccccagccca

SEQ ID NO: 5052958 - DNA, 22 bp, Homo sapiens
cagcccctgccccagcccaagt

SEQ ID NO: 5052959 - DNA, 20 bp, Homo sapiens
cagccgctcggaggccccaa

SEQ ID NO: 5052960 - DNA, 16 bp, Homo sapiens
cagcctggacccccag

SEQ ID NO: 5052961 - DNA, 14 bp, Homo sapiens
cagccttggaagca

SEQ ID NO: 5052962 - DNA, 16 bp, Homo sapiens
cagctccccctgtccc

SEQ ID NO: 5052963 - DNA, 13 bp, Homo sapiens
cagctcctttccc

SEQ ID NO: 5052964 - DNA, 23 bp, Homo sapiens
caggaaggaactcaaggtggctg

SEQ ID NO: 5052965 - DNA, 15 bp, Homo sapiens
caggaatcaaggagc

SEQ ID NO: 5052966 - DNA, 23 bp, Homo sapiens
caggaccaagcttaaggagagga

SEQ ID NO: 5052967 - DNA, 22 bp, Homo sapiens
caggaggcctgggagggcaagg

SEQ ID NO: 5052968 - DNA, 17 bp, Homo sapiens
caggattgtacgtggga

SEQ ID NO: 5052969 - DNA, 21 bp, Homo sapiens
caggattgtacgtgggagagg

SEQ ID NO: 5052970 - DNA, 18 bp, Homo sapiens
gctgggcaggtcctgggg

SEQ ID NO: 5052971 - DNA, 18 bp, Homo sapiens
gctgggttttcaggggct

SEQ ID NO: 5052972 - DNA, 21 bp, Homo sapiens
gctgggttttcaggggctttg

SEQ ID NO: 5052973 - DNA, 20 bp, Homo sapiens
gctggttctccaacagagtg

SEQ ID NO: 5052974 - DNA, 20 bp, Homo sapiens
gctgtcatgtgaatccctca

SEQ ID NO: 5052975 - DNA, 21 bp, Homo sapiens
gctgtcccaggggtctccctg

SEQ ID NO: 5052976 - DNA, 12 bp, Homo sapiens
gcttaaggagag

SEQ ID NO: 5052977 - DNA, 14 bp, Homo sapiens
gcttaaggagagga

SEQ ID NO: 5052978 - DNA, 15 bp, Homo sapiens
gcttaaggagaggag

SEQ ID NO: 5052979 - DNA, 13 bp, Homo sapiens
gcttcagggctgg

SEQ ID NO: 5052980 - DNA, 15 bp, Homo sapiens
gcttcagggctgggc

SEQ ID NO: 5052981 - DNA, 18 bp, Homo sapiens
gcttcagggctgggcagg

SEQ ID NO: 5052982 - DNA, 14 bp, Homo sapiens
gcttctccagcctg

SEQ ID NO: 5052983 - DNA, 19 bp, Homo sapiens
gcttctgcggtgaggcagg

SEQ ID NO: 5052984 - DNA, 20 bp, Homo sapiens
gcttctgcggtgaggcaggg

SEQ ID NO: 5052985 - DNA, 23 bp, Homo sapiens
gcttgggcttctgcggtgaggca

SEQ ID NO: 5052986 - DNA, 21 bp, Homo sapiens
gcttggtgcggtaggtgctgg

SEQ ID NO: 5052987 - DNA, 17 bp, Homo sapiens
gctttccggggaggagc

SEQ ID NO: 5052988 - DNA, 23 bp, Homo sapiens
gctttgcccaacaccagcccctg

SEQ ID NO: 5052989 - DNA, 20 bp, Homo sapiens
gctttgggggagtaagaatg

SEQ ID NO: 5052990 - DNA, 16 bp, Homo sapiens
gcttttctcctctttc

SEQ ID NO: 5052991 - DNA, 16 bp, Homo sapiens
ggaaaaagcacaagaa

SEQ ID NO: 5052992 - DNA, 17 bp, Homo sapiens
ggaaaaagcacaagaag

SEQ ID NO: 5052993 - DNA, 14 bp, Homo sapiens
ggaactcaaggtgg

SEQ ID NO: 5052994 - DNA, 19 bp, Homo sapiens
ggaagatgggggcaagaag

SEQ ID NO: 5052995 - DNA, 23 bp, Homo sapiens
ggaaggaccaacccatgccctgc

SEQ ID NO: 5052996 - DNA, 13 bp, Homo sapiens
ggaaggagagagg

SEQ ID NO: 5052997 - DNA, 14 bp, Homo sapiens
ggaaggagagaggt

SEQ ID NO: 5052998 - DNA, 13 bp, Homo sapiens
ggaaggccttgct

SEQ ID NO: 5052999 - DNA, 20 bp, Homo sapiens
ggaccaacccatgccctgcc

SEQ ID NO: 5053000 - DNA, 20 bp, Homo sapiens
ggaccaagcttaaggagagg

SEQ ID NO: 5053001 - DNA, 14 bp, Homo sapiens
ggagagactggcca

SEQ ID NO: 5053002 - DNA, 12 bp, Homo sapiens
ggagaggagagc

SEQ ID NO: 5053003 - DNA, 19 bp, Homo sapiens
ggagagtacccccctgaga

SEQ ID NO: 5053004 - DNA, 17 bp, Homo sapiens
taactaccctacacctc

SEQ ID NO: 5053005 - DNA, 19 bp, Homo sapiens
taactctccagttatcagt

SEQ ID NO: 5053006 - DNA, 18 bp, Homo sapiens
taagaatgtgtgtgcaga

SEQ ID NO: 5053007 - DNA, 14 bp, Homo sapiens
taagccccgaggcc

SEQ ID NO: 5053008 - DNA, 14 bp, Homo sapiens
taaggagaggagag

SEQ ID NO: 5053009 - DNA, 19 bp, Homo sapiens
taatggccatggtaccccc

SEQ ID NO: 5053010 - DNA, 22 bp, Homo sapiens
tacactgccttaccttcactta

SEQ ID NO: 5053011 - DNA, 15 bp, Homo sapiens
tacagggagcctcct

SEQ ID NO: 5053012 - DNA, 17 bp, Homo sapiens
tacagggagcctcctgc

SEQ ID NO: 5053013 - DNA, 20 bp, Homo sapiens
tacagggagcctcctgccca

SEQ ID NO: 5053014 - DNA, 21 bp, Homo sapiens
tacagggagcctcctgcccag

SEQ ID NO: 5053015 - DNA, 22 bp, Homo sapiens
tacatggcgtaccgtacacaga

SEQ ID NO: 5053016 - DNA, 14 bp, Homo sapiens
tacatttttctgat

SEQ ID NO: 5053017 - DNA, 16 bp, Homo sapiens
tacatttttctgatgg

SEQ ID NO: 5053018 - DNA, 17 bp, Homo sapiens
taccccccaacccctga

SEQ ID NO: 5053019 - DNA, 15 bp, Homo sapiens
taccccttctctgta

SEQ ID NO: 5053020 - DNA, 20 bp, Homo sapiens
taccctacacctctgggccc

SEQ ID NO: 5053021 - DNA, 16 bp, Homo sapiens
tacctcgaacatcagt

SEQ ID NO: 5053022 - DNA, 13 bp, Homo sapiens
tacctttgctgtc

SEQ ID NO: 5053023 - DNA, 14 bp, Homo sapiens
tagagcccactgct

SEQ ID NO: 5053024 - DNA, 16 bp, Homo sapiens
tagagtggcagccaag

SEQ ID NO: 5053025 - DNA, 18 bp, Homo sapiens
tagcacatgtgtaagaca

SEQ ID NO: 5053026 - DNA, 11 bp, Homo sapiens
tagcctgctct

SEQ ID NO: 5053027 - DNA, 14 bp, Homo sapiens
tagcctgctctgcc

SEQ ID NO: 5053028 - DNA, 15 bp, Homo sapiens
tagcctgctctgcca

SEQ ID NO: 5053029 - DNA, 16 bp, Homo sapiens
tagcctgctctgccac

SEQ ID NO: 5053030 - DNA, 17 bp, Homo sapiens
tagcctgctctgccact

SEQ ID NO: 5053031 - DNA, 17 bp, Homo sapiens
tagctaactaattctgt

SEQ ID NO: 5053032 - DNA, 18 bp, Homo sapiens
taggagagactggccaga

SEQ ID NO: 5053033 - DNA, 18 bp, Homo sapiens
tagggatctggggaagga

SEQ ID NO: 5053034 - DNA, 11 bp, Homo sapiens
taggtgctggc

SEQ ID NO: 5053035 - DNA, 14 bp, Homo sapiens
taggtgctggcctc

SEQ ID NO: 5053036 - DNA, 17 bp, Homo sapiens
tagtttgcacttcctgt

SEQ ID NO: 5053037 - DNA, 24 bp, Homo sapiens
tataaattctgttagctgctcact

SEQ ID NO: 5053038 - DNA, 13 bp, Homo sapiens
tattcaagccttt

SEQ ID NO: 5053039 - DNA, 15 bp, Homo sapiens
tattcaagcctttgg

SEQ ID NO: 5053040 - DNA, 20 bp, Homo sapiens
tatttgctggagtgctggct

SEQ ID NO: 5053041 - DNA, 19 bp, Homo sapiens
tcaaccacacacacctgtc

SEQ ID NO: 5053042 - DNA, 21 bp, Homo sapiens
tcaaccacacacacctgtctg

SEQ ID NO: 5053043 - DNA, 16 bp, Homo sapiens
tcacatattcatcagc

SEQ ID NO: 5053044 - DNA, 19 bp, Homo sapiens
tcacatgcccgctgtccca

SEQ ID NO: 5053045 - DNA, 16 bp, Homo sapiens
tcaccatcatttctag

SEQ ID NO: 5053046 - DNA, 19 bp, Homo sapiens
tcaccctcctagcctgctc

SEQ ID NO: 5053047 - DNA, 22 bp, Homo sapiens
tcaccctcctagcctgctctgc

SEQ ID NO: 5053048 - DNA, 16 bp, Homo sapiens
tcacgctccccgcctg

SEQ ID NO: 5053049 - DNA, 19 bp, Homo sapiens
tcagacatgaaatgtacat

SEQ ID NO: 5053050 - DNA, 18 bp, Homo sapiens
tcagcaaatgccttttca

SEQ ID NO: 5053051 - DNA, 22 bp, Homo sapiens
tcagctccccctgtcccctcag

SEQ ID NO: 5053052 - DNA, 23 bp, Homo sapiens
tcagctccccctgtcccctcagc

SEQ ID NO: 5053053 - DNA, 15 bp, Homo sapiens
tcaggagcagcatca

SEQ ID NO: 5053054 - DNA, 14 bp, Homo sapiens
tcagggctgggcag

SEQ ID NO: 5053055 - DNA, 15 bp, Homo sapiens
tcagggctgggcagg

SEQ ID NO: 5053056 - DNA, 22 bp, Homo sapiens
tcagggctgggcaggtcctggg

SEQ ID NO: 5053057 - DNA, 22 bp, Homo sapiens
tcagtgtgctaacctcactgcc

SEQ ID NO: 5053058 - DNA, 18 bp, Homo sapiens
tcatattctcatggcttt

SEQ ID NO: 5053059 - DNA, 20 bp, Homo sapiens
tcatccattctctctgccca

SEQ ID NO: 5053060 - DNA, 21 bp, Homo sapiens
tcatgcgaattcttgcttgag

SEQ ID NO: 5053061 - DNA, 21 bp, Homo sapiens
tcatggcagtgcctgaacatg

SEQ ID NO: 5053062 - DNA, 13 bp, Homo sapiens
tcatgtctctgat

SEQ ID NO: 5053063 - DNA, 20 bp, Homo sapiens
tcattcagcaaatgcctttt

SEQ ID NO: 5053064 - DNA, 15 bp, Homo sapiens
tccaaacaattctga

SEQ ID NO: 5053065 - DNA, 14 bp, Homo sapiens
tccactggcctgcc

SEQ ID NO: 5053066 - DNA, 21 bp, Homo sapiens
tccagtggggtctcagtccag

SEQ ID NO: 5053067 - DNA, 13 bp, Homo sapiens
tccattctctctg

SEQ ID NO: 5053068 - DNA, 15 bp, Homo sapiens
tccattctctctgcc

SEQ ID NO: 5053069 - DNA, 19 bp, Homo sapiens
tcccaaagtgccttctgag

SEQ ID NO: 5053070 - DNA, 13 bp, Homo sapiens
tcccaagaggcca

SEQ ID NO: 5053071 - DNA, 20 bp, Homo sapiens
tcccaagggaggcccatgtg

SEQ ID NO: 5053072 - DNA, 18 bp, Homo sapiens
tcccaggggtctccctga

SEQ ID NO: 5053073 - DNA, 22 bp, Homo sapiens
tcccaggggtctccctgagcct

SEQ ID NO: 5053074 - DNA, 15 bp, Homo sapiens
tcccccaaccccagc

SEQ ID NO: 5053075 - DNA, 15 bp, Homo sapiens
tccccctgtcccctc

SEQ ID NO: 5053076 - DNA, 16 bp, Homo sapiens
tccccctgtcccctca

SEQ ID NO: 5053077 - DNA, 14 bp, Homo sapiens
tccccgcctgttcc

SEQ ID NO: 5053078 - DNA, 12 bp, Homo sapiens
tcccctcagctc

SEQ ID NO: 5053079 - DNA, 13 bp, Homo sapiens
tccctgagcctgc

SEQ ID NO: 5053080 - DNA, 21 bp, Homo sapiens
tccctgagcctgccccagctg

SEQ ID NO: 5053081 - DNA, 19 bp, Homo sapiens
tccctgattaaagtgcctt

SEQ ID NO: 5053082 - DNA, 15 bp, Homo sapiens
tccggggaggagcct

SEQ ID NO: 5053083 - DNA, 14 bp, Homo sapiens
tccgttcccacctc

SEQ ID NO: 5053084 - DNA, 14 bp, Homo sapiens
tcctacggagggac

SEQ ID NO: 5053085 - DNA, 15 bp, Homo sapiens
tcctagcctgctctg

SEQ ID NO: 5053086 - DNA, 16 bp, Homo sapiens
tcctagcctgctctgc

SEQ ID NO: 5053087 - DNA, 18 bp, Homo sapiens
tcctagcctgctctgcca

SEQ ID NO: 5053088 - DNA, 14 bp, Homo sapiens
tcctcacatgcccg

SEQ ID NO: 5053089 - DNA, 23 bp, Homo sapiens
tcctcacatgcccgctgtcccag

SEQ ID NO: 5053090 - DNA, 16 bp, Homo sapiens
tcctcccaagaggcca

SEQ ID NO: 5053091 - DNA, 19 bp, Homo sapiens
tcctctctttgttctcagc

SEQ ID NO: 5053092 - DNA, 14 bp, Homo sapiens
tcctgcccagtccc

SEQ ID NO: 5053093 - DNA, 15 bp, Homo sapiens
tcctgcccagtcccc

SEQ ID NO: 5053094 - DNA, 17 bp, Homo sapiens
tcctgcccagtccccca

SEQ ID NO: 5053095 - DNA, 20 bp, Homo sapiens
tcctgcttttggggctcttg

SEQ ID NO: 5053096 - DNA, 22 bp, Homo sapiens
tcctgttggaaggtagagccca

SEQ ID NO: 5053097 - DNA, 16 bp, Homo sapiens
tccttgccctgggcca

SEQ ID NO: 5053098 - DNA, 19 bp, Homo sapiens
tccttgccctgggccagcc

SEQ ID NO: 5053099 - DNA, 14 bp, Homo sapiens
tcctttcccttttc

SEQ ID NO: 5053100 - DNA, 17 bp, Homo sapiens
tcgctcagtcagtgcac

SEQ ID NO: 5053101 - DNA, 18 bp, Homo sapiens
tcgctcagtcagtgcact

SEQ ID NO: 5053102 - DNA, 19 bp, Homo sapiens
tcgctcagtcagtgcacta

SEQ ID NO: 5053103 - DNA, 12 bp, Homo sapiens
tcggaggcccca

SEQ ID NO: 5053104 - DNA, 19 bp, Homo sapiens
tcggggggcgagggagggg

SEQ ID NO: 5053105 - DNA, 20 bp, Homo sapiens
tcggggggcgagggagggga

SEQ ID NO: 5053106 - DNA, 21 bp, Homo sapiens
tcggggggcgagggaggggag

SEQ ID NO: 5053107 - DNA, 17 bp, Homo sapiens
tctcagctccccctgtc

SEQ ID NO: 5053108 - DNA, 13 bp, Homo sapiens
tctcatggctttg

SEQ ID NO: 5053109 - DNA, 19 bp, Homo sapiens
tctccagcctggaccccca

SEQ ID NO: 5053110 - DNA, 16 bp, Homo sapiens
tgctgagtctcccaag

SEQ ID NO: 5053111 - DNA, 17 bp, Homo sapiens
tgctgagtctcccaagg

SEQ ID NO: 5053112 - DNA, 17 bp, Homo sapiens
tgctgcttctgggcctg

SEQ ID NO: 5053113 - DNA, 14 bp, Homo sapiens
tgctggaccatcaa

SEQ ID NO: 5053114 - DNA, 23 bp, Homo sapiens
tgctggctccacgccctggggag

SEQ ID NO: 5053115 - DNA, 15 bp, Homo sapiens
tgctgtcatgtgaat

SEQ ID NO: 5053116 - DNA, 13 bp, Homo sapiens
tgcttccaagccc

SEQ ID NO: 5053117 - DNA, 16 bp, Homo sapiens
tgcttctgggcctgat

SEQ ID NO: 5053118 - DNA, 17 bp, Homo sapiens
tgcttgggcttctgcgg

SEQ ID NO: 5053119 - DNA, 15 bp, Homo sapiens
tgctttgcccaggct

SEQ ID NO: 5053120 - DNA, 12 bp, Homo sapiens
tggaaaccacag

SEQ ID NO: 5053121 - DNA, 12 bp, Homo sapiens
tggaaggagaga

SEQ ID NO: 5053122 - DNA, 21 bp, Homo sapiens
tggaaggagagaggttgagga

SEQ ID NO: 5053123 - DNA, 19 bp, Homo sapiens
tggaaggtagagcccactg

SEQ ID NO: 5053124 - DNA, 21 bp, Homo sapiens
tggaaggtagagcccactgct

SEQ ID NO: 5053125 - DNA, 13 bp, Homo sapiens
tggaccccaggcc

SEQ ID NO: 5053126 - DNA, 13 bp, Homo sapiens
tggacccccagct

SEQ ID NO: 5053127 - DNA, 14 bp, Homo sapiens
tggagaggagaaca

SEQ ID NO: 5053128 - DNA, 17 bp, Homo sapiens
tggagatggctgctgct

SEQ ID NO: 5053129 - DNA, 14 bp, Homo sapiens
tggaggggcccctg

SEQ ID NO: 5053130 - DNA, 13 bp, Homo sapiens
tggagtgctggct

SEQ ID NO: 5053131 - DNA, 16 bp, Homo sapiens
tggagtgctggctcca

SEQ ID NO: 5053132 - DNA, 23 bp, Homo sapiens
tggagtgctggctccacgccctg

SEQ ID NO: 5053133 - DNA, 19 bp, Homo sapiens
tggcaagtctcacatattc

SEQ ID NO: 5053134 - DNA, 16 bp, Homo sapiens
tggcagtctagggtga

SEQ ID NO: 5053135 - DNA, 20 bp, Homo sapiens
tggcatcatccattctctct

SEQ ID NO: 5053136 - DNA, 21 bp, Homo sapiens
tggcatcatccattctctctg

SEQ ID NO: 5053137 - DNA, 14 bp, Homo sapiens
tggccagaggcagc

SEQ ID NO: 5053138 - DNA, 18 bp, Homo sapiens
tggccatggtaccccctt

SEQ ID NO: 5053139 - DNA, 16 bp, Homo sapiens
tggcctgttctgtagg

SEQ ID NO: 5053140 - DNA, 14 bp, Homo sapiens
tggctcccaaggga

SEQ ID NO: 5053141 - DNA, 14 bp, Homo sapiens
tggctgctgctcac

SEQ ID NO: 5053142 - DNA, 18 bp, Homo sapiens
tggctggagatggctgct

SEQ ID NO: 5053143 - DNA, 14 bp, Homo sapiens
tgggagaggcagaa

SEQ ID NO: 5053144 - DNA, 17 bp, Homo sapiens
tgggagaggcagaaagg

SEQ ID NO: 5053145 - DNA, 15 bp, Homo sapiens
tgggcaggtcctggg

SEQ ID NO: 5053146 - DNA, 16 bp, Homo sapiens
tgggcaggtcctgggg

SEQ ID NO: 5053147 - DNA, 15 bp, Homo sapiens
tgggcatctgttctg

SEQ ID NO: 5053148 - DNA, 19 bp, Homo sapiens
tgggcctgatggagaggag

SEQ ID NO: 5053149 - DNA, 14 bp, Homo sapiens
tgggctgggagaag

SEQ ID NO: 5053150 - DNA, 20 bp, Homo sapiens
tgggctgttggctgggggca

SEQ ID NO: 5053151 - DNA, 22 bp, Homo sapiens
tgggcttctgcggtgaggcagg

SEQ ID NO: 5053152 - DNA, 13 bp, Homo sapiens
tggggaggctgag

SEQ ID NO: 5053153 - DNA, 19 bp, Homo sapiens
tggggagtgagcttggtgc

SEQ ID NO: 5053154 - DNA, 15 bp, Homo sapiens
tgggggagcctggag

SEQ ID NO: 5053155 - DNA, 15 bp, Homo sapiens
tgggggaggctctga

SEQ ID NO: 5053156 - DNA, 23 bp, Homo sapiens
tgggggcaagaagatcacgctcc

SEQ ID NO: 5053157 - DNA, 23 bp, Homo sapiens
tggggtgggtttagcaggctgca

SEQ ID NO: 5053158 - DNA, 16 bp, Homo sapiens
tggtacccccttctgg

SEQ ID NO: 5053159 - DNA, 17 bp, Homo sapiens
tggtacccccttctggg

SEQ ID NO: 5053160 - DNA, 20 bp, Homo sapiens
tggtacccccttctgggcat

SEQ ID NO: 5053161 - DNA, 13 bp, Homo sapiens
tggtagctctgag

SEQ ID NO: 5053162 - DNA, 23 bp, Homo sapiens
tggtcattcatatcactatgaac

SEQ ID NO: 5053163 - DNA, 16 bp, Homo sapiens
tggtgaagtgtgactt

SEQ ID NO: 5053164 - DNA, 14 bp, Homo sapiens
tggtgcagccccag

SEQ ID NO: 5053165 - DNA, 17 bp, Homo sapiens
tggtgcagccccaggac

SEQ ID NO: 5053166 - DNA, 21 bp, Homo sapiens
tggtgcagccccaggaccaag

SEQ ID NO: 5053167 - DNA, 20 bp, Homo sapiens
tggtgcggtaggtgctggcc

SEQ ID NO: 5053168 - DNA, 15 bp, Homo sapiens
tgtaaaataaaggct

SEQ ID NO: 5053169 - DNA, 18 bp, Homo sapiens
tgtaaaataaaggctctg

SEQ ID NO: 5053170 - DNA, 20 bp, Homo sapiens
tgtacgtgggagaggcagaa

SEQ ID NO: 5053171 - DNA, 18 bp, Homo sapiens
tgtaggcgcccctggggt

SEQ ID NO: 5053172 - DNA, 14 bp, Homo sapiens
tgtcaactccagga

SEQ ID NO: 5053173 - DNA, 17 bp, Homo sapiens
tgtcactttctctctta

SEQ ID NO: 5053174 - DNA, 17 bp, Homo sapiens
tgtcagcatctttgccc

SEQ ID NO: 5053175 - DNA, 13 bp, Homo sapiens
tgtcatctgggcc

SEQ ID NO: 5053176 - DNA, 19 bp, Homo sapiens
tgtcatgtgaatccctcaa

SEQ ID NO: 5053177 - DNA, 21 bp, Homo sapiens
tgtcccaggggtctccctgag

SEQ ID NO: 5053178 - DNA, 13 bp, Homo sapiens
tgtcccctcagct

SEQ ID NO: 5053179 - DNA, 23 bp, Homo sapiens
tgtgacttcgaattagtttgcac

SEQ ID NO: 5053180 - DNA, 22 bp, Homo sapiens
tgtgcagtataattttctaatt

SEQ ID NO: 5053181 - DNA, 21 bp, Homo sapiens
tgtgcattttgtgtgatgcat

SEQ ID NO: 5053182 - DNA, 21 bp, Homo sapiens
tgtgctaacctcactgcctca

SEQ ID NO: 5053183 - DNA, 21 bp, Homo sapiens
tgtggtccctccactaggagt

SEQ ID NO: 5053184 - DNA, 12 bp, Homo sapiens
tgtgtgtgcaga

SEQ ID NO: 5053185 - DNA, 13 bp, Homo sapiens
tgttagctgctca

SEQ ID NO: 5053186 - DNA, 14 bp, Homo sapiens
tgttagctgctcac

SEQ ID NO: 5053187 - DNA, 16 bp, Homo sapiens
tgttcctcccaagagg

SEQ ID NO: 5053188 - DNA, 17 bp, Homo sapiens
tgttctcagctccccct

SEQ ID NO: 5053189 - DNA, 10 bp, Homo sapiens
tgttctgagc

SEQ ID NO: 5053190 - DNA, 22 bp, Homo sapiens
tgttgactgtaggcgcccctgg

SEQ ID NO: 5053191 - DNA, 16 bp, Homo sapiens
gccaactcgggagcat

SEQ ID NO: 5053192 - DNA, 13 bp, Homo sapiens
gccaagcctggag

SEQ ID NO: 5053193 - DNA, 17 bp, Homo sapiens
gccacaggcctccctgt

SEQ ID NO: 5053194 - DNA, 22 bp, Homo sapiens
gccacaggcctccctgtttgaa

SEQ ID NO: 5053195 - DNA, 17 bp, Homo sapiens
gccaccagctccactgg

SEQ ID NO: 5053196 - DNA, 20 bp, Homo sapiens
gccacctctctgcctgttcc

SEQ ID NO: 5053197 - DNA, 13 bp, Homo sapiens
gccacctgggctg

SEQ ID NO: 5053198 - DNA, 17 bp, Homo sapiens
gccacctgggctgggag

SEQ ID NO: 5053199 - DNA, 18 bp, Homo sapiens
gccacctgggctgggaga

SEQ ID NO: 5053200 - DNA, 20 bp, Homo sapiens
gccacgaggtggtagctctg

SEQ ID NO: 5053201 - DNA, 11 bp, Homo sapiens
gccagaggcag

SEQ ID NO: 5053202 - DNA, 22 bp, Homo sapiens
gccagctcctttcccttttcca

SEQ ID NO: 5053203 - DNA, 21 bp, Homo sapiens
gccaggggtggtgagggcagt

SEQ ID NO: 5053204 - DNA, 19 bp, Homo sapiens
gccagttacctttgctgtc

SEQ ID NO: 5053205 - DNA, 15 bp, Homo sapiens
gccataccaggtgct

SEQ ID NO: 5053206 - DNA, 17 bp, Homo sapiens
gccatctgaagccacct

SEQ ID NO: 5053207 - DNA, 17 bp, Homo sapiens
gccatggtacccccttc

SEQ ID NO: 5053208 - DNA, 20 bp, Homo sapiens
gccatggtacccccttctgg

SEQ ID NO: 5053209 - DNA, 21 bp, Homo sapiens
gccatggtacccccttctggg

SEQ ID NO: 5053210 - DNA, 18 bp, Homo sapiens
gcccaacaccagcccctg

SEQ ID NO: 5053211 - DNA, 22 bp, Homo sapiens
gcccaacaccagcccctgcccc

SEQ ID NO: 5053212 - DNA, 15 bp, Homo sapiens
gcccaagtccaaatg

SEQ ID NO: 5053213 - DNA, 16 bp, Homo sapiens
gcccaagtccaaatgt

SEQ ID NO: 5053214 - DNA, 23 bp, Homo sapiens
gcccaggattgtacgtgggagag

SEQ ID NO: 5053215 - DNA, 17 bp, Homo sapiens
gcccagtcccccaaccc

SEQ ID NO: 5053216 - DNA, 15 bp, Homo sapiens
gccccagcccaagtc

SEQ ID NO: 5053217 - DNA, 15 bp, Homo sapiens
gcccctgccccagcc

SEQ ID NO: 5053218 - DNA, 20 bp, Homo sapiens
gcccctgccccagcccaagt

SEQ ID NO: 5053219 - DNA, 15 bp, Homo sapiens
gcccctgcttctcca

SEQ ID NO: 5053220 - DNA, 20 bp, Homo sapiens
gcccctgcttctccagcctg

SEQ ID NO: 5053221 - DNA, 17 bp, Homo sapiens
gcccctgtgttgggggg

SEQ ID NO: 5053222 - DNA, 19 bp, Homo sapiens
gcccgttgccgggcctgga

SEQ ID NO: 5053223 - DNA, 20 bp, Homo sapiens
gcccgttgccgggcctggac

SEQ ID NO: 5053224 - DNA, 18 bp, Homo sapiens
gccctccttcttgccctg

SEQ ID NO: 5053225 - DNA, 20 bp, Homo sapiens
gccctgagctttccggggag

SEQ ID NO: 5053226 - DNA, 13 bp, Homo sapiens
gccctgcaggagg

SEQ ID NO: 5053227 - DNA, 17 bp, Homo sapiens
gccctgcaggaggcctg

SEQ ID NO: 5053228 - DNA, 14 bp, Homo sapiens
ctgtgtgggagggc

SEQ ID NO: 5053229 - DNA, 16 bp, Homo sapiens
ctgtgtgggagggcga

SEQ ID NO: 5053230 - DNA, 20 bp, Homo sapiens
ctgttagctgctcacttaaa

SEQ ID NO: 5053231 - DNA, 20 bp, Homo sapiens
ctgttcctcccaagaggcca

SEQ ID NO: 5053232 - DNA, 17 bp, Homo sapiens
ctgttctgtaggagaga

SEQ ID NO: 5053233 - DNA, 21 bp, Homo sapiens
ctgttgcaggtgtccgggggt

SEQ ID NO: 5053234 - DNA, 23 bp, Homo sapiens
ctgttggaaattgggtgtgccct

SEQ ID NO: 5053235 - DNA, 17 bp, Homo sapiens
cttaaacaatgtcctct

SEQ ID NO: 5053236 - DNA, 21 bp, Homo sapiens
cttaaacaatgtcctctttga

SEQ ID NO: 5053237 - DNA, 15 bp, Homo sapiens
cttaaggagaggaga

SEQ ID NO: 5053238 - DNA, 17 bp, Homo sapiens
cttaaggagaggagagc

SEQ ID NO: 5053239 - DNA, 18 bp, Homo sapiens
cttaaggagaggagagca

SEQ ID NO: 5053240 - DNA, 16 bp, Homo sapiens
cttaccttcacttaaa

SEQ ID NO: 5053241 - DNA, 15 bp, Homo sapiens
cttagcagggacagg

SEQ ID NO: 5053242 - DNA, 23 bp, Homo sapiens
cttataaattctgttagctgctc

SEQ ID NO: 5053243 - DNA, 23 bp, Homo sapiens
cttcaaaaagcaatctggaagaa

SEQ ID NO: 5053244 - DNA, 14 bp, Homo sapiens
cttcagccaagacc

SEQ ID NO: 5053245 - DNA, 22 bp, Homo sapiens
cttccaagcccttccctctgtt

SEQ ID NO: 5053246 - DNA, 13 bp, Homo sapiens
cttccgctcccac

SEQ ID NO: 5053247 - DNA, 17 bp, Homo sapiens
cttccgctcccaccagc

SEQ ID NO: 5053248 - DNA, 21 bp, Homo sapiens
cttctgggcatctgttctggt

SEQ ID NO: 5053249 - DNA, 14 bp, Homo sapiens
cttctgggcctgat

SEQ ID NO: 5053250 - DNA, 22 bp, Homo sapiens
cttctgggcctgatggagagga

SEQ ID NO: 5053251 - DNA, 23 bp, Homo sapiens
cttctgggcctgatggagaggag

SEQ ID NO: 5053252 - DNA, 12 bp, Homo sapiens
cttcttgccctg

SEQ ID NO: 5053253 - DNA, 14 bp, Homo sapiens
cttcttgccctgag

SEQ ID NO: 5053254 - DNA, 17 bp, Homo sapiens
cttcttgccctgagctt

SEQ ID NO: 5053255 - DNA, 21 bp, Homo sapiens
cttgagccagttacctttgct

SEQ ID NO: 5053256 - DNA, 22 bp, Homo sapiens
cttgagccagttacctttgctg

SEQ ID NO: 5053257 - DNA, 10 bp, Homo sapiens
cttgatcagt

SEQ ID NO: 5053258 - DNA, 23 bp, Homo sapiens
cttggtgcggtaggtgctggcct

SEQ ID NO: 5053259 - DNA, 14 bp, Homo sapiens
cttgttctttgctg

SEQ ID NO: 5053260 - DNA, 19 bp, Homo sapiens
ctttagggatctggggaag

SEQ ID NO: 5053261 - DNA, 22 bp, Homo sapiens
ctttagggatctggggaaggac

SEQ ID NO: 5053262 - DNA, 16 bp, Homo sapiens
ctttatccagcagtca

SEQ ID NO: 5053263 - DNA, 12 bp, Homo sapiens
ctttcctgatga

SEQ ID NO: 5053264 - DNA, 17 bp, Homo sapiens
ctttgcccttctggttt

SEQ ID NO: 5053265 - DNA, 18 bp, Homo sapiens
ctttgcccttctggttta

SEQ ID NO: 5053266 - DNA, 17 bp, Homo sapiens
ctttgcgtcaggagcag

SEQ ID NO: 5053267 - DNA, 22 bp, Homo sapiens
ctttgcgtcaggagcagcatca

SEQ ID NO: 5053268 - DNA, 13 bp, Homo sapiens
ctttgctgtcact

SEQ ID NO: 5053269 - DNA, 22 bp, Homo sapiens
ctttgctgtcactttctctctt

SEQ ID NO: 5053270 - DNA, 21 bp, Homo sapiens
ctttgtaccccccaacccctg

SEQ ID NO: 5053271 - DNA, 20 bp, Homo sapiens
ctttgttaaacttatttcaa

SEQ ID NO: 5053272 - DNA, 17 bp, Homo sapiens
ctttgttctcagctccc

SEQ ID NO: 5053273 - DNA, 18 bp, Homo sapiens
cttttacatttttctgat

SEQ ID NO: 5053274 - DNA, 16 bp, Homo sapiens
gaaaaattattcccat

SEQ ID NO: 5053275 - DNA, 19 bp, Homo sapiens
gaaattgggtgtgccctgg

SEQ ID NO: 5053276 - DNA, 23 bp, Homo sapiens
gaaattgggtgtgccctggctcc

SEQ ID NO: 5053277 - DNA, 19 bp, Homo sapiens
gaactcaaggtggctggag

SEQ ID NO: 5053278 - DNA, 13 bp, Homo sapiens
gaagaaagccctg

SEQ ID NO: 5053279 - DNA, 17 bp, Homo sapiens
gaagatcacgctccccg

SEQ ID NO: 5053280 - DNA, 15 bp, Homo sapiens
gaagcgtgagacgcc

SEQ ID NO: 5053281 - DNA, 20 bp, Homo sapiens
gaaggaactcaaggtggctg

SEQ ID NO: 5053282 - DNA, 21 bp, Homo sapiens
gaaggaactcaaggtggctgg

SEQ ID NO: 5053283 - DNA, 22 bp, Homo sapiens
gaaggaactcaaggtggctgga

SEQ ID NO: 5053284 - DNA, 20 bp, Homo sapiens
gaaggaccaacccatgccct

SEQ ID NO: 5053285 - DNA, 22 bp, Homo sapiens
gaaggaccaacccatgccctgc

SEQ ID NO: 5053286 - DNA, 15 bp, Homo sapiens
gaaggccttgctgtc

SEQ ID NO: 5053287 - DNA, 16 bp, Homo sapiens
gaaggccttgctgtca

SEQ ID NO: 5053288 - DNA, 18 bp, Homo sapiens
gaaggccttgctgtcatg

SEQ ID NO: 5053289 - DNA, 14 bp, Homo sapiens
gaataccccttctc

SEQ ID NO: 5053290 - DNA, 17 bp, Homo sapiens
gaataccccttctctgt

SEQ ID NO: 5053291 - DNA, 14 bp, Homo sapiens
gaatcaaggagcct

SEQ ID NO: 5053292 - DNA, 21 bp, Homo sapiens
gacactgtgcaaattttttga

SEQ ID NO: 5053293 - DNA, 19 bp, Homo sapiens
gaccaagcttaaggagagg

SEQ ID NO: 5053294 - DNA, 20 bp, Homo sapiens
gaccaggtgtctagaggcaa

SEQ ID NO: 5053295 - DNA, 23 bp, Homo sapiens
gaccccatctctgctgcttctgg

SEQ ID NO: 5053296 - DNA, 14 bp, Homo sapiens
gacgccaccattcc

SEQ ID NO: 5053297 - DNA, 17 bp, Homo sapiens
gacggatggaaggagag

SEQ ID NO: 5053298 - DNA, 13 bp, Homo sapiens
gactgcagaggag

SEQ ID NO: 5053299 - DNA, 16 bp, Homo sapiens
gactgcagaggagcca

SEQ ID NO: 5053300 - DNA, 23 bp, Homo sapiens
gactgcagaggagccacctgggc

SEQ ID NO: 5053301 - DNA, 13 bp, Homo sapiens
gactgtcttgact

SEQ ID NO: 5053302 - DNA, 16 bp, Homo sapiens
gactttagggatctgg

SEQ ID NO: 5053303 - DNA, 14 bp, Homo sapiens
gactttgtaccccc

SEQ ID NO: 5053304 - DNA, 22 bp, Homo sapiens
gagacggatggaaggagagagg

SEQ ID NO: 5053305 - DNA, 16 bp, Homo sapiens
gagactgcagaggagc

SEQ ID NO: 5053306 - DNA, 18 bp, Homo sapiens
gagactggccagaggcag

SEQ ID NO: 5053307 - DNA, 18 bp, Homo sapiens
gagagcatctgctctgag

SEQ ID NO: 5053308 - DNA, 15 bp, Homo sapiens
gagaggcagaaaggg

SEQ ID NO: 5053309 - DNA, 19 bp, Homo sapiens
gagaggttgaggatgcact

SEQ ID NO: 5053310 - DNA, 21 bp, Homo sapiens
gagaggttgaggatgcactgg

SEQ ID NO: 5053311 - DNA, 19 bp, Homo sapiens
gagatggctgctgctcacc

SEQ ID NO: 5053312 - DNA, 15 bp, Homo sapiens
gagcatctgctctga

SEQ ID NO: 5053313 - DNA, 17 bp, Homo sapiens
gagcatctgctctgaga

SEQ ID NO: 5053314 - DNA, 18 bp, Homo sapiens
gagcatgtgggggaaggc

SEQ ID NO: 5053315 - DNA, 16 bp, Homo sapiens
gagcattctgcctgcc

SEQ ID NO: 5053316 - DNA, 21 bp, Homo sapiens
gagccacctgggctgggagaa

SEQ ID NO: 5053317 - DNA, 18 bp, Homo sapiens
gagcccccacctgcctga

SEQ ID NO: 5053318 - DNA, 19 bp, Homo sapiens
gagcccctgtgtgggaggg

SEQ ID NO: 5053319 - DNA, 20 bp, Homo sapiens
gagcccctgtgtgggagggc

SEQ ID NO: 5053320 - DNA, 23 bp, Homo sapiens
gagccctccttcttgccctgagc

SEQ ID NO: 5053321 - DNA, 19 bp, Homo sapiens
gagcctccgttcccacctc

SEQ ID NO: 5053322 - DNA, 18 bp, Homo sapiens
gagcctcctgcccagtcc

SEQ ID NO: 5053323 - DNA, 10 bp, Homo sapiens
gagcctggag

SEQ ID NO: 5053324 - DNA, 11 bp, Homo sapiens
gagcctggagc

SEQ ID NO: 5053325 - DNA, 14 bp, Homo sapiens
gagcctggagcccc

SEQ ID NO: 5053326 - DNA, 15 bp, Homo sapiens
gagcctggagcccct

SEQ ID NO: 5053327 - DNA, 21 bp, Homo sapiens
gagcttggtgcggtaggtgct

SEQ ID NO: 5053328 - DNA, 15 bp, Homo sapiens
gagctttccggggag

SEQ ID NO: 5053329 - DNA, 21 bp, Homo sapiens
gaggaagatgggggcaagaag

SEQ ID NO: 5053330 - DNA, 20 bp, Homo sapiens
gaggagaacactagacatgc

SEQ ID NO: 5053331 - DNA, 22 bp, Homo sapiens
gaggagagcatctgctctgaga

SEQ ID NO: 5053332 - DNA, 16 bp, Homo sapiens
gaggagccacctgggc

SEQ ID NO: 5053333 - DNA, 20 bp, Homo sapiens
gaggagccacctgggctggg

SEQ ID NO: 5053334 - DNA, 22 bp, Homo sapiens
gaggagccacctgggctgggag

SEQ ID NO: 5053335 - DNA, 14 bp, Homo sapiens
gaggagccttggag

SEQ ID NO: 5053336 - DNA, 17 bp, Homo sapiens
gaggatgcactggcctg

SEQ ID NO: 5053337 - DNA, 18 bp, Homo sapiens
gaggatgcactggcctgt

SEQ ID NO: 5053338 - DNA, 21 bp, Homo sapiens
gaggcaacagtgttctgagcc

SEQ ID NO: 5053339 - DNA, 19 bp, Homo sapiens
gaggccccaaaggaaaaag

SEQ ID NO: 5053340 - DNA, 12 bp, Homo sapiens
gaggcctgggag

SEQ ID NO: 5053341 - DNA, 15 bp, Homo sapiens
gaggcgggggagcct

SEQ ID NO: 5053342 - DNA, 16 bp, Homo sapiens
gaggcgggggagcctg

SEQ ID NO: 5053343 - DNA, 18 bp, Homo sapiens
gaggcgggggagcctgga

SEQ ID NO: 5053344 - DNA, 22 bp, Homo sapiens
gaggcgggggatcctggagccc

SEQ ID NO: 5053345 - DNA, 14 bp, Homo sapiens
gaggctgagactgc

SEQ ID NO: 5053346 - DNA, 19 bp, Homo sapiens
gaggctgagactgcagagg

SEQ ID NO: 5053347 - DNA, 20 bp, Homo sapiens
gaggctgagactgcagagga

SEQ ID NO: 5053348 - DNA, 23 bp, Homo sapiens
gagggacttgagccagttacctt

SEQ ID NO: 5053349 - DNA, 16 bp, Homo sapiens
gagggcagttctgcac

SEQ ID NO: 5053350 - DNA, 23 bp, Homo sapiens
gagggcagttctgcacccagcca

SEQ ID NO: 5053351 - DNA, 14 bp, Homo sapiens
gaggggcccctgct

SEQ ID NO: 5053352 - DNA, 22 bp, Homo sapiens
gaggggttgccacaggcctccc

SEQ ID NO: 5053353 - DNA, 22 bp, Homo sapiens
gaggtggtagctctgagccctc

SEQ ID NO: 5053354 - DNA, 19 bp, Homo sapiens
gaggttgaggatgcactgg

SEQ ID NO: 5053355 - DNA, 20 bp, Homo sapiens
gagtaagaatgtgtgtgcag

SEQ ID NO: 5053356 - DNA, 22 bp, Homo sapiens
gagtacccccctgagagcatgt

SEQ ID NO: 5053357 - DNA, 14 bp, Homo sapiens
gagtctcccaaggc

SEQ ID NO: 5053358 - DNA, 18 bp, Homo sapiens
gagtctgcttgtcttaga

SEQ ID NO: 5053359 - DNA, 11 bp, Homo sapiens
gagtgctggct

SEQ ID NO: 5053360 - DNA, 22 bp, Homo sapiens
gagtgctggctccacgccctgg

SEQ ID NO: 5053361 - DNA, 16 bp, Homo sapiens
gatattcaagcctttg

SEQ ID NO: 5053362 - DNA, 19 bp, Homo sapiens
gatattcaagcctttggat

SEQ ID NO: 5053363 - DNA, 13 bp, Homo sapiens
gatcacgctcccc

SEQ ID NO: 5053364 - DNA, 16 bp, Homo sapiens
gatccctcctccagcc

SEQ ID NO: 5053365 - DNA, 14 bp, Homo sapiens
gatctggggaagga

SEQ ID NO: 5053366 - DNA, 18 bp, Homo sapiens
gatctggggaaggaccaa

SEQ ID NO: 5053367 - DNA, 22 bp, Homo sapiens
gatgaaaacaaaatcacagcac

SEQ ID NO: 5053368 - DNA, 13 bp, Homo sapiens
gatgcactggcct

SEQ ID NO: 5053369 - DNA, 14 bp, Homo sapiens
gatgcactggcctg

SEQ ID NO: 5053370 - DNA, 14 bp, Homo sapiens
gatggagaggagaa

SEQ ID NO: 5053371 - DNA, 14 bp, Homo sapiens
gatgggccaccgcc

SEQ ID NO: 5053372 - DNA, 22 bp, Homo sapiens
gattaaagattgctttatccag

SEQ ID NO: 5053373 - DNA, 17 bp, Homo sapiens
gattaaagtgccttcag

SEQ ID NO: 5053374 - DNA, 17 bp, Homo sapiens
gcaacagtgttctgagc

SEQ ID NO: 5053375 - DNA, 18 bp, Homo sapiens
gcaacagtgttctgagcc

SEQ ID NO: 5053376 - DNA, 19 bp, Homo sapiens
gcaaggtgggggagcctgg

SEQ ID NO: 5053377 - DNA, 20 bp, Homo sapiens
gcaaggtgggggagcctgga

SEQ ID NO: 5053378 - DNA, 16 bp, Homo sapiens
gcaatctggaagaaag

SEQ ID NO: 5053379 - DNA, 11 bp, Homo sapiens
gcacaagaagc

SEQ ID NO: 5053380 - DNA, 18 bp, Homo sapiens
gcacaaggtggcagcaag

SEQ ID NO: 5053381 - DNA, 23 bp, Homo sapiens
gcacatgctgagtctcccaaggc

SEQ ID NO: 5053382 - DNA, 17 bp, Homo sapiens
gcactaaccccagctgc

SEQ ID NO: 5053383 - DNA, 15 bp, Homo sapiens
gcagaaagggtaggt

SEQ ID NO: 5053384 - DNA, 17 bp, Homo sapiens
gcagaattctaggcagc

SEQ ID NO: 5053385 - DNA, 14 bp, Homo sapiens
gcagcaagcaattc

SEQ ID NO: 5053386 - DNA, 13 bp, Homo sapiens
gcagcaggcagag

SEQ ID NO: 5053387 - DNA, 13 bp, Homo sapiens
gcagccccaggac

SEQ ID NO: 5053388 - DNA, 15 bp, Homo sapiens
gcagccccaggacca

SEQ ID NO: 5053389 - DNA, 17 bp, Homo sapiens
gcagctaaggggcagga

SEQ ID NO: 5053390 - DNA, 21 bp, Homo sapiens
gcaggaaggaactcaaggtgg

SEQ ID NO: 5053391 - DNA, 13 bp, Homo sapiens
gcaggaggcctgg

SEQ ID NO: 5053392 - DNA, 12 bp, Homo sapiens
gcaggggagtct

SEQ ID NO: 5053393 - DNA, 15 bp, Homo sapiens
gcaggggagtctgct

SEQ ID NO: 5053394 - DNA, 21 bp, Homo sapiens
gcatcatccattctctctgcc

SEQ ID NO: 5053395 - DNA, 15 bp, Homo sapiens
gcatctgctctgaga

SEQ ID NO: 5053396 - DNA, 19 bp, Homo sapiens
gcatgggggaggctctgaa

SEQ ID NO: 5053397 - DNA, 12 bp, Homo sapiens
gcatgtggggga

SEQ ID NO: 5053398 - DNA, 14 bp, Homo sapiens
gcatgtgggggaag

SEQ ID NO: 5053399 - DNA, 23 bp, Homo sapiens
ctgaggaagatgggggcaagaag

SEQ ID NO: 5053400 - DNA, 13 bp, Homo sapiens
ctgaggactctgg

SEQ ID NO: 5053401 - DNA, 20 bp, Homo sapiens
ctgaggactctggaccccag

SEQ ID NO: 5053402 - DNA, 16 bp, Homo sapiens
ctgagtctcccaaggc

SEQ ID NO: 5053403 - DNA, 15 bp, Homo sapiens
ctgatatttgctgga

SEQ ID NO: 5053404 - DNA, 17 bp, Homo sapiens
ctgatatttgctggagt

SEQ ID NO: 5053405 - DNA, 16 bp, Homo sapiens
ctgatggagaggagaa

SEQ ID NO: 5053406 - DNA, 16 bp, Homo sapiens
ctgattgggtcagctg

SEQ ID NO: 5053407 - DNA, 12 bp, Homo sapiens
ctgcagaggagc

SEQ ID NO: 5053408 - DNA, 20 bp, Homo sapiens
ctgcagaggagccacctggg

SEQ ID NO: 5053409 - DNA, 23 bp, Homo sapiens
ctgcagaggagccacctgggctg

SEQ ID NO: 5053410 - DNA, 13 bp, Homo sapiens
ctgcagcaggcag

SEQ ID NO: 5053411 - DNA, 15 bp, Homo sapiens
ctgcagcaggcagag

SEQ ID NO: 5053412 - DNA, 19 bp, Homo sapiens
ctgcagcaggcagaggaga

SEQ ID NO: 5053413 - DNA, 18 bp, Homo sapiens
ctgcaggaggcctgggag

SEQ ID NO: 5053414 - DNA, 13 bp, Homo sapiens
ctgccactgggac

SEQ ID NO: 5053415 - DNA, 23 bp, Homo sapiens
ctgccactgggacggctcctgct

SEQ ID NO: 5053416 - DNA, 20 bp, Homo sapiens
ctgcccaagttgctctgtat

SEQ ID NO: 5053417 - DNA, 17 bp, Homo sapiens
ctgccccagctgggctg

SEQ ID NO: 5053418 - DNA, 16 bp, Homo sapiens
ctgcccgttgccgggc

SEQ ID NO: 5053419 - DNA, 17 bp, Homo sapiens
ctgcccgttgccgggcc

SEQ ID NO: 5053420 - DNA, 19 bp, Homo sapiens
ctgcccgttgccgggcctg

SEQ ID NO: 5053421 - DNA, 21 bp, Homo sapiens
ctgcccgttgccgggcctgga

SEQ ID NO: 5053422 - DNA, 13 bp, Homo sapiens
ctgccggcagtgc

SEQ ID NO: 5053423 - DNA, 17 bp, Homo sapiens
ctgccggcagtgctggt

SEQ ID NO: 5053424 - DNA, 20 bp, Homo sapiens
ctgcctgggaacggggtgga

SEQ ID NO: 5053425 - DNA, 19 bp, Homo sapiens
ctgcctgttcctcccaaga

SEQ ID NO: 5053426 - DNA, 16 bp, Homo sapiens
ctgccttaccttcact

SEQ ID NO: 5053427 - DNA, 16 bp, Homo sapiens
ctgcggtgaggcaggg

SEQ ID NO: 5053428 - DNA, 15 bp, Homo sapiens
ctgcgtctggagggg

SEQ ID NO: 5053429 - DNA, 21 bp, Homo sapiens
ctgctcaccctcctagcctgc

SEQ ID NO: 5053430 - DNA, 21 bp, Homo sapiens
ctgctctccttgccctgggcc

SEQ ID NO: 5053431 - DNA, 11 bp, Homo sapiens
ctgctgctcac

SEQ ID NO: 5053432 - DNA, 12 bp, Homo sapiens
ctgctgctcacc

SEQ ID NO: 5053433 - DNA, 15 bp, Homo sapiens
ctgctgcttctgggc

SEQ ID NO: 5053434 - DNA, 20 bp, Homo sapiens
ctgctgcttctgggcctgat

SEQ ID NO: 5053435 - DNA, 15 bp, Homo sapiens
ctgcttctccagcct

SEQ ID NO: 5053436 - DNA, 14 bp, Homo sapiens
ctgcttctgggcct

SEQ ID NO: 5053437 - DNA, 15 bp, Homo sapiens
ctgcttctgggcctg

SEQ ID NO: 5053438 - DNA, 16 bp, Homo sapiens
ctggaagaaagccctg

SEQ ID NO: 5053439 - DNA, 12 bp, Homo sapiens
ctggactgtcct

SEQ ID NO: 5053440 - DNA, 13 bp, Homo sapiens
ctggactgtccta

SEQ ID NO: 5053441 - DNA, 18 bp, Homo sapiens
ctggactgtcctaggtga

SEQ ID NO: 5053442 - DNA, 15 bp, Homo sapiens
ctggagatggctgct

SEQ ID NO: 5053443 - DNA, 16 bp, Homo sapiens
ctggagatggctgctg

SEQ ID NO: 5053444 - DNA, 19 bp, Homo sapiens
ctggagatggctgctgctc

SEQ ID NO: 5053445 - DNA, 20 bp, Homo sapiens
ctggagatggctgctgctca

SEQ ID NO: 5053446 - DNA, 16 bp, Homo sapiens
ctggaggggcccctgc

SEQ ID NO: 5053447 - DNA, 23 bp, Homo sapiens
ctggaggggcccctgcttctcca

SEQ ID NO: 5053448 - DNA, 22 bp, Homo sapiens
ctggagtgctggctccacgccc

SEQ ID NO: 5053449 - DNA, 12 bp, Homo sapiens
ctggccagaggc

SEQ ID NO: 5053450 - DNA, 15 bp, Homo sapiens
ctggccagaggcagc

SEQ ID NO: 5053451 - DNA, 22 bp, Homo sapiens
ctggcctgttctgtaggagaga

SEQ ID NO: 5053452 - DNA, 16 bp, Homo sapiens
ctggcgggatgggcca

SEQ ID NO: 5053453 - DNA, 20 bp, Homo sapiens
ctggcgggatgggccaccgc

SEQ ID NO: 5053454 - DNA, 21 bp, Homo sapiens
ctggctccacgccctggggag

SEQ ID NO: 5053455 - DNA, 20 bp, Homo sapiens
ctggctgggttttcaggggc

SEQ ID NO: 5053456 - DNA, 15 bp, Homo sapiens
ctgggacggctcctg

SEQ ID NO: 5053457 - DNA, 15 bp, Homo sapiens
ctgggagaaggtgct

SEQ ID NO: 5053458 - DNA, 14 bp, Homo sapiens
ctgggagggcaagg

SEQ ID NO: 5053459 - DNA, 18 bp, Homo sapiens
ctgggcaggtcctgggga

SEQ ID NO: 5053460 - DNA, 19 bp, Homo sapiens
ctgggcaggtcctggggag

SEQ ID NO: 5053461 - DNA, 18 bp, Homo sapiens
ctgggcatctgttctggt

SEQ ID NO: 5053462 - DNA, 15 bp, Homo sapiens
ctgggccagcccagg

SEQ ID NO: 5053463 - DNA, 16 bp, Homo sapiens
aaattgacagctttct

SEQ ID NO: 5053464 - DNA, 24 bp, Homo sapiens
aacaaaatcacagcacccactacc

SEQ ID NO: 5053465 - DNA, 15 bp, Homo sapiens
aacaataaaaaccaa

SEQ ID NO: 5053466 - DNA, 13 bp, Homo sapiens
aacaccagcccct

SEQ ID NO: 5053467 - DNA, 22 bp, Homo sapiens
aacaccagcccctgccccagcc

SEQ ID NO: 5053468 - DNA, 15 bp, Homo sapiens
aaccaaactctgtgt

SEQ ID NO: 5053469 - DNA, 18 bp, Homo sapiens
aaccaaactctgtgtcag

SEQ ID NO: 5053470 - DNA, 21 bp, Homo sapiens
aaccacacacacaaggtgctc

SEQ ID NO: 5053471 - DNA, 14 bp, Homo sapiens
aaccattgtcttgt

SEQ ID NO: 5053472 - DNA, 19 bp, Homo sapiens
aaccattgtcttgttctgt

SEQ ID NO: 5053473 - DNA, 22 bp, Homo sapiens
aacccatgccctgccaagcctg

SEQ ID NO: 5053474 - DNA, 15 bp, Homo sapiens
aaccccagctgccgg

SEQ ID NO: 5053475 - DNA, 23 bp, Homo sapiens
aaccccagctgccggcagtgctg

SEQ ID NO: 5053476 - DNA, 14 bp, Homo sapiens
aactcatattttga

SEQ ID NO: 5053477 - DNA, 15 bp, Homo sapiens
aacttggatattcaa

SEQ ID NO: 5053478 - DNA, 17 bp, Homo sapiens
aagaaagccctgtgctt

SEQ ID NO: 5053479 - DNA, 18 bp, Homo sapiens
aagaaagccctgtgcttt

SEQ ID NO: 5053480 - DNA, 21 bp, Homo sapiens
aagaagatcacgctccccgcc

SEQ ID NO: 5053481 - DNA, 20 bp, Homo sapiens
aagaccatctctccctcctg

SEQ ID NO: 5053482 - DNA, 17 bp, Homo sapiens
aagatcacgctccccgc

SEQ ID NO: 5053483 - DNA, 17 bp, Homo sapiens
aagatgggggcaagaag

SEQ ID NO: 5053484 - DNA, 20 bp, Homo sapiens
aagcaattctgccccacacc

SEQ ID NO: 5053485 - DNA, 17 bp, Homo sapiens
aagccacctctctgcct

SEQ ID NO: 5053486 - DNA, 21 bp, Homo sapiens
aagccacctctctgcctgttc

SEQ ID NO: 5053487 - DNA, 14 bp, Homo sapiens
aagcttaaggagag

SEQ ID NO: 5053488 - DNA, 21 bp, Homo sapiens
aaggaaaaagcacaagaagcg

SEQ ID NO: 5053489 - DNA, 13 bp, Homo sapiens
aaggccttgctgt

SEQ ID NO: 5053490 - DNA, 18 bp, Homo sapiens
aaggtgggggagcctgga

SEQ ID NO: 5053491 - DNA, 15 bp, Homo sapiens
aataaaggctctgtg

SEQ ID NO: 5053492 - DNA, 11 bp, Homo sapiens
aatcatattct

SEQ ID NO: 5053493 - DNA, 13 bp, Homo sapiens
aatcatattctca

SEQ ID NO: 5053494 - DNA, 21 bp, Homo sapiens
aatcccaaagtgccttctgag

SEQ ID NO: 5053495 - DNA, 22 bp, Homo sapiens
aatcccaaagtgccttctgagc

SEQ ID NO: 5053496 - DNA, 19 bp, Homo sapiens
aatcccacttagcagggac

SEQ ID NO: 5053497 - DNA, 21 bp, Homo sapiens
aatcccacttagcagggacag

SEQ ID NO: 5053498 - DNA, 22 bp, Homo sapiens
aatctggaagaaagccctgtgc

SEQ ID NO: 5053499 - DNA, 17 bp, Homo sapiens
aattctgccccacaccc

SEQ ID NO: 5053500 - DNA, 14 bp, Homo sapiens
aattcttgcttgag

SEQ ID NO: 5053501 - DNA, 17 bp, Homo sapiens
aattgggtgtgccctgg

SEQ ID NO: 5053502 - DNA, 18 bp, Homo sapiens
aattgggtgtgccctggc

SEQ ID NO: 5053503 - DNA, 22 bp, Homo sapiens
aattgggtgtgccctggctccc

SEQ ID NO: 5053504 - DNA, 15 bp, Homo sapiens
aatttattttctcaa

SEQ ID NO: 5053505 - DNA, 22 bp, Homo sapiens
aatttattttctcaatctttta

SEQ ID NO: 5053506 - DNA, 20 bp, Homo sapiens
acaaaattgacagctttcta

SEQ ID NO: 5053507 - DNA, 15 bp, Homo sapiens
acaaggtgctcagac

SEQ ID NO: 5053508 - DNA, 14 bp, Homo sapiens
acaataaaaaccaa

SEQ ID NO: 5053509 - DNA, 13 bp, Homo sapiens
acaattctgatga

SEQ ID NO: 5053510 - DNA, 14 bp, Homo sapiens
acacaaggtgctca

SEQ ID NO: 5053511 - DNA, 20 bp, Homo sapiens
acacaagtttacttgtcttt

SEQ ID NO: 5053512 - DNA, 17 bp, Homo sapiens
acacacaaggtgctcag

SEQ ID NO: 5053513 - DNA, 13 bp, Homo sapiens
acacacacctgtc

SEQ ID NO: 5053514 - DNA, 13 bp, Homo sapiens
acaccagcccctg

SEQ ID NO: 5053515 - DNA, 21 bp, Homo sapiens
acaccagcccctgccccagcc

SEQ ID NO: 5053516 - DNA, 23 bp, Homo sapiens
acacccagccagctcctttccct

SEQ ID NO: 5053517 - DNA, 22 bp, Homo sapiens
acacctctgggccctgcaggag

SEQ ID NO: 5053518 - DNA, 15 bp, Homo sapiens
acaggcatagagtga

SEQ ID NO: 5053519 - DNA, 11 bp, Homo sapiens
acaggcctccc

SEQ ID NO: 5053520 - DNA, 13 bp, Homo sapiens
acaggcctccctg

SEQ ID NO: 5053521 - DNA, 16 bp, Homo sapiens
acaggcctccctgttt

SEQ ID NO: 5053522 - DNA, 15 bp, Homo sapiens
acagggagcctcctg

SEQ ID NO: 5053523 - DNA, 22 bp, Homo sapiens
acaggtgtcaccatcatttcta

SEQ ID NO: 5053524 - DNA, 16 bp, Homo sapiens
acatgaaatgtacatg

SEQ ID NO: 5053525 - DNA, 13 bp, Homo sapiens
acatgagtgtcaa

SEQ ID NO: 5053526 - DNA, 14 bp, Homo sapiens
acatgctgagtctc

SEQ ID NO: 5053527 - DNA, 16 bp, Homo sapiens
acatgtgtaagacact

SEQ ID NO: 5053528 - DNA, 15 bp, Homo sapiens
acatttttctgatgg

SEQ ID NO: 5053529 - DNA, 11 bp, Homo sapiens
accagcccctg

SEQ ID NO: 5053530 - DNA, 16 bp, Homo sapiens
accagcccctgcccca

SEQ ID NO: 5053531 - DNA, 14 bp, Homo sapiens
accagctccactgg

SEQ ID NO: 5053532 - DNA, 21 bp, Homo sapiens
accaggtgctagggtgcctgc

SEQ ID NO: 5053533 - DNA, 16 bp, Homo sapiens
accatacagacagcac

SEQ ID NO: 5053534 - DNA, 18 bp, Homo sapiens
accatcaagggtcatggc

SEQ ID NO: 5053535 - DNA, 21 bp, Homo sapiens
accatctctccctcctggtga

SEQ ID NO: 5053536 - DNA, 17 bp, Homo sapiens
accattgtcttgttctg

SEQ ID NO: 5053537 - DNA, 15 bp, Homo sapiens
acccagccagctcct

SEQ ID NO: 5053538 - DNA, 14 bp, Homo sapiens
accccagctgccgg

SEQ ID NO: 5053539 - DNA, 19 bp, Homo sapiens
accccccaacccctgagga

SEQ ID NO: 5053540 - DNA, 13 bp, Homo sapiens
acccccttctggg

SEQ ID NO: 5053541 - DNA, 19 bp, Homo sapiens
acccctgaggaagatgggg

SEQ ID NO: 5053542 - DNA, 19 bp, Homo sapiens
accctacacctctgggccc

SEQ ID NO: 5053543 - DNA, 21 bp, Homo sapiens
accctacacctctgggccctg

SEQ ID NO: 5053544 - DNA, 22 bp, Homo sapiens
accctcctagcctgctctgcca

SEQ ID NO: 5053545 - DNA, 18 bp, Homo sapiens
accgccgactttgtaccc

SEQ ID NO: 5053546 - DNA, 21 bp, Homo sapiens
accgccgactttgtacccccc

SEQ ID NO: 5053547 - DNA, 15 bp, Homo sapiens
acctcactgcctcat

SEQ ID NO: 5053548 - DNA, 19 bp, Homo sapiens
acctctgggccctgcagga

SEQ ID NO: 5053549 - DNA, 23 bp, Homo sapiens
acctctgggccctgcaggaggcc

SEQ ID NO: 5053550 - DNA, 15 bp, Homo sapiens
acctgtcatctgggc

SEQ ID NO: 5053551 - DNA, 18 bp, Homo sapiens
acctgtcatctgggccac

SEQ ID NO: 5053552 - DNA, 14 bp, Homo sapiens
accttttaatcaga

SEQ ID NO: 5053553 - DNA, 22 bp, Homo sapiens
acgaggtggtagctctgagccc

SEQ ID NO: 5053554 - DNA, 13 bp, Homo sapiens
acgccaccattcc

SEQ ID NO: 5053555 - DNA, 18 bp, Homo sapiens
acgccaccattcctggaa

SEQ ID NO: 5053556 - DNA, 22 bp, Homo sapiens
acgccctggggagtgagcttgg

SEQ ID NO: 5053557 - DNA, 18 bp, Homo sapiens
acgctccccgcctgttcc

SEQ ID NO: 5053558 - DNA, 15 bp, Homo sapiens
acggggtggacgagg

SEQ ID NO: 5053559 - DNA, 14 bp, Homo sapiens
acgtgggagaggca

SEQ ID NO: 5053560 - DNA, 20 bp, Homo sapiens
gaggcgggggagcctggagc

SEQ ID NO: 5053561 - DNA, 17 bp, Homo sapiens
gaggcgggggatcctgg

SEQ ID NO: 5053562 - DNA, 11 bp, Homo sapiens
gaggctctgaa

SEQ ID NO: 5053563 - DNA, 14 bp, Homo sapiens
gaggctctgaagag

SEQ ID NO: 5053564 - DNA, 19 bp, Homo sapiens
gagggaccaggtgtctaga

SEQ ID NO: 5053565 - DNA, 23 bp, Homo sapiens
gagggaccaggtgtctagaggca

SEQ ID NO: 5053566 - DNA, 20 bp, Homo sapiens
gagggacttgagccagttac

SEQ ID NO: 5053567 - DNA, 13 bp, Homo sapiens
gaggggaggtggc

SEQ ID NO: 5053568 - DNA, 23 bp, Homo sapiens
gaggggttgccacaggcctccct

SEQ ID NO: 5053569 - DNA, 18 bp, Homo sapiens
gaggtggtagctctgagc

SEQ ID NO: 5053570 - DNA, 21 bp, Homo sapiens
gaggtggtagctctgagccct

SEQ ID NO: 5053571 - DNA, 21 bp, Homo sapiens
gagtaagaatgtgtgtgcaga

SEQ ID NO: 5053572 - DNA, 16 bp, Homo sapiens
gagtacccccctgaga

SEQ ID NO: 5053573 - DNA, 13 bp, Homo sapiens
gagtctcccaagg

SEQ ID NO: 5053574 - DNA, 20 bp, Homo sapiens
gagtgaccttttaatcagag

SEQ ID NO: 5053575 - DNA, 23 bp, Homo sapiens
gagtgctggctccacgccctggg

SEQ ID NO: 5053576 - DNA, 20 bp, Homo sapiens
gagtgtcaactccaggactt

SEQ ID NO: 5053577 - DNA, 21 bp, Homo sapiens
gatatttgctggagtgctggc

SEQ ID NO: 5053578 - DNA, 14 bp, Homo sapiens
gatcacgctccccg

SEQ ID NO: 5053579 - DNA, 16 bp, Homo sapiens
gatcagtgtgctaacc

SEQ ID NO: 5053580 - DNA, 22 bp, Homo sapiens
gatcagtgtgctaacctcactg

SEQ ID NO: 5053581 - DNA, 19 bp, Homo sapiens
gatcctggagcccctgtgt

SEQ ID NO: 5053582 - DNA, 16 bp, Homo sapiens
gatcttgttctttgct

SEQ ID NO: 5053583 - DNA, 20 bp, Homo sapiens
gatgctggtaatggccatgg

SEQ ID NO: 5053584 - DNA, 22 bp, Homo sapiens
gatgctttgcccaggcttctca

SEQ ID NO: 5053585 - DNA, 14 bp, Homo sapiens
gatggaaggagaga

SEQ ID NO: 5053586 - DNA, 17 bp, Homo sapiens
gatggctgctgctcacc

SEQ ID NO: 5053587 - DNA, 15 bp, Homo sapiens
gatgggccaccgccg

SEQ ID NO: 5053588 - DNA, 14 bp, Homo sapiens
gattaaagtgcctt

SEQ ID NO: 5053589 - DNA, 18 bp, Homo sapiens
gattgctttatccagcag

SEQ ID NO: 5053590 - DNA, 21 bp, Homo sapiens
gattgctttatccagcagtca

SEQ ID NO: 5053591 - DNA, 17 bp, Homo sapiens
gcaaacttataaatcat

SEQ ID NO: 5053592 - DNA, 18 bp, Homo sapiens
gcaaatgccttttcaaat

SEQ ID NO: 5053593 - DNA, 14 bp, Homo sapiens
gcaagcaattctgc

SEQ ID NO: 5053594 - DNA, 23 bp, Homo sapiens
gcaagggtcctacggagggacca

SEQ ID NO: 5053595 - DNA, 18 bp, Homo sapiens
gcaaggtgggggagcctg

SEQ ID NO: 5053596 - DNA, 23 bp, Homo sapiens
gcaaggtgggggagcctggagcc

SEQ ID NO: 5053597 - DNA, 18 bp, Homo sapiens
gcacaatctacactgcct

SEQ ID NO: 5053598 - DNA, 13 bp, Homo sapiens
gcacccagccaaa

SEQ ID NO: 5053599 - DNA, 23 bp, Homo sapiens
gcactaaccccagctgccggcag

SEQ ID NO: 5053600 - DNA, 17 bp, Homo sapiens
gcacttcctgttggaag

SEQ ID NO: 5053601 - DNA, 17 bp, Homo sapiens
gcagaggagccacctgg

SEQ ID NO: 5053602 - DNA, 13 bp, Homo sapiens
gcagatgctttgc

SEQ ID NO: 5053603 - DNA, 15 bp, Homo sapiens
gcagatgctttgccc

SEQ ID NO: 5053604 - DNA, 16 bp, Homo sapiens
gcagattgaagcattt

SEQ ID NO: 5053605 - DNA, 15 bp, Homo sapiens
gcagcaggcagagga

SEQ ID NO: 5053606 - DNA, 16 bp, Homo sapiens
gcagcaggcagaggag

SEQ ID NO: 5053607 - DNA, 17 bp, Homo sapiens
gcagcaggcagaggaga

SEQ ID NO: 5053608 - DNA, 14 bp, Homo sapiens
gcagccccaggacc

SEQ ID NO: 5053609 - DNA, 17 bp, Homo sapiens
gcaggaatcaaggagcc

SEQ ID NO: 5053610 - DNA, 12 bp, Homo sapiens
gcaggaggcctg

SEQ ID NO: 5053611 - DNA, 15 bp, Homo sapiens
gcaggaggcctggga

SEQ ID NO: 5053612 - DNA, 18 bp, Homo sapiens
gcaggctgcagcaggcag

SEQ ID NO: 5053613 - DNA, 20 bp, Homo sapiens
gcaggctgcagcaggcagag

SEQ ID NO: 5053614 - DNA, 13 bp, Homo sapiens
gcaggggagtctg

SEQ ID NO: 5053615 - DNA, 12 bp, Homo sapiens
gcaggtcctggg

SEQ ID NO: 5053616 - DNA, 16 bp, Homo sapiens
gcaggtcctggggagg

SEQ ID NO: 5053617 - DNA, 18 bp, Homo sapiens
gcaggtcctggggaggct

SEQ ID NO: 5053618 - DNA, 16 bp, Homo sapiens
gcagtataattttcta

SEQ ID NO: 5053619 - DNA, 13 bp, Homo sapiens
gcagttctgcacc

SEQ ID NO: 5053620 - DNA, 17 bp, Homo sapiens
gcatctttgcccttctg

SEQ ID NO: 5053621 - DNA, 16 bp, Homo sapiens
gcatgggggaggctct

SEQ ID NO: 5053622 - DNA, 17 bp, Homo sapiens
gcattctgcctgcctgg

SEQ ID NO: 5053623 - DNA, 19 bp, Homo sapiens
gcattctgcctgcctggga

SEQ ID NO: 5053624 - DNA, 11 bp, Homo sapiens
gccaagaccat

SEQ ID NO: 5053625 - DNA, 22 bp, Homo sapiens
gccaagagccatctgaagccac

SEQ ID NO: 5053626 - DNA, 16 bp, Homo sapiens
gccaagatgatccttc

SEQ ID NO: 5053627 - DNA, 14 bp, Homo sapiens
gccaagcctggagc

SEQ ID NO: 5053628 - DNA, 18 bp, Homo sapiens
gccaagcctggagcccct

SEQ ID NO: 5053629 - DNA, 14 bp, Homo sapiens
gccacaggcctccc

SEQ ID NO: 5053630 - DNA, 16 bp, Homo sapiens
gccacaggcctccctg

SEQ ID NO: 5053631 - DNA, 21 bp, Homo sapiens
gccacaggcctccctgtttga

SEQ ID NO: 5053632 - DNA, 16 bp, Homo sapiens
gccaccagctccactg

SEQ ID NO: 5053633 - DNA, 20 bp, Homo sapiens
gccaccagctccactggcct

SEQ ID NO: 5053634 - DNA, 22 bp, Homo sapiens
gccaccgccgactttgtacccc

SEQ ID NO: 5053635 - DNA, 22 bp, Homo sapiens
gccactgggacggctcctgctt

SEQ ID NO: 5053636 - DNA, 19 bp, Homo sapiens
gccatggtacccccttctg

SEQ ID NO: 5053637 - DNA, 13 bp, Homo sapiens
gcccaacaccagc

SEQ ID NO: 5053638 - DNA, 17 bp, Homo sapiens
gcccaacaccagcccct

SEQ ID NO: 5053639 - DNA, 14 bp, Homo sapiens
gcccaagttgctct

SEQ ID NO: 5053640 - DNA, 15 bp, Homo sapiens
gcccaagttgctctg

SEQ ID NO: 5053641 - DNA, 16 bp, Homo sapiens
gcccaagttgctctgt

SEQ ID NO: 5053642 - DNA, 15 bp, Homo sapiens
gcccacatccagtgg

SEQ ID NO: 5053643 - DNA, 19 bp, Homo sapiens
gcccaggattgtacgtggg

SEQ ID NO: 5053644 - DNA, 21 bp, Homo sapiens
gcccaggattgtacgtgggag

SEQ ID NO: 5053645 - DNA, 14 bp, Homo sapiens
gcccaggcttctca

SEQ ID NO: 5053646 - DNA, 15 bp, Homo sapiens
gcccagtcccccaac

SEQ ID NO: 5053647 - DNA, 14 bp, Homo sapiens
gccccaaaggaaaa

SEQ ID NO: 5053648 - DNA, 15 bp, Homo sapiens
gccccacacccagcc

SEQ ID NO: 5053649 - DNA, 18 bp, Homo sapiens
gccccacacccagccagc

SEQ ID NO: 5053650 - DNA, 14 bp, Homo sapiens
gccccagcccaagt

SEQ ID NO: 5053651 - DNA, 15 bp, Homo sapiens
gccccagctgggctg

SEQ ID NO: 5053652 - DNA, 22 bp, Homo sapiens
gccccgaggcctagagtggcag

SEQ ID NO: 5053653 - DNA, 19 bp, Homo sapiens
gcccctgcttctccagcct

SEQ ID NO: 5053654 - DNA, 17 bp, Homo sapiens
gccctccttcttgccct

SEQ ID NO: 5053655 - DNA, 20 bp, Homo sapiens
gccctccttcttgccctgag

SEQ ID NO: 5053656 - DNA, 21 bp, Homo sapiens
gccctccttcttgccctgagc

SEQ ID NO: 5053657 - DNA, 22 bp, Homo sapiens
gccctccttcttgccctgagct

SEQ ID NO: 5053658 - DNA, 21 bp, Homo sapiens
gccctgagctttccggggagg

SEQ ID NO: 5053659 - DNA, 18 bp, Homo sapiens
gccctgcaggaggcctgg

SEQ ID NO: 5053660 - DNA, 21 bp, Homo sapiens
gccctgccaagcctggagccc

SEQ ID NO: 5053661 - DNA, 21 bp, Homo sapiens
gccctggctcccaagggaggc

SEQ ID NO: 5053662 - DNA, 12 bp, Homo sapiens
gcccttccctct

SEQ ID NO: 5053663 - DNA, 13 bp, Homo sapiens
gcccttgtctgag

SEQ ID NO: 5053664 - DNA, 16 bp, Homo sapiens
gccgctcggaggcccc

SEQ ID NO: 5053665 - DNA, 17 bp, Homo sapiens
gccgctcggaggcccca

SEQ ID NO: 5053666 - DNA, 13 bp, Homo sapiens
gccggcagtgctg

SEQ ID NO: 5053667 - DNA, 12 bp, Homo sapiens
gccgggcctgga

SEQ ID NO: 5053668 - DNA, 13 bp, Homo sapiens
gccgggcctggac

SEQ ID NO: 5053669 - DNA, 12 bp, Homo sapiens
gcctcctgccca

SEQ ID NO: 5053670 - DNA, 15 bp, Homo sapiens
gcctgatggagagga

SEQ ID NO: 5053671 - DNA, 19 bp, Homo sapiens
gcctgccccagctgggctg

SEQ ID NO: 5053672 - DNA, 14 bp, Homo sapiens
gcctgcctgggaac

SEQ ID NO: 5053673 - DNA, 18 bp, Homo sapiens
gcctgctctccttgccct

SEQ ID NO: 5053674 - DNA, 21 bp, Homo sapiens
gcctgctctccttgccctggg

SEQ ID NO: 5053675 - DNA, 16 bp, Homo sapiens
gcctgctctgccactg

SEQ ID NO: 5053676 - DNA, 13 bp, Homo sapiens
gcctggagcccct

SEQ ID NO: 5053677 - DNA, 14 bp, Homo sapiens
gcctggagcccctg

SEQ ID NO: 5053678 - DNA, 22 bp, Homo sapiens
gcctggcgggatgggccaccgc

SEQ ID NO: 5053679 - DNA, 14 bp, Homo sapiens
gcctgttcccccgc

SEQ ID NO: 5053680 - DNA, 19 bp, Homo sapiens
gcctgttctgtaggagaga

SEQ ID NO: 5053681 - DNA, 22 bp, Homo sapiens
gcctgttctgtaggagagactg

SEQ ID NO: 5053682 - DNA, 12 bp, Homo sapiens
ctgggcctgatg

SEQ ID NO: 5053683 - DNA, 18 bp, Homo sapiens
ctgggcctgatggagagg

SEQ ID NO: 5053684 - DNA, 11 bp, Homo sapiens
ctggggaagga

SEQ ID NO: 5053685 - DNA, 13 bp, Homo sapiens
ctggggaggctga

SEQ ID NO: 5053686 - DNA, 14 bp, Homo sapiens
ctggggaggctgag

SEQ ID NO: 5053687 - DNA, 20 bp, Homo sapiens
ctggggtgggtttagcaggc

SEQ ID NO: 5053688 - DNA, 16 bp, Homo sapiens
ctgtaggagagactgg

SEQ ID NO: 5053689 - DNA, 19 bp, Homo sapiens
ctgtaggagagactggcca

SEQ ID NO: 5053690 - DNA, 23 bp, Homo sapiens
ctgtaggagagactggccagagg

SEQ ID NO: 5053691 - DNA, 21 bp, Homo sapiens
ctgtaggcgcccctggggtgg

SEQ ID NO: 5053692 - DNA, 24 bp, Homo sapiens
ctgtcacggaacagatcttgttct

SEQ ID NO: 5053693 - DNA, 13 bp, Homo sapiens
tcatcagcaggag

SEQ ID NO: 5053694 - DNA, 13 bp, Homo sapiens
tcatctcttttcc

SEQ ID NO: 5053695 - DNA, 12 bp, Homo sapiens
tcatctgggcca

SEQ ID NO: 5053696 - DNA, 22 bp, Homo sapiens
tcatgcgaattcttgcttgagg

SEQ ID NO: 5053697 - DNA, 23 bp, Homo sapiens
tcatggcatcatccattctctct

SEQ ID NO: 5053698 - DNA, 17 bp, Homo sapiens
tcattaaactcatattt

SEQ ID NO: 5053699 - DNA, 22 bp, Homo sapiens
tcattcatatcactatgaactt

SEQ ID NO: 5053700 - DNA, 16 bp, Homo sapiens
tccaaacaattctgat

SEQ ID NO: 5053701 - DNA, 17 bp, Homo sapiens
tccaaacaattctgatg

SEQ ID NO: 5053702 - DNA, 14 bp, Homo sapiens
tccacgccctgggg

SEQ ID NO: 5053703 - DNA, 16 bp, Homo sapiens
tccacgccctggggag

SEQ ID NO: 5053704 - DNA, 12 bp, Homo sapiens
tccactggcctg

SEQ ID NO: 5053705 - DNA, 18 bp, Homo sapiens
tccagacgtaggggaggg

SEQ ID NO: 5053706 - DNA, 19 bp, Homo sapiens
tccagcctggacccccagc

SEQ ID NO: 5053707 - DNA, 20 bp, Homo sapiens
tccagcctggacccccagct

SEQ ID NO: 5053708 - DNA, 20 bp, Homo sapiens
tccagtcctcacatgcccgc

SEQ ID NO: 5053709 - DNA, 16 bp, Homo sapiens
tccatcatctcttttc

SEQ ID NO: 5053710 - DNA, 17 bp, Homo sapiens
tccatcatctcttttcc

SEQ ID NO: 5053711 - DNA, 14 bp, Homo sapiens
tcccacctctgagg

SEQ ID NO: 5053712 - DNA, 20 bp, Homo sapiens
tcccacctctgaggactctg

SEQ ID NO: 5053713 - DNA, 20 bp, Homo sapiens
tcccaggggtctccctgagc

SEQ ID NO: 5053714 - DNA, 13 bp, Homo sapiens
tccccgcctgttc

SEQ ID NO: 5053715 - DNA, 14 bp, Homo sapiens
tcccctcagctcca

SEQ ID NO: 5053716 - DNA, 13 bp, Homo sapiens
tccctcctggtga

SEQ ID NO: 5053717 - DNA, 13 bp, Homo sapiens
tccctctgttgga

SEQ ID NO: 5053718 - DNA, 11 bp, Homo sapiens
tccctgagcct

SEQ ID NO: 5053719 - DNA, 19 bp, Homo sapiens
ggcgagggaggggaggtgg

SEQ ID NO: 5053720 - DNA, 13 bp, Homo sapiens
ggcgcccctgggg

SEQ ID NO: 5053721 - DNA, 17 bp, Homo sapiens
ggcgggggatcctggag

SEQ ID NO: 5053722 - DNA, 23 bp, Homo sapiens
ggcgggggatcctggagcccctg

SEQ ID NO: 5053723 - DNA, 17 bp, Homo sapiens
ggctgagactgcagagg

SEQ ID NO: 5053724 - DNA, 20 bp, Homo sapiens
ggctgagactgcagaggagc

SEQ ID NO: 5053725 - DNA, 21 bp, Homo sapiens
ggctgagactgcagaggagcc

SEQ ID NO: 5053726 - DNA, 17 bp, Homo sapiens
ggctgcagcaggcagag

SEQ ID NO: 5053727 - DNA, 11 bp, Homo sapiens
ggctgctgctc

SEQ ID NO: 5053728 - DNA, 14 bp, Homo sapiens
ggctgctgctcacc

SEQ ID NO: 5053729 - DNA, 23 bp, Homo sapiens
ggctggagatggctgctgctcac

SEQ ID NO: 5053730 - DNA, 12 bp, Homo sapiens
ggctgggcaggt

SEQ ID NO: 5053731 - DNA, 12 bp, Homo sapiens
gggagcctcctg

SEQ ID NO: 5053732 - DNA, 13 bp, Homo sapiens
gggagcctcctgc

SEQ ID NO: 5053733 - DNA, 16 bp, Homo sapiens
gggaggagccttggag

SEQ ID NO: 5053734 - DNA, 16 bp, Homo sapiens
gggaggcccatgtgac

SEQ ID NO: 5053735 - DNA, 13 bp, Homo sapiens
gggaggctctgaa

SEQ ID NO: 5053736 - DNA, 16 bp, Homo sapiens
gggagggcgaggcggg

SEQ ID NO: 5053737 - DNA, 14 bp, Homo sapiens
gggaggggaggtgg

SEQ ID NO: 5053738 - DNA, 15 bp, Homo sapiens
gggaggggaggtggc

SEQ ID NO: 5053739 - DNA, 19 bp, Homo sapiens
gggaggggttgccacaggc

SEQ ID NO: 5053740 - DNA, 23 bp, Homo sapiens
gggaggggttgccacaggcctcc

SEQ ID NO: 5053741 - DNA, 22 bp, Homo sapiens
gggaggtggccgtcgagttgac

SEQ ID NO: 5053742 - DNA, 17 bp, Homo sapiens
gggatcctggagcccct

SEQ ID NO: 5053743 - DNA, 16 bp, Homo sapiens
gggatgggccaccgcc

SEQ ID NO: 5053744 - DNA, 20 bp, Homo sapiens
gggcaaggtgggggagcctg

SEQ ID NO: 5053745 - DNA, 20 bp, Homo sapiens
gggcacatgctgagtctccc

SEQ ID NO: 5053746 - DNA, 21 bp, Homo sapiens
gggcaggaatcaaggagcctc

SEQ ID NO: 5053747 - DNA, 15 bp, Homo sapiens
gggcatgggggaggc

SEQ ID NO: 5053748 - DNA, 16 bp, Homo sapiens
gggcatgggggaggct

SEQ ID NO: 5053749 - DNA, 18 bp, Homo sapiens
gggccaccagctccactg

SEQ ID NO: 5053750 - DNA, 20 bp, Homo sapiens
gggcctgatggagaggagaa

SEQ ID NO: 5053751 - DNA, 20 bp, Homo sapiens
gggcctggcgggatgggcca

SEQ ID NO: 5053752 - DNA, 12 bp, Homo sapiens
gggcgagggagg

SEQ ID NO: 5053753 - DNA, 17 bp, Homo sapiens
gggctgggcaggtcctg

SEQ ID NO: 5053754 - DNA, 19 bp, Homo sapiens
gggcttctgcggtgaggca

SEQ ID NO: 5053755 - DNA, 21 bp, Homo sapiens
gggcttctgcggtgaggcagg

SEQ ID NO: 5053756 - DNA, 14 bp, Homo sapiens
ggggaaggaccaac

SEQ ID NO: 5053757 - DNA, 15 bp, Homo sapiens
ggggaaggccttgct

SEQ ID NO: 5053758 - DNA, 14 bp, Homo sapiens
ggggagcctggagc

SEQ ID NO: 5053759 - DNA, 17 bp, Homo sapiens
ggggaggctgagactgc

SEQ ID NO: 5053760 - DNA, 22 bp, Homo sapiens
ggggaggggttgccacaggcct

SEQ ID NO: 5053761 - DNA, 14 bp, Homo sapiens
ggggatcctggagc

SEQ ID NO: 5053762 - DNA, 15 bp, Homo sapiens
ggggatcctggagcc

SEQ ID NO: 5053763 - DNA, 18 bp, Homo sapiens
ggggatcctggagcccct

SEQ ID NO: 5053764 - DNA, 22 bp, Homo sapiens
ggggcaagaagatcacgctccc

SEQ ID NO: 5053765 - DNA, 22 bp, Homo sapiens
ggggcaggaatcaaggagcctc

SEQ ID NO: 5053766 - DNA, 20 bp, Homo sapiens
ggggcatgggggaggctctg

SEQ ID NO: 5053767 - DNA, 22 bp, Homo sapiens
ggggctcttgatcagtgtgcta

SEQ ID NO: 5053768 - DNA, 12 bp, Homo sapiens
gggggagcctgg

SEQ ID NO: 5053769 - DNA, 19 bp, Homo sapiens
ggggtctccctgagcctgc

SEQ ID NO: 5053770 - DNA, 20 bp, Homo sapiens
ggggttgccacaggcctccc

SEQ ID NO: 5053771 - DNA, 14 bp, Homo sapiens
gggtctccctgagc

SEQ ID NO: 5053772 - DNA, 20 bp, Homo sapiens
gggtggacgagggagtgtct

SEQ ID NO: 5053773 - DNA, 15 bp, Homo sapiens
gggtgtgccctggct

SEQ ID NO: 5053774 - DNA, 19 bp, Homo sapiens
gggttgccacaggcctccc

SEQ ID NO: 5053775 - DNA, 17 bp, Homo sapiens
gggtttagcaggctgca

SEQ ID NO: 5053776 - DNA, 14 bp, Homo sapiens
ggtagctctgagcc

SEQ ID NO: 5053777 - DNA, 16 bp, Homo sapiens
ggtcctggggaggctg

SEQ ID NO: 5053778 - DNA, 16 bp, Homo sapiens
ggtctccctgagcctg

SEQ ID NO: 5053779 - DNA, 17 bp, Homo sapiens
ggtctccctgagcctgc

SEQ ID NO: 5053780 - DNA, 20 bp, Homo sapiens
ggtctccctgagcctgcccc

SEQ ID NO: 5053781 - DNA, 16 bp, Homo sapiens
ggtgaagtgtgacttc

SEQ ID NO: 5053782 - DNA, 16 bp, Homo sapiens
ggtgcagccccaggac

SEQ ID NO: 5053783 - DNA, 20 bp, Homo sapiens
ggtgcagccccaggaccaag

SEQ ID NO: 5053784 - DNA, 15 bp, Homo sapiens
ggtgcctgctctcct

SEQ ID NO: 5053785 - DNA, 16 bp, Homo sapiens
ggtgcctgctctcctt

SEQ ID NO: 5053786 - DNA, 20 bp, Homo sapiens
ggtgcggtaggtgctggcct

SEQ ID NO: 5053787 - DNA, 20 bp, Homo sapiens
ggtgctagggtgcctgctct

SEQ ID NO: 5053788 - DNA, 15 bp, Homo sapiens
ggtggctggagatgg

SEQ ID NO: 5053789 - DNA, 17 bp, Homo sapiens
ggtgggggagcctggag

SEQ ID NO: 5053790 - DNA, 15 bp, Homo sapiens
ggtggtagctctgag

SEQ ID NO: 5053791 - DNA, 18 bp, Homo sapiens
ggttgccacaggcctccc

SEQ ID NO: 5053792 - DNA, 15 bp, Homo sapiens
ggtttagcaggctgc

SEQ ID NO: 5053793 - DNA, 20 bp, Homo sapiens
gtacaggtgtcaccatcatt

SEQ ID NO: 5053794 - DNA, 15 bp, Homo sapiens
gtacccccttctggg

SEQ ID NO: 5053795 - DNA, 19 bp, Homo sapiens
gtacgtgggagaggcagaa

SEQ ID NO: 5053796 - DNA, 14 bp, Homo sapiens
gtaggtgctggcct

SEQ ID NO: 5053797 - DNA, 14 bp, Homo sapiens
gtcactttctctct

SEQ ID NO: 5053798 - DNA, 17 bp, Homo sapiens
gtcagcatctttgccct

SEQ ID NO: 5053799 - DNA, 18 bp, Homo sapiens
gtccaaatgtttacaggg

SEQ ID NO: 5053800 - DNA, 15 bp, Homo sapiens
gtccagtcctcacat

SEQ ID NO: 5053801 - DNA, 18 bp, Homo sapiens
gtcccaggggtctccctg

SEQ ID NO: 5053802 - DNA, 15 bp, Homo sapiens
gtcctacggagggac

SEQ ID NO: 5053803 - DNA, 20 bp, Homo sapiens
gtctaggactttagggatct

SEQ ID NO: 5053804 - DNA, 15 bp, Homo sapiens
gtctcacatattcat

SEQ ID NO: 5053805 - DNA, 12 bp, Homo sapiens
gtctcccaaggc

SEQ ID NO: 5053806 - DNA, 19 bp, Homo sapiens
gtctgtgcagatgctttgc

SEQ ID NO: 5053807 - DNA, 13 bp, Homo sapiens
gtgaacaatcccc

SEQ ID NO: 5053808 - DNA, 19 bp, Homo sapiens
gtgagacgccaccattcct

SEQ ID NO: 5053809 - DNA, 15 bp, Homo sapiens
gtgagccttcccatt

SEQ ID NO: 5053810 - DNA, 18 bp, Homo sapiens
gtgaggcaggggagtctg

SEQ ID NO: 5053811 - DNA, 19 bp, Homo sapiens
gtgcagtataattttctaa

SEQ ID NO: 5053812 - DNA, 15 bp, Homo sapiens
gtgcattttgtgtga

SEQ ID NO: 5053813 - DNA, 17 bp, Homo sapiens
gtgcattttgtgtgatg

SEQ ID NO: 5053814 - DNA, 19 bp, Homo sapiens
gtgcattttgtgtgatgca

SEQ ID NO: 5053815 - DNA, 13 bp, Homo sapiens
gtgccctggctcc

SEQ ID NO: 5053816 - DNA, 23 bp, Homo sapiens
gtgccctggctcccaagggaggc

SEQ ID NO: 5053817 - DNA, 15 bp, Homo sapiens
gtgcggtaggtgctg

SEQ ID NO: 5053818 - DNA, 16 bp, Homo sapiens
gtgcggtaggtgctgg

SEQ ID NO: 5053819 - DNA, 19 bp, Homo sapiens
gtgcggtaggtgctggcct

SEQ ID NO: 5053820 - DNA, 17 bp, Homo sapiens
gtgctagggtgcctgct

SEQ ID NO: 5053821 - DNA, 22 bp, Homo sapiens
gtgctagggtgcctgctctcct

SEQ ID NO: 5053822 - DNA, 16 bp, Homo sapiens
gtgcttgggcttctgc

SEQ ID NO: 5053823 - DNA, 13 bp, Homo sapiens
gtggacgagggag

SEQ ID NO: 5053824 - DNA, 14 bp, Homo sapiens
gtggacgagggagt

SEQ ID NO: 5053825 - DNA, 13 bp, Homo sapiens
gtggccaggggtg

SEQ ID NO: 5053826 - DNA, 20 bp, Homo sapiens
ctctccagttatcagtactc

SEQ ID NO: 5053827 - DNA, 21 bp, Homo sapiens
ctctccagttatcagtactcc

SEQ ID NO: 5053828 - DNA, 17 bp, Homo sapiens
ctctccctcctggtgaa

SEQ ID NO: 5053829 - DNA, 13 bp, Homo sapiens
ctctccttgccct

SEQ ID NO: 5053830 - DNA, 14 bp, Homo sapiens
ctctccttgccctg

SEQ ID NO: 5053831 - DNA, 14 bp, Homo sapiens
ctctctgcctgttc

SEQ ID NO: 5053832 - DNA, 14 bp, Homo sapiens
ctctctttgttctc

SEQ ID NO: 5053833 - DNA, 13 bp, Homo sapiens
aaaaagcacaaga

SEQ ID NO: 5053834 - DNA, 23 bp, Homo sapiens
aaaacttttacatttttctgatg

SEQ ID NO: 5053835 - DNA, 14 bp, Homo sapiens
aaaagcacaagaag

SEQ ID NO: 5053836 - DNA, 18 bp, Homo sapiens
aaaataaaggctctgtgc

SEQ ID NO: 5053837 - DNA, 22 bp, Homo sapiens
aaacaaaatcacagcacccact

SEQ ID NO: 5053838 - DNA, 18 bp, Homo sapiens
aaacaatgtcctctttga

SEQ ID NO: 5053839 - DNA, 14 bp, Homo sapiens
aaacaattctgatg

SEQ ID NO: 5053840 - DNA, 15 bp, Homo sapiens
aaacaattctgatga

SEQ ID NO: 5053841 - DNA, 18 bp, Homo sapiens
aaactccggcactgggtt

SEQ ID NO: 5053842 - DNA, 16 bp, Homo sapiens
aaagcacaagaagcgt

SEQ ID NO: 5053843 - DNA, 14 bp, Homo sapiens
aaagccctgtgctt

SEQ ID NO: 5053844 - DNA, 12 bp, Homo sapiens
aaaggctctgtg

SEQ ID NO: 5053845 - DNA, 17 bp, Homo sapiens
aaaggctctgtgcttga

SEQ ID NO: 5053846 - DNA, 21 bp, Homo sapiens
aaagtgccttctgagctgtct

SEQ ID NO: 5053847 - DNA, 17 bp, Homo sapiens
aaataaaggctctgtgc

SEQ ID NO: 5053848 - DNA, 15 bp, Homo sapiens
aaatcatattctcat

SEQ ID NO: 5053849 - DNA, 22 bp, Homo sapiens
aaatgccttttcaaatgcagca

SEQ ID NO: 5053850 - DNA, 19 bp, Homo sapiens
aaattgacagctttctaac

SEQ ID NO: 5053851 - DNA, 22 bp, Homo sapiens
aacaaaattgacagctttctaa

SEQ ID NO: 5053852 - DNA, 17 bp, Homo sapiens
aacaatgtcctctttga

SEQ ID NO: 5053853 - DNA, 14 bp, Homo sapiens
aacaattctgatga

SEQ ID NO: 5053854 - DNA, 21 bp, Homo sapiens
aacacaagtttacttgtcttt

SEQ ID NO: 5053855 - DNA, 15 bp, Homo sapiens
aacaccagcccctgc

SEQ ID NO: 5053856 - DNA, 17 bp, Homo sapiens
aacaccagcccctgccc

SEQ ID NO: 5053857 - DNA, 18 bp, Homo sapiens
aacaccagcccctgcccc

SEQ ID NO: 5053858 - DNA, 23 bp, Homo sapiens
aacaccagcccctgccccagccc

SEQ ID NO: 5053859 - DNA, 17 bp, Homo sapiens
aacagtgttctgagccc

SEQ ID NO: 5053860 - DNA, 15 bp, Homo sapiens
aaccacacacacctg

SEQ ID NO: 5053861 - DNA, 24 bp, Homo sapiens
aaccattgtcttgttctgtgatga

SEQ ID NO: 5053862 - DNA, 15 bp, Homo sapiens
aacccatgccctgcc

SEQ ID NO: 5053863 - DNA, 13 bp, Homo sapiens
aaccccagctgcc

SEQ ID NO: 5053864 - DNA, 21 bp, Homo sapiens
aaccccagctgccggcagtgc

SEQ ID NO: 5053865 - DNA, 20 bp, Homo sapiens
aacggggtggacgagggagt

SEQ ID NO: 5053866 - DNA, 21 bp, Homo sapiens
aactaccctacacctctgggc

SEQ ID NO: 5053867 - DNA, 18 bp, Homo sapiens
aactccaaacaattctga

SEQ ID NO: 5053868 - DNA, 21 bp, Homo sapiens
aactcgggagcattctgcctg

SEQ ID NO: 5053869 - DNA, 20 bp, Homo sapiens
aactctccagttatcagtac

SEQ ID NO: 5053870 - DNA, 21 bp, Homo sapiens
aacttttacatttttctgatg

SEQ ID NO: 5053871 - DNA, 12 bp, Homo sapiens
aagaccatctct

SEQ ID NO: 5053872 - DNA, 16 bp, Homo sapiens
aagaccatctctccct

SEQ ID NO: 5053873 - DNA, 22 bp, Homo sapiens
aagagccatctgaagccacctc

SEQ ID NO: 5053874 - DNA, 16 bp, Homo sapiens
aagatcacgctccccg

SEQ ID NO: 5053875 - DNA, 13 bp, Homo sapiens
aagatgatccttc

SEQ ID NO: 5053876 - DNA, 13 bp, Homo sapiens
aagcacaagaagc

SEQ ID NO: 5053877 - DNA, 13 bp, Homo sapiens
aagccctgtgctt

SEQ ID NO: 5053878 - DNA, 10 bp, Homo sapiens
aagcctgccc

SEQ ID NO: 5053879 - DNA, 11 bp, Homo sapiens
aagcctgccct

SEQ ID NO: 5053880 - DNA, 18 bp, Homo sapiens
aagcctgcccttgtctga

SEQ ID NO: 5053881 - DNA, 18 bp, Homo sapiens
aagcctggagcccctgtg

SEQ ID NO: 5053882 - DNA, 17 bp, Homo sapiens
aagcgtgagacgccacc

SEQ ID NO: 5053883 - DNA, 16 bp, Homo sapiens
aagcttaaggagagga

SEQ ID NO: 5053884 - DNA, 22 bp, Homo sapiens
aaggaccaacccatgccctgcc

SEQ ID NO: 5053885 - DNA, 21 bp, Homo sapiens
aagggtcctacggagggacca

SEQ ID NO: 5053886 - DNA, 17 bp, Homo sapiens
aaggtgggggagcctgg

SEQ ID NO: 5053887 - DNA, 19 bp, Homo sapiens
aaggtgggggagcctggag

SEQ ID NO: 5053888 - DNA, 21 bp, Homo sapiens
aagtccaaatgtttacaggga

SEQ ID NO: 5053889 - DNA, 16 bp, Homo sapiens
aagtgggacctggtgg

SEQ ID NO: 5053890 - DNA, 21 bp, Homo sapiens
aataaaaaccaaactctgtgt

SEQ ID NO: 5053891 - DNA, 18 bp, Homo sapiens
aataaaggctctgtgctt

SEQ ID NO: 5053892 - DNA, 22 bp, Homo sapiens
aatcatattctcatggctttgt

SEQ ID NO: 5053893 - DNA, 18 bp, Homo sapiens
aatcccacttagcaggga

SEQ ID NO: 5053894 - DNA, 13 bp, Homo sapiens
aatctacactgcc

SEQ ID NO: 5053895 - DNA, 15 bp, Homo sapiens
aatctacactgcctt

SEQ ID NO: 5053896 - DNA, 23 bp, Homo sapiens
aatgtaaaataaaggctctgtgc

SEQ ID NO: 5053897 - DNA, 21 bp, Homo sapiens
aatgtttacagggagcctcct

SEQ ID NO: 5053898 - DNA, 22 bp, Homo sapiens
aattacctgtcatctgggccac

SEQ ID NO: 5053899 - DNA, 14 bp, Homo sapiens
aattagtttgcact

SEQ ID NO: 5053900 - DNA, 12 bp, Homo sapiens
aattattcccat

SEQ ID NO: 5053901 - DNA, 10 bp, Homo sapiens
aattctgatg

SEQ ID NO: 5053902 - DNA, 14 bp, Homo sapiens
aattctgtcattaa

SEQ ID NO: 5053903 - DNA, 20 bp, Homo sapiens
aattctgttagctgctcact

SEQ ID NO: 5053904 - DNA, 21 bp, Homo sapiens
aattgggtgtgccctggctcc

SEQ ID NO: 5053905 - DNA, 15 bp, Homo sapiens
acaaaattgacagct

SEQ ID NO: 5053906 - DNA, 20 bp, Homo sapiens
acaaggtgctcagacatgaa

SEQ ID NO: 5053907 - DNA, 16 bp, Homo sapiens
acaatctacactgcct

SEQ ID NO: 5053908 - DNA, 13 bp, Homo sapiens
acaatgtcctctt

SEQ ID NO: 5053909 - DNA, 13 bp, Homo sapiens
acacaaggtgctc

SEQ ID NO: 5053910 - DNA, 17 bp, Homo sapiens
acacacacctgtctgtg

SEQ ID NO: 5053911 - DNA, 13 bp, Homo sapiens
acacccagccagc

SEQ ID NO: 5053912 - DNA, 14 bp, Homo sapiens
acacccagccagct

SEQ ID NO: 5053913 - DNA, 15 bp, Homo sapiens
caagcctggagcccc

SEQ ID NO: 5053914 - DNA, 15 bp, Homo sapiens
caagcttaaggagag

SEQ ID NO: 5053915 - DNA, 17 bp, Homo sapiens
caaggctgcgtctggag

SEQ ID NO: 5053916 - DNA, 18 bp, Homo sapiens
caaggctgcgtctggagg

SEQ ID NO: 5053917 - DNA, 13 bp, Homo sapiens
caaggtgctcaga

SEQ ID NO: 5053918 - DNA, 17 bp, Homo sapiens
caaggtggcagcaagca

SEQ ID NO: 5053919 - DNA, 17 bp, Homo sapiens
caaggtgggggagcctg

SEQ ID NO: 5053920 - DNA, 18 bp, Homo sapiens
caaggtgggggagcctgg

SEQ ID NO: 5053921 - DNA, 14 bp, Homo sapiens
caagttgctctgta

SEQ ID NO: 5053922 - DNA, 21 bp, Homo sapiens
caatacccctagtatctggct

SEQ ID NO: 5053923 - DNA, 23 bp, Homo sapiens
caatacccctagtatctggctgg

SEQ ID NO: 5053924 - DNA, 14 bp, Homo sapiens
caatctacactgcc

SEQ ID NO: 5053925 - DNA, 17 bp, Homo sapiens
caatctacactgcctta

SEQ ID NO: 5053926 - DNA, 19 bp, Homo sapiens
caattctgccccacaccca

SEQ ID NO: 5053927 - DNA, 21 bp, Homo sapiens
caattctgccccacacccagc

SEQ ID NO: 5053928 - DNA, 13 bp, Homo sapiens
cacaaggtgctca

SEQ ID NO: 5053929 - DNA, 15 bp, Homo sapiens
cacaaggtgctcaga

SEQ ID NO: 5053930 - DNA, 22 bp, Homo sapiens
cacaagtttacttgtctttgat

SEQ ID NO: 5053931 - DNA, 17 bp, Homo sapiens
cacacaaggtgctcaga

SEQ ID NO: 5053932 - DNA, 15 bp, Homo sapiens
cacacacctgtctgt

SEQ ID NO: 5053933 - DNA, 18 bp, Homo sapiens
cacacacctgtctgtgca

SEQ ID NO: 5053934 - DNA, 15 bp, Homo sapiens
cacagatctcttgtt

SEQ ID NO: 5053935 - DNA, 15 bp, Homo sapiens
cacaggcctccctgt

SEQ ID NO: 5053936 - DNA, 16 bp, Homo sapiens
cacaggcctccctgtt

SEQ ID NO: 5053937 - DNA, 13 bp, Homo sapiens
caccagctccact

SEQ ID NO: 5053938 - DNA, 18 bp, Homo sapiens
caccagctccactggcct

SEQ ID NO: 5053939 - DNA, 16 bp, Homo sapiens
caccatcatttctagt

SEQ ID NO: 5053940 - DNA, 23 bp, Homo sapiens
caccattcctggaaaccacagtc

SEQ ID NO: 5053941 - DNA, 16 bp, Homo sapiens
cacccagccagctcct

SEQ ID NO: 5053942 - DNA, 20 bp, Homo sapiens
caccctcctagcctgctctg

SEQ ID NO: 5053943 - DNA, 22 bp, Homo sapiens
caccgccgactttgtacccccc

SEQ ID NO: 5053944 - DNA, 18 bp, Homo sapiens
cacctctgaggactctgg

SEQ ID NO: 5053945 - DNA, 20 bp, Homo sapiens
cacctctgggccctgcagga

SEQ ID NO: 5053946 - DNA, 18 bp, Homo sapiens
cacgctccccgcctgttc

SEQ ID NO: 5053947 - DNA, 18 bp, Homo sapiens
cactaccatacagacagc

SEQ ID NO: 5053948 - DNA, 19 bp, Homo sapiens
cactaccatacagacagca

SEQ ID NO: 5053949 - DNA, 14 bp, Homo sapiens
cactgccttacctt

SEQ ID NO: 5053950 - DNA, 10 bp, Homo sapiens
cactggcctg

SEQ ID NO: 5053951 - DNA, 21 bp, Homo sapiens
cactggcctgttctgtaggag

SEQ ID NO: 5053952 - DNA, 14 bp, Homo sapiens
cacttagcagggac

SEQ ID NO: 5053953 - DNA, 15 bp, Homo sapiens
cacttagcagggaca

SEQ ID NO: 5053954 - DNA, 16 bp, Homo sapiens
cacttagcagggacag

SEQ ID NO: 5053955 - DNA, 20 bp, Homo sapiens
cacttagcagggacaggaga

SEQ ID NO: 5053956 - DNA, 18 bp, Homo sapiens
cacttcctgttggaaggt

SEQ ID NO: 5053957 - DNA, 13 bp, Homo sapiens
cactttctctctt

SEQ ID NO: 5053958 - DNA, 16 bp, Homo sapiens
cagagcttcagggctg

SEQ ID NO: 5053959 - DNA, 17 bp, Homo sapiens
cagaggagccacctggg

SEQ ID NO: 5053960 - DNA, 20 bp, Homo sapiens
cagaggagccacctgggctg

SEQ ID NO: 5053961 - DNA, 14 bp, Homo sapiens
cagatcttgttctt

SEQ ID NO: 5053962 - DNA, 15 bp, Homo sapiens
cagcacccactacca

SEQ ID NO: 5053963 - DNA, 12 bp, Homo sapiens
cagcaggcagag

SEQ ID NO: 5053964 - DNA, 15 bp, Homo sapiens
cagcaggcagaggag

SEQ ID NO: 5053965 - DNA, 14 bp, Homo sapiens
cagcatcattcagc

SEQ ID NO: 5053966 - DNA, 15 bp, Homo sapiens
cagcatcattcagca

SEQ ID NO: 5053967 - DNA, 15 bp, Homo sapiens
cagcatctttgccct

SEQ ID NO: 5053968 - DNA, 20 bp, Homo sapiens
cagcatctttgcccttctgg

SEQ ID NO: 5053969 - DNA, 20 bp, Homo sapiens
cagccaaacacataacaata

SEQ ID NO: 5053970 - DNA, 13 bp, Homo sapiens
cagccaagagcca

SEQ ID NO: 5053971 - DNA, 14 bp, Homo sapiens
cagccagctccttt

SEQ ID NO: 5053972 - DNA, 11 bp, Homo sapiens
cagcccctgcc

SEQ ID NO: 5053973 - DNA, 23 bp, Homo sapiens
cagcccctgccccagcccaagtc

SEQ ID NO: 5053974 - DNA, 19 bp, Homo sapiens
cagccgctcggaggcccca

SEQ ID NO: 5053975 - DNA, 21 bp, Homo sapiens
cagccgctcggaggccccaaa

SEQ ID NO: 5053976 - DNA, 23 bp, Homo sapiens
cagccgctcggaggccccaaagg

SEQ ID NO: 5053977 - DNA, 15 bp, Homo sapiens
cagcctggaccccca

SEQ ID NO: 5053978 - DNA, 18 bp, Homo sapiens
cagcctggacccccagct

SEQ ID NO: 5053979 - DNA, 17 bp, Homo sapiens
cagctaaggggcaggaa

SEQ ID NO: 5053980 - DNA, 13 bp, Homo sapiens
cagctccccctgt

SEQ ID NO: 5053981 - DNA, 19 bp, Homo sapiens
cagctccccctgtcccctc

SEQ ID NO: 5053982 - DNA, 16 bp, Homo sapiens
cagctcctttcccttt

SEQ ID NO: 5053983 - DNA, 21 bp, Homo sapiens
cagctcctttcccttttccat

SEQ ID NO: 5053984 - DNA, 16 bp, Homo sapiens
caggaatcaaggagcc

SEQ ID NO: 5053985 - DNA, 17 bp, Homo sapiens
caggaatcaaggagcct

SEQ ID NO: 5053986 - DNA, 23 bp, Homo sapiens
caggacttgcttccaagcccttc

SEQ ID NO: 5053987 - DNA, 20 bp, Homo sapiens
caggattgtacgtgggagag

SEQ ID NO: 5053988 - DNA, 12 bp, Homo sapiens
caggcagaggag

SEQ ID NO: 5053989 - DNA, 14 bp, Homo sapiens
caggcagaggagag

SEQ ID NO: 5053990 - DNA, 18 bp, Homo sapiens
caggctgcagcaggcaga

SEQ ID NO: 5053991 - DNA, 19 bp, Homo sapiens
caggctgcagcaggcagag

SEQ ID NO: 5053992 - DNA, 22 bp, Homo sapiens
caggctgcagcaggcagaggag

SEQ ID NO: 5053993 - DNA, 16 bp, Homo sapiens
cagggagcctcctgcc

SEQ ID NO: 5053994 - DNA, 17 bp, Homo sapiens
caggggtctccctgagc

SEQ ID NO: 5053995 - DNA, 22 bp, Homo sapiens
cagggtggccaggggtggtgag

SEQ ID NO: 5053996 - DNA, 22 bp, Homo sapiens
cagtaacaaaattgacagcttt

SEQ ID NO: 5053997 - DNA, 15 bp, Homo sapiens
cagtataattttcta

SEQ ID NO: 5053998 - DNA, 14 bp, Homo sapiens
cagtggggtctcag

SEQ ID NO: 5053999 - DNA, 21 bp, Homo sapiens
cagtgtgctaacctcactgcc

SEQ ID NO: 5054000 - DNA, 16 bp, Homo sapiens
cagtgttctgagcccc

SEQ ID NO: 5054001 - DNA, 20 bp, Homo sapiens
cagttacctttgctgtcact

SEQ ID NO: 5054002 - DNA, 12 bp, Homo sapiens
cagttctgcacc

SEQ ID NO: 5054003 - DNA, 11 bp, Homo sapiens
cataccaggtg

SEQ ID NO: 5054004 - DNA, 21 bp, Homo sapiens
catattctcatggctttgtta

SEQ ID NO: 5054005 - DNA, 17 bp, Homo sapiens
catcatccattctctct

SEQ ID NO: 5054006 - DNA, 21 bp, Homo sapiens
catcattcagcaaatgccttt

SEQ ID NO: 5054007 - DNA, 13 bp, Homo sapiens
catcatttctagt

SEQ ID NO: 5054008 - DNA, 20 bp, Homo sapiens
catcatttctagtatattag

SEQ ID NO: 5054009 - DNA, 16 bp, Homo sapiens
catccattctctctgc

SEQ ID NO: 5054010 - DNA, 13 bp, Homo sapiens
catctctccctcc

SEQ ID NO: 5054011 - DNA, 14 bp, Homo sapiens
catctctccctcct

SEQ ID NO: 5054012 - DNA, 18 bp, Homo sapiens
catctctgctgcttctgg

SEQ ID NO: 5054013 - DNA, 21 bp, Homo sapiens
catctctgctgcttctgggcc

SEQ ID NO: 5054014 - DNA, 23 bp, Homo sapiens
catctctgctgcttctgggcctg

SEQ ID NO: 5054015 - DNA, 13 bp, Homo sapiens
catctcttttccc

SEQ ID NO: 5054016 - DNA, 15 bp, Homo sapiens
catctcttttcccac

SEQ ID NO: 5054017 - DNA, 17 bp, Homo sapiens
catctcttttcccactc

SEQ ID NO: 5054018 - DNA, 21 bp, Homo sapiens
catctcttttcccactccctt

SEQ ID NO: 5054019 - DNA, 19 bp, Homo sapiens
ccccaaaggaaaaagcaca

SEQ ID NO: 5054020 - DNA, 14 bp, Homo sapiens
ccccaacccctgag

SEQ ID NO: 5054021 - DNA, 16 bp, Homo sapiens
ccccaacccctgagga

SEQ ID NO: 5054022 - DNA, 13 bp, Homo sapiens
ccccacctgcctg

SEQ ID NO: 5054023 - DNA, 16 bp, Homo sapiens
ccccagcccaagtcca

SEQ ID NO: 5054024 - DNA, 14 bp, Homo sapiens
ccccagctgccggc

SEQ ID NO: 5054025 - DNA, 15 bp, Homo sapiens
ccccagctgccggca

SEQ ID NO: 5054026 - DNA, 18 bp, Homo sapiens
ccccagctgccggcagtg

SEQ ID NO: 5054027 - DNA, 21 bp, Homo sapiens
ccccagctgccggcagtgctg

SEQ ID NO: 5054028 - DNA, 21 bp, Homo sapiens
ccccagctgggctgttggctg

SEQ ID NO: 5054029 - DNA, 14 bp, Homo sapiens
ccccagctttgccc

SEQ ID NO: 5054030 - DNA, 22 bp, Homo sapiens
cccccttctgggcatctgttct

SEQ ID NO: 5054031 - DNA, 14 bp, Homo sapiens
ccccgcctgttccc

SEQ ID NO: 5054032 - DNA, 17 bp, Homo sapiens
cccctagtatctggctg

SEQ ID NO: 5054033 - DNA, 15 bp, Homo sapiens
cccctgcttctccag

SEQ ID NO: 5054034 - DNA, 18 bp, Homo sapiens
cccctgcttctccagcct

SEQ ID NO: 5054035 - DNA, 17 bp, Homo sapiens
cccctgtcccctcagct

SEQ ID NO: 5054036 - DNA, 12 bp, Homo sapiens
ccccttctctgt

SEQ ID NO: 5054037 - DNA, 13 bp, Homo sapiens
ccccttctctgta

SEQ ID NO: 5054038 - DNA, 13 bp, Homo sapiens
cccgcctgttccc

SEQ ID NO: 5054039 - DNA, 15 bp, Homo sapiens
ccctacacctctggg

SEQ ID NO: 5054040 - DNA, 16 bp, Homo sapiens
ccctacacctctgggc

SEQ ID NO: 5054041 - DNA, 19 bp, Homo sapiens
ccctcctagcctgctctgc

SEQ ID NO: 5054042 - DNA, 17 bp, Homo sapiens
ccctcctggtgaagtgt

SEQ ID NO: 5054043 - DNA, 16 bp, Homo sapiens
ccctccttcttgccct

SEQ ID NO: 5054044 - DNA, 15 bp, Homo sapiens
ccctgagagcatgtg

SEQ ID NO: 5054045 - DNA, 16 bp, Homo sapiens
ccctgagagcatgtgg

SEQ ID NO: 5054046 - DNA, 17 bp, Homo sapiens
ccctgagagcatgtggg

SEQ ID NO: 5054047 - DNA, 21 bp, Homo sapiens
ccctgagagcatgtgggggaa

SEQ ID NO: 5054048 - DNA, 19 bp, Homo sapiens
ccctgagcctgccccagct

SEQ ID NO: 5054049 - DNA, 20 bp, Homo sapiens
ccctgagcctgccccagctg

SEQ ID NO: 5054050 - DNA, 23 bp, Homo sapiens
ccctgcaggaggcctgggagggc

SEQ ID NO: 5054051 - DNA, 13 bp, Homo sapiens
ccctgccccagcc

SEQ ID NO: 5054052 - DNA, 15 bp, Homo sapiens
ccctgccccagccca

SEQ ID NO: 5054053 - DNA, 20 bp, Homo sapiens
ccctgccccagcccaagtcc

SEQ ID NO: 5054054 - DNA, 11 bp, Homo sapiens
ccctgcttctc

SEQ ID NO: 5054055 - DNA, 18 bp, Homo sapiens
ccctgcttctccagcctg

SEQ ID NO: 5054056 - DNA, 23 bp, Homo sapiens
ccctgcttctccagcctggaccc

SEQ ID NO: 5054057 - DNA, 10 bp, Homo sapiens
ccctggctcc

SEQ ID NO: 5054058 - DNA, 19 bp, Homo sapiens
ccctgtcccctcagctcca

SEQ ID NO: 5054059 - DNA, 15 bp, Homo sapiens
cccttccctctgttg

SEQ ID NO: 5054060 - DNA, 20 bp, Homo sapiens
cccttctgggcatctgttct

SEQ ID NO: 5054061 - DNA, 12 bp, Homo sapiens
cccttgtctgag

SEQ ID NO: 5054062 - DNA, 13 bp, Homo sapiens
cccttgtctgaga

SEQ ID NO: 5054063 - DNA, 14 bp, Homo sapiens
cccttgtctgagat

SEQ ID NO: 5054064 - DNA, 19 bp, Homo sapiens
ccgccgactttgtaccccc

SEQ ID NO: 5054065 - DNA, 20 bp, Homo sapiens
ccgcctgttcccccgccgct

SEQ ID NO: 5054066 - DNA, 18 bp, Homo sapiens
ccgctcggaggccccaaa

SEQ ID NO: 5054067 - DNA, 13 bp, Homo sapiens
ccggcactgggtt

SEQ ID NO: 5054068 - DNA, 12 bp, Homo sapiens
ccgggcctggac

SEQ ID NO: 5054069 - DNA, 14 bp, Homo sapiens
ccggggaggagcct

SEQ ID NO: 5054070 - DNA, 19 bp, Homo sapiens
ccggggaggagccttggag

SEQ ID NO: 5054071 - DNA, 13 bp, Homo sapiens
ccgttcccacctc

SEQ ID NO: 5054072 - DNA, 18 bp, Homo sapiens
ccgttcccacctctgagg

SEQ ID NO: 5054073 - DNA, 17 bp, Homo sapiens
ccgttgccgggcctgga

SEQ ID NO: 5054074 - DNA, 18 bp, Homo sapiens
cctacacctctgggccct

SEQ ID NO: 5054075 - DNA, 23 bp, Homo sapiens
cctagagtggcagccaagagcca

SEQ ID NO: 5054076 - DNA, 14 bp, Homo sapiens
cctagcctgctctg

SEQ ID NO: 5054077 - DNA, 17 bp, Homo sapiens
cctagcctgctctgcca

SEQ ID NO: 5054078 - DNA, 14 bp, Homo sapiens
cctagtatctggct

SEQ ID NO: 5054079 - DNA, 15 bp, Homo sapiens
cctagtatctggctg

SEQ ID NO: 5054080 - DNA, 17 bp, Homo sapiens
cctagtatctggctggg

SEQ ID NO: 5054081 - DNA, 16 bp, Homo sapiens
cctcacatgcccgctg

SEQ ID NO: 5054082 - DNA, 19 bp, Homo sapiens
cctcacatgcccgctgtcc

SEQ ID NO: 5054083 - DNA, 12 bp, Homo sapiens
cctcactgcctc

SEQ ID NO: 5054084 - DNA, 14 bp, Homo sapiens
cctcactgcctcat

SEQ ID NO: 5054085 - DNA, 23 bp, Homo sapiens
cctccgttcccacctctgaggac

SEQ ID NO: 5054086 - DNA, 24 bp, Homo sapiens
cctccgttcccacctctgaggact

SEQ ID NO: 5054087 - DNA, 14 bp, Homo sapiens
cctcctagcctgct

SEQ ID NO: 5054088 - DNA, 22 bp, Homo sapiens
cctcctagcctgctctgccact

SEQ ID NO: 5054089 - DNA, 15 bp, Homo sapiens
cctcctgcccagtcc

SEQ ID NO: 5054090 - DNA, 17 bp, Homo sapiens
cctcctgcccagtcccc

SEQ ID NO: 5054091 - DNA, 15 bp, Homo sapiens
cctctctttgttctc

SEQ ID NO: 5054092 - DNA, 19 bp, Homo sapiens
cctctctttgttctcagct

SEQ ID NO: 5054093 - DNA, 12 bp, Homo sapiens
cctctgggccct

SEQ ID NO: 5054094 - DNA, 13 bp, Homo sapiens
cctctgggccctg

SEQ ID NO: 5054095 - DNA, 15 bp, Homo sapiens
cctctgggccctgca

SEQ ID NO: 5054096 - DNA, 18 bp, Homo sapiens
cctgaccatcccatgagc

SEQ ID NO: 5054097 - DNA, 21 bp, Homo sapiens
cctgagcctgccccagctggg

SEQ ID NO: 5054098 - DNA, 20 bp, Homo sapiens
cctgagctttccggggagga

SEQ ID NO: 5054099 - DNA, 18 bp, Homo sapiens
cctgaggaagatgggggc

SEQ ID NO: 5054100 - DNA, 12 bp, Homo sapiens
cctgatggagag

SEQ ID NO: 5054101 - DNA, 18 bp, Homo sapiens
cctgatggagaggagaac

SEQ ID NO: 5054102 - DNA, 16 bp, Homo sapiens
cctgcaggaggcctgg

SEQ ID NO: 5054103 - DNA, 18 bp, Homo sapiens
cctgcaggaggcctggga

SEQ ID NO: 5054104 - DNA, 21 bp, Homo sapiens
cctgcaggaggcctgggaggg

SEQ ID NO: 5054105 - DNA, 16 bp, Homo sapiens
cctgccaagcctggag

SEQ ID NO: 5054106 - DNA, 17 bp, Homo sapiens
cctgccaagcctggagc

SEQ ID NO: 5054107 - DNA, 19 bp, Homo sapiens
cctgcccagtcccccaacc

SEQ ID NO: 5054108 - DNA, 23 bp, Homo sapiens
cctgcccagtcccccaaccccag

SEQ ID NO: 5054109 - DNA, 13 bp, Homo sapiens
cctgccccagccc

SEQ ID NO: 5054110 - DNA, 15 bp, Homo sapiens
cctgccccagcccaa

SEQ ID NO: 5054111 - DNA, 17 bp, Homo sapiens
cctgccccagctgggct

SEQ ID NO: 5054112 - DNA, 18 bp, Homo sapiens
cctgccccagctgggctg

SEQ ID NO: 5054113 - DNA, 19 bp, Homo sapiens
cctgccccagctgggctgt

SEQ ID NO: 5054114 - DNA, 16 bp, Homo sapiens
cctgcccgttgccggg

SEQ ID NO: 5054115 - DNA, 16 bp, Homo sapiens
cctgcccttgtctgag

SEQ ID NO: 5054116 - DNA, 17 bp, Homo sapiens
cctgcccttgtctgaga

SEQ ID NO: 5054117 - DNA, 20 bp, Homo sapiens
cctgcctgaccatcccatga

SEQ ID NO: 5054118 - DNA, 21 bp, Homo sapiens
cctgcctgaccatcccatgag

SEQ ID NO: 5054119 - DNA, 18 bp, Homo sapiens
cctgctctccttgccctg

SEQ ID NO: 5054120 - DNA, 20 bp, Homo sapiens
cctgctctccttgccctggg

SEQ ID NO: 5054121 - DNA, 12 bp, Homo sapiens
cctgctctgcca

SEQ ID NO: 5054122 - DNA, 14 bp, Homo sapiens
cctgcttctccagc

SEQ ID NO: 5054123 - DNA, 15 bp, Homo sapiens
cctgcttctccagcc

SEQ ID NO: 5054124 - DNA, 20 bp, Homo sapiens
cctgcttctccagcctggac

SEQ ID NO: 5054125 - DNA, 12 bp, Homo sapiens
ctctgagccctc

SEQ ID NO: 5054126 - DNA, 16 bp, Homo sapiens
ctctgctgcttctggg

SEQ ID NO: 5054127 - DNA, 17 bp, Homo sapiens
ctctgctgcttctgggc

SEQ ID NO: 5054128 - DNA, 19 bp, Homo sapiens
ctctgctgcttctgggcct

SEQ ID NO: 5054129 - DNA, 20 bp, Homo sapiens
ctctgctgcttctgggcctg

SEQ ID NO: 5054130 - DNA, 21 bp, Homo sapiens
ctctgctgcttctgggcctga

SEQ ID NO: 5054131 - DNA, 14 bp, Homo sapiens
ctctggaccccagg

SEQ ID NO: 5054132 - DNA, 23 bp, Homo sapiens
ctctgtgtcagcatctttgccct

SEQ ID NO: 5054133 - DNA, 14 bp, Homo sapiens
ctcttgttcgcaca

SEQ ID NO: 5054134 - DNA, 17 bp, Homo sapiens
ctctttgttctcagctc

SEQ ID NO: 5054135 - DNA, 17 bp, Homo sapiens
ctgaagccacctctctg

SEQ ID NO: 5054136 - DNA, 20 bp, Homo sapiens
ctgaagccacctctctgcct

SEQ ID NO: 5054137 - DNA, 22 bp, Homo sapiens
ctgaagccacctctctgcctgt

SEQ ID NO: 5054138 - DNA, 15 bp, Homo sapiens
ctgaccatcccatga

SEQ ID NO: 5054139 - DNA, 21 bp, Homo sapiens
ctgagacggatggaaggagag

SEQ ID NO: 5054140 - DNA, 13 bp, Homo sapiens
ctgagagcatgtg

SEQ ID NO: 5054141 - DNA, 20 bp, Homo sapiens
ctgagagcatgtgggggaag

SEQ ID NO: 5054142 - DNA, 15 bp, Homo sapiens
ctgagcccccacctg

SEQ ID NO: 5054143 - DNA, 13 bp, Homo sapiens
ctgagccctcctt

SEQ ID NO: 5054144 - DNA, 15 bp, Homo sapiens
ctgagcctgccccag

SEQ ID NO: 5054145 - DNA, 17 bp, Homo sapiens
ctgagctttccggggag

SEQ ID NO: 5054146 - DNA, 14 bp, Homo sapiens
ctgaggactctgga

SEQ ID NO: 5054147 - DNA, 15 bp, Homo sapiens
ctgagtctcccaagg

SEQ ID NO: 5054148 - DNA, 18 bp, Homo sapiens
ctgatatttgctggagtg

SEQ ID NO: 5054149 - DNA, 14 bp, Homo sapiens
ctgatggagaggag

SEQ ID NO: 5054150 - DNA, 16 bp, Homo sapiens
ctgattaaagtgcctt

SEQ ID NO: 5054151 - DNA, 17 bp, Homo sapiens
ctgattaaagtgccttc

SEQ ID NO: 5054152 - DNA, 19 bp, Homo sapiens
ctgcacccagccaaacaca

SEQ ID NO: 5054153 - DNA, 15 bp, Homo sapiens
ctgcagaggagccac

SEQ ID NO: 5054154 - DNA, 22 bp, Homo sapiens
ctgcagaggagccacctgggct

SEQ ID NO: 5054155 - DNA, 14 bp, Homo sapiens
ctgcagcaggcaga

SEQ ID NO: 5054156 - DNA, 21 bp, Homo sapiens
ctgcagcaggcagaggagagt

SEQ ID NO: 5054157 - DNA, 17 bp, Homo sapiens
ctgcaggaggcctggga

SEQ ID NO: 5054158 - DNA, 13 bp, Homo sapiens
ctgccaagcctgg

SEQ ID NO: 5054159 - DNA, 16 bp, Homo sapiens
ctgcccaagttgctct

SEQ ID NO: 5054160 - DNA, 18 bp, Homo sapiens
ctgcccaagttgctctgt

SEQ ID NO: 5054161 - DNA, 19 bp, Homo sapiens
ctgcccaagttgctctgta

SEQ ID NO: 5054162 - DNA, 16 bp, Homo sapiens
ctgccccacacccagc

SEQ ID NO: 5054163 - DNA, 16 bp, Homo sapiens
ctgccccagcccaagt

SEQ ID NO: 5054164 - DNA, 19 bp, Homo sapiens
ctgccccagcccaagtcca

SEQ ID NO: 5054165 - DNA, 13 bp, Homo sapiens
ctgccccagctgg

SEQ ID NO: 5054166 - DNA, 15 bp, Homo sapiens
ctgccccagctgggc

SEQ ID NO: 5054167 - DNA, 16 bp, Homo sapiens
ctgccggcagtgctgg

SEQ ID NO: 5054168 - DNA, 17 bp, Homo sapiens
ctgcctcatggcatcat

SEQ ID NO: 5054169 - DNA, 14 bp, Homo sapiens
ctgcctgcctggga

SEQ ID NO: 5054170 - DNA, 15 bp, Homo sapiens
ctgcctgttcctccc

SEQ ID NO: 5054171 - DNA, 20 bp, Homo sapiens
ctgcctgttcctcccaagag

SEQ ID NO: 5054172 - DNA, 23 bp, Homo sapiens
ctgcctgttcctcccaagaggcc

SEQ ID NO: 5054173 - DNA, 20 bp, Homo sapiens
ctgccttaccttcacttaaa

SEQ ID NO: 5054174 - DNA, 22 bp, Homo sapiens
ctgcgtctggaggggcccctgc

SEQ ID NO: 5054175 - DNA, 19 bp, Homo sapiens
ctgctagtgagccttccca

SEQ ID NO: 5054176 - DNA, 16 bp, Homo sapiens
ctgctctccttgccct

SEQ ID NO: 5054177 - DNA, 13 bp, Homo sapiens
ctgctctgccact

SEQ ID NO: 5054178 - DNA, 19 bp, Homo sapiens
ctgctgcttctgggcctga

SEQ ID NO: 5054179 - DNA, 14 bp, Homo sapiens
ctgcttctccagcc

SEQ ID NO: 5054180 - DNA, 22 bp, Homo sapiens
ctgcttttggggctcttgatca

SEQ ID NO: 5054181 - DNA, 16 bp, Homo sapiens
ctggaaaccacagtcc

SEQ ID NO: 5054182 - DNA, 21 bp, Homo sapiens
ctggaagaaagccctgtgctt

SEQ ID NO: 5054183 - DNA, 15 bp, Homo sapiens
ctggaccccaggcca

SEQ ID NO: 5054184 - DNA, 18 bp, Homo sapiens
ctggagatggctgctgct

SEQ ID NO: 5054185 - DNA, 22 bp, Homo sapiens
ctggagatggctgctgctcacc

SEQ ID NO: 5054186 - DNA, 12 bp, Homo sapiens
ctggagcccctg

SEQ ID NO: 5054187 - DNA, 19 bp, Homo sapiens
ctggagcccctgtgtggga

SEQ ID NO: 5054188 - DNA, 14 bp, Homo sapiens
ctggagtgctggct

SEQ ID NO: 5054189 - DNA, 13 bp, Homo sapiens
ctggcgggatggg

SEQ ID NO: 5054190 - DNA, 17 bp, Homo sapiens
ctggctccacgccctgg

SEQ ID NO: 5054191 - DNA, 20 bp, Homo sapiens
ctggctccacgccctgggga

SEQ ID NO: 5054192 - DNA, 23 bp, Homo sapiens
ctggctccacgccctggggagtg

SEQ ID NO: 5054193 - DNA, 17 bp, Homo sapiens
ctggctcccaagggagg

SEQ ID NO: 5054194 - DNA, 18 bp, Homo sapiens
ctggctcccaagggaggc

SEQ ID NO: 5054195 - DNA, 16 bp, Homo sapiens
ctggcttcctagccta

SEQ ID NO: 5054196 - DNA, 15 bp, Homo sapiens
ctgggaacggggtgg

SEQ ID NO: 5054197 - DNA, 17 bp, Homo sapiens
ctgggcaggtcctgggg

SEQ ID NO: 5054198 - DNA, 14 bp, Homo sapiens
ctgggcatctgttc

SEQ ID NO: 5054199 - DNA, 21 bp, Homo sapiens
ctgggccctgcaggaggcctg

SEQ ID NO: 5054200 - DNA, 14 bp, Homo sapiens
ctgggcctgatgga

SEQ ID NO: 5054201 - DNA, 17 bp, Homo sapiens
ctgggcctgatggagag

SEQ ID NO: 5054202 - DNA, 14 bp, Homo sapiens
ctggggaaggacca

SEQ ID NO: 5054203 - DNA, 19 bp, Homo sapiens
ctggggaggctgagactgc

SEQ ID NO: 5054204 - DNA, 17 bp, Homo sapiens
ctggggagtgagcttgg

SEQ ID NO: 5054205 - DNA, 21 bp, Homo sapiens
ctggggtgggtttagcaggct

SEQ ID NO: 5054206 - DNA, 14 bp, Homo sapiens
ctggtgaagtgtga

SEQ ID NO: 5054207 - DNA, 14 bp, Homo sapiens
ctgtaggagagact

SEQ ID NO: 5054208 - DNA, 19 bp, Homo sapiens
ctgtaggcgcccctggggt

SEQ ID NO: 5054209 - DNA, 18 bp, Homo sapiens
ctgtcacggaacagatct

SEQ ID NO: 5054210 - DNA, 19 bp, Homo sapiens
ctgtcacggaacagatctt

SEQ ID NO: 5054211 - DNA, 21 bp, Homo sapiens
ctgtcccaggggtctccctga

SEQ ID NO: 5054212 - DNA, 17 bp, Homo sapiens
ctgtcccctcagctcca

SEQ ID NO: 5054213 - DNA, 13 bp, Homo sapiens
ctgtctgtgcaga

SEQ ID NO: 5054214 - DNA, 16 bp, Homo sapiens
ctgtcttgactgtcac

SEQ ID NO: 5054215 - DNA, 20 bp, Homo sapiens
ctgtgcagatgctttgccca

SEQ ID NO: 5054216 - DNA, 19 bp, Homo sapiens
ctgtgtcagcatctttgcc

SEQ ID NO: 5054217 - DNA, 20 bp, Homo sapiens
ctgtgtcagcatctttgccc

SEQ ID NO: 5054218 - DNA, 21 bp, Homo sapiens
ctgtgtcagcatctttgccct

SEQ ID NO: 5054219 - DNA, 23 bp, Homo sapiens
ctgtgtcggggggcgagggaggg

SEQ ID NO: 5054220 - DNA, 15 bp, Homo sapiens
ctgttagctgctcac

SEQ ID NO: 5054221 - DNA, 16 bp, Homo sapiens
ctgttagctgctcact

SEQ ID NO: 5054222 - DNA, 12 bp, Homo sapiens
ctgttcccccgc

SEQ ID NO: 5054223 - DNA, 23 bp, Homo sapiens
ctgttcccccgccgcttttctcc

SEQ ID NO: 5054224 - DNA, 19 bp, Homo sapiens
ctgttctgtaggagagact

SEQ ID NO: 5054225 - DNA, 22 bp, Homo sapiens
cttaaaccacacacacaaggtg

SEQ ID NO: 5054226 - DNA, 16 bp, Homo sapiens
cttaaggagaggagag

SEQ ID NO: 5054227 - DNA, 19 bp, Homo sapiens
cttataaattctgttagct

SEQ ID NO: 5054228 - DNA, 16 bp, Homo sapiens
cttcagccaagaccat

SEQ ID NO: 5054229 - DNA, 12 bp, Homo sapiens
cttctccagcct

SEQ ID NO: 5054230 - DNA, 14 bp, Homo sapiens
cttctgagctgtct

SEQ ID NO: 5054231 - DNA, 23 bp, Homo sapiens
gatgaaaacaaaatcacagcacc

SEQ ID NO: 5054232 - DNA, 15 bp, Homo sapiens
gatgcactggcctgt

SEQ ID NO: 5054233 - DNA, 17 bp, Homo sapiens
gatggaaggagagaggt

SEQ ID NO: 5054234 - DNA, 15 bp, Homo sapiens
gatggctgctgctca

SEQ ID NO: 5054235 - DNA, 17 bp, Homo sapiens
gttctcagctccccctg

SEQ ID NO: 5054236 - DNA, 22 bp, Homo sapiens
gttctgagcccccacctgcctg

SEQ ID NO: 5054237 - DNA, 19 bp, Homo sapiens
gttctgtaggagagactgg

SEQ ID NO: 5054238 - DNA, 22 bp, Homo sapiens
gttctgtaggagagactggcca

SEQ ID NO: 5054239 - DNA, 17 bp, Homo sapiens
gttgcaggtgtccgggg

SEQ ID NO: 5054240 - DNA, 11 bp, Homo sapiens
gttgccacagg

SEQ ID NO: 5054241 - DNA, 15 bp, Homo sapiens
gttgccacaggcctc

SEQ ID NO: 5054242 - DNA, 19 bp, Homo sapiens
gttgccacaggcctccctg

SEQ ID NO: 5054243 - DNA, 15 bp, Homo sapiens
gttgccgggcctgga

SEQ ID NO: 5054244 - DNA, 12 bp, Homo sapiens
gttggctggggg

SEQ ID NO: 5054245 - DNA, 18 bp, Homo sapiens
gtttacagggagcctcct

SEQ ID NO: 5054246 - DNA, 19 bp, Homo sapiens
gtttacagggagcctcctg

SEQ ID NO: 5054247 - DNA, 20 bp, Homo sapiens
gtttacagggagcctcctgc

SEQ ID NO: 5054248 - DNA, 21 bp, Homo sapiens
gtttgaagcctgcccttgtct

SEQ ID NO: 5054249 - DNA, 20 bp, Homo sapiens
gttttcaggggctttggaag

SEQ ID NO: 5054250 - DNA, 20 bp, Homo sapiens
taaaaaccaaactctgtgtc

SEQ ID NO: 5054251 - DNA, 21 bp, Homo sapiens
taaaaaccaaactctgtgtca

SEQ ID NO: 5054252 - DNA, 18 bp, Homo sapiens
taaaataaaggctctgtg

SEQ ID NO: 5054253 - DNA, 19 bp, Homo sapiens
taaaataaaggctctgtgc

SEQ ID NO: 5054254 - DNA, 21 bp, Homo sapiens
taaaccacacacacaaggtgc

SEQ ID NO: 5054255 - DNA, 17 bp, Homo sapiens
taaacttccctctagtt

SEQ ID NO: 5054256 - DNA, 19 bp, Homo sapiens
taaagattgctttatccag

SEQ ID NO: 5054257 - DNA, 13 bp, Homo sapiens
taaaggctctgtg

SEQ ID NO: 5054258 - DNA, 12 bp, Homo sapiens
taaatcatattc

SEQ ID NO: 5054259 - DNA, 15 bp, Homo sapiens
taaatcatattctca

SEQ ID NO: 5054260 - DNA, 16 bp, Homo sapiens
taaatcatattctcat

SEQ ID NO: 5054261 - DNA, 22 bp, Homo sapiens
taaattctgttagctgctcact

SEQ ID NO: 5054262 - DNA, 20 bp, Homo sapiens
taaccattgtcttgttctgt

SEQ ID NO: 5054263 - DNA, 14 bp, Homo sapiens
taaccccagctgcc

SEQ ID NO: 5054264 - DNA, 22 bp, Homo sapiens
caggattgtacgtgggagaggc

SEQ ID NO: 5054265 - DNA, 15 bp, Homo sapiens
caggcagaggagagt

SEQ ID NO: 5054266 - DNA, 20 bp, Homo sapiens
caggcctcatgcctcgctca

SEQ ID NO: 5054267 - DNA, 13 bp, Homo sapiens
caggcctccctgt

SEQ ID NO: 5054268 - DNA, 17 bp, Homo sapiens
caggctgcagcaggcag

SEQ ID NO: 5054269 - DNA, 21 bp, Homo sapiens
caggctgcagcaggcagagga

SEQ ID NO: 5054270 - DNA, 23 bp, Homo sapiens
caggctgcagcaggcagaggaga

SEQ ID NO: 5054271 - DNA, 13 bp, Homo sapiens
cagggacaggaga

SEQ ID NO: 5054272 - DNA, 12 bp, Homo sapiens
cagggctgggca

SEQ ID NO: 5054273 - DNA, 14 bp, Homo sapiens
caggggagtctgct

SEQ ID NO: 5054274 - DNA, 21 bp, Homo sapiens
caggggctttggaagctctgt

SEQ ID NO: 5054275 - DNA, 13 bp, Homo sapiens
caggggtctccct

SEQ ID NO: 5054276 - DNA, 13 bp, Homo sapiens
cagggtggccagg

SEQ ID NO: 5054277 - DNA, 15 bp, Homo sapiens
caggtcctggggagg

SEQ ID NO: 5054278 - DNA, 23 bp, Homo sapiens
caggtcctggggaggctgagact

SEQ ID NO: 5054279 - DNA, 20 bp, Homo sapiens
caggtgctagggtgcctgct

SEQ ID NO: 5054280 - DNA, 22 bp, Homo sapiens
cagtgcactaaccccagctgcc

SEQ ID NO: 5054281 - DNA, 19 bp, Homo sapiens
cagtgtgctaacctcactg

SEQ ID NO: 5054282 - DNA, 13 bp, Homo sapiens
cagtgttctgagc

SEQ ID NO: 5054283 - DNA, 15 bp, Homo sapiens
cagtgttctgagccc

SEQ ID NO: 5054284 - DNA, 22 bp, Homo sapiens
cagtgttctgagcccccacctg

SEQ ID NO: 5054285 - DNA, 18 bp, Homo sapiens
cagtgttgactgtaggcg

SEQ ID NO: 5054286 - DNA, 17 bp, Homo sapiens
catagagtgacctttta

SEQ ID NO: 5054287 - DNA, 14 bp, Homo sapiens
catattcatcagca

SEQ ID NO: 5054288 - DNA, 17 bp, Homo sapiens
catattctcatggcttt

SEQ ID NO: 5054289 - DNA, 11 bp, Homo sapiens
catcagcagga

SEQ ID NO: 5054290 - DNA, 14 bp, Homo sapiens
catcagcaggagtg

SEQ ID NO: 5054291 - DNA, 18 bp, Homo sapiens
catcatccattctctctg

SEQ ID NO: 5054292 - DNA, 19 bp, Homo sapiens
catcatccattctctctgc

SEQ ID NO: 5054293 - DNA, 21 bp, Homo sapiens
catcatctcttttcccactcc

SEQ ID NO: 5054294 - DNA, 15 bp, Homo sapiens
catccattctctctg

SEQ ID NO: 5054295 - DNA, 20 bp, Homo sapiens
catctctccctcctggtgaa

SEQ ID NO: 5054296 - DNA, 19 bp, Homo sapiens
catctctgctgcttctggg

SEQ ID NO: 5054297 - DNA, 20 bp, Homo sapiens
catctctgctgcttctgggc

SEQ ID NO: 5054298 - DNA, 22 bp, Homo sapiens
catctctgctgcttctgggcct

SEQ ID NO: 5054299 - DNA, 21 bp, Homo sapiens
catctgaagccacctctctgc

SEQ ID NO: 5054300 - DNA, 14 bp, Homo sapiens
catctgctctgaga

SEQ ID NO: 5054301 - DNA, 22 bp, Homo sapiens
catgagtgtcaactccaggact

SEQ ID NO: 5054302 - DNA, 10 bp, Homo sapiens
catgccctgc

SEQ ID NO: 5054303 - DNA, 20 bp, Homo sapiens
catgccctgccaagcctgga

SEQ ID NO: 5054304 - DNA, 15 bp, Homo sapiens
catgcgaattcttgc

SEQ ID NO: 5054305 - DNA, 17 bp, Homo sapiens
catgctgagtctcccaa

SEQ ID NO: 5054306 - DNA, 19 bp, Homo sapiens
catgctgagtctcccaagg

SEQ ID NO: 5054307 - DNA, 22 bp, Homo sapiens
catggcatcatccattctctct

SEQ ID NO: 5054308 - DNA, 13 bp, Homo sapiens
catgggggaggct

SEQ ID NO: 5054309 - DNA, 16 bp, Homo sapiens
catgggggaggctctg

SEQ ID NO: 5054310 - DNA, 20 bp, Homo sapiens
catgggggaggctctgaaga

SEQ ID NO: 5054311 - DNA, 21 bp, Homo sapiens
tgtttacagggagcctcctgc

SEQ ID NO: 5054312 - DNA, 16 bp, Homo sapiens
ttaaacgcctccttca

SEQ ID NO: 5054313 - DNA, 14 bp, Homo sapiens
ttaaagtgccttca

SEQ ID NO: 5054314 - DNA, 13 bp, Homo sapiens
ttaaccattgtct

SEQ ID NO: 5054315 - DNA, 14 bp, Homo sapiens
ttaaggagaggaga

SEQ ID NO: 5054316 - DNA, 18 bp, Homo sapiens
ttacagggagcctcctgc

SEQ ID NO: 5054317 - DNA, 20 bp, Homo sapiens
ttacagggagcctcctgccc

SEQ ID NO: 5054318 - DNA, 21 bp, Homo sapiens
ttacagggagcctcctgccca

SEQ ID NO: 5054319 - DNA, 16 bp, Homo sapiens
ttacatttttctgatg

SEQ ID NO: 5054320 - DNA, 17 bp, Homo sapiens
ttacatttttctgatgg

SEQ ID NO: 5054321 - DNA, 19 bp, Homo sapiens
ttacctgtcatctgggcca

SEQ ID NO: 5054322 - DNA, 19 bp, Homo sapiens
ttagagaaggctcagcctt

SEQ ID NO: 5054323 - DNA, 13 bp, Homo sapiens
ttagctgctcact

SEQ ID NO: 5054324 - DNA, 15 bp, Homo sapiens
ttcagcaaatgcctt

SEQ ID NO: 5054325 - DNA, 16 bp, Homo sapiens
ttcagcaaatgccttt

SEQ ID NO: 5054326 - DNA, 19 bp, Homo sapiens
ttcagcaaatgccttttca

SEQ ID NO: 5054327 - DNA, 15 bp, Homo sapiens
ttcaggttgtgcatt

SEQ ID NO: 5054328 - DNA, 19 bp, Homo sapiens
ttccaagcccttccctctg

SEQ ID NO: 5054329 - DNA, 18 bp, Homo sapiens
ttcccatgttgactgtct

SEQ ID NO: 5054330 - DNA, 23 bp, Homo sapiens
ttcccccgccgcttttctcctct

SEQ ID NO: 5054331 - DNA, 12 bp, Homo sapiens
ttccgctcccac

SEQ ID NO: 5054332 - DNA, 18 bp, Homo sapiens
ttccggggaggagccttg

SEQ ID NO: 5054333 - DNA, 18 bp, Homo sapiens
ttcctctctttgttctca

SEQ ID NO: 5054334 - DNA, 22 bp, Homo sapiens
ttcctctctttgttctcagctc

SEQ ID NO: 5054335 - DNA, 23 bp, Homo sapiens
ttcctgatgacagaacacagatc

SEQ ID NO: 5054336 - DNA, 21 bp, Homo sapiens
ttcgcacaatctacactgcct

SEQ ID NO: 5054337 - DNA, 19 bp, Homo sapiens
ttctaatttattttctcaa

SEQ ID NO: 5054338 - DNA, 14 bp, Homo sapiens
ttctcagctccccc

SEQ ID NO: 5054339 - DNA, 16 bp, Homo sapiens
ttctcagctccccctg

SEQ ID NO: 5054340 - DNA, 17 bp, Homo sapiens
ttctcagctccccctgt

SEQ ID NO: 5054341 - DNA, 22 bp, Homo sapiens
ttctcatggctttgttaaactt

SEQ ID NO: 5054342 - DNA, 20 bp, Homo sapiens
ttctctcttataaattctgt

SEQ ID NO: 5054343 - DNA, 10 bp, Homo sapiens
ttctgagccc

SEQ ID NO: 5054344 - DNA, 22 bp, Homo sapiens
ttctgccccacacccagccagc

SEQ ID NO: 5054345 - DNA, 18 bp, Homo sapiens
ttctgcctgcctgggaac

SEQ ID NO: 5054346 - DNA, 16 bp, Homo sapiens
ttctgcggtgaggcag

SEQ ID NO: 5054347 - DNA, 14 bp, Homo sapiens
ttctgtaggagaga

SEQ ID NO: 5054348 - DNA, 21 bp, Homo sapiens
ttctgtaggagagactggcca

SEQ ID NO: 5054349 - DNA, 14 bp, Homo sapiens
ttctgttagctgct

SEQ ID NO: 5054350 - DNA, 16 bp, Homo sapiens
ttctgttagctgctca

SEQ ID NO: 5054351 - DNA, 14 bp, Homo sapiens
ttcttgccctgagc

SEQ ID NO: 5054352 - DNA, 21 bp, Homo sapiens
ttgaagcctgcccttgtctga

SEQ ID NO: 5054353 - DNA, 21 bp, Homo sapiens
ttgagccagttacctttgctg

SEQ ID NO: 5054354 - DNA, 15 bp, Homo sapiens
ttgccacaggcctcc

SEQ ID NO: 5054355 - DNA, 19 bp, Homo sapiens
ttgcccaacaccagcccct

SEQ ID NO: 5054356 - DNA, 12 bp, Homo sapiens
ttgccctgggcc

SEQ ID NO: 5054357 - DNA, 13 bp, Homo sapiens
ttgccgggcctgg

SEQ ID NO: 5054358 - DNA, 23 bp, Homo sapiens
ttgctccctgattaaagtgcctt

SEQ ID NO: 5054359 - DNA, 17 bp, Homo sapiens
ttgctgtcatgtgaatc

SEQ ID NO: 5054360 - DNA, 22 bp, Homo sapiens
ttgcttccaagcccttccctct

SEQ ID NO: 5054361 - DNA, 18 bp, Homo sapiens
ttgctttatccagcagtc

SEQ ID NO: 5054362 - DNA, 23 bp, Homo sapiens
ttggaaattgggtgtgccctggc

SEQ ID NO: 5054363 - DNA, 22 bp, Homo sapiens
ttggaaggtagagcccactgct

SEQ ID NO: 5054364 - DNA, 20 bp, Homo sapiens
ttgggcttctgcggtgaggc

SEQ ID NO: 5054365 - DNA, 15 bp, Homo sapiens
ttggggctcttgatc

SEQ ID NO: 5054366 - DNA, 16 bp, Homo sapiens
ttggggctcttgatca

SEQ ID NO: 5054367 - DNA, 14 bp, Homo sapiens
ttgggtcagctggc

SEQ ID NO: 5054368 - DNA, 15 bp, Homo sapiens
ttgggtgtgccctgg

SEQ ID NO: 5054369 - DNA, 15 bp, Homo sapiens
ttgtaccccccaacc

SEQ ID NO: 5054370 - DNA, 20 bp, Homo sapiens
ttgtaccccccaacccctga

SEQ ID NO: 5054371 - DNA, 21 bp, Homo sapiens
ttgtaccccccaacccctgag

SEQ ID NO: 5054372 - DNA, 15 bp, Homo sapiens
ttgtacgtgggagag

SEQ ID NO: 5054373 - DNA, 13 bp, Homo sapiens
ttgtgcattttgt

SEQ ID NO: 5054374 - DNA, 12 bp, Homo sapiens
ttgttctttgct

SEQ ID NO: 5054375 - DNA, 22 bp, Homo sapiens
tttaaccattgtcttgttctgt

SEQ ID NO: 5054376 - DNA, 20 bp, Homo sapiens
tttacagggagcctcctgcc

SEQ ID NO: 5054377 - DNA, 22 bp, Homo sapiens
tttacagggagcctcctgccca

SEQ ID NO: 5054378 - DNA, 23 bp, Homo sapiens
tttatcagagtaacgagaagaca

SEQ ID NO: 5054379 - DNA, 16 bp, Homo sapiens
tttcaaatgcagcaat

SEQ ID NO: 5054380 - DNA, 20 bp, Homo sapiens
tttcaggggctttggaagct

SEQ ID NO: 5054381 - DNA, 16 bp, Homo sapiens
tttcaggttgtgcatt

SEQ ID NO: 5054382 - DNA, 15 bp, Homo sapiens
tttcccactcccttt

SEQ ID NO: 5054383 - DNA, 13 bp, Homo sapiens
tttcctgatgaca

SEQ ID NO: 5054384 - DNA, 22 bp, Homo sapiens
tttgaagcctgcccttgtctga

SEQ ID NO: 5054385 - DNA, 23 bp, Homo sapiens
tttgcccaacaccagcccctgcc

SEQ ID NO: 5054386 - DNA, 14 bp, Homo sapiens
tttgctggagtgct

SEQ ID NO: 5054387 - DNA, 19 bp, Homo sapiens
tttgtaccccccaacccct

SEQ ID NO: 5054388 - DNA, 17 bp, Homo sapiens
ttttacatttttctgat

SEQ ID NO: 5054389 - DNA, 23 bp, Homo sapiens
ttttcaaatgcagcaatcccact

SEQ ID NO: 5054390 - DNA, 22 bp, Homo sapiens
ttttctaatttattttctcaat

SEQ ID NO: 5054391 - DNA, 18 bp, Homo sapiens
ttttggggctcttgatca

SEQ ID NO: 5054392 - DNA, 13 bp, Homo sapiens
ttttgtgtgatgc

SEQ ID NO: 5054393 - DNA, 12 bp, Homo sapiens
agcagtcaatta

SEQ ID NO: 5054394 - DNA, 22 bp, Homo sapiens
agcatcattcagcaaatgcctt

SEQ ID NO: 5054395 - DNA, 13 bp, Homo sapiens
agcatctgctctg

SEQ ID NO: 5054396 - DNA, 15 bp, Homo sapiens
agcatctttgccctt

SEQ ID NO: 5054397 - DNA, 16 bp, Homo sapiens
agcatctttgcccttc

SEQ ID NO: 5054398 - DNA, 17 bp, Homo sapiens
agcatgtgggggaaggc

SEQ ID NO: 5054399 - DNA, 13 bp, Homo sapiens
agcattctgcctg

SEQ ID NO: 5054400 - DNA, 20 bp, Homo sapiens
agccaagaccatctctccct

SEQ ID NO: 5054401 - DNA, 17 bp, Homo sapiens
agccacctctctgcctg

SEQ ID NO: 5054402 - DNA, 13 bp, Homo sapiens
agccacctgggct

SEQ ID NO: 5054403 - DNA, 14 bp, Homo sapiens
agccacgaggtggt

SEQ ID NO: 5054404 - DNA, 15 bp, Homo sapiens
agccagctcctttcc

SEQ ID NO: 5054405 - DNA, 21 bp, Homo sapiens
agccagttacctttgctgtca

SEQ ID NO: 5054406 - DNA, 16 bp, Homo sapiens
agccatctgaagccac

SEQ ID NO: 5054407 - DNA, 17 bp, Homo sapiens
agcccaagtccaaatgt

SEQ ID NO: 5054408 - DNA, 12 bp, Homo sapiens
agcccactgctc

SEQ ID NO: 5054409 - DNA, 14 bp, Homo sapiens
agccccaggaccaa

SEQ ID NO: 5054410 - DNA, 15 bp, Homo sapiens
agcccctgccccagc

SEQ ID NO: 5054411 - DNA, 17 bp, Homo sapiens
agcccctgccccagccc

SEQ ID NO: 5054412 - DNA, 21 bp, Homo sapiens
agcccctgccccagcccaagt

SEQ ID NO: 5054413 - DNA, 18 bp, Homo sapiens
agcccctgtgtgggaggg

SEQ ID NO: 5054414 - DNA, 19 bp, Homo sapiens
agcccctgtgtgggagggc

SEQ ID NO: 5054415 - DNA, 23 bp, Homo sapiens
agcctccgttcccacctctgagg

SEQ ID NO: 5054416 - DNA, 13 bp, Homo sapiens
agcctgctctgcc

SEQ ID NO: 5054417 - DNA, 17 bp, Homo sapiens
agcctgctctgccactg

SEQ ID NO: 5054418 - DNA, 15 bp, Homo sapiens
agcctggacccccag

SEQ ID NO: 5054419 - DNA, 11 bp, Homo sapiens
agcctggagcc

SEQ ID NO: 5054420 - DNA, 15 bp, Homo sapiens
agcctggagcccctg

SEQ ID NO: 5054421 - DNA, 13 bp, Homo sapiens
agccttggagtgt

SEQ ID NO: 5054422 - DNA, 15 bp, Homo sapiens
agctccccctgtccc

SEQ ID NO: 5054423 - DNA, 17 bp, Homo sapiens
agctccccctgtcccct

SEQ ID NO: 5054424 - DNA, 23 bp, Homo sapiens
agctccccctgtcccctcagctc

SEQ ID NO: 5054425 - DNA, 12 bp, Homo sapiens
agctctgagccc

SEQ ID NO: 5054426 - DNA, 15 bp, Homo sapiens
agctgctagtgagcc

SEQ ID NO: 5054427 - DNA, 15 bp, Homo sapiens
agctggcttcctagc

SEQ ID NO: 5054428 - DNA, 16 bp, Homo sapiens
agctgggctgttggct

SEQ ID NO: 5054429 - DNA, 18 bp, Homo sapiens
agctttccggggaggagc

SEQ ID NO: 5054430 - DNA, 22 bp, Homo sapiens
agctttgcccaacaccagcccc

SEQ ID NO: 5054431 - DNA, 22 bp, Homo sapiens
aggaagatgggggcaagaagat

SEQ ID NO: 5054432 - DNA, 12 bp, Homo sapiens
aggactctggac

SEQ ID NO: 5054433 - DNA, 16 bp, Homo sapiens
aggactttagggatct

SEQ ID NO: 5054434 - DNA, 16 bp, Homo sapiens
aggagagactggccag

SEQ ID NO: 5054435 - DNA, 18 bp, Homo sapiens
aggagagcatctgctctg

SEQ ID NO: 5054436 - DNA, 19 bp, Homo sapiens
aggagagcatctgctctga

SEQ ID NO: 5054437 - DNA, 12 bp, Homo sapiens
aggagaggagag

SEQ ID NO: 5054438 - DNA, 18 bp, Homo sapiens
aggagaggagagcatctg

SEQ ID NO: 5054439 - DNA, 20 bp, Homo sapiens
aggagagtacccccctgaga

SEQ ID NO: 5054440 - DNA, 16 bp, Homo sapiens
aggagccacctgggct

SEQ ID NO: 5054441 - DNA, 23 bp, Homo sapiens
aggagccacctgggctgggagaa

SEQ ID NO: 5054442 - DNA, 14 bp, Homo sapiens
aggagccttggagt

SEQ ID NO: 5054443 - DNA, 14 bp, Homo sapiens
aggaggcctgggag

SEQ ID NO: 5054444 - DNA, 16 bp, Homo sapiens
aggaggcctgggaggg

SEQ ID NO: 5054445 - DNA, 17 bp, Homo sapiens
aggaggcctgggagggc

SEQ ID NO: 5054446 - DNA, 12 bp, Homo sapiens
aggatgcactgg

SEQ ID NO: 5054447 - DNA, 17 bp, Homo sapiens
aggcagaaagggtaggt

SEQ ID NO: 5054448 - DNA, 16 bp, Homo sapiens
aggcaggggagtctgc

SEQ ID NO: 5054449 - DNA, 17 bp, Homo sapiens
aggcaggggagtctgct

SEQ ID NO: 5054450 - DNA, 18 bp, Homo sapiens
aggcaggggagtctgctt

SEQ ID NO: 5054451 - DNA, 18 bp, Homo sapiens
aggccataccaggtgcta

SEQ ID NO: 5054452 - DNA, 13 bp, Homo sapiens
aggcctccctgtt

SEQ ID NO: 5054453 - DNA, 15 bp, Homo sapiens
aggcctgggagggca

SEQ ID NO: 5054454 - DNA, 17 bp, Homo sapiens
aggcctgggagggcaag

SEQ ID NO: 5054455 - DNA, 15 bp, Homo sapiens
aggcgcccctggggt

SEQ ID NO: 5054456 - DNA, 18 bp, Homo sapiens
aggcgggggagcctggag

SEQ ID NO: 5054457 - DNA, 21 bp, Homo sapiens
aggcgggggagcctggagccc

SEQ ID NO: 5054458 - DNA, 17 bp, Homo sapiens
aggcgggggatcctgga

SEQ ID NO: 5054459 - DNA, 18 bp, Homo sapiens
aggcgggggatcctggag

SEQ ID NO: 5054460 - DNA, 22 bp, Homo sapiens
aggcgggggatcctggagcccc

SEQ ID NO: 5054461 - DNA, 17 bp, Homo sapiens
aggctgagactgcagag

SEQ ID NO: 5054462 - DNA, 19 bp, Homo sapiens
aggctgagactgcagagga

SEQ ID NO: 5054463 - DNA, 18 bp, Homo sapiens
aggctgcagcaggcagag

SEQ ID NO: 5054464 - DNA, 21 bp, Homo sapiens
aggctgcagcaggcagaggag

SEQ ID NO: 5054465 - DNA, 12 bp, Homo sapiens
agggacaggaga

SEQ ID NO: 5054466 - DNA, 15 bp, Homo sapiens
agggagggactggga

SEQ ID NO: 5054467 - DNA, 14 bp, Homo sapiens
agggaggggaggtg

SEQ ID NO: 5054468 - DNA, 13 bp, Homo sapiens
agggatctgggga

SEQ ID NO: 5054469 - DNA, 16 bp, Homo sapiens
agggatctggggaagg

SEQ ID NO: 5054470 - DNA, 19 bp, Homo sapiens
agggcagttctgcacccag

SEQ ID NO: 5054471 - DNA, 21 bp, Homo sapiens
agggcgaggcgggggatcctg

SEQ ID NO: 5054472 - DNA, 21 bp, Homo sapiens
agggctgggcaggtcctgggg

SEQ ID NO: 5054473 - DNA, 16 bp, Homo sapiens
aggggagtctgcttgt

SEQ ID NO: 5054474 - DNA, 18 bp, Homo sapiens
aggggagtctgcttgtct

SEQ ID NO: 5054475 - DNA, 22 bp, Homo sapiens
aggggcaggaatcaaggagcct

SEQ ID NO: 5054476 - DNA, 16 bp, Homo sapiens
aggggcccctgcttct

SEQ ID NO: 5054477 - DNA, 21 bp, Homo sapiens
aggggcccctgcttctccagc

SEQ ID NO: 5054478 - DNA, 20 bp, Homo sapiens
aggggctttggaagctctgt

SEQ ID NO: 5054479 - DNA, 16 bp, Homo sapiens
aggggtctccctgagc

SEQ ID NO: 5054480 - DNA, 21 bp, Homo sapiens
aggggtctccctgagcctgcc

SEQ ID NO: 5054481 - DNA, 23 bp, Homo sapiens
aggggtctccctgagcctgcccc

SEQ ID NO: 5054482 - DNA, 12 bp, Homo sapiens
agggtgcctgct

SEQ ID NO: 5054483 - DNA, 14 bp, Homo sapiens
agggtgcctgctct

SEQ ID NO: 5054484 - DNA, 17 bp, Homo sapiens
agggtgcctgctctcct

SEQ ID NO: 5054485 - DNA, 21 bp, Homo sapiens
aggtgaccccatctctgctgc

SEQ ID NO: 5054486 - DNA, 11 bp, Homo sapiens
aggtgctcaga

SEQ ID NO: 5054487 - DNA, 13 bp, Homo sapiens
aggtgctggcctc

SEQ ID NO: 5054488 - DNA, 23 bp, Homo sapiens
aggtgggggagcctggagcccct

SEQ ID NO: 5054489 - DNA, 17 bp, Homo sapiens
aggtggtagctctgagc

SEQ ID NO: 5054490 - DNA, 23 bp, Homo sapiens
aggtggtagctctgagccctcct

SEQ ID NO: 5054491 - DNA, 17 bp, Homo sapiens
aggtgtctagaggcaac

SEQ ID NO: 5054492 - DNA, 14 bp, Homo sapiens
agtaacgagaagac

SEQ ID NO: 5054493 - DNA, 19 bp, Homo sapiens
agtacccccctgagagcat

SEQ ID NO: 5054494 - DNA, 16 bp, Homo sapiens
agtataattttctaat

SEQ ID NO: 5054495 - DNA, 13 bp, Homo sapiens
agtatctggctgg

SEQ ID NO: 5054496 - DNA, 24 bp, Homo sapiens
agtcagtgcactaaccccagctgc

SEQ ID NO: 5054497 - DNA, 15 bp, Homo sapiens
agtcccccaacccca

SEQ ID NO: 5054498 - DNA, 15 bp, Homo sapiens
agtctcacatattca

SEQ ID NO: 5054499 - DNA, 19 bp, Homo sapiens
tgccctgccaagcctggag

SEQ ID NO: 5054500 - DNA, 20 bp, Homo sapiens
tgccctgccaagcctggagc

SEQ ID NO: 5054501 - DNA, 16 bp, Homo sapiens
tgccctgggccagccc

SEQ ID NO: 5054502 - DNA, 18 bp, Homo sapiens
tgcctgaccatcccatga

SEQ ID NO: 5054503 - DNA, 23 bp, Homo sapiens
tgcctgaccatcccatgagcagt

SEQ ID NO: 5054504 - DNA, 14 bp, Homo sapiens
tgcctgttcctccc

SEQ ID NO: 5054505 - DNA, 15 bp, Homo sapiens
tgccttaccttcact

SEQ ID NO: 5054506 - DNA, 13 bp, Homo sapiens
tgcggtaggtgct

SEQ ID NO: 5054507 - DNA, 17 bp, Homo sapiens
tgcggtaggtgctggcc

SEQ ID NO: 5054508 - DNA, 19 bp, Homo sapiens
tgcggtaggtgctggcctc

SEQ ID NO: 5054509 - DNA, 16 bp, Homo sapiens
tgcggtgaggcagggg

SEQ ID NO: 5054510 - DNA, 23 bp, Homo sapiens
tgcggtgaggcaggggagtctgc

SEQ ID NO: 5054511 - DNA, 13 bp, Homo sapiens
tgcgtcaggagca

SEQ ID NO: 5054512 - DNA, 19 bp, Homo sapiens
tgcgtcaggagcagcatca

SEQ ID NO: 5054513 - DNA, 23 bp, Homo sapiens
tgcgtctggaggggcccctgctt

SEQ ID NO: 5054514 - DNA, 17 bp, Homo sapiens
tgctaacctcactgcct

SEQ ID NO: 5054515 - DNA, 16 bp, Homo sapiens
tgctagggtgcctgct

SEQ ID NO: 5054516 - DNA, 19 bp, Homo sapiens
tgctagtgagccttcccat

SEQ ID NO: 5054517 - DNA, 21 bp, Homo sapiens
tgctcacttaaacaatgtcct

SEQ ID NO: 5054518 - DNA, 22 bp, Homo sapiens
tgctccctgattaaagtgcctt

SEQ ID NO: 5054519 - DNA, 17 bp, Homo sapiens
tgctctccttgccctgg

SEQ ID NO: 5054520 - DNA, 18 bp, Homo sapiens
tgctctccttgccctggg

SEQ ID NO: 5054521 - DNA, 20 bp, Homo sapiens
tgctctccttgccctgggcc

SEQ ID NO: 5054522 - DNA, 22 bp, Homo sapiens
tgctctgagacggatggaagga

SEQ ID NO: 5054523 - DNA, 16 bp, Homo sapiens
tgctctgtatgtgttc

SEQ ID NO: 5054524 - DNA, 9 bp, Homo sapiens
aaagacaga

SEQ ID NO: 5054525 - DNA, 14 bp, Homo sapiens
aaatgtaagatcgt

SEQ ID NO: 5054526 - DNA, 16 bp, Homo sapiens
aagatcgttctctgcc

SEQ ID NO: 5054527 - DNA, 21 bp, Homo sapiens
aagtaatccacctgcctcggc

SEQ ID NO: 5054528 - DNA, 11 bp, Homo sapiens
aataaagacag

SEQ ID NO: 5054529 - DNA, 13 bp, Homo sapiens
aatctttctgcag

SEQ ID NO: 5054530 - DNA, 15 bp, Homo sapiens
acaagccagctggag

SEQ ID NO: 5054531 - DNA, 11 bp, Homo sapiens
agacagagtct

SEQ ID NO: 5054532 - DNA, 12 bp, Homo sapiens
agcctcatctct

SEQ ID NO: 5054533 - DNA, 14 bp, Homo sapiens
agtaatccacctgc

SEQ ID NO: 5054534 - DNA, 19 bp, Homo sapiens
agtctcgctctgttgccca

SEQ ID NO: 5054535 - DNA, 17 bp, Homo sapiens
agtgctgggattacagg

SEQ ID NO: 5054536 - DNA, 17 bp, Homo sapiens
atatgcagttttcctta

SEQ ID NO: 5054537 - DNA, 14 bp, Homo sapiens
atcgttctctgcct

SEQ ID NO: 5054538 - DNA, 18 bp, Homo sapiens
attctcctgcctcagcct

SEQ ID NO: 5054539 - DNA, 17 bp, Homo sapiens
attttactttttcctgg

SEQ ID NO: 5054540 - DNA, 20 bp, Homo sapiens
caaagtgctgggattacagg

SEQ ID NO: 5054541 - DNA, 22 bp, Homo sapiens
caagtaatccacctgcctcggc

SEQ ID NO: 5054542 - DNA, 16 bp, Homo sapiens
cactgcaacttctgcc

SEQ ID NO: 5054543 - DNA, 16 bp, Homo sapiens
catgttggccaggctg

SEQ ID NO: 5054544 - DNA, 22 bp, Homo sapiens
cattttactttttcctggctca

SEQ ID NO: 5054545 - DNA, 14 bp, Homo sapiens
ccaggctggtctca

SEQ ID NO: 5054546 - DNA, 14 bp, Homo sapiens
cctcagcctcctga

SEQ ID NO: 5054547 - DNA, 15 bp, Homo sapiens
cctcagcctcctgag

SEQ ID NO: 5054548 - DNA, 23 bp, Homo sapiens
cctcccaaagtgctgggattaca

SEQ ID NO: 5054549 - DNA, 19 bp, Homo sapiens
cctgagtagctggattaca

SEQ ID NO: 5054550 - DNA, 20 bp, Homo sapiens
cctgagtagctggattacag

SEQ ID NO: 5054551 - DNA, 22 bp, Homo sapiens
cgctctgttgcccaggctggag

SEQ ID NO: 5054552 - DNA, 17 bp, Homo sapiens
gttctaaagatggaaaa

SEQ ID NO: 5054553 - DNA, 22 bp, Homo sapiens
taatttttgtgtttttaataaa

SEQ ID NO: 5054554 - DNA, 13 bp, Homo sapiens
tactttttcctgg

SEQ ID NO: 5054555 - DNA, 21 bp, Homo sapiens
tagcttacaagccagctggag

SEQ ID NO: 5054556 - DNA, 21 bp, Homo sapiens
tcaccatgttggccaggctgg

SEQ ID NO: 5054557 - DNA, 17 bp, Homo sapiens
tcactgcaacttctgcc

SEQ ID NO: 5054558 - DNA, 18 bp, Homo sapiens
tcactgcaacttctgcct

SEQ ID NO: 5054559 - DNA, 19 bp, Homo sapiens
tcctgagtagctggattac

SEQ ID NO: 5054560 - DNA, 13 bp, Homo sapiens
tcgttctctgcct

SEQ ID NO: 5054561 - DNA, 16 bp, Homo sapiens
tctgttgcccaggctg

SEQ ID NO: 5054562 - DNA, 19 bp, Homo sapiens
tcttctttttgcttcaaaa

SEQ ID NO: 5054563 - DNA, 21 bp, Homo sapiens
tctttctgcagaaacagaaag

SEQ ID NO: 5054564 - DNA, 22 bp, Homo sapiens
tgaaaaagtatcctgcttctga

SEQ ID NO: 5054565 - DNA, 12 bp, Homo sapiens
tgcagttttcct

SEQ ID NO: 5054566 - DNA, 13 bp, Homo sapiens
tgcccaggctgga

SEQ ID NO: 5054567 - DNA, 20 bp, Homo sapiens
tgcccaggctggagtgcaat

SEQ ID NO: 5054568 - DNA, 13 bp, Homo sapiens
tgcttcaaaaaca

SEQ ID NO: 5054569 - DNA, 21 bp, Homo sapiens
tgggattacagggatgagcca

SEQ ID NO: 5054570 - DNA, 17 bp, Homo sapiens
tggtactcattaaaaaa

SEQ ID NO: 5054571 - DNA, 18 bp, Homo sapiens
tggtctcaaactcctgac

SEQ ID NO: 5054572 - DNA, 20 bp, Homo sapiens
tgtaagatcgttctctgcct

SEQ ID NO: 5054573 - DNA, 15 bp, Homo sapiens
tgtgtttttaataaa

SEQ ID NO: 5054574 - DNA, 14 bp, Homo sapiens
tgttgcccaggctg

SEQ ID NO: 5054575 - DNA, 21 bp, Homo sapiens
tgttgcccaggctggagtgca

SEQ ID NO: 5054576 - DNA, 20 bp, Homo sapiens
ttcaagtgattctcctgcct

SEQ ID NO: 5054577 - DNA, 20 bp, Homo sapiens
ttcatatctatttattaaat

SEQ ID NO: 5054578 - DNA, 14 bp, Homo sapiens
tttctgcagaaaca

SEQ ID NO: 5054579 - DNA, 15 bp, Homo sapiens
tttgcttcaaaaaca

SEQ ID NO: 5054580 - DNA, 17 bp, Homo sapiens
tctctttgttctaaaga

SEQ ID NO: 5054581 - DNA, 22 bp, Homo sapiens
tctttctgcagaaacagaaagg

SEQ ID NO: 5054582 - DNA, 23 bp, Homo sapiens
tctttttttttttttaaagacag

SEQ ID NO: 5054583 - DNA, 23 bp, Homo sapiens
tgacacagtcttggctcactgca

SEQ ID NO: 5054584 - DNA, 13 bp, Homo sapiens
tgagtagctggat

SEQ ID NO: 5054585 - DNA, 18 bp, Homo sapiens
tgcccaggctggagtgca

SEQ ID NO: 5054586 - DNA, 19 bp, Homo sapiens
tgtaagatcgttctctgcc

SEQ ID NO: 5054587 - DNA, 20 bp, Homo sapiens
tgtgtttttaataaagacag

SEQ ID NO: 5054588 - DNA, 15 bp, Homo sapiens
tgttgcccaggctgg

SEQ ID NO: 5054589 - DNA, 14 bp, Homo sapiens
tgttggccaggctg

SEQ ID NO: 5054590 - DNA, 12 bp, Homo sapiens
ttaaagacagag

SEQ ID NO: 5054591 - DNA, 13 bp, Homo sapiens
ttaataaagacag

SEQ ID NO: 5054592 - DNA, 20 bp, Homo sapiens
ttacagggatgagccaccgc

SEQ ID NO: 5054593 - DNA, 22 bp, Homo sapiens
ttaggccaaaaaaatgtaagat

SEQ ID NO: 5054594 - DNA, 17 bp, Homo sapiens
tttttaaagacagagtc

SEQ ID NO: 5054595 - DNA, 20 bp, Homo sapiens
ctcacatagcttacaagcca

SEQ ID NO: 5054596 - DNA, 22 bp, Homo sapiens
ctcagcctcctgagtagctgga

SEQ ID NO: 5054597 - DNA, 21 bp, Homo sapiens
ctcctgagtagctggattaca

SEQ ID NO: 5054598 - DNA, 17 bp, Homo sapiens
cttacaagccagctgga

SEQ ID NO: 5054599 - DNA, 24 bp, Homo sapiens
cttggctcactgcaacttctgcct

SEQ ID NO: 5054600 - DNA, 23 bp, Homo sapiens
cttgggttcaagtgattctcctg

SEQ ID NO: 5054601 - DNA, 16 bp, Homo sapiens
cttttaggccaaaaaa

SEQ ID NO: 5054602 - DNA, 18 bp, Homo sapiens
gagccaccgcgcccagcc

SEQ ID NO: 5054603 - DNA, 17 bp, Homo sapiens
gctgggattacagggat

SEQ ID NO: 5054604 - DNA, 19 bp, Homo sapiens
gctggtctcaaactcctga

SEQ ID NO: 5054605 - DNA, 13 bp, Homo sapiens
gcttacaagccag

SEQ ID NO: 5054606 - DNA, 20 bp, Homo sapiens
ggagtgcaatgacacagtct

SEQ ID NO: 5054607 - DNA, 17 bp, Homo sapiens
ggtctcaaactcctgac

SEQ ID NO: 5054608 - DNA, 19 bp, Homo sapiens
ggtttcaccatgttggcca

SEQ ID NO: 5054609 - DNA, 19 bp, Homo sapiens
gtaagatcgttctctgcct

SEQ ID NO: 5054610 - DNA, 16 bp, Homo sapiens
gtctcaaactcctgac

SEQ ID NO: 5054611 - DNA, 18 bp, Homo sapiens
aagtatcctgcttctgat

SEQ ID NO: 5054612 - DNA, 12 bp, Homo sapiens
aataaagacagg

SEQ ID NO: 5054613 - DNA, 13 bp, Homo sapiens
aatgtttccttta

SEQ ID NO: 5054614 - DNA, 21 bp, Homo sapiens
acatagcttacaagccagctg

SEQ ID NO: 5054615 - DNA, 15 bp, Homo sapiens
actcctgacctcaag

SEQ ID NO: 5054616 - DNA, 19 bp, Homo sapiens
agacagggtttcaccatgt

SEQ ID NO: 5054617 - DNA, 11 bp, Homo sapiens
agcctcctgag

SEQ ID NO: 5054618 - DNA, 15 bp, Homo sapiens
agcttacaagccagc

SEQ ID NO: 5054619 - DNA, 17 bp, Homo sapiens
agcttacaagccagctg

SEQ ID NO: 5054620 - DNA, 13 bp, Homo sapiens
aggccaaaaaaat

SEQ ID NO: 5054621 - DNA, 17 bp, Homo sapiens
agtagctggattacagg

SEQ ID NO: 5054622 - DNA, 22 bp, Homo sapiens
agtgattctcctgcctcagcct

SEQ ID NO: 5054623 - DNA, 18 bp, Homo sapiens
agtgcaatgacacagtct

SEQ ID NO: 5054624 - DNA, 16 bp, Homo sapiens
atatgcagttttcctt

SEQ ID NO: 5054625 - DNA, 16 bp, Homo sapiens
atcaattcatatctat

SEQ ID NO: 5054626 - DNA, 20 bp, Homo sapiens
caagtgattctcctgcctca

SEQ ID NO: 5054627 - DNA, 17 bp, Homo sapiens
cactgcaacttctgcct

SEQ ID NO: 5054628 - DNA, 18 bp, Homo sapiens
cagctggagaaatatggt

SEQ ID NO: 5054629 - DNA, 23 bp, Homo sapiens
caggctggtctcaaactcctgac

SEQ ID NO: 5054630 - DNA, 16 bp, Homo sapiens
cagtcttggctcactg

SEQ ID NO: 5054631 - DNA, 22 bp, Homo sapiens
ccaaagtgctgggattacaggg

SEQ ID NO: 5054632 - DNA, 23 bp, Homo sapiens
ccatgttggccaggctggtctca

SEQ ID NO: 5054633 - DNA, 20 bp, Homo sapiens
cccaggctggagtgcaatga

SEQ ID NO: 5054634 - DNA, 13 bp, Homo sapiens
cctgcctcagcct

SEQ ID NO: 5054635 - DNA, 20 bp, Homo sapiens
ccttctgaaaaagtatcctg

SEQ ID NO: 5054636 - DNA, 14 bp, Homo sapiens
cggcctcccaaagt

SEQ ID NO: 5054637 - DNA, 12 bp, Homo sapiens
cgttctctgcct

SEQ ID NO: 5054638 - DNA, 14 bp, Homo sapiens
ctcaaactcctgac

SEQ ID NO: 5054639 - DNA, 13 bp, Homo sapiens
ctcattaaaaaaa

SEQ ID NO: 5054640 - DNA, 21 bp, Homo sapiens
ctcctgcctcagcctcctgag

SEQ ID NO: 5054641 - DNA, 19 bp, Homo sapiens
ctcttgggttcaagtgatt

SEQ ID NO: 5054642 - DNA, 16 bp, Homo sapiens
cttacaagccagctgg

SEQ ID NO: 5054643 - DNA, 15 bp, Homo sapiens
ctttctgcagaaaca

SEQ ID NO: 5054644 - DNA, 18 bp, Homo sapiens
cttttaggccaaaaaaat

SEQ ID NO: 5054645 - DNA, 22 bp, Homo sapiens
ctttttttttttttaaagacag

SEQ ID NO: 5054646 - DNA, 12 bp, Homo sapiens
gagtagctggat

SEQ ID NO: 5054647 - DNA, 18 bp, Homo sapiens
gatatgcagttttcctta

SEQ ID NO: 5054648 - DNA, 22 bp, Homo sapiens
gatggaaaaaccacccccaaat

SEQ ID NO: 5054649 - DNA, 18 bp, Homo sapiens
gattacaggcatgtgcca

SEQ ID NO: 5054650 - DNA, 13 bp, Homo sapiens
gccagctggagaa

SEQ ID NO: 5054651 - DNA, 19 bp, Homo sapiens
gcttacaagccagctggag

SEQ ID NO: 5054652 - DNA, 19 bp, Homo sapiens
ggaaaaaccacccccaaat

SEQ ID NO: 5054653 - DNA, 20 bp, Homo sapiens
gggtttcaccatgttggcca

SEQ ID NO: 5054654 - DNA, 13 bp, Homo sapiens
gtgattctcctgc

SEQ ID NO: 5054655 - DNA, 23 bp, Homo sapiens
gttctaaagatggaaaaaccacc

SEQ ID NO: 5054656 - DNA, 10 bp, Homo sapiens
taaagacaga

SEQ ID NO: 5054657 - DNA, 13 bp, Homo sapiens
taataaagacagg

SEQ ID NO: 5054658 - DNA, 22 bp, Homo sapiens
tatcctgcttctgatatgcagt

SEQ ID NO: 5054659 - DNA, 19 bp, Homo sapiens
tcaagtgattctcctgcct

SEQ ID NO: 5054660 - DNA, 15 bp, Homo sapiens
tcaccatgttggcca

SEQ ID NO: 5054661 - DNA, 21 bp, Homo sapiens
tcccaaagtgctgggattaca

SEQ ID NO: 5054662 - DNA, 14 bp, Homo sapiens
tcctgcctcagcct

SEQ ID NO: 5054663 - DNA, 20 bp, Homo sapiens
tctgcctcacatagcttaca

SEQ ID NO: 5054664 - DNA, 19 bp, Homo sapiens
tgatatgcagttttcctta

SEQ ID NO: 5054665 - DNA, 14 bp, Homo sapiens
tgcaacttctgcct

SEQ ID NO: 5054666 - DNA, 21 bp, Homo sapiens
tgcaatgacacagtcttggct

SEQ ID NO: 5054667 - DNA, 17 bp, Homo sapiens
tgcctcagcctcctgag

SEQ ID NO: 5054668 - DNA, 21 bp, Homo sapiens
tgcttcaaaaacattcttaca

SEQ ID NO: 5054669 - DNA, 20 bp, Homo sapiens
tggaaaaaccacccccaaat

SEQ ID NO: 5054670 - DNA, 17 bp, Homo sapiens
tggagtgcaatgacaca

SEQ ID NO: 5054671 - DNA, 13 bp, Homo sapiens
ttctaaagatgga

SEQ ID NO: 5054672 - DNA, 15 bp, Homo sapiens
ttctaaagatggaaa

SEQ ID NO: 5054673 - DNA, 22 bp, Homo sapiens
ttctgatatgcagttttcctta

SEQ ID NO: 5054674 - DNA, 17 bp, Homo sapiens
ttcttctttttgcttca

SEQ ID NO: 5054675 - DNA, 20 bp, Homo sapiens
ttttaggccaaaaaaatgta

SEQ ID NO: 5054676 - DNA, 20 bp, Homo sapiens
tttttaataaagacagggtt

SEQ ID NO: 5054677 - DNA, 15 bp, Homo sapiens
aaaatctgctaggga

SEQ ID NO: 5054678 - DNA, 11 bp, Homo sapiens
aaactcctgac

SEQ ID NO: 5054679 - DNA, 22 bp, Homo sapiens
aaatgtaagatcgttctctgcc

SEQ ID NO: 5054680 - DNA, 12 bp, Homo sapiens
aagacagagtct

SEQ ID NO: 5054681 - DNA, 17 bp, Homo sapiens
aagatcgttctctgcct

SEQ ID NO: 5054682 - DNA, 13 bp, Homo sapiens
aatgacacagtct

SEQ ID NO: 5054683 - DNA, 12 bp, Homo sapiens
aatgtttccttt

SEQ ID NO: 5054684 - DNA, 16 bp, Homo sapiens
acccccaaattttctt

SEQ ID NO: 5054685 - DNA, 14 bp, Homo sapiens
actaatctttctgc

SEQ ID NO: 5054686 - DNA, 14 bp, Homo sapiens
actgcaacttctgc

SEQ ID NO: 5054687 - DNA, 19 bp, Homo sapiens
agcctcctgagtagctgga

SEQ ID NO: 5054688 - DNA, 15 bp, Homo sapiens
agtcttggctcactg

SEQ ID NO: 5054689 - DNA, 22 bp, Homo sapiens
atagcttacaagccagctggag

SEQ ID NO: 5054690 - DNA, 21 bp, Homo sapiens
atcctgcttctgatatgcagt

SEQ ID NO: 5054691 - DNA, 15 bp, Homo sapiens
atgcagttttcctta

SEQ ID NO: 5054692 - DNA, 16 bp, Homo sapiens
atgttggccaggctgg

SEQ ID NO: 5054693 - DNA, 19 bp, Homo sapiens
caaagtgctgggattacag

SEQ ID NO: 5054694 - DNA, 21 bp, Homo sapiens
caagtgattctcctgcctcag

SEQ ID NO: 5054695 - DNA, 22 bp, Homo sapiens
caagtgattctcctgcctcagc

SEQ ID NO: 5054696 - DNA, 19 bp, Homo sapiens
caatagatatttacctttt

SEQ ID NO: 5054697 - DNA, 21 bp, Homo sapiens
caatgacacagtcttggctca

SEQ ID NO: 5054698 - DNA, 20 bp, Homo sapiens
cagaaaggttttcttctttt

SEQ ID NO: 5054699 - DNA, 22 bp, Homo sapiens
cattaaaaaaaaaaaaaaaagt

SEQ ID NO: 5054700 - DNA, 17 bp, Homo sapiens
cattttactttttcctg

SEQ ID NO: 5054701 - DNA, 15 bp, Homo sapiens
cctgagtagctggat

SEQ ID NO: 5054702 - DNA, 13 bp, Homo sapiens
ctcaaactcctga

SEQ ID NO: 5054703 - DNA, 14 bp, Homo sapiens
ctcagcctcctgag

SEQ ID NO: 5054704 - DNA, 20 bp, Homo sapiens
ctctgttgcccaggctggag

SEQ ID NO: 5054705 - DNA, 22 bp, Homo sapiens
ctctgttgcccaggctggagtg

SEQ ID NO: 5054706 - DNA, 20 bp, Homo sapiens
ctctttgttctaaagatgga

SEQ ID NO: 5054707 - DNA, 20 bp, Homo sapiens
ctgagtagctggattacagg

SEQ ID NO: 5054708 - DNA, 14 bp, Homo sapiens
ctgcaacttctgcc

SEQ ID NO: 5054709 - DNA, 15 bp, Homo sapiens
ctgcaacttctgcct

SEQ ID NO: 5054710 - DNA, 13 bp, Homo sapiens
ctggctcatctct

SEQ ID NO: 5054711 - DNA, 18 bp, Homo sapiens
ctggtctcaaactcctga

SEQ ID NO: 5054712 - DNA, 18 bp, Homo sapiens
ctttgttctaaagatgga

SEQ ID NO: 5054713 - DNA, 19 bp, Homo sapiens
gagtgcaatgacacagtct

SEQ ID NO: 5054714 - DNA, 18 bp, Homo sapiens
gattctcctgcctcagcc

SEQ ID NO: 5054715 - DNA, 17 bp, Homo sapiens
gccaccgcgcccagcct

SEQ ID NO: 5054716 - DNA, 15 bp, Homo sapiens
gcccaggctggagtg

SEQ ID NO: 5054717 - DNA, 16 bp, Homo sapiens
gcctcagcctcctgag

SEQ ID NO: 5054718 - DNA, 16 bp, Homo sapiens
gctggattacaggcat

SEQ ID NO: 5054719 - DNA, 22 bp, Homo sapiens
gcttacaagccagctggagaaa

SEQ ID NO: 5054720 - DNA, 13 bp, Homo sapiens
ggcctcccaaagt

SEQ ID NO: 5054721 - DNA, 17 bp, Homo sapiens
gtagctggattacaggc

SEQ ID NO: 5054722 - DNA, 14 bp, Homo sapiens
gttctaaagatgga

SEQ ID NO: 5054723 - DNA, 17 bp, Homo sapiens
gtttttaataaagacag

SEQ ID NO: 5054724 - DNA, 13 bp, Homo sapiens
taaagatggaaaa

SEQ ID NO: 5054725 - DNA, 18 bp, Homo sapiens
taagatcgttctctgcct

SEQ ID NO: 5054726 - DNA, 11 bp, Homo sapiens
taatgtttcct

SEQ ID NO: 5054727 - DNA, 18 bp, Homo sapiens
tacaagccagctggagaa

SEQ ID NO: 5054728 - DNA, 15 bp, Homo sapiens
tcaaaaacattctta

SEQ ID NO: 5054729 - DNA, 19 bp, Homo sapiens
tcaagtaatccacctgcct

SEQ ID NO: 5054730 - DNA, 18 bp, Homo sapiens
tcaagtgattctcctgcc

SEQ ID NO: 5054731 - DNA, 13 bp, Homo sapiens
tcagcctcctgag

SEQ ID NO: 5054732 - DNA, 20 bp, Homo sapiens
tcagcctcctgagtagctgg

SEQ ID NO: 5054733 - DNA, 21 bp, Homo sapiens
tcagcctcctgagtagctgga

SEQ ID NO: 5054734 - DNA, 20 bp, Homo sapiens
tcccaaagtgctgggattac

SEQ ID NO: 5054735 - DNA, 21 bp, Homo sapiens
tcctttaattttttactattt

SEQ ID NO: 5054736 - DNA, 17 bp, Homo sapiens
tctcgctctgttgccca

SEQ ID NO: 5054737 - DNA, 21 bp, Homo sapiens
aaagtatcctgcttctgatat

SEQ ID NO: 5054738 - DNA, 12 bp, Homo sapiens
aaagtgctggga

SEQ ID NO: 5054739 - DNA, 21 bp, Homo sapiens
aagtgattctcctgcctcagc

SEQ ID NO: 5054740 - DNA, 18 bp, Homo sapiens
aatccacctgcctcggcc

SEQ ID NO: 5054741 - DNA, 19 bp, Homo sapiens
aatccacctgcctcggcct

SEQ ID NO: 5054742 - DNA, 13 bp, Homo sapiens
acaagccagctgg

SEQ ID NO: 5054743 - DNA, 19 bp, Homo sapiens
acacagtcttggctcactg

SEQ ID NO: 5054744 - DNA, 16 bp, Homo sapiens
acagaaaggttttctt

SEQ ID NO: 5054745 - DNA, 18 bp, Homo sapiens
acattttactttttcctg

SEQ ID NO: 5054746 - DNA, 16 bp, Homo sapiens
actgcaacttctgcct

SEQ ID NO: 5054747 - DNA, 13 bp, Homo sapiens
acttctgcctctt

SEQ ID NO: 5054748 - DNA, 16 bp, Homo sapiens
agatcgttctctgcct

SEQ ID NO: 5054749 - DNA, 17 bp, Homo sapiens
agctggagaaatatggt

SEQ ID NO: 5054750 - DNA, 19 bp, Homo sapiens
agcttacaagccagctgga

SEQ ID NO: 5054751 - DNA, 22 bp, Homo sapiens
aggcatgtgccacccacccaac

SEQ ID NO: 5054752 - DNA, 22 bp, Homo sapiens
aggctggtctcaaactcctgac

SEQ ID NO: 5054753 - DNA, 19 bp, Homo sapiens
agtgattctcctgcctcag

SEQ ID NO: 5054754 - DNA, 16 bp, Homo sapiens
agtgcaatgacacagt

SEQ ID NO: 5054755 - DNA, 11 bp, Homo sapiens
ataaagacagg

SEQ ID NO: 5054756 - DNA, 19 bp, Homo sapiens
atcctgcttctgatatgca

SEQ ID NO: 5054757 - DNA, 22 bp, Homo sapiens
atctctttgttctaaagatgga

SEQ ID NO: 5054758 - DNA, 20 bp, Homo sapiens
atctgctagggaatatcaat

SEQ ID NO: 5054759 - DNA, 13 bp, Homo sapiens
atctttctgcaga

SEQ ID NO: 5054760 - DNA, 18 bp, Homo sapiens
atgagccaccgcgcccag

SEQ ID NO: 5054761 - DNA, 21 bp, Homo sapiens
atgagccaccgcgcccagcct

SEQ ID NO: 5054762 - DNA, 19 bp, Homo sapiens
attatctaaaatctgctag

SEQ ID NO: 5054763 - DNA, 16 bp, Homo sapiens
attttactttttcctg

SEQ ID NO: 5054764 - DNA, 14 bp, Homo sapiens
caagccagctggag

SEQ ID NO: 5054765 - DNA, 14 bp, Homo sapiens
caagtgattctcct

SEQ ID NO: 5054766 - DNA, 16 bp, Homo sapiens
caagtgattctcctgc

SEQ ID NO: 5054767 - DNA, 14 bp, Homo sapiens
caatgacacagtct

SEQ ID NO: 5054768 - DNA, 19 bp, Homo sapiens
caatgacacagtcttggct

SEQ ID NO: 5054769 - DNA, 19 bp, Homo sapiens
caccatgttggccaggctg

SEQ ID NO: 5054770 - DNA, 23 bp, Homo sapiens
cacctgcctcggcctcccaaagt

SEQ ID NO: 5054771 - DNA, 23 bp, Homo sapiens
cagagtctcgctctgttgcccag

SEQ ID NO: 5054772 - DNA, 20 bp, Homo sapiens
cagcctcctgagtagctgga

SEQ ID NO: 5054773 - DNA, 11 bp, Homo sapiens
cagttttcctt

SEQ ID NO: 5054774 - DNA, 22 bp, Homo sapiens
catagcttacaagccagctgga

SEQ ID NO: 5054775 - DNA, 20 bp, Homo sapiens
cattttactttttcctggct

SEQ ID NO: 5054776 - DNA, 17 bp, Homo sapiens
ccaaattttctttttat

SEQ ID NO: 5054777 - DNA, 19 bp, Homo sapiens
ccagcctcatctctttgtt

SEQ ID NO: 5054778 - DNA, 24 bp, Homo sapiens
ccagctggagaaatatggtactca

SEQ ID NO: 5054779 - DNA, 19 bp, Homo sapiens
cgctctgttgcccaggctg

SEQ ID NO: 5054780 - DNA, 22 bp, Homo sapiens
ctcccaaagtgctgggattaca

SEQ ID NO: 5054781 - DNA, 19 bp, Homo sapiens
ctgagtagctggattacag

SEQ ID NO: 5054782 - DNA, 20 bp, Homo sapiens
cttacattttactttttcct

SEQ ID NO: 5054783 - DNA, 23 bp, Homo sapiens
ctttttttttttttaaagacaga

SEQ ID NO: 5054784 - DNA, 17 bp, Homo sapiens
gacagggtttcaccatg

SEQ ID NO: 5054785 - DNA, 18 bp, Homo sapiens
gattacagggatgagcca

SEQ ID NO: 5054786 - DNA, 20 bp, Homo sapiens
gattacagggatgagccacc

SEQ ID NO: 5054787 - DNA, 18 bp, Homo sapiens
gcctcagcctcctgagta

SEQ ID NO: 5054788 - DNA, 20 bp, Homo sapiens
gctggtctcaaactcctgac

SEQ ID NO: 5054789 - DNA, 15 bp, Homo sapiens
gtaatccacctgcct

SEQ ID NO: 5054790 - DNA, 14 bp, Homo sapiens
gtactcattaaaaa

SEQ ID NO: 5054791 - DNA, 20 bp, Homo sapiens
gttctaaagatggaaaaacc

SEQ ID NO: 5054792 - DNA, 9 bp, Homo sapiens
taaagacag

SEQ ID NO: 5054793 - DNA, 13 bp, Homo sapiens
taattttttacta

SEQ ID NO: 5054794 - DNA, 21 bp, Homo sapiens
tcgctctgttgcccaggctgg

SEQ ID NO: 5054795 - DNA, 14 bp, Homo sapiens
tctcaaactcctga

SEQ ID NO: 5054796 - DNA, 15 bp, Homo sapiens
tctgcagaaacagaa

SEQ ID NO: 5054797 - DNA, 16 bp, Homo sapiens
tctttttatactatta

SEQ ID NO: 5054798 - DNA, 22 bp, Homo sapiens
tgacacagtcttggctcactgc

SEQ ID NO: 5054799 - DNA, 13 bp, Homo sapiens
tgattctcctgcc

SEQ ID NO: 5054800 - DNA, 13 bp, Homo sapiens
tgcaacttctgcc

SEQ ID NO: 5054801 - DNA, 13 bp, Homo sapiens
tggccaggctggt

SEQ ID NO: 5054802 - DNA, 11 bp, Homo sapiens
ttaaagacaga

SEQ ID NO: 5054803 - DNA, 15 bp, Homo sapiens
ttaaatttctaccgc

SEQ ID NO: 5054804 - DNA, 14 bp, Homo sapiens
ttaataaagacagg

SEQ ID NO: 5054805 - DNA, 21 bp, Homo sapiens
ttcttctttttgcttcaaaaa

SEQ ID NO: 5054806 - DNA, 19 bp, Homo sapiens
tttccttaaattatctaaa

SEQ ID NO: 5054807 - DNA, 17 bp, Homo sapiens
tttttaataaagacagg

SEQ ID NO: 5054808 - DNA, 21 bp, Homo sapiens
atttcaaaatggacgtactgg

SEQ ID NO: 5054809 - DNA, 16 bp, Homo sapiens
atttcaaaattaatag

SEQ ID NO: 5054810 - DNA, 14 bp, Homo sapiens
atttcaaaatttaa

SEQ ID NO: 5054811 - DNA, 23 bp, Homo sapiens
atttcaaacagtctcccttccta

SEQ ID NO: 5054812 - DNA, 19 bp, Homo sapiens
atttcaaacatcagctgaa

SEQ ID NO: 5054813 - DNA, 22 bp, Homo sapiens
atttcaaacatcagctgaattc

SEQ ID NO: 5054814 - DNA, 13 bp, Homo sapiens
atttcaaactttt

SEQ ID NO: 5054815 - DNA, 16 bp, Homo sapiens
atttcaaacttttgaa

SEQ ID NO: 5054816 - DNA, 16 bp, Homo sapiens
atttcaaagccctgcc

SEQ ID NO: 5054817 - DNA, 19 bp, Homo sapiens
atttcaaagccctgcctct

SEQ ID NO: 5054818 - DNA, 17 bp, Homo sapiens
atttcaaatagaatatg

SEQ ID NO: 5054819 - DNA, 19 bp, Homo sapiens
atttcaaatagaatatgga

SEQ ID NO: 5054820 - DNA, 11 bp, Homo sapiens
atttcaaatat

SEQ ID NO: 5054821 - DNA, 22 bp, Homo sapiens
atttcaaatatttacagtactt

SEQ ID NO: 5054822 - DNA, 12 bp, Homo sapiens
atttcaaatcat

SEQ ID NO: 5054823 - DNA, 14 bp, Homo sapiens
atttcaaatctgta

SEQ ID NO: 5054824 - DNA, 21 bp, Homo sapiens
atttcaaatctgtaattacca

SEQ ID NO: 5054825 - DNA, 13 bp, Homo sapiens
atttcaaatgatt

SEQ ID NO: 5054826 - DNA, 15 bp, Homo sapiens
atttcaaatgcagaa

SEQ ID NO: 5054827 - DNA, 11 bp, Homo sapiens
atttcaaatgt

SEQ ID NO: 5054828 - DNA, 22 bp, Homo sapiens
atttcaaatgttagatattgct

SEQ ID NO: 5054829 - DNA, 22 bp, Homo sapiens
atttcaaattaatctttctata

SEQ ID NO: 5054830 - DNA, 14 bp, Homo sapiens
atttcaacataatt

SEQ ID NO: 5054831 - DNA, 22 bp, Homo sapiens
atttcaaccacacctaaattaa

SEQ ID NO: 5054832 - DNA, 14 bp, Homo sapiens
atttcaactccaga

SEQ ID NO: 5054833 - DNA, 15 bp, Homo sapiens
atttcaactccagaa

SEQ ID NO: 5054834 - DNA, 15 bp, Homo sapiens
atttcaacttttgac

SEQ ID NO: 5054835 - DNA, 13 bp, Homo sapiens
atttcaagaaaaa

SEQ ID NO: 5054836 - DNA, 20 bp, Homo sapiens
atttcaagaaaaaataaatg

SEQ ID NO: 5054837 - DNA, 22 bp, Homo sapiens
atttcaagaaaatttaaaacga

SEQ ID NO: 5054838 - DNA, 19 bp, Homo sapiens
atttcaagaatgtttcagt

SEQ ID NO: 5054839 - DNA, 12 bp, Homo sapiens
atttcaagacag

SEQ ID NO: 5054840 - DNA, 20 bp, Homo sapiens
atttcaagagatttaattaa

SEQ ID NO: 5054841 - DNA, 16 bp, Homo sapiens
atttcaagatccaaat

SEQ ID NO: 5054842 - DNA, 18 bp, Homo sapiens
atttcaagcagctgaaga

SEQ ID NO: 5054843 - DNA, 21 bp, Homo sapiens
atttcaagcagctgaagaaaa

SEQ ID NO: 5054844 - DNA, 17 bp, Homo sapiens
atttcaaggaatagagt

SEQ ID NO: 5054845 - DNA, 22 bp, Homo sapiens
atttcaaggaatggaatcttct

SEQ ID NO: 5054846 - DNA, 23 bp, Homo sapiens
atttcaaggtccgagctctgtcc

SEQ ID NO: 5054847 - DNA, 16 bp, Homo sapiens
atttcaagttccaagt

SEQ ID NO: 5054848 - DNA, 22 bp, Homo sapiens
atttcaagttccaagttgctaa

SEQ ID NO: 5054849 - DNA, 23 bp, Homo sapiens
atttcaagttccaagttgctaat

SEQ ID NO: 5054850 - DNA, 15 bp, Homo sapiens
atttcaataaatgat

SEQ ID NO: 5054851 - DNA, 17 bp, Homo sapiens
atttcaataaatgatat

SEQ ID NO: 5054852 - DNA, 22 bp, Homo sapiens
atttcaataaatgatatataat

SEQ ID NO: 5054853 - DNA, 13 bp, Homo sapiens
atttcaatatcaa

SEQ ID NO: 5054854 - DNA, 19 bp, Homo sapiens
atttcaatcattgaagtat

SEQ ID NO: 5054855 - DNA, 16 bp, Homo sapiens
atttcaatcttttaaa

SEQ ID NO: 5054856 - DNA, 17 bp, Homo sapiens
atttcaatgattgttta

SEQ ID NO: 5054857 - DNA, 16 bp, Homo sapiens
atttcaatgtcagcct

SEQ ID NO: 5054858 - DNA, 15 bp, Homo sapiens
atttcaatgtgtata

SEQ ID NO: 5054859 - DNA, 17 bp, Homo sapiens
atttcaattcctggccc

SEQ ID NO: 5054860 - DNA, 17 bp, Homo sapiens
atttcaattgtttatat

SEQ ID NO: 5054861 - DNA, 21 bp, Homo sapiens
atttcaattgtttatatggat

SEQ ID NO: 5054862 - DNA, 23 bp, Homo sapiens
atttcaattgtttatatggataa

SEQ ID NO: 5054863 - DNA, 23 bp, Homo sapiens
attaatttgttaattaaatattt

SEQ ID NO: 5054864 - DNA, 21 bp, Homo sapiens
attaattttcttggttctttc

SEQ ID NO: 5054865 - DNA, 15 bp, Homo sapiens
attaattttgtgcat

SEQ ID NO: 5054866 - DNA, 19 bp, Homo sapiens
attaattttgtgcattctt

SEQ ID NO: 5054867 - DNA, 24 bp, Homo sapiens
attaattttgtgcattctttggta

SEQ ID NO: 5054868 - DNA, 12 bp, Homo sapiens
attaatttttca

SEQ ID NO: 5054869 - DNA, 23 bp, Homo sapiens
attaatttttgtactttgcttct

SEQ ID NO: 5054870 - DNA, 17 bp, Homo sapiens
attaatttttttattgt

SEQ ID NO: 5054871 - DNA, 20 bp, Homo sapiens
attaattttttttttaaaca

SEQ ID NO: 5054872 - DNA, 13 bp, Homo sapiens
attacaaacaaag

SEQ ID NO: 5054873 - DNA, 15 bp, Homo sapiens
attacaaacaaagga

SEQ ID NO: 5054874 - DNA, 17 bp, Homo sapiens
attacaaacaaaggatt

SEQ ID NO: 5054875 - DNA, 22 bp, Homo sapiens
attacaaacaaaggatttgaaa

SEQ ID NO: 5054876 - DNA, 22 bp, Homo sapiens
attacaaacaataagaacaagt

SEQ ID NO: 5054877 - DNA, 10 bp, Homo sapiens
attacaaaga

SEQ ID NO: 5054878 - DNA, 11 bp, Homo sapiens
attacaaagcc

SEQ ID NO: 5054879 - DNA, 13 bp, Homo sapiens
attacaaagttaa

SEQ ID NO: 5054880 - DNA, 15 bp, Homo sapiens
attacaaagttaaaa

SEQ ID NO: 5054881 - DNA, 10 bp, Homo sapiens
attacaaata

SEQ ID NO: 5054882 - DNA, 14 bp, Homo sapiens
attacaaatcagaa

SEQ ID NO: 5054883 - DNA, 15 bp, Homo sapiens
attacaaattgctta

SEQ ID NO: 5054884 - DNA, 14 bp, Homo sapiens
attacaaatttctg

SEQ ID NO: 5054885 - DNA, 20 bp, Homo sapiens
attacaacaagcaaactgaa

SEQ ID NO: 5054886 - DNA, 20 bp, Homo sapiens
attacaacagatattccaga

SEQ ID NO: 5054887 - DNA, 20 bp, Homo sapiens
attacaacagtagagaggga

SEQ ID NO: 5054888 - DNA, 23 bp, Homo sapiens
attacaacagtagagagggaaca

SEQ ID NO: 5054889 - DNA, 15 bp, Homo sapiens
attacaacagtgaga

SEQ ID NO: 5054890 - DNA, 16 bp, Homo sapiens
attacaacatttatgt

SEQ ID NO: 5054891 - DNA, 19 bp, Homo sapiens
attacaaccggttatcagt

SEQ ID NO: 5054892 - DNA, 14 bp, Homo sapiens
attacaacctggaa

SEQ ID NO: 5054893 - DNA, 22 bp, Homo sapiens
attacaacctggaaaataaatc

SEQ ID NO: 5054894 - DNA, 17 bp, Homo sapiens
attacaactctatttaa

SEQ ID NO: 5054895 - DNA, 16 bp, Homo sapiens
attacaagataaaaaa

SEQ ID NO: 5054896 - DNA, 19 bp, Homo sapiens
attacaagataaaaaacga

SEQ ID NO: 5054897 - DNA, 15 bp, Homo sapiens
attacaagccctggg

SEQ ID NO: 5054898 - DNA, 22 bp, Homo sapiens
attacaagcgtgagccactgca

SEQ ID NO: 5054899 - DNA, 19 bp, Homo sapiens
attacaaggcaatggaaac

SEQ ID NO: 5054900 - DNA, 21 bp, Homo sapiens
attacaagtggctccccacct

SEQ ID NO: 5054901 - DNA, 23 bp, Homo sapiens
attacaagtggctccccacctgg

SEQ ID NO: 5054902 - DNA, 14 bp, Homo sapiens
attacaagtttcag

SEQ ID NO: 5054903 - DNA, 18 bp, Homo sapiens
attacaataaatccttta

SEQ ID NO: 5054904 - DNA, 16 bp, Homo sapiens
attacaatacagtatt

SEQ ID NO: 5054905 - DNA, 14 bp, Homo sapiens
attacaatatttct

SEQ ID NO: 5054906 - DNA, 13 bp, Homo sapiens
attacaatatttg

SEQ ID NO: 5054907 - DNA, 17 bp, Homo sapiens
attacaatggccagccc

SEQ ID NO: 5054908 - DNA, 15 bp, Homo sapiens
attacaatgtatctt

SEQ ID NO: 5054909 - DNA, 18 bp, Homo sapiens
attacaatgtatctttat

SEQ ID NO: 5054910 - DNA, 21 bp, Homo sapiens
attacaatgtatctttattaa

SEQ ID NO: 5054911 - DNA, 15 bp, Homo sapiens
attacaattttatct

SEQ ID NO: 5054912 - DNA, 16 bp, Homo sapiens
attacaattttctgta

SEQ ID NO: 5054913 - DNA, 17 bp, Homo sapiens
attacaattttctgtaa

SEQ ID NO: 5054914 - DNA, 19 bp, Homo sapiens
attacaattttctgtaaga

SEQ ID NO: 5054915 - DNA, 14 bp, Homo sapiens
attacacaaaacaa

SEQ ID NO: 5054916 - DNA, 21 bp, Homo sapiens
attacacaaagaacttgctgc

SEQ ID NO: 5054917 - DNA, 22 bp, Homo sapiens
attacacagtcaaatttacatt

SEQ ID NO: 5054918 - DNA, 18 bp, Homo sapiens
attacacatttgtacaga

SEQ ID NO: 5054919 - DNA, 19 bp, Homo sapiens
attacaccacaagtatcta

SEQ ID NO: 5054920 - DNA, 14 bp, Homo sapiens
attacacccaaaga

SEQ ID NO: 5054921 - DNA, 18 bp, Homo sapiens
attacacccaaatattgt

SEQ ID NO: 5054922 - DNA, 14 bp, Homo sapiens
attacacccatgca

SEQ ID NO: 5054923 - DNA, 16 bp, Homo sapiens
attacacccatgcaca

SEQ ID NO: 5054924 - DNA, 23 bp, Homo sapiens
attacacctcagaaattgaaagc

SEQ ID NO: 5054925 - DNA, 16 bp, Homo sapiens
attacactaaagtgca

SEQ ID NO: 5054926 - DNA, 14 bp, Homo sapiens
attacactaaatta

SEQ ID NO: 5054927 - DNA, 14 bp, Homo sapiens
attacactccagcc

SEQ ID NO: 5054928 - DNA, 14 bp, Homo sapiens
attacactgtaaga

SEQ ID NO: 5054929 - DNA, 21 bp, Homo sapiens
attacactgtaagaaatgtat

SEQ ID NO: 5054930 - DNA, 18 bp, Homo sapiens
attacactgtatttgtat

SEQ ID NO: 5054931 - DNA, 20 bp, Homo sapiens
attacactgtatttgtatct

SEQ ID NO: 5054932 - DNA, 16 bp, Homo sapiens
attacactgtgccttt

SEQ ID NO: 5054933 - DNA, 14 bp, Homo sapiens
attacacttggtaa

SEQ ID NO: 5054934 - DNA, 17 bp, Homo sapiens
attacacttgtctttac

SEQ ID NO: 5054935 - DNA, 20 bp, Homo sapiens
attacagaaaatttgcaaca

SEQ ID NO: 5054936 - DNA, 13 bp, Homo sapiens
attacagaaacac

SEQ ID NO: 5054937 - DNA, 15 bp, Homo sapiens
attacagaaactgat

SEQ ID NO: 5054938 - DNA, 21 bp, Homo sapiens
attacagaaactgatgccaag

SEQ ID NO: 5054939 - DNA, 19 bp, Homo sapiens
attacagaaatacataggc

SEQ ID NO: 5054940 - DNA, 13 bp, Homo sapiens
attacagaaattt

SEQ ID NO: 5054941 - DNA, 14 bp, Homo sapiens
attacagaccatgg

SEQ ID NO: 5054942 - DNA, 15 bp, Homo sapiens
attacagagaggaga

SEQ ID NO: 5054943 - DNA, 23 bp, Homo sapiens
attacagagggctcattttctac

SEQ ID NO: 5054944 - DNA, 21 bp, Homo sapiens
attacagaggtattaaaacta

SEQ ID NO: 5054945 - DNA, 15 bp, Homo sapiens
attacagataaaatg

SEQ ID NO: 5054946 - DNA, 16 bp, Homo sapiens
attacagatcatataa

SEQ ID NO: 5054947 - DNA, 19 bp, Homo sapiens
attacagatgggcaaatta

SEQ ID NO: 5054948 - DNA, 19 bp, Homo sapiens
attacagatgtgaaaataa

SEQ ID NO: 5054949 - DNA, 13 bp, Homo sapiens
attacagattaaa

SEQ ID NO: 5054950 - DNA, 21 bp, Homo sapiens
attacagcttatttttttcta

SEQ ID NO: 5054951 - DNA, 15 bp, Homo sapiens
attacagcttttatg

SEQ ID NO: 5054952 - DNA, 19 bp, Homo sapiens
attacaggaatgaagaact

SEQ ID NO: 5054953 - DNA, 20 bp, Homo sapiens
attacaggagggaacatttc

SEQ ID NO: 5054954 - DNA, 16 bp, Homo sapiens
attacaggattaatat

SEQ ID NO: 5054955 - DNA, 19 bp, Homo sapiens
attacaggattaatatatt

SEQ ID NO: 5054956 - DNA, 20 bp, Homo sapiens
attacaggcacctgccacca

SEQ ID NO: 5054957 - DNA, 16 bp, Homo sapiens
attacaggcatgtgcc

SEQ ID NO: 5054958 - DNA, 17 bp, Homo sapiens
attacaggcgcacacca

SEQ ID NO: 5054959 - DNA, 22 bp, Homo sapiens
attacaggcgcacaccaccaca

SEQ ID NO: 5054960 - DNA, 17 bp, Homo sapiens
attacaggctcctgcca

SEQ ID NO: 5054961 - DNA, 19 bp, Homo sapiens
attacaggctcctgccacc

SEQ ID NO: 5054962 - DNA, 20 bp, Homo sapiens
attacaggcttgaaagtcta

SEQ ID NO: 5054963 - DNA, 18 bp, Homo sapiens
attacagggaagaaatca

SEQ ID NO: 5054964 - DNA, 21 bp, Homo sapiens
attacagggaagaaatcaagt

SEQ ID NO: 5054965 - DNA, 23 bp, Homo sapiens
attacaggggcagtgcctttgta

SEQ ID NO: 5054966 - DNA, 16 bp, Homo sapiens
attacagggtgactca

SEQ ID NO: 5054967 - DNA, 16 bp, Homo sapiens
attacaggtgcccacc

SEQ ID NO: 5054968 - DNA, 24 bp, Homo sapiens
attacaggtgggatatgctagaaa

SEQ ID NO: 5054969 - DNA, 16 bp, Homo sapiens
attacaggtgtgaacc

SEQ ID NO: 5054970 - DNA, 14 bp, Homo sapiens
attacaggttcctt

SEQ ID NO: 5054971 - DNA, 14 bp, Homo sapiens
attacagtattgct

SEQ ID NO: 5054972 - DNA, 21 bp, Homo sapiens
attacagtgaaattttggtga

SEQ ID NO: 5054973 - DNA, 15 bp, Homo sapiens
attacagtgcctaaa

SEQ ID NO: 5054974 - DNA, 21 bp, Homo sapiens
attacagtgtaaaaattcaga

SEQ ID NO: 5054975 - DNA, 15 bp, Homo sapiens
attacagttcataat

SEQ ID NO: 5054976 - DNA, 20 bp, Homo sapiens
attacataacaggcattgca

SEQ ID NO: 5054977 - DNA, 15 bp, Homo sapiens
attacataatttagt

SEQ ID NO: 5054978 - DNA, 22 bp, Homo sapiens
attacataatttagttgtttct

SEQ ID NO: 5054979 - DNA, 12 bp, Homo sapiens
attacatacaga

SEQ ID NO: 5054980 - DNA, 18 bp, Homo sapiens
attacatagaacacttca

SEQ ID NO: 5054981 - DNA, 22 bp, Homo sapiens
attacatagaacacttcagaca

SEQ ID NO: 5054982 - DNA, 19 bp, Homo sapiens
attacatagatcagccatt

SEQ ID NO: 5054983 - DNA, 22 bp, Homo sapiens
attacatagatcagccattaaa

SEQ ID NO: 5054984 - DNA, 17 bp, Homo sapiens
attacatatttgactct

SEQ ID NO: 5054985 - DNA, 21 bp, Homo sapiens
attacatcccataacttgtca

SEQ ID NO: 5054986 - DNA, 14 bp, Homo sapiens
attacatcctctgc

SEQ ID NO: 5054987 - DNA, 18 bp, Homo sapiens
attacatccttgtggcac

SEQ ID NO: 5054988 - DNA, 14 bp, Homo sapiens
attacatctaatgc

SEQ ID NO: 5054989 - DNA, 17 bp, Homo sapiens
attacatctgagtattt

SEQ ID NO: 5054990 - DNA, 15 bp, Homo sapiens
attacatctgcctta

SEQ ID NO: 5054991 - DNA, 16 bp, Homo sapiens
attacatctgccttaa

SEQ ID NO: 5054992 - DNA, 17 bp, Homo sapiens
attacatctttattaac

SEQ ID NO: 5054993 - DNA, 18 bp, Homo sapiens
attacatctttcacattg

SEQ ID NO: 5054994 - DNA, 22 bp, Homo sapiens
attacatctttcacattggcta

SEQ ID NO: 5054995 - DNA, 18 bp, Homo sapiens
attacatgactgtttctt

SEQ ID NO: 5054996 - DNA, 23 bp, Homo sapiens
attacatgctgctatacacaagc

SEQ ID NO: 5054997 - DNA, 16 bp, Homo sapiens
attacatgtaaaacat

SEQ ID NO: 5054998 - DNA, 14 bp, Homo sapiens
attacatgtaaaca

SEQ ID NO: 5054999 - DNA, 16 bp, Homo sapiens
attacatgtaaacaaa

SEQ ID NO: 5055000 - DNA, 15 bp, Homo sapiens
attacatgtaaagct

SEQ ID NO: 5055001 - DNA, 12 bp, Homo sapiens
attacatgtgtt

SEQ ID NO: 5055002 - DNA, 18 bp, Homo sapiens
attacatgttttttcatt

SEQ ID NO: 5055003 - DNA, 23 bp, Homo sapiens
attacatgttttttcatttgtaa

SEQ ID NO: 5055004 - DNA, 22 bp, Homo sapiens
attacattactgaaaacttcat

SEQ ID NO: 5055005 - DNA, 15 bp, Homo sapiens
attacattattaaac

SEQ ID NO: 5055006 - DNA, 16 bp, Homo sapiens
attacattattaaacg

SEQ ID NO: 5055007 - DNA, 14 bp, Homo sapiens
attacattcctaac

SEQ ID NO: 5055008 - DNA, 22 bp, Homo sapiens
attacattcctaactagaatta

SEQ ID NO: 5055009 - DNA, 23 bp, Homo sapiens
attacattgcattcaaaatcttc

SEQ ID NO: 5055010 - DNA, 14 bp, Homo sapiens
attacatttataca

SEQ ID NO: 5055011 - DNA, 16 bp, Homo sapiens
attacatttatacatc

SEQ ID NO: 5055012 - DNA, 16 bp, Homo sapiens
attacatttcatttat

SEQ ID NO: 5055013 - DNA, 17 bp, Homo sapiens
attacatttcatttata

SEQ ID NO: 5055014 - DNA, 15 bp, Homo sapiens
attacatttccaaat

SEQ ID NO: 5055015 - DNA, 17 bp, Homo sapiens
attacatttccaaatga

SEQ ID NO: 5055016 - DNA, 10 bp, Homo sapiens
attacatttt

SEQ ID NO: 5055017 - DNA, 15 bp, Homo sapiens
attacattttcagtg

SEQ ID NO: 5055018 - DNA, 13 bp, Homo sapiens
attacatttttaa

SEQ ID NO: 5055019 - DNA, 15 bp, Homo sapiens
attacatttttgcag

SEQ ID NO: 5055020 - DNA, 19 bp, Homo sapiens
attaccaaaaaagtatttt

SEQ ID NO: 5055021 - DNA, 19 bp, Homo sapiens
attaccaaagcaaggtaca

SEQ ID NO: 5055022 - DNA, 14 bp, Homo sapiens
attaccaacctgtt

SEQ ID NO: 5055023 - DNA, 20 bp, Homo sapiens
attaccaagttacttgaaaa

SEQ ID NO: 5055024 - DNA, 14 bp, Homo sapiens
attaccacacttgg

SEQ ID NO: 5055025 - DNA, 19 bp, Homo sapiens
attaccacagacatactaa

SEQ ID NO: 5055026 - DNA, 20 bp, Homo sapiens
attaccaccacctgctcact

SEQ ID NO: 5055027 - DNA, 22 bp, Homo sapiens
attaccaccatcccgtgctttt

SEQ ID NO: 5055028 - DNA, 19 bp, Homo sapiens
attaccacgccttgacctt

SEQ ID NO: 5055029 - DNA, 16 bp, Homo sapiens
attaccagaacaatta

SEQ ID NO: 5055030 - DNA, 17 bp, Homo sapiens
attaccagagttgttct

SEQ ID NO: 5055031 - DNA, 20 bp, Homo sapiens
attaccagatataaaataat

SEQ ID NO: 5055032 - DNA, 19 bp, Homo sapiens
attaccagcttaaaacact

SEQ ID NO: 5055033 - DNA, 21 bp, Homo sapiens
attaccagggactatctttgc

SEQ ID NO: 5055034 - DNA, 23 bp, Homo sapiens
attaccagtctttaaaggcccag

SEQ ID NO: 5055035 - DNA, 14 bp, Homo sapiens
attaccatgtaaat

SEQ ID NO: 5055036 - DNA, 15 bp, Homo sapiens
attaccatgtaaata

SEQ ID NO: 5055037 - DNA, 15 bp, Homo sapiens
attaccattaattac

SEQ ID NO: 5055038 - DNA, 19 bp, Homo sapiens
attaccatttgttaatatc

SEQ ID NO: 5055039 - DNA, 13 bp, Homo sapiens
attacccaagcaa

SEQ ID NO: 5055040 - DNA, 15 bp, Homo sapiens
attacccaagcaaaa

SEQ ID NO: 5055041 - DNA, 19 bp, Homo sapiens
attacccacgtgacaccac

SEQ ID NO: 5055042 - DNA, 14 bp, Homo sapiens
atttcacaaataat

SEQ ID NO: 5055043 - DNA, 13 bp, Homo sapiens
atttcacaaatat

SEQ ID NO: 5055044 - DNA, 18 bp, Homo sapiens
atttcacaaatattaaaa

SEQ ID NO: 5055045 - DNA, 20 bp, Homo sapiens
atttcacaaatattaaaaag

SEQ ID NO: 5055046 - DNA, 15 bp, Homo sapiens
atttcacaacagatc

SEQ ID NO: 5055047 - DNA, 19 bp, Homo sapiens
atttcacaacagcctgaca

SEQ ID NO: 5055048 - DNA, 12 bp, Homo sapiens
atttcacactgg

SEQ ID NO: 5055049 - DNA, 20 bp, Homo sapiens
atttcacagagcacgcctgc

SEQ ID NO: 5055050 - DNA, 23 bp, Homo sapiens
atttcacagagtacaaaatagtt

SEQ ID NO: 5055051 - DNA, 22 bp, Homo sapiens
atttcacagataatttacttat

SEQ ID NO: 5055052 - DNA, 20 bp, Homo sapiens
atttcacagatgctgtgtaa

SEQ ID NO: 5055053 - DNA, 16 bp, Homo sapiens
atttcacaggctgtaa

SEQ ID NO: 5055054 - DNA, 22 bp, Homo sapiens
atttcacagtgcccaagagtgg

SEQ ID NO: 5055055 - DNA, 17 bp, Homo sapiens
atttcacagtgtgtggt

SEQ ID NO: 5055056 - DNA, 23 bp, Homo sapiens
atttcacagtgtgtttgtgattg

SEQ ID NO: 5055057 - DNA, 17 bp, Homo sapiens
atttcacagttctgtaa

SEQ ID NO: 5055058 - DNA, 20 bp, Homo sapiens
atttcacagttggcacttct

SEQ ID NO: 5055059 - DNA, 20 bp, Homo sapiens
atttcacatcagctttagga

SEQ ID NO: 5055060 - DNA, 21 bp, Homo sapiens
atttcacattaatatttgctg

SEQ ID NO: 5055061 - DNA, 16 bp, Homo sapiens
atttcacattaatggt

SEQ ID NO: 5055062 - DNA, 18 bp, Homo sapiens
atttcacattaatggtct

SEQ ID NO: 5055063 - DNA, 22 bp, Homo sapiens
atttcacattaatggtctaaaa

SEQ ID NO: 5055064 - DNA, 14 bp, Homo sapiens
atttcacattgaat

SEQ ID NO: 5055065 - DNA, 14 bp, Homo sapiens
atttcacatttcta

SEQ ID NO: 5055066 - DNA, 16 bp, Homo sapiens
atttcacatttttgta

SEQ ID NO: 5055067 - DNA, 18 bp, Homo sapiens
atttcaccagaagttaca

SEQ ID NO: 5055068 - DNA, 12 bp, Homo sapiens
atttcaccagca

SEQ ID NO: 5055069 - DNA, 15 bp, Homo sapiens
atttcaccagcagca

SEQ ID NO: 5055070 - DNA, 23 bp, Homo sapiens
atttcacctactaatgtctcttc

SEQ ID NO: 5055071 - DNA, 16 bp, Homo sapiens
atttcacctgtaaacc

SEQ ID NO: 5055072 - DNA, 16 bp, Homo sapiens
atttcacctgtgacaa

SEQ ID NO: 5055073 - DNA, 23 bp, Homo sapiens
atttcacctgtgacaaaggatga

SEQ ID NO: 5055074 - DNA, 18 bp, Homo sapiens
atttcacggagacagcaa

SEQ ID NO: 5055075 - DNA, 23 bp, Homo sapiens
atttcacgggcaacactcactgc

SEQ ID NO: 5055076 - DNA, 18 bp, Homo sapiens
atttcacgtcataggaag

SEQ ID NO: 5055077 - DNA, 17 bp, Homo sapiens
atttcactacttagcat

SEQ ID NO: 5055078 - DNA, 16 bp, Homo sapiens
atttcactagaaaagc

SEQ ID NO: 5055079 - DNA, 15 bp, Homo sapiens
atttcactaggactc

SEQ ID NO: 5055080 - DNA, 19 bp, Homo sapiens
atttcactatcttcttcaa

SEQ ID NO: 5055081 - DNA, 14 bp, Homo sapiens
atttcactctcctt

SEQ ID NO: 5055082 - DNA, 15 bp, Homo sapiens
atttcactgaatttc

SEQ ID NO: 5055083 - DNA, 12 bp, Homo sapiens
atttcactggag

SEQ ID NO: 5055084 - DNA, 17 bp, Homo sapiens
atttcactggagcacaa

SEQ ID NO: 5055085 - DNA, 23 bp, Homo sapiens
atttcactgtctttaattctgta

SEQ ID NO: 5055086 - DNA, 16 bp, Homo sapiens
atttcacttatttaga

SEQ ID NO: 5055087 - DNA, 21 bp, Homo sapiens
atttcacttgaaattaaagct

SEQ ID NO: 5055088 - DNA, 12 bp, Homo sapiens
atttcacttgtc

SEQ ID NO: 5055089 - DNA, 15 bp, Homo sapiens
atttcactttagatg

SEQ ID NO: 5055090 - DNA, 19 bp, Homo sapiens
atttcactttagatgctga

SEQ ID NO: 5055091 - DNA, 16 bp, Homo sapiens
atttcacttttctgta

SEQ ID NO: 5055092 - DNA, 19 bp, Homo sapiens
atttcacttttgttctgct

SEQ ID NO: 5055093 - DNA, 20 bp, Homo sapiens
atttcagaaactaagaatca

SEQ ID NO: 5055094 - DNA, 16 bp, Homo sapiens
atttcagaagtttaaa

SEQ ID NO: 5055095 - DNA, 19 bp, Homo sapiens
atttcagaagtttaaatat

SEQ ID NO: 5055096 - DNA, 14 bp, Homo sapiens
atttcagaatattt

SEQ ID NO: 5055097 - DNA, 15 bp, Homo sapiens
atttcagaatatttt

SEQ ID NO: 5055098 - DNA, 22 bp, Homo sapiens
atttcagacctagcagggaagg

SEQ ID NO: 5055099 - DNA, 19 bp, Homo sapiens
atttcagagagaatcaaga

SEQ ID NO: 5055100 - DNA, 18 bp, Homo sapiens
atttcagaggctgcagga

SEQ ID NO: 5055101 - DNA, 20 bp, Homo sapiens
atttcagatacttgaagaat

SEQ ID NO: 5055102 - DNA, 19 bp, Homo sapiens
atttcagatatcaaaattc

SEQ ID NO: 5055103 - DNA, 17 bp, Homo sapiens
atttcagatgtaatgtt

SEQ ID NO: 5055104 - DNA, 16 bp, Homo sapiens
atttcagattttgata

SEQ ID NO: 5055105 - DNA, 15 bp, Homo sapiens
atttcagccaaagtc

SEQ ID NO: 5055106 - DNA, 12 bp, Homo sapiens
atttcagctgct

SEQ ID NO: 5055107 - DNA, 23 bp, Homo sapiens
atttcagcttgaacctgcttcct

SEQ ID NO: 5055108 - DNA, 22 bp, Homo sapiens
atttcaggaaaatgtattgatt

SEQ ID NO: 5055109 - DNA, 13 bp, Homo sapiens
atttcaggaattt

SEQ ID NO: 5055110 - DNA, 20 bp, Homo sapiens
atttcaggactctctccagg

SEQ ID NO: 5055111 - DNA, 21 bp, Homo sapiens
atttcaggactctctccagga

SEQ ID NO: 5055112 - DNA, 22 bp, Homo sapiens
atttcaggactctctccaggag

SEQ ID NO: 5055113 - DNA, 15 bp, Homo sapiens
atttcaggattaact

SEQ ID NO: 5055114 - DNA, 22 bp, Homo sapiens
atttcaggcagcaggggctgct

SEQ ID NO: 5055115 - DNA, 14 bp, Homo sapiens
atttcagggaaatt

SEQ ID NO: 5055116 - DNA, 16 bp, Homo sapiens
atttcagggaaattaa

SEQ ID NO: 5055117 - DNA, 15 bp, Homo sapiens
atttcagggacctca

SEQ ID NO: 5055118 - DNA, 19 bp, Homo sapiens
atttcagggacctcagggg

SEQ ID NO: 5055119 - DNA, 20 bp, Homo sapiens
atttcagggacctcaggggc

SEQ ID NO: 5055120 - DNA, 22 bp, Homo sapiens
atttcagggacctcaggggcac

SEQ ID NO: 5055121 - DNA, 18 bp, Homo sapiens
atttcagggagaaactcc

SEQ ID NO: 5055122 - DNA, 13 bp, Homo sapiens
atttcaggttact

SEQ ID NO: 5055123 - DNA, 23 bp, Homo sapiens
atttcaggttgttggtgactatc

SEQ ID NO: 5055124 - DNA, 19 bp, Homo sapiens
atttcagtaaacctgtctg

SEQ ID NO: 5055125 - DNA, 20 bp, Homo sapiens
atttcagtaaacctgtctga

SEQ ID NO: 5055126 - DNA, 21 bp, Homo sapiens
atttcagtaagatcaagctcc

SEQ ID NO: 5055127 - DNA, 14 bp, Homo sapiens
atttcagtaagtct

SEQ ID NO: 5055128 - DNA, 15 bp, Homo sapiens
atttcagtaatgtct

SEQ ID NO: 5055129 - DNA, 17 bp, Homo sapiens
atttcagtaatgtcttc

SEQ ID NO: 5055130 - DNA, 18 bp, Homo sapiens
atttcagtattttccagc

SEQ ID NO: 5055131 - DNA, 17 bp, Homo sapiens
atttcagtcctgtagtt

SEQ ID NO: 5055132 - DNA, 14 bp, Homo sapiens
atttcagtcttttc

SEQ ID NO: 5055133 - DNA, 18 bp, Homo sapiens
atttcagtgataatgttc

SEQ ID NO: 5055134 - DNA, 23 bp, Homo sapiens
atttcagtgataatgttcatttt

SEQ ID NO: 5055135 - DNA, 12 bp, Homo sapiens
atttcagtgcca

SEQ ID NO: 5055136 - DNA, 16 bp, Homo sapiens
atttcagtgtattgtt

SEQ ID NO: 5055137 - DNA, 24 bp, Homo sapiens
atttcagttctaaaaagatgtaat

SEQ ID NO: 5055138 - DNA, 19 bp, Homo sapiens
atttcagttctaggaaaat

SEQ ID NO: 5055139 - DNA, 10 bp, Homo sapiens
atttcagttt

SEQ ID NO: 5055140 - DNA, 17 bp, Homo sapiens
atttcagttttaaaaat

SEQ ID NO: 5055141 - DNA, 18 bp, Homo sapiens
atttcagttttaaaaatg

SEQ ID NO: 5055142 - DNA, 15 bp, Homo sapiens
atttcagtttttcat

SEQ ID NO: 5055143 - DNA, 18 bp, Homo sapiens
atttcagtttttcatttg

SEQ ID NO: 5055144 - DNA, 19 bp, Homo sapiens
atttcagtttttcatttgt

SEQ ID NO: 5055145 - DNA, 22 bp, Homo sapiens
atttcataaattaacaaagtgt

SEQ ID NO: 5055146 - DNA, 15 bp, Homo sapiens
atttcataaattggc

SEQ ID NO: 5055147 - DNA, 20 bp, Homo sapiens
atttcataaattggctcctt

SEQ ID NO: 5055148 - DNA, 16 bp, Homo sapiens
atttcataagacaaga

SEQ ID NO: 5055149 - DNA, 20 bp, Homo sapiens
atttcataaggcctgccctc

SEQ ID NO: 5055150 - DNA, 15 bp, Homo sapiens
atttcataattctga

SEQ ID NO: 5055151 - DNA, 16 bp, Homo sapiens
atttcataattctgaa

SEQ ID NO: 5055152 - DNA, 17 bp, Homo sapiens
atttcataattctgaaa

SEQ ID NO: 5055153 - DNA, 23 bp, Homo sapiens
atttcataattgcctacatttat

SEQ ID NO: 5055154 - DNA, 23 bp, Homo sapiens
atttcataatttgtttccagcat

SEQ ID NO: 5055155 - DNA, 21 bp, Homo sapiens
atttcataccattattatgta

SEQ ID NO: 5055156 - DNA, 21 bp, Homo sapiens
atttcatacctcagaatgtaa

SEQ ID NO: 5055157 - DNA, 23 bp, Homo sapiens
atttcatactgaaattattttct

SEQ ID NO: 5055158 - DNA, 23 bp, Homo sapiens
atttcatactgtaacattcagga

SEQ ID NO: 5055159 - DNA, 19 bp, Homo sapiens
atttcatagatattttata

SEQ ID NO: 5055160 - DNA, 13 bp, Homo sapiens
atttcatagttca

SEQ ID NO: 5055161 - DNA, 16 bp, Homo sapiens
atttcatagttcagaa

SEQ ID NO: 5055162 - DNA, 15 bp, Homo sapiens
atttcctctaaagaa

SEQ ID NO: 5055163 - DNA, 22 bp, Homo sapiens
atttcctctattgatgtacagt

SEQ ID NO: 5055164 - DNA, 16 bp, Homo sapiens
atttcctctccactgc

SEQ ID NO: 5055165 - DNA, 21 bp, Homo sapiens
atttcctctgaattataataa

SEQ ID NO: 5055166 - DNA, 17 bp, Homo sapiens
atttcctctgagctgtt

SEQ ID NO: 5055167 - DNA, 14 bp, Homo sapiens
atttcctcttcctt

SEQ ID NO: 5055168 - DNA, 16 bp, Homo sapiens
atttcctcttgaacca

SEQ ID NO: 5055169 - DNA, 18 bp, Homo sapiens
atttcctgaaataaatgt

SEQ ID NO: 5055170 - DNA, 19 bp, Homo sapiens
atttcctgacagcaggtgt

SEQ ID NO: 5055171 - DNA, 11 bp, Homo sapiens
atttcctgcta

SEQ ID NO: 5055172 - DNA, 15 bp, Homo sapiens
atttcctgctcctcc

SEQ ID NO: 5055173 - DNA, 18 bp, Homo sapiens
atttcctggagtgccctg

SEQ ID NO: 5055174 - DNA, 14 bp, Homo sapiens
atttcctggatgtt

SEQ ID NO: 5055175 - DNA, 16 bp, Homo sapiens
atttcctggccctcca

SEQ ID NO: 5055176 - DNA, 18 bp, Homo sapiens
atttcctgggagaaagac

SEQ ID NO: 5055177 - DNA, 22 bp, Homo sapiens
atttcctgggagcttttgtaga

SEQ ID NO: 5055178 - DNA, 17 bp, Homo sapiens
atttcctggtgtgaagg

SEQ ID NO: 5055179 - DNA, 18 bp, Homo sapiens
atttcctgtacaatcatg

SEQ ID NO: 5055180 - DNA, 22 bp, Homo sapiens
atttcctgtacaatcatgaaca

SEQ ID NO: 5055181 - DNA, 22 bp, Homo sapiens
atttcctgtataatttaacagt

SEQ ID NO: 5055182 - DNA, 16 bp, Homo sapiens
atttcctgtatgttgt

SEQ ID NO: 5055183 - DNA, 12 bp, Homo sapiens
atttcctgtgag

SEQ ID NO: 5055184 - DNA, 14 bp, Homo sapiens
atttcctgtgagga

SEQ ID NO: 5055185 - DNA, 19 bp, Homo sapiens
atttcctgtgtttgtcctg

SEQ ID NO: 5055186 - DNA, 22 bp, Homo sapiens
atttcctgtgtttgtcctgggt

SEQ ID NO: 5055187 - DNA, 21 bp, Homo sapiens
atttcctgttggatttgttta

SEQ ID NO: 5055188 - DNA, 23 bp, Homo sapiens
atttcctgttggatttgtttaaa

SEQ ID NO: 5055189 - DNA, 19 bp, Homo sapiens
atttcctgtttgaaatatc

SEQ ID NO: 5055190 - DNA, 18 bp, Homo sapiens
atttccttagtgccagga

SEQ ID NO: 5055191 - DNA, 21 bp, Homo sapiens
atttccttcaccacctcatgt

SEQ ID NO: 5055192 - DNA, 12 bp, Homo sapiens
atttccttcagg

SEQ ID NO: 5055193 - DNA, 23 bp, Homo sapiens
atttccttccaaggtcactcttg

SEQ ID NO: 5055194 - DNA, 12 bp, Homo sapiens
atttccttccag

SEQ ID NO: 5055195 - DNA, 19 bp, Homo sapiens
atttccttctgttaagaaa

SEQ ID NO: 5055196 - DNA, 20 bp, Homo sapiens
atttccttctgttaagaaag

SEQ ID NO: 5055197 - DNA, 14 bp, Homo sapiens
atttccttgaatgt

SEQ ID NO: 5055198 - DNA, 11 bp, Homo sapiens
atttccttgga

SEQ ID NO: 5055199 - DNA, 13 bp, Homo sapiens
atttccttggagg

SEQ ID NO: 5055200 - DNA, 15 bp, Homo sapiens
atttccttggaggcc

SEQ ID NO: 5055201 - DNA, 19 bp, Homo sapiens
atttccttgtctaaagatc

SEQ ID NO: 5055202 - DNA, 13 bp, Homo sapiens
atttcctttatac

SEQ ID NO: 5055203 - DNA, 17 bp, Homo sapiens
atttcctttatactgtg

SEQ ID NO: 5055204 - DNA, 13 bp, Homo sapiens
atttcctttatgt

SEQ ID NO: 5055205 - DNA, 17 bp, Homo sapiens
atttcctttatgtgaat

SEQ ID NO: 5055206 - DNA, 16 bp, Homo sapiens
atttcctttgcttcaa

SEQ ID NO: 5055207 - DNA, 16 bp, Homo sapiens
atttcctttggcaata

SEQ ID NO: 5055208 - DNA, 13 bp, Homo sapiens
atttcctttggct

SEQ ID NO: 5055209 - DNA, 13 bp, Homo sapiens
atttccttttcac

SEQ ID NO: 5055210 - DNA, 22 bp, Homo sapiens
atttccttttcacattagataa

SEQ ID NO: 5055211 - DNA, 18 bp, Homo sapiens
atttccttttctctgccc

SEQ ID NO: 5055212 - DNA, 18 bp, Homo sapiens
atttccttttgtaaagta

SEQ ID NO: 5055213 - DNA, 23 bp, Homo sapiens
atttccttttgtaaagtaaaata

SEQ ID NO: 5055214 - DNA, 23 bp, Homo sapiens
atttccttttgtccacttgtaag

SEQ ID NO: 5055215 - DNA, 16 bp, Homo sapiens
atttcctttttctagt

SEQ ID NO: 5055216 - DNA, 18 bp, Homo sapiens
atttcctttttgacactg

SEQ ID NO: 5055217 - DNA, 19 bp, Homo sapiens
atttcctttttgacactga

SEQ ID NO: 5055218 - DNA, 18 bp, Homo sapiens
atttccttttttcttttc

SEQ ID NO: 5055219 - DNA, 15 bp, Homo sapiens
atttcgaaactgcca

SEQ ID NO: 5055220 - DNA, 24 bp, Homo sapiens
attagaaatattttaaaatcagct

SEQ ID NO: 5055221 - DNA, 13 bp, Homo sapiens
attagaaatgaat

SEQ ID NO: 5055222 - DNA, 23 bp, Homo sapiens
attagaaattagctgtgtgaaat

SEQ ID NO: 5055223 - DNA, 14 bp, Homo sapiens
attagaaatttata

SEQ ID NO: 5055224 - DNA, 15 bp, Homo sapiens
attagaacttgaata

SEQ ID NO: 5055225 - DNA, 15 bp, Homo sapiens
attagaagaaaacat

SEQ ID NO: 5055226 - DNA, 19 bp, Homo sapiens
attagaagaaaacatatat

SEQ ID NO: 5055227 - DNA, 13 bp, Homo sapiens
attagaagaaaat

SEQ ID NO: 5055228 - DNA, 22 bp, Homo sapiens
attagaagaaaataatttatat

SEQ ID NO: 5055229 - DNA, 19 bp, Homo sapiens
attagaatcaaacattttg

SEQ ID NO: 5055230 - DNA, 20 bp, Homo sapiens
attagaatccaattaatgat

SEQ ID NO: 5055231 - DNA, 11 bp, Homo sapiens
attagaatgct

SEQ ID NO: 5055232 - DNA, 17 bp, Homo sapiens
attagaattaccatttg

SEQ ID NO: 5055233 - DNA, 14 bp, Homo sapiens
attagaattattta

SEQ ID NO: 5055234 - DNA, 13 bp, Homo sapiens
attagaattctgt

SEQ ID NO: 5055235 - DNA, 16 bp, Homo sapiens
attagaattctgtata

SEQ ID NO: 5055236 - DNA, 17 bp, Homo sapiens
attagaattctgtatag

SEQ ID NO: 5055237 - DNA, 15 bp, Homo sapiens
attagacacacatat

SEQ ID NO: 5055238 - DNA, 16 bp, Homo sapiens
attagacacacatata

SEQ ID NO: 5055239 - DNA, 22 bp, Homo sapiens
attagacacacatatacattat

SEQ ID NO: 5055240 - DNA, 18 bp, Homo sapiens
attagacactttggaaga

SEQ ID NO: 5055241 - DNA, 14 bp, Homo sapiens
attagacagaacac

SEQ ID NO: 5055242 - DNA, 17 bp, Homo sapiens
attagacagaacaccta

SEQ ID NO: 5055243 - DNA, 23 bp, Homo sapiens
attagacaggttaaatatataaa

SEQ ID NO: 5055244 - DNA, 13 bp, Homo sapiens
attagacctttat

SEQ ID NO: 5055245 - DNA, 17 bp, Homo sapiens
attagactgaatttaac

SEQ ID NO: 5055246 - DNA, 14 bp, Homo sapiens
attagacttctgtt

SEQ ID NO: 5055247 - DNA, 16 bp, Homo sapiens
attagacttctgtttt

SEQ ID NO: 5055248 - DNA, 19 bp, Homo sapiens
attagactttagaaataaa

SEQ ID NO: 5055249 - DNA, 17 bp, Homo sapiens
attagagaaaaccttaa

SEQ ID NO: 5055250 - DNA, 12 bp, Homo sapiens
attagagaaagt

SEQ ID NO: 5055251 - DNA, 16 bp, Homo sapiens
attagagagtgttgaa

SEQ ID NO: 5055252 - DNA, 19 bp, Homo sapiens
attagagagtgttgaaacg

SEQ ID NO: 5055253 - DNA, 21 bp, Homo sapiens
attagagattgacttcagaaa

SEQ ID NO: 5055254 - DNA, 21 bp, Homo sapiens
attagagcacagcttcttctg

SEQ ID NO: 5055255 - DNA, 21 bp, Homo sapiens
attagagcagatgacccctcc

SEQ ID NO: 5055256 - DNA, 15 bp, Homo sapiens
attagagcttaaatt

SEQ ID NO: 5055257 - DNA, 13 bp, Homo sapiens
attagagggaggt

SEQ ID NO: 5055258 - DNA, 11 bp, Homo sapiens
attagagggcc

SEQ ID NO: 5055259 - DNA, 22 bp, Homo sapiens
attagagggccttgcttctctt

SEQ ID NO: 5055260 - DNA, 16 bp, Homo sapiens
attagaggggaaaagc

SEQ ID NO: 5055261 - DNA, 17 bp, Homo sapiens
attagagtatttccctt

SEQ ID NO: 5055262 - DNA, 23 bp, Homo sapiens
attagagtatttcccttccaaag

SEQ ID NO: 5055263 - DNA, 23 bp, Homo sapiens
attagagtcaactacacaaagca

SEQ ID NO: 5055264 - DNA, 23 bp, Homo sapiens
attagagtcagagatcttggtat

SEQ ID NO: 5055265 - DNA, 16 bp, Homo sapiens
attagagtgtctttcc

SEQ ID NO: 5055266 - DNA, 15 bp, Homo sapiens
attagataaacacag

SEQ ID NO: 5055267 - DNA, 17 bp, Homo sapiens
attagataaacacaggc

SEQ ID NO: 5055268 - DNA, 17 bp, Homo sapiens
attagataaagatttct

SEQ ID NO: 5055269 - DNA, 18 bp, Homo sapiens
attagataaatgtccatt

SEQ ID NO: 5055270 - DNA, 14 bp, Homo sapiens
attagataaattac

SEQ ID NO: 5055271 - DNA, 20 bp, Homo sapiens
attagatagtcatgctgcta

SEQ ID NO: 5055272 - DNA, 16 bp, Homo sapiens
attagatcaaatagtt

SEQ ID NO: 5055273 - DNA, 22 bp, Homo sapiens
attagatcaattacttatttta

SEQ ID NO: 5055274 - DNA, 18 bp, Homo sapiens
attagatcttcaaacaga

SEQ ID NO: 5055275 - DNA, 21 bp, Homo sapiens
attagatgactgaatttctat

SEQ ID NO: 5055276 - DNA, 13 bp, Homo sapiens
attagatgcatgt

SEQ ID NO: 5055277 - DNA, 17 bp, Homo sapiens
attagatgctctgagaa

SEQ ID NO: 5055278 - DNA, 18 bp, Homo sapiens
attagatgctctgagaaa

SEQ ID NO: 5055279 - DNA, 19 bp, Homo sapiens
attagatggaaaaatgtga

SEQ ID NO: 5055280 - DNA, 18 bp, Homo sapiens
attagatgtcatgaggaa

SEQ ID NO: 5055281 - DNA, 22 bp, Homo sapiens
attagatgttacaagtttatat

SEQ ID NO: 5055282 - DNA, 13 bp, Homo sapiens
attagatgtttat

SEQ ID NO: 5055283 - DNA, 18 bp, Homo sapiens
attagatgtttatttaga

SEQ ID NO: 5055284 - DNA, 21 bp, Homo sapiens
attagattgcaaagcaatgaa

SEQ ID NO: 5055285 - DNA, 16 bp, Homo sapiens
attagatttaaaataa

SEQ ID NO: 5055286 - DNA, 23 bp, Homo sapiens
attagatttctcatttgccaata

SEQ ID NO: 5055287 - DNA, 17 bp, Homo sapiens
attagatttctgaatct

SEQ ID NO: 5055288 - DNA, 22 bp, Homo sapiens
attagattttattttactattg

SEQ ID NO: 5055289 - DNA, 19 bp, Homo sapiens
attagcaaaaaaagttgta

SEQ ID NO: 5055290 - DNA, 20 bp, Homo sapiens
attagcaaaaaaagttgtat

SEQ ID NO: 5055291 - DNA, 18 bp, Homo sapiens
attagcaaagaagcttca

SEQ ID NO: 5055292 - DNA, 18 bp, Homo sapiens
attagcaaggcagagcct

SEQ ID NO: 5055293 - DNA, 21 bp, Homo sapiens
attagcaagtgagtttggtgt

SEQ ID NO: 5055294 - DNA, 15 bp, Homo sapiens
attagcaatcatttt

SEQ ID NO: 5055295 - DNA, 14 bp, Homo sapiens
attagcacagattt

SEQ ID NO: 5055296 - DNA, 14 bp, Homo sapiens
attagcaccagctt

SEQ ID NO: 5055297 - DNA, 15 bp, Homo sapiens
attagcaccagcttg

SEQ ID NO: 5055298 - DNA, 15 bp, Homo sapiens
attagcacctctttt

SEQ ID NO: 5055299 - DNA, 20 bp, Homo sapiens
attagcagccatattgtcac

SEQ ID NO: 5055300 - DNA, 19 bp, Homo sapiens
attagcaggtgcaccttct

SEQ ID NO: 5055301 - DNA, 12 bp, Homo sapiens
attagcattctg

SEQ ID NO: 5055302 - DNA, 19 bp, Homo sapiens
attagcatttgtcaacaaa

SEQ ID NO: 5055303 - DNA, 14 bp, Homo sapiens
attagccaggatca

SEQ ID NO: 5055304 - DNA, 21 bp, Homo sapiens
attagccaggatcatggtgta

SEQ ID NO: 5055305 - DNA, 15 bp, Homo sapiens
attagccaggtaatg

SEQ ID NO: 5055306 - DNA, 18 bp, Homo sapiens
attagccagtaatcctgt

SEQ ID NO: 5055307 - DNA, 23 bp, Homo sapiens
attagccagtaatcctgtaggaa

SEQ ID NO: 5055308 - DNA, 15 bp, Homo sapiens
attagccctgcattt

SEQ ID NO: 5055309 - DNA, 17 bp, Homo sapiens
attagccctgcattttc

SEQ ID NO: 5055310 - DNA, 21 bp, Homo sapiens
attagcctcgtctttcagcga

SEQ ID NO: 5055311 - DNA, 17 bp, Homo sapiens
attagcctgagtagaaa

SEQ ID NO: 5055312 - DNA, 15 bp, Homo sapiens
attagcggctcctcg

SEQ ID NO: 5055313 - DNA, 19 bp, Homo sapiens
attagctagactaggagac

SEQ ID NO: 5055314 - DNA, 24 bp, Homo sapiens
attagctatatttttatataatat

SEQ ID NO: 5055315 - DNA, 18 bp, Homo sapiens
attagctcactgaatctt

SEQ ID NO: 5055316 - DNA, 15 bp, Homo sapiens
attagctctgggggg

SEQ ID NO: 5055317 - DNA, 13 bp, Homo sapiens
attagctgcttct

SEQ ID NO: 5055318 - DNA, 21 bp, Homo sapiens
attagctgcttctatgtttca

SEQ ID NO: 5055319 - DNA, 21 bp, Homo sapiens
attagctgtaaatacatgtgt

SEQ ID NO: 5055320 - DNA, 15 bp, Homo sapiens
attagctgtgatttt

SEQ ID NO: 5055321 - DNA, 22 bp, Homo sapiens
attagctgtgatttttgttgat

SEQ ID NO: 5055322 - DNA, 15 bp, Homo sapiens
attagcttcaggata

SEQ ID NO: 5055323 - DNA, 18 bp, Homo sapiens
attagcttgcttaaggca

SEQ ID NO: 5055324 - DNA, 18 bp, Homo sapiens
attagcttgtctattatt

SEQ ID NO: 5055325 - DNA, 16 bp, Homo sapiens
attagctttaattaag

SEQ ID NO: 5055326 - DNA, 15 bp, Homo sapiens
attagctttactgtt

SEQ ID NO: 5055327 - DNA, 19 bp, Homo sapiens
attagctttattatggctt

SEQ ID NO: 5055328 - DNA, 23 bp, Homo sapiens
attagctttattatggcttgtga

SEQ ID NO: 5055329 - DNA, 13 bp, Homo sapiens
attagctttctcc

SEQ ID NO: 5055330 - DNA, 23 bp, Homo sapiens
attagctttgggtgcctttgcca

SEQ ID NO: 5055331 - DNA, 12 bp, Homo sapiens
attagctttgtg

SEQ ID NO: 5055332 - DNA, 13 bp, Homo sapiens
attagcttttcct

SEQ ID NO: 5055333 - DNA, 17 bp, Homo sapiens
attaggaaaagatattt

SEQ ID NO: 5055334 - DNA, 22 bp, Homo sapiens
attaggaaaagatatttttata

SEQ ID NO: 5055335 - DNA, 14 bp, Homo sapiens
attaggaaaataaa

SEQ ID NO: 5055336 - DNA, 15 bp, Homo sapiens
attaggaaaatatgg

SEQ ID NO: 5055337 - DNA, 18 bp, Homo sapiens
attaggaacagagtatat

SEQ ID NO: 5055338 - DNA, 22 bp, Homo sapiens
attaggaacagagtatatatgt

SEQ ID NO: 5055339 - DNA, 17 bp, Homo sapiens
attaggaattactttat

SEQ ID NO: 5055340 - DNA, 19 bp, Homo sapiens
caggactcccagaacctct

SEQ ID NO: 5055341 - DNA, 21 bp, Homo sapiens
caggactcccagaacctctaa

SEQ ID NO: 5055342 - DNA, 17 bp, Homo sapiens
caggactccccaggcca

SEQ ID NO: 5055343 - DNA, 19 bp, Homo sapiens
caggactccccaggccagg

SEQ ID NO: 5055344 - DNA, 13 bp, Homo sapiens
caggactccctcc

SEQ ID NO: 5055345 - DNA, 14 bp, Homo sapiens
caggactccctcct

SEQ ID NO: 5055346 - DNA, 15 bp, Homo sapiens
caggactccctcctc

SEQ ID NO: 5055347 - DNA, 17 bp, Homo sapiens
caggactccctcctcac

SEQ ID NO: 5055348 - DNA, 18 bp, Homo sapiens
caggactctatccctggc

SEQ ID NO: 5055349 - DNA, 17 bp, Homo sapiens
caggactctctccagga

SEQ ID NO: 5055350 - DNA, 14 bp, Homo sapiens
caggactctgcagc

SEQ ID NO: 5055351 - DNA, 15 bp, Homo sapiens
caggactctgcagcc

SEQ ID NO: 5055352 - DNA, 20 bp, Homo sapiens
caggactctgcccagaccac

SEQ ID NO: 5055353 - DNA, 20 bp, Homo sapiens
caggactctgccccttctgt

SEQ ID NO: 5055354 - DNA, 13 bp, Homo sapiens
caggactctgcct

SEQ ID NO: 5055355 - DNA, 15 bp, Homo sapiens
caggactctgcctcc

SEQ ID NO: 5055356 - DNA, 16 bp, Homo sapiens
caggactctgcctcct

SEQ ID NO: 5055357 - DNA, 14 bp, Homo sapiens
caggactctgcctt

SEQ ID NO: 5055358 - DNA, 15 bp, Homo sapiens
caggactctgccttc

SEQ ID NO: 5055359 - DNA, 17 bp, Homo sapiens
caggactctgcgggagg

SEQ ID NO: 5055360 - DNA, 15 bp, Homo sapiens
caggactctggcact

SEQ ID NO: 5055361 - DNA, 23 bp, Homo sapiens
caggactctttgaagaaaagaaa

SEQ ID NO: 5055362 - DNA, 17 bp, Homo sapiens
caggactgagccccgca

SEQ ID NO: 5055363 - DNA, 20 bp, Homo sapiens
caggactgagccccgcagac

SEQ ID NO: 5055364 - DNA, 21 bp, Homo sapiens
caggactgagccctctcactc

SEQ ID NO: 5055365 - DNA, 15 bp, Homo sapiens
caggactgaggacag

SEQ ID NO: 5055366 - DNA, 21 bp, Homo sapiens
caggactgagtcccctccagg

SEQ ID NO: 5055367 - DNA, 16 bp, Homo sapiens
caggactgcagagcag

SEQ ID NO: 5055368 - DNA, 17 bp, Homo sapiens
caggactgcagagcaga

SEQ ID NO: 5055369 - DNA, 19 bp, Homo sapiens
caggactgcagagcagatg

SEQ ID NO: 5055370 - DNA, 15 bp, Homo sapiens
caggactggctcacc

SEQ ID NO: 5055371 - DNA, 15 bp, Homo sapiens
caggactgggccact

SEQ ID NO: 5055372 - DNA, 21 bp, Homo sapiens
caggactgggtctgacctggt

SEQ ID NO: 5055373 - DNA, 20 bp, Homo sapiens
caggactgtaaagatttgtt

SEQ ID NO: 5055374 - DNA, 13 bp, Homo sapiens
caggactgtgacc

SEQ ID NO: 5055375 - DNA, 15 bp, Homo sapiens
caggactgtgaccaa

SEQ ID NO: 5055376 - DNA, 16 bp, Homo sapiens
caggactgtgaccaaa

SEQ ID NO: 5055377 - DNA, 18 bp, Homo sapiens
caggactgtgaccaaagc

SEQ ID NO: 5055378 - DNA, 23 bp, Homo sapiens
caggactgtgataatcagaagct

SEQ ID NO: 5055379 - DNA, 15 bp, Homo sapiens
caggactgtgcctcc

SEQ ID NO: 5055380 - DNA, 23 bp, Homo sapiens
caggactgtgggggcccctcagg

SEQ ID NO: 5055381 - DNA, 20 bp, Homo sapiens
caggacttaacggctccagg

SEQ ID NO: 5055382 - DNA, 23 bp, Homo sapiens
caggacttaagacaaatgggact

SEQ ID NO: 5055383 - DNA, 21 bp, Homo sapiens
caggacttagaatagtgccta

SEQ ID NO: 5055384 - DNA, 15 bp, Homo sapiens
caggacttattatat

SEQ ID NO: 5055385 - DNA, 16 bp, Homo sapiens
caggacttctcaccag

SEQ ID NO: 5055386 - DNA, 23 bp, Homo sapiens
caggacttgcttccaagcccttc

SEQ ID NO: 5055387 - DNA, 17 bp, Homo sapiens
caggacttggggtcagg

SEQ ID NO: 5055388 - DNA, 19 bp, Homo sapiens
caggacttggggtcaggaa

SEQ ID NO: 5055389 - DNA, 20 bp, Homo sapiens
caggacttggtctgatttca

SEQ ID NO: 5055390 - DNA, 23 bp, Homo sapiens
caggacttggtctgatttcagga

SEQ ID NO: 5055391 - DNA, 14 bp, Homo sapiens
caggactttccctg

SEQ ID NO: 5055392 - DNA, 23 bp, Homo sapiens
caggactttgatgcatttccaca

SEQ ID NO: 5055393 - DNA, 15 bp, Homo sapiens
caggagaaagccggg

SEQ ID NO: 5055394 - DNA, 18 bp, Homo sapiens
caggagaaagccggggga

SEQ ID NO: 5055395 - DNA, 20 bp, Homo sapiens
caggagaaagccgggggagg

SEQ ID NO: 5055396 - DNA, 21 bp, Homo sapiens
caggagaaagccgggggaggg

SEQ ID NO: 5055397 - DNA, 19 bp, Homo sapiens
caggagaaagtaccctctt

SEQ ID NO: 5055398 - DNA, 17 bp, Homo sapiens
caggagaaccactacat

SEQ ID NO: 5055399 - DNA, 14 bp, Homo sapiens
caggagaagaaaga

SEQ ID NO: 5055400 - DNA, 16 bp, Homo sapiens
caggagaagaaagaac

SEQ ID NO: 5055401 - DNA, 21 bp, Homo sapiens
caggagaagaacaagaaatgg

SEQ ID NO: 5055402 - DNA, 14 bp, Homo sapiens
caggagaagagagg

SEQ ID NO: 5055403 - DNA, 17 bp, Homo sapiens
caggagaagccagtgtc

SEQ ID NO: 5055404 - DNA, 15 bp, Homo sapiens
caggagaagctcagc

SEQ ID NO: 5055405 - DNA, 22 bp, Homo sapiens
caggagaaggccaattcctata

SEQ ID NO: 5055406 - DNA, 15 bp, Homo sapiens
caggagaaggcctgc

SEQ ID NO: 5055407 - DNA, 15 bp, Homo sapiens
caggagaagggacaa

SEQ ID NO: 5055408 - DNA, 18 bp, Homo sapiens
caggagaaggggaaggga

SEQ ID NO: 5055409 - DNA, 16 bp, Homo sapiens
caggagaaggtcagcg

SEQ ID NO: 5055410 - DNA, 18 bp, Homo sapiens
caggagaagtgctccctg

SEQ ID NO: 5055411 - DNA, 23 bp, Homo sapiens
caggagaagtgctccctggaggc

SEQ ID NO: 5055412 - DNA, 14 bp, Homo sapiens
caggagaatcactg

SEQ ID NO: 5055413 - DNA, 16 bp, Homo sapiens
caggagaatcgcttga

SEQ ID NO: 5055414 - DNA, 21 bp, Homo sapiens
caggagaatcgcttgaacctg

SEQ ID NO: 5055415 - DNA, 22 bp, Homo sapiens
caggagaatcgcttgaacctgg

SEQ ID NO: 5055416 - DNA, 18 bp, Homo sapiens
caggagaattaggaaggc

SEQ ID NO: 5055417 - DNA, 23 bp, Homo sapiens
caggagacaaacagcccttcctt

SEQ ID NO: 5055418 - DNA, 19 bp, Homo sapiens
caggagacactggtctcag

SEQ ID NO: 5055419 - DNA, 23 bp, Homo sapiens
caggagacactgtgctataaatc

SEQ ID NO: 5055420 - DNA, 13 bp, Homo sapiens
caggagacattac

SEQ ID NO: 5055421 - DNA, 14 bp, Homo sapiens
caggagacattttc

SEQ ID NO: 5055422 - DNA, 15 bp, Homo sapiens
caggagaccaccccc

SEQ ID NO: 5055423 - DNA, 15 bp, Homo sapiens
caggagaccctgtct

SEQ ID NO: 5055424 - DNA, 19 bp, Homo sapiens
caggagactgggctctggc

SEQ ID NO: 5055425 - DNA, 21 bp, Homo sapiens
caggagactgtggagactgct

SEQ ID NO: 5055426 - DNA, 15 bp, Homo sapiens
caggagagaagctgg

SEQ ID NO: 5055427 - DNA, 15 bp, Homo sapiens
caggagagacaggat

SEQ ID NO: 5055428 - DNA, 16 bp, Homo sapiens
caggagagacccctcc

SEQ ID NO: 5055429 - DNA, 13 bp, Homo sapiens
caggagagagaaa

SEQ ID NO: 5055430 - DNA, 14 bp, Homo sapiens
caggagagagaaag

SEQ ID NO: 5055431 - DNA, 20 bp, Homo sapiens
caggagagagaaagccaggc

SEQ ID NO: 5055432 - DNA, 16 bp, Homo sapiens
caggagagagagagag

SEQ ID NO: 5055433 - DNA, 20 bp, Homo sapiens
caggagagagagagagaaag

SEQ ID NO: 5055434 - DNA, 23 bp, Homo sapiens
caggagagagagagagaaagaat

SEQ ID NO: 5055435 - DNA, 14 bp, Homo sapiens
caggagagagatct

SEQ ID NO: 5055436 - DNA, 11 bp, Homo sapiens
caggagagagc

SEQ ID NO: 5055437 - DNA, 14 bp, Homo sapiens
caggagagagccag

SEQ ID NO: 5055438 - DNA, 16 bp, Homo sapiens
caggagagagccagga

SEQ ID NO: 5055439 - DNA, 21 bp, Homo sapiens
caggagagagccaggatgccc

SEQ ID NO: 5055440 - DNA, 17 bp, Homo sapiens
caggagagagccttggc

SEQ ID NO: 5055441 - DNA, 19 bp, Homo sapiens
caggagagagttgaaccta

SEQ ID NO: 5055442 - DNA, 19 bp, Homo sapiens
caggagagcacccacagcc

SEQ ID NO: 5055443 - DNA, 20 bp, Homo sapiens
caggagagcatcaccaccac

SEQ ID NO: 5055444 - DNA, 16 bp, Homo sapiens
caggagagccagccct

SEQ ID NO: 5055445 - DNA, 17 bp, Homo sapiens
caggagagccagccctc

SEQ ID NO: 5055446 - DNA, 18 bp, Homo sapiens
caggagagccagccctcc

SEQ ID NO: 5055447 - DNA, 17 bp, Homo sapiens
caggagagcccccacca

SEQ ID NO: 5055448 - DNA, 23 bp, Homo sapiens
caggagagcccccaccagcagca

SEQ ID NO: 5055449 - DNA, 22 bp, Homo sapiens
caggagagccctctgctgcttt

SEQ ID NO: 5055450 - DNA, 15 bp, Homo sapiens
caggagagcctgggg

SEQ ID NO: 5055451 - DNA, 13 bp, Homo sapiens
caggagaggaaga

SEQ ID NO: 5055452 - DNA, 14 bp, Homo sapiens
caggagaggagagc

SEQ ID NO: 5055453 - DNA, 18 bp, Homo sapiens
caggagaggagagccaga

SEQ ID NO: 5055454 - DNA, 17 bp, Homo sapiens
caggagaggctgggctg

SEQ ID NO: 5055455 - DNA, 20 bp, Homo sapiens
caggagagggatacaagaga

SEQ ID NO: 5055456 - DNA, 12 bp, Homo sapiens
caggagagtaga

SEQ ID NO: 5055457 - DNA, 23 bp, Homo sapiens
caggagataattgtttcattcat

SEQ ID NO: 5055458 - DNA, 14 bp, Homo sapiens
caggagatcagcag

SEQ ID NO: 5055459 - DNA, 16 bp, Homo sapiens
caggagatcagcagcg

SEQ ID NO: 5055460 - DNA, 23 bp, Homo sapiens
caggagatcgagaccatcctggc

SEQ ID NO: 5055461 - DNA, 17 bp, Homo sapiens
caggagatggagggctt

SEQ ID NO: 5055462 - DNA, 14 bp, Homo sapiens
caggagatggcccc

SEQ ID NO: 5055463 - DNA, 18 bp, Homo sapiens
caggagatggccccaaca

SEQ ID NO: 5055464 - DNA, 23 bp, Homo sapiens
caggagatggggaataatttcct

SEQ ID NO: 5055465 - DNA, 15 bp, Homo sapiens
caggagatgggtcca

SEQ ID NO: 5055466 - DNA, 17 bp, Homo sapiens
caggagattgagaagga

SEQ ID NO: 5055467 - DNA, 15 bp, Homo sapiens
caggagcaaatgctg

SEQ ID NO: 5055468 - DNA, 13 bp, Homo sapiens
caggagcaagtga

SEQ ID NO: 5055469 - DNA, 17 bp, Homo sapiens
caggagcaatcacagga

SEQ ID NO: 5055470 - DNA, 17 bp, Homo sapiens
caggagcaatgggactg

SEQ ID NO: 5055471 - DNA, 18 bp, Homo sapiens
caggagcaatgggactgg

SEQ ID NO: 5055472 - DNA, 15 bp, Homo sapiens
caggagcacacccag

SEQ ID NO: 5055473 - DNA, 19 bp, Homo sapiens
caggagcacacccagcccc

SEQ ID NO: 5055474 - DNA, 17 bp, Homo sapiens
caggagcacacggccct

SEQ ID NO: 5055475 - DNA, 14 bp, Homo sapiens
caggagcacagcca

SEQ ID NO: 5055476 - DNA, 15 bp, Homo sapiens
caggagcacagccat

SEQ ID NO: 5055477 - DNA, 16 bp, Homo sapiens
caggagcacagccata

SEQ ID NO: 5055478 - DNA, 16 bp, Homo sapiens
caggagcaccctgtct

SEQ ID NO: 5055479 - DNA, 18 bp, Homo sapiens
caggagcaccctgtcttc

SEQ ID NO: 5055480 - DNA, 20 bp, Homo sapiens
caggagcaccctgtcttctt

SEQ ID NO: 5055481 - DNA, 16 bp, Homo sapiens
caggagcacggctctg

SEQ ID NO: 5055482 - DNA, 17 bp, Homo sapiens
caggagcacggctctgt

SEQ ID NO: 5055483 - DNA, 19 bp, Homo sapiens
caggagcacggctctgtcc

SEQ ID NO: 5055484 - DNA, 14 bp, Homo sapiens
caggagcagaaaga

SEQ ID NO: 5055485 - DNA, 13 bp, Homo sapiens
caggagcagacag

SEQ ID NO: 5055486 - DNA, 15 bp, Homo sapiens
caggagcagacagag

SEQ ID NO: 5055487 - DNA, 16 bp, Homo sapiens
caggagcagacagaga

SEQ ID NO: 5055488 - DNA, 13 bp, Homo sapiens
caggagcagcagc

SEQ ID NO: 5055489 - DNA, 16 bp, Homo sapiens
caggagcagcagccag

SEQ ID NO: 5055490 - DNA, 19 bp, Homo sapiens
caggagcagcagccagcac

SEQ ID NO: 5055491 - DNA, 21 bp, Homo sapiens
caggagcagcagccagcacca

SEQ ID NO: 5055492 - DNA, 12 bp, Homo sapiens
cactgcaagaag

SEQ ID NO: 5055493 - DNA, 18 bp, Homo sapiens
cactgcaagagccttggt

SEQ ID NO: 5055494 - DNA, 19 bp, Homo sapiens
cactgcaagagccttggtg

SEQ ID NO: 5055495 - DNA, 20 bp, Homo sapiens
cactgcaagctccaactccc

SEQ ID NO: 5055496 - DNA, 20 bp, Homo sapiens
cactgcaagtccttttgtaa

SEQ ID NO: 5055497 - DNA, 20 bp, Homo sapiens
cactgcaatctccacctccc

SEQ ID NO: 5055498 - DNA, 22 bp, Homo sapiens
cactgcacaataactcctccca

SEQ ID NO: 5055499 - DNA, 18 bp, Homo sapiens
cactgcacacacctcaga

SEQ ID NO: 5055500 - DNA, 12 bp, Homo sapiens
cactgcacagaa

SEQ ID NO: 5055501 - DNA, 15 bp, Homo sapiens
cactgcacagagctc

SEQ ID NO: 5055502 - DNA, 19 bp, Homo sapiens
cactgcacagagctctcca

SEQ ID NO: 5055503 - DNA, 22 bp, Homo sapiens
cactgcacagagctctccagct

SEQ ID NO: 5055504 - DNA, 19 bp, Homo sapiens
cactgcacagtgcatctca

SEQ ID NO: 5055505 - DNA, 21 bp, Homo sapiens
cactgcacagtgcatctcagc

SEQ ID NO: 5055506 - DNA, 22 bp, Homo sapiens
cactgcacagtgcatctcagcc

SEQ ID NO: 5055507 - DNA, 20 bp, Homo sapiens
cactgcacccccctgtgcct

SEQ ID NO: 5055508 - DNA, 21 bp, Homo sapiens
cactgcaccccctcctgctgc

SEQ ID NO: 5055509 - DNA, 12 bp, Homo sapiens
cactgcacccct

SEQ ID NO: 5055510 - DNA, 20 bp, Homo sapiens
cactgcaccctcaacctcct

SEQ ID NO: 5055511 - DNA, 16 bp, Homo sapiens
cactgcaccctccaca

SEQ ID NO: 5055512 - DNA, 22 bp, Homo sapiens
cactgcaccctccacaggagcc

SEQ ID NO: 5055513 - DNA, 18 bp, Homo sapiens
cactgcaccgggccacag

SEQ ID NO: 5055514 - DNA, 14 bp, Homo sapiens
cactgcacctgcct

SEQ ID NO: 5055515 - DNA, 19 bp, Homo sapiens
cactgcacctgcctccagc

SEQ ID NO: 5055516 - DNA, 23 bp, Homo sapiens
cactgcacctgcctccagccgcc

SEQ ID NO: 5055517 - DNA, 11 bp, Homo sapiens
cactgctacac

SEQ ID NO: 5055518 - DNA, 17 bp, Homo sapiens
cactgctactgacccag

SEQ ID NO: 5055519 - DNA, 19 bp, Homo sapiens
cactgctactgacccagag

SEQ ID NO: 5055520 - DNA, 20 bp, Homo sapiens
cactgctaggcgagtgccag

SEQ ID NO: 5055521 - DNA, 16 bp, Homo sapiens
cactgctaggtgggcc

SEQ ID NO: 5055522 - DNA, 17 bp, Homo sapiens
cactgctatgccatttc

SEQ ID NO: 5055523 - DNA, 17 bp, Homo sapiens
cactgctcacggacccc

SEQ ID NO: 5055524 - DNA, 23 bp, Homo sapiens
cactgctccaagggacaggtggg

SEQ ID NO: 5055525 - DNA, 12 bp, Homo sapiens
cactgctccagg

SEQ ID NO: 5055526 - DNA, 14 bp, Homo sapiens
cactgctccaggcc

SEQ ID NO: 5055527 - DNA, 15 bp, Homo sapiens
cactgctccaggcct

SEQ ID NO: 5055528 - DNA, 17 bp, Homo sapiens
cactgctccaggcctgc

SEQ ID NO: 5055529 - DNA, 22 bp, Homo sapiens
cactgctccatttataacccca

SEQ ID NO: 5055530 - DNA, 12 bp, Homo sapiens
cactgctcccta

SEQ ID NO: 5055531 - DNA, 21 bp, Homo sapiens
cactgctccctaagccagcct

SEQ ID NO: 5055532 - DNA, 23 bp, Homo sapiens
cactgctccctaagccagcctgg

SEQ ID NO: 5055533 - DNA, 19 bp, Homo sapiens
cactgctccctgaagccag

SEQ ID NO: 5055534 - DNA, 22 bp, Homo sapiens
cactgctccctgaagccagcct

SEQ ID NO: 5055535 - DNA, 17 bp, Homo sapiens
cactgctccgtggagga

SEQ ID NO: 5055536 - DNA, 20 bp, Homo sapiens
cactgctcgtggactgtgct

SEQ ID NO: 5055537 - DNA, 13 bp, Homo sapiens
cactgctctcacc

SEQ ID NO: 5055538 - DNA, 14 bp, Homo sapiens
cactgctctcacct

SEQ ID NO: 5055539 - DNA, 13 bp, Homo sapiens
cactgctctcagc

SEQ ID NO: 5055540 - DNA, 15 bp, Homo sapiens
cactgctctcagcct

SEQ ID NO: 5055541 - DNA, 16 bp, Homo sapiens
cactgctctcagcctc

SEQ ID NO: 5055542 - DNA, 23 bp, Homo sapiens
cactgctctccagcctgggaggc

SEQ ID NO: 5055543 - DNA, 16 bp, Homo sapiens
cactgctctgccccca

SEQ ID NO: 5055544 - DNA, 17 bp, Homo sapiens
cactgctcttaagaaac

SEQ ID NO: 5055545 - DNA, 13 bp, Homo sapiens
cactgctgaaaaa

SEQ ID NO: 5055546 - DNA, 18 bp, Homo sapiens
cactgctgaggagtctga

SEQ ID NO: 5055547 - DNA, 20 bp, Homo sapiens
cactgctgatattttctcta

SEQ ID NO: 5055548 - DNA, 22 bp, Homo sapiens
cactgctgatcgtagaaaattt

SEQ ID NO: 5055549 - DNA, 20 bp, Homo sapiens
cactgctgcaccagagtgaa

SEQ ID NO: 5055550 - DNA, 15 bp, Homo sapiens
cactgctgcccagcc

SEQ ID NO: 5055551 - DNA, 18 bp, Homo sapiens
cactgctgctactgcccc

SEQ ID NO: 5055552 - DNA, 13 bp, Homo sapiens
cactgctgctgcc

SEQ ID NO: 5055553 - DNA, 23 bp, Homo sapiens
cactgctgcttctccatggccac

SEQ ID NO: 5055554 - DNA, 17 bp, Homo sapiens
cactgctggacatgaga

SEQ ID NO: 5055555 - DNA, 20 bp, Homo sapiens
cactgctgggtggcccatcc

SEQ ID NO: 5055556 - DNA, 23 bp, Homo sapiens
cactgctgggtggcccatccccc

SEQ ID NO: 5055557 - DNA, 13 bp, Homo sapiens
cactgctgtattt

SEQ ID NO: 5055558 - DNA, 11 bp, Homo sapiens
cactgctgtca

SEQ ID NO: 5055559 - DNA, 14 bp, Homo sapiens
cactgctgtccaca

SEQ ID NO: 5055560 - DNA, 23 bp, Homo sapiens
cactgctgtccacatgacctcca

SEQ ID NO: 5055561 - DNA, 16 bp, Homo sapiens
cactgctgtcctctcc

SEQ ID NO: 5055562 - DNA, 18 bp, Homo sapiens
cactgctgtcctctcccc

SEQ ID NO: 5055563 - DNA, 17 bp, Homo sapiens
cactgctgtgaacaagt

SEQ ID NO: 5055564 - DNA, 21 bp, Homo sapiens
cactgctgtgctgtgcccaag

SEQ ID NO: 5055565 - DNA, 21 bp, Homo sapiens
cactgctgttatatttcatca

SEQ ID NO: 5055566 - DNA, 18 bp, Homo sapiens
cactgctgttcctgctcc

SEQ ID NO: 5055567 - DNA, 19 bp, Homo sapiens
cactgctgttcctgctcca

SEQ ID NO: 5055568 - DNA, 20 bp, Homo sapiens
cactgcttccagtgaggctc

SEQ ID NO: 5055569 - DNA, 14 bp, Homo sapiens
cactgcttcccact

SEQ ID NO: 5055570 - DNA, 18 bp, Homo sapiens
cactgcttctcggaggcc

SEQ ID NO: 5055571 - DNA, 21 bp, Homo sapiens
cactgcttctcggaggccagg

SEQ ID NO: 5055572 - DNA, 22 bp, Homo sapiens
cactgcttctcggaggccaggc

SEQ ID NO: 5055573 - DNA, 19 bp, Homo sapiens
cactgcttctcggccagcc

SEQ ID NO: 5055574 - DNA, 17 bp, Homo sapiens
cactgcttctcttttga

SEQ ID NO: 5055575 - DNA, 15 bp, Homo sapiens
cactgcttctgcttt

SEQ ID NO: 5055576 - DNA, 22 bp, Homo sapiens
cactgctttgcaccgtggtcag

SEQ ID NO: 5055577 - DNA, 13 bp, Homo sapiens
cactgcttttggc

SEQ ID NO: 5055578 - DNA, 20 bp, Homo sapiens
cactgcttttggtctgtgtg

SEQ ID NO: 5055579 - DNA, 21 bp, Homo sapiens
cactgcttttggtctgtgtga

SEQ ID NO: 5055580 - DNA, 15 bp, Homo sapiens
cactgctttttcctt

SEQ ID NO: 5055581 - DNA, 17 bp, Homo sapiens
cactgctttttccttag

SEQ ID NO: 5055582 - DNA, 15 bp, Homo sapiens
cactggaaaggggag

SEQ ID NO: 5055583 - DNA, 23 bp, Homo sapiens
cactggaaaggggagagcctgct

SEQ ID NO: 5055584 - DNA, 16 bp, Homo sapiens
cactggaacagcccat

SEQ ID NO: 5055585 - DNA, 17 bp, Homo sapiens
cactggaacatggctag

SEQ ID NO: 5055586 - DNA, 14 bp, Homo sapiens
cactggaacattcc

SEQ ID NO: 5055587 - DNA, 17 bp, Homo sapiens
cactggaacctccctgg

SEQ ID NO: 5055588 - DNA, 20 bp, Homo sapiens
cactggaacctccctgggcc

SEQ ID NO: 5055589 - DNA, 13 bp, Homo sapiens
cactggaactcag

SEQ ID NO: 5055590 - DNA, 15 bp, Homo sapiens
cactggaagatttat

SEQ ID NO: 5055591 - DNA, 16 bp, Homo sapiens
cactggaagcaggatg

SEQ ID NO: 5055592 - DNA, 20 bp, Homo sapiens
cactggaatcgatctgtact

SEQ ID NO: 5055593 - DNA, 13 bp, Homo sapiens
cactggaatgaag

SEQ ID NO: 5055594 - DNA, 18 bp, Homo sapiens
cactggaattttgcttta

SEQ ID NO: 5055595 - DNA, 17 bp, Homo sapiens
cactggacaacactgat

SEQ ID NO: 5055596 - DNA, 17 bp, Homo sapiens
cactggacagacccagg

SEQ ID NO: 5055597 - DNA, 21 bp, Homo sapiens
cactggacatggcccattgga

SEQ ID NO: 5055598 - DNA, 16 bp, Homo sapiens
cactggaccactgggc

SEQ ID NO: 5055599 - DNA, 22 bp, Homo sapiens
cactggactgcatggggaggca

SEQ ID NO: 5055600 - DNA, 22 bp, Homo sapiens
cactggagaattgaaaaggact

SEQ ID NO: 5055601 - DNA, 12 bp, Homo sapiens
cactggagcaca

SEQ ID NO: 5055602 - DNA, 14 bp, Homo sapiens
cactggagcagaag

SEQ ID NO: 5055603 - DNA, 14 bp, Homo sapiens
cactggagccacag

SEQ ID NO: 5055604 - DNA, 15 bp, Homo sapiens
cactggagccacagg

SEQ ID NO: 5055605 - DNA, 20 bp, Homo sapiens
cactggagccatctcttcct

SEQ ID NO: 5055606 - DNA, 22 bp, Homo sapiens
cactggaggagagaagaatgag

SEQ ID NO: 5055607 - DNA, 18 bp, Homo sapiens
cactggaggagcagcttc

SEQ ID NO: 5055608 - DNA, 15 bp, Homo sapiens
cactggaggcctctg

SEQ ID NO: 5055609 - DNA, 16 bp, Homo sapiens
cactggaggcctctgc

SEQ ID NO: 5055610 - DNA, 17 bp, Homo sapiens
cactggaggggcccacc

SEQ ID NO: 5055611 - DNA, 19 bp, Homo sapiens
cactggaggggcccaccca

SEQ ID NO: 5055612 - DNA, 23 bp, Homo sapiens
cactggaggggcccacccacatg

SEQ ID NO: 5055613 - DNA, 22 bp, Homo sapiens
cactggagtctctctctctcca

SEQ ID NO: 5055614 - DNA, 19 bp, Homo sapiens
cactggagtcttgtacact

SEQ ID NO: 5055615 - DNA, 19 bp, Homo sapiens
cactggatcaagttcagcc

SEQ ID NO: 5055616 - DNA, 20 bp, Homo sapiens
cactggatcaagttcagcca

SEQ ID NO: 5055617 - DNA, 17 bp, Homo sapiens
cactggatccagaagct

SEQ ID NO: 5055618 - DNA, 23 bp, Homo sapiens
cactggatccatccgtccagcca

SEQ ID NO: 5055619 - DNA, 14 bp, Homo sapiens
cactggatcctgct

SEQ ID NO: 5055620 - DNA, 19 bp, Homo sapiens
cactggatgcaaagaaaat

SEQ ID NO: 5055621 - DNA, 15 bp, Homo sapiens
cactggatgtttctc

SEQ ID NO: 5055622 - DNA, 16 bp, Homo sapiens
cactggatgtttctca

SEQ ID NO: 5055623 - DNA, 17 bp, Homo sapiens
cactggatgtttctcat

SEQ ID NO: 5055624 - DNA, 20 bp, Homo sapiens
cactggattgtagaacttgt

SEQ ID NO: 5055625 - DNA, 17 bp, Homo sapiens
cactggcaaacagggcc

SEQ ID NO: 5055626 - DNA, 22 bp, Homo sapiens
cactggcaaacagggcctctgc

SEQ ID NO: 5055627 - DNA, 21 bp, Homo sapiens
cactggcacttgcctgctgct

SEQ ID NO: 5055628 - DNA, 18 bp, Homo sapiens
cactggcagactgtgtaa

SEQ ID NO: 5055629 - DNA, 21 bp, Homo sapiens
cactggcagactgtgtaaaat

SEQ ID NO: 5055630 - DNA, 21 bp, Homo sapiens
cactggcagagaggtaaaggg

SEQ ID NO: 5055631 - DNA, 19 bp, Homo sapiens
cactggcagagcacagccc

SEQ ID NO: 5055632 - DNA, 20 bp, Homo sapiens
cactggcagagcacagccca

SEQ ID NO: 5055633 - DNA, 21 bp, Homo sapiens
cactggcagagcacagcccac

SEQ ID NO: 5055634 - DNA, 15 bp, Homo sapiens
cactggcagccccag

SEQ ID NO: 5055635 - DNA, 17 bp, Homo sapiens
cactggcagccccagca

SEQ ID NO: 5055636 - DNA, 15 bp, Homo sapiens
cactggcagcctgca

SEQ ID NO: 5055637 - DNA, 16 bp, Homo sapiens
cactggcagcctgcac

SEQ ID NO: 5055638 - DNA, 19 bp, Homo sapiens
cactggcagcctgcacctg

SEQ ID NO: 5055639 - DNA, 16 bp, Homo sapiens
cactggcaggatcaca

SEQ ID NO: 5055640 - DNA, 18 bp, Homo sapiens
cactggcaggatcacagc

SEQ ID NO: 5055641 - DNA, 20 bp, Homo sapiens
cactggcatcgcagcttcct

SEQ ID NO: 5055642 - DNA, 21 bp, Homo sapiens
cactggcatcgcagcttcctg

SEQ ID NO: 5055643 - DNA, 22 bp, Homo sapiens
cactggcatcgcagcttcctgt

SEQ ID NO: 5055644 - DNA, 19 bp, Homo sapiens
cactggcattgtccctgtg

SEQ ID NO: 5055645 - DNA, 22 bp, Homo sapiens
cactggcattgtccctgtgcct

SEQ ID NO: 5055646 - DNA, 15 bp, Homo sapiens
cactggccaagaaaa

SEQ ID NO: 5055647 - DNA, 12 bp, Homo sapiens
cactggccacca

SEQ ID NO: 5055648 - DNA, 15 bp, Homo sapiens
cactggccaccaggc

SEQ ID NO: 5055649 - DNA, 14 bp, Homo sapiens
cactggccacccaa

SEQ ID NO: 5055650 - DNA, 23 bp, Homo sapiens
cactggccagagagggcccagct

SEQ ID NO: 5055651 - DNA, 18 bp, Homo sapiens
cactggccagtagctgcc

SEQ ID NO: 5055652 - DNA, 14 bp, Homo sapiens
cactggccagtcct

SEQ ID NO: 5055653 - DNA, 15 bp, Homo sapiens
cactggccagtccta

SEQ ID NO: 5055654 - DNA, 14 bp, Homo sapiens
cactggccatccct

SEQ ID NO: 5055655 - DNA, 13 bp, Homo sapiens
cactggccctgtt

SEQ ID NO: 5055656 - DNA, 15 bp, Homo sapiens
cactggccctgtttc

SEQ ID NO: 5055657 - DNA, 16 bp, Homo sapiens
cactggccgctgagcg

SEQ ID NO: 5055658 - DNA, 11 bp, Homo sapiens
cactggcctct

SEQ ID NO: 5055659 - DNA, 15 bp, Homo sapiens
cactggcctctcccc

SEQ ID NO: 5055660 - DNA, 16 bp, Homo sapiens
cactggcctctcccca

SEQ ID NO: 5055661 - DNA, 14 bp, Homo sapiens
cactggcctgggtc

SEQ ID NO: 5055662 - DNA, 22 bp, Homo sapiens
cactggcctgggtctccctggt

SEQ ID NO: 5055663 - DNA, 15 bp, Homo sapiens
cactggccttgcctc

SEQ ID NO: 5055664 - DNA, 18 bp, Homo sapiens
cactggccttgcctccag

SEQ ID NO: 5055665 - DNA, 19 bp, Homo sapiens
cactggccttgcctccagg

SEQ ID NO: 5055666 - DNA, 14 bp, Homo sapiens
cactggctcaccca

SEQ ID NO: 5055667 - DNA, 21 bp, Homo sapiens
cactggctccatgattctctg

SEQ ID NO: 5055668 - DNA, 14 bp, Homo sapiens
cactggctcctcca

SEQ ID NO: 5055669 - DNA, 15 bp, Homo sapiens
cactggctcctccag

SEQ ID NO: 5055670 - DNA, 17 bp, Homo sapiens
cactggctcctcccagc

SEQ ID NO: 5055671 - DNA, 13 bp, Homo sapiens
cactggctcctgg

SEQ ID NO: 5055672 - DNA, 17 bp, Homo sapiens
caggagggacagtctca

SEQ ID NO: 5055673 - DNA, 19 bp, Homo sapiens
caggagggacagtctcacc

SEQ ID NO: 5055674 - DNA, 17 bp, Homo sapiens
caggagggaccaccctc

SEQ ID NO: 5055675 - DNA, 18 bp, Homo sapiens
caggagggaccaccctcc

SEQ ID NO: 5055676 - DNA, 21 bp, Homo sapiens
caggagggactctgtctggcc

SEQ ID NO: 5055677 - DNA, 23 bp, Homo sapiens
caggagggactctgtctggccag

SEQ ID NO: 5055678 - DNA, 24 bp, Homo sapiens
caggagggactctgtctggccagg

SEQ ID NO: 5055679 - DNA, 12 bp, Homo sapiens
caggagggagag

SEQ ID NO: 5055680 - DNA, 13 bp, Homo sapiens
caggagggaggcg

SEQ ID NO: 5055681 - DNA, 14 bp, Homo sapiens
caggagggaggcgg

SEQ ID NO: 5055682 - DNA, 19 bp, Homo sapiens
caggagggaggcggggagg

SEQ ID NO: 5055683 - DNA, 12 bp, Homo sapiens
caggagggaggg

SEQ ID NO: 5055684 - DNA, 18 bp, Homo sapiens
caggagggagggtttctc

SEQ ID NO: 5055685 - DNA, 23 bp, Homo sapiens
caggagggagggtttctctccca

SEQ ID NO: 5055686 - DNA, 22 bp, Homo sapiens
caggagggattggccgcttggc

SEQ ID NO: 5055687 - DNA, 16 bp, Homo sapiens
caggagggcaagggcc

SEQ ID NO: 5055688 - DNA, 19 bp, Homo sapiens
caggagggcaagggccatg

SEQ ID NO: 5055689 - DNA, 18 bp, Homo sapiens
caggagggcacagcaggg

SEQ ID NO: 5055690 - DNA, 14 bp, Homo sapiens
caggagggcactgg

SEQ ID NO: 5055691 - DNA, 14 bp, Homo sapiens
caggagggcaggct

SEQ ID NO: 5055692 - DNA, 15 bp, Homo sapiens
caggagggcaggctg

SEQ ID NO: 5055693 - DNA, 19 bp, Homo sapiens
caggagggcaggctgaggt

SEQ ID NO: 5055694 - DNA, 18 bp, Homo sapiens
caggatctgtctgtgcac

SEQ ID NO: 5055695 - DNA, 17 bp, Homo sapiens
caggatctttgactgaa

SEQ ID NO: 5055696 - DNA, 16 bp, Homo sapiens
caggatgaactagcca

SEQ ID NO: 5055697 - DNA, 15 bp, Homo sapiens
caggatgaattttct

SEQ ID NO: 5055698 - DNA, 19 bp, Homo sapiens
caggatgaattttctgcag

SEQ ID NO: 5055699 - DNA, 21 bp, Homo sapiens
caggatgacacctccatttct

SEQ ID NO: 5055700 - DNA, 16 bp, Homo sapiens
caggatgacctggata

SEQ ID NO: 5055701 - DNA, 21 bp, Homo sapiens
caggatgacggtattatgctt

SEQ ID NO: 5055702 - DNA, 14 bp, Homo sapiens
caggatgactttac

SEQ ID NO: 5055703 - DNA, 19 bp, Homo sapiens
caggatgagaacacactga

SEQ ID NO: 5055704 - DNA, 23 bp, Homo sapiens
caggatgaggaacctcaaactgg

SEQ ID NO: 5055705 - DNA, 19 bp, Homo sapiens
caggatgaggacagagggc

SEQ ID NO: 5055706 - DNA, 13 bp, Homo sapiens
caggatgaggccc

SEQ ID NO: 5055707 - DNA, 14 bp, Homo sapiens
caggatgaggcccc

SEQ ID NO: 5055708 - DNA, 18 bp, Homo sapiens
caggatgagggaaaagaa

SEQ ID NO: 5055709 - DNA, 22 bp, Homo sapiens
caggatgagggaaaagaaaaag

SEQ ID NO: 5055710 - DNA, 14 bp, Homo sapiens
caggatgaggtctc

SEQ ID NO: 5055711 - DNA, 18 bp, Homo sapiens
caggatgcacggtttctg

SEQ ID NO: 5055712 - DNA, 19 bp, Homo sapiens
caggatgcacggtttctgt

SEQ ID NO: 5055713 - DNA, 12 bp, Homo sapiens
caggatgcatat

SEQ ID NO: 5055714 - DNA, 16 bp, Homo sapiens
caggatgcatattaaa

SEQ ID NO: 5055715 - DNA, 16 bp, Homo sapiens
caggatgcatgcaggg

SEQ ID NO: 5055716 - DNA, 19 bp, Homo sapiens
caggatgcatgcagggccc

SEQ ID NO: 5055717 - DNA, 22 bp, Homo sapiens
caggatgcatgcagggccccca

SEQ ID NO: 5055718 - DNA, 16 bp, Homo sapiens
caggatgccaagtggc

SEQ ID NO: 5055719 - DNA, 19 bp, Homo sapiens
caggatgccaagtggccct

SEQ ID NO: 5055720 - DNA, 18 bp, Homo sapiens
caggatgccacgcctgga

SEQ ID NO: 5055721 - DNA, 19 bp, Homo sapiens
caggatgccagcccctgcc

SEQ ID NO: 5055722 - DNA, 22 bp, Homo sapiens
caggatgccagcccctgcctgg

SEQ ID NO: 5055723 - DNA, 22 bp, Homo sapiens
caggatgcccagatgaactgac

SEQ ID NO: 5055724 - DNA, 13 bp, Homo sapiens
caggatgcccagg

SEQ ID NO: 5055725 - DNA, 19 bp, Homo sapiens
caggatgcctgagccccct

SEQ ID NO: 5055726 - DNA, 20 bp, Homo sapiens
caggatgctcccccagggaa

SEQ ID NO: 5055727 - DNA, 13 bp, Homo sapiens
caggatgctgagc

SEQ ID NO: 5055728 - DNA, 14 bp, Homo sapiens
caggatgctgagct

SEQ ID NO: 5055729 - DNA, 16 bp, Homo sapiens
caggatgctgggtggc

SEQ ID NO: 5055730 - DNA, 23 bp, Homo sapiens
caggatggaattcttcctcctct

SEQ ID NO: 5055731 - DNA, 21 bp, Homo sapiens
caggatggactcttctcggct

SEQ ID NO: 5055732 - DNA, 23 bp, Homo sapiens
caggatggactcttctcggctca

SEQ ID NO: 5055733 - DNA, 22 bp, Homo sapiens
caggatggagcaagctcttccc

SEQ ID NO: 5055734 - DNA, 15 bp, Homo sapiens
caggatggagctgac

SEQ ID NO: 5055735 - DNA, 15 bp, Homo sapiens
caggatggaggggtg

SEQ ID NO: 5055736 - DNA, 21 bp, Homo sapiens
caggatggaggggtggtcctg

SEQ ID NO: 5055737 - DNA, 21 bp, Homo sapiens
caggatggcaaccagaccatt

SEQ ID NO: 5055738 - DNA, 16 bp, Homo sapiens
caggatggcctttcct

SEQ ID NO: 5055739 - DNA, 18 bp, Homo sapiens
caggatggcgtgtcccct

SEQ ID NO: 5055740 - DNA, 19 bp, Homo sapiens
caggatggcgtgtcccctg

SEQ ID NO: 5055741 - DNA, 12 bp, Homo sapiens
caggatggcttt

SEQ ID NO: 5055742 - DNA, 23 bp, Homo sapiens
caggatgggaagaaaaaggaaac

SEQ ID NO: 5055743 - DNA, 13 bp, Homo sapiens
caggatgggctga

SEQ ID NO: 5055744 - DNA, 18 bp, Homo sapiens
caggatgggctgagctag

SEQ ID NO: 5055745 - DNA, 20 bp, Homo sapiens
caggatggggaggggctctg

SEQ ID NO: 5055746 - DNA, 18 bp, Homo sapiens
caggatgggggctggcct

SEQ ID NO: 5055747 - DNA, 15 bp, Homo sapiens
caggatggtgttact

SEQ ID NO: 5055748 - DNA, 21 bp, Homo sapiens
caggatggttcccttgatgaa

SEQ ID NO: 5055749 - DNA, 21 bp, Homo sapiens
caggatgtagttctgccaggc

SEQ ID NO: 5055750 - DNA, 23 bp, Homo sapiens
caggatgtagttctgccaggcaa

SEQ ID NO: 5055751 - DNA, 17 bp, Homo sapiens
caggatgtggcactgct

SEQ ID NO: 5055752 - DNA, 22 bp, Homo sapiens
caggatgtgtgggccaggatcc

SEQ ID NO: 5055753 - DNA, 15 bp, Homo sapiens
caggatgtgtttgct

SEQ ID NO: 5055754 - DNA, 18 bp, Homo sapiens
caggattaactaaagaag

SEQ ID NO: 5055755 - DNA, 19 bp, Homo sapiens
caggattaactaaagaaga

SEQ ID NO: 5055756 - DNA, 20 bp, Homo sapiens
caggattaactaaagaagag

SEQ ID NO: 5055757 - DNA, 18 bp, Homo sapiens
caggattacagtgtagct

SEQ ID NO: 5055758 - DNA, 22 bp, Homo sapiens
caggattactactttgcctctt

SEQ ID NO: 5055759 - DNA, 20 bp, Homo sapiens
caggattactagtcaaacaa

SEQ ID NO: 5055760 - DNA, 20 bp, Homo sapiens
caggattcaggcctctgagg

SEQ ID NO: 5055761 - DNA, 22 bp, Homo sapiens
caggattcaggcctctgaggag

SEQ ID NO: 5055762 - DNA, 21 bp, Homo sapiens
caggattccaaagttttgaag

SEQ ID NO: 5055763 - DNA, 17 bp, Homo sapiens
caggattcccttctggg

SEQ ID NO: 5055764 - DNA, 23 bp, Homo sapiens
caggattcctctctcaggtcact

SEQ ID NO: 5055765 - DNA, 16 bp, Homo sapiens
caggattcctcttttc

SEQ ID NO: 5055766 - DNA, 17 bp, Homo sapiens
caggattcctcttttct

SEQ ID NO: 5055767 - DNA, 13 bp, Homo sapiens
caggattccttct

SEQ ID NO: 5055768 - DNA, 18 bp, Homo sapiens
caggattctctgcagccc

SEQ ID NO: 5055769 - DNA, 13 bp, Homo sapiens
caggattctgaca

SEQ ID NO: 5055770 - DNA, 14 bp, Homo sapiens
caggattcttcccg

SEQ ID NO: 5055771 - DNA, 17 bp, Homo sapiens
caggattcttcccgctc

SEQ ID NO: 5055772 - DNA, 13 bp, Homo sapiens
caggattgaagag

SEQ ID NO: 5055773 - DNA, 19 bp, Homo sapiens
caggattgcgagagatgtg

SEQ ID NO: 5055774 - DNA, 22 bp, Homo sapiens
caggattgcgagagatgtgtgt

SEQ ID NO: 5055775 - DNA, 22 bp, Homo sapiens
caggattggcacaagctccctg

SEQ ID NO: 5055776 - DNA, 19 bp, Homo sapiens
caggattggcctgtgtctg

SEQ ID NO: 5055777 - DNA, 22 bp, Homo sapiens
caggattggcctgtgtctggcc

SEQ ID NO: 5055778 - DNA, 22 bp, Homo sapiens
caggattgggccaacaaggact

SEQ ID NO: 5055779 - DNA, 24 bp, Homo sapiens
caggattggggaagagagcctgca

SEQ ID NO: 5055780 - DNA, 17 bp, Homo sapiens
caggattgtacgtggga

SEQ ID NO: 5055781 - DNA, 22 bp, Homo sapiens
caggattgtacgtgggagaggc

SEQ ID NO: 5055782 - DNA, 21 bp, Homo sapiens
caggattgtctggggccgagg

SEQ ID NO: 5055783 - DNA, 12 bp, Homo sapiens
caggatttataa

SEQ ID NO: 5055784 - DNA, 22 bp, Homo sapiens
caggatttcaccagaagttaca

SEQ ID NO: 5055785 - DNA, 21 bp, Homo sapiens
caggatttcgtgggtctgttt

SEQ ID NO: 5055786 - DNA, 15 bp, Homo sapiens
caggatttgcacaga

SEQ ID NO: 5055787 - DNA, 15 bp, Homo sapiens
caggatttggccaca

SEQ ID NO: 5055788 - DNA, 22 bp, Homo sapiens
caggatttggccacactggggc

SEQ ID NO: 5055789 - DNA, 23 bp, Homo sapiens
caggatttggccacactggggct

SEQ ID NO: 5055790 - DNA, 17 bp, Homo sapiens
caggatttggttgttta

SEQ ID NO: 5055791 - DNA, 21 bp, Homo sapiens
caggatttggtttttctcttt

SEQ ID NO: 5055792 - DNA, 19 bp, Homo sapiens
caggatttgttctctgtcc

SEQ ID NO: 5055793 - DNA, 22 bp, Homo sapiens
caggattttaacaaaagcaaga

SEQ ID NO: 5055794 - DNA, 22 bp, Homo sapiens
caggattttaatttcaggaaaa

SEQ ID NO: 5055795 - DNA, 21 bp, Homo sapiens
caggatttttagagcattaaa

SEQ ID NO: 5055796 - DNA, 22 bp, Homo sapiens
caggatttttagagcattaaaa

SEQ ID NO: 5055797 - DNA, 20 bp, Homo sapiens
caggcaaaacacgcaagggc

SEQ ID NO: 5055798 - DNA, 21 bp, Homo sapiens
caggcaaaacacgcaagggca

SEQ ID NO: 5055799 - DNA, 14 bp, Homo sapiens
caggcaaaatcctt

SEQ ID NO: 5055800 - DNA, 18 bp, Homo sapiens
caggcaaaatccttgctt

SEQ ID NO: 5055801 - DNA, 19 bp, Homo sapiens
caggcaaagaggtgctgct

SEQ ID NO: 5055802 - DNA, 11 bp, Homo sapiens
caggcaaatca

SEQ ID NO: 5055803 - DNA, 16 bp, Homo sapiens
caggcaacctcccatc

SEQ ID NO: 5055804 - DNA, 18 bp, Homo sapiens
caggcaacctcccatccc

SEQ ID NO: 5055805 - DNA, 22 bp, Homo sapiens
caggcaacctcccatcccaccc

SEQ ID NO: 5055806 - DNA, 21 bp, Homo sapiens
caggcaacgtgcgtgtctctg

SEQ ID NO: 5055807 - DNA, 23 bp, Homo sapiens
caggcaacgtgcgtgtctctgcc

SEQ ID NO: 5055808 - DNA, 17 bp, Homo sapiens
caggcaactgaggcaga

SEQ ID NO: 5055809 - DNA, 19 bp, Homo sapiens
caggcaactgaggcagaca

SEQ ID NO: 5055810 - DNA, 20 bp, Homo sapiens
caggcaactgaggcagacag

SEQ ID NO: 5055811 - DNA, 20 bp, Homo sapiens
caggcaagaaaagcgcagag

SEQ ID NO: 5055812 - DNA, 21 bp, Homo sapiens
caggcaagaaaagcgcagaga

SEQ ID NO: 5055813 - DNA, 14 bp, Homo sapiens
caggcaagaaagct

SEQ ID NO: 5055814 - DNA, 17 bp, Homo sapiens
caggcaagacaccttcc

SEQ ID NO: 5055815 - DNA, 21 bp, Homo sapiens
caggcaagcacctcctgcctc

SEQ ID NO: 5055816 - DNA, 13 bp, Homo sapiens
caggcaagcagct

SEQ ID NO: 5055817 - DNA, 14 bp, Homo sapiens
caggcaagcagctg

SEQ ID NO: 5055818 - DNA, 13 bp, Homo sapiens
caggcaagcatgt

SEQ ID NO: 5055819 - DNA, 13 bp, Homo sapiens
caggcaagcccct

SEQ ID NO: 5055820 - DNA, 18 bp, Homo sapiens
caggcaagcccctcagcc

SEQ ID NO: 5055821 - DNA, 13 bp, Homo sapiens
caggcaagcccgg

SEQ ID NO: 5055822 - DNA, 15 bp, Homo sapiens
caggcaaggaacaga

SEQ ID NO: 5055823 - DNA, 14 bp, Homo sapiens
caggcaaggaggag

SEQ ID NO: 5055824 - DNA, 19 bp, Homo sapiens
caggcaaggaggaggagtc

SEQ ID NO: 5055825 - DNA, 18 bp, Homo sapiens
caggcaaggttggcgact

SEQ ID NO: 5055826 - DNA, 19 bp, Homo sapiens
caggcaatagtcaaaaaca

SEQ ID NO: 5055827 - DNA, 18 bp, Homo sapiens
caggcaatcgttctgctg

SEQ ID NO: 5055828 - DNA, 23 bp, Homo sapiens
caggcaatgactgcgcagagtgg

SEQ ID NO: 5055829 - DNA, 15 bp, Homo sapiens
caggcaatgccctgc

SEQ ID NO: 5055830 - DNA, 16 bp, Homo sapiens
caggcaatgccctgcg

SEQ ID NO: 5055831 - DNA, 20 bp, Homo sapiens
caggcaatgccctgcggctc

SEQ ID NO: 5055832 - DNA, 16 bp, Homo sapiens
caggcaatgctggctg

SEQ ID NO: 5055833 - DNA, 17 bp, Homo sapiens
caggcaatgctggctgt

SEQ ID NO: 5055834 - DNA, 14 bp, Homo sapiens
caggcaatgctgta

SEQ ID NO: 5055835 - DNA, 13 bp, Homo sapiens
caggcacaacttc

SEQ ID NO: 5055836 - DNA, 19 bp, Homo sapiens
caggcacaacttcagcagg

SEQ ID NO: 5055837 - DNA, 22 bp, Homo sapiens
caggcacaacttcagcagggga

SEQ ID NO: 5055838 - DNA, 19 bp, Homo sapiens
caggcacacaaggggccct

SEQ ID NO: 5055839 - DNA, 16 bp, Homo sapiens
caggcacacacagccc

SEQ ID NO: 5055840 - DNA, 16 bp, Homo sapiens
caggcacacaccacca

SEQ ID NO: 5055841 - DNA, 16 bp, Homo sapiens
caggcacacacgcctt

SEQ ID NO: 5055842 - DNA, 23 bp, Homo sapiens
caggcacacacgccttcatgcca

SEQ ID NO: 5055843 - DNA, 16 bp, Homo sapiens
caggcacacagcagcc

SEQ ID NO: 5055844 - DNA, 17 bp, Homo sapiens
caggcacaccttgcaga

SEQ ID NO: 5055845 - DNA, 18 bp, Homo sapiens
caggcacaccttgcagaa

SEQ ID NO: 5055846 - DNA, 16 bp, Homo sapiens
caggcacagaggaggt

SEQ ID NO: 5055847 - DNA, 21 bp, Homo sapiens
caggcacagaggaggtcagca

SEQ ID NO: 5055848 - DNA, 13 bp, Homo sapiens
caggcacaggaca

SEQ ID NO: 5055849 - DNA, 14 bp, Homo sapiens
caggcacaggacac

SEQ ID NO: 5055850 - DNA, 13 bp, Homo sapiens
caggcacaggatg

SEQ ID NO: 5055851 - DNA, 12 bp, Homo sapiens
caggcacaggca

SEQ ID NO: 5055852 - DNA, 14 bp, Homo sapiens
caggcacaggcagg

SEQ ID NO: 5055853 - DNA, 17 bp, Homo sapiens
caggcacaggcagggca

SEQ ID NO: 5055854 - DNA, 19 bp, Homo sapiens
caggcacaggcagggcagg

SEQ ID NO: 5055855 - DNA, 12 bp, Homo sapiens
caggcacaggct

SEQ ID NO: 5055856 - DNA, 13 bp, Homo sapiens
caggcacagggcc

SEQ ID NO: 5055857 - DNA, 22 bp, Homo sapiens
caggcacatacacctcgtcaag

SEQ ID NO: 5055858 - DNA, 13 bp, Homo sapiens
caggcaccacagc

SEQ ID NO: 5055859 - DNA, 14 bp, Homo sapiens
caggcaccacagcc

SEQ ID NO: 5055860 - DNA, 14 bp, Homo sapiens
caggcaccaccagg

SEQ ID NO: 5055861 - DNA, 15 bp, Homo sapiens
caggcaccaccagga

SEQ ID NO: 5055862 - DNA, 14 bp, Homo sapiens
caggcaccaggcag

SEQ ID NO: 5055863 - DNA, 16 bp, Homo sapiens
caggcaccatctgcca

SEQ ID NO: 5055864 - DNA, 17 bp, Homo sapiens
caggcaccatctgccaa

SEQ ID NO: 5055865 - DNA, 19 bp, Homo sapiens
caggcaccatgctgggccg

SEQ ID NO: 5055866 - DNA, 15 bp, Homo sapiens
caggcacccacatcc

SEQ ID NO: 5055867 - DNA, 16 bp, Homo sapiens
caggcacccatgtggg

SEQ ID NO: 5055868 - DNA, 15 bp, Homo sapiens
caggcacccccagaa

SEQ ID NO: 5055869 - DNA, 17 bp, Homo sapiens
caggcaccccctggaga

SEQ ID NO: 5055870 - DNA, 18 bp, Homo sapiens
cccagaggctcctggagc

SEQ ID NO: 5055871 - DNA, 21 bp, Homo sapiens
cccagaggctcctggagccag

SEQ ID NO: 5055872 - DNA, 16 bp, Homo sapiens
cccagaggctgcccca

SEQ ID NO: 5055873 - DNA, 14 bp, Homo sapiens
cccagagggagcag

SEQ ID NO: 5055874 - DNA, 14 bp, Homo sapiens
cccagagggcccag

SEQ ID NO: 5055875 - DNA, 15 bp, Homo sapiens
cccagagggcccagg

SEQ ID NO: 5055876 - DNA, 22 bp, Homo sapiens
cccagagggcccaggcaggcca

SEQ ID NO: 5055877 - DNA, 20 bp, Homo sapiens
cccagaggggacgctgagga

SEQ ID NO: 5055878 - DNA, 17 bp, Homo sapiens
cccagaggggcctgcca

SEQ ID NO: 5055879 - DNA, 20 bp, Homo sapiens
cccagaggggcctgccacct

SEQ ID NO: 5055880 - DNA, 23 bp, Homo sapiens
cccagaggggcctgccacctgga

SEQ ID NO: 5055881 - DNA, 21 bp, Homo sapiens
cccagagggtagggcagcaga

SEQ ID NO: 5055882 - DNA, 22 bp, Homo sapiens
cccagagggtctgggggcacaa

SEQ ID NO: 5055883 - DNA, 13 bp, Homo sapiens
cccagaggtaaca

SEQ ID NO: 5055884 - DNA, 20 bp, Homo sapiens
cccagaggtaacagaacagc

SEQ ID NO: 5055885 - DNA, 16 bp, Homo sapiens
cccagaggtccagccc

SEQ ID NO: 5055886 - DNA, 14 bp, Homo sapiens
cccagaggtccagg

SEQ ID NO: 5055887 - DNA, 22 bp, Homo sapiens
cccagaggtcgcagctaccctc

SEQ ID NO: 5055888 - DNA, 17 bp, Homo sapiens
cccagaggtctcatctc

SEQ ID NO: 5055889 - DNA, 22 bp, Homo sapiens
cccagaggtctcatctcccagg

SEQ ID NO: 5055890 - DNA, 20 bp, Homo sapiens
cccagaggtggatactgggg

SEQ ID NO: 5055891 - DNA, 21 bp, Homo sapiens
cccagaggtggccctcccagg

SEQ ID NO: 5055892 - DNA, 20 bp, Homo sapiens
cccagaggttatctgcctgg

SEQ ID NO: 5055893 - DNA, 14 bp, Homo sapiens
cccagagtagccca

SEQ ID NO: 5055894 - DNA, 15 bp, Homo sapiens
cccagagtagcccag

SEQ ID NO: 5055895 - DNA, 18 bp, Homo sapiens
cccagagtcaggaagaga

SEQ ID NO: 5055896 - DNA, 20 bp, Homo sapiens
cccagagtccccccactccc

SEQ ID NO: 5055897 - DNA, 12 bp, Homo sapiens
cccagagtgctg

SEQ ID NO: 5055898 - DNA, 20 bp, Homo sapiens
cccagagtgctgtcgggacc

SEQ ID NO: 5055899 - DNA, 21 bp, Homo sapiens
cccagagtggagtctgagtct

SEQ ID NO: 5055900 - DNA, 14 bp, Homo sapiens
cccagagtgggctt

SEQ ID NO: 5055901 - DNA, 17 bp, Homo sapiens
cccagagtgtgaaactt

SEQ ID NO: 5055902 - DNA, 16 bp, Homo sapiens
cccagagtgtgggaag

SEQ ID NO: 5055903 - DNA, 19 bp, Homo sapiens
cccagagttcttgcaccct

SEQ ID NO: 5055904 - DNA, 23 bp, Homo sapiens
cccagagttgctgggagctgaaa

SEQ ID NO: 5055905 - DNA, 16 bp, Homo sapiens
cccagatacctgtgag

SEQ ID NO: 5055906 - DNA, 20 bp, Homo sapiens
cccagatacgggggctgtga

SEQ ID NO: 5055907 - DNA, 21 bp, Homo sapiens
cccagatacgggggctgtgac

SEQ ID NO: 5055908 - DNA, 23 bp, Homo sapiens
cccagatagagctgggtggcctg

SEQ ID NO: 5055909 - DNA, 19 bp, Homo sapiens
cccagatatggaaacagaa

SEQ ID NO: 5055910 - DNA, 14 bp, Homo sapiens
cccagatcagactc

SEQ ID NO: 5055911 - DNA, 17 bp, Homo sapiens
cccagatcaggaaccag

SEQ ID NO: 5055912 - DNA, 23 bp, Homo sapiens
cccagatcaggaaccagggcctc

SEQ ID NO: 5055913 - DNA, 21 bp, Homo sapiens
cccagatccaggaacacatgc

SEQ ID NO: 5055914 - DNA, 15 bp, Homo sapiens
cccagatcccaagag

SEQ ID NO: 5055915 - DNA, 21 bp, Homo sapiens
cccagatcgctcccttggctt

SEQ ID NO: 5055916 - DNA, 19 bp, Homo sapiens
cccagatcgttctgccact

SEQ ID NO: 5055917 - DNA, 16 bp, Homo sapiens
ccaacactccaggccc

SEQ ID NO: 5055918 - DNA, 20 bp, Homo sapiens
ccaacactgtccttccctgc

SEQ ID NO: 5055919 - DNA, 22 bp, Homo sapiens
ccaacactgtccttccctgcca

SEQ ID NO: 5055920 - DNA, 23 bp, Homo sapiens
ccaacactgtccttccctgccac

SEQ ID NO: 5055921 - DNA, 17 bp, Homo sapiens
ccaacactgtctgcccc

SEQ ID NO: 5055922 - DNA, 15 bp, Homo sapiens
ccaacactgtgccct

SEQ ID NO: 5055923 - DNA, 16 bp, Homo sapiens
ccaacactgtgccctg

SEQ ID NO: 5055924 - DNA, 18 bp, Homo sapiens
ccaacactgtgccctggt

SEQ ID NO: 5055925 - DNA, 17 bp, Homo sapiens
ccaacagaacccacagt

SEQ ID NO: 5055926 - DNA, 17 bp, Homo sapiens
ccaacagacacaattta

SEQ ID NO: 5055927 - DNA, 20 bp, Homo sapiens
ccaacagacaccctccactc

SEQ ID NO: 5055928 - DNA, 18 bp, Homo sapiens
ccaacagagaaaagcagg

SEQ ID NO: 5055929 - DNA, 16 bp, Homo sapiens
ccaacagaggcctccc

SEQ ID NO: 5055930 - DNA, 14 bp, Homo sapiens
ccaacagagtggtg

SEQ ID NO: 5055931 - DNA, 15 bp, Homo sapiens
ccaacagcaagtgtt

SEQ ID NO: 5055932 - DNA, 12 bp, Homo sapiens
ccaacagccatg

SEQ ID NO: 5055933 - DNA, 15 bp, Homo sapiens
ccaacagccatgccc

SEQ ID NO: 5055934 - DNA, 11 bp, Homo sapiens
ccaacagctac

SEQ ID NO: 5055935 - DNA, 13 bp, Homo sapiens
ccaacagctacaa

SEQ ID NO: 5055936 - DNA, 16 bp, Homo sapiens
ccaacagctacaacag

SEQ ID NO: 5055937 - DNA, 17 bp, Homo sapiens
ccaacagctacaacagc

SEQ ID NO: 5055938 - DNA, 14 bp, Homo sapiens
ccaacagcttgacc

SEQ ID NO: 5055939 - DNA, 20 bp, Homo sapiens
ccaacagcttgaccagacct

SEQ ID NO: 5055940 - DNA, 22 bp, Homo sapiens
ccaacagcttgaccagacctag

SEQ ID NO: 5055941 - DNA, 23 bp, Homo sapiens
ccaacaggagctgggatcctaag

SEQ ID NO: 5055942 - DNA, 15 bp, Homo sapiens
ccaacaggaggacaa

SEQ ID NO: 5055943 - DNA, 17 bp, Homo sapiens
ccaacaggggctccatg

SEQ ID NO: 5055944 - DNA, 19 bp, Homo sapiens
ccaacaggggctggagggc

SEQ ID NO: 5055945 - DNA, 22 bp, Homo sapiens
ccaacagggtagatttctcttg

SEQ ID NO: 5055946 - DNA, 20 bp, Homo sapiens
ccaacaggtagcatagctct

SEQ ID NO: 5055947 - DNA, 22 bp, Homo sapiens
ccaacaggtgctgaactgtgca

SEQ ID NO: 5055948 - DNA, 14 bp, Homo sapiens
ccaacaggtggcag

SEQ ID NO: 5055949 - DNA, 15 bp, Homo sapiens
ccaacaggtggcagg

SEQ ID NO: 5055950 - DNA, 20 bp, Homo sapiens
ccaacagtgagtctgtcagc

SEQ ID NO: 5055951 - DNA, 11 bp, Homo sapiens
ccaacagtggc

SEQ ID NO: 5055952 - DNA, 19 bp, Homo sapiens
ccaacagtgtgaagttaga

SEQ ID NO: 5055953 - DNA, 22 bp, Homo sapiens
ccaacagtgtgaagttagaatt

SEQ ID NO: 5055954 - DNA, 20 bp, Homo sapiens
ccaacagtgttaggcctggc

SEQ ID NO: 5055955 - DNA, 23 bp, Homo sapiens
ccaacagtgttaggcctggcaca

SEQ ID NO: 5055956 - DNA, 16 bp, Homo sapiens
ccaacagtttattttt

SEQ ID NO: 5055957 - DNA, 15 bp, Homo sapiens
ccaacataaaaatga

SEQ ID NO: 5055958 - DNA, 23 bp, Homo sapiens
ccaacataaaacaaaaccaagcc

SEQ ID NO: 5055959 - DNA, 17 bp, Homo sapiens
ccaacatactcccatct

SEQ ID NO: 5055960 - DNA, 22 bp, Homo sapiens
ccaacatactcccatctgtgaa

SEQ ID NO: 5055961 - DNA, 16 bp, Homo sapiens
ccaacatcaacatctt

SEQ ID NO: 5055962 - DNA, 21 bp, Homo sapiens
ccaacatcatatacctcttga

SEQ ID NO: 5055963 - DNA, 13 bp, Homo sapiens
ccaacatccactc

SEQ ID NO: 5055964 - DNA, 15 bp, Homo sapiens
ccaacatccactctc

SEQ ID NO: 5055965 - DNA, 17 bp, Homo sapiens
ccaacatccactctctc

SEQ ID NO: 5055966 - DNA, 13 bp, Homo sapiens
ccaacatccagat

SEQ ID NO: 5055967 - DNA, 20 bp, Homo sapiens
ccaacatccagatctatagc

SEQ ID NO: 5055968 - DNA, 16 bp, Homo sapiens
ccaacatccagtcctg

SEQ ID NO: 5055969 - DNA, 18 bp, Homo sapiens
ccaacatccagtcctgct

SEQ ID NO: 5055970 - DNA, 20 bp, Homo sapiens
ccaacatctttgcgaaaaga

SEQ ID NO: 5055971 - DNA, 21 bp, Homo sapiens
ccaacatgaaggatcaaaaaa

SEQ ID NO: 5055972 - DNA, 21 bp, Homo sapiens
ccaacatgaggacagaaggac

SEQ ID NO: 5055973 - DNA, 22 bp, Homo sapiens
ccaacatgaggacagaaggact

SEQ ID NO: 5055974 - DNA, 17 bp, Homo sapiens
ccaacatgcactgatgt

SEQ ID NO: 5055975 - DNA, 19 bp, Homo sapiens
ccaacatggatgtgttgcc

SEQ ID NO: 5055976 - DNA, 15 bp, Homo sapiens
ccaacatgggaggga

SEQ ID NO: 5055977 - DNA, 22 bp, Homo sapiens
ccaacatgggagggatcagccc

SEQ ID NO: 5055978 - DNA, 23 bp, Homo sapiens
ccaacatgggagggatcagcccc

SEQ ID NO: 5055979 - DNA, 16 bp, Homo sapiens
ccaacatggtcctagc

SEQ ID NO: 5055980 - DNA, 22 bp, Homo sapiens
ccaacatggtgaaaccctgtct

SEQ ID NO: 5055981 - DNA, 18 bp, Homo sapiens
ccaacatgtatctgtcta

SEQ ID NO: 5055982 - DNA, 20 bp, Homo sapiens
ccaacatgtatctgtctact

SEQ ID NO: 5055983 - DNA, 15 bp, Homo sapiens
ccaacatgtggctcc

SEQ ID NO: 5055984 - DNA, 21 bp, Homo sapiens
ccaacatgtttctgttttgtt

SEQ ID NO: 5055985 - DNA, 16 bp, Homo sapiens
ccaacattatcctgtg

SEQ ID NO: 5055986 - DNA, 13 bp, Homo sapiens
ccaacattctgca

SEQ ID NO: 5055987 - DNA, 18 bp, Homo sapiens
ccaacattgccttgcatt

SEQ ID NO: 5055988 - DNA, 16 bp, Homo sapiens
ccaacattgttcattc

SEQ ID NO: 5055989 - DNA, 16 bp, Homo sapiens
ccaaccaaccagcagg

SEQ ID NO: 5055990 - DNA, 13 bp, Homo sapiens
ccaaccaaggaag

SEQ ID NO: 5055991 - DNA, 18 bp, Homo sapiens
ccaaccaaggaaggagcc

SEQ ID NO: 5055992 - DNA, 21 bp, Homo sapiens
ccaaccaaggaaggagcccct

SEQ ID NO: 5055993 - DNA, 20 bp, Homo sapiens
ccaaccaagtggctcccaca

SEQ ID NO: 5055994 - DNA, 19 bp, Homo sapiens
ccaaccacagcatcgggag

SEQ ID NO: 5055995 - DNA, 21 bp, Homo sapiens
ccaaccacagcatcgggagca

SEQ ID NO: 5055996 - DNA, 15 bp, Homo sapiens
ccaaccagaataaaa

SEQ ID NO: 5055997 - DNA, 12 bp, Homo sapiens
ccaaccagacag

SEQ ID NO: 5055998 - DNA, 13 bp, Homo sapiens
ccaaccagacagc

SEQ ID NO: 5055999 - DNA, 13 bp, Homo sapiens
ccaaccagacttt

SEQ ID NO: 5056000 - DNA, 12 bp, Homo sapiens
ccaaccagcccg

SEQ ID NO: 5056001 - DNA, 13 bp, Homo sapiens
ccaaccagcccga

SEQ ID NO: 5056002 - DNA, 20 bp, Homo sapiens
ccaaccagcccgacagtgcc

SEQ ID NO: 5056003 - DNA, 22 bp, Homo sapiens
ccaaccagcccgacagtgccat

SEQ ID NO: 5056004 - DNA, 14 bp, Homo sapiens
ccaaccagcttgtc

SEQ ID NO: 5056005 - DNA, 13 bp, Homo sapiens
ccaaccaggaccc

SEQ ID NO: 5056006 - DNA, 17 bp, Homo sapiens
ccaaccaggacccaggg

SEQ ID NO: 5056007 - DNA, 22 bp, Homo sapiens
ccaaccaggaggggtctgcctc

SEQ ID NO: 5056008 - DNA, 14 bp, Homo sapiens
ccaaccaggccctg

SEQ ID NO: 5056009 - DNA, 18 bp, Homo sapiens
ccaaccagtgccaaggac

SEQ ID NO: 5056010 - DNA, 14 bp, Homo sapiens
ccaaccatttcctc

SEQ ID NO: 5056011 - DNA, 17 bp, Homo sapiens
ccaaccatttcctcaga

SEQ ID NO: 5056012 - DNA, 19 bp, Homo sapiens
ccaacccaaacctggagat

SEQ ID NO: 5056013 - DNA, 22 bp, Homo sapiens
ccaacccaactgacttctgcta

SEQ ID NO: 5056014 - DNA, 20 bp, Homo sapiens
ccaacccaataaaactgatg

SEQ ID NO: 5056015 - DNA, 22 bp, Homo sapiens
ccaacccaataaaactgatgtt

SEQ ID NO: 5056016 - DNA, 21 bp, Homo sapiens
ccaacccaattcaggactggc

SEQ ID NO: 5056017 - DNA, 15 bp, Homo sapiens
ccaacccacctctgg

SEQ ID NO: 5056018 - DNA, 13 bp, Homo sapiens
ccaacccagccca

SEQ ID NO: 5056019 - DNA, 19 bp, Homo sapiens
ccaacccagccgctgcccg

SEQ ID NO: 5056020 - DNA, 14 bp, Homo sapiens
ccaacccatcagaa

SEQ ID NO: 5056021 - DNA, 17 bp, Homo sapiens
ccaacccatgagtgcta

SEQ ID NO: 5056022 - DNA, 17 bp, Homo sapiens
ccaacccatgcatggcc

SEQ ID NO: 5056023 - DNA, 15 bp, Homo sapiens
ccaacccatgccctg

SEQ ID NO: 5056024 - DNA, 16 bp, Homo sapiens
ccaacccatgccctgc

SEQ ID NO: 5056025 - DNA, 16 bp, Homo sapiens
ccaaccccaacaattg

SEQ ID NO: 5056026 - DNA, 13 bp, Homo sapiens
ccaaccccagccg

SEQ ID NO: 5056027 - DNA, 13 bp, Homo sapiens
ccaaccccagctg

SEQ ID NO: 5056028 - DNA, 14 bp, Homo sapiens
ccaaccccagctgg

SEQ ID NO: 5056029 - DNA, 16 bp, Homo sapiens
ccaaccccagctggcc

SEQ ID NO: 5056030 - DNA, 18 bp, Homo sapiens
ccaacccccaccccacac

SEQ ID NO: 5056031 - DNA, 19 bp, Homo sapiens
ccaacccccaccccacact

SEQ ID NO: 5056032 - DNA, 18 bp, Homo sapiens
ccaacccccagaggtggc

SEQ ID NO: 5056033 - DNA, 19 bp, Homo sapiens
ccaacccccagaggtggcc

SEQ ID NO: 5056034 - DNA, 22 bp, Homo sapiens
ccaacccccagaggtggccctt

SEQ ID NO: 5056035 - DNA, 13 bp, Homo sapiens
ccaacccccagca

SEQ ID NO: 5056036 - DNA, 15 bp, Homo sapiens
ccaacccccagcacc

SEQ ID NO: 5056037 - DNA, 17 bp, Homo sapiens
ccaacccccagccccca

SEQ ID NO: 5056038 - DNA, 14 bp, Homo sapiens
ccaaccccccagca

SEQ ID NO: 5056039 - DNA, 19 bp, Homo sapiens
ccaaccccccagcactgag

SEQ ID NO: 5056040 - DNA, 21 bp, Homo sapiens
ccaaccccccagcactgagga

SEQ ID NO: 5056041 - DNA, 14 bp, Homo sapiens
ccaacccccctcct

SEQ ID NO: 5056042 - DNA, 17 bp, Homo sapiens
ccaacccccctcctgct

SEQ ID NO: 5056043 - DNA, 19 bp, Homo sapiens
ccaacccccgacttcatcc

SEQ ID NO: 5056044 - DNA, 15 bp, Homo sapiens
ccaaccccgcggccc

SEQ ID NO: 5056045 - DNA, 20 bp, Homo sapiens
ccaacccctcccccacgtct

SEQ ID NO: 5056046 - DNA, 14 bp, Homo sapiens
ccaacccctcctcc

SEQ ID NO: 5056047 - DNA, 19 bp, Homo sapiens
ccaacttgagggcccagag

SEQ ID NO: 5056048 - DNA, 20 bp, Homo sapiens
ccaacttgagggcccagagc

SEQ ID NO: 5056049 - DNA, 13 bp, Homo sapiens
ccaacttgccaaa

SEQ ID NO: 5056050 - DNA, 17 bp, Homo sapiens
ccaacttggctgcagga

SEQ ID NO: 5056051 - DNA, 17 bp, Homo sapiens
ccaacttgtaaatacac

SEQ ID NO: 5056052 - DNA, 20 bp, Homo sapiens
ccaacttgtctctgtagaag

SEQ ID NO: 5056053 - DNA, 23 bp, Homo sapiens
ccaacttgtctctgtagaagctc

SEQ ID NO: 5056054 - DNA, 17 bp, Homo sapiens
ccaacttgttgtggctc

SEQ ID NO: 5056055 - DNA, 18 bp, Homo sapiens
ccaacttgttgtggctct

SEQ ID NO: 5056056 - DNA, 22 bp, Homo sapiens
ccaactttcaagaacttgttta

SEQ ID NO: 5056057 - DNA, 12 bp, Homo sapiens
ccaactttcatt

SEQ ID NO: 5056058 - DNA, 15 bp, Homo sapiens
ccaactttccagact

SEQ ID NO: 5056059 - DNA, 23 bp, Homo sapiens
ccaacttttaatgggatttcatg

SEQ ID NO: 5056060 - DNA, 11 bp, Homo sapiens
ccaagaaaaag

SEQ ID NO: 5056061 - DNA, 15 bp, Homo sapiens
ccaagaaaatcacat

SEQ ID NO: 5056062 - DNA, 14 bp, Homo sapiens
ccaagaaaatgaag

SEQ ID NO: 5056063 - DNA, 19 bp, Homo sapiens
ccaagaaacactgcctgcc

SEQ ID NO: 5056064 - DNA, 21 bp, Homo sapiens
ccaagaaaccaaagtctgccg

SEQ ID NO: 5056065 - DNA, 23 bp, Homo sapiens
ccaagaaactagtatctctggcc

SEQ ID NO: 5056066 - DNA, 12 bp, Homo sapiens
ccaagaaactga

SEQ ID NO: 5056067 - DNA, 11 bp, Homo sapiens
ccaagaaactt

SEQ ID NO: 5056068 - DNA, 18 bp, Homo sapiens
ccaagaaaggaaaccttt

SEQ ID NO: 5056069 - DNA, 23 bp, Homo sapiens
ccaagaactctaaccagtgtaca

SEQ ID NO: 5056070 - DNA, 16 bp, Homo sapiens
ccaagaactctgggca

SEQ ID NO: 5056071 - DNA, 18 bp, Homo sapiens
ccaagaactgaaaacata

SEQ ID NO: 5056072 - DNA, 22 bp, Homo sapiens
ccaagaactgcagatagcccag

SEQ ID NO: 5056073 - DNA, 12 bp, Homo sapiens
ccaagaagcaaa

SEQ ID NO: 5056074 - DNA, 20 bp, Homo sapiens
ccaagaagcccaggaaaggc

SEQ ID NO: 5056075 - DNA, 13 bp, Homo sapiens
ccaagaagggcta

SEQ ID NO: 5056076 - DNA, 13 bp, Homo sapiens
ccaagaagttgga

SEQ ID NO: 5056077 - DNA, 22 bp, Homo sapiens
ccaagaatatattatataaaga

SEQ ID NO: 5056078 - DNA, 21 bp, Homo sapiens
ccaagaatccacatttctaaa

SEQ ID NO: 5056079 - DNA, 11 bp, Homo sapiens
ccaagaatctt

SEQ ID NO: 5056080 - DNA, 12 bp, Homo sapiens
ccaagaatgctg

SEQ ID NO: 5056081 - DNA, 13 bp, Homo sapiens
ccaagaatgctga

SEQ ID NO: 5056082 - DNA, 18 bp, Homo sapiens
ccaagaatgtacgtccag

SEQ ID NO: 5056083 - DNA, 21 bp, Homo sapiens
ccaagaatgtacgtccagcct

SEQ ID NO: 5056084 - DNA, 18 bp, Homo sapiens
ccaagaatgtctccattg

SEQ ID NO: 5056085 - DNA, 16 bp, Homo sapiens
ccaagacaaactaaac

SEQ ID NO: 5056086 - DNA, 13 bp, Homo sapiens
ccaagacaaatca

SEQ ID NO: 5056087 - DNA, 22 bp, Homo sapiens
ccaagacaaatcaacagaagca

SEQ ID NO: 5056088 - DNA, 15 bp, Homo sapiens
ccaagacaagtgatt

SEQ ID NO: 5056089 - DNA, 14 bp, Homo sapiens
ccaagacacatgct

SEQ ID NO: 5056090 - DNA, 21 bp, Homo sapiens
ccaagacacttccccttgtct

SEQ ID NO: 5056091 - DNA, 21 bp, Homo sapiens
ccaagacagatgccccagagc

SEQ ID NO: 5056092 - DNA, 14 bp, Homo sapiens
ccaagacagatgga

SEQ ID NO: 5056093 - DNA, 14 bp, Homo sapiens
ccaagacagcagca

SEQ ID NO: 5056094 - DNA, 17 bp, Homo sapiens
ccaagacagcagcagcc

SEQ ID NO: 5056095 - DNA, 21 bp, Homo sapiens
ccaagacagcagcagcctgca

SEQ ID NO: 5056096 - DNA, 16 bp, Homo sapiens
ccaagacagggctcat

SEQ ID NO: 5056097 - DNA, 11 bp, Homo sapiens
ccaagacagtg

SEQ ID NO: 5056098 - DNA, 18 bp, Homo sapiens
cccagcccaccctcctgt

SEQ ID NO: 5056099 - DNA, 19 bp, Homo sapiens
cccagcccaccctgctcct

SEQ ID NO: 5056100 - DNA, 12 bp, Homo sapiens
cccagcccacct

SEQ ID NO: 5056101 - DNA, 19 bp, Homo sapiens
cccagcccacctgctccca

SEQ ID NO: 5056102 - DNA, 19 bp, Homo sapiens
cccagcccacttctgccat

SEQ ID NO: 5056103 - DNA, 16 bp, Homo sapiens
cccagcccagacagca

SEQ ID NO: 5056104 - DNA, 13 bp, Homo sapiens
cccagcccagcac

SEQ ID NO: 5056105 - DNA, 13 bp, Homo sapiens
cccagcccagcct

SEQ ID NO: 5056106 - DNA, 22 bp, Homo sapiens
cccagcccagctgctctgccca

SEQ ID NO: 5056107 - DNA, 12 bp, Homo sapiens
cccagcccagga

SEQ ID NO: 5056108 - DNA, 13 bp, Homo sapiens
cccagcccaggcc

SEQ ID NO: 5056109 - DNA, 14 bp, Homo sapiens
cccagcccaggcct

SEQ ID NO: 5056110 - DNA, 15 bp, Homo sapiens
cccagcccaggcctg

SEQ ID NO: 5056111 - DNA, 16 bp, Homo sapiens
cccagcccaggcctgg

SEQ ID NO: 5056112 - DNA, 22 bp, Homo sapiens
cccagcccatccattaggccag

SEQ ID NO: 5056113 - DNA, 18 bp, Homo sapiens
cccagcccatctgaacac

SEQ ID NO: 5056114 - DNA, 22 bp, Homo sapiens
cccagcccattctctctcctgt

SEQ ID NO: 5056115 - DNA, 16 bp, Homo sapiens
cccagcccattgctgc

SEQ ID NO: 5056116 - DNA, 23 bp, Homo sapiens
cccagccccaaaactctcctctg

SEQ ID NO: 5056117 - DNA, 19 bp, Homo sapiens
cccagccccaaggggtggc

SEQ ID NO: 5056118 - DNA, 12 bp, Homo sapiens
cccagccccaat

SEQ ID NO: 5056119 - DNA, 22 bp, Homo sapiens
cccagccccactcctctgctga

SEQ ID NO: 5056120 - DNA, 16 bp, Homo sapiens
cccagccccactgccc

SEQ ID NO: 5056121 - DNA, 22 bp, Homo sapiens
cccagccccactgccctccagg

SEQ ID NO: 5056122 - DNA, 23 bp, Homo sapiens
cccagccccactgccctccaggg

SEQ ID NO: 5056123 - DNA, 21 bp, Homo sapiens
cccagccccagcgagtctgga

SEQ ID NO: 5056124 - DNA, 16 bp, Homo sapiens
cccagccccaggcctg

SEQ ID NO: 5056125 - DNA, 11 bp, Homo sapiens
cccagccccat

SEQ ID NO: 5056126 - DNA, 13 bp, Homo sapiens
cccagccccatcc

SEQ ID NO: 5056127 - DNA, 15 bp, Homo sapiens
cccagccccatccct

SEQ ID NO: 5056128 - DNA, 19 bp, Homo sapiens
cccagccccatccctgtcc

SEQ ID NO: 5056129 - DNA, 15 bp, Homo sapiens
cccagcccccacagc

SEQ ID NO: 5056130 - DNA, 18 bp, Homo sapiens
cccagccccctaagagag

SEQ ID NO: 5056131 - DNA, 21 bp, Homo sapiens
cccagccccctaagagagcac

SEQ ID NO: 5056132 - DNA, 12 bp, Homo sapiens
cccagccccctc

SEQ ID NO: 5056133 - DNA, 17 bp, Homo sapiens
cccagccccctcccacc

SEQ ID NO: 5056134 - DNA, 20 bp, Homo sapiens
cccagccccctcccaccgct

SEQ ID NO: 5056135 - DNA, 21 bp, Homo sapiens
cccagccccctttgggcccag

SEQ ID NO: 5056136 - DNA, 18 bp, Homo sapiens
cccagccccgactccagc

SEQ ID NO: 5056137 - DNA, 20 bp, Homo sapiens
cccagccccgactccagcca

SEQ ID NO: 5056138 - DNA, 20 bp, Homo sapiens
cccagccccgtcccagaggc

SEQ ID NO: 5056139 - DNA, 22 bp, Homo sapiens
cccagccccgtcccagaggccg

SEQ ID NO: 5056140 - DNA, 15 bp, Homo sapiens
cccagcccctactgc

SEQ ID NO: 5056141 - DNA, 19 bp, Homo sapiens
cccagcccctactgctgtg

SEQ ID NO: 5056142 - DNA, 13 bp, Homo sapiens
cccagcccctaga

SEQ ID NO: 5056143 - DNA, 22 bp, Homo sapiens
cccagcccctagaaacccaagc

SEQ ID NO: 5056144 - DNA, 22 bp, Homo sapiens
cccagcccctagcccaggagag

SEQ ID NO: 5056145 - DNA, 18 bp, Homo sapiens
cccagcccctcaaccctc

SEQ ID NO: 5056146 - DNA, 15 bp, Homo sapiens
cccagcccctccacg

SEQ ID NO: 5056147 - DNA, 18 bp, Homo sapiens
cccagcccctcccccatc

SEQ ID NO: 5056148 - DNA, 14 bp, Homo sapiens
cccagcccctcctc

SEQ ID NO: 5056149 - DNA, 15 bp, Homo sapiens
cccagcccctcctcc

SEQ ID NO: 5056150 - DNA, 19 bp, Homo sapiens
cccagcccctcctcccctt

SEQ ID NO: 5056151 - DNA, 21 bp, Homo sapiens
cccagcccctcctccccttcc

SEQ ID NO: 5056152 - DNA, 19 bp, Homo sapiens
cccagcccctcctccctca

SEQ ID NO: 5056153 - DNA, 20 bp, Homo sapiens
cccagcccctcctccctcaa

SEQ ID NO: 5056154 - DNA, 23 bp, Homo sapiens
cccagcccctcctccctcagacc

SEQ ID NO: 5056155 - DNA, 22 bp, Homo sapiens
cccagcccctcctccctcaggc

SEQ ID NO: 5056156 - DNA, 14 bp, Homo sapiens
cccagcccctgcag

SEQ ID NO: 5056157 - DNA, 15 bp, Homo sapiens
cccagcccctgcaga

SEQ ID NO: 5056158 - DNA, 15 bp, Homo sapiens
cccagcccctgcggc

SEQ ID NO: 5056159 - DNA, 16 bp, Homo sapiens
cccagcccctgcggcc

SEQ ID NO: 5056160 - DNA, 20 bp, Homo sapiens
cccagcccctgcggccgtca

SEQ ID NO: 5056161 - DNA, 11 bp, Homo sapiens
cccagcccctt

SEQ ID NO: 5056162 - DNA, 16 bp, Homo sapiens
cccagccccttcccct

SEQ ID NO: 5056163 - DNA, 19 bp, Homo sapiens
cccagccccttcccctggg

SEQ ID NO: 5056164 - DNA, 20 bp, Homo sapiens
cccagccccttcccctggga

SEQ ID NO: 5056165 - DNA, 22 bp, Homo sapiens
cccagccccttcccctgggaac

SEQ ID NO: 5056166 - DNA, 18 bp, Homo sapiens
cccagccccttttctctg

SEQ ID NO: 5056167 - DNA, 21 bp, Homo sapiens
cccagccccttttctctgctc

SEQ ID NO: 5056168 - DNA, 19 bp, Homo sapiens
cccagcccgcggcctggac

SEQ ID NO: 5056169 - DNA, 20 bp, Homo sapiens
cccagcccgcggcctggacc

SEQ ID NO: 5056170 - DNA, 21 bp, Homo sapiens
cccagcccgcggcctggaccc

SEQ ID NO: 5056171 - DNA, 20 bp, Homo sapiens
cccagcccgctgctcacttt

SEQ ID NO: 5056172 - DNA, 14 bp, Homo sapiens
cccagcccggctga

SEQ ID NO: 5056173 - DNA, 18 bp, Homo sapiens
cccagccctatggatgtg

SEQ ID NO: 5056174 - DNA, 13 bp, Homo sapiens
cccagccctcagg

SEQ ID NO: 5056175 - DNA, 14 bp, Homo sapiens
cccagccctcaggc

SEQ ID NO: 5056176 - DNA, 19 bp, Homo sapiens
cccagccctcaggccagtg

SEQ ID NO: 5056177 - DNA, 15 bp, Homo sapiens
cccagccctcatccc

SEQ ID NO: 5056178 - DNA, 14 bp, Homo sapiens
cccagccctccttc

SEQ ID NO: 5056179 - DNA, 15 bp, Homo sapiens
cccagccctcgcctc

SEQ ID NO: 5056180 - DNA, 23 bp, Homo sapiens
cccagccctctgtggccaggagc

SEQ ID NO: 5056181 - DNA, 11 bp, Homo sapiens
cccagccctgc

SEQ ID NO: 5056182 - DNA, 15 bp, Homo sapiens
cccagccctgccagg

SEQ ID NO: 5056183 - DNA, 16 bp, Homo sapiens
cccagccctgccagga

SEQ ID NO: 5056184 - DNA, 17 bp, Homo sapiens
cccagccctgccaggag

SEQ ID NO: 5056185 - DNA, 15 bp, Homo sapiens
cccagccctgcccag

SEQ ID NO: 5056186 - DNA, 12 bp, Homo sapiens
cccagccctgct

SEQ ID NO: 5056187 - DNA, 13 bp, Homo sapiens
cccagccctgctg

SEQ ID NO: 5056188 - DNA, 15 bp, Homo sapiens
cccagccctgctggc

SEQ ID NO: 5056189 - DNA, 16 bp, Homo sapiens
cccagccctggcccag

SEQ ID NO: 5056190 - DNA, 14 bp, Homo sapiens
cccagccctggctc

SEQ ID NO: 5056191 - DNA, 14 bp, Homo sapiens
cccagccctgggaa

SEQ ID NO: 5056192 - DNA, 22 bp, Homo sapiens
cccagccctgggaaccactccc

SEQ ID NO: 5056193 - DNA, 14 bp, Homo sapiens
cccagccctgggca

SEQ ID NO: 5056194 - DNA, 16 bp, Homo sapiens
cccagccctgggcaag

SEQ ID NO: 5056195 - DNA, 21 bp, Homo sapiens
cccagccctgggcttggctct

SEQ ID NO: 5056196 - DNA, 13 bp, Homo sapiens
cccagccctgggg

SEQ ID NO: 5056197 - DNA, 14 bp, Homo sapiens
cccagccctggtct

SEQ ID NO: 5056198 - DNA, 17 bp, Homo sapiens
cccagccctgtcctggt

SEQ ID NO: 5056199 - DNA, 15 bp, Homo sapiens
cccagccctgtggaa

SEQ ID NO: 5056200 - DNA, 14 bp, Homo sapiens
cccagcccttcctt

SEQ ID NO: 5056201 - DNA, 15 bp, Homo sapiens
cccagcccttctgcc

SEQ ID NO: 5056202 - DNA, 18 bp, Homo sapiens
cccagccgcaggaaggca

SEQ ID NO: 5056203 - DNA, 14 bp, Homo sapiens
cccagccggcctct

SEQ ID NO: 5056204 - DNA, 14 bp, Homo sapiens
cccagccgggcaca

SEQ ID NO: 5056205 - DNA, 14 bp, Homo sapiens
cccagccggggtgg

SEQ ID NO: 5056206 - DNA, 16 bp, Homo sapiens
cccagccggggtgggg

SEQ ID NO: 5056207 - DNA, 17 bp, Homo sapiens
cccagccggggtggggt

SEQ ID NO: 5056208 - DNA, 14 bp, Homo sapiens
cccagcctacctct

SEQ ID NO: 5056209 - DNA, 13 bp, Homo sapiens
cccagcctaggtg

SEQ ID NO: 5056210 - DNA, 13 bp, Homo sapiens
cccagcctagtca

SEQ ID NO: 5056211 - DNA, 16 bp, Homo sapiens
cccagcctagtcaggg

SEQ ID NO: 5056212 - DNA, 19 bp, Homo sapiens
cccagcctagtcagggcac

SEQ ID NO: 5056213 - DNA, 16 bp, Homo sapiens
cccagcctatctctct

SEQ ID NO: 5056214 - DNA, 23 bp, Homo sapiens
cccagcctcaaatccaggaccct

SEQ ID NO: 5056215 - DNA, 16 bp, Homo sapiens
cccagcctcactccat

SEQ ID NO: 5056216 - DNA, 20 bp, Homo sapiens
cccagcctcactccatttcc

SEQ ID NO: 5056217 - DNA, 18 bp, Homo sapiens
cccagcctcacttccttt

SEQ ID NO: 5056218 - DNA, 19 bp, Homo sapiens
cccagcctcacttcctttg

SEQ ID NO: 5056219 - DNA, 11 bp, Homo sapiens
cccagcctcag

SEQ ID NO: 5056220 - DNA, 17 bp, Homo sapiens
cccagcctcagaagcct

SEQ ID NO: 5056221 - DNA, 21 bp, Homo sapiens
cccagcctcagaagccttctt

SEQ ID NO: 5056222 - DNA, 12 bp, Homo sapiens
cccagcctcagc

SEQ ID NO: 5056223 - DNA, 13 bp, Homo sapiens
cccagcctcagcc

SEQ ID NO: 5056224 - DNA, 18 bp, Homo sapiens
cccagcctcagcccaact

SEQ ID NO: 5056225 - DNA, 15 bp, Homo sapiens
cccagcctcagcgcg

SEQ ID NO: 5056226 - DNA, 19 bp, Homo sapiens
cccagcctcattgtgccaa

SEQ ID NO: 5056227 - DNA, 13 bp, Homo sapiens
cctcccggtgccc

SEQ ID NO: 5056228 - DNA, 15 bp, Homo sapiens
cctccctacacacac

SEQ ID NO: 5056229 - DNA, 14 bp, Homo sapiens
cctccctaccctcg

SEQ ID NO: 5056230 - DNA, 15 bp, Homo sapiens
cctccctacctcaac

SEQ ID NO: 5056231 - DNA, 13 bp, Homo sapiens
cctccctacctga

SEQ ID NO: 5056232 - DNA, 16 bp, Homo sapiens
cctccctagatccagg

SEQ ID NO: 5056233 - DNA, 21 bp, Homo sapiens
cctccctagccagcacttgta

SEQ ID NO: 5056234 - DNA, 18 bp, Homo sapiens
cctccctagcccttccag

SEQ ID NO: 5056235 - DNA, 22 bp, Homo sapiens
cctccctagttagcatccaggc

SEQ ID NO: 5056236 - DNA, 20 bp, Homo sapiens
cctccctatatgcacccctg

SEQ ID NO: 5056237 - DNA, 14 bp, Homo sapiens
cctccctcaacaag

SEQ ID NO: 5056238 - DNA, 17 bp, Homo sapiens
cctccctcaacctcatc

SEQ ID NO: 5056239 - DNA, 21 bp, Homo sapiens
cctccctcaacctcatcctct

SEQ ID NO: 5056240 - DNA, 22 bp, Homo sapiens
cctccctcaccctgagcccctt

SEQ ID NO: 5056241 - DNA, 14 bp, Homo sapiens
cctccctcagaccc

SEQ ID NO: 5056242 - DNA, 15 bp, Homo sapiens
cctccctcagaccca

SEQ ID NO: 5056243 - DNA, 23 bp, Homo sapiens
cctccctcagacccagcggtcca

SEQ ID NO: 5056244 - DNA, 20 bp, Homo sapiens
cctccctcagacccaggagt

SEQ ID NO: 5056245 - DNA, 23 bp, Homo sapiens
cctccctcagacccaggagtcca

SEQ ID NO: 5056246 - DNA, 14 bp, Homo sapiens
cctccctcagactc

SEQ ID NO: 5056247 - DNA, 14 bp, Homo sapiens
cctccctcagccac

SEQ ID NO: 5056248 - DNA, 21 bp, Homo sapiens
cctccctcagccacgcctctc

SEQ ID NO: 5056249 - DNA, 20 bp, Homo sapiens
cctccctcagcccccaggat

SEQ ID NO: 5056250 - DNA, 15 bp, Homo sapiens
cctccctcagcccct

SEQ ID NO: 5056251 - DNA, 20 bp, Homo sapiens
cctccctcagcccctcttgc

SEQ ID NO: 5056252 - DNA, 14 bp, Homo sapiens
cctccctcagcctc

SEQ ID NO: 5056253 - DNA, 18 bp, Homo sapiens
cctccctcagcctcccct

SEQ ID NO: 5056254 - DNA, 20 bp, Homo sapiens
cctccctcagcctccccttc

SEQ ID NO: 5056255 - DNA, 12 bp, Homo sapiens
cctccctcagcg

SEQ ID NO: 5056256 - DNA, 15 bp, Homo sapiens
cctccctcagggagc

SEQ ID NO: 5056257 - DNA, 20 bp, Homo sapiens
cctccctcagggagcgatcc

SEQ ID NO: 5056258 - DNA, 21 bp, Homo sapiens
cctccctccaagcctggcacc

SEQ ID NO: 5056259 - DNA, 15 bp, Homo sapiens
cctccctccacacct

SEQ ID NO: 5056260 - DNA, 15 bp, Homo sapiens
cctccctccacccca

SEQ ID NO: 5056261 - DNA, 19 bp, Homo sapiens
cctccctccaccccaggac

SEQ ID NO: 5056262 - DNA, 20 bp, Homo sapiens
cctccctccaccccaggacg

SEQ ID NO: 5056263 - DNA, 20 bp, Homo sapiens
cctccctccacctccctgca

SEQ ID NO: 5056264 - DNA, 12 bp, Homo sapiens
cctccctccagc

SEQ ID NO: 5056265 - DNA, 15 bp, Homo sapiens
cctccctccagctgc

SEQ ID NO: 5056266 - DNA, 19 bp, Homo sapiens
cctccctccagctgcgact

SEQ ID NO: 5056267 - DNA, 17 bp, Homo sapiens
cctccctcccagatcca

SEQ ID NO: 5056268 - DNA, 15 bp, Homo sapiens
cctccctcccagctg

SEQ ID NO: 5056269 - DNA, 16 bp, Homo sapiens
cctccctcccagctgc

SEQ ID NO: 5056270 - DNA, 13 bp, Homo sapiens
cctccctccccag

SEQ ID NO: 5056271 - DNA, 17 bp, Homo sapiens
cctccctcccctgccct

SEQ ID NO: 5056272 - DNA, 15 bp, Homo sapiens
cctccctccccttgc

SEQ ID NO: 5056273 - DNA, 19 bp, Homo sapiens
cctccctcccggcatggga

SEQ ID NO: 5056274 - DNA, 16 bp, Homo sapiens
cctccctcccggctgc

SEQ ID NO: 5056275 - DNA, 19 bp, Homo sapiens
cctccctcccggctgcccc

SEQ ID NO: 5056276 - DNA, 16 bp, Homo sapiens
cctccctccctagccc

SEQ ID NO: 5056277 - DNA, 12 bp, Homo sapiens
cctccctccctc

SEQ ID NO: 5056278 - DNA, 14 bp, Homo sapiens
cctccctccctctc

SEQ ID NO: 5056279 - DNA, 15 bp, Homo sapiens
cctccctccctctcc

SEQ ID NO: 5056280 - DNA, 14 bp, Homo sapiens
cctccctccctctt

SEQ ID NO: 5056281 - DNA, 14 bp, Homo sapiens
cctccctccctgca

SEQ ID NO: 5056282 - DNA, 15 bp, Homo sapiens
cctccctccctgcag

SEQ ID NO: 5056283 - DNA, 16 bp, Homo sapiens
cctccctccctgcagg

SEQ ID NO: 5056284 - DNA, 18 bp, Homo sapiens
cctccctccctgctccct

SEQ ID NO: 5056285 - DNA, 23 bp, Homo sapiens
cctccctccggccatactgcctt

SEQ ID NO: 5056286 - DNA, 18 bp, Homo sapiens
cctccctccgtccctctg

SEQ ID NO: 5056287 - DNA, 13 bp, Homo sapiens
cctccctcctcag

SEQ ID NO: 5056288 - DNA, 12 bp, Homo sapiens
cctccctcctcg

SEQ ID NO: 5056289 - DNA, 16 bp, Homo sapiens
cctccctcctctgtcc

SEQ ID NO: 5056290 - DNA, 13 bp, Homo sapiens
cctccctcctgcc

SEQ ID NO: 5056291 - DNA, 14 bp, Homo sapiens
cctccctcctggct

SEQ ID NO: 5056292 - DNA, 15 bp, Homo sapiens
cctccctcctggctc

SEQ ID NO: 5056293 - DNA, 18 bp, Homo sapiens
cctccctcctggctcaca

SEQ ID NO: 5056294 - DNA, 14 bp, Homo sapiens
cctccctcctgggg

SEQ ID NO: 5056295 - DNA, 14 bp, Homo sapiens
cctccctcctgtgt

SEQ ID NO: 5056296 - DNA, 12 bp, Homo sapiens
cctccctctact

SEQ ID NO: 5056297 - DNA, 23 bp, Homo sapiens
cctccctctagaggctgcctggg

SEQ ID NO: 5056298 - DNA, 18 bp, Homo sapiens
cctccctctccagcaggc

SEQ ID NO: 5056299 - DNA, 14 bp, Homo sapiens
cctccctctccata

SEQ ID NO: 5056300 - DNA, 22 bp, Homo sapiens
cctccctctctcatgagaagcc

SEQ ID NO: 5056301 - DNA, 20 bp, Homo sapiens
cctccctctctcttctgctc

SEQ ID NO: 5056302 - DNA, 20 bp, Homo sapiens
cctccctctcttccgggagc

SEQ ID NO: 5056303 - DNA, 18 bp, Homo sapiens
cctccctctgacctgcag

SEQ ID NO: 5056304 - DNA, 21 bp, Homo sapiens
cctccctctgaggctgtagga

SEQ ID NO: 5056305 - DNA, 14 bp, Homo sapiens
cctccctctgccag

SEQ ID NO: 5056306 - DNA, 18 bp, Homo sapiens
cctccctctgccccaagc

SEQ ID NO: 5056307 - DNA, 23 bp, Homo sapiens
cctccctctgccccaagcagcca

SEQ ID NO: 5056308 - DNA, 15 bp, Homo sapiens
cctccctctgcctca

SEQ ID NO: 5056309 - DNA, 20 bp, Homo sapiens
cctccctctgcctcatcctc

SEQ ID NO: 5056310 - DNA, 13 bp, Homo sapiens
cctccctctgctc

SEQ ID NO: 5056311 - DNA, 15 bp, Homo sapiens
cctccctctgctctc

SEQ ID NO: 5056312 - DNA, 14 bp, Homo sapiens
cctccctctgctgt

SEQ ID NO: 5056313 - DNA, 12 bp, Homo sapiens
cctccctcttcc

SEQ ID NO: 5056314 - DNA, 22 bp, Homo sapiens
cctccctcttcccagcacaggc

SEQ ID NO: 5056315 - DNA, 15 bp, Homo sapiens
cctccctcttgtttt

SEQ ID NO: 5056316 - DNA, 20 bp, Homo sapiens
cctccctgaaaatgtttttc

SEQ ID NO: 5056317 - DNA, 15 bp, Homo sapiens
cctccctgaccctgc

SEQ ID NO: 5056318 - DNA, 16 bp, Homo sapiens
cctccctgaccctgct

SEQ ID NO: 5056319 - DNA, 21 bp, Homo sapiens
cctccctgactccctgtgggg

SEQ ID NO: 5056320 - DNA, 15 bp, Homo sapiens
cctccctgcacttca

SEQ ID NO: 5056321 - DNA, 19 bp, Homo sapiens
cctccctgcagctttgagg

SEQ ID NO: 5056322 - DNA, 14 bp, Homo sapiens
cctccctgcagggt

SEQ ID NO: 5056323 - DNA, 14 bp, Homo sapiens
cctccctgcatctg

SEQ ID NO: 5056324 - DNA, 21 bp, Homo sapiens
cctccctgcatctgaccagca

SEQ ID NO: 5056325 - DNA, 13 bp, Homo sapiens
cctccctgcccaa

SEQ ID NO: 5056326 - DNA, 14 bp, Homo sapiens
cctccctgcccagg

SEQ ID NO: 5056327 - DNA, 13 bp, Homo sapiens
cctccctgcccct

SEQ ID NO: 5056328 - DNA, 21 bp, Homo sapiens
cctccctgccctgtcctccag

SEQ ID NO: 5056329 - DNA, 16 bp, Homo sapiens
cctccctgcctcagtg

SEQ ID NO: 5056330 - DNA, 14 bp, Homo sapiens
cctccctgcctcca

SEQ ID NO: 5056331 - DNA, 18 bp, Homo sapiens
cctccctgcctccaccca

SEQ ID NO: 5056332 - DNA, 15 bp, Homo sapiens
cctccctgcctgctc

SEQ ID NO: 5056333 - DNA, 11 bp, Homo sapiens
cctccctgcta

SEQ ID NO: 5056334 - DNA, 12 bp, Homo sapiens
cctccctgctac

SEQ ID NO: 5056335 - DNA, 22 bp, Homo sapiens
cctccctgctaccaaggcccag

SEQ ID NO: 5056336 - DNA, 14 bp, Homo sapiens
cctccctgctagca

SEQ ID NO: 5056337 - DNA, 19 bp, Homo sapiens
cctccctgctagcacagag

SEQ ID NO: 5056338 - DNA, 16 bp, Homo sapiens
cctccctgctcctcat

SEQ ID NO: 5056339 - DNA, 20 bp, Homo sapiens
cctccctgctcctcatggga

SEQ ID NO: 5056340 - DNA, 15 bp, Homo sapiens
cctccctgctgccag

SEQ ID NO: 5056341 - DNA, 12 bp, Homo sapiens
cctccctgctgt

SEQ ID NO: 5056342 - DNA, 14 bp, Homo sapiens
cctccctgctgtca

SEQ ID NO: 5056343 - DNA, 20 bp, Homo sapiens
cctccctggagcctccactg

SEQ ID NO: 5056344 - DNA, 13 bp, Homo sapiens
cctccctggagct

SEQ ID NO: 5056345 - DNA, 14 bp, Homo sapiens
cctccctggagcta

SEQ ID NO: 5056346 - DNA, 23 bp, Homo sapiens
cctccctggagtgtggctgagga

SEQ ID NO: 5056347 - DNA, 14 bp, Homo sapiens
cctccctggcactg

SEQ ID NO: 5056348 - DNA, 13 bp, Homo sapiens
cctccctggcctc

SEQ ID NO: 5056349 - DNA, 14 bp, Homo sapiens
cctccctggcctca

SEQ ID NO: 5056350 - DNA, 12 bp, Homo sapiens
cctccctggctg

SEQ ID NO: 5056351 - DNA, 13 bp, Homo sapiens
cctccctggctgc

SEQ ID NO: 5056352 - DNA, 16 bp, Homo sapiens
cctccctggctgcagc

SEQ ID NO: 5056353 - DNA, 16 bp, Homo sapiens
cctccctggctgccct

SEQ ID NO: 5056354 - DNA, 17 bp, Homo sapiens
cctccctggctgccctg

SEQ ID NO: 5056355 - DNA, 23 bp, Homo sapiens
cctccctggctgccctggccctg

SEQ ID NO: 5056356 - DNA, 10 bp, Homo sapiens
cctccctggg

SEQ ID NO: 5056357 - DNA, 19 bp, Homo sapiens
cctccctgggccacctcct

SEQ ID NO: 5056358 - DNA, 21 bp, Homo sapiens
cctccctgggccacctcctac

SEQ ID NO: 5056359 - DNA, 13 bp, Homo sapiens
cctccctgggcct

SEQ ID NO: 5056360 - DNA, 20 bp, Homo sapiens
cctccctgggggcgggactc

SEQ ID NO: 5056361 - DNA, 20 bp, Homo sapiens
cctccctgggggtggggctc

SEQ ID NO: 5056362 - DNA, 12 bp, Homo sapiens
cctccctgggtt

SEQ ID NO: 5056363 - DNA, 11 bp, Homo sapiens
cctccctgtaa

SEQ ID NO: 5056364 - DNA, 14 bp, Homo sapiens
cctccctgtaactt

SEQ ID NO: 5056365 - DNA, 20 bp, Homo sapiens
cctccctgtaatgcactcct

SEQ ID NO: 5056366 - DNA, 21 bp, Homo sapiens
cctccctgtaatgcactcctg

SEQ ID NO: 5056367 - DNA, 13 bp, Homo sapiens
cgatattctccct

SEQ ID NO: 5056368 - DNA, 21 bp, Homo sapiens
cgatatttaattcacctcagc

SEQ ID NO: 5056369 - DNA, 22 bp, Homo sapiens
cgatcaacatttatgacctaag

SEQ ID NO: 5056370 - DNA, 22 bp, Homo sapiens
cgatcaagttgttgactgtgat

SEQ ID NO: 5056371 - DNA, 17 bp, Homo sapiens
cgatcacaaatgacttt

SEQ ID NO: 5056372 - DNA, 18 bp, Homo sapiens
cgatcacaacgtgcattg

SEQ ID NO: 5056373 - DNA, 20 bp, Homo sapiens
cgatcacaggccttgctttt

SEQ ID NO: 5056374 - DNA, 21 bp, Homo sapiens
cgatcatatttccccttggac

SEQ ID NO: 5056375 - DNA, 17 bp, Homo sapiens
cgatcattgtgcccact

SEQ ID NO: 5056376 - DNA, 15 bp, Homo sapiens
cgatccacctgtctc

SEQ ID NO: 5056377 - DNA, 20 bp, Homo sapiens
cgatccacctgtctcagcct

SEQ ID NO: 5056378 - DNA, 22 bp, Homo sapiens
cgatccacctgtctcagcctcc

SEQ ID NO: 5056379 - DNA, 17 bp, Homo sapiens
cgatccagattcccagg

SEQ ID NO: 5056380 - DNA, 22 bp, Homo sapiens
cgatccccgcttccccttgcca

SEQ ID NO: 5056381 - DNA, 13 bp, Homo sapiens
cgatcccctcccc

SEQ ID NO: 5056382 - DNA, 19 bp, Homo sapiens
cgatccgcaacccatgccc

SEQ ID NO: 5056383 - DNA, 22 bp, Homo sapiens
cgatccgcaacccatgccctgg

SEQ ID NO: 5056384 - DNA, 14 bp, Homo sapiens
cgatcctcccctgg

SEQ ID NO: 5056385 - DNA, 14 bp, Homo sapiens
cgatcctcctgtct

SEQ ID NO: 5056386 - DNA, 13 bp, Homo sapiens
cgatcctgccacc

SEQ ID NO: 5056387 - DNA, 18 bp, Homo sapiens
cgatcctgccaccctgta

SEQ ID NO: 5056388 - DNA, 16 bp, Homo sapiens
cgatcgcccaggctgg

SEQ ID NO: 5056389 - DNA, 19 bp, Homo sapiens
cgatcgcggcggagctggc

SEQ ID NO: 5056390 - DNA, 23 bp, Homo sapiens
cgatcgtaccactacactccagc

SEQ ID NO: 5056391 - DNA, 22 bp, Homo sapiens
cgatctaaccccttacccatct

SEQ ID NO: 5056392 - DNA, 12 bp, Homo sapiens
cgatctcagctc

SEQ ID NO: 5056393 - DNA, 18 bp, Homo sapiens
cgatctcagctcactgca

SEQ ID NO: 5056394 - DNA, 16 bp, Homo sapiens
cgatctcattcagtat

SEQ ID NO: 5056395 - DNA, 11 bp, Homo sapiens
cgatctcctga

SEQ ID NO: 5056396 - DNA, 20 bp, Homo sapiens
cgatctcggctcactgcaac

SEQ ID NO: 5056397 - DNA, 15 bp, Homo sapiens
cgatctcggctcagt

SEQ ID NO: 5056398 - DNA, 23 bp, Homo sapiens
cgatctggaaagagctgttttgg

SEQ ID NO: 5056399 - DNA, 22 bp, Homo sapiens
cgatcttccagaagctgtactt

SEQ ID NO: 5056400 - DNA, 23 bp, Homo sapiens
cgatgaatttggagactctgtgg

SEQ ID NO: 5056401 - DNA, 13 bp, Homo sapiens
cgatgacagtgct

SEQ ID NO: 5056402 - DNA, 16 bp, Homo sapiens
cgatgacgcctctgga

SEQ ID NO: 5056403 - DNA, 19 bp, Homo sapiens
cgatgacgcctctggacct

SEQ ID NO: 5056404 - DNA, 13 bp, Homo sapiens
cgatgagggaagg

SEQ ID NO: 5056405 - DNA, 20 bp, Homo sapiens
cgatgagggaaggagcccag

SEQ ID NO: 5056406 - DNA, 17 bp, Homo sapiens
cgatgatactgtttctt

SEQ ID NO: 5056407 - DNA, 24 bp, Homo sapiens
cctccgaacgctgctccatgcaca

SEQ ID NO: 5056408 - DNA, 22 bp, Homo sapiens
cctccgacagccccctctgccg

SEQ ID NO: 5056409 - DNA, 20 bp, Homo sapiens
cctccgaccacttccagggg

SEQ ID NO: 5056410 - DNA, 22 bp, Homo sapiens
cctccgaccacttccaggggaa

SEQ ID NO: 5056411 - DNA, 14 bp, Homo sapiens
cctccgacctctct

SEQ ID NO: 5056412 - DNA, 16 bp, Homo sapiens
cctccgacctctctcg

SEQ ID NO: 5056413 - DNA, 20 bp, Homo sapiens
cctccgacctctctcggccc

SEQ ID NO: 5056414 - DNA, 19 bp, Homo sapiens
cctccgacgctgcctctca

SEQ ID NO: 5056415 - DNA, 15 bp, Homo sapiens
cctccgactccagat

SEQ ID NO: 5056416 - DNA, 18 bp, Homo sapiens
cctccgagacccaggaga

SEQ ID NO: 5056417 - DNA, 20 bp, Homo sapiens
cctccgaggctccccgcctc

SEQ ID NO: 5056418 - DNA, 15 bp, Homo sapiens
cctccgatgcctggc

SEQ ID NO: 5056419 - DNA, 17 bp, Homo sapiens
cctccgatgctgaggcc

SEQ ID NO: 5056420 - DNA, 13 bp, Homo sapiens
cctccgcacctga

SEQ ID NO: 5056421 - DNA, 18 bp, Homo sapiens
cctccgcagcagggaagc

SEQ ID NO: 5056422 - DNA, 14 bp, Homo sapiens
cctccgcagtgtct

SEQ ID NO: 5056423 - DNA, 18 bp, Homo sapiens
cctccgccaatgcacggc

SEQ ID NO: 5056424 - DNA, 21 bp, Homo sapiens
cctccgccaatgcacggcctc

SEQ ID NO: 5056425 - DNA, 14 bp, Homo sapiens
cctccgccagaccc

SEQ ID NO: 5056426 - DNA, 20 bp, Homo sapiens
cctccgccagaccccgtggc

SEQ ID NO: 5056427 - DNA, 14 bp, Homo sapiens
cctccgccagccct

SEQ ID NO: 5056428 - DNA, 15 bp, Homo sapiens
cctccgccagccctg

SEQ ID NO: 5056429 - DNA, 16 bp, Homo sapiens
cctccgccagccctgt

SEQ ID NO: 5056430 - DNA, 22 bp, Homo sapiens
cctccgcccaaatcaataaact

SEQ ID NO: 5056431 - DNA, 16 bp, Homo sapiens
cctccgccccagacac

SEQ ID NO: 5056432 - DNA, 20 bp, Homo sapiens
cctccgccccagacacaccc

SEQ ID NO: 5056433 - DNA, 14 bp, Homo sapiens
cctccgccctgcca

SEQ ID NO: 5056434 - DNA, 16 bp, Homo sapiens
cctccgccctgccact

SEQ ID NO: 5056435 - DNA, 13 bp, Homo sapiens
cctccgcccttcc

SEQ ID NO: 5056436 - DNA, 14 bp, Homo sapiens
cctccgcccttccc

SEQ ID NO: 5056437 - DNA, 13 bp, Homo sapiens
cctccgcctactg

SEQ ID NO: 5056438 - DNA, 12 bp, Homo sapiens
cctccgcctaga

SEQ ID NO: 5056439 - DNA, 18 bp, Homo sapiens
cctccgcctagaggtccc

SEQ ID NO: 5056440 - DNA, 16 bp, Homo sapiens
cctccgcctccaggaa

SEQ ID NO: 5056441 - DNA, 17 bp, Homo sapiens
cctccgcctcccatccc

SEQ ID NO: 5056442 - DNA, 16 bp, Homo sapiens
cctccgcctgtccaca

SEQ ID NO: 5056443 - DNA, 16 bp, Homo sapiens
cctccgcctgtgtcca

SEQ ID NO: 5056444 - DNA, 19 bp, Homo sapiens
cctccgccttcactccggt

SEQ ID NO: 5056445 - DNA, 17 bp, Homo sapiens
cctccgccttctcccac

SEQ ID NO: 5056446 - DNA, 20 bp, Homo sapiens
cctccgcggaggcccctgag

SEQ ID NO: 5056447 - DNA, 21 bp, Homo sapiens
cctccgcggaggcccctgagg

SEQ ID NO: 5056448 - DNA, 20 bp, Homo sapiens
cctccgcgtgatcaaagcca

SEQ ID NO: 5056449 - DNA, 22 bp, Homo sapiens
cctccgctaaggcttccggctg

SEQ ID NO: 5056450 - DNA, 18 bp, Homo sapiens
cctccgctcccctttccc

SEQ ID NO: 5056451 - DNA, 15 bp, Homo sapiens
cctccggacatccag

SEQ ID NO: 5056452 - DNA, 15 bp, Homo sapiens
cctccggactggtgc

SEQ ID NO: 5056453 - DNA, 17 bp, Homo sapiens
cctccggagcctcatgt

SEQ ID NO: 5056454 - DNA, 20 bp, Homo sapiens
cctccggccaggtgcctcct

SEQ ID NO: 5056455 - DNA, 21 bp, Homo sapiens
cctccggccaggtgcctcctg

SEQ ID NO: 5056456 - DNA, 19 bp, Homo sapiens
cctccggccccgtctctct

SEQ ID NO: 5056457 - DNA, 20 bp, Homo sapiens
cctccggccctgccccacac

SEQ ID NO: 5056458 - DNA, 16 bp, Homo sapiens
cctccggcctccacat

SEQ ID NO: 5056459 - DNA, 15 bp, Homo sapiens
cctccggcctcccct

SEQ ID NO: 5056460 - DNA, 18 bp, Homo sapiens
cctccggcctgcactccc

SEQ ID NO: 5056461 - DNA, 20 bp, Homo sapiens
cctccggcgggtgacagctc

SEQ ID NO: 5056462 - DNA, 17 bp, Homo sapiens
cctccggcgtcagcctc

SEQ ID NO: 5056463 - DNA, 18 bp, Homo sapiens
cctccggcgtcagcctcc

SEQ ID NO: 5056464 - DNA, 23 bp, Homo sapiens
cctccggcgtcagcctccagcct

SEQ ID NO: 5056465 - DNA, 21 bp, Homo sapiens
cctccggcgtcttgcccagca

SEQ ID NO: 5056466 - DNA, 13 bp, Homo sapiens
cctccggctggac

SEQ ID NO: 5056467 - DNA, 15 bp, Homo sapiens
cctccggctggacct

SEQ ID NO: 5056468 - DNA, 15 bp, Homo sapiens
cctccgggaccccca

SEQ ID NO: 5056469 - DNA, 18 bp, Homo sapiens
cctccgggacccccagga

SEQ ID NO: 5056470 - DNA, 19 bp, Homo sapiens
cctccgggacccccaggac

SEQ ID NO: 5056471 - DNA, 17 bp, Homo sapiens
cctccgggactgacctt

SEQ ID NO: 5056472 - DNA, 21 bp, Homo sapiens
cctccgggcaggggagccagg

SEQ ID NO: 5056473 - DNA, 16 bp, Homo sapiens
cctccggggctcagcc

SEQ ID NO: 5056474 - DNA, 23 bp, Homo sapiens
cctccgtagggtctttcttggga

SEQ ID NO: 5056475 - DNA, 15 bp, Homo sapiens
cctccgtatttcaga

SEQ ID NO: 5056476 - DNA, 14 bp, Homo sapiens
cctccgtcaggaga

SEQ ID NO: 5056477 - DNA, 13 bp, Homo sapiens
cctccgtccaccc

SEQ ID NO: 5056478 - DNA, 16 bp, Homo sapiens
cctccgtccacccagg

SEQ ID NO: 5056479 - DNA, 17 bp, Homo sapiens
cctccgtccacccaggc

SEQ ID NO: 5056480 - DNA, 13 bp, Homo sapiens
cctccgtccccag

SEQ ID NO: 5056481 - DNA, 13 bp, Homo sapiens
cctccgtccctct

SEQ ID NO: 5056482 - DNA, 14 bp, Homo sapiens
cctccgtcctctcc

SEQ ID NO: 5056483 - DNA, 23 bp, Homo sapiens
cctccgtcctggcagggcaggca

SEQ ID NO: 5056484 - DNA, 20 bp, Homo sapiens
cctccgtcctgtcactgatg

SEQ ID NO: 5056485 - DNA, 17 bp, Homo sapiens
cctccgtcgggcccctg

SEQ ID NO: 5056486 - DNA, 20 bp, Homo sapiens
cctccgtctgaccctctgcg

SEQ ID NO: 5056487 - DNA, 13 bp, Homo sapiens
cctccgtcttccc

SEQ ID NO: 5056488 - DNA, 16 bp, Homo sapiens
cctccgtgatccatcc

SEQ ID NO: 5056489 - DNA, 14 bp, Homo sapiens
cctccgtggaacat

SEQ ID NO: 5056490 - DNA, 13 bp, Homo sapiens
cctccgtggcaca

SEQ ID NO: 5056491 - DNA, 14 bp, Homo sapiens
cctccgtggcacat

SEQ ID NO: 5056492 - DNA, 15 bp, Homo sapiens
cctccgttcccacct

SEQ ID NO: 5056493 - DNA, 16 bp, Homo sapiens
cctccgttgggcccca

SEQ ID NO: 5056494 - DNA, 12 bp, Homo sapiens
cctccgttgtct

SEQ ID NO: 5056495 - DNA, 17 bp, Homo sapiens
cctccgtttatgggcct

SEQ ID NO: 5056496 - DNA, 19 bp, Homo sapiens
cctccgtttatgggccttg

SEQ ID NO: 5056497 - DNA, 20 bp, Homo sapiens
cctccgtttatgggccttgc

SEQ ID NO: 5056498 - DNA, 22 bp, Homo sapiens
cctccgtttatgggccttgctt

SEQ ID NO: 5056499 - DNA, 13 bp, Homo sapiens
cctccgtttttct

SEQ ID NO: 5056500 - DNA, 15 bp, Homo sapiens
cctcctaaaaggccc

SEQ ID NO: 5056501 - DNA, 16 bp, Homo sapiens
cctcctaaaaggccca

SEQ ID NO: 5056502 - DNA, 15 bp, Homo sapiens
cctcctaagcagctg

SEQ ID NO: 5056503 - DNA, 18 bp, Homo sapiens
cctcctaagcagctggga

SEQ ID NO: 5056504 - DNA, 21 bp, Homo sapiens
cctcctaagcagctgggacta

SEQ ID NO: 5056505 - DNA, 22 bp, Homo sapiens
cctcctaaggctccccaccccg

SEQ ID NO: 5056506 - DNA, 19 bp, Homo sapiens
cctcctaagtcccttccta

SEQ ID NO: 5056507 - DNA, 23 bp, Homo sapiens
cctcctaatggcatggagactct

SEQ ID NO: 5056508 - DNA, 21 bp, Homo sapiens
cctcctacagcactccacctt

SEQ ID NO: 5056509 - DNA, 17 bp, Homo sapiens
cctcctacccctcccag

SEQ ID NO: 5056510 - DNA, 19 bp, Homo sapiens
cctcctacccctcccagct

SEQ ID NO: 5056511 - DNA, 19 bp, Homo sapiens
cctcctaccccttcctgtc

SEQ ID NO: 5056512 - DNA, 13 bp, Homo sapiens
cctcctaccctcc

SEQ ID NO: 5056513 - DNA, 14 bp, Homo sapiens
cctcctaccctccc

SEQ ID NO: 5056514 - DNA, 17 bp, Homo sapiens
cctcctaccctcccacc

SEQ ID NO: 5056515 - DNA, 23 bp, Homo sapiens
cctcctaccctcccaccagaacg

SEQ ID NO: 5056516 - DNA, 13 bp, Homo sapiens
cctcctacctcag

SEQ ID NO: 5056517 - DNA, 14 bp, Homo sapiens
cctcctacctgggg

SEQ ID NO: 5056518 - DNA, 22 bp, Homo sapiens
cctcctacctggggactcctca

SEQ ID NO: 5056519 - DNA, 14 bp, Homo sapiens
cctcctagacccag

SEQ ID NO: 5056520 - DNA, 21 bp, Homo sapiens
cctcctagaggtgggcagctg

SEQ ID NO: 5056521 - DNA, 22 bp, Homo sapiens
cctcctagcacaaggagtgccc

SEQ ID NO: 5056522 - DNA, 18 bp, Homo sapiens
cctcctagcctgctctgc

SEQ ID NO: 5056523 - DNA, 16 bp, Homo sapiens
cctcctagctctccca

SEQ ID NO: 5056524 - DNA, 19 bp, Homo sapiens
cctcctagctctcccagtg

SEQ ID NO: 5056525 - DNA, 13 bp, Homo sapiens
cctcctagctgga

SEQ ID NO: 5056526 - DNA, 15 bp, Homo sapiens
cctcctagctggagt

SEQ ID NO: 5056527 - DNA, 13 bp, Homo sapiens
cctcctaggctcc

SEQ ID NO: 5056528 - DNA, 14 bp, Homo sapiens
cctcctaggctccc

SEQ ID NO: 5056529 - DNA, 16 bp, Homo sapiens
cctcctaggctccctg

SEQ ID NO: 5056530 - DNA, 22 bp, Homo sapiens
cctcctaggctccctgaggtac

SEQ ID NO: 5056531 - DNA, 14 bp, Homo sapiens
cctcctaggctgga

SEQ ID NO: 5056532 - DNA, 22 bp, Homo sapiens
cctcctagggcttatcatcagc

SEQ ID NO: 5056533 - DNA, 13 bp, Homo sapiens
cctcctaggggaa

SEQ ID NO: 5056534 - DNA, 19 bp, Homo sapiens
cctcctaggggaagggggt

SEQ ID NO: 5056535 - DNA, 13 bp, Homo sapiens
cctcctagggggt

SEQ ID NO: 5056536 - DNA, 19 bp, Homo sapiens
cctcctatatcattattta

SEQ ID NO: 5056537 - DNA, 18 bp, Homo sapiens
cctcctatcacctcccct

SEQ ID NO: 5056538 - DNA, 19 bp, Homo sapiens
cctcctcacccacctctgg

SEQ ID NO: 5056539 - DNA, 13 bp, Homo sapiens
cctcctcaccccc

SEQ ID NO: 5056540 - DNA, 13 bp, Homo sapiens
cctcctcacctca

SEQ ID NO: 5056541 - DNA, 14 bp, Homo sapiens
cctcctcacctcat

SEQ ID NO: 5056542 - DNA, 19 bp, Homo sapiens
cctcctcacctcatgccca

SEQ ID NO: 5056543 - DNA, 22 bp, Homo sapiens
cctcctcacctctggactggct

SEQ ID NO: 5056544 - DNA, 20 bp, Homo sapiens
cctcctcactccctaggccc

SEQ ID NO: 5056545 - DNA, 14 bp, Homo sapiens
cctcctcactggcc

SEQ ID NO: 5056546 - DNA, 15 bp, Homo sapiens
cctcctcactggcca

SEQ ID NO: 5056547 - DNA, 20 bp, Homo sapiens
cctcctcagcacggtgcctc

SEQ ID NO: 5056548 - DNA, 17 bp, Homo sapiens
cgcaggaaccgaggact

SEQ ID NO: 5056549 - DNA, 24 bp, Homo sapiens
cgcaggaagacccaacacatggga

SEQ ID NO: 5056550 - DNA, 22 bp, Homo sapiens
cgcaggaccagtttgattgagg

SEQ ID NO: 5056551 - DNA, 13 bp, Homo sapiens
cgcaggagggagg

SEQ ID NO: 5056552 - DNA, 18 bp, Homo sapiens
cgcaggagggaggcgggg

SEQ ID NO: 5056553 - DNA, 23 bp, Homo sapiens
cgcaggagtctctgccacccact

SEQ ID NO: 5056554 - DNA, 17 bp, Homo sapiens
cgcaggatccctcctga

SEQ ID NO: 5056555 - DNA, 21 bp, Homo sapiens
cgcaggatccctcctgagctc

SEQ ID NO: 5056556 - DNA, 15 bp, Homo sapiens
cgcaggatccgctgc

SEQ ID NO: 5056557 - DNA, 17 bp, Homo sapiens
cgcaggatccgctgcca

SEQ ID NO: 5056558 - DNA, 19 bp, Homo sapiens
cgcaggatccgctgccacc

SEQ ID NO: 5056559 - DNA, 18 bp, Homo sapiens
cgcaggcacagcagctgc

SEQ ID NO: 5056560 - DNA, 19 bp, Homo sapiens
cgcaggcacagcagctgca

SEQ ID NO: 5056561 - DNA, 16 bp, Homo sapiens
cgcaggcagcgcaggg

SEQ ID NO: 5056562 - DNA, 17 bp, Homo sapiens
cgcaggcagggagaagg

SEQ ID NO: 5056563 - DNA, 14 bp, Homo sapiens
cgcaggcccagtga

SEQ ID NO: 5056564 - DNA, 18 bp, Homo sapiens
cgcaggcccccaggtgcc

SEQ ID NO: 5056565 - DNA, 14 bp, Homo sapiens
cgcaggcccctctc

SEQ ID NO: 5056566 - DNA, 11 bp, Homo sapiens
cgcaggccctc

SEQ ID NO: 5056567 - DNA, 16 bp, Homo sapiens
cgcaggccctggtgga

SEQ ID NO: 5056568 - DNA, 13 bp, Homo sapiens
cgcaggccctgtc

SEQ ID NO: 5056569 - DNA, 15 bp, Homo sapiens
cgcaggccctgtcca

SEQ ID NO: 5056570 - DNA, 16 bp, Homo sapiens
cgcaggccctgtccag

SEQ ID NO: 5056571 - DNA, 16 bp, Homo sapiens
cgcaggcctccctgcc

SEQ ID NO: 5056572 - DNA, 19 bp, Homo sapiens
cgcaggcgaccgggcctcc

SEQ ID NO: 5056573 - DNA, 15 bp, Homo sapiens
cgcaggcggccaggg

SEQ ID NO: 5056574 - DNA, 14 bp, Homo sapiens
cgcaggctgcagag

SEQ ID NO: 5056575 - DNA, 13 bp, Homo sapiens
cgcaggctggccc

SEQ ID NO: 5056576 - DNA, 19 bp, Homo sapiens
cgcaggctggccctgccct

SEQ ID NO: 5056577 - DNA, 16 bp, Homo sapiens
cgcagggacatggggc

SEQ ID NO: 5056578 - DNA, 17 bp, Homo sapiens
cgcagggacatggggca

SEQ ID NO: 5056579 - DNA, 21 bp, Homo sapiens
cgcagggacatggggcaagcc

SEQ ID NO: 5056580 - DNA, 23 bp, Homo sapiens
cgcagggacatggggcaagccag

SEQ ID NO: 5056581 - DNA, 15 bp, Homo sapiens
cgcagggagaccctg

SEQ ID NO: 5056582 - DNA, 17 bp, Homo sapiens
cgcagggagaccctggg

SEQ ID NO: 5056583 - DNA, 16 bp, Homo sapiens
cgcagggaggatgcca

SEQ ID NO: 5056584 - DNA, 17 bp, Homo sapiens
cgcagggaggatgccac

SEQ ID NO: 5056585 - DNA, 23 bp, Homo sapiens
cgcagggcccaccttggaccctg

SEQ ID NO: 5056586 - DNA, 18 bp, Homo sapiens
cctcctcccatgtcactg

SEQ ID NO: 5056587 - DNA, 15 bp, Homo sapiens
cctcctccccagagc

SEQ ID NO: 5056588 - DNA, 15 bp, Homo sapiens
cctcctccccagctc

SEQ ID NO: 5056589 - DNA, 17 bp, Homo sapiens
cctcctccccaggtgga

SEQ ID NO: 5056590 - DNA, 16 bp, Homo sapiens
cctcctcccccacccc

SEQ ID NO: 5056591 - DNA, 18 bp, Homo sapiens
cctcctcccccacccctt

SEQ ID NO: 5056592 - DNA, 19 bp, Homo sapiens
cctcctcccccacgcctcc

SEQ ID NO: 5056593 - DNA, 16 bp, Homo sapiens
cctcctccccctgttc

SEQ ID NO: 5056594 - DNA, 21 bp, Homo sapiens
cctcctccccctttggggtag

SEQ ID NO: 5056595 - DNA, 15 bp, Homo sapiens
cctcctcccctggca

SEQ ID NO: 5056596 - DNA, 21 bp, Homo sapiens
cctcctcccctggcaactgct

SEQ ID NO: 5056597 - DNA, 16 bp, Homo sapiens
cctcctccccttcctg

SEQ ID NO: 5056598 - DNA, 19 bp, Homo sapiens
cctcctccccttcctgcac

SEQ ID NO: 5056599 - DNA, 13 bp, Homo sapiens
cctcctcccgact

SEQ ID NO: 5056600 - DNA, 12 bp, Homo sapiens
cctcctccctca

SEQ ID NO: 5056601 - DNA, 13 bp, Homo sapiens
cctcctccctcaa

SEQ ID NO: 5056602 - DNA, 14 bp, Homo sapiens
cctcctccctcaaa

SEQ ID NO: 5056603 - DNA, 14 bp, Homo sapiens
cctcctccctcaga

SEQ ID NO: 5056604 - DNA, 17 bp, Homo sapiens
cctcctccctcagactc

SEQ ID NO: 5056605 - DNA, 15 bp, Homo sapiens
cctcctccctcaggc

SEQ ID NO: 5056606 - DNA, 23 bp, Homo sapiens
cctcctccctcaggcccaggagt

SEQ ID NO: 5056607 - DNA, 13 bp, Homo sapiens
cctcctccctcca

SEQ ID NO: 5056608 - DNA, 20 bp, Homo sapiens
cctcctccctccaagcctgg

SEQ ID NO: 5056609 - DNA, 16 bp, Homo sapiens
cctcctccctcccagc

SEQ ID NO: 5056610 - DNA, 17 bp, Homo sapiens
cctcctccctcccagct

SEQ ID NO: 5056611 - DNA, 14 bp, Homo sapiens
cctcctccctccct

SEQ ID NO: 5056612 - DNA, 18 bp, Homo sapiens
cctcctccctcctgccga

SEQ ID NO: 5056613 - DNA, 15 bp, Homo sapiens
cctcctccctgcctg

SEQ ID NO: 5056614 - DNA, 14 bp, Homo sapiens
cctcctcctccctc

SEQ ID NO: 5056615 - DNA, 15 bp, Homo sapiens
cctcctcctccctcc

SEQ ID NO: 5056616 - DNA, 21 bp, Homo sapiens
cctcctcctgagagctgttcc

SEQ ID NO: 5056617 - DNA, 13 bp, Homo sapiens
cctcctcctgctg

SEQ ID NO: 5056618 - DNA, 16 bp, Homo sapiens
cctcctcctgctgctc

SEQ ID NO: 5056619 - DNA, 15 bp, Homo sapiens
cctcctcctgttcct

SEQ ID NO: 5056620 - DNA, 21 bp, Homo sapiens
cctcctccttcccaaaggact

SEQ ID NO: 5056621 - DNA, 12 bp, Homo sapiens
cctcctcctttc

SEQ ID NO: 5056622 - DNA, 15 bp, Homo sapiens
cctcctcctttgcct

SEQ ID NO: 5056623 - DNA, 13 bp, Homo sapiens
cctcctccttttt

SEQ ID NO: 5056624 - DNA, 22 bp, Homo sapiens
cctcctcgaagtcccggcttcc

SEQ ID NO: 5056625 - DNA, 13 bp, Homo sapiens
cctcctcgctcct

SEQ ID NO: 5056626 - DNA, 19 bp, Homo sapiens
cctcctcgctgtgccacca

SEQ ID NO: 5056627 - DNA, 20 bp, Homo sapiens
cctcctcggagagcagcagc

SEQ ID NO: 5056628 - DNA, 16 bp, Homo sapiens
cctcctcgggcacaga

SEQ ID NO: 5056629 - DNA, 14 bp, Homo sapiens
cctcctcgggccga

SEQ ID NO: 5056630 - DNA, 17 bp, Homo sapiens
cctcctcgggcgcctgc

SEQ ID NO: 5056631 - DNA, 13 bp, Homo sapiens
cctcctcgtcagt

SEQ ID NO: 5056632 - DNA, 18 bp, Homo sapiens
cctcctcgttcctttctc

SEQ ID NO: 5056633 - DNA, 21 bp, Homo sapiens
cctcctctaacaggggctggt

SEQ ID NO: 5056634 - DNA, 19 bp, Homo sapiens
cctcctctaaggttgggca

SEQ ID NO: 5056635 - DNA, 16 bp, Homo sapiens
cctcctctacctctct

SEQ ID NO: 5056636 - DNA, 15 bp, Homo sapiens
cctcctctagctctg

SEQ ID NO: 5056637 - DNA, 19 bp, Homo sapiens
cctcctctcaaacctggca

SEQ ID NO: 5056638 - DNA, 12 bp, Homo sapiens
cctcctctccat

SEQ ID NO: 5056639 - DNA, 13 bp, Homo sapiens
cctcctctcccat

SEQ ID NO: 5056640 - DNA, 14 bp, Homo sapiens
cctcctctcccatc

SEQ ID NO: 5056641 - DNA, 15 bp, Homo sapiens
cctcctctcccgcag

SEQ ID NO: 5056642 - DNA, 23 bp, Homo sapiens
cctcctctcctcgtccggcctgc

SEQ ID NO: 5056643 - DNA, 12 bp, Homo sapiens
cctcctctcctg

SEQ ID NO: 5056644 - DNA, 16 bp, Homo sapiens
cctcctctctccctgc

SEQ ID NO: 5056645 - DNA, 17 bp, Homo sapiens
cctcctctctccctgcc

SEQ ID NO: 5056646 - DNA, 19 bp, Homo sapiens
cctcctctctccctgcctc

SEQ ID NO: 5056647 - DNA, 13 bp, Homo sapiens
cctcctctctgct

SEQ ID NO: 5056648 - DNA, 10 bp, Homo sapiens
cctcctctga

SEQ ID NO: 5056649 - DNA, 13 bp, Homo sapiens
cctcctctgaaac

SEQ ID NO: 5056650 - DNA, 17 bp, Homo sapiens
cctcctctgaaacagct

SEQ ID NO: 5056651 - DNA, 21 bp, Homo sapiens
cctcctctgaaacagctgcct

SEQ ID NO: 5056652 - DNA, 23 bp, Homo sapiens
cctcctctgaaacagctgcctta

SEQ ID NO: 5056653 - DNA, 11 bp, Homo sapiens
cctcctctgcc

SEQ ID NO: 5056654 - DNA, 12 bp, Homo sapiens
cctcctctgcca

SEQ ID NO: 5056655 - DNA, 14 bp, Homo sapiens
cctcctctgccacc

SEQ ID NO: 5056656 - DNA, 21 bp, Homo sapiens
cctcctctgccacctccccta

SEQ ID NO: 5056657 - DNA, 16 bp, Homo sapiens
cctcctctgccagcag

SEQ ID NO: 5056658 - DNA, 12 bp, Homo sapiens
cctcctctgccc

SEQ ID NO: 5056659 - DNA, 17 bp, Homo sapiens
cctcctctgcctacagc

SEQ ID NO: 5056660 - DNA, 13 bp, Homo sapiens
cctcctctgcttg

SEQ ID NO: 5056661 - DNA, 20 bp, Homo sapiens
cctcctctggacggcaggct

SEQ ID NO: 5056662 - DNA, 22 bp, Homo sapiens
cctcctctggacggcaggctca

SEQ ID NO: 5056663 - DNA, 19 bp, Homo sapiens
cctcctctggcccagccta

SEQ ID NO: 5056664 - DNA, 13 bp, Homo sapiens
cctcctctgggcc

SEQ ID NO: 5056665 - DNA, 12 bp, Homo sapiens
cctcctctgtcc

SEQ ID NO: 5056666 - DNA, 18 bp, Homo sapiens
cctcctctgtccagggcc

SEQ ID NO: 5056667 - DNA, 13 bp, Homo sapiens
cctcctctgtctg

SEQ ID NO: 5056668 - DNA, 17 bp, Homo sapiens
cctcctctgtctgccct

SEQ ID NO: 5056669 - DNA, 15 bp, Homo sapiens
cctcctctgtgaaac

SEQ ID NO: 5056670 - DNA, 22 bp, Homo sapiens
cctcctctgtgaccaatgtctt

SEQ ID NO: 5056671 - DNA, 12 bp, Homo sapiens
cctcctctgtgc

SEQ ID NO: 5056672 - DNA, 14 bp, Homo sapiens
cctcctctgtgctc

SEQ ID NO: 5056673 - DNA, 19 bp, Homo sapiens
cctcctcttcaccccggca

SEQ ID NO: 5056674 - DNA, 20 bp, Homo sapiens
cctcctcttcaccccggcag

SEQ ID NO: 5056675 - DNA, 22 bp, Homo sapiens
cctcctcttcccttagcctctc

SEQ ID NO: 5056676 - DNA, 17 bp, Homo sapiens
cctcctcttctgacgtg

SEQ ID NO: 5056677 - DNA, 12 bp, Homo sapiens
cctcctctttct

SEQ ID NO: 5056678 - DNA, 15 bp, Homo sapiens
cctcctctttctctc

SEQ ID NO: 5056679 - DNA, 16 bp, Homo sapiens
cctcctgaagcctctg

SEQ ID NO: 5056680 - DNA, 14 bp, Homo sapiens
cctcctgaaggagg

SEQ ID NO: 5056681 - DNA, 23 bp, Homo sapiens
cctcctgacaacgtctcttcaag

SEQ ID NO: 5056682 - DNA, 19 bp, Homo sapiens
cctcctgacacacctgcag

SEQ ID NO: 5056683 - DNA, 20 bp, Homo sapiens
cctcctgacacacctgcagc

SEQ ID NO: 5056684 - DNA, 15 bp, Homo sapiens
cctcctgacacccca

SEQ ID NO: 5056685 - DNA, 18 bp, Homo sapiens
cctcctgacacccttctc

SEQ ID NO: 5056686 - DNA, 17 bp, Homo sapiens
cctcctgacccccatgt

SEQ ID NO: 5056687 - DNA, 20 bp, Homo sapiens
cctcctgaccctgtgatgcc

SEQ ID NO: 5056688 - DNA, 16 bp, Homo sapiens
cctcctgactcatccg

SEQ ID NO: 5056689 - DNA, 15 bp, Homo sapiens
cctcctgagagctgt

SEQ ID NO: 5056690 - DNA, 13 bp, Homo sapiens
cctcctgagcctc

SEQ ID NO: 5056691 - DNA, 17 bp, Homo sapiens
cctcctgagcctcacct

SEQ ID NO: 5056692 - DNA, 17 bp, Homo sapiens
cctcctgagcctgtggg

SEQ ID NO: 5056693 - DNA, 14 bp, Homo sapiens
cctcctgagggctc

SEQ ID NO: 5056694 - DNA, 24 bp, Homo sapiens
cctcctgaggggtatcctcctaaa

SEQ ID NO: 5056695 - DNA, 20 bp, Homo sapiens
cctcctgagtagctgagact

SEQ ID NO: 5056696 - DNA, 17 bp, Homo sapiens
cctcctgagtagctggg

SEQ ID NO: 5056697 - DNA, 19 bp, Homo sapiens
cctcctgagtagctgggat

SEQ ID NO: 5056698 - DNA, 18 bp, Homo sapiens
cctcctgatggccaagag

SEQ ID NO: 5056699 - DNA, 19 bp, Homo sapiens
cctcctgatgtttgtatca

SEQ ID NO: 5056700 - DNA, 16 bp, Homo sapiens
cctcctgatgtttttc

SEQ ID NO: 5056701 - DNA, 24 bp, Homo sapiens
cctcctgattaaggcgtggcttct

SEQ ID NO: 5056702 - DNA, 19 bp, Homo sapiens
cctcctgcacacagggcag

SEQ ID NO: 5056703 - DNA, 19 bp, Homo sapiens
cctcctgcagacacctgga

SEQ ID NO: 5056704 - DNA, 21 bp, Homo sapiens
cctcctgcagacacctggact

SEQ ID NO: 5056705 - DNA, 22 bp, Homo sapiens
cctcctgcagacacctggactg

SEQ ID NO: 5056706 - DNA, 19 bp, Homo sapiens
cctcctgcagaccacgccc

SEQ ID NO: 5056707 - DNA, 16 bp, Homo sapiens
cctcctgcaggctggc

SEQ ID NO: 5056708 - DNA, 21 bp, Homo sapiens
cctcctgcaggctggctgttg

SEQ ID NO: 5056709 - DNA, 15 bp, Homo sapiens
cctcctgcagtttgg

SEQ ID NO: 5056710 - DNA, 12 bp, Homo sapiens
cctcctgccaaa

SEQ ID NO: 5056711 - DNA, 12 bp, Homo sapiens
cctcctgccacc

SEQ ID NO: 5056712 - DNA, 12 bp, Homo sapiens
cctcctgccagc

SEQ ID NO: 5056713 - DNA, 13 bp, Homo sapiens
cctcctgccagct

SEQ ID NO: 5056714 - DNA, 20 bp, Homo sapiens
cctcctgccagctctgtcac

SEQ ID NO: 5056715 - DNA, 12 bp, Homo sapiens
cctcctgcccac

SEQ ID NO: 5056716 - DNA, 14 bp, Homo sapiens
cctcctgcccacct

SEQ ID NO: 5056717 - DNA, 21 bp, Homo sapiens
cctcctgcccacgcagacctg

SEQ ID NO: 5056718 - DNA, 19 bp, Homo sapiens
cctcctgcccagctcctca

SEQ ID NO: 5056719 - DNA, 13 bp, Homo sapiens
cctcctgcccagg

SEQ ID NO: 5056720 - DNA, 14 bp, Homo sapiens
cctcctgcccagga

SEQ ID NO: 5056721 - DNA, 17 bp, Homo sapiens
cctcctgcccagtcccc

SEQ ID NO: 5056722 - DNA, 16 bp, Homo sapiens
cctcctgccccacact

SEQ ID NO: 5056723 - DNA, 14 bp, Homo sapiens
cctcctgcccccac

SEQ ID NO: 5056724 - DNA, 17 bp, Homo sapiens
cctcctgcccccacccc

SEQ ID NO: 5056725 - DNA, 21 bp, Homo sapiens
cctcctgcccccaccccaggc

SEQ ID NO: 5056726 - DNA, 16 bp, Homo sapiens
cctcctgccccctgcc

SEQ ID NO: 5056727 - DNA, 18 bp, Homo sapiens
cctcctgccccctgccag

SEQ ID NO: 5056728 - DNA, 12 bp, Homo sapiens
cctcctgccctc

SEQ ID NO: 5056729 - DNA, 13 bp, Homo sapiens
cctcctgccctcc

SEQ ID NO: 5056730 - DNA, 14 bp, Homo sapiens
cctcctgccctccg

SEQ ID NO: 5056731 - DNA, 14 bp, Homo sapiens
cctcctgccctcct

SEQ ID NO: 5056732 - DNA, 17 bp, Homo sapiens
cctcctgccctgtccct

SEQ ID NO: 5056733 - DNA, 20 bp, Homo sapiens
cgcccccacaccccatctct

SEQ ID NO: 5056734 - DNA, 19 bp, Homo sapiens
cgcccccaccctgagcgcc

SEQ ID NO: 5056735 - DNA, 16 bp, Homo sapiens
cgcccccaccgggctg

SEQ ID NO: 5056736 - DNA, 14 bp, Homo sapiens
cgcccccacctcca

SEQ ID NO: 5056737 - DNA, 22 bp, Homo sapiens
cgcccccaggcctgccctgcta

SEQ ID NO: 5056738 - DNA, 18 bp, Homo sapiens
cgcccccagtccccaccc

SEQ ID NO: 5056739 - DNA, 22 bp, Homo sapiens
cgcccccagtccccacccctgc

SEQ ID NO: 5056740 - DNA, 13 bp, Homo sapiens
cgcccccagtgtg

SEQ ID NO: 5056741 - DNA, 18 bp, Homo sapiens
cgcccccatgctctctgt

SEQ ID NO: 5056742 - DNA, 20 bp, Homo sapiens
cgccccccacacttccctgg

SEQ ID NO: 5056743 - DNA, 21 bp, Homo sapiens
cgccccccacacttccctggc

SEQ ID NO: 5056744 - DNA, 13 bp, Homo sapiens
cgccccccacctt

SEQ ID NO: 5056745 - DNA, 19 bp, Homo sapiens
cgccccccagagccagggc

SEQ ID NO: 5056746 - DNA, 15 bp, Homo sapiens
cgccccccagtggac

SEQ ID NO: 5056747 - DNA, 18 bp, Homo sapiens
cgccccccggcctggccc

SEQ ID NO: 5056748 - DNA, 22 bp, Homo sapiens
cgcccccctacccccttgtctg

SEQ ID NO: 5056749 - DNA, 14 bp, Homo sapiens
cgcccccgagccct

SEQ ID NO: 5056750 - DNA, 19 bp, Homo sapiens
cgcccccgagccctgactc

SEQ ID NO: 5056751 - DNA, 16 bp, Homo sapiens
cgcccccgccccaggc

SEQ ID NO: 5056752 - DNA, 18 bp, Homo sapiens
cgcccccgccctcgctcc

SEQ ID NO: 5056753 - DNA, 23 bp, Homo sapiens
cgcccccgggtttggcgggccaa

SEQ ID NO: 5056754 - DNA, 14 bp, Homo sapiens
cgccccctccctgc

SEQ ID NO: 5056755 - DNA, 19 bp, Homo sapiens
cgccccctccgccctgcca

SEQ ID NO: 5056756 - DNA, 12 bp, Homo sapiens
cgccccctggtg

SEQ ID NO: 5056757 - DNA, 19 bp, Homo sapiens
cgccccgcacgactgcggg

SEQ ID NO: 5056758 - DNA, 14 bp, Homo sapiens
cgccccgcccacac

SEQ ID NO: 5056759 - DNA, 19 bp, Homo sapiens
cgccccgcccacaccctcg

SEQ ID NO: 5056760 - DNA, 13 bp, Homo sapiens
cgccccgccccac

SEQ ID NO: 5056761 - DNA, 14 bp, Homo sapiens
cgccccgccccaga

SEQ ID NO: 5056762 - DNA, 15 bp, Homo sapiens
cgccccgccccagag

SEQ ID NO: 5056763 - DNA, 15 bp, Homo sapiens
cgccccgctgctccc

SEQ ID NO: 5056764 - DNA, 19 bp, Homo sapiens
cgccccgctgtgtcctccc

SEQ ID NO: 5056765 - DNA, 23 bp, Homo sapiens
cgccccgctgtgtcctccctccc

SEQ ID NO: 5056766 - DNA, 16 bp, Homo sapiens
cgccccggacagggtg

SEQ ID NO: 5056767 - DNA, 14 bp, Homo sapiens
acataattgtgacc

SEQ ID NO: 5056768 - DNA, 22 bp, Homo sapiens
acataatttaaaataaataaac

SEQ ID NO: 5056769 - DNA, 13 bp, Homo sapiens
acattgtaaagta

SEQ ID NO: 5056770 - DNA, 17 bp, Homo sapiens
acattgtaaagtatgtg

SEQ ID NO: 5056771 - DNA, 19 bp, Homo sapiens
acattgtaaataaattttg

SEQ ID NO: 5056772 - DNA, 17 bp, Homo sapiens
acattgtaaatagtatt

SEQ ID NO: 5056773 - DNA, 22 bp, Homo sapiens
acattgtaatctgctttgttaa

SEQ ID NO: 5056774 - DNA, 13 bp, Homo sapiens
acattgtactgtt

SEQ ID NO: 5056775 - DNA, 18 bp, Homo sapiens
acattgtcagaatgttgt

SEQ ID NO: 5056776 - DNA, 15 bp, Homo sapiens
acattgtcatttata

SEQ ID NO: 5056777 - DNA, 17 bp, Homo sapiens
acattgtcatttatata

SEQ ID NO: 5056778 - DNA, 24 bp, Homo sapiens
acattgtccccaatgaatatactc

SEQ ID NO: 5056779 - DNA, 19 bp, Homo sapiens
acattgtctcctatatatt

SEQ ID NO: 5056780 - DNA, 12 bp, Homo sapiens
acattgtctgcg

SEQ ID NO: 5056781 - DNA, 16 bp, Homo sapiens
acattgtcttgatgtt

SEQ ID NO: 5056782 - DNA, 11 bp, Homo sapiens
acattgtgaat

SEQ ID NO: 5056783 - DNA, 12 bp, Homo sapiens
acattgtgaatg

SEQ ID NO: 5056784 - DNA, 17 bp, Homo sapiens
acattgtgacaaacagc

SEQ ID NO: 5056785 - DNA, 19 bp, Homo sapiens
acattgtgactgtgtttgc

SEQ ID NO: 5056786 - DNA, 21 bp, Homo sapiens
acattgtgactttgctttgag

SEQ ID NO: 5056787 - DNA, 18 bp, Homo sapiens
acattgtgatgattatta

SEQ ID NO: 5056788 - DNA, 22 bp, Homo sapiens
acattgtgatgtatattccttt

SEQ ID NO: 5056789 - DNA, 13 bp, Homo sapiens
acattgtgattat

SEQ ID NO: 5056790 - DNA, 18 bp, Homo sapiens
acattgtgcccttgattt

SEQ ID NO: 5056791 - DNA, 19 bp, Homo sapiens
acattgtgtcctgcttata

SEQ ID NO: 5056792 - DNA, 12 bp, Homo sapiens
acattgtgtcta

SEQ ID NO: 5056793 - DNA, 22 bp, Homo sapiens
acattgtgtgaaaaaagaaaat

SEQ ID NO: 5056794 - DNA, 23 bp, Homo sapiens
acattgtgtgaaaaaagaaaatg

SEQ ID NO: 5056795 - DNA, 17 bp, Homo sapiens
acattgttaagaaaaat

SEQ ID NO: 5056796 - DNA, 18 bp, Homo sapiens
acattgttattcttaagc

SEQ ID NO: 5056797 - DNA, 20 bp, Homo sapiens
acattgttcaactcccttct

SEQ ID NO: 5056798 - DNA, 21 bp, Homo sapiens
acattgttcaactcccttctc

SEQ ID NO: 5056799 - DNA, 13 bp, Homo sapiens
acattgttcaggt

SEQ ID NO: 5056800 - DNA, 17 bp, Homo sapiens
acattgttcttattctg

SEQ ID NO: 5056801 - DNA, 14 bp, Homo sapiens
acattgttgagcta

SEQ ID NO: 5056802 - DNA, 17 bp, Homo sapiens
acattgttgagctattg

SEQ ID NO: 5056803 - DNA, 17 bp, Homo sapiens
acattgtttgctgctat

SEQ ID NO: 5056804 - DNA, 13 bp, Homo sapiens
acattgttttaaa

SEQ ID NO: 5056805 - DNA, 12 bp, Homo sapiens
acattgttttgc

SEQ ID NO: 5056806 - DNA, 16 bp, Homo sapiens
acatttaaaaaacatt

SEQ ID NO: 5056807 - DNA, 14 bp, Homo sapiens
acatttaaaacatt

SEQ ID NO: 5056808 - DNA, 22 bp, Homo sapiens
acatttaaaacattaaaatata

SEQ ID NO: 5056809 - DNA, 15 bp, Homo sapiens
acatttaaaagacag

SEQ ID NO: 5056810 - DNA, 23 bp, Homo sapiens
acatttaaaagacagacattcct

SEQ ID NO: 5056811 - DNA, 17 bp, Homo sapiens
acatttaaaatagtttt

SEQ ID NO: 5056812 - DNA, 19 bp, Homo sapiens
acatttaaaatagttttct

SEQ ID NO: 5056813 - DNA, 20 bp, Homo sapiens
acatttaaaatagttttcta

SEQ ID NO: 5056814 - DNA, 14 bp, Homo sapiens
acatttaaaattaa

SEQ ID NO: 5056815 - DNA, 15 bp, Homo sapiens
acatttaaaattaaa

SEQ ID NO: 5056816 - DNA, 14 bp, Homo sapiens
acatttaaaccttt

SEQ ID NO: 5056817 - DNA, 13 bp, Homo sapiens
acatttaaagcat

SEQ ID NO: 5056818 - DNA, 14 bp, Homo sapiens
acatttaaagcatt

SEQ ID NO: 5056819 - DNA, 19 bp, Homo sapiens
acatttaaagcattgctgt

SEQ ID NO: 5056820 - DNA, 20 bp, Homo sapiens
acatttaaagcattgctgtt

SEQ ID NO: 5056821 - DNA, 15 bp, Homo sapiens
acatttaaatccttg

SEQ ID NO: 5056822 - DNA, 16 bp, Homo sapiens
acatttaaatccttgt

SEQ ID NO: 5056823 - DNA, 12 bp, Homo sapiens
acatttaaatgt

SEQ ID NO: 5056824 - DNA, 17 bp, Homo sapiens
acatttaaatgtaactt

SEQ ID NO: 5056825 - DNA, 11 bp, Homo sapiens
acatttaacat

SEQ ID NO: 5056826 - DNA, 14 bp, Homo sapiens
acatttaacataat

SEQ ID NO: 5056827 - DNA, 13 bp, Homo sapiens
acatttaactagc

SEQ ID NO: 5056828 - DNA, 21 bp, Homo sapiens
acatttaaggatggggttatg

SEQ ID NO: 5056829 - DNA, 13 bp, Homo sapiens
acatttaataaaa

SEQ ID NO: 5056830 - DNA, 23 bp, Homo sapiens
acatttaataatgtatgtacagc

SEQ ID NO: 5056831 - DNA, 13 bp, Homo sapiens
acatttaatacag

SEQ ID NO: 5056832 - DNA, 16 bp, Homo sapiens
acatttaatacagata

SEQ ID NO: 5056833 - DNA, 20 bp, Homo sapiens
acatttaatgaacacaattt

SEQ ID NO: 5056834 - DNA, 12 bp, Homo sapiens
acatttaattta

SEQ ID NO: 5056835 - DNA, 15 bp, Homo sapiens
acatttaatttagat

SEQ ID NO: 5056836 - DNA, 23 bp, Homo sapiens
acatttaatttagatattttcca

SEQ ID NO: 5056837 - DNA, 21 bp, Homo sapiens
acatttacaaactgaagagta

SEQ ID NO: 5056838 - DNA, 18 bp, Homo sapiens
acatttacaccacacttt

SEQ ID NO: 5056839 - DNA, 22 bp, Homo sapiens
acatttacaccacactttcaaa

SEQ ID NO: 5056840 - DNA, 14 bp, Homo sapiens
acatttacaggagg

SEQ ID NO: 5056841 - DNA, 15 bp, Homo sapiens
acatttacaggaggg

SEQ ID NO: 5056842 - DNA, 12 bp, Homo sapiens
acatttacagtc

SEQ ID NO: 5056843 - DNA, 21 bp, Homo sapiens
acatttacatgtattatttca

SEQ ID NO: 5056844 - DNA, 13 bp, Homo sapiens
acatttacatgtt

SEQ ID NO: 5056845 - DNA, 19 bp, Homo sapiens
acatttactagctgtgcaa

SEQ ID NO: 5056846 - DNA, 14 bp, Homo sapiens
acatttactgaaat

SEQ ID NO: 5056847 - DNA, 22 bp, Homo sapiens
acatttagaaaagtgaattgaa

SEQ ID NO: 5056848 - DNA, 20 bp, Homo sapiens
acatttagaacctgcattta

SEQ ID NO: 5056849 - DNA, 21 bp, Homo sapiens
acatttagaacctgcatttaa

SEQ ID NO: 5056850 - DNA, 15 bp, Homo sapiens
acatttagaagaaag

SEQ ID NO: 5056851 - DNA, 16 bp, Homo sapiens
acatttagaagaaaga

SEQ ID NO: 5056852 - DNA, 18 bp, Homo sapiens
acatttagaagaaagatg

SEQ ID NO: 5056853 - DNA, 23 bp, Homo sapiens
acatttagaatttgaaaggaaaa

SEQ ID NO: 5056854 - DNA, 21 bp, Homo sapiens
acatttagagaactgtggccg

SEQ ID NO: 5056855 - DNA, 16 bp, Homo sapiens
acatttagagtattta

SEQ ID NO: 5056856 - DNA, 14 bp, Homo sapiens
acatttagatttag

SEQ ID NO: 5056857 - DNA, 14 bp, Homo sapiens
acatttaggagaag

SEQ ID NO: 5056858 - DNA, 17 bp, Homo sapiens
acatttaggagaagttg

SEQ ID NO: 5056859 - DNA, 17 bp, Homo sapiens
acatttagtaccctgca

SEQ ID NO: 5056860 - DNA, 20 bp, Homo sapiens
acatttagtccaatgaagat

SEQ ID NO: 5056861 - DNA, 21 bp, Homo sapiens
acatttagtccaatgaagata

SEQ ID NO: 5056862 - DNA, 23 bp, Homo sapiens
acatttagttaacacacatatat

SEQ ID NO: 5056863 - DNA, 14 bp, Homo sapiens
acatttatacatca

SEQ ID NO: 5056864 - DNA, 18 bp, Homo sapiens
acatttatatatatatgt

SEQ ID NO: 5056865 - DNA, 17 bp, Homo sapiens
acatttatatattgtct

SEQ ID NO: 5056866 - DNA, 19 bp, Homo sapiens
acatttatattaaataaca

SEQ ID NO: 5056867 - DNA, 21 bp, Homo sapiens
acatttatcatggtcctgaat

SEQ ID NO: 5056868 - DNA, 16 bp, Homo sapiens
acatttatctaaaaga

SEQ ID NO: 5056869 - DNA, 12 bp, Homo sapiens
acatttatcttt

SEQ ID NO: 5056870 - DNA, 18 bp, Homo sapiens
acatttatgagtaactat

SEQ ID NO: 5056871 - DNA, 12 bp, Homo sapiens
acatttatgtac

SEQ ID NO: 5056872 - DNA, 18 bp, Homo sapiens
acatttatgtacaaaatg

SEQ ID NO: 5056873 - DNA, 13 bp, Homo sapiens
acatttatgtgct

SEQ ID NO: 5056874 - DNA, 16 bp, Homo sapiens
acatttatgtgttgat

SEQ ID NO: 5056875 - DNA, 19 bp, Homo sapiens
acatttatttattactgtc

SEQ ID NO: 5056876 - DNA, 21 bp, Homo sapiens
acatttatttattactgtccc

SEQ ID NO: 5056877 - DNA, 13 bp, Homo sapiens
acatttatttcct

SEQ ID NO: 5056878 - DNA, 14 bp, Homo sapiens
acatttatttcctc

SEQ ID NO: 5056879 - DNA, 12 bp, Homo sapiens
acatttatttgg

SEQ ID NO: 5056880 - DNA, 14 bp, Homo sapiens
acatttattttatg

SEQ ID NO: 5056881 - DNA, 15 bp, Homo sapiens
acatttattttatga

SEQ ID NO: 5056882 - DNA, 18 bp, Homo sapiens
acatttattttatgagaa

SEQ ID NO: 5056883 - DNA, 17 bp, Homo sapiens
acatttcaaaattaata

SEQ ID NO: 5056884 - DNA, 14 bp, Homo sapiens
acatttcaaagctg

SEQ ID NO: 5056885 - DNA, 20 bp, Homo sapiens
acatttcaaataactgcaga

SEQ ID NO: 5056886 - DNA, 15 bp, Homo sapiens
acatttcaaattgaa

SEQ ID NO: 5056887 - DNA, 19 bp, Homo sapiens
acatttcaagatccaaatg

SEQ ID NO: 5056888 - DNA, 23 bp, Homo sapiens
acatttcaagtttactccttctg

SEQ ID NO: 5056889 - DNA, 16 bp, Homo sapiens
acatttcacattattc

SEQ ID NO: 5056890 - DNA, 14 bp, Homo sapiens
acatttcactaaaa

SEQ ID NO: 5056891 - DNA, 12 bp, Homo sapiens
acatttcagaaa

SEQ ID NO: 5056892 - DNA, 14 bp, Homo sapiens
acatttcagtgttt

SEQ ID NO: 5056893 - DNA, 23 bp, Homo sapiens
acatttcataatttgtttccagc

SEQ ID NO: 5056894 - DNA, 16 bp, Homo sapiens
acatttcatacaacag

SEQ ID NO: 5056895 - DNA, 23 bp, Homo sapiens
acatttcatagtttcaaatctgt

SEQ ID NO: 5056896 - DNA, 18 bp, Homo sapiens
acatttcatataaatgga

SEQ ID NO: 5056897 - DNA, 15 bp, Homo sapiens
acatttcatctgggt

SEQ ID NO: 5056898 - DNA, 16 bp, Homo sapiens
acatttcatgtattcc

SEQ ID NO: 5056899 - DNA, 20 bp, Homo sapiens
acatttcatgtatttcttta

SEQ ID NO: 5056900 - DNA, 21 bp, Homo sapiens
acatttcatgtatttctttag

SEQ ID NO: 5056901 - DNA, 22 bp, Homo sapiens
acatttcatgtatttctttaga

SEQ ID NO: 5056902 - DNA, 15 bp, Homo sapiens
acatttccaagctgt

SEQ ID NO: 5056903 - DNA, 20 bp, Homo sapiens
acatttccagggcagcagcc

SEQ ID NO: 5056904 - DNA, 14 bp, Homo sapiens
acatttccatttat

SEQ ID NO: 5056905 - DNA, 17 bp, Homo sapiens
acatttccatttattgt

SEQ ID NO: 5056906 - DNA, 19 bp, Homo sapiens
acatttccatttattgttt

SEQ ID NO: 5056907 - DNA, 22 bp, Homo sapiens
acatttccatttattgtttgaa

SEQ ID NO: 5056908 - DNA, 16 bp, Homo sapiens
acatttccctatttta

SEQ ID NO: 5056909 - DNA, 11 bp, Homo sapiens
acatttccctc

SEQ ID NO: 5056910 - DNA, 12 bp, Homo sapiens
acatttccctgt

SEQ ID NO: 5056911 - DNA, 15 bp, Homo sapiens
acatttccctgtgct

SEQ ID NO: 5056912 - DNA, 17 bp, Homo sapiens
acatttccgaataaagt

SEQ ID NO: 5056913 - DNA, 19 bp, Homo sapiens
acatttccgccacatccct

SEQ ID NO: 5056914 - DNA, 16 bp, Homo sapiens
acatttcctaaatata

SEQ ID NO: 5056915 - DNA, 18 bp, Homo sapiens
acatttccttacagaact

SEQ ID NO: 5056916 - DNA, 17 bp, Homo sapiens
acatttcctttttctat

SEQ ID NO: 5056917 - DNA, 22 bp, Homo sapiens
acatttcctttttctattttac

SEQ ID NO: 5056918 - DNA, 18 bp, Homo sapiens
acatttctaacatatgta

SEQ ID NO: 5056919 - DNA, 21 bp, Homo sapiens
acatttctaacatatgtatta

SEQ ID NO: 5056920 - DNA, 19 bp, Homo sapiens
acatttctaactctattaa

SEQ ID NO: 5056921 - DNA, 23 bp, Homo sapiens
acatttctaagtcaaacacttgt

SEQ ID NO: 5056922 - DNA, 17 bp, Homo sapiens
acatttctaatttgaat

SEQ ID NO: 5056923 - DNA, 18 bp, Homo sapiens
acatttctatcagtactt

SEQ ID NO: 5056924 - DNA, 12 bp, Homo sapiens
acatttctcaaa

SEQ ID NO: 5056925 - DNA, 13 bp, Homo sapiens
acatttctcaggc

SEQ ID NO: 5056926 - DNA, 17 bp, Homo sapiens
acatttctcatgttgaa

SEQ ID NO: 5056927 - DNA, 14 bp, Homo sapiens
acatttctctaact

SEQ ID NO: 5056928 - DNA, 21 bp, Homo sapiens
acatttctctaactcctgcca

SEQ ID NO: 5056929 - DNA, 23 bp, Homo sapiens
acatttctctaactcctgccatt

SEQ ID NO: 5056930 - DNA, 22 bp, Homo sapiens
acatttctctccaccttagtac

SEQ ID NO: 5056931 - DNA, 12 bp, Homo sapiens
acatttctctga

SEQ ID NO: 5056932 - DNA, 15 bp, Homo sapiens
acatttctctgagca

SEQ ID NO: 5056933 - DNA, 19 bp, Homo sapiens
acatttctcttcagtgtgt

SEQ ID NO: 5056934 - DNA, 14 bp, Homo sapiens
acatttctcttccc

SEQ ID NO: 5056935 - DNA, 18 bp, Homo sapiens
acatttctgatcagaggt

SEQ ID NO: 5056936 - DNA, 15 bp, Homo sapiens
acatttctgattctg

SEQ ID NO: 5056937 - DNA, 13 bp, Homo sapiens
acatttctggatt

SEQ ID NO: 5056938 - DNA, 14 bp, Homo sapiens
acatttctgtatac

SEQ ID NO: 5056939 - DNA, 14 bp, Homo sapiens
acatttctgttctc

SEQ ID NO: 5056940 - DNA, 15 bp, Homo sapiens
acatttctgttctca

SEQ ID NO: 5056941 - DNA, 19 bp, Homo sapiens
acatttcttaaaacacatg

SEQ ID NO: 5056942 - DNA, 21 bp, Homo sapiens
acatttcttaaaacacatgat

SEQ ID NO: 5056943 - DNA, 22 bp, Homo sapiens
acatttcttaaaacacatgata

SEQ ID NO: 5056944 - DNA, 21 bp, Homo sapiens
acatttcttaaattattttat

SEQ ID NO: 5056945 - DNA, 14 bp, Homo sapiens
acatttcttatgat

SEQ ID NO: 5056946 - DNA, 21 bp, Homo sapiens
accaaaaaagctgtattttga

SEQ ID NO: 5056947 - DNA, 12 bp, Homo sapiens
accaaaaacaaa

SEQ ID NO: 5056948 - DNA, 13 bp, Homo sapiens
accaaaaacaagt

SEQ ID NO: 5056949 - DNA, 12 bp, Homo sapiens
accaaaaaccag

SEQ ID NO: 5056950 - DNA, 15 bp, Homo sapiens
accaaaacaccccaa

SEQ ID NO: 5056951 - DNA, 14 bp, Homo sapiens
accaaaacatccac

SEQ ID NO: 5056952 - DNA, 14 bp, Homo sapiens
acatataataaata

SEQ ID NO: 5056953 - DNA, 15 bp, Homo sapiens
acatatacaacacca

SEQ ID NO: 5056954 - DNA, 16 bp, Homo sapiens
acatatacagcaggat

SEQ ID NO: 5056955 - DNA, 14 bp, Homo sapiens
acatatacatatat

SEQ ID NO: 5056956 - DNA, 14 bp, Homo sapiens
acatatacatatga

SEQ ID NO: 5056957 - DNA, 21 bp, Homo sapiens
acatatacatatgatcaaata

SEQ ID NO: 5056958 - DNA, 14 bp, Homo sapiens
acatatacatctag

SEQ ID NO: 5056959 - DNA, 15 bp, Homo sapiens
acatataccaaaaac

SEQ ID NO: 5056960 - DNA, 14 bp, Homo sapiens
acatataccaccca

SEQ ID NO: 5056961 - DNA, 21 bp, Homo sapiens
acatataccacccatagtgct

SEQ ID NO: 5056962 - DNA, 22 bp, Homo sapiens
acatatacctataatgtgtgta

SEQ ID NO: 5056963 - DNA, 23 bp, Homo sapiens
acatatacctataatgtgtgtat

SEQ ID NO: 5056964 - DNA, 20 bp, Homo sapiens
acatataggttactacttaa

SEQ ID NO: 5056965 - DNA, 14 bp, Homo sapiens
acatatatacatac

SEQ ID NO: 5056966 - DNA, 19 bp, Homo sapiens
acatatatacatacgcaat

SEQ ID NO: 5056967 - DNA, 14 bp, Homo sapiens
acatatatacattt

SEQ ID NO: 5056968 - DNA, 10 bp, Homo sapiens
acatatatat

SEQ ID NO: 5056969 - DNA, 11 bp, Homo sapiens
acatatatata

SEQ ID NO: 5056970 - DNA, 19 bp, Homo sapiens
acatatatatatcccttta

SEQ ID NO: 5056971 - DNA, 14 bp, Homo sapiens
acatatatatattt

SEQ ID NO: 5056972 - DNA, 22 bp, Homo sapiens
acatatatatatttgtaacatt

SEQ ID NO: 5056973 - DNA, 16 bp, Homo sapiens
acatatatatctgata

SEQ ID NO: 5056974 - DNA, 13 bp, Homo sapiens
acatatatatgcc

SEQ ID NO: 5056975 - DNA, 12 bp, Homo sapiens
acatatatattt

SEQ ID NO: 5056976 - DNA, 22 bp, Homo sapiens
acatatatctacacatacagaa

SEQ ID NO: 5056977 - DNA, 20 bp, Homo sapiens
acatatatgtataatatata

SEQ ID NO: 5056978 - DNA, 22 bp, Homo sapiens
acatatatgtataatatatatc

SEQ ID NO: 5056979 - DNA, 20 bp, Homo sapiens
acatatatgtatacgcacgc

SEQ ID NO: 5056980 - DNA, 23 bp, Homo sapiens
acatatatgtatacgcacgcacc

SEQ ID NO: 5056981 - DNA, 10 bp, Homo sapiens
acatatatta

SEQ ID NO: 5056982 - DNA, 14 bp, Homo sapiens
acatatattatata

SEQ ID NO: 5056983 - DNA, 19 bp, Homo sapiens
acatatattatatatagaa

SEQ ID NO: 5056984 - DNA, 15 bp, Homo sapiens
acatatcaaaatagg

SEQ ID NO: 5056985 - DNA, 17 bp, Homo sapiens
acatatcaattcaacac

SEQ ID NO: 5056986 - DNA, 13 bp, Homo sapiens
acatatcagaaaa

SEQ ID NO: 5056987 - DNA, 22 bp, Homo sapiens
acatatcagacttcaccaaata

SEQ ID NO: 5056988 - DNA, 22 bp, Homo sapiens
acatatcagcaggagtaataaa

SEQ ID NO: 5056989 - DNA, 15 bp, Homo sapiens
acatatcatttgtga

SEQ ID NO: 5056990 - DNA, 18 bp, Homo sapiens
acatatccaaaataatga

SEQ ID NO: 5056991 - DNA, 17 bp, Homo sapiens
acatatcctttggtcct

SEQ ID NO: 5056992 - DNA, 17 bp, Homo sapiens
acatatcgctgacttca

SEQ ID NO: 5056993 - DNA, 18 bp, Homo sapiens
acatatctaaaaatagtt

SEQ ID NO: 5056994 - DNA, 15 bp, Homo sapiens
acatatctaaagtca

SEQ ID NO: 5056995 - DNA, 17 bp, Homo sapiens
acatatctagtatgaaa

SEQ ID NO: 5056996 - DNA, 22 bp, Homo sapiens
acatatctagtatgaaattata

SEQ ID NO: 5056997 - DNA, 14 bp, Homo sapiens
acatatctctgccg

SEQ ID NO: 5056998 - DNA, 19 bp, Homo sapiens
acatatctttattaatcac

SEQ ID NO: 5056999 - DNA, 14 bp, Homo sapiens
acatatctttgagt

SEQ ID NO: 5057000 - DNA, 15 bp, Homo sapiens
acatatctttgagtt

SEQ ID NO: 5057001 - DNA, 18 bp, Homo sapiens
acatatgaaatataaatt

SEQ ID NO: 5057002 - DNA, 15 bp, Homo sapiens
acatatgaaatttaa

SEQ ID NO: 5057003 - DNA, 16 bp, Homo sapiens
acatatgaacgcacaa

SEQ ID NO: 5057004 - DNA, 21 bp, Homo sapiens
acatatgagtgtggaagccgg

SEQ ID NO: 5057005 - DNA, 14 bp, Homo sapiens
acatatgagtgttt

SEQ ID NO: 5057006 - DNA, 16 bp, Homo sapiens
acatatgatactgatg

SEQ ID NO: 5057007 - DNA, 16 bp, Homo sapiens
acatatgatctgtctg

SEQ ID NO: 5057008 - DNA, 18 bp, Homo sapiens
acatatgattgtatttgt

SEQ ID NO: 5057009 - DNA, 15 bp, Homo sapiens
acatatgatttcact

SEQ ID NO: 5057010 - DNA, 15 bp, Homo sapiens
acatatgcaccttgt

SEQ ID NO: 5057011 - DNA, 23 bp, Homo sapiens
acatatggactctgcacatgaat

SEQ ID NO: 5057012 - DNA, 23 bp, Homo sapiens
acatatggtctccattttacagt

SEQ ID NO: 5057013 - DNA, 12 bp, Homo sapiens
acatatgtaaaa

SEQ ID NO: 5057014 - DNA, 15 bp, Homo sapiens
acatatgtaattctt

SEQ ID NO: 5057015 - DNA, 20 bp, Homo sapiens
acatatgtagactatataca

SEQ ID NO: 5057016 - DNA, 23 bp, Homo sapiens
acatatgtagactatatacatgt

SEQ ID NO: 5057017 - DNA, 12 bp, Homo sapiens
acatatgtatac

SEQ ID NO: 5057018 - DNA, 17 bp, Homo sapiens
acatatgtatacatgtg

SEQ ID NO: 5057019 - DNA, 16 bp, Homo sapiens
acatatgtatgtgtga

SEQ ID NO: 5057020 - DNA, 20 bp, Homo sapiens
acatatgtctgtctttgcaa

SEQ ID NO: 5057021 - DNA, 23 bp, Homo sapiens
acatatgtcttactactttaaat

SEQ ID NO: 5057022 - DNA, 19 bp, Homo sapiens
acatattacaagaaaacta

SEQ ID NO: 5057023 - DNA, 20 bp, Homo sapiens
acatattagcgacaacagat

SEQ ID NO: 5057024 - DNA, 21 bp, Homo sapiens
acatattagtgcagccaagta

SEQ ID NO: 5057025 - DNA, 17 bp, Homo sapiens
acatattatgcctgaat

SEQ ID NO: 5057026 - DNA, 15 bp, Homo sapiens
acatattatttcatt

SEQ ID NO: 5057027 - DNA, 13 bp, Homo sapiens
acatattcaaatc

SEQ ID NO: 5057028 - DNA, 15 bp, Homo sapiens
acatattcaagtgat

SEQ ID NO: 5057029 - DNA, 16 bp, Homo sapiens
acatattcatcagcag

SEQ ID NO: 5057030 - DNA, 13 bp, Homo sapiens
acatattcatgaa

SEQ ID NO: 5057031 - DNA, 20 bp, Homo sapiens
acatattcatttggaaataa

SEQ ID NO: 5057032 - DNA, 22 bp, Homo sapiens
acatattccatgtttggaagac

SEQ ID NO: 5057033 - DNA, 21 bp, Homo sapiens
acatattcttgctttcacaaa

SEQ ID NO: 5057034 - DNA, 14 bp, Homo sapiens
acatattgatttcc

SEQ ID NO: 5057035 - DNA, 15 bp, Homo sapiens
acatattgtgaatgt

SEQ ID NO: 5057036 - DNA, 12 bp, Homo sapiens
acatattgttag

SEQ ID NO: 5057037 - DNA, 15 bp, Homo sapiens
acatatttaactggt

SEQ ID NO: 5057038 - DNA, 20 bp, Homo sapiens
acatatttaactggtgcact

SEQ ID NO: 5057039 - DNA, 20 bp, Homo sapiens
acatatttaatgttttaaat

SEQ ID NO: 5057040 - DNA, 23 bp, Homo sapiens
acatatttattgtgcattaaaat

SEQ ID NO: 5057041 - DNA, 23 bp, Homo sapiens
acatatttatttttacctgcttt

SEQ ID NO: 5057042 - DNA, 15 bp, Homo sapiens
acatatttcataagc

SEQ ID NO: 5057043 - DNA, 22 bp, Homo sapiens
acatatttcataagcacatcca

SEQ ID NO: 5057044 - DNA, 13 bp, Homo sapiens
acatatttcattt

SEQ ID NO: 5057045 - DNA, 16 bp, Homo sapiens
acatatttgaatgact

SEQ ID NO: 5057046 - DNA, 16 bp, Homo sapiens
acatatttgactcttt

SEQ ID NO: 5057047 - DNA, 18 bp, Homo sapiens
acatatttgactctttca

SEQ ID NO: 5057048 - DNA, 20 bp, Homo sapiens
acatatttgactctttcaaa

SEQ ID NO: 5057049 - DNA, 21 bp, Homo sapiens
acatatttgactctttcaaag

SEQ ID NO: 5057050 - DNA, 22 bp, Homo sapiens
acatatttgtagctagaatatc

SEQ ID NO: 5057051 - DNA, 17 bp, Homo sapiens
acatatttgtatgtttt

SEQ ID NO: 5057052 - DNA, 19 bp, Homo sapiens
acatatttgtatgtttttc

SEQ ID NO: 5057053 - DNA, 20 bp, Homo sapiens
acatatttgtatgtttttct

SEQ ID NO: 5057054 - DNA, 21 bp, Homo sapiens
acatatttgtatgtttttctg

SEQ ID NO: 5057055 - DNA, 19 bp, Homo sapiens
acatatttgttaaatattt

SEQ ID NO: 5057056 - DNA, 17 bp, Homo sapiens
acatattttattaagaa

SEQ ID NO: 5057057 - DNA, 19 bp, Homo sapiens
acatattttattaagaact

SEQ ID NO: 5057058 - DNA, 13 bp, Homo sapiens
acatatttttaaa

SEQ ID NO: 5057059 - DNA, 21 bp, Homo sapiens
acatatttttatactttattg

SEQ ID NO: 5057060 - DNA, 22 bp, Homo sapiens
acatatttttatactttattga

SEQ ID NO: 5057061 - DNA, 21 bp, Homo sapiens
acatattttttatatctggaa

SEQ ID NO: 5057062 - DNA, 12 bp, Homo sapiens
acatcaaagagg

SEQ ID NO: 5057063 - DNA, 15 bp, Homo sapiens
acatcaaagcctggc

SEQ ID NO: 5057064 - DNA, 18 bp, Homo sapiens
acatcaaagcctggccta

SEQ ID NO: 5057065 - DNA, 21 bp, Homo sapiens
acatcaaagtggtaaatactg

SEQ ID NO: 5057066 - DNA, 17 bp, Homo sapiens
acatcaaataaatttct

SEQ ID NO: 5057067 - DNA, 23 bp, Homo sapiens
acatcaaataaatttctgggata

SEQ ID NO: 5057068 - DNA, 17 bp, Homo sapiens
acatcaacaagaagaaa

SEQ ID NO: 5057069 - DNA, 18 bp, Homo sapiens
acatcaacatcttggtca

SEQ ID NO: 5057070 - DNA, 18 bp, Homo sapiens
acatcaacccgagtcatt

SEQ ID NO: 5057071 - DNA, 11 bp, Homo sapiens
acatcaagaaa

SEQ ID NO: 5057072 - DNA, 14 bp, Homo sapiens
acatcaagcatcat

SEQ ID NO: 5057073 - DNA, 15 bp, Homo sapiens
acatcaagcatgcaa

SEQ ID NO: 5057074 - DNA, 16 bp, Homo sapiens
acatcaagcttttctg

SEQ ID NO: 5057075 - DNA, 18 bp, Homo sapiens
acatcaagcttttctgta

SEQ ID NO: 5057076 - DNA, 17 bp, Homo sapiens
acatcaagggaggaagg

SEQ ID NO: 5057077 - DNA, 18 bp, Homo sapiens
acatcaagtccatctgac

SEQ ID NO: 5057078 - DNA, 20 bp, Homo sapiens
acatcaagtccatctgacaa

SEQ ID NO: 5057079 - DNA, 21 bp, Homo sapiens
acatcaagtccatctgacaaa

SEQ ID NO: 5057080 - DNA, 15 bp, Homo sapiens
acatcaagtgccaga

SEQ ID NO: 5057081 - DNA, 23 bp, Homo sapiens
acatcaagtgccagatgttgtct

SEQ ID NO: 5057082 - DNA, 13 bp, Homo sapiens
acatcaagtgtaa

SEQ ID NO: 5057083 - DNA, 15 bp, Homo sapiens
acatcaagtgtaatt

SEQ ID NO: 5057084 - DNA, 21 bp, Homo sapiens
acatcaagtgtaattagcttt

SEQ ID NO: 5057085 - DNA, 13 bp, Homo sapiens
acatcaatatgta

SEQ ID NO: 5057086 - DNA, 13 bp, Homo sapiens
acatcaatgaaac

SEQ ID NO: 5057087 - DNA, 13 bp, Homo sapiens
acatcaatgttca

SEQ ID NO: 5057088 - DNA, 20 bp, Homo sapiens
acatcaatgttcattgtaat

SEQ ID NO: 5057089 - DNA, 21 bp, Homo sapiens
acatcaattaattaaatgaac

SEQ ID NO: 5057090 - DNA, 16 bp, Homo sapiens
acatcaattaattgat

SEQ ID NO: 5057091 - DNA, 13 bp, Homo sapiens
acatcacacacac

SEQ ID NO: 5057092 - DNA, 17 bp, Homo sapiens
acatcacatccctctcc

SEQ ID NO: 5057093 - DNA, 21 bp, Homo sapiens
acatcacatcttatttatttt

SEQ ID NO: 5057094 - DNA, 22 bp, Homo sapiens
acatcacccttaccatgtgcct

SEQ ID NO: 5057095 - DNA, 20 bp, Homo sapiens
acatcaccctttgccttagc

SEQ ID NO: 5057096 - DNA, 16 bp, Homo sapiens
acatcactacaaaaag

SEQ ID NO: 5057097 - DNA, 22 bp, Homo sapiens
acatcactacaaaaagaagagt

SEQ ID NO: 5057098 - DNA, 18 bp, Homo sapiens
acatcactatcaatttta

SEQ ID NO: 5057099 - DNA, 19 bp, Homo sapiens
acatcactatcaattttaa

SEQ ID NO: 5057100 - DNA, 21 bp, Homo sapiens
acatcactattgggcccccag

SEQ ID NO: 5057101 - DNA, 14 bp, Homo sapiens
acatcactccctct

SEQ ID NO: 5057102 - DNA, 14 bp, Homo sapiens
acatcactgagaag

SEQ ID NO: 5057103 - DNA, 18 bp, Homo sapiens
acatcactgattgggtgc

SEQ ID NO: 5057104 - DNA, 19 bp, Homo sapiens
acatcactgattgggtgcc

SEQ ID NO: 5057105 - DNA, 14 bp, Homo sapiens
acatcactgcttga

SEQ ID NO: 5057106 - DNA, 23 bp, Homo sapiens
acatcactggcatggtggttggg

SEQ ID NO: 5057107 - DNA, 18 bp, Homo sapiens
acatcacttcctgtttta

SEQ ID NO: 5057108 - DNA, 16 bp, Homo sapiens
acatcacttgccaatg

SEQ ID NO: 5057109 - DNA, 16 bp, Homo sapiens
acatcacttgtacaaa

SEQ ID NO: 5057110 - DNA, 19 bp, Homo sapiens
acatcactttgtgaattaa

SEQ ID NO: 5057111 - DNA, 21 bp, Homo sapiens
acatcactttgtgaattaaca

SEQ ID NO: 5057112 - DNA, 13 bp, Homo sapiens
acatcagaaagga

SEQ ID NO: 5057113 - DNA, 20 bp, Homo sapiens
acatcagaagtaactcccac

SEQ ID NO: 5057114 - DNA, 19 bp, Homo sapiens
acatcagacctgtcttcca

SEQ ID NO: 5057115 - DNA, 12 bp, Homo sapiens
acatcagatttc

SEQ ID NO: 5057116 - DNA, 14 bp, Homo sapiens
acatcagatttctt

SEQ ID NO: 5057117 - DNA, 15 bp, Homo sapiens
acatcagatttctta

SEQ ID NO: 5057118 - DNA, 18 bp, Homo sapiens
acatcagcaagactttat

SEQ ID NO: 5057119 - DNA, 13 bp, Homo sapiens
acatcagcacttt

SEQ ID NO: 5057120 - DNA, 14 bp, Homo sapiens
acatcagcatgttt

SEQ ID NO: 5057121 - DNA, 16 bp, Homo sapiens
acatcagcatgttttc

SEQ ID NO: 5057122 - DNA, 17 bp, Homo sapiens
acatcagcatgttttct

SEQ ID NO: 5057123 - DNA, 23 bp, Homo sapiens
acatcagcatgttttctgcttta

SEQ ID NO: 5057124 - DNA, 14 bp, Homo sapiens
agcagaattcattc

SEQ ID NO: 5057125 - DNA, 15 bp, Homo sapiens
agcagaattgacagt

SEQ ID NO: 5057126 - DNA, 15 bp, Homo sapiens
agcagaattgcttga

SEQ ID NO: 5057127 - DNA, 17 bp, Homo sapiens
agcagaattggaaaaga

SEQ ID NO: 5057128 - DNA, 19 bp, Homo sapiens
agcagaattggaaaagact

SEQ ID NO: 5057129 - DNA, 14 bp, Homo sapiens
agcagaattttaat

SEQ ID NO: 5057130 - DNA, 21 bp, Homo sapiens
agcagacaataacttcttaaa

SEQ ID NO: 5057131 - DNA, 12 bp, Homo sapiens
agcagacacaca

SEQ ID NO: 5057132 - DNA, 15 bp, Homo sapiens
agcagacacacacat

SEQ ID NO: 5057133 - DNA, 22 bp, Homo sapiens
agcagacacacacatatataca

SEQ ID NO: 5057134 - DNA, 13 bp, Homo sapiens
agcagacacactg

SEQ ID NO: 5057135 - DNA, 16 bp, Homo sapiens
agcagacacatgccag

SEQ ID NO: 5057136 - DNA, 17 bp, Homo sapiens
agcagacaccattcatt

SEQ ID NO: 5057137 - DNA, 15 bp, Homo sapiens
agcagacagaaactg

SEQ ID NO: 5057138 - DNA, 18 bp, Homo sapiens
agcagacagaaactggat

SEQ ID NO: 5057139 - DNA, 14 bp, Homo sapiens
agcagacagagcca

SEQ ID NO: 5057140 - DNA, 16 bp, Homo sapiens
agcagacagagccagg

SEQ ID NO: 5057141 - DNA, 14 bp, Homo sapiens
agcagacaggcctg

SEQ ID NO: 5057142 - DNA, 12 bp, Homo sapiens
agcagacattgt

SEQ ID NO: 5057143 - DNA, 17 bp, Homo sapiens
agcagacattgtcagca

SEQ ID NO: 5057144 - DNA, 16 bp, Homo sapiens
agcagacattgttaca

SEQ ID NO: 5057145 - DNA, 17 bp, Homo sapiens
agcagacattgttacaa

SEQ ID NO: 5057146 - DNA, 22 bp, Homo sapiens
agcagaccaccccgcctgccct

SEQ ID NO: 5057147 - DNA, 14 bp, Homo sapiens
agcagaccagcttt

SEQ ID NO: 5057148 - DNA, 21 bp, Homo sapiens
agcagacccatacctttccag

SEQ ID NO: 5057149 - DNA, 17 bp, Homo sapiens
agcagacctacctgcag

SEQ ID NO: 5057150 - DNA, 17 bp, Homo sapiens
agcagacggggggctgc

SEQ ID NO: 5057151 - DNA, 13 bp, Homo sapiens
agcagactacagc

SEQ ID NO: 5057152 - DNA, 22 bp, Homo sapiens
agcagactacagctggggtgca

SEQ ID NO: 5057153 - DNA, 23 bp, Homo sapiens
agcagactacagctggggtgcag

SEQ ID NO: 5057154 - DNA, 14 bp, Homo sapiens
agcagactcagctg

SEQ ID NO: 5057155 - DNA, 14 bp, Homo sapiens
agcagactccagcc

SEQ ID NO: 5057156 - DNA, 15 bp, Homo sapiens
agcagactccagccc

SEQ ID NO: 5057157 - DNA, 19 bp, Homo sapiens
agcagactccagcccctgg

SEQ ID NO: 5057158 - DNA, 17 bp, Homo sapiens
agcagactgatcaggac

SEQ ID NO: 5057159 - DNA, 19 bp, Homo sapiens
agcagactttctctgtgta

SEQ ID NO: 5057160 - DNA, 18 bp, Homo sapiens
agcagagaagcctgtctg

SEQ ID NO: 5057161 - DNA, 13 bp, Homo sapiens
agcagagaagggc

SEQ ID NO: 5057162 - DNA, 19 bp, Homo sapiens
agcagagaagtacaggtca

SEQ ID NO: 5057163 - DNA, 21 bp, Homo sapiens
agcagagaatgaaagggccca

SEQ ID NO: 5057164 - DNA, 23 bp, Homo sapiens
agcagagaatgaaagggcccaga

SEQ ID NO: 5057165 - DNA, 17 bp, Homo sapiens
agcagagaccatccctg

SEQ ID NO: 5057166 - DNA, 19 bp, Homo sapiens
agcagagaccatccctgaa

SEQ ID NO: 5057167 - DNA, 23 bp, Homo sapiens
agcagagagaagtacttttgatt

SEQ ID NO: 5057168 - DNA, 12 bp, Homo sapiens
agcagagagaga

SEQ ID NO: 5057169 - DNA, 13 bp, Homo sapiens
agcagagagagag

SEQ ID NO: 5057170 - DNA, 15 bp, Homo sapiens
agcagagagagagga

SEQ ID NO: 5057171 - DNA, 22 bp, Homo sapiens
agcagagagagaggacagaggg

SEQ ID NO: 5057172 - DNA, 19 bp, Homo sapiens
agcagagagagccagacag

SEQ ID NO: 5057173 - DNA, 15 bp, Homo sapiens
agcagagagatgcgg

SEQ ID NO: 5057174 - DNA, 19 bp, Homo sapiens
agcagagagccctgggtga

SEQ ID NO: 5057175 - DNA, 16 bp, Homo sapiens
agcagagatcgacaga

SEQ ID NO: 5057176 - DNA, 19 bp, Homo sapiens
agcagagatcgacagacag

SEQ ID NO: 5057177 - DNA, 21 bp, Homo sapiens
agcagagatcgacagacagcc

SEQ ID NO: 5057178 - DNA, 16 bp, Homo sapiens
agcagagatgtattat

SEQ ID NO: 5057179 - DNA, 18 bp, Homo sapiens
agcagagcaagtctgcag

SEQ ID NO: 5057180 - DNA, 20 bp, Homo sapiens
agcagagcaccttagacagt

SEQ ID NO: 5057181 - DNA, 15 bp, Homo sapiens
agcagagcaggggca

SEQ ID NO: 5057182 - DNA, 14 bp, Homo sapiens
agcagagcattttt

SEQ ID NO: 5057183 - DNA, 13 bp, Homo sapiens
agcagagccaagg

SEQ ID NO: 5057184 - DNA, 17 bp, Homo sapiens
agcagagccaaggccac

SEQ ID NO: 5057185 - DNA, 14 bp, Homo sapiens
agcagagccagggc

SEQ ID NO: 5057186 - DNA, 20 bp, Homo sapiens
agcagagccagggcagggcg

SEQ ID NO: 5057187 - DNA, 18 bp, Homo sapiens
agcagagcccaccagcca

SEQ ID NO: 5057188 - DNA, 19 bp, Homo sapiens
agcagagcccaccagccag

SEQ ID NO: 5057189 - DNA, 20 bp, Homo sapiens
agcagagcccaccagccagc

SEQ ID NO: 5057190 - DNA, 21 bp, Homo sapiens
agcagagcccaccagccagcc

SEQ ID NO: 5057191 - DNA, 13 bp, Homo sapiens
agcagagccccca

SEQ ID NO: 5057192 - DNA, 17 bp, Homo sapiens
agcagagcccggagctc

SEQ ID NO: 5057193 - DNA, 18 bp, Homo sapiens
agcagagcccggagctcc

SEQ ID NO: 5057194 - DNA, 17 bp, Homo sapiens
agcagagccgttcctgg

SEQ ID NO: 5057195 - DNA, 13 bp, Homo sapiens
agcagagcctcct

SEQ ID NO: 5057196 - DNA, 14 bp, Homo sapiens
agcagagcctcctg

SEQ ID NO: 5057197 - DNA, 12 bp, Homo sapiens
agcagagcctgg

SEQ ID NO: 5057198 - DNA, 14 bp, Homo sapiens
agcagagcgcagcc

SEQ ID NO: 5057199 - DNA, 18 bp, Homo sapiens
agcagagcgcagccccca

SEQ ID NO: 5057200 - DNA, 22 bp, Homo sapiens
agcagagcgggactctgtccaa

SEQ ID NO: 5057201 - DNA, 22 bp, Homo sapiens
agcagagcggggtcccctctgt

SEQ ID NO: 5057202 - DNA, 17 bp, Homo sapiens
agcagagctgatggaga

SEQ ID NO: 5057203 - DNA, 16 bp, Homo sapiens
agcagagcttcctcag

SEQ ID NO: 5057204 - DNA, 11 bp, Homo sapiens
agcagaggaag

SEQ ID NO: 5057205 - DNA, 14 bp, Homo sapiens
agcagaggaaggaa

SEQ ID NO: 5057206 - DNA, 17 bp, Homo sapiens
agcagaggaaggaaaca

SEQ ID NO: 5057207 - DNA, 17 bp, Homo sapiens
agcagaggaattatgaa

SEQ ID NO: 5057208 - DNA, 18 bp, Homo sapiens
agcagaggaattatgaac

SEQ ID NO: 5057209 - DNA, 22 bp, Homo sapiens
agcagaggacagtctggagaag

SEQ ID NO: 5057210 - DNA, 20 bp, Homo sapiens
agaggccatggcagaataat

SEQ ID NO: 5057211 - DNA, 23 bp, Homo sapiens
agaggccatggcagaataatctt

SEQ ID NO: 5057212 - DNA, 22 bp, Homo sapiens
agaggccatgttccaataaaca

SEQ ID NO: 5057213 - DNA, 18 bp, Homo sapiens
agaggcccactagagggc

SEQ ID NO: 5057214 - DNA, 20 bp, Homo sapiens
agaggcccactagagggccc

SEQ ID NO: 5057215 - DNA, 20 bp, Homo sapiens
agaggcccagatattagaaa

SEQ ID NO: 5057216 - DNA, 18 bp, Homo sapiens
agaggcccaggcaccacc

SEQ ID NO: 5057217 - DNA, 20 bp, Homo sapiens
agaggcccaggcaccaccag

SEQ ID NO: 5057218 - DNA, 22 bp, Homo sapiens
agaggcccaggcaccaccagga

SEQ ID NO: 5057219 - DNA, 17 bp, Homo sapiens
agaggcccaggctgccg

SEQ ID NO: 5057220 - DNA, 12 bp, Homo sapiens
agaggcccaggg

SEQ ID NO: 5057221 - DNA, 21 bp, Homo sapiens
agaggccccaataccccatgg

SEQ ID NO: 5057222 - DNA, 14 bp, Homo sapiens
agaggccccacctg

SEQ ID NO: 5057223 - DNA, 22 bp, Homo sapiens
agaggccccacctgaagggtgg

SEQ ID NO: 5057224 - DNA, 23 bp, Homo sapiens
agaggccccacctgaagggtgga

SEQ ID NO: 5057225 - DNA, 12 bp, Homo sapiens
agaggccccagc

SEQ ID NO: 5057226 - DNA, 15 bp, Homo sapiens
agaggccccagcctc

SEQ ID NO: 5057227 - DNA, 20 bp, Homo sapiens
agaggcccccagtggggaca

SEQ ID NO: 5057228 - DNA, 22 bp, Homo sapiens
agaggcccccagtggggacagg

SEQ ID NO: 5057229 - DNA, 21 bp, Homo sapiens
agaggccccttgctgctggct

SEQ ID NO: 5057230 - DNA, 22 bp, Homo sapiens
agaggccccttgctgctggctc

SEQ ID NO: 5057231 - DNA, 14 bp, Homo sapiens
agaggccctctgga

SEQ ID NO: 5057232 - DNA, 21 bp, Homo sapiens
agaggccctctggagtggcca

SEQ ID NO: 5057233 - DNA, 12 bp, Homo sapiens
agaggccctgcc

SEQ ID NO: 5057234 - DNA, 15 bp, Homo sapiens
agaggccctgccccc

SEQ ID NO: 5057235 - DNA, 16 bp, Homo sapiens
agaggccctgccccca

SEQ ID NO: 5057236 - DNA, 15 bp, Homo sapiens
agaggccctggaggg

SEQ ID NO: 5057237 - DNA, 16 bp, Homo sapiens
agaggccctggaggtc

SEQ ID NO: 5057238 - DNA, 23 bp, Homo sapiens
agaggccctggaggtctccaggg

SEQ ID NO: 5057239 - DNA, 13 bp, Homo sapiens
agaggccctggat

SEQ ID NO: 5057240 - DNA, 20 bp, Homo sapiens
agaggccctggatcagcgtg

SEQ ID NO: 5057241 - DNA, 14 bp, Homo sapiens
agaggccgctgcag

SEQ ID NO: 5057242 - DNA, 16 bp, Homo sapiens
agaggccgctgcaggg

SEQ ID NO: 5057243 - DNA, 15 bp, Homo sapiens
agaggccgtggctgc

SEQ ID NO: 5057244 - DNA, 19 bp, Homo sapiens
agaggcctcggctgtctcc

SEQ ID NO: 5057245 - DNA, 22 bp, Homo sapiens
agaggcctcttttcctgaagaa

SEQ ID NO: 5057246 - DNA, 20 bp, Homo sapiens
agaggcctgaaatcctggtt

SEQ ID NO: 5057247 - DNA, 22 bp, Homo sapiens
agaggcctgaggatgagctgga

SEQ ID NO: 5057248 - DNA, 13 bp, Homo sapiens
agaggcctgcagg

SEQ ID NO: 5057249 - DNA, 22 bp, Homo sapiens
agaggcctgcctccagggctgg

SEQ ID NO: 5057250 - DNA, 23 bp, Homo sapiens
agaggcctgctgccagtgcagcc

SEQ ID NO: 5057251 - DNA, 14 bp, Homo sapiens
agaggcctggagcc

SEQ ID NO: 5057252 - DNA, 15 bp, Homo sapiens
agaggcctggagccc

SEQ ID NO: 5057253 - DNA, 12 bp, Homo sapiens
agaggcctgggg

SEQ ID NO: 5057254 - DNA, 21 bp, Homo sapiens
agaggcctgggggacccctgg

SEQ ID NO: 5057255 - DNA, 13 bp, Homo sapiens
agaggcctggggt

SEQ ID NO: 5057256 - DNA, 19 bp, Homo sapiens
agaggcctgggtgtgacct

SEQ ID NO: 5057257 - DNA, 11 bp, Homo sapiens
agaggcctggt

SEQ ID NO: 5057258 - DNA, 12 bp, Homo sapiens
agaggcctggtg

SEQ ID NO: 5057259 - DNA, 21 bp, Homo sapiens
agaggcctggtgccctggccc

SEQ ID NO: 5057260 - DNA, 22 bp, Homo sapiens
agaggcctggtgccctggccca

SEQ ID NO: 5057261 - DNA, 14 bp, Homo sapiens
agaggcctgttcat

SEQ ID NO: 5057262 - DNA, 15 bp, Homo sapiens
agaggcctgttcata

SEQ ID NO: 5057263 - DNA, 20 bp, Homo sapiens
agaggcctgtttggcctctc

SEQ ID NO: 5057264 - DNA, 21 bp, Homo sapiens
agaggccttgggggtctgctc

SEQ ID NO: 5057265 - DNA, 19 bp, Homo sapiens
agaggccttgggtgttcca

SEQ ID NO: 5057266 - DNA, 14 bp, Homo sapiens
agaggccttttgtt

SEQ ID NO: 5057267 - DNA, 21 bp, Homo sapiens
agaggcgcgtctgccccaccc

SEQ ID NO: 5057268 - DNA, 19 bp, Homo sapiens
agaggcggaaaccttgcag

SEQ ID NO: 5057269 - DNA, 20 bp, Homo sapiens
agaggcggaaaccttgcagc

SEQ ID NO: 5057270 - DNA, 13 bp, Homo sapiens
agaggcgggccag

SEQ ID NO: 5057271 - DNA, 16 bp, Homo sapiens
agaggcgggccagcca

SEQ ID NO: 5057272 - DNA, 18 bp, Homo sapiens
agaggcgggccagccagg

SEQ ID NO: 5057273 - DNA, 19 bp, Homo sapiens
agaggcgggccagccaggc

SEQ ID NO: 5057274 - DNA, 13 bp, Homo sapiens
agaggcggggcta

SEQ ID NO: 5057275 - DNA, 15 bp, Homo sapiens
agaggcggggctaca

SEQ ID NO: 5057276 - DNA, 18 bp, Homo sapiens
agaggcgtactacccagc

SEQ ID NO: 5057277 - DNA, 21 bp, Homo sapiens
agaggcgtactacccagctct

SEQ ID NO: 5057278 - DNA, 20 bp, Homo sapiens
agaggcgtctgctgtctcat

SEQ ID NO: 5057279 - DNA, 16 bp, Homo sapiens
agaggcgtctgtatat

SEQ ID NO: 5057280 - DNA, 14 bp, Homo sapiens
agaggcgtgtgcag

SEQ ID NO: 5057281 - DNA, 22 bp, Homo sapiens
agaggcgtgtgcaggccgacag

SEQ ID NO: 5057282 - DNA, 15 bp, Homo sapiens
agaggctaaaatgtt

SEQ ID NO: 5057283 - DNA, 20 bp, Homo sapiens
agaggctaacctcaaaatat

SEQ ID NO: 5057284 - DNA, 17 bp, Homo sapiens
agaggctagccccaggg

SEQ ID NO: 5057285 - DNA, 19 bp, Homo sapiens
agaggctagcttctgcttt

SEQ ID NO: 5057286 - DNA, 15 bp, Homo sapiens
agaggctatttaaaa

SEQ ID NO: 5057287 - DNA, 22 bp, Homo sapiens
agaggctcatggccctgtagtt

SEQ ID NO: 5057288 - DNA, 14 bp, Homo sapiens
agaggctccccagg

SEQ ID NO: 5057289 - DNA, 15 bp, Homo sapiens
agaggctccccaggg

SEQ ID NO: 5057290 - DNA, 14 bp, Homo sapiens
agaggctccctcct

SEQ ID NO: 5057291 - DNA, 15 bp, Homo sapiens
agaggctccctcctg

SEQ ID NO: 5057292 - DNA, 11 bp, Homo sapiens
agaggctcctg

SEQ ID NO: 5057293 - DNA, 17 bp, Homo sapiens
agaggctcctggagcca

SEQ ID NO: 5057294 - DNA, 18 bp, Homo sapiens
agaggctcctggagccag

SEQ ID NO: 5057295 - DNA, 18 bp, Homo sapiens
agaggctcgaggggctca

SEQ ID NO: 5057296 - DNA, 16 bp, Homo sapiens
agaggctctccgtgca

SEQ ID NO: 5057297 - DNA, 22 bp, Homo sapiens
agaggctctgaaagctgcttct

SEQ ID NO: 5057298 - DNA, 23 bp, Homo sapiens
agaggctctgaaagctgcttctg

SEQ ID NO: 5057299 - DNA, 20 bp, Homo sapiens
agaggctctggacagcagaa

SEQ ID NO: 5057300 - DNA, 22 bp, Homo sapiens
agaggctctggacagcagaagc

SEQ ID NO: 5057301 - DNA, 17 bp, Homo sapiens
agaggctctggggcagc

SEQ ID NO: 5057302 - DNA, 15 bp, Homo sapiens
agagggtgagggcct

SEQ ID NO: 5057303 - DNA, 21 bp, Homo sapiens
agagggtgagtcctccagaac

SEQ ID NO: 5057304 - DNA, 22 bp, Homo sapiens
agagggtgccggaaagagagct

SEQ ID NO: 5057305 - DNA, 13 bp, Homo sapiens
agagggtggggcc

SEQ ID NO: 5057306 - DNA, 17 bp, Homo sapiens
agagggtgggtgttcat

SEQ ID NO: 5057307 - DNA, 18 bp, Homo sapiens
agagggtgggtgttcata

SEQ ID NO: 5057308 - DNA, 22 bp, Homo sapiens
agagggtggtgacctctgcctg

SEQ ID NO: 5057309 - DNA, 16 bp, Homo sapiens
agagggtgtcctgcac

SEQ ID NO: 5057310 - DNA, 20 bp, Homo sapiens
agagggtgtcgtcctgcagt

SEQ ID NO: 5057311 - DNA, 20 bp, Homo sapiens
agagggttcacacagcccag

SEQ ID NO: 5057312 - DNA, 17 bp, Homo sapiens
agagggttgctggtcct

SEQ ID NO: 5057313 - DNA, 23 bp, Homo sapiens
agagggttttaggtagaaaaaca

SEQ ID NO: 5057314 - DNA, 18 bp, Homo sapiens
agagggttttctctccca

SEQ ID NO: 5057315 - DNA, 19 bp, Homo sapiens
agagggttttgattttaaa

SEQ ID NO: 5057316 - DNA, 16 bp, Homo sapiens
agaggtaaaaaaaaga

SEQ ID NO: 5057317 - DNA, 17 bp, Homo sapiens
agaggtaaaaaaaagaa

SEQ ID NO: 5057318 - DNA, 18 bp, Homo sapiens
agaggtaaaagtgtgagc

SEQ ID NO: 5057319 - DNA, 19 bp, Homo sapiens
agaggtaaaagtgtgagca

SEQ ID NO: 5057320 - DNA, 23 bp, Homo sapiens
agaggtaaaagtgtgagcagtga

SEQ ID NO: 5057321 - DNA, 16 bp, Homo sapiens
agaggtaacagaacag

SEQ ID NO: 5057322 - DNA, 18 bp, Homo sapiens
agaggtaacagaacagct

SEQ ID NO: 5057323 - DNA, 19 bp, Homo sapiens
agaggtacagggtttttac

SEQ ID NO: 5057324 - DNA, 18 bp, Homo sapiens
agaggtacccaaggtcac

SEQ ID NO: 5057325 - DNA, 18 bp, Homo sapiens
agaggtagcactctcaga

SEQ ID NO: 5057326 - DNA, 15 bp, Homo sapiens
agaggtagccgggct

SEQ ID NO: 5057327 - DNA, 15 bp, Homo sapiens
agaggtagtgtgaat

SEQ ID NO: 5057328 - DNA, 13 bp, Homo sapiens
agaggtataattg

SEQ ID NO: 5057329 - DNA, 19 bp, Homo sapiens
agaggtatgtcagaaaaaa

SEQ ID NO: 5057330 - DNA, 15 bp, Homo sapiens
agaggtatgtgcccc

SEQ ID NO: 5057331 - DNA, 21 bp, Homo sapiens
agaggtatgtgcccctcctgg

SEQ ID NO: 5057332 - DNA, 22 bp, Homo sapiens
agaggtatgtgcccctcctggg

SEQ ID NO: 5057333 - DNA, 17 bp, Homo sapiens
agaggtatttatcttta

SEQ ID NO: 5057334 - DNA, 16 bp, Homo sapiens
agaggtcacaaagaat

SEQ ID NO: 5057335 - DNA, 14 bp, Homo sapiens
agaggtcaccagct

SEQ ID NO: 5057336 - DNA, 19 bp, Homo sapiens
agaggtcaggacggctcct

SEQ ID NO: 5057337 - DNA, 21 bp, Homo sapiens
agaggtcatcccttcctcctc

SEQ ID NO: 5057338 - DNA, 16 bp, Homo sapiens
agaggtccagagtcct

SEQ ID NO: 5057339 - DNA, 17 bp, Homo sapiens
agaggtccagcccatct

SEQ ID NO: 5057340 - DNA, 18 bp, Homo sapiens
agaggtccagcccatctc

SEQ ID NO: 5057341 - DNA, 18 bp, Homo sapiens
agaggtccaggtcccagc

SEQ ID NO: 5057342 - DNA, 17 bp, Homo sapiens
agaggtcccagccccag

SEQ ID NO: 5057343 - DNA, 21 bp, Homo sapiens
agaggtcccagccccaggcct

SEQ ID NO: 5057344 - DNA, 12 bp, Homo sapiens
agaggtccctgc

SEQ ID NO: 5057345 - DNA, 16 bp, Homo sapiens
agaggtccctgcttac

SEQ ID NO: 5057346 - DNA, 18 bp, Homo sapiens
agaggtccctgcttacct

SEQ ID NO: 5057347 - DNA, 18 bp, Homo sapiens
agaggtcctctggagccc

SEQ ID NO: 5057348 - DNA, 16 bp, Homo sapiens
agaggtctcatctccc

SEQ ID NO: 5057349 - DNA, 13 bp, Homo sapiens
agaggtctccaaa

SEQ ID NO: 5057350 - DNA, 12 bp, Homo sapiens
agaggtctccct

SEQ ID NO: 5057351 - DNA, 12 bp, Homo sapiens
agaggtctgagc

SEQ ID NO: 5057352 - DNA, 15 bp, Homo sapiens
agaggtctgagccct

SEQ ID NO: 5057353 - DNA, 14 bp, Homo sapiens
agaggtctgattgg

SEQ ID NO: 5057354 - DNA, 15 bp, Homo sapiens
agaggtctgattggc

SEQ ID NO: 5057355 - DNA, 17 bp, Homo sapiens
agaggtctgattggctg

SEQ ID NO: 5057356 - DNA, 19 bp, Homo sapiens
agaggtctgattggctgct

SEQ ID NO: 5057357 - DNA, 13 bp, Homo sapiens
agaggtctgtgct

SEQ ID NO: 5057358 - DNA, 16 bp, Homo sapiens
agaggtctgtgctgag

SEQ ID NO: 5057359 - DNA, 18 bp, Homo sapiens
agaggtctgtgctgaggc

SEQ ID NO: 5057360 - DNA, 17 bp, Homo sapiens
agaggtcttgatctttg

SEQ ID NO: 5057361 - DNA, 16 bp, Homo sapiens
agaggtgaaaatgaag

SEQ ID NO: 5057362 - DNA, 17 bp, Homo sapiens
agaggtgaaaatgaaga

SEQ ID NO: 5057363 - DNA, 20 bp, Homo sapiens
agaggtgacccaatgctcct

SEQ ID NO: 5057364 - DNA, 15 bp, Homo sapiens
agaggtgaccccagg

SEQ ID NO: 5057365 - DNA, 17 bp, Homo sapiens
agaggtgaccccagggc

SEQ ID NO: 5057366 - DNA, 18 bp, Homo sapiens
agaggtgaccccagggca

SEQ ID NO: 5057367 - DNA, 23 bp, Homo sapiens
agaggtgaccccagggcacagga

SEQ ID NO: 5057368 - DNA, 15 bp, Homo sapiens
agaggtgcaagacct

SEQ ID NO: 5057369 - DNA, 22 bp, Homo sapiens
agaggtgcacttggggcacagg

SEQ ID NO: 5057370 - DNA, 12 bp, Homo sapiens
agaggtgccagc

SEQ ID NO: 5057371 - DNA, 16 bp, Homo sapiens
agaggtgccagcaact

SEQ ID NO: 5057372 - DNA, 21 bp, Homo sapiens
agaggtgccagcaactgaata

SEQ ID NO: 5057373 - DNA, 23 bp, Homo sapiens
agaggtgccggggaggggcagag

SEQ ID NO: 5057374 - DNA, 17 bp, Homo sapiens
agaggtgcctgggagga

SEQ ID NO: 5057375 - DNA, 21 bp, Homo sapiens
agaggtgcctgggaggagtgg

SEQ ID NO: 5057376 - DNA, 14 bp, Homo sapiens
agaggtgctgcttt

SEQ ID NO: 5057377 - DNA, 15 bp, Homo sapiens
agaggtgctgctttg

SEQ ID NO: 5057378 - DNA, 16 bp, Homo sapiens
agaggtgctgctttgc

SEQ ID NO: 5057379 - DNA, 20 bp, Homo sapiens
agaggtgcttctgcctgtgc

SEQ ID NO: 5057380 - DNA, 17 bp, Homo sapiens
agaggtggatcctgtag

SEQ ID NO: 5057381 - DNA, 22 bp, Homo sapiens
agaggtggatcctgtaggctaa

SEQ ID NO: 5057382 - DNA, 12 bp, Homo sapiens
agaggtggatgt

SEQ ID NO: 5057383 - DNA, 20 bp, Homo sapiens
agaggtggatgttatgaaca

SEQ ID NO: 5057384 - DNA, 21 bp, Homo sapiens
agaggtggatgttatgaacag

SEQ ID NO: 5057385 - DNA, 22 bp, Homo sapiens
agaggtggatgttatgaacagc

SEQ ID NO: 5057386 - DNA, 23 bp, Homo sapiens
agaggtggatgttatgaacagct

SEQ ID NO: 5057387 - DNA, 11 bp, Homo sapiens
agaggtggccc

SEQ ID NO: 5057388 - DNA, 23 bp, Homo sapiens
agaggtggctgcgcccccagctt

SEQ ID NO: 5057389 - DNA, 23 bp, Homo sapiens
agaggtgggaggcccctggtggc

SEQ ID NO: 5057390 - DNA, 19 bp, Homo sapiens
agcagcctcgaggctggtg

SEQ ID NO: 5057391 - DNA, 22 bp, Homo sapiens
agcagcctcgcacaggccctag

SEQ ID NO: 5057392 - DNA, 21 bp, Homo sapiens
agcagcctcgcccctggcaga

SEQ ID NO: 5057393 - DNA, 14 bp, Homo sapiens
agcagcctcgtgga

SEQ ID NO: 5057394 - DNA, 15 bp, Homo sapiens
agcagcctcgtggag

SEQ ID NO: 5057395 - DNA, 20 bp, Homo sapiens
agcagcctctccccaggtcc

SEQ ID NO: 5057396 - DNA, 12 bp, Homo sapiens
agcagcctctga

SEQ ID NO: 5057397 - DNA, 16 bp, Homo sapiens
agcagcctctgatctg

SEQ ID NO: 5057398 - DNA, 23 bp, Homo sapiens
agcagcctgagcaactcttgatt

SEQ ID NO: 5057399 - DNA, 14 bp, Homo sapiens
agcagcctgatggc

SEQ ID NO: 5057400 - DNA, 20 bp, Homo sapiens
agcagcctgatggccaaggg

SEQ ID NO: 5057401 - DNA, 12 bp, Homo sapiens
agcagcctgcac

SEQ ID NO: 5057402 - DNA, 14 bp, Homo sapiens
agcagcctggagac

SEQ ID NO: 5057403 - DNA, 15 bp, Homo sapiens
agcagcctggagact

SEQ ID NO: 5057404 - DNA, 14 bp, Homo sapiens
agcagcctggagcc

SEQ ID NO: 5057405 - DNA, 16 bp, Homo sapiens
agcagcctggagccct

SEQ ID NO: 5057406 - DNA, 19 bp, Homo sapiens
agcagcctggagccctgga

SEQ ID NO: 5057407 - DNA, 12 bp, Homo sapiens
agcagcctggcc

SEQ ID NO: 5057408 - DNA, 14 bp, Homo sapiens
agcagcctggctcc

SEQ ID NO: 5057409 - DNA, 16 bp, Homo sapiens
agcagcctgtgaggga

SEQ ID NO: 5057410 - DNA, 20 bp, Homo sapiens
agcagcctgtgagggagtgc

SEQ ID NO: 5057411 - DNA, 18 bp, Homo sapiens
agcagcgaccacccctgc

SEQ ID NO: 5057412 - DNA, 23 bp, Homo sapiens
agcagcgaccgccccctcctcta

SEQ ID NO: 5057413 - DNA, 13 bp, Homo sapiens
agcagcgagcctg

SEQ ID NO: 5057414 - DNA, 14 bp, Homo sapiens
agcagcgagcctgc

SEQ ID NO: 5057415 - DNA, 14 bp, Homo sapiens
agcagcgcccaggc

SEQ ID NO: 5057416 - DNA, 20 bp, Homo sapiens
agcagcgcccaggcctgctg

SEQ ID NO: 5057417 - DNA, 21 bp, Homo sapiens
agcagcgcccaggcctgctgg

SEQ ID NO: 5057418 - DNA, 15 bp, Homo sapiens
agcagcgcccgaggc

SEQ ID NO: 5057419 - DNA, 21 bp, Homo sapiens
agcagcgcccgaggccagggc

SEQ ID NO: 5057420 - DNA, 16 bp, Homo sapiens
agcagcgcgcaggcct

SEQ ID NO: 5057421 - DNA, 15 bp, Homo sapiens
agcagcggcccagat

SEQ ID NO: 5057422 - DNA, 15 bp, Homo sapiens
agcagcggctctggt

SEQ ID NO: 5057423 - DNA, 22 bp, Homo sapiens
agcagcgggggcggcccagcct

SEQ ID NO: 5057424 - DNA, 18 bp, Homo sapiens
agcagctaaattttctga

SEQ ID NO: 5057425 - DNA, 20 bp, Homo sapiens
agcagctaactccgagagca

SEQ ID NO: 5057426 - DNA, 14 bp, Homo sapiens
agcagctactgtaa

SEQ ID NO: 5057427 - DNA, 15 bp, Homo sapiens
agcagctactgtaac

SEQ ID NO: 5057428 - DNA, 15 bp, Homo sapiens
agcagctagaaagag

SEQ ID NO: 5057429 - DNA, 14 bp, Homo sapiens
agcagctagagctc

SEQ ID NO: 5057430 - DNA, 14 bp, Homo sapiens
agcagctagcaagg

SEQ ID NO: 5057431 - DNA, 12 bp, Homo sapiens
agcagctagctg

SEQ ID NO: 5057432 - DNA, 16 bp, Homo sapiens
agcagctcaaaggcac

SEQ ID NO: 5057433 - DNA, 19 bp, Homo sapiens
agcagctcaaaggcacagt

SEQ ID NO: 5057434 - DNA, 12 bp, Homo sapiens
agcagctcaggc

SEQ ID NO: 5057435 - DNA, 21 bp, Homo sapiens
agcagctcaggcacacttctt

SEQ ID NO: 5057436 - DNA, 22 bp, Homo sapiens
agcagctcaggcgcagccctag

SEQ ID NO: 5057437 - DNA, 19 bp, Homo sapiens
agcagctccaacctggagg

SEQ ID NO: 5057438 - DNA, 20 bp, Homo sapiens
agcagctccaacctggaggc

SEQ ID NO: 5057439 - DNA, 18 bp, Homo sapiens
agcagctccccaggagct

SEQ ID NO: 5057440 - DNA, 21 bp, Homo sapiens
agcagctccccaggagctcag

SEQ ID NO: 5057441 - DNA, 15 bp, Homo sapiens
agcagctcccctggg

SEQ ID NO: 5057442 - DNA, 19 bp, Homo sapiens
agcagctccctttctcagg

SEQ ID NO: 5057443 - DNA, 18 bp, Homo sapiens
agcagctccgcctggcac

SEQ ID NO: 5057444 - DNA, 21 bp, Homo sapiens
agcagctccttcctagccttg

SEQ ID NO: 5057445 - DNA, 18 bp, Homo sapiens
agcagctctaaaacatag

SEQ ID NO: 5057446 - DNA, 14 bp, Homo sapiens
agcagctctcccct

SEQ ID NO: 5057447 - DNA, 17 bp, Homo sapiens
agcagctctgagccaga

SEQ ID NO: 5057448 - DNA, 14 bp, Homo sapiens
agcagctctggctc

SEQ ID NO: 5057449 - DNA, 17 bp, Homo sapiens
agcagctctggctctgc

SEQ ID NO: 5057450 - DNA, 20 bp, Homo sapiens
agcagctcttcccctttcct

SEQ ID NO: 5057451 - DNA, 21 bp, Homo sapiens
agcagctcttcccctttcctg

SEQ ID NO: 5057452 - DNA, 16 bp, Homo sapiens
agcagctcttgctaat

SEQ ID NO: 5057453 - DNA, 17 bp, Homo sapiens
agcagctcttgctaatc

SEQ ID NO: 5057454 - DNA, 19 bp, Homo sapiens
agcagctgaagaaaaaatc

SEQ ID NO: 5057455 - DNA, 19 bp, Homo sapiens
agcagctgaagccagctcc

SEQ ID NO: 5057456 - DNA, 20 bp, Homo sapiens
agcagctgaagccagctccc

SEQ ID NO: 5057457 - DNA, 21 bp, Homo sapiens
agcagctgaagtctctttttc

SEQ ID NO: 5057458 - DNA, 19 bp, Homo sapiens
agcagctgaataacctgca

SEQ ID NO: 5057459 - DNA, 21 bp, Homo sapiens
agcagctgaataacctgcaca

SEQ ID NO: 5057460 - DNA, 22 bp, Homo sapiens
agcagctgaataacctgcacag

SEQ ID NO: 5057461 - DNA, 12 bp, Homo sapiens
agcagctgagca

SEQ ID NO: 5057462 - DNA, 18 bp, Homo sapiens
agcagctgagcagggccg

SEQ ID NO: 5057463 - DNA, 17 bp, Homo sapiens
agcagctgatgcctcct

SEQ ID NO: 5057464 - DNA, 14 bp, Homo sapiens
agcagctgatgctg

SEQ ID NO: 5057465 - DNA, 21 bp, Homo sapiens
agcagctgcaccccagcgtca

SEQ ID NO: 5057466 - DNA, 19 bp, Homo sapiens
agcagctgcaggggcctct

SEQ ID NO: 5057467 - DNA, 18 bp, Homo sapiens
agcagctgccaggagcac

SEQ ID NO: 5057468 - DNA, 21 bp, Homo sapiens
agcagctgccaggagcacggc

SEQ ID NO: 5057469 - DNA, 12 bp, Homo sapiens
agcagctgcggg

SEQ ID NO: 5057470 - DNA, 12 bp, Homo sapiens
agcagctgctac

SEQ ID NO: 5057471 - DNA, 13 bp, Homo sapiens
agcagctggactg

SEQ ID NO: 5057472 - DNA, 14 bp, Homo sapiens
agcagctggactgg

SEQ ID NO: 5057473 - DNA, 17 bp, Homo sapiens
agcagctggactgggtg

SEQ ID NO: 5057474 - DNA, 17 bp, Homo sapiens
agcagctggcactgaca

SEQ ID NO: 5057475 - DNA, 22 bp, Homo sapiens
agcagctggcactgacagcctg

SEQ ID NO: 5057476 - DNA, 23 bp, Homo sapiens
agcagctggcactgacagcctgg

SEQ ID NO: 5057477 - DNA, 21 bp, Homo sapiens
agcagctgggacccctcccaa

SEQ ID NO: 5057478 - DNA, 12 bp, Homo sapiens
agcagctgggcc

SEQ ID NO: 5057479 - DNA, 23 bp, Homo sapiens
agcagctgggccggccagccttg

SEQ ID NO: 5057480 - DNA, 16 bp, Homo sapiens
agcagggctgggctct

SEQ ID NO: 5057481 - DNA, 16 bp, Homo sapiens
agcagggctggtcacc

SEQ ID NO: 5057482 - DNA, 18 bp, Homo sapiens
agcaggggaagcaggacc

SEQ ID NO: 5057483 - DNA, 21 bp, Homo sapiens
agcaggggaattccctccccc

SEQ ID NO: 5057484 - DNA, 23 bp, Homo sapiens
agcaggggaattccctccccctc

SEQ ID NO: 5057485 - DNA, 18 bp, Homo sapiens
agcaggggagcttgggac

SEQ ID NO: 5057486 - DNA, 19 bp, Homo sapiens
agcaggggagcttgggact

SEQ ID NO: 5057487 - DNA, 13 bp, Homo sapiens
agcaggggcaggc

SEQ ID NO: 5057488 - DNA, 20 bp, Homo sapiens
agcaggggccaagcaggcac

SEQ ID NO: 5057489 - DNA, 13 bp, Homo sapiens
agcaggggcccct

SEQ ID NO: 5057490 - DNA, 19 bp, Homo sapiens
agcaggggctacaagaggg

SEQ ID NO: 5057491 - DNA, 14 bp, Homo sapiens
agcaggggctccag

SEQ ID NO: 5057492 - DNA, 18 bp, Homo sapiens
agcaggggctgcccgagt

SEQ ID NO: 5057493 - DNA, 13 bp, Homo sapiens
agcaggggctgct

SEQ ID NO: 5057494 - DNA, 14 bp, Homo sapiens
agcaggggctgctg

SEQ ID NO: 5057495 - DNA, 23 bp, Homo sapiens
agcaggggctgctgggggctccc

SEQ ID NO: 5057496 - DNA, 18 bp, Homo sapiens
agcaggggggctgtgcca

SEQ ID NO: 5057497 - DNA, 23 bp, Homo sapiens
agcaggggggctgtgccaacctg

SEQ ID NO: 5057498 - DNA, 20 bp, Homo sapiens
agcaggggggttgggttcca

SEQ ID NO: 5057499 - DNA, 17 bp, Homo sapiens
agcaggggtgggaggct

SEQ ID NO: 5057500 - DNA, 13 bp, Homo sapiens
agcagggtccaca

SEQ ID NO: 5057501 - DNA, 17 bp, Homo sapiens
agcagggtccacagctg

SEQ ID NO: 5057502 - DNA, 18 bp, Homo sapiens
agcagggtccacagctgg

SEQ ID NO: 5057503 - DNA, 22 bp, Homo sapiens
agcagggtcttttcatctggga

SEQ ID NO: 5057504 - DNA, 14 bp, Homo sapiens
agcagggtgacccc

SEQ ID NO: 5057505 - DNA, 17 bp, Homo sapiens
agcagggtgttgggata

SEQ ID NO: 5057506 - DNA, 15 bp, Homo sapiens
agcagggtttgagca

SEQ ID NO: 5057507 - DNA, 17 bp, Homo sapiens
agcagggtttgagcaca

SEQ ID NO: 5057508 - DNA, 18 bp, Homo sapiens
agcagggtttgagcacaa

SEQ ID NO: 5057509 - DNA, 19 bp, Homo sapiens
agcagggtttgagcacaat

SEQ ID NO: 5057510 - DNA, 22 bp, Homo sapiens
agcaggtagaagaaaagttggg

SEQ ID NO: 5057511 - DNA, 14 bp, Homo sapiens
agcaggtcacactg

SEQ ID NO: 5057512 - DNA, 15 bp, Homo sapiens
agcaggtctctggca

SEQ ID NO: 5057513 - DNA, 18 bp, Homo sapiens
agcaggtctgcaggccac

SEQ ID NO: 5057514 - DNA, 13 bp, Homo sapiens
agcaggtgactgt

SEQ ID NO: 5057515 - DNA, 19 bp, Homo sapiens
agcaggtgattggaccagg

SEQ ID NO: 5057516 - DNA, 20 bp, Homo sapiens
agcaggtgattggaccaggc

SEQ ID NO: 5057517 - DNA, 23 bp, Homo sapiens
agcaggtgcaagagacagagccc

SEQ ID NO: 5057518 - DNA, 13 bp, Homo sapiens
agcaggtgctgac

SEQ ID NO: 5057519 - DNA, 15 bp, Homo sapiens
agcaggtgctgctac

SEQ ID NO: 5057520 - DNA, 20 bp, Homo sapiens
agcaggtgctgctaccctcc

SEQ ID NO: 5057521 - DNA, 16 bp, Homo sapiens
agcaggtgctgggctg

SEQ ID NO: 5057522 - DNA, 13 bp, Homo sapiens
agcaggtggcttg

SEQ ID NO: 5057523 - DNA, 22 bp, Homo sapiens
agcaggtgtcctttcccctctc

SEQ ID NO: 5057524 - DNA, 23 bp, Homo sapiens
agcaggtgtctttaactgtcatt

SEQ ID NO: 5057525 - DNA, 14 bp, Homo sapiens
agcaggtgtggtgg

SEQ ID NO: 5057526 - DNA, 16 bp, Homo sapiens
agcaggttcccaagct

SEQ ID NO: 5057527 - DNA, 17 bp, Homo sapiens
agcaggttcccaagctc

SEQ ID NO: 5057528 - DNA, 16 bp, Homo sapiens
agcaggttccccaagg

SEQ ID NO: 5057529 - DNA, 18 bp, Homo sapiens
agcaggttccccaagggc

SEQ ID NO: 5057530 - DNA, 21 bp, Homo sapiens
agcaggttccccaagggccct

SEQ ID NO: 5057531 - DNA, 19 bp, Homo sapiens
agcaggttctctcctgtga

SEQ ID NO: 5057532 - DNA, 15 bp, Homo sapiens
agcaggttgaatggg

SEQ ID NO: 5057533 - DNA, 18 bp, Homo sapiens
agcaggttgataaatcat

SEQ ID NO: 5057534 - DNA, 16 bp, Homo sapiens
agcaggttgttattta

SEQ ID NO: 5057535 - DNA, 13 bp, Homo sapiens
agcaggtttgttt

SEQ ID NO: 5057536 - DNA, 17 bp, Homo sapiens
agcagtaaaataaaaaa

SEQ ID NO: 5057537 - DNA, 13 bp, Homo sapiens
agcagtaaaatag

SEQ ID NO: 5057538 - DNA, 20 bp, Homo sapiens
agcagtaaatacttgcagtt

SEQ ID NO: 5057539 - DNA, 17 bp, Homo sapiens
agcagtaactgtccctg

SEQ ID NO: 5057540 - DNA, 14 bp, Homo sapiens
agcagtaagcaggc

SEQ ID NO: 5057541 - DNA, 16 bp, Homo sapiens
agcagtaagcaggcct

SEQ ID NO: 5057542 - DNA, 14 bp, Homo sapiens
agcagtacaataaa

SEQ ID NO: 5057543 - DNA, 15 bp, Homo sapiens
agcagtacaataaaa

SEQ ID NO: 5057544 - DNA, 22 bp, Homo sapiens
agcagtacacttggatgcagtg

SEQ ID NO: 5057545 - DNA, 16 bp, Homo sapiens
agcagtacatcttgtg

SEQ ID NO: 5057546 - DNA, 11 bp, Homo sapiens
agcagtacatg

SEQ ID NO: 5057547 - DNA, 17 bp, Homo sapiens
agcagtaccagcgctct

SEQ ID NO: 5057548 - DNA, 15 bp, Homo sapiens
agcagtaccatccca

SEQ ID NO: 5057549 - DNA, 18 bp, Homo sapiens
agcagtaccatcccactg

SEQ ID NO: 5057550 - DNA, 19 bp, Homo sapiens
agcagtaccatcccactga

SEQ ID NO: 5057551 - DNA, 16 bp, Homo sapiens
agcagtaccctagcct

SEQ ID NO: 5057552 - DNA, 19 bp, Homo sapiens
agcagtacgtggcttcaga

SEQ ID NO: 5057553 - DNA, 14 bp, Homo sapiens
agcagtactctgaa

SEQ ID NO: 5057554 - DNA, 23 bp, Homo sapiens
agcagtagacattttaacaagaa

SEQ ID NO: 5057555 - DNA, 15 bp, Homo sapiens
agcagtatataataa

SEQ ID NO: 5057556 - DNA, 20 bp, Homo sapiens
agcagtatataataacttta

SEQ ID NO: 5057557 - DNA, 12 bp, Homo sapiens
agcagtatctca

SEQ ID NO: 5057558 - DNA, 17 bp, Homo sapiens
agcagtatgaatgatgt

SEQ ID NO: 5057559 - DNA, 18 bp, Homo sapiens
agcagtatgtgtgctctt

SEQ ID NO: 5057560 - DNA, 22 bp, Homo sapiens
agcagtatgtgtgctcttatcc

SEQ ID NO: 5057561 - DNA, 13 bp, Homo sapiens
agcagtattttgg

SEQ ID NO: 5057562 - DNA, 12 bp, Homo sapiens
agcagtcaatta

SEQ ID NO: 5057563 - DNA, 13 bp, Homo sapiens
agcagtcacactg

SEQ ID NO: 5057564 - DNA, 20 bp, Homo sapiens
agcagtcacactgttactcc

SEQ ID NO: 5057565 - DNA, 20 bp, Homo sapiens
agcagtcacaggcccaggaa

SEQ ID NO: 5057566 - DNA, 20 bp, Homo sapiens
agcagtcccagtattctcag

SEQ ID NO: 5057567 - DNA, 19 bp, Homo sapiens
agcagtccccagctgagtg

SEQ ID NO: 5057568 - DNA, 16 bp, Homo sapiens
agcagtccccttccct

SEQ ID NO: 5057569 - DNA, 18 bp, Homo sapiens
agcagtccccttccctcc

SEQ ID NO: 5057570 - DNA, 13 bp, Homo sapiens
agcagtccctgct

SEQ ID NO: 5057571 - DNA, 19 bp, Homo sapiens
agcagtcctcttattccta

SEQ ID NO: 5057572 - DNA, 22 bp, Homo sapiens
agagtctctccagcctcacaga

SEQ ID NO: 5057573 - DNA, 20 bp, Homo sapiens
agagtctctgatacacagta

SEQ ID NO: 5057574 - DNA, 18 bp, Homo sapiens
agagtctctggctcagct

SEQ ID NO: 5057575 - DNA, 23 bp, Homo sapiens
agagtctctggctcagctgtggt

SEQ ID NO: 5057576 - DNA, 16 bp, Homo sapiens
agagtctgacaggaag

SEQ ID NO: 5057577 - DNA, 14 bp, Homo sapiens
agagtctgagcccc

SEQ ID NO: 5057578 - DNA, 15 bp, Homo sapiens
agagtctgagccccc

SEQ ID NO: 5057579 - DNA, 13 bp, Homo sapiens
agagtctggagct

SEQ ID NO: 5057580 - DNA, 19 bp, Homo sapiens
agagtctggagctgagcta

SEQ ID NO: 5057581 - DNA, 23 bp, Homo sapiens
agagtctggataacttccacagg

SEQ ID NO: 5057582 - DNA, 15 bp, Homo sapiens
agagtctggccctag

SEQ ID NO: 5057583 - DNA, 13 bp, Homo sapiens
agagtctgggcct

SEQ ID NO: 5057584 - DNA, 16 bp, Homo sapiens
agagtctgggcctctg

SEQ ID NO: 5057585 - DNA, 22 bp, Homo sapiens
agagtctggtctgcgccttggg

SEQ ID NO: 5057586 - DNA, 18 bp, Homo sapiens
agagtctggtgaagctca

SEQ ID NO: 5057587 - DNA, 13 bp, Homo sapiens
agagtctgtcttg

SEQ ID NO: 5057588 - DNA, 17 bp, Homo sapiens
agagtcttaattttcta

SEQ ID NO: 5057589 - DNA, 18 bp, Homo sapiens
agagtcttaattttctaa

SEQ ID NO: 5057590 - DNA, 22 bp, Homo sapiens
agagtcttacaatcaaatctcc

SEQ ID NO: 5057591 - DNA, 10 bp, Homo sapiens
agagtcttcc

SEQ ID NO: 5057592 - DNA, 23 bp, Homo sapiens
agagtcttccaaggccagaagga

SEQ ID NO: 5057593 - DNA, 22 bp, Homo sapiens
agagtctttgtaagtaaactgc

SEQ ID NO: 5057594 - DNA, 16 bp, Homo sapiens
agagtgaaaaagagaa

SEQ ID NO: 5057595 - DNA, 14 bp, Homo sapiens
agagtgaaagggct

SEQ ID NO: 5057596 - DNA, 16 bp, Homo sapiens
agagtgaaataaaatg

SEQ ID NO: 5057597 - DNA, 22 bp, Homo sapiens
agagtgaaataattaaaaacca

SEQ ID NO: 5057598 - DNA, 18 bp, Homo sapiens
agagtgaaatattgtaaa

SEQ ID NO: 5057599 - DNA, 13 bp, Homo sapiens
agagtgaagagca

SEQ ID NO: 5057600 - DNA, 18 bp, Homo sapiens
agagtgaagagtgaagag

SEQ ID NO: 5057601 - DNA, 20 bp, Homo sapiens
agagtgaagagtgaagagca

SEQ ID NO: 5057602 - DNA, 14 bp, Homo sapiens
agagtgaatttcag

SEQ ID NO: 5057603 - DNA, 14 bp, Homo sapiens
agagtgacagtcat

SEQ ID NO: 5057604 - DNA, 16 bp, Homo sapiens
agagtgacctcggaca

SEQ ID NO: 5057605 - DNA, 20 bp, Homo sapiens
agagtgaccttttaatcaga

SEQ ID NO: 5057606 - DNA, 17 bp, Homo sapiens
agagtgacttggagaga

SEQ ID NO: 5057607 - DNA, 13 bp, Homo sapiens
agagtgagaataa

SEQ ID NO: 5057608 - DNA, 21 bp, Homo sapiens
agagtgagaataattgtgtac

SEQ ID NO: 5057609 - DNA, 23 bp, Homo sapiens
agagtgagaataattgtgtacaa

SEQ ID NO: 5057610 - DNA, 15 bp, Homo sapiens
agagtgagaatctgg

SEQ ID NO: 5057611 - DNA, 15 bp, Homo sapiens
agagtgagaccctgt

SEQ ID NO: 5057612 - DNA, 11 bp, Homo sapiens
agagtgagaga

SEQ ID NO: 5057613 - DNA, 22 bp, Homo sapiens
agagtgagagacattaactcat

SEQ ID NO: 5057614 - DNA, 22 bp, Homo sapiens
agagtgagagagagtgagagca

SEQ ID NO: 5057615 - DNA, 17 bp, Homo sapiens
agagtgagagcacaaag

SEQ ID NO: 5057616 - DNA, 22 bp, Homo sapiens
agagtgagctacagagccgagc

SEQ ID NO: 5057617 - DNA, 14 bp, Homo sapiens
agagtgagctctgg

SEQ ID NO: 5057618 - DNA, 15 bp, Homo sapiens
agagtgagctctggt

SEQ ID NO: 5057619 - DNA, 16 bp, Homo sapiens
agagtgagggctccct

SEQ ID NO: 5057620 - DNA, 20 bp, Homo sapiens
agagtgatagtcttttgctt

SEQ ID NO: 5057621 - DNA, 18 bp, Homo sapiens
agagtgatttgtaaaaca

SEQ ID NO: 5057622 - DNA, 23 bp, Homo sapiens
agagtgatttgtaaaacagtggt

SEQ ID NO: 5057623 - DNA, 15 bp, Homo sapiens
agagtgcaaattgta

SEQ ID NO: 5057624 - DNA, 22 bp, Homo sapiens
agagtgcaacagtagcatagga

SEQ ID NO: 5057625 - DNA, 19 bp, Homo sapiens
agagtgcaacccagtcaca

SEQ ID NO: 5057626 - DNA, 13 bp, Homo sapiens
agagtgcaatggt

SEQ ID NO: 5057627 - DNA, 14 bp, Homo sapiens
agagtgcacagctg

SEQ ID NO: 5057628 - DNA, 15 bp, Homo sapiens
agagtgcactgacct

SEQ ID NO: 5057629 - DNA, 13 bp, Homo sapiens
agagtgcactgct

SEQ ID NO: 5057630 - DNA, 23 bp, Homo sapiens
agagtgcaggtgcagtttcattc

SEQ ID NO: 5057631 - DNA, 22 bp, Homo sapiens
agagtgcataaataattttgtt

SEQ ID NO: 5057632 - DNA, 18 bp, Homo sapiens
agagtgccactgcgggag

SEQ ID NO: 5057633 - DNA, 17 bp, Homo sapiens
agagtgccagtcagcag

SEQ ID NO: 5057634 - DNA, 11 bp, Homo sapiens
agagtgcccat

SEQ ID NO: 5057635 - DNA, 19 bp, Homo sapiens
agagtgccccacctgccac

SEQ ID NO: 5057636 - DNA, 16 bp, Homo sapiens
agagtgccctgctttg

SEQ ID NO: 5057637 - DNA, 21 bp, Homo sapiens
agagtgccctgctttgcaaac

SEQ ID NO: 5057638 - DNA, 22 bp, Homo sapiens
agagtgccctgctttgcaaaca

SEQ ID NO: 5057639 - DNA, 23 bp, Homo sapiens
agagtgccctggggcatccacct

SEQ ID NO: 5057640 - DNA, 21 bp, Homo sapiens
agagtgctaagcattagcttt

SEQ ID NO: 5057641 - DNA, 22 bp, Homo sapiens
agagtgctaagcattagcttta

SEQ ID NO: 5057642 - DNA, 21 bp, Homo sapiens
agagtgctctgaccctgggct

SEQ ID NO: 5057643 - DNA, 20 bp, Homo sapiens
agagtgctgagaaggacacc

SEQ ID NO: 5057644 - DNA, 16 bp, Homo sapiens
agagtgctgaggggca

SEQ ID NO: 5057645 - DNA, 22 bp, Homo sapiens
agagtgctgaggggcactctcc

SEQ ID NO: 5057646 - DNA, 15 bp, Homo sapiens
agagtgctggactgt

SEQ ID NO: 5057647 - DNA, 21 bp, Homo sapiens
agagtgctgtccggtggagat

SEQ ID NO: 5057648 - DNA, 19 bp, Homo sapiens
agagtgctgtcgggaccac

SEQ ID NO: 5057649 - DNA, 18 bp, Homo sapiens
agagtggaaactcagccg

SEQ ID NO: 5057650 - DNA, 17 bp, Homo sapiens
agagtggaaatggggaa

SEQ ID NO: 5057651 - DNA, 21 bp, Homo sapiens
agagtggaaattacccactgt

SEQ ID NO: 5057652 - DNA, 22 bp, Homo sapiens
agagtggaaggactgtggctgc

SEQ ID NO: 5057653 - DNA, 16 bp, Homo sapiens
agagtggaataagaca

SEQ ID NO: 5057654 - DNA, 18 bp, Homo sapiens
agagtggaataaggatgt

SEQ ID NO: 5057655 - DNA, 22 bp, Homo sapiens
agagtggaatgcttcctagaag

SEQ ID NO: 5057656 - DNA, 16 bp, Homo sapiens
agagtggactgcattt

SEQ ID NO: 5057657 - DNA, 15 bp, Homo sapiens
ataaattaacattat

SEQ ID NO: 5057658 - DNA, 22 bp, Homo sapiens
ataaattaagatcctaaactct

SEQ ID NO: 5057659 - DNA, 13 bp, Homo sapiens
ataaattaataaa

SEQ ID NO: 5057660 - DNA, 17 bp, Homo sapiens
ataaattaataaattta

SEQ ID NO: 5057661 - DNA, 16 bp, Homo sapiens
ataaattaatacagag

SEQ ID NO: 5057662 - DNA, 23 bp, Homo sapiens
ataaattaatacataagttaata

SEQ ID NO: 5057663 - DNA, 15 bp, Homo sapiens
ataaattaatattgt

SEQ ID NO: 5057664 - DNA, 14 bp, Homo sapiens
ataaattaatgatt

SEQ ID NO: 5057665 - DNA, 21 bp, Homo sapiens
ataaattaattgtgcctgcca

SEQ ID NO: 5057666 - DNA, 17 bp, Homo sapiens
ataaattaatttttcaa

SEQ ID NO: 5057667 - DNA, 19 bp, Homo sapiens
ataaattacacaataaagc

SEQ ID NO: 5057668 - DNA, 18 bp, Homo sapiens
ataaattacagtcatctg

SEQ ID NO: 5057669 - DNA, 22 bp, Homo sapiens
ataaattactatctgttgaaaa

SEQ ID NO: 5057670 - DNA, 16 bp, Homo sapiens
ataaattagagaaatg

SEQ ID NO: 5057671 - DNA, 21 bp, Homo sapiens
ataaattagagaaatggttct

SEQ ID NO: 5057672 - DNA, 14 bp, Homo sapiens
ataaattaggacca

SEQ ID NO: 5057673 - DNA, 23 bp, Homo sapiens
ataaattagtttgggttctctac

SEQ ID NO: 5057674 - DNA, 23 bp, Homo sapiens
ataaattatattaatttttgaaa

SEQ ID NO: 5057675 - DNA, 17 bp, Homo sapiens
ataaattatctgaatat

SEQ ID NO: 5057676 - DNA, 19 bp, Homo sapiens
ataaattatctgaatatta

SEQ ID NO: 5057677 - DNA, 14 bp, Homo sapiens
ataaattatcttat

SEQ ID NO: 5057678 - DNA, 16 bp, Homo sapiens
ataaattatgagattt

SEQ ID NO: 5057679 - DNA, 21 bp, Homo sapiens
ataaattatggtaaaattttg

SEQ ID NO: 5057680 - DNA, 12 bp, Homo sapiens
ataaattattac

SEQ ID NO: 5057681 - DNA, 16 bp, Homo sapiens
ataaattattacttta

SEQ ID NO: 5057682 - DNA, 18 bp, Homo sapiens
ataaattattactttaaa

SEQ ID NO: 5057683 - DNA, 21 bp, Homo sapiens
ataaattattagtttacatca

SEQ ID NO: 5057684 - DNA, 19 bp, Homo sapiens
ataaattattgtttttctt

SEQ ID NO: 5057685 - DNA, 19 bp, Homo sapiens
ataaattatttctaaaaca

SEQ ID NO: 5057686 - DNA, 13 bp, Homo sapiens
ataaattatttgt

SEQ ID NO: 5057687 - DNA, 15 bp, Homo sapiens
ataaattatttgtta

SEQ ID NO: 5057688 - DNA, 13 bp, Homo sapiens
ataaattcaaacc

SEQ ID NO: 5057689 - DNA, 16 bp, Homo sapiens
ataaattcaaaccatt

SEQ ID NO: 5057690 - DNA, 20 bp, Homo sapiens
ataaattcacattttctcaa

SEQ ID NO: 5057691 - DNA, 23 bp, Homo sapiens
ataaattcactttcatttttgat

SEQ ID NO: 5057692 - DNA, 19 bp, Homo sapiens
ataaattcatcagaatcct

SEQ ID NO: 5057693 - DNA, 16 bp, Homo sapiens
ataaattccaaaatat

SEQ ID NO: 5057694 - DNA, 15 bp, Homo sapiens
ataaattccactgga

SEQ ID NO: 5057695 - DNA, 23 bp, Homo sapiens
ataaattccccatatttgtgttc

SEQ ID NO: 5057696 - DNA, 24 bp, Homo sapiens
ataaattccccatatttgtgttca

SEQ ID NO: 5057697 - DNA, 18 bp, Homo sapiens
ataaattcctaaactccc

SEQ ID NO: 5057698 - DNA, 14 bp, Homo sapiens
ataaattctaaatt

SEQ ID NO: 5057699 - DNA, 16 bp, Homo sapiens
ataaattctaaattac

SEQ ID NO: 5057700 - DNA, 18 bp, Homo sapiens
ataaattctactaagtta

SEQ ID NO: 5057701 - DNA, 19 bp, Homo sapiens
ataaattctgacttatgaa

SEQ ID NO: 5057702 - DNA, 14 bp, Homo sapiens
ataaattgaaatat

SEQ ID NO: 5057703 - DNA, 14 bp, Homo sapiens
ataaattgatttgt

SEQ ID NO: 5057704 - DNA, 21 bp, Homo sapiens
ataaattgcacaccttggaat

SEQ ID NO: 5057705 - DNA, 12 bp, Homo sapiens
ataaattgcatg

SEQ ID NO: 5057706 - DNA, 15 bp, Homo sapiens
ataaattgccataat

SEQ ID NO: 5057707 - DNA, 16 bp, Homo sapiens
ataaattggattattt

SEQ ID NO: 5057708 - DNA, 20 bp, Homo sapiens
ataaattggctcctttccca

SEQ ID NO: 5057709 - DNA, 20 bp, Homo sapiens
ataaattgggataaacatca

SEQ ID NO: 5057710 - DNA, 19 bp, Homo sapiens
ataaattggtgataagtgg

SEQ ID NO: 5057711 - DNA, 20 bp, Homo sapiens
ataaattggtgataagtgga

SEQ ID NO: 5057712 - DNA, 22 bp, Homo sapiens
ataaattggtgataagtggaaa

SEQ ID NO: 5057713 - DNA, 13 bp, Homo sapiens
ataaattgtaatt

SEQ ID NO: 5057714 - DNA, 14 bp, Homo sapiens
ataaattgtaattt

SEQ ID NO: 5057715 - DNA, 17 bp, Homo sapiens
ataaattgtacagccgg

SEQ ID NO: 5057716 - DNA, 14 bp, Homo sapiens
ataaattgtacatt

SEQ ID NO: 5057717 - DNA, 22 bp, Homo sapiens
ataaattgtagggctttagctt

SEQ ID NO: 5057718 - DNA, 15 bp, Homo sapiens
ataaattgtcttaat

SEQ ID NO: 5057719 - DNA, 16 bp, Homo sapiens
ataaattgtgaaaaaa

SEQ ID NO: 5057720 - DNA, 21 bp, Homo sapiens
ataaattgtgaaaaaaatgaa

SEQ ID NO: 5057721 - DNA, 15 bp, Homo sapiens
ataaattgtttgacc

SEQ ID NO: 5057722 - DNA, 20 bp, Homo sapiens
ataaattgtttggcttcctc

SEQ ID NO: 5057723 - DNA, 19 bp, Homo sapiens
ataaatttaaaacacagta

SEQ ID NO: 5057724 - DNA, 15 bp, Homo sapiens
ataaatttaagaaaa

SEQ ID NO: 5057725 - DNA, 17 bp, Homo sapiens
ataaatttaagaaaaca

SEQ ID NO: 5057726 - DNA, 16 bp, Homo sapiens
ataaatttaagcaaac

SEQ ID NO: 5057727 - DNA, 13 bp, Homo sapiens
ataaatttaatgt

SEQ ID NO: 5057728 - DNA, 22 bp, Homo sapiens
ataaatttactctgttgaatat

SEQ ID NO: 5057729 - DNA, 17 bp, Homo sapiens
ataaatttatatacttt

SEQ ID NO: 5057730 - DNA, 20 bp, Homo sapiens
ataaatttcccagttaaaga

SEQ ID NO: 5057731 - DNA, 12 bp, Homo sapiens
ataaatttctgg

SEQ ID NO: 5057732 - DNA, 20 bp, Homo sapiens
ataaatttctgggatattta

SEQ ID NO: 5057733 - DNA, 21 bp, Homo sapiens
ataaatttgacttttctgtaa

SEQ ID NO: 5057734 - DNA, 21 bp, Homo sapiens
ataaatttgatcccaatagaa

SEQ ID NO: 5057735 - DNA, 20 bp, Homo sapiens
ataaatttggttctaataga

SEQ ID NO: 5057736 - DNA, 13 bp, Homo sapiens
ataaatttgtaac

SEQ ID NO: 5057737 - DNA, 15 bp, Homo sapiens
ataaatttgtaactt

SEQ ID NO: 5057738 - DNA, 16 bp, Homo sapiens
ataaatttgtaacttt

SEQ ID NO: 5057739 - DNA, 14 bp, Homo sapiens
ataaatttgtaata

SEQ ID NO: 5057740 - DNA, 17 bp, Homo sapiens
ataaatttgtaatatat

SEQ ID NO: 5057741 - DNA, 19 bp, Homo sapiens
ataaatttgtaatatatcc

SEQ ID NO: 5057742 - DNA, 15 bp, Homo sapiens
ataaatttgtgtaat

SEQ ID NO: 5057743 - DNA, 14 bp, Homo sapiens
ataaatttgttgaa

SEQ ID NO: 5057744 - DNA, 17 bp, Homo sapiens
ataaatttgttgtcatg

SEQ ID NO: 5057745 - DNA, 14 bp, Homo sapiens
ataaattttaattc

SEQ ID NO: 5057746 - DNA, 21 bp, Homo sapiens
ataaattttaattcaagaaat

SEQ ID NO: 5057747 - DNA, 15 bp, Homo sapiens
ataaattttctaaaa

SEQ ID NO: 5057748 - DNA, 13 bp, Homo sapiens
ataaattttgaaa

SEQ ID NO: 5057749 - DNA, 14 bp, Homo sapiens
ataaattttgaaaa

SEQ ID NO: 5057750 - DNA, 15 bp, Homo sapiens
ataaattttgaaaag

SEQ ID NO: 5057751 - DNA, 13 bp, Homo sapiens
ataaattttggaa

SEQ ID NO: 5057752 - DNA, 14 bp, Homo sapiens
ataaattttggaag

SEQ ID NO: 5057753 - DNA, 17 bp, Homo sapiens
ataaattttggaagaat

SEQ ID NO: 5057754 - DNA, 20 bp, Homo sapiens
ataaattttggaagaattca

SEQ ID NO: 5057755 - DNA, 16 bp, Homo sapiens
ataaattttgtacatt

SEQ ID NO: 5057756 - DNA, 14 bp, Homo sapiens
ataaattttgtgca

SEQ ID NO: 5057757 - DNA, 13 bp, Homo sapiens
ataaatttttaag

SEQ ID NO: 5057758 - DNA, 22 bp, Homo sapiens
ataaatttttaagtgtcagact

SEQ ID NO: 5057759 - DNA, 17 bp, Homo sapiens
ataaattttttgaaaca

SEQ ID NO: 5057760 - DNA, 20 bp, Homo sapiens
ataaattttttgaaacacaa

SEQ ID NO: 5057761 - DNA, 14 bp, Homo sapiens
ataaattttttgac

SEQ ID NO: 5057762 - DNA, 17 bp, Homo sapiens
ataaattttttttggtc

SEQ ID NO: 5057763 - DNA, 22 bp, Homo sapiens
ataaattttttttgtttcatat

SEQ ID NO: 5057764 - DNA, 15 bp, Homo sapiens
ataacaaaaaagaga

SEQ ID NO: 5057765 - DNA, 17 bp, Homo sapiens
ataacaaaaaaggtttc

SEQ ID NO: 5057766 - DNA, 17 bp, Homo sapiens
ataacaaaaaataaatt

SEQ ID NO: 5057767 - DNA, 18 bp, Homo sapiens
ataacaaaaaataaattt

SEQ ID NO: 5057768 - DNA, 15 bp, Homo sapiens
ataacaaaatcacaa

SEQ ID NO: 5057769 - DNA, 21 bp, Homo sapiens
ataacaaaatcacaagcaata

SEQ ID NO: 5057770 - DNA, 23 bp, Homo sapiens
ataacaaaatcacaagcaataat

SEQ ID NO: 5057771 - DNA, 13 bp, Homo sapiens
ataacaaaatgga

SEQ ID NO: 5057772 - DNA, 20 bp, Homo sapiens
ataacaaacgtgttttttaa

SEQ ID NO: 5057773 - DNA, 14 bp, Homo sapiens
ataacaaagatatc

SEQ ID NO: 5057774 - DNA, 14 bp, Homo sapiens
ataacaaagcacat

SEQ ID NO: 5057775 - DNA, 16 bp, Homo sapiens
ataacaaataaccaac

SEQ ID NO: 5057776 - DNA, 11 bp, Homo sapiens
ataacaaatgc

SEQ ID NO: 5057777 - DNA, 21 bp, Homo sapiens
ataacaaatgccaaattaaaa

SEQ ID NO: 5057778 - DNA, 13 bp, Homo sapiens
ataacaaattctg

SEQ ID NO: 5057779 - DNA, 14 bp, Homo sapiens
ataacaacaattta

SEQ ID NO: 5057780 - DNA, 14 bp, Homo sapiens
ataacaacactaat

SEQ ID NO: 5057781 - DNA, 18 bp, Homo sapiens
ataacaactatttacata

SEQ ID NO: 5057782 - DNA, 21 bp, Homo sapiens
ataacaactatttttgttgtt

SEQ ID NO: 5057783 - DNA, 23 bp, Homo sapiens
ataacaactgagatgttaaaata

SEQ ID NO: 5057784 - DNA, 19 bp, Homo sapiens
ataacaactggatgcatca

SEQ ID NO: 5057785 - DNA, 19 bp, Homo sapiens
ataacaagatctttcagga

SEQ ID NO: 5057786 - DNA, 19 bp, Homo sapiens
ataacaagcatgcataaat

SEQ ID NO: 5057787 - DNA, 17 bp, Homo sapiens
ataacaaggagatttct

SEQ ID NO: 5057788 - DNA, 19 bp, Homo sapiens
ataacaaggagatttctta

SEQ ID NO: 5057789 - DNA, 21 bp, Homo sapiens
ataacaaggtccaagatacct

SEQ ID NO: 5057790 - DNA, 21 bp, Homo sapiens
ataacaaggttcttctaaaat

SEQ ID NO: 5057791 - DNA, 19 bp, Homo sapiens
ataacaatatatgatatat

SEQ ID NO: 5057792 - DNA, 14 bp, Homo sapiens
ataacaatcactgg

SEQ ID NO: 5057793 - DNA, 17 bp, Homo sapiens
ataacaatgctgtattt

SEQ ID NO: 5057794 - DNA, 14 bp, Homo sapiens
ataacaatgtatgt

SEQ ID NO: 5057795 - DNA, 16 bp, Homo sapiens
ataacaatgtgctctc

SEQ ID NO: 5057796 - DNA, 13 bp, Homo sapiens
ataacaatgttaa

SEQ ID NO: 5057797 - DNA, 14 bp, Homo sapiens
ataacacacagcta

SEQ ID NO: 5057798 - DNA, 14 bp, Homo sapiens
ataacacagagaga

SEQ ID NO: 5057799 - DNA, 16 bp, Homo sapiens
ataacacagatattgt

SEQ ID NO: 5057800 - DNA, 22 bp, Homo sapiens
ataacaccaatcccagggctgg

SEQ ID NO: 5057801 - DNA, 13 bp, Homo sapiens
ataacacctgcca

SEQ ID NO: 5057802 - DNA, 23 bp, Homo sapiens
ataacactctaggatgtatattt

SEQ ID NO: 5057803 - DNA, 23 bp, Homo sapiens
ataacagaaagcctgggtgacat

SEQ ID NO: 5057804 - DNA, 16 bp, Homo sapiens
ataacagaatgcacca

SEQ ID NO: 5057805 - DNA, 22 bp, Homo sapiens
ataacagagaatcttgattaaa

SEQ ID NO: 5057806 - DNA, 20 bp, Homo sapiens
ataacagagtgatttgtaaa

SEQ ID NO: 5057807 - DNA, 22 bp, Homo sapiens
ataacagatggtgctgctaatt

SEQ ID NO: 5057808 - DNA, 12 bp, Homo sapiens
ataacagatgtg

SEQ ID NO: 5057809 - DNA, 15 bp, Homo sapiens
ataacagatgtgaaa

SEQ ID NO: 5057810 - DNA, 18 bp, Homo sapiens
ataacagatgtgaaaata

SEQ ID NO: 5057811 - DNA, 17 bp, Homo sapiens
ataacagcaaggaaaca

SEQ ID NO: 5057812 - DNA, 18 bp, Homo sapiens
ataacagcaaggaaacat

SEQ ID NO: 5057813 - DNA, 13 bp, Homo sapiens
agtggcataaaaa

SEQ ID NO: 5057814 - DNA, 17 bp, Homo sapiens
agtggcataccaaatgg

SEQ ID NO: 5057815 - DNA, 14 bp, Homo sapiens
agtggcatagagaa

SEQ ID NO: 5057816 - DNA, 18 bp, Homo sapiens
agtggcatagagaataca

SEQ ID NO: 5057817 - DNA, 19 bp, Homo sapiens
agtggcatcatctcagctc

SEQ ID NO: 5057818 - DNA, 17 bp, Homo sapiens
agtggcatggtcctgtg

SEQ ID NO: 5057819 - DNA, 18 bp, Homo sapiens
agtggccaagaagcagtg

SEQ ID NO: 5057820 - DNA, 18 bp, Homo sapiens
agtggccaagcctgctgt

SEQ ID NO: 5057821 - DNA, 24 bp, Homo sapiens
agtggccaagcctgctgtgtcctt

SEQ ID NO: 5057822 - DNA, 20 bp, Homo sapiens
agtggccacactctgccttc

SEQ ID NO: 5057823 - DNA, 16 bp, Homo sapiens
agtggccacggcccag

SEQ ID NO: 5057824 - DNA, 20 bp, Homo sapiens
agtggccactaagcagagga

SEQ ID NO: 5057825 - DNA, 14 bp, Homo sapiens
agtggccactcagc

SEQ ID NO: 5057826 - DNA, 22 bp, Homo sapiens
agtggccactggcacttgcctg

SEQ ID NO: 5057827 - DNA, 14 bp, Homo sapiens
agtggccagaccag

SEQ ID NO: 5057828 - DNA, 17 bp, Homo sapiens
agtggccagaccagagc

SEQ ID NO: 5057829 - DNA, 19 bp, Homo sapiens
agtggccagaccagagctc

SEQ ID NO: 5057830 - DNA, 22 bp, Homo sapiens
agtggccagaccagagctctgg

SEQ ID NO: 5057831 - DNA, 14 bp, Homo sapiens
agtggccagcgcca

SEQ ID NO: 5057832 - DNA, 15 bp, Homo sapiens
agtggccagcgccag

SEQ ID NO: 5057833 - DNA, 23 bp, Homo sapiens
agtggccagcgccagggcccagg

SEQ ID NO: 5057834 - DNA, 12 bp, Homo sapiens
agtggccaggca

SEQ ID NO: 5057835 - DNA, 14 bp, Homo sapiens
ataacttgctttct

SEQ ID NO: 5057836 - DNA, 18 bp, Homo sapiens
ataacttgctttcttctt

SEQ ID NO: 5057837 - DNA, 20 bp, Homo sapiens
ataacttgctttcttctttc

SEQ ID NO: 5057838 - DNA, 21 bp, Homo sapiens
ataacttgctttcttctttcc

SEQ ID NO: 5057839 - DNA, 17 bp, Homo sapiens
ataacttggggaggcaa

SEQ ID NO: 5057840 - DNA, 15 bp, Homo sapiens
ataactttaaatctt

SEQ ID NO: 5057841 - DNA, 16 bp, Homo sapiens
ataactttaaatcttt

SEQ ID NO: 5057842 - DNA, 15 bp, Homo sapiens
ataactttatatgaa

SEQ ID NO: 5057843 - DNA, 13 bp, Homo sapiens
ataactttattgc

SEQ ID NO: 5057844 - DNA, 17 bp, Homo sapiens
ataactttgactttctt

SEQ ID NO: 5057845 - DNA, 23 bp, Homo sapiens
ataactttgctggaaaatctgta

SEQ ID NO: 5057846 - DNA, 20 bp, Homo sapiens
ataacttttcaccaatgagc

SEQ ID NO: 5057847 - DNA, 22 bp, Homo sapiens
ataactttttatattctcagca

SEQ ID NO: 5057848 - DNA, 18 bp, Homo sapiens
ataacttttttttaagtt

SEQ ID NO: 5057849 - DNA, 12 bp, Homo sapiens
ataagaaaaact

SEQ ID NO: 5057850 - DNA, 14 bp, Homo sapiens
ataagaaaaacttt

SEQ ID NO: 5057851 - DNA, 15 bp, Homo sapiens
ataagaaaaactttt

SEQ ID NO: 5057852 - DNA, 21 bp, Homo sapiens
ataagaaaaaggaaaagttga

SEQ ID NO: 5057853 - DNA, 18 bp, Homo sapiens
ataagaaaaatattaata

SEQ ID NO: 5057854 - DNA, 19 bp, Homo sapiens
ataagaaaaatattaataa

SEQ ID NO: 5057855 - DNA, 17 bp, Homo sapiens
ataagaaaaatcatgtt

SEQ ID NO: 5057856 - DNA, 15 bp, Homo sapiens
ataagaaaaatgctt

SEQ ID NO: 5057857 - DNA, 22 bp, Homo sapiens
ataagaaaaccaccccttagat

SEQ ID NO: 5057858 - DNA, 22 bp, Homo sapiens
ataagaaaagatgtagatttat

SEQ ID NO: 5057859 - DNA, 13 bp, Homo sapiens
ataagaaaagtaa

SEQ ID NO: 5057860 - DNA, 15 bp, Homo sapiens
ataagaaaagtgaaa

SEQ ID NO: 5057861 - DNA, 18 bp, Homo sapiens
ataagaaacagtttaaca

SEQ ID NO: 5057862 - DNA, 19 bp, Homo sapiens
ataagaaacagtttaacag

SEQ ID NO: 5057863 - DNA, 13 bp, Homo sapiens
ataagaaactttt

SEQ ID NO: 5057864 - DNA, 21 bp, Homo sapiens
ataagaaacttttttatttaa

SEQ ID NO: 5057865 - DNA, 14 bp, Homo sapiens
ataagaaagacatc

SEQ ID NO: 5057866 - DNA, 18 bp, Homo sapiens
ataagaaagcctaaaatt

SEQ ID NO: 5057867 - DNA, 15 bp, Homo sapiens
ataagaaagtttcac

SEQ ID NO: 5057868 - DNA, 21 bp, Homo sapiens
ataagaaataatgctacaatt

SEQ ID NO: 5057869 - DNA, 22 bp, Homo sapiens
ataagaaataatgctacaattt

SEQ ID NO: 5057870 - DNA, 13 bp, Homo sapiens
ataagaaatgaac

SEQ ID NO: 5057871 - DNA, 17 bp, Homo sapiens
ataagaaatgaacaaaa

SEQ ID NO: 5057872 - DNA, 20 bp, Homo sapiens
ataagaaatgaacaaaagat

SEQ ID NO: 5057873 - DNA, 21 bp, Homo sapiens
ataagaaattttattagacat

SEQ ID NO: 5057874 - DNA, 13 bp, Homo sapiens
ataagaacagatc

SEQ ID NO: 5057875 - DNA, 14 bp, Homo sapiens
ataagaacagatca

SEQ ID NO: 5057876 - DNA, 17 bp, Homo sapiens
ataagaagaagagaggc

SEQ ID NO: 5057877 - DNA, 11 bp, Homo sapiens
ataagaagaat

SEQ ID NO: 5057878 - DNA, 13 bp, Homo sapiens
ataagaagaatgc

SEQ ID NO: 5057879 - DNA, 13 bp, Homo sapiens
ataagaaggaaaa

SEQ ID NO: 5057880 - DNA, 15 bp, Homo sapiens
ataagaaggcaattt

SEQ ID NO: 5057881 - DNA, 19 bp, Homo sapiens
ataagaagggggagtgaaa

SEQ ID NO: 5057882 - DNA, 22 bp, Homo sapiens
ataagaatcatagtgccataga

SEQ ID NO: 5057883 - DNA, 20 bp, Homo sapiens
ataagaatctatagttcact

SEQ ID NO: 5057884 - DNA, 16 bp, Homo sapiens
ataagaatgctggttt

SEQ ID NO: 5057885 - DNA, 22 bp, Homo sapiens
ataagaatgctggttttcctaa

SEQ ID NO: 5057886 - DNA, 17 bp, Homo sapiens
ataagaatggtttgtaa

SEQ ID NO: 5057887 - DNA, 22 bp, Homo sapiens
ataagaattagacatcttcaga

SEQ ID NO: 5057888 - DNA, 16 bp, Homo sapiens
ataagaattgtctctg

SEQ ID NO: 5057889 - DNA, 12 bp, Homo sapiens
ataagaatttgc

SEQ ID NO: 5057890 - DNA, 13 bp, Homo sapiens
ataagaatttgca

SEQ ID NO: 5057891 - DNA, 15 bp, Homo sapiens
ataagaatttgcata

SEQ ID NO: 5057892 - DNA, 17 bp, Homo sapiens
ataagaatttgcatact

SEQ ID NO: 5057893 - DNA, 15 bp, Homo sapiens
ataagacaaaaataa

SEQ ID NO: 5057894 - DNA, 13 bp, Homo sapiens
ataagacaaacac

SEQ ID NO: 5057895 - DNA, 20 bp, Homo sapiens
ataagacaagagatctacac

SEQ ID NO: 5057896 - DNA, 24 bp, Homo sapiens
ataagacaagagatctacacatgt

SEQ ID NO: 5057897 - DNA, 17 bp, Homo sapiens
ataagacaatagtattt

SEQ ID NO: 5057898 - DNA, 22 bp, Homo sapiens
ataagacaatagtatttctcct

SEQ ID NO: 5057899 - DNA, 14 bp, Homo sapiens
ataagacattaaga

SEQ ID NO: 5057900 - DNA, 14 bp, Homo sapiens
ataagacatttgtt

SEQ ID NO: 5057901 - DNA, 17 bp, Homo sapiens
ataagacggatttattt

SEQ ID NO: 5057902 - DNA, 18 bp, Homo sapiens
ataagactactattcctt

SEQ ID NO: 5057903 - DNA, 15 bp, Homo sapiens
ataagactattccaa

SEQ ID NO: 5057904 - DNA, 10 bp, Homo sapiens
ataagactgg

SEQ ID NO: 5057905 - DNA, 17 bp, Homo sapiens
ataagactggaaaatag

SEQ ID NO: 5057906 - DNA, 19 bp, Homo sapiens
ataagacttgtttctttct

SEQ ID NO: 5057907 - DNA, 16 bp, Homo sapiens
ataagagaaacctgcc

SEQ ID NO: 5057908 - DNA, 22 bp, Homo sapiens
ataagagaaacctgccaaggag

SEQ ID NO: 5057909 - DNA, 14 bp, Homo sapiens
ataagagaaagaaa

SEQ ID NO: 5057910 - DNA, 18 bp, Homo sapiens
ataagagaaagaaaatga

SEQ ID NO: 5057911 - DNA, 12 bp, Homo sapiens
ataagagaaatg

SEQ ID NO: 5057912 - DNA, 18 bp, Homo sapiens
ataagagaagtctcattc

SEQ ID NO: 5057913 - DNA, 22 bp, Homo sapiens
ataagagaagtttaacaagtat

SEQ ID NO: 5057914 - DNA, 17 bp, Homo sapiens
ataagagaatgttccta

SEQ ID NO: 5057915 - DNA, 15 bp, Homo sapiens
ataagagacaaagtt

SEQ ID NO: 5057916 - DNA, 17 bp, Homo sapiens
ataagagacaaagtttg

SEQ ID NO: 5057917 - DNA, 16 bp, Homo sapiens
ataagagacagacact

SEQ ID NO: 5057918 - DNA, 12 bp, Homo sapiens
ataagagatttg

SEQ ID NO: 5057919 - DNA, 15 bp, Homo sapiens
ataagagcagtcaca

SEQ ID NO: 5057920 - DNA, 19 bp, Homo sapiens
ataagagcatgatttgaaa

SEQ ID NO: 5057921 - DNA, 20 bp, Homo sapiens
ataagagcatgatttgaaaa

SEQ ID NO: 5057922 - DNA, 15 bp, Homo sapiens
ataagagctcaggat

SEQ ID NO: 5057923 - DNA, 21 bp, Homo sapiens
ataagaggacactagatgata

SEQ ID NO: 5057924 - DNA, 19 bp, Homo sapiens
ataagagggcacacactgt

SEQ ID NO: 5057925 - DNA, 19 bp, Homo sapiens
ataagaggttctaacttct

SEQ ID NO: 5057926 - DNA, 13 bp, Homo sapiens
ataagagtaaaaa

SEQ ID NO: 5057927 - DNA, 20 bp, Homo sapiens
ataagagtctccttctcttc

SEQ ID NO: 5057928 - DNA, 17 bp, Homo sapiens
ataagagtgattagagc

SEQ ID NO: 5057929 - DNA, 17 bp, Homo sapiens
ataagagttcttgccct

SEQ ID NO: 5057930 - DNA, 13 bp, Homo sapiens
ataagataaaata

SEQ ID NO: 5057931 - DNA, 14 bp, Homo sapiens
ataagataaaataa

SEQ ID NO: 5057932 - DNA, 21 bp, Homo sapiens
ataagataaaataaaatttta

SEQ ID NO: 5057933 - DNA, 13 bp, Homo sapiens
ataagataaatgt

SEQ ID NO: 5057934 - DNA, 17 bp, Homo sapiens
ataagataaatgtgctg

SEQ ID NO: 5057935 - DNA, 15 bp, Homo sapiens
ataagataatgatga

SEQ ID NO: 5057936 - DNA, 18 bp, Homo sapiens
ataagatacaataaaaca

SEQ ID NO: 5057937 - DNA, 14 bp, Homo sapiens
ataagatacacagc

SEQ ID NO: 5057938 - DNA, 20 bp, Homo sapiens
ataagatattaccctcagaa

SEQ ID NO: 5057939 - DNA, 15 bp, Homo sapiens
ataagatatttttca

SEQ ID NO: 5057940 - DNA, 18 bp, Homo sapiens
ataagatatttttcatga

SEQ ID NO: 5057941 - DNA, 16 bp, Homo sapiens
ataagatgaaacatca

SEQ ID NO: 5057942 - DNA, 16 bp, Homo sapiens
ataagatgacaatgtt

SEQ ID NO: 5057943 - DNA, 14 bp, Homo sapiens
ataagatgactgtg

SEQ ID NO: 5057944 - DNA, 16 bp, Homo sapiens
ataagatgatgttaaa

SEQ ID NO: 5057945 - DNA, 17 bp, Homo sapiens
ataagatgatgttaaat

SEQ ID NO: 5057946 - DNA, 19 bp, Homo sapiens
ataagatgatttaatgttg

SEQ ID NO: 5057947 - DNA, 17 bp, Homo sapiens
ataagatggagaataaa

SEQ ID NO: 5057948 - DNA, 14 bp, Homo sapiens
ataagatggctgtg

SEQ ID NO: 5057949 - DNA, 15 bp, Homo sapiens
ataagattaataaga

SEQ ID NO: 5057950 - DNA, 14 bp, Homo sapiens
ataagattcatatt

SEQ ID NO: 5057951 - DNA, 19 bp, Homo sapiens
ataagattccaaaaagcac

SEQ ID NO: 5057952 - DNA, 14 bp, Homo sapiens
ataagattgaaatt

SEQ ID NO: 5057953 - DNA, 10 bp, Homo sapiens
ataagattgt

SEQ ID NO: 5057954 - DNA, 21 bp, Homo sapiens
ataagatttagttgagttatt

SEQ ID NO: 5057955 - DNA, 18 bp, Homo sapiens
ataagatttttcaaaatc

SEQ ID NO: 5057956 - DNA, 16 bp, Homo sapiens
ataagatttttgaaaa

SEQ ID NO: 5057957 - DNA, 21 bp, Homo sapiens
ataagcaaaatcctgactatt

SEQ ID NO: 5057958 - DNA, 20 bp, Homo sapiens
ataagcaaattagtaattgt

SEQ ID NO: 5057959 - DNA, 18 bp, Homo sapiens
ataagcaaattgcttttt

SEQ ID NO: 5057960 - DNA, 15 bp, Homo sapiens
ataagcaaatttcaa

SEQ ID NO: 5057961 - DNA, 21 bp, Homo sapiens
ataagcaaatttcaaaagaca

SEQ ID NO: 5057962 - DNA, 22 bp, Homo sapiens
ataagcaaatttcaaaagacat

SEQ ID NO: 5057963 - DNA, 13 bp, Homo sapiens
ataagcaacaatt

SEQ ID NO: 5057964 - DNA, 17 bp, Homo sapiens
ataagcaacaattttca

SEQ ID NO: 5057965 - DNA, 23 bp, Homo sapiens
ataagcaagaaggcaaaaatagt

SEQ ID NO: 5057966 - DNA, 12 bp, Homo sapiens
ataagcaagaga

SEQ ID NO: 5057967 - DNA, 17 bp, Homo sapiens
ataagcaagagagatgt

SEQ ID NO: 5057968 - DNA, 20 bp, Homo sapiens
ataagcacagacaattctaa

SEQ ID NO: 5057969 - DNA, 21 bp, Homo sapiens
ataagcacagacaattctaat

SEQ ID NO: 5057970 - DNA, 21 bp, Homo sapiens
ataagcacttgcctggaataa

SEQ ID NO: 5057971 - DNA, 13 bp, Homo sapiens
ataagcagaacat

SEQ ID NO: 5057972 - DNA, 20 bp, Homo sapiens
ataagcagaacatactgttc

SEQ ID NO: 5057973 - DNA, 23 bp, Homo sapiens
ataagcagaacatactgttctca

SEQ ID NO: 5057974 - DNA, 23 bp, Homo sapiens
ataagcaggttgttatttaggtt

SEQ ID NO: 5057975 - DNA, 14 bp, Homo sapiens
ataagcatcattat

SEQ ID NO: 5057976 - DNA, 15 bp, Homo sapiens
ataagcatcattatt

SEQ ID NO: 5057977 - DNA, 19 bp, Homo sapiens
ataagcatcattatttatg

SEQ ID NO: 5057978 - DNA, 18 bp, Homo sapiens
ataagcattgaaattata

SEQ ID NO: 5057979 - DNA, 15 bp, Homo sapiens
ataagcattgccatt

SEQ ID NO: 5057980 - DNA, 17 bp, Homo sapiens
ataagccaaaataagac

SEQ ID NO: 5057981 - DNA, 19 bp, Homo sapiens
ataagccaatttttctgca

SEQ ID NO: 5057982 - DNA, 22 bp, Homo sapiens
ataagccaatttttctgcactg

SEQ ID NO: 5057983 - DNA, 23 bp, Homo sapiens
ataagccaatttttctgcactga

SEQ ID NO: 5057984 - DNA, 18 bp, Homo sapiens
ataagccatgagaatgtt

SEQ ID NO: 5057985 - DNA, 15 bp, Homo sapiens
ataagccatggtgaa

SEQ ID NO: 5057986 - DNA, 22 bp, Homo sapiens
ataagccattgcttctccctca

SEQ ID NO: 5057987 - DNA, 17 bp, Homo sapiens
ataagcctcaggcctgg

SEQ ID NO: 5057988 - DNA, 21 bp, Homo sapiens
ataagcctccatttagttctt

SEQ ID NO: 5057989 - DNA, 12 bp, Homo sapiens
ataagcctgagc

SEQ ID NO: 5057990 - DNA, 14 bp, Homo sapiens
ataagcctgagcct

SEQ ID NO: 5057991 - DNA, 15 bp, Homo sapiens
ataagcctgagcctt

SEQ ID NO: 5057992 - DNA, 22 bp, Homo sapiens
ataagccttcgaaaagaaattg

SEQ ID NO: 5057993 - DNA, 18 bp, Homo sapiens
ataagcggcgtaagttta

SEQ ID NO: 5057994 - DNA, 20 bp, Homo sapiens
agtgggccaggacaggcccg

SEQ ID NO: 5057995 - DNA, 12 bp, Homo sapiens
agtgggccaggg

SEQ ID NO: 5057996 - DNA, 16 bp, Homo sapiens
agtgggccagtcctgg

SEQ ID NO: 5057997 - DNA, 22 bp, Homo sapiens
agtgggcccaatgcactttgtt

SEQ ID NO: 5057998 - DNA, 21 bp, Homo sapiens
agtgggccccgggctggagaa

SEQ ID NO: 5057999 - DNA, 19 bp, Homo sapiens
agtgggccctgcccgggga

SEQ ID NO: 5058000 - DNA, 16 bp, Homo sapiens
agtgggccctggctct

SEQ ID NO: 5058001 - DNA, 20 bp, Homo sapiens
agtgggccctggctctgtca

SEQ ID NO: 5058002 - DNA, 14 bp, Homo sapiens
agtgggcctgctga

SEQ ID NO: 5058003 - DNA, 16 bp, Homo sapiens
agtgggcctgtgtgtg

SEQ ID NO: 5058004 - DNA, 15 bp, Homo sapiens
agtgggcgttgggag

SEQ ID NO: 5058005 - DNA, 21 bp, Homo sapiens
agtgggctccctggcccagcc

SEQ ID NO: 5058006 - DNA, 11 bp, Homo sapiens
agtgggctcct

SEQ ID NO: 5058007 - DNA, 20 bp, Homo sapiens
agtgggctgcacgctcccct

SEQ ID NO: 5058008 - DNA, 21 bp, Homo sapiens
agtgggctgcacgctcccctc

SEQ ID NO: 5058009 - DNA, 14 bp, Homo sapiens
agtgggctggtatt

SEQ ID NO: 5058010 - DNA, 21 bp, Homo sapiens
agtgggctggtattctctcta

SEQ ID NO: 5058011 - DNA, 20 bp, Homo sapiens
agtgggctgtttctgcttat

SEQ ID NO: 5058012 - DNA, 22 bp, Homo sapiens
agtgggcttcggagtgaatgtg

SEQ ID NO: 5058013 - DNA, 20 bp, Homo sapiens
agtgtaccaagtgcttccta

SEQ ID NO: 5058014 - DNA, 19 bp, Homo sapiens
agtgtaccattaaaatatg

SEQ ID NO: 5058015 - DNA, 19 bp, Homo sapiens
agtgtacccccgcccaggc

SEQ ID NO: 5058016 - DNA, 23 bp, Homo sapiens
agtgtaccgcgtctaccctggga

SEQ ID NO: 5058017 - DNA, 14 bp, Homo sapiens
agtgtacctcctct

SEQ ID NO: 5058018 - DNA, 22 bp, Homo sapiens
agtgtacctcctctcagtgttt

SEQ ID NO: 5058019 - DNA, 13 bp, Homo sapiens
agtgtacctgtgt

SEQ ID NO: 5058020 - DNA, 17 bp, Homo sapiens
agtgtacctgtgtacat

SEQ ID NO: 5058021 - DNA, 13 bp, Homo sapiens
agtgtactgcttt

SEQ ID NO: 5058022 - DNA, 17 bp, Homo sapiens
agtgtactgtgcctggt

SEQ ID NO: 5058023 - DNA, 15 bp, Homo sapiens
agtgtactttgttaa

SEQ ID NO: 5058024 - DNA, 15 bp, Homo sapiens
agtgtagaacctaat

SEQ ID NO: 5058025 - DNA, 18 bp, Homo sapiens
agtgtagactggccatgc

SEQ ID NO: 5058026 - DNA, 19 bp, Homo sapiens
agtgtagcatcctaaagat

SEQ ID NO: 5058027 - DNA, 16 bp, Homo sapiens
agtgtagccaggtccc

SEQ ID NO: 5058028 - DNA, 21 bp, Homo sapiens
agtgtagcccacacttgagag

SEQ ID NO: 5058029 - DNA, 17 bp, Homo sapiens
agtgtagccccaagaag

SEQ ID NO: 5058030 - DNA, 20 bp, Homo sapiens
agtgtagcctaaagggcagg

SEQ ID NO: 5058031 - DNA, 15 bp, Homo sapiens
agtgtagccttgccc

SEQ ID NO: 5058032 - DNA, 17 bp, Homo sapiens
agtgtagccttgcccgg

SEQ ID NO: 5058033 - DNA, 19 bp, Homo sapiens
agtgtagctgccacattga

SEQ ID NO: 5058034 - DNA, 13 bp, Homo sapiens
agtgtagctgtaa

SEQ ID NO: 5058035 - DNA, 21 bp, Homo sapiens
agtgtagctgtaagggcagtg

SEQ ID NO: 5058036 - DNA, 13 bp, Homo sapiens
agtgtagctgtga

SEQ ID NO: 5058037 - DNA, 18 bp, Homo sapiens
agtgtaggcagacacagg

SEQ ID NO: 5058038 - DNA, 20 bp, Homo sapiens
agtgtaggcagacacaggga

SEQ ID NO: 5058039 - DNA, 23 bp, Homo sapiens
agtgtagggcaagggtgcctcag

SEQ ID NO: 5058040 - DNA, 18 bp, Homo sapiens
agtgtagtcaggtgctca

SEQ ID NO: 5058041 - DNA, 15 bp, Homo sapiens
agtgtagttaattta

SEQ ID NO: 5058042 - DNA, 21 bp, Homo sapiens
agtgtagttttccttttgtgt

SEQ ID NO: 5058043 - DNA, 20 bp, Homo sapiens
agtgtataatgttggtgtgg

SEQ ID NO: 5058044 - DNA, 21 bp, Homo sapiens
agtgtataccacctgtacata

SEQ ID NO: 5058045 - DNA, 22 bp, Homo sapiens
agtgtataccacctgtacatac

SEQ ID NO: 5058046 - DNA, 21 bp, Homo sapiens
agtgtatactctgtagtctca

SEQ ID NO: 5058047 - DNA, 23 bp, Homo sapiens
agtgtatactctgtagtctcagt

SEQ ID NO: 5058048 - DNA, 21 bp, Homo sapiens
agtgtatatgtgattttcaaa

SEQ ID NO: 5058049 - DNA, 23 bp, Homo sapiens
agtgtatatgtgattttcaaata

SEQ ID NO: 5058050 - DNA, 14 bp, Homo sapiens
agtgtatcaaaatg

SEQ ID NO: 5058051 - DNA, 16 bp, Homo sapiens
agtgtatcaaaatgct

SEQ ID NO: 5058052 - DNA, 21 bp, Homo sapiens
agtgtatcaggtcagggactt

SEQ ID NO: 5058053 - DNA, 14 bp, Homo sapiens
agtgtatctccttt

SEQ ID NO: 5058054 - DNA, 23 bp, Homo sapiens
agtgtatctcgaagtcttccatc

SEQ ID NO: 5058055 - DNA, 18 bp, Homo sapiens
agtgtatgactgcacatg

SEQ ID NO: 5058056 - DNA, 19 bp, Homo sapiens
agtgtatgagagggccctg

SEQ ID NO: 5058057 - DNA, 12 bp, Homo sapiens
agtgtatgcata

SEQ ID NO: 5058058 - DNA, 13 bp, Homo sapiens
agtgtatgtgaat

SEQ ID NO: 5058059 - DNA, 15 bp, Homo sapiens
agtgtattaatcata

SEQ ID NO: 5058060 - DNA, 18 bp, Homo sapiens
agtgtattagatgtggtt

SEQ ID NO: 5058061 - DNA, 19 bp, Homo sapiens
agtgtattagtcataaaac

SEQ ID NO: 5058062 - DNA, 15 bp, Homo sapiens
agtgtattataacag

SEQ ID NO: 5058063 - DNA, 14 bp, Homo sapiens
agtgtattatcact

SEQ ID NO: 5058064 - DNA, 21 bp, Homo sapiens
agtgtatttaatgtttgtaag

SEQ ID NO: 5058065 - DNA, 14 bp, Homo sapiens
agtgtatttggaaa

SEQ ID NO: 5058066 - DNA, 18 bp, Homo sapiens
agtgtattttataaaatt

SEQ ID NO: 5058067 - DNA, 21 bp, Homo sapiens
agtgtatttttcaataaagca

SEQ ID NO: 5058068 - DNA, 15 bp, Homo sapiens
agtgtatttttgtaa

SEQ ID NO: 5058069 - DNA, 17 bp, Homo sapiens
agtgtatttttttacta

SEQ ID NO: 5058070 - DNA, 17 bp, Homo sapiens
agtgtcaaataaacact

SEQ ID NO: 5058071 - DNA, 20 bp, Homo sapiens
agtgtcaaataaacactgtg

SEQ ID NO: 5058072 - DNA, 16 bp, Homo sapiens
agtgtcaaccagacag

SEQ ID NO: 5058073 - DNA, 17 bp, Homo sapiens
agtgtcaactccaggac

SEQ ID NO: 5058074 - DNA, 14 bp, Homo sapiens
agtgtcaagtcctg

SEQ ID NO: 5058075 - DNA, 16 bp, Homo sapiens
agtgtcaagtcctgac

SEQ ID NO: 5058076 - DNA, 20 bp, Homo sapiens
agtgtcaagttgtgcttgtt

SEQ ID NO: 5058077 - DNA, 22 bp, Homo sapiens
agtgtcaagttgtgcttgttta

SEQ ID NO: 5058078 - DNA, 20 bp, Homo sapiens
agtgtcaccagctgccaaaa

SEQ ID NO: 5058079 - DNA, 13 bp, Homo sapiens
agtgtcacctcct

SEQ ID NO: 5058080 - DNA, 15 bp, Homo sapiens
agtgtcacctctctc

SEQ ID NO: 5058081 - DNA, 12 bp, Homo sapiens
agtgtcacctgc

SEQ ID NO: 5058082 - DNA, 13 bp, Homo sapiens
agtgtcacctgca

SEQ ID NO: 5058083 - DNA, 17 bp, Homo sapiens
agtgtcactccataaaa

SEQ ID NO: 5058084 - DNA, 14 bp, Homo sapiens
agtgtcactgagct

SEQ ID NO: 5058085 - DNA, 15 bp, Homo sapiens
agtgtcactggtcag

SEQ ID NO: 5058086 - DNA, 19 bp, Homo sapiens
agtgtcacttttttcctgt

SEQ ID NO: 5058087 - DNA, 23 bp, Homo sapiens
agtgtcacttttttcctgtcaat

SEQ ID NO: 5058088 - DNA, 20 bp, Homo sapiens
agtgtcagaatcagaatcat

SEQ ID NO: 5058089 - DNA, 15 bp, Homo sapiens
agtgtcagcgggtga

SEQ ID NO: 5058090 - DNA, 14 bp, Homo sapiens
agtgtcaggaggaa

SEQ ID NO: 5058091 - DNA, 15 bp, Homo sapiens
agtgtcaggcactgg

SEQ ID NO: 5058092 - DNA, 15 bp, Homo sapiens
agtgtcaggccccca

SEQ ID NO: 5058093 - DNA, 19 bp, Homo sapiens
agtgtcagggtccaggaga

SEQ ID NO: 5058094 - DNA, 20 bp, Homo sapiens
agtgtcatatgtaggtgtct

SEQ ID NO: 5058095 - DNA, 16 bp, Homo sapiens
agtgtcatcagaagat

SEQ ID NO: 5058096 - DNA, 20 bp, Homo sapiens
agtgtcatcagaagataact

SEQ ID NO: 5058097 - DNA, 20 bp, Homo sapiens
agtgtcatccaccagtgtgt

SEQ ID NO: 5058098 - DNA, 19 bp, Homo sapiens
agtgtcatgaagtgcacag

SEQ ID NO: 5058099 - DNA, 24 bp, Homo sapiens
agtgtcattcccctttgcactgta

SEQ ID NO: 5058100 - DNA, 20 bp, Homo sapiens
agtgtcatttctcatccaca

SEQ ID NO: 5058101 - DNA, 17 bp, Homo sapiens
agtgtcatttcttttag

SEQ ID NO: 5058102 - DNA, 23 bp, Homo sapiens
agtgtcattttattttttccctc

SEQ ID NO: 5058103 - DNA, 22 bp, Homo sapiens
agtgtcattttgatctgctttt

SEQ ID NO: 5058104 - DNA, 24 bp, Homo sapiens
agtgtccatagatataaagccatt

SEQ ID NO: 5058105 - DNA, 22 bp, Homo sapiens
agtgtccattgacatgtacaga

SEQ ID NO: 5058106 - DNA, 13 bp, Homo sapiens
agtgtccattttg

SEQ ID NO: 5058107 - DNA, 20 bp, Homo sapiens
agtgtccattttgtgaagcc

SEQ ID NO: 5058108 - DNA, 22 bp, Homo sapiens
agtgtccattttgtgaagccct

SEQ ID NO: 5058109 - DNA, 23 bp, Homo sapiens
agtgtccattttgtgaagccctg

SEQ ID NO: 5058110 - DNA, 14 bp, Homo sapiens
agtgtcccaggcag

SEQ ID NO: 5058111 - DNA, 18 bp, Homo sapiens
agtgtccccagagacatg

SEQ ID NO: 5058112 - DNA, 23 bp, Homo sapiens
agtgtccccaggggcacacttcc

SEQ ID NO: 5058113 - DNA, 22 bp, Homo sapiens
agtgtccccccttgaagcaata

SEQ ID NO: 5058114 - DNA, 13 bp, Homo sapiens
agtgtcccctcca

SEQ ID NO: 5058115 - DNA, 15 bp, Homo sapiens
agtgtcccctgcccc

SEQ ID NO: 5058116 - DNA, 21 bp, Homo sapiens
agtgtcccctgccccagaggt

SEQ ID NO: 5058117 - DNA, 17 bp, Homo sapiens
agtgtcctataattcta

SEQ ID NO: 5058118 - DNA, 19 bp, Homo sapiens
agtgtcctatgcaataaaa

SEQ ID NO: 5058119 - DNA, 17 bp, Homo sapiens
agtgtcctcatctataa

SEQ ID NO: 5058120 - DNA, 15 bp, Homo sapiens
agtgtcctccaagtg

SEQ ID NO: 5058121 - DNA, 16 bp, Homo sapiens
agtgtcctccaagtgc

SEQ ID NO: 5058122 - DNA, 23 bp, Homo sapiens
agtgtcctccaagtgccccctca

SEQ ID NO: 5058123 - DNA, 21 bp, Homo sapiens
agtgtcctgagctcagcgtgg

SEQ ID NO: 5058124 - DNA, 14 bp, Homo sapiens
agtgtcctgcccac

SEQ ID NO: 5058125 - DNA, 16 bp, Homo sapiens
agtgtcctgctacctt

SEQ ID NO: 5058126 - DNA, 19 bp, Homo sapiens
agtgtcctggaccctggcc

SEQ ID NO: 5058127 - DNA, 15 bp, Homo sapiens
agtgtcctgtctgct

SEQ ID NO: 5058128 - DNA, 18 bp, Homo sapiens
agtgtcctgtgctttctg

SEQ ID NO: 5058129 - DNA, 22 bp, Homo sapiens
agtgtcctgtgctttctgcatg

SEQ ID NO: 5058130 - DNA, 14 bp, Homo sapiens
agtgtccttagtgt

SEQ ID NO: 5058131 - DNA, 18 bp, Homo sapiens
agtgtccttagtgtataa

SEQ ID NO: 5058132 - DNA, 17 bp, Homo sapiens
agtgtcgggaattttcc

SEQ ID NO: 5058133 - DNA, 14 bp, Homo sapiens
agtgtctaaaaaca

SEQ ID NO: 5058134 - DNA, 16 bp, Homo sapiens
agtgtctaagttttgt

SEQ ID NO: 5058135 - DNA, 19 bp, Homo sapiens
agtgtctaagttttgtcat

SEQ ID NO: 5058136 - DNA, 23 bp, Homo sapiens
agtgtctaggcactgagcaggga

SEQ ID NO: 5058137 - DNA, 18 bp, Homo sapiens
agtgtctatggagcagcc

SEQ ID NO: 5058138 - DNA, 16 bp, Homo sapiens
agtgtctattatcaca

SEQ ID NO: 5058139 - DNA, 14 bp, Homo sapiens
agtgtctcaaagga

SEQ ID NO: 5058140 - DNA, 17 bp, Homo sapiens
agtgtctcattctcaga

SEQ ID NO: 5058141 - DNA, 14 bp, Homo sapiens
agtgtctctattta

SEQ ID NO: 5058142 - DNA, 10 bp, Homo sapiens
agtgtctctg

SEQ ID NO: 5058143 - DNA, 19 bp, Homo sapiens
agtgtctcttgactggctc

SEQ ID NO: 5058144 - DNA, 21 bp, Homo sapiens
agtgtctgacttttgttaaat

SEQ ID NO: 5058145 - DNA, 23 bp, Homo sapiens
agtgtctgccagctgggcccagc

SEQ ID NO: 5058146 - DNA, 20 bp, Homo sapiens
agtgtctgcgccccgcctcc

SEQ ID NO: 5058147 - DNA, 20 bp, Homo sapiens
agtgtctgctgctgcctccc

SEQ ID NO: 5058148 - DNA, 19 bp, Homo sapiens
agtgtctggagcgcttcag

SEQ ID NO: 5058149 - DNA, 19 bp, Homo sapiens
agtgtctggcccagccatg

SEQ ID NO: 5058150 - DNA, 24 bp, Homo sapiens
agtgtctggcccagccatggctgg

SEQ ID NO: 5058151 - DNA, 17 bp, Homo sapiens
agtgtctgggtttttct

SEQ ID NO: 5058152 - DNA, 13 bp, Homo sapiens
agtgtctgtaaat

SEQ ID NO: 5058153 - DNA, 19 bp, Homo sapiens
agtgtctgtaggtacgttt

SEQ ID NO: 5058154 - DNA, 17 bp, Homo sapiens
agtgtctgtctgaggtg

SEQ ID NO: 5058155 - DNA, 16 bp, Homo sapiens
agtgtctgtgccatgg

SEQ ID NO: 5058156 - DNA, 16 bp, Homo sapiens
agtgtctgttcagcaa

SEQ ID NO: 5058157 - DNA, 19 bp, Homo sapiens
agtgtctgttcttcatttc

SEQ ID NO: 5058158 - DNA, 18 bp, Homo sapiens
agtgtcttaattaaaaga

SEQ ID NO: 5058159 - DNA, 21 bp, Homo sapiens
agtgtcttaattaaaagaata

SEQ ID NO: 5058160 - DNA, 14 bp, Homo sapiens
agtgtcttccataa

SEQ ID NO: 5058161 - DNA, 22 bp, Homo sapiens
agtgtcttcttaaaatcaaatg

SEQ ID NO: 5058162 - DNA, 20 bp, Homo sapiens
agtgtctttcggaattttta

SEQ ID NO: 5058163 - DNA, 16 bp, Homo sapiens
agtgtctttctagcca

SEQ ID NO: 5058164 - DNA, 21 bp, Homo sapiens
agtgtctttctttggtgcctt

SEQ ID NO: 5058165 - DNA, 16 bp, Homo sapiens
agtgtcttttgacatt

SEQ ID NO: 5058166 - DNA, 19 bp, Homo sapiens
agtgtctttttttgtatag

SEQ ID NO: 5058167 - DNA, 20 bp, Homo sapiens
agtgtctttttttgtatagt

SEQ ID NO: 5058168 - DNA, 22 bp, Homo sapiens
agtgtctttttttgtatagtta

SEQ ID NO: 5058169 - DNA, 20 bp, Homo sapiens
agtgtgaaatagttctgcca

SEQ ID NO: 5058170 - DNA, 22 bp, Homo sapiens
agtgtgaacaaaagatgctctt

SEQ ID NO: 5058171 - DNA, 13 bp, Homo sapiens
ataataaaacatg

SEQ ID NO: 5058172 - DNA, 13 bp, Homo sapiens
ataataaaaccaa

SEQ ID NO: 5058173 - DNA, 14 bp, Homo sapiens
ataataaaaccaaa

SEQ ID NO: 5058174 - DNA, 20 bp, Homo sapiens
ataataaaaggaaaagcaaa

SEQ ID NO: 5058175 - DNA, 12 bp, Homo sapiens
ataataaaatag

SEQ ID NO: 5058176 - DNA, 14 bp, Homo sapiens
ataataaaatcaaa

SEQ ID NO: 5058177 - DNA, 13 bp, Homo sapiens
ataataaaatcac

SEQ ID NO: 5058178 - DNA, 16 bp, Homo sapiens
ataataaaatgcaaat

SEQ ID NO: 5058179 - DNA, 17 bp, Homo sapiens
ataataaaatgcaaatg

SEQ ID NO: 5058180 - DNA, 23 bp, Homo sapiens
ataataaaatgcaaatgaatcat

SEQ ID NO: 5058181 - DNA, 13 bp, Homo sapiens
ataataaaattat

SEQ ID NO: 5058182 - DNA, 14 bp, Homo sapiens
ataataaaattcat

SEQ ID NO: 5058183 - DNA, 21 bp, Homo sapiens
ataataaaattcattccattt

SEQ ID NO: 5058184 - DNA, 13 bp, Homo sapiens
ataataaacataa

SEQ ID NO: 5058185 - DNA, 17 bp, Homo sapiens
ataataaacgatgttgt

SEQ ID NO: 5058186 - DNA, 20 bp, Homo sapiens
ataataaacgatgttgtgat

SEQ ID NO: 5058187 - DNA, 13 bp, Homo sapiens
ataataaactaga

SEQ ID NO: 5058188 - DNA, 19 bp, Homo sapiens
ataataaacttttttgaaa

SEQ ID NO: 5058189 - DNA, 17 bp, Homo sapiens
gggagccagctgcttga

SEQ ID NO: 5058190 - DNA, 12 bp, Homo sapiens
gggagccaggac

SEQ ID NO: 5058191 - DNA, 12 bp, Homo sapiens
gggagccagggc

SEQ ID NO: 5058192 - DNA, 12 bp, Homo sapiens
gggagccagggt

SEQ ID NO: 5058193 - DNA, 15 bp, Homo sapiens
gggagccatttgaga

SEQ ID NO: 5058194 - DNA, 12 bp, Homo sapiens
gggagcccactg

SEQ ID NO: 5058195 - DNA, 19 bp, Homo sapiens
gggagcccactgaggggcc

SEQ ID NO: 5058196 - DNA, 20 bp, Homo sapiens
gggagcccactgtcctgggc

SEQ ID NO: 5058197 - DNA, 18 bp, Homo sapiens
gtggcacgatctcagctc

SEQ ID NO: 5058198 - DNA, 16 bp, Homo sapiens
gtggcacgcacctgta

SEQ ID NO: 5058199 - DNA, 23 bp, Homo sapiens
gtggcacgcacctgtagtcccag

SEQ ID NO: 5058200 - DNA, 19 bp, Homo sapiens
gtggcactcaactctgagc

SEQ ID NO: 5058201 - DNA, 15 bp, Homo sapiens
gtggcactgagcccc

SEQ ID NO: 5058202 - DNA, 19 bp, Homo sapiens
gtggcactgggagggggtg

SEQ ID NO: 5058203 - DNA, 22 bp, Homo sapiens
gtggcacttccacctccagcct

SEQ ID NO: 5058204 - DNA, 19 bp, Homo sapiens
gtggcacttgcctgggtca

SEQ ID NO: 5058205 - DNA, 21 bp, Homo sapiens
gtggcagaaatcccagttcat

SEQ ID NO: 5058206 - DNA, 22 bp, Homo sapiens
gtggcagaagtgtcaccctgtg

SEQ ID NO: 5058207 - DNA, 19 bp, Homo sapiens
gtggcagagacagtgggca

SEQ ID NO: 5058208 - DNA, 11 bp, Homo sapiens
gtggcagagga

SEQ ID NO: 5058209 - DNA, 22 bp, Homo sapiens
gtggcagcaacaaaggatttga

SEQ ID NO: 5058210 - DNA, 19 bp, Homo sapiens
gtggcagcaacggcacagc

SEQ ID NO: 5058211 - DNA, 13 bp, Homo sapiens
gtggcagcaagca

SEQ ID NO: 5058212 - DNA, 12 bp, Homo sapiens
gtggcagcagcc

SEQ ID NO: 5058213 - DNA, 13 bp, Homo sapiens
gtggcagcaggag

SEQ ID NO: 5058214 - DNA, 14 bp, Homo sapiens
gtggcagccatgcc

SEQ ID NO: 5058215 - DNA, 16 bp, Homo sapiens
gtggcagccatgcctc

SEQ ID NO: 5058216 - DNA, 22 bp, Homo sapiens
gtggcagccatgcctcatgcca

SEQ ID NO: 5058217 - DNA, 14 bp, Homo sapiens
gtggcagcccagcc

SEQ ID NO: 5058218 - DNA, 17 bp, Homo sapiens
gtggcagcccagccagc

SEQ ID NO: 5058219 - DNA, 19 bp, Homo sapiens
gtggcagctgccccagggc

SEQ ID NO: 5058220 - DNA, 17 bp, Homo sapiens
gtggcagctgcggtcca

SEQ ID NO: 5058221 - DNA, 22 bp, Homo sapiens
gtggcagctgcggtccacccag

SEQ ID NO: 5058222 - DNA, 12 bp, Homo sapiens
gtggcagctgct

SEQ ID NO: 5058223 - DNA, 15 bp, Homo sapiens
gtggcagctggggag

SEQ ID NO: 5058224 - DNA, 20 bp, Homo sapiens
gtggcagctggggagcagct

SEQ ID NO: 5058225 - DNA, 23 bp, Homo sapiens
gtggcagctggggagcagctgag

SEQ ID NO: 5058226 - DNA, 14 bp, Homo sapiens
gtggcagctgtccc

SEQ ID NO: 5058227 - DNA, 22 bp, Homo sapiens
gtggcagctgtcccctctccct

SEQ ID NO: 5058228 - DNA, 15 bp, Homo sapiens
gtggcagcttgctgg

SEQ ID NO: 5058229 - DNA, 19 bp, Homo sapiens
gtggcagcttgctgggctt

SEQ ID NO: 5058230 - DNA, 20 bp, Homo sapiens
gtggcagcttgctgggcttt

SEQ ID NO: 5058231 - DNA, 15 bp, Homo sapiens
gtggcaggaaaatgg

SEQ ID NO: 5058232 - DNA, 19 bp, Homo sapiens
gtggcaggcacacagcagc

SEQ ID NO: 5058233 - DNA, 22 bp, Homo sapiens
gtggcaggcacacagcagcccc

SEQ ID NO: 5058234 - DNA, 19 bp, Homo sapiens
gtggcaggcagcgccaagc

SEQ ID NO: 5058235 - DNA, 20 bp, Homo sapiens
gtggcagggaagggtgcctg

SEQ ID NO: 5058236 - DNA, 21 bp, Homo sapiens
gtggcagggaagggtgcctgg

SEQ ID NO: 5058237 - DNA, 22 bp, Homo sapiens
gtggcagggaccggcagagctc

SEQ ID NO: 5058238 - DNA, 18 bp, Homo sapiens
gtggcagggcctagctgc

SEQ ID NO: 5058239 - DNA, 13 bp, Homo sapiens
gtggcagggctca

SEQ ID NO: 5058240 - DNA, 16 bp, Homo sapiens
gtggcaggggagcagg

SEQ ID NO: 5058241 - DNA, 19 bp, Homo sapiens
gtggcaggtcactgtcact

SEQ ID NO: 5058242 - DNA, 20 bp, Homo sapiens
gtggcaggtcactgtcactg

SEQ ID NO: 5058243 - DNA, 21 bp, Homo sapiens
gtggcaggtgggctgcctgct

SEQ ID NO: 5058244 - DNA, 20 bp, Homo sapiens
gtggcagtaaagagaaactt

SEQ ID NO: 5058245 - DNA, 12 bp, Homo sapiens
gtggcagtattg

SEQ ID NO: 5058246 - DNA, 18 bp, Homo sapiens
gtggcagtggaggtgggg

SEQ ID NO: 5058247 - DNA, 18 bp, Homo sapiens
gtggcagtggccaggcag

SEQ ID NO: 5058248 - DNA, 15 bp, Homo sapiens
gtggcagtgggagct

SEQ ID NO: 5058249 - DNA, 19 bp, Homo sapiens
gtggcagtgggagctgcct

SEQ ID NO: 5058250 - DNA, 18 bp, Homo sapiens
gtggcagttacagggccc

SEQ ID NO: 5058251 - DNA, 16 bp, Homo sapiens
gtggcagttctttact

SEQ ID NO: 5058252 - DNA, 15 bp, Homo sapiens
gtggcagtttggcaa

SEQ ID NO: 5058253 - DNA, 18 bp, Homo sapiens
gtggcatatggaagggac

SEQ ID NO: 5058254 - DNA, 15 bp, Homo sapiens
gtggcatcacagacc

SEQ ID NO: 5058255 - DNA, 22 bp, Homo sapiens
gtggcatcaccttaggcaggga

SEQ ID NO: 5058256 - DNA, 20 bp, Homo sapiens
gtggcatcaggagctgctca

SEQ ID NO: 5058257 - DNA, 21 bp, Homo sapiens
gtggcatcaggagctgctcag

SEQ ID NO: 5058258 - DNA, 22 bp, Homo sapiens
gtggcatcaggagctgctcagg

SEQ ID NO: 5058259 - DNA, 20 bp, Homo sapiens
gtggcatcctccggagagag

SEQ ID NO: 5058260 - DNA, 21 bp, Homo sapiens
gtggcatctttgccttgggct

SEQ ID NO: 5058261 - DNA, 16 bp, Homo sapiens
gtggcatgcacctgca

SEQ ID NO: 5058262 - DNA, 13 bp, Homo sapiens
gtggcatggccac

SEQ ID NO: 5058263 - DNA, 14 bp, Homo sapiens
gtggcatggtcctg

SEQ ID NO: 5058264 - DNA, 18 bp, Homo sapiens
gtggcatgtccacgtgtg

SEQ ID NO: 5058265 - DNA, 14 bp, Homo sapiens
gtggcatgtggcct

SEQ ID NO: 5058266 - DNA, 19 bp, Homo sapiens
gtggcattctctctgctca

SEQ ID NO: 5058267 - DNA, 16 bp, Homo sapiens
gtggcatttgctgaat

SEQ ID NO: 5058268 - DNA, 19 bp, Homo sapiens
gtggccaaaagctagacag

SEQ ID NO: 5058269 - DNA, 21 bp, Homo sapiens
gtggccaaccaggacccaggg

SEQ ID NO: 5058270 - DNA, 22 bp, Homo sapiens
gtggccaaccaggacccagggt

SEQ ID NO: 5058271 - DNA, 23 bp, Homo sapiens
gtggccaagaagcagtggcctta

SEQ ID NO: 5058272 - DNA, 19 bp, Homo sapiens
gtggccaagcctgccccgg

SEQ ID NO: 5058273 - DNA, 21 bp, Homo sapiens
gtggccaagcctgccccggcc

SEQ ID NO: 5058274 - DNA, 20 bp, Homo sapiens
gtggccacacaggcagggcc

SEQ ID NO: 5058275 - DNA, 23 bp, Homo sapiens
gtggccacacaggcagggcctgg

SEQ ID NO: 5058276 - DNA, 16 bp, Homo sapiens
gtggccacaccacagc

SEQ ID NO: 5058277 - DNA, 14 bp, Homo sapiens
gtggccacagcacc

SEQ ID NO: 5058278 - DNA, 14 bp, Homo sapiens
gtggccacagcccc

SEQ ID NO: 5058279 - DNA, 16 bp, Homo sapiens
gtggccacagcgccag

SEQ ID NO: 5058280 - DNA, 14 bp, Homo sapiens
gtggccacagcgtg

SEQ ID NO: 5058281 - DNA, 19 bp, Homo sapiens
gtggccaccgggggtggct

SEQ ID NO: 5058282 - DNA, 21 bp, Homo sapiens
gtggccaccgggggtggctct

SEQ ID NO: 5058283 - DNA, 14 bp, Homo sapiens
gtggccactcagct

SEQ ID NO: 5058284 - DNA, 15 bp, Homo sapiens
gtggccactgagctg

SEQ ID NO: 5058285 - DNA, 16 bp, Homo sapiens
gtggccactgagctgg

SEQ ID NO: 5058286 - DNA, 18 bp, Homo sapiens
gtggccactgagctggct

SEQ ID NO: 5058287 - DNA, 19 bp, Homo sapiens
gtggccactgagctggctg

SEQ ID NO: 5058288 - DNA, 23 bp, Homo sapiens
gtggccacttcattccagcagct

SEQ ID NO: 5058289 - DNA, 16 bp, Homo sapiens
gtggccactttaagag

SEQ ID NO: 5058290 - DNA, 20 bp, Homo sapiens
gtggccagaagagcttgtca

SEQ ID NO: 5058291 - DNA, 15 bp, Homo sapiens
gtggccagaccagag

SEQ ID NO: 5058292 - DNA, 17 bp, Homo sapiens
gtggccagagcacctca

SEQ ID NO: 5058293 - DNA, 18 bp, Homo sapiens
gtggccagagcacctcag

SEQ ID NO: 5058294 - DNA, 14 bp, Homo sapiens
gtggccagagctgg

SEQ ID NO: 5058295 - DNA, 19 bp, Homo sapiens
gtggccagagctggaaggc

SEQ ID NO: 5058296 - DNA, 13 bp, Homo sapiens
gtggccagaggtg

SEQ ID NO: 5058297 - DNA, 19 bp, Homo sapiens
gtggccagaggtgtcaccc

SEQ ID NO: 5058298 - DNA, 17 bp, Homo sapiens
gtggccagccagtgcca

SEQ ID NO: 5058299 - DNA, 13 bp, Homo sapiens
gtggccagcccgc

SEQ ID NO: 5058300 - DNA, 14 bp, Homo sapiens
gtggccagcctgga

SEQ ID NO: 5058301 - DNA, 13 bp, Homo sapiens
gtggccagcgcca

SEQ ID NO: 5058302 - DNA, 12 bp, Homo sapiens
gtggccaggagg

SEQ ID NO: 5058303 - DNA, 13 bp, Homo sapiens
gtggccaggctgg

SEQ ID NO: 5058304 - DNA, 14 bp, Homo sapiens
gtggccaggctggt

SEQ ID NO: 5058305 - DNA, 10 bp, Homo sapiens
gtggccaggg

SEQ ID NO: 5058306 - DNA, 13 bp, Homo sapiens
gtggccagggctt

SEQ ID NO: 5058307 - DNA, 14 bp, Homo sapiens
gtggccagggcttc

SEQ ID NO: 5058308 - DNA, 15 bp, Homo sapiens
gtggccagggcttcc

SEQ ID NO: 5058309 - DNA, 23 bp, Homo sapiens
gtggccagggcttccccatcagc

SEQ ID NO: 5058310 - DNA, 13 bp, Homo sapiens
gtggccagggtga

SEQ ID NO: 5058311 - DNA, 16 bp, Homo sapiens
gtggccatcactcagc

SEQ ID NO: 5058312 - DNA, 18 bp, Homo sapiens
gtggccatcactcagccc

SEQ ID NO: 5058313 - DNA, 19 bp, Homo sapiens
gtggccatcactcagcccc

SEQ ID NO: 5058314 - DNA, 21 bp, Homo sapiens
gtggccatcactcagccccta

SEQ ID NO: 5058315 - DNA, 21 bp, Homo sapiens
gtggccatcaggactttccct

SEQ ID NO: 5058316 - DNA, 15 bp, Homo sapiens
gtggccatccctggg

SEQ ID NO: 5058317 - DNA, 17 bp, Homo sapiens
gtggccatccctgggcc

SEQ ID NO: 5058318 - DNA, 19 bp, Homo sapiens
gtggccatccctgggcccc

SEQ ID NO: 5058319 - DNA, 22 bp, Homo sapiens
gtggccatccctgggcccctcc

SEQ ID NO: 5058320 - DNA, 18 bp, Homo sapiens
gtggccatccctgtgagg

SEQ ID NO: 5058321 - DNA, 18 bp, Homo sapiens
gtggccatcctacccagc

SEQ ID NO: 5058322 - DNA, 13 bp, Homo sapiens
gtggccatctgga

SEQ ID NO: 5058323 - DNA, 21 bp, Homo sapiens
gtggccatgaccctgcctctc

SEQ ID NO: 5058324 - DNA, 19 bp, Homo sapiens
gtggccatgctcctcttcc

SEQ ID NO: 5058325 - DNA, 19 bp, Homo sapiens
gtggccatgcttcttgccc

SEQ ID NO: 5058326 - DNA, 16 bp, Homo sapiens
gtggccatggcctctg

SEQ ID NO: 5058327 - DNA, 23 bp, Homo sapiens
gtggccatttagccaccatcttt

SEQ ID NO: 5058328 - DNA, 20 bp, Homo sapiens
gtggcccacgggccggccag

SEQ ID NO: 5058329 - DNA, 15 bp, Homo sapiens
gtggcccagagccat

SEQ ID NO: 5058330 - DNA, 19 bp, Homo sapiens
gtggcccagagccatactg

SEQ ID NO: 5058331 - DNA, 14 bp, Homo sapiens
gtggcccagagcct

SEQ ID NO: 5058332 - DNA, 13 bp, Homo sapiens
gtggcccagcacg

SEQ ID NO: 5058333 - DNA, 11 bp, Homo sapiens
gtggcccagct

SEQ ID NO: 5058334 - DNA, 13 bp, Homo sapiens
gtggcccaggacc

SEQ ID NO: 5058335 - DNA, 22 bp, Homo sapiens
gtggcccagtcgtccgctcagc

SEQ ID NO: 5058336 - DNA, 20 bp, Homo sapiens
gtggcccatcccccctcacc

SEQ ID NO: 5058337 - DNA, 15 bp, Homo sapiens
gtggccccaccctgg

SEQ ID NO: 5058338 - DNA, 12 bp, Homo sapiens
gtggccccagcc

SEQ ID NO: 5058339 - DNA, 22 bp, Homo sapiens
gtggccccagctgtgactgagg

SEQ ID NO: 5058340 - DNA, 15 bp, Homo sapiens
gtggccccaggtgcc

SEQ ID NO: 5058341 - DNA, 17 bp, Homo sapiens
gtggccccaggtgccac

SEQ ID NO: 5058342 - DNA, 18 bp, Homo sapiens
gtggccccatccagcatg

SEQ ID NO: 5058343 - DNA, 22 bp, Homo sapiens
gtggccccatccagcatgtgtg

SEQ ID NO: 5058344 - DNA, 21 bp, Homo sapiens
gtggcccccgccccctcccta

SEQ ID NO: 5058345 - DNA, 13 bp, Homo sapiens
gtggcccccgggc

SEQ ID NO: 5058346 - DNA, 15 bp, Homo sapiens
gtggcccccgggcct

SEQ ID NO: 5058347 - DNA, 16 bp, Homo sapiens
gtggcccccgggcctg

SEQ ID NO: 5058348 - DNA, 13 bp, Homo sapiens
gtggccccctgtc

SEQ ID NO: 5058349 - DNA, 21 bp, Homo sapiens
gtggccccctgtccccaagac

SEQ ID NO: 5058350 - DNA, 17 bp, Homo sapiens
gtggccccctgtgccag

SEQ ID NO: 5058351 - DNA, 21 bp, Homo sapiens
gtggccccctgtgccagctca

SEQ ID NO: 5058352 - DNA, 23 bp, Homo sapiens
gtggccccgcccgagcccctgcc

SEQ ID NO: 5058353 - DNA, 16 bp, Homo sapiens
gtggccccgccctcag

SEQ ID NO: 5058354 - DNA, 23 bp, Homo sapiens
gtggccccgtttctggtggtctg

SEQ ID NO: 5058355 - DNA, 11 bp, Homo sapiens
gtggcccctcc

SEQ ID NO: 5058356 - DNA, 17 bp, Homo sapiens
gtggcccctcccctgca

SEQ ID NO: 5058357 - DNA, 19 bp, Homo sapiens
gtggcccctcccctgcaga

SEQ ID NO: 5058358 - DNA, 22 bp, Homo sapiens
gtggcccctgctgtctctctgg

SEQ ID NO: 5058359 - DNA, 16 bp, Homo sapiens
gtggcccgacagcctg

SEQ ID NO: 5058360 - DNA, 17 bp, Homo sapiens
gtggcccgtggcctggc

SEQ ID NO: 5058361 - DNA, 13 bp, Homo sapiens
gtggccctccctc

SEQ ID NO: 5058362 - DNA, 19 bp, Homo sapiens
gtggccctctcccttaccc

SEQ ID NO: 5058363 - DNA, 13 bp, Homo sapiens
gtggccctgccat

SEQ ID NO: 5058364 - DNA, 13 bp, Homo sapiens
gtggccctgccct

SEQ ID NO: 5058365 - DNA, 21 bp, Homo sapiens
gtggccctgccctctccttcc

SEQ ID NO: 5058366 - DNA, 23 bp, Homo sapiens
gtggccctgccctctccttcctt

SEQ ID NO: 5058367 - DNA, 20 bp, Homo sapiens
gtggctgaccaggccctgct

SEQ ID NO: 5058368 - DNA, 15 bp, Homo sapiens
gtggctgacccagtc

SEQ ID NO: 5058369 - DNA, 19 bp, Homo sapiens
gtggctgacccagtccctg

SEQ ID NO: 5058370 - DNA, 20 bp, Homo sapiens
gtggctgatgctttgaacat

SEQ ID NO: 5058371 - DNA, 15 bp, Homo sapiens
gtggctgcagcagcg

SEQ ID NO: 5058372 - DNA, 19 bp, Homo sapiens
gtggctgcaggcaccgctg

SEQ ID NO: 5058373 - DNA, 18 bp, Homo sapiens
gtggctgccacacccagg

SEQ ID NO: 5058374 - DNA, 18 bp, Homo sapiens
gtggctgccagcccactg

SEQ ID NO: 5058375 - DNA, 19 bp, Homo sapiens
gtggctgccagcccactgc

SEQ ID NO: 5058376 - DNA, 13 bp, Homo sapiens
gtggctgccccgg

SEQ ID NO: 5058377 - DNA, 16 bp, Homo sapiens
gggagggagggggagg

SEQ ID NO: 5058378 - DNA, 22 bp, Homo sapiens
gggagggagtctcaggaggagg

SEQ ID NO: 5058379 - DNA, 14 bp, Homo sapiens
gggagggagtctgg

SEQ ID NO: 5058380 - DNA, 15 bp, Homo sapiens
gggagggagtctggg

SEQ ID NO: 5058381 - DNA, 22 bp, Homo sapiens
gggagggatgaagggcgagtga

SEQ ID NO: 5058382 - DNA, 11 bp, Homo sapiens
gggagggatta

SEQ ID NO: 5058383 - DNA, 22 bp, Homo sapiens
gggagggattctggttccaggg

SEQ ID NO: 5058384 - DNA, 20 bp, Homo sapiens
gggagggcaggtccagctct

SEQ ID NO: 5058385 - DNA, 14 bp, Homo sapiens
gggagggccaggat

SEQ ID NO: 5058386 - DNA, 21 bp, Homo sapiens
gggagggccagggaggcagag

SEQ ID NO: 5058387 - DNA, 19 bp, Homo sapiens
gggagggccggcggctctg

SEQ ID NO: 5058388 - DNA, 23 bp, Homo sapiens
gggagggccggcggctctgagca

SEQ ID NO: 5058389 - DNA, 13 bp, Homo sapiens
gggagggcctggg

SEQ ID NO: 5058390 - DNA, 21 bp, Homo sapiens
gggagggcggtggacaataaa

SEQ ID NO: 5058391 - DNA, 18 bp, Homo sapiens
gggagggcgtcaggcaga

SEQ ID NO: 5058392 - DNA, 13 bp, Homo sapiens
gggagggctccag

SEQ ID NO: 5058393 - DNA, 14 bp, Homo sapiens
gggagggctccaga

SEQ ID NO: 5058394 - DNA, 18 bp, Homo sapiens
gggagggctccagacaca

SEQ ID NO: 5058395 - DNA, 13 bp, Homo sapiens
gggagggctcctg

SEQ ID NO: 5058396 - DNA, 17 bp, Homo sapiens
gggagggctcctggggc

SEQ ID NO: 5058397 - DNA, 22 bp, Homo sapiens
gggagggctcctggggcagaga

SEQ ID NO: 5058398 - DNA, 12 bp, Homo sapiens
gggagggctctg

SEQ ID NO: 5058399 - DNA, 16 bp, Homo sapiens
gggagggctctgaggc

SEQ ID NO: 5058400 - DNA, 19 bp, Homo sapiens
gggagggctctgaggcgcc

SEQ ID NO: 5058401 - DNA, 14 bp, Homo sapiens
gggagggctgcctg

SEQ ID NO: 5058402 - DNA, 13 bp, Homo sapiens
gggagggctgcga

SEQ ID NO: 5058403 - DNA, 16 bp, Homo sapiens
gggaggggaaaagcat

SEQ ID NO: 5058404 - DNA, 16 bp, Homo sapiens
gggaggggaagggctg

SEQ ID NO: 5058405 - DNA, 14 bp, Homo sapiens
gggaggggacagag

SEQ ID NO: 5058406 - DNA, 15 bp, Homo sapiens
gggaggggacagagc

SEQ ID NO: 5058407 - DNA, 22 bp, Homo sapiens
gggaggggacagaggccctgcc

SEQ ID NO: 5058408 - DNA, 12 bp, Homo sapiens
gggaggggagag

SEQ ID NO: 5058409 - DNA, 14 bp, Homo sapiens
gggaggggaggtgg

SEQ ID NO: 5058410 - DNA, 15 bp, Homo sapiens
gggaggggaggtggc

SEQ ID NO: 5058411 - DNA, 19 bp, Homo sapiens
gggaggggatggcagacag

SEQ ID NO: 5058412 - DNA, 14 bp, Homo sapiens
gggaggggcaggct

SEQ ID NO: 5058413 - DNA, 13 bp, Homo sapiens
gggaggggccctc

SEQ ID NO: 5058414 - DNA, 19 bp, Homo sapiens
gggaggggccctcaggcca

SEQ ID NO: 5058415 - DNA, 14 bp, Homo sapiens
gggaggggcctagg

SEQ ID NO: 5058416 - DNA, 16 bp, Homo sapiens
gggaggggcctggcct

SEQ ID NO: 5058417 - DNA, 21 bp, Homo sapiens
gggaggggcgcgggagggggc

SEQ ID NO: 5058418 - DNA, 16 bp, Homo sapiens
gggaggggcgctggcc

SEQ ID NO: 5058419 - DNA, 13 bp, Homo sapiens
gggaggggctctg

SEQ ID NO: 5058420 - DNA, 13 bp, Homo sapiens
gggagggggacct

SEQ ID NO: 5058421 - DNA, 15 bp, Homo sapiens
gggagggggatccga

SEQ ID NO: 5058422 - DNA, 18 bp, Homo sapiens
gggagggggcacggcagg

SEQ ID NO: 5058423 - DNA, 19 bp, Homo sapiens
gggagggggcccttccaga

SEQ ID NO: 5058424 - DNA, 13 bp, Homo sapiens
gggagggggctcc

SEQ ID NO: 5058425 - DNA, 13 bp, Homo sapiens
gggagggggctgg

SEQ ID NO: 5058426 - DNA, 14 bp, Homo sapiens
gggagggggtcctg

SEQ ID NO: 5058427 - DNA, 18 bp, Homo sapiens
gggaggggtcagctctgg

SEQ ID NO: 5058428 - DNA, 15 bp, Homo sapiens
gggagggtaccagca

SEQ ID NO: 5058429 - DNA, 22 bp, Homo sapiens
gggagggtcatgtacttcttta

SEQ ID NO: 5058430 - DNA, 19 bp, Homo sapiens
gggagggtgacccacagct

SEQ ID NO: 5058431 - DNA, 24 bp, Homo sapiens
gggagggtgacccacagctctggg

SEQ ID NO: 5058432 - DNA, 14 bp, Homo sapiens
gggagggtgagctg

SEQ ID NO: 5058433 - DNA, 16 bp, Homo sapiens
gggagggtggatccac

SEQ ID NO: 5058434 - DNA, 15 bp, Homo sapiens
gggagggtggcagag

SEQ ID NO: 5058435 - DNA, 17 bp, Homo sapiens
gggagggtggcagagac

SEQ ID NO: 5058436 - DNA, 18 bp, Homo sapiens
gggagggttcccctggcc

SEQ ID NO: 5058437 - DNA, 19 bp, Homo sapiens
gggagggttcccctggcct

SEQ ID NO: 5058438 - DNA, 20 bp, Homo sapiens
gggaggtcccagggccctag

SEQ ID NO: 5058439 - DNA, 15 bp, Homo sapiens
gggaggtcgaggcag

SEQ ID NO: 5058440 - DNA, 18 bp, Homo sapiens
gggaggtcgaggcaggag

SEQ ID NO: 5058441 - DNA, 21 bp, Homo sapiens
gggaggtctcgtcccagccct

SEQ ID NO: 5058442 - DNA, 21 bp, Homo sapiens
gggaggtgaaaagggcagagg

SEQ ID NO: 5058443 - DNA, 18 bp, Homo sapiens
gggaggtgagaccacctc

SEQ ID NO: 5058444 - DNA, 15 bp, Homo sapiens
gggaggtgagctaga

SEQ ID NO: 5058445 - DNA, 23 bp, Homo sapiens
gggaggtggaagaagggagaaga

SEQ ID NO: 5058446 - DNA, 12 bp, Homo sapiens
gggaggtggcca

SEQ ID NO: 5058447 - DNA, 18 bp, Homo sapiens
gggaggtggccagcccgc

SEQ ID NO: 5058448 - DNA, 22 bp, Homo sapiens
gggaggtggccgtcgagttgac

SEQ ID NO: 5058449 - DNA, 14 bp, Homo sapiens
gggaggtgggaggc

SEQ ID NO: 5058450 - DNA, 19 bp, Homo sapiens
gggaggtgggtgtgggtgg

SEQ ID NO: 5058451 - DNA, 22 bp, Homo sapiens
gggaggtgtttaaagagaggtt

SEQ ID NO: 5058452 - DNA, 19 bp, Homo sapiens
gggaggttgggaggctgtg

SEQ ID NO: 5058453 - DNA, 15 bp, Homo sapiens
gggaggttggttcct

SEQ ID NO: 5058454 - DNA, 16 bp, Homo sapiens
gggaggttgtggggcc

SEQ ID NO: 5058455 - DNA, 23 bp, Homo sapiens
gggaggttgtggggcctcaggct

SEQ ID NO: 5058456 - DNA, 21 bp, Homo sapiens
gggaggttttattctgacttc

SEQ ID NO: 5058457 - DNA, 22 bp, Homo sapiens
gggagtaagaaatgggcctcag

SEQ ID NO: 5058458 - DNA, 18 bp, Homo sapiens
gggagtaagtagaggtgg

SEQ ID NO: 5058459 - DNA, 20 bp, Homo sapiens
gggagtaataggaccagagc

SEQ ID NO: 5058460 - DNA, 19 bp, Homo sapiens
gggagtaggctccagacag

SEQ ID NO: 5058461 - DNA, 21 bp, Homo sapiens
gggagtatgctggaggcagag

SEQ ID NO: 5058462 - DNA, 13 bp, Homo sapiens
gggagtatgttgt

SEQ ID NO: 5058463 - DNA, 20 bp, Homo sapiens
gggagtatgttgtcataaca

SEQ ID NO: 5058464 - DNA, 16 bp, Homo sapiens
gggagtcaagtgtgcc

SEQ ID NO: 5058465 - DNA, 19 bp, Homo sapiens
gggagtcaagtgtgcctgc

SEQ ID NO: 5058466 - DNA, 20 bp, Homo sapiens
gggagtcaagtgtgcctgct

SEQ ID NO: 5058467 - DNA, 21 bp, Homo sapiens
gggagtcaagtgtgcctgcta

SEQ ID NO: 5058468 - DNA, 16 bp, Homo sapiens
gggagtcaccttccct

SEQ ID NO: 5058469 - DNA, 19 bp, Homo sapiens
gggagtcaggcccggccta

SEQ ID NO: 5058470 - DNA, 20 bp, Homo sapiens
gggagtccactttcctctct

SEQ ID NO: 5058471 - DNA, 15 bp, Homo sapiens
gggagtccaggcaca

SEQ ID NO: 5058472 - DNA, 19 bp, Homo sapiens
gggagtccaggcacaggat

SEQ ID NO: 5058473 - DNA, 20 bp, Homo sapiens
gggagtccagggtttctctg

SEQ ID NO: 5058474 - DNA, 15 bp, Homo sapiens
gggagtcccgtcagg

SEQ ID NO: 5058475 - DNA, 20 bp, Homo sapiens
gggagtctcaggaggaggct

SEQ ID NO: 5058476 - DNA, 14 bp, Homo sapiens
gggagtctccctcc

SEQ ID NO: 5058477 - DNA, 14 bp, Homo sapiens
gggagtctctcttc

SEQ ID NO: 5058478 - DNA, 17 bp, Homo sapiens
gggagtctgaagcagat

SEQ ID NO: 5058479 - DNA, 17 bp, Homo sapiens
gggagtctgccagggcc

SEQ ID NO: 5058480 - DNA, 15 bp, Homo sapiens
gggagtcttgggtgg

SEQ ID NO: 5058481 - DNA, 20 bp, Homo sapiens
gggagtcttgggtggcgctg

SEQ ID NO: 5058482 - DNA, 18 bp, Homo sapiens
gggagtgacagaggcagc

SEQ ID NO: 5058483 - DNA, 23 bp, Homo sapiens
gggagtgactcaagaagtgaaga

SEQ ID NO: 5058484 - DNA, 16 bp, Homo sapiens
gggagtgagcagctac

SEQ ID NO: 5058485 - DNA, 13 bp, Homo sapiens
gggagtgagcttg

SEQ ID NO: 5058486 - DNA, 19 bp, Homo sapiens
gggagtgaggcaggtgaca

SEQ ID NO: 5058487 - DNA, 17 bp, Homo sapiens
gggagtgaggggctgtg

SEQ ID NO: 5058488 - DNA, 18 bp, Homo sapiens
gggagtgaggggctgtga

SEQ ID NO: 5058489 - DNA, 13 bp, Homo sapiens
gggagtgaggggt

SEQ ID NO: 5058490 - DNA, 23 bp, Homo sapiens
gggagtgaggggttacctccctc

SEQ ID NO: 5058491 - DNA, 21 bp, Homo sapiens
gggagtgagttgatagcacag

SEQ ID NO: 5058492 - DNA, 17 bp, Homo sapiens
gggagtgcagacaccta

SEQ ID NO: 5058493 - DNA, 18 bp, Homo sapiens
gggagtgcagagaaagaa

SEQ ID NO: 5058494 - DNA, 19 bp, Homo sapiens
gggagtgctggctcacagt

SEQ ID NO: 5058495 - DNA, 15 bp, Homo sapiens
gggagtgctgtgttt

SEQ ID NO: 5058496 - DNA, 20 bp, Homo sapiens
gggagtggcacttctgcctt

SEQ ID NO: 5058497 - DNA, 12 bp, Homo sapiens
gggagtgggaga

SEQ ID NO: 5058498 - DNA, 15 bp, Homo sapiens
gggagtgggagagga

SEQ ID NO: 5058499 - DNA, 12 bp, Homo sapiens
gggagtggggag

SEQ ID NO: 5058500 - DNA, 18 bp, Homo sapiens
gggagtggttcctgtgga

SEQ ID NO: 5058501 - DNA, 15 bp, Homo sapiens
gggagtgtgggctgc

SEQ ID NO: 5058502 - DNA, 17 bp, Homo sapiens
gggagtgtgggctgccc

SEQ ID NO: 5058503 - DNA, 19 bp, Homo sapiens
gggagtgtgggctgccctt

SEQ ID NO: 5058504 - DNA, 13 bp, Homo sapiens
gggagtgtgtgcc

SEQ ID NO: 5058505 - DNA, 21 bp, Homo sapiens
gggagtgttcccgtgcctggg

SEQ ID NO: 5058506 - DNA, 20 bp, Homo sapiens
gggagtgttctgtgggcttg

SEQ ID NO: 5058507 - DNA, 20 bp, Homo sapiens
gggagttcgagaccaacctg

SEQ ID NO: 5058508 - DNA, 20 bp, Homo sapiens
gggagttgagtcacaagagg

SEQ ID NO: 5058509 - DNA, 20 bp, Homo sapiens
gggagttgctcactcaggac

SEQ ID NO: 5058510 - DNA, 20 bp, Homo sapiens
gggagtttaatacaggaaat

SEQ ID NO: 5058511 - DNA, 16 bp, Homo sapiens
gggagtttagggtggg

SEQ ID NO: 5058512 - DNA, 21 bp, Homo sapiens
gggagtttctttcctgccttc

SEQ ID NO: 5058513 - DNA, 21 bp, Homo sapiens
gggataaccccaggcactgtt

SEQ ID NO: 5058514 - DNA, 20 bp, Homo sapiens
gggataaccctacacccaga

SEQ ID NO: 5058515 - DNA, 13 bp, Homo sapiens
gggataagaatag

SEQ ID NO: 5058516 - DNA, 19 bp, Homo sapiens
gggataatgtccccactcc

SEQ ID NO: 5058517 - DNA, 14 bp, Homo sapiens
gggataatttattt

SEQ ID NO: 5058518 - DNA, 12 bp, Homo sapiens
gggatacagctg

SEQ ID NO: 5058519 - DNA, 13 bp, Homo sapiens
gggatacagctga

SEQ ID NO: 5058520 - DNA, 17 bp, Homo sapiens
gggatactgaaaaatac

SEQ ID NO: 5058521 - DNA, 14 bp, Homo sapiens
gggatactttgata

SEQ ID NO: 5058522 - DNA, 13 bp, Homo sapiens
gggatagaggaaa

SEQ ID NO: 5058523 - DNA, 14 bp, Homo sapiens
gggatagatgtgtg

SEQ ID NO: 5058524 - DNA, 16 bp, Homo sapiens
gggatagcactgagca

SEQ ID NO: 5058525 - DNA, 23 bp, Homo sapiens
gggatagccatttccatggctct

SEQ ID NO: 5058526 - DNA, 20 bp, Homo sapiens
gggataggagaagaggcatc

SEQ ID NO: 5058527 - DNA, 12 bp, Homo sapiens
gggataggaggg

SEQ ID NO: 5058528 - DNA, 21 bp, Homo sapiens
gggataggagggtgcccctgg

SEQ ID NO: 5058529 - DNA, 14 bp, Homo sapiens
gggatagtctggaa

SEQ ID NO: 5058530 - DNA, 16 bp, Homo sapiens
gggatagtctggaaag

SEQ ID NO: 5058531 - DNA, 21 bp, Homo sapiens
gggatagtttgggggaacttg

SEQ ID NO: 5058532 - DNA, 17 bp, Homo sapiens
gggatataatacatatt

SEQ ID NO: 5058533 - DNA, 16 bp, Homo sapiens
gggatataggagagga

SEQ ID NO: 5058534 - DNA, 18 bp, Homo sapiens
gggatatcacttccatga

SEQ ID NO: 5058535 - DNA, 12 bp, Homo sapiens
gggatatgctta

SEQ ID NO: 5058536 - DNA, 13 bp, Homo sapiens
gggatatttccta

SEQ ID NO: 5058537 - DNA, 22 bp, Homo sapiens
gggatattttgaaatgaacttt

SEQ ID NO: 5058538 - DNA, 22 bp, Homo sapiens
gggatcaaacctttctggcctg

SEQ ID NO: 5058539 - DNA, 22 bp, Homo sapiens
gggatcaaccagctaagaaaag

SEQ ID NO: 5058540 - DNA, 12 bp, Homo sapiens
gggatcacagcg

SEQ ID NO: 5058541 - DNA, 17 bp, Homo sapiens
gggatcacaggtgtcag

SEQ ID NO: 5058542 - DNA, 22 bp, Homo sapiens
gggatcactggctggcctgagc

SEQ ID NO: 5058543 - DNA, 15 bp, Homo sapiens
gggatcagccccgcc

SEQ ID NO: 5058544 - DNA, 23 bp, Homo sapiens
gggatcagcctccgccattccaa

SEQ ID NO: 5058545 - DNA, 19 bp, Homo sapiens
gtgggaggggaagaaaaac

SEQ ID NO: 5058546 - DNA, 14 bp, Homo sapiens
gtgggaggggcagg

SEQ ID NO: 5058547 - DNA, 16 bp, Homo sapiens
gtgggaggggcaggct

SEQ ID NO: 5058548 - DNA, 19 bp, Homo sapiens
gtgggaggggcccacagga

SEQ ID NO: 5058549 - DNA, 13 bp, Homo sapiens
gtgggagggggag

SEQ ID NO: 5058550 - DNA, 12 bp, Homo sapiens
gtgggagggggc

SEQ ID NO: 5058551 - DNA, 20 bp, Homo sapiens
gtgggagggtctgcagggaa

SEQ ID NO: 5058552 - DNA, 14 bp, Homo sapiens
gtgggagggttggc

SEQ ID NO: 5058553 - DNA, 22 bp, Homo sapiens
gtgggaggtaggctgtggggtg

SEQ ID NO: 5058554 - DNA, 17 bp, Homo sapiens
gtgggaggttgtgcatg

SEQ ID NO: 5058555 - DNA, 18 bp, Homo sapiens
gtgggagtgggagaggaa

SEQ ID NO: 5058556 - DNA, 13 bp, Homo sapiens
gtgggagtgggcc

SEQ ID NO: 5058557 - DNA, 17 bp, Homo sapiens
gggatccgactgctttg

SEQ ID NO: 5058558 - DNA, 22 bp, Homo sapiens
gggatccgagggcccctctcca

SEQ ID NO: 5058559 - DNA, 20 bp, Homo sapiens
gggatcctccacagagagga

SEQ ID NO: 5058560 - DNA, 22 bp, Homo sapiens
gggatcctccacagagaggagg

SEQ ID NO: 5058561 - DNA, 21 bp, Homo sapiens
gggatcctctccaccctcctc

SEQ ID NO: 5058562 - DNA, 14 bp, Homo sapiens
gggatcctgccccc

SEQ ID NO: 5058563 - DNA, 13 bp, Homo sapiens
gggatcctggagc

SEQ ID NO: 5058564 - DNA, 18 bp, Homo sapiens
gggatcgatgtgctcagc

SEQ ID NO: 5058565 - DNA, 18 bp, Homo sapiens
gggatctaaaaaaatgtt

SEQ ID NO: 5058566 - DNA, 22 bp, Homo sapiens
gggatctactttccctctggga

SEQ ID NO: 5058567 - DNA, 12 bp, Homo sapiens
gggatctgaaat

SEQ ID NO: 5058568 - DNA, 13 bp, Homo sapiens
gggatctgaaatc

SEQ ID NO: 5058569 - DNA, 12 bp, Homo sapiens
gggatctgagaa

SEQ ID NO: 5058570 - DNA, 23 bp, Homo sapiens
gggatctgagctcccacctccct

SEQ ID NO: 5058571 - DNA, 23 bp, Homo sapiens
gggatctggtcctacccatcccc

SEQ ID NO: 5058572 - DNA, 17 bp, Homo sapiens
gggatctgtgcccagag

SEQ ID NO: 5058573 - DNA, 16 bp, Homo sapiens
gggatcttacccactt

SEQ ID NO: 5058574 - DNA, 13 bp, Homo sapiens
gggatcttcccac

SEQ ID NO: 5058575 - DNA, 18 bp, Homo sapiens
gggatcttgcattcccag

SEQ ID NO: 5058576 - DNA, 16 bp, Homo sapiens
gggatgaaaagccata

SEQ ID NO: 5058577 - DNA, 20 bp, Homo sapiens
gggatgaaactaaagcaata

SEQ ID NO: 5058578 - DNA, 15 bp, Homo sapiens
gggatgacggccagg

SEQ ID NO: 5058579 - DNA, 17 bp, Homo sapiens
gggatgacggccaggct

SEQ ID NO: 5058580 - DNA, 20 bp, Homo sapiens
gggatgagcatggagctggc

SEQ ID NO: 5058581 - DNA, 15 bp, Homo sapiens
gggatgagccgctgt

SEQ ID NO: 5058582 - DNA, 20 bp, Homo sapiens
gggatgagctcaagcaggaa

SEQ ID NO: 5058583 - DNA, 14 bp, Homo sapiens
gggatgatgtgtga

SEQ ID NO: 5058584 - DNA, 15 bp, Homo sapiens
gggatgattgaagaa

SEQ ID NO: 5058585 - DNA, 16 bp, Homo sapiens
gggatgattgcttgag

SEQ ID NO: 5058586 - DNA, 21 bp, Homo sapiens
gggatgcaaataaagcctgct

SEQ ID NO: 5058587 - DNA, 13 bp, Homo sapiens
gggatgcagtgat

SEQ ID NO: 5058588 - DNA, 17 bp, Homo sapiens
gggatgccatctgtggg

SEQ ID NO: 5058589 - DNA, 20 bp, Homo sapiens
gggatgcccccaggcagcca

SEQ ID NO: 5058590 - DNA, 24 bp, Homo sapiens
gggatgcccctggccctgcctcac

SEQ ID NO: 5058591 - DNA, 16 bp, Homo sapiens
gggatgcggatcctgc

SEQ ID NO: 5058592 - DNA, 20 bp, Homo sapiens
gggatgcgtgttccagccaa

SEQ ID NO: 5058593 - DNA, 21 bp, Homo sapiens
gggatgctatctcgctagcca

SEQ ID NO: 5058594 - DNA, 17 bp, Homo sapiens
gggatgctgacccagga

SEQ ID NO: 5058595 - DNA, 15 bp, Homo sapiens
gggatggaaaaggaa

SEQ ID NO: 5058596 - DNA, 19 bp, Homo sapiens
gggatggacaggaaagggc

SEQ ID NO: 5058597 - DNA, 18 bp, Homo sapiens
gggatggactgatgcttt

SEQ ID NO: 5058598 - DNA, 22 bp, Homo sapiens
gggatggacttgtgattggctg

SEQ ID NO: 5058599 - DNA, 19 bp, Homo sapiens
gggatggagaggcggcctc

SEQ ID NO: 5058600 - DNA, 14 bp, Homo sapiens
gggatggaggccag

SEQ ID NO: 5058601 - DNA, 15 bp, Homo sapiens
gggatggaggccaga

SEQ ID NO: 5058602 - DNA, 18 bp, Homo sapiens
gggatggcagtggctgtg

SEQ ID NO: 5058603 - DNA, 22 bp, Homo sapiens
gggatggcatttggtctcaggc

SEQ ID NO: 5058604 - DNA, 16 bp, Homo sapiens
gggatgggacagggag

SEQ ID NO: 5058605 - DNA, 18 bp, Homo sapiens
gggatgggacagggaggc

SEQ ID NO: 5058606 - DNA, 16 bp, Homo sapiens
gggatgggcagcccaa

SEQ ID NO: 5058607 - DNA, 12 bp, Homo sapiens
gggatggggagg

SEQ ID NO: 5058608 - DNA, 18 bp, Homo sapiens
gggatggggatgggaggg

SEQ ID NO: 5058609 - DNA, 21 bp, Homo sapiens
gggatggggcctccctccttg

SEQ ID NO: 5058610 - DNA, 14 bp, Homo sapiens
gggatggggctggg

SEQ ID NO: 5058611 - DNA, 20 bp, Homo sapiens
gggatgggggatgggccagg

SEQ ID NO: 5058612 - DNA, 23 bp, Homo sapiens
gggatggggggggatgtggatca

SEQ ID NO: 5058613 - DNA, 17 bp, Homo sapiens
gggatgggggtggctgg

SEQ ID NO: 5058614 - DNA, 13 bp, Homo sapiens
gggatggtcaggc

SEQ ID NO: 5058615 - DNA, 14 bp, Homo sapiens
gggatggtccagga

SEQ ID NO: 5058616 - DNA, 16 bp, Homo sapiens
gggatggtgatggaga

SEQ ID NO: 5058617 - DNA, 12 bp, Homo sapiens
gggatggtgccc

SEQ ID NO: 5058618 - DNA, 17 bp, Homo sapiens
gggatggtggagggcca

SEQ ID NO: 5058619 - DNA, 14 bp, Homo sapiens
gggatggtggcaca

SEQ ID NO: 5058620 - DNA, 17 bp, Homo sapiens
gggatggtggcacaggc

SEQ ID NO: 5058621 - DNA, 12 bp, Homo sapiens
gggatgtaaacc

SEQ ID NO: 5058622 - DNA, 22 bp, Homo sapiens
gggatgtcaacagccataataa

SEQ ID NO: 5058623 - DNA, 15 bp, Homo sapiens
gggatgtcagcagac

SEQ ID NO: 5058624 - DNA, 12 bp, Homo sapiens
gggatgtcctct

SEQ ID NO: 5058625 - DNA, 11 bp, Homo sapiens
gggatgtctta

SEQ ID NO: 5058626 - DNA, 22 bp, Homo sapiens
gggatgtgaattgcctgcagag

SEQ ID NO: 5058627 - DNA, 13 bp, Homo sapiens
gggatgtgtcctg

SEQ ID NO: 5058628 - DNA, 17 bp, Homo sapiens
gggatgttctgcctctc

SEQ ID NO: 5058629 - DNA, 16 bp, Homo sapiens
gggatgttctggccct

SEQ ID NO: 5058630 - DNA, 17 bp, Homo sapiens
gggatgtttacctggtg

SEQ ID NO: 5058631 - DNA, 13 bp, Homo sapiens
gggatgtttttct

SEQ ID NO: 5058632 - DNA, 11 bp, Homo sapiens
gggattacaga

SEQ ID NO: 5058633 - DNA, 19 bp, Homo sapiens
gggattacaggcgcctgcc

SEQ ID NO: 5058634 - DNA, 14 bp, Homo sapiens
gggattacaggcgt

SEQ ID NO: 5058635 - DNA, 12 bp, Homo sapiens
gggattacaggt

SEQ ID NO: 5058636 - DNA, 16 bp, Homo sapiens
gggattacccaagcaa

SEQ ID NO: 5058637 - DNA, 23 bp, Homo sapiens
gggattattagaatcaaacattt

SEQ ID NO: 5058638 - DNA, 15 bp, Homo sapiens
gggattcaaatgcat

SEQ ID NO: 5058639 - DNA, 21 bp, Homo sapiens
gggattcaggaaaaggcctgg

SEQ ID NO: 5058640 - DNA, 15 bp, Homo sapiens
gggattcaggctgct

SEQ ID NO: 5058641 - DNA, 22 bp, Homo sapiens
gggattcaggggctttgggccc

SEQ ID NO: 5058642 - DNA, 16 bp, Homo sapiens
gggattcatggctttg

SEQ ID NO: 5058643 - DNA, 16 bp, Homo sapiens
gggattcctgacccag

SEQ ID NO: 5058644 - DNA, 18 bp, Homo sapiens
gggattcctgagctggcc

SEQ ID NO: 5058645 - DNA, 20 bp, Homo sapiens
gggattcctgagctggcctg

SEQ ID NO: 5058646 - DNA, 18 bp, Homo sapiens
gggattgattttaaaatg

SEQ ID NO: 5058647 - DNA, 22 bp, Homo sapiens
gggattgcccctggctttgcct

SEQ ID NO: 5058648 - DNA, 17 bp, Homo sapiens
gggattgctgccacttt

SEQ ID NO: 5058649 - DNA, 13 bp, Homo sapiens
gggattggctgtg

SEQ ID NO: 5058650 - DNA, 14 bp, Homo sapiens
gggattggggggaa

SEQ ID NO: 5058651 - DNA, 23 bp, Homo sapiens
gggattggggggaaagagggagc

SEQ ID NO: 5058652 - DNA, 17 bp, Homo sapiens
gggattgtaaaatggtg

SEQ ID NO: 5058653 - DNA, 13 bp, Homo sapiens
gggattgtccctg

SEQ ID NO: 5058654 - DNA, 13 bp, Homo sapiens
gggatttctggga

SEQ ID NO: 5058655 - DNA, 18 bp, Homo sapiens
gggatttcttcgctgctc

SEQ ID NO: 5058656 - DNA, 20 bp, Homo sapiens
gggatttcttcgctgctcta

SEQ ID NO: 5058657 - DNA, 18 bp, Homo sapiens
gggatttgaactgagccg

SEQ ID NO: 5058658 - DNA, 23 bp, Homo sapiens
gggatttttcttttgaggcatgc

SEQ ID NO: 5058659 - DNA, 22 bp, Homo sapiens
gggatttttggtgcaagtagca

SEQ ID NO: 5058660 - DNA, 18 bp, Homo sapiens
gggatttttttgttcttg

SEQ ID NO: 5058661 - DNA, 21 bp, Homo sapiens
gggcaaaaaactcgaggactg

SEQ ID NO: 5058662 - DNA, 15 bp, Homo sapiens
gggcaaaaatatttt

SEQ ID NO: 5058663 - DNA, 18 bp, Homo sapiens
gggcaaaagggcagctgt

SEQ ID NO: 5058664 - DNA, 23 bp, Homo sapiens
gggcaaaatcgccataggccaag

SEQ ID NO: 5058665 - DNA, 18 bp, Homo sapiens
gggcaaacacctgctgat

SEQ ID NO: 5058666 - DNA, 18 bp, Homo sapiens
gggcaaaccctggtgctt

SEQ ID NO: 5058667 - DNA, 13 bp, Homo sapiens
gggcaaagaaaac

SEQ ID NO: 5058668 - DNA, 20 bp, Homo sapiens
gggcaaagaactgccccatc

SEQ ID NO: 5058669 - DNA, 14 bp, Homo sapiens
gggcaaagagctcc

SEQ ID NO: 5058670 - DNA, 16 bp, Homo sapiens
gggcaaagccaggtcc

SEQ ID NO: 5058671 - DNA, 23 bp, Homo sapiens
gggcaaagctgatttttttttta

SEQ ID NO: 5058672 - DNA, 20 bp, Homo sapiens
gggcaaagctgctgggccag

SEQ ID NO: 5058673 - DNA, 14 bp, Homo sapiens
gggcaaaggcaggg

SEQ ID NO: 5058674 - DNA, 16 bp, Homo sapiens
gggcaaaggcagggcc

SEQ ID NO: 5058675 - DNA, 13 bp, Homo sapiens
gggcaaataatga

SEQ ID NO: 5058676 - DNA, 21 bp, Homo sapiens
gggcaaatgacatgcactgac

SEQ ID NO: 5058677 - DNA, 16 bp, Homo sapiens
gggcaaatgccagggc

SEQ ID NO: 5058678 - DNA, 20 bp, Homo sapiens
gggcaacaaagtgagactcc

SEQ ID NO: 5058679 - DNA, 21 bp, Homo sapiens
gggcaactcgtgacagcctct

SEQ ID NO: 5058680 - DNA, 16 bp, Homo sapiens
gggcaactcttggaag

SEQ ID NO: 5058681 - DNA, 12 bp, Homo sapiens
gggcaagaaaga

SEQ ID NO: 5058682 - DNA, 15 bp, Homo sapiens
gggcaagagaggctg

SEQ ID NO: 5058683 - DNA, 19 bp, Homo sapiens
gggcaagagctcaggagaa

SEQ ID NO: 5058684 - DNA, 15 bp, Homo sapiens
gggcaagaggtgcct

SEQ ID NO: 5058685 - DNA, 21 bp, Homo sapiens
gggcaagatccaggtggtccc

SEQ ID NO: 5058686 - DNA, 23 bp, Homo sapiens
gggcaagccagggcccagagccc

SEQ ID NO: 5058687 - DNA, 19 bp, Homo sapiens
gggcaagccctgcccacag

SEQ ID NO: 5058688 - DNA, 16 bp, Homo sapiens
gggcaagctaggcccc

SEQ ID NO: 5058689 - DNA, 20 bp, Homo sapiens
gggcaagctaggccccagag

SEQ ID NO: 5058690 - DNA, 16 bp, Homo sapiens
gggcaaggaaaaagaa

SEQ ID NO: 5058691 - DNA, 18 bp, Homo sapiens
gggcaaggaagctttgga

SEQ ID NO: 5058692 - DNA, 13 bp, Homo sapiens
gggcaagggccat

SEQ ID NO: 5058693 - DNA, 18 bp, Homo sapiens
gggcaagggccgtgcccg

SEQ ID NO: 5058694 - DNA, 14 bp, Homo sapiens
gggcaagggctcct

SEQ ID NO: 5058695 - DNA, 13 bp, Homo sapiens
gggcaaggggcca

SEQ ID NO: 5058696 - DNA, 21 bp, Homo sapiens
gggcaaggtgggggagcctgg

SEQ ID NO: 5058697 - DNA, 17 bp, Homo sapiens
gggcaagtagcaggact

SEQ ID NO: 5058698 - DNA, 18 bp, Homo sapiens
gggcaagtagcaggacta

SEQ ID NO: 5058699 - DNA, 21 bp, Homo sapiens
gggcaagtagcaggactaggc

SEQ ID NO: 5058700 - DNA, 22 bp, Homo sapiens
gggcaagtcatcctcctggtgc

SEQ ID NO: 5058701 - DNA, 17 bp, Homo sapiens
gggcaagtgagagggga

SEQ ID NO: 5058702 - DNA, 19 bp, Homo sapiens
gggcaagtgagaggggagg

SEQ ID NO: 5058703 - DNA, 23 bp, Homo sapiens
gggcaagtgagaggggagggagg

SEQ ID NO: 5058704 - DNA, 17 bp, Homo sapiens
gggcaagtggatgggaa

SEQ ID NO: 5058705 - DNA, 20 bp, Homo sapiens
gggcaatattctctgtacat

SEQ ID NO: 5058706 - DNA, 23 bp, Homo sapiens
gggcaatattctctgtacatatt

SEQ ID NO: 5058707 - DNA, 17 bp, Homo sapiens
gggcaatcctgggctgg

SEQ ID NO: 5058708 - DNA, 16 bp, Homo sapiens
gggcaatgaaaccaaa

SEQ ID NO: 5058709 - DNA, 12 bp, Homo sapiens
gggcaatgccat

SEQ ID NO: 5058710 - DNA, 21 bp, Homo sapiens
gggcaatgccatcagcccctg

SEQ ID NO: 5058711 - DNA, 13 bp, Homo sapiens
gggcaatggaaat

SEQ ID NO: 5058712 - DNA, 15 bp, Homo sapiens
gggcaatggccaggg

SEQ ID NO: 5058713 - DNA, 20 bp, Homo sapiens
gggcaatggccaggggccag

SEQ ID NO: 5058714 - DNA, 21 bp, Homo sapiens
gggcaatggccaggggccagg

SEQ ID NO: 5058715 - DNA, 13 bp, Homo sapiens
gggcaatggggag

SEQ ID NO: 5058716 - DNA, 21 bp, Homo sapiens
gggcaattaattccttcagca

SEQ ID NO: 5058717 - DNA, 17 bp, Homo sapiens
gggcaattggaacaaag

SEQ ID NO: 5058718 - DNA, 14 bp, Homo sapiens
gggcaatttagaaa

SEQ ID NO: 5058719 - DNA, 19 bp, Homo sapiens
gggcacaaactgcagctgt

SEQ ID NO: 5058720 - DNA, 16 bp, Homo sapiens
gggcacaaagggccca

SEQ ID NO: 5058721 - DNA, 23 bp, Homo sapiens
gggcacaagactgacgccagggt

SEQ ID NO: 5058722 - DNA, 23 bp, Homo sapiens
gggcacaagctcaggtcctgctg

SEQ ID NO: 5058723 - DNA, 17 bp, Homo sapiens
gtggggaggggcctttg

SEQ ID NO: 5058724 - DNA, 13 bp, Homo sapiens
gtggggaggggct

SEQ ID NO: 5058725 - DNA, 17 bp, Homo sapiens
gtggggagtcagtcatg

SEQ ID NO: 5058726 - DNA, 22 bp, Homo sapiens
gtggggagtccagggctcccgg

SEQ ID NO: 5058727 - DNA, 19 bp, Homo sapiens
gtggggataggccagccgc

SEQ ID NO: 5058728 - DNA, 21 bp, Homo sapiens
gtggggatgtttgtgctgcag

SEQ ID NO: 5058729 - DNA, 15 bp, Homo sapiens
gtggggattgcccat

SEQ ID NO: 5058730 - DNA, 16 bp, Homo sapiens
gtggggatttctccca

SEQ ID NO: 5058731 - DNA, 22 bp, Homo sapiens
gtggggcaagcctgagtggtga

SEQ ID NO: 5058732 - DNA, 14 bp, Homo sapiens
gtggggcactcctt

SEQ ID NO: 5058733 - DNA, 18 bp, Homo sapiens
gtggggcagaaaggctgc

SEQ ID NO: 5058734 - DNA, 13 bp, Homo sapiens
gtggggcagaggc

SEQ ID NO: 5058735 - DNA, 14 bp, Homo sapiens
gtggggcagcacag

SEQ ID NO: 5058736 - DNA, 23 bp, Homo sapiens
gtggggcagcacagagagggggc

SEQ ID NO: 5058737 - DNA, 17 bp, Homo sapiens
gggcacagctgtctgcc

SEQ ID NO: 5058738 - DNA, 22 bp, Homo sapiens
gggcacagctgtctgccaggca

SEQ ID NO: 5058739 - DNA, 17 bp, Homo sapiens
gggcacaggagctacct

SEQ ID NO: 5058740 - DNA, 21 bp, Homo sapiens
gggcacaggagctacctgtgt

SEQ ID NO: 5058741 - DNA, 18 bp, Homo sapiens
gggcacaggaggcaggca

SEQ ID NO: 5058742 - DNA, 17 bp, Homo sapiens
gggcacagggaggctgc

SEQ ID NO: 5058743 - DNA, 18 bp, Homo sapiens
gggcacagggcaccagag

SEQ ID NO: 5058744 - DNA, 22 bp, Homo sapiens
gggcacagggcaccagaggccg

SEQ ID NO: 5058745 - DNA, 14 bp, Homo sapiens
gggcacagggcctg

SEQ ID NO: 5058746 - DNA, 13 bp, Homo sapiens
gggcacaggtcag

SEQ ID NO: 5058747 - DNA, 12 bp, Homo sapiens
gggcacagtcat

SEQ ID NO: 5058748 - DNA, 13 bp, Homo sapiens
gggcacagtccag

SEQ ID NO: 5058749 - DNA, 13 bp, Homo sapiens
gggcacagtgctg

SEQ ID NO: 5058750 - DNA, 23 bp, Homo sapiens
gggcacatagcataggctgggga

SEQ ID NO: 5058751 - DNA, 16 bp, Homo sapiens
gggcacatcatttcaa

SEQ ID NO: 5058752 - DNA, 16 bp, Homo sapiens
gggcacatgaggaggg

SEQ ID NO: 5058753 - DNA, 17 bp, Homo sapiens
gggcaccaagcccacag

SEQ ID NO: 5058754 - DNA, 19 bp, Homo sapiens
gggcaccacccccagtccc

SEQ ID NO: 5058755 - DNA, 12 bp, Homo sapiens
gggcaccagagg

SEQ ID NO: 5058756 - DNA, 16 bp, Homo sapiens
gggcaccagaggccga

SEQ ID NO: 5058757 - DNA, 21 bp, Homo sapiens
gggcaccagcatttggcagca

SEQ ID NO: 5058758 - DNA, 15 bp, Homo sapiens
gggcaccagccagcg

SEQ ID NO: 5058759 - DNA, 19 bp, Homo sapiens
gggcaccagcttctttctc

SEQ ID NO: 5058760 - DNA, 13 bp, Homo sapiens
gggcaccaggggc

SEQ ID NO: 5058761 - DNA, 19 bp, Homo sapiens
gggcacccaccagttgctg

SEQ ID NO: 5058762 - DNA, 21 bp, Homo sapiens
gggcacccccagcctgggcct

SEQ ID NO: 5058763 - DNA, 14 bp, Homo sapiens
gggcacccccggcc

SEQ ID NO: 5058764 - DNA, 16 bp, Homo sapiens
gggcacccctgcctcc

SEQ ID NO: 5058765 - DNA, 15 bp, Homo sapiens
gggcaccctccaaac

SEQ ID NO: 5058766 - DNA, 20 bp, Homo sapiens
gggcaccctgtggccctggc

SEQ ID NO: 5058767 - DNA, 18 bp, Homo sapiens
gggcacctataataccag

SEQ ID NO: 5058768 - DNA, 19 bp, Homo sapiens
gggcacctatagtcccagc

SEQ ID NO: 5058769 - DNA, 14 bp, Homo sapiens
gggcacctgccacc

SEQ ID NO: 5058770 - DNA, 15 bp, Homo sapiens
gggcacctgccaccg

SEQ ID NO: 5058771 - DNA, 20 bp, Homo sapiens
gggcacgccctcctcagcga

SEQ ID NO: 5058772 - DNA, 16 bp, Homo sapiens
gggcacggactgtcca

SEQ ID NO: 5058773 - DNA, 20 bp, Homo sapiens
gggcacggcgggatcctcca

SEQ ID NO: 5058774 - DNA, 13 bp, Homo sapiens
gggcacgggagag

SEQ ID NO: 5058775 - DNA, 16 bp, Homo sapiens
gggcacgggagagcgc

SEQ ID NO: 5058776 - DNA, 17 bp, Homo sapiens
gggcacgggagagcgcc

SEQ ID NO: 5058777 - DNA, 22 bp, Homo sapiens
gggcacgggagagcgccacccg

SEQ ID NO: 5058778 - DNA, 23 bp, Homo sapiens
gggcacgggagagcgccacccgc

SEQ ID NO: 5058779 - DNA, 21 bp, Homo sapiens
gggcacgggtgtcacggccag

SEQ ID NO: 5058780 - DNA, 17 bp, Homo sapiens
gggcacggtcacacggc

SEQ ID NO: 5058781 - DNA, 21 bp, Homo sapiens
gggcacggtcacacggccacc

SEQ ID NO: 5058782 - DNA, 14 bp, Homo sapiens
gggcactagctaga

SEQ ID NO: 5058783 - DNA, 23 bp, Homo sapiens
gggcactcagccacgaccagccc

SEQ ID NO: 5058784 - DNA, 11 bp, Homo sapiens
gggcactcccc

SEQ ID NO: 5058785 - DNA, 15 bp, Homo sapiens
gggcactctctgcca

SEQ ID NO: 5058786 - DNA, 17 bp, Homo sapiens
gggcactctctgccagc

SEQ ID NO: 5058787 - DNA, 19 bp, Homo sapiens
gggcactctctgccagctc

SEQ ID NO: 5058788 - DNA, 19 bp, Homo sapiens
gggcactctgttcccctcc

SEQ ID NO: 5058789 - DNA, 23 bp, Homo sapiens
gggcactctgttcccctccccct

SEQ ID NO: 5058790 - DNA, 17 bp, Homo sapiens
gggcactgccagactga

SEQ ID NO: 5058791 - DNA, 16 bp, Homo sapiens
gggcactgccagccca

SEQ ID NO: 5058792 - DNA, 18 bp, Homo sapiens
gggcactgctccaaggga

SEQ ID NO: 5058793 - DNA, 15 bp, Homo sapiens
gggcactgctgagga

SEQ ID NO: 5058794 - DNA, 21 bp, Homo sapiens
gggcactgctgggtggcccat

SEQ ID NO: 5058795 - DNA, 17 bp, Homo sapiens
gggcactggagctggga

SEQ ID NO: 5058796 - DNA, 18 bp, Homo sapiens
gggcactggctgctctgt

SEQ ID NO: 5058797 - DNA, 14 bp, Homo sapiens
gggcactgggcact

SEQ ID NO: 5058798 - DNA, 15 bp, Homo sapiens
gggcactgggcacta

SEQ ID NO: 5058799 - DNA, 12 bp, Homo sapiens
gggcactgggcg

SEQ ID NO: 5058800 - DNA, 22 bp, Homo sapiens
gggcactgggcgtctgactccc

SEQ ID NO: 5058801 - DNA, 16 bp, Homo sapiens
gggcactggtggcccg

SEQ ID NO: 5058802 - DNA, 16 bp, Homo sapiens
gggcactgtggtcagg

SEQ ID NO: 5058803 - DNA, 20 bp, Homo sapiens
gggcacttaatttgtaaact

SEQ ID NO: 5058804 - DNA, 15 bp, Homo sapiens
gggcacttcacagag

SEQ ID NO: 5058805 - DNA, 16 bp, Homo sapiens
gggcacttcaggtccg

SEQ ID NO: 5058806 - DNA, 20 bp, Homo sapiens
gggcacttcaggtccgtggg

SEQ ID NO: 5058807 - DNA, 14 bp, Homo sapiens
gggcacttccctgc

SEQ ID NO: 5058808 - DNA, 18 bp, Homo sapiens
gggcacttccctgctgcc

SEQ ID NO: 5058809 - DNA, 17 bp, Homo sapiens
gggcacttcctccacag

SEQ ID NO: 5058810 - DNA, 24 bp, Homo sapiens
gggcacttttgaactcacgagcct

SEQ ID NO: 5058811 - DNA, 16 bp, Homo sapiens
gggcagaaaggctgca

SEQ ID NO: 5058812 - DNA, 22 bp, Homo sapiens
gggcagaaaggctgcaacgctg

SEQ ID NO: 5058813 - DNA, 22 bp, Homo sapiens
gggcagaaatgtgctgcaaaga

SEQ ID NO: 5058814 - DNA, 17 bp, Homo sapiens
gggcagaactcctacct

SEQ ID NO: 5058815 - DNA, 20 bp, Homo sapiens
gggcagaactcctacctgaa

SEQ ID NO: 5058816 - DNA, 21 bp, Homo sapiens
gggcagaaggaggaagggact

SEQ ID NO: 5058817 - DNA, 19 bp, Homo sapiens
gggcagaagggagaaggat

SEQ ID NO: 5058818 - DNA, 20 bp, Homo sapiens
gggcagaatcctgggccccc

SEQ ID NO: 5058819 - DNA, 16 bp, Homo sapiens
gggcagaccagagagc

SEQ ID NO: 5058820 - DNA, 23 bp, Homo sapiens
gggcagagaccaccgcgcccctc

SEQ ID NO: 5058821 - DNA, 15 bp, Homo sapiens
gggcagagaggaagt

SEQ ID NO: 5058822 - DNA, 14 bp, Homo sapiens
gggcagagaggctg

SEQ ID NO: 5058823 - DNA, 14 bp, Homo sapiens
gggcagagcacagc

SEQ ID NO: 5058824 - DNA, 11 bp, Homo sapiens
gggcagagcag

SEQ ID NO: 5058825 - DNA, 16 bp, Homo sapiens
gggcagagcagagacc

SEQ ID NO: 5058826 - DNA, 22 bp, Homo sapiens
gggcagagcagagaccatccct

SEQ ID NO: 5058827 - DNA, 12 bp, Homo sapiens
gggcagagcagc

SEQ ID NO: 5058828 - DNA, 13 bp, Homo sapiens
gggcagagccacc

SEQ ID NO: 5058829 - DNA, 15 bp, Homo sapiens
gggcagagccatggg

SEQ ID NO: 5058830 - DNA, 16 bp, Homo sapiens
gggcagagccatgggc

SEQ ID NO: 5058831 - DNA, 19 bp, Homo sapiens
gggcagagccatgggcctg

SEQ ID NO: 5058832 - DNA, 17 bp, Homo sapiens
gggcagagccgggaagc

SEQ ID NO: 5058833 - DNA, 23 bp, Homo sapiens
gggcagagctcagaggagtctgg

SEQ ID NO: 5058834 - DNA, 11 bp, Homo sapiens
gggcagagctg

SEQ ID NO: 5058835 - DNA, 15 bp, Homo sapiens
gggcagagctgagtc

SEQ ID NO: 5058836 - DNA, 17 bp, Homo sapiens
gggcagagctggctctg

SEQ ID NO: 5058837 - DNA, 15 bp, Homo sapiens
gggcagaggaagaga

SEQ ID NO: 5058838 - DNA, 23 bp, Homo sapiens
gggcagaggaatgtgggctatgt

SEQ ID NO: 5058839 - DNA, 16 bp, Homo sapiens
gggcagaggatgaggt

SEQ ID NO: 5058840 - DNA, 15 bp, Homo sapiens
gggcagaggctggag

SEQ ID NO: 5058841 - DNA, 16 bp, Homo sapiens
gggcagaggctggagg

SEQ ID NO: 5058842 - DNA, 23 bp, Homo sapiens
gggcagaggctggaggcagggcc

SEQ ID NO: 5058843 - DNA, 12 bp, Homo sapiens
gggcagagggaa

SEQ ID NO: 5058844 - DNA, 14 bp, Homo sapiens
gggcagagggaatg

SEQ ID NO: 5058845 - DNA, 22 bp, Homo sapiens
gggcagagggaatgttccctgc

SEQ ID NO: 5058846 - DNA, 16 bp, Homo sapiens
gggcagagggctggag

SEQ ID NO: 5058847 - DNA, 16 bp, Homo sapiens
gggcagaggggagagg

SEQ ID NO: 5058848 - DNA, 13 bp, Homo sapiens
gggcagaggggca

SEQ ID NO: 5058849 - DNA, 23 bp, Homo sapiens
gggcagaggtggcgcccaggggc

SEQ ID NO: 5058850 - DNA, 12 bp, Homo sapiens
gggcagagtcac

SEQ ID NO: 5058851 - DNA, 14 bp, Homo sapiens
gggcagagtcctgc

SEQ ID NO: 5058852 - DNA, 18 bp, Homo sapiens
gggcagagtggagcccag

SEQ ID NO: 5058853 - DNA, 17 bp, Homo sapiens
gggcagagtggcctgtg

SEQ ID NO: 5058854 - DNA, 19 bp, Homo sapiens
gggcagagtggcctgtgag

SEQ ID NO: 5058855 - DNA, 20 bp, Homo sapiens
gggcagatcttggactcatg

SEQ ID NO: 5058856 - DNA, 16 bp, Homo sapiens
gggcagatcttttctt

SEQ ID NO: 5058857 - DNA, 16 bp, Homo sapiens
gggcagattttcagca

SEQ ID NO: 5058858 - DNA, 14 bp, Homo sapiens
gggcagcaaggcct

SEQ ID NO: 5058859 - DNA, 17 bp, Homo sapiens
gggcagcacacctctgg

SEQ ID NO: 5058860 - DNA, 12 bp, Homo sapiens
gggcagcaccct

SEQ ID NO: 5058861 - DNA, 18 bp, Homo sapiens
gggcagcaccctcccccg

SEQ ID NO: 5058862 - DNA, 20 bp, Homo sapiens
gggcagcacctccgggactg

SEQ ID NO: 5058863 - DNA, 16 bp, Homo sapiens
gggcagcactccccag

SEQ ID NO: 5058864 - DNA, 21 bp, Homo sapiens
gggcagcactgggaagctgga

SEQ ID NO: 5058865 - DNA, 13 bp, Homo sapiens
gggcagcagagag

SEQ ID NO: 5058866 - DNA, 21 bp, Homo sapiens
gggcagcagcatcccagcctt

SEQ ID NO: 5058867 - DNA, 20 bp, Homo sapiens
gggcagcagccagccctgcc

SEQ ID NO: 5058868 - DNA, 20 bp, Homo sapiens
gggcagcaggccagagaaag

SEQ ID NO: 5058869 - DNA, 14 bp, Homo sapiens
gggcagcagggcta

SEQ ID NO: 5058870 - DNA, 13 bp, Homo sapiens
gggcagcaggggc

SEQ ID NO: 5058871 - DNA, 13 bp, Homo sapiens
gggcagcaggggt

SEQ ID NO: 5058872 - DNA, 21 bp, Homo sapiens
gggcagcagggtagagaggac

SEQ ID NO: 5058873 - DNA, 20 bp, Homo sapiens
gggcagcatagcaagacaca

SEQ ID NO: 5058874 - DNA, 12 bp, Homo sapiens
gggcagccacag

SEQ ID NO: 5058875 - DNA, 14 bp, Homo sapiens
gggcagccacagga

SEQ ID NO: 5058876 - DNA, 23 bp, Homo sapiens
gggcagccacccaagcctgctgg

SEQ ID NO: 5058877 - DNA, 11 bp, Homo sapiens
gggcagccagc

SEQ ID NO: 5058878 - DNA, 16 bp, Homo sapiens
gggcagccagccctgg

SEQ ID NO: 5058879 - DNA, 19 bp, Homo sapiens
gggcagccagccctggctt

SEQ ID NO: 5058880 - DNA, 18 bp, Homo sapiens
gggcagccaggctgggcc

SEQ ID NO: 5058881 - DNA, 14 bp, Homo sapiens
gggcagccaggggc

SEQ ID NO: 5058882 - DNA, 18 bp, Homo sapiens
gggcagccattggcctct

SEQ ID NO: 5058883 - DNA, 23 bp, Homo sapiens
gggcagccccgacccctgtccag

SEQ ID NO: 5058884 - DNA, 20 bp, Homo sapiens
gggcagccccgcgaccaccc

SEQ ID NO: 5058885 - DNA, 22 bp, Homo sapiens
gggcagccccgcgaccacccct

SEQ ID NO: 5058886 - DNA, 23 bp, Homo sapiens
gggcagccccgcgaccacccctg

SEQ ID NO: 5058887 - DNA, 12 bp, Homo sapiens
gggcagcccctg

SEQ ID NO: 5058888 - DNA, 13 bp, Homo sapiens
gggcagcccctgc

SEQ ID NO: 5058889 - DNA, 14 bp, Homo sapiens
gggcagcccctgca

SEQ ID NO: 5058890 - DNA, 17 bp, Homo sapiens
gggcagcccctgcagac

SEQ ID NO: 5058891 - DNA, 20 bp, Homo sapiens
gggcagcccctgctggacca

SEQ ID NO: 5058892 - DNA, 13 bp, Homo sapiens
gggcagccctcca

SEQ ID NO: 5058893 - DNA, 19 bp, Homo sapiens
gggcagccgctaggagaga

SEQ ID NO: 5058894 - DNA, 23 bp, Homo sapiens
gggcagccgctaggagagactga

SEQ ID NO: 5058895 - DNA, 13 bp, Homo sapiens
gggcagcctccag

SEQ ID NO: 5058896 - DNA, 21 bp, Homo sapiens
gggcagcctctccgactctgc

SEQ ID NO: 5058897 - DNA, 14 bp, Homo sapiens
gggcagcctgcctt

SEQ ID NO: 5058898 - DNA, 19 bp, Homo sapiens
gggcagcctgcgtggctga

SEQ ID NO: 5058899 - DNA, 18 bp, Homo sapiens
gggcagcctggctcccag

SEQ ID NO: 5058900 - DNA, 20 bp, Homo sapiens
gggcagcctggctcccagga

SEQ ID NO: 5058901 - DNA, 19 bp, Homo sapiens
gtttgtaaaattgttcctg

SEQ ID NO: 5058902 - DNA, 22 bp, Homo sapiens
gtttgtaaaattgttcctgaat

SEQ ID NO: 5058903 - DNA, 17 bp, Homo sapiens
gtttgtaaataagagat

SEQ ID NO: 5058904 - DNA, 13 bp, Homo sapiens
gtttgtaaatgcc

SEQ ID NO: 5058905 - DNA, 20 bp, Homo sapiens
gtttgtaaatgttatttctg

SEQ ID NO: 5058906 - DNA, 17 bp, Homo sapiens
gtttgtaaattaacttt

SEQ ID NO: 5058907 - DNA, 13 bp, Homo sapiens
gtttgtaaattat

SEQ ID NO: 5058908 - DNA, 16 bp, Homo sapiens
gtttgtaaattatttg

SEQ ID NO: 5058909 - DNA, 17 bp, Homo sapiens
gtttgtaaattctggaa

SEQ ID NO: 5058910 - DNA, 23 bp, Homo sapiens
gtttgtaacttgggctgtaaagc

SEQ ID NO: 5058911 - DNA, 14 bp, Homo sapiens
gtttgtaacttttt

SEQ ID NO: 5058912 - DNA, 18 bp, Homo sapiens
gtttgtaagcaattctaa

SEQ ID NO: 5058913 - DNA, 22 bp, Homo sapiens
gtttgtaagtaagtaagaaaga

SEQ ID NO: 5058914 - DNA, 19 bp, Homo sapiens
gtttgtaatggtgcttatt

SEQ ID NO: 5058915 - DNA, 17 bp, Homo sapiens
gtttgtacagtaatatg

SEQ ID NO: 5058916 - DNA, 19 bp, Homo sapiens
gtttgtacagtaatatgtt

SEQ ID NO: 5058917 - DNA, 18 bp, Homo sapiens
gtttgtacatatcaaata

SEQ ID NO: 5058918 - DNA, 16 bp, Homo sapiens
gtttgtaccatttatg

SEQ ID NO: 5058919 - DNA, 13 bp, Homo sapiens
gtttgtactcaaa

SEQ ID NO: 5058920 - DNA, 14 bp, Homo sapiens
gtttgtactcagtg

SEQ ID NO: 5058921 - DNA, 13 bp, Homo sapiens
gtttgtagccagg

SEQ ID NO: 5058922 - DNA, 18 bp, Homo sapiens
gtttgtagctttcctgga

SEQ ID NO: 5058923 - DNA, 21 bp, Homo sapiens
gtttgtagctttcctggaagt

SEQ ID NO: 5058924 - DNA, 16 bp, Homo sapiens
gtttgtaggctgtggg

SEQ ID NO: 5058925 - DNA, 21 bp, Homo sapiens
gtttgtagtttttgctgaagg

SEQ ID NO: 5058926 - DNA, 15 bp, Homo sapiens
gtttgtataacttct

SEQ ID NO: 5058927 - DNA, 16 bp, Homo sapiens
gtttgtatataaatgg

SEQ ID NO: 5058928 - DNA, 13 bp, Homo sapiens
gtttgtatattgt

SEQ ID NO: 5058929 - DNA, 12 bp, Homo sapiens
gtttgtatattt

SEQ ID NO: 5058930 - DNA, 14 bp, Homo sapiens
gtttgtatgatgta

SEQ ID NO: 5058931 - DNA, 14 bp, Homo sapiens
gtttgtatgtataa

SEQ ID NO: 5058932 - DNA, 16 bp, Homo sapiens
gtttgtatgtctgtgt

SEQ ID NO: 5058933 - DNA, 13 bp, Homo sapiens
gtttgtatgtgtg

SEQ ID NO: 5058934 - DNA, 20 bp, Homo sapiens
gtttgtattttaaatgtttt

SEQ ID NO: 5058935 - DNA, 20 bp, Homo sapiens
gtttgtattttttatttaca

SEQ ID NO: 5058936 - DNA, 21 bp, Homo sapiens
gtttgtattttttatttacat

SEQ ID NO: 5058937 - DNA, 17 bp, Homo sapiens
gtttgtatttttttcca

SEQ ID NO: 5058938 - DNA, 19 bp, Homo sapiens
gtttgtcactgccaaagta

SEQ ID NO: 5058939 - DNA, 13 bp, Homo sapiens
gtttgtcagcatc

SEQ ID NO: 5058940 - DNA, 14 bp, Homo sapiens
gtttgtcagcatct

SEQ ID NO: 5058941 - DNA, 23 bp, Homo sapiens
gtttgtcagcatctgaccatctg

SEQ ID NO: 5058942 - DNA, 18 bp, Homo sapiens
gtttgtcatatattcatg

SEQ ID NO: 5058943 - DNA, 15 bp, Homo sapiens
gtttgtcattagcct

SEQ ID NO: 5058944 - DNA, 17 bp, Homo sapiens
gtttgtcccccggggca

SEQ ID NO: 5058945 - DNA, 14 bp, Homo sapiens
gtttgtcctgggtt

SEQ ID NO: 5058946 - DNA, 16 bp, Homo sapiens
gtttgtcctttaacta

SEQ ID NO: 5058947 - DNA, 15 bp, Homo sapiens
gtttgtcctttatgt

SEQ ID NO: 5058948 - DNA, 13 bp, Homo sapiens
gtttgtctatttt

SEQ ID NO: 5058949 - DNA, 21 bp, Homo sapiens
gtttgtctctccttttctttt

SEQ ID NO: 5058950 - DNA, 13 bp, Homo sapiens
gtttgtctcttct

SEQ ID NO: 5058951 - DNA, 15 bp, Homo sapiens
gtttgtctcttctgg

SEQ ID NO: 5058952 - DNA, 13 bp, Homo sapiens
gtttgtctgtgtg

SEQ ID NO: 5058953 - DNA, 16 bp, Homo sapiens
gtttgtctgtttgttt

SEQ ID NO: 5058954 - DNA, 22 bp, Homo sapiens
gtttgtgaacgctgtgatgctg

SEQ ID NO: 5058955 - DNA, 20 bp, Homo sapiens
gtttgtgaggacctttgcac

SEQ ID NO: 5058956 - DNA, 13 bp, Homo sapiens
gtttgtgcagaat

SEQ ID NO: 5058957 - DNA, 15 bp, Homo sapiens
gtttgtggaatggat

SEQ ID NO: 5058958 - DNA, 19 bp, Homo sapiens
gtttgtggcgtctccctcg

SEQ ID NO: 5058959 - DNA, 18 bp, Homo sapiens
gtttgtggctattaaaac

SEQ ID NO: 5058960 - DNA, 13 bp, Homo sapiens
gtttgtggctggg

SEQ ID NO: 5058961 - DNA, 20 bp, Homo sapiens
gtttgtgggggcccttcctt

SEQ ID NO: 5058962 - DNA, 23 bp, Homo sapiens
gtttgtggggtgacgggactcag

SEQ ID NO: 5058963 - DNA, 15 bp, Homo sapiens
gtttgtgtctgtggt

SEQ ID NO: 5058964 - DNA, 13 bp, Homo sapiens
gtttgtgtctttg

SEQ ID NO: 5058965 - DNA, 18 bp, Homo sapiens
gtttgtgtgatttcctaa

SEQ ID NO: 5058966 - DNA, 13 bp, Homo sapiens
gtttgtgtggatg

SEQ ID NO: 5058967 - DNA, 17 bp, Homo sapiens
gtttgtgtgtatttgta

SEQ ID NO: 5058968 - DNA, 21 bp, Homo sapiens
gtttgtgtgtatttgtattaa

SEQ ID NO: 5058969 - DNA, 20 bp, Homo sapiens
gtttgtgtgttgtctcttga

SEQ ID NO: 5058970 - DNA, 21 bp, Homo sapiens
gtttgtgttgttgttgctgct

SEQ ID NO: 5058971 - DNA, 21 bp, Homo sapiens
gtttgtgttttaaaaaaactg

SEQ ID NO: 5058972 - DNA, 16 bp, Homo sapiens
gtttgttaaaaataaa

SEQ ID NO: 5058973 - DNA, 19 bp, Homo sapiens
gtttgttaaaaataaatcc

SEQ ID NO: 5058974 - DNA, 14 bp, Homo sapiens
gtttgttaattgat

SEQ ID NO: 5058975 - DNA, 23 bp, Homo sapiens
gtttgttaattgattaaactgta

SEQ ID NO: 5058976 - DNA, 16 bp, Homo sapiens
gtttgttactttgaat

SEQ ID NO: 5058977 - DNA, 14 bp, Homo sapiens
gtttgttatatcct

SEQ ID NO: 5058978 - DNA, 13 bp, Homo sapiens
gtttgttattaat

SEQ ID NO: 5058979 - DNA, 15 bp, Homo sapiens
gtttgttatttacac

SEQ ID NO: 5058980 - DNA, 17 bp, Homo sapiens
gtttgttatttacactg

SEQ ID NO: 5058981 - DNA, 13 bp, Homo sapiens
gtttgttcagtga

SEQ ID NO: 5058982 - DNA, 14 bp, Homo sapiens
gtttgttcatctgt

SEQ ID NO: 5058983 - DNA, 23 bp, Homo sapiens
gtttgttcccattggatgcattt

SEQ ID NO: 5058984 - DNA, 23 bp, Homo sapiens
gtttgttctccgggtgtggcctc

SEQ ID NO: 5058985 - DNA, 15 bp, Homo sapiens
gtttgttctgttctg

SEQ ID NO: 5058986 - DNA, 17 bp, Homo sapiens
gtttgttctgttctggg

SEQ ID NO: 5058987 - DNA, 23 bp, Homo sapiens
gtttgttgcacagtccctcctgt

SEQ ID NO: 5058988 - DNA, 17 bp, Homo sapiens
gtttgttggtcacatgg

SEQ ID NO: 5058989 - DNA, 21 bp, Homo sapiens
gtttgttggtcacatggagct

SEQ ID NO: 5058990 - DNA, 21 bp, Homo sapiens
gtttgttggttgattgtttaa

SEQ ID NO: 5058991 - DNA, 12 bp, Homo sapiens
gtttgtttagtc

SEQ ID NO: 5058992 - DNA, 20 bp, Homo sapiens
gtttgtttatatcactgtct

SEQ ID NO: 5058993 - DNA, 12 bp, Homo sapiens
gtttgtttcctg

SEQ ID NO: 5058994 - DNA, 17 bp, Homo sapiens
gtttgtttcctgtctga

SEQ ID NO: 5058995 - DNA, 19 bp, Homo sapiens
gtttgtttctccccctggg

SEQ ID NO: 5058996 - DNA, 14 bp, Homo sapiens
gtttgtttcttctt

SEQ ID NO: 5058997 - DNA, 14 bp, Homo sapiens
tatattaaagtaaa

SEQ ID NO: 5058998 - DNA, 13 bp, Homo sapiens
tatattacaatga

SEQ ID NO: 5058999 - DNA, 17 bp, Homo sapiens
tatattacaatgatcac

SEQ ID NO: 5059000 - DNA, 17 bp, Homo sapiens
tatattacacatttgta

SEQ ID NO: 5059001 - DNA, 13 bp, Homo sapiens
tatattacaccaa

SEQ ID NO: 5059002 - DNA, 17 bp, Homo sapiens
tatattacagatatttg

SEQ ID NO: 5059003 - DNA, 19 bp, Homo sapiens
tatattaccccttcatgtc

SEQ ID NO: 5059004 - DNA, 22 bp, Homo sapiens
tatattaccccttcatgtccta

SEQ ID NO: 5059005 - DNA, 19 bp, Homo sapiens
tatattactaataactttt

SEQ ID NO: 5059006 - DNA, 23 bp, Homo sapiens
tatattactgacatttcttctag

SEQ ID NO: 5059007 - DNA, 14 bp, Homo sapiens
tatattactgattt

SEQ ID NO: 5059008 - DNA, 15 bp, Homo sapiens
tatattacttttgta

SEQ ID NO: 5059009 - DNA, 22 bp, Homo sapiens
tatattaggatctgcaaacaat

SEQ ID NO: 5059010 - DNA, 23 bp, Homo sapiens
tatattaggcatgttcagggatg

SEQ ID NO: 5059011 - DNA, 14 bp, Homo sapiens
tatattataaatat

SEQ ID NO: 5059012 - DNA, 21 bp, Homo sapiens
tatattataaatatatataaa

SEQ ID NO: 5059013 - DNA, 22 bp, Homo sapiens
tatattataaatatatataaag

SEQ ID NO: 5059014 - DNA, 13 bp, Homo sapiens
tatattataagtt

SEQ ID NO: 5059015 - DNA, 23 bp, Homo sapiens
tatattataataatgttctctgg

SEQ ID NO: 5059016 - DNA, 17 bp, Homo sapiens
tatattatacttgtaat

SEQ ID NO: 5059017 - DNA, 17 bp, Homo sapiens
tatattatataaagaat

SEQ ID NO: 5059018 - DNA, 12 bp, Homo sapiens
tatattatatac

SEQ ID NO: 5059019 - DNA, 17 bp, Homo sapiens
tatattatatatacatt

SEQ ID NO: 5059020 - DNA, 22 bp, Homo sapiens
tatattatcaaggggactaaag

SEQ ID NO: 5059021 - DNA, 22 bp, Homo sapiens
tatattatcatgcaaatgctgt

SEQ ID NO: 5059022 - DNA, 20 bp, Homo sapiens
tatattatcctaagggaaga

SEQ ID NO: 5059023 - DNA, 16 bp, Homo sapiens
tatattatcttctggt

SEQ ID NO: 5059024 - DNA, 13 bp, Homo sapiens
tatattatgaaaa

SEQ ID NO: 5059025 - DNA, 14 bp, Homo sapiens
tatattatgaaaat

SEQ ID NO: 5059026 - DNA, 18 bp, Homo sapiens
tatattatggtgtaatgc

SEQ ID NO: 5059027 - DNA, 14 bp, Homo sapiens
tatattatgtgaag

SEQ ID NO: 5059028 - DNA, 17 bp, Homo sapiens
tatattatgtgaagaat

SEQ ID NO: 5059029 - DNA, 18 bp, Homo sapiens
tatattatgtgaagaatt

SEQ ID NO: 5059030 - DNA, 14 bp, Homo sapiens
tatattatgtttaa

SEQ ID NO: 5059031 - DNA, 12 bp, Homo sapiens
tatattattact

SEQ ID NO: 5059032 - DNA, 19 bp, Homo sapiens
tatattattacttgtaaat

SEQ ID NO: 5059033 - DNA, 12 bp, Homo sapiens
tatattattata

SEQ ID NO: 5059034 - DNA, 16 bp, Homo sapiens
tatattattatatata

SEQ ID NO: 5059035 - DNA, 15 bp, Homo sapiens
tatattattccaaag

SEQ ID NO: 5059036 - DNA, 22 bp, Homo sapiens
tatattattccgtattacattt

SEQ ID NO: 5059037 - DNA, 15 bp, Homo sapiens
tatattattctcatt

SEQ ID NO: 5059038 - DNA, 16 bp, Homo sapiens
tatattattctcattt

SEQ ID NO: 5059039 - DNA, 22 bp, Homo sapiens
tatattattctcatttagtgcc

SEQ ID NO: 5059040 - DNA, 15 bp, Homo sapiens
tatattattgattca

SEQ ID NO: 5059041 - DNA, 12 bp, Homo sapiens
tatattattgct

SEQ ID NO: 5059042 - DNA, 18 bp, Homo sapiens
tatattcaaaaattatat

SEQ ID NO: 5059043 - DNA, 16 bp, Homo sapiens
tatattcacagttttt

SEQ ID NO: 5059044 - DNA, 13 bp, Homo sapiens
tatattcaccaat

SEQ ID NO: 5059045 - DNA, 19 bp, Homo sapiens
tatattcaccaatgttgta

SEQ ID NO: 5059046 - DNA, 22 bp, Homo sapiens
tatattcactggttttacacag

SEQ ID NO: 5059047 - DNA, 18 bp, Homo sapiens
tatattcatctaataaat

SEQ ID NO: 5059048 - DNA, 20 bp, Homo sapiens
tatattcatctaataaatca

SEQ ID NO: 5059049 - DNA, 16 bp, Homo sapiens
tatattccaaggaaaa

SEQ ID NO: 5059050 - DNA, 22 bp, Homo sapiens
tatattccaggtttaagtagat

SEQ ID NO: 5059051 - DNA, 19 bp, Homo sapiens
tatattccatatattagca

SEQ ID NO: 5059052 - DNA, 14 bp, Homo sapiens
tatattcccaagct

SEQ ID NO: 5059053 - DNA, 22 bp, Homo sapiens
tatattccgggtgccattccca

SEQ ID NO: 5059054 - DNA, 18 bp, Homo sapiens
tatattccgtatttaaag

SEQ ID NO: 5059055 - DNA, 21 bp, Homo sapiens
tatattccgtatttaaagttg

SEQ ID NO: 5059056 - DNA, 15 bp, Homo sapiens
tatattcctccagct

SEQ ID NO: 5059057 - DNA, 17 bp, Homo sapiens
tatattcctccagctgg

SEQ ID NO: 5059058 - DNA, 18 bp, Homo sapiens
tatattccttactagaaa

SEQ ID NO: 5059059 - DNA, 21 bp, Homo sapiens
tatattccttactagaaatat

SEQ ID NO: 5059060 - DNA, 23 bp, Homo sapiens
tatattccttactagaaatatat

SEQ ID NO: 5059061 - DNA, 12 bp, Homo sapiens
tatattcctttt

SEQ ID NO: 5059062 - DNA, 13 bp, Homo sapiens
tatattcctttta

SEQ ID NO: 5059063 - DNA, 17 bp, Homo sapiens
tatattctaattaaaat

SEQ ID NO: 5059064 - DNA, 16 bp, Homo sapiens
tatattctattttaca

SEQ ID NO: 5059065 - DNA, 14 bp, Homo sapiens
tatattctctttgg

SEQ ID NO: 5059066 - DNA, 22 bp, Homo sapiens
tatattctctttggtgtacaaa

SEQ ID NO: 5059067 - DNA, 20 bp, Homo sapiens
tatattctgaccgttaaaaa

SEQ ID NO: 5059068 - DNA, 14 bp, Homo sapiens
tatattctgtttat

SEQ ID NO: 5059069 - DNA, 18 bp, Homo sapiens
tatattcttattggaaat

SEQ ID NO: 5059070 - DNA, 22 bp, Homo sapiens
tatattcttattggaaatgtac

SEQ ID NO: 5059071 - DNA, 14 bp, Homo sapiens
tatattcttccttg

SEQ ID NO: 5059072 - DNA, 14 bp, Homo sapiens
tatattgaaaagat

SEQ ID NO: 5059073 - DNA, 21 bp, Homo sapiens
tatattgaacttttgtactga

SEQ ID NO: 5059074 - DNA, 21 bp, Homo sapiens
tatattgaagtaagttcatca

SEQ ID NO: 5059075 - DNA, 13 bp, Homo sapiens
tatattgaatata

SEQ ID NO: 5059076 - DNA, 20 bp, Homo sapiens
tatattgagaatcccttaaa

SEQ ID NO: 5059077 - DNA, 16 bp, Homo sapiens
tatattgataagatct

SEQ ID NO: 5059078 - DNA, 19 bp, Homo sapiens
tatattgcacaattataaa

SEQ ID NO: 5059079 - DNA, 13 bp, Homo sapiens
tatattgcatttc

SEQ ID NO: 5059080 - DNA, 22 bp, Homo sapiens
gttttagaaattctataagaga

SEQ ID NO: 5059081 - DNA, 14 bp, Homo sapiens
gttttagaaattgg

SEQ ID NO: 5059082 - DNA, 14 bp, Homo sapiens
gttttagaattaca

SEQ ID NO: 5059083 - DNA, 18 bp, Homo sapiens
gttttagacaaatactca

SEQ ID NO: 5059084 - DNA, 18 bp, Homo sapiens
gttttagacctcatctcc

SEQ ID NO: 5059085 - DNA, 13 bp, Homo sapiens
gttttagagataa

SEQ ID NO: 5059086 - DNA, 18 bp, Homo sapiens
gttttagagataaatatt

SEQ ID NO: 5059087 - DNA, 18 bp, Homo sapiens
gttttagagtaagaaatt

SEQ ID NO: 5059088 - DNA, 18 bp, Homo sapiens
gttttagatttttaaaag

SEQ ID NO: 5059089 - DNA, 15 bp, Homo sapiens
gttttagcatttgta

SEQ ID NO: 5059090 - DNA, 16 bp, Homo sapiens
gttttagcatttgtat

SEQ ID NO: 5059091 - DNA, 18 bp, Homo sapiens
gttttagcatttgtataa

SEQ ID NO: 5059092 - DNA, 20 bp, Homo sapiens
gttttagcggggagggggat

SEQ ID NO: 5059093 - DNA, 15 bp, Homo sapiens
gttttagctgtagat

SEQ ID NO: 5059094 - DNA, 21 bp, Homo sapiens
gttttaggacaaacagctcag

SEQ ID NO: 5059095 - DNA, 23 bp, Homo sapiens
gttttaggatacttaacaaatac

SEQ ID NO: 5059096 - DNA, 22 bp, Homo sapiens
gttttagggagtggttcctgtg

SEQ ID NO: 5059097 - DNA, 16 bp, Homo sapiens
gttttaggtagaaaaa

SEQ ID NO: 5059098 - DNA, 23 bp, Homo sapiens
gttttaggtggcatagtggctta

SEQ ID NO: 5059099 - DNA, 22 bp, Homo sapiens
gttttaggtgtgtgtgtccaga

SEQ ID NO: 5059100 - DNA, 12 bp, Homo sapiens
gttttaggttct

SEQ ID NO: 5059101 - DNA, 15 bp, Homo sapiens
gttttaggttctaaa

SEQ ID NO: 5059102 - DNA, 17 bp, Homo sapiens
gttttaggttctaaagt

SEQ ID NO: 5059103 - DNA, 17 bp, Homo sapiens
gttttagtgccaggctg

SEQ ID NO: 5059104 - DNA, 17 bp, Homo sapiens
gttttagtgtaaaattg

SEQ ID NO: 5059105 - DNA, 17 bp, Homo sapiens
gttttagtgtctgacct

SEQ ID NO: 5059106 - DNA, 18 bp, Homo sapiens
gttttagtgtctgaccta

SEQ ID NO: 5059107 - DNA, 15 bp, Homo sapiens
gttttagttaaattt

SEQ ID NO: 5059108 - DNA, 21 bp, Homo sapiens
gttttagttgcagaaacattt

SEQ ID NO: 5059109 - DNA, 13 bp, Homo sapiens
gttttataaatgg

SEQ ID NO: 5059110 - DNA, 20 bp, Homo sapiens
gttttataagcatcattatt

SEQ ID NO: 5059111 - DNA, 23 bp, Homo sapiens
gttttataagcatcattatttat

SEQ ID NO: 5059112 - DNA, 21 bp, Homo sapiens
gttttataatttaataaaaag

SEQ ID NO: 5059113 - DNA, 23 bp, Homo sapiens
gttttataccctttttcatttaa

SEQ ID NO: 5059114 - DNA, 21 bp, Homo sapiens
gttttatactgaaggaaaaac

SEQ ID NO: 5059115 - DNA, 21 bp, Homo sapiens
gttttatactgctctataaat

SEQ ID NO: 5059116 - DNA, 15 bp, Homo sapiens
gttttatagaggttc

SEQ ID NO: 5059117 - DNA, 18 bp, Homo sapiens
gttttataggcagctgtc

SEQ ID NO: 5059118 - DNA, 11 bp, Homo sapiens
gttttatatat

SEQ ID NO: 5059119 - DNA, 20 bp, Homo sapiens
gttttatatattatgtgaag

SEQ ID NO: 5059120 - DNA, 22 bp, Homo sapiens
gttttatatattatgtgaagaa

SEQ ID NO: 5059121 - DNA, 23 bp, Homo sapiens
gttttatatattatgtgaagaat

SEQ ID NO: 5059122 - DNA, 13 bp, Homo sapiens
gttttatatgatt

SEQ ID NO: 5059123 - DNA, 20 bp, Homo sapiens
gttttatcacatgtatgttt

SEQ ID NO: 5059124 - DNA, 21 bp, Homo sapiens
gttttatcacatgtatgtttt

SEQ ID NO: 5059125 - DNA, 19 bp, Homo sapiens
gttttatctccatactttg

SEQ ID NO: 5059126 - DNA, 22 bp, Homo sapiens
gttttatctccatactttggat

SEQ ID NO: 5059127 - DNA, 16 bp, Homo sapiens
gttttatcttttaagt

SEQ ID NO: 5059128 - DNA, 11 bp, Homo sapiens
gttttatgata

SEQ ID NO: 5059129 - DNA, 18 bp, Homo sapiens
gttttatgctactgaact

SEQ ID NO: 5059130 - DNA, 13 bp, Homo sapiens
gttttatgtttct

SEQ ID NO: 5059131 - DNA, 14 bp, Homo sapiens
gttttatgtttctt

SEQ ID NO: 5059132 - DNA, 21 bp, Homo sapiens
gttttattatttctattaaat

SEQ ID NO: 5059133 - DNA, 14 bp, Homo sapiens
gttttattcctgta

SEQ ID NO: 5059134 - DNA, 20 bp, Homo sapiens
gttttattcctgtatgttgt

SEQ ID NO: 5059135 - DNA, 23 bp, Homo sapiens
gttttattggggaattaaatagt

SEQ ID NO: 5059136 - DNA, 13 bp, Homo sapiens
gttttattgtgtt

SEQ ID NO: 5059137 - DNA, 17 bp, Homo sapiens
gttttatttaaatgctt

SEQ ID NO: 5059138 - DNA, 21 bp, Homo sapiens
gttttatttatcaaaatgtag

SEQ ID NO: 5059139 - DNA, 13 bp, Homo sapiens
gttttatttccta

SEQ ID NO: 5059140 - DNA, 13 bp, Homo sapiens
gttttatttgtat

SEQ ID NO: 5059141 - DNA, 16 bp, Homo sapiens
gttttattttaaatta

SEQ ID NO: 5059142 - DNA, 13 bp, Homo sapiens
gttttattttaat

SEQ ID NO: 5059143 - DNA, 20 bp, Homo sapiens
gttttattttctaaagtact

SEQ ID NO: 5059144 - DNA, 20 bp, Homo sapiens
gttttattttctaaattctt

SEQ ID NO: 5059145 - DNA, 13 bp, Homo sapiens
gttttatttttgc

SEQ ID NO: 5059146 - DNA, 21 bp, Homo sapiens
gttttattttttattgttttc

SEQ ID NO: 5059147 - DNA, 21 bp, Homo sapiens
gttttcaaactgctgcatact

SEQ ID NO: 5059148 - DNA, 11 bp, Homo sapiens
gttttcaaaga

SEQ ID NO: 5059149 - DNA, 16 bp, Homo sapiens
gttttcaaatggagtt

SEQ ID NO: 5059150 - DNA, 17 bp, Homo sapiens
gttttcaaattggactt

SEQ ID NO: 5059151 - DNA, 16 bp, Homo sapiens
gttttcaacaattggt

SEQ ID NO: 5059152 - DNA, 18 bp, Homo sapiens
gttttcaacctctagaat

SEQ ID NO: 5059153 - DNA, 23 bp, Homo sapiens
gttttcaactcttccctgaactt

SEQ ID NO: 5059154 - DNA, 18 bp, Homo sapiens
gttttcaagtcaaattaa

SEQ ID NO: 5059155 - DNA, 13 bp, Homo sapiens
gttttcaatgaat

SEQ ID NO: 5059156 - DNA, 15 bp, Homo sapiens
gttttcaatgtgaaa

SEQ ID NO: 5059157 - DNA, 23 bp, Homo sapiens
gttttcaatgtgaaacacatgcc

SEQ ID NO: 5059158 - DNA, 22 bp, Homo sapiens
gttttcacaccagtcacacatt

SEQ ID NO: 5059159 - DNA, 20 bp, Homo sapiens
gttttcacagtcaccaagtg

SEQ ID NO: 5059160 - DNA, 20 bp, Homo sapiens
gttttcacataaatgcagcc

SEQ ID NO: 5059161 - DNA, 23 bp, Homo sapiens
gttttcacataaatgcagcccat

SEQ ID NO: 5059162 - DNA, 21 bp, Homo sapiens
gttttcaccatctttctaatc

SEQ ID NO: 5059163 - DNA, 13 bp, Homo sapiens
gttttcacttgta

SEQ ID NO: 5059164 - DNA, 17 bp, Homo sapiens
gttttcacttgtattga

SEQ ID NO: 5059165 - DNA, 22 bp, Homo sapiens
gttttcacttgtattgacttta

SEQ ID NO: 5059166 - DNA, 21 bp, Homo sapiens
gttttcagaacctcttcccca

SEQ ID NO: 5059167 - DNA, 18 bp, Homo sapiens
gttttcagaagaaataaa

SEQ ID NO: 5059168 - DNA, 20 bp, Homo sapiens
gttttcagagaattatctca

SEQ ID NO: 5059169 - DNA, 18 bp, Homo sapiens
gttttcagagcaggaggc

SEQ ID NO: 5059170 - DNA, 16 bp, Homo sapiens
gttttcagcaactcag

SEQ ID NO: 5059171 - DNA, 14 bp, Homo sapiens
gttttcagcccccc

SEQ ID NO: 5059172 - DNA, 22 bp, Homo sapiens
gttttcagctaggaacaaatct

SEQ ID NO: 5059173 - DNA, 19 bp, Homo sapiens
gttttcagctatacctgca

SEQ ID NO: 5059174 - DNA, 22 bp, Homo sapiens
gttttcagctgctcagaattca

SEQ ID NO: 5059175 - DNA, 15 bp, Homo sapiens
tatatttgtaggtat

SEQ ID NO: 5059176 - DNA, 13 bp, Homo sapiens
tatatttgtcatg

SEQ ID NO: 5059177 - DNA, 14 bp, Homo sapiens
tatatttgtcttcc

SEQ ID NO: 5059178 - DNA, 21 bp, Homo sapiens
tatatttgtgatagcactttc

SEQ ID NO: 5059179 - DNA, 16 bp, Homo sapiens
tatatttgtgctatag

SEQ ID NO: 5059180 - DNA, 17 bp, Homo sapiens
tatatttgtgctatagt

SEQ ID NO: 5059181 - DNA, 17 bp, Homo sapiens
tatatttgtgtatgtgt

SEQ ID NO: 5059182 - DNA, 20 bp, Homo sapiens
tatatttgtgtatttaacag

SEQ ID NO: 5059183 - DNA, 15 bp, Homo sapiens
tatatttgttttatg

SEQ ID NO: 5059184 - DNA, 15 bp, Homo sapiens
tatattttaaatgtg

SEQ ID NO: 5059185 - DNA, 16 bp, Homo sapiens
tatattttaaatgtgg

SEQ ID NO: 5059186 - DNA, 17 bp, Homo sapiens
tatattttaaatgtgga

SEQ ID NO: 5059187 - DNA, 13 bp, Homo sapiens
tatattttaagac

SEQ ID NO: 5059188 - DNA, 23 bp, Homo sapiens
tatattttaagccttcatttgca

SEQ ID NO: 5059189 - DNA, 14 bp, Homo sapiens
tatattttaatttg

SEQ ID NO: 5059190 - DNA, 16 bp, Homo sapiens
tatattttacaatttt

SEQ ID NO: 5059191 - DNA, 23 bp, Homo sapiens
tatattttacacgtatctcttgg

SEQ ID NO: 5059192 - DNA, 15 bp, Homo sapiens
tatattttaccatac

SEQ ID NO: 5059193 - DNA, 17 bp, Homo sapiens
tatattttagcatttta

SEQ ID NO: 5059194 - DNA, 21 bp, Homo sapiens
tatattttatactgcacttta

SEQ ID NO: 5059195 - DNA, 22 bp, Homo sapiens
tatattttatcaaggaagtctt

SEQ ID NO: 5059196 - DNA, 12 bp, Homo sapiens
tatattttatga

SEQ ID NO: 5059197 - DNA, 17 bp, Homo sapiens
tatattttatgatttaa

SEQ ID NO: 5059198 - DNA, 18 bp, Homo sapiens
tatattttatttcaatgt

SEQ ID NO: 5059199 - DNA, 22 bp, Homo sapiens
tatattttatttttagaatttt

SEQ ID NO: 5059200 - DNA, 18 bp, Homo sapiens
tatattttcagcaaagaa

SEQ ID NO: 5059201 - DNA, 14 bp, Homo sapiens
tatattttcagtac

SEQ ID NO: 5059202 - DNA, 17 bp, Homo sapiens
tatattttccctctctt

SEQ ID NO: 5059203 - DNA, 22 bp, Homo sapiens
tatattttccctctcttgcctt

SEQ ID NO: 5059204 - DNA, 22 bp, Homo sapiens
tatattttcccttattactgct

SEQ ID NO: 5059205 - DNA, 12 bp, Homo sapiens
tatattttcctc

SEQ ID NO: 5059206 - DNA, 12 bp, Homo sapiens
tatattttcgta

SEQ ID NO: 5059207 - DNA, 14 bp, Homo sapiens
tatattttctgtat

SEQ ID NO: 5059208 - DNA, 14 bp, Homo sapiens
tatattttcttttt

SEQ ID NO: 5059209 - DNA, 21 bp, Homo sapiens
tatattttgaacaactcgaat

SEQ ID NO: 5059210 - DNA, 14 bp, Homo sapiens
tatattttgctagc

SEQ ID NO: 5059211 - DNA, 14 bp, Homo sapiens
tatattttgctgtt

SEQ ID NO: 5059212 - DNA, 12 bp, Homo sapiens
tatattttggga

SEQ ID NO: 5059213 - DNA, 15 bp, Homo sapiens
tatattttgtatgca

SEQ ID NO: 5059214 - DNA, 17 bp, Homo sapiens
tatattttgtatgcaag

SEQ ID NO: 5059215 - DNA, 22 bp, Homo sapiens
tatattttgtgtgaaattgcat

SEQ ID NO: 5059216 - DNA, 20 bp, Homo sapiens
tatattttgttgttcctcta

SEQ ID NO: 5059217 - DNA, 16 bp, Homo sapiens
tatatttttaaagaat

SEQ ID NO: 5059218 - DNA, 18 bp, Homo sapiens
tatatttttaaagaatgt

SEQ ID NO: 5059219 - DNA, 14 bp, Homo sapiens
tatatttttaagac

SEQ ID NO: 5059220 - DNA, 20 bp, Homo sapiens
tatatttttaagataataat

SEQ ID NO: 5059221 - DNA, 18 bp, Homo sapiens
tatatttttaataaaagt

SEQ ID NO: 5059222 - DNA, 21 bp, Homo sapiens
tatatttttactgctttctga

SEQ ID NO: 5059223 - DNA, 20 bp, Homo sapiens
tatatttttagcctaaatgt

SEQ ID NO: 5059224 - DNA, 21 bp, Homo sapiens
tatatttttataataaacata

SEQ ID NO: 5059225 - DNA, 18 bp, Homo sapiens
tatatttttatatttact

SEQ ID NO: 5059226 - DNA, 18 bp, Homo sapiens
tatatttttatatttagt

SEQ ID NO: 5059227 - DNA, 14 bp, Homo sapiens
tatatttttatttc

SEQ ID NO: 5059228 - DNA, 13 bp, Homo sapiens
tatatttttcaaa

SEQ ID NO: 5059229 - DNA, 22 bp, Homo sapiens
tatatttttcaaccagcatttt

SEQ ID NO: 5059230 - DNA, 23 bp, Homo sapiens
tatatttttccctgtttgcctat

SEQ ID NO: 5059231 - DNA, 17 bp, Homo sapiens
tatatttttctgagatt

SEQ ID NO: 5059232 - DNA, 13 bp, Homo sapiens
tatatttttctgg

SEQ ID NO: 5059233 - DNA, 18 bp, Homo sapiens
tatatttttcttaaaaag

SEQ ID NO: 5059234 - DNA, 21 bp, Homo sapiens
tatatttttgatctttgagtg

SEQ ID NO: 5059235 - DNA, 21 bp, Homo sapiens
tatatttttgatggtaagact

SEQ ID NO: 5059236 - DNA, 18 bp, Homo sapiens
tatatttttggttgtcaa

SEQ ID NO: 5059237 - DNA, 20 bp, Homo sapiens
tatatttttgtacatattgt

SEQ ID NO: 5059238 - DNA, 20 bp, Homo sapiens
tatatttttgtctgcagctg

SEQ ID NO: 5059239 - DNA, 20 bp, Homo sapiens
tatatttttgtgttttcttg

SEQ ID NO: 5059240 - DNA, 24 bp, Homo sapiens
tatatttttgtgttttcttgtaaa

SEQ ID NO: 5059241 - DNA, 20 bp, Homo sapiens
tatattttttaaatttacag

SEQ ID NO: 5059242 - DNA, 19 bp, Homo sapiens
tatattttttaatttgatg

SEQ ID NO: 5059243 - DNA, 15 bp, Homo sapiens
tatattttttacaaa

SEQ ID NO: 5059244 - DNA, 16 bp, Homo sapiens
tatattttttgaactt

SEQ ID NO: 5059245 - DNA, 19 bp, Homo sapiens
tatattttttgttaaatga

SEQ ID NO: 5059246 - DNA, 16 bp, Homo sapiens
tatatttttttaactt

SEQ ID NO: 5059247 - DNA, 20 bp, Homo sapiens
tatcaaaaaacagaaaaaca

SEQ ID NO: 5059248 - DNA, 18 bp, Homo sapiens
tatcaaaaaacctttaca

SEQ ID NO: 5059249 - DNA, 19 bp, Homo sapiens
tatcaaaaagatatcaaag

SEQ ID NO: 5059250 - DNA, 20 bp, Homo sapiens
tatcaaaaagctaatgtgca

SEQ ID NO: 5059251 - DNA, 18 bp, Homo sapiens
tatcaaaaagtataaatt

SEQ ID NO: 5059252 - DNA, 12 bp, Homo sapiens
tatcaaaacaag

SEQ ID NO: 5059253 - DNA, 14 bp, Homo sapiens
tatcaaaagaaaga

SEQ ID NO: 5059254 - DNA, 18 bp, Homo sapiens
tatcaaaagaaatagaaa

SEQ ID NO: 5059255 - DNA, 12 bp, Homo sapiens
tatcaaaagaca

SEQ ID NO: 5059256 - DNA, 20 bp, Homo sapiens
tatcagcggccccttgactc

SEQ ID NO: 5059257 - DNA, 14 bp, Homo sapiens
tatcagctactgta

SEQ ID NO: 5059258 - DNA, 20 bp, Homo sapiens
tatcagctacttaagagaaa

SEQ ID NO: 5059259 - DNA, 21 bp, Homo sapiens
tatcagctacttaagagaaat

SEQ ID NO: 5059260 - DNA, 15 bp, Homo sapiens
tatcagctctctgca

SEQ ID NO: 5059261 - DNA, 15 bp, Homo sapiens
tatcagctctctgct

SEQ ID NO: 5059262 - DNA, 19 bp, Homo sapiens
tatcagctctctgctgggt

SEQ ID NO: 5059263 - DNA, 14 bp, Homo sapiens
tatcagcttcagaa

SEQ ID NO: 5059264 - DNA, 21 bp, Homo sapiens
tatcaggacccagaggaaggg

SEQ ID NO: 5059265 - DNA, 20 bp, Homo sapiens
tatcaggactgtgaccaaag

SEQ ID NO: 5059266 - DNA, 23 bp, Homo sapiens
tatcaggactgtgaccaaagcat

SEQ ID NO: 5059267 - DNA, 21 bp, Homo sapiens
tatcaggagtccactgcctcc

SEQ ID NO: 5059268 - DNA, 13 bp, Homo sapiens
tatcaggcacagg

SEQ ID NO: 5059269 - DNA, 16 bp, Homo sapiens
tatcaggcacaggcag

SEQ ID NO: 5059270 - DNA, 17 bp, Homo sapiens
tatcaggcacaggcagg

SEQ ID NO: 5059271 - DNA, 14 bp, Homo sapiens
tatcaggcagaaga

SEQ ID NO: 5059272 - DNA, 17 bp, Homo sapiens
tatcaggcagaagaatc

SEQ ID NO: 5059273 - DNA, 13 bp, Homo sapiens
tatcaggcaggac

SEQ ID NO: 5059274 - DNA, 15 bp, Homo sapiens
tatcagggatcctct

SEQ ID NO: 5059275 - DNA, 16 bp, Homo sapiens
tatcagggcaagctca

SEQ ID NO: 5059276 - DNA, 24 bp, Homo sapiens
tatcagggcaagctcatagcacat

SEQ ID NO: 5059277 - DNA, 19 bp, Homo sapiens
tatcagggcccaaataaca

SEQ ID NO: 5059278 - DNA, 14 bp, Homo sapiens
tatcagggcctgag

SEQ ID NO: 5059279 - DNA, 16 bp, Homo sapiens
tatcagggcctgagtg

SEQ ID NO: 5059280 - DNA, 13 bp, Homo sapiens
tatcaggggaaaa

SEQ ID NO: 5059281 - DNA, 14 bp, Homo sapiens
tatcaggggtgcat

SEQ ID NO: 5059282 - DNA, 23 bp, Homo sapiens
tatcaggtaaaatattttccaaa

SEQ ID NO: 5059283 - DNA, 23 bp, Homo sapiens
tatcaggtctcccacgtgggaga

SEQ ID NO: 5059284 - DNA, 20 bp, Homo sapiens
tatcaggtgctgccatccag

SEQ ID NO: 5059285 - DNA, 15 bp, Homo sapiens
tatcaggtgtataaa

SEQ ID NO: 5059286 - DNA, 21 bp, Homo sapiens
tatcagtaacccccttaaatt

SEQ ID NO: 5059287 - DNA, 21 bp, Homo sapiens
tatcagtaatgctaaatgtgt

SEQ ID NO: 5059288 - DNA, 17 bp, Homo sapiens
tatcagtacaattcttt

SEQ ID NO: 5059289 - DNA, 20 bp, Homo sapiens
tatcagtacaattctttgtt

SEQ ID NO: 5059290 - DNA, 9 bp, Homo sapiens
tatcagtag

SEQ ID NO: 5059291 - DNA, 14 bp, Homo sapiens
tatcagtagaaaga

SEQ ID NO: 5059292 - DNA, 15 bp, Homo sapiens
tatcagtagaaagag

SEQ ID NO: 5059293 - DNA, 15 bp, Homo sapiens
tatcagtagtgtaca

SEQ ID NO: 5059294 - DNA, 21 bp, Homo sapiens
tatcagtatcacgatttgcag

SEQ ID NO: 5059295 - DNA, 16 bp, Homo sapiens
tatcagtattctgaca

SEQ ID NO: 5059296 - DNA, 21 bp, Homo sapiens
tatcagtcaatatttttagat

SEQ ID NO: 5059297 - DNA, 15 bp, Homo sapiens
tatcagtcatgacta

SEQ ID NO: 5059298 - DNA, 22 bp, Homo sapiens
tatcagtcatgactagtgccta

SEQ ID NO: 5059299 - DNA, 19 bp, Homo sapiens
tatcagtccagtttgtcct

SEQ ID NO: 5059300 - DNA, 18 bp, Homo sapiens
tatcagtcgttttagtgt

SEQ ID NO: 5059301 - DNA, 22 bp, Homo sapiens
tatcagtcgttttagtgtctga

SEQ ID NO: 5059302 - DNA, 16 bp, Homo sapiens
tatcagtgacagagtt

SEQ ID NO: 5059303 - DNA, 19 bp, Homo sapiens
tatcagtgatggtctcaca

SEQ ID NO: 5059304 - DNA, 13 bp, Homo sapiens
tatcagtggttcg

SEQ ID NO: 5059305 - DNA, 21 bp, Homo sapiens
tatcagtggttcgggggaaat

SEQ ID NO: 5059306 - DNA, 17 bp, Homo sapiens
tatcagtgtaagccctg

SEQ ID NO: 5059307 - DNA, 18 bp, Homo sapiens
tatcagtgtcctttccag

SEQ ID NO: 5059308 - DNA, 15 bp, Homo sapiens
tatcagtgtttatgt

SEQ ID NO: 5059309 - DNA, 19 bp, Homo sapiens
tatcagtgttttaaattct

SEQ ID NO: 5059310 - DNA, 21 bp, Homo sapiens
tatcagttaaaatcacatttt

SEQ ID NO: 5059311 - DNA, 15 bp, Homo sapiens
tatcagttacacatg

SEQ ID NO: 5059312 - DNA, 21 bp, Homo sapiens
tatcagttacagtggcagtat

SEQ ID NO: 5059313 - DNA, 22 bp, Homo sapiens
tatcagttacagtggcagtatt

SEQ ID NO: 5059314 - DNA, 14 bp, Homo sapiens
tatcagttaccaaa

SEQ ID NO: 5059315 - DNA, 16 bp, Homo sapiens
tatcagttacccactc

SEQ ID NO: 5059316 - DNA, 14 bp, Homo sapiens
tatcagttatatga

SEQ ID NO: 5059317 - DNA, 17 bp, Homo sapiens
tatcagttatatgatat

SEQ ID NO: 5059318 - DNA, 16 bp, Homo sapiens
tatcagttgacagaat

SEQ ID NO: 5059319 - DNA, 21 bp, Homo sapiens
tatcagttgagcttcatatac

SEQ ID NO: 5059320 - DNA, 17 bp, Homo sapiens
tatcagttgatttttct

SEQ ID NO: 5059321 - DNA, 23 bp, Homo sapiens
tatcagtttgctagcagaaatct

SEQ ID NO: 5059322 - DNA, 16 bp, Homo sapiens
tatcataaaatcaaaa

SEQ ID NO: 5059323 - DNA, 13 bp, Homo sapiens
tatcataaagcat

SEQ ID NO: 5059324 - DNA, 15 bp, Homo sapiens
tatcataaaggatat

SEQ ID NO: 5059325 - DNA, 12 bp, Homo sapiens
tatcataaagta

SEQ ID NO: 5059326 - DNA, 17 bp, Homo sapiens
tatcataacttaataaa

SEQ ID NO: 5059327 - DNA, 21 bp, Homo sapiens
tatcataatatattgtgtttt

SEQ ID NO: 5059328 - DNA, 16 bp, Homo sapiens
tatcataatgtaatga

SEQ ID NO: 5059329 - DNA, 16 bp, Homo sapiens
tatcatacaaatcagt

SEQ ID NO: 5059330 - DNA, 14 bp, Homo sapiens
tatcatacagtttt

SEQ ID NO: 5059331 - DNA, 15 bp, Homo sapiens
tatcatacgttgata

SEQ ID NO: 5059332 - DNA, 14 bp, Homo sapiens
tatcatactcttct

SEQ ID NO: 5059333 - DNA, 20 bp, Homo sapiens
tatcatactcttctaaaact

SEQ ID NO: 5059334 - DNA, 15 bp, Homo sapiens
tatcatactgttcaa

SEQ ID NO: 5059335 - DNA, 12 bp, Homo sapiens
tatcatagcaaa

SEQ ID NO: 5059336 - DNA, 15 bp, Homo sapiens
tatcatataaaattt

SEQ ID NO: 5059337 - DNA, 18 bp, Homo sapiens
tatcatataaacatttta

SEQ ID NO: 5059338 - DNA, 16 bp, Homo sapiens
tatcatatatactgta

SEQ ID NO: 5059339 - DNA, 13 bp, Homo sapiens
tatcatatatgct

SEQ ID NO: 5059340 - DNA, 16 bp, Homo sapiens
tatcatattattatcc

SEQ ID NO: 5059341 - DNA, 15 bp, Homo sapiens
tatcatattggtgct

SEQ ID NO: 5059342 - DNA, 13 bp, Homo sapiens
tatcatatttaat

SEQ ID NO: 5059343 - DNA, 15 bp, Homo sapiens
tatcatatttctgtg

SEQ ID NO: 5059344 - DNA, 20 bp, Homo sapiens
tatcatcacgtatgttatac

SEQ ID NO: 5059345 - DNA, 18 bp, Homo sapiens
tatcatcagatagcatct

SEQ ID NO: 5059346 - DNA, 15 bp, Homo sapiens
tatcatcagtattga

SEQ ID NO: 5059347 - DNA, 22 bp, Homo sapiens
tatcatcagtattgaagcattt

SEQ ID NO: 5059348 - DNA, 16 bp, Homo sapiens
tatcatccacattgtt

SEQ ID NO: 5059349 - DNA, 20 bp, Homo sapiens
tatcatcccaacagccaaga

SEQ ID NO: 5059350 - DNA, 20 bp, Homo sapiens
tatcatcctttcagttttta

SEQ ID NO: 5059351 - DNA, 23 bp, Homo sapiens
tatcatcggagttgacagtgaaa

SEQ ID NO: 5059352 - DNA, 17 bp, Homo sapiens
tatcatctaaatattat

SEQ ID NO: 5059353 - DNA, 17 bp, Homo sapiens
tatcatctacctagatt

SEQ ID NO: 5059354 - DNA, 17 bp, Homo sapiens
tatcatctgtcattata

SEQ ID NO: 5059355 - DNA, 18 bp, Homo sapiens
gttttgtaagatgctggg

SEQ ID NO: 5059356 - DNA, 14 bp, Homo sapiens
gttttgtaagccct

SEQ ID NO: 5059357 - DNA, 20 bp, Homo sapiens
gttttgtaagccctctttaa

SEQ ID NO: 5059358 - DNA, 14 bp, Homo sapiens
gttttgtacataga

SEQ ID NO: 5059359 - DNA, 18 bp, Homo sapiens
gttttgtacatagattta

SEQ ID NO: 5059360 - DNA, 19 bp, Homo sapiens
gttttgtacatgtaacatt

SEQ ID NO: 5059361 - DNA, 14 bp, Homo sapiens
gttttgtaccagtg

SEQ ID NO: 5059362 - DNA, 9 bp, Homo sapiens
gttttgtag

SEQ ID NO: 5059363 - DNA, 12 bp, Homo sapiens
gttttgtagatg

SEQ ID NO: 5059364 - DNA, 20 bp, Homo sapiens
gttttgtagatggagtttca

SEQ ID NO: 5059365 - DNA, 12 bp, Homo sapiens
gttttgtagcag

SEQ ID NO: 5059366 - DNA, 18 bp, Homo sapiens
gttttgtaggtacttttg

SEQ ID NO: 5059367 - DNA, 18 bp, Homo sapiens
gttttgtataaaatctga

SEQ ID NO: 5059368 - DNA, 21 bp, Homo sapiens
gttttgtataaaatctgaatt

SEQ ID NO: 5059369 - DNA, 19 bp, Homo sapiens
gttttgtataaataataaa

SEQ ID NO: 5059370 - DNA, 22 bp, Homo sapiens
gttttgtataaataataaagaa

SEQ ID NO: 5059371 - DNA, 12 bp, Homo sapiens
gttttgtattct

SEQ ID NO: 5059372 - DNA, 15 bp, Homo sapiens
gttttgtattgcttc

SEQ ID NO: 5059373 - DNA, 20 bp, Homo sapiens
gttttgtattttttaaaaca

SEQ ID NO: 5059374 - DNA, 17 bp, Homo sapiens
gttttgtcaaactgtag

SEQ ID NO: 5059375 - DNA, 17 bp, Homo sapiens
gttttgtcccatttcct

SEQ ID NO: 5059376 - DNA, 21 bp, Homo sapiens
gttttgtcccatttccttgga

SEQ ID NO: 5059377 - DNA, 15 bp, Homo sapiens
gttttgtcctgcctc

SEQ ID NO: 5059378 - DNA, 18 bp, Homo sapiens
gttttgtcctttgagaaa

SEQ ID NO: 5059379 - DNA, 21 bp, Homo sapiens
gttttgtcctttgagaaagaa

SEQ ID NO: 5059380 - DNA, 17 bp, Homo sapiens
gttttgtctgtctccct

SEQ ID NO: 5059381 - DNA, 21 bp, Homo sapiens
gttttgtctgtgttgctgttt

SEQ ID NO: 5059382 - DNA, 13 bp, Homo sapiens
gttttgtgaaatt

SEQ ID NO: 5059383 - DNA, 18 bp, Homo sapiens
gttttgtgaaatttttca

SEQ ID NO: 5059384 - DNA, 20 bp, Homo sapiens
gttttgtgaaatttttcata

SEQ ID NO: 5059385 - DNA, 24 bp, Homo sapiens
gttttgtgactatatagagatgtt

SEQ ID NO: 5059386 - DNA, 13 bp, Homo sapiens
gttttgtgcttta

SEQ ID NO: 5059387 - DNA, 17 bp, Homo sapiens
gttttgtgtctggtgca

SEQ ID NO: 5059388 - DNA, 13 bp, Homo sapiens
gttttgtgtgtat

SEQ ID NO: 5059389 - DNA, 15 bp, Homo sapiens
gttttgtgttgtttg

SEQ ID NO: 5059390 - DNA, 17 bp, Homo sapiens
gttttgttatataattt

SEQ ID NO: 5059391 - DNA, 21 bp, Homo sapiens
gttttgttcaccattataatg

SEQ ID NO: 5059392 - DNA, 20 bp, Homo sapiens
gttttgttcccctcctccac

SEQ ID NO: 5059393 - DNA, 18 bp, Homo sapiens
gttttgttctgtatattt

SEQ ID NO: 5059394 - DNA, 14 bp, Homo sapiens
gttttgttgacatt

SEQ ID NO: 5059395 - DNA, 21 bp, Homo sapiens
gttttgttgacattctgaatg

SEQ ID NO: 5059396 - DNA, 22 bp, Homo sapiens
gttttgttgacattctgaatgc

SEQ ID NO: 5059397 - DNA, 12 bp, Homo sapiens
gttttgttgagc

SEQ ID NO: 5059398 - DNA, 14 bp, Homo sapiens
gttttgtttacaga

SEQ ID NO: 5059399 - DNA, 16 bp, Homo sapiens
gttttgtttcactttg

SEQ ID NO: 5059400 - DNA, 11 bp, Homo sapiens
gttttgtttgt

SEQ ID NO: 5059401 - DNA, 13 bp, Homo sapiens
gttttgtttgtct

SEQ ID NO: 5059402 - DNA, 15 bp, Homo sapiens
gttttgtttgtctct

SEQ ID NO: 5059403 - DNA, 17 bp, Homo sapiens
gttttgttttaaaatta

SEQ ID NO: 5059404 - DNA, 19 bp, Homo sapiens
gttttgttttcgtttttca

SEQ ID NO: 5059405 - DNA, 21 bp, Homo sapiens
gttttgttttctaagatgttc

SEQ ID NO: 5059406 - DNA, 12 bp, Homo sapiens
gttttgttttgg

SEQ ID NO: 5059407 - DNA, 13 bp, Homo sapiens
gttttgttttgta

SEQ ID NO: 5059408 - DNA, 15 bp, Homo sapiens
gttttgtttttacaa

SEQ ID NO: 5059409 - DNA, 16 bp, Homo sapiens
gttttgttttttaact

SEQ ID NO: 5059410 - DNA, 16 bp, Homo sapiens
gttttgttttttaagg

SEQ ID NO: 5059411 - DNA, 20 bp, Homo sapiens
gttttgttttttgtttctaa

SEQ ID NO: 5059412 - DNA, 20 bp, Homo sapiens
gtttttaaaaaggcctttgg

SEQ ID NO: 5059413 - DNA, 15 bp, Homo sapiens
gtttttaaaatattt

SEQ ID NO: 5059414 - DNA, 16 bp, Homo sapiens
gtttttaaaatattta

SEQ ID NO: 5059415 - DNA, 15 bp, Homo sapiens
gtttttaaactgtac

SEQ ID NO: 5059416 - DNA, 16 bp, Homo sapiens
gtttttaaactgtaca

SEQ ID NO: 5059417 - DNA, 22 bp, Homo sapiens
gtttttaaactgtacagtgtct

SEQ ID NO: 5059418 - DNA, 14 bp, Homo sapiens
gtttttaaagcctt

SEQ ID NO: 5059419 - DNA, 22 bp, Homo sapiens
gtttttaaataaagaacaattg

SEQ ID NO: 5059420 - DNA, 16 bp, Homo sapiens
gtttttaaattttgta

SEQ ID NO: 5059421 - DNA, 19 bp, Homo sapiens
gtttttaaattttgtaatg

SEQ ID NO: 5059422 - DNA, 15 bp, Homo sapiens
gtttttaacatgtga

SEQ ID NO: 5059423 - DNA, 20 bp, Homo sapiens
gtttttaactcatctttaga

SEQ ID NO: 5059424 - DNA, 21 bp, Homo sapiens
gtttttaactctactgtgtaa

SEQ ID NO: 5059425 - DNA, 23 bp, Homo sapiens
gtttttaagaaaaacatgtcatg

SEQ ID NO: 5059426 - DNA, 21 bp, Homo sapiens
gtttttaagggtttgtggaaa

SEQ ID NO: 5059427 - DNA, 18 bp, Homo sapiens
gtttttaagtaacttaag

SEQ ID NO: 5059428 - DNA, 19 bp, Homo sapiens
gtttttaatctcttgtcat

SEQ ID NO: 5059429 - DNA, 20 bp, Homo sapiens
gtttttaatctttgtgacag

SEQ ID NO: 5059430 - DNA, 14 bp, Homo sapiens
gtttttacatactt

SEQ ID NO: 5059431 - DNA, 21 bp, Homo sapiens
gtttttacatacttttgcaaa

SEQ ID NO: 5059432 - DNA, 22 bp, Homo sapiens
gtttttacatatagctttgcaa

SEQ ID NO: 5059433 - DNA, 13 bp, Homo sapiens
gtttttacattat

SEQ ID NO: 5059434 - DNA, 17 bp, Homo sapiens
tcaactgggttttcagc

SEQ ID NO: 5059435 - DNA, 19 bp, Homo sapiens
tcaactggttgtatatttt

SEQ ID NO: 5059436 - DNA, 21 bp, Homo sapiens
tcaactgtcaaatatgttctg

SEQ ID NO: 5059437 - DNA, 15 bp, Homo sapiens
tcaacttaaaagtca

SEQ ID NO: 5059438 - DNA, 13 bp, Homo sapiens
tcaacttaacatg

SEQ ID NO: 5059439 - DNA, 19 bp, Homo sapiens
tcaacttaactatcatctt

SEQ ID NO: 5059440 - DNA, 16 bp, Homo sapiens
tcaacttaattctgtt

SEQ ID NO: 5059441 - DNA, 13 bp, Homo sapiens
tcaacttatttca

SEQ ID NO: 5059442 - DNA, 14 bp, Homo sapiens
tcaacttatttcat

SEQ ID NO: 5059443 - DNA, 13 bp, Homo sapiens
tctataaatggtg

SEQ ID NO: 5059444 - DNA, 23 bp, Homo sapiens
tctataaattgtagaacatagat

SEQ ID NO: 5059445 - DNA, 18 bp, Homo sapiens
tctataaatttaagaaaa

SEQ ID NO: 5059446 - DNA, 19 bp, Homo sapiens
tctataacataaagaataa

SEQ ID NO: 5059447 - DNA, 14 bp, Homo sapiens
tctataaggccata

SEQ ID NO: 5059448 - DNA, 16 bp, Homo sapiens
tctataaggccataaa

SEQ ID NO: 5059449 - DNA, 22 bp, Homo sapiens
tctataaggccataaaacaggt

SEQ ID NO: 5059450 - DNA, 17 bp, Homo sapiens
tctataagtagtaaatc

SEQ ID NO: 5059451 - DNA, 19 bp, Homo sapiens
tctataagtagtaaatcag

SEQ ID NO: 5059452 - DNA, 22 bp, Homo sapiens
tctataagtagtaaatcagaaa

SEQ ID NO: 5059453 - DNA, 20 bp, Homo sapiens
tctataagtgttcagtgttg

SEQ ID NO: 5059454 - DNA, 23 bp, Homo sapiens
tctataagtgttcagtgttgaca

SEQ ID NO: 5059455 - DNA, 24 bp, Homo sapiens
tctataagtgttcagtgttgacat

SEQ ID NO: 5059456 - DNA, 20 bp, Homo sapiens
tctataataaatgggcacag

SEQ ID NO: 5059457 - DNA, 23 bp, Homo sapiens
tctataataaatgggcacagtat

SEQ ID NO: 5059458 - DNA, 21 bp, Homo sapiens
tctataatcccagcactttgg

SEQ ID NO: 5059459 - DNA, 14 bp, Homo sapiens
tctataattcctta

SEQ ID NO: 5059460 - DNA, 13 bp, Homo sapiens
tctataatttaaa

SEQ ID NO: 5059461 - DNA, 15 bp, Homo sapiens
tctataattttacaa

SEQ ID NO: 5059462 - DNA, 16 bp, Homo sapiens
tctatacaaatataaa

SEQ ID NO: 5059463 - DNA, 17 bp, Homo sapiens
tctatacacaccctgcc

SEQ ID NO: 5059464 - DNA, 23 bp, Homo sapiens
tctatacacaccctgcccctgca

SEQ ID NO: 5059465 - DNA, 15 bp, Homo sapiens
tctatacagtagctt

SEQ ID NO: 5059466 - DNA, 15 bp, Homo sapiens
tctatacatatcttt

SEQ ID NO: 5059467 - DNA, 18 bp, Homo sapiens
tctatacatatctttatt

SEQ ID NO: 5059468 - DNA, 18 bp, Homo sapiens
tctatacatgtttgcagt

SEQ ID NO: 5059469 - DNA, 13 bp, Homo sapiens
tctatacattcct

SEQ ID NO: 5059470 - DNA, 14 bp, Homo sapiens
tctataccaataaa

SEQ ID NO: 5059471 - DNA, 15 bp, Homo sapiens
tctataccaataaag

SEQ ID NO: 5059472 - DNA, 16 bp, Homo sapiens
tctatacccacccaga

SEQ ID NO: 5059473 - DNA, 20 bp, Homo sapiens
tctatacctttcaaagaact

SEQ ID NO: 5059474 - DNA, 16 bp, Homo sapiens
tctatactaatgctta

SEQ ID NO: 5059475 - DNA, 16 bp, Homo sapiens
tctatactaccctggg

SEQ ID NO: 5059476 - DNA, 20 bp, Homo sapiens
tctatactaccctgggctct

SEQ ID NO: 5059477 - DNA, 22 bp, Homo sapiens
tctatactgtggcctgcaggag

SEQ ID NO: 5059478 - DNA, 12 bp, Homo sapiens
tctatactgttt

SEQ ID NO: 5059479 - DNA, 16 bp, Homo sapiens
tctatactgtttgtaa

SEQ ID NO: 5059480 - DNA, 22 bp, Homo sapiens
tctatactgtttgtaatataca

SEQ ID NO: 5059481 - DNA, 23 bp, Homo sapiens
tctatactgtttgtaatatacag

SEQ ID NO: 5059482 - DNA, 15 bp, Homo sapiens
tctatacttgctttg

SEQ ID NO: 5059483 - DNA, 13 bp, Homo sapiens
tctatactttgtt

SEQ ID NO: 5059484 - DNA, 20 bp, Homo sapiens
tctatactttgttctgttgt

SEQ ID NO: 5059485 - DNA, 13 bp, Homo sapiens
tctatagagaaaa

SEQ ID NO: 5059486 - DNA, 15 bp, Homo sapiens
tctatagagcctggc

SEQ ID NO: 5059487 - DNA, 17 bp, Homo sapiens
tctatagcaccagggct

SEQ ID NO: 5059488 - DNA, 19 bp, Homo sapiens
tctatagccaaaaatagct

SEQ ID NO: 5059489 - DNA, 16 bp, Homo sapiens
tctatagccaaagctg

SEQ ID NO: 5059490 - DNA, 21 bp, Homo sapiens
tctatagccaaagctgttagt

SEQ ID NO: 5059491 - DNA, 20 bp, Homo sapiens
tctatagccaactgctaatg

SEQ ID NO: 5059492 - DNA, 20 bp, Homo sapiens
tctataggaacatatgaaaa

SEQ ID NO: 5059493 - DNA, 21 bp, Homo sapiens
tctataggacttaatttagca

SEQ ID NO: 5059494 - DNA, 14 bp, Homo sapiens
tctatagtagtcaa

SEQ ID NO: 5059495 - DNA, 14 bp, Homo sapiens
tctatagttctaga

SEQ ID NO: 5059496 - DNA, 16 bp, Homo sapiens
tctatagttgtcagta

SEQ ID NO: 5059497 - DNA, 20 bp, Homo sapiens
tctatagtttgattctgagt

SEQ ID NO: 5059498 - DNA, 17 bp, Homo sapiens
tctatataaaatgtatt

SEQ ID NO: 5059499 - DNA, 22 bp, Homo sapiens
tctatataaaatgtattcaagc

SEQ ID NO: 5059500 - DNA, 21 bp, Homo sapiens
tctatatagtacctttgctct

SEQ ID NO: 5059501 - DNA, 20 bp, Homo sapiens
tctatatagttccttgcctt

SEQ ID NO: 5059502 - DNA, 14 bp, Homo sapiens
tctatatataattc

SEQ ID NO: 5059503 - DNA, 18 bp, Homo sapiens
tctatatataattctgta

SEQ ID NO: 5059504 - DNA, 19 bp, Homo sapiens
tctatatataattctgtac

SEQ ID NO: 5059505 - DNA, 22 bp, Homo sapiens
tctatatatacatatacacaaa

SEQ ID NO: 5059506 - DNA, 15 bp, Homo sapiens
tctatatatacatgt

SEQ ID NO: 5059507 - DNA, 24 bp, Homo sapiens
tctatatatatagggagcacttta

SEQ ID NO: 5059508 - DNA, 18 bp, Homo sapiens
tctatatcatatttctgt

SEQ ID NO: 5059509 - DNA, 14 bp, Homo sapiens
tctatatccaaaat

SEQ ID NO: 5059510 - DNA, 17 bp, Homo sapiens
tctatatccaaaattca

SEQ ID NO: 5059511 - DNA, 13 bp, Homo sapiens
tctatatcctcaa

SEQ ID NO: 5059512 - DNA, 12 bp, Homo sapiens
tctatatgaatt

SEQ ID NO: 5059513 - DNA, 14 bp, Homo sapiens
tctatatgaattta

SEQ ID NO: 5059514 - DNA, 13 bp, Homo sapiens
tctatatgatcct

SEQ ID NO: 5059515 - DNA, 16 bp, Homo sapiens
tctatatgatcctgaa

SEQ ID NO: 5059516 - DNA, 18 bp, Homo sapiens
tctatatgtacttgtcaa

SEQ ID NO: 5059517 - DNA, 15 bp, Homo sapiens
tctatattaaagtgt

SEQ ID NO: 5059518 - DNA, 15 bp, Homo sapiens
tctatattaaatgag

SEQ ID NO: 5059519 - DNA, 14 bp, Homo sapiens
tctatattatgtct

SEQ ID NO: 5059520 - DNA, 22 bp, Homo sapiens
tctatattatgtcttcttttgt

SEQ ID NO: 5059521 - DNA, 16 bp, Homo sapiens
tctatattattatata

SEQ ID NO: 5059522 - DNA, 22 bp, Homo sapiens
tctatattattgcccatgatat

SEQ ID NO: 5059523 - DNA, 19 bp, Homo sapiens
tctatattcctccagctgg

SEQ ID NO: 5059524 - DNA, 14 bp, Homo sapiens
tctatattctaaag

SEQ ID NO: 5059525 - DNA, 16 bp, Homo sapiens
tctatattctttattc

SEQ ID NO: 5059526 - DNA, 17 bp, Homo sapiens
tctatatttactgttta

SEQ ID NO: 5059527 - DNA, 12 bp, Homo sapiens
tctatatttcat

SEQ ID NO: 5059528 - DNA, 16 bp, Homo sapiens
tctatatttcatattg

SEQ ID NO: 5059529 - DNA, 15 bp, Homo sapiens
tctatatttgtcttc

SEQ ID NO: 5059530 - DNA, 16 bp, Homo sapiens
tctatatttgtcttcc

SEQ ID NO: 5059531 - DNA, 18 bp, Homo sapiens
tctatattttaatagaaa

SEQ ID NO: 5059532 - DNA, 14 bp, Homo sapiens
tctatattttcatt

SEQ ID NO: 5059533 - DNA, 16 bp, Homo sapiens
tctatattttcattct

SEQ ID NO: 5059534 - DNA, 23 bp, Homo sapiens
tctatattttgggaaaaaaacat

SEQ ID NO: 5059535 - DNA, 16 bp, Homo sapiens
tctatatttttgtgaa

SEQ ID NO: 5059536 - DNA, 20 bp, Homo sapiens
tctatcaactttaatcaagt

SEQ ID NO: 5059537 - DNA, 22 bp, Homo sapiens
tctatcaagtattatacctttt

SEQ ID NO: 5059538 - DNA, 13 bp, Homo sapiens
tctatcacctgtc

SEQ ID NO: 5059539 - DNA, 18 bp, Homo sapiens
tctatcacctgtcatcat

SEQ ID NO: 5059540 - DNA, 23 bp, Homo sapiens
tctatcactaaaaatttttacaa

SEQ ID NO: 5059541 - DNA, 14 bp, Homo sapiens
tctatcagaaatac

SEQ ID NO: 5059542 - DNA, 19 bp, Homo sapiens
tctatcagaaatacaaaaa

SEQ ID NO: 5059543 - DNA, 20 bp, Homo sapiens
tctatcagaaatacaaaaaa

SEQ ID NO: 5059544 - DNA, 23 bp, Homo sapiens
tctatcagactcagttttttgta

SEQ ID NO: 5059545 - DNA, 16 bp, Homo sapiens
tctatcagattaagtt

SEQ ID NO: 5059546 - DNA, 17 bp, Homo sapiens
tctatcagcattgtttc

SEQ ID NO: 5059547 - DNA, 17 bp, Homo sapiens
tctatcagccttgctaa

SEQ ID NO: 5059548 - DNA, 20 bp, Homo sapiens
tctatcaggaaaacaaatca

SEQ ID NO: 5059549 - DNA, 23 bp, Homo sapiens
tctatcaggggtgcattctggcc

SEQ ID NO: 5059550 - DNA, 17 bp, Homo sapiens
tctatcagtgacttctg

SEQ ID NO: 5059551 - DNA, 16 bp, Homo sapiens
tctatcattaaagttc

SEQ ID NO: 5059552 - DNA, 20 bp, Homo sapiens
tctatcattcccctgcccac

SEQ ID NO: 5059553 - DNA, 15 bp, Homo sapiens
tctatcatttaataa

SEQ ID NO: 5059554 - DNA, 22 bp, Homo sapiens
tctatcatttaataatatactt

SEQ ID NO: 5059555 - DNA, 15 bp, Homo sapiens
tctatcatttttgta

SEQ ID NO: 5059556 - DNA, 23 bp, Homo sapiens
tctatcatttttgtacagtttgc

SEQ ID NO: 5059557 - DNA, 22 bp, Homo sapiens
tctatccaaagaacttgatttg

SEQ ID NO: 5059558 - DNA, 14 bp, Homo sapiens
tctatccatctcct

SEQ ID NO: 5059559 - DNA, 17 bp, Homo sapiens
tctatccatctcctggt

SEQ ID NO: 5059560 - DNA, 20 bp, Homo sapiens
tctatccatctcctggtgtt

SEQ ID NO: 5059561 - DNA, 14 bp, Homo sapiens
tctatccccaagct

SEQ ID NO: 5059562 - DNA, 15 bp, Homo sapiens
tctatccccaagctg

SEQ ID NO: 5059563 - DNA, 15 bp, Homo sapiens
tctatccctggccac

SEQ ID NO: 5059564 - DNA, 16 bp, Homo sapiens
tctatccctggccacc

SEQ ID NO: 5059565 - DNA, 14 bp, Homo sapiens
tctatccctggctt

SEQ ID NO: 5059566 - DNA, 19 bp, Homo sapiens
tctatccctggcttcccct

SEQ ID NO: 5059567 - DNA, 22 bp, Homo sapiens
tctatccctggcttccccttca

SEQ ID NO: 5059568 - DNA, 14 bp, Homo sapiens
tctatcctctctct

SEQ ID NO: 5059569 - DNA, 17 bp, Homo sapiens
tctatcctgtttaataa

SEQ ID NO: 5059570 - DNA, 16 bp, Homo sapiens
tctatccttccagaaa

SEQ ID NO: 5059571 - DNA, 13 bp, Homo sapiens
tctatcctttcct

SEQ ID NO: 5059572 - DNA, 14 bp, Homo sapiens
tctatcctttcctg

SEQ ID NO: 5059573 - DNA, 16 bp, Homo sapiens
tctatccttttgcctg

SEQ ID NO: 5059574 - DNA, 19 bp, Homo sapiens
tctatcggaagaacatgaa

SEQ ID NO: 5059575 - DNA, 20 bp, Homo sapiens
tctatcggaagaacatgaat

SEQ ID NO: 5059576 - DNA, 20 bp, Homo sapiens
tctatctaatagagaacttt

SEQ ID NO: 5059577 - DNA, 18 bp, Homo sapiens
tctatctaatcagatctt

SEQ ID NO: 5059578 - DNA, 15 bp, Homo sapiens
tctatctaattttta

SEQ ID NO: 5059579 - DNA, 20 bp, Homo sapiens
tctatctacaaagaaaaatt

SEQ ID NO: 5059580 - DNA, 20 bp, Homo sapiens
tctatctatatatacatata

SEQ ID NO: 5059581 - DNA, 14 bp, Homo sapiens
tctatctatttgag

SEQ ID NO: 5059582 - DNA, 15 bp, Homo sapiens
tctatctatttgagg

SEQ ID NO: 5059583 - DNA, 19 bp, Homo sapiens
tctatctcacactgcacca

SEQ ID NO: 5059584 - DNA, 14 bp, Homo sapiens
tctatctcacagca

SEQ ID NO: 5059585 - DNA, 16 bp, Homo sapiens
tctatctctatataaa

SEQ ID NO: 5059586 - DNA, 12 bp, Homo sapiens
tctatctctcaa

SEQ ID NO: 5059587 - DNA, 17 bp, Homo sapiens
tctatctggaatttaat

SEQ ID NO: 5059588 - DNA, 12 bp, Homo sapiens
tctatctgggcc

SEQ ID NO: 5059589 - DNA, 16 bp, Homo sapiens
tctatctgggcctggg

SEQ ID NO: 5059590 - DNA, 17 bp, Homo sapiens
tctatctgggcctgggc

SEQ ID NO: 5059591 - DNA, 18 bp, Homo sapiens
tctatctgggcctgggct

SEQ ID NO: 5059592 - DNA, 21 bp, Homo sapiens
tctatctggtattaaatgcca

SEQ ID NO: 5059593 - DNA, 16 bp, Homo sapiens
tctatcttatatagtt

SEQ ID NO: 5059594 - DNA, 13 bp, Homo sapiens
tctatcttccaaa

SEQ ID NO: 5059595 - DNA, 14 bp, Homo sapiens
tctatcttccaaac

SEQ ID NO: 5059596 - DNA, 17 bp, Homo sapiens
tctatcttccaaatgca

SEQ ID NO: 5059597 - DNA, 15 bp, Homo sapiens
tctatcttgtaaata

SEQ ID NO: 5059598 - DNA, 14 bp, Homo sapiens
tctatcttgttcca

SEQ ID NO: 5059599 - DNA, 12 bp, Homo sapiens
tctatgaaaacc

SEQ ID NO: 5059600 - DNA, 14 bp, Homo sapiens
tctatgaaatatta

SEQ ID NO: 5059601 - DNA, 17 bp, Homo sapiens
tctatgaaatattatgt

SEQ ID NO: 5059602 - DNA, 16 bp, Homo sapiens
tctatgaacaacagta

SEQ ID NO: 5059603 - DNA, 23 bp, Homo sapiens
tctatgaactctgttttctttct

SEQ ID NO: 5059604 - DNA, 18 bp, Homo sapiens
tctatgaagtatataatg

SEQ ID NO: 5059605 - DNA, 11 bp, Homo sapiens
tctatgaagtt

SEQ ID NO: 5059606 - DNA, 14 bp, Homo sapiens
tctatgaagttgct

SEQ ID NO: 5059607 - DNA, 15 bp, Homo sapiens
tctatgaagttgctg

SEQ ID NO: 5059608 - DNA, 19 bp, Homo sapiens
tctatgaagttgctgttta

SEQ ID NO: 5059609 - DNA, 20 bp, Homo sapiens
tctatgaagttgctgtttat

SEQ ID NO: 5059610 - DNA, 16 bp, Homo sapiens
tctatgacaataaatt

SEQ ID NO: 5059611 - DNA, 22 bp, Homo sapiens
tctatgacaataaattttatct

SEQ ID NO: 5059612 - DNA, 13 bp, Homo sapiens
tctattgtttgtt

SEQ ID NO: 5059613 - DNA, 13 bp, Homo sapiens
tctatttaaaaaa

SEQ ID NO: 5059614 - DNA, 18 bp, Homo sapiens
tctatttaaaaaactgta

SEQ ID NO: 5059615 - DNA, 16 bp, Homo sapiens
tctatttaaaaaataa

SEQ ID NO: 5059616 - DNA, 13 bp, Homo sapiens
tctatttaaattc

SEQ ID NO: 5059617 - DNA, 12 bp, Homo sapiens
tctatttaatat

SEQ ID NO: 5059618 - DNA, 13 bp, Homo sapiens
tctatttaatatt

SEQ ID NO: 5059619 - DNA, 22 bp, Homo sapiens
tctatttacctcctaatggcat

SEQ ID NO: 5059620 - DNA, 23 bp, Homo sapiens
tctatttacttctaatcttaaat

SEQ ID NO: 5059621 - DNA, 14 bp, Homo sapiens
tctatttataatac

SEQ ID NO: 5059622 - DNA, 18 bp, Homo sapiens
tctatttatatgtacatg

SEQ ID NO: 5059623 - DNA, 16 bp, Homo sapiens
tctatttatctgtctg

SEQ ID NO: 5059624 - DNA, 16 bp, Homo sapiens
tcaagcaggttagaga

SEQ ID NO: 5059625 - DNA, 19 bp, Homo sapiens
tcaagcagtcgtgcctgtg

SEQ ID NO: 5059626 - DNA, 22 bp, Homo sapiens
tcaagcagtcgtgcctgtgtcc

SEQ ID NO: 5059627 - DNA, 20 bp, Homo sapiens
tcaagcagtctacccacctc

SEQ ID NO: 5059628 - DNA, 15 bp, Homo sapiens
tcaagcatattggaa

SEQ ID NO: 5059629 - DNA, 16 bp, Homo sapiens
tcaagcatcctcagaa

SEQ ID NO: 5059630 - DNA, 23 bp, Homo sapiens
tcaagcatctcctgaggatcaga

SEQ ID NO: 5059631 - DNA, 16 bp, Homo sapiens
tcaagcattctgttta

SEQ ID NO: 5059632 - DNA, 15 bp, Homo sapiens
tcaagcattgctaaa

SEQ ID NO: 5059633 - DNA, 14 bp, Homo sapiens
tcaagccaagcagc

SEQ ID NO: 5059634 - DNA, 17 bp, Homo sapiens
tcaagccaagcagccaa

SEQ ID NO: 5059635 - DNA, 19 bp, Homo sapiens
tcaagccaagcagccaagc

SEQ ID NO: 5059636 - DNA, 20 bp, Homo sapiens
tcaagccaagcagccaagct

SEQ ID NO: 5059637 - DNA, 17 bp, Homo sapiens
tcaagccaatcccctcc

SEQ ID NO: 5059638 - DNA, 12 bp, Homo sapiens
tcaagccaccaa

SEQ ID NO: 5059639 - DNA, 20 bp, Homo sapiens
tcaagccaccaacatactcc

SEQ ID NO: 5059640 - DNA, 19 bp, Homo sapiens
tcaagccatcaaacctggg

SEQ ID NO: 5059641 - DNA, 20 bp, Homo sapiens
tcaagccatgtataaatgtg

SEQ ID NO: 5059642 - DNA, 21 bp, Homo sapiens
tcaagccatgtgctttagcat

SEQ ID NO: 5059643 - DNA, 12 bp, Homo sapiens
tcaagcccaggc

SEQ ID NO: 5059644 - DNA, 23 bp, Homo sapiens
tcaagccccaccacatagcatgc

SEQ ID NO: 5059645 - DNA, 24 bp, Homo sapiens
tcaagccccaccacatagcatgct

SEQ ID NO: 5059646 - DNA, 14 bp, Homo sapiens
tcaagccccagcag

SEQ ID NO: 5059647 - DNA, 18 bp, Homo sapiens
tcaagccccagcagccct

SEQ ID NO: 5059648 - DNA, 21 bp, Homo sapiens
tcaagccccagcagccctcaa

SEQ ID NO: 5059649 - DNA, 15 bp, Homo sapiens
tcaagccccctttga

SEQ ID NO: 5059650 - DNA, 14 bp, Homo sapiens
tcaagcccctgtct

SEQ ID NO: 5059651 - DNA, 15 bp, Homo sapiens
tcaagccccttctct

SEQ ID NO: 5059652 - DNA, 16 bp, Homo sapiens
tcaagcccgcggggac

SEQ ID NO: 5059653 - DNA, 12 bp, Homo sapiens
tcaagccctgca

SEQ ID NO: 5059654 - DNA, 17 bp, Homo sapiens
tcaagccgcaagctctc

SEQ ID NO: 5059655 - DNA, 22 bp, Homo sapiens
tcaagcctagatgttttataca

SEQ ID NO: 5059656 - DNA, 15 bp, Homo sapiens
tcaagcctctaaaca

SEQ ID NO: 5059657 - DNA, 14 bp, Homo sapiens
tcaagcctctggtc

SEQ ID NO: 5059658 - DNA, 19 bp, Homo sapiens
tcaagcctgcagcgagctg

SEQ ID NO: 5059659 - DNA, 13 bp, Homo sapiens
tcaagcctggccc

SEQ ID NO: 5059660 - DNA, 20 bp, Homo sapiens
tcaagcctggcccagtgaga

SEQ ID NO: 5059661 - DNA, 18 bp, Homo sapiens
tcaagcctgtgcaaaaaa

SEQ ID NO: 5059662 - DNA, 14 bp, Homo sapiens
tcaagcctgtggga

SEQ ID NO: 5059663 - DNA, 18 bp, Homo sapiens
tcaagcctttatggctgc

SEQ ID NO: 5059664 - DNA, 15 bp, Homo sapiens
tcaagcgattctcat

SEQ ID NO: 5059665 - DNA, 20 bp, Homo sapiens
tcaagcgattctcccgcctc

SEQ ID NO: 5059666 - DNA, 22 bp, Homo sapiens
tcaagcgattctcccgcctcag

SEQ ID NO: 5059667 - DNA, 15 bp, Homo sapiens
tcaagcgattctcct

SEQ ID NO: 5059668 - DNA, 17 bp, Homo sapiens
tcaagcgattctcctgc

SEQ ID NO: 5059669 - DNA, 17 bp, Homo sapiens
tcaagcgattctcctgt

SEQ ID NO: 5059670 - DNA, 15 bp, Homo sapiens
tcaagcgattctctt

SEQ ID NO: 5059671 - DNA, 15 bp, Homo sapiens
tcaagcgattcttct

SEQ ID NO: 5059672 - DNA, 17 bp, Homo sapiens
tcaagcgattcttctgc

SEQ ID NO: 5059673 - DNA, 19 bp, Homo sapiens
tcaagcgctatccacagaa

SEQ ID NO: 5059674 - DNA, 15 bp, Homo sapiens
tcaagcgctccaggg

SEQ ID NO: 5059675 - DNA, 17 bp, Homo sapiens
tcaagcgctccagggcc

SEQ ID NO: 5059676 - DNA, 21 bp, Homo sapiens
tcaagcggtgcctaagaagtt

SEQ ID NO: 5059677 - DNA, 17 bp, Homo sapiens
tcaagctaagtaaaaat

SEQ ID NO: 5059678 - DNA, 19 bp, Homo sapiens
tcaagctaagtaaaaatat

SEQ ID NO: 5059679 - DNA, 23 bp, Homo sapiens
tcaagctaataaaatatcattca

SEQ ID NO: 5059680 - DNA, 20 bp, Homo sapiens
tcaagctactttatgtaaat

SEQ ID NO: 5059681 - DNA, 15 bp, Homo sapiens
tcaagctagccagag

SEQ ID NO: 5059682 - DNA, 16 bp, Homo sapiens
tcaagctagccagagg

SEQ ID NO: 5059683 - DNA, 14 bp, Homo sapiens
tcaagctagtgttt

SEQ ID NO: 5059684 - DNA, 17 bp, Homo sapiens
tcaagctagtgtttcta

SEQ ID NO: 5059685 - DNA, 18 bp, Homo sapiens
tcaagctattctcatgcc

SEQ ID NO: 5059686 - DNA, 18 bp, Homo sapiens
tcaagctatttctctgga

SEQ ID NO: 5059687 - DNA, 17 bp, Homo sapiens
tcaagctcaccctgctc

SEQ ID NO: 5059688 - DNA, 19 bp, Homo sapiens
tcaagctcaccctgctcct

SEQ ID NO: 5059689 - DNA, 18 bp, Homo sapiens
tcaagctccatcttattt

SEQ ID NO: 5059690 - DNA, 14 bp, Homo sapiens
tcaagctcctagta

SEQ ID NO: 5059691 - DNA, 15 bp, Homo sapiens
tcaagctcctcctcc

SEQ ID NO: 5059692 - DNA, 12 bp, Homo sapiens
tcaagctctgag

SEQ ID NO: 5059693 - DNA, 15 bp, Homo sapiens
tcaagctctgaggga

SEQ ID NO: 5059694 - DNA, 18 bp, Homo sapiens
tcaagctctgagggaaag

SEQ ID NO: 5059695 - DNA, 21 bp, Homo sapiens
tcaagctctgagggaaagggc

SEQ ID NO: 5059696 - DNA, 16 bp, Homo sapiens
tcaagctctgcaacag

SEQ ID NO: 5059697 - DNA, 18 bp, Homo sapiens
tcaagctgaccttgctga

SEQ ID NO: 5059698 - DNA, 16 bp, Homo sapiens
tcaagctgagaaaagt

SEQ ID NO: 5059699 - DNA, 14 bp, Homo sapiens
tcaagctgctctga

SEQ ID NO: 5059700 - DNA, 21 bp, Homo sapiens
tcaagctggaaaggccagcag

SEQ ID NO: 5059701 - DNA, 15 bp, Homo sapiens
tcaagctggccgtgg

SEQ ID NO: 5059702 - DNA, 16 bp, Homo sapiens
tcaagctggccgtgga

SEQ ID NO: 5059703 - DNA, 18 bp, Homo sapiens
tcaagctggccgtggagt

SEQ ID NO: 5059704 - DNA, 21 bp, Homo sapiens
tcaagctggtggcctctgcag

SEQ ID NO: 5059705 - DNA, 13 bp, Homo sapiens
tcaagctgtcccc

SEQ ID NO: 5059706 - DNA, 20 bp, Homo sapiens
tcaagctgtcccctctgtca

SEQ ID NO: 5059707 - DNA, 21 bp, Homo sapiens
tcaagctgttatttcttccct

SEQ ID NO: 5059708 - DNA, 19 bp, Homo sapiens
tcaagctgttgaagtctca

SEQ ID NO: 5059709 - DNA, 20 bp, Homo sapiens
tcaagcttagtgagcagtga

SEQ ID NO: 5059710 - DNA, 17 bp, Homo sapiens
tcaagcttctctgttct

SEQ ID NO: 5059711 - DNA, 17 bp, Homo sapiens
tcaagcttgtgtacttg

SEQ ID NO: 5059712 - DNA, 17 bp, Homo sapiens
tcaagctttcaaatcct

SEQ ID NO: 5059713 - DNA, 18 bp, Homo sapiens
tcaagctttcctgctgtc

SEQ ID NO: 5059714 - DNA, 22 bp, Homo sapiens
tcaagcttttcctttctttttt

SEQ ID NO: 5059715 - DNA, 22 bp, Homo sapiens
tcaagcttttgcttgatccaga

SEQ ID NO: 5059716 - DNA, 20 bp, Homo sapiens
tcaagctttttgtgagaaag

SEQ ID NO: 5059717 - DNA, 20 bp, Homo sapiens
tcaaggaaaagatcattaaa

SEQ ID NO: 5059718 - DNA, 15 bp, Homo sapiens
tcaaggaaaataagt

SEQ ID NO: 5059719 - DNA, 20 bp, Homo sapiens
tcaaggaaaataagtgaaat

SEQ ID NO: 5059720 - DNA, 14 bp, Homo sapiens
tcaaggaaacgttt

SEQ ID NO: 5059721 - DNA, 20 bp, Homo sapiens
tcaaggaaaggctcatttaa

SEQ ID NO: 5059722 - DNA, 16 bp, Homo sapiens
tcaaggaacagccaca

SEQ ID NO: 5059723 - DNA, 20 bp, Homo sapiens
tcaaggaacttgaaaaatac

SEQ ID NO: 5059724 - DNA, 22 bp, Homo sapiens
tcaaggaacttgaaaaatactt

SEQ ID NO: 5059725 - DNA, 17 bp, Homo sapiens
tcaaggaagaataattt

SEQ ID NO: 5059726 - DNA, 16 bp, Homo sapiens
tcaaggaagagccagc

SEQ ID NO: 5059727 - DNA, 14 bp, Homo sapiens
tcaaggaaggaaaa

SEQ ID NO: 5059728 - DNA, 18 bp, Homo sapiens
tcaaggaaggttcatgta

SEQ ID NO: 5059729 - DNA, 14 bp, Homo sapiens
tcaaggaagtcttc

SEQ ID NO: 5059730 - DNA, 22 bp, Homo sapiens
tcaaggaagtcttcaaatttga

SEQ ID NO: 5059731 - DNA, 23 bp, Homo sapiens
tcaaggaagtgataacactggag

SEQ ID NO: 5059732 - DNA, 16 bp, Homo sapiens
tcaaggaatcctgagt

SEQ ID NO: 5059733 - DNA, 14 bp, Homo sapiens
tcaaggaatcggct

SEQ ID NO: 5059734 - DNA, 21 bp, Homo sapiens
tcaaggacacgggcctgtcca

SEQ ID NO: 5059735 - DNA, 15 bp, Homo sapiens
tcaaggacaggagcc

SEQ ID NO: 5059736 - DNA, 17 bp, Homo sapiens
tcaaggacaggagcctg

SEQ ID NO: 5059737 - DNA, 16 bp, Homo sapiens
tcaaggacagggctga

SEQ ID NO: 5059738 - DNA, 22 bp, Homo sapiens
tcaaggaccaacaagggcagtg

SEQ ID NO: 5059739 - DNA, 23 bp, Homo sapiens
tcaaggaccaacaagggcagtgg

SEQ ID NO: 5059740 - DNA, 16 bp, Homo sapiens
tcaaggaccaagagca

SEQ ID NO: 5059741 - DNA, 23 bp, Homo sapiens
tcaaggaccaagagcaattgcag

SEQ ID NO: 5059742 - DNA, 17 bp, Homo sapiens
tcaaggaccacatgtgt

SEQ ID NO: 5059743 - DNA, 22 bp, Homo sapiens
tcaaggactagaacctatcttt

SEQ ID NO: 5059744 - DNA, 20 bp, Homo sapiens
tcaaggactggtaaaataca

SEQ ID NO: 5059745 - DNA, 22 bp, Homo sapiens
tcaaggactgtttcagtgtgag

SEQ ID NO: 5059746 - DNA, 20 bp, Homo sapiens
tcaaggactttctgaagcct

SEQ ID NO: 5059747 - DNA, 16 bp, Homo sapiens
tcaaggagaatatgat

SEQ ID NO: 5059748 - DNA, 14 bp, Homo sapiens
tcaaggagaggagg

SEQ ID NO: 5059749 - DNA, 13 bp, Homo sapiens
tcaaggagaggca

SEQ ID NO: 5059750 - DNA, 18 bp, Homo sapiens
tcaaggagatataaaatc

SEQ ID NO: 5059751 - DNA, 13 bp, Homo sapiens
tcaaggagatgag

SEQ ID NO: 5059752 - DNA, 18 bp, Homo sapiens
tcaaggagatgagcgtcc

SEQ ID NO: 5059753 - DNA, 15 bp, Homo sapiens
tcaaggagcccagaa

SEQ ID NO: 5059754 - DNA, 19 bp, Homo sapiens
tcaaggagtcttctaatgt

SEQ ID NO: 5059755 - DNA, 13 bp, Homo sapiens
tcaaggataaata

SEQ ID NO: 5059756 - DNA, 19 bp, Homo sapiens
tcaaggatatactgcagct

SEQ ID NO: 5059757 - DNA, 13 bp, Homo sapiens
tcaaggatcctga

SEQ ID NO: 5059758 - DNA, 15 bp, Homo sapiens
tcaaggatcctgagc

SEQ ID NO: 5059759 - DNA, 17 bp, Homo sapiens
tcaaggatcctgagcca

SEQ ID NO: 5059760 - DNA, 12 bp, Homo sapiens
tcaaggatgacg

SEQ ID NO: 5059761 - DNA, 18 bp, Homo sapiens
tcaaggatgtttttcttt

SEQ ID NO: 5059762 - DNA, 20 bp, Homo sapiens
tcaaggattttcatgttgat

SEQ ID NO: 5059763 - DNA, 14 bp, Homo sapiens
tcaaggcaaaagga

SEQ ID NO: 5059764 - DNA, 20 bp, Homo sapiens
tcaaggcactctagattcca

SEQ ID NO: 5059765 - DNA, 16 bp, Homo sapiens
tcaaggcactgcctga

SEQ ID NO: 5059766 - DNA, 19 bp, Homo sapiens
tcaaggcagttgcttgtgt

SEQ ID NO: 5059767 - DNA, 14 bp, Homo sapiens
tcaaggcattattt

SEQ ID NO: 5059768 - DNA, 10 bp, Homo sapiens
tcaaggccaa

SEQ ID NO: 5059769 - DNA, 18 bp, Homo sapiens
tcaaggccacaaaaacaa

SEQ ID NO: 5059770 - DNA, 20 bp, Homo sapiens
tcaaggccacctctgcctct

SEQ ID NO: 5059771 - DNA, 20 bp, Homo sapiens
tcaaggccaccttggaggag

SEQ ID NO: 5059772 - DNA, 14 bp, Homo sapiens
tcaaggccctcgga

SEQ ID NO: 5059773 - DNA, 16 bp, Homo sapiens
tcaaggccctcggagc

SEQ ID NO: 5059774 - DNA, 22 bp, Homo sapiens
tcaaggccctcggagctggctg

SEQ ID NO: 5059775 - DNA, 23 bp, Homo sapiens
tcaaggccctcggagctggctgt

SEQ ID NO: 5059776 - DNA, 19 bp, Homo sapiens
tcaaggcccttacaccctt

SEQ ID NO: 5059777 - DNA, 18 bp, Homo sapiens
tcaaggccgagggccagg

SEQ ID NO: 5059778 - DNA, 14 bp, Homo sapiens
tcaaggcctcccac

SEQ ID NO: 5059779 - DNA, 15 bp, Homo sapiens
tcaaggcctgtccct

SEQ ID NO: 5059780 - DNA, 10 bp, Homo sapiens
tcaaggcctt

SEQ ID NO: 5059781 - DNA, 12 bp, Homo sapiens
tcaaggccttca

SEQ ID NO: 5059782 - DNA, 16 bp, Homo sapiens
tcaaggcggtgcttga

SEQ ID NO: 5059783 - DNA, 18 bp, Homo sapiens
tcaaggcgtgaggatggg

SEQ ID NO: 5059784 - DNA, 11 bp, Homo sapiens
tcaaggctcag

SEQ ID NO: 5059785 - DNA, 17 bp, Homo sapiens
tcaaggctcttcttcct

SEQ ID NO: 5059786 - DNA, 17 bp, Homo sapiens
tcaaggctgcctggaga

SEQ ID NO: 5059787 - DNA, 18 bp, Homo sapiens
tcaaggctgcttagaatc

SEQ ID NO: 5059788 - DNA, 13 bp, Homo sapiens
tcaaggctggggc

SEQ ID NO: 5059789 - DNA, 15 bp, Homo sapiens
tcaaggctggggcat

SEQ ID NO: 5059790 - DNA, 21 bp, Homo sapiens
tctggcctgaggtcaatggtg

SEQ ID NO: 5059791 - DNA, 12 bp, Homo sapiens
tctggcctgcca

SEQ ID NO: 5059792 - DNA, 14 bp, Homo sapiens
tctggcctggcctg

SEQ ID NO: 5059793 - DNA, 12 bp, Homo sapiens
tctggcctggga

SEQ ID NO: 5059794 - DNA, 11 bp, Homo sapiens
tctggcctgtt

SEQ ID NO: 5059795 - DNA, 17 bp, Homo sapiens
tctggccttcggcctcc

SEQ ID NO: 5059796 - DNA, 18 bp, Homo sapiens
tctggccttcggcctcca

SEQ ID NO: 5059797 - DNA, 23 bp, Homo sapiens
tctggccttcggcctccatcctg

SEQ ID NO: 5059798 - DNA, 12 bp, Homo sapiens
tctggccttgac

SEQ ID NO: 5059799 - DNA, 23 bp, Homo sapiens
tctggccttgccccaggccctgc

SEQ ID NO: 5059800 - DNA, 19 bp, Homo sapiens
tctggccttggttcctcca

SEQ ID NO: 5059801 - DNA, 14 bp, Homo sapiens
tctggcgagccctt

SEQ ID NO: 5059802 - DNA, 15 bp, Homo sapiens
tctggcgcaagagaa

SEQ ID NO: 5059803 - DNA, 20 bp, Homo sapiens
tctggcgccaggggcaggca

SEQ ID NO: 5059804 - DNA, 18 bp, Homo sapiens
tctggcggaggtctctgg

SEQ ID NO: 5059805 - DNA, 20 bp, Homo sapiens
tctggcggaggtctctggga

SEQ ID NO: 5059806 - DNA, 21 bp, Homo sapiens
tctggcggaggtctctgggag

SEQ ID NO: 5059807 - DNA, 19 bp, Homo sapiens
tctggcggcttcctgtcca

SEQ ID NO: 5059808 - DNA, 21 bp, Homo sapiens
tctggcggcttcctgtccact

SEQ ID NO: 5059809 - DNA, 18 bp, Homo sapiens
tctggctagagggcccaa

SEQ ID NO: 5059810 - DNA, 23 bp, Homo sapiens
tctggctcagcctgtctcgggct

SEQ ID NO: 5059811 - DNA, 19 bp, Homo sapiens
tctggctcagctgtggtcc

SEQ ID NO: 5059812 - DNA, 22 bp, Homo sapiens
tctggctcagctgtggtcccac

SEQ ID NO: 5059813 - DNA, 23 bp, Homo sapiens
tctggctcagggtcaaagacaga

SEQ ID NO: 5059814 - DNA, 10 bp, Homo sapiens
tctggctcca

SEQ ID NO: 5059815 - DNA, 13 bp, Homo sapiens
tctggctccagaa

SEQ ID NO: 5059816 - DNA, 15 bp, Homo sapiens
tctggctccagagga

SEQ ID NO: 5059817 - DNA, 15 bp, Homo sapiens
tctggctccagctgg

SEQ ID NO: 5059818 - DNA, 17 bp, Homo sapiens
tctggctccaggcagaa

SEQ ID NO: 5059819 - DNA, 16 bp, Homo sapiens
tctggctccccaaggc

SEQ ID NO: 5059820 - DNA, 13 bp, Homo sapiens
tctggctccctgc

SEQ ID NO: 5059821 - DNA, 15 bp, Homo sapiens
tctggctccctggga

SEQ ID NO: 5059822 - DNA, 22 bp, Homo sapiens
tctggctcctaccactggacag

SEQ ID NO: 5059823 - DNA, 12 bp, Homo sapiens
tctggctcctgt

SEQ ID NO: 5059824 - DNA, 16 bp, Homo sapiens
tctggctctaattcac

SEQ ID NO: 5059825 - DNA, 20 bp, Homo sapiens
tctggctctaattcacagtg

SEQ ID NO: 5059826 - DNA, 15 bp, Homo sapiens
tctggctctgcctca

SEQ ID NO: 5059827 - DNA, 16 bp, Homo sapiens
tctggctcttccaggc

SEQ ID NO: 5059828 - DNA, 18 bp, Homo sapiens
tctggctcttccaggctg

SEQ ID NO: 5059829 - DNA, 14 bp, Homo sapiens
tctggctgaaaaag

SEQ ID NO: 5059830 - DNA, 14 bp, Homo sapiens
tctggctgaaccct

SEQ ID NO: 5059831 - DNA, 21 bp, Homo sapiens
tctggctgaaccctgtgctgg

SEQ ID NO: 5059832 - DNA, 22 bp, Homo sapiens
tctggctgactaaatttgggga

SEQ ID NO: 5059833 - DNA, 19 bp, Homo sapiens
tctggctgagcccctgggg

SEQ ID NO: 5059834 - DNA, 20 bp, Homo sapiens
tctggctgagcccctgggga

SEQ ID NO: 5059835 - DNA, 15 bp, Homo sapiens
tctggctgagccctg

SEQ ID NO: 5059836 - DNA, 14 bp, Homo sapiens
tctggctgagctga

SEQ ID NO: 5059837 - DNA, 17 bp, Homo sapiens
tctggctgcctggccca

SEQ ID NO: 5059838 - DNA, 18 bp, Homo sapiens
tctggctgcctggcccag

SEQ ID NO: 5059839 - DNA, 17 bp, Homo sapiens
tctggctggaatagtaa

SEQ ID NO: 5059840 - DNA, 12 bp, Homo sapiens
tctggctgggga

SEQ ID NO: 5059841 - DNA, 15 bp, Homo sapiens
tctggctggtcttca

SEQ ID NO: 5059842 - DNA, 12 bp, Homo sapiens
tctggctggtgt

SEQ ID NO: 5059843 - DNA, 22 bp, Homo sapiens
tctggctggtttggaatgcttc

SEQ ID NO: 5059844 - DNA, 16 bp, Homo sapiens
tctggctgtaaggctc

SEQ ID NO: 5059845 - DNA, 21 bp, Homo sapiens
tctggctgtaaggctctagat

SEQ ID NO: 5059846 - DNA, 22 bp, Homo sapiens
tctggctgtaaggctctagatc

SEQ ID NO: 5059847 - DNA, 20 bp, Homo sapiens
tctggctgtacgtctggtgt

SEQ ID NO: 5059848 - DNA, 18 bp, Homo sapiens
tctggctgtctagaatgt

SEQ ID NO: 5059849 - DNA, 19 bp, Homo sapiens
tctggctgtgatcttaaaa

SEQ ID NO: 5059850 - DNA, 16 bp, Homo sapiens
tctggctgtggcccct

SEQ ID NO: 5059851 - DNA, 18 bp, Homo sapiens
tctggctgtggcccctcc

SEQ ID NO: 5059852 - DNA, 13 bp, Homo sapiens
tctggctgtgtgg

SEQ ID NO: 5059853 - DNA, 21 bp, Homo sapiens
tctggcttagaaattttttca

SEQ ID NO: 5059854 - DNA, 15 bp, Homo sapiens
tctggcttagtgcca

SEQ ID NO: 5059855 - DNA, 16 bp, Homo sapiens
tctggcttagtgccac

SEQ ID NO: 5059856 - DNA, 21 bp, Homo sapiens
tctggcttatgctcagaagcc

SEQ ID NO: 5059857 - DNA, 17 bp, Homo sapiens
tctggcttattttaatg

SEQ ID NO: 5059858 - DNA, 20 bp, Homo sapiens
tctggcttcaaaaagccaca

SEQ ID NO: 5059859 - DNA, 19 bp, Homo sapiens
tctggcttccctaaactgc

SEQ ID NO: 5059860 - DNA, 21 bp, Homo sapiens
tctggcttccctaaactgcag

SEQ ID NO: 5059861 - DNA, 22 bp, Homo sapiens
tctggcttccctaaactgcagc

SEQ ID NO: 5059862 - DNA, 16 bp, Homo sapiens
tctggcttccctgccc

SEQ ID NO: 5059863 - DNA, 16 bp, Homo sapiens
tctggcttccctggaa

SEQ ID NO: 5059864 - DNA, 18 bp, Homo sapiens
tctggcttccctggaagc

SEQ ID NO: 5059865 - DNA, 15 bp, Homo sapiens
tctggcttcctgctg

SEQ ID NO: 5059866 - DNA, 19 bp, Homo sapiens
tctggcttctgaagagcct

SEQ ID NO: 5059867 - DNA, 15 bp, Homo sapiens
tctggcttctggcca

SEQ ID NO: 5059868 - DNA, 20 bp, Homo sapiens
tctggcttctggccaggaag

SEQ ID NO: 5059869 - DNA, 18 bp, Homo sapiens
tctggcttgccccaggac

SEQ ID NO: 5059870 - DNA, 22 bp, Homo sapiens
tctggcttgccccaggactctg

SEQ ID NO: 5059871 - DNA, 23 bp, Homo sapiens
tctggcttgccccaggactctgg

SEQ ID NO: 5059872 - DNA, 13 bp, Homo sapiens
tctggcttggcct

SEQ ID NO: 5059873 - DNA, 21 bp, Homo sapiens
tctggctttacctttttgtat

SEQ ID NO: 5059874 - DNA, 22 bp, Homo sapiens
tctggctttacctttttgtatg

SEQ ID NO: 5059875 - DNA, 13 bp, Homo sapiens
tctggctttccca

SEQ ID NO: 5059876 - DNA, 15 bp, Homo sapiens
tctggctttcccagg

SEQ ID NO: 5059877 - DNA, 23 bp, Homo sapiens
tctggctttctccgactgctagg

SEQ ID NO: 5059878 - DNA, 15 bp, Homo sapiens
tctggctttggcact

SEQ ID NO: 5059879 - DNA, 18 bp, Homo sapiens
tctggctttggcactctc

SEQ ID NO: 5059880 - DNA, 20 bp, Homo sapiens
tctggctttggcactctctg

SEQ ID NO: 5059881 - DNA, 15 bp, Homo sapiens
tgcctttctgcagtt

SEQ ID NO: 5059882 - DNA, 22 bp, Homo sapiens
tgcctttctgcagtttttcagg

SEQ ID NO: 5059883 - DNA, 15 bp, Homo sapiens
tgcctttctgggagc

SEQ ID NO: 5059884 - DNA, 17 bp, Homo sapiens
tgcctttctgggagcag

SEQ ID NO: 5059885 - DNA, 19 bp, Homo sapiens
tgcctttctgggagcagaa

SEQ ID NO: 5059886 - DNA, 21 bp, Homo sapiens
tgcctttctgggagcagaaac

SEQ ID NO: 5059887 - DNA, 18 bp, Homo sapiens
tgcctttcttatttgcaa

SEQ ID NO: 5059888 - DNA, 19 bp, Homo sapiens
tgcctttcttatttgcaat

SEQ ID NO: 5059889 - DNA, 16 bp, Homo sapiens
tgcctttcttctgccc

SEQ ID NO: 5059890 - DNA, 12 bp, Homo sapiens
tgcctttctttg

SEQ ID NO: 5059891 - DNA, 13 bp, Homo sapiens
tgcctttctttgc

SEQ ID NO: 5059892 - DNA, 22 bp, Homo sapiens
tgcctttctttgcctctgcagt

SEQ ID NO: 5059893 - DNA, 22 bp, Homo sapiens
tgcctttgacccaggaaccgat

SEQ ID NO: 5059894 - DNA, 12 bp, Homo sapiens
tgcctttgagac

SEQ ID NO: 5059895 - DNA, 13 bp, Homo sapiens
tgcctttgagaca

SEQ ID NO: 5059896 - DNA, 18 bp, Homo sapiens
tgcctttgagacagtttc

SEQ ID NO: 5059897 - DNA, 20 bp, Homo sapiens
tgcctttgagacagtttctt

SEQ ID NO: 5059898 - DNA, 19 bp, Homo sapiens
tgcctttgagcttctcctc

SEQ ID NO: 5059899 - DNA, 21 bp, Homo sapiens
tgcctttgagtttcctcaggc

SEQ ID NO: 5059900 - DNA, 16 bp, Homo sapiens
tgcctttgataattct

SEQ ID NO: 5059901 - DNA, 16 bp, Homo sapiens
tgcctttgcaaatcag

SEQ ID NO: 5059902 - DNA, 15 bp, Homo sapiens
tgcctttgcagaaac

SEQ ID NO: 5059903 - DNA, 17 bp, Homo sapiens
tgcctttgccaggtgac

SEQ ID NO: 5059904 - DNA, 16 bp, Homo sapiens
tgcctttgcctccaga

SEQ ID NO: 5059905 - DNA, 13 bp, Homo sapiens
tgcctttgcctct

SEQ ID NO: 5059906 - DNA, 17 bp, Homo sapiens
tgcctttgctctggtct

SEQ ID NO: 5059907 - DNA, 17 bp, Homo sapiens
tgcctttgctcttataa

SEQ ID NO: 5059908 - DNA, 18 bp, Homo sapiens
tgcctttgctcttataaa

SEQ ID NO: 5059909 - DNA, 12 bp, Homo sapiens
tgcctttgctgc

SEQ ID NO: 5059910 - DNA, 15 bp, Homo sapiens
tgcctttgctgcctt

SEQ ID NO: 5059911 - DNA, 17 bp, Homo sapiens
tgcctttgctgccttct

SEQ ID NO: 5059912 - DNA, 17 bp, Homo sapiens
tgcctttggcagagttc

SEQ ID NO: 5059913 - DNA, 13 bp, Homo sapiens
tgcctttgggcac

SEQ ID NO: 5059914 - DNA, 17 bp, Homo sapiens
tgcctttgggcacggcc

SEQ ID NO: 5059915 - DNA, 23 bp, Homo sapiens
tgcctttgggtcgacatagtatg

SEQ ID NO: 5059916 - DNA, 9 bp, Homo sapiens
tgcctttgt

SEQ ID NO: 5059917 - DNA, 11 bp, Homo sapiens
tgcctttgtaa

SEQ ID NO: 5059918 - DNA, 15 bp, Homo sapiens
tgcctttgtaagtta

SEQ ID NO: 5059919 - DNA, 20 bp, Homo sapiens
tgcctttgtagcctatgtct

SEQ ID NO: 5059920 - DNA, 16 bp, Homo sapiens
tgcctttgtccccaca

SEQ ID NO: 5059921 - DNA, 18 bp, Homo sapiens
tgcctttgtccccacaca

SEQ ID NO: 5059922 - DNA, 22 bp, Homo sapiens
tgcctttgtttcggtgccctgt

SEQ ID NO: 5059923 - DNA, 17 bp, Homo sapiens
tgcctttgtttctaaag

SEQ ID NO: 5059924 - DNA, 16 bp, Homo sapiens
tgccttttaaaagaaa

SEQ ID NO: 5059925 - DNA, 15 bp, Homo sapiens
tgccttttaagtttg

SEQ ID NO: 5059926 - DNA, 20 bp, Homo sapiens
tgccttttaagtttgaaact

SEQ ID NO: 5059927 - DNA, 16 bp, Homo sapiens
tgccttttagttcctg

SEQ ID NO: 5059928 - DNA, 14 bp, Homo sapiens
tgccttttatgtaa

SEQ ID NO: 5059929 - DNA, 15 bp, Homo sapiens
tgccttttatgtaaa

SEQ ID NO: 5059930 - DNA, 20 bp, Homo sapiens
tgccttttatgtaaattttt

SEQ ID NO: 5059931 - DNA, 23 bp, Homo sapiens
tgccttttatgtaaattttttac

SEQ ID NO: 5059932 - DNA, 13 bp, Homo sapiens
tgccttttcaaat

SEQ ID NO: 5059933 - DNA, 15 bp, Homo sapiens
tgccttttctggagt

SEQ ID NO: 5059934 - DNA, 13 bp, Homo sapiens
tgccttttctgtg

SEQ ID NO: 5059935 - DNA, 22 bp, Homo sapiens
tgccttttcttcccctcctgta

SEQ ID NO: 5059936 - DNA, 22 bp, Homo sapiens
tgccttttgaatacatttgtat

SEQ ID NO: 5059937 - DNA, 14 bp, Homo sapiens
tgccttttgcaccc

SEQ ID NO: 5059938 - DNA, 15 bp, Homo sapiens
tgccttttgcacccc

SEQ ID NO: 5059939 - DNA, 17 bp, Homo sapiens
tgccttttgcacccctc

SEQ ID NO: 5059940 - DNA, 20 bp, Homo sapiens
tgccttttgcacccctccca

SEQ ID NO: 5059941 - DNA, 22 bp, Homo sapiens
tgccttttgcacccctcccatt

SEQ ID NO: 5059942 - DNA, 16 bp, Homo sapiens
tgccttttgcagaaga

SEQ ID NO: 5059943 - DNA, 15 bp, Homo sapiens
tgccttttggtttca

SEQ ID NO: 5059944 - DNA, 23 bp, Homo sapiens
tgccttttggtttcaccttccct

SEQ ID NO: 5059945 - DNA, 22 bp, Homo sapiens
tgccttttgtaggctgttccct

SEQ ID NO: 5059946 - DNA, 17 bp, Homo sapiens
tgccttttgtgtgatgc

SEQ ID NO: 5059947 - DNA, 14 bp, Homo sapiens
tgcctttttcatta

SEQ ID NO: 5059948 - DNA, 15 bp, Homo sapiens
tgcctttttcattat

SEQ ID NO: 5059949 - DNA, 17 bp, Homo sapiens
tgcctttttcattattt

SEQ ID NO: 5059950 - DNA, 13 bp, Homo sapiens
tgcctttttccta

SEQ ID NO: 5059951 - DNA, 15 bp, Homo sapiens
tgcctttttcctaga

SEQ ID NO: 5059952 - DNA, 13 bp, Homo sapiens
tgcctttttcctt

SEQ ID NO: 5059953 - DNA, 18 bp, Homo sapiens
tgccttttttagcttcat

SEQ ID NO: 5059954 - DNA, 20 bp, Homo sapiens
tgccttttttcacggaagtt

SEQ ID NO: 5059955 - DNA, 22 bp, Homo sapiens
tgccttttttctgtataaatgt

SEQ ID NO: 5059956 - DNA, 19 bp, Homo sapiens
tgcgaaaacttgaatctgt

SEQ ID NO: 5059957 - DNA, 13 bp, Homo sapiens
tgcgaaagaattt

SEQ ID NO: 5059958 - DNA, 18 bp, Homo sapiens
tgcgaaatgttctcatga

SEQ ID NO: 5059959 - DNA, 23 bp, Homo sapiens
tgcgaaatgttctcatgaactac

SEQ ID NO: 5059960 - DNA, 16 bp, Homo sapiens
tgcgaacacagtgaca

SEQ ID NO: 5059961 - DNA, 13 bp, Homo sapiens
tgcgaactgtgca

SEQ ID NO: 5059962 - DNA, 19 bp, Homo sapiens
tgcgaatctagaggagggg

SEQ ID NO: 5059963 - DNA, 21 bp, Homo sapiens
tgcgaatggactttggaagca

SEQ ID NO: 5059964 - DNA, 13 bp, Homo sapiens
tgcgaatgtgcag

SEQ ID NO: 5059965 - DNA, 17 bp, Homo sapiens
tgcgacaccaccaacag

SEQ ID NO: 5059966 - DNA, 11 bp, Homo sapiens
tgcgaccacca

SEQ ID NO: 5059967 - DNA, 21 bp, Homo sapiens
tgcgaccaccaacacacagga

SEQ ID NO: 5059968 - DNA, 14 bp, Homo sapiens
tgcgtgtgtcaggg

SEQ ID NO: 5059969 - DNA, 16 bp, Homo sapiens
tgcgtgtgtcagggat

SEQ ID NO: 5059970 - DNA, 18 bp, Homo sapiens
tgcgtgtgtcagggatga

SEQ ID NO: 5059971 - DNA, 17 bp, Homo sapiens
tgcgtgtgtccatgtgt

SEQ ID NO: 5059972 - DNA, 12 bp, Homo sapiens
tgcgtgtgtgca

SEQ ID NO: 5059973 - DNA, 19 bp, Homo sapiens
tgcgtgtgttctctccgga

SEQ ID NO: 5059974 - DNA, 17 bp, Homo sapiens
tgcgttaaataagcaaa

SEQ ID NO: 5059975 - DNA, 13 bp, Homo sapiens
tgcgttactaatt

SEQ ID NO: 5059976 - DNA, 19 bp, Homo sapiens
tgcgttagaatgaggagga

SEQ ID NO: 5059977 - DNA, 15 bp, Homo sapiens
tgcgttaggcagggc

SEQ ID NO: 5059978 - DNA, 14 bp, Homo sapiens
tgcgttattttctt

SEQ ID NO: 5059979 - DNA, 22 bp, Homo sapiens
tgcgttattttctttttccttt

SEQ ID NO: 5059980 - DNA, 23 bp, Homo sapiens
tgcgttcagcccctgatctctga

SEQ ID NO: 5059981 - DNA, 22 bp, Homo sapiens
tgcgttcctaaactctgaaatc

SEQ ID NO: 5059982 - DNA, 23 bp, Homo sapiens
tgcgttctcccagcactgcctcc

SEQ ID NO: 5059983 - DNA, 14 bp, Homo sapiens
tgcgttggagccac

SEQ ID NO: 5059984 - DNA, 15 bp, Homo sapiens
tgcgttggagccact

SEQ ID NO: 5059985 - DNA, 16 bp, Homo sapiens
tgcgttggagccactc

SEQ ID NO: 5059986 - DNA, 23 bp, Homo sapiens
tgcgttggagccactcctgtccc

SEQ ID NO: 5059987 - DNA, 23 bp, Homo sapiens
tgcgttggcttctccctggggac

SEQ ID NO: 5059988 - DNA, 13 bp, Homo sapiens
tgcgttggtctct

SEQ ID NO: 5059989 - DNA, 17 bp, Homo sapiens
tgcgttggtctctgcat

SEQ ID NO: 5059990 - DNA, 14 bp, Homo sapiens
tgcgtttgcctcct

SEQ ID NO: 5059991 - DNA, 16 bp, Homo sapiens
tgcgtttgcctcctgg

SEQ ID NO: 5059992 - DNA, 20 bp, Homo sapiens
tgcgtttggaggcccctggg

SEQ ID NO: 5059993 - DNA, 13 bp, Homo sapiens
tgcgttttggaag

SEQ ID NO: 5059994 - DNA, 18 bp, Homo sapiens
tgcgtttttccttgtagc

SEQ ID NO: 5059995 - DNA, 19 bp, Homo sapiens
tgctaaaaaataaataaaa

SEQ ID NO: 5059996 - DNA, 14 bp, Homo sapiens
tgctaaaacttcac

SEQ ID NO: 5059997 - DNA, 12 bp, Homo sapiens
tgctaaaagaag

SEQ ID NO: 5059998 - DNA, 16 bp, Homo sapiens
tgctaaaagtgcattt

SEQ ID NO: 5059999 - DNA, 21 bp, Homo sapiens
tgctaaaatagaatatagcat

SEQ ID NO: 5060000 - DNA, 22 bp, Homo sapiens
tgctaaaatattttagatgtta

SEQ ID NO: 5060001 - DNA, 14 bp, Homo sapiens
tgctaaaattcaga

SEQ ID NO: 5060002 - DNA, 14 bp, Homo sapiens
tgctaaaattctat

SEQ ID NO: 5060003 - DNA, 12 bp, Homo sapiens
tgctaaacactg

SEQ ID NO: 5060004 - DNA, 22 bp, Homo sapiens
tgctaaacagatgtcttcttgc

SEQ ID NO: 5060005 - DNA, 13 bp, Homo sapiens
tgctaaaccttag

SEQ ID NO: 5060006 - DNA, 15 bp, Homo sapiens
tgctaaacgtgtatg

SEQ ID NO: 5060007 - DNA, 16 bp, Homo sapiens
tgctaaacgtgtatgt

SEQ ID NO: 5060008 - DNA, 19 bp, Homo sapiens
tgctaaacgtgtatgtttt

SEQ ID NO: 5060009 - DNA, 22 bp, Homo sapiens
tgctaaacgtgtatgtttttca

SEQ ID NO: 5060010 - DNA, 13 bp, Homo sapiens
tgctaaactactg

SEQ ID NO: 5060011 - DNA, 18 bp, Homo sapiens
tgctaaactgtgaaaaat

SEQ ID NO: 5060012 - DNA, 23 bp, Homo sapiens
tgctaaactgtgaaaaatcagat

SEQ ID NO: 5060013 - DNA, 11 bp, Homo sapiens
tgctaaacttg

SEQ ID NO: 5060014 - DNA, 15 bp, Homo sapiens
tgctaaagattgtta

SEQ ID NO: 5060015 - DNA, 14 bp, Homo sapiens
tgctaaagccagga

SEQ ID NO: 5060016 - DNA, 17 bp, Homo sapiens
tgctaaagccttcctat

SEQ ID NO: 5060017 - DNA, 18 bp, Homo sapiens
tgctaaagggagaaatgc

SEQ ID NO: 5060018 - DNA, 17 bp, Homo sapiens
tgctaaataaaatttgt

SEQ ID NO: 5060019 - DNA, 12 bp, Homo sapiens
tgctaaataact

SEQ ID NO: 5060020 - DNA, 13 bp, Homo sapiens
tgctaaataacta

SEQ ID NO: 5060021 - DNA, 19 bp, Homo sapiens
tgctaaatacaacactgat

SEQ ID NO: 5060022 - DNA, 13 bp, Homo sapiens
tgctaaatgaaga

SEQ ID NO: 5060023 - DNA, 19 bp, Homo sapiens
tgctaaatgcaaacactgt

SEQ ID NO: 5060024 - DNA, 15 bp, Homo sapiens
tgctaaatgtaacag

SEQ ID NO: 5060025 - DNA, 14 bp, Homo sapiens
tgctaaatgtgagt

SEQ ID NO: 5060026 - DNA, 15 bp, Homo sapiens
tgctaaatgtgagta

SEQ ID NO: 5060027 - DNA, 14 bp, Homo sapiens
tgctaaattattat

SEQ ID NO: 5060028 - DNA, 20 bp, Homo sapiens
tgctaaattctatgttaaat

SEQ ID NO: 5060029 - DNA, 15 bp, Homo sapiens
tgctaaattgagagg

SEQ ID NO: 5060030 - DNA, 15 bp, Homo sapiens
tgctaaattgatgtt

SEQ ID NO: 5060031 - DNA, 21 bp, Homo sapiens
tgctaaattgatgttgatgca

SEQ ID NO: 5060032 - DNA, 23 bp, Homo sapiens
tgctaaattgattgaattaaatc

SEQ ID NO: 5060033 - DNA, 14 bp, Homo sapiens
tgctaaatttacgt

SEQ ID NO: 5060034 - DNA, 12 bp, Homo sapiens
tgctaaatttca

SEQ ID NO: 5060035 - DNA, 14 bp, Homo sapiens
tgctaaatttgtgt

SEQ ID NO: 5060036 - DNA, 15 bp, Homo sapiens
tgctaaattttcagt

SEQ ID NO: 5060037 - DNA, 13 bp, Homo sapiens
tgctaacaaactg

SEQ ID NO: 5060038 - DNA, 22 bp, Homo sapiens
tgctaacaaagacaaaagtctg

SEQ ID NO: 5060039 - DNA, 22 bp, Homo sapiens
tgctaacagcaacacaaagctt

SEQ ID NO: 5060040 - DNA, 16 bp, Homo sapiens
tgctaacatctaaaaa

SEQ ID NO: 5060041 - DNA, 19 bp, Homo sapiens
tgctaacatgaagaccttt

SEQ ID NO: 5060042 - DNA, 23 bp, Homo sapiens
tgctaaccacgtctgtcttcaca

SEQ ID NO: 5060043 - DNA, 23 bp, Homo sapiens
tgctaacctcaatttatgttaac

SEQ ID NO: 5060044 - DNA, 16 bp, Homo sapiens
tgctaacctgtggaaa

SEQ ID NO: 5060045 - DNA, 20 bp, Homo sapiens
tgctaactagcttggaaact

SEQ ID NO: 5060046 - DNA, 22 bp, Homo sapiens
tgctaactagcttggaaactgg

SEQ ID NO: 5060047 - DNA, 16 bp, Homo sapiens
tgctaactgggttaaa

SEQ ID NO: 5060048 - DNA, 17 bp, Homo sapiens
tgctaactgggttaaat

SEQ ID NO: 5060049 - DNA, 15 bp, Homo sapiens
tgctaactggttaaa

SEQ ID NO: 5060050 - DNA, 22 bp, Homo sapiens
tgctaactggttaaacattaat

SEQ ID NO: 5060051 - DNA, 14 bp, Homo sapiens
tgctaagaaaccag

SEQ ID NO: 5060052 - DNA, 15 bp, Homo sapiens
tgctaagaaagcaaa

SEQ ID NO: 5060053 - DNA, 23 bp, Homo sapiens
tgctaagaaagcaaataagctct

SEQ ID NO: 5060054 - DNA, 19 bp, Homo sapiens
tgctaagaatgcattattg

SEQ ID NO: 5060055 - DNA, 16 bp, Homo sapiens
tgctaagaatttttta

SEQ ID NO: 5060056 - DNA, 16 bp, Homo sapiens
tgctaagagaagtaga

SEQ ID NO: 5060057 - DNA, 19 bp, Homo sapiens
tgctaagagcctctggaag

SEQ ID NO: 5060058 - DNA, 14 bp, Homo sapiens
tgctaagagggccc

SEQ ID NO: 5060059 - DNA, 13 bp, Homo sapiens
tgctaagagtttt

SEQ ID NO: 5060060 - DNA, 19 bp, Homo sapiens
tgctaagcattccaactat

SEQ ID NO: 5060061 - DNA, 18 bp, Homo sapiens
tgctaagccccagcaagc

SEQ ID NO: 5060062 - DNA, 20 bp, Homo sapiens
tgctaagccccagcaagcaa

SEQ ID NO: 5060063 - DNA, 23 bp, Homo sapiens
tgctaagctgatattatttcttc

SEQ ID NO: 5060064 - DNA, 17 bp, Homo sapiens
tgctaagctgccctgag

SEQ ID NO: 5060065 - DNA, 14 bp, Homo sapiens
tgctaaggaacaat

SEQ ID NO: 5060066 - DNA, 17 bp, Homo sapiens
tctgtaaccgcttctgg

SEQ ID NO: 5060067 - DNA, 23 bp, Homo sapiens
tctgtaactctttctgaggagct

SEQ ID NO: 5060068 - DNA, 16 bp, Homo sapiens
tctgtaactgcccagc

SEQ ID NO: 5060069 - DNA, 19 bp, Homo sapiens
tctgtaactgcccagcccc

SEQ ID NO: 5060070 - DNA, 23 bp, Homo sapiens
tctgtaacttacacctggaatgt

SEQ ID NO: 5060071 - DNA, 14 bp, Homo sapiens
tctgtaagaaacct

SEQ ID NO: 5060072 - DNA, 22 bp, Homo sapiens
tctgtaagagcttgctccagat

SEQ ID NO: 5060073 - DNA, 18 bp, Homo sapiens
tctgtaagcataagctta

SEQ ID NO: 5060074 - DNA, 16 bp, Homo sapiens
tctgtaatagttcagt

SEQ ID NO: 5060075 - DNA, 19 bp, Homo sapiens
tctgtaatatttacaatgt

SEQ ID NO: 5060076 - DNA, 17 bp, Homo sapiens
tctgtaatgtaaataaa

SEQ ID NO: 5060077 - DNA, 15 bp, Homo sapiens
tctgtaattacaact

SEQ ID NO: 5060078 - DNA, 19 bp, Homo sapiens
tctgtaattacaactaaat

SEQ ID NO: 5060079 - DNA, 14 bp, Homo sapiens
tctgtaattcattg

SEQ ID NO: 5060080 - DNA, 20 bp, Homo sapiens
tctgtaattcttctcctttg

SEQ ID NO: 5060081 - DNA, 23 bp, Homo sapiens
tctgtaattcttctcctttgtca

SEQ ID NO: 5060082 - DNA, 13 bp, Homo sapiens
tctgtaattgcaa

SEQ ID NO: 5060083 - DNA, 19 bp, Homo sapiens
tctgtaattgtaattccaa

SEQ ID NO: 5060084 - DNA, 13 bp, Homo sapiens
tctgtaattgtgt

SEQ ID NO: 5060085 - DNA, 14 bp, Homo sapiens
tctgtaatttcact

SEQ ID NO: 5060086 - DNA, 13 bp, Homo sapiens
tctgtaatttgaa

SEQ ID NO: 5060087 - DNA, 13 bp, Homo sapiens
tctgtaattttac

SEQ ID NO: 5060088 - DNA, 14 bp, Homo sapiens
tctgtaatttttca

SEQ ID NO: 5060089 - DNA, 15 bp, Homo sapiens
tctgtaatttttcag

SEQ ID NO: 5060090 - DNA, 12 bp, Homo sapiens
tctgtacaaagg

SEQ ID NO: 5060091 - DNA, 16 bp, Homo sapiens
tctgtacaaataatag

SEQ ID NO: 5060092 - DNA, 13 bp, Homo sapiens
tctgtacaatgaa

SEQ ID NO: 5060093 - DNA, 14 bp, Homo sapiens
tctgtacagagccc

SEQ ID NO: 5060094 - DNA, 23 bp, Homo sapiens
tctgtacagagcccacgccccca

SEQ ID NO: 5060095 - DNA, 22 bp, Homo sapiens
tctgtacagagccgtaaaaact

SEQ ID NO: 5060096 - DNA, 13 bp, Homo sapiens
tctgtacagcaag

SEQ ID NO: 5060097 - DNA, 21 bp, Homo sapiens
tctgtacagcaagatgtttct

SEQ ID NO: 5060098 - DNA, 15 bp, Homo sapiens
tctgtacagtaagac

SEQ ID NO: 5060099 - DNA, 15 bp, Homo sapiens
tctgtacatactggc

SEQ ID NO: 5060100 - DNA, 19 bp, Homo sapiens
tctgtacatactggcctct

SEQ ID NO: 5060101 - DNA, 15 bp, Homo sapiens
tctgtacatactgtt

SEQ ID NO: 5060102 - DNA, 18 bp, Homo sapiens
tctgtacatattactgtt

SEQ ID NO: 5060103 - DNA, 21 bp, Homo sapiens
tctgtacatgtggaaaactca

SEQ ID NO: 5060104 - DNA, 14 bp, Homo sapiens
tctgtacatttgca

SEQ ID NO: 5060105 - DNA, 14 bp, Homo sapiens
tctgtaccacacta

SEQ ID NO: 5060106 - DNA, 21 bp, Homo sapiens
tctgtaccgcccggcagcccc

SEQ ID NO: 5060107 - DNA, 12 bp, Homo sapiens
tctgtacctaaa

SEQ ID NO: 5060108 - DNA, 13 bp, Homo sapiens
tctgtacctcaaa

SEQ ID NO: 5060109 - DNA, 14 bp, Homo sapiens
tctgtacctcgggt

SEQ ID NO: 5060110 - DNA, 23 bp, Homo sapiens
tctgtacctgcccccactcagca

SEQ ID NO: 5060111 - DNA, 19 bp, Homo sapiens
tctgtacgaggcttctcta

SEQ ID NO: 5060112 - DNA, 21 bp, Homo sapiens
tctgtacgaggcttctctaac

SEQ ID NO: 5060113 - DNA, 18 bp, Homo sapiens
tctgtacgtctgacaggc

SEQ ID NO: 5060114 - DNA, 22 bp, Homo sapiens
tctgtactaaacagtaagatat

SEQ ID NO: 5060115 - DNA, 15 bp, Homo sapiens
tctgtactaaacatt

SEQ ID NO: 5060116 - DNA, 15 bp, Homo sapiens
tctgtactgattcaa

SEQ ID NO: 5060117 - DNA, 17 bp, Homo sapiens
tctgtactgattcaatt

SEQ ID NO: 5060118 - DNA, 22 bp, Homo sapiens
tctgtactggaggctctgttct

SEQ ID NO: 5060119 - DNA, 13 bp, Homo sapiens
tctgtactgtaat

SEQ ID NO: 5060120 - DNA, 16 bp, Homo sapiens
tctgtacttcagtatg

SEQ ID NO: 5060121 - DNA, 23 bp, Homo sapiens
tctgtacttcagttctcatcttg

SEQ ID NO: 5060122 - DNA, 14 bp, Homo sapiens
tctgtacttcctga

SEQ ID NO: 5060123 - DNA, 12 bp, Homo sapiens
tctgtacttggt

SEQ ID NO: 5060124 - DNA, 14 bp, Homo sapiens
tctgtactttgtgt

SEQ ID NO: 5060125 - DNA, 14 bp, Homo sapiens
tctgtacttttcat

SEQ ID NO: 5060126 - DNA, 20 bp, Homo sapiens
tctgtacttttcattctctt

SEQ ID NO: 5060127 - DNA, 18 bp, Homo sapiens
tctgtacttttttcaaat

SEQ ID NO: 5060128 - DNA, 20 bp, Homo sapiens
tctgtacttttttcaaatat

SEQ ID NO: 5060129 - DNA, 20 bp, Homo sapiens
tctgtagaaaagaaaacatt

SEQ ID NO: 5060130 - DNA, 23 bp, Homo sapiens
tctgtagaaaagaaaacatttaa

SEQ ID NO: 5060131 - DNA, 12 bp, Homo sapiens
tctgtagaaatg

SEQ ID NO: 5060132 - DNA, 15 bp, Homo sapiens
tctgtagacttctgg

SEQ ID NO: 5060133 - DNA, 19 bp, Homo sapiens
tctgtagacttctggttgt

SEQ ID NO: 5060134 - DNA, 13 bp, Homo sapiens
tctgtagagaatg

SEQ ID NO: 5060135 - DNA, 22 bp, Homo sapiens
tctgtagagagcagcattccca

SEQ ID NO: 5060136 - DNA, 18 bp, Homo sapiens
tctgtagagccttctgat

SEQ ID NO: 5060137 - DNA, 16 bp, Homo sapiens
tctgtagagggccctg

SEQ ID NO: 5060138 - DNA, 19 bp, Homo sapiens
tctgtagagggccctggtg

SEQ ID NO: 5060139 - DNA, 16 bp, Homo sapiens
tctgtagatgttgtct

SEQ ID NO: 5060140 - DNA, 14 bp, Homo sapiens
tctgtagccacctc

SEQ ID NO: 5060141 - DNA, 16 bp, Homo sapiens
tctgtagccacctcct

SEQ ID NO: 5060142 - DNA, 15 bp, Homo sapiens
tctgtagcctccttt

SEQ ID NO: 5060143 - DNA, 19 bp, Homo sapiens
tctgtagcctcctttgtaa

SEQ ID NO: 5060144 - DNA, 14 bp, Homo sapiens
tctgtagcctgaag

SEQ ID NO: 5060145 - DNA, 19 bp, Homo sapiens
tctgtagcctgaagagttt

SEQ ID NO: 5060146 - DNA, 13 bp, Homo sapiens
tctgtagcctggt

SEQ ID NO: 5060147 - DNA, 14 bp, Homo sapiens
tggatatgtgtaaa

SEQ ID NO: 5060148 - DNA, 19 bp, Homo sapiens
tggatatgttgtattaact

SEQ ID NO: 5060149 - DNA, 20 bp, Homo sapiens
tggatatgttgtattaactg

SEQ ID NO: 5060150 - DNA, 15 bp, Homo sapiens
tggatattagtcata

SEQ ID NO: 5060151 - DNA, 14 bp, Homo sapiens
tggatattgttacg

SEQ ID NO: 5060152 - DNA, 18 bp, Homo sapiens
tggatatttatttaaaca

SEQ ID NO: 5060153 - DNA, 22 bp, Homo sapiens
tggatatttatttaaacaaatg

SEQ ID NO: 5060154 - DNA, 22 bp, Homo sapiens
tggatatttcaatcttttaaat

SEQ ID NO: 5060155 - DNA, 18 bp, Homo sapiens
tggatatttgcacttatg

SEQ ID NO: 5060156 - DNA, 13 bp, Homo sapiens
tggatatttgtat

SEQ ID NO: 5060157 - DNA, 13 bp, Homo sapiens
tggatattttcaa

SEQ ID NO: 5060158 - DNA, 23 bp, Homo sapiens
tggatcaaaatctgtagagcagg

SEQ ID NO: 5060159 - DNA, 17 bp, Homo sapiens
tggatcaagcagaaaac

SEQ ID NO: 5060160 - DNA, 23 bp, Homo sapiens
tggatcaagcagaaaacaagaga

SEQ ID NO: 5060161 - DNA, 14 bp, Homo sapiens
tggatcaagtatta

SEQ ID NO: 5060162 - DNA, 19 bp, Homo sapiens
tggatcaagttcagccacc

SEQ ID NO: 5060163 - DNA, 16 bp, Homo sapiens
tggatcacaagatgga

SEQ ID NO: 5060164 - DNA, 14 bp, Homo sapiens
tggatcacagctgc

SEQ ID NO: 5060165 - DNA, 19 bp, Homo sapiens
tggatcacctgaggtcagg

SEQ ID NO: 5060166 - DNA, 12 bp, Homo sapiens
tggatcacctgt

SEQ ID NO: 5060167 - DNA, 19 bp, Homo sapiens
tggatcacgacgctgcaga

SEQ ID NO: 5060168 - DNA, 15 bp, Homo sapiens
tggatcactcaccat

SEQ ID NO: 5060169 - DNA, 15 bp, Homo sapiens
tggatcagagcattt

SEQ ID NO: 5060170 - DNA, 19 bp, Homo sapiens
tggatcagagcatttattt

SEQ ID NO: 5060171 - DNA, 14 bp, Homo sapiens
tggatcagaggtca

SEQ ID NO: 5060172 - DNA, 21 bp, Homo sapiens
tggatcagatagcaggaggaa

SEQ ID NO: 5060173 - DNA, 18 bp, Homo sapiens
tggatcagcgtggccttg

SEQ ID NO: 5060174 - DNA, 19 bp, Homo sapiens
tggatcataagacaatgga

SEQ ID NO: 5060175 - DNA, 14 bp, Homo sapiens
tggatccaatgtta

SEQ ID NO: 5060176 - DNA, 21 bp, Homo sapiens
tggatccactggctggacaaa

SEQ ID NO: 5060177 - DNA, 18 bp, Homo sapiens
tggatccagccattcctg

SEQ ID NO: 5060178 - DNA, 18 bp, Homo sapiens
tggatccagctctgggag

SEQ ID NO: 5060179 - DNA, 14 bp, Homo sapiens
tggatccatcctgc

SEQ ID NO: 5060180 - DNA, 23 bp, Homo sapiens
tggatccatcttgagccacagtc

SEQ ID NO: 5060181 - DNA, 23 bp, Homo sapiens
tggatccatggggggagaagtga

SEQ ID NO: 5060182 - DNA, 21 bp, Homo sapiens
tggatcccaaagcaaggagat

SEQ ID NO: 5060183 - DNA, 21 bp, Homo sapiens
tggatcccctgcggtcaggct

SEQ ID NO: 5060184 - DNA, 16 bp, Homo sapiens
tggatcccgttcagaa

SEQ ID NO: 5060185 - DNA, 17 bp, Homo sapiens
tggatccgtttgaccaa

SEQ ID NO: 5060186 - DNA, 13 bp, Homo sapiens
tggatcctagcct

SEQ ID NO: 5060187 - DNA, 23 bp, Homo sapiens
tggatcgagtgtagctgtgaaat

SEQ ID NO: 5060188 - DNA, 16 bp, Homo sapiens
tggatcgtggaagaag

SEQ ID NO: 5060189 - DNA, 22 bp, Homo sapiens
tggatcgtggaagaagggccac

SEQ ID NO: 5060190 - DNA, 16 bp, Homo sapiens
tggatcgttatctact

SEQ ID NO: 5060191 - DNA, 16 bp, Homo sapiens
tggatctacctggagg

SEQ ID NO: 5060192 - DNA, 19 bp, Homo sapiens
tggatctattgatttgaaa

SEQ ID NO: 5060193 - DNA, 14 bp, Homo sapiens
tggatctcaatctt

SEQ ID NO: 5060194 - DNA, 13 bp, Homo sapiens
tggatctcagttt

SEQ ID NO: 5060195 - DNA, 15 bp, Homo sapiens
tggatctcctccctt

SEQ ID NO: 5060196 - DNA, 19 bp, Homo sapiens
tggatctccttcccttctc

SEQ ID NO: 5060197 - DNA, 21 bp, Homo sapiens
tggatctccttcccttctctt

SEQ ID NO: 5060198 - DNA, 16 bp, Homo sapiens
tggatctccttgagat

SEQ ID NO: 5060199 - DNA, 20 bp, Homo sapiens
tggatctcttcttaatgtac

SEQ ID NO: 5060200 - DNA, 11 bp, Homo sapiens
tggatctgcag

SEQ ID NO: 5060201 - DNA, 16 bp, Homo sapiens
tggatctgcttctcca

SEQ ID NO: 5060202 - DNA, 12 bp, Homo sapiens
tggatctggagt

SEQ ID NO: 5060203 - DNA, 19 bp, Homo sapiens
tggatctgtatgtgttcta

SEQ ID NO: 5060204 - DNA, 18 bp, Homo sapiens
tggatctgtccaaggaaa

SEQ ID NO: 5060205 - DNA, 16 bp, Homo sapiens
tggatcttgagctctg

SEQ ID NO: 5060206 - DNA, 12 bp, Homo sapiens
tggatcttgcca

SEQ ID NO: 5060207 - DNA, 19 bp, Homo sapiens
tggatcttttactttaaag

SEQ ID NO: 5060208 - DNA, 19 bp, Homo sapiens
tggatcttttctaaatgtt

SEQ ID NO: 5060209 - DNA, 21 bp, Homo sapiens
tggatcttttgaagggagaag

SEQ ID NO: 5060210 - DNA, 15 bp, Homo sapiens
tggatctttttaaaa

SEQ ID NO: 5060211 - DNA, 14 bp, Homo sapiens
tggatgaaaaaagc

SEQ ID NO: 5060212 - DNA, 23 bp, Homo sapiens
tggatgaaagagccagactctgt

SEQ ID NO: 5060213 - DNA, 19 bp, Homo sapiens
tggatgaagattctcctgt

SEQ ID NO: 5060214 - DNA, 23 bp, Homo sapiens
tggatgacacaatccctggggct

SEQ ID NO: 5060215 - DNA, 18 bp, Homo sapiens
tggatgacacatttaatg

SEQ ID NO: 5060216 - DNA, 15 bp, Homo sapiens
tggatgacagggcag

SEQ ID NO: 5060217 - DNA, 14 bp, Homo sapiens
tggatgacattaaa

SEQ ID NO: 5060218 - DNA, 20 bp, Homo sapiens
tggatgaccagaacaaggtt

SEQ ID NO: 5060219 - DNA, 12 bp, Homo sapiens
tggatgactgtt

SEQ ID NO: 5060220 - DNA, 18 bp, Homo sapiens
tggatgagcaactcctgt

SEQ ID NO: 5060221 - DNA, 23 bp, Homo sapiens
tggatgagctcccacaagcctga

SEQ ID NO: 5060222 - DNA, 16 bp, Homo sapiens
tggatgaggagacaga

SEQ ID NO: 5060223 - DNA, 18 bp, Homo sapiens
tggatgagggccaccagg

SEQ ID NO: 5060224 - DNA, 19 bp, Homo sapiens
tggatgagtaaactgtttc

SEQ ID NO: 5060225 - DNA, 20 bp, Homo sapiens
tggatgagtaaactgtttct

SEQ ID NO: 5060226 - DNA, 22 bp, Homo sapiens
tggatgagtaaactgtttctca

SEQ ID NO: 5060227 - DNA, 15 bp, Homo sapiens
tggatgagtcagaca

SEQ ID NO: 5060228 - DNA, 16 bp, Homo sapiens
tggatgatacagtgtt

SEQ ID NO: 5060229 - DNA, 16 bp, Homo sapiens
tggatgatactaataa

SEQ ID NO: 5060230 - DNA, 19 bp, Homo sapiens
tggatgatataatgcgggt

SEQ ID NO: 5060231 - DNA, 16 bp, Homo sapiens
tggatgatatacacag

SEQ ID NO: 5060232 - DNA, 22 bp, Homo sapiens
tggatgatccccacgccacagc

SEQ ID NO: 5060233 - DNA, 21 bp, Homo sapiens
tggatgatggtcttcagcctc

SEQ ID NO: 5060234 - DNA, 14 bp, Homo sapiens
tggatgatgtttcg

SEQ ID NO: 5060235 - DNA, 17 bp, Homo sapiens
tggatgatgtttcgtga

SEQ ID NO: 5060236 - DNA, 16 bp, Homo sapiens
tggatgattcttttcc

SEQ ID NO: 5060237 - DNA, 15 bp, Homo sapiens
tggatgattgttcat

SEQ ID NO: 5060238 - DNA, 15 bp, Homo sapiens
tggatgatttcatct

SEQ ID NO: 5060239 - DNA, 17 bp, Homo sapiens
tggatgattttttaagc

SEQ ID NO: 5060240 - DNA, 21 bp, Homo sapiens
tggatgcaaatagattcagag

SEQ ID NO: 5060241 - DNA, 13 bp, Homo sapiens
tggatgcagcctc

SEQ ID NO: 5060242 - DNA, 21 bp, Homo sapiens
tggatgcagttgtatagtttt

SEQ ID NO: 5060243 - DNA, 15 bp, Homo sapiens
tggatgcatttcaaa

SEQ ID NO: 5060244 - DNA, 18 bp, Homo sapiens
tggatgcatttcaaatgt

SEQ ID NO: 5060245 - DNA, 15 bp, Homo sapiens
tggatgcatttctct

SEQ ID NO: 5060246 - DNA, 20 bp, Homo sapiens
tggatgccaatattaaatct

SEQ ID NO: 5060247 - DNA, 15 bp, Homo sapiens
tggatgccagctgtg

SEQ ID NO: 5060248 - DNA, 17 bp, Homo sapiens
tggatgccagctgtgtc

SEQ ID NO: 5060249 - DNA, 17 bp, Homo sapiens
tggatgcccattatatt

SEQ ID NO: 5060250 - DNA, 22 bp, Homo sapiens
tggatgccgatttctgtaaact

SEQ ID NO: 5060251 - DNA, 15 bp, Homo sapiens
tggatgcctggtggc

SEQ ID NO: 5060252 - DNA, 19 bp, Homo sapiens
tggatgcctggtggcagct

SEQ ID NO: 5060253 - DNA, 14 bp, Homo sapiens
tggatgccttcccc

SEQ ID NO: 5060254 - DNA, 20 bp, Homo sapiens
tggatgcgaggaccactttg

SEQ ID NO: 5060255 - DNA, 18 bp, Homo sapiens
tggatgcggccattcaag

SEQ ID NO: 5060256 - DNA, 19 bp, Homo sapiens
tggatgctccagggcagcc

SEQ ID NO: 5060257 - DNA, 20 bp, Homo sapiens
tggatgctcgccatcaaggt

SEQ ID NO: 5060258 - DNA, 15 bp, Homo sapiens
tggatgctctcaggc

SEQ ID NO: 5060259 - DNA, 23 bp, Homo sapiens
tggatgctctcaggctgagggag

SEQ ID NO: 5060260 - DNA, 16 bp, Homo sapiens
tggatgctgagctgtg

SEQ ID NO: 5060261 - DNA, 13 bp, Homo sapiens
tggatgctgggga

SEQ ID NO: 5060262 - DNA, 22 bp, Homo sapiens
tggatgctgggttctggggctg

SEQ ID NO: 5060263 - DNA, 21 bp, Homo sapiens
tggatgcttagagggatttct

SEQ ID NO: 5060264 - DNA, 22 bp, Homo sapiens
tggatggaacgggcatgggcct

SEQ ID NO: 5060265 - DNA, 15 bp, Homo sapiens
tggatggaaggagac

SEQ ID NO: 5060266 - DNA, 17 bp, Homo sapiens
tggatggaatatcagaa

SEQ ID NO: 5060267 - DNA, 12 bp, Homo sapiens
tggatggacaga

SEQ ID NO: 5060268 - DNA, 13 bp, Homo sapiens
tggatggacagaa

SEQ ID NO: 5060269 - DNA, 16 bp, Homo sapiens
tggatggacagacacc

SEQ ID NO: 5060270 - DNA, 19 bp, Homo sapiens
tggatggacagacacctcc

SEQ ID NO: 5060271 - DNA, 20 bp, Homo sapiens
tggatggacagacacctccc

SEQ ID NO: 5060272 - DNA, 14 bp, Homo sapiens
tggatggacagatg

SEQ ID NO: 5060273 - DNA, 23 bp, Homo sapiens
tggatggacttggcttcagactc

SEQ ID NO: 5060274 - DNA, 17 bp, Homo sapiens
tggatggaggtgatgaa

SEQ ID NO: 5060275 - DNA, 13 bp, Homo sapiens
tggatggatctgc

SEQ ID NO: 5060276 - DNA, 14 bp, Homo sapiens
tggatggatggaca

SEQ ID NO: 5060277 - DNA, 17 bp, Homo sapiens
tggatggatggacagaa

SEQ ID NO: 5060278 - DNA, 15 bp, Homo sapiens
tggatggcacaatga

SEQ ID NO: 5060279 - DNA, 20 bp, Homo sapiens
tggatggcacaatgaatgta

SEQ ID NO: 5060280 - DNA, 17 bp, Homo sapiens
tggatggcaccctggaa

SEQ ID NO: 5060281 - DNA, 13 bp, Homo sapiens
tggatggcagtgt

SEQ ID NO: 5060282 - DNA, 17 bp, Homo sapiens
tggatggcccagcaggc

SEQ ID NO: 5060283 - DNA, 22 bp, Homo sapiens
tggatggcccagcaggcaggca

SEQ ID NO: 5060284 - DNA, 14 bp, Homo sapiens
tggatggccccagc

SEQ ID NO: 5060285 - DNA, 17 bp, Homo sapiens
tggatggccccagcaca

SEQ ID NO: 5060286 - DNA, 18 bp, Homo sapiens
tggatggccccagcacag

SEQ ID NO: 5060287 - DNA, 21 bp, Homo sapiens
tggatggccccagcacagctt

SEQ ID NO: 5060288 - DNA, 19 bp, Homo sapiens
tggatggcccctccttgca

SEQ ID NO: 5060289 - DNA, 20 bp, Homo sapiens
tggatggcccctccttgcaa

SEQ ID NO: 5060290 - DNA, 15 bp, Homo sapiens
tggatggccgggctg

SEQ ID NO: 5060291 - DNA, 18 bp, Homo sapiens
tggatggccgtggatgcg

SEQ ID NO: 5060292 - DNA, 17 bp, Homo sapiens
tggatggcctctggggc

SEQ ID NO: 5060293 - DNA, 18 bp, Homo sapiens
tggatggcctctggggca

SEQ ID NO: 5060294 - DNA, 15 bp, Homo sapiens
tggatgggaagatgg

SEQ ID NO: 5060295 - DNA, 15 bp, Homo sapiens
tggatgggaatttgt

SEQ ID NO: 5060296 - DNA, 21 bp, Homo sapiens
tggatgggacatttttgtctg

SEQ ID NO: 5060297 - DNA, 15 bp, Homo sapiens
tggatgggaggagag

SEQ ID NO: 5060298 - DNA, 17 bp, Homo sapiens
tggatgggaggctcctg

SEQ ID NO: 5060299 - DNA, 14 bp, Homo sapiens
tggatgggagtggg

SEQ ID NO: 5060300 - DNA, 16 bp, Homo sapiens
tggatgggcagtcatt

SEQ ID NO: 5060301 - DNA, 21 bp, Homo sapiens
tggatgggcctttgagcctga

SEQ ID NO: 5060302 - DNA, 14 bp, Homo sapiens
tggatggggcccag

SEQ ID NO: 5060303 - DNA, 15 bp, Homo sapiens
tggatggggcccagg

SEQ ID NO: 5060304 - DNA, 22 bp, Homo sapiens
tggatgggggaactcagatcca

SEQ ID NO: 5060305 - DNA, 19 bp, Homo sapiens
tggatgggggctctgcacc

SEQ ID NO: 5060306 - DNA, 20 bp, Homo sapiens
tggatgggggctctgcaccc

SEQ ID NO: 5060307 - DNA, 17 bp, Homo sapiens
tggatggtgaagtcaca

SEQ ID NO: 5060308 - DNA, 22 bp, Homo sapiens
tggatggtttgttgttctgcct

SEQ ID NO: 5060309 - DNA, 12 bp, Homo sapiens
tggatgtaaata

SEQ ID NO: 5060310 - DNA, 15 bp, Homo sapiens
tggatgtaaatcctg

SEQ ID NO: 5060311 - DNA, 21 bp, Homo sapiens
tggatgtaattagctctgggg

SEQ ID NO: 5060312 - DNA, 15 bp, Homo sapiens
ttacaaaatgccaag

SEQ ID NO: 5060313 - DNA, 12 bp, Homo sapiens
ttacaaaatgta

SEQ ID NO: 5060314 - DNA, 11 bp, Homo sapiens
ttacaaacaag

SEQ ID NO: 5060315 - DNA, 14 bp, Homo sapiens
ttacaaacaagata

SEQ ID NO: 5060316 - DNA, 19 bp, Homo sapiens
ttacaaacagatgaaaaaa

SEQ ID NO: 5060317 - DNA, 15 bp, Homo sapiens
ttacaaacatgtggt

SEQ ID NO: 5060318 - DNA, 17 bp, Homo sapiens
ttacaaaccaaccattt

SEQ ID NO: 5060319 - DNA, 20 bp, Homo sapiens
ttacaaaccaaccatttcta

SEQ ID NO: 5060320 - DNA, 13 bp, Homo sapiens
ttacaaactacag

SEQ ID NO: 5060321 - DNA, 16 bp, Homo sapiens
ttacaaactgaagagt

SEQ ID NO: 5060322 - DNA, 13 bp, Homo sapiens
ttacaaactgcaa

SEQ ID NO: 5060323 - DNA, 14 bp, Homo sapiens
ttacaaactgcaat

SEQ ID NO: 5060324 - DNA, 23 bp, Homo sapiens
ttacaaactgcaatagagactgt

SEQ ID NO: 5060325 - DNA, 16 bp, Homo sapiens
tggcaaccccagaccc

SEQ ID NO: 5060326 - DNA, 23 bp, Homo sapiens
tggcaaccctcagctgcctcatc

SEQ ID NO: 5060327 - DNA, 13 bp, Homo sapiens
tggcaacctgctt

SEQ ID NO: 5060328 - DNA, 14 bp, Homo sapiens
tggcaacctttgtg

SEQ ID NO: 5060329 - DNA, 19 bp, Homo sapiens
tggcaactcttcagacgga

SEQ ID NO: 5060330 - DNA, 23 bp, Homo sapiens
tggcaactgtattaaagaaaaat

SEQ ID NO: 5060331 - DNA, 12 bp, Homo sapiens
tggcaactttct

SEQ ID NO: 5060332 - DNA, 13 bp, Homo sapiens
tggcaactttctt

SEQ ID NO: 5060333 - DNA, 15 bp, Homo sapiens
tggcaagaaagctgg

SEQ ID NO: 5060334 - DNA, 22 bp, Homo sapiens
tggcaagaaatcccctaactga

SEQ ID NO: 5060335 - DNA, 21 bp, Homo sapiens
tggcaagagactactctgcct

SEQ ID NO: 5060336 - DNA, 17 bp, Homo sapiens
tggcaagagcagatact

SEQ ID NO: 5060337 - DNA, 13 bp, Homo sapiens
tggcaagagcccc

SEQ ID NO: 5060338 - DNA, 14 bp, Homo sapiens
tggcaagaggcctc

SEQ ID NO: 5060339 - DNA, 19 bp, Homo sapiens
tggcaagaggcctcatgcc

SEQ ID NO: 5060340 - DNA, 20 bp, Homo sapiens
tggcaagaggcctcatgcct

SEQ ID NO: 5060341 - DNA, 17 bp, Homo sapiens
tggcaagatgaaataat

SEQ ID NO: 5060342 - DNA, 15 bp, Homo sapiens
tggcaagatgtttct

SEQ ID NO: 5060343 - DNA, 16 bp, Homo sapiens
tggcaagatgtttctt

SEQ ID NO: 5060344 - DNA, 17 bp, Homo sapiens
tggcaagatgtttctta

SEQ ID NO: 5060345 - DNA, 21 bp, Homo sapiens
tggcaagcagggaaagctcca

SEQ ID NO: 5060346 - DNA, 23 bp, Homo sapiens
tggcaagcagggaaagctccacg

SEQ ID NO: 5060347 - DNA, 20 bp, Homo sapiens
tggcaagctcttcattgcac

SEQ ID NO: 5060348 - DNA, 12 bp, Homo sapiens
tggcaagctgca

SEQ ID NO: 5060349 - DNA, 11 bp, Homo sapiens
tggcaaggaaa

SEQ ID NO: 5060350 - DNA, 16 bp, Homo sapiens
tggcaaggaaaaacag

SEQ ID NO: 5060351 - DNA, 13 bp, Homo sapiens
tggcaaggacttt

SEQ ID NO: 5060352 - DNA, 20 bp, Homo sapiens
tggcaaggactttgtacatt

SEQ ID NO: 5060353 - DNA, 14 bp, Homo sapiens
tggcaaggctgtgc

SEQ ID NO: 5060354 - DNA, 16 bp, Homo sapiens
tggcaaggctgtgctc

SEQ ID NO: 5060355 - DNA, 17 bp, Homo sapiens
tggcaagggggtgtcat

SEQ ID NO: 5060356 - DNA, 20 bp, Homo sapiens
tggcaaggggtctccttgga

SEQ ID NO: 5060357 - DNA, 15 bp, Homo sapiens
tggcaaggtgggttc

SEQ ID NO: 5060358 - DNA, 16 bp, Homo sapiens
tggcaaggttcagtct

SEQ ID NO: 5060359 - DNA, 15 bp, Homo sapiens
tggcaagtcacatgc

SEQ ID NO: 5060360 - DNA, 16 bp, Homo sapiens
tggcaagtcacatgcg

SEQ ID NO: 5060361 - DNA, 19 bp, Homo sapiens
tggcaagtcattagaatgt

SEQ ID NO: 5060362 - DNA, 12 bp, Homo sapiens
tggcaagtgggg

SEQ ID NO: 5060363 - DNA, 14 bp, Homo sapiens
tggcaagtggggct

SEQ ID NO: 5060364 - DNA, 22 bp, Homo sapiens
tggcaagttttgatatgagtat

SEQ ID NO: 5060365 - DNA, 20 bp, Homo sapiens
tggcaataaaggagaagaga

SEQ ID NO: 5060366 - DNA, 15 bp, Homo sapiens
tggcaataaatggct

SEQ ID NO: 5060367 - DNA, 21 bp, Homo sapiens
tggcaataaatgtcccaaata

SEQ ID NO: 5060368 - DNA, 18 bp, Homo sapiens
tggcaataaattttgaaa

SEQ ID NO: 5060369 - DNA, 18 bp, Homo sapiens
tggcaatacctagtgata

SEQ ID NO: 5060370 - DNA, 14 bp, Homo sapiens
tggcaatagcattg

SEQ ID NO: 5060371 - DNA, 18 bp, Homo sapiens
tggcaatagtgggccctc

SEQ ID NO: 5060372 - DNA, 16 bp, Homo sapiens
tggcaatagtgtgttc

SEQ ID NO: 5060373 - DNA, 20 bp, Homo sapiens
tggcaatatcatattctaaa

SEQ ID NO: 5060374 - DNA, 15 bp, Homo sapiens
tggcaatattctgta

SEQ ID NO: 5060375 - DNA, 18 bp, Homo sapiens
tggcaatatttgttctgg

SEQ ID NO: 5060376 - DNA, 20 bp, Homo sapiens
tggcaatcaaacattttctg

SEQ ID NO: 5060377 - DNA, 19 bp, Homo sapiens
tggcaatcccaccaaatca

SEQ ID NO: 5060378 - DNA, 14 bp, Homo sapiens
tggcaatgaaaatt

SEQ ID NO: 5060379 - DNA, 16 bp, Homo sapiens
tggcaatgaaaatttt

SEQ ID NO: 5060380 - DNA, 15 bp, Homo sapiens
tggcaatgccacagc

SEQ ID NO: 5060381 - DNA, 19 bp, Homo sapiens
tggcaatgccacagccctg

SEQ ID NO: 5060382 - DNA, 20 bp, Homo sapiens
tggcaatgccacagccctgt

SEQ ID NO: 5060383 - DNA, 21 bp, Homo sapiens
tggcaatgccacagccctgtc

SEQ ID NO: 5060384 - DNA, 21 bp, Homo sapiens
tggcaatgccctacctgcctg

SEQ ID NO: 5060385 - DNA, 22 bp, Homo sapiens
tggcaatgccctacctgcctgt

SEQ ID NO: 5060386 - DNA, 23 bp, Homo sapiens
tggcaatgccctacctgcctgtt

SEQ ID NO: 5060387 - DNA, 20 bp, Homo sapiens
tggcaatggatgaactgaaa

SEQ ID NO: 5060388 - DNA, 18 bp, Homo sapiens
tggcaatggtagtttctg

SEQ ID NO: 5060389 - DNA, 21 bp, Homo sapiens
tggcaatggtagtttctgtgg

SEQ ID NO: 5060390 - DNA, 18 bp, Homo sapiens
tggcaatgttttgctttt

SEQ ID NO: 5060391 - DNA, 16 bp, Homo sapiens
tggcaattaagtggtc

SEQ ID NO: 5060392 - DNA, 13 bp, Homo sapiens
tggcaattccaat

SEQ ID NO: 5060393 - DNA, 23 bp, Homo sapiens
tggcaattcctcttcattgtcta

SEQ ID NO: 5060394 - DNA, 16 bp, Homo sapiens
tggcaattgtctattt

SEQ ID NO: 5060395 - DNA, 15 bp, Homo sapiens
tggcaatttcctggc

SEQ ID NO: 5060396 - DNA, 16 bp, Homo sapiens
tggcaatttcctggcc

SEQ ID NO: 5060397 - DNA, 22 bp, Homo sapiens
tggcaatttcctggccctccac

SEQ ID NO: 5060398 - DNA, 17 bp, Homo sapiens
tggcaatttctttagat

SEQ ID NO: 5060399 - DNA, 14 bp, Homo sapiens
tggcaatttgaatt

SEQ ID NO: 5060400 - DNA, 12 bp, Homo sapiens
tggcacaagctc

SEQ ID NO: 5060401 - DNA, 23 bp, Homo sapiens
tggcacaatcatggctgattgca

SEQ ID NO: 5060402 - DNA, 20 bp, Homo sapiens
tggcacaatgttggagcagc

SEQ ID NO: 5060403 - DNA, 18 bp, Homo sapiens
tggcacaccctctctgtc

SEQ ID NO: 5060404 - DNA, 14 bp, Homo sapiens
tggcacagaaacac

SEQ ID NO: 5060405 - DNA, 13 bp, Homo sapiens
tggcacagaaagg

SEQ ID NO: 5060406 - DNA, 20 bp, Homo sapiens
tggcacagaaagggcagctt

SEQ ID NO: 5060407 - DNA, 19 bp, Homo sapiens
tggcacagaagaggagtca

SEQ ID NO: 5060408 - DNA, 16 bp, Homo sapiens
tggcacagaccaggcc

SEQ ID NO: 5060409 - DNA, 17 bp, Homo sapiens
tggcacagaccaggcct

SEQ ID NO: 5060410 - DNA, 18 bp, Homo sapiens
tggcacagaccaggcctt

SEQ ID NO: 5060411 - DNA, 15 bp, Homo sapiens
tggcacagcccctgg

SEQ ID NO: 5060412 - DNA, 14 bp, Homo sapiens
tggcacaggcactg

SEQ ID NO: 5060413 - DNA, 15 bp, Homo sapiens
tggcacaggcactga

SEQ ID NO: 5060414 - DNA, 16 bp, Homo sapiens
tggcacaggccccctt

SEQ ID NO: 5060415 - DNA, 16 bp, Homo sapiens
tggcacaggccgaggc

SEQ ID NO: 5060416 - DNA, 16 bp, Homo sapiens
tggcacagggcagtgg

SEQ ID NO: 5060417 - DNA, 18 bp, Homo sapiens
tggcacagtgatgccggg

SEQ ID NO: 5060418 - DNA, 16 bp, Homo sapiens
tggcacagtgtctggg

SEQ ID NO: 5060419 - DNA, 22 bp, Homo sapiens
tggcacagttttctgagaaaga

SEQ ID NO: 5060420 - DNA, 23 bp, Homo sapiens
tggcacatcctatgcaatatatc

SEQ ID NO: 5060421 - DNA, 19 bp, Homo sapiens
tggcacattcctttgggta

SEQ ID NO: 5060422 - DNA, 16 bp, Homo sapiens
tggcaccaataaagga

SEQ ID NO: 5060423 - DNA, 22 bp, Homo sapiens
tggcaccaataaaggaggaatc

SEQ ID NO: 5060424 - DNA, 14 bp, Homo sapiens
tggcaccagacacc

SEQ ID NO: 5060425 - DNA, 23 bp, Homo sapiens
tggcaccagacacccaggactta

SEQ ID NO: 5060426 - DNA, 19 bp, Homo sapiens
tggcaccagaggctgcaga

SEQ ID NO: 5060427 - DNA, 20 bp, Homo sapiens
tggcaccagaggctgcagaa

SEQ ID NO: 5060428 - DNA, 20 bp, Homo sapiens
tggcaccagatgcaacctca

SEQ ID NO: 5060429 - DNA, 18 bp, Homo sapiens
tggcaccagcagcctgga

SEQ ID NO: 5060430 - DNA, 15 bp, Homo sapiens
tggcaccagccccct

SEQ ID NO: 5060431 - DNA, 16 bp, Homo sapiens
tggcaccagccccctg

SEQ ID NO: 5060432 - DNA, 18 bp, Homo sapiens
tggcaccagccccctgga

SEQ ID NO: 5060433 - DNA, 13 bp, Homo sapiens
tggcaccagcgaa

SEQ ID NO: 5060434 - DNA, 14 bp, Homo sapiens
tggcaccatcagcc

SEQ ID NO: 5060435 - DNA, 22 bp, Homo sapiens
tggcaccatggtgactgccaca

SEQ ID NO: 5060436 - DNA, 19 bp, Homo sapiens
tggcaccatgttggcctct

SEQ ID NO: 5060437 - DNA, 19 bp, Homo sapiens
tggcacccacacagaggac

SEQ ID NO: 5060438 - DNA, 11 bp, Homo sapiens
tggcacccacc

SEQ ID NO: 5060439 - DNA, 20 bp, Homo sapiens
tggcacccaccactctcagg

SEQ ID NO: 5060440 - DNA, 22 bp, Homo sapiens
tggcacccaccactctcaggac

SEQ ID NO: 5060441 - DNA, 21 bp, Homo sapiens
tggcaccccagctaccccttc

SEQ ID NO: 5060442 - DNA, 16 bp, Homo sapiens
tggcacccccatgctg

SEQ ID NO: 5060443 - DNA, 20 bp, Homo sapiens
tggcacccccatgctgcctt

SEQ ID NO: 5060444 - DNA, 23 bp, Homo sapiens
tggcaccccggatcgaggacaag

SEQ ID NO: 5060445 - DNA, 23 bp, Homo sapiens
tggcaccgcctccccacctccag

SEQ ID NO: 5060446 - DNA, 15 bp, Homo sapiens
tggcaccgccttctc

SEQ ID NO: 5060447 - DNA, 12 bp, Homo sapiens
tggcacctccta

SEQ ID NO: 5060448 - DNA, 22 bp, Homo sapiens
tggcacctcctcggctggctgt

SEQ ID NO: 5060449 - DNA, 14 bp, Homo sapiens
tggcacctcctgag

SEQ ID NO: 5060450 - DNA, 16 bp, Homo sapiens
tggcacctcctgagaa

SEQ ID NO: 5060451 - DNA, 17 bp, Homo sapiens
tggcacctcctgagaag

SEQ ID NO: 5060452 - DNA, 15 bp, Homo sapiens
tggcacctctgccct

SEQ ID NO: 5060453 - DNA, 16 bp, Homo sapiens
tggcacctctgccctt

SEQ ID NO: 5060454 - DNA, 23 bp, Homo sapiens
tggcacctctgcccttcccctcc

SEQ ID NO: 5060455 - DNA, 16 bp, Homo sapiens
tggcacctgaaattaa

SEQ ID NO: 5060456 - DNA, 21 bp, Homo sapiens
tggcacctgcacactccatct

SEQ ID NO: 5060457 - DNA, 12 bp, Homo sapiens
tggcacctgcag

SEQ ID NO: 5060458 - DNA, 14 bp, Homo sapiens
tggcacctgcagcg

SEQ ID NO: 5060459 - DNA, 20 bp, Homo sapiens
tggcacctgcctagctcttg

SEQ ID NO: 5060460 - DNA, 21 bp, Homo sapiens
tggcacctgggtgctctggct

SEQ ID NO: 5060461 - DNA, 18 bp, Homo sapiens
tggcacctgtctgctcca

SEQ ID NO: 5060462 - DNA, 17 bp, Homo sapiens
tggcacctttgagagag

SEQ ID NO: 5060463 - DNA, 22 bp, Homo sapiens
tggcacgcacctgtagtcccag

SEQ ID NO: 5060464 - DNA, 15 bp, Homo sapiens
tggcacggagagaag

SEQ ID NO: 5060465 - DNA, 20 bp, Homo sapiens
tggcacggagagaaggccca

SEQ ID NO: 5060466 - DNA, 13 bp, Homo sapiens
tggcacgggccct

SEQ ID NO: 5060467 - DNA, 21 bp, Homo sapiens
tggcacgggccctccctccca

SEQ ID NO: 5060468 - DNA, 20 bp, Homo sapiens
tggcacggtggctcaggcct

SEQ ID NO: 5060469 - DNA, 15 bp, Homo sapiens
tggcacgtattgctg

SEQ ID NO: 5060470 - DNA, 18 bp, Homo sapiens
tggcacgtcatctagttt

SEQ ID NO: 5060471 - DNA, 17 bp, Homo sapiens
tggcacgtgacaggctc

SEQ ID NO: 5060472 - DNA, 13 bp, Homo sapiens
tggcactaaaatg

SEQ ID NO: 5060473 - DNA, 22 bp, Homo sapiens
tggcactaacgttgagcccctg

SEQ ID NO: 5060474 - DNA, 22 bp, Homo sapiens
tggcactataatgtaagctcta

SEQ ID NO: 5060475 - DNA, 15 bp, Homo sapiens
tggcactatttttat

SEQ ID NO: 5060476 - DNA, 19 bp, Homo sapiens
tggcactccctccagcaca

SEQ ID NO: 5060477 - DNA, 20 bp, Homo sapiens
tggcactccctccagcacaa

SEQ ID NO: 5060478 - DNA, 21 bp, Homo sapiens
tggcactccctccagcacaaa

SEQ ID NO: 5060479 - DNA, 21 bp, Homo sapiens
tggcactctctaacgtccact

SEQ ID NO: 5060480 - DNA, 13 bp, Homo sapiens
tggcactctctgc

SEQ ID NO: 5060481 - DNA, 23 bp, Homo sapiens
tggcactctctgccattctgtgc

SEQ ID NO: 5060482 - DNA, 12 bp, Homo sapiens
tggcactgaagt

SEQ ID NO: 5060483 - DNA, 18 bp, Homo sapiens
tggcactgaagtggccct

SEQ ID NO: 5060484 - DNA, 13 bp, Homo sapiens
tggcactgacagc

SEQ ID NO: 5060485 - DNA, 20 bp, Homo sapiens
tggcactgacagcctggggg

SEQ ID NO: 5060486 - DNA, 20 bp, Homo sapiens
tggcactgaccggtgctttt

SEQ ID NO: 5060487 - DNA, 21 bp, Homo sapiens
tggcactgactgaatgctgtt

SEQ ID NO: 5060488 - DNA, 22 bp, Homo sapiens
tggcactgagatatttattgtt

SEQ ID NO: 5060489 - DNA, 14 bp, Homo sapiens
tggcactgagcccc

SEQ ID NO: 5060490 - DNA, 18 bp, Homo sapiens
tggcactgcaggtggcct

SEQ ID NO: 5060491 - DNA, 17 bp, Homo sapiens
tggcactgccaccagca

SEQ ID NO: 5060492 - DNA, 20 bp, Homo sapiens
tggcactgcgatcaggaaga

SEQ ID NO: 5060493 - DNA, 16 bp, Homo sapiens
tggcactgctaaaata

SEQ ID NO: 5060494 - DNA, 22 bp, Homo sapiens
tggcactgctaaaatagaatat

SEQ ID NO: 5060495 - DNA, 15 bp, Homo sapiens
ttacatttgtataaa

SEQ ID NO: 5060496 - DNA, 14 bp, Homo sapiens
ttacattttacaca

SEQ ID NO: 5060497 - DNA, 15 bp, Homo sapiens
ttacattttcctgtg

SEQ ID NO: 5060498 - DNA, 19 bp, Homo sapiens
ttacattttcctgtgtaaa

SEQ ID NO: 5060499 - DNA, 22 bp, Homo sapiens
ttacattttcgtcctgtagcac

SEQ ID NO: 5060500 - DNA, 23 bp, Homo sapiens
ttacattttctggtactctgtga

SEQ ID NO: 5060501 - DNA, 16 bp, Homo sapiens
ttacattttgtgcagt

SEQ ID NO: 5060502 - DNA, 20 bp, Homo sapiens
ttcatagttggaaatatttg

SEQ ID NO: 5060503 - DNA, 12 bp, Homo sapiens
ttcatagtttat

SEQ ID NO: 5060504 - DNA, 18 bp, Homo sapiens
ttcatagttttatatccc

SEQ ID NO: 5060505 - DNA, 15 bp, Homo sapiens
ttcatataaaaacac

SEQ ID NO: 5060506 - DNA, 21 bp, Homo sapiens
ttcatataaaagttgcgttta

SEQ ID NO: 5060507 - DNA, 14 bp, Homo sapiens
ttcatataaagtat

SEQ ID NO: 5060508 - DNA, 14 bp, Homo sapiens
ttcatataaagtgc

SEQ ID NO: 5060509 - DNA, 16 bp, Homo sapiens
ttcatataaagtgcaa

SEQ ID NO: 5060510 - DNA, 15 bp, Homo sapiens
ttcatataaatggaa

SEQ ID NO: 5060511 - DNA, 18 bp, Homo sapiens
ttcatataatttaaagaa

SEQ ID NO: 5060512 - DNA, 21 bp, Homo sapiens
ttcatataatttaaagaaaca

SEQ ID NO: 5060513 - DNA, 13 bp, Homo sapiens
ttcatataatttg

SEQ ID NO: 5060514 - DNA, 15 bp, Homo sapiens
ttcatatactataat

SEQ ID NO: 5060515 - DNA, 23 bp, Homo sapiens
ttcatataggggcaaaaatttga

SEQ ID NO: 5060516 - DNA, 18 bp, Homo sapiens
ttcatatatgaggacttg

SEQ ID NO: 5060517 - DNA, 22 bp, Homo sapiens
ttcatatattatcaaaattctg

SEQ ID NO: 5060518 - DNA, 17 bp, Homo sapiens
ttcatatattgcatttc

SEQ ID NO: 5060519 - DNA, 19 bp, Homo sapiens
ttcatatattgcatttctg

SEQ ID NO: 5060520 - DNA, 19 bp, Homo sapiens
ttcatatcactatgaactt

SEQ ID NO: 5060521 - DNA, 15 bp, Homo sapiens
ttcatatcatccaca

SEQ ID NO: 5060522 - DNA, 11 bp, Homo sapiens
ttcatatcatt

SEQ ID NO: 5060523 - DNA, 13 bp, Homo sapiens
ttcatatccagct

SEQ ID NO: 5060524 - DNA, 22 bp, Homo sapiens
ttcatatcctccgccctttttg

SEQ ID NO: 5060525 - DNA, 15 bp, Homo sapiens
ttcatatctaattta

SEQ ID NO: 5060526 - DNA, 24 bp, Homo sapiens
ttcatatctatgggaaaaatctaa

SEQ ID NO: 5060527 - DNA, 20 bp, Homo sapiens
ttcatatctatttattaaat

SEQ ID NO: 5060528 - DNA, 13 bp, Homo sapiens
ttcatatctctcc

SEQ ID NO: 5060529 - DNA, 14 bp, Homo sapiens
ttcatatctctccc

SEQ ID NO: 5060530 - DNA, 20 bp, Homo sapiens
ttcatatcttaaaaattaaa

SEQ ID NO: 5060531 - DNA, 20 bp, Homo sapiens
ttcatatgaggggacccagc

SEQ ID NO: 5060532 - DNA, 23 bp, Homo sapiens
ttcatatgcagaacgtatttagc

SEQ ID NO: 5060533 - DNA, 12 bp, Homo sapiens
ttcatatgcata

SEQ ID NO: 5060534 - DNA, 13 bp, Homo sapiens
ttcatatgctctg

SEQ ID NO: 5060535 - DNA, 13 bp, Homo sapiens
ttcatatgtaatc

SEQ ID NO: 5060536 - DNA, 20 bp, Homo sapiens
ttcatatgtacttgtttgct

SEQ ID NO: 5060537 - DNA, 15 bp, Homo sapiens
ttcatatgtcacctt

SEQ ID NO: 5060538 - DNA, 20 bp, Homo sapiens
ttcatattaagacagtgtac

SEQ ID NO: 5060539 - DNA, 15 bp, Homo sapiens
ttcatattacaatat

SEQ ID NO: 5060540 - DNA, 21 bp, Homo sapiens
ttcatattaccagaaaatgag

SEQ ID NO: 5060541 - DNA, 16 bp, Homo sapiens
ttcatattctttcaat

SEQ ID NO: 5060542 - DNA, 20 bp, Homo sapiens
ttcatattgatctttttatc

SEQ ID NO: 5060543 - DNA, 15 bp, Homo sapiens
ttcatattgcatcat

SEQ ID NO: 5060544 - DNA, 19 bp, Homo sapiens
ttcatattgcatcatagtt

SEQ ID NO: 5060545 - DNA, 20 bp, Homo sapiens
ttcatattggattgcgcctt

SEQ ID NO: 5060546 - DNA, 14 bp, Homo sapiens
ttcatattgtaatc

SEQ ID NO: 5060547 - DNA, 16 bp, Homo sapiens
ttcatattgtgccaat

SEQ ID NO: 5060548 - DNA, 20 bp, Homo sapiens
ttcatattgtggcacaagca

SEQ ID NO: 5060549 - DNA, 23 bp, Homo sapiens
ttcatattgttgcattgcttttt

SEQ ID NO: 5060550 - DNA, 14 bp, Homo sapiens
ttcatatttaaagc

SEQ ID NO: 5060551 - DNA, 19 bp, Homo sapiens
ttcatatttaaagccaaat

SEQ ID NO: 5060552 - DNA, 18 bp, Homo sapiens
ttcatatttatactttgc

SEQ ID NO: 5060553 - DNA, 22 bp, Homo sapiens
ttcatatttgtactttctgtta

SEQ ID NO: 5060554 - DNA, 19 bp, Homo sapiens
ttcatatttgtctttgaat

SEQ ID NO: 5060555 - DNA, 17 bp, Homo sapiens
ttcatattttaaacaga

SEQ ID NO: 5060556 - DNA, 22 bp, Homo sapiens
ttcatattttaaacagaggata

SEQ ID NO: 5060557 - DNA, 16 bp, Homo sapiens
ttcatattttaaatct

SEQ ID NO: 5060558 - DNA, 18 bp, Homo sapiens
ttcatattttaatttcaa

SEQ ID NO: 5060559 - DNA, 14 bp, Homo sapiens
ttcatcaagactgg

SEQ ID NO: 5060560 - DNA, 16 bp, Homo sapiens
ttcatcaagagtttat

SEQ ID NO: 5060561 - DNA, 17 bp, Homo sapiens
ttcatcaagagtttatt

SEQ ID NO: 5060562 - DNA, 13 bp, Homo sapiens
ttcatcaagtagc

SEQ ID NO: 5060563 - DNA, 21 bp, Homo sapiens
ttcatcaagtagcgttggaga

SEQ ID NO: 5060564 - DNA, 15 bp, Homo sapiens
ttcatcaatcaaata

SEQ ID NO: 5060565 - DNA, 19 bp, Homo sapiens
ttcatcaatgggattttct

SEQ ID NO: 5060566 - DNA, 20 bp, Homo sapiens
ttcatcaatgggattttcta

SEQ ID NO: 5060567 - DNA, 19 bp, Homo sapiens
ttcatcaatttttatacat

SEQ ID NO: 5060568 - DNA, 20 bp, Homo sapiens
ttcatcaccagactttggct

SEQ ID NO: 5060569 - DNA, 11 bp, Homo sapiens
ttcatcactgg

SEQ ID NO: 5060570 - DNA, 20 bp, Homo sapiens
ttcatcacttcttccactgt

SEQ ID NO: 5060571 - DNA, 22 bp, Homo sapiens
ttcatcagaacagctgttgact

SEQ ID NO: 5060572 - DNA, 15 bp, Homo sapiens
ttcatcagtaagcag

SEQ ID NO: 5060573 - DNA, 16 bp, Homo sapiens
ttcatcagtgttaaaa

SEQ ID NO: 5060574 - DNA, 19 bp, Homo sapiens
ttcatcatatgaatgttct

SEQ ID NO: 5060575 - DNA, 17 bp, Homo sapiens
ttcatcatccctccctg

SEQ ID NO: 5060576 - DNA, 19 bp, Homo sapiens
ttcatcatccctccctgcc

SEQ ID NO: 5060577 - DNA, 15 bp, Homo sapiens
ttcatcattgggctc

SEQ ID NO: 5060578 - DNA, 22 bp, Homo sapiens
ttcatcattgtttctgcatgaa

SEQ ID NO: 5060579 - DNA, 15 bp, Homo sapiens
ttcatcatttcagcc

SEQ ID NO: 5060580 - DNA, 21 bp, Homo sapiens
ttttctacataattgtgacca

SEQ ID NO: 5060581 - DNA, 22 bp, Homo sapiens
ttttctacataattgtgaccaa

SEQ ID NO: 5060582 - DNA, 16 bp, Homo sapiens
ttttctaccctagcca

SEQ ID NO: 5060583 - DNA, 15 bp, Homo sapiens
ttttctacgtcatgt

SEQ ID NO: 5060584 - DNA, 16 bp, Homo sapiens
ttttctacgtttcttt

SEQ ID NO: 5060585 - DNA, 13 bp, Homo sapiens
ttttctactcgag

SEQ ID NO: 5060586 - DNA, 20 bp, Homo sapiens
ttttctactcgagttacaga

SEQ ID NO: 5060587 - DNA, 23 bp, Homo sapiens
ttttctactcgagttacagacaa

SEQ ID NO: 5060588 - DNA, 15 bp, Homo sapiens
ttttctactgtttta

SEQ ID NO: 5060589 - DNA, 16 bp, Homo sapiens
ttttctactttgaaat

SEQ ID NO: 5060590 - DNA, 17 bp, Homo sapiens
ttttctactttttttaa

SEQ ID NO: 5060591 - DNA, 13 bp, Homo sapiens
ttttctagaatac

SEQ ID NO: 5060592 - DNA, 14 bp, Homo sapiens
ttttctagaattat

SEQ ID NO: 5060593 - DNA, 22 bp, Homo sapiens
ttttctagaattatttttcact

SEQ ID NO: 5060594 - DNA, 18 bp, Homo sapiens
ttttctagcccgaataca

SEQ ID NO: 5060595 - DNA, 14 bp, Homo sapiens
ttttctagtacact

SEQ ID NO: 5060596 - DNA, 17 bp, Homo sapiens
ttttctagtttgctcat

SEQ ID NO: 5060597 - DNA, 12 bp, Homo sapiens
ttttctataaat

SEQ ID NO: 5060598 - DNA, 14 bp, Homo sapiens
ttttctataaatca

SEQ ID NO: 5060599 - DNA, 16 bp, Homo sapiens
ttttctataatttaaa

SEQ ID NO: 5060600 - DNA, 17 bp, Homo sapiens
ttttctatatcaaaaaa

SEQ ID NO: 5060601 - DNA, 14 bp, Homo sapiens
ttttctatatttgg

SEQ ID NO: 5060602 - DNA, 22 bp, Homo sapiens
ttttctatcatggaatatttat

SEQ ID NO: 5060603 - DNA, 14 bp, Homo sapiens
ttttctatgcttat

SEQ ID NO: 5060604 - DNA, 12 bp, Homo sapiens
ttttctatgtac

SEQ ID NO: 5060605 - DNA, 21 bp, Homo sapiens
ttttctatgtactagtactgt

SEQ ID NO: 5060606 - DNA, 18 bp, Homo sapiens
ttttctatgtccagcctt

SEQ ID NO: 5060607 - DNA, 11 bp, Homo sapiens
ttttctattaa

SEQ ID NO: 5060608 - DNA, 13 bp, Homo sapiens
ttttctattaaaa

SEQ ID NO: 5060609 - DNA, 14 bp, Homo sapiens
ttttctattaaaag

SEQ ID NO: 5060610 - DNA, 23 bp, Homo sapiens
ttttctattatggaaaactgtgt

SEQ ID NO: 5060611 - DNA, 20 bp, Homo sapiens
ttttctattccttctggcct

SEQ ID NO: 5060612 - DNA, 14 bp, Homo sapiens
ttttctatttctct

SEQ ID NO: 5060613 - DNA, 16 bp, Homo sapiens
ttttctattttaataa

SEQ ID NO: 5060614 - DNA, 12 bp, Homo sapiens
ttttctattttg

SEQ ID NO: 5060615 - DNA, 22 bp, Homo sapiens
ttttctcaaaagcatttatcat

SEQ ID NO: 5060616 - DNA, 23 bp, Homo sapiens
ttttctcaaagttttgaaaagct

SEQ ID NO: 5060617 - DNA, 13 bp, Homo sapiens
ttttctcaaataa

SEQ ID NO: 5060618 - DNA, 14 bp, Homo sapiens
ttttctcacaaaaa

SEQ ID NO: 5060619 - DNA, 19 bp, Homo sapiens
ttttctcacagaagatgaa

SEQ ID NO: 5060620 - DNA, 13 bp, Homo sapiens
ttttctcagagat

SEQ ID NO: 5060621 - DNA, 15 bp, Homo sapiens
ttttctcagatctgg

SEQ ID NO: 5060622 - DNA, 21 bp, Homo sapiens
ttttctcaggagcttcaatga

SEQ ID NO: 5060623 - DNA, 18 bp, Homo sapiens
ttttctcagtgtgccctt

SEQ ID NO: 5060624 - DNA, 15 bp, Homo sapiens
ttttctcatgtatct

SEQ ID NO: 5060625 - DNA, 14 bp, Homo sapiens
ttttctccaaataa

SEQ ID NO: 5060626 - DNA, 20 bp, Homo sapiens
ttttctccaatatcagtgct

SEQ ID NO: 5060627 - DNA, 22 bp, Homo sapiens
ttttctccaatttttttttcct

SEQ ID NO: 5060628 - DNA, 15 bp, Homo sapiens
ttttctccacactcc

SEQ ID NO: 5060629 - DNA, 14 bp, Homo sapiens
ttttctccacttca

SEQ ID NO: 5060630 - DNA, 17 bp, Homo sapiens
ttttctccactttgttg

SEQ ID NO: 5060631 - DNA, 19 bp, Homo sapiens
ttttctcccaagaaacctg

SEQ ID NO: 5060632 - DNA, 23 bp, Homo sapiens
ttttctccccacgatgatatcta

SEQ ID NO: 5060633 - DNA, 15 bp, Homo sapiens
ttttctccctctcat

SEQ ID NO: 5060634 - DNA, 14 bp, Homo sapiens
ttttctcctaggag

SEQ ID NO: 5060635 - DNA, 20 bp, Homo sapiens
ttttctcctgcatgtgtata

SEQ ID NO: 5060636 - DNA, 11 bp, Homo sapiens
ttttctccttc

SEQ ID NO: 5060637 - DNA, 18 bp, Homo sapiens
ttttctcgtccccctccc

SEQ ID NO: 5060638 - DNA, 19 bp, Homo sapiens
ttttctcgtccccctccct

SEQ ID NO: 5060639 - DNA, 14 bp, Homo sapiens
ttttctctaaactg

SEQ ID NO: 5060640 - DNA, 21 bp, Homo sapiens
ttttctctagaagctgtctgc

SEQ ID NO: 5060641 - DNA, 19 bp, Homo sapiens
ttttctctataaagggtca

SEQ ID NO: 5060642 - DNA, 23 bp, Homo sapiens
ttttctctatgaaaagcaactga

SEQ ID NO: 5060643 - DNA, 18 bp, Homo sapiens
ttttctctcctgtcctcc

SEQ ID NO: 5060644 - DNA, 12 bp, Homo sapiens
ttttctctctgg

SEQ ID NO: 5060645 - DNA, 14 bp, Homo sapiens
ttttctctctggat

SEQ ID NO: 5060646 - DNA, 19 bp, Homo sapiens
ttttctctgatcacaactt

SEQ ID NO: 5060647 - DNA, 12 bp, Homo sapiens
ttttctcttaga

SEQ ID NO: 5060648 - DNA, 14 bp, Homo sapiens
ttttctcttagaaa

SEQ ID NO: 5060649 - DNA, 16 bp, Homo sapiens
ttttctcttatctgtg

SEQ ID NO: 5060650 - DNA, 22 bp, Homo sapiens
ttttctcttgccccaaatcaca

SEQ ID NO: 5060651 - DNA, 12 bp, Homo sapiens
ttttctctttct

SEQ ID NO: 5060652 - DNA, 15 bp, Homo sapiens
ttttctctttctctc

SEQ ID NO: 5060653 - DNA, 12 bp, Homo sapiens
ttttctcttttt

SEQ ID NO: 5060654 - DNA, 13 bp, Homo sapiens
ttttctgaaacta

SEQ ID NO: 5060655 - DNA, 15 bp, Homo sapiens
ttttctgaaactaat

SEQ ID NO: 5060656 - DNA, 16 bp, Homo sapiens
ttttctgaacaaaagc

SEQ ID NO: 5060657 - DNA, 17 bp, Homo sapiens
ttttctgaataacattt

SEQ ID NO: 5060658 - DNA, 21 bp, Homo sapiens
ttttctgaattcataaaaata

SEQ ID NO: 5060659 - DNA, 12 bp, Homo sapiens
ttttctgaccaa

SEQ ID NO: 5060660 - DNA, 15 bp, Homo sapiens
ttttctgaccaaaat

SEQ ID NO: 5060661 - DNA, 13 bp, Homo sapiens
ttttctgactaat

SEQ ID NO: 5060662 - DNA, 22 bp, Homo sapiens
ttttctgagcccgggctgcctg

SEQ ID NO: 5060663 - DNA, 23 bp, Homo sapiens
ttttctgaggtccttatgtcctg

SEQ ID NO: 5060664 - DNA, 15 bp, Homo sapiens
ttttctgatccagtt

SEQ ID NO: 5060665 - DNA, 23 bp, Homo sapiens
ttttctgatcgtctcggcccctc

SEQ ID NO: 5060666 - DNA, 22 bp, Homo sapiens
ttttctgatgacataataaaga

SEQ ID NO: 5060667 - DNA, 23 bp, Homo sapiens
ttttctgatgggaggaaagtagc

SEQ ID NO: 5060668 - DNA, 11 bp, Homo sapiens
ttttctgatta

SEQ ID NO: 5060669 - DNA, 12 bp, Homo sapiens
ttttctgcacag

SEQ ID NO: 5060670 - DNA, 22 bp, Homo sapiens
ttttctgcacagcttttccaaa

SEQ ID NO: 5060671 - DNA, 19 bp, Homo sapiens
ttttctgcactatatgcaa

SEQ ID NO: 5060672 - DNA, 16 bp, Homo sapiens
ttttctgcactgagca

SEQ ID NO: 5060673 - DNA, 19 bp, Homo sapiens
ttttctgcccaactttcat

SEQ ID NO: 5060674 - DNA, 13 bp, Homo sapiens
ttttctgccctgg

SEQ ID NO: 5060675 - DNA, 16 bp, Homo sapiens
ttttctgccctggctg

SEQ ID NO: 5060676 - DNA, 14 bp, Homo sapiens
ttttctgcctgaga

SEQ ID NO: 5060677 - DNA, 16 bp, Homo sapiens
ttttctgcgcttcagt

SEQ ID NO: 5060678 - DNA, 18 bp, Homo sapiens
ttttctgctacctggttt

SEQ ID NO: 5060679 - DNA, 12 bp, Homo sapiens
ttttctgctgtt

SEQ ID NO: 5060680 - DNA, 16 bp, Homo sapiens
ttttctggaaaatgct

SEQ ID NO: 5060681 - DNA, 19 bp, Homo sapiens
ttttgctttctgaaattca

SEQ ID NO: 5060682 - DNA, 12 bp, Homo sapiens
ttttgcttttgt

SEQ ID NO: 5060683 - DNA, 13 bp, Homo sapiens
ttttggaaaaatg

SEQ ID NO: 5060684 - DNA, 18 bp, Homo sapiens
ttttggaaaaatgtcact

SEQ ID NO: 5060685 - DNA, 22 bp, Homo sapiens
ttttggaaaacgatttaattta

SEQ ID NO: 5060686 - DNA, 18 bp, Homo sapiens
ttttggaaattcagaagc

SEQ ID NO: 5060687 - DNA, 18 bp, Homo sapiens
ttttggaacgcagttgat

SEQ ID NO: 5060688 - DNA, 18 bp, Homo sapiens
ttttggaactatgaagac

SEQ ID NO: 5060689 - DNA, 13 bp, Homo sapiens
ttttggaagacat

SEQ ID NO: 5060690 - DNA, 16 bp, Homo sapiens
ttttggaagacatata

SEQ ID NO: 5060691 - DNA, 17 bp, Homo sapiens
ttttggaagacatatat

SEQ ID NO: 5060692 - DNA, 23 bp, Homo sapiens
ttttggaagacatatattatata

SEQ ID NO: 5060693 - DNA, 22 bp, Homo sapiens
ttttggaagagacaaagatttc

SEQ ID NO: 5060694 - DNA, 23 bp, Homo sapiens
ttttggaagagacaaagatttct

SEQ ID NO: 5060695 - DNA, 11 bp, Homo sapiens
ttttggaatca

SEQ ID NO: 5060696 - DNA, 11 bp, Homo sapiens
ttttggaatct

SEQ ID NO: 5060697 - DNA, 22 bp, Homo sapiens
ttttggaatctagaagaaatga

SEQ ID NO: 5060698 - DNA, 18 bp, Homo sapiens
ttttggaattcagcagtt

SEQ ID NO: 5060699 - DNA, 15 bp, Homo sapiens
ttttggaattttcct

SEQ ID NO: 5060700 - DNA, 19 bp, Homo sapiens
ttttggactagccagaatt

SEQ ID NO: 5060701 - DNA, 17 bp, Homo sapiens
ttttggactccatctct

SEQ ID NO: 5060702 - DNA, 15 bp, Homo sapiens
ttttggactctctgt

SEQ ID NO: 5060703 - DNA, 17 bp, Homo sapiens
ttttggacttcaaagca

SEQ ID NO: 5060704 - DNA, 20 bp, Homo sapiens
ttttggagaaggttatcaaa

SEQ ID NO: 5060705 - DNA, 18 bp, Homo sapiens
ttttggagattataataa

SEQ ID NO: 5060706 - DNA, 19 bp, Homo sapiens
ttttggaggtgcttgatct

SEQ ID NO: 5060707 - DNA, 21 bp, Homo sapiens
ttttggaggtgcttgatctat

SEQ ID NO: 5060708 - DNA, 21 bp, Homo sapiens
ttttggagtgcttaaaaatgc

SEQ ID NO: 5060709 - DNA, 20 bp, Homo sapiens
ttttggagtgttatgtattt

SEQ ID NO: 5060710 - DNA, 22 bp, Homo sapiens
ttttggatgaatgcagtataaa

SEQ ID NO: 5060711 - DNA, 19 bp, Homo sapiens
ttttggatgattaaaaaat

SEQ ID NO: 5060712 - DNA, 16 bp, Homo sapiens
ttttggatgttgctat

SEQ ID NO: 5060713 - DNA, 16 bp, Homo sapiens
ttttggattgtatatt

SEQ ID NO: 5060714 - DNA, 20 bp, Homo sapiens
ttttggatttggagagaaat

SEQ ID NO: 5060715 - DNA, 23 bp, Homo sapiens
ttttggcaatgactcaaagtctg

SEQ ID NO: 5060716 - DNA, 22 bp, Homo sapiens
ttttggcacttgccattccaaa

SEQ ID NO: 5060717 - DNA, 21 bp, Homo sapiens
ttttggcataacataaatctg

SEQ ID NO: 5060718 - DNA, 19 bp, Homo sapiens
ttttggcatctctgtccca

SEQ ID NO: 5060719 - DNA, 18 bp, Homo sapiens
ttttggcatctgcaaagg

SEQ ID NO: 5060720 - DNA, 17 bp, Homo sapiens
ttttggcatgaaagtgc

SEQ ID NO: 5060721 - DNA, 22 bp, Homo sapiens
ttttggcattatctctttctct

SEQ ID NO: 5060722 - DNA, 19 bp, Homo sapiens
ttttggccaccccttgctc

SEQ ID NO: 5060723 - DNA, 17 bp, Homo sapiens
ttttggcctttgtaaga

SEQ ID NO: 5060724 - DNA, 22 bp, Homo sapiens
ttttggctgaaattctcctgga

SEQ ID NO: 5060725 - DNA, 22 bp, Homo sapiens
ttttgggaaaaattatttgtgt

SEQ ID NO: 5060726 - DNA, 22 bp, Homo sapiens
ttttgggaaattcttgcactgt

SEQ ID NO: 5060727 - DNA, 22 bp, Homo sapiens
ttttgggaagacgttttcttta

SEQ ID NO: 5060728 - DNA, 20 bp, Homo sapiens
ttttgggaggtccaggcagg

SEQ ID NO: 5060729 - DNA, 20 bp, Homo sapiens
ttttgggatctaactgttgt

SEQ ID NO: 5060730 - DNA, 18 bp, Homo sapiens
ttttgggatttgttgaaa

SEQ ID NO: 5060731 - DNA, 23 bp, Homo sapiens
ttttgggatttgttgaaatcttt

SEQ ID NO: 5060732 - DNA, 22 bp, Homo sapiens
ttttggggaactgttgtttgat

SEQ ID NO: 5060733 - DNA, 21 bp, Homo sapiens
ttttggggagtacctgtccaa

SEQ ID NO: 5060734 - DNA, 21 bp, Homo sapiens
ttttggggatatgcttagtaa

SEQ ID NO: 5060735 - DNA, 18 bp, Homo sapiens
ttttggggctcttgatca

SEQ ID NO: 5060736 - DNA, 13 bp, Homo sapiens
ttttgggggcttt

SEQ ID NO: 5060737 - DNA, 21 bp, Homo sapiens
ttttggggggcagagaataaa

SEQ ID NO: 5060738 - DNA, 19 bp, Homo sapiens
ttttgggggtcagcatcca

SEQ ID NO: 5060739 - DNA, 21 bp, Homo sapiens
ttttgggggtcagcatccagt

SEQ ID NO: 5060740 - DNA, 16 bp, Homo sapiens
ttttggggttcaagaa

SEQ ID NO: 5060741 - DNA, 21 bp, Homo sapiens
ttttgggtactggagctttta

SEQ ID NO: 5060742 - DNA, 23 bp, Homo sapiens
ttttgggtattgtaatctgaagt

SEQ ID NO: 5060743 - DNA, 16 bp, Homo sapiens
ttttgggtgaatcttg

SEQ ID NO: 5060744 - DNA, 21 bp, Homo sapiens
ttttgggttgtttaaaaattt

SEQ ID NO: 5060745 - DNA, 18 bp, Homo sapiens
ttttgggttttcttccct

SEQ ID NO: 5060746 - DNA, 22 bp, Homo sapiens
ttttggtaaatatgagactatt

SEQ ID NO: 5060747 - DNA, 22 bp, Homo sapiens
ttttggtaaatttttgaaaaat

SEQ ID NO: 5060748 - DNA, 16 bp, Homo sapiens
ttttggtagattaaat

SEQ ID NO: 5060749 - DNA, 17 bp, Homo sapiens
ttttggtagattaaata

SEQ ID NO: 5060750 - DNA, 14 bp, Homo sapiens
ttttggtataatgt

SEQ ID NO: 5060751 - DNA, 14 bp, Homo sapiens
ttttggtcattgta

SEQ ID NO: 5060752 - DNA, 21 bp, Homo sapiens
ttttggtccaagttgtgctta

SEQ ID NO: 5060753 - DNA, 20 bp, Homo sapiens
ttttggtccacttttccagt

SEQ ID NO: 5060754 - DNA, 14 bp, Homo sapiens
ttttggtcccctcc

SEQ ID NO: 5060755 - DNA, 18 bp, Homo sapiens
ttttggtccttctttcct

SEQ ID NO: 5060756 - DNA, 15 bp, Homo sapiens
ttttggtctgtgtga

SEQ ID NO: 5060757 - DNA, 21 bp, Homo sapiens
ttttggtcttcagcctccctc

SEQ ID NO: 5060758 - DNA, 17 bp, Homo sapiens
ttttggtgattcaaatg

SEQ ID NO: 5060759 - DNA, 13 bp, Homo sapiens
ttttggtgcaata

SEQ ID NO: 5060760 - DNA, 14 bp, Homo sapiens
ttttggtggatgta

SEQ ID NO: 5060761 - DNA, 14 bp, Homo sapiens
ttcatgtaaaaagt

SEQ ID NO: 5060762 - DNA, 16 bp, Homo sapiens
ttcatgtaaagtgtca

SEQ ID NO: 5060763 - DNA, 19 bp, Homo sapiens
ttcatgtaacagttgtgtc

SEQ ID NO: 5060764 - DNA, 16 bp, Homo sapiens
ttcatgtaactctcca

SEQ ID NO: 5060765 - DNA, 23 bp, Homo sapiens
ttcatgtaagtagcaaacagggc

SEQ ID NO: 5060766 - DNA, 15 bp, Homo sapiens
ttcatgtaataaatc

SEQ ID NO: 5060767 - DNA, 18 bp, Homo sapiens
ttcatgtaatcctcaaga

SEQ ID NO: 5060768 - DNA, 17 bp, Homo sapiens
ttcatgtacaagatgaa

SEQ ID NO: 5060769 - DNA, 12 bp, Homo sapiens
ttcatgtacagc

SEQ ID NO: 5060770 - DNA, 16 bp, Homo sapiens
ttcatgtacagcatgc

SEQ ID NO: 5060771 - DNA, 13 bp, Homo sapiens
ttcatgtacattt

SEQ ID NO: 5060772 - DNA, 20 bp, Homo sapiens
ttcatgtagaactcagcagt

SEQ ID NO: 5060773 - DNA, 17 bp, Homo sapiens
ttcatgtatgtatataa

SEQ ID NO: 5060774 - DNA, 19 bp, Homo sapiens
ttcatgtatttctttagaa

SEQ ID NO: 5060775 - DNA, 15 bp, Homo sapiens
ttcatgtattttaca

SEQ ID NO: 5060776 - DNA, 20 bp, Homo sapiens
ttcatgtccagagctcattt

SEQ ID NO: 5060777 - DNA, 22 bp, Homo sapiens
ttcatgtccagtgagcagtgtt

SEQ ID NO: 5060778 - DNA, 16 bp, Homo sapiens
ttcatgtcccagaact

SEQ ID NO: 5060779 - DNA, 22 bp, Homo sapiens
ttcatgtcctaaagaagacatt

SEQ ID NO: 5060780 - DNA, 23 bp, Homo sapiens
ttcatgtcctgtgtcagtttatg

SEQ ID NO: 5060781 - DNA, 20 bp, Homo sapiens
ttcatgtctgaaacagagaa

SEQ ID NO: 5060782 - DNA, 16 bp, Homo sapiens
ttcatgtctgctatca

SEQ ID NO: 5060783 - DNA, 22 bp, Homo sapiens
ttcatgtctttccacttctctg

SEQ ID NO: 5060784 - DNA, 21 bp, Homo sapiens
ttcatgtgcctctgcggggca

SEQ ID NO: 5060785 - DNA, 18 bp, Homo sapiens
ttcatgtgcttgtgccta

SEQ ID NO: 5060786 - DNA, 13 bp, Homo sapiens
ttcatgttagtta

SEQ ID NO: 5060787 - DNA, 18 bp, Homo sapiens
ttcatgttcactgtgagt

SEQ ID NO: 5060788 - DNA, 22 bp, Homo sapiens
ttcatgttctgagctataacat

SEQ ID NO: 5060789 - DNA, 21 bp, Homo sapiens
ttcatgttggatctgtcatta

SEQ ID NO: 5060790 - DNA, 18 bp, Homo sapiens
ttcatgtttaagaaatga

SEQ ID NO: 5060791 - DNA, 14 bp, Homo sapiens
ttcatgtttggaaa

SEQ ID NO: 5060792 - DNA, 17 bp, Homo sapiens
ttcatgttttaacaaaa

SEQ ID NO: 5060793 - DNA, 14 bp, Homo sapiens
ttcatgttttgcta

SEQ ID NO: 5060794 - DNA, 18 bp, Homo sapiens
ttcatgttttgtgactat

SEQ ID NO: 5060795 - DNA, 17 bp, Homo sapiens
ttcattaaaaacatttt

SEQ ID NO: 5060796 - DNA, 17 bp, Homo sapiens
ttcattaaaacaagaga

SEQ ID NO: 5060797 - DNA, 12 bp, Homo sapiens
ttcattaaactt

SEQ ID NO: 5060798 - DNA, 13 bp, Homo sapiens
ttcattaaacttg

SEQ ID NO: 5060799 - DNA, 20 bp, Homo sapiens
ttcattaaacttgaagcagt

SEQ ID NO: 5060800 - DNA, 17 bp, Homo sapiens
ttcattaaccaaagaaa

SEQ ID NO: 5060801 - DNA, 19 bp, Homo sapiens
ttcattaagttgtaaaatg

SEQ ID NO: 5060802 - DNA, 14 bp, Homo sapiens
ttcattaataggaa

SEQ ID NO: 5060803 - DNA, 17 bp, Homo sapiens
ttcattaatctgtttgt

SEQ ID NO: 5060804 - DNA, 15 bp, Homo sapiens
ttcattaatgtttat

SEQ ID NO: 5060805 - DNA, 21 bp, Homo sapiens
ttcattacatttctgaattgt

SEQ ID NO: 5060806 - DNA, 13 bp, Homo sapiens
ttcattaccaggt

SEQ ID NO: 5060807 - DNA, 20 bp, Homo sapiens
ttcattaccctacagacagc

SEQ ID NO: 5060808 - DNA, 20 bp, Homo sapiens
ttcattactagataaaatgt

SEQ ID NO: 5060809 - DNA, 12 bp, Homo sapiens
ttcattacttga

SEQ ID NO: 5060810 - DNA, 14 bp, Homo sapiens
ttcattacttttaa

SEQ ID NO: 5060811 - DNA, 20 bp, Homo sapiens
ttcattagaaatattttaaa

SEQ ID NO: 5060812 - DNA, 13 bp, Homo sapiens
ttcattagagcag

SEQ ID NO: 5060813 - DNA, 20 bp, Homo sapiens
ttcattagcaaaaaaagttg

SEQ ID NO: 5060814 - DNA, 21 bp, Homo sapiens
ttcattagcaaaaaaagttgt

SEQ ID NO: 5060815 - DNA, 22 bp, Homo sapiens
ttcattagcaaaaaaagttgta

SEQ ID NO: 5060816 - DNA, 22 bp, Homo sapiens
ttcattagccatgcaacatgga

SEQ ID NO: 5060817 - DNA, 15 bp, Homo sapiens
ttcattaggcaaagt

SEQ ID NO: 5060818 - DNA, 16 bp, Homo sapiens
ttcattaggcaaagta

SEQ ID NO: 5060819 - DNA, 21 bp, Homo sapiens
ttcattagggcaaagatctca

SEQ ID NO: 5060820 - DNA, 17 bp, Homo sapiens
ttcattatctgagttgc

SEQ ID NO: 5060821 - DNA, 22 bp, Homo sapiens
ttcattatctgtactgaaagca

SEQ ID NO: 5060822 - DNA, 17 bp, Homo sapiens
ttcattatgtaaaatgt

SEQ ID NO: 5060823 - DNA, 16 bp, Homo sapiens
ttcattatgttcatgt

SEQ ID NO: 5060824 - DNA, 19 bp, Homo sapiens
ttcattattcaagaatgaa

SEQ ID NO: 5060825 - DNA, 23 bp, Homo sapiens
ttcattattcaagaatgaaaaat

SEQ ID NO: 5060826 - DNA, 13 bp, Homo sapiens
ttcattattctct

SEQ ID NO: 5060827 - DNA, 20 bp, Homo sapiens
ttcattattggaattaacct

SEQ ID NO: 5060828 - DNA, 22 bp, Homo sapiens
ttcattattttattatgaaact

SEQ ID NO: 5060829 - DNA, 13 bp, Homo sapiens
ttcattattttcc

SEQ ID NO: 5060830 - DNA, 15 bp, Homo sapiens
ttcattattttgtgg

SEQ ID NO: 5060831 - DNA, 16 bp, Homo sapiens
ttcattattttgtggt

SEQ ID NO: 5060832 - DNA, 14 bp, Homo sapiens
ttcattcaaactgc

SEQ ID NO: 5060833 - DNA, 18 bp, Homo sapiens
ttcattcaaactgcactt

SEQ ID NO: 5060834 - DNA, 13 bp, Homo sapiens
ttcattcaagcta

SEQ ID NO: 5060835 - DNA, 14 bp, Homo sapiens
ttcattcaagctat

SEQ ID NO: 5060836 - DNA, 14 bp, Homo sapiens
ttcattcactgtgc

SEQ ID NO: 5060837 - DNA, 16 bp, Homo sapiens
ttcattcactgtgcac

SEQ ID NO: 5060838 - DNA, 15 bp, Homo sapiens
ttcattcagatataa

SEQ ID NO: 5060839 - DNA, 21 bp, Homo sapiens
ttcattcagatataagatttg

SEQ ID NO: 5060840 - DNA, 12 bp, Homo sapiens
ttcattcatatc

SEQ ID NO: 5060841 - DNA, 12 bp, Homo sapiens
ttcattcatatt

SEQ ID NO: 5060842 - DNA, 14 bp, Homo sapiens
ttcattcatattac

SEQ ID NO: 5060843 - DNA, 12 bp, Homo sapiens
ttcattcatttt

SEQ ID NO: 5060844 - DNA, 15 bp, Homo sapiens
ttcattccacaggac

SEQ ID NO: 5060845 - DNA, 18 bp, Homo sapiens
ttcattccatttgctgat

SEQ ID NO: 5060846 - DNA, 19 bp, Homo sapiens
ttcattcccttctctcagc

SEQ ID NO: 5060847 - DNA, 20 bp, Homo sapiens
ttcattcccttctctcagcc

SEQ ID NO: 5060848 - DNA, 20 bp, Homo sapiens
ttcattccggactggcagaa

SEQ ID NO: 5060849 - DNA, 22 bp, Homo sapiens
ttcattccgttaggaataacac

SEQ ID NO: 5060850 - DNA, 17 bp, Homo sapiens
ttcattcctcacaatga

SEQ ID NO: 5060851 - DNA, 22 bp, Homo sapiens
ttcattcctcacaatgaggcta

SEQ ID NO: 5060852 - DNA, 12 bp, Homo sapiens
ttcattcctgtc

SEQ ID NO: 5060853 - DNA, 12 bp, Homo sapiens
ttcattctcaga

SEQ ID NO: 5060854 - DNA, 12 bp, Homo sapiens
ttcattctcata

SEQ ID NO: 5060855 - DNA, 18 bp, Homo sapiens
ttcattctcataattcct

SEQ ID NO: 5060856 - DNA, 21 bp, Homo sapiens
ttcattctcattgcagaataa

SEQ ID NO: 5060857 - DNA, 23 bp, Homo sapiens
acgccaatgttatgccagctcca

SEQ ID NO: 5060858 - DNA, 15 bp, Homo sapiens
acgccacagcccagc

SEQ ID NO: 5060859 - DNA, 17 bp, Homo sapiens
acgccacagcccttttg

SEQ ID NO: 5060860 - DNA, 12 bp, Homo sapiens
acgccacccagc

SEQ ID NO: 5060861 - DNA, 20 bp, Homo sapiens
acgccacccccgcccccacc

SEQ ID NO: 5060862 - DNA, 21 bp, Homo sapiens
acgccaccctgcccacccccg

SEQ ID NO: 5060863 - DNA, 15 bp, Homo sapiens
acgccactcatttca

SEQ ID NO: 5060864 - DNA, 18 bp, Homo sapiens
acgccactgcactatagc

SEQ ID NO: 5060865 - DNA, 20 bp, Homo sapiens
acgccactgcactccagcct

SEQ ID NO: 5060866 - DNA, 22 bp, Homo sapiens
acgccactgcactccagcctgg

SEQ ID NO: 5060867 - DNA, 19 bp, Homo sapiens
acgccagattctttcctga

SEQ ID NO: 5060868 - DNA, 22 bp, Homo sapiens
acgccagattctttcctgaggc

SEQ ID NO: 5060869 - DNA, 14 bp, Homo sapiens
acgccagctcctct

SEQ ID NO: 5060870 - DNA, 13 bp, Homo sapiens
acgccagctggcc

SEQ ID NO: 5060871 - DNA, 17 bp, Homo sapiens
acgccagctggcccagt

SEQ ID NO: 5060872 - DNA, 18 bp, Homo sapiens
acgccaggcaccacagcc

SEQ ID NO: 5060873 - DNA, 20 bp, Homo sapiens
acgccaggcaccacagcctc

SEQ ID NO: 5060874 - DNA, 18 bp, Homo sapiens
acgccagggaccccagaa

SEQ ID NO: 5060875 - DNA, 18 bp, Homo sapiens
acgccaggggaaaatcag

SEQ ID NO: 5060876 - DNA, 14 bp, Homo sapiens
acgccagtctccca

SEQ ID NO: 5060877 - DNA, 14 bp, Homo sapiens
acgccatcccagcc

SEQ ID NO: 5060878 - DNA, 21 bp, Homo sapiens
acgccattctcctgcctcagc

SEQ ID NO: 5060879 - DNA, 19 bp, Homo sapiens
acgccattgcactccagcc

SEQ ID NO: 5060880 - DNA, 20 bp, Homo sapiens
acgccattgcactccagcct

SEQ ID NO: 5060881 - DNA, 20 bp, Homo sapiens
acgccattgtactccagcct

SEQ ID NO: 5060882 - DNA, 21 bp, Homo sapiens
acgccattgtactccagcctg

SEQ ID NO: 5060883 - DNA, 15 bp, Homo sapiens
acgcccaccagcctt

SEQ ID NO: 5060884 - DNA, 18 bp, Homo sapiens
acgcccaccagccttgct

SEQ ID NO: 5060885 - DNA, 19 bp, Homo sapiens
acgcccaccagccttgctc

SEQ ID NO: 5060886 - DNA, 17 bp, Homo sapiens
acgcccacccccagtct

SEQ ID NO: 5060887 - DNA, 10 bp, Homo sapiens
acgcccacct

SEQ ID NO: 5060888 - DNA, 13 bp, Homo sapiens
acgcccacttccc

SEQ ID NO: 5060889 - DNA, 11 bp, Homo sapiens
acgcccagccc

SEQ ID NO: 5060890 - DNA, 13 bp, Homo sapiens
acgcccagccccc

SEQ ID NO: 5060891 - DNA, 19 bp, Homo sapiens
acgcccagcctcctcccac

SEQ ID NO: 5060892 - DNA, 12 bp, Homo sapiens
acgcccagctcc

SEQ ID NO: 5060893 - DNA, 13 bp, Homo sapiens
acgcccagctccg

SEQ ID NO: 5060894 - DNA, 15 bp, Homo sapiens
acgcccaggacccca

SEQ ID NO: 5060895 - DNA, 12 bp, Homo sapiens
acgccccaggac

SEQ ID NO: 5060896 - DNA, 17 bp, Homo sapiens
acgcccccaggaatgca

SEQ ID NO: 5060897 - DNA, 19 bp, Homo sapiens
acgcccccatgcagtgacc

SEQ ID NO: 5060898 - DNA, 16 bp, Homo sapiens
acgcccccccccaccc

SEQ ID NO: 5060899 - DNA, 21 bp, Homo sapiens
acgccccggtcccccagagca

SEQ ID NO: 5060900 - DNA, 20 bp, Homo sapiens
acgccccgtgtctggatgca

SEQ ID NO: 5060901 - DNA, 15 bp, Homo sapiens
acgcccctcccaagc

SEQ ID NO: 5060902 - DNA, 16 bp, Homo sapiens
acgcccctccccagcc

SEQ ID NO: 5060903 - DNA, 17 bp, Homo sapiens
acgcccctccccagccc

SEQ ID NO: 5060904 - DNA, 18 bp, Homo sapiens
acgcccctccctcctctg

SEQ ID NO: 5060905 - DNA, 23 bp, Homo sapiens
acgcccctccctcctctggccca

SEQ ID NO: 5060906 - DNA, 14 bp, Homo sapiens
acgcccctgtggcc

SEQ ID NO: 5060907 - DNA, 15 bp, Homo sapiens
acgcccctgtggcca

SEQ ID NO: 5060908 - DNA, 16 bp, Homo sapiens
acgcccctttctcttg

SEQ ID NO: 5060909 - DNA, 16 bp, Homo sapiens
acgcccgactctctcc

SEQ ID NO: 5060910 - DNA, 18 bp, Homo sapiens
acgcccggctaatgtttg

SEQ ID NO: 5060911 - DNA, 18 bp, Homo sapiens
acgcccgtcctgcctgtg

SEQ ID NO: 5060912 - DNA, 16 bp, Homo sapiens
acgccctactccactg

SEQ ID NO: 5060913 - DNA, 21 bp, Homo sapiens
acgccctactccactgccctg

SEQ ID NO: 5060914 - DNA, 19 bp, Homo sapiens
acgccctaggaggagaact

SEQ ID NO: 5060915 - DNA, 13 bp, Homo sapiens
acgccctattttt

SEQ ID NO: 5060916 - DNA, 19 bp, Homo sapiens
acgccctcccctcccctgc

SEQ ID NO: 5060917 - DNA, 21 bp, Homo sapiens
acgccctctccccacccctac

SEQ ID NO: 5060918 - DNA, 19 bp, Homo sapiens
acgccctgcgttggagcca

SEQ ID NO: 5060919 - DNA, 22 bp, Homo sapiens
acgccctgggcctgcacctctc

SEQ ID NO: 5060920 - DNA, 12 bp, Homo sapiens
acgccctgttcc

SEQ ID NO: 5060921 - DNA, 17 bp, Homo sapiens
acgccctgttcccttcc

SEQ ID NO: 5060922 - DNA, 20 bp, Homo sapiens
acgccctgttcccttcctgc

SEQ ID NO: 5060923 - DNA, 21 bp, Homo sapiens
acgccctttcctcctcaggca

SEQ ID NO: 5060924 - DNA, 18 bp, Homo sapiens
acgccgatataagccata

SEQ ID NO: 5060925 - DNA, 22 bp, Homo sapiens
acgccgccctccatccgtgctg

SEQ ID NO: 5060926 - DNA, 16 bp, Homo sapiens
acgccggccacacccc

SEQ ID NO: 5060927 - DNA, 13 bp, Homo sapiens
acgccggcctctg

SEQ ID NO: 5060928 - DNA, 15 bp, Homo sapiens
acgccggcctctgct

SEQ ID NO: 5060929 - DNA, 19 bp, Homo sapiens
acgccggcctctgctgccc

SEQ ID NO: 5060930 - DNA, 22 bp, Homo sapiens
acgccggggacagaggcctgcc

SEQ ID NO: 5060931 - DNA, 23 bp, Homo sapiens
acgccggggacagaggcctgccc

SEQ ID NO: 5060932 - DNA, 23 bp, Homo sapiens
acgccggggctggccctgccctc

SEQ ID NO: 5060933 - DNA, 18 bp, Homo sapiens
acgccgtaattctttctg

SEQ ID NO: 5060934 - DNA, 19 bp, Homo sapiens
acgccgtcccaccagcttc

SEQ ID NO: 5060935 - DNA, 21 bp, Homo sapiens
acgccgtcccaccagcttcac

SEQ ID NO: 5060936 - DNA, 18 bp, Homo sapiens
acgccgtctccatggcat

SEQ ID NO: 5060937 - DNA, 17 bp, Homo sapiens
acgcctagcctcacgct

SEQ ID NO: 5060938 - DNA, 18 bp, Homo sapiens
acgcctcactgaaacatg

SEQ ID NO: 5060939 - DNA, 14 bp, Homo sapiens
acgcctcccactgg

SEQ ID NO: 5060940 - DNA, 15 bp, Homo sapiens
acgcctcctggccag

SEQ ID NO: 5060941 - DNA, 11 bp, Homo sapiens
acgcctctccc

SEQ ID NO: 5060942 - DNA, 12 bp, Homo sapiens
acgcctctctca

SEQ ID NO: 5060943 - DNA, 20 bp, Homo sapiens
acgcctctctcagcccaggt

SEQ ID NO: 5060944 - DNA, 21 bp, Homo sapiens
acgcctctctcagcccaggtc

SEQ ID NO: 5060945 - DNA, 20 bp, Homo sapiens
acgcctctggacctcggtga

SEQ ID NO: 5060946 - DNA, 15 bp, Homo sapiens
acgcctcttgaccag

SEQ ID NO: 5060947 - DNA, 18 bp, Homo sapiens
acgcctcttgttcatgtc

SEQ ID NO: 5060948 - DNA, 21 bp, Homo sapiens
acgcctgaaactttgaggata

SEQ ID NO: 5060949 - DNA, 17 bp, Homo sapiens
acgcctgagacagcacc

SEQ ID NO: 5060950 - DNA, 13 bp, Homo sapiens
acgcctgagccca

SEQ ID NO: 5060951 - DNA, 16 bp, Homo sapiens
acgcctgagcccaggg

SEQ ID NO: 5060952 - DNA, 21 bp, Homo sapiens
acgcctgaggaacccttacag

SEQ ID NO: 5060953 - DNA, 19 bp, Homo sapiens
acgcctgaggcaattagac

SEQ ID NO: 5060954 - DNA, 21 bp, Homo sapiens
acgcctgatggtgctgctcag

SEQ ID NO: 5060955 - DNA, 14 bp, Homo sapiens
acgcctgcaaacgc

SEQ ID NO: 5060956 - DNA, 19 bp, Homo sapiens
acgcctgcaaacgctgcct

SEQ ID NO: 5060957 - DNA, 20 bp, Homo sapiens
acgcctgcaaacgctgcctg

SEQ ID NO: 5060958 - DNA, 22 bp, Homo sapiens
acgcctgcaggagagagcagca

SEQ ID NO: 5060959 - DNA, 21 bp, Homo sapiens
acgcctgccctccccagagca

SEQ ID NO: 5060960 - DNA, 12 bp, Homo sapiens
acgcctgcctcc

SEQ ID NO: 5060961 - DNA, 12 bp, Homo sapiens
acgcctgcgatg

SEQ ID NO: 5060962 - DNA, 13 bp, Homo sapiens
acgcctgctggcc

SEQ ID NO: 5060963 - DNA, 17 bp, Homo sapiens
acgcctgcttgtccctg

SEQ ID NO: 5060964 - DNA, 16 bp, Homo sapiens
acgcctgcttttgcaa

SEQ ID NO: 5060965 - DNA, 17 bp, Homo sapiens
acgcctggctgctgatc

SEQ ID NO: 5060966 - DNA, 17 bp, Homo sapiens
acgcctgtaatcccagc

SEQ ID NO: 5060967 - DNA, 18 bp, Homo sapiens
acgcctgtcctcctggaa

SEQ ID NO: 5060968 - DNA, 20 bp, Homo sapiens
acgcctgtgccaccccttcc

SEQ ID NO: 5060969 - DNA, 14 bp, Homo sapiens
acgccttcatgcca

SEQ ID NO: 5060970 - DNA, 14 bp, Homo sapiens
acgccttgttcttg

SEQ ID NO: 5060971 - DNA, 18 bp, Homo sapiens
acgcctttaaaggttttt

SEQ ID NO: 5060972 - DNA, 22 bp, Homo sapiens
acgcctttaaaggtttttaaat

SEQ ID NO: 5060973 - DNA, 19 bp, Homo sapiens
acgcgaaaccaattcctca

SEQ ID NO: 5060974 - DNA, 20 bp, Homo sapiens
acgcgaaaccaattcctcat

SEQ ID NO: 5060975 - DNA, 20 bp, Homo sapiens
acgcgacttctcaggacgac

SEQ ID NO: 5060976 - DNA, 17 bp, Homo sapiens
acgcgcccccctcccag

SEQ ID NO: 5060977 - DNA, 23 bp, Homo sapiens
acgcgcctcgccggatctgaggg

SEQ ID NO: 5060978 - DNA, 20 bp, Homo sapiens
acgcgccttgtctcctactc

SEQ ID NO: 5060979 - DNA, 15 bp, Homo sapiens
acgcgcgcacacaca

SEQ ID NO: 5060980 - DNA, 21 bp, Homo sapiens
acgcgcgcgcgcgcacacaca

SEQ ID NO: 5060981 - DNA, 19 bp, Homo sapiens
acgcggccgctctccgccc

SEQ ID NO: 5060982 - DNA, 23 bp, Homo sapiens
acgcggctgctgcttctccctgg

SEQ ID NO: 5060983 - DNA, 23 bp, Homo sapiens
acgcgggcaagcgtgctgcctct

SEQ ID NO: 5060984 - DNA, 17 bp, Homo sapiens
acgcgggctgtgcctta

SEQ ID NO: 5060985 - DNA, 15 bp, Homo sapiens
acgcggtttggtttg

SEQ ID NO: 5060986 - DNA, 13 bp, Homo sapiens
acgcggttttttc

SEQ ID NO: 5060987 - DNA, 20 bp, Homo sapiens
acgcgtatctaggctttggt

SEQ ID NO: 5060988 - DNA, 21 bp, Homo sapiens
acgcgtccacatacactgcat

SEQ ID NO: 5060989 - DNA, 15 bp, Homo sapiens
acgcgtctcctgttt

SEQ ID NO: 5060990 - DNA, 15 bp, Homo sapiens
acgcgtctgcctggg

SEQ ID NO: 5060991 - DNA, 13 bp, Homo sapiens
acgcgtcttcctg

SEQ ID NO: 5060992 - DNA, 15 bp, Homo sapiens
acgcgtcttcctgag

SEQ ID NO: 5060993 - DNA, 17 bp, Homo sapiens
acgcgtcttgccttgtc

SEQ ID NO: 5060994 - DNA, 13 bp, Homo sapiens
acgcgtgcataaa

SEQ ID NO: 5060995 - DNA, 16 bp, Homo sapiens
acgcgtgccgtggcac

SEQ ID NO: 5060996 - DNA, 21 bp, Homo sapiens
acgcgtgtgtacacgggactg

SEQ ID NO: 5060997 - DNA, 23 bp, Homo sapiens
acgcgtgtgtgcctgaacattct

SEQ ID NO: 5060998 - DNA, 17 bp, Homo sapiens
acgctaaagagcccttg

SEQ ID NO: 5060999 - DNA, 18 bp, Homo sapiens
acgctaaagagcccttgc

SEQ ID NO: 5061000 - DNA, 17 bp, Homo sapiens
acgctaagcctggaagc

SEQ ID NO: 5061001 - DNA, 13 bp, Homo sapiens
acgctacccggga

SEQ ID NO: 5061002 - DNA, 21 bp, Homo sapiens
acgctacccgggaagggggct

SEQ ID NO: 5061003 - DNA, 13 bp, Homo sapiens
acgctacggggaa

SEQ ID NO: 5061004 - DNA, 22 bp, Homo sapiens
acgctacggggaaaatgcattt

SEQ ID NO: 5061005 - DNA, 23 bp, Homo sapiens
acgctacggggaaaatgcatttt

SEQ ID NO: 5061006 - DNA, 18 bp, Homo sapiens
acgctactataaagagaa

SEQ ID NO: 5061007 - DNA, 17 bp, Homo sapiens
acgctatgtagaatgtc

SEQ ID NO: 5061008 - DNA, 14 bp, Homo sapiens
acgctattccagct

SEQ ID NO: 5061009 - DNA, 22 bp, Homo sapiens
acgctattccagctgtcccccc

SEQ ID NO: 5061010 - DNA, 20 bp, Homo sapiens
acgctcaagaatcctctggg

SEQ ID NO: 5061011 - DNA, 11 bp, Homo sapiens
acgctcaagga

SEQ ID NO: 5061012 - DNA, 22 bp, Homo sapiens
acgctcaaggaaggatgcctta

SEQ ID NO: 5061013 - DNA, 19 bp, Homo sapiens
acgctcacccagtcacctc

SEQ ID NO: 5061014 - DNA, 19 bp, Homo sapiens
acgctcagccccaggccag

SEQ ID NO: 5061015 - DNA, 16 bp, Homo sapiens
acgctcatgtcctgtc

SEQ ID NO: 5061016 - DNA, 18 bp, Homo sapiens
acgctcatgtcctgtcct

SEQ ID NO: 5061017 - DNA, 22 bp, Homo sapiens
acgctcatgtcctgtcctggtc

SEQ ID NO: 5061018 - DNA, 14 bp, Homo sapiens
acgctcccccgcag

SEQ ID NO: 5061019 - DNA, 21 bp, Homo sapiens
acgctcccccgcagtccccag

SEQ ID NO: 5061020 - DNA, 19 bp, Homo sapiens
acgctccccgcctgttccc

SEQ ID NO: 5061021 - DNA, 17 bp, Homo sapiens
acgctcccctccatccc

SEQ ID NO: 5061022 - DNA, 13 bp, Homo sapiens
acgctccctggaa

SEQ ID NO: 5061023 - DNA, 12 bp, Homo sapiens
acgctcctctgt

SEQ ID NO: 5061024 - DNA, 16 bp, Homo sapiens
acgctcctctgttcag

SEQ ID NO: 5061025 - DNA, 14 bp, Homo sapiens
acgctcctttctga

SEQ ID NO: 5061026 - DNA, 20 bp, Homo sapiens
acgctcctttctgatcttca

SEQ ID NO: 5061027 - DNA, 18 bp, Homo sapiens
acgctctaccctgcagct

SEQ ID NO: 5061028 - DNA, 15 bp, Homo sapiens
acgctctctgtctgg

SEQ ID NO: 5061029 - DNA, 20 bp, Homo sapiens
acgctgaagcggtcagactg

SEQ ID NO: 5061030 - DNA, 16 bp, Homo sapiens
acgctgaataaatgtc

SEQ ID NO: 5061031 - DNA, 18 bp, Homo sapiens
acgctgaataaatgtctt

SEQ ID NO: 5061032 - DNA, 19 bp, Homo sapiens
acgctgaataaatgtcttt

SEQ ID NO: 5061033 - DNA, 12 bp, Homo sapiens
acgctgacaata

SEQ ID NO: 5061034 - DNA, 13 bp, Homo sapiens
actaactggcagg

SEQ ID NO: 5061035 - DNA, 14 bp, Homo sapiens
actaactgtggaca

SEQ ID NO: 5061036 - DNA, 12 bp, Homo sapiens
actaacttattt

SEQ ID NO: 5061037 - DNA, 18 bp, Homo sapiens
actaacttattttgattg

SEQ ID NO: 5061038 - DNA, 20 bp, Homo sapiens
actaacttcttccacttttt

SEQ ID NO: 5061039 - DNA, 14 bp, Homo sapiens
actaacttgtcttt

SEQ ID NO: 5061040 - DNA, 11 bp, Homo sapiens
actaagaaaga

SEQ ID NO: 5061041 - DNA, 24 bp, Homo sapiens
actaagaaagaaaggaaagaagga

SEQ ID NO: 5061042 - DNA, 19 bp, Homo sapiens
actaagaacccctctgctt

SEQ ID NO: 5061043 - DNA, 14 bp, Homo sapiens
actaagaagaaaat

SEQ ID NO: 5061044 - DNA, 20 bp, Homo sapiens
actaagaagatgttttgaaa

SEQ ID NO: 5061045 - DNA, 14 bp, Homo sapiens
actaagaataaata

SEQ ID NO: 5061046 - DNA, 23 bp, Homo sapiens
actaagaataacaagaagcccag

SEQ ID NO: 5061047 - DNA, 13 bp, Homo sapiens
actaagaatgtcc

SEQ ID NO: 5061048 - DNA, 20 bp, Homo sapiens
actaagacaagaacattctc

SEQ ID NO: 5061049 - DNA, 20 bp, Homo sapiens
actaagaccctggtctgagg

SEQ ID NO: 5061050 - DNA, 14 bp, Homo sapiens
actaagagaaactg

SEQ ID NO: 5061051 - DNA, 15 bp, Homo sapiens
actaagagagaatga

SEQ ID NO: 5061052 - DNA, 19 bp, Homo sapiens
actaagaggggctggacct

SEQ ID NO: 5061053 - DNA, 17 bp, Homo sapiens
actaagatcggttaaca

SEQ ID NO: 5061054 - DNA, 20 bp, Homo sapiens
actaagatcggttaacaaat

SEQ ID NO: 5061055 - DNA, 17 bp, Homo sapiens
actaagatgaaattgcc

SEQ ID NO: 5061056 - DNA, 18 bp, Homo sapiens
actaagatgaaattgcca

SEQ ID NO: 5061057 - DNA, 13 bp, Homo sapiens
actaagattcttt

SEQ ID NO: 5061058 - DNA, 17 bp, Homo sapiens
actaagcaatttccccc

SEQ ID NO: 5061059 - DNA, 12 bp, Homo sapiens
actaagcagagg

SEQ ID NO: 5061060 - DNA, 11 bp, Homo sapiens
actaagcattg

SEQ ID NO: 5061061 - DNA, 21 bp, Homo sapiens
actaagccaacttgatgtgaa

SEQ ID NO: 5061062 - DNA, 19 bp, Homo sapiens
actaagccaagctgtgttc

SEQ ID NO: 5061063 - DNA, 18 bp, Homo sapiens
actaagccacaagaaatt

SEQ ID NO: 5061064 - DNA, 12 bp, Homo sapiens
actaagccagga

SEQ ID NO: 5061065 - DNA, 13 bp, Homo sapiens
actaagccaggag

SEQ ID NO: 5061066 - DNA, 17 bp, Homo sapiens
actaagccatgccatgc

SEQ ID NO: 5061067 - DNA, 19 bp, Homo sapiens
actaagccccgtctgaccc

SEQ ID NO: 5061068 - DNA, 21 bp, Homo sapiens
actaagccccgtctgacccca

SEQ ID NO: 5061069 - DNA, 23 bp, Homo sapiens
actaagccccgtctgaccccagc

SEQ ID NO: 5061070 - DNA, 23 bp, Homo sapiens
actaagccctcgaaccaaggcag

SEQ ID NO: 5061071 - DNA, 13 bp, Homo sapiens
actaagccctgtc

SEQ ID NO: 5061072 - DNA, 22 bp, Homo sapiens
actaagccctgtcgagacactt

SEQ ID NO: 5061073 - DNA, 14 bp, Homo sapiens
actaagcctacctg

SEQ ID NO: 5061074 - DNA, 18 bp, Homo sapiens
actaagctctctgggcct

SEQ ID NO: 5061075 - DNA, 17 bp, Homo sapiens
actaagctctttgagaa

SEQ ID NO: 5061076 - DNA, 19 bp, Homo sapiens
actaagcttaatttttaaa

SEQ ID NO: 5061077 - DNA, 16 bp, Homo sapiens
actaagctttctcctt

SEQ ID NO: 5061078 - DNA, 16 bp, Homo sapiens
actaaggaaatatttc

SEQ ID NO: 5061079 - DNA, 17 bp, Homo sapiens
actaaggaaatatttca

SEQ ID NO: 5061080 - DNA, 22 bp, Homo sapiens
actaaggccttttatgtaattt

SEQ ID NO: 5061081 - DNA, 17 bp, Homo sapiens
actaaggcttttatttc

SEQ ID NO: 5061082 - DNA, 18 bp, Homo sapiens
actaaggcttttatttct

SEQ ID NO: 5061083 - DNA, 22 bp, Homo sapiens
actaagggaacaatccatgtga

SEQ ID NO: 5061084 - DNA, 23 bp, Homo sapiens
actaagggcaggaagacttccag

SEQ ID NO: 5061085 - DNA, 19 bp, Homo sapiens
actaaggggcagctcctga

SEQ ID NO: 5061086 - DNA, 23 bp, Homo sapiens
actaaggggcagctcctgaccaa

SEQ ID NO: 5061087 - DNA, 12 bp, Homo sapiens
actaaggggccc

SEQ ID NO: 5061088 - DNA, 20 bp, Homo sapiens
actaagggggtagaagtagt

SEQ ID NO: 5061089 - DNA, 14 bp, Homo sapiens
actaaggtcagaag

SEQ ID NO: 5061090 - DNA, 19 bp, Homo sapiens
actaaggtgactttctgaa

SEQ ID NO: 5061091 - DNA, 22 bp, Homo sapiens
actaaggtgactttctgaaact

SEQ ID NO: 5061092 - DNA, 17 bp, Homo sapiens
actaaggtgctaaatct

SEQ ID NO: 5061093 - DNA, 23 bp, Homo sapiens
actaagtaatctcacagcatttg

SEQ ID NO: 5061094 - DNA, 18 bp, Homo sapiens
actaagtagcccataagg

SEQ ID NO: 5061095 - DNA, 15 bp, Homo sapiens
actaagtcaggagtg

SEQ ID NO: 5061096 - DNA, 19 bp, Homo sapiens
actaagtcatggtcctggc

SEQ ID NO: 5061097 - DNA, 20 bp, Homo sapiens
actaagtcatggtcctggct

SEQ ID NO: 5061098 - DNA, 23 bp, Homo sapiens
actaagtccctataataaaggct

SEQ ID NO: 5061099 - DNA, 22 bp, Homo sapiens
actaagtctcttttttacaaag

SEQ ID NO: 5061100 - DNA, 23 bp, Homo sapiens
actaagtctcttttttacaaagg

SEQ ID NO: 5061101 - DNA, 16 bp, Homo sapiens
actaagtgatgctgtg

SEQ ID NO: 5061102 - DNA, 22 bp, Homo sapiens
actaagtgatgctgtgatacct

SEQ ID NO: 5061103 - DNA, 19 bp, Homo sapiens
actaagtggaacgttctct

SEQ ID NO: 5061104 - DNA, 17 bp, Homo sapiens
actaagttattgctgca

SEQ ID NO: 5061105 - DNA, 22 bp, Homo sapiens
actaagttattgctgcataaat

SEQ ID NO: 5061106 - DNA, 15 bp, Homo sapiens
actaagttattttat

SEQ ID NO: 5061107 - DNA, 22 bp, Homo sapiens
actaagtttccttttaattcta

SEQ ID NO: 5061108 - DNA, 13 bp, Homo sapiens
actaagttttgtg

SEQ ID NO: 5061109 - DNA, 20 bp, Homo sapiens
actaagttttgtgtgtatat

SEQ ID NO: 5061110 - DNA, 19 bp, Homo sapiens
actaataaaaaactgtgaa

SEQ ID NO: 5061111 - DNA, 13 bp, Homo sapiens
actaataaaaagg

SEQ ID NO: 5061112 - DNA, 14 bp, Homo sapiens
actaataaaaaggt

SEQ ID NO: 5061113 - DNA, 16 bp, Homo sapiens
actaataaaaaggttt

SEQ ID NO: 5061114 - DNA, 22 bp, Homo sapiens
actaataaaagcataaatgcaa

SEQ ID NO: 5061115 - DNA, 17 bp, Homo sapiens
actaataaaatattttc

SEQ ID NO: 5061116 - DNA, 19 bp, Homo sapiens
actaataaaatattttctg

SEQ ID NO: 5061117 - DNA, 14 bp, Homo sapiens
actaataaaatgtg

SEQ ID NO: 5061118 - DNA, 19 bp, Homo sapiens
actaataaactaataattg

SEQ ID NO: 5061119 - DNA, 12 bp, Homo sapiens
actaataaagtg

SEQ ID NO: 5061120 - DNA, 13 bp, Homo sapiens
actaataaatata

SEQ ID NO: 5061121 - DNA, 17 bp, Homo sapiens
actaataaatataattt

SEQ ID NO: 5061122 - DNA, 19 bp, Homo sapiens
actaataaatataatttat

SEQ ID NO: 5061123 - DNA, 15 bp, Homo sapiens
actaatagacaattt

SEQ ID NO: 5061124 - DNA, 20 bp, Homo sapiens
actaatagcctaaaagattt

SEQ ID NO: 5061125 - DNA, 14 bp, Homo sapiens
actaatatatctgt

SEQ ID NO: 5061126 - DNA, 16 bp, Homo sapiens
actaatatatctgtaa

SEQ ID NO: 5061127 - DNA, 14 bp, Homo sapiens
actaatatatgaaa

SEQ ID NO: 5061128 - DNA, 13 bp, Homo sapiens
actaatatatgga

SEQ ID NO: 5061129 - DNA, 17 bp, Homo sapiens
actaatatatggaccta

SEQ ID NO: 5061130 - DNA, 14 bp, Homo sapiens
actaatatttctgt

SEQ ID NO: 5061131 - DNA, 15 bp, Homo sapiens
actaatatttctgta

SEQ ID NO: 5061132 - DNA, 17 bp, Homo sapiens
actaatatttctgtaat

SEQ ID NO: 5061133 - DNA, 13 bp, Homo sapiens
actaatcatgaga

SEQ ID NO: 5061134 - DNA, 19 bp, Homo sapiens
actaatccaatacctcttg

SEQ ID NO: 5061135 - DNA, 21 bp, Homo sapiens
actaatccaatacctcttgga

SEQ ID NO: 5061136 - DNA, 19 bp, Homo sapiens
actaatccattatccttta

SEQ ID NO: 5061137 - DNA, 20 bp, Homo sapiens
actaatctattgggttcatt

SEQ ID NO: 5061138 - DNA, 22 bp, Homo sapiens
actaatctattgggttcattat

SEQ ID NO: 5061139 - DNA, 16 bp, Homo sapiens
actaatctcaatttaa

SEQ ID NO: 5061140 - DNA, 18 bp, Homo sapiens
actaatgaaaacagaatg

SEQ ID NO: 5061141 - DNA, 15 bp, Homo sapiens
actaatgaacaaata

SEQ ID NO: 5061142 - DNA, 19 bp, Homo sapiens
actaatgaacaaatatgct

SEQ ID NO: 5061143 - DNA, 21 bp, Homo sapiens
actaatgaatgcaaaaagata

SEQ ID NO: 5061144 - DNA, 18 bp, Homo sapiens
actaatgaattgaaattt

SEQ ID NO: 5061145 - DNA, 22 bp, Homo sapiens
actaatgaccacacctgcctct

SEQ ID NO: 5061146 - DNA, 21 bp, Homo sapiens
actaatgagggaaatctgtaa

SEQ ID NO: 5061147 - DNA, 16 bp, Homo sapiens
actaatgatgagcatt

SEQ ID NO: 5061148 - DNA, 13 bp, Homo sapiens
actaatggcatga

SEQ ID NO: 5061149 - DNA, 21 bp, Homo sapiens
actaatggcatgagaaataca

SEQ ID NO: 5061150 - DNA, 22 bp, Homo sapiens
actaatggcatgagaaatacaa

SEQ ID NO: 5061151 - DNA, 15 bp, Homo sapiens
actaatgtaaaatga

SEQ ID NO: 5061152 - DNA, 17 bp, Homo sapiens
actaatgtctcttctaa

SEQ ID NO: 5061153 - DNA, 20 bp, Homo sapiens
actaatgtgtaagacaaaaa

SEQ ID NO: 5061154 - DNA, 17 bp, Homo sapiens
actaatgtgtctcaggc

SEQ ID NO: 5061155 - DNA, 23 bp, Homo sapiens
actaatgttggacagacactgtt

SEQ ID NO: 5061156 - DNA, 21 bp, Homo sapiens
actaatgttttggtctgaaaa

SEQ ID NO: 5061157 - DNA, 15 bp, Homo sapiens
actaattaaaatctg

SEQ ID NO: 5061158 - DNA, 19 bp, Homo sapiens
actaattaaaatctggaaa

SEQ ID NO: 5061159 - DNA, 18 bp, Homo sapiens
actaattaacatataata

SEQ ID NO: 5061160 - DNA, 15 bp, Homo sapiens
actaattagtgtcca

SEQ ID NO: 5061161 - DNA, 15 bp, Homo sapiens
actaattccacacct

SEQ ID NO: 5061162 - DNA, 23 bp, Homo sapiens
actaattccacaccttttattga

SEQ ID NO: 5061163 - DNA, 17 bp, Homo sapiens
actaattccttaaatga

SEQ ID NO: 5061164 - DNA, 14 bp, Homo sapiens
actaattgacttgc

SEQ ID NO: 5061165 - DNA, 17 bp, Homo sapiens
actaattgtataacagg

SEQ ID NO: 5061166 - DNA, 18 bp, Homo sapiens
actaattgtataacaggt

SEQ ID NO: 5061167 - DNA, 18 bp, Homo sapiens
actaatttaaagatgctg

SEQ ID NO: 5061168 - DNA, 14 bp, Homo sapiens
actaatttcaaaat

SEQ ID NO: 5061169 - DNA, 16 bp, Homo sapiens
actaatttcaaaatgc

SEQ ID NO: 5061170 - DNA, 19 bp, Homo sapiens
actaatttcaaaatgcttt

SEQ ID NO: 5061171 - DNA, 12 bp, Homo sapiens
actaatttcata

SEQ ID NO: 5061172 - DNA, 18 bp, Homo sapiens
actaatttcctgctgaaa

SEQ ID NO: 5061173 - DNA, 17 bp, Homo sapiens
actaatttgatgtttac

SEQ ID NO: 5061174 - DNA, 12 bp, Homo sapiens
actaatttgtgg

SEQ ID NO: 5061175 - DNA, 21 bp, Homo sapiens
actaattttagtattcattct

SEQ ID NO: 5061176 - DNA, 18 bp, Homo sapiens
actaattttgttgaaaat

SEQ ID NO: 5061177 - DNA, 22 bp, Homo sapiens
actaattttgttttaaactgtg

SEQ ID NO: 5061178 - DNA, 23 bp, Homo sapiens
actaattttgttttaaactgtga

SEQ ID NO: 5061179 - DNA, 17 bp, Homo sapiens
actaatttttagatatt

SEQ ID NO: 5061180 - DNA, 14 bp, Homo sapiens
actaatttttgctt

SEQ ID NO: 5061181 - DNA, 20 bp, Homo sapiens
actaatttttgcttaacatt

SEQ ID NO: 5061182 - DNA, 13 bp, Homo sapiens
actaatttttgta

SEQ ID NO: 5061183 - DNA, 18 bp, Homo sapiens
actaatttttgtattatt

SEQ ID NO: 5061184 - DNA, 19 bp, Homo sapiens
actaattttttaagaggaa

SEQ ID NO: 5061185 - DNA, 14 bp, Homo sapiens
actacaaaaagaag

SEQ ID NO: 5061186 - DNA, 18 bp, Homo sapiens
actacaaaaatacaatta

SEQ ID NO: 5061187 - DNA, 14 bp, Homo sapiens
actacaaaatacaa

SEQ ID NO: 5061188 - DNA, 19 bp, Homo sapiens
actacaaacaaaagcagcc

SEQ ID NO: 5061189 - DNA, 21 bp, Homo sapiens
actacaaacaaaatttctatt

SEQ ID NO: 5061190 - DNA, 23 bp, Homo sapiens
actacaaaggtttaaatgaacaa

SEQ ID NO: 5061191 - DNA, 17 bp, Homo sapiens
actacaaagtaaaatga

SEQ ID NO: 5061192 - DNA, 11 bp, Homo sapiens
actacaaatca

SEQ ID NO: 5061193 - DNA, 18 bp, Homo sapiens
actacaacattagaatat

SEQ ID NO: 5061194 - DNA, 22 bp, Homo sapiens
actacaacattagaatattgta

SEQ ID NO: 5061195 - DNA, 19 bp, Homo sapiens
actacaaccaagctctctg

SEQ ID NO: 5061196 - DNA, 14 bp, Homo sapiens
actacaacttttgt

SEQ ID NO: 5061197 - DNA, 23 bp, Homo sapiens
actacaagcttttaactttttaa

SEQ ID NO: 5061198 - DNA, 13 bp, Homo sapiens
actacaatatgta

SEQ ID NO: 5061199 - DNA, 18 bp, Homo sapiens
actacaatatgtacattt

SEQ ID NO: 5061200 - DNA, 17 bp, Homo sapiens
actacaatttaaagcaa

SEQ ID NO: 5061201 - DNA, 17 bp, Homo sapiens
actacacaatacagtat

SEQ ID NO: 5061202 - DNA, 15 bp, Homo sapiens
actacacaccatttc

SEQ ID NO: 5061203 - DNA, 22 bp, Homo sapiens
actacacactgtgtactgcagt

SEQ ID NO: 5061204 - DNA, 20 bp, Homo sapiens
actacacagtctgcaagatt

SEQ ID NO: 5061205 - DNA, 15 bp, Homo sapiens
actacacattcaata

SEQ ID NO: 5061206 - DNA, 23 bp, Homo sapiens
actacaccacacacaacagccaa

SEQ ID NO: 5061207 - DNA, 22 bp, Homo sapiens
actacaccacactaaaacattg

SEQ ID NO: 5061208 - DNA, 13 bp, Homo sapiens
actacacccagca

SEQ ID NO: 5061209 - DNA, 14 bp, Homo sapiens
actacacctggctg

SEQ ID NO: 5061210 - DNA, 21 bp, Homo sapiens
actacaccttgccttgctgtt

SEQ ID NO: 5061211 - DNA, 21 bp, Homo sapiens
atcagtgggcaggataaactg

SEQ ID NO: 5061212 - DNA, 15 bp, Homo sapiens
atcagtggggcccca

SEQ ID NO: 5061213 - DNA, 21 bp, Homo sapiens
atcagtggggccccaaagccc

SEQ ID NO: 5061214 - DNA, 19 bp, Homo sapiens
atcagtgtaccatttgcct

SEQ ID NO: 5061215 - DNA, 18 bp, Homo sapiens
atcagtgtattagtcata

SEQ ID NO: 5061216 - DNA, 14 bp, Homo sapiens
atcagtgtctcaca

SEQ ID NO: 5061217 - DNA, 15 bp, Homo sapiens
atcagtgtctcacac

SEQ ID NO: 5061218 - DNA, 22 bp, Homo sapiens
atcagtgtctgtttcagaatct

SEQ ID NO: 5061219 - DNA, 16 bp, Homo sapiens
atcagtgtctttccac

SEQ ID NO: 5061220 - DNA, 15 bp, Homo sapiens
atcagtgtgcccccc

SEQ ID NO: 5061221 - DNA, 16 bp, Homo sapiens
atcagtgtggaaaaaa

SEQ ID NO: 5061222 - DNA, 23 bp, Homo sapiens
atcagtgtggaaaaaaattctga

SEQ ID NO: 5061223 - DNA, 16 bp, Homo sapiens
atcagtgtgtaaataa

SEQ ID NO: 5061224 - DNA, 20 bp, Homo sapiens
atcagtgtgtctaaatttga

SEQ ID NO: 5061225 - DNA, 19 bp, Homo sapiens
atcagtgtgttactatcta

SEQ ID NO: 5061226 - DNA, 19 bp, Homo sapiens
atcagtgttaaaaaatttt

SEQ ID NO: 5061227 - DNA, 15 bp, Homo sapiens
atcagtgttaaagtg

SEQ ID NO: 5061228 - DNA, 18 bp, Homo sapiens
atcagtgttgattctaga

SEQ ID NO: 5061229 - DNA, 13 bp, Homo sapiens
atcagtgtttaaa

SEQ ID NO: 5061230 - DNA, 17 bp, Homo sapiens
atcagtgtttaaataaa

SEQ ID NO: 5061231 - DNA, 20 bp, Homo sapiens
atcagttaaaatcacatttt

SEQ ID NO: 5061232 - DNA, 22 bp, Homo sapiens
atcagttacccactcggtccca

SEQ ID NO: 5061233 - DNA, 21 bp, Homo sapiens
atcagttactcagccctgggc

SEQ ID NO: 5061234 - DNA, 18 bp, Homo sapiens
atcagttactctgaaggg

SEQ ID NO: 5061235 - DNA, 14 bp, Homo sapiens
atcagttactggtt

SEQ ID NO: 5061236 - DNA, 18 bp, Homo sapiens
atcagttatatgatattc

SEQ ID NO: 5061237 - DNA, 15 bp, Homo sapiens
atcagttatcctttg

SEQ ID NO: 5061238 - DNA, 21 bp, Homo sapiens
atcagttatcctttgtgagcc

SEQ ID NO: 5061239 - DNA, 22 bp, Homo sapiens
atcagttatcctttgtgagcct

SEQ ID NO: 5061240 - DNA, 14 bp, Homo sapiens
atcagttattcatt

SEQ ID NO: 5061241 - DNA, 17 bp, Homo sapiens
atcagttccagccttct

SEQ ID NO: 5061242 - DNA, 20 bp, Homo sapiens
atcagttcccccagtacctc

SEQ ID NO: 5061243 - DNA, 14 bp, Homo sapiens
atcagttcctttgt

SEQ ID NO: 5061244 - DNA, 13 bp, Homo sapiens
atcagttctcaat

SEQ ID NO: 5061245 - DNA, 12 bp, Homo sapiens
atcagttctgtg

SEQ ID NO: 5061246 - DNA, 22 bp, Homo sapiens
atcagttcttagattcagggga

SEQ ID NO: 5061247 - DNA, 17 bp, Homo sapiens
atcagttgacagaatgg

SEQ ID NO: 5061248 - DNA, 21 bp, Homo sapiens
atcagttgactttaagtgaaa

SEQ ID NO: 5061249 - DNA, 22 bp, Homo sapiens
atcagttgaggccaggagttta

SEQ ID NO: 5061250 - DNA, 19 bp, Homo sapiens
atcagttgcaggtgccaat

SEQ ID NO: 5061251 - DNA, 20 bp, Homo sapiens
atcagttgcaggtgccaatg

SEQ ID NO: 5061252 - DNA, 20 bp, Homo sapiens
atcagttgcgcgttctgaaa

SEQ ID NO: 5061253 - DNA, 20 bp, Homo sapiens
atcagttgctctctgttcaa

SEQ ID NO: 5061254 - DNA, 22 bp, Homo sapiens
atcagttgtgaatacattcttt

SEQ ID NO: 5061255 - DNA, 15 bp, Homo sapiens
atcagtttaggcctt

SEQ ID NO: 5061256 - DNA, 18 bp, Homo sapiens
atcagtttcatgaaatga

SEQ ID NO: 5061257 - DNA, 18 bp, Homo sapiens
atcagtttccatgaaaga

SEQ ID NO: 5061258 - DNA, 16 bp, Homo sapiens
atcagtttttgttctt

SEQ ID NO: 5061259 - DNA, 19 bp, Homo sapiens
atcagtttttgttcttaaa

SEQ ID NO: 5061260 - DNA, 22 bp, Homo sapiens
atcataaaaataaaatctgtaa

SEQ ID NO: 5061261 - DNA, 15 bp, Homo sapiens
atcataaaacttgat

SEQ ID NO: 5061262 - DNA, 19 bp, Homo sapiens
atcataaaaggtgaccctt

SEQ ID NO: 5061263 - DNA, 13 bp, Homo sapiens
atcataaaataaa

SEQ ID NO: 5061264 - DNA, 14 bp, Homo sapiens
atcataaaatcaaa

SEQ ID NO: 5061265 - DNA, 20 bp, Homo sapiens
atcataaaggatatttcaaa

SEQ ID NO: 5061266 - DNA, 21 bp, Homo sapiens
atcataaaggatatttcaaat

SEQ ID NO: 5061267 - DNA, 16 bp, Homo sapiens
atcataaagttagaat

SEQ ID NO: 5061268 - DNA, 11 bp, Homo sapiens
atcataaatct

SEQ ID NO: 5061269 - DNA, 15 bp, Homo sapiens
atcataacaatgtct

SEQ ID NO: 5061270 - DNA, 20 bp, Homo sapiens
atcataacatagttgaaaaa

SEQ ID NO: 5061271 - DNA, 14 bp, Homo sapiens
atcataacttaata

SEQ ID NO: 5061272 - DNA, 20 bp, Homo sapiens
atcataacttaataaatatt

SEQ ID NO: 5061273 - DNA, 16 bp, Homo sapiens
atcataaggtcttatt

SEQ ID NO: 5061274 - DNA, 17 bp, Homo sapiens
atcataagtgaatttat

SEQ ID NO: 5061275 - DNA, 19 bp, Homo sapiens
atcataagtgaatttatac

SEQ ID NO: 5061276 - DNA, 14 bp, Homo sapiens
atcataattaccaa

SEQ ID NO: 5061277 - DNA, 18 bp, Homo sapiens
atcataattaccaagtga

SEQ ID NO: 5061278 - DNA, 13 bp, Homo sapiens
atcataattttca

SEQ ID NO: 5061279 - DNA, 23 bp, Homo sapiens
atcatacagatcaggcagtgttt

SEQ ID NO: 5061280 - DNA, 17 bp, Homo sapiens
atcatacagttttcatt

SEQ ID NO: 5061281 - DNA, 21 bp, Homo sapiens
atcataccctttattctcact

SEQ ID NO: 5061282 - DNA, 17 bp, Homo sapiens
atcatactcctatgctt

SEQ ID NO: 5061283 - DNA, 20 bp, Homo sapiens
atcatactcttctaaaactt

SEQ ID NO: 5061284 - DNA, 17 bp, Homo sapiens
atcatactgatttttaa

SEQ ID NO: 5061285 - DNA, 15 bp, Homo sapiens
atcatactgcctact

SEQ ID NO: 5061286 - DNA, 15 bp, Homo sapiens
atcatacttaacatt

SEQ ID NO: 5061287 - DNA, 18 bp, Homo sapiens
atcatacttaacatttca

SEQ ID NO: 5061288 - DNA, 18 bp, Homo sapiens
atcatagaaaattgaaac

SEQ ID NO: 5061289 - DNA, 12 bp, Homo sapiens
atcatagaaatg

SEQ ID NO: 5061290 - DNA, 15 bp, Homo sapiens
atcatagaaatgtaa

SEQ ID NO: 5061291 - DNA, 21 bp, Homo sapiens
atcatagacccatctggaggc

SEQ ID NO: 5061292 - DNA, 21 bp, Homo sapiens
atcatagaggatgatgtaatt

SEQ ID NO: 5061293 - DNA, 22 bp, Homo sapiens
atcatagaggatgatgtaatta

SEQ ID NO: 5061294 - DNA, 18 bp, Homo sapiens
atcatagatttctgattt

SEQ ID NO: 5061295 - DNA, 20 bp, Homo sapiens
atcatagatttctgatttta

SEQ ID NO: 5061296 - DNA, 23 bp, Homo sapiens
atcatagatttctgattttatgt

SEQ ID NO: 5061297 - DNA, 18 bp, Homo sapiens
atcataggtatttcaaaa

SEQ ID NO: 5061298 - DNA, 12 bp, Homo sapiens
atcatagtacag

SEQ ID NO: 5061299 - DNA, 17 bp, Homo sapiens
atcatagtataaatcta

SEQ ID NO: 5061300 - DNA, 15 bp, Homo sapiens
atcatagttactgtg

SEQ ID NO: 5061301 - DNA, 16 bp, Homo sapiens
atcatagttttattta

SEQ ID NO: 5061302 - DNA, 17 bp, Homo sapiens
atcatagttttatttat

SEQ ID NO: 5061303 - DNA, 21 bp, Homo sapiens
atcatataaaaagcagcagag

SEQ ID NO: 5061304 - DNA, 15 bp, Homo sapiens
atcatataaaatttc

SEQ ID NO: 5061305 - DNA, 13 bp, Homo sapiens
atcatataaacat

SEQ ID NO: 5061306 - DNA, 18 bp, Homo sapiens
atcatataaatagaatgt

SEQ ID NO: 5061307 - DNA, 18 bp, Homo sapiens
atcatataaattttttgt

SEQ ID NO: 5061308 - DNA, 16 bp, Homo sapiens
atcatatataaaagtc

SEQ ID NO: 5061309 - DNA, 21 bp, Homo sapiens
atcatatatcataaaggatat

SEQ ID NO: 5061310 - DNA, 15 bp, Homo sapiens
atcatatatgctttt

SEQ ID NO: 5061311 - DNA, 16 bp, Homo sapiens
atcatatattaaaaca

SEQ ID NO: 5061312 - DNA, 21 bp, Homo sapiens
atcatatgaattagccaaaag

SEQ ID NO: 5061313 - DNA, 18 bp, Homo sapiens
atcatatgaattgctgtc

SEQ ID NO: 5061314 - DNA, 19 bp, Homo sapiens
atcatatgacatgccaccc

SEQ ID NO: 5061315 - DNA, 20 bp, Homo sapiens
atcatatgacatgccaccct

SEQ ID NO: 5061316 - DNA, 23 bp, Homo sapiens
atcatatgaccattgaaaaagga

SEQ ID NO: 5061317 - DNA, 13 bp, Homo sapiens
atcatatgattct

SEQ ID NO: 5061318 - DNA, 16 bp, Homo sapiens
atcatatgattctgct

SEQ ID NO: 5061319 - DNA, 18 bp, Homo sapiens
atcatatgattctgcttt

SEQ ID NO: 5061320 - DNA, 21 bp, Homo sapiens
atcatatgattctgcttttac

SEQ ID NO: 5061321 - DNA, 21 bp, Homo sapiens
atcatatgggtcaggtcattt

SEQ ID NO: 5061322 - DNA, 23 bp, Homo sapiens
atcatatggtaggaccctcgaga

SEQ ID NO: 5061323 - DNA, 21 bp, Homo sapiens
atcatatgtatctaaatgaaa

SEQ ID NO: 5061324 - DNA, 22 bp, Homo sapiens
atcatatgtgatctgtcttgta

SEQ ID NO: 5061325 - DNA, 19 bp, Homo sapiens
atcatatgtgtctttatag

SEQ ID NO: 5061326 - DNA, 19 bp, Homo sapiens
atcatattaaaattacaga

SEQ ID NO: 5061327 - DNA, 22 bp, Homo sapiens
atcatattaaaattacagatgt

SEQ ID NO: 5061328 - DNA, 13 bp, Homo sapiens
atcatattaatta

SEQ ID NO: 5061329 - DNA, 15 bp, Homo sapiens
atcatattaattatt

SEQ ID NO: 5061330 - DNA, 22 bp, Homo sapiens
atcatattaattattttccaaa

SEQ ID NO: 5061331 - DNA, 16 bp, Homo sapiens
atcatattatacagac

SEQ ID NO: 5061332 - DNA, 16 bp, Homo sapiens
atcatattctaaaagt

SEQ ID NO: 5061333 - DNA, 13 bp, Homo sapiens
atcatattgagaa

SEQ ID NO: 5061334 - DNA, 14 bp, Homo sapiens
atcatattgagaat

SEQ ID NO: 5061335 - DNA, 13 bp, Homo sapiens
atcatattgtatg

SEQ ID NO: 5061336 - DNA, 19 bp, Homo sapiens
atcatatttaaagatcttt

SEQ ID NO: 5061337 - DNA, 14 bp, Homo sapiens
atcatatttctgtg

SEQ ID NO: 5061338 - DNA, 15 bp, Homo sapiens
atcatatttgaaaac

SEQ ID NO: 5061339 - DNA, 23 bp, Homo sapiens
atcatcaaaaagaaaaatcaaag

SEQ ID NO: 5061340 - DNA, 23 bp, Homo sapiens
atcatcaaagtgtttaattgtat

SEQ ID NO: 5061341 - DNA, 14 bp, Homo sapiens
atcatcaagaaggg

SEQ ID NO: 5061342 - DNA, 15 bp, Homo sapiens
atcatcaagagaatt

SEQ ID NO: 5061343 - DNA, 19 bp, Homo sapiens
atcatcaaggcactgcctg

SEQ ID NO: 5061344 - DNA, 21 bp, Homo sapiens
atcatcaagtaatacaaacta

SEQ ID NO: 5061345 - DNA, 14 bp, Homo sapiens
atcatcaatacttt

SEQ ID NO: 5061346 - DNA, 20 bp, Homo sapiens
atcatcaatacttttgtgta

SEQ ID NO: 5061347 - DNA, 20 bp, Homo sapiens
atcatcaatgtgacatttac

SEQ ID NO: 5061348 - DNA, 13 bp, Homo sapiens
atcatcacaaatg

SEQ ID NO: 5061349 - DNA, 21 bp, Homo sapiens
atcatcaccgattcttccttg

SEQ ID NO: 5061350 - DNA, 21 bp, Homo sapiens
atcatcacgtatgttatacaa

SEQ ID NO: 5061351 - DNA, 13 bp, Homo sapiens
atcatcactgtaa

SEQ ID NO: 5061352 - DNA, 21 bp, Homo sapiens
atcatcactgtaaagacaaat

SEQ ID NO: 5061353 - DNA, 19 bp, Homo sapiens
atcatcagacttgcggcca

SEQ ID NO: 5061354 - DNA, 22 bp, Homo sapiens
atcatcagcatacctttattgt

SEQ ID NO: 5061355 - DNA, 13 bp, Homo sapiens
atcatcagggcct

SEQ ID NO: 5061356 - DNA, 15 bp, Homo sapiens
atcatcatagaaaaa

SEQ ID NO: 5061357 - DNA, 18 bp, Homo sapiens
atcatcatgcagctcaac

SEQ ID NO: 5061358 - DNA, 20 bp, Homo sapiens
atcatcatgcagctcaactt

SEQ ID NO: 5061359 - DNA, 14 bp, Homo sapiens
atcatcatggccag

SEQ ID NO: 5061360 - DNA, 18 bp, Homo sapiens
atcatcatgtgtgtccac

SEQ ID NO: 5061361 - DNA, 15 bp, Homo sapiens
atcatcattattatt

SEQ ID NO: 5061362 - DNA, 14 bp, Homo sapiens
atcatccacccgct

SEQ ID NO: 5061363 - DNA, 15 bp, Homo sapiens
atcatccacccgctg

SEQ ID NO: 5061364 - DNA, 22 bp, Homo sapiens
atcatccacccgctgcccctcc

SEQ ID NO: 5061365 - DNA, 23 bp, Homo sapiens
atcatccactgtgccatgtgcca

SEQ ID NO: 5061366 - DNA, 17 bp, Homo sapiens
atcatccagatgtggct

SEQ ID NO: 5061367 - DNA, 17 bp, Homo sapiens
atcatccattctctctg

SEQ ID NO: 5061368 - DNA, 22 bp, Homo sapiens
atcatccattctctctgcccaa

SEQ ID NO: 5061369 - DNA, 21 bp, Homo sapiens
atcatcccatctaagctgcag

SEQ ID NO: 5061370 - DNA, 17 bp, Homo sapiens
atcatccccaaatgtgt

SEQ ID NO: 5061371 - DNA, 18 bp, Homo sapiens
atcatccccaaatgtgtc

SEQ ID NO: 5061372 - DNA, 18 bp, Homo sapiens
atcatccccatcctccag

SEQ ID NO: 5061373 - DNA, 15 bp, Homo sapiens
atcatccctccctgc

SEQ ID NO: 5061374 - DNA, 22 bp, Homo sapiens
atcatccctccctgcctaagga

SEQ ID NO: 5061375 - DNA, 15 bp, Homo sapiens
atcatccctttccct

SEQ ID NO: 5061376 - DNA, 15 bp, Homo sapiens
atcatccctttctcc

SEQ ID NO: 5061377 - DNA, 15 bp, Homo sapiens
atcatcctataaaga

SEQ ID NO: 5061378 - DNA, 16 bp, Homo sapiens
atcatcctataaagaa

SEQ ID NO: 5061379 - DNA, 12 bp, Homo sapiens
atcatcctcctt

SEQ ID NO: 5061380 - DNA, 22 bp, Homo sapiens
atcatcctggaggggtgttgta

SEQ ID NO: 5061381 - DNA, 15 bp, Homo sapiens
atcatcctgttttct

SEQ ID NO: 5061382 - DNA, 18 bp, Homo sapiens
atcatcctttccagcatg

SEQ ID NO: 5061383 - DNA, 17 bp, Homo sapiens
atcatcctttgttctga

SEQ ID NO: 5061384 - DNA, 21 bp, Homo sapiens
atcatcctttgttctgagcat

SEQ ID NO: 5061385 - DNA, 15 bp, Homo sapiens
atcatcgccagaggt

SEQ ID NO: 5061386 - DNA, 16 bp, Homo sapiens
atcatcggagttgaca

SEQ ID NO: 5061387 - DNA, 20 bp, Homo sapiens
atcatcggagttgacagtga

SEQ ID NO: 5061388 - DNA, 20 bp, Homo sapiens
atcccaagatggagaggaag

SEQ ID NO: 5061389 - DNA, 17 bp, Homo sapiens
atcccaagctagtgagc

SEQ ID NO: 5061390 - DNA, 19 bp, Homo sapiens
atcccaaggcaagcatgaa

SEQ ID NO: 5061391 - DNA, 20 bp, Homo sapiens
atcccaaggcaagcatgaat

SEQ ID NO: 5061392 - DNA, 20 bp, Homo sapiens
atcccaagtagaatctcagt

SEQ ID NO: 5061393 - DNA, 20 bp, Homo sapiens
atcccaagtcaaacagtgtg

SEQ ID NO: 5061394 - DNA, 20 bp, Homo sapiens
atcccaataaagtcctcttc

SEQ ID NO: 5061395 - DNA, 21 bp, Homo sapiens
atcccaataaagtcctcttcc

SEQ ID NO: 5061396 - DNA, 22 bp, Homo sapiens
atcccaataaagtcctcttccc

SEQ ID NO: 5061397 - DNA, 23 bp, Homo sapiens
atcccaataaagtcctcttccct

SEQ ID NO: 5061398 - DNA, 17 bp, Homo sapiens
atcccaatattttggga

SEQ ID NO: 5061399 - DNA, 19 bp, Homo sapiens
atcccaatcaaagaattac

SEQ ID NO: 5061400 - DNA, 18 bp, Homo sapiens
atcccaatctttctatat

SEQ ID NO: 5061401 - DNA, 19 bp, Homo sapiens
atcccaattcatttcatct

SEQ ID NO: 5061402 - DNA, 16 bp, Homo sapiens
atcccaattctgtccc

SEQ ID NO: 5061403 - DNA, 11 bp, Homo sapiens
atcccacagcc

SEQ ID NO: 5061404 - DNA, 15 bp, Homo sapiens
atcccacagtggcac

SEQ ID NO: 5061405 - DNA, 13 bp, Homo sapiens
atcccacatccaa

SEQ ID NO: 5061406 - DNA, 22 bp, Homo sapiens
atcccacatccaactccagcaa

SEQ ID NO: 5061407 - DNA, 21 bp, Homo sapiens
atcccacattcggaccctgcc

SEQ ID NO: 5061408 - DNA, 23 bp, Homo sapiens
atcccacattcggaccctgccca

SEQ ID NO: 5061409 - DNA, 16 bp, Homo sapiens
atcccacatttccatg

SEQ ID NO: 5061410 - DNA, 15 bp, Homo sapiens
atcccaccaaccctc

SEQ ID NO: 5061411 - DNA, 14 bp, Homo sapiens
atcccacccacatg

SEQ ID NO: 5061412 - DNA, 21 bp, Homo sapiens
atcccacccccaatgcacagg

SEQ ID NO: 5061413 - DNA, 15 bp, Homo sapiens
atcccaccccctcct

SEQ ID NO: 5061414 - DNA, 20 bp, Homo sapiens
atcccaccccctcctccccc

SEQ ID NO: 5061415 - DNA, 12 bp, Homo sapiens
atcccacccctc

SEQ ID NO: 5061416 - DNA, 20 bp, Homo sapiens
atcccaccgacccttcctgg

SEQ ID NO: 5061417 - DNA, 22 bp, Homo sapiens
atcccacctagcccaggagaga

SEQ ID NO: 5061418 - DNA, 12 bp, Homo sapiens
atcccacctcca

SEQ ID NO: 5061419 - DNA, 15 bp, Homo sapiens
atcccacctccagcc

SEQ ID NO: 5061420 - DNA, 16 bp, Homo sapiens
atcccacctccagccc

SEQ ID NO: 5061421 - DNA, 14 bp, Homo sapiens
atcccaccttccca

SEQ ID NO: 5061422 - DNA, 16 bp, Homo sapiens
atcccacgcactccat

SEQ ID NO: 5061423 - DNA, 18 bp, Homo sapiens
atcccacgcttctctttg

SEQ ID NO: 5061424 - DNA, 23 bp, Homo sapiens
atcccacggaaaatgccaatctc

SEQ ID NO: 5061425 - DNA, 17 bp, Homo sapiens
atcccacgttctgttaa

SEQ ID NO: 5061426 - DNA, 13 bp, Homo sapiens
atcccactccact

SEQ ID NO: 5061427 - DNA, 19 bp, Homo sapiens
atcccactgattggccagc

SEQ ID NO: 5061428 - DNA, 18 bp, Homo sapiens
atcccacttagcagggac

SEQ ID NO: 5061429 - DNA, 22 bp, Homo sapiens
atcccacttagcagggacagga

SEQ ID NO: 5061430 - DNA, 13 bp, Homo sapiens
atcccacttcagt

SEQ ID NO: 5061431 - DNA, 15 bp, Homo sapiens
atcccacttcctttc

SEQ ID NO: 5061432 - DNA, 21 bp, Homo sapiens
atcccacttcctttcctactg

SEQ ID NO: 5061433 - DNA, 22 bp, Homo sapiens
atcccactttctatagcagatt

SEQ ID NO: 5061434 - DNA, 17 bp, Homo sapiens
atcccagaaattagaaa

SEQ ID NO: 5061435 - DNA, 15 bp, Homo sapiens
atcccagacccctct

SEQ ID NO: 5061436 - DNA, 17 bp, Homo sapiens
atcccagagaacaatca

SEQ ID NO: 5061437 - DNA, 21 bp, Homo sapiens
atcccagcacctgccagggcc

SEQ ID NO: 5061438 - DNA, 21 bp, Homo sapiens
atcccagcacctgcctcctcg

SEQ ID NO: 5061439 - DNA, 19 bp, Homo sapiens
atcccagcactttgggaga

SEQ ID NO: 5061440 - DNA, 22 bp, Homo sapiens
atcccagcactttgggaggctg

SEQ ID NO: 5061441 - DNA, 21 bp, Homo sapiens
atcccagcagcagagaaccat

SEQ ID NO: 5061442 - DNA, 15 bp, Homo sapiens
atcccagcaggaggg

SEQ ID NO: 5061443 - DNA, 11 bp, Homo sapiens
atcccagcccc

SEQ ID NO: 5061444 - DNA, 14 bp, Homo sapiens
atcccagccggcca

SEQ ID NO: 5061445 - DNA, 12 bp, Homo sapiens
atcccagcctca

SEQ ID NO: 5061446 - DNA, 13 bp, Homo sapiens
atcccagcctcag

SEQ ID NO: 5061447 - DNA, 17 bp, Homo sapiens
atcccagcctcagaagc

SEQ ID NO: 5061448 - DNA, 15 bp, Homo sapiens
atcccagccttggca

SEQ ID NO: 5061449 - DNA, 23 bp, Homo sapiens
atcccagcggctggtgcagggcc

SEQ ID NO: 5061450 - DNA, 13 bp, Homo sapiens
atcccagctacta

SEQ ID NO: 5061451 - DNA, 18 bp, Homo sapiens
atcccagctactcaggag

SEQ ID NO: 5061452 - DNA, 20 bp, Homo sapiens
atcccagctactcaggaggc

SEQ ID NO: 5061453 - DNA, 20 bp, Homo sapiens
atcccagctacttgggaagc

SEQ ID NO: 5061454 - DNA, 12 bp, Homo sapiens
atcccagctatt

SEQ ID NO: 5061455 - DNA, 16 bp, Homo sapiens
atcccagctcactgca

SEQ ID NO: 5061456 - DNA, 22 bp, Homo sapiens
atcccagctcactgcagcctcg

SEQ ID NO: 5061457 - DNA, 17 bp, Homo sapiens
atcccagcttgcccccg

SEQ ID NO: 5061458 - DNA, 18 bp, Homo sapiens
atcccagcttgcccccgc

SEQ ID NO: 5061459 - DNA, 10 bp, Homo sapiens
atcccaggaa

SEQ ID NO: 5061460 - DNA, 16 bp, Homo sapiens
atcccaggaaataaaa

SEQ ID NO: 5061461 - DNA, 21 bp, Homo sapiens
atcccaggacaccacacccag

SEQ ID NO: 5061462 - DNA, 11 bp, Homo sapiens
atcccaggagg

SEQ ID NO: 5061463 - DNA, 13 bp, Homo sapiens
atcccaggagggg

SEQ ID NO: 5061464 - DNA, 15 bp, Homo sapiens
atcccaggaggggcc

SEQ ID NO: 5061465 - DNA, 23 bp, Homo sapiens
atcccaggaggggcctctgaaat

SEQ ID NO: 5061466 - DNA, 17 bp, Homo sapiens
atcccaggaggtgcagt

SEQ ID NO: 5061467 - DNA, 22 bp, Homo sapiens
atcccaggatgggtgtctgggg

SEQ ID NO: 5061468 - DNA, 19 bp, Homo sapiens
atcccaggcttcaccctga

SEQ ID NO: 5061469 - DNA, 17 bp, Homo sapiens
atcccagggcaaatgtt

SEQ ID NO: 5061470 - DNA, 12 bp, Homo sapiens
atcccagggctg

SEQ ID NO: 5061471 - DNA, 15 bp, Homo sapiens
atcccagggctggct

SEQ ID NO: 5061472 - DNA, 12 bp, Homo sapiens
atcccaggggac

SEQ ID NO: 5061473 - DNA, 19 bp, Homo sapiens
atcccaggggaccacacct

SEQ ID NO: 5061474 - DNA, 23 bp, Homo sapiens
atcccaggggaccacacctccct

SEQ ID NO: 5061475 - DNA, 17 bp, Homo sapiens
atcccagggtcccaccc

SEQ ID NO: 5061476 - DNA, 13 bp, Homo sapiens
atcccaggtgagg

SEQ ID NO: 5061477 - DNA, 17 bp, Homo sapiens
atcccagtactttggaa

SEQ ID NO: 5061478 - DNA, 20 bp, Homo sapiens
atcccagtactttggaaagc

SEQ ID NO: 5061479 - DNA, 18 bp, Homo sapiens
atcccagtcactcctctc

SEQ ID NO: 5061480 - DNA, 17 bp, Homo sapiens
atcccagtctctgccag

SEQ ID NO: 5061481 - DNA, 17 bp, Homo sapiens
atcccagtgacttagga

SEQ ID NO: 5061482 - DNA, 14 bp, Homo sapiens
atcccagttcatgt

SEQ ID NO: 5061483 - DNA, 15 bp, Homo sapiens
atcccagttcatgtt

SEQ ID NO: 5061484 - DNA, 14 bp, Homo sapiens
atcccagttcttcc

SEQ ID NO: 5061485 - DNA, 20 bp, Homo sapiens
atcccagttcttcctgcaac

SEQ ID NO: 5061486 - DNA, 21 bp, Homo sapiens
atcccagttcttcctgcaacc

SEQ ID NO: 5061487 - DNA, 16 bp, Homo sapiens
atcccatatgcctggg

SEQ ID NO: 5061488 - DNA, 11 bp, Homo sapiens
atcccatcagt

SEQ ID NO: 5061489 - DNA, 17 bp, Homo sapiens
atcccatcattttccat

SEQ ID NO: 5061490 - DNA, 15 bp, Homo sapiens
atcccatccatcagc

SEQ ID NO: 5061491 - DNA, 13 bp, Homo sapiens
atcccatcccatc

SEQ ID NO: 5061492 - DNA, 19 bp, Homo sapiens
atcccatcccatcccatcc

SEQ ID NO: 5061493 - DNA, 20 bp, Homo sapiens
atcccatcccgctcttttcc

SEQ ID NO: 5061494 - DNA, 12 bp, Homo sapiens
atcccatccctt

SEQ ID NO: 5061495 - DNA, 23 bp, Homo sapiens
atcccatcgtctcggccttcaca

SEQ ID NO: 5061496 - DNA, 17 bp, Homo sapiens
atcccatctcagaagat

SEQ ID NO: 5061497 - DNA, 21 bp, Homo sapiens
atcccatctcagaagatgggt

SEQ ID NO: 5061498 - DNA, 13 bp, Homo sapiens
atcccatctctcc

SEQ ID NO: 5061499 - DNA, 22 bp, Homo sapiens
atcccatctctcccacttcctc

SEQ ID NO: 5061500 - DNA, 18 bp, Homo sapiens
atcccatgaacacactgt

SEQ ID NO: 5061501 - DNA, 19 bp, Homo sapiens
atcccatgagaccctggtg

SEQ ID NO: 5061502 - DNA, 13 bp, Homo sapiens
atcccatgtaaca

SEQ ID NO: 5061503 - DNA, 19 bp, Homo sapiens
atcccatgtaacagaaagg

SEQ ID NO: 5061504 - DNA, 17 bp, Homo sapiens
atcccatgtcacctcag

SEQ ID NO: 5061505 - DNA, 15 bp, Homo sapiens
atcccatgttgaagt

SEQ ID NO: 5061506 - DNA, 15 bp, Homo sapiens
atcccattattcaaa

SEQ ID NO: 5061507 - DNA, 14 bp, Homo sapiens
atcccattcacttc

SEQ ID NO: 5061508 - DNA, 12 bp, Homo sapiens
atcccattccag

SEQ ID NO: 5061509 - DNA, 14 bp, Homo sapiens
atcccattgccctg

SEQ ID NO: 5061510 - DNA, 16 bp, Homo sapiens
atcccattgccctggt

SEQ ID NO: 5061511 - DNA, 17 bp, Homo sapiens
atcccattgtatttaaa

SEQ ID NO: 5061512 - DNA, 21 bp, Homo sapiens
atcccatttagtgtgaatatt

SEQ ID NO: 5061513 - DNA, 23 bp, Homo sapiens
atcccatttcttgaaaagccttg

SEQ ID NO: 5061514 - DNA, 16 bp, Homo sapiens
atcccattttcatcct

SEQ ID NO: 5061515 - DNA, 20 bp, Homo sapiens
atccccaaaacaaagtcttt

SEQ ID NO: 5061516 - DNA, 23 bp, Homo sapiens
atccccaaactgtgccctgcctt

SEQ ID NO: 5061517 - DNA, 16 bp, Homo sapiens
atccccaaatgtgtct

SEQ ID NO: 5061518 - DNA, 16 bp, Homo sapiens
atccccaaccccctgt

SEQ ID NO: 5061519 - DNA, 17 bp, Homo sapiens
atccccaagaccccctg

SEQ ID NO: 5061520 - DNA, 12 bp, Homo sapiens
atccccaagctg

SEQ ID NO: 5061521 - DNA, 16 bp, Homo sapiens
atccccaagctggcag

SEQ ID NO: 5061522 - DNA, 18 bp, Homo sapiens
atccccaagctggcagct

SEQ ID NO: 5061523 - DNA, 17 bp, Homo sapiens
atccccaaggcacttga

SEQ ID NO: 5061524 - DNA, 22 bp, Homo sapiens
atccccaataattgcagaacta

SEQ ID NO: 5061525 - DNA, 11 bp, Homo sapiens
atccccaccct

SEQ ID NO: 5061526 - DNA, 14 bp, Homo sapiens
atccccaccctggg

SEQ ID NO: 5061527 - DNA, 16 bp, Homo sapiens
atccccacgccacagc

SEQ ID NO: 5061528 - DNA, 18 bp, Homo sapiens
atccccacgccacagccc

SEQ ID NO: 5061529 - DNA, 12 bp, Homo sapiens
atccccagagcc

SEQ ID NO: 5061530 - DNA, 17 bp, Homo sapiens
atccccagagcccagct

SEQ ID NO: 5061531 - DNA, 19 bp, Homo sapiens
atccccagagcccagctct

SEQ ID NO: 5061532 - DNA, 20 bp, Homo sapiens
atccccagagcccagctctt

SEQ ID NO: 5061533 - DNA, 16 bp, Homo sapiens
atccccagcctaggac

SEQ ID NO: 5061534 - DNA, 18 bp, Homo sapiens
atccccagggcagcctcg

SEQ ID NO: 5061535 - DNA, 19 bp, Homo sapiens
atccccagggcccaccccc

SEQ ID NO: 5061536 - DNA, 17 bp, Homo sapiens
atccccaggtccccaaa

SEQ ID NO: 5061537 - DNA, 18 bp, Homo sapiens
atccccaggtccccaaac

SEQ ID NO: 5061538 - DNA, 19 bp, Homo sapiens
atccccaggtccccaaact

SEQ ID NO: 5061539 - DNA, 13 bp, Homo sapiens
atccccaggtctc

SEQ ID NO: 5061540 - DNA, 17 bp, Homo sapiens
atccccaggtctctcca

SEQ ID NO: 5061541 - DNA, 22 bp, Homo sapiens
atccccagttcgcctggagccc

SEQ ID NO: 5061542 - DNA, 16 bp, Homo sapiens
atccccatcctccaga

SEQ ID NO: 5061543 - DNA, 17 bp, Homo sapiens
atccccatcctccagag

SEQ ID NO: 5061544 - DNA, 15 bp, Homo sapiens
atccccatcggccct

SEQ ID NO: 5061545 - DNA, 17 bp, Homo sapiens
atccccatcggccctgt

SEQ ID NO: 5061546 - DNA, 19 bp, Homo sapiens
atccccatcggccctgtcc

SEQ ID NO: 5061547 - DNA, 23 bp, Homo sapiens
atccccatcggccctgtcccctg

SEQ ID NO: 5061548 - DNA, 13 bp, Homo sapiens
atccccatctccc

SEQ ID NO: 5061549 - DNA, 19 bp, Homo sapiens
atccccatctccctgcctg

SEQ ID NO: 5061550 - DNA, 18 bp, Homo sapiens
atccccatgcctgtggct

SEQ ID NO: 5061551 - DNA, 20 bp, Homo sapiens
atccccatgcctgtggctgc

SEQ ID NO: 5061552 - DNA, 21 bp, Homo sapiens
atccccatggaacagccctgc

SEQ ID NO: 5061553 - DNA, 19 bp, Homo sapiens
atcccccaaacagcatgtg

SEQ ID NO: 5061554 - DNA, 13 bp, Homo sapiens
atcccccaaagtt

SEQ ID NO: 5061555 - DNA, 16 bp, Homo sapiens
atcccccactgccaca

SEQ ID NO: 5061556 - DNA, 14 bp, Homo sapiens
atcccccaggagaa

SEQ ID NO: 5061557 - DNA, 12 bp, Homo sapiens
atcccccaggga

SEQ ID NO: 5061558 - DNA, 12 bp, Homo sapiens
atccccccaccc

SEQ ID NO: 5061559 - DNA, 17 bp, Homo sapiens
atccccccatcttgctt

SEQ ID NO: 5061560 - DNA, 22 bp, Homo sapiens
atccccccattttctctattct

SEQ ID NO: 5061561 - DNA, 16 bp, Homo sapiens
atcccccccagcctgg

SEQ ID NO: 5061562 - DNA, 14 bp, Homo sapiens
atcccccctgctgc

SEQ ID NO: 5061563 - DNA, 16 bp, Homo sapiens
atcccccctgctgccc

SEQ ID NO: 5061564 - DNA, 17 bp, Homo sapiens
atcccccctgctgccca

SEQ ID NO: 5061565 - DNA, 18 bp, Homo sapiens
atccccctcctctccctg

SEQ ID NO: 5061566 - DNA, 14 bp, Homo sapiens
atccccctccttgc

SEQ ID NO: 5061567 - DNA, 19 bp, Homo sapiens
ggcaggatggcctttcctt

SEQ ID NO: 5061568 - DNA, 21 bp, Homo sapiens
ggcaggatggcctttccttcc

SEQ ID NO: 5061569 - DNA, 23 bp, Homo sapiens
ggcaggatggcctttccttccct

SEQ ID NO: 5061570 - DNA, 22 bp, Homo sapiens
ggcaggatgggggagaggggga

SEQ ID NO: 5061571 - DNA, 22 bp, Homo sapiens
ggcaggattggggaagagagcc

SEQ ID NO: 5061572 - DNA, 17 bp, Homo sapiens
ggcaggcaaaggccccc

SEQ ID NO: 5061573 - DNA, 13 bp, Homo sapiens
ggcaggcacagca

SEQ ID NO: 5061574 - DNA, 17 bp, Homo sapiens
ggcaggcagagaagtgg

SEQ ID NO: 5061575 - DNA, 14 bp, Homo sapiens
ggcaggcagagctc

SEQ ID NO: 5061576 - DNA, 17 bp, Homo sapiens
ggcaggcagaggcccag

SEQ ID NO: 5061577 - DNA, 23 bp, Homo sapiens
ggcaggcagaggcccaggctgcc

SEQ ID NO: 5061578 - DNA, 19 bp, Homo sapiens
ggcaggcagcctgagagct

SEQ ID NO: 5061579 - DNA, 20 bp, Homo sapiens
ggcaggcagctaggcaggga

SEQ ID NO: 5061580 - DNA, 14 bp, Homo sapiens
ggcaggcagggctc

SEQ ID NO: 5061581 - DNA, 22 bp, Homo sapiens
ggcaggcagggctctcctggct

SEQ ID NO: 5061582 - DNA, 17 bp, Homo sapiens
ggcaggcagggctgcag

SEQ ID NO: 5061583 - DNA, 14 bp, Homo sapiens
ggcaggcaggtgtt

SEQ ID NO: 5061584 - DNA, 10 bp, Homo sapiens
ggcaggcagt

SEQ ID NO: 5061585 - DNA, 15 bp, Homo sapiens
ggcaggcatggccct

SEQ ID NO: 5061586 - DNA, 17 bp, Homo sapiens
ggcaggcatggccctgg

SEQ ID NO: 5061587 - DNA, 20 bp, Homo sapiens
ggcaggcatggccctgggcg

SEQ ID NO: 5061588 - DNA, 22 bp, Homo sapiens
ggcaggcatggctggtgcctga

SEQ ID NO: 5061589 - DNA, 14 bp, Homo sapiens
ggcaggcattcctg

SEQ ID NO: 5061590 - DNA, 18 bp, Homo sapiens
ggcaggccacctggctct

SEQ ID NO: 5061591 - DNA, 18 bp, Homo sapiens
ggcaggccagatggcccc

SEQ ID NO: 5061592 - DNA, 16 bp, Homo sapiens
ggcaggccagcaataa

SEQ ID NO: 5061593 - DNA, 23 bp, Homo sapiens
ggcaggccagcttcgtgctggag

SEQ ID NO: 5061594 - DNA, 13 bp, Homo sapiens
ggcaggcccactc

SEQ ID NO: 5061595 - DNA, 15 bp, Homo sapiens
ggcaggcccactccc

SEQ ID NO: 5061596 - DNA, 21 bp, Homo sapiens
ggcaggcccactccccagccc

SEQ ID NO: 5061597 - DNA, 13 bp, Homo sapiens
ggcaggcccagcc

SEQ ID NO: 5061598 - DNA, 14 bp, Homo sapiens
ggcaggcccagcct

SEQ ID NO: 5061599 - DNA, 19 bp, Homo sapiens
ggcaggcccagcctctgcc

SEQ ID NO: 5061600 - DNA, 14 bp, Homo sapiens
ggcaggccctgcac

SEQ ID NO: 5061601 - DNA, 14 bp, Homo sapiens
ggcaggccctgccc

SEQ ID NO: 5061602 - DNA, 18 bp, Homo sapiens
ggcaggccctgcccagcc

SEQ ID NO: 5061603 - DNA, 16 bp, Homo sapiens
ggcaggccgggcctgc

SEQ ID NO: 5061604 - DNA, 20 bp, Homo sapiens
ggcaggcctaggacctcagg

SEQ ID NO: 5061605 - DNA, 19 bp, Homo sapiens
ggcaggcctcccaagctga

SEQ ID NO: 5061606 - DNA, 22 bp, Homo sapiens
ggcaggcctcccaagctgatgg

SEQ ID NO: 5061607 - DNA, 18 bp, Homo sapiens
ggcaggcctccctttggg

SEQ ID NO: 5061608 - DNA, 12 bp, Homo sapiens
ggcaggcctccg

SEQ ID NO: 5061609 - DNA, 14 bp, Homo sapiens
ggcaggcctgaccc

SEQ ID NO: 5061610 - DNA, 21 bp, Homo sapiens
ggcaggcctgagaatgagtgg

SEQ ID NO: 5061611 - DNA, 13 bp, Homo sapiens
ggcaggcctggga

SEQ ID NO: 5061612 - DNA, 19 bp, Homo sapiens
ggcaggcctgggacccagc

SEQ ID NO: 5061613 - DNA, 16 bp, Homo sapiens
ggcaggccttgctggg

SEQ ID NO: 5061614 - DNA, 17 bp, Homo sapiens
ggcaggccttgctgggg

SEQ ID NO: 5061615 - DNA, 14 bp, Homo sapiens
ggcaggcctttcct

SEQ ID NO: 5061616 - DNA, 15 bp, Homo sapiens
ggcaggcctttccta

SEQ ID NO: 5061617 - DNA, 14 bp, Homo sapiens
ggcaggcctttttg

SEQ ID NO: 5061618 - DNA, 23 bp, Homo sapiens
ggcaggcgcatgagtatctgtgg

SEQ ID NO: 5061619 - DNA, 15 bp, Homo sapiens
ggcaggcgtgtggca

SEQ ID NO: 5061620 - DNA, 20 bp, Homo sapiens
ggcaggcgtgtggcagccac

SEQ ID NO: 5061621 - DNA, 21 bp, Homo sapiens
ggcaggcgtgtggcagccaca

SEQ ID NO: 5061622 - DNA, 17 bp, Homo sapiens
ggcaggctaaggcgtgg

SEQ ID NO: 5061623 - DNA, 21 bp, Homo sapiens
ggcaggctaaggcgtggagct

SEQ ID NO: 5061624 - DNA, 17 bp, Homo sapiens
ggcaggctacagttggg

SEQ ID NO: 5061625 - DNA, 16 bp, Homo sapiens
ggcaggctaccccttc

SEQ ID NO: 5061626 - DNA, 15 bp, Homo sapiens
ggcaggctcactgcc

SEQ ID NO: 5061627 - DNA, 19 bp, Homo sapiens
ggcaggctcactgccaggc

SEQ ID NO: 5061628 - DNA, 22 bp, Homo sapiens
ggcaggctcactgccaggccag

SEQ ID NO: 5061629 - DNA, 19 bp, Homo sapiens
ggcaggctcatttcactaa

SEQ ID NO: 5061630 - DNA, 17 bp, Homo sapiens
ggcaggctgaggtgggg

SEQ ID NO: 5061631 - DNA, 16 bp, Homo sapiens
ggcaggctgggccatg

SEQ ID NO: 5061632 - DNA, 22 bp, Homo sapiens
ggcaggctgggccatgtccaaa

SEQ ID NO: 5061633 - DNA, 22 bp, Homo sapiens
ggcaggctgtctggccaggcct

SEQ ID NO: 5061634 - DNA, 17 bp, Homo sapiens
ggcaggcttggggaaaa

SEQ ID NO: 5061635 - DNA, 17 bp, Homo sapiens
ggcagggaacatgggga

SEQ ID NO: 5061636 - DNA, 18 bp, Homo sapiens
ggcagggaacatggggag

SEQ ID NO: 5061637 - DNA, 18 bp, Homo sapiens
ggcagggaaggacaggac

SEQ ID NO: 5061638 - DNA, 22 bp, Homo sapiens
ggcagggaagggtgcctggctg

SEQ ID NO: 5061639 - DNA, 16 bp, Homo sapiens
ggcagggaatgcctgg

SEQ ID NO: 5061640 - DNA, 18 bp, Homo sapiens
ggcagggaatgcctggag

SEQ ID NO: 5061641 - DNA, 16 bp, Homo sapiens
ggcagggacagggccg

SEQ ID NO: 5061642 - DNA, 14 bp, Homo sapiens
ggcagggaccacac

SEQ ID NO: 5061643 - DNA, 19 bp, Homo sapiens
ggcagggaccggcagagct

SEQ ID NO: 5061644 - DNA, 19 bp, Homo sapiens
ggcagggacttgcctccac

SEQ ID NO: 5061645 - DNA, 14 bp, Homo sapiens
ggcagggaggcagc

SEQ ID NO: 5061646 - DNA, 17 bp, Homo sapiens
ggcagggagggcctggg

SEQ ID NO: 5061647 - DNA, 19 bp, Homo sapiens
ggcagggagggcctgggcc

SEQ ID NO: 5061648 - DNA, 20 bp, Homo sapiens
ggcagggagtgtctgcagtc

SEQ ID NO: 5061649 - DNA, 22 bp, Homo sapiens
ggcagggagtgtctgcagtcct

SEQ ID NO: 5061650 - DNA, 18 bp, Homo sapiens
ggcagggatgggggtggc

SEQ ID NO: 5061651 - DNA, 16 bp, Homo sapiens
ggcagggcaaaggtca

SEQ ID NO: 5061652 - DNA, 15 bp, Homo sapiens
ggcagggcagaggga

SEQ ID NO: 5061653 - DNA, 11 bp, Homo sapiens
ggcagggcagc

SEQ ID NO: 5061654 - DNA, 14 bp, Homo sapiens
ggcagggcagcctg

SEQ ID NO: 5061655 - DNA, 15 bp, Homo sapiens
ggcagggcaggacca

SEQ ID NO: 5061656 - DNA, 17 bp, Homo sapiens
ggcagggccaccccact

SEQ ID NO: 5061657 - DNA, 19 bp, Homo sapiens
ggcagggccacctgcagga

SEQ ID NO: 5061658 - DNA, 23 bp, Homo sapiens
ggcagggccactcaacagagagg

SEQ ID NO: 5061659 - DNA, 11 bp, Homo sapiens
ggcagggccag

SEQ ID NO: 5061660 - DNA, 12 bp, Homo sapiens
ggcagggccagg

SEQ ID NO: 5061661 - DNA, 18 bp, Homo sapiens
ggcagggccaggcctctg

SEQ ID NO: 5061662 - DNA, 13 bp, Homo sapiens
ggcagggccaggg

SEQ ID NO: 5061663 - DNA, 15 bp, Homo sapiens
ggcagggccagggca

SEQ ID NO: 5061664 - DNA, 21 bp, Homo sapiens
ggcagggccagggcaatgcca

SEQ ID NO: 5061665 - DNA, 17 bp, Homo sapiens
ggcagggccagggggtg

SEQ ID NO: 5061666 - DNA, 14 bp, Homo sapiens
ggcagggcccacgt

SEQ ID NO: 5061667 - DNA, 17 bp, Homo sapiens
ggcagggcccacgtgta

SEQ ID NO: 5061668 - DNA, 19 bp, Homo sapiens
ggcagggcccatctgccgc

SEQ ID NO: 5061669 - DNA, 16 bp, Homo sapiens
ggcagggccccaggca

SEQ ID NO: 5061670 - DNA, 18 bp, Homo sapiens
ggcagggcccccaataaa

SEQ ID NO: 5061671 - DNA, 22 bp, Homo sapiens
ggcagggccctgaaatggcctg

SEQ ID NO: 5061672 - DNA, 23 bp, Homo sapiens
gcctctggggagaccgagtgtgg

SEQ ID NO: 5061673 - DNA, 16 bp, Homo sapiens
gcctctggggcagagc

SEQ ID NO: 5061674 - DNA, 18 bp, Homo sapiens
gcctctggggcagagctt

SEQ ID NO: 5061675 - DNA, 16 bp, Homo sapiens
gcctctggggcaggac

SEQ ID NO: 5061676 - DNA, 18 bp, Homo sapiens
gcctctggggcaggacca

SEQ ID NO: 5061677 - DNA, 23 bp, Homo sapiens
gcctctggggcaggaccactagc

SEQ ID NO: 5061678 - DNA, 17 bp, Homo sapiens
gcctctggggggtggcc

SEQ ID NO: 5061679 - DNA, 13 bp, Homo sapiens
gcctctgggtcag

SEQ ID NO: 5061680 - DNA, 20 bp, Homo sapiens
gcctctgggtgagtggctga

SEQ ID NO: 5061681 - DNA, 12 bp, Homo sapiens
gcctctggtcct

SEQ ID NO: 5061682 - DNA, 14 bp, Homo sapiens
gcctctggttccac

SEQ ID NO: 5061683 - DNA, 21 bp, Homo sapiens
gcctctggttccactcagctt

SEQ ID NO: 5061684 - DNA, 12 bp, Homo sapiens
gcctctggttgc

SEQ ID NO: 5061685 - DNA, 20 bp, Homo sapiens
gcctctgtcactgcaggcac

SEQ ID NO: 5061686 - DNA, 16 bp, Homo sapiens
gcctctgtcaggcctt

SEQ ID NO: 5061687 - DNA, 18 bp, Homo sapiens
gcctctgtccccttctct

SEQ ID NO: 5061688 - DNA, 20 bp, Homo sapiens
gcctctgtccccttctctca

SEQ ID NO: 5061689 - DNA, 21 bp, Homo sapiens
gcctctgtccccttctctcat

SEQ ID NO: 5061690 - DNA, 22 bp, Homo sapiens
gcctctgtcccggaagagtcat

SEQ ID NO: 5061691 - DNA, 13 bp, Homo sapiens
gcctctgtccctc

SEQ ID NO: 5061692 - DNA, 19 bp, Homo sapiens
gcctctgtccgtgcccctt

SEQ ID NO: 5061693 - DNA, 23 bp, Homo sapiens
gcctctgtccgtgccccttccct

SEQ ID NO: 5061694 - DNA, 21 bp, Homo sapiens
gcctctgtcctggctgtgcac

SEQ ID NO: 5061695 - DNA, 22 bp, Homo sapiens
gcctctgtcctggctgtgcaca

SEQ ID NO: 5061696 - DNA, 16 bp, Homo sapiens
gcctctgtctggagcc

SEQ ID NO: 5061697 - DNA, 23 bp, Homo sapiens
gcctctgtctggcaatgccacag

SEQ ID NO: 5061698 - DNA, 19 bp, Homo sapiens
gcctctgtgattacataga

SEQ ID NO: 5061699 - DNA, 17 bp, Homo sapiens
gcctctgtggaagagat

SEQ ID NO: 5061700 - DNA, 12 bp, Homo sapiens
gcctctgtgtac

SEQ ID NO: 5061701 - DNA, 14 bp, Homo sapiens
gcctctgtgtacaa

SEQ ID NO: 5061702 - DNA, 16 bp, Homo sapiens
gcctctgtgtcactgg

SEQ ID NO: 5061703 - DNA, 19 bp, Homo sapiens
gcctctgtgtcactggctg

SEQ ID NO: 5061704 - DNA, 20 bp, Homo sapiens
gcctctgtgtcactggctgc

SEQ ID NO: 5061705 - DNA, 18 bp, Homo sapiens
gcctctgtgtccttccct

SEQ ID NO: 5061706 - DNA, 20 bp, Homo sapiens
gcctctgttcctttctctgg

SEQ ID NO: 5061707 - DNA, 21 bp, Homo sapiens
gcctctgttcctttctctggg

SEQ ID NO: 5061708 - DNA, 22 bp, Homo sapiens
gcctcttaaaaattatctttaa

SEQ ID NO: 5061709 - DNA, 18 bp, Homo sapiens
gcctcttaaagctgcctg

SEQ ID NO: 5061710 - DNA, 19 bp, Homo sapiens
gcctcttaaagctgcctgt

SEQ ID NO: 5061711 - DNA, 19 bp, Homo sapiens
gcctcttaaataaaccttt

SEQ ID NO: 5061712 - DNA, 22 bp, Homo sapiens
gcctcttaacttaaaagaacat

SEQ ID NO: 5061713 - DNA, 19 bp, Homo sapiens
gcctcttactaatgtaaaa

SEQ ID NO: 5061714 - DNA, 15 bp, Homo sapiens
gcctcttacttgcca

SEQ ID NO: 5061715 - DNA, 16 bp, Homo sapiens
gcctcttagtgattgt

SEQ ID NO: 5061716 - DNA, 20 bp, Homo sapiens
gcctcttattccaggagaag

SEQ ID NO: 5061717 - DNA, 15 bp, Homo sapiens
gcctcttcagcagca

SEQ ID NO: 5061718 - DNA, 22 bp, Homo sapiens
gcctcttcagcagcatctactc

SEQ ID NO: 5061719 - DNA, 14 bp, Homo sapiens
gcctcttcagcccc

SEQ ID NO: 5061720 - DNA, 13 bp, Homo sapiens
gcctcttccaccc

SEQ ID NO: 5061721 - DNA, 21 bp, Homo sapiens
gcctcttccagtcttcctgac

SEQ ID NO: 5061722 - DNA, 14 bp, Homo sapiens
gcctcttccagtga

SEQ ID NO: 5061723 - DNA, 15 bp, Homo sapiens
gcctcttccctcagt

SEQ ID NO: 5061724 - DNA, 17 bp, Homo sapiens
gcctcttcctccccatg

SEQ ID NO: 5061725 - DNA, 22 bp, Homo sapiens
gcctcttcctccctcattccac

SEQ ID NO: 5061726 - DNA, 13 bp, Homo sapiens
gcctcttcctctg

SEQ ID NO: 5061727 - DNA, 15 bp, Homo sapiens
gcctcttcctctggg

SEQ ID NO: 5061728 - DNA, 17 bp, Homo sapiens
gcctcttcctctgggca

SEQ ID NO: 5061729 - DNA, 23 bp, Homo sapiens
gcctcttcctctgggcagcgcta

SEQ ID NO: 5061730 - DNA, 14 bp, Homo sapiens
gcctcttcctgttg

SEQ ID NO: 5061731 - DNA, 23 bp, Homo sapiens
gcctcttcgcctttcccaccctc

SEQ ID NO: 5061732 - DNA, 15 bp, Homo sapiens
gcctcttctacttgt

SEQ ID NO: 5061733 - DNA, 20 bp, Homo sapiens
gcctcttctacttgtaaaat

SEQ ID NO: 5061734 - DNA, 21 bp, Homo sapiens
gcctcttctcctgcagcctga

SEQ ID NO: 5061735 - DNA, 19 bp, Homo sapiens
gcctcttctcttgacagtc

SEQ ID NO: 5061736 - DNA, 20 bp, Homo sapiens
gcctcttctcttgacagtct

SEQ ID NO: 5061737 - DNA, 18 bp, Homo sapiens
gcctcttctgggagggca

SEQ ID NO: 5061738 - DNA, 19 bp, Homo sapiens
gcctcttctgtcccaagtc

SEQ ID NO: 5061739 - DNA, 16 bp, Homo sapiens
gcctcttctgtccctg

SEQ ID NO: 5061740 - DNA, 14 bp, Homo sapiens
gcctcttctttgtg

SEQ ID NO: 5061741 - DNA, 14 bp, Homo sapiens
gcctcttgaccagg

SEQ ID NO: 5061742 - DNA, 17 bp, Homo sapiens
gcctcttgaccaggctg

SEQ ID NO: 5061743 - DNA, 12 bp, Homo sapiens
gcctcttgcccg

SEQ ID NO: 5061744 - DNA, 15 bp, Homo sapiens
tatttctgtgtccag

SEQ ID NO: 5061745 - DNA, 13 bp, Homo sapiens
tatttctgtgtta

SEQ ID NO: 5061746 - DNA, 16 bp, Homo sapiens
tatttctgtttctcat

SEQ ID NO: 5061747 - DNA, 17 bp, Homo sapiens
tatttcttaaaattcag

SEQ ID NO: 5061748 - DNA, 20 bp, Homo sapiens
tatttcttaaacaaatgtat

SEQ ID NO: 5061749 - DNA, 15 bp, Homo sapiens
tatttcttaaagctt

SEQ ID NO: 5061750 - DNA, 20 bp, Homo sapiens
tatttcttaagaattcaaat

SEQ ID NO: 5061751 - DNA, 15 bp, Homo sapiens
tatttcttaatttgg

SEQ ID NO: 5061752 - DNA, 23 bp, Homo sapiens
tatttcttacaggcacaaaatga

SEQ ID NO: 5061753 - DNA, 19 bp, Homo sapiens
tatttcttatatatgtgaa

SEQ ID NO: 5061754 - DNA, 16 bp, Homo sapiens
tatttcttatttgaaa

SEQ ID NO: 5061755 - DNA, 14 bp, Homo sapiens
tatttcttcaaata

SEQ ID NO: 5061756 - DNA, 12 bp, Homo sapiens
tatttcttccct

SEQ ID NO: 5061757 - DNA, 22 bp, Homo sapiens
tatttcttctcttatcctctct

SEQ ID NO: 5061758 - DNA, 12 bp, Homo sapiens
tatttcttcttc

SEQ ID NO: 5061759 - DNA, 19 bp, Homo sapiens
tatttcttcttcacatcca

SEQ ID NO: 5061760 - DNA, 20 bp, Homo sapiens
tatttcttcttcacatccat

SEQ ID NO: 5061761 - DNA, 23 bp, Homo sapiens
tatttcttcttctaagaagacat

SEQ ID NO: 5061762 - DNA, 23 bp, Homo sapiens
tatttcttgtggttataacttaa

SEQ ID NO: 5061763 - DNA, 14 bp, Homo sapiens
tatttcttgtttgt

SEQ ID NO: 5061764 - DNA, 15 bp, Homo sapiens
tatttctttctcgaa

SEQ ID NO: 5061765 - DNA, 18 bp, Homo sapiens
tatttctttgtgataaca

SEQ ID NO: 5061766 - DNA, 22 bp, Homo sapiens
tatttctttgtgataacaaaga

SEQ ID NO: 5061767 - DNA, 13 bp, Homo sapiens
tatttcttttata

SEQ ID NO: 5061768 - DNA, 14 bp, Homo sapiens
tatttcttttatat

SEQ ID NO: 5061769 - DNA, 18 bp, Homo sapiens
tatttcttttatatataa

SEQ ID NO: 5061770 - DNA, 22 bp, Homo sapiens
tatttcttttatatataaaata

SEQ ID NO: 5061771 - DNA, 20 bp, Homo sapiens
tatttcttttgtgcagatca

SEQ ID NO: 5061772 - DNA, 12 bp, Homo sapiens
tatttcttttta

SEQ ID NO: 5061773 - DNA, 15 bp, Homo sapiens
tatttctttttatag

SEQ ID NO: 5061774 - DNA, 18 bp, Homo sapiens
tatttgaaaaaagaagag

SEQ ID NO: 5061775 - DNA, 22 bp, Homo sapiens
tatttgaaaacatataaagcac

SEQ ID NO: 5061776 - DNA, 20 bp, Homo sapiens
tatttgaaaacatgtttatt

SEQ ID NO: 5061777 - DNA, 20 bp, Homo sapiens
tatttgaaaattacatgttt

SEQ ID NO: 5061778 - DNA, 23 bp, Homo sapiens
tatttgaaaattacctttaatgc

SEQ ID NO: 5061779 - DNA, 15 bp, Homo sapiens
tatttgaaagtgcct

SEQ ID NO: 5061780 - DNA, 15 bp, Homo sapiens
tatttgaaatactaa

SEQ ID NO: 5061781 - DNA, 19 bp, Homo sapiens
tatttgaaatactaaaagc

SEQ ID NO: 5061782 - DNA, 13 bp, Homo sapiens
tatttgaagaaaa

SEQ ID NO: 5061783 - DNA, 17 bp, Homo sapiens
tatttgaagaaaaaaat

SEQ ID NO: 5061784 - DNA, 17 bp, Homo sapiens
tatttgaagactgattt

SEQ ID NO: 5061785 - DNA, 20 bp, Homo sapiens
tatttgaagatttaattact

SEQ ID NO: 5061786 - DNA, 14 bp, Homo sapiens
tatttgaagcagct

SEQ ID NO: 5061787 - DNA, 14 bp, Homo sapiens
tatttgaataaatt

SEQ ID NO: 5061788 - DNA, 12 bp, Homo sapiens
tatttgaatctt

SEQ ID NO: 5061789 - DNA, 16 bp, Homo sapiens
tatttgaatcttgtct

SEQ ID NO: 5061790 - DNA, 20 bp, Homo sapiens
tatttgaatcttgtctcaat

SEQ ID NO: 5061791 - DNA, 13 bp, Homo sapiens
tatttgaatgaaa

SEQ ID NO: 5061792 - DNA, 17 bp, Homo sapiens
tatttgaatgaaaacat

SEQ ID NO: 5061793 - DNA, 19 bp, Homo sapiens
tatttgaatgaacactatg

SEQ ID NO: 5061794 - DNA, 21 bp, Homo sapiens
tatttgaatgatttttcttta

SEQ ID NO: 5061795 - DNA, 22 bp, Homo sapiens
tatttgaatgtatgcttcatac

SEQ ID NO: 5061796 - DNA, 16 bp, Homo sapiens
tatttgaattaaaact

SEQ ID NO: 5061797 - DNA, 18 bp, Homo sapiens
tatttgaattaaaacttc

SEQ ID NO: 5061798 - DNA, 21 bp, Homo sapiens
tatttgaattaaaacttctta

SEQ ID NO: 5061799 - DNA, 17 bp, Homo sapiens
tatttgaattatttctg

SEQ ID NO: 5061800 - DNA, 17 bp, Homo sapiens
tatttgacagacatcct

SEQ ID NO: 5061801 - DNA, 18 bp, Homo sapiens
tatttgactaaagcatca

SEQ ID NO: 5061802 - DNA, 17 bp, Homo sapiens
tatttgactctttcaaa

SEQ ID NO: 5061803 - DNA, 21 bp, Homo sapiens
tatttgactctttcaaagaaa

SEQ ID NO: 5061804 - DNA, 15 bp, Homo sapiens
tatttgactgcttca

SEQ ID NO: 5061805 - DNA, 13 bp, Homo sapiens
tatttgacttgaa

SEQ ID NO: 5061806 - DNA, 19 bp, Homo sapiens
tatttgacttgcatgaaga

SEQ ID NO: 5061807 - DNA, 22 bp, Homo sapiens
tatttgacttgcatgaagagaa

SEQ ID NO: 5061808 - DNA, 14 bp, Homo sapiens
tatttgagaaaata

SEQ ID NO: 5061809 - DNA, 12 bp, Homo sapiens
tatttgagacgg

SEQ ID NO: 5061810 - DNA, 19 bp, Homo sapiens
tatttgagagagagaacct

SEQ ID NO: 5061811 - DNA, 18 bp, Homo sapiens
tatttgagagttctaaat

SEQ ID NO: 5061812 - DNA, 19 bp, Homo sapiens
tatttgagagttctaaatt

SEQ ID NO: 5061813 - DNA, 20 bp, Homo sapiens
tatttgagcaagtaacatta

SEQ ID NO: 5061814 - DNA, 16 bp, Homo sapiens
tatttgaggaaactca

SEQ ID NO: 5061815 - DNA, 17 bp, Homo sapiens
tatttgaggagtgttaa

SEQ ID NO: 5061816 - DNA, 20 bp, Homo sapiens
tatttgagtttctttcagat

SEQ ID NO: 5061817 - DNA, 19 bp, Homo sapiens
tatttgagtttgacattta

SEQ ID NO: 5061818 - DNA, 14 bp, Homo sapiens
tatttgatctggtg

SEQ ID NO: 5061819 - DNA, 21 bp, Homo sapiens
tatttgattagggtagtaatt

SEQ ID NO: 5061820 - DNA, 13 bp, Homo sapiens
tatttgattattt

SEQ ID NO: 5061821 - DNA, 15 bp, Homo sapiens
tatttgattcaaaat

SEQ ID NO: 5061822 - DNA, 16 bp, Homo sapiens
tatttgattcaaaata

SEQ ID NO: 5061823 - DNA, 17 bp, Homo sapiens
tatttgattcaaaatat

SEQ ID NO: 5061824 - DNA, 13 bp, Homo sapiens
tatttgatttcta

SEQ ID NO: 5061825 - DNA, 14 bp, Homo sapiens
tatttgatttgcaa

SEQ ID NO: 5061826 - DNA, 14 bp, Homo sapiens
tatttgcaacattt

SEQ ID NO: 5061827 - DNA, 15 bp, Homo sapiens
tatttgcaatttgag

SEQ ID NO: 5061828 - DNA, 17 bp, Homo sapiens
tatttgcacatgggatt

SEQ ID NO: 5061829 - DNA, 20 bp, Homo sapiens
tatttgcacatgggattgct

SEQ ID NO: 5061830 - DNA, 18 bp, Homo sapiens
tatttgcactaagatatt

SEQ ID NO: 5061831 - DNA, 20 bp, Homo sapiens
tatttgcactatttccacat

SEQ ID NO: 5061832 - DNA, 22 bp, Homo sapiens
tatttgcacttatgtacttgat

SEQ ID NO: 5061833 - DNA, 23 bp, Homo sapiens
tatttgcagataattctggacca

SEQ ID NO: 5061834 - DNA, 19 bp, Homo sapiens
tatttgcagtatgaactat

SEQ ID NO: 5061835 - DNA, 15 bp, Homo sapiens
tatttgcagttactt

SEQ ID NO: 5061836 - DNA, 15 bp, Homo sapiens
tatttgcatgttatg

SEQ ID NO: 5061837 - DNA, 17 bp, Homo sapiens
tatttgccaataaagct

SEQ ID NO: 5061838 - DNA, 23 bp, Homo sapiens
tatttgccaataaagcttttgga

SEQ ID NO: 5061839 - DNA, 16 bp, Homo sapiens
tatttgcctaaatact

SEQ ID NO: 5061840 - DNA, 19 bp, Homo sapiens
tatttgcctccatgtagaa

SEQ ID NO: 5061841 - DNA, 17 bp, Homo sapiens
tatttgcctgtctgttt

SEQ ID NO: 5061842 - DNA, 19 bp, Homo sapiens
tatttgccttctgaaatgt

SEQ ID NO: 5061843 - DNA, 17 bp, Homo sapiens
tatttgcgtaaatggtt

SEQ ID NO: 5061844 - DNA, 16 bp, Homo sapiens
tatttgctaaatattt

SEQ ID NO: 5061845 - DNA, 19 bp, Homo sapiens
tatttgctaaatatttctt

SEQ ID NO: 5061846 - DNA, 16 bp, Homo sapiens
tatttgctaagaatgt

SEQ ID NO: 5061847 - DNA, 20 bp, Homo sapiens
tatttgctaataccaactat

SEQ ID NO: 5061848 - DNA, 22 bp, Homo sapiens
tatttgctaataccaactattt

SEQ ID NO: 5061849 - DNA, 15 bp, Homo sapiens
tatttgctaattaaa

SEQ ID NO: 5061850 - DNA, 23 bp, Homo sapiens
tatttgctaattaaaaagttaat

SEQ ID NO: 5061851 - DNA, 18 bp, Homo sapiens
tatttgctgcaaagagaa

SEQ ID NO: 5061852 - DNA, 18 bp, Homo sapiens
tatttgctgccagacact

SEQ ID NO: 5061853 - DNA, 19 bp, Homo sapiens
tatttgctgtattgccccc

SEQ ID NO: 5061854 - DNA, 14 bp, Homo sapiens
tatttgctgtcaca

SEQ ID NO: 5061855 - DNA, 20 bp, Homo sapiens
tatttgctgtcacatagttt

SEQ ID NO: 5061856 - DNA, 12 bp, Homo sapiens
tatttgctgttt

SEQ ID NO: 5061857 - DNA, 14 bp, Homo sapiens
tatttgcttattta

SEQ ID NO: 5061858 - DNA, 15 bp, Homo sapiens
tatttgcttatttat

SEQ ID NO: 5061859 - DNA, 17 bp, Homo sapiens
tatttgcttatttttat

SEQ ID NO: 5061860 - DNA, 16 bp, Homo sapiens
tatttggaaagagacc

SEQ ID NO: 5061861 - DNA, 16 bp, Homo sapiens
tatttggaaataaagt

SEQ ID NO: 5061862 - DNA, 19 bp, Homo sapiens
tatttggaaataaagtcag

SEQ ID NO: 5061863 - DNA, 20 bp, Homo sapiens
tatttggaagcaacgtgtta

SEQ ID NO: 5061864 - DNA, 16 bp, Homo sapiens
tatttggaatatttga

SEQ ID NO: 5061865 - DNA, 15 bp, Homo sapiens
tatttggaattagaa

SEQ ID NO: 5061866 - DNA, 16 bp, Homo sapiens
tatttggaattgacat

SEQ ID NO: 5061867 - DNA, 20 bp, Homo sapiens
tatttggaatttatatacaa

SEQ ID NO: 5061868 - DNA, 17 bp, Homo sapiens
tatttggaattttaagt

SEQ ID NO: 5061869 - DNA, 21 bp, Homo sapiens
tatttggacagccaagggcag

SEQ ID NO: 5061870 - DNA, 22 bp, Homo sapiens
tatttggagctatcagtgcttt

SEQ ID NO: 5061871 - DNA, 18 bp, Homo sapiens
tatttggagtggaggcat

SEQ ID NO: 5061872 - DNA, 16 bp, Homo sapiens
tatttggatatctgtt

SEQ ID NO: 5061873 - DNA, 15 bp, Homo sapiens
tatttggatgcagag

SEQ ID NO: 5061874 - DNA, 14 bp, Homo sapiens
tatttggcagtttg

SEQ ID NO: 5061875 - DNA, 17 bp, Homo sapiens
tatttggcagtttggta

SEQ ID NO: 5061876 - DNA, 15 bp, Homo sapiens
tatttggcttaaata

SEQ ID NO: 5061877 - DNA, 16 bp, Homo sapiens
tatttggcttaaatat

SEQ ID NO: 5061878 - DNA, 14 bp, Homo sapiens
tatttggcttgttt

SEQ ID NO: 5061879 - DNA, 23 bp, Homo sapiens
tatttgggagggaaaagggaagt

SEQ ID NO: 5061880 - DNA, 17 bp, Homo sapiens
tatttgggctctgaaat

SEQ ID NO: 5061881 - DNA, 22 bp, Homo sapiens
tatttggggttgcatcagaaat

SEQ ID NO: 5061882 - DNA, 22 bp, Homo sapiens
tatttggtaacttgctgtgaaa

SEQ ID NO: 5061883 - DNA, 15 bp, Homo sapiens
tatttggtccaaaaa

SEQ ID NO: 5061884 - DNA, 13 bp, Homo sapiens
tatttggtgctag

SEQ ID NO: 5061885 - DNA, 18 bp, Homo sapiens
tatttggtgctagtaaat

SEQ ID NO: 5061886 - DNA, 23 bp, Homo sapiens
tatttgtaaaagaacagtaaaca

SEQ ID NO: 5061887 - DNA, 16 bp, Homo sapiens
tatttgtaaaagctaa

SEQ ID NO: 5061888 - DNA, 17 bp, Homo sapiens
tatttgtaaaagctaag

SEQ ID NO: 5061889 - DNA, 14 bp, Homo sapiens
tatttgtaaagtga

SEQ ID NO: 5061890 - DNA, 17 bp, Homo sapiens
tatttgtaaatttatgt

SEQ ID NO: 5061891 - DNA, 17 bp, Homo sapiens
tatttgtaactttgcat

SEQ ID NO: 5061892 - DNA, 17 bp, Homo sapiens
tatttgtaagatatttg

SEQ ID NO: 5061893 - DNA, 14 bp, Homo sapiens
tatttgtaatagat

SEQ ID NO: 5061894 - DNA, 13 bp, Homo sapiens
tatttgtaattaa

SEQ ID NO: 5061895 - DNA, 18 bp, Homo sapiens
tatttgtacaaataaacc

SEQ ID NO: 5061896 - DNA, 20 bp, Homo sapiens
tatttgtacaattttaaagt

SEQ ID NO: 5061897 - DNA, 24 bp, Homo sapiens
tatttgtactgtttaatgttctgt

SEQ ID NO: 5061898 - DNA, 22 bp, Homo sapiens
tatttgtagataccgagaatga

SEQ ID NO: 5061899 - DNA, 17 bp, Homo sapiens
tatttgtagctagaata

SEQ ID NO: 5061900 - DNA, 15 bp, Homo sapiens
tatttgtaggagaaa

SEQ ID NO: 5061901 - DNA, 17 bp, Homo sapiens
tatttgtaggtatacta

SEQ ID NO: 5061902 - DNA, 19 bp, Homo sapiens
tatttgtaggtatactatg

SEQ ID NO: 5061903 - DNA, 20 bp, Homo sapiens
tatttgtaggtatactatgt

SEQ ID NO: 5061904 - DNA, 21 bp, Homo sapiens
tatttgtaggtatactatgta

SEQ ID NO: 5061905 - DNA, 22 bp, Homo sapiens
tatttgtaggtatactatgtaa

SEQ ID NO: 5061906 - DNA, 22 bp, Homo sapiens
tatttgtataaaagtgtgaaat

SEQ ID NO: 5061907 - DNA, 15 bp, Homo sapiens
tatttgtatatattt

SEQ ID NO: 5061908 - DNA, 14 bp, Homo sapiens
tatttgtatcacac

SEQ ID NO: 5061909 - DNA, 12 bp, Homo sapiens
tatttgtatctc

SEQ ID NO: 5061910 - DNA, 16 bp, Homo sapiens
tatttgtatgtactgt

SEQ ID NO: 5061911 - DNA, 19 bp, Homo sapiens
tatttgtatgtactgttat

SEQ ID NO: 5061912 - DNA, 14 bp, Homo sapiens
tatttgtattaata

SEQ ID NO: 5061913 - DNA, 15 bp, Homo sapiens
tatttgtattaataa

SEQ ID NO: 5061914 - DNA, 18 bp, Homo sapiens
tatttgtattaataaagc

SEQ ID NO: 5061915 - DNA, 15 bp, Homo sapiens
tatttgtattcatga

SEQ ID NO: 5061916 - DNA, 19 bp, Homo sapiens
tatttgtattcccttttat

SEQ ID NO: 5061917 - DNA, 18 bp, Homo sapiens
tatttgtattctctgcaa

SEQ ID NO: 5061918 - DNA, 12 bp, Homo sapiens
tatttgtattta

SEQ ID NO: 5061919 - DNA, 17 bp, Homo sapiens
tatttgtatttattctt

SEQ ID NO: 5061920 - DNA, 12 bp, Homo sapiens
tatttgtcaaat

SEQ ID NO: 5061921 - DNA, 16 bp, Homo sapiens
tatttgtcaacagatt

SEQ ID NO: 5061922 - DNA, 16 bp, Homo sapiens
tatttttactgccact

SEQ ID NO: 5061923 - DNA, 21 bp, Homo sapiens
tatttttactgctttctgaat

SEQ ID NO: 5061924 - DNA, 22 bp, Homo sapiens
tatttttagatggttacactgt

SEQ ID NO: 5061925 - DNA, 16 bp, Homo sapiens
tatttttataaaactg

SEQ ID NO: 5061926 - DNA, 12 bp, Homo sapiens
tatttttataat

SEQ ID NO: 5061927 - DNA, 14 bp, Homo sapiens
tatttttataatga

SEQ ID NO: 5061928 - DNA, 20 bp, Homo sapiens
tatttttatacaagtaattt

SEQ ID NO: 5061929 - DNA, 17 bp, Homo sapiens
tatttttatacactgta

SEQ ID NO: 5061930 - DNA, 21 bp, Homo sapiens
tatttttatactcttcctatt

SEQ ID NO: 5061931 - DNA, 15 bp, Homo sapiens
tatttttatacttta

SEQ ID NO: 5061932 - DNA, 12 bp, Homo sapiens
tatttttatagg

SEQ ID NO: 5061933 - DNA, 23 bp, Homo sapiens
tatttttatataatatctaaagt

SEQ ID NO: 5061934 - DNA, 12 bp, Homo sapiens
tatttttatcta

SEQ ID NO: 5061935 - DNA, 18 bp, Homo sapiens
tatttttatctatataaa

SEQ ID NO: 5061936 - DNA, 16 bp, Homo sapiens
tatttttatgtgcagc

SEQ ID NO: 5061937 - DNA, 16 bp, Homo sapiens
tatttttattactttt

SEQ ID NO: 5061938 - DNA, 12 bp, Homo sapiens
tatttttatttg

SEQ ID NO: 5061939 - DNA, 13 bp, Homo sapiens
tatttttcaaaat

SEQ ID NO: 5061940 - DNA, 17 bp, Homo sapiens
tatttttcaaaatcaaa

SEQ ID NO: 5061941 - DNA, 13 bp, Homo sapiens
tatttttcaaata

SEQ ID NO: 5061942 - DNA, 16 bp, Homo sapiens
tatttttcaaatagat

SEQ ID NO: 5061943 - DNA, 18 bp, Homo sapiens
tatttttcaaccagcatt

SEQ ID NO: 5061944 - DNA, 19 bp, Homo sapiens
tatttttcaaccagcattt

SEQ ID NO: 5061945 - DNA, 11 bp, Homo sapiens
tatttttcaat

SEQ ID NO: 5061946 - DNA, 20 bp, Homo sapiens
tatttttcaataaagcattt

SEQ ID NO: 5061947 - DNA, 13 bp, Homo sapiens
tatttttcaatta

SEQ ID NO: 5061948 - DNA, 17 bp, Homo sapiens
tatttttcaattttgaa

SEQ ID NO: 5061949 - DNA, 22 bp, Homo sapiens
tatttttcactctaagtcatgt

SEQ ID NO: 5061950 - DNA, 14 bp, Homo sapiens
tatttttcagaaat

SEQ ID NO: 5061951 - DNA, 13 bp, Homo sapiens
tatttttcagaga

SEQ ID NO: 5061952 - DNA, 21 bp, Homo sapiens
tatttttcagagatttatata

SEQ ID NO: 5061953 - DNA, 14 bp, Homo sapiens
tatttttcagttcc

SEQ ID NO: 5061954 - DNA, 17 bp, Homo sapiens
tatttttcagttccaag

SEQ ID NO: 5061955 - DNA, 15 bp, Homo sapiens
tatttttcatattgt

SEQ ID NO: 5061956 - DNA, 21 bp, Homo sapiens
tatttttccctccgggcaggg

SEQ ID NO: 5061957 - DNA, 13 bp, Homo sapiens
tatttttcctcaa

SEQ ID NO: 5061958 - DNA, 14 bp, Homo sapiens
tatttttcctgtcc

SEQ ID NO: 5061959 - DNA, 15 bp, Homo sapiens
tatttttcctgtcct

SEQ ID NO: 5061960 - DNA, 15 bp, Homo sapiens
tatttttctaaagaa

SEQ ID NO: 5061961 - DNA, 14 bp, Homo sapiens
tatttttctaaggt

SEQ ID NO: 5061962 - DNA, 20 bp, Homo sapiens
tatttttctaagtgtaacct

SEQ ID NO: 5061963 - DNA, 14 bp, Homo sapiens
tatttttctcatga

SEQ ID NO: 5061964 - DNA, 12 bp, Homo sapiens
tatttttctctt

SEQ ID NO: 5061965 - DNA, 15 bp, Homo sapiens
tatttttctgccctg

SEQ ID NO: 5061966 - DNA, 13 bp, Homo sapiens
tatttttctgtga

SEQ ID NO: 5061967 - DNA, 18 bp, Homo sapiens
tatttttctgtgaccatc

SEQ ID NO: 5061968 - DNA, 13 bp, Homo sapiens
tatttttcttact

SEQ ID NO: 5061969 - DNA, 13 bp, Homo sapiens
tatttttcttgct

SEQ ID NO: 5061970 - DNA, 14 bp, Homo sapiens
tatttttctttaaa

SEQ ID NO: 5061971 - DNA, 14 bp, Homo sapiens
tatttttgaaaaat

SEQ ID NO: 5061972 - DNA, 20 bp, Homo sapiens
tatttttgaacccctgtgtc

SEQ ID NO: 5061973 - DNA, 15 bp, Homo sapiens
tatttttgaattctt

SEQ ID NO: 5061974 - DNA, 16 bp, Homo sapiens
tatttttgaattcttt

SEQ ID NO: 5061975 - DNA, 20 bp, Homo sapiens
tatttttgaattctttagat

SEQ ID NO: 5061976 - DNA, 13 bp, Homo sapiens
tatttttgacaga

SEQ ID NO: 5061977 - DNA, 16 bp, Homo sapiens
tatttttgatctttga

SEQ ID NO: 5061978 - DNA, 12 bp, Homo sapiens
tatttttgcaaa

SEQ ID NO: 5061979 - DNA, 15 bp, Homo sapiens
tatttttgcaaaata

SEQ ID NO: 5061980 - DNA, 17 bp, Homo sapiens
tatttttgcacaacttt

SEQ ID NO: 5061981 - DNA, 13 bp, Homo sapiens
tatttttgccctg

SEQ ID NO: 5061982 - DNA, 17 bp, Homo sapiens
tatttttgctctccctc

SEQ ID NO: 5061983 - DNA, 16 bp, Homo sapiens
tatttttgctgcttct

SEQ ID NO: 5061984 - DNA, 18 bp, Homo sapiens
tatttttggactggcaga

SEQ ID NO: 5061985 - DNA, 13 bp, Homo sapiens
tatttttggactt

SEQ ID NO: 5061986 - DNA, 20 bp, Homo sapiens
tatttttggcattcctctaa

SEQ ID NO: 5061987 - DNA, 18 bp, Homo sapiens
tatttttgggtttggcca

SEQ ID NO: 5061988 - DNA, 11 bp, Homo sapiens
tatttttgtaa

SEQ ID NO: 5061989 - DNA, 14 bp, Homo sapiens
tatttttgtaaata

SEQ ID NO: 5061990 - DNA, 22 bp, Homo sapiens
tatttttgtaaatagtttaaca

SEQ ID NO: 5061991 - DNA, 12 bp, Homo sapiens
tatttttgtaat

SEQ ID NO: 5061992 - DNA, 13 bp, Homo sapiens
tatttttgtaatg

SEQ ID NO: 5061993 - DNA, 22 bp, Homo sapiens
tatttttgtaatgtgaaaagta

SEQ ID NO: 5061994 - DNA, 13 bp, Homo sapiens
tatttttgtaatt

SEQ ID NO: 5061995 - DNA, 12 bp, Homo sapiens
tatttttgtacc

SEQ ID NO: 5061996 - DNA, 12 bp, Homo sapiens
tatttttgtact

SEQ ID NO: 5061997 - DNA, 17 bp, Homo sapiens
tatttttgtactgtgct

SEQ ID NO: 5061998 - DNA, 15 bp, Homo sapiens
tatttttgtagcact

SEQ ID NO: 5061999 - DNA, 22 bp, Homo sapiens
tatttttgtagttagacaatag

SEQ ID NO: 5062000 - DNA, 13 bp, Homo sapiens
tatttttgtattt

SEQ ID NO: 5062001 - DNA, 19 bp, Homo sapiens
tatttttgtattttacatg

SEQ ID NO: 5062002 - DNA, 15 bp, Homo sapiens
tatttttgtctgcag

SEQ ID NO: 5062003 - DNA, 13 bp, Homo sapiens
tatttttgtgaag

SEQ ID NO: 5062004 - DNA, 21 bp, Homo sapiens
tatttttgtgaagtattcaca

SEQ ID NO: 5062005 - DNA, 15 bp, Homo sapiens
tatttttgtgtttct

SEQ ID NO: 5062006 - DNA, 16 bp, Homo sapiens
tatttttgtgtttgaa

SEQ ID NO: 5062007 - DNA, 21 bp, Homo sapiens
tatttttgtgttttcttgtaa

SEQ ID NO: 5062008 - DNA, 12 bp, Homo sapiens
tatttttgttag

SEQ ID NO: 5062009 - DNA, 23 bp, Homo sapiens
tatttttgttggagccactctgt

SEQ ID NO: 5062010 - DNA, 19 bp, Homo sapiens
tatttttgttgtgttctgt

SEQ ID NO: 5062011 - DNA, 18 bp, Homo sapiens
tatttttgtttgttttgt

SEQ ID NO: 5062012 - DNA, 18 bp, Homo sapiens
tatttttgtttttattaa

SEQ ID NO: 5062013 - DNA, 20 bp, Homo sapiens
tatttttgtttttattaaaa

SEQ ID NO: 5062014 - DNA, 18 bp, Homo sapiens
tattttttaaaaagtgtt

SEQ ID NO: 5062015 - DNA, 17 bp, Homo sapiens
tattttttaaaacacta

SEQ ID NO: 5062016 - DNA, 17 bp, Homo sapiens
tattttttaaatcttga

SEQ ID NO: 5062017 - DNA, 13 bp, Homo sapiens
tattttttaagaa

SEQ ID NO: 5062018 - DNA, 14 bp, Homo sapiens
tattttttaagaaa

SEQ ID NO: 5062019 - DNA, 20 bp, Homo sapiens
tattttttaaggcaaataaa

SEQ ID NO: 5062020 - DNA, 13 bp, Homo sapiens
tattttttaagta

SEQ ID NO: 5062021 - DNA, 21 bp, Homo sapiens
tattttttaagtatttatata

SEQ ID NO: 5062022 - DNA, 15 bp, Homo sapiens
tattttttaagttca

SEQ ID NO: 5062023 - DNA, 16 bp, Homo sapiens
tattttttaatgtatt

SEQ ID NO: 5062024 - DNA, 14 bp, Homo sapiens
tattttttaatgtg

SEQ ID NO: 5062025 - DNA, 15 bp, Homo sapiens
tattttttaattatt

SEQ ID NO: 5062026 - DNA, 16 bp, Homo sapiens
tattttttaattattg

SEQ ID NO: 5062027 - DNA, 20 bp, Homo sapiens
tattttttacattttacaca

SEQ ID NO: 5062028 - DNA, 21 bp, Homo sapiens
tattttttatcattgaaacat

SEQ ID NO: 5062029 - DNA, 23 bp, Homo sapiens
tattttttatgatggagcaactg

SEQ ID NO: 5062030 - DNA, 18 bp, Homo sapiens
tattttttattcagtaaa

SEQ ID NO: 5062031 - DNA, 18 bp, Homo sapiens
tattttttatttccacat

SEQ ID NO: 5062032 - DNA, 12 bp, Homo sapiens
tattttttcaga

SEQ ID NO: 5062033 - DNA, 13 bp, Homo sapiens
tattttttcagac

SEQ ID NO: 5062034 - DNA, 15 bp, Homo sapiens
tattttttcagaccg

SEQ ID NO: 5062035 - DNA, 17 bp, Homo sapiens
tattttttcagactgtg

SEQ ID NO: 5062036 - DNA, 14 bp, Homo sapiens
tattttttcccaaa

SEQ ID NO: 5062037 - DNA, 15 bp, Homo sapiens
tattttttccctcct

SEQ ID NO: 5062038 - DNA, 12 bp, Homo sapiens
tattttttcctt

SEQ ID NO: 5062039 - DNA, 14 bp, Homo sapiens
tattttttcctttt

SEQ ID NO: 5062040 - DNA, 19 bp, Homo sapiens
tattttttcttgcattgac

SEQ ID NO: 5062041 - DNA, 14 bp, Homo sapiens
tattttttcttttg

SEQ ID NO: 5062042 - DNA, 21 bp, Homo sapiens
tattttttcttttgtaattgt

SEQ ID NO: 5062043 - DNA, 13 bp, Homo sapiens
tattttttgaaaa

SEQ ID NO: 5062044 - DNA, 21 bp, Homo sapiens
tattttttgaactttgtagga

SEQ ID NO: 5062045 - DNA, 19 bp, Homo sapiens
tattttttgaatctatgaa

SEQ ID NO: 5062046 - DNA, 14 bp, Homo sapiens
tattttttgatgga

SEQ ID NO: 5062047 - DNA, 24 bp, Homo sapiens
tattttttgcaaatttgtaaactt

SEQ ID NO: 5062048 - DNA, 13 bp, Homo sapiens
tattttttgcaag

SEQ ID NO: 5062049 - DNA, 15 bp, Homo sapiens
tattttttgggccat

SEQ ID NO: 5062050 - DNA, 14 bp, Homo sapiens
tattttttggtgtg

SEQ ID NO: 5062051 - DNA, 15 bp, Homo sapiens
tattttttgtaactc

SEQ ID NO: 5062052 - DNA, 18 bp, Homo sapiens
tattttttgtaactcttt

SEQ ID NO: 5062053 - DNA, 16 bp, Homo sapiens
tattttttgtataatt

SEQ ID NO: 5062054 - DNA, 14 bp, Homo sapiens
tattttttgttgaa

SEQ ID NO: 5062055 - DNA, 14 bp, Homo sapiens
tattttttgtttgt

SEQ ID NO: 5062056 - DNA, 18 bp, Homo sapiens
tatttttttaaaatcact

SEQ ID NO: 5062057 - DNA, 23 bp, Homo sapiens
tatttttttaaaatcactaacat

SEQ ID NO: 5062058 - DNA, 14 bp, Homo sapiens
tatttttttaaact

SEQ ID NO: 5062059 - DNA, 23 bp, Homo sapiens
tatttttttaaacttcagtttta

SEQ ID NO: 5062060 - DNA, 15 bp, Homo sapiens
tatttttttaacttt

SEQ ID NO: 5062061 - DNA, 20 bp, Homo sapiens
tatttttttaagctgtaaaa

SEQ ID NO: 5062062 - DNA, 20 bp, Homo sapiens
tatttttttaatttaacatg

SEQ ID NO: 5062063 - DNA, 19 bp, Homo sapiens
tatttttttaccaattcca

SEQ ID NO: 5062064 - DNA, 17 bp, Homo sapiens
tatttttttcactgttt

SEQ ID NO: 5062065 - DNA, 13 bp, Homo sapiens
tatttttttccaa

SEQ ID NO: 5062066 - DNA, 15 bp, Homo sapiens
tatttttttccaagt

SEQ ID NO: 5062067 - DNA, 22 bp, Homo sapiens
tatttttttcctaagacatttt

SEQ ID NO: 5062068 - DNA, 18 bp, Homo sapiens
tatttttttccttacata

SEQ ID NO: 5062069 - DNA, 21 bp, Homo sapiens
tatttttttcctttgcattca

SEQ ID NO: 5062070 - DNA, 15 bp, Homo sapiens
tatttttttctagct

SEQ ID NO: 5062071 - DNA, 17 bp, Homo sapiens
tatttttttctattttt

SEQ ID NO: 5062072 - DNA, 18 bp, Homo sapiens
tatttttttctgattgta

SEQ ID NO: 5062073 - DNA, 17 bp, Homo sapiens
tatttttttctgtaaaa

SEQ ID NO: 5062074 - DNA, 18 bp, Homo sapiens
tatttttttcttaccaaa

SEQ ID NO: 5062075 - DNA, 17 bp, Homo sapiens
tatttttttcttttctt

SEQ ID NO: 5062076 - DNA, 17 bp, Homo sapiens
tatttttttgcaagtga

SEQ ID NO: 5062077 - DNA, 15 bp, Homo sapiens
tatttttttgttgct

SEQ ID NO: 5062078 - DNA, 18 bp, Homo sapiens
tatttttttgttgctgtt

SEQ ID NO: 5062079 - DNA, 20 bp, Homo sapiens
tatttttttgttgctgttgt

SEQ ID NO: 5062080 - DNA, 16 bp, Homo sapiens
tattttttttaaatca

SEQ ID NO: 5062081 - DNA, 15 bp, Homo sapiens
tattttttttaactg

SEQ ID NO: 5062082 - DNA, 18 bp, Homo sapiens
tattttttttaattgtat

SEQ ID NO: 5062083 - DNA, 19 bp, Homo sapiens
tattttttttaattgtatt

SEQ ID NO: 5062084 - DNA, 15 bp, Homo sapiens
tattttttttcaaaa

SEQ ID NO: 5062085 - DNA, 14 bp, Homo sapiens
tattttttttctgt

SEQ ID NO: 5062086 - DNA, 13 bp, Homo sapiens
tattttttttggc

SEQ ID NO: 5062087 - DNA, 16 bp, Homo sapiens
tattttttttttcttc

SEQ ID NO: 5062088 - DNA, 17 bp, Homo sapiens
tattttttttttcttct

SEQ ID NO: 5062089 - DNA, 21 bp, Homo sapiens
tattttttttttcttcttggg

SEQ ID NO: 5062090 - DNA, 23 bp, Homo sapiens
tatttttttttttccaagacaga

SEQ ID NO: 5062091 - DNA, 20 bp, Homo sapiens
tattttttttttttgaaaaa

SEQ ID NO: 5062092 - DNA, 19 bp, Homo sapiens
tcaaaaaaaaaaaaaaaga

SEQ ID NO: 5062093 - DNA, 19 bp, Homo sapiens
tcaaaaaaaaaaaaaacaa

SEQ ID NO: 5062094 - DNA, 16 bp, Homo sapiens
tcaaaaaaaaaaaaga

SEQ ID NO: 5062095 - DNA, 18 bp, Homo sapiens
tcaaaaaaaagaaaatgt

SEQ ID NO: 5062096 - DNA, 21 bp, Homo sapiens
tcaaaaaaaagaaaatgtctt

SEQ ID NO: 5062097 - DNA, 14 bp, Homo sapiens
tcaaaaaaacacta

SEQ ID NO: 5062098 - DNA, 14 bp, Homo sapiens
tcaaaaaaatctaa

SEQ ID NO: 5062099 - DNA, 19 bp, Homo sapiens
tcaaaaaacagaaaaacaa

SEQ ID NO: 5062100 - DNA, 16 bp, Homo sapiens
tcaaaaaacctttaca

SEQ ID NO: 5062101 - DNA, 23 bp, Homo sapiens
tcaaaaaagaggagaaaagctca

SEQ ID NO: 5062102 - DNA, 20 bp, Homo sapiens
tcaaaaaaggaaacttcctt

SEQ ID NO: 5062103 - DNA, 12 bp, Homo sapiens
tcaaaaaaggca

SEQ ID NO: 5062104 - DNA, 11 bp, Homo sapiens
tcaaaaaatta

SEQ ID NO: 5062105 - DNA, 12 bp, Homo sapiens
tcaaaaacaaac

SEQ ID NO: 5062106 - DNA, 16 bp, Homo sapiens
tcaaaaacaaagctga

SEQ ID NO: 5062107 - DNA, 20 bp, Homo sapiens
tcaaaaacatgcttttccaa

SEQ ID NO: 5062108 - DNA, 16 bp, Homo sapiens
tcaaaaaccagccagg

SEQ ID NO: 5062109 - DNA, 17 bp, Homo sapiens
tcaaaaaccagccaggc

SEQ ID NO: 5062110 - DNA, 19 bp, Homo sapiens
tcaaaaaccattacaaaat

SEQ ID NO: 5062111 - DNA, 16 bp, Homo sapiens
tcaaaaacgccctcaa

SEQ ID NO: 5062112 - DNA, 22 bp, Homo sapiens
tcaaaaacgccctcaagaacat

SEQ ID NO: 5062113 - DNA, 13 bp, Homo sapiens
tcaaaaactattt

SEQ ID NO: 5062114 - DNA, 13 bp, Homo sapiens
tcaaaaactgttt

SEQ ID NO: 5062115 - DNA, 14 bp, Homo sapiens
tcaaaaagaaatca

SEQ ID NO: 5062116 - DNA, 17 bp, Homo sapiens
tcaaaaagaaatcaata

SEQ ID NO: 5062117 - DNA, 14 bp, Homo sapiens
tcaaaaagaactaa

SEQ ID NO: 5062118 - DNA, 21 bp, Homo sapiens
tcaaaaagagtcttaattttc

SEQ ID NO: 5062119 - DNA, 13 bp, Homo sapiens
tcaaaaagcagag

SEQ ID NO: 5062120 - DNA, 14 bp, Homo sapiens
tcaaaaagcatttt

SEQ ID NO: 5062121 - DNA, 14 bp, Homo sapiens
tcaaaaagccacag

SEQ ID NO: 5062122 - DNA, 23 bp, Homo sapiens
tcaaaaagccacagcagagcatt

SEQ ID NO: 5062123 - DNA, 15 bp, Homo sapiens
tcaaaaagctgctat

SEQ ID NO: 5062124 - DNA, 20 bp, Homo sapiens
tcaaaaaggcttataaaaca

SEQ ID NO: 5062125 - DNA, 21 bp, Homo sapiens
tcaaaaagggaagtaagcaaa

SEQ ID NO: 5062126 - DNA, 23 bp, Homo sapiens
tcaaaaagggaagtaagcaaaca

SEQ ID NO: 5062127 - DNA, 22 bp, Homo sapiens
tcaaaaaggtctcaccacatac

SEQ ID NO: 5062128 - DNA, 19 bp, Homo sapiens
tcaaaaataaaaaatctga

SEQ ID NO: 5062129 - DNA, 12 bp, Homo sapiens
tcaaaaataaac

SEQ ID NO: 5062130 - DNA, 16 bp, Homo sapiens
tcaaaaataaactagt

SEQ ID NO: 5062131 - DNA, 22 bp, Homo sapiens
tcaaaaataaactagtttccag

SEQ ID NO: 5062132 - DNA, 13 bp, Homo sapiens
tcaaaaatataac

SEQ ID NO: 5062133 - DNA, 14 bp, Homo sapiens
tcaaaaatataact

SEQ ID NO: 5062134 - DNA, 21 bp, Homo sapiens
tcaaaaatatgtgtttttaag

SEQ ID NO: 5062135 - DNA, 20 bp, Homo sapiens
tcaaaaatatttatattgtc

SEQ ID NO: 5062136 - DNA, 13 bp, Homo sapiens
tcaaaaatatttt

SEQ ID NO: 5062137 - DNA, 21 bp, Homo sapiens
tcaaaaatatttttatgtgaa

SEQ ID NO: 5062138 - DNA, 17 bp, Homo sapiens
tcaaaaatcatcaaagt

SEQ ID NO: 5062139 - DNA, 21 bp, Homo sapiens
tcaaaaatcatcaaagtgttt

SEQ ID NO: 5062140 - DNA, 16 bp, Homo sapiens
tcaaaaatctgaagat

SEQ ID NO: 5062141 - DNA, 15 bp, Homo sapiens
tcaaaaattaaatat

SEQ ID NO: 5062142 - DNA, 20 bp, Homo sapiens
tcaaaaattatctatagcta

SEQ ID NO: 5062143 - DNA, 16 bp, Homo sapiens
tcaaaaattgaagaga

SEQ ID NO: 5062144 - DNA, 22 bp, Homo sapiens
tcaaaaattgtgtttagatttt

SEQ ID NO: 5062145 - DNA, 14 bp, Homo sapiens
tcaaaaatttctgc

SEQ ID NO: 5062146 - DNA, 22 bp, Homo sapiens
tcaaaaatttctgcttttgcat

SEQ ID NO: 5062147 - DNA, 14 bp, Homo sapiens
tcaaaacaaaacaa

SEQ ID NO: 5062148 - DNA, 22 bp, Homo sapiens
tcaaaacaaacagatgctctga

SEQ ID NO: 5062149 - DNA, 23 bp, Homo sapiens
tcaaaacacactactacctctta

SEQ ID NO: 5062150 - DNA, 12 bp, Homo sapiens
tcaaaacactgt

SEQ ID NO: 5062151 - DNA, 14 bp, Homo sapiens
tcaaaacactgtgg

SEQ ID NO: 5062152 - DNA, 14 bp, Homo sapiens
tcaaaacacttgta

SEQ ID NO: 5062153 - DNA, 17 bp, Homo sapiens
tcaaaacacttgtaatt

SEQ ID NO: 5062154 - DNA, 15 bp, Homo sapiens
tcaaaacagagatgt

SEQ ID NO: 5062155 - DNA, 23 bp, Homo sapiens
tcaaaacagttacttaagattca

SEQ ID NO: 5062156 - DNA, 18 bp, Homo sapiens
tcaaaacatacaagcaac

SEQ ID NO: 5062157 - DNA, 18 bp, Homo sapiens
tcaaaacatatcaattca

SEQ ID NO: 5062158 - DNA, 12 bp, Homo sapiens
tcaaaacattcc

SEQ ID NO: 5062159 - DNA, 14 bp, Homo sapiens
tcaaaacattccaa

SEQ ID NO: 5062160 - DNA, 22 bp, Homo sapiens
tcaaaacattgtgccatgtcaa

SEQ ID NO: 5062161 - DNA, 17 bp, Homo sapiens
tcaaaaccaggtaatgt

SEQ ID NO: 5062162 - DNA, 19 bp, Homo sapiens
tcaaaaccatctctcttcc

SEQ ID NO: 5062163 - DNA, 15 bp, Homo sapiens
tcaaaacctaccctg

SEQ ID NO: 5062164 - DNA, 14 bp, Homo sapiens
tcaaaacctggaga

SEQ ID NO: 5062165 - DNA, 17 bp, Homo sapiens
tcaaaaccttccttccc

SEQ ID NO: 5062166 - DNA, 20 bp, Homo sapiens
tcaaaacctttcaaatatca

SEQ ID NO: 5062167 - DNA, 22 bp, Homo sapiens
tcaaaacggttttactgcagct

SEQ ID NO: 5062168 - DNA, 21 bp, Homo sapiens
tcaaaacgtgatgttttgaat

SEQ ID NO: 5062169 - DNA, 15 bp, Homo sapiens
tcaaaactcaaatgc

SEQ ID NO: 5062170 - DNA, 15 bp, Homo sapiens
tcaaaactccactca

SEQ ID NO: 5062171 - DNA, 24 bp, Homo sapiens
tcaaaactggagtcccaaatgtca

SEQ ID NO: 5062172 - DNA, 12 bp, Homo sapiens
tcaaaactggtt

SEQ ID NO: 5062173 - DNA, 17 bp, Homo sapiens
tcaaaacttggtatttt

SEQ ID NO: 5062174 - DNA, 16 bp, Homo sapiens
tcaaaactttcgttgt

SEQ ID NO: 5062175 - DNA, 22 bp, Homo sapiens
tcaaaagaaaattgatattttt

SEQ ID NO: 5062176 - DNA, 20 bp, Homo sapiens
tcaaaagaagttcattcctg

SEQ ID NO: 5062177 - DNA, 19 bp, Homo sapiens
tcaaaagaatcagaaacag

SEQ ID NO: 5062178 - DNA, 12 bp, Homo sapiens
tcaaaagaatgt

SEQ ID NO: 5062179 - DNA, 12 bp, Homo sapiens
tcaaaagacaat

SEQ ID NO: 5062180 - DNA, 18 bp, Homo sapiens
tcaaaagacacctgcctt

SEQ ID NO: 5062181 - DNA, 18 bp, Homo sapiens
tcaaaagaggttacttta

SEQ ID NO: 5062182 - DNA, 17 bp, Homo sapiens
tcaaaagattaacaaca

SEQ ID NO: 5062183 - DNA, 12 bp, Homo sapiens
tcaaaagcaaac

SEQ ID NO: 5062184 - DNA, 22 bp, Homo sapiens
tcaaaagcacaaaccctgggga

SEQ ID NO: 5062185 - DNA, 23 bp, Homo sapiens
tcaaaagcacaaaccctggggac

SEQ ID NO: 5062186 - DNA, 12 bp, Homo sapiens
tcaaaagcactt

SEQ ID NO: 5062187 - DNA, 15 bp, Homo sapiens
tcaaaagcacttgtt

SEQ ID NO: 5062188 - DNA, 21 bp, Homo sapiens
tcaaaagcacttgttccttct

SEQ ID NO: 5062189 - DNA, 15 bp, Homo sapiens
tcaaaagcattgtct

SEQ ID NO: 5062190 - DNA, 22 bp, Homo sapiens
tcaaaagctatttaaagcatct

SEQ ID NO: 5062191 - DNA, 23 bp, Homo sapiens
tcaaaagctctctttggaatgaa

SEQ ID NO: 5062192 - DNA, 13 bp, Homo sapiens
tcaaaagctgaaa

SEQ ID NO: 5062193 - DNA, 15 bp, Homo sapiens
tcaaaagctggatta

SEQ ID NO: 5062194 - DNA, 18 bp, Homo sapiens
tcaaaagctgggaaccag

SEQ ID NO: 5062195 - DNA, 15 bp, Homo sapiens
tcaaaaggaaaccaa

SEQ ID NO: 5062196 - DNA, 11 bp, Homo sapiens
tcaaaaggaac

SEQ ID NO: 5062197 - DNA, 22 bp, Homo sapiens
tcaaaaggaacaaaaattacaa

SEQ ID NO: 5062198 - DNA, 22 bp, Homo sapiens
tcaaaaggaactgggtggtttg

SEQ ID NO: 5062199 - DNA, 18 bp, Homo sapiens
tcaaaaggcaaatcattt

SEQ ID NO: 5062200 - DNA, 16 bp, Homo sapiens
tcaaaagggaagagtt

SEQ ID NO: 5062201 - DNA, 14 bp, Homo sapiens
tcaaaagggccaaa

SEQ ID NO: 5062202 - DNA, 21 bp, Homo sapiens
tcaaaagggccaaagaaccaa

SEQ ID NO: 5062203 - DNA, 18 bp, Homo sapiens
tcaaaaggtaatgcacat

SEQ ID NO: 5062204 - DNA, 20 bp, Homo sapiens
tcaaaaggtattatacatgt

SEQ ID NO: 5062205 - DNA, 22 bp, Homo sapiens
tcaaaaggtgattaaatattta

SEQ ID NO: 5062206 - DNA, 23 bp, Homo sapiens
tcaaaaggtgcctgtgaggcagg

SEQ ID NO: 5062207 - DNA, 17 bp, Homo sapiens
tcaaaagtccttagaat

SEQ ID NO: 5062208 - DNA, 17 bp, Homo sapiens
tcaaaagtgatctgtcc

SEQ ID NO: 5062209 - DNA, 12 bp, Homo sapiens
tcaaaagtgcct

SEQ ID NO: 5062210 - DNA, 12 bp, Homo sapiens
tcaaaagtggag

SEQ ID NO: 5062211 - DNA, 14 bp, Homo sapiens
tcaaaagttgaaat

SEQ ID NO: 5062212 - DNA, 15 bp, Homo sapiens
tcaaaagttgaaatt

SEQ ID NO: 5062213 - DNA, 21 bp, Homo sapiens
tcaaaagttgatttcttcttc

SEQ ID NO: 5062214 - DNA, 18 bp, Homo sapiens
tcaaaagttggactaaat

SEQ ID NO: 5062215 - DNA, 13 bp, Homo sapiens
tcaaaagtttgtt

SEQ ID NO: 5062216 - DNA, 13 bp, Homo sapiens
tcaaaataaaaag

SEQ ID NO: 5062217 - DNA, 20 bp, Homo sapiens
tcaaaataaaaagcctcagt

SEQ ID NO: 5062218 - DNA, 18 bp, Homo sapiens
tcaaaataaaaattaaat

SEQ ID NO: 5062219 - DNA, 17 bp, Homo sapiens
tcaaaataaaaccagaa

SEQ ID NO: 5062220 - DNA, 15 bp, Homo sapiens
tcaaaataatctgaa

SEQ ID NO: 5062221 - DNA, 20 bp, Homo sapiens
tcaaaataatctgaaatgac

SEQ ID NO: 5062222 - DNA, 21 bp, Homo sapiens
tcaaaataatctgaaatgaca

SEQ ID NO: 5062223 - DNA, 23 bp, Homo sapiens
tcaaaatacaacttcattgctac

SEQ ID NO: 5062224 - DNA, 14 bp, Homo sapiens
tcaaaatacttctt

SEQ ID NO: 5062225 - DNA, 18 bp, Homo sapiens
tcaaaatagacaagtttt

SEQ ID NO: 5062226 - DNA, 17 bp, Homo sapiens
tcaaaatagtgccacta

SEQ ID NO: 5062227 - DNA, 15 bp, Homo sapiens
tcaaaatagttctat

SEQ ID NO: 5062228 - DNA, 20 bp, Homo sapiens
tcaaaatagttctatttcta

SEQ ID NO: 5062229 - DNA, 21 bp, Homo sapiens
tcaaaatagttctatttctat

SEQ ID NO: 5062230 - DNA, 14 bp, Homo sapiens
tcaaaatatgtgta

SEQ ID NO: 5062231 - DNA, 15 bp, Homo sapiens
tcaaaatatgtgtat

SEQ ID NO: 5062232 - DNA, 13 bp, Homo sapiens
tcaaaatattgag

SEQ ID NO: 5062233 - DNA, 20 bp, Homo sapiens
tcaaaatatttaaaaatgtc

SEQ ID NO: 5062234 - DNA, 23 bp, Homo sapiens
tcaaaatatttaaaaatgtcttg

SEQ ID NO: 5062235 - DNA, 15 bp, Homo sapiens
tcaaaatatttctca

SEQ ID NO: 5062236 - DNA, 16 bp, Homo sapiens
tcaaaatatttctcat

SEQ ID NO: 5062237 - DNA, 18 bp, Homo sapiens
tcaaaatatttgtacata

SEQ ID NO: 5062238 - DNA, 18 bp, Homo sapiens
tcaaaatatttttaaaag

SEQ ID NO: 5062239 - DNA, 19 bp, Homo sapiens
tcaaaatatttttaaaaga

SEQ ID NO: 5062240 - DNA, 21 bp, Homo sapiens
tcaaaatcactatctttctga

SEQ ID NO: 5062241 - DNA, 17 bp, Homo sapiens
tcaaaatcagtttttca

SEQ ID NO: 5062242 - DNA, 19 bp, Homo sapiens
tcaaaatcagtttttcata

SEQ ID NO: 5062243 - DNA, 16 bp, Homo sapiens
tcaaaatccttccaaa

SEQ ID NO: 5062244 - DNA, 19 bp, Homo sapiens
tcaaaatccttccaaagaa

SEQ ID NO: 5062245 - DNA, 22 bp, Homo sapiens
tcaaaatctctccactttcagc

SEQ ID NO: 5062246 - DNA, 21 bp, Homo sapiens
tcaaaatctgtgacctgtcag

SEQ ID NO: 5062247 - DNA, 17 bp, Homo sapiens
tcaaaatctttgtataa

SEQ ID NO: 5062248 - DNA, 18 bp, Homo sapiens
tcaaaatctttgtataaa

SEQ ID NO: 5062249 - DNA, 14 bp, Homo sapiens
tcaaaatgaagata

SEQ ID NO: 5062250 - DNA, 15 bp, Homo sapiens
tcaaaatgaagatac

SEQ ID NO: 5062251 - DNA, 23 bp, Homo sapiens
tcaaaatgaagatacacattaca

SEQ ID NO: 5062252 - DNA, 16 bp, Homo sapiens
tcaaaatgacagtttc

SEQ ID NO: 5062253 - DNA, 22 bp, Homo sapiens
tcaaaatgatttcctctgtaat

SEQ ID NO: 5062254 - DNA, 13 bp, Homo sapiens
tcaaaatgcaaaa

SEQ ID NO: 5062255 - DNA, 16 bp, Homo sapiens
tcaaaatgcatgtgat

SEQ ID NO: 5062256 - DNA, 21 bp, Homo sapiens
tcaaaatgctcttatttcatc

SEQ ID NO: 5062257 - DNA, 22 bp, Homo sapiens
tcaaaatgctcttatttcatca

SEQ ID NO: 5062258 - DNA, 22 bp, Homo sapiens
tcaaaatgtatatatttagtgc

SEQ ID NO: 5062259 - DNA, 16 bp, Homo sapiens
tcaaaatgtccagctt

SEQ ID NO: 5062260 - DNA, 12 bp, Homo sapiens
tcaaaatgtgaa

SEQ ID NO: 5062261 - DNA, 17 bp, Homo sapiens
tcaaaatgtggaccagt

SEQ ID NO: 5062262 - DNA, 18 bp, Homo sapiens
tcaaaatgttaacaactt

SEQ ID NO: 5062263 - DNA, 18 bp, Homo sapiens
tcaaaatgttaataaagg

SEQ ID NO: 5062264 - DNA, 20 bp, Homo sapiens
tcaaaatgttaataaaggtt

SEQ ID NO: 5062265 - DNA, 21 bp, Homo sapiens
tcaaaatgttatcttctcaag

SEQ ID NO: 5062266 - DNA, 18 bp, Homo sapiens
tcaaaatgttcgtattct

SEQ ID NO: 5062267 - DNA, 14 bp, Homo sapiens
tcaaaattaaatct

SEQ ID NO: 5062268 - DNA, 15 bp, Homo sapiens
tcaaaattacatata

SEQ ID NO: 5062269 - DNA, 16 bp, Homo sapiens
tcaaaattacttttct

SEQ ID NO: 5062270 - DNA, 22 bp, Homo sapiens
tcaaaattataggagacttgta

SEQ ID NO: 5062271 - DNA, 12 bp, Homo sapiens
tcaaaattcaaa

SEQ ID NO: 5062272 - DNA, 13 bp, Homo sapiens
tcaaaattcaaaa

SEQ ID NO: 5062273 - DNA, 17 bp, Homo sapiens
tcaaaattctaaatgta

SEQ ID NO: 5062274 - DNA, 12 bp, Homo sapiens
tcaaaattgctt

SEQ ID NO: 5062275 - DNA, 18 bp, Homo sapiens
tcaaaattgcttctaaaa

SEQ ID NO: 5062276 - DNA, 13 bp, Homo sapiens
tcaaaattgtgtc

SEQ ID NO: 5062277 - DNA, 17 bp, Homo sapiens
tcaaaattgttgcatcc

SEQ ID NO: 5062278 - DNA, 16 bp, Homo sapiens
tcaaaatttgaagaat

SEQ ID NO: 5062279 - DNA, 12 bp, Homo sapiens
tcaaaatttgca

SEQ ID NO: 5062280 - DNA, 13 bp, Homo sapiens
tcaaaatttgctg

SEQ ID NO: 5062281 - DNA, 17 bp, Homo sapiens
tggaggttgaagccaag

SEQ ID NO: 5062282 - DNA, 14 bp, Homo sapiens
tggaggttgaatag

SEQ ID NO: 5062283 - DNA, 19 bp, Homo sapiens
tggaggttgaataggagtt

SEQ ID NO: 5062284 - DNA, 20 bp, Homo sapiens
tggaggttgataactttgct

SEQ ID NO: 5062285 - DNA, 18 bp, Homo sapiens
tggaggttgcagtgagct

SEQ ID NO: 5062286 - DNA, 21 bp, Homo sapiens
tggaggttgccgtgagccaag

SEQ ID NO: 5062287 - DNA, 15 bp, Homo sapiens
tggaggttgtgcatg

SEQ ID NO: 5062288 - DNA, 15 bp, Homo sapiens
tggaggtttcatact

SEQ ID NO: 5062289 - DNA, 19 bp, Homo sapiens
tggagtaacgttttccttg

SEQ ID NO: 5062290 - DNA, 14 bp, Homo sapiens
tggagtaattgcac

SEQ ID NO: 5062291 - DNA, 13 bp, Homo sapiens
tggagtacccagc

SEQ ID NO: 5062292 - DNA, 16 bp, Homo sapiens
tggagtacccagccta

SEQ ID NO: 5062293 - DNA, 15 bp, Homo sapiens
tggagtacttagcta

SEQ ID NO: 5062294 - DNA, 18 bp, Homo sapiens
tggagtagagtcaggaga

SEQ ID NO: 5062295 - DNA, 14 bp, Homo sapiens
tggagtagcctgga

SEQ ID NO: 5062296 - DNA, 13 bp, Homo sapiens
tggagtaggcctg

SEQ ID NO: 5062297 - DNA, 21 bp, Homo sapiens
tggagtaggtaccatttgtgt

SEQ ID NO: 5062298 - DNA, 14 bp, Homo sapiens
tggagtatgattta

SEQ ID NO: 5062299 - DNA, 21 bp, Homo sapiens
tggagtatgtctgatggatcc

SEQ ID NO: 5062300 - DNA, 18 bp, Homo sapiens
tggagtatttattgtcag

SEQ ID NO: 5062301 - DNA, 17 bp, Homo sapiens
tggagtatttggaagca

SEQ ID NO: 5062302 - DNA, 17 bp, Homo sapiens
tggagtatttttataat

SEQ ID NO: 5062303 - DNA, 23 bp, Homo sapiens
tggagtcacatcagtgaggaggg

SEQ ID NO: 5062304 - DNA, 14 bp, Homo sapiens
tggagtcagatgag

SEQ ID NO: 5062305 - DNA, 19 bp, Homo sapiens
tggagtcagggctgtgctt

SEQ ID NO: 5062306 - DNA, 18 bp, Homo sapiens
tggagtcagtagccagag

SEQ ID NO: 5062307 - DNA, 19 bp, Homo sapiens
tggagtcagtagccagagt

SEQ ID NO: 5062308 - DNA, 19 bp, Homo sapiens
tggagtcatcttgcacaca

SEQ ID NO: 5062309 - DNA, 12 bp, Homo sapiens
tggagtcattca

SEQ ID NO: 5062310 - DNA, 14 bp, Homo sapiens
tggagtcattctca

SEQ ID NO: 5062311 - DNA, 15 bp, Homo sapiens
tggagtcattctcat

SEQ ID NO: 5062312 - DNA, 15 bp, Homo sapiens
tggagtccagctcta

SEQ ID NO: 5062313 - DNA, 22 bp, Homo sapiens
tggagtccaggacaggagatgc

SEQ ID NO: 5062314 - DNA, 15 bp, Homo sapiens
tggagtccagtctct

SEQ ID NO: 5062315 - DNA, 14 bp, Homo sapiens
tggagtcccagagc

SEQ ID NO: 5062316 - DNA, 16 bp, Homo sapiens
tggagtcccagagctg

SEQ ID NO: 5062317 - DNA, 20 bp, Homo sapiens
tggagtcccctcacctcctc

SEQ ID NO: 5062318 - DNA, 15 bp, Homo sapiens
tggagtcccctcctc

SEQ ID NO: 5062319 - DNA, 17 bp, Homo sapiens
tggagtcctgttctcag

SEQ ID NO: 5062320 - DNA, 23 bp, Homo sapiens
tggagtcggatctagccatggct

SEQ ID NO: 5062321 - DNA, 15 bp, Homo sapiens
tggagtctcactctt

SEQ ID NO: 5062322 - DNA, 18 bp, Homo sapiens
tggagtctcactcttgtc

SEQ ID NO: 5062323 - DNA, 18 bp, Homo sapiens
tggagtctcagagcacag

SEQ ID NO: 5062324 - DNA, 13 bp, Homo sapiens
tggagtctccagt

SEQ ID NO: 5062325 - DNA, 16 bp, Homo sapiens
tggagtctccctctga

SEQ ID NO: 5062326 - DNA, 17 bp, Homo sapiens
tggagtctccctctgat

SEQ ID NO: 5062327 - DNA, 13 bp, Homo sapiens
tggagtctcctga

SEQ ID NO: 5062328 - DNA, 14 bp, Homo sapiens
tggagtctctctct

SEQ ID NO: 5062329 - DNA, 16 bp, Homo sapiens
tggagtctgaaggaga

SEQ ID NO: 5062330 - DNA, 17 bp, Homo sapiens
tggagtctgaaggagag

SEQ ID NO: 5062331 - DNA, 18 bp, Homo sapiens
tggagtctgaaggagagg

SEQ ID NO: 5062332 - DNA, 19 bp, Homo sapiens
tggagtctgaaggagagga

SEQ ID NO: 5062333 - DNA, 21 bp, Homo sapiens
tggagtctgaaggagaggagt

SEQ ID NO: 5062334 - DNA, 14 bp, Homo sapiens
tggagtctgcagtg

SEQ ID NO: 5062335 - DNA, 22 bp, Homo sapiens
tggagtctgccacccaggatcc

SEQ ID NO: 5062336 - DNA, 16 bp, Homo sapiens
tggagtctggagtggg

SEQ ID NO: 5062337 - DNA, 19 bp, Homo sapiens
tggagtctggagtgggcag

SEQ ID NO: 5062338 - DNA, 16 bp, Homo sapiens
tggagtcttgtgccaa

SEQ ID NO: 5062339 - DNA, 19 bp, Homo sapiens
tggagtgaagcatttaaaa

SEQ ID NO: 5062340 - DNA, 21 bp, Homo sapiens
tggagtgaagcatttaaaaga

SEQ ID NO: 5062341 - DNA, 23 bp, Homo sapiens
tggagtgaagcatttaaaagagt

SEQ ID NO: 5062342 - DNA, 14 bp, Homo sapiens
tggagtgagactga

SEQ ID NO: 5062343 - DNA, 15 bp, Homo sapiens
tggagtgagactgac

SEQ ID NO: 5062344 - DNA, 16 bp, Homo sapiens
tggagtgagagccttt

SEQ ID NO: 5062345 - DNA, 21 bp, Homo sapiens
tggagtgagaggcccccaccc

SEQ ID NO: 5062346 - DNA, 18 bp, Homo sapiens
tggagtgagatcttacag

SEQ ID NO: 5062347 - DNA, 19 bp, Homo sapiens
tggagtgaggcttccaggc

SEQ ID NO: 5062348 - DNA, 21 bp, Homo sapiens
tggagtgagggcctcagagcc

SEQ ID NO: 5062349 - DNA, 19 bp, Homo sapiens
tggagtgagtcacctgctc

SEQ ID NO: 5062350 - DNA, 20 bp, Homo sapiens
tggagtgagtcacctgctcc

SEQ ID NO: 5062351 - DNA, 22 bp, Homo sapiens
tggagtgatatgatccagagca

SEQ ID NO: 5062352 - DNA, 23 bp, Homo sapiens
tggagtgatctcagctcactgca

SEQ ID NO: 5062353 - DNA, 22 bp, Homo sapiens
tggagtgatggtgtccttccct

SEQ ID NO: 5062354 - DNA, 16 bp, Homo sapiens
tggagtgattctagag

SEQ ID NO: 5062355 - DNA, 14 bp, Homo sapiens
tggagtgcagtgag

SEQ ID NO: 5062356 - DNA, 14 bp, Homo sapiens
tggagtgcagtggt

SEQ ID NO: 5062357 - DNA, 21 bp, Homo sapiens
tggagtgccacgtggccgctg

SEQ ID NO: 5062358 - DNA, 17 bp, Homo sapiens
tggagtgccatggctgg

SEQ ID NO: 5062359 - DNA, 12 bp, Homo sapiens
tggagtgcccca

SEQ ID NO: 5062360 - DNA, 17 bp, Homo sapiens
tggagtgccctgcaggc

SEQ ID NO: 5062361 - DNA, 18 bp, Homo sapiens
tggagtgccctgcaggca

SEQ ID NO: 5062362 - DNA, 12 bp, Homo sapiens
tggagtgcgctc

SEQ ID NO: 5062363 - DNA, 16 bp, Homo sapiens
tggagtgctcttccca

SEQ ID NO: 5062364 - DNA, 16 bp, Homo sapiens
tggagtgctgcagctt

SEQ ID NO: 5062365 - DNA, 17 bp, Homo sapiens
tggagtgctgcttgtgc

SEQ ID NO: 5062366 - DNA, 14 bp, Homo sapiens
tggagtgctgtgct

SEQ ID NO: 5062367 - DNA, 17 bp, Homo sapiens
tggagtgctgtgctgtg

SEQ ID NO: 5062368 - DNA, 14 bp, Homo sapiens
tggagtggaggcat

SEQ ID NO: 5062369 - DNA, 13 bp, Homo sapiens
tggagtggagggg

SEQ ID NO: 5062370 - DNA, 20 bp, Homo sapiens
tggagtggaggggtcagcag

SEQ ID NO: 5062371 - DNA, 16 bp, Homo sapiens
tggagtggagtgagag

SEQ ID NO: 5062372 - DNA, 18 bp, Homo sapiens
tggagtggcagcccagcc

SEQ ID NO: 5062373 - DNA, 18 bp, Homo sapiens
tggagtggccactggcac

SEQ ID NO: 5062374 - DNA, 19 bp, Homo sapiens
tggagtggctcgccaggcc

SEQ ID NO: 5062375 - DNA, 13 bp, Homo sapiens
tggagtgggagat

SEQ ID NO: 5062376 - DNA, 19 bp, Homo sapiens
tggagtgtcggatcctgtg

SEQ ID NO: 5062377 - DNA, 22 bp, Homo sapiens
tggagtgtcggatcctgtgagt

SEQ ID NO: 5062378 - DNA, 22 bp, Homo sapiens
tggagtgtgcagacagccatgc

SEQ ID NO: 5062379 - DNA, 21 bp, Homo sapiens
tggagtgtgcgtgtgtgcatg

SEQ ID NO: 5062380 - DNA, 18 bp, Homo sapiens
tggagtgtgctgaacaca

SEQ ID NO: 5062381 - DNA, 20 bp, Homo sapiens
tggagtgtgtcagagcccag

SEQ ID NO: 5062382 - DNA, 14 bp, Homo sapiens
tggagtgtgtgggg

SEQ ID NO: 5062383 - DNA, 18 bp, Homo sapiens
tggagtgttatgtatttc

SEQ ID NO: 5062384 - DNA, 19 bp, Homo sapiens
tggagtgttccccttccac

SEQ ID NO: 5062385 - DNA, 12 bp, Homo sapiens
tggagtgtttga

SEQ ID NO: 5062386 - DNA, 15 bp, Homo sapiens
tggagtgtttgaaaa

SEQ ID NO: 5062387 - DNA, 20 bp, Homo sapiens
tggagttaacgggtgaataa

SEQ ID NO: 5062388 - DNA, 22 bp, Homo sapiens
tggagttattgaagcagagtgg

SEQ ID NO: 5062389 - DNA, 19 bp, Homo sapiens
tggagttcaccttggaagg

SEQ ID NO: 5062390 - DNA, 13 bp, Homo sapiens
tggagttcagaga

SEQ ID NO: 5062391 - DNA, 16 bp, Homo sapiens
tggagttcatcttgaa

SEQ ID NO: 5062392 - DNA, 17 bp, Homo sapiens
tggagttcatcttgaat

SEQ ID NO: 5062393 - DNA, 20 bp, Homo sapiens
tggagttcatcttgaattgt

SEQ ID NO: 5062394 - DNA, 17 bp, Homo sapiens
tggagttcattcatatt

SEQ ID NO: 5062395 - DNA, 15 bp, Homo sapiens
tggagttccattctt

SEQ ID NO: 5062396 - DNA, 12 bp, Homo sapiens
tggagttccctc

SEQ ID NO: 5062397 - DNA, 14 bp, Homo sapiens
tggagttccggcct

SEQ ID NO: 5062398 - DNA, 17 bp, Homo sapiens
tggagttccggcctggg

SEQ ID NO: 5062399 - DNA, 19 bp, Homo sapiens
tggagttccggcctgggca

SEQ ID NO: 5062400 - DNA, 23 bp, Homo sapiens
tggagttccttatccctctcttc

SEQ ID NO: 5062401 - DNA, 17 bp, Homo sapiens
tggagttccttctggtg

SEQ ID NO: 5062402 - DNA, 14 bp, Homo sapiens
tggagttctctcat

SEQ ID NO: 5062403 - DNA, 22 bp, Homo sapiens
tggagttgatctggaacccaga

SEQ ID NO: 5062404 - DNA, 11 bp, Homo sapiens
tggagttggag

SEQ ID NO: 5062405 - DNA, 16 bp, Homo sapiens
tggagttggagttcat

SEQ ID NO: 5062406 - DNA, 21 bp, Homo sapiens
tggagttgtattttgacaaaa

SEQ ID NO: 5062407 - DNA, 23 bp, Homo sapiens
tggagttgtattttgacaaaaat

SEQ ID NO: 5062408 - DNA, 17 bp, Homo sapiens
tggagttgttttaacag

SEQ ID NO: 5062409 - DNA, 19 bp, Homo sapiens
tggagtttaatacagtgag

SEQ ID NO: 5062410 - DNA, 21 bp, Homo sapiens
tggagtttcatgtacaagatg

SEQ ID NO: 5062411 - DNA, 14 bp, Homo sapiens
tggagtttcatgtt

SEQ ID NO: 5062412 - DNA, 14 bp, Homo sapiens
tggagtttccaaca

SEQ ID NO: 5062413 - DNA, 17 bp, Homo sapiens
tggagtttctaaggtcc

SEQ ID NO: 5062414 - DNA, 18 bp, Homo sapiens
tggagtttctctagaagc

SEQ ID NO: 5062415 - DNA, 20 bp, Homo sapiens
tggagtttctctagaagctc

SEQ ID NO: 5062416 - DNA, 14 bp, Homo sapiens
tggagtttctctct

SEQ ID NO: 5062417 - DNA, 16 bp, Homo sapiens
tggagtttctctcttg

SEQ ID NO: 5062418 - DNA, 13 bp, Homo sapiens
tggagtttctctg

SEQ ID NO: 5062419 - DNA, 14 bp, Homo sapiens
tggagtttctctgt

SEQ ID NO: 5062420 - DNA, 13 bp, Homo sapiens
tggagtttctgac

SEQ ID NO: 5062421 - DNA, 19 bp, Homo sapiens
tggagtttgggctggagct

SEQ ID NO: 5062422 - DNA, 24 bp, Homo sapiens
tggagtttgggctggagctcctcc

SEQ ID NO: 5062423 - DNA, 20 bp, Homo sapiens
tggagtttgtattttgcata

SEQ ID NO: 5062424 - DNA, 23 bp, Homo sapiens
tggagttttaaaaggctcccatg

SEQ ID NO: 5062425 - DNA, 14 bp, Homo sapiens
tggagttttataaa

SEQ ID NO: 5062426 - DNA, 19 bp, Homo sapiens
tggagttttataaattaaa

SEQ ID NO: 5062427 - DNA, 15 bp, Homo sapiens
tggagtttttctgaa

SEQ ID NO: 5062428 - DNA, 17 bp, Homo sapiens
tggataaaaaagaaaac

SEQ ID NO: 5062429 - DNA, 22 bp, Homo sapiens
tggataaaacattagaagaaaa

SEQ ID NO: 5062430 - DNA, 12 bp, Homo sapiens
tggataaaccac

SEQ ID NO: 5062431 - DNA, 18 bp, Homo sapiens
tggataaaccaccctctg

SEQ ID NO: 5062432 - DNA, 16 bp, Homo sapiens
tggataaagccactga

SEQ ID NO: 5062433 - DNA, 13 bp, Homo sapiens
tggataaatcatt

SEQ ID NO: 5062434 - DNA, 15 bp, Homo sapiens
tggataaattgttta

SEQ ID NO: 5062435 - DNA, 15 bp, Homo sapiens
tggataacaccacca

SEQ ID NO: 5062436 - DNA, 21 bp, Homo sapiens
tggataacttaggtggcaagc

SEQ ID NO: 5062437 - DNA, 20 bp, Homo sapiens
tggataagaaaaatgcttga

SEQ ID NO: 5062438 - DNA, 21 bp, Homo sapiens
tggataagatgatgttaaatg

SEQ ID NO: 5062439 - DNA, 21 bp, Homo sapiens
tggataagtggctgtttcatc

SEQ ID NO: 5062440 - DNA, 13 bp, Homo sapiens
tggataagtttct

SEQ ID NO: 5062441 - DNA, 19 bp, Homo sapiens
tggataagtttctattctg

SEQ ID NO: 5062442 - DNA, 23 bp, Homo sapiens
tggataataaacctgggctcagc

SEQ ID NO: 5062443 - DNA, 20 bp, Homo sapiens
tggataataactagatctcc

SEQ ID NO: 5062444 - DNA, 18 bp, Homo sapiens
tggataataggaattcaa

SEQ ID NO: 5062445 - DNA, 16 bp, Homo sapiens
tggataatctgagcag

SEQ ID NO: 5062446 - DNA, 21 bp, Homo sapiens
tggataattttgcataaaatt

SEQ ID NO: 5062447 - DNA, 14 bp, Homo sapiens
tggatacagagcca

SEQ ID NO: 5062448 - DNA, 15 bp, Homo sapiens
tggatacagcagtag

SEQ ID NO: 5062449 - DNA, 18 bp, Homo sapiens
tggatacagcagtagaca

SEQ ID NO: 5062450 - DNA, 16 bp, Homo sapiens
tggatacagtgcccac

SEQ ID NO: 5062451 - DNA, 17 bp, Homo sapiens
tggatacagtgcccacc

SEQ ID NO: 5062452 - DNA, 20 bp, Homo sapiens
tggatacagtgcccaccgcc

SEQ ID NO: 5062453 - DNA, 17 bp, Homo sapiens
tggatacataaagacta

SEQ ID NO: 5062454 - DNA, 17 bp, Homo sapiens
tggatacatctgctgtg

SEQ ID NO: 5062455 - DNA, 18 bp, Homo sapiens
tggatacatctgctgtgt

SEQ ID NO: 5062456 - DNA, 20 bp, Homo sapiens
tggatacatctgctgtgtgg

SEQ ID NO: 5062457 - DNA, 15 bp, Homo sapiens
tggataccattatat

SEQ ID NO: 5062458 - DNA, 23 bp, Homo sapiens
tggatacgggggttccctttccc

SEQ ID NO: 5062459 - DNA, 17 bp, Homo sapiens
tggattttttttttcag

SEQ ID NO: 5062460 - DNA, 15 bp, Homo sapiens
tggcaaaactcaggc

SEQ ID NO: 5062461 - DNA, 15 bp, Homo sapiens
tggcaaaagccacat

SEQ ID NO: 5062462 - DNA, 17 bp, Homo sapiens
tggcaaaagccttgtgt

SEQ ID NO: 5062463 - DNA, 21 bp, Homo sapiens
tggcaaaaggatctttgtggc

SEQ ID NO: 5062464 - DNA, 12 bp, Homo sapiens
tggcaaaataaa

SEQ ID NO: 5062465 - DNA, 17 bp, Homo sapiens
tggcaaaataaaacatg

SEQ ID NO: 5062466 - DNA, 16 bp, Homo sapiens
tggcaaaatatggttt

SEQ ID NO: 5062467 - DNA, 17 bp, Homo sapiens
tggcaaaatattatgtt

SEQ ID NO: 5062468 - DNA, 17 bp, Homo sapiens
tggcaaaattacagttc

SEQ ID NO: 5062469 - DNA, 16 bp, Homo sapiens
tggcaaacagggcctc

SEQ ID NO: 5062470 - DNA, 19 bp, Homo sapiens
tggcaaacagggcctctgc

SEQ ID NO: 5062471 - DNA, 17 bp, Homo sapiens
tggcaaaccctcccaga

SEQ ID NO: 5062472 - DNA, 22 bp, Homo sapiens
tggcaaacgagactttctcctg

SEQ ID NO: 5062473 - DNA, 17 bp, Homo sapiens
tggcaaacgctaaagag

SEQ ID NO: 5062474 - DNA, 17 bp, Homo sapiens
tggcaaacgtttctcaa

SEQ ID NO: 5062475 - DNA, 19 bp, Homo sapiens
tggcaaactctccaccaca

SEQ ID NO: 5062476 - DNA, 13 bp, Homo sapiens
tggcaaagacaga

SEQ ID NO: 5062477 - DNA, 23 bp, Homo sapiens
tggcaaagcagcaactattcaca

SEQ ID NO: 5062478 - DNA, 14 bp, Homo sapiens
tggcaaagccagaa

SEQ ID NO: 5062479 - DNA, 21 bp, Homo sapiens
tggcaaagccttcattgcctt

SEQ ID NO: 5062480 - DNA, 14 bp, Homo sapiens
tggcaaaggatcca

SEQ ID NO: 5062481 - DNA, 18 bp, Homo sapiens
tggcaaagtgacaaagca

SEQ ID NO: 5062482 - DNA, 14 bp, Homo sapiens
tggcaaagtgctgt

SEQ ID NO: 5062483 - DNA, 19 bp, Homo sapiens
tggcaaagtttaaatgtat

SEQ ID NO: 5062484 - DNA, 17 bp, Homo sapiens
tggcaaatcaggggcca

SEQ ID NO: 5062485 - DNA, 21 bp, Homo sapiens
tggcaaatcaggggccagaga

SEQ ID NO: 5062486 - DNA, 16 bp, Homo sapiens
tggcaaatccaggctg

SEQ ID NO: 5062487 - DNA, 15 bp, Homo sapiens
tggcaaatgaaagca

SEQ ID NO: 5062488 - DNA, 13 bp, Homo sapiens
tggcaaatgatga

SEQ ID NO: 5062489 - DNA, 11 bp, Homo sapiens
tggcaaatgca

SEQ ID NO: 5062490 - DNA, 20 bp, Homo sapiens
tggcaaattaacttgagttt

SEQ ID NO: 5062491 - DNA, 17 bp, Homo sapiens
tggcaaatttgtgaact

SEQ ID NO: 5062492 - DNA, 13 bp, Homo sapiens
tggcaacaaactg

SEQ ID NO: 5062493 - DNA, 14 bp, Homo sapiens
tggcaacaaactgc

SEQ ID NO: 5062494 - DNA, 19 bp, Homo sapiens
tggcaacactgaaggaaca

SEQ ID NO: 5062495 - DNA, 14 bp, Homo sapiens
tggcaacagaagtg

SEQ ID NO: 5062496 - DNA, 22 bp, Homo sapiens
tggcaacagatctggaacctca

SEQ ID NO: 5062497 - DNA, 14 bp, Homo sapiens
tggcaacaggacag

SEQ ID NO: 5062498 - DNA, 16 bp, Homo sapiens
tggcaacattccaaga

SEQ ID NO: 5062499 - DNA, 17 bp, Homo sapiens
tggcaacatttggggag

SEQ ID NO: 5062500 - DNA, 16 bp, Homo sapiens
tggcaaccagaccatt

SEQ ID NO: 5062501 - DNA, 14 bp, Homo sapiens
tggcaaccagccag

SEQ ID NO: 5062502 - DNA, 17 bp, Homo sapiens
tggcaacccaaggaacc

SEQ ID NO: 5062503 - DNA, 15 bp, Homo sapiens
tggcaacgttcatgt

SEQ ID NO: 5062504 - DNA, 19 bp, Homo sapiens
tggcaagaaagctggtaaa

SEQ ID NO: 5062505 - DNA, 13 bp, Homo sapiens
tggcaagaacttg

SEQ ID NO: 5062506 - DNA, 16 bp, Homo sapiens
tggcaagactgtctta

SEQ ID NO: 5062507 - DNA, 15 bp, Homo sapiens
tggcaagagctcttt

SEQ ID NO: 5062508 - DNA, 22 bp, Homo sapiens
tggcaagagggtgacagcttcc

SEQ ID NO: 5062509 - DNA, 17 bp, Homo sapiens
tggcaagataaacactt

SEQ ID NO: 5062510 - DNA, 22 bp, Homo sapiens
tggcaagattgaagtctgatat

SEQ ID NO: 5062511 - DNA, 18 bp, Homo sapiens
tggcaagcaagagctctt

SEQ ID NO: 5062512 - DNA, 16 bp, Homo sapiens
tggcaagcccctgccc

SEQ ID NO: 5062513 - DNA, 15 bp, Homo sapiens
tggcaagctcttcat

SEQ ID NO: 5062514 - DNA, 21 bp, Homo sapiens
tggcaagctcttcattgcact

SEQ ID NO: 5062515 - DNA, 14 bp, Homo sapiens
tggcaaggagaata

SEQ ID NO: 5062516 - DNA, 19 bp, Homo sapiens
tggcaaggtgggttccagg

SEQ ID NO: 5062517 - DNA, 20 bp, Homo sapiens
tggcaaggtgggttccaggg

SEQ ID NO: 5062518 - DNA, 17 bp, Homo sapiens
tggcaagtaacttctga

SEQ ID NO: 5062519 - DNA, 19 bp, Homo sapiens
tggcaagtctcacatattc

SEQ ID NO: 5062520 - DNA, 12 bp, Homo sapiens
tggcaagtgacc

SEQ ID NO: 5062521 - DNA, 13 bp, Homo sapiens
tggcaataaactc

SEQ ID NO: 5062522 - DNA, 16 bp, Homo sapiens
tggcaataaataaagc

SEQ ID NO: 5062523 - DNA, 21 bp, Homo sapiens
tggcaataaataaagcttggg

SEQ ID NO: 5062524 - DNA, 13 bp, Homo sapiens
tggcaataaatgg

SEQ ID NO: 5062525 - DNA, 20 bp, Homo sapiens
tggcaataaatgtcccaaat

SEQ ID NO: 5062526 - DNA, 23 bp, Homo sapiens
tggcaataaatgtcccaaataaa

SEQ ID NO: 5062527 - DNA, 20 bp, Homo sapiens
tggcaataaattttgaaaag

SEQ ID NO: 5062528 - DNA, 21 bp, Homo sapiens
tggcaataaattttgaaaagt

SEQ ID NO: 5062529 - DNA, 20 bp, Homo sapiens
tggcaataagatacacagct

SEQ ID NO: 5062530 - DNA, 19 bp, Homo sapiens
tggcaataatgtcaacacc

SEQ ID NO: 5062531 - DNA, 20 bp, Homo sapiens
tggcaatagtcaaattgtgt

SEQ ID NO: 5062532 - DNA, 15 bp, Homo sapiens
tggcaatagtgtgtt

SEQ ID NO: 5062533 - DNA, 13 bp, Homo sapiens
tggcaatatagaa

SEQ ID NO: 5062534 - DNA, 15 bp, Homo sapiens
tggcaatattcctta

SEQ ID NO: 5062535 - DNA, 20 bp, Homo sapiens
tggcaatattctgtaactat

SEQ ID NO: 5062536 - DNA, 20 bp, Homo sapiens
tggcaatcttgcccttaata

SEQ ID NO: 5062537 - DNA, 20 bp, Homo sapiens
tggcaatgaaaattttaaga

SEQ ID NO: 5062538 - DNA, 19 bp, Homo sapiens
tggcaatgagtgtgccaga

SEQ ID NO: 5062539 - DNA, 14 bp, Homo sapiens
tggcaatgccacag

SEQ ID NO: 5062540 - DNA, 16 bp, Homo sapiens
tggcaatgctaattca

SEQ ID NO: 5062541 - DNA, 19 bp, Homo sapiens
tggcaatgcttaaactaaa

SEQ ID NO: 5062542 - DNA, 20 bp, Homo sapiens
tggcaatgggatttgggcta

SEQ ID NO: 5062543 - DNA, 20 bp, Homo sapiens
tggcaatgggccgtcccctc

SEQ ID NO: 5062544 - DNA, 17 bp, Homo sapiens
tggcaattccaatattt

SEQ ID NO: 5062545 - DNA, 16 bp, Homo sapiens
tggcaattctggaagc

SEQ ID NO: 5062546 - DNA, 16 bp, Homo sapiens
tggcaattgcactcat

SEQ ID NO: 5062547 - DNA, 14 bp, Homo sapiens
tggcaattgtctat

SEQ ID NO: 5062548 - DNA, 16 bp, Homo sapiens
tggcaatttaacatgt

SEQ ID NO: 5062549 - DNA, 18 bp, Homo sapiens
tggcaatttattttaaga

SEQ ID NO: 5062550 - DNA, 12 bp, Homo sapiens
tggcaatttctt

SEQ ID NO: 5062551 - DNA, 16 bp, Homo sapiens
tggcacaaaagacagc

SEQ ID NO: 5062552 - DNA, 22 bp, Homo sapiens
tggcacaagctccctggtgagg

SEQ ID NO: 5062553 - DNA, 10 bp, Homo sapiens
tggcacaatg

SEQ ID NO: 5062554 - DNA, 15 bp, Homo sapiens
tggcacaatgaatgt

SEQ ID NO: 5062555 - DNA, 23 bp, Homo sapiens
tggcacaatggctaattcccaga

SEQ ID NO: 5062556 - DNA, 22 bp, Homo sapiens
tggcacaatgttggagcagcag

SEQ ID NO: 5062557 - DNA, 22 bp, Homo sapiens
tggcacacaatcctataaatgt

SEQ ID NO: 5062558 - DNA, 13 bp, Homo sapiens
tggcacactccct

SEQ ID NO: 5062559 - DNA, 22 bp, Homo sapiens
tggcacagaaacctctactaaa

SEQ ID NO: 5062560 - DNA, 14 bp, Homo sapiens
tggcacagaagagg

SEQ ID NO: 5062561 - DNA, 15 bp, Homo sapiens
tggcacagaccaggc

SEQ ID NO: 5062562 - DNA, 23 bp, Homo sapiens
tggcacagaggtagtctcactgc

SEQ ID NO: 5062563 - DNA, 20 bp, Homo sapiens
tggcacagcccaaagaagga

SEQ ID NO: 5062564 - DNA, 12 bp, Homo sapiens
tggcacagcccc

SEQ ID NO: 5062565 - DNA, 14 bp, Homo sapiens
tggcacagcccctg

SEQ ID NO: 5062566 - DNA, 16 bp, Homo sapiens
tggcacagcccctgga

SEQ ID NO: 5062567 - DNA, 17 bp, Homo sapiens
tggcacagccctgagtg

SEQ ID NO: 5062568 - DNA, 22 bp, Homo sapiens
tggcacagccctgagtgtccca

SEQ ID NO: 5062569 - DNA, 22 bp, Homo sapiens
tggcacagccgcgggccaggag

SEQ ID NO: 5062570 - DNA, 17 bp, Homo sapiens
tggcacagcctgcactt

SEQ ID NO: 5062571 - DNA, 22 bp, Homo sapiens
tggcacagcctggctgtggcct

SEQ ID NO: 5062572 - DNA, 20 bp, Homo sapiens
tggcacagctgggagcctgg

SEQ ID NO: 5062573 - DNA, 14 bp, Homo sapiens
tggcacaggacatg

SEQ ID NO: 5062574 - DNA, 13 bp, Homo sapiens
tggcacaggactg

SEQ ID NO: 5062575 - DNA, 21 bp, Homo sapiens
tggcacaggagtgtcctcttc

SEQ ID NO: 5062576 - DNA, 13 bp, Homo sapiens
tggcacaggcact

SEQ ID NO: 5062577 - DNA, 23 bp, Homo sapiens
tggcacaggcccgccctctgcct

SEQ ID NO: 5062578 - DNA, 19 bp, Homo sapiens
tggcacaggccgaggcagg

SEQ ID NO: 5062579 - DNA, 15 bp, Homo sapiens
tggcacagggcagtg

SEQ ID NO: 5062580 - DNA, 18 bp, Homo sapiens
tggcacagggcagtggga

SEQ ID NO: 5062581 - DNA, 16 bp, Homo sapiens
tggcacagggcatgaa

SEQ ID NO: 5062582 - DNA, 22 bp, Homo sapiens
tggcacagtgatgccgggcgcc

SEQ ID NO: 5062583 - DNA, 23 bp, Homo sapiens
tggcacagtgatgccgggcgcca

SEQ ID NO: 5062584 - DNA, 18 bp, Homo sapiens
tggcacagttttctgaga

SEQ ID NO: 5062585 - DNA, 14 bp, Homo sapiens
tggcacatcagaaa

SEQ ID NO: 5062586 - DNA, 15 bp, Homo sapiens
tggcacatcagaaag

SEQ ID NO: 5062587 - DNA, 15 bp, Homo sapiens
tggcacatcctatgc

SEQ ID NO: 5062588 - DNA, 18 bp, Homo sapiens
tggcacatcctatgcaat

SEQ ID NO: 5062589 - DNA, 19 bp, Homo sapiens
tggcacatcctatgcaata

SEQ ID NO: 5062590 - DNA, 23 bp, Homo sapiens
tggcacattagggtgggcgtgct

SEQ ID NO: 5062591 - DNA, 21 bp, Homo sapiens
tggcacattcattttctcagt

SEQ ID NO: 5062592 - DNA, 12 bp, Homo sapiens
tggcacattcct

SEQ ID NO: 5062593 - DNA, 16 bp, Homo sapiens
tggcacattcctttgg

SEQ ID NO: 5062594 - DNA, 18 bp, Homo sapiens
tggcacattcctttgggt

SEQ ID NO: 5062595 - DNA, 16 bp, Homo sapiens
tggcacattgcccctc

SEQ ID NO: 5062596 - DNA, 18 bp, Homo sapiens
tggcacatttaagagaca

SEQ ID NO: 5062597 - DNA, 13 bp, Homo sapiens
tggcacatttcag

SEQ ID NO: 5062598 - DNA, 16 bp, Homo sapiens
tggcacatttcaggga

SEQ ID NO: 5062599 - DNA, 18 bp, Homo sapiens
tggcacatttcagggaga

SEQ ID NO: 5062600 - DNA, 11 bp, Homo sapiens
tggcaccaaag

SEQ ID NO: 5062601 - DNA, 19 bp, Homo sapiens
tggcaccaaagatgcagcc

SEQ ID NO: 5062602 - DNA, 14 bp, Homo sapiens
tggcaccaataaag

SEQ ID NO: 5062603 - DNA, 19 bp, Homo sapiens
tggcaccaataaaggagga

SEQ ID NO: 5062604 - DNA, 16 bp, Homo sapiens
tggcaccaccagggtg

SEQ ID NO: 5062605 - DNA, 21 bp, Homo sapiens
tggcaccaccagggtggacca

SEQ ID NO: 5062606 - DNA, 13 bp, Homo sapiens
tggcaccactctc

SEQ ID NO: 5062607 - DNA, 22 bp, Homo sapiens
tggcaccacttatttattgttg

SEQ ID NO: 5062608 - DNA, 20 bp, Homo sapiens
tggcaccagacacccaggac

SEQ ID NO: 5062609 - DNA, 19 bp, Homo sapiens
tggcaccagatgcaacctc

SEQ ID NO: 5062610 - DNA, 17 bp, Homo sapiens
tggcaccagcagcctgg

SEQ ID NO: 5062611 - DNA, 14 bp, Homo sapiens
tggcaccagcaggc

SEQ ID NO: 5062612 - DNA, 15 bp, Homo sapiens
tggcaccagcaggca

SEQ ID NO: 5062613 - DNA, 12 bp, Homo sapiens
tggcaccagccc

SEQ ID NO: 5062614 - DNA, 13 bp, Homo sapiens
tggcaccagcccc

SEQ ID NO: 5062615 - DNA, 13 bp, Homo sapiens
tggcaccatcagc

SEQ ID NO: 5062616 - DNA, 17 bp, Homo sapiens
tggcaccatcagcctgt

SEQ ID NO: 5062617 - DNA, 13 bp, Homo sapiens
tggcaccatccac

SEQ ID NO: 5062618 - DNA, 20 bp, Homo sapiens
tggcaccatccaccctgcag

SEQ ID NO: 5062619 - DNA, 20 bp, Homo sapiens
tggcacccaaatcacatctc

SEQ ID NO: 5062620 - DNA, 14 bp, Homo sapiens
tggcacccaagacc

SEQ ID NO: 5062621 - DNA, 23 bp, Homo sapiens
tggcacccaagacctcagggcac

SEQ ID NO: 5062622 - DNA, 16 bp, Homo sapiens
tggcacccaccgtctc

SEQ ID NO: 5062623 - DNA, 23 bp, Homo sapiens
tggcacccaccgtctcggccctg

SEQ ID NO: 5062624 - DNA, 20 bp, Homo sapiens
tggcacccaccgtggaggag

SEQ ID NO: 5062625 - DNA, 13 bp, Homo sapiens
tggcacccactcc

SEQ ID NO: 5062626 - DNA, 14 bp, Homo sapiens
tggcaccccagcta

SEQ ID NO: 5062627 - DNA, 18 bp, Homo sapiens
tggcacccccacaagctg

SEQ ID NO: 5062628 - DNA, 15 bp, Homo sapiens
tggcacccccatgct

SEQ ID NO: 5062629 - DNA, 18 bp, Homo sapiens
tggcacccccatgctgcc

SEQ ID NO: 5062630 - DNA, 19 bp, Homo sapiens
tggcacccccatgctgcct

SEQ ID NO: 5062631 - DNA, 15 bp, Homo sapiens
tggcacccggcccct

SEQ ID NO: 5062632 - DNA, 16 bp, Homo sapiens
tggcacccggcccctg

SEQ ID NO: 5062633 - DNA, 19 bp, Homo sapiens
tggcacccggcccctgctg

SEQ ID NO: 5062634 - DNA, 20 bp, Homo sapiens
tggcacccggcccctgctgg

SEQ ID NO: 5062635 - DNA, 21 bp, Homo sapiens
tggcacccggcccctgctggt

SEQ ID NO: 5062636 - DNA, 19 bp, Homo sapiens
tggcaccctggccacccca

SEQ ID NO: 5062637 - DNA, 19 bp, Homo sapiens
tggcatcccagtggcctca

SEQ ID NO: 5062638 - DNA, 13 bp, Homo sapiens
tggcatccctggg

SEQ ID NO: 5062639 - DNA, 15 bp, Homo sapiens
tggcatccctgggcc

SEQ ID NO: 5062640 - DNA, 12 bp, Homo sapiens
tggcatcctggc

SEQ ID NO: 5062641 - DNA, 22 bp, Homo sapiens
tggcatcctggctggctgtgtc

SEQ ID NO: 5062642 - DNA, 23 bp, Homo sapiens
tggcatcctggctggctgtgtcc

SEQ ID NO: 5062643 - DNA, 13 bp, Homo sapiens
tggcatcctgtga

SEQ ID NO: 5062644 - DNA, 15 bp, Homo sapiens
tggcatcctgtgaag

SEQ ID NO: 5062645 - DNA, 17 bp, Homo sapiens
tggcatcctgtgaagtc

SEQ ID NO: 5062646 - DNA, 22 bp, Homo sapiens
tggcatcgcaccattctgactc

SEQ ID NO: 5062647 - DNA, 16 bp, Homo sapiens
tggcatcgcagcttcc

SEQ ID NO: 5062648 - DNA, 18 bp, Homo sapiens
tggcatcgcagtctctta

SEQ ID NO: 5062649 - DNA, 23 bp, Homo sapiens
tggcatcgtagaagagatgtggc

SEQ ID NO: 5062650 - DNA, 17 bp, Homo sapiens
tggcatcgtgtattcca

SEQ ID NO: 5062651 - DNA, 13 bp, Homo sapiens
tggcatctagcca

SEQ ID NO: 5062652 - DNA, 21 bp, Homo sapiens
tggcatctagccagaggctgg

SEQ ID NO: 5062653 - DNA, 15 bp, Homo sapiens
tggcatctcccacac

SEQ ID NO: 5062654 - DNA, 13 bp, Homo sapiens
tggcatctcctgt

SEQ ID NO: 5062655 - DNA, 16 bp, Homo sapiens
tggcatctcctgtcct

SEQ ID NO: 5062656 - DNA, 21 bp, Homo sapiens
tggcatctgaatgaaaataac

SEQ ID NO: 5062657 - DNA, 18 bp, Homo sapiens
tggcatctgcaaaggaat

SEQ ID NO: 5062658 - DNA, 13 bp, Homo sapiens
tggcatctgcttt

SEQ ID NO: 5062659 - DNA, 14 bp, Homo sapiens
tggcatctgctttt

SEQ ID NO: 5062660 - DNA, 17 bp, Homo sapiens
tggcatctgcttttaat

SEQ ID NO: 5062661 - DNA, 13 bp, Homo sapiens
tggcatctgtgcg

SEQ ID NO: 5062662 - DNA, 13 bp, Homo sapiens
tggcatctgtgtg

SEQ ID NO: 5062663 - DNA, 23 bp, Homo sapiens
tggcatcttcgtcttcactctta

SEQ ID NO: 5062664 - DNA, 13 bp, Homo sapiens
tggcatcttctgg

SEQ ID NO: 5062665 - DNA, 13 bp, Homo sapiens
tggcatcttgcca

SEQ ID NO: 5062666 - DNA, 20 bp, Homo sapiens
tggcatctttgccttgggct

SEQ ID NO: 5062667 - DNA, 23 bp, Homo sapiens
tggcatctttgccttgggctgct

SEQ ID NO: 5062668 - DNA, 19 bp, Homo sapiens
tggcatctttggaggaatt

SEQ ID NO: 5062669 - DNA, 18 bp, Homo sapiens
tggcatgaagattttctt

SEQ ID NO: 5062670 - DNA, 21 bp, Homo sapiens
tggcatgaatcgggctaaggt

SEQ ID NO: 5062671 - DNA, 14 bp, Homo sapiens
tggcatgacctcat

SEQ ID NO: 5062672 - DNA, 20 bp, Homo sapiens
tggcatgatcatagctcact

SEQ ID NO: 5062673 - DNA, 22 bp, Homo sapiens
tggcatgatcatagctcactgc

SEQ ID NO: 5062674 - DNA, 21 bp, Homo sapiens
tggcatgattagattgcaaag

SEQ ID NO: 5062675 - DNA, 20 bp, Homo sapiens
tggcatgatttatatatggc

SEQ ID NO: 5062676 - DNA, 15 bp, Homo sapiens
tggcatgcacctgca

SEQ ID NO: 5062677 - DNA, 16 bp, Homo sapiens
tggcatgcttaaattt

SEQ ID NO: 5062678 - DNA, 17 bp, Homo sapiens
tggcatgcttaaatttt

SEQ ID NO: 5062679 - DNA, 18 bp, Homo sapiens
tggcatgcttaaatttta

SEQ ID NO: 5062680 - DNA, 19 bp, Homo sapiens
tggcatggaaatttaaagc

SEQ ID NO: 5062681 - DNA, 20 bp, Homo sapiens
tggcatggaaatttaaagca

SEQ ID NO: 5062682 - DNA, 13 bp, Homo sapiens
tggcatggagact

SEQ ID NO: 5062683 - DNA, 19 bp, Homo sapiens
tggcatggagactctgaga

SEQ ID NO: 5062684 - DNA, 14 bp, Homo sapiens
tggcatggcacctg

SEQ ID NO: 5062685 - DNA, 16 bp, Homo sapiens
tggcatggcacctgtc

SEQ ID NO: 5062686 - DNA, 17 bp, Homo sapiens
tggcatgggcgcaggcc

SEQ ID NO: 5062687 - DNA, 21 bp, Homo sapiens
tggcatgggcgcaggcccagt

SEQ ID NO: 5062688 - DNA, 19 bp, Homo sapiens
tggcatggtagtatacaaa

SEQ ID NO: 5062689 - DNA, 13 bp, Homo sapiens
tggcatggtcctg

SEQ ID NO: 5062690 - DNA, 16 bp, Homo sapiens
tggcatggtcctgtgc

SEQ ID NO: 5062691 - DNA, 17 bp, Homo sapiens
tggcatggtgagtgttg

SEQ ID NO: 5062692 - DNA, 21 bp, Homo sapiens
tggcatggtggttgggaccca

SEQ ID NO: 5062693 - DNA, 23 bp, Homo sapiens
tggcatggttttgtgccatctgt

SEQ ID NO: 5062694 - DNA, 15 bp, Homo sapiens
tggcatgtcagagcc

SEQ ID NO: 5062695 - DNA, 23 bp, Homo sapiens
tggcatgtcagagccaggctctg

SEQ ID NO: 5062696 - DNA, 15 bp, Homo sapiens
tggcatgtctcctca

SEQ ID NO: 5062697 - DNA, 13 bp, Homo sapiens
tggcatgtcttca

SEQ ID NO: 5062698 - DNA, 19 bp, Homo sapiens
tggcatgtgaaaagtaaaa

SEQ ID NO: 5062699 - DNA, 12 bp, Homo sapiens
tggcatgtgcct

SEQ ID NO: 5062700 - DNA, 13 bp, Homo sapiens
tggcatgtgcctg

SEQ ID NO: 5062701 - DNA, 13 bp, Homo sapiens
tggcatgtggaga

SEQ ID NO: 5062702 - DNA, 16 bp, Homo sapiens
tggcatgtggagacac

SEQ ID NO: 5062703 - DNA, 15 bp, Homo sapiens
tggcatgtggcctgt

SEQ ID NO: 5062704 - DNA, 16 bp, Homo sapiens
tggcatgtggcctgtg

SEQ ID NO: 5062705 - DNA, 20 bp, Homo sapiens
tggcatgtgggttgtgatat

SEQ ID NO: 5062706 - DNA, 23 bp, Homo sapiens
tggcatgtgggttgtgatattga

SEQ ID NO: 5062707 - DNA, 14 bp, Homo sapiens
tggcatgttgattt

SEQ ID NO: 5062708 - DNA, 15 bp, Homo sapiens
tggcatgttgatttc

SEQ ID NO: 5062709 - DNA, 12 bp, Homo sapiens
tggcatgtttaa

SEQ ID NO: 5062710 - DNA, 13 bp, Homo sapiens
tggcatgtttaat

SEQ ID NO: 5062711 - DNA, 13 bp, Homo sapiens
tggcatgttttga

SEQ ID NO: 5062712 - DNA, 19 bp, Homo sapiens
tggcatgttttgtcattgt

SEQ ID NO: 5062713 - DNA, 23 bp, Homo sapiens
tggcatgttttgtcattgttttc

SEQ ID NO: 5062714 - DNA, 15 bp, Homo sapiens
tggcattaaaactta

SEQ ID NO: 5062715 - DNA, 19 bp, Homo sapiens
tggcattaaaccacatcat

SEQ ID NO: 5062716 - DNA, 16 bp, Homo sapiens
tggcattaacaataaa

SEQ ID NO: 5062717 - DNA, 19 bp, Homo sapiens
tggcattaacaataaagca

SEQ ID NO: 5062718 - DNA, 18 bp, Homo sapiens
tggcattaccctctgcag

SEQ ID NO: 5062719 - DNA, 18 bp, Homo sapiens
tggcattatgtccactgt

SEQ ID NO: 5062720 - DNA, 17 bp, Homo sapiens
tggcattctacacctgg

SEQ ID NO: 5062721 - DNA, 18 bp, Homo sapiens
tggcattctttgcaatac

SEQ ID NO: 5062722 - DNA, 20 bp, Homo sapiens
tggcattctttgcaatactg

SEQ ID NO: 5062723 - DNA, 20 bp, Homo sapiens
tggcattgaccttcatgacc

SEQ ID NO: 5062724 - DNA, 16 bp, Homo sapiens
tggcattgatcttaaa

SEQ ID NO: 5062725 - DNA, 18 bp, Homo sapiens
tggcattgcactgcttat

SEQ ID NO: 5062726 - DNA, 14 bp, Homo sapiens
tggcattggcagca

SEQ ID NO: 5062727 - DNA, 19 bp, Homo sapiens
tggcattggcagcaggtgc

SEQ ID NO: 5062728 - DNA, 19 bp, Homo sapiens
tggcattgtccctgtgcct

SEQ ID NO: 5062729 - DNA, 13 bp, Homo sapiens
tggcattgttgat

SEQ ID NO: 5062730 - DNA, 15 bp, Homo sapiens
tggcatttagcacag

SEQ ID NO: 5062731 - DNA, 19 bp, Homo sapiens
tggcatttagcacagtatt

SEQ ID NO: 5062732 - DNA, 20 bp, Homo sapiens
tggcatttagcacagtattt

SEQ ID NO: 5062733 - DNA, 21 bp, Homo sapiens
tggcatttagtaccttcaaat

SEQ ID NO: 5062734 - DNA, 23 bp, Homo sapiens
tggcatttcaattcctggccctg

SEQ ID NO: 5062735 - DNA, 14 bp, Homo sapiens
tggcatttccaaac

SEQ ID NO: 5062736 - DNA, 12 bp, Homo sapiens
tggcatttctat

SEQ ID NO: 5062737 - DNA, 16 bp, Homo sapiens
tggcatttctctttaa

SEQ ID NO: 5062738 - DNA, 23 bp, Homo sapiens
tggcatttctctttaaactatgt

SEQ ID NO: 5062739 - DNA, 14 bp, Homo sapiens
tggcatttgaacta

SEQ ID NO: 5062740 - DNA, 17 bp, Homo sapiens
tggcatttgcagatttt

SEQ ID NO: 5062741 - DNA, 17 bp, Homo sapiens
tggcatttgctggttat

SEQ ID NO: 5062742 - DNA, 21 bp, Homo sapiens
tggcatttgctggttataaca

SEQ ID NO: 5062743 - DNA, 17 bp, Homo sapiens
tggcatttggtctcagg

SEQ ID NO: 5062744 - DNA, 20 bp, Homo sapiens
tggcatttggtctcaggcag

SEQ ID NO: 5062745 - DNA, 19 bp, Homo sapiens
tggcatttgtgtgttggct

SEQ ID NO: 5062746 - DNA, 19 bp, Homo sapiens
tggcatttgttatcctctt

SEQ ID NO: 5062747 - DNA, 11 bp, Homo sapiens
tggcattttaa

SEQ ID NO: 5062748 - DNA, 16 bp, Homo sapiens
tggcattttctgttcc

SEQ ID NO: 5062749 - DNA, 20 bp, Homo sapiens
tggcatttttagctccttga

SEQ ID NO: 5062750 - DNA, 19 bp, Homo sapiens
tggcatttttgcaggctgg

SEQ ID NO: 5062751 - DNA, 22 bp, Homo sapiens
tggccaaaaagaatctgcattt

SEQ ID NO: 5062752 - DNA, 15 bp, Homo sapiens
tggccaaaacaggct

SEQ ID NO: 5062753 - DNA, 14 bp, Homo sapiens
tggccaaagagcct

SEQ ID NO: 5062754 - DNA, 15 bp, Homo sapiens
tggccaaagagcctt

SEQ ID NO: 5062755 - DNA, 21 bp, Homo sapiens
tggccaaagccaaagctaggc

SEQ ID NO: 5062756 - DNA, 20 bp, Homo sapiens
tggccaaattatttgtgtaa

SEQ ID NO: 5062757 - DNA, 13 bp, Homo sapiens
tggccaacatggt

SEQ ID NO: 5062758 - DNA, 22 bp, Homo sapiens
tggccaacattgtaaaacccca

SEQ ID NO: 5062759 - DNA, 12 bp, Homo sapiens
tggccaaccagg

SEQ ID NO: 5062760 - DNA, 13 bp, Homo sapiens
tggccaaccagga

SEQ ID NO: 5062761 - DNA, 22 bp, Homo sapiens
tggccaaccaggacccagggtc

SEQ ID NO: 5062762 - DNA, 15 bp, Homo sapiens
tggccaagaaaattg

SEQ ID NO: 5062763 - DNA, 16 bp, Homo sapiens
tggccaagaaagaaaa

SEQ ID NO: 5062764 - DNA, 13 bp, Homo sapiens
tggccaagaagca

SEQ ID NO: 5062765 - DNA, 21 bp, Homo sapiens
tggccaagaagcagtggcctt

SEQ ID NO: 5062766 - DNA, 14 bp, Homo sapiens
tggccaagagaaac

SEQ ID NO: 5062767 - DNA, 18 bp, Homo sapiens
tggccaagagaaacttcc

SEQ ID NO: 5062768 - DNA, 14 bp, Homo sapiens
tggccaagagcatc

SEQ ID NO: 5062769 - DNA, 17 bp, Homo sapiens
tggccaagcaggctggt

SEQ ID NO: 5062770 - DNA, 23 bp, Homo sapiens
tggccaagcagggaggaagaagc

SEQ ID NO: 5062771 - DNA, 14 bp, Homo sapiens
tggccaagcctatc

SEQ ID NO: 5062772 - DNA, 17 bp, Homo sapiens
tggccaagcctgccccg

SEQ ID NO: 5062773 - DNA, 14 bp, Homo sapiens
tggccaagcctggc

SEQ ID NO: 5062774 - DNA, 14 bp, Homo sapiens
tggccaagctgagg

SEQ ID NO: 5062775 - DNA, 17 bp, Homo sapiens
tggccaagctgaggtgc

SEQ ID NO: 5062776 - DNA, 19 bp, Homo sapiens
tggccaagctgaggtgccc

SEQ ID NO: 5062777 - DNA, 16 bp, Homo sapiens
tggccaaggaaaggca

SEQ ID NO: 5062778 - DNA, 15 bp, Homo sapiens
tggccaaggagctgc

SEQ ID NO: 5062779 - DNA, 17 bp, Homo sapiens
tggccaaggagctgcta

SEQ ID NO: 5062780 - DNA, 18 bp, Homo sapiens
tggccaaggagctgctat

SEQ ID NO: 5062781 - DNA, 20 bp, Homo sapiens
tggccaaggctctctctgtc

SEQ ID NO: 5062782 - DNA, 18 bp, Homo sapiens
tggccaaggctgagagct

SEQ ID NO: 5062783 - DNA, 13 bp, Homo sapiens
tggccaagggcca

SEQ ID NO: 5062784 - DNA, 18 bp, Homo sapiens
tggccaagggccagacag

SEQ ID NO: 5062785 - DNA, 21 bp, Homo sapiens
tggccaaggggccagctgccc

SEQ ID NO: 5062786 - DNA, 23 bp, Homo sapiens
tggccaaggggccagctgcccct

SEQ ID NO: 5062787 - DNA, 20 bp, Homo sapiens
tggccaaggtgaatagcaca

SEQ ID NO: 5062788 - DNA, 16 bp, Homo sapiens
tggccaagttcctcta

SEQ ID NO: 5062789 - DNA, 22 bp, Homo sapiens
tggccaatccaggtgggagaga

SEQ ID NO: 5062790 - DNA, 22 bp, Homo sapiens
tggccaatgcacctaaagaaaa

SEQ ID NO: 5062791 - DNA, 18 bp, Homo sapiens
tggccaatgcggcccact

SEQ ID NO: 5062792 - DNA, 21 bp, Homo sapiens
tggccaattttagtcttgctg

SEQ ID NO: 5062793 - DNA, 17 bp, Homo sapiens
tggccacaaacctgccc

SEQ ID NO: 5062794 - DNA, 22 bp, Homo sapiens
tggccacaaggaaaaggaggag

SEQ ID NO: 5062795 - DNA, 21 bp, Homo sapiens
tggccacaatcctccccacca

SEQ ID NO: 5062796 - DNA, 16 bp, Homo sapiens
tggccacacagcagcg

SEQ ID NO: 5062797 - DNA, 22 bp, Homo sapiens
tggccacacaggcagggcctgg

SEQ ID NO: 5062798 - DNA, 14 bp, Homo sapiens
tggccacactgtga

SEQ ID NO: 5062799 - DNA, 16 bp, Homo sapiens
tggccacactgtgaca

SEQ ID NO: 5062800 - DNA, 17 bp, Homo sapiens
tggccacagacccccag

SEQ ID NO: 5062801 - DNA, 12 bp, Homo sapiens
tggccacagact

SEQ ID NO: 5062802 - DNA, 11 bp, Homo sapiens
tggccacagca

SEQ ID NO: 5062803 - DNA, 16 bp, Homo sapiens
tggccacagccacctc

SEQ ID NO: 5062804 - DNA, 14 bp, Homo sapiens
tggccacagccagg

SEQ ID NO: 5062805 - DNA, 18 bp, Homo sapiens
tggccacagccaggggag

SEQ ID NO: 5062806 - DNA, 22 bp, Homo sapiens
tggccacagcccatccatagta

SEQ ID NO: 5062807 - DNA, 15 bp, Homo sapiens
tggccacagccccct

SEQ ID NO: 5062808 - DNA, 12 bp, Homo sapiens
tggccacagcct

SEQ ID NO: 5062809 - DNA, 19 bp, Homo sapiens
tggccacagccttccctct

SEQ ID NO: 5062810 - DNA, 18 bp, Homo sapiens
tggccacagcgccagcct

SEQ ID NO: 5062811 - DNA, 17 bp, Homo sapiens
tggccacagcgtgctgg

SEQ ID NO: 5062812 - DNA, 18 bp, Homo sapiens
tggccacagcgtgctggc

SEQ ID NO: 5062813 - DNA, 15 bp, Homo sapiens
tggccacatcagccc

SEQ ID NO: 5062814 - DNA, 19 bp, Homo sapiens
tggccacatcctcatggcc

SEQ ID NO: 5062815 - DNA, 19 bp, Homo sapiens
aaagctgattactgtcaat

SEQ ID NO: 5062816 - DNA, 22 bp, Homo sapiens
aaagctgattactgtcaataaa

SEQ ID NO: 5062817 - DNA, 20 bp, Homo sapiens
aaagctgatttccctttttt

SEQ ID NO: 5062818 - DNA, 20 bp, Homo sapiens
aaagctgcaaaaattatata

SEQ ID NO: 5062819 - DNA, 22 bp, Homo sapiens
aaagctgcccactgtttctctt

SEQ ID NO: 5062820 - DNA, 19 bp, Homo sapiens
aaagctgcctcgtttccct

SEQ ID NO: 5062821 - DNA, 17 bp, Homo sapiens
aaagctgcctgtagtta

SEQ ID NO: 5062822 - DNA, 23 bp, Homo sapiens
aaagctgcctgtagttaggaaat

SEQ ID NO: 5062823 - DNA, 13 bp, Homo sapiens
aaagctgcctgtg

SEQ ID NO: 5062824 - DNA, 20 bp, Homo sapiens
aaagctgcctgtgccatgcc

SEQ ID NO: 5062825 - DNA, 15 bp, Homo sapiens
aaagctgctaaatct

SEQ ID NO: 5062826 - DNA, 14 bp, Homo sapiens
aaagctgctaacta

SEQ ID NO: 5062827 - DNA, 13 bp, Homo sapiens
aaagctgctatcc

SEQ ID NO: 5062828 - DNA, 14 bp, Homo sapiens
aaagctgctatcca

SEQ ID NO: 5062829 - DNA, 21 bp, Homo sapiens
aaagctgctcagggaaaagca

SEQ ID NO: 5062830 - DNA, 23 bp, Homo sapiens
aaagctgctgagaatctagcctc

SEQ ID NO: 5062831 - DNA, 22 bp, Homo sapiens
aaagctgctgggccagtggcac

SEQ ID NO: 5062832 - DNA, 21 bp, Homo sapiens
aaagctgcttgactatcacat

SEQ ID NO: 5062833 - DNA, 19 bp, Homo sapiens
aaagctgctttcttctctg

SEQ ID NO: 5062834 - DNA, 20 bp, Homo sapiens
aaagctgctttcttctctgc

SEQ ID NO: 5062835 - DNA, 16 bp, Homo sapiens
aaagctggaacatttg

SEQ ID NO: 5062836 - DNA, 18 bp, Homo sapiens
aaagctggacaagaagct

SEQ ID NO: 5062837 - DNA, 22 bp, Homo sapiens
aaagctggactgaccaaagact

SEQ ID NO: 5062838 - DNA, 9 bp, Homo sapiens
aaagctggc

SEQ ID NO: 5062839 - DNA, 14 bp, Homo sapiens
aaagctggccctgc

SEQ ID NO: 5062840 - DNA, 19 bp, Homo sapiens
aaagctggtgggtgaaaga

SEQ ID NO: 5062841 - DNA, 16 bp, Homo sapiens
aaagctgtaaattact

SEQ ID NO: 5062842 - DNA, 12 bp, Homo sapiens
aaagctgtacac

SEQ ID NO: 5062843 - DNA, 13 bp, Homo sapiens
aaagctgtacacc

SEQ ID NO: 5062844 - DNA, 19 bp, Homo sapiens
aaagctgtgacagttctgt

SEQ ID NO: 5062845 - DNA, 14 bp, Homo sapiens
aaagctgtgccttt

SEQ ID NO: 5062846 - DNA, 17 bp, Homo sapiens
aaagctgtggctcaaca

SEQ ID NO: 5062847 - DNA, 17 bp, Homo sapiens
aaagctgtgtctctgta

SEQ ID NO: 5062848 - DNA, 18 bp, Homo sapiens
aaagctgtgtctctgtat

SEQ ID NO: 5062849 - DNA, 21 bp, Homo sapiens
aaagctgtgtctctgtatata

SEQ ID NO: 5062850 - DNA, 18 bp, Homo sapiens
aaagctgtgtgtttggaa

SEQ ID NO: 5062851 - DNA, 14 bp, Homo sapiens
aaagctgttaaact

SEQ ID NO: 5062852 - DNA, 15 bp, Homo sapiens
aaagctgttaaactg

SEQ ID NO: 5062853 - DNA, 13 bp, Homo sapiens
aaagctgttcttc

SEQ ID NO: 5062854 - DNA, 14 bp, Homo sapiens
aaagctgttcttcc

SEQ ID NO: 5062855 - DNA, 17 bp, Homo sapiens
aaagctgtttcatttgt

SEQ ID NO: 5062856 - DNA, 20 bp, Homo sapiens
aaagctgtttcatttgtgtc

SEQ ID NO: 5062857 - DNA, 17 bp, Homo sapiens
aaagctgtttctaaaca

SEQ ID NO: 5062858 - DNA, 14 bp, Homo sapiens
aaagctgtttttat

SEQ ID NO: 5062859 - DNA, 15 bp, Homo sapiens
aaagcttaaaacttt

SEQ ID NO: 5062860 - DNA, 15 bp, Homo sapiens
aaagcttaaatgcct

SEQ ID NO: 5062861 - DNA, 15 bp, Homo sapiens
aaagcttaaatttta

SEQ ID NO: 5062862 - DNA, 13 bp, Homo sapiens
aaagcttaataaa

SEQ ID NO: 5062863 - DNA, 23 bp, Homo sapiens
aaagcttacccttggtttgcaca

SEQ ID NO: 5062864 - DNA, 19 bp, Homo sapiens
aaagcttactgtttttgat

SEQ ID NO: 5062865 - DNA, 13 bp, Homo sapiens
aaagcttattaaa

SEQ ID NO: 5062866 - DNA, 12 bp, Homo sapiens
aaagcttatttt

SEQ ID NO: 5062867 - DNA, 17 bp, Homo sapiens
aaagcttattttgtaag

SEQ ID NO: 5062868 - DNA, 16 bp, Homo sapiens
aaagcttatttttatg

SEQ ID NO: 5062869 - DNA, 18 bp, Homo sapiens
aaagcttatttttctgtg

SEQ ID NO: 5062870 - DNA, 13 bp, Homo sapiens
aaagcttccagta

SEQ ID NO: 5062871 - DNA, 17 bp, Homo sapiens
aaagcttccatgattct

SEQ ID NO: 5062872 - DNA, 20 bp, Homo sapiens
aaagcttccatgattctatt

SEQ ID NO: 5062873 - DNA, 16 bp, Homo sapiens
aaagcttccctccctg

SEQ ID NO: 5062874 - DNA, 22 bp, Homo sapiens
aaagcttcgtcttgtgtttgct

SEQ ID NO: 5062875 - DNA, 15 bp, Homo sapiens
aaagcttctctctga

SEQ ID NO: 5062876 - DNA, 16 bp, Homo sapiens
aaagcttctctctgag

SEQ ID NO: 5062877 - DNA, 12 bp, Homo sapiens
aaagcttcttaa

SEQ ID NO: 5062878 - DNA, 23 bp, Homo sapiens
aaagcttcttaattaatttgatt

SEQ ID NO: 5062879 - DNA, 15 bp, Homo sapiens
aaagcttgaaaagat

SEQ ID NO: 5062880 - DNA, 17 bp, Homo sapiens
aaagcttgagtaaaata

SEQ ID NO: 5062881 - DNA, 19 bp, Homo sapiens
aaagcttgagtaaaataaa

SEQ ID NO: 5062882 - DNA, 20 bp, Homo sapiens
aaagcttgatttgatctttg

SEQ ID NO: 5062883 - DNA, 21 bp, Homo sapiens
aaagcttgatttgatctttgt

SEQ ID NO: 5062884 - DNA, 22 bp, Homo sapiens
aaagcttgccactttccagcct

SEQ ID NO: 5062885 - DNA, 20 bp, Homo sapiens
aaagcttggattaaatacat

SEQ ID NO: 5062886 - DNA, 21 bp, Homo sapiens
aaagcttggattaaatacata

SEQ ID NO: 5062887 - DNA, 17 bp, Homo sapiens
aaagcttgtaaatatgg

SEQ ID NO: 5062888 - DNA, 23 bp, Homo sapiens
aaagcttgtgtatcttgattaat

SEQ ID NO: 5062889 - DNA, 19 bp, Homo sapiens
aaagctttagattgaaatt

SEQ ID NO: 5062890 - DNA, 20 bp, Homo sapiens
aaagctttagattgaaattt

SEQ ID NO: 5062891 - DNA, 15 bp, Homo sapiens
aaagctttatctttg

SEQ ID NO: 5062892 - DNA, 19 bp, Homo sapiens
aaagctttatgattttcat

SEQ ID NO: 5062893 - DNA, 17 bp, Homo sapiens
aaagctttcaacatgta

SEQ ID NO: 5062894 - DNA, 23 bp, Homo sapiens
aaagctttcatgtcccagaactt

SEQ ID NO: 5062895 - DNA, 21 bp, Homo sapiens
aaagctttcctgtttccaggg

SEQ ID NO: 5062896 - DNA, 21 bp, Homo sapiens
aaagctttgaaataaaataac

SEQ ID NO: 5062897 - DNA, 19 bp, Homo sapiens
aaagctttgaacaattgtg

SEQ ID NO: 5062898 - DNA, 12 bp, Homo sapiens
aaagctttgcta

SEQ ID NO: 5062899 - DNA, 24 bp, Homo sapiens
aaagctttgctacaaatttatgca

SEQ ID NO: 5062900 - DNA, 19 bp, Homo sapiens
aaagcttttaaaatgtaga

SEQ ID NO: 5062901 - DNA, 23 bp, Homo sapiens
aaagcttttatgagctcatgtag

SEQ ID NO: 5062902 - DNA, 15 bp, Homo sapiens
aaagcttttattcct

SEQ ID NO: 5062903 - DNA, 17 bp, Homo sapiens
aaagcttttattccttt

SEQ ID NO: 5062904 - DNA, 12 bp, Homo sapiens
aaagcttttcag

SEQ ID NO: 5062905 - DNA, 14 bp, Homo sapiens
aaagcttttgcata

SEQ ID NO: 5062906 - DNA, 16 bp, Homo sapiens
aaagcttttgtctaca

SEQ ID NO: 5062907 - DNA, 9 bp, Homo sapiens
aaaggaaaa

SEQ ID NO: 5062908 - DNA, 16 bp, Homo sapiens
aaaggaaaaaaaacac

SEQ ID NO: 5062909 - DNA, 14 bp, Homo sapiens
aaaggaaaaaaaga

SEQ ID NO: 5062910 - DNA, 15 bp, Homo sapiens
aaaggaaaaaaagac

SEQ ID NO: 5062911 - DNA, 12 bp, Homo sapiens
aaaggaaaaaag

SEQ ID NO: 5062912 - DNA, 15 bp, Homo sapiens
aaaggaaaaacaaac

SEQ ID NO: 5062913 - DNA, 21 bp, Homo sapiens
aaaggaaaaacagaacatttc

SEQ ID NO: 5062914 - DNA, 14 bp, Homo sapiens
aaaggaaaaagctc

SEQ ID NO: 5062915 - DNA, 15 bp, Homo sapiens
aaaggaaaaagctcc

SEQ ID NO: 5062916 - DNA, 11 bp, Homo sapiens
aaaggaaaaat

SEQ ID NO: 5062917 - DNA, 18 bp, Homo sapiens
aaaggaaaacacctttat

SEQ ID NO: 5062918 - DNA, 15 bp, Homo sapiens
aaaggaaaacctgaa

SEQ ID NO: 5062919 - DNA, 18 bp, Homo sapiens
aaaggaaaacctgaagac

SEQ ID NO: 5062920 - DNA, 21 bp, Homo sapiens
aaaggaaaactcaccatttca

SEQ ID NO: 5062921 - DNA, 12 bp, Homo sapiens
aaaggaaaagaa

SEQ ID NO: 5062922 - DNA, 17 bp, Homo sapiens
aaaggaaaagaaaaaaa

SEQ ID NO: 5062923 - DNA, 13 bp, Homo sapiens
aaaggaaaagaca

SEQ ID NO: 5062924 - DNA, 11 bp, Homo sapiens
aaaggaaaagt

SEQ ID NO: 5062925 - DNA, 14 bp, Homo sapiens
aaaggaaacctctg

SEQ ID NO: 5062926 - DNA, 14 bp, Homo sapiens
aaaggaaacctttt

SEQ ID NO: 5062927 - DNA, 15 bp, Homo sapiens
aaaggaaagaaaaca

SEQ ID NO: 5062928 - DNA, 17 bp, Homo sapiens
aaaggaaagtgctttcc

SEQ ID NO: 5062929 - DNA, 16 bp, Homo sapiens
aaaggaaatattcttt

SEQ ID NO: 5062930 - DNA, 17 bp, Homo sapiens
aaaggaaatatttttca

SEQ ID NO: 5062931 - DNA, 17 bp, Homo sapiens
aaaggaaatctcacccc

SEQ ID NO: 5062932 - DNA, 23 bp, Homo sapiens
aaaggaaatctcaccccatccca

SEQ ID NO: 5062933 - DNA, 15 bp, Homo sapiens
aaaggaaattagtct

SEQ ID NO: 5062934 - DNA, 19 bp, Homo sapiens
aaaggaaatttgtttgtat

SEQ ID NO: 5062935 - DNA, 22 bp, Homo sapiens
aaaggaacaaaaattacaaaga

SEQ ID NO: 5062936 - DNA, 19 bp, Homo sapiens
aaaggaacacccggaaaga

SEQ ID NO: 5062937 - DNA, 13 bp, Homo sapiens
aaaggaacacgtg

SEQ ID NO: 5062938 - DNA, 19 bp, Homo sapiens
aaaggaacacgtttttaca

SEQ ID NO: 5062939 - DNA, 16 bp, Homo sapiens
aaaggaacactggctt

SEQ ID NO: 5062940 - DNA, 17 bp, Homo sapiens
aaaggaacattgtgtct

SEQ ID NO: 5062941 - DNA, 13 bp, Homo sapiens
aaaggaacatttt

SEQ ID NO: 5062942 - DNA, 14 bp, Homo sapiens
aaaggaactctaga

SEQ ID NO: 5062943 - DNA, 23 bp, Homo sapiens
aaaggaacttgccctgagcactc

SEQ ID NO: 5062944 - DNA, 18 bp, Homo sapiens
aaaggaagactggagaaa

SEQ ID NO: 5062945 - DNA, 15 bp, Homo sapiens
aaaggaagcactctg

SEQ ID NO: 5062946 - DNA, 17 bp, Homo sapiens
aaaggaagcagatacct

SEQ ID NO: 5062947 - DNA, 12 bp, Homo sapiens
aaaggaagccaa

SEQ ID NO: 5062948 - DNA, 13 bp, Homo sapiens
aaaggaagctttc

SEQ ID NO: 5062949 - DNA, 15 bp, Homo sapiens
aaaggaaggaccagg

SEQ ID NO: 5062950 - DNA, 23 bp, Homo sapiens
aaaggaaggttctggtgtgaact

SEQ ID NO: 5062951 - DNA, 17 bp, Homo sapiens
aaaggaagtcaccaaaa

SEQ ID NO: 5062952 - DNA, 22 bp, Homo sapiens
aaaggaagtgaggtagtgccaa

SEQ ID NO: 5062953 - DNA, 13 bp, Homo sapiens
aaaggaatataag

SEQ ID NO: 5062954 - DNA, 22 bp, Homo sapiens
aaaggaatataccacaccgagg

SEQ ID NO: 5062955 - DNA, 17 bp, Homo sapiens
aaaggaatcaattattt

SEQ ID NO: 5062956 - DNA, 13 bp, Homo sapiens
aaaggaatttaaa

SEQ ID NO: 5062957 - DNA, 23 bp, Homo sapiens
aaaggaattttgtaaagtttcta

SEQ ID NO: 5062958 - DNA, 15 bp, Homo sapiens
aaaggacaaacagtg

SEQ ID NO: 5062959 - DNA, 17 bp, Homo sapiens
aaaggacaaacagtgaa

SEQ ID NO: 5062960 - DNA, 22 bp, Homo sapiens
aaaggacaccttttaactcacc

SEQ ID NO: 5062961 - DNA, 21 bp, Homo sapiens
aaaggacacgccgtctgtcct

SEQ ID NO: 5062962 - DNA, 16 bp, Homo sapiens
aaaggacactggatca

SEQ ID NO: 5062963 - DNA, 23 bp, Homo sapiens
aaaggacagagccagcggctcca

SEQ ID NO: 5062964 - DNA, 19 bp, Homo sapiens
aaaggacagagtatgaaca

SEQ ID NO: 5062965 - DNA, 18 bp, Homo sapiens
aaaggacaggcagaaaga

SEQ ID NO: 5062966 - DNA, 14 bp, Homo sapiens
aaaggacataaaat

SEQ ID NO: 5062967 - DNA, 16 bp, Homo sapiens
aaaggacatcagcaaa

SEQ ID NO: 5062968 - DNA, 14 bp, Homo sapiens
aaaggacattatgt

SEQ ID NO: 5062969 - DNA, 21 bp, Homo sapiens
aaaggaccaactggcttctgt

SEQ ID NO: 5062970 - DNA, 16 bp, Homo sapiens
aaaggacccaagtact

SEQ ID NO: 5062971 - DNA, 16 bp, Homo sapiens
aaaggaccctgtttct

SEQ ID NO: 5062972 - DNA, 22 bp, Homo sapiens
aaaggaccgttttgtattgctt

SEQ ID NO: 5062973 - DNA, 23 bp, Homo sapiens
aaaggacctcttctgaagctaga

SEQ ID NO: 5062974 - DNA, 15 bp, Homo sapiens
aaaggacgcctgcag

SEQ ID NO: 5062975 - DNA, 19 bp, Homo sapiens
aaaggacgcctgcaggaga

SEQ ID NO: 5062976 - DNA, 16 bp, Homo sapiens
aaaggacgtaaaattt

SEQ ID NO: 5062977 - DNA, 23 bp, Homo sapiens
aaaggactctggaagattttcat

SEQ ID NO: 5062978 - DNA, 15 bp, Homo sapiens
aaaggactctggggt

SEQ ID NO: 5062979 - DNA, 16 bp, Homo sapiens
aaaggactctggggtt

SEQ ID NO: 5062980 - DNA, 18 bp, Homo sapiens
aaaggactggaaaaatga

SEQ ID NO: 5062981 - DNA, 15 bp, Homo sapiens
aaaggactgtaagca

SEQ ID NO: 5062982 - DNA, 18 bp, Homo sapiens
aaaggagaactgtgctct

SEQ ID NO: 5062983 - DNA, 13 bp, Homo sapiens
aaaggagaagaga

SEQ ID NO: 5062984 - DNA, 13 bp, Homo sapiens
aaaggagaataag

SEQ ID NO: 5062985 - DNA, 15 bp, Homo sapiens
aaaggagaatgaatc

SEQ ID NO: 5062986 - DNA, 16 bp, Homo sapiens
aaaggagacaaagcag

SEQ ID NO: 5062987 - DNA, 14 bp, Homo sapiens
aaaggagacatatc

SEQ ID NO: 5062988 - DNA, 17 bp, Homo sapiens
aaaggagagaagaaagt

SEQ ID NO: 5062989 - DNA, 19 bp, Homo sapiens
aaaggagagaagagagaaa

SEQ ID NO: 5062990 - DNA, 24 bp, Homo sapiens
aaaggagagattattaaatcgttt

SEQ ID NO: 5062991 - DNA, 12 bp, Homo sapiens
aaaggagcctgt

SEQ ID NO: 5062992 - DNA, 22 bp, Homo sapiens
aaaggagctcgaaggatattgt

SEQ ID NO: 5062993 - DNA, 21 bp, Homo sapiens
aaaggagcttacctcccacct

SEQ ID NO: 5062994 - DNA, 12 bp, Homo sapiens
aaagtgaatttg

SEQ ID NO: 5062995 - DNA, 22 bp, Homo sapiens
aaagtgaatttgaatgaaaaat

SEQ ID NO: 5062996 - DNA, 13 bp, Homo sapiens
aaagtgacacagc

SEQ ID NO: 5062997 - DNA, 20 bp, Homo sapiens
aaagtgacagtatctttttt

SEQ ID NO: 5062998 - DNA, 19 bp, Homo sapiens
aaagtgactaatggcatga

SEQ ID NO: 5062999 - DNA, 21 bp, Homo sapiens
aaagtgactttaaaagaaaat

SEQ ID NO: 5063000 - DNA, 19 bp, Homo sapiens
aaagtgagaaagaaagtaa

SEQ ID NO: 5063001 - DNA, 14 bp, Homo sapiens
aaagtgagaaatta

SEQ ID NO: 5063002 - DNA, 23 bp, Homo sapiens
aaagtgagactgacacctcactg

SEQ ID NO: 5063003 - DNA, 14 bp, Homo sapiens
aaagtgagagcacg

SEQ ID NO: 5063004 - DNA, 21 bp, Homo sapiens
aaagtgagatgggaagggctt

SEQ ID NO: 5063005 - DNA, 19 bp, Homo sapiens
aaagtgagcatgctttctg

SEQ ID NO: 5063006 - DNA, 13 bp, Homo sapiens
aaagtgataaatt

SEQ ID NO: 5063007 - DNA, 15 bp, Homo sapiens
aaagtgataatttct

SEQ ID NO: 5063008 - DNA, 21 bp, Homo sapiens
aaagtgataatttctggaatt

SEQ ID NO: 5063009 - DNA, 16 bp, Homo sapiens
aaagtgatcagcaatg

SEQ ID NO: 5063010 - DNA, 20 bp, Homo sapiens
aaagtgatcagcaatgaaga

SEQ ID NO: 5063011 - DNA, 14 bp, Homo sapiens
aaagtgatctgtcc

SEQ ID NO: 5063012 - DNA, 23 bp, Homo sapiens
aaagtgatctgtcccctctcccc

SEQ ID NO: 5063013 - DNA, 15 bp, Homo sapiens
aaagtgatgacatat

SEQ ID NO: 5063014 - DNA, 21 bp, Homo sapiens
aaagtgatgggctttctcttt

SEQ ID NO: 5063015 - DNA, 21 bp, Homo sapiens
aaagtgatgtttgtgtgtttt

SEQ ID NO: 5063016 - DNA, 10 bp, Homo sapiens
aaagtgatta

SEQ ID NO: 5063017 - DNA, 16 bp, Homo sapiens
aaagtgattatctctt

SEQ ID NO: 5063018 - DNA, 15 bp, Homo sapiens
aaagtgattgtgaag

SEQ ID NO: 5063019 - DNA, 22 bp, Homo sapiens
aaagtgattttagcaattaaac

SEQ ID NO: 5063020 - DNA, 12 bp, Homo sapiens
aaagtgcaaagc

SEQ ID NO: 5063021 - DNA, 15 bp, Homo sapiens
aaagtgcaatgcgtg

SEQ ID NO: 5063022 - DNA, 18 bp, Homo sapiens
aaagtgcaattgcacaaa

SEQ ID NO: 5063023 - DNA, 13 bp, Homo sapiens
aaagtgcacacct

SEQ ID NO: 5063024 - DNA, 22 bp, Homo sapiens
aaagtgcacacctttattcaga

SEQ ID NO: 5063025 - DNA, 15 bp, Homo sapiens
aaagtgcactgtgtc

SEQ ID NO: 5063026 - DNA, 11 bp, Homo sapiens
aaagtgcagta

SEQ ID NO: 5063027 - DNA, 18 bp, Homo sapiens
aaagtgcagtcatttgtg

SEQ ID NO: 5063028 - DNA, 18 bp, Homo sapiens
aaagtgcatatttatcca

SEQ ID NO: 5063029 - DNA, 13 bp, Homo sapiens
aaagtgcattatt

SEQ ID NO: 5063030 - DNA, 16 bp, Homo sapiens
aaagtgcattcaacct

SEQ ID NO: 5063031 - DNA, 12 bp, Homo sapiens
aaagtgcattta

SEQ ID NO: 5063032 - DNA, 16 bp, Homo sapiens
aaagtgcatttaagga

SEQ ID NO: 5063033 - DNA, 18 bp, Homo sapiens
aaagtgccaaaataaagt

SEQ ID NO: 5063034 - DNA, 11 bp, Homo sapiens
aaagtgccagc

SEQ ID NO: 5063035 - DNA, 21 bp, Homo sapiens
aaagtgccccttaagggttga

SEQ ID NO: 5063036 - DNA, 20 bp, Homo sapiens
aaagtgcctgagctggggaa

SEQ ID NO: 5063037 - DNA, 17 bp, Homo sapiens
aaagtgccttagcatgt

SEQ ID NO: 5063038 - DNA, 22 bp, Homo sapiens
aaagtgccttatcaaataatat

SEQ ID NO: 5063039 - DNA, 11 bp, Homo sapiens
aaagtgccttc

SEQ ID NO: 5063040 - DNA, 15 bp, Homo sapiens
aaagtgcctttcagg

SEQ ID NO: 5063041 - DNA, 16 bp, Homo sapiens
aaagtgcctttcagga

SEQ ID NO: 5063042 - DNA, 17 bp, Homo sapiens
aaagtgcctttcaggat

SEQ ID NO: 5063043 - DNA, 22 bp, Homo sapiens
aaagtgcctttcaggatctatt

SEQ ID NO: 5063044 - DNA, 12 bp, Homo sapiens
aaagtgcctttg

SEQ ID NO: 5063045 - DNA, 14 bp, Homo sapiens
aaagtgcctttgca

SEQ ID NO: 5063046 - DNA, 16 bp, Homo sapiens
aaagtgcgttctccca

SEQ ID NO: 5063047 - DNA, 16 bp, Homo sapiens
aaagtgctaaggttct

SEQ ID NO: 5063048 - DNA, 12 bp, Homo sapiens
aaagtgctggga

SEQ ID NO: 5063049 - DNA, 13 bp, Homo sapiens
aaagtgctgggat

SEQ ID NO: 5063050 - DNA, 23 bp, Homo sapiens
aaagtgctgggattacagacatg

SEQ ID NO: 5063051 - DNA, 19 bp, Homo sapiens
aaagtgcttagaaagttat

SEQ ID NO: 5063052 - DNA, 21 bp, Homo sapiens
aaagtgcttcaagggtaatct

SEQ ID NO: 5063053 - DNA, 13 bp, Homo sapiens
aaagtgcttgtgt

SEQ ID NO: 5063054 - DNA, 15 bp, Homo sapiens
aaagtgcttgtgtaa

SEQ ID NO: 5063055 - DNA, 17 bp, Homo sapiens
aaagtgcttgtgtaatt

SEQ ID NO: 5063056 - DNA, 21 bp, Homo sapiens
aaagtgctttccagaataata

SEQ ID NO: 5063057 - DNA, 20 bp, Homo sapiens
aaagtggaacgaaaatgaaa

SEQ ID NO: 5063058 - DNA, 14 bp, Homo sapiens
aaagtggaaggaaa

SEQ ID NO: 5063059 - DNA, 16 bp, Homo sapiens
aaagtggaattaaagg

SEQ ID NO: 5063060 - DNA, 18 bp, Homo sapiens
aaagtggaatttcttgtt

SEQ ID NO: 5063061 - DNA, 19 bp, Homo sapiens
aaagtggaatttcttgttt

SEQ ID NO: 5063062 - DNA, 15 bp, Homo sapiens
aaagtggacttctga

SEQ ID NO: 5063063 - DNA, 15 bp, Homo sapiens
aaagtggagctggga

SEQ ID NO: 5063064 - DNA, 18 bp, Homo sapiens
aaagtggattttcctgaa

SEQ ID NO: 5063065 - DNA, 18 bp, Homo sapiens
aaagtggcagagccagga

SEQ ID NO: 5063066 - DNA, 20 bp, Homo sapiens
aaagtggggctaaatgaagt

SEQ ID NO: 5063067 - DNA, 21 bp, Homo sapiens
aaagtggggggtggacacaga

SEQ ID NO: 5063068 - DNA, 18 bp, Homo sapiens
aaagtgggtactttctga

SEQ ID NO: 5063069 - DNA, 22 bp, Homo sapiens
aaagtgggtactttctgaaaat

SEQ ID NO: 5063070 - DNA, 21 bp, Homo sapiens
aaagtgggttcactagagctg

SEQ ID NO: 5063071 - DNA, 17 bp, Homo sapiens
aaagtgggttttttagt

SEQ ID NO: 5063072 - DNA, 22 bp, Homo sapiens
aaagtgggttttttagttgaat

SEQ ID NO: 5063073 - DNA, 13 bp, Homo sapiens
aaagtggtaaata

SEQ ID NO: 5063074 - DNA, 14 bp, Homo sapiens
aaagtggtacttga

SEQ ID NO: 5063075 - DNA, 23 bp, Homo sapiens
aaagtggtacttgatcattttta

SEQ ID NO: 5063076 - DNA, 17 bp, Homo sapiens
aaagtggtatagaaatg

SEQ ID NO: 5063077 - DNA, 20 bp, Homo sapiens
aaagtggtctgaactgcttg

SEQ ID NO: 5063078 - DNA, 18 bp, Homo sapiens
aaagtggttctctgcctt

SEQ ID NO: 5063079 - DNA, 17 bp, Homo sapiens
aaagtggttttgtttgt

SEQ ID NO: 5063080 - DNA, 15 bp, Homo sapiens
aaagtgtaaaataga

SEQ ID NO: 5063081 - DNA, 17 bp, Homo sapiens
aaagtgtaaaatagaat

SEQ ID NO: 5063082 - DNA, 15 bp, Homo sapiens
aaagtgtaaagcatt

SEQ ID NO: 5063083 - DNA, 17 bp, Homo sapiens
aaagtgtaaagcattcc

SEQ ID NO: 5063084 - DNA, 20 bp, Homo sapiens
aaagtgtaaatcctttttct

SEQ ID NO: 5063085 - DNA, 17 bp, Homo sapiens
aaagtgtaacatatgca

SEQ ID NO: 5063086 - DNA, 15 bp, Homo sapiens
aaagtgtaataatat

SEQ ID NO: 5063087 - DNA, 18 bp, Homo sapiens
aaagtgtacaattttcat

SEQ ID NO: 5063088 - DNA, 20 bp, Homo sapiens
aaagtgtacaattttcatcc

SEQ ID NO: 5063089 - DNA, 12 bp, Homo sapiens
aaagtgtacaga

SEQ ID NO: 5063090 - DNA, 13 bp, Homo sapiens
aaagtgtacatga

SEQ ID NO: 5063091 - DNA, 21 bp, Homo sapiens
aaagtgtacatgaagaatgta

SEQ ID NO: 5063092 - DNA, 20 bp, Homo sapiens
aaagtgtacctgtaaatgtc

SEQ ID NO: 5063093 - DNA, 11 bp, Homo sapiens
aaagtgtatta

SEQ ID NO: 5063094 - DNA, 22 bp, Homo sapiens
aaagtgtattagatgtggtttt

SEQ ID NO: 5063095 - DNA, 14 bp, Homo sapiens
aaagtgtatttgga

SEQ ID NO: 5063096 - DNA, 23 bp, Homo sapiens
aaagtgtatttggaaataaagtc

SEQ ID NO: 5063097 - DNA, 15 bp, Homo sapiens
aaagtgtatttgtta

SEQ ID NO: 5063098 - DNA, 20 bp, Homo sapiens
aaagtgtattttataaaatt

SEQ ID NO: 5063099 - DNA, 14 bp, Homo sapiens
aaagtgtatttttt

SEQ ID NO: 5063100 - DNA, 18 bp, Homo sapiens
aaagtgtcaactctttgt

SEQ ID NO: 5063101 - DNA, 20 bp, Homo sapiens
aaagtgtcaccttttcttgc

SEQ ID NO: 5063102 - DNA, 11 bp, Homo sapiens
aaagtgtcatc

SEQ ID NO: 5063103 - DNA, 18 bp, Homo sapiens
aaagtgtcatcaatttgt

SEQ ID NO: 5063104 - DNA, 20 bp, Homo sapiens
aaagtgtcatccaccagtgt

SEQ ID NO: 5063105 - DNA, 21 bp, Homo sapiens
aaagtgtctcaaaggagcttt

SEQ ID NO: 5063106 - DNA, 14 bp, Homo sapiens
aaagtgtctgcagt

SEQ ID NO: 5063107 - DNA, 22 bp, Homo sapiens
aaagtgtctgtaggtacgtttt

SEQ ID NO: 5063108 - DNA, 17 bp, Homo sapiens
aaagtgtcttttgacat

SEQ ID NO: 5063109 - DNA, 21 bp, Homo sapiens
aaagtgtgaaataaatttttt

SEQ ID NO: 5063110 - DNA, 23 bp, Homo sapiens
aaagtgtgaagacccaaaacagc

SEQ ID NO: 5063111 - DNA, 18 bp, Homo sapiens
aaagtgtgagcaaactaa

SEQ ID NO: 5063112 - DNA, 14 bp, Homo sapiens
aaagtgtgctttat

SEQ ID NO: 5063113 - DNA, 16 bp, Homo sapiens
aaagtgtgctttataa

SEQ ID NO: 5063114 - DNA, 17 bp, Homo sapiens
aaagtgtgctttataaa

SEQ ID NO: 5063115 - DNA, 19 bp, Homo sapiens
aaagtgtgctttatgctga

SEQ ID NO: 5063116 - DNA, 22 bp, Homo sapiens
aaagtgtgctttatgctgaaac

SEQ ID NO: 5063117 - DNA, 17 bp, Homo sapiens
aaagtgtggaaagcaaa

SEQ ID NO: 5063118 - DNA, 18 bp, Homo sapiens
aaagtgtgtctgggattt

SEQ ID NO: 5063119 - DNA, 13 bp, Homo sapiens
aaagtgtgtgtgc

SEQ ID NO: 5063120 - DNA, 14 bp, Homo sapiens
aaagtgtgtgtgca

SEQ ID NO: 5063121 - DNA, 16 bp, Homo sapiens
aaagtgtgtgtgttct

SEQ ID NO: 5063122 - DNA, 17 bp, Homo sapiens
aaagtgtgttgttgctt

SEQ ID NO: 5063123 - DNA, 13 bp, Homo sapiens
aaagtgttacttt

SEQ ID NO: 5063124 - DNA, 14 bp, Homo sapiens
aaagtgttactttt

SEQ ID NO: 5063125 - DNA, 20 bp, Homo sapiens
aaagtgttattatttggcat

SEQ ID NO: 5063126 - DNA, 16 bp, Homo sapiens
aaagtgttctgttaca

SEQ ID NO: 5063127 - DNA, 17 bp, Homo sapiens
aaagtgttctgttacaa

SEQ ID NO: 5063128 - DNA, 19 bp, Homo sapiens
aaagtgttgaaaatgtatt

SEQ ID NO: 5063129 - DNA, 16 bp, Homo sapiens
aaagtgttgtgttcct

SEQ ID NO: 5063130 - DNA, 19 bp, Homo sapiens
aaagtgttgtgttcctggc

SEQ ID NO: 5063131 - DNA, 17 bp, Homo sapiens
aaagtgtttatttttca

SEQ ID NO: 5063132 - DNA, 21 bp, Homo sapiens
aaagtgtttatttttcatatt

SEQ ID NO: 5063133 - DNA, 12 bp, Homo sapiens
aaagtgtttcag

SEQ ID NO: 5063134 - DNA, 15 bp, Homo sapiens
aaagtgtttccttca

SEQ ID NO: 5063135 - DNA, 15 bp, Homo sapiens
aaagtgtttctgtta

SEQ ID NO: 5063136 - DNA, 13 bp, Homo sapiens
aaagtgtttgcct

SEQ ID NO: 5063137 - DNA, 10 bp, Homo sapiens
aaagtgtttt

SEQ ID NO: 5063138 - DNA, 11 bp, Homo sapiens
aaagtgttttc

SEQ ID NO: 5063139 - DNA, 23 bp, Homo sapiens
aaagtgttttctctgaacacatt

SEQ ID NO: 5063140 - DNA, 21 bp, Homo sapiens
aaagtgttttgccctatatac

SEQ ID NO: 5063141 - DNA, 14 bp, Homo sapiens
aaagtgtttttaca

SEQ ID NO: 5063142 - DNA, 18 bp, Homo sapiens
aaagtgtttttacatata

SEQ ID NO: 5063143 - DNA, 15 bp, Homo sapiens
aaagttaaaaaaaat

SEQ ID NO: 5063144 - DNA, 20 bp, Homo sapiens
aaagttaaacgtgatgtgct

SEQ ID NO: 5063145 - DNA, 14 bp, Homo sapiens
aaagttaaatgtgt

SEQ ID NO: 5063146 - DNA, 22 bp, Homo sapiens
aaagttaatgcttaagagggaa

SEQ ID NO: 5063147 - DNA, 18 bp, Homo sapiens
aaagttaatgggatggtc

SEQ ID NO: 5063148 - DNA, 16 bp, Homo sapiens
aaagttacaaattcaa

SEQ ID NO: 5063149 - DNA, 19 bp, Homo sapiens
aaagttacagtttgataca

SEQ ID NO: 5063150 - DNA, 22 bp, Homo sapiens
aaagttaccagtgccttaaact

SEQ ID NO: 5063151 - DNA, 17 bp, Homo sapiens
aaagttacccactgaag

SEQ ID NO: 5063152 - DNA, 17 bp, Homo sapiens
aaagttactactgattt

SEQ ID NO: 5063153 - DNA, 21 bp, Homo sapiens
aaagttactaggtaacttcat

SEQ ID NO: 5063154 - DNA, 22 bp, Homo sapiens
aaagttactgattcactgcatg

SEQ ID NO: 5063155 - DNA, 17 bp, Homo sapiens
aaagttactgcaactta

SEQ ID NO: 5063156 - DNA, 16 bp, Homo sapiens
aaagttactgtaaatg

SEQ ID NO: 5063157 - DNA, 19 bp, Homo sapiens
aaagttactgtaaatgcct

SEQ ID NO: 5063158 - DNA, 22 bp, Homo sapiens
aaagttacttgaatttcaaaca

SEQ ID NO: 5063159 - DNA, 20 bp, Homo sapiens
aaagttagaatctattttct

SEQ ID NO: 5063160 - DNA, 20 bp, Homo sapiens
aaagttagagtacagatcct

SEQ ID NO: 5063161 - DNA, 17 bp, Homo sapiens
aaagttagggcattttt

SEQ ID NO: 5063162 - DNA, 24 bp, Homo sapiens
aaagttagggcatttttcttggat

SEQ ID NO: 5063163 - DNA, 16 bp, Homo sapiens
aaagttagggggttct

SEQ ID NO: 5063164 - DNA, 18 bp, Homo sapiens
aaagttagggggttctta

SEQ ID NO: 5063165 - DNA, 17 bp, Homo sapiens
aaagttagtattaaaat

SEQ ID NO: 5063166 - DNA, 20 bp, Homo sapiens
aaagttagtattaaaatcta

SEQ ID NO: 5063167 - DNA, 14 bp, Homo sapiens
aaagttagtctact

SEQ ID NO: 5063168 - DNA, 23 bp, Homo sapiens
aaagttagtctactcttaagcca

SEQ ID NO: 5063169 - DNA, 14 bp, Homo sapiens
aaagttataagaaa

SEQ ID NO: 5063170 - DNA, 14 bp, Homo sapiens
aaagttataataac

SEQ ID NO: 5063171 - DNA, 15 bp, Homo sapiens
aaagttataataact

SEQ ID NO: 5063172 - DNA, 18 bp, Homo sapiens
aaataaaagatagcaata

SEQ ID NO: 5063173 - DNA, 12 bp, Homo sapiens
aaataaaagcac

SEQ ID NO: 5063174 - DNA, 13 bp, Homo sapiens
aaataaaagcaca

SEQ ID NO: 5063175 - DNA, 16 bp, Homo sapiens
aaataaaagcacaagt

SEQ ID NO: 5063176 - DNA, 13 bp, Homo sapiens
aaataaaagcagt

SEQ ID NO: 5063177 - DNA, 14 bp, Homo sapiens
aaataaaagcctct

SEQ ID NO: 5063178 - DNA, 14 bp, Homo sapiens
aaataaaagtataa

SEQ ID NO: 5063179 - DNA, 14 bp, Homo sapiens
aaataaaagtatga

SEQ ID NO: 5063180 - DNA, 13 bp, Homo sapiens
aaataaaataagt

SEQ ID NO: 5063181 - DNA, 13 bp, Homo sapiens
aaataaaatactg

SEQ ID NO: 5063182 - DNA, 20 bp, Homo sapiens
aaataaaatagagtctggaa

SEQ ID NO: 5063183 - DNA, 11 bp, Homo sapiens
aaataaaatat

SEQ ID NO: 5063184 - DNA, 15 bp, Homo sapiens
aaataaaatataatt

SEQ ID NO: 5063185 - DNA, 13 bp, Homo sapiens
aaataaaatatgt

SEQ ID NO: 5063186 - DNA, 17 bp, Homo sapiens
aaataaaatattcactc

SEQ ID NO: 5063187 - DNA, 14 bp, Homo sapiens
aaataaaatatttt

SEQ ID NO: 5063188 - DNA, 14 bp, Homo sapiens
aaataaaatgaaaa

SEQ ID NO: 5063189 - DNA, 21 bp, Homo sapiens
aaataaaatgaaaattgtatt

SEQ ID NO: 5063190 - DNA, 23 bp, Homo sapiens
aaataaaatgaaaattgtattat

SEQ ID NO: 5063191 - DNA, 20 bp, Homo sapiens
aaataaaatgaacatctctt

SEQ ID NO: 5063192 - DNA, 13 bp, Homo sapiens
aaataaaatgatg

SEQ ID NO: 5063193 - DNA, 15 bp, Homo sapiens
aaataaaatgcattt

SEQ ID NO: 5063194 - DNA, 13 bp, Homo sapiens
aaataaaatgcta

SEQ ID NO: 5063195 - DNA, 16 bp, Homo sapiens
aaataaaatgtttaca

SEQ ID NO: 5063196 - DNA, 17 bp, Homo sapiens
aaataaaatgtttacat

SEQ ID NO: 5063197 - DNA, 19 bp, Homo sapiens
aaataaaatgtttacattt

SEQ ID NO: 5063198 - DNA, 21 bp, Homo sapiens
aaataaaatgtttacattttc

SEQ ID NO: 5063199 - DNA, 22 bp, Homo sapiens
aaataaaatgtttacattttct

SEQ ID NO: 5063200 - DNA, 13 bp, Homo sapiens
aaataaaattatg

SEQ ID NO: 5063201 - DNA, 22 bp, Homo sapiens
aaataaaatttaaaaaactcct

SEQ ID NO: 5063202 - DNA, 22 bp, Homo sapiens
aaataaaattttttacttttaa

SEQ ID NO: 5063203 - DNA, 15 bp, Homo sapiens
aaataaacaataaga

SEQ ID NO: 5063204 - DNA, 15 bp, Homo sapiens
aaataaacacgattt

SEQ ID NO: 5063205 - DNA, 16 bp, Homo sapiens
aaataaacactacaga

SEQ ID NO: 5063206 - DNA, 13 bp, Homo sapiens
aaataaacactgt

SEQ ID NO: 5063207 - DNA, 15 bp, Homo sapiens
aaataaacagttgtt

SEQ ID NO: 5063208 - DNA, 18 bp, Homo sapiens
aaataaacatcagtttct

SEQ ID NO: 5063209 - DNA, 12 bp, Homo sapiens
aaataaacattt

SEQ ID NO: 5063210 - DNA, 19 bp, Homo sapiens
aaataaacctataatattt

SEQ ID NO: 5063211 - DNA, 17 bp, Homo sapiens
aaataaacgaaacattt

SEQ ID NO: 5063212 - DNA, 15 bp, Homo sapiens
aaataaacgtcttaa

SEQ ID NO: 5063213 - DNA, 17 bp, Homo sapiens
aaataaacgtcttaaat

SEQ ID NO: 5063214 - DNA, 12 bp, Homo sapiens
aaataaactaga

SEQ ID NO: 5063215 - DNA, 13 bp, Homo sapiens
aaataaactattt

SEQ ID NO: 5063216 - DNA, 19 bp, Homo sapiens
aaataaactatttatatca

SEQ ID NO: 5063217 - DNA, 13 bp, Homo sapiens
aaataaactcttc

SEQ ID NO: 5063218 - DNA, 11 bp, Homo sapiens
aaataaactgt

SEQ ID NO: 5063219 - DNA, 16 bp, Homo sapiens
aaataaactgtaaact

SEQ ID NO: 5063220 - DNA, 16 bp, Homo sapiens
aaataaactgtttata

SEQ ID NO: 5063221 - DNA, 17 bp, Homo sapiens
aaataaactgtttatat

SEQ ID NO: 5063222 - DNA, 14 bp, Homo sapiens
aaataaactgtttt

SEQ ID NO: 5063223 - DNA, 18 bp, Homo sapiens
aaataaactgttttcaag

SEQ ID NO: 5063224 - DNA, 13 bp, Homo sapiens
aaataaacttctt

SEQ ID NO: 5063225 - DNA, 17 bp, Homo sapiens
aaataaactttttttag

SEQ ID NO: 5063226 - DNA, 21 bp, Homo sapiens
aaataaactttttttcaatgt

SEQ ID NO: 5063227 - DNA, 15 bp, Homo sapiens
aaataaagaaaagat

SEQ ID NO: 5063228 - DNA, 13 bp, Homo sapiens
aaataaagactag

SEQ ID NO: 5063229 - DNA, 24 bp, Homo sapiens
aaataaagagttctccttgtactt

SEQ ID NO: 5063230 - DNA, 17 bp, Homo sapiens
aaataaagatcacacat

SEQ ID NO: 5063231 - DNA, 13 bp, Homo sapiens
aaataaagcagtc

SEQ ID NO: 5063232 - DNA, 14 bp, Homo sapiens
aaataaagcctgct

SEQ ID NO: 5063233 - DNA, 20 bp, Homo sapiens
aaataaagcttgcaacaaaa

SEQ ID NO: 5063234 - DNA, 23 bp, Homo sapiens
aaataaaggcgatagctgacttt

SEQ ID NO: 5063235 - DNA, 15 bp, Homo sapiens
aaataaagtatatat

SEQ ID NO: 5063236 - DNA, 16 bp, Homo sapiens
aaataaagtctgtcat

SEQ ID NO: 5063237 - DNA, 15 bp, Homo sapiens
aaataaagttacatt

SEQ ID NO: 5063238 - DNA, 18 bp, Homo sapiens
aaataaagttggtgacag

SEQ ID NO: 5063239 - DNA, 22 bp, Homo sapiens
aaataaagtttcagcggaacac

SEQ ID NO: 5063240 - DNA, 20 bp, Homo sapiens
aaataaagtttgcttagaaa

SEQ ID NO: 5063241 - DNA, 14 bp, Homo sapiens
aaataaagtttgga

SEQ ID NO: 5063242 - DNA, 15 bp, Homo sapiens
aaataaataaacttt

SEQ ID NO: 5063243 - DNA, 14 bp, Homo sapiens
aaataaataatttt

SEQ ID NO: 5063244 - DNA, 17 bp, Homo sapiens
aaataaataattttaat

SEQ ID NO: 5063245 - DNA, 15 bp, Homo sapiens
aaataaatagaaaag

SEQ ID NO: 5063246 - DNA, 16 bp, Homo sapiens
aaataaatagcctctt

SEQ ID NO: 5063247 - DNA, 13 bp, Homo sapiens
aaataaatagctt

SEQ ID NO: 5063248 - DNA, 21 bp, Homo sapiens
aaataaatagggaagatggag

SEQ ID NO: 5063249 - DNA, 13 bp, Homo sapiens
aaataaatatacc

SEQ ID NO: 5063250 - DNA, 14 bp, Homo sapiens
aaataaatatacta

SEQ ID NO: 5063251 - DNA, 13 bp, Homo sapiens
aaataaatatata

SEQ ID NO: 5063252 - DNA, 12 bp, Homo sapiens
aaataaatatca

SEQ ID NO: 5063253 - DNA, 16 bp, Homo sapiens
aaataaatatgaaagt

SEQ ID NO: 5063254 - DNA, 12 bp, Homo sapiens
aaataaatattt

SEQ ID NO: 5063255 - DNA, 13 bp, Homo sapiens
aaataaatatttt

SEQ ID NO: 5063256 - DNA, 15 bp, Homo sapiens
aaataaatcatcttt

SEQ ID NO: 5063257 - DNA, 15 bp, Homo sapiens
aaataaatctatatt

SEQ ID NO: 5063258 - DNA, 20 bp, Homo sapiens
aaataaatcttagtgttcaa

SEQ ID NO: 5063259 - DNA, 20 bp, Homo sapiens
aaataaatgagctatgtatt

SEQ ID NO: 5063260 - DNA, 16 bp, Homo sapiens
aaataaatgctgcttt

SEQ ID NO: 5063261 - DNA, 21 bp, Homo sapiens
aaataaatggtttggtgcttt

SEQ ID NO: 5063262 - DNA, 12 bp, Homo sapiens
aaataaatgtac

SEQ ID NO: 5063263 - DNA, 17 bp, Homo sapiens
aaataaatgtcactgcc

SEQ ID NO: 5063264 - DNA, 13 bp, Homo sapiens
aaataaatgtgca

SEQ ID NO: 5063265 - DNA, 19 bp, Homo sapiens
aaataaatgtttcaaatgc

SEQ ID NO: 5063266 - DNA, 14 bp, Homo sapiens
aaataaatgtttcc

SEQ ID NO: 5063267 - DNA, 14 bp, Homo sapiens
aaataaattagaaa

SEQ ID NO: 5063268 - DNA, 15 bp, Homo sapiens
aaataaattcaaacc

SEQ ID NO: 5063269 - DNA, 14 bp, Homo sapiens
aaataaattcctaa

SEQ ID NO: 5063270 - DNA, 22 bp, Homo sapiens
aaataaattcctacaacttaat

SEQ ID NO: 5063271 - DNA, 17 bp, Homo sapiens
aaataaattctgattct

SEQ ID NO: 5063272 - DNA, 22 bp, Homo sapiens
aaataaattggtgataagtgga

SEQ ID NO: 5063273 - DNA, 23 bp, Homo sapiens
aaataaattggtgataagtggaa

SEQ ID NO: 5063274 - DNA, 20 bp, Homo sapiens
aaataaattgtatattcact

SEQ ID NO: 5063275 - DNA, 21 bp, Homo sapiens
aaataaatttaactttaacca

SEQ ID NO: 5063276 - DNA, 14 bp, Homo sapiens
aaataaatttatat

SEQ ID NO: 5063277 - DNA, 16 bp, Homo sapiens
aaataaatttcccagt

SEQ ID NO: 5063278 - DNA, 22 bp, Homo sapiens
aaataaatttcccagttaaaga

SEQ ID NO: 5063279 - DNA, 14 bp, Homo sapiens
aaataaatttctgg

SEQ ID NO: 5063280 - DNA, 14 bp, Homo sapiens
aaataaattttgtt

SEQ ID NO: 5063281 - DNA, 16 bp, Homo sapiens
aaataaatttttataa

SEQ ID NO: 5063282 - DNA, 20 bp, Homo sapiens
aaataaatttttataaggaa

SEQ ID NO: 5063283 - DNA, 15 bp, Homo sapiens
aaataacaaaatgga

SEQ ID NO: 5063284 - DNA, 12 bp, Homo sapiens
aaataacaacta

SEQ ID NO: 5063285 - DNA, 12 bp, Homo sapiens
aaataacaatga

SEQ ID NO: 5063286 - DNA, 16 bp, Homo sapiens
aaataacaatgttaag

SEQ ID NO: 5063287 - DNA, 19 bp, Homo sapiens
aaataacaatgttaaggaa

SEQ ID NO: 5063288 - DNA, 23 bp, Homo sapiens
aaataacacagagagacagactt

SEQ ID NO: 5063289 - DNA, 13 bp, Homo sapiens
aaataacacagat

SEQ ID NO: 5063290 - DNA, 16 bp, Homo sapiens
aaataacagaagaaaa

SEQ ID NO: 5063291 - DNA, 20 bp, Homo sapiens
aaataacagaattctgaagt

SEQ ID NO: 5063292 - DNA, 12 bp, Homo sapiens
aaataacagtat

SEQ ID NO: 5063293 - DNA, 20 bp, Homo sapiens
aaataacatattcttgcttt

SEQ ID NO: 5063294 - DNA, 22 bp, Homo sapiens
aaataacatcattgtattaacg

SEQ ID NO: 5063295 - DNA, 21 bp, Homo sapiens
aaataacatgtttctctataa

SEQ ID NO: 5063296 - DNA, 22 bp, Homo sapiens
aaataacattgcactttataaa

SEQ ID NO: 5063297 - DNA, 12 bp, Homo sapiens
aaataacatttg

SEQ ID NO: 5063298 - DNA, 12 bp, Homo sapiens
aaataaccacaa

SEQ ID NO: 5063299 - DNA, 13 bp, Homo sapiens
aaataaccctgaa

SEQ ID NO: 5063300 - DNA, 17 bp, Homo sapiens
aaataaccctgggctgt

SEQ ID NO: 5063301 - DNA, 21 bp, Homo sapiens
aaataaccctgggctgtccag

SEQ ID NO: 5063302 - DNA, 23 bp, Homo sapiens
aaataacccttcaacgtttcttc

SEQ ID NO: 5063303 - DNA, 20 bp, Homo sapiens
aaataacctaattaatatat

SEQ ID NO: 5063304 - DNA, 13 bp, Homo sapiens
aaataacctctgg

SEQ ID NO: 5063305 - DNA, 22 bp, Homo sapiens
aaataacctctggcccttggaa

SEQ ID NO: 5063306 - DNA, 22 bp, Homo sapiens
aaataaccttcatcaagaaata

SEQ ID NO: 5063307 - DNA, 14 bp, Homo sapiens
aaataactaaaatg

SEQ ID NO: 5063308 - DNA, 20 bp, Homo sapiens
aaataactatataagacatt

SEQ ID NO: 5063309 - DNA, 22 bp, Homo sapiens
aaataactatataagacattaa

SEQ ID NO: 5063310 - DNA, 14 bp, Homo sapiens
aaataactatcagg

SEQ ID NO: 5063311 - DNA, 17 bp, Homo sapiens
aaataactatcaggcag

SEQ ID NO: 5063312 - DNA, 18 bp, Homo sapiens
aaataactatcaggcaga

SEQ ID NO: 5063313 - DNA, 21 bp, Homo sapiens
aaataactatcaggcagaaga

SEQ ID NO: 5063314 - DNA, 19 bp, Homo sapiens
aaataactattttgtttta

SEQ ID NO: 5063315 - DNA, 21 bp, Homo sapiens
aaataactattttgttttaat

SEQ ID NO: 5063316 - DNA, 18 bp, Homo sapiens
aaataactgaaccaaatt

SEQ ID NO: 5063317 - DNA, 15 bp, Homo sapiens
aaataactgaatttg

SEQ ID NO: 5063318 - DNA, 22 bp, Homo sapiens
aaataactgatctcaagtatat

SEQ ID NO: 5063319 - DNA, 16 bp, Homo sapiens
aaataactggaaaaca

SEQ ID NO: 5063320 - DNA, 20 bp, Homo sapiens
aaataactggaaaacagaac

SEQ ID NO: 5063321 - DNA, 21 bp, Homo sapiens
aaataactggaggaattttct

SEQ ID NO: 5063322 - DNA, 16 bp, Homo sapiens
aaataactgtaattat

SEQ ID NO: 5063323 - DNA, 15 bp, Homo sapiens
aaataacttcaagca

SEQ ID NO: 5063324 - DNA, 16 bp, Homo sapiens
aaataacttcaagcaa

SEQ ID NO: 5063325 - DNA, 23 bp, Homo sapiens
aaataacttcattgtttggacct

SEQ ID NO: 5063326 - DNA, 15 bp, Homo sapiens
aaataacttgtgtta

SEQ ID NO: 5063327 - DNA, 14 bp, Homo sapiens
aaataagaaaccta

SEQ ID NO: 5063328 - DNA, 15 bp, Homo sapiens
aaataagaaactttt

SEQ ID NO: 5063329 - DNA, 14 bp, Homo sapiens
aaataagaaataat

SEQ ID NO: 5063330 - DNA, 15 bp, Homo sapiens
aaataagaagaatgc

SEQ ID NO: 5063331 - DNA, 20 bp, Homo sapiens
aaataagaagggggagtgaa

SEQ ID NO: 5063332 - DNA, 21 bp, Homo sapiens
aaataagaagggggagtgaaa

SEQ ID NO: 5063333 - DNA, 14 bp, Homo sapiens
aaataagaatagaa

SEQ ID NO: 5063334 - DNA, 17 bp, Homo sapiens
aaataagaatagaaata

SEQ ID NO: 5063335 - DNA, 23 bp, Homo sapiens
aaataagaattaggtttctttga

SEQ ID NO: 5063336 - DNA, 19 bp, Homo sapiens
aaataagacaaaaataata

SEQ ID NO: 5063337 - DNA, 12 bp, Homo sapiens
aaataagagatt

SEQ ID NO: 5063338 - DNA, 17 bp, Homo sapiens
aaataagagctcaggat

SEQ ID NO: 5063339 - DNA, 12 bp, Homo sapiens
aaataagattct

SEQ ID NO: 5063340 - DNA, 14 bp, Homo sapiens
aaataagattctaa

SEQ ID NO: 5063341 - DNA, 15 bp, Homo sapiens
aaataagattctaac

SEQ ID NO: 5063342 - DNA, 15 bp, Homo sapiens
aaataagcaggtgga

SEQ ID NO: 5063343 - DNA, 22 bp, Homo sapiens
aaataagctatttgatgtaata

SEQ ID NO: 5063344 - DNA, 22 bp, Homo sapiens
aaataaggaagagggctgagct

SEQ ID NO: 5063345 - DNA, 15 bp, Homo sapiens
aaataaggaatttcc

SEQ ID NO: 5063346 - DNA, 17 bp, Homo sapiens
aaataaggaatttcctc

SEQ ID NO: 5063347 - DNA, 14 bp, Homo sapiens
aaataaggacacaa

SEQ ID NO: 5063348 - DNA, 22 bp, Homo sapiens
aaataaggatttttctcttatt

SEQ ID NO: 5063349 - DNA, 16 bp, Homo sapiens
aaataaggtaaaattt

SEQ ID NO: 5063350 - DNA, 16 bp, Homo sapiens
aaataaggtgtattgc

SEQ ID NO: 5063351 - DNA, 19 bp, Homo sapiens
aaataaggttatgattgaa

SEQ ID NO: 5063352 - DNA, 15 bp, Homo sapiens
aaataagtaacatat

SEQ ID NO: 5063353 - DNA, 20 bp, Homo sapiens
agaattgttagatggcaata

SEQ ID NO: 5063354 - DNA, 17 bp, Homo sapiens
agaattgttgagatact

SEQ ID NO: 5063355 - DNA, 21 bp, Homo sapiens
agaattgttgggggttttttt

SEQ ID NO: 5063356 - DNA, 23 bp, Homo sapiens
agaattgttgggggtttttttgg

SEQ ID NO: 5063357 - DNA, 14 bp, Homo sapiens
agaattgtttagat

SEQ ID NO: 5063358 - DNA, 13 bp, Homo sapiens
agaatttaaagaa

SEQ ID NO: 5063359 - DNA, 22 bp, Homo sapiens
agaatttaaattctttttcaaa

SEQ ID NO: 5063360 - DNA, 17 bp, Homo sapiens
agaatttaccagaaata

SEQ ID NO: 5063361 - DNA, 14 bp, Homo sapiens
agaatttagatctt

SEQ ID NO: 5063362 - DNA, 14 bp, Homo sapiens
agaatttagtatta

SEQ ID NO: 5063363 - DNA, 23 bp, Homo sapiens
agaatttagtttgtactcagtgg

SEQ ID NO: 5063364 - DNA, 20 bp, Homo sapiens
agaatttatccctttacaat

SEQ ID NO: 5063365 - DNA, 11 bp, Homo sapiens
agaatttatta

SEQ ID NO: 5063366 - DNA, 18 bp, Homo sapiens
agaatttattagtttaaa

SEQ ID NO: 5063367 - DNA, 20 bp, Homo sapiens
agaatttcaatttgttcagt

SEQ ID NO: 5063368 - DNA, 17 bp, Homo sapiens
agaatttcactgtcttt

SEQ ID NO: 5063369 - DNA, 23 bp, Homo sapiens
agaatttcccaaagcagtgcatg

SEQ ID NO: 5063370 - DNA, 16 bp, Homo sapiens
agaatttcctaatgag

SEQ ID NO: 5063371 - DNA, 17 bp, Homo sapiens
agaatttcctgtaatat

SEQ ID NO: 5063372 - DNA, 23 bp, Homo sapiens
agaatttcctgtaatatatttat

SEQ ID NO: 5063373 - DNA, 17 bp, Homo sapiens
agaatttctaaaaagat

SEQ ID NO: 5063374 - DNA, 14 bp, Homo sapiens
agaatttctaagaa

SEQ ID NO: 5063375 - DNA, 20 bp, Homo sapiens
agaatttctaccatttcaga

SEQ ID NO: 5063376 - DNA, 13 bp, Homo sapiens
agaatttctagga

SEQ ID NO: 5063377 - DNA, 21 bp, Homo sapiens
agaatttgaaagtttccttat

SEQ ID NO: 5063378 - DNA, 19 bp, Homo sapiens
agaatttgaagacttcaaa

SEQ ID NO: 5063379 - DNA, 14 bp, Homo sapiens
agaatttgaatatt

SEQ ID NO: 5063380 - DNA, 18 bp, Homo sapiens
agaatttgatatgtgaac

SEQ ID NO: 5063381 - DNA, 19 bp, Homo sapiens
agaatttgatatgtgaaca

SEQ ID NO: 5063382 - DNA, 22 bp, Homo sapiens
agaatttggaaatcctagtttc

SEQ ID NO: 5063383 - DNA, 19 bp, Homo sapiens
agaatttggcccagagagg

SEQ ID NO: 5063384 - DNA, 19 bp, Homo sapiens
agaatttgtattttgctta

SEQ ID NO: 5063385 - DNA, 19 bp, Homo sapiens
agaatttgtgaatatattt

SEQ ID NO: 5063386 - DNA, 15 bp, Homo sapiens
agaatttgtgttgaa

SEQ ID NO: 5063387 - DNA, 19 bp, Homo sapiens
agaatttgtgttgaaggaa

SEQ ID NO: 5063388 - DNA, 14 bp, Homo sapiens
agaatttgttcttg

SEQ ID NO: 5063389 - DNA, 18 bp, Homo sapiens
agaattttaaaaaagatg

SEQ ID NO: 5063390 - DNA, 21 bp, Homo sapiens
agaattttaaaaaagatggat

SEQ ID NO: 5063391 - DNA, 14 bp, Homo sapiens
agaattttaaaaat

SEQ ID NO: 5063392 - DNA, 17 bp, Homo sapiens
agaattttaaaaatgaa

SEQ ID NO: 5063393 - DNA, 18 bp, Homo sapiens
agaattttaaaaatgaat

SEQ ID NO: 5063394 - DNA, 16 bp, Homo sapiens
agaattttaagtgctt

SEQ ID NO: 5063395 - DNA, 19 bp, Homo sapiens
agaattttaatgtgaagac

SEQ ID NO: 5063396 - DNA, 19 bp, Homo sapiens
agaattttacttccattat

SEQ ID NO: 5063397 - DNA, 17 bp, Homo sapiens
agaattttagaagagat

SEQ ID NO: 5063398 - DNA, 14 bp, Homo sapiens
agaattttaggaac

SEQ ID NO: 5063399 - DNA, 22 bp, Homo sapiens
agaattttaggaacttcagaga

SEQ ID NO: 5063400 - DNA, 21 bp, Homo sapiens
agaattttatttataaatgag

SEQ ID NO: 5063401 - DNA, 21 bp, Homo sapiens
agaattttcagaccccagcgg

SEQ ID NO: 5063402 - DNA, 18 bp, Homo sapiens
agaattttggaaaaatgt

SEQ ID NO: 5063403 - DNA, 22 bp, Homo sapiens
agaattttggaaaaatgtcact

SEQ ID NO: 5063404 - DNA, 12 bp, Homo sapiens
agaattttgtat

SEQ ID NO: 5063405 - DNA, 19 bp, Homo sapiens
agaattttgttggtctgaa

SEQ ID NO: 5063406 - DNA, 22 bp, Homo sapiens
agaatttttaactgtactgaat

SEQ ID NO: 5063407 - DNA, 21 bp, Homo sapiens
agaatttttaatgacttttta

SEQ ID NO: 5063408 - DNA, 11 bp, Homo sapiens
agaatttttgc

SEQ ID NO: 5063409 - DNA, 21 bp, Homo sapiens
agaattttttctttgtattta

SEQ ID NO: 5063410 - DNA, 15 bp, Homo sapiens
agaatttttttgtct

SEQ ID NO: 5063411 - DNA, 23 bp, Homo sapiens
agaatttttttttaaattttatt

SEQ ID NO: 5063412 - DNA, 13 bp, Homo sapiens
agacaaaaacaag

SEQ ID NO: 5063413 - DNA, 17 bp, Homo sapiens
agacaaaaacagcctca

SEQ ID NO: 5063414 - DNA, 15 bp, Homo sapiens
agacaaaaagacaaa

SEQ ID NO: 5063415 - DNA, 14 bp, Homo sapiens
agacaaaaagtata

SEQ ID NO: 5063416 - DNA, 19 bp, Homo sapiens
agacaaaaagtatattaaa

SEQ ID NO: 5063417 - DNA, 14 bp, Homo sapiens
agacaaaaatactc

SEQ ID NO: 5063418 - DNA, 23 bp, Homo sapiens
agacaaaaatactctaattctaa

SEQ ID NO: 5063419 - DNA, 19 bp, Homo sapiens
agacaaaaatatcaatggt

SEQ ID NO: 5063420 - DNA, 15 bp, Homo sapiens
agacaaaacagataa

SEQ ID NO: 5063421 - DNA, 19 bp, Homo sapiens
agacaaaacatacattttg

SEQ ID NO: 5063422 - DNA, 13 bp, Homo sapiens
agacaaaaccaaa

SEQ ID NO: 5063423 - DNA, 17 bp, Homo sapiens
agacaaaacgagtcttt

SEQ ID NO: 5063424 - DNA, 15 bp, Homo sapiens
agacaaaacttataa

SEQ ID NO: 5063425 - DNA, 22 bp, Homo sapiens
agacaaaacttataatttccaa

SEQ ID NO: 5063426 - DNA, 12 bp, Homo sapiens
agacaaaagaaa

SEQ ID NO: 5063427 - DNA, 14 bp, Homo sapiens
agacaaaagaaaaa

SEQ ID NO: 5063428 - DNA, 15 bp, Homo sapiens
agacaaaagaaactt

SEQ ID NO: 5063429 - DNA, 17 bp, Homo sapiens
agacaaaagaaacttac

SEQ ID NO: 5063430 - DNA, 15 bp, Homo sapiens
agacaaaagagcagt

SEQ ID NO: 5063431 - DNA, 15 bp, Homo sapiens
agacaaaaggaaagg

SEQ ID NO: 5063432 - DNA, 13 bp, Homo sapiens
agacaaaatcaaa

SEQ ID NO: 5063433 - DNA, 16 bp, Homo sapiens
agacaaaatggataca

SEQ ID NO: 5063434 - DNA, 14 bp, Homo sapiens
agacaaaatgtttt

SEQ ID NO: 5063435 - DNA, 22 bp, Homo sapiens
agacaaaattgtaagccagagt

SEQ ID NO: 5063436 - DNA, 16 bp, Homo sapiens
agacaaaatttagatt

SEQ ID NO: 5063437 - DNA, 15 bp, Homo sapiens
agacaaaatttgaga

SEQ ID NO: 5063438 - DNA, 16 bp, Homo sapiens
agacaaaatttgagaa

SEQ ID NO: 5063439 - DNA, 18 bp, Homo sapiens
agacaaaatttgagaata

SEQ ID NO: 5063440 - DNA, 20 bp, Homo sapiens
agacaaacagcccttccttg

SEQ ID NO: 5063441 - DNA, 21 bp, Homo sapiens
agacaaacagcccttccttgg

SEQ ID NO: 5063442 - DNA, 16 bp, Homo sapiens
agacaaaccagaagca

SEQ ID NO: 5063443 - DNA, 19 bp, Homo sapiens
agacaaaccttaaaacagc

SEQ ID NO: 5063444 - DNA, 21 bp, Homo sapiens
agacaaactttgcatctcagt

SEQ ID NO: 5063445 - DNA, 16 bp, Homo sapiens
agacaaagaaggaaaa

SEQ ID NO: 5063446 - DNA, 15 bp, Homo sapiens
agacaaagcaggagt

SEQ ID NO: 5063447 - DNA, 13 bp, Homo sapiens
agacaaagccctg

SEQ ID NO: 5063448 - DNA, 19 bp, Homo sapiens
agacaaagcggctttctaa

SEQ ID NO: 5063449 - DNA, 14 bp, Homo sapiens
agacaaaggcccag

SEQ ID NO: 5063450 - DNA, 18 bp, Homo sapiens
agacaaaggttttcctct

SEQ ID NO: 5063451 - DNA, 23 bp, Homo sapiens
agacaaagtcccagaattgtatc

SEQ ID NO: 5063452 - DNA, 16 bp, Homo sapiens
agacaaatacacatac

SEQ ID NO: 5063453 - DNA, 17 bp, Homo sapiens
agacaaatacacataca

SEQ ID NO: 5063454 - DNA, 18 bp, Homo sapiens
agacaaatactcatgtgt

SEQ ID NO: 5063455 - DNA, 12 bp, Homo sapiens
agacaaatattt

SEQ ID NO: 5063456 - DNA, 17 bp, Homo sapiens
agacaaatcaacagaag

SEQ ID NO: 5063457 - DNA, 23 bp, Homo sapiens
agacaaatcctttctgcccccca

SEQ ID NO: 5063458 - DNA, 18 bp, Homo sapiens
agacaaatctcagaacct

SEQ ID NO: 5063459 - DNA, 23 bp, Homo sapiens
agacaaatctttaagaatagttc

SEQ ID NO: 5063460 - DNA, 19 bp, Homo sapiens
agacaaatgcagtgtattt

SEQ ID NO: 5063461 - DNA, 18 bp, Homo sapiens
agacaaatgctgcgccct

SEQ ID NO: 5063462 - DNA, 16 bp, Homo sapiens
agacaaatgggactga

SEQ ID NO: 5063463 - DNA, 19 bp, Homo sapiens
agacaaatgggactgatgt

SEQ ID NO: 5063464 - DNA, 23 bp, Homo sapiens
agacaaattactgataaaaatga

SEQ ID NO: 5063465 - DNA, 17 bp, Homo sapiens
agacaaattctgtttct

SEQ ID NO: 5063466 - DNA, 13 bp, Homo sapiens
agacaacaaaaga

SEQ ID NO: 5063467 - DNA, 16 bp, Homo sapiens
agacaacaaaagaaat

SEQ ID NO: 5063468 - DNA, 14 bp, Homo sapiens
agacaacagaagtc

SEQ ID NO: 5063469 - DNA, 16 bp, Homo sapiens
agacaacagcacacag

SEQ ID NO: 5063470 - DNA, 15 bp, Homo sapiens
agacaacagcccagg

SEQ ID NO: 5063471 - DNA, 14 bp, Homo sapiens
agacaacaggcatt

SEQ ID NO: 5063472 - DNA, 15 bp, Homo sapiens
agacaacaggcattt

SEQ ID NO: 5063473 - DNA, 18 bp, Homo sapiens
agacaacaggcattttct

SEQ ID NO: 5063474 - DNA, 17 bp, Homo sapiens
agacaacatcttaaatc

SEQ ID NO: 5063475 - DNA, 19 bp, Homo sapiens
agacaacattatgatctaa

SEQ ID NO: 5063476 - DNA, 21 bp, Homo sapiens
agacaacattatgatctaata

SEQ ID NO: 5063477 - DNA, 13 bp, Homo sapiens
agacaaccaaaac

SEQ ID NO: 5063478 - DNA, 16 bp, Homo sapiens
agacaaccaaaacata

SEQ ID NO: 5063479 - DNA, 15 bp, Homo sapiens
agacaaccaagtatg

SEQ ID NO: 5063480 - DNA, 18 bp, Homo sapiens
agacaaccatagaactgt

SEQ ID NO: 5063481 - DNA, 20 bp, Homo sapiens
agacaaccctgcaaaggact

SEQ ID NO: 5063482 - DNA, 15 bp, Homo sapiens
agacaacctttctgt

SEQ ID NO: 5063483 - DNA, 12 bp, Homo sapiens
agacaactagat

SEQ ID NO: 5063484 - DNA, 17 bp, Homo sapiens
agacaactagatttgtc

SEQ ID NO: 5063485 - DNA, 18 bp, Homo sapiens
agacaactagatttgtcc

SEQ ID NO: 5063486 - DNA, 20 bp, Homo sapiens
agacaactcttccatttatt

SEQ ID NO: 5063487 - DNA, 19 bp, Homo sapiens
agacaactggtctgttaat

SEQ ID NO: 5063488 - DNA, 16 bp, Homo sapiens
agacaacttgctcctt

SEQ ID NO: 5063489 - DNA, 19 bp, Homo sapiens
agacaacttgctcctttcc

SEQ ID NO: 5063490 - DNA, 19 bp, Homo sapiens
agacaagacttcagtatgt

SEQ ID NO: 5063491 - DNA, 21 bp, Homo sapiens
agacaagacttcagtatgttg

SEQ ID NO: 5063492 - DNA, 19 bp, Homo sapiens
agacaagagatctacacat

SEQ ID NO: 5063493 - DNA, 20 bp, Homo sapiens
agacaagagatctacacatg

SEQ ID NO: 5063494 - DNA, 24 bp, Homo sapiens
agacaagagatctacacatgttgc

SEQ ID NO: 5063495 - DNA, 15 bp, Homo sapiens
agacaagagatggga

SEQ ID NO: 5063496 - DNA, 13 bp, Homo sapiens
agacaagagctgc

SEQ ID NO: 5063497 - DNA, 14 bp, Homo sapiens
agacaagagctgct

SEQ ID NO: 5063498 - DNA, 15 bp, Homo sapiens
agacaagagctgtta

SEQ ID NO: 5063499 - DNA, 20 bp, Homo sapiens
agacaagagctgttatgctg

SEQ ID NO: 5063500 - DNA, 23 bp, Homo sapiens
agacaagagctgttatgctgttt

SEQ ID NO: 5063501 - DNA, 15 bp, Homo sapiens
agacaagatattgta

SEQ ID NO: 5063502 - DNA, 16 bp, Homo sapiens
agacaagatattgtac

SEQ ID NO: 5063503 - DNA, 17 bp, Homo sapiens
agacaagatattgtaca

SEQ ID NO: 5063504 - DNA, 16 bp, Homo sapiens
agacaagcactatttt

SEQ ID NO: 5063505 - DNA, 15 bp, Homo sapiens
agacaagcagccctt

SEQ ID NO: 5063506 - DNA, 16 bp, Homo sapiens
agacaagcagcccttg

SEQ ID NO: 5063507 - DNA, 14 bp, Homo sapiens
agacaagcattggg

SEQ ID NO: 5063508 - DNA, 19 bp, Homo sapiens
agacaagcattgggtcaga

SEQ ID NO: 5063509 - DNA, 15 bp, Homo sapiens
agacaagccctggca

SEQ ID NO: 5063510 - DNA, 16 bp, Homo sapiens
agacaagccctggcaa

SEQ ID NO: 5063511 - DNA, 17 bp, Homo sapiens
agacaagccctggcaac

SEQ ID NO: 5063512 - DNA, 10 bp, Homo sapiens
agacaagcct

SEQ ID NO: 5063513 - DNA, 17 bp, Homo sapiens
agacaagctcctccctt

SEQ ID NO: 5063514 - DNA, 18 bp, Homo sapiens
agacaagctgttgaccag

SEQ ID NO: 5063515 - DNA, 19 bp, Homo sapiens
agacaaggaaaaaataaca

SEQ ID NO: 5063516 - DNA, 13 bp, Homo sapiens
agacaaggaaata

SEQ ID NO: 5063517 - DNA, 16 bp, Homo sapiens
agacaaggtagccctg

SEQ ID NO: 5063518 - DNA, 16 bp, Homo sapiens
agacaaggttgctgtt

SEQ ID NO: 5063519 - DNA, 19 bp, Homo sapiens
agacaagtaatcactaacc

SEQ ID NO: 5063520 - DNA, 22 bp, Homo sapiens
agacaagtaatttcagtgtaaa

SEQ ID NO: 5063521 - DNA, 19 bp, Homo sapiens
agacaagtatgaatattac

SEQ ID NO: 5063522 - DNA, 18 bp, Homo sapiens
agacaagtctgagtagtt

SEQ ID NO: 5063523 - DNA, 19 bp, Homo sapiens
agacaagtcttgctgtgct

SEQ ID NO: 5063524 - DNA, 22 bp, Homo sapiens
agacaagtcttgctgtgcttta

SEQ ID NO: 5063525 - DNA, 20 bp, Homo sapiens
agacaagtgactgtatctgt

SEQ ID NO: 5063526 - DNA, 22 bp, Homo sapiens
agacaagtgactgtatctgtgt

SEQ ID NO: 5063527 - DNA, 14 bp, Homo sapiens
agacaagtgatttt

SEQ ID NO: 5063528 - DNA, 22 bp, Homo sapiens
agacaagtgtttattaaaatac

SEQ ID NO: 5063529 - DNA, 16 bp, Homo sapiens
agacaataaaacattc

SEQ ID NO: 5063530 - DNA, 15 bp, Homo sapiens
agacaataattctac

SEQ ID NO: 5063531 - DNA, 16 bp, Homo sapiens
agaccaccacttcgaa

SEQ ID NO: 5063532 - DNA, 22 bp, Homo sapiens
agaccaccagccgccccagccc

SEQ ID NO: 5063533 - DNA, 11 bp, Homo sapiens
agaccaccagg

SEQ ID NO: 5063534 - DNA, 14 bp, Homo sapiens
agaccaccagggca

SEQ ID NO: 5063535 - DNA, 23 bp, Homo sapiens
agaccaccagggcatctctgggc

SEQ ID NO: 5063536 - DNA, 14 bp, Homo sapiens
agaccaccagggtc

SEQ ID NO: 5063537 - DNA, 21 bp, Homo sapiens
agaccaccagggtcccaggaa

SEQ ID NO: 5063538 - DNA, 23 bp, Homo sapiens
agaccaccagggtcccaggaagc

SEQ ID NO: 5063539 - DNA, 17 bp, Homo sapiens
agaccaccatccaccgc

SEQ ID NO: 5063540 - DNA, 21 bp, Homo sapiens
agaccacccaacctcaccctc

SEQ ID NO: 5063541 - DNA, 17 bp, Homo sapiens
agaccacccatatcatg

SEQ ID NO: 5063542 - DNA, 21 bp, Homo sapiens
agaccacccccgagcttgcct

SEQ ID NO: 5063543 - DNA, 14 bp, Homo sapiens
agaccaccccgcct

SEQ ID NO: 5063544 - DNA, 22 bp, Homo sapiens
agaccacccggcattctctgcc

SEQ ID NO: 5063545 - DNA, 17 bp, Homo sapiens
agaccaccgcgcccctc

SEQ ID NO: 5063546 - DNA, 20 bp, Homo sapiens
agaccaccgcgcccctctgc

SEQ ID NO: 5063547 - DNA, 11 bp, Homo sapiens
agaccacctcc

SEQ ID NO: 5063548 - DNA, 12 bp, Homo sapiens
agaccacctcca

SEQ ID NO: 5063549 - DNA, 14 bp, Homo sapiens
agaccacctccctg

SEQ ID NO: 5063550 - DNA, 22 bp, Homo sapiens
agaccacctccctgccctgtcc

SEQ ID NO: 5063551 - DNA, 17 bp, Homo sapiens
agaccacctctcaatat

SEQ ID NO: 5063552 - DNA, 12 bp, Homo sapiens
agaccacctgcc

SEQ ID NO: 5063553 - DNA, 19 bp, Homo sapiens
agaccacctgccagccatc

SEQ ID NO: 5063554 - DNA, 20 bp, Homo sapiens
agaccacctgccagccatca

SEQ ID NO: 5063555 - DNA, 22 bp, Homo sapiens
agaccacctgcttctgaactca

SEQ ID NO: 5063556 - DNA, 14 bp, Homo sapiens
agaccaccttccct

SEQ ID NO: 5063557 - DNA, 19 bp, Homo sapiens
agaccacgcccctgcctga

SEQ ID NO: 5063558 - DNA, 14 bp, Homo sapiens
agaccacgtttcta

SEQ ID NO: 5063559 - DNA, 15 bp, Homo sapiens
agaccacgtttctaa

SEQ ID NO: 5063560 - DNA, 22 bp, Homo sapiens
agaccactgagtaccaggggct

SEQ ID NO: 5063561 - DNA, 18 bp, Homo sapiens
agaccactgtcctggctg

SEQ ID NO: 5063562 - DNA, 20 bp, Homo sapiens
agaccactgtcctggctgct

SEQ ID NO: 5063563 - DNA, 14 bp, Homo sapiens
agaccacttcctta

SEQ ID NO: 5063564 - DNA, 16 bp, Homo sapiens
agaccacttccttaac

SEQ ID NO: 5063565 - DNA, 21 bp, Homo sapiens
agaccagaacagcatggcccg

SEQ ID NO: 5063566 - DNA, 19 bp, Homo sapiens
agaccagaagtgaatggga

SEQ ID NO: 5063567 - DNA, 19 bp, Homo sapiens
agaccagaattcccttgaa

SEQ ID NO: 5063568 - DNA, 23 bp, Homo sapiens
agaccagaattcccttgaattgt

SEQ ID NO: 5063569 - DNA, 17 bp, Homo sapiens
agaccagagcagtctga

SEQ ID NO: 5063570 - DNA, 14 bp, Homo sapiens
agaccagagctctg

SEQ ID NO: 5063571 - DNA, 19 bp, Homo sapiens
agaccagagctctggagcc

SEQ ID NO: 5063572 - DNA, 16 bp, Homo sapiens
agaccagcactcagcc

SEQ ID NO: 5063573 - DNA, 20 bp, Homo sapiens
agaccagcagacagagccag

SEQ ID NO: 5063574 - DNA, 21 bp, Homo sapiens
agaccagcagacagagccagg

SEQ ID NO: 5063575 - DNA, 19 bp, Homo sapiens
agaccagcagcaatctgtc

SEQ ID NO: 5063576 - DNA, 18 bp, Homo sapiens
agaccagcatagttctgc

SEQ ID NO: 5063577 - DNA, 13 bp, Homo sapiens
agaccagcctcgc

SEQ ID NO: 5063578 - DNA, 12 bp, Homo sapiens
agaccagcctga

SEQ ID NO: 5063579 - DNA, 13 bp, Homo sapiens
agaccagcctgcc

SEQ ID NO: 5063580 - DNA, 20 bp, Homo sapiens
agaccagcctgccaggccct

SEQ ID NO: 5063581 - DNA, 13 bp, Homo sapiens
agaccagcctggg

SEQ ID NO: 5063582 - DNA, 17 bp, Homo sapiens
agaccagcctttcttcc

SEQ ID NO: 5063583 - DNA, 23 bp, Homo sapiens
agaccaggactctgccttccagg

SEQ ID NO: 5063584 - DNA, 11 bp, Homo sapiens
agaccaggagg

SEQ ID NO: 5063585 - DNA, 23 bp, Homo sapiens
agaccaggagggagagcctctgt

SEQ ID NO: 5063586 - DNA, 19 bp, Homo sapiens
agaccaggcaggcaaaggc

SEQ ID NO: 5063587 - DNA, 12 bp, Homo sapiens
agaccaggctgg

SEQ ID NO: 5063588 - DNA, 15 bp, Homo sapiens
agaccaggctgtgtc

SEQ ID NO: 5063589 - DNA, 15 bp, Homo sapiens
agaccagggagcctt

SEQ ID NO: 5063590 - DNA, 16 bp, Homo sapiens
agaccagggctccagc

SEQ ID NO: 5063591 - DNA, 23 bp, Homo sapiens
agaccagggctgctctttccact

SEQ ID NO: 5063592 - DNA, 22 bp, Homo sapiens
agaccaggggaccagagggatg

SEQ ID NO: 5063593 - DNA, 16 bp, Homo sapiens
agaccagggtggccac

SEQ ID NO: 5063594 - DNA, 18 bp, Homo sapiens
agaccagggtggccacac

SEQ ID NO: 5063595 - DNA, 17 bp, Homo sapiens
agaccaggtgctcagcc

SEQ ID NO: 5063596 - DNA, 18 bp, Homo sapiens
agaccaggtgctcagccc

SEQ ID NO: 5063597 - DNA, 19 bp, Homo sapiens
agaccaggtggaattactt

SEQ ID NO: 5063598 - DNA, 16 bp, Homo sapiens
agaccagtagtgacca

SEQ ID NO: 5063599 - DNA, 14 bp, Homo sapiens
agaccagtctggcc

SEQ ID NO: 5063600 - DNA, 16 bp, Homo sapiens
agaccagtgcttagca

SEQ ID NO: 5063601 - DNA, 18 bp, Homo sapiens
agaccagtggggatttgt

SEQ ID NO: 5063602 - DNA, 22 bp, Homo sapiens
agaccagttagattattgaaat

SEQ ID NO: 5063603 - DNA, 19 bp, Homo sapiens
agaccagttgggagcactg

SEQ ID NO: 5063604 - DNA, 23 bp, Homo sapiens
agaccagttgggagcactggagt

SEQ ID NO: 5063605 - DNA, 16 bp, Homo sapiens
agaccagtttgcatga

SEQ ID NO: 5063606 - DNA, 15 bp, Homo sapiens
agaccatataactgt

SEQ ID NO: 5063607 - DNA, 19 bp, Homo sapiens
agaccatataactgtgatg

SEQ ID NO: 5063608 - DNA, 21 bp, Homo sapiens
agaccatatttttaaagaaat

SEQ ID NO: 5063609 - DNA, 21 bp, Homo sapiens
agaccatccattctcctcagt

SEQ ID NO: 5063610 - DNA, 13 bp, Homo sapiens
agaccatccctga

SEQ ID NO: 5063611 - DNA, 17 bp, Homo sapiens
agaccatccctgaaggc

SEQ ID NO: 5063612 - DNA, 21 bp, Homo sapiens
agaccatccctgaaggccccg

SEQ ID NO: 5063613 - DNA, 13 bp, Homo sapiens
agaccatcctggc

SEQ ID NO: 5063614 - DNA, 15 bp, Homo sapiens
agaccatcctggccc

SEQ ID NO: 5063615 - DNA, 21 bp, Homo sapiens
agaccatcctggcccctccag

SEQ ID NO: 5063616 - DNA, 23 bp, Homo sapiens
agaccatctccagcatcctgctt

SEQ ID NO: 5063617 - DNA, 13 bp, Homo sapiens
agaccatctccta

SEQ ID NO: 5063618 - DNA, 14 bp, Homo sapiens
agaccatcttctat

SEQ ID NO: 5063619 - DNA, 16 bp, Homo sapiens
agaccatgaagtaaat

SEQ ID NO: 5063620 - DNA, 17 bp, Homo sapiens
agaccatgcagagcgcc

SEQ ID NO: 5063621 - DNA, 23 bp, Homo sapiens
agaccatgcattcagatctgaag

SEQ ID NO: 5063622 - DNA, 17 bp, Homo sapiens
agaccatgccagaccca

SEQ ID NO: 5063623 - DNA, 22 bp, Homo sapiens
agaccatggacactacacccag

SEQ ID NO: 5063624 - DNA, 15 bp, Homo sapiens
agaccatgggaaatg

SEQ ID NO: 5063625 - DNA, 19 bp, Homo sapiens
agaccatggggtggaagga

SEQ ID NO: 5063626 - DNA, 20 bp, Homo sapiens
agaccatgtggagacttcat

SEQ ID NO: 5063627 - DNA, 12 bp, Homo sapiens
agaccattctgt

SEQ ID NO: 5063628 - DNA, 14 bp, Homo sapiens
agaccattctgtga

SEQ ID NO: 5063629 - DNA, 23 bp, Homo sapiens
agaccattggggctcccagccag

SEQ ID NO: 5063630 - DNA, 18 bp, Homo sapiens
agaccatttaacatgcaa

SEQ ID NO: 5063631 - DNA, 13 bp, Homo sapiens
agaccatttaatc

SEQ ID NO: 5063632 - DNA, 19 bp, Homo sapiens
agaccatttcacagaaaac

SEQ ID NO: 5063633 - DNA, 12 bp, Homo sapiens
agaccatttgta

SEQ ID NO: 5063634 - DNA, 15 bp, Homo sapiens
agaccatttgtagtg

SEQ ID NO: 5063635 - DNA, 18 bp, Homo sapiens
agaccatttgtagtgagc

SEQ ID NO: 5063636 - DNA, 15 bp, Homo sapiens
agacccaaaccccca

SEQ ID NO: 5063637 - DNA, 21 bp, Homo sapiens
agacccaacagcaaaggaact

SEQ ID NO: 5063638 - DNA, 23 bp, Homo sapiens
agacccaacccatgcccctgaca

SEQ ID NO: 5063639 - DNA, 13 bp, Homo sapiens
agacccaaccctt

SEQ ID NO: 5063640 - DNA, 16 bp, Homo sapiens
agacccaaggctcact

SEQ ID NO: 5063641 - DNA, 16 bp, Homo sapiens
agacccaataaagaat

SEQ ID NO: 5063642 - DNA, 18 bp, Homo sapiens
agacccacagccctgaaa

SEQ ID NO: 5063643 - DNA, 13 bp, Homo sapiens
agacccaccccac

SEQ ID NO: 5063644 - DNA, 17 bp, Homo sapiens
agacccacccccagcct

SEQ ID NO: 5063645 - DNA, 19 bp, Homo sapiens
agacccacctgaggctcag

SEQ ID NO: 5063646 - DNA, 15 bp, Homo sapiens
agacccacctggagc

SEQ ID NO: 5063647 - DNA, 20 bp, Homo sapiens
agacccagagccctctgagc

SEQ ID NO: 5063648 - DNA, 16 bp, Homo sapiens
agacccagaggccctg

SEQ ID NO: 5063649 - DNA, 18 bp, Homo sapiens
agacccagaggccctgaa

SEQ ID NO: 5063650 - DNA, 18 bp, Homo sapiens
agacccagaggtccaggt

SEQ ID NO: 5063651 - DNA, 13 bp, Homo sapiens
agacccagatctc

SEQ ID NO: 5063652 - DNA, 12 bp, Homo sapiens
agacccagcccc

SEQ ID NO: 5063653 - DNA, 23 bp, Homo sapiens
agacccagccccttcccctggga

SEQ ID NO: 5063654 - DNA, 17 bp, Homo sapiens
agacccagcccgcggcc

SEQ ID NO: 5063655 - DNA, 17 bp, Homo sapiens
agacccagccctcatcc

SEQ ID NO: 5063656 - DNA, 20 bp, Homo sapiens
agacccaggagtccagaccc

SEQ ID NO: 5063657 - DNA, 22 bp, Homo sapiens
agacccaggagtccagcccctc

SEQ ID NO: 5063658 - DNA, 14 bp, Homo sapiens
agacccaggcctgt

SEQ ID NO: 5063659 - DNA, 13 bp, Homo sapiens
agacccagggcag

SEQ ID NO: 5063660 - DNA, 19 bp, Homo sapiens
agacccagggggctgaaac

SEQ ID NO: 5063661 - DNA, 16 bp, Homo sapiens
agacccaggggtccag

SEQ ID NO: 5063662 - DNA, 19 bp, Homo sapiens
agacccaggtcttccagac

SEQ ID NO: 5063663 - DNA, 21 bp, Homo sapiens
agacccaggtcttccagacct

SEQ ID NO: 5063664 - DNA, 22 bp, Homo sapiens
agacccaggtcttccagacctg

SEQ ID NO: 5063665 - DNA, 18 bp, Homo sapiens
agacccagtcccacactg

SEQ ID NO: 5063666 - DNA, 20 bp, Homo sapiens
agacccagtgtaaagaataa

SEQ ID NO: 5063667 - DNA, 20 bp, Homo sapiens
agacccataaaccacctccc

SEQ ID NO: 5063668 - DNA, 17 bp, Homo sapiens
agacccatgtgctggga

SEQ ID NO: 5063669 - DNA, 15 bp, Homo sapiens
agaccccacccaagc

SEQ ID NO: 5063670 - DNA, 20 bp, Homo sapiens
agaccccacccaagcttggc

SEQ ID NO: 5063671 - DNA, 14 bp, Homo sapiens
agaccccaccgcca

SEQ ID NO: 5063672 - DNA, 16 bp, Homo sapiens
agaccccactggagtc

SEQ ID NO: 5063673 - DNA, 18 bp, Homo sapiens
agaccccagatgtgaggg

SEQ ID NO: 5063674 - DNA, 15 bp, Homo sapiens
agaccccagctgggg

SEQ ID NO: 5063675 - DNA, 18 bp, Homo sapiens
agaccccagctggggcgc

SEQ ID NO: 5063676 - DNA, 13 bp, Homo sapiens
agaccccagggca

SEQ ID NO: 5063677 - DNA, 19 bp, Homo sapiens
agaccccaggtcagcatct

SEQ ID NO: 5063678 - DNA, 18 bp, Homo sapiens
agaccccagtcaagctcc

SEQ ID NO: 5063679 - DNA, 15 bp, Homo sapiens
agaccccagtgcctg

SEQ ID NO: 5063680 - DNA, 17 bp, Homo sapiens
agaccccagtgcctgca

SEQ ID NO: 5063681 - DNA, 13 bp, Homo sapiens
agaccccatctct

SEQ ID NO: 5063682 - DNA, 15 bp, Homo sapiens
agacccccacacctc

SEQ ID NO: 5063683 - DNA, 14 bp, Homo sapiens
agacccccacccct

SEQ ID NO: 5063684 - DNA, 19 bp, Homo sapiens
agacccccaccccttcccc

SEQ ID NO: 5063685 - DNA, 13 bp, Homo sapiens
agacccccactct

SEQ ID NO: 5063686 - DNA, 14 bp, Homo sapiens
agacccccagcact

SEQ ID NO: 5063687 - DNA, 13 bp, Homo sapiens
agacccccatcca

SEQ ID NO: 5063688 - DNA, 20 bp, Homo sapiens
agacccccatttgtcccaga

SEQ ID NO: 5063689 - DNA, 16 bp, Homo sapiens
agaccccccagcccct

SEQ ID NO: 5063690 - DNA, 17 bp, Homo sapiens
agaccccccagcccctc

SEQ ID NO: 5063691 - DNA, 20 bp, Homo sapiens
agaccccccagcccctcctc

SEQ ID NO: 5063692 - DNA, 20 bp, Homo sapiens
agacccccccatttcccgca

SEQ ID NO: 5063693 - DNA, 18 bp, Homo sapiens
agacccccccccaactcc

SEQ ID NO: 5063694 - DNA, 23 bp, Homo sapiens
agacccccccccccaacagaaca

SEQ ID NO: 5063695 - DNA, 19 bp, Homo sapiens
agacccccggaacaagcct

SEQ ID NO: 5063696 - DNA, 15 bp, Homo sapiens
agaccccctggagac

SEQ ID NO: 5063697 - DNA, 19 bp, Homo sapiens
agaccccctggagactaac

SEQ ID NO: 5063698 - DNA, 23 bp, Homo sapiens
agaccccgaggtaggggtgggga

SEQ ID NO: 5063699 - DNA, 18 bp, Homo sapiens
agaccccgcacccggctc

SEQ ID NO: 5063700 - DNA, 18 bp, Homo sapiens
agaccccgcactgcagac

SEQ ID NO: 5063701 - DNA, 19 bp, Homo sapiens
agaccccgcagcacgcctc

SEQ ID NO: 5063702 - DNA, 21 bp, Homo sapiens
agaccccgcagcacgcctctc

SEQ ID NO: 5063703 - DNA, 21 bp, Homo sapiens
agaccccgcaggatccctcct

SEQ ID NO: 5063704 - DNA, 22 bp, Homo sapiens
agaccccgggtctccttggctg

SEQ ID NO: 5063705 - DNA, 20 bp, Homo sapiens
agaccccgtggctctgggag

SEQ ID NO: 5063706 - DNA, 12 bp, Homo sapiens
agacccctcagc

SEQ ID NO: 5063707 - DNA, 20 bp, Homo sapiens
agacccctcagccccagccc

SEQ ID NO: 5063708 - DNA, 21 bp, Homo sapiens
gtacattctgcctagagtgta

SEQ ID NO: 5063709 - DNA, 23 bp, Homo sapiens
gtacattcttccatcatcactgt

SEQ ID NO: 5063710 - DNA, 15 bp, Homo sapiens
gtacattgcttaaaa

SEQ ID NO: 5063711 - DNA, 18 bp, Homo sapiens
gtacattgtgagctctgg

SEQ ID NO: 5063712 - DNA, 16 bp, Homo sapiens
gtacattgtgccctgt

SEQ ID NO: 5063713 - DNA, 14 bp, Homo sapiens
gtacatttaaaatt

SEQ ID NO: 5063714 - DNA, 13 bp, Homo sapiens
gtacatttaataa

SEQ ID NO: 5063715 - DNA, 18 bp, Homo sapiens
gtacatttaataatatca

SEQ ID NO: 5063716 - DNA, 23 bp, Homo sapiens
gtacatttaattgagaagcgtat

SEQ ID NO: 5063717 - DNA, 13 bp, Homo sapiens
gtacatttataat

SEQ ID NO: 5063718 - DNA, 16 bp, Homo sapiens
gtacatttatgattta

SEQ ID NO: 5063719 - DNA, 14 bp, Homo sapiens
gtacatttatgtgt

SEQ ID NO: 5063720 - DNA, 21 bp, Homo sapiens
gtacatttatgtgtgaagcaa

SEQ ID NO: 5063721 - DNA, 21 bp, Homo sapiens
gtacatttatttattactgtc

SEQ ID NO: 5063722 - DNA, 18 bp, Homo sapiens
gtacatttccaaatgaac

SEQ ID NO: 5063723 - DNA, 16 bp, Homo sapiens
gtacatttccctgtgc

SEQ ID NO: 5063724 - DNA, 18 bp, Homo sapiens
gtacatttccctgtgctg

SEQ ID NO: 5063725 - DNA, 18 bp, Homo sapiens
gtacatttctgattctga

SEQ ID NO: 5063726 - DNA, 19 bp, Homo sapiens
gtacatttctgattctgat

SEQ ID NO: 5063727 - DNA, 23 bp, Homo sapiens
gtacatttgatttgatatacaga

SEQ ID NO: 5063728 - DNA, 14 bp, Homo sapiens
gtacatttgcaatt

SEQ ID NO: 5063729 - DNA, 13 bp, Homo sapiens
gtacatttggaac

SEQ ID NO: 5063730 - DNA, 14 bp, Homo sapiens
gtacattttataaa

SEQ ID NO: 5063731 - DNA, 15 bp, Homo sapiens
gtacattttataaag

SEQ ID NO: 5063732 - DNA, 23 bp, Homo sapiens
gtacattttgtaaaatattatgt

SEQ ID NO: 5063733 - DNA, 15 bp, Homo sapiens
gtacattttgtaaca

SEQ ID NO: 5063734 - DNA, 17 bp, Homo sapiens
gtacattttgttgtaaa

SEQ ID NO: 5063735 - DNA, 19 bp, Homo sapiens
gtacattttgttgtaaaaa

SEQ ID NO: 5063736 - DNA, 10 bp, Homo sapiens
gtacattttt

SEQ ID NO: 5063737 - DNA, 21 bp, Homo sapiens
gtacatttttgatcaaatgta

SEQ ID NO: 5063738 - DNA, 15 bp, Homo sapiens
gtacatttttggggg

SEQ ID NO: 5063739 - DNA, 18 bp, Homo sapiens
gtacatttttggggggag

SEQ ID NO: 5063740 - DNA, 20 bp, Homo sapiens
gtacatttttggggggagag

SEQ ID NO: 5063741 - DNA, 16 bp, Homo sapiens
gtacattttttttcaa

SEQ ID NO: 5063742 - DNA, 13 bp, Homo sapiens
gtaccaaaacatc

SEQ ID NO: 5063743 - DNA, 16 bp, Homo sapiens
gtaccaaaattttaaa

SEQ ID NO: 5063744 - DNA, 16 bp, Homo sapiens
gtaccaaacaaggaag

SEQ ID NO: 5063745 - DNA, 17 bp, Homo sapiens
gtaccaaacaaggaagc

SEQ ID NO: 5063746 - DNA, 18 bp, Homo sapiens
gtaccaaacaaggaagcc

SEQ ID NO: 5063747 - DNA, 21 bp, Homo sapiens
gtaccaaacaaggaagccaaa

SEQ ID NO: 5063748 - DNA, 13 bp, Homo sapiens
gtaccaaagctgt

SEQ ID NO: 5063749 - DNA, 13 bp, Homo sapiens
gtaccaaagtttt

SEQ ID NO: 5063750 - DNA, 18 bp, Homo sapiens
gtaccaaagttttatcaa

SEQ ID NO: 5063751 - DNA, 21 bp, Homo sapiens
gtaccaaagttttatcaagtt

SEQ ID NO: 5063752 - DNA, 19 bp, Homo sapiens
gtaccaaatccacaagcca

SEQ ID NO: 5063753 - DNA, 17 bp, Homo sapiens
gtaccaaatctgacata

SEQ ID NO: 5063754 - DNA, 20 bp, Homo sapiens
gtaccaaatctgacatatta

SEQ ID NO: 5063755 - DNA, 16 bp, Homo sapiens
gtaccaactgagccaa

SEQ ID NO: 5063756 - DNA, 21 bp, Homo sapiens
gtaccaagaatcttggtttgc

SEQ ID NO: 5063757 - DNA, 23 bp, Homo sapiens
gtaccaagccaccgcagctgctg

SEQ ID NO: 5063758 - DNA, 13 bp, Homo sapiens
gtaccaagcccct

SEQ ID NO: 5063759 - DNA, 13 bp, Homo sapiens
gtaccaagtgaaa

SEQ ID NO: 5063760 - DNA, 18 bp, Homo sapiens
gtaccaatcgtctcagcc

SEQ ID NO: 5063761 - DNA, 16 bp, Homo sapiens
gtaccaatgggaagca

SEQ ID NO: 5063762 - DNA, 18 bp, Homo sapiens
gtaccaattgtcaaatta

SEQ ID NO: 5063763 - DNA, 21 bp, Homo sapiens
gtaccacaccctgcctgctgt

SEQ ID NO: 5063764 - DNA, 16 bp, Homo sapiens
gtaccacactgagttc

SEQ ID NO: 5063765 - DNA, 12 bp, Homo sapiens
gtaccacaggaa

SEQ ID NO: 5063766 - DNA, 23 bp, Homo sapiens
gtaccactacttagagatatgta

SEQ ID NO: 5063767 - DNA, 14 bp, Homo sapiens
gtaccactcaggcc

SEQ ID NO: 5063768 - DNA, 17 bp, Homo sapiens
gtaccactgaatctgta

SEQ ID NO: 5063769 - DNA, 20 bp, Homo sapiens
gtaccactgctaataaatga

SEQ ID NO: 5063770 - DNA, 15 bp, Homo sapiens
gtaccacttcctgag

SEQ ID NO: 5063771 - DNA, 17 bp, Homo sapiens
gtaccacttctgtgggc

SEQ ID NO: 5063772 - DNA, 22 bp, Homo sapiens
gtaccagagcctatggaaaggg

SEQ ID NO: 5063773 - DNA, 15 bp, Homo sapiens
gtaccagataacttt

SEQ ID NO: 5063774 - DNA, 16 bp, Homo sapiens
gtaccagataactttt

SEQ ID NO: 5063775 - DNA, 22 bp, Homo sapiens
gtaccagcgctctaaaagcacc

SEQ ID NO: 5063776 - DNA, 18 bp, Homo sapiens
gtaccagctcactccctg

SEQ ID NO: 5063777 - DNA, 16 bp, Homo sapiens
gtaccaggcacatggc

SEQ ID NO: 5063778 - DNA, 17 bp, Homo sapiens
gtaccaggcacatggct

SEQ ID NO: 5063779 - DNA, 18 bp, Homo sapiens
gtaccaggcccgcactgg

SEQ ID NO: 5063780 - DNA, 21 bp, Homo sapiens
gtaccaggcccgcactggggg

SEQ ID NO: 5063781 - DNA, 17 bp, Homo sapiens
gtaccaggggctgggct

SEQ ID NO: 5063782 - DNA, 21 bp, Homo sapiens
gtaccaggtattattatcttt

SEQ ID NO: 5063783 - DNA, 16 bp, Homo sapiens
gtaccaggtcattctt

SEQ ID NO: 5063784 - DNA, 15 bp, Homo sapiens
gtaccagtgaatttt

SEQ ID NO: 5063785 - DNA, 19 bp, Homo sapiens
gtaccagtgaatttttgca

SEQ ID NO: 5063786 - DNA, 22 bp, Homo sapiens
gtaccagtgaatttttgcaata

SEQ ID NO: 5063787 - DNA, 10 bp, Homo sapiens
gtaccagtta

SEQ ID NO: 5063788 - DNA, 11 bp, Homo sapiens
gtaccagttaa

SEQ ID NO: 5063789 - DNA, 22 bp, Homo sapiens
gtaccagttaatttttccaact

SEQ ID NO: 5063790 - DNA, 21 bp, Homo sapiens
gtaccagttctttaagaagat

SEQ ID NO: 5063791 - DNA, 17 bp, Homo sapiens
gtaccataatcttagag

SEQ ID NO: 5063792 - DNA, 21 bp, Homo sapiens
gtaccatagaaaaatgtataa

SEQ ID NO: 5063793 - DNA, 20 bp, Homo sapiens
gtaccatagtaccatttata

SEQ ID NO: 5063794 - DNA, 15 bp, Homo sapiens
gtaccatatgtagca

SEQ ID NO: 5063795 - DNA, 16 bp, Homo sapiens
gtaccatatgtagcat

SEQ ID NO: 5063796 - DNA, 11 bp, Homo sapiens
gtaccatcaat

SEQ ID NO: 5063797 - DNA, 15 bp, Homo sapiens
gtaccatcccactga

SEQ ID NO: 5063798 - DNA, 21 bp, Homo sapiens
gtaccatgggctacagtgtct

SEQ ID NO: 5063799 - DNA, 21 bp, Homo sapiens
gtaccatgtgctacaggggcc

SEQ ID NO: 5063800 - DNA, 16 bp, Homo sapiens
gtaccatgttgcccag

SEQ ID NO: 5063801 - DNA, 17 bp, Homo sapiens
gtaccatgttgcccaga

SEQ ID NO: 5063802 - DNA, 19 bp, Homo sapiens
gtaccatgttgcccagaat

SEQ ID NO: 5063803 - DNA, 17 bp, Homo sapiens
gtaccattccttcaaat

SEQ ID NO: 5063804 - DNA, 23 bp, Homo sapiens
gtaccatttaatggggaggacaa

SEQ ID NO: 5063805 - DNA, 19 bp, Homo sapiens
gtaccatttatacaaatta

SEQ ID NO: 5063806 - DNA, 13 bp, Homo sapiens
gtaccattttaaa

SEQ ID NO: 5063807 - DNA, 18 bp, Homo sapiens
gtacccaaaagctcagcc

SEQ ID NO: 5063808 - DNA, 20 bp, Homo sapiens
gtacccaaccaaagatgctt

SEQ ID NO: 5063809 - DNA, 22 bp, Homo sapiens
gtacccaataggtaatttttca

SEQ ID NO: 5063810 - DNA, 13 bp, Homo sapiens
gtacccaccccag

SEQ ID NO: 5063811 - DNA, 14 bp, Homo sapiens
gtacccaccccagc

SEQ ID NO: 5063812 - DNA, 18 bp, Homo sapiens
gtacccaccccagcacag

SEQ ID NO: 5063813 - DNA, 23 bp, Homo sapiens
gtacccaccccagcacagccacc

SEQ ID NO: 5063814 - DNA, 20 bp, Homo sapiens
gtacccactcctcactgccc

SEQ ID NO: 5063815 - DNA, 13 bp, Homo sapiens
gtacccactgctc

SEQ ID NO: 5063816 - DNA, 15 bp, Homo sapiens
gtacccagccacctt

SEQ ID NO: 5063817 - DNA, 16 bp, Homo sapiens
gtacccagccaccttc

SEQ ID NO: 5063818 - DNA, 20 bp, Homo sapiens
gtacccagccatctgcccag

SEQ ID NO: 5063819 - DNA, 21 bp, Homo sapiens
gtacccagccatctgcccagg

SEQ ID NO: 5063820 - DNA, 14 bp, Homo sapiens
gtacccaggctggt

SEQ ID NO: 5063821 - DNA, 22 bp, Homo sapiens
gtaccccactgggccagccctg

SEQ ID NO: 5063822 - DNA, 17 bp, Homo sapiens
gtaccccagctctgctt

SEQ ID NO: 5063823 - DNA, 18 bp, Homo sapiens
gtaccccagctctgcttg

SEQ ID NO: 5063824 - DNA, 13 bp, Homo sapiens
gtaccccatccct

SEQ ID NO: 5063825 - DNA, 14 bp, Homo sapiens
gtaccccatccctt

SEQ ID NO: 5063826 - DNA, 14 bp, Homo sapiens
gtacccccaggacc

SEQ ID NO: 5063827 - DNA, 19 bp, Homo sapiens
gtacccccgcccaggctgg

SEQ ID NO: 5063828 - DNA, 20 bp, Homo sapiens
gtacccccgtggtctttgaa

SEQ ID NO: 5063829 - DNA, 14 bp, Homo sapiens
gtacccccttctgg

SEQ ID NO: 5063830 - DNA, 19 bp, Homo sapiens
gtacccctggtaaaccaag

SEQ ID NO: 5063831 - DNA, 17 bp, Homo sapiens
gtacccggggcccaggg

SEQ ID NO: 5063832 - DNA, 21 bp, Homo sapiens
gtaccctaccctgcacattgt

SEQ ID NO: 5063833 - DNA, 17 bp, Homo sapiens
gtaccctcctcccgact

SEQ ID NO: 5063834 - DNA, 17 bp, Homo sapiens
gtaccctcctggctctt

SEQ ID NO: 5063835 - DNA, 18 bp, Homo sapiens
gtaccctctcagctccag

SEQ ID NO: 5063836 - DNA, 15 bp, Homo sapiens
gtaccctctccaggc

SEQ ID NO: 5063837 - DNA, 11 bp, Homo sapiens
gtaccctgcag

SEQ ID NO: 5063838 - DNA, 12 bp, Homo sapiens
gtaccctgcagg

SEQ ID NO: 5063839 - DNA, 13 bp, Homo sapiens
gtaccctgcaggc

SEQ ID NO: 5063840 - DNA, 18 bp, Homo sapiens
gtaccctgcttcccaaac

SEQ ID NO: 5063841 - DNA, 16 bp, Homo sapiens
gtaccctggcagagaa

SEQ ID NO: 5063842 - DNA, 18 bp, Homo sapiens
gtaccctggcagagaaga

SEQ ID NO: 5063843 - DNA, 13 bp, Homo sapiens
gtaccctgggtgt

SEQ ID NO: 5063844 - DNA, 18 bp, Homo sapiens
gtacccttccttcttccc

SEQ ID NO: 5063845 - DNA, 18 bp, Homo sapiens
gtacccttcttgtctctc

SEQ ID NO: 5063846 - DNA, 18 bp, Homo sapiens
gtaccgaaacaccccgct

SEQ ID NO: 5063847 - DNA, 14 bp, Homo sapiens
gtaccgaatcaact

SEQ ID NO: 5063848 - DNA, 21 bp, Homo sapiens
gtaccgatgatactgtttctt

SEQ ID NO: 5063849 - DNA, 23 bp, Homo sapiens
gtaccgccttgcacactcagaag

SEQ ID NO: 5063850 - DNA, 20 bp, Homo sapiens
gtaccgcgtctaccctggga

SEQ ID NO: 5063851 - DNA, 15 bp, Homo sapiens
gtaccggccactgca

SEQ ID NO: 5063852 - DNA, 16 bp, Homo sapiens
gtaccggccactgcaa

SEQ ID NO: 5063853 - DNA, 14 bp, Homo sapiens
gtacctaagtaaat

SEQ ID NO: 5063854 - DNA, 13 bp, Homo sapiens
gtacctataaagt

SEQ ID NO: 5063855 - DNA, 20 bp, Homo sapiens
gtacctataaagtaaagcta

SEQ ID NO: 5063856 - DNA, 14 bp, Homo sapiens
gtacctatggctgc

SEQ ID NO: 5063857 - DNA, 13 bp, Homo sapiens
gtacctatttctg

SEQ ID NO: 5063858 - DNA, 20 bp, Homo sapiens
gtacctatttctgatgatgt

SEQ ID NO: 5063859 - DNA, 14 bp, Homo sapiens
gtacctcaaatgaa

SEQ ID NO: 5063860 - DNA, 14 bp, Homo sapiens
gtacctcagtttct

SEQ ID NO: 5063861 - DNA, 15 bp, Homo sapiens
gtacctcagtttctc

SEQ ID NO: 5063862 - DNA, 18 bp, Homo sapiens
gtacctccagtcacactc

SEQ ID NO: 5063863 - DNA, 16 bp, Homo sapiens
gtacctcccctgcctt

SEQ ID NO: 5063864 - DNA, 19 bp, Homo sapiens
gtacctcctctcagtgttt

SEQ ID NO: 5063865 - DNA, 21 bp, Homo sapiens
gtacctcgggtgggagggatg

SEQ ID NO: 5063866 - DNA, 17 bp, Homo sapiens
gtacctctagaatccca

SEQ ID NO: 5063867 - DNA, 23 bp, Homo sapiens
gtacctctagaatcccagcagca

SEQ ID NO: 5063868 - DNA, 15 bp, Homo sapiens
gtacctctctctgct

SEQ ID NO: 5063869 - DNA, 18 bp, Homo sapiens
gtacctctctctgctcct

SEQ ID NO: 5063870 - DNA, 21 bp, Homo sapiens
gtacctctggctgactaaatt

SEQ ID NO: 5063871 - DNA, 12 bp, Homo sapiens
gtacctgaaaag

SEQ ID NO: 5063872 - DNA, 15 bp, Homo sapiens
gtacctgagggtctg

SEQ ID NO: 5063873 - DNA, 16 bp, Homo sapiens
gtacctgcaagcagaa

SEQ ID NO: 5063874 - DNA, 19 bp, Homo sapiens
gtacctgcaagcagaactt

SEQ ID NO: 5063875 - DNA, 12 bp, Homo sapiens
gtacctgctgcc

SEQ ID NO: 5063876 - DNA, 16 bp, Homo sapiens
gtacctgctggaagaa

SEQ ID NO: 5063877 - DNA, 12 bp, Homo sapiens
gtacctgggaaa

SEQ ID NO: 5063878 - DNA, 22 bp, Homo sapiens
gtacctgggaaaggacccaccc

SEQ ID NO: 5063879 - DNA, 15 bp, Homo sapiens
gtacctgggcaagct

SEQ ID NO: 5063880 - DNA, 21 bp, Homo sapiens
gtacctgtaggaaacagaaaa

SEQ ID NO: 5063881 - DNA, 18 bp, Homo sapiens
gtacctgtcaaaaatttt

SEQ ID NO: 5063882 - DNA, 16 bp, Homo sapiens
gtacctgtccctccag

SEQ ID NO: 5063883 - DNA, 14 bp, Homo sapiens
gtacctgtgactct

SEQ ID NO: 5063884 - DNA, 15 bp, Homo sapiens
gtacctgtgtgtttc

SEQ ID NO: 5063885 - DNA, 16 bp, Homo sapiens
gtaccttaatttgact

SEQ ID NO: 5063886 - DNA, 21 bp, Homo sapiens
gtaccttatttaaaagatttt

SEQ ID NO: 5063887 - DNA, 16 bp, Homo sapiens
gtagccatggctcagg

SEQ ID NO: 5063888 - DNA, 17 bp, Homo sapiens
gtagccatggctcaggc

SEQ ID NO: 5063889 - DNA, 22 bp, Homo sapiens
gtagccatggctcaggcaagcc

SEQ ID NO: 5063890 - DNA, 14 bp, Homo sapiens
gtagccatggctgg

SEQ ID NO: 5063891 - DNA, 17 bp, Homo sapiens
gtagccattttgtaact

SEQ ID NO: 5063892 - DNA, 22 bp, Homo sapiens
gtagcccacaataatgaataat

SEQ ID NO: 5063893 - DNA, 21 bp, Homo sapiens
gtagcccacacttgagaggat

SEQ ID NO: 5063894 - DNA, 17 bp, Homo sapiens
gtagcccaggtcactgt

SEQ ID NO: 5063895 - DNA, 15 bp, Homo sapiens
gtagccccagtgaca

SEQ ID NO: 5063896 - DNA, 16 bp, Homo sapiens
gtagccccagtgacag

SEQ ID NO: 5063897 - DNA, 15 bp, Homo sapiens
gtagccccctcatct

SEQ ID NO: 5063898 - DNA, 17 bp, Homo sapiens
gtagccccctggcctct

SEQ ID NO: 5063899 - DNA, 18 bp, Homo sapiens
gtagccccctggcctctg

SEQ ID NO: 5063900 - DNA, 19 bp, Homo sapiens
gtagccccgggctgaccca

SEQ ID NO: 5063901 - DNA, 20 bp, Homo sapiens
gtagccccgggctgacccag

SEQ ID NO: 5063902 - DNA, 14 bp, Homo sapiens
gtagccccttttct

SEQ ID NO: 5063903 - DNA, 15 bp, Homo sapiens
gtagccctcccactt

SEQ ID NO: 5063904 - DNA, 23 bp, Homo sapiens
gtagccctggatggcctctgggg

SEQ ID NO: 5063905 - DNA, 15 bp, Homo sapiens
gtagccctggccaga

SEQ ID NO: 5063906 - DNA, 21 bp, Homo sapiens
gtagccctggcccggtcccag

SEQ ID NO: 5063907 - DNA, 22 bp, Homo sapiens
gtagccctgggtttaatgtcaa

SEQ ID NO: 5063908 - DNA, 14 bp, Homo sapiens
gtagccctttctgt

SEQ ID NO: 5063909 - DNA, 13 bp, Homo sapiens
gtagccgccctga

SEQ ID NO: 5063910 - DNA, 16 bp, Homo sapiens
gtagccgccctgagag

SEQ ID NO: 5063911 - DNA, 16 bp, Homo sapiens
gtagcctaaagggcag

SEQ ID NO: 5063912 - DNA, 21 bp, Homo sapiens
gtagcctaatattcatgctgc

SEQ ID NO: 5063913 - DNA, 16 bp, Homo sapiens
gtagcctatgttgtgg

SEQ ID NO: 5063914 - DNA, 13 bp, Homo sapiens
gtagcctcctcct

SEQ ID NO: 5063915 - DNA, 21 bp, Homo sapiens
gtagcctcgccgtctgtgaat

SEQ ID NO: 5063916 - DNA, 13 bp, Homo sapiens
gtagcctctggga

SEQ ID NO: 5063917 - DNA, 24 bp, Homo sapiens
gtagcctgaagagtttgtaaatga

SEQ ID NO: 5063918 - DNA, 14 bp, Homo sapiens
gtagcctgctgtgg

SEQ ID NO: 5063919 - DNA, 22 bp, Homo sapiens
gtagcctggatattattcttgt

SEQ ID NO: 5063920 - DNA, 12 bp, Homo sapiens
gtagcctggatg

SEQ ID NO: 5063921 - DNA, 19 bp, Homo sapiens
gtagcctgggctcactgtg

SEQ ID NO: 5063922 - DNA, 14 bp, Homo sapiens
gtagcctggtctgt

SEQ ID NO: 5063923 - DNA, 18 bp, Homo sapiens
gtagcctggtctgtgcat

SEQ ID NO: 5063924 - DNA, 22 bp, Homo sapiens
gtagcctggtctgtgcattgtg

SEQ ID NO: 5063925 - DNA, 19 bp, Homo sapiens
gtagcctttcctgatgaca

SEQ ID NO: 5063926 - DNA, 19 bp, Homo sapiens
gtagcgaactgcactgctg

SEQ ID NO: 5063927 - DNA, 16 bp, Homo sapiens
gtagcgaccccagact

SEQ ID NO: 5063928 - DNA, 23 bp, Homo sapiens
gtagcggaaaagttgtcttaaaa

SEQ ID NO: 5063929 - DNA, 13 bp, Homo sapiens
gtagcgggaggaa

SEQ ID NO: 5063930 - DNA, 18 bp, Homo sapiens
gtagcgttttttaaatgt

SEQ ID NO: 5063931 - DNA, 22 bp, Homo sapiens
gtagcgttttttaaatgtatac

SEQ ID NO: 5063932 - DNA, 15 bp, Homo sapiens
gtagctaacagtgaa

SEQ ID NO: 5063933 - DNA, 17 bp, Homo sapiens
gtagctacaagggaagc

SEQ ID NO: 5063934 - DNA, 17 bp, Homo sapiens
gtagctacactgtataa

SEQ ID NO: 5063935 - DNA, 21 bp, Homo sapiens
gtagctacactgtataactgt

SEQ ID NO: 5063936 - DNA, 15 bp, Homo sapiens
gtagctacagagaaa

SEQ ID NO: 5063937 - DNA, 19 bp, Homo sapiens
gtagctacattttcagaag

SEQ ID NO: 5063938 - DNA, 17 bp, Homo sapiens
gtagctagaggaaccaa

SEQ ID NO: 5063939 - DNA, 15 bp, Homo sapiens
gtagctatagttgca

SEQ ID NO: 5063940 - DNA, 19 bp, Homo sapiens
gtagctatagttgcagccc

SEQ ID NO: 5063941 - DNA, 19 bp, Homo sapiens
gtagctattagcggctcct

SEQ ID NO: 5063942 - DNA, 13 bp, Homo sapiens
gtagctcaagttt

SEQ ID NO: 5063943 - DNA, 15 bp, Homo sapiens
gtagctcaagtttaa

SEQ ID NO: 5063944 - DNA, 19 bp, Homo sapiens
gtagctcaagtttaaaagc

SEQ ID NO: 5063945 - DNA, 10 bp, Homo sapiens
gtagctcagt

SEQ ID NO: 5063946 - DNA, 11 bp, Homo sapiens
gtagctcagtc

SEQ ID NO: 5063947 - DNA, 14 bp, Homo sapiens
gtagctccacaaga

SEQ ID NO: 5063948 - DNA, 22 bp, Homo sapiens
gtagctcccctgctgaggcagt

SEQ ID NO: 5063949 - DNA, 19 bp, Homo sapiens
gtagctcccctggctggct

SEQ ID NO: 5063950 - DNA, 20 bp, Homo sapiens
gtagctcccctggctggctc

SEQ ID NO: 5063951 - DNA, 21 bp, Homo sapiens
gtagctcctataaagggccca

SEQ ID NO: 5063952 - DNA, 13 bp, Homo sapiens
gtagctcctcccc

SEQ ID NO: 5063953 - DNA, 14 bp, Homo sapiens
gtagctcggcacca

SEQ ID NO: 5063954 - DNA, 16 bp, Homo sapiens
gtagctcgtcctcact

SEQ ID NO: 5063955 - DNA, 11 bp, Homo sapiens
gtagctctagg

SEQ ID NO: 5063956 - DNA, 17 bp, Homo sapiens
gtagctctcaaatgtgt

SEQ ID NO: 5063957 - DNA, 12 bp, Homo sapiens
gtagctctgagc

SEQ ID NO: 5063958 - DNA, 15 bp, Homo sapiens
gtagctctgagccct

SEQ ID NO: 5063959 - DNA, 12 bp, Homo sapiens
gtagctctgcct

SEQ ID NO: 5063960 - DNA, 18 bp, Homo sapiens
gtagctctgcctccctct

SEQ ID NO: 5063961 - DNA, 17 bp, Homo sapiens
gtagctctgctgctgat

SEQ ID NO: 5063962 - DNA, 20 bp, Homo sapiens
gtagctcttagtcctccctg

SEQ ID NO: 5063963 - DNA, 19 bp, Homo sapiens
gtagctctttgtcagggag

SEQ ID NO: 5063964 - DNA, 13 bp, Homo sapiens
gtagctgacacag

SEQ ID NO: 5063965 - DNA, 20 bp, Homo sapiens
gtagctgagactacaggtga

SEQ ID NO: 5063966 - DNA, 12 bp, Homo sapiens
gtagctgagagg

SEQ ID NO: 5063967 - DNA, 11 bp, Homo sapiens
gtagctgagct

SEQ ID NO: 5063968 - DNA, 16 bp, Homo sapiens
gtagctgcaaaaataa

SEQ ID NO: 5063969 - DNA, 17 bp, Homo sapiens
gtagctgcaaaggacag

SEQ ID NO: 5063970 - DNA, 13 bp, Homo sapiens
gtagctgcagcct

SEQ ID NO: 5063971 - DNA, 23 bp, Homo sapiens
gtagctgccacttgaacaaaatc

SEQ ID NO: 5063972 - DNA, 10 bp, Homo sapiens
gtagctgcta

SEQ ID NO: 5063973 - DNA, 20 bp, Homo sapiens
gtagctgctagtgagccttc

SEQ ID NO: 5063974 - DNA, 17 bp, Homo sapiens
gtagctggattacaggc

SEQ ID NO: 5063975 - DNA, 22 bp, Homo sapiens
gtagctggctgtactgccaagg

SEQ ID NO: 5063976 - DNA, 12 bp, Homo sapiens
gtagctgggact

SEQ ID NO: 5063977 - DNA, 21 bp, Homo sapiens
gtagctgggagtacaggcgtc

SEQ ID NO: 5063978 - DNA, 23 bp, Homo sapiens
gtagctgggatcacagctgcagg

SEQ ID NO: 5063979 - DNA, 13 bp, Homo sapiens
gtagctgggatta

SEQ ID NO: 5063980 - DNA, 18 bp, Homo sapiens
gtagctgggattacaggt

SEQ ID NO: 5063981 - DNA, 14 bp, Homo sapiens
gtagctgggcctgt

SEQ ID NO: 5063982 - DNA, 17 bp, Homo sapiens
gtagctggtggttgtgc

SEQ ID NO: 5063983 - DNA, 20 bp, Homo sapiens
gtagctgtaaggcatgaagg

SEQ ID NO: 5063984 - DNA, 14 bp, Homo sapiens
gtagctgtaagggc

SEQ ID NO: 5063985 - DNA, 20 bp, Homo sapiens
gtagctgtcagatgtcacat

SEQ ID NO: 5063986 - DNA, 23 bp, Homo sapiens
gtagctgtccaaaataataacat

SEQ ID NO: 5063987 - DNA, 15 bp, Homo sapiens
gtagctgtgacctgc

SEQ ID NO: 5063988 - DNA, 21 bp, Homo sapiens
gtagctgtgacctgctgagct

SEQ ID NO: 5063989 - DNA, 16 bp, Homo sapiens
gtagctgtggcctcac

SEQ ID NO: 5063990 - DNA, 17 bp, Homo sapiens
gtagctgtggggagctg

SEQ ID NO: 5063991 - DNA, 18 bp, Homo sapiens
gtagctgtggggagctgg

SEQ ID NO: 5063992 - DNA, 17 bp, Homo sapiens
gtagcttacctgacaca

SEQ ID NO: 5063993 - DNA, 18 bp, Homo sapiens
gtagcttacctgacacaa

SEQ ID NO: 5063994 - DNA, 22 bp, Homo sapiens
gtagcttacctgacacaagagg

SEQ ID NO: 5063995 - DNA, 16 bp, Homo sapiens
gtagcttcagccaggc

SEQ ID NO: 5063996 - DNA, 14 bp, Homo sapiens
gtagcttcagtcat

SEQ ID NO: 5063997 - DNA, 15 bp, Homo sapiens
gtagcttccacctca

SEQ ID NO: 5063998 - DNA, 19 bp, Homo sapiens
gtagcttctgacctcagca

SEQ ID NO: 5063999 - DNA, 14 bp, Homo sapiens
gtagcttgctccct

SEQ ID NO: 5064000 - DNA, 19 bp, Homo sapiens
gtagcttgctccctgtgtc

SEQ ID NO: 5064001 - DNA, 20 bp, Homo sapiens
gtagctttaaaaccacagct

SEQ ID NO: 5064002 - DNA, 16 bp, Homo sapiens
gtagctttcctggaag

SEQ ID NO: 5064003 - DNA, 22 bp, Homo sapiens
gtagcttttactttttatgaaa

SEQ ID NO: 5064004 - DNA, 21 bp, Homo sapiens
gtagctttttaccgttcactt

SEQ ID NO: 5064005 - DNA, 19 bp, Homo sapiens
gtaggaaaaataaaaacag

SEQ ID NO: 5064006 - DNA, 14 bp, Homo sapiens
gtaggaaacagaaa

SEQ ID NO: 5064007 - DNA, 17 bp, Homo sapiens
gtaggaaacagaaaaga

SEQ ID NO: 5064008 - DNA, 19 bp, Homo sapiens
gtaggaaaccaccctgagg

SEQ ID NO: 5064009 - DNA, 20 bp, Homo sapiens
gtaggaaaccaccctgaggg

SEQ ID NO: 5064010 - DNA, 17 bp, Homo sapiens
gtaggaaactcatctcc

SEQ ID NO: 5064011 - DNA, 22 bp, Homo sapiens
gtaggaaagcaccgcagcatgt

SEQ ID NO: 5064012 - DNA, 16 bp, Homo sapiens
gtaggaaatcaggcag

SEQ ID NO: 5064013 - DNA, 13 bp, Homo sapiens
gtaggaaatgtgg

SEQ ID NO: 5064014 - DNA, 16 bp, Homo sapiens
gtaggaacaagctggc

SEQ ID NO: 5064015 - DNA, 23 bp, Homo sapiens
gtaggaacaagctggcttctgtg

SEQ ID NO: 5064016 - DNA, 22 bp, Homo sapiens
gtaggaaccgtggtatgtctgc

SEQ ID NO: 5064017 - DNA, 18 bp, Homo sapiens
gtaggaacggtaaatttc

SEQ ID NO: 5064018 - DNA, 16 bp, Homo sapiens
gtaggaactgctgggc

SEQ ID NO: 5064019 - DNA, 15 bp, Homo sapiens
gtaggaagactttgg

SEQ ID NO: 5064020 - DNA, 20 bp, Homo sapiens
gtaggaagaggccgctgcag

SEQ ID NO: 5064021 - DNA, 17 bp, Homo sapiens
gtaggaagagtagcatt

SEQ ID NO: 5064022 - DNA, 13 bp, Homo sapiens
gtaggaagcattt

SEQ ID NO: 5064023 - DNA, 17 bp, Homo sapiens
gtaggaatattatattt

SEQ ID NO: 5064024 - DNA, 20 bp, Homo sapiens
gtaggaatattatatttgga

SEQ ID NO: 5064025 - DNA, 17 bp, Homo sapiens
gtaggaatcctttgaga

SEQ ID NO: 5064026 - DNA, 23 bp, Homo sapiens
gtaggaatgaccacgggcctcag

SEQ ID NO: 5064027 - DNA, 16 bp, Homo sapiens
gtaggaccaatgttgt

SEQ ID NO: 5064028 - DNA, 15 bp, Homo sapiens
gtaggaccaggccac

SEQ ID NO: 5064029 - DNA, 20 bp, Homo sapiens
gtaggagacacagatggcac

SEQ ID NO: 5064030 - DNA, 23 bp, Homo sapiens
gtaggagacacagatggcacctg

SEQ ID NO: 5064031 - DNA, 20 bp, Homo sapiens
gtaggagactgtttggaaat

SEQ ID NO: 5064032 - DNA, 17 bp, Homo sapiens
gtaggagagcactgcct

SEQ ID NO: 5064033 - DNA, 20 bp, Homo sapiens
gtaggagagcactgcctcta

SEQ ID NO: 5064034 - DNA, 12 bp, Homo sapiens
gtaggagaggag

SEQ ID NO: 5064035 - DNA, 20 bp, Homo sapiens
gtaggagcactggggtgggg

SEQ ID NO: 5064036 - DNA, 18 bp, Homo sapiens
gtaggagcccagctctga

SEQ ID NO: 5064037 - DNA, 16 bp, Homo sapiens
gtaggagcccttctct

SEQ ID NO: 5064038 - DNA, 23 bp, Homo sapiens
gtaggaggaaacagttctcactg

SEQ ID NO: 5064039 - DNA, 15 bp, Homo sapiens
gtaggaggaacaggt

SEQ ID NO: 5064040 - DNA, 16 bp, Homo sapiens
gtaggagggtgggaag

SEQ ID NO: 5064041 - DNA, 24 bp, Homo sapiens
gtaggagtcttatatcccaggtga

SEQ ID NO: 5064042 - DNA, 22 bp, Homo sapiens
gtaggagtggctgaccaggccc

SEQ ID NO: 5064043 - DNA, 14 bp, Homo sapiens
gtaggatatgcctg

SEQ ID NO: 5064044 - DNA, 16 bp, Homo sapiens
gtaggatattggcatt

SEQ ID NO: 5064045 - DNA, 15 bp, Homo sapiens
gtaggatcacctgag

SEQ ID NO: 5064046 - DNA, 16 bp, Homo sapiens
gtaggatcacctgagg

SEQ ID NO: 5064047 - DNA, 14 bp, Homo sapiens
gtaggatgacaggc

SEQ ID NO: 5064048 - DNA, 22 bp, Homo sapiens
gtaggatgtatgctgtttgtac

SEQ ID NO: 5064049 - DNA, 18 bp, Homo sapiens
gtaggatgttgcttctga

SEQ ID NO: 5064050 - DNA, 22 bp, Homo sapiens
gtaggatgttgcttctgaatca

SEQ ID NO: 5064051 - DNA, 15 bp, Homo sapiens
gtaggattaatttat

SEQ ID NO: 5064052 - DNA, 13 bp, Homo sapiens
gtaggattactag

SEQ ID NO: 5064053 - DNA, 18 bp, Homo sapiens
gtaggatttatgtatttt

SEQ ID NO: 5064054 - DNA, 23 bp, Homo sapiens
gtaggatttatgtattttgaaaa

SEQ ID NO: 5064055 - DNA, 14 bp, Homo sapiens
gtaggatttttgtt

SEQ ID NO: 5064056 - DNA, 16 bp, Homo sapiens
gtaggcaaggctgccg

SEQ ID NO: 5064057 - DNA, 21 bp, Homo sapiens
gtaggcaaggctgccggctgc

SEQ ID NO: 5064058 - DNA, 19 bp, Homo sapiens
gtaggcagaccctggaccc

SEQ ID NO: 5064059 - DNA, 14 bp, Homo sapiens
gtaggcagaggctg

SEQ ID NO: 5064060 - DNA, 12 bp, Homo sapiens
gtaggcagccac

SEQ ID NO: 5064061 - DNA, 13 bp, Homo sapiens
gtaggcagccacg

SEQ ID NO: 5064062 - DNA, 16 bp, Homo sapiens
gtaggcagccacggcc

SEQ ID NO: 5064063 - DNA, 13 bp, Homo sapiens
gtaggcaggattg

SEQ ID NO: 5064064 - DNA, 19 bp, Homo sapiens
gtaggcaggtgtcttggac

SEQ ID NO: 5064065 - DNA, 20 bp, Homo sapiens
tccaggcttcctgccctagc

SEQ ID NO: 5064066 - DNA, 22 bp, Homo sapiens
tccaggcttctcccggacctgg

SEQ ID NO: 5064067 - DNA, 16 bp, Homo sapiens
tccagggaaacagcct

SEQ ID NO: 5064068 - DNA, 18 bp, Homo sapiens
tccagggaaacagcctct

SEQ ID NO: 5064069 - DNA, 22 bp, Homo sapiens
tccagggaaacagcctctctct

SEQ ID NO: 5064070 - DNA, 15 bp, Homo sapiens
tccagggaaatgcct

SEQ ID NO: 5064071 - DNA, 16 bp, Homo sapiens
tccagggaagctggcc

SEQ ID NO: 5064072 - DNA, 18 bp, Homo sapiens
tccagggaagctggccga

SEQ ID NO: 5064073 - DNA, 19 bp, Homo sapiens
tccagggaaggtggccaca

SEQ ID NO: 5064074 - DNA, 19 bp, Homo sapiens
tccagggaatccaagcctc

SEQ ID NO: 5064075 - DNA, 15 bp, Homo sapiens
tccagggacagaggc

SEQ ID NO: 5064076 - DNA, 23 bp, Homo sapiens
tccagggacagaggccccagcct

SEQ ID NO: 5064077 - DNA, 13 bp, Homo sapiens
tccagggacagca

SEQ ID NO: 5064078 - DNA, 17 bp, Homo sapiens
tccagggacccttgcct

SEQ ID NO: 5064079 - DNA, 21 bp, Homo sapiens
tccagggacccttgcctgcct

SEQ ID NO: 5064080 - DNA, 22 bp, Homo sapiens
tccagggacccttgcctgcctc

SEQ ID NO: 5064081 - DNA, 16 bp, Homo sapiens
tccagggactgtacct

SEQ ID NO: 5064082 - DNA, 18 bp, Homo sapiens
tccagggactgtacctgt

SEQ ID NO: 5064083 - DNA, 23 bp, Homo sapiens
tccagggactgtacctgtaggaa

SEQ ID NO: 5064084 - DNA, 17 bp, Homo sapiens
tccagggagcaagacag

SEQ ID NO: 5064085 - DNA, 18 bp, Homo sapiens
tccagggaggcgatgcca

SEQ ID NO: 5064086 - DNA, 23 bp, Homo sapiens
tccagggaggcgatgccagcctt

SEQ ID NO: 5064087 - DNA, 14 bp, Homo sapiens
tccagggaggctgg

SEQ ID NO: 5064088 - DNA, 22 bp, Homo sapiens
tccagggaggctggtcctatgg

SEQ ID NO: 5064089 - DNA, 15 bp, Homo sapiens
tccagggatgagcca

SEQ ID NO: 5064090 - DNA, 22 bp, Homo sapiens
tccagggatgattcaagccatt

SEQ ID NO: 5064091 - DNA, 23 bp, Homo sapiens
tccagggatgattcaagccattc

SEQ ID NO: 5064092 - DNA, 20 bp, Homo sapiens
tccagggatgccatctgtgg

SEQ ID NO: 5064093 - DNA, 13 bp, Homo sapiens
tccagggatggcc

SEQ ID NO: 5064094 - DNA, 16 bp, Homo sapiens
tccagggcagcagccg

SEQ ID NO: 5064095 - DNA, 14 bp, Homo sapiens
tccagggcagcagg

SEQ ID NO: 5064096 - DNA, 17 bp, Homo sapiens
tccagggcagcaggcca

SEQ ID NO: 5064097 - DNA, 20 bp, Homo sapiens
tccagggcattgctcagccc

SEQ ID NO: 5064098 - DNA, 11 bp, Homo sapiens
tccagggccag

SEQ ID NO: 5064099 - DNA, 13 bp, Homo sapiens
tccagggccagga

SEQ ID NO: 5064100 - DNA, 22 bp, Homo sapiens
tccagggccaggattcaggcct

SEQ ID NO: 5064101 - DNA, 23 bp, Homo sapiens
tccagggccaggattcaggcctc

SEQ ID NO: 5064102 - DNA, 16 bp, Homo sapiens
tccagggcccaggttc

SEQ ID NO: 5064103 - DNA, 15 bp, Homo sapiens
tccagggcccccacc

SEQ ID NO: 5064104 - DNA, 17 bp, Homo sapiens
tccagggcccccatctc

SEQ ID NO: 5064105 - DNA, 13 bp, Homo sapiens
tccagggccctga

SEQ ID NO: 5064106 - DNA, 16 bp, Homo sapiens
tccagggccctgagct

SEQ ID NO: 5064107 - DNA, 14 bp, Homo sapiens
tccagggcctgaca

SEQ ID NO: 5064108 - DNA, 16 bp, Homo sapiens
tccagggcctgacacc

SEQ ID NO: 5064109 - DNA, 17 bp, Homo sapiens
tccagggcctgacaccc

SEQ ID NO: 5064110 - DNA, 22 bp, Homo sapiens
tccagggcctgacaccccctcc

SEQ ID NO: 5064111 - DNA, 13 bp, Homo sapiens
tccagggctctga

SEQ ID NO: 5064112 - DNA, 13 bp, Homo sapiens
tccagggctgccc

SEQ ID NO: 5064113 - DNA, 14 bp, Homo sapiens
tccagggctgcccc

SEQ ID NO: 5064114 - DNA, 14 bp, Homo sapiens
tccagggctggact

SEQ ID NO: 5064115 - DNA, 19 bp, Homo sapiens
tccagggctgttggaggac

SEQ ID NO: 5064116 - DNA, 22 bp, Homo sapiens
tccagggctgttggaggacccc

SEQ ID NO: 5064117 - DNA, 13 bp, Homo sapiens
tccagggcttcag

SEQ ID NO: 5064118 - DNA, 14 bp, Homo sapiens
tccaggggaacctg

SEQ ID NO: 5064119 - DNA, 19 bp, Homo sapiens
tccaggggcccctccagct

SEQ ID NO: 5064120 - DNA, 20 bp, Homo sapiens
tccaggggcccttgggacag

SEQ ID NO: 5064121 - DNA, 18 bp, Homo sapiens
tccaggggcctgcagaag

SEQ ID NO: 5064122 - DNA, 13 bp, Homo sapiens
tccaggggctcct

SEQ ID NO: 5064123 - DNA, 13 bp, Homo sapiens
tccaggggctgca

SEQ ID NO: 5064124 - DNA, 20 bp, Homo sapiens
tccaggggctgcagccccct

SEQ ID NO: 5064125 - DNA, 23 bp, Homo sapiens
tccaggggctgcagccccctgct

SEQ ID NO: 5064126 - DNA, 22 bp, Homo sapiens
tccaggggctgcttcctcctgg

SEQ ID NO: 5064127 - DNA, 19 bp, Homo sapiens
tccagggggaaggccaagg

SEQ ID NO: 5064128 - DNA, 18 bp, Homo sapiens
tccagggggcctgcaggc

SEQ ID NO: 5064129 - DNA, 19 bp, Homo sapiens
tccagggggcctgcaggcc

SEQ ID NO: 5064130 - DNA, 21 bp, Homo sapiens
tccagggggcctgcaggcccc

SEQ ID NO: 5064131 - DNA, 23 bp, Homo sapiens
tccaggggtgccccagacccaga

SEQ ID NO: 5064132 - DNA, 22 bp, Homo sapiens
tccaggggtgggacaccctgtg

SEQ ID NO: 5064133 - DNA, 16 bp, Homo sapiens
tccagggtccctctgt

SEQ ID NO: 5064134 - DNA, 17 bp, Homo sapiens
tccagggtcctctcttc

SEQ ID NO: 5064135 - DNA, 21 bp, Homo sapiens
tccagggtcctctcttccaca

SEQ ID NO: 5064136 - DNA, 23 bp, Homo sapiens
tccagggtcctctcttccacagt

SEQ ID NO: 5064137 - DNA, 20 bp, Homo sapiens
tccagggtctaaagagaaca

SEQ ID NO: 5064138 - DNA, 20 bp, Homo sapiens
tccagggtctggcagagcct

SEQ ID NO: 5064139 - DNA, 23 bp, Homo sapiens
tccagggtctggcagagcctctg

SEQ ID NO: 5064140 - DNA, 16 bp, Homo sapiens
tccagggtcttgggct

SEQ ID NO: 5064141 - DNA, 17 bp, Homo sapiens
tccagggtcttgggcta

SEQ ID NO: 5064142 - DNA, 22 bp, Homo sapiens
tccagggtcttgggctactggc

SEQ ID NO: 5064143 - DNA, 17 bp, Homo sapiens
tccagggtctttactgg

SEQ ID NO: 5064144 - DNA, 20 bp, Homo sapiens
tccagggtgacaaggcctgc

SEQ ID NO: 5064145 - DNA, 19 bp, Homo sapiens
tccagggtggactctgtct

SEQ ID NO: 5064146 - DNA, 20 bp, Homo sapiens
tccagggtggcagcaacaat

SEQ ID NO: 5064147 - DNA, 14 bp, Homo sapiens
tccagggtttctct

SEQ ID NO: 5064148 - DNA, 15 bp, Homo sapiens
tccagggtttctctg

SEQ ID NO: 5064149 - DNA, 17 bp, Homo sapiens
tccaggtaactttgaag

SEQ ID NO: 5064150 - DNA, 17 bp, Homo sapiens
tccaggtaactttgctt

SEQ ID NO: 5064151 - DNA, 15 bp, Homo sapiens
tccaggtacgcacag

SEQ ID NO: 5064152 - DNA, 17 bp, Homo sapiens
tccaggtacgcacagac

SEQ ID NO: 5064153 - DNA, 19 bp, Homo sapiens
tccaggtacgcacagacag

SEQ ID NO: 5064154 - DNA, 20 bp, Homo sapiens
tccaggtacgcacagacagg

SEQ ID NO: 5064155 - DNA, 16 bp, Homo sapiens
tccaggtaggaaacaa

SEQ ID NO: 5064156 - DNA, 16 bp, Homo sapiens
tccaggtatgggacct

SEQ ID NO: 5064157 - DNA, 23 bp, Homo sapiens
tccaggtcaccagcctgactgca

SEQ ID NO: 5064158 - DNA, 21 bp, Homo sapiens
tccaggtcctggtggggcagc

SEQ ID NO: 5064159 - DNA, 22 bp, Homo sapiens
tccaggtcctggtggggcagct

SEQ ID NO: 5064160 - DNA, 19 bp, Homo sapiens
tccaggtcctttccttctc

SEQ ID NO: 5064161 - DNA, 20 bp, Homo sapiens
tccaggtcctttccttctcg

SEQ ID NO: 5064162 - DNA, 21 bp, Homo sapiens
tccaggtcggagtgcctggag

SEQ ID NO: 5064163 - DNA, 24 bp, Homo sapiens
tccaggtcggagtgcctggagtca

SEQ ID NO: 5064164 - DNA, 14 bp, Homo sapiens
tccaggtcgggctc

SEQ ID NO: 5064165 - DNA, 16 bp, Homo sapiens
tccaggtcgggctcag

SEQ ID NO: 5064166 - DNA, 19 bp, Homo sapiens
tccaggtcgggctcagctc

SEQ ID NO: 5064167 - DNA, 20 bp, Homo sapiens
tccaggtcgggctcagctct

SEQ ID NO: 5064168 - DNA, 22 bp, Homo sapiens
tccaggtcgggctcagctctgg

SEQ ID NO: 5064169 - DNA, 16 bp, Homo sapiens
tccaggtctcacgggc

SEQ ID NO: 5064170 - DNA, 14 bp, Homo sapiens
tccaggtctgcctg

SEQ ID NO: 5064171 - DNA, 17 bp, Homo sapiens
tccaggtctgcctggtt

SEQ ID NO: 5064172 - DNA, 16 bp, Homo sapiens
tccaggtcttgactca

SEQ ID NO: 5064173 - DNA, 17 bp, Homo sapiens
tccaggtcttgaggaga

SEQ ID NO: 5064174 - DNA, 18 bp, Homo sapiens
tccaggtgagtgtgaggg

SEQ ID NO: 5064175 - DNA, 20 bp, Homo sapiens
tccaggtgattctgtttcct

SEQ ID NO: 5064176 - DNA, 20 bp, Homo sapiens
tccaggtgcacaagctccaa

SEQ ID NO: 5064177 - DNA, 21 bp, Homo sapiens
tccaggtgcacaagctccaag

SEQ ID NO: 5064178 - DNA, 19 bp, Homo sapiens
tccaggtgccctgtgggag

SEQ ID NO: 5064179 - DNA, 18 bp, Homo sapiens
tccaggtgcctggccctt

SEQ ID NO: 5064180 - DNA, 16 bp, Homo sapiens
tccaggtgggagagac

SEQ ID NO: 5064181 - DNA, 18 bp, Homo sapiens
tccaggtggtgaattttc

SEQ ID NO: 5064182 - DNA, 19 bp, Homo sapiens
tccaggtgtagctaacagt

SEQ ID NO: 5064183 - DNA, 17 bp, Homo sapiens
tccaggtgtgcacgtgg

SEQ ID NO: 5064184 - DNA, 16 bp, Homo sapiens
tccaggtgttactgta

SEQ ID NO: 5064185 - DNA, 18 bp, Homo sapiens
tccaggtgttactgtaat

SEQ ID NO: 5064186 - DNA, 23 bp, Homo sapiens
tccaggttcaacccacagctact

SEQ ID NO: 5064187 - DNA, 15 bp, Homo sapiens
tccaggttcagcttg

SEQ ID NO: 5064188 - DNA, 17 bp, Homo sapiens
tccaggttccatccacc

SEQ ID NO: 5064189 - DNA, 20 bp, Homo sapiens
tccaggttccctcccagagg

SEQ ID NO: 5064190 - DNA, 21 bp, Homo sapiens
tccaggttcgtatagaaaaag

SEQ ID NO: 5064191 - DNA, 21 bp, Homo sapiens
tccaggttgcctcaacagcag

SEQ ID NO: 5064192 - DNA, 22 bp, Homo sapiens
tccaggttgcctcaacagcagg

SEQ ID NO: 5064193 - DNA, 14 bp, Homo sapiens
tccaggtttttcaa

SEQ ID NO: 5064194 - DNA, 19 bp, Homo sapiens
tccaggtttttcaattaaa

SEQ ID NO: 5064195 - DNA, 20 bp, Homo sapiens
tccaggtttttcaattaaac

SEQ ID NO: 5064196 - DNA, 22 bp, Homo sapiens
tccaggtttttcaattaaacgg

SEQ ID NO: 5064197 - DNA, 15 bp, Homo sapiens
tccagtaacccaaat

SEQ ID NO: 5064198 - DNA, 15 bp, Homo sapiens
tccagtaacctcgga

SEQ ID NO: 5064199 - DNA, 18 bp, Homo sapiens
tccagtaacttttttgtg

SEQ ID NO: 5064200 - DNA, 23 bp, Homo sapiens
tccagtaacttttttgtgtatgt

SEQ ID NO: 5064201 - DNA, 20 bp, Homo sapiens
tccagtaagatcactgttta

SEQ ID NO: 5064202 - DNA, 23 bp, Homo sapiens
tccagtaagatcactgtttagat

SEQ ID NO: 5064203 - DNA, 15 bp, Homo sapiens
tccagtaatctaata

SEQ ID NO: 5064204 - DNA, 15 bp, Homo sapiens
tccagtaccttgctt

SEQ ID NO: 5064205 - DNA, 22 bp, Homo sapiens
tccagtaccttgcttcttactg

SEQ ID NO: 5064206 - DNA, 20 bp, Homo sapiens
tccagtacgtcccgctgctg

SEQ ID NO: 5064207 - DNA, 13 bp, Homo sapiens
tccagtactattt

SEQ ID NO: 5064208 - DNA, 16 bp, Homo sapiens
tccagtactttataac

SEQ ID NO: 5064209 - DNA, 23 bp, Homo sapiens
tccagtagcttgggacaaatcaa

SEQ ID NO: 5064210 - DNA, 23 bp, Homo sapiens
tccagtagggaaaatagggtcct

SEQ ID NO: 5064211 - DNA, 21 bp, Homo sapiens
tccagtataaattacatgcat

SEQ ID NO: 5064212 - DNA, 23 bp, Homo sapiens
tccagtataaattacatgcatga

SEQ ID NO: 5064213 - DNA, 22 bp, Homo sapiens
tccagtatggaagaatggggtg

SEQ ID NO: 5064214 - DNA, 13 bp, Homo sapiens
tccagtattcttg

SEQ ID NO: 5064215 - DNA, 21 bp, Homo sapiens
tccagtattgaaaacttcaaa

SEQ ID NO: 5064216 - DNA, 20 bp, Homo sapiens
tccagtcaaatctgggctca

SEQ ID NO: 5064217 - DNA, 21 bp, Homo sapiens
tccagtcaagttccctcctgc

SEQ ID NO: 5064218 - DNA, 14 bp, Homo sapiens
tccagtcagatgag

SEQ ID NO: 5064219 - DNA, 12 bp, Homo sapiens
tccagtcaggct

SEQ ID NO: 5064220 - DNA, 13 bp, Homo sapiens
tccagtcaggctc

SEQ ID NO: 5064221 - DNA, 20 bp, Homo sapiens
tccagtcaggctctctgggc

SEQ ID NO: 5064222 - DNA, 22 bp, Homo sapiens
tccagtcatcctgccctgcagc

SEQ ID NO: 5064223 - DNA, 18 bp, Homo sapiens
tccagtcatctgtaagag

SEQ ID NO: 5064224 - DNA, 23 bp, Homo sapiens
tccagtccaaggaaaccacagct

SEQ ID NO: 5064225 - DNA, 16 bp, Homo sapiens
tccagtccaattttcc

SEQ ID NO: 5064226 - DNA, 18 bp, Homo sapiens
tccagtccaattttccta

SEQ ID NO: 5064227 - DNA, 14 bp, Homo sapiens
tccagtccagtgat

SEQ ID NO: 5064228 - DNA, 18 bp, Homo sapiens
tccagtccccagaagcag

SEQ ID NO: 5064229 - DNA, 23 bp, Homo sapiens
tccagtccccctatccttggcac

SEQ ID NO: 5064230 - DNA, 22 bp, Homo sapiens
tccagtcctatctgggcttcct

SEQ ID NO: 5064231 - DNA, 20 bp, Homo sapiens
tccagtcctcacatgcccgc

SEQ ID NO: 5064232 - DNA, 14 bp, Homo sapiens
tccagtcctgccac

SEQ ID NO: 5064233 - DNA, 20 bp, Homo sapiens
tccagtcctgccaccaccct

SEQ ID NO: 5064234 - DNA, 17 bp, Homo sapiens
tccagtcctgctggcct

SEQ ID NO: 5064235 - DNA, 19 bp, Homo sapiens
tccagtcctgctggcctgc

SEQ ID NO: 5064236 - DNA, 19 bp, Homo sapiens
tccagtcctttgttgctgt

SEQ ID NO: 5064237 - DNA, 15 bp, Homo sapiens
tccagtcgggaggag

SEQ ID NO: 5064238 - DNA, 17 bp, Homo sapiens
tccagtcgttatttctg

SEQ ID NO: 5064239 - DNA, 20 bp, Homo sapiens
tccattatcatgtgtaatca

SEQ ID NO: 5064240 - DNA, 15 bp, Homo sapiens
tccattatcctttat

SEQ ID NO: 5064241 - DNA, 16 bp, Homo sapiens
tccattatctgctgtt

SEQ ID NO: 5064242 - DNA, 17 bp, Homo sapiens
tccattatctgctgttc

SEQ ID NO: 5064243 - DNA, 13 bp, Homo sapiens
tccattatcttat

SEQ ID NO: 5064244 - DNA, 14 bp, Homo sapiens
tccattattcaaga

SEQ ID NO: 5064245 - DNA, 21 bp, Homo sapiens
tccattattcaagaaagatat

SEQ ID NO: 5064246 - DNA, 22 bp, Homo sapiens
tccattattcctctcaccccac

SEQ ID NO: 5064247 - DNA, 11 bp, Homo sapiens
tccattattta

SEQ ID NO: 5064248 - DNA, 15 bp, Homo sapiens
tccattattttgtat

SEQ ID NO: 5064249 - DNA, 18 bp, Homo sapiens
tccattattttgtattct

SEQ ID NO: 5064250 - DNA, 15 bp, Homo sapiens
tccattcacaagcct

SEQ ID NO: 5064251 - DNA, 16 bp, Homo sapiens
tccattcagaaagctt

SEQ ID NO: 5064252 - DNA, 18 bp, Homo sapiens
tccattcagaaagcttca

SEQ ID NO: 5064253 - DNA, 14 bp, Homo sapiens
tccattcagtctgc

SEQ ID NO: 5064254 - DNA, 16 bp, Homo sapiens
tccattcatccttcca

SEQ ID NO: 5064255 - DNA, 14 bp, Homo sapiens
tccattccacatcc

SEQ ID NO: 5064256 - DNA, 18 bp, Homo sapiens
tccattccagagctgcag

SEQ ID NO: 5064257 - DNA, 14 bp, Homo sapiens
tccattccatggaa

SEQ ID NO: 5064258 - DNA, 20 bp, Homo sapiens
tccattcccaagatgcctga

SEQ ID NO: 5064259 - DNA, 16 bp, Homo sapiens
tccattccctccaccc

SEQ ID NO: 5064260 - DNA, 21 bp, Homo sapiens
tccattcctaggtcacttgaa

SEQ ID NO: 5064261 - DNA, 18 bp, Homo sapiens
tccattccttcacatagt

SEQ ID NO: 5064262 - DNA, 12 bp, Homo sapiens
tccattctacat

SEQ ID NO: 5064263 - DNA, 12 bp, Homo sapiens
tccattctatga

SEQ ID NO: 5064264 - DNA, 16 bp, Homo sapiens
tccattctcctcagtg

SEQ ID NO: 5064265 - DNA, 18 bp, Homo sapiens
tccattctcctcagtggc

SEQ ID NO: 5064266 - DNA, 14 bp, Homo sapiens
tccattctcctgag

SEQ ID NO: 5064267 - DNA, 15 bp, Homo sapiens
tccattctctctgcc

SEQ ID NO: 5064268 - DNA, 16 bp, Homo sapiens
tccattctctctgccc

SEQ ID NO: 5064269 - DNA, 20 bp, Homo sapiens
tccattctgaaaatagcagg

SEQ ID NO: 5064270 - DNA, 23 bp, Homo sapiens
tccattctgctttcttgccacac

SEQ ID NO: 5064271 - DNA, 13 bp, Homo sapiens
tccattctggaag

SEQ ID NO: 5064272 - DNA, 13 bp, Homo sapiens
tccattctgggtg

SEQ ID NO: 5064273 - DNA, 15 bp, Homo sapiens
tccattctgggtgtt

SEQ ID NO: 5064274 - DNA, 13 bp, Homo sapiens
tccattcttcagt

SEQ ID NO: 5064275 - DNA, 17 bp, Homo sapiens
tccattcttggcatcta

SEQ ID NO: 5064276 - DNA, 16 bp, Homo sapiens
tccattctttcagctg

SEQ ID NO: 5064277 - DNA, 18 bp, Homo sapiens
tccattctttctgataac

SEQ ID NO: 5064278 - DNA, 19 bp, Homo sapiens
tccattctttctgataact

SEQ ID NO: 5064279 - DNA, 17 bp, Homo sapiens
tccattgaactggaaga

SEQ ID NO: 5064280 - DNA, 18 bp, Homo sapiens
tccattgacatgtacaga

SEQ ID NO: 5064281 - DNA, 12 bp, Homo sapiens
tccattgatgtc

SEQ ID NO: 5064282 - DNA, 20 bp, Homo sapiens
tccattgcatgtattgtaaa

SEQ ID NO: 5064283 - DNA, 14 bp, Homo sapiens
tccattgcattcat

SEQ ID NO: 5064284 - DNA, 15 bp, Homo sapiens
tccattgccacggcc

SEQ ID NO: 5064285 - DNA, 18 bp, Homo sapiens
tccattgctcccagtgcc

SEQ ID NO: 5064286 - DNA, 13 bp, Homo sapiens
tccattgctgttg

SEQ ID NO: 5064287 - DNA, 23 bp, Homo sapiens
tccattggatctgcaagaacact

SEQ ID NO: 5064288 - DNA, 15 bp, Homo sapiens
tccattggtccaaga

SEQ ID NO: 5064289 - DNA, 19 bp, Homo sapiens
tccattggtccaagattcc

SEQ ID NO: 5064290 - DNA, 23 bp, Homo sapiens
tccattggttcttcctttccctg

SEQ ID NO: 5064291 - DNA, 22 bp, Homo sapiens
tccattggtttacctgtgaaat

SEQ ID NO: 5064292 - DNA, 23 bp, Homo sapiens
tccattgtaaaccacaaggctgt

SEQ ID NO: 5064293 - DNA, 17 bp, Homo sapiens
tccattgtattgtctga

SEQ ID NO: 5064294 - DNA, 18 bp, Homo sapiens
tccattgtgccttactaa

SEQ ID NO: 5064295 - DNA, 22 bp, Homo sapiens
tccattgtgtgatccagccctg

SEQ ID NO: 5064296 - DNA, 18 bp, Homo sapiens
tccattgtgtggcctggt

SEQ ID NO: 5064297 - DNA, 23 bp, Homo sapiens
tccattgtttgaaacaaagaagg

SEQ ID NO: 5064298 - DNA, 19 bp, Homo sapiens
tccatttaaaacaagctga

SEQ ID NO: 5064299 - DNA, 14 bp, Homo sapiens
tccatttaaacaga

SEQ ID NO: 5064300 - DNA, 20 bp, Homo sapiens
tccatttaaactaacctttt

SEQ ID NO: 5064301 - DNA, 14 bp, Homo sapiens
tccatttaagacac

SEQ ID NO: 5064302 - DNA, 23 bp, Homo sapiens
tccatttaatggggtgcacctgt

SEQ ID NO: 5064303 - DNA, 19 bp, Homo sapiens
tccatttacagtctctttc

SEQ ID NO: 5064304 - DNA, 14 bp, Homo sapiens
tccatttagttctt

SEQ ID NO: 5064305 - DNA, 22 bp, Homo sapiens
tccatttatatatctaagttca

SEQ ID NO: 5064306 - DNA, 16 bp, Homo sapiens
tccatttatatatgaa

SEQ ID NO: 5064307 - DNA, 19 bp, Homo sapiens
tccatttatatatgaaaac

SEQ ID NO: 5064308 - DNA, 18 bp, Homo sapiens
tccatttatgctggttaa

SEQ ID NO: 5064309 - DNA, 19 bp, Homo sapiens
tccatttatgttttttctg

SEQ ID NO: 5064310 - DNA, 17 bp, Homo sapiens
tccatttatttaaaact

SEQ ID NO: 5064311 - DNA, 17 bp, Homo sapiens
tccatttcaactccaga

SEQ ID NO: 5064312 - DNA, 23 bp, Homo sapiens
tccatttcacacaggtcctgaaa

SEQ ID NO: 5064313 - DNA, 14 bp, Homo sapiens
tccatttcaggact

SEQ ID NO: 5064314 - DNA, 21 bp, Homo sapiens
tccatttcatctatttctgag

SEQ ID NO: 5064315 - DNA, 19 bp, Homo sapiens
tccatttccattgcttatt

SEQ ID NO: 5064316 - DNA, 21 bp, Homo sapiens
tccatttcccaaagtcctctg

SEQ ID NO: 5064317 - DNA, 12 bp, Homo sapiens
tccatttcctaa

SEQ ID NO: 5064318 - DNA, 13 bp, Homo sapiens
tccatttctaatt

SEQ ID NO: 5064319 - DNA, 22 bp, Homo sapiens
tccatttctactgtataaacaa

SEQ ID NO: 5064320 - DNA, 12 bp, Homo sapiens
tccatttctcaa

SEQ ID NO: 5064321 - DNA, 21 bp, Homo sapiens
tccatttctcaatcagtgcag

SEQ ID NO: 5064322 - DNA, 14 bp, Homo sapiens
tccatttctgcaca

SEQ ID NO: 5064323 - DNA, 12 bp, Homo sapiens
tccatttctggc

SEQ ID NO: 5064324 - DNA, 12 bp, Homo sapiens
tccatttctgtc

SEQ ID NO: 5064325 - DNA, 14 bp, Homo sapiens
tccatttcttccac

SEQ ID NO: 5064326 - DNA, 14 bp, Homo sapiens
tccatttctttctt

SEQ ID NO: 5064327 - DNA, 15 bp, Homo sapiens
tccatttctttcttc

SEQ ID NO: 5064328 - DNA, 22 bp, Homo sapiens
tccatttcttttatacctttcc

SEQ ID NO: 5064329 - DNA, 12 bp, Homo sapiens
tccatttgagga

SEQ ID NO: 5064330 - DNA, 12 bp, Homo sapiens
tccatttgcatt

SEQ ID NO: 5064331 - DNA, 15 bp, Homo sapiens
tccatttgcatttgt

SEQ ID NO: 5064332 - DNA, 13 bp, Homo sapiens
tccatttgccttt

SEQ ID NO: 5064333 - DNA, 15 bp, Homo sapiens
tccatttgcctttct

SEQ ID NO: 5064334 - DNA, 15 bp, Homo sapiens
tccatttgctcttca

SEQ ID NO: 5064335 - DNA, 17 bp, Homo sapiens
tccatttggacaaaatg

SEQ ID NO: 5064336 - DNA, 20 bp, Homo sapiens
tccatttggacaaaatggaa

SEQ ID NO: 5064337 - DNA, 19 bp, Homo sapiens
tccatttggattttaaaca

SEQ ID NO: 5064338 - DNA, 21 bp, Homo sapiens
tccatttggattttaaacaaa

SEQ ID NO: 5064339 - DNA, 17 bp, Homo sapiens
tccatttggcactatgg

SEQ ID NO: 5064340 - DNA, 19 bp, Homo sapiens
tccatttggcactatggtt

SEQ ID NO: 5064341 - DNA, 20 bp, Homo sapiens
tccatttggcagaactgctg

SEQ ID NO: 5064342 - DNA, 16 bp, Homo sapiens
tccatttggtcctttc

SEQ ID NO: 5064343 - DNA, 13 bp, Homo sapiens
tccatttgtaaaa

SEQ ID NO: 5064344 - DNA, 21 bp, Homo sapiens
tccatttgtaattaaattatg

SEQ ID NO: 5064345 - DNA, 23 bp, Homo sapiens
tccatttgtaccgaaacaccccg

SEQ ID NO: 5064346 - DNA, 17 bp, Homo sapiens
tccatttgtattcaaat

SEQ ID NO: 5064347 - DNA, 14 bp, Homo sapiens
tccatttgtgtgtg

SEQ ID NO: 5064348 - DNA, 19 bp, Homo sapiens
tccatttgttatctgggaa

SEQ ID NO: 5064349 - DNA, 19 bp, Homo sapiens
tccatttgttcctgcttcc

SEQ ID NO: 5064350 - DNA, 17 bp, Homo sapiens
tccattttaattttaaa

SEQ ID NO: 5064351 - DNA, 20 bp, Homo sapiens
tccattttacgttttagaaa

SEQ ID NO: 5064352 - DNA, 23 bp, Homo sapiens
tccattttaggtgataaaatttt

SEQ ID NO: 5064353 - DNA, 17 bp, Homo sapiens
tccattttcccccacta

SEQ ID NO: 5064354 - DNA, 12 bp, Homo sapiens
tccattttctaa

SEQ ID NO: 5064355 - DNA, 14 bp, Homo sapiens
tccattttcttgtc

SEQ ID NO: 5064356 - DNA, 20 bp, Homo sapiens
tccattttggtgtctttctc

SEQ ID NO: 5064357 - DNA, 13 bp, Homo sapiens
tccattttgtgaa

SEQ ID NO: 5064358 - DNA, 19 bp, Homo sapiens
tccatttttactaaagcag

SEQ ID NO: 5064359 - DNA, 21 bp, Homo sapiens
tccatttttactaaagcagtg

SEQ ID NO: 5064360 - DNA, 14 bp, Homo sapiens
tccatttttcctct

SEQ ID NO: 5064361 - DNA, 16 bp, Homo sapiens
tccatttttcctctgt

SEQ ID NO: 5064362 - DNA, 14 bp, Homo sapiens
tccatttttcttgt

SEQ ID NO: 5064363 - DNA, 16 bp, Homo sapiens
tccatttttgagtaaa

SEQ ID NO: 5064364 - DNA, 13 bp, Homo sapiens
tccatttttgttg

SEQ ID NO: 5064365 - DNA, 23 bp, Homo sapiens
tccattttttcaaggtaatttct

SEQ ID NO: 5064366 - DNA, 19 bp, Homo sapiens
tccattttttcttcccttt

SEQ ID NO: 5064367 - DNA, 15 bp, Homo sapiens
tccattttttgtatt

SEQ ID NO: 5064368 - DNA, 13 bp, Homo sapiens
tccatttttttct

SEQ ID NO: 5064369 - DNA, 16 bp, Homo sapiens
tccatttttttcttta

SEQ ID NO: 5064370 - DNA, 17 bp, Homo sapiens
tccatttttttctttac

SEQ ID NO: 5064371 - DNA, 14 bp, Homo sapiens
tcccaaaaaactac

SEQ ID NO: 5064372 - DNA, 13 bp, Homo sapiens
tcccaaaaagatg

SEQ ID NO: 5064373 - DNA, 12 bp, Homo sapiens
tcccaaaacaat

SEQ ID NO: 5064374 - DNA, 21 bp, Homo sapiens
tcccaaaacaatctatttaaa

SEQ ID NO: 5064375 - DNA, 20 bp, Homo sapiens
tcccaaaacccttacagtga

SEQ ID NO: 5064376 - DNA, 20 bp, Homo sapiens
tcccaaaagcccattcattc

SEQ ID NO: 5064377 - DNA, 17 bp, Homo sapiens
tcccaaaatgctgggat

SEQ ID NO: 5064378 - DNA, 16 bp, Homo sapiens
tcccaaaatgtgcctc

SEQ ID NO: 5064379 - DNA, 22 bp, Homo sapiens
tcccaaaattagggagctcttg

SEQ ID NO: 5064380 - DNA, 14 bp, Homo sapiens
tcccaaaattgttt

SEQ ID NO: 5064381 - DNA, 15 bp, Homo sapiens
tcccaaaattgtttt

SEQ ID NO: 5064382 - DNA, 21 bp, Homo sapiens
tcccaaacacataatttctgt

SEQ ID NO: 5064383 - DNA, 15 bp, Homo sapiens
tcccaaacagagggc

SEQ ID NO: 5064384 - DNA, 20 bp, Homo sapiens
tcccaaaccacgcctcttga

SEQ ID NO: 5064385 - DNA, 22 bp, Homo sapiens
tcccaaacgccctttcctcctc

SEQ ID NO: 5064386 - DNA, 14 bp, Homo sapiens
tcccaaactcccag

SEQ ID NO: 5064387 - DNA, 15 bp, Homo sapiens
tcccaaactcccagg

SEQ ID NO: 5064388 - DNA, 19 bp, Homo sapiens
tcccaaactcccaggacct

SEQ ID NO: 5064389 - DNA, 14 bp, Homo sapiens
tcccaaactttaaa

SEQ ID NO: 5064390 - DNA, 18 bp, Homo sapiens
tcccaaactttaaaatgc

SEQ ID NO: 5064391 - DNA, 20 bp, Homo sapiens
tcccaaactttaaaatgcga

SEQ ID NO: 5064392 - DNA, 21 bp, Homo sapiens
tcccaaactttaaaatgcgaa

SEQ ID NO: 5064393 - DNA, 16 bp, Homo sapiens
tcccaaagagctgcct

SEQ ID NO: 5064394 - DNA, 13 bp, Homo sapiens
tcccaaagcaagg

SEQ ID NO: 5064395 - DNA, 12 bp, Homo sapiens
tcccaaaggcat

SEQ ID NO: 5064396 - DNA, 14 bp, Homo sapiens
tcccaaagggcaca

SEQ ID NO: 5064397 - DNA, 16 bp, Homo sapiens
tcccaaagtcctctgc

SEQ ID NO: 5064398 - DNA, 21 bp, Homo sapiens
tcccaaagtgctaggattaca

SEQ ID NO: 5064399 - DNA, 15 bp, Homo sapiens
tcccaaagtgctgag

SEQ ID NO: 5064400 - DNA, 19 bp, Homo sapiens
tcccaaagtgctgagatta

SEQ ID NO: 5064401 - DNA, 15 bp, Homo sapiens
tcccaaagtgctggg

SEQ ID NO: 5064402 - DNA, 19 bp, Homo sapiens
tcccaaagtgctgggatga

SEQ ID NO: 5064403 - DNA, 20 bp, Homo sapiens
tcccaaagtgctgggattac

SEQ ID NO: 5064404 - DNA, 23 bp, Homo sapiens
tcccaaagtgctgggattacaga

SEQ ID NO: 5064405 - DNA, 21 bp, Homo sapiens
tcccaaagtgttgggattaca

SEQ ID NO: 5064406 - DNA, 17 bp, Homo sapiens
tcccaaataaactcctt

SEQ ID NO: 5064407 - DNA, 22 bp, Homo sapiens
tcccaaataaatttataacaat

SEQ ID NO: 5064408 - DNA, 20 bp, Homo sapiens
tcccaaatatgcccctcccc

SEQ ID NO: 5064409 - DNA, 16 bp, Homo sapiens
tcccaaatccgccagt

SEQ ID NO: 5064410 - DNA, 23 bp, Homo sapiens
tcccaaatcctagactgctcctg

SEQ ID NO: 5064411 - DNA, 17 bp, Homo sapiens
tcccaaatcctatttaa

SEQ ID NO: 5064412 - DNA, 19 bp, Homo sapiens
tcccaaatccttcccaagt

SEQ ID NO: 5064413 - DNA, 15 bp, Homo sapiens
tcccaaatctcaaaa

SEQ ID NO: 5064414 - DNA, 17 bp, Homo sapiens
tcccaaatctgtcagca

SEQ ID NO: 5064415 - DNA, 22 bp, Homo sapiens
tcccaaattccctggacctctg

SEQ ID NO: 5064416 - DNA, 17 bp, Homo sapiens
tcccaaatttgattgat

SEQ ID NO: 5064417 - DNA, 22 bp, Homo sapiens
tcccaaatttgattgatttgaa

SEQ ID NO: 5064418 - DNA, 12 bp, Homo sapiens
tgtcctcagcct

SEQ ID NO: 5064419 - DNA, 22 bp, Homo sapiens
tgtcctcagccttgccagagat

SEQ ID NO: 5064420 - DNA, 12 bp, Homo sapiens
tgtcctcaggga

SEQ ID NO: 5064421 - DNA, 19 bp, Homo sapiens
tgtcctcagggagcaggga

SEQ ID NO: 5064422 - DNA, 14 bp, Homo sapiens
tgtcctcatctata

SEQ ID NO: 5064423 - DNA, 17 bp, Homo sapiens
tgtcctcatctataaaa

SEQ ID NO: 5064424 - DNA, 17 bp, Homo sapiens
tgtcctcatgacccctc

SEQ ID NO: 5064425 - DNA, 16 bp, Homo sapiens
tgtcctcatttctcca

SEQ ID NO: 5064426 - DNA, 21 bp, Homo sapiens
tgtcctccaacaataaagagc

SEQ ID NO: 5064427 - DNA, 15 bp, Homo sapiens
tgtcctccaagtgcc

SEQ ID NO: 5064428 - DNA, 15 bp, Homo sapiens
tgtcctccaccatgc

SEQ ID NO: 5064429 - DNA, 17 bp, Homo sapiens
tgtcctccagaagcctc

SEQ ID NO: 5064430 - DNA, 18 bp, Homo sapiens
tgtcctccagaagcctct

SEQ ID NO: 5064431 - DNA, 21 bp, Homo sapiens
tgtcctccagaagcctctggc

SEQ ID NO: 5064432 - DNA, 22 bp, Homo sapiens
tgtcctccagaagcctctggct

SEQ ID NO: 5064433 - DNA, 16 bp, Homo sapiens
tgtcctccaggagctt

SEQ ID NO: 5064434 - DNA, 18 bp, Homo sapiens
tgtcctcccacagacctg

SEQ ID NO: 5064435 - DNA, 17 bp, Homo sapiens
tgtcctcccacccctcc

SEQ ID NO: 5064436 - DNA, 12 bp, Homo sapiens
tgtcctcccagg

SEQ ID NO: 5064437 - DNA, 17 bp, Homo sapiens
tgtcctcccaggaacca

SEQ ID NO: 5064438 - DNA, 17 bp, Homo sapiens
tgtcctcccatcccctc

SEQ ID NO: 5064439 - DNA, 14 bp, Homo sapiens
tgtcctccccttgg

SEQ ID NO: 5064440 - DNA, 11 bp, Homo sapiens
tgtcctcctct

SEQ ID NO: 5064441 - DNA, 14 bp, Homo sapiens
tgtcctcctctgtg

SEQ ID NO: 5064442 - DNA, 15 bp, Homo sapiens
tgtcctcctctgtga

SEQ ID NO: 5064443 - DNA, 16 bp, Homo sapiens
tgtcctcctctgtgaa

SEQ ID NO: 5064444 - DNA, 17 bp, Homo sapiens
tgtcctcctctgtgaaa

SEQ ID NO: 5064445 - DNA, 13 bp, Homo sapiens
tgtcctcctgctc

SEQ ID NO: 5064446 - DNA, 15 bp, Homo sapiens
tgtcctcctgctctg

SEQ ID NO: 5064447 - DNA, 17 bp, Homo sapiens
tgtcctcctgctctgct

SEQ ID NO: 5064448 - DNA, 14 bp, Homo sapiens
tgtcctcctggaag

SEQ ID NO: 5064449 - DNA, 18 bp, Homo sapiens
tgtcctcctgttcatctg

SEQ ID NO: 5064450 - DNA, 14 bp, Homo sapiens
tgtcctccttcctg

SEQ ID NO: 5064451 - DNA, 11 bp, Homo sapiens
tgtcctccttt

SEQ ID NO: 5064452 - DNA, 17 bp, Homo sapiens
tgtcctccttttcactt

SEQ ID NO: 5064453 - DNA, 14 bp, Homo sapiens
tgtcctcgcagaga

SEQ ID NO: 5064454 - DNA, 21 bp, Homo sapiens
tgtcctctcagaactcctgtg

SEQ ID NO: 5064455 - DNA, 18 bp, Homo sapiens
tgtcctctcagagcctca

SEQ ID NO: 5064456 - DNA, 21 bp, Homo sapiens
tgtcctctcagagcctcagct

SEQ ID NO: 5064457 - DNA, 13 bp, Homo sapiens
tgtcctctccccc

SEQ ID NO: 5064458 - DNA, 20 bp, Homo sapiens
tgtcctctcccccaaccccc

SEQ ID NO: 5064459 - DNA, 14 bp, Homo sapiens
tgtcctctccccct

SEQ ID NO: 5064460 - DNA, 17 bp, Homo sapiens
tgtcctctcccccttca

SEQ ID NO: 5064461 - DNA, 23 bp, Homo sapiens
tgtcctctcccctctgccctgta

SEQ ID NO: 5064462 - DNA, 20 bp, Homo sapiens
tgtcctctcgagcccagatg

SEQ ID NO: 5064463 - DNA, 19 bp, Homo sapiens
tgtcctctctggctgggga

SEQ ID NO: 5064464 - DNA, 22 bp, Homo sapiens
tgtcctctgcaagcttcttgct

SEQ ID NO: 5064465 - DNA, 17 bp, Homo sapiens
tgtcctctgcctgggct

SEQ ID NO: 5064466 - DNA, 18 bp, Homo sapiens
tgtcctctgctttgctgt

SEQ ID NO: 5064467 - DNA, 17 bp, Homo sapiens
tgtcctctgtcagtcat

SEQ ID NO: 5064468 - DNA, 13 bp, Homo sapiens
tgtcctctgtccg

SEQ ID NO: 5064469 - DNA, 16 bp, Homo sapiens
tgtcctctgtccgtct

SEQ ID NO: 5064470 - DNA, 16 bp, Homo sapiens
tgtcctcttccctctc

SEQ ID NO: 5064471 - DNA, 18 bp, Homo sapiens
tgtcctcttctgctcttt

SEQ ID NO: 5064472 - DNA, 23 bp, Homo sapiens
tgtcctcttctgctcttttcctg

SEQ ID NO: 5064473 - DNA, 15 bp, Homo sapiens
tgtcctcttctgtga

SEQ ID NO: 5064474 - DNA, 23 bp, Homo sapiens
tgtcctcttgctcaaaaatctgt

SEQ ID NO: 5064475 - DNA, 19 bp, Homo sapiens
tgtcctctttcagaaaaca

SEQ ID NO: 5064476 - DNA, 14 bp, Homo sapiens
tgtcctctttcagc

SEQ ID NO: 5064477 - DNA, 17 bp, Homo sapiens
tgtcctctttcagctcc

SEQ ID NO: 5064478 - DNA, 19 bp, Homo sapiens
tgtcctctttcagctcctg

SEQ ID NO: 5064479 - DNA, 22 bp, Homo sapiens
tgtcctcttttgttgtttctta

SEQ ID NO: 5064480 - DNA, 19 bp, Homo sapiens
tgtcctgaaacatgaaccc

SEQ ID NO: 5064481 - DNA, 15 bp, Homo sapiens
tgtcctgaaagcggc

SEQ ID NO: 5064482 - DNA, 18 bp, Homo sapiens
tgtcctgaaagcggctgc

SEQ ID NO: 5064483 - DNA, 20 bp, Homo sapiens
tgtcctgaaagcggctgcct

SEQ ID NO: 5064484 - DNA, 16 bp, Homo sapiens
tgtcctgaagcccagc

SEQ ID NO: 5064485 - DNA, 20 bp, Homo sapiens
tgtcctgaagctgctggagc

SEQ ID NO: 5064486 - DNA, 21 bp, Homo sapiens
tgtcctgaatggctttgtctt

SEQ ID NO: 5064487 - DNA, 14 bp, Homo sapiens
tgtcctgaccaccc

SEQ ID NO: 5064488 - DNA, 21 bp, Homo sapiens
tgtcctgaccaccctcccctc

SEQ ID NO: 5064489 - DNA, 22 bp, Homo sapiens
tgtcctgaccaccctcccctct

SEQ ID NO: 5064490 - DNA, 17 bp, Homo sapiens
tgtcctgacctgtctca

SEQ ID NO: 5064491 - DNA, 21 bp, Homo sapiens
tgtcctgacttcaggggctgc

SEQ ID NO: 5064492 - DNA, 18 bp, Homo sapiens
tgtcctgagccccaggga

SEQ ID NO: 5064493 - DNA, 21 bp, Homo sapiens
tgtcctgagccccctgcaccc

SEQ ID NO: 5064494 - DNA, 21 bp, Homo sapiens
tgtcctgagctaacactaaaa

SEQ ID NO: 5064495 - DNA, 20 bp, Homo sapiens
tgtcctgatggtcagctccc

SEQ ID NO: 5064496 - DNA, 21 bp, Homo sapiens
tgtcctgatggtcagctccct

SEQ ID NO: 5064497 - DNA, 13 bp, Homo sapiens
tgtcctgatttct

SEQ ID NO: 5064498 - DNA, 17 bp, Homo sapiens
tgtcctgcacaccctgg

SEQ ID NO: 5064499 - DNA, 18 bp, Homo sapiens
tgtcctgcaccggggcct

SEQ ID NO: 5064500 - DNA, 15 bp, Homo sapiens
tgtcctgcagagctg

SEQ ID NO: 5064501 - DNA, 16 bp, Homo sapiens
tgtcctgcagagctgg

SEQ ID NO: 5064502 - DNA, 19 bp, Homo sapiens
tgtcctgcagagctggggg

SEQ ID NO: 5064503 - DNA, 21 bp, Homo sapiens
tgtcctgcatgtatgccatgt

SEQ ID NO: 5064504 - DNA, 18 bp, Homo sapiens
tgtcctgccacccagccc

SEQ ID NO: 5064505 - DNA, 14 bp, Homo sapiens
tgtcctgccagctg

SEQ ID NO: 5064506 - DNA, 15 bp, Homo sapiens
tgtcctgccagctgc

SEQ ID NO: 5064507 - DNA, 21 bp, Homo sapiens
tgtcctgccccccagcctagg

SEQ ID NO: 5064508 - DNA, 17 bp, Homo sapiens
tgtcctgcctattatct

SEQ ID NO: 5064509 - DNA, 24 bp, Homo sapiens
tgtcctgcctattatctgtcagct

SEQ ID NO: 5064510 - DNA, 16 bp, Homo sapiens
tgtcctgcctcctcat

SEQ ID NO: 5064511 - DNA, 21 bp, Homo sapiens
tgtcctgcctctctgctccag

SEQ ID NO: 5064512 - DNA, 13 bp, Homo sapiens
tgtcctgcctctt

SEQ ID NO: 5064513 - DNA, 22 bp, Homo sapiens
tgtcctgcctgcaatatttgaa

SEQ ID NO: 5064514 - DNA, 12 bp, Homo sapiens
tgtcctgcctgt

SEQ ID NO: 5064515 - DNA, 14 bp, Homo sapiens
tgtcctgcctgtct

SEQ ID NO: 5064516 - DNA, 15 bp, Homo sapiens
tgtcctgccttgatg

SEQ ID NO: 5064517 - DNA, 13 bp, Homo sapiens
tgtcctgcgcctg

SEQ ID NO: 5064518 - DNA, 15 bp, Homo sapiens
tgtcctgcgttttct

SEQ ID NO: 5064519 - DNA, 18 bp, Homo sapiens
tgtcctgctacctttgtc

SEQ ID NO: 5064520 - DNA, 17 bp, Homo sapiens
tgtcctgctagctgtct

SEQ ID NO: 5064521 - DNA, 10 bp, Homo sapiens
tgtcctgctc

SEQ ID NO: 5064522 - DNA, 12 bp, Homo sapiens
tgtcctgctcac

SEQ ID NO: 5064523 - DNA, 15 bp, Homo sapiens
tgtcctgctcacctg

SEQ ID NO: 5064524 - DNA, 17 bp, Homo sapiens
tgtcctgctccacagtg

SEQ ID NO: 5064525 - DNA, 17 bp, Homo sapiens
tgtcctgctctcttcag

SEQ ID NO: 5064526 - DNA, 19 bp, Homo sapiens
tgtcctgctctgtttggtg

SEQ ID NO: 5064527 - DNA, 14 bp, Homo sapiens
tgtcctgctgccct

SEQ ID NO: 5064528 - DNA, 16 bp, Homo sapiens
tgtcctgctggcttcc

SEQ ID NO: 5064529 - DNA, 18 bp, Homo sapiens
tgtcctgctggcttccag

SEQ ID NO: 5064530 - DNA, 12 bp, Homo sapiens
tgtcctgctgtg

SEQ ID NO: 5064531 - DNA, 22 bp, Homo sapiens
tgtcctgcttatacttttctca

SEQ ID NO: 5064532 - DNA, 15 bp, Homo sapiens
tgtcctgcttctgaa

SEQ ID NO: 5064533 - DNA, 24 bp, Homo sapiens
tgtcctggaaccaggcttgcctgg

SEQ ID NO: 5064534 - DNA, 12 bp, Homo sapiens
tgtcctggccct

SEQ ID NO: 5064535 - DNA, 18 bp, Homo sapiens
tgtcctggcccttcagtc

SEQ ID NO: 5064536 - DNA, 21 bp, Homo sapiens
tgtcctggcccttcagtctgc

SEQ ID NO: 5064537 - DNA, 19 bp, Homo sapiens
tgtcctgggagtgagctgg

SEQ ID NO: 5064538 - DNA, 10 bp, Homo sapiens
tgtcctgggc

SEQ ID NO: 5064539 - DNA, 14 bp, Homo sapiens
tgtcctgggcctgc

SEQ ID NO: 5064540 - DNA, 17 bp, Homo sapiens
tgtcctgggcctgcccc

SEQ ID NO: 5064541 - DNA, 17 bp, Homo sapiens
tgtcctgggctggtggc

SEQ ID NO: 5064542 - DNA, 21 bp, Homo sapiens
tgtcctggtaattcctctcca

SEQ ID NO: 5064543 - DNA, 18 bp, Homo sapiens
tgtcctggtacagcaggg

SEQ ID NO: 5064544 - DNA, 16 bp, Homo sapiens
tgtcctggtggctggg

SEQ ID NO: 5064545 - DNA, 23 bp, Homo sapiens
tgtcctggtggctgggcccagca

SEQ ID NO: 5064546 - DNA, 17 bp, Homo sapiens
tgtcctggtggtatttt

SEQ ID NO: 5064547 - DNA, 18 bp, Homo sapiens
tgtcctggtggtattttc

SEQ ID NO: 5064548 - DNA, 20 bp, Homo sapiens
tgtcctggtggtattttcaa

SEQ ID NO: 5064549 - DNA, 16 bp, Homo sapiens
tgtcctggtgtcactt

SEQ ID NO: 5064550 - DNA, 15 bp, Homo sapiens
tgtcctggttcccgt

SEQ ID NO: 5064551 - DNA, 22 bp, Homo sapiens
tgtcctgtaaaggttacaagcc

SEQ ID NO: 5064552 - DNA, 13 bp, Homo sapiens
tgtcctgtagctt

SEQ ID NO: 5064553 - DNA, 14 bp, Homo sapiens
tgtcctgtcctgct

SEQ ID NO: 5064554 - DNA, 15 bp, Homo sapiens
tgtcctgtcctgctc

SEQ ID NO: 5064555 - DNA, 14 bp, Homo sapiens
tgtcctgtcctggt

SEQ ID NO: 5064556 - DNA, 18 bp, Homo sapiens
tgtcctgtcctggtcctg

SEQ ID NO: 5064557 - DNA, 14 bp, Homo sapiens
tgtcctgtctttga

SEQ ID NO: 5064558 - DNA, 23 bp, Homo sapiens
tgtcctgtgaagtaacccctcct

SEQ ID NO: 5064559 - DNA, 13 bp, Homo sapiens
tgtcctgtgaatg

SEQ ID NO: 5064560 - DNA, 15 bp, Homo sapiens
tgtcctgtgagatgt

SEQ ID NO: 5064561 - DNA, 23 bp, Homo sapiens
tgtcctgtgagatgtgtatcagt

SEQ ID NO: 5064562 - DNA, 13 bp, Homo sapiens
tgtcctgtgaggt

SEQ ID NO: 5064563 - DNA, 21 bp, Homo sapiens
tgtcctgtgaggtttcccaat

SEQ ID NO: 5064564 - DNA, 18 bp, Homo sapiens
tgtcctgtgatctgtgta

SEQ ID NO: 5064565 - DNA, 16 bp, Homo sapiens
tgtcctgtgtcagttt

SEQ ID NO: 5064566 - DNA, 18 bp, Homo sapiens
tgtcctgtgtcagtttat

SEQ ID NO: 5064567 - DNA, 13 bp, Homo sapiens
tgtcctgtgtcta

SEQ ID NO: 5064568 - DNA, 23 bp, Homo sapiens
tgtcctgtgtctatgtacctcta

SEQ ID NO: 5064569 - DNA, 18 bp, Homo sapiens
tgtcctgttaatttatag

SEQ ID NO: 5064570 - DNA, 20 bp, Homo sapiens
tgtccttacccatctgcacc

SEQ ID NO: 5064571 - DNA, 15 bp, Homo sapiens
tgtccttactcagag

SEQ ID NO: 5064572 - DNA, 19 bp, Homo sapiens
tgtccttactcagagctgc

SEQ ID NO: 5064573 - DNA, 23 bp, Homo sapiens
tgtccttactcagagctgcgggc

SEQ ID NO: 5064574 - DNA, 19 bp, Homo sapiens
tgtccttagactccttctc

SEQ ID NO: 5064575 - DNA, 15 bp, Homo sapiens
tgtccttagcctgga

SEQ ID NO: 5064576 - DNA, 17 bp, Homo sapiens
tgtccttagcctggacc

SEQ ID NO: 5064577 - DNA, 15 bp, Homo sapiens
tgtccttagtgtata

SEQ ID NO: 5064578 - DNA, 19 bp, Homo sapiens
tgtccttcagagctcttca

SEQ ID NO: 5064579 - DNA, 16 bp, Homo sapiens
tgtccttccattttca

SEQ ID NO: 5064580 - DNA, 23 bp, Homo sapiens
tgtccttcccacggccactgcag

SEQ ID NO: 5064581 - DNA, 15 bp, Homo sapiens
tgtccttcccccagc

SEQ ID NO: 5064582 - DNA, 16 bp, Homo sapiens
tgtccttcccccagca

SEQ ID NO: 5064583 - DNA, 17 bp, Homo sapiens
tgtccttccctcaaaga

SEQ ID NO: 5064584 - DNA, 22 bp, Homo sapiens
tgtccttccctgcatttctgag

SEQ ID NO: 5064585 - DNA, 17 bp, Homo sapiens
tgtccttccctgccact

SEQ ID NO: 5064586 - DNA, 15 bp, Homo sapiens
tgtccttccttccat

SEQ ID NO: 5064587 - DNA, 13 bp, Homo sapiens
tgtccttctactc

SEQ ID NO: 5064588 - DNA, 18 bp, Homo sapiens
tgtccttctctcacctcc

SEQ ID NO: 5064589 - DNA, 20 bp, Homo sapiens
tgtccttgaacccaacagtc

SEQ ID NO: 5064590 - DNA, 21 bp, Homo sapiens
tgtccttgaactgaggccctg

SEQ ID NO: 5064591 - DNA, 18 bp, Homo sapiens
tgtccttgaagcttgtat

SEQ ID NO: 5064592 - DNA, 19 bp, Homo sapiens
tgtccttgaagcttgtatc

SEQ ID NO: 5064593 - DNA, 22 bp, Homo sapiens
tgtccttgaagcttgtatctga

SEQ ID NO: 5064594 - DNA, 17 bp, Homo sapiens
tgtccttgcacctgagc

SEQ ID NO: 5064595 - DNA, 15 bp, Homo sapiens
tgtccttgcaggggc

SEQ ID NO: 5064596 - DNA, 20 bp, Homo sapiens
tgtctctgctcttgcctgca

SEQ ID NO: 5064597 - DNA, 15 bp, Homo sapiens
tgtctctgcttccat

SEQ ID NO: 5064598 - DNA, 17 bp, Homo sapiens
tgtctctgcttccatgg

SEQ ID NO: 5064599 - DNA, 15 bp, Homo sapiens
tgtctctgctttcct

SEQ ID NO: 5064600 - DNA, 16 bp, Homo sapiens
tgtctctgctttcctt

SEQ ID NO: 5064601 - DNA, 18 bp, Homo sapiens
tgtctctggcgtgtgggt

SEQ ID NO: 5064602 - DNA, 11 bp, Homo sapiens
tgtctctgggg

SEQ ID NO: 5064603 - DNA, 16 bp, Homo sapiens
tgtctctgtcatggta

SEQ ID NO: 5064604 - DNA, 22 bp, Homo sapiens
tgtctctgtggaaaagccatct

SEQ ID NO: 5064605 - DNA, 18 bp, Homo sapiens
tgtctctgttcagatgtg

SEQ ID NO: 5064606 - DNA, 21 bp, Homo sapiens
tgtctctgttggtccactgtg

SEQ ID NO: 5064607 - DNA, 20 bp, Homo sapiens
tgtctcttaaaaaaataaaa

SEQ ID NO: 5064608 - DNA, 17 bp, Homo sapiens
tgtctcttagaaatact

SEQ ID NO: 5064609 - DNA, 13 bp, Homo sapiens
tgtctcttccata

SEQ ID NO: 5064610 - DNA, 20 bp, Homo sapiens
tgtctcttcctctgttctat

SEQ ID NO: 5064611 - DNA, 15 bp, Homo sapiens
tgtctcttctaacat

SEQ ID NO: 5064612 - DNA, 15 bp, Homo sapiens
tgtctcttctatgta

SEQ ID NO: 5064613 - DNA, 17 bp, Homo sapiens
tgtctcttctttagaac

SEQ ID NO: 5064614 - DNA, 13 bp, Homo sapiens
tgtctcttgagca

SEQ ID NO: 5064615 - DNA, 23 bp, Homo sapiens
tgtctcttgagcatcaatcttgt

SEQ ID NO: 5064616 - DNA, 15 bp, Homo sapiens
tgtctcttgcctgcc

SEQ ID NO: 5064617 - DNA, 19 bp, Homo sapiens
tgtctcttgcctgccactg

SEQ ID NO: 5064618 - DNA, 22 bp, Homo sapiens
tgtctcttgcctgccactgtgt

SEQ ID NO: 5064619 - DNA, 22 bp, Homo sapiens
tgtctcttggctttgtcacttt

SEQ ID NO: 5064620 - DNA, 14 bp, Homo sapiens
tgtctcttgggaag

SEQ ID NO: 5064621 - DNA, 19 bp, Homo sapiens
tgtctcttgggaagcagtt

SEQ ID NO: 5064622 - DNA, 20 bp, Homo sapiens
tgtctcttgggaagcagttt

SEQ ID NO: 5064623 - DNA, 18 bp, Homo sapiens
tgtctcttggtcctgctg

SEQ ID NO: 5064624 - DNA, 21 bp, Homo sapiens
tgtctcttgttaaatgagctt

SEQ ID NO: 5064625 - DNA, 22 bp, Homo sapiens
tgtctctttaagggcatgcctt

SEQ ID NO: 5064626 - DNA, 20 bp, Homo sapiens
tgtctctttaagttttgatt

SEQ ID NO: 5064627 - DNA, 23 bp, Homo sapiens
tgtctctttgcaactcctgtaat

SEQ ID NO: 5064628 - DNA, 14 bp, Homo sapiens
tgtctctttgccaa

SEQ ID NO: 5064629 - DNA, 23 bp, Homo sapiens
tgtctctttggcgacctcctttc

SEQ ID NO: 5064630 - DNA, 14 bp, Homo sapiens
tgtctcttttctct

SEQ ID NO: 5064631 - DNA, 16 bp, Homo sapiens
tgtctcttttctcttt

SEQ ID NO: 5064632 - DNA, 16 bp, Homo sapiens
tgtctcttttttaagt

SEQ ID NO: 5064633 - DNA, 22 bp, Homo sapiens
tgtctgaaaaatgcctgctgct

SEQ ID NO: 5064634 - DNA, 16 bp, Homo sapiens
tgtctgaaacagagaa

SEQ ID NO: 5064635 - DNA, 21 bp, Homo sapiens
tgtctgaaacagagaaccaaa

SEQ ID NO: 5064636 - DNA, 17 bp, Homo sapiens
tgtctgaaaccagaaga

SEQ ID NO: 5064637 - DNA, 22 bp, Homo sapiens
tgtctgaaattttctagaatac

SEQ ID NO: 5064638 - DNA, 13 bp, Homo sapiens
tgtctgaacaaag

SEQ ID NO: 5064639 - DNA, 15 bp, Homo sapiens
tgtctgaacatagaa

SEQ ID NO: 5064640 - DNA, 15 bp, Homo sapiens
tgtctgaacccaggc

SEQ ID NO: 5064641 - DNA, 16 bp, Homo sapiens
tgtctgaacccaggca

SEQ ID NO: 5064642 - DNA, 23 bp, Homo sapiens
tgtctgaacccaggcagctggca

SEQ ID NO: 5064643 - DNA, 13 bp, Homo sapiens
tgtctgaacttgc

SEQ ID NO: 5064644 - DNA, 18 bp, Homo sapiens
tgtctgaacttgcattgt

SEQ ID NO: 5064645 - DNA, 12 bp, Homo sapiens
tgtctgaacttt

SEQ ID NO: 5064646 - DNA, 17 bp, Homo sapiens
tgtctgaactttgggaa

SEQ ID NO: 5064647 - DNA, 12 bp, Homo sapiens
tgtctgaagcca

SEQ ID NO: 5064648 - DNA, 17 bp, Homo sapiens
tgtctgaagcccaaagc

SEQ ID NO: 5064649 - DNA, 19 bp, Homo sapiens
tgtctgaaggacacttcct

SEQ ID NO: 5064650 - DNA, 12 bp, Homo sapiens
tgtctgaaggat

SEQ ID NO: 5064651 - DNA, 15 bp, Homo sapiens
tgtctgaagtacaaa

SEQ ID NO: 5064652 - DNA, 20 bp, Homo sapiens
tgtctgaagtacaaacatga

SEQ ID NO: 5064653 - DNA, 17 bp, Homo sapiens
tgtctgaagtcactgca

SEQ ID NO: 5064654 - DNA, 18 bp, Homo sapiens
tgtctgaagtcactgcac

SEQ ID NO: 5064655 - DNA, 19 bp, Homo sapiens
tgtctgaagtcactgcaca

SEQ ID NO: 5064656 - DNA, 20 bp, Homo sapiens
tgtctgaagtcactgcacag

SEQ ID NO: 5064657 - DNA, 22 bp, Homo sapiens
tgtctgaatcgagtgagacaaa

SEQ ID NO: 5064658 - DNA, 22 bp, Homo sapiens
tgtctgaattattctgcctacg

SEQ ID NO: 5064659 - DNA, 20 bp, Homo sapiens
tgtctgaattgagaaaagag

SEQ ID NO: 5064660 - DNA, 17 bp, Homo sapiens
tgtctgacttctcagga

SEQ ID NO: 5064661 - DNA, 17 bp, Homo sapiens
tgtctgacttttgttaa

SEQ ID NO: 5064662 - DNA, 14 bp, Homo sapiens
tgtctgagagacca

SEQ ID NO: 5064663 - DNA, 15 bp, Homo sapiens
tgtctgagagaccat

SEQ ID NO: 5064664 - DNA, 13 bp, Homo sapiens
tgtctgagcccaa

SEQ ID NO: 5064665 - DNA, 18 bp, Homo sapiens
tgtctgaggagtaagtgt

SEQ ID NO: 5064666 - DNA, 19 bp, Homo sapiens
tgtctgaggagtaagtgta

SEQ ID NO: 5064667 - DNA, 23 bp, Homo sapiens
tgtctgaggagtaagtgtacaat

SEQ ID NO: 5064668 - DNA, 20 bp, Homo sapiens
tgtctgaggtgacttaaaaa

SEQ ID NO: 5064669 - DNA, 17 bp, Homo sapiens
tgtctgagtagtggcca

SEQ ID NO: 5064670 - DNA, 14 bp, Homo sapiens
tgtctgagtgaacc

SEQ ID NO: 5064671 - DNA, 20 bp, Homo sapiens
tgtctgagtgaacctgtata

SEQ ID NO: 5064672 - DNA, 14 bp, Homo sapiens
tgtctgataatgat

SEQ ID NO: 5064673 - DNA, 21 bp, Homo sapiens
tgtctgatcgttcaaagcatg

SEQ ID NO: 5064674 - DNA, 15 bp, Homo sapiens
tgtctgatctgtgct

SEQ ID NO: 5064675 - DNA, 16 bp, Homo sapiens
tgtctgattggcttgt

SEQ ID NO: 5064676 - DNA, 14 bp, Homo sapiens
tgtctgatttttaa

SEQ ID NO: 5064677 - DNA, 19 bp, Homo sapiens
tgtctgcaaaggagggcct

SEQ ID NO: 5064678 - DNA, 15 bp, Homo sapiens
tgtctgcaatggtga

SEQ ID NO: 5064679 - DNA, 13 bp, Homo sapiens
tgtctgcacctcc

SEQ ID NO: 5064680 - DNA, 22 bp, Homo sapiens
tgtctgcactgaggatttcttt

SEQ ID NO: 5064681 - DNA, 22 bp, Homo sapiens
tgtctgcagcaccgtgggccct

SEQ ID NO: 5064682 - DNA, 12 bp, Homo sapiens
tgtctgcagccc

SEQ ID NO: 5064683 - DNA, 13 bp, Homo sapiens
tgtctgcagccct

SEQ ID NO: 5064684 - DNA, 18 bp, Homo sapiens
tgtctgcagccctgagaa

SEQ ID NO: 5064685 - DNA, 12 bp, Homo sapiens
tgtctgcagctc

SEQ ID NO: 5064686 - DNA, 17 bp, Homo sapiens
tgtctgcagctcctgga

SEQ ID NO: 5064687 - DNA, 18 bp, Homo sapiens
tgtctgcaggtttctcct

SEQ ID NO: 5064688 - DNA, 23 bp, Homo sapiens
tgtctgcagtcctggtggggctg

SEQ ID NO: 5064689 - DNA, 21 bp, Homo sapiens
tgtctgcatttcggtggctag

SEQ ID NO: 5064690 - DNA, 15 bp, Homo sapiens
tgtctgccaaaatgc

SEQ ID NO: 5064691 - DNA, 17 bp, Homo sapiens
tgtctgccaaaatgcaa

SEQ ID NO: 5064692 - DNA, 19 bp, Homo sapiens
tgtctgccaacctaaaact

SEQ ID NO: 5064693 - DNA, 16 bp, Homo sapiens
tgtctgccagccagca

SEQ ID NO: 5064694 - DNA, 19 bp, Homo sapiens
tgtctgccagccagcagcc

SEQ ID NO: 5064695 - DNA, 15 bp, Homo sapiens
tgtctgccaggcact

SEQ ID NO: 5064696 - DNA, 18 bp, Homo sapiens
tgtctgccatgttgcccc

SEQ ID NO: 5064697 - DNA, 22 bp, Homo sapiens
tgtctgccccaagttttgtgaa

SEQ ID NO: 5064698 - DNA, 22 bp, Homo sapiens
tgtctgcccccgtcttctctcc

SEQ ID NO: 5064699 - DNA, 13 bp, Homo sapiens
tgtctgccccctc

SEQ ID NO: 5064700 - DNA, 15 bp, Homo sapiens
tgtctgccctctggg

SEQ ID NO: 5064701 - DNA, 16 bp, Homo sapiens
tgtctgccctctgggt

SEQ ID NO: 5064702 - DNA, 14 bp, Homo sapiens
tgtctgcctcctgc

SEQ ID NO: 5064703 - DNA, 15 bp, Homo sapiens
tgtctgcctcctgct

SEQ ID NO: 5064704 - DNA, 15 bp, Homo sapiens
tgtctgcctcttaga

SEQ ID NO: 5064705 - DNA, 13 bp, Homo sapiens
tgtctgcctgcct

SEQ ID NO: 5064706 - DNA, 14 bp, Homo sapiens
tgtctgcctgcctc

SEQ ID NO: 5064707 - DNA, 18 bp, Homo sapiens
tgtctgccttaggctgct

SEQ ID NO: 5064708 - DNA, 13 bp, Homo sapiens
tgtctgccttcac

SEQ ID NO: 5064709 - DNA, 15 bp, Homo sapiens
tgtctgcctttaaat

SEQ ID NO: 5064710 - DNA, 16 bp, Homo sapiens
tgtctgcggagccagc

SEQ ID NO: 5064711 - DNA, 17 bp, Homo sapiens
tgtctgcggagccagcg

SEQ ID NO: 5064712 - DNA, 14 bp, Homo sapiens
tgtctgctaatgta

SEQ ID NO: 5064713 - DNA, 23 bp, Homo sapiens
tgtctgctaggcgctggggagac

SEQ ID NO: 5064714 - DNA, 23 bp, Homo sapiens
tgtctgctgactgtttcattcac

SEQ ID NO: 5064715 - DNA, 10 bp, Homo sapiens
tgtctgctgc

SEQ ID NO: 5064716 - DNA, 17 bp, Homo sapiens
tgtctgctgccagcaca

SEQ ID NO: 5064717 - DNA, 19 bp, Homo sapiens
tgtctgctgcctccaagtc

SEQ ID NO: 5064718 - DNA, 17 bp, Homo sapiens
tgtctgctggtatttct

SEQ ID NO: 5064719 - DNA, 18 bp, Homo sapiens
tgtctgctggtcacttct

SEQ ID NO: 5064720 - DNA, 23 bp, Homo sapiens
tgtctgctggtcacttcttctgt

SEQ ID NO: 5064721 - DNA, 17 bp, Homo sapiens
tgtctgcttctctctct

SEQ ID NO: 5064722 - DNA, 13 bp, Homo sapiens
tgtctgcttctgt

SEQ ID NO: 5064723 - DNA, 19 bp, Homo sapiens
tgtctgcttctgtccagga

SEQ ID NO: 5064724 - DNA, 19 bp, Homo sapiens
tgtctgctttctccattgt

SEQ ID NO: 5064725 - DNA, 13 bp, Homo sapiens
tgtctgctttggt

SEQ ID NO: 5064726 - DNA, 17 bp, Homo sapiens
tgtctggaaaagcactt

SEQ ID NO: 5064727 - DNA, 23 bp, Homo sapiens
tgtctggaaacctgtcattgtat

SEQ ID NO: 5064728 - DNA, 23 bp, Homo sapiens
tgtctggaacatggactttcttg

SEQ ID NO: 5064729 - DNA, 16 bp, Homo sapiens
tgtctggaatcccagc

SEQ ID NO: 5064730 - DNA, 17 bp, Homo sapiens
tgtctggaatcccagct

SEQ ID NO: 5064731 - DNA, 15 bp, Homo sapiens
tgtctggaattgtgg

SEQ ID NO: 5064732 - DNA, 13 bp, Homo sapiens
tgtctggagacca

SEQ ID NO: 5064733 - DNA, 17 bp, Homo sapiens
tgtctggagaccaccag

SEQ ID NO: 5064734 - DNA, 18 bp, Homo sapiens
tgtctggagaccaccagg

SEQ ID NO: 5064735 - DNA, 21 bp, Homo sapiens
tgtctggagaccaccagggca

SEQ ID NO: 5064736 - DNA, 13 bp, Homo sapiens
tgtctggagcctg

SEQ ID NO: 5064737 - DNA, 14 bp, Homo sapiens
tgtctggagcctgc

SEQ ID NO: 5064738 - DNA, 19 bp, Homo sapiens
tgtctggagcctgcaggca

SEQ ID NO: 5064739 - DNA, 21 bp, Homo sapiens
tgtctggagtcccctcctcca

SEQ ID NO: 5064740 - DNA, 16 bp, Homo sapiens
tgtctggatccttccc

SEQ ID NO: 5064741 - DNA, 21 bp, Homo sapiens
tgtctggatgatgctgtgcta

SEQ ID NO: 5064742 - DNA, 15 bp, Homo sapiens
tgtctggattcccag

SEQ ID NO: 5064743 - DNA, 15 bp, Homo sapiens
tgtctggcaatgcca

SEQ ID NO: 5064744 - DNA, 17 bp, Homo sapiens
tgtctggcacagcctgc

SEQ ID NO: 5064745 - DNA, 16 bp, Homo sapiens
tgtctggccagggagg

SEQ ID NO: 5064746 - DNA, 15 bp, Homo sapiens
tgtctggcccagcca

SEQ ID NO: 5064747 - DNA, 19 bp, Homo sapiens
tgtctggcccagccatggc

SEQ ID NO: 5064748 - DNA, 12 bp, Homo sapiens
tgtctggcctca

SEQ ID NO: 5064749 - DNA, 15 bp, Homo sapiens
tgtctggccttggga

SEQ ID NO: 5064750 - DNA, 20 bp, Homo sapiens
tgtctggctcggacccaccc

SEQ ID NO: 5064751 - DNA, 14 bp, Homo sapiens
tgtctggctgaagc

SEQ ID NO: 5064752 - DNA, 14 bp, Homo sapiens
tgtctggctgtacg

SEQ ID NO: 5064753 - DNA, 18 bp, Homo sapiens
tgtctggctgtggcccct

SEQ ID NO: 5064754 - DNA, 17 bp, Homo sapiens
tgtctggcttctagaga

SEQ ID NO: 5064755 - DNA, 23 bp, Homo sapiens
tgtctggctttttcctctgagcc

SEQ ID NO: 5064756 - DNA, 17 bp, Homo sapiens
tgtctgggaaagcagag

SEQ ID NO: 5064757 - DNA, 19 bp, Homo sapiens
tgtctgggaaagcagagtg

SEQ ID NO: 5064758 - DNA, 15 bp, Homo sapiens
tgtctgggagagcct

SEQ ID NO: 5064759 - DNA, 16 bp, Homo sapiens
tgtctgggagagcctg

SEQ ID NO: 5064760 - DNA, 19 bp, Homo sapiens
tgtctgggagagcctggca

SEQ ID NO: 5064761 - DNA, 19 bp, Homo sapiens
tgtctgggattaagggcaa

SEQ ID NO: 5064762 - DNA, 18 bp, Homo sapiens
tgtctgggctcaagcttt

SEQ ID NO: 5064763 - DNA, 22 bp, Homo sapiens
tgtctgggctcagacatccaca

SEQ ID NO: 5064764 - DNA, 13 bp, Homo sapiens
tgtctggggacag

SEQ ID NO: 5064765 - DNA, 14 bp, Homo sapiens
tgtctggggcccca

SEQ ID NO: 5064766 - DNA, 16 bp, Homo sapiens
tgtctgggtgctactg

SEQ ID NO: 5064767 - DNA, 19 bp, Homo sapiens
tgtctgggtttgagaaatg

SEQ ID NO: 5064768 - DNA, 12 bp, Homo sapiens
tgtctggtaact

SEQ ID NO: 5064769 - DNA, 21 bp, Homo sapiens
tgtctggtatccatgttttat

SEQ ID NO: 5064770 - DNA, 17 bp, Homo sapiens
tgtctggtccacacacc

SEQ ID NO: 5064771 - DNA, 17 bp, Homo sapiens
tgtctggtccaggagaa

SEQ ID NO: 5064772 - DNA, 15 bp, Homo sapiens
tgtctggtgcctgga

SEQ ID NO: 5064773 - DNA, 13 bp, Homo sapiens
tgtctggtggccc

SEQ ID NO: 5064774 - DNA, 15 bp, Homo sapiens
tgtctggtgggtgga

SEQ ID NO: 5064775 - DNA, 20 bp, Homo sapiens
cagtgactcatgctggatga

SEQ ID NO: 5064776 - DNA, 17 bp, Homo sapiens
cagtgactccaggagag

SEQ ID NO: 5064777 - DNA, 18 bp, Homo sapiens
cagtgactccccagccca

SEQ ID NO: 5064778 - DNA, 21 bp, Homo sapiens
cagtgactccccagcccagca

SEQ ID NO: 5064779 - DNA, 14 bp, Homo sapiens
cagtgactccctgg

SEQ ID NO: 5064780 - DNA, 15 bp, Homo sapiens
cagtgactccctggg

SEQ ID NO: 5064781 - DNA, 16 bp, Homo sapiens
cagtgactccctggga

SEQ ID NO: 5064782 - DNA, 19 bp, Homo sapiens
cagtgactcctgctggtac

SEQ ID NO: 5064783 - DNA, 19 bp, Homo sapiens
cagtgactcgacaaaggcc

SEQ ID NO: 5064784 - DNA, 23 bp, Homo sapiens
cagtgactcgacaaaggccacag

SEQ ID NO: 5064785 - DNA, 16 bp, Homo sapiens
cagtgactcgggctcc

SEQ ID NO: 5064786 - DNA, 22 bp, Homo sapiens
cagtgactcgggctcctgtgcc

SEQ ID NO: 5064787 - DNA, 23 bp, Homo sapiens
cagtgactgaattctgccttggt

SEQ ID NO: 5064788 - DNA, 16 bp, Homo sapiens
cagtgactgctgcgct

SEQ ID NO: 5064789 - DNA, 17 bp, Homo sapiens
cagtgactgctgcgctg

SEQ ID NO: 5064790 - DNA, 13 bp, Homo sapiens
cagtgactggcag

SEQ ID NO: 5064791 - DNA, 14 bp, Homo sapiens
cagtgactggcagg

SEQ ID NO: 5064792 - DNA, 17 bp, Homo sapiens
cagtgactgggccctgt

SEQ ID NO: 5064793 - DNA, 18 bp, Homo sapiens
cagtgactgggccctgtc

SEQ ID NO: 5064794 - DNA, 19 bp, Homo sapiens
cagtgactgggccctgtcc

SEQ ID NO: 5064795 - DNA, 20 bp, Homo sapiens
cagtgactgggccctgtcca

SEQ ID NO: 5064796 - DNA, 23 bp, Homo sapiens
cagtgactgtcgtgtttacaaaa

SEQ ID NO: 5064797 - DNA, 24 bp, Homo sapiens
cagtgactgttgtagcattttcct

SEQ ID NO: 5064798 - DNA, 19 bp, Homo sapiens
cagtgacttaggaggctga

SEQ ID NO: 5064799 - DNA, 21 bp, Homo sapiens
cagtgacttaggaggctgagg

SEQ ID NO: 5064800 - DNA, 15 bp, Homo sapiens
cagtgacttctgaga

SEQ ID NO: 5064801 - DNA, 16 bp, Homo sapiens
cagtgacttctgagat

SEQ ID NO: 5064802 - DNA, 22 bp, Homo sapiens
cagtgacttgttctgagtaagt

SEQ ID NO: 5064803 - DNA, 19 bp, Homo sapiens
cagtgactttacaggaggt

SEQ ID NO: 5064804 - DNA, 14 bp, Homo sapiens
cagtgagaaaaagc

SEQ ID NO: 5064805 - DNA, 20 bp, Homo sapiens
cagtgagaaaaagctcctgt

SEQ ID NO: 5064806 - DNA, 21 bp, Homo sapiens
cagtgagaaaaagctcctgtc

SEQ ID NO: 5064807 - DNA, 18 bp, Homo sapiens
cagtgagaaattacaggt

SEQ ID NO: 5064808 - DNA, 18 bp, Homo sapiens
cagtgagaagctgaggcc

SEQ ID NO: 5064809 - DNA, 21 bp, Homo sapiens
cagtgagaagggcctgctctg

SEQ ID NO: 5064810 - DNA, 16 bp, Homo sapiens
cagtgagacacagagt

SEQ ID NO: 5064811 - DNA, 19 bp, Homo sapiens
cagtgagacacagagtgga

SEQ ID NO: 5064812 - DNA, 21 bp, Homo sapiens
cagtgagacagtctggaaagt

SEQ ID NO: 5064813 - DNA, 18 bp, Homo sapiens
cagtgagactgtacataa

SEQ ID NO: 5064814 - DNA, 20 bp, Homo sapiens
cagtgagactgtacataatt

SEQ ID NO: 5064815 - DNA, 21 bp, Homo sapiens
cagtgagagacgccctatttc

SEQ ID NO: 5064816 - DNA, 17 bp, Homo sapiens
cagtgagagcagggctg

SEQ ID NO: 5064817 - DNA, 20 bp, Homo sapiens
cagtgagagcagggctgggc

SEQ ID NO: 5064818 - DNA, 19 bp, Homo sapiens
cagtgagaggggagggctc

SEQ ID NO: 5064819 - DNA, 14 bp, Homo sapiens
cagtgagagtgagg

SEQ ID NO: 5064820 - DNA, 20 bp, Homo sapiens
cagtgagatgagggatgggc

SEQ ID NO: 5064821 - DNA, 18 bp, Homo sapiens
cagtgagatgtcagacaa

SEQ ID NO: 5064822 - DNA, 18 bp, Homo sapiens
cagtgagattacagagga

SEQ ID NO: 5064823 - DNA, 13 bp, Homo sapiens
cagtgagcactga

SEQ ID NO: 5064824 - DNA, 17 bp, Homo sapiens
cagtgagcagggtgggg

SEQ ID NO: 5064825 - DNA, 13 bp, Homo sapiens
cagtgagccaaga

SEQ ID NO: 5064826 - DNA, 13 bp, Homo sapiens
cagtgagccactc

SEQ ID NO: 5064827 - DNA, 14 bp, Homo sapiens
cagtgagcccctcc

SEQ ID NO: 5064828 - DNA, 17 bp, Homo sapiens
cagtgagcccctcccca

SEQ ID NO: 5064829 - DNA, 13 bp, Homo sapiens
cagtgagccctgc

SEQ ID NO: 5064830 - DNA, 12 bp, Homo sapiens
cagtgagccgag

SEQ ID NO: 5064831 - DNA, 19 bp, Homo sapiens
cagtgagccgcatcttctc

SEQ ID NO: 5064832 - DNA, 21 bp, Homo sapiens
cagtgagcctcctgtgcctgg

SEQ ID NO: 5064833 - DNA, 13 bp, Homo sapiens
cagtgagcctctg

SEQ ID NO: 5064834 - DNA, 17 bp, Homo sapiens
cagtgagcctctgcgcc

SEQ ID NO: 5064835 - DNA, 17 bp, Homo sapiens
cagtgagcggagatcgc

SEQ ID NO: 5064836 - DNA, 15 bp, Homo sapiens
cagtgagctgagatc

SEQ ID NO: 5064837 - DNA, 18 bp, Homo sapiens
cagtgagctgatgtgccc

SEQ ID NO: 5064838 - DNA, 14 bp, Homo sapiens
cagtgaggaaaaac

SEQ ID NO: 5064839 - DNA, 21 bp, Homo sapiens
cagtgaggaaccctgatctct

SEQ ID NO: 5064840 - DNA, 22 bp, Homo sapiens
cagtgaggactcggccactgtg

SEQ ID NO: 5064841 - DNA, 23 bp, Homo sapiens
cagtgaggactcggccactgtgt

SEQ ID NO: 5064842 - DNA, 22 bp, Homo sapiens
cagtgaggactctttccgactg

SEQ ID NO: 5064843 - DNA, 16 bp, Homo sapiens
cagtgaggagggatgt

SEQ ID NO: 5064844 - DNA, 13 bp, Homo sapiens
cagtgaggagggt

SEQ ID NO: 5064845 - DNA, 21 bp, Homo sapiens
cagtgaggagggtggaggaag

SEQ ID NO: 5064846 - DNA, 17 bp, Homo sapiens
cagtgaggcaggagaag

SEQ ID NO: 5064847 - DNA, 13 bp, Homo sapiens
cagtgaggcccag

SEQ ID NO: 5064848 - DNA, 16 bp, Homo sapiens
cagtgaggcccaggga

SEQ ID NO: 5064849 - DNA, 12 bp, Homo sapiens
cagtgaggctct

SEQ ID NO: 5064850 - DNA, 21 bp, Homo sapiens
cagtgaggctctattgagcca

SEQ ID NO: 5064851 - DNA, 14 bp, Homo sapiens
cagtgaggctctgc

SEQ ID NO: 5064852 - DNA, 16 bp, Homo sapiens
cagtgaggctctgccc

SEQ ID NO: 5064853 - DNA, 13 bp, Homo sapiens
cagtgaggctggg

SEQ ID NO: 5064854 - DNA, 21 bp, Homo sapiens
cagtgagggagggctgtcatc

SEQ ID NO: 5064855 - DNA, 13 bp, Homo sapiens
cagtgagggctgg

SEQ ID NO: 5064856 - DNA, 18 bp, Homo sapiens
cagtgagggctgggccca

SEQ ID NO: 5064857 - DNA, 19 bp, Homo sapiens
cagtgagggctgggcccac

SEQ ID NO: 5064858 - DNA, 21 bp, Homo sapiens
cagtgaggggccctccatgcg

SEQ ID NO: 5064859 - DNA, 23 bp, Homo sapiens
cagtgaggggccctccatgcgca

SEQ ID NO: 5064860 - DNA, 24 bp, Homo sapiens
cagtgaggggccctccatgcgcag

SEQ ID NO: 5064861 - DNA, 20 bp, Homo sapiens
cagtgaggtatgatgtgctg

SEQ ID NO: 5064862 - DNA, 17 bp, Homo sapiens
cagtgaggtcctggggg

SEQ ID NO: 5064863 - DNA, 20 bp, Homo sapiens
cagtgaggtcctgggggcct

SEQ ID NO: 5064864 - DNA, 21 bp, Homo sapiens
cagtgaggtcctgggggcctg

SEQ ID NO: 5064865 - DNA, 20 bp, Homo sapiens
cagtgaggttatcttgctgc

SEQ ID NO: 5064866 - DNA, 17 bp, Homo sapiens
cagtgagtacctgcaaa

SEQ ID NO: 5064867 - DNA, 18 bp, Homo sapiens
cagtgagtacctgcaaaa

SEQ ID NO: 5064868 - DNA, 17 bp, Homo sapiens
cagtgagtcacatcctg

SEQ ID NO: 5064869 - DNA, 15 bp, Homo sapiens
cagtgagtcctcctc

SEQ ID NO: 5064870 - DNA, 18 bp, Homo sapiens
cagtgagtcgagattgca

SEQ ID NO: 5064871 - DNA, 18 bp, Homo sapiens
cagtgagtcgaggacagg

SEQ ID NO: 5064872 - DNA, 22 bp, Homo sapiens
cagtgagtcgaggacagggagg

SEQ ID NO: 5064873 - DNA, 23 bp, Homo sapiens
cagtgagtcgaggacagggaggt

SEQ ID NO: 5064874 - DNA, 17 bp, Homo sapiens
cagtgagtctcttcaga

SEQ ID NO: 5064875 - DNA, 16 bp, Homo sapiens
cagtgagtgaatcagg

SEQ ID NO: 5064876 - DNA, 22 bp, Homo sapiens
cagtgagtgacaaagcctctga

SEQ ID NO: 5064877 - DNA, 23 bp, Homo sapiens
cagtgagtgacaaagcctctgaa

SEQ ID NO: 5064878 - DNA, 16 bp, Homo sapiens
cagtgagtgagcctgg

SEQ ID NO: 5064879 - DNA, 17 bp, Homo sapiens
cagtgagtgagcctggc

SEQ ID NO: 5064880 - DNA, 21 bp, Homo sapiens
cagtgagtgagcctggctctt

SEQ ID NO: 5064881 - DNA, 21 bp, Homo sapiens
cagtgagtgccatgctttttg

SEQ ID NO: 5064882 - DNA, 15 bp, Homo sapiens
cagtgagtggcccca

SEQ ID NO: 5064883 - DNA, 21 bp, Homo sapiens
cagtgagtggccccacctgtg

SEQ ID NO: 5064884 - DNA, 18 bp, Homo sapiens
cagtgagttgggattgga

SEQ ID NO: 5064885 - DNA, 16 bp, Homo sapiens
cagtgataagagcagt

SEQ ID NO: 5064886 - DNA, 20 bp, Homo sapiens
cagtgataatgccccaagga

SEQ ID NO: 5064887 - DNA, 18 bp, Homo sapiens
cagtgatacgtacagcca

SEQ ID NO: 5064888 - DNA, 14 bp, Homo sapiens
cagtgatagaacaa

SEQ ID NO: 5064889 - DNA, 15 bp, Homo sapiens
cagtgataggcccaa

SEQ ID NO: 5064890 - DNA, 12 bp, Homo sapiens
cagtgatattct

SEQ ID NO: 5064891 - DNA, 24 bp, Homo sapiens
cagtgatcagttgctctctgttca

SEQ ID NO: 5064892 - DNA, 21 bp, Homo sapiens
cagtgatcctcaaacacacaa

SEQ ID NO: 5064893 - DNA, 22 bp, Homo sapiens
cagtgatctatgtttgtgtgat

SEQ ID NO: 5064894 - DNA, 16 bp, Homo sapiens
cagtgatctcagggca

SEQ ID NO: 5064895 - DNA, 13 bp, Homo sapiens
cagtgatctccat

SEQ ID NO: 5064896 - DNA, 19 bp, Homo sapiens
cagtgatctcgactccccc

SEQ ID NO: 5064897 - DNA, 17 bp, Homo sapiens
cagtgatgaatgtacta

SEQ ID NO: 5064898 - DNA, 18 bp, Homo sapiens
cagtgatgacttgctgtc

SEQ ID NO: 5064899 - DNA, 22 bp, Homo sapiens
cagtgatgacttgctgtccagg

SEQ ID NO: 5064900 - DNA, 20 bp, Homo sapiens
cagtgatgccatgaagacag

SEQ ID NO: 5064901 - DNA, 17 bp, Homo sapiens
cagtgatgccgggcgcc

SEQ ID NO: 5064902 - DNA, 21 bp, Homo sapiens
cagtgatggcattactctgca

SEQ ID NO: 5064903 - DNA, 21 bp, Homo sapiens
cagtgatggcgcgggaggcac

SEQ ID NO: 5064904 - DNA, 22 bp, Homo sapiens
cagtgatggcgcgggaggcacc

SEQ ID NO: 5064905 - DNA, 17 bp, Homo sapiens
cagtgatgggagagtag

SEQ ID NO: 5064906 - DNA, 22 bp, Homo sapiens
cagtgatgtgcctaaataagtt

SEQ ID NO: 5064907 - DNA, 14 bp, Homo sapiens
cagtgatgttgaaa

SEQ ID NO: 5064908 - DNA, 21 bp, Homo sapiens
cagtgatgtttgccatttgct

SEQ ID NO: 5064909 - DNA, 20 bp, Homo sapiens
cagtgattaaggtctctctt

SEQ ID NO: 5064910 - DNA, 18 bp, Homo sapiens
cagtgattaccagggact

SEQ ID NO: 5064911 - DNA, 22 bp, Homo sapiens
cagtgattaccagggactgagg

SEQ ID NO: 5064912 - DNA, 14 bp, Homo sapiens
cagtgattattttt

SEQ ID NO: 5064913 - DNA, 17 bp, Homo sapiens
cagtgattcagcaggcc

SEQ ID NO: 5064914 - DNA, 15 bp, Homo sapiens
cagtgattcatgtag

SEQ ID NO: 5064915 - DNA, 20 bp, Homo sapiens
cagtgattcgagctatattt

SEQ ID NO: 5064916 - DNA, 19 bp, Homo sapiens
cagtgattctctcttctct

SEQ ID NO: 5064917 - DNA, 16 bp, Homo sapiens
cagtgattgtcttaat

SEQ ID NO: 5064918 - DNA, 13 bp, Homo sapiens
cagtgatttacat

SEQ ID NO: 5064919 - DNA, 17 bp, Homo sapiens
cagtgattttcaaacct

SEQ ID NO: 5064920 - DNA, 13 bp, Homo sapiens
cagtgatttttat

SEQ ID NO: 5064921 - DNA, 15 bp, Homo sapiens
cagtgatttttatcc

SEQ ID NO: 5064922 - DNA, 13 bp, Homo sapiens
cagtgcaaaatgt

SEQ ID NO: 5064923 - DNA, 15 bp, Homo sapiens
cagtgcaaaatgtct

SEQ ID NO: 5064924 - DNA, 13 bp, Homo sapiens
cagtgcaaatgca

SEQ ID NO: 5064925 - DNA, 17 bp, Homo sapiens
cagtgcaacagcactgg

SEQ ID NO: 5064926 - DNA, 22 bp, Homo sapiens
cagtgcaacaggaggctttttc

SEQ ID NO: 5064927 - DNA, 16 bp, Homo sapiens
cagtgcaatctgtcca

SEQ ID NO: 5064928 - DNA, 17 bp, Homo sapiens
cagtgcaatctgtccag

SEQ ID NO: 5064929 - DNA, 19 bp, Homo sapiens
cagtgcaatgcttgtagaa

SEQ ID NO: 5064930 - DNA, 18 bp, Homo sapiens
cagtgcacctgcctcagc

SEQ ID NO: 5064931 - DNA, 15 bp, Homo sapiens
cagtgcacctgggac

SEQ ID NO: 5064932 - DNA, 17 bp, Homo sapiens
cagtgcacctgtcatat

SEQ ID NO: 5064933 - DNA, 19 bp, Homo sapiens
cagtgcactaattctgcat

SEQ ID NO: 5064934 - DNA, 12 bp, Homo sapiens
cagtgcagaatg

SEQ ID NO: 5064935 - DNA, 22 bp, Homo sapiens
cagtgcagaatgtaagtgggcc

SEQ ID NO: 5064936 - DNA, 13 bp, Homo sapiens
cagtgcagacagg

SEQ ID NO: 5064937 - DNA, 19 bp, Homo sapiens
cagtgcagagccttctcag

SEQ ID NO: 5064938 - DNA, 14 bp, Homo sapiens
cagtgcagatggag

SEQ ID NO: 5064939 - DNA, 19 bp, Homo sapiens
cagtgcagcaagcctggcc

SEQ ID NO: 5064940 - DNA, 20 bp, Homo sapiens
cagtgcagcaagcctggccc

SEQ ID NO: 5064941 - DNA, 13 bp, Homo sapiens
cagtgcagcaata

SEQ ID NO: 5064942 - DNA, 14 bp, Homo sapiens
cagtgcagcagagg

SEQ ID NO: 5064943 - DNA, 12 bp, Homo sapiens
cagtgcagccac

SEQ ID NO: 5064944 - DNA, 22 bp, Homo sapiens
cagtgcagccccctcctgaccc

SEQ ID NO: 5064945 - DNA, 14 bp, Homo sapiens
cagtgcaggcacag

SEQ ID NO: 5064946 - DNA, 18 bp, Homo sapiens
cagtgcaggctggccagc

SEQ ID NO: 5064947 - DNA, 21 bp, Homo sapiens
cagtgcagggacagcctgcac

SEQ ID NO: 5064948 - DNA, 17 bp, Homo sapiens
cagtgcagggcaaaata

SEQ ID NO: 5064949 - DNA, 15 bp, Homo sapiens
cagtgcagtaatttc

SEQ ID NO: 5064950 - DNA, 17 bp, Homo sapiens
cagtgcagtaatttctg

SEQ ID NO: 5064951 - DNA, 22 bp, Homo sapiens
cagtggggccccaaagcccagc

SEQ ID NO: 5064952 - DNA, 23 bp, Homo sapiens
cagtggggccccaaagcccagcc

SEQ ID NO: 5064953 - DNA, 14 bp, Homo sapiens
cagtggggcctgtg

SEQ ID NO: 5064954 - DNA, 15 bp, Homo sapiens
cagtggggcctgtgg

SEQ ID NO: 5064955 - DNA, 16 bp, Homo sapiens
cagtggggctctctga

SEQ ID NO: 5064956 - DNA, 18 bp, Homo sapiens
cagtggggctctctgagt

SEQ ID NO: 5064957 - DNA, 18 bp, Homo sapiens
cagtggggctggaagcag

SEQ ID NO: 5064958 - DNA, 14 bp, Homo sapiens
cagtggggctggca

SEQ ID NO: 5064959 - DNA, 15 bp, Homo sapiens
cagtggggctggcat

SEQ ID NO: 5064960 - DNA, 16 bp, Homo sapiens
cagtgggggtgcctgg

SEQ ID NO: 5064961 - DNA, 19 bp, Homo sapiens
cagtggggtcaagctgagc

SEQ ID NO: 5064962 - DNA, 21 bp, Homo sapiens
cagtggggtcccccctgagtg

SEQ ID NO: 5064963 - DNA, 11 bp, Homo sapiens
cagtggggtga

SEQ ID NO: 5064964 - DNA, 20 bp, Homo sapiens
cagtggggtttcgcagcctg

SEQ ID NO: 5064965 - DNA, 23 bp, Homo sapiens
cagtgggtcccacttcccctcct

SEQ ID NO: 5064966 - DNA, 21 bp, Homo sapiens
cagtgggtggcacctcctgag

SEQ ID NO: 5064967 - DNA, 15 bp, Homo sapiens
cagtgggtgggagct

SEQ ID NO: 5064968 - DNA, 23 bp, Homo sapiens
cagtgggtggggctgtacacacc

SEQ ID NO: 5064969 - DNA, 14 bp, Homo sapiens
cagtgggttaacat

SEQ ID NO: 5064970 - DNA, 16 bp, Homo sapiens
cagtgggttaattata

SEQ ID NO: 5064971 - DNA, 16 bp, Homo sapiens
cagtgggttcagaacc

SEQ ID NO: 5064972 - DNA, 15 bp, Homo sapiens
cagtgggttcaggcc

SEQ ID NO: 5064973 - DNA, 17 bp, Homo sapiens
cagtggtaagctctggc

SEQ ID NO: 5064974 - DNA, 18 bp, Homo sapiens
cagtggtaccagctcact

SEQ ID NO: 5064975 - DNA, 23 bp, Homo sapiens
cagtggtaccagctcactccctg

SEQ ID NO: 5064976 - DNA, 16 bp, Homo sapiens
cagtggtactctgtgt

SEQ ID NO: 5064977 - DNA, 20 bp, Homo sapiens
cagtggtactctgtgtctgg

SEQ ID NO: 5064978 - DNA, 17 bp, Homo sapiens
cagtggtagagaggttt

SEQ ID NO: 5064979 - DNA, 16 bp, Homo sapiens
cagtggtcaccttcct

SEQ ID NO: 5064980 - DNA, 19 bp, Homo sapiens
cagtggtcaccttcctcag

SEQ ID NO: 5064981 - DNA, 22 bp, Homo sapiens
cagtggtcagcgattcctgcca

SEQ ID NO: 5064982 - DNA, 23 bp, Homo sapiens
cagtggtcccatttatatctgct

SEQ ID NO: 5064983 - DNA, 13 bp, Homo sapiens
cagtggtctcaca

SEQ ID NO: 5064984 - DNA, 19 bp, Homo sapiens
cagtggtctggaaacagct

SEQ ID NO: 5064985 - DNA, 16 bp, Homo sapiens
cagtggtgaccccctt

SEQ ID NO: 5064986 - DNA, 17 bp, Homo sapiens
cagtggtgcgggccagg

SEQ ID NO: 5064987 - DNA, 19 bp, Homo sapiens
cagtggtggcagggcctag

SEQ ID NO: 5064988 - DNA, 13 bp, Homo sapiens
cagtggtgggcgg

SEQ ID NO: 5064989 - DNA, 20 bp, Homo sapiens
cagtggtgggtaattgtaca

SEQ ID NO: 5064990 - DNA, 23 bp, Homo sapiens
cagtggtgggtaattgtacaata

SEQ ID NO: 5064991 - DNA, 15 bp, Homo sapiens
cagtggtgtgtgaag

SEQ ID NO: 5064992 - DNA, 18 bp, Homo sapiens
cagtggtgtgtgaagttt

SEQ ID NO: 5064993 - DNA, 17 bp, Homo sapiens
cagtggtgttacatttt

SEQ ID NO: 5064994 - DNA, 18 bp, Homo sapiens
cagtggttcgggggaaat

SEQ ID NO: 5064995 - DNA, 20 bp, Homo sapiens
cagtggttcgggggaaatag

SEQ ID NO: 5064996 - DNA, 21 bp, Homo sapiens
cagtggttctacaatctattt

SEQ ID NO: 5064997 - DNA, 14 bp, Homo sapiens
cagtggtttccctg

SEQ ID NO: 5064998 - DNA, 18 bp, Homo sapiens
cagtggtttgagacactg

SEQ ID NO: 5064999 - DNA, 20 bp, Homo sapiens
cagtggttttatactgaagg

SEQ ID NO: 5065000 - DNA, 17 bp, Homo sapiens
cagtgtaaattcagtct

SEQ ID NO: 5065001 - DNA, 16 bp, Homo sapiens
cagtgtaactggctgc

SEQ ID NO: 5065002 - DNA, 15 bp, Homo sapiens
cagtgtaatgtgact

SEQ ID NO: 5065003 - DNA, 15 bp, Homo sapiens
cagtgtaatttcttt

SEQ ID NO: 5065004 - DNA, 17 bp, Homo sapiens
cagtgtaatttctttgc

SEQ ID NO: 5065005 - DNA, 17 bp, Homo sapiens
cagtgtacaaaactgta

SEQ ID NO: 5065006 - DNA, 17 bp, Homo sapiens
cagtgtacacgtctgga

SEQ ID NO: 5065007 - DNA, 20 bp, Homo sapiens
cagtgtacatagtgtaatgt

SEQ ID NO: 5065008 - DNA, 23 bp, Homo sapiens
cagtgtacatggaataacatgta

SEQ ID NO: 5065009 - DNA, 13 bp, Homo sapiens
cagtgtacatgta

SEQ ID NO: 5065010 - DNA, 16 bp, Homo sapiens
cagtgtacatgtacat

SEQ ID NO: 5065011 - DNA, 17 bp, Homo sapiens
cagtgtacatgtacata

SEQ ID NO: 5065012 - DNA, 22 bp, Homo sapiens
cagtgtacccacgctgggtatt

SEQ ID NO: 5065013 - DNA, 14 bp, Homo sapiens
cagtgtacccccgc

SEQ ID NO: 5065014 - DNA, 18 bp, Homo sapiens
cagtgtacccccgcccag

SEQ ID NO: 5065015 - DNA, 19 bp, Homo sapiens
cagtgtagacacaggtcac

SEQ ID NO: 5065016 - DNA, 22 bp, Homo sapiens
cagtgtagacacaggtcaccat

SEQ ID NO: 5065017 - DNA, 21 bp, Homo sapiens
cagtgtagacctgagctggga

SEQ ID NO: 5065018 - DNA, 20 bp, Homo sapiens
cagtgtagattttatagtgt

SEQ ID NO: 5065019 - DNA, 19 bp, Homo sapiens
cagtgtagcatcttcctct

SEQ ID NO: 5065020 - DNA, 15 bp, Homo sapiens
cagtgtagttaattt

SEQ ID NO: 5065021 - DNA, 16 bp, Homo sapiens
cagtgtagttaattta

SEQ ID NO: 5065022 - DNA, 21 bp, Homo sapiens
cagtgtagttaatttatctaa

SEQ ID NO: 5065023 - DNA, 18 bp, Homo sapiens
cagtgtagttttcctttt

SEQ ID NO: 5065024 - DNA, 22 bp, Homo sapiens
cagtgtataaatccaatatcat

SEQ ID NO: 5065025 - DNA, 19 bp, Homo sapiens
cagtgtatcaggtcaggga

SEQ ID NO: 5065026 - DNA, 23 bp, Homo sapiens
cagtgtatctcgaagtcttccat

SEQ ID NO: 5065027 - DNA, 18 bp, Homo sapiens
cagtgtatgtagaagcat

SEQ ID NO: 5065028 - DNA, 14 bp, Homo sapiens
cagtgtatttaaga

SEQ ID NO: 5065029 - DNA, 15 bp, Homo sapiens
cagtgtatttcagtt

SEQ ID NO: 5065030 - DNA, 12 bp, Homo sapiens
cagtgtatttta

SEQ ID NO: 5065031 - DNA, 17 bp, Homo sapiens
cagtgtcaaataaacac

SEQ ID NO: 5065032 - DNA, 19 bp, Homo sapiens
cagtgtcaaataaacactg

SEQ ID NO: 5065033 - DNA, 20 bp, Homo sapiens
cagtgtcaaataaacactgt

SEQ ID NO: 5065034 - DNA, 18 bp, Homo sapiens
cagtgtcaagttgtgctt

SEQ ID NO: 5065035 - DNA, 21 bp, Homo sapiens
cagtgtcaatccaatctgtaa

SEQ ID NO: 5065036 - DNA, 17 bp, Homo sapiens
cagtgtcacatgaggaa

SEQ ID NO: 5065037 - DNA, 13 bp, Homo sapiens
cagtgtcactggt

SEQ ID NO: 5065038 - DNA, 15 bp, Homo sapiens
cagtgtcagagtcat

SEQ ID NO: 5065039 - DNA, 13 bp, Homo sapiens
cagtgtcagcggg

SEQ ID NO: 5065040 - DNA, 16 bp, Homo sapiens
cagtgtcaggcactgg

SEQ ID NO: 5065041 - DNA, 11 bp, Homo sapiens
cagtgtcattt

SEQ ID NO: 5065042 - DNA, 16 bp, Homo sapiens
cagtgtcatttctcat

SEQ ID NO: 5065043 - DNA, 22 bp, Homo sapiens
cagtgtcatttctcatccacat

SEQ ID NO: 5065044 - DNA, 13 bp, Homo sapiens
cagtgtcatttgc

SEQ ID NO: 5065045 - DNA, 17 bp, Homo sapiens
cagtgtcatttgctctg

SEQ ID NO: 5065046 - DNA, 14 bp, Homo sapiens
cagtgtccatgttg

SEQ ID NO: 5065047 - DNA, 20 bp, Homo sapiens
cagtgtccattatctgctgt

SEQ ID NO: 5065048 - DNA, 22 bp, Homo sapiens
cagtgtccattatctgctgttc

SEQ ID NO: 5065049 - DNA, 16 bp, Homo sapiens
cagtgtcccaggcagc

SEQ ID NO: 5065050 - DNA, 15 bp, Homo sapiens
cagtgtcccctccac

SEQ ID NO: 5065051 - DNA, 18 bp, Homo sapiens
cagtgtcccctgccccag

SEQ ID NO: 5065052 - DNA, 19 bp, Homo sapiens
cagtgtcccctgccccaga

SEQ ID NO: 5065053 - DNA, 21 bp, Homo sapiens
cagtgtcccctgccccagagg

SEQ ID NO: 5065054 - DNA, 18 bp, Homo sapiens
cagtgtcctcccctcaag

SEQ ID NO: 5065055 - DNA, 21 bp, Homo sapiens
cagtgtccttcacggcactgg

SEQ ID NO: 5065056 - DNA, 20 bp, Homo sapiens
cagtgtccttggcaggctga

SEQ ID NO: 5065057 - DNA, 13 bp, Homo sapiens
cagtgtcctttcc

SEQ ID NO: 5065058 - DNA, 21 bp, Homo sapiens
cagtgtcgccgtccctctgcc

SEQ ID NO: 5065059 - DNA, 23 bp, Homo sapiens
cagtgtcgccgtccctctgcctt

SEQ ID NO: 5065060 - DNA, 15 bp, Homo sapiens
cagtgtctaccttca

SEQ ID NO: 5065061 - DNA, 22 bp, Homo sapiens
cagtgtctaggcactgagcagg

SEQ ID NO: 5065062 - DNA, 15 bp, Homo sapiens
cagtgtctagtttct

SEQ ID NO: 5065063 - DNA, 12 bp, Homo sapiens
cagtgtctcaca

SEQ ID NO: 5065064 - DNA, 20 bp, Homo sapiens
cagtgtctcacagccctgct

SEQ ID NO: 5065065 - DNA, 12 bp, Homo sapiens
cagtgtctccac

SEQ ID NO: 5065066 - DNA, 18 bp, Homo sapiens
cagtgtctggcccagcca

SEQ ID NO: 5065067 - DNA, 13 bp, Homo sapiens
cagtgtctggctt

SEQ ID NO: 5065068 - DNA, 14 bp, Homo sapiens
cagtgtctggcttt

SEQ ID NO: 5065069 - DNA, 18 bp, Homo sapiens
cagtgtctgggctgactg

SEQ ID NO: 5065070 - DNA, 14 bp, Homo sapiens
cagtgtctgtgtgt

SEQ ID NO: 5065071 - DNA, 23 bp, Homo sapiens
cagtgtctgtgttttgaaagaat

SEQ ID NO: 5065072 - DNA, 18 bp, Homo sapiens
cagtgtcttaaggagact

SEQ ID NO: 5065073 - DNA, 21 bp, Homo sapiens
cagtgtcttaaggagactggt

SEQ ID NO: 5065074 - DNA, 23 bp, Homo sapiens
cagtgtcttaaggagactggtag

SEQ ID NO: 5065075 - DNA, 14 bp, Homo sapiens
cagtgtcttccata

SEQ ID NO: 5065076 - DNA, 16 bp, Homo sapiens
cagtgtcttccataat

SEQ ID NO: 5065077 - DNA, 18 bp, Homo sapiens
cagtgtcttccataatgt

SEQ ID NO: 5065078 - DNA, 23 bp, Homo sapiens
cagtgtcttccataatgtataaa

SEQ ID NO: 5065079 - DNA, 20 bp, Homo sapiens
cagtgtctttctagccataa

SEQ ID NO: 5065080 - DNA, 18 bp, Homo sapiens
cagtgtctttctttggtg

SEQ ID NO: 5065081 - DNA, 16 bp, Homo sapiens
cagtgtgaagacactg

SEQ ID NO: 5065082 - DNA, 11 bp, Homo sapiens
cagtgtgaatg

SEQ ID NO: 5065083 - DNA, 12 bp, Homo sapiens
cagtgtgaatgg

SEQ ID NO: 5065084 - DNA, 18 bp, Homo sapiens
cagtgtgagatactgtgt

SEQ ID NO: 5065085 - DNA, 22 bp, Homo sapiens
cagtgtgaggacctccctgtct

SEQ ID NO: 5065086 - DNA, 17 bp, Homo sapiens
cagtgtgaggccagggc

SEQ ID NO: 5065087 - DNA, 13 bp, Homo sapiens
cagtgtgagggtg

SEQ ID NO: 5065088 - DNA, 16 bp, Homo sapiens
cagtgtgagggtgcag

SEQ ID NO: 5065089 - DNA, 17 bp, Homo sapiens
cagtgtgagtcagaatg

SEQ ID NO: 5065090 - DNA, 21 bp, Homo sapiens
cagtgtgcaaggcagccgtgg

SEQ ID NO: 5065091 - DNA, 14 bp, Homo sapiens
cagtgtgcacccct

SEQ ID NO: 5065092 - DNA, 19 bp, Homo sapiens
cagtgtgcacccctcccca

SEQ ID NO: 5065093 - DNA, 21 bp, Homo sapiens
cagtgtgcacgagtgggaagg

SEQ ID NO: 5065094 - DNA, 22 bp, Homo sapiens
cagtgtgcacgagtgggaagga

SEQ ID NO: 5065095 - DNA, 19 bp, Homo sapiens
cagtgtgcactaaggggcc

SEQ ID NO: 5065096 - DNA, 16 bp, Homo sapiens
cagtgtgccaccctct

SEQ ID NO: 5065097 - DNA, 21 bp, Homo sapiens
cagtgtgccaccctctgcagg

SEQ ID NO: 5065098 - DNA, 17 bp, Homo sapiens
cagtgtgcccaaaagcc

SEQ ID NO: 5065099 - DNA, 14 bp, Homo sapiens
cagtgtgcccatct

SEQ ID NO: 5065100 - DNA, 19 bp, Homo sapiens
cagtgtgccccccatcctg

SEQ ID NO: 5065101 - DNA, 20 bp, Homo sapiens
cagtgtgccccccatcctgg

SEQ ID NO: 5065102 - DNA, 22 bp, Homo sapiens
cagtgtgccccccatcctggcc

SEQ ID NO: 5065103 - DNA, 21 bp, Homo sapiens
cagtgtgctttgcattttctg

SEQ ID NO: 5065104 - DNA, 11 bp, Homo sapiens
cagtgtggaac

SEQ ID NO: 5065105 - DNA, 22 bp, Homo sapiens
cagtgtggactgggaagcatta

SEQ ID NO: 5065106 - DNA, 15 bp, Homo sapiens
cagtgtggagaccct

SEQ ID NO: 5065107 - DNA, 20 bp, Homo sapiens
cagtgtggaggccactgttt

SEQ ID NO: 5065108 - DNA, 16 bp, Homo sapiens
cagtgtggatgtaaat

SEQ ID NO: 5065109 - DNA, 17 bp, Homo sapiens
cagtgtggcaagcaaga

SEQ ID NO: 5065110 - DNA, 12 bp, Homo sapiens
cagtgtggcctc

SEQ ID NO: 5065111 - DNA, 16 bp, Homo sapiens
cagtgtggcttaaaca

SEQ ID NO: 5065112 - DNA, 23 bp, Homo sapiens
cagtgtgggaatgcggcaagaag

SEQ ID NO: 5065113 - DNA, 12 bp, Homo sapiens
cagtgtgggaca

SEQ ID NO: 5065114 - DNA, 17 bp, Homo sapiens
cagtgtgggacaggctc

SEQ ID NO: 5065115 - DNA, 21 bp, Homo sapiens
cagtgtgggacaggctcttct

SEQ ID NO: 5065116 - DNA, 17 bp, Homo sapiens
cagtgtgggcttgacca

SEQ ID NO: 5065117 - DNA, 20 bp, Homo sapiens
cagtgtggggagggcaggtc

SEQ ID NO: 5065118 - DNA, 23 bp, Homo sapiens
cagtgtggggagggcaggtccag

SEQ ID NO: 5065119 - DNA, 19 bp, Homo sapiens
cagtgtggggataaagaca

SEQ ID NO: 5065120 - DNA, 20 bp, Homo sapiens
cagtgtggggggacagacag

SEQ ID NO: 5065121 - DNA, 20 bp, Homo sapiens
cagtgtggtctcttacatgg

SEQ ID NO: 5065122 - DNA, 20 bp, Homo sapiens
cagtgtggttatgttcccag

SEQ ID NO: 5065123 - DNA, 14 bp, Homo sapiens
cagtgtgtaaacaa

SEQ ID NO: 5065124 - DNA, 16 bp, Homo sapiens
cagtgtgtaaacaaaa

SEQ ID NO: 5065125 - DNA, 11 bp, Homo sapiens
cagtgtgtaat

SEQ ID NO: 5065126 - DNA, 15 bp, Homo sapiens
cagtgtgtacttctt

SEQ ID NO: 5065127 - DNA, 15 bp, Homo sapiens
cagtgtgtcagtttt

SEQ ID NO: 5065128 - DNA, 13 bp, Homo sapiens
cagttgaataatt

SEQ ID NO: 5065129 - DNA, 16 bp, Homo sapiens
cagttgaataatttgt

SEQ ID NO: 5065130 - DNA, 20 bp, Homo sapiens
cagttgaatgacaacagaag

SEQ ID NO: 5065131 - DNA, 14 bp, Homo sapiens
cagttgaatttcat

SEQ ID NO: 5065132 - DNA, 14 bp, Homo sapiens
cagttgaattttaa

SEQ ID NO: 5065133 - DNA, 14 bp, Homo sapiens
cagttgacagcagg

SEQ ID NO: 5065134 - DNA, 22 bp, Homo sapiens
cagttgacatccaggatggctg

SEQ ID NO: 5065135 - DNA, 18 bp, Homo sapiens
cagttgacggggcagtca

SEQ ID NO: 5065136 - DNA, 13 bp, Homo sapiens
cagttgactcaga

SEQ ID NO: 5065137 - DNA, 16 bp, Homo sapiens
cagttgagacaagaaa

SEQ ID NO: 5065138 - DNA, 13 bp, Homo sapiens
cagttgagctcag

SEQ ID NO: 5065139 - DNA, 14 bp, Homo sapiens
cagttgagctcagg

SEQ ID NO: 5065140 - DNA, 22 bp, Homo sapiens
cagttgaggaatatgactgttt

SEQ ID NO: 5065141 - DNA, 16 bp, Homo sapiens
cagttgatcttcttca

SEQ ID NO: 5065142 - DNA, 21 bp, Homo sapiens
cagttgatggagccccagggt

SEQ ID NO: 5065143 - DNA, 23 bp, Homo sapiens
cagttgcaagtctggacaaatgt

SEQ ID NO: 5065144 - DNA, 15 bp, Homo sapiens
cagttgcaataaaat

SEQ ID NO: 5065145 - DNA, 20 bp, Homo sapiens
cagttgcaataaactcagtc

SEQ ID NO: 5065146 - DNA, 22 bp, Homo sapiens
cagttgcaataaactcagtcaa

SEQ ID NO: 5065147 - DNA, 15 bp, Homo sapiens
cagttgcaataatac

SEQ ID NO: 5065148 - DNA, 12 bp, Homo sapiens
cagttgcacagc

SEQ ID NO: 5065149 - DNA, 22 bp, Homo sapiens
cagttgcacagcatctcagctc

SEQ ID NO: 5065150 - DNA, 19 bp, Homo sapiens
cagttgcacttctaagact

SEQ ID NO: 5065151 - DNA, 20 bp, Homo sapiens
cagttgcacttggcctctgg

SEQ ID NO: 5065152 - DNA, 11 bp, Homo sapiens
cagttgcagtc

SEQ ID NO: 5065153 - DNA, 18 bp, Homo sapiens
cagttgcatgctagcatg

SEQ ID NO: 5065154 - DNA, 20 bp, Homo sapiens
cagttgccatgtagacccct

SEQ ID NO: 5065155 - DNA, 16 bp, Homo sapiens
cagttgcccagagcac

SEQ ID NO: 5065156 - DNA, 20 bp, Homo sapiens
cagttgcccagagcacttta

SEQ ID NO: 5065157 - DNA, 22 bp, Homo sapiens
cagttgcccagagcactttagc

SEQ ID NO: 5065158 - DNA, 19 bp, Homo sapiens
cagttgcccagcctctttc

SEQ ID NO: 5065159 - DNA, 15 bp, Homo sapiens
cagttgccccccatc

SEQ ID NO: 5065160 - DNA, 22 bp, Homo sapiens
cagttgcccgaaactaagccag

SEQ ID NO: 5065161 - DNA, 19 bp, Homo sapiens
cagttgccgcttctggtta

SEQ ID NO: 5065162 - DNA, 22 bp, Homo sapiens
cagttgccttttatcccaaagt

SEQ ID NO: 5065163 - DNA, 14 bp, Homo sapiens
cagttgctcattgt

SEQ ID NO: 5065164 - DNA, 17 bp, Homo sapiens
cagttgctcattgtaga

SEQ ID NO: 5065165 - DNA, 17 bp, Homo sapiens
cagttgctctctgttca

SEQ ID NO: 5065166 - DNA, 20 bp, Homo sapiens
cagttgctctgacgtagaaa

SEQ ID NO: 5065167 - DNA, 14 bp, Homo sapiens
cagttgctgtcaca

SEQ ID NO: 5065168 - DNA, 14 bp, Homo sapiens
cagttgctgtgaac

SEQ ID NO: 5065169 - DNA, 19 bp, Homo sapiens
cagttgcttcttcagctga

SEQ ID NO: 5065170 - DNA, 14 bp, Homo sapiens
cagttgcttgtctt

SEQ ID NO: 5065171 - DNA, 12 bp, Homo sapiens
cagttggaaaat

SEQ ID NO: 5065172 - DNA, 18 bp, Homo sapiens
cagttggactctcaggga

SEQ ID NO: 5065173 - DNA, 16 bp, Homo sapiens
cagttggactgtggcc

SEQ ID NO: 5065174 - DNA, 20 bp, Homo sapiens
cagttggactgtggcctcag

SEQ ID NO: 5065175 - DNA, 15 bp, Homo sapiens
cagttggacttttta

SEQ ID NO: 5065176 - DNA, 21 bp, Homo sapiens
cagttggagctccagcctgac

SEQ ID NO: 5065177 - DNA, 22 bp, Homo sapiens
cagttggagctccagcctgaca

SEQ ID NO: 5065178 - DNA, 18 bp, Homo sapiens
cagttggagggaaagcca

SEQ ID NO: 5065179 - DNA, 20 bp, Homo sapiens
cagttggagggaaagccagc

SEQ ID NO: 5065180 - DNA, 22 bp, Homo sapiens
cagttggagttttttgtaccaa

SEQ ID NO: 5065181 - DNA, 19 bp, Homo sapiens
cagttggcacttctgccat

SEQ ID NO: 5065182 - DNA, 22 bp, Homo sapiens
cagttggcagaaaggatgtttt

SEQ ID NO: 5065183 - DNA, 15 bp, Homo sapiens
cagttggcagagaag

SEQ ID NO: 5065184 - DNA, 18 bp, Homo sapiens
cagttggccaagcagaaa

SEQ ID NO: 5065185 - DNA, 16 bp, Homo sapiens
cagttggccagagagc

SEQ ID NO: 5065186 - DNA, 17 bp, Homo sapiens
cagttggccagagagcc

SEQ ID NO: 5065187 - DNA, 15 bp, Homo sapiens
cagttggcccttctg

SEQ ID NO: 5065188 - DNA, 18 bp, Homo sapiens
cagttggccctttaatat

SEQ ID NO: 5065189 - DNA, 21 bp, Homo sapiens
cagttggccctttaatatttc

SEQ ID NO: 5065190 - DNA, 14 bp, Homo sapiens
cagttggcctcagc

SEQ ID NO: 5065191 - DNA, 16 bp, Homo sapiens
cagttggcctcagcag

SEQ ID NO: 5065192 - DNA, 14 bp, Homo sapiens
cagttggcctctgc

SEQ ID NO: 5065193 - DNA, 16 bp, Homo sapiens
cagttggcctctgccc

SEQ ID NO: 5065194 - DNA, 19 bp, Homo sapiens
cagttggcctctgcccctc

SEQ ID NO: 5065195 - DNA, 23 bp, Homo sapiens
cagttggcctctgcccctcttcc

SEQ ID NO: 5065196 - DNA, 20 bp, Homo sapiens
cagttggcctgtgcttggag

SEQ ID NO: 5065197 - DNA, 19 bp, Homo sapiens
cagttggcttctgtgcctg

SEQ ID NO: 5065198 - DNA, 19 bp, Homo sapiens
cagttgggaagtctcagcc

SEQ ID NO: 5065199 - DNA, 20 bp, Homo sapiens
cagttgggaagtctcagcct

SEQ ID NO: 5065200 - DNA, 22 bp, Homo sapiens
cagttgggaagtctcagcctgg

SEQ ID NO: 5065201 - DNA, 17 bp, Homo sapiens
cagttgggagcactgga

SEQ ID NO: 5065202 - DNA, 20 bp, Homo sapiens
cagttgggagcactggagtg

SEQ ID NO: 5065203 - DNA, 18 bp, Homo sapiens
cagttgggaggaggaagt

SEQ ID NO: 5065204 - DNA, 16 bp, Homo sapiens
cagttgggagtgagtt

SEQ ID NO: 5065205 - DNA, 14 bp, Homo sapiens
cagttggggccctc

SEQ ID NO: 5065206 - DNA, 17 bp, Homo sapiens
cagttggggccctcttg

SEQ ID NO: 5065207 - DNA, 18 bp, Homo sapiens
cagttggggccctcttgc

SEQ ID NO: 5065208 - DNA, 22 bp, Homo sapiens
cagttggggccctcttgccagc

SEQ ID NO: 5065209 - DNA, 21 bp, Homo sapiens
cagttggggcggcccacgcca

SEQ ID NO: 5065210 - DNA, 22 bp, Homo sapiens
cagttggggctgcgaccgccag

SEQ ID NO: 5065211 - DNA, 20 bp, Homo sapiens
cagttgggtagatgggtggg

SEQ ID NO: 5065212 - DNA, 23 bp, Homo sapiens
cagttgggtagatgggtgggggc

SEQ ID NO: 5065213 - DNA, 16 bp, Homo sapiens
cagttgggtggatgcc

SEQ ID NO: 5065214 - DNA, 22 bp, Homo sapiens
cagttgggtttcacgagtgttc

SEQ ID NO: 5065215 - DNA, 16 bp, Homo sapiens
cagttgggttttttaa

SEQ ID NO: 5065216 - DNA, 23 bp, Homo sapiens
cagttggtaagcttccaggaaaa

SEQ ID NO: 5065217 - DNA, 18 bp, Homo sapiens
cagttggtcccccttcca

SEQ ID NO: 5065218 - DNA, 22 bp, Homo sapiens
cagttggtcccccttccatgga

SEQ ID NO: 5065219 - DNA, 22 bp, Homo sapiens
cagttggtgactgggaaagtta

SEQ ID NO: 5065220 - DNA, 17 bp, Homo sapiens
cagttggtgattttaga

SEQ ID NO: 5065221 - DNA, 23 bp, Homo sapiens
cagttggtgattttagatttctt

SEQ ID NO: 5065222 - DNA, 21 bp, Homo sapiens
cagttggtggggccaggccag

SEQ ID NO: 5065223 - DNA, 15 bp, Homo sapiens
cagttggtgtgtttt

SEQ ID NO: 5065224 - DNA, 18 bp, Homo sapiens
cagttggttgtgtctttt

SEQ ID NO: 5065225 - DNA, 21 bp, Homo sapiens
cagttggttttgcatgtctgc

SEQ ID NO: 5065226 - DNA, 22 bp, Homo sapiens
cagttgtaacattctatttcaa

SEQ ID NO: 5065227 - DNA, 17 bp, Homo sapiens
cagttgtagaatgtatt

SEQ ID NO: 5065228 - DNA, 19 bp, Homo sapiens
cagttgtagaatgtattgt

SEQ ID NO: 5065229 - DNA, 15 bp, Homo sapiens
cagttgtagcagaaa

SEQ ID NO: 5065230 - DNA, 18 bp, Homo sapiens
cagttgtagcagaaacca

SEQ ID NO: 5065231 - DNA, 23 bp, Homo sapiens
cagttgtagcaggtttcactatt

SEQ ID NO: 5065232 - DNA, 23 bp, Homo sapiens
cagttgtagggttacagagacct

SEQ ID NO: 5065233 - DNA, 16 bp, Homo sapiens
cagttgtataaactgt

SEQ ID NO: 5065234 - DNA, 18 bp, Homo sapiens
cagttgtatttaacagaa

SEQ ID NO: 5065235 - DNA, 21 bp, Homo sapiens
cagttgtatttaacagaaatt

SEQ ID NO: 5065236 - DNA, 20 bp, Homo sapiens
cagttgtcccgattgtaact

SEQ ID NO: 5065237 - DNA, 14 bp, Homo sapiens
cagttgtccttaaa

SEQ ID NO: 5065238 - DNA, 19 bp, Homo sapiens
cagttgtctattctgagcc

SEQ ID NO: 5065239 - DNA, 22 bp, Homo sapiens
cagttgtctattctgagccttg

SEQ ID NO: 5065240 - DNA, 14 bp, Homo sapiens
cagttgtctctgat

SEQ ID NO: 5065241 - DNA, 15 bp, Homo sapiens
cagttgtctctgatg

SEQ ID NO: 5065242 - DNA, 22 bp, Homo sapiens
cagttgtctctgatgcagctta

SEQ ID NO: 5065243 - DNA, 13 bp, Homo sapiens
cagttgtctctgt

SEQ ID NO: 5065244 - DNA, 15 bp, Homo sapiens
cagttgtctctgttt

SEQ ID NO: 5065245 - DNA, 13 bp, Homo sapiens
cagttgtgaagag

SEQ ID NO: 5065246 - DNA, 22 bp, Homo sapiens
cagttgtgaatacattctttgc

SEQ ID NO: 5065247 - DNA, 14 bp, Homo sapiens
cagttgtgatttct

SEQ ID NO: 5065248 - DNA, 19 bp, Homo sapiens
cagttgtgatttctgtgga

SEQ ID NO: 5065249 - DNA, 22 bp, Homo sapiens
cagttgtgatttctgtggatcc

SEQ ID NO: 5065250 - DNA, 18 bp, Homo sapiens
cagttgtggtgtgccatg

SEQ ID NO: 5065251 - DNA, 16 bp, Homo sapiens
cagttgtgtcataaat

SEQ ID NO: 5065252 - DNA, 22 bp, Homo sapiens
cagttgtgtcataaattacaca

SEQ ID NO: 5065253 - DNA, 17 bp, Homo sapiens
cagttgtgtggcccagc

SEQ ID NO: 5065254 - DNA, 22 bp, Homo sapiens
cagttgtgtggcccagcacgag

SEQ ID NO: 5065255 - DNA, 18 bp, Homo sapiens
cagttgtgttagcctctt

SEQ ID NO: 5065256 - DNA, 12 bp, Homo sapiens
cagttgtgttca

SEQ ID NO: 5065257 - DNA, 23 bp, Homo sapiens
cagttgtgtttgttgctggcttg

SEQ ID NO: 5065258 - DNA, 21 bp, Homo sapiens
cagttgttaagtccttggctt

SEQ ID NO: 5065259 - DNA, 17 bp, Homo sapiens
cagttgttactgaagtt

SEQ ID NO: 5065260 - DNA, 22 bp, Homo sapiens
cagttgttactgaagttatctg

SEQ ID NO: 5065261 - DNA, 22 bp, Homo sapiens
cagttgttagtgtgtcttagtg

SEQ ID NO: 5065262 - DNA, 19 bp, Homo sapiens
cagttgttatattcattct

SEQ ID NO: 5065263 - DNA, 16 bp, Homo sapiens
cagttgttatttattg

SEQ ID NO: 5065264 - DNA, 23 bp, Homo sapiens
cagttgttcaataataaatattt

SEQ ID NO: 5065265 - DNA, 14 bp, Homo sapiens
cagttgttggcctc

SEQ ID NO: 5065266 - DNA, 16 bp, Homo sapiens
cagttgtttagatctt

SEQ ID NO: 5065267 - DNA, 17 bp, Homo sapiens
cagttgtttctaagagc

SEQ ID NO: 5065268 - DNA, 22 bp, Homo sapiens
cagttgtttctaagagcagagt

SEQ ID NO: 5065269 - DNA, 13 bp, Homo sapiens
cagttgtttgatg

SEQ ID NO: 5065270 - DNA, 14 bp, Homo sapiens
cagttgtttgcttc

SEQ ID NO: 5065271 - DNA, 17 bp, Homo sapiens
cagttgtttgcttcttg

SEQ ID NO: 5065272 - DNA, 18 bp, Homo sapiens
cagttgtttgtttttgct

SEQ ID NO: 5065273 - DNA, 14 bp, Homo sapiens
cagttgttttcccg

SEQ ID NO: 5065274 - DNA, 22 bp, Homo sapiens
cagtttaaaaaataacttcatt

SEQ ID NO: 5065275 - DNA, 15 bp, Homo sapiens
cagtttaaaagcacg

SEQ ID NO: 5065276 - DNA, 11 bp, Homo sapiens
cagtttaacag

SEQ ID NO: 5065277 - DNA, 13 bp, Homo sapiens
cagtttaacagaa

SEQ ID NO: 5065278 - DNA, 20 bp, Homo sapiens
cagtttaacctgatgcagtc

SEQ ID NO: 5065279 - DNA, 20 bp, Homo sapiens
cagtttaagccgcagacctg

SEQ ID NO: 5065280 - DNA, 23 bp, Homo sapiens
cagtttaagccgcagacctggag

SEQ ID NO: 5065281 - DNA, 23 bp, Homo sapiens
cagtttaaggtacactgtttcca

SEQ ID NO: 5065282 - DNA, 18 bp, Homo sapiens
cagtttaatgaagatcta

SEQ ID NO: 5065283 - DNA, 15 bp, Homo sapiens
cagtttaatgcaaga

SEQ ID NO: 5065284 - DNA, 22 bp, Homo sapiens
cagtttaatgtctcctttgctc

SEQ ID NO: 5065285 - DNA, 24 bp, Homo sapiens
cagtttaattttgatatattcaaa

SEQ ID NO: 5065286 - DNA, 14 bp, Homo sapiens
cagtttacagtatt

SEQ ID NO: 5065287 - DNA, 23 bp, Homo sapiens
cagtttaccagttgccttttatc

SEQ ID NO: 5065288 - DNA, 15 bp, Homo sapiens
cagtttactggttta

SEQ ID NO: 5065289 - DNA, 16 bp, Homo sapiens
cagtttagaacagagg

SEQ ID NO: 5065290 - DNA, 18 bp, Homo sapiens
cagtttagaacctacaaa

SEQ ID NO: 5065291 - DNA, 21 bp, Homo sapiens
cagtttagaacctacaaaagc

SEQ ID NO: 5065292 - DNA, 17 bp, Homo sapiens
cagtttaggacccaagg

SEQ ID NO: 5065293 - DNA, 22 bp, Homo sapiens
cagtttaggacccaaggtggtc

SEQ ID NO: 5065294 - DNA, 16 bp, Homo sapiens
cagtttataaagccaa

SEQ ID NO: 5065295 - DNA, 20 bp, Homo sapiens
cagtttatatactgctattt

SEQ ID NO: 5065296 - DNA, 18 bp, Homo sapiens
cagtttatattgtggaat

SEQ ID NO: 5065297 - DNA, 23 bp, Homo sapiens
cagtttatattgtggaataaatc

SEQ ID NO: 5065298 - DNA, 14 bp, Homo sapiens
cagtttatatttaa

SEQ ID NO: 5065299 - DNA, 17 bp, Homo sapiens
cagtttatatttaactc

SEQ ID NO: 5065300 - DNA, 19 bp, Homo sapiens
cagtttatcatgaagcctg

SEQ ID NO: 5065301 - DNA, 20 bp, Homo sapiens
cagtttatcatgaagcctgt

SEQ ID NO: 5065302 - DNA, 22 bp, Homo sapiens
cagtttatcatgaagcctgtgg

SEQ ID NO: 5065303 - DNA, 17 bp, Homo sapiens
ctaagagcctctggaag

SEQ ID NO: 5065304 - DNA, 18 bp, Homo sapiens
ctaagagcctctggaagg

SEQ ID NO: 5065305 - DNA, 18 bp, Homo sapiens
ctaagagctagcgctgcc

SEQ ID NO: 5065306 - DNA, 20 bp, Homo sapiens
ctaagagctagcgctgccgc

SEQ ID NO: 5065307 - DNA, 13 bp, Homo sapiens
ctaagagctcccg

SEQ ID NO: 5065308 - DNA, 24 bp, Homo sapiens
ctaagaggcgacttcctctccagc

SEQ ID NO: 5065309 - DNA, 12 bp, Homo sapiens
ctaagaggctgc

SEQ ID NO: 5065310 - DNA, 14 bp, Homo sapiens
ctaagaggtgggag

SEQ ID NO: 5065311 - DNA, 16 bp, Homo sapiens
ctaagagtaaagcaac

SEQ ID NO: 5065312 - DNA, 22 bp, Homo sapiens
ctaagagtcctgggtaaatgtg

SEQ ID NO: 5065313 - DNA, 17 bp, Homo sapiens
ctaagataattaaatga

SEQ ID NO: 5065314 - DNA, 22 bp, Homo sapiens
ctaagataattaaatgaaatac

SEQ ID NO: 5065315 - DNA, 19 bp, Homo sapiens
ctaagatactgctgatgct

SEQ ID NO: 5065316 - DNA, 15 bp, Homo sapiens
ctaagatagaaagct

SEQ ID NO: 5065317 - DNA, 16 bp, Homo sapiens
ctaagatagaaagctg

SEQ ID NO: 5065318 - DNA, 20 bp, Homo sapiens
ctaagatagaaagctggact

SEQ ID NO: 5065319 - DNA, 20 bp, Homo sapiens
ctaagatataatttaaacgt

SEQ ID NO: 5065320 - DNA, 12 bp, Homo sapiens
ctaagatcttag

SEQ ID NO: 5065321 - DNA, 19 bp, Homo sapiens
ctaagatgaaatgcactgt

SEQ ID NO: 5065322 - DNA, 17 bp, Homo sapiens
ctaagatgaaattgcca

SEQ ID NO: 5065323 - DNA, 19 bp, Homo sapiens
ctaagatgacattgctaag

SEQ ID NO: 5065324 - DNA, 22 bp, Homo sapiens
ctaagatgagatttgccagcac

SEQ ID NO: 5065325 - DNA, 18 bp, Homo sapiens
ctaagatgccatgtgcag

SEQ ID NO: 5065326 - DNA, 11 bp, Homo sapiens
ctaagatgctc

SEQ ID NO: 5065327 - DNA, 18 bp, Homo sapiens
ctaagatgtgttcttatt

SEQ ID NO: 5065328 - DNA, 15 bp, Homo sapiens
ctaagattaatagca

SEQ ID NO: 5065329 - DNA, 22 bp, Homo sapiens
ctaagattacaaatcagaagtc

SEQ ID NO: 5065330 - DNA, 23 bp, Homo sapiens
ctaagattacaaatcagaagtca

SEQ ID NO: 5065331 - DNA, 12 bp, Homo sapiens
ctaagattctaa

SEQ ID NO: 5065332 - DNA, 13 bp, Homo sapiens
ctaagattctaat

SEQ ID NO: 5065333 - DNA, 15 bp, Homo sapiens
ctaagattctaatga

SEQ ID NO: 5065334 - DNA, 18 bp, Homo sapiens
ctaagattctagatcaga

SEQ ID NO: 5065335 - DNA, 12 bp, Homo sapiens
ctaagattgtac

SEQ ID NO: 5065336 - DNA, 14 bp, Homo sapiens
ctaagattgtacat

SEQ ID NO: 5065337 - DNA, 17 bp, Homo sapiens
ctaagatttatctgcaa

SEQ ID NO: 5065338 - DNA, 20 bp, Homo sapiens
ctaagatttattttgttaaa

SEQ ID NO: 5065339 - DNA, 18 bp, Homo sapiens
ctaagatttcctttggca

SEQ ID NO: 5065340 - DNA, 23 bp, Homo sapiens
ctaagcaaaaagaacaaagctgg

SEQ ID NO: 5065341 - DNA, 23 bp, Homo sapiens
ctaagcaaaagggaaaaggagcg

SEQ ID NO: 5065342 - DNA, 15 bp, Homo sapiens
ctaagcaaaatgtga

SEQ ID NO: 5065343 - DNA, 15 bp, Homo sapiens
ctaagcaaccacact

SEQ ID NO: 5065344 - DNA, 19 bp, Homo sapiens
ctaagcaagatgttttgta

SEQ ID NO: 5065345 - DNA, 22 bp, Homo sapiens
ctaagcaagatgttttgtataa

SEQ ID NO: 5065346 - DNA, 16 bp, Homo sapiens
ctaagcaagccaggag

SEQ ID NO: 5065347 - DNA, 23 bp, Homo sapiens
ctaagcaatcactgggcccagag

SEQ ID NO: 5065348 - DNA, 15 bp, Homo sapiens
ctaagcaatgcaaat

SEQ ID NO: 5065349 - DNA, 20 bp, Homo sapiens
ctaagcaatgcaaatgtcta

SEQ ID NO: 5065350 - DNA, 21 bp, Homo sapiens
ctaagcaatgcaaatgtctaa

SEQ ID NO: 5065351 - DNA, 15 bp, Homo sapiens
ctaagcaatttcttg

SEQ ID NO: 5065352 - DNA, 20 bp, Homo sapiens
ctaagcacgggccatatgaa

SEQ ID NO: 5065353 - DNA, 16 bp, Homo sapiens
ctaagcagaaagtgcc

SEQ ID NO: 5065354 - DNA, 17 bp, Homo sapiens
ctaagcagaaagtgcct

SEQ ID NO: 5065355 - DNA, 22 bp, Homo sapiens
ctaagcagaaagtgcctttcag

SEQ ID NO: 5065356 - DNA, 16 bp, Homo sapiens
ctaagcagaagactct

SEQ ID NO: 5065357 - DNA, 17 bp, Homo sapiens
ctaagcagaataatgga

SEQ ID NO: 5065358 - DNA, 15 bp, Homo sapiens
ctaagcagaggaggg

SEQ ID NO: 5065359 - DNA, 18 bp, Homo sapiens
ctaagcagaggaggggcc

SEQ ID NO: 5065360 - DNA, 17 bp, Homo sapiens
ctaagcagccaggaggg

SEQ ID NO: 5065361 - DNA, 16 bp, Homo sapiens
ctaagcagctgggact

SEQ ID NO: 5065362 - DNA, 16 bp, Homo sapiens
ctaagcagtgcttgta

SEQ ID NO: 5065363 - DNA, 22 bp, Homo sapiens
ctaagcatatcgtaaagctgtt

SEQ ID NO: 5065364 - DNA, 19 bp, Homo sapiens
ctaagcatccatttttccc

SEQ ID NO: 5065365 - DNA, 13 bp, Homo sapiens
ctaagcatctaag

SEQ ID NO: 5065366 - DNA, 16 bp, Homo sapiens
ctaagcattccacact

SEQ ID NO: 5065367 - DNA, 14 bp, Homo sapiens
ctaagcattttctc

SEQ ID NO: 5065368 - DNA, 14 bp, Homo sapiens
ctaagccaagctgt

SEQ ID NO: 5065369 - DNA, 16 bp, Homo sapiens
ctaagccagctgcccc

SEQ ID NO: 5065370 - DNA, 17 bp, Homo sapiens
ctaagcccaggatctct

SEQ ID NO: 5065371 - DNA, 16 bp, Homo sapiens
ctaagcccatgggaca

SEQ ID NO: 5065372 - DNA, 16 bp, Homo sapiens
ctaagccccagcaagc

SEQ ID NO: 5065373 - DNA, 20 bp, Homo sapiens
ctaagcccccagggcctcca

SEQ ID NO: 5065374 - DNA, 14 bp, Homo sapiens
ctaagcccccgctg

SEQ ID NO: 5065375 - DNA, 22 bp, Homo sapiens
ctaagcccccgctgtaatgaaa

SEQ ID NO: 5065376 - DNA, 18 bp, Homo sapiens
ctaagccctcgaaccaag

SEQ ID NO: 5065377 - DNA, 20 bp, Homo sapiens
ctaagccctcgaaccaaggc

SEQ ID NO: 5065378 - DNA, 16 bp, Homo sapiens
ctaagccctttgccat

SEQ ID NO: 5065379 - DNA, 20 bp, Homo sapiens
ctaagcctgaaggggcgtct

SEQ ID NO: 5065380 - DNA, 12 bp, Homo sapiens
ctaagcctggac

SEQ ID NO: 5065381 - DNA, 13 bp, Homo sapiens
ctaagcctggaca

SEQ ID NO: 5065382 - DNA, 22 bp, Homo sapiens
ctaagcctggcttagaaggcac

SEQ ID NO: 5065383 - DNA, 14 bp, Homo sapiens
ctaagcctgtcccc

SEQ ID NO: 5065384 - DNA, 18 bp, Homo sapiens
ctaagcctgtccccagac

SEQ ID NO: 5065385 - DNA, 11 bp, Homo sapiens
ctaagcctgtt

SEQ ID NO: 5065386 - DNA, 17 bp, Homo sapiens
ctaagcgtgctgacatc

SEQ ID NO: 5065387 - DNA, 16 bp, Homo sapiens
ctaagctaaagaaact

SEQ ID NO: 5065388 - DNA, 21 bp, Homo sapiens
ctaagctattcagtaataact

SEQ ID NO: 5065389 - DNA, 15 bp, Homo sapiens
ctaagctccaggtgc

SEQ ID NO: 5065390 - DNA, 13 bp, Homo sapiens
ctaagctctctgg

SEQ ID NO: 5065391 - DNA, 16 bp, Homo sapiens
ctaagctgcaggcaca

SEQ ID NO: 5065392 - DNA, 15 bp, Homo sapiens
ctaagctgccagcct

SEQ ID NO: 5065393 - DNA, 15 bp, Homo sapiens
ctaagctgccctgag

SEQ ID NO: 5065394 - DNA, 15 bp, Homo sapiens
ctaagctgctctaaa

SEQ ID NO: 5065395 - DNA, 15 bp, Homo sapiens
ctaagctggagctct

SEQ ID NO: 5065396 - DNA, 17 bp, Homo sapiens
ctaagctggctctgttt

SEQ ID NO: 5065397 - DNA, 17 bp, Homo sapiens
ctaagctttctcctttg

SEQ ID NO: 5065398 - DNA, 20 bp, Homo sapiens
ctaaggaaatggagaagctc

SEQ ID NO: 5065399 - DNA, 19 bp, Homo sapiens
ctaaggaagacacagccca

SEQ ID NO: 5065400 - DNA, 21 bp, Homo sapiens
ctaaggaagacacagcccaga

SEQ ID NO: 5065401 - DNA, 22 bp, Homo sapiens
ctaaggaagacacagcccagac

SEQ ID NO: 5065402 - DNA, 23 bp, Homo sapiens
ctaaggaagatcactttgctctg

SEQ ID NO: 5065403 - DNA, 16 bp, Homo sapiens
ctaaggaatatatatg

SEQ ID NO: 5065404 - DNA, 17 bp, Homo sapiens
ctaaggaatatatatgg

SEQ ID NO: 5065405 - DNA, 15 bp, Homo sapiens
ctaaggaatctgaaa

SEQ ID NO: 5065406 - DNA, 18 bp, Homo sapiens
ctaaggaatgcacaaatt

SEQ ID NO: 5065407 - DNA, 14 bp, Homo sapiens
ctaaggacaaatta

SEQ ID NO: 5065408 - DNA, 13 bp, Homo sapiens
ctaaggacacact

SEQ ID NO: 5065409 - DNA, 14 bp, Homo sapiens
ctaaggacacacta

SEQ ID NO: 5065410 - DNA, 19 bp, Homo sapiens
ctaaggacctgaaattcca

SEQ ID NO: 5065411 - DNA, 14 bp, Homo sapiens
ctaaggacttcttt

SEQ ID NO: 5065412 - DNA, 16 bp, Homo sapiens
ctaaggacttctttaa

SEQ ID NO: 5065413 - DNA, 19 bp, Homo sapiens
ctaaggagatataatatag

SEQ ID NO: 5065414 - DNA, 13 bp, Homo sapiens
ctaaggagcatga

SEQ ID NO: 5065415 - DNA, 16 bp, Homo sapiens
ctaaggagcctgggat

SEQ ID NO: 5065416 - DNA, 19 bp, Homo sapiens
ctaaggagcgctagtgcct

SEQ ID NO: 5065417 - DNA, 15 bp, Homo sapiens
ctaaggagttttgtt

SEQ ID NO: 5065418 - DNA, 20 bp, Homo sapiens
ctaaggagttttgttgtatt

SEQ ID NO: 5065419 - DNA, 18 bp, Homo sapiens
ctaaggataatgaaataa

SEQ ID NO: 5065420 - DNA, 20 bp, Homo sapiens
ctaaggataatgaaataatc

SEQ ID NO: 5065421 - DNA, 22 bp, Homo sapiens
ctaaggataatgaaataatcag

SEQ ID NO: 5065422 - DNA, 17 bp, Homo sapiens
ctaaggatacctgcttt

SEQ ID NO: 5065423 - DNA, 15 bp, Homo sapiens
ctaaggatagccttt

SEQ ID NO: 5065424 - DNA, 17 bp, Homo sapiens
ctaaggatagcctttgt

SEQ ID NO: 5065425 - DNA, 18 bp, Homo sapiens
ctaaggatagcctttgta

SEQ ID NO: 5065426 - DNA, 15 bp, Homo sapiens
ctaaggatagggaaa

SEQ ID NO: 5065427 - DNA, 18 bp, Homo sapiens
ctaaggatgctaaacctt

SEQ ID NO: 5065428 - DNA, 20 bp, Homo sapiens
ctaaggatgctaaaccttag

SEQ ID NO: 5065429 - DNA, 22 bp, Homo sapiens
ctaaggatggaaaggtgacagt

SEQ ID NO: 5065430 - DNA, 18 bp, Homo sapiens
ctaaggatgtcacagggc

SEQ ID NO: 5065431 - DNA, 20 bp, Homo sapiens
ctaaggcacccacaaataaa

SEQ ID NO: 5065432 - DNA, 19 bp, Homo sapiens
ctaaggcaggaggatcact

SEQ ID NO: 5065433 - DNA, 22 bp, Homo sapiens
ctaaggcaggtgggcagacagt

SEQ ID NO: 5065434 - DNA, 20 bp, Homo sapiens
ctaaggcatctatctgtgct

SEQ ID NO: 5065435 - DNA, 22 bp, Homo sapiens
ctaaggcatctatctgtgctag

SEQ ID NO: 5065436 - DNA, 22 bp, Homo sapiens
ctaaggcatgctcccagcattt

SEQ ID NO: 5065437 - DNA, 19 bp, Homo sapiens
ctaaggccaatgggctaga

SEQ ID NO: 5065438 - DNA, 22 bp, Homo sapiens
ctaaggccaatgggctagaggg

SEQ ID NO: 5065439 - DNA, 21 bp, Homo sapiens
ctaaggccactgttttaaaag

SEQ ID NO: 5065440 - DNA, 15 bp, Homo sapiens
ctaaggccagccatt

SEQ ID NO: 5065441 - DNA, 14 bp, Homo sapiens
ctaaggccagctag

SEQ ID NO: 5065442 - DNA, 18 bp, Homo sapiens
ctaaggcccagctgccag

SEQ ID NO: 5065443 - DNA, 22 bp, Homo sapiens
ctaaggcccccaaacatagccc

SEQ ID NO: 5065444 - DNA, 19 bp, Homo sapiens
ctaaggccgaagaagggtc

SEQ ID NO: 5065445 - DNA, 19 bp, Homo sapiens
ctaaggcctcttgctggtg

SEQ ID NO: 5065446 - DNA, 22 bp, Homo sapiens
ctaaggccttttatgtaatttc

SEQ ID NO: 5065447 - DNA, 15 bp, Homo sapiens
ctaaggctccccacc

SEQ ID NO: 5065448 - DNA, 16 bp, Homo sapiens
ctaaggctccccaccc

SEQ ID NO: 5065449 - DNA, 15 bp, Homo sapiens
ctaaggctcctcctt

SEQ ID NO: 5065450 - DNA, 16 bp, Homo sapiens
ctaaggctcctccttg

SEQ ID NO: 5065451 - DNA, 21 bp, Homo sapiens
ctaaggctctatgagtctaga

SEQ ID NO: 5065452 - DNA, 11 bp, Homo sapiens
ctaaggctctg

SEQ ID NO: 5065453 - DNA, 13 bp, Homo sapiens
ctaaggctctgag

SEQ ID NO: 5065454 - DNA, 17 bp, Homo sapiens
ctaaggctgtttgcttc

SEQ ID NO: 5065455 - DNA, 11 bp, Homo sapiens
ctaaggcttcc

SEQ ID NO: 5065456 - DNA, 17 bp, Homo sapiens
ctaaggcttccggctga

SEQ ID NO: 5065457 - DNA, 22 bp, Homo sapiens
ctaagggaaagaattgaggaat

SEQ ID NO: 5065458 - DNA, 14 bp, Homo sapiens
ctaagggaaaggga

SEQ ID NO: 5065459 - DNA, 15 bp, Homo sapiens
ctaagggaagaactc

SEQ ID NO: 5065460 - DNA, 19 bp, Homo sapiens
ctaagggaagacatttctt

SEQ ID NO: 5065461 - DNA, 20 bp, Homo sapiens
ctaagggaggcacttcctcc

SEQ ID NO: 5065462 - DNA, 23 bp, Homo sapiens
ctaagggcaggaagacttccagc

SEQ ID NO: 5065463 - DNA, 15 bp, Homo sapiens
ctaagggcttgtttt

SEQ ID NO: 5065464 - DNA, 19 bp, Homo sapiens
ctaaggggacctacagaca

SEQ ID NO: 5065465 - DNA, 13 bp, Homo sapiens
ctaaggggcagct

SEQ ID NO: 5065466 - DNA, 17 bp, Homo sapiens
ctaaggggcccctcctt

SEQ ID NO: 5065467 - DNA, 12 bp, Homo sapiens
ctaaggggcccg

SEQ ID NO: 5065468 - DNA, 18 bp, Homo sapiens
ctaaggggcccggccagc

SEQ ID NO: 5065469 - DNA, 23 bp, Homo sapiens
ctaaggggcttgtgttctgctcc

SEQ ID NO: 5065470 - DNA, 19 bp, Homo sapiens
ctaagggtcgaaagctcta

SEQ ID NO: 5065471 - DNA, 23 bp, Homo sapiens
ctaagggtcgaaagctctagaat

SEQ ID NO: 5065472 - DNA, 20 bp, Homo sapiens
ctaagggtgggtgctcagaa

SEQ ID NO: 5065473 - DNA, 21 bp, Homo sapiens
ctaagggtgggtgctcagaat

SEQ ID NO: 5065474 - DNA, 22 bp, Homo sapiens
ctaagggtgggtgctcagaata

SEQ ID NO: 5065475 - DNA, 23 bp, Homo sapiens
ctaaggtaactcccatatctcct

SEQ ID NO: 5065476 - DNA, 13 bp, Homo sapiens
ctaaggtactgtg

SEQ ID NO: 5065477 - DNA, 15 bp, Homo sapiens
ctaaggtactgtggg

SEQ ID NO: 5065478 - DNA, 19 bp, Homo sapiens
ctaaggtcattaccacagg

SEQ ID NO: 5065479 - DNA, 22 bp, Homo sapiens
ctaaggtccggtgttctaagat

SEQ ID NO: 5065480 - DNA, 20 bp, Homo sapiens
ctaattcatacctccctcct

SEQ ID NO: 5065481 - DNA, 17 bp, Homo sapiens
ctaattcccaacatttc

SEQ ID NO: 5065482 - DNA, 23 bp, Homo sapiens
ctaattcctgttgctctgtttct

SEQ ID NO: 5065483 - DNA, 12 bp, Homo sapiens
ctaattccttaa

SEQ ID NO: 5065484 - DNA, 16 bp, Homo sapiens
ctaattccttaaatga

SEQ ID NO: 5065485 - DNA, 17 bp, Homo sapiens
ctaattccttaaatgaa

SEQ ID NO: 5065486 - DNA, 16 bp, Homo sapiens
ctaattcgatgaaggc

SEQ ID NO: 5065487 - DNA, 15 bp, Homo sapiens
ctaattctatgatta

SEQ ID NO: 5065488 - DNA, 16 bp, Homo sapiens
ctaattctattaaagt

SEQ ID NO: 5065489 - DNA, 15 bp, Homo sapiens
ctaattctatttctc

SEQ ID NO: 5065490 - DNA, 16 bp, Homo sapiens
ctaattctatttctct

SEQ ID NO: 5065491 - DNA, 18 bp, Homo sapiens
ctaattctctaggaaagt

SEQ ID NO: 5065492 - DNA, 20 bp, Homo sapiens
ctaattctcttacccagaat

SEQ ID NO: 5065493 - DNA, 14 bp, Homo sapiens
ctaattctgcctta

SEQ ID NO: 5065494 - DNA, 18 bp, Homo sapiens
ctaattctgtgattaaaa

SEQ ID NO: 5065495 - DNA, 19 bp, Homo sapiens
ctaattctgtgattaaaat

SEQ ID NO: 5065496 - DNA, 18 bp, Homo sapiens
ctaattcttctgtcctga

SEQ ID NO: 5065497 - DNA, 17 bp, Homo sapiens
ctaattcttgcatattt

SEQ ID NO: 5065498 - DNA, 22 bp, Homo sapiens
ctaattctttgacctgttggga

SEQ ID NO: 5065499 - DNA, 15 bp, Homo sapiens
ctaattcttttcaaa

SEQ ID NO: 5065500 - DNA, 17 bp, Homo sapiens
ctaattcttttcaaaat

SEQ ID NO: 5065501 - DNA, 18 bp, Homo sapiens
ctaattgctgccaggatt

SEQ ID NO: 5065502 - DNA, 18 bp, Homo sapiens
ctaattgctgttgaaagc

SEQ ID NO: 5065503 - DNA, 12 bp, Homo sapiens
ctaattgcttat

SEQ ID NO: 5065504 - DNA, 21 bp, Homo sapiens
ctaattggaagaaattcctgt

SEQ ID NO: 5065505 - DNA, 15 bp, Homo sapiens
ctaattggaagaaga

SEQ ID NO: 5065506 - DNA, 18 bp, Homo sapiens
ctaattggaaggagaggg

SEQ ID NO: 5065507 - DNA, 17 bp, Homo sapiens
ctaattggcagcaccca

SEQ ID NO: 5065508 - DNA, 22 bp, Homo sapiens
ctaattggcagcacccactcag

SEQ ID NO: 5065509 - DNA, 23 bp, Homo sapiens
ctaattggcagcacccactcagc

SEQ ID NO: 5065510 - DNA, 23 bp, Homo sapiens
ctaattgggagtccaggcacagg

SEQ ID NO: 5065511 - DNA, 19 bp, Homo sapiens
ctaattggtacttttaaaa

SEQ ID NO: 5065512 - DNA, 17 bp, Homo sapiens
ctaattgtaagtgaaat

SEQ ID NO: 5065513 - DNA, 18 bp, Homo sapiens
ctaattgtactaatctga

SEQ ID NO: 5065514 - DNA, 13 bp, Homo sapiens
ctaattgtataac

SEQ ID NO: 5065515 - DNA, 15 bp, Homo sapiens
ctaattgtataacag

SEQ ID NO: 5065516 - DNA, 16 bp, Homo sapiens
ctaattgtataacagg

SEQ ID NO: 5065517 - DNA, 14 bp, Homo sapiens
ctaattgtatttag

SEQ ID NO: 5065518 - DNA, 18 bp, Homo sapiens
ctaattgtcacatcaagc

SEQ ID NO: 5065519 - DNA, 22 bp, Homo sapiens
ctaattgtcacatcaagcatca

SEQ ID NO: 5065520 - DNA, 17 bp, Homo sapiens
ctaattgtcagtgattt

SEQ ID NO: 5065521 - DNA, 14 bp, Homo sapiens
ctaattgtggtaga

SEQ ID NO: 5065522 - DNA, 18 bp, Homo sapiens
ctaattgtggtagaaatt

SEQ ID NO: 5065523 - DNA, 17 bp, Homo sapiens
ctaattgttttttttct

SEQ ID NO: 5065524 - DNA, 15 bp, Homo sapiens
ctaatttaaaccagc

SEQ ID NO: 5065525 - DNA, 16 bp, Homo sapiens
ctaatttaaaccagca

SEQ ID NO: 5065526 - DNA, 11 bp, Homo sapiens
ctaatttaaca

SEQ ID NO: 5065527 - DNA, 13 bp, Homo sapiens
ctaatttatacaa

SEQ ID NO: 5065528 - DNA, 14 bp, Homo sapiens
ctaatttatacaaa

SEQ ID NO: 5065529 - DNA, 22 bp, Homo sapiens
ctaatttatacaaaataattta

SEQ ID NO: 5065530 - DNA, 22 bp, Homo sapiens
ctaatttatagcaagatattga

SEQ ID NO: 5065531 - DNA, 15 bp, Homo sapiens
ctaatttatattatc

SEQ ID NO: 5065532 - DNA, 23 bp, Homo sapiens
ctaatttatcctgaaatttcaga

SEQ ID NO: 5065533 - DNA, 17 bp, Homo sapiens
ctaatttattctaaatt

SEQ ID NO: 5065534 - DNA, 16 bp, Homo sapiens
ctaatttatttcccca

SEQ ID NO: 5065535 - DNA, 14 bp, Homo sapiens
ctaatttattttgt

SEQ ID NO: 5065536 - DNA, 15 bp, Homo sapiens
ctaatttcattttag

SEQ ID NO: 5065537 - DNA, 19 bp, Homo sapiens
ctaatttctcctcccttcc

SEQ ID NO: 5065538 - DNA, 21 bp, Homo sapiens
ctaatttctgtgtctaaattt

SEQ ID NO: 5065539 - DNA, 23 bp, Homo sapiens
ctaatttgaataaactctcccct

SEQ ID NO: 5065540 - DNA, 15 bp, Homo sapiens
ctaatttgaatgaaa

SEQ ID NO: 5065541 - DNA, 21 bp, Homo sapiens
ctaatttgcactaatgtgtta

SEQ ID NO: 5065542 - DNA, 19 bp, Homo sapiens
ctaatttgttttggatata

SEQ ID NO: 5065543 - DNA, 14 bp, Homo sapiens
ctaattttaaataa

SEQ ID NO: 5065544 - DNA, 19 bp, Homo sapiens
ctaattttccataagctat

SEQ ID NO: 5065545 - DNA, 17 bp, Homo sapiens
ctaattttctatcagaa

SEQ ID NO: 5065546 - DNA, 20 bp, Homo sapiens
ctaattttctcccaagctga

SEQ ID NO: 5065547 - DNA, 12 bp, Homo sapiens
ctaattttctgt

SEQ ID NO: 5065548 - DNA, 14 bp, Homo sapiens
ctaattttctttcc

SEQ ID NO: 5065549 - DNA, 23 bp, Homo sapiens
ctaattttctttccgacacattt

SEQ ID NO: 5065550 - DNA, 15 bp, Homo sapiens
ctaattttggatgga

SEQ ID NO: 5065551 - DNA, 15 bp, Homo sapiens
ctaattttgtacata

SEQ ID NO: 5065552 - DNA, 16 bp, Homo sapiens
ctaattttgtacatac

SEQ ID NO: 5065553 - DNA, 15 bp, Homo sapiens
ctaattttgtacgta

SEQ ID NO: 5065554 - DNA, 22 bp, Homo sapiens
ctaattttgtgctctttcctgc

SEQ ID NO: 5065555 - DNA, 17 bp, Homo sapiens
ctaattttgttgaaaat

SEQ ID NO: 5065556 - DNA, 12 bp, Homo sapiens
ctaatttttaag

SEQ ID NO: 5065557 - DNA, 22 bp, Homo sapiens
ctaatttttaagaattgagtaa

SEQ ID NO: 5065558 - DNA, 12 bp, Homo sapiens
ctaatttttcct

SEQ ID NO: 5065559 - DNA, 18 bp, Homo sapiens
ctaatttttggagaaatg

SEQ ID NO: 5065560 - DNA, 20 bp, Homo sapiens
ctaatttttgtaattttagt

SEQ ID NO: 5065561 - DNA, 14 bp, Homo sapiens
ctaatttttgtatg

SEQ ID NO: 5065562 - DNA, 23 bp, Homo sapiens
ctaatttttgtatgtttagtaga

SEQ ID NO: 5065563 - DNA, 20 bp, Homo sapiens
ctaatttttgtatttttagt

SEQ ID NO: 5065564 - DNA, 17 bp, Homo sapiens
ctaattttttaaagaat

SEQ ID NO: 5065565 - DNA, 17 bp, Homo sapiens
ctaattttttgtacttt

SEQ ID NO: 5065566 - DNA, 17 bp, Homo sapiens
ctaattttttgtgtttt

SEQ ID NO: 5065567 - DNA, 13 bp, Homo sapiens
ctaatttttttct

SEQ ID NO: 5065568 - DNA, 16 bp, Homo sapiens
ctaatttttttgtatt

SEQ ID NO: 5065569 - DNA, 20 bp, Homo sapiens
ctaatttttttgtattttag

SEQ ID NO: 5065570 - DNA, 10 bp, Homo sapiens
ctacaaaaac

SEQ ID NO: 5065571 - DNA, 17 bp, Homo sapiens
ctacaaaaacacagcaa

SEQ ID NO: 5065572 - DNA, 18 bp, Homo sapiens
ctacaaaaacacagcaag

SEQ ID NO: 5065573 - DNA, 22 bp, Homo sapiens
ctacaaaaaggtataaataata

SEQ ID NO: 5065574 - DNA, 15 bp, Homo sapiens
ctacaaaaatacaat

SEQ ID NO: 5065575 - DNA, 12 bp, Homo sapiens
ctacaaaagctt

SEQ ID NO: 5065576 - DNA, 19 bp, Homo sapiens
ctacaaaagcttgtgtatc

SEQ ID NO: 5065577 - DNA, 22 bp, Homo sapiens
ctacaaaataaaacttggttct

SEQ ID NO: 5065578 - DNA, 16 bp, Homo sapiens
ctacaaaataaagctg

SEQ ID NO: 5065579 - DNA, 21 bp, Homo sapiens
ctacaaacaaaatttctatta

SEQ ID NO: 5065580 - DNA, 18 bp, Homo sapiens
ctacaaaccaggagcaac

SEQ ID NO: 5065581 - DNA, 19 bp, Homo sapiens
ctacaaacttttaagattt

SEQ ID NO: 5065582 - DNA, 17 bp, Homo sapiens
ctacaaacttttataaa

SEQ ID NO: 5065583 - DNA, 16 bp, Homo sapiens
ctacaaagaagacatg

SEQ ID NO: 5065584 - DNA, 18 bp, Homo sapiens
ctacaaagaagacatgtt

SEQ ID NO: 5065585 - DNA, 20 bp, Homo sapiens
ctacaaagcactagagaatg

SEQ ID NO: 5065586 - DNA, 13 bp, Homo sapiens
ctacaaagcagag

SEQ ID NO: 5065587 - DNA, 23 bp, Homo sapiens
ctacaaagctgaagaaaatgaag

SEQ ID NO: 5065588 - DNA, 18 bp, Homo sapiens
ctacaaagctttgctaca

SEQ ID NO: 5065589 - DNA, 23 bp, Homo sapiens
ctacaaaggaggacaagaccctc

SEQ ID NO: 5065590 - DNA, 18 bp, Homo sapiens
ctacaaaggtttaaatga

SEQ ID NO: 5065591 - DNA, 19 bp, Homo sapiens
ctacaaaggtttaaatgaa

SEQ ID NO: 5065592 - DNA, 17 bp, Homo sapiens
ctacaaagtaaaatgaa

SEQ ID NO: 5065593 - DNA, 13 bp, Homo sapiens
ctacaaatatagg

SEQ ID NO: 5065594 - DNA, 22 bp, Homo sapiens
ctacaaatttatgcatttcatt

SEQ ID NO: 5065595 - DNA, 16 bp, Homo sapiens
ctacaacagcctcact

SEQ ID NO: 5065596 - DNA, 21 bp, Homo sapiens
ctacaacatattgtttcagtg

SEQ ID NO: 5065597 - DNA, 16 bp, Homo sapiens
ctacaacattagaata

SEQ ID NO: 5065598 - DNA, 20 bp, Homo sapiens
ctacaaccaagctctctgca

SEQ ID NO: 5065599 - DNA, 22 bp, Homo sapiens
ctacaaccagagccccccacaa

SEQ ID NO: 5065600 - DNA, 19 bp, Homo sapiens
ctacaaccatccctgccac

SEQ ID NO: 5065601 - DNA, 20 bp, Homo sapiens
ctacaactaaaaataaatta

SEQ ID NO: 5065602 - DNA, 14 bp, Homo sapiens
ctacaactccagcc

SEQ ID NO: 5065603 - DNA, 17 bp, Homo sapiens
ctacaacttaatggaaa

SEQ ID NO: 5065604 - DNA, 17 bp, Homo sapiens
ctacaacttcagcagta

SEQ ID NO: 5065605 - DNA, 19 bp, Homo sapiens
ctacaacttttgttttctg

SEQ ID NO: 5065606 - DNA, 20 bp, Homo sapiens
ctacaacttttgttttctga

SEQ ID NO: 5065607 - DNA, 19 bp, Homo sapiens
ctacaagagcagcctgtgg

SEQ ID NO: 5065608 - DNA, 20 bp, Homo sapiens
ctacaagagcagcctgtggc

SEQ ID NO: 5065609 - DNA, 22 bp, Homo sapiens
ctacaagagcagcctgtggcat

SEQ ID NO: 5065610 - DNA, 15 bp, Homo sapiens
ctacaagcatatttg

SEQ ID NO: 5065611 - DNA, 16 bp, Homo sapiens
ctacaagcatatttga

SEQ ID NO: 5065612 - DNA, 22 bp, Homo sapiens
ctacaagccaaaagtccctccc

SEQ ID NO: 5065613 - DNA, 21 bp, Homo sapiens
ctacaaggactccattggatc

SEQ ID NO: 5065614 - DNA, 17 bp, Homo sapiens
ctacaaggagataagaa

SEQ ID NO: 5065615 - DNA, 12 bp, Homo sapiens
ctacaaggccta

SEQ ID NO: 5065616 - DNA, 18 bp, Homo sapiens
ctacaagtgtaggccacc

SEQ ID NO: 5065617 - DNA, 18 bp, Homo sapiens
ctacaagttaaccagttg

SEQ ID NO: 5065618 - DNA, 12 bp, Homo sapiens
ctacaataaatg

SEQ ID NO: 5065619 - DNA, 18 bp, Homo sapiens
ctacaataaatgctgaat

SEQ ID NO: 5065620 - DNA, 22 bp, Homo sapiens
ctacaataaatgctgaatgaat

SEQ ID NO: 5065621 - DNA, 19 bp, Homo sapiens
ctacaatacaacacattga

SEQ ID NO: 5065622 - DNA, 12 bp, Homo sapiens
ctacaatatata

SEQ ID NO: 5065623 - DNA, 13 bp, Homo sapiens
ctacaatatatat

SEQ ID NO: 5065624 - DNA, 22 bp, Homo sapiens
ctacaatatcattttcctggga

SEQ ID NO: 5065625 - DNA, 21 bp, Homo sapiens
ctacaatatgtacatttctaa

SEQ ID NO: 5065626 - DNA, 18 bp, Homo sapiens
ctacaatattctctctta

SEQ ID NO: 5065627 - DNA, 19 bp, Homo sapiens
ctacaatcagttgacttta

SEQ ID NO: 5065628 - DNA, 11 bp, Homo sapiens
ctacaatcatg

SEQ ID NO: 5065629 - DNA, 12 bp, Homo sapiens
ctacaatcatgg

SEQ ID NO: 5065630 - DNA, 23 bp, Homo sapiens
ctacaatcatggtcaagttccca

SEQ ID NO: 5065631 - DNA, 18 bp, Homo sapiens
ctacaatcctaccttttg

SEQ ID NO: 5065632 - DNA, 21 bp, Homo sapiens
ctacaatctctttttgtttgc

SEQ ID NO: 5065633 - DNA, 17 bp, Homo sapiens
ctacaatgtgaacttta

SEQ ID NO: 5065634 - DNA, 18 bp, Homo sapiens
ctacaatgtgaactttat

SEQ ID NO: 5065635 - DNA, 19 bp, Homo sapiens
ctacaatgtgaactttatt

SEQ ID NO: 5065636 - DNA, 19 bp, Homo sapiens
ctacaattactttgaacat

SEQ ID NO: 5065637 - DNA, 13 bp, Homo sapiens
ctacaattgtaaa

SEQ ID NO: 5065638 - DNA, 17 bp, Homo sapiens
ctacaattgtaaactag

SEQ ID NO: 5065639 - DNA, 22 bp, Homo sapiens
ctacaatttgttaattcctatg

SEQ ID NO: 5065640 - DNA, 15 bp, Homo sapiens
ctacacaacatgtat

SEQ ID NO: 5065641 - DNA, 22 bp, Homo sapiens
ctacacaacatgtatgtggata

SEQ ID NO: 5065642 - DNA, 15 bp, Homo sapiens
ctacacacacacaca

SEQ ID NO: 5065643 - DNA, 12 bp, Homo sapiens
ctacacaccctg

SEQ ID NO: 5065644 - DNA, 14 bp, Homo sapiens
ctacacagacccct

SEQ ID NO: 5065645 - DNA, 18 bp, Homo sapiens
ctacacagaccctgccca

SEQ ID NO: 5065646 - DNA, 19 bp, Homo sapiens
ctacacagaccctgcccac

SEQ ID NO: 5065647 - DNA, 16 bp, Homo sapiens
ctacacagcatctgtt

SEQ ID NO: 5065648 - DNA, 15 bp, Homo sapiens
ctacacagctgtttc

SEQ ID NO: 5065649 - DNA, 17 bp, Homo sapiens
ctacacagctgtttcct

SEQ ID NO: 5065650 - DNA, 22 bp, Homo sapiens
ctacacagctgtttcctcacgt

SEQ ID NO: 5065651 - DNA, 22 bp, Homo sapiens
ctacacaggacaggggttcctt

SEQ ID NO: 5065652 - DNA, 16 bp, Homo sapiens
ctacacaggcaggaat

SEQ ID NO: 5065653 - DNA, 15 bp, Homo sapiens
ctacacagggcctgc

SEQ ID NO: 5065654 - DNA, 18 bp, Homo sapiens
ctacacagggcctgctat

SEQ ID NO: 5065655 - DNA, 22 bp, Homo sapiens
ctacacaggggccctgtacagt

SEQ ID NO: 5065656 - DNA, 15 bp, Homo sapiens
ctacacagtaaaaac

SEQ ID NO: 5065657 - DNA, 22 bp, Homo sapiens
gacatgcgtgtgtcagggatga

SEQ ID NO: 5065658 - DNA, 23 bp, Homo sapiens
gacatgcgtgtgtcagggatgag

SEQ ID NO: 5065659 - DNA, 16 bp, Homo sapiens
gacatgctaaataact

SEQ ID NO: 5065660 - DNA, 21 bp, Homo sapiens
gacatgctaacctctctgaac

SEQ ID NO: 5065661 - DNA, 18 bp, Homo sapiens
gacatgctctccccacag

SEQ ID NO: 5065662 - DNA, 21 bp, Homo sapiens
gacatgctctttttttaagtg

SEQ ID NO: 5065663 - DNA, 13 bp, Homo sapiens
gacatgctgccca

SEQ ID NO: 5065664 - DNA, 21 bp, Homo sapiens
gacatgctgcccaccccctgc

SEQ ID NO: 5065665 - DNA, 23 bp, Homo sapiens
gacatgctgcccaccccctgctg

SEQ ID NO: 5065666 - DNA, 16 bp, Homo sapiens
gacatgcttacttttt

SEQ ID NO: 5065667 - DNA, 14 bp, Homo sapiens
gacatgctttccat

SEQ ID NO: 5065668 - DNA, 18 bp, Homo sapiens
gacatggaaggttagagg

SEQ ID NO: 5065669 - DNA, 17 bp, Homo sapiens
gacatggacaaggagct

SEQ ID NO: 5065670 - DNA, 17 bp, Homo sapiens
gacatggagactcctgc

SEQ ID NO: 5065671 - DNA, 19 bp, Homo sapiens
gacatggagactcctgccc

SEQ ID NO: 5065672 - DNA, 20 bp, Homo sapiens
gacatggaggttctaaggcc

SEQ ID NO: 5065673 - DNA, 16 bp, Homo sapiens
gacatggcaacaaagg

SEQ ID NO: 5065674 - DNA, 16 bp, Homo sapiens
gacatggcacaggccc

SEQ ID NO: 5065675 - DNA, 14 bp, Homo sapiens
gacatggcctctgg

SEQ ID NO: 5065676 - DNA, 19 bp, Homo sapiens
gacatggctccggcctctg

SEQ ID NO: 5065677 - DNA, 23 bp, Homo sapiens
gacatggctctggactctaaaga

SEQ ID NO: 5065678 - DNA, 18 bp, Homo sapiens
gacatggcttctgaacct

SEQ ID NO: 5065679 - DNA, 20 bp, Homo sapiens
gacatggctttcagaaaacg

SEQ ID NO: 5065680 - DNA, 17 bp, Homo sapiens
gacatgggacatttgct

SEQ ID NO: 5065681 - DNA, 18 bp, Homo sapiens
gacatgggagtggggagc

SEQ ID NO: 5065682 - DNA, 19 bp, Homo sapiens
gacatggggaaggcagagg

SEQ ID NO: 5065683 - DNA, 15 bp, Homo sapiens
gacatggggaggaag

SEQ ID NO: 5065684 - DNA, 15 bp, Homo sapiens
gacatggggcaagcc

SEQ ID NO: 5065685 - DNA, 23 bp, Homo sapiens
gacatggggcaagccagggccca

SEQ ID NO: 5065686 - DNA, 12 bp, Homo sapiens
gacatggggcat

SEQ ID NO: 5065687 - DNA, 15 bp, Homo sapiens
gacatggggcataga

SEQ ID NO: 5065688 - DNA, 21 bp, Homo sapiens
gacatgggtcgcccatgagag

SEQ ID NO: 5065689 - DNA, 20 bp, Homo sapiens
gacatgggtgaacttacttg

SEQ ID NO: 5065690 - DNA, 19 bp, Homo sapiens
gacatggtgcctgagaggc

SEQ ID NO: 5065691 - DNA, 20 bp, Homo sapiens
gacatggtgcctgagaggca

SEQ ID NO: 5065692 - DNA, 23 bp, Homo sapiens
gacatggtgcctgagaggcaggc

SEQ ID NO: 5065693 - DNA, 13 bp, Homo sapiens
gacatggtgctgt

SEQ ID NO: 5065694 - DNA, 14 bp, Homo sapiens
gacatggtgctgtg

SEQ ID NO: 5065695 - DNA, 21 bp, Homo sapiens
gacatggtgtgccacaggctg

SEQ ID NO: 5065696 - DNA, 16 bp, Homo sapiens
gacatggttgggggaa

SEQ ID NO: 5065697 - DNA, 14 bp, Homo sapiens
gacatgtaaaaaga

SEQ ID NO: 5065698 - DNA, 11 bp, Homo sapiens
gacatgtacag

SEQ ID NO: 5065699 - DNA, 18 bp, Homo sapiens
gacatgtaccccctttcc

SEQ ID NO: 5065700 - DNA, 15 bp, Homo sapiens
gacatgtagcttctt

SEQ ID NO: 5065701 - DNA, 17 bp, Homo sapiens
gacatgtagcttcttct

SEQ ID NO: 5065702 - DNA, 21 bp, Homo sapiens
gacatgtagcttcttctgaaa

SEQ ID NO: 5065703 - DNA, 12 bp, Homo sapiens
gacatgtgaaac

SEQ ID NO: 5065704 - DNA, 17 bp, Homo sapiens
gacatgtgaggaggaaa

SEQ ID NO: 5065705 - DNA, 18 bp, Homo sapiens
gacatgtgaggaggaaaa

SEQ ID NO: 5065706 - DNA, 21 bp, Homo sapiens
gacatgtgcaattgtgaggga

SEQ ID NO: 5065707 - DNA, 14 bp, Homo sapiens
gacatgtgcctgta

SEQ ID NO: 5065708 - DNA, 13 bp, Homo sapiens
gacatgtggaaag

SEQ ID NO: 5065709 - DNA, 21 bp, Homo sapiens
gacatgtggaggggcagcctg

SEQ ID NO: 5065710 - DNA, 17 bp, Homo sapiens
gacatgtggggccaggt

SEQ ID NO: 5065711 - DNA, 19 bp, Homo sapiens
gacatgtgggtggagaagg

SEQ ID NO: 5065712 - DNA, 15 bp, Homo sapiens
gacatgttatatatt

SEQ ID NO: 5065713 - DNA, 18 bp, Homo sapiens
gacatgttatatattttt

SEQ ID NO: 5065714 - DNA, 16 bp, Homo sapiens
gacatgttcccttctc

SEQ ID NO: 5065715 - DNA, 15 bp, Homo sapiens
gacatgtttcacaac

SEQ ID NO: 5065716 - DNA, 14 bp, Homo sapiens
gacatgttttgata

SEQ ID NO: 5065717 - DNA, 16 bp, Homo sapiens
gacatgttttgataaa

SEQ ID NO: 5065718 - DNA, 23 bp, Homo sapiens
gacattaaaaatgttagtatttt

SEQ ID NO: 5065719 - DNA, 16 bp, Homo sapiens
gacattaaaagattat

SEQ ID NO: 5065720 - DNA, 13 bp, Homo sapiens
gacattaaataat

SEQ ID NO: 5065721 - DNA, 14 bp, Homo sapiens
gacattaacagttt

SEQ ID NO: 5065722 - DNA, 19 bp, Homo sapiens
gacattaacagttttccat

SEQ ID NO: 5065723 - DNA, 14 bp, Homo sapiens
gacattaattatct

SEQ ID NO: 5065724 - DNA, 20 bp, Homo sapiens
gacattagagaaaaccttaa

SEQ ID NO: 5065725 - DNA, 22 bp, Homo sapiens
gacattagagagatttttcatt

SEQ ID NO: 5065726 - DNA, 23 bp, Homo sapiens
gacattatatttgagtttctttc

SEQ ID NO: 5065727 - DNA, 16 bp, Homo sapiens
gacattatgtgtgcat

SEQ ID NO: 5065728 - DNA, 20 bp, Homo sapiens
gacattatgttttatttaaa

SEQ ID NO: 5065729 - DNA, 22 bp, Homo sapiens
gacattatgttttatttaaatg

SEQ ID NO: 5065730 - DNA, 23 bp, Homo sapiens
gacattcaaaaaactctctccca

SEQ ID NO: 5065731 - DNA, 20 bp, Homo sapiens
gacattcaaaacagttactt

SEQ ID NO: 5065732 - DNA, 12 bp, Homo sapiens
gacattcacctg

SEQ ID NO: 5065733 - DNA, 15 bp, Homo sapiens
gacattcacctgccc

SEQ ID NO: 5065734 - DNA, 18 bp, Homo sapiens
gacattcacctgccccaa

SEQ ID NO: 5065735 - DNA, 12 bp, Homo sapiens
gacattcactga

SEQ ID NO: 5065736 - DNA, 13 bp, Homo sapiens
gacattcactgag

SEQ ID NO: 5065737 - DNA, 15 bp, Homo sapiens
gacattcactgctga

SEQ ID NO: 5065738 - DNA, 20 bp, Homo sapiens
gacattcagactaaaaatac

SEQ ID NO: 5065739 - DNA, 13 bp, Homo sapiens
gacattcatgcct

SEQ ID NO: 5065740 - DNA, 14 bp, Homo sapiens
gacattccaacaat

SEQ ID NO: 5065741 - DNA, 16 bp, Homo sapiens
gacattccaagacagt

SEQ ID NO: 5065742 - DNA, 17 bp, Homo sapiens
gacattcctgggcacag

SEQ ID NO: 5065743 - DNA, 21 bp, Homo sapiens
gacattccttctcccatctct

SEQ ID NO: 5065744 - DNA, 20 bp, Homo sapiens
gacattccttgtcaccagca

SEQ ID NO: 5065745 - DNA, 12 bp, Homo sapiens
gacattctaatg

SEQ ID NO: 5065746 - DNA, 15 bp, Homo sapiens
gacattctaatgcat

SEQ ID NO: 5065747 - DNA, 18 bp, Homo sapiens
gacattctaatgcatatt

SEQ ID NO: 5065748 - DNA, 14 bp, Homo sapiens
gacattctacagtt

SEQ ID NO: 5065749 - DNA, 20 bp, Homo sapiens
gacattctcgcttccctgaa

SEQ ID NO: 5065750 - DNA, 23 bp, Homo sapiens
gacattctgtcgccttagcatgt

SEQ ID NO: 5065751 - DNA, 18 bp, Homo sapiens
gacattctgtctttcaaa

SEQ ID NO: 5065752 - DNA, 15 bp, Homo sapiens
gacattcttcactgt

SEQ ID NO: 5065753 - DNA, 12 bp, Homo sapiens
gacattctttta

SEQ ID NO: 5065754 - DNA, 14 bp, Homo sapiens
gacattgaaatcta

SEQ ID NO: 5065755 - DNA, 21 bp, Homo sapiens
gacattgaaatctaggaaaat

SEQ ID NO: 5065756 - DNA, 14 bp, Homo sapiens
gacattgacagcaa

SEQ ID NO: 5065757 - DNA, 17 bp, Homo sapiens
gacattgacagcaattc

SEQ ID NO: 5065758 - DNA, 19 bp, Homo sapiens
gacattgacagcaattcat

SEQ ID NO: 5065759 - DNA, 23 bp, Homo sapiens
gacattgacctatttccagaaat

SEQ ID NO: 5065760 - DNA, 14 bp, Homo sapiens
gacattgactattt

SEQ ID NO: 5065761 - DNA, 21 bp, Homo sapiens
gacattgattgctgcatttta

SEQ ID NO: 5065762 - DNA, 18 bp, Homo sapiens
gacattgatttgattttt

SEQ ID NO: 5065763 - DNA, 14 bp, Homo sapiens
gacattgccccaag

SEQ ID NO: 5065764 - DNA, 14 bp, Homo sapiens
gacattgcgtttga

SEQ ID NO: 5065765 - DNA, 12 bp, Homo sapiens
gacattgctaag

SEQ ID NO: 5065766 - DNA, 19 bp, Homo sapiens
gacattgctctatgtctgc

SEQ ID NO: 5065767 - DNA, 22 bp, Homo sapiens
gacattgctctatgtctgcctt

SEQ ID NO: 5065768 - DNA, 17 bp, Homo sapiens
gacattgctctcagtgc

SEQ ID NO: 5065769 - DNA, 19 bp, Homo sapiens
gacattgctctcagtgctt

SEQ ID NO: 5065770 - DNA, 13 bp, Homo sapiens
gacattgctctct

SEQ ID NO: 5065771 - DNA, 13 bp, Homo sapiens
gacattggagatg

SEQ ID NO: 5065772 - DNA, 23 bp, Homo sapiens
gacattgggtctattccagctca

SEQ ID NO: 5065773 - DNA, 15 bp, Homo sapiens
gacattgtaaataaa

SEQ ID NO: 5065774 - DNA, 19 bp, Homo sapiens
gacattgtagagcttctgg

SEQ ID NO: 5065775 - DNA, 18 bp, Homo sapiens
gacattgtatgcagggag

SEQ ID NO: 5065776 - DNA, 14 bp, Homo sapiens
gacattgtcaataa

SEQ ID NO: 5065777 - DNA, 15 bp, Homo sapiens
gacattgtcaataaa

SEQ ID NO: 5065778 - DNA, 17 bp, Homo sapiens
gacattgtcagcaaatt

SEQ ID NO: 5065779 - DNA, 18 bp, Homo sapiens
gacattgtggcacattct

SEQ ID NO: 5065780 - DNA, 18 bp, Homo sapiens
gacattgttaaaataaag

SEQ ID NO: 5065781 - DNA, 21 bp, Homo sapiens
gacattgtttggatttccttt

SEQ ID NO: 5065782 - DNA, 21 bp, Homo sapiens
gacattgttttgccaacattg

SEQ ID NO: 5065783 - DNA, 22 bp, Homo sapiens
gacatttaaaatagttttctaa

SEQ ID NO: 5065784 - DNA, 18 bp, Homo sapiens
gacatttaacttttctac

SEQ ID NO: 5065785 - DNA, 13 bp, Homo sapiens
gacatttaattta

SEQ ID NO: 5065786 - DNA, 16 bp, Homo sapiens
gacatttacaggaggg

SEQ ID NO: 5065787 - DNA, 20 bp, Homo sapiens
gacatttacaggagggcccg

SEQ ID NO: 5065788 - DNA, 13 bp, Homo sapiens
gacatttacatgt

SEQ ID NO: 5065789 - DNA, 14 bp, Homo sapiens
gacatttagaagaa

SEQ ID NO: 5065790 - DNA, 21 bp, Homo sapiens
gacatttatgatgcagcagat

SEQ ID NO: 5065791 - DNA, 15 bp, Homo sapiens
gacatttatgtacaa

SEQ ID NO: 5065792 - DNA, 18 bp, Homo sapiens
gacatttcaaaattaata

SEQ ID NO: 5065793 - DNA, 19 bp, Homo sapiens
gacatttcaaataactgca

SEQ ID NO: 5065794 - DNA, 18 bp, Homo sapiens
gacatttcaaatctgtag

SEQ ID NO: 5065795 - DNA, 20 bp, Homo sapiens
gacatttcatataaatggaa

SEQ ID NO: 5065796 - DNA, 23 bp, Homo sapiens
gacatttcatccaccaatatcat

SEQ ID NO: 5065797 - DNA, 12 bp, Homo sapiens
gacatttcatct

SEQ ID NO: 5065798 - DNA, 11 bp, Homo sapiens
gacatttccca

SEQ ID NO: 5065799 - DNA, 19 bp, Homo sapiens
gacatttcccaagtcagac

SEQ ID NO: 5065800 - DNA, 21 bp, Homo sapiens
gacatttcccaagtcagacag

SEQ ID NO: 5065801 - DNA, 22 bp, Homo sapiens
gacatttccctcctgggagaga

SEQ ID NO: 5065802 - DNA, 19 bp, Homo sapiens
gacatttctcttactgcaa

SEQ ID NO: 5065803 - DNA, 21 bp, Homo sapiens
gacatttctcttactgcaaat

SEQ ID NO: 5065804 - DNA, 14 bp, Homo sapiens
gacatttcttcata

SEQ ID NO: 5065805 - DNA, 13 bp, Homo sapiens
gacatttctttct

SEQ ID NO: 5065806 - DNA, 17 bp, Homo sapiens
gacatttgctcatggaa

SEQ ID NO: 5065807 - DNA, 21 bp, Homo sapiens
gacatttgctgaactcagcac

SEQ ID NO: 5065808 - DNA, 14 bp, Homo sapiens
gacatttggtggta

SEQ ID NO: 5065809 - DNA, 13 bp, Homo sapiens
gacatttgtatat

SEQ ID NO: 5065810 - DNA, 15 bp, Homo sapiens
gacatttgtcatttt

SEQ ID NO: 5065811 - DNA, 18 bp, Homo sapiens
gacatttgtcctgcagag

SEQ ID NO: 5065812 - DNA, 19 bp, Homo sapiens
gacatttgtcctgcagagc

SEQ ID NO: 5065813 - DNA, 21 bp, Homo sapiens
gacatttgtgggcaagcagat

SEQ ID NO: 5065814 - DNA, 17 bp, Homo sapiens
gacatttgtttgctgta

SEQ ID NO: 5065815 - DNA, 13 bp, Homo sapiens
gacatttgtttgg

SEQ ID NO: 5065816 - DNA, 16 bp, Homo sapiens
gacattttaacaagaa

SEQ ID NO: 5065817 - DNA, 13 bp, Homo sapiens
gacattttacatt

SEQ ID NO: 5065818 - DNA, 21 bp, Homo sapiens
gacattttacattaaattttt

SEQ ID NO: 5065819 - DNA, 21 bp, Homo sapiens
gacattttaggaatcaccaat

SEQ ID NO: 5065820 - DNA, 15 bp, Homo sapiens
gacattttagggaca

SEQ ID NO: 5065821 - DNA, 16 bp, Homo sapiens
gacattttatgtcttt

SEQ ID NO: 5065822 - DNA, 18 bp, Homo sapiens
gacattttctctttaaaa

SEQ ID NO: 5065823 - DNA, 22 bp, Homo sapiens
gacattttgggctggataaata

SEQ ID NO: 5065824 - DNA, 14 bp, Homo sapiens
gacattttgtagct

SEQ ID NO: 5065825 - DNA, 15 bp, Homo sapiens
gacattttgtagcta

SEQ ID NO: 5065826 - DNA, 17 bp, Homo sapiens
gacattttgtgtgagac

SEQ ID NO: 5065827 - DNA, 17 bp, Homo sapiens
gacattttgtttttact

SEQ ID NO: 5065828 - DNA, 12 bp, Homo sapiens
gacatttttcat

SEQ ID NO: 5065829 - DNA, 20 bp, Homo sapiens
gacatttttcattcatgaat

SEQ ID NO: 5065830 - DNA, 18 bp, Homo sapiens
gacatttttccggagaag

SEQ ID NO: 5065831 - DNA, 19 bp, Homo sapiens
gaccaaaaaaggacgtaaa

SEQ ID NO: 5065832 - DNA, 15 bp, Homo sapiens
gaccaaaagcaacat

SEQ ID NO: 5065833 - DNA, 19 bp, Homo sapiens
gaccaaaagttacatgttt

SEQ ID NO: 5065834 - DNA, 17 bp, Homo sapiens
gaccaaaatccccttct

SEQ ID NO: 5065835 - DNA, 15 bp, Homo sapiens
gaccattcaattagt

SEQ ID NO: 5065836 - DNA, 21 bp, Homo sapiens
gaccattcagaatatcatctt

SEQ ID NO: 5065837 - DNA, 18 bp, Homo sapiens
gaccattccaaagttctt

SEQ ID NO: 5065838 - DNA, 17 bp, Homo sapiens
gaccattctccacctgc

SEQ ID NO: 5065839 - DNA, 20 bp, Homo sapiens
gaccattctccacctgccag

SEQ ID NO: 5065840 - DNA, 14 bp, Homo sapiens
gaccattctgcctc

SEQ ID NO: 5065841 - DNA, 16 bp, Homo sapiens
gaccattgacctcagc

SEQ ID NO: 5065842 - DNA, 18 bp, Homo sapiens
gaccattgacctcagctg

SEQ ID NO: 5065843 - DNA, 16 bp, Homo sapiens
gaccattgagtccctg

SEQ ID NO: 5065844 - DNA, 18 bp, Homo sapiens
gaccattgagtccctgct

SEQ ID NO: 5065845 - DNA, 21 bp, Homo sapiens
gaccattggggctcccagcca

SEQ ID NO: 5065846 - DNA, 16 bp, Homo sapiens
gaccattgtctcagag

SEQ ID NO: 5065847 - DNA, 14 bp, Homo sapiens
gaccattgtcttcc

SEQ ID NO: 5065848 - DNA, 16 bp, Homo sapiens
gaccattgtcttccaa

SEQ ID NO: 5065849 - DNA, 14 bp, Homo sapiens
gaccatttcacaga

SEQ ID NO: 5065850 - DNA, 20 bp, Homo sapiens
gaccatttcacagaaaacat

SEQ ID NO: 5065851 - DNA, 18 bp, Homo sapiens
gaccatttgtagtgagcg

SEQ ID NO: 5065852 - DNA, 17 bp, Homo sapiens
gaccattttagttttaa

SEQ ID NO: 5065853 - DNA, 15 bp, Homo sapiens
gaccatttttaaatg

SEQ ID NO: 5065854 - DNA, 23 bp, Homo sapiens
gaccattttttaatttacttgtt

SEQ ID NO: 5065855 - DNA, 19 bp, Homo sapiens
gacccaaaaatgttccctt

SEQ ID NO: 5065856 - DNA, 19 bp, Homo sapiens
gacccaaaacagctttgtc

SEQ ID NO: 5065857 - DNA, 16 bp, Homo sapiens
gacccaaaaggcagaa

SEQ ID NO: 5065858 - DNA, 18 bp, Homo sapiens
gacccaaaaggcagaagc

SEQ ID NO: 5065859 - DNA, 20 bp, Homo sapiens
gacccaaaccccctgcagcc

SEQ ID NO: 5065860 - DNA, 11 bp, Homo sapiens
gacccaaagac

SEQ ID NO: 5065861 - DNA, 21 bp, Homo sapiens
gacccaaattataagggccct

SEQ ID NO: 5065862 - DNA, 22 bp, Homo sapiens
gacccaaattataagggccctg

SEQ ID NO: 5065863 - DNA, 23 bp, Homo sapiens
gacccaaattataagggccctgc

SEQ ID NO: 5065864 - DNA, 20 bp, Homo sapiens
gacccaacccatgcccctga

SEQ ID NO: 5065865 - DNA, 16 bp, Homo sapiens
gacccaacccttagct

SEQ ID NO: 5065866 - DNA, 21 bp, Homo sapiens
gacccaactgatcctgctcca

SEQ ID NO: 5065867 - DNA, 20 bp, Homo sapiens
gacccaactgggggcaaagg

SEQ ID NO: 5065868 - DNA, 12 bp, Homo sapiens
gacccaagaact

SEQ ID NO: 5065869 - DNA, 19 bp, Homo sapiens
gacccaaggctcactgcag

SEQ ID NO: 5065870 - DNA, 18 bp, Homo sapiens
gacccaagtactttccaa

SEQ ID NO: 5065871 - DNA, 22 bp, Homo sapiens
gacccaagtagctgctaccttc

SEQ ID NO: 5065872 - DNA, 15 bp, Homo sapiens
gacccaagtctgaac

SEQ ID NO: 5065873 - DNA, 18 bp, Homo sapiens
gacccacagccctgaaac

SEQ ID NO: 5065874 - DNA, 15 bp, Homo sapiens
gacccacagctctgg

SEQ ID NO: 5065875 - DNA, 17 bp, Homo sapiens
gacccacagctctgggc

SEQ ID NO: 5065876 - DNA, 18 bp, Homo sapiens
gacccacagctctgggcc

SEQ ID NO: 5065877 - DNA, 19 bp, Homo sapiens
gacccacagctctgggcct

SEQ ID NO: 5065878 - DNA, 12 bp, Homo sapiens
gacccacatgct

SEQ ID NO: 5065879 - DNA, 15 bp, Homo sapiens
gacccaccactggaa

SEQ ID NO: 5065880 - DNA, 17 bp, Homo sapiens
gacccaccactggaagc

SEQ ID NO: 5065881 - DNA, 15 bp, Homo sapiens
gacccaccagtgcct

SEQ ID NO: 5065882 - DNA, 16 bp, Homo sapiens
gacccaccagtgcctt

SEQ ID NO: 5065883 - DNA, 15 bp, Homo sapiens
gacccaccatccttc

SEQ ID NO: 5065884 - DNA, 12 bp, Homo sapiens
gacccacccagc

SEQ ID NO: 5065885 - DNA, 21 bp, Homo sapiens
gacccaccccaactctcccca

SEQ ID NO: 5065886 - DNA, 23 bp, Homo sapiens
gacccaccccaactctccccagt

SEQ ID NO: 5065887 - DNA, 16 bp, Homo sapiens
gacccaccccacctgc

SEQ ID NO: 5065888 - DNA, 14 bp, Homo sapiens
gacccacccctgtg

SEQ ID NO: 5065889 - DNA, 15 bp, Homo sapiens
gacccacccctgtgc

SEQ ID NO: 5065890 - DNA, 17 bp, Homo sapiens
gacccacccctgtgctc

SEQ ID NO: 5065891 - DNA, 20 bp, Homo sapiens
gacccacccgccttggcctc

SEQ ID NO: 5065892 - DNA, 14 bp, Homo sapiens
gacccacctccccc

SEQ ID NO: 5065893 - DNA, 15 bp, Homo sapiens
gacccacctgaggct

SEQ ID NO: 5065894 - DNA, 18 bp, Homo sapiens
gacccacctgaggctcag

SEQ ID NO: 5065895 - DNA, 23 bp, Homo sapiens
gacccacctgcgcttctgctgga

SEQ ID NO: 5065896 - DNA, 13 bp, Homo sapiens
gacccacctgcta

SEQ ID NO: 5065897 - DNA, 16 bp, Homo sapiens
gacccacctggagccc

SEQ ID NO: 5065898 - DNA, 20 bp, Homo sapiens
gacccacctgtggggcctgg

SEQ ID NO: 5065899 - DNA, 17 bp, Homo sapiens
gacccacggagccctcc

SEQ ID NO: 5065900 - DNA, 19 bp, Homo sapiens
gacccacggagccctccct

SEQ ID NO: 5065901 - DNA, 22 bp, Homo sapiens
gacccacggagccctccctatg

SEQ ID NO: 5065902 - DNA, 15 bp, Homo sapiens
gacccactacccttc

SEQ ID NO: 5065903 - DNA, 17 bp, Homo sapiens
gacccactacccttctc

SEQ ID NO: 5065904 - DNA, 13 bp, Homo sapiens
gacccactcacac

SEQ ID NO: 5065905 - DNA, 18 bp, Homo sapiens
gacccactccgactcccc

SEQ ID NO: 5065906 - DNA, 16 bp, Homo sapiens
gacccactctgcggcc

SEQ ID NO: 5065907 - DNA, 15 bp, Homo sapiens
gacccactctgcttc

SEQ ID NO: 5065908 - DNA, 20 bp, Homo sapiens
gacccactgaaatgaccaag

SEQ ID NO: 5065909 - DNA, 19 bp, Homo sapiens
gacccactggactcacctc

SEQ ID NO: 5065910 - DNA, 23 bp, Homo sapiens
gacccacttcacacacaggcaac

SEQ ID NO: 5065911 - DNA, 17 bp, Homo sapiens
gacccagaatggagcct

SEQ ID NO: 5065912 - DNA, 19 bp, Homo sapiens
gacccagaatggagcctgc

SEQ ID NO: 5065913 - DNA, 10 bp, Homo sapiens
gacccagacc

SEQ ID NO: 5065914 - DNA, 14 bp, Homo sapiens
gacccagacccagt

SEQ ID NO: 5065915 - DNA, 17 bp, Homo sapiens
gacccagagctgctgca

SEQ ID NO: 5065916 - DNA, 22 bp, Homo sapiens
gacccagaggccctgaagcctc

SEQ ID NO: 5065917 - DNA, 20 bp, Homo sapiens
gacccagaggggacgctgag

SEQ ID NO: 5065918 - DNA, 21 bp, Homo sapiens
gacccagagggtgggtgttca

SEQ ID NO: 5065919 - DNA, 19 bp, Homo sapiens
gacccagaggtccaggtcc

SEQ ID NO: 5065920 - DNA, 17 bp, Homo sapiens
gacccagagtcccaggc

SEQ ID NO: 5065921 - DNA, 19 bp, Homo sapiens
gacccagagtggagtctga

SEQ ID NO: 5065922 - DNA, 22 bp, Homo sapiens
gacccagatatggaaacagaag

SEQ ID NO: 5065923 - DNA, 15 bp, Homo sapiens
gacccagatgtgacg

SEQ ID NO: 5065924 - DNA, 17 bp, Homo sapiens
gacccagcactgcccaa

SEQ ID NO: 5065925 - DNA, 14 bp, Homo sapiens
gacccagccagctg

SEQ ID NO: 5065926 - DNA, 15 bp, Homo sapiens
gacccagccagctgc

SEQ ID NO: 5065927 - DNA, 18 bp, Homo sapiens
gacccagccagctgcagg

SEQ ID NO: 5065928 - DNA, 21 bp, Homo sapiens
gacccagccagctgcagggca

SEQ ID NO: 5065929 - DNA, 23 bp, Homo sapiens
gacccagccccttcccctgggaa

SEQ ID NO: 5065930 - DNA, 18 bp, Homo sapiens
gacccagcccgcggcctg

SEQ ID NO: 5065931 - DNA, 19 bp, Homo sapiens
gacccagcccgcggcctgg

SEQ ID NO: 5065932 - DNA, 21 bp, Homo sapiens
gacccagcccgcggcctggac

SEQ ID NO: 5065933 - DNA, 12 bp, Homo sapiens
gacccagccctc

SEQ ID NO: 5065934 - DNA, 14 bp, Homo sapiens
gacccagccctcgc

SEQ ID NO: 5065935 - DNA, 13 bp, Homo sapiens
gacccagcctgaa

SEQ ID NO: 5065936 - DNA, 12 bp, Homo sapiens
gacccagctact

SEQ ID NO: 5065937 - DNA, 20 bp, Homo sapiens
gacccagctactctgtccag

SEQ ID NO: 5065938 - DNA, 15 bp, Homo sapiens
gacccagctcctctg

SEQ ID NO: 5065939 - DNA, 17 bp, Homo sapiens
gacccagctcctctgag

SEQ ID NO: 5065940 - DNA, 18 bp, Homo sapiens
gacccagctctactccag

SEQ ID NO: 5065941 - DNA, 20 bp, Homo sapiens
gacccagctctactccaggc

SEQ ID NO: 5065942 - DNA, 18 bp, Homo sapiens
gacccaggaatagtggac

SEQ ID NO: 5065943 - DNA, 13 bp, Homo sapiens
gacccaggactcc

SEQ ID NO: 5065944 - DNA, 15 bp, Homo sapiens
gacccaggagtccag

SEQ ID NO: 5065945 - DNA, 17 bp, Homo sapiens
gacccaggagtccagac

SEQ ID NO: 5065946 - DNA, 11 bp, Homo sapiens
gacccaggccc

SEQ ID NO: 5065947 - DNA, 18 bp, Homo sapiens
gacccaggccctccatgg

SEQ ID NO: 5065948 - DNA, 15 bp, Homo sapiens
gacccaggccgcagc

SEQ ID NO: 5065949 - DNA, 19 bp, Homo sapiens
gacccaggccgcagctctt

SEQ ID NO: 5065950 - DNA, 22 bp, Homo sapiens
gacccaggccgcagctcttgcc

SEQ ID NO: 5065951 - DNA, 22 bp, Homo sapiens
gacccaggccgcctgccatacc

SEQ ID NO: 5065952 - DNA, 17 bp, Homo sapiens
gacccaggcctgtggcc

SEQ ID NO: 5065953 - DNA, 15 bp, Homo sapiens
gacccaggcgctgca

SEQ ID NO: 5065954 - DNA, 18 bp, Homo sapiens
gacccaggctcccagcct

SEQ ID NO: 5065955 - DNA, 16 bp, Homo sapiens
gacccaggctgcctga

SEQ ID NO: 5065956 - DNA, 13 bp, Homo sapiens
gacccaggctggg

SEQ ID NO: 5065957 - DNA, 17 bp, Homo sapiens
gacccagggaacagcca

SEQ ID NO: 5065958 - DNA, 22 bp, Homo sapiens
gacccagggaacagccactccc

SEQ ID NO: 5065959 - DNA, 14 bp, Homo sapiens
gacccagggagagg

SEQ ID NO: 5065960 - DNA, 21 bp, Homo sapiens
gacccagggagaggctgtgtc

SEQ ID NO: 5065961 - DNA, 17 bp, Homo sapiens
gacccagggcctgactt

SEQ ID NO: 5065962 - DNA, 19 bp, Homo sapiens
gacccaggggtccaggccc

SEQ ID NO: 5065963 - DNA, 11 bp, Homo sapiens
gacccagggtc

SEQ ID NO: 5065964 - DNA, 16 bp, Homo sapiens
gacccagggtcccctc

SEQ ID NO: 5065965 - DNA, 15 bp, Homo sapiens
gacccaggtcttcca

SEQ ID NO: 5065966 - DNA, 16 bp, Homo sapiens
gacccaggtcttccag

SEQ ID NO: 5065967 - DNA, 21 bp, Homo sapiens
gacccaggtcttccagacctg

SEQ ID NO: 5065968 - DNA, 23 bp, Homo sapiens
gacccaggtcttccagacctgct

SEQ ID NO: 5065969 - DNA, 21 bp, Homo sapiens
gacccaggtggagggcacagc

SEQ ID NO: 5065970 - DNA, 15 bp, Homo sapiens
gacccaggtgtgcct

SEQ ID NO: 5065971 - DNA, 17 bp, Homo sapiens
gacccagtcccacactg

SEQ ID NO: 5065972 - DNA, 22 bp, Homo sapiens
gacccagtcccacactgtggcc

SEQ ID NO: 5065973 - DNA, 23 bp, Homo sapiens
gacccagtcccacactgtggcca

SEQ ID NO: 5065974 - DNA, 15 bp, Homo sapiens
gacccagtccctggg

SEQ ID NO: 5065975 - DNA, 19 bp, Homo sapiens
gacccagtgcactccggtc

SEQ ID NO: 5065976 - DNA, 20 bp, Homo sapiens
gacccagtggcagggcacag

SEQ ID NO: 5065977 - DNA, 20 bp, Homo sapiens
gacccagtggtcagcaggtg

SEQ ID NO: 5065978 - DNA, 17 bp, Homo sapiens
gacccagtgtgtgctca

SEQ ID NO: 5065979 - DNA, 17 bp, Homo sapiens
gacccatacctttccag

SEQ ID NO: 5065980 - DNA, 23 bp, Homo sapiens
gacccatagcagctttgtctctg

SEQ ID NO: 5065981 - DNA, 16 bp, Homo sapiens
gacccatccctgcctg

SEQ ID NO: 5065982 - DNA, 17 bp, Homo sapiens
gacccatccctgcctgg

SEQ ID NO: 5065983 - DNA, 18 bp, Homo sapiens
gacccatccctgcctgga

SEQ ID NO: 5065984 - DNA, 20 bp, Homo sapiens
gacccatccctgcctggagg

SEQ ID NO: 5065985 - DNA, 22 bp, Homo sapiens
gacccatccctgcctggaggct

SEQ ID NO: 5065986 - DNA, 23 bp, Homo sapiens
gacccatcccttttcctttctgg

SEQ ID NO: 5065987 - DNA, 13 bp, Homo sapiens
gacccatctctcc

SEQ ID NO: 5065988 - DNA, 17 bp, Homo sapiens
gacccatgaaacagcag

SEQ ID NO: 5065989 - DNA, 18 bp, Homo sapiens
gacccatgaaacagcagc

SEQ ID NO: 5065990 - DNA, 19 bp, Homo sapiens
gacccatgaaacagcagct

SEQ ID NO: 5065991 - DNA, 16 bp, Homo sapiens
gacccatgctgccctg

SEQ ID NO: 5065992 - DNA, 20 bp, Homo sapiens
gacccatgggcaggagactg

SEQ ID NO: 5065993 - DNA, 14 bp, Homo sapiens
gacccatgtgctgg

SEQ ID NO: 5065994 - DNA, 15 bp, Homo sapiens
gacccatgtgctggg

SEQ ID NO: 5065995 - DNA, 19 bp, Homo sapiens
gacccatgtgctgggaaat

SEQ ID NO: 5065996 - DNA, 15 bp, Homo sapiens
gacccattcacattt

SEQ ID NO: 5065997 - DNA, 14 bp, Homo sapiens
gacccattccttcc

SEQ ID NO: 5065998 - DNA, 15 bp, Homo sapiens
gacccattccttccc

SEQ ID NO: 5065999 - DNA, 15 bp, Homo sapiens
gacccattgctgttg

SEQ ID NO: 5066000 - DNA, 16 bp, Homo sapiens
gaccccaaagagcctg

SEQ ID NO: 5066001 - DNA, 19 bp, Homo sapiens
gaccccaaagagcctggag

SEQ ID NO: 5066002 - DNA, 20 bp, Homo sapiens
gaccccaaagagcctggaga

SEQ ID NO: 5066003 - DNA, 19 bp, Homo sapiens
gaccccaatccaacccggg

SEQ ID NO: 5066004 - DNA, 19 bp, Homo sapiens
gaccccacccaagcttggc

SEQ ID NO: 5066005 - DNA, 16 bp, Homo sapiens
gaccccacccctcatc

SEQ ID NO: 5066006 - DNA, 21 bp, Homo sapiens
gaccccaccctgtctgcaggc

SEQ ID NO: 5066007 - DNA, 22 bp, Homo sapiens
gaccccactccggccctccaga

SEQ ID NO: 5066008 - DNA, 17 bp, Homo sapiens
gaccccactggctgaga

SEQ ID NO: 5066009 - DNA, 23 bp, Homo sapiens
gaccccacttatgctgctgtgaa

SEQ ID NO: 5066010 - DNA, 17 bp, Homo sapiens
gaccccacttcaggcac

SEQ ID NO: 5066011 - DNA, 12 bp, Homo sapiens
gaccccagactg

SEQ ID NO: 5066012 - DNA, 16 bp, Homo sapiens
gaccgggagacagagg

SEQ ID NO: 5066013 - DNA, 22 bp, Homo sapiens
gaccgggcccctctctagggac

SEQ ID NO: 5066014 - DNA, 16 bp, Homo sapiens
gaccgggccctgggtt

SEQ ID NO: 5066015 - DNA, 17 bp, Homo sapiens
gaccgggctctgacagc

SEQ ID NO: 5066016 - DNA, 14 bp, Homo sapiens
gaccgggggctgct

SEQ ID NO: 5066017 - DNA, 17 bp, Homo sapiens
gaccgggggctgctggg

SEQ ID NO: 5066018 - DNA, 17 bp, Homo sapiens
gaccggggtcctgaggc

SEQ ID NO: 5066019 - DNA, 20 bp, Homo sapiens
gaccggggtcctgaggctgg

SEQ ID NO: 5066020 - DNA, 21 bp, Homo sapiens
gaccgggtcacacaaaggcat

SEQ ID NO: 5066021 - DNA, 18 bp, Homo sapiens
gaccgggtgggcctggcc

SEQ ID NO: 5066022 - DNA, 15 bp, Homo sapiens
gaccggtacagaaag

SEQ ID NO: 5066023 - DNA, 16 bp, Homo sapiens
gaccggtgctgcagga

SEQ ID NO: 5066024 - DNA, 22 bp, Homo sapiens
gaccggtgcttttattgtaaag

SEQ ID NO: 5066025 - DNA, 16 bp, Homo sapiens
gaccggttcccacaag

SEQ ID NO: 5066026 - DNA, 20 bp, Homo sapiens
gaccgtactctcacatgtgg

SEQ ID NO: 5066027 - DNA, 16 bp, Homo sapiens
gaccgtcccctgccca

SEQ ID NO: 5066028 - DNA, 19 bp, Homo sapiens
gaccgtgaagatactttgt

SEQ ID NO: 5066029 - DNA, 14 bp, Homo sapiens
gaccgtgaggccag

SEQ ID NO: 5066030 - DNA, 16 bp, Homo sapiens
gaccgtgaggccagag

SEQ ID NO: 5066031 - DNA, 21 bp, Homo sapiens
gaccgtgatttggaagagagg

SEQ ID NO: 5066032 - DNA, 18 bp, Homo sapiens
gaccgtgccccacctccc

SEQ ID NO: 5066033 - DNA, 21 bp, Homo sapiens
gaccgtgccccacctccccac

SEQ ID NO: 5066034 - DNA, 15 bp, Homo sapiens
gaccgtgcgagctgc

SEQ ID NO: 5066035 - DNA, 17 bp, Homo sapiens
gaccgtgcgagctgccg

SEQ ID NO: 5066036 - DNA, 13 bp, Homo sapiens
gaccgtggacagg

SEQ ID NO: 5066037 - DNA, 19 bp, Homo sapiens
gaccgtggacaggcccagc

SEQ ID NO: 5066038 - DNA, 13 bp, Homo sapiens
gaccgtggccctg

SEQ ID NO: 5066039 - DNA, 17 bp, Homo sapiens
gaccgtggccctgccct

SEQ ID NO: 5066040 - DNA, 20 bp, Homo sapiens
gaccgtgggcggggccttgc

SEQ ID NO: 5066041 - DNA, 21 bp, Homo sapiens
gaccgtgggcggggccttgcg

SEQ ID NO: 5066042 - DNA, 19 bp, Homo sapiens
gaccgtggtgtcctctgtc

SEQ ID NO: 5066043 - DNA, 16 bp, Homo sapiens
gaccgtgtcccaagga

SEQ ID NO: 5066044 - DNA, 21 bp, Homo sapiens
gaccgtttgtccacttcattt

SEQ ID NO: 5066045 - DNA, 23 bp, Homo sapiens
gaccgtttgtccacttcattttg

SEQ ID NO: 5066046 - DNA, 22 bp, Homo sapiens
gaccgttttcatcctggcctcc

SEQ ID NO: 5066047 - DNA, 20 bp, Homo sapiens
gacctaaaaaggtctgttaa

SEQ ID NO: 5066048 - DNA, 22 bp, Homo sapiens
gacctaaaatttgccctcccat

SEQ ID NO: 5066049 - DNA, 21 bp, Homo sapiens
gacctaaagtgcttgcttttt

SEQ ID NO: 5066050 - DNA, 18 bp, Homo sapiens
gacctaaatccattttct

SEQ ID NO: 5066051 - DNA, 20 bp, Homo sapiens
gacctaaatccattttctaa

SEQ ID NO: 5066052 - DNA, 20 bp, Homo sapiens
gacctaaatggcctcatgtg

SEQ ID NO: 5066053 - DNA, 15 bp, Homo sapiens
gacctaaccagggcc

SEQ ID NO: 5066054 - DNA, 21 bp, Homo sapiens
gacctaacctaagcaaaacca

SEQ ID NO: 5066055 - DNA, 16 bp, Homo sapiens
gacctaagtcaggtaa

SEQ ID NO: 5066056 - DNA, 21 bp, Homo sapiens
gacctaagtcaggtaatatac

SEQ ID NO: 5066057 - DNA, 21 bp, Homo sapiens
gacctaatatcattttattca

SEQ ID NO: 5066058 - DNA, 15 bp, Homo sapiens
gacctaatgctcctt

SEQ ID NO: 5066059 - DNA, 11 bp, Homo sapiens
gacctacagac

SEQ ID NO: 5066060 - DNA, 15 bp, Homo sapiens
gacctacagggaact

SEQ ID NO: 5066061 - DNA, 23 bp, Homo sapiens
gacctacagggggtctggctggt

SEQ ID NO: 5066062 - DNA, 15 bp, Homo sapiens
gacctacatctgaaa

SEQ ID NO: 5066063 - DNA, 17 bp, Homo sapiens
gacctaccaccccactg

SEQ ID NO: 5066064 - DNA, 20 bp, Homo sapiens
gacctaccagggacaagcag

SEQ ID NO: 5066065 - DNA, 15 bp, Homo sapiens
gacctaccccagcca

SEQ ID NO: 5066066 - DNA, 17 bp, Homo sapiens
gacctaccccagccagg

SEQ ID NO: 5066067 - DNA, 15 bp, Homo sapiens
gacctaccctggacc

SEQ ID NO: 5066068 - DNA, 20 bp, Homo sapiens
gacctacctcaaagggcagt

SEQ ID NO: 5066069 - DNA, 13 bp, Homo sapiens
gacctacctcagg

SEQ ID NO: 5066070 - DNA, 14 bp, Homo sapiens
gacctacctccctc

SEQ ID NO: 5066071 - DNA, 19 bp, Homo sapiens
gacctacctgcagtgggaa

SEQ ID NO: 5066072 - DNA, 17 bp, Homo sapiens
gacctactacgcagagg

SEQ ID NO: 5066073 - DNA, 20 bp, Homo sapiens
gacctagaccagtttgcatg

SEQ ID NO: 5066074 - DNA, 13 bp, Homo sapiens
gacctagcaggct

SEQ ID NO: 5066075 - DNA, 14 bp, Homo sapiens
gacctagctctttg

SEQ ID NO: 5066076 - DNA, 14 bp, Homo sapiens
gacctaggcaagtt

SEQ ID NO: 5066077 - DNA, 17 bp, Homo sapiens
gacctagggaggacctt

SEQ ID NO: 5066078 - DNA, 21 bp, Homo sapiens
gacctagggaggaccttatct

SEQ ID NO: 5066079 - DNA, 23 bp, Homo sapiens
gacctagggatgttctggccctc

SEQ ID NO: 5066080 - DNA, 20 bp, Homo sapiens
gacctagggggacggggctg

SEQ ID NO: 5066081 - DNA, 22 bp, Homo sapiens
gacctatatctggagtgagagg

SEQ ID NO: 5066082 - DNA, 18 bp, Homo sapiens
gacctatcccaaatgtgg

SEQ ID NO: 5066083 - DNA, 20 bp, Homo sapiens
gacctatcccaaatgtggaa

SEQ ID NO: 5066084 - DNA, 14 bp, Homo sapiens
gacctatgataaat

SEQ ID NO: 5066085 - DNA, 23 bp, Homo sapiens
gacctatgtcctaaggacacact

SEQ ID NO: 5066086 - DNA, 22 bp, Homo sapiens
gacctatgtttgctcagaacac

SEQ ID NO: 5066087 - DNA, 16 bp, Homo sapiens
gacctattcaccctcc

SEQ ID NO: 5066088 - DNA, 16 bp, Homo sapiens
gacctattcctcctgg

SEQ ID NO: 5066089 - DNA, 15 bp, Homo sapiens
gacctcaagcaacca

SEQ ID NO: 5066090 - DNA, 16 bp, Homo sapiens
gacctcaagggacagg

SEQ ID NO: 5066091 - DNA, 20 bp, Homo sapiens
gacctcaagtgatccacctg

SEQ ID NO: 5066092 - DNA, 18 bp, Homo sapiens
gacctcacagtgaccctt

SEQ ID NO: 5066093 - DNA, 21 bp, Homo sapiens
gacctcacagtgacccttccc

SEQ ID NO: 5066094 - DNA, 15 bp, Homo sapiens
gacctcactgtcctg

SEQ ID NO: 5066095 - DNA, 18 bp, Homo sapiens
gacctcactgtcctgtga

SEQ ID NO: 5066096 - DNA, 13 bp, Homo sapiens
gacctcagaagta

SEQ ID NO: 5066097 - DNA, 18 bp, Homo sapiens
gacctcagagtccaggcc

SEQ ID NO: 5066098 - DNA, 13 bp, Homo sapiens
gacctcagatgtg

SEQ ID NO: 5066099 - DNA, 13 bp, Homo sapiens
gacctcagcaaat

SEQ ID NO: 5066100 - DNA, 15 bp, Homo sapiens
gacctcagcaagctg

SEQ ID NO: 5066101 - DNA, 10 bp, Homo sapiens
gacctcagcc

SEQ ID NO: 5066102 - DNA, 15 bp, Homo sapiens
gacctcagcctgcac

SEQ ID NO: 5066103 - DNA, 19 bp, Homo sapiens
gacctcagcctgtgctgcc

SEQ ID NO: 5066104 - DNA, 17 bp, Homo sapiens
gacctcagctgcttctc

SEQ ID NO: 5066105 - DNA, 15 bp, Homo sapiens
gacctcaggagggca

SEQ ID NO: 5066106 - DNA, 18 bp, Homo sapiens
gacctcaggagggcaggc

SEQ ID NO: 5066107 - DNA, 20 bp, Homo sapiens
gacctcaggagggcaggctg

SEQ ID NO: 5066108 - DNA, 18 bp, Homo sapiens
gacctcaggcactagcct

SEQ ID NO: 5066109 - DNA, 12 bp, Homo sapiens
gacctcaggcct

SEQ ID NO: 5066110 - DNA, 13 bp, Homo sapiens
gacctcaggcggg

SEQ ID NO: 5066111 - DNA, 16 bp, Homo sapiens
gacctcaggggcacct

SEQ ID NO: 5066112 - DNA, 18 bp, Homo sapiens
gacctcaggtgagaagca

SEQ ID NO: 5066113 - DNA, 21 bp, Homo sapiens
gacctcaggtgagaagcagag

SEQ ID NO: 5066114 - DNA, 22 bp, Homo sapiens
gacctcagtttctgttgtttct

SEQ ID NO: 5066115 - DNA, 21 bp, Homo sapiens
gacctcagttttatcattttc

SEQ ID NO: 5066116 - DNA, 19 bp, Homo sapiens
gacctcagttttatgcccc

SEQ ID NO: 5066117 - DNA, 20 bp, Homo sapiens
gacctcatatcttcctcatc

SEQ ID NO: 5066118 - DNA, 10 bp, Homo sapiens
gacctcatca

SEQ ID NO: 5066119 - DNA, 13 bp, Homo sapiens
gacctcatcctgc

SEQ ID NO: 5066120 - DNA, 17 bp, Homo sapiens
gacctcatctgcctgca

SEQ ID NO: 5066121 - DNA, 17 bp, Homo sapiens
gacctcatctgtggagc

SEQ ID NO: 5066122 - DNA, 22 bp, Homo sapiens
gacctcatgcatctccacctgc

SEQ ID NO: 5066123 - DNA, 20 bp, Homo sapiens
gacctcatgccatggtcttt

SEQ ID NO: 5066124 - DNA, 22 bp, Homo sapiens
gacctcatgcccagctctctga

SEQ ID NO: 5066125 - DNA, 16 bp, Homo sapiens
gacctccaagccactg

SEQ ID NO: 5066126 - DNA, 20 bp, Homo sapiens
gacctccacacccgtgagaa

SEQ ID NO: 5066127 - DNA, 17 bp, Homo sapiens
gacctccacctgggaga

SEQ ID NO: 5066128 - DNA, 11 bp, Homo sapiens
gacctccagaa

SEQ ID NO: 5066129 - DNA, 20 bp, Homo sapiens
gacctccagattattttcta

SEQ ID NO: 5066130 - DNA, 14 bp, Homo sapiens
gacctccagctgtt

SEQ ID NO: 5066131 - DNA, 19 bp, Homo sapiens
gacctccagctttcctgta

SEQ ID NO: 5066132 - DNA, 12 bp, Homo sapiens
gacctccaggct

SEQ ID NO: 5066133 - DNA, 13 bp, Homo sapiens
gacctccaggggc

SEQ ID NO: 5066134 - DNA, 20 bp, Homo sapiens
gacctccaggggctcctggg

SEQ ID NO: 5066135 - DNA, 21 bp, Homo sapiens
gacctccaggggctcctgggt

SEQ ID NO: 5066136 - DNA, 20 bp, Homo sapiens
gacctccagtcctgctggcc

SEQ ID NO: 5066137 - DNA, 24 bp, Homo sapiens
gacctccagtcctgctggcctgct

SEQ ID NO: 5066138 - DNA, 13 bp, Homo sapiens
gacctccagtgag

SEQ ID NO: 5066139 - DNA, 16 bp, Homo sapiens
gacctccatccctgct

SEQ ID NO: 5066140 - DNA, 12 bp, Homo sapiens
gacctccatgcc

SEQ ID NO: 5066141 - DNA, 14 bp, Homo sapiens
gacctccatttccc

SEQ ID NO: 5066142 - DNA, 18 bp, Homo sapiens
gacctcccaactctaaag

SEQ ID NO: 5066143 - DNA, 23 bp, Homo sapiens
gacctcccagccctatggatgtg

SEQ ID NO: 5066144 - DNA, 15 bp, Homo sapiens
gacctcccaggacaa

SEQ ID NO: 5066145 - DNA, 14 bp, Homo sapiens
gacctccccacccg

SEQ ID NO: 5066146 - DNA, 18 bp, Homo sapiens
gacctccccagcccagga

SEQ ID NO: 5066147 - DNA, 15 bp, Homo sapiens
gacctcccccaggga

SEQ ID NO: 5066148 - DNA, 17 bp, Homo sapiens
gacctcccccagggagg

SEQ ID NO: 5066149 - DNA, 12 bp, Homo sapiens
gacctccccctc

SEQ ID NO: 5066150 - DNA, 14 bp, Homo sapiens
gacctccccctcct

SEQ ID NO: 5066151 - DNA, 17 bp, Homo sapiens
gacctccccctccttcc

SEQ ID NO: 5066152 - DNA, 22 bp, Homo sapiens
gacctccccctgtgtggccctg

SEQ ID NO: 5066153 - DNA, 16 bp, Homo sapiens
gacctcccctccccag

SEQ ID NO: 5066154 - DNA, 15 bp, Homo sapiens
gacctccctggcttg

SEQ ID NO: 5066155 - DNA, 12 bp, Homo sapiens
gacctcccttcc

SEQ ID NO: 5066156 - DNA, 19 bp, Homo sapiens
gacctcccttccgaccctc

SEQ ID NO: 5066157 - DNA, 20 bp, Homo sapiens
gacctcccttccgaccctct

SEQ ID NO: 5066158 - DNA, 12 bp, Homo sapiens
gacctccggagc

SEQ ID NO: 5066159 - DNA, 16 bp, Homo sapiens
gacctccggggagagc

SEQ ID NO: 5066160 - DNA, 19 bp, Homo sapiens
gacctccggggagagcaga

SEQ ID NO: 5066161 - DNA, 16 bp, Homo sapiens
gacctccgtcctctcc

SEQ ID NO: 5066162 - DNA, 17 bp, Homo sapiens
gacctcctaaataaatt

SEQ ID NO: 5066163 - DNA, 12 bp, Homo sapiens
gacctcctccct

SEQ ID NO: 5066164 - DNA, 20 bp, Homo sapiens
gacctcctccctcattcatc

SEQ ID NO: 5066165 - DNA, 13 bp, Homo sapiens
gacctcctgacaa

SEQ ID NO: 5066166 - DNA, 22 bp, Homo sapiens
gacctcctgacaacgtctcttc

SEQ ID NO: 5066167 - DNA, 14 bp, Homo sapiens
gacctcctgatgtc

SEQ ID NO: 5066168 - DNA, 21 bp, Homo sapiens
gacctcctgcagggagccttc

SEQ ID NO: 5066169 - DNA, 17 bp, Homo sapiens
gacctcgactggttttt

SEQ ID NO: 5066170 - DNA, 16 bp, Homo sapiens
gacctcggacagagcc

SEQ ID NO: 5066171 - DNA, 20 bp, Homo sapiens
gacctcggacagagcccccc

SEQ ID NO: 5066172 - DNA, 18 bp, Homo sapiens
gacctcggatgaccatac

SEQ ID NO: 5066173 - DNA, 14 bp, Homo sapiens
gacctcgggctgtt

SEQ ID NO: 5066174 - DNA, 21 bp, Homo sapiens
gacctcggtgaccactcttct

SEQ ID NO: 5066175 - DNA, 20 bp, Homo sapiens
gacctcgtcccatcttcact

SEQ ID NO: 5066176 - DNA, 17 bp, Homo sapiens
gacctcgtcctccccct

SEQ ID NO: 5066177 - DNA, 21 bp, Homo sapiens
gacctcgtgatgggcccgcct

SEQ ID NO: 5066178 - DNA, 18 bp, Homo sapiens
gacctcgtgccaccccga

SEQ ID NO: 5066179 - DNA, 15 bp, Homo sapiens
gacctcgtgctttaa

SEQ ID NO: 5066180 - DNA, 18 bp, Homo sapiens
gacctcgtgctttaagtg

SEQ ID NO: 5066181 - DNA, 16 bp, Homo sapiens
gacctcgtttgggagt

SEQ ID NO: 5066182 - DNA, 20 bp, Homo sapiens
gacctctacttgctgaagga

SEQ ID NO: 5066183 - DNA, 17 bp, Homo sapiens
gacctctcactttttta

SEQ ID NO: 5066184 - DNA, 20 bp, Homo sapiens
gacctctcacttttttataa

SEQ ID NO: 5066185 - DNA, 16 bp, Homo sapiens
gacctctcagggcctg

SEQ ID NO: 5066186 - DNA, 19 bp, Homo sapiens
gacctctcagggcctggca

SEQ ID NO: 5066187 - DNA, 16 bp, Homo sapiens
gacctctccacacagg

SEQ ID NO: 5066188 - DNA, 19 bp, Homo sapiens
gacctctccatcttcagct

SEQ ID NO: 5066189 - DNA, 19 bp, Homo sapiens
gacctctccggcctggcct

SEQ ID NO: 5066190 - DNA, 19 bp, Homo sapiens
ggcgttatggcagcccggc

SEQ ID NO: 5066191 - DNA, 22 bp, Homo sapiens
ggcgttatttatggaccacttt

SEQ ID NO: 5066192 - DNA, 13 bp, Homo sapiens
ggcgttcctgcca

SEQ ID NO: 5066193 - DNA, 22 bp, Homo sapiens
ggcgttctaggtaggaagagcc

SEQ ID NO: 5066194 - DNA, 15 bp, Homo sapiens
ggcgttctcctgctt

SEQ ID NO: 5066195 - DNA, 14 bp, Homo sapiens
ggcgttctgctgcc

SEQ ID NO: 5066196 - DNA, 23 bp, Homo sapiens
ggcgttgggagggggagaaaagg

SEQ ID NO: 5066197 - DNA, 16 bp, Homo sapiens
ggcgttgtgggcaggc

SEQ ID NO: 5066198 - DNA, 11 bp, Homo sapiens
ggcgtttcttt

SEQ ID NO: 5066199 - DNA, 20 bp, Homo sapiens
ggcgtttggagaaggtctgt

SEQ ID NO: 5066200 - DNA, 14 bp, Homo sapiens
ggcgtttgtaaatt

SEQ ID NO: 5066201 - DNA, 13 bp, Homo sapiens
ggcgtttgtaatg

SEQ ID NO: 5066202 - DNA, 18 bp, Homo sapiens
ggcgttttgtctgtgttg

SEQ ID NO: 5066203 - DNA, 14 bp, Homo sapiens
ggcgtttttctcgt

SEQ ID NO: 5066204 - DNA, 22 bp, Homo sapiens
ggctaaaaaagctgaatcagac

SEQ ID NO: 5066205 - DNA, 12 bp, Homo sapiens
ggctaaaaagaa

SEQ ID NO: 5066206 - DNA, 21 bp, Homo sapiens
ggctaaaaagaatgcagagat

SEQ ID NO: 5066207 - DNA, 21 bp, Homo sapiens
ggctaaaggggagaaactgaa

SEQ ID NO: 5066208 - DNA, 12 bp, Homo sapiens
ggctaaatgaag

SEQ ID NO: 5066209 - DNA, 16 bp, Homo sapiens
ggctaacaaattttaa

SEQ ID NO: 5066210 - DNA, 18 bp, Homo sapiens
ggctaacatttaggagaa

SEQ ID NO: 5066211 - DNA, 19 bp, Homo sapiens
ggctaacatttaggagaag

SEQ ID NO: 5066212 - DNA, 17 bp, Homo sapiens
ggctaacctggacctgg

SEQ ID NO: 5066213 - DNA, 19 bp, Homo sapiens
ggctaacctgttacactgg

SEQ ID NO: 5066214 - DNA, 14 bp, Homo sapiens
ggctaactggcccc

SEQ ID NO: 5066215 - DNA, 15 bp, Homo sapiens
ggctaactggcccca

SEQ ID NO: 5066216 - DNA, 22 bp, Homo sapiens
ggctaagaagttcaccagccct

SEQ ID NO: 5066217 - DNA, 19 bp, Homo sapiens
ggctaagagctagcgctgc

SEQ ID NO: 5066218 - DNA, 15 bp, Homo sapiens
ggctaagatgagatt

SEQ ID NO: 5066219 - DNA, 22 bp, Homo sapiens
ggctaagatgagatttgccagc

SEQ ID NO: 5066220 - DNA, 12 bp, Homo sapiens
ggctaagcctgg

SEQ ID NO: 5066221 - DNA, 16 bp, Homo sapiens
ggctaagcctggacac

SEQ ID NO: 5066222 - DNA, 14 bp, Homo sapiens
ggctaaggcaggag

SEQ ID NO: 5066223 - DNA, 12 bp, Homo sapiens
ggctaaggcctc

SEQ ID NO: 5066224 - DNA, 19 bp, Homo sapiens
ggctaaggcctcttgctgg

SEQ ID NO: 5066225 - DNA, 23 bp, Homo sapiens
ggctaaggcctcttgctggtgca

SEQ ID NO: 5066226 - DNA, 16 bp, Homo sapiens
ggctaaggtaagaacg

SEQ ID NO: 5066227 - DNA, 16 bp, Homo sapiens
ggctaaggtccctggg

SEQ ID NO: 5066228 - DNA, 17 bp, Homo sapiens
ggctaagtccagctctc

SEQ ID NO: 5066229 - DNA, 19 bp, Homo sapiens
ggctaataaactgtattaa

SEQ ID NO: 5066230 - DNA, 22 bp, Homo sapiens
ggctaataaactgtattaaatc

SEQ ID NO: 5066231 - DNA, 17 bp, Homo sapiens
ggctaatggagtgtttg

SEQ ID NO: 5066232 - DNA, 21 bp, Homo sapiens
ggctaatggagtgtttgaaaa

SEQ ID NO: 5066233 - DNA, 15 bp, Homo sapiens
ggctaattaaataaa

SEQ ID NO: 5066234 - DNA, 21 bp, Homo sapiens
ggctaattagaggatgtggca

SEQ ID NO: 5066235 - DNA, 19 bp, Homo sapiens
ggctaattatatattttgt

SEQ ID NO: 5066236 - DNA, 19 bp, Homo sapiens
ggctaattcccagagtgtg

SEQ ID NO: 5066237 - DNA, 13 bp, Homo sapiens
ggctaatttttgt

SEQ ID NO: 5066238 - DNA, 19 bp, Homo sapiens
ggctaattttttatccttt

SEQ ID NO: 5066239 - DNA, 17 bp, Homo sapiens
ggctacaaaggaggaca

SEQ ID NO: 5066240 - DNA, 17 bp, Homo sapiens
ggctacaattactttga

SEQ ID NO: 5066241 - DNA, 14 bp, Homo sapiens
ggctacagagaagc

SEQ ID NO: 5066242 - DNA, 22 bp, Homo sapiens
ggctacagattgggcggggctt

SEQ ID NO: 5066243 - DNA, 18 bp, Homo sapiens
ggctacagtgtctggcct

SEQ ID NO: 5066244 - DNA, 21 bp, Homo sapiens
ggctacagttgatatttaaaa

SEQ ID NO: 5066245 - DNA, 19 bp, Homo sapiens
ggctacatcccagcctgtg

SEQ ID NO: 5066246 - DNA, 20 bp, Homo sapiens
ggctacatcccagcctgtgg

SEQ ID NO: 5066247 - DNA, 16 bp, Homo sapiens
ggctacatctccaaat

SEQ ID NO: 5066248 - DNA, 20 bp, Homo sapiens
ggctacattgtaatctgctt

SEQ ID NO: 5066249 - DNA, 20 bp, Homo sapiens
ggctaccccccgtctcctgc

SEQ ID NO: 5066250 - DNA, 19 bp, Homo sapiens
ggctacccctcgactcagc

SEQ ID NO: 5066251 - DNA, 18 bp, Homo sapiens
ggctacccgctgtggccg

SEQ ID NO: 5066252 - DNA, 17 bp, Homo sapiens
ggctacccgtgagccct

SEQ ID NO: 5066253 - DNA, 19 bp, Homo sapiens
ggctaccctgagctgaggc

SEQ ID NO: 5066254 - DNA, 17 bp, Homo sapiens
ggctaccgaagtaaact

SEQ ID NO: 5066255 - DNA, 14 bp, Homo sapiens
ggctacctctgagt

SEQ ID NO: 5066256 - DNA, 16 bp, Homo sapiens
ggctaccttgtgggaa

SEQ ID NO: 5066257 - DNA, 19 bp, Homo sapiens
ggctaccttgtgggaataa

SEQ ID NO: 5066258 - DNA, 13 bp, Homo sapiens
ggctacgcctctt

SEQ ID NO: 5066259 - DNA, 14 bp, Homo sapiens
ggctacgttttggt

SEQ ID NO: 5066260 - DNA, 15 bp, Homo sapiens
ggctactcagcagcc

SEQ ID NO: 5066261 - DNA, 16 bp, Homo sapiens
ggctactcagcagccc

SEQ ID NO: 5066262 - DNA, 14 bp, Homo sapiens
ggctactctatata

SEQ ID NO: 5066263 - DNA, 20 bp, Homo sapiens
ggctactctgcccaccccag

SEQ ID NO: 5066264 - DNA, 16 bp, Homo sapiens
ggctactctgtgccag

SEQ ID NO: 5066265 - DNA, 15 bp, Homo sapiens
ggctactgcagcttt

SEQ ID NO: 5066266 - DNA, 18 bp, Homo sapiens
ggctactgcagctttaca

SEQ ID NO: 5066267 - DNA, 13 bp, Homo sapiens
ggctactgccact

SEQ ID NO: 5066268 - DNA, 17 bp, Homo sapiens
ggctactgccactgtgt

SEQ ID NO: 5066269 - DNA, 17 bp, Homo sapiens
ggctactggcagctcct

SEQ ID NO: 5066270 - DNA, 18 bp, Homo sapiens
ggctactggttacctgga

SEQ ID NO: 5066271 - DNA, 22 bp, Homo sapiens
ggctactgtaatgctgcctcag

SEQ ID NO: 5066272 - DNA, 16 bp, Homo sapiens
ggctacttcccttcct

SEQ ID NO: 5066273 - DNA, 13 bp, Homo sapiens
ggctagaaaaaac

SEQ ID NO: 5066274 - DNA, 13 bp, Homo sapiens
ggctagaatctgg

SEQ ID NO: 5066275 - DNA, 14 bp, Homo sapiens
ggctagactgggct

SEQ ID NO: 5066276 - DNA, 22 bp, Homo sapiens
ggctagactgggctggctgcct

SEQ ID NO: 5066277 - DNA, 13 bp, Homo sapiens
ggctagagaaatc

SEQ ID NO: 5066278 - DNA, 19 bp, Homo sapiens
ggctagagacagatgctgg

SEQ ID NO: 5066279 - DNA, 21 bp, Homo sapiens
ggctagagccgaggggagaga

SEQ ID NO: 5066280 - DNA, 22 bp, Homo sapiens
ggctagagccgaggggagagag

SEQ ID NO: 5066281 - DNA, 20 bp, Homo sapiens
ggctagaggccagccccacc

SEQ ID NO: 5066282 - DNA, 12 bp, Homo sapiens
ggctagagggtg

SEQ ID NO: 5066283 - DNA, 13 bp, Homo sapiens
ggctagagtcctc

SEQ ID NO: 5066284 - DNA, 18 bp, Homo sapiens
ggctagagtcctcactcc

SEQ ID NO: 5066285 - DNA, 19 bp, Homo sapiens
ggctagagtcctcactccc

SEQ ID NO: 5066286 - DNA, 14 bp, Homo sapiens
ggctagagtgcagt

SEQ ID NO: 5066287 - DNA, 20 bp, Homo sapiens
ggctagagtgcggtggcgcg

SEQ ID NO: 5066288 - DNA, 19 bp, Homo sapiens
ggctagattctaacatatt

SEQ ID NO: 5066289 - DNA, 14 bp, Homo sapiens
ggctagccctgagc

SEQ ID NO: 5066290 - DNA, 16 bp, Homo sapiens
ggctagccctgagccc

SEQ ID NO: 5066291 - DNA, 18 bp, Homo sapiens
ggctagccctgagcccgg

SEQ ID NO: 5066292 - DNA, 16 bp, Homo sapiens
ggctagctggagcctg

SEQ ID NO: 5066293 - DNA, 22 bp, Homo sapiens
ggctagcttctgcttttctgcc

SEQ ID NO: 5066294 - DNA, 16 bp, Homo sapiens
ggctaggacccctcca

SEQ ID NO: 5066295 - DNA, 17 bp, Homo sapiens
ggctaggacgttggcct

SEQ ID NO: 5066296 - DNA, 19 bp, Homo sapiens
ggctaggactgtggagggg

SEQ ID NO: 5066297 - DNA, 23 bp, Homo sapiens
ggctaggactgtggaggggagct

SEQ ID NO: 5066298 - DNA, 14 bp, Homo sapiens
ggctaggccagcag

SEQ ID NO: 5066299 - DNA, 22 bp, Homo sapiens
ggctagggagacgccatgtgat

SEQ ID NO: 5066300 - DNA, 14 bp, Homo sapiens
ggctaggggccgag

SEQ ID NO: 5066301 - DNA, 17 bp, Homo sapiens
ggctaggggctggtcct

SEQ ID NO: 5066302 - DNA, 13 bp, Homo sapiens
ggctaggtacaca

SEQ ID NO: 5066303 - DNA, 20 bp, Homo sapiens
ggctaggtagaaaaagggtc

SEQ ID NO: 5066304 - DNA, 16 bp, Homo sapiens
ggctaggtagtgggga

SEQ ID NO: 5066305 - DNA, 20 bp, Homo sapiens
ggctagtatcaaaagaaaga

SEQ ID NO: 5066306 - DNA, 16 bp, Homo sapiens
ggctagtcaagctcct

SEQ ID NO: 5066307 - DNA, 19 bp, Homo sapiens
ggctagtcaagctcctcct

SEQ ID NO: 5066308 - DNA, 15 bp, Homo sapiens
ggctagtctgtgcct

SEQ ID NO: 5066309 - DNA, 17 bp, Homo sapiens
ggctagtctgtgcctca

SEQ ID NO: 5066310 - DNA, 20 bp, Homo sapiens
ggctagtcttgaatttctga

SEQ ID NO: 5066311 - DNA, 21 bp, Homo sapiens
ggctagtggggtgaacagctg

SEQ ID NO: 5066312 - DNA, 20 bp, Homo sapiens
ggctagtgggtttctgacag

SEQ ID NO: 5066313 - DNA, 20 bp, Homo sapiens
ggctatagctacaggaagca

SEQ ID NO: 5066314 - DNA, 23 bp, Homo sapiens
ggctataggtgctacaaaaacac

SEQ ID NO: 5066315 - DNA, 14 bp, Homo sapiens
ggctatataaaatg

SEQ ID NO: 5066316 - DNA, 15 bp, Homo sapiens
ggctatataaaatgt

SEQ ID NO: 5066317 - DNA, 18 bp, Homo sapiens
ggctatataaaatgtggc

SEQ ID NO: 5066318 - DNA, 11 bp, Homo sapiens
ggctatattcc

SEQ ID NO: 5066319 - DNA, 21 bp, Homo sapiens
ggctatcaaagaataagaaaa

SEQ ID NO: 5066320 - DNA, 14 bp, Homo sapiens
ggctatcctgggac

SEQ ID NO: 5066321 - DNA, 15 bp, Homo sapiens
ggctatcctgggacc

SEQ ID NO: 5066322 - DNA, 17 bp, Homo sapiens
ggctatctactaccaga

SEQ ID NO: 5066323 - DNA, 20 bp, Homo sapiens
ggctatctatacctgccttt

SEQ ID NO: 5066324 - DNA, 18 bp, Homo sapiens
ggctatgccactaggccc

SEQ ID NO: 5066325 - DNA, 16 bp, Homo sapiens
ggctatgccatgtgcg

SEQ ID NO: 5066326 - DNA, 21 bp, Homo sapiens
ggctatggatctgatttttaa

SEQ ID NO: 5066327 - DNA, 18 bp, Homo sapiens
ggctatggcaagggggtg

SEQ ID NO: 5066328 - DNA, 19 bp, Homo sapiens
ggctatgggggcactgagg

SEQ ID NO: 5066329 - DNA, 19 bp, Homo sapiens
ggctatggttgccacccca

SEQ ID NO: 5066330 - DNA, 19 bp, Homo sapiens
ggctatgtagacataaaga

SEQ ID NO: 5066331 - DNA, 13 bp, Homo sapiens
ggctatgtggatt

SEQ ID NO: 5066332 - DNA, 19 bp, Homo sapiens
ggctattccataattccat

SEQ ID NO: 5066333 - DNA, 16 bp, Homo sapiens
ggctattccctggaga

SEQ ID NO: 5066334 - DNA, 20 bp, Homo sapiens
ggctattcctaggcctcagg

SEQ ID NO: 5066335 - DNA, 20 bp, Homo sapiens
ggctattgtccttgtgtatc

SEQ ID NO: 5066336 - DNA, 13 bp, Homo sapiens
ggctatttaaaag

SEQ ID NO: 5066337 - DNA, 22 bp, Homo sapiens
ggctatttaaaagtataaaact

SEQ ID NO: 5066338 - DNA, 14 bp, Homo sapiens
ggctatttgaaata

SEQ ID NO: 5066339 - DNA, 15 bp, Homo sapiens
ggctatttgttcaga

SEQ ID NO: 5066340 - DNA, 20 bp, Homo sapiens
ggctattttctaaagacttg

SEQ ID NO: 5066341 - DNA, 17 bp, Homo sapiens
ggctcaaagcccttcct

SEQ ID NO: 5066342 - DNA, 15 bp, Homo sapiens
ggctcaaccacacac

SEQ ID NO: 5066343 - DNA, 22 bp, Homo sapiens
ggctcaaccttccaacttcctg

SEQ ID NO: 5066344 - DNA, 13 bp, Homo sapiens
ggctcaagaataa

SEQ ID NO: 5066345 - DNA, 21 bp, Homo sapiens
ggctcaagacaaggctggcaa

SEQ ID NO: 5066346 - DNA, 17 bp, Homo sapiens
ggctcaagaggcccagg

SEQ ID NO: 5066347 - DNA, 23 bp, Homo sapiens
ggctcaagcaatcctcctgcctc

SEQ ID NO: 5066348 - DNA, 18 bp, Homo sapiens
ggctcaagcagtcctccc

SEQ ID NO: 5066349 - DNA, 23 bp, Homo sapiens
ggctcaagcagtctacccacctc

SEQ ID NO: 5066350 - DNA, 17 bp, Homo sapiens
ggctcaagcccaggagg

SEQ ID NO: 5066351 - DNA, 13 bp, Homo sapiens
ggctcaagttttt

SEQ ID NO: 5066352 - DNA, 14 bp, Homo sapiens
ggctcaagttttta

SEQ ID NO: 5066353 - DNA, 15 bp, Homo sapiens
ggctcaagtttttat

SEQ ID NO: 5066354 - DNA, 20 bp, Homo sapiens
ggctcaatgcaacctctgcc

SEQ ID NO: 5066355 - DNA, 17 bp, Homo sapiens
ggctcacaaggcccagg

SEQ ID NO: 5066356 - DNA, 18 bp, Homo sapiens
ggctcacaaggcccagga

SEQ ID NO: 5066357 - DNA, 20 bp, Homo sapiens
ggctcacaaggcccaggaga

SEQ ID NO: 5066358 - DNA, 23 bp, Homo sapiens
ggctcacaccggcactgtgcact

SEQ ID NO: 5066359 - DNA, 12 bp, Homo sapiens
ggctcacactga

SEQ ID NO: 5066360 - DNA, 17 bp, Homo sapiens
ggctcacactgagaatg

SEQ ID NO: 5066361 - DNA, 14 bp, Homo sapiens
ggctcacagccacc

SEQ ID NO: 5066362 - DNA, 16 bp, Homo sapiens
ggctcacagccaccac

SEQ ID NO: 5066363 - DNA, 12 bp, Homo sapiens
ggctcacaggcc

SEQ ID NO: 5066364 - DNA, 13 bp, Homo sapiens
ggctcacaggcct

SEQ ID NO: 5066365 - DNA, 19 bp, Homo sapiens
ggctcacccctctcccccg

SEQ ID NO: 5066366 - DNA, 23 bp, Homo sapiens
ggctcacgcctataatcccagca

SEQ ID NO: 5066367 - DNA, 17 bp, Homo sapiens
ggctcacgcctgtaatc

SEQ ID NO: 5066368 - DNA, 13 bp, Homo sapiens
ggctctctggacc

SEQ ID NO: 5066369 - DNA, 14 bp, Homo sapiens
ggctctctggacca

SEQ ID NO: 5066370 - DNA, 21 bp, Homo sapiens
ggctctctggacctgaccaga

SEQ ID NO: 5066371 - DNA, 18 bp, Homo sapiens
ggctctctttccttcttg

SEQ ID NO: 5066372 - DNA, 23 bp, Homo sapiens
ggctctgaacacacacgccagct

SEQ ID NO: 5066373 - DNA, 22 bp, Homo sapiens
ggctctgaagcaaggcggtgga

SEQ ID NO: 5066374 - DNA, 23 bp, Homo sapiens
ggctctgaagcaaggcggtggac

SEQ ID NO: 5066375 - DNA, 17 bp, Homo sapiens
ggctctgaatctctcaa

SEQ ID NO: 5066376 - DNA, 19 bp, Homo sapiens
ggctctgaatgtagccagc

SEQ ID NO: 5066377 - DNA, 22 bp, Homo sapiens
ggctctgaatgtagccagccca

SEQ ID NO: 5066378 - DNA, 13 bp, Homo sapiens
ggctctgaccagt

SEQ ID NO: 5066379 - DNA, 16 bp, Homo sapiens
ggctctgagacacacc

SEQ ID NO: 5066380 - DNA, 12 bp, Homo sapiens
ggctctgagact

SEQ ID NO: 5066381 - DNA, 22 bp, Homo sapiens
ggctctgagagtctagattctc

SEQ ID NO: 5066382 - DNA, 16 bp, Homo sapiens
ggctctgagcaggggc

SEQ ID NO: 5066383 - DNA, 22 bp, Homo sapiens
ggctctgagcaggggcaggcgc

SEQ ID NO: 5066384 - DNA, 17 bp, Homo sapiens
ggctctgaggtgcctgt

SEQ ID NO: 5066385 - DNA, 20 bp, Homo sapiens
ggctctgaggtgcctgtccc

SEQ ID NO: 5066386 - DNA, 19 bp, Homo sapiens
ggctctgagttctggggtg

SEQ ID NO: 5066387 - DNA, 15 bp, Homo sapiens
ggctctgatctaaca

SEQ ID NO: 5066388 - DNA, 15 bp, Homo sapiens
ggctctgattggctg

SEQ ID NO: 5066389 - DNA, 19 bp, Homo sapiens
ggctctgcaattcccctct

SEQ ID NO: 5066390 - DNA, 15 bp, Homo sapiens
ggctctgcactaaga

SEQ ID NO: 5066391 - DNA, 14 bp, Homo sapiens
ggctctgcaggcca

SEQ ID NO: 5066392 - DNA, 15 bp, Homo sapiens
ggctctgcaggccac

SEQ ID NO: 5066393 - DNA, 14 bp, Homo sapiens
ggctctgcagtcct

SEQ ID NO: 5066394 - DNA, 21 bp, Homo sapiens
ggctctgccagcgtccccggc

SEQ ID NO: 5066395 - DNA, 16 bp, Homo sapiens
ggctctgccagtcctg

SEQ ID NO: 5066396 - DNA, 18 bp, Homo sapiens
ggctctgcccacctctct

SEQ ID NO: 5066397 - DNA, 21 bp, Homo sapiens
ggctctgcccacctctctttt

SEQ ID NO: 5066398 - DNA, 21 bp, Homo sapiens
ggctctgccccagaggcctct

SEQ ID NO: 5066399 - DNA, 15 bp, Homo sapiens
ggctctgccccctcc

SEQ ID NO: 5066400 - DNA, 13 bp, Homo sapiens
ggctctgccccgc

SEQ ID NO: 5066401 - DNA, 15 bp, Homo sapiens
ggctctgcccctcag

SEQ ID NO: 5066402 - DNA, 13 bp, Homo sapiens
ggctctgccctgc

SEQ ID NO: 5066403 - DNA, 14 bp, Homo sapiens
ggctctgccctgga

SEQ ID NO: 5066404 - DNA, 12 bp, Homo sapiens
ggctctgccctt

SEQ ID NO: 5066405 - DNA, 15 bp, Homo sapiens
ggctctgcccttggt

SEQ ID NO: 5066406 - DNA, 14 bp, Homo sapiens
ggctctgcctggag

SEQ ID NO: 5066407 - DNA, 16 bp, Homo sapiens
ggctctgccttctcag

SEQ ID NO: 5066408 - DNA, 20 bp, Homo sapiens
ggctctgccttctcaggccc

SEQ ID NO: 5066409 - DNA, 22 bp, Homo sapiens
ggctctgccttctcaggccccg

SEQ ID NO: 5066410 - DNA, 17 bp, Homo sapiens
ggctctgcgtcccactg

SEQ ID NO: 5066411 - DNA, 18 bp, Homo sapiens
ggctctgcttcctcagcc

SEQ ID NO: 5066412 - DNA, 17 bp, Homo sapiens
ggctctggaaagcaact

SEQ ID NO: 5066413 - DNA, 12 bp, Homo sapiens
ggctctggagac

SEQ ID NO: 5066414 - DNA, 17 bp, Homo sapiens
ggctctggagacagccc

SEQ ID NO: 5066415 - DNA, 16 bp, Homo sapiens
ggctctggagccagag

SEQ ID NO: 5066416 - DNA, 17 bp, Homo sapiens
ggctctggagccagaga

SEQ ID NO: 5066417 - DNA, 13 bp, Homo sapiens
ggctctggagccc

SEQ ID NO: 5066418 - DNA, 18 bp, Homo sapiens
ggctctggcaggtggcca

SEQ ID NO: 5066419 - DNA, 18 bp, Homo sapiens
ggctctggccaagggcca

SEQ ID NO: 5066420 - DNA, 16 bp, Homo sapiens
ggctctggcccttgcc

SEQ ID NO: 5066421 - DNA, 12 bp, Homo sapiens
ggctctggctcc

SEQ ID NO: 5066422 - DNA, 22 bp, Homo sapiens
ggctctgggaaggggtgccctc

SEQ ID NO: 5066423 - DNA, 17 bp, Homo sapiens
ggctctgggagagccag

SEQ ID NO: 5066424 - DNA, 23 bp, Homo sapiens
ggctctgggatagctgacccagc

SEQ ID NO: 5066425 - DNA, 12 bp, Homo sapiens
ggctctgggcac

SEQ ID NO: 5066426 - DNA, 20 bp, Homo sapiens
ggctctgggcacagtgctgc

SEQ ID NO: 5066427 - DNA, 16 bp, Homo sapiens
ggctctgggcctgagg

SEQ ID NO: 5066428 - DNA, 15 bp, Homo sapiens
ggctctgggcggtcc

SEQ ID NO: 5066429 - DNA, 12 bp, Homo sapiens
ggctctgggctc

SEQ ID NO: 5066430 - DNA, 15 bp, Homo sapiens
ggctctgggctcagg

SEQ ID NO: 5066431 - DNA, 19 bp, Homo sapiens
ggctctgggctcagggctg

SEQ ID NO: 5066432 - DNA, 16 bp, Homo sapiens
ggctctgggctggctg

SEQ ID NO: 5066433 - DNA, 23 bp, Homo sapiens
ggctctgggggacccaggtggga

SEQ ID NO: 5066434 - DNA, 14 bp, Homo sapiens
ggctctgggggcag

SEQ ID NO: 5066435 - DNA, 16 bp, Homo sapiens
ggctctgggggcagat

SEQ ID NO: 5066436 - DNA, 11 bp, Homo sapiens
ggctctggggt

SEQ ID NO: 5066437 - DNA, 17 bp, Homo sapiens
ggctctgggtgctgccc

SEQ ID NO: 5066438 - DNA, 14 bp, Homo sapiens
ggctctgggtgggc

SEQ ID NO: 5066439 - DNA, 18 bp, Homo sapiens
ggctctgggttcgggaag

SEQ ID NO: 5066440 - DNA, 14 bp, Homo sapiens
ggctctggtggcca

SEQ ID NO: 5066441 - DNA, 22 bp, Homo sapiens
ggctctggttcctccagccacc

SEQ ID NO: 5066442 - DNA, 16 bp, Homo sapiens
ggctctgtattctgca

SEQ ID NO: 5066443 - DNA, 20 bp, Homo sapiens
ggctctgtcaccgccatgca

SEQ ID NO: 5066444 - DNA, 14 bp, Homo sapiens
ggctctgtcactcc

SEQ ID NO: 5066445 - DNA, 18 bp, Homo sapiens
ggctctgtcactccaggc

SEQ ID NO: 5066446 - DNA, 16 bp, Homo sapiens
ggctctgtccccagcc

SEQ ID NO: 5066447 - DNA, 15 bp, Homo sapiens
ggctctgtccccctg

SEQ ID NO: 5066448 - DNA, 12 bp, Homo sapiens
ggctctgtgccc

SEQ ID NO: 5066449 - DNA, 11 bp, Homo sapiens
ggctctgtgct

SEQ ID NO: 5066450 - DNA, 12 bp, Homo sapiens
ggctctgtgctt

SEQ ID NO: 5066451 - DNA, 14 bp, Homo sapiens
ggctctgtgggctg

SEQ ID NO: 5066452 - DNA, 18 bp, Homo sapiens
ggctctgtgggctgcact

SEQ ID NO: 5066453 - DNA, 19 bp, Homo sapiens
ggctctgtgggtgatgggg

SEQ ID NO: 5066454 - DNA, 14 bp, Homo sapiens
ggctctgttcctca

SEQ ID NO: 5066455 - DNA, 23 bp, Homo sapiens
ggctctgttcggcctttgggtgt

SEQ ID NO: 5066456 - DNA, 19 bp, Homo sapiens
ggctctgtttgtgggactg

SEQ ID NO: 5066457 - DNA, 20 bp, Homo sapiens
ggctctgtttgtgggactgg

SEQ ID NO: 5066458 - DNA, 17 bp, Homo sapiens
ggctcttaactgttgct

SEQ ID NO: 5066459 - DNA, 14 bp, Homo sapiens
ggctcttaagcagc

SEQ ID NO: 5066460 - DNA, 15 bp, Homo sapiens
ggctcttagaaactc

SEQ ID NO: 5066461 - DNA, 18 bp, Homo sapiens
ggctcttagcagcttcca

SEQ ID NO: 5066462 - DNA, 21 bp, Homo sapiens
ggctcttatagaagcttcagc

SEQ ID NO: 5066463 - DNA, 21 bp, Homo sapiens
ggctcttatttctgaattcaa

SEQ ID NO: 5066464 - DNA, 11 bp, Homo sapiens
ggctcttccaa

SEQ ID NO: 5066465 - DNA, 12 bp, Homo sapiens
ggctcttccagg

SEQ ID NO: 5066466 - DNA, 23 bp, Homo sapiens
ggctcttccaggctgggagagcc

SEQ ID NO: 5066467 - DNA, 14 bp, Homo sapiens
ggctcttcctggac

SEQ ID NO: 5066468 - DNA, 15 bp, Homo sapiens
ggctcttcctggacc

SEQ ID NO: 5066469 - DNA, 16 bp, Homo sapiens
ggctcttcctggacct

SEQ ID NO: 5066470 - DNA, 17 bp, Homo sapiens
ggctcttcctggacctg

SEQ ID NO: 5066471 - DNA, 19 bp, Homo sapiens
ggctcttcctggacctgag

SEQ ID NO: 5066472 - DNA, 13 bp, Homo sapiens
ggctcttctcctt

SEQ ID NO: 5066473 - DNA, 15 bp, Homo sapiens
ggctcttctcctttc

SEQ ID NO: 5066474 - DNA, 13 bp, Homo sapiens
ggctcttctgact

SEQ ID NO: 5066475 - DNA, 14 bp, Homo sapiens
ggctcttctgacta

SEQ ID NO: 5066476 - DNA, 15 bp, Homo sapiens
ggctcttctgagcag

SEQ ID NO: 5066477 - DNA, 18 bp, Homo sapiens
ggctcttgaactgagctt

SEQ ID NO: 5066478 - DNA, 13 bp, Homo sapiens
ggctcttggcttc

SEQ ID NO: 5066479 - DNA, 23 bp, Homo sapiens
ggctcttgtgctggatggagccc

SEQ ID NO: 5066480 - DNA, 12 bp, Homo sapiens
ggctctttccct

SEQ ID NO: 5066481 - DNA, 16 bp, Homo sapiens
ggctctttccttgctc

SEQ ID NO: 5066482 - DNA, 16 bp, Homo sapiens
ggctcttttcctgctg

SEQ ID NO: 5066483 - DNA, 19 bp, Homo sapiens
ggctgaaaagtgctttgct

SEQ ID NO: 5066484 - DNA, 24 bp, Homo sapiens
ggctgaaagaacatggacttgtat

SEQ ID NO: 5066485 - DNA, 13 bp, Homo sapiens
ggctgaaagacag

SEQ ID NO: 5066486 - DNA, 21 bp, Homo sapiens
ggctgaaaggaagctgtgcgt

SEQ ID NO: 5066487 - DNA, 16 bp, Homo sapiens
ggctgaaattctcctg

SEQ ID NO: 5066488 - DNA, 14 bp, Homo sapiens
ggctgaacagtgct

SEQ ID NO: 5066489 - DNA, 16 bp, Homo sapiens
ggctgaacagtgctct

SEQ ID NO: 5066490 - DNA, 19 bp, Homo sapiens
ggctgaacagtgctctgcc

SEQ ID NO: 5066491 - DNA, 16 bp, Homo sapiens
ggctgaaccctcagcc

SEQ ID NO: 5066492 - DNA, 21 bp, Homo sapiens
ggctgaaccctcagccttgac

SEQ ID NO: 5066493 - DNA, 17 bp, Homo sapiens
ggctgaaccctgtgctg

SEQ ID NO: 5066494 - DNA, 23 bp, Homo sapiens
ggctgaaccctgtgctggtgtcc

SEQ ID NO: 5066495 - DNA, 10 bp, Homo sapiens
ggctgaagaa

SEQ ID NO: 5066496 - DNA, 22 bp, Homo sapiens
ggctgaagaggaccagaggagc

SEQ ID NO: 5066497 - DNA, 19 bp, Homo sapiens
ggctgaagccacacagccc

SEQ ID NO: 5066498 - DNA, 15 bp, Homo sapiens
ggctgaagctggagc

SEQ ID NO: 5066499 - DNA, 18 bp, Homo sapiens
ggctgaaggactgtgaca

SEQ ID NO: 5066500 - DNA, 12 bp, Homo sapiens
ggctgaagggag

SEQ ID NO: 5066501 - DNA, 20 bp, Homo sapiens
ggctgaagtgcatgggtcag

SEQ ID NO: 5066502 - DNA, 21 bp, Homo sapiens
ggctgaagtgcatgggtcagg

SEQ ID NO: 5066503 - DNA, 21 bp, Homo sapiens
ggctgaatcaaagacatttca

SEQ ID NO: 5066504 - DNA, 16 bp, Homo sapiens
ggctgaatgtatgtaa

SEQ ID NO: 5066505 - DNA, 16 bp, Homo sapiens
ggctgacacccaggcc

SEQ ID NO: 5066506 - DNA, 17 bp, Homo sapiens
ggctgacacccaggccc

SEQ ID NO: 5066507 - DNA, 17 bp, Homo sapiens
ggctgacacctaccatg

SEQ ID NO: 5066508 - DNA, 22 bp, Homo sapiens
ggctgacacctaccatgctgct

SEQ ID NO: 5066509 - DNA, 24 bp, Homo sapiens
ggctgacacgtccaccccagtgca

SEQ ID NO: 5066510 - DNA, 22 bp, Homo sapiens
ggctgacagacagccctccatc

SEQ ID NO: 5066511 - DNA, 18 bp, Homo sapiens
ggctgacatctgtgtttc

SEQ ID NO: 5066512 - DNA, 17 bp, Homo sapiens
ggctgacatgctcacac

SEQ ID NO: 5066513 - DNA, 21 bp, Homo sapiens
ggctgacatgctcacacatta

SEQ ID NO: 5066514 - DNA, 17 bp, Homo sapiens
ggctgacattcactgag

SEQ ID NO: 5066515 - DNA, 13 bp, Homo sapiens
ggctgaccacagc

SEQ ID NO: 5066516 - DNA, 16 bp, Homo sapiens
ggctgaccacagcaca

SEQ ID NO: 5066517 - DNA, 18 bp, Homo sapiens
ggctgaccacagcacagc

SEQ ID NO: 5066518 - DNA, 22 bp, Homo sapiens
ggctgaccacagcacagccaac

SEQ ID NO: 5066519 - DNA, 20 bp, Homo sapiens
ggctgaccaggccctgctca

SEQ ID NO: 5066520 - DNA, 17 bp, Homo sapiens
ggctgacccagcatctc

SEQ ID NO: 5066521 - DNA, 18 bp, Homo sapiens
ggctgacccagcatctcc

SEQ ID NO: 5066522 - DNA, 14 bp, Homo sapiens
ggctgacccagtgt

SEQ ID NO: 5066523 - DNA, 21 bp, Homo sapiens
ggctgacccagtgtgtgctca

SEQ ID NO: 5066524 - DNA, 20 bp, Homo sapiens
ggctgaccccaaagagcctg

SEQ ID NO: 5066525 - DNA, 14 bp, Homo sapiens
ggctgacccctctg

SEQ ID NO: 5066526 - DNA, 18 bp, Homo sapiens
ggctgacccttttctgat

SEQ ID NO: 5066527 - DNA, 17 bp, Homo sapiens
ggctgacctgcctctca

SEQ ID NO: 5066528 - DNA, 17 bp, Homo sapiens
ggctgacctgctgtgga

SEQ ID NO: 5066529 - DNA, 20 bp, Homo sapiens
ggctgaccttcctcgcagag

SEQ ID NO: 5066530 - DNA, 15 bp, Homo sapiens
ggctgacctttcaaa

SEQ ID NO: 5066531 - DNA, 15 bp, Homo sapiens
ggctgacgtgtgagg

SEQ ID NO: 5066532 - DNA, 23 bp, Homo sapiens
ggctgacgtgtgagggaggacag

SEQ ID NO: 5066533 - DNA, 17 bp, Homo sapiens
ggctgacgttccgggca

SEQ ID NO: 5066534 - DNA, 22 bp, Homo sapiens
ggctgactggatgtccagagct

SEQ ID NO: 5066535 - DNA, 14 bp, Homo sapiens
ggctgactggcagg

SEQ ID NO: 5066536 - DNA, 23 bp, Homo sapiens
ggctgactggccagttgcccaga

SEQ ID NO: 5066537 - DNA, 15 bp, Homo sapiens
ggctgactgggccac

SEQ ID NO: 5066538 - DNA, 17 bp, Homo sapiens
ggctgactgggccacag

SEQ ID NO: 5066539 - DNA, 13 bp, Homo sapiens
ggctgactggggc

SEQ ID NO: 5066540 - DNA, 17 bp, Homo sapiens
ggctgactggggctggg

SEQ ID NO: 5066541 - DNA, 22 bp, Homo sapiens
ggctgactgggggcctctgcct

SEQ ID NO: 5066542 - DNA, 15 bp, Homo sapiens
ggctgacttcatctg

SEQ ID NO: 5066543 - DNA, 14 bp, Homo sapiens
ggctgagaaggaac

SEQ ID NO: 5066544 - DNA, 15 bp, Homo sapiens
ggctgagacaggaga

SEQ ID NO: 5066545 - DNA, 17 bp, Homo sapiens
ggctgagacaggagaaa

SEQ ID NO: 5066546 - DNA, 11 bp, Homo sapiens
ggctgagacct

SEQ ID NO: 5066547 - DNA, 13 bp, Homo sapiens
aaaaaaaaaccaa

SEQ ID NO: 5066548 - DNA, 12 bp, Homo sapiens
aaaaaaaaactt

SEQ ID NO: 5066549 - DNA, 12 bp, Homo sapiens
aaaaaaaaaggg

SEQ ID NO: 5066550 - DNA, 13 bp, Homo sapiens
aaaaaaaaagtca

SEQ ID NO: 5066551 - DNA, 12 bp, Homo sapiens
aaaaaaaaatac

SEQ ID NO: 5066552 - DNA, 14 bp, Homo sapiens
aaaaaaaaatgttc

SEQ ID NO: 5066553 - DNA, 14 bp, Homo sapiens
aaaaaaaaccttgt

SEQ ID NO: 5066554 - DNA, 12 bp, Homo sapiens
aaaaaaaactta

SEQ ID NO: 5066555 - DNA, 10 bp, Homo sapiens
aaaaaaaaga

SEQ ID NO: 5066556 - DNA, 12 bp, Homo sapiens
aaaaaaaagaag

SEQ ID NO: 5066557 - DNA, 13 bp, Homo sapiens
aaaaaaaagaata

SEQ ID NO: 5066558 - DNA, 11 bp, Homo sapiens
aaaaaaaagat

SEQ ID NO: 5066559 - DNA, 12 bp, Homo sapiens
aaaaaaaagtca

SEQ ID NO: 5066560 - DNA, 14 bp, Homo sapiens
aaaaaaaagttgca

SEQ ID NO: 5066561 - DNA, 13 bp, Homo sapiens
aaaaaaaagttgg

SEQ ID NO: 5066562 - DNA, 13 bp, Homo sapiens
aaaaaaaatcctt

SEQ ID NO: 5066563 - DNA, 13 bp, Homo sapiens
aaaaaaaatgata

SEQ ID NO: 5066564 - DNA, 13 bp, Homo sapiens
aaaaaaacaaagc

SEQ ID NO: 5066565 - DNA, 11 bp, Homo sapiens
aaaaaaaccaa

SEQ ID NO: 5066566 - DNA, 12 bp, Homo sapiens
aaaaaaactgaa

SEQ ID NO: 5066567 - DNA, 10 bp, Homo sapiens
aaaaaaagaa

SEQ ID NO: 5066568 - DNA, 13 bp, Homo sapiens
aaaaaaagaaact

SEQ ID NO: 5066569 - DNA, 13 bp, Homo sapiens
aaaaaaagaagaa

SEQ ID NO: 5066570 - DNA, 12 bp, Homo sapiens
aaaaaaagaagt

SEQ ID NO: 5066571 - DNA, 13 bp, Homo sapiens
aaaaaaagacaag

SEQ ID NO: 5066572 - DNA, 12 bp, Homo sapiens
aaaaaaagcaaa

SEQ ID NO: 5066573 - DNA, 12 bp, Homo sapiens
aaaaaaagcata

SEQ ID NO: 5066574 - DNA, 13 bp, Homo sapiens
aaaaaaagcatgt

SEQ ID NO: 5066575 - DNA, 12 bp, Homo sapiens
aaaaaaagcttt

SEQ ID NO: 5066576 - DNA, 11 bp, Homo sapiens
aaaaaaaggaa

SEQ ID NO: 5066577 - DNA, 9 bp, Homo sapiens
aaaaaaagt

SEQ ID NO: 5066578 - DNA, 12 bp, Homo sapiens
aaaaaaagtatt

SEQ ID NO: 5066579 - DNA, 14 bp, Homo sapiens
aaaaaaagtattat

SEQ ID NO: 5066580 - DNA, 12 bp, Homo sapiens
aaaaaaagtgtg

SEQ ID NO: 5066581 - DNA, 12 bp, Homo sapiens
aaaaaaagttgg

SEQ ID NO: 5066582 - DNA, 12 bp, Homo sapiens
aaaaaaagttgt

SEQ ID NO: 5066583 - DNA, 11 bp, Homo sapiens
aaaaaaagttt

SEQ ID NO: 5066584 - DNA, 12 bp, Homo sapiens
aaaaaaataaaa

SEQ ID NO: 5066585 - DNA, 11 bp, Homo sapiens
aaaaaaataag

SEQ ID NO: 5066586 - DNA, 12 bp, Homo sapiens
aaaaaaataata

SEQ ID NO: 5066587 - DNA, 12 bp, Homo sapiens
aaaaaaatacag

SEQ ID NO: 5066588 - DNA, 13 bp, Homo sapiens
aaaaaaatacttg

SEQ ID NO: 5066589 - DNA, 13 bp, Homo sapiens
aaaaaaatatatt

SEQ ID NO: 5066590 - DNA, 14 bp, Homo sapiens
aaaaaaatatattt

SEQ ID NO: 5066591 - DNA, 11 bp, Homo sapiens
aaaaaaatatg

SEQ ID NO: 5066592 - DNA, 12 bp, Homo sapiens
aaaaaaatatga

SEQ ID NO: 5066593 - DNA, 13 bp, Homo sapiens
aaaaaaatatgtg

SEQ ID NO: 5066594 - DNA, 12 bp, Homo sapiens
aaaaaaatcttc

SEQ ID NO: 5066595 - DNA, 12 bp, Homo sapiens
aaaaaaatgaca

SEQ ID NO: 5066596 - DNA, 12 bp, Homo sapiens
aaaaaaatgatg

SEQ ID NO: 5066597 - DNA, 11 bp, Homo sapiens
aaaaaaatgcc

SEQ ID NO: 5066598 - DNA, 14 bp, Homo sapiens
aaaaaaatgccata

SEQ ID NO: 5066599 - DNA, 14 bp, Homo sapiens
aaaaaaatgtgaaa

SEQ ID NO: 5066600 - DNA, 13 bp, Homo sapiens
aaaaaaatgttgt

SEQ ID NO: 5066601 - DNA, 13 bp, Homo sapiens
aaaaaaattacaa

SEQ ID NO: 5066602 - DNA, 11 bp, Homo sapiens
aaaaaaattta

SEQ ID NO: 5066603 - DNA, 13 bp, Homo sapiens
aaaaaaatttttg

SEQ ID NO: 5066604 - DNA, 16 bp, Homo sapiens
aaaaaacaatatctgc

SEQ ID NO: 5066605 - DNA, 11 bp, Homo sapiens
aaaaaacactt

SEQ ID NO: 5066606 - DNA, 12 bp, Homo sapiens
aaaaaacagaaa

SEQ ID NO: 5066607 - DNA, 21 bp, Homo sapiens
aaaaaacatacttacatttca

SEQ ID NO: 5066608 - DNA, 10 bp, Homo sapiens
aaaaaacatt

SEQ ID NO: 5066609 - DNA, 16 bp, Homo sapiens
aaaaaaccacaaaggc

SEQ ID NO: 5066610 - DNA, 18 bp, Homo sapiens
aaaaaaccgaggccctca

SEQ ID NO: 5066611 - DNA, 13 bp, Homo sapiens
aaaaaactactgt

SEQ ID NO: 5066612 - DNA, 19 bp, Homo sapiens
aaaaaactcgaggactgta

SEQ ID NO: 5066613 - DNA, 11 bp, Homo sapiens
aaaaaactgaa

SEQ ID NO: 5066614 - DNA, 13 bp, Homo sapiens
aaaaaactggaaa

SEQ ID NO: 5066615 - DNA, 19 bp, Homo sapiens
aaaaaactttctctttgcc

SEQ ID NO: 5066616 - DNA, 11 bp, Homo sapiens
aaaaaactttt

SEQ ID NO: 5066617 - DNA, 9 bp, Homo sapiens
aaaaaagaa

SEQ ID NO: 5066618 - DNA, 10 bp, Homo sapiens
aaaaaagaaa

SEQ ID NO: 5066619 - DNA, 13 bp, Homo sapiens
aaaaaagaaaaat

SEQ ID NO: 5066620 - DNA, 12 bp, Homo sapiens
aaaaaagaaacc

SEQ ID NO: 5066621 - DNA, 13 bp, Homo sapiens
aaaaaagaaacga

SEQ ID NO: 5066622 - DNA, 13 bp, Homo sapiens
aaaaaagaaagtt

SEQ ID NO: 5066623 - DNA, 12 bp, Homo sapiens
aaaaaagaaatg

SEQ ID NO: 5066624 - DNA, 20 bp, Homo sapiens
aaaaaagaaattatctttag

SEQ ID NO: 5066625 - DNA, 12 bp, Homo sapiens
aaaaaagaacct

SEQ ID NO: 5066626 - DNA, 15 bp, Homo sapiens
aaaaaagaagtttgg

SEQ ID NO: 5066627 - DNA, 12 bp, Homo sapiens
aaaaaagaatgt

SEQ ID NO: 5066628 - DNA, 14 bp, Homo sapiens
aaaaaagaatgtca

SEQ ID NO: 5066629 - DNA, 12 bp, Homo sapiens
aaaaaagaattc

SEQ ID NO: 5066630 - DNA, 15 bp, Homo sapiens
aaaaaagagaattag

SEQ ID NO: 5066631 - DNA, 21 bp, Homo sapiens
aaaaaagaggaaagaatgaaa

SEQ ID NO: 5066632 - DNA, 18 bp, Homo sapiens
aaaaaagatactgtatat

SEQ ID NO: 5066633 - DNA, 12 bp, Homo sapiens
aaaaaagattct

SEQ ID NO: 5066634 - DNA, 14 bp, Homo sapiens
aaaaaagattctac

SEQ ID NO: 5066635 - DNA, 16 bp, Homo sapiens
aaaaaagattctacta

SEQ ID NO: 5066636 - DNA, 11 bp, Homo sapiens
aaaaaagcaaa

SEQ ID NO: 5066637 - DNA, 12 bp, Homo sapiens
aaaaaagcaaaa

SEQ ID NO: 5066638 - DNA, 12 bp, Homo sapiens
aaaaaagcacat

SEQ ID NO: 5066639 - DNA, 13 bp, Homo sapiens
aaaaaagcatgaa

SEQ ID NO: 5066640 - DNA, 13 bp, Homo sapiens
aaaaaagcctcca

SEQ ID NO: 5066641 - DNA, 11 bp, Homo sapiens
aaaaaagctca

SEQ ID NO: 5066642 - DNA, 12 bp, Homo sapiens
aaaaaagctcat

SEQ ID NO: 5066643 - DNA, 11 bp, Homo sapiens
aaaaaagcttt

SEQ ID NO: 5066644 - DNA, 19 bp, Homo sapiens
aaaaaagctttatgatttt

SEQ ID NO: 5066645 - DNA, 11 bp, Homo sapiens
aaaaaaggaag

SEQ ID NO: 5066646 - DNA, 18 bp, Homo sapiens
aaaaaaggatgcaacaat

SEQ ID NO: 5066647 - DNA, 12 bp, Homo sapiens
aaaaaaggtagt

SEQ ID NO: 5066648 - DNA, 17 bp, Homo sapiens
aaaaaagtctctattta

SEQ ID NO: 5066649 - DNA, 12 bp, Homo sapiens
aaaaaagtgcat

SEQ ID NO: 5066650 - DNA, 13 bp, Homo sapiens
aaaaaagtttcta

SEQ ID NO: 5066651 - DNA, 12 bp, Homo sapiens
aaaaaagtttta

SEQ ID NO: 5066652 - DNA, 18 bp, Homo sapiens
aaaaaagttttgatgaaa

SEQ ID NO: 5066653 - DNA, 17 bp, Homo sapiens
aaaaaagtttttgcttc

SEQ ID NO: 5066654 - DNA, 21 bp, Homo sapiens
aaaaaataaatataattggga

SEQ ID NO: 5066655 - DNA, 12 bp, Homo sapiens
aaaaaataagta

SEQ ID NO: 5066656 - DNA, 20 bp, Homo sapiens
aaaaaataatctatttctat

SEQ ID NO: 5066657 - DNA, 18 bp, Homo sapiens
aaaaaatacaaacattct

SEQ ID NO: 5066658 - DNA, 17 bp, Homo sapiens
aaaaaatacaccacgaa

SEQ ID NO: 5066659 - DNA, 20 bp, Homo sapiens
aaaaaatacaccacgaattt

SEQ ID NO: 5066660 - DNA, 12 bp, Homo sapiens
aaaaaatacagt

SEQ ID NO: 5066661 - DNA, 16 bp, Homo sapiens
aaaaaataccattgaa

SEQ ID NO: 5066662 - DNA, 11 bp, Homo sapiens
aaaaaatactg

SEQ ID NO: 5066663 - DNA, 20 bp, Homo sapiens
aaaaaatactgccagatgct

SEQ ID NO: 5066664 - DNA, 11 bp, Homo sapiens
aaaaaatactt

SEQ ID NO: 5066665 - DNA, 13 bp, Homo sapiens
aaaaaatatatat

SEQ ID NO: 5066666 - DNA, 13 bp, Homo sapiens
aaaaaatatgaga

SEQ ID NO: 5066667 - DNA, 14 bp, Homo sapiens
aaaaaatattttaa

SEQ ID NO: 5066668 - DNA, 15 bp, Homo sapiens
aaaaaatattttcct

SEQ ID NO: 5066669 - DNA, 12 bp, Homo sapiens
aaaaaatcagct

SEQ ID NO: 5066670 - DNA, 12 bp, Homo sapiens
aaaaaatcatct

SEQ ID NO: 5066671 - DNA, 17 bp, Homo sapiens
aaaaaatcatctatttt

SEQ ID NO: 5066672 - DNA, 22 bp, Homo sapiens
aaaaaatctctccccaatgctc

SEQ ID NO: 5066673 - DNA, 12 bp, Homo sapiens
aaaaaatcttgt

SEQ ID NO: 5066674 - DNA, 12 bp, Homo sapiens
aaaaaatgaata

SEQ ID NO: 5066675 - DNA, 13 bp, Homo sapiens
aaaaaatgaatag

SEQ ID NO: 5066676 - DNA, 21 bp, Homo sapiens
aaaaaatgatctattgcagat

SEQ ID NO: 5066677 - DNA, 12 bp, Homo sapiens
aaaaaatgatgc

SEQ ID NO: 5066678 - DNA, 13 bp, Homo sapiens
aaaaaatgtagct

SEQ ID NO: 5066679 - DNA, 16 bp, Homo sapiens
aaaaaatgtatatgca

SEQ ID NO: 5066680 - DNA, 11 bp, Homo sapiens
aaaaaatgtca

SEQ ID NO: 5066681 - DNA, 20 bp, Homo sapiens
aaaaaatgtgaaatttttcc

SEQ ID NO: 5066682 - DNA, 13 bp, Homo sapiens
aaaaaattaactg

SEQ ID NO: 5066683 - DNA, 12 bp, Homo sapiens
aaaaaattatgg

SEQ ID NO: 5066684 - DNA, 13 bp, Homo sapiens
aaaaaattcttta

SEQ ID NO: 5066685 - DNA, 21 bp, Homo sapiens
aaaaaattctttcacttgatg

SEQ ID NO: 5066686 - DNA, 12 bp, Homo sapiens
aaaaaatttaag

SEQ ID NO: 5066687 - DNA, 12 bp, Homo sapiens
aaaaaatttgtc

SEQ ID NO: 5066688 - DNA, 11 bp, Homo sapiens
aaaaaattttt

SEQ ID NO: 5066689 - DNA, 11 bp, Homo sapiens
aaaaacaaaaa

SEQ ID NO: 5066690 - DNA, 12 bp, Homo sapiens
aaaaacaaacaa

SEQ ID NO: 5066691 - DNA, 12 bp, Homo sapiens
aaaaacaaagct

SEQ ID NO: 5066692 - DNA, 14 bp, Homo sapiens
aaaaacaaatgtta

SEQ ID NO: 5066693 - DNA, 17 bp, Homo sapiens
aaaaacaacaaatactt

SEQ ID NO: 5066694 - DNA, 20 bp, Homo sapiens
aaaaacaacatcattccaaa

SEQ ID NO: 5066695 - DNA, 12 bp, Homo sapiens
aaaaacaacttt

SEQ ID NO: 5066696 - DNA, 18 bp, Homo sapiens
aaaaacacaaaaaaagac

SEQ ID NO: 5066697 - DNA, 15 bp, Homo sapiens
aaaaacacacaaaaa

SEQ ID NO: 5066698 - DNA, 15 bp, Homo sapiens
aaaaacacctagctt

SEQ ID NO: 5066699 - DNA, 18 bp, Homo sapiens
aaaaacacctagctttat

SEQ ID NO: 5066700 - DNA, 16 bp, Homo sapiens
aaaaacacggcagctg

SEQ ID NO: 5066701 - DNA, 16 bp, Homo sapiens
aaaaacactatttctg

SEQ ID NO: 5066702 - DNA, 22 bp, Homo sapiens
aaaaacactggattcatttcat

SEQ ID NO: 5066703 - DNA, 13 bp, Homo sapiens
aaaaacagaaaaa

SEQ ID NO: 5066704 - DNA, 15 bp, Homo sapiens
aaaaacagaaaaaca

SEQ ID NO: 5066705 - DNA, 12 bp, Homo sapiens
aaaaacagagga

SEQ ID NO: 5066706 - DNA, 22 bp, Homo sapiens
aaaaacagattctgattccctt

SEQ ID NO: 5066707 - DNA, 18 bp, Homo sapiens
aaaaacagatttggaaag

SEQ ID NO: 5066708 - DNA, 14 bp, Homo sapiens
aaaaacagcagctc

SEQ ID NO: 5066709 - DNA, 17 bp, Homo sapiens
aaaaacagcagctcata

SEQ ID NO: 5066710 - DNA, 15 bp, Homo sapiens
aaaaacagcagtttg

SEQ ID NO: 5066711 - DNA, 15 bp, Homo sapiens
aaaaacagcattgct

SEQ ID NO: 5066712 - DNA, 17 bp, Homo sapiens
aaaaacagcattgcttt

SEQ ID NO: 5066713 - DNA, 20 bp, Homo sapiens
aaaaacagcattgctttctg

SEQ ID NO: 5066714 - DNA, 13 bp, Homo sapiens
aaaaacaggaaaa

SEQ ID NO: 5066715 - DNA, 17 bp, Homo sapiens
aaaaacaggcacaggct

SEQ ID NO: 5066716 - DNA, 22 bp, Homo sapiens
aaaaacatcccaaactttaaaa

SEQ ID NO: 5066717 - DNA, 14 bp, Homo sapiens
aaaaacatgaccac

SEQ ID NO: 5066718 - DNA, 23 bp, Homo sapiens
aaaaacattctatctactgattt

SEQ ID NO: 5066719 - DNA, 12 bp, Homo sapiens
aaaaacattgcc

SEQ ID NO: 5066720 - DNA, 13 bp, Homo sapiens
aaaaacattgttt

SEQ ID NO: 5066721 - DNA, 13 bp, Homo sapiens
aaaaacatttgta

SEQ ID NO: 5066722 - DNA, 17 bp, Homo sapiens
aaaaacatttgtacatt

SEQ ID NO: 5066723 - DNA, 14 bp, Homo sapiens
aaaaacatttgtca

SEQ ID NO: 5066724 - DNA, 16 bp, Homo sapiens
aaaaacattttaaaat

SEQ ID NO: 5066725 - DNA, 22 bp, Homo sapiens
aaaaacattttaaaatcaactt

SEQ ID NO: 5066726 - DNA, 23 bp, Homo sapiens
aaaaacattttttaaggagggag

SEQ ID NO: 5066727 - DNA, 18 bp, Homo sapiens
aaaaacatttttttaagc

SEQ ID NO: 5066728 - DNA, 14 bp, Homo sapiens
aaaaaccaaaactg

SEQ ID NO: 5066729 - DNA, 22 bp, Homo sapiens
aaaaaccaaaatactccaaaga

SEQ ID NO: 5066730 - DNA, 20 bp, Homo sapiens
aaaaaccaaataagcatctg

SEQ ID NO: 5066731 - DNA, 17 bp, Homo sapiens
aaaaaccaatttaccca

SEQ ID NO: 5066732 - DNA, 22 bp, Homo sapiens
aaaaaccacagatactgaaaca

SEQ ID NO: 5066733 - DNA, 19 bp, Homo sapiens
aaaaaccaccaaaaacaaa

SEQ ID NO: 5066734 - DNA, 15 bp, Homo sapiens
aaaaaccagaatcat

SEQ ID NO: 5066735 - DNA, 20 bp, Homo sapiens
aaaaaccagaatcataattt

SEQ ID NO: 5066736 - DNA, 22 bp, Homo sapiens
aaaaaccagaatcataattttc

SEQ ID NO: 5066737 - DNA, 23 bp, Homo sapiens
aaaaaccagaatcataattttca

SEQ ID NO: 5066738 - DNA, 16 bp, Homo sapiens
aaaaaccagtattgta

SEQ ID NO: 5066739 - DNA, 13 bp, Homo sapiens
aaaaacccaaaat

SEQ ID NO: 5066740 - DNA, 14 bp, Homo sapiens
aaaaacccaaaata

SEQ ID NO: 5066741 - DNA, 19 bp, Homo sapiens
aaaaacccacaattgaact

SEQ ID NO: 5066742 - DNA, 19 bp, Homo sapiens
aaaaacccagcaacagaaa

SEQ ID NO: 5066743 - DNA, 20 bp, Homo sapiens
aaaaacccctaaaaacaaaa

SEQ ID NO: 5066744 - DNA, 16 bp, Homo sapiens
aaaaaccctaattttg

SEQ ID NO: 5066745 - DNA, 22 bp, Homo sapiens
aaaaaccctaattttgtacata

SEQ ID NO: 5066746 - DNA, 22 bp, Homo sapiens
aaaaaccctatatgcttactgt

SEQ ID NO: 5066747 - DNA, 23 bp, Homo sapiens
aaaaaccctatatgcttactgtg

SEQ ID NO: 5066748 - DNA, 17 bp, Homo sapiens
aaaaaccgaataaatgt

SEQ ID NO: 5066749 - DNA, 17 bp, Homo sapiens
aaaaaccgttcaaattc

SEQ ID NO: 5066750 - DNA, 16 bp, Homo sapiens
aaaaacctattccact

SEQ ID NO: 5066751 - DNA, 13 bp, Homo sapiens
aaaaacctatttt

SEQ ID NO: 5066752 - DNA, 22 bp, Homo sapiens
aaaaacctgagatttattaaag

SEQ ID NO: 5066753 - DNA, 17 bp, Homo sapiens
aaaaacctgatgcagtg

SEQ ID NO: 5066754 - DNA, 11 bp, Homo sapiens
aaaaacctgcc

SEQ ID NO: 5066755 - DNA, 13 bp, Homo sapiens
aaaaacctgtggg

SEQ ID NO: 5066756 - DNA, 12 bp, Homo sapiens
aaaaaccttggg

SEQ ID NO: 5066757 - DNA, 22 bp, Homo sapiens
aaaaacgaaactccatctcaaa

SEQ ID NO: 5066758 - DNA, 13 bp, Homo sapiens
aaaaactacacat

SEQ ID NO: 5066759 - DNA, 17 bp, Homo sapiens
aaaaactacattttgca

SEQ ID NO: 5066760 - DNA, 17 bp, Homo sapiens
aaaaactactgaataaa

SEQ ID NO: 5066761 - DNA, 21 bp, Homo sapiens
aaaaactactgttaacactgc

SEQ ID NO: 5066762 - DNA, 12 bp, Homo sapiens
aaaaactcctgg

SEQ ID NO: 5066763 - DNA, 17 bp, Homo sapiens
aaaaactcgaggactgt

SEQ ID NO: 5066764 - DNA, 16 bp, Homo sapiens
aaaaactctatttttg

SEQ ID NO: 5066765 - DNA, 15 bp, Homo sapiens
aaaaactctttattt

SEQ ID NO: 5066766 - DNA, 15 bp, Homo sapiens
aaaaactctttggtg

SEQ ID NO: 5066767 - DNA, 15 bp, Homo sapiens
aaaaactgaaggttt

SEQ ID NO: 5066768 - DNA, 12 bp, Homo sapiens
aaaaactgaagt

SEQ ID NO: 5066769 - DNA, 15 bp, Homo sapiens
aaaaactgatttgct

SEQ ID NO: 5066770 - DNA, 14 bp, Homo sapiens
aaaaactgcagtca

SEQ ID NO: 5066771 - DNA, 13 bp, Homo sapiens
aaaaactgccccc

SEQ ID NO: 5066772 - DNA, 22 bp, Homo sapiens
aaaaactggaaacatctgattt

SEQ ID NO: 5066773 - DNA, 18 bp, Homo sapiens
aaaaactggatatttcaa

SEQ ID NO: 5066774 - DNA, 13 bp, Homo sapiens
aaaaactgggata

SEQ ID NO: 5066775 - DNA, 14 bp, Homo sapiens
aaaaactgtaaaag

SEQ ID NO: 5066776 - DNA, 19 bp, Homo sapiens
aaaaactgtataaggagat

SEQ ID NO: 5066777 - DNA, 15 bp, Homo sapiens
aaaaactgtctttaa

SEQ ID NO: 5066778 - DNA, 20 bp, Homo sapiens
aaaaactgtctttaaaagag

SEQ ID NO: 5066779 - DNA, 15 bp, Homo sapiens
aaaaactgtgtatca

SEQ ID NO: 5066780 - DNA, 21 bp, Homo sapiens
aaaaactgtgtatcattaaaa

SEQ ID NO: 5066781 - DNA, 17 bp, Homo sapiens
aaaaactgttaccagat

SEQ ID NO: 5066782 - DNA, 15 bp, Homo sapiens
aaaaacttaaagcaa

SEQ ID NO: 5066783 - DNA, 20 bp, Homo sapiens
aaaaacttaaatattgtaat

SEQ ID NO: 5066784 - DNA, 23 bp, Homo sapiens
aaaaacttaaatattgtaatatg

SEQ ID NO: 5066785 - DNA, 21 bp, Homo sapiens
aaaaacttagtgacaaaatag

SEQ ID NO: 5066786 - DNA, 19 bp, Homo sapiens
aaaaacttcagtaagtacg

SEQ ID NO: 5066787 - DNA, 10 bp, Homo sapiens
aaaaacttcc

SEQ ID NO: 5066788 - DNA, 12 bp, Homo sapiens
aaaaacttgtaa

SEQ ID NO: 5066789 - DNA, 18 bp, Homo sapiens
aaaaacttgtaaatgctg

SEQ ID NO: 5066790 - DNA, 18 bp, Homo sapiens
aaaaacttgtactatgtt

SEQ ID NO: 5066791 - DNA, 22 bp, Homo sapiens
aaaaacttgtactatgttaata

SEQ ID NO: 5066792 - DNA, 13 bp, Homo sapiens
aaaaactttccat

SEQ ID NO: 5066793 - DNA, 17 bp, Homo sapiens
aaaaactttccatgaca

SEQ ID NO: 5066794 - DNA, 20 bp, Homo sapiens
aaaaactttccatgacagta

SEQ ID NO: 5066795 - DNA, 22 bp, Homo sapiens
aaaaactttccatgacagtagc

SEQ ID NO: 5066796 - DNA, 15 bp, Homo sapiens
aaaaactttctcttt

SEQ ID NO: 5066797 - DNA, 20 bp, Homo sapiens
aaaaacttttaggttgttac

SEQ ID NO: 5066798 - DNA, 21 bp, Homo sapiens
aaaaacttttaggttgttacc

SEQ ID NO: 5066799 - DNA, 12 bp, Homo sapiens
aaaaacttttat

SEQ ID NO: 5066800 - DNA, 18 bp, Homo sapiens
aaaaacttttataaatta

SEQ ID NO: 5066801 - DNA, 15 bp, Homo sapiens
aaaaacttttcattt

SEQ ID NO: 5066802 - DNA, 16 bp, Homo sapiens
aaaaacttttttcttt

SEQ ID NO: 5066803 - DNA, 13 bp, Homo sapiens
aaaaagaaaaaag

SEQ ID NO: 5066804 - DNA, 13 bp, Homo sapiens
aaaaagaaaaaca

SEQ ID NO: 5066805 - DNA, 19 bp, Homo sapiens
aaaaagaaaaacatttcct

SEQ ID NO: 5066806 - DNA, 15 bp, Homo sapiens
aaaaagaaaaaggaa

SEQ ID NO: 5066807 - DNA, 12 bp, Homo sapiens
aaaaagaaaact

SEQ ID NO: 5066808 - DNA, 11 bp, Homo sapiens
aaaaagaaaag

SEQ ID NO: 5066809 - DNA, 14 bp, Homo sapiens
aaaaagaaaatgaa

SEQ ID NO: 5066810 - DNA, 12 bp, Homo sapiens
aaaaagaaacta

SEQ ID NO: 5066811 - DNA, 17 bp, Homo sapiens
aaaaagaaactttgttt

SEQ ID NO: 5066812 - DNA, 14 bp, Homo sapiens
aaaaagaaagctaa

SEQ ID NO: 5066813 - DNA, 15 bp, Homo sapiens
aaaaagaaaggaggg

SEQ ID NO: 5066814 - DNA, 12 bp, Homo sapiens
aaaaagaaatga

SEQ ID NO: 5066815 - DNA, 15 bp, Homo sapiens
aaaaagaaatgacta

SEQ ID NO: 5066816 - DNA, 11 bp, Homo sapiens
aaaaagaaatt

SEQ ID NO: 5066817 - DNA, 16 bp, Homo sapiens
aaaaagaacttttgta

SEQ ID NO: 5066818 - DNA, 14 bp, Homo sapiens
aaaaagaagaatct

SEQ ID NO: 5066819 - DNA, 18 bp, Homo sapiens
aaaaagaagcaacctcag

SEQ ID NO: 5066820 - DNA, 14 bp, Homo sapiens
aaaaagaagtttgg

SEQ ID NO: 5066821 - DNA, 13 bp, Homo sapiens
aaaaagaatagaa

SEQ ID NO: 5066822 - DNA, 13 bp, Homo sapiens
aaaaagaatgtca

SEQ ID NO: 5066823 - DNA, 20 bp, Homo sapiens
aaaaagacagcgataagctt

SEQ ID NO: 5066824 - DNA, 14 bp, Homo sapiens
aaaaagacagggct

SEQ ID NO: 5066825 - DNA, 16 bp, Homo sapiens
aaaaagacctggcctt

SEQ ID NO: 5066826 - DNA, 15 bp, Homo sapiens
aaaaagaccttctcc

SEQ ID NO: 5066827 - DNA, 23 bp, Homo sapiens
aaaaagacgatgtttatgttctt

SEQ ID NO: 5066828 - DNA, 12 bp, Homo sapiens
aaaaagactatt

SEQ ID NO: 5066829 - DNA, 15 bp, Homo sapiens
aaaaagactgttatt

SEQ ID NO: 5066830 - DNA, 12 bp, Homo sapiens
aaaaagagaaac

SEQ ID NO: 5066831 - DNA, 19 bp, Homo sapiens
aaaaagagaagtattataa

SEQ ID NO: 5066832 - DNA, 14 bp, Homo sapiens
aaaaagagaattgt

SEQ ID NO: 5066833 - DNA, 12 bp, Homo sapiens
aaaaagagacat

SEQ ID NO: 5066834 - DNA, 20 bp, Homo sapiens
aaaaagagtcttaattttct

SEQ ID NO: 5066835 - DNA, 16 bp, Homo sapiens
aaaaagatactgtata

SEQ ID NO: 5066836 - DNA, 22 bp, Homo sapiens
aaaaagatatattaaaaatata

SEQ ID NO: 5066837 - DNA, 14 bp, Homo sapiens
aaaaagatattgta

SEQ ID NO: 5066838 - DNA, 15 bp, Homo sapiens
aaaaagatattgtat

SEQ ID NO: 5066839 - DNA, 22 bp, Homo sapiens
aaaaagatggcctttgcttatg

SEQ ID NO: 5066840 - DNA, 14 bp, Homo sapiens
aaaaagatgtacag

SEQ ID NO: 5066841 - DNA, 14 bp, Homo sapiens
aaaaagattagcaa

SEQ ID NO: 5066842 - DNA, 13 bp, Homo sapiens
aaaaagattatat

SEQ ID NO: 5066843 - DNA, 16 bp, Homo sapiens
aaaaagattctactaa

SEQ ID NO: 5066844 - DNA, 16 bp, Homo sapiens
aaaaagattgccaatt

SEQ ID NO: 5066845 - DNA, 19 bp, Homo sapiens
aaaaagattgtattacttt

SEQ ID NO: 5066846 - DNA, 13 bp, Homo sapiens
aaaaagatttttt

SEQ ID NO: 5066847 - DNA, 10 bp, Homo sapiens
aaaaagcaaa

SEQ ID NO: 5066848 - DNA, 16 bp, Homo sapiens
aaaaagcaaaaacaat

SEQ ID NO: 5066849 - DNA, 15 bp, Homo sapiens
aaaaagcaaatggaa

SEQ ID NO: 5066850 - DNA, 13 bp, Homo sapiens
aaaaagcaacttt

SEQ ID NO: 5066851 - DNA, 11 bp, Homo sapiens
aaaaagcacaa

SEQ ID NO: 5066852 - DNA, 13 bp, Homo sapiens
aaaaagcacaaga

SEQ ID NO: 5066853 - DNA, 15 bp, Homo sapiens
aaaaagcacaagaag

SEQ ID NO: 5066854 - DNA, 12 bp, Homo sapiens
aaaaagcacata

SEQ ID NO: 5066855 - DNA, 16 bp, Homo sapiens
aaaaagcacatacatt

SEQ ID NO: 5066856 - DNA, 22 bp, Homo sapiens
aaaaagcaggaaagatcccaag

SEQ ID NO: 5066857 - DNA, 23 bp, Homo sapiens
aaaaagcaggaaagatcccaagt

SEQ ID NO: 5066858 - DNA, 17 bp, Homo sapiens
aaaaagcaggactgtgc

SEQ ID NO: 5066859 - DNA, 14 bp, Homo sapiens
aaaaagcagtcctc

SEQ ID NO: 5066860 - DNA, 14 bp, Homo sapiens
aaaaagcagttctt

SEQ ID NO: 5066861 - DNA, 19 bp, Homo sapiens
aaaaagcagtttttgaaag

SEQ ID NO: 5066862 - DNA, 17 bp, Homo sapiens
aaaaagcatatataact

SEQ ID NO: 5066863 - DNA, 16 bp, Homo sapiens
aaaaagcatgaatatt

SEQ ID NO: 5066864 - DNA, 17 bp, Homo sapiens
aaaaagcatgactattt

SEQ ID NO: 5066865 - DNA, 20 bp, Homo sapiens
aaaaagcatgatgggaaaat

SEQ ID NO: 5066866 - DNA, 18 bp, Homo sapiens
aaaaagcatgtacagtgt

SEQ ID NO: 5066867 - DNA, 21 bp, Homo sapiens
aaaaagcatgtacagtgttct

SEQ ID NO: 5066868 - DNA, 18 bp, Homo sapiens
aaaaagccaccacacact

SEQ ID NO: 5066869 - DNA, 17 bp, Homo sapiens
aaaaagccagggctgga

SEQ ID NO: 5066870 - DNA, 20 bp, Homo sapiens
aaaaagccccacacataact

SEQ ID NO: 5066871 - DNA, 12 bp, Homo sapiens
aaaaagccctct

SEQ ID NO: 5066872 - DNA, 23 bp, Homo sapiens
aaaaagcctaacaaatgggatta

SEQ ID NO: 5066873 - DNA, 15 bp, Homo sapiens
aaaaagcctaagaaa

SEQ ID NO: 5066874 - DNA, 17 bp, Homo sapiens
aaaaagcctaagaaaaa

SEQ ID NO: 5066875 - DNA, 16 bp, Homo sapiens
aaaaagcctacattct

SEQ ID NO: 5066876 - DNA, 20 bp, Homo sapiens
aaaaagcctgcaatttcata

SEQ ID NO: 5066877 - DNA, 18 bp, Homo sapiens
aaaaagcctggtttttct

SEQ ID NO: 5066878 - DNA, 17 bp, Homo sapiens
aaaaagctaataccagt

SEQ ID NO: 5066879 - DNA, 19 bp, Homo sapiens
aaaaagctcaatgcattgt

SEQ ID NO: 5066880 - DNA, 19 bp, Homo sapiens
aaaaagctcatattttgta

SEQ ID NO: 5066881 - DNA, 15 bp, Homo sapiens
aaaaagctctttcat

SEQ ID NO: 5066882 - DNA, 20 bp, Homo sapiens
aaaaagctgcaaaaattata

SEQ ID NO: 5066883 - DNA, 22 bp, Homo sapiens
aaaaagctggtgggtgaaagaa

SEQ ID NO: 5066884 - DNA, 22 bp, Homo sapiens
aaaaagcttgtggccaatggaa

SEQ ID NO: 5066885 - DNA, 16 bp, Homo sapiens
aaaaagctttactctt

SEQ ID NO: 5066886 - DNA, 14 bp, Homo sapiens
aaaaagcttttatg

SEQ ID NO: 5066887 - DNA, 11 bp, Homo sapiens
aaaaaggaaaa

SEQ ID NO: 5066888 - DNA, 12 bp, Homo sapiens
aaaaaggaaaaa

SEQ ID NO: 5066889 - DNA, 19 bp, Homo sapiens
aaaaaggaaaaaattaata

SEQ ID NO: 5066890 - DNA, 13 bp, Homo sapiens
aaaaaggaaaaat

SEQ ID NO: 5066891 - DNA, 17 bp, Homo sapiens
aaaaaggaaaagttaaa

SEQ ID NO: 5066892 - DNA, 23 bp, Homo sapiens
aaaaaggaaagatgaaataaata

SEQ ID NO: 5066893 - DNA, 12 bp, Homo sapiens
aaaaaggaaata

SEQ ID NO: 5066894 - DNA, 13 bp, Homo sapiens
aaaaaggaaatat

SEQ ID NO: 5066895 - DNA, 19 bp, Homo sapiens
aaaaaggaaatttgtttgt

SEQ ID NO: 5066896 - DNA, 12 bp, Homo sapiens
aaaaaggaagga

SEQ ID NO: 5066897 - DNA, 13 bp, Homo sapiens
aaaaaggaaggag

SEQ ID NO: 5066898 - DNA, 19 bp, Homo sapiens
aaaaaggaaggagagatga

SEQ ID NO: 5066899 - DNA, 23 bp, Homo sapiens
aaaaaggaagtggggacagattc

SEQ ID NO: 5066900 - DNA, 13 bp, Homo sapiens
aaaaaggactgga

SEQ ID NO: 5066901 - DNA, 23 bp, Homo sapiens
aaaaaggactggaaaaatgaact

SEQ ID NO: 5066902 - DNA, 14 bp, Homo sapiens
aaaaaggaggaaga

SEQ ID NO: 5066903 - DNA, 17 bp, Homo sapiens
aaaaaggatacataatg

SEQ ID NO: 5066904 - DNA, 13 bp, Homo sapiens
aaaaaggatggaa

SEQ ID NO: 5066905 - DNA, 22 bp, Homo sapiens
aaaaaggatggaagaaagaagc

SEQ ID NO: 5066906 - DNA, 12 bp, Homo sapiens
aaaaaggcaaat

SEQ ID NO: 5066907 - DNA, 14 bp, Homo sapiens
aaaaaggccaaaga

SEQ ID NO: 5066908 - DNA, 20 bp, Homo sapiens
aaaaaggctagtttattttg

SEQ ID NO: 5066909 - DNA, 16 bp, Homo sapiens
aaaaagggaaaaagac

SEQ ID NO: 5066910 - DNA, 17 bp, Homo sapiens
aaaaagggaaagttttg

SEQ ID NO: 5066911 - DNA, 15 bp, Homo sapiens
aaaaagggaggggga

SEQ ID NO: 5066912 - DNA, 22 bp, Homo sapiens
aaaaagggcagggcatctcctg

SEQ ID NO: 5066913 - DNA, 22 bp, Homo sapiens
aaaaagggccctggtaaaatag

SEQ ID NO: 5066914 - DNA, 21 bp, Homo sapiens
aaaaaggggggtgggagggga

SEQ ID NO: 5066915 - DNA, 21 bp, Homo sapiens
aaaaagggtaagctagagaga

SEQ ID NO: 5066916 - DNA, 18 bp, Homo sapiens
aaaaaggtctgttaatgt

SEQ ID NO: 5066917 - DNA, 16 bp, Homo sapiens
aaaaaggtgagtgggt

SEQ ID NO: 5066918 - DNA, 12 bp, Homo sapiens
aaaaaggtgcta

SEQ ID NO: 5066919 - DNA, 17 bp, Homo sapiens
aaaaaggtgtgtcaaag

SEQ ID NO: 5066920 - DNA, 22 bp, Homo sapiens
aaaaaggtgtgtcaaagatttt

SEQ ID NO: 5066921 - DNA, 16 bp, Homo sapiens
aaaaaggttaattttt

SEQ ID NO: 5066922 - DNA, 21 bp, Homo sapiens
aaaaaggttggagcagtgctt

SEQ ID NO: 5066923 - DNA, 13 bp, Homo sapiens
aaaaaggtttaca

SEQ ID NO: 5066924 - DNA, 14 bp, Homo sapiens
aaaaagtaacacag

SEQ ID NO: 5066925 - DNA, 19 bp, Homo sapiens
aaaaagtaagttaataatg

SEQ ID NO: 5066926 - DNA, 21 bp, Homo sapiens
aaaaagtaagttaataatgta

SEQ ID NO: 5066927 - DNA, 19 bp, Homo sapiens
aaaaagtaatgatttcttg

SEQ ID NO: 5066928 - DNA, 22 bp, Homo sapiens
aaaaagtagattaaaatatttg

SEQ ID NO: 5066929 - DNA, 14 bp, Homo sapiens
aaaaagtataaaat

SEQ ID NO: 5066930 - DNA, 12 bp, Homo sapiens
aaaaagtattgc

SEQ ID NO: 5066931 - DNA, 16 bp, Homo sapiens
aaaaagtattgccaaa

SEQ ID NO: 5066932 - DNA, 20 bp, Homo sapiens
aaaaagtattgccaaacatt

SEQ ID NO: 5066933 - DNA, 20 bp, Homo sapiens
aaaaagtatttttttaagtt

SEQ ID NO: 5066934 - DNA, 15 bp, Homo sapiens
aaaaagtcaaacttt

SEQ ID NO: 5066935 - DNA, 19 bp, Homo sapiens
aaaaagtcaccattctgca

SEQ ID NO: 5066936 - DNA, 20 bp, Homo sapiens
aaaaagtcagactgctggga

SEQ ID NO: 5066937 - DNA, 18 bp, Homo sapiens
aaaaagtcagagacagat

SEQ ID NO: 5066938 - DNA, 15 bp, Homo sapiens
aaaaagtcattgtaa

SEQ ID NO: 5066939 - DNA, 22 bp, Homo sapiens
aaaaagtcctgtcagttcagaa

SEQ ID NO: 5066940 - DNA, 22 bp, Homo sapiens
aaaaagtctacgctctcctttc

SEQ ID NO: 5066941 - DNA, 15 bp, Homo sapiens
aaaaagtctctattt

SEQ ID NO: 5066942 - DNA, 21 bp, Homo sapiens
aaaaagtctctatttaaattc

SEQ ID NO: 5066943 - DNA, 15 bp, Homo sapiens
aaaaagtctgtatgg

SEQ ID NO: 5066944 - DNA, 17 bp, Homo sapiens
aaaaagtgaaataatgt

SEQ ID NO: 5066945 - DNA, 12 bp, Homo sapiens
aaaaagtgaact

SEQ ID NO: 5066946 - DNA, 14 bp, Homo sapiens
aaaaagtgaacttt

SEQ ID NO: 5066947 - DNA, 19 bp, Homo sapiens
aaaaagtgaacttttgtaa

SEQ ID NO: 5066948 - DNA, 21 bp, Homo sapiens
aaaaagtgaacttttgtaatt

SEQ ID NO: 5066949 - DNA, 14 bp, Homo sapiens
aaaaagtgacacag

SEQ ID NO: 5066950 - DNA, 16 bp, Homo sapiens
aaaaagtgacacagca

SEQ ID NO: 5066951 - DNA, 22 bp, Homo sapiens
aaaaagtggggcagagcctccc

SEQ ID NO: 5066952 - DNA, 15 bp, Homo sapiens
aaaaagtgtacatga

SEQ ID NO: 5066953 - DNA, 12 bp, Homo sapiens
aaaaagtgtctc

SEQ ID NO: 5066954 - DNA, 19 bp, Homo sapiens
aaaaagtgtttataatgca

SEQ ID NO: 5066955 - DNA, 20 bp, Homo sapiens
aaaaagttaaaaaaaataat

SEQ ID NO: 5066956 - DNA, 16 bp, Homo sapiens
aaaaagttaaatgtgt

SEQ ID NO: 5066957 - DNA, 20 bp, Homo sapiens
aaaaagttaaatgtgtgtaa

SEQ ID NO: 5066958 - DNA, 12 bp, Homo sapiens
aaaaagttataa

SEQ ID NO: 5066959 - DNA, 11 bp, Homo sapiens
aaaaagttcaa

SEQ ID NO: 5066960 - DNA, 15 bp, Homo sapiens
aaaaagttgcacatt

SEQ ID NO: 5066961 - DNA, 22 bp, Homo sapiens
aaaaagttgcagctgttttgtt

SEQ ID NO: 5066962 - DNA, 23 bp, Homo sapiens
aaaaagttgcagctgttttgttg

SEQ ID NO: 5066963 - DNA, 23 bp, Homo sapiens
aaaaagttgtaatagagaatatt

SEQ ID NO: 5066964 - DNA, 12 bp, Homo sapiens
aaaaagttgtgt

SEQ ID NO: 5066965 - DNA, 13 bp, Homo sapiens
aaaaagttgttta

SEQ ID NO: 5066966 - DNA, 15 bp, Homo sapiens
aaaaagttgtttata

SEQ ID NO: 5066967 - DNA, 14 bp, Homo sapiens
aaaaagtttaaaat

SEQ ID NO: 5066968 - DNA, 16 bp, Homo sapiens
aaaaagtttaaaatgt

SEQ ID NO: 5066969 - DNA, 17 bp, Homo sapiens
aaaaagtttacaagtgt

SEQ ID NO: 5066970 - DNA, 17 bp, Homo sapiens
aaaaagtttgccagaag

SEQ ID NO: 5066971 - DNA, 18 bp, Homo sapiens
aaaaagtttgtcttagtt

SEQ ID NO: 5066972 - DNA, 20 bp, Homo sapiens
aaaaagtttgttactttgaa

SEQ ID NO: 5066973 - DNA, 23 bp, Homo sapiens
aaaaagttttgccctttttaagg

SEQ ID NO: 5066974 - DNA, 18 bp, Homo sapiens
aaaaataaaaacataaaa

SEQ ID NO: 5066975 - DNA, 21 bp, Homo sapiens
aaaaataaaaactgactcctt

SEQ ID NO: 5066976 - DNA, 16 bp, Homo sapiens
aaaaataaaaatggaa

SEQ ID NO: 5066977 - DNA, 14 bp, Homo sapiens
aaaaataaaacatt

SEQ ID NO: 5066978 - DNA, 12 bp, Homo sapiens
aaaaataaaagt

SEQ ID NO: 5066979 - DNA, 13 bp, Homo sapiens
aaaaataaaagtg

SEQ ID NO: 5066980 - DNA, 19 bp, Homo sapiens
aaaaataaaataagtccta

SEQ ID NO: 5066981 - DNA, 20 bp, Homo sapiens
aaaaataaaataattataaa

SEQ ID NO: 5066982 - DNA, 13 bp, Homo sapiens
aaaaataaaatgt

SEQ ID NO: 5066983 - DNA, 15 bp, Homo sapiens
aaaaataaaatgttt

SEQ ID NO: 5066984 - DNA, 12 bp, Homo sapiens
aaaaataaaatt

SEQ ID NO: 5066985 - DNA, 13 bp, Homo sapiens
aaaaataaaatta

SEQ ID NO: 5066986 - DNA, 13 bp, Homo sapiens
aaaaataaactag

SEQ ID NO: 5066987 - DNA, 15 bp, Homo sapiens
aaaaataaactagtt

SEQ ID NO: 5066988 - DNA, 12 bp, Homo sapiens
aaaaataaagct

SEQ ID NO: 5066989 - DNA, 13 bp, Homo sapiens
aaaaataaagcta

SEQ ID NO: 5066990 - DNA, 22 bp, Homo sapiens
aaaaataaatataattgggatt

SEQ ID NO: 5066991 - DNA, 11 bp, Homo sapiens
aaaaataaatc

SEQ ID NO: 5066992 - DNA, 13 bp, Homo sapiens
aaaaataaatcaa

SEQ ID NO: 5066993 - DNA, 15 bp, Homo sapiens
aaaaataaatcaagg

SEQ ID NO: 5066994 - DNA, 15 bp, Homo sapiens
aaaaataaatgttca

SEQ ID NO: 5066995 - DNA, 19 bp, Homo sapiens
aaaaataaattaataaatt

SEQ ID NO: 5066996 - DNA, 14 bp, Homo sapiens
aaaaataacactgt

SEQ ID NO: 5066997 - DNA, 15 bp, Homo sapiens
aaaaataacactgtt

SEQ ID NO: 5066998 - DNA, 22 bp, Homo sapiens
aaaaataaccccaaaatgaaga

SEQ ID NO: 5066999 - DNA, 17 bp, Homo sapiens
aaaaataactattttgt

SEQ ID NO: 5067000 - DNA, 18 bp, Homo sapiens
aaaaataactgtaattat

SEQ ID NO: 5067001 - DNA, 20 bp, Homo sapiens
aaaaataagccaaaataaga

SEQ ID NO: 5067002 - DNA, 21 bp, Homo sapiens
aaaaataagtcaacagtaaac

SEQ ID NO: 5067003 - DNA, 12 bp, Homo sapiens
aaaaataataaa

SEQ ID NO: 5067004 - DNA, 13 bp, Homo sapiens
aaaaataataaaa

SEQ ID NO: 5067005 - DNA, 17 bp, Homo sapiens
aaaaataataaattgca

SEQ ID NO: 5067006 - DNA, 16 bp, Homo sapiens
aaaaataataataatg

SEQ ID NO: 5067007 - DNA, 20 bp, Homo sapiens
aaaaataatataaatgaatg

SEQ ID NO: 5067008 - DNA, 18 bp, Homo sapiens
aaaaataatcaaaagcta

SEQ ID NO: 5067009 - DNA, 15 bp, Homo sapiens
aaaaataattatttt

SEQ ID NO: 5067010 - DNA, 17 bp, Homo sapiens
aaaaataatttattttg

SEQ ID NO: 5067011 - DNA, 17 bp, Homo sapiens
aaaaatacaatttttat

SEQ ID NO: 5067012 - DNA, 18 bp, Homo sapiens
aaaaatacaccacgaatt

SEQ ID NO: 5067013 - DNA, 22 bp, Homo sapiens
aaaaatacaccgtttagaaaaa

SEQ ID NO: 5067014 - DNA, 16 bp, Homo sapiens
aaaaatacagtaaagt

SEQ ID NO: 5067015 - DNA, 15 bp, Homo sapiens
aaaaatacagtatta

SEQ ID NO: 5067016 - DNA, 14 bp, Homo sapiens
aaaaatacatgcat

SEQ ID NO: 5067017 - DNA, 17 bp, Homo sapiens
aaaaatacatttttgtt

SEQ ID NO: 5067018 - DNA, 14 bp, Homo sapiens
aaaaatactaccta

SEQ ID NO: 5067019 - DNA, 16 bp, Homo sapiens
aaaaatactctaattc

SEQ ID NO: 5067020 - DNA, 17 bp, Homo sapiens
aaaaatactctaattct

SEQ ID NO: 5067021 - DNA, 19 bp, Homo sapiens
aaaaatactctaattctaa

SEQ ID NO: 5067022 - DNA, 22 bp, Homo sapiens
aaaaatactctaattctaacca

SEQ ID NO: 5067023 - DNA, 10 bp, Homo sapiens
aaaaatactt

SEQ ID NO: 5067024 - DNA, 17 bp, Homo sapiens
aaaaatacttaaatatt

SEQ ID NO: 5067025 - DNA, 11 bp, Homo sapiens
aaaaatacttc

SEQ ID NO: 5067026 - DNA, 15 bp, Homo sapiens
aaaaatacttgtcaa

SEQ ID NO: 5067027 - DNA, 13 bp, Homo sapiens
aaaaatagaaaca

SEQ ID NO: 5067028 - DNA, 16 bp, Homo sapiens
aaaaatagaaacatat

SEQ ID NO: 5067029 - DNA, 12 bp, Homo sapiens
aaaaatagacag

SEQ ID NO: 5067030 - DNA, 14 bp, Homo sapiens
aaaaatagatgttt

SEQ ID NO: 5067031 - DNA, 19 bp, Homo sapiens
aaaaatagatgttttaact

SEQ ID NO: 5067032 - DNA, 15 bp, Homo sapiens
aaaaatagcaacttg

SEQ ID NO: 5067033 - DNA, 18 bp, Homo sapiens
aaaaatagtcttccacaa

SEQ ID NO: 5067034 - DNA, 17 bp, Homo sapiens
aaaaatagtgtctttgt

SEQ ID NO: 5067035 - DNA, 21 bp, Homo sapiens
aaaaatagttttacattaaca

SEQ ID NO: 5067036 - DNA, 19 bp, Homo sapiens
aaaaatataaaatttctgg

SEQ ID NO: 5067037 - DNA, 20 bp, Homo sapiens
aaaaatataaacaatgttca

SEQ ID NO: 5067038 - DNA, 12 bp, Homo sapiens
aaaaatataatg

SEQ ID NO: 5067039 - DNA, 12 bp, Homo sapiens
aaaaatatacat

SEQ ID NO: 5067040 - DNA, 18 bp, Homo sapiens
aaaaatatacatgtttat

SEQ ID NO: 5067041 - DNA, 15 bp, Homo sapiens
aaaaatatatactaa

SEQ ID NO: 5067042 - DNA, 22 bp, Homo sapiens
aaaaatatatatataaaatatt

SEQ ID NO: 5067043 - DNA, 21 bp, Homo sapiens
aaaaatatatatatatattta

SEQ ID NO: 5067044 - DNA, 18 bp, Homo sapiens
aaaaatatatatctatct

SEQ ID NO: 5067045 - DNA, 11 bp, Homo sapiens
aaaaatatatg

SEQ ID NO: 5067046 - DNA, 12 bp, Homo sapiens
aaaaatatatgt

SEQ ID NO: 5067047 - DNA, 17 bp, Homo sapiens
aaaaatatatgtatata

SEQ ID NO: 5067048 - DNA, 21 bp, Homo sapiens
aaaaatatatgttgaatgtta

SEQ ID NO: 5067049 - DNA, 14 bp, Homo sapiens
aaaaatatcaaaaa

SEQ ID NO: 5067050 - DNA, 21 bp, Homo sapiens
aaaaatatccttgatgtacag

SEQ ID NO: 5067051 - DNA, 13 bp, Homo sapiens
aaaaatatctcct

SEQ ID NO: 5067052 - DNA, 15 bp, Homo sapiens
aaaaatatctgtaag

SEQ ID NO: 5067053 - DNA, 20 bp, Homo sapiens
aaaaatatggaacttctaat

SEQ ID NO: 5067054 - DNA, 11 bp, Homo sapiens
aaaaatatgtc

SEQ ID NO: 5067055 - DNA, 14 bp, Homo sapiens
aaaaatatgtcatc

SEQ ID NO: 5067056 - DNA, 16 bp, Homo sapiens
aaaaatatgtgaagga

SEQ ID NO: 5067057 - DNA, 12 bp, Homo sapiens
aaaaatatgtgt

SEQ ID NO: 5067058 - DNA, 13 bp, Homo sapiens
aaaaatatgtgta

SEQ ID NO: 5067059 - DNA, 18 bp, Homo sapiens
aaaaatattcctccaaat

SEQ ID NO: 5067060 - DNA, 20 bp, Homo sapiens
aaaaatattcctccaaatct

SEQ ID NO: 5067061 - DNA, 15 bp, Homo sapiens
aaaaatattctccat

SEQ ID NO: 5067062 - DNA, 19 bp, Homo sapiens
aaaaatattgctaaaagtg

SEQ ID NO: 5067063 - DNA, 11 bp, Homo sapiens
aaaaatattgt

SEQ ID NO: 5067064 - DNA, 11 bp, Homo sapiens
aaaaatattta

SEQ ID NO: 5067065 - DNA, 18 bp, Homo sapiens
aaaaatcaaaaaattatc

SEQ ID NO: 5067066 - DNA, 23 bp, Homo sapiens
aaaaatcaactttttattgcctt

SEQ ID NO: 5067067 - DNA, 16 bp, Homo sapiens
aaaaatcaatcaatgg

SEQ ID NO: 5067068 - DNA, 16 bp, Homo sapiens
aaaaatcaattaacca

SEQ ID NO: 5067069 - DNA, 14 bp, Homo sapiens
aaaaatcacaaaaa

SEQ ID NO: 5067070 - DNA, 20 bp, Homo sapiens
aaaaatcacaatttttaatg

SEQ ID NO: 5067071 - DNA, 17 bp, Homo sapiens
aaaaatcaccatctttg

SEQ ID NO: 5067072 - DNA, 17 bp, Homo sapiens
aaaaatcacccagttgt

SEQ ID NO: 5067073 - DNA, 20 bp, Homo sapiens
aaaaatcactatgatttctg

SEQ ID NO: 5067074 - DNA, 22 bp, Homo sapiens
aaaaatcagatgaattgataaa

SEQ ID NO: 5067075 - DNA, 23 bp, Homo sapiens
aaaaatcagatgaattgataaaa

SEQ ID NO: 5067076 - DNA, 21 bp, Homo sapiens
aaaaatcaggcagaaatattt

SEQ ID NO: 5067077 - DNA, 20 bp, Homo sapiens
aaaaatcagtttttgttctt

SEQ ID NO: 5067078 - DNA, 13 bp, Homo sapiens
aaaaatcatatag

SEQ ID NO: 5067079 - DNA, 16 bp, Homo sapiens
aaaaatcatatagacc

SEQ ID NO: 5067080 - DNA, 20 bp, Homo sapiens
aaaaatcatatagaccaatt

SEQ ID NO: 5067081 - DNA, 12 bp, Homo sapiens
aaaaatcatcta

SEQ ID NO: 5067082 - DNA, 20 bp, Homo sapiens
aaaaatcatcttataattag

SEQ ID NO: 5067083 - DNA, 20 bp, Homo sapiens
aaaaatcatgccagtatttt

SEQ ID NO: 5067084 - DNA, 19 bp, Homo sapiens
aaaaatcatgggccagagc

SEQ ID NO: 5067085 - DNA, 16 bp, Homo sapiens
aaaaatcatgtttgct

SEQ ID NO: 5067086 - DNA, 15 bp, Homo sapiens
aaaaatcctcttcct

SEQ ID NO: 5067087 - DNA, 19 bp, Homo sapiens
aaaaatcctcttcctctga

SEQ ID NO: 5067088 - DNA, 20 bp, Homo sapiens
aaaaatcctgcccaaaatgt

SEQ ID NO: 5067089 - DNA, 22 bp, Homo sapiens
aaaaatcctgcccaaaatgtga

SEQ ID NO: 5067090 - DNA, 15 bp, Homo sapiens
aaaaatccttctaat

SEQ ID NO: 5067091 - DNA, 16 bp, Homo sapiens
aaaaatccttctaatc

SEQ ID NO: 5067092 - DNA, 16 bp, Homo sapiens
aaaaatctacagtgtt

SEQ ID NO: 5067093 - DNA, 18 bp, Homo sapiens
aaaaatctaccttctgta

SEQ ID NO: 5067094 - DNA, 23 bp, Homo sapiens
aaaaatctagtgggttgaccttt

SEQ ID NO: 5067095 - DNA, 14 bp, Homo sapiens
aaaaatctagtttt

SEQ ID NO: 5067096 - DNA, 15 bp, Homo sapiens
aaaaatctagttttt

SEQ ID NO: 5067097 - DNA, 14 bp, Homo sapiens
aaaaatctatattt

SEQ ID NO: 5067098 - DNA, 9 bp, Homo sapiens
aaaaatctc

SEQ ID NO: 5067099 - DNA, 14 bp, Homo sapiens
aaaaatctcaaatt

SEQ ID NO: 5067100 - DNA, 19 bp, Homo sapiens
aaaaatctcaattgaaagc

SEQ ID NO: 5067101 - DNA, 12 bp, Homo sapiens
aaaaatctcatt

SEQ ID NO: 5067102 - DNA, 17 bp, Homo sapiens
aaaaatctgaagattgt

SEQ ID NO: 5067103 - DNA, 20 bp, Homo sapiens
aaaaatctgaagattgttta

SEQ ID NO: 5067104 - DNA, 23 bp, Homo sapiens
aaaaatctgaagattgtttatct

SEQ ID NO: 5067105 - DNA, 13 bp, Homo sapiens
aaaaatctgaatt

SEQ ID NO: 5067106 - DNA, 14 bp, Homo sapiens
aaaaatctgaattt

SEQ ID NO: 5067107 - DNA, 13 bp, Homo sapiens
aaaaatctgagaa

SEQ ID NO: 5067108 - DNA, 12 bp, Homo sapiens
aaaaatctgttt

SEQ ID NO: 5067109 - DNA, 16 bp, Homo sapiens
aaaaatcttgggcaag

SEQ ID NO: 5067110 - DNA, 20 bp, Homo sapiens
aaaaatcttggtttggtaca

SEQ ID NO: 5067111 - DNA, 13 bp, Homo sapiens
aaaaatcttgtgc

SEQ ID NO: 5067112 - DNA, 20 bp, Homo sapiens
aaaaatcttgtgctagaata

SEQ ID NO: 5067113 - DNA, 10 bp, Homo sapiens
aaaaatgaaa

SEQ ID NO: 5067114 - DNA, 12 bp, Homo sapiens
aaaaatgaaaga

SEQ ID NO: 5067115 - DNA, 15 bp, Homo sapiens
aaaaatgaaagtgac

SEQ ID NO: 5067116 - DNA, 18 bp, Homo sapiens
aaaaatgaaagtgacttt

SEQ ID NO: 5067117 - DNA, 17 bp, Homo sapiens
aaaaatgaaataaagca

SEQ ID NO: 5067118 - DNA, 14 bp, Homo sapiens
aaaaatgaactgta

SEQ ID NO: 5067119 - DNA, 14 bp, Homo sapiens
aaaaatgacagact

SEQ ID NO: 5067120 - DNA, 14 bp, Homo sapiens
aaaaatgagaacat

SEQ ID NO: 5067121 - DNA, 16 bp, Homo sapiens
aaaaatgagaacatgt

SEQ ID NO: 5067122 - DNA, 11 bp, Homo sapiens
aaaaatgatgc

SEQ ID NO: 5067123 - DNA, 20 bp, Homo sapiens
aaaaatgatttcagtagcac

SEQ ID NO: 5067124 - DNA, 15 bp, Homo sapiens
aaaaatgcaaaaaag

SEQ ID NO: 5067125 - DNA, 21 bp, Homo sapiens
aaaaatgcacaaacaatgcaa

SEQ ID NO: 5067126 - DNA, 21 bp, Homo sapiens
aaaaatgcacgtagctgaggc

SEQ ID NO: 5067127 - DNA, 13 bp, Homo sapiens
aaaaatgcagaat

SEQ ID NO: 5067128 - DNA, 10 bp, Homo sapiens
aaaaatgcat

SEQ ID NO: 5067129 - DNA, 12 bp, Homo sapiens
aaaaatgcatga

SEQ ID NO: 5067130 - DNA, 17 bp, Homo sapiens
aaaaatgcattgaacat

SEQ ID NO: 5067131 - DNA, 21 bp, Homo sapiens
aaaaatgcatttaagttgtaa

SEQ ID NO: 5067132 - DNA, 20 bp, Homo sapiens
aaaaatgcctttgagacagt

SEQ ID NO: 5067133 - DNA, 14 bp, Homo sapiens
aaaaatgctgctct

SEQ ID NO: 5067134 - DNA, 21 bp, Homo sapiens
aaaaatgctgttcagaaatat

SEQ ID NO: 5067135 - DNA, 12 bp, Homo sapiens
aaaaatgcttct

SEQ ID NO: 5067136 - DNA, 16 bp, Homo sapiens
aaaaatgcttgaccct

SEQ ID NO: 5067137 - DNA, 15 bp, Homo sapiens
aaaaatggatattat

SEQ ID NO: 5067138 - DNA, 23 bp, Homo sapiens
aaaaatgggacttcttttcacat

SEQ ID NO: 5067139 - DNA, 17 bp, Homo sapiens
aaaaatgggagccagga

SEQ ID NO: 5067140 - DNA, 15 bp, Homo sapiens
aaaaatggtataaaa

SEQ ID NO: 5067141 - DNA, 19 bp, Homo sapiens
aaaaatggtataaaaggtt

SEQ ID NO: 5067142 - DNA, 20 bp, Homo sapiens
aaaaatggtggcttcagctc

SEQ ID NO: 5067143 - DNA, 14 bp, Homo sapiens
aaaaatggttgatg

SEQ ID NO: 5067144 - DNA, 21 bp, Homo sapiens
aaaaatggttttgaatagatc

SEQ ID NO: 5067145 - DNA, 21 bp, Homo sapiens
aaaaatgtaacatcataatta

SEQ ID NO: 5067146 - DNA, 13 bp, Homo sapiens
aaaaatgtacatt

SEQ ID NO: 5067147 - DNA, 17 bp, Homo sapiens
aaaaatgtacatttatt

SEQ ID NO: 5067148 - DNA, 19 bp, Homo sapiens
aaaaatgtagaatgatttt

SEQ ID NO: 5067149 - DNA, 21 bp, Homo sapiens
aaaaatgtagaatgatttttg

SEQ ID NO: 5067150 - DNA, 17 bp, Homo sapiens
aaaaatgtattttatgt

SEQ ID NO: 5067151 - DNA, 14 bp, Homo sapiens
aaaaatgtcactga

SEQ ID NO: 5067152 - DNA, 18 bp, Homo sapiens
aaaaatgtccagccaccc

SEQ ID NO: 5067153 - DNA, 19 bp, Homo sapiens
aaaaatgtccagccacccc

SEQ ID NO: 5067154 - DNA, 18 bp, Homo sapiens
aaaaatgtcctgcctttt

SEQ ID NO: 5067155 - DNA, 13 bp, Homo sapiens
aaaaatgtgaaat

SEQ ID NO: 5067156 - DNA, 15 bp, Homo sapiens
aaaaatgtgaaattt

SEQ ID NO: 5067157 - DNA, 17 bp, Homo sapiens
aaaaatgtgagctataa

SEQ ID NO: 5067158 - DNA, 22 bp, Homo sapiens
aaaaatgttaagcatctaagga

SEQ ID NO: 5067159 - DNA, 23 bp, Homo sapiens
aaaaatgttagtattttaatcct

SEQ ID NO: 5067160 - DNA, 11 bp, Homo sapiens
aaaaatgttca

SEQ ID NO: 5067161 - DNA, 13 bp, Homo sapiens
aaaaatgttcact

SEQ ID NO: 5067162 - DNA, 12 bp, Homo sapiens
aaaaatgttcat

SEQ ID NO: 5067163 - DNA, 20 bp, Homo sapiens
aaaaatgttctattttaatt

SEQ ID NO: 5067164 - DNA, 13 bp, Homo sapiens
aaaaatgttggaa

SEQ ID NO: 5067165 - DNA, 22 bp, Homo sapiens
aaaaatgttggatttataaatg

SEQ ID NO: 5067166 - DNA, 15 bp, Homo sapiens
aaaaatgttttccaa

SEQ ID NO: 5067167 - DNA, 22 bp, Homo sapiens
aaaaatgttttccaatatttta

SEQ ID NO: 5067168 - DNA, 20 bp, Homo sapiens
aaaaattaaaatctttcttt

SEQ ID NO: 5067169 - DNA, 14 bp, Homo sapiens
aaaaattaaagccc

SEQ ID NO: 5067170 - DNA, 11 bp, Homo sapiens
aaaaattaaat

SEQ ID NO: 5067171 - DNA, 13 bp, Homo sapiens
aaaaattaaatat

SEQ ID NO: 5067172 - DNA, 14 bp, Homo sapiens
aaaaattaaatatt

SEQ ID NO: 5067173 - DNA, 18 bp, Homo sapiens
aaaaattaattaggaatt

SEQ ID NO: 5067174 - DNA, 12 bp, Homo sapiens
aaaaattacaaa

SEQ ID NO: 5067175 - DNA, 22 bp, Homo sapiens
aaaaattacatatataaaacta

SEQ ID NO: 5067176 - DNA, 18 bp, Homo sapiens
aaaaattacattatgccc

SEQ ID NO: 5067177 - DNA, 19 bp, Homo sapiens
aaaaattacattatgccct

SEQ ID NO: 5067178 - DNA, 19 bp, Homo sapiens
aaaaattacctttaatttt

SEQ ID NO: 5067179 - DNA, 17 bp, Homo sapiens
aaaaattatatattgca

SEQ ID NO: 5067180 - DNA, 15 bp, Homo sapiens
aaaaattatctttaa

SEQ ID NO: 5067181 - DNA, 16 bp, Homo sapiens
aaaaattatgcaattc

SEQ ID NO: 5067182 - DNA, 15 bp, Homo sapiens
aaaaattatggaata

SEQ ID NO: 5067183 - DNA, 11 bp, Homo sapiens
aaaaattatta

SEQ ID NO: 5067184 - DNA, 17 bp, Homo sapiens
aaaaattcaatagtaat

SEQ ID NO: 5067185 - DNA, 19 bp, Homo sapiens
aaaaattcaatagtaatat

SEQ ID NO: 5067186 - DNA, 21 bp, Homo sapiens
aaaaattcagagtccttgcaa

SEQ ID NO: 5067187 - DNA, 20 bp, Homo sapiens
aaaaattcagcaaagtggtt

SEQ ID NO: 5067188 - DNA, 19 bp, Homo sapiens
aaaaattcctttgtgtttc

SEQ ID NO: 5067189 - DNA, 23 bp, Homo sapiens
aaaaattctagtctgtttcatta

SEQ ID NO: 5067190 - DNA, 17 bp, Homo sapiens
aaaaattgaaagaactt

SEQ ID NO: 5067191 - DNA, 22 bp, Homo sapiens
aaaaattgaaatgtaaggctgt

SEQ ID NO: 5067192 - DNA, 12 bp, Homo sapiens
aaaaattgaatt

SEQ ID NO: 5067193 - DNA, 14 bp, Homo sapiens
aaaaattgcacaat

SEQ ID NO: 5067194 - DNA, 16 bp, Homo sapiens
aaaaattggagctcat

SEQ ID NO: 5067195 - DNA, 18 bp, Homo sapiens
aaaaattggggattctta

SEQ ID NO: 5067196 - DNA, 20 bp, Homo sapiens
aaaaattggggattcttaaa

SEQ ID NO: 5067197 - DNA, 23 bp, Homo sapiens
aaaaattggttttatttttttct

SEQ ID NO: 5067198 - DNA, 13 bp, Homo sapiens
aaaaattgtctct

SEQ ID NO: 5067199 - DNA, 11 bp, Homo sapiens
aaaaattgtta

SEQ ID NO: 5067200 - DNA, 13 bp, Homo sapiens
aaaaattgtttcc

SEQ ID NO: 5067201 - DNA, 16 bp, Homo sapiens
aaaaattgtttccaaa

SEQ ID NO: 5067202 - DNA, 18 bp, Homo sapiens
aaaaattgtttcttgaca

SEQ ID NO: 5067203 - DNA, 21 bp, Homo sapiens
aaaaatttaaagggtgtactt

SEQ ID NO: 5067204 - DNA, 13 bp, Homo sapiens
aaaaatttaagtg

SEQ ID NO: 5067205 - DNA, 13 bp, Homo sapiens
aaaaatttacttt

SEQ ID NO: 5067206 - DNA, 20 bp, Homo sapiens
aaaaatttataacagttata

SEQ ID NO: 5067207 - DNA, 22 bp, Homo sapiens
aaaaatttatacaccagcaatt

SEQ ID NO: 5067208 - DNA, 22 bp, Homo sapiens
aaaaatttattatatatttaca

SEQ ID NO: 5067209 - DNA, 20 bp, Homo sapiens
aaaaatttctggcaaatatt

SEQ ID NO: 5067210 - DNA, 23 bp, Homo sapiens
aaaaatttctggcaaatattttg

SEQ ID NO: 5067211 - DNA, 12 bp, Homo sapiens
aaaaatttgaac

SEQ ID NO: 5067212 - DNA, 13 bp, Homo sapiens
aaaaatttgacat

SEQ ID NO: 5067213 - DNA, 22 bp, Homo sapiens
aaaaatttgacattgtcagaat

SEQ ID NO: 5067214 - DNA, 24 bp, Homo sapiens
aaaaatttgacattgtcagaatgt

SEQ ID NO: 5067215 - DNA, 19 bp, Homo sapiens
aaaaatttgcatgcaaaat

SEQ ID NO: 5067216 - DNA, 23 bp, Homo sapiens
aaaaatttggaattctgttcatt

SEQ ID NO: 5067217 - DNA, 15 bp, Homo sapiens
aaaaatttgtataag

SEQ ID NO: 5067218 - DNA, 13 bp, Homo sapiens
aaaaattttagct

SEQ ID NO: 5067219 - DNA, 14 bp, Homo sapiens
aaaaattttgaatg

SEQ ID NO: 5067220 - DNA, 16 bp, Homo sapiens
aaaaattttgcatttc

SEQ ID NO: 5067221 - DNA, 11 bp, Homo sapiens
aaaaattttgt

SEQ ID NO: 5067222 - DNA, 11 bp, Homo sapiens
aaaaattttta

SEQ ID NO: 5067223 - DNA, 14 bp, Homo sapiens
aaaaatttttatgt

SEQ ID NO: 5067224 - DNA, 19 bp, Homo sapiens
aaaaatttttatgtaaaac

SEQ ID NO: 5067225 - DNA, 13 bp, Homo sapiens
aaaaatttttgac

SEQ ID NO: 5067226 - DNA, 15 bp, Homo sapiens
aaaaatttttttgtt

SEQ ID NO: 5067227 - DNA, 15 bp, Homo sapiens
aaaacaaaaaacaat

SEQ ID NO: 5067228 - DNA, 14 bp, Homo sapiens
aaaacaaaaataaa

SEQ ID NO: 5067229 - DNA, 13 bp, Homo sapiens
aaaacaaaaccaa

SEQ ID NO: 5067230 - DNA, 18 bp, Homo sapiens
aaaacaaaaccagctgct

SEQ ID NO: 5067231 - DNA, 13 bp, Homo sapiens
aaaacaaaaggca

SEQ ID NO: 5067232 - DNA, 10 bp, Homo sapiens
aaaacaaaat

SEQ ID NO: 5067233 - DNA, 13 bp, Homo sapiens
aaaacaaacaaat

SEQ ID NO: 5067234 - DNA, 15 bp, Homo sapiens
aaaacaaactaaatg

SEQ ID NO: 5067235 - DNA, 13 bp, Homo sapiens
aaaacaaagacat

SEQ ID NO: 5067236 - DNA, 19 bp, Homo sapiens
aaaacaaagcagctttaaa

SEQ ID NO: 5067237 - DNA, 16 bp, Homo sapiens
aaaacaaagctgattt

SEQ ID NO: 5067238 - DNA, 18 bp, Homo sapiens
aaaacaaagctgatttcc

SEQ ID NO: 5067239 - DNA, 18 bp, Homo sapiens
aaaacaaagggaaaaaag

SEQ ID NO: 5067240 - DNA, 23 bp, Homo sapiens
aaaacaaagtctgggaaattcta

SEQ ID NO: 5067241 - DNA, 16 bp, Homo sapiens
aaaacaaagtgcaaag

SEQ ID NO: 5067242 - DNA, 21 bp, Homo sapiens
aaaacaaagttttaaacgaaa

SEQ ID NO: 5067243 - DNA, 12 bp, Homo sapiens
aaaacaaatgaa

SEQ ID NO: 5067244 - DNA, 15 bp, Homo sapiens
aaaacaaatgccaca

SEQ ID NO: 5067245 - DNA, 11 bp, Homo sapiens
aaaacaaatgt

SEQ ID NO: 5067246 - DNA, 12 bp, Homo sapiens
aaaacaacaaaa

SEQ ID NO: 5067247 - DNA, 13 bp, Homo sapiens
aaaacaacaaaaa

SEQ ID NO: 5067248 - DNA, 14 bp, Homo sapiens
aaaacaacaaataa

SEQ ID NO: 5067249 - DNA, 22 bp, Homo sapiens
aaaacaacagcaacaacaacag

SEQ ID NO: 5067250 - DNA, 18 bp, Homo sapiens
aaaacaaccaaagaaaat

SEQ ID NO: 5067251 - DNA, 23 bp, Homo sapiens
aaaacaaccaacagaaaacatcc

SEQ ID NO: 5067252 - DNA, 14 bp, Homo sapiens
aaaacaaccaagcg

SEQ ID NO: 5067253 - DNA, 17 bp, Homo sapiens
aaaacaactttcacttc

SEQ ID NO: 5067254 - DNA, 18 bp, Homo sapiens
aaaacaactttcacttct

SEQ ID NO: 5067255 - DNA, 18 bp, Homo sapiens
aaaacaagaaaccaagtg

SEQ ID NO: 5067256 - DNA, 14 bp, Homo sapiens
aaaacaagaaagaa

SEQ ID NO: 5067257 - DNA, 17 bp, Homo sapiens
aaaacaagaaagtttcc

SEQ ID NO: 5067258 - DNA, 22 bp, Homo sapiens
aaaacaagagactgcttgacaa

SEQ ID NO: 5067259 - DNA, 17 bp, Homo sapiens
aaaacaagcaggatggc

SEQ ID NO: 5067260 - DNA, 12 bp, Homo sapiens
aaaacaagcctt

SEQ ID NO: 5067261 - DNA, 15 bp, Homo sapiens
aaaacaagtctataa

SEQ ID NO: 5067262 - DNA, 19 bp, Homo sapiens
aaaacaagtctataatgtg

SEQ ID NO: 5067263 - DNA, 17 bp, Homo sapiens
aaaacaataggatgggc

SEQ ID NO: 5067264 - DNA, 14 bp, Homo sapiens
aaaacaatatatgt

SEQ ID NO: 5067265 - DNA, 20 bp, Homo sapiens
aaaacaatatatgtaaatta

SEQ ID NO: 5067266 - DNA, 19 bp, Homo sapiens
aaaacaatattactttgtc

SEQ ID NO: 5067267 - DNA, 17 bp, Homo sapiens
aaaacaatattgtttct

SEQ ID NO: 5067268 - DNA, 18 bp, Homo sapiens
aaaacaatattgtttcta

SEQ ID NO: 5067269 - DNA, 13 bp, Homo sapiens
aaaacaatctatt

SEQ ID NO: 5067270 - DNA, 13 bp, Homo sapiens
aaaacaatctgta

SEQ ID NO: 5067271 - DNA, 13 bp, Homo sapiens
aaaacaatgaaga

SEQ ID NO: 5067272 - DNA, 20 bp, Homo sapiens
aaaacaatgccatgaacaaa

SEQ ID NO: 5067273 - DNA, 22 bp, Homo sapiens
aaaacaatgccatgaacaaatt

SEQ ID NO: 5067274 - DNA, 12 bp, Homo sapiens
aaaacaattcag

SEQ ID NO: 5067275 - DNA, 16 bp, Homo sapiens
aaaacaattcagtggt

SEQ ID NO: 5067276 - DNA, 14 bp, Homo sapiens
aaaacaattgtaat

SEQ ID NO: 5067277 - DNA, 20 bp, Homo sapiens
aaaacaattttctgtaatct

SEQ ID NO: 5067278 - DNA, 18 bp, Homo sapiens
aaaacacaacattttaat

SEQ ID NO: 5067279 - DNA, 18 bp, Homo sapiens
aaaacacaagactgtcat

SEQ ID NO: 5067280 - DNA, 16 bp, Homo sapiens
aaaacacacctcgtgg

SEQ ID NO: 5067281 - DNA, 21 bp, Homo sapiens
aaaacacacgctcctctgccc

SEQ ID NO: 5067282 - DNA, 18 bp, Homo sapiens
aaaacacagcaagggtga

SEQ ID NO: 5067283 - DNA, 18 bp, Homo sapiens
aaaacacagcctccctga

SEQ ID NO: 5067284 - DNA, 22 bp, Homo sapiens
aaaacacagtgcactcagagct

SEQ ID NO: 5067285 - DNA, 16 bp, Homo sapiens
aaaacacatgttttta

SEQ ID NO: 5067286 - DNA, 21 bp, Homo sapiens
aaaacaccaccaaatgacaag

SEQ ID NO: 5067287 - DNA, 17 bp, Homo sapiens
aaaacaccagctgtata

SEQ ID NO: 5067288 - DNA, 21 bp, Homo sapiens
aaaacaccatggagatgaaat

SEQ ID NO: 5067289 - DNA, 18 bp, Homo sapiens
aaaacacccttgaaaata

SEQ ID NO: 5067290 - DNA, 22 bp, Homo sapiens
aaaacaccgcttctgccttttc

SEQ ID NO: 5067291 - DNA, 22 bp, Homo sapiens
aaaacacctagctttattcttc

SEQ ID NO: 5067292 - DNA, 16 bp, Homo sapiens
aaaacacctttatttt

SEQ ID NO: 5067293 - DNA, 18 bp, Homo sapiens
aaaacactacttttgctt

SEQ ID NO: 5067294 - DNA, 19 bp, Homo sapiens
aaaacactatttctggaat

SEQ ID NO: 5067295 - DNA, 21 bp, Homo sapiens
aaaacactatttttttttctt

SEQ ID NO: 5067296 - DNA, 13 bp, Homo sapiens
aaaacactgtgca

SEQ ID NO: 5067297 - DNA, 13 bp, Homo sapiens
aaaacactgtgga

SEQ ID NO: 5067298 - DNA, 19 bp, Homo sapiens
aaaacactgttctctgccc

SEQ ID NO: 5067299 - DNA, 22 bp, Homo sapiens
aaaacacttggcatacaaaata

SEQ ID NO: 5067300 - DNA, 14 bp, Homo sapiens
aaaacactttcctg

SEQ ID NO: 5067301 - DNA, 21 bp, Homo sapiens
aaaacagaaaaaaaacacaca

SEQ ID NO: 5067302 - DNA, 17 bp, Homo sapiens
aaaacagaaaaataaga

SEQ ID NO: 5067303 - DNA, 12 bp, Homo sapiens
aaaacagaaacc

SEQ ID NO: 5067304 - DNA, 15 bp, Homo sapiens
aaaacagaaattggt

SEQ ID NO: 5067305 - DNA, 22 bp, Homo sapiens
aaaacagaacatcattagaaca

SEQ ID NO: 5067306 - DNA, 16 bp, Homo sapiens
aaaacagaacatttct

SEQ ID NO: 5067307 - DNA, 15 bp, Homo sapiens
aaaacagaagcaaat

SEQ ID NO: 5067308 - DNA, 15 bp, Homo sapiens
aaaacagaatcttct

SEQ ID NO: 5067309 - DNA, 17 bp, Homo sapiens
aaaacagaatcttctgg

SEQ ID NO: 5067310 - DNA, 14 bp, Homo sapiens
aaaacagacaataa

SEQ ID NO: 5067311 - DNA, 22 bp, Homo sapiens
aaaacagaccggggttcccgtg

SEQ ID NO: 5067312 - DNA, 19 bp, Homo sapiens
aaaacagaggatgctgaag

SEQ ID NO: 5067313 - DNA, 15 bp, Homo sapiens
aaaacagataaacaa

SEQ ID NO: 5067314 - DNA, 11 bp, Homo sapiens
aaaacagatat

SEQ ID NO: 5067315 - DNA, 16 bp, Homo sapiens
aaaacagattctatat

SEQ ID NO: 5067316 - DNA, 20 bp, Homo sapiens
aaaacagattctatattatt

SEQ ID NO: 5067317 - DNA, 14 bp, Homo sapiens
aaaacagattctga

SEQ ID NO: 5067318 - DNA, 23 bp, Homo sapiens
aaaacagcaatagtgaatgaatg

SEQ ID NO: 5067319 - DNA, 22 bp, Homo sapiens
aaaacagccataggccctttca

SEQ ID NO: 5067320 - DNA, 17 bp, Homo sapiens
aaaacagcccaggtcct

SEQ ID NO: 5067321 - DNA, 18 bp, Homo sapiens
aaaacagctagcttgaaa

SEQ ID NO: 5067322 - DNA, 18 bp, Homo sapiens
aaaacagctctgcaggct

SEQ ID NO: 5067323 - DNA, 17 bp, Homo sapiens
aaaacaggcaaagtttt

SEQ ID NO: 5067324 - DNA, 15 bp, Homo sapiens
aaaacaggcaaattc

SEQ ID NO: 5067325 - DNA, 19 bp, Homo sapiens
aaaacagggtccaggaatg

SEQ ID NO: 5067326 - DNA, 18 bp, Homo sapiens
aaaacaggtatatacttt

SEQ ID NO: 5067327 - DNA, 18 bp, Homo sapiens
aaaacaggtcaatacagt

SEQ ID NO: 5067328 - DNA, 21 bp, Homo sapiens
aaaacaggtcttcatcgaatc

SEQ ID NO: 5067329 - DNA, 23 bp, Homo sapiens
aaaacagtaactaagcacattat

SEQ ID NO: 5067330 - DNA, 14 bp, Homo sapiens
aaaacagtacagaa

SEQ ID NO: 5067331 - DNA, 18 bp, Homo sapiens
aaaacagtagtgtattaa

SEQ ID NO: 5067332 - DNA, 18 bp, Homo sapiens
aaaacagtatttattttg

SEQ ID NO: 5067333 - DNA, 19 bp, Homo sapiens
aaaacagtatttattttgt

SEQ ID NO: 5067334 - DNA, 23 bp, Homo sapiens
aaaacagtatttattttgtaatt

SEQ ID NO: 5067335 - DNA, 22 bp, Homo sapiens
aaaacagtttcatctaaatgaa

SEQ ID NO: 5067336 - DNA, 17 bp, Homo sapiens
aaaacataaaaagttaa

SEQ ID NO: 5067337 - DNA, 17 bp, Homo sapiens
aaaacataacataaatt

SEQ ID NO: 5067338 - DNA, 21 bp, Homo sapiens
aaaacataatagaatttccta

SEQ ID NO: 5067339 - DNA, 14 bp, Homo sapiens
aaaacataatataa

SEQ ID NO: 5067340 - DNA, 14 bp, Homo sapiens
aaaacataatatct

SEQ ID NO: 5067341 - DNA, 24 bp, Homo sapiens
aaaacataatcttctgccttctca

SEQ ID NO: 5067342 - DNA, 21 bp, Homo sapiens
aaaacatacttacatttcaga

SEQ ID NO: 5067343 - DNA, 13 bp, Homo sapiens
aaaacatagaaaa

SEQ ID NO: 5067344 - DNA, 15 bp, Homo sapiens
aaaacatagactgaa

SEQ ID NO: 5067345 - DNA, 22 bp, Homo sapiens
aaaacatagactgaagatttat

SEQ ID NO: 5067346 - DNA, 12 bp, Homo sapiens
aaaacatagctt

SEQ ID NO: 5067347 - DNA, 13 bp, Homo sapiens
aaaacatatattt

SEQ ID NO: 5067348 - DNA, 16 bp, Homo sapiens
aaaacatatattttat

SEQ ID NO: 5067349 - DNA, 13 bp, Homo sapiens
aaaacatatcaat

SEQ ID NO: 5067350 - DNA, 20 bp, Homo sapiens
aaaacatatcaattcaacac

SEQ ID NO: 5067351 - DNA, 23 bp, Homo sapiens
aaaacatatcaattcaacacatt

SEQ ID NO: 5067352 - DNA, 13 bp, Homo sapiens
aaaacatatgaaa

SEQ ID NO: 5067353 - DNA, 21 bp, Homo sapiens
aaaacatatgaaatataaatt

SEQ ID NO: 5067354 - DNA, 23 bp, Homo sapiens
aaaacatattcaaagcagcagcc

SEQ ID NO: 5067355 - DNA, 16 bp, Homo sapiens
aaaacatatttcattt

SEQ ID NO: 5067356 - DNA, 18 bp, Homo sapiens
aaaacatattttacatct

SEQ ID NO: 5067357 - DNA, 14 bp, Homo sapiens
aaaacatcacattc

SEQ ID NO: 5067358 - DNA, 12 bp, Homo sapiens
aaaacatcacta

SEQ ID NO: 5067359 - DNA, 14 bp, Homo sapiens
aaaacatcattcct

SEQ ID NO: 5067360 - DNA, 17 bp, Homo sapiens
aaaacatccacttaagt

SEQ ID NO: 5067361 - DNA, 19 bp, Homo sapiens
aaaacatccacttaagttc

SEQ ID NO: 5067362 - DNA, 16 bp, Homo sapiens
aaaacatcccaaactt

SEQ ID NO: 5067363 - DNA, 16 bp, Homo sapiens
aaaacatctagcccaa

SEQ ID NO: 5067364 - DNA, 24 bp, Homo sapiens
aaaacatctttgaaattatgtaaa

SEQ ID NO: 5067365 - DNA, 21 bp, Homo sapiens
aaaacatgagaaatgtgaact

SEQ ID NO: 5067366 - DNA, 15 bp, Homo sapiens
aaaacatgagttatt

SEQ ID NO: 5067367 - DNA, 23 bp, Homo sapiens
aaaacatgcagaacaaatgaaga

SEQ ID NO: 5067368 - DNA, 13 bp, Homo sapiens
aaaacatgctaca

SEQ ID NO: 5067369 - DNA, 15 bp, Homo sapiens
aaaacatgctacaca

SEQ ID NO: 5067370 - DNA, 13 bp, Homo sapiens
aaaacatgctgtt

SEQ ID NO: 5067371 - DNA, 21 bp, Homo sapiens
aaaacatgcttgaataactga

SEQ ID NO: 5067372 - DNA, 16 bp, Homo sapiens
aaaacatgcttttcca

SEQ ID NO: 5067373 - DNA, 20 bp, Homo sapiens
aaaacatggcaataaatggc

SEQ ID NO: 5067374 - DNA, 16 bp, Homo sapiens
aaaacatgtaatattt

SEQ ID NO: 5067375 - DNA, 19 bp, Homo sapiens
aaaacatgtatgtttgctc

SEQ ID NO: 5067376 - DNA, 14 bp, Homo sapiens
aaaacatgtcatgt

SEQ ID NO: 5067377 - DNA, 13 bp, Homo sapiens
aaaacatgttgaa

SEQ ID NO: 5067378 - DNA, 15 bp, Homo sapiens
aaaacatgtttctgc

SEQ ID NO: 5067379 - DNA, 15 bp, Homo sapiens
aaaacattaagaaaa

SEQ ID NO: 5067380 - DNA, 23 bp, Homo sapiens
aaaacattaagaaaatcatattg

SEQ ID NO: 5067381 - DNA, 23 bp, Homo sapiens
aaaacattagaagaaaacatata

SEQ ID NO: 5067382 - DNA, 15 bp, Homo sapiens
aaaacattcagagga

SEQ ID NO: 5067383 - DNA, 12 bp, Homo sapiens
aaaacattcatg

SEQ ID NO: 5067384 - DNA, 13 bp, Homo sapiens
aaaacattcatgt

SEQ ID NO: 5067385 - DNA, 12 bp, Homo sapiens
aaaacattctat

SEQ ID NO: 5067386 - DNA, 20 bp, Homo sapiens
aaaacattgaagagagagct

SEQ ID NO: 5067387 - DNA, 22 bp, Homo sapiens
aaaacattgaagagagagctga

SEQ ID NO: 5067388 - DNA, 23 bp, Homo sapiens
aaaacattgcaaatttattttat

SEQ ID NO: 5067389 - DNA, 17 bp, Homo sapiens
aaaacattgcttttgaa

SEQ ID NO: 5067390 - DNA, 22 bp, Homo sapiens
aaaacattgtccccaatgaata

SEQ ID NO: 5067391 - DNA, 13 bp, Homo sapiens
aaaacattgttcc

SEQ ID NO: 5067392 - DNA, 13 bp, Homo sapiens
aaaacatttacat

SEQ ID NO: 5067393 - DNA, 17 bp, Homo sapiens
aaaacatttactgacca

SEQ ID NO: 5067394 - DNA, 13 bp, Homo sapiens
aaaacatttatga

SEQ ID NO: 5067395 - DNA, 12 bp, Homo sapiens
aaaacatttatt

SEQ ID NO: 5067396 - DNA, 16 bp, Homo sapiens
aaaacatttattttga

SEQ ID NO: 5067397 - DNA, 15 bp, Homo sapiens
aaaacatttcaaagc

SEQ ID NO: 5067398 - DNA, 12 bp, Homo sapiens
aaaacatttcat

SEQ ID NO: 5067399 - DNA, 13 bp, Homo sapiens
aaaacatttgctg

SEQ ID NO: 5067400 - DNA, 11 bp, Homo sapiens
aaaacatttgt

SEQ ID NO: 5067401 - DNA, 13 bp, Homo sapiens
aaaacatttgtac

SEQ ID NO: 5067402 - DNA, 15 bp, Homo sapiens
aaaacatttgtacat

SEQ ID NO: 5067403 - DNA, 13 bp, Homo sapiens
aaaacatttgtca

SEQ ID NO: 5067404 - DNA, 18 bp, Homo sapiens
aaaacattttaaaatcaa

SEQ ID NO: 5067405 - DNA, 16 bp, Homo sapiens
aaaacattttaaatga

SEQ ID NO: 5067406 - DNA, 12 bp, Homo sapiens
aaaacattttac

SEQ ID NO: 5067407 - DNA, 15 bp, Homo sapiens
aaaacattttgaagt

SEQ ID NO: 5067408 - DNA, 13 bp, Homo sapiens
aaaacatttttaa

SEQ ID NO: 5067409 - DNA, 20 bp, Homo sapiens
aaaacatttttaatttaaca

SEQ ID NO: 5067410 - DNA, 21 bp, Homo sapiens
aaaacattttttaatagaata

SEQ ID NO: 5067411 - DNA, 18 bp, Homo sapiens
aaaacattttttatacat

SEQ ID NO: 5067412 - DNA, 20 bp, Homo sapiens
aaaacattttttatacattt

SEQ ID NO: 5067413 - DNA, 15 bp, Homo sapiens
aaaacatttttttaa

SEQ ID NO: 5067414 - DNA, 17 bp, Homo sapiens
aaaaccaaacacccaga

SEQ ID NO: 5067415 - DNA, 21 bp, Homo sapiens
aaaaccaacaggtttatctga

SEQ ID NO: 5067416 - DNA, 14 bp, Homo sapiens
aaaaccaatcaata

SEQ ID NO: 5067417 - DNA, 19 bp, Homo sapiens
aaaaccaatgttttgcagt

SEQ ID NO: 5067418 - DNA, 14 bp, Homo sapiens
aaaaccacaaaggc

SEQ ID NO: 5067419 - DNA, 12 bp, Homo sapiens
aaaaccacacaa

SEQ ID NO: 5067420 - DNA, 16 bp, Homo sapiens
aaaaccacagctgggc

SEQ ID NO: 5067421 - DNA, 18 bp, Homo sapiens
aaaaccacagctgggcag

SEQ ID NO: 5067422 - DNA, 20 bp, Homo sapiens
aaaaccacatggcacagaga

SEQ ID NO: 5067423 - DNA, 15 bp, Homo sapiens
aaaaccacatgggct

SEQ ID NO: 5067424 - DNA, 18 bp, Homo sapiens
aaaaccaccaaaaacaaa

SEQ ID NO: 5067425 - DNA, 18 bp, Homo sapiens
aaaaccactgaacatttg

SEQ ID NO: 5067426 - DNA, 12 bp, Homo sapiens
aaaaccagagag

SEQ ID NO: 5067427 - DNA, 13 bp, Homo sapiens
aaaaccagagcct

SEQ ID NO: 5067428 - DNA, 17 bp, Homo sapiens
aaaaccagagggcagtc

SEQ ID NO: 5067429 - DNA, 22 bp, Homo sapiens
aaaaccagctgctactcataag

SEQ ID NO: 5067430 - DNA, 12 bp, Homo sapiens
aaaaccaggcct

SEQ ID NO: 5067431 - DNA, 16 bp, Homo sapiens
aaaaccaggctttcta

SEQ ID NO: 5067432 - DNA, 18 bp, Homo sapiens
aaaaccataaaataaatt

SEQ ID NO: 5067433 - DNA, 19 bp, Homo sapiens
aaaaccataaaataaattt

SEQ ID NO: 5067434 - DNA, 20 bp, Homo sapiens
aaaaccatcaaaaatattcc

SEQ ID NO: 5067435 - DNA, 15 bp, Homo sapiens
aaaaccatctctctt

SEQ ID NO: 5067436 - DNA, 15 bp, Homo sapiens
aaaaccatgcagctt

SEQ ID NO: 5067437 - DNA, 20 bp, Homo sapiens
aaaaccatgcagcttcatca

SEQ ID NO: 5067438 - DNA, 20 bp, Homo sapiens
aaaaccatgcctggtatttt

SEQ ID NO: 5067439 - DNA, 19 bp, Homo sapiens
aaaaccattatttaataag

SEQ ID NO: 5067440 - DNA, 14 bp, Homo sapiens
aaaaccattctaaa

SEQ ID NO: 5067441 - DNA, 13 bp, Homo sapiens
aaaaccattgctt

SEQ ID NO: 5067442 - DNA, 15 bp, Homo sapiens
aaaaccattggggag

SEQ ID NO: 5067443 - DNA, 22 bp, Homo sapiens
aaaacccaaatggctagaacgt

SEQ ID NO: 5067444 - DNA, 12 bp, Homo sapiens
aaaacccaagtg

SEQ ID NO: 5067445 - DNA, 20 bp, Homo sapiens
aaaacccaatacttttgtcc

SEQ ID NO: 5067446 - DNA, 21 bp, Homo sapiens
aaaacccacaaaaatgttgaa

SEQ ID NO: 5067447 - DNA, 13 bp, Homo sapiens
aaaacccagagag

SEQ ID NO: 5067448 - DNA, 21 bp, Homo sapiens
aaaacccagcaacagaaaaat

SEQ ID NO: 5067449 - DNA, 21 bp, Homo sapiens
aaaaccccagctattttctga

SEQ ID NO: 5067450 - DNA, 17 bp, Homo sapiens
aaaaccccccagatatc

SEQ ID NO: 5067451 - DNA, 20 bp, Homo sapiens
aaaaccccccagatatcatc

SEQ ID NO: 5067452 - DNA, 12 bp, Homo sapiens
aaaacccctggc

SEQ ID NO: 5067453 - DNA, 19 bp, Homo sapiens
aaaacccgagggacagcag

SEQ ID NO: 5067454 - DNA, 22 bp, Homo sapiens
aaaaccctaagtgtggatgttc

SEQ ID NO: 5067455 - DNA, 21 bp, Homo sapiens
aaaaccctaattttgtacata

SEQ ID NO: 5067456 - DNA, 21 bp, Homo sapiens
aaaaccctatatgcttactgt

SEQ ID NO: 5067457 - DNA, 15 bp, Homo sapiens
aaaaccctcaagggc

SEQ ID NO: 5067458 - DNA, 21 bp, Homo sapiens
aaaaccctcagcactgttaca

SEQ ID NO: 5067459 - DNA, 18 bp, Homo sapiens
aaaaccctgctttttgac

SEQ ID NO: 5067460 - DNA, 14 bp, Homo sapiens
aaaaccgaataaat

SEQ ID NO: 5067461 - DNA, 21 bp, Homo sapiens
aaaaccgtgtttgtctcttct

SEQ ID NO: 5067462 - DNA, 15 bp, Homo sapiens
aaaacctacatattc

SEQ ID NO: 5067463 - DNA, 20 bp, Homo sapiens
aaaacctacgcacatacctt

SEQ ID NO: 5067464 - DNA, 18 bp, Homo sapiens
aaaacctattttgaaagg

SEQ ID NO: 5067465 - DNA, 18 bp, Homo sapiens
aaaacctatttttccttt

SEQ ID NO: 5067466 - DNA, 23 bp, Homo sapiens
aaaacctcagttggcctctgccc

SEQ ID NO: 5067467 - DNA, 20 bp, Homo sapiens
aaaacctcatgacagccaga

SEQ ID NO: 5067468 - DNA, 21 bp, Homo sapiens
aaaacctcatgacagccagag

SEQ ID NO: 5067469 - DNA, 20 bp, Homo sapiens
aaaacctccagtagtggaca

SEQ ID NO: 5067470 - DNA, 19 bp, Homo sapiens
aaaacctgcttccttcagt

SEQ ID NO: 5067471 - DNA, 18 bp, Homo sapiens
aaaacctgggattatata

SEQ ID NO: 5067472 - DNA, 22 bp, Homo sapiens
aaaacctgggtatgttcctaag

SEQ ID NO: 5067473 - DNA, 11 bp, Homo sapiens
aaaacctgttc

SEQ ID NO: 5067474 - DNA, 22 bp, Homo sapiens
aaaaccttaaaagtaataaaga

SEQ ID NO: 5067475 - DNA, 17 bp, Homo sapiens
aaaaccttgtgtaagag

SEQ ID NO: 5067476 - DNA, 13 bp, Homo sapiens
aaaacctttcaaa

SEQ ID NO: 5067477 - DNA, 20 bp, Homo sapiens
aaaacctttccccagacaca

SEQ ID NO: 5067478 - DNA, 13 bp, Homo sapiens
aaaaccttttact

SEQ ID NO: 5067479 - DNA, 19 bp, Homo sapiens
aaaaccttttttcttgcta

SEQ ID NO: 5067480 - DNA, 13 bp, Homo sapiens
aaaacgaaaacag

SEQ ID NO: 5067481 - DNA, 20 bp, Homo sapiens
aaaacgaaaataaagtagct

SEQ ID NO: 5067482 - DNA, 21 bp, Homo sapiens
aaaacgaagctcattcccaac

SEQ ID NO: 5067483 - DNA, 16 bp, Homo sapiens
aaaacgatttaattta

SEQ ID NO: 5067484 - DNA, 17 bp, Homo sapiens
aaaacgcatggagtgtg

SEQ ID NO: 5067485 - DNA, 15 bp, Homo sapiens
aaaacgcgcagatgt

SEQ ID NO: 5067486 - DNA, 17 bp, Homo sapiens
aaaacgcgtctgcctgg

SEQ ID NO: 5067487 - DNA, 23 bp, Homo sapiens
aaaacgggcagtctgctctgctg

SEQ ID NO: 5067488 - DNA, 14 bp, Homo sapiens
aaaacgtgatgttt

SEQ ID NO: 5067489 - DNA, 21 bp, Homo sapiens
aaaacgtggcacacactgacc

SEQ ID NO: 5067490 - DNA, 17 bp, Homo sapiens
aaaacgtggctgcttca

SEQ ID NO: 5067491 - DNA, 18 bp, Homo sapiens
aaaacgtggctgcttcaa

SEQ ID NO: 5067492 - DNA, 21 bp, Homo sapiens
aaaacgtgggtatttcctgct

SEQ ID NO: 5067493 - DNA, 15 bp, Homo sapiens
aaaacgtgtaaatga

SEQ ID NO: 5067494 - DNA, 16 bp, Homo sapiens
aaaacgtttcaaagca

SEQ ID NO: 5067495 - DNA, 22 bp, Homo sapiens
aaaacgttttatgtgaatgtgg

SEQ ID NO: 5067496 - DNA, 15 bp, Homo sapiens
aaaacgttttattgt

SEQ ID NO: 5067497 - DNA, 15 bp, Homo sapiens
aaaactaaaattcaa

SEQ ID NO: 5067498 - DNA, 21 bp, Homo sapiens
aaaactaaactacagaaacct

SEQ ID NO: 5067499 - DNA, 19 bp, Homo sapiens
aaaactaaagcagttttta

SEQ ID NO: 5067500 - DNA, 17 bp, Homo sapiens
aaaactaaagttgaaaa

SEQ ID NO: 5067501 - DNA, 19 bp, Homo sapiens
aaaactaaatctctaatat

SEQ ID NO: 5067502 - DNA, 18 bp, Homo sapiens
aaaactaaatgtgtacac

SEQ ID NO: 5067503 - DNA, 17 bp, Homo sapiens
aaaactaaggcatttga

SEQ ID NO: 5067504 - DNA, 23 bp, Homo sapiens
aaaactaaggcttttatttctgt

SEQ ID NO: 5067505 - DNA, 13 bp, Homo sapiens
aaaactaatctaa

SEQ ID NO: 5067506 - DNA, 14 bp, Homo sapiens
aaaactaatctaaa

SEQ ID NO: 5067507 - DNA, 19 bp, Homo sapiens
aaaactaatgtactgtaca

SEQ ID NO: 5067508 - DNA, 20 bp, Homo sapiens
aaaactaatgtactgtacat

SEQ ID NO: 5067509 - DNA, 14 bp, Homo sapiens
aaaactaatttcat

SEQ ID NO: 5067510 - DNA, 21 bp, Homo sapiens
aaaactacaaatcaagtattt

SEQ ID NO: 5067511 - DNA, 22 bp, Homo sapiens
aaaactacaaccaatggaatgt

SEQ ID NO: 5067512 - DNA, 18 bp, Homo sapiens
aaaactacattttaacat

SEQ ID NO: 5067513 - DNA, 17 bp, Homo sapiens
aaaactacctgtgagca

SEQ ID NO: 5067514 - DNA, 19 bp, Homo sapiens
aaaactactgaataaatca

SEQ ID NO: 5067515 - DNA, 11 bp, Homo sapiens
aaaactactgc

SEQ ID NO: 5067516 - DNA, 20 bp, Homo sapiens
aaaactactgttaacactgc

SEQ ID NO: 5067517 - DNA, 17 bp, Homo sapiens
aaaactacttagcactt

SEQ ID NO: 5067518 - DNA, 17 bp, Homo sapiens
aaaactacttctttttt

SEQ ID NO: 5067519 - DNA, 11 bp, Homo sapiens
aaaactacttt

SEQ ID NO: 5067520 - DNA, 22 bp, Homo sapiens
aaaactagaggtgagaaattta

SEQ ID NO: 5067521 - DNA, 21 bp, Homo sapiens
aaaactagataacttaaataa

SEQ ID NO: 5067522 - DNA, 16 bp, Homo sapiens
aaaactaggtgctgca

SEQ ID NO: 5067523 - DNA, 14 bp, Homo sapiens
aaaactataaaaaa

SEQ ID NO: 5067524 - DNA, 12 bp, Homo sapiens
aaaactatacaa

SEQ ID NO: 5067525 - DNA, 20 bp, Homo sapiens
aaaactatacttgaacaaaa

SEQ ID NO: 5067526 - DNA, 19 bp, Homo sapiens
aaaactatcggttcaagtt

SEQ ID NO: 5067527 - DNA, 13 bp, Homo sapiens
aaaactatgtatt

SEQ ID NO: 5067528 - DNA, 21 bp, Homo sapiens
aaaactatgtattaatttaga

SEQ ID NO: 5067529 - DNA, 23 bp, Homo sapiens
aaaactatgtgttcaatgaaata

SEQ ID NO: 5067530 - DNA, 17 bp, Homo sapiens
aaaactatttaaaattg

SEQ ID NO: 5067531 - DNA, 14 bp, Homo sapiens
aaaactatttttgt

SEQ ID NO: 5067532 - DNA, 13 bp, Homo sapiens
aaaactcaaagaa

SEQ ID NO: 5067533 - DNA, 18 bp, Homo sapiens
aaaactcaacattactgt

SEQ ID NO: 5067534 - DNA, 13 bp, Homo sapiens
aaaactcaccatt

SEQ ID NO: 5067535 - DNA, 15 bp, Homo sapiens
aaaactcaccatttc

SEQ ID NO: 5067536 - DNA, 17 bp, Homo sapiens
aaaactcaccatttcat

SEQ ID NO: 5067537 - DNA, 20 bp, Homo sapiens
aaaactcagatttaaaacaa

SEQ ID NO: 5067538 - DNA, 19 bp, Homo sapiens
aaaactcagcctgggacag

SEQ ID NO: 5067539 - DNA, 21 bp, Homo sapiens
aaaactcagtctcaaataata

SEQ ID NO: 5067540 - DNA, 22 bp, Homo sapiens
aaaactcagtctcaaataataa

SEQ ID NO: 5067541 - DNA, 18 bp, Homo sapiens
aaaactcagttaaaatgt

SEQ ID NO: 5067542 - DNA, 16 bp, Homo sapiens
aaaactccaccttccc

SEQ ID NO: 5067543 - DNA, 17 bp, Homo sapiens
aaaactccaccttccca

SEQ ID NO: 5067544 - DNA, 17 bp, Homo sapiens
aaaactcccaatacaaa

SEQ ID NO: 5067545 - DNA, 22 bp, Homo sapiens
aaaactcccaatacaaagatga

SEQ ID NO: 5067546 - DNA, 16 bp, Homo sapiens
aaaactcccatttacg

SEQ ID NO: 5067547 - DNA, 23 bp, Homo sapiens
aaaactcccttccttatgcatac

SEQ ID NO: 5067548 - DNA, 22 bp, Homo sapiens
aaaactcctgtgtcggtcagaa

SEQ ID NO: 5067549 - DNA, 13 bp, Homo sapiens
aaaactctacaga

SEQ ID NO: 5067550 - DNA, 19 bp, Homo sapiens
aaaactctacttaatccaa

SEQ ID NO: 5067551 - DNA, 14 bp, Homo sapiens
aaaactctctccca

SEQ ID NO: 5067552 - DNA, 13 bp, Homo sapiens
aaaactctgggtc

SEQ ID NO: 5067553 - DNA, 15 bp, Homo sapiens
aaaactcttggcctc

SEQ ID NO: 5067554 - DNA, 12 bp, Homo sapiens
aaaactctttga

SEQ ID NO: 5067555 - DNA, 13 bp, Homo sapiens
aaaactgaaaaat

SEQ ID NO: 5067556 - DNA, 19 bp, Homo sapiens
aaaactgaaaatctaatat

SEQ ID NO: 5067557 - DNA, 23 bp, Homo sapiens
aaaactgaaagtgaaagtccaga

SEQ ID NO: 5067558 - DNA, 13 bp, Homo sapiens
aaaactgaaataa

SEQ ID NO: 5067559 - DNA, 21 bp, Homo sapiens
aaaactgaacttgaagctaac

SEQ ID NO: 5067560 - DNA, 16 bp, Homo sapiens
aaaactgaagaatttt

SEQ ID NO: 5067561 - DNA, 15 bp, Homo sapiens
aaaactgaagctttt

SEQ ID NO: 5067562 - DNA, 17 bp, Homo sapiens
aaaactgaagcttttta

SEQ ID NO: 5067563 - DNA, 12 bp, Homo sapiens
aaaactgaaggt

SEQ ID NO: 5067564 - DNA, 23 bp, Homo sapiens
aaaactgaaggttttttttttaa

SEQ ID NO: 5067565 - DNA, 18 bp, Homo sapiens
aaaactgaagtctgaaat

SEQ ID NO: 5067566 - DNA, 15 bp, Homo sapiens
aaaactgacatcaga

SEQ ID NO: 5067567 - DNA, 17 bp, Homo sapiens
aaaactgacatcagatt

SEQ ID NO: 5067568 - DNA, 22 bp, Homo sapiens
aaaactgacatcagatttctta

SEQ ID NO: 5067569 - DNA, 16 bp, Homo sapiens
aaaactgactccttag

SEQ ID NO: 5067570 - DNA, 14 bp, Homo sapiens
aaaactgagtccat

SEQ ID NO: 5067571 - DNA, 15 bp, Homo sapiens
aaaactgatcaaaaa

SEQ ID NO: 5067572 - DNA, 21 bp, Homo sapiens
aaaactgatcaaaaataaact

SEQ ID NO: 5067573 - DNA, 23 bp, Homo sapiens
aaaactgatcaaaaataaactag

SEQ ID NO: 5067574 - DNA, 21 bp, Homo sapiens
aaaactgatgttactagcctc

SEQ ID NO: 5067575 - DNA, 18 bp, Homo sapiens
aaaactgatttttttttc

SEQ ID NO: 5067576 - DNA, 22 bp, Homo sapiens
aaaactgatttttttttccttc

SEQ ID NO: 5067577 - DNA, 23 bp, Homo sapiens
aaaactgcagtcatcaacaatga

SEQ ID NO: 5067578 - DNA, 18 bp, Homo sapiens
aaaactgcagtttgatca

SEQ ID NO: 5067579 - DNA, 19 bp, Homo sapiens
aaaactgcatttttaatca

SEQ ID NO: 5067580 - DNA, 11 bp, Homo sapiens
aaaactgcctg

SEQ ID NO: 5067581 - DNA, 22 bp, Homo sapiens
aaaactgcgaggacatcaaagt

SEQ ID NO: 5067582 - DNA, 11 bp, Homo sapiens
aaaactgctcc

SEQ ID NO: 5067583 - DNA, 22 bp, Homo sapiens
aaaactgctcctcctcctgtat

SEQ ID NO: 5067584 - DNA, 20 bp, Homo sapiens
aaaactgctgactgttttct

SEQ ID NO: 5067585 - DNA, 22 bp, Homo sapiens
aaaactgctgactgttttctct

SEQ ID NO: 5067586 - DNA, 17 bp, Homo sapiens
aaaactgctttgtgcat

SEQ ID NO: 5067587 - DNA, 19 bp, Homo sapiens
aaaactgctttgtgcatat

SEQ ID NO: 5067588 - DNA, 12 bp, Homo sapiens
aaaactgctttt

SEQ ID NO: 5067589 - DNA, 23 bp, Homo sapiens
aaaactgcttttttttttccagc

SEQ ID NO: 5067590 - DNA, 12 bp, Homo sapiens
aaaactggaaat

SEQ ID NO: 5067591 - DNA, 17 bp, Homo sapiens
aaaactggaataagaag

SEQ ID NO: 5067592 - DNA, 21 bp, Homo sapiens
aaaactggaataagaagcaaa

SEQ ID NO: 5067593 - DNA, 21 bp, Homo sapiens
aaaactggcaacattccaaga

SEQ ID NO: 5067594 - DNA, 13 bp, Homo sapiens
aaaactggcctga

SEQ ID NO: 5067595 - DNA, 12 bp, Homo sapiens
aaaactgggata

SEQ ID NO: 5067596 - DNA, 16 bp, Homo sapiens
aaaactgggataactg

SEQ ID NO: 5067597 - DNA, 20 bp, Homo sapiens
aaaactgggataactgattt

SEQ ID NO: 5067598 - DNA, 23 bp, Homo sapiens
aaaactggtgcaattacagcaaa

SEQ ID NO: 5067599 - DNA, 12 bp, Homo sapiens
aaaactgtaaat

SEQ ID NO: 5067600 - DNA, 21 bp, Homo sapiens
aaaactgtaaataaaatgtgt

SEQ ID NO: 5067601 - DNA, 22 bp, Homo sapiens
aaaactgtaaataaaatgtgta

SEQ ID NO: 5067602 - DNA, 18 bp, Homo sapiens
aaaactgtaaatacaaaa

SEQ ID NO: 5067603 - DNA, 16 bp, Homo sapiens
aaaactgtaccttttg

SEQ ID NO: 5067604 - DNA, 21 bp, Homo sapiens
aaaactgtactttgattcaca

SEQ ID NO: 5067605 - DNA, 17 bp, Homo sapiens
aaaactgtataaggaga

SEQ ID NO: 5067606 - DNA, 14 bp, Homo sapiens
aaaactgtatttaa

SEQ ID NO: 5067607 - DNA, 12 bp, Homo sapiens
aaaactgtgaca

SEQ ID NO: 5067608 - DNA, 17 bp, Homo sapiens
aaaactgtgaccaagta

SEQ ID NO: 5067609 - DNA, 19 bp, Homo sapiens
aaaactgtgaccaagtata

SEQ ID NO: 5067610 - DNA, 21 bp, Homo sapiens
aaaactgtgatttttatcaca

SEQ ID NO: 5067611 - DNA, 15 bp, Homo sapiens
aaaactgtgcatctc

SEQ ID NO: 5067612 - DNA, 13 bp, Homo sapiens
aaaactgtgtaaa

SEQ ID NO: 5067613 - DNA, 12 bp, Homo sapiens
aaaactgtgtat

SEQ ID NO: 5067614 - DNA, 17 bp, Homo sapiens
aaaactgtgtatcatta

SEQ ID NO: 5067615 - DNA, 17 bp, Homo sapiens
aaaactgtgttgccaca

SEQ ID NO: 5067616 - DNA, 16 bp, Homo sapiens
aaaactgttacctaaa

SEQ ID NO: 5067617 - DNA, 14 bp, Homo sapiens
aaaactgttgtcac

SEQ ID NO: 5067618 - DNA, 19 bp, Homo sapiens
aaaactgtttttgaacctg

SEQ ID NO: 5067619 - DNA, 15 bp, Homo sapiens
aaaacttaaagcaaa

SEQ ID NO: 5067620 - DNA, 16 bp, Homo sapiens
aaaacttaaagcaaaa

SEQ ID NO: 5067621 - DNA, 19 bp, Homo sapiens
aaaacttaaagcaaaatag

SEQ ID NO: 5067622 - DNA, 24 bp, Homo sapiens
aaaacttaaagcaaaatagtattg

SEQ ID NO: 5067623 - DNA, 16 bp, Homo sapiens
aaaacttaaatattgt

SEQ ID NO: 5067624 - DNA, 19 bp, Homo sapiens
aaaacttaacatatttact

SEQ ID NO: 5067625 - DNA, 21 bp, Homo sapiens
aaaacttaacttccaatgaaa

SEQ ID NO: 5067626 - DNA, 13 bp, Homo sapiens
aaaacttattaac

SEQ ID NO: 5067627 - DNA, 21 bp, Homo sapiens
aaaacttattaacaactgtga

SEQ ID NO: 5067628 - DNA, 11 bp, Homo sapiens
aaaacttattt

SEQ ID NO: 5067629 - DNA, 15 bp, Homo sapiens
aaaacttatttgagt

SEQ ID NO: 5067630 - DNA, 17 bp, Homo sapiens
aaaacttcaaaaactaa

SEQ ID NO: 5067631 - DNA, 14 bp, Homo sapiens
aaaacttcaaagct

SEQ ID NO: 5067632 - DNA, 21 bp, Homo sapiens
aaaacttcaaggaaaataagt

SEQ ID NO: 5067633 - DNA, 15 bp, Homo sapiens
aaaacttcactccaa

SEQ ID NO: 5067634 - DNA, 15 bp, Homo sapiens
aaaacttcagacata

SEQ ID NO: 5067635 - DNA, 9 bp, Homo sapiens
aaaacttcc

SEQ ID NO: 5067636 - DNA, 13 bp, Homo sapiens
aaaacttccacta

SEQ ID NO: 5067637 - DNA, 18 bp, Homo sapiens
aaaacttctattatccag

SEQ ID NO: 5067638 - DNA, 16 bp, Homo sapiens
aaaacttctcatttat

SEQ ID NO: 5067639 - DNA, 15 bp, Homo sapiens
aaaacttctgctcgt

SEQ ID NO: 5067640 - DNA, 10 bp, Homo sapiens
aaaacttctt

SEQ ID NO: 5067641 - DNA, 22 bp, Homo sapiens
aaaacttcttgtcagacataaa

SEQ ID NO: 5067642 - DNA, 12 bp, Homo sapiens
aaaacttctttt

SEQ ID NO: 5067643 - DNA, 22 bp, Homo sapiens
aaaacttgaatctgttactgaa

SEQ ID NO: 5067644 - DNA, 13 bp, Homo sapiens
aaaacttggcact

SEQ ID NO: 5067645 - DNA, 15 bp, Homo sapiens
aaaacttggcacttt

SEQ ID NO: 5067646 - DNA, 21 bp, Homo sapiens
aaaacttgggcaccagcttct

SEQ ID NO: 5067647 - DNA, 13 bp, Homo sapiens
aaaaaaaaaatgt

SEQ ID NO: 5067648 - DNA, 13 bp, Homo sapiens
aaaaaaaaacaca

SEQ ID NO: 5067649 - DNA, 12 bp, Homo sapiens
aaaaaaaaactc

SEQ ID NO: 5067650 - DNA, 13 bp, Homo sapiens
aaaaaaaaagaaa

SEQ ID NO: 5067651 - DNA, 12 bp, Homo sapiens
aaaaaaaaagca

SEQ ID NO: 5067652 - DNA, 12 bp, Homo sapiens
aaaaaaaaagtt

SEQ ID NO: 5067653 - DNA, 12 bp, Homo sapiens
aaaaaaaaatca

SEQ ID NO: 5067654 - DNA, 12 bp, Homo sapiens
aaaaaaaaatgc

SEQ ID NO: 5067655 - DNA, 12 bp, Homo sapiens
aaaaaaaagaat

SEQ ID NO: 5067656 - DNA, 11 bp, Homo sapiens
aaaaaaaagag

SEQ ID NO: 5067657 - DNA, 11 bp, Homo sapiens
aaaaaaaagct

SEQ ID NO: 5067658 - DNA, 11 bp, Homo sapiens
aaaaaaaagtt

SEQ ID NO: 5067659 - DNA, 13 bp, Homo sapiens
aaaaaaaagttgt

SEQ ID NO: 5067660 - DNA, 13 bp, Homo sapiens
aaaaaaaatgcca

SEQ ID NO: 5067661 - DNA, 11 bp, Homo sapiens
aaaaaaaatgt

SEQ ID NO: 5067662 - DNA, 11 bp, Homo sapiens
aaaaaaacaat

SEQ ID NO: 5067663 - DNA, 13 bp, Homo sapiens
aaaaaaacataaa

SEQ ID NO: 5067664 - DNA, 19 bp, Homo sapiens
aaaaaaacctgagatttat

SEQ ID NO: 5067665 - DNA, 11 bp, Homo sapiens
aaaaaaactac

SEQ ID NO: 5067666 - DNA, 13 bp, Homo sapiens
aaaaaaactgaag

SEQ ID NO: 5067667 - DNA, 11 bp, Homo sapiens
aaaaaaacttt

SEQ ID NO: 5067668 - DNA, 13 bp, Homo sapiens
aaaaaaactttta

SEQ ID NO: 5067669 - DNA, 13 bp, Homo sapiens
aaaaaaagactgt

SEQ ID NO: 5067670 - DNA, 11 bp, Homo sapiens
aaaaaaagcaa

SEQ ID NO: 5067671 - DNA, 12 bp, Homo sapiens
aaaaaaagtgtc

SEQ ID NO: 5067672 - DNA, 11 bp, Homo sapiens
aaaaaaatagt

SEQ ID NO: 5067673 - DNA, 14 bp, Homo sapiens
aaaaaaatatgaga

SEQ ID NO: 5067674 - DNA, 13 bp, Homo sapiens
aaaaaaatctaaa

SEQ ID NO: 5067675 - DNA, 12 bp, Homo sapiens
aaaaaaatgaaa

SEQ ID NO: 5067676 - DNA, 13 bp, Homo sapiens
aaaaaaatgaata

SEQ ID NO: 5067677 - DNA, 11 bp, Homo sapiens
aaaaaaatgat

SEQ ID NO: 5067678 - DNA, 13 bp, Homo sapiens
aaaaaaattctgt

SEQ ID NO: 5067679 - DNA, 12 bp, Homo sapiens
aaaaaaattttt

SEQ ID NO: 5067680 - DNA, 13 bp, Homo sapiens
aaaaaaattttta

SEQ ID NO: 5067681 - DNA, 11 bp, Homo sapiens
aaaaaacaaaa

SEQ ID NO: 5067682 - DNA, 10 bp, Homo sapiens
aaaaaacaag

SEQ ID NO: 5067683 - DNA, 21 bp, Homo sapiens
aaaaaacacttggcatacaaa

SEQ ID NO: 5067684 - DNA, 13 bp, Homo sapiens
aaaaaacagaaaa

SEQ ID NO: 5067685 - DNA, 20 bp, Homo sapiens
aaaaaacagaaaaacagaca

SEQ ID NO: 5067686 - DNA, 13 bp, Homo sapiens
aaaaaacatttgt

SEQ ID NO: 5067687 - DNA, 17 bp, Homo sapiens
aaaaaaccctatatgct

SEQ ID NO: 5067688 - DNA, 17 bp, Homo sapiens
aaaaaactaaggcattt

SEQ ID NO: 5067689 - DNA, 12 bp, Homo sapiens
aaaaaactagac

SEQ ID NO: 5067690 - DNA, 15 bp, Homo sapiens
aaaaaactctttggt

SEQ ID NO: 5067691 - DNA, 12 bp, Homo sapiens
aaaaaactgaag

SEQ ID NO: 5067692 - DNA, 13 bp, Homo sapiens
aaaaaactgaagg

SEQ ID NO: 5067693 - DNA, 12 bp, Homo sapiens
aaaaaagaaaaa

SEQ ID NO: 5067694 - DNA, 12 bp, Homo sapiens
aaaaaagaaaat

SEQ ID NO: 5067695 - DNA, 11 bp, Homo sapiens
aaaaaagaaag

SEQ ID NO: 5067696 - DNA, 12 bp, Homo sapiens
aaaaaagaaaga

SEQ ID NO: 5067697 - DNA, 12 bp, Homo sapiens
aaaaaagaaagt

SEQ ID NO: 5067698 - DNA, 12 bp, Homo sapiens
aaaaaagaaatc

SEQ ID NO: 5067699 - DNA, 14 bp, Homo sapiens
aaaaaagaaatgaa

SEQ ID NO: 5067700 - DNA, 12 bp, Homo sapiens
aaaaaagaaatt

SEQ ID NO: 5067701 - DNA, 11 bp, Homo sapiens
aaaaaagaacc

SEQ ID NO: 5067702 - DNA, 12 bp, Homo sapiens
aaaaaagaagtt

SEQ ID NO: 5067703 - DNA, 18 bp, Homo sapiens
aaaaaagaataatgaccc

SEQ ID NO: 5067704 - DNA, 21 bp, Homo sapiens
aaaaaagagaaaaaccaatga

SEQ ID NO: 5067705 - DNA, 12 bp, Homo sapiens
aaaaaagagaca

SEQ ID NO: 5067706 - DNA, 12 bp, Homo sapiens
aaaaaagatttt

SEQ ID NO: 5067707 - DNA, 14 bp, Homo sapiens
aaaaaagcaacagt

SEQ ID NO: 5067708 - DNA, 21 bp, Homo sapiens
aaaaaagcacaaagttctcag

SEQ ID NO: 5067709 - DNA, 12 bp, Homo sapiens
aaaaaagcctcc

SEQ ID NO: 5067710 - DNA, 13 bp, Homo sapiens
aaaaaagctgaat

SEQ ID NO: 5067711 - DNA, 11 bp, Homo sapiens
aaaaaaggaaa

SEQ ID NO: 5067712 - DNA, 12 bp, Homo sapiens
aaaaaaggaagg

SEQ ID NO: 5067713 - DNA, 16 bp, Homo sapiens
aaaaaaggcattgttt

SEQ ID NO: 5067714 - DNA, 11 bp, Homo sapiens
aaaaaagtaat

SEQ ID NO: 5067715 - DNA, 22 bp, Homo sapiens
aaaaaagtcaccattctgcatt

SEQ ID NO: 5067716 - DNA, 12 bp, Homo sapiens
aaaaaagtcaga

SEQ ID NO: 5067717 - DNA, 13 bp, Homo sapiens
aaaaaagtcagag

SEQ ID NO: 5067718 - DNA, 14 bp, Homo sapiens
aaaaaagtccttca

SEQ ID NO: 5067719 - DNA, 13 bp, Homo sapiens
aaaaaagttataa

SEQ ID NO: 5067720 - DNA, 15 bp, Homo sapiens
aaaaaagttatatag

SEQ ID NO: 5067721 - DNA, 20 bp, Homo sapiens
aaaaaagttggtattttata

SEQ ID NO: 5067722 - DNA, 12 bp, Homo sapiens
aaaaaagttgtg

SEQ ID NO: 5067723 - DNA, 13 bp, Homo sapiens
aaaaaagttttta

SEQ ID NO: 5067724 - DNA, 16 bp, Homo sapiens
aaaaaataaaacattt

SEQ ID NO: 5067725 - DNA, 10 bp, Homo sapiens
aaaaaataca

SEQ ID NO: 5067726 - DNA, 13 bp, Homo sapiens
aaaaaatactatt

SEQ ID NO: 5067727 - DNA, 14 bp, Homo sapiens
aaaaaatactgcca

SEQ ID NO: 5067728 - DNA, 13 bp, Homo sapiens
aaaaaatacttgt

SEQ ID NO: 5067729 - DNA, 9 bp, Homo sapiens
aaaaaatag

SEQ ID NO: 5067730 - DNA, 16 bp, Homo sapiens
aaaaaatagacatgta

SEQ ID NO: 5067731 - DNA, 21 bp, Homo sapiens
aaaaaatagagagagaggtat

SEQ ID NO: 5067732 - DNA, 10 bp, Homo sapiens
aaaaaatata

SEQ ID NO: 5067733 - DNA, 19 bp, Homo sapiens
aaaaaatatagcctttaca

SEQ ID NO: 5067734 - DNA, 21 bp, Homo sapiens
aaaaaatatatgacagattat

SEQ ID NO: 5067735 - DNA, 14 bp, Homo sapiens
aaaaaatatatgta

SEQ ID NO: 5067736 - DNA, 12 bp, Homo sapiens
aaaaaatattaa

SEQ ID NO: 5067737 - DNA, 13 bp, Homo sapiens
aaaaaatattgaa

SEQ ID NO: 5067738 - DNA, 15 bp, Homo sapiens
aaaaaatctgcagaa

SEQ ID NO: 5067739 - DNA, 11 bp, Homo sapiens
aaaaaatcttc

SEQ ID NO: 5067740 - DNA, 19 bp, Homo sapiens
aaaaaatgaaatgttttaa

SEQ ID NO: 5067741 - DNA, 14 bp, Homo sapiens
aaaaaatgaacagt

SEQ ID NO: 5067742 - DNA, 18 bp, Homo sapiens
aaaaaatgagacttactg

SEQ ID NO: 5067743 - DNA, 21 bp, Homo sapiens
aaaaaatgatgcagctgttga

SEQ ID NO: 5067744 - DNA, 12 bp, Homo sapiens
aaaaaatggaaa

SEQ ID NO: 5067745 - DNA, 13 bp, Homo sapiens
aaaaaatgtaaca

SEQ ID NO: 5067746 - DNA, 12 bp, Homo sapiens
aaaaaatgtgaa

SEQ ID NO: 5067747 - DNA, 16 bp, Homo sapiens
aaaaaatgtgaaattt

SEQ ID NO: 5067748 - DNA, 11 bp, Homo sapiens
aaaaaatgttg

SEQ ID NO: 5067749 - DNA, 12 bp, Homo sapiens
aaaaaatgtttc

SEQ ID NO: 5067750 - DNA, 12 bp, Homo sapiens
aaaaaattaaaa

SEQ ID NO: 5067751 - DNA, 12 bp, Homo sapiens
aaaaaattgcac

SEQ ID NO: 5067752 - DNA, 13 bp, Homo sapiens
aaaaaattggcat

SEQ ID NO: 5067753 - DNA, 12 bp, Homo sapiens
aaaaaatttaaa

SEQ ID NO: 5067754 - DNA, 12 bp, Homo sapiens
aaaaaatttgta

SEQ ID NO: 5067755 - DNA, 12 bp, Homo sapiens
aaaaaatttgtt

SEQ ID NO: 5067756 - DNA, 21 bp, Homo sapiens
aaaaaatttgttttcaacaat

SEQ ID NO: 5067757 - DNA, 11 bp, Homo sapiens
aaaaaattttg

SEQ ID NO: 5067758 - DNA, 15 bp, Homo sapiens
aaaaacaaaaaaact

SEQ ID NO: 5067759 - DNA, 13 bp, Homo sapiens
aaaaacaaaacaa

SEQ ID NO: 5067760 - DNA, 23 bp, Homo sapiens
aaaaacaaacaaacaaactgttg

SEQ ID NO: 5067761 - DNA, 15 bp, Homo sapiens
aaaaacaaataatat

SEQ ID NO: 5067762 - DNA, 12 bp, Homo sapiens
aaaaacaaatat

SEQ ID NO: 5067763 - DNA, 12 bp, Homo sapiens
aaaaacaacaaa

SEQ ID NO: 5067764 - DNA, 14 bp, Homo sapiens
aaaaacaatatatt

SEQ ID NO: 5067765 - DNA, 17 bp, Homo sapiens
aaaaacaatatctgcag

SEQ ID NO: 5067766 - DNA, 18 bp, Homo sapiens
aaaaacaatatttattgt

SEQ ID NO: 5067767 - DNA, 14 bp, Homo sapiens
aaaaacaattaact

SEQ ID NO: 5067768 - DNA, 19 bp, Homo sapiens
aaaaacaattaactgccct

SEQ ID NO: 5067769 - DNA, 22 bp, Homo sapiens
aaaaacaattgcaacagaagca

SEQ ID NO: 5067770 - DNA, 19 bp, Homo sapiens
aaaaacacaaaacaacaaa

SEQ ID NO: 5067771 - DNA, 12 bp, Homo sapiens
aaaaacacagca

SEQ ID NO: 5067772 - DNA, 12 bp, Homo sapiens
aaaaacactagt

SEQ ID NO: 5067773 - DNA, 17 bp, Homo sapiens
aaaaacagaacatttct

SEQ ID NO: 5067774 - DNA, 23 bp, Homo sapiens
aaaaacagaccggggttcccgtg

SEQ ID NO: 5067775 - DNA, 12 bp, Homo sapiens
aaaaacagcaga

SEQ ID NO: 5067776 - DNA, 16 bp, Homo sapiens
aaaaacagcttgttct

SEQ ID NO: 5067777 - DNA, 18 bp, Homo sapiens
aaaaacaggtatatactt

SEQ ID NO: 5067778 - DNA, 19 bp, Homo sapiens
aaaaacaggtatatacttt

SEQ ID NO: 5067779 - DNA, 21 bp, Homo sapiens
aaaaacaggtatatactttga

SEQ ID NO: 5067780 - DNA, 18 bp, Homo sapiens
aaaaacataacataaatt

SEQ ID NO: 5067781 - DNA, 18 bp, Homo sapiens
aaaaacatacttacattt

SEQ ID NO: 5067782 - DNA, 16 bp, Homo sapiens
aaaaacatagaaaaat

SEQ ID NO: 5067783 - DNA, 15 bp, Homo sapiens
aaaaacatattcttg

SEQ ID NO: 5067784 - DNA, 21 bp, Homo sapiens
aaaaacatgaatttagaaata

SEQ ID NO: 5067785 - DNA, 20 bp, Homo sapiens
aaaaacatgtatgtgcattt

SEQ ID NO: 5067786 - DNA, 19 bp, Homo sapiens
aaaaacattctatctactg

SEQ ID NO: 5067787 - DNA, 18 bp, Homo sapiens
aaaaacattgaaatatta

SEQ ID NO: 5067788 - DNA, 15 bp, Homo sapiens
aaaaacatttatttt

SEQ ID NO: 5067789 - DNA, 14 bp, Homo sapiens
aaaaacatttgtac

SEQ ID NO: 5067790 - DNA, 15 bp, Homo sapiens
aaaaacatttgtaca

SEQ ID NO: 5067791 - DNA, 17 bp, Homo sapiens
aaaaaccaaagtacttt

SEQ ID NO: 5067792 - DNA, 18 bp, Homo sapiens
aaaaaccaacaggtttat

SEQ ID NO: 5067793 - DNA, 11 bp, Homo sapiens
aaaaaccacaa

SEQ ID NO: 5067794 - DNA, 21 bp, Homo sapiens
aaaaaccacccacaaagaaac

SEQ ID NO: 5067795 - DNA, 18 bp, Homo sapiens
aaaaaccactgaacattt

SEQ ID NO: 5067796 - DNA, 14 bp, Homo sapiens
aaaaaccagaatta

SEQ ID NO: 5067797 - DNA, 20 bp, Homo sapiens
aaaaaccataaacatttgca

SEQ ID NO: 5067798 - DNA, 23 bp, Homo sapiens
aaaaaccatgttgcgttcaaaga

SEQ ID NO: 5067799 - DNA, 17 bp, Homo sapiens
aaaaacccacaattgaa

SEQ ID NO: 5067800 - DNA, 24 bp, Homo sapiens
aaaaaccctatttaaatgaaagga

SEQ ID NO: 5067801 - DNA, 22 bp, Homo sapiens
aaaaaccgtgtttgtctcttct

SEQ ID NO: 5067802 - DNA, 23 bp, Homo sapiens
aaaaacctgagatttattaaaga

SEQ ID NO: 5067803 - DNA, 14 bp, Homo sapiens
aaaaacctgtatct

SEQ ID NO: 5067804 - DNA, 13 bp, Homo sapiens
aaaaaccttgggt

SEQ ID NO: 5067805 - DNA, 22 bp, Homo sapiens
aaaaaccttgtaaaaaaagcaa

SEQ ID NO: 5067806 - DNA, 22 bp, Homo sapiens
aaaaaccttgtatatcttgttt

SEQ ID NO: 5067807 - DNA, 13 bp, Homo sapiens
aaaaacggggaga

SEQ ID NO: 5067808 - DNA, 15 bp, Homo sapiens
aaaaactaatgtgtc

SEQ ID NO: 5067809 - DNA, 21 bp, Homo sapiens
aaaaactacccatgtctttct

SEQ ID NO: 5067810 - DNA, 20 bp, Homo sapiens
aaaaactactgaataaatca

SEQ ID NO: 5067811 - DNA, 16 bp, Homo sapiens
aaaaactagactccat

SEQ ID NO: 5067812 - DNA, 17 bp, Homo sapiens
aaaaactatgttcagaa

SEQ ID NO: 5067813 - DNA, 12 bp, Homo sapiens
aaaaactcacag

SEQ ID NO: 5067814 - DNA, 14 bp, Homo sapiens
aaaaactcctgggc

SEQ ID NO: 5067815 - DNA, 18 bp, Homo sapiens
aaaaactcctgtcttgct

SEQ ID NO: 5067816 - DNA, 13 bp, Homo sapiens
aaaaactcctgtg

SEQ ID NO: 5067817 - DNA, 17 bp, Homo sapiens
aaaaactctatttttgt

SEQ ID NO: 5067818 - DNA, 13 bp, Homo sapiens
aaaaactcttcag

SEQ ID NO: 5067819 - DNA, 20 bp, Homo sapiens
aaaaactctttaacttgtaa

SEQ ID NO: 5067820 - DNA, 13 bp, Homo sapiens
aaaaactgaaaaa

SEQ ID NO: 5067821 - DNA, 16 bp, Homo sapiens
aaaaactgaagaattt

SEQ ID NO: 5067822 - DNA, 17 bp, Homo sapiens
aaaaactgaaggttttt

SEQ ID NO: 5067823 - DNA, 13 bp, Homo sapiens
aaaaactgaagtt

SEQ ID NO: 5067824 - DNA, 12 bp, Homo sapiens
aaaaactgaatg

SEQ ID NO: 5067825 - DNA, 15 bp, Homo sapiens
aaaaactgagtgact

SEQ ID NO: 5067826 - DNA, 13 bp, Homo sapiens
aaaaactgctgta

SEQ ID NO: 5067827 - DNA, 17 bp, Homo sapiens
aaaaactgctgtaaaca

SEQ ID NO: 5067828 - DNA, 22 bp, Homo sapiens
aaaaactggaacggtgaaggtg

SEQ ID NO: 5067829 - DNA, 20 bp, Homo sapiens
aaaaactgggataactgatt

SEQ ID NO: 5067830 - DNA, 16 bp, Homo sapiens
aaaaactgtaaaagtg

SEQ ID NO: 5067831 - DNA, 14 bp, Homo sapiens
aaaaactgtactgt

SEQ ID NO: 5067832 - DNA, 14 bp, Homo sapiens
aaaaactgtgattt

SEQ ID NO: 5067833 - DNA, 11 bp, Homo sapiens
aaaaactgtgt

SEQ ID NO: 5067834 - DNA, 17 bp, Homo sapiens
aaaaactgtgtatcatt

SEQ ID NO: 5067835 - DNA, 17 bp, Homo sapiens
aaaaacttaaagcaaaa

SEQ ID NO: 5067836 - DNA, 17 bp, Homo sapiens
aaaaacttaaatattgt

SEQ ID NO: 5067837 - DNA, 21 bp, Homo sapiens
aaaaacttaaatattgtaata

SEQ ID NO: 5067838 - DNA, 13 bp, Homo sapiens
aaaaaaaaaacaa

SEQ ID NO: 5067839 - DNA, 13 bp, Homo sapiens
aaaaaaaaacaaa

SEQ ID NO: 5067840 - DNA, 11 bp, Homo sapiens
aaaaaaaaact

SEQ ID NO: 5067841 - DNA, 13 bp, Homo sapiens
aaaaaaaaagact

SEQ ID NO: 5067842 - DNA, 13 bp, Homo sapiens
aaaaaaaaaggaa

SEQ ID NO: 5067843 - DNA, 13 bp, Homo sapiens
aaaaaaaaagtgt

SEQ ID NO: 5067844 - DNA, 13 bp, Homo sapiens
aaaaaaaaagttc

SEQ ID NO: 5067845 - DNA, 11 bp, Homo sapiens
aaaaaaaactc

SEQ ID NO: 5067846 - DNA, 13 bp, Homo sapiens
aaaaaaaactctt

SEQ ID NO: 5067847 - DNA, 13 bp, Homo sapiens
aaaaaaaacttaa

SEQ ID NO: 5067848 - DNA, 11 bp, Homo sapiens
aaaaaaaagaa

SEQ ID NO: 5067849 - DNA, 12 bp, Homo sapiens
aaaaaaaagaaa

SEQ ID NO: 5067850 - DNA, 14 bp, Homo sapiens
aaaaaaaagcttta

SEQ ID NO: 5067851 - DNA, 10 bp, Homo sapiens
aaaaaaaagt

SEQ ID NO: 5067852 - DNA, 13 bp, Homo sapiens
aaaaaaaagtcag

SEQ ID NO: 5067853 - DNA, 12 bp, Homo sapiens
aaaaaaaagttg

SEQ ID NO: 5067854 - DNA, 12 bp, Homo sapiens
aaaaaaaataca

SEQ ID NO: 5067855 - DNA, 12 bp, Homo sapiens
aaaaaaaataga

SEQ ID NO: 5067856 - DNA, 13 bp, Homo sapiens
aaaaaaaatagga

SEQ ID NO: 5067857 - DNA, 13 bp, Homo sapiens
aaaaaaaatatga

SEQ ID NO: 5067858 - DNA, 11 bp, Homo sapiens
aaaaaaacaaa

SEQ ID NO: 5067859 - DNA, 18 bp, Homo sapiens
aaaaaaacagtggatcac

SEQ ID NO: 5067860 - DNA, 12 bp, Homo sapiens
aaaaaaacatta

SEQ ID NO: 5067861 - DNA, 13 bp, Homo sapiens
aaaaaaacattct

SEQ ID NO: 5067862 - DNA, 12 bp, Homo sapiens
aaaaaaactatt

SEQ ID NO: 5067863 - DNA, 12 bp, Homo sapiens
aaaaaaactctt

SEQ ID NO: 5067864 - DNA, 10 bp, Homo sapiens
aaaaaaactg

SEQ ID NO: 5067865 - DNA, 12 bp, Homo sapiens
aaaaaaacttaa

SEQ ID NO: 5067866 - DNA, 13 bp, Homo sapiens
aaaaaaagaaaag

SEQ ID NO: 5067867 - DNA, 11 bp, Homo sapiens
aaaaaaagaca

SEQ ID NO: 5067868 - DNA, 12 bp, Homo sapiens
aaaaaaagactg

SEQ ID NO: 5067869 - DNA, 10 bp, Homo sapiens
aaaaaaagag

SEQ ID NO: 5067870 - DNA, 14 bp, Homo sapiens
aaaaaaagatctgt

SEQ ID NO: 5067871 - DNA, 11 bp, Homo sapiens
aaaaaaagcct

SEQ ID NO: 5067872 - DNA, 13 bp, Homo sapiens
aaaaaaagcctcc

SEQ ID NO: 5067873 - DNA, 14 bp, Homo sapiens
aaaaaaagcctcca

SEQ ID NO: 5067874 - DNA, 11 bp, Homo sapiens
aaaaaaagctt

SEQ ID NO: 5067875 - DNA, 11 bp, Homo sapiens
aaaaaaagtta

SEQ ID NO: 5067876 - DNA, 12 bp, Homo sapiens
aaaaaaataaca

SEQ ID NO: 5067877 - DNA, 16 bp, Homo sapiens
aaaaaaataatgtaag

SEQ ID NO: 5067878 - DNA, 10 bp, Homo sapiens
aaaaaaatac

SEQ ID NO: 5067879 - DNA, 12 bp, Homo sapiens
aaaaaaatacaa

SEQ ID NO: 5067880 - DNA, 13 bp, Homo sapiens
aaaaaaatacagt

SEQ ID NO: 5067881 - DNA, 13 bp, Homo sapiens
aaaaaaatagatg

SEQ ID NO: 5067882 - DNA, 11 bp, Homo sapiens
aaaaaaatata

SEQ ID NO: 5067883 - DNA, 12 bp, Homo sapiens
aaaaaaatcaca

SEQ ID NO: 5067884 - DNA, 12 bp, Homo sapiens
aaaaaaatgact

SEQ ID NO: 5067885 - DNA, 13 bp, Homo sapiens
aaaaaaatgacta

SEQ ID NO: 5067886 - DNA, 13 bp, Homo sapiens
aaaaaaatgctga

SEQ ID NO: 5067887 - DNA, 13 bp, Homo sapiens
aaaaaaatggaaa

SEQ ID NO: 5067888 - DNA, 10 bp, Homo sapiens
aaaaaaatgt

SEQ ID NO: 5067889 - DNA, 12 bp, Homo sapiens
aaaaaaatgttg

SEQ ID NO: 5067890 - DNA, 19 bp, Homo sapiens
aaaaaaattgaaatgtaag

SEQ ID NO: 5067891 - DNA, 12 bp, Homo sapiens
aaaaaacaaagc

SEQ ID NO: 5067892 - DNA, 11 bp, Homo sapiens
aaaaaacaaat

SEQ ID NO: 5067893 - DNA, 10 bp, Homo sapiens
aaaaaacaac

SEQ ID NO: 5067894 - DNA, 13 bp, Homo sapiens
aaaaaacaagaaa

SEQ ID NO: 5067895 - DNA, 19 bp, Homo sapiens
aaaaaacacttggcataca

SEQ ID NO: 5067896 - DNA, 22 bp, Homo sapiens
aaaaaacagccaccgtttcttc

SEQ ID NO: 5067897 - DNA, 19 bp, Homo sapiens
aaaaaacatacttacattt

SEQ ID NO: 5067898 - DNA, 15 bp, Homo sapiens
aaaaaaccttgtaaa

SEQ ID NO: 5067899 - DNA, 10 bp, Homo sapiens
aaaaaactac

SEQ ID NO: 5067900 - DNA, 11 bp, Homo sapiens
aaaaaactctt

SEQ ID NO: 5067901 - DNA, 15 bp, Homo sapiens
aaaaaactggaaaca

SEQ ID NO: 5067902 - DNA, 11 bp, Homo sapiens
aaaaaagaaac

SEQ ID NO: 5067903 - DNA, 13 bp, Homo sapiens
aaaaaagaaacat

SEQ ID NO: 5067904 - DNA, 11 bp, Homo sapiens
aaaaaagaaca

SEQ ID NO: 5067905 - DNA, 10 bp, Homo sapiens
aaaaaagaag

SEQ ID NO: 5067906 - DNA, 20 bp, Homo sapiens
aaaaaagaagttactttgta

SEQ ID NO: 5067907 - DNA, 12 bp, Homo sapiens
aaaaaagagaaa

SEQ ID NO: 5067908 - DNA, 11 bp, Homo sapiens
aaaaaagatga

SEQ ID NO: 5067909 - DNA, 19 bp, Homo sapiens
aaaaaagattgtattgctg

SEQ ID NO: 5067910 - DNA, 14 bp, Homo sapiens
aaaaaagcaaaaat

SEQ ID NO: 5067911 - DNA, 14 bp, Homo sapiens
aaaaaagcaacttt

SEQ ID NO: 5067912 - DNA, 12 bp, Homo sapiens
aaaaaagcaatt

SEQ ID NO: 5067913 - DNA, 10 bp, Homo sapiens
aaaaaagcac

SEQ ID NO: 5067914 - DNA, 14 bp, Homo sapiens
aaaaaagcacaaag

SEQ ID NO: 5067915 - DNA, 15 bp, Homo sapiens
aaaaaagcacataca

SEQ ID NO: 5067916 - DNA, 11 bp, Homo sapiens
aaaaaagcatg

SEQ ID NO: 5067917 - DNA, 12 bp, Homo sapiens
aaaaaagccttt

SEQ ID NO: 5067918 - DNA, 10 bp, Homo sapiens
aaaaaagctc

SEQ ID NO: 5067919 - DNA, 21 bp, Homo sapiens
aaaaaagctggtgggtgaaag

SEQ ID NO: 5067920 - DNA, 13 bp, Homo sapiens
aaaaaaggaaaaa

SEQ ID NO: 5067921 - DNA, 19 bp, Homo sapiens
aaaaaagggacagcatgcc

SEQ ID NO: 5067922 - DNA, 22 bp, Homo sapiens
aaaaaagtacaattcattgttt

SEQ ID NO: 5067923 - DNA, 11 bp, Homo sapiens
aaaaaagtata

SEQ ID NO: 5067924 - DNA, 23 bp, Homo sapiens
aaaaaagtcaccattctgcattt

SEQ ID NO: 5067925 - DNA, 11 bp, Homo sapiens
aaaaaagtctc

SEQ ID NO: 5067926 - DNA, 13 bp, Homo sapiens
aaaaaagttatat

SEQ ID NO: 5067927 - DNA, 18 bp, Homo sapiens
aaaaaagttatataggtt

SEQ ID NO: 5067928 - DNA, 13 bp, Homo sapiens
aaaaaagttgaag

SEQ ID NO: 5067929 - DNA, 20 bp, Homo sapiens
aaaaaagttgcagctgtttt

SEQ ID NO: 5067930 - DNA, 12 bp, Homo sapiens
aaaaaagttgta

SEQ ID NO: 5067931 - DNA, 20 bp, Homo sapiens
aaaaaagtttacaagtgtat

SEQ ID NO: 5067932 - DNA, 13 bp, Homo sapiens
aaaaaataaatat

SEQ ID NO: 5067933 - DNA, 12 bp, Homo sapiens
aaaaaataacac

SEQ ID NO: 5067934 - DNA, 13 bp, Homo sapiens
aaaaaataagaga

SEQ ID NO: 5067935 - DNA, 14 bp, Homo sapiens
aaaaaataattgga

SEQ ID NO: 5067936 - DNA, 17 bp, Homo sapiens
aaaaaataccattgaaa

SEQ ID NO: 5067937 - DNA, 16 bp, Homo sapiens
aaaaaatactgccaga

SEQ ID NO: 5067938 - DNA, 13 bp, Homo sapiens
aaaaaatatcaga

SEQ ID NO: 5067939 - DNA, 12 bp, Homo sapiens
aaaaaatatcta

SEQ ID NO: 5067940 - DNA, 11 bp, Homo sapiens
aaaaaatatgt

SEQ ID NO: 5067941 - DNA, 13 bp, Homo sapiens
aaaaaatatgtgt

SEQ ID NO: 5067942 - DNA, 14 bp, Homo sapiens
aaaaaatatgtgta

SEQ ID NO: 5067943 - DNA, 12 bp, Homo sapiens
aaaaaatatttt

SEQ ID NO: 5067944 - DNA, 13 bp, Homo sapiens
aaaaaatatttta

SEQ ID NO: 5067945 - DNA, 12 bp, Homo sapiens
aaaaaatcaaaa

SEQ ID NO: 5067946 - DNA, 13 bp, Homo sapiens
aaaaaatcatatt

SEQ ID NO: 5067947 - DNA, 14 bp, Homo sapiens
aaaaaatcatctat

SEQ ID NO: 5067948 - DNA, 22 bp, Homo sapiens
aaaaaatctctcagagccctca

SEQ ID NO: 5067949 - DNA, 13 bp, Homo sapiens
aaaaaatctgcag

SEQ ID NO: 5067950 - DNA, 17 bp, Homo sapiens
aaaaaatgaatagtaca

SEQ ID NO: 5067951 - DNA, 12 bp, Homo sapiens
aaaaaatgaatt

SEQ ID NO: 5067952 - DNA, 18 bp, Homo sapiens
aaaaaatgatctattgca

SEQ ID NO: 5067953 - DNA, 11 bp, Homo sapiens
aaaaaatgatg

SEQ ID NO: 5067954 - DNA, 14 bp, Homo sapiens
aaaaaatgctcaca

SEQ ID NO: 5067955 - DNA, 12 bp, Homo sapiens
aaaaaatgctga

SEQ ID NO: 5067956 - DNA, 20 bp, Homo sapiens
aaaaaatgctgaacattgca

SEQ ID NO: 5067957 - DNA, 22 bp, Homo sapiens
aaaaaatgctgaacattgcata

SEQ ID NO: 5067958 - DNA, 12 bp, Homo sapiens
aaaaaatggttc

SEQ ID NO: 5067959 - DNA, 12 bp, Homo sapiens
aaaaaatgtaat

SEQ ID NO: 5067960 - DNA, 22 bp, Homo sapiens
aaaaaatgtagcgacagcattt

SEQ ID NO: 5067961 - DNA, 11 bp, Homo sapiens
aaaaaatgttc

SEQ ID NO: 5067962 - DNA, 14 bp, Homo sapiens
aaaaaatgttcatt

SEQ ID NO: 5067963 - DNA, 13 bp, Homo sapiens
aaaaaatgttgtt

SEQ ID NO: 5067964 - DNA, 10 bp, Homo sapiens
aaaaaattaa

SEQ ID NO: 5067965 - DNA, 11 bp, Homo sapiens
aaaaaattaag

SEQ ID NO: 5067966 - DNA, 13 bp, Homo sapiens
aaaaaattacaaa

SEQ ID NO: 5067967 - DNA, 22 bp, Homo sapiens
aaaaaattagaaattggctgga

SEQ ID NO: 5067968 - DNA, 21 bp, Homo sapiens
aaaaaattcagtgatgtgcct

SEQ ID NO: 5067969 - DNA, 15 bp, Homo sapiens
aaaaaattgcacaat

SEQ ID NO: 5067970 - DNA, 16 bp, Homo sapiens
aaaaaatttccagtga

SEQ ID NO: 5067971 - DNA, 22 bp, Homo sapiens
aaaaaatttgagaaagccttca

SEQ ID NO: 5067972 - DNA, 13 bp, Homo sapiens
aaaaaattttata

SEQ ID NO: 5067973 - DNA, 17 bp, Homo sapiens
aaaaaatttttgacact

SEQ ID NO: 5067974 - DNA, 18 bp, Homo sapiens
aaaaacaaaaaaactata

SEQ ID NO: 5067975 - DNA, 17 bp, Homo sapiens
aaaaacaaaaccagctg

SEQ ID NO: 5067976 - DNA, 11 bp, Homo sapiens
aaaaacaaaag

SEQ ID NO: 5067977 - DNA, 11 bp, Homo sapiens
aaaaacaaaca

SEQ ID NO: 5067978 - DNA, 12 bp, Homo sapiens
aaaaacaaagag

SEQ ID NO: 5067979 - DNA, 15 bp, Homo sapiens
aaaaacaaagtgcaa

SEQ ID NO: 5067980 - DNA, 20 bp, Homo sapiens
aaaaacaaatatatatatgt

SEQ ID NO: 5067981 - DNA, 16 bp, Homo sapiens
aaaaacaaatgttcat

SEQ ID NO: 5067982 - DNA, 11 bp, Homo sapiens
aaaaacaacaa

SEQ ID NO: 5067983 - DNA, 14 bp, Homo sapiens
aaaaacaacaaata

SEQ ID NO: 5067984 - DNA, 15 bp, Homo sapiens
aaaaacaatcttatt

SEQ ID NO: 5067985 - DNA, 16 bp, Homo sapiens
aaaaacaattaactgc

SEQ ID NO: 5067986 - DNA, 13 bp, Homo sapiens
aaaaacacaaaaa

SEQ ID NO: 5067987 - DNA, 14 bp, Homo sapiens
aaaaacacaaaaca

SEQ ID NO: 5067988 - DNA, 14 bp, Homo sapiens
aaaaacacaaaagt

SEQ ID NO: 5067989 - DNA, 13 bp, Homo sapiens
aaaaacacaaata

SEQ ID NO: 5067990 - DNA, 21 bp, Homo sapiens
aaaaacacagtgaaaggcctg

SEQ ID NO: 5067991 - DNA, 17 bp, Homo sapiens
aaaaacacctagcttta

SEQ ID NO: 5067992 - DNA, 19 bp, Homo sapiens
aaaaacactatttctggaa

SEQ ID NO: 5067993 - DNA, 11 bp, Homo sapiens
aaaaacagaaa

SEQ ID NO: 5067994 - DNA, 17 bp, Homo sapiens
aaaaacagaaaaataag

SEQ ID NO: 5067995 - DNA, 16 bp, Homo sapiens
aaaaacagaacatttc

SEQ ID NO: 5067996 - DNA, 14 bp, Homo sapiens
aaaaacagaggcca

SEQ ID NO: 5067997 - DNA, 19 bp, Homo sapiens
aaaaacagcattgctttct

SEQ ID NO: 5067998 - DNA, 18 bp, Homo sapiens
aaaaacagccaccgtttc

SEQ ID NO: 5067999 - DNA, 17 bp, Homo sapiens
aaaaacagcgtcttcct

SEQ ID NO: 5068000 - DNA, 12 bp, Homo sapiens
aaaaacaggcac

SEQ ID NO: 5068001 - DNA, 13 bp, Homo sapiens
aaaaacataacat

SEQ ID NO: 5068002 - DNA, 24 bp, Homo sapiens
aaaaacatatgtctgtctttgcaa

SEQ ID NO: 5068003 - DNA, 17 bp, Homo sapiens
aaaaacatcccaaactt

SEQ ID NO: 5068004 - DNA, 23 bp, Homo sapiens
aaaaacatcccaaactttaaaat

SEQ ID NO: 5068005 - DNA, 12 bp, Homo sapiens
aaaaacatgctt

SEQ ID NO: 5068006 - DNA, 16 bp, Homo sapiens
aaaaacatgcttaagg

SEQ ID NO: 5068007 - DNA, 14 bp, Homo sapiens
aaaaacatggcctt

SEQ ID NO: 5068008 - DNA, 13 bp, Homo sapiens
aaaaacatgtatg

SEQ ID NO: 5068009 - DNA, 13 bp, Homo sapiens
aaaaacatgtcat

SEQ ID NO: 5068010 - DNA, 14 bp, Homo sapiens
aaaaacatgtcatg

SEQ ID NO: 5068011 - DNA, 15 bp, Homo sapiens
aaaaacattgaaata

SEQ ID NO: 5068012 - DNA, 16 bp, Homo sapiens
aaaaacattttgaagt

SEQ ID NO: 5068013 - DNA, 23 bp, Homo sapiens
aaaaacattttttatacatttgg

SEQ ID NO: 5068014 - DNA, 16 bp, Homo sapiens
aaaaacatttttttaa

SEQ ID NO: 5068015 - DNA, 16 bp, Homo sapiens
aaaaaccaatcatttt

SEQ ID NO: 5068016 - DNA, 19 bp, Homo sapiens
aaaaaccaatcattttaag

SEQ ID NO: 5068017 - DNA, 18 bp, Homo sapiens
aaaaaccagtattgtaca

SEQ ID NO: 5068018 - DNA, 20 bp, Homo sapiens
aaaaaccagtattgtacaaa

SEQ ID NO: 5068019 - DNA, 14 bp, Homo sapiens
aaaaaccataaaca

SEQ ID NO: 5068020 - DNA, 17 bp, Homo sapiens
aaaaaccataaacattt

SEQ ID NO: 5068021 - DNA, 12 bp, Homo sapiens
aaaaacccagcg

SEQ ID NO: 5068022 - DNA, 22 bp, Homo sapiens
aaaaaccccagctattttctga

SEQ ID NO: 5068023 - DNA, 21 bp, Homo sapiens
aaaaaccctaattttgtacat

SEQ ID NO: 5068024 - DNA, 20 bp, Homo sapiens
aaaaaccctatatgcttact

SEQ ID NO: 5068025 - DNA, 16 bp, Homo sapiens
aaaaaccgttcaaatt

SEQ ID NO: 5068026 - DNA, 17 bp, Homo sapiens
aaaaacctattttgaaa

SEQ ID NO: 5068027 - DNA, 14 bp, Homo sapiens
aaaaacctcactgg

SEQ ID NO: 5068028 - DNA, 18 bp, Homo sapiens
aaaaacctgagatttatt

SEQ ID NO: 5068029 - DNA, 12 bp, Homo sapiens
aaaaaccttcca

SEQ ID NO: 5068030 - DNA, 15 bp, Homo sapiens
aaaaacgaaaacagt

SEQ ID NO: 5068031 - DNA, 22 bp, Homo sapiens
aaaacttgtactatgttaataa

SEQ ID NO: 5068032 - DNA, 15 bp, Homo sapiens
aaaacttgtgctata

SEQ ID NO: 5068033 - DNA, 13 bp, Homo sapiens
aaaactttaaaag

SEQ ID NO: 5068034 - DNA, 14 bp, Homo sapiens
aaaactttaaaagg

SEQ ID NO: 5068035 - DNA, 21 bp, Homo sapiens
aaaactttatgctaagtgaaa

SEQ ID NO: 5068036 - DNA, 17 bp, Homo sapiens
aaaactttatgtactgc

SEQ ID NO: 5068037 - DNA, 15 bp, Homo sapiens
aaaactttattttat

SEQ ID NO: 5068038 - DNA, 18 bp, Homo sapiens
aaaactttattttatata

SEQ ID NO: 5068039 - DNA, 15 bp, Homo sapiens
aaaactttcatgcct

SEQ ID NO: 5068040 - DNA, 15 bp, Homo sapiens
aaaactttccatgac

SEQ ID NO: 5068041 - DNA, 17 bp, Homo sapiens
aaaactttccatgacag

SEQ ID NO: 5068042 - DNA, 23 bp, Homo sapiens
aaaactttccatgacagtagcat

SEQ ID NO: 5068043 - DNA, 14 bp, Homo sapiens
aaaactttcctcgc

SEQ ID NO: 5068044 - DNA, 18 bp, Homo sapiens
aaaactttctaaatgcat

SEQ ID NO: 5068045 - DNA, 17 bp, Homo sapiens
aaaactttgctccaggc

SEQ ID NO: 5068046 - DNA, 22 bp, Homo sapiens
aaaactttgtagacattttgaa

SEQ ID NO: 5068047 - DNA, 23 bp, Homo sapiens
aaaacttttacatttttctgatg

SEQ ID NO: 5068048 - DNA, 21 bp, Homo sapiens
aaaacttttcatttcagattt

SEQ ID NO: 5068049 - DNA, 16 bp, Homo sapiens
aaaacttttgtaaatt

SEQ ID NO: 5068050 - DNA, 20 bp, Homo sapiens
aaaacttttgtaaattattg

SEQ ID NO: 5068051 - DNA, 22 bp, Homo sapiens
aaaacttttgtttagagccctc

SEQ ID NO: 5068052 - DNA, 18 bp, Homo sapiens
aaaacttttgttttttgg

SEQ ID NO: 5068053 - DNA, 11 bp, Homo sapiens
aaaagaaaaaa

SEQ ID NO: 5068054 - DNA, 17 bp, Homo sapiens
aaaagaaaaaaaaaaga

SEQ ID NO: 5068055 - DNA, 16 bp, Homo sapiens
aaaagaaaaaaaaaga

SEQ ID NO: 5068056 - DNA, 18 bp, Homo sapiens
aaaagaaaaaaaaagaaa

SEQ ID NO: 5068057 - DNA, 16 bp, Homo sapiens
aaaagaaaaaaaattt

SEQ ID NO: 5068058 - DNA, 18 bp, Homo sapiens
aaaagaaaaaaagaaaaa

SEQ ID NO: 5068059 - DNA, 14 bp, Homo sapiens
aaaagaaaaaagtc

SEQ ID NO: 5068060 - DNA, 21 bp, Homo sapiens
aaaagaaaaaccactcccagt

SEQ ID NO: 5068061 - DNA, 14 bp, Homo sapiens
aaaagaaaaactgt

SEQ ID NO: 5068062 - DNA, 13 bp, Homo sapiens
aaaagaaaaagat

SEQ ID NO: 5068063 - DNA, 15 bp, Homo sapiens
aaaagaaaaaggaaa

SEQ ID NO: 5068064 - DNA, 15 bp, Homo sapiens
aaaagaaaaatttct

SEQ ID NO: 5068065 - DNA, 12 bp, Homo sapiens
aaaagaaaacaa

SEQ ID NO: 5068066 - DNA, 14 bp, Homo sapiens
aaaagaaaacattt

SEQ ID NO: 5068067 - DNA, 13 bp, Homo sapiens
aaaagaaaatatt

SEQ ID NO: 5068068 - DNA, 13 bp, Homo sapiens
aaaagaaaatctt

SEQ ID NO: 5068069 - DNA, 10 bp, Homo sapiens
aaaagaaaca

SEQ ID NO: 5068070 - DNA, 17 bp, Homo sapiens
aaaagaaacaccagtgt

SEQ ID NO: 5068071 - DNA, 18 bp, Homo sapiens
aaaagaaaccatgacaaa

SEQ ID NO: 5068072 - DNA, 10 bp, Homo sapiens
aaaagaaaga

SEQ ID NO: 5068073 - DNA, 14 bp, Homo sapiens
aaaagaaagaaaaa

SEQ ID NO: 5068074 - DNA, 20 bp, Homo sapiens
aaaagaaagaagttattttc

SEQ ID NO: 5068075 - DNA, 10 bp, Homo sapiens
aaaagaaagc

SEQ ID NO: 5068076 - DNA, 11 bp, Homo sapiens
aaaagaaagca

SEQ ID NO: 5068077 - DNA, 11 bp, Homo sapiens
aaaagaaaggc

SEQ ID NO: 5068078 - DNA, 13 bp, Homo sapiens
aaaagaaaggcta

SEQ ID NO: 5068079 - DNA, 21 bp, Homo sapiens
aaaagaaaggttgcgtttaat

SEQ ID NO: 5068080 - DNA, 9 bp, Homo sapiens
aaaagaaat

SEQ ID NO: 5068081 - DNA, 13 bp, Homo sapiens
aaaagaaataata

SEQ ID NO: 5068082 - DNA, 14 bp, Homo sapiens
aaaagaaataataa

SEQ ID NO: 5068083 - DNA, 15 bp, Homo sapiens
aaaagaaataataat

SEQ ID NO: 5068084 - DNA, 17 bp, Homo sapiens
aaaagaaatagaaaagg

SEQ ID NO: 5068085 - DNA, 23 bp, Homo sapiens
aaaagaaatatacagtttgactt

SEQ ID NO: 5068086 - DNA, 14 bp, Homo sapiens
aaaagaaatatatt

SEQ ID NO: 5068087 - DNA, 23 bp, Homo sapiens
aaaagaaatatattttttgttat

SEQ ID NO: 5068088 - DNA, 13 bp, Homo sapiens
aaaagaaatcaat

SEQ ID NO: 5068089 - DNA, 19 bp, Homo sapiens
aaaagaaatccagtttgtg

SEQ ID NO: 5068090 - DNA, 15 bp, Homo sapiens
aaaagaaatcttgtc

SEQ ID NO: 5068091 - DNA, 14 bp, Homo sapiens
aaaagaaatgaaat

SEQ ID NO: 5068092 - DNA, 13 bp, Homo sapiens
aaaagaaatgatg

SEQ ID NO: 5068093 - DNA, 13 bp, Homo sapiens
aaaagaaatgcaa

SEQ ID NO: 5068094 - DNA, 16 bp, Homo sapiens
aaaagaaatggtatgt

SEQ ID NO: 5068095 - DNA, 21 bp, Homo sapiens
aaaagaaattaatatggcttc

SEQ ID NO: 5068096 - DNA, 20 bp, Homo sapiens
aaaagaaattatctttagtt

SEQ ID NO: 5068097 - DNA, 13 bp, Homo sapiens
aaaagaaattctg

SEQ ID NO: 5068098 - DNA, 14 bp, Homo sapiens
aaaagaaattgtcc

SEQ ID NO: 5068099 - DNA, 17 bp, Homo sapiens
aaaagaacactagagtc

SEQ ID NO: 5068100 - DNA, 16 bp, Homo sapiens
aaaagaacagtaaaca

SEQ ID NO: 5068101 - DNA, 9 bp, Homo sapiens
aaaagaaga

SEQ ID NO: 5068102 - DNA, 19 bp, Homo sapiens
aaaagaagaaactattttt

SEQ ID NO: 5068103 - DNA, 21 bp, Homo sapiens
aaaagaagaaagtctatgctt

SEQ ID NO: 5068104 - DNA, 11 bp, Homo sapiens
aaaagaagaag

SEQ ID NO: 5068105 - DNA, 21 bp, Homo sapiens
aaaagaagaagagatgacaaa

SEQ ID NO: 5068106 - DNA, 12 bp, Homo sapiens
aaaagaagaagt

SEQ ID NO: 5068107 - DNA, 19 bp, Homo sapiens
aaaagaagcccggctcctg

SEQ ID NO: 5068108 - DNA, 17 bp, Homo sapiens
aaaagaaggaccctttt

SEQ ID NO: 5068109 - DNA, 21 bp, Homo sapiens
aaaagaaggaccctttttgga

SEQ ID NO: 5068110 - DNA, 23 bp, Homo sapiens
aaaagaaggggggtctctggctt

SEQ ID NO: 5068111 - DNA, 24 bp, Homo sapiens
aaaagaaggtatttttccaatcac

SEQ ID NO: 5068112 - DNA, 14 bp, Homo sapiens
aaaagaagtagtgt

SEQ ID NO: 5068113 - DNA, 23 bp, Homo sapiens
aaaagaagtgaagtcttgggtat

SEQ ID NO: 5068114 - DNA, 16 bp, Homo sapiens
aaaagaagttactttg

SEQ ID NO: 5068115 - DNA, 17 bp, Homo sapiens
aaaagaagttactttgt

SEQ ID NO: 5068116 - DNA, 19 bp, Homo sapiens
aaaagaagttactttgtaa

SEQ ID NO: 5068117 - DNA, 23 bp, Homo sapiens
aaaagaagtttgggctaacattt

SEQ ID NO: 5068118 - DNA, 13 bp, Homo sapiens
aaaagaataagac

SEQ ID NO: 5068119 - DNA, 11 bp, Homo sapiens
aaaagaatata

SEQ ID NO: 5068120 - DNA, 11 bp, Homo sapiens
aaaagaatgac

SEQ ID NO: 5068121 - DNA, 17 bp, Homo sapiens
aaaagaatgcagagatg

SEQ ID NO: 5068122 - DNA, 11 bp, Homo sapiens
aaaagaatgga

SEQ ID NO: 5068123 - DNA, 21 bp, Homo sapiens
aaaagaatgtcagaaaaacaa

SEQ ID NO: 5068124 - DNA, 20 bp, Homo sapiens
aaaagaattctggtcctgtt

SEQ ID NO: 5068125 - DNA, 24 bp, Homo sapiens
aaaagaattttagtgttaatgact

SEQ ID NO: 5068126 - DNA, 13 bp, Homo sapiens
aaaagacaaacac

SEQ ID NO: 5068127 - DNA, 16 bp, Homo sapiens
aaaagacaaatatgta

SEQ ID NO: 5068128 - DNA, 13 bp, Homo sapiens
aaaagacaagaga

SEQ ID NO: 5068129 - DNA, 20 bp, Homo sapiens
aaaagacaagcattgggtca

SEQ ID NO: 5068130 - DNA, 13 bp, Homo sapiens
aaaagacaattct

SEQ ID NO: 5068131 - DNA, 16 bp, Homo sapiens
aaaagacattagagaa

SEQ ID NO: 5068132 - DNA, 15 bp, Homo sapiens
aaaagacattcagga

SEQ ID NO: 5068133 - DNA, 21 bp, Homo sapiens
aaaagacatttgatagaaagg

SEQ ID NO: 5068134 - DNA, 14 bp, Homo sapiens
aaaagacattttaa

SEQ ID NO: 5068135 - DNA, 16 bp, Homo sapiens
aaaagaccaaatctca

SEQ ID NO: 5068136 - DNA, 21 bp, Homo sapiens
aaaagaccatgcattcagatc

SEQ ID NO: 5068137 - DNA, 15 bp, Homo sapiens
aaaagacctgcattt

SEQ ID NO: 5068138 - DNA, 17 bp, Homo sapiens
aaaagactaagatcggt

SEQ ID NO: 5068139 - DNA, 10 bp, Homo sapiens
aaaagactca

SEQ ID NO: 5068140 - DNA, 20 bp, Homo sapiens
aaaagactccagtactattt

SEQ ID NO: 5068141 - DNA, 13 bp, Homo sapiens
aaaagactctttt

SEQ ID NO: 5068142 - DNA, 13 bp, Homo sapiens
aaaagactgaaca

SEQ ID NO: 5068143 - DNA, 17 bp, Homo sapiens
aaaagactgtcaaatga

SEQ ID NO: 5068144 - DNA, 14 bp, Homo sapiens
aaaagactgtctta

SEQ ID NO: 5068145 - DNA, 13 bp, Homo sapiens
aaaagagaaaaga

SEQ ID NO: 5068146 - DNA, 16 bp, Homo sapiens
aaaagagaaaagaaaa

SEQ ID NO: 5068147 - DNA, 15 bp, Homo sapiens
aaaagagaaacaagt

SEQ ID NO: 5068148 - DNA, 15 bp, Homo sapiens
aaaagagaacagaaa

SEQ ID NO: 5068149 - DNA, 16 bp, Homo sapiens
aaaagagaacagaaaa

SEQ ID NO: 5068150 - DNA, 12 bp, Homo sapiens
aaaagagaagaa

SEQ ID NO: 5068151 - DNA, 20 bp, Homo sapiens
aaaagagaattacttatatt

SEQ ID NO: 5068152 - DNA, 21 bp, Homo sapiens
aaaagagacttctctgtaagt

SEQ ID NO: 5068153 - DNA, 21 bp, Homo sapiens
aaaagagagaaaacttatttg

SEQ ID NO: 5068154 - DNA, 14 bp, Homo sapiens
aaaagagatatttt

SEQ ID NO: 5068155 - DNA, 21 bp, Homo sapiens
aaaagagatattttaaaatga

SEQ ID NO: 5068156 - DNA, 16 bp, Homo sapiens
aaaagagatgatgaaa

SEQ ID NO: 5068157 - DNA, 16 bp, Homo sapiens
aaaagagatttcaaga

SEQ ID NO: 5068158 - DNA, 16 bp, Homo sapiens
aaaagagcatggatgc

SEQ ID NO: 5068159 - DNA, 15 bp, Homo sapiens
aaaagagccaagttc

SEQ ID NO: 5068160 - DNA, 12 bp, Homo sapiens
aaaagagccctg

SEQ ID NO: 5068161 - DNA, 22 bp, Homo sapiens
aaaagagccctggctctgcccc

SEQ ID NO: 5068162 - DNA, 23 bp, Homo sapiens
aaaagagcgatacacaaagcttt

SEQ ID NO: 5068163 - DNA, 20 bp, Homo sapiens
aaaagagctactcagaaatg

SEQ ID NO: 5068164 - DNA, 12 bp, Homo sapiens
aaaagagctggg

SEQ ID NO: 5068165 - DNA, 12 bp, Homo sapiens
aaaagaggaaaa

SEQ ID NO: 5068166 - DNA, 21 bp, Homo sapiens
aaaagaggagaggaaaactat

SEQ ID NO: 5068167 - DNA, 21 bp, Homo sapiens
aaaagaggattagtagaaaat

SEQ ID NO: 5068168 - DNA, 15 bp, Homo sapiens
aaaagaggcctgttc

SEQ ID NO: 5068169 - DNA, 12 bp, Homo sapiens
aaaagagggggg

SEQ ID NO: 5068170 - DNA, 15 bp, Homo sapiens
aaaagaggtccatta

SEQ ID NO: 5068171 - DNA, 16 bp, Homo sapiens
aaaagaggtgtcatgc

SEQ ID NO: 5068172 - DNA, 18 bp, Homo sapiens
aaaagaggtgtcatgctt

SEQ ID NO: 5068173 - DNA, 17 bp, Homo sapiens
aaaagaggttactttag

SEQ ID NO: 5068174 - DNA, 22 bp, Homo sapiens
aaaagaggtttttcttaaataa

SEQ ID NO: 5068175 - DNA, 22 bp, Homo sapiens
aaaagagtaatggtattttcta

SEQ ID NO: 5068176 - DNA, 19 bp, Homo sapiens
aaaagagtagaataacctt

SEQ ID NO: 5068177 - DNA, 15 bp, Homo sapiens
aaaagagtcagccct

SEQ ID NO: 5068178 - DNA, 23 bp, Homo sapiens
aaaagagtcttaattttctaaaa

SEQ ID NO: 5068179 - DNA, 17 bp, Homo sapiens
aaaagagtcttccaatt

SEQ ID NO: 5068180 - DNA, 13 bp, Homo sapiens
aaaagagtgaatg

SEQ ID NO: 5068181 - DNA, 22 bp, Homo sapiens
aaaagagttccctgcaaccaat

SEQ ID NO: 5068182 - DNA, 18 bp, Homo sapiens
aaaagagttttctttagt

SEQ ID NO: 5068183 - DNA, 21 bp, Homo sapiens
aaaagataaaaaaacagcttt

SEQ ID NO: 5068184 - DNA, 12 bp, Homo sapiens
aaaagataaaca

SEQ ID NO: 5068185 - DNA, 22 bp, Homo sapiens
aaaagataaagaccagaaattc

SEQ ID NO: 5068186 - DNA, 18 bp, Homo sapiens
aaaagataaagatgatct

SEQ ID NO: 5068187 - DNA, 17 bp, Homo sapiens
aaaagataaatattata

SEQ ID NO: 5068188 - DNA, 14 bp, Homo sapiens
aaaagatacatttg

SEQ ID NO: 5068189 - DNA, 15 bp, Homo sapiens
aaaagatataagtgc

SEQ ID NO: 5068190 - DNA, 15 bp, Homo sapiens
aaaagatattgtatt

SEQ ID NO: 5068191 - DNA, 19 bp, Homo sapiens
aaaagatattgtattatca

SEQ ID NO: 5068192 - DNA, 22 bp, Homo sapiens
aaaagatattgtattatcatat

SEQ ID NO: 5068193 - DNA, 23 bp, Homo sapiens
aaaagatattgttgttttccatg

SEQ ID NO: 5068194 - DNA, 21 bp, Homo sapiens
aaaagatattttatttctgat

SEQ ID NO: 5068195 - DNA, 22 bp, Homo sapiens
aaaagatattttatttctgatg

SEQ ID NO: 5068196 - DNA, 22 bp, Homo sapiens
aaaagatcattcaactaaaaat

SEQ ID NO: 5068197 - DNA, 22 bp, Homo sapiens
aaaagatccccaagaccccctg

SEQ ID NO: 5068198 - DNA, 16 bp, Homo sapiens
aaaagatctttcattt

SEQ ID NO: 5068199 - DNA, 19 bp, Homo sapiens
aaaagatgaaaaagaataa

SEQ ID NO: 5068200 - DNA, 17 bp, Homo sapiens
aaaagatgaaaatattt

SEQ ID NO: 5068201 - DNA, 18 bp, Homo sapiens
aaaagatgaaagagcagt

SEQ ID NO: 5068202 - DNA, 13 bp, Homo sapiens
aaaagatgaattt

SEQ ID NO: 5068203 - DNA, 14 bp, Homo sapiens
aaaagatgaatttg

SEQ ID NO: 5068204 - DNA, 13 bp, Homo sapiens
aaaagatgcttct

SEQ ID NO: 5068205 - DNA, 19 bp, Homo sapiens
aaaagatggcttatgtcat

SEQ ID NO: 5068206 - DNA, 21 bp, Homo sapiens
aaaagatggggtctgtaaaat

SEQ ID NO: 5068207 - DNA, 22 bp, Homo sapiens
aaaagatgggtggttgaatgat

SEQ ID NO: 5068208 - DNA, 19 bp, Homo sapiens
aaaagatggttgtagcatt

SEQ ID NO: 5068209 - DNA, 14 bp, Homo sapiens
aaaagatgtagatt

SEQ ID NO: 5068210 - DNA, 22 bp, Homo sapiens
aaaagatgtagatttatttcat

SEQ ID NO: 5068211 - DNA, 23 bp, Homo sapiens
aaaagatgtagatttatttcatc

SEQ ID NO: 5068212 - DNA, 22 bp, Homo sapiens
aaaaacttcatgtaattttatt

SEQ ID NO: 5068213 - DNA, 23 bp, Homo sapiens
aaaaacttcatgtaattttattt

SEQ ID NO: 5068214 - DNA, 15 bp, Homo sapiens
aaaaacttgtactat

SEQ ID NO: 5068215 - DNA, 24 bp, Homo sapiens
aaaaactttccatgacagtagcat

SEQ ID NO: 5068216 - DNA, 14 bp, Homo sapiens
aaaaactttgctcc

SEQ ID NO: 5068217 - DNA, 21 bp, Homo sapiens
aaaaactttggaaccagactc

SEQ ID NO: 5068218 - DNA, 17 bp, Homo sapiens
aaaaacttttataaatt

SEQ ID NO: 5068219 - DNA, 23 bp, Homo sapiens
aaaaacttttataaattaaatat

SEQ ID NO: 5068220 - DNA, 22 bp, Homo sapiens
aaaaacttttcatttcagattt

SEQ ID NO: 5068221 - DNA, 15 bp, Homo sapiens
aaaaacttttgagga

SEQ ID NO: 5068222 - DNA, 14 bp, Homo sapiens
aaaaactttttgtt

SEQ ID NO: 5068223 - DNA, 16 bp, Homo sapiens
aaaaacttttttggaa

SEQ ID NO: 5068224 - DNA, 14 bp, Homo sapiens
aaaaagaaaagata

SEQ ID NO: 5068225 - DNA, 15 bp, Homo sapiens
aaaaagaaaatatta

SEQ ID NO: 5068226 - DNA, 15 bp, Homo sapiens
aaaaagaaaatgtct

SEQ ID NO: 5068227 - DNA, 14 bp, Homo sapiens
aaaaagaaacaaga

SEQ ID NO: 5068228 - DNA, 23 bp, Homo sapiens
aaaaagaaagaattaaaaacttt

SEQ ID NO: 5068229 - DNA, 19 bp, Homo sapiens
aaaaagaaagctgtgaaat

SEQ ID NO: 5068230 - DNA, 11 bp, Homo sapiens
aaaaagaaatg

SEQ ID NO: 5068231 - DNA, 14 bp, Homo sapiens
aaaaagaaatgtca

SEQ ID NO: 5068232 - DNA, 13 bp, Homo sapiens
aaaaagaaattat

SEQ ID NO: 5068233 - DNA, 20 bp, Homo sapiens
aaaaagaaattcgcatgttt

SEQ ID NO: 5068234 - DNA, 13 bp, Homo sapiens
aaaaagaacttcc

SEQ ID NO: 5068235 - DNA, 22 bp, Homo sapiens
aaaaagaagaggttcatttttc

SEQ ID NO: 5068236 - DNA, 15 bp, Homo sapiens
aaaaagaagccacag

SEQ ID NO: 5068237 - DNA, 14 bp, Homo sapiens
aaaaagaagtgctg

SEQ ID NO: 5068238 - DNA, 15 bp, Homo sapiens
aaaaagaagttactt

SEQ ID NO: 5068239 - DNA, 16 bp, Homo sapiens
aaaaagaagttacttt

SEQ ID NO: 5068240 - DNA, 20 bp, Homo sapiens
aaaaagaagttactttgtaa

SEQ ID NO: 5068241 - DNA, 22 bp, Homo sapiens
aaaaagaagttactttgtaatt

SEQ ID NO: 5068242 - DNA, 12 bp, Homo sapiens
aaaaagaagttt

SEQ ID NO: 5068243 - DNA, 11 bp, Homo sapiens
aaaaagaatgt

SEQ ID NO: 5068244 - DNA, 11 bp, Homo sapiens
aaaaagacaag

SEQ ID NO: 5068245 - DNA, 12 bp, Homo sapiens
aaaaagacattt

SEQ ID NO: 5068246 - DNA, 19 bp, Homo sapiens
aaaaagacctcgtggagaa

SEQ ID NO: 5068247 - DNA, 16 bp, Homo sapiens
aaaaagaccttctccc

SEQ ID NO: 5068248 - DNA, 22 bp, Homo sapiens
aaaaagactgaacatgtttaca

SEQ ID NO: 5068249 - DNA, 23 bp, Homo sapiens
aaaaagactgaacatgtttacag

SEQ ID NO: 5068250 - DNA, 22 bp, Homo sapiens
aaaaagactgtcaaatgaactt

SEQ ID NO: 5068251 - DNA, 20 bp, Homo sapiens
aaaaagacttgagacaatgt

SEQ ID NO: 5068252 - DNA, 19 bp, Homo sapiens
aaaaagactttaaaagtga

SEQ ID NO: 5068253 - DNA, 15 bp, Homo sapiens
aaaaagagacatcca

SEQ ID NO: 5068254 - DNA, 19 bp, Homo sapiens
aaaaagaggaaagaatgaa

SEQ ID NO: 5068255 - DNA, 20 bp, Homo sapiens
aaaaagagtatgagtcttct

SEQ ID NO: 5068256 - DNA, 19 bp, Homo sapiens
aaaaagagtcttaattttc

SEQ ID NO: 5068257 - DNA, 13 bp, Homo sapiens
aaaaagataaaga

SEQ ID NO: 5068258 - DNA, 13 bp, Homo sapiens
aaaaagatatatt

SEQ ID NO: 5068259 - DNA, 14 bp, Homo sapiens
aaaaagatccaggg

SEQ ID NO: 5068260 - DNA, 14 bp, Homo sapiens
aaaaagatcccaaa

SEQ ID NO: 5068261 - DNA, 16 bp, Homo sapiens
aaaaagatgacccatt

SEQ ID NO: 5068262 - DNA, 18 bp, Homo sapiens
aaaaagatgatcgctgta

SEQ ID NO: 5068263 - DNA, 21 bp, Homo sapiens
aaaaagatggatttgacacac

SEQ ID NO: 5068264 - DNA, 22 bp, Homo sapiens
aaaaagatttactttgtacatg

SEQ ID NO: 5068265 - DNA, 15 bp, Homo sapiens
aaaaagcaaaaatga

SEQ ID NO: 5068266 - DNA, 11 bp, Homo sapiens
aaaaagcaaat

SEQ ID NO: 5068267 - DNA, 15 bp, Homo sapiens
aaaaagcaaatcaga

SEQ ID NO: 5068268 - DNA, 15 bp, Homo sapiens
aaaaagcaacttttc

SEQ ID NO: 5068269 - DNA, 15 bp, Homo sapiens
aaaaagcaagggaga

SEQ ID NO: 5068270 - DNA, 14 bp, Homo sapiens
aaaaagcacaagaa

SEQ ID NO: 5068271 - DNA, 17 bp, Homo sapiens
aaaaagcacatacatta

SEQ ID NO: 5068272 - DNA, 13 bp, Homo sapiens
aaaaagcagacag

SEQ ID NO: 5068273 - DNA, 22 bp, Homo sapiens
aaaaagcagagtggactgcatt

SEQ ID NO: 5068274 - DNA, 13 bp, Homo sapiens
aaaaagcagctac

SEQ ID NO: 5068275 - DNA, 19 bp, Homo sapiens
aaaaagcaggactgtgcct

SEQ ID NO: 5068276 - DNA, 21 bp, Homo sapiens
aaaaagcagtttttgaaagac

SEQ ID NO: 5068277 - DNA, 20 bp, Homo sapiens
aaaaagcataaaaacatttt

SEQ ID NO: 5068278 - DNA, 17 bp, Homo sapiens
aaaaagcatcattacaa

SEQ ID NO: 5068279 - DNA, 13 bp, Homo sapiens
aaaaagcattaaa

SEQ ID NO: 5068280 - DNA, 23 bp, Homo sapiens
aaaaagccagtttgggtaaaata

SEQ ID NO: 5068281 - DNA, 14 bp, Homo sapiens
aaaaagccattgtt

SEQ ID NO: 5068282 - DNA, 12 bp, Homo sapiens
aaaaagcctcca

SEQ ID NO: 5068283 - DNA, 23 bp, Homo sapiens
aaaaagcctccaagggtttcgac

SEQ ID NO: 5068284 - DNA, 16 bp, Homo sapiens
aaaaagccttacagtt

SEQ ID NO: 5068285 - DNA, 23 bp, Homo sapiens
aaaaagccttgaagaaaatgact

SEQ ID NO: 5068286 - DNA, 18 bp, Homo sapiens
aaaaagcgaaaaaatcag

SEQ ID NO: 5068287 - DNA, 13 bp, Homo sapiens
aaaaagctaacat

SEQ ID NO: 5068288 - DNA, 22 bp, Homo sapiens
aaaaagctaatccctaaaatag

SEQ ID NO: 5068289 - DNA, 17 bp, Homo sapiens
aaaaagctaatgtgcag

SEQ ID NO: 5068290 - DNA, 19 bp, Homo sapiens
aaaaagctataaattatat

SEQ ID NO: 5068291 - DNA, 22 bp, Homo sapiens
aaaaagctatgtatcgctccta

SEQ ID NO: 5068292 - DNA, 18 bp, Homo sapiens
aaaaagctcactgctgat

SEQ ID NO: 5068293 - DNA, 18 bp, Homo sapiens
aaaaagctcatattttgt

SEQ ID NO: 5068294 - DNA, 17 bp, Homo sapiens
aaaaagctcatttcatg

SEQ ID NO: 5068295 - DNA, 21 bp, Homo sapiens
aaaaagctcatttcatgctct

SEQ ID NO: 5068296 - DNA, 18 bp, Homo sapiens
aaaaagctgaagcctatt

SEQ ID NO: 5068297 - DNA, 13 bp, Homo sapiens
aaaaagctggtgg

SEQ ID NO: 5068298 - DNA, 17 bp, Homo sapiens
aaaaagcttaaaacttt

SEQ ID NO: 5068299 - DNA, 20 bp, Homo sapiens
aaaaagcttaaaactttgaa

SEQ ID NO: 5068300 - DNA, 12 bp, Homo sapiens
aaaaagctttac

SEQ ID NO: 5068301 - DNA, 12 bp, Homo sapiens
aaaaagctttat

SEQ ID NO: 5068302 - DNA, 14 bp, Homo sapiens
aaaaagctttttcc

SEQ ID NO: 5068303 - DNA, 19 bp, Homo sapiens
aaaaaggaaaaaaaacaca

SEQ ID NO: 5068304 - DNA, 16 bp, Homo sapiens
aaaaaggaaaaaaaga

SEQ ID NO: 5068305 - DNA, 15 bp, Homo sapiens
aaaaaggaaaactca

SEQ ID NO: 5068306 - DNA, 15 bp, Homo sapiens
aaaaaggaaacttcc

SEQ ID NO: 5068307 - DNA, 19 bp, Homo sapiens
aaaaaggaaatatttttca

SEQ ID NO: 5068308 - DNA, 15 bp, Homo sapiens
aaaaaggaaattagt

SEQ ID NO: 5068309 - DNA, 20 bp, Homo sapiens
aaaaaggaaatttgtttgta

SEQ ID NO: 5068310 - DNA, 14 bp, Homo sapiens
aaaaaggactggaa

SEQ ID NO: 5068311 - DNA, 21 bp, Homo sapiens
aaaaaggactggaaaaatgaa

SEQ ID NO: 5068312 - DNA, 14 bp, Homo sapiens
aaaaaggagctctt

SEQ ID NO: 5068313 - DNA, 16 bp, Homo sapiens
aaaaaggatcatggtt

SEQ ID NO: 5068314 - DNA, 14 bp, Homo sapiens
aaaaaggcaaataa

SEQ ID NO: 5068315 - DNA, 15 bp, Homo sapiens
aaaaaggcaaatatt

SEQ ID NO: 5068316 - DNA, 17 bp, Homo sapiens
aaaaaggcaaatattga

SEQ ID NO: 5068317 - DNA, 16 bp, Homo sapiens
aaaaaggcaatcacat

SEQ ID NO: 5068318 - DNA, 13 bp, Homo sapiens
aaaaaggcagtta

SEQ ID NO: 5068319 - DNA, 19 bp, Homo sapiens
aaaaaggcatattgctttt

SEQ ID NO: 5068320 - DNA, 18 bp, Homo sapiens
aaaaaggccaaagataaa

SEQ ID NO: 5068321 - DNA, 18 bp, Homo sapiens
aaaaaggcctaatgcatt

SEQ ID NO: 5068322 - DNA, 21 bp, Homo sapiens
aaaaaggcctttgggatttgc

SEQ ID NO: 5068323 - DNA, 17 bp, Homo sapiens
aaaaaggctagtttatt

SEQ ID NO: 5068324 - DNA, 13 bp, Homo sapiens
aaaaaggctgaaa

SEQ ID NO: 5068325 - DNA, 22 bp, Homo sapiens
aaaaaggctgctcacaagttct

SEQ ID NO: 5068326 - DNA, 12 bp, Homo sapiens
aaaaagggaaaa

SEQ ID NO: 5068327 - DNA, 15 bp, Homo sapiens
aaaaagggaaaaaga

SEQ ID NO: 5068328 - DNA, 20 bp, Homo sapiens
aaaaagggaaaacaaatatt

SEQ ID NO: 5068329 - DNA, 21 bp, Homo sapiens
aaaaagggagaaagaaaactg

SEQ ID NO: 5068330 - DNA, 19 bp, Homo sapiens
aaaaagggctgtccatgta

SEQ ID NO: 5068331 - DNA, 22 bp, Homo sapiens
aaaaagggcttgaggtgaattt

SEQ ID NO: 5068332 - DNA, 14 bp, Homo sapiens
aaaaagggtaactt

SEQ ID NO: 5068333 - DNA, 22 bp, Homo sapiens
aaaaagggtaacttgtttttat

SEQ ID NO: 5068334 - DNA, 18 bp, Homo sapiens
aaaaagggtaagctagag

SEQ ID NO: 5068335 - DNA, 21 bp, Homo sapiens
aaaaagggtcaatgctatttt

SEQ ID NO: 5068336 - DNA, 20 bp, Homo sapiens
aaaaaggtataaataataat

SEQ ID NO: 5068337 - DNA, 18 bp, Homo sapiens
aaaaaggtggtatgtaat

SEQ ID NO: 5068338 - DNA, 11 bp, Homo sapiens
aaaaaggttta

SEQ ID NO: 5068339 - DNA, 14 bp, Homo sapiens
aaaaagtaaaaatt

SEQ ID NO: 5068340 - DNA, 15 bp, Homo sapiens
aaaaagtaaaaatta

SEQ ID NO: 5068341 - DNA, 14 bp, Homo sapiens
aaaaagtaacacac

SEQ ID NO: 5068342 - DNA, 18 bp, Homo sapiens
aaaaagtacaattcattg

SEQ ID NO: 5068343 - DNA, 21 bp, Homo sapiens
aaaaagtaccacattccatga

SEQ ID NO: 5068344 - DNA, 19 bp, Homo sapiens
aaaaagtaggaaatgaatg

SEQ ID NO: 5068345 - DNA, 11 bp, Homo sapiens
aaaaagtatat

SEQ ID NO: 5068346 - DNA, 17 bp, Homo sapiens
aaaaagtatatattcta

SEQ ID NO: 5068347 - DNA, 21 bp, Homo sapiens
aaaaagtatgttctaaaatta

SEQ ID NO: 5068348 - DNA, 13 bp, Homo sapiens
aaaaagtattatt

SEQ ID NO: 5068349 - DNA, 19 bp, Homo sapiens
aaaaagtattattttccaa

SEQ ID NO: 5068350 - DNA, 14 bp, Homo sapiens
aaaaagtatttttt

SEQ ID NO: 5068351 - DNA, 11 bp, Homo sapiens
aaaaagtcaat

SEQ ID NO: 5068352 - DNA, 16 bp, Homo sapiens
aaaaagtcaattcatc

SEQ ID NO: 5068353 - DNA, 24 bp, Homo sapiens
aaaaagtcaccattctgcatttag

SEQ ID NO: 5068354 - DNA, 14 bp, Homo sapiens
aaaaagtcagatgt

SEQ ID NO: 5068355 - DNA, 17 bp, Homo sapiens
aaaaagtcattgtaatc

SEQ ID NO: 5068356 - DNA, 15 bp, Homo sapiens
aaaaagtccttcagt

SEQ ID NO: 5068357 - DNA, 21 bp, Homo sapiens
aaaaagtccttcagtttagaa

SEQ ID NO: 5068358 - DNA, 22 bp, Homo sapiens
aaaaagtccttgcaagaatgga

SEQ ID NO: 5068359 - DNA, 18 bp, Homo sapiens
aaaaagtctctatttaaa

SEQ ID NO: 5068360 - DNA, 23 bp, Homo sapiens
aaaaagtctctatttaaattctt

SEQ ID NO: 5068361 - DNA, 14 bp, Homo sapiens
aaaaagtctgcatt

SEQ ID NO: 5068362 - DNA, 20 bp, Homo sapiens
aaaaagtcttaacaacagct

SEQ ID NO: 5068363 - DNA, 17 bp, Homo sapiens
aaaaagtgaaaaaaaga

SEQ ID NO: 5068364 - DNA, 19 bp, Homo sapiens
aaaaagtgaaaaaaagaaa

SEQ ID NO: 5068365 - DNA, 14 bp, Homo sapiens
aaaaagtgaaataa

SEQ ID NO: 5068366 - DNA, 16 bp, Homo sapiens
aaaaagtgaaataaga

SEQ ID NO: 5068367 - DNA, 20 bp, Homo sapiens
aaaaagtgaacttttgtaat

SEQ ID NO: 5068368 - DNA, 15 bp, Homo sapiens
aaaaagtgacacagc

SEQ ID NO: 5068369 - DNA, 19 bp, Homo sapiens
aaaaagtgacacagcagct

SEQ ID NO: 5068370 - DNA, 23 bp, Homo sapiens
aaaaagtgacacagcagcttcac

SEQ ID NO: 5068371 - DNA, 17 bp, Homo sapiens
aaaaagtgattgtgaag

SEQ ID NO: 5068372 - DNA, 16 bp, Homo sapiens
aaaaagtgcaacttga

SEQ ID NO: 5068373 - DNA, 17 bp, Homo sapiens
aaaaagtggaaaacatc

SEQ ID NO: 5068374 - DNA, 17 bp, Homo sapiens
aaaaagtggaatttctt

SEQ ID NO: 5068375 - DNA, 20 bp, Homo sapiens
aaaaagtggcgttgttcata

SEQ ID NO: 5068376 - DNA, 23 bp, Homo sapiens
aaaaagtgggttttttagttgaa

SEQ ID NO: 5068377 - DNA, 12 bp, Homo sapiens
aaaaagtgtcaa

SEQ ID NO: 5068378 - DNA, 14 bp, Homo sapiens
aaaaagtgtctcaa

SEQ ID NO: 5068379 - DNA, 16 bp, Homo sapiens
aaaaagtgtctcaaag

SEQ ID NO: 5068380 - DNA, 10 bp, Homo sapiens
aaaaagtgtt

SEQ ID NO: 5068381 - DNA, 22 bp, Homo sapiens
aaaaagtgttgatcaaccattc

SEQ ID NO: 5068382 - DNA, 12 bp, Homo sapiens
aaaaagtgttta

SEQ ID NO: 5068383 - DNA, 18 bp, Homo sapiens
aaaaagtgtttttacata

SEQ ID NO: 5068384 - DNA, 15 bp, Homo sapiens
aaaaagttaaatgtg

SEQ ID NO: 5068385 - DNA, 13 bp, Homo sapiens
aaaaagttaacat

SEQ ID NO: 5068386 - DNA, 16 bp, Homo sapiens
aaaaagttataagaaa

SEQ ID NO: 5068387 - DNA, 17 bp, Homo sapiens
aaaaagttatataggtt

SEQ ID NO: 5068388 - DNA, 13 bp, Homo sapiens
aaaaagttgaagg

SEQ ID NO: 5068389 - DNA, 15 bp, Homo sapiens
aaaaagttgcagctg

SEQ ID NO: 5068390 - DNA, 20 bp, Homo sapiens
aaaaagttgcagtctcagaa

SEQ ID NO: 5068391 - DNA, 20 bp, Homo sapiens
aaaaagttggtattttataa

SEQ ID NO: 5068392 - DNA, 13 bp, Homo sapiens
aaaagattaatgt

SEQ ID NO: 5068393 - DNA, 17 bp, Homo sapiens
aaaagattatatatcat

SEQ ID NO: 5068394 - DNA, 22 bp, Homo sapiens
aaaagattatatatcataaagt

SEQ ID NO: 5068395 - DNA, 15 bp, Homo sapiens
aaaagattatgtatt

SEQ ID NO: 5068396 - DNA, 23 bp, Homo sapiens
aaaagattcccttgaaatttaga

SEQ ID NO: 5068397 - DNA, 17 bp, Homo sapiens
aaaagattcttcttaaa

SEQ ID NO: 5068398 - DNA, 22 bp, Homo sapiens
aaaagattctttaaactactga

SEQ ID NO: 5068399 - DNA, 16 bp, Homo sapiens
aaaagattgctgaaat

SEQ ID NO: 5068400 - DNA, 21 bp, Homo sapiens
aaaagattgctgaaattttat

SEQ ID NO: 5068401 - DNA, 16 bp, Homo sapiens
aaaagatttgtttttg

SEQ ID NO: 5068402 - DNA, 9 bp, Homo sapiens
aaaagcaaa

SEQ ID NO: 5068403 - DNA, 20 bp, Homo sapiens
aaaagcaaaaaaaaaaaagg

SEQ ID NO: 5068404 - DNA, 19 bp, Homo sapiens
aaaagcaaaaatgacaaca

SEQ ID NO: 5068405 - DNA, 15 bp, Homo sapiens
aaaagcaaaattttt

SEQ ID NO: 5068406 - DNA, 14 bp, Homo sapiens
aaaagcaaatcaga

SEQ ID NO: 5068407 - DNA, 21 bp, Homo sapiens
aaaagcaaatcagaaaaccca

SEQ ID NO: 5068408 - DNA, 13 bp, Homo sapiens
aaaagcaaatcta

SEQ ID NO: 5068409 - DNA, 14 bp, Homo sapiens
aaaagcaacattca

SEQ ID NO: 5068410 - DNA, 14 bp, Homo sapiens
aaaagcaacttttc

SEQ ID NO: 5068411 - DNA, 13 bp, Homo sapiens
aaaagcaagaatt

SEQ ID NO: 5068412 - DNA, 18 bp, Homo sapiens
aaaagcaagggagaaaag

SEQ ID NO: 5068413 - DNA, 20 bp, Homo sapiens
aaaagcaagtactctggagc

SEQ ID NO: 5068414 - DNA, 20 bp, Homo sapiens
aaaagcaagtgttcactgct

SEQ ID NO: 5068415 - DNA, 15 bp, Homo sapiens
aaaagcaatattgta

SEQ ID NO: 5068416 - DNA, 21 bp, Homo sapiens
aaaagcaattaggtagcacag

SEQ ID NO: 5068417 - DNA, 13 bp, Homo sapiens
aaaagcacaaaat

SEQ ID NO: 5068418 - DNA, 13 bp, Homo sapiens
aaaagcacaagca

SEQ ID NO: 5068419 - DNA, 17 bp, Homo sapiens
aaaagcacaagtacttt

SEQ ID NO: 5068420 - DNA, 16 bp, Homo sapiens
aaaagcacaatcacta

SEQ ID NO: 5068421 - DNA, 22 bp, Homo sapiens
aaaagcacagaggatttcttta

SEQ ID NO: 5068422 - DNA, 12 bp, Homo sapiens
aaaagcacagct

SEQ ID NO: 5068423 - DNA, 17 bp, Homo sapiens
aaaagcacatacattaa

SEQ ID NO: 5068424 - DNA, 16 bp, Homo sapiens
aaaagcacctcttgaa

SEQ ID NO: 5068425 - DNA, 15 bp, Homo sapiens
aaaagcactcctgct

SEQ ID NO: 5068426 - DNA, 15 bp, Homo sapiens
aaaagcacttaaagt

SEQ ID NO: 5068427 - DNA, 18 bp, Homo sapiens
aaaagcacttactttttt

SEQ ID NO: 5068428 - DNA, 16 bp, Homo sapiens
aaaagcacttgaagaa

SEQ ID NO: 5068429 - DNA, 18 bp, Homo sapiens
aaaagcacttttgttatt

SEQ ID NO: 5068430 - DNA, 19 bp, Homo sapiens
aaaagcacttttgttattc

SEQ ID NO: 5068431 - DNA, 22 bp, Homo sapiens
aaaagcacttttgttattccat

SEQ ID NO: 5068432 - DNA, 14 bp, Homo sapiens
aaaagcacttttta

SEQ ID NO: 5068433 - DNA, 14 bp, Homo sapiens
aaaagcagacattt

SEQ ID NO: 5068434 - DNA, 16 bp, Homo sapiens
aaaagcagagcatttt

SEQ ID NO: 5068435 - DNA, 18 bp, Homo sapiens
aaaagcagagcatttttt

SEQ ID NO: 5068436 - DNA, 19 bp, Homo sapiens
aaaagcagcccttggccag

SEQ ID NO: 5068437 - DNA, 18 bp, Homo sapiens
aaaagcagcgtcactcta

SEQ ID NO: 5068438 - DNA, 20 bp, Homo sapiens
aaaagcagctaaatgtaact

SEQ ID NO: 5068439 - DNA, 14 bp, Homo sapiens
aaaagcagctacca

SEQ ID NO: 5068440 - DNA, 16 bp, Homo sapiens
aaaagcagctctcccc

SEQ ID NO: 5068441 - DNA, 23 bp, Homo sapiens
aaaagcagcttttagttcagact

SEQ ID NO: 5068442 - DNA, 18 bp, Homo sapiens
aaaagcaggactgtgcct

SEQ ID NO: 5068443 - DNA, 19 bp, Homo sapiens
aaaagcaggcctttgcaga

SEQ ID NO: 5068444 - DNA, 15 bp, Homo sapiens
aaaagcaggttttta

SEQ ID NO: 5068445 - DNA, 18 bp, Homo sapiens
aaaagcagtcccattcat

SEQ ID NO: 5068446 - DNA, 19 bp, Homo sapiens
aaaagcagttcatgtctga

SEQ ID NO: 5068447 - DNA, 19 bp, Homo sapiens
aaaagcatactctatgtga

SEQ ID NO: 5068448 - DNA, 16 bp, Homo sapiens
aaaagcatctgccaca

SEQ ID NO: 5068449 - DNA, 14 bp, Homo sapiens
aaaagcatgaattg

SEQ ID NO: 5068450 - DNA, 16 bp, Homo sapiens
aaaagcatgactattt

SEQ ID NO: 5068451 - DNA, 17 bp, Homo sapiens
aaaagcatgatgggaaa

SEQ ID NO: 5068452 - DNA, 14 bp, Homo sapiens
aaaagcatgtacag

SEQ ID NO: 5068453 - DNA, 18 bp, Homo sapiens
aaaagcatgtacagtgtt

SEQ ID NO: 5068454 - DNA, 14 bp, Homo sapiens
aaaagcattttgta

SEQ ID NO: 5068455 - DNA, 11 bp, Homo sapiens
aaaagccaaag

SEQ ID NO: 5068456 - DNA, 19 bp, Homo sapiens
aaaagccaacaaaccaaga

SEQ ID NO: 5068457 - DNA, 22 bp, Homo sapiens
aaaagccaacaggtaaacacat

SEQ ID NO: 5068458 - DNA, 16 bp, Homo sapiens
aaaagccaagaaagta

SEQ ID NO: 5068459 - DNA, 21 bp, Homo sapiens
aaaagccaaggtgtcatttat

SEQ ID NO: 5068460 - DNA, 11 bp, Homo sapiens
aaaagccagat

SEQ ID NO: 5068461 - DNA, 22 bp, Homo sapiens
aaaagccagccaagctttaaat

SEQ ID NO: 5068462 - DNA, 15 bp, Homo sapiens
aaaagccatatctag

SEQ ID NO: 5068463 - DNA, 14 bp, Homo sapiens
aaaagccatgtata

SEQ ID NO: 5068464 - DNA, 18 bp, Homo sapiens
aaaagccattattatgat

SEQ ID NO: 5068465 - DNA, 10 bp, Homo sapiens
aaaagcccag

SEQ ID NO: 5068466 - DNA, 11 bp, Homo sapiens
aaaagcccagt

SEQ ID NO: 5068467 - DNA, 20 bp, Homo sapiens
aaaagcccagtgacctgacc

SEQ ID NO: 5068468 - DNA, 21 bp, Homo sapiens
aaaagccctagactggtgcta

SEQ ID NO: 5068469 - DNA, 16 bp, Homo sapiens
aaaagcctctggtgga

SEQ ID NO: 5068470 - DNA, 16 bp, Homo sapiens
aaaagcctgaactatt

SEQ ID NO: 5068471 - DNA, 19 bp, Homo sapiens
aaaagcctgcaatttcata

SEQ ID NO: 5068472 - DNA, 14 bp, Homo sapiens
aaaagccttccagt

SEQ ID NO: 5068473 - DNA, 13 bp, Homo sapiens
aaaagccttctta

SEQ ID NO: 5068474 - DNA, 23 bp, Homo sapiens
aaaagcctttcataccagtcagt

SEQ ID NO: 5068475 - DNA, 17 bp, Homo sapiens
aaaagcgctaatttcta

SEQ ID NO: 5068476 - DNA, 15 bp, Homo sapiens
aaaagcgtctttaag

SEQ ID NO: 5068477 - DNA, 20 bp, Homo sapiens
aaaagcgtctttaagagact

SEQ ID NO: 5068478 - DNA, 16 bp, Homo sapiens
aaaagctaaattacat

SEQ ID NO: 5068479 - DNA, 15 bp, Homo sapiens
aaaagctaacatctt

SEQ ID NO: 5068480 - DNA, 17 bp, Homo sapiens
aaaagctagaacactgc

SEQ ID NO: 5068481 - DNA, 21 bp, Homo sapiens
aaaagctagtgtacctcctct

SEQ ID NO: 5068482 - DNA, 19 bp, Homo sapiens
aaaagctatcttaaaatat

SEQ ID NO: 5068483 - DNA, 14 bp, Homo sapiens
aaaagctattaaag

SEQ ID NO: 5068484 - DNA, 15 bp, Homo sapiens
aaaagctattaaagt

SEQ ID NO: 5068485 - DNA, 13 bp, Homo sapiens
aaaagctcactgc

SEQ ID NO: 5068486 - DNA, 16 bp, Homo sapiens
aaaagctcactgctga

SEQ ID NO: 5068487 - DNA, 17 bp, Homo sapiens
aaaagctcactgctgat

SEQ ID NO: 5068488 - DNA, 17 bp, Homo sapiens
aaaagctcatttcatgc

SEQ ID NO: 5068489 - DNA, 22 bp, Homo sapiens
aaaagctccatgtgcctctttg

SEQ ID NO: 5068490 - DNA, 22 bp, Homo sapiens
aaaagctccatttttagtgaaa

SEQ ID NO: 5068491 - DNA, 16 bp, Homo sapiens
aaaagctctagataaa

SEQ ID NO: 5068492 - DNA, 14 bp, Homo sapiens
aaaagctcttttaa

SEQ ID NO: 5068493 - DNA, 23 bp, Homo sapiens
aaaagctgatcataagtgaattt

SEQ ID NO: 5068494 - DNA, 14 bp, Homo sapiens
aaaagctggtcttt

SEQ ID NO: 5068495 - DNA, 20 bp, Homo sapiens
aaaagctgtagctggagaag

SEQ ID NO: 5068496 - DNA, 20 bp, Homo sapiens
aaaagctgtgtactttatag

SEQ ID NO: 5068497 - DNA, 16 bp, Homo sapiens
aaaagctgtgtctctg

SEQ ID NO: 5068498 - DNA, 21 bp, Homo sapiens
aaaagcttcttaattaatttg

SEQ ID NO: 5068499 - DNA, 22 bp, Homo sapiens
aaaagcttcttaattaatttga

SEQ ID NO: 5068500 - DNA, 16 bp, Homo sapiens
aaaagcttgtgtatct

SEQ ID NO: 5068501 - DNA, 13 bp, Homo sapiens
aaaagctttgttt

SEQ ID NO: 5068502 - DNA, 13 bp, Homo sapiens
aaaagcttttgtc

SEQ ID NO: 5068503 - DNA, 21 bp, Homo sapiens
aaaagcttttgttttgcttac

SEQ ID NO: 5068504 - DNA, 14 bp, Homo sapiens
aaaagctttttgat

SEQ ID NO: 5068505 - DNA, 11 bp, Homo sapiens
aaaaggaaaaa

SEQ ID NO: 5068506 - DNA, 13 bp, Homo sapiens
aaaaggaaaaaaa

SEQ ID NO: 5068507 - DNA, 21 bp, Homo sapiens
aaaaggaaaaaaagactcttt

SEQ ID NO: 5068508 - DNA, 14 bp, Homo sapiens
aaaaggaaaaaaga

SEQ ID NO: 5068509 - DNA, 14 bp, Homo sapiens
aaaaggaaaaagct

SEQ ID NO: 5068510 - DNA, 18 bp, Homo sapiens
aaaaggaaaaataatcaa

SEQ ID NO: 5068511 - DNA, 14 bp, Homo sapiens
aaaaggaaaaatgt

SEQ ID NO: 5068512 - DNA, 11 bp, Homo sapiens
aaaaggaaaac

SEQ ID NO: 5068513 - DNA, 22 bp, Homo sapiens
aaaaggaaaactcaccatttca

SEQ ID NO: 5068514 - DNA, 12 bp, Homo sapiens
aaaaggaaaaga

SEQ ID NO: 5068515 - DNA, 14 bp, Homo sapiens
aaaaggaaacttcc

SEQ ID NO: 5068516 - DNA, 19 bp, Homo sapiens
aaaaggaaagtttgccagg

SEQ ID NO: 5068517 - DNA, 23 bp, Homo sapiens
aaaaggaaagtttgccaggagga

SEQ ID NO: 5068518 - DNA, 22 bp, Homo sapiens
aaaaggaaatattctttctcat

SEQ ID NO: 5068519 - DNA, 23 bp, Homo sapiens
aaaaggaaatattctttctcata

SEQ ID NO: 5068520 - DNA, 15 bp, Homo sapiens
aaaaggaaatatttt

SEQ ID NO: 5068521 - DNA, 19 bp, Homo sapiens
aaaaggaacaaaaattaca

SEQ ID NO: 5068522 - DNA, 14 bp, Homo sapiens
aaaaggaactgcag

SEQ ID NO: 5068523 - DNA, 16 bp, Homo sapiens
aaaaggaactgcagca

SEQ ID NO: 5068524 - DNA, 13 bp, Homo sapiens
aaaaggaaggaga

SEQ ID NO: 5068525 - DNA, 21 bp, Homo sapiens
aaaaggaaggtagttcaagaa

SEQ ID NO: 5068526 - DNA, 22 bp, Homo sapiens
aaaaggaagtggggacagattc

SEQ ID NO: 5068527 - DNA, 14 bp, Homo sapiens
aaaaggaatgaact

SEQ ID NO: 5068528 - DNA, 17 bp, Homo sapiens
aaaaggaatgatatatt

SEQ ID NO: 5068529 - DNA, 21 bp, Homo sapiens
aaaaggaatgcaagagaagga

SEQ ID NO: 5068530 - DNA, 21 bp, Homo sapiens
aaaaggacaaataaaacatgg

SEQ ID NO: 5068531 - DNA, 21 bp, Homo sapiens
aaaaggacaggcagaaagagt

SEQ ID NO: 5068532 - DNA, 14 bp, Homo sapiens
aaaaggactggaaa

SEQ ID NO: 5068533 - DNA, 14 bp, Homo sapiens
aaaaggagaataag

SEQ ID NO: 5068534 - DNA, 18 bp, Homo sapiens
aaaaggagcgggcagggc

SEQ ID NO: 5068535 - DNA, 19 bp, Homo sapiens
aaaaggaggatagaaaaag

SEQ ID NO: 5068536 - DNA, 21 bp, Homo sapiens
aaaaggaggggacgggacaga

SEQ ID NO: 5068537 - DNA, 18 bp, Homo sapiens
aaaaggagtcaagaacaa

SEQ ID NO: 5068538 - DNA, 15 bp, Homo sapiens
aaaaggatacataat

SEQ ID NO: 5068539 - DNA, 19 bp, Homo sapiens
aaaaggatctttgtggcca

SEQ ID NO: 5068540 - DNA, 17 bp, Homo sapiens
aaaaggatgatggaaaa

SEQ ID NO: 5068541 - DNA, 14 bp, Homo sapiens
aaaaggatgcacag

SEQ ID NO: 5068542 - DNA, 22 bp, Homo sapiens
aaaaggatgcacagagttgtta

SEQ ID NO: 5068543 - DNA, 15 bp, Homo sapiens
aaaaggatggaagaa

SEQ ID NO: 5068544 - DNA, 23 bp, Homo sapiens
aaaaggatggaagaaagaagcat

SEQ ID NO: 5068545 - DNA, 17 bp, Homo sapiens
aaaaggatgtataaatt

SEQ ID NO: 5068546 - DNA, 16 bp, Homo sapiens
aaaaggatgttacaag

SEQ ID NO: 5068547 - DNA, 17 bp, Homo sapiens
aaaaggatgttacaagt

SEQ ID NO: 5068548 - DNA, 21 bp, Homo sapiens
aaaaggatgttacaagtttgc

SEQ ID NO: 5068549 - DNA, 11 bp, Homo sapiens
aaaaggattaa

SEQ ID NO: 5068550 - DNA, 16 bp, Homo sapiens
aaaaggcaaaagactg

SEQ ID NO: 5068551 - DNA, 14 bp, Homo sapiens
aaaaggcaaatatt

SEQ ID NO: 5068552 - DNA, 17 bp, Homo sapiens
aaaaggcaaatattgaa

SEQ ID NO: 5068553 - DNA, 20 bp, Homo sapiens
aaaaggcaactcaaagatga

SEQ ID NO: 5068554 - DNA, 21 bp, Homo sapiens
aaaaggcagcatttgaatact

SEQ ID NO: 5068555 - DNA, 14 bp, Homo sapiens
aaaaggcagccaga

SEQ ID NO: 5068556 - DNA, 23 bp, Homo sapiens
aaaaggcagccagatccccaggg

SEQ ID NO: 5068557 - DNA, 13 bp, Homo sapiens
aaaaggcagttac

SEQ ID NO: 5068558 - DNA, 14 bp, Homo sapiens
aaaaggcattgttt

SEQ ID NO: 5068559 - DNA, 14 bp, Homo sapiens
aaaaggccaaacct

SEQ ID NO: 5068560 - DNA, 17 bp, Homo sapiens
aaaaggccaaagataaa

SEQ ID NO: 5068561 - DNA, 15 bp, Homo sapiens
aaaaggccaatatac

SEQ ID NO: 5068562 - DNA, 17 bp, Homo sapiens
aaaaggccaatatacct

SEQ ID NO: 5068563 - DNA, 14 bp, Homo sapiens
aaaaggccctgtgg

SEQ ID NO: 5068564 - DNA, 20 bp, Homo sapiens
aaaaggcctaatgcattatt

SEQ ID NO: 5068565 - DNA, 11 bp, Homo sapiens
aaaaggcctgg

SEQ ID NO: 5068566 - DNA, 12 bp, Homo sapiens
aaaaggcctggg

SEQ ID NO: 5068567 - DNA, 14 bp, Homo sapiens
aaaaggcctttggg

SEQ ID NO: 5068568 - DNA, 19 bp, Homo sapiens
aaaaggcctttgggatttg

SEQ ID NO: 5068569 - DNA, 15 bp, Homo sapiens
aaaaggctgagaagg

SEQ ID NO: 5068570 - DNA, 20 bp, Homo sapiens
aaaaggctgcagctaatttg

SEQ ID NO: 5068571 - DNA, 19 bp, Homo sapiens
aaaaggcttataaaacaga

SEQ ID NO: 5068572 - DNA, 16 bp, Homo sapiens
aaaagggaaaaaagaa

SEQ ID NO: 5068573 - DNA, 13 bp, Homo sapiens
aaaaaaaaaaact

SEQ ID NO: 5068574 - DNA, 13 bp, Homo sapiens
aaaaaaaaaaaga

SEQ ID NO: 5068575 - DNA, 14 bp, Homo sapiens
aaaaaaaaaacact

SEQ ID NO: 5068576 - DNA, 13 bp, Homo sapiens
aaaaaaaaaatat

SEQ ID NO: 5068577 - DNA, 13 bp, Homo sapiens
aaaaaaaaagcaa

SEQ ID NO: 5068578 - DNA, 12 bp, Homo sapiens
aaaaaaaaagcg

SEQ ID NO: 5068579 - DNA, 13 bp, Homo sapiens
aaaaaaaaatatg

SEQ ID NO: 5068580 - DNA, 13 bp, Homo sapiens
aaaaaaaaatgtt

SEQ ID NO: 5068581 - DNA, 14 bp, Homo sapiens
aaaaaaaaattgca

SEQ ID NO: 5068582 - DNA, 11 bp, Homo sapiens
aaaaaaaacaa

SEQ ID NO: 5068583 - DNA, 12 bp, Homo sapiens
aaaaaaaacaaa

SEQ ID NO: 5068584 - DNA, 11 bp, Homo sapiens
aaaaaaaacac

SEQ ID NO: 5068585 - DNA, 13 bp, Homo sapiens
aaaaaaaacactt

SEQ ID NO: 5068586 - DNA, 12 bp, Homo sapiens
aaaaaaaacagt

SEQ ID NO: 5068587 - DNA, 12 bp, Homo sapiens
aaaaaaaagctt

SEQ ID NO: 5068588 - DNA, 13 bp, Homo sapiens
aaaaaaaagcttc

SEQ ID NO: 5068589 - DNA, 12 bp, Homo sapiens
aaaaaaaagtta

SEQ ID NO: 5068590 - DNA, 13 bp, Homo sapiens
aaaaaaaatactt

SEQ ID NO: 5068591 - DNA, 12 bp, Homo sapiens
aaaaaaaatata

SEQ ID NO: 5068592 - DNA, 11 bp, Homo sapiens
aaaaaaaatgg

SEQ ID NO: 5068593 - DNA, 13 bp, Homo sapiens
aaaaaaaatgtga

SEQ ID NO: 5068594 - DNA, 13 bp, Homo sapiens
aaaaaaaattact

SEQ ID NO: 5068595 - DNA, 13 bp, Homo sapiens
aaaaaaaattccc

SEQ ID NO: 5068596 - DNA, 13 bp, Homo sapiens
aaaaaaaattgca

SEQ ID NO: 5068597 - DNA, 13 bp, Homo sapiens
aaaaaaaattgta

SEQ ID NO: 5068598 - DNA, 13 bp, Homo sapiens
aaaaaaacacaaa

SEQ ID NO: 5068599 - DNA, 11 bp, Homo sapiens
aaaaaaaccac

SEQ ID NO: 5068600 - DNA, 13 bp, Homo sapiens
aaaaaaacccagg

SEQ ID NO: 5068601 - DNA, 11 bp, Homo sapiens
aaaaaaactga

SEQ ID NO: 5068602 - DNA, 11 bp, Homo sapiens
aaaaaaactgt

SEQ ID NO: 5068603 - DNA, 9 bp, Homo sapiens
aaaaaaaga

SEQ ID NO: 5068604 - DNA, 11 bp, Homo sapiens
aaaaaaagaaa

SEQ ID NO: 5068605 - DNA, 13 bp, Homo sapiens
aaaaaaagaaaat

SEQ ID NO: 5068606 - DNA, 14 bp, Homo sapiens
aaaaaaagaagtta

SEQ ID NO: 5068607 - DNA, 11 bp, Homo sapiens
aaaaaaagaat

SEQ ID NO: 5068608 - DNA, 13 bp, Homo sapiens
aaaaaaagaataa

SEQ ID NO: 5068609 - DNA, 10 bp, Homo sapiens
aaaaaaagac

SEQ ID NO: 5068610 - DNA, 10 bp, Homo sapiens
aaaaaaagat

SEQ ID NO: 5068611 - DNA, 12 bp, Homo sapiens
aaaaaaagatga

SEQ ID NO: 5068612 - DNA, 12 bp, Homo sapiens
aaaaaaagcatg

SEQ ID NO: 5068613 - DNA, 12 bp, Homo sapiens
aaaaaaagctgc

SEQ ID NO: 5068614 - DNA, 13 bp, Homo sapiens
aaaaaaaggaaaa

SEQ ID NO: 5068615 - DNA, 10 bp, Homo sapiens
aaaaaaagtg

SEQ ID NO: 5068616 - DNA, 11 bp, Homo sapiens
aaaaaaagtgc

SEQ ID NO: 5068617 - DNA, 10 bp, Homo sapiens
aaaaaaataa

SEQ ID NO: 5068618 - DNA, 12 bp, Homo sapiens
aaaaaaataact

SEQ ID NO: 5068619 - DNA, 13 bp, Homo sapiens
aaaaaaataggat

SEQ ID NO: 5068620 - DNA, 12 bp, Homo sapiens
aaaaaaatataa

SEQ ID NO: 5068621 - DNA, 12 bp, Homo sapiens
aaaaaaatatat

SEQ ID NO: 5068622 - DNA, 10 bp, Homo sapiens
aaaaaaatca

SEQ ID NO: 5068623 - DNA, 11 bp, Homo sapiens
aaaaaaatcaa

SEQ ID NO: 5068624 - DNA, 12 bp, Homo sapiens
aaaaaaatcaaa

SEQ ID NO: 5068625 - DNA, 14 bp, Homo sapiens
aaaaaaatctgcag

SEQ ID NO: 5068626 - DNA, 13 bp, Homo sapiens
aaaaaaatgaatg

SEQ ID NO: 5068627 - DNA, 13 bp, Homo sapiens
aaaaaaatgtatt

SEQ ID NO: 5068628 - DNA, 13 bp, Homo sapiens
aaaaaaatgtgaa

SEQ ID NO: 5068629 - DNA, 12 bp, Homo sapiens
aaaaaaattgca

SEQ ID NO: 5068630 - DNA, 12 bp, Homo sapiens
aaaaaaattggc

SEQ ID NO: 5068631 - DNA, 10 bp, Homo sapiens
aaaaaaattt

SEQ ID NO: 5068632 - DNA, 11 bp, Homo sapiens
aaaaaaatttg

SEQ ID NO: 5068633 - DNA, 12 bp, Homo sapiens
aaaaaacaaaaa

SEQ ID NO: 5068634 - DNA, 12 bp, Homo sapiens
aaaaaacaagta

SEQ ID NO: 5068635 - DNA, 12 bp, Homo sapiens
aaaaaacaagtc

SEQ ID NO: 5068636 - DNA, 15 bp, Homo sapiens
aaaaaacagaggcca

SEQ ID NO: 5068637 - DNA, 11 bp, Homo sapiens
aaaaaacatac

SEQ ID NO: 5068638 - DNA, 13 bp, Homo sapiens
aaaaaacatttat

SEQ ID NO: 5068639 - DNA, 12 bp, Homo sapiens
aaaaaacatttt

SEQ ID NO: 5068640 - DNA, 13 bp, Homo sapiens
aaaaaacatttta

SEQ ID NO: 5068641 - DNA, 22 bp, Homo sapiens
aaaaaactacaaaaaccctaat

SEQ ID NO: 5068642 - DNA, 13 bp, Homo sapiens
aaaaaactcctgt

SEQ ID NO: 5068643 - DNA, 20 bp, Homo sapiens
aaaaaactcttaatctgtgt

SEQ ID NO: 5068644 - DNA, 22 bp, Homo sapiens
aaaaaactgctgactgttttct

SEQ ID NO: 5068645 - DNA, 11 bp, Homo sapiens
aaaaaagaaaa

SEQ ID NO: 5068646 - DNA, 20 bp, Homo sapiens
aaaaaagaaaacattccaga

SEQ ID NO: 5068647 - DNA, 12 bp, Homo sapiens
aaaaaagaaacg

SEQ ID NO: 5068648 - DNA, 13 bp, Homo sapiens
aaaaaagaaatga

SEQ ID NO: 5068649 - DNA, 10 bp, Homo sapiens
aaaaaagaac

SEQ ID NO: 5068650 - DNA, 13 bp, Homo sapiens
aaaaaagaaccaa

SEQ ID NO: 5068651 - DNA, 13 bp, Homo sapiens
aaaaaagaagtgt

SEQ ID NO: 5068652 - DNA, 9 bp, Homo sapiens
aaaaaagac

SEQ ID NO: 5068653 - DNA, 11 bp, Homo sapiens
aaaaaagactg

SEQ ID NO: 5068654 - DNA, 12 bp, Homo sapiens
aaaaaagactga

SEQ ID NO: 5068655 - DNA, 12 bp, Homo sapiens
aaaaaagactgt

SEQ ID NO: 5068656 - DNA, 12 bp, Homo sapiens
aaaaaagaggaa

SEQ ID NO: 5068657 - DNA, 13 bp, Homo sapiens
aaaaaagatatat

SEQ ID NO: 5068658 - DNA, 12 bp, Homo sapiens
aaaaaagatttg

SEQ ID NO: 5068659 - DNA, 11 bp, Homo sapiens
aaaaaagcaca

SEQ ID NO: 5068660 - DNA, 13 bp, Homo sapiens
aaaaaagctttat

SEQ ID NO: 5068661 - DNA, 12 bp, Homo sapiens
aaaaaaggaaaa

SEQ ID NO: 5068662 - DNA, 19 bp, Homo sapiens
aaaaaaggacaatttcaaa

SEQ ID NO: 5068663 - DNA, 13 bp, Homo sapiens
aaaaaagggctga

SEQ ID NO: 5068664 - DNA, 19 bp, Homo sapiens
aaaaaaggttaatttttcc

SEQ ID NO: 5068665 - DNA, 16 bp, Homo sapiens
aaaaaagtcaccaaat

SEQ ID NO: 5068666 - DNA, 20 bp, Homo sapiens
aaaaaagtcaccattctgca

SEQ ID NO: 5068667 - DNA, 24 bp, Homo sapiens
aaaaaagtcaccattctgcattta

SEQ ID NO: 5068668 - DNA, 12 bp, Homo sapiens
aaaaaagtgagc

SEQ ID NO: 5068669 - DNA, 12 bp, Homo sapiens
aaaaaagttata

SEQ ID NO: 5068670 - DNA, 21 bp, Homo sapiens
aaaaaagtttttaatttgatg

SEQ ID NO: 5068671 - DNA, 13 bp, Homo sapiens
aaaaaataaaaag

SEQ ID NO: 5068672 - DNA, 12 bp, Homo sapiens
aaaaaataaaat

SEQ ID NO: 5068673 - DNA, 21 bp, Homo sapiens
aaaaaataacatattcttgct

SEQ ID NO: 5068674 - DNA, 12 bp, Homo sapiens
aaaaaataatat

SEQ ID NO: 5068675 - DNA, 12 bp, Homo sapiens
aaaaaataatta

SEQ ID NO: 5068676 - DNA, 12 bp, Homo sapiens
aaaaaataattt

SEQ ID NO: 5068677 - DNA, 13 bp, Homo sapiens
aaaaaatacagta

SEQ ID NO: 5068678 - DNA, 20 bp, Homo sapiens
aaaaaatagatgtcttttat

SEQ ID NO: 5068679 - DNA, 21 bp, Homo sapiens
aaaaaatagatgtcttttata

SEQ ID NO: 5068680 - DNA, 11 bp, Homo sapiens
aaaaaatatat

SEQ ID NO: 5068681 - DNA, 13 bp, Homo sapiens
aaaaaatatttat

SEQ ID NO: 5068682 - DNA, 13 bp, Homo sapiens
aaaaaatctaaca

SEQ ID NO: 5068683 - DNA, 13 bp, Homo sapiens
aaaaaatctatcc

SEQ ID NO: 5068684 - DNA, 12 bp, Homo sapiens
aaaaaatgaaat

SEQ ID NO: 5068685 - DNA, 15 bp, Homo sapiens
aaaaaatgcgtatat

SEQ ID NO: 5068686 - DNA, 12 bp, Homo sapiens
aaaaaatgcttc

SEQ ID NO: 5068687 - DNA, 12 bp, Homo sapiens
aaaaaatggcaa

SEQ ID NO: 5068688 - DNA, 11 bp, Homo sapiens
aaaaaatgtcc

SEQ ID NO: 5068689 - DNA, 16 bp, Homo sapiens
aaaaaatgtttttaaa

SEQ ID NO: 5068690 - DNA, 11 bp, Homo sapiens
aaaaaattaaa

SEQ ID NO: 5068691 - DNA, 21 bp, Homo sapiens
aaaaaattattcatgctctca

SEQ ID NO: 5068692 - DNA, 12 bp, Homo sapiens
aaaaaattcaca

SEQ ID NO: 5068693 - DNA, 11 bp, Homo sapiens
aaaaaattgca

SEQ ID NO: 5068694 - DNA, 18 bp, Homo sapiens
aaaaaattggggattctt

SEQ ID NO: 5068695 - DNA, 23 bp, Homo sapiens
aaaaaattggggattcttaaagt

SEQ ID NO: 5068696 - DNA, 11 bp, Homo sapiens
aaaaaattggt

SEQ ID NO: 5068697 - DNA, 16 bp, Homo sapiens
aaaaaattgtttttcc

SEQ ID NO: 5068698 - DNA, 21 bp, Homo sapiens
aaaaaatttaaaattacgttt

SEQ ID NO: 5068699 - DNA, 14 bp, Homo sapiens
aaaaaatttaagtg

SEQ ID NO: 5068700 - DNA, 13 bp, Homo sapiens
aaaaaatttatac

SEQ ID NO: 5068701 - DNA, 19 bp, Homo sapiens
aaaaaattttaaaaatcta

SEQ ID NO: 5068702 - DNA, 19 bp, Homo sapiens
aaaaaattttgtaattttc

SEQ ID NO: 5068703 - DNA, 23 bp, Homo sapiens
aaaaacaaaataccaccctacaa

SEQ ID NO: 5068704 - DNA, 15 bp, Homo sapiens
aaaaacaaaatgtta

SEQ ID NO: 5068705 - DNA, 22 bp, Homo sapiens
aaaaacaaacaaaaaactgcct

SEQ ID NO: 5068706 - DNA, 15 bp, Homo sapiens
aaaaacaaacaaaca

SEQ ID NO: 5068707 - DNA, 13 bp, Homo sapiens
aaaaacaaagaaa

SEQ ID NO: 5068708 - DNA, 11 bp, Homo sapiens
aaaaacaaagc

SEQ ID NO: 5068709 - DNA, 13 bp, Homo sapiens
aaaaacaaagctg

SEQ ID NO: 5068710 - DNA, 15 bp, Homo sapiens
aaaaacaaatgttag

SEQ ID NO: 5068711 - DNA, 13 bp, Homo sapiens
aaaaacaacaaat

SEQ ID NO: 5068712 - DNA, 12 bp, Homo sapiens
aaaaacaaccaa

SEQ ID NO: 5068713 - DNA, 18 bp, Homo sapiens
aaaaacaagactgcctcc

SEQ ID NO: 5068714 - DNA, 23 bp, Homo sapiens
aaaaacaagtcatttttgtattt

SEQ ID NO: 5068715 - DNA, 22 bp, Homo sapiens
aaaaacaataaagatacatgat

SEQ ID NO: 5068716 - DNA, 13 bp, Homo sapiens
aaaaacaatatat

SEQ ID NO: 5068717 - DNA, 23 bp, Homo sapiens
aaaaacaatatatgtaaattata

SEQ ID NO: 5068718 - DNA, 22 bp, Homo sapiens
aaaaacaattggttgtatataa

SEQ ID NO: 5068719 - DNA, 23 bp, Homo sapiens
aaaaacaattggttgtatataaa

SEQ ID NO: 5068720 - DNA, 17 bp, Homo sapiens
aaaaacaatttttgaaa

SEQ ID NO: 5068721 - DNA, 17 bp, Homo sapiens
aaaaacacaaaaaaaga

SEQ ID NO: 5068722 - DNA, 13 bp, Homo sapiens
aaaaacacagcaa

SEQ ID NO: 5068723 - DNA, 18 bp, Homo sapiens
aaaaacacagcaagggtg

SEQ ID NO: 5068724 - DNA, 18 bp, Homo sapiens
aaaaacacggcagctgta

SEQ ID NO: 5068725 - DNA, 23 bp, Homo sapiens
aaaaacactacttttgctttttt

SEQ ID NO: 5068726 - DNA, 12 bp, Homo sapiens
aaaaacagaaaa

SEQ ID NO: 5068727 - DNA, 20 bp, Homo sapiens
aaaaacagattctgattccc

SEQ ID NO: 5068728 - DNA, 21 bp, Homo sapiens
aaaaacagcattgctttctga

SEQ ID NO: 5068729 - DNA, 19 bp, Homo sapiens
aaaaacagcctcacagaag

SEQ ID NO: 5068730 - DNA, 10 bp, Homo sapiens
aaaaacagct

SEQ ID NO: 5068731 - DNA, 11 bp, Homo sapiens
aaaaacagctt

SEQ ID NO: 5068732 - DNA, 16 bp, Homo sapiens
aaaaacataaaaagca

SEQ ID NO: 5068733 - DNA, 20 bp, Homo sapiens
aaaaacatacttacatttca

SEQ ID NO: 5068734 - DNA, 14 bp, Homo sapiens
aaaaacatattctt

SEQ ID NO: 5068735 - DNA, 19 bp, Homo sapiens
aaaaacatcccaaacttta

SEQ ID NO: 5068736 - DNA, 15 bp, Homo sapiens
aaaaacatctgaaga

SEQ ID NO: 5068737 - DNA, 11 bp, Homo sapiens
aaaaacatgct

SEQ ID NO: 5068738 - DNA, 16 bp, Homo sapiens
aaaaacatgtatgtgc

SEQ ID NO: 5068739 - DNA, 11 bp, Homo sapiens
aaaaacatgtc

SEQ ID NO: 5068740 - DNA, 15 bp, Homo sapiens
aaaaacatgtcatgt

SEQ ID NO: 5068741 - DNA, 11 bp, Homo sapiens
aaaaacattat

SEQ ID NO: 5068742 - DNA, 13 bp, Homo sapiens
aaaaacattgaaa

SEQ ID NO: 5068743 - DNA, 17 bp, Homo sapiens
aaaaacattgaaatatt

SEQ ID NO: 5068744 - DNA, 20 bp, Homo sapiens
aaaaacattgaaatattagt

SEQ ID NO: 5068745 - DNA, 15 bp, Homo sapiens
aaaaacattgccttt

SEQ ID NO: 5068746 - DNA, 11 bp, Homo sapiens
aaaaacattta

SEQ ID NO: 5068747 - DNA, 13 bp, Homo sapiens
aaaaacatttaaa

SEQ ID NO: 5068748 - DNA, 11 bp, Homo sapiens
aaaaacatttt

SEQ ID NO: 5068749 - DNA, 20 bp, Homo sapiens
aaaaacattttaaaatcaac

SEQ ID NO: 5068750 - DNA, 22 bp, Homo sapiens
aaaaacattttatttttaaaat

SEQ ID NO: 5068751 - DNA, 20 bp, Homo sapiens
aaaaacattttttatacatt

SEQ ID NO: 5068752 - DNA, 15 bp, Homo sapiens
aaaaaccaacatcta

SEQ ID NO: 5068753 - DNA, 17 bp, Homo sapiens
aaaaaccaatgattcat

SEQ ID NO: 5068754 - DNA, 16 bp, Homo sapiens
aaaaaccacacaaaga

SEQ ID NO: 5068755 - DNA, 22 bp, Homo sapiens
aaaaaccacccacaaagaaaca

SEQ ID NO: 5068756 - DNA, 18 bp, Homo sapiens
aaaaaccataaacatttg

SEQ ID NO: 5068757 - DNA, 19 bp, Homo sapiens
aaaaaccatctgtaaaaga

SEQ ID NO: 5068758 - DNA, 22 bp, Homo sapiens
aaaaaccattataaaatctttc

SEQ ID NO: 5068759 - DNA, 17 bp, Homo sapiens
aaaaaccctaattttgt

SEQ ID NO: 5068760 - DNA, 17 bp, Homo sapiens
aaaaaccctatatgctt

SEQ ID NO: 5068761 - DNA, 18 bp, Homo sapiens
aaaaaccctatatgctta

SEQ ID NO: 5068762 - DNA, 21 bp, Homo sapiens
aaaaaccctatatgcttactg

SEQ ID NO: 5068763 - DNA, 16 bp, Homo sapiens
aaaaaccgaataaatg

SEQ ID NO: 5068764 - DNA, 14 bp, Homo sapiens
aaaaaccgttcaaa

SEQ ID NO: 5068765 - DNA, 19 bp, Homo sapiens
aaaaacctattttgaaagg

SEQ ID NO: 5068766 - DNA, 23 bp, Homo sapiens
aaaaagttggtattttataagca

SEQ ID NO: 5068767 - DNA, 21 bp, Homo sapiens
aaaaagttgtaatagagaata

SEQ ID NO: 5068768 - DNA, 14 bp, Homo sapiens
aaaaagttgttctt

SEQ ID NO: 5068769 - DNA, 19 bp, Homo sapiens
aaaaagttgttttatccat

SEQ ID NO: 5068770 - DNA, 12 bp, Homo sapiens
aaaaagtttaaa

SEQ ID NO: 5068771 - DNA, 17 bp, Homo sapiens
aaaaagtttgttacttt

SEQ ID NO: 5068772 - DNA, 21 bp, Homo sapiens
aaaaataaaaactaatttcat

SEQ ID NO: 5068773 - DNA, 18 bp, Homo sapiens
aaaaataaaaagattcta

SEQ ID NO: 5068774 - DNA, 12 bp, Homo sapiens
aaaaataaaagc

SEQ ID NO: 5068775 - DNA, 13 bp, Homo sapiens
aaaaataaaagtt

SEQ ID NO: 5068776 - DNA, 12 bp, Homo sapiens
aaaaataaaatg

SEQ ID NO: 5068777 - DNA, 16 bp, Homo sapiens
aaaaataaaatgcatt

SEQ ID NO: 5068778 - DNA, 14 bp, Homo sapiens
aaaaataaacacta

SEQ ID NO: 5068779 - DNA, 21 bp, Homo sapiens
aaaaataaactagtttccagt

SEQ ID NO: 5068780 - DNA, 15 bp, Homo sapiens
aaaaataaaggaaaa

SEQ ID NO: 5068781 - DNA, 15 bp, Homo sapiens
aaaaataaaggaaat

SEQ ID NO: 5068782 - DNA, 11 bp, Homo sapiens
aaaaataaata

SEQ ID NO: 5068783 - DNA, 17 bp, Homo sapiens
aaaaataaataaaagcc

SEQ ID NO: 5068784 - DNA, 18 bp, Homo sapiens
aaaaataaatatatctac

SEQ ID NO: 5068785 - DNA, 12 bp, Homo sapiens
aaaaataaatgg

SEQ ID NO: 5068786 - DNA, 21 bp, Homo sapiens
aaaaataaatttggttctaat

SEQ ID NO: 5068787 - DNA, 22 bp, Homo sapiens
aaaaataacatctctttcatct

SEQ ID NO: 5068788 - DNA, 16 bp, Homo sapiens
aaaaataactattttg

SEQ ID NO: 5068789 - DNA, 21 bp, Homo sapiens
aaaaataactgagatattatt

SEQ ID NO: 5068790 - DNA, 14 bp, Homo sapiens
aaaaataagaagaa

SEQ ID NO: 5068791 - DNA, 16 bp, Homo sapiens
aaaaataagaagaatg

SEQ ID NO: 5068792 - DNA, 11 bp, Homo sapiens
aaaaataaggt

SEQ ID NO: 5068793 - DNA, 18 bp, Homo sapiens
aaaaataagtcaacagta

SEQ ID NO: 5068794 - DNA, 17 bp, Homo sapiens
aaaaataatatactttt

SEQ ID NO: 5068795 - DNA, 12 bp, Homo sapiens
aaaaataatcaa

SEQ ID NO: 5068796 - DNA, 18 bp, Homo sapiens
aaaaataatcaagatttt

SEQ ID NO: 5068797 - DNA, 19 bp, Homo sapiens
aaaaataatttattttgct

SEQ ID NO: 5068798 - DNA, 12 bp, Homo sapiens
aaaaataatttt

SEQ ID NO: 5068799 - DNA, 17 bp, Homo sapiens
aaaaataatttttatat

SEQ ID NO: 5068800 - DNA, 13 bp, Homo sapiens
aaaaatacaaaat

SEQ ID NO: 5068801 - DNA, 22 bp, Homo sapiens
aaaaatacaattattgtatatt

SEQ ID NO: 5068802 - DNA, 12 bp, Homo sapiens
aaaaatacagta

SEQ ID NO: 5068803 - DNA, 14 bp, Homo sapiens
aaaaatacagtaaa

SEQ ID NO: 5068804 - DNA, 16 bp, Homo sapiens
aaaaatacagtattat

SEQ ID NO: 5068805 - DNA, 17 bp, Homo sapiens
aaaaatacagtattatt

SEQ ID NO: 5068806 - DNA, 21 bp, Homo sapiens
aaaaatacagtattatttagt

SEQ ID NO: 5068807 - DNA, 13 bp, Homo sapiens
aaaaataccattg

SEQ ID NO: 5068808 - DNA, 14 bp, Homo sapiens
aaaaataccattga

SEQ ID NO: 5068809 - DNA, 16 bp, Homo sapiens
aaaaataccattgaaa

SEQ ID NO: 5068810 - DNA, 17 bp, Homo sapiens
aaaaataccttctatgt

SEQ ID NO: 5068811 - DNA, 22 bp, Homo sapiens
aaaaatacgttttgtgtatatt

SEQ ID NO: 5068812 - DNA, 23 bp, Homo sapiens
aaaaatactatgaaatgaaagaa

SEQ ID NO: 5068813 - DNA, 14 bp, Homo sapiens
aaaaatactcagat

SEQ ID NO: 5068814 - DNA, 22 bp, Homo sapiens
aaaaatactctttcaataaatg

SEQ ID NO: 5068815 - DNA, 11 bp, Homo sapiens
aaaaatactgc

SEQ ID NO: 5068816 - DNA, 15 bp, Homo sapiens
aaaaatactgtttca

SEQ ID NO: 5068817 - DNA, 21 bp, Homo sapiens
aaaaatactttttctaatgag

SEQ ID NO: 5068818 - DNA, 15 bp, Homo sapiens
aaaaatagaaacata

SEQ ID NO: 5068819 - DNA, 11 bp, Homo sapiens
aaaaatagaag

SEQ ID NO: 5068820 - DNA, 14 bp, Homo sapiens
aaaaatagaatata

SEQ ID NO: 5068821 - DNA, 23 bp, Homo sapiens
aaaaatagaatatataaacgata

SEQ ID NO: 5068822 - DNA, 15 bp, Homo sapiens
aaaaatagagagaga

SEQ ID NO: 5068823 - DNA, 21 bp, Homo sapiens
aaaaatagagcaaaatcaaca

SEQ ID NO: 5068824 - DNA, 11 bp, Homo sapiens
aaaaatagatg

SEQ ID NO: 5068825 - DNA, 18 bp, Homo sapiens
aaaaatagctataaatag

SEQ ID NO: 5068826 - DNA, 16 bp, Homo sapiens
aaaaatagctcttgct

SEQ ID NO: 5068827 - DNA, 16 bp, Homo sapiens
aaaaataggattgctt

SEQ ID NO: 5068828 - DNA, 22 bp, Homo sapiens
aaaaatagtaagcctccctcct

SEQ ID NO: 5068829 - DNA, 23 bp, Homo sapiens
aaaaatagtttggatatgtaaaa

SEQ ID NO: 5068830 - DNA, 11 bp, Homo sapiens
aaaaatataaa

SEQ ID NO: 5068831 - DNA, 12 bp, Homo sapiens
aaaaatataaaa

SEQ ID NO: 5068832 - DNA, 14 bp, Homo sapiens
aaaaatataaacaa

SEQ ID NO: 5068833 - DNA, 11 bp, Homo sapiens
aaaaatatata

SEQ ID NO: 5068834 - DNA, 16 bp, Homo sapiens
aaaaatatatacagat

SEQ ID NO: 5068835 - DNA, 20 bp, Homo sapiens
aaaaatatatatataaaata

SEQ ID NO: 5068836 - DNA, 19 bp, Homo sapiens
aaaaatatatattttaagt

SEQ ID NO: 5068837 - DNA, 19 bp, Homo sapiens
aaaaatatatgtaatatat

SEQ ID NO: 5068838 - DNA, 11 bp, Homo sapiens
aaaaatatatt

SEQ ID NO: 5068839 - DNA, 13 bp, Homo sapiens
aaaaatatattta

SEQ ID NO: 5068840 - DNA, 15 bp, Homo sapiens
aaaaatatctcctcc

SEQ ID NO: 5068841 - DNA, 14 bp, Homo sapiens
aaaaatatgaacct

SEQ ID NO: 5068842 - DNA, 22 bp, Homo sapiens
aaaaatatgaacctattttcat

SEQ ID NO: 5068843 - DNA, 23 bp, Homo sapiens
aaaaatatgaacctattttcatt

SEQ ID NO: 5068844 - DNA, 23 bp, Homo sapiens
aaaaatatgaccacactccagct

SEQ ID NO: 5068845 - DNA, 12 bp, Homo sapiens
aaaaatatgtat

SEQ ID NO: 5068846 - DNA, 13 bp, Homo sapiens
aaaaatatgtgaa

SEQ ID NO: 5068847 - DNA, 23 bp, Homo sapiens
aaaaatatgtgaaggaccttcac

SEQ ID NO: 5068848 - DNA, 16 bp, Homo sapiens
aaaaatattataactt

SEQ ID NO: 5068849 - DNA, 16 bp, Homo sapiens
aaaaatattcaagtaa

SEQ ID NO: 5068850 - DNA, 19 bp, Homo sapiens
aaaaatattcaagtaacac

SEQ ID NO: 5068851 - DNA, 22 bp, Homo sapiens
aaaaatattcctccaaatctct

SEQ ID NO: 5068852 - DNA, 14 bp, Homo sapiens
aaaaatattgctaa

SEQ ID NO: 5068853 - DNA, 18 bp, Homo sapiens
aaaaatattgtcatgttt

SEQ ID NO: 5068854 - DNA, 13 bp, Homo sapiens
aaaaatatttaat

SEQ ID NO: 5068855 - DNA, 15 bp, Homo sapiens
aaaaatatttaatgt

SEQ ID NO: 5068856 - DNA, 16 bp, Homo sapiens
aaaaatatttaatgtt

SEQ ID NO: 5068857 - DNA, 13 bp, Homo sapiens
aaaaatattttaa

SEQ ID NO: 5068858 - DNA, 22 bp, Homo sapiens
aaaaatattttctctgtacttt

SEQ ID NO: 5068859 - DNA, 15 bp, Homo sapiens
aaaaatattttttct

SEQ ID NO: 5068860 - DNA, 18 bp, Homo sapiens
aaaaatatttttttttct

SEQ ID NO: 5068861 - DNA, 15 bp, Homo sapiens
aaaaatcaaagaaca

SEQ ID NO: 5068862 - DNA, 18 bp, Homo sapiens
aaaaatcaacctatcaaa

SEQ ID NO: 5068863 - DNA, 17 bp, Homo sapiens
aaaaatcacaaaaattt

SEQ ID NO: 5068864 - DNA, 18 bp, Homo sapiens
aaaaatcacaatttttaa

SEQ ID NO: 5068865 - DNA, 15 bp, Homo sapiens
aaaaatcacatcctg

SEQ ID NO: 5068866 - DNA, 20 bp, Homo sapiens
aaaaatcacttgattcataa

SEQ ID NO: 5068867 - DNA, 18 bp, Homo sapiens
aaaaatcagaacaaaact

SEQ ID NO: 5068868 - DNA, 14 bp, Homo sapiens
aaaaatcagttttg

SEQ ID NO: 5068869 - DNA, 19 bp, Homo sapiens
aaaaatcatcaaagtgttt

SEQ ID NO: 5068870 - DNA, 21 bp, Homo sapiens
aaaaatcatgccagtattttt

SEQ ID NO: 5068871 - DNA, 15 bp, Homo sapiens
aaaaatcatgtgata

SEQ ID NO: 5068872 - DNA, 18 bp, Homo sapiens
aaaaatcatttagatgca

SEQ ID NO: 5068873 - DNA, 12 bp, Homo sapiens
aaaaatccaaaa

SEQ ID NO: 5068874 - DNA, 18 bp, Homo sapiens
aaaaatccaaatattgtt

SEQ ID NO: 5068875 - DNA, 10 bp, Homo sapiens
aaaaatccac

SEQ ID NO: 5068876 - DNA, 23 bp, Homo sapiens
aaaaatccattttacacagcacc

SEQ ID NO: 5068877 - DNA, 15 bp, Homo sapiens
aaaaatcccaaattc

SEQ ID NO: 5068878 - DNA, 17 bp, Homo sapiens
aaaaatccccaaaaaag

SEQ ID NO: 5068879 - DNA, 23 bp, Homo sapiens
aaaaatccctcttcctccaaagc

SEQ ID NO: 5068880 - DNA, 23 bp, Homo sapiens
aaaaatcctgcccaaaatgtgaa

SEQ ID NO: 5068881 - DNA, 17 bp, Homo sapiens
aaaaatccttctaatct

SEQ ID NO: 5068882 - DNA, 20 bp, Homo sapiens
aaaaatccttctaatctgct

SEQ ID NO: 5068883 - DNA, 22 bp, Homo sapiens
aaaaatctaccttctgtagttt

SEQ ID NO: 5068884 - DNA, 20 bp, Homo sapiens
aaaaatctagcacactcttc

SEQ ID NO: 5068885 - DNA, 13 bp, Homo sapiens
aaaaatctagttt

SEQ ID NO: 5068886 - DNA, 16 bp, Homo sapiens
aaaaatctagtttttt

SEQ ID NO: 5068887 - DNA, 17 bp, Homo sapiens
aaaaatctcaaatttct

SEQ ID NO: 5068888 - DNA, 16 bp, Homo sapiens
aaaaatctcattattt

SEQ ID NO: 5068889 - DNA, 19 bp, Homo sapiens
aaaaatctcattatttcaa

SEQ ID NO: 5068890 - DNA, 20 bp, Homo sapiens
aaaaatctcattatttcaaa

SEQ ID NO: 5068891 - DNA, 20 bp, Homo sapiens
aaaaatctcattatttctgg

SEQ ID NO: 5068892 - DNA, 21 bp, Homo sapiens
aaaaatctgaagattgtttat

SEQ ID NO: 5068893 - DNA, 20 bp, Homo sapiens
aaaaatctgcagaaggaaaa

SEQ ID NO: 5068894 - DNA, 15 bp, Homo sapiens
aaaaatcttaatact

SEQ ID NO: 5068895 - DNA, 18 bp, Homo sapiens
aaaaatcttaatactgtt

SEQ ID NO: 5068896 - DNA, 17 bp, Homo sapiens
aaaaatcttccaattta

SEQ ID NO: 5068897 - DNA, 13 bp, Homo sapiens
aaaaatcttgggc

SEQ ID NO: 5068898 - DNA, 14 bp, Homo sapiens
aaaaatcttgggca

SEQ ID NO: 5068899 - DNA, 17 bp, Homo sapiens
aaaaatgaaagatgatt

SEQ ID NO: 5068900 - DNA, 12 bp, Homo sapiens
aaaaatgaagat

SEQ ID NO: 5068901 - DNA, 20 bp, Homo sapiens
aaaaatgaatgtctaaaatt

SEQ ID NO: 5068902 - DNA, 11 bp, Homo sapiens
aaaaatgaatt

SEQ ID NO: 5068903 - DNA, 19 bp, Homo sapiens
aaaaatgacaacagaaaaa

SEQ ID NO: 5068904 - DNA, 18 bp, Homo sapiens
aaaaatgacaattgtgaa

SEQ ID NO: 5068905 - DNA, 12 bp, Homo sapiens
aaaaatgagaac

SEQ ID NO: 5068906 - DNA, 17 bp, Homo sapiens
aaaaatgagaacatgtt

SEQ ID NO: 5068907 - DNA, 21 bp, Homo sapiens
aaaaatgagaacatgttggta

SEQ ID NO: 5068908 - DNA, 16 bp, Homo sapiens
aaaaatgagcttgtaa

SEQ ID NO: 5068909 - DNA, 12 bp, Homo sapiens
aaaaatgagttg

SEQ ID NO: 5068910 - DNA, 22 bp, Homo sapiens
aaaaatgagttgtcacagaaat

SEQ ID NO: 5068911 - DNA, 18 bp, Homo sapiens
aaaaatgatcctcagtgc

SEQ ID NO: 5068912 - DNA, 14 bp, Homo sapiens
aaaaatgatctaaa

SEQ ID NO: 5068913 - DNA, 17 bp, Homo sapiens
aaaaatgatctattgca

SEQ ID NO: 5068914 - DNA, 20 bp, Homo sapiens
aaaaatgcaaatcctatgtg

SEQ ID NO: 5068915 - DNA, 23 bp, Homo sapiens
aaaaatgcaaatcctatgtgatt

SEQ ID NO: 5068916 - DNA, 15 bp, Homo sapiens
aaaaatgcatttaag

SEQ ID NO: 5068917 - DNA, 22 bp, Homo sapiens
aaaaatgcatttaagttgtaaa

SEQ ID NO: 5068918 - DNA, 17 bp, Homo sapiens
aaaaatgccaaaaacaa

SEQ ID NO: 5068919 - DNA, 18 bp, Homo sapiens
aaaaatgccataatacaa

SEQ ID NO: 5068920 - DNA, 21 bp, Homo sapiens
aaaaatgccataatacaaaag

SEQ ID NO: 5068921 - DNA, 18 bp, Homo sapiens
aaaaatgccatcaaatga

SEQ ID NO: 5068922 - DNA, 22 bp, Homo sapiens
aaaaatgcccatttttgctaat

SEQ ID NO: 5068923 - DNA, 18 bp, Homo sapiens
aaaaatgcctttgagaca

SEQ ID NO: 5068924 - DNA, 15 bp, Homo sapiens
aaaaatgctgaacat

SEQ ID NO: 5068925 - DNA, 16 bp, Homo sapiens
aaaaatgctgaacatt

SEQ ID NO: 5068926 - DNA, 11 bp, Homo sapiens
aaaaatgctgg

SEQ ID NO: 5068927 - DNA, 14 bp, Homo sapiens
aaaaatgctttgct

SEQ ID NO: 5068928 - DNA, 12 bp, Homo sapiens
aaaaatggaaaa

SEQ ID NO: 5068929 - DNA, 17 bp, Homo sapiens
aaaaatggaaaaaaaca

SEQ ID NO: 5068930 - DNA, 19 bp, Homo sapiens
aaaaatggaaaaataaaca

SEQ ID NO: 5068931 - DNA, 23 bp, Homo sapiens
aaaaatggaaacatttattcctt

SEQ ID NO: 5068932 - DNA, 12 bp, Homo sapiens
aaaaatggatat

SEQ ID NO: 5068933 - DNA, 11 bp, Homo sapiens
aaaaatggcaa

SEQ ID NO: 5068934 - DNA, 15 bp, Homo sapiens
aaaaatggcaagaga

SEQ ID NO: 5068935 - DNA, 18 bp, Homo sapiens
aaaaatggcaagagatca

SEQ ID NO: 5068936 - DNA, 13 bp, Homo sapiens
aaaaatggcattt

SEQ ID NO: 5068937 - DNA, 19 bp, Homo sapiens
aaaaatggctaactgatga

SEQ ID NO: 5068938 - DNA, 15 bp, Homo sapiens
aaaaatgggagccag

SEQ ID NO: 5068939 - DNA, 16 bp, Homo sapiens
aaaaatgggagccagg

SEQ ID NO: 5068940 - DNA, 18 bp, Homo sapiens
aaaaatgggtcttttata

SEQ ID NO: 5068941 - DNA, 19 bp, Homo sapiens
aaaaatggtaaaattgcat

SEQ ID NO: 5068942 - DNA, 13 bp, Homo sapiens
aaaaatggtaatt

SEQ ID NO: 5068943 - DNA, 13 bp, Homo sapiens
aaaaatggtataa

SEQ ID NO: 5068944 - DNA, 22 bp, Homo sapiens
aaaaatggtataagtaacttta

SEQ ID NO: 5068945 - DNA, 17 bp, Homo sapiens
aaaaatggtgccttctt

SEQ ID NO: 5068946 - DNA, 22 bp, Homo sapiens
aaaaatggtggcttcagctcca

SEQ ID NO: 5068947 - DNA, 20 bp, Homo sapiens
aaaaacctattttgaaaggt

SEQ ID NO: 5068948 - DNA, 19 bp, Homo sapiens
aaaaacctgaactttcatt

SEQ ID NO: 5068949 - DNA, 14 bp, Homo sapiens
aaaaactaaaaact

SEQ ID NO: 5068950 - DNA, 14 bp, Homo sapiens
aaaaactaaattgt

SEQ ID NO: 5068951 - DNA, 13 bp, Homo sapiens
aaaaactaatgtg

SEQ ID NO: 5068952 - DNA, 18 bp, Homo sapiens
aaaaactagacattattt

SEQ ID NO: 5068953 - DNA, 21 bp, Homo sapiens
aaaaactagtaatactgtctt

SEQ ID NO: 5068954 - DNA, 15 bp, Homo sapiens
aaaaactagtagttc

SEQ ID NO: 5068955 - DNA, 19 bp, Homo sapiens
aaaaactataaaaaagaaa

SEQ ID NO: 5068956 - DNA, 21 bp, Homo sapiens
aaaaactataaatacaaatct

SEQ ID NO: 5068957 - DNA, 12 bp, Homo sapiens
aaaaactattaa

SEQ ID NO: 5068958 - DNA, 23 bp, Homo sapiens
aaaaactattaaggatgtagctt

SEQ ID NO: 5068959 - DNA, 21 bp, Homo sapiens
aaaaactattcgaatgaaaag

SEQ ID NO: 5068960 - DNA, 11 bp, Homo sapiens
aaaaactattt

SEQ ID NO: 5068961 - DNA, 13 bp, Homo sapiens
aaaaactatttaa

SEQ ID NO: 5068962 - DNA, 23 bp, Homo sapiens
aaaaactattttatgttcagaaa

SEQ ID NO: 5068963 - DNA, 16 bp, Homo sapiens
aaaaactcctgtgtcg

SEQ ID NO: 5068964 - DNA, 22 bp, Homo sapiens
aaaaactcctgttttcacacct

SEQ ID NO: 5068965 - DNA, 14 bp, Homo sapiens
aaaaactccttttg

SEQ ID NO: 5068966 - DNA, 21 bp, Homo sapiens
aaaaactcgaggactgtattt

SEQ ID NO: 5068967 - DNA, 15 bp, Homo sapiens
aaaaactctctccca

SEQ ID NO: 5068968 - DNA, 20 bp, Homo sapiens
aaaaactctgggaaataaga

SEQ ID NO: 5068969 - DNA, 19 bp, Homo sapiens
aaaaactctttaacttgta

SEQ ID NO: 5068970 - DNA, 14 bp, Homo sapiens
aaaaactctttatt

SEQ ID NO: 5068971 - DNA, 10 bp, Homo sapiens
aaaaactgaa

SEQ ID NO: 5068972 - DNA, 11 bp, Homo sapiens
aaaaactgaag

SEQ ID NO: 5068973 - DNA, 14 bp, Homo sapiens
aaaaactgacagat

SEQ ID NO: 5068974 - DNA, 13 bp, Homo sapiens
aaaaactgatttt

SEQ ID NO: 5068975 - DNA, 12 bp, Homo sapiens
aaaaactggaaa

SEQ ID NO: 5068976 - DNA, 15 bp, Homo sapiens
aaaaactggaaacat

SEQ ID NO: 5068977 - DNA, 18 bp, Homo sapiens
aaaaactggaaacatctg

SEQ ID NO: 5068978 - DNA, 12 bp, Homo sapiens
aaaaactgtaaa

SEQ ID NO: 5068979 - DNA, 16 bp, Homo sapiens
aaaaactgtactgtgt

SEQ ID NO: 5068980 - DNA, 12 bp, Homo sapiens
aaaaactgtatt

SEQ ID NO: 5068981 - DNA, 22 bp, Homo sapiens
aaaaactgtgatttttatcaca

SEQ ID NO: 5068982 - DNA, 18 bp, Homo sapiens
aaaaactgttcttttgca

SEQ ID NO: 5068983 - DNA, 20 bp, Homo sapiens
aaaaacttaaagcaaaatag

SEQ ID NO: 5068984 - DNA, 13 bp, Homo sapiens
aaaaacttaaata

SEQ ID NO: 5068985 - DNA, 15 bp, Homo sapiens
aaaaacttattttat

SEQ ID NO: 5068986 - DNA, 16 bp, Homo sapiens
aaaaacttattttatc

SEQ ID NO: 5068987 - DNA, 22 bp, Homo sapiens
aaaaacttgtgctataaagcta

SEQ ID NO: 5068988 - DNA, 13 bp, Homo sapiens
aaaaactttaaaa

SEQ ID NO: 5068989 - DNA, 16 bp, Homo sapiens
aaaaactttcatgcct

SEQ ID NO: 5068990 - DNA, 23 bp, Homo sapiens
aaaaactttccatgacagtagca

SEQ ID NO: 5068991 - DNA, 18 bp, Homo sapiens
aaaaactttctactcatt

SEQ ID NO: 5068992 - DNA, 19 bp, Homo sapiens
aaaaactttctactcattt

SEQ ID NO: 5068993 - DNA, 22 bp, Homo sapiens
aaaaactttctctttgccattt

SEQ ID NO: 5068994 - DNA, 19 bp, Homo sapiens
aaaaactttgccagccatt

SEQ ID NO: 5068995 - DNA, 20 bp, Homo sapiens
aaaaactttggaaccagact

SEQ ID NO: 5068996 - DNA, 16 bp, Homo sapiens
aaaaactttgttatat

SEQ ID NO: 5068997 - DNA, 17 bp, Homo sapiens
aaaaacttttcatttca

SEQ ID NO: 5068998 - DNA, 20 bp, Homo sapiens
aaaaacttttcatttcagat

SEQ ID NO: 5068999 - DNA, 12 bp, Homo sapiens
aaaaacttttga

SEQ ID NO: 5069000 - DNA, 20 bp, Homo sapiens
aaaaacttttttctttgaaa

SEQ ID NO: 5069001 - DNA, 9 bp, Homo sapiens
aaaaagaaa

SEQ ID NO: 5069002 - DNA, 18 bp, Homo sapiens
aaaaagaaaaagagataa

SEQ ID NO: 5069003 - DNA, 20 bp, Homo sapiens
aaaaagaaaaatctcattat

SEQ ID NO: 5069004 - DNA, 20 bp, Homo sapiens
aaaaagaaaatggctaataa

SEQ ID NO: 5069005 - DNA, 16 bp, Homo sapiens
aaaaagaaacttttct

SEQ ID NO: 5069006 - DNA, 16 bp, Homo sapiens
aaaaagaaagagaaga

SEQ ID NO: 5069007 - DNA, 19 bp, Homo sapiens
aaaaagaaaggctgttaaa

SEQ ID NO: 5069008 - DNA, 12 bp, Homo sapiens
aaaaagaaatcc

SEQ ID NO: 5069009 - DNA, 12 bp, Homo sapiens
aaaaagaaatct

SEQ ID NO: 5069010 - DNA, 16 bp, Homo sapiens
aaaaagaaattatctt

SEQ ID NO: 5069011 - DNA, 22 bp, Homo sapiens
aaaaagaaattcgcatgtttaa

SEQ ID NO: 5069012 - DNA, 17 bp, Homo sapiens
aaaaagaaattctgtta

SEQ ID NO: 5069013 - DNA, 14 bp, Homo sapiens
aaaaagaaattgtg

SEQ ID NO: 5069014 - DNA, 20 bp, Homo sapiens
aaaaagaacatgcagtttga

SEQ ID NO: 5069015 - DNA, 11 bp, Homo sapiens
aaaaagaacca

SEQ ID NO: 5069016 - DNA, 19 bp, Homo sapiens
aaaaagaactaaatatgca

SEQ ID NO: 5069017 - DNA, 11 bp, Homo sapiens
aaaaagaagaa

SEQ ID NO: 5069018 - DNA, 16 bp, Homo sapiens
aaaaagaaggactgaa

SEQ ID NO: 5069019 - DNA, 14 bp, Homo sapiens
aaaaagaagtaggg

SEQ ID NO: 5069020 - DNA, 13 bp, Homo sapiens
aaaaagaagttac

SEQ ID NO: 5069021 - DNA, 23 bp, Homo sapiens
aaaaagaagttactttgtaattt

SEQ ID NO: 5069022 - DNA, 21 bp, Homo sapiens
aaaaagaatctgcatttagca

SEQ ID NO: 5069023 - DNA, 17 bp, Homo sapiens
aaaaagaatgaagcctc

SEQ ID NO: 5069024 - DNA, 13 bp, Homo sapiens
aaaaagacaaaca

SEQ ID NO: 5069025 - DNA, 11 bp, Homo sapiens
aaaaagacata

SEQ ID NO: 5069026 - DNA, 16 bp, Homo sapiens
aaaaagacataaaaca

SEQ ID NO: 5069027 - DNA, 19 bp, Homo sapiens
aaaaagacatggaaggtta

SEQ ID NO: 5069028 - DNA, 13 bp, Homo sapiens
aaaaagaccagac

SEQ ID NO: 5069029 - DNA, 19 bp, Homo sapiens
aaaaagacgatgtttatgt

SEQ ID NO: 5069030 - DNA, 14 bp, Homo sapiens
aaaaagactgaaca

SEQ ID NO: 5069031 - DNA, 11 bp, Homo sapiens
aaaaagactgt

SEQ ID NO: 5069032 - DNA, 15 bp, Homo sapiens
aaaaagactgtcaaa

SEQ ID NO: 5069033 - DNA, 21 bp, Homo sapiens
aaaaagactgtcaaatgaact

SEQ ID NO: 5069034 - DNA, 11 bp, Homo sapiens
aaaaagagact

SEQ ID NO: 5069035 - DNA, 13 bp, Homo sapiens
aaaaagagagagc

SEQ ID NO: 5069036 - DNA, 23 bp, Homo sapiens
aaaaagagctcaggcttttccag

SEQ ID NO: 5069037 - DNA, 14 bp, Homo sapiens
aaaaagaggagctt

SEQ ID NO: 5069038 - DNA, 17 bp, Homo sapiens
aaaaagagtaatttcat

SEQ ID NO: 5069039 - DNA, 16 bp, Homo sapiens
aaaaagagttttcttt

SEQ ID NO: 5069040 - DNA, 17 bp, Homo sapiens
aaaaagataccttaaaa

SEQ ID NO: 5069041 - DNA, 13 bp, Homo sapiens
aaaaagatactgt

SEQ ID NO: 5069042 - DNA, 18 bp, Homo sapiens
aaaaagatattgtattat

SEQ ID NO: 5069043 - DNA, 20 bp, Homo sapiens
aaaaagatattgtattatca

SEQ ID NO: 5069044 - DNA, 21 bp, Homo sapiens
aaaaagatatttatgatgtta

SEQ ID NO: 5069045 - DNA, 20 bp, Homo sapiens
aaaaagatgacttaaggtga

SEQ ID NO: 5069046 - DNA, 20 bp, Homo sapiens
aaaaagatgccttttaccat

SEQ ID NO: 5069047 - DNA, 22 bp, Homo sapiens
aaaaagatggatttgacacact

SEQ ID NO: 5069048 - DNA, 18 bp, Homo sapiens
aaaaagattatatatcat

SEQ ID NO: 5069049 - DNA, 12 bp, Homo sapiens
aaaaagattcta

SEQ ID NO: 5069050 - DNA, 18 bp, Homo sapiens
aaaaagattgtattgctg

SEQ ID NO: 5069051 - DNA, 23 bp, Homo sapiens
aaaaagattttcagaaaatatta

SEQ ID NO: 5069052 - DNA, 16 bp, Homo sapiens
aaaaagatttttaaaa

SEQ ID NO: 5069053 - DNA, 18 bp, Homo sapiens
aaaaagcaaatcagaaaa

SEQ ID NO: 5069054 - DNA, 17 bp, Homo sapiens
aaaaagcaactttccaa

SEQ ID NO: 5069055 - DNA, 11 bp, Homo sapiens
aaaaagcacat

SEQ ID NO: 5069056 - DNA, 14 bp, Homo sapiens
aaaaagcacataca

SEQ ID NO: 5069057 - DNA, 20 bp, Homo sapiens
aaaaagcacatacattaaaa

SEQ ID NO: 5069058 - DNA, 21 bp, Homo sapiens
aaaaagcagacagaagtcact

SEQ ID NO: 5069059 - DNA, 23 bp, Homo sapiens
aaaaagcagagtggactgcattt

SEQ ID NO: 5069060 - DNA, 21 bp, Homo sapiens
aaaaagcagctaccaggtgtt

SEQ ID NO: 5069061 - DNA, 21 bp, Homo sapiens
aaaaagcaggactgtgcctcc

SEQ ID NO: 5069062 - DNA, 15 bp, Homo sapiens
aaaaagcatgaatat

SEQ ID NO: 5069063 - DNA, 17 bp, Homo sapiens
aaaaagcatgaatattt

SEQ ID NO: 5069064 - DNA, 12 bp, Homo sapiens
aaaaagcatgta

SEQ ID NO: 5069065 - DNA, 15 bp, Homo sapiens
aaaaagcatgtacag

SEQ ID NO: 5069066 - DNA, 17 bp, Homo sapiens
aaaaagcatgtacagtg

SEQ ID NO: 5069067 - DNA, 15 bp, Homo sapiens
aaaaagcatgtgtca

SEQ ID NO: 5069068 - DNA, 14 bp, Homo sapiens
aaaaagcattttaa

SEQ ID NO: 5069069 - DNA, 13 bp, Homo sapiens
aaaaagccacagc

SEQ ID NO: 5069070 - DNA, 17 bp, Homo sapiens
aaaaagcccaccatttg

SEQ ID NO: 5069071 - DNA, 23 bp, Homo sapiens
aaaaagccctatgtgaaaagatc

SEQ ID NO: 5069072 - DNA, 17 bp, Homo sapiens
aaaaagcctccaagggt

SEQ ID NO: 5069073 - DNA, 17 bp, Homo sapiens
aaaaagcctccagtcca

SEQ ID NO: 5069074 - DNA, 20 bp, Homo sapiens
aaaaagcctggtttttctca

SEQ ID NO: 5069075 - DNA, 12 bp, Homo sapiens
aaaaagccttcc

SEQ ID NO: 5069076 - DNA, 22 bp, Homo sapiens
aaaaagcgaaccgtgaggaggg

SEQ ID NO: 5069077 - DNA, 20 bp, Homo sapiens
aaaaagcgctgtttccttgc

SEQ ID NO: 5069078 - DNA, 19 bp, Homo sapiens
aaaaagctaacatctttac

SEQ ID NO: 5069079 - DNA, 19 bp, Homo sapiens
aaaaagctagtcaacagta

SEQ ID NO: 5069080 - DNA, 9 bp, Homo sapiens
aaaaagctc

SEQ ID NO: 5069081 - DNA, 17 bp, Homo sapiens
aaaaagctcactgctga

SEQ ID NO: 5069082 - DNA, 12 bp, Homo sapiens
aaaaagctcttt

SEQ ID NO: 5069083 - DNA, 21 bp, Homo sapiens
aaaaagctgcaaaaattatat

SEQ ID NO: 5069084 - DNA, 12 bp, Homo sapiens
aaaaagcttaaa

SEQ ID NO: 5069085 - DNA, 19 bp, Homo sapiens
aaaaagcttccatgattct

SEQ ID NO: 5069086 - DNA, 17 bp, Homo sapiens
aaaaagcttgtggccaa

SEQ ID NO: 5069087 - DNA, 15 bp, Homo sapiens
aaaaagctttactct

SEQ ID NO: 5069088 - DNA, 23 bp, Homo sapiens
aaaaagctttatgattttcataa

SEQ ID NO: 5069089 - DNA, 9 bp, Homo sapiens
aaaaaggaa

SEQ ID NO: 5069090 - DNA, 17 bp, Homo sapiens
aaaaaggaaaaaaagac

SEQ ID NO: 5069091 - DNA, 14 bp, Homo sapiens
aaaaaggaaaaata

SEQ ID NO: 5069092 - DNA, 12 bp, Homo sapiens
aaaaaggaaaac

SEQ ID NO: 5069093 - DNA, 23 bp, Homo sapiens
aaaaaggaaaactcaccatttca

SEQ ID NO: 5069094 - DNA, 11 bp, Homo sapiens
aaaaaggaaat

SEQ ID NO: 5069095 - DNA, 15 bp, Homo sapiens
aaaaaggaaatttgt

SEQ ID NO: 5069096 - DNA, 13 bp, Homo sapiens
aaaaaggaactgc

SEQ ID NO: 5069097 - DNA, 17 bp, Homo sapiens
aaaaaggaactgcagca

SEQ ID NO: 5069098 - DNA, 11 bp, Homo sapiens
aaaaaggactg

SEQ ID NO: 5069099 - DNA, 22 bp, Homo sapiens
aaaaaggagctcttcttgtgaa

SEQ ID NO: 5069100 - DNA, 18 bp, Homo sapiens
aaaaaggaggatagaaaa

SEQ ID NO: 5069101 - DNA, 15 bp, Homo sapiens
aaaaaggatacataa

SEQ ID NO: 5069102 - DNA, 14 bp, Homo sapiens
aaaaaggatggaag

SEQ ID NO: 5069103 - DNA, 20 bp, Homo sapiens
aaaaaggatggaagaaagaa

SEQ ID NO: 5069104 - DNA, 14 bp, Homo sapiens
aaaaaggcaaatat

SEQ ID NO: 5069105 - DNA, 12 bp, Homo sapiens
aaaaaggcagga

SEQ ID NO: 5069106 - DNA, 21 bp, Homo sapiens
aaaaaggccagtggaaattca

SEQ ID NO: 5069107 - DNA, 19 bp, Homo sapiens
aaaaaggcccttagaggga

SEQ ID NO: 5069108 - DNA, 12 bp, Homo sapiens
aaaaaggccttt

SEQ ID NO: 5069109 - DNA, 13 bp, Homo sapiens
aaaaaggcctttg

SEQ ID NO: 5069110 - DNA, 14 bp, Homo sapiens
aaaaaggctgaaaa

SEQ ID NO: 5069111 - DNA, 23 bp, Homo sapiens
aaaaaggctggctgaaaatcact

SEQ ID NO: 5069112 - DNA, 13 bp, Homo sapiens
aaaaagggaaaag

SEQ ID NO: 5069113 - DNA, 17 bp, Homo sapiens
aaaaagggaagtaagca

SEQ ID NO: 5069114 - DNA, 16 bp, Homo sapiens
aaaaagggagtttttg

SEQ ID NO: 5069115 - DNA, 21 bp, Homo sapiens
aaaaagggatccgtacattca

SEQ ID NO: 5069116 - DNA, 18 bp, Homo sapiens
aaaaaggggcctgagtgg

SEQ ID NO: 5069117 - DNA, 12 bp, Homo sapiens
aaaaaggggggt

SEQ ID NO: 5069118 - DNA, 23 bp, Homo sapiens
aaaaagggtcaatgctatttttg

SEQ ID NO: 5069119 - DNA, 14 bp, Homo sapiens
aaaaaggtgtttat

SEQ ID NO: 5069120 - DNA, 16 bp, Homo sapiens
aaaaaggttaacagta

SEQ ID NO: 5069121 - DNA, 18 bp, Homo sapiens
aaaaaggtttacagaatt

SEQ ID NO: 5069122 - DNA, 21 bp, Homo sapiens
aaaaagtaattgtagatggaa

SEQ ID NO: 5069123 - DNA, 19 bp, Homo sapiens
aaaaagtacaatgaactgc

SEQ ID NO: 5069124 - DNA, 18 bp, Homo sapiens
aaaaagtacagaacatat

SEQ ID NO: 5069125 - DNA, 21 bp, Homo sapiens
aaaaagtagcaaatgtttact

SEQ ID NO: 5069126 - DNA, 22 bp, Homo sapiens
aaaaagtagcaaatgtttactg

SEQ ID NO: 5069127 - DNA, 16 bp, Homo sapiens
aaaaagtaggctgccg

SEQ ID NO: 5069128 - DNA, 22 bp, Homo sapiens
aaaaagtatcatggaaatatta

SEQ ID NO: 5069129 - DNA, 20 bp, Homo sapiens
aaaaatggttgatggaaaat

SEQ ID NO: 5069130 - DNA, 21 bp, Homo sapiens
aaaaatggttgatggaaaata

SEQ ID NO: 5069131 - DNA, 22 bp, Homo sapiens
aaaaatggttgatggaaaataa

SEQ ID NO: 5069132 - DNA, 17 bp, Homo sapiens
aaaaatggtttaaatgg

SEQ ID NO: 5069133 - DNA, 14 bp, Homo sapiens
aaaaatgtaaaatg

SEQ ID NO: 5069134 - DNA, 12 bp, Homo sapiens
aaaaatgtaaat

SEQ ID NO: 5069135 - DNA, 13 bp, Homo sapiens
aaaaatgtaaata

SEQ ID NO: 5069136 - DNA, 13 bp, Homo sapiens
aaaaatgtaacat

SEQ ID NO: 5069137 - DNA, 19 bp, Homo sapiens
aaaaatgtaatttagaaac

SEQ ID NO: 5069138 - DNA, 22 bp, Homo sapiens
aaaaatgtagaaattcttcatg

SEQ ID NO: 5069139 - DNA, 16 bp, Homo sapiens
aaaaatgtagaatgat

SEQ ID NO: 5069140 - DNA, 18 bp, Homo sapiens
aaaaatgtagcttttatg

SEQ ID NO: 5069141 - DNA, 18 bp, Homo sapiens
aaaaatgtaggagactgt

SEQ ID NO: 5069142 - DNA, 18 bp, Homo sapiens
aaaaatgtataaaaatta

SEQ ID NO: 5069143 - DNA, 20 bp, Homo sapiens
aaaaatgtatccagtctgaa

SEQ ID NO: 5069144 - DNA, 16 bp, Homo sapiens
aaaaatgtattttatg

SEQ ID NO: 5069145 - DNA, 18 bp, Homo sapiens
aaaaatgtcaaaagtaga

SEQ ID NO: 5069146 - DNA, 22 bp, Homo sapiens
aaaaatgtcttgggtaggcggg

SEQ ID NO: 5069147 - DNA, 23 bp, Homo sapiens
aaaaatgtgaaatgcttttatat

SEQ ID NO: 5069148 - DNA, 20 bp, Homo sapiens
aaaaatgtgaagtctacttt

SEQ ID NO: 5069149 - DNA, 17 bp, Homo sapiens
aaaaatgtgaatctctt

SEQ ID NO: 5069150 - DNA, 18 bp, Homo sapiens
aaaaatgtgcaaaacagc

SEQ ID NO: 5069151 - DNA, 18 bp, Homo sapiens
aaaaatgtggtttgtaca

SEQ ID NO: 5069152 - DNA, 12 bp, Homo sapiens
aaaaatgtgtgg

SEQ ID NO: 5069153 - DNA, 22 bp, Homo sapiens
aaaaatgtgtgtattcttaaaa

SEQ ID NO: 5069154 - DNA, 18 bp, Homo sapiens
aaaaatgttaagcatcta

SEQ ID NO: 5069155 - DNA, 16 bp, Homo sapiens
aaaaatgttggattta

SEQ ID NO: 5069156 - DNA, 20 bp, Homo sapiens
aaaaatgttggatttataaa

SEQ ID NO: 5069157 - DNA, 12 bp, Homo sapiens
aaaaatgtttgt

SEQ ID NO: 5069158 - DNA, 12 bp, Homo sapiens
aaaaattaaaat

SEQ ID NO: 5069159 - DNA, 16 bp, Homo sapiens
aaaaattaaaattttc

SEQ ID NO: 5069160 - DNA, 19 bp, Homo sapiens
aaaaattaaattctctcta

SEQ ID NO: 5069161 - DNA, 18 bp, Homo sapiens
aaaaattaacttagtttt

SEQ ID NO: 5069162 - DNA, 19 bp, Homo sapiens
aaaaattaacttagttttt

SEQ ID NO: 5069163 - DNA, 14 bp, Homo sapiens
aaaaattaactttt

SEQ ID NO: 5069164 - DNA, 13 bp, Homo sapiens
aaaaattaagctt

SEQ ID NO: 5069165 - DNA, 16 bp, Homo sapiens
aaaaattaattctctt

SEQ ID NO: 5069166 - DNA, 15 bp, Homo sapiens
aaaaattaattcttt

SEQ ID NO: 5069167 - DNA, 13 bp, Homo sapiens
aaaaattacagat

SEQ ID NO: 5069168 - DNA, 23 bp, Homo sapiens
aaaaattacagcttcaccctgtc

SEQ ID NO: 5069169 - DNA, 13 bp, Homo sapiens
aaaaattacagtt

SEQ ID NO: 5069170 - DNA, 17 bp, Homo sapiens
aaaaattacatatataa

SEQ ID NO: 5069171 - DNA, 18 bp, Homo sapiens
aaaaattactaattttac

SEQ ID NO: 5069172 - DNA, 16 bp, Homo sapiens
aaaaattactgtgaat

SEQ ID NO: 5069173 - DNA, 15 bp, Homo sapiens
aaaaattagccgggc

SEQ ID NO: 5069174 - DNA, 15 bp, Homo sapiens
aaaaattatcaaaaa

SEQ ID NO: 5069175 - DNA, 18 bp, Homo sapiens
aaaaattatctatttgta

SEQ ID NO: 5069176 - DNA, 22 bp, Homo sapiens
aaaaattatctatttgtatata

SEQ ID NO: 5069177 - DNA, 16 bp, Homo sapiens
aaaaattatctttaaa

SEQ ID NO: 5069178 - DNA, 20 bp, Homo sapiens
aaaaattatctttaaaactt

SEQ ID NO: 5069179 - DNA, 20 bp, Homo sapiens
aaaaattatgtgttgccaaa

SEQ ID NO: 5069180 - DNA, 23 bp, Homo sapiens
aaaaattattatatatttatagc

SEQ ID NO: 5069181 - DNA, 17 bp, Homo sapiens
aaaaattatttgccttt

SEQ ID NO: 5069182 - DNA, 18 bp, Homo sapiens
aaaaattcaatagtaata

SEQ ID NO: 5069183 - DNA, 21 bp, Homo sapiens
aaaaattctagtctgtttcat

SEQ ID NO: 5069184 - DNA, 13 bp, Homo sapiens
aaaaattgaaaaa

SEQ ID NO: 5069185 - DNA, 13 bp, Homo sapiens
aaaaattgaaata

SEQ ID NO: 5069186 - DNA, 14 bp, Homo sapiens
aaaaattgaaatgt

SEQ ID NO: 5069187 - DNA, 13 bp, Homo sapiens
aaaaattgcacaa

SEQ ID NO: 5069188 - DNA, 18 bp, Homo sapiens
aaaaattgcacaatttga

SEQ ID NO: 5069189 - DNA, 19 bp, Homo sapiens
aaaaattgctctgtgtata

SEQ ID NO: 5069190 - DNA, 23 bp, Homo sapiens
aaaaattgctgactgtagctttg

SEQ ID NO: 5069191 - DNA, 24 bp, Homo sapiens
aaaaattggcattttaagtgttta

SEQ ID NO: 5069192 - DNA, 15 bp, Homo sapiens
aaaaattgtctcttt

SEQ ID NO: 5069193 - DNA, 18 bp, Homo sapiens
aaaaattgtctcttttca

SEQ ID NO: 5069194 - DNA, 14 bp, Homo sapiens
aaaaattgtgatca

SEQ ID NO: 5069195 - DNA, 17 bp, Homo sapiens
aaaaattgttataatta

SEQ ID NO: 5069196 - DNA, 20 bp, Homo sapiens
aaaaattgtttccaaagtgc

SEQ ID NO: 5069197 - DNA, 13 bp, Homo sapiens
aaaaattgtttct

SEQ ID NO: 5069198 - DNA, 16 bp, Homo sapiens
aaaaattgtttcttga

SEQ ID NO: 5069199 - DNA, 11 bp, Homo sapiens
aaaaatttaaa

SEQ ID NO: 5069200 - DNA, 15 bp, Homo sapiens
aaaaatttaaaagta

SEQ ID NO: 5069201 - DNA, 21 bp, Homo sapiens
aaaaatttaaaattacgtttg

SEQ ID NO: 5069202 - DNA, 14 bp, Homo sapiens
aaaaatttaagcat

SEQ ID NO: 5069203 - DNA, 16 bp, Homo sapiens
aaaaatttaagcattg

SEQ ID NO: 5069204 - DNA, 21 bp, Homo sapiens
aaaaatttactacaatatgta

SEQ ID NO: 5069205 - DNA, 18 bp, Homo sapiens
aaaaatttactttaaact

SEQ ID NO: 5069206 - DNA, 21 bp, Homo sapiens
aaaaatttataacagttataa

SEQ ID NO: 5069207 - DNA, 22 bp, Homo sapiens
aaaaatttataacagttataaa

SEQ ID NO: 5069208 - DNA, 13 bp, Homo sapiens
aaaaatttcacga

SEQ ID NO: 5069209 - DNA, 21 bp, Homo sapiens
aaaaatttctggcaaatattt

SEQ ID NO: 5069210 - DNA, 14 bp, Homo sapiens
aaaaatttgacatt

SEQ ID NO: 5069211 - DNA, 22 bp, Homo sapiens
aaaaattttataaaattaagca

SEQ ID NO: 5069212 - DNA, 16 bp, Homo sapiens
aaaaattttgactttt

SEQ ID NO: 5069213 - DNA, 13 bp, Homo sapiens
aaaaattttgcat

SEQ ID NO: 5069214 - DNA, 19 bp, Homo sapiens
aaaaattttgtaattttct

SEQ ID NO: 5069215 - DNA, 20 bp, Homo sapiens
aaaaatttttgacacttttt

SEQ ID NO: 5069216 - DNA, 22 bp, Homo sapiens
aaaaatttttggattgacagta

SEQ ID NO: 5069217 - DNA, 14 bp, Homo sapiens
aaaacaaaaaaaga

SEQ ID NO: 5069218 - DNA, 15 bp, Homo sapiens
aaaacaaaaaacttt

SEQ ID NO: 5069219 - DNA, 15 bp, Homo sapiens
aaaacaaaaacagaa

SEQ ID NO: 5069220 - DNA, 20 bp, Homo sapiens
aaaacaaaaacgccttttct

SEQ ID NO: 5069221 - DNA, 11 bp, Homo sapiens
aaaacaaaaag

SEQ ID NO: 5069222 - DNA, 17 bp, Homo sapiens
aaaacaaaaagaacaaa

SEQ ID NO: 5069223 - DNA, 15 bp, Homo sapiens
aaaacaaaaagatgt

SEQ ID NO: 5069224 - DNA, 16 bp, Homo sapiens
aaaacaaaaataaata

SEQ ID NO: 5069225 - DNA, 12 bp, Homo sapiens
aaaacaaaacaa

SEQ ID NO: 5069226 - DNA, 16 bp, Homo sapiens
aaaacaaaacaaaact

SEQ ID NO: 5069227 - DNA, 13 bp, Homo sapiens
aaaacaaaaccag

SEQ ID NO: 5069228 - DNA, 15 bp, Homo sapiens
aaaacaaaaccagct

SEQ ID NO: 5069229 - DNA, 14 bp, Homo sapiens
aaaacaaaactata

SEQ ID NO: 5069230 - DNA, 10 bp, Homo sapiens
aaaacaaaag

SEQ ID NO: 5069231 - DNA, 14 bp, Homo sapiens
aaaacaaaatcctt

SEQ ID NO: 5069232 - DNA, 23 bp, Homo sapiens
aaaacaaaatccttgccttcaaa

SEQ ID NO: 5069233 - DNA, 18 bp, Homo sapiens
aaaacaaaatctgaactc

SEQ ID NO: 5069234 - DNA, 15 bp, Homo sapiens
aaaacaaaattttat

SEQ ID NO: 5069235 - DNA, 13 bp, Homo sapiens
aaaacaaacaaaa

SEQ ID NO: 5069236 - DNA, 16 bp, Homo sapiens
aaaacaaagacattct

SEQ ID NO: 5069237 - DNA, 13 bp, Homo sapiens
aaaacaaataata

SEQ ID NO: 5069238 - DNA, 16 bp, Homo sapiens
aaaacaaataatatct

SEQ ID NO: 5069239 - DNA, 11 bp, Homo sapiens
aaaacaaatat

SEQ ID NO: 5069240 - DNA, 18 bp, Homo sapiens
aaaacaaatatttcactt

SEQ ID NO: 5069241 - DNA, 15 bp, Homo sapiens
aaaacaaatcactgt

SEQ ID NO: 5069242 - DNA, 16 bp, Homo sapiens
aaaacaaatctataaa

SEQ ID NO: 5069243 - DNA, 12 bp, Homo sapiens
aaaacaaatctc

SEQ ID NO: 5069244 - DNA, 14 bp, Homo sapiens
aaaacaaatcttca

SEQ ID NO: 5069245 - DNA, 13 bp, Homo sapiens
aaaacaaatgtta

SEQ ID NO: 5069246 - DNA, 13 bp, Homo sapiens
aaaacaacaaata

SEQ ID NO: 5069247 - DNA, 14 bp, Homo sapiens
aaaacaacaacaat

SEQ ID NO: 5069248 - DNA, 12 bp, Homo sapiens
aaaacaaccaaa

SEQ ID NO: 5069249 - DNA, 11 bp, Homo sapiens
aaaacaaccac

SEQ ID NO: 5069250 - DNA, 14 bp, Homo sapiens
aaaacaactctgat

SEQ ID NO: 5069251 - DNA, 16 bp, Homo sapiens
aaaacaacttggcatt

SEQ ID NO: 5069252 - DNA, 20 bp, Homo sapiens
aaaacaactttcacttcttc

SEQ ID NO: 5069253 - DNA, 21 bp, Homo sapiens
aaaacaactttcacttcttcc

SEQ ID NO: 5069254 - DNA, 11 bp, Homo sapiens
aaaacaagaaa

SEQ ID NO: 5069255 - DNA, 13 bp, Homo sapiens
aaaacaagacaga

SEQ ID NO: 5069256 - DNA, 22 bp, Homo sapiens
aaaacaagagaccacttcctta

SEQ ID NO: 5069257 - DNA, 23 bp, Homo sapiens
aaaacaagagaccacttccttaa

SEQ ID NO: 5069258 - DNA, 21 bp, Homo sapiens
aaaacaagaggacacaatggc

SEQ ID NO: 5069259 - DNA, 13 bp, Homo sapiens
aaaacaagcctta

SEQ ID NO: 5069260 - DNA, 14 bp, Homo sapiens
aaaacaagccttaa

SEQ ID NO: 5069261 - DNA, 17 bp, Homo sapiens
aaaacaaggatgaatta

SEQ ID NO: 5069262 - DNA, 22 bp, Homo sapiens
aaaacaagtatataatttactt

SEQ ID NO: 5069263 - DNA, 12 bp, Homo sapiens
aaaacaagtgaa

SEQ ID NO: 5069264 - DNA, 23 bp, Homo sapiens
aaaacaagttattaaaaatgtat

SEQ ID NO: 5069265 - DNA, 15 bp, Homo sapiens
aaaacaagtttgcta

SEQ ID NO: 5069266 - DNA, 16 bp, Homo sapiens
aaaacaagttttagaa

SEQ ID NO: 5069267 - DNA, 14 bp, Homo sapiens
aaaacaatacatca

SEQ ID NO: 5069268 - DNA, 16 bp, Homo sapiens
aaaacaatatctgcag

SEQ ID NO: 5069269 - DNA, 18 bp, Homo sapiens
aaaacaatatctgcagcg

SEQ ID NO: 5069270 - DNA, 16 bp, Homo sapiens
aaaacaatattacttt

SEQ ID NO: 5069271 - DNA, 21 bp, Homo sapiens
aaaacaatattactttgtctt

SEQ ID NO: 5069272 - DNA, 17 bp, Homo sapiens
aaaacaatatttattgt

SEQ ID NO: 5069273 - DNA, 19 bp, Homo sapiens
aaaacaatatttattgtat

SEQ ID NO: 5069274 - DNA, 20 bp, Homo sapiens
aaaacaatatttattgtatt

SEQ ID NO: 5069275 - DNA, 23 bp, Homo sapiens
aaaacaatatttattgtatttta

SEQ ID NO: 5069276 - DNA, 16 bp, Homo sapiens
aaaacaatcacactca

SEQ ID NO: 5069277 - DNA, 19 bp, Homo sapiens
aaaacaatcatttgctttt

SEQ ID NO: 5069278 - DNA, 15 bp, Homo sapiens
aaaacaatctattta

SEQ ID NO: 5069279 - DNA, 13 bp, Homo sapiens
aaaacaatgaatt

SEQ ID NO: 5069280 - DNA, 15 bp, Homo sapiens
aaaacaatgactttt

SEQ ID NO: 5069281 - DNA, 12 bp, Homo sapiens
aaaacaatgcca

SEQ ID NO: 5069282 - DNA, 13 bp, Homo sapiens
aaaacaatgccat

SEQ ID NO: 5069283 - DNA, 13 bp, Homo sapiens
aaaacaattcagt

SEQ ID NO: 5069284 - DNA, 21 bp, Homo sapiens
aaaacaattcagtggtcttat

SEQ ID NO: 5069285 - DNA, 17 bp, Homo sapiens
aaaacaattgcaacaga

SEQ ID NO: 5069286 - DNA, 18 bp, Homo sapiens
aaaacaattggttgtata

SEQ ID NO: 5069287 - DNA, 19 bp, Homo sapiens
aaaacaattggttgtatat

SEQ ID NO: 5069288 - DNA, 20 bp, Homo sapiens
aaaacaattgttctgggtga

SEQ ID NO: 5069289 - DNA, 14 bp, Homo sapiens
aaaacaattttctg

SEQ ID NO: 5069290 - DNA, 14 bp, Homo sapiens
aaaacacaacattt

SEQ ID NO: 5069291 - DNA, 15 bp, Homo sapiens
aaaacacaacttgtg

SEQ ID NO: 5069292 - DNA, 15 bp, Homo sapiens
aaaacacaagcaaaa

SEQ ID NO: 5069293 - DNA, 12 bp, Homo sapiens
aaaacacagagg

SEQ ID NO: 5069294 - DNA, 12 bp, Homo sapiens
aaaacacagcaa

SEQ ID NO: 5069295 - DNA, 13 bp, Homo sapiens
aaaacacagcaag

SEQ ID NO: 5069296 - DNA, 15 bp, Homo sapiens
aaaacacagtattgt

SEQ ID NO: 5069297 - DNA, 20 bp, Homo sapiens
aaaacacagtgtttttgtaa

SEQ ID NO: 5069298 - DNA, 19 bp, Homo sapiens
aaaacacatacaaaagaat

SEQ ID NO: 5069299 - DNA, 13 bp, Homo sapiens
aaaacacatgata

SEQ ID NO: 5069300 - DNA, 12 bp, Homo sapiens
aaaacacatttt

SEQ ID NO: 5069301 - DNA, 15 bp, Homo sapiens
aaaacacatttttct

SEQ ID NO: 5069302 - DNA, 17 bp, Homo sapiens
aaaacacctaagtgact

SEQ ID NO: 5069303 - DNA, 20 bp, Homo sapiens
aaaacacctcagctgcctcc

SEQ ID NO: 5069304 - DNA, 15 bp, Homo sapiens
aaaacacctttattt

SEQ ID NO: 5069305 - DNA, 10 bp, Homo sapiens
aaaacactaa

SEQ ID NO: 5069306 - DNA, 24 bp, Homo sapiens
aaaacactcaaaatgatgcaacca

SEQ ID NO: 5069307 - DNA, 19 bp, Homo sapiens
aaaacactcaacaaactta

SEQ ID NO: 5069308 - DNA, 21 bp, Homo sapiens
aaaacactgaaaaatattcca

SEQ ID NO: 5069309 - DNA, 20 bp, Homo sapiens
aaaacactgaaaaattatac

SEQ ID NO: 5069310 - DNA, 15 bp, Homo sapiens
aaaacactgccctct

SEQ ID NO: 5069311 - DNA, 15 bp, Homo sapiens
aaaaagtattgccaa

SEQ ID NO: 5069312 - DNA, 14 bp, Homo sapiens
aaaaagtcaacaaa

SEQ ID NO: 5069313 - DNA, 23 bp, Homo sapiens
aaaaagtcaccattctgcattta

SEQ ID NO: 5069314 - DNA, 19 bp, Homo sapiens
aaaaagtcagagacagata

SEQ ID NO: 5069315 - DNA, 16 bp, Homo sapiens
aaaaagtcagatgttt

SEQ ID NO: 5069316 - DNA, 16 bp, Homo sapiens
aaaaagtccaatttta

SEQ ID NO: 5069317 - DNA, 23 bp, Homo sapiens
aaaaagtccaattttaatttagt

SEQ ID NO: 5069318 - DNA, 13 bp, Homo sapiens
aaaaagtccttca

SEQ ID NO: 5069319 - DNA, 18 bp, Homo sapiens
aaaaagtccttgcaagaa

SEQ ID NO: 5069320 - DNA, 14 bp, Homo sapiens
aaaaagtctgtatg

SEQ ID NO: 5069321 - DNA, 20 bp, Homo sapiens
aaaaagtctgtatggcatga

SEQ ID NO: 5069322 - DNA, 15 bp, Homo sapiens
aaaaagtcttttaaa

SEQ ID NO: 5069323 - DNA, 12 bp, Homo sapiens
aaaaagtgaaat

SEQ ID NO: 5069324 - DNA, 17 bp, Homo sapiens
aaaaagtgaacttttgt

SEQ ID NO: 5069325 - DNA, 13 bp, Homo sapiens
aaaaagtgacaca

SEQ ID NO: 5069326 - DNA, 17 bp, Homo sapiens
aaaaagtgacacagcag

SEQ ID NO: 5069327 - DNA, 20 bp, Homo sapiens
aaaaagtgacacagcagctt

SEQ ID NO: 5069328 - DNA, 14 bp, Homo sapiens
aaaaagtgcatgat

SEQ ID NO: 5069329 - DNA, 18 bp, Homo sapiens
aaaaagtgcttcattctt

SEQ ID NO: 5069330 - DNA, 13 bp, Homo sapiens
aaaaagtggctaa

SEQ ID NO: 5069331 - DNA, 13 bp, Homo sapiens
aaaaagtggctgc

SEQ ID NO: 5069332 - DNA, 22 bp, Homo sapiens
aaaaagtgggttttttagttga

SEQ ID NO: 5069333 - DNA, 22 bp, Homo sapiens
aaaaagtgtacatgaagaatgt

SEQ ID NO: 5069334 - DNA, 13 bp, Homo sapiens
aaaaagtgtcttt

SEQ ID NO: 5069335 - DNA, 22 bp, Homo sapiens
aaaaagtgttctgtgtccttct

SEQ ID NO: 5069336 - DNA, 23 bp, Homo sapiens
aaaaagtgttctgtgtccttcta

SEQ ID NO: 5069337 - DNA, 18 bp, Homo sapiens
aaaaagtgtttatcttca

SEQ ID NO: 5069338 - DNA, 23 bp, Homo sapiens
aaaaagtgtttatttttcatatt

SEQ ID NO: 5069339 - DNA, 17 bp, Homo sapiens
aaaaagtgtttttacat

SEQ ID NO: 5069340 - DNA, 15 bp, Homo sapiens
aaaaagttaatgctt

SEQ ID NO: 5069341 - DNA, 21 bp, Homo sapiens
aaaaagttgaaccattatact

SEQ ID NO: 5069342 - DNA, 22 bp, Homo sapiens
aaaaagttgtaatttgaataag

SEQ ID NO: 5069343 - DNA, 23 bp, Homo sapiens
aaaaagttgtatgatctgtgcct

SEQ ID NO: 5069344 - DNA, 13 bp, Homo sapiens
aaaaagttgttct

SEQ ID NO: 5069345 - DNA, 18 bp, Homo sapiens
aaaaagtttgccagaagt

SEQ ID NO: 5069346 - DNA, 19 bp, Homo sapiens
aaaaagtttggttctgtgt

SEQ ID NO: 5069347 - DNA, 11 bp, Homo sapiens
aaaaagtttgt

SEQ ID NO: 5069348 - DNA, 23 bp, Homo sapiens
aaaaagtttgttactttgaatag

SEQ ID NO: 5069349 - DNA, 13 bp, Homo sapiens
aaaaagtttgttt

SEQ ID NO: 5069350 - DNA, 16 bp, Homo sapiens
aaaaagttttagtttt

SEQ ID NO: 5069351 - DNA, 17 bp, Homo sapiens
aaaaagttttatttttc

SEQ ID NO: 5069352 - DNA, 14 bp, Homo sapiens
aaaaataaaacagt

SEQ ID NO: 5069353 - DNA, 14 bp, Homo sapiens
aaaaataaaactgt

SEQ ID NO: 5069354 - DNA, 13 bp, Homo sapiens
aaaaataaaagaa

SEQ ID NO: 5069355 - DNA, 15 bp, Homo sapiens
aaaaataaaatgatg

SEQ ID NO: 5069356 - DNA, 16 bp, Homo sapiens
aaaaataaaattacct

SEQ ID NO: 5069357 - DNA, 12 bp, Homo sapiens
aaaaataaacta

SEQ ID NO: 5069358 - DNA, 12 bp, Homo sapiens
aaaaataaagaa

SEQ ID NO: 5069359 - DNA, 11 bp, Homo sapiens
aaaaataaagc

SEQ ID NO: 5069360 - DNA, 16 bp, Homo sapiens
aaaaataaagctactg

SEQ ID NO: 5069361 - DNA, 12 bp, Homo sapiens
aaaaataaagga

SEQ ID NO: 5069362 - DNA, 22 bp, Homo sapiens
aaaaataaataaaatggataga

SEQ ID NO: 5069363 - DNA, 24 bp, Homo sapiens
aaaaataaatatatctaccccaga

SEQ ID NO: 5069364 - DNA, 12 bp, Homo sapiens
aaaaataaatgt

SEQ ID NO: 5069365 - DNA, 14 bp, Homo sapiens
aaaaataacaatga

SEQ ID NO: 5069366 - DNA, 14 bp, Homo sapiens
aaaaataactattt

SEQ ID NO: 5069367 - DNA, 15 bp, Homo sapiens
aaaaataactgagat

SEQ ID NO: 5069368 - DNA, 19 bp, Homo sapiens
aaaaataactgtaattatt

SEQ ID NO: 5069369 - DNA, 22 bp, Homo sapiens
aaaaataagaagaatgcttaat

SEQ ID NO: 5069370 - DNA, 19 bp, Homo sapiens
aaaaataagttttatacat

SEQ ID NO: 5069371 - DNA, 10 bp, Homo sapiens
aaaaataata

SEQ ID NO: 5069372 - DNA, 12 bp, Homo sapiens
aaaaataataat

SEQ ID NO: 5069373 - DNA, 16 bp, Homo sapiens
aaaaataatataaatg

SEQ ID NO: 5069374 - DNA, 19 bp, Homo sapiens
aaaaataatcaagatttta

SEQ ID NO: 5069375 - DNA, 19 bp, Homo sapiens
aaaaataatctatttctat

SEQ ID NO: 5069376 - DNA, 13 bp, Homo sapiens
aaaaatacaaaaa

SEQ ID NO: 5069377 - DNA, 17 bp, Homo sapiens
aaaaatacaaaaatttg

SEQ ID NO: 5069378 - DNA, 14 bp, Homo sapiens
aaaaatacatttta

SEQ ID NO: 5069379 - DNA, 22 bp, Homo sapiens
aaaaataccattgaaatcagca

SEQ ID NO: 5069380 - DNA, 23 bp, Homo sapiens
aaaaatacctcaggaaagaatag

SEQ ID NO: 5069381 - DNA, 13 bp, Homo sapiens
aaaaatacgtaat

SEQ ID NO: 5069382 - DNA, 16 bp, Homo sapiens
aaaaatactaagagat

SEQ ID NO: 5069383 - DNA, 12 bp, Homo sapiens
aaaaatactacc

SEQ ID NO: 5069384 - DNA, 13 bp, Homo sapiens
aaaaatactacct

SEQ ID NO: 5069385 - DNA, 20 bp, Homo sapiens
aaaaatactatgaaatgaaa

SEQ ID NO: 5069386 - DNA, 14 bp, Homo sapiens
aaaaatacttgagc

SEQ ID NO: 5069387 - DNA, 18 bp, Homo sapiens
aaaaatactttttctaat

SEQ ID NO: 5069388 - DNA, 11 bp, Homo sapiens
aaaaatagaaa

SEQ ID NO: 5069389 - DNA, 15 bp, Homo sapiens
aaaaatagaaattag

SEQ ID NO: 5069390 - DNA, 16 bp, Homo sapiens
aaaaatagaaattaga

SEQ ID NO: 5069391 - DNA, 14 bp, Homo sapiens
aaaaatagacatgt

SEQ ID NO: 5069392 - DNA, 18 bp, Homo sapiens
aaaaatagacatgtagtt

SEQ ID NO: 5069393 - DNA, 21 bp, Homo sapiens
aaaaatagagagagaggtatt

SEQ ID NO: 5069394 - DNA, 14 bp, Homo sapiens
aaaaatagcaactt

SEQ ID NO: 5069395 - DNA, 17 bp, Homo sapiens
aaaaatagcaacttgtg

SEQ ID NO: 5069396 - DNA, 15 bp, Homo sapiens
aaaaatagcagtatt

SEQ ID NO: 5069397 - DNA, 21 bp, Homo sapiens
aaaaatagctaaatacctcaa

SEQ ID NO: 5069398 - DNA, 14 bp, Homo sapiens
aaaaatagtaaaca

SEQ ID NO: 5069399 - DNA, 15 bp, Homo sapiens
aaaaatagtaaacat

SEQ ID NO: 5069400 - DNA, 21 bp, Homo sapiens
aaaaatagttctaaactatca

SEQ ID NO: 5069401 - DNA, 16 bp, Homo sapiens
aaaaatagttttacat

SEQ ID NO: 5069402 - DNA, 17 bp, Homo sapiens
aaaaatagttttacatt

SEQ ID NO: 5069403 - DNA, 22 bp, Homo sapiens
aaaaatataaaattatgagatt

SEQ ID NO: 5069404 - DNA, 13 bp, Homo sapiens
aaaaatataaaca

SEQ ID NO: 5069405 - DNA, 12 bp, Homo sapiens
aaaaatataaag

SEQ ID NO: 5069406 - DNA, 14 bp, Homo sapiens
aaaaatataactta

SEQ ID NO: 5069407 - DNA, 14 bp, Homo sapiens
aaaaatataatgtt

SEQ ID NO: 5069408 - DNA, 16 bp, Homo sapiens
aaaaatataatgttga

SEQ ID NO: 5069409 - DNA, 13 bp, Homo sapiens
aaaaatatatgct

SEQ ID NO: 5069410 - DNA, 13 bp, Homo sapiens
aaaaatatatgta

SEQ ID NO: 5069411 - DNA, 14 bp, Homo sapiens
aaaaatatatgtaa

SEQ ID NO: 5069412 - DNA, 18 bp, Homo sapiens
aaaaatatatgttgaatg

SEQ ID NO: 5069413 - DNA, 12 bp, Homo sapiens
aaaaatatatta

SEQ ID NO: 5069414 - DNA, 15 bp, Homo sapiens
aaaaatatatttaat

SEQ ID NO: 5069415 - DNA, 16 bp, Homo sapiens
aaaaatatcaaattaa

SEQ ID NO: 5069416 - DNA, 21 bp, Homo sapiens
aaaaatatcaagtactacatt

SEQ ID NO: 5069417 - DNA, 16 bp, Homo sapiens
aaaaatatcaggagct

SEQ ID NO: 5069418 - DNA, 16 bp, Homo sapiens
aaaaatatctcctcca

SEQ ID NO: 5069419 - DNA, 17 bp, Homo sapiens
aaaaatatctgaatata

SEQ ID NO: 5069420 - DNA, 21 bp, Homo sapiens
aaaaatatgaccacactccag

SEQ ID NO: 5069421 - DNA, 21 bp, Homo sapiens
aaaaatatgtattatacatct

SEQ ID NO: 5069422 - DNA, 11 bp, Homo sapiens
aaaaatatgtg

SEQ ID NO: 5069423 - DNA, 20 bp, Homo sapiens
aaaaatatgtgtacacatat

SEQ ID NO: 5069424 - DNA, 23 bp, Homo sapiens
aaaaatattttaagaaagagaat

SEQ ID NO: 5069425 - DNA, 15 bp, Homo sapiens
aaaaatattttctga

SEQ ID NO: 5069426 - DNA, 22 bp, Homo sapiens
aaaaatcaaatcatgtacattt

SEQ ID NO: 5069427 - DNA, 22 bp, Homo sapiens
aaaaatcaactttttattgcct

SEQ ID NO: 5069428 - DNA, 13 bp, Homo sapiens
aaaaatcaatcaa

SEQ ID NO: 5069429 - DNA, 15 bp, Homo sapiens
aaaaatcaatcaatg

SEQ ID NO: 5069430 - DNA, 16 bp, Homo sapiens
aaaaatcagaaagaca

SEQ ID NO: 5069431 - DNA, 14 bp, Homo sapiens
aaaaatcaggagcc

SEQ ID NO: 5069432 - DNA, 16 bp, Homo sapiens
aaaaatcagtgtttaa

SEQ ID NO: 5069433 - DNA, 15 bp, Homo sapiens
aaaaatcagtttttg

SEQ ID NO: 5069434 - DNA, 17 bp, Homo sapiens
aaaaatcataaactgtg

SEQ ID NO: 5069435 - DNA, 11 bp, Homo sapiens
aaaaatcatgt

SEQ ID NO: 5069436 - DNA, 21 bp, Homo sapiens
aaaaatccaaatattgttaag

SEQ ID NO: 5069437 - DNA, 21 bp, Homo sapiens
aaaaatccattttacacagca

SEQ ID NO: 5069438 - DNA, 18 bp, Homo sapiens
aaaaatcccttgttctca

SEQ ID NO: 5069439 - DNA, 20 bp, Homo sapiens
aaaaatcctattctgatgaa

SEQ ID NO: 5069440 - DNA, 16 bp, Homo sapiens
aaaaatcctgcccaaa

SEQ ID NO: 5069441 - DNA, 18 bp, Homo sapiens
aaaaatccttctaatctg

SEQ ID NO: 5069442 - DNA, 15 bp, Homo sapiens
aaaaatccttttgaa

SEQ ID NO: 5069443 - DNA, 23 bp, Homo sapiens
aaaaatcgatgagcgccacctct

SEQ ID NO: 5069444 - DNA, 12 bp, Homo sapiens
aaaaatctaaaa

SEQ ID NO: 5069445 - DNA, 19 bp, Homo sapiens
aaaaatctaccttctgtag

SEQ ID NO: 5069446 - DNA, 12 bp, Homo sapiens
aaaaatctagtt

SEQ ID NO: 5069447 - DNA, 10 bp, Homo sapiens
aaaaatctca

SEQ ID NO: 5069448 - DNA, 19 bp, Homo sapiens
aaaaatctcaaatttctaa

SEQ ID NO: 5069449 - DNA, 20 bp, Homo sapiens
aaaaatctcaaatttctaaa

SEQ ID NO: 5069450 - DNA, 11 bp, Homo sapiens
aaaaatctcat

SEQ ID NO: 5069451 - DNA, 23 bp, Homo sapiens
aaaaatctcattatttcaaaatg

SEQ ID NO: 5069452 - DNA, 19 bp, Homo sapiens
aaaaatctgaatttctaaa

SEQ ID NO: 5069453 - DNA, 22 bp, Homo sapiens
aaaaatctgaccaaaacaaaca

SEQ ID NO: 5069454 - DNA, 16 bp, Homo sapiens
aaaaatcttctccaga

SEQ ID NO: 5069455 - DNA, 14 bp, Homo sapiens
aaaaatcttggttt

SEQ ID NO: 5069456 - DNA, 15 bp, Homo sapiens
aaaaatcttgtgtta

SEQ ID NO: 5069457 - DNA, 15 bp, Homo sapiens
aaaaatgaaaagcaa

SEQ ID NO: 5069458 - DNA, 14 bp, Homo sapiens
aaaaatgaaagatg

SEQ ID NO: 5069459 - DNA, 12 bp, Homo sapiens
aaaaatgaaagc

SEQ ID NO: 5069460 - DNA, 21 bp, Homo sapiens
aaaaatgaaagtgactttaaa

SEQ ID NO: 5069461 - DNA, 14 bp, Homo sapiens
aaaaatgaaattat

SEQ ID NO: 5069462 - DNA, 17 bp, Homo sapiens
aaaaatgaaatttaagc

SEQ ID NO: 5069463 - DNA, 19 bp, Homo sapiens
aaaaatgaaatttaagcac

SEQ ID NO: 5069464 - DNA, 11 bp, Homo sapiens
aaaaatgacaa

SEQ ID NO: 5069465 - DNA, 13 bp, Homo sapiens
aaaaatgacaaca

SEQ ID NO: 5069466 - DNA, 15 bp, Homo sapiens
aaaaatgagatttct

SEQ ID NO: 5069467 - DNA, 20 bp, Homo sapiens
aaaaatgagcttccattaat

SEQ ID NO: 5069468 - DNA, 22 bp, Homo sapiens
aaaaatgagcttgattaaatca

SEQ ID NO: 5069469 - DNA, 14 bp, Homo sapiens
aaaaatgaggaata

SEQ ID NO: 5069470 - DNA, 12 bp, Homo sapiens
aaaaatgagttt

SEQ ID NO: 5069471 - DNA, 19 bp, Homo sapiens
aaaaatgatcctcagtgca

SEQ ID NO: 5069472 - DNA, 14 bp, Homo sapiens
aaaaatgatttaat

SEQ ID NO: 5069473 - DNA, 18 bp, Homo sapiens
aaaaatgcaaatcctatg

SEQ ID NO: 5069474 - DNA, 18 bp, Homo sapiens
aaaaatgcatttaagttg

SEQ ID NO: 5069475 - DNA, 17 bp, Homo sapiens
aaaaatgccataataca

SEQ ID NO: 5069476 - DNA, 18 bp, Homo sapiens
aaaaatgcccttaaatca

SEQ ID NO: 5069477 - DNA, 12 bp, Homo sapiens
aaaaatgccttt

SEQ ID NO: 5069478 - DNA, 14 bp, Homo sapiens
aaaaatgcctttga

SEQ ID NO: 5069479 - DNA, 15 bp, Homo sapiens
aaaaatgcctttgag

SEQ ID NO: 5069480 - DNA, 19 bp, Homo sapiens
aaaaatgcctttgagacag

SEQ ID NO: 5069481 - DNA, 21 bp, Homo sapiens
aaaaatgcctttgagacagtt

SEQ ID NO: 5069482 - DNA, 24 bp, Homo sapiens
aaaaatgcctttgagacagtttct

SEQ ID NO: 5069483 - DNA, 12 bp, Homo sapiens
aaaaatgctaat

SEQ ID NO: 5069484 - DNA, 13 bp, Homo sapiens
aaaaatgctaata

SEQ ID NO: 5069485 - DNA, 14 bp, Homo sapiens
aaaaatgctgaaca

SEQ ID NO: 5069486 - DNA, 19 bp, Homo sapiens
aaaaatgctgaacattgca

SEQ ID NO: 5069487 - DNA, 12 bp, Homo sapiens
aaaaatgctgct

SEQ ID NO: 5069488 - DNA, 20 bp, Homo sapiens
aaaaatgctgcttctcctcc

SEQ ID NO: 5069489 - DNA, 15 bp, Homo sapiens
aaaaatggaactgtg

SEQ ID NO: 5069490 - DNA, 23 bp, Homo sapiens
aaaaatggatattattagaaatt

SEQ ID NO: 5069491 - DNA, 22 bp, Homo sapiens
aaaaatggcatttttttagtaa

SEQ ID NO: 5069492 - DNA, 22 bp, Homo sapiens
aaaaatggctaactgatgaatt

SEQ ID NO: 5069493 - DNA, 13 bp, Homo sapiens
aaaagggaaaaag

SEQ ID NO: 5069494 - DNA, 22 bp, Homo sapiens
aaaagggaaagttttgttctgt

SEQ ID NO: 5069495 - DNA, 15 bp, Homo sapiens
aaaagggaagaaact

SEQ ID NO: 5069496 - DNA, 20 bp, Homo sapiens
aaaagggaagttgtgccttt

SEQ ID NO: 5069497 - DNA, 13 bp, Homo sapiens
aaaagggacagca

SEQ ID NO: 5069498 - DNA, 16 bp, Homo sapiens
aaaagggagaaaaaga

SEQ ID NO: 5069499 - DNA, 18 bp, Homo sapiens
aaaagggattacccaagc

SEQ ID NO: 5069500 - DNA, 15 bp, Homo sapiens
aaaagggcagccctc

SEQ ID NO: 5069501 - DNA, 16 bp, Homo sapiens
aaaagggcattttgta

SEQ ID NO: 5069502 - DNA, 22 bp, Homo sapiens
aaaagggcggaagagttacaat

SEQ ID NO: 5069503 - DNA, 11 bp, Homo sapiens
aaaaggggcat

SEQ ID NO: 5069504 - DNA, 23 bp, Homo sapiens
aaaagggggctattccctggaga

SEQ ID NO: 5069505 - DNA, 13 bp, Homo sapiens
aaaagggtcagag

SEQ ID NO: 5069506 - DNA, 19 bp, Homo sapiens
aaaagggtcttgggaaata

SEQ ID NO: 5069507 - DNA, 20 bp, Homo sapiens
aaaagggtgtatagtgttca

SEQ ID NO: 5069508 - DNA, 22 bp, Homo sapiens
aaaagggtgtatagtgttcaca

SEQ ID NO: 5069509 - DNA, 19 bp, Homo sapiens
aaaaggtagagtcttacaa

SEQ ID NO: 5069510 - DNA, 23 bp, Homo sapiens
aaaaggtagatcctgagatgatt

SEQ ID NO: 5069511 - DNA, 15 bp, Homo sapiens
aaaaggtaggtcaga

SEQ ID NO: 5069512 - DNA, 18 bp, Homo sapiens
aaaaggtagtttttctgt

SEQ ID NO: 5069513 - DNA, 15 bp, Homo sapiens
aaaaggtataaataa

SEQ ID NO: 5069514 - DNA, 19 bp, Homo sapiens
aaaaggtattttgaatacc

SEQ ID NO: 5069515 - DNA, 21 bp, Homo sapiens
aaaaggtgaaaatgttttatt

SEQ ID NO: 5069516 - DNA, 18 bp, Homo sapiens
aaaaggtgataaaatcat

SEQ ID NO: 5069517 - DNA, 18 bp, Homo sapiens
aaaaggtgattaaatatt

SEQ ID NO: 5069518 - DNA, 20 bp, Homo sapiens
aaaaggtgcctgtgaggcag

SEQ ID NO: 5069519 - DNA, 22 bp, Homo sapiens
aaaaggtgcctgtgaggcaggg

SEQ ID NO: 5069520 - DNA, 17 bp, Homo sapiens
aaaaggtgtcaactttt

SEQ ID NO: 5069521 - DNA, 16 bp, Homo sapiens
aaaaggttaagccata

SEQ ID NO: 5069522 - DNA, 13 bp, Homo sapiens
aaaaggttgaata

SEQ ID NO: 5069523 - DNA, 14 bp, Homo sapiens
aaaaggttgccaaa

SEQ ID NO: 5069524 - DNA, 13 bp, Homo sapiens
aaaaggtttacag

SEQ ID NO: 5069525 - DNA, 18 bp, Homo sapiens
aaaaggtttacagaattt

SEQ ID NO: 5069526 - DNA, 23 bp, Homo sapiens
aaaaggtttctttttttttcctt

SEQ ID NO: 5069527 - DNA, 17 bp, Homo sapiens
aaaaggttttattttgt

SEQ ID NO: 5069528 - DNA, 18 bp, Homo sapiens
aaaagtaagaatgcaaaa

SEQ ID NO: 5069529 - DNA, 21 bp, Homo sapiens
aaaagtaagggaataaatttt

SEQ ID NO: 5069530 - DNA, 23 bp, Homo sapiens
aaaagtaagtaccactcaggcca

SEQ ID NO: 5069531 - DNA, 13 bp, Homo sapiens
aaaagtaataaag

SEQ ID NO: 5069532 - DNA, 15 bp, Homo sapiens
aaaagtaataaagag

SEQ ID NO: 5069533 - DNA, 14 bp, Homo sapiens
aaaagtaatcatgt

SEQ ID NO: 5069534 - DNA, 22 bp, Homo sapiens
aaaagtaatctttaaactggct

SEQ ID NO: 5069535 - DNA, 14 bp, Homo sapiens
aaaagtaatgaaga

SEQ ID NO: 5069536 - DNA, 19 bp, Homo sapiens
aaaagtacatagtgaattt

SEQ ID NO: 5069537 - DNA, 23 bp, Homo sapiens
aaaagtacattgcttaaaatata

SEQ ID NO: 5069538 - DNA, 17 bp, Homo sapiens
aaaagtaccagcatgtt

SEQ ID NO: 5069539 - DNA, 22 bp, Homo sapiens
aaaagtacctctgcattgagca

SEQ ID NO: 5069540 - DNA, 14 bp, Homo sapiens
aaaagtactttaaa

SEQ ID NO: 5069541 - DNA, 15 bp, Homo sapiens
aaaagtagaactttg

SEQ ID NO: 5069542 - DNA, 18 bp, Homo sapiens
aaaagtagaactttgtat

SEQ ID NO: 5069543 - DNA, 23 bp, Homo sapiens
aaaagtagaattatatctaattt

SEQ ID NO: 5069544 - DNA, 12 bp, Homo sapiens
aaaagtagactt

SEQ ID NO: 5069545 - DNA, 14 bp, Homo sapiens
aaaagtagagaaat

SEQ ID NO: 5069546 - DNA, 13 bp, Homo sapiens
aaaagtaggctgc

SEQ ID NO: 5069547 - DNA, 21 bp, Homo sapiens
aaaagtagtaaattttgtgat

SEQ ID NO: 5069548 - DNA, 22 bp, Homo sapiens
aaaagtagtgttgtccaggaag

SEQ ID NO: 5069549 - DNA, 11 bp, Homo sapiens
aaaagtatata

SEQ ID NO: 5069550 - DNA, 15 bp, Homo sapiens
aaaagtatatgttag

SEQ ID NO: 5069551 - DNA, 21 bp, Homo sapiens
aaaagtatcgggggctggggc

SEQ ID NO: 5069552 - DNA, 22 bp, Homo sapiens
aaaagtatcgggggctggggca

SEQ ID NO: 5069553 - DNA, 14 bp, Homo sapiens
aaaagtatctttaa

SEQ ID NO: 5069554 - DNA, 16 bp, Homo sapiens
aaaagtatctttaaca

SEQ ID NO: 5069555 - DNA, 23 bp, Homo sapiens
aaaagtatctttaacaattgtct

SEQ ID NO: 5069556 - DNA, 22 bp, Homo sapiens
aaaagtatgcagattatttgcc

SEQ ID NO: 5069557 - DNA, 14 bp, Homo sapiens
aaaagtatgttgta

SEQ ID NO: 5069558 - DNA, 14 bp, Homo sapiens
aaaagtattatttt

SEQ ID NO: 5069559 - DNA, 20 bp, Homo sapiens
aaaagtattattttccaaaa

SEQ ID NO: 5069560 - DNA, 19 bp, Homo sapiens
aaaagtattgaaagccaac

SEQ ID NO: 5069561 - DNA, 22 bp, Homo sapiens
aaaagtattggttactggtgat

SEQ ID NO: 5069562 - DNA, 12 bp, Homo sapiens
aaaagtattttc

SEQ ID NO: 5069563 - DNA, 14 bp, Homo sapiens
aaaagtattttgaa

SEQ ID NO: 5069564 - DNA, 23 bp, Homo sapiens
aaaagtattttgaagtttacatt

SEQ ID NO: 5069565 - DNA, 19 bp, Homo sapiens
aaaagtattttttcaagtt

SEQ ID NO: 5069566 - DNA, 15 bp, Homo sapiens
aaaagtcaaaaggtg

SEQ ID NO: 5069567 - DNA, 15 bp, Homo sapiens
aaaagtcaaactttc

SEQ ID NO: 5069568 - DNA, 15 bp, Homo sapiens
aaaagtcacaatgtt

SEQ ID NO: 5069569 - DNA, 15 bp, Homo sapiens
aaaagtcacacagac

SEQ ID NO: 5069570 - DNA, 23 bp, Homo sapiens
aaaagtcaccaaatagtgtgaaa

SEQ ID NO: 5069571 - DNA, 19 bp, Homo sapiens
aaaagtcagactgctggga

SEQ ID NO: 5069572 - DNA, 14 bp, Homo sapiens
aaaagtcattcaag

SEQ ID NO: 5069573 - DNA, 13 bp, Homo sapiens
aaaagtccctccc

SEQ ID NO: 5069574 - DNA, 16 bp, Homo sapiens
aaaagtccctccctgc

SEQ ID NO: 5069575 - DNA, 17 bp, Homo sapiens
aaaagtccttgcaagaa

SEQ ID NO: 5069576 - DNA, 14 bp, Homo sapiens
aaaagtctgtcttt

SEQ ID NO: 5069577 - DNA, 19 bp, Homo sapiens
aaaagtcttaggtgaacaa

SEQ ID NO: 5069578 - DNA, 23 bp, Homo sapiens
aaaagtcttcaagggctgcttca

SEQ ID NO: 5069579 - DNA, 19 bp, Homo sapiens
aaaagtcttcactctctga

SEQ ID NO: 5069580 - DNA, 20 bp, Homo sapiens
aaaagtcttctcccaactca

SEQ ID NO: 5069581 - DNA, 17 bp, Homo sapiens
aaaagtgaaaaaaagaa

SEQ ID NO: 5069582 - DNA, 19 bp, Homo sapiens
aaaagtgaacttgatttta

SEQ ID NO: 5069583 - DNA, 22 bp, Homo sapiens
aaaagtgaacttttgtaatttg

SEQ ID NO: 5069584 - DNA, 14 bp, Homo sapiens
aaaagtgacacagc

SEQ ID NO: 5069585 - DNA, 16 bp, Homo sapiens
aaaagtgacagatgtt

SEQ ID NO: 5069586 - DNA, 17 bp, Homo sapiens
aaaagtgacagatgtta

SEQ ID NO: 5069587 - DNA, 14 bp, Homo sapiens
aaaagtgactctca

SEQ ID NO: 5069588 - DNA, 17 bp, Homo sapiens
aaaagtgactctcagcg

SEQ ID NO: 5069589 - DNA, 16 bp, Homo sapiens
aaaagtgagagacctc

SEQ ID NO: 5069590 - DNA, 16 bp, Homo sapiens
aaaagtgatgtatttt

SEQ ID NO: 5069591 - DNA, 23 bp, Homo sapiens
aaaagtgatgtattttcatagtg

SEQ ID NO: 5069592 - DNA, 19 bp, Homo sapiens
aaaagtgatgtgatttatg

SEQ ID NO: 5069593 - DNA, 21 bp, Homo sapiens
aaaagtgatgtgatttatgca

SEQ ID NO: 5069594 - DNA, 15 bp, Homo sapiens
aaaagtgattgtgaa

SEQ ID NO: 5069595 - DNA, 16 bp, Homo sapiens
aaaagtgattgtgaag

SEQ ID NO: 5069596 - DNA, 14 bp, Homo sapiens
aaaagtgcaaagtt

SEQ ID NO: 5069597 - DNA, 15 bp, Homo sapiens
aaaagtgcaacttga

SEQ ID NO: 5069598 - DNA, 14 bp, Homo sapiens
aaaagtgcatttaa

SEQ ID NO: 5069599 - DNA, 15 bp, Homo sapiens
aaaagtgcttcattc

SEQ ID NO: 5069600 - DNA, 18 bp, Homo sapiens
aaaagtggctggaagagt

SEQ ID NO: 5069601 - DNA, 13 bp, Homo sapiens
aaaagtggggcag

SEQ ID NO: 5069602 - DNA, 14 bp, Homo sapiens
aaaagtggggcaga

SEQ ID NO: 5069603 - DNA, 15 bp, Homo sapiens
aaaagtggtctctgc

SEQ ID NO: 5069604 - DNA, 14 bp, Homo sapiens
aaaagtgtacaagt

SEQ ID NO: 5069605 - DNA, 13 bp, Homo sapiens
aaaagtgtacaga

SEQ ID NO: 5069606 - DNA, 21 bp, Homo sapiens
aaaagtgtacctgtaaatgtc

SEQ ID NO: 5069607 - DNA, 16 bp, Homo sapiens
aaaagtgtatagaata

SEQ ID NO: 5069608 - DNA, 12 bp, Homo sapiens
aaaagtgtattt

SEQ ID NO: 5069609 - DNA, 14 bp, Homo sapiens
aaaagtgtcctata

SEQ ID NO: 5069610 - DNA, 19 bp, Homo sapiens
aaaagtgtcctataattct

SEQ ID NO: 5069611 - DNA, 21 bp, Homo sapiens
aaaagtgtgtatatattttgt

SEQ ID NO: 5069612 - DNA, 19 bp, Homo sapiens
aaaagtgttgattacataa

SEQ ID NO: 5069613 - DNA, 17 bp, Homo sapiens
aaaagtgtttttacata

SEQ ID NO: 5069614 - DNA, 18 bp, Homo sapiens
aaaagtgtttttacatat

SEQ ID NO: 5069615 - DNA, 16 bp, Homo sapiens
aaaagttaaaaaaaat

SEQ ID NO: 5069616 - DNA, 22 bp, Homo sapiens
aaaagttaagctgctatagtaa

SEQ ID NO: 5069617 - DNA, 22 bp, Homo sapiens
aaaagttaataacagctccttt

SEQ ID NO: 5069618 - DNA, 21 bp, Homo sapiens
aaaagttaatattcagatgtt

SEQ ID NO: 5069619 - DNA, 23 bp, Homo sapiens
aaaagttaatgcttaagagggaa

SEQ ID NO: 5069620 - DNA, 19 bp, Homo sapiens
aaaagttactaatatatct

SEQ ID NO: 5069621 - DNA, 14 bp, Homo sapiens
aaaagttagtatta

SEQ ID NO: 5069622 - DNA, 15 bp, Homo sapiens
aaaagttataataac

SEQ ID NO: 5069623 - DNA, 21 bp, Homo sapiens
aaaagttataataactgaact

SEQ ID NO: 5069624 - DNA, 15 bp, Homo sapiens
aaaagttattaaaat

SEQ ID NO: 5069625 - DNA, 12 bp, Homo sapiens
aaaagttattta

SEQ ID NO: 5069626 - DNA, 14 bp, Homo sapiens
aaaagttatttatg

SEQ ID NO: 5069627 - DNA, 16 bp, Homo sapiens
aaaagttatttatgct

SEQ ID NO: 5069628 - DNA, 21 bp, Homo sapiens
aaaagttcaatactcttgaaa

SEQ ID NO: 5069629 - DNA, 15 bp, Homo sapiens
aaaagttccaagagt

SEQ ID NO: 5069630 - DNA, 16 bp, Homo sapiens
aaaagttccatagaaa

SEQ ID NO: 5069631 - DNA, 16 bp, Homo sapiens
aaaagttcgaaagaaa

SEQ ID NO: 5069632 - DNA, 17 bp, Homo sapiens
aaaagttctgacttgac

SEQ ID NO: 5069633 - DNA, 18 bp, Homo sapiens
aaaagttctgcagataaa

SEQ ID NO: 5069634 - DNA, 15 bp, Homo sapiens
aaaagttcttaaaac

SEQ ID NO: 5069635 - DNA, 11 bp, Homo sapiens
aaaagttcttt

SEQ ID NO: 5069636 - DNA, 17 bp, Homo sapiens
aaaagttgaaaagccaa

SEQ ID NO: 5069637 - DNA, 19 bp, Homo sapiens
aaaagttgaaaagccaaag

SEQ ID NO: 5069638 - DNA, 19 bp, Homo sapiens
aaaagttgaaatgtgtaat

SEQ ID NO: 5069639 - DNA, 14 bp, Homo sapiens
aaaagttgaaatta

SEQ ID NO: 5069640 - DNA, 14 bp, Homo sapiens
aaaagttgaaccat

SEQ ID NO: 5069641 - DNA, 18 bp, Homo sapiens
aaaagttgaattttacat

SEQ ID NO: 5069642 - DNA, 16 bp, Homo sapiens
aaaagttgagattttg

SEQ ID NO: 5069643 - DNA, 22 bp, Homo sapiens
aaaagttgcaaagtggaattaa

SEQ ID NO: 5069644 - DNA, 14 bp, Homo sapiens
aaaagttgcagtct

SEQ ID NO: 5069645 - DNA, 22 bp, Homo sapiens
aaaagttgctatttgaactttt

SEQ ID NO: 5069646 - DNA, 13 bp, Homo sapiens
aaaagttggaagg

SEQ ID NO: 5069647 - DNA, 18 bp, Homo sapiens
aaaagttggagttatatt

SEQ ID NO: 5069648 - DNA, 14 bp, Homo sapiens
aaaagttggtattt

SEQ ID NO: 5069649 - DNA, 22 bp, Homo sapiens
aaaagttgtaatagagaatatt

SEQ ID NO: 5069650 - DNA, 15 bp, Homo sapiens
aaaagttgttcaact

SEQ ID NO: 5069651 - DNA, 16 bp, Homo sapiens
aaaagttgtttaataa

SEQ ID NO: 5069652 - DNA, 16 bp, Homo sapiens
aaaagttgtttataaa

SEQ ID NO: 5069653 - DNA, 17 bp, Homo sapiens
aaaagttgtttataaaa

SEQ ID NO: 5069654 - DNA, 14 bp, Homo sapiens
aaaagtttaaagaa

SEQ ID NO: 5069655 - DNA, 21 bp, Homo sapiens
aaaagtttaatattaaagcca

SEQ ID NO: 5069656 - DNA, 23 bp, Homo sapiens
aaaagtttaatattaaagccatg

SEQ ID NO: 5069657 - DNA, 19 bp, Homo sapiens
aaaagtttatctttgcaca

SEQ ID NO: 5069658 - DNA, 13 bp, Homo sapiens
aaaagtttcaatg

SEQ ID NO: 5069659 - DNA, 20 bp, Homo sapiens
aaaagtttcacaacagattt

SEQ ID NO: 5069660 - DNA, 20 bp, Homo sapiens
aaaagtttcacgtcttggtg

SEQ ID NO: 5069661 - DNA, 12 bp, Homo sapiens
aaaagtttccat

SEQ ID NO: 5069662 - DNA, 13 bp, Homo sapiens
aaaagtttcctag

SEQ ID NO: 5069663 - DNA, 23 bp, Homo sapiens
aaaagtttcctaggatgtcatgt

SEQ ID NO: 5069664 - DNA, 11 bp, Homo sapiens
aaaagtttcta

SEQ ID NO: 5069665 - DNA, 23 bp, Homo sapiens
aaaagtttctatttagttattta

SEQ ID NO: 5069666 - DNA, 17 bp, Homo sapiens
aaaagtttgaaaagcaa

SEQ ID NO: 5069667 - DNA, 18 bp, Homo sapiens
aaaagtttgaaaagcaat

SEQ ID NO: 5069668 - DNA, 22 bp, Homo sapiens
aaaagttttcaagcattgctaa

SEQ ID NO: 5069669 - DNA, 19 bp, Homo sapiens
aaaagttttgaaggaaacc

SEQ ID NO: 5069670 - DNA, 20 bp, Homo sapiens
aaaagttttgaaggaaacct

SEQ ID NO: 5069671 - DNA, 20 bp, Homo sapiens
aaaagttttgatatttattt

SEQ ID NO: 5069672 - DNA, 18 bp, Homo sapiens
aaaaatgggacttctttt

SEQ ID NO: 5069673 - DNA, 11 bp, Homo sapiens
aaaaatggtaa

SEQ ID NO: 5069674 - DNA, 15 bp, Homo sapiens
aaaaatggtaaaatt

SEQ ID NO: 5069675 - DNA, 16 bp, Homo sapiens
aaaaatggtaaaattg

SEQ ID NO: 5069676 - DNA, 19 bp, Homo sapiens
aaaaatggtagcattttaa

SEQ ID NO: 5069677 - DNA, 20 bp, Homo sapiens
aaaaatggtagcattttaaa

SEQ ID NO: 5069678 - DNA, 19 bp, Homo sapiens
aaaaatggtatcaaaatta

SEQ ID NO: 5069679 - DNA, 18 bp, Homo sapiens
aaaaatggtggcttcagc

SEQ ID NO: 5069680 - DNA, 16 bp, Homo sapiens
aaaaatgtaaaacaca

SEQ ID NO: 5069681 - DNA, 22 bp, Homo sapiens
aaaaatgtaaattagtttgaca

SEQ ID NO: 5069682 - DNA, 12 bp, Homo sapiens
aaaaatgtacat

SEQ ID NO: 5069683 - DNA, 15 bp, Homo sapiens
aaaaatgtagctttt

SEQ ID NO: 5069684 - DNA, 19 bp, Homo sapiens
aaaaatgtagcttttatgt

SEQ ID NO: 5069685 - DNA, 22 bp, Homo sapiens
aaaaatgtatgctatcctctta

SEQ ID NO: 5069686 - DNA, 13 bp, Homo sapiens
aaaaatgtatgtt

SEQ ID NO: 5069687 - DNA, 23 bp, Homo sapiens
aaaaatgtcaaaagtagaacttt

SEQ ID NO: 5069688 - DNA, 14 bp, Homo sapiens
aaaaatgtcactat

SEQ ID NO: 5069689 - DNA, 21 bp, Homo sapiens
aaaaatgtcttgctgttgaca

SEQ ID NO: 5069690 - DNA, 12 bp, Homo sapiens
aaaaatgtgaaa

SEQ ID NO: 5069691 - DNA, 19 bp, Homo sapiens
aaaaatgtgaaaaaaatta

SEQ ID NO: 5069692 - DNA, 20 bp, Homo sapiens
aaaaatgtgaaatgctttta

SEQ ID NO: 5069693 - DNA, 16 bp, Homo sapiens
aaaaatgtgaaatttt

SEQ ID NO: 5069694 - DNA, 12 bp, Homo sapiens
aaaaatgtgaat

SEQ ID NO: 5069695 - DNA, 20 bp, Homo sapiens
aaaaatgttaaaatgtattc

SEQ ID NO: 5069696 - DNA, 14 bp, Homo sapiens
aaaaatgttcaaat

SEQ ID NO: 5069697 - DNA, 13 bp, Homo sapiens
aaaaatgttcatt

SEQ ID NO: 5069698 - DNA, 15 bp, Homo sapiens
aaaaatgttctatat

SEQ ID NO: 5069699 - DNA, 13 bp, Homo sapiens
aaaaatgttctca

SEQ ID NO: 5069700 - DNA, 22 bp, Homo sapiens
aaaaatgtttgtactttttaat

SEQ ID NO: 5069701 - DNA, 11 bp, Homo sapiens
aaaaatgtttt

SEQ ID NO: 5069702 - DNA, 19 bp, Homo sapiens
aaaaatgttttccaatatt

SEQ ID NO: 5069703 - DNA, 16 bp, Homo sapiens
aaaaatgttttttcat

SEQ ID NO: 5069704 - DNA, 17 bp, Homo sapiens
aaaaattaaaatggatg

SEQ ID NO: 5069705 - DNA, 17 bp, Homo sapiens
aaaaattaaaccaagca

SEQ ID NO: 5069706 - DNA, 21 bp, Homo sapiens
aaaaattaaaccggaccatct

SEQ ID NO: 5069707 - DNA, 16 bp, Homo sapiens
aaaaattaaatattta

SEQ ID NO: 5069708 - DNA, 17 bp, Homo sapiens
aaaaattaaatatttat

SEQ ID NO: 5069709 - DNA, 13 bp, Homo sapiens
aaaaattaagtct

SEQ ID NO: 5069710 - DNA, 23 bp, Homo sapiens
aaaaattaattctttatcacatg

SEQ ID NO: 5069711 - DNA, 14 bp, Homo sapiens
aaaaattacaaaga

SEQ ID NO: 5069712 - DNA, 21 bp, Homo sapiens
aaaaattacagatcatataag

SEQ ID NO: 5069713 - DNA, 14 bp, Homo sapiens
aaaaattacattat

SEQ ID NO: 5069714 - DNA, 16 bp, Homo sapiens
aaaaattacttagtat

SEQ ID NO: 5069715 - DNA, 19 bp, Homo sapiens
aaaaattagccttgatatt

SEQ ID NO: 5069716 - DNA, 22 bp, Homo sapiens
aaaaattaggacagaaataata

SEQ ID NO: 5069717 - DNA, 16 bp, Homo sapiens
aaaaattatagactcc

SEQ ID NO: 5069718 - DNA, 14 bp, Homo sapiens
aaaaattatatttt

SEQ ID NO: 5069719 - DNA, 20 bp, Homo sapiens
aaaaattatcagttatattt

SEQ ID NO: 5069720 - DNA, 12 bp, Homo sapiens
aaaaattatgca

SEQ ID NO: 5069721 - DNA, 18 bp, Homo sapiens
aaaaattattatatattt

SEQ ID NO: 5069722 - DNA, 19 bp, Homo sapiens
aaaaattattgattgcttt

SEQ ID NO: 5069723 - DNA, 14 bp, Homo sapiens
aaaaattatttttt

SEQ ID NO: 5069724 - DNA, 16 bp, Homo sapiens
aaaaattcataaccaa

SEQ ID NO: 5069725 - DNA, 15 bp, Homo sapiens
aaaaattcccttcct

SEQ ID NO: 5069726 - DNA, 13 bp, Homo sapiens
aaaaattgaaatg

SEQ ID NO: 5069727 - DNA, 13 bp, Homo sapiens
aaaaattgaagag

SEQ ID NO: 5069728 - DNA, 19 bp, Homo sapiens
aaaaattgaagagagatat

SEQ ID NO: 5069729 - DNA, 16 bp, Homo sapiens
aaaaattgaataatgt

SEQ ID NO: 5069730 - DNA, 12 bp, Homo sapiens
aaaaattgcaca

SEQ ID NO: 5069731 - DNA, 17 bp, Homo sapiens
aaaaattgcacaatttg

SEQ ID NO: 5069732 - DNA, 20 bp, Homo sapiens
aaaaattgctctgtgtatat

SEQ ID NO: 5069733 - DNA, 21 bp, Homo sapiens
aaaaattgctgactgtagctt

SEQ ID NO: 5069734 - DNA, 17 bp, Homo sapiens
aaaaattggcattttaa

SEQ ID NO: 5069735 - DNA, 23 bp, Homo sapiens
aaaaattggcattttaagtgttt

SEQ ID NO: 5069736 - DNA, 19 bp, Homo sapiens
aaaaattggggattcttaa

SEQ ID NO: 5069737 - DNA, 18 bp, Homo sapiens
aaaaattggttctttatt

SEQ ID NO: 5069738 - DNA, 23 bp, Homo sapiens
aaaaattgtattgaaaacactta

SEQ ID NO: 5069739 - DNA, 14 bp, Homo sapiens
aaaaattgtctctt

SEQ ID NO: 5069740 - DNA, 15 bp, Homo sapiens
aaaaattgtctttat

SEQ ID NO: 5069741 - DNA, 22 bp, Homo sapiens
aaaaattgtgtttagattttat

SEQ ID NO: 5069742 - DNA, 23 bp, Homo sapiens
aaaaattgtgtttagattttatg

SEQ ID NO: 5069743 - DNA, 21 bp, Homo sapiens
aaaaattgttaatttttccta

SEQ ID NO: 5069744 - DNA, 13 bp, Homo sapiens
aaaaattgttata

SEQ ID NO: 5069745 - DNA, 12 bp, Homo sapiens
aaaaattgtttc

SEQ ID NO: 5069746 - DNA, 23 bp, Homo sapiens
aaaaattgtttcaaaataaaaac

SEQ ID NO: 5069747 - DNA, 15 bp, Homo sapiens
aaaaattgtttccaa

SEQ ID NO: 5069748 - DNA, 15 bp, Homo sapiens
aaaaattgtttttcc

SEQ ID NO: 5069749 - DNA, 12 bp, Homo sapiens
aaaaatttaaga

SEQ ID NO: 5069750 - DNA, 15 bp, Homo sapiens
aaaaatttaagcatt

SEQ ID NO: 5069751 - DNA, 20 bp, Homo sapiens
aaaaatttaagcattgtttg

SEQ ID NO: 5069752 - DNA, 21 bp, Homo sapiens
aaaaatttaagcattgtttgc

SEQ ID NO: 5069753 - DNA, 12 bp, Homo sapiens
aaaaatttataa

SEQ ID NO: 5069754 - DNA, 23 bp, Homo sapiens
aaaaatttattatatatttacag

SEQ ID NO: 5069755 - DNA, 18 bp, Homo sapiens
aaaaatttctggcaaata

SEQ ID NO: 5069756 - DNA, 17 bp, Homo sapiens
aaaaatttgaacactgg

SEQ ID NO: 5069757 - DNA, 20 bp, Homo sapiens
aaaaatttgaaccaaaacat

SEQ ID NO: 5069758 - DNA, 21 bp, Homo sapiens
aaaaatttgacattgtcagaa

SEQ ID NO: 5069759 - DNA, 23 bp, Homo sapiens
aaaaatttgtgtgcttctgctca

SEQ ID NO: 5069760 - DNA, 15 bp, Homo sapiens
aaaaatttgtttaaa

SEQ ID NO: 5069761 - DNA, 16 bp, Homo sapiens
aaaaatttgtttaaag

SEQ ID NO: 5069762 - DNA, 17 bp, Homo sapiens
aaaaattttattatcct

SEQ ID NO: 5069763 - DNA, 19 bp, Homo sapiens
aaaaattttgcatttcatg

SEQ ID NO: 5069764 - DNA, 21 bp, Homo sapiens
aaaaattttgtgacattcctt

SEQ ID NO: 5069765 - DNA, 23 bp, Homo sapiens
aaaaattttgtgacattccttct

SEQ ID NO: 5069766 - DNA, 15 bp, Homo sapiens
aaaaatttttataaa

SEQ ID NO: 5069767 - DNA, 13 bp, Homo sapiens
aaaaatttttgtt

SEQ ID NO: 5069768 - DNA, 19 bp, Homo sapiens
aaaaatttttttgttgttt

SEQ ID NO: 5069769 - DNA, 22 bp, Homo sapiens
aaaaatttttttttctcttttt

SEQ ID NO: 5069770 - DNA, 10 bp, Homo sapiens
aaaacaaaaa

SEQ ID NO: 5069771 - DNA, 11 bp, Homo sapiens
aaaacaaaaaa

SEQ ID NO: 5069772 - DNA, 12 bp, Homo sapiens
aaaacaaaaaac

SEQ ID NO: 5069773 - DNA, 15 bp, Homo sapiens
aaaacaaaaagaaca

SEQ ID NO: 5069774 - DNA, 16 bp, Homo sapiens
aaaacaaaaagaacaa

SEQ ID NO: 5069775 - DNA, 20 bp, Homo sapiens
aaaacaaaactatacttgaa

SEQ ID NO: 5069776 - DNA, 15 bp, Homo sapiens
aaaacaaaactgcat

SEQ ID NO: 5069777 - DNA, 12 bp, Homo sapiens
aaaacaaaagag

SEQ ID NO: 5069778 - DNA, 19 bp, Homo sapiens
aaaacaaaagggtgtatag

SEQ ID NO: 5069779 - DNA, 22 bp, Homo sapiens
aaaacaaaatttgactaatttt

SEQ ID NO: 5069780 - DNA, 15 bp, Homo sapiens
aaaacaaactcattc

SEQ ID NO: 5069781 - DNA, 13 bp, Homo sapiens
aaaacaaacttcc

SEQ ID NO: 5069782 - DNA, 12 bp, Homo sapiens
aaaacaaagaag

SEQ ID NO: 5069783 - DNA, 21 bp, Homo sapiens
aaaacaaagggaaaaaagagt

SEQ ID NO: 5069784 - DNA, 12 bp, Homo sapiens
aaaacaaagtgc

SEQ ID NO: 5069785 - DNA, 15 bp, Homo sapiens
aaaacaaagtgcaaa

SEQ ID NO: 5069786 - DNA, 18 bp, Homo sapiens
aaaacaaagtgcaaagct

SEQ ID NO: 5069787 - DNA, 19 bp, Homo sapiens
aaaacaaagtgcaaagctg

SEQ ID NO: 5069788 - DNA, 22 bp, Homo sapiens
aaaacaaagtgcaaagctgctt

SEQ ID NO: 5069789 - DNA, 20 bp, Homo sapiens
aaaacaaataataaatgttc

SEQ ID NO: 5069790 - DNA, 17 bp, Homo sapiens
aaaacaaatatacattt

SEQ ID NO: 5069791 - DNA, 20 bp, Homo sapiens
aaaacaacaaaaaaagtttg

SEQ ID NO: 5069792 - DNA, 18 bp, Homo sapiens
aaaacaacaaaagaattt

SEQ ID NO: 5069793 - DNA, 20 bp, Homo sapiens
aaaacaacaaataatttaag

SEQ ID NO: 5069794 - DNA, 19 bp, Homo sapiens
aaaacaaccaaagaaaatt

SEQ ID NO: 5069795 - DNA, 13 bp, Homo sapiens
aaaacaaccgtcc

SEQ ID NO: 5069796 - DNA, 22 bp, Homo sapiens
aaaacaactatggatcagaata

SEQ ID NO: 5069797 - DNA, 18 bp, Homo sapiens
aaaacaacttctttgtaa

SEQ ID NO: 5069798 - DNA, 22 bp, Homo sapiens
aaaacaactttcacttcttcct

SEQ ID NO: 5069799 - DNA, 18 bp, Homo sapiens
aaaacaagaaagtttccc

SEQ ID NO: 5069800 - DNA, 15 bp, Homo sapiens
aaaacaagaatgaaa

SEQ ID NO: 5069801 - DNA, 17 bp, Homo sapiens
aaaacaagactgcctcc

SEQ ID NO: 5069802 - DNA, 23 bp, Homo sapiens
aaaacaagcgtttatttgaatgt

SEQ ID NO: 5069803 - DNA, 14 bp, Homo sapiens
aaaacaaggatgaa

SEQ ID NO: 5069804 - DNA, 21 bp, Homo sapiens
aaaacaagttggctagaagaa

SEQ ID NO: 5069805 - DNA, 16 bp, Homo sapiens
aaaacaataaaatttt

SEQ ID NO: 5069806 - DNA, 15 bp, Homo sapiens
aaaacaataatgcaa

SEQ ID NO: 5069807 - DNA, 18 bp, Homo sapiens
aaaacaataggatgggct

SEQ ID NO: 5069808 - DNA, 13 bp, Homo sapiens
aaaacaatatatg

SEQ ID NO: 5069809 - DNA, 13 bp, Homo sapiens
aaaacaatatatt

SEQ ID NO: 5069810 - DNA, 14 bp, Homo sapiens
aaaacaatatattt

SEQ ID NO: 5069811 - DNA, 15 bp, Homo sapiens
aaaacaatatctgca

SEQ ID NO: 5069812 - DNA, 19 bp, Homo sapiens
aaaacaatctggaagaaaa

SEQ ID NO: 5069813 - DNA, 13 bp, Homo sapiens
aaaacaatcttat

SEQ ID NO: 5069814 - DNA, 17 bp, Homo sapiens
aaaacaatgaaggaaaa

SEQ ID NO: 5069815 - DNA, 21 bp, Homo sapiens
aaaacaatgccatgaacaaat

SEQ ID NO: 5069816 - DNA, 23 bp, Homo sapiens
aaaacaatgccatgaacaaattc

SEQ ID NO: 5069817 - DNA, 18 bp, Homo sapiens
aaaacaatggagtattct

SEQ ID NO: 5069818 - DNA, 19 bp, Homo sapiens
aaaacaatggtaacatttt

SEQ ID NO: 5069819 - DNA, 22 bp, Homo sapiens
aaaacaatggtgtggtgaatgt

SEQ ID NO: 5069820 - DNA, 22 bp, Homo sapiens
aaaacaatgtattgctgataat

SEQ ID NO: 5069821 - DNA, 18 bp, Homo sapiens
aaaacaattgcaacagaa

SEQ ID NO: 5069822 - DNA, 21 bp, Homo sapiens
aaaacaattggttgtatataa

SEQ ID NO: 5069823 - DNA, 16 bp, Homo sapiens
aaaacaatttcttttt

SEQ ID NO: 5069824 - DNA, 18 bp, Homo sapiens
aaaacacaaaatgaataa

SEQ ID NO: 5069825 - DNA, 15 bp, Homo sapiens
aaaacacaaatgtgt

SEQ ID NO: 5069826 - DNA, 23 bp, Homo sapiens
aaaacacagacattctgccaggc

SEQ ID NO: 5069827 - DNA, 12 bp, Homo sapiens
aaaacacatgat

SEQ ID NO: 5069828 - DNA, 18 bp, Homo sapiens
aaaacacattgagtttaa

SEQ ID NO: 5069829 - DNA, 12 bp, Homo sapiens
aaaacacattgc

SEQ ID NO: 5069830 - DNA, 13 bp, Homo sapiens
aaaacacattttt

SEQ ID NO: 5069831 - DNA, 22 bp, Homo sapiens
aaaacaccagctgtatatattt

SEQ ID NO: 5069832 - DNA, 17 bp, Homo sapiens
aaaacacccttgaaaat

SEQ ID NO: 5069833 - DNA, 15 bp, Homo sapiens
aaaacaccttctata

SEQ ID NO: 5069834 - DNA, 20 bp, Homo sapiens
aaaacacgcacaccctgccc

SEQ ID NO: 5069835 - DNA, 20 bp, Homo sapiens
aaaacacggccctcctggga

SEQ ID NO: 5069836 - DNA, 21 bp, Homo sapiens
aaaacactaaaaataaaaatg

SEQ ID NO: 5069837 - DNA, 14 bp, Homo sapiens
aaaacactgtggaa

SEQ ID NO: 5069838 - DNA, 17 bp, Homo sapiens
aaaacacttagtatgca

SEQ ID NO: 5069839 - DNA, 13 bp, Homo sapiens
aaaacacttattc

SEQ ID NO: 5069840 - DNA, 15 bp, Homo sapiens
aaaacacttatttta

SEQ ID NO: 5069841 - DNA, 23 bp, Homo sapiens
aaaacacttattttacacagcaa

SEQ ID NO: 5069842 - DNA, 18 bp, Homo sapiens
aaaacacttccagtctgg

SEQ ID NO: 5069843 - DNA, 18 bp, Homo sapiens
aaaacacttggcatacaa

SEQ ID NO: 5069844 - DNA, 19 bp, Homo sapiens
aaaacacttggcatacaaa

SEQ ID NO: 5069845 - DNA, 16 bp, Homo sapiens
aaaacagaaaaacaaa

SEQ ID NO: 5069846 - DNA, 19 bp, Homo sapiens
aaaacagaaaaacagacaa

SEQ ID NO: 5069847 - DNA, 15 bp, Homo sapiens
aaaacagaaaaataa

SEQ ID NO: 5069848 - DNA, 12 bp, Homo sapiens
aaaacagaaaac

SEQ ID NO: 5069849 - DNA, 21 bp, Homo sapiens
aaaacagaacatcattagaac

SEQ ID NO: 5069850 - DNA, 18 bp, Homo sapiens
aaaacagaccagcatagt

SEQ ID NO: 5069851 - DNA, 21 bp, Homo sapiens
aaaagttttgatatttatttt

SEQ ID NO: 5069852 - DNA, 19 bp, Homo sapiens
aaaagtttttaatttgatg

SEQ ID NO: 5069853 - DNA, 20 bp, Homo sapiens
aaaagttttttattatgcat

SEQ ID NO: 5069854 - DNA, 16 bp, Homo sapiens
aaaataaaaaaaagaa

SEQ ID NO: 5069855 - DNA, 17 bp, Homo sapiens
aaaataaaaaaaagaaa

SEQ ID NO: 5069856 - DNA, 21 bp, Homo sapiens
aaaataaaaaaaagaaaaaag

SEQ ID NO: 5069857 - DNA, 21 bp, Homo sapiens
aaaataaaaagcgggcacggg

SEQ ID NO: 5069858 - DNA, 13 bp, Homo sapiens
aaaataaaaagtt

SEQ ID NO: 5069859 - DNA, 15 bp, Homo sapiens
aaaataaaaagttaa

SEQ ID NO: 5069860 - DNA, 16 bp, Homo sapiens
aaaataaaaagttaaa

SEQ ID NO: 5069861 - DNA, 19 bp, Homo sapiens
aaaataaaaagttaaaaag

SEQ ID NO: 5069862 - DNA, 18 bp, Homo sapiens
aaaataaaaatagaaata

SEQ ID NO: 5069863 - DNA, 13 bp, Homo sapiens
aaaataaaaatgg

SEQ ID NO: 5069864 - DNA, 13 bp, Homo sapiens
aaaataaaacaaa

SEQ ID NO: 5069865 - DNA, 16 bp, Homo sapiens
aaaataaaacaagcct

SEQ ID NO: 5069866 - DNA, 17 bp, Homo sapiens
aaaataaaacaagcctt

SEQ ID NO: 5069867 - DNA, 14 bp, Homo sapiens
aaaataaaacacac

SEQ ID NO: 5069868 - DNA, 14 bp, Homo sapiens
aaaataaaacagta

SEQ ID NO: 5069869 - DNA, 13 bp, Homo sapiens
aaaataaaacata

SEQ ID NO: 5069870 - DNA, 18 bp, Homo sapiens
aaaataaaacatagcaaa

SEQ ID NO: 5069871 - DNA, 14 bp, Homo sapiens
aaaataaaacatgt

SEQ ID NO: 5069872 - DNA, 19 bp, Homo sapiens
aaaataaaaccagaaagag

SEQ ID NO: 5069873 - DNA, 14 bp, Homo sapiens
aaaataaaactaag

SEQ ID NO: 5069874 - DNA, 12 bp, Homo sapiens
aaaataaaagct

SEQ ID NO: 5069875 - DNA, 13 bp, Homo sapiens
aaaataaaagcta

SEQ ID NO: 5069876 - DNA, 19 bp, Homo sapiens
aaaataaaaggactctgga

SEQ ID NO: 5069877 - DNA, 15 bp, Homo sapiens
aaaataaaataaata

SEQ ID NO: 5069878 - DNA, 17 bp, Homo sapiens
aaaataaaatactttga

SEQ ID NO: 5069879 - DNA, 13 bp, Homo sapiens
aaaataaaatatt

SEQ ID NO: 5069880 - DNA, 15 bp, Homo sapiens
aaaataaaatattca

SEQ ID NO: 5069881 - DNA, 17 bp, Homo sapiens
aaaataaaatattcact

SEQ ID NO: 5069882 - DNA, 20 bp, Homo sapiens
aaaataaaatatttttttcc

SEQ ID NO: 5069883 - DNA, 16 bp, Homo sapiens
aaaataaaatgcattt

SEQ ID NO: 5069884 - DNA, 13 bp, Homo sapiens
aaaataaaattaa

SEQ ID NO: 5069885 - DNA, 12 bp, Homo sapiens
aaaataaacatc

SEQ ID NO: 5069886 - DNA, 16 bp, Homo sapiens
aaaataaaccaacaat

SEQ ID NO: 5069887 - DNA, 13 bp, Homo sapiens
aaaataaacctgt

SEQ ID NO: 5069888 - DNA, 23 bp, Homo sapiens
aaaataaacgaaacatttagaca

SEQ ID NO: 5069889 - DNA, 19 bp, Homo sapiens
aaaataaactagtttccag

SEQ ID NO: 5069890 - DNA, 21 bp, Homo sapiens
aaaataaagaaaagatgcact

SEQ ID NO: 5069891 - DNA, 14 bp, Homo sapiens
aaaataaagaaata

SEQ ID NO: 5069892 - DNA, 12 bp, Homo sapiens
aaaataaagaat

SEQ ID NO: 5069893 - DNA, 15 bp, Homo sapiens
aaaataaagaatgga

SEQ ID NO: 5069894 - DNA, 20 bp, Homo sapiens
aaaataaagacaaccatatt

SEQ ID NO: 5069895 - DNA, 14 bp, Homo sapiens
aaaataaagcaaat

SEQ ID NO: 5069896 - DNA, 15 bp, Homo sapiens
aaaataaagcagaag

SEQ ID NO: 5069897 - DNA, 18 bp, Homo sapiens
aaaataaagctactgaat

SEQ ID NO: 5069898 - DNA, 19 bp, Homo sapiens
aaaataaagctactgaatt

SEQ ID NO: 5069899 - DNA, 20 bp, Homo sapiens
aaaataaagcttacatagtt

SEQ ID NO: 5069900 - DNA, 12 bp, Homo sapiens
aaaataaagtgt

SEQ ID NO: 5069901 - DNA, 15 bp, Homo sapiens
aaaataaagtgtgtg

SEQ ID NO: 5069902 - DNA, 19 bp, Homo sapiens
aaaataaagtttttttctt

SEQ ID NO: 5069903 - DNA, 20 bp, Homo sapiens
aaaataaataaaaactaatt

SEQ ID NO: 5069904 - DNA, 14 bp, Homo sapiens
aaaataaataaata

SEQ ID NO: 5069905 - DNA, 15 bp, Homo sapiens
aaaataaataatttt

SEQ ID NO: 5069906 - DNA, 19 bp, Homo sapiens
aaaataaataccaattatg

SEQ ID NO: 5069907 - DNA, 15 bp, Homo sapiens
aaaataaatatacta

SEQ ID NO: 5069908 - DNA, 16 bp, Homo sapiens
aaaataaatatactaa

SEQ ID NO: 5069909 - DNA, 14 bp, Homo sapiens
aaaataaatatata

SEQ ID NO: 5069910 - DNA, 17 bp, Homo sapiens
aaaataaatatatctac

SEQ ID NO: 5069911 - DNA, 13 bp, Homo sapiens
aaaataaatatca

SEQ ID NO: 5069912 - DNA, 13 bp, Homo sapiens
aaaataaatcaag

SEQ ID NO: 5069913 - DNA, 11 bp, Homo sapiens
aaaataaatgg

SEQ ID NO: 5069914 - DNA, 14 bp, Homo sapiens
aaaataaatgtaaa

SEQ ID NO: 5069915 - DNA, 18 bp, Homo sapiens
aaaataaatgtcactgcc

SEQ ID NO: 5069916 - DNA, 19 bp, Homo sapiens
aaaataaatgtcactgcca

SEQ ID NO: 5069917 - DNA, 14 bp, Homo sapiens
aaaataaatgtttt

SEQ ID NO: 5069918 - DNA, 13 bp, Homo sapiens
aaaataaattaat

SEQ ID NO: 5069919 - DNA, 12 bp, Homo sapiens
aaaataaattat

SEQ ID NO: 5069920 - DNA, 12 bp, Homo sapiens
aaaataaattga

SEQ ID NO: 5069921 - DNA, 13 bp, Homo sapiens
aaaataaatttaa

SEQ ID NO: 5069922 - DNA, 14 bp, Homo sapiens
aaaataaatttata

SEQ ID NO: 5069923 - DNA, 22 bp, Homo sapiens
aaaataaattttaaaaaggaat

SEQ ID NO: 5069924 - DNA, 13 bp, Homo sapiens
aaaataacaacta

SEQ ID NO: 5069925 - DNA, 20 bp, Homo sapiens
aaaataacagagctggatgc

SEQ ID NO: 5069926 - DNA, 13 bp, Homo sapiens
aaaataacagtat

SEQ ID NO: 5069927 - DNA, 17 bp, Homo sapiens
aaaataacatctgaaaa

SEQ ID NO: 5069928 - DNA, 20 bp, Homo sapiens
aaaataacatctgaaaagaa

SEQ ID NO: 5069929 - DNA, 21 bp, Homo sapiens
aaaataacatctgaaaagaaa

SEQ ID NO: 5069930 - DNA, 13 bp, Homo sapiens
aaaataacatgct

SEQ ID NO: 5069931 - DNA, 14 bp, Homo sapiens
aaaataacatttga

SEQ ID NO: 5069932 - DNA, 13 bp, Homo sapiens
aaaataaccaaaa

SEQ ID NO: 5069933 - DNA, 19 bp, Homo sapiens
aaaataaccggatatatac

SEQ ID NO: 5069934 - DNA, 18 bp, Homo sapiens
aaaataacctaattaata

SEQ ID NO: 5069935 - DNA, 18 bp, Homo sapiens
aaaataaccttgcagaag

SEQ ID NO: 5069936 - DNA, 22 bp, Homo sapiens
aaaataacggtgcttgtgtcac

SEQ ID NO: 5069937 - DNA, 18 bp, Homo sapiens
aaaataactatcaggcag

SEQ ID NO: 5069938 - DNA, 13 bp, Homo sapiens
aaaataactattt

SEQ ID NO: 5069939 - DNA, 20 bp, Homo sapiens
aaaataactattttgtttta

SEQ ID NO: 5069940 - DNA, 18 bp, Homo sapiens
aaaataacttagactcta

SEQ ID NO: 5069941 - DNA, 16 bp, Homo sapiens
aaaataacttcaagca

SEQ ID NO: 5069942 - DNA, 12 bp, Homo sapiens
aaaataagaaaa

SEQ ID NO: 5069943 - DNA, 14 bp, Homo sapiens
aaaataagaaagaa

SEQ ID NO: 5069944 - DNA, 22 bp, Homo sapiens
aaaataagatgggcccaaaggt

SEQ ID NO: 5069945 - DNA, 19 bp, Homo sapiens
aaaataagcaggtggatct

SEQ ID NO: 5069946 - DNA, 12 bp, Homo sapiens
aaaataagtaaa

SEQ ID NO: 5069947 - DNA, 14 bp, Homo sapiens
aaaataagtaaagt

SEQ ID NO: 5069948 - DNA, 14 bp, Homo sapiens
aaaataagtaaata

SEQ ID NO: 5069949 - DNA, 13 bp, Homo sapiens
aaaataagtaaca

SEQ ID NO: 5069950 - DNA, 15 bp, Homo sapiens
aaaataagtaacata

SEQ ID NO: 5069951 - DNA, 17 bp, Homo sapiens
aaaataagtaacatata

SEQ ID NO: 5069952 - DNA, 19 bp, Homo sapiens
aaaataagtaacatataaa

SEQ ID NO: 5069953 - DNA, 13 bp, Homo sapiens
aaaataagtcaaa

SEQ ID NO: 5069954 - DNA, 14 bp, Homo sapiens
aaaataagtcaaca

SEQ ID NO: 5069955 - DNA, 13 bp, Homo sapiens
aaaataagtctga

SEQ ID NO: 5069956 - DNA, 23 bp, Homo sapiens
aaaataagtgaaattttaaaagt

SEQ ID NO: 5069957 - DNA, 12 bp, Homo sapiens
aaaataagttct

SEQ ID NO: 5069958 - DNA, 14 bp, Homo sapiens
aaaataataaagtc

SEQ ID NO: 5069959 - DNA, 12 bp, Homo sapiens
aaaataatacaa

SEQ ID NO: 5069960 - DNA, 12 bp, Homo sapiens
aaaataatactt

SEQ ID NO: 5069961 - DNA, 14 bp, Homo sapiens
aaaataatcaagat

SEQ ID NO: 5069962 - DNA, 14 bp, Homo sapiens
aaaataatgcaaat

SEQ ID NO: 5069963 - DNA, 13 bp, Homo sapiens
aaaataatgcttt

SEQ ID NO: 5069964 - DNA, 18 bp, Homo sapiens
aaaataatgtactgaatt

SEQ ID NO: 5069965 - DNA, 16 bp, Homo sapiens
aaaataattaaataaa

SEQ ID NO: 5069966 - DNA, 17 bp, Homo sapiens
aaaataattagttaggc

SEQ ID NO: 5069967 - DNA, 15 bp, Homo sapiens
aaaataattctcaaa

SEQ ID NO: 5069968 - DNA, 21 bp, Homo sapiens
aaaataattgagactgaaaga

SEQ ID NO: 5069969 - DNA, 22 bp, Homo sapiens
aaaataattgatttcaagacct

SEQ ID NO: 5069970 - DNA, 14 bp, Homo sapiens
aaaataattgttgg

SEQ ID NO: 5069971 - DNA, 12 bp, Homo sapiens
aaaataatttaa

SEQ ID NO: 5069972 - DNA, 16 bp, Homo sapiens
aaaataatttaactaa

SEQ ID NO: 5069973 - DNA, 18 bp, Homo sapiens
aaaataatttaactaatt

SEQ ID NO: 5069974 - DNA, 19 bp, Homo sapiens
aaaataatttaactaattt

SEQ ID NO: 5069975 - DNA, 23 bp, Homo sapiens
aaaataatttaactaatttaaac

SEQ ID NO: 5069976 - DNA, 16 bp, Homo sapiens
aaaataatttagatat

SEQ ID NO: 5069977 - DNA, 15 bp, Homo sapiens
aaaataatttatcaa

SEQ ID NO: 5069978 - DNA, 21 bp, Homo sapiens
aaaataatttatcaaaaaaca

SEQ ID NO: 5069979 - DNA, 17 bp, Homo sapiens
aaaataatttctctaca

SEQ ID NO: 5069980 - DNA, 11 bp, Homo sapiens
aaaataatttt

SEQ ID NO: 5069981 - DNA, 19 bp, Homo sapiens
aaaataattttaaaaatgg

SEQ ID NO: 5069982 - DNA, 13 bp, Homo sapiens
aaaataattttgt

SEQ ID NO: 5069983 - DNA, 16 bp, Homo sapiens
aaaataatttttatat

SEQ ID NO: 5069984 - DNA, 16 bp, Homo sapiens
aaaatacaaacacatg

SEQ ID NO: 5069985 - DNA, 15 bp, Homo sapiens
aaaatacaataaact

SEQ ID NO: 5069986 - DNA, 17 bp, Homo sapiens
aaaatacaatcctgttt

SEQ ID NO: 5069987 - DNA, 19 bp, Homo sapiens
aaaatacaatcctgtttat

SEQ ID NO: 5069988 - DNA, 22 bp, Homo sapiens
aaaatacaatgttatcaaccaa

SEQ ID NO: 5069989 - DNA, 15 bp, Homo sapiens
aaaatacaattattg

SEQ ID NO: 5069990 - DNA, 14 bp, Homo sapiens
aaaatacacactca

SEQ ID NO: 5069991 - DNA, 12 bp, Homo sapiens
aaaatacagtaa

SEQ ID NO: 5069992 - DNA, 19 bp, Homo sapiens
aaaatacagtattatttag

SEQ ID NO: 5069993 - DNA, 18 bp, Homo sapiens
aaaatacataacttcagt

SEQ ID NO: 5069994 - DNA, 14 bp, Homo sapiens
aaaatacatagcat

SEQ ID NO: 5069995 - DNA, 14 bp, Homo sapiens
aaaatacatataaa

SEQ ID NO: 5069996 - DNA, 23 bp, Homo sapiens
aaaatacatataaagattaacac

SEQ ID NO: 5069997 - DNA, 12 bp, Homo sapiens
aaaatacatgaa

SEQ ID NO: 5069998 - DNA, 13 bp, Homo sapiens
aaaatacatgaag

SEQ ID NO: 5069999 - DNA, 15 bp, Homo sapiens
aaaatacatgaagct

SEQ ID NO: 5070000 - DNA, 20 bp, Homo sapiens
aaaatacattcttaaactag

SEQ ID NO: 5070001 - DNA, 12 bp, Homo sapiens
aaaatacattgt

SEQ ID NO: 5070002 - DNA, 12 bp, Homo sapiens
aaaatacattta

SEQ ID NO: 5070003 - DNA, 19 bp, Homo sapiens
aaaataccagagccttcaa

SEQ ID NO: 5070004 - DNA, 15 bp, Homo sapiens
aaaataccagccagt

SEQ ID NO: 5070005 - DNA, 15 bp, Homo sapiens
aaaataccattgaaa

SEQ ID NO: 5070006 - DNA, 16 bp, Homo sapiens
aaaataccattgaaat

SEQ ID NO: 5070007 - DNA, 16 bp, Homo sapiens
aaaatacggtgggggt

SEQ ID NO: 5070008 - DNA, 21 bp, Homo sapiens
aaaatactatgaaatgaaaga

SEQ ID NO: 5070009 - DNA, 21 bp, Homo sapiens
aaaatactatgcagtatctct

SEQ ID NO: 5070010 - DNA, 18 bp, Homo sapiens
aaaatactatttaagatg

SEQ ID NO: 5070011 - DNA, 22 bp, Homo sapiens
aaaatactatttaagatgtgaa

SEQ ID NO: 5070012 - DNA, 15 bp, Homo sapiens
aaaatactcaccaaa

SEQ ID NO: 5070013 - DNA, 12 bp, Homo sapiens
aaaatactccaa

SEQ ID NO: 5070014 - DNA, 21 bp, Homo sapiens
aaaatactccaaagatgactt

SEQ ID NO: 5070015 - DNA, 18 bp, Homo sapiens
aaaatactctaattctaa

SEQ ID NO: 5070016 - DNA, 15 bp, Homo sapiens
aaaatactctttcaa

SEQ ID NO: 5070017 - DNA, 18 bp, Homo sapiens
aaaatactgccagatgct

SEQ ID NO: 5070018 - DNA, 11 bp, Homo sapiens
aaaatactgta

SEQ ID NO: 5070019 - DNA, 9 bp, Homo sapiens
aaaatactt

SEQ ID NO: 5070020 - DNA, 12 bp, Homo sapiens
aaaatacttatt

SEQ ID NO: 5070021 - DNA, 12 bp, Homo sapiens
aaaatacttctt

SEQ ID NO: 5070022 - DNA, 19 bp, Homo sapiens
aaaatacttgagctgtata

SEQ ID NO: 5070023 - DNA, 20 bp, Homo sapiens
aaaatacttgtctgttttaa

SEQ ID NO: 5070024 - DNA, 11 bp, Homo sapiens
aaaatagaaac

SEQ ID NO: 5070025 - DNA, 13 bp, Homo sapiens
aaaatagaaacat

SEQ ID NO: 5070026 - DNA, 15 bp, Homo sapiens
aaaatagaagaagag

SEQ ID NO: 5070027 - DNA, 16 bp, Homo sapiens
aaaatagaataattct

SEQ ID NO: 5070028 - DNA, 12 bp, Homo sapiens
aaaatagaatat

SEQ ID NO: 5070029 - DNA, 17 bp, Homo sapiens
aaaatagaatatagcat

SEQ ID NO: 5070030 - DNA, 23 bp, Homo sapiens
aaaatagaatatagcatctttca

SEQ ID NO: 5070031 - DNA, 13 bp, Homo sapiens
aaaatagacactc

SEQ ID NO: 5070032 - DNA, 11 bp, Homo sapiens
aaaatagacat

SEQ ID NO: 5070033 - DNA, 13 bp, Homo sapiens
aaaatagacatct

SEQ ID NO: 5070034 - DNA, 17 bp, Homo sapiens
aaaatagacatgtagtt

SEQ ID NO: 5070035 - DNA, 15 bp, Homo sapiens
aaaatagagaaaatt

SEQ ID NO: 5070036 - DNA, 15 bp, Homo sapiens
aaaacagactcaggt

SEQ ID NO: 5070037 - DNA, 22 bp, Homo sapiens
aaaacagaggccacactttctg

SEQ ID NO: 5070038 - DNA, 18 bp, Homo sapiens
aaaacagatgaccataat

SEQ ID NO: 5070039 - DNA, 19 bp, Homo sapiens
aaaacagatgagaagacta

SEQ ID NO: 5070040 - DNA, 20 bp, Homo sapiens
aaaacagattctgattccct

SEQ ID NO: 5070041 - DNA, 17 bp, Homo sapiens
aaaacagatttgttcat

SEQ ID NO: 5070042 - DNA, 18 bp, Homo sapiens
aaaacagcaggccatctt

SEQ ID NO: 5070043 - DNA, 12 bp, Homo sapiens
aaaacagctatt

SEQ ID NO: 5070044 - DNA, 15 bp, Homo sapiens
aaaacagctatttta

SEQ ID NO: 5070045 - DNA, 23 bp, Homo sapiens
aaaacagctgtctctaacttatt

SEQ ID NO: 5070046 - DNA, 20 bp, Homo sapiens
aaaacagctttgtctccaaa

SEQ ID NO: 5070047 - DNA, 18 bp, Homo sapiens
aaaacaggcaaagtttta

SEQ ID NO: 5070048 - DNA, 19 bp, Homo sapiens
aaaacaggcaaagttttac

SEQ ID NO: 5070049 - DNA, 17 bp, Homo sapiens
aaaacagggtccaggaa

SEQ ID NO: 5070050 - DNA, 18 bp, Homo sapiens
aaaacagggtccaggaat

SEQ ID NO: 5070051 - DNA, 20 bp, Homo sapiens
aaaacagggtccaggaatgg

SEQ ID NO: 5070052 - DNA, 22 bp, Homo sapiens
aaaacaggtagaattatctaat

SEQ ID NO: 5070053 - DNA, 18 bp, Homo sapiens
aaaacaggtggagaaatt

SEQ ID NO: 5070054 - DNA, 17 bp, Homo sapiens
aaaacagtcctttaaat

SEQ ID NO: 5070055 - DNA, 18 bp, Homo sapiens
aaaacagtgctattctga

SEQ ID NO: 5070056 - DNA, 22 bp, Homo sapiens
aaaacagtgctattctgagtga

SEQ ID NO: 5070057 - DNA, 11 bp, Homo sapiens
aaaacagtggt

SEQ ID NO: 5070058 - DNA, 17 bp, Homo sapiens
aaaacagtgtgtaaaca

SEQ ID NO: 5070059 - DNA, 20 bp, Homo sapiens
aaaacagtgtgtaaacaaaa

SEQ ID NO: 5070060 - DNA, 17 bp, Homo sapiens
aaaacagtgtttccagt

SEQ ID NO: 5070061 - DNA, 16 bp, Homo sapiens
aaaacagttctcagaa

SEQ ID NO: 5070062 - DNA, 17 bp, Homo sapiens
aaaacagttctcagaaa

SEQ ID NO: 5070063 - DNA, 17 bp, Homo sapiens
aaaacataaaaattcag

SEQ ID NO: 5070064 - DNA, 21 bp, Homo sapiens
aaaacataaacacatttccat

SEQ ID NO: 5070065 - DNA, 17 bp, Homo sapiens
aaaacataatagaattt

SEQ ID NO: 5070066 - DNA, 17 bp, Homo sapiens
aaaacataatcttctgc

SEQ ID NO: 5070067 - DNA, 18 bp, Homo sapiens
aaaacataatcttctgcc

SEQ ID NO: 5070068 - DNA, 15 bp, Homo sapiens
aaaacatacttcaaa

SEQ ID NO: 5070069 - DNA, 23 bp, Homo sapiens
aaaacatagaaatggaaattttg

SEQ ID NO: 5070070 - DNA, 13 bp, Homo sapiens
aaaacatagactg

SEQ ID NO: 5070071 - DNA, 18 bp, Homo sapiens
aaaacatagactgaagat

SEQ ID NO: 5070072 - DNA, 18 bp, Homo sapiens
aaaacatagctggttaac

SEQ ID NO: 5070073 - DNA, 14 bp, Homo sapiens
aaaacataggaaag

SEQ ID NO: 5070074 - DNA, 22 bp, Homo sapiens
aaaacataggaaagtagaatgg

SEQ ID NO: 5070075 - DNA, 14 bp, Homo sapiens
aaaacatatatttt

SEQ ID NO: 5070076 - DNA, 22 bp, Homo sapiens
aaaacatatcaattcaacacat

SEQ ID NO: 5070077 - DNA, 22 bp, Homo sapiens
aaaacatatgtctgtctttgca

SEQ ID NO: 5070078 - DNA, 13 bp, Homo sapiens
aaaacatatttca

SEQ ID NO: 5070079 - DNA, 18 bp, Homo sapiens
aaaacatcaaaatgaata

SEQ ID NO: 5070080 - DNA, 13 bp, Homo sapiens
aaaacatcacatt

SEQ ID NO: 5070081 - DNA, 22 bp, Homo sapiens
aaaacatcactatcaattttaa

SEQ ID NO: 5070082 - DNA, 16 bp, Homo sapiens
aaaacatccagataca

SEQ ID NO: 5070083 - DNA, 21 bp, Homo sapiens
aaaacatccagatacacccaa

SEQ ID NO: 5070084 - DNA, 14 bp, Homo sapiens
aaaacatcctgact

SEQ ID NO: 5070085 - DNA, 15 bp, Homo sapiens
aaaacatcctgactt

SEQ ID NO: 5070086 - DNA, 13 bp, Homo sapiens
aaaacatctattc

SEQ ID NO: 5070087 - DNA, 13 bp, Homo sapiens
aaaacatctcatc

SEQ ID NO: 5070088 - DNA, 11 bp, Homo sapiens
aaaacatctgg

SEQ ID NO: 5070089 - DNA, 20 bp, Homo sapiens
aaaacatcttaggcactttt

SEQ ID NO: 5070090 - DNA, 19 bp, Homo sapiens
aaaacatgagaaatgtgaa

SEQ ID NO: 5070091 - DNA, 14 bp, Homo sapiens
aaaacatgctacac

SEQ ID NO: 5070092 - DNA, 12 bp, Homo sapiens
aaaacatgtaaa

SEQ ID NO: 5070093 - DNA, 15 bp, Homo sapiens
aaaacatgtactaca

SEQ ID NO: 5070094 - DNA, 13 bp, Homo sapiens
aaaacatgtatgt

SEQ ID NO: 5070095 - DNA, 12 bp, Homo sapiens
aaaacatgtcat

SEQ ID NO: 5070096 - DNA, 19 bp, Homo sapiens
aaaacatgtttatttttct

SEQ ID NO: 5070097 - DNA, 18 bp, Homo sapiens
aaaacattaagaaaatca

SEQ ID NO: 5070098 - DNA, 19 bp, Homo sapiens
aaaacattaagaaaatcat

SEQ ID NO: 5070099 - DNA, 15 bp, Homo sapiens
aaaacattaattgct

SEQ ID NO: 5070100 - DNA, 14 bp, Homo sapiens
aaaacattcatcca

SEQ ID NO: 5070101 - DNA, 22 bp, Homo sapiens
aaaacattcatccagttgcaat

SEQ ID NO: 5070102 - DNA, 16 bp, Homo sapiens
aaaacattccatcctt

SEQ ID NO: 5070103 - DNA, 20 bp, Homo sapiens
aaaacattccgtttacattt

SEQ ID NO: 5070104 - DNA, 16 bp, Homo sapiens
aaaacattctatctac

SEQ ID NO: 5070105 - DNA, 19 bp, Homo sapiens
aaaacattctatctactga

SEQ ID NO: 5070106 - DNA, 12 bp, Homo sapiens
aaaacattgttc

SEQ ID NO: 5070107 - DNA, 12 bp, Homo sapiens
aaaacatttaat

SEQ ID NO: 5070108 - DNA, 17 bp, Homo sapiens
aaaacatttctaagact

SEQ ID NO: 5070109 - DNA, 15 bp, Homo sapiens
aaaacatttctctct

SEQ ID NO: 5070110 - DNA, 18 bp, Homo sapiens
aaaacatttctctcttat

SEQ ID NO: 5070111 - DNA, 19 bp, Homo sapiens
aaaacatttcttaaaacag

SEQ ID NO: 5070112 - DNA, 22 bp, Homo sapiens
aaaacatttgattaataaaata

SEQ ID NO: 5070113 - DNA, 12 bp, Homo sapiens
aaaacatttgct

SEQ ID NO: 5070114 - DNA, 12 bp, Homo sapiens
aaaacatttgta

SEQ ID NO: 5070115 - DNA, 21 bp, Homo sapiens
aaaacatttgtacattcctga

SEQ ID NO: 5070116 - DNA, 17 bp, Homo sapiens
aaaacattttaaatgaa

SEQ ID NO: 5070117 - DNA, 20 bp, Homo sapiens
aaaacattttaagttttact

SEQ ID NO: 5070118 - DNA, 23 bp, Homo sapiens
aaaacatttttaatttaacaaac

SEQ ID NO: 5070119 - DNA, 13 bp, Homo sapiens
aaaaccaaaatga

SEQ ID NO: 5070120 - DNA, 22 bp, Homo sapiens
aaaaccaaactgggtcttcagc

SEQ ID NO: 5070121 - DNA, 15 bp, Homo sapiens
aaaaccaaacttgtt

SEQ ID NO: 5070122 - DNA, 13 bp, Homo sapiens
aaaaccaaagaat

SEQ ID NO: 5070123 - DNA, 15 bp, Homo sapiens
aaaaccaaatgttta

SEQ ID NO: 5070124 - DNA, 18 bp, Homo sapiens
aaaaccaaatgtttattt

SEQ ID NO: 5070125 - DNA, 12 bp, Homo sapiens
aaaaccaaattc

SEQ ID NO: 5070126 - DNA, 18 bp, Homo sapiens
aaaaccaagcctctggaa

SEQ ID NO: 5070127 - DNA, 17 bp, Homo sapiens
aaaaccaagttatctgt

SEQ ID NO: 5070128 - DNA, 14 bp, Homo sapiens
aaaaccacagtcag

SEQ ID NO: 5070129 - DNA, 19 bp, Homo sapiens
aaaaccacagtcagtggag

SEQ ID NO: 5070130 - DNA, 12 bp, Homo sapiens
aaaaccacatgg

SEQ ID NO: 5070131 - DNA, 16 bp, Homo sapiens
aaaaccacatgggctg

SEQ ID NO: 5070132 - DNA, 21 bp, Homo sapiens
aaaaccacccacaaagaaaca

SEQ ID NO: 5070133 - DNA, 12 bp, Homo sapiens
aaaaccacccct

SEQ ID NO: 5070134 - DNA, 17 bp, Homo sapiens
aaaaccactagaactct

SEQ ID NO: 5070135 - DNA, 18 bp, Homo sapiens
aaaaccactatgcaaaga

SEQ ID NO: 5070136 - DNA, 19 bp, Homo sapiens
aaaaccactatgcaaagaa

SEQ ID NO: 5070137 - DNA, 20 bp, Homo sapiens
aaaaccactgaacatttgct

SEQ ID NO: 5070138 - DNA, 15 bp, Homo sapiens
aaaaccagaaagagg

SEQ ID NO: 5070139 - DNA, 18 bp, Homo sapiens
aaaaccagagaatcttaa

SEQ ID NO: 5070140 - DNA, 13 bp, Homo sapiens
aaaaccagagggc

SEQ ID NO: 5070141 - DNA, 14 bp, Homo sapiens
aaaaccagcctcat

SEQ ID NO: 5070142 - DNA, 20 bp, Homo sapiens
aaaaccagctgctactcata

SEQ ID NO: 5070143 - DNA, 11 bp, Homo sapiens
aaaaccaggcc

SEQ ID NO: 5070144 - DNA, 12 bp, Homo sapiens
aaaaccagggat

SEQ ID NO: 5070145 - DNA, 17 bp, Homo sapiens
aaaaccagtattgtaca

SEQ ID NO: 5070146 - DNA, 13 bp, Homo sapiens
aaaaccagttacc

SEQ ID NO: 5070147 - DNA, 18 bp, Homo sapiens
aaaaccataaacatttgc

SEQ ID NO: 5070148 - DNA, 17 bp, Homo sapiens
aaaaccatcaagttgtg

SEQ ID NO: 5070149 - DNA, 19 bp, Homo sapiens
aaaaccatcagatatttct

SEQ ID NO: 5070150 - DNA, 20 bp, Homo sapiens
aaaaccatccatccctagaa

SEQ ID NO: 5070151 - DNA, 21 bp, Homo sapiens
aaaaccatctctcttccagct

SEQ ID NO: 5070152 - DNA, 14 bp, Homo sapiens
aaaaccatgcagct

SEQ ID NO: 5070153 - DNA, 22 bp, Homo sapiens
aaaaccatgcagcttcatcaat

SEQ ID NO: 5070154 - DNA, 23 bp, Homo sapiens
aaaaccatgcagcttcatcaatt

SEQ ID NO: 5070155 - DNA, 18 bp, Homo sapiens
aaaaccattatttaataa

SEQ ID NO: 5070156 - DNA, 16 bp, Homo sapiens
aaaaccattgcttcac

SEQ ID NO: 5070157 - DNA, 13 bp, Homo sapiens
aaaaccatttgaa

SEQ ID NO: 5070158 - DNA, 22 bp, Homo sapiens
aaaacccaccttgttggagcct

SEQ ID NO: 5070159 - DNA, 12 bp, Homo sapiens
aaaacccagact

SEQ ID NO: 5070160 - DNA, 18 bp, Homo sapiens
aaaacccagactgtctcc

SEQ ID NO: 5070161 - DNA, 15 bp, Homo sapiens
aaaacccagataaag

SEQ ID NO: 5070162 - DNA, 14 bp, Homo sapiens
aaaacccagcatgt

SEQ ID NO: 5070163 - DNA, 16 bp, Homo sapiens
aaaacccagcatgtac

SEQ ID NO: 5070164 - DNA, 19 bp, Homo sapiens
aaaacccagcatgtacaaa

SEQ ID NO: 5070165 - DNA, 14 bp, Homo sapiens
aaaacccagctgca

SEQ ID NO: 5070166 - DNA, 22 bp, Homo sapiens
aaaacccagctgcaccccttcc

SEQ ID NO: 5070167 - DNA, 21 bp, Homo sapiens
aaaacccatcgtggtatgtga

SEQ ID NO: 5070168 - DNA, 13 bp, Homo sapiens
aaaacccattgtc

SEQ ID NO: 5070169 - DNA, 17 bp, Homo sapiens
aaaacccattgtcttta

SEQ ID NO: 5070170 - DNA, 22 bp, Homo sapiens
aaaaccccactacacagtctgc

SEQ ID NO: 5070171 - DNA, 13 bp, Homo sapiens
aaaacccccaaac

SEQ ID NO: 5070172 - DNA, 21 bp, Homo sapiens
aaaacccctaaaaacaaaaca

SEQ ID NO: 5070173 - DNA, 18 bp, Homo sapiens
aaaaccctaagtgtggat

SEQ ID NO: 5070174 - DNA, 22 bp, Homo sapiens
aaaaccctatatgcttactgtg

SEQ ID NO: 5070175 - DNA, 18 bp, Homo sapiens
aaaaccctcgatgttcat

SEQ ID NO: 5070176 - DNA, 21 bp, Homo sapiens
aaaaccctgctaaatgactta

SEQ ID NO: 5070177 - DNA, 20 bp, Homo sapiens
aaaacccttgggccagaagt

SEQ ID NO: 5070178 - DNA, 24 bp, Homo sapiens
aaaacccttggtctgtgttctcaa

SEQ ID NO: 5070179 - DNA, 21 bp, Homo sapiens
aaaaccgaattaggtccactt

SEQ ID NO: 5070180 - DNA, 18 bp, Homo sapiens
aaaaccgagataggggag

SEQ ID NO: 5070181 - DNA, 21 bp, Homo sapiens
aaaaccggcaacctgtaactg

SEQ ID NO: 5070182 - DNA, 18 bp, Homo sapiens
aaaaccgttcaaattctc

SEQ ID NO: 5070183 - DNA, 20 bp, Homo sapiens
aaaacctaagtcctttatgt

SEQ ID NO: 5070184 - DNA, 16 bp, Homo sapiens
aaaacctacatattcc

SEQ ID NO: 5070185 - DNA, 19 bp, Homo sapiens
aaaacctagaacttcaaaa

SEQ ID NO: 5070186 - DNA, 19 bp, Homo sapiens
aaaacctatttttccttta

SEQ ID NO: 5070187 - DNA, 17 bp, Homo sapiens
aaaacctcaagcagtaa

SEQ ID NO: 5070188 - DNA, 22 bp, Homo sapiens
aaaacctcacccgaggctgccc

SEQ ID NO: 5070189 - DNA, 21 bp, Homo sapiens
aaaacctctttccaaaggctg

SEQ ID NO: 5070190 - DNA, 13 bp, Homo sapiens
aaaacctgacaaa

SEQ ID NO: 5070191 - DNA, 22 bp, Homo sapiens
aaaacctgagatttattaaaga

SEQ ID NO: 5070192 - DNA, 17 bp, Homo sapiens
aaaacctgattggccac

SEQ ID NO: 5070193 - DNA, 19 bp, Homo sapiens
aaaacctgattggccactg

SEQ ID NO: 5070194 - DNA, 19 bp, Homo sapiens
aaaacctgtatttttgtta

SEQ ID NO: 5070195 - DNA, 19 bp, Homo sapiens
aaaacctgtgccaggctga

SEQ ID NO: 5070196 - DNA, 23 bp, Homo sapiens
aaaacctgttcaagtctaccaac

SEQ ID NO: 5070197 - DNA, 21 bp, Homo sapiens
aaaaccttaaaagtaataaag

SEQ ID NO: 5070198 - DNA, 18 bp, Homo sapiens
aaaaccttctatgttcat

SEQ ID NO: 5070199 - DNA, 23 bp, Homo sapiens
aaaaccttgtaaaaaaagcaaaa

SEQ ID NO: 5070200 - DNA, 16 bp, Homo sapiens
aaaaccttgttctatt

SEQ ID NO: 5070201 - DNA, 17 bp, Homo sapiens
aaaacctttacagttag

SEQ ID NO: 5070202 - DNA, 16 bp, Homo sapiens
aaaacctttattcttt

SEQ ID NO: 5070203 - DNA, 20 bp, Homo sapiens
aaaacctttcaaatttcaca

SEQ ID NO: 5070204 - DNA, 21 bp, Homo sapiens
aaaacctttccccagacacat

SEQ ID NO: 5070205 - DNA, 15 bp, Homo sapiens
aaaaccttttactgg

SEQ ID NO: 5070206 - DNA, 23 bp, Homo sapiens
aaaaccttttactggttgcatgg

SEQ ID NO: 5070207 - DNA, 14 bp, Homo sapiens
aaaaccttttttct

SEQ ID NO: 5070208 - DNA, 15 bp, Homo sapiens
aaaaccttttttctt

SEQ ID NO: 5070209 - DNA, 14 bp, Homo sapiens
aaaacgaaaataaa

SEQ ID NO: 5070210 - DNA, 16 bp, Homo sapiens
aaaacgagtctttcat

SEQ ID NO: 5070211 - DNA, 22 bp, Homo sapiens
aaaacgatctaaaggtaggcag

SEQ ID NO: 5070212 - DNA, 19 bp, Homo sapiens
aaaacgatgaagttatgct

SEQ ID NO: 5070213 - DNA, 13 bp, Homo sapiens
aaaacgcatggag

SEQ ID NO: 5070214 - DNA, 13 bp, Homo sapiens
aaaacgcctcttt

SEQ ID NO: 5070215 - DNA, 17 bp, Homo sapiens
aaaatagagatgagctt

SEQ ID NO: 5070216 - DNA, 21 bp, Homo sapiens
aaaatagagatgagctttctt

SEQ ID NO: 5070217 - DNA, 17 bp, Homo sapiens
aaaatagagcaaaatca

SEQ ID NO: 5070218 - DNA, 21 bp, Homo sapiens
aaaatagagcttttaaaaatg

SEQ ID NO: 5070219 - DNA, 16 bp, Homo sapiens
aaaatagaggctttga

SEQ ID NO: 5070220 - DNA, 20 bp, Homo sapiens
aaaatagagtgtagtttaca

SEQ ID NO: 5070221 - DNA, 15 bp, Homo sapiens
aaaatagatatataa

SEQ ID NO: 5070222 - DNA, 19 bp, Homo sapiens
aaaatagatcaataaatgt

SEQ ID NO: 5070223 - DNA, 14 bp, Homo sapiens
aaaatagatgtctt

SEQ ID NO: 5070224 - DNA, 20 bp, Homo sapiens
aaaatagatgttttaactta

SEQ ID NO: 5070225 - DNA, 12 bp, Homo sapiens
aaaatagatttt

SEQ ID NO: 5070226 - DNA, 21 bp, Homo sapiens
aaaatagattttataagatga

SEQ ID NO: 5070227 - DNA, 19 bp, Homo sapiens
aaaatagcaagagtgtgaa

SEQ ID NO: 5070228 - DNA, 21 bp, Homo sapiens
aaaatagcaataactgaaaat

SEQ ID NO: 5070229 - DNA, 17 bp, Homo sapiens
aaaatagcaatcctaaa

SEQ ID NO: 5070230 - DNA, 17 bp, Homo sapiens
aaaatagcatactgtgt

SEQ ID NO: 5070231 - DNA, 18 bp, Homo sapiens
aaaatagcggtacaagtt

SEQ ID NO: 5070232 - DNA, 20 bp, Homo sapiens
aaaatagcggtacaagttct

SEQ ID NO: 5070233 - DNA, 19 bp, Homo sapiens
aaaatagcgttcttgtaat

SEQ ID NO: 5070234 - DNA, 20 bp, Homo sapiens
aaaatagctatttttttcct

SEQ ID NO: 5070235 - DNA, 12 bp, Homo sapiens
aaaataggattt

SEQ ID NO: 5070236 - DNA, 23 bp, Homo sapiens
aaaataggatttgcactgcttta

SEQ ID NO: 5070237 - DNA, 12 bp, Homo sapiens
aaaataggcagg

SEQ ID NO: 5070238 - DNA, 17 bp, Homo sapiens
aaaataggctttttaat

SEQ ID NO: 5070239 - DNA, 16 bp, Homo sapiens
aaaatagggtccttga

SEQ ID NO: 5070240 - DNA, 20 bp, Homo sapiens
aaaatagggtccttgaaaca

SEQ ID NO: 5070241 - DNA, 18 bp, Homo sapiens
aaaatagggtggacagaa

SEQ ID NO: 5070242 - DNA, 16 bp, Homo sapiens
aaaataggtgcattgt

SEQ ID NO: 5070243 - DNA, 19 bp, Homo sapiens
aaaatagtaaatgctttgt

SEQ ID NO: 5070244 - DNA, 11 bp, Homo sapiens
aaaatagtaat

SEQ ID NO: 5070245 - DNA, 20 bp, Homo sapiens
aaaatagtaattttttacat

SEQ ID NO: 5070246 - DNA, 15 bp, Homo sapiens
aaaatagtagaacaa

SEQ ID NO: 5070247 - DNA, 22 bp, Homo sapiens
aaaatagtattgctgaactctt

SEQ ID NO: 5070248 - DNA, 18 bp, Homo sapiens
aaaatagtcatgattcta

SEQ ID NO: 5070249 - DNA, 21 bp, Homo sapiens
aaaatagtcatgtttctgcag

SEQ ID NO: 5070250 - DNA, 13 bp, Homo sapiens
aaaatagtgaatt

SEQ ID NO: 5070251 - DNA, 20 bp, Homo sapiens
aaaatagtggatctcagttt

SEQ ID NO: 5070252 - DNA, 15 bp, Homo sapiens
aaaatagttcccttt

SEQ ID NO: 5070253 - DNA, 14 bp, Homo sapiens
aaaatagttctatt

SEQ ID NO: 5070254 - DNA, 18 bp, Homo sapiens
aaaatagttctatttcta

SEQ ID NO: 5070255 - DNA, 19 bp, Homo sapiens
aaaatagttctatttctat

SEQ ID NO: 5070256 - DNA, 20 bp, Homo sapiens
aaaatagttgagccagcaga

SEQ ID NO: 5070257 - DNA, 19 bp, Homo sapiens
aaaatagtttaaaaatatt

SEQ ID NO: 5070258 - DNA, 15 bp, Homo sapiens
aaaatataaaaatta

SEQ ID NO: 5070259 - DNA, 17 bp, Homo sapiens
aaaatataaaactgcgt

SEQ ID NO: 5070260 - DNA, 22 bp, Homo sapiens
aaaatataaaactgcgttaaag

SEQ ID NO: 5070261 - DNA, 16 bp, Homo sapiens
aaaatataaacaaaga

SEQ ID NO: 5070262 - DNA, 12 bp, Homo sapiens
aaaatataaatg

SEQ ID NO: 5070263 - DNA, 13 bp, Homo sapiens
aaaatataaatgc

SEQ ID NO: 5070264 - DNA, 20 bp, Homo sapiens
aaaatataaatgcatgattt

SEQ ID NO: 5070265 - DNA, 18 bp, Homo sapiens
aaaatataaattaagact

SEQ ID NO: 5070266 - DNA, 16 bp, Homo sapiens
aaaatataaattgtac

SEQ ID NO: 5070267 - DNA, 19 bp, Homo sapiens
aaaatataaattgtacatt

SEQ ID NO: 5070268 - DNA, 20 bp, Homo sapiens
aaaatataaattgtacattt

SEQ ID NO: 5070269 - DNA, 10 bp, Homo sapiens
aaaatataag

SEQ ID NO: 5070270 - DNA, 22 bp, Homo sapiens
aaaatataaggactttttgatg

SEQ ID NO: 5070271 - DNA, 18 bp, Homo sapiens
aaaatataagtaaagtga

SEQ ID NO: 5070272 - DNA, 11 bp, Homo sapiens
aaaatataatt

SEQ ID NO: 5070273 - DNA, 13 bp, Homo sapiens
aaaatataattct

SEQ ID NO: 5070274 - DNA, 24 bp, Homo sapiens
aaaatataattttttagagagctg

SEQ ID NO: 5070275 - DNA, 15 bp, Homo sapiens
aaaatatacaagtaa

SEQ ID NO: 5070276 - DNA, 22 bp, Homo sapiens
aaaatatactgtaaagaaagag

SEQ ID NO: 5070277 - DNA, 20 bp, Homo sapiens
aaaatatagctgtacaaata

SEQ ID NO: 5070278 - DNA, 16 bp, Homo sapiens
aaaatataggtgatgg

SEQ ID NO: 5070279 - DNA, 10 bp, Homo sapiens
aaaatatata

SEQ ID NO: 5070280 - DNA, 11 bp, Homo sapiens
aaaatatatac

SEQ ID NO: 5070281 - DNA, 17 bp, Homo sapiens
aaaatatatactaaaca

SEQ ID NO: 5070282 - DNA, 13 bp, Homo sapiens
aaaatatatataa

SEQ ID NO: 5070283 - DNA, 23 bp, Homo sapiens
aaaatatatataaatatatattt

SEQ ID NO: 5070284 - DNA, 20 bp, Homo sapiens
aaaatatatatataaaatat

SEQ ID NO: 5070285 - DNA, 21 bp, Homo sapiens
aaaatatatatgttgatttct

SEQ ID NO: 5070286 - DNA, 14 bp, Homo sapiens
aaaatatatattgt

SEQ ID NO: 5070287 - DNA, 17 bp, Homo sapiens
aaaatatatgtaatata

SEQ ID NO: 5070288 - DNA, 20 bp, Homo sapiens
aaaatatatgtaatatatac

SEQ ID NO: 5070289 - DNA, 15 bp, Homo sapiens
aaaatatatgtattt

SEQ ID NO: 5070290 - DNA, 22 bp, Homo sapiens
aaaatatattaaaaatataaac

SEQ ID NO: 5070291 - DNA, 19 bp, Homo sapiens
aaaatatattgctgcattt

SEQ ID NO: 5070292 - DNA, 15 bp, Homo sapiens
aaaatatatttaatg

SEQ ID NO: 5070293 - DNA, 16 bp, Homo sapiens
aaaatatatttaatga

SEQ ID NO: 5070294 - DNA, 17 bp, Homo sapiens
aaaatatattttatgat

SEQ ID NO: 5070295 - DNA, 16 bp, Homo sapiens
aaaatatattttgtat

SEQ ID NO: 5070296 - DNA, 13 bp, Homo sapiens
aaaatatcaaatt

SEQ ID NO: 5070297 - DNA, 21 bp, Homo sapiens
aaaatatcaccaaaaacctat

SEQ ID NO: 5070298 - DNA, 16 bp, Homo sapiens
aaaatatcactttgta

SEQ ID NO: 5070299 - DNA, 17 bp, Homo sapiens
aaaatatcactttgtat

SEQ ID NO: 5070300 - DNA, 20 bp, Homo sapiens
aaaatatcactttgtattct

SEQ ID NO: 5070301 - DNA, 19 bp, Homo sapiens
aaaatatcagacaagcact

SEQ ID NO: 5070302 - DNA, 14 bp, Homo sapiens
aaaatatcattcag

SEQ ID NO: 5070303 - DNA, 16 bp, Homo sapiens
aaaatatcattcagca

SEQ ID NO: 5070304 - DNA, 18 bp, Homo sapiens
aaaatatccctttttcac

SEQ ID NO: 5070305 - DNA, 20 bp, Homo sapiens
aaaatatcctttcatcaatg

SEQ ID NO: 5070306 - DNA, 14 bp, Homo sapiens
aaaatatcttttga

SEQ ID NO: 5070307 - DNA, 19 bp, Homo sapiens
aaaatatgaacctattttc

SEQ ID NO: 5070308 - DNA, 23 bp, Homo sapiens
aaaatatgaacctattttcattt

SEQ ID NO: 5070309 - DNA, 11 bp, Homo sapiens
aaaatatgcat

SEQ ID NO: 5070310 - DNA, 20 bp, Homo sapiens
aaaatatggaacttctaata

SEQ ID NO: 5070311 - DNA, 15 bp, Homo sapiens
aaaatatggtttggt

SEQ ID NO: 5070312 - DNA, 17 bp, Homo sapiens
aaaatatgtaatttcaa

SEQ ID NO: 5070313 - DNA, 12 bp, Homo sapiens
aaaatatgtatg

SEQ ID NO: 5070314 - DNA, 22 bp, Homo sapiens
aaaatatgtccagaagagtcaa

SEQ ID NO: 5070315 - DNA, 13 bp, Homo sapiens
aaaatatgtctcg

SEQ ID NO: 5070316 - DNA, 13 bp, Homo sapiens
aaaatatgtgtac

SEQ ID NO: 5070317 - DNA, 16 bp, Homo sapiens
aaaatattaatacaga

SEQ ID NO: 5070318 - DNA, 11 bp, Homo sapiens
aaaatattatc

SEQ ID NO: 5070319 - DNA, 16 bp, Homo sapiens
aaaatattatctgaac

SEQ ID NO: 5070320 - DNA, 17 bp, Homo sapiens
aaaatattatttgatat

SEQ ID NO: 5070321 - DNA, 19 bp, Homo sapiens
aaaatattattttattata

SEQ ID NO: 5070322 - DNA, 15 bp, Homo sapiens
aaaatattcaagtaa

SEQ ID NO: 5070323 - DNA, 14 bp, Homo sapiens
aaaatattcaataa

SEQ ID NO: 5070324 - DNA, 20 bp, Homo sapiens
aaaatattcaataagaagtc

SEQ ID NO: 5070325 - DNA, 14 bp, Homo sapiens
aaaatattctccat

SEQ ID NO: 5070326 - DNA, 11 bp, Homo sapiens
aaaatattctg

SEQ ID NO: 5070327 - DNA, 16 bp, Homo sapiens
aaaatattctgtcatt

SEQ ID NO: 5070328 - DNA, 22 bp, Homo sapiens
aaaatattgaaatgctgtattt

SEQ ID NO: 5070329 - DNA, 21 bp, Homo sapiens
aaaatattgagcagaattcat

SEQ ID NO: 5070330 - DNA, 17 bp, Homo sapiens
aaaatattgctaaaagt

SEQ ID NO: 5070331 - DNA, 21 bp, Homo sapiens
aaaatattgctaaaagtgcat

SEQ ID NO: 5070332 - DNA, 17 bp, Homo sapiens
aaaatattggctgattt

SEQ ID NO: 5070333 - DNA, 19 bp, Homo sapiens
aaaatattggtattaaaga

SEQ ID NO: 5070334 - DNA, 13 bp, Homo sapiens
aaaatattgtagt

SEQ ID NO: 5070335 - DNA, 20 bp, Homo sapiens
aaaatattgtttaatgcaaa

SEQ ID NO: 5070336 - DNA, 15 bp, Homo sapiens
aaaatattgtttctg

SEQ ID NO: 5070337 - DNA, 11 bp, Homo sapiens
aaaatatttaa

SEQ ID NO: 5070338 - DNA, 12 bp, Homo sapiens
aaaatatttaaa

SEQ ID NO: 5070339 - DNA, 14 bp, Homo sapiens
aaaatatttaactt

SEQ ID NO: 5070340 - DNA, 15 bp, Homo sapiens
aaaatatttaacttt

SEQ ID NO: 5070341 - DNA, 14 bp, Homo sapiens
aaaatatttaagtg

SEQ ID NO: 5070342 - DNA, 11 bp, Homo sapiens
aaaatatttcc

SEQ ID NO: 5070343 - DNA, 15 bp, Homo sapiens
aaaatatttcctgac

SEQ ID NO: 5070344 - DNA, 21 bp, Homo sapiens
aaaatatttcctgacttgagt

SEQ ID NO: 5070345 - DNA, 22 bp, Homo sapiens
aaaatatttcctgacttgagtg

SEQ ID NO: 5070346 - DNA, 12 bp, Homo sapiens
aaaatatttcta

SEQ ID NO: 5070347 - DNA, 23 bp, Homo sapiens
aaaatatttgcctccatgtagaa

SEQ ID NO: 5070348 - DNA, 15 bp, Homo sapiens
aaaatattttaagaa

SEQ ID NO: 5070349 - DNA, 18 bp, Homo sapiens
aaaatattttaagtatga

SEQ ID NO: 5070350 - DNA, 13 bp, Homo sapiens
aaaatattttaga

SEQ ID NO: 5070351 - DNA, 13 bp, Homo sapiens
aaaatattttata

SEQ ID NO: 5070352 - DNA, 13 bp, Homo sapiens
aaaatattttcat

SEQ ID NO: 5070353 - DNA, 23 bp, Homo sapiens
aaaatattttctctgtacttttc

SEQ ID NO: 5070354 - DNA, 15 bp, Homo sapiens
aaaatattttctgtg

SEQ ID NO: 5070355 - DNA, 16 bp, Homo sapiens
aaaatattttctgtgt

SEQ ID NO: 5070356 - DNA, 21 bp, Homo sapiens
aaaatattttctgtgtgttcc

SEQ ID NO: 5070357 - DNA, 16 bp, Homo sapiens
aaaatattttcttaat

SEQ ID NO: 5070358 - DNA, 13 bp, Homo sapiens
aaaatattttgaa

SEQ ID NO: 5070359 - DNA, 20 bp, Homo sapiens
aaaatattttgcaagctctg

SEQ ID NO: 5070360 - DNA, 12 bp, Homo sapiens
aaaatattttgg

SEQ ID NO: 5070361 - DNA, 20 bp, Homo sapiens
aaaatattttggaataagca

SEQ ID NO: 5070362 - DNA, 12 bp, Homo sapiens
aaaatattttgt

SEQ ID NO: 5070363 - DNA, 20 bp, Homo sapiens
aaaatattttgttgccttca

SEQ ID NO: 5070364 - DNA, 18 bp, Homo sapiens
aaaatatttttaaatgga

SEQ ID NO: 5070365 - DNA, 18 bp, Homo sapiens
aaaatatttttatgtgaa

SEQ ID NO: 5070366 - DNA, 21 bp, Homo sapiens
aaaatatttttatgtgaaggt

SEQ ID NO: 5070367 - DNA, 20 bp, Homo sapiens
aaaatattttttatatatac

SEQ ID NO: 5070368 - DNA, 17 bp, Homo sapiens
aaaatattttttctgta

SEQ ID NO: 5070369 - DNA, 16 bp, Homo sapiens
aaaatatttttttcct

SEQ ID NO: 5070370 - DNA, 15 bp, Homo sapiens
aaaatcaaaacaaaa

SEQ ID NO: 5070371 - DNA, 20 bp, Homo sapiens
aaaatcaaaaggcactgtga

SEQ ID NO: 5070372 - DNA, 19 bp, Homo sapiens
aaaatcaaaaggtaatgca

SEQ ID NO: 5070373 - DNA, 18 bp, Homo sapiens
aaaatcaaagaacagatg

SEQ ID NO: 5070374 - DNA, 17 bp, Homo sapiens
aaaatcaacctatcaaa

SEQ ID NO: 5070375 - DNA, 16 bp, Homo sapiens
aaaatcaacttgtgta

SEQ ID NO: 5070376 - DNA, 14 bp, Homo sapiens
aaaatcaactttta

SEQ ID NO: 5070377 - DNA, 20 bp, Homo sapiens
aaaatcaactttttattgcc

SEQ ID NO: 5070378 - DNA, 12 bp, Homo sapiens
aaaatcaagagt

SEQ ID NO: 5070379 - DNA, 23 bp, Homo sapiens
aaaatcacaagcaataattagga

SEQ ID NO: 5070380 - DNA, 14 bp, Homo sapiens
aaaatcacaatttt

SEQ ID NO: 5070381 - DNA, 15 bp, Homo sapiens
aaaatcaccatcttt

SEQ ID NO: 5070382 - DNA, 15 bp, Homo sapiens
aaaatcactatcttt

SEQ ID NO: 5070383 - DNA, 21 bp, Homo sapiens
aaaatcactatctttctgata

SEQ ID NO: 5070384 - DNA, 20 bp, Homo sapiens
aaaatcactggattataagt

SEQ ID NO: 5070385 - DNA, 13 bp, Homo sapiens
aaaatcactgtca

SEQ ID NO: 5070386 - DNA, 14 bp, Homo sapiens
aaaatcacttagca

SEQ ID NO: 5070387 - DNA, 13 bp, Homo sapiens
aaaatcacttcag

SEQ ID NO: 5070388 - DNA, 14 bp, Homo sapiens
aaaatcacttgatt

SEQ ID NO: 5070389 - DNA, 20 bp, Homo sapiens
aaaatcactttcataatctt

SEQ ID NO: 5070390 - DNA, 16 bp, Homo sapiens
aaaatcagaaagacat

SEQ ID NO: 5070391 - DNA, 18 bp, Homo sapiens
aaaatcagaacaaaactt

SEQ ID NO: 5070392 - DNA, 13 bp, Homo sapiens
aaaatcagaatgg

SEQ ID NO: 5070393 - DNA, 21 bp, Homo sapiens
aaaatcagaatggaatgctct

SEQ ID NO: 5070394 - DNA, 15 bp, Homo sapiens
aaaatcagattttct

SEQ ID NO: 5070395 - DNA, 17 bp, Homo sapiens
aaaatcagcaacttcta

SEQ ID NO: 5070396 - DNA, 21 bp, Homo sapiens
aaaacgggttactaagatgaa

SEQ ID NO: 5070397 - DNA, 16 bp, Homo sapiens
aaaacggttaaaactg

SEQ ID NO: 5070398 - DNA, 15 bp, Homo sapiens
aaaacgtatttatct

SEQ ID NO: 5070399 - DNA, 17 bp, Homo sapiens
aaaacgtcttccttctt

SEQ ID NO: 5070400 - DNA, 23 bp, Homo sapiens
aaaacgtgagctacatgtgtaag

SEQ ID NO: 5070401 - DNA, 17 bp, Homo sapiens
aaaacgtgatgttttga

SEQ ID NO: 5070402 - DNA, 19 bp, Homo sapiens
aaaacgttgacccctttcc

SEQ ID NO: 5070403 - DNA, 21 bp, Homo sapiens
aaaacgttgacccctttcccc

SEQ ID NO: 5070404 - DNA, 17 bp, Homo sapiens
aaaacgttttattgtgt

SEQ ID NO: 5070405 - DNA, 13 bp, Homo sapiens
aaaactaaacata

SEQ ID NO: 5070406 - DNA, 18 bp, Homo sapiens
aaaactaaatagcatgta

SEQ ID NO: 5070407 - DNA, 19 bp, Homo sapiens
aaaactaaatagcatgtat

SEQ ID NO: 5070408 - DNA, 18 bp, Homo sapiens
aaaactaaatctctaata

SEQ ID NO: 5070409 - DNA, 13 bp, Homo sapiens
aaaactaagttct

SEQ ID NO: 5070410 - DNA, 13 bp, Homo sapiens
aaaactaatgtga

SEQ ID NO: 5070411 - DNA, 13 bp, Homo sapiens
aaaactaatttca

SEQ ID NO: 5070412 - DNA, 17 bp, Homo sapiens
aaaactaatttcatact

SEQ ID NO: 5070413 - DNA, 17 bp, Homo sapiens
aaaactacatgtaaaat

SEQ ID NO: 5070414 - DNA, 12 bp, Homo sapiens
aaaactacattt

SEQ ID NO: 5070415 - DNA, 16 bp, Homo sapiens
aaaactacattttaac

SEQ ID NO: 5070416 - DNA, 17 bp, Homo sapiens
aaaactacattttaaca

SEQ ID NO: 5070417 - DNA, 13 bp, Homo sapiens
aaaactactgcct

SEQ ID NO: 5070418 - DNA, 15 bp, Homo sapiens
aaaactactgccttt

SEQ ID NO: 5070419 - DNA, 19 bp, Homo sapiens
aaaactactttttggtcat

SEQ ID NO: 5070420 - DNA, 16 bp, Homo sapiens
aaaactagacaaaagt

SEQ ID NO: 5070421 - DNA, 13 bp, Homo sapiens
aaaactagcaact

SEQ ID NO: 5070422 - DNA, 14 bp, Homo sapiens
aaaactagcaactc

SEQ ID NO: 5070423 - DNA, 18 bp, Homo sapiens
aaaactaggcatttgtaa

SEQ ID NO: 5070424 - DNA, 20 bp, Homo sapiens
aaaactaggtaatgttttgt

SEQ ID NO: 5070425 - DNA, 13 bp, Homo sapiens
aaaactaggtgct

SEQ ID NO: 5070426 - DNA, 18 bp, Homo sapiens
aaaactataaaaaagaaa

SEQ ID NO: 5070427 - DNA, 21 bp, Homo sapiens
aaaactatacttgaacaaaag

SEQ ID NO: 5070428 - DNA, 23 bp, Homo sapiens
aaaactatacttgtactccttaa

SEQ ID NO: 5070429 - DNA, 16 bp, Homo sapiens
aaaactatcagcagcg

SEQ ID NO: 5070430 - DNA, 23 bp, Homo sapiens
aaaactatcctatgccttcaaat

SEQ ID NO: 5070431 - DNA, 14 bp, Homo sapiens
aaaactatggaaat

SEQ ID NO: 5070432 - DNA, 21 bp, Homo sapiens
aaaactatgtgttcaatgaaa

SEQ ID NO: 5070433 - DNA, 15 bp, Homo sapiens
aaaactattaaggat

SEQ ID NO: 5070434 - DNA, 17 bp, Homo sapiens
aaaactattaagtatgt

SEQ ID NO: 5070435 - DNA, 11 bp, Homo sapiens
aaaactattcc

SEQ ID NO: 5070436 - DNA, 19 bp, Homo sapiens
aaaactatttaaaattggc

SEQ ID NO: 5070437 - DNA, 21 bp, Homo sapiens
aaaactatttatgaatattaa

SEQ ID NO: 5070438 - DNA, 13 bp, Homo sapiens
aaaactattttaa

SEQ ID NO: 5070439 - DNA, 16 bp, Homo sapiens
aaaactcaaagaatgt

SEQ ID NO: 5070440 - DNA, 19 bp, Homo sapiens
aaaactcaaccaaatggta

SEQ ID NO: 5070441 - DNA, 15 bp, Homo sapiens
aaaactcactgtgat

SEQ ID NO: 5070442 - DNA, 14 bp, Homo sapiens
aaaactcagaatat

SEQ ID NO: 5070443 - DNA, 12 bp, Homo sapiens
aaaactcagcct

SEQ ID NO: 5070444 - DNA, 13 bp, Homo sapiens
aaaactcaggatt

SEQ ID NO: 5070445 - DNA, 18 bp, Homo sapiens
aaaactcaggcaaagaaa

SEQ ID NO: 5070446 - DNA, 23 bp, Homo sapiens
aaaactcaggcaaagaaaatgaa

SEQ ID NO: 5070447 - DNA, 18 bp, Homo sapiens
aaaactcatacaatgata

SEQ ID NO: 5070448 - DNA, 21 bp, Homo sapiens
aaaactcatcacataaagaaa

SEQ ID NO: 5070449 - DNA, 12 bp, Homo sapiens
aaaactcatgat

SEQ ID NO: 5070450 - DNA, 13 bp, Homo sapiens
aaaactcattttt

SEQ ID NO: 5070451 - DNA, 16 bp, Homo sapiens
aaaactccgcccccag

SEQ ID NO: 5070452 - DNA, 13 bp, Homo sapiens
aaaactcgctttt

SEQ ID NO: 5070453 - DNA, 21 bp, Homo sapiens
aaaactctacaccctctgccc

SEQ ID NO: 5070454 - DNA, 12 bp, Homo sapiens
aaaactctactt

SEQ ID NO: 5070455 - DNA, 15 bp, Homo sapiens
aaaactctacttaat

SEQ ID NO: 5070456 - DNA, 17 bp, Homo sapiens
aaaactctagcagttgt

SEQ ID NO: 5070457 - DNA, 18 bp, Homo sapiens
aaaactctatcaaatgtg

SEQ ID NO: 5070458 - DNA, 22 bp, Homo sapiens
aaaactctccttttccttacca

SEQ ID NO: 5070459 - DNA, 14 bp, Homo sapiens
aaaactctgggtct

SEQ ID NO: 5070460 - DNA, 18 bp, Homo sapiens
aaaactcttaagtcctaa

SEQ ID NO: 5070461 - DNA, 16 bp, Homo sapiens
aaaactcttaatctgt

SEQ ID NO: 5070462 - DNA, 19 bp, Homo sapiens
aaaactcttataaatttct

SEQ ID NO: 5070463 - DNA, 13 bp, Homo sapiens
aaaactcttcagt

SEQ ID NO: 5070464 - DNA, 14 bp, Homo sapiens
aaaactcttcagtg

SEQ ID NO: 5070465 - DNA, 15 bp, Homo sapiens
aaaactcttcagtgc

SEQ ID NO: 5070466 - DNA, 21 bp, Homo sapiens
aaaactctttaacttgtaata

SEQ ID NO: 5070467 - DNA, 18 bp, Homo sapiens
aaaactgaaaatctaata

SEQ ID NO: 5070468 - DNA, 20 bp, Homo sapiens
aaaactgaacttgaagctaa

SEQ ID NO: 5070469 - DNA, 10 bp, Homo sapiens
aaaactgaag

SEQ ID NO: 5070470 - DNA, 17 bp, Homo sapiens
aaaactgaattataaga

SEQ ID NO: 5070471 - DNA, 18 bp, Homo sapiens
aaaactgacatcagattt

SEQ ID NO: 5070472 - DNA, 21 bp, Homo sapiens
aaaactgacatcagatttctt

SEQ ID NO: 5070473 - DNA, 22 bp, Homo sapiens
aaaactgaccatcagtatattt

SEQ ID NO: 5070474 - DNA, 13 bp, Homo sapiens
aaaactgagcata

SEQ ID NO: 5070475 - DNA, 19 bp, Homo sapiens
aaaactgatcaaaaataaa

SEQ ID NO: 5070476 - DNA, 20 bp, Homo sapiens
aaaactgatcaaaaataaac

SEQ ID NO: 5070477 - DNA, 22 bp, Homo sapiens
aaaactgatcaaaaataaacta

SEQ ID NO: 5070478 - DNA, 15 bp, Homo sapiens
aaaactgatttccca

SEQ ID NO: 5070479 - DNA, 22 bp, Homo sapiens
aaaactgcagtcatcaacaatg

SEQ ID NO: 5070480 - DNA, 14 bp, Homo sapiens
aaaactgcatttca

SEQ ID NO: 5070481 - DNA, 15 bp, Homo sapiens
aaaactgcattttta

SEQ ID NO: 5070482 - DNA, 19 bp, Homo sapiens
aaaactgcgttaaaggctc

SEQ ID NO: 5070483 - DNA, 22 bp, Homo sapiens
aaaactgctagtgagttattgt

SEQ ID NO: 5070484 - DNA, 13 bp, Homo sapiens
aaaactgctttat

SEQ ID NO: 5070485 - DNA, 17 bp, Homo sapiens
aaaactggatatttcaa

SEQ ID NO: 5070486 - DNA, 17 bp, Homo sapiens
aaaactggatggaaata

SEQ ID NO: 5070487 - DNA, 22 bp, Homo sapiens
aaaactggttctacaaattttt

SEQ ID NO: 5070488 - DNA, 12 bp, Homo sapiens
aaaactgtaact

SEQ ID NO: 5070489 - DNA, 14 bp, Homo sapiens
aaaactgtactgtg

SEQ ID NO: 5070490 - DNA, 22 bp, Homo sapiens
aaaactgtactttgattcacat

SEQ ID NO: 5070491 - DNA, 13 bp, Homo sapiens
aaaactgtatgga

SEQ ID NO: 5070492 - DNA, 12 bp, Homo sapiens
aaaactgtattt

SEQ ID NO: 5070493 - DNA, 15 bp, Homo sapiens
aaaactgtgacattc

SEQ ID NO: 5070494 - DNA, 17 bp, Homo sapiens
aaaactgtgacattcca

SEQ ID NO: 5070495 - DNA, 19 bp, Homo sapiens
aaaactgtgacattccaca

SEQ ID NO: 5070496 - DNA, 22 bp, Homo sapiens
aaaactgtgacattccacagag

SEQ ID NO: 5070497 - DNA, 21 bp, Homo sapiens
aaaactgtgaccaagtataaa

SEQ ID NO: 5070498 - DNA, 19 bp, Homo sapiens
aaaactgtgcaacttttta

SEQ ID NO: 5070499 - DNA, 15 bp, Homo sapiens
aaaactgtgggaaga

SEQ ID NO: 5070500 - DNA, 16 bp, Homo sapiens
aaaactgtgggaagat

SEQ ID NO: 5070501 - DNA, 19 bp, Homo sapiens
aaaactgtgtatcattaaa

SEQ ID NO: 5070502 - DNA, 12 bp, Homo sapiens
aaaactgtgttg

SEQ ID NO: 5070503 - DNA, 21 bp, Homo sapiens
aaaactgttaagggaagctga

SEQ ID NO: 5070504 - DNA, 20 bp, Homo sapiens
aaaactgtttgacttctcaa

SEQ ID NO: 5070505 - DNA, 18 bp, Homo sapiens
aaaacttaaagcaaaata

SEQ ID NO: 5070506 - DNA, 13 bp, Homo sapiens
aaaacttaaatat

SEQ ID NO: 5070507 - DNA, 17 bp, Homo sapiens
aaaacttaaatattgta

SEQ ID NO: 5070508 - DNA, 18 bp, Homo sapiens
aaaacttagacccatgct

SEQ ID NO: 5070509 - DNA, 17 bp, Homo sapiens
aaaacttagtttgtgaa

SEQ ID NO: 5070510 - DNA, 20 bp, Homo sapiens
aaaacttatgctagtttatt

SEQ ID NO: 5070511 - DNA, 22 bp, Homo sapiens
aaaacttcattctaaaccaaaa

SEQ ID NO: 5070512 - DNA, 18 bp, Homo sapiens
aaaacttcattctcgtga

SEQ ID NO: 5070513 - DNA, 12 bp, Homo sapiens
aaaacttccttt

SEQ ID NO: 5070514 - DNA, 13 bp, Homo sapiens
aaaacttccttta

SEQ ID NO: 5070515 - DNA, 21 bp, Homo sapiens
aaaacttcgtaagaacatgtt

SEQ ID NO: 5070516 - DNA, 13 bp, Homo sapiens
aaaacttctcatt

SEQ ID NO: 5070517 - DNA, 14 bp, Homo sapiens
aaaacttctcattt

SEQ ID NO: 5070518 - DNA, 18 bp, Homo sapiens
aaaacttcttaaatatct

SEQ ID NO: 5070519 - DNA, 13 bp, Homo sapiens
aaaacttcttaga

SEQ ID NO: 5070520 - DNA, 23 bp, Homo sapiens
aaaacttcttgtcagacataaag

SEQ ID NO: 5070521 - DNA, 14 bp, Homo sapiens
aaaacttgaaagaa

SEQ ID NO: 5070522 - DNA, 15 bp, Homo sapiens
aaaacttgaatctgt

SEQ ID NO: 5070523 - DNA, 20 bp, Homo sapiens
aaaacttgaatctgttactg

SEQ ID NO: 5070524 - DNA, 21 bp, Homo sapiens
aaaacttgactccatttcatc

SEQ ID NO: 5070525 - DNA, 22 bp, Homo sapiens
aaaacttgatgtgttatctctt

SEQ ID NO: 5070526 - DNA, 12 bp, Homo sapiens
aaaactttaaaa

SEQ ID NO: 5070527 - DNA, 15 bp, Homo sapiens
aaaactttaaaaatt

SEQ ID NO: 5070528 - DNA, 19 bp, Homo sapiens
aaaactttaaagataagtc

SEQ ID NO: 5070529 - DNA, 19 bp, Homo sapiens
aaaactttactaagatgac

SEQ ID NO: 5070530 - DNA, 16 bp, Homo sapiens
aaaactttactttcag

SEQ ID NO: 5070531 - DNA, 16 bp, Homo sapiens
aaaactttatgtactg

SEQ ID NO: 5070532 - DNA, 11 bp, Homo sapiens
aaaactttatt

SEQ ID NO: 5070533 - DNA, 16 bp, Homo sapiens
aaaactttattaaaag

SEQ ID NO: 5070534 - DNA, 16 bp, Homo sapiens
aaaactttattttata

SEQ ID NO: 5070535 - DNA, 20 bp, Homo sapiens
aaaactttattttatataat

SEQ ID NO: 5070536 - DNA, 22 bp, Homo sapiens
aaaactttcactgaatacaaat

SEQ ID NO: 5070537 - DNA, 12 bp, Homo sapiens
aaaactttccat

SEQ ID NO: 5070538 - DNA, 18 bp, Homo sapiens
aaaactttccatgacagt

SEQ ID NO: 5070539 - DNA, 22 bp, Homo sapiens
aaaactttccatgacagtagca

SEQ ID NO: 5070540 - DNA, 20 bp, Homo sapiens
aaaactttcctcgcctgaca

SEQ ID NO: 5070541 - DNA, 17 bp, Homo sapiens
aaaactttgactttgcc

SEQ ID NO: 5070542 - DNA, 11 bp, Homo sapiens
aaaactttgga

SEQ ID NO: 5070543 - DNA, 17 bp, Homo sapiens
aaaactttggaaccaga

SEQ ID NO: 5070544 - DNA, 19 bp, Homo sapiens
aaaactttggaaccagact

SEQ ID NO: 5070545 - DNA, 19 bp, Homo sapiens
aaaactttggcaacatctt

SEQ ID NO: 5070546 - DNA, 19 bp, Homo sapiens
aaaactttggtgcattgtt

SEQ ID NO: 5070547 - DNA, 23 bp, Homo sapiens
aaaactttggtgcattgttattt

SEQ ID NO: 5070548 - DNA, 11 bp, Homo sapiens
aaaactttgtt

SEQ ID NO: 5070549 - DNA, 16 bp, Homo sapiens
aaaacttttaaaactt

SEQ ID NO: 5070550 - DNA, 13 bp, Homo sapiens
aaaacttttaaac

SEQ ID NO: 5070551 - DNA, 15 bp, Homo sapiens
aaaacttttataaat

SEQ ID NO: 5070552 - DNA, 17 bp, Homo sapiens
aaaacttttataaatta

SEQ ID NO: 5070553 - DNA, 22 bp, Homo sapiens
aaaacttttataaattaaatat

SEQ ID NO: 5070554 - DNA, 16 bp, Homo sapiens
aaaacttttcatttca

SEQ ID NO: 5070555 - DNA, 18 bp, Homo sapiens
aaaacttttcatttcaga

SEQ ID NO: 5070556 - DNA, 13 bp, Homo sapiens
aaaacttttctca

SEQ ID NO: 5070557 - DNA, 14 bp, Homo sapiens
aaaacttttctgca

SEQ ID NO: 5070558 - DNA, 18 bp, Homo sapiens
aaaacttttctgcatttg

SEQ ID NO: 5070559 - DNA, 14 bp, Homo sapiens
aaaacttttgagga

SEQ ID NO: 5070560 - DNA, 17 bp, Homo sapiens
aaaactttttgttgttt

SEQ ID NO: 5070561 - DNA, 19 bp, Homo sapiens
aaaagaaaaaaaaagaaaa

SEQ ID NO: 5070562 - DNA, 18 bp, Homo sapiens
aaaagaaaaaaaaagcat

SEQ ID NO: 5070563 - DNA, 16 bp, Homo sapiens
aaaagaaaaaaaccaa

SEQ ID NO: 5070564 - DNA, 12 bp, Homo sapiens
aaaagaaaaaat

SEQ ID NO: 5070565 - DNA, 15 bp, Homo sapiens
aaaagaaaaaatcat

SEQ ID NO: 5070566 - DNA, 11 bp, Homo sapiens
aaaagaaaaac

SEQ ID NO: 5070567 - DNA, 13 bp, Homo sapiens
aaaagaaaaacca

SEQ ID NO: 5070568 - DNA, 16 bp, Homo sapiens
aaaagaaaaaggaaaa

SEQ ID NO: 5070569 - DNA, 15 bp, Homo sapiens
aaaagaaaaatatga

SEQ ID NO: 5070570 - DNA, 11 bp, Homo sapiens
aaaagaaaaca

SEQ ID NO: 5070571 - DNA, 19 bp, Homo sapiens
aaaagaaaacattccagat

SEQ ID NO: 5070572 - DNA, 20 bp, Homo sapiens
aaaagaaaaccattttagtt

SEQ ID NO: 5070573 - DNA, 10 bp, Homo sapiens
aaaagaaaag

SEQ ID NO: 5070574 - DNA, 11 bp, Homo sapiens
aaaagaaaagc

SEQ ID NO: 5070575 - DNA, 20 bp, Homo sapiens
aaaagaaaatcagttgatta

SEQ ID NO: 5070576 - DNA, 22 bp, Homo sapiens
aaaagaaaatctttataaatgt

SEQ ID NO: 5070577 - DNA, 21 bp, Homo sapiens
aaaatcagcagatgttgaaga

SEQ ID NO: 5070578 - DNA, 20 bp, Homo sapiens
aaaatcagccaattatgtta

SEQ ID NO: 5070579 - DNA, 22 bp, Homo sapiens
aaaatcagccaattatgttaaa

SEQ ID NO: 5070580 - DNA, 18 bp, Homo sapiens
aaaatcaggaaaggctgt

SEQ ID NO: 5070581 - DNA, 21 bp, Homo sapiens
aaaatcaggagcctgctaagg

SEQ ID NO: 5070582 - DNA, 21 bp, Homo sapiens
aaaatcaggtggcttttgcgg

SEQ ID NO: 5070583 - DNA, 20 bp, Homo sapiens
aaaatcagttatattcttta

SEQ ID NO: 5070584 - DNA, 24 bp, Homo sapiens
aaaatcatattgagaataattatt

SEQ ID NO: 5070585 - DNA, 13 bp, Homo sapiens
aaaatcatattgc

SEQ ID NO: 5070586 - DNA, 18 bp, Homo sapiens
aaaatcatattgcttctt

SEQ ID NO: 5070587 - DNA, 12 bp, Homo sapiens
aaaatcatcaaa

SEQ ID NO: 5070588 - DNA, 15 bp, Homo sapiens
aaaatcatcagaaag

SEQ ID NO: 5070589 - DNA, 16 bp, Homo sapiens
aaaatcatctattttg

SEQ ID NO: 5070590 - DNA, 18 bp, Homo sapiens
aaaatcatctattttgat

SEQ ID NO: 5070591 - DNA, 17 bp, Homo sapiens
aaaatcatgccagtatt

SEQ ID NO: 5070592 - DNA, 19 bp, Homo sapiens
aaaatcatggaatggttat

SEQ ID NO: 5070593 - DNA, 16 bp, Homo sapiens
aaaatcattaacactt

SEQ ID NO: 5070594 - DNA, 19 bp, Homo sapiens
aaaatcattcaatatctga

SEQ ID NO: 5070595 - DNA, 17 bp, Homo sapiens
aaaatcattccctttcc

SEQ ID NO: 5070596 - DNA, 22 bp, Homo sapiens
aaaatcattttatatgtcaaag

SEQ ID NO: 5070597 - DNA, 12 bp, Homo sapiens
aaaatccaaact

SEQ ID NO: 5070598 - DNA, 19 bp, Homo sapiens
aaaatccaaatattgttaa

SEQ ID NO: 5070599 - DNA, 22 bp, Homo sapiens
aaaatccaaatattgttaaggg

SEQ ID NO: 5070600 - DNA, 22 bp, Homo sapiens
aaaatccaagctgctcatttca

SEQ ID NO: 5070601 - DNA, 20 bp, Homo sapiens
aaaatccaataatcagaaaa

SEQ ID NO: 5070602 - DNA, 13 bp, Homo sapiens
aaaatccacagct

SEQ ID NO: 5070603 - DNA, 16 bp, Homo sapiens
aaaatccagactttct

SEQ ID NO: 5070604 - DNA, 22 bp, Homo sapiens
aaaatccagactttctttttct

SEQ ID NO: 5070605 - DNA, 19 bp, Homo sapiens
aaaatcccaaagtgccttc

SEQ ID NO: 5070606 - DNA, 18 bp, Homo sapiens
aaaatcccattgtattta

SEQ ID NO: 5070607 - DNA, 22 bp, Homo sapiens
aaaatcccattgtatttaaaac

SEQ ID NO: 5070608 - DNA, 16 bp, Homo sapiens
aaaatccccaaaaaag

SEQ ID NO: 5070609 - DNA, 18 bp, Homo sapiens
aaaatccccatgcctgtg

SEQ ID NO: 5070610 - DNA, 18 bp, Homo sapiens
aaaatcctacagtgaaat

SEQ ID NO: 5070611 - DNA, 18 bp, Homo sapiens
aaaatcctaccaacctct

SEQ ID NO: 5070612 - DNA, 20 bp, Homo sapiens
aaaatcctatatctgtttgt

SEQ ID NO: 5070613 - DNA, 22 bp, Homo sapiens
aaaatcctcaacactattgtaa

SEQ ID NO: 5070614 - DNA, 23 bp, Homo sapiens
aaaatcctgaactttctccctca

SEQ ID NO: 5070615 - DNA, 14 bp, Homo sapiens
aaaatcctgaataa

SEQ ID NO: 5070616 - DNA, 18 bp, Homo sapiens
aaaatcctgaataaacca

SEQ ID NO: 5070617 - DNA, 14 bp, Homo sapiens
aaaatcctggaaga

SEQ ID NO: 5070618 - DNA, 14 bp, Homo sapiens
aaaatccttcagca

SEQ ID NO: 5070619 - DNA, 16 bp, Homo sapiens
aaaatccttctaatct

SEQ ID NO: 5070620 - DNA, 18 bp, Homo sapiens
aaaatccttgccttcaaa

SEQ ID NO: 5070621 - DNA, 13 bp, Homo sapiens
aaaatccttgctt

SEQ ID NO: 5070622 - DNA, 22 bp, Homo sapiens
aaaatccttgttgaagtttttt

SEQ ID NO: 5070623 - DNA, 18 bp, Homo sapiens
aaaatcctttttgtattt

SEQ ID NO: 5070624 - DNA, 15 bp, Homo sapiens
aaaatcgatgagcgc

SEQ ID NO: 5070625 - DNA, 16 bp, Homo sapiens
aaaatctaaaacaaaa

SEQ ID NO: 5070626 - DNA, 15 bp, Homo sapiens
aaaatctaaaatgtg

SEQ ID NO: 5070627 - DNA, 16 bp, Homo sapiens
aaaatctaaaatgtgt

SEQ ID NO: 5070628 - DNA, 18 bp, Homo sapiens
aaaatctaaaatttcata

SEQ ID NO: 5070629 - DNA, 22 bp, Homo sapiens
aaaatctaagcagcttattgtt

SEQ ID NO: 5070630 - DNA, 23 bp, Homo sapiens
aaaatctaagcagcttattgttt

SEQ ID NO: 5070631 - DNA, 21 bp, Homo sapiens
aaaatctaccttctgtagttt

SEQ ID NO: 5070632 - DNA, 23 bp, Homo sapiens
aaaatctagatcaattaattctt

SEQ ID NO: 5070633 - DNA, 21 bp, Homo sapiens
aaaatctatatttgtcttccg

SEQ ID NO: 5070634 - DNA, 16 bp, Homo sapiens
aaaatctattttgtct

SEQ ID NO: 5070635 - DNA, 19 bp, Homo sapiens
aaaatctcaaatttctaaa

SEQ ID NO: 5070636 - DNA, 13 bp, Homo sapiens
aaaatctcattat

SEQ ID NO: 5070637 - DNA, 19 bp, Homo sapiens
aaaatctcattatttcaaa

SEQ ID NO: 5070638 - DNA, 21 bp, Homo sapiens
aaaatctcccattttggaatt

SEQ ID NO: 5070639 - DNA, 15 bp, Homo sapiens
aaaatctctccactt

SEQ ID NO: 5070640 - DNA, 21 bp, Homo sapiens
aaaatctgaactctaagcaga

SEQ ID NO: 5070641 - DNA, 16 bp, Homo sapiens
aaaatctgaactctca

SEQ ID NO: 5070642 - DNA, 23 bp, Homo sapiens
aaaatctgaagaggcttctcctg

SEQ ID NO: 5070643 - DNA, 13 bp, Homo sapiens
aaaatctgaagat

SEQ ID NO: 5070644 - DNA, 16 bp, Homo sapiens
aaaatctgaagattgt

SEQ ID NO: 5070645 - DNA, 24 bp, Homo sapiens
aaaatctgaattttgcaatgtatt

SEQ ID NO: 5070646 - DNA, 16 bp, Homo sapiens
aaaatctgagaaactc

SEQ ID NO: 5070647 - DNA, 18 bp, Homo sapiens
aaaatctgagaaactcta

SEQ ID NO: 5070648 - DNA, 16 bp, Homo sapiens
aaaatctgagggaaat

SEQ ID NO: 5070649 - DNA, 16 bp, Homo sapiens
aaaatctgatttaatg

SEQ ID NO: 5070650 - DNA, 21 bp, Homo sapiens
aaaatctgatttaatgttttc

SEQ ID NO: 5070651 - DNA, 22 bp, Homo sapiens
aaaatctgccctcagatgaaaa

SEQ ID NO: 5070652 - DNA, 13 bp, Homo sapiens
aaaatctgctgca

SEQ ID NO: 5070653 - DNA, 15 bp, Homo sapiens
aaaatctgctgttaa

SEQ ID NO: 5070654 - DNA, 18 bp, Homo sapiens
aaaatctgtcactacaat

SEQ ID NO: 5070655 - DNA, 11 bp, Homo sapiens
aaaatctgtga

SEQ ID NO: 5070656 - DNA, 16 bp, Homo sapiens
aaaatctgttcacttt

SEQ ID NO: 5070657 - DNA, 21 bp, Homo sapiens
aaaatctgttgataaatccat

SEQ ID NO: 5070658 - DNA, 17 bp, Homo sapiens
aaaatcttaatactgtt

SEQ ID NO: 5070659 - DNA, 21 bp, Homo sapiens
aaaatcttattaaagtttcaa

SEQ ID NO: 5070660 - DNA, 11 bp, Homo sapiens
aaaatcttcac

SEQ ID NO: 5070661 - DNA, 18 bp, Homo sapiens
aaaatcttcactgaatat

SEQ ID NO: 5070662 - DNA, 15 bp, Homo sapiens
aaaatcttcatggaa

SEQ ID NO: 5070663 - DNA, 14 bp, Homo sapiens
aaaatcttggaagt

SEQ ID NO: 5070664 - DNA, 12 bp, Homo sapiens
aaaatcttgggc

SEQ ID NO: 5070665 - DNA, 21 bp, Homo sapiens
aaaatcttgtaggtcattgca

SEQ ID NO: 5070666 - DNA, 12 bp, Homo sapiens
aaaatcttgtca

SEQ ID NO: 5070667 - DNA, 13 bp, Homo sapiens
aaaatcttgtcat

SEQ ID NO: 5070668 - DNA, 19 bp, Homo sapiens
aaaatcttgtcatgtgtat

SEQ ID NO: 5070669 - DNA, 12 bp, Homo sapiens
aaaatctttaat

SEQ ID NO: 5070670 - DNA, 17 bp, Homo sapiens
aaaatctttctttctta

SEQ ID NO: 5070671 - DNA, 23 bp, Homo sapiens
aaaatctttctttcttagaaatt

SEQ ID NO: 5070672 - DNA, 18 bp, Homo sapiens
aaaatctttgtataaata

SEQ ID NO: 5070673 - DNA, 9 bp, Homo sapiens
aaaatgaaa

SEQ ID NO: 5070674 - DNA, 11 bp, Homo sapiens
aaaatgaaaca

SEQ ID NO: 5070675 - DNA, 21 bp, Homo sapiens
aaaatgaaacaacaaaacaat

SEQ ID NO: 5070676 - DNA, 12 bp, Homo sapiens
aaaatgaaagaa

SEQ ID NO: 5070677 - DNA, 22 bp, Homo sapiens
aaaatgaaagcatgtctcaata

SEQ ID NO: 5070678 - DNA, 19 bp, Homo sapiens
aaaatgaaagctactcata

SEQ ID NO: 5070679 - DNA, 15 bp, Homo sapiens
aaaatgaaagtgact

SEQ ID NO: 5070680 - DNA, 14 bp, Homo sapiens
aaaatgaaatgcat

SEQ ID NO: 5070681 - DNA, 16 bp, Homo sapiens
aaaatgaaatgcattt

SEQ ID NO: 5070682 - DNA, 14 bp, Homo sapiens
aaaatgaaatgcta

SEQ ID NO: 5070683 - DNA, 22 bp, Homo sapiens
aaaatgaaatgtttttgctata

SEQ ID NO: 5070684 - DNA, 17 bp, Homo sapiens
aaaatgaacaggttctt

SEQ ID NO: 5070685 - DNA, 20 bp, Homo sapiens
aaaatgaactaactgccatg

SEQ ID NO: 5070686 - DNA, 20 bp, Homo sapiens
aaaatgaactgtatattatt

SEQ ID NO: 5070687 - DNA, 16 bp, Homo sapiens
aaaatgaactgtatta

SEQ ID NO: 5070688 - DNA, 18 bp, Homo sapiens
aaaatgaagaaggaagct

SEQ ID NO: 5070689 - DNA, 15 bp, Homo sapiens
aaaatgaagaattta

SEQ ID NO: 5070690 - DNA, 17 bp, Homo sapiens
aaaatgaagctgacaat

SEQ ID NO: 5070691 - DNA, 18 bp, Homo sapiens
aaaatgaaggaattacat

SEQ ID NO: 5070692 - DNA, 21 bp, Homo sapiens
aaaatgaataatttattatta

SEQ ID NO: 5070693 - DNA, 14 bp, Homo sapiens
aaaatgaatatcta

SEQ ID NO: 5070694 - DNA, 23 bp, Homo sapiens
aaaatgaatgaggtctgggctag

SEQ ID NO: 5070695 - DNA, 22 bp, Homo sapiens
aaaatgaattgaaaaacaattt

SEQ ID NO: 5070696 - DNA, 15 bp, Homo sapiens
aaaatgaattgcctt

SEQ ID NO: 5070697 - DNA, 12 bp, Homo sapiens
aaaatgaatttg

SEQ ID NO: 5070698 - DNA, 14 bp, Homo sapiens
aaaatgaattttgt

SEQ ID NO: 5070699 - DNA, 22 bp, Homo sapiens
aaaatgaattttgtatgctgaa

SEQ ID NO: 5070700 - DNA, 16 bp, Homo sapiens
aaaatgaatttttatt

SEQ ID NO: 5070701 - DNA, 12 bp, Homo sapiens
aaaatgacaaac

SEQ ID NO: 5070702 - DNA, 14 bp, Homo sapiens
aaaatgacaacaga

SEQ ID NO: 5070703 - DNA, 16 bp, Homo sapiens
aaaatgacaaggggag

SEQ ID NO: 5070704 - DNA, 14 bp, Homo sapiens
aaaatgacaatcat

SEQ ID NO: 5070705 - DNA, 17 bp, Homo sapiens
aaaatgacaatcatgtg

SEQ ID NO: 5070706 - DNA, 16 bp, Homo sapiens
aaaatgacaattgtga

SEQ ID NO: 5070707 - DNA, 20 bp, Homo sapiens
aaaatgaccagtaattgtga

SEQ ID NO: 5070708 - DNA, 16 bp, Homo sapiens
aaaatgacctcaagga

SEQ ID NO: 5070709 - DNA, 18 bp, Homo sapiens
aaaatgactacttagcat

SEQ ID NO: 5070710 - DNA, 16 bp, Homo sapiens
aaaatgactttgaact

SEQ ID NO: 5070711 - DNA, 12 bp, Homo sapiens
aaaatgagaaat

SEQ ID NO: 5070712 - DNA, 18 bp, Homo sapiens
aaaatgagaacatgttgg

SEQ ID NO: 5070713 - DNA, 23 bp, Homo sapiens
aaaatgagaacatgttggtattt

SEQ ID NO: 5070714 - DNA, 22 bp, Homo sapiens
aaaatgagactatgcgttttta

SEQ ID NO: 5070715 - DNA, 15 bp, Homo sapiens
aaaatgagatatgca

SEQ ID NO: 5070716 - DNA, 13 bp, Homo sapiens
aaaatgagatttc

SEQ ID NO: 5070717 - DNA, 14 bp, Homo sapiens
aaaatgagatttct

SEQ ID NO: 5070718 - DNA, 17 bp, Homo sapiens
aaaatgagcctgtaatc

SEQ ID NO: 5070719 - DNA, 19 bp, Homo sapiens
aaaatgagcctgtaatcct

SEQ ID NO: 5070720 - DNA, 20 bp, Homo sapiens
aaaatgaggaatccaaaaga

SEQ ID NO: 5070721 - DNA, 16 bp, Homo sapiens
aaaatgaggaatgtat

SEQ ID NO: 5070722 - DNA, 18 bp, Homo sapiens
aaaatgaggaatgtatat

SEQ ID NO: 5070723 - DNA, 14 bp, Homo sapiens
aaaatgaggaggat

SEQ ID NO: 5070724 - DNA, 20 bp, Homo sapiens
aaaatgagggtctcactgct

SEQ ID NO: 5070725 - DNA, 21 bp, Homo sapiens
aaaatgagtaggatgtctctt

SEQ ID NO: 5070726 - DNA, 18 bp, Homo sapiens
aaaatgagtcatttgttt

SEQ ID NO: 5070727 - DNA, 18 bp, Homo sapiens
aaaatgagtgatctcaaa

SEQ ID NO: 5070728 - DNA, 15 bp, Homo sapiens
aaaatgagtttgtat

SEQ ID NO: 5070729 - DNA, 19 bp, Homo sapiens
aaaatgataaagaacagaa

SEQ ID NO: 5070730 - DNA, 14 bp, Homo sapiens
aaaatgatacagca

SEQ ID NO: 5070731 - DNA, 16 bp, Homo sapiens
aaaatgatagacatat

SEQ ID NO: 5070732 - DNA, 19 bp, Homo sapiens
aaaatgatattgttatata

SEQ ID NO: 5070733 - DNA, 17 bp, Homo sapiens
aaaatgatcctcagtgc

SEQ ID NO: 5070734 - DNA, 16 bp, Homo sapiens
aaaatgatgataatca

SEQ ID NO: 5070735 - DNA, 16 bp, Homo sapiens
aaaatgatgcaaccaa

SEQ ID NO: 5070736 - DNA, 18 bp, Homo sapiens
aaaatgatgcaaccaaaa

SEQ ID NO: 5070737 - DNA, 17 bp, Homo sapiens
aaaatgatgcagctgtt

SEQ ID NO: 5070738 - DNA, 17 bp, Homo sapiens
aaaatgatgtagacatt

SEQ ID NO: 5070739 - DNA, 16 bp, Homo sapiens
aaaatgatgttcattt

SEQ ID NO: 5070740 - DNA, 23 bp, Homo sapiens
aaaatgattcctggacatcacca

SEQ ID NO: 5070741 - DNA, 19 bp, Homo sapiens
aaaatgattgtaaaatagc

SEQ ID NO: 5070742 - DNA, 13 bp, Homo sapiens
aaaatgattgtct

SEQ ID NO: 5070743 - DNA, 17 bp, Homo sapiens
aaaatgattgtcttttt

SEQ ID NO: 5070744 - DNA, 15 bp, Homo sapiens
aaaatgatttgcttt

SEQ ID NO: 5070745 - DNA, 13 bp, Homo sapiens
aaaatgattttta

SEQ ID NO: 5070746 - DNA, 16 bp, Homo sapiens
aaaatgcaaaatgaaa

SEQ ID NO: 5070747 - DNA, 14 bp, Homo sapiens
aaaatgcaaatgaa

SEQ ID NO: 5070748 - DNA, 16 bp, Homo sapiens
aaaatgcaacaaatga

SEQ ID NO: 5070749 - DNA, 18 bp, Homo sapiens
aaaatgcaacaacatgta

SEQ ID NO: 5070750 - DNA, 11 bp, Homo sapiens
aaaatgcaata

SEQ ID NO: 5070751 - DNA, 17 bp, Homo sapiens
aaaatgcactgtgacac

SEQ ID NO: 5070752 - DNA, 17 bp, Homo sapiens
aaaatgcagtccagaat

SEQ ID NO: 5070753 - DNA, 19 bp, Homo sapiens
aaaatgcagtccagaataa

SEQ ID NO: 5070754 - DNA, 14 bp, Homo sapiens
aaaatgcatatttc

SEQ ID NO: 5070755 - DNA, 12 bp, Homo sapiens
aaaatgcatgat

SEQ ID NO: 5070756 - DNA, 22 bp, Homo sapiens
aaaagaaaatgtgtaacagagt

SEQ ID NO: 5070757 - DNA, 14 bp, Homo sapiens
aaaagaaacacaag

SEQ ID NO: 5070758 - DNA, 10 bp, Homo sapiens
aaaagaaacc

SEQ ID NO: 5070759 - DNA, 18 bp, Homo sapiens
aaaagaaaccgtaatttt

SEQ ID NO: 5070760 - DNA, 22 bp, Homo sapiens
aaaagaaaccttccaatgcttc

SEQ ID NO: 5070761 - DNA, 20 bp, Homo sapiens
aaaagaaactctatggtctt

SEQ ID NO: 5070762 - DNA, 12 bp, Homo sapiens
aaaagaaacttt

SEQ ID NO: 5070763 - DNA, 18 bp, Homo sapiens
aaaagaaactttgttttt

SEQ ID NO: 5070764 - DNA, 13 bp, Homo sapiens
aaaagaaactttt

SEQ ID NO: 5070765 - DNA, 17 bp, Homo sapiens
aaaagaaacttttctga

SEQ ID NO: 5070766 - DNA, 17 bp, Homo sapiens
aaaagaaagaaaaaagt

SEQ ID NO: 5070767 - DNA, 20 bp, Homo sapiens
aaaagaaagatacttacatg

SEQ ID NO: 5070768 - DNA, 13 bp, Homo sapiens
aaaagaaagctaa

SEQ ID NO: 5070769 - DNA, 13 bp, Homo sapiens
aaaagaaagttaa

SEQ ID NO: 5070770 - DNA, 13 bp, Homo sapiens
aaaagaaataagt

SEQ ID NO: 5070771 - DNA, 16 bp, Homo sapiens
aaaagaaatatatttt

SEQ ID NO: 5070772 - DNA, 14 bp, Homo sapiens
aaaagaaatcaata

SEQ ID NO: 5070773 - DNA, 13 bp, Homo sapiens
aaaagaaatccag

SEQ ID NO: 5070774 - DNA, 12 bp, Homo sapiens
aaaagaaatcta

SEQ ID NO: 5070775 - DNA, 22 bp, Homo sapiens
aaaagaaatctcctaacaaaag

SEQ ID NO: 5070776 - DNA, 12 bp, Homo sapiens
aaaagaaatgaa

SEQ ID NO: 5070777 - DNA, 15 bp, Homo sapiens
aaaagaaatgactaa

SEQ ID NO: 5070778 - DNA, 19 bp, Homo sapiens
aaaagaaatgctaatgtaa

SEQ ID NO: 5070779 - DNA, 16 bp, Homo sapiens
aaaagaaattaatatg

SEQ ID NO: 5070780 - DNA, 17 bp, Homo sapiens
aaaagaacaaagctgga

SEQ ID NO: 5070781 - DNA, 22 bp, Homo sapiens
aaaagaacaataatgagagcaa

SEQ ID NO: 5070782 - DNA, 10 bp, Homo sapiens
aaaagaacat

SEQ ID NO: 5070783 - DNA, 11 bp, Homo sapiens
aaaagaacatg

SEQ ID NO: 5070784 - DNA, 22 bp, Homo sapiens
aaaagaacatgcagtttgaaat

SEQ ID NO: 5070785 - DNA, 16 bp, Homo sapiens
aaaagaactaaatatg

SEQ ID NO: 5070786 - DNA, 13 bp, Homo sapiens
aaaagaagaaaag

SEQ ID NO: 5070787 - DNA, 16 bp, Homo sapiens
aaaagaagaaactatt

SEQ ID NO: 5070788 - DNA, 14 bp, Homo sapiens
aaaagaagaaagtc

SEQ ID NO: 5070789 - DNA, 15 bp, Homo sapiens
aaaagaagaaataaa

SEQ ID NO: 5070790 - DNA, 14 bp, Homo sapiens
aaaagaagaagttt

SEQ ID NO: 5070791 - DNA, 15 bp, Homo sapiens
aaaagaagactggaa

SEQ ID NO: 5070792 - DNA, 20 bp, Homo sapiens
aaaagaagagaggggaagaa

SEQ ID NO: 5070793 - DNA, 15 bp, Homo sapiens
aaaagaagagtttgt

SEQ ID NO: 5070794 - DNA, 15 bp, Homo sapiens
aaaagaagagtttta

SEQ ID NO: 5070795 - DNA, 12 bp, Homo sapiens
aaaagaagctgt

SEQ ID NO: 5070796 - DNA, 11 bp, Homo sapiens
aaaagaaggaa

SEQ ID NO: 5070797 - DNA, 14 bp, Homo sapiens
aaaagaaggaaaga

SEQ ID NO: 5070798 - DNA, 13 bp, Homo sapiens
aaaagaagtgtga

SEQ ID NO: 5070799 - DNA, 12 bp, Homo sapiens
aaaagaagttac

SEQ ID NO: 5070800 - DNA, 20 bp, Homo sapiens
aaaagaagttcattcctgtc

SEQ ID NO: 5070801 - DNA, 17 bp, Homo sapiens
aaaagaataaaaacttt

SEQ ID NO: 5070802 - DNA, 13 bp, Homo sapiens
aaaagaataaaca

SEQ ID NO: 5070803 - DNA, 19 bp, Homo sapiens
aaaagaatccctgttcatt

SEQ ID NO: 5070804 - DNA, 17 bp, Homo sapiens
aaaagaatcggcagtat

SEQ ID NO: 5070805 - DNA, 20 bp, Homo sapiens
aaaagaatcggcagtatttt

SEQ ID NO: 5070806 - DNA, 22 bp, Homo sapiens
aaaagaatcggcagtattttct

SEQ ID NO: 5070807 - DNA, 23 bp, Homo sapiens
aaaagaatcggcagtattttctg

SEQ ID NO: 5070808 - DNA, 22 bp, Homo sapiens
aaaagaatgagtgaagtattgc

SEQ ID NO: 5070809 - DNA, 20 bp, Homo sapiens
aaaagaatgggcagttacat

SEQ ID NO: 5070810 - DNA, 12 bp, Homo sapiens
aaaagaatgtac

SEQ ID NO: 5070811 - DNA, 19 bp, Homo sapiens
aaaagaatgtacagaaaat

SEQ ID NO: 5070812 - DNA, 17 bp, Homo sapiens
aaaagaatgtacattac

SEQ ID NO: 5070813 - DNA, 21 bp, Homo sapiens
aaaagaattaccaagagaagg

SEQ ID NO: 5070814 - DNA, 16 bp, Homo sapiens
aaaagacaaacatgca

SEQ ID NO: 5070815 - DNA, 15 bp, Homo sapiens
aaaagacaaatatgt

SEQ ID NO: 5070816 - DNA, 20 bp, Homo sapiens
aaaagacaaggaaaaaataa

SEQ ID NO: 5070817 - DNA, 13 bp, Homo sapiens
aaaagacaagtgc

SEQ ID NO: 5070818 - DNA, 23 bp, Homo sapiens
aaaagacaattttttttcaaatg

SEQ ID NO: 5070819 - DNA, 13 bp, Homo sapiens
aaaagacacttca

SEQ ID NO: 5070820 - DNA, 18 bp, Homo sapiens
aaaagacacttttaccga

SEQ ID NO: 5070821 - DNA, 15 bp, Homo sapiens
aaaagacagacattc

SEQ ID NO: 5070822 - DNA, 13 bp, Homo sapiens
aaaagacagctgg

SEQ ID NO: 5070823 - DNA, 20 bp, Homo sapiens
aaaagacagggtgggaggga

SEQ ID NO: 5070824 - DNA, 16 bp, Homo sapiens
aaaagacataaaacag

SEQ ID NO: 5070825 - DNA, 19 bp, Homo sapiens
aaaagacataaaacagaat

SEQ ID NO: 5070826 - DNA, 12 bp, Homo sapiens
aaaagacatgtt

SEQ ID NO: 5070827 - DNA, 13 bp, Homo sapiens
aaaagacattcag

SEQ ID NO: 5070828 - DNA, 15 bp, Homo sapiens
aaaagaccaagactt

SEQ ID NO: 5070829 - DNA, 14 bp, Homo sapiens
aaaagaccagggct

SEQ ID NO: 5070830 - DNA, 19 bp, Homo sapiens
aaaagaccatgcattcaga

SEQ ID NO: 5070831 - DNA, 15 bp, Homo sapiens
aaaagacgatgttta

SEQ ID NO: 5070832 - DNA, 19 bp, Homo sapiens
aaaagacgatgtttatgtt

SEQ ID NO: 5070833 - DNA, 21 bp, Homo sapiens
aaaagacgatgtttatgttct

SEQ ID NO: 5070834 - DNA, 22 bp, Homo sapiens
aaaagactattaagagcaataa

SEQ ID NO: 5070835 - DNA, 11 bp, Homo sapiens
aaaagactcat

SEQ ID NO: 5070836 - DNA, 12 bp, Homo sapiens
aaaagactcatc

SEQ ID NO: 5070837 - DNA, 17 bp, Homo sapiens
aaaagactgcagctgct

SEQ ID NO: 5070838 - DNA, 21 bp, Homo sapiens
aaaagactggtttgtttgctt

SEQ ID NO: 5070839 - DNA, 24 bp, Homo sapiens
aaaagactggtttgtttgcttaat

SEQ ID NO: 5070840 - DNA, 12 bp, Homo sapiens
aaaagactttga

SEQ ID NO: 5070841 - DNA, 20 bp, Homo sapiens
aaaagacttttgttgaaata

SEQ ID NO: 5070842 - DNA, 13 bp, Homo sapiens
aaaagagaaaaac

SEQ ID NO: 5070843 - DNA, 16 bp, Homo sapiens
aaaagagaaaaaccaa

SEQ ID NO: 5070844 - DNA, 13 bp, Homo sapiens
aaaagagaagaag

SEQ ID NO: 5070845 - DNA, 15 bp, Homo sapiens
aaaagagaagaagaa

SEQ ID NO: 5070846 - DNA, 17 bp, Homo sapiens
aaaagagaagaagaaaa

SEQ ID NO: 5070847 - DNA, 13 bp, Homo sapiens
aaaagagaatgat

SEQ ID NO: 5070848 - DNA, 14 bp, Homo sapiens
aaaagagaattaga

SEQ ID NO: 5070849 - DNA, 17 bp, Homo sapiens
aaaagagactgtgccat

SEQ ID NO: 5070850 - DNA, 16 bp, Homo sapiens
aaaagagatattttaa

SEQ ID NO: 5070851 - DNA, 15 bp, Homo sapiens
aaaagagattgagat

SEQ ID NO: 5070852 - DNA, 20 bp, Homo sapiens
aaaagagccagaagttgatg

SEQ ID NO: 5070853 - DNA, 18 bp, Homo sapiens
aaaagagctcagacattt

SEQ ID NO: 5070854 - DNA, 13 bp, Homo sapiens
aaaagagcttccc

SEQ ID NO: 5070855 - DNA, 14 bp, Homo sapiens
aaaagaggaaatta

SEQ ID NO: 5070856 - DNA, 19 bp, Homo sapiens
aaaagaggaaattaaataa

SEQ ID NO: 5070857 - DNA, 19 bp, Homo sapiens
aaaagaggatgatttcaga

SEQ ID NO: 5070858 - DNA, 20 bp, Homo sapiens
aaaagaggatgatttcagaa

SEQ ID NO: 5070859 - DNA, 17 bp, Homo sapiens
aaaagaggtccattaat

SEQ ID NO: 5070860 - DNA, 14 bp, Homo sapiens
aaaagagtaatggt

SEQ ID NO: 5070861 - DNA, 16 bp, Homo sapiens
aaaagagtcagccctt

SEQ ID NO: 5070862 - DNA, 22 bp, Homo sapiens
aaaagagtcttaattttctaaa

SEQ ID NO: 5070863 - DNA, 15 bp, Homo sapiens
aaaagagttaaggca

SEQ ID NO: 5070864 - DNA, 17 bp, Homo sapiens
aaaagataaacacaaga

SEQ ID NO: 5070865 - DNA, 19 bp, Homo sapiens
aaaagataaacacaagatt

SEQ ID NO: 5070866 - DNA, 12 bp, Homo sapiens
aaaagataaaga

SEQ ID NO: 5070867 - DNA, 14 bp, Homo sapiens
aaaagataaagagt

SEQ ID NO: 5070868 - DNA, 13 bp, Homo sapiens
aaaagataaagat

SEQ ID NO: 5070869 - DNA, 20 bp, Homo sapiens
aaaagataaagatgatctac

SEQ ID NO: 5070870 - DNA, 15 bp, Homo sapiens
aaaagataatatttt

SEQ ID NO: 5070871 - DNA, 22 bp, Homo sapiens
aaaagatacaaaagctttttaa

SEQ ID NO: 5070872 - DNA, 16 bp, Homo sapiens
aaaagatacatttgta

SEQ ID NO: 5070873 - DNA, 18 bp, Homo sapiens
aaaagatacatttgtatg

SEQ ID NO: 5070874 - DNA, 22 bp, Homo sapiens
aaaagataccttaaaatttgaa

SEQ ID NO: 5070875 - DNA, 19 bp, Homo sapiens
aaaagatactgtatatgtc

SEQ ID NO: 5070876 - DNA, 20 bp, Homo sapiens
aaaagataggtttgagttca

SEQ ID NO: 5070877 - DNA, 19 bp, Homo sapiens
aaaagatataagtgctgta

SEQ ID NO: 5070878 - DNA, 16 bp, Homo sapiens
aaaagatatattaaaa

SEQ ID NO: 5070879 - DNA, 22 bp, Homo sapiens
aaaagatatattaaaaatataa

SEQ ID NO: 5070880 - DNA, 20 bp, Homo sapiens
aaaagatatgtattctaatt

SEQ ID NO: 5070881 - DNA, 13 bp, Homo sapiens
aaaagatattgta

SEQ ID NO: 5070882 - DNA, 17 bp, Homo sapiens
aaaagatattttatttc

SEQ ID NO: 5070883 - DNA, 20 bp, Homo sapiens
aaaagatattttatttctga

SEQ ID NO: 5070884 - DNA, 10 bp, Homo sapiens
aaaagatccc

SEQ ID NO: 5070885 - DNA, 18 bp, Homo sapiens
aaaagatccttcatttta

SEQ ID NO: 5070886 - DNA, 21 bp, Homo sapiens
aaaagatccttcattttagat

SEQ ID NO: 5070887 - DNA, 16 bp, Homo sapiens
aaaagatcctttttaa

SEQ ID NO: 5070888 - DNA, 13 bp, Homo sapiens
aaaagatcgcagt

SEQ ID NO: 5070889 - DNA, 14 bp, Homo sapiens
aaaagatctttcat

SEQ ID NO: 5070890 - DNA, 15 bp, Homo sapiens
aaaagatgaaaaaga

SEQ ID NO: 5070891 - DNA, 20 bp, Homo sapiens
aaaagatgatcgctgtattt

SEQ ID NO: 5070892 - DNA, 18 bp, Homo sapiens
aaaagatgcactttgctt

SEQ ID NO: 5070893 - DNA, 19 bp, Homo sapiens
aaaagatgcttttaacaga

SEQ ID NO: 5070894 - DNA, 18 bp, Homo sapiens
aaaagatggcctttgctt

SEQ ID NO: 5070895 - DNA, 21 bp, Homo sapiens
aaaagatggcttatgtcatca

SEQ ID NO: 5070896 - DNA, 19 bp, Homo sapiens
aaaagatggggtctgtaaa

SEQ ID NO: 5070897 - DNA, 22 bp, Homo sapiens
aaaagatggtaaaccagatctg

SEQ ID NO: 5070898 - DNA, 16 bp, Homo sapiens
aaaagatggtatcata

SEQ ID NO: 5070899 - DNA, 15 bp, Homo sapiens
aaaagatgtaataat

SEQ ID NO: 5070900 - DNA, 14 bp, Homo sapiens
aaaagatgtatcct

SEQ ID NO: 5070901 - DNA, 15 bp, Homo sapiens
aaaagattaaactgc

SEQ ID NO: 5070902 - DNA, 12 bp, Homo sapiens
aaaagattaatg

SEQ ID NO: 5070903 - DNA, 23 bp, Homo sapiens
aaaagattactagggttttgcca

SEQ ID NO: 5070904 - DNA, 23 bp, Homo sapiens
aaaagattataggaactgaggtt

SEQ ID NO: 5070905 - DNA, 13 bp, Homo sapiens
aaaagattatata

SEQ ID NO: 5070906 - DNA, 20 bp, Homo sapiens
aaaagattatatatcataaa

SEQ ID NO: 5070907 - DNA, 11 bp, Homo sapiens
aaaagattcat

SEQ ID NO: 5070908 - DNA, 14 bp, Homo sapiens
aaaagattctacta

SEQ ID NO: 5070909 - DNA, 23 bp, Homo sapiens
aaaagattctgaaaccacagttt

SEQ ID NO: 5070910 - DNA, 12 bp, Homo sapiens
aaaagattctgt

SEQ ID NO: 5070911 - DNA, 17 bp, Homo sapiens
aaaagattctgtaagaa

SEQ ID NO: 5070912 - DNA, 15 bp, Homo sapiens
aaaagattcttctta

SEQ ID NO: 5070913 - DNA, 13 bp, Homo sapiens
aaaagattgcaaa

SEQ ID NO: 5070914 - DNA, 17 bp, Homo sapiens
aaaagattgcaaaggga

SEQ ID NO: 5070915 - DNA, 14 bp, Homo sapiens
aaaagattgctgaa

SEQ ID NO: 5070916 - DNA, 15 bp, Homo sapiens
aaaagattgtattgc

SEQ ID NO: 5070917 - DNA, 17 bp, Homo sapiens
aaaagatttaacaaata

SEQ ID NO: 5070918 - DNA, 15 bp, Homo sapiens
aaaagatttgttttt

SEQ ID NO: 5070919 - DNA, 15 bp, Homo sapiens
aaaagattttaatca

SEQ ID NO: 5070920 - DNA, 21 bp, Homo sapiens
aaaagattttgtgaaatttca

SEQ ID NO: 5070921 - DNA, 21 bp, Homo sapiens
aaaagcaaaataaaaactatt

SEQ ID NO: 5070922 - DNA, 14 bp, Homo sapiens
aaaagcaaaatcat

SEQ ID NO: 5070923 - DNA, 14 bp, Homo sapiens
aaaagcaaaatttt

SEQ ID NO: 5070924 - DNA, 14 bp, Homo sapiens
aaaagcaaagtgaa

SEQ ID NO: 5070925 - DNA, 22 bp, Homo sapiens
aaaagcaaatactgattttcaa

SEQ ID NO: 5070926 - DNA, 14 bp, Homo sapiens
aaaagcaaatgaga

SEQ ID NO: 5070927 - DNA, 14 bp, Homo sapiens
aaaagcaaatggaa

SEQ ID NO: 5070928 - DNA, 13 bp, Homo sapiens
aaaagcaacactt

SEQ ID NO: 5070929 - DNA, 17 bp, Homo sapiens
aaaagcaacatcagctt

SEQ ID NO: 5070930 - DNA, 16 bp, Homo sapiens
aaaagcaactccatca

SEQ ID NO: 5070931 - DNA, 18 bp, Homo sapiens
aaaagcaattatattgtc

SEQ ID NO: 5070932 - DNA, 10 bp, Homo sapiens
aaaagcacaa

SEQ ID NO: 5070933 - DNA, 13 bp, Homo sapiens
aaaagcacaaacc

SEQ ID NO: 5070934 - DNA, 19 bp, Homo sapiens
aaaagcacaagtacttttg

SEQ ID NO: 5070935 - DNA, 17 bp, Homo sapiens
aaaagcacaatcactaa

SEQ ID NO: 5070936 - DNA, 16 bp, Homo sapiens
aaaagcacatacatta

SEQ ID NO: 5070937 - DNA, 19 bp, Homo sapiens
aaaagcacatacattaaaa

SEQ ID NO: 5070938 - DNA, 22 bp, Homo sapiens
aaaagcacatacattaaaacta

SEQ ID NO: 5070939 - DNA, 16 bp, Homo sapiens
aaaatgcatgtaatca

SEQ ID NO: 5070940 - DNA, 13 bp, Homo sapiens
aaaatgcatgtga

SEQ ID NO: 5070941 - DNA, 14 bp, Homo sapiens
aaaatgcattgtat

SEQ ID NO: 5070942 - DNA, 15 bp, Homo sapiens
aaaatgccaatctct

SEQ ID NO: 5070943 - DNA, 13 bp, Homo sapiens
aaaatgccaccat

SEQ ID NO: 5070944 - DNA, 23 bp, Homo sapiens
aaaatgccatgatgcctctgtct

SEQ ID NO: 5070945 - DNA, 17 bp, Homo sapiens
aaaatgcctagagatat

SEQ ID NO: 5070946 - DNA, 21 bp, Homo sapiens
aaaatgcctagagatatttca

SEQ ID NO: 5070947 - DNA, 16 bp, Homo sapiens
aaaatgcctcagtgta

SEQ ID NO: 5070948 - DNA, 18 bp, Homo sapiens
aaaatgcctcagtgtatt

SEQ ID NO: 5070949 - DNA, 15 bp, Homo sapiens
aaaatgcctttgaga

SEQ ID NO: 5070950 - DNA, 21 bp, Homo sapiens
aaaatgcgaaattattggttg

SEQ ID NO: 5070951 - DNA, 16 bp, Homo sapiens
aaaatgctaatattaa

SEQ ID NO: 5070952 - DNA, 17 bp, Homo sapiens
aaaatgctatcaaataa

SEQ ID NO: 5070953 - DNA, 19 bp, Homo sapiens
aaaatgctcctagaagtct

SEQ ID NO: 5070954 - DNA, 15 bp, Homo sapiens
aaaatgctgaacatt

SEQ ID NO: 5070955 - DNA, 20 bp, Homo sapiens
aaaatgctgacaaaaatatt

SEQ ID NO: 5070956 - DNA, 12 bp, Homo sapiens
aaaatgctgctc

SEQ ID NO: 5070957 - DNA, 21 bp, Homo sapiens
aaaatgctggctgagctgaac

SEQ ID NO: 5070958 - DNA, 21 bp, Homo sapiens
aaaatgctgttctcaatcatt

SEQ ID NO: 5070959 - DNA, 21 bp, Homo sapiens
aaaatgcttcatgaatttctc

SEQ ID NO: 5070960 - DNA, 22 bp, Homo sapiens
aaaatgcttcatgaatttctcc

SEQ ID NO: 5070961 - DNA, 12 bp, Homo sapiens
aaaatgcttctt

SEQ ID NO: 5070962 - DNA, 19 bp, Homo sapiens
aaaatgcttctttctactt

SEQ ID NO: 5070963 - DNA, 19 bp, Homo sapiens
aaaatgctttttatttctg

SEQ ID NO: 5070964 - DNA, 22 bp, Homo sapiens
aaaatgctttttatttctgcat

SEQ ID NO: 5070965 - DNA, 15 bp, Homo sapiens
aaaatggaaaaaaac

SEQ ID NO: 5070966 - DNA, 12 bp, Homo sapiens
aaaatggaaaat

SEQ ID NO: 5070967 - DNA, 18 bp, Homo sapiens
aaaatggaaaatatacaa

SEQ ID NO: 5070968 - DNA, 21 bp, Homo sapiens
aaaatggaaaatatacaagta

SEQ ID NO: 5070969 - DNA, 19 bp, Homo sapiens
aaaatggaaaattaattct

SEQ ID NO: 5070970 - DNA, 14 bp, Homo sapiens
aaaatggaaagaag

SEQ ID NO: 5070971 - DNA, 16 bp, Homo sapiens
aaaatggaaccaggct

SEQ ID NO: 5070972 - DNA, 20 bp, Homo sapiens
aaaatggaagacagctctta

SEQ ID NO: 5070973 - DNA, 13 bp, Homo sapiens
aaaatggaagcaa

SEQ ID NO: 5070974 - DNA, 14 bp, Homo sapiens
aaaatggaagcaaa

SEQ ID NO: 5070975 - DNA, 15 bp, Homo sapiens
aaaatggaagcaaag

SEQ ID NO: 5070976 - DNA, 20 bp, Homo sapiens
aaaatggaagccaacacatc

SEQ ID NO: 5070977 - DNA, 19 bp, Homo sapiens
aaaatggacacaaattttc

SEQ ID NO: 5070978 - DNA, 23 bp, Homo sapiens
aaaatggacatggtggctttgtt

SEQ ID NO: 5070979 - DNA, 22 bp, Homo sapiens
aaaatggactgtggtgactttg

SEQ ID NO: 5070980 - DNA, 22 bp, Homo sapiens
aaaatggaggccattgtgtgag

SEQ ID NO: 5070981 - DNA, 13 bp, Homo sapiens
aaaatggatacat

SEQ ID NO: 5070982 - DNA, 20 bp, Homo sapiens
aaaatggatattattagaaa

SEQ ID NO: 5070983 - DNA, 14 bp, Homo sapiens
aaaatggatttaat

SEQ ID NO: 5070984 - DNA, 21 bp, Homo sapiens
aaaatggatttaatccatttt

SEQ ID NO: 5070985 - DNA, 14 bp, Homo sapiens
aaaatggcaagaga

SEQ ID NO: 5070986 - DNA, 19 bp, Homo sapiens
aaaatggcatttagcacag

SEQ ID NO: 5070987 - DNA, 18 bp, Homo sapiens
aaaatggctaataaactg

SEQ ID NO: 5070988 - DNA, 23 bp, Homo sapiens
aaaatggctaataaactgtatta

SEQ ID NO: 5070989 - DNA, 20 bp, Homo sapiens
aaaatgggaaaaataaaaga

SEQ ID NO: 5070990 - DNA, 19 bp, Homo sapiens
aaaatgggaagactgagct

SEQ ID NO: 5070991 - DNA, 22 bp, Homo sapiens
aaaatgggagacaatttcacat

SEQ ID NO: 5070992 - DNA, 14 bp, Homo sapiens
aaaatgggagatct

SEQ ID NO: 5070993 - DNA, 17 bp, Homo sapiens
aaaatgggatgaattct

SEQ ID NO: 5070994 - DNA, 16 bp, Homo sapiens
aaaatgggcacttaaa

SEQ ID NO: 5070995 - DNA, 13 bp, Homo sapiens
aaaatggtataaa

SEQ ID NO: 5070996 - DNA, 24 bp, Homo sapiens
aaaatggtatcaaaattacatata

SEQ ID NO: 5070997 - DNA, 15 bp, Homo sapiens
aaaatggtctctaac

SEQ ID NO: 5070998 - DNA, 19 bp, Homo sapiens
aaaatggtggcttcagctc

SEQ ID NO: 5070999 - DNA, 20 bp, Homo sapiens
aaaatggttgatggaaaata

SEQ ID NO: 5071000 - DNA, 16 bp, Homo sapiens
aaaatggtttaaatgg

SEQ ID NO: 5071001 - DNA, 14 bp, Homo sapiens
aaaatggtttattt

SEQ ID NO: 5071002 - DNA, 13 bp, Homo sapiens
aaaatgtaaaaaa

SEQ ID NO: 5071003 - DNA, 19 bp, Homo sapiens
aaaatgtaaaggagtcaaa

SEQ ID NO: 5071004 - DNA, 11 bp, Homo sapiens
aaaatgtaaat

SEQ ID NO: 5071005 - DNA, 20 bp, Homo sapiens
aaaatgtaaatattctatat

SEQ ID NO: 5071006 - DNA, 15 bp, Homo sapiens
aaaatgtaaatgaat

SEQ ID NO: 5071007 - DNA, 12 bp, Homo sapiens
aaaatgtaaatt

SEQ ID NO: 5071008 - DNA, 16 bp, Homo sapiens
aaaatgtaaattagtt

SEQ ID NO: 5071009 - DNA, 21 bp, Homo sapiens
aaaatgtaaattagtttgaca

SEQ ID NO: 5071010 - DNA, 20 bp, Homo sapiens
aaaatgtaagaaaagctgat

SEQ ID NO: 5071011 - DNA, 19 bp, Homo sapiens
aaaatgtaaggattctgga

SEQ ID NO: 5071012 - DNA, 23 bp, Homo sapiens
aaaatgtaagtaaatgtctgtgg

SEQ ID NO: 5071013 - DNA, 18 bp, Homo sapiens
aaaatgtaatttagaaac

SEQ ID NO: 5071014 - DNA, 21 bp, Homo sapiens
aaaatgtacaaaataaagtta

SEQ ID NO: 5071015 - DNA, 15 bp, Homo sapiens
aaaatgtacatgtat

SEQ ID NO: 5071016 - DNA, 22 bp, Homo sapiens
aaaatgtacatgtattaaatta

SEQ ID NO: 5071017 - DNA, 15 bp, Homo sapiens
aaaatgtacatttat

SEQ ID NO: 5071018 - DNA, 19 bp, Homo sapiens
aaaatgtacttaaagggtt

SEQ ID NO: 5071019 - DNA, 18 bp, Homo sapiens
aaaatgtacttaaatgag

SEQ ID NO: 5071020 - DNA, 18 bp, Homo sapiens
aaaatgtagaaattctaa

SEQ ID NO: 5071021 - DNA, 19 bp, Homo sapiens
aaaatgtagaagaaagcaa

SEQ ID NO: 5071022 - DNA, 16 bp, Homo sapiens
aaaatgtagaatattc

SEQ ID NO: 5071023 - DNA, 21 bp, Homo sapiens
aaaatgtaggcttagtttgtg

SEQ ID NO: 5071024 - DNA, 21 bp, Homo sapiens
aaaatgtagggttataataat

SEQ ID NO: 5071025 - DNA, 20 bp, Homo sapiens
aaaatgtagttttaaataaa

SEQ ID NO: 5071026 - DNA, 20 bp, Homo sapiens
aaaatgtataaaaattatca

SEQ ID NO: 5071027 - DNA, 20 bp, Homo sapiens
aaaatgtataaattattcag

SEQ ID NO: 5071028 - DNA, 21 bp, Homo sapiens
aaaatgtataagttgaggcat

SEQ ID NO: 5071029 - DNA, 23 bp, Homo sapiens
aaaatgtataagttgaggcattt

SEQ ID NO: 5071030 - DNA, 21 bp, Homo sapiens
aaaatgtataatgacttttaa

SEQ ID NO: 5071031 - DNA, 13 bp, Homo sapiens
aaaatgtatattt

SEQ ID NO: 5071032 - DNA, 13 bp, Homo sapiens
aaaatgtatctaa

SEQ ID NO: 5071033 - DNA, 15 bp, Homo sapiens
aaaatgtatgcatgt

SEQ ID NO: 5071034 - DNA, 20 bp, Homo sapiens
aaaatgtatgcatgttgtct

SEQ ID NO: 5071035 - DNA, 22 bp, Homo sapiens
aaaatgtattattgtaaagttt

SEQ ID NO: 5071036 - DNA, 17 bp, Homo sapiens
aaaatgtattcaagcaa

SEQ ID NO: 5071037 - DNA, 14 bp, Homo sapiens
aaaatgtattcctt

SEQ ID NO: 5071038 - DNA, 18 bp, Homo sapiens
aaaatgtattcctttaaa

SEQ ID NO: 5071039 - DNA, 20 bp, Homo sapiens
aaaatgtattcctttaaaat

SEQ ID NO: 5071040 - DNA, 16 bp, Homo sapiens
aaaatgtattgattca

SEQ ID NO: 5071041 - DNA, 19 bp, Homo sapiens
aaaatgtatttaactcaga

SEQ ID NO: 5071042 - DNA, 16 bp, Homo sapiens
aaaatgtattttatgt

SEQ ID NO: 5071043 - DNA, 22 bp, Homo sapiens
aaaatgtattttatgttatata

SEQ ID NO: 5071044 - DNA, 13 bp, Homo sapiens
aaaatgtattttt

SEQ ID NO: 5071045 - DNA, 15 bp, Homo sapiens
aaaatgtcaaaagta

SEQ ID NO: 5071046 - DNA, 20 bp, Homo sapiens
aaaatgtcaagacagggaag

SEQ ID NO: 5071047 - DNA, 20 bp, Homo sapiens
aaaatgtcaatttttaactt

SEQ ID NO: 5071048 - DNA, 13 bp, Homo sapiens
aaaatgtcactgt

SEQ ID NO: 5071049 - DNA, 19 bp, Homo sapiens
aaaatgtcactgttataaa

SEQ ID NO: 5071050 - DNA, 20 bp, Homo sapiens
aaaatgtcccagtgtcagta

SEQ ID NO: 5071051 - DNA, 18 bp, Homo sapiens
aaaatgtcctgcctttta

SEQ ID NO: 5071052 - DNA, 16 bp, Homo sapiens
aaaatgtctcagtatt

SEQ ID NO: 5071053 - DNA, 21 bp, Homo sapiens
aaaatgtctcagtattttagg

SEQ ID NO: 5071054 - DNA, 12 bp, Homo sapiens
aaaatgtctgta

SEQ ID NO: 5071055 - DNA, 18 bp, Homo sapiens
aaaatgtctgtaataata

SEQ ID NO: 5071056 - DNA, 14 bp, Homo sapiens
aaaatgtcttggtc

SEQ ID NO: 5071057 - DNA, 21 bp, Homo sapiens
aaaatgtcttgtgtatttctc

SEQ ID NO: 5071058 - DNA, 18 bp, Homo sapiens
aaaatgtcttgtgttacc

SEQ ID NO: 5071059 - DNA, 19 bp, Homo sapiens
aaaatgtgaaaaaaattat

SEQ ID NO: 5071060 - DNA, 22 bp, Homo sapiens
aaaatgtgaaatctcagaattt

SEQ ID NO: 5071061 - DNA, 14 bp, Homo sapiens
aaaatgtgaaatgc

SEQ ID NO: 5071062 - DNA, 21 bp, Homo sapiens
aaaatgtgaaatgcttttata

SEQ ID NO: 5071063 - DNA, 13 bp, Homo sapiens
aaaatgtgaaatt

SEQ ID NO: 5071064 - DNA, 11 bp, Homo sapiens
aaaatgtgaag

SEQ ID NO: 5071065 - DNA, 12 bp, Homo sapiens
aaaatgtgaagt

SEQ ID NO: 5071066 - DNA, 23 bp, Homo sapiens
aaaatgtgaattgcatgacttgt

SEQ ID NO: 5071067 - DNA, 19 bp, Homo sapiens
aaaatgtgacccagatcct

SEQ ID NO: 5071068 - DNA, 13 bp, Homo sapiens
aaaatgtgaccct

SEQ ID NO: 5071069 - DNA, 15 bp, Homo sapiens
aaaatgtgaggaaga

SEQ ID NO: 5071070 - DNA, 18 bp, Homo sapiens
aaaatgtgaggcaataag

SEQ ID NO: 5071071 - DNA, 18 bp, Homo sapiens
aaaatgtgagtggttgaa

SEQ ID NO: 5071072 - DNA, 15 bp, Homo sapiens
aaaatgtgatgttct

SEQ ID NO: 5071073 - DNA, 17 bp, Homo sapiens
aaaatgtgatgttctaa

SEQ ID NO: 5071074 - DNA, 16 bp, Homo sapiens
aaaatgtgatttttct

SEQ ID NO: 5071075 - DNA, 21 bp, Homo sapiens
aaaatgtgggattatgggtca

SEQ ID NO: 5071076 - DNA, 22 bp, Homo sapiens
aaaatgtgggattatgggtcac

SEQ ID NO: 5071077 - DNA, 14 bp, Homo sapiens
aaaatgtgtacagt

SEQ ID NO: 5071078 - DNA, 16 bp, Homo sapiens
aaaatgtgtacagtga

SEQ ID NO: 5071079 - DNA, 18 bp, Homo sapiens
aaaatgtgtacagtgaat

SEQ ID NO: 5071080 - DNA, 19 bp, Homo sapiens
aaaatgtgtacagtgaatt

SEQ ID NO: 5071081 - DNA, 22 bp, Homo sapiens
aaaatgtgtacagtgaattgtc

SEQ ID NO: 5071082 - DNA, 14 bp, Homo sapiens
aaaatgtgtctctg

SEQ ID NO: 5071083 - DNA, 20 bp, Homo sapiens
aaaatgtgtctgcaacatgg

SEQ ID NO: 5071084 - DNA, 15 bp, Homo sapiens
aaaatgtgtgcttgg

SEQ ID NO: 5071085 - DNA, 18 bp, Homo sapiens
aaaatgtgtgcttggaaa

SEQ ID NO: 5071086 - DNA, 19 bp, Homo sapiens
aaaatgtgtgcttggaaaa

SEQ ID NO: 5071087 - DNA, 12 bp, Homo sapiens
aaaatgtgtgtg

SEQ ID NO: 5071088 - DNA, 11 bp, Homo sapiens
aaaatgtgttc

SEQ ID NO: 5071089 - DNA, 13 bp, Homo sapiens
aaaatgtgttgaa

SEQ ID NO: 5071090 - DNA, 15 bp, Homo sapiens
aaaatgtgttgaaac

SEQ ID NO: 5071091 - DNA, 14 bp, Homo sapiens
aaaatgtgtttcag

SEQ ID NO: 5071092 - DNA, 17 bp, Homo sapiens
aaaatgtgtttttcagt

SEQ ID NO: 5071093 - DNA, 14 bp, Homo sapiens
aaaatgttaaaaca

SEQ ID NO: 5071094 - DNA, 18 bp, Homo sapiens
aaaatgttaacaacttga

SEQ ID NO: 5071095 - DNA, 14 bp, Homo sapiens
aaaatgttaagcat

SEQ ID NO: 5071096 - DNA, 12 bp, Homo sapiens
aaaatgttaata

SEQ ID NO: 5071097 - DNA, 15 bp, Homo sapiens
aaaatgttacgtgaa

SEQ ID NO: 5071098 - DNA, 16 bp, Homo sapiens
aaaatgttatttccct

SEQ ID NO: 5071099 - DNA, 14 bp, Homo sapiens
aaaatgttcaaatt

SEQ ID NO: 5071100 - DNA, 13 bp, Homo sapiens
aaaatgttcactt

SEQ ID NO: 5071101 - DNA, 12 bp, Homo sapiens
aaaatgttcatt

SEQ ID NO: 5071102 - DNA, 18 bp, Homo sapiens
aaaatgttcgtattctat

SEQ ID NO: 5071103 - DNA, 17 bp, Homo sapiens
aaaatgttctatatgca

SEQ ID NO: 5071104 - DNA, 23 bp, Homo sapiens
aaaatgttctatatgcatttaat

SEQ ID NO: 5071105 - DNA, 15 bp, Homo sapiens
aaaatgttctgtttg

SEQ ID NO: 5071106 - DNA, 15 bp, Homo sapiens
aaaatgttggaatgg

SEQ ID NO: 5071107 - DNA, 22 bp, Homo sapiens
aaaatgttggatttataaatgc

SEQ ID NO: 5071108 - DNA, 15 bp, Homo sapiens
aaaatgttggctgcg

SEQ ID NO: 5071109 - DNA, 16 bp, Homo sapiens
aaaatgttggtgcaat

SEQ ID NO: 5071110 - DNA, 16 bp, Homo sapiens
aaaatgtttacatttt

SEQ ID NO: 5071111 - DNA, 19 bp, Homo sapiens
aaaatgtttacattttctt

SEQ ID NO: 5071112 - DNA, 20 bp, Homo sapiens
aaaatgtttacattttcttt

SEQ ID NO: 5071113 - DNA, 12 bp, Homo sapiens
aaaatgtttact

SEQ ID NO: 5071114 - DNA, 16 bp, Homo sapiens
aaaatgtttactgtaa

SEQ ID NO: 5071115 - DNA, 19 bp, Homo sapiens
aaaatgtttactgtaaatt

SEQ ID NO: 5071116 - DNA, 14 bp, Homo sapiens
aaaatgtttaggaa

SEQ ID NO: 5071117 - DNA, 16 bp, Homo sapiens
aaaatgtttaggaaat

SEQ ID NO: 5071118 - DNA, 11 bp, Homo sapiens
aaaagcacctc

SEQ ID NO: 5071119 - DNA, 10 bp, Homo sapiens
aaaagcactt

SEQ ID NO: 5071120 - DNA, 13 bp, Homo sapiens
aaaagcacttttg

SEQ ID NO: 5071121 - DNA, 15 bp, Homo sapiens
aaaagcacttttgtt

SEQ ID NO: 5071122 - DNA, 21 bp, Homo sapiens
aaaagcacttttgttattcca

SEQ ID NO: 5071123 - DNA, 14 bp, Homo sapiens
aaaagcagaatttt

SEQ ID NO: 5071124 - DNA, 20 bp, Homo sapiens
aaaagcagaattttaatgtg

SEQ ID NO: 5071125 - DNA, 22 bp, Homo sapiens
aaaagcagaattttaatgtgaa

SEQ ID NO: 5071126 - DNA, 23 bp, Homo sapiens
aaaagcagacgcagcagctggga

SEQ ID NO: 5071127 - DNA, 15 bp, Homo sapiens
aaaagcagagcattt

SEQ ID NO: 5071128 - DNA, 18 bp, Homo sapiens
aaaagcagagtggactgc

SEQ ID NO: 5071129 - DNA, 21 bp, Homo sapiens
aaaagcagatggacttgaaaa

SEQ ID NO: 5071130 - DNA, 12 bp, Homo sapiens
aaaagcaggaac

SEQ ID NO: 5071131 - DNA, 23 bp, Homo sapiens
aaaagcaggcttgtgctttatac

SEQ ID NO: 5071132 - DNA, 15 bp, Homo sapiens
aaaagcagggcagca

SEQ ID NO: 5071133 - DNA, 12 bp, Homo sapiens
aaaagcagtcct

SEQ ID NO: 5071134 - DNA, 23 bp, Homo sapiens
aaaagcagttcatgtctgaaaca

SEQ ID NO: 5071135 - DNA, 21 bp, Homo sapiens
aaaagcatctgccacaaaaat

SEQ ID NO: 5071136 - DNA, 14 bp, Homo sapiens
aaaagcatgaaaca

SEQ ID NO: 5071137 - DNA, 16 bp, Homo sapiens
aaaagcatgaatattt

SEQ ID NO: 5071138 - DNA, 18 bp, Homo sapiens
aaaagcatggccctgctg

SEQ ID NO: 5071139 - DNA, 13 bp, Homo sapiens
aaaagcatgtaca

SEQ ID NO: 5071140 - DNA, 13 bp, Homo sapiens
aaaagcattaaaa

SEQ ID NO: 5071141 - DNA, 20 bp, Homo sapiens
aaaagcattgtccaaaatcc

SEQ ID NO: 5071142 - DNA, 10 bp, Homo sapiens
aaaagcattt

SEQ ID NO: 5071143 - DNA, 15 bp, Homo sapiens
aaaagcatttgggca

SEQ ID NO: 5071144 - DNA, 18 bp, Homo sapiens
aaaagccaagaggctgca

SEQ ID NO: 5071145 - DNA, 17 bp, Homo sapiens
aaaagccagatgctaga

SEQ ID NO: 5071146 - DNA, 18 bp, Homo sapiens
aaaagccagggctggaga

SEQ ID NO: 5071147 - DNA, 23 bp, Homo sapiens
aaaagccaggttccacagaggac

SEQ ID NO: 5071148 - DNA, 11 bp, Homo sapiens
aaaagccatat

SEQ ID NO: 5071149 - DNA, 16 bp, Homo sapiens
aaaagccatatctagt

SEQ ID NO: 5071150 - DNA, 15 bp, Homo sapiens
aaaagccatgtttaa

SEQ ID NO: 5071151 - DNA, 21 bp, Homo sapiens
aaaagccatgtttaagattta

SEQ ID NO: 5071152 - DNA, 12 bp, Homo sapiens
aaaagccattat

SEQ ID NO: 5071153 - DNA, 14 bp, Homo sapiens
aaaagcccaacaca

SEQ ID NO: 5071154 - DNA, 13 bp, Homo sapiens
aaaagcccaacct

SEQ ID NO: 5071155 - DNA, 15 bp, Homo sapiens
aaaagcccaacctct

SEQ ID NO: 5071156 - DNA, 20 bp, Homo sapiens
aaaagcccaacctcttcctc

SEQ ID NO: 5071157 - DNA, 16 bp, Homo sapiens
aaaagcccacaggcct

SEQ ID NO: 5071158 - DNA, 14 bp, Homo sapiens
aaaagcccaggagc

SEQ ID NO: 5071159 - DNA, 20 bp, Homo sapiens
aaaagccctatgtgaaaaga

SEQ ID NO: 5071160 - DNA, 17 bp, Homo sapiens
aaaagcctaacaaatgg

SEQ ID NO: 5071161 - DNA, 15 bp, Homo sapiens
aaaagcctaagaaaa

SEQ ID NO: 5071162 - DNA, 12 bp, Homo sapiens
aaaagcctcagc

SEQ ID NO: 5071163 - DNA, 13 bp, Homo sapiens
aaaagcctccttg

SEQ ID NO: 5071164 - DNA, 14 bp, Homo sapiens
aaaagcctctgtgt

SEQ ID NO: 5071165 - DNA, 14 bp, Homo sapiens
aaaagcctctttct

SEQ ID NO: 5071166 - DNA, 15 bp, Homo sapiens
aaaagcctggttttt

SEQ ID NO: 5071167 - DNA, 23 bp, Homo sapiens
aaaagccttacagttatcctgca

SEQ ID NO: 5071168 - DNA, 15 bp, Homo sapiens
aaaagccttattcta

SEQ ID NO: 5071169 - DNA, 13 bp, Homo sapiens
aaaagccttattt

SEQ ID NO: 5071170 - DNA, 20 bp, Homo sapiens
aaaagccttcttatatctga

SEQ ID NO: 5071171 - DNA, 11 bp, Homo sapiens
aaaagccttgg

SEQ ID NO: 5071172 - DNA, 17 bp, Homo sapiens
aaaagcgcgttgtgtat

SEQ ID NO: 5071173 - DNA, 20 bp, Homo sapiens
aaaagcgcgttgtgtatatt

SEQ ID NO: 5071174 - DNA, 21 bp, Homo sapiens
aaaagcgcgttgtgtatatta

SEQ ID NO: 5071175 - DNA, 16 bp, Homo sapiens
aaaagcgtctttaaga

SEQ ID NO: 5071176 - DNA, 22 bp, Homo sapiens
aaaagcgtctttaagagactca

SEQ ID NO: 5071177 - DNA, 17 bp, Homo sapiens
aaaagcgtgagcttaaa

SEQ ID NO: 5071178 - DNA, 19 bp, Homo sapiens
aaaagcgtgagcttaaaat

SEQ ID NO: 5071179 - DNA, 21 bp, Homo sapiens
aaaagcgtgagcttaaaatac

SEQ ID NO: 5071180 - DNA, 14 bp, Homo sapiens
aaaagctaaattac

SEQ ID NO: 5071181 - DNA, 16 bp, Homo sapiens
aaaagctaacatcttt

SEQ ID NO: 5071182 - DNA, 16 bp, Homo sapiens
aaaagctaataccagt

SEQ ID NO: 5071183 - DNA, 20 bp, Homo sapiens
aaaagctacagttttgtgaa

SEQ ID NO: 5071184 - DNA, 21 bp, Homo sapiens
aaaagctataaagcagtattt

SEQ ID NO: 5071185 - DNA, 21 bp, Homo sapiens
aaaagctataaagtatatatt

SEQ ID NO: 5071186 - DNA, 16 bp, Homo sapiens
aaaagctataaattat

SEQ ID NO: 5071187 - DNA, 20 bp, Homo sapiens
aaaagctatggtgagatgca

SEQ ID NO: 5071188 - DNA, 20 bp, Homo sapiens
aaaagctattagccaggatc

SEQ ID NO: 5071189 - DNA, 20 bp, Homo sapiens
aaaagctatttaaagcatct

SEQ ID NO: 5071190 - DNA, 12 bp, Homo sapiens
aaaagctcagag

SEQ ID NO: 5071191 - DNA, 14 bp, Homo sapiens
aaaagctcatattt

SEQ ID NO: 5071192 - DNA, 14 bp, Homo sapiens
aaaagctctgaaaa

SEQ ID NO: 5071193 - DNA, 20 bp, Homo sapiens
aaaagctgaaattctcagaa

SEQ ID NO: 5071194 - DNA, 18 bp, Homo sapiens
aaaagctgaacacatttc

SEQ ID NO: 5071195 - DNA, 19 bp, Homo sapiens
aaaagctgaacacatttct

SEQ ID NO: 5071196 - DNA, 17 bp, Homo sapiens
aaaagctgactgttttt

SEQ ID NO: 5071197 - DNA, 10 bp, Homo sapiens
aaaagctgat

SEQ ID NO: 5071198 - DNA, 18 bp, Homo sapiens
aaaagctgcaaaaattat

SEQ ID NO: 5071199 - DNA, 13 bp, Homo sapiens
aaaagctgctcag

SEQ ID NO: 5071200 - DNA, 22 bp, Homo sapiens
aaaagctgcttgactatcacat

SEQ ID NO: 5071201 - DNA, 13 bp, Homo sapiens
aaaagctgtgtct

SEQ ID NO: 5071202 - DNA, 18 bp, Homo sapiens
aaaagcttaatgattctg

SEQ ID NO: 5071203 - DNA, 13 bp, Homo sapiens
aaaagcttcttaa

SEQ ID NO: 5071204 - DNA, 16 bp, Homo sapiens
aaaagcttcttaatta

SEQ ID NO: 5071205 - DNA, 13 bp, Homo sapiens
aaaagcttgtcca

SEQ ID NO: 5071206 - DNA, 18 bp, Homo sapiens
aaaagcttgtgtatcttg

SEQ ID NO: 5071207 - DNA, 19 bp, Homo sapiens
aaaagctttaaaaaataaa

SEQ ID NO: 5071208 - DNA, 21 bp, Homo sapiens
aaaagctttaaaaaataaagc

SEQ ID NO: 5071209 - DNA, 17 bp, Homo sapiens
aaaagctttagattgaa

SEQ ID NO: 5071210 - DNA, 19 bp, Homo sapiens
aaaagctttagattgaaat

SEQ ID NO: 5071211 - DNA, 22 bp, Homo sapiens
aaaagctttagattgaaattta

SEQ ID NO: 5071212 - DNA, 13 bp, Homo sapiens
aaaagctttcatg

SEQ ID NO: 5071213 - DNA, 21 bp, Homo sapiens
aaaagctttgaaccctgggac

SEQ ID NO: 5071214 - DNA, 15 bp, Homo sapiens
aaaagcttttgtttt

SEQ ID NO: 5071215 - DNA, 16 bp, Homo sapiens
aaaagctttttgatgt

SEQ ID NO: 5071216 - DNA, 10 bp, Homo sapiens
aaaaggaaaa

SEQ ID NO: 5071217 - DNA, 20 bp, Homo sapiens
aaaaggaaaaaaaacacaaa

SEQ ID NO: 5071218 - DNA, 15 bp, Homo sapiens
aaaaggaaaaaaaga

SEQ ID NO: 5071219 - DNA, 15 bp, Homo sapiens
aaaaggaaaaagctc

SEQ ID NO: 5071220 - DNA, 20 bp, Homo sapiens
aaaaggaaaactcaccattt

SEQ ID NO: 5071221 - DNA, 15 bp, Homo sapiens
aaaaggaaaagaaaa

SEQ ID NO: 5071222 - DNA, 23 bp, Homo sapiens
aaaaggaaaagaaaaaaaaaaga

SEQ ID NO: 5071223 - DNA, 13 bp, Homo sapiens
aaaaggaaagaaa

SEQ ID NO: 5071224 - DNA, 14 bp, Homo sapiens
aaaaggaaagaaaa

SEQ ID NO: 5071225 - DNA, 11 bp, Homo sapiens
aaaaggaaagc

SEQ ID NO: 5071226 - DNA, 19 bp, Homo sapiens
aaaaggaaattagtctttt

SEQ ID NO: 5071227 - DNA, 20 bp, Homo sapiens
aaaaggaaattagtcttttt

SEQ ID NO: 5071228 - DNA, 15 bp, Homo sapiens
aaaaggaaatttgtt

SEQ ID NO: 5071229 - DNA, 15 bp, Homo sapiens
aaaaggaacaaaaat

SEQ ID NO: 5071230 - DNA, 16 bp, Homo sapiens
aaaaggaacaaataaa

SEQ ID NO: 5071231 - DNA, 13 bp, Homo sapiens
aaaaggaagacta

SEQ ID NO: 5071232 - DNA, 14 bp, Homo sapiens
aaaaggaagattct

SEQ ID NO: 5071233 - DNA, 15 bp, Homo sapiens
aaaaggaagattctt

SEQ ID NO: 5071234 - DNA, 20 bp, Homo sapiens
aaaaggaagcttacatgcct

SEQ ID NO: 5071235 - DNA, 18 bp, Homo sapiens
aaaaggaaggaagggaca

SEQ ID NO: 5071236 - DNA, 13 bp, Homo sapiens
aaaaggaagtaga

SEQ ID NO: 5071237 - DNA, 14 bp, Homo sapiens
aaaaggacaaataa

SEQ ID NO: 5071238 - DNA, 18 bp, Homo sapiens
aaaaggacaaataaagca

SEQ ID NO: 5071239 - DNA, 23 bp, Homo sapiens
aaaaggacaaataaagcaatgaa

SEQ ID NO: 5071240 - DNA, 19 bp, Homo sapiens
aaaaggacaggcagaaaga

SEQ ID NO: 5071241 - DNA, 19 bp, Homo sapiens
aaaaggacatcagcaaaca

SEQ ID NO: 5071242 - DNA, 17 bp, Homo sapiens
aaaaggacgtaaaattt

SEQ ID NO: 5071243 - DNA, 20 bp, Homo sapiens
aaaaggacgtaaaatttaca

SEQ ID NO: 5071244 - DNA, 14 bp, Homo sapiens
aaaaggactcttga

SEQ ID NO: 5071245 - DNA, 15 bp, Homo sapiens
aaaaggactggaaaa

SEQ ID NO: 5071246 - DNA, 22 bp, Homo sapiens
aaaaggagagactcccatgaag

SEQ ID NO: 5071247 - DNA, 18 bp, Homo sapiens
aaaaggagagattattaa

SEQ ID NO: 5071248 - DNA, 22 bp, Homo sapiens
aaaaggagccaatttaaagaaa

SEQ ID NO: 5071249 - DNA, 19 bp, Homo sapiens
aaaaggagccttttgctct

SEQ ID NO: 5071250 - DNA, 17 bp, Homo sapiens
aaaaggagcgggcaggg

SEQ ID NO: 5071251 - DNA, 15 bp, Homo sapiens
aaaaggagctcttct

SEQ ID NO: 5071252 - DNA, 13 bp, Homo sapiens
aaaaggaggaaat

SEQ ID NO: 5071253 - DNA, 15 bp, Homo sapiens
aaaaggatgcacaga

SEQ ID NO: 5071254 - DNA, 21 bp, Homo sapiens
aaaaggatgtataaattttta

SEQ ID NO: 5071255 - DNA, 19 bp, Homo sapiens
aaaaggatgttacaagttt

SEQ ID NO: 5071256 - DNA, 16 bp, Homo sapiens
aaaaggattaggcaaa

SEQ ID NO: 5071257 - DNA, 15 bp, Homo sapiens
aaaaggatttaagca

SEQ ID NO: 5071258 - DNA, 16 bp, Homo sapiens
aaaaggcaaatattga

SEQ ID NO: 5071259 - DNA, 23 bp, Homo sapiens
aaaaggcaaatattgaagttgtt

SEQ ID NO: 5071260 - DNA, 22 bp, Homo sapiens
aaaaggcactgcacataatttg

SEQ ID NO: 5071261 - DNA, 14 bp, Homo sapiens
aaaaggcagcacgt

SEQ ID NO: 5071262 - DNA, 12 bp, Homo sapiens
aaaaggcagcca

SEQ ID NO: 5071263 - DNA, 19 bp, Homo sapiens
aaaaggccaaacctctgtt

SEQ ID NO: 5071264 - DNA, 22 bp, Homo sapiens
aaaaggccaaacctctgttcag

SEQ ID NO: 5071265 - DNA, 23 bp, Homo sapiens
aaaaggccaaacctctgttcagt

SEQ ID NO: 5071266 - DNA, 18 bp, Homo sapiens
aaaaggccaatataccta

SEQ ID NO: 5071267 - DNA, 12 bp, Homo sapiens
aaaaggcccctt

SEQ ID NO: 5071268 - DNA, 21 bp, Homo sapiens
aaaaggcctcttgtaaagact

SEQ ID NO: 5071269 - DNA, 23 bp, Homo sapiens
aaaaggcctcttgtaaagactgg

SEQ ID NO: 5071270 - DNA, 18 bp, Homo sapiens
aaaaggcctttgggattt

SEQ ID NO: 5071271 - DNA, 17 bp, Homo sapiens
aaaaggctaagaaaaag

SEQ ID NO: 5071272 - DNA, 18 bp, Homo sapiens
aaaaggctaagaatagtg

SEQ ID NO: 5071273 - DNA, 13 bp, Homo sapiens
aaaaggctgccct

SEQ ID NO: 5071274 - DNA, 16 bp, Homo sapiens
aaaaggctgccctggg

SEQ ID NO: 5071275 - DNA, 22 bp, Homo sapiens
aaaaggctggatgtgctttcat

SEQ ID NO: 5071276 - DNA, 20 bp, Homo sapiens
aaaaggctgtgctgccctga

SEQ ID NO: 5071277 - DNA, 20 bp, Homo sapiens
aaaagggaaaaaagaaagaa

SEQ ID NO: 5071278 - DNA, 17 bp, Homo sapiens
aaaagggaaaaaagcaa

SEQ ID NO: 5071279 - DNA, 14 bp, Homo sapiens
aaaagggaaaaaga

SEQ ID NO: 5071280 - DNA, 16 bp, Homo sapiens
aaaagggaaaaagacc

SEQ ID NO: 5071281 - DNA, 18 bp, Homo sapiens
aaaagggaactgaacatt

SEQ ID NO: 5071282 - DNA, 12 bp, Homo sapiens
aaaagggaagta

SEQ ID NO: 5071283 - DNA, 23 bp, Homo sapiens
aaaagggacagtattctcagtgc

SEQ ID NO: 5071284 - DNA, 22 bp, Homo sapiens
aaaagggagaataaaattccta

SEQ ID NO: 5071285 - DNA, 19 bp, Homo sapiens
aaaagggagtttaaaaatg

SEQ ID NO: 5071286 - DNA, 13 bp, Homo sapiens
aaaagggcagagg

SEQ ID NO: 5071287 - DNA, 14 bp, Homo sapiens
aaaagggcagccag

SEQ ID NO: 5071288 - DNA, 18 bp, Homo sapiens
aaaagggcagccctcctt

SEQ ID NO: 5071289 - DNA, 16 bp, Homo sapiens
aaaagggcggaagagt

SEQ ID NO: 5071290 - DNA, 13 bp, Homo sapiens
aaaaggggaggag

SEQ ID NO: 5071291 - DNA, 23 bp, Homo sapiens
aaaaggggggggcaatctctctc

SEQ ID NO: 5071292 - DNA, 19 bp, Homo sapiens
aaaaggggggtgggagggg

SEQ ID NO: 5071293 - DNA, 10 bp, Homo sapiens
aaaagggtca

SEQ ID NO: 5071294 - DNA, 18 bp, Homo sapiens
aaaagggtcaaacctgta

SEQ ID NO: 5071295 - DNA, 21 bp, Homo sapiens
aaaagggtcaatgctattttt

SEQ ID NO: 5071296 - DNA, 12 bp, Homo sapiens
aaaagggtcaga

SEQ ID NO: 5071297 - DNA, 21 bp, Homo sapiens
aaaagggtcttgggaaatatg

SEQ ID NO: 5071298 - DNA, 23 bp, Homo sapiens
aaaaggtaaaactttttatattt

SEQ ID NO: 5071299 - DNA, 15 bp, Homo sapiens
aaaatgtttcattat

SEQ ID NO: 5071300 - DNA, 16 bp, Homo sapiens
aaaatgtttcatttac

SEQ ID NO: 5071301 - DNA, 18 bp, Homo sapiens
aaaatgtttcattttcat

SEQ ID NO: 5071302 - DNA, 21 bp, Homo sapiens
aaaatgtttgccctgttcaaa

SEQ ID NO: 5071303 - DNA, 24 bp, Homo sapiens
aaaatgtttgccctgttcaaagta

SEQ ID NO: 5071304 - DNA, 23 bp, Homo sapiens
aaaatgtttggtttcaggtattt

SEQ ID NO: 5071305 - DNA, 14 bp, Homo sapiens
aaaatgttttacat

SEQ ID NO: 5071306 - DNA, 15 bp, Homo sapiens
aaaatgttttagcaa

SEQ ID NO: 5071307 - DNA, 16 bp, Homo sapiens
aaaatgttttatgaca

SEQ ID NO: 5071308 - DNA, 19 bp, Homo sapiens
aaaatgttttatgacattt

SEQ ID NO: 5071309 - DNA, 13 bp, Homo sapiens
aaaatgttttatt

SEQ ID NO: 5071310 - DNA, 19 bp, Homo sapiens
aaaatgttttccaatattt

SEQ ID NO: 5071311 - DNA, 14 bp, Homo sapiens
aaaatgttttctgg

SEQ ID NO: 5071312 - DNA, 21 bp, Homo sapiens
aaaatgttttgtaagaaacca

SEQ ID NO: 5071313 - DNA, 13 bp, Homo sapiens
aaaatgtttttaa

SEQ ID NO: 5071314 - DNA, 21 bp, Homo sapiens
aaaatgttttttcatgtgttt

SEQ ID NO: 5071315 - DNA, 13 bp, Homo sapiens
aaaattaaaattt

SEQ ID NO: 5071316 - DNA, 14 bp, Homo sapiens
aaaattaaaatttt

SEQ ID NO: 5071317 - DNA, 24 bp, Homo sapiens
aaaattaaaccaatgaagaagaca

SEQ ID NO: 5071318 - DNA, 20 bp, Homo sapiens
aaaattaaaccggaccatct

SEQ ID NO: 5071319 - DNA, 16 bp, Homo sapiens
aaaattaaagaaaata

SEQ ID NO: 5071320 - DNA, 14 bp, Homo sapiens
aaaattaaatactt

SEQ ID NO: 5071321 - DNA, 16 bp, Homo sapiens
aaaattaaatactttt

SEQ ID NO: 5071322 - DNA, 18 bp, Homo sapiens
aaaattaaatctagacat

SEQ ID NO: 5071323 - DNA, 14 bp, Homo sapiens
aaaattaaatgcct

SEQ ID NO: 5071324 - DNA, 17 bp, Homo sapiens
aaaattaaatgccttgt

SEQ ID NO: 5071325 - DNA, 16 bp, Homo sapiens
aaaattaaatggattt

SEQ ID NO: 5071326 - DNA, 13 bp, Homo sapiens
aaaattaagaaag

SEQ ID NO: 5071327 - DNA, 20 bp, Homo sapiens
aaaattaagcaaatgttaaa

SEQ ID NO: 5071328 - DNA, 17 bp, Homo sapiens
aaaattaaggcaactga

SEQ ID NO: 5071329 - DNA, 20 bp, Homo sapiens
aaaattaaggtgtttgaaaa

SEQ ID NO: 5071330 - DNA, 14 bp, Homo sapiens
aaaattaagtagaa

SEQ ID NO: 5071331 - DNA, 17 bp, Homo sapiens
aaaattaagtagaacaa

SEQ ID NO: 5071332 - DNA, 18 bp, Homo sapiens
aaaattaagtgtgtataa

SEQ ID NO: 5071333 - DNA, 15 bp, Homo sapiens
aaaattaatatcaca

SEQ ID NO: 5071334 - DNA, 15 bp, Homo sapiens
aaaattaatcttgct

SEQ ID NO: 5071335 - DNA, 18 bp, Homo sapiens
aaaattaatcttgcttca

SEQ ID NO: 5071336 - DNA, 15 bp, Homo sapiens
aaaattaatgtaata

SEQ ID NO: 5071337 - DNA, 18 bp, Homo sapiens
aaaattaatgtaataaag

SEQ ID NO: 5071338 - DNA, 22 bp, Homo sapiens
aaaattaatgtaataaagtgaa

SEQ ID NO: 5071339 - DNA, 14 bp, Homo sapiens
aaaattaattctaa

SEQ ID NO: 5071340 - DNA, 19 bp, Homo sapiens
aaaattaattctaaactta

SEQ ID NO: 5071341 - DNA, 16 bp, Homo sapiens
aaaattaattctttat

SEQ ID NO: 5071342 - DNA, 23 bp, Homo sapiens
aaaattaattctttatcacatgt

SEQ ID NO: 5071343 - DNA, 17 bp, Homo sapiens
aaaattacaaaagagca

SEQ ID NO: 5071344 - DNA, 13 bp, Homo sapiens
aaaattacaaaga

SEQ ID NO: 5071345 - DNA, 14 bp, Homo sapiens
aaaattacagaaga

SEQ ID NO: 5071346 - DNA, 21 bp, Homo sapiens
aaaattacagaagaagctcct

SEQ ID NO: 5071347 - DNA, 18 bp, Homo sapiens
aaaattacagatgtgaaa

SEQ ID NO: 5071348 - DNA, 14 bp, Homo sapiens
aaaattacatgttt

SEQ ID NO: 5071349 - DNA, 22 bp, Homo sapiens
aaaattacgttcttacaagctt

SEQ ID NO: 5071350 - DNA, 12 bp, Homo sapiens
aaaattactaat

SEQ ID NO: 5071351 - DNA, 11 bp, Homo sapiens
aaaattacttt

SEQ ID NO: 5071352 - DNA, 17 bp, Homo sapiens
aaaattagaaaggacaa

SEQ ID NO: 5071353 - DNA, 20 bp, Homo sapiens
aaaattagaaattggctgga

SEQ ID NO: 5071354 - DNA, 16 bp, Homo sapiens
aaaattagacaaatgc

SEQ ID NO: 5071355 - DNA, 23 bp, Homo sapiens
aaaattaggaacagtaaaatcca

SEQ ID NO: 5071356 - DNA, 20 bp, Homo sapiens
aaaattagtacctcaaagta

SEQ ID NO: 5071357 - DNA, 23 bp, Homo sapiens
aaaattagtgaccattattcaca

SEQ ID NO: 5071358 - DNA, 16 bp, Homo sapiens
aaaattagttgggcat

SEQ ID NO: 5071359 - DNA, 15 bp, Homo sapiens
aaaattataagaaga

SEQ ID NO: 5071360 - DNA, 18 bp, Homo sapiens
aaaattatactgtgtgtg

SEQ ID NO: 5071361 - DNA, 15 bp, Homo sapiens
aaaattatagctcta

SEQ ID NO: 5071362 - DNA, 24 bp, Homo sapiens
aaaattatagctctaatgtttgca

SEQ ID NO: 5071363 - DNA, 23 bp, Homo sapiens
aaaattataggaatatcaatata

SEQ ID NO: 5071364 - DNA, 16 bp, Homo sapiens
aaaattatcaaaaagc

SEQ ID NO: 5071365 - DNA, 12 bp, Homo sapiens
aaaattatcagt

SEQ ID NO: 5071366 - DNA, 14 bp, Homo sapiens
aaaattatctattt

SEQ ID NO: 5071367 - DNA, 16 bp, Homo sapiens
aaaattatctgttcta

SEQ ID NO: 5071368 - DNA, 14 bp, Homo sapiens
aaaattatgaatct

SEQ ID NO: 5071369 - DNA, 22 bp, Homo sapiens
aaaattatgaatctgattttta

SEQ ID NO: 5071370 - DNA, 15 bp, Homo sapiens
aaaattatgcaaaag

SEQ ID NO: 5071371 - DNA, 23 bp, Homo sapiens
aaaattatgcaattcagtgttcc

SEQ ID NO: 5071372 - DNA, 17 bp, Homo sapiens
aaaattatggaaacaga

SEQ ID NO: 5071373 - DNA, 13 bp, Homo sapiens
aaaattatggaat

SEQ ID NO: 5071374 - DNA, 23 bp, Homo sapiens
aaaattatgtgttgccaaaacca

SEQ ID NO: 5071375 - DNA, 22 bp, Homo sapiens
aaaattatgttactgtattttt

SEQ ID NO: 5071376 - DNA, 14 bp, Homo sapiens
aaaattattaaaaa

SEQ ID NO: 5071377 - DNA, 18 bp, Homo sapiens
aaaattattaaaaattat

SEQ ID NO: 5071378 - DNA, 20 bp, Homo sapiens
aaaattattaaaaattatag

SEQ ID NO: 5071379 - DNA, 14 bp, Homo sapiens
aaaattattatata

SEQ ID NO: 5071380 - DNA, 17 bp, Homo sapiens
aaaattattatatattt

SEQ ID NO: 5071381 - DNA, 23 bp, Homo sapiens
aaaattattccctgaattgtttg

SEQ ID NO: 5071382 - DNA, 14 bp, Homo sapiens
aaaattatttcaga

SEQ ID NO: 5071383 - DNA, 19 bp, Homo sapiens
aaaattatttcagaaatgt

SEQ ID NO: 5071384 - DNA, 21 bp, Homo sapiens
aaaattatttgaaaacatata

SEQ ID NO: 5071385 - DNA, 17 bp, Homo sapiens
aaaattatttgcctttt

SEQ ID NO: 5071386 - DNA, 19 bp, Homo sapiens
aaaattattttaaacaaaa

SEQ ID NO: 5071387 - DNA, 14 bp, Homo sapiens
aaaattattttgac

SEQ ID NO: 5071388 - DNA, 16 bp, Homo sapiens
aaaattattttgttca

SEQ ID NO: 5071389 - DNA, 20 bp, Homo sapiens
aaaattattttgttcataca

SEQ ID NO: 5071390 - DNA, 18 bp, Homo sapiens
aaaattcaaaagtattga

SEQ ID NO: 5071391 - DNA, 20 bp, Homo sapiens
aaaattcaaaatacttttta

SEQ ID NO: 5071392 - DNA, 15 bp, Homo sapiens
aaaattcaaagcatg

SEQ ID NO: 5071393 - DNA, 13 bp, Homo sapiens
aaaattcaacaaa

SEQ ID NO: 5071394 - DNA, 21 bp, Homo sapiens
aaaattcaagcatttaggaat

SEQ ID NO: 5071395 - DNA, 23 bp, Homo sapiens
aaaattcaaggccacaaaaacaa

SEQ ID NO: 5071396 - DNA, 16 bp, Homo sapiens
aaaattcacaagctaa

SEQ ID NO: 5071397 - DNA, 13 bp, Homo sapiens
aaaattcagcaaa

SEQ ID NO: 5071398 - DNA, 21 bp, Homo sapiens
aaaattcagcaaaccattttt

SEQ ID NO: 5071399 - DNA, 19 bp, Homo sapiens
aaaattcagcaaagtggtt

SEQ ID NO: 5071400 - DNA, 21 bp, Homo sapiens
aaaattcagggctttaaacat

SEQ ID NO: 5071401 - DNA, 17 bp, Homo sapiens
aaaattcagtgagatat

SEQ ID NO: 5071402 - DNA, 13 bp, Homo sapiens
aaaattcagtgga

SEQ ID NO: 5071403 - DNA, 13 bp, Homo sapiens
aaaattcagtttt

SEQ ID NO: 5071404 - DNA, 15 bp, Homo sapiens
aaaattcagtttttg

SEQ ID NO: 5071405 - DNA, 23 bp, Homo sapiens
aaaattcagtttttgtatcttgg

SEQ ID NO: 5071406 - DNA, 19 bp, Homo sapiens
aaaattcatagtaagattg

SEQ ID NO: 5071407 - DNA, 20 bp, Homo sapiens
aaaattcatagtaagattga

SEQ ID NO: 5071408 - DNA, 12 bp, Homo sapiens
aaaattcatgcc

SEQ ID NO: 5071409 - DNA, 15 bp, Homo sapiens
aaaattcatggaact

SEQ ID NO: 5071410 - DNA, 21 bp, Homo sapiens
aaaattcatggaactttcata

SEQ ID NO: 5071411 - DNA, 18 bp, Homo sapiens
aaaattcattccatttgc

SEQ ID NO: 5071412 - DNA, 13 bp, Homo sapiens
aaaattcatttct

SEQ ID NO: 5071413 - DNA, 13 bp, Homo sapiens
aaaattccactca

SEQ ID NO: 5071414 - DNA, 16 bp, Homo sapiens
aaaattccattatctt

SEQ ID NO: 5071415 - DNA, 17 bp, Homo sapiens
aaaattccattatctta

SEQ ID NO: 5071416 - DNA, 21 bp, Homo sapiens
aaaattccattatcttatgaa

SEQ ID NO: 5071417 - DNA, 16 bp, Homo sapiens
aaaattcccaaatatt

SEQ ID NO: 5071418 - DNA, 19 bp, Homo sapiens
aaaattcccaaatattaca

SEQ ID NO: 5071419 - DNA, 22 bp, Homo sapiens
aaaattccccttttttctctat

SEQ ID NO: 5071420 - DNA, 16 bp, Homo sapiens
aaaattccctaaagcc

SEQ ID NO: 5071421 - DNA, 15 bp, Homo sapiens
aaaattcctgtgttc

SEQ ID NO: 5071422 - DNA, 23 bp, Homo sapiens
aaaattcgacctgatttacagtt

SEQ ID NO: 5071423 - DNA, 19 bp, Homo sapiens
aaaattctagctgtatgat

SEQ ID NO: 5071424 - DNA, 13 bp, Homo sapiens
aaaattctagtct

SEQ ID NO: 5071425 - DNA, 21 bp, Homo sapiens
aaaattctagtctgtttcatt

SEQ ID NO: 5071426 - DNA, 20 bp, Homo sapiens
aaaattctcataggaattaa

SEQ ID NO: 5071427 - DNA, 13 bp, Homo sapiens
aaaattctcctga

SEQ ID NO: 5071428 - DNA, 23 bp, Homo sapiens
aaaattctcttaatcactactgt

SEQ ID NO: 5071429 - DNA, 17 bp, Homo sapiens
aaaattctctttggtca

SEQ ID NO: 5071430 - DNA, 15 bp, Homo sapiens
aaaattctgaatttt

SEQ ID NO: 5071431 - DNA, 21 bp, Homo sapiens
aaaattctgaattttggggat

SEQ ID NO: 5071432 - DNA, 20 bp, Homo sapiens
aaaattctgtaggttctgtg

SEQ ID NO: 5071433 - DNA, 22 bp, Homo sapiens
aaaattctgttgttccatttta

SEQ ID NO: 5071434 - DNA, 17 bp, Homo sapiens
aaaattcttgaaagaat

SEQ ID NO: 5071435 - DNA, 18 bp, Homo sapiens
aaaattcttgagaagtaa

SEQ ID NO: 5071436 - DNA, 13 bp, Homo sapiens
aaaattcttggaa

SEQ ID NO: 5071437 - DNA, 20 bp, Homo sapiens
aaaattcttggttattctgc

SEQ ID NO: 5071438 - DNA, 17 bp, Homo sapiens
aaaattctttagagatt

SEQ ID NO: 5071439 - DNA, 12 bp, Homo sapiens
aaaattgaaagt

SEQ ID NO: 5071440 - DNA, 14 bp, Homo sapiens
aaaattgaaatgta

SEQ ID NO: 5071441 - DNA, 16 bp, Homo sapiens
aaaattgaaatgtaag

SEQ ID NO: 5071442 - DNA, 12 bp, Homo sapiens
aaaattgaatag

SEQ ID NO: 5071443 - DNA, 20 bp, Homo sapiens
aaaattgaatgtggctgaag

SEQ ID NO: 5071444 - DNA, 20 bp, Homo sapiens
aaaattgaattcgtttctga

SEQ ID NO: 5071445 - DNA, 14 bp, Homo sapiens
aaaattgaatttaa

SEQ ID NO: 5071446 - DNA, 16 bp, Homo sapiens
aaaattgaatttaaca

SEQ ID NO: 5071447 - DNA, 17 bp, Homo sapiens
aaaattgaatttaacaa

SEQ ID NO: 5071448 - DNA, 22 bp, Homo sapiens
aaaattgagttcttcctgtaat

SEQ ID NO: 5071449 - DNA, 13 bp, Homo sapiens
aaaattgatatta

SEQ ID NO: 5071450 - DNA, 19 bp, Homo sapiens
aaaattgatattatattaa

SEQ ID NO: 5071451 - DNA, 23 bp, Homo sapiens
aaaattgatattatattaaacat

SEQ ID NO: 5071452 - DNA, 21 bp, Homo sapiens
aaaattgatgggatttggtca

SEQ ID NO: 5071453 - DNA, 17 bp, Homo sapiens
aaaattgattgtcaaat

SEQ ID NO: 5071454 - DNA, 19 bp, Homo sapiens
aaaattgatttttctcttc

SEQ ID NO: 5071455 - DNA, 10 bp, Homo sapiens
aaaattgcac

SEQ ID NO: 5071456 - DNA, 12 bp, Homo sapiens
aaaattgcacaa

SEQ ID NO: 5071457 - DNA, 22 bp, Homo sapiens
aaaattgcacaatttgagcaat

SEQ ID NO: 5071458 - DNA, 13 bp, Homo sapiens
aaaattgcatgaa

SEQ ID NO: 5071459 - DNA, 16 bp, Homo sapiens
aaaattgcatgaaact

SEQ ID NO: 5071460 - DNA, 19 bp, Homo sapiens
aaaattgccaagtgcctat

SEQ ID NO: 5071461 - DNA, 12 bp, Homo sapiens
aaaattgccata

SEQ ID NO: 5071462 - DNA, 21 bp, Homo sapiens
aaaattgccatattgcacatg

SEQ ID NO: 5071463 - DNA, 22 bp, Homo sapiens
aaaattgcctttctgtgtttat

SEQ ID NO: 5071464 - DNA, 13 bp, Homo sapiens
aaaattgctatgt

SEQ ID NO: 5071465 - DNA, 20 bp, Homo sapiens
aaaattgctatgttactatt

SEQ ID NO: 5071466 - DNA, 21 bp, Homo sapiens
aaaattgctctgtgtatatct

SEQ ID NO: 5071467 - DNA, 23 bp, Homo sapiens
aaaattgctctgtgtatatctct

SEQ ID NO: 5071468 - DNA, 17 bp, Homo sapiens
aaaattggggattctta

SEQ ID NO: 5071469 - DNA, 17 bp, Homo sapiens
aaaattggtatatttga

SEQ ID NO: 5071470 - DNA, 21 bp, Homo sapiens
aaaattggtatatttgaaata

SEQ ID NO: 5071471 - DNA, 17 bp, Homo sapiens
aaaattgtaagccagag

SEQ ID NO: 5071472 - DNA, 20 bp, Homo sapiens
aaaattgtaagccagagtca

SEQ ID NO: 5071473 - DNA, 12 bp, Homo sapiens
aaaattgtataa

SEQ ID NO: 5071474 - DNA, 16 bp, Homo sapiens
aaaattgtataaatta

SEQ ID NO: 5071475 - DNA, 16 bp, Homo sapiens
aaaattgtatagagat

SEQ ID NO: 5071476 - DNA, 21 bp, Homo sapiens
aaaattgtatagagatatgca

SEQ ID NO: 5071477 - DNA, 17 bp, Homo sapiens
aaaattgtcaaatgtca

SEQ ID NO: 5071478 - DNA, 16 bp, Homo sapiens
aaaaggtactggtgag

SEQ ID NO: 5071479 - DNA, 15 bp, Homo sapiens
aaaaggtattaaatt

SEQ ID NO: 5071480 - DNA, 22 bp, Homo sapiens
aaaaggtatttattgagcacct

SEQ ID NO: 5071481 - DNA, 16 bp, Homo sapiens
aaaaggtcctgtaaga

SEQ ID NO: 5071482 - DNA, 15 bp, Homo sapiens
aaaaggtgagctcag

SEQ ID NO: 5071483 - DNA, 21 bp, Homo sapiens
aaaaggtgataggtaaatttt

SEQ ID NO: 5071484 - DNA, 19 bp, Homo sapiens
aaaaggttcttactgcttg

SEQ ID NO: 5071485 - DNA, 20 bp, Homo sapiens
aaaaggttcttcatcccttt

SEQ ID NO: 5071486 - DNA, 16 bp, Homo sapiens
aaaaggttgccaaatt

SEQ ID NO: 5071487 - DNA, 14 bp, Homo sapiens
aaaaggtttatgaa

SEQ ID NO: 5071488 - DNA, 19 bp, Homo sapiens
aaaaggttttattttgtaa

SEQ ID NO: 5071489 - DNA, 13 bp, Homo sapiens
aaaagtaaaaaat

SEQ ID NO: 5071490 - DNA, 11 bp, Homo sapiens
aaaagtaaaca

SEQ ID NO: 5071491 - DNA, 16 bp, Homo sapiens
aaaagtaaactactgt

SEQ ID NO: 5071492 - DNA, 13 bp, Homo sapiens
aaaagtaaagatg

SEQ ID NO: 5071493 - DNA, 20 bp, Homo sapiens
aaaagtaactggttgtcacc

SEQ ID NO: 5071494 - DNA, 22 bp, Homo sapiens
aaaagtaagtaccactcaggcc

SEQ ID NO: 5071495 - DNA, 14 bp, Homo sapiens
aaaagtaataaaga

SEQ ID NO: 5071496 - DNA, 17 bp, Homo sapiens
aaaagtaataaagagaa

SEQ ID NO: 5071497 - DNA, 22 bp, Homo sapiens
aaaagtaatgacttagaaactg

SEQ ID NO: 5071498 - DNA, 16 bp, Homo sapiens
aaaagtaatgcctctg

SEQ ID NO: 5071499 - DNA, 22 bp, Homo sapiens
aaaagtaatgtatatctgtaat

SEQ ID NO: 5071500 - DNA, 17 bp, Homo sapiens
aaaagtaattaaaaaga

SEQ ID NO: 5071501 - DNA, 13 bp, Homo sapiens
aaaagtaattttg

SEQ ID NO: 5071502 - DNA, 15 bp, Homo sapiens
aaaagtaattttgtc

SEQ ID NO: 5071503 - DNA, 21 bp, Homo sapiens
aaaagtaattttgtcacatta

SEQ ID NO: 5071504 - DNA, 18 bp, Homo sapiens
aaaagtacaattcattgt

SEQ ID NO: 5071505 - DNA, 13 bp, Homo sapiens
aaaagtacagttt

SEQ ID NO: 5071506 - DNA, 20 bp, Homo sapiens
aaaagtactaatagaacttg

SEQ ID NO: 5071507 - DNA, 13 bp, Homo sapiens
aaaagtagaaaaa

SEQ ID NO: 5071508 - DNA, 18 bp, Homo sapiens
aaaagtagaattatatct

SEQ ID NO: 5071509 - DNA, 22 bp, Homo sapiens
aaaagtagcaaatgtttactgt

SEQ ID NO: 5071510 - DNA, 20 bp, Homo sapiens
aaaagtagcaaccttcattt

SEQ ID NO: 5071511 - DNA, 14 bp, Homo sapiens
aaaagtaggctgcc

SEQ ID NO: 5071512 - DNA, 16 bp, Homo sapiens
aaaagtataaaatagt

SEQ ID NO: 5071513 - DNA, 22 bp, Homo sapiens
aaaagtatagatacaaaacctt

SEQ ID NO: 5071514 - DNA, 14 bp, Homo sapiens
aaaagtatatgtta

SEQ ID NO: 5071515 - DNA, 22 bp, Homo sapiens
aaaagtatattcaaaaattata

SEQ ID NO: 5071516 - DNA, 15 bp, Homo sapiens
aaaagtatctttaac

SEQ ID NO: 5071517 - DNA, 20 bp, Homo sapiens
aaaagtattcgttacatctt

SEQ ID NO: 5071518 - DNA, 18 bp, Homo sapiens
aaaagtattctcaaagat

SEQ ID NO: 5071519 - DNA, 16 bp, Homo sapiens
aaaagtattgccaaac

SEQ ID NO: 5071520 - DNA, 14 bp, Homo sapiens
aaaagtatttaatt

SEQ ID NO: 5071521 - DNA, 16 bp, Homo sapiens
aaaagtatttaatttg

SEQ ID NO: 5071522 - DNA, 11 bp, Homo sapiens
aaaagtatttt

SEQ ID NO: 5071523 - DNA, 14 bp, Homo sapiens
aaaagtattttcct

SEQ ID NO: 5071524 - DNA, 13 bp, Homo sapiens
aaaagtattttga

SEQ ID NO: 5071525 - DNA, 18 bp, Homo sapiens
aaaagtattttgaagttt

SEQ ID NO: 5071526 - DNA, 22 bp, Homo sapiens
aaaagtattttgaagtttacat

SEQ ID NO: 5071527 - DNA, 12 bp, Homo sapiens
aaaagtcacaca

SEQ ID NO: 5071528 - DNA, 14 bp, Homo sapiens
aaaagtcacacaga

SEQ ID NO: 5071529 - DNA, 19 bp, Homo sapiens
aaaagtcacacagacacac

SEQ ID NO: 5071530 - DNA, 16 bp, Homo sapiens
aaaagtcaccattctg

SEQ ID NO: 5071531 - DNA, 19 bp, Homo sapiens
aaaagtcaccattctgcat

SEQ ID NO: 5071532 - DNA, 20 bp, Homo sapiens
aaaagtcactcttttgggat

SEQ ID NO: 5071533 - DNA, 15 bp, Homo sapiens
aaaagtcacttacta

SEQ ID NO: 5071534 - DNA, 16 bp, Homo sapiens
aaaagtcagagacaga

SEQ ID NO: 5071535 - DNA, 17 bp, Homo sapiens
aaaagtcagagctcagg

SEQ ID NO: 5071536 - DNA, 24 bp, Homo sapiens
aaaagtcagcgtgacaatatactt

SEQ ID NO: 5071537 - DNA, 22 bp, Homo sapiens
aaaagtcataaaatgtatcttc

SEQ ID NO: 5071538 - DNA, 15 bp, Homo sapiens
aaaagtcattcaaga

SEQ ID NO: 5071539 - DNA, 13 bp, Homo sapiens
aaaagtccaattt

SEQ ID NO: 5071540 - DNA, 16 bp, Homo sapiens
aaaagtccacttttaa

SEQ ID NO: 5071541 - DNA, 17 bp, Homo sapiens
aaaagtcctgtcagttc

SEQ ID NO: 5071542 - DNA, 17 bp, Homo sapiens
aaaagtccttagaatga

SEQ ID NO: 5071543 - DNA, 14 bp, Homo sapiens
aaaagtccttcagt

SEQ ID NO: 5071544 - DNA, 15 bp, Homo sapiens
aaaagtctacctgtg

SEQ ID NO: 5071545 - DNA, 18 bp, Homo sapiens
aaaagtctacctgtgttt

SEQ ID NO: 5071546 - DNA, 21 bp, Homo sapiens
aaaagtctacctgtgtttttt

SEQ ID NO: 5071547 - DNA, 14 bp, Homo sapiens
aaaagtctattttt

SEQ ID NO: 5071548 - DNA, 19 bp, Homo sapiens
aaaagtctcaatgttccat

SEQ ID NO: 5071549 - DNA, 17 bp, Homo sapiens
aaaagtctccaaaacat

SEQ ID NO: 5071550 - DNA, 19 bp, Homo sapiens
aaaagtctctatttaaatt

SEQ ID NO: 5071551 - DNA, 21 bp, Homo sapiens
aaaagtctctatttaaattct

SEQ ID NO: 5071552 - DNA, 23 bp, Homo sapiens
aaaagtctctatttaaattcttt

SEQ ID NO: 5071553 - DNA, 22 bp, Homo sapiens
aaaagtctgattggttttaatt

SEQ ID NO: 5071554 - DNA, 14 bp, Homo sapiens
aaaagtctgcatta

SEQ ID NO: 5071555 - DNA, 18 bp, Homo sapiens
aaaagtctgtctttcctg

SEQ ID NO: 5071556 - DNA, 19 bp, Homo sapiens
aaaagtcttaacaacagct

SEQ ID NO: 5071557 - DNA, 23 bp, Homo sapiens
aaaagtcttcactctctgaagat

SEQ ID NO: 5071558 - DNA, 16 bp, Homo sapiens
aaaagtgaaaaaaaga

SEQ ID NO: 5071559 - DNA, 13 bp, Homo sapiens
aaaagtgaaataa

SEQ ID NO: 5071560 - DNA, 13 bp, Homo sapiens
aaaagtgaacttt

SEQ ID NO: 5071561 - DNA, 14 bp, Homo sapiens
aaaagtgaactttt

SEQ ID NO: 5071562 - DNA, 18 bp, Homo sapiens
aaaagtgaacttttgtaa

SEQ ID NO: 5071563 - DNA, 21 bp, Homo sapiens
aaaagtgaacttttgtaattt

SEQ ID NO: 5071564 - DNA, 19 bp, Homo sapiens
aaaagtgagagtagtcaga

SEQ ID NO: 5071565 - DNA, 23 bp, Homo sapiens
aaaagtgatcaataaaatgtgat

SEQ ID NO: 5071566 - DNA, 22 bp, Homo sapiens
aaaagtgatcttaggtttgttt

SEQ ID NO: 5071567 - DNA, 20 bp, Homo sapiens
aaaagtgattatctctttga

SEQ ID NO: 5071568 - DNA, 21 bp, Homo sapiens
aaaagtgattgtgaaggattt

SEQ ID NO: 5071569 - DNA, 15 bp, Homo sapiens
aaaagtgcaagtcca

SEQ ID NO: 5071570 - DNA, 14 bp, Homo sapiens
aaaagtgcaatgcg

SEQ ID NO: 5071571 - DNA, 21 bp, Homo sapiens
aaaagtgcaatgcgtgttgta

SEQ ID NO: 5071572 - DNA, 22 bp, Homo sapiens
aaaagtgcattcaaccttacca

SEQ ID NO: 5071573 - DNA, 18 bp, Homo sapiens
aaaagtgcctcaagagga

SEQ ID NO: 5071574 - DNA, 21 bp, Homo sapiens
aaaagtgctacttgagagtgg

SEQ ID NO: 5071575 - DNA, 18 bp, Homo sapiens
aaaagtgcttcattcttt

SEQ ID NO: 5071576 - DNA, 23 bp, Homo sapiens
aaaagtggagttgttttaacaga

SEQ ID NO: 5071577 - DNA, 19 bp, Homo sapiens
aaaagtggcaagaccaaaa

SEQ ID NO: 5071578 - DNA, 16 bp, Homo sapiens
aaaagtggcctctttg

SEQ ID NO: 5071579 - DNA, 17 bp, Homo sapiens
aaaagtggcctctttgt

SEQ ID NO: 5071580 - DNA, 21 bp, Homo sapiens
aaaagtggctggaagagtccc

SEQ ID NO: 5071581 - DNA, 15 bp, Homo sapiens
aaaagtggggcagag

SEQ ID NO: 5071582 - DNA, 13 bp, Homo sapiens
aaaagtgtacaag

SEQ ID NO: 5071583 - DNA, 11 bp, Homo sapiens
aaaagtgtcct

SEQ ID NO: 5071584 - DNA, 16 bp, Homo sapiens
aaaagtgtcttgttca

SEQ ID NO: 5071585 - DNA, 19 bp, Homo sapiens
aaaagtgtctttgtttaaa

SEQ ID NO: 5071586 - DNA, 16 bp, Homo sapiens
aaaagtgtttttacat

SEQ ID NO: 5071587 - DNA, 14 bp, Homo sapiens
aaaagttaaaaagt

SEQ ID NO: 5071588 - DNA, 15 bp, Homo sapiens
aaaagttaaatgtgt

SEQ ID NO: 5071589 - DNA, 14 bp, Homo sapiens
aaaagttaacatta

SEQ ID NO: 5071590 - DNA, 16 bp, Homo sapiens
aaaagttaatgcttaa

SEQ ID NO: 5071591 - DNA, 18 bp, Homo sapiens
aaaagttacatgtttgca

SEQ ID NO: 5071592 - DNA, 19 bp, Homo sapiens
aaaagttacatgtttgcac

SEQ ID NO: 5071593 - DNA, 18 bp, Homo sapiens
aaaagttactaatatatc

SEQ ID NO: 5071594 - DNA, 21 bp, Homo sapiens
aaaagttactaatatatctgt

SEQ ID NO: 5071595 - DNA, 23 bp, Homo sapiens
aaaagttactaatatatctgtaa

SEQ ID NO: 5071596 - DNA, 13 bp, Homo sapiens
aaaagttataaga

SEQ ID NO: 5071597 - DNA, 16 bp, Homo sapiens
aaaagttataataact

SEQ ID NO: 5071598 - DNA, 18 bp, Homo sapiens
aaaagttataataactga

SEQ ID NO: 5071599 - DNA, 15 bp, Homo sapiens
aaaagttatatctaa

SEQ ID NO: 5071600 - DNA, 12 bp, Homo sapiens
aaaagttattaa

SEQ ID NO: 5071601 - DNA, 22 bp, Homo sapiens
aaaagttattacctttacatat

SEQ ID NO: 5071602 - DNA, 13 bp, Homo sapiens
aaaagttatttat

SEQ ID NO: 5071603 - DNA, 15 bp, Homo sapiens
aaaagttattttgta

SEQ ID NO: 5071604 - DNA, 22 bp, Homo sapiens
aaaagttcataacagtgccatt

SEQ ID NO: 5071605 - DNA, 22 bp, Homo sapiens
aaaagttcatataatttaaaga

SEQ ID NO: 5071606 - DNA, 17 bp, Homo sapiens
aaaagttccctgaaaca

SEQ ID NO: 5071607 - DNA, 14 bp, Homo sapiens
aaaagttgaatatt

SEQ ID NO: 5071608 - DNA, 18 bp, Homo sapiens
aaaagttgaccaatgaaa

SEQ ID NO: 5071609 - DNA, 14 bp, Homo sapiens
aaaagttgagattt

SEQ ID NO: 5071610 - DNA, 14 bp, Homo sapiens
aaaagttgcacatt

SEQ ID NO: 5071611 - DNA, 14 bp, Homo sapiens
aaaagttgcagctg

SEQ ID NO: 5071612 - DNA, 15 bp, Homo sapiens
aaaagttgcagctgt

SEQ ID NO: 5071613 - DNA, 18 bp, Homo sapiens
aaaagttgcagctgtttt

SEQ ID NO: 5071614 - DNA, 21 bp, Homo sapiens
aaaagttggaaggatctgctg

SEQ ID NO: 5071615 - DNA, 22 bp, Homo sapiens
aaaagttggaaggatctgctga

SEQ ID NO: 5071616 - DNA, 16 bp, Homo sapiens
aaaagttggactaaat

SEQ ID NO: 5071617 - DNA, 20 bp, Homo sapiens
aaaagttggactaaatgcct

SEQ ID NO: 5071618 - DNA, 23 bp, Homo sapiens
aaaagttggactaaatgcctagt

SEQ ID NO: 5071619 - DNA, 16 bp, Homo sapiens
aaaagttggtatttta

SEQ ID NO: 5071620 - DNA, 16 bp, Homo sapiens
aaaagttgtatgatct

SEQ ID NO: 5071621 - DNA, 18 bp, Homo sapiens
aaaagttgtatgatctgt

SEQ ID NO: 5071622 - DNA, 11 bp, Homo sapiens
aaaagttgttt

SEQ ID NO: 5071623 - DNA, 18 bp, Homo sapiens
aaaagttgtttataaaaa

SEQ ID NO: 5071624 - DNA, 18 bp, Homo sapiens
aaaagtttaaagaagagt

SEQ ID NO: 5071625 - DNA, 17 bp, Homo sapiens
aaaagtttacaacataa

SEQ ID NO: 5071626 - DNA, 19 bp, Homo sapiens
aaaagtttacaacttgatt

SEQ ID NO: 5071627 - DNA, 14 bp, Homo sapiens
aaaagtttatcttt

SEQ ID NO: 5071628 - DNA, 17 bp, Homo sapiens
aaaagtttattgtttga

SEQ ID NO: 5071629 - DNA, 18 bp, Homo sapiens
aaaagtttcaatgtgatt

SEQ ID NO: 5071630 - DNA, 19 bp, Homo sapiens
aaaagtttcacgtcttggt

SEQ ID NO: 5071631 - DNA, 23 bp, Homo sapiens
aaaagtttgaaaagcaatattgt

SEQ ID NO: 5071632 - DNA, 17 bp, Homo sapiens
aaaagtttgccagaagt

SEQ ID NO: 5071633 - DNA, 12 bp, Homo sapiens
aaaagtttgtcc

SEQ ID NO: 5071634 - DNA, 16 bp, Homo sapiens
aaaagtttgttacttt

SEQ ID NO: 5071635 - DNA, 17 bp, Homo sapiens
aaaagtttgttactttg

SEQ ID NO: 5071636 - DNA, 19 bp, Homo sapiens
aaaagtttgttactttgaa

SEQ ID NO: 5071637 - DNA, 14 bp, Homo sapiens
aaaagtttgtttta

SEQ ID NO: 5071638 - DNA, 15 bp, Homo sapiens
aaaagttttgttctt

SEQ ID NO: 5071639 - DNA, 16 bp, Homo sapiens
aaaagtttttgtttgg

SEQ ID NO: 5071640 - DNA, 22 bp, Homo sapiens
aaaagttttttttttgtttgtt

SEQ ID NO: 5071641 - DNA, 15 bp, Homo sapiens
aaaataaaaaaaaga

SEQ ID NO: 5071642 - DNA, 18 bp, Homo sapiens
aaaataaaaaaatacagt

SEQ ID NO: 5071643 - DNA, 15 bp, Homo sapiens
aaaataaaaaacact

SEQ ID NO: 5071644 - DNA, 16 bp, Homo sapiens
aaaataaaaaagatcc

SEQ ID NO: 5071645 - DNA, 20 bp, Homo sapiens
aaaataaaaaatctgaagag

SEQ ID NO: 5071646 - DNA, 14 bp, Homo sapiens
aaaataaaaaccag

SEQ ID NO: 5071647 - DNA, 17 bp, Homo sapiens
aaaataaaaaccagaat

SEQ ID NO: 5071648 - DNA, 20 bp, Homo sapiens
aaaataaaaaccagaatcat

SEQ ID NO: 5071649 - DNA, 17 bp, Homo sapiens
aaaataaaaagtgacac

SEQ ID NO: 5071650 - DNA, 21 bp, Homo sapiens
aaaataaaaagtgacacagca

SEQ ID NO: 5071651 - DNA, 18 bp, Homo sapiens
aaaataaaaataaattca

SEQ ID NO: 5071652 - DNA, 14 bp, Homo sapiens
aaaataaaaattga

SEQ ID NO: 5071653 - DNA, 13 bp, Homo sapiens
aaaataaaacaag

SEQ ID NO: 5071654 - DNA, 19 bp, Homo sapiens
aaaataaaacaagccttaa

SEQ ID NO: 5071655 - DNA, 15 bp, Homo sapiens
aaaataaaacacatt

SEQ ID NO: 5071656 - DNA, 12 bp, Homo sapiens
aaaataaaacat

SEQ ID NO: 5071657 - DNA, 23 bp, Homo sapiens
aaaattgtgatgttttgttcaaa

SEQ ID NO: 5071658 - DNA, 14 bp, Homo sapiens
aaaattgtgcataa

SEQ ID NO: 5071659 - DNA, 13 bp, Homo sapiens
aaaattgtgttta

SEQ ID NO: 5071660 - DNA, 20 bp, Homo sapiens
aaaattgtgtttagatttta

SEQ ID NO: 5071661 - DNA, 13 bp, Homo sapiens
aaaattgttattt

SEQ ID NO: 5071662 - DNA, 16 bp, Homo sapiens
aaaattgtttagtgat

SEQ ID NO: 5071663 - DNA, 14 bp, Homo sapiens
aaaattgtttccaa

SEQ ID NO: 5071664 - DNA, 12 bp, Homo sapiens
aaaattgttttc

SEQ ID NO: 5071665 - DNA, 19 bp, Homo sapiens
aaaattgttttcacttgta

SEQ ID NO: 5071666 - DNA, 20 bp, Homo sapiens
aaaatttaaaaaactcctgt

SEQ ID NO: 5071667 - DNA, 18 bp, Homo sapiens
aaaatttaaaaagcccaa

SEQ ID NO: 5071668 - DNA, 13 bp, Homo sapiens
aaaatttaaaatt

SEQ ID NO: 5071669 - DNA, 14 bp, Homo sapiens
aaaatttaaaatta

SEQ ID NO: 5071670 - DNA, 16 bp, Homo sapiens
aaaatttaagcattgt

SEQ ID NO: 5071671 - DNA, 19 bp, Homo sapiens
aaaatttaagtatcttttt

SEQ ID NO: 5071672 - DNA, 20 bp, Homo sapiens
aaaatttaattgtgtaactg

SEQ ID NO: 5071673 - DNA, 15 bp, Homo sapiens
aaaatttacacatct

SEQ ID NO: 5071674 - DNA, 14 bp, Homo sapiens
aaaatttacattta

SEQ ID NO: 5071675 - DNA, 19 bp, Homo sapiens
aaaatttacatttaataca

SEQ ID NO: 5071676 - DNA, 15 bp, Homo sapiens
aaaatttactaatct

SEQ ID NO: 5071677 - DNA, 19 bp, Homo sapiens
aaaatttagaaatataatt

SEQ ID NO: 5071678 - DNA, 13 bp, Homo sapiens
aaaatttagaaca

SEQ ID NO: 5071679 - DNA, 21 bp, Homo sapiens
aaaatttagaagaaaagttat

SEQ ID NO: 5071680 - DNA, 18 bp, Homo sapiens
aaaatttagccctttaaa

SEQ ID NO: 5071681 - DNA, 17 bp, Homo sapiens
aaaatttagcttatgct

SEQ ID NO: 5071682 - DNA, 10 bp, Homo sapiens
aaaatttata

SEQ ID NO: 5071683 - DNA, 12 bp, Homo sapiens
aaaatttataag

SEQ ID NO: 5071684 - DNA, 13 bp, Homo sapiens
aaaatttatattt

SEQ ID NO: 5071685 - DNA, 12 bp, Homo sapiens
aaaatttatctt

SEQ ID NO: 5071686 - DNA, 23 bp, Homo sapiens
aaaatttatcttaagttctatga

SEQ ID NO: 5071687 - DNA, 24 bp, Homo sapiens
aaaatttatcttaagttctatgaa

SEQ ID NO: 5071688 - DNA, 23 bp, Homo sapiens
aaaatttatgtcattttcagatc

SEQ ID NO: 5071689 - DNA, 23 bp, Homo sapiens
aaaatttattatatatttacaga

SEQ ID NO: 5071690 - DNA, 13 bp, Homo sapiens
aaaatttattatt

SEQ ID NO: 5071691 - DNA, 13 bp, Homo sapiens
aaaatttatttca

SEQ ID NO: 5071692 - DNA, 16 bp, Homo sapiens
aaaatttcaaaagtga

SEQ ID NO: 5071693 - DNA, 18 bp, Homo sapiens
aaaatttcaaaagtgatc

SEQ ID NO: 5071694 - DNA, 20 bp, Homo sapiens
aaaatttcacattaatattt

SEQ ID NO: 5071695 - DNA, 20 bp, Homo sapiens
aaaatttcaggattaactaa

SEQ ID NO: 5071696 - DNA, 16 bp, Homo sapiens
aaaatttctggcaaat

SEQ ID NO: 5071697 - DNA, 23 bp, Homo sapiens
aaaatttctggcaaatattttgt

SEQ ID NO: 5071698 - DNA, 16 bp, Homo sapiens
aaaatttgaaacattg

SEQ ID NO: 5071699 - DNA, 13 bp, Homo sapiens
aaaatttgaaact

SEQ ID NO: 5071700 - DNA, 18 bp, Homo sapiens
aaaatttgaaatttagct

SEQ ID NO: 5071701 - DNA, 15 bp, Homo sapiens
aaaatttgaaccaaa

SEQ ID NO: 5071702 - DNA, 19 bp, Homo sapiens
aaaatttgaaccaaaacat

SEQ ID NO: 5071703 - DNA, 23 bp, Homo sapiens
aaaatttgaaccaaaacattccg

SEQ ID NO: 5071704 - DNA, 19 bp, Homo sapiens
aaaatttgactaattttac

SEQ ID NO: 5071705 - DNA, 15 bp, Homo sapiens
aaaatttgctttaat

SEQ ID NO: 5071706 - DNA, 15 bp, Homo sapiens
aaaatttgtagaatt

SEQ ID NO: 5071707 - DNA, 13 bp, Homo sapiens
aaaatttgtattt

SEQ ID NO: 5071708 - DNA, 22 bp, Homo sapiens
aaaatttgtctgaaacatttca

SEQ ID NO: 5071709 - DNA, 24 bp, Homo sapiens
aaaatttgtcttaaaaatttatac

SEQ ID NO: 5071710 - DNA, 16 bp, Homo sapiens
aaaatttgtgtaaatt

SEQ ID NO: 5071711 - DNA, 20 bp, Homo sapiens
aaaatttgtgtaaatttgta

SEQ ID NO: 5071712 - DNA, 22 bp, Homo sapiens
aaaatttgtgtaaatttgtatc

SEQ ID NO: 5071713 - DNA, 19 bp, Homo sapiens
aaaatttgttcttgtattt

SEQ ID NO: 5071714 - DNA, 13 bp, Homo sapiens
aaaatttgttgca

SEQ ID NO: 5071715 - DNA, 14 bp, Homo sapiens
aaaatttgttgcat

SEQ ID NO: 5071716 - DNA, 16 bp, Homo sapiens
aaaatttgttttgacg

SEQ ID NO: 5071717 - DNA, 15 bp, Homo sapiens
aaaattttaaaaagt

SEQ ID NO: 5071718 - DNA, 17 bp, Homo sapiens
aaaattttaaaaatcta

SEQ ID NO: 5071719 - DNA, 13 bp, Homo sapiens
aaaattttaagaa

SEQ ID NO: 5071720 - DNA, 12 bp, Homo sapiens
aaaattttaagc

SEQ ID NO: 5071721 - DNA, 12 bp, Homo sapiens
aaaattttactt

SEQ ID NO: 5071722 - DNA, 19 bp, Homo sapiens
aaaattttagctcttccca

SEQ ID NO: 5071723 - DNA, 21 bp, Homo sapiens
aaaattttaggcactcttaaa

SEQ ID NO: 5071724 - DNA, 23 bp, Homo sapiens
aaaattttataagcaaatttcaa

SEQ ID NO: 5071725 - DNA, 14 bp, Homo sapiens
aaaattttatgaca

SEQ ID NO: 5071726 - DNA, 13 bp, Homo sapiens
aaaattttattcc

SEQ ID NO: 5071727 - DNA, 18 bp, Homo sapiens
aaaattttattttaaatt

SEQ ID NO: 5071728 - DNA, 18 bp, Homo sapiens
aaaattttcattctgaat

SEQ ID NO: 5071729 - DNA, 20 bp, Homo sapiens
aaaattttcattctgaatct

SEQ ID NO: 5071730 - DNA, 17 bp, Homo sapiens
aaaattttcttctttaa

SEQ ID NO: 5071731 - DNA, 12 bp, Homo sapiens
aaaattttgcag

SEQ ID NO: 5071732 - DNA, 18 bp, Homo sapiens
aaaattttgcatttcatg

SEQ ID NO: 5071733 - DNA, 17 bp, Homo sapiens
aaaattttgctaccaaa

SEQ ID NO: 5071734 - DNA, 23 bp, Homo sapiens
aaaattttgctccccagtgaagg

SEQ ID NO: 5071735 - DNA, 17 bp, Homo sapiens
aaaattttggaatattt

SEQ ID NO: 5071736 - DNA, 13 bp, Homo sapiens
aaaattttgtaat

SEQ ID NO: 5071737 - DNA, 15 bp, Homo sapiens
aaaattttgtaattt

SEQ ID NO: 5071738 - DNA, 17 bp, Homo sapiens
aaaattttgtaattttc

SEQ ID NO: 5071739 - DNA, 14 bp, Homo sapiens
aaaattttgtatgt

SEQ ID NO: 5071740 - DNA, 21 bp, Homo sapiens
aaaattttgtatgttaaagag

SEQ ID NO: 5071741 - DNA, 19 bp, Homo sapiens
aaaattttgtcccatctct

SEQ ID NO: 5071742 - DNA, 16 bp, Homo sapiens
aaaatttttaatcttt

SEQ ID NO: 5071743 - DNA, 19 bp, Homo sapiens
aaaatttttaatctttaat

SEQ ID NO: 5071744 - DNA, 13 bp, Homo sapiens
aaaatttttatgt

SEQ ID NO: 5071745 - DNA, 12 bp, Homo sapiens
aaaatttttgtc

SEQ ID NO: 5071746 - DNA, 13 bp, Homo sapiens
aaaatttttgtct

SEQ ID NO: 5071747 - DNA, 17 bp, Homo sapiens
aaaatttttgtctttca

SEQ ID NO: 5071748 - DNA, 19 bp, Homo sapiens
aaaattttttctctaggaa

SEQ ID NO: 5071749 - DNA, 16 bp, Homo sapiens
aaaatttttttagaaa

SEQ ID NO: 5071750 - DNA, 13 bp, Homo sapiens
aaaatttttttct

SEQ ID NO: 5071751 - DNA, 15 bp, Homo sapiens
aaaattttttttcat

SEQ ID NO: 5071752 - DNA, 18 bp, Homo sapiens
aaaattttttttcatgtt

SEQ ID NO: 5071753 - DNA, 21 bp, Homo sapiens
aaacaaaaaaatttaaaaaga

SEQ ID NO: 5071754 - DNA, 18 bp, Homo sapiens
aaacaaaaaatgtgctgt

SEQ ID NO: 5071755 - DNA, 13 bp, Homo sapiens
aaacaaaaacact

SEQ ID NO: 5071756 - DNA, 15 bp, Homo sapiens
aaacaaaaactttcc

SEQ ID NO: 5071757 - DNA, 21 bp, Homo sapiens
aaacaaaaactttccatgaca

SEQ ID NO: 5071758 - DNA, 23 bp, Homo sapiens
aaacaaaaactttccatgacagt

SEQ ID NO: 5071759 - DNA, 14 bp, Homo sapiens
aaacaaaaagacag

SEQ ID NO: 5071760 - DNA, 14 bp, Homo sapiens
aaacaaaaagcagg

SEQ ID NO: 5071761 - DNA, 19 bp, Homo sapiens
aaacaaaaattaaaatcct

SEQ ID NO: 5071762 - DNA, 11 bp, Homo sapiens
aaacaaaacaa

SEQ ID NO: 5071763 - DNA, 14 bp, Homo sapiens
aaacaaaacaaaac

SEQ ID NO: 5071764 - DNA, 13 bp, Homo sapiens
aaacaaaacaaac

SEQ ID NO: 5071765 - DNA, 16 bp, Homo sapiens
aaacaaaacaaacttc

SEQ ID NO: 5071766 - DNA, 16 bp, Homo sapiens
aaacaaaaccaagcct

SEQ ID NO: 5071767 - DNA, 20 bp, Homo sapiens
aaacaaaactatacttgaac

SEQ ID NO: 5071768 - DNA, 15 bp, Homo sapiens
aaacaaaactcttaa

SEQ ID NO: 5071769 - DNA, 9 bp, Homo sapiens
aaacaaaag

SEQ ID NO: 5071770 - DNA, 16 bp, Homo sapiens
aaacaaaagagagaat

SEQ ID NO: 5071771 - DNA, 12 bp, Homo sapiens
aaacaaaagcac

SEQ ID NO: 5071772 - DNA, 18 bp, Homo sapiens
aaacaaaagggtgtatag

SEQ ID NO: 5071773 - DNA, 21 bp, Homo sapiens
aaacaaaagggtgtatagtgt

SEQ ID NO: 5071774 - DNA, 22 bp, Homo sapiens
aaacaaaatcacagcacccact

SEQ ID NO: 5071775 - DNA, 20 bp, Homo sapiens
aaacaaaatccaaccctgtc

SEQ ID NO: 5071776 - DNA, 16 bp, Homo sapiens
aaacaaaatcctcagg

SEQ ID NO: 5071777 - DNA, 14 bp, Homo sapiens
aaacaaaatctgaa

SEQ ID NO: 5071778 - DNA, 17 bp, Homo sapiens
aaacaaaatctgaactc

SEQ ID NO: 5071779 - DNA, 18 bp, Homo sapiens
aaacaaaatggcttcagt

SEQ ID NO: 5071780 - DNA, 13 bp, Homo sapiens
aaacaaaattgca

SEQ ID NO: 5071781 - DNA, 14 bp, Homo sapiens
aaacaaaatttcta

SEQ ID NO: 5071782 - DNA, 15 bp, Homo sapiens
aaacaaaatttgact

SEQ ID NO: 5071783 - DNA, 20 bp, Homo sapiens
aaacaaaatttgtttgaaat

SEQ ID NO: 5071784 - DNA, 13 bp, Homo sapiens
aaacaaacaaaaa

SEQ ID NO: 5071785 - DNA, 12 bp, Homo sapiens
aaacaaacaaac

SEQ ID NO: 5071786 - DNA, 15 bp, Homo sapiens
aaacaaacacacaca

SEQ ID NO: 5071787 - DNA, 15 bp, Homo sapiens
aaacaaacattgtgt

SEQ ID NO: 5071788 - DNA, 21 bp, Homo sapiens
aaacaaacttccaaacagtgt

SEQ ID NO: 5071789 - DNA, 23 bp, Homo sapiens
aaacaaacttttcaaggcttata

SEQ ID NO: 5071790 - DNA, 13 bp, Homo sapiens
aaacaaagaaatt

SEQ ID NO: 5071791 - DNA, 15 bp, Homo sapiens
aaacaaagacattct

SEQ ID NO: 5071792 - DNA, 18 bp, Homo sapiens
aaacaaagagttcaagaa

SEQ ID NO: 5071793 - DNA, 15 bp, Homo sapiens
aaacaaagcttagca

SEQ ID NO: 5071794 - DNA, 16 bp, Homo sapiens
aaacaaagggtgggca

SEQ ID NO: 5071795 - DNA, 16 bp, Homo sapiens
aaacaaagtgactgtt

SEQ ID NO: 5071796 - DNA, 15 bp, Homo sapiens
aaacaaagtgcaaag

SEQ ID NO: 5071797 - DNA, 16 bp, Homo sapiens
aaacaaagtgcaaagc

SEQ ID NO: 5071798 - DNA, 19 bp, Homo sapiens
aaacaaagtgcaaagctgc

SEQ ID NO: 5071799 - DNA, 15 bp, Homo sapiens
aaacaaagtttcaga

SEQ ID NO: 5071800 - DNA, 19 bp, Homo sapiens
aaacaaagtttcagagtat

SEQ ID NO: 5071801 - DNA, 15 bp, Homo sapiens
aaacaaataatcaca

SEQ ID NO: 5071802 - DNA, 17 bp, Homo sapiens
aaacaaataatttgaac

SEQ ID NO: 5071803 - DNA, 22 bp, Homo sapiens
aaacaaataatttgaactttgg

SEQ ID NO: 5071804 - DNA, 13 bp, Homo sapiens
aaacaaatatact

SEQ ID NO: 5071805 - DNA, 15 bp, Homo sapiens
aaacaaatatactca

SEQ ID NO: 5071806 - DNA, 14 bp, Homo sapiens
aaacaaatatgaaa

SEQ ID NO: 5071807 - DNA, 12 bp, Homo sapiens
aaacaaatatgc

SEQ ID NO: 5071808 - DNA, 17 bp, Homo sapiens
aaacaaatatttcactt

SEQ ID NO: 5071809 - DNA, 19 bp, Homo sapiens
aaacaaatgaattgtattt

SEQ ID NO: 5071810 - DNA, 11 bp, Homo sapiens
aaacaaatgat

SEQ ID NO: 5071811 - DNA, 21 bp, Homo sapiens
aaacaaatggaagagaagaga

SEQ ID NO: 5071812 - DNA, 15 bp, Homo sapiens
aaacaaattccttcc

SEQ ID NO: 5071813 - DNA, 14 bp, Homo sapiens
aaacaacaaaggaa

SEQ ID NO: 5071814 - DNA, 15 bp, Homo sapiens
aaacaacaacaatac

SEQ ID NO: 5071815 - DNA, 13 bp, Homo sapiens
aaacaacagaaac

SEQ ID NO: 5071816 - DNA, 14 bp, Homo sapiens
aaacaacagcaaca

SEQ ID NO: 5071817 - DNA, 19 bp, Homo sapiens
aaacaacagtcttcatttt

SEQ ID NO: 5071818 - DNA, 13 bp, Homo sapiens
aaacaacatcatt

SEQ ID NO: 5071819 - DNA, 18 bp, Homo sapiens
aaacaacatttatatgta

SEQ ID NO: 5071820 - DNA, 21 bp, Homo sapiens
aaacaacattttgagaacaaa

SEQ ID NO: 5071821 - DNA, 22 bp, Homo sapiens
aaacaacattttgagaacaaag

SEQ ID NO: 5071822 - DNA, 15 bp, Homo sapiens
aaacaacctgaatct

SEQ ID NO: 5071823 - DNA, 17 bp, Homo sapiens
aaacaacctgaatcttt

SEQ ID NO: 5071824 - DNA, 13 bp, Homo sapiens
aaacaaccttcag

SEQ ID NO: 5071825 - DNA, 13 bp, Homo sapiens
aaacaactgaaat

SEQ ID NO: 5071826 - DNA, 14 bp, Homo sapiens
aaacaactgccaaa

SEQ ID NO: 5071827 - DNA, 17 bp, Homo sapiens
aaacaactgccaaataa

SEQ ID NO: 5071828 - DNA, 19 bp, Homo sapiens
aaacaacttcaatatccaa

SEQ ID NO: 5071829 - DNA, 15 bp, Homo sapiens
aaacaacttcagaaa

SEQ ID NO: 5071830 - DNA, 14 bp, Homo sapiens
aaacaacttggcat

SEQ ID NO: 5071831 - DNA, 19 bp, Homo sapiens
aaacaacttggcatttcta

SEQ ID NO: 5071832 - DNA, 16 bp, Homo sapiens
aaacaacttgtacttg

SEQ ID NO: 5071833 - DNA, 12 bp, Homo sapiens
aaacaagaaaga

SEQ ID NO: 5071834 - DNA, 15 bp, Homo sapiens
aaacaagaaagtttc

SEQ ID NO: 5071835 - DNA, 15 bp, Homo sapiens
aaacaagaatactga

SEQ ID NO: 5071836 - DNA, 18 bp, Homo sapiens
aaacaagaccacgtttct

SEQ ID NO: 5071837 - DNA, 17 bp, Homo sapiens
aaacaagagaccacttc

SEQ ID NO: 5071838 - DNA, 21 bp, Homo sapiens
aaacaagagaccacttcctta

SEQ ID NO: 5071839 - DNA, 22 bp, Homo sapiens
aaacaagagaccacttccttaa

SEQ ID NO: 5071840 - DNA, 17 bp, Homo sapiens
aaaataaaacatagcaa

SEQ ID NO: 5071841 - DNA, 14 bp, Homo sapiens
aaaataaaacattt

SEQ ID NO: 5071842 - DNA, 22 bp, Homo sapiens
aaaataaaaccaccaaagtcct

SEQ ID NO: 5071843 - DNA, 22 bp, Homo sapiens
aaaataaaacccgttgattact

SEQ ID NO: 5071844 - DNA, 20 bp, Homo sapiens
aaaataaaacttcacattta

SEQ ID NO: 5071845 - DNA, 14 bp, Homo sapiens
aaaataaaactttt

SEQ ID NO: 5071846 - DNA, 17 bp, Homo sapiens
aaaataaaactttttaa

SEQ ID NO: 5071847 - DNA, 15 bp, Homo sapiens
aaaataaaagctatt

SEQ ID NO: 5071848 - DNA, 15 bp, Homo sapiens
aaaataaaaggtcta

SEQ ID NO: 5071849 - DNA, 12 bp, Homo sapiens
aaaataaaagta

SEQ ID NO: 5071850 - DNA, 17 bp, Homo sapiens
aaaataaaatgcattta

SEQ ID NO: 5071851 - DNA, 12 bp, Homo sapiens
aaaataaaatgt

SEQ ID NO: 5071852 - DNA, 16 bp, Homo sapiens
aaaataaaattaagaa

SEQ ID NO: 5071853 - DNA, 16 bp, Homo sapiens
aaaataaaattatggt

SEQ ID NO: 5071854 - DNA, 14 bp, Homo sapiens
aaaataaacaaata

SEQ ID NO: 5071855 - DNA, 22 bp, Homo sapiens
aaaataaacagacaaaaacaag

SEQ ID NO: 5071856 - DNA, 18 bp, Homo sapiens
aaaataaacgaaacattt

SEQ ID NO: 5071857 - DNA, 17 bp, Homo sapiens
aaaataaacgtggattt

SEQ ID NO: 5071858 - DNA, 14 bp, Homo sapiens
aaaataaactataa

SEQ ID NO: 5071859 - DNA, 15 bp, Homo sapiens
aaaataaactgggga

SEQ ID NO: 5071860 - DNA, 13 bp, Homo sapiens
aaaataaactgta

SEQ ID NO: 5071861 - DNA, 13 bp, Homo sapiens
aaaataaacttct

SEQ ID NO: 5071862 - DNA, 16 bp, Homo sapiens
aaaataaagaaaagat

SEQ ID NO: 5071863 - DNA, 12 bp, Homo sapiens
aaaataaagaca

SEQ ID NO: 5071864 - DNA, 22 bp, Homo sapiens
aaaataaagacaaccatattta

SEQ ID NO: 5071865 - DNA, 10 bp, Homo sapiens
aaaataaagc

SEQ ID NO: 5071866 - DNA, 13 bp, Homo sapiens
aaaataaagcaag

SEQ ID NO: 5071867 - DNA, 17 bp, Homo sapiens
aaaataaagcagaagca

SEQ ID NO: 5071868 - DNA, 22 bp, Homo sapiens
aaaataaagcctatttttcaaa

SEQ ID NO: 5071869 - DNA, 11 bp, Homo sapiens
aaaataaagct

SEQ ID NO: 5071870 - DNA, 21 bp, Homo sapiens
aaaataaagctaccatgttaa

SEQ ID NO: 5071871 - DNA, 22 bp, Homo sapiens
aaaataaagctaccattttaca

SEQ ID NO: 5071872 - DNA, 20 bp, Homo sapiens
aaaataaagctactgaattt

SEQ ID NO: 5071873 - DNA, 14 bp, Homo sapiens
aaaataaagctgtg

SEQ ID NO: 5071874 - DNA, 18 bp, Homo sapiens
aaaataaagcttttgcat

SEQ ID NO: 5071875 - DNA, 18 bp, Homo sapiens
aaaataaaggataactct

SEQ ID NO: 5071876 - DNA, 13 bp, Homo sapiens
aaaataaaggctc

SEQ ID NO: 5071877 - DNA, 15 bp, Homo sapiens
aaaataaaggctctg

SEQ ID NO: 5071878 - DNA, 10 bp, Homo sapiens
aaaataaagt

SEQ ID NO: 5071879 - DNA, 17 bp, Homo sapiens
aaaataaagtctgtcat

SEQ ID NO: 5071880 - DNA, 12 bp, Homo sapiens
aaaataaagttg

SEQ ID NO: 5071881 - DNA, 21 bp, Homo sapiens
aaaataaagttgagcttagtt

SEQ ID NO: 5071882 - DNA, 13 bp, Homo sapiens
aaaataaagttgg

SEQ ID NO: 5071883 - DNA, 10 bp, Homo sapiens
aaaataaata

SEQ ID NO: 5071884 - DNA, 17 bp, Homo sapiens
aaaataaataaaagcct

SEQ ID NO: 5071885 - DNA, 12 bp, Homo sapiens
aaaataaataat

SEQ ID NO: 5071886 - DNA, 16 bp, Homo sapiens
aaaataaataatttta

SEQ ID NO: 5071887 - DNA, 22 bp, Homo sapiens
aaaataaatacaagtttgaaca

SEQ ID NO: 5071888 - DNA, 13 bp, Homo sapiens
aaaataaatacca

SEQ ID NO: 5071889 - DNA, 14 bp, Homo sapiens
aaaataaatatact

SEQ ID NO: 5071890 - DNA, 14 bp, Homo sapiens
aaaataaatatatc

SEQ ID NO: 5071891 - DNA, 21 bp, Homo sapiens
aaaataaatattgtctttttg

SEQ ID NO: 5071892 - DNA, 20 bp, Homo sapiens
aaaataaatctatcaaaatt

SEQ ID NO: 5071893 - DNA, 13 bp, Homo sapiens
aaaataaatgaaa

SEQ ID NO: 5071894 - DNA, 17 bp, Homo sapiens
aaaataaatgtcactgc

SEQ ID NO: 5071895 - DNA, 15 bp, Homo sapiens
aaaataaattctctc

SEQ ID NO: 5071896 - DNA, 22 bp, Homo sapiens
aaaataacaactgagatgttaa

SEQ ID NO: 5071897 - DNA, 14 bp, Homo sapiens
aaaataacacacat

SEQ ID NO: 5071898 - DNA, 13 bp, Homo sapiens
aaaataacactgt

SEQ ID NO: 5071899 - DNA, 17 bp, Homo sapiens
aaaataacctaattaat

SEQ ID NO: 5071900 - DNA, 17 bp, Homo sapiens
aaaataactaaaatgta

SEQ ID NO: 5071901 - DNA, 19 bp, Homo sapiens
aaaataactatcaggcaga

SEQ ID NO: 5071902 - DNA, 22 bp, Homo sapiens
aaaataactatcaggcagaaga

SEQ ID NO: 5071903 - DNA, 18 bp, Homo sapiens
aaaataactatgctttag

SEQ ID NO: 5071904 - DNA, 13 bp, Homo sapiens
aaaataactgaac

SEQ ID NO: 5071905 - DNA, 21 bp, Homo sapiens
aaaataactgaaccaaattgc

SEQ ID NO: 5071906 - DNA, 22 bp, Homo sapiens
aaaataactgagatattatttt

SEQ ID NO: 5071907 - DNA, 15 bp, Homo sapiens
aaaataactgtaatt

SEQ ID NO: 5071908 - DNA, 14 bp, Homo sapiens
aaaataacttcatt

SEQ ID NO: 5071909 - DNA, 17 bp, Homo sapiens
aaaataagaaaaatatt

SEQ ID NO: 5071910 - DNA, 14 bp, Homo sapiens
aaaataagaaaaga

SEQ ID NO: 5071911 - DNA, 22 bp, Homo sapiens
aaaataagaaaagatgtagatt

SEQ ID NO: 5071912 - DNA, 16 bp, Homo sapiens
aaaataagaatagaaa

SEQ ID NO: 5071913 - DNA, 13 bp, Homo sapiens
aaaataagccaaa

SEQ ID NO: 5071914 - DNA, 12 bp, Homo sapiens
aaaataagcttt

SEQ ID NO: 5071915 - DNA, 14 bp, Homo sapiens
aaaataagctttat

SEQ ID NO: 5071916 - DNA, 12 bp, Homo sapiens
aaaataagggcc

SEQ ID NO: 5071917 - DNA, 13 bp, Homo sapiens
aaaataagtaaat

SEQ ID NO: 5071918 - DNA, 16 bp, Homo sapiens
aaaataagtaacatat

SEQ ID NO: 5071919 - DNA, 16 bp, Homo sapiens
aaaataagtcaacagt

SEQ ID NO: 5071920 - DNA, 13 bp, Homo sapiens
aaaataagtcatt

SEQ ID NO: 5071921 - DNA, 11 bp, Homo sapiens
aaaataataaa

SEQ ID NO: 5071922 - DNA, 17 bp, Homo sapiens
aaaataataaaagaatc

SEQ ID NO: 5071923 - DNA, 18 bp, Homo sapiens
aaaataataaaagaatca

SEQ ID NO: 5071924 - DNA, 20 bp, Homo sapiens
aaaataataaagtggcattt

SEQ ID NO: 5071925 - DNA, 22 bp, Homo sapiens
aaaataataatttttatattta

SEQ ID NO: 5071926 - DNA, 17 bp, Homo sapiens
aaaataatagccatcct

SEQ ID NO: 5071927 - DNA, 16 bp, Homo sapiens
aaaataatagttttag

SEQ ID NO: 5071928 - DNA, 23 bp, Homo sapiens
aaaataatcaaaagctatttaaa

SEQ ID NO: 5071929 - DNA, 13 bp, Homo sapiens
aaaataatcaaac

SEQ ID NO: 5071930 - DNA, 19 bp, Homo sapiens
aaaataatcaaaccaaaga

SEQ ID NO: 5071931 - DNA, 21 bp, Homo sapiens
aaaataatctatttctatgag

SEQ ID NO: 5071932 - DNA, 23 bp, Homo sapiens
aaaataatctatttctatgagaa

SEQ ID NO: 5071933 - DNA, 14 bp, Homo sapiens
aaaataatgattta

SEQ ID NO: 5071934 - DNA, 14 bp, Homo sapiens
aaaataatgctgca

SEQ ID NO: 5071935 - DNA, 13 bp, Homo sapiens
aaaataatgtctt

SEQ ID NO: 5071936 - DNA, 18 bp, Homo sapiens
aaaataatgtcttgttaa

SEQ ID NO: 5071937 - DNA, 23 bp, Homo sapiens
aaaataatgtcttgttaatattc

SEQ ID NO: 5071938 - DNA, 20 bp, Homo sapiens
aaaataattaaataaatgaa

SEQ ID NO: 5071939 - DNA, 18 bp, Homo sapiens
aaaataattagctatatt

SEQ ID NO: 5071940 - DNA, 20 bp, Homo sapiens
aaaataattatataactgta

SEQ ID NO: 5071941 - DNA, 17 bp, Homo sapiens
aaaataattcatatcta

SEQ ID NO: 5071942 - DNA, 13 bp, Homo sapiens
aaaataattctaa

SEQ ID NO: 5071943 - DNA, 14 bp, Homo sapiens
aaaataatttaact

SEQ ID NO: 5071944 - DNA, 17 bp, Homo sapiens
aaaataatttaactaat

SEQ ID NO: 5071945 - DNA, 12 bp, Homo sapiens
aaaataatttat

SEQ ID NO: 5071946 - DNA, 20 bp, Homo sapiens
aaaataatttattttgctct

SEQ ID NO: 5071947 - DNA, 12 bp, Homo sapiens
aaaataatttta

SEQ ID NO: 5071948 - DNA, 18 bp, Homo sapiens
aaaataattttatgaact

SEQ ID NO: 5071949 - DNA, 14 bp, Homo sapiens
aaaataattttgta

SEQ ID NO: 5071950 - DNA, 17 bp, Homo sapiens
aaaataatttttatatt

SEQ ID NO: 5071951 - DNA, 21 bp, Homo sapiens
aaaataatttttatatttgaa

SEQ ID NO: 5071952 - DNA, 17 bp, Homo sapiens
aaaatacaaaaaaatta

SEQ ID NO: 5071953 - DNA, 14 bp, Homo sapiens
aaaatacaaaaagc

SEQ ID NO: 5071954 - DNA, 18 bp, Homo sapiens
aaaatacaaaaatcagcc

SEQ ID NO: 5071955 - DNA, 13 bp, Homo sapiens
aaaatacaaacaa

SEQ ID NO: 5071956 - DNA, 16 bp, Homo sapiens
aaaatacaactagaga

SEQ ID NO: 5071957 - DNA, 15 bp, Homo sapiens
aaaatacaacttcat

SEQ ID NO: 5071958 - DNA, 15 bp, Homo sapiens
aaaatacaagactgc

SEQ ID NO: 5071959 - DNA, 24 bp, Homo sapiens
aaaatacaattattgtatattgat

SEQ ID NO: 5071960 - DNA, 19 bp, Homo sapiens
aaaatacacgtgtatatga

SEQ ID NO: 5071961 - DNA, 18 bp, Homo sapiens
aaaatacacgtttatctt

SEQ ID NO: 5071962 - DNA, 13 bp, Homo sapiens
aaaatacagtaaa

SEQ ID NO: 5071963 - DNA, 12 bp, Homo sapiens
aaaatacagtat

SEQ ID NO: 5071964 - DNA, 13 bp, Homo sapiens
aaaatacagtatt

SEQ ID NO: 5071965 - DNA, 20 bp, Homo sapiens
aaaatacagtattatttagt

SEQ ID NO: 5071966 - DNA, 15 bp, Homo sapiens
aaaatacagtattct

SEQ ID NO: 5071967 - DNA, 20 bp, Homo sapiens
aaaatacataaaagaatgta

SEQ ID NO: 5071968 - DNA, 15 bp, Homo sapiens
aaaatacatactata

SEQ ID NO: 5071969 - DNA, 10 bp, Homo sapiens
aaaatacatg

SEQ ID NO: 5071970 - DNA, 14 bp, Homo sapiens
aaaatacattgtgt

SEQ ID NO: 5071971 - DNA, 18 bp, Homo sapiens
aaaatacatttaaaactt

SEQ ID NO: 5071972 - DNA, 13 bp, Homo sapiens
aaaatacatttta

SEQ ID NO: 5071973 - DNA, 14 bp, Homo sapiens
aaaatacattttat

SEQ ID NO: 5071974 - DNA, 22 bp, Homo sapiens
aaaataccaaatgcctgttgta

SEQ ID NO: 5071975 - DNA, 13 bp, Homo sapiens
aaaataccaagga

SEQ ID NO: 5071976 - DNA, 14 bp, Homo sapiens
aaaataccaaggaa

SEQ ID NO: 5071977 - DNA, 19 bp, Homo sapiens
aaaataccactgtaattga

SEQ ID NO: 5071978 - DNA, 15 bp, Homo sapiens
aaaataccagagcct

SEQ ID NO: 5071979 - DNA, 22 bp, Homo sapiens
aaaataccagagccttcaagtg

SEQ ID NO: 5071980 - DNA, 16 bp, Homo sapiens
aaaatacctcaggaaa

SEQ ID NO: 5071981 - DNA, 21 bp, Homo sapiens
aaaatacctctaataaacact

SEQ ID NO: 5071982 - DNA, 24 bp, Homo sapiens
aaaataccttctatgtattagtgt

SEQ ID NO: 5071983 - DNA, 15 bp, Homo sapiens
aaaatactatattaa

SEQ ID NO: 5071984 - DNA, 15 bp, Homo sapiens
aaaatactattctga

SEQ ID NO: 5071985 - DNA, 17 bp, Homo sapiens
aaaatactattgcctca

SEQ ID NO: 5071986 - DNA, 17 bp, Homo sapiens
aaaatactatttaagat

SEQ ID NO: 5071987 - DNA, 15 bp, Homo sapiens
aaaatactccaaaga

SEQ ID NO: 5071988 - DNA, 13 bp, Homo sapiens
aaaatactctaat

SEQ ID NO: 5071989 - DNA, 17 bp, Homo sapiens
aaaatactctaattcta

SEQ ID NO: 5071990 - DNA, 23 bp, Homo sapiens
aaaatactctaattctaaccaga

SEQ ID NO: 5071991 - DNA, 22 bp, Homo sapiens
aaaatactctttcaataaatgt

SEQ ID NO: 5071992 - DNA, 23 bp, Homo sapiens
aaaatactctttcaataaatgta

SEQ ID NO: 5071993 - DNA, 14 bp, Homo sapiens
aaaatactcttttt

SEQ ID NO: 5071994 - DNA, 14 bp, Homo sapiens
aaaatactgccaga

SEQ ID NO: 5071995 - DNA, 19 bp, Homo sapiens
aaaatactgccagatgctg

SEQ ID NO: 5071996 - DNA, 18 bp, Homo sapiens
aaaatactggaattcaaa

SEQ ID NO: 5071997 - DNA, 17 bp, Homo sapiens
aaaatacttgagctgta

SEQ ID NO: 5071998 - DNA, 15 bp, Homo sapiens
aaaatactttgagtt

SEQ ID NO: 5071999 - DNA, 15 bp, Homo sapiens
aaaatactttgattt

SEQ ID NO: 5072000 - DNA, 11 bp, Homo sapiens
aaaatactttt

SEQ ID NO: 5072001 - DNA, 15 bp, Homo sapiens
aaaatacttttcctt

SEQ ID NO: 5072002 - DNA, 16 bp, Homo sapiens
aaaatacttttcctta

SEQ ID NO: 5072003 - DNA, 12 bp, Homo sapiens
aaaatagaaata

SEQ ID NO: 5072004 - DNA, 17 bp, Homo sapiens
aaaatagaaattttgta

SEQ ID NO: 5072005 - DNA, 21 bp, Homo sapiens
aaaatagaaattttgtaagaa

SEQ ID NO: 5072006 - DNA, 21 bp, Homo sapiens
aaaatagaatgtggccactta

SEQ ID NO: 5072007 - DNA, 17 bp, Homo sapiens
aaaatagaattgacatt

SEQ ID NO: 5072008 - DNA, 19 bp, Homo sapiens
aaaatagacaaatagaaaa

SEQ ID NO: 5072009 - DNA, 14 bp, Homo sapiens
aaaatagacatctt

SEQ ID NO: 5072010 - DNA, 15 bp, Homo sapiens
aaaatagacatcttt

SEQ ID NO: 5072011 - DNA, 23 bp, Homo sapiens
aaaatagagagagaggtatttaa

SEQ ID NO: 5072012 - DNA, 18 bp, Homo sapiens
aaaatagagcaaaatcaa

SEQ ID NO: 5072013 - DNA, 24 bp, Homo sapiens
aaaatagaggctttgagcaactaa

SEQ ID NO: 5072014 - DNA, 14 bp, Homo sapiens
aaaatagagtgcag

SEQ ID NO: 5072015 - DNA, 13 bp, Homo sapiens
aaaatagatgttt

SEQ ID NO: 5072016 - DNA, 13 bp, Homo sapiens
aaaatagattttt

SEQ ID NO: 5072017 - DNA, 17 bp, Homo sapiens
aaaatagcaaaagaaga

SEQ ID NO: 5072018 - DNA, 22 bp, Homo sapiens
aaaatagcaacactctatattt

SEQ ID NO: 5072019 - DNA, 19 bp, Homo sapiens
aaaatagcatactgtgtat

SEQ ID NO: 5072020 - DNA, 23 bp, Homo sapiens
aaaatagcatactgtgtatgttt

SEQ ID NO: 5072021 - DNA, 12 bp, Homo sapiens
aaaatagcctgc

SEQ ID NO: 5072022 - DNA, 18 bp, Homo sapiens
aaaatagcgttcttgtaa

SEQ ID NO: 5072023 - DNA, 18 bp, Homo sapiens
aaacaagatacgtatatt

SEQ ID NO: 5072024 - DNA, 15 bp, Homo sapiens
aaacaagattttaaa

SEQ ID NO: 5072025 - DNA, 22 bp, Homo sapiens
aaacaagattttaaagacatgt

SEQ ID NO: 5072026 - DNA, 19 bp, Homo sapiens
aaacaagcaagttctgaga

SEQ ID NO: 5072027 - DNA, 20 bp, Homo sapiens
aaacaagcactaaacaaaga

SEQ ID NO: 5072028 - DNA, 18 bp, Homo sapiens
aaacaagcatataaaatg

SEQ ID NO: 5072029 - DNA, 23 bp, Homo sapiens
aaacaagccaagaaagatgtata

SEQ ID NO: 5072030 - DNA, 16 bp, Homo sapiens
aaacaagccccctgcc

SEQ ID NO: 5072031 - DNA, 17 bp, Homo sapiens
aaacaagccccctgccc

SEQ ID NO: 5072032 - DNA, 12 bp, Homo sapiens
aaacaagcctta

SEQ ID NO: 5072033 - DNA, 23 bp, Homo sapiens
aaacaagcttcaaagccatatgg

SEQ ID NO: 5072034 - DNA, 18 bp, Homo sapiens
aaacaaggaaggacattt

SEQ ID NO: 5072035 - DNA, 17 bp, Homo sapiens
aaacaaggatgaattaa

SEQ ID NO: 5072036 - DNA, 14 bp, Homo sapiens
aaacaaggcattca

SEQ ID NO: 5072037 - DNA, 20 bp, Homo sapiens
aaacaaggggctgttacata

SEQ ID NO: 5072038 - DNA, 16 bp, Homo sapiens
aaacaagtaaatatat

SEQ ID NO: 5072039 - DNA, 15 bp, Homo sapiens
aaacaagtatataat

SEQ ID NO: 5072040 - DNA, 22 bp, Homo sapiens
aaacaagtatataatttacttt

SEQ ID NO: 5072041 - DNA, 12 bp, Homo sapiens
aaacaagtattt

SEQ ID NO: 5072042 - DNA, 22 bp, Homo sapiens
aaacaagtatttgttaatttag

SEQ ID NO: 5072043 - DNA, 19 bp, Homo sapiens
aaacaagtcagtcattcag

SEQ ID NO: 5072044 - DNA, 20 bp, Homo sapiens
aaacaagtctagtcttctgg

SEQ ID NO: 5072045 - DNA, 21 bp, Homo sapiens
aaacaagtctcattagctctc

SEQ ID NO: 5072046 - DNA, 15 bp, Homo sapiens
aaacaagtgctggca

SEQ ID NO: 5072047 - DNA, 19 bp, Homo sapiens
aaacaagtggatgttttta

SEQ ID NO: 5072048 - DNA, 19 bp, Homo sapiens
aaacaagttggctagaaga

SEQ ID NO: 5072049 - DNA, 17 bp, Homo sapiens
aaacaagttgtgccttt

SEQ ID NO: 5072050 - DNA, 17 bp, Homo sapiens
aaacaagtttagaaagc

SEQ ID NO: 5072051 - DNA, 16 bp, Homo sapiens
aaacaataaatgtgca

SEQ ID NO: 5072052 - DNA, 12 bp, Homo sapiens
aaacaataagaa

SEQ ID NO: 5072053 - DNA, 14 bp, Homo sapiens
aaacaataagaaca

SEQ ID NO: 5072054 - DNA, 21 bp, Homo sapiens
aaacaataagaacaagttttg

SEQ ID NO: 5072055 - DNA, 14 bp, Homo sapiens
aaacaataagacat

SEQ ID NO: 5072056 - DNA, 12 bp, Homo sapiens
aaacaatacctg

SEQ ID NO: 5072057 - DNA, 22 bp, Homo sapiens
aaacaataggcttttaaaagca

SEQ ID NO: 5072058 - DNA, 19 bp, Homo sapiens
aaacaatatctgcagcgtt

SEQ ID NO: 5072059 - DNA, 23 bp, Homo sapiens
aaacaatatgaggagacattctg

SEQ ID NO: 5072060 - DNA, 16 bp, Homo sapiens
aaacaatattgtttct

SEQ ID NO: 5072061 - DNA, 17 bp, Homo sapiens
aaacaatatttattgta

SEQ ID NO: 5072062 - DNA, 17 bp, Homo sapiens
aaacaatcccaatcttt

SEQ ID NO: 5072063 - DNA, 13 bp, Homo sapiens
aaacaatcctgtt

SEQ ID NO: 5072064 - DNA, 18 bp, Homo sapiens
aaacaatctggaagaaaa

SEQ ID NO: 5072065 - DNA, 13 bp, Homo sapiens
aaacaatgaaaac

SEQ ID NO: 5072066 - DNA, 17 bp, Homo sapiens
aaacaatgaagaattat

SEQ ID NO: 5072067 - DNA, 16 bp, Homo sapiens
aaacaatgaagtgaaa

SEQ ID NO: 5072068 - DNA, 14 bp, Homo sapiens
aaacaatgaagtgt

SEQ ID NO: 5072069 - DNA, 18 bp, Homo sapiens
aaacaatgaagtgtttta

SEQ ID NO: 5072070 - DNA, 21 bp, Homo sapiens
aaacaatgccatgaacaaatt

SEQ ID NO: 5072071 - DNA, 22 bp, Homo sapiens
aaacaatggggctggttttgct

SEQ ID NO: 5072072 - DNA, 13 bp, Homo sapiens
aaacaatgtaaag

SEQ ID NO: 5072073 - DNA, 17 bp, Homo sapiens
aaacaatgtataaagat

SEQ ID NO: 5072074 - DNA, 20 bp, Homo sapiens
aaacaatgtataaagattgt

SEQ ID NO: 5072075 - DNA, 18 bp, Homo sapiens
aaacaatgtcctctttga

SEQ ID NO: 5072076 - DNA, 12 bp, Homo sapiens
aaacaatgtgga

SEQ ID NO: 5072077 - DNA, 23 bp, Homo sapiens
aaacaatgtttgggggaaaaaaa

SEQ ID NO: 5072078 - DNA, 20 bp, Homo sapiens
aaacaattcaatcaaagcta

SEQ ID NO: 5072079 - DNA, 21 bp, Homo sapiens
aaacaattcaatcaaagctac

SEQ ID NO: 5072080 - DNA, 13 bp, Homo sapiens
aaacaattctgat

SEQ ID NO: 5072081 - DNA, 14 bp, Homo sapiens
aaacaattctgatg

SEQ ID NO: 5072082 - DNA, 23 bp, Homo sapiens
aaacaattcttgtaactttcttc

SEQ ID NO: 5072083 - DNA, 15 bp, Homo sapiens
aaacaatttaaaaat

SEQ ID NO: 5072084 - DNA, 12 bp, Homo sapiens
aaacaatttatt

SEQ ID NO: 5072085 - DNA, 16 bp, Homo sapiens
aaacaatttattttat

SEQ ID NO: 5072086 - DNA, 17 bp, Homo sapiens
aaacaatttattttatt

SEQ ID NO: 5072087 - DNA, 21 bp, Homo sapiens
aaacaatttgcataatactaa

SEQ ID NO: 5072088 - DNA, 14 bp, Homo sapiens
aaacaattttttgt

SEQ ID NO: 5072089 - DNA, 22 bp, Homo sapiens
aaacaattttttgtgatgaaaa

SEQ ID NO: 5072090 - DNA, 14 bp, Homo sapiens
aaacacaaaaaaag

SEQ ID NO: 5072091 - DNA, 18 bp, Homo sapiens
aaacacaaaacattcatg

SEQ ID NO: 5072092 - DNA, 17 bp, Homo sapiens
aaacacaaagaagtttt

SEQ ID NO: 5072093 - DNA, 22 bp, Homo sapiens
aaacacaaatacggaagtaaac

SEQ ID NO: 5072094 - DNA, 14 bp, Homo sapiens
aaacacaaatgcag

SEQ ID NO: 5072095 - DNA, 14 bp, Homo sapiens
aaacacaacacaag

SEQ ID NO: 5072096 - DNA, 15 bp, Homo sapiens
aaacacaacttgtgt

SEQ ID NO: 5072097 - DNA, 21 bp, Homo sapiens
aaacacaagattggtgttttt

SEQ ID NO: 5072098 - DNA, 11 bp, Homo sapiens
aaacacacaca

SEQ ID NO: 5072099 - DNA, 16 bp, Homo sapiens
aaacacacagactctg

SEQ ID NO: 5072100 - DNA, 21 bp, Homo sapiens
aaacacacagtgaccaaggga

SEQ ID NO: 5072101 - DNA, 18 bp, Homo sapiens
aaacacaccctctgtgct

SEQ ID NO: 5072102 - DNA, 14 bp, Homo sapiens
aaacacacctcgtg

SEQ ID NO: 5072103 - DNA, 19 bp, Homo sapiens
aaacacactcaaaagacaa

SEQ ID NO: 5072104 - DNA, 14 bp, Homo sapiens
aaacacactgtaaa

SEQ ID NO: 5072105 - DNA, 14 bp, Homo sapiens
aaacacacttttgc

SEQ ID NO: 5072106 - DNA, 17 bp, Homo sapiens
aaacacacttttgcaca

SEQ ID NO: 5072107 - DNA, 10 bp, Homo sapiens
aaacacagag

SEQ ID NO: 5072108 - DNA, 12 bp, Homo sapiens
aaacacagagcg

SEQ ID NO: 5072109 - DNA, 11 bp, Homo sapiens
aaacacagagg

SEQ ID NO: 5072110 - DNA, 11 bp, Homo sapiens
aaacacagcaa

SEQ ID NO: 5072111 - DNA, 21 bp, Homo sapiens
aaacacagcatcgtgatcact

SEQ ID NO: 5072112 - DNA, 17 bp, Homo sapiens
aaacacagcatgcattt

SEQ ID NO: 5072113 - DNA, 12 bp, Homo sapiens
aaacacagctgt

SEQ ID NO: 5072114 - DNA, 13 bp, Homo sapiens
aaacacagctgtt

SEQ ID NO: 5072115 - DNA, 17 bp, Homo sapiens
aaacacagggttttgta

SEQ ID NO: 5072116 - DNA, 18 bp, Homo sapiens
aaacacagggttttgtat

SEQ ID NO: 5072117 - DNA, 21 bp, Homo sapiens
aaacacagtattgtagaaagc

SEQ ID NO: 5072118 - DNA, 23 bp, Homo sapiens
aaacacagtattgtagaaagcta

SEQ ID NO: 5072119 - DNA, 21 bp, Homo sapiens
aaacacagtgaaaggcctgct

SEQ ID NO: 5072120 - DNA, 16 bp, Homo sapiens
aaacacataaatgaaa

SEQ ID NO: 5072121 - DNA, 19 bp, Homo sapiens
aaacacatagattcacctg

SEQ ID NO: 5072122 - DNA, 16 bp, Homo sapiens
aaacacatcttcccta

SEQ ID NO: 5072123 - DNA, 14 bp, Homo sapiens
aaacacatgccagt

SEQ ID NO: 5072124 - DNA, 21 bp, Homo sapiens
aaacacatgccttaaatttgt

SEQ ID NO: 5072125 - DNA, 11 bp, Homo sapiens
aaacacattaa

SEQ ID NO: 5072126 - DNA, 21 bp, Homo sapiens
aaacacattgaatgcgcttta

SEQ ID NO: 5072127 - DNA, 13 bp, Homo sapiens
aaacacattgcct

SEQ ID NO: 5072128 - DNA, 15 bp, Homo sapiens
aaacacattgttatt

SEQ ID NO: 5072129 - DNA, 20 bp, Homo sapiens
aaacacattttccatatttg

SEQ ID NO: 5072130 - DNA, 18 bp, Homo sapiens
aaacaccaaagaattgta

SEQ ID NO: 5072131 - DNA, 16 bp, Homo sapiens
aaacaccacttaatct

SEQ ID NO: 5072132 - DNA, 22 bp, Homo sapiens
aaacaccagtcacctcgtctcc

SEQ ID NO: 5072133 - DNA, 13 bp, Homo sapiens
aaacaccagtgtt

SEQ ID NO: 5072134 - DNA, 11 bp, Homo sapiens
aaacacccaga

SEQ ID NO: 5072135 - DNA, 12 bp, Homo sapiens
aaacacccctca

SEQ ID NO: 5072136 - DNA, 15 bp, Homo sapiens
aaacaccctcacact

SEQ ID NO: 5072137 - DNA, 20 bp, Homo sapiens
aaacacccttcagcaatgat

SEQ ID NO: 5072138 - DNA, 22 bp, Homo sapiens
aaacacctaagtgactaccact

SEQ ID NO: 5072139 - DNA, 13 bp, Homo sapiens
aaacacctcccag

SEQ ID NO: 5072140 - DNA, 11 bp, Homo sapiens
aaacacctcct

SEQ ID NO: 5072141 - DNA, 15 bp, Homo sapiens
aaacacctctgtatt

SEQ ID NO: 5072142 - DNA, 13 bp, Homo sapiens
aaacacctgacac

SEQ ID NO: 5072143 - DNA, 14 bp, Homo sapiens
aaacacctgacaca

SEQ ID NO: 5072144 - DNA, 18 bp, Homo sapiens
aaacacctgacagcccct

SEQ ID NO: 5072145 - DNA, 13 bp, Homo sapiens
aaacaccttctct

SEQ ID NO: 5072146 - DNA, 14 bp, Homo sapiens
aaacaccttctctg

SEQ ID NO: 5072147 - DNA, 23 bp, Homo sapiens
aaacaccttcttattatatatat

SEQ ID NO: 5072148 - DNA, 13 bp, Homo sapiens
aaacacgaaactt

SEQ ID NO: 5072149 - DNA, 23 bp, Homo sapiens
aaacacgaaacttgttattgtga

SEQ ID NO: 5072150 - DNA, 14 bp, Homo sapiens
aaacacggacccat

SEQ ID NO: 5072151 - DNA, 22 bp, Homo sapiens
aaacacggagtttccatttgga

SEQ ID NO: 5072152 - DNA, 23 bp, Homo sapiens
aaacacggagtttccatttggat

SEQ ID NO: 5072153 - DNA, 22 bp, Homo sapiens
aaacacgttttaaggactgact

SEQ ID NO: 5072154 - DNA, 17 bp, Homo sapiens
aaacactaaatgttaaa

SEQ ID NO: 5072155 - DNA, 20 bp, Homo sapiens
aaacactaaatgttaaagat

SEQ ID NO: 5072156 - DNA, 22 bp, Homo sapiens
aaacactaaatgttaaagatgt

SEQ ID NO: 5072157 - DNA, 12 bp, Homo sapiens
aaacactaacaa

SEQ ID NO: 5072158 - DNA, 13 bp, Homo sapiens
aaacactaacaaa

SEQ ID NO: 5072159 - DNA, 23 bp, Homo sapiens
aaacactaatggccaagtgtaca

SEQ ID NO: 5072160 - DNA, 20 bp, Homo sapiens
aaacactacctcttttgaga

SEQ ID NO: 5072161 - DNA, 15 bp, Homo sapiens
aaacactatttgtga

SEQ ID NO: 5072162 - DNA, 23 bp, Homo sapiens
aaacactatttgtgactttttaa

SEQ ID NO: 5072163 - DNA, 19 bp, Homo sapiens
aaacactcaataaattgca

SEQ ID NO: 5072164 - DNA, 16 bp, Homo sapiens
aaacactcagctgttc

SEQ ID NO: 5072165 - DNA, 17 bp, Homo sapiens
aaacactcggcatttca

SEQ ID NO: 5072166 - DNA, 21 bp, Homo sapiens
aaacactcggcatttcaaatg

SEQ ID NO: 5072167 - DNA, 17 bp, Homo sapiens
aaacactcgtgtgcatg

SEQ ID NO: 5072168 - DNA, 16 bp, Homo sapiens
aaacactcgtgtgccc

SEQ ID NO: 5072169 - DNA, 19 bp, Homo sapiens
aaacactctaaataaattt

SEQ ID NO: 5072170 - DNA, 23 bp, Homo sapiens
aaacactctcactatgctgctat

SEQ ID NO: 5072171 - DNA, 14 bp, Homo sapiens
aaacactctttgag

SEQ ID NO: 5072172 - DNA, 16 bp, Homo sapiens
aaacactgaaaagaag

SEQ ID NO: 5072173 - DNA, 16 bp, Homo sapiens
aaacactgaaatgaaa

SEQ ID NO: 5072174 - DNA, 17 bp, Homo sapiens
aaacactgaatcatgtt

SEQ ID NO: 5072175 - DNA, 22 bp, Homo sapiens
aaacactgcagtttcctggaaa

SEQ ID NO: 5072176 - DNA, 13 bp, Homo sapiens
aaacactgccata

SEQ ID NO: 5072177 - DNA, 21 bp, Homo sapiens
aaacactgccatattgtgtaa

SEQ ID NO: 5072178 - DNA, 22 bp, Homo sapiens
aaacactgccatattgtgtaat

SEQ ID NO: 5072179 - DNA, 23 bp, Homo sapiens
aaacactgccatcttagtttgga

SEQ ID NO: 5072180 - DNA, 18 bp, Homo sapiens
aaacactgcctttttatt

SEQ ID NO: 5072181 - DNA, 22 bp, Homo sapiens
aaacactgcctttttatttata

SEQ ID NO: 5072182 - DNA, 21 bp, Homo sapiens
aaacactgcgctttattttct

SEQ ID NO: 5072183 - DNA, 18 bp, Homo sapiens
aaacactggacctggggg

SEQ ID NO: 5072184 - DNA, 22 bp, Homo sapiens
aaacactggattcatttcatct

SEQ ID NO: 5072185 - DNA, 14 bp, Homo sapiens
aaacactggctctg

SEQ ID NO: 5072186 - DNA, 15 bp, Homo sapiens
aaacactggctctgg

SEQ ID NO: 5072187 - DNA, 16 bp, Homo sapiens
aaacactggctctggg

SEQ ID NO: 5072188 - DNA, 19 bp, Homo sapiens
aaacactggctctgggact

SEQ ID NO: 5072189 - DNA, 22 bp, Homo sapiens
aaacactgggagaaatgaaaaa

SEQ ID NO: 5072190 - DNA, 19 bp, Homo sapiens
aaacactggggctggcaca

SEQ ID NO: 5072191 - DNA, 18 bp, Homo sapiens
aaacactggtgccaacca

SEQ ID NO: 5072192 - DNA, 12 bp, Homo sapiens
aaacactgtaat

SEQ ID NO: 5072193 - DNA, 14 bp, Homo sapiens
aaacactgtaatct

SEQ ID NO: 5072194 - DNA, 13 bp, Homo sapiens
aaacactgtctgc

SEQ ID NO: 5072195 - DNA, 22 bp, Homo sapiens
aaacactgtggaactaataaat

SEQ ID NO: 5072196 - DNA, 19 bp, Homo sapiens
aaacactgttctctgccct

SEQ ID NO: 5072197 - DNA, 19 bp, Homo sapiens
aaacacttaggaagaaatc

SEQ ID NO: 5072198 - DNA, 22 bp, Homo sapiens
aaacacttattgtttgaaagac

SEQ ID NO: 5072199 - DNA, 14 bp, Homo sapiens
aaacacttcattct

SEQ ID NO: 5072200 - DNA, 18 bp, Homo sapiens
aaacacttcattgaaaat

SEQ ID NO: 5072201 - DNA, 21 bp, Homo sapiens
aaacacttcgttcgcagagct

SEQ ID NO: 5072202 - DNA, 21 bp, Homo sapiens
aaaatagctatggttgtaaca

SEQ ID NO: 5072203 - DNA, 21 bp, Homo sapiens
aaaatagcttgtatagtgtaa

SEQ ID NO: 5072204 - DNA, 12 bp, Homo sapiens
aaaatagctttt

SEQ ID NO: 5072205 - DNA, 13 bp, Homo sapiens
aaaatagctttta

SEQ ID NO: 5072206 - DNA, 19 bp, Homo sapiens
aaaatagcttttattgagt

SEQ ID NO: 5072207 - DNA, 22 bp, Homo sapiens
aaaataggattgcttcaattaa

SEQ ID NO: 5072208 - DNA, 15 bp, Homo sapiens
aaaataggatttctt

SEQ ID NO: 5072209 - DNA, 18 bp, Homo sapiens
aaaataggatttcttaaa

SEQ ID NO: 5072210 - DNA, 20 bp, Homo sapiens
aaaataggatttgcactgct

SEQ ID NO: 5072211 - DNA, 15 bp, Homo sapiens
aaaataggcttttta

SEQ ID NO: 5072212 - DNA, 16 bp, Homo sapiens
aaaataggctttttaa

SEQ ID NO: 5072213 - DNA, 22 bp, Homo sapiens
aaaatagggactatctatctta

SEQ ID NO: 5072214 - DNA, 18 bp, Homo sapiens
aaaataggggatatttaa

SEQ ID NO: 5072215 - DNA, 18 bp, Homo sapiens
aaaataggtatacagtgg

SEQ ID NO: 5072216 - DNA, 19 bp, Homo sapiens
aaaataggttttccctgtt

SEQ ID NO: 5072217 - DNA, 20 bp, Homo sapiens
aaaatagtatgttaatatgt

SEQ ID NO: 5072218 - DNA, 18 bp, Homo sapiens
aaaatagtattgaaagtg

SEQ ID NO: 5072219 - DNA, 21 bp, Homo sapiens
aaaatagtcatttttagcact

SEQ ID NO: 5072220 - DNA, 13 bp, Homo sapiens
aaaatagtgtaag

SEQ ID NO: 5072221 - DNA, 14 bp, Homo sapiens
aaaatagttacagt

SEQ ID NO: 5072222 - DNA, 19 bp, Homo sapiens
aaaatagttccctttgcca

SEQ ID NO: 5072223 - DNA, 22 bp, Homo sapiens
aaaatagtttaggagaaaccag

SEQ ID NO: 5072224 - DNA, 13 bp, Homo sapiens
aaaatagtttatt

SEQ ID NO: 5072225 - DNA, 14 bp, Homo sapiens
aaaatagtttattt

SEQ ID NO: 5072226 - DNA, 13 bp, Homo sapiens
aaaatagtttgga

SEQ ID NO: 5072227 - DNA, 12 bp, Homo sapiens
aaaatagtttgt

SEQ ID NO: 5072228 - DNA, 13 bp, Homo sapiens
aaaatagtttgtt

SEQ ID NO: 5072229 - DNA, 18 bp, Homo sapiens
aaaatagttttctaaatg

SEQ ID NO: 5072230 - DNA, 14 bp, Homo sapiens
aaaatataaaactg

SEQ ID NO: 5072231 - DNA, 14 bp, Homo sapiens
aaaatataaaatta

SEQ ID NO: 5072232 - DNA, 18 bp, Homo sapiens
aaaatataaagcatctaa

SEQ ID NO: 5072233 - DNA, 14 bp, Homo sapiens
aaaatataaatgca

SEQ ID NO: 5072234 - DNA, 22 bp, Homo sapiens
aaaatataaatgcatgatttta

SEQ ID NO: 5072235 - DNA, 22 bp, Homo sapiens
aaaatataaattaagactttaa

SEQ ID NO: 5072236 - DNA, 16 bp, Homo sapiens
aaaatataagtaaagt

SEQ ID NO: 5072237 - DNA, 22 bp, Homo sapiens
aaaatataattgttttttatct

SEQ ID NO: 5072238 - DNA, 13 bp, Homo sapiens
aaaatatacaaaa

SEQ ID NO: 5072239 - DNA, 17 bp, Homo sapiens
aaaatatacaaacatgt

SEQ ID NO: 5072240 - DNA, 13 bp, Homo sapiens
aaaatatacaagt

SEQ ID NO: 5072241 - DNA, 21 bp, Homo sapiens
aaaatatacaagtaaattctg

SEQ ID NO: 5072242 - DNA, 11 bp, Homo sapiens
aaaatatacat

SEQ ID NO: 5072243 - DNA, 12 bp, Homo sapiens
aaaatatactgt

SEQ ID NO: 5072244 - DNA, 15 bp, Homo sapiens
aaaatatactgtaaa

SEQ ID NO: 5072245 - DNA, 16 bp, Homo sapiens
aaaatatactgtaaag

SEQ ID NO: 5072246 - DNA, 17 bp, Homo sapiens
aaaatatactgtaaaga

SEQ ID NO: 5072247 - DNA, 18 bp, Homo sapiens
aaaatatactgtaaagaa

SEQ ID NO: 5072248 - DNA, 22 bp, Homo sapiens
aaaatatacttgactctaatat

SEQ ID NO: 5072249 - DNA, 19 bp, Homo sapiens
aaaatatagagacaggaca

SEQ ID NO: 5072250 - DNA, 13 bp, Homo sapiens
aaaatatagcaaa

SEQ ID NO: 5072251 - DNA, 14 bp, Homo sapiens
aaaatatatacaga

SEQ ID NO: 5072252 - DNA, 16 bp, Homo sapiens
aaaatatatataaata

SEQ ID NO: 5072253 - DNA, 22 bp, Homo sapiens
aaaatatatataaatatatatt

SEQ ID NO: 5072254 - DNA, 13 bp, Homo sapiens
aaaatatatatag

SEQ ID NO: 5072255 - DNA, 19 bp, Homo sapiens
aaaatatatatagtgctat

SEQ ID NO: 5072256 - DNA, 13 bp, Homo sapiens
aaaatatatatat

SEQ ID NO: 5072257 - DNA, 21 bp, Homo sapiens
aaaatatatatatatatttaa

SEQ ID NO: 5072258 - DNA, 13 bp, Homo sapiens
aaaatatatatct

SEQ ID NO: 5072259 - DNA, 14 bp, Homo sapiens
aaaatatatatcta

SEQ ID NO: 5072260 - DNA, 20 bp, Homo sapiens
aaaatatatatgtatataaa

SEQ ID NO: 5072261 - DNA, 12 bp, Homo sapiens
aaaatatatatt

SEQ ID NO: 5072262 - DNA, 21 bp, Homo sapiens
aaaatatatattatatacata

SEQ ID NO: 5072263 - DNA, 14 bp, Homo sapiens
aaaatatatatttt

SEQ ID NO: 5072264 - DNA, 12 bp, Homo sapiens
aaaatatatgat

SEQ ID NO: 5072265 - DNA, 12 bp, Homo sapiens
aaaatatatgta

SEQ ID NO: 5072266 - DNA, 15 bp, Homo sapiens
aaaatatatgtaata

SEQ ID NO: 5072267 - DNA, 16 bp, Homo sapiens
aaaatatatgtaatat

SEQ ID NO: 5072268 - DNA, 22 bp, Homo sapiens
aaaatatatgtaatatatacat

SEQ ID NO: 5072269 - DNA, 23 bp, Homo sapiens
aaaatatatgtaatatatacata

SEQ ID NO: 5072270 - DNA, 13 bp, Homo sapiens
aaaatatatgtat

SEQ ID NO: 5072271 - DNA, 12 bp, Homo sapiens
aaaatatatgtt

SEQ ID NO: 5072272 - DNA, 13 bp, Homo sapiens
aaaatatatgttc

SEQ ID NO: 5072273 - DNA, 14 bp, Homo sapiens
aaaatatatgttct

SEQ ID NO: 5072274 - DNA, 20 bp, Homo sapiens
aaaatatatgttgaatgtta

SEQ ID NO: 5072275 - DNA, 11 bp, Homo sapiens
aaaatatattt

SEQ ID NO: 5072276 - DNA, 21 bp, Homo sapiens
aaaatatatttaatacctttg

SEQ ID NO: 5072277 - DNA, 14 bp, Homo sapiens
aaaatatatttatg

SEQ ID NO: 5072278 - DNA, 22 bp, Homo sapiens
aaaatatatttatgataactat

SEQ ID NO: 5072279 - DNA, 18 bp, Homo sapiens
aaaatatattttcagtac

SEQ ID NO: 5072280 - DNA, 17 bp, Homo sapiens
aaaatatatttttatat

SEQ ID NO: 5072281 - DNA, 13 bp, Homo sapiens
aaaatatcacttt

SEQ ID NO: 5072282 - DNA, 16 bp, Homo sapiens
aaaatatcataaagca

SEQ ID NO: 5072283 - DNA, 13 bp, Homo sapiens
aaaatatcattca

SEQ ID NO: 5072284 - DNA, 14 bp, Homo sapiens
aaaatatcctcagg

SEQ ID NO: 5072285 - DNA, 23 bp, Homo sapiens
aaaatatcctgtaactacaatga

SEQ ID NO: 5072286 - DNA, 22 bp, Homo sapiens
aaaatatctacattaatatact

SEQ ID NO: 5072287 - DNA, 19 bp, Homo sapiens
aaaatatctagtaatatat

SEQ ID NO: 5072288 - DNA, 13 bp, Homo sapiens
aaaatatctattt

SEQ ID NO: 5072289 - DNA, 18 bp, Homo sapiens
aaaatatctgaaatgtga

SEQ ID NO: 5072290 - DNA, 13 bp, Homo sapiens
aaaatatcttagg

SEQ ID NO: 5072291 - DNA, 17 bp, Homo sapiens
aaaatatcttttgacct

SEQ ID NO: 5072292 - DNA, 21 bp, Homo sapiens
aaaatatgaacctattttcat

SEQ ID NO: 5072293 - DNA, 22 bp, Homo sapiens
aaaatatgaccacactccagct

SEQ ID NO: 5072294 - DNA, 12 bp, Homo sapiens
aaaatatgcact

SEQ ID NO: 5072295 - DNA, 15 bp, Homo sapiens
aaaatatgtaaaact

SEQ ID NO: 5072296 - DNA, 15 bp, Homo sapiens
aaaatatgtaatttc

SEQ ID NO: 5072297 - DNA, 14 bp, Homo sapiens
aaaatatgtaccaa

SEQ ID NO: 5072298 - DNA, 16 bp, Homo sapiens
aaaatatgtatcctct

SEQ ID NO: 5072299 - DNA, 12 bp, Homo sapiens
aaaatatgtgaa

SEQ ID NO: 5072300 - DNA, 16 bp, Homo sapiens
aaaatatgtgaagttt

SEQ ID NO: 5072301 - DNA, 15 bp, Homo sapiens
aaaatattaacatat

SEQ ID NO: 5072302 - DNA, 17 bp, Homo sapiens
aaaatattaacattctt

SEQ ID NO: 5072303 - DNA, 22 bp, Homo sapiens
aaaatattactcagtttatgtt

SEQ ID NO: 5072304 - DNA, 13 bp, Homo sapiens
aaaatattatgtt

SEQ ID NO: 5072305 - DNA, 17 bp, Homo sapiens
aaaatattatgttatga

SEQ ID NO: 5072306 - DNA, 13 bp, Homo sapiens
aaaatattatttg

SEQ ID NO: 5072307 - DNA, 13 bp, Homo sapiens
aaaatattcactc

SEQ ID NO: 5072308 - DNA, 20 bp, Homo sapiens
aaaatattcctccaaatctc

SEQ ID NO: 5072309 - DNA, 21 bp, Homo sapiens
aaaatattcctccaaatctct

SEQ ID NO: 5072310 - DNA, 15 bp, Homo sapiens
aaaatattctaacat

SEQ ID NO: 5072311 - DNA, 14 bp, Homo sapiens
aaaatattctctat

SEQ ID NO: 5072312 - DNA, 14 bp, Homo sapiens
aaaatattctgtca

SEQ ID NO: 5072313 - DNA, 13 bp, Homo sapiens
aaaatattgctaa

SEQ ID NO: 5072314 - DNA, 14 bp, Homo sapiens
aaaatattgctaaa

SEQ ID NO: 5072315 - DNA, 15 bp, Homo sapiens
aaaatattgctaaaa

SEQ ID NO: 5072316 - DNA, 16 bp, Homo sapiens
aaaatattgctaaaag

SEQ ID NO: 5072317 - DNA, 18 bp, Homo sapiens
aaaatattgtttaatgca

SEQ ID NO: 5072318 - DNA, 19 bp, Homo sapiens
aaaatattgttttacaata

SEQ ID NO: 5072319 - DNA, 20 bp, Homo sapiens
aaaatatttaaaaatgtctt

SEQ ID NO: 5072320 - DNA, 14 bp, Homo sapiens
aaaatatttaatat

SEQ ID NO: 5072321 - DNA, 14 bp, Homo sapiens
aaaatatttaatgt

SEQ ID NO: 5072322 - DNA, 13 bp, Homo sapiens
aaaatatttataa

SEQ ID NO: 5072323 - DNA, 21 bp, Homo sapiens
aaaatatttataaaacttctc

SEQ ID NO: 5072324 - DNA, 15 bp, Homo sapiens
aaaatatttatgaag

SEQ ID NO: 5072325 - DNA, 20 bp, Homo sapiens
aaaatatttatgaagaaaat

SEQ ID NO: 5072326 - DNA, 13 bp, Homo sapiens
aaaatatttattt

SEQ ID NO: 5072327 - DNA, 13 bp, Homo sapiens
aaaatatttcaga

SEQ ID NO: 5072328 - DNA, 17 bp, Homo sapiens
aaaatatttcagatatc

SEQ ID NO: 5072329 - DNA, 20 bp, Homo sapiens
aaaatatttcagatatcaaa

SEQ ID NO: 5072330 - DNA, 21 bp, Homo sapiens
aaaatatttctaagcttattt

SEQ ID NO: 5072331 - DNA, 21 bp, Homo sapiens
aaaatatttctatgtaaatta

SEQ ID NO: 5072332 - DNA, 22 bp, Homo sapiens
aaaatatttgcacacatttaaa

SEQ ID NO: 5072333 - DNA, 19 bp, Homo sapiens
aaaatatttgtctttaaac

SEQ ID NO: 5072334 - DNA, 13 bp, Homo sapiens
aaaatattttaag

SEQ ID NO: 5072335 - DNA, 18 bp, Homo sapiens
aaaatattttaagaaaga

SEQ ID NO: 5072336 - DNA, 18 bp, Homo sapiens
aaaatattttataatttt

SEQ ID NO: 5072337 - DNA, 13 bp, Homo sapiens
aaaatattttcct

SEQ ID NO: 5072338 - DNA, 13 bp, Homo sapiens
aaaatattttctc

SEQ ID NO: 5072339 - DNA, 14 bp, Homo sapiens
aaaatattttctgt

SEQ ID NO: 5072340 - DNA, 17 bp, Homo sapiens
aaaatattttctgtgtg

SEQ ID NO: 5072341 - DNA, 19 bp, Homo sapiens
aaaatattttctgtgtgtt

SEQ ID NO: 5072342 - DNA, 22 bp, Homo sapiens
aaaatattttctgtgtgttcct

SEQ ID NO: 5072343 - DNA, 12 bp, Homo sapiens
aaaatattttga

SEQ ID NO: 5072344 - DNA, 19 bp, Homo sapiens
aaaatattttgatcttcaa

SEQ ID NO: 5072345 - DNA, 16 bp, Homo sapiens
aaaatattttgtctaa

SEQ ID NO: 5072346 - DNA, 16 bp, Homo sapiens
aaaatatttttaaatg

SEQ ID NO: 5072347 - DNA, 20 bp, Homo sapiens
aaaatatttttttcctttgc

SEQ ID NO: 5072348 - DNA, 19 bp, Homo sapiens
aaaatatttttttctagct

SEQ ID NO: 5072349 - DNA, 20 bp, Homo sapiens
aaaatatttttttctagcta

SEQ ID NO: 5072350 - DNA, 17 bp, Homo sapiens
aaaatatttttttttct

SEQ ID NO: 5072351 - DNA, 12 bp, Homo sapiens
aaaatcaaagaa

SEQ ID NO: 5072352 - DNA, 20 bp, Homo sapiens
aaaatcaaaggggatatatg

SEQ ID NO: 5072353 - DNA, 13 bp, Homo sapiens
aaaatcaaatggt

SEQ ID NO: 5072354 - DNA, 15 bp, Homo sapiens
aaaatcaacttgtgt

SEQ ID NO: 5072355 - DNA, 22 bp, Homo sapiens
aaaatcaactttttattgcctt

SEQ ID NO: 5072356 - DNA, 16 bp, Homo sapiens
aaaatcaagagtgaga

SEQ ID NO: 5072357 - DNA, 24 bp, Homo sapiens
aaaatcaagagtgagatgtagaaa

SEQ ID NO: 5072358 - DNA, 22 bp, Homo sapiens
aaaatcaaggagtcttctaatg

SEQ ID NO: 5072359 - DNA, 23 bp, Homo sapiens
aaaatcaaggagtcttctaatgt

SEQ ID NO: 5072360 - DNA, 24 bp, Homo sapiens
aaaatcaaggagtcttctaatgta

SEQ ID NO: 5072361 - DNA, 15 bp, Homo sapiens
aaaatcaagtattat

SEQ ID NO: 5072362 - DNA, 17 bp, Homo sapiens
aaaatcaagtggtattt

SEQ ID NO: 5072363 - DNA, 20 bp, Homo sapiens
aaaatcaatcaatggtgcaa

SEQ ID NO: 5072364 - DNA, 13 bp, Homo sapiens
aaaatcaatgctt

SEQ ID NO: 5072365 - DNA, 16 bp, Homo sapiens
aaaatcacaaaaacaa

SEQ ID NO: 5072366 - DNA, 17 bp, Homo sapiens
aaaatcacaaaaacaaa

SEQ ID NO: 5072367 - DNA, 19 bp, Homo sapiens
aaaatcacaagcaataatt

SEQ ID NO: 5072368 - DNA, 21 bp, Homo sapiens
aaaatcacaagcaataattag

SEQ ID NO: 5072369 - DNA, 20 bp, Homo sapiens
aaaatcacaatttttaatgg

SEQ ID NO: 5072370 - DNA, 21 bp, Homo sapiens
aaaatcacagattttttcttt

SEQ ID NO: 5072371 - DNA, 16 bp, Homo sapiens
aaaatcacattttaag

SEQ ID NO: 5072372 - DNA, 18 bp, Homo sapiens
aaaatcacattttaagtg

SEQ ID NO: 5072373 - DNA, 20 bp, Homo sapiens
aaaatcaccctgactgtggg

SEQ ID NO: 5072374 - DNA, 11 bp, Homo sapiens
aaaatcactaa

SEQ ID NO: 5072375 - DNA, 16 bp, Homo sapiens
aaaatcactaacatta

SEQ ID NO: 5072376 - DNA, 13 bp, Homo sapiens
aaaatcactgttt

SEQ ID NO: 5072377 - DNA, 14 bp, Homo sapiens
aaaatcacttcaga

SEQ ID NO: 5072378 - DNA, 17 bp, Homo sapiens
aaaatcactttcataat

SEQ ID NO: 5072379 - DNA, 13 bp, Homo sapiens
aaaatcagaacaa

SEQ ID NO: 5072380 - DNA, 14 bp, Homo sapiens
aaaatcagaacaaa

SEQ ID NO: 5072381 - DNA, 22 bp, Homo sapiens
aaaatcagaacagggctatttg

SEQ ID NO: 5072382 - DNA, 13 bp, Homo sapiens
aaaatcagatttt

SEQ ID NO: 5072383 - DNA, 21 bp, Homo sapiens
aaaatcagccaattatgttaa

SEQ ID NO: 5072384 - DNA, 17 bp, Homo sapiens
aaacacttctccttaac

SEQ ID NO: 5072385 - DNA, 14 bp, Homo sapiens
aaacacttctgctt

SEQ ID NO: 5072386 - DNA, 16 bp, Homo sapiens
aaacacttctgctttc

SEQ ID NO: 5072387 - DNA, 15 bp, Homo sapiens
aaacacttctgtcct

SEQ ID NO: 5072388 - DNA, 15 bp, Homo sapiens
aaacacttgcaacct

SEQ ID NO: 5072389 - DNA, 23 bp, Homo sapiens
aaacacttggcatacaaaatatt

SEQ ID NO: 5072390 - DNA, 13 bp, Homo sapiens
aaacactttcaaa

SEQ ID NO: 5072391 - DNA, 13 bp, Homo sapiens
aaacactttctct

SEQ ID NO: 5072392 - DNA, 21 bp, Homo sapiens
aaacactttggccacagcccc

SEQ ID NO: 5072393 - DNA, 13 bp, Homo sapiens
aaacacttttcaa

SEQ ID NO: 5072394 - DNA, 13 bp, Homo sapiens
aaacagaaaaaaa

SEQ ID NO: 5072395 - DNA, 14 bp, Homo sapiens
aaacagaaaaacaa

SEQ ID NO: 5072396 - DNA, 22 bp, Homo sapiens
aaacagaaacgagatttgccaa

SEQ ID NO: 5072397 - DNA, 14 bp, Homo sapiens
aaacagaaattggt

SEQ ID NO: 5072398 - DNA, 13 bp, Homo sapiens
aaacagaacattt

SEQ ID NO: 5072399 - DNA, 14 bp, Homo sapiens
aaacagaacatttc

SEQ ID NO: 5072400 - DNA, 14 bp, Homo sapiens
aaacagaactcgat

SEQ ID NO: 5072401 - DNA, 13 bp, Homo sapiens
aaacagaagaaaa

SEQ ID NO: 5072402 - DNA, 16 bp, Homo sapiens
aaacagaagaaaaaca

SEQ ID NO: 5072403 - DNA, 20 bp, Homo sapiens
aaacagaagaaaaacactga

SEQ ID NO: 5072404 - DNA, 17 bp, Homo sapiens
aaacagaagacaaaatt

SEQ ID NO: 5072405 - DNA, 19 bp, Homo sapiens
aaacagaagattacaaaag

SEQ ID NO: 5072406 - DNA, 12 bp, Homo sapiens
aaacagaagcct

SEQ ID NO: 5072407 - DNA, 18 bp, Homo sapiens
aaacagaagcctgtttca

SEQ ID NO: 5072408 - DNA, 22 bp, Homo sapiens
aaacagaaggtaataggaagaa

SEQ ID NO: 5072409 - DNA, 22 bp, Homo sapiens
aaacagaataaaagttcctctc

SEQ ID NO: 5072410 - DNA, 15 bp, Homo sapiens
aaacagaatcttctg

SEQ ID NO: 5072411 - DNA, 13 bp, Homo sapiens
aaacagaatgtct

SEQ ID NO: 5072412 - DNA, 14 bp, Homo sapiens
aaacagacaataat

SEQ ID NO: 5072413 - DNA, 14 bp, Homo sapiens
aaacagacaatatg

SEQ ID NO: 5072414 - DNA, 12 bp, Homo sapiens
aaacagacactg

SEQ ID NO: 5072415 - DNA, 17 bp, Homo sapiens
aaacagacagaaagaga

SEQ ID NO: 5072416 - DNA, 14 bp, Homo sapiens
aaacagactcaggt

SEQ ID NO: 5072417 - DNA, 20 bp, Homo sapiens
aaacagactcgctagcactc

SEQ ID NO: 5072418 - DNA, 13 bp, Homo sapiens
aaacagagaaaga

SEQ ID NO: 5072419 - DNA, 14 bp, Homo sapiens
aaacagagaaagaa

SEQ ID NO: 5072420 - DNA, 19 bp, Homo sapiens
aaacagagaaagaaaaggc

SEQ ID NO: 5072421 - DNA, 11 bp, Homo sapiens
aaacagagaac

SEQ ID NO: 5072422 - DNA, 17 bp, Homo sapiens
aaacagagaaccctgtg

SEQ ID NO: 5072423 - DNA, 16 bp, Homo sapiens
aaacagagacaggccc

SEQ ID NO: 5072424 - DNA, 17 bp, Homo sapiens
aaacagagcccagggag

SEQ ID NO: 5072425 - DNA, 16 bp, Homo sapiens
aaacagaggaccagca

SEQ ID NO: 5072426 - DNA, 23 bp, Homo sapiens
aaacagaggaggccagcctcacc

SEQ ID NO: 5072427 - DNA, 17 bp, Homo sapiens
aaacagaggtaaaaaaa

SEQ ID NO: 5072428 - DNA, 22 bp, Homo sapiens
aaacagaggtaaaaaaaagaag

SEQ ID NO: 5072429 - DNA, 18 bp, Homo sapiens
aaacagagtaatcttgtt

SEQ ID NO: 5072430 - DNA, 18 bp, Homo sapiens
aaacagagtggcctccct

SEQ ID NO: 5072431 - DNA, 13 bp, Homo sapiens
aaacagataccat

SEQ ID NO: 5072432 - DNA, 14 bp, Homo sapiens
aaacagataccata

SEQ ID NO: 5072433 - DNA, 23 bp, Homo sapiens
aaacagatatcttcagtttaatg

SEQ ID NO: 5072434 - DNA, 20 bp, Homo sapiens
aaacagatctcctggcaaag

SEQ ID NO: 5072435 - DNA, 17 bp, Homo sapiens
aaacagatgaccataat

SEQ ID NO: 5072436 - DNA, 20 bp, Homo sapiens
aaacagatgataaatattta

SEQ ID NO: 5072437 - DNA, 14 bp, Homo sapiens
aaacagatgctctg

SEQ ID NO: 5072438 - DNA, 14 bp, Homo sapiens
aaacagatgtccat

SEQ ID NO: 5072439 - DNA, 12 bp, Homo sapiens
aaacagattctg

SEQ ID NO: 5072440 - DNA, 22 bp, Homo sapiens
aaacagatttaagcaagaccat

SEQ ID NO: 5072441 - DNA, 20 bp, Homo sapiens
aaacagatttggtgaatttg

SEQ ID NO: 5072442 - DNA, 23 bp, Homo sapiens
aaacagatttggtgaatttgaat

SEQ ID NO: 5072443 - DNA, 14 bp, Homo sapiens
aaacagatttttac

SEQ ID NO: 5072444 - DNA, 16 bp, Homo sapiens
aaacagcaaaagttct

SEQ ID NO: 5072445 - DNA, 18 bp, Homo sapiens
aaacagcaaaccaagaga

SEQ ID NO: 5072446 - DNA, 19 bp, Homo sapiens
aaacagcaaaccaagagat

SEQ ID NO: 5072447 - DNA, 16 bp, Homo sapiens
aaacagcaaagccata

SEQ ID NO: 5072448 - DNA, 21 bp, Homo sapiens
aaacagcaaagccatattcta

SEQ ID NO: 5072449 - DNA, 11 bp, Homo sapiens
aaacagcagct

SEQ ID NO: 5072450 - DNA, 12 bp, Homo sapiens
aaacagcagctg

SEQ ID NO: 5072451 - DNA, 15 bp, Homo sapiens
aaacagcagtttgtg

SEQ ID NO: 5072452 - DNA, 19 bp, Homo sapiens
aaacagcatcaaaatacaa

SEQ ID NO: 5072453 - DNA, 17 bp, Homo sapiens
aaacagcattgctttct

SEQ ID NO: 5072454 - DNA, 13 bp, Homo sapiens
aaacagccactga

SEQ ID NO: 5072455 - DNA, 15 bp, Homo sapiens
aaacagccatgtcca

SEQ ID NO: 5072456 - DNA, 19 bp, Homo sapiens
aaacagccccagtcttcct

SEQ ID NO: 5072457 - DNA, 20 bp, Homo sapiens
aaacagccccagtcttcctt

SEQ ID NO: 5072458 - DNA, 21 bp, Homo sapiens
aaacagccccagtcttccttg

SEQ ID NO: 5072459 - DNA, 22 bp, Homo sapiens
aaacagccgtcagccaaatgta

SEQ ID NO: 5072460 - DNA, 22 bp, Homo sapiens
aaacagcctgggtaggaaaatt

SEQ ID NO: 5072461 - DNA, 15 bp, Homo sapiens
aaacagcctgtgtct

SEQ ID NO: 5072462 - DNA, 21 bp, Homo sapiens
aaacagcgctgggtccacccc

SEQ ID NO: 5072463 - DNA, 15 bp, Homo sapiens
aaacagcgtttaaga

SEQ ID NO: 5072464 - DNA, 12 bp, Homo sapiens
aaacagctattt

SEQ ID NO: 5072465 - DNA, 17 bp, Homo sapiens
aaacagctcagccagtg

SEQ ID NO: 5072466 - DNA, 18 bp, Homo sapiens
aaacagctgcattagaaa

SEQ ID NO: 5072467 - DNA, 20 bp, Homo sapiens
aaacagctgcattagaaaaa

SEQ ID NO: 5072468 - DNA, 12 bp, Homo sapiens
aaacagctgcct

SEQ ID NO: 5072469 - DNA, 13 bp, Homo sapiens
aaacagctgcctt

SEQ ID NO: 5072470 - DNA, 21 bp, Homo sapiens
aaacagctgccttagcttcag

SEQ ID NO: 5072471 - DNA, 16 bp, Homo sapiens
aaacagctgtctctaa

SEQ ID NO: 5072472 - DNA, 14 bp, Homo sapiens
aaacagcttaaatt

SEQ ID NO: 5072473 - DNA, 18 bp, Homo sapiens
aaacagcttcatgccttt

SEQ ID NO: 5072474 - DNA, 20 bp, Homo sapiens
aaacagctttggggtgtctt

SEQ ID NO: 5072475 - DNA, 14 bp, Homo sapiens
aaacagctttgtct

SEQ ID NO: 5072476 - DNA, 22 bp, Homo sapiens
aaacagctttgtctccaaagaa

SEQ ID NO: 5072477 - DNA, 22 bp, Homo sapiens
aaacaggaaaaaaaataatgta

SEQ ID NO: 5072478 - DNA, 18 bp, Homo sapiens
aaacaggaaaaaaacttt

SEQ ID NO: 5072479 - DNA, 16 bp, Homo sapiens
aaacaggaaaggagca

SEQ ID NO: 5072480 - DNA, 17 bp, Homo sapiens
aaacaggaatgtctgga

SEQ ID NO: 5072481 - DNA, 14 bp, Homo sapiens
aaacaggaatttta

SEQ ID NO: 5072482 - DNA, 17 bp, Homo sapiens
aaacaggaattttattt

SEQ ID NO: 5072483 - DNA, 19 bp, Homo sapiens
aaacaggaattttattttg

SEQ ID NO: 5072484 - DNA, 17 bp, Homo sapiens
aaacaggagacaggaag

SEQ ID NO: 5072485 - DNA, 18 bp, Homo sapiens
aaacaggagacaggaagg

SEQ ID NO: 5072486 - DNA, 12 bp, Homo sapiens
aaacaggagaga

SEQ ID NO: 5072487 - DNA, 12 bp, Homo sapiens
aaacaggatcag

SEQ ID NO: 5072488 - DNA, 19 bp, Homo sapiens
aaacaggcaaagttttaca

SEQ ID NO: 5072489 - DNA, 21 bp, Homo sapiens
aaacaggcaaagttttacaga

SEQ ID NO: 5072490 - DNA, 16 bp, Homo sapiens
aaacaggcactgccct

SEQ ID NO: 5072491 - DNA, 17 bp, Homo sapiens
aaacaggcactgccctg

SEQ ID NO: 5072492 - DNA, 15 bp, Homo sapiens
aaacaggcacttggc

SEQ ID NO: 5072493 - DNA, 21 bp, Homo sapiens
aaacaggcagttggccagaga

SEQ ID NO: 5072494 - DNA, 13 bp, Homo sapiens
aaacaggcccagc

SEQ ID NO: 5072495 - DNA, 21 bp, Homo sapiens
aaacaggccctctgtggcctg

SEQ ID NO: 5072496 - DNA, 18 bp, Homo sapiens
aaacagggacaaagaaat

SEQ ID NO: 5072497 - DNA, 22 bp, Homo sapiens
aaacagggcagtgacaagtgga

SEQ ID NO: 5072498 - DNA, 17 bp, Homo sapiens
aaacagggccacataga

SEQ ID NO: 5072499 - DNA, 15 bp, Homo sapiens
aaacagggctgcctt

SEQ ID NO: 5072500 - DNA, 21 bp, Homo sapiens
aaacaggggatcaaagttcct

SEQ ID NO: 5072501 - DNA, 17 bp, Homo sapiens
aaacagggggaaaatgt

SEQ ID NO: 5072502 - DNA, 17 bp, Homo sapiens
aaacagggtctcactct

SEQ ID NO: 5072503 - DNA, 21 bp, Homo sapiens
aaacagggtgttgtcagcatc

SEQ ID NO: 5072504 - DNA, 23 bp, Homo sapiens
aaacagggtgttgtcagcatctt

SEQ ID NO: 5072505 - DNA, 17 bp, Homo sapiens
aaacaggtcaatacagt

SEQ ID NO: 5072506 - DNA, 22 bp, Homo sapiens
aaacaggtcaatgaatgaaact

SEQ ID NO: 5072507 - DNA, 19 bp, Homo sapiens
aaacaggtgctggcccagc

SEQ ID NO: 5072508 - DNA, 24 bp, Homo sapiens
aaacaggtgctggcccagcatgga

SEQ ID NO: 5072509 - DNA, 14 bp, Homo sapiens
aaacaggtggttct

SEQ ID NO: 5072510 - DNA, 20 bp, Homo sapiens
aaacaggtgtgtgtgaactg

SEQ ID NO: 5072511 - DNA, 20 bp, Homo sapiens
aaacagtaactaagcacatt

SEQ ID NO: 5072512 - DNA, 19 bp, Homo sapiens
aaacagtagttgtattctt

SEQ ID NO: 5072513 - DNA, 23 bp, Homo sapiens
aaacagtagttgtattcttctgt

SEQ ID NO: 5072514 - DNA, 14 bp, Homo sapiens
aaacagtataattt

SEQ ID NO: 5072515 - DNA, 19 bp, Homo sapiens
aaacagtatattctttggt

SEQ ID NO: 5072516 - DNA, 14 bp, Homo sapiens
aaacagtatctctt

SEQ ID NO: 5072517 - DNA, 20 bp, Homo sapiens
aaacagtatttattttgtaa

SEQ ID NO: 5072518 - DNA, 23 bp, Homo sapiens
aaacagtccaaactgttctgaga

SEQ ID NO: 5072519 - DNA, 17 bp, Homo sapiens
aaacagtcgatcaaggg

SEQ ID NO: 5072520 - DNA, 17 bp, Homo sapiens
aaacagtctaaagaaga

SEQ ID NO: 5072521 - DNA, 17 bp, Homo sapiens
aaacagtgaatcttatg

SEQ ID NO: 5072522 - DNA, 18 bp, Homo sapiens
aaacagtgaatttaagca

SEQ ID NO: 5072523 - DNA, 12 bp, Homo sapiens
aaacagtgcctg

SEQ ID NO: 5072524 - DNA, 13 bp, Homo sapiens
aaacagtgtaaca

SEQ ID NO: 5072525 - DNA, 18 bp, Homo sapiens
aaacagtgtcttcttaaa

SEQ ID NO: 5072526 - DNA, 15 bp, Homo sapiens
aaacagtgtgtaaac

SEQ ID NO: 5072527 - DNA, 22 bp, Homo sapiens
aaacagtgtgttggtgctttag

SEQ ID NO: 5072528 - DNA, 15 bp, Homo sapiens
aaacagtgtttatga

SEQ ID NO: 5072529 - DNA, 14 bp, Homo sapiens
aaacagtgtttcca

SEQ ID NO: 5072530 - DNA, 19 bp, Homo sapiens
aaacagtgtttggtgacat

SEQ ID NO: 5072531 - DNA, 13 bp, Homo sapiens
aaacagtgttttg

SEQ ID NO: 5072532 - DNA, 22 bp, Homo sapiens
aaacagttaagacaacaggcat

SEQ ID NO: 5072533 - DNA, 14 bp, Homo sapiens
aaacagttatttct

SEQ ID NO: 5072534 - DNA, 19 bp, Homo sapiens
aaacagttgcatgtagtaa

SEQ ID NO: 5072535 - DNA, 16 bp, Homo sapiens
aaacagttgctgtgaa

SEQ ID NO: 5072536 - DNA, 23 bp, Homo sapiens
aaacataaaaaaattagtcaggt

SEQ ID NO: 5072537 - DNA, 20 bp, Homo sapiens
aaacataaaaaccaaaccca

SEQ ID NO: 5072538 - DNA, 18 bp, Homo sapiens
aaacataaaatatacaaa

SEQ ID NO: 5072539 - DNA, 24 bp, Homo sapiens
aaacataaaatatacaaacatgtg

SEQ ID NO: 5072540 - DNA, 17 bp, Homo sapiens
aaacataaagaaaagat

SEQ ID NO: 5072541 - DNA, 17 bp, Homo sapiens
aaacataaataaaatga

SEQ ID NO: 5072542 - DNA, 17 bp, Homo sapiens
aaacataacataaattt

SEQ ID NO: 5072543 - DNA, 18 bp, Homo sapiens
aaacataagttgcattta

SEQ ID NO: 5072544 - DNA, 22 bp, Homo sapiens
aaacataataccaccatttaaa

SEQ ID NO: 5072545 - DNA, 15 bp, Homo sapiens
aaacataatataaga

SEQ ID NO: 5072546 - DNA, 18 bp, Homo sapiens
aaacataatataagaatc

SEQ ID NO: 5072547 - DNA, 20 bp, Homo sapiens
aaacataatatagcttaaaa

SEQ ID NO: 5072548 - DNA, 14 bp, Homo sapiens
aaacataatatctt

SEQ ID NO: 5072549 - DNA, 20 bp, Homo sapiens
aaacataatatcttgaagaa

SEQ ID NO: 5072550 - DNA, 18 bp, Homo sapiens
aaacataatgaaaatatt

SEQ ID NO: 5072551 - DNA, 21 bp, Homo sapiens
aaacataattcttgtatatta

SEQ ID NO: 5072552 - DNA, 20 bp, Homo sapiens
aaacataattgtggattata

SEQ ID NO: 5072553 - DNA, 21 bp, Homo sapiens
aaacataccctttatctctgt

SEQ ID NO: 5072554 - DNA, 15 bp, Homo sapiens
aaacatagaaacata

SEQ ID NO: 5072555 - DNA, 12 bp, Homo sapiens
aaacatagaaag

SEQ ID NO: 5072556 - DNA, 14 bp, Homo sapiens
aaacatagacagat

SEQ ID NO: 5072557 - DNA, 18 bp, Homo sapiens
aaacatagagggagagag

SEQ ID NO: 5072558 - DNA, 14 bp, Homo sapiens
aaacatagtggtat

SEQ ID NO: 5072559 - DNA, 16 bp, Homo sapiens
aaacatagtggtattt

SEQ ID NO: 5072560 - DNA, 20 bp, Homo sapiens
aaacatagtggtattttaac

SEQ ID NO: 5072561 - DNA, 22 bp, Homo sapiens
aaacatagtggtattttaacat

SEQ ID NO: 5072562 - DNA, 15 bp, Homo sapiens
aaacatatacagaaa

SEQ ID NO: 5072563 - DNA, 15 bp, Homo sapiens
aaaatcagccagaca

SEQ ID NO: 5072564 - DNA, 21 bp, Homo sapiens
aaaatcagcctgctccagctg

SEQ ID NO: 5072565 - DNA, 18 bp, Homo sapiens
aaaatcagctattttgtg

SEQ ID NO: 5072566 - DNA, 17 bp, Homo sapiens
aaaatcaggagcctgct

SEQ ID NO: 5072567 - DNA, 22 bp, Homo sapiens
aaaatcaggagcctgctaagga

SEQ ID NO: 5072568 - DNA, 15 bp, Homo sapiens
aaaatcaggcagaaa

SEQ ID NO: 5072569 - DNA, 18 bp, Homo sapiens
aaaatcaggcagaaatat

SEQ ID NO: 5072570 - DNA, 18 bp, Homo sapiens
aaaatcagtgatgggagt

SEQ ID NO: 5072571 - DNA, 15 bp, Homo sapiens
aaaatcagtttttgt

SEQ ID NO: 5072572 - DNA, 13 bp, Homo sapiens
aaaatcataaact

SEQ ID NO: 5072573 - DNA, 22 bp, Homo sapiens
aaaatcataaactgtgtgcaga

SEQ ID NO: 5072574 - DNA, 16 bp, Homo sapiens
aaaatcatattgagaa

SEQ ID NO: 5072575 - DNA, 14 bp, Homo sapiens
aaaatcatcactca

SEQ ID NO: 5072576 - DNA, 15 bp, Homo sapiens
aaaatcatctatttt

SEQ ID NO: 5072577 - DNA, 18 bp, Homo sapiens
aaaatcatgaatatttca

SEQ ID NO: 5072578 - DNA, 22 bp, Homo sapiens
aaaatcatgcttataagcaaca

SEQ ID NO: 5072579 - DNA, 15 bp, Homo sapiens
aaaatcatgtacatt

SEQ ID NO: 5072580 - DNA, 17 bp, Homo sapiens
aaaatcatgtacatttc

SEQ ID NO: 5072581 - DNA, 18 bp, Homo sapiens
aaaatcatgtacatttct

SEQ ID NO: 5072582 - DNA, 14 bp, Homo sapiens
aaaatcatgtgaca

SEQ ID NO: 5072583 - DNA, 13 bp, Homo sapiens
aaaatcatgttaa

SEQ ID NO: 5072584 - DNA, 12 bp, Homo sapiens
aaaatcatgttt

SEQ ID NO: 5072585 - DNA, 12 bp, Homo sapiens
aaaatcatttct

SEQ ID NO: 5072586 - DNA, 14 bp, Homo sapiens
aaaatccaaaaaga

SEQ ID NO: 5072587 - DNA, 18 bp, Homo sapiens
aaaatccaaaaagctctg

SEQ ID NO: 5072588 - DNA, 16 bp, Homo sapiens
aaaatccaaaacttct

SEQ ID NO: 5072589 - DNA, 15 bp, Homo sapiens
aaaatccaaactgct

SEQ ID NO: 5072590 - DNA, 14 bp, Homo sapiens
aaaatccaaatatt

SEQ ID NO: 5072591 - DNA, 16 bp, Homo sapiens
aaaatccaaatattgt

SEQ ID NO: 5072592 - DNA, 14 bp, Homo sapiens
aaaatccaatgctt

SEQ ID NO: 5072593 - DNA, 21 bp, Homo sapiens
aaaatccagaaacttgttctt

SEQ ID NO: 5072594 - DNA, 17 bp, Homo sapiens
aaaatccagactttctt

SEQ ID NO: 5072595 - DNA, 19 bp, Homo sapiens
aaaatccagactttctttt

SEQ ID NO: 5072596 - DNA, 19 bp, Homo sapiens
aaaatccatacatttgtgt

SEQ ID NO: 5072597 - DNA, 19 bp, Homo sapiens
aaaatccatagatttattt

SEQ ID NO: 5072598 - DNA, 15 bp, Homo sapiens
aaaatccatccaaat

SEQ ID NO: 5072599 - DNA, 20 bp, Homo sapiens
aaaatccattttacacagca

SEQ ID NO: 5072600 - DNA, 23 bp, Homo sapiens
aaaatcccaaatctatagcattt

SEQ ID NO: 5072601 - DNA, 19 bp, Homo sapiens
aaaatcccattgtatttaa

SEQ ID NO: 5072602 - DNA, 19 bp, Homo sapiens
aaaatcccatttatgcaat

SEQ ID NO: 5072603 - DNA, 22 bp, Homo sapiens
aaaatccccttcgctgaaattg

SEQ ID NO: 5072604 - DNA, 14 bp, Homo sapiens
aaaatccctattta

SEQ ID NO: 5072605 - DNA, 17 bp, Homo sapiens
aaaatccctatttaatt

SEQ ID NO: 5072606 - DNA, 22 bp, Homo sapiens
aaaatccctatttaattttcct

SEQ ID NO: 5072607 - DNA, 21 bp, Homo sapiens
aaaatccctcttcctccaaag

SEQ ID NO: 5072608 - DNA, 20 bp, Homo sapiens
aaaatcccttaatctatgtg

SEQ ID NO: 5072609 - DNA, 22 bp, Homo sapiens
aaaatcctaagacacaaatgca

SEQ ID NO: 5072610 - DNA, 16 bp, Homo sapiens
aaaatcctacagtgaa

SEQ ID NO: 5072611 - DNA, 12 bp, Homo sapiens
aaaatcctacca

SEQ ID NO: 5072612 - DNA, 18 bp, Homo sapiens
aaaatcctatatctgttt

SEQ ID NO: 5072613 - DNA, 20 bp, Homo sapiens
aaaatcctcaacactattgt

SEQ ID NO: 5072614 - DNA, 22 bp, Homo sapiens
aaaatcctgaactttctccctc

SEQ ID NO: 5072615 - DNA, 22 bp, Homo sapiens
aaaatcctgcccaaaatgtgaa

SEQ ID NO: 5072616 - DNA, 19 bp, Homo sapiens
aaaatccttatgcatgaaa

SEQ ID NO: 5072617 - DNA, 22 bp, Homo sapiens
aaaatccttatgcatgaaatga

SEQ ID NO: 5072618 - DNA, 20 bp, Homo sapiens
aaaatccttgcttatgacat

SEQ ID NO: 5072619 - DNA, 22 bp, Homo sapiens
aaaatctaaaaattttgcattt

SEQ ID NO: 5072620 - DNA, 14 bp, Homo sapiens
aaaatctaaaacaa

SEQ ID NO: 5072621 - DNA, 14 bp, Homo sapiens
aaaatctaaaatgt

SEQ ID NO: 5072622 - DNA, 23 bp, Homo sapiens
aaaatctaatattaaaaatatgg

SEQ ID NO: 5072623 - DNA, 21 bp, Homo sapiens
aaaatctacactccagtgaga

SEQ ID NO: 5072624 - DNA, 22 bp, Homo sapiens
aaaatctagatcaattaattct

SEQ ID NO: 5072625 - DNA, 12 bp, Homo sapiens
aaaatctagttt

SEQ ID NO: 5072626 - DNA, 22 bp, Homo sapiens
aaaatctagttttggcaagaag

SEQ ID NO: 5072627 - DNA, 12 bp, Homo sapiens
aaaatctatatt

SEQ ID NO: 5072628 - DNA, 16 bp, Homo sapiens
aaaatctcaaatttct

SEQ ID NO: 5072629 - DNA, 18 bp, Homo sapiens
aaaatctcaaatttctaa

SEQ ID NO: 5072630 - DNA, 22 bp, Homo sapiens
aaaatctcaaatttctaaatct

SEQ ID NO: 5072631 - DNA, 17 bp, Homo sapiens
aaaatctcaatatttca

SEQ ID NO: 5072632 - DNA, 17 bp, Homo sapiens
aaaatctcattatttct

SEQ ID NO: 5072633 - DNA, 13 bp, Homo sapiens
aaaatctccatta

SEQ ID NO: 5072634 - DNA, 19 bp, Homo sapiens
aaaatctccccagtagaga

SEQ ID NO: 5072635 - DNA, 11 bp, Homo sapiens
aaaatctccta

SEQ ID NO: 5072636 - DNA, 14 bp, Homo sapiens
aaaatctcctaaat

SEQ ID NO: 5072637 - DNA, 12 bp, Homo sapiens
aaaatctcctgg

SEQ ID NO: 5072638 - DNA, 18 bp, Homo sapiens
aaaatctctccactttca

SEQ ID NO: 5072639 - DNA, 21 bp, Homo sapiens
aaaatctctccactttcagct

SEQ ID NO: 5072640 - DNA, 16 bp, Homo sapiens
aaaatctcttgattat

SEQ ID NO: 5072641 - DNA, 17 bp, Homo sapiens
aaaatctgaactctcaa

SEQ ID NO: 5072642 - DNA, 13 bp, Homo sapiens
aaaatctgaagag

SEQ ID NO: 5072643 - DNA, 16 bp, Homo sapiens
aaaatctgaagaggct

SEQ ID NO: 5072644 - DNA, 15 bp, Homo sapiens
aaaatctgaagattg

SEQ ID NO: 5072645 - DNA, 18 bp, Homo sapiens
aaaatctgaagattgttt

SEQ ID NO: 5072646 - DNA, 14 bp, Homo sapiens
aaaatctgaatttc

SEQ ID NO: 5072647 - DNA, 17 bp, Homo sapiens
aaaatctgaattttgca

SEQ ID NO: 5072648 - DNA, 22 bp, Homo sapiens
aaaatctgaattttgcaatgta

SEQ ID NO: 5072649 - DNA, 22 bp, Homo sapiens
aaaatctgagaaactctacatg

SEQ ID NO: 5072650 - DNA, 15 bp, Homo sapiens
aaaatctgattagaa

SEQ ID NO: 5072651 - DNA, 14 bp, Homo sapiens
aaaatctgatttaa

SEQ ID NO: 5072652 - DNA, 23 bp, Homo sapiens
aaaatctgccctcagatgaaaat

SEQ ID NO: 5072653 - DNA, 20 bp, Homo sapiens
aaaatctgctgatctctgta

SEQ ID NO: 5072654 - DNA, 21 bp, Homo sapiens
aaaatctgctgcaccttgtaa

SEQ ID NO: 5072655 - DNA, 14 bp, Homo sapiens
aaaatctggaaatc

SEQ ID NO: 5072656 - DNA, 21 bp, Homo sapiens
aaaatctggggaggacaaagg

SEQ ID NO: 5072657 - DNA, 12 bp, Homo sapiens
aaaatctgtcca

SEQ ID NO: 5072658 - DNA, 13 bp, Homo sapiens
aaaatctgtggca

SEQ ID NO: 5072659 - DNA, 23 bp, Homo sapiens
aaaatctgttgttccaaatgtgt

SEQ ID NO: 5072660 - DNA, 18 bp, Homo sapiens
aaaatcttaatactgtta

SEQ ID NO: 5072661 - DNA, 22 bp, Homo sapiens
aaaatcttattaaagtttcaaa

SEQ ID NO: 5072662 - DNA, 15 bp, Homo sapiens
aaaatcttcactttc

SEQ ID NO: 5072663 - DNA, 16 bp, Homo sapiens
aaaatcttcatggaat

SEQ ID NO: 5072664 - DNA, 17 bp, Homo sapiens
aaaatcttcatggaatt

SEQ ID NO: 5072665 - DNA, 23 bp, Homo sapiens
aaaatcttcatggaattcacaaa

SEQ ID NO: 5072666 - DNA, 21 bp, Homo sapiens
aaaatcttgatagctaaataa

SEQ ID NO: 5072667 - DNA, 15 bp, Homo sapiens
aaaatcttgatcagt

SEQ ID NO: 5072668 - DNA, 18 bp, Homo sapiens
aaaatcttgcagttttgt

SEQ ID NO: 5072669 - DNA, 19 bp, Homo sapiens
aaaatcttgcagttttgta

SEQ ID NO: 5072670 - DNA, 17 bp, Homo sapiens
aaaatcttggcacagaa

SEQ ID NO: 5072671 - DNA, 15 bp, Homo sapiens
aaaatcttgggcaag

SEQ ID NO: 5072672 - DNA, 10 bp, Homo sapiens
aaaatcttgt

SEQ ID NO: 5072673 - DNA, 18 bp, Homo sapiens
aaaatcttgtgctagaat

SEQ ID NO: 5072674 - DNA, 14 bp, Homo sapiens
aaaatcttgtgtta

SEQ ID NO: 5072675 - DNA, 14 bp, Homo sapiens
aaaatcttgttaat

SEQ ID NO: 5072676 - DNA, 20 bp, Homo sapiens
aaaatcttgttaatgtcatt

SEQ ID NO: 5072677 - DNA, 20 bp, Homo sapiens
aaaatctttaggctttcaaa

SEQ ID NO: 5072678 - DNA, 22 bp, Homo sapiens
aaaatctttccatctcattaca

SEQ ID NO: 5072679 - DNA, 19 bp, Homo sapiens
aaaatctttctttcttaga

SEQ ID NO: 5072680 - DNA, 21 bp, Homo sapiens
aaaatctttctttcttagaaa

SEQ ID NO: 5072681 - DNA, 22 bp, Homo sapiens
aaaatctttctttcttagaaat

SEQ ID NO: 5072682 - DNA, 16 bp, Homo sapiens
aaaatcttttgaagca

SEQ ID NO: 5072683 - DNA, 23 bp, Homo sapiens
aaaatctttttttaataatttca

SEQ ID NO: 5072684 - DNA, 19 bp, Homo sapiens
aaaatgaaaacttttgtaa

SEQ ID NO: 5072685 - DNA, 19 bp, Homo sapiens
aaaatgaaaagcaatacaa

SEQ ID NO: 5072686 - DNA, 16 bp, Homo sapiens
aaaatgaaaattgtat

SEQ ID NO: 5072687 - DNA, 14 bp, Homo sapiens
aaaatgaaagatga

SEQ ID NO: 5072688 - DNA, 16 bp, Homo sapiens
aaaatgaaagtgactt

SEQ ID NO: 5072689 - DNA, 23 bp, Homo sapiens
aaaatgaaagtgactttaaaaga

SEQ ID NO: 5072690 - DNA, 15 bp, Homo sapiens
aaaatgaaatccttt

SEQ ID NO: 5072691 - DNA, 21 bp, Homo sapiens
aaaatgaagaaggaagctgtg

SEQ ID NO: 5072692 - DNA, 16 bp, Homo sapiens
aaaatgaagaatttaa

SEQ ID NO: 5072693 - DNA, 12 bp, Homo sapiens
aaaatgaagaca

SEQ ID NO: 5072694 - DNA, 18 bp, Homo sapiens
aaaatgaagatacacatt

SEQ ID NO: 5072695 - DNA, 12 bp, Homo sapiens
aaaatgaagatt

SEQ ID NO: 5072696 - DNA, 17 bp, Homo sapiens
aaaatgaagcaatttat

SEQ ID NO: 5072697 - DNA, 20 bp, Homo sapiens
aaaatgaaggttaggattta

SEQ ID NO: 5072698 - DNA, 18 bp, Homo sapiens
aaaatgaatactgaattt

SEQ ID NO: 5072699 - DNA, 14 bp, Homo sapiens
aaaatgaatagctt

SEQ ID NO: 5072700 - DNA, 13 bp, Homo sapiens
aaaatgacaaaca

SEQ ID NO: 5072701 - DNA, 24 bp, Homo sapiens
aaaatgacaaacatgatactgctg

SEQ ID NO: 5072702 - DNA, 15 bp, Homo sapiens
aaaatgacaaagcca

SEQ ID NO: 5072703 - DNA, 16 bp, Homo sapiens
aaaatgacaaagccat

SEQ ID NO: 5072704 - DNA, 18 bp, Homo sapiens
aaaatgacaatcatgtgt

SEQ ID NO: 5072705 - DNA, 17 bp, Homo sapiens
aaaatgacaattgtgaa

SEQ ID NO: 5072706 - DNA, 13 bp, Homo sapiens
aaaatgacagatg

SEQ ID NO: 5072707 - DNA, 18 bp, Homo sapiens
aaaatgacagatgttgaa

SEQ ID NO: 5072708 - DNA, 14 bp, Homo sapiens
aaaatgacatccca

SEQ ID NO: 5072709 - DNA, 17 bp, Homo sapiens
aaaatgacatcttttta

SEQ ID NO: 5072710 - DNA, 17 bp, Homo sapiens
aaaatgactttatacaa

SEQ ID NO: 5072711 - DNA, 19 bp, Homo sapiens
aaaatgactttgaactgaa

SEQ ID NO: 5072712 - DNA, 20 bp, Homo sapiens
aaaatgactttgaactgaaa

SEQ ID NO: 5072713 - DNA, 11 bp, Homo sapiens
aaaatgagaaa

SEQ ID NO: 5072714 - DNA, 15 bp, Homo sapiens
aaaatgagaacatgt

SEQ ID NO: 5072715 - DNA, 19 bp, Homo sapiens
aaaatgagaatctgtgcag

SEQ ID NO: 5072716 - DNA, 15 bp, Homo sapiens
aaaatgagagctgta

SEQ ID NO: 5072717 - DNA, 13 bp, Homo sapiens
aaaatgagagtga

SEQ ID NO: 5072718 - DNA, 24 bp, Homo sapiens
aaaatgagatatgcaataaatatt

SEQ ID NO: 5072719 - DNA, 17 bp, Homo sapiens
aaaatgagatttcttat

SEQ ID NO: 5072720 - DNA, 19 bp, Homo sapiens
aaaatgagatttcttattt

SEQ ID NO: 5072721 - DNA, 18 bp, Homo sapiens
aaaatgagcatacatctt

SEQ ID NO: 5072722 - DNA, 11 bp, Homo sapiens
aaaatgagccc

SEQ ID NO: 5072723 - DNA, 12 bp, Homo sapiens
aaaatgagccct

SEQ ID NO: 5072724 - DNA, 21 bp, Homo sapiens
aaaatgagcctggcaagaatg

SEQ ID NO: 5072725 - DNA, 19 bp, Homo sapiens
aaaatgagcttccattaat

SEQ ID NO: 5072726 - DNA, 16 bp, Homo sapiens
aaaatgagcttgatta

SEQ ID NO: 5072727 - DNA, 22 bp, Homo sapiens
aaaatgagcttgtaaatactcc

SEQ ID NO: 5072728 - DNA, 16 bp, Homo sapiens
aaaatgaggaatagca

SEQ ID NO: 5072729 - DNA, 15 bp, Homo sapiens
aaaatgaggaggatt

SEQ ID NO: 5072730 - DNA, 19 bp, Homo sapiens
aaaatgagtgaaatttaaa

SEQ ID NO: 5072731 - DNA, 21 bp, Homo sapiens
aaaatgagttacctacatttt

SEQ ID NO: 5072732 - DNA, 18 bp, Homo sapiens
aaaatgagttgtcacaga

SEQ ID NO: 5072733 - DNA, 23 bp, Homo sapiens
aaaatgagtttttatggggctga

SEQ ID NO: 5072734 - DNA, 13 bp, Homo sapiens
aaaatgatactgt

SEQ ID NO: 5072735 - DNA, 18 bp, Homo sapiens
aaaatgatagacatatac

SEQ ID NO: 5072736 - DNA, 19 bp, Homo sapiens
aaaatgatgtatgatttgt

SEQ ID NO: 5072737 - DNA, 16 bp, Homo sapiens
aaaatgattgtaaaat

SEQ ID NO: 5072738 - DNA, 17 bp, Homo sapiens
aaaatgatttacatagg

SEQ ID NO: 5072739 - DNA, 22 bp, Homo sapiens
aaaatgatttgtagtggaaaca

SEQ ID NO: 5072740 - DNA, 14 bp, Homo sapiens
aaaatgattttact

SEQ ID NO: 5072741 - DNA, 14 bp, Homo sapiens
aaaatgattttatc

SEQ ID NO: 5072742 - DNA, 19 bp, Homo sapiens
aaacatatataacaatgct

SEQ ID NO: 5072743 - DNA, 22 bp, Homo sapiens
aaacatatcaattcaacacatt

SEQ ID NO: 5072744 - DNA, 17 bp, Homo sapiens
aaacatatgatttcact

SEQ ID NO: 5072745 - DNA, 17 bp, Homo sapiens
aaacatatgtctgtctt

SEQ ID NO: 5072746 - DNA, 18 bp, Homo sapiens
aaacatatgtctgtcttt

SEQ ID NO: 5072747 - DNA, 22 bp, Homo sapiens
aaacatatttgttaaatattta

SEQ ID NO: 5072748 - DNA, 22 bp, Homo sapiens
aaacatattttacatctgaaca

SEQ ID NO: 5072749 - DNA, 16 bp, Homo sapiens
aaacatcaaataaatt

SEQ ID NO: 5072750 - DNA, 14 bp, Homo sapiens
aaacatcacacaca

SEQ ID NO: 5072751 - DNA, 21 bp, Homo sapiens
aaacatcacattccagtctga

SEQ ID NO: 5072752 - DNA, 16 bp, Homo sapiens
aaacatcactccctct

SEQ ID NO: 5072753 - DNA, 16 bp, Homo sapiens
aaacatcagttactct

SEQ ID NO: 5072754 - DNA, 22 bp, Homo sapiens
aaacatcagttactctgaaggg

SEQ ID NO: 5072755 - DNA, 22 bp, Homo sapiens
aaacatcattcctttttattta

SEQ ID NO: 5072756 - DNA, 13 bp, Homo sapiens
aaacatcattgtt

SEQ ID NO: 5072757 - DNA, 19 bp, Homo sapiens
aaacatccaatattttctt

SEQ ID NO: 5072758 - DNA, 19 bp, Homo sapiens
aaacatccacttaagttct

SEQ ID NO: 5072759 - DNA, 21 bp, Homo sapiens
aaacatccacttaagttcttt

SEQ ID NO: 5072760 - DNA, 16 bp, Homo sapiens
aaacatcccaaacttt

SEQ ID NO: 5072761 - DNA, 22 bp, Homo sapiens
aaacatcccaaactttaaaatg

SEQ ID NO: 5072762 - DNA, 19 bp, Homo sapiens
aaacatcccccaatgacct

SEQ ID NO: 5072763 - DNA, 18 bp, Homo sapiens
aaacatccttcaagaact

SEQ ID NO: 5072764 - DNA, 13 bp, Homo sapiens
aaacatctagaaa

SEQ ID NO: 5072765 - DNA, 16 bp, Homo sapiens
aaacatctagcagtaa

SEQ ID NO: 5072766 - DNA, 15 bp, Homo sapiens
aaacatctattctct

SEQ ID NO: 5072767 - DNA, 20 bp, Homo sapiens
aaacatctattctctccaaa

SEQ ID NO: 5072768 - DNA, 15 bp, Homo sapiens
aaacatctcatcatg

SEQ ID NO: 5072769 - DNA, 23 bp, Homo sapiens
aaacatctcatcatgtctattgt

SEQ ID NO: 5072770 - DNA, 14 bp, Homo sapiens
aaacatctgatttc

SEQ ID NO: 5072771 - DNA, 18 bp, Homo sapiens
aaacatctgatttctgaa

SEQ ID NO: 5072772 - DNA, 18 bp, Homo sapiens
aaacatctggatatcaag

SEQ ID NO: 5072773 - DNA, 19 bp, Homo sapiens
aaacatctgtgtctgtgtc

SEQ ID NO: 5072774 - DNA, 16 bp, Homo sapiens
aaacatcttttcctga

SEQ ID NO: 5072775 - DNA, 12 bp, Homo sapiens
aaacatgaaaac

SEQ ID NO: 5072776 - DNA, 14 bp, Homo sapiens
aaacatgaaacaac

SEQ ID NO: 5072777 - DNA, 15 bp, Homo sapiens
aaacatgaacccaaa

SEQ ID NO: 5072778 - DNA, 18 bp, Homo sapiens
aaacatgaagcataattt

SEQ ID NO: 5072779 - DNA, 19 bp, Homo sapiens
aaacatgaatcaagcaatc

SEQ ID NO: 5072780 - DNA, 16 bp, Homo sapiens
aaacatgaatttaatg

SEQ ID NO: 5072781 - DNA, 19 bp, Homo sapiens
aaacatgaccctaaatctt

SEQ ID NO: 5072782 - DNA, 15 bp, Homo sapiens
aaacatgagaaatgt

SEQ ID NO: 5072783 - DNA, 18 bp, Homo sapiens
aaacatgagaaatgtgaa

SEQ ID NO: 5072784 - DNA, 22 bp, Homo sapiens
aaacatgagcgctactcttgga

SEQ ID NO: 5072785 - DNA, 15 bp, Homo sapiens
aaacatgcacatttt

SEQ ID NO: 5072786 - DNA, 12 bp, Homo sapiens
aaacatgcagaa

SEQ ID NO: 5072787 - DNA, 15 bp, Homo sapiens
aaacatgcagtactt

SEQ ID NO: 5072788 - DNA, 16 bp, Homo sapiens
aaacatgcatccattt

SEQ ID NO: 5072789 - DNA, 16 bp, Homo sapiens
aaacatgccctcaggc

SEQ ID NO: 5072790 - DNA, 17 bp, Homo sapiens
aaacatgccctcaggct

SEQ ID NO: 5072791 - DNA, 22 bp, Homo sapiens
aaacatgctacacactgcatgt

SEQ ID NO: 5072792 - DNA, 22 bp, Homo sapiens
aaacatgctgtacatacttttt

SEQ ID NO: 5072793 - DNA, 15 bp, Homo sapiens
aaacatgctgtttat

SEQ ID NO: 5072794 - DNA, 21 bp, Homo sapiens
aaacatgcttgaataactgag

SEQ ID NO: 5072795 - DNA, 15 bp, Homo sapiens
aaacatggaaaacag

SEQ ID NO: 5072796 - DNA, 20 bp, Homo sapiens
aaacatggaaaacagagtat

SEQ ID NO: 5072797 - DNA, 14 bp, Homo sapiens
aaacatggagaaat

SEQ ID NO: 5072798 - DNA, 22 bp, Homo sapiens
aaacatggatacttcctgggtc

SEQ ID NO: 5072799 - DNA, 17 bp, Homo sapiens
aaacatggcctttgctt

SEQ ID NO: 5072800 - DNA, 22 bp, Homo sapiens
aaacatggggttggctgggccc

SEQ ID NO: 5072801 - DNA, 21 bp, Homo sapiens
aaacatgggtggtaacaagag

SEQ ID NO: 5072802 - DNA, 21 bp, Homo sapiens
aaacatggtagaattggagag

SEQ ID NO: 5072803 - DNA, 20 bp, Homo sapiens
aaacatgtactacagctata

SEQ ID NO: 5072804 - DNA, 15 bp, Homo sapiens
aaacatgtgaaagat

SEQ ID NO: 5072805 - DNA, 19 bp, Homo sapiens
aaacatgtgcagatatcca

SEQ ID NO: 5072806 - DNA, 20 bp, Homo sapiens
aaacatgtgcagatatccaa

SEQ ID NO: 5072807 - DNA, 18 bp, Homo sapiens
aaacatgtgcccctgcca

SEQ ID NO: 5072808 - DNA, 20 bp, Homo sapiens
aaacatgtggagtgtattaa

SEQ ID NO: 5072809 - DNA, 14 bp, Homo sapiens
aaacatgtgtttta

SEQ ID NO: 5072810 - DNA, 16 bp, Homo sapiens
aaacatgttagaagca

SEQ ID NO: 5072811 - DNA, 19 bp, Homo sapiens
aaacatgttagtcaaggac

SEQ ID NO: 5072812 - DNA, 20 bp, Homo sapiens
aaacatgttcccaaggcccc

SEQ ID NO: 5072813 - DNA, 12 bp, Homo sapiens
aaacatgttgat

SEQ ID NO: 5072814 - DNA, 22 bp, Homo sapiens
aaacatgttgccaaaatggtgg

SEQ ID NO: 5072815 - DNA, 19 bp, Homo sapiens
aaacatgtttaaatagcct

SEQ ID NO: 5072816 - DNA, 22 bp, Homo sapiens
aaacatgtttaaatagcctaaa

SEQ ID NO: 5072817 - DNA, 20 bp, Homo sapiens
aaacatgtttatttttcttg

SEQ ID NO: 5072818 - DNA, 12 bp, Homo sapiens
aaacatgtttcc

SEQ ID NO: 5072819 - DNA, 22 bp, Homo sapiens
aaacatgtttctttgtaatgaa

SEQ ID NO: 5072820 - DNA, 17 bp, Homo sapiens
aaacattaaaaatggaa

SEQ ID NO: 5072821 - DNA, 12 bp, Homo sapiens
aaacattaaaca

SEQ ID NO: 5072822 - DNA, 20 bp, Homo sapiens
aaacattaaatgtcttatat

SEQ ID NO: 5072823 - DNA, 13 bp, Homo sapiens
aaacattaagaaa

SEQ ID NO: 5072824 - DNA, 16 bp, Homo sapiens
aaacattaagaaaatc

SEQ ID NO: 5072825 - DNA, 20 bp, Homo sapiens
aaacattaagaaaatcatat

SEQ ID NO: 5072826 - DNA, 16 bp, Homo sapiens
aaacattaagtaaatg

SEQ ID NO: 5072827 - DNA, 20 bp, Homo sapiens
aaacattaatagcagccttt

SEQ ID NO: 5072828 - DNA, 22 bp, Homo sapiens
aaacattaatagcagcctttct

SEQ ID NO: 5072829 - DNA, 20 bp, Homo sapiens
aaacattaatatttaccaaa

SEQ ID NO: 5072830 - DNA, 19 bp, Homo sapiens
aaacattaatgttgatttc

SEQ ID NO: 5072831 - DNA, 20 bp, Homo sapiens
aaacattaatgttgatttct

SEQ ID NO: 5072832 - DNA, 22 bp, Homo sapiens
aaacattaatgttgatttctag

SEQ ID NO: 5072833 - DNA, 24 bp, Homo sapiens
aaacattaatgttgatttctagtt

SEQ ID NO: 5072834 - DNA, 18 bp, Homo sapiens
aaacattacagttcataa

SEQ ID NO: 5072835 - DNA, 14 bp, Homo sapiens
aaacattagaagaa

SEQ ID NO: 5072836 - DNA, 22 bp, Homo sapiens
aaacattagaagaaaacatata

SEQ ID NO: 5072837 - DNA, 14 bp, Homo sapiens
aaacattagtactt

SEQ ID NO: 5072838 - DNA, 22 bp, Homo sapiens
aaacattagttctatttctatc

SEQ ID NO: 5072839 - DNA, 12 bp, Homo sapiens
aaacattcactt

SEQ ID NO: 5072840 - DNA, 13 bp, Homo sapiens
aaacattcatcca

SEQ ID NO: 5072841 - DNA, 17 bp, Homo sapiens
aaacattcatgtaactc

SEQ ID NO: 5072842 - DNA, 13 bp, Homo sapiens
aaacattccaaga

SEQ ID NO: 5072843 - DNA, 17 bp, Homo sapiens
aaacattcctccagcct

SEQ ID NO: 5072844 - DNA, 12 bp, Homo sapiens
aaacattctatc

SEQ ID NO: 5072845 - DNA, 17 bp, Homo sapiens
aaacattctttaacata

SEQ ID NO: 5072846 - DNA, 19 bp, Homo sapiens
aaacattctttaacataca

SEQ ID NO: 5072847 - DNA, 13 bp, Homo sapiens
aaacattgaaata

SEQ ID NO: 5072848 - DNA, 20 bp, Homo sapiens
aaacattgaagtaatgaatt

SEQ ID NO: 5072849 - DNA, 19 bp, Homo sapiens
aaacattgacgattccttc

SEQ ID NO: 5072850 - DNA, 24 bp, Homo sapiens
aaacattgacgattccttctctga

SEQ ID NO: 5072851 - DNA, 16 bp, Homo sapiens
aaacattgagactgct

SEQ ID NO: 5072852 - DNA, 16 bp, Homo sapiens
aaacattgatgaatga

SEQ ID NO: 5072853 - DNA, 17 bp, Homo sapiens
aaacattgcctttgaat

SEQ ID NO: 5072854 - DNA, 12 bp, Homo sapiens
aaacattgctgc

SEQ ID NO: 5072855 - DNA, 13 bp, Homo sapiens
aaacattgctgcc

SEQ ID NO: 5072856 - DNA, 13 bp, Homo sapiens
aaacattgctttt

SEQ ID NO: 5072857 - DNA, 16 bp, Homo sapiens
aaacattgcttttaaa

SEQ ID NO: 5072858 - DNA, 14 bp, Homo sapiens
aaacattgtctaca

SEQ ID NO: 5072859 - DNA, 18 bp, Homo sapiens
aaacattgtgatgattat

SEQ ID NO: 5072860 - DNA, 22 bp, Homo sapiens
aaacattgttaatataatttaa

SEQ ID NO: 5072861 - DNA, 14 bp, Homo sapiens
aaacattgttttgt

SEQ ID NO: 5072862 - DNA, 17 bp, Homo sapiens
aaacattgttttgtgta

SEQ ID NO: 5072863 - DNA, 23 bp, Homo sapiens
aaacattgttttgtgtaacatat

SEQ ID NO: 5072864 - DNA, 16 bp, Homo sapiens
aaacatttaaactttt

SEQ ID NO: 5072865 - DNA, 15 bp, Homo sapiens
aaacatttaacataa

SEQ ID NO: 5072866 - DNA, 23 bp, Homo sapiens
aaacatttaacataatggttgtg

SEQ ID NO: 5072867 - DNA, 23 bp, Homo sapiens
aaacatttaacttgtttccaatg

SEQ ID NO: 5072868 - DNA, 23 bp, Homo sapiens
aaacatttacaataaatattctg

SEQ ID NO: 5072869 - DNA, 14 bp, Homo sapiens
aaacatttattttg

SEQ ID NO: 5072870 - DNA, 18 bp, Homo sapiens
aaacatttattttgacat

SEQ ID NO: 5072871 - DNA, 21 bp, Homo sapiens
aaacatttattttgacataaa

SEQ ID NO: 5072872 - DNA, 21 bp, Homo sapiens
aaacatttcaagtttactcct

SEQ ID NO: 5072873 - DNA, 20 bp, Homo sapiens
aaacatttcattatgaggtc

SEQ ID NO: 5072874 - DNA, 15 bp, Homo sapiens
aaacatttcatttcc

SEQ ID NO: 5072875 - DNA, 12 bp, Homo sapiens
aaacatttcctc

SEQ ID NO: 5072876 - DNA, 20 bp, Homo sapiens
aaacatttcctttttctatt

SEQ ID NO: 5072877 - DNA, 21 bp, Homo sapiens
aaacatttcctttttctattt

SEQ ID NO: 5072878 - DNA, 21 bp, Homo sapiens
aaacatttctggacagtacct

SEQ ID NO: 5072879 - DNA, 12 bp, Homo sapiens
aaacatttctgt

SEQ ID NO: 5072880 - DNA, 14 bp, Homo sapiens
aaacatttctgtga

SEQ ID NO: 5072881 - DNA, 16 bp, Homo sapiens
aaacatttctgtgaaa

SEQ ID NO: 5072882 - DNA, 20 bp, Homo sapiens
aaacatttctttttccttct

SEQ ID NO: 5072883 - DNA, 19 bp, Homo sapiens
aaacatttgacacataaaa

SEQ ID NO: 5072884 - DNA, 22 bp, Homo sapiens
aaacatttgacacataaaagta

SEQ ID NO: 5072885 - DNA, 14 bp, Homo sapiens
aaacatttgctgaa

SEQ ID NO: 5072886 - DNA, 18 bp, Homo sapiens
aaacatttgtaaaaatac

SEQ ID NO: 5072887 - DNA, 14 bp, Homo sapiens
aaacattttaaaaa

SEQ ID NO: 5072888 - DNA, 14 bp, Homo sapiens
aaacattttacatg

SEQ ID NO: 5072889 - DNA, 18 bp, Homo sapiens
aaacattttatactgtac

SEQ ID NO: 5072890 - DNA, 22 bp, Homo sapiens
aaacattttatcattaaaaatt

SEQ ID NO: 5072891 - DNA, 14 bp, Homo sapiens
aaacattttcacac

SEQ ID NO: 5072892 - DNA, 14 bp, Homo sapiens
aaacattttcatgc

SEQ ID NO: 5072893 - DNA, 20 bp, Homo sapiens
aaacattttctcttagaaaa

SEQ ID NO: 5072894 - DNA, 16 bp, Homo sapiens
aaacattttctttctt

SEQ ID NO: 5072895 - DNA, 18 bp, Homo sapiens
aaacattttctttctttt

SEQ ID NO: 5072896 - DNA, 15 bp, Homo sapiens
aaacattttgaagtg

SEQ ID NO: 5072897 - DNA, 17 bp, Homo sapiens
aaacattttgaagtgtg

SEQ ID NO: 5072898 - DNA, 23 bp, Homo sapiens
aaacattttgtatgctgcatgaa

SEQ ID NO: 5072899 - DNA, 20 bp, Homo sapiens
aaacatttttaatttaacaa

SEQ ID NO: 5072900 - DNA, 15 bp, Homo sapiens
aaacattttttaaga

SEQ ID NO: 5072901 - DNA, 21 bp, Homo sapiens
aaacattttttatacatttgg

SEQ ID NO: 5072902 - DNA, 17 bp, Homo sapiens
aaacattttttcttctg

SEQ ID NO: 5072903 - DNA, 18 bp, Homo sapiens
aaacattttttcttctga

SEQ ID NO: 5072904 - DNA, 21 bp, Homo sapiens
aaaccaaaaaaaaaaaaaatc

SEQ ID NO: 5072905 - DNA, 15 bp, Homo sapiens
aaaccaaaaactgaa

SEQ ID NO: 5072906 - DNA, 12 bp, Homo sapiens
aaaccaaaaaga

SEQ ID NO: 5072907 - DNA, 20 bp, Homo sapiens
aaaccaaaaggccgtgtgtt

SEQ ID NO: 5072908 - DNA, 18 bp, Homo sapiens
aaaccaaaatgacatctt

SEQ ID NO: 5072909 - DNA, 14 bp, Homo sapiens
aaaccaaaatgata

SEQ ID NO: 5072910 - DNA, 16 bp, Homo sapiens
aaaccaaacccagcca

SEQ ID NO: 5072911 - DNA, 20 bp, Homo sapiens
aaaccaaacttgttcattta

SEQ ID NO: 5072912 - DNA, 16 bp, Homo sapiens
aaaccaaagaaacata

SEQ ID NO: 5072913 - DNA, 14 bp, Homo sapiens
aaaccaaagaagaa

SEQ ID NO: 5072914 - DNA, 20 bp, Homo sapiens
aaaccaaagagggcttcctc

SEQ ID NO: 5072915 - DNA, 20 bp, Homo sapiens
aaaccaaagagtattcagtg

SEQ ID NO: 5072916 - DNA, 13 bp, Homo sapiens
aaaccaaagccag

SEQ ID NO: 5072917 - DNA, 13 bp, Homo sapiens
aaaccaaaggaca

SEQ ID NO: 5072918 - DNA, 13 bp, Homo sapiens
aaaccaacaatta

SEQ ID NO: 5072919 - DNA, 14 bp, Homo sapiens
aaaccaactctaat

SEQ ID NO: 5072920 - DNA, 17 bp, Homo sapiens
aaaatgcaaaaaatctt

SEQ ID NO: 5072921 - DNA, 11 bp, Homo sapiens
aaaatgcaaag

SEQ ID NO: 5072922 - DNA, 12 bp, Homo sapiens
aaaatgcaaagc

SEQ ID NO: 5072923 - DNA, 14 bp, Homo sapiens
aaaatgcaaagctg

SEQ ID NO: 5072924 - DNA, 18 bp, Homo sapiens
aaaatgcaaatgaatcat

SEQ ID NO: 5072925 - DNA, 14 bp, Homo sapiens
aaaatgcaacaaat

SEQ ID NO: 5072926 - DNA, 12 bp, Homo sapiens
aaaatgcaatat

SEQ ID NO: 5072927 - DNA, 23 bp, Homo sapiens
aaaatgcaatcaggattttaaac

SEQ ID NO: 5072928 - DNA, 12 bp, Homo sapiens
aaaatgcaattt

SEQ ID NO: 5072929 - DNA, 14 bp, Homo sapiens
aaaatgcaatttga

SEQ ID NO: 5072930 - DNA, 14 bp, Homo sapiens
aaaatgcacgtagc

SEQ ID NO: 5072931 - DNA, 19 bp, Homo sapiens
aaaatgcaggtgaactttt

SEQ ID NO: 5072932 - DNA, 21 bp, Homo sapiens
aaaatgcagtccagaataagt

SEQ ID NO: 5072933 - DNA, 16 bp, Homo sapiens
aaaatgcatacgtatt

SEQ ID NO: 5072934 - DNA, 23 bp, Homo sapiens
aaaatgcatactgttgatacaaa

SEQ ID NO: 5072935 - DNA, 16 bp, Homo sapiens
aaaatgcatgataatg

SEQ ID NO: 5072936 - DNA, 15 bp, Homo sapiens
aaaatgcattatgtg

SEQ ID NO: 5072937 - DNA, 15 bp, Homo sapiens
aaaatgcattattta

SEQ ID NO: 5072938 - DNA, 19 bp, Homo sapiens
aaaatgcattgaaagaatt

SEQ ID NO: 5072939 - DNA, 18 bp, Homo sapiens
aaaatgcatttaagttgt

SEQ ID NO: 5072940 - DNA, 19 bp, Homo sapiens
aaaatgcatttaagttgta

SEQ ID NO: 5072941 - DNA, 23 bp, Homo sapiens
aaaatgcatttaagttgtaaacg

SEQ ID NO: 5072942 - DNA, 20 bp, Homo sapiens
aaaatgcattttcttcagaa

SEQ ID NO: 5072943 - DNA, 17 bp, Homo sapiens
aaaatgccaaaaacaaa

SEQ ID NO: 5072944 - DNA, 23 bp, Homo sapiens
aaaatgccaagggggtgactgga

SEQ ID NO: 5072945 - DNA, 20 bp, Homo sapiens
aaaatgccactccctaccca

SEQ ID NO: 5072946 - DNA, 19 bp, Homo sapiens
aaaatgccacttaacagga

SEQ ID NO: 5072947 - DNA, 17 bp, Homo sapiens
aaaatgccataatacaa

SEQ ID NO: 5072948 - DNA, 18 bp, Homo sapiens
aaaatgccataatacaaa

SEQ ID NO: 5072949 - DNA, 16 bp, Homo sapiens
aaaatgccatgaatta

SEQ ID NO: 5072950 - DNA, 21 bp, Homo sapiens
aaaatgccatttagcaataaa

SEQ ID NO: 5072951 - DNA, 15 bp, Homo sapiens
aaaatgcccatttgt

SEQ ID NO: 5072952 - DNA, 19 bp, Homo sapiens
aaaatgcctcaattcacat

SEQ ID NO: 5072953 - DNA, 22 bp, Homo sapiens
aaaatgcctcagtgtatttgta

SEQ ID NO: 5072954 - DNA, 15 bp, Homo sapiens
aaaatgcctgctgct

SEQ ID NO: 5072955 - DNA, 16 bp, Homo sapiens
aaaatgcctgctgctg

SEQ ID NO: 5072956 - DNA, 12 bp, Homo sapiens
aaaatgcctttg

SEQ ID NO: 5072957 - DNA, 17 bp, Homo sapiens
aaaatgcctttgagaca

SEQ ID NO: 5072958 - DNA, 22 bp, Homo sapiens
aaaatgcctttgagacagtttc

SEQ ID NO: 5072959 - DNA, 21 bp, Homo sapiens
aaaatgcggcactatttctga

SEQ ID NO: 5072960 - DNA, 22 bp, Homo sapiens
aaaatgcggttataaaaaatgg

SEQ ID NO: 5072961 - DNA, 16 bp, Homo sapiens
aaaatgctaggttcta

SEQ ID NO: 5072962 - DNA, 11 bp, Homo sapiens
aaaatgctatc

SEQ ID NO: 5072963 - DNA, 16 bp, Homo sapiens
aaaatgctcaatttca

SEQ ID NO: 5072964 - DNA, 14 bp, Homo sapiens
aaaatgctctaatg

SEQ ID NO: 5072965 - DNA, 21 bp, Homo sapiens
aaaatgctcttaaaatatctt

SEQ ID NO: 5072966 - DNA, 17 bp, Homo sapiens
aaaatgctcttatttca

SEQ ID NO: 5072967 - DNA, 18 bp, Homo sapiens
aaaatgctcttatttcat

SEQ ID NO: 5072968 - DNA, 16 bp, Homo sapiens
aaaatgctgaacattg

SEQ ID NO: 5072969 - DNA, 20 bp, Homo sapiens
aaaatgctgaacattgcata

SEQ ID NO: 5072970 - DNA, 17 bp, Homo sapiens
aaaatgctgacaaaaat

SEQ ID NO: 5072971 - DNA, 22 bp, Homo sapiens
aaaatgctgaggtaataattat

SEQ ID NO: 5072972 - DNA, 23 bp, Homo sapiens
aaaatgctgcctagtgctacaga

SEQ ID NO: 5072973 - DNA, 17 bp, Homo sapiens
aaaatgctgctttgtcc

SEQ ID NO: 5072974 - DNA, 19 bp, Homo sapiens
aaaatgctggtgaaatgct

SEQ ID NO: 5072975 - DNA, 16 bp, Homo sapiens
aaaatgcttacatttg

SEQ ID NO: 5072976 - DNA, 14 bp, Homo sapiens
aaaatgcttcaaag

SEQ ID NO: 5072977 - DNA, 11 bp, Homo sapiens
aaaatgcttct

SEQ ID NO: 5072978 - DNA, 16 bp, Homo sapiens
aaaatgcttcttggct

SEQ ID NO: 5072979 - DNA, 20 bp, Homo sapiens
aaaatgcttgaccctgaaat

SEQ ID NO: 5072980 - DNA, 13 bp, Homo sapiens
aaaatgctttctc

SEQ ID NO: 5072981 - DNA, 19 bp, Homo sapiens
aaaatgctttctcatgcat

SEQ ID NO: 5072982 - DNA, 14 bp, Homo sapiens
aaaatgcttttaat

SEQ ID NO: 5072983 - DNA, 13 bp, Homo sapiens
aaaatgcttttta

SEQ ID NO: 5072984 - DNA, 11 bp, Homo sapiens
aaaatggaaaa

SEQ ID NO: 5072985 - DNA, 16 bp, Homo sapiens
aaaatggaaaaaaaca

SEQ ID NO: 5072986 - DNA, 12 bp, Homo sapiens
aaaatggaaaga

SEQ ID NO: 5072987 - DNA, 16 bp, Homo sapiens
aaaatggaaagaagga

SEQ ID NO: 5072988 - DNA, 18 bp, Homo sapiens
aaaatggaaagaaggaaa

SEQ ID NO: 5072989 - DNA, 14 bp, Homo sapiens
aaaatggaaagaat

SEQ ID NO: 5072990 - DNA, 20 bp, Homo sapiens
aaaatggaagcaaagacaaa

SEQ ID NO: 5072991 - DNA, 15 bp, Homo sapiens
aaaatggaattactc

SEQ ID NO: 5072992 - DNA, 16 bp, Homo sapiens
aaaatggacacaaatt

SEQ ID NO: 5072993 - DNA, 15 bp, Homo sapiens
aaaatggagacacca

SEQ ID NO: 5072994 - DNA, 22 bp, Homo sapiens
aaaatggagctcagtaacataa

SEQ ID NO: 5072995 - DNA, 13 bp, Homo sapiens
aaaatggatagaa

SEQ ID NO: 5072996 - DNA, 17 bp, Homo sapiens
aaaatggatgacaaaga

SEQ ID NO: 5072997 - DNA, 21 bp, Homo sapiens
aaaatggatgacaaagaaaat

SEQ ID NO: 5072998 - DNA, 21 bp, Homo sapiens
aaaatggatgccttgaataat

SEQ ID NO: 5072999 - DNA, 22 bp, Homo sapiens
aaaatggattttagtcaaatat

SEQ ID NO: 5073000 - DNA, 15 bp, Homo sapiens
aaaatggcaagagat

SEQ ID NO: 5073001 - DNA, 14 bp, Homo sapiens
aaaatggcagaaag

SEQ ID NO: 5073002 - DNA, 21 bp, Homo sapiens
aaaatggcagggggtggaatt

SEQ ID NO: 5073003 - DNA, 23 bp, Homo sapiens
aaaatggcatccagggctgccag

SEQ ID NO: 5073004 - DNA, 18 bp, Homo sapiens
aaaatggcatttagcaca

SEQ ID NO: 5073005 - DNA, 21 bp, Homo sapiens
aaaatggctaataaactgtat

SEQ ID NO: 5073006 - DNA, 22 bp, Homo sapiens
aaaatggctaataaactgtatt

SEQ ID NO: 5073007 - DNA, 16 bp, Homo sapiens
aaaatggctagaatta

SEQ ID NO: 5073008 - DNA, 14 bp, Homo sapiens
aaaatggctgaaga

SEQ ID NO: 5073009 - DNA, 17 bp, Homo sapiens
aaaatgggaagactgag

SEQ ID NO: 5073010 - DNA, 22 bp, Homo sapiens
aaaatgggaagcattagttgga

SEQ ID NO: 5073011 - DNA, 13 bp, Homo sapiens
aaaatgggaggag

SEQ ID NO: 5073012 - DNA, 15 bp, Homo sapiens
aaaatgggaggagga

SEQ ID NO: 5073013 - DNA, 18 bp, Homo sapiens
aaaatgggtaattttctt

SEQ ID NO: 5073014 - DNA, 16 bp, Homo sapiens
aaaatggtaaaattgc

SEQ ID NO: 5073015 - DNA, 17 bp, Homo sapiens
aaaatggtaaaattgca

SEQ ID NO: 5073016 - DNA, 21 bp, Homo sapiens
aaaatggtacagcttctggag

SEQ ID NO: 5073017 - DNA, 22 bp, Homo sapiens
aaaatggtagcattttaaacaa

SEQ ID NO: 5073018 - DNA, 22 bp, Homo sapiens
aaaatggtgagcgatcatttat

SEQ ID NO: 5073019 - DNA, 23 bp, Homo sapiens
aaaatggtgttttcatgtaaata

SEQ ID NO: 5073020 - DNA, 16 bp, Homo sapiens
aaaatggttatgtgca

SEQ ID NO: 5073021 - DNA, 19 bp, Homo sapiens
aaaatggttgatggaaaat

SEQ ID NO: 5073022 - DNA, 17 bp, Homo sapiens
aaaatgtaaaaaacaaa

SEQ ID NO: 5073023 - DNA, 24 bp, Homo sapiens
aaaatgtaaaaaccctgctaaatg

SEQ ID NO: 5073024 - DNA, 15 bp, Homo sapiens
aaaatgtaaactgct

SEQ ID NO: 5073025 - DNA, 14 bp, Homo sapiens
aaaatgtaaagcca

SEQ ID NO: 5073026 - DNA, 17 bp, Homo sapiens
aaaatgtaaatactcat

SEQ ID NO: 5073027 - DNA, 23 bp, Homo sapiens
aaaatgtaaattagtttgacact

SEQ ID NO: 5073028 - DNA, 12 bp, Homo sapiens
aaaatgtaacat

SEQ ID NO: 5073029 - DNA, 23 bp, Homo sapiens
aaaatgtaacatcataattacat

SEQ ID NO: 5073030 - DNA, 13 bp, Homo sapiens
aaaatgtaactgt

SEQ ID NO: 5073031 - DNA, 16 bp, Homo sapiens
aaaatgtaactgttac

SEQ ID NO: 5073032 - DNA, 12 bp, Homo sapiens
aaaatgtaactt

SEQ ID NO: 5073033 - DNA, 21 bp, Homo sapiens
aaaatgtaagctgtttatttt

SEQ ID NO: 5073034 - DNA, 16 bp, Homo sapiens
aaaatgtaataacttt

SEQ ID NO: 5073035 - DNA, 18 bp, Homo sapiens
aaaatgtaatttaaatga

SEQ ID NO: 5073036 - DNA, 12 bp, Homo sapiens
aaaatgtacact

SEQ ID NO: 5073037 - DNA, 14 bp, Homo sapiens
aaaatgtacatgta

SEQ ID NO: 5073038 - DNA, 21 bp, Homo sapiens
aaaatgtacatgtattaaatt

SEQ ID NO: 5073039 - DNA, 10 bp, Homo sapiens
aaaatgtact

SEQ ID NO: 5073040 - DNA, 14 bp, Homo sapiens
aaaatgtagaaatt

SEQ ID NO: 5073041 - DNA, 16 bp, Homo sapiens
aaaatgtagaaattct

SEQ ID NO: 5073042 - DNA, 20 bp, Homo sapiens
aaaatgtagaaattctaact

SEQ ID NO: 5073043 - DNA, 16 bp, Homo sapiens
aaaatgtagaagaaag

SEQ ID NO: 5073044 - DNA, 12 bp, Homo sapiens
aaaatgtagctg

SEQ ID NO: 5073045 - DNA, 15 bp, Homo sapiens
aaaatgtagctgcgt

SEQ ID NO: 5073046 - DNA, 23 bp, Homo sapiens
aaaatgtagcttttatgtgatat

SEQ ID NO: 5073047 - DNA, 14 bp, Homo sapiens
aaaatgtatatatt

SEQ ID NO: 5073048 - DNA, 14 bp, Homo sapiens
aaaatgtatatgca

SEQ ID NO: 5073049 - DNA, 12 bp, Homo sapiens
aaaatgtatgtt

SEQ ID NO: 5073050 - DNA, 23 bp, Homo sapiens
aaaatgtattcctttaaaatatt

SEQ ID NO: 5073051 - DNA, 15 bp, Homo sapiens
aaaatgtattttatg

SEQ ID NO: 5073052 - DNA, 17 bp, Homo sapiens
aaaatgtattttatgtt

SEQ ID NO: 5073053 - DNA, 14 bp, Homo sapiens
aaaatgtcaaaagt

SEQ ID NO: 5073054 - DNA, 21 bp, Homo sapiens
aaaatgtcaaaagtagaactt

SEQ ID NO: 5073055 - DNA, 22 bp, Homo sapiens
aaaatgtcaaagagaaaactta

SEQ ID NO: 5073056 - DNA, 16 bp, Homo sapiens
aaaatgtcaagacagg

SEQ ID NO: 5073057 - DNA, 15 bp, Homo sapiens
aaaatgtcactgaag

SEQ ID NO: 5073058 - DNA, 20 bp, Homo sapiens
aaaatgtcactgaagtgatt

SEQ ID NO: 5073059 - DNA, 23 bp, Homo sapiens
aaaatgtcactgaagtgattgaa

SEQ ID NO: 5073060 - DNA, 16 bp, Homo sapiens
aaaatgtcctgccttt

SEQ ID NO: 5073061 - DNA, 17 bp, Homo sapiens
aaaatgtcctgcctttt

SEQ ID NO: 5073062 - DNA, 13 bp, Homo sapiens
aaaatgtctcagt

SEQ ID NO: 5073063 - DNA, 19 bp, Homo sapiens
aaaatgtctcagtatttta

SEQ ID NO: 5073064 - DNA, 20 bp, Homo sapiens
aaaatgtctcagtattttag

SEQ ID NO: 5073065 - DNA, 21 bp, Homo sapiens
aaaatgtctgtagctcctcaa

SEQ ID NO: 5073066 - DNA, 18 bp, Homo sapiens
aaaatgtctgttaactta

SEQ ID NO: 5073067 - DNA, 18 bp, Homo sapiens
aaaatgtctgttttccaa

SEQ ID NO: 5073068 - DNA, 22 bp, Homo sapiens
aaaatgtcttggtcttctactg

SEQ ID NO: 5073069 - DNA, 20 bp, Homo sapiens
aaaatgtgaaaaaaattatt

SEQ ID NO: 5073070 - DNA, 16 bp, Homo sapiens
aaaatgtgaaaaacta

SEQ ID NO: 5073071 - DNA, 18 bp, Homo sapiens
aaaatgtgaaaaactaat

SEQ ID NO: 5073072 - DNA, 15 bp, Homo sapiens
aaaatgtgaaatctc

SEQ ID NO: 5073073 - DNA, 13 bp, Homo sapiens
aaaatgtgaaatg

SEQ ID NO: 5073074 - DNA, 15 bp, Homo sapiens
aaaatgtgaaatgct

SEQ ID NO: 5073075 - DNA, 19 bp, Homo sapiens
aaaatgtgaaatttttcca

SEQ ID NO: 5073076 - DNA, 21 bp, Homo sapiens
aaaatgtgaaatttttccaca

SEQ ID NO: 5073077 - DNA, 18 bp, Homo sapiens
aaaatgtgaataaaatta

SEQ ID NO: 5073078 - DNA, 22 bp, Homo sapiens
aaaatgtgacatctttggtcat

SEQ ID NO: 5073079 - DNA, 16 bp, Homo sapiens
aaaatgtgacccagat

SEQ ID NO: 5073080 - DNA, 20 bp, Homo sapiens
aaaatgtgagtggttgaata

SEQ ID NO: 5073081 - DNA, 17 bp, Homo sapiens
aaaatgtgcaaaacagc

SEQ ID NO: 5073082 - DNA, 23 bp, Homo sapiens
aaaatgtgcagtaatagcactgc

SEQ ID NO: 5073083 - DNA, 20 bp, Homo sapiens
aaaatgtgctatactgcata

SEQ ID NO: 5073084 - DNA, 14 bp, Homo sapiens
aaaatgtgctgcct

SEQ ID NO: 5073085 - DNA, 16 bp, Homo sapiens
aaaatgtgtaattcaa

SEQ ID NO: 5073086 - DNA, 16 bp, Homo sapiens
aaaatgtgtaattttg

SEQ ID NO: 5073087 - DNA, 17 bp, Homo sapiens
aaaatgtgtaattttgt

SEQ ID NO: 5073088 - DNA, 17 bp, Homo sapiens
aaaatgtgtcagcatgc

SEQ ID NO: 5073089 - DNA, 14 bp, Homo sapiens
aaaatgtgtgccat

SEQ ID NO: 5073090 - DNA, 14 bp, Homo sapiens
aaaatgtgtgtttt

SEQ ID NO: 5073091 - DNA, 13 bp, Homo sapiens
aaaatgtgtttca

SEQ ID NO: 5073092 - DNA, 14 bp, Homo sapiens
aaaatgtgtttgct

SEQ ID NO: 5073093 - DNA, 14 bp, Homo sapiens
aaaatgtgtttttc

SEQ ID NO: 5073094 - DNA, 13 bp, Homo sapiens
aaaatgttaaaac

SEQ ID NO: 5073095 - DNA, 12 bp, Homo sapiens
aaaatgttaaca

SEQ ID NO: 5073096 - DNA, 13 bp, Homo sapiens
aaaatgttaataa

SEQ ID NO: 5073097 - DNA, 15 bp, Homo sapiens
aaaatgttaataaag

SEQ ID NO: 5073098 - DNA, 11 bp, Homo sapiens
aaaatgttacc

SEQ ID NO: 5073099 - DNA, 21 bp, Homo sapiens
aaaatgttacggcatcacact

SEQ ID NO: 5073100 - DNA, 18 bp, Homo sapiens
aaaccaactgttgacata

SEQ ID NO: 5073101 - DNA, 14 bp, Homo sapiens
aaaccaagaaggag

SEQ ID NO: 5073102 - DNA, 21 bp, Homo sapiens
aaaccaagaaggagacctttt

SEQ ID NO: 5073103 - DNA, 13 bp, Homo sapiens
aaaccaagactaa

SEQ ID NO: 5073104 - DNA, 17 bp, Homo sapiens
aaaccaagagattgcta

SEQ ID NO: 5073105 - DNA, 19 bp, Homo sapiens
aaaccaagagattgctaat

SEQ ID NO: 5073106 - DNA, 14 bp, Homo sapiens
aaaccaagcagctt

SEQ ID NO: 5073107 - DNA, 16 bp, Homo sapiens
aaaccaagcatcaggg

SEQ ID NO: 5073108 - DNA, 23 bp, Homo sapiens
aaaccaagccattaatgagatgt

SEQ ID NO: 5073109 - DNA, 16 bp, Homo sapiens
aaaccaagcctctgga

SEQ ID NO: 5073110 - DNA, 14 bp, Homo sapiens
aaaccaagccttgg

SEQ ID NO: 5073111 - DNA, 23 bp, Homo sapiens
aaaccaagtcaagtgaaaaagga

SEQ ID NO: 5073112 - DNA, 17 bp, Homo sapiens
aaaccaatcctatgcat

SEQ ID NO: 5073113 - DNA, 14 bp, Homo sapiens
aaaccaatgaagaa

SEQ ID NO: 5073114 - DNA, 19 bp, Homo sapiens
aaaccaatgaagaagacaa

SEQ ID NO: 5073115 - DNA, 12 bp, Homo sapiens
aaaccaatgatt

SEQ ID NO: 5073116 - DNA, 13 bp, Homo sapiens
aaaccaatgctga

SEQ ID NO: 5073117 - DNA, 19 bp, Homo sapiens
aaaccaatggtgatcctct

SEQ ID NO: 5073118 - DNA, 18 bp, Homo sapiens
aaaccaatttcttccttc

SEQ ID NO: 5073119 - DNA, 17 bp, Homo sapiens
aaaccaatttgttctgt

SEQ ID NO: 5073120 - DNA, 15 bp, Homo sapiens
aaaccacaaaaaaat

SEQ ID NO: 5073121 - DNA, 14 bp, Homo sapiens
aaaccacaaaagtt

SEQ ID NO: 5073122 - DNA, 12 bp, Homo sapiens
aaaccacaaagg

SEQ ID NO: 5073123 - DNA, 22 bp, Homo sapiens
aaaccacaaaggccaaactgct

SEQ ID NO: 5073124 - DNA, 21 bp, Homo sapiens
aaaccacaactgacacaggaa

SEQ ID NO: 5073125 - DNA, 14 bp, Homo sapiens
aaaccacaactttt

SEQ ID NO: 5073126 - DNA, 16 bp, Homo sapiens
aaaccacaagcatctc

SEQ ID NO: 5073127 - DNA, 21 bp, Homo sapiens
aaaccacaaggctgttgcatg

SEQ ID NO: 5073128 - DNA, 16 bp, Homo sapiens
aaaccacacttcttga

SEQ ID NO: 5073129 - DNA, 12 bp, Homo sapiens
aaaccacagcag

SEQ ID NO: 5073130 - DNA, 13 bp, Homo sapiens
aaaccacagcagg

SEQ ID NO: 5073131 - DNA, 16 bp, Homo sapiens
aaaccacagcagttga

SEQ ID NO: 5073132 - DNA, 14 bp, Homo sapiens
aaaccacagtcagt

SEQ ID NO: 5073133 - DNA, 18 bp, Homo sapiens
aaaccacataatttttgt

SEQ ID NO: 5073134 - DNA, 15 bp, Homo sapiens
aaaccacatgggctg

SEQ ID NO: 5073135 - DNA, 18 bp, Homo sapiens
aaaccacatgggctgggg

SEQ ID NO: 5073136 - DNA, 18 bp, Homo sapiens
aaaccaccagaagcccag

SEQ ID NO: 5073137 - DNA, 18 bp, Homo sapiens
aaaccacccacaaagaaa

SEQ ID NO: 5073138 - DNA, 21 bp, Homo sapiens
aaaccaccctaaaatgacagc

SEQ ID NO: 5073139 - DNA, 18 bp, Homo sapiens
aaaccaccctctggggac

SEQ ID NO: 5073140 - DNA, 19 bp, Homo sapiens
aaaccactcagtaaaagca

SEQ ID NO: 5073141 - DNA, 17 bp, Homo sapiens
aaaccactgaaaaaata

SEQ ID NO: 5073142 - DNA, 14 bp, Homo sapiens
aaaccactgtacat

SEQ ID NO: 5073143 - DNA, 15 bp, Homo sapiens
aaaccactgtacata

SEQ ID NO: 5073144 - DNA, 16 bp, Homo sapiens
aaaccacttgagccta

SEQ ID NO: 5073145 - DNA, 12 bp, Homo sapiens
aaaccacttgcc

SEQ ID NO: 5073146 - DNA, 13 bp, Homo sapiens
aaaccagaaaaaa

SEQ ID NO: 5073147 - DNA, 20 bp, Homo sapiens
aaaccagaaagaggaataaa

SEQ ID NO: 5073148 - DNA, 16 bp, Homo sapiens
aaaccagaagactgga

SEQ ID NO: 5073149 - DNA, 17 bp, Homo sapiens
aaaccagaatcataatt

SEQ ID NO: 5073150 - DNA, 17 bp, Homo sapiens
aaaccagagaaaggaaa

SEQ ID NO: 5073151 - DNA, 15 bp, Homo sapiens
aaaccagaggcagct

SEQ ID NO: 5073152 - DNA, 17 bp, Homo sapiens
aaaccagagtctgtatt

SEQ ID NO: 5073153 - DNA, 17 bp, Homo sapiens
aaaccagcagaaaagtg

SEQ ID NO: 5073154 - DNA, 18 bp, Homo sapiens
aaaccagcagaaaagtgc

SEQ ID NO: 5073155 - DNA, 20 bp, Homo sapiens
aaaccagcagaaaagtgctt

SEQ ID NO: 5073156 - DNA, 14 bp, Homo sapiens
aaaccagcctcagc

SEQ ID NO: 5073157 - DNA, 22 bp, Homo sapiens
aaaccagctacttgatgtaact

SEQ ID NO: 5073158 - DNA, 12 bp, Homo sapiens
aaaccagcttcc

SEQ ID NO: 5073159 - DNA, 18 bp, Homo sapiens
aaaccagcttccttcaga

SEQ ID NO: 5073160 - DNA, 13 bp, Homo sapiens
aaaccaggaaaaa

SEQ ID NO: 5073161 - DNA, 18 bp, Homo sapiens
aaaccaggaaaaaataaa

SEQ ID NO: 5073162 - DNA, 23 bp, Homo sapiens
aaaccaggacactaccctgagat

SEQ ID NO: 5073163 - DNA, 15 bp, Homo sapiens
aaaccaggcctctgc

SEQ ID NO: 5073164 - DNA, 16 bp, Homo sapiens
aaaccaggctgcaggt

SEQ ID NO: 5073165 - DNA, 12 bp, Homo sapiens
aaaccagggagc

SEQ ID NO: 5073166 - DNA, 20 bp, Homo sapiens
aaaccaggtcaccatcctca

SEQ ID NO: 5073167 - DNA, 20 bp, Homo sapiens
aaaccaggtccaatgagctt

SEQ ID NO: 5073168 - DNA, 19 bp, Homo sapiens
aaaccagtatacaagataa

SEQ ID NO: 5073169 - DNA, 16 bp, Homo sapiens
aaaccagtatggaagg

SEQ ID NO: 5073170 - DNA, 22 bp, Homo sapiens
aaaccagtattgtacaaagtat

SEQ ID NO: 5073171 - DNA, 12 bp, Homo sapiens
aaaccagtgtga

SEQ ID NO: 5073172 - DNA, 22 bp, Homo sapiens
aaaccagtttaaggaacttctg

SEQ ID NO: 5073173 - DNA, 17 bp, Homo sapiens
aaaccataaaataaata

SEQ ID NO: 5073174 - DNA, 13 bp, Homo sapiens
aaaccataaacat

SEQ ID NO: 5073175 - DNA, 18 bp, Homo sapiens
aaaccataaacatttgca

SEQ ID NO: 5073176 - DNA, 13 bp, Homo sapiens
aaaccataaactt

SEQ ID NO: 5073177 - DNA, 22 bp, Homo sapiens
aaaccatcaagttgtgccaaat

SEQ ID NO: 5073178 - DNA, 20 bp, Homo sapiens
aaaccatcagatatttctta

SEQ ID NO: 5073179 - DNA, 18 bp, Homo sapiens
aaaccatcattgaaatct

SEQ ID NO: 5073180 - DNA, 23 bp, Homo sapiens
aaaccatccagtgacaaaccatc

SEQ ID NO: 5073181 - DNA, 16 bp, Homo sapiens
aaaccatcctgtttga

SEQ ID NO: 5073182 - DNA, 22 bp, Homo sapiens
aaaccatctccctggtgcttat

SEQ ID NO: 5073183 - DNA, 15 bp, Homo sapiens
aaaccatctggcctg

SEQ ID NO: 5073184 - DNA, 21 bp, Homo sapiens
aaaccatctggtgcctttcca

SEQ ID NO: 5073185 - DNA, 14 bp, Homo sapiens
aaaccatcttctgt

SEQ ID NO: 5073186 - DNA, 12 bp, Homo sapiens
aaaccatgaaaa

SEQ ID NO: 5073187 - DNA, 19 bp, Homo sapiens
aaaccatgaaaagttttca

SEQ ID NO: 5073188 - DNA, 13 bp, Homo sapiens
aaaccatgactgt

SEQ ID NO: 5073189 - DNA, 21 bp, Homo sapiens
aaaccatgactgtgaccacct

SEQ ID NO: 5073190 - DNA, 15 bp, Homo sapiens
aaaccatgcctggta

SEQ ID NO: 5073191 - DNA, 18 bp, Homo sapiens
aaaccatggattgtacat

SEQ ID NO: 5073192 - DNA, 22 bp, Homo sapiens
aaaccatgtgactaaaaatgca

SEQ ID NO: 5073193 - DNA, 16 bp, Homo sapiens
aaaccattgatgttta

SEQ ID NO: 5073194 - DNA, 16 bp, Homo sapiens
aaaccattgccatcat

SEQ ID NO: 5073195 - DNA, 15 bp, Homo sapiens
aaaccattgctctta

SEQ ID NO: 5073196 - DNA, 21 bp, Homo sapiens
aaaccattggacagatttcag

SEQ ID NO: 5073197 - DNA, 15 bp, Homo sapiens
aaaccattgtaacta

SEQ ID NO: 5073198 - DNA, 21 bp, Homo sapiens
aaaccatttaattcataatta

SEQ ID NO: 5073199 - DNA, 14 bp, Homo sapiens
aaaccatttcaaat

SEQ ID NO: 5073200 - DNA, 20 bp, Homo sapiens
aaaccattttcccatcatcc

SEQ ID NO: 5073201 - DNA, 23 bp, Homo sapiens
aaaccattttcccatcatccttt

SEQ ID NO: 5073202 - DNA, 17 bp, Homo sapiens
aaaccatttttaaagta

SEQ ID NO: 5073203 - DNA, 13 bp, Homo sapiens
aaaccatttttgc

SEQ ID NO: 5073204 - DNA, 19 bp, Homo sapiens
aaaccatttttgctgaatt

SEQ ID NO: 5073205 - DNA, 16 bp, Homo sapiens
aaacccaaaaaagaac

SEQ ID NO: 5073206 - DNA, 19 bp, Homo sapiens
aaacccaaaggtggcagct

SEQ ID NO: 5073207 - DNA, 17 bp, Homo sapiens
aaacccaaataaatgtg

SEQ ID NO: 5073208 - DNA, 13 bp, Homo sapiens
aaacccaactaag

SEQ ID NO: 5073209 - DNA, 16 bp, Homo sapiens
aaacccaactaagcca

SEQ ID NO: 5073210 - DNA, 13 bp, Homo sapiens
aaacccaagtccc

SEQ ID NO: 5073211 - DNA, 14 bp, Homo sapiens
aaacccaagttttt

SEQ ID NO: 5073212 - DNA, 15 bp, Homo sapiens
aaacccaagttttta

SEQ ID NO: 5073213 - DNA, 17 bp, Homo sapiens
aaacccaatacttttgt

SEQ ID NO: 5073214 - DNA, 15 bp, Homo sapiens
aaacccaatccaaat

SEQ ID NO: 5073215 - DNA, 13 bp, Homo sapiens
aaacccacaaaaa

SEQ ID NO: 5073216 - DNA, 11 bp, Homo sapiens
aaacccacagt

SEQ ID NO: 5073217 - DNA, 12 bp, Homo sapiens
aaacccacagtt

SEQ ID NO: 5073218 - DNA, 16 bp, Homo sapiens
aaacccacataaacac

SEQ ID NO: 5073219 - DNA, 17 bp, Homo sapiens
aaacccacataaacact

SEQ ID NO: 5073220 - DNA, 19 bp, Homo sapiens
aaacccacataaacacttc

SEQ ID NO: 5073221 - DNA, 14 bp, Homo sapiens
aaacccaccagcct

SEQ ID NO: 5073222 - DNA, 19 bp, Homo sapiens
aaacccacgacctgtcctg

SEQ ID NO: 5073223 - DNA, 20 bp, Homo sapiens
aaacccagaaagattttctc

SEQ ID NO: 5073224 - DNA, 17 bp, Homo sapiens
aaacccagcatgtacaa

SEQ ID NO: 5073225 - DNA, 11 bp, Homo sapiens
aaacccagccc

SEQ ID NO: 5073226 - DNA, 22 bp, Homo sapiens
aaacccagctgcaccccttcct

SEQ ID NO: 5073227 - DNA, 23 bp, Homo sapiens
aaacccagctgcaccccttcctg

SEQ ID NO: 5073228 - DNA, 23 bp, Homo sapiens
aaacccagggaggaagactgtaa

SEQ ID NO: 5073229 - DNA, 22 bp, Homo sapiens
aaacccatacaatgtatgtaca

SEQ ID NO: 5073230 - DNA, 23 bp, Homo sapiens
aaacccatacaatgtatgtacaa

SEQ ID NO: 5073231 - DNA, 22 bp, Homo sapiens
aaacccatattgtaaaacaggt

SEQ ID NO: 5073232 - DNA, 21 bp, Homo sapiens
aaacccatcgtggtatgtgaa

SEQ ID NO: 5073233 - DNA, 15 bp, Homo sapiens
aaacccatctgtaat

SEQ ID NO: 5073234 - DNA, 14 bp, Homo sapiens
aaacccatcttcat

SEQ ID NO: 5073235 - DNA, 15 bp, Homo sapiens
aaacccatcttttgt

SEQ ID NO: 5073236 - DNA, 13 bp, Homo sapiens
aaacccatgtgtt

SEQ ID NO: 5073237 - DNA, 18 bp, Homo sapiens
aaaccccagccccaactc

SEQ ID NO: 5073238 - DNA, 12 bp, Homo sapiens
aaacccccagga

SEQ ID NO: 5073239 - DNA, 14 bp, Homo sapiens
aaacccccaggagg

SEQ ID NO: 5073240 - DNA, 16 bp, Homo sapiens
aaacccccgctccaga

SEQ ID NO: 5073241 - DNA, 18 bp, Homo sapiens
aaacccccgctccagatc

SEQ ID NO: 5073242 - DNA, 15 bp, Homo sapiens
aaacccccttttccc

SEQ ID NO: 5073243 - DNA, 18 bp, Homo sapiens
aaacccccttttcccttc

SEQ ID NO: 5073244 - DNA, 18 bp, Homo sapiens
aaacccctcagacagttt

SEQ ID NO: 5073245 - DNA, 13 bp, Homo sapiens
aaacccctgggta

SEQ ID NO: 5073246 - DNA, 19 bp, Homo sapiens
aaacccgaggaagatgctc

SEQ ID NO: 5073247 - DNA, 16 bp, Homo sapiens
aaacccggctgactca

SEQ ID NO: 5073248 - DNA, 19 bp, Homo sapiens
aaacccggggaactggttt

SEQ ID NO: 5073249 - DNA, 20 bp, Homo sapiens
aaacccgtctctactaaaaa

SEQ ID NO: 5073250 - DNA, 17 bp, Homo sapiens
aaaccctaagtgtggat

SEQ ID NO: 5073251 - DNA, 15 bp, Homo sapiens
aaaccctataaacct

SEQ ID NO: 5073252 - DNA, 17 bp, Homo sapiens
aaaccctatctgtgatt

SEQ ID NO: 5073253 - DNA, 19 bp, Homo sapiens
aaaccctatgccttttgta

SEQ ID NO: 5073254 - DNA, 19 bp, Homo sapiens
aaaccctcacaacccctga

SEQ ID NO: 5073255 - DNA, 14 bp, Homo sapiens
aaaccctcagagcc

SEQ ID NO: 5073256 - DNA, 15 bp, Homo sapiens
aaaccctcagagcct

SEQ ID NO: 5073257 - DNA, 21 bp, Homo sapiens
aaaccctcccagaaacatctc

SEQ ID NO: 5073258 - DNA, 13 bp, Homo sapiens
aaaccctctccat

SEQ ID NO: 5073259 - DNA, 13 bp, Homo sapiens
aaaccctctgtga

SEQ ID NO: 5073260 - DNA, 17 bp, Homo sapiens
aaaccctgaagccattg

SEQ ID NO: 5073261 - DNA, 17 bp, Homo sapiens
aaaccctgctccaatct

SEQ ID NO: 5073262 - DNA, 16 bp, Homo sapiens
aaaccctggagccatc

SEQ ID NO: 5073263 - DNA, 12 bp, Homo sapiens
aaaccctgggga

SEQ ID NO: 5073264 - DNA, 13 bp, Homo sapiens
aaaccctggggac

SEQ ID NO: 5073265 - DNA, 11 bp, Homo sapiens
aaaccctggtt

SEQ ID NO: 5073266 - DNA, 12 bp, Homo sapiens
aaaccctgtctc

SEQ ID NO: 5073267 - DNA, 12 bp, Homo sapiens
aaaccctgttta

SEQ ID NO: 5073268 - DNA, 17 bp, Homo sapiens
aaacccttctcttctcc

SEQ ID NO: 5073269 - DNA, 16 bp, Homo sapiens
aaacccttgactgtta

SEQ ID NO: 5073270 - DNA, 19 bp, Homo sapiens
aaacccttgccatgtgcta

SEQ ID NO: 5073271 - DNA, 13 bp, Homo sapiens
aaaccgaataaat

SEQ ID NO: 5073272 - DNA, 14 bp, Homo sapiens
aaaccgaataaatg

SEQ ID NO: 5073273 - DNA, 20 bp, Homo sapiens
aaaccgataatgcatgaagc

SEQ ID NO: 5073274 - DNA, 16 bp, Homo sapiens
aaaccgccaaggctgg

SEQ ID NO: 5073275 - DNA, 18 bp, Homo sapiens
aaaccgctaaaagaaact

SEQ ID NO: 5073276 - DNA, 17 bp, Homo sapiens
aaaccgtaaagtgcctt

SEQ ID NO: 5073277 - DNA, 19 bp, Homo sapiens
aaaccgtcccctccttccc

SEQ ID NO: 5073278 - DNA, 15 bp, Homo sapiens
aaaccgtcctctttt

SEQ ID NO: 5073279 - DNA, 17 bp, Homo sapiens
aaaccgtgtgtccagca

SEQ ID NO: 5073280 - DNA, 15 bp, Homo sapiens
aaacctaaaaaagat

SEQ ID NO: 5073281 - DNA, 19 bp, Homo sapiens
aaacctaaaaaagatatat

SEQ ID NO: 5073282 - DNA, 23 bp, Homo sapiens
aaaatgttacggcatcacactta

SEQ ID NO: 5073283 - DNA, 22 bp, Homo sapiens
aaaatgttacgtgaagaaataa

SEQ ID NO: 5073284 - DNA, 17 bp, Homo sapiens
aaaatgttacttatttt

SEQ ID NO: 5073285 - DNA, 15 bp, Homo sapiens
aaaatgttatttccc

SEQ ID NO: 5073286 - DNA, 16 bp, Homo sapiens
aaaatgttcagaaggt

SEQ ID NO: 5073287 - DNA, 19 bp, Homo sapiens
aaaatgttcattctatgac

SEQ ID NO: 5073288 - DNA, 23 bp, Homo sapiens
aaaatgttcattctatgacaata

SEQ ID NO: 5073289 - DNA, 16 bp, Homo sapiens
aaaatgttctatttaa

SEQ ID NO: 5073290 - DNA, 20 bp, Homo sapiens
aaaatgttctatttaacaac

SEQ ID NO: 5073291 - DNA, 17 bp, Homo sapiens
aaaatgttgaaaagtca

SEQ ID NO: 5073292 - DNA, 13 bp, Homo sapiens
aaaatgttgaaat

SEQ ID NO: 5073293 - DNA, 17 bp, Homo sapiens
aaaatgttgaaatatga

SEQ ID NO: 5073294 - DNA, 15 bp, Homo sapiens
aaaatgttggattta

SEQ ID NO: 5073295 - DNA, 21 bp, Homo sapiens
aaaatgttggggtaaaagtgt

SEQ ID NO: 5073296 - DNA, 21 bp, Homo sapiens
aaaatgttggtcattttatgt

SEQ ID NO: 5073297 - DNA, 18 bp, Homo sapiens
aaaatgttggtgcaatta

SEQ ID NO: 5073298 - DNA, 15 bp, Homo sapiens
aaaatgtttaattca

SEQ ID NO: 5073299 - DNA, 13 bp, Homo sapiens
aaaatgtttactg

SEQ ID NO: 5073300 - DNA, 13 bp, Homo sapiens
aaaatgtttattt

SEQ ID NO: 5073301 - DNA, 18 bp, Homo sapiens
aaaatgtttatttttgct

SEQ ID NO: 5073302 - DNA, 12 bp, Homo sapiens
aaaatgtttggt

SEQ ID NO: 5073303 - DNA, 15 bp, Homo sapiens
aaaatgtttgtactt

SEQ ID NO: 5073304 - DNA, 12 bp, Homo sapiens
aaaatgttttaa

SEQ ID NO: 5073305 - DNA, 18 bp, Homo sapiens
aaaatgttttagcaattt

SEQ ID NO: 5073306 - DNA, 12 bp, Homo sapiens
aaaatgttttca

SEQ ID NO: 5073307 - DNA, 17 bp, Homo sapiens
aaaatgttttgtaagaa

SEQ ID NO: 5073308 - DNA, 22 bp, Homo sapiens
aaaatgtttttggtcttttata

SEQ ID NO: 5073309 - DNA, 16 bp, Homo sapiens
aaaatgttttttgata

SEQ ID NO: 5073310 - DNA, 18 bp, Homo sapiens
aaaattaaaaaatgaaat

SEQ ID NO: 5073311 - DNA, 16 bp, Homo sapiens
aaaattaaaatttaac

SEQ ID NO: 5073312 - DNA, 18 bp, Homo sapiens
aaaattaaataaatttta

SEQ ID NO: 5073313 - DNA, 19 bp, Homo sapiens
aaaattaaataaattttaa

SEQ ID NO: 5073314 - DNA, 19 bp, Homo sapiens
aaaattaaatgccttgtat

SEQ ID NO: 5073315 - DNA, 14 bp, Homo sapiens
aaaattaacactgc

SEQ ID NO: 5073316 - DNA, 13 bp, Homo sapiens
aaaattaactttt

SEQ ID NO: 5073317 - DNA, 20 bp, Homo sapiens
aaaattaagaaaggataaag

SEQ ID NO: 5073318 - DNA, 14 bp, Homo sapiens
aaaattaagaatgt

SEQ ID NO: 5073319 - DNA, 20 bp, Homo sapiens
aaaattaagacaagcctggc

SEQ ID NO: 5073320 - DNA, 21 bp, Homo sapiens
aaaattaaggcaactgaacaa

SEQ ID NO: 5073321 - DNA, 17 bp, Homo sapiens
aaaattaaggtgtttga

SEQ ID NO: 5073322 - DNA, 18 bp, Homo sapiens
aaaattaaggtgtttgaa

SEQ ID NO: 5073323 - DNA, 18 bp, Homo sapiens
aaaattaagtagaacaaa

SEQ ID NO: 5073324 - DNA, 16 bp, Homo sapiens
aaaattaatacattct

SEQ ID NO: 5073325 - DNA, 19 bp, Homo sapiens
aaaattaatacattctatg

SEQ ID NO: 5073326 - DNA, 14 bp, Homo sapiens
aaaattaatagctt

SEQ ID NO: 5073327 - DNA, 15 bp, Homo sapiens
aaaattaatagcttt

SEQ ID NO: 5073328 - DNA, 19 bp, Homo sapiens
aaaattaatagttttatct

SEQ ID NO: 5073329 - DNA, 16 bp, Homo sapiens
aaaattaatgtaataa

SEQ ID NO: 5073330 - DNA, 16 bp, Homo sapiens
aaaattaattctaaac

SEQ ID NO: 5073331 - DNA, 14 bp, Homo sapiens
aaaattacaactaa

SEQ ID NO: 5073332 - DNA, 14 bp, Homo sapiens
aaaattacagatgt

SEQ ID NO: 5073333 - DNA, 21 bp, Homo sapiens
aaaattacatgttttttcatt

SEQ ID NO: 5073334 - DNA, 19 bp, Homo sapiens
aaaattaccaaacaaagca

SEQ ID NO: 5073335 - DNA, 19 bp, Homo sapiens
aaaattacctttaatgcaa

SEQ ID NO: 5073336 - DNA, 18 bp, Homo sapiens
aaaattacctttaatttt

SEQ ID NO: 5073337 - DNA, 19 bp, Homo sapiens
aaaattacctttaatttta

SEQ ID NO: 5073338 - DNA, 17 bp, Homo sapiens
aaaattacgtttgttat

SEQ ID NO: 5073339 - DNA, 18 bp, Homo sapiens
aaaattactaactgccat

SEQ ID NO: 5073340 - DNA, 23 bp, Homo sapiens
aaaattactattcttggttctta

SEQ ID NO: 5073341 - DNA, 21 bp, Homo sapiens
aaaattactcccttattggca

SEQ ID NO: 5073342 - DNA, 17 bp, Homo sapiens
aaaattactgtgaattg

SEQ ID NO: 5073343 - DNA, 22 bp, Homo sapiens
aaaattacttagtattgcaaag

SEQ ID NO: 5073344 - DNA, 23 bp, Homo sapiens
aaaattacttagtattgcaaagt

SEQ ID NO: 5073345 - DNA, 16 bp, Homo sapiens
aaaattacttggcttt

SEQ ID NO: 5073346 - DNA, 14 bp, Homo sapiens
aaaattagaaagga

SEQ ID NO: 5073347 - DNA, 22 bp, Homo sapiens
aaaattagaaaggacaacagtt

SEQ ID NO: 5073348 - DNA, 14 bp, Homo sapiens
aaaattagccaggc

SEQ ID NO: 5073349 - DNA, 14 bp, Homo sapiens
aaaattagccaggt

SEQ ID NO: 5073350 - DNA, 18 bp, Homo sapiens
aaaattagccgggcgtgg

SEQ ID NO: 5073351 - DNA, 17 bp, Homo sapiens
aaaattagcctaagata

SEQ ID NO: 5073352 - DNA, 20 bp, Homo sapiens
aaaattagccttgatattct

SEQ ID NO: 5073353 - DNA, 20 bp, Homo sapiens
aaaattagggagctcttgac

SEQ ID NO: 5073354 - DNA, 17 bp, Homo sapiens
aaaattagtcttttgta

SEQ ID NO: 5073355 - DNA, 12 bp, Homo sapiens
aaaattataaga

SEQ ID NO: 5073356 - DNA, 18 bp, Homo sapiens
aaaattatagatgggaat

SEQ ID NO: 5073357 - DNA, 14 bp, Homo sapiens
aaaattatatagca

SEQ ID NO: 5073358 - DNA, 21 bp, Homo sapiens
aaaattatatattgcaaggtg

SEQ ID NO: 5073359 - DNA, 13 bp, Homo sapiens
aaaattatattct

SEQ ID NO: 5073360 - DNA, 17 bp, Homo sapiens
aaaattatcaaaaagct

SEQ ID NO: 5073361 - DNA, 13 bp, Homo sapiens
aaaattatcagtg

SEQ ID NO: 5073362 - DNA, 15 bp, Homo sapiens
aaaattatctatttg

SEQ ID NO: 5073363 - DNA, 17 bp, Homo sapiens
aaaattatctgttctat

SEQ ID NO: 5073364 - DNA, 16 bp, Homo sapiens
aaaattatctttaaaa

SEQ ID NO: 5073365 - DNA, 22 bp, Homo sapiens
aaaattatctttaaaacttact

SEQ ID NO: 5073366 - DNA, 13 bp, Homo sapiens
aaaattatgaaat

SEQ ID NO: 5073367 - DNA, 17 bp, Homo sapiens
aaaattatgaaatatgg

SEQ ID NO: 5073368 - DNA, 13 bp, Homo sapiens
aaaattatgaatc

SEQ ID NO: 5073369 - DNA, 16 bp, Homo sapiens
aaaattatgaatctga

SEQ ID NO: 5073370 - DNA, 15 bp, Homo sapiens
aaaattatgctgcat

SEQ ID NO: 5073371 - DNA, 18 bp, Homo sapiens
aaaattatggaaacagat

SEQ ID NO: 5073372 - DNA, 18 bp, Homo sapiens
aaaattatggaatatcat

SEQ ID NO: 5073373 - DNA, 20 bp, Homo sapiens
aaaattatggaatatcatct

SEQ ID NO: 5073374 - DNA, 24 bp, Homo sapiens
aaaattatggaatatcatctgtca

SEQ ID NO: 5073375 - DNA, 18 bp, Homo sapiens
aaaattatggtgaaatta

SEQ ID NO: 5073376 - DNA, 19 bp, Homo sapiens
aaaattatgttactgtatt

SEQ ID NO: 5073377 - DNA, 23 bp, Homo sapiens
aaaattatgtttgccactttgca

SEQ ID NO: 5073378 - DNA, 19 bp, Homo sapiens
aaaattattaaaaattata

SEQ ID NO: 5073379 - DNA, 12 bp, Homo sapiens
aaaattattaga

SEQ ID NO: 5073380 - DNA, 14 bp, Homo sapiens
aaaattatttgcat

SEQ ID NO: 5073381 - DNA, 12 bp, Homo sapiens
aaaattattttg

SEQ ID NO: 5073382 - DNA, 16 bp, Homo sapiens
aaaattattttgacat

SEQ ID NO: 5073383 - DNA, 13 bp, Homo sapiens
aaaattattttgg

SEQ ID NO: 5073384 - DNA, 18 bp, Homo sapiens
aaaattattttgttcata

SEQ ID NO: 5073385 - DNA, 14 bp, Homo sapiens
aaaattcaaaaagt

SEQ ID NO: 5073386 - DNA, 19 bp, Homo sapiens
aaaattcaacccatttact

SEQ ID NO: 5073387 - DNA, 22 bp, Homo sapiens
aaaattcaagcatttaggaatg

SEQ ID NO: 5073388 - DNA, 17 bp, Homo sapiens
aaaattcacagagtttc

SEQ ID NO: 5073389 - DNA, 18 bp, Homo sapiens
aaaattcactattggctg

SEQ ID NO: 5073390 - DNA, 14 bp, Homo sapiens
aaaattcagctcct

SEQ ID NO: 5073391 - DNA, 21 bp, Homo sapiens
aaaattcagtttttgtatctt

SEQ ID NO: 5073392 - DNA, 13 bp, Homo sapiens
aaaattcatttca

SEQ ID NO: 5073393 - DNA, 14 bp, Homo sapiens
aaaattcatttcac

SEQ ID NO: 5073394 - DNA, 14 bp, Homo sapiens
aaaattcatttcta

SEQ ID NO: 5073395 - DNA, 12 bp, Homo sapiens
aaaattcatttt

SEQ ID NO: 5073396 - DNA, 17 bp, Homo sapiens
aaaattccaaattcatg

SEQ ID NO: 5073397 - DNA, 22 bp, Homo sapiens
aaaattccaaatttttttctta

SEQ ID NO: 5073398 - DNA, 14 bp, Homo sapiens
aaaattccactcaa

SEQ ID NO: 5073399 - DNA, 16 bp, Homo sapiens
aaaattccagaaagga

SEQ ID NO: 5073400 - DNA, 15 bp, Homo sapiens
aaaattccctaaagc

SEQ ID NO: 5073401 - DNA, 23 bp, Homo sapiens
aaaattccctggggtcaccttct

SEQ ID NO: 5073402 - DNA, 14 bp, Homo sapiens
aaaattcctattgt

SEQ ID NO: 5073403 - DNA, 22 bp, Homo sapiens
aaaattcctttgtgtttctatt

SEQ ID NO: 5073404 - DNA, 13 bp, Homo sapiens
aaaattctaaata

SEQ ID NO: 5073405 - DNA, 20 bp, Homo sapiens
aaaattctaaataaaatata

SEQ ID NO: 5073406 - DNA, 21 bp, Homo sapiens
aaaattctatggaatagttct

SEQ ID NO: 5073407 - DNA, 12 bp, Homo sapiens
aaaattctcaag

SEQ ID NO: 5073408 - DNA, 20 bp, Homo sapiens
aaaattctcagtcagtaatt

SEQ ID NO: 5073409 - DNA, 17 bp, Homo sapiens
aaaattctcttaaataa

SEQ ID NO: 5073410 - DNA, 13 bp, Homo sapiens
aaaattctgaatt

SEQ ID NO: 5073411 - DNA, 13 bp, Homo sapiens
aaaattcttcgca

SEQ ID NO: 5073412 - DNA, 21 bp, Homo sapiens
aaaattcttgagaagtaactg

SEQ ID NO: 5073413 - DNA, 15 bp, Homo sapiens
aaaattctttcactt

SEQ ID NO: 5073414 - DNA, 16 bp, Homo sapiens
aaaattgaaagaactt

SEQ ID NO: 5073415 - DNA, 14 bp, Homo sapiens
aaaattgaaagtat

SEQ ID NO: 5073416 - DNA, 17 bp, Homo sapiens
aaaattgaaatgtaagg

SEQ ID NO: 5073417 - DNA, 23 bp, Homo sapiens
aaaattgaactaatttatacttt

SEQ ID NO: 5073418 - DNA, 22 bp, Homo sapiens
aaaattgaagagagatatatct

SEQ ID NO: 5073419 - DNA, 23 bp, Homo sapiens
aaaattgaatagtttatttctgt

SEQ ID NO: 5073420 - DNA, 14 bp, Homo sapiens
aaaattgaatgcaa

SEQ ID NO: 5073421 - DNA, 21 bp, Homo sapiens
aaaattgaatgcaaaccatag

SEQ ID NO: 5073422 - DNA, 13 bp, Homo sapiens
aaaattgaattta

SEQ ID NO: 5073423 - DNA, 15 bp, Homo sapiens
aaaattgaatttaac

SEQ ID NO: 5073424 - DNA, 19 bp, Homo sapiens
aaaattgaatttaacaatg

SEQ ID NO: 5073425 - DNA, 18 bp, Homo sapiens
aaaattgacttagatatt

SEQ ID NO: 5073426 - DNA, 15 bp, Homo sapiens
aaaattgatagaaga

SEQ ID NO: 5073427 - DNA, 23 bp, Homo sapiens
aaaattgatatacttttttctta

SEQ ID NO: 5073428 - DNA, 21 bp, Homo sapiens
aaaattgatatttttatacaa

SEQ ID NO: 5073429 - DNA, 21 bp, Homo sapiens
aaaattgatgtgtttatttat

SEQ ID NO: 5073430 - DNA, 20 bp, Homo sapiens
aaaattgatttttctcttca

SEQ ID NO: 5073431 - DNA, 11 bp, Homo sapiens
aaaattgcaca

SEQ ID NO: 5073432 - DNA, 15 bp, Homo sapiens
aaaattgcacaattt

SEQ ID NO: 5073433 - DNA, 16 bp, Homo sapiens
aaaattgcacaatttg

SEQ ID NO: 5073434 - DNA, 19 bp, Homo sapiens
aaaattgcagtttcatgta

SEQ ID NO: 5073435 - DNA, 15 bp, Homo sapiens
aaaattgcattttta

SEQ ID NO: 5073436 - DNA, 23 bp, Homo sapiens
aaaattgccagattaaatgaata

SEQ ID NO: 5073437 - DNA, 16 bp, Homo sapiens
aaaattgccatattgc

SEQ ID NO: 5073438 - DNA, 19 bp, Homo sapiens
aaaattgcctataatactt

SEQ ID NO: 5073439 - DNA, 23 bp, Homo sapiens
aaaattgcctataatacttgcaa

SEQ ID NO: 5073440 - DNA, 21 bp, Homo sapiens
aaaattgctagtgatttcatt

SEQ ID NO: 5073441 - DNA, 22 bp, Homo sapiens
aaaattgctatgttactatttt

SEQ ID NO: 5073442 - DNA, 21 bp, Homo sapiens
aaaattgctgtgcctcccaaa

SEQ ID NO: 5073443 - DNA, 15 bp, Homo sapiens
aaaattgcttctaaa

SEQ ID NO: 5073444 - DNA, 15 bp, Homo sapiens
aaaattggcatttta

SEQ ID NO: 5073445 - DNA, 19 bp, Homo sapiens
aaaattggggattcttaaa

SEQ ID NO: 5073446 - DNA, 21 bp, Homo sapiens
aaaattggggattcttaaagt

SEQ ID NO: 5073447 - DNA, 15 bp, Homo sapiens
aaaattggtaaaaat

SEQ ID NO: 5073448 - DNA, 21 bp, Homo sapiens
aaaattgtatgttaagttact

SEQ ID NO: 5073449 - DNA, 17 bp, Homo sapiens
aaaattgtcacctctgt

SEQ ID NO: 5073450 - DNA, 21 bp, Homo sapiens
aaaattgtcacctctgttaag

SEQ ID NO: 5073451 - DNA, 20 bp, Homo sapiens
aaaattgtctaaaatgtcag

SEQ ID NO: 5073452 - DNA, 20 bp, Homo sapiens
aaaattgtctgggttccaaa

SEQ ID NO: 5073453 - DNA, 15 bp, Homo sapiens
aaaattgtctttcct

SEQ ID NO: 5073454 - DNA, 12 bp, Homo sapiens
aaaattgtgaag

SEQ ID NO: 5073455 - DNA, 13 bp, Homo sapiens
aaaattgtgatca

SEQ ID NO: 5073456 - DNA, 22 bp, Homo sapiens
aaaattgtgttcttaaaatatt

SEQ ID NO: 5073457 - DNA, 17 bp, Homo sapiens
aaaattgttaatatgca

SEQ ID NO: 5073458 - DNA, 15 bp, Homo sapiens
aaaattgttgtgctt

SEQ ID NO: 5073459 - DNA, 12 bp, Homo sapiens
aaaattgtttca

SEQ ID NO: 5073460 - DNA, 13 bp, Homo sapiens
aaaattgtttcca

SEQ ID NO: 5073461 - DNA, 13 bp, Homo sapiens
aaacctaaaaatt

SEQ ID NO: 5073462 - DNA, 17 bp, Homo sapiens
aaacctaagtccttcca

SEQ ID NO: 5073463 - DNA, 19 bp, Homo sapiens
aaacctaagtcctttatgt

SEQ ID NO: 5073464 - DNA, 18 bp, Homo sapiens
aaacctaattaaggaagt

SEQ ID NO: 5073465 - DNA, 14 bp, Homo sapiens
aaacctacagcata

SEQ ID NO: 5073466 - DNA, 21 bp, Homo sapiens
aaacctaccttatagagcaca

SEQ ID NO: 5073467 - DNA, 21 bp, Homo sapiens
aaacctactttttatgtgcta

SEQ ID NO: 5073468 - DNA, 16 bp, Homo sapiens
aaacctagcttttaaa

SEQ ID NO: 5073469 - DNA, 19 bp, Homo sapiens
aaacctagcttttaaaaaa

SEQ ID NO: 5073470 - DNA, 22 bp, Homo sapiens
aaacctagcttttaaaaaatat

SEQ ID NO: 5073471 - DNA, 23 bp, Homo sapiens
aaacctagcttttaaaaaatatt

SEQ ID NO: 5073472 - DNA, 22 bp, Homo sapiens
aaacctatcaatcctgccccca

SEQ ID NO: 5073473 - DNA, 17 bp, Homo sapiens
aaacctatcctcactgc

SEQ ID NO: 5073474 - DNA, 18 bp, Homo sapiens
aaacctatctcagggagg

SEQ ID NO: 5073475 - DNA, 15 bp, Homo sapiens
aaacctatctgtatt

SEQ ID NO: 5073476 - DNA, 17 bp, Homo sapiens
aaacctatctgtattgg

SEQ ID NO: 5073477 - DNA, 20 bp, Homo sapiens
aaacctatctgtattggcag

SEQ ID NO: 5073478 - DNA, 21 bp, Homo sapiens
aaacctattaagtcatcatct

SEQ ID NO: 5073479 - DNA, 11 bp, Homo sapiens
aaacctatttt

SEQ ID NO: 5073480 - DNA, 15 bp, Homo sapiens
aaacctattttgaaa

SEQ ID NO: 5073481 - DNA, 18 bp, Homo sapiens
aaacctattttgaaaggt

SEQ ID NO: 5073482 - DNA, 21 bp, Homo sapiens
aaacctattttgaaaggtcag

SEQ ID NO: 5073483 - DNA, 16 bp, Homo sapiens
aaacctatttttcctt

SEQ ID NO: 5073484 - DNA, 17 bp, Homo sapiens
aaacctcacactactgt

SEQ ID NO: 5073485 - DNA, 19 bp, Homo sapiens
aaacctcagggctgtccca

SEQ ID NO: 5073486 - DNA, 20 bp, Homo sapiens
aaacctcagggctgtcccag

SEQ ID NO: 5073487 - DNA, 11 bp, Homo sapiens
aaacctcagtt

SEQ ID NO: 5073488 - DNA, 22 bp, Homo sapiens
aaacctcagttggcctctgccc

SEQ ID NO: 5073489 - DNA, 23 bp, Homo sapiens
aaacctcagttggcctctgcccc

SEQ ID NO: 5073490 - DNA, 23 bp, Homo sapiens
aaacctcatgacagccagagcct

SEQ ID NO: 5073491 - DNA, 18 bp, Homo sapiens
aaacctccatcctgccag

SEQ ID NO: 5073492 - DNA, 19 bp, Homo sapiens
aaacctctaacccaggtct

SEQ ID NO: 5073493 - DNA, 19 bp, Homo sapiens
aaacctctaatttattttg

SEQ ID NO: 5073494 - DNA, 17 bp, Homo sapiens
aaacctctacatattta

SEQ ID NO: 5073495 - DNA, 15 bp, Homo sapiens
aaacctctatatgtt

SEQ ID NO: 5073496 - DNA, 18 bp, Homo sapiens
aaacctctgagtgttgaa

SEQ ID NO: 5073497 - DNA, 21 bp, Homo sapiens
aaacctctgttcagtgtaaat

SEQ ID NO: 5073498 - DNA, 20 bp, Homo sapiens
aaacctcttctgtatttttt

SEQ ID NO: 5073499 - DNA, 16 bp, Homo sapiens
aaacctgaaaaaaagt

SEQ ID NO: 5073500 - DNA, 22 bp, Homo sapiens
aaacctgaaaaaaagtttacaa

SEQ ID NO: 5073501 - DNA, 17 bp, Homo sapiens
aaacctgaacaaaccct

SEQ ID NO: 5073502 - DNA, 12 bp, Homo sapiens
aaacctgaagat

SEQ ID NO: 5073503 - DNA, 16 bp, Homo sapiens
aaacctgaagatgtct

SEQ ID NO: 5073504 - DNA, 13 bp, Homo sapiens
aaacctgaatggt

SEQ ID NO: 5073505 - DNA, 16 bp, Homo sapiens
aaacctgacttcagtg

SEQ ID NO: 5073506 - DNA, 15 bp, Homo sapiens
aaacctgatgcagtg

SEQ ID NO: 5073507 - DNA, 14 bp, Homo sapiens
aaacctgatgttaa

SEQ ID NO: 5073508 - DNA, 15 bp, Homo sapiens
aaacctgcagttttt

SEQ ID NO: 5073509 - DNA, 21 bp, Homo sapiens
aaacctgcagtttttaatttg

SEQ ID NO: 5073510 - DNA, 15 bp, Homo sapiens
aaacctgcatattgt

SEQ ID NO: 5073511 - DNA, 15 bp, Homo sapiens
aaacctgcatggtgt

SEQ ID NO: 5073512 - DNA, 20 bp, Homo sapiens
aaacctgcatttttaaagga

SEQ ID NO: 5073513 - DNA, 18 bp, Homo sapiens
aaacctgcctaaattaaa

SEQ ID NO: 5073514 - DNA, 18 bp, Homo sapiens
aaacctgcctttgtatgt

SEQ ID NO: 5073515 - DNA, 19 bp, Homo sapiens
aaacctgctccaaggcagt

SEQ ID NO: 5073516 - DNA, 11 bp, Homo sapiens
aaacctgctgg

SEQ ID NO: 5073517 - DNA, 13 bp, Homo sapiens
aaacctgcttcct

SEQ ID NO: 5073518 - DNA, 20 bp, Homo sapiens
aaacctggaacatctcacct

SEQ ID NO: 5073519 - DNA, 18 bp, Homo sapiens
aaacctggagatgatgat

SEQ ID NO: 5073520 - DNA, 19 bp, Homo sapiens
aaacctggagatggtggat

SEQ ID NO: 5073521 - DNA, 11 bp, Homo sapiens
aaacctggagg

SEQ ID NO: 5073522 - DNA, 12 bp, Homo sapiens
aaacctggaggg

SEQ ID NO: 5073523 - DNA, 23 bp, Homo sapiens
aaacctggattttttatgtacaa

SEQ ID NO: 5073524 - DNA, 12 bp, Homo sapiens
aaacctggcaga

SEQ ID NO: 5073525 - DNA, 20 bp, Homo sapiens
aaacctggcatggtgctttc

SEQ ID NO: 5073526 - DNA, 14 bp, Homo sapiens
aaacctgggagaga

SEQ ID NO: 5073527 - DNA, 18 bp, Homo sapiens
aaacctgggctctggttt

SEQ ID NO: 5073528 - DNA, 12 bp, Homo sapiens
aaacctggggga

SEQ ID NO: 5073529 - DNA, 21 bp, Homo sapiens
aaacctgggtatgttcctaag

SEQ ID NO: 5073530 - DNA, 16 bp, Homo sapiens
aaacctgtagaatcaa

SEQ ID NO: 5073531 - DNA, 21 bp, Homo sapiens
aaacctgtctaagcaatactt

SEQ ID NO: 5073532 - DNA, 17 bp, Homo sapiens
aaacctgtgaaagctgc

SEQ ID NO: 5073533 - DNA, 12 bp, Homo sapiens
aaacctgtgcct

SEQ ID NO: 5073534 - DNA, 16 bp, Homo sapiens
aaacctgtgctttcat

SEQ ID NO: 5073535 - DNA, 20 bp, Homo sapiens
aaacctgtgctttcatgttt

SEQ ID NO: 5073536 - DNA, 17 bp, Homo sapiens
aaacctgttaaaacaac

SEQ ID NO: 5073537 - DNA, 16 bp, Homo sapiens
aaacctgttcctgact

SEQ ID NO: 5073538 - DNA, 17 bp, Homo sapiens
aaacctgtttttaacat

SEQ ID NO: 5073539 - DNA, 20 bp, Homo sapiens
aaacctgtttttaacatgtg

SEQ ID NO: 5073540 - DNA, 21 bp, Homo sapiens
aaaccttaaaagtaataaaga

SEQ ID NO: 5073541 - DNA, 17 bp, Homo sapiens
aaaccttaagtgctgca

SEQ ID NO: 5073542 - DNA, 19 bp, Homo sapiens
aaaccttaatatttcttca

SEQ ID NO: 5073543 - DNA, 19 bp, Homo sapiens
aaaccttaccttggaattg

SEQ ID NO: 5073544 - DNA, 18 bp, Homo sapiens
aaaccttagtaccttttt

SEQ ID NO: 5073545 - DNA, 13 bp, Homo sapiens
aaaccttagtttc

SEQ ID NO: 5073546 - DNA, 17 bp, Homo sapiens
aaaccttattgtacctc

SEQ ID NO: 5073547 - DNA, 17 bp, Homo sapiens
aaaccttcacccagcac

SEQ ID NO: 5073548 - DNA, 17 bp, Homo sapiens
aaaccttcacttaggaa

SEQ ID NO: 5073549 - DNA, 16 bp, Homo sapiens
aaaccttccacccagt

SEQ ID NO: 5073550 - DNA, 12 bp, Homo sapiens
aaaccttcctct

SEQ ID NO: 5073551 - DNA, 12 bp, Homo sapiens
aaaccttcctgg

SEQ ID NO: 5073552 - DNA, 15 bp, Homo sapiens
aaaccttctaccctg

SEQ ID NO: 5073553 - DNA, 15 bp, Homo sapiens
aaaccttgaacagtg

SEQ ID NO: 5073554 - DNA, 21 bp, Homo sapiens
aaaccttgcaaactctataaa

SEQ ID NO: 5073555 - DNA, 17 bp, Homo sapiens
aaaccttgctctcctca

SEQ ID NO: 5073556 - DNA, 11 bp, Homo sapiens
aaaccttggag

SEQ ID NO: 5073557 - DNA, 17 bp, Homo sapiens
aaaccttggagaggaga

SEQ ID NO: 5073558 - DNA, 16 bp, Homo sapiens
aaaccttggcataaga

SEQ ID NO: 5073559 - DNA, 11 bp, Homo sapiens
aaaccttgggc

SEQ ID NO: 5073560 - DNA, 22 bp, Homo sapiens
aaaccttgggccctggaagagt

SEQ ID NO: 5073561 - DNA, 14 bp, Homo sapiens
aaaccttggtgtag

SEQ ID NO: 5073562 - DNA, 21 bp, Homo sapiens
aaaccttgtaaaaaaagcaaa

SEQ ID NO: 5073563 - DNA, 23 bp, Homo sapiens
aaaccttgtgactcagtgtattt

SEQ ID NO: 5073564 - DNA, 15 bp, Homo sapiens
aaaccttgttctatt

SEQ ID NO: 5073565 - DNA, 14 bp, Homo sapiens
aaaccttgtttgtt

SEQ ID NO: 5073566 - DNA, 17 bp, Homo sapiens
aaaccttgtttgtttta

SEQ ID NO: 5073567 - DNA, 13 bp, Homo sapiens
aaacctttaatga

SEQ ID NO: 5073568 - DNA, 15 bp, Homo sapiens
aaacctttattcttt

SEQ ID NO: 5073569 - DNA, 17 bp, Homo sapiens
aaacctttcaaatttca

SEQ ID NO: 5073570 - DNA, 19 bp, Homo sapiens
aaacctttcagtactctta

SEQ ID NO: 5073571 - DNA, 22 bp, Homo sapiens
aaacctttcagtactcttatta

SEQ ID NO: 5073572 - DNA, 15 bp, Homo sapiens
aaacctttcataatt

SEQ ID NO: 5073573 - DNA, 13 bp, Homo sapiens
aaacctttccatt

SEQ ID NO: 5073574 - DNA, 19 bp, Homo sapiens
aaacctttccccagacaca

SEQ ID NO: 5073575 - DNA, 17 bp, Homo sapiens
aaaccttttatttttat

SEQ ID NO: 5073576 - DNA, 18 bp, Homo sapiens
aaaccttttatttttatt

SEQ ID NO: 5073577 - DNA, 22 bp, Homo sapiens
aaaccttttttaagatttttct

SEQ ID NO: 5073578 - DNA, 13 bp, Homo sapiens
aaacgaaaaacat

SEQ ID NO: 5073579 - DNA, 18 bp, Homo sapiens
aaacgaaaacctgactag

SEQ ID NO: 5073580 - DNA, 13 bp, Homo sapiens
aaacgaaagctgg

SEQ ID NO: 5073581 - DNA, 14 bp, Homo sapiens
aaacgaaagctggg

SEQ ID NO: 5073582 - DNA, 23 bp, Homo sapiens
aaacgaatataagcttaaaataa

SEQ ID NO: 5073583 - DNA, 18 bp, Homo sapiens
aaacgacaaatctgtctg

SEQ ID NO: 5073584 - DNA, 16 bp, Homo sapiens
aaacgactcaaaatga

SEQ ID NO: 5073585 - DNA, 18 bp, Homo sapiens
aaacgactccgagaacaa

SEQ ID NO: 5073586 - DNA, 18 bp, Homo sapiens
aaacgacttttgtttgcg

SEQ ID NO: 5073587 - DNA, 14 bp, Homo sapiens
aaacgagactttct

SEQ ID NO: 5073588 - DNA, 14 bp, Homo sapiens
aaacgagataatgt

SEQ ID NO: 5073589 - DNA, 19 bp, Homo sapiens
aaacgagggctgatggagg

SEQ ID NO: 5073590 - DNA, 23 bp, Homo sapiens
aaacgagggctgatggaggaaaa

SEQ ID NO: 5073591 - DNA, 15 bp, Homo sapiens
aaacgatatatgtaa

SEQ ID NO: 5073592 - DNA, 19 bp, Homo sapiens
aaacgcacttacaagtggt

SEQ ID NO: 5073593 - DNA, 13 bp, Homo sapiens
aaacgcagacact

SEQ ID NO: 5073594 - DNA, 23 bp, Homo sapiens
aaacgcagttgtgtggcccagca

SEQ ID NO: 5073595 - DNA, 16 bp, Homo sapiens
aaacgcattaagaggt

SEQ ID NO: 5073596 - DNA, 21 bp, Homo sapiens
aaacgccccgggcaaagggtc

SEQ ID NO: 5073597 - DNA, 21 bp, Homo sapiens
aaacgcgcagatgtgcagcag

SEQ ID NO: 5073598 - DNA, 23 bp, Homo sapiens
aaacgcgcagatgtgcagcagat

SEQ ID NO: 5073599 - DNA, 24 bp, Homo sapiens
aaacgcgcagatgtgcagcagatt

SEQ ID NO: 5073600 - DNA, 16 bp, Homo sapiens
aaacgcgtctgcctgg

SEQ ID NO: 5073601 - DNA, 16 bp, Homo sapiens
aaacgctcctttgtgt

SEQ ID NO: 5073602 - DNA, 12 bp, Homo sapiens
aaacgctgcctg

SEQ ID NO: 5073603 - DNA, 13 bp, Homo sapiens
aaacgctgtcaaa

SEQ ID NO: 5073604 - DNA, 22 bp, Homo sapiens
aaacgctgtcaaaagttggact

SEQ ID NO: 5073605 - DNA, 16 bp, Homo sapiens
aaacggatgagttatt

SEQ ID NO: 5073606 - DNA, 20 bp, Homo sapiens
aaacggattattttttcaga

SEQ ID NO: 5073607 - DNA, 22 bp, Homo sapiens
aaacggattattttttcagacc

SEQ ID NO: 5073608 - DNA, 20 bp, Homo sapiens
aaacggcaacgtagcctggg

SEQ ID NO: 5073609 - DNA, 23 bp, Homo sapiens
aaacggcctcactaggcttctgg

SEQ ID NO: 5073610 - DNA, 22 bp, Homo sapiens
aaacgggcgccaagactcaggg

SEQ ID NO: 5073611 - DNA, 21 bp, Homo sapiens
aaacgggttaaaaattgtttt

SEQ ID NO: 5073612 - DNA, 21 bp, Homo sapiens
aaacggtatcctccctgccca

SEQ ID NO: 5073613 - DNA, 22 bp, Homo sapiens
aaacggtatgacttaattttag

SEQ ID NO: 5073614 - DNA, 22 bp, Homo sapiens
aaacggtctttatgaattattt

SEQ ID NO: 5073615 - DNA, 17 bp, Homo sapiens
aaacggtgcaacagaag

SEQ ID NO: 5073616 - DNA, 20 bp, Homo sapiens
aaacggtgcaacagaagggt

SEQ ID NO: 5073617 - DNA, 13 bp, Homo sapiens
aaacggtgctttc

SEQ ID NO: 5073618 - DNA, 13 bp, Homo sapiens
aaacgtaaatgtt

SEQ ID NO: 5073619 - DNA, 19 bp, Homo sapiens
aaacgtagcatgtggcatc

SEQ ID NO: 5073620 - DNA, 18 bp, Homo sapiens
aaacgtataatatgtaca

SEQ ID NO: 5073621 - DNA, 19 bp, Homo sapiens
aaacgtatggaatgcttct

SEQ ID NO: 5073622 - DNA, 16 bp, Homo sapiens
aaacgtcccacacttt

SEQ ID NO: 5073623 - DNA, 18 bp, Homo sapiens
aaacgtcccacactttga

SEQ ID NO: 5073624 - DNA, 19 bp, Homo sapiens
aaacgtcccacactttgaa

SEQ ID NO: 5073625 - DNA, 14 bp, Homo sapiens
aaacgtcctcttta

SEQ ID NO: 5073626 - DNA, 20 bp, Homo sapiens
aaacgtctattttgtatatt

SEQ ID NO: 5073627 - DNA, 13 bp, Homo sapiens
aaacgtctcccag

SEQ ID NO: 5073628 - DNA, 18 bp, Homo sapiens
aaacgtcttattgtggta

SEQ ID NO: 5073629 - DNA, 12 bp, Homo sapiens
aaacgtgaaaat

SEQ ID NO: 5073630 - DNA, 21 bp, Homo sapiens
aaacgtgatgttttgaatgtg

SEQ ID NO: 5073631 - DNA, 14 bp, Homo sapiens
aaacgtgccctctg

SEQ ID NO: 5073632 - DNA, 15 bp, Homo sapiens
aaacgtgcgcggact

SEQ ID NO: 5073633 - DNA, 17 bp, Homo sapiens
aaacgtggctgcttcaa

SEQ ID NO: 5073634 - DNA, 20 bp, Homo sapiens
aaacgtggcttttagacaga

SEQ ID NO: 5073635 - DNA, 21 bp, Homo sapiens
aaacgtgggtatttcctgcta

SEQ ID NO: 5073636 - DNA, 16 bp, Homo sapiens
aaacgtgtatgttttt

SEQ ID NO: 5073637 - DNA, 20 bp, Homo sapiens
aaacgtgtatgtttttcagt

SEQ ID NO: 5073638 - DNA, 18 bp, Homo sapiens
aaacgtgttttttaaaaa

SEQ ID NO: 5073639 - DNA, 13 bp, Homo sapiens
aaaattgtttctt

SEQ ID NO: 5073640 - DNA, 15 bp, Homo sapiens
aaaattgtttcttga

SEQ ID NO: 5073641 - DNA, 17 bp, Homo sapiens
aaaattgtttcttgaca

SEQ ID NO: 5073642 - DNA, 20 bp, Homo sapiens
aaaattgttttcacttgtat

SEQ ID NO: 5073643 - DNA, 21 bp, Homo sapiens
aaaattgttttcacttgtatt

SEQ ID NO: 5073644 - DNA, 16 bp, Homo sapiens
aaaatttaaaaattaa

SEQ ID NO: 5073645 - DNA, 17 bp, Homo sapiens
aaaatttaaaagtaaaa

SEQ ID NO: 5073646 - DNA, 22 bp, Homo sapiens
aaaatttaaagggtgtacttat

SEQ ID NO: 5073647 - DNA, 19 bp, Homo sapiens
aaaatttaaatggcttttg

SEQ ID NO: 5073648 - DNA, 20 bp, Homo sapiens
aaaatttaaatggcttttgc

SEQ ID NO: 5073649 - DNA, 21 bp, Homo sapiens
aaaatttaacatctgcagtgt

SEQ ID NO: 5073650 - DNA, 21 bp, Homo sapiens
aaaatttaagcattgtttgct

SEQ ID NO: 5073651 - DNA, 12 bp, Homo sapiens
aaaatttaattt

SEQ ID NO: 5073652 - DNA, 19 bp, Homo sapiens
aaaatttactacaatatgt

SEQ ID NO: 5073653 - DNA, 19 bp, Homo sapiens
aaaatttagtttttgttct

SEQ ID NO: 5073654 - DNA, 23 bp, Homo sapiens
aaaatttagtttttgttcttaat

SEQ ID NO: 5073655 - DNA, 22 bp, Homo sapiens
aaaatttatggttttggtattt

SEQ ID NO: 5073656 - DNA, 21 bp, Homo sapiens
aaaatttattatatatttaca

SEQ ID NO: 5073657 - DNA, 14 bp, Homo sapiens
aaaatttatttgca

SEQ ID NO: 5073658 - DNA, 20 bp, Homo sapiens
aaaatttcaacaagtagcta

SEQ ID NO: 5073659 - DNA, 14 bp, Homo sapiens
aaaatttcacagtt

SEQ ID NO: 5073660 - DNA, 15 bp, Homo sapiens
aaaatttcaggatta

SEQ ID NO: 5073661 - DNA, 19 bp, Homo sapiens
aaaatttcataattctgaa

SEQ ID NO: 5073662 - DNA, 20 bp, Homo sapiens
aaaatttcataattctgaaa

SEQ ID NO: 5073663 - DNA, 21 bp, Homo sapiens
aaaatttcataattctgaaac

SEQ ID NO: 5073664 - DNA, 17 bp, Homo sapiens
aaaatttccagtacctt

SEQ ID NO: 5073665 - DNA, 18 bp, Homo sapiens
aaaatttcgttgtccaat

SEQ ID NO: 5073666 - DNA, 22 bp, Homo sapiens
aaaatttcgttgtccaatttgt

SEQ ID NO: 5073667 - DNA, 21 bp, Homo sapiens
aaaatttctgcttttgcatct

SEQ ID NO: 5073668 - DNA, 18 bp, Homo sapiens
aaaatttctggcaaatat

SEQ ID NO: 5073669 - DNA, 22 bp, Homo sapiens
aaaatttctggcaaatattttg

SEQ ID NO: 5073670 - DNA, 20 bp, Homo sapiens
aaaatttcttagaaaacaat

SEQ ID NO: 5073671 - DNA, 12 bp, Homo sapiens
aaaatttgaaac

SEQ ID NO: 5073672 - DNA, 13 bp, Homo sapiens
aaaatttgaaaca

SEQ ID NO: 5073673 - DNA, 15 bp, Homo sapiens
aaaatttgaaacatt

SEQ ID NO: 5073674 - DNA, 21 bp, Homo sapiens
aaaatttgaaacattgctttt

SEQ ID NO: 5073675 - DNA, 14 bp, Homo sapiens
aaaatttgaaccaa

SEQ ID NO: 5073676 - DNA, 15 bp, Homo sapiens
aaaatttgaagtatt

SEQ ID NO: 5073677 - DNA, 13 bp, Homo sapiens
aaaatttgacatt

SEQ ID NO: 5073678 - DNA, 14 bp, Homo sapiens
aaaatttgacattg

SEQ ID NO: 5073679 - DNA, 24 bp, Homo sapiens
aaaatttgacattgtcagaatgtt

SEQ ID NO: 5073680 - DNA, 19 bp, Homo sapiens
aaaatttgatggactaatt

SEQ ID NO: 5073681 - DNA, 19 bp, Homo sapiens
aaaatttgatggtgaatat

SEQ ID NO: 5073682 - DNA, 20 bp, Homo sapiens
aaaatttgccaatctttcct

SEQ ID NO: 5073683 - DNA, 14 bp, Homo sapiens
aaaatttggaattc

SEQ ID NO: 5073684 - DNA, 22 bp, Homo sapiens
aaaatttggagtaaatatatat

SEQ ID NO: 5073685 - DNA, 16 bp, Homo sapiens
aaaatttgtaatattt

SEQ ID NO: 5073686 - DNA, 23 bp, Homo sapiens
aaaatttgtaatatttttgtcat

SEQ ID NO: 5073687 - DNA, 17 bp, Homo sapiens
aaaatttgtcttaaaaa

SEQ ID NO: 5073688 - DNA, 21 bp, Homo sapiens
aaaatttgtgtgcttctgctc

SEQ ID NO: 5073689 - DNA, 20 bp, Homo sapiens
aaaatttgttcttgtattta

SEQ ID NO: 5073690 - DNA, 19 bp, Homo sapiens
aaaatttgtttgaaatctt

SEQ ID NO: 5073691 - DNA, 14 bp, Homo sapiens
aaaatttgtttgac

SEQ ID NO: 5073692 - DNA, 18 bp, Homo sapiens
aaaatttgttttcaacaa

SEQ ID NO: 5073693 - DNA, 22 bp, Homo sapiens
aaaatttgttttgacggatgat

SEQ ID NO: 5073694 - DNA, 13 bp, Homo sapiens
aaaattttaagct

SEQ ID NO: 5073695 - DNA, 19 bp, Homo sapiens
aaaattttaccagcagaag

SEQ ID NO: 5073696 - DNA, 13 bp, Homo sapiens
aaaattttacttc

SEQ ID NO: 5073697 - DNA, 15 bp, Homo sapiens
aaaattttataagca

SEQ ID NO: 5073698 - DNA, 12 bp, Homo sapiens
aaaattttatga

SEQ ID NO: 5073699 - DNA, 19 bp, Homo sapiens
aaaattttcaaactttgta

SEQ ID NO: 5073700 - DNA, 17 bp, Homo sapiens
aaaattttcattctgaa

SEQ ID NO: 5073701 - DNA, 20 bp, Homo sapiens
aaaattttcttctttaattt

SEQ ID NO: 5073702 - DNA, 13 bp, Homo sapiens
aaaattttgaatg

SEQ ID NO: 5073703 - DNA, 13 bp, Homo sapiens
aaaattttgactt

SEQ ID NO: 5073704 - DNA, 20 bp, Homo sapiens
aaaattttgatgttttaagg

SEQ ID NO: 5073705 - DNA, 13 bp, Homo sapiens
aaaattttgcaga

SEQ ID NO: 5073706 - DNA, 19 bp, Homo sapiens
aaaattttgcatttcatgc

SEQ ID NO: 5073707 - DNA, 16 bp, Homo sapiens
aaaattttgcttttaa

SEQ ID NO: 5073708 - DNA, 11 bp, Homo sapiens
aaaattttgga

SEQ ID NO: 5073709 - DNA, 21 bp, Homo sapiens
aaaattttgtaaaacaatgcc

SEQ ID NO: 5073710 - DNA, 16 bp, Homo sapiens
aaaattttgtatgtca

SEQ ID NO: 5073711 - DNA, 20 bp, Homo sapiens
aaaattttgtattaatttct

SEQ ID NO: 5073712 - DNA, 22 bp, Homo sapiens
aaaattttgtattaatttctga

SEQ ID NO: 5073713 - DNA, 19 bp, Homo sapiens
aaaattttgtgacattcct

SEQ ID NO: 5073714 - DNA, 21 bp, Homo sapiens
aaaattttgtgacattccttc

SEQ ID NO: 5073715 - DNA, 15 bp, Homo sapiens
aaaattttgtgagtg

SEQ ID NO: 5073716 - DNA, 21 bp, Homo sapiens
aaaatttttacaaaactgcca

SEQ ID NO: 5073717 - DNA, 15 bp, Homo sapiens
aaaatttttacattc

SEQ ID NO: 5073718 - DNA, 16 bp, Homo sapiens
aaaatttttatgtaaa

SEQ ID NO: 5073719 - DNA, 15 bp, Homo sapiens
aaaatttttgacact

SEQ ID NO: 5073720 - DNA, 15 bp, Homo sapiens
aaaatttttgcaaat

SEQ ID NO: 5073721 - DNA, 22 bp, Homo sapiens
aaaattttttctctaggaaata

SEQ ID NO: 5073722 - DNA, 14 bp, Homo sapiens
aaaatttttttaga

SEQ ID NO: 5073723 - DNA, 18 bp, Homo sapiens
aaaatttttttctttcga

SEQ ID NO: 5073724 - DNA, 17 bp, Homo sapiens
aaaatttttttttctct

SEQ ID NO: 5073725 - DNA, 16 bp, Homo sapiens
aaacaaaaaaaacaac

SEQ ID NO: 5073726 - DNA, 14 bp, Homo sapiens
aaacaaaaaaaaga

SEQ ID NO: 5073727 - DNA, 13 bp, Homo sapiens
aaacaaaaaaact

SEQ ID NO: 5073728 - DNA, 13 bp, Homo sapiens
aaacaaaaaaaga

SEQ ID NO: 5073729 - DNA, 14 bp, Homo sapiens
aaacaaaaaaccca

SEQ ID NO: 5073730 - DNA, 18 bp, Homo sapiens
aaacaaaaacaaaaccag

SEQ ID NO: 5073731 - DNA, 18 bp, Homo sapiens
aaacaaaaacagaatttg

SEQ ID NO: 5073732 - DNA, 12 bp, Homo sapiens
aaacaaaaacat

SEQ ID NO: 5073733 - DNA, 11 bp, Homo sapiens
aaacaaaaaga

SEQ ID NO: 5073734 - DNA, 16 bp, Homo sapiens
aaacaaaaagaacaaa

SEQ ID NO: 5073735 - DNA, 16 bp, Homo sapiens
aaacaaaaagatgtct

SEQ ID NO: 5073736 - DNA, 13 bp, Homo sapiens
aaacaaaaataaa

SEQ ID NO: 5073737 - DNA, 13 bp, Homo sapiens
aaacaaaaataga

SEQ ID NO: 5073738 - DNA, 14 bp, Homo sapiens
aaacaaaaatagaa

SEQ ID NO: 5073739 - DNA, 20 bp, Homo sapiens
aaacaaaaattcacaagctg

SEQ ID NO: 5073740 - DNA, 23 bp, Homo sapiens
aaacaaaaattcacaagctgcct

SEQ ID NO: 5073741 - DNA, 15 bp, Homo sapiens
aaacaaaacaaaact

SEQ ID NO: 5073742 - DNA, 16 bp, Homo sapiens
aaacaaaacaaaacta

SEQ ID NO: 5073743 - DNA, 17 bp, Homo sapiens
aaacaaaacaaaactat

SEQ ID NO: 5073744 - DNA, 12 bp, Homo sapiens
aaacaaaacaac

SEQ ID NO: 5073745 - DNA, 14 bp, Homo sapiens
aaacaaaacaacaa

SEQ ID NO: 5073746 - DNA, 13 bp, Homo sapiens
aaacaaaaccaaa

SEQ ID NO: 5073747 - DNA, 19 bp, Homo sapiens
aaacaaaaccaagccttgg

SEQ ID NO: 5073748 - DNA, 20 bp, Homo sapiens
aaacaaaaccaattcatgaa

SEQ ID NO: 5073749 - DNA, 17 bp, Homo sapiens
aaacaaaaccagctgct

SEQ ID NO: 5073750 - DNA, 18 bp, Homo sapiens
aaacaaaactatacttga

SEQ ID NO: 5073751 - DNA, 14 bp, Homo sapiens
aaacaaaactggaa

SEQ ID NO: 5073752 - DNA, 13 bp, Homo sapiens
aaacaaaacttaa

SEQ ID NO: 5073753 - DNA, 14 bp, Homo sapiens
aaacaaaagagaga

SEQ ID NO: 5073754 - DNA, 19 bp, Homo sapiens
aaacaaaagctgaacacat

SEQ ID NO: 5073755 - DNA, 19 bp, Homo sapiens
aaacaaaagggtgtatagt

SEQ ID NO: 5073756 - DNA, 16 bp, Homo sapiens
aaacaaaatagaaagt

SEQ ID NO: 5073757 - DNA, 14 bp, Homo sapiens
aaacaaaatatctg

SEQ ID NO: 5073758 - DNA, 15 bp, Homo sapiens
aaacaaaatatctga

SEQ ID NO: 5073759 - DNA, 15 bp, Homo sapiens
aaacaaaatctgaac

SEQ ID NO: 5073760 - DNA, 12 bp, Homo sapiens
aaacaaaatgaa

SEQ ID NO: 5073761 - DNA, 17 bp, Homo sapiens
aaacaaaatgaaaaaaa

SEQ ID NO: 5073762 - DNA, 17 bp, Homo sapiens
aaacaaaatggcttcag

SEQ ID NO: 5073763 - DNA, 13 bp, Homo sapiens
aaacaaaatttat

SEQ ID NO: 5073764 - DNA, 13 bp, Homo sapiens
aaacaaacaaaac

SEQ ID NO: 5073765 - DNA, 16 bp, Homo sapiens
aaacaaacaaacaaaa

SEQ ID NO: 5073766 - DNA, 13 bp, Homo sapiens
aaacaaaccagaa

SEQ ID NO: 5073767 - DNA, 19 bp, Homo sapiens
aaacaaactctactaattt

SEQ ID NO: 5073768 - DNA, 21 bp, Homo sapiens
aaacaaactctcaaatcatga

SEQ ID NO: 5073769 - DNA, 13 bp, Homo sapiens
aaacaaacttctc

SEQ ID NO: 5073770 - DNA, 12 bp, Homo sapiens
aaacaaagaaag

SEQ ID NO: 5073771 - DNA, 12 bp, Homo sapiens
aaacaaagatgt

SEQ ID NO: 5073772 - DNA, 20 bp, Homo sapiens
aaacaaagatttgtggtaac

SEQ ID NO: 5073773 - DNA, 14 bp, Homo sapiens
aaacaaagcagtat

SEQ ID NO: 5073774 - DNA, 23 bp, Homo sapiens
aaacaaagcagtatataataact

SEQ ID NO: 5073775 - DNA, 12 bp, Homo sapiens
aaacaaagccag

SEQ ID NO: 5073776 - DNA, 13 bp, Homo sapiens
aaacaaagccaga

SEQ ID NO: 5073777 - DNA, 14 bp, Homo sapiens
aaacaaagccatgc

SEQ ID NO: 5073778 - DNA, 15 bp, Homo sapiens
aaacaaagctgatag

SEQ ID NO: 5073779 - DNA, 15 bp, Homo sapiens
aaacaaagctgattt

SEQ ID NO: 5073780 - DNA, 23 bp, Homo sapiens
aaacaaagcttagcaggagagga

SEQ ID NO: 5073781 - DNA, 19 bp, Homo sapiens
aaacaaaggatttgaaaac

SEQ ID NO: 5073782 - DNA, 20 bp, Homo sapiens
aaacaaaggcctaattctat

SEQ ID NO: 5073783 - DNA, 17 bp, Homo sapiens
aaacaaaggttgagatg

SEQ ID NO: 5073784 - DNA, 14 bp, Homo sapiens
aaacaaagtgcaaa

SEQ ID NO: 5073785 - DNA, 17 bp, Homo sapiens
aaacaaagtgcaaagct

SEQ ID NO: 5073786 - DNA, 18 bp, Homo sapiens
aaacaaagtgcaaagctg

SEQ ID NO: 5073787 - DNA, 17 bp, Homo sapiens
aaacaaagtggaaggaa

SEQ ID NO: 5073788 - DNA, 23 bp, Homo sapiens
aaacaaagtttcagagtatattg

SEQ ID NO: 5073789 - DNA, 12 bp, Homo sapiens
aaacaaataaaa

SEQ ID NO: 5073790 - DNA, 19 bp, Homo sapiens
aaacaaataaactagtctg

SEQ ID NO: 5073791 - DNA, 12 bp, Homo sapiens
aaacaaataata

SEQ ID NO: 5073792 - DNA, 22 bp, Homo sapiens
aaacaaatatgaaaaatgtaaa

SEQ ID NO: 5073793 - DNA, 13 bp, Homo sapiens
aaacaaatatgca

SEQ ID NO: 5073794 - DNA, 17 bp, Homo sapiens
aaacaaatatgcaaaag

SEQ ID NO: 5073795 - DNA, 22 bp, Homo sapiens
aaacaaatattgccaactcttc

SEQ ID NO: 5073796 - DNA, 16 bp, Homo sapiens
aaacaaatcaaacaca

SEQ ID NO: 5073797 - DNA, 14 bp, Homo sapiens
aaacaaatcatttt

SEQ ID NO: 5073798 - DNA, 18 bp, Homo sapiens
aaacaaatcattttgatg

SEQ ID NO: 5073799 - DNA, 19 bp, Homo sapiens
aaacaaatcattttgatgt

SEQ ID NO: 5073800 - DNA, 16 bp, Homo sapiens
aaacaaatgatttcca

SEQ ID NO: 5073801 - DNA, 17 bp, Homo sapiens
aaacaaatggaagagaa

SEQ ID NO: 5073802 - DNA, 22 bp, Homo sapiens
aaacaaatggcttacttacaaa

SEQ ID NO: 5073803 - DNA, 14 bp, Homo sapiens
aaacaaatgttcat

SEQ ID NO: 5073804 - DNA, 21 bp, Homo sapiens
aaacaaattagcaatcatttt

SEQ ID NO: 5073805 - DNA, 20 bp, Homo sapiens
aaacaaattcaagaatgcag

SEQ ID NO: 5073806 - DNA, 21 bp, Homo sapiens
aaacaaattcatattctgtct

SEQ ID NO: 5073807 - DNA, 13 bp, Homo sapiens
aaacaaattcttt

SEQ ID NO: 5073808 - DNA, 16 bp, Homo sapiens
aaacaacaaaggaagt

SEQ ID NO: 5073809 - DNA, 12 bp, Homo sapiens
aaacaacaaata

SEQ ID NO: 5073810 - DNA, 13 bp, Homo sapiens
aaacaacaacaat

SEQ ID NO: 5073811 - DNA, 14 bp, Homo sapiens
aaacaacaacaata

SEQ ID NO: 5073812 - DNA, 16 bp, Homo sapiens
aaacaacaacacaata

SEQ ID NO: 5073813 - DNA, 16 bp, Homo sapiens
aaacaacaatttctac

SEQ ID NO: 5073814 - DNA, 19 bp, Homo sapiens
aaacaacagaaacttctca

SEQ ID NO: 5073815 - DNA, 15 bp, Homo sapiens
aaacaacagctgaag

SEQ ID NO: 5073816 - DNA, 22 bp, Homo sapiens
aaacaacattaggggattcttc

SEQ ID NO: 5073817 - DNA, 17 bp, Homo sapiens
aaacaacatttatatgt

SEQ ID NO: 5073818 - DNA, 15 bp, Homo sapiens
aaacaaccatgtcat

SEQ ID NO: 5073819 - DNA, 17 bp, Homo sapiens
aaacaaccatgtcattt

SEQ ID NO: 5073820 - DNA, 18 bp, Homo sapiens
aaacgttaaaagtgtaca

SEQ ID NO: 5073821 - DNA, 13 bp, Homo sapiens
aaacgtttgaaat

SEQ ID NO: 5073822 - DNA, 14 bp, Homo sapiens
aaacgtttgacaaa

SEQ ID NO: 5073823 - DNA, 20 bp, Homo sapiens
aaacgttttatgtgaatgtg

SEQ ID NO: 5073824 - DNA, 21 bp, Homo sapiens
aaacgttttattgtgttttta

SEQ ID NO: 5073825 - DNA, 17 bp, Homo sapiens
aaacgttttgtttgaaa

SEQ ID NO: 5073826 - DNA, 20 bp, Homo sapiens
aaactaaaaaaaaaaaggcc

SEQ ID NO: 5073827 - DNA, 12 bp, Homo sapiens
aaactaaaaact

SEQ ID NO: 5073828 - DNA, 17 bp, Homo sapiens
aaactaaaaaggaagaa

SEQ ID NO: 5073829 - DNA, 14 bp, Homo sapiens
aaactaaaaataat

SEQ ID NO: 5073830 - DNA, 13 bp, Homo sapiens
aaactaaaaatat

SEQ ID NO: 5073831 - DNA, 14 bp, Homo sapiens
aaactaaaaatatt

SEQ ID NO: 5073832 - DNA, 18 bp, Homo sapiens
aaactaaaagacatttgt

SEQ ID NO: 5073833 - DNA, 11 bp, Homo sapiens
aaactaaaatc

SEQ ID NO: 5073834 - DNA, 13 bp, Homo sapiens
aaactaaaatcat

SEQ ID NO: 5073835 - DNA, 22 bp, Homo sapiens
aaactaaaattcaacaaatgat

SEQ ID NO: 5073836 - DNA, 17 bp, Homo sapiens
aaactaaacagaaaact

SEQ ID NO: 5073837 - DNA, 17 bp, Homo sapiens
aaactaaactacagaaa

SEQ ID NO: 5073838 - DNA, 13 bp, Homo sapiens
aaactaaacttta

SEQ ID NO: 5073839 - DNA, 19 bp, Homo sapiens
aaactaaagaaatttctca

SEQ ID NO: 5073840 - DNA, 17 bp, Homo sapiens
aaactaaagcaatagaa

SEQ ID NO: 5073841 - DNA, 17 bp, Homo sapiens
aaactaaagttgaaaat

SEQ ID NO: 5073842 - DNA, 17 bp, Homo sapiens
aaactaaatagcatgta

SEQ ID NO: 5073843 - DNA, 23 bp, Homo sapiens
aaactaaatagcatgtattgtgt

SEQ ID NO: 5073844 - DNA, 16 bp, Homo sapiens
aaactaaatgtgtaca

SEQ ID NO: 5073845 - DNA, 14 bp, Homo sapiens
aaactaaattactg

SEQ ID NO: 5073846 - DNA, 13 bp, Homo sapiens
aaactaaattgta

SEQ ID NO: 5073847 - DNA, 20 bp, Homo sapiens
aaactaaattgtaaactcct

SEQ ID NO: 5073848 - DNA, 13 bp, Homo sapiens
aaactaaatttca

SEQ ID NO: 5073849 - DNA, 14 bp, Homo sapiens
aaactaacaatatg

SEQ ID NO: 5073850 - DNA, 20 bp, Homo sapiens
aaactaacagataagcaaga

SEQ ID NO: 5073851 - DNA, 12 bp, Homo sapiens
aaactaaccttt

SEQ ID NO: 5073852 - DNA, 20 bp, Homo sapiens
aaactaactaataaaatata

SEQ ID NO: 5073853 - DNA, 13 bp, Homo sapiens
aaactaagaatca

SEQ ID NO: 5073854 - DNA, 16 bp, Homo sapiens
aaactaagatctgtta

SEQ ID NO: 5073855 - DNA, 16 bp, Homo sapiens
aaactaagattctttt

SEQ ID NO: 5073856 - DNA, 14 bp, Homo sapiens
aaactaagcattgt

SEQ ID NO: 5073857 - DNA, 14 bp, Homo sapiens
aaactaagccaggc

SEQ ID NO: 5073858 - DNA, 16 bp, Homo sapiens
aaactaaggtgctaaa

SEQ ID NO: 5073859 - DNA, 12 bp, Homo sapiens
aaactaataaaa

SEQ ID NO: 5073860 - DNA, 20 bp, Homo sapiens
aaactaataaaatattttct

SEQ ID NO: 5073861 - DNA, 15 bp, Homo sapiens
aaactaataattgca

SEQ ID NO: 5073862 - DNA, 23 bp, Homo sapiens
aaactaatcttaaccctgtgctg

SEQ ID NO: 5073863 - DNA, 13 bp, Homo sapiens
aaactaatgagtt

SEQ ID NO: 5073864 - DNA, 18 bp, Homo sapiens
aaactaatgtactgtaca

SEQ ID NO: 5073865 - DNA, 19 bp, Homo sapiens
aaactaatgtactgtacat

SEQ ID NO: 5073866 - DNA, 13 bp, Homo sapiens
aaactaatgtgtc

SEQ ID NO: 5073867 - DNA, 22 bp, Homo sapiens
aaactaattctcacatccctct

SEQ ID NO: 5073868 - DNA, 23 bp, Homo sapiens
aaactaattctcacatccctcta

SEQ ID NO: 5073869 - DNA, 12 bp, Homo sapiens
aaactaattgta

SEQ ID NO: 5073870 - DNA, 15 bp, Homo sapiens
aaactacaaacgttt

SEQ ID NO: 5073871 - DNA, 14 bp, Homo sapiens
aaactacaaagtaa

SEQ ID NO: 5073872 - DNA, 12 bp, Homo sapiens
aaactacaaata

SEQ ID NO: 5073873 - DNA, 21 bp, Homo sapiens
aaactacaaccaatggaatgt

SEQ ID NO: 5073874 - DNA, 15 bp, Homo sapiens
aaactacagatcttt

SEQ ID NO: 5073875 - DNA, 15 bp, Homo sapiens
aaactacatattgta

SEQ ID NO: 5073876 - DNA, 20 bp, Homo sapiens
aaactacattaggttgtgaa

SEQ ID NO: 5073877 - DNA, 21 bp, Homo sapiens
aaactacattaggttgtgaat

SEQ ID NO: 5073878 - DNA, 12 bp, Homo sapiens
aaactacatttc

SEQ ID NO: 5073879 - DNA, 14 bp, Homo sapiens
aaactacattttaa

SEQ ID NO: 5073880 - DNA, 23 bp, Homo sapiens
aaactaccaccctcgctgccacc

SEQ ID NO: 5073881 - DNA, 17 bp, Homo sapiens
aaactaccacctcaggt

SEQ ID NO: 5073882 - DNA, 22 bp, Homo sapiens
aaactaccactttttttaacca

SEQ ID NO: 5073883 - DNA, 17 bp, Homo sapiens
aaactaccctccagagt

SEQ ID NO: 5073884 - DNA, 21 bp, Homo sapiens
aaactacctgtatttaaaaat

SEQ ID NO: 5073885 - DNA, 18 bp, Homo sapiens
aaactacctgtgagcatg

SEQ ID NO: 5073886 - DNA, 13 bp, Homo sapiens
aaactactaattt

SEQ ID NO: 5073887 - DNA, 21 bp, Homo sapiens
aaactactatttttctttcca

SEQ ID NO: 5073888 - DNA, 14 bp, Homo sapiens
aaactactctttga

SEQ ID NO: 5073889 - DNA, 16 bp, Homo sapiens
aaactactgaataaat

SEQ ID NO: 5073890 - DNA, 20 bp, Homo sapiens
aaactactgattgaatgtta

SEQ ID NO: 5073891 - DNA, 21 bp, Homo sapiens
aaactactgattgaatgttaa

SEQ ID NO: 5073892 - DNA, 17 bp, Homo sapiens
aaactactgcctttcaa

SEQ ID NO: 5073893 - DNA, 13 bp, Homo sapiens
aaactactgtaat

SEQ ID NO: 5073894 - DNA, 17 bp, Homo sapiens
aaactactgtacatttt

SEQ ID NO: 5073895 - DNA, 14 bp, Homo sapiens
aaactacttcattt

SEQ ID NO: 5073896 - DNA, 15 bp, Homo sapiens
aaactacttcatttt

SEQ ID NO: 5073897 - DNA, 17 bp, Homo sapiens
aaactacttttctaaaa

SEQ ID NO: 5073898 - DNA, 23 bp, Homo sapiens
aaactacttttgtaccagtgtga

SEQ ID NO: 5073899 - DNA, 16 bp, Homo sapiens
aaactagaatttcatt

SEQ ID NO: 5073900 - DNA, 14 bp, Homo sapiens
aaactagacaaaag

SEQ ID NO: 5073901 - DNA, 15 bp, Homo sapiens
aaactagataactta

SEQ ID NO: 5073902 - DNA, 21 bp, Homo sapiens
aaactagataacttaaataat

SEQ ID NO: 5073903 - DNA, 13 bp, Homo sapiens
aaactagatgacc

SEQ ID NO: 5073904 - DNA, 17 bp, Homo sapiens
aaactagatgacctcat

SEQ ID NO: 5073905 - DNA, 22 bp, Homo sapiens
aaactagatgacctcattaacc

SEQ ID NO: 5073906 - DNA, 21 bp, Homo sapiens
aaactagcatatctgccttta

SEQ ID NO: 5073907 - DNA, 22 bp, Homo sapiens
aaactagcatatctgcctttat

SEQ ID NO: 5073908 - DNA, 19 bp, Homo sapiens
aaactagcttacatgagaa

SEQ ID NO: 5073909 - DNA, 21 bp, Homo sapiens
aaactaggagatgaaactggt

SEQ ID NO: 5073910 - DNA, 18 bp, Homo sapiens
aaactaggaggaaaagac

SEQ ID NO: 5073911 - DNA, 20 bp, Homo sapiens
aaactaggattgacattcta

SEQ ID NO: 5073912 - DNA, 17 bp, Homo sapiens
aaactaggcaatgtact

SEQ ID NO: 5073913 - DNA, 20 bp, Homo sapiens
aaactaggcatttgtaaata

SEQ ID NO: 5073914 - DNA, 15 bp, Homo sapiens
aaactaggctccttc

SEQ ID NO: 5073915 - DNA, 20 bp, Homo sapiens
aaactaggcttctgtaatca

SEQ ID NO: 5073916 - DNA, 15 bp, Homo sapiens
aaactaggtaaaatt

SEQ ID NO: 5073917 - DNA, 16 bp, Homo sapiens
aaactaggtaatgttt

SEQ ID NO: 5073918 - DNA, 17 bp, Homo sapiens
aaactaggtaatgtttt

SEQ ID NO: 5073919 - DNA, 15 bp, Homo sapiens
aaactagtagttctc

SEQ ID NO: 5073920 - DNA, 18 bp, Homo sapiens
aaactagtagttctcttg

SEQ ID NO: 5073921 - DNA, 21 bp, Homo sapiens
aaactagtttaagggtggaaa

SEQ ID NO: 5073922 - DNA, 14 bp, Homo sapiens
aaactagtttccag

SEQ ID NO: 5073923 - DNA, 16 bp, Homo sapiens
aaactagtttccagtg

SEQ ID NO: 5073924 - DNA, 17 bp, Homo sapiens
aaactagtttccagtgg

SEQ ID NO: 5073925 - DNA, 21 bp, Homo sapiens
aaactataaaaaagaaagaat

SEQ ID NO: 5073926 - DNA, 19 bp, Homo sapiens
aaactataaactactgtaa

SEQ ID NO: 5073927 - DNA, 15 bp, Homo sapiens
aaactataaacttaa

SEQ ID NO: 5073928 - DNA, 14 bp, Homo sapiens
aaactataaataca

SEQ ID NO: 5073929 - DNA, 15 bp, Homo sapiens
aaactataaatacaa

SEQ ID NO: 5073930 - DNA, 23 bp, Homo sapiens
aaactataaatacaaatctgtat

SEQ ID NO: 5073931 - DNA, 13 bp, Homo sapiens
aaactatacttga

SEQ ID NO: 5073932 - DNA, 19 bp, Homo sapiens
aaactatacttgaacaaaa

SEQ ID NO: 5073933 - DNA, 22 bp, Homo sapiens
aaactatacttgaacaaaaggg

SEQ ID NO: 5073934 - DNA, 16 bp, Homo sapiens
aaactatagaataaag

SEQ ID NO: 5073935 - DNA, 17 bp, Homo sapiens
aaactatatataatgta

SEQ ID NO: 5073936 - DNA, 18 bp, Homo sapiens
aaactatcctatgccttc

SEQ ID NO: 5073937 - DNA, 21 bp, Homo sapiens
aaactatccttctctttcaat

SEQ ID NO: 5073938 - DNA, 22 bp, Homo sapiens
aaactatccttctctttcaatg

SEQ ID NO: 5073939 - DNA, 18 bp, Homo sapiens
aaactatcggttcaagtt

SEQ ID NO: 5073940 - DNA, 18 bp, Homo sapiens
aaactatctgtatttatt

SEQ ID NO: 5073941 - DNA, 23 bp, Homo sapiens
aaactatctgtatttattatttg

SEQ ID NO: 5073942 - DNA, 14 bp, Homo sapiens
aaactatcttgtgt

SEQ ID NO: 5073943 - DNA, 14 bp, Homo sapiens
aaactatgaaacct

SEQ ID NO: 5073944 - DNA, 19 bp, Homo sapiens
aaactatgaaacctttttc

SEQ ID NO: 5073945 - DNA, 17 bp, Homo sapiens
aaactatgaagatctga

SEQ ID NO: 5073946 - DNA, 20 bp, Homo sapiens
aaactatggctttaaactac

SEQ ID NO: 5073947 - DNA, 23 bp, Homo sapiens
aaactatggttcccaataaaagt

SEQ ID NO: 5073948 - DNA, 17 bp, Homo sapiens
aaactatgtgtttttct

SEQ ID NO: 5073949 - DNA, 14 bp, Homo sapiens
aaactatgttccta

SEQ ID NO: 5073950 - DNA, 21 bp, Homo sapiens
aaactattaaggatgtagctt

SEQ ID NO: 5073951 - DNA, 22 bp, Homo sapiens
aaactattaaggatgtagcttt

SEQ ID NO: 5073952 - DNA, 17 bp, Homo sapiens
aaactattacttacaaa

SEQ ID NO: 5073953 - DNA, 17 bp, Homo sapiens
aaactattagagtattt

SEQ ID NO: 5073954 - DNA, 17 bp, Homo sapiens
aaactattcagaggaaa

SEQ ID NO: 5073955 - DNA, 19 bp, Homo sapiens
aaactattcatgctaccca

SEQ ID NO: 5073956 - DNA, 15 bp, Homo sapiens
aaactattccatgtt

SEQ ID NO: 5073957 - DNA, 13 bp, Homo sapiens
aaactattcttaa

SEQ ID NO: 5073958 - DNA, 15 bp, Homo sapiens
aaactattgagcctt

SEQ ID NO: 5073959 - DNA, 20 bp, Homo sapiens
aaactattggaaagtactcc

SEQ ID NO: 5073960 - DNA, 18 bp, Homo sapiens
aaactatttaaagaaata

SEQ ID NO: 5073961 - DNA, 16 bp, Homo sapiens
aaactatttaacattc

SEQ ID NO: 5073962 - DNA, 13 bp, Homo sapiens
aaactatttaact

SEQ ID NO: 5073963 - DNA, 17 bp, Homo sapiens
aaactatttaacttgag

SEQ ID NO: 5073964 - DNA, 13 bp, Homo sapiens
aaactatttatct

SEQ ID NO: 5073965 - DNA, 13 bp, Homo sapiens
aaactatttcaga

SEQ ID NO: 5073966 - DNA, 14 bp, Homo sapiens
aaactatttgtata

SEQ ID NO: 5073967 - DNA, 15 bp, Homo sapiens
aaactatttgtataa

SEQ ID NO: 5073968 - DNA, 16 bp, Homo sapiens
aaactatttttttctt

SEQ ID NO: 5073969 - DNA, 18 bp, Homo sapiens
aaactcaaaacttaacat

SEQ ID NO: 5073970 - DNA, 22 bp, Homo sapiens
aaactcaaaacttaacatattt

SEQ ID NO: 5073971 - DNA, 21 bp, Homo sapiens
aaactcaaaatatttgtacat

SEQ ID NO: 5073972 - DNA, 15 bp, Homo sapiens
aaactcaaacttttc

SEQ ID NO: 5073973 - DNA, 15 bp, Homo sapiens
aaactcaaagaatgt

SEQ ID NO: 5073974 - DNA, 17 bp, Homo sapiens
aaactcaaccaaatggt

SEQ ID NO: 5073975 - DNA, 18 bp, Homo sapiens
aaactcaaccaaatggta

SEQ ID NO: 5073976 - DNA, 17 bp, Homo sapiens
aaactcaaccagagtca

SEQ ID NO: 5073977 - DNA, 14 bp, Homo sapiens
aaactcaagcttct

SEQ ID NO: 5073978 - DNA, 13 bp, Homo sapiens
aaactcacaaatg

SEQ ID NO: 5073979 - DNA, 15 bp, Homo sapiens
aaactcaccatttca

SEQ ID NO: 5073980 - DNA, 19 bp, Homo sapiens
aaactcacctgctggcccc

SEQ ID NO: 5073981 - DNA, 20 bp, Homo sapiens
aaactcacctgctggcccct

SEQ ID NO: 5073982 - DNA, 22 bp, Homo sapiens
aaactcacctgctggcccctca

SEQ ID NO: 5073983 - DNA, 13 bp, Homo sapiens
aaactcaccttga

SEQ ID NO: 5073984 - DNA, 21 bp, Homo sapiens
aaactcactcagtaaaacata

SEQ ID NO: 5073985 - DNA, 14 bp, Homo sapiens
aaactcagaaggct

SEQ ID NO: 5073986 - DNA, 13 bp, Homo sapiens
aaactcagaatat

SEQ ID NO: 5073987 - DNA, 15 bp, Homo sapiens
aaactcagatctgat

SEQ ID NO: 5073988 - DNA, 20 bp, Homo sapiens
aaactcaggaaagaggagat

SEQ ID NO: 5073989 - DNA, 17 bp, Homo sapiens
aaactcagggacagagc

SEQ ID NO: 5073990 - DNA, 20 bp, Homo sapiens
aaactcagtctcaaataata

SEQ ID NO: 5073991 - DNA, 16 bp, Homo sapiens
aaactcagttaaaatg

SEQ ID NO: 5073992 - DNA, 14 bp, Homo sapiens
aaactcagttccaa

SEQ ID NO: 5073993 - DNA, 13 bp, Homo sapiens
aaactcatacagt

SEQ ID NO: 5073994 - DNA, 15 bp, Homo sapiens
aaactcatacagtct

SEQ ID NO: 5073995 - DNA, 21 bp, Homo sapiens
aaactcatacagtctctattt

SEQ ID NO: 5073996 - DNA, 14 bp, Homo sapiens
aaactcatcatttt

SEQ ID NO: 5073997 - DNA, 20 bp, Homo sapiens
aaactcatcgttctaaaatc

SEQ ID NO: 5073998 - DNA, 17 bp, Homo sapiens
aaactcatctgaaatgt

SEQ ID NO: 5073999 - DNA, 15 bp, Homo sapiens
aaactcattgcagca

SEQ ID NO: 5074000 - DNA, 22 bp, Homo sapiens
aaacaaccattttttgttctgt

SEQ ID NO: 5074001 - DNA, 23 bp, Homo sapiens
aaacaaccattttttgttctgtg

SEQ ID NO: 5074002 - DNA, 22 bp, Homo sapiens
aaacaaccgtcctgctgtccct

SEQ ID NO: 5074003 - DNA, 18 bp, Homo sapiens
aaacaacctgaatctttt

SEQ ID NO: 5074004 - DNA, 15 bp, Homo sapiens
aaacaaccttcagct

SEQ ID NO: 5074005 - DNA, 17 bp, Homo sapiens
aaacaacgcaaacctct

SEQ ID NO: 5074006 - DNA, 19 bp, Homo sapiens
aaacaacgcattgccacgg

SEQ ID NO: 5074007 - DNA, 22 bp, Homo sapiens
aaacaacgtgtatagtgcctaa

SEQ ID NO: 5074008 - DNA, 18 bp, Homo sapiens
aaacaactgccaaataaa

SEQ ID NO: 5074009 - DNA, 23 bp, Homo sapiens
aaacaactgccaaataaaatgtt

SEQ ID NO: 5074010 - DNA, 18 bp, Homo sapiens
aaacaactttctcttgta

SEQ ID NO: 5074011 - DNA, 17 bp, Homo sapiens
aaacaagaaaaataaag

SEQ ID NO: 5074012 - DNA, 18 bp, Homo sapiens
aaacaagaaaaataaaga

SEQ ID NO: 5074013 - DNA, 20 bp, Homo sapiens
aaacaagaaaaataaagaaa

SEQ ID NO: 5074014 - DNA, 21 bp, Homo sapiens
aaacaagaaagaaatggcttt

SEQ ID NO: 5074015 - DNA, 12 bp, Homo sapiens
aaacaagaatgt

SEQ ID NO: 5074016 - DNA, 19 bp, Homo sapiens
aaacaagacacccaagtcc

SEQ ID NO: 5074017 - DNA, 20 bp, Homo sapiens
aaacaagaccacgtttctaa

SEQ ID NO: 5074018 - DNA, 23 bp, Homo sapiens
aaacaagagaccacttccttaac

SEQ ID NO: 5074019 - DNA, 21 bp, Homo sapiens
aaacaagagactgcttgacaa

SEQ ID NO: 5074020 - DNA, 12 bp, Homo sapiens
aaacaagaggac

SEQ ID NO: 5074021 - DNA, 20 bp, Homo sapiens
aaacaagaggacacaatggc

SEQ ID NO: 5074022 - DNA, 19 bp, Homo sapiens
aaacaagatgctggatgtc

SEQ ID NO: 5074023 - DNA, 11 bp, Homo sapiens
aaacaagcctt

SEQ ID NO: 5074024 - DNA, 16 bp, Homo sapiens
aaacaaggaagccaaa

SEQ ID NO: 5074025 - DNA, 19 bp, Homo sapiens
aaacaaggggctgttacat

SEQ ID NO: 5074026 - DNA, 12 bp, Homo sapiens
aaacaagtatga

SEQ ID NO: 5074027 - DNA, 14 bp, Homo sapiens
aaacaagtatgaat

SEQ ID NO: 5074028 - DNA, 16 bp, Homo sapiens
aaacaagtgtgatgcc

SEQ ID NO: 5074029 - DNA, 14 bp, Homo sapiens
aaacaataaacgaa

SEQ ID NO: 5074030 - DNA, 14 bp, Homo sapiens
aaacaatatagtct

SEQ ID NO: 5074031 - DNA, 12 bp, Homo sapiens
aaacaatatcat

SEQ ID NO: 5074032 - DNA, 15 bp, Homo sapiens
aaacaatatctgcag

SEQ ID NO: 5074033 - DNA, 16 bp, Homo sapiens
aaacaatatgctttac

SEQ ID NO: 5074034 - DNA, 18 bp, Homo sapiens
aaacaatatttattgtat

SEQ ID NO: 5074035 - DNA, 15 bp, Homo sapiens
aaacaatcacactca

SEQ ID NO: 5074036 - DNA, 18 bp, Homo sapiens
aaacaatcccaatctttc

SEQ ID NO: 5074037 - DNA, 22 bp, Homo sapiens
aaacaatcccaatctttctata

SEQ ID NO: 5074038 - DNA, 21 bp, Homo sapiens
aaacaatcctgttactctgtc

SEQ ID NO: 5074039 - DNA, 13 bp, Homo sapiens
aaacaatctattt

SEQ ID NO: 5074040 - DNA, 12 bp, Homo sapiens
aaacaatctctt

SEQ ID NO: 5074041 - DNA, 14 bp, Homo sapiens
aaacaatctgtaat

SEQ ID NO: 5074042 - DNA, 16 bp, Homo sapiens
aaacaatgaatgtctt

SEQ ID NO: 5074043 - DNA, 17 bp, Homo sapiens
aaacaatgcaaaacctt

SEQ ID NO: 5074044 - DNA, 14 bp, Homo sapiens
aaacaatgccatga

SEQ ID NO: 5074045 - DNA, 20 bp, Homo sapiens
aaacaatgccatgaacaaat

SEQ ID NO: 5074046 - DNA, 22 bp, Homo sapiens
aaacaatggtgtggtgaatgtg

SEQ ID NO: 5074047 - DNA, 21 bp, Homo sapiens
aaacaatgtataaagattgta

SEQ ID NO: 5074048 - DNA, 16 bp, Homo sapiens
aaacaatgttgtccaa

SEQ ID NO: 5074049 - DNA, 22 bp, Homo sapiens
aaacaatgttgtccaacaataa

SEQ ID NO: 5074050 - DNA, 17 bp, Homo sapiens
aaacaattcaagctgag

SEQ ID NO: 5074051 - DNA, 21 bp, Homo sapiens
aaacaattcaagctgagaaaa

SEQ ID NO: 5074052 - DNA, 23 bp, Homo sapiens
aaacaattcaatcaaagctacct

SEQ ID NO: 5074053 - DNA, 13 bp, Homo sapiens
aaacaattcagtg

SEQ ID NO: 5074054 - DNA, 16 bp, Homo sapiens
aaacaattcagtggtc

SEQ ID NO: 5074055 - DNA, 23 bp, Homo sapiens
aaacaattcatgcctttcatagt

SEQ ID NO: 5074056 - DNA, 19 bp, Homo sapiens
aaacaattcttgtaacttt

SEQ ID NO: 5074057 - DNA, 18 bp, Homo sapiens
aaacaattctttcaactg

SEQ ID NO: 5074058 - DNA, 17 bp, Homo sapiens
aaacaattggttgtata

SEQ ID NO: 5074059 - DNA, 22 bp, Homo sapiens
aaacaattggttgtatataaag

SEQ ID NO: 5074060 - DNA, 16 bp, Homo sapiens
aaacaattgtgacagc

SEQ ID NO: 5074061 - DNA, 15 bp, Homo sapiens
aaacaatttaaattg

SEQ ID NO: 5074062 - DNA, 13 bp, Homo sapiens
aaacaatttattt

SEQ ID NO: 5074063 - DNA, 14 bp, Homo sapiens
aaacaatttgcata

SEQ ID NO: 5074064 - DNA, 15 bp, Homo sapiens
aaacaatttgcataa

SEQ ID NO: 5074065 - DNA, 17 bp, Homo sapiens
aaacaattttctgtaat

SEQ ID NO: 5074066 - DNA, 12 bp, Homo sapiens
aaacaatttttt

SEQ ID NO: 5074067 - DNA, 20 bp, Homo sapiens
aaacaattttttgtgatgaa

SEQ ID NO: 5074068 - DNA, 15 bp, Homo sapiens
aaacacaaaaaaaat

SEQ ID NO: 5074069 - DNA, 13 bp, Homo sapiens
aaacacaaaacaa

SEQ ID NO: 5074070 - DNA, 18 bp, Homo sapiens
aaacacaaaacaaatcct

SEQ ID NO: 5074071 - DNA, 13 bp, Homo sapiens
aaacacaaaacat

SEQ ID NO: 5074072 - DNA, 15 bp, Homo sapiens
aaacacaaaatgaat

SEQ ID NO: 5074073 - DNA, 22 bp, Homo sapiens
aaacacaaaccacaactgacac

SEQ ID NO: 5074074 - DNA, 13 bp, Homo sapiens
aaacacaaatgca

SEQ ID NO: 5074075 - DNA, 20 bp, Homo sapiens
aaacacaacaagaaactgtc

SEQ ID NO: 5074076 - DNA, 12 bp, Homo sapiens
aaacacaacaca

SEQ ID NO: 5074077 - DNA, 14 bp, Homo sapiens
aaacacaactatat

SEQ ID NO: 5074078 - DNA, 22 bp, Homo sapiens
aaacacaagaaggaatcctgga

SEQ ID NO: 5074079 - DNA, 21 bp, Homo sapiens
aaacacaataagagtctcctt

SEQ ID NO: 5074080 - DNA, 20 bp, Homo sapiens
aaacacaatggagtgtgtaa

SEQ ID NO: 5074081 - DNA, 10 bp, Homo sapiens
aaacacacac

SEQ ID NO: 5074082 - DNA, 15 bp, Homo sapiens
aaacacacacacaca

SEQ ID NO: 5074083 - DNA, 14 bp, Homo sapiens
aaacacacagtatt

SEQ ID NO: 5074084 - DNA, 13 bp, Homo sapiens
aaacacacagtca

SEQ ID NO: 5074085 - DNA, 17 bp, Homo sapiens
aaacacacagtgaccaa

SEQ ID NO: 5074086 - DNA, 11 bp, Homo sapiens
aaacacacatt

SEQ ID NO: 5074087 - DNA, 23 bp, Homo sapiens
aaacacaccaggctgtgggcctc

SEQ ID NO: 5074088 - DNA, 14 bp, Homo sapiens
aaacacacgagcaa

SEQ ID NO: 5074089 - DNA, 19 bp, Homo sapiens
aaacacactgaggcaggga

SEQ ID NO: 5074090 - DNA, 17 bp, Homo sapiens
aaacacacttagaatac

SEQ ID NO: 5074091 - DNA, 19 bp, Homo sapiens
aaacacacttagaatacta

SEQ ID NO: 5074092 - DNA, 16 bp, Homo sapiens
aaacacacttttgcac

SEQ ID NO: 5074093 - DNA, 22 bp, Homo sapiens
aaacacacttttgcacatatat

SEQ ID NO: 5074094 - DNA, 13 bp, Homo sapiens
aaacacagagcgg

SEQ ID NO: 5074095 - DNA, 21 bp, Homo sapiens
aaacacagattgtattctatg

SEQ ID NO: 5074096 - DNA, 12 bp, Homo sapiens
aaacacagcaag

SEQ ID NO: 5074097 - DNA, 14 bp, Homo sapiens
aaacacagcaaggg

SEQ ID NO: 5074098 - DNA, 18 bp, Homo sapiens
aaacacaggctgtcctta

SEQ ID NO: 5074099 - DNA, 10 bp, Homo sapiens
aaacacaggg

SEQ ID NO: 5074100 - DNA, 14 bp, Homo sapiens
aaacacagggaaag

SEQ ID NO: 5074101 - DNA, 18 bp, Homo sapiens
aaacacagtattgtagaa

SEQ ID NO: 5074102 - DNA, 13 bp, Homo sapiens
aaacacagtgctg

SEQ ID NO: 5074103 - DNA, 16 bp, Homo sapiens
aaacacagtgtttttg

SEQ ID NO: 5074104 - DNA, 18 bp, Homo sapiens
aaacacagttacacttgt

SEQ ID NO: 5074105 - DNA, 18 bp, Homo sapiens
aaacacataaatgaaaga

SEQ ID NO: 5074106 - DNA, 19 bp, Homo sapiens
aaacacataaatgaaagaa

SEQ ID NO: 5074107 - DNA, 14 bp, Homo sapiens
aaacacataattaa

SEQ ID NO: 5074108 - DNA, 19 bp, Homo sapiens
aaacacataattaacactt

SEQ ID NO: 5074109 - DNA, 17 bp, Homo sapiens
aaacacataatttctgt

SEQ ID NO: 5074110 - DNA, 18 bp, Homo sapiens
aaacacataatttctgtt

SEQ ID NO: 5074111 - DNA, 23 bp, Homo sapiens
aaacacatacaaaagaattaaac

SEQ ID NO: 5074112 - DNA, 22 bp, Homo sapiens
aaacacatagattcacctgtaa

SEQ ID NO: 5074113 - DNA, 12 bp, Homo sapiens
aaacacatgata

SEQ ID NO: 5074114 - DNA, 13 bp, Homo sapiens
aaacacatgatac

SEQ ID NO: 5074115 - DNA, 15 bp, Homo sapiens
aaacacattaaaggt

SEQ ID NO: 5074116 - DNA, 21 bp, Homo sapiens
aaacacattaaaggtactttg

SEQ ID NO: 5074117 - DNA, 19 bp, Homo sapiens
aaacacattatgtatctta

SEQ ID NO: 5074118 - DNA, 14 bp, Homo sapiens
aaacacattgaatg

SEQ ID NO: 5074119 - DNA, 20 bp, Homo sapiens
aaacacattgttattttcag

SEQ ID NO: 5074120 - DNA, 12 bp, Homo sapiens
aaacacattttt

SEQ ID NO: 5074121 - DNA, 19 bp, Homo sapiens
aaacaccaacatgttggga

SEQ ID NO: 5074122 - DNA, 20 bp, Homo sapiens
aaacaccaccaaatgacaag

SEQ ID NO: 5074123 - DNA, 14 bp, Homo sapiens
aaacaccagtgtta

SEQ ID NO: 5074124 - DNA, 17 bp, Homo sapiens
aaacaccagtgttagct

SEQ ID NO: 5074125 - DNA, 13 bp, Homo sapiens
aaacaccatcttc

SEQ ID NO: 5074126 - DNA, 15 bp, Homo sapiens
aaacaccatcttcag

SEQ ID NO: 5074127 - DNA, 15 bp, Homo sapiens
aaacaccattataaa

SEQ ID NO: 5074128 - DNA, 16 bp, Homo sapiens
aaacaccattattcca

SEQ ID NO: 5074129 - DNA, 22 bp, Homo sapiens
aaacacccaaaaatatctcctc

SEQ ID NO: 5074130 - DNA, 21 bp, Homo sapiens
aaacacccaagcacaaactgt

SEQ ID NO: 5074131 - DNA, 14 bp, Homo sapiens
aaacacccctctgt

SEQ ID NO: 5074132 - DNA, 16 bp, Homo sapiens
aaacacctaagtgact

SEQ ID NO: 5074133 - DNA, 15 bp, Homo sapiens
aaacacctagcttta

SEQ ID NO: 5074134 - DNA, 17 bp, Homo sapiens
aaacacctccccagccc

SEQ ID NO: 5074135 - DNA, 15 bp, Homo sapiens
aaacacgaaacttgt

SEQ ID NO: 5074136 - DNA, 18 bp, Homo sapiens
aaacacgaaacttgttat

SEQ ID NO: 5074137 - DNA, 23 bp, Homo sapiens
aaacacgccttgttcctgctctt

SEQ ID NO: 5074138 - DNA, 16 bp, Homo sapiens
aaacacggagtttcca

SEQ ID NO: 5074139 - DNA, 21 bp, Homo sapiens
aaacacggagtttccatttgg

SEQ ID NO: 5074140 - DNA, 19 bp, Homo sapiens
aaacacggccctcctggga

SEQ ID NO: 5074141 - DNA, 23 bp, Homo sapiens
aaacacggcttctcatgctattt

SEQ ID NO: 5074142 - DNA, 16 bp, Homo sapiens
aaacacgtttagaaat

SEQ ID NO: 5074143 - DNA, 18 bp, Homo sapiens
aaacacgttttaaggact

SEQ ID NO: 5074144 - DNA, 15 bp, Homo sapiens
aaacactaaatgtta

SEQ ID NO: 5074145 - DNA, 19 bp, Homo sapiens
aaacactaaatgttaaaga

SEQ ID NO: 5074146 - DNA, 23 bp, Homo sapiens
aaacactaaattagtttaaaatg

SEQ ID NO: 5074147 - DNA, 17 bp, Homo sapiens
aaacactaagctctctg

SEQ ID NO: 5074148 - DNA, 17 bp, Homo sapiens
aaacactacacatttga

SEQ ID NO: 5074149 - DNA, 21 bp, Homo sapiens
aaacactcaaaatgatgcaac

SEQ ID NO: 5074150 - DNA, 24 bp, Homo sapiens
aaacactcagttgttcaataataa

SEQ ID NO: 5074151 - DNA, 11 bp, Homo sapiens
aaacactccac

SEQ ID NO: 5074152 - DNA, 20 bp, Homo sapiens
aaacactccacagtgtttat

SEQ ID NO: 5074153 - DNA, 14 bp, Homo sapiens
aaacactccttgca

SEQ ID NO: 5074154 - DNA, 20 bp, Homo sapiens
aaacactcggcatttcaaat

SEQ ID NO: 5074155 - DNA, 16 bp, Homo sapiens
aaacactcgtgtgcat

SEQ ID NO: 5074156 - DNA, 17 bp, Homo sapiens
aaacactcttgaaaaat

SEQ ID NO: 5074157 - DNA, 18 bp, Homo sapiens
aaacactgagaaaaagca

SEQ ID NO: 5074158 - DNA, 23 bp, Homo sapiens
aaacactgaggcagccttgggga

SEQ ID NO: 5074159 - DNA, 21 bp, Homo sapiens
aaacactgataatcacactgc

SEQ ID NO: 5074160 - DNA, 15 bp, Homo sapiens
aaacactgcaaattt

SEQ ID NO: 5074161 - DNA, 22 bp, Homo sapiens
aaacactgcaaattttaactgt

SEQ ID NO: 5074162 - DNA, 13 bp, Homo sapiens
aaacactgccttt

SEQ ID NO: 5074163 - DNA, 11 bp, Homo sapiens
aaacactggac

SEQ ID NO: 5074164 - DNA, 18 bp, Homo sapiens
aaacactggctctgggac

SEQ ID NO: 5074165 - DNA, 17 bp, Homo sapiens
aaacactgggctctgag

SEQ ID NO: 5074166 - DNA, 20 bp, Homo sapiens
aaacactgggctctgaggag

SEQ ID NO: 5074167 - DNA, 17 bp, Homo sapiens
aaacactggtgccaacc

SEQ ID NO: 5074168 - DNA, 16 bp, Homo sapiens
aaacactgtattgtaa

SEQ ID NO: 5074169 - DNA, 13 bp, Homo sapiens
aaacactgtggaa

SEQ ID NO: 5074170 - DNA, 23 bp, Homo sapiens
aaacactgtggaactaataaata

SEQ ID NO: 5074171 - DNA, 15 bp, Homo sapiens
aaacactgtgtaagc

SEQ ID NO: 5074172 - DNA, 18 bp, Homo sapiens
aaacactgttctctgccc

SEQ ID NO: 5074173 - DNA, 23 bp, Homo sapiens
aaacactgtttgttccagaatct

SEQ ID NO: 5074174 - DNA, 13 bp, Homo sapiens
aaacacttagtat

SEQ ID NO: 5074175 - DNA, 17 bp, Homo sapiens
aaacacttatcctcctg

SEQ ID NO: 5074176 - DNA, 18 bp, Homo sapiens
aaacacttatcttctgga

SEQ ID NO: 5074177 - DNA, 19 bp, Homo sapiens
aaacacttatcttctggat

SEQ ID NO: 5074178 - DNA, 15 bp, Homo sapiens
aaacacttattgttt

SEQ ID NO: 5074179 - DNA, 15 bp, Homo sapiens
aaacacttcaataat

SEQ ID NO: 5074180 - DNA, 22 bp, Homo sapiens
aaactcatttcctatgtaactg

SEQ ID NO: 5074181 - DNA, 16 bp, Homo sapiens
aaactcatttctagca

SEQ ID NO: 5074182 - DNA, 19 bp, Homo sapiens
aaactccacatctgcctta

SEQ ID NO: 5074183 - DNA, 15 bp, Homo sapiens
aaactccagatgcca

SEQ ID NO: 5074184 - DNA, 12 bp, Homo sapiens
aaactccagggt

SEQ ID NO: 5074185 - DNA, 22 bp, Homo sapiens
aaactccatctcaaaacaaaac

SEQ ID NO: 5074186 - DNA, 17 bp, Homo sapiens
aaactccccttccctgg

SEQ ID NO: 5074187 - DNA, 19 bp, Homo sapiens
aaactccccttccctgggg

SEQ ID NO: 5074188 - DNA, 22 bp, Homo sapiens
aaactccccttccctggggagc

SEQ ID NO: 5074189 - DNA, 18 bp, Homo sapiens
aaactcccttgtgttcct

SEQ ID NO: 5074190 - DNA, 17 bp, Homo sapiens
aaactccggattgcgtt

SEQ ID NO: 5074191 - DNA, 14 bp, Homo sapiens
aaactcctatttca

SEQ ID NO: 5074192 - DNA, 16 bp, Homo sapiens
aaactcctatttcaat

SEQ ID NO: 5074193 - DNA, 18 bp, Homo sapiens
aaactcctatttcaatga

SEQ ID NO: 5074194 - DNA, 22 bp, Homo sapiens
aaactcctcccttttatcttct

SEQ ID NO: 5074195 - DNA, 14 bp, Homo sapiens
aaactcctgacctc

SEQ ID NO: 5074196 - DNA, 19 bp, Homo sapiens
aaactcctgattttgtagt

SEQ ID NO: 5074197 - DNA, 23 bp, Homo sapiens
aaactcctggcctcaagcaatcc

SEQ ID NO: 5074198 - DNA, 12 bp, Homo sapiens
aaactcctgggc

SEQ ID NO: 5074199 - DNA, 11 bp, Homo sapiens
aaactcctgtg

SEQ ID NO: 5074200 - DNA, 20 bp, Homo sapiens
aaactcctttactgcagcct

SEQ ID NO: 5074201 - DNA, 20 bp, Homo sapiens
aaactcctttcttatcttga

SEQ ID NO: 5074202 - DNA, 22 bp, Homo sapiens
aaactcgagaccataaagatat

SEQ ID NO: 5074203 - DNA, 22 bp, Homo sapiens
aaactcgaggactgtatttgtg

SEQ ID NO: 5074204 - DNA, 24 bp, Homo sapiens
aaactcgaggactgtatttgtgac

SEQ ID NO: 5074205 - DNA, 18 bp, Homo sapiens
aaactctacaccctctgc

SEQ ID NO: 5074206 - DNA, 12 bp, Homo sapiens
aaactctagact

SEQ ID NO: 5074207 - DNA, 22 bp, Homo sapiens
aaactctagactgcaagaactg

SEQ ID NO: 5074208 - DNA, 23 bp, Homo sapiens
aaactctagactgcaagaactgt

SEQ ID NO: 5074209 - DNA, 14 bp, Homo sapiens
aaactctataaaga

SEQ ID NO: 5074210 - DNA, 15 bp, Homo sapiens
aaactctataaagaa

SEQ ID NO: 5074211 - DNA, 18 bp, Homo sapiens
aaactctataaagaaact

SEQ ID NO: 5074212 - DNA, 19 bp, Homo sapiens
aaactctataaagaaactt

SEQ ID NO: 5074213 - DNA, 21 bp, Homo sapiens
aaactctataaagaaactttt

SEQ ID NO: 5074214 - DNA, 20 bp, Homo sapiens
aaactctatcggagaacatg

SEQ ID NO: 5074215 - DNA, 23 bp, Homo sapiens
aaactctatttttgtaaaaaggg

SEQ ID NO: 5074216 - DNA, 16 bp, Homo sapiens
aaactctcattattct

SEQ ID NO: 5074217 - DNA, 13 bp, Homo sapiens
aaactctcctctg

SEQ ID NO: 5074218 - DNA, 13 bp, Homo sapiens
aaactctctgaac

SEQ ID NO: 5074219 - DNA, 17 bp, Homo sapiens
aaactctctttgggaat

SEQ ID NO: 5074220 - DNA, 18 bp, Homo sapiens
aaactctgaatttatctt

SEQ ID NO: 5074221 - DNA, 14 bp, Homo sapiens
aaactctgccagcc

SEQ ID NO: 5074222 - DNA, 11 bp, Homo sapiens
aaactctgctg

SEQ ID NO: 5074223 - DNA, 20 bp, Homo sapiens
aaactctgggtcttggccat

SEQ ID NO: 5074224 - DNA, 21 bp, Homo sapiens
aaactctgggtcttggccatg

SEQ ID NO: 5074225 - DNA, 22 bp, Homo sapiens
aaactctgggtcttggccatga

SEQ ID NO: 5074226 - DNA, 15 bp, Homo sapiens
aaactctggtgccgg

SEQ ID NO: 5074227 - DNA, 19 bp, Homo sapiens
aaactctgttgcaagtgca

SEQ ID NO: 5074228 - DNA, 18 bp, Homo sapiens
aaactcttagagaataag

SEQ ID NO: 5074229 - DNA, 12 bp, Homo sapiens
aaactcttcaag

SEQ ID NO: 5074230 - DNA, 11 bp, Homo sapiens
aaactcttcag

SEQ ID NO: 5074231 - DNA, 13 bp, Homo sapiens
aaactcttcagtg

SEQ ID NO: 5074232 - DNA, 13 bp, Homo sapiens
aaactcttctact

SEQ ID NO: 5074233 - DNA, 14 bp, Homo sapiens
aaactcttgaatat

SEQ ID NO: 5074234 - DNA, 22 bp, Homo sapiens
aaactcttgtgtacctttgtgt

SEQ ID NO: 5074235 - DNA, 12 bp, Homo sapiens
aaactctttaac

SEQ ID NO: 5074236 - DNA, 20 bp, Homo sapiens
aaactctttaacttgtaata

SEQ ID NO: 5074237 - DNA, 13 bp, Homo sapiens
aaactctttcatt

SEQ ID NO: 5074238 - DNA, 20 bp, Homo sapiens
aaactctttggtcgtttttt

SEQ ID NO: 5074239 - DNA, 18 bp, Homo sapiens
aaactctttttgggtcca

SEQ ID NO: 5074240 - DNA, 17 bp, Homo sapiens
aaactgaaaactgtaaa

SEQ ID NO: 5074241 - DNA, 14 bp, Homo sapiens
aaactgaaaatcta

SEQ ID NO: 5074242 - DNA, 13 bp, Homo sapiens
aaactgaaagtgt

SEQ ID NO: 5074243 - DNA, 14 bp, Homo sapiens
aaactgaaataaac

SEQ ID NO: 5074244 - DNA, 12 bp, Homo sapiens
aaactgaaatta

SEQ ID NO: 5074245 - DNA, 18 bp, Homo sapiens
aaactgaagcagcctctc

SEQ ID NO: 5074246 - DNA, 22 bp, Homo sapiens
aaactgaagcagcctctcccca

SEQ ID NO: 5074247 - DNA, 11 bp, Homo sapiens
aaactgaagct

SEQ ID NO: 5074248 - DNA, 13 bp, Homo sapiens
aaactgaaggttt

SEQ ID NO: 5074249 - DNA, 21 bp, Homo sapiens
aaactgaatataaagcttaat

SEQ ID NO: 5074250 - DNA, 18 bp, Homo sapiens
aaactgaatattttggaa

SEQ ID NO: 5074251 - DNA, 14 bp, Homo sapiens
aaactgaatggaag

SEQ ID NO: 5074252 - DNA, 13 bp, Homo sapiens
aaactgaatgtca

SEQ ID NO: 5074253 - DNA, 17 bp, Homo sapiens
aaactgaatttgtactt

SEQ ID NO: 5074254 - DNA, 19 bp, Homo sapiens
aaactgacaacctgtgcag

SEQ ID NO: 5074255 - DNA, 22 bp, Homo sapiens
aaactgacagtattaagggtag

SEQ ID NO: 5074256 - DNA, 19 bp, Homo sapiens
aaactgacatcagatttct

SEQ ID NO: 5074257 - DNA, 20 bp, Homo sapiens
aaactgacatcagatttctt

SEQ ID NO: 5074258 - DNA, 17 bp, Homo sapiens
aaactgacatttgttgt

SEQ ID NO: 5074259 - DNA, 17 bp, Homo sapiens
aaactgactcttaagaa

SEQ ID NO: 5074260 - DNA, 17 bp, Homo sapiens
aaactgagacaggcagt

SEQ ID NO: 5074261 - DNA, 17 bp, Homo sapiens
aaactgagagtaattca

SEQ ID NO: 5074262 - DNA, 21 bp, Homo sapiens
aaactgagatgtgaacacatc

SEQ ID NO: 5074263 - DNA, 14 bp, Homo sapiens
aaactgaggaattt

SEQ ID NO: 5074264 - DNA, 23 bp, Homo sapiens
aaactgaggagtagctgagagga

SEQ ID NO: 5074265 - DNA, 19 bp, Homo sapiens
aaactgaggccattatttc

SEQ ID NO: 5074266 - DNA, 21 bp, Homo sapiens
aaactgaggcccagagagctg

SEQ ID NO: 5074267 - DNA, 20 bp, Homo sapiens
aaactgaggtatggccatgc

SEQ ID NO: 5074268 - DNA, 20 bp, Homo sapiens
aaactgagtaaattggaaac

SEQ ID NO: 5074269 - DNA, 22 bp, Homo sapiens
aaactgagtataatcaataagc

SEQ ID NO: 5074270 - DNA, 13 bp, Homo sapiens
aaactgagtcact

SEQ ID NO: 5074271 - DNA, 20 bp, Homo sapiens
aaactgagtccatgaaaata

SEQ ID NO: 5074272 - DNA, 18 bp, Homo sapiens
aaactgagtcctgttctt

SEQ ID NO: 5074273 - DNA, 18 bp, Homo sapiens
aaactgatcaaaaataaa

SEQ ID NO: 5074274 - DNA, 19 bp, Homo sapiens
aaactgatcaaaaataaac

SEQ ID NO: 5074275 - DNA, 21 bp, Homo sapiens
aaactgatcaaaaataaacta

SEQ ID NO: 5074276 - DNA, 22 bp, Homo sapiens
aaactgatccagtataagacta

SEQ ID NO: 5074277 - DNA, 15 bp, Homo sapiens
aaactgatgctgagg

SEQ ID NO: 5074278 - DNA, 18 bp, Homo sapiens
aaactgatgtatagcttt

SEQ ID NO: 5074279 - DNA, 21 bp, Homo sapiens
aaactgatgtatagctttaac

SEQ ID NO: 5074280 - DNA, 23 bp, Homo sapiens
aaactgatgtatagctttaacat

SEQ ID NO: 5074281 - DNA, 14 bp, Homo sapiens
aaactgatgtgaaa

SEQ ID NO: 5074282 - DNA, 13 bp, Homo sapiens
aaactgatttttt

SEQ ID NO: 5074283 - DNA, 20 bp, Homo sapiens
aaactgatttttttttcctt

SEQ ID NO: 5074284 - DNA, 23 bp, Homo sapiens
aaactgatttttttttccttcag

SEQ ID NO: 5074285 - DNA, 16 bp, Homo sapiens
aaactgcaatagagac

SEQ ID NO: 5074286 - DNA, 12 bp, Homo sapiens
aaactgcacatg

SEQ ID NO: 5074287 - DNA, 14 bp, Homo sapiens
aaactgcacatgat

SEQ ID NO: 5074288 - DNA, 15 bp, Homo sapiens
aaactgcactgtcaa

SEQ ID NO: 5074289 - DNA, 10 bp, Homo sapiens
aaactgcagc

SEQ ID NO: 5074290 - DNA, 17 bp, Homo sapiens
aaactgcagcctctctg

SEQ ID NO: 5074291 - DNA, 23 bp, Homo sapiens
aaactgcagcctctctggctggt

SEQ ID NO: 5074292 - DNA, 13 bp, Homo sapiens
aaactgcaggagc

SEQ ID NO: 5074293 - DNA, 22 bp, Homo sapiens
aaactgcagtcatcaacaatga

SEQ ID NO: 5074294 - DNA, 17 bp, Homo sapiens
aaactgccacaagcaca

SEQ ID NO: 5074295 - DNA, 21 bp, Homo sapiens
aaactgccccctctgccctgc

SEQ ID NO: 5074296 - DNA, 19 bp, Homo sapiens
aaactgcctgacaattatg

SEQ ID NO: 5074297 - DNA, 20 bp, Homo sapiens
aaactgcctgacaattatga

SEQ ID NO: 5074298 - DNA, 20 bp, Homo sapiens
aaactgcgggaatactgtct

SEQ ID NO: 5074299 - DNA, 17 bp, Homo sapiens
aaactgcgttaaaggct

SEQ ID NO: 5074300 - DNA, 11 bp, Homo sapiens
aaactgctcag

SEQ ID NO: 5074301 - DNA, 12 bp, Homo sapiens
aaactgctcaga

SEQ ID NO: 5074302 - DNA, 15 bp, Homo sapiens
aaactgctcagacgt

SEQ ID NO: 5074303 - DNA, 15 bp, Homo sapiens
aaactgctgtctctt

SEQ ID NO: 5074304 - DNA, 20 bp, Homo sapiens
aaactgcttcctttcttgat

SEQ ID NO: 5074305 - DNA, 17 bp, Homo sapiens
aaactgcttgtttccta

SEQ ID NO: 5074306 - DNA, 13 bp, Homo sapiens
aaactgctttatt

SEQ ID NO: 5074307 - DNA, 23 bp, Homo sapiens
aaactgctttatttttataaaac

SEQ ID NO: 5074308 - DNA, 16 bp, Homo sapiens
aaactgctttgtgcat

SEQ ID NO: 5074309 - DNA, 17 bp, Homo sapiens
aaactgctttgtgcata

SEQ ID NO: 5074310 - DNA, 14 bp, Homo sapiens
aaactggaaacatc

SEQ ID NO: 5074311 - DNA, 14 bp, Homo sapiens
aaactggaagttat

SEQ ID NO: 5074312 - DNA, 16 bp, Homo sapiens
aaactggaataagcct

SEQ ID NO: 5074313 - DNA, 11 bp, Homo sapiens
aaactggagac

SEQ ID NO: 5074314 - DNA, 11 bp, Homo sapiens
aaactggagtc

SEQ ID NO: 5074315 - DNA, 15 bp, Homo sapiens
aaactggagtctgga

SEQ ID NO: 5074316 - DNA, 15 bp, Homo sapiens
aaactggatactgta

SEQ ID NO: 5074317 - DNA, 18 bp, Homo sapiens
aaactggatatttcaatc

SEQ ID NO: 5074318 - DNA, 19 bp, Homo sapiens
aaactggatatttcaatct

SEQ ID NO: 5074319 - DNA, 22 bp, Homo sapiens
aaactggattaaaacaattttt

SEQ ID NO: 5074320 - DNA, 16 bp, Homo sapiens
aaactggattaaactt

SEQ ID NO: 5074321 - DNA, 15 bp, Homo sapiens
aaactggattatcac

SEQ ID NO: 5074322 - DNA, 15 bp, Homo sapiens
aaactggcaaagcag

SEQ ID NO: 5074323 - DNA, 13 bp, Homo sapiens
aaactggcatctg

SEQ ID NO: 5074324 - DNA, 20 bp, Homo sapiens
aaactggcatctgacacaaa

SEQ ID NO: 5074325 - DNA, 15 bp, Homo sapiens
aaactggccccggat

SEQ ID NO: 5074326 - DNA, 19 bp, Homo sapiens
aaactggcttccccactcc

SEQ ID NO: 5074327 - DNA, 17 bp, Homo sapiens
aaactgggaaactgggt

SEQ ID NO: 5074328 - DNA, 15 bp, Homo sapiens
aaactgggatgggag

SEQ ID NO: 5074329 - DNA, 20 bp, Homo sapiens
aaactgggctggaagatatt

SEQ ID NO: 5074330 - DNA, 20 bp, Homo sapiens
aaactggggcctccagaact

SEQ ID NO: 5074331 - DNA, 16 bp, Homo sapiens
aaactggggcctccct

SEQ ID NO: 5074332 - DNA, 12 bp, Homo sapiens
aaactggggctg

SEQ ID NO: 5074333 - DNA, 21 bp, Homo sapiens
aaactgggtcttcagctttat

SEQ ID NO: 5074334 - DNA, 21 bp, Homo sapiens
aaactggtatgaataattgca

SEQ ID NO: 5074335 - DNA, 23 bp, Homo sapiens
aaactggtgggtctttaataaaa

SEQ ID NO: 5074336 - DNA, 22 bp, Homo sapiens
aaactggttctgtgttgaaata

SEQ ID NO: 5074337 - DNA, 23 bp, Homo sapiens
aaactggttctgtgttgaaatat

SEQ ID NO: 5074338 - DNA, 20 bp, Homo sapiens
aaactggtttataataaact

SEQ ID NO: 5074339 - DNA, 21 bp, Homo sapiens
aaactggttttaagtgctttc

SEQ ID NO: 5074340 - DNA, 14 bp, Homo sapiens
aaactgtaaaaaat

SEQ ID NO: 5074341 - DNA, 12 bp, Homo sapiens
aaactgtaaact

SEQ ID NO: 5074342 - DNA, 21 bp, Homo sapiens
aaactgtaaataaaatgtgta

SEQ ID NO: 5074343 - DNA, 20 bp, Homo sapiens
aaactgtaaatatgtttgtg

SEQ ID NO: 5074344 - DNA, 11 bp, Homo sapiens
aaactgtacag

SEQ ID NO: 5074345 - DNA, 15 bp, Homo sapiens
aaactgtacatttaa

SEQ ID NO: 5074346 - DNA, 20 bp, Homo sapiens
aaactgtactttgattcaca

SEQ ID NO: 5074347 - DNA, 17 bp, Homo sapiens
aaactgtagatgaagag

SEQ ID NO: 5074348 - DNA, 16 bp, Homo sapiens
aaactgtagctgtatt

SEQ ID NO: 5074349 - DNA, 16 bp, Homo sapiens
aaactgtagtctcagg

SEQ ID NO: 5074350 - DNA, 15 bp, Homo sapiens
aaactgtatgctcac

SEQ ID NO: 5074351 - DNA, 19 bp, Homo sapiens
aaactgtattaaatcttaa

SEQ ID NO: 5074352 - DNA, 14 bp, Homo sapiens
aaactgtattgatg

SEQ ID NO: 5074353 - DNA, 20 bp, Homo sapiens
aaactgtatttacttgttat

SEQ ID NO: 5074354 - DNA, 14 bp, Homo sapiens
aaactgtctgtctc

SEQ ID NO: 5074355 - DNA, 18 bp, Homo sapiens
aaactgtctttaaaagag

SEQ ID NO: 5074356 - DNA, 19 bp, Homo sapiens
aaactgtctttaaaagaga

SEQ ID NO: 5074357 - DNA, 16 bp, Homo sapiens
aaactgtgaaaatagt

SEQ ID NO: 5074358 - DNA, 17 bp, Homo sapiens
aaactgtgaaaatagtg

SEQ ID NO: 5074359 - DNA, 16 bp, Homo sapiens
aaacacttccagtctg

SEQ ID NO: 5074360 - DNA, 17 bp, Homo sapiens
aaacacttccagtctgg

SEQ ID NO: 5074361 - DNA, 18 bp, Homo sapiens
aaacacttcgttcgcaga

SEQ ID NO: 5074362 - DNA, 21 bp, Homo sapiens
aaacacttctcatcatattgt

SEQ ID NO: 5074363 - DNA, 16 bp, Homo sapiens
aaacacttctccttaa

SEQ ID NO: 5074364 - DNA, 15 bp, Homo sapiens
aaacacttctgcttt

SEQ ID NO: 5074365 - DNA, 17 bp, Homo sapiens
aaacacttctgctttca

SEQ ID NO: 5074366 - DNA, 19 bp, Homo sapiens
aaacacttggcatacaaaa

SEQ ID NO: 5074367 - DNA, 12 bp, Homo sapiens
aaacacttgtaa

SEQ ID NO: 5074368 - DNA, 14 bp, Homo sapiens
aaacactttcaaaa

SEQ ID NO: 5074369 - DNA, 15 bp, Homo sapiens
aaacactttcctgga

SEQ ID NO: 5074370 - DNA, 16 bp, Homo sapiens
aaacactttcctggat

SEQ ID NO: 5074371 - DNA, 13 bp, Homo sapiens
aaacacttttttg

SEQ ID NO: 5074372 - DNA, 14 bp, Homo sapiens
aaacacttttttgg

SEQ ID NO: 5074373 - DNA, 15 bp, Homo sapiens
aaacagaaaaaaaac

SEQ ID NO: 5074374 - DNA, 14 bp, Homo sapiens
aaacagaaaaaaag

SEQ ID NO: 5074375 - DNA, 20 bp, Homo sapiens
aaacagaaaaggttctgaat

SEQ ID NO: 5074376 - DNA, 14 bp, Homo sapiens
aaacagaaaagtag

SEQ ID NO: 5074377 - DNA, 19 bp, Homo sapiens
aaacagaaaatctttcctc

SEQ ID NO: 5074378 - DNA, 21 bp, Homo sapiens
aaacagaaacaaaaacactaa

SEQ ID NO: 5074379 - DNA, 21 bp, Homo sapiens
aaacagaaatcaggtgtttta

SEQ ID NO: 5074380 - DNA, 22 bp, Homo sapiens
aaacagaaatcaggtgttttaa

SEQ ID NO: 5074381 - DNA, 14 bp, Homo sapiens
aaacagaaatggaa

SEQ ID NO: 5074382 - DNA, 15 bp, Homo sapiens
aaacagaaattggta

SEQ ID NO: 5074383 - DNA, 15 bp, Homo sapiens
aaacagaagcttttt

SEQ ID NO: 5074384 - DNA, 13 bp, Homo sapiens
aaacagaaggaga

SEQ ID NO: 5074385 - DNA, 16 bp, Homo sapiens
aaacagaagtgcatcc

SEQ ID NO: 5074386 - DNA, 18 bp, Homo sapiens
aaacagaataaaagttcc

SEQ ID NO: 5074387 - DNA, 21 bp, Homo sapiens
aaacagaataaaagttcctct

SEQ ID NO: 5074388 - DNA, 17 bp, Homo sapiens
aaacagaatattctgta

SEQ ID NO: 5074389 - DNA, 17 bp, Homo sapiens
aaacagaatcagtgtta

SEQ ID NO: 5074390 - DNA, 16 bp, Homo sapiens
aaacagaatcttctgg

SEQ ID NO: 5074391 - DNA, 20 bp, Homo sapiens
aaacagaattttccatttat

SEQ ID NO: 5074392 - DNA, 13 bp, Homo sapiens
aaacagacaaaac

SEQ ID NO: 5074393 - DNA, 14 bp, Homo sapiens
aaacagacaaaaca

SEQ ID NO: 5074394 - DNA, 20 bp, Homo sapiens
aaacagacaaaacagataaa

SEQ ID NO: 5074395 - DNA, 20 bp, Homo sapiens
aaacagacaagcaacccaaa

SEQ ID NO: 5074396 - DNA, 15 bp, Homo sapiens
aaacagacaataatt

SEQ ID NO: 5074397 - DNA, 16 bp, Homo sapiens
aaacagacaatatgtg

SEQ ID NO: 5074398 - DNA, 22 bp, Homo sapiens
aaacagacaatatgtgagtgcc

SEQ ID NO: 5074399 - DNA, 20 bp, Homo sapiens
aaacagacaggaatttagaa

SEQ ID NO: 5074400 - DNA, 22 bp, Homo sapiens
aaacagacctaatgctccttgt

SEQ ID NO: 5074401 - DNA, 13 bp, Homo sapiens
aaacagactattt

SEQ ID NO: 5074402 - DNA, 22 bp, Homo sapiens
aaacagacttgtatattctatt

SEQ ID NO: 5074403 - DNA, 19 bp, Homo sapiens
aaacagagaaaagcttgga

SEQ ID NO: 5074404 - DNA, 15 bp, Homo sapiens
aaacagagaaagaaa

SEQ ID NO: 5074405 - DNA, 18 bp, Homo sapiens
aaacagagaaagaaaagg

SEQ ID NO: 5074406 - DNA, 13 bp, Homo sapiens
aaacagagagaga

SEQ ID NO: 5074407 - DNA, 18 bp, Homo sapiens
aaacagagagagacagag

SEQ ID NO: 5074408 - DNA, 15 bp, Homo sapiens
aaacagagcctgcct

SEQ ID NO: 5074409 - DNA, 16 bp, Homo sapiens
aaacagagcctgccta

SEQ ID NO: 5074410 - DNA, 17 bp, Homo sapiens
aaacagaggatgctgaa

SEQ ID NO: 5074411 - DNA, 19 bp, Homo sapiens
aaacagaggtaaaaaaaag

SEQ ID NO: 5074412 - DNA, 17 bp, Homo sapiens
aaacagagtaatcttgt

SEQ ID NO: 5074413 - DNA, 15 bp, Homo sapiens
aaacagagtggcctc

SEQ ID NO: 5074414 - DNA, 21 bp, Homo sapiens
aaacagagtggcctccctgct

SEQ ID NO: 5074415 - DNA, 15 bp, Homo sapiens
aaacagatataaatg

SEQ ID NO: 5074416 - DNA, 15 bp, Homo sapiens
aaacagatatcttca

SEQ ID NO: 5074417 - DNA, 22 bp, Homo sapiens
aaacagatattacagcttattt

SEQ ID NO: 5074418 - DNA, 17 bp, Homo sapiens
aaacagatgaaaagcct

SEQ ID NO: 5074419 - DNA, 18 bp, Homo sapiens
aaacagatgaccataatt

SEQ ID NO: 5074420 - DNA, 19 bp, Homo sapiens
aaacagatgataaatattt

SEQ ID NO: 5074421 - DNA, 22 bp, Homo sapiens
aaacagatgatgagaatttcta

SEQ ID NO: 5074422 - DNA, 16 bp, Homo sapiens
aaacagatggtagaga

SEQ ID NO: 5074423 - DNA, 21 bp, Homo sapiens
aaacagatgtattatgctgtt

SEQ ID NO: 5074424 - DNA, 15 bp, Homo sapiens
aaacagatgtccctg

SEQ ID NO: 5074425 - DNA, 14 bp, Homo sapiens
aaacagattctgat

SEQ ID NO: 5074426 - DNA, 17 bp, Homo sapiens
aaacagatttgttcatt

SEQ ID NO: 5074427 - DNA, 14 bp, Homo sapiens
aaacagattttttg

SEQ ID NO: 5074428 - DNA, 13 bp, Homo sapiens
aaacagcaaacca

SEQ ID NO: 5074429 - DNA, 24 bp, Homo sapiens
aaacagcaaaccaagagattgcta

SEQ ID NO: 5074430 - DNA, 12 bp, Homo sapiens
aaacagcacacc

SEQ ID NO: 5074431 - DNA, 20 bp, Homo sapiens
aaacagcacacctgtgtcca

SEQ ID NO: 5074432 - DNA, 14 bp, Homo sapiens
aaacagcagctcat

SEQ ID NO: 5074433 - DNA, 11 bp, Homo sapiens
aaacagcaggg

SEQ ID NO: 5074434 - DNA, 21 bp, Homo sapiens
aaacagcagggtttgagcaca

SEQ ID NO: 5074435 - DNA, 21 bp, Homo sapiens
aaacagcagtttgtgatatag

SEQ ID NO: 5074436 - DNA, 15 bp, Homo sapiens
aaacagcatcaaaat

SEQ ID NO: 5074437 - DNA, 12 bp, Homo sapiens
aaacagcatgaa

SEQ ID NO: 5074438 - DNA, 15 bp, Homo sapiens
aaacagcatgaataa

SEQ ID NO: 5074439 - DNA, 14 bp, Homo sapiens
aaacagcattgctt

SEQ ID NO: 5074440 - DNA, 18 bp, Homo sapiens
aaacagcattgctttctg

SEQ ID NO: 5074441 - DNA, 14 bp, Homo sapiens
aaacagccaaataa

SEQ ID NO: 5074442 - DNA, 14 bp, Homo sapiens
aaacagccagcaag

SEQ ID NO: 5074443 - DNA, 14 bp, Homo sapiens
aaacagccatgtcc

SEQ ID NO: 5074444 - DNA, 13 bp, Homo sapiens
aaacagccattgc

SEQ ID NO: 5074445 - DNA, 23 bp, Homo sapiens
aaacagccattgcggccccagga

SEQ ID NO: 5074446 - DNA, 14 bp, Homo sapiens
aaacagcccttcct

SEQ ID NO: 5074447 - DNA, 23 bp, Homo sapiens
aaacagccgtcagccaaatgtaa

SEQ ID NO: 5074448 - DNA, 21 bp, Homo sapiens
aaacagcctctctcttttcta

SEQ ID NO: 5074449 - DNA, 16 bp, Homo sapiens
aaacagcctgggtagg

SEQ ID NO: 5074450 - DNA, 20 bp, Homo sapiens
aaacagcctgggtaggaaaa

SEQ ID NO: 5074451 - DNA, 21 bp, Homo sapiens
aaacagctagcttgaaaactt

SEQ ID NO: 5074452 - DNA, 21 bp, Homo sapiens
aaacagctattatatcagctt

SEQ ID NO: 5074453 - DNA, 16 bp, Homo sapiens
aaacagctatttaagg

SEQ ID NO: 5074454 - DNA, 11 bp, Homo sapiens
aaacagctcag

SEQ ID NO: 5074455 - DNA, 14 bp, Homo sapiens
aaacagctcaggct

SEQ ID NO: 5074456 - DNA, 14 bp, Homo sapiens
aaacagctgcctta

SEQ ID NO: 5074457 - DNA, 17 bp, Homo sapiens
aaacagctgccttagct

SEQ ID NO: 5074458 - DNA, 13 bp, Homo sapiens
aaacagctgcttc

SEQ ID NO: 5074459 - DNA, 17 bp, Homo sapiens
aaacagctggacttatt

SEQ ID NO: 5074460 - DNA, 19 bp, Homo sapiens
aaacagctggacttattta

SEQ ID NO: 5074461 - DNA, 14 bp, Homo sapiens
aaacagctgtaact

SEQ ID NO: 5074462 - DNA, 21 bp, Homo sapiens
aaacagcttcatgcctttgta

SEQ ID NO: 5074463 - DNA, 12 bp, Homo sapiens
aaacaggaaaaa

SEQ ID NO: 5074464 - DNA, 11 bp, Homo sapiens
aaacaggacca

SEQ ID NO: 5074465 - DNA, 20 bp, Homo sapiens
aaacaggatacgatgactga

SEQ ID NO: 5074466 - DNA, 12 bp, Homo sapiens
aaacaggcagct

SEQ ID NO: 5074467 - DNA, 15 bp, Homo sapiens
aaacaggcccagcat

SEQ ID NO: 5074468 - DNA, 14 bp, Homo sapiens
aaacaggctgctta

SEQ ID NO: 5074469 - DNA, 17 bp, Homo sapiens
aaacagggacaaagaaa

SEQ ID NO: 5074470 - DNA, 11 bp, Homo sapiens
aaacagggagc

SEQ ID NO: 5074471 - DNA, 16 bp, Homo sapiens
aaacaggggatcaaag

SEQ ID NO: 5074472 - DNA, 17 bp, Homo sapiens
aaacaggggatcaaagt

SEQ ID NO: 5074473 - DNA, 18 bp, Homo sapiens
aaacaggggatcaaagtt

SEQ ID NO: 5074474 - DNA, 20 bp, Homo sapiens
aaacaggggatcaaagttcc

SEQ ID NO: 5074475 - DNA, 17 bp, Homo sapiens
aaacagggtccaggaat

SEQ ID NO: 5074476 - DNA, 19 bp, Homo sapiens
aaacagggtccaggaatgg

SEQ ID NO: 5074477 - DNA, 23 bp, Homo sapiens
aaacagggtggcccaggtggcta

SEQ ID NO: 5074478 - DNA, 23 bp, Homo sapiens
aaacaggtatatactttgaaagg

SEQ ID NO: 5074479 - DNA, 20 bp, Homo sapiens
aaacaggtgctggcccagca

SEQ ID NO: 5074480 - DNA, 19 bp, Homo sapiens
aaacaggtgtgtgtgaact

SEQ ID NO: 5074481 - DNA, 23 bp, Homo sapiens
aaacaggtttttgattttgaata

SEQ ID NO: 5074482 - DNA, 13 bp, Homo sapiens
aaacagtacagaa

SEQ ID NO: 5074483 - DNA, 22 bp, Homo sapiens
aaacagtagccccatcacattt

SEQ ID NO: 5074484 - DNA, 18 bp, Homo sapiens
aaacagtataatttgaca

SEQ ID NO: 5074485 - DNA, 15 bp, Homo sapiens
aaacagtatttattt

SEQ ID NO: 5074486 - DNA, 19 bp, Homo sapiens
aaacagtatttattttgta

SEQ ID NO: 5074487 - DNA, 22 bp, Homo sapiens
aaacagtatttctggtgtatat

SEQ ID NO: 5074488 - DNA, 15 bp, Homo sapiens
aaacagtctcaggaa

SEQ ID NO: 5074489 - DNA, 23 bp, Homo sapiens
aaacagtgaacttgtctggcttt

SEQ ID NO: 5074490 - DNA, 18 bp, Homo sapiens
aaacagtgggagggaatt

SEQ ID NO: 5074491 - DNA, 23 bp, Homo sapiens
aaacagtgtggcttaaacatttt

SEQ ID NO: 5074492 - DNA, 13 bp, Homo sapiens
aaacagtgtttat

SEQ ID NO: 5074493 - DNA, 14 bp, Homo sapiens
aaacagttaacttt

SEQ ID NO: 5074494 - DNA, 18 bp, Homo sapiens
aaacagttaactttcaga

SEQ ID NO: 5074495 - DNA, 17 bp, Homo sapiens
aaacagttatacagatg

SEQ ID NO: 5074496 - DNA, 15 bp, Homo sapiens
aaacagttgcacagc

SEQ ID NO: 5074497 - DNA, 17 bp, Homo sapiens
aaacagttgcacagcat

SEQ ID NO: 5074498 - DNA, 19 bp, Homo sapiens
aaacagttgcacagcatct

SEQ ID NO: 5074499 - DNA, 18 bp, Homo sapiens
aaacagttgcatgtagta

SEQ ID NO: 5074500 - DNA, 20 bp, Homo sapiens
aaacagttgcatgtagtaac

SEQ ID NO: 5074501 - DNA, 24 bp, Homo sapiens
aaacagttgcatgtagtaacacta

SEQ ID NO: 5074502 - DNA, 14 bp, Homo sapiens
aaacagttggcact

SEQ ID NO: 5074503 - DNA, 16 bp, Homo sapiens
aaacagttggtaactt

SEQ ID NO: 5074504 - DNA, 18 bp, Homo sapiens
aaacagttggtaactttt

SEQ ID NO: 5074505 - DNA, 15 bp, Homo sapiens
aaacataaaaaccaa

SEQ ID NO: 5074506 - DNA, 14 bp, Homo sapiens
aaacataaaaactg

SEQ ID NO: 5074507 - DNA, 15 bp, Homo sapiens
aaacataaaaagcag

SEQ ID NO: 5074508 - DNA, 20 bp, Homo sapiens
aaacataaaaagcagaattt

SEQ ID NO: 5074509 - DNA, 18 bp, Homo sapiens
aaacataaaaatcactca

SEQ ID NO: 5074510 - DNA, 14 bp, Homo sapiens
aaacataaaatgag

SEQ ID NO: 5074511 - DNA, 16 bp, Homo sapiens
aaacataaacacattt

SEQ ID NO: 5074512 - DNA, 14 bp, Homo sapiens
aaacataaataaaa

SEQ ID NO: 5074513 - DNA, 14 bp, Homo sapiens
aaacataagacgac

SEQ ID NO: 5074514 - DNA, 22 bp, Homo sapiens
aaacataagctacctgaatgga

SEQ ID NO: 5074515 - DNA, 12 bp, Homo sapiens
aaacataataaa

SEQ ID NO: 5074516 - DNA, 22 bp, Homo sapiens
aaacataataaatcacacattc

SEQ ID NO: 5074517 - DNA, 13 bp, Homo sapiens
aaacataataata

SEQ ID NO: 5074518 - DNA, 15 bp, Homo sapiens
aaacataatagaatt

SEQ ID NO: 5074519 - DNA, 16 bp, Homo sapiens
aaacataatataagaa

SEQ ID NO: 5074520 - DNA, 17 bp, Homo sapiens
aaacataatataagaat

SEQ ID NO: 5074521 - DNA, 14 bp, Homo sapiens
aaacataattgtgg

SEQ ID NO: 5074522 - DNA, 16 bp, Homo sapiens
aaacataattgtggat

SEQ ID NO: 5074523 - DNA, 12 bp, Homo sapiens
aaacatacagag

SEQ ID NO: 5074524 - DNA, 20 bp, Homo sapiens
aaacatacagaggatgcctt

SEQ ID NO: 5074525 - DNA, 16 bp, Homo sapiens
aaacatacgtgtgcat

SEQ ID NO: 5074526 - DNA, 18 bp, Homo sapiens
aaacatacttacatttca

SEQ ID NO: 5074527 - DNA, 14 bp, Homo sapiens
aaacatagaaaaat

SEQ ID NO: 5074528 - DNA, 22 bp, Homo sapiens
aaacatagaaaaatgatgtctt

SEQ ID NO: 5074529 - DNA, 12 bp, Homo sapiens
aaacatagaaac

SEQ ID NO: 5074530 - DNA, 19 bp, Homo sapiens
aaacatagaaacatacaca

SEQ ID NO: 5074531 - DNA, 15 bp, Homo sapiens
aaacatagaaagaca

SEQ ID NO: 5074532 - DNA, 16 bp, Homo sapiens
aaacatagactgaaga

SEQ ID NO: 5074533 - DNA, 14 bp, Homo sapiens
aaacatagatagtg

SEQ ID NO: 5074534 - DNA, 19 bp, Homo sapiens
aaacatagtggtattttaa

SEQ ID NO: 5074535 - DNA, 21 bp, Homo sapiens
aaacatagtggtattttaaca

SEQ ID NO: 5074536 - DNA, 16 bp, Homo sapiens
aaacatatataacaat

SEQ ID NO: 5074537 - DNA, 15 bp, Homo sapiens
aaacatatcaattca

SEQ ID NO: 5074538 - DNA, 16 bp, Homo sapiens
aaacatatcaattcaa

SEQ ID NO: 5074539 - DNA, 20 bp, Homo sapiens
aaacatatcaattcaacaca

SEQ ID NO: 5074540 - DNA, 11 bp, Homo sapiens
aaactgtgaat

SEQ ID NO: 5074541 - DNA, 12 bp, Homo sapiens
aaactgtgaatg

SEQ ID NO: 5074542 - DNA, 10 bp, Homo sapiens
aaactgtgag

SEQ ID NO: 5074543 - DNA, 14 bp, Homo sapiens
aaactgtgagataa

SEQ ID NO: 5074544 - DNA, 17 bp, Homo sapiens
aaactgtgagataaata

SEQ ID NO: 5074545 - DNA, 20 bp, Homo sapiens
aaactgtgagataaatatca

SEQ ID NO: 5074546 - DNA, 12 bp, Homo sapiens
aaactgtgcacc

SEQ ID NO: 5074547 - DNA, 23 bp, Homo sapiens
aaactgtgcttctctatgataat

SEQ ID NO: 5074548 - DNA, 16 bp, Homo sapiens
aaactgtggcaactga

SEQ ID NO: 5074549 - DNA, 15 bp, Homo sapiens
aaactgtgtatcatt

SEQ ID NO: 5074550 - DNA, 21 bp, Homo sapiens
aaactgtgtatcattaaaata

SEQ ID NO: 5074551 - DNA, 17 bp, Homo sapiens
aaactgtgtattatttg

SEQ ID NO: 5074552 - DNA, 19 bp, Homo sapiens
aaactgtgtattatttgga

SEQ ID NO: 5074553 - DNA, 14 bp, Homo sapiens
aaactgtgttgcca

SEQ ID NO: 5074554 - DNA, 22 bp, Homo sapiens
aaactgttaacttattcaaaga

SEQ ID NO: 5074555 - DNA, 21 bp, Homo sapiens
aaactgttacctaaagtattt

SEQ ID NO: 5074556 - DNA, 16 bp, Homo sapiens
aaactgttagcactgt

SEQ ID NO: 5074557 - DNA, 16 bp, Homo sapiens
aaactgttatttttac

SEQ ID NO: 5074558 - DNA, 22 bp, Homo sapiens
aaactgttcaagaaataataaa

SEQ ID NO: 5074559 - DNA, 20 bp, Homo sapiens
aaactgttcccacctgctgg

SEQ ID NO: 5074560 - DNA, 16 bp, Homo sapiens
aaactgttcttttgca

SEQ ID NO: 5074561 - DNA, 16 bp, Homo sapiens
aaactgttgccagaga

SEQ ID NO: 5074562 - DNA, 16 bp, Homo sapiens
aaactgttgttttgta

SEQ ID NO: 5074563 - DNA, 14 bp, Homo sapiens
aaactgtttatata

SEQ ID NO: 5074564 - DNA, 11 bp, Homo sapiens
aaactgtttct

SEQ ID NO: 5074565 - DNA, 14 bp, Homo sapiens
aaactgtttctcag

SEQ ID NO: 5074566 - DNA, 16 bp, Homo sapiens
aaactgtttctttaaa

SEQ ID NO: 5074567 - DNA, 20 bp, Homo sapiens
aaactgttttgggtagctgc

SEQ ID NO: 5074568 - DNA, 23 bp, Homo sapiens
aaactgttttgggtagctgccac

SEQ ID NO: 5074569 - DNA, 18 bp, Homo sapiens
aaactgtttttgaacctg

SEQ ID NO: 5074570 - DNA, 17 bp, Homo sapiens
aaacttaaaactttgta

SEQ ID NO: 5074571 - DNA, 17 bp, Homo sapiens
aaacttaaagcaaaata

SEQ ID NO: 5074572 - DNA, 23 bp, Homo sapiens
aaacttaaagcaaaatagtattg

SEQ ID NO: 5074573 - DNA, 20 bp, Homo sapiens
aaacttaaagctactgtaga

SEQ ID NO: 5074574 - DNA, 18 bp, Homo sapiens
aaacttaaatattgtaat

SEQ ID NO: 5074575 - DNA, 21 bp, Homo sapiens
aaacttaaatgttattatctg

SEQ ID NO: 5074576 - DNA, 15 bp, Homo sapiens
aaacttaacagatca

SEQ ID NO: 5074577 - DNA, 17 bp, Homo sapiens
aaacttaacatatttac

SEQ ID NO: 5074578 - DNA, 14 bp, Homo sapiens
aaacttaagatgaa

SEQ ID NO: 5074579 - DNA, 18 bp, Homo sapiens
aaacttaagatgaataca

SEQ ID NO: 5074580 - DNA, 17 bp, Homo sapiens
aaacttaagcataaaaa

SEQ ID NO: 5074581 - DNA, 18 bp, Homo sapiens
aaacttaatctaaatgga

SEQ ID NO: 5074582 - DNA, 19 bp, Homo sapiens
aaacttaatctaaatggaa

SEQ ID NO: 5074583 - DNA, 17 bp, Homo sapiens
aaacttaatttaatatt

SEQ ID NO: 5074584 - DNA, 14 bp, Homo sapiens
aaacttacacacaa

SEQ ID NO: 5074585 - DNA, 16 bp, Homo sapiens
aaacttacactgtttc

SEQ ID NO: 5074586 - DNA, 23 bp, Homo sapiens
aaacttacctaagtgacatttgt

SEQ ID NO: 5074587 - DNA, 22 bp, Homo sapiens
aaacttactatggtatatattt

SEQ ID NO: 5074588 - DNA, 23 bp, Homo sapiens
aaacttactatggtatatatttt

SEQ ID NO: 5074589 - DNA, 21 bp, Homo sapiens
aaacttactgtcagagaatat

SEQ ID NO: 5074590 - DNA, 16 bp, Homo sapiens
aaacttagaaatatgc

SEQ ID NO: 5074591 - DNA, 20 bp, Homo sapiens
aaacttagcatctaatttca

SEQ ID NO: 5074592 - DNA, 18 bp, Homo sapiens
aaacttaggatataagag

SEQ ID NO: 5074593 - DNA, 17 bp, Homo sapiens
aaacttagtgacaaaat

SEQ ID NO: 5074594 - DNA, 16 bp, Homo sapiens
aaacttagtttgtgaa

SEQ ID NO: 5074595 - DNA, 14 bp, Homo sapiens
aaacttatcttaca

SEQ ID NO: 5074596 - DNA, 16 bp, Homo sapiens
aaacttatcttacaaa

SEQ ID NO: 5074597 - DNA, 16 bp, Homo sapiens
aaacttatgaatgttt

SEQ ID NO: 5074598 - DNA, 23 bp, Homo sapiens
aaacttatgctagtttattggaa

SEQ ID NO: 5074599 - DNA, 18 bp, Homo sapiens
aaacttattaacaactgt

SEQ ID NO: 5074600 - DNA, 19 bp, Homo sapiens
aaacttattggaatgttga

SEQ ID NO: 5074601 - DNA, 20 bp, Homo sapiens
aaacttatttttttctgatt

SEQ ID NO: 5074602 - DNA, 12 bp, Homo sapiens
aaacttcaaagc

SEQ ID NO: 5074603 - DNA, 23 bp, Homo sapiens
aaacttcaaagctgaatattttt

SEQ ID NO: 5074604 - DNA, 12 bp, Homo sapiens
aaacttcagaaa

SEQ ID NO: 5074605 - DNA, 19 bp, Homo sapiens
aaacttcagacatagaatt

SEQ ID NO: 5074606 - DNA, 12 bp, Homo sapiens
aaacttcagaga

SEQ ID NO: 5074607 - DNA, 15 bp, Homo sapiens
aaacttcagagaaat

SEQ ID NO: 5074608 - DNA, 20 bp, Homo sapiens
aaacttcagtttcacagaaa

SEQ ID NO: 5074609 - DNA, 17 bp, Homo sapiens
aaacttcagttttactg

SEQ ID NO: 5074610 - DNA, 15 bp, Homo sapiens
aaacttcatgtaact

SEQ ID NO: 5074611 - DNA, 21 bp, Homo sapiens
aaacttcatgtaattttattt

SEQ ID NO: 5074612 - DNA, 20 bp, Homo sapiens
aaacttcattggtaagattg

SEQ ID NO: 5074613 - DNA, 20 bp, Homo sapiens
aaacttccaaacagtgtgtt

SEQ ID NO: 5074614 - DNA, 21 bp, Homo sapiens
aaacttccaaaggtttaaact

SEQ ID NO: 5074615 - DNA, 19 bp, Homo sapiens
aaacttccagtgcaacact

SEQ ID NO: 5074616 - DNA, 21 bp, Homo sapiens
aaacttccagtgcaacactga

SEQ ID NO: 5074617 - DNA, 22 bp, Homo sapiens
aaacttccagtgcaacactgaa

SEQ ID NO: 5074618 - DNA, 23 bp, Homo sapiens
aaacttccatgaggccaaacgtt

SEQ ID NO: 5074619 - DNA, 22 bp, Homo sapiens
aaacttccattctttcttcctc

SEQ ID NO: 5074620 - DNA, 19 bp, Homo sapiens
aaacttcgctgtcccccaa

SEQ ID NO: 5074621 - DNA, 17 bp, Homo sapiens
aaacttcgtaagaacat

SEQ ID NO: 5074622 - DNA, 12 bp, Homo sapiens
aaacttctcatt

SEQ ID NO: 5074623 - DNA, 19 bp, Homo sapiens
aaacttctcctgaatgcat

SEQ ID NO: 5074624 - DNA, 23 bp, Homo sapiens
aaacttctcgcaactgaaggaag

SEQ ID NO: 5074625 - DNA, 18 bp, Homo sapiens
aaacttctgaactttgga

SEQ ID NO: 5074626 - DNA, 17 bp, Homo sapiens
aaacttctgaagactga

SEQ ID NO: 5074627 - DNA, 14 bp, Homo sapiens
aaacttctgctcgt

SEQ ID NO: 5074628 - DNA, 16 bp, Homo sapiens
aaacttcttaaatatc

SEQ ID NO: 5074629 - DNA, 17 bp, Homo sapiens
aaacttcttaaatatct

SEQ ID NO: 5074630 - DNA, 14 bp, Homo sapiens
aaacttcttaacat

SEQ ID NO: 5074631 - DNA, 23 bp, Homo sapiens
aaacttcttgtcagacataaagc

SEQ ID NO: 5074632 - DNA, 21 bp, Homo sapiens
aaacttctttttaatcttaag

SEQ ID NO: 5074633 - DNA, 22 bp, Homo sapiens
aaacttgaacaagaaattggta

SEQ ID NO: 5074634 - DNA, 12 bp, Homo sapiens
aaacttgaactc

SEQ ID NO: 5074635 - DNA, 18 bp, Homo sapiens
aaacttgaacttgcaggc

SEQ ID NO: 5074636 - DNA, 15 bp, Homo sapiens
aaacttgaagcagtc

SEQ ID NO: 5074637 - DNA, 14 bp, Homo sapiens
aaacttgaatctgt

SEQ ID NO: 5074638 - DNA, 18 bp, Homo sapiens
aaacttgaatctgttact

SEQ ID NO: 5074639 - DNA, 21 bp, Homo sapiens
aaacttgaatctgttactgaa

SEQ ID NO: 5074640 - DNA, 19 bp, Homo sapiens
aaacttgactccatttcat

SEQ ID NO: 5074641 - DNA, 17 bp, Homo sapiens
aaacttgataaatggaa

SEQ ID NO: 5074642 - DNA, 20 bp, Homo sapiens
aaacttgcaatgaaaagaaa

SEQ ID NO: 5074643 - DNA, 18 bp, Homo sapiens
aaacttgctttatgcctt

SEQ ID NO: 5074644 - DNA, 20 bp, Homo sapiens
aaacttggacccttggaaaa

SEQ ID NO: 5074645 - DNA, 18 bp, Homo sapiens
aaacttggatacttggat

SEQ ID NO: 5074646 - DNA, 15 bp, Homo sapiens
aaacttggattctct

SEQ ID NO: 5074647 - DNA, 18 bp, Homo sapiens
aaacttggattctctaac

SEQ ID NO: 5074648 - DNA, 17 bp, Homo sapiens
aaacttggctgtatgtc

SEQ ID NO: 5074649 - DNA, 16 bp, Homo sapiens
aaacttggttcccaga

SEQ ID NO: 5074650 - DNA, 17 bp, Homo sapiens
aaacttggttcccagaa

SEQ ID NO: 5074651 - DNA, 20 bp, Homo sapiens
aaacttgtaatttttttaat

SEQ ID NO: 5074652 - DNA, 12 bp, Homo sapiens
aaacttgtacat

SEQ ID NO: 5074653 - DNA, 20 bp, Homo sapiens
aaacttgtcaagaatgagaa

SEQ ID NO: 5074654 - DNA, 16 bp, Homo sapiens
aaacttgtcacttgca

SEQ ID NO: 5074655 - DNA, 19 bp, Homo sapiens
aaacttgtcacttgcatgt

SEQ ID NO: 5074656 - DNA, 12 bp, Homo sapiens
aaacttgtgaat

SEQ ID NO: 5074657 - DNA, 21 bp, Homo sapiens
aaacttgtgctatagtgtata

SEQ ID NO: 5074658 - DNA, 24 bp, Homo sapiens
aaacttgtggcctcaagcaatcca

SEQ ID NO: 5074659 - DNA, 18 bp, Homo sapiens
aaacttgttactaaagaa

SEQ ID NO: 5074660 - DNA, 12 bp, Homo sapiens
aaacttgttcat

SEQ ID NO: 5074661 - DNA, 13 bp, Homo sapiens
aaacttgttcatt

SEQ ID NO: 5074662 - DNA, 14 bp, Homo sapiens
aaacttgttcattt

SEQ ID NO: 5074663 - DNA, 17 bp, Homo sapiens
aaacttgtttcactgaa

SEQ ID NO: 5074664 - DNA, 19 bp, Homo sapiens
aaacttgtttgctgtgaac

SEQ ID NO: 5074665 - DNA, 20 bp, Homo sapiens
aaactttaaaaaatatttat

SEQ ID NO: 5074666 - DNA, 22 bp, Homo sapiens
aaactttaaaaaatatttatta

SEQ ID NO: 5074667 - DNA, 14 bp, Homo sapiens
aaactttaaaatgc

SEQ ID NO: 5074668 - DNA, 16 bp, Homo sapiens
aaactttaaaatgcga

SEQ ID NO: 5074669 - DNA, 14 bp, Homo sapiens
aaactttaaacctg

SEQ ID NO: 5074670 - DNA, 22 bp, Homo sapiens
aaactttaaacctgtagaatca

SEQ ID NO: 5074671 - DNA, 21 bp, Homo sapiens
aaactttaacttccactttgt

SEQ ID NO: 5074672 - DNA, 12 bp, Homo sapiens
aaactttaagaa

SEQ ID NO: 5074673 - DNA, 13 bp, Homo sapiens
aaactttaatata

SEQ ID NO: 5074674 - DNA, 17 bp, Homo sapiens
aaactttacctttttta

SEQ ID NO: 5074675 - DNA, 22 bp, Homo sapiens
aaactttaccttttttatacat

SEQ ID NO: 5074676 - DNA, 21 bp, Homo sapiens
aaactttactaagatgacatt

SEQ ID NO: 5074677 - DNA, 15 bp, Homo sapiens
aaactttagacttcc

SEQ ID NO: 5074678 - DNA, 18 bp, Homo sapiens
aaactttagggtaaaaat

SEQ ID NO: 5074679 - DNA, 16 bp, Homo sapiens
aaactttaggtttttt

SEQ ID NO: 5074680 - DNA, 23 bp, Homo sapiens
aaactttatacattagtaaatgt

SEQ ID NO: 5074681 - DNA, 16 bp, Homo sapiens
aaactttatgtactgc

SEQ ID NO: 5074682 - DNA, 20 bp, Homo sapiens
aaactttattaaaagaatga

SEQ ID NO: 5074683 - DNA, 16 bp, Homo sapiens
aaactttatttaaatg

SEQ ID NO: 5074684 - DNA, 17 bp, Homo sapiens
aaactttatttaaatgc

SEQ ID NO: 5074685 - DNA, 20 bp, Homo sapiens
aaactttatttgtaaaccat

SEQ ID NO: 5074686 - DNA, 21 bp, Homo sapiens
aaactttattttatataataa

SEQ ID NO: 5074687 - DNA, 18 bp, Homo sapiens
aaactttcatttttggta

SEQ ID NO: 5074688 - DNA, 18 bp, Homo sapiens
aaactttccaaatatttc

SEQ ID NO: 5074689 - DNA, 13 bp, Homo sapiens
aaactttcccttg

SEQ ID NO: 5074690 - DNA, 16 bp, Homo sapiens
aaactttcctttaact

SEQ ID NO: 5074691 - DNA, 16 bp, Homo sapiens
aaactttctctttgcc

SEQ ID NO: 5074692 - DNA, 21 bp, Homo sapiens
aaactttgaggataacttttt

SEQ ID NO: 5074693 - DNA, 23 bp, Homo sapiens
aaactttgaggataactttttaa

SEQ ID NO: 5074694 - DNA, 14 bp, Homo sapiens
aaactttgctaaat

SEQ ID NO: 5074695 - DNA, 16 bp, Homo sapiens
aaactttgctccaggc

SEQ ID NO: 5074696 - DNA, 14 bp, Homo sapiens
aaactttggaagtt

SEQ ID NO: 5074697 - DNA, 22 bp, Homo sapiens
aaactttggagaactcatttca

SEQ ID NO: 5074698 - DNA, 18 bp, Homo sapiens
aaactttggcaacatctt

SEQ ID NO: 5074699 - DNA, 16 bp, Homo sapiens
aaactttgtcacttct

SEQ ID NO: 5074700 - DNA, 16 bp, Homo sapiens
aaacttttaaacatga

SEQ ID NO: 5074701 - DNA, 19 bp, Homo sapiens
aaacttttaatgccttcca

SEQ ID NO: 5074702 - DNA, 21 bp, Homo sapiens
aaacttttaatgccttccaca

SEQ ID NO: 5074703 - DNA, 16 bp, Homo sapiens
aaacttttaattcatt

SEQ ID NO: 5074704 - DNA, 20 bp, Homo sapiens
aaacttttacatttttctga

SEQ ID NO: 5074705 - DNA, 21 bp, Homo sapiens
aaacttttacatttttctgat

SEQ ID NO: 5074706 - DNA, 15 bp, Homo sapiens
aaacttttataaatg

SEQ ID NO: 5074707 - DNA, 19 bp, Homo sapiens
aaacttttataaattaaat

SEQ ID NO: 5074708 - DNA, 21 bp, Homo sapiens
aaacttttataaattaaatat

SEQ ID NO: 5074709 - DNA, 20 bp, Homo sapiens
aaacttttattgtaaatgag

SEQ ID NO: 5074710 - DNA, 12 bp, Homo sapiens
aaacttttcatt

SEQ ID NO: 5074711 - DNA, 14 bp, Homo sapiens
aaacttttcattac

SEQ ID NO: 5074712 - DNA, 17 bp, Homo sapiens
aaacttttcatttcaga

SEQ ID NO: 5074713 - DNA, 20 bp, Homo sapiens
aaacttttcatttcagattt

SEQ ID NO: 5074714 - DNA, 16 bp, Homo sapiens
aaacttttctgataga

SEQ ID NO: 5074715 - DNA, 16 bp, Homo sapiens
aaacttttgaaaaagt

SEQ ID NO: 5074716 - DNA, 17 bp, Homo sapiens
aaacttttgaaaaagtg

SEQ ID NO: 5074717 - DNA, 13 bp, Homo sapiens
aaacttttgaaag

SEQ ID NO: 5074718 - DNA, 14 bp, Homo sapiens
aaacatatggcttt

SEQ ID NO: 5074719 - DNA, 14 bp, Homo sapiens
aaacatatgtctgt

SEQ ID NO: 5074720 - DNA, 16 bp, Homo sapiens
aaacatattcaaggag

SEQ ID NO: 5074721 - DNA, 19 bp, Homo sapiens
aaacatatttatagtttaa

SEQ ID NO: 5074722 - DNA, 13 bp, Homo sapiens
aaacatatttgtg

SEQ ID NO: 5074723 - DNA, 23 bp, Homo sapiens
aaacatatttgtgaaaagagtat

SEQ ID NO: 5074724 - DNA, 16 bp, Homo sapiens
aaacatattttacatc

SEQ ID NO: 5074725 - DNA, 14 bp, Homo sapiens
aaacatatttttat

SEQ ID NO: 5074726 - DNA, 20 bp, Homo sapiens
aaacatatttttatacttta

SEQ ID NO: 5074727 - DNA, 23 bp, Homo sapiens
aaacatatttttatactttattg

SEQ ID NO: 5074728 - DNA, 18 bp, Homo sapiens
aaacatcaaataaatttc

SEQ ID NO: 5074729 - DNA, 14 bp, Homo sapiens
aaacatcaacctgg

SEQ ID NO: 5074730 - DNA, 15 bp, Homo sapiens
aaacatcactccctc

SEQ ID NO: 5074731 - DNA, 15 bp, Homo sapiens
aaacatcagaaactg

SEQ ID NO: 5074732 - DNA, 16 bp, Homo sapiens
aaacatcagaaactga

SEQ ID NO: 5074733 - DNA, 16 bp, Homo sapiens
aaacatcagacctgtc

SEQ ID NO: 5074734 - DNA, 17 bp, Homo sapiens
aaacatcagacctgtct

SEQ ID NO: 5074735 - DNA, 14 bp, Homo sapiens
aaacatcagctgaa

SEQ ID NO: 5074736 - DNA, 16 bp, Homo sapiens
aaacatcagctgaatt

SEQ ID NO: 5074737 - DNA, 17 bp, Homo sapiens
aaacatcagctgaattc

SEQ ID NO: 5074738 - DNA, 21 bp, Homo sapiens
aaacatcagtcaattgcttga

SEQ ID NO: 5074739 - DNA, 14 bp, Homo sapiens
aaacatcagtttct

SEQ ID NO: 5074740 - DNA, 17 bp, Homo sapiens
aaacatccaatattttc

SEQ ID NO: 5074741 - DNA, 12 bp, Homo sapiens
aaacatccactt

SEQ ID NO: 5074742 - DNA, 21 bp, Homo sapiens
aaacatcccccaatgacctta

SEQ ID NO: 5074743 - DNA, 22 bp, Homo sapiens
aaacatcctacaagacacagtg

SEQ ID NO: 5074744 - DNA, 17 bp, Homo sapiens
aaacatcctcttccata

SEQ ID NO: 5074745 - DNA, 20 bp, Homo sapiens
aaacatccttcaagaactct

SEQ ID NO: 5074746 - DNA, 19 bp, Homo sapiens
aaacatctagcagtaaata

SEQ ID NO: 5074747 - DNA, 18 bp, Homo sapiens
aaacatctcatcatgtct

SEQ ID NO: 5074748 - DNA, 12 bp, Homo sapiens
aaacatctctgg

SEQ ID NO: 5074749 - DNA, 17 bp, Homo sapiens
aaacatctgatctgtat

SEQ ID NO: 5074750 - DNA, 17 bp, Homo sapiens
aaacatctgatttctga

SEQ ID NO: 5074751 - DNA, 13 bp, Homo sapiens
aaacatctggata

SEQ ID NO: 5074752 - DNA, 20 bp, Homo sapiens
aaacatcttaggcacttttt

SEQ ID NO: 5074753 - DNA, 22 bp, Homo sapiens
aaacatctttgaaattatgtaa

SEQ ID NO: 5074754 - DNA, 12 bp, Homo sapiens
aaacatgaaact

SEQ ID NO: 5074755 - DNA, 16 bp, Homo sapiens
aaacatgaagcataat

SEQ ID NO: 5074756 - DNA, 15 bp, Homo sapiens
aaacatgacactgac

SEQ ID NO: 5074757 - DNA, 15 bp, Homo sapiens
aaacatgagatgtgt

SEQ ID NO: 5074758 - DNA, 23 bp, Homo sapiens
aaacatgagcgctactcttggat

SEQ ID NO: 5074759 - DNA, 21 bp, Homo sapiens
aaacatgagttattcataaag

SEQ ID NO: 5074760 - DNA, 22 bp, Homo sapiens
aaacatgagttattcataaaga

SEQ ID NO: 5074761 - DNA, 14 bp, Homo sapiens
aaacatgattatct

SEQ ID NO: 5074762 - DNA, 15 bp, Homo sapiens
aaacatgattatctt

SEQ ID NO: 5074763 - DNA, 14 bp, Homo sapiens
aaacatgcacattt

SEQ ID NO: 5074764 - DNA, 20 bp, Homo sapiens
aaacatgcacattttgtaca

SEQ ID NO: 5074765 - DNA, 22 bp, Homo sapiens
aaacatgcagctcttcaacatg

SEQ ID NO: 5074766 - DNA, 12 bp, Homo sapiens
aaacatgccctc

SEQ ID NO: 5074767 - DNA, 20 bp, Homo sapiens
aaacatgccctcaggcttgg

SEQ ID NO: 5074768 - DNA, 21 bp, Homo sapiens
aaacatgcgatgttagtttta

SEQ ID NO: 5074769 - DNA, 16 bp, Homo sapiens
aaacatgctacacact

SEQ ID NO: 5074770 - DNA, 19 bp, Homo sapiens
aaacatgctgaaatctatt

SEQ ID NO: 5074771 - DNA, 23 bp, Homo sapiens
aaacatgctgtacatactttttg

SEQ ID NO: 5074772 - DNA, 14 bp, Homo sapiens
aaacatgctgttta

SEQ ID NO: 5074773 - DNA, 19 bp, Homo sapiens
aaacatgcttgaataactg

SEQ ID NO: 5074774 - DNA, 17 bp, Homo sapiens
aaacatggagaaatcta

SEQ ID NO: 5074775 - DNA, 18 bp, Homo sapiens
aaacatggatacttcctg

SEQ ID NO: 5074776 - DNA, 16 bp, Homo sapiens
aaacatggcctttgct

SEQ ID NO: 5074777 - DNA, 22 bp, Homo sapiens
aaacatgggctgtgattactgc

SEQ ID NO: 5074778 - DNA, 23 bp, Homo sapiens
aaacatggtgcctatatctgaga

SEQ ID NO: 5074779 - DNA, 17 bp, Homo sapiens
aaacatggttacaatca

SEQ ID NO: 5074780 - DNA, 12 bp, Homo sapiens
aaacatgtatgt

SEQ ID NO: 5074781 - DNA, 13 bp, Homo sapiens
aaacatgtattta

SEQ ID NO: 5074782 - DNA, 20 bp, Homo sapiens
aaacatgtcacaatacagta

SEQ ID NO: 5074783 - DNA, 13 bp, Homo sapiens
aaacatgtcatgt

SEQ ID NO: 5074784 - DNA, 15 bp, Homo sapiens
aaacatgtccccttc

SEQ ID NO: 5074785 - DNA, 17 bp, Homo sapiens
aaacatgtccccttccc

SEQ ID NO: 5074786 - DNA, 16 bp, Homo sapiens
aaacatgtgaaagata

SEQ ID NO: 5074787 - DNA, 13 bp, Homo sapiens
aaacatgtgcaac

SEQ ID NO: 5074788 - DNA, 21 bp, Homo sapiens
aaacatgtgcaactcttgtat

SEQ ID NO: 5074789 - DNA, 23 bp, Homo sapiens
aaacatgtgcaactcttgtattg

SEQ ID NO: 5074790 - DNA, 15 bp, Homo sapiens
aaacatgtgcccctg

SEQ ID NO: 5074791 - DNA, 17 bp, Homo sapiens
aaacatgtgcccctgcc

SEQ ID NO: 5074792 - DNA, 22 bp, Homo sapiens
aaacatgtggcaacctgttctt

SEQ ID NO: 5074793 - DNA, 20 bp, Homo sapiens
aaacatgtggttacacagtg

SEQ ID NO: 5074794 - DNA, 21 bp, Homo sapiens
aaacatgttaatgacaatatt

SEQ ID NO: 5074795 - DNA, 12 bp, Homo sapiens
aaacatgtttaa

SEQ ID NO: 5074796 - DNA, 14 bp, Homo sapiens
aaacattaaaagaa

SEQ ID NO: 5074797 - DNA, 13 bp, Homo sapiens
aaacattaaacac

SEQ ID NO: 5074798 - DNA, 14 bp, Homo sapiens
aaacattaaacact

SEQ ID NO: 5074799 - DNA, 15 bp, Homo sapiens
aaacattaaatgtct

SEQ ID NO: 5074800 - DNA, 15 bp, Homo sapiens
aaacattaagaaaat

SEQ ID NO: 5074801 - DNA, 21 bp, Homo sapiens
aaacattaatagcagcctttc

SEQ ID NO: 5074802 - DNA, 20 bp, Homo sapiens
aaacattaatgcttagaatt

SEQ ID NO: 5074803 - DNA, 16 bp, Homo sapiens
aaacattaatgttgat

SEQ ID NO: 5074804 - DNA, 21 bp, Homo sapiens
aaacattaattgctaacaatt

SEQ ID NO: 5074805 - DNA, 22 bp, Homo sapiens
aaacattaattgctaacaattg

SEQ ID NO: 5074806 - DNA, 18 bp, Homo sapiens
aaacattaattttgtgca

SEQ ID NO: 5074807 - DNA, 19 bp, Homo sapiens
aaacattaattttgtgcat

SEQ ID NO: 5074808 - DNA, 20 bp, Homo sapiens
aaacattaattttgtgcatt

SEQ ID NO: 5074809 - DNA, 21 bp, Homo sapiens
aaacattaattttgtgcattc

SEQ ID NO: 5074810 - DNA, 15 bp, Homo sapiens
aaacattagaagaaa

SEQ ID NO: 5074811 - DNA, 23 bp, Homo sapiens
aaacattagaagaaaacatatat

SEQ ID NO: 5074812 - DNA, 17 bp, Homo sapiens
aaacattagtgaaaatt

SEQ ID NO: 5074813 - DNA, 18 bp, Homo sapiens
aaacattattaagtaact

SEQ ID NO: 5074814 - DNA, 21 bp, Homo sapiens
aaacattcatccagttgcaat

SEQ ID NO: 5074815 - DNA, 12 bp, Homo sapiens
aaacattccaag

SEQ ID NO: 5074816 - DNA, 19 bp, Homo sapiens
aaacattccacgtgcccct

SEQ ID NO: 5074817 - DNA, 15 bp, Homo sapiens
aaacattcctccagc

SEQ ID NO: 5074818 - DNA, 19 bp, Homo sapiens
aaacattcctccagcctcc

SEQ ID NO: 5074819 - DNA, 20 bp, Homo sapiens
aaacattcctccagcctccc

SEQ ID NO: 5074820 - DNA, 23 bp, Homo sapiens
aaacattcctccagcctcccctc

SEQ ID NO: 5074821 - DNA, 21 bp, Homo sapiens
aaacattctatctactgattt

SEQ ID NO: 5074822 - DNA, 13 bp, Homo sapiens
aaacattcttatt

SEQ ID NO: 5074823 - DNA, 14 bp, Homo sapiens
aaacattcttattt

SEQ ID NO: 5074824 - DNA, 15 bp, Homo sapiens
aaacattgaaatatt

SEQ ID NO: 5074825 - DNA, 16 bp, Homo sapiens
aaacattgaagtaatg

SEQ ID NO: 5074826 - DNA, 15 bp, Homo sapiens
aaacattgatgaatg

SEQ ID NO: 5074827 - DNA, 15 bp, Homo sapiens
aaacattgcatgtat

SEQ ID NO: 5074828 - DNA, 14 bp, Homo sapiens
aaacattgcttttg

SEQ ID NO: 5074829 - DNA, 19 bp, Homo sapiens
aaacattggaagcaggtta

SEQ ID NO: 5074830 - DNA, 22 bp, Homo sapiens
aaacattggaagcaggttaaat

SEQ ID NO: 5074831 - DNA, 19 bp, Homo sapiens
aaacattggcataattttt

SEQ ID NO: 5074832 - DNA, 17 bp, Homo sapiens
aaacattggttcttgta

SEQ ID NO: 5074833 - DNA, 21 bp, Homo sapiens
aaacattggttcttgtattaa

SEQ ID NO: 5074834 - DNA, 13 bp, Homo sapiens
aaacattgtaaat

SEQ ID NO: 5074835 - DNA, 23 bp, Homo sapiens
aaacattgtaaatatttactctt

SEQ ID NO: 5074836 - DNA, 17 bp, Homo sapiens
aaacattgtgttgacat

SEQ ID NO: 5074837 - DNA, 19 bp, Homo sapiens
aaacattgtgttgacatta

SEQ ID NO: 5074838 - DNA, 13 bp, Homo sapiens
aaacatttaacat

SEQ ID NO: 5074839 - DNA, 17 bp, Homo sapiens
aaacatttaacataatg

SEQ ID NO: 5074840 - DNA, 13 bp, Homo sapiens
aaacatttacaat

SEQ ID NO: 5074841 - DNA, 19 bp, Homo sapiens
aaacatttacaataaatat

SEQ ID NO: 5074842 - DNA, 21 bp, Homo sapiens
aaacatttaccaatcatatta

SEQ ID NO: 5074843 - DNA, 16 bp, Homo sapiens
aaacatttactgacca

SEQ ID NO: 5074844 - DNA, 12 bp, Homo sapiens
aaacatttattt

SEQ ID NO: 5074845 - DNA, 17 bp, Homo sapiens
aaacatttattttgaca

SEQ ID NO: 5074846 - DNA, 20 bp, Homo sapiens
aaacatttattttgacataa

SEQ ID NO: 5074847 - DNA, 13 bp, Homo sapiens
aaacatttcactt

SEQ ID NO: 5074848 - DNA, 14 bp, Homo sapiens
aaacatttcataat

SEQ ID NO: 5074849 - DNA, 22 bp, Homo sapiens
aaacatttcataatttgtttcc

SEQ ID NO: 5074850 - DNA, 15 bp, Homo sapiens
aaacatttcatgtat

SEQ ID NO: 5074851 - DNA, 17 bp, Homo sapiens
aaacatttccctgctga

SEQ ID NO: 5074852 - DNA, 19 bp, Homo sapiens
aaacatttctgtgaaacta

SEQ ID NO: 5074853 - DNA, 11 bp, Homo sapiens
aaacatttctt

SEQ ID NO: 5074854 - DNA, 15 bp, Homo sapiens
aaacatttgacacat

SEQ ID NO: 5074855 - DNA, 17 bp, Homo sapiens
aaacatttgacacataa

SEQ ID NO: 5074856 - DNA, 21 bp, Homo sapiens
aaacatttgacacataaaagt

SEQ ID NO: 5074857 - DNA, 15 bp, Homo sapiens
aaacatttgccaagt

SEQ ID NO: 5074858 - DNA, 12 bp, Homo sapiens
aaacatttgctg

SEQ ID NO: 5074859 - DNA, 22 bp, Homo sapiens
aaacatttgtaaaaatactgtt

SEQ ID NO: 5074860 - DNA, 18 bp, Homo sapiens
aaacatttgtacattcct

SEQ ID NO: 5074861 - DNA, 20 bp, Homo sapiens
aaacatttgtcagagaagaa

SEQ ID NO: 5074862 - DNA, 16 bp, Homo sapiens
aaacatttgttcctgg

SEQ ID NO: 5074863 - DNA, 17 bp, Homo sapiens
aaacatttgtttccccc

SEQ ID NO: 5074864 - DNA, 21 bp, Homo sapiens
aaacattttaaaatcaacttt

SEQ ID NO: 5074865 - DNA, 15 bp, Homo sapiens
aaacattttaaatgg

SEQ ID NO: 5074866 - DNA, 17 bp, Homo sapiens
aaacattttatactgta

SEQ ID NO: 5074867 - DNA, 20 bp, Homo sapiens
aaacattttatactgtacat

SEQ ID NO: 5074868 - DNA, 23 bp, Homo sapiens
aaacattttatcattaaaaatta

SEQ ID NO: 5074869 - DNA, 20 bp, Homo sapiens
aaacattttatttttaaaat

SEQ ID NO: 5074870 - DNA, 16 bp, Homo sapiens
aaacattttcacacaa

SEQ ID NO: 5074871 - DNA, 13 bp, Homo sapiens
aaacattttctcc

SEQ ID NO: 5074872 - DNA, 16 bp, Homo sapiens
aaacattttctggcca

SEQ ID NO: 5074873 - DNA, 13 bp, Homo sapiens
aaacattttgact

SEQ ID NO: 5074874 - DNA, 21 bp, Homo sapiens
aaacattttgtggtcattaag

SEQ ID NO: 5074875 - DNA, 13 bp, Homo sapiens
aaacatttttaat

SEQ ID NO: 5074876 - DNA, 23 bp, Homo sapiens
aaacatttttaatttaacaaact

SEQ ID NO: 5074877 - DNA, 22 bp, Homo sapiens
aaacattttttaagaaaacatt

SEQ ID NO: 5074878 - DNA, 21 bp, Homo sapiens
aaacattttttttaaaaatta

SEQ ID NO: 5074879 - DNA, 22 bp, Homo sapiens
aaaccaaaaaggctagtttatt

SEQ ID NO: 5074880 - DNA, 13 bp, Homo sapiens
aaaccaaaaatta

SEQ ID NO: 5074881 - DNA, 18 bp, Homo sapiens
aaaccaaaagtgcattca

SEQ ID NO: 5074882 - DNA, 19 bp, Homo sapiens
aaaccaaaatactccaaag

SEQ ID NO: 5074883 - DNA, 13 bp, Homo sapiens
aaaccaaaatgac

SEQ ID NO: 5074884 - DNA, 15 bp, Homo sapiens
aaaccaaacccagcc

SEQ ID NO: 5074885 - DNA, 20 bp, Homo sapiens
aaaccaaactgggtcttcag

SEQ ID NO: 5074886 - DNA, 14 bp, Homo sapiens
aaaccaaacttgtt

SEQ ID NO: 5074887 - DNA, 18 bp, Homo sapiens
aaaccaaacttgttcatt

SEQ ID NO: 5074888 - DNA, 17 bp, Homo sapiens
aaaccaaagagggcttc

SEQ ID NO: 5074889 - DNA, 21 bp, Homo sapiens
aaaccaaagagggcttcctct

SEQ ID NO: 5074890 - DNA, 18 bp, Homo sapiens
aaaccaaagctgcctgtg

SEQ ID NO: 5074891 - DNA, 23 bp, Homo sapiens
aaaccaaaggacattatgtgtgc

SEQ ID NO: 5074892 - DNA, 18 bp, Homo sapiens
aaaccaaatcactgaact

SEQ ID NO: 5074893 - DNA, 15 bp, Homo sapiens
aaaccaaattttaaa

SEQ ID NO: 5074894 - DNA, 17 bp, Homo sapiens
aaaccaacaataaatat

SEQ ID NO: 5074895 - DNA, 22 bp, Homo sapiens
aaaccaacctaatatattgtat

SEQ ID NO: 5074896 - DNA, 14 bp, Homo sapiens
aaaccaactaaata

SEQ ID NO: 5074897 - DNA, 12 bp, Homo sapiens
aaacttttgttt

SEQ ID NO: 5074898 - DNA, 18 bp, Homo sapiens
aaacttttgttttttggg

SEQ ID NO: 5074899 - DNA, 19 bp, Homo sapiens
aaacttttgttttttgggg

SEQ ID NO: 5074900 - DNA, 12 bp, Homo sapiens
aaactttttaat

SEQ ID NO: 5074901 - DNA, 18 bp, Homo sapiens
aaactttttaatggcaat

SEQ ID NO: 5074902 - DNA, 22 bp, Homo sapiens
aaactttttgaccagtttcttt

SEQ ID NO: 5074903 - DNA, 14 bp, Homo sapiens
aaactttttgttca

SEQ ID NO: 5074904 - DNA, 18 bp, Homo sapiens
aaactttttgttcatgtg

SEQ ID NO: 5074905 - DNA, 13 bp, Homo sapiens
aaactttttttca

SEQ ID NO: 5074906 - DNA, 15 bp, Homo sapiens
aaactttttttcaat

SEQ ID NO: 5074907 - DNA, 23 bp, Homo sapiens
aaactttttttctgtaccagtta

SEQ ID NO: 5074908 - DNA, 15 bp, Homo sapiens
aaacttttttttcct

SEQ ID NO: 5074909 - DNA, 9 bp, Homo sapiens
aaagaaaaa

SEQ ID NO: 5074910 - DNA, 20 bp, Homo sapiens
aaagaaaaaaaaaagaagaa

SEQ ID NO: 5074911 - DNA, 17 bp, Homo sapiens
aaagaaaaaaaaaagat

SEQ ID NO: 5074912 - DNA, 16 bp, Homo sapiens
aaagaaaaaaaaagaa

SEQ ID NO: 5074913 - DNA, 17 bp, Homo sapiens
aaagaaaaaaaaagaat

SEQ ID NO: 5074914 - DNA, 23 bp, Homo sapiens
aaagaaaaaaaaccatcaagttg

SEQ ID NO: 5074915 - DNA, 17 bp, Homo sapiens
aaagaaaaaaatagttt

SEQ ID NO: 5074916 - DNA, 19 bp, Homo sapiens
aaagaaaaaaatagtttta

SEQ ID NO: 5074917 - DNA, 17 bp, Homo sapiens
aaagaaaaaaatggaaa

SEQ ID NO: 5074918 - DNA, 13 bp, Homo sapiens
aaagaaaaaaatt

SEQ ID NO: 5074919 - DNA, 14 bp, Homo sapiens
aaagaaaaaacaac

SEQ ID NO: 5074920 - DNA, 13 bp, Homo sapiens
aaagaaaaaagaa

SEQ ID NO: 5074921 - DNA, 11 bp, Homo sapiens
aaagaaaaaat

SEQ ID NO: 5074922 - DNA, 16 bp, Homo sapiens
aaagaaaaaattttat

SEQ ID NO: 5074923 - DNA, 21 bp, Homo sapiens
aaagaaaaacaatgaaattga

SEQ ID NO: 5074924 - DNA, 15 bp, Homo sapiens
aaagaaaaacatttc

SEQ ID NO: 5074925 - DNA, 16 bp, Homo sapiens
aaagaaaaactttaaa

SEQ ID NO: 5074926 - DNA, 12 bp, Homo sapiens
aaagaaaaagaa

SEQ ID NO: 5074927 - DNA, 10 bp, Homo sapiens
aaagaaaaat

SEQ ID NO: 5074928 - DNA, 21 bp, Homo sapiens
aaagaaaaataattgccatag

SEQ ID NO: 5074929 - DNA, 13 bp, Homo sapiens
aaagaaaaatatt

SEQ ID NO: 5074930 - DNA, 18 bp, Homo sapiens
aaagaaaaatatttaatg

SEQ ID NO: 5074931 - DNA, 13 bp, Homo sapiens
aaagaaaaatgca

SEQ ID NO: 5074932 - DNA, 19 bp, Homo sapiens
aaagaaaaatgcctgtctc

SEQ ID NO: 5074933 - DNA, 14 bp, Homo sapiens
aaagaaaacaaaaa

SEQ ID NO: 5074934 - DNA, 14 bp, Homo sapiens
aaagaaaacattta

SEQ ID NO: 5074935 - DNA, 14 bp, Homo sapiens
aaagaaaaccataa

SEQ ID NO: 5074936 - DNA, 19 bp, Homo sapiens
aaagaaaaccattttagtt

SEQ ID NO: 5074937 - DNA, 12 bp, Homo sapiens
aaagaaaacttg

SEQ ID NO: 5074938 - DNA, 17 bp, Homo sapiens
aaagaaaagacaaatgg

SEQ ID NO: 5074939 - DNA, 16 bp, Homo sapiens
aaagaaaagacatttt

SEQ ID NO: 5074940 - DNA, 15 bp, Homo sapiens
aaagaaaagccaagc

SEQ ID NO: 5074941 - DNA, 21 bp, Homo sapiens
aaagaaaaggaatgcaagaga

SEQ ID NO: 5074942 - DNA, 18 bp, Homo sapiens
aaagaaaaggatttaagc

SEQ ID NO: 5074943 - DNA, 12 bp, Homo sapiens
aaagaaaaggca

SEQ ID NO: 5074944 - DNA, 22 bp, Homo sapiens
aaagaaaagttcttaaaacact

SEQ ID NO: 5074945 - DNA, 21 bp, Homo sapiens
aaagaaaataaaaaaaagaaa

SEQ ID NO: 5074946 - DNA, 16 bp, Homo sapiens
aaagaaaataaagaca

SEQ ID NO: 5074947 - DNA, 22 bp, Homo sapiens
aaagaaaatgaaaaacaaccaa

SEQ ID NO: 5074948 - DNA, 18 bp, Homo sapiens
aaagaaaatggaaagaag

SEQ ID NO: 5074949 - DNA, 20 bp, Homo sapiens
aaagaaaatggaaagaagga

SEQ ID NO: 5074950 - DNA, 23 bp, Homo sapiens
aaagaaaatggaaagaaggaaaa

SEQ ID NO: 5074951 - DNA, 15 bp, Homo sapiens
aaagaaaattatatt

SEQ ID NO: 5074952 - DNA, 18 bp, Homo sapiens
aaagaaaattatattctg

SEQ ID NO: 5074953 - DNA, 16 bp, Homo sapiens
aaagaaaattgccaaa

SEQ ID NO: 5074954 - DNA, 22 bp, Homo sapiens
aaagaaaattgccaaaatatat

SEQ ID NO: 5074955 - DNA, 12 bp, Homo sapiens
aaagaaaatttt

SEQ ID NO: 5074956 - DNA, 9 bp, Homo sapiens
aaagaaaca

SEQ ID NO: 5074957 - DNA, 20 bp, Homo sapiens
aaagaaacaagctgtgcagg

SEQ ID NO: 5074958 - DNA, 12 bp, Homo sapiens
aaagaaacacaa

SEQ ID NO: 5074959 - DNA, 16 bp, Homo sapiens
aaagaaacaccactta

SEQ ID NO: 5074960 - DNA, 18 bp, Homo sapiens
aaagaaacactaaattag

SEQ ID NO: 5074961 - DNA, 22 bp, Homo sapiens
aaagaaacactttcttgagcac

SEQ ID NO: 5074962 - DNA, 17 bp, Homo sapiens
aaagaaacatctacagg

SEQ ID NO: 5074963 - DNA, 15 bp, Homo sapiens
aaagaaacatttcct

SEQ ID NO: 5074964 - DNA, 15 bp, Homo sapiens
aaagaaaccacttct

SEQ ID NO: 5074965 - DNA, 22 bp, Homo sapiens
aaagaaactatgatgtggagaa

SEQ ID NO: 5074966 - DNA, 13 bp, Homo sapiens
aaagaaacttttg

SEQ ID NO: 5074967 - DNA, 16 bp, Homo sapiens
aaagaaacttttgaaa

SEQ ID NO: 5074968 - DNA, 14 bp, Homo sapiens
aaagaaagaaaaag

SEQ ID NO: 5074969 - DNA, 15 bp, Homo sapiens
aaagaaagaaatttg

SEQ ID NO: 5074970 - DNA, 11 bp, Homo sapiens
aaagaaagaac

SEQ ID NO: 5074971 - DNA, 13 bp, Homo sapiens
aaagaaagagaga

SEQ ID NO: 5074972 - DNA, 14 bp, Homo sapiens
aaagaaagagagaa

SEQ ID NO: 5074973 - DNA, 15 bp, Homo sapiens
aaagaaagaggaaaa

SEQ ID NO: 5074974 - DNA, 18 bp, Homo sapiens
aaagaaagattgtaaact

SEQ ID NO: 5074975 - DNA, 12 bp, Homo sapiens
aaagaaagattt

SEQ ID NO: 5074976 - DNA, 14 bp, Homo sapiens
aaagaaagcaaatt

SEQ ID NO: 5074977 - DNA, 17 bp, Homo sapiens
aaagaaagcctcagaga

SEQ ID NO: 5074978 - DNA, 14 bp, Homo sapiens
aaagaaaggaaaga

SEQ ID NO: 5074979 - DNA, 17 bp, Homo sapiens
aaagaaaggaaagaagg

SEQ ID NO: 5074980 - DNA, 15 bp, Homo sapiens
aaagaaaggcagaga

SEQ ID NO: 5074981 - DNA, 13 bp, Homo sapiens
aaagaaagggaaa

SEQ ID NO: 5074982 - DNA, 12 bp, Homo sapiens
aaagaaagtgta

SEQ ID NO: 5074983 - DNA, 19 bp, Homo sapiens
aaagaaatagaaaaggaag

SEQ ID NO: 5074984 - DNA, 13 bp, Homo sapiens
aaagaaatatctg

SEQ ID NO: 5074985 - DNA, 22 bp, Homo sapiens
aaagaaatattaatatgtactt

SEQ ID NO: 5074986 - DNA, 23 bp, Homo sapiens
aaagaaatattaatatgtacttt

SEQ ID NO: 5074987 - DNA, 13 bp, Homo sapiens
aaagaaatattta

SEQ ID NO: 5074988 - DNA, 14 bp, Homo sapiens
aaagaaatcaattt

SEQ ID NO: 5074989 - DNA, 13 bp, Homo sapiens
aaagaaatcatgt

SEQ ID NO: 5074990 - DNA, 18 bp, Homo sapiens
aaagaaatcatgtccata

SEQ ID NO: 5074991 - DNA, 16 bp, Homo sapiens
aaagaaatcatgttat

SEQ ID NO: 5074992 - DNA, 20 bp, Homo sapiens
aaagaaatcttgtcttacca

SEQ ID NO: 5074993 - DNA, 12 bp, Homo sapiens
aaagaaatgaaa

SEQ ID NO: 5074994 - DNA, 13 bp, Homo sapiens
aaagaaatgaaca

SEQ ID NO: 5074995 - DNA, 15 bp, Homo sapiens
aaagaaatgaacatt

SEQ ID NO: 5074996 - DNA, 15 bp, Homo sapiens
aaagaaattagccta

SEQ ID NO: 5074997 - DNA, 17 bp, Homo sapiens
aaagaaattatctttag

SEQ ID NO: 5074998 - DNA, 23 bp, Homo sapiens
aaagaaattatctttagttgaat

SEQ ID NO: 5074999 - DNA, 14 bp, Homo sapiens
aaagaaattcaaga

SEQ ID NO: 5075000 - DNA, 23 bp, Homo sapiens
aaagaaattcagaacagcctgcc

SEQ ID NO: 5075001 - DNA, 21 bp, Homo sapiens
aaagaaattcgcatgtttaat

SEQ ID NO: 5075002 - DNA, 14 bp, Homo sapiens
aaagaaattctgtt

SEQ ID NO: 5075003 - DNA, 18 bp, Homo sapiens
aaagaaatttcaacagtt

SEQ ID NO: 5075004 - DNA, 16 bp, Homo sapiens
aaagaaatttgaaaaa

SEQ ID NO: 5075005 - DNA, 22 bp, Homo sapiens
aaagaaatttgaaaaaactttc

SEQ ID NO: 5075006 - DNA, 17 bp, Homo sapiens
aaagaacaacacttgtt

SEQ ID NO: 5075007 - DNA, 14 bp, Homo sapiens
aaagaacaagaaat

SEQ ID NO: 5075008 - DNA, 12 bp, Homo sapiens
aaagaacagatg

SEQ ID NO: 5075009 - DNA, 12 bp, Homo sapiens
aaagaacataaa

SEQ ID NO: 5075010 - DNA, 11 bp, Homo sapiens
aaagaacatcc

SEQ ID NO: 5075011 - DNA, 19 bp, Homo sapiens
aaagaacatgcagtttgaa

SEQ ID NO: 5075012 - DNA, 21 bp, Homo sapiens
aaagaacatgcagtttgaaat

SEQ ID NO: 5075013 - DNA, 20 bp, Homo sapiens
aaagaacatggacttgtata

SEQ ID NO: 5075014 - DNA, 21 bp, Homo sapiens
aaagaacatggacttgtatat

SEQ ID NO: 5075015 - DNA, 15 bp, Homo sapiens
aaagaaccaggaggc

SEQ ID NO: 5075016 - DNA, 11 bp, Homo sapiens
aaagaacccca

SEQ ID NO: 5075017 - DNA, 18 bp, Homo sapiens
aaagaacccccctcccca

SEQ ID NO: 5075018 - DNA, 18 bp, Homo sapiens
aaagaacgctgatttaaa

SEQ ID NO: 5075019 - DNA, 23 bp, Homo sapiens
aaagaacggcatgtgaattctgt

SEQ ID NO: 5075020 - DNA, 23 bp, Homo sapiens
aaagaacgtggtcagagtagaac

SEQ ID NO: 5075021 - DNA, 19 bp, Homo sapiens
aaagaactcattcatagga

SEQ ID NO: 5075022 - DNA, 12 bp, Homo sapiens
aaagaacttacc

SEQ ID NO: 5075023 - DNA, 19 bp, Homo sapiens
aaagaacttgctgctgcct

SEQ ID NO: 5075024 - DNA, 21 bp, Homo sapiens
aaagaactttaaagctcagga

SEQ ID NO: 5075025 - DNA, 9 bp, Homo sapiens
aaagaagaa

SEQ ID NO: 5075026 - DNA, 11 bp, Homo sapiens
aaagaagaaaa

SEQ ID NO: 5075027 - DNA, 11 bp, Homo sapiens
aaagaagaaac

SEQ ID NO: 5075028 - DNA, 16 bp, Homo sapiens
aaagaagaaactattt

SEQ ID NO: 5075029 - DNA, 18 bp, Homo sapiens
aaagaagaaacttgtaaa

SEQ ID NO: 5075030 - DNA, 22 bp, Homo sapiens
aaagaagaaacttgtaaatatc

SEQ ID NO: 5075031 - DNA, 16 bp, Homo sapiens
aaagaagaaagactct

SEQ ID NO: 5075032 - DNA, 12 bp, Homo sapiens
aaagaagaaata

SEQ ID NO: 5075033 - DNA, 19 bp, Homo sapiens
aaagaagaaatagttctgt

SEQ ID NO: 5075034 - DNA, 13 bp, Homo sapiens
aaagaagaacagc

SEQ ID NO: 5075035 - DNA, 15 bp, Homo sapiens
aaagaagaacagctg

SEQ ID NO: 5075036 - DNA, 21 bp, Homo sapiens
aaagaagaagaagaaggagag

SEQ ID NO: 5075037 - DNA, 12 bp, Homo sapiens
aaagaagaagga

SEQ ID NO: 5075038 - DNA, 15 bp, Homo sapiens
aaagaagacaaactt

SEQ ID NO: 5075039 - DNA, 12 bp, Homo sapiens
aaagaagacatg

SEQ ID NO: 5075040 - DNA, 11 bp, Homo sapiens
aaagaagaccg

SEQ ID NO: 5075041 - DNA, 14 bp, Homo sapiens
aaagaagactggaa

SEQ ID NO: 5075042 - DNA, 20 bp, Homo sapiens
aaagaagactgtgtttttgc

SEQ ID NO: 5075043 - DNA, 13 bp, Homo sapiens
aaagaagagaagt

SEQ ID NO: 5075044 - DNA, 12 bp, Homo sapiens
aaagaagagaca

SEQ ID NO: 5075045 - DNA, 21 bp, Homo sapiens
aaagaagagccggagcctcca

SEQ ID NO: 5075046 - DNA, 16 bp, Homo sapiens
aaagaagatagtgaga

SEQ ID NO: 5075047 - DNA, 14 bp, Homo sapiens
aaagaagatctgta

SEQ ID NO: 5075048 - DNA, 15 bp, Homo sapiens
aaagaagatgttgaa

SEQ ID NO: 5075049 - DNA, 16 bp, Homo sapiens
aaagaagcagaccatt

SEQ ID NO: 5075050 - DNA, 12 bp, Homo sapiens
aaagaagccaca

SEQ ID NO: 5075051 - DNA, 20 bp, Homo sapiens
aaagaagcccaatattataa

SEQ ID NO: 5075052 - DNA, 19 bp, Homo sapiens
aaagaagctactattttgg

SEQ ID NO: 5075053 - DNA, 19 bp, Homo sapiens
aaagaagctcgccccacct

SEQ ID NO: 5075054 - DNA, 21 bp, Homo sapiens
aaagaagctcgccccacctcc

SEQ ID NO: 5075055 - DNA, 11 bp, Homo sapiens
aaagaagctgt

SEQ ID NO: 5075056 - DNA, 20 bp, Homo sapiens
aaagaagctgtcagaagttt

SEQ ID NO: 5075057 - DNA, 22 bp, Homo sapiens
aaagaagcttaacagtaagaaa

SEQ ID NO: 5075058 - DNA, 18 bp, Homo sapiens
aaagaaggaaaatgatct

SEQ ID NO: 5075059 - DNA, 17 bp, Homo sapiens
aaagaaggaaagatggt

SEQ ID NO: 5075060 - DNA, 16 bp, Homo sapiens
aaagaagggatcccta

SEQ ID NO: 5075061 - DNA, 18 bp, Homo sapiens
aaagaagggggccctgct

SEQ ID NO: 5075062 - DNA, 20 bp, Homo sapiens
aaagaaggtttcagaaagaa

SEQ ID NO: 5075063 - DNA, 22 bp, Homo sapiens
aaagaaggtttgtgtttttctg

SEQ ID NO: 5075064 - DNA, 16 bp, Homo sapiens
aaagaagtaaatttgt

SEQ ID NO: 5075065 - DNA, 18 bp, Homo sapiens
aaagaagtatttaaactt

SEQ ID NO: 5075066 - DNA, 19 bp, Homo sapiens
aaagaagtgtgactagata

SEQ ID NO: 5075067 - DNA, 17 bp, Homo sapiens
aaagaagttactttgta

SEQ ID NO: 5075068 - DNA, 20 bp, Homo sapiens
aaagaagttactttgtaatt

SEQ ID NO: 5075069 - DNA, 17 bp, Homo sapiens
aaagaagtttgaacatt

SEQ ID NO: 5075070 - DNA, 14 bp, Homo sapiens
aaagaataaaaact

SEQ ID NO: 5075071 - DNA, 15 bp, Homo sapiens
aaagaataaaaactt

SEQ ID NO: 5075072 - DNA, 14 bp, Homo sapiens
aaagaataagaaaa

SEQ ID NO: 5075073 - DNA, 13 bp, Homo sapiens
aaagaatacttga

SEQ ID NO: 5075074 - DNA, 15 bp, Homo sapiens
aaagaatacttgaac

SEQ ID NO: 5075075 - DNA, 17 bp, Homo sapiens
aaagaatacttgaactt

SEQ ID NO: 5075076 - DNA, 14 bp, Homo sapiens
aaagaataggactt

SEQ ID NO: 5075077 - DNA, 18 bp, Homo sapiens
aaagaatagtgcctcagc

SEQ ID NO: 5075078 - DNA, 17 bp, Homo sapiens
aaagaatatatttattt

SEQ ID NO: 5075079 - DNA, 13 bp, Homo sapiens
aaagaatattcag

SEQ ID NO: 5075080 - DNA, 22 bp, Homo sapiens
aaagaatattcagagaatatca

SEQ ID NO: 5075081 - DNA, 12 bp, Homo sapiens
aaaccaagaaga

SEQ ID NO: 5075082 - DNA, 22 bp, Homo sapiens
aaaccaagattttgaaggaaat

SEQ ID NO: 5075083 - DNA, 14 bp, Homo sapiens
aaaccaagccgtgg

SEQ ID NO: 5075084 - DNA, 20 bp, Homo sapiens
aaaccaagtcggaacagcag

SEQ ID NO: 5075085 - DNA, 21 bp, Homo sapiens
aaaccaagtcggaacagcaga

SEQ ID NO: 5075086 - DNA, 13 bp, Homo sapiens
aaaccaagtgcct

SEQ ID NO: 5075087 - DNA, 23 bp, Homo sapiens
aaaccaagtgccttgagctgcct

SEQ ID NO: 5075088 - DNA, 18 bp, Homo sapiens
aaaccaataaaacaagaa

SEQ ID NO: 5075089 - DNA, 17 bp, Homo sapiens
aaaccaatcaataatag

SEQ ID NO: 5075090 - DNA, 21 bp, Homo sapiens
aaaccaatcttaaacataata

SEQ ID NO: 5075091 - DNA, 22 bp, Homo sapiens
aaaccacaactgacacaggaaa

SEQ ID NO: 5075092 - DNA, 15 bp, Homo sapiens
aaaccacaagcatct

SEQ ID NO: 5075093 - DNA, 20 bp, Homo sapiens
aaaccacaaggctgttgcat

SEQ ID NO: 5075094 - DNA, 12 bp, Homo sapiens
aaaccacacaaa

SEQ ID NO: 5075095 - DNA, 14 bp, Homo sapiens
aaaccacacaaaga

SEQ ID NO: 5075096 - DNA, 15 bp, Homo sapiens
aaaccacagcagttg

SEQ ID NO: 5075097 - DNA, 18 bp, Homo sapiens
aaaccacagccctgtcag

SEQ ID NO: 5075098 - DNA, 14 bp, Homo sapiens
aaaccacagctgct

SEQ ID NO: 5075099 - DNA, 20 bp, Homo sapiens
aaaccacataatttttgtac

SEQ ID NO: 5075100 - DNA, 21 bp, Homo sapiens
aaaccacataatttttgtaca

SEQ ID NO: 5075101 - DNA, 22 bp, Homo sapiens
aaaccacatcatggaccaaatg

SEQ ID NO: 5075102 - DNA, 11 bp, Homo sapiens
aaaccacatgg

SEQ ID NO: 5075103 - DNA, 17 bp, Homo sapiens
aaaccaccaaaaacaaa

SEQ ID NO: 5075104 - DNA, 14 bp, Homo sapiens
aaaccaccagaagc

SEQ ID NO: 5075105 - DNA, 15 bp, Homo sapiens
aaaccaccagaagcc

SEQ ID NO: 5075106 - DNA, 19 bp, Homo sapiens
aaaccaccagaagcccaga

SEQ ID NO: 5075107 - DNA, 23 bp, Homo sapiens
aaaccaccagtgcccaaagtctg

SEQ ID NO: 5075108 - DNA, 20 bp, Homo sapiens
aaaccacccacaaagaaaca

SEQ ID NO: 5075109 - DNA, 16 bp, Homo sapiens
aaaccaccctctgggg

SEQ ID NO: 5075110 - DNA, 14 bp, Homo sapiens
aaaccaccctgagg

SEQ ID NO: 5075111 - DNA, 16 bp, Homo sapiens
aaaccactgaaaaaat

SEQ ID NO: 5075112 - DNA, 18 bp, Homo sapiens
aaaccacttctctgctgc

SEQ ID NO: 5075113 - DNA, 10 bp, Homo sapiens
aaaccacttt

SEQ ID NO: 5075114 - DNA, 20 bp, Homo sapiens
aaaccactttttgcagcttt

SEQ ID NO: 5075115 - DNA, 12 bp, Homo sapiens
aaaccagaaaga

SEQ ID NO: 5075116 - DNA, 17 bp, Homo sapiens
aaaccagaaagaggaat

SEQ ID NO: 5075117 - DNA, 12 bp, Homo sapiens
aaaccagaagca

SEQ ID NO: 5075118 - DNA, 16 bp, Homo sapiens
aaaccagaatcataat

SEQ ID NO: 5075119 - DNA, 16 bp, Homo sapiens
aaaccagacaaggaaa

SEQ ID NO: 5075120 - DNA, 22 bp, Homo sapiens
aaaccagagaatcttaaggtct

SEQ ID NO: 5075121 - DNA, 15 bp, Homo sapiens
aaaccagagggcagt

SEQ ID NO: 5075122 - DNA, 19 bp, Homo sapiens
aaaccagatctgtctccaa

SEQ ID NO: 5075123 - DNA, 16 bp, Homo sapiens
aaaccagcagaaaagt

SEQ ID NO: 5075124 - DNA, 19 bp, Homo sapiens
aaaccagcagaaaagtgct

SEQ ID NO: 5075125 - DNA, 15 bp, Homo sapiens
aaaccagccaggcag

SEQ ID NO: 5075126 - DNA, 12 bp, Homo sapiens
aaaccagccttc

SEQ ID NO: 5075127 - DNA, 13 bp, Homo sapiens
aaaccagcttcct

SEQ ID NO: 5075128 - DNA, 21 bp, Homo sapiens
aaaccagcttgttctgggctc

SEQ ID NO: 5075129 - DNA, 17 bp, Homo sapiens
aaaccaggctttctaga

SEQ ID NO: 5075130 - DNA, 21 bp, Homo sapiens
aaaccaggctttctagaaaga

SEQ ID NO: 5075131 - DNA, 13 bp, Homo sapiens
aaaccagggatag

SEQ ID NO: 5075132 - DNA, 22 bp, Homo sapiens
aaaccaggtccaatgagctttc

SEQ ID NO: 5075133 - DNA, 24 bp, Homo sapiens
aaaccaggtccaatgagctttctg

SEQ ID NO: 5075134 - DNA, 14 bp, Homo sapiens
aaaccagtattgta

SEQ ID NO: 5075135 - DNA, 18 bp, Homo sapiens
aaaccagtattgtacaaa

SEQ ID NO: 5075136 - DNA, 13 bp, Homo sapiens
aaaccagtattta

SEQ ID NO: 5075137 - DNA, 17 bp, Homo sapiens
aaaccagtatttaagct

SEQ ID NO: 5075138 - DNA, 15 bp, Homo sapiens
aaaccagtgtgaacc

SEQ ID NO: 5075139 - DNA, 15 bp, Homo sapiens
aaaccataaacattt

SEQ ID NO: 5075140 - DNA, 17 bp, Homo sapiens
aaaccatatgaacatat

SEQ ID NO: 5075141 - DNA, 17 bp, Homo sapiens
aaaccatattttattgt

SEQ ID NO: 5075142 - DNA, 23 bp, Homo sapiens
aaaccatattttattgtattttg

SEQ ID NO: 5075143 - DNA, 16 bp, Homo sapiens
aaaccatcagatattt

SEQ ID NO: 5075144 - DNA, 19 bp, Homo sapiens
aaaccatcatttaatttct

SEQ ID NO: 5075145 - DNA, 23 bp, Homo sapiens
aaaccatccatctgtggaaatga

SEQ ID NO: 5075146 - DNA, 15 bp, Homo sapiens
aaaccatctccctgg

SEQ ID NO: 5075147 - DNA, 16 bp, Homo sapiens
aaaccatctggtgcct

SEQ ID NO: 5075148 - DNA, 15 bp, Homo sapiens
aaaccatgaaaaaat

SEQ ID NO: 5075149 - DNA, 13 bp, Homo sapiens
aaaccatgacaaa

SEQ ID NO: 5075150 - DNA, 16 bp, Homo sapiens
aaaccatgagaatttg

SEQ ID NO: 5075151 - DNA, 15 bp, Homo sapiens
aaaccatgcaaatgc

SEQ ID NO: 5075152 - DNA, 16 bp, Homo sapiens
aaaccatgcagcttca

SEQ ID NO: 5075153 - DNA, 19 bp, Homo sapiens
aaaccatgcagcttcatca

SEQ ID NO: 5075154 - DNA, 16 bp, Homo sapiens
aaaccatgtagtttta

SEQ ID NO: 5075155 - DNA, 22 bp, Homo sapiens
aaaccatgtagttttaacagaa

SEQ ID NO: 5075156 - DNA, 12 bp, Homo sapiens
aaaccatgtgac

SEQ ID NO: 5075157 - DNA, 21 bp, Homo sapiens
aaaccatgttgcgttcaaaga

SEQ ID NO: 5075158 - DNA, 18 bp, Homo sapiens
aaaccattaccttaaaat

SEQ ID NO: 5075159 - DNA, 18 bp, Homo sapiens
aaaccattactgagggga

SEQ ID NO: 5075160 - DNA, 19 bp, Homo sapiens
aaaccattataaaatcttt

SEQ ID NO: 5075161 - DNA, 21 bp, Homo sapiens
aaaccattcgaagtcagctaa

SEQ ID NO: 5075162 - DNA, 12 bp, Homo sapiens
aaaccattgctt

SEQ ID NO: 5075163 - DNA, 13 bp, Homo sapiens
aaaccattgcttc

SEQ ID NO: 5075164 - DNA, 14 bp, Homo sapiens
aaaccattgcttca

SEQ ID NO: 5075165 - DNA, 17 bp, Homo sapiens
aaaccattgcttcacta

SEQ ID NO: 5075166 - DNA, 12 bp, Homo sapiens
aaaccattggac

SEQ ID NO: 5075167 - DNA, 18 bp, Homo sapiens
aaaccattggacagattt

SEQ ID NO: 5075168 - DNA, 12 bp, Homo sapiens
aaaccattgtaa

SEQ ID NO: 5075169 - DNA, 22 bp, Homo sapiens
aaaccattgtaactattaacct

SEQ ID NO: 5075170 - DNA, 18 bp, Homo sapiens
aaaccattgttcagaaga

SEQ ID NO: 5075171 - DNA, 19 bp, Homo sapiens
aaaccatttaattcataat

SEQ ID NO: 5075172 - DNA, 13 bp, Homo sapiens
aaaccatttcagc

SEQ ID NO: 5075173 - DNA, 20 bp, Homo sapiens
aaaccattttattttttggg

SEQ ID NO: 5075174 - DNA, 18 bp, Homo sapiens
aaaccatttttgttactc

SEQ ID NO: 5075175 - DNA, 16 bp, Homo sapiens
aaacccaaaatatata

SEQ ID NO: 5075176 - DNA, 15 bp, Homo sapiens
aaacccaaaccacat

SEQ ID NO: 5075177 - DNA, 14 bp, Homo sapiens
aaacccaaagatgt

SEQ ID NO: 5075178 - DNA, 21 bp, Homo sapiens
aaacccaaagctctaaggtaa

SEQ ID NO: 5075179 - DNA, 15 bp, Homo sapiens
aaacccaaaggtggc

SEQ ID NO: 5075180 - DNA, 23 bp, Homo sapiens
aaacccaaataaatgtgtaaatg

SEQ ID NO: 5075181 - DNA, 21 bp, Homo sapiens
aaacccaagtttatttctctc

SEQ ID NO: 5075182 - DNA, 19 bp, Homo sapiens
aaacccaatacttttgtcc

SEQ ID NO: 5075183 - DNA, 20 bp, Homo sapiens
aaacccaatacttttgtcca

SEQ ID NO: 5075184 - DNA, 17 bp, Homo sapiens
aaacccaatcagatgcc

SEQ ID NO: 5075185 - DNA, 14 bp, Homo sapiens
aaacccaatgtcaa

SEQ ID NO: 5075186 - DNA, 20 bp, Homo sapiens
aaacccacgacctgtcctgt

SEQ ID NO: 5075187 - DNA, 18 bp, Homo sapiens
aaacccacgcgtgttctg

SEQ ID NO: 5075188 - DNA, 20 bp, Homo sapiens
aaacccactcttcatatatg

SEQ ID NO: 5075189 - DNA, 17 bp, Homo sapiens
aaacccacttctggcct

SEQ ID NO: 5075190 - DNA, 19 bp, Homo sapiens
aaacccacttctggcctcc

SEQ ID NO: 5075191 - DNA, 15 bp, Homo sapiens
aaacccagactgaac

SEQ ID NO: 5075192 - DNA, 13 bp, Homo sapiens
aaacccagaggtg

SEQ ID NO: 5075193 - DNA, 15 bp, Homo sapiens
aaacccagcaaaaca

SEQ ID NO: 5075194 - DNA, 23 bp, Homo sapiens
aaacccagcaaaacagattcaaa

SEQ ID NO: 5075195 - DNA, 16 bp, Homo sapiens
aaacccagcccctgcg

SEQ ID NO: 5075196 - DNA, 12 bp, Homo sapiens
aaacccagctct

SEQ ID NO: 5075197 - DNA, 16 bp, Homo sapiens
aaacccagctctggtc

SEQ ID NO: 5075198 - DNA, 13 bp, Homo sapiens
aaacccagggcaa

SEQ ID NO: 5075199 - DNA, 19 bp, Homo sapiens
aaacccaggttcatgaata

SEQ ID NO: 5075200 - DNA, 15 bp, Homo sapiens
aaacccatacaatgt

SEQ ID NO: 5075201 - DNA, 19 bp, Homo sapiens
aaacccatacaatgtatgt

SEQ ID NO: 5075202 - DNA, 19 bp, Homo sapiens
aaacccataggcccacaca

SEQ ID NO: 5075203 - DNA, 14 bp, Homo sapiens
aaacccatggctct

SEQ ID NO: 5075204 - DNA, 19 bp, Homo sapiens
aaacccatgtgttaaaata

SEQ ID NO: 5075205 - DNA, 15 bp, Homo sapiens
aaacccatttactta

SEQ ID NO: 5075206 - DNA, 14 bp, Homo sapiens
aaacccattttggt

SEQ ID NO: 5075207 - DNA, 17 bp, Homo sapiens
aaaccccaaacagtgac

SEQ ID NO: 5075208 - DNA, 12 bp, Homo sapiens
aaaccccaagca

SEQ ID NO: 5075209 - DNA, 13 bp, Homo sapiens
aaaccccaagcag

SEQ ID NO: 5075210 - DNA, 17 bp, Homo sapiens
aaaccccacagaaatct

SEQ ID NO: 5075211 - DNA, 20 bp, Homo sapiens
aaaccccaccccaaaattag

SEQ ID NO: 5075212 - DNA, 11 bp, Homo sapiens
aaaccccagcc

SEQ ID NO: 5075213 - DNA, 15 bp, Homo sapiens
aaaccccagccccaa

SEQ ID NO: 5075214 - DNA, 16 bp, Homo sapiens
aaaccccagctatttt

SEQ ID NO: 5075215 - DNA, 13 bp, Homo sapiens
aaaccccatctct

SEQ ID NO: 5075216 - DNA, 22 bp, Homo sapiens
aaacccccacacacacacacat

SEQ ID NO: 5075217 - DNA, 13 bp, Homo sapiens
aaacccccaggag

SEQ ID NO: 5075218 - DNA, 15 bp, Homo sapiens
aaacccccaggagga

SEQ ID NO: 5075219 - DNA, 15 bp, Homo sapiens
aaaccccggggctcc

SEQ ID NO: 5075220 - DNA, 18 bp, Homo sapiens
aaaccccttctctgtgac

SEQ ID NO: 5075221 - DNA, 18 bp, Homo sapiens
aaacccgacagagggaag

SEQ ID NO: 5075222 - DNA, 23 bp, Homo sapiens
aaacccgagggttgattaaggca

SEQ ID NO: 5075223 - DNA, 18 bp, Homo sapiens
aaaccctaaacctcttca

SEQ ID NO: 5075224 - DNA, 22 bp, Homo sapiens
aaaccctaagtgtggatgttca

SEQ ID NO: 5075225 - DNA, 13 bp, Homo sapiens
aaaccctagcctt

SEQ ID NO: 5075226 - DNA, 16 bp, Homo sapiens
aaaccctagccttgct

SEQ ID NO: 5075227 - DNA, 18 bp, Homo sapiens
aaaccctagccttgcttg

SEQ ID NO: 5075228 - DNA, 21 bp, Homo sapiens
aaaccctaggttcccggtccc

SEQ ID NO: 5075229 - DNA, 14 bp, Homo sapiens
aaaccctatatgct

SEQ ID NO: 5075230 - DNA, 16 bp, Homo sapiens
aaaccctattggtaaa

SEQ ID NO: 5075231 - DNA, 18 bp, Homo sapiens
aaaccctcattgtgtttc

SEQ ID NO: 5075232 - DNA, 20 bp, Homo sapiens
aaaccctcccagaaacatct

SEQ ID NO: 5075233 - DNA, 13 bp, Homo sapiens
aaaccctcgaggc

SEQ ID NO: 5075234 - DNA, 24 bp, Homo sapiens
aaaccctcgaggcggatctttgga

SEQ ID NO: 5075235 - DNA, 23 bp, Homo sapiens
aaaccctcgtttctgattaatgc

SEQ ID NO: 5075236 - DNA, 12 bp, Homo sapiens
aaaccctctgtg

SEQ ID NO: 5075237 - DNA, 15 bp, Homo sapiens
aaaccctgctgaaca

SEQ ID NO: 5075238 - DNA, 13 bp, Homo sapiens
aaaccctgcttct

SEQ ID NO: 5075239 - DNA, 14 bp, Homo sapiens
aaaccctggtgctt

SEQ ID NO: 5075240 - DNA, 21 bp, Homo sapiens
aaaccctggtggtattttatt

SEQ ID NO: 5075241 - DNA, 18 bp, Homo sapiens
aaaccctgtcaaacatta

SEQ ID NO: 5075242 - DNA, 14 bp, Homo sapiens
aaaccctgtcctcc

SEQ ID NO: 5075243 - DNA, 13 bp, Homo sapiens
aaaccctgtctct

SEQ ID NO: 5075244 - DNA, 20 bp, Homo sapiens
aaacccttaacctaaattta

SEQ ID NO: 5075245 - DNA, 16 bp, Homo sapiens
aaacccttaactgaca

SEQ ID NO: 5075246 - DNA, 22 bp, Homo sapiens
aaacccttcaactcctggctcc

SEQ ID NO: 5075247 - DNA, 16 bp, Homo sapiens
aaacccttgctttcct

SEQ ID NO: 5075248 - DNA, 20 bp, Homo sapiens
aaaccctttaaatggggacg

SEQ ID NO: 5075249 - DNA, 19 bp, Homo sapiens
aaaccctttgtattataat

SEQ ID NO: 5075250 - DNA, 17 bp, Homo sapiens
aaaccgacgacaaatct

SEQ ID NO: 5075251 - DNA, 17 bp, Homo sapiens
aaaccgagataggggag

SEQ ID NO: 5075252 - DNA, 19 bp, Homo sapiens
aaaccgagcagggctgtgt

SEQ ID NO: 5075253 - DNA, 14 bp, Homo sapiens
aaaccgataatgca

SEQ ID NO: 5075254 - DNA, 23 bp, Homo sapiens
aaaccgataatgcatgaagcaac

SEQ ID NO: 5075255 - DNA, 15 bp, Homo sapiens
aaaccgccaaggctg

SEQ ID NO: 5075256 - DNA, 14 bp, Homo sapiens
aaaccgctaaaaga

SEQ ID NO: 5075257 - DNA, 15 bp, Homo sapiens
aaaccgctaaaagaa

SEQ ID NO: 5075258 - DNA, 16 bp, Homo sapiens
aaaccgctaaaagaaa

SEQ ID NO: 5075259 - DNA, 18 bp, Homo sapiens
aaaccgctttggcctgag

SEQ ID NO: 5075260 - DNA, 17 bp, Homo sapiens
aaaccggcaacctgtaa

SEQ ID NO: 5075261 - DNA, 19 bp, Homo sapiens
aaaccggcaacctgtaact

SEQ ID NO: 5075262 - DNA, 21 bp, Homo sapiens
aaagaatatttaaataaacgt

SEQ ID NO: 5075263 - DNA, 15 bp, Homo sapiens
aaagaatcattattt

SEQ ID NO: 5075264 - DNA, 13 bp, Homo sapiens
aaagaatcatttg

SEQ ID NO: 5075265 - DNA, 21 bp, Homo sapiens
aaagaatccaagacaaactaa

SEQ ID NO: 5075266 - DNA, 15 bp, Homo sapiens
aaagaatccttatct

SEQ ID NO: 5075267 - DNA, 18 bp, Homo sapiens
aaagaatcggcagtattt

SEQ ID NO: 5075268 - DNA, 12 bp, Homo sapiens
aaagaatctact

SEQ ID NO: 5075269 - DNA, 15 bp, Homo sapiens
aaagaatctgtattc

SEQ ID NO: 5075270 - DNA, 15 bp, Homo sapiens
aaagaatgaaaacaa

SEQ ID NO: 5075271 - DNA, 14 bp, Homo sapiens
aaagaatgaaagta

SEQ ID NO: 5075272 - DNA, 17 bp, Homo sapiens
aaagaatgcatgttctg

SEQ ID NO: 5075273 - DNA, 17 bp, Homo sapiens
aaagaatggcagaaaag

SEQ ID NO: 5075274 - DNA, 13 bp, Homo sapiens
aaagaatgtaaag

SEQ ID NO: 5075275 - DNA, 16 bp, Homo sapiens
aaagaatgtacagaaa

SEQ ID NO: 5075276 - DNA, 19 bp, Homo sapiens
aaagaatgttactgcctta

SEQ ID NO: 5075277 - DNA, 14 bp, Homo sapiens
aaagaattacagta

SEQ ID NO: 5075278 - DNA, 15 bp, Homo sapiens
aaagaattattttgt

SEQ ID NO: 5075279 - DNA, 20 bp, Homo sapiens
aaagaattatttttgtgttt

SEQ ID NO: 5075280 - DNA, 22 bp, Homo sapiens
aaagaattatttttgtgtttct

SEQ ID NO: 5075281 - DNA, 18 bp, Homo sapiens
aaagaattccaaagcaaa

SEQ ID NO: 5075282 - DNA, 18 bp, Homo sapiens
aaagaattcctacaatat

SEQ ID NO: 5075283 - DNA, 16 bp, Homo sapiens
aaagaattctattttg

SEQ ID NO: 5075284 - DNA, 18 bp, Homo sapiens
aaagaattctattttgct

SEQ ID NO: 5075285 - DNA, 23 bp, Homo sapiens
aaagaattgatcagaatcccaaa

SEQ ID NO: 5075286 - DNA, 18 bp, Homo sapiens
aaagaattgcagtaaagt

SEQ ID NO: 5075287 - DNA, 12 bp, Homo sapiens
aaagaatttaaa

SEQ ID NO: 5075288 - DNA, 16 bp, Homo sapiens
aaagaatttaaattct

SEQ ID NO: 5075289 - DNA, 13 bp, Homo sapiens
aaagaatttgtca

SEQ ID NO: 5075290 - DNA, 12 bp, Homo sapiens
aaagaatttgtt

SEQ ID NO: 5075291 - DNA, 13 bp, Homo sapiens
aaagaatttgtta

SEQ ID NO: 5075292 - DNA, 13 bp, Homo sapiens
aaagaatttttgc

SEQ ID NO: 5075293 - DNA, 16 bp, Homo sapiens
aaagaatttttggtgt

SEQ ID NO: 5075294 - DNA, 19 bp, Homo sapiens
aaagacaaaagaaacttac

SEQ ID NO: 5075295 - DNA, 17 bp, Homo sapiens
aaagacaaaatttagat

SEQ ID NO: 5075296 - DNA, 14 bp, Homo sapiens
aaagacaaacatgc

SEQ ID NO: 5075297 - DNA, 14 bp, Homo sapiens
aaagacaaatatgt

SEQ ID NO: 5075298 - DNA, 20 bp, Homo sapiens
aaagacaaatatttctttct

SEQ ID NO: 5075299 - DNA, 16 bp, Homo sapiens
aaagacaaatcaaagc

SEQ ID NO: 5075300 - DNA, 19 bp, Homo sapiens
aaagacaaatcaaagcaga

SEQ ID NO: 5075301 - DNA, 22 bp, Homo sapiens
aaagacaaattcggatgtatga

SEQ ID NO: 5075302 - DNA, 22 bp, Homo sapiens
aaagacaaattctgtttcttga

SEQ ID NO: 5075303 - DNA, 21 bp, Homo sapiens
aaagacaagagagatgaaaac

SEQ ID NO: 5075304 - DNA, 19 bp, Homo sapiens
aaagacaatcactgaaaca

SEQ ID NO: 5075305 - DNA, 18 bp, Homo sapiens
aaagacaatcactgccaa

SEQ ID NO: 5075306 - DNA, 19 bp, Homo sapiens
aaagacaattctttataca

SEQ ID NO: 5075307 - DNA, 18 bp, Homo sapiens
aaagacacagaacacaga

SEQ ID NO: 5075308 - DNA, 20 bp, Homo sapiens
aaagacacagatttcggtca

SEQ ID NO: 5075309 - DNA, 15 bp, Homo sapiens
aaagacacctgcctt

SEQ ID NO: 5075310 - DNA, 14 bp, Homo sapiens
aaagacactgcaga

SEQ ID NO: 5075311 - DNA, 16 bp, Homo sapiens
aaagacactggcagag

SEQ ID NO: 5075312 - DNA, 13 bp, Homo sapiens
aaagacagaagcc

SEQ ID NO: 5075313 - DNA, 16 bp, Homo sapiens
aaagacagaatgtcac

SEQ ID NO: 5075314 - DNA, 21 bp, Homo sapiens
aaagacagcactacagatatc

SEQ ID NO: 5075315 - DNA, 16 bp, Homo sapiens
aaagacagcagacaaa

SEQ ID NO: 5075316 - DNA, 13 bp, Homo sapiens
aaagacaggaaga

SEQ ID NO: 5075317 - DNA, 15 bp, Homo sapiens
aaagacaggctctgt

SEQ ID NO: 5075318 - DNA, 15 bp, Homo sapiens
aaagacagtatttat

SEQ ID NO: 5075319 - DNA, 16 bp, Homo sapiens
aaagacagtgtgtgtg

SEQ ID NO: 5075320 - DNA, 12 bp, Homo sapiens
aaagacataaaa

SEQ ID NO: 5075321 - DNA, 17 bp, Homo sapiens
aaagacataaaacagaa

SEQ ID NO: 5075322 - DNA, 14 bp, Homo sapiens
aaagacatcaagca

SEQ ID NO: 5075323 - DNA, 18 bp, Homo sapiens
aaagacatccataaagaa

SEQ ID NO: 5075324 - DNA, 14 bp, Homo sapiens
aaagacatctgcct

SEQ ID NO: 5075325 - DNA, 14 bp, Homo sapiens
aaagacatggaaga

SEQ ID NO: 5075326 - DNA, 14 bp, Homo sapiens
aaagacatgttgta

SEQ ID NO: 5075327 - DNA, 17 bp, Homo sapiens
aaagacattagagaaaa

SEQ ID NO: 5075328 - DNA, 18 bp, Homo sapiens
aaagacattagagaaaac

SEQ ID NO: 5075329 - DNA, 21 bp, Homo sapiens
aaagacattagagaaaacctt

SEQ ID NO: 5075330 - DNA, 19 bp, Homo sapiens
aaagacattatttctcata

SEQ ID NO: 5075331 - DNA, 20 bp, Homo sapiens
aaagacattgacagcaattc

SEQ ID NO: 5075332 - DNA, 19 bp, Homo sapiens
aaagacattgtttttaaaa

SEQ ID NO: 5075333 - DNA, 20 bp, Homo sapiens
aaagacatttaaaatagttt

SEQ ID NO: 5075334 - DNA, 15 bp, Homo sapiens
aaagacatttaaaga

SEQ ID NO: 5075335 - DNA, 13 bp, Homo sapiens
aaagacattttaa

SEQ ID NO: 5075336 - DNA, 11 bp, Homo sapiens
aaagaccaaac

SEQ ID NO: 5075337 - DNA, 17 bp, Homo sapiens
aaagaccaaatctcagt

SEQ ID NO: 5075338 - DNA, 16 bp, Homo sapiens
aaagaccaaattttga

SEQ ID NO: 5075339 - DNA, 17 bp, Homo sapiens
aaagaccaaattttgag

SEQ ID NO: 5075340 - DNA, 15 bp, Homo sapiens
aaagaccaagacttt

SEQ ID NO: 5075341 - DNA, 19 bp, Homo sapiens
aaagaccacctccaaccca

SEQ ID NO: 5075342 - DNA, 14 bp, Homo sapiens
aaagaccaggccaa

SEQ ID NO: 5075343 - DNA, 17 bp, Homo sapiens
aaagaccagggatgctg

SEQ ID NO: 5075344 - DNA, 13 bp, Homo sapiens
aaagaccagggct

SEQ ID NO: 5075345 - DNA, 14 bp, Homo sapiens
aaagaccatgcatt

SEQ ID NO: 5075346 - DNA, 15 bp, Homo sapiens
aaagaccatgcattc

SEQ ID NO: 5075347 - DNA, 16 bp, Homo sapiens
aaagaccatgcattca

SEQ ID NO: 5075348 - DNA, 17 bp, Homo sapiens
aaagaccatgcattcag

SEQ ID NO: 5075349 - DNA, 16 bp, Homo sapiens
aaagacccagggggag

SEQ ID NO: 5075350 - DNA, 20 bp, Homo sapiens
aaagaccctaaatctgagga

SEQ ID NO: 5075351 - DNA, 17 bp, Homo sapiens
aaagaccctaggtgctc

SEQ ID NO: 5075352 - DNA, 22 bp, Homo sapiens
aaagaccctcctattctataaa

SEQ ID NO: 5075353 - DNA, 20 bp, Homo sapiens
aaagaccctgagactccaga

SEQ ID NO: 5075354 - DNA, 20 bp, Homo sapiens
aaagacctacattccctctc

SEQ ID NO: 5075355 - DNA, 14 bp, Homo sapiens
aaagacctacctcc

SEQ ID NO: 5075356 - DNA, 16 bp, Homo sapiens
aaagacctagattatt

SEQ ID NO: 5075357 - DNA, 21 bp, Homo sapiens
aaagacctagattattgaatt

SEQ ID NO: 5075358 - DNA, 19 bp, Homo sapiens
aaagacctcgtggagaatt

SEQ ID NO: 5075359 - DNA, 22 bp, Homo sapiens
aaagacctcgtggagaattttt

SEQ ID NO: 5075360 - DNA, 12 bp, Homo sapiens
aaagacctgcct

SEQ ID NO: 5075361 - DNA, 22 bp, Homo sapiens
aaagacctggggctgctgtgaa

SEQ ID NO: 5075362 - DNA, 16 bp, Homo sapiens
aaagaccttctcccta

SEQ ID NO: 5075363 - DNA, 22 bp, Homo sapiens
aaagaccttctccctagccctt

SEQ ID NO: 5075364 - DNA, 22 bp, Homo sapiens
aaagacgatgtttatgttctta

SEQ ID NO: 5075365 - DNA, 16 bp, Homo sapiens
aaagacgcatgttatg

SEQ ID NO: 5075366 - DNA, 23 bp, Homo sapiens
aaagacgctaataaaaatttatt

SEQ ID NO: 5075367 - DNA, 22 bp, Homo sapiens
aaagacggaatgaccagaaaat

SEQ ID NO: 5075368 - DNA, 20 bp, Homo sapiens
aaagacggatggcaggatcc

SEQ ID NO: 5075369 - DNA, 15 bp, Homo sapiens
aaagacgttttataa

SEQ ID NO: 5075370 - DNA, 18 bp, Homo sapiens
aaagacgttttataagca

SEQ ID NO: 5075371 - DNA, 16 bp, Homo sapiens
aaagactagtttgtta

SEQ ID NO: 5075372 - DNA, 22 bp, Homo sapiens
aaagactattaagagcaataaa

SEQ ID NO: 5075373 - DNA, 15 bp, Homo sapiens
aaagactattctgtt

SEQ ID NO: 5075374 - DNA, 14 bp, Homo sapiens
aaagactccaaaga

SEQ ID NO: 5075375 - DNA, 23 bp, Homo sapiens
aaagactcctcctgggggctggc

SEQ ID NO: 5075376 - DNA, 17 bp, Homo sapiens
aaagactcctttcctgc

SEQ ID NO: 5075377 - DNA, 15 bp, Homo sapiens
aaagactctgagcca

SEQ ID NO: 5075378 - DNA, 15 bp, Homo sapiens
aaagactcttgggag

SEQ ID NO: 5075379 - DNA, 21 bp, Homo sapiens
aaagactgaaatgcctggaag

SEQ ID NO: 5075380 - DNA, 18 bp, Homo sapiens
aaagactgaacatgttta

SEQ ID NO: 5075381 - DNA, 20 bp, Homo sapiens
aaagactgaacatgtttaca

SEQ ID NO: 5075382 - DNA, 23 bp, Homo sapiens
aaagactgagtacgttgtgcatt

SEQ ID NO: 5075383 - DNA, 14 bp, Homo sapiens
aaagactgatctca

SEQ ID NO: 5075384 - DNA, 18 bp, Homo sapiens
aaagactgcagctgctga

SEQ ID NO: 5075385 - DNA, 21 bp, Homo sapiens
aaagactgccacgtgccttag

SEQ ID NO: 5075386 - DNA, 19 bp, Homo sapiens
aaagactggatttgcagaa

SEQ ID NO: 5075387 - DNA, 12 bp, Homo sapiens
aaagactggctt

SEQ ID NO: 5075388 - DNA, 13 bp, Homo sapiens
aaagactggcttt

SEQ ID NO: 5075389 - DNA, 21 bp, Homo sapiens
aaagactggcttttattaatg

SEQ ID NO: 5075390 - DNA, 12 bp, Homo sapiens
aaagactggttt

SEQ ID NO: 5075391 - DNA, 20 bp, Homo sapiens
aaagactggtttgtttgctt

SEQ ID NO: 5075392 - DNA, 22 bp, Homo sapiens
aaagactggtttgtttgcttaa

SEQ ID NO: 5075393 - DNA, 14 bp, Homo sapiens
aaagactgtgaaca

SEQ ID NO: 5075394 - DNA, 22 bp, Homo sapiens
aaagactgtgaacagcttgctg

SEQ ID NO: 5075395 - DNA, 14 bp, Homo sapiens
aaagactgtgggtg

SEQ ID NO: 5075396 - DNA, 13 bp, Homo sapiens
aaagacttaaagg

SEQ ID NO: 5075397 - DNA, 11 bp, Homo sapiens
aaagacttaag

SEQ ID NO: 5075398 - DNA, 13 bp, Homo sapiens
aaagacttaagat

SEQ ID NO: 5075399 - DNA, 12 bp, Homo sapiens
aaagacttaagc

SEQ ID NO: 5075400 - DNA, 21 bp, Homo sapiens
aaagacttacctgaataatta

SEQ ID NO: 5075401 - DNA, 23 bp, Homo sapiens
aaagacttctcaaagagaattgt

SEQ ID NO: 5075402 - DNA, 16 bp, Homo sapiens
aaagacttgagacaat

SEQ ID NO: 5075403 - DNA, 23 bp, Homo sapiens
aaagacttgttagccaacttcaa

SEQ ID NO: 5075404 - DNA, 13 bp, Homo sapiens
aaagactttctaa

SEQ ID NO: 5075405 - DNA, 18 bp, Homo sapiens
aaagacttttatgtgaga

SEQ ID NO: 5075406 - DNA, 10 bp, Homo sapiens
aaagagaaaa

SEQ ID NO: 5075407 - DNA, 18 bp, Homo sapiens
aaagagaaaaaaagtttg

SEQ ID NO: 5075408 - DNA, 12 bp, Homo sapiens
aaagagaaaaac

SEQ ID NO: 5075409 - DNA, 14 bp, Homo sapiens
aaagagaaaaagaa

SEQ ID NO: 5075410 - DNA, 13 bp, Homo sapiens
aaagagaaaatat

SEQ ID NO: 5075411 - DNA, 20 bp, Homo sapiens
aaagagaaaatatatatttt

SEQ ID NO: 5075412 - DNA, 15 bp, Homo sapiens
aaagagaaaatgctt

SEQ ID NO: 5075413 - DNA, 19 bp, Homo sapiens
aaagagaaacagttggtaa

SEQ ID NO: 5075414 - DNA, 15 bp, Homo sapiens
aaagagaaaccgagg

SEQ ID NO: 5075415 - DNA, 21 bp, Homo sapiens
aaagagaaaccgcttttggtt

SEQ ID NO: 5075416 - DNA, 16 bp, Homo sapiens
aaagagaaaccgggag

SEQ ID NO: 5075417 - DNA, 13 bp, Homo sapiens
aaagagaaaccta

SEQ ID NO: 5075418 - DNA, 11 bp, Homo sapiens
aaagagaaact

SEQ ID NO: 5075419 - DNA, 12 bp, Homo sapiens
aaagagaaactt

SEQ ID NO: 5075420 - DNA, 12 bp, Homo sapiens
aaagagaaagag

SEQ ID NO: 5075421 - DNA, 13 bp, Homo sapiens
aaagagaaatata

SEQ ID NO: 5075422 - DNA, 14 bp, Homo sapiens
aaagagaaccatgt

SEQ ID NO: 5075423 - DNA, 12 bp, Homo sapiens
aaagagaagaag

SEQ ID NO: 5075424 - DNA, 15 bp, Homo sapiens
aaagagaagatgcct

SEQ ID NO: 5075425 - DNA, 14 bp, Homo sapiens
aaagagaaggagcc

SEQ ID NO: 5075426 - DNA, 18 bp, Homo sapiens
aaagagaatgaactgtgg

SEQ ID NO: 5075427 - DNA, 21 bp, Homo sapiens
aaagagaatgaactgtggaat

SEQ ID NO: 5075428 - DNA, 22 bp, Homo sapiens
aaagagaatgaactgtggaatt

SEQ ID NO: 5075429 - DNA, 20 bp, Homo sapiens
aaagagaatgccattctctt

SEQ ID NO: 5075430 - DNA, 15 bp, Homo sapiens
aaagagaattactta

SEQ ID NO: 5075431 - DNA, 12 bp, Homo sapiens
aaagagaattgt

SEQ ID NO: 5075432 - DNA, 11 bp, Homo sapiens
aaagagacaga

SEQ ID NO: 5075433 - DNA, 16 bp, Homo sapiens
aaagagacatttcaaa

SEQ ID NO: 5075434 - DNA, 14 bp, Homo sapiens
aaagagaccagcac

SEQ ID NO: 5075435 - DNA, 17 bp, Homo sapiens
aaagagacctacctcag

SEQ ID NO: 5075436 - DNA, 18 bp, Homo sapiens
aaagagacctacctcagg

SEQ ID NO: 5075437 - DNA, 20 bp, Homo sapiens
aaagagacctacctcaggtt

SEQ ID NO: 5075438 - DNA, 23 bp, Homo sapiens
aaagagactgatcatccaggcct

SEQ ID NO: 5075439 - DNA, 15 bp, Homo sapiens
aaagagactgtgcca

SEQ ID NO: 5075440 - DNA, 16 bp, Homo sapiens
aaagagactgtgccat

SEQ ID NO: 5075441 - DNA, 13 bp, Homo sapiens
aaagagagaaaac

SEQ ID NO: 5075442 - DNA, 22 bp, Homo sapiens
aaagagagaaaacttatttgag

SEQ ID NO: 5075443 - DNA, 16 bp, Homo sapiens
aaagagagaaaataaa

SEQ ID NO: 5075444 - DNA, 20 bp, Homo sapiens
aaaccggcaacctgtaactg

SEQ ID NO: 5075445 - DNA, 16 bp, Homo sapiens
aaaccgtaattttatt

SEQ ID NO: 5075446 - DNA, 19 bp, Homo sapiens
aaaccgtaattttattatt

SEQ ID NO: 5075447 - DNA, 20 bp, Homo sapiens
aaaccgtgtttgtctcttct

SEQ ID NO: 5075448 - DNA, 21 bp, Homo sapiens
aaaccgtgtttgtctcttctg

SEQ ID NO: 5075449 - DNA, 14 bp, Homo sapiens
aaacctaaaaatca

SEQ ID NO: 5075450 - DNA, 15 bp, Homo sapiens
aaacctaacaggaga

SEQ ID NO: 5075451 - DNA, 20 bp, Homo sapiens
aaacctaagtcctttatgtg

SEQ ID NO: 5075452 - DNA, 21 bp, Homo sapiens
aaacctaatgtctgtataaat

SEQ ID NO: 5075453 - DNA, 22 bp, Homo sapiens
aaacctaatgtctgtataaata

SEQ ID NO: 5075454 - DNA, 11 bp, Homo sapiens
aaacctacctt

SEQ ID NO: 5075455 - DNA, 22 bp, Homo sapiens
aaacctaccttatagagcacaa

SEQ ID NO: 5075456 - DNA, 14 bp, Homo sapiens
aaacctactgccca

SEQ ID NO: 5075457 - DNA, 16 bp, Homo sapiens
aaacctagaacttcaa

SEQ ID NO: 5075458 - DNA, 18 bp, Homo sapiens
aaacctagaacttcaaaa

SEQ ID NO: 5075459 - DNA, 17 bp, Homo sapiens
aaacctagagaagataa

SEQ ID NO: 5075460 - DNA, 16 bp, Homo sapiens
aaacctaggatggata

SEQ ID NO: 5075461 - DNA, 23 bp, Homo sapiens
aaacctagggttttctatttctt

SEQ ID NO: 5075462 - DNA, 11 bp, Homo sapiens
aaacctaggtc

SEQ ID NO: 5075463 - DNA, 16 bp, Homo sapiens
aaacctagtactgccc

SEQ ID NO: 5075464 - DNA, 18 bp, Homo sapiens
aaacctatcctcactgcc

SEQ ID NO: 5075465 - DNA, 12 bp, Homo sapiens
aaacctattttg

SEQ ID NO: 5075466 - DNA, 17 bp, Homo sapiens
aaacctcaaaatgtcta

SEQ ID NO: 5075467 - DNA, 14 bp, Homo sapiens
aaacctcacatttg

SEQ ID NO: 5075468 - DNA, 23 bp, Homo sapiens
aaacctcactgagaggcctggag

SEQ ID NO: 5075469 - DNA, 12 bp, Homo sapiens
aaacctcagcta

SEQ ID NO: 5075470 - DNA, 16 bp, Homo sapiens
aaacctcagctagctc

SEQ ID NO: 5075471 - DNA, 11 bp, Homo sapiens
aaacctcaggg

SEQ ID NO: 5075472 - DNA, 15 bp, Homo sapiens
aaacctcagggctgt

SEQ ID NO: 5075473 - DNA, 23 bp, Homo sapiens
aaacctcagggctgtcccagccc

SEQ ID NO: 5075474 - DNA, 19 bp, Homo sapiens
aaacctcagttggcctctg

SEQ ID NO: 5075475 - DNA, 20 bp, Homo sapiens
aaacctcagttggcctctgc

SEQ ID NO: 5075476 - DNA, 18 bp, Homo sapiens
aaacctcatgacagccag

SEQ ID NO: 5075477 - DNA, 20 bp, Homo sapiens
aaacctcattggccagctca

SEQ ID NO: 5075478 - DNA, 21 bp, Homo sapiens
aaacctccaaaactcctgccc

SEQ ID NO: 5075479 - DNA, 14 bp, Homo sapiens
aaacctcctgctgt

SEQ ID NO: 5075480 - DNA, 17 bp, Homo sapiens
aaacctcctgctgtgcc

SEQ ID NO: 5075481 - DNA, 11 bp, Homo sapiens
aaacctctcct

SEQ ID NO: 5075482 - DNA, 17 bp, Homo sapiens
aaacctctccttcctca

SEQ ID NO: 5075483 - DNA, 14 bp, Homo sapiens
aaacctctgttcag

SEQ ID NO: 5075484 - DNA, 16 bp, Homo sapiens
aaacctctgttcagtg

SEQ ID NO: 5075485 - DNA, 21 bp, Homo sapiens
aaacctcttttgttgtccttg

SEQ ID NO: 5075486 - DNA, 21 bp, Homo sapiens
aaacctgaactcagaccactt

SEQ ID NO: 5075487 - DNA, 19 bp, Homo sapiens
aaacctgaactttcattgg

SEQ ID NO: 5075488 - DNA, 18 bp, Homo sapiens
aaacctgaagatgtctcc

SEQ ID NO: 5075489 - DNA, 18 bp, Homo sapiens
aaacctgacccctgctca

SEQ ID NO: 5075490 - DNA, 22 bp, Homo sapiens
aaacctgactaggttctgtaga

SEQ ID NO: 5075491 - DNA, 22 bp, Homo sapiens
aaacctgactcaattatttgca

SEQ ID NO: 5075492 - DNA, 22 bp, Homo sapiens
aaacctgagatttattaaagaa

SEQ ID NO: 5075493 - DNA, 19 bp, Homo sapiens
aaacctgatatatacacat

SEQ ID NO: 5075494 - DNA, 17 bp, Homo sapiens
aaacctgatgcagtgct

SEQ ID NO: 5075495 - DNA, 23 bp, Homo sapiens
aaacctgatgtcagctgctgttg

SEQ ID NO: 5075496 - DNA, 20 bp, Homo sapiens
aaacctgcagtttttaattt

SEQ ID NO: 5075497 - DNA, 18 bp, Homo sapiens
aaacctgcatgaaagcat

SEQ ID NO: 5075498 - DNA, 14 bp, Homo sapiens
aaacctgcattttt

SEQ ID NO: 5075499 - DNA, 12 bp, Homo sapiens
aaacctgccctg

SEQ ID NO: 5075500 - DNA, 16 bp, Homo sapiens
aaacctgcctgggttt

SEQ ID NO: 5075501 - DNA, 12 bp, Homo sapiens
aaacctgccttt

SEQ ID NO: 5075502 - DNA, 14 bp, Homo sapiens
aaacctgcttcctt

SEQ ID NO: 5075503 - DNA, 21 bp, Homo sapiens
aaacctggaatctacaagcca

SEQ ID NO: 5075504 - DNA, 19 bp, Homo sapiens
aaacctggagatgatgatg

SEQ ID NO: 5075505 - DNA, 22 bp, Homo sapiens
aaacctggagatgcagctactg

SEQ ID NO: 5075506 - DNA, 16 bp, Homo sapiens
aaacctgggaaggcca

SEQ ID NO: 5075507 - DNA, 18 bp, Homo sapiens
aaacctgggattcaggaa

SEQ ID NO: 5075508 - DNA, 17 bp, Homo sapiens
aaacctgggctcagcct

SEQ ID NO: 5075509 - DNA, 12 bp, Homo sapiens
aaacctggttca

SEQ ID NO: 5075510 - DNA, 19 bp, Homo sapiens
aaacctgtagatgcagaaa

SEQ ID NO: 5075511 - DNA, 20 bp, Homo sapiens
aaacctgtatttttgttagt

SEQ ID NO: 5075512 - DNA, 17 bp, Homo sapiens
aaacctgtccataaagt

SEQ ID NO: 5075513 - DNA, 12 bp, Homo sapiens
aaacctgtctga

SEQ ID NO: 5075514 - DNA, 11 bp, Homo sapiens
aaacctgtggg

SEQ ID NO: 5075515 - DNA, 16 bp, Homo sapiens
aaacctgttatgccaa

SEQ ID NO: 5075516 - DNA, 18 bp, Homo sapiens
aaacctgttcctgactgt

SEQ ID NO: 5075517 - DNA, 24 bp, Homo sapiens
aaacctgttcctgactgttctctt

SEQ ID NO: 5075518 - DNA, 15 bp, Homo sapiens
aaacctgttcttcct

SEQ ID NO: 5075519 - DNA, 16 bp, Homo sapiens
aaacctgtttaaatat

SEQ ID NO: 5075520 - DNA, 21 bp, Homo sapiens
aaacctgtttttaacatgtga

SEQ ID NO: 5075521 - DNA, 20 bp, Homo sapiens
aaacctgtttttttttcatt

SEQ ID NO: 5075522 - DNA, 19 bp, Homo sapiens
aaaccttaaaaaatgtttc

SEQ ID NO: 5075523 - DNA, 13 bp, Homo sapiens
aaaccttaaaagt

SEQ ID NO: 5075524 - DNA, 14 bp, Homo sapiens
aaaccttaaaagta

SEQ ID NO: 5075525 - DNA, 17 bp, Homo sapiens
aaaccttaaaagtaata

SEQ ID NO: 5075526 - DNA, 14 bp, Homo sapiens
aaaccttaatattt

SEQ ID NO: 5075527 - DNA, 15 bp, Homo sapiens
aaaccttaatatttc

SEQ ID NO: 5075528 - DNA, 21 bp, Homo sapiens
aaaccttaatatttcttcaaa

SEQ ID NO: 5075529 - DNA, 22 bp, Homo sapiens
aaaccttagtacctttttaaca

SEQ ID NO: 5075530 - DNA, 23 bp, Homo sapiens
aaaccttagtcatcagatatgct

SEQ ID NO: 5075531 - DNA, 18 bp, Homo sapiens
aaaccttattgtacctct

SEQ ID NO: 5075532 - DNA, 19 bp, Homo sapiens
aaaccttattttttcccaa

SEQ ID NO: 5075533 - DNA, 20 bp, Homo sapiens
aaaccttattttttcccaaa

SEQ ID NO: 5075534 - DNA, 20 bp, Homo sapiens
aaaccttcacacacagactg

SEQ ID NO: 5075535 - DNA, 13 bp, Homo sapiens
aaaccttcagaag

SEQ ID NO: 5075536 - DNA, 13 bp, Homo sapiens
aaaccttcctggg

SEQ ID NO: 5075537 - DNA, 12 bp, Homo sapiens
aaaccttccttc

SEQ ID NO: 5075538 - DNA, 22 bp, Homo sapiens
aaaccttctatgttcataaaaa

SEQ ID NO: 5075539 - DNA, 14 bp, Homo sapiens
aaaccttctgcctt

SEQ ID NO: 5075540 - DNA, 11 bp, Homo sapiens
aaaccttcttt

SEQ ID NO: 5075541 - DNA, 23 bp, Homo sapiens
aaaccttcttttcaatgcaatgc

SEQ ID NO: 5075542 - DNA, 13 bp, Homo sapiens
aaaccttgaacag

SEQ ID NO: 5075543 - DNA, 16 bp, Homo sapiens
aaaccttgaaggtctg

SEQ ID NO: 5075544 - DNA, 11 bp, Homo sapiens
aaaccttgcag

SEQ ID NO: 5075545 - DNA, 12 bp, Homo sapiens
aaaccttgcagc

SEQ ID NO: 5075546 - DNA, 19 bp, Homo sapiens
aaaccttgcagcattttta

SEQ ID NO: 5075547 - DNA, 14 bp, Homo sapiens
aaaccttgcctttc

SEQ ID NO: 5075548 - DNA, 20 bp, Homo sapiens
aaaccttgctaattttctca

SEQ ID NO: 5075549 - DNA, 16 bp, Homo sapiens
aaaccttgctctcctc

SEQ ID NO: 5075550 - DNA, 20 bp, Homo sapiens
aaaccttgctctcctcatct

SEQ ID NO: 5075551 - DNA, 16 bp, Homo sapiens
aaaccttgggccctgg

SEQ ID NO: 5075552 - DNA, 16 bp, Homo sapiens
aaaccttgttctattt

SEQ ID NO: 5075553 - DNA, 12 bp, Homo sapiens
aaaccttgtttc

SEQ ID NO: 5075554 - DNA, 14 bp, Homo sapiens
aaaccttgtttctt

SEQ ID NO: 5075555 - DNA, 22 bp, Homo sapiens
aaacctttagctgtgaatggct

SEQ ID NO: 5075556 - DNA, 16 bp, Homo sapiens
aaacctttagggcagc

SEQ ID NO: 5075557 - DNA, 11 bp, Homo sapiens
aaacctttcaa

SEQ ID NO: 5075558 - DNA, 19 bp, Homo sapiens
aaacctttcaaatttcaca

SEQ ID NO: 5075559 - DNA, 22 bp, Homo sapiens
aaacctttcagctggcagagtt

SEQ ID NO: 5075560 - DNA, 23 bp, Homo sapiens
aaacctttcagctggcagagtta

SEQ ID NO: 5075561 - DNA, 15 bp, Homo sapiens
aaacctttccatttt

SEQ ID NO: 5075562 - DNA, 12 bp, Homo sapiens
aaacctttcccc

SEQ ID NO: 5075563 - DNA, 18 bp, Homo sapiens
aaacctttctataatttt

SEQ ID NO: 5075564 - DNA, 21 bp, Homo sapiens
aaacctttctataattttaca

SEQ ID NO: 5075565 - DNA, 17 bp, Homo sapiens
aaacctttcttcaccaa

SEQ ID NO: 5075566 - DNA, 20 bp, Homo sapiens
aaacctttgcttaccttgtt

SEQ ID NO: 5075567 - DNA, 19 bp, Homo sapiens
aaacctttggctacacaat

SEQ ID NO: 5075568 - DNA, 18 bp, Homo sapiens
aaaccttttatatttagt

SEQ ID NO: 5075569 - DNA, 12 bp, Homo sapiens
aaaccttttatt

SEQ ID NO: 5075570 - DNA, 13 bp, Homo sapiens
aaaccttttattt

SEQ ID NO: 5075571 - DNA, 14 bp, Homo sapiens
aaaccttttatttt

SEQ ID NO: 5075572 - DNA, 20 bp, Homo sapiens
aaaccttttggaaaatctgc

SEQ ID NO: 5075573 - DNA, 23 bp, Homo sapiens
aaacctttttataaagatcattt

SEQ ID NO: 5075574 - DNA, 15 bp, Homo sapiens
aaacctttttctagt

SEQ ID NO: 5075575 - DNA, 15 bp, Homo sapiens
aaaccttttttaaga

SEQ ID NO: 5075576 - DNA, 16 bp, Homo sapiens
aaaccttttttaagat

SEQ ID NO: 5075577 - DNA, 19 bp, Homo sapiens
aaaccttttttaagatttt

SEQ ID NO: 5075578 - DNA, 16 bp, Homo sapiens
aaacgaaaataaagta

SEQ ID NO: 5075579 - DNA, 14 bp, Homo sapiens
aaacgaaacattta

SEQ ID NO: 5075580 - DNA, 16 bp, Homo sapiens
aaacgaaactgctcta

SEQ ID NO: 5075581 - DNA, 20 bp, Homo sapiens
aaacgaacccactgtgctta

SEQ ID NO: 5075582 - DNA, 15 bp, Homo sapiens
aaacgaaggcataat

SEQ ID NO: 5075583 - DNA, 17 bp, Homo sapiens
aaacgaatataagctta

SEQ ID NO: 5075584 - DNA, 17 bp, Homo sapiens
aaacgactaacctatct

SEQ ID NO: 5075585 - DNA, 21 bp, Homo sapiens
aaacgactcaaaatgacagtt

SEQ ID NO: 5075586 - DNA, 16 bp, Homo sapiens
aaacgagatttgccaa

SEQ ID NO: 5075587 - DNA, 16 bp, Homo sapiens
aaacgatatatgtaaa

SEQ ID NO: 5075588 - DNA, 18 bp, Homo sapiens
aaacgatatatgtaaata

SEQ ID NO: 5075589 - DNA, 22 bp, Homo sapiens
aaacgatgtgcaatacattttt

SEQ ID NO: 5075590 - DNA, 13 bp, Homo sapiens
aaacgatgttgtg

SEQ ID NO: 5075591 - DNA, 18 bp, Homo sapiens
aaacgatttaattctctt

SEQ ID NO: 5075592 - DNA, 21 bp, Homo sapiens
aaacgatttaattctcttgaa

SEQ ID NO: 5075593 - DNA, 20 bp, Homo sapiens
aaacgatttttaaaatgtac

SEQ ID NO: 5075594 - DNA, 21 bp, Homo sapiens
aaacgcaccaatcagcactct

SEQ ID NO: 5075595 - DNA, 15 bp, Homo sapiens
aaacgcacttacaag

SEQ ID NO: 5075596 - DNA, 16 bp, Homo sapiens
aaacgcacttacaagt

SEQ ID NO: 5075597 - DNA, 22 bp, Homo sapiens
aaacgcagttgtgtggcccagc

SEQ ID NO: 5075598 - DNA, 13 bp, Homo sapiens
aaacgcatctagt

SEQ ID NO: 5075599 - DNA, 20 bp, Homo sapiens
aaacgcctcttttccctctc

SEQ ID NO: 5075600 - DNA, 22 bp, Homo sapiens
aaacgcctcttttccctctcta

SEQ ID NO: 5075601 - DNA, 17 bp, Homo sapiens
aaacgcgtctgcctggg

SEQ ID NO: 5075602 - DNA, 13 bp, Homo sapiens
aaacgctacctct

SEQ ID NO: 5075603 - DNA, 16 bp, Homo sapiens
aaacgctacctctctg

SEQ ID NO: 5075604 - DNA, 19 bp, Homo sapiens
aaacgctctctactctgct

SEQ ID NO: 5075605 - DNA, 18 bp, Homo sapiens
aaacgctgtcaaaagttg

SEQ ID NO: 5075606 - DNA, 18 bp, Homo sapiens
aaacggatgatttctatg

SEQ ID NO: 5075607 - DNA, 23 bp, Homo sapiens
aaacggattagggcatttgagaa

SEQ ID NO: 5075608 - DNA, 18 bp, Homo sapiens
aaacggattattttttca

SEQ ID NO: 5075609 - DNA, 21 bp, Homo sapiens
aaacggattattttttcagac

SEQ ID NO: 5075610 - DNA, 23 bp, Homo sapiens
aaacggattattttttcagaccg

SEQ ID NO: 5075611 - DNA, 21 bp, Homo sapiens
aaacggcaacgtagcctgggc

SEQ ID NO: 5075612 - DNA, 12 bp, Homo sapiens
aaacggcagcct

SEQ ID NO: 5075613 - DNA, 12 bp, Homo sapiens
aaacggcccagg

SEQ ID NO: 5075614 - DNA, 13 bp, Homo sapiens
aaacggccctctt

SEQ ID NO: 5075615 - DNA, 17 bp, Homo sapiens
aaacgggaacatgcccc

SEQ ID NO: 5075616 - DNA, 17 bp, Homo sapiens
aaacgggatacaggaga

SEQ ID NO: 5075617 - DNA, 18 bp, Homo sapiens
aaacgggcagtctgctct

SEQ ID NO: 5075618 - DNA, 19 bp, Homo sapiens
aaacggtatcctccctgcc

SEQ ID NO: 5075619 - DNA, 23 bp, Homo sapiens
aaacggtatcctccctgcccatc

SEQ ID NO: 5075620 - DNA, 16 bp, Homo sapiens
aaacggtgctatttct

SEQ ID NO: 5075621 - DNA, 21 bp, Homo sapiens
aaacggtgtatataccttttg

SEQ ID NO: 5075622 - DNA, 15 bp, Homo sapiens
aaacggttcctggtg

SEQ ID NO: 5075623 - DNA, 22 bp, Homo sapiens
aaagagagaaaataaaaagtta

SEQ ID NO: 5075624 - DNA, 18 bp, Homo sapiens
aaagagagaacaggacta

SEQ ID NO: 5075625 - DNA, 13 bp, Homo sapiens
aaagagagaagcc

SEQ ID NO: 5075626 - DNA, 14 bp, Homo sapiens
aaagagagaagcca

SEQ ID NO: 5075627 - DNA, 18 bp, Homo sapiens
aaagagagaatgtagata

SEQ ID NO: 5075628 - DNA, 16 bp, Homo sapiens
aaagagagagatacat

SEQ ID NO: 5075629 - DNA, 11 bp, Homo sapiens
aaagagagagc

SEQ ID NO: 5075630 - DNA, 13 bp, Homo sapiens
aaagagagatttt

SEQ ID NO: 5075631 - DNA, 14 bp, Homo sapiens
aaagagagattttt

SEQ ID NO: 5075632 - DNA, 20 bp, Homo sapiens
aaagagaggtccagagtcct

SEQ ID NO: 5075633 - DNA, 12 bp, Homo sapiens
aaagagatattt

SEQ ID NO: 5075634 - DNA, 15 bp, Homo sapiens
aaagagatctgggca

SEQ ID NO: 5075635 - DNA, 20 bp, Homo sapiens
aaagagatgactaagtcaag

SEQ ID NO: 5075636 - DNA, 20 bp, Homo sapiens
aaagagatgatgaaaatatt

SEQ ID NO: 5075637 - DNA, 14 bp, Homo sapiens
aaagagattcgaat

SEQ ID NO: 5075638 - DNA, 15 bp, Homo sapiens
aaagagatttaaact

SEQ ID NO: 5075639 - DNA, 21 bp, Homo sapiens
aaagagatttaaactctgaat

SEQ ID NO: 5075640 - DNA, 19 bp, Homo sapiens
aaagagcacaaacattttt

SEQ ID NO: 5075641 - DNA, 12 bp, Homo sapiens
aaagagcactta

SEQ ID NO: 5075642 - DNA, 18 bp, Homo sapiens
aaagagcacttaagagaa

SEQ ID NO: 5075643 - DNA, 22 bp, Homo sapiens
aaagagcaggatagctcttcct

SEQ ID NO: 5075644 - DNA, 20 bp, Homo sapiens
aaagagccaagttcaaagaa

SEQ ID NO: 5075645 - DNA, 15 bp, Homo sapiens
aaagagccagaagtt

SEQ ID NO: 5075646 - DNA, 17 bp, Homo sapiens
aaagagccagaagttga

SEQ ID NO: 5075647 - DNA, 17 bp, Homo sapiens
aaagagccatgtgtcat

SEQ ID NO: 5075648 - DNA, 23 bp, Homo sapiens
aaagagccattggtttttgtagt

SEQ ID NO: 5075649 - DNA, 21 bp, Homo sapiens
aaagagccctggctctgcccc

SEQ ID NO: 5075650 - DNA, 18 bp, Homo sapiens
aaagagccttcagaatgc

SEQ ID NO: 5075651 - DNA, 19 bp, Homo sapiens
aaagagctactcagaaatg

SEQ ID NO: 5075652 - DNA, 11 bp, Homo sapiens
aaagagctgcc

SEQ ID NO: 5075653 - DNA, 15 bp, Homo sapiens
aaagagctgcctgga

SEQ ID NO: 5075654 - DNA, 21 bp, Homo sapiens
aaagagctgtctatgcagcct

SEQ ID NO: 5075655 - DNA, 23 bp, Homo sapiens
aaagagctgtctatgcagcctgc

SEQ ID NO: 5075656 - DNA, 14 bp, Homo sapiens
aaagagctgtctga

SEQ ID NO: 5075657 - DNA, 17 bp, Homo sapiens
aaagagctgtggctggg

SEQ ID NO: 5075658 - DNA, 15 bp, Homo sapiens
aaagagctgttttgg

SEQ ID NO: 5075659 - DNA, 12 bp, Homo sapiens
aaagagcttccc

SEQ ID NO: 5075660 - DNA, 15 bp, Homo sapiens
aaagaggaatgaagt

SEQ ID NO: 5075661 - DNA, 20 bp, Homo sapiens
aaagaggactcgcttgtaaa

SEQ ID NO: 5075662 - DNA, 16 bp, Homo sapiens
aaagaggagaaggaga

SEQ ID NO: 5075663 - DNA, 19 bp, Homo sapiens
aaagaggagaaggagaggg

SEQ ID NO: 5075664 - DNA, 16 bp, Homo sapiens
aaagaggagaccctgg

SEQ ID NO: 5075665 - DNA, 23 bp, Homo sapiens
aaagaggagaggaaaactattcc

SEQ ID NO: 5075666 - DNA, 20 bp, Homo sapiens
aaagaggaggacccctgcct

SEQ ID NO: 5075667 - DNA, 16 bp, Homo sapiens
aaagaggagtgttatt

SEQ ID NO: 5075668 - DNA, 21 bp, Homo sapiens
aaagaggattagtagaaaata

SEQ ID NO: 5075669 - DNA, 12 bp, Homo sapiens
aaagaggcctgt

SEQ ID NO: 5075670 - DNA, 22 bp, Homo sapiens
aaagaggcgtcttgtattttct

SEQ ID NO: 5075671 - DNA, 18 bp, Homo sapiens
aaagaggctatgtgagca

SEQ ID NO: 5075672 - DNA, 18 bp, Homo sapiens
aaagaggctgcccctctc

SEQ ID NO: 5075673 - DNA, 23 bp, Homo sapiens
aaagaggctgcccctctcaccaa

SEQ ID NO: 5075674 - DNA, 13 bp, Homo sapiens
aaagaggcttcca

SEQ ID NO: 5075675 - DNA, 13 bp, Homo sapiens
aaagagggagcag

SEQ ID NO: 5075676 - DNA, 15 bp, Homo sapiens
aaagaggggcgctgt

SEQ ID NO: 5075677 - DNA, 22 bp, Homo sapiens
aaagagggtgagggccttctta

SEQ ID NO: 5075678 - DNA, 19 bp, Homo sapiens
aaagagggtttattttcag

SEQ ID NO: 5075679 - DNA, 16 bp, Homo sapiens
aaagaggtccattaat

SEQ ID NO: 5075680 - DNA, 21 bp, Homo sapiens
aaagaggtccattaatacttc

SEQ ID NO: 5075681 - DNA, 18 bp, Homo sapiens
aaagaggtcgcttgggaa

SEQ ID NO: 5075682 - DNA, 21 bp, Homo sapiens
aaagaggtgaaaatgaagaag

SEQ ID NO: 5075683 - DNA, 19 bp, Homo sapiens
aaagaggtgaccccagggc

SEQ ID NO: 5075684 - DNA, 22 bp, Homo sapiens
aaagaggttactttagttagca

SEQ ID NO: 5075685 - DNA, 23 bp, Homo sapiens
aaagaggttactttagttagcat

SEQ ID NO: 5075686 - DNA, 11 bp, Homo sapiens
aaagaggtttt

SEQ ID NO: 5075687 - DNA, 16 bp, Homo sapiens
aaagagtacactcagc

SEQ ID NO: 5075688 - DNA, 12 bp, Homo sapiens
aaagagtactct

SEQ ID NO: 5075689 - DNA, 22 bp, Homo sapiens
aaagagtagaactttaaaagaa

SEQ ID NO: 5075690 - DNA, 14 bp, Homo sapiens
aaagagtaggaaga

SEQ ID NO: 5075691 - DNA, 15 bp, Homo sapiens
aaagagtatgtacgt

SEQ ID NO: 5075692 - DNA, 17 bp, Homo sapiens
aaagagtattcagtgat

SEQ ID NO: 5075693 - DNA, 14 bp, Homo sapiens
aaagagtcacacaa

SEQ ID NO: 5075694 - DNA, 17 bp, Homo sapiens
aaagagtcctccttccc

SEQ ID NO: 5075695 - DNA, 13 bp, Homo sapiens
aaagagtctagat

SEQ ID NO: 5075696 - DNA, 15 bp, Homo sapiens
aaagagtctagattc

SEQ ID NO: 5075697 - DNA, 16 bp, Homo sapiens
aaagagtgaaatattg

SEQ ID NO: 5075698 - DNA, 17 bp, Homo sapiens
aaagagtgtgctcggga

SEQ ID NO: 5075699 - DNA, 19 bp, Homo sapiens
aaagagtgtggcaaaataa

SEQ ID NO: 5075700 - DNA, 13 bp, Homo sapiens
aaagagtgtgtta

SEQ ID NO: 5075701 - DNA, 17 bp, Homo sapiens
aaagagtgttatcatat

SEQ ID NO: 5075702 - DNA, 12 bp, Homo sapiens
aaagagttagaa

SEQ ID NO: 5075703 - DNA, 16 bp, Homo sapiens
aaagagttattcaaat

SEQ ID NO: 5075704 - DNA, 20 bp, Homo sapiens
aaagagttattcaaatgaag

SEQ ID NO: 5075705 - DNA, 22 bp, Homo sapiens
aaagagttctccttgtacttga

SEQ ID NO: 5075706 - DNA, 19 bp, Homo sapiens
aaagagttggcatgaaagt

SEQ ID NO: 5075707 - DNA, 21 bp, Homo sapiens
aaagagttgggtgtctcctta

SEQ ID NO: 5075708 - DNA, 21 bp, Homo sapiens
aaagagtttaaacaaaaaacc

SEQ ID NO: 5075709 - DNA, 21 bp, Homo sapiens
aaagataaaaggtttcttttt

SEQ ID NO: 5075710 - DNA, 15 bp, Homo sapiens
aaagataaaatagtg

SEQ ID NO: 5075711 - DNA, 13 bp, Homo sapiens
aaagataaagatg

SEQ ID NO: 5075712 - DNA, 15 bp, Homo sapiens
aaagataaatattat

SEQ ID NO: 5075713 - DNA, 20 bp, Homo sapiens
aaagataacaagatctttca

SEQ ID NO: 5075714 - DNA, 16 bp, Homo sapiens
aaagataacgcaggag

SEQ ID NO: 5075715 - DNA, 20 bp, Homo sapiens
aaagataattgctatttatt

SEQ ID NO: 5075716 - DNA, 19 bp, Homo sapiens
aaagatacaaaatgttact

SEQ ID NO: 5075717 - DNA, 16 bp, Homo sapiens
aaagatacatttgtat

SEQ ID NO: 5075718 - DNA, 20 bp, Homo sapiens
aaagataccatgtataattt

SEQ ID NO: 5075719 - DNA, 16 bp, Homo sapiens
aaagataccttaaaat

SEQ ID NO: 5075720 - DNA, 18 bp, Homo sapiens
aaagataccttaaaattt

SEQ ID NO: 5075721 - DNA, 20 bp, Homo sapiens
aaagatacgactttattttc

SEQ ID NO: 5075722 - DNA, 17 bp, Homo sapiens
aaagatagacaggtcct

SEQ ID NO: 5075723 - DNA, 13 bp, Homo sapiens
aaagatagcagaa

SEQ ID NO: 5075724 - DNA, 20 bp, Homo sapiens
aaagatagtgctgaaagaat

SEQ ID NO: 5075725 - DNA, 16 bp, Homo sapiens
aaagatataagtgctg

SEQ ID NO: 5075726 - DNA, 13 bp, Homo sapiens
aaagatatatatt

SEQ ID NO: 5075727 - DNA, 20 bp, Homo sapiens
aaagatatattaaaaatata

SEQ ID NO: 5075728 - DNA, 15 bp, Homo sapiens
aaagatatcttttct

SEQ ID NO: 5075729 - DNA, 13 bp, Homo sapiens
aaagatatgtata

SEQ ID NO: 5075730 - DNA, 18 bp, Homo sapiens
aaagatatgtatattttt

SEQ ID NO: 5075731 - DNA, 20 bp, Homo sapiens
aaagatattgtatctccttt

SEQ ID NO: 5075732 - DNA, 16 bp, Homo sapiens
aaagatattgtattat

SEQ ID NO: 5075733 - DNA, 21 bp, Homo sapiens
aaagatattgttgttttccat

SEQ ID NO: 5075734 - DNA, 22 bp, Homo sapiens
aaagatattgttgttttccatg

SEQ ID NO: 5075735 - DNA, 15 bp, Homo sapiens
aaagatatttccaag

SEQ ID NO: 5075736 - DNA, 19 bp, Homo sapiens
aaagatattttatttctga

SEQ ID NO: 5075737 - DNA, 20 bp, Homo sapiens
aaagatattttatttctgat

SEQ ID NO: 5075738 - DNA, 16 bp, Homo sapiens
aaagatattttgcttt

SEQ ID NO: 5075739 - DNA, 13 bp, Homo sapiens
aaagatattttta

SEQ ID NO: 5075740 - DNA, 14 bp, Homo sapiens
aaagatatttttat

SEQ ID NO: 5075741 - DNA, 15 bp, Homo sapiens
aaagatcaaaataaa

SEQ ID NO: 5075742 - DNA, 20 bp, Homo sapiens
aaagatcaaaataaaaagtg

SEQ ID NO: 5075743 - DNA, 14 bp, Homo sapiens
aaagatcagctatt

SEQ ID NO: 5075744 - DNA, 18 bp, Homo sapiens
aaagatcatagttgcaaa

SEQ ID NO: 5075745 - DNA, 21 bp, Homo sapiens
aaagatccaccctcaaatgtc

SEQ ID NO: 5075746 - DNA, 13 bp, Homo sapiens
aaagatccattta

SEQ ID NO: 5075747 - DNA, 20 bp, Homo sapiens
aaagatccatttaaaacaag

SEQ ID NO: 5075748 - DNA, 15 bp, Homo sapiens
aaagatccttcattt

SEQ ID NO: 5075749 - DNA, 18 bp, Homo sapiens
aaagatctcctgtgcacc

SEQ ID NO: 5075750 - DNA, 16 bp, Homo sapiens
aaagatctctgtcaca

SEQ ID NO: 5075751 - DNA, 18 bp, Homo sapiens
aaagatctgctcctcgct

SEQ ID NO: 5075752 - DNA, 19 bp, Homo sapiens
aaagatctgtcctcagcct

SEQ ID NO: 5075753 - DNA, 21 bp, Homo sapiens
aaagatctgttttgaaggcaa

SEQ ID NO: 5075754 - DNA, 21 bp, Homo sapiens
aaagatctttcgttggttgtt

SEQ ID NO: 5075755 - DNA, 16 bp, Homo sapiens
aaagatctttttttaa

SEQ ID NO: 5075756 - DNA, 18 bp, Homo sapiens
aaagatctttttttaagt

SEQ ID NO: 5075757 - DNA, 17 bp, Homo sapiens
aaagatgaaaatatttg

SEQ ID NO: 5075758 - DNA, 17 bp, Homo sapiens
aaagatgaaagagcagt

SEQ ID NO: 5075759 - DNA, 19 bp, Homo sapiens
aaagatgaaggtctgtttt

SEQ ID NO: 5075760 - DNA, 12 bp, Homo sapiens
aaagatgaagtt

SEQ ID NO: 5075761 - DNA, 11 bp, Homo sapiens
aaagatgagtt

SEQ ID NO: 5075762 - DNA, 17 bp, Homo sapiens
aaagatgatattaagaa

SEQ ID NO: 5075763 - DNA, 15 bp, Homo sapiens
aaagatgatcgctgt

SEQ ID NO: 5075764 - DNA, 15 bp, Homo sapiens
aaagatgatggaaac

SEQ ID NO: 5075765 - DNA, 18 bp, Homo sapiens
aaagatgatggaaacgca

SEQ ID NO: 5075766 - DNA, 12 bp, Homo sapiens
aaagatgattga

SEQ ID NO: 5075767 - DNA, 21 bp, Homo sapiens
aaagatgatttaaaagggaag

SEQ ID NO: 5075768 - DNA, 12 bp, Homo sapiens
aaagatgcactt

SEQ ID NO: 5075769 - DNA, 21 bp, Homo sapiens
aaagatgcagagtaagtatta

SEQ ID NO: 5075770 - DNA, 23 bp, Homo sapiens
aaagatgcagagtaagtattatg

SEQ ID NO: 5075771 - DNA, 23 bp, Homo sapiens
aaagatgcatcatctcttcctca

SEQ ID NO: 5075772 - DNA, 15 bp, Homo sapiens
aaagatgcattttga

SEQ ID NO: 5075773 - DNA, 21 bp, Homo sapiens
aaagatgccaattattgttac

SEQ ID NO: 5075774 - DNA, 17 bp, Homo sapiens
aaagatgccccattcct

SEQ ID NO: 5075775 - DNA, 22 bp, Homo sapiens
aaagatgccccattccttgcgc

SEQ ID NO: 5075776 - DNA, 18 bp, Homo sapiens
aaagatgcgtttgcctcc

SEQ ID NO: 5075777 - DNA, 20 bp, Homo sapiens
aaagatgcgtttgcctcctg

SEQ ID NO: 5075778 - DNA, 23 bp, Homo sapiens
aaagatgctcaggtacagagaag

SEQ ID NO: 5075779 - DNA, 17 bp, Homo sapiens
aaagatgctcttctgtg

SEQ ID NO: 5075780 - DNA, 17 bp, Homo sapiens
aaagatgctttaattgt

SEQ ID NO: 5075781 - DNA, 20 bp, Homo sapiens
aaagatgctttaattgtgtg

SEQ ID NO: 5075782 - DNA, 12 bp, Homo sapiens
aaagatgctttt

SEQ ID NO: 5075783 - DNA, 14 bp, Homo sapiens
aaagatggataaac

SEQ ID NO: 5075784 - DNA, 12 bp, Homo sapiens
aaagatggattt

SEQ ID NO: 5075785 - DNA, 22 bp, Homo sapiens
aaagatggatttgacacactca

SEQ ID NO: 5075786 - DNA, 19 bp, Homo sapiens
aaagatggggtctgtaaaa

SEQ ID NO: 5075787 - DNA, 21 bp, Homo sapiens
aaagatggggtctgtaaaatc

SEQ ID NO: 5075788 - DNA, 19 bp, Homo sapiens
aaagatgggtgaaggctgg

SEQ ID NO: 5075789 - DNA, 13 bp, Homo sapiens
aaagatgggtggt

SEQ ID NO: 5075790 - DNA, 20 bp, Homo sapiens
aaagatggtaatcttttctg

SEQ ID NO: 5075791 - DNA, 13 bp, Homo sapiens
aaagatggtggct

SEQ ID NO: 5075792 - DNA, 16 bp, Homo sapiens
aaagatggtggctgtg

SEQ ID NO: 5075793 - DNA, 19 bp, Homo sapiens
aaagatggttaaacatttt

SEQ ID NO: 5075794 - DNA, 24 bp, Homo sapiens
aaagatggtttatgcatgtatatg

SEQ ID NO: 5075795 - DNA, 22 bp, Homo sapiens
aaagatgtaatgtccctttcag

SEQ ID NO: 5075796 - DNA, 18 bp, Homo sapiens
aaagatgtactgagagga

SEQ ID NO: 5075797 - DNA, 12 bp, Homo sapiens
aaagatgtagca

SEQ ID NO: 5075798 - DNA, 15 bp, Homo sapiens
aaagatgtagcaaac

SEQ ID NO: 5075799 - DNA, 13 bp, Homo sapiens
aaagatgtatata

SEQ ID NO: 5075800 - DNA, 22 bp, Homo sapiens
aaagatgtatatttgcatattt

SEQ ID NO: 5075801 - DNA, 21 bp, Homo sapiens
aaagatgtcaaatatctcaga

SEQ ID NO: 5075802 - DNA, 19 bp, Homo sapiens
aaacgtacttaactgtgtg

SEQ ID NO: 5075803 - DNA, 13 bp, Homo sapiens
aaacgtagcatgt

SEQ ID NO: 5075804 - DNA, 17 bp, Homo sapiens
aaacgtatgcatgtgaa

SEQ ID NO: 5075805 - DNA, 20 bp, Homo sapiens
aaacgtatggaatgcttctt

SEQ ID NO: 5075806 - DNA, 19 bp, Homo sapiens
aaacgtatgtgtgcaggag

SEQ ID NO: 5075807 - DNA, 15 bp, Homo sapiens
aaacgtattcagagt

SEQ ID NO: 5075808 - DNA, 16 bp, Homo sapiens
aaacgtattcagagtt

SEQ ID NO: 5075809 - DNA, 21 bp, Homo sapiens
aaacgtattttgatcagtgtt

SEQ ID NO: 5075810 - DNA, 13 bp, Homo sapiens
aaacgtccccagc

SEQ ID NO: 5075811 - DNA, 14 bp, Homo sapiens
aaacgtctcccaga

SEQ ID NO: 5075812 - DNA, 15 bp, Homo sapiens
aaacgtcttaaatat

SEQ ID NO: 5075813 - DNA, 17 bp, Homo sapiens
aaacgtctttttaagcc

SEQ ID NO: 5075814 - DNA, 22 bp, Homo sapiens
aaacgtgaggactcaggaaaaa

SEQ ID NO: 5075815 - DNA, 17 bp, Homo sapiens
aaacgtgatgttttgaa

SEQ ID NO: 5075816 - DNA, 20 bp, Homo sapiens
aaacgtggattttaaaaaat

SEQ ID NO: 5075817 - DNA, 16 bp, Homo sapiens
aaacgtggtcaccttc

SEQ ID NO: 5075818 - DNA, 12 bp, Homo sapiens
aaacgtgtcccg

SEQ ID NO: 5075819 - DNA, 16 bp, Homo sapiens
aaacgttaaaagtgta

SEQ ID NO: 5075820 - DNA, 19 bp, Homo sapiens
aaacgttaaaagtgtacaa

SEQ ID NO: 5075821 - DNA, 22 bp, Homo sapiens
aaacgttggagtttgggctgga

SEQ ID NO: 5075822 - DNA, 13 bp, Homo sapiens
aaacgtttcaaag

SEQ ID NO: 5075823 - DNA, 14 bp, Homo sapiens
aaacgtttcagtaa

SEQ ID NO: 5075824 - DNA, 14 bp, Homo sapiens
aaacgtttctcaaa

SEQ ID NO: 5075825 - DNA, 16 bp, Homo sapiens
aaacgttttgtatagt

SEQ ID NO: 5075826 - DNA, 14 bp, Homo sapiens
aaactaaaaactag

SEQ ID NO: 5075827 - DNA, 13 bp, Homo sapiens
aaactaaaataga

SEQ ID NO: 5075828 - DNA, 16 bp, Homo sapiens
aaactaaaattttcta

SEQ ID NO: 5075829 - DNA, 20 bp, Homo sapiens
aaactaaagagctgcacagc

SEQ ID NO: 5075830 - DNA, 20 bp, Homo sapiens
aaactaaagcaatagaaaca

SEQ ID NO: 5075831 - DNA, 14 bp, Homo sapiens
aaactaaagcagtt

SEQ ID NO: 5075832 - DNA, 21 bp, Homo sapiens
aaactaaagttgaaaatacat

SEQ ID NO: 5075833 - DNA, 20 bp, Homo sapiens
aaactaaataatgaataaac

SEQ ID NO: 5075834 - DNA, 13 bp, Homo sapiens
aaactaaatctct

SEQ ID NO: 5075835 - DNA, 16 bp, Homo sapiens
aaactaacaagattaa

SEQ ID NO: 5075836 - DNA, 22 bp, Homo sapiens
aaactaacaagattaaatatcc

SEQ ID NO: 5075837 - DNA, 17 bp, Homo sapiens
aaactaaccttgaataa

SEQ ID NO: 5075838 - DNA, 13 bp, Homo sapiens
aaactaacttggt

SEQ ID NO: 5075839 - DNA, 12 bp, Homo sapiens
aaactaagagaa

SEQ ID NO: 5075840 - DNA, 13 bp, Homo sapiens
aaactaagagaaa

SEQ ID NO: 5075841 - DNA, 18 bp, Homo sapiens
aaactaagagaaactgtg

SEQ ID NO: 5075842 - DNA, 19 bp, Homo sapiens
aaactaagagaaactgtgt

SEQ ID NO: 5075843 - DNA, 15 bp, Homo sapiens
aaactaagattcttt

SEQ ID NO: 5075844 - DNA, 14 bp, Homo sapiens
aaactaagctcttt

SEQ ID NO: 5075845 - DNA, 21 bp, Homo sapiens
aaactaaggaaccctggaaac

SEQ ID NO: 5075846 - DNA, 18 bp, Homo sapiens
aaactaaggccctcttga

SEQ ID NO: 5075847 - DNA, 15 bp, Homo sapiens
aaactaaggtgctaa

SEQ ID NO: 5075848 - DNA, 18 bp, Homo sapiens
aaactaataaaatatttt

SEQ ID NO: 5075849 - DNA, 21 bp, Homo sapiens
aaactaataaaatattttctg

SEQ ID NO: 5075850 - DNA, 23 bp, Homo sapiens
aaactaataaaatattttctgtg

SEQ ID NO: 5075851 - DNA, 18 bp, Homo sapiens
aaactaatcaccatattg

SEQ ID NO: 5075852 - DNA, 11 bp, Homo sapiens
aaactaatcca

SEQ ID NO: 5075853 - DNA, 16 bp, Homo sapiens
aaactaatgagtatga

SEQ ID NO: 5075854 - DNA, 22 bp, Homo sapiens
aaactaatgagtatgaacttga

SEQ ID NO: 5075855 - DNA, 15 bp, Homo sapiens
aaactaatgtactgt

SEQ ID NO: 5075856 - DNA, 16 bp, Homo sapiens
aaactaatgtactgta

SEQ ID NO: 5075857 - DNA, 12 bp, Homo sapiens
aaactaatgtgt

SEQ ID NO: 5075858 - DNA, 14 bp, Homo sapiens
aaactacaaacaaa

SEQ ID NO: 5075859 - DNA, 16 bp, Homo sapiens
aaactacaaagtaaaa

SEQ ID NO: 5075860 - DNA, 18 bp, Homo sapiens
aaactacaaagtaaaatg

SEQ ID NO: 5075861 - DNA, 14 bp, Homo sapiens
aaactacaccacac

SEQ ID NO: 5075862 - DNA, 17 bp, Homo sapiens
aaactacaccacactaa

SEQ ID NO: 5075863 - DNA, 17 bp, Homo sapiens
aaactacagaataatgt

SEQ ID NO: 5075864 - DNA, 14 bp, Homo sapiens
aaactacatgtaaa

SEQ ID NO: 5075865 - DNA, 18 bp, Homo sapiens
aaactacatgtaaaatct

SEQ ID NO: 5075866 - DNA, 13 bp, Homo sapiens
aaactacatttta

SEQ ID NO: 5075867 - DNA, 13 bp, Homo sapiens
aaactaccaccct

SEQ ID NO: 5075868 - DNA, 20 bp, Homo sapiens
aaactaccagtgggcatgta

SEQ ID NO: 5075869 - DNA, 21 bp, Homo sapiens
aaactaccagtgggcatgtat

SEQ ID NO: 5075870 - DNA, 23 bp, Homo sapiens
aaactaccagtgggcatgtatta

SEQ ID NO: 5075871 - DNA, 18 bp, Homo sapiens
aaactacctcaaaacact

SEQ ID NO: 5075872 - DNA, 19 bp, Homo sapiens
aaactacctcaaaacactt

SEQ ID NO: 5075873 - DNA, 21 bp, Homo sapiens
aaactacctcaaaacactttc

SEQ ID NO: 5075874 - DNA, 17 bp, Homo sapiens
aaactacctgtgagcat

SEQ ID NO: 5075875 - DNA, 17 bp, Homo sapiens
aaactactatttttctt

SEQ ID NO: 5075876 - DNA, 13 bp, Homo sapiens
aaactactctttg

SEQ ID NO: 5075877 - DNA, 16 bp, Homo sapiens
aaactactgattactt

SEQ ID NO: 5075878 - DNA, 19 bp, Homo sapiens
aaactactgtaattaagtg

SEQ ID NO: 5075879 - DNA, 20 bp, Homo sapiens
aaactacttgattttattgt

SEQ ID NO: 5075880 - DNA, 13 bp, Homo sapiens
aaactactttctt

SEQ ID NO: 5075881 - DNA, 16 bp, Homo sapiens
aaactacttttctaaa

SEQ ID NO: 5075882 - DNA, 16 bp, Homo sapiens
aaactagactccattg

SEQ ID NO: 5075883 - DNA, 23 bp, Homo sapiens
aaactagacttgaggaaaccagg

SEQ ID NO: 5075884 - DNA, 22 bp, Homo sapiens
aaactagatactgttgatcttt

SEQ ID NO: 5075885 - DNA, 20 bp, Homo sapiens
aaactagatttataaatgca

SEQ ID NO: 5075886 - DNA, 19 bp, Homo sapiens
aaactagcaactcttattt

SEQ ID NO: 5075887 - DNA, 19 bp, Homo sapiens
aaactagcatatctgcctt

SEQ ID NO: 5075888 - DNA, 15 bp, Homo sapiens
aaactagctcgtgat

SEQ ID NO: 5075889 - DNA, 23 bp, Homo sapiens
aaactagctcgtgattggcatat

SEQ ID NO: 5075890 - DNA, 19 bp, Homo sapiens
aaactagctttgctcttta

SEQ ID NO: 5075891 - DNA, 17 bp, Homo sapiens
aaactaggaaaattgga

SEQ ID NO: 5075892 - DNA, 18 bp, Homo sapiens
aaactaggtgcatattta

SEQ ID NO: 5075893 - DNA, 14 bp, Homo sapiens
aaactagtaaaact

SEQ ID NO: 5075894 - DNA, 16 bp, Homo sapiens
aaactagtaaagacat

SEQ ID NO: 5075895 - DNA, 14 bp, Homo sapiens
aaactagtaatggg

SEQ ID NO: 5075896 - DNA, 19 bp, Homo sapiens
aaactagtatctctggcct

SEQ ID NO: 5075897 - DNA, 16 bp, Homo sapiens
aaactagtatgaaata

SEQ ID NO: 5075898 - DNA, 17 bp, Homo sapiens
aaactagtatgaaataa

SEQ ID NO: 5075899 - DNA, 15 bp, Homo sapiens
aaactagtttccagt

SEQ ID NO: 5075900 - DNA, 21 bp, Homo sapiens
aaactataaactactgtaatt

SEQ ID NO: 5075901 - DNA, 22 bp, Homo sapiens
aaactataaactactgtaatta

SEQ ID NO: 5075902 - DNA, 16 bp, Homo sapiens
aaactataaagtttta

SEQ ID NO: 5075903 - DNA, 21 bp, Homo sapiens
aaactataacattatataaca

SEQ ID NO: 5075904 - DNA, 18 bp, Homo sapiens
aaactatacttgaacaaa

SEQ ID NO: 5075905 - DNA, 17 bp, Homo sapiens
aaactatcagcagcggc

SEQ ID NO: 5075906 - DNA, 19 bp, Homo sapiens
aaactatccaattaaaatt

SEQ ID NO: 5075907 - DNA, 23 bp, Homo sapiens
aaactatccaattaaaattaagg

SEQ ID NO: 5075908 - DNA, 17 bp, Homo sapiens
aaactatcctatgcctt

SEQ ID NO: 5075909 - DNA, 23 bp, Homo sapiens
aaactatcctatgccttcaaata

SEQ ID NO: 5075910 - DNA, 19 bp, Homo sapiens
aaactatcctgattccaaa

SEQ ID NO: 5075911 - DNA, 21 bp, Homo sapiens
aaactatcggttcaagttgat

SEQ ID NO: 5075912 - DNA, 13 bp, Homo sapiens
aaactatgacaat

SEQ ID NO: 5075913 - DNA, 17 bp, Homo sapiens
aaactatgatcacagtg

SEQ ID NO: 5075914 - DNA, 18 bp, Homo sapiens
aaactatgcacctataaa

SEQ ID NO: 5075915 - DNA, 19 bp, Homo sapiens
aaactatggaaataatacc

SEQ ID NO: 5075916 - DNA, 13 bp, Homo sapiens
aaactatgtgttt

SEQ ID NO: 5075917 - DNA, 16 bp, Homo sapiens
aaactatgtgtttttc

SEQ ID NO: 5075918 - DNA, 20 bp, Homo sapiens
aaactatgtgtttttctcat

SEQ ID NO: 5075919 - DNA, 21 bp, Homo sapiens
aaactatgtgtttttctcata

SEQ ID NO: 5075920 - DNA, 17 bp, Homo sapiens
aaactatgttcctaaca

SEQ ID NO: 5075921 - DNA, 14 bp, Homo sapiens
aaactattaaggat

SEQ ID NO: 5075922 - DNA, 23 bp, Homo sapiens
aaactattagagtatttcccttc

SEQ ID NO: 5075923 - DNA, 16 bp, Homo sapiens
aaactattccatgttt

SEQ ID NO: 5075924 - DNA, 18 bp, Homo sapiens
aaactattccatgtttta

SEQ ID NO: 5075925 - DNA, 16 bp, Homo sapiens
aaactatttaaaattg

SEQ ID NO: 5075926 - DNA, 20 bp, Homo sapiens
aaactatttaaaattggcac

SEQ ID NO: 5075927 - DNA, 21 bp, Homo sapiens
aaactatttaaaattggcacc

SEQ ID NO: 5075928 - DNA, 18 bp, Homo sapiens
aaactatttacaatgtgt

SEQ ID NO: 5075929 - DNA, 20 bp, Homo sapiens
aaactatttagtgttagtta

SEQ ID NO: 5075930 - DNA, 11 bp, Homo sapiens
aaactatttat

SEQ ID NO: 5075931 - DNA, 19 bp, Homo sapiens
aaactatttatatcacaca

SEQ ID NO: 5075932 - DNA, 21 bp, Homo sapiens
aaactatttattgtgctgggt

SEQ ID NO: 5075933 - DNA, 22 bp, Homo sapiens
aaactatttcagaatattttgt

SEQ ID NO: 5075934 - DNA, 23 bp, Homo sapiens
aaactatttcagaatattttgta

SEQ ID NO: 5075935 - DNA, 20 bp, Homo sapiens
aaactatttgtctttcagga

SEQ ID NO: 5075936 - DNA, 18 bp, Homo sapiens
aaactcaaaacacccaaa

SEQ ID NO: 5075937 - DNA, 18 bp, Homo sapiens
aaactcaaaaccatctct

SEQ ID NO: 5075938 - DNA, 13 bp, Homo sapiens
aaactcaaaactt

SEQ ID NO: 5075939 - DNA, 13 bp, Homo sapiens
aaactcaaaatat

SEQ ID NO: 5075940 - DNA, 17 bp, Homo sapiens
aaactcaaaatctggga

SEQ ID NO: 5075941 - DNA, 22 bp, Homo sapiens
aaactcaaccaaatggtacaaa

SEQ ID NO: 5075942 - DNA, 13 bp, Homo sapiens
aaactcaagacaa

SEQ ID NO: 5075943 - DNA, 22 bp, Homo sapiens
aaactcaagatttgaccaaatc

SEQ ID NO: 5075944 - DNA, 13 bp, Homo sapiens
aaactcaatgctt

SEQ ID NO: 5075945 - DNA, 16 bp, Homo sapiens
aaactcaccatgtaaa

SEQ ID NO: 5075946 - DNA, 18 bp, Homo sapiens
aaactcaccatgtaaaag

SEQ ID NO: 5075947 - DNA, 18 bp, Homo sapiens
aaactcacctgctggccc

SEQ ID NO: 5075948 - DNA, 16 bp, Homo sapiens
aaactcactgctcaag

SEQ ID NO: 5075949 - DNA, 20 bp, Homo sapiens
aaactcactgctcaagaaga

SEQ ID NO: 5075950 - DNA, 22 bp, Homo sapiens
aaactcactgtgatcaatattt

SEQ ID NO: 5075951 - DNA, 21 bp, Homo sapiens
aaactcacttcaatgaacaaa

SEQ ID NO: 5075952 - DNA, 19 bp, Homo sapiens
aaactcagaatataacatg

SEQ ID NO: 5075953 - DNA, 11 bp, Homo sapiens
aaactcagccg

SEQ ID NO: 5075954 - DNA, 23 bp, Homo sapiens
aaactcagcctcaataagccttg

SEQ ID NO: 5075955 - DNA, 17 bp, Homo sapiens
aaactcaggcaaagaaa

SEQ ID NO: 5075956 - DNA, 19 bp, Homo sapiens
aaactcaggcaaagaaaat

SEQ ID NO: 5075957 - DNA, 22 bp, Homo sapiens
aaactcatattacaaaaacaaa

SEQ ID NO: 5075958 - DNA, 13 bp, Homo sapiens
aaactcatatttt

SEQ ID NO: 5075959 - DNA, 17 bp, Homo sapiens
aaactcatcacataaag

SEQ ID NO: 5075960 - DNA, 15 bp, Homo sapiens
aaactcatctgtaaa

SEQ ID NO: 5075961 - DNA, 12 bp, Homo sapiens
aaactcattgca

SEQ ID NO: 5075962 - DNA, 15 bp, Homo sapiens
aaactcatttcctat

SEQ ID NO: 5075963 - DNA, 12 bp, Homo sapiens
aaactcattttt

SEQ ID NO: 5075964 - DNA, 14 bp, Homo sapiens
aaactccaaagtcc

SEQ ID NO: 5075965 - DNA, 12 bp, Homo sapiens
aaactccacagg

SEQ ID NO: 5075966 - DNA, 12 bp, Homo sapiens
aaactccacatc

SEQ ID NO: 5075967 - DNA, 15 bp, Homo sapiens
aaactccaccttccc

SEQ ID NO: 5075968 - DNA, 19 bp, Homo sapiens
aaactccatctcaaaacaa

SEQ ID NO: 5075969 - DNA, 20 bp, Homo sapiens
aaactccatctcaaaacaaa

SEQ ID NO: 5075970 - DNA, 15 bp, Homo sapiens
aaactcccaatggat

SEQ ID NO: 5075971 - DNA, 21 bp, Homo sapiens
aaactcccaccctaccccctt

SEQ ID NO: 5075972 - DNA, 23 bp, Homo sapiens
aaactcccacttgtcatgtgaca

SEQ ID NO: 5075973 - DNA, 12 bp, Homo sapiens
aaactccccttc

SEQ ID NO: 5075974 - DNA, 13 bp, Homo sapiens
aaactccccttcc

SEQ ID NO: 5075975 - DNA, 14 bp, Homo sapiens
aaactccccttccc

SEQ ID NO: 5075976 - DNA, 21 bp, Homo sapiens
aaactccccttccctggggag

SEQ ID NO: 5075977 - DNA, 23 bp, Homo sapiens
aaactccccttccctggggagcc

SEQ ID NO: 5075978 - DNA, 16 bp, Homo sapiens
aaactcccttgtgttc

SEQ ID NO: 5075979 - DNA, 21 bp, Homo sapiens
aaactcccttgtgttccttct

SEQ ID NO: 5075980 - DNA, 19 bp, Homo sapiens
aaactccgtcttagaagtg

SEQ ID NO: 5075981 - DNA, 12 bp, Homo sapiens
aaagatgtccca

SEQ ID NO: 5075982 - DNA, 13 bp, Homo sapiens
aaagatgtcccac

SEQ ID NO: 5075983 - DNA, 20 bp, Homo sapiens
aaagatgtcccacagggacc

SEQ ID NO: 5075984 - DNA, 20 bp, Homo sapiens
aaagatgtccttggagatga

SEQ ID NO: 5075985 - DNA, 22 bp, Homo sapiens
aaagatgtcttaacctcaggga

SEQ ID NO: 5075986 - DNA, 14 bp, Homo sapiens
aaagatgtgaaaac

SEQ ID NO: 5075987 - DNA, 22 bp, Homo sapiens
aaagatgtgttcaggcattcca

SEQ ID NO: 5075988 - DNA, 15 bp, Homo sapiens
aaagatgttaaatgg

SEQ ID NO: 5075989 - DNA, 14 bp, Homo sapiens
aaagatgttaacag

SEQ ID NO: 5075990 - DNA, 20 bp, Homo sapiens
aaagatgttaacagtatttt

SEQ ID NO: 5075991 - DNA, 18 bp, Homo sapiens
aaagatgttaagcattta

SEQ ID NO: 5075992 - DNA, 19 bp, Homo sapiens
aaagatgttaagcatttat

SEQ ID NO: 5075993 - DNA, 21 bp, Homo sapiens
aaagatgtttgtcagatatga

SEQ ID NO: 5075994 - DNA, 15 bp, Homo sapiens
aaagattaacaacac

SEQ ID NO: 5075995 - DNA, 17 bp, Homo sapiens
aaagattaatctttaaa

SEQ ID NO: 5075996 - DNA, 15 bp, Homo sapiens
aaagattatatatca

SEQ ID NO: 5075997 - DNA, 20 bp, Homo sapiens
aaagattatctgattccttt

SEQ ID NO: 5075998 - DNA, 17 bp, Homo sapiens
aaagattatgatgcata

SEQ ID NO: 5075999 - DNA, 14 bp, Homo sapiens
aaagattcacctga

SEQ ID NO: 5076000 - DNA, 13 bp, Homo sapiens
aaagattcactaa

SEQ ID NO: 5076001 - DNA, 14 bp, Homo sapiens
aaagattcactaaa

SEQ ID NO: 5076002 - DNA, 19 bp, Homo sapiens
aaagattcatttttaatca

SEQ ID NO: 5076003 - DNA, 10 bp, Homo sapiens
aaagattcta

SEQ ID NO: 5076004 - DNA, 14 bp, Homo sapiens
aaagattctctgcg

SEQ ID NO: 5076005 - DNA, 23 bp, Homo sapiens
aaagattctgtgtcagagcccag

SEQ ID NO: 5076006 - DNA, 21 bp, Homo sapiens
aaagattcttcttaaaagttt

SEQ ID NO: 5076007 - DNA, 12 bp, Homo sapiens
aaagattcttta

SEQ ID NO: 5076008 - DNA, 13 bp, Homo sapiens
aaagattctttaa

SEQ ID NO: 5076009 - DNA, 21 bp, Homo sapiens
aaagattggttgcctctgcct

SEQ ID NO: 5076010 - DNA, 16 bp, Homo sapiens
aaagattgtaaactaa

SEQ ID NO: 5076011 - DNA, 21 bp, Homo sapiens
aaagattgtaaactaaagtgt

SEQ ID NO: 5076012 - DNA, 18 bp, Homo sapiens
aaagattgtacttagcca

SEQ ID NO: 5076013 - DNA, 16 bp, Homo sapiens
aaagatttacattcca

SEQ ID NO: 5076014 - DNA, 13 bp, Homo sapiens
aaagatttatcaa

SEQ ID NO: 5076015 - DNA, 21 bp, Homo sapiens
aaagatttcatatctaacttt

SEQ ID NO: 5076016 - DNA, 13 bp, Homo sapiens
aaagatttctgtt

SEQ ID NO: 5076017 - DNA, 14 bp, Homo sapiens
aaagatttcttgag

SEQ ID NO: 5076018 - DNA, 14 bp, Homo sapiens
aaagatttggaaaa

SEQ ID NO: 5076019 - DNA, 16 bp, Homo sapiens
aaagatttggaaaatt

SEQ ID NO: 5076020 - DNA, 22 bp, Homo sapiens
aaagatttgtgaactggaagaa

SEQ ID NO: 5076021 - DNA, 22 bp, Homo sapiens
aaagatttgttactgtattttt

SEQ ID NO: 5076022 - DNA, 13 bp, Homo sapiens
aaagattttatgg

SEQ ID NO: 5076023 - DNA, 24 bp, Homo sapiens
aaagattttatgtgcttgaagatt

SEQ ID NO: 5076024 - DNA, 15 bp, Homo sapiens
aaagattttattgta

SEQ ID NO: 5076025 - DNA, 22 bp, Homo sapiens
aaagattttgatctcacatttt

SEQ ID NO: 5076026 - DNA, 19 bp, Homo sapiens
aaagatttttgttaagctc

SEQ ID NO: 5076027 - DNA, 22 bp, Homo sapiens
aaagatttttgttaagctcagg

SEQ ID NO: 5076028 - DNA, 13 bp, Homo sapiens
aaagattttttaa

SEQ ID NO: 5076029 - DNA, 21 bp, Homo sapiens
aaagattttttaataatttag

SEQ ID NO: 5076030 - DNA, 18 bp, Homo sapiens
aaagatttttttaactta

SEQ ID NO: 5076031 - DNA, 19 bp, Homo sapiens
aaagattttttttaatcta

SEQ ID NO: 5076032 - DNA, 14 bp, Homo sapiens
aaagcaaaaaagaa

SEQ ID NO: 5076033 - DNA, 15 bp, Homo sapiens
aaagcaaaaaagaaa

SEQ ID NO: 5076034 - DNA, 21 bp, Homo sapiens
aaagcaaaaaagaaaaccttt

SEQ ID NO: 5076035 - DNA, 19 bp, Homo sapiens
aaagcaaaaaataaaataa

SEQ ID NO: 5076036 - DNA, 22 bp, Homo sapiens
aaagcaaaaagatgtatatttg

SEQ ID NO: 5076037 - DNA, 14 bp, Homo sapiens
aaagcaaaaatgac

SEQ ID NO: 5076038 - DNA, 13 bp, Homo sapiens
aaagcaaaaatgc

SEQ ID NO: 5076039 - DNA, 19 bp, Homo sapiens
aaagcaaaaatgctaatat

SEQ ID NO: 5076040 - DNA, 21 bp, Homo sapiens
aaagcaaaactcccaatggat

SEQ ID NO: 5076041 - DNA, 19 bp, Homo sapiens
aaagcaaaagaagtaaaag

SEQ ID NO: 5076042 - DNA, 13 bp, Homo sapiens
aaagcaaaagaga

SEQ ID NO: 5076043 - DNA, 14 bp, Homo sapiens
aaagcaaaagagaa

SEQ ID NO: 5076044 - DNA, 21 bp, Homo sapiens
aaagcaaaagagaaatacata

SEQ ID NO: 5076045 - DNA, 22 bp, Homo sapiens
aaagcaaaagatccctttttct

SEQ ID NO: 5076046 - DNA, 11 bp, Homo sapiens
aaagcaaaata

SEQ ID NO: 5076047 - DNA, 17 bp, Homo sapiens
aaagcaaaataaaaact

SEQ ID NO: 5076048 - DNA, 23 bp, Homo sapiens
aaagcaaaataacaaaaaagaga

SEQ ID NO: 5076049 - DNA, 17 bp, Homo sapiens
aaagcaaaatagtattg

SEQ ID NO: 5076050 - DNA, 15 bp, Homo sapiens
aaagcaaaatatttg

SEQ ID NO: 5076051 - DNA, 11 bp, Homo sapiens
aaagcaaagca

SEQ ID NO: 5076052 - DNA, 13 bp, Homo sapiens
aaagcaaaggaga

SEQ ID NO: 5076053 - DNA, 14 bp, Homo sapiens
aaagcaaaggcagt

SEQ ID NO: 5076054 - DNA, 15 bp, Homo sapiens
aaagcaaaggcagtc

SEQ ID NO: 5076055 - DNA, 14 bp, Homo sapiens
aaagcaaagtcact

SEQ ID NO: 5076056 - DNA, 17 bp, Homo sapiens
aaagcaaataagctcta

SEQ ID NO: 5076057 - DNA, 14 bp, Homo sapiens
aaagcaaatataga

SEQ ID NO: 5076058 - DNA, 17 bp, Homo sapiens
aaagcaaatcagaaaac

SEQ ID NO: 5076059 - DNA, 13 bp, Homo sapiens
aaagcaaatggaa

SEQ ID NO: 5076060 - DNA, 18 bp, Homo sapiens
aaagcaaatggaaaatgt

SEQ ID NO: 5076061 - DNA, 14 bp, Homo sapiens
aaagcaaattgttt

SEQ ID NO: 5076062 - DNA, 14 bp, Homo sapiens
aaagcaacactttt

SEQ ID NO: 5076063 - DNA, 21 bp, Homo sapiens
aaagcaacagtagcagggaat

SEQ ID NO: 5076064 - DNA, 14 bp, Homo sapiens
aaagcaacatttta

SEQ ID NO: 5076065 - DNA, 19 bp, Homo sapiens
aaagcaactgtctatttct

SEQ ID NO: 5076066 - DNA, 14 bp, Homo sapiens
aaagcaagaattct

SEQ ID NO: 5076067 - DNA, 15 bp, Homo sapiens
aaagcaaggacatgc

SEQ ID NO: 5076068 - DNA, 13 bp, Homo sapiens
aaagcaaggcaca

SEQ ID NO: 5076069 - DNA, 17 bp, Homo sapiens
aaagcaagggagaaaag

SEQ ID NO: 5076070 - DNA, 14 bp, Homo sapiens
aaagcaaggtacag

SEQ ID NO: 5076071 - DNA, 13 bp, Homo sapiens
aaagcaagtgttg

SEQ ID NO: 5076072 - DNA, 13 bp, Homo sapiens
aaagcaataaaat

SEQ ID NO: 5076073 - DNA, 21 bp, Homo sapiens
aaagcaataaaatttttttgg

SEQ ID NO: 5076074 - DNA, 17 bp, Homo sapiens
aaagcaataaatgaatg

SEQ ID NO: 5076075 - DNA, 14 bp, Homo sapiens
aaagcaataatggt

SEQ ID NO: 5076076 - DNA, 22 bp, Homo sapiens
aaagcaataatggtcccatcca

SEQ ID NO: 5076077 - DNA, 23 bp, Homo sapiens
aaagcaataatggtcccatccag

SEQ ID NO: 5076078 - DNA, 14 bp, Homo sapiens
aaagcaatacaact

SEQ ID NO: 5076079 - DNA, 12 bp, Homo sapiens
aaagcaatagaa

SEQ ID NO: 5076080 - DNA, 16 bp, Homo sapiens
aaagcaatagaaacaa

SEQ ID NO: 5076081 - DNA, 14 bp, Homo sapiens
aaagcaatatgcat

SEQ ID NO: 5076082 - DNA, 13 bp, Homo sapiens
aaagcaatatttc

SEQ ID NO: 5076083 - DNA, 19 bp, Homo sapiens
aaagcaatctgattcagca

SEQ ID NO: 5076084 - DNA, 23 bp, Homo sapiens
aaagcaatctggaagaaagccct

SEQ ID NO: 5076085 - DNA, 19 bp, Homo sapiens
aaagcaatctgttgaaatg

SEQ ID NO: 5076086 - DNA, 13 bp, Homo sapiens
aaagcaatgcatt

SEQ ID NO: 5076087 - DNA, 14 bp, Homo sapiens
aaagcaatgcattt

SEQ ID NO: 5076088 - DNA, 16 bp, Homo sapiens
aaagcaatgtgatggt

SEQ ID NO: 5076089 - DNA, 15 bp, Homo sapiens
aaagcaattttcctt

SEQ ID NO: 5076090 - DNA, 17 bp, Homo sapiens
aaagcaattttccttga

SEQ ID NO: 5076091 - DNA, 23 bp, Homo sapiens
aaagcaattttccttgaagccga

SEQ ID NO: 5076092 - DNA, 16 bp, Homo sapiens
aaagcacaaaaagaaa

SEQ ID NO: 5076093 - DNA, 15 bp, Homo sapiens
aaagcacaaaatgga

SEQ ID NO: 5076094 - DNA, 16 bp, Homo sapiens
aaagcacaaaatggat

SEQ ID NO: 5076095 - DNA, 16 bp, Homo sapiens
aaagcacaaaccctgg

SEQ ID NO: 5076096 - DNA, 18 bp, Homo sapiens
aaagcacaaaccctgggg

SEQ ID NO: 5076097 - DNA, 18 bp, Homo sapiens
aaagcacaaacttctgta

SEQ ID NO: 5076098 - DNA, 23 bp, Homo sapiens
aaagcacaaagttctcagagctc

SEQ ID NO: 5076099 - DNA, 18 bp, Homo sapiens
aaagcacaagtacttttg

SEQ ID NO: 5076100 - DNA, 14 bp, Homo sapiens
aaagcacagtgtta

SEQ ID NO: 5076101 - DNA, 17 bp, Homo sapiens
aaagcacagtttgaaca

SEQ ID NO: 5076102 - DNA, 20 bp, Homo sapiens
aaagcacatgaataatttca

SEQ ID NO: 5076103 - DNA, 18 bp, Homo sapiens
aaagcacatgcttagctt

SEQ ID NO: 5076104 - DNA, 19 bp, Homo sapiens
aaagcaccaaaataagaaa

SEQ ID NO: 5076105 - DNA, 22 bp, Homo sapiens
aaagcaccagcttctccaggct

SEQ ID NO: 5076106 - DNA, 19 bp, Homo sapiens
aaagcaccgcagcatgtgg

SEQ ID NO: 5076107 - DNA, 18 bp, Homo sapiens
aaagcacctgaaccactg

SEQ ID NO: 5076108 - DNA, 17 bp, Homo sapiens
aaagcacgacagtggat

SEQ ID NO: 5076109 - DNA, 15 bp, Homo sapiens
aaagcactagagaat

SEQ ID NO: 5076110 - DNA, 18 bp, Homo sapiens
aaagcactatgaatttgt

SEQ ID NO: 5076111 - DNA, 14 bp, Homo sapiens
aaagcactattgtt

SEQ ID NO: 5076112 - DNA, 21 bp, Homo sapiens
aaagcactattgtttagatat

SEQ ID NO: 5076113 - DNA, 15 bp, Homo sapiens
aaagcactctctgca

SEQ ID NO: 5076114 - DNA, 17 bp, Homo sapiens
aaagcactggtttcaag

SEQ ID NO: 5076115 - DNA, 22 bp, Homo sapiens
aaagcactggtttcaagaatat

SEQ ID NO: 5076116 - DNA, 19 bp, Homo sapiens
aaagcacttggactcttgc

SEQ ID NO: 5076117 - DNA, 14 bp, Homo sapiens
aaagcacttttgtt

SEQ ID NO: 5076118 - DNA, 12 bp, Homo sapiens
aaagcagaaaat

SEQ ID NO: 5076119 - DNA, 22 bp, Homo sapiens
aaagcagaacagttaagcagcc

SEQ ID NO: 5076120 - DNA, 14 bp, Homo sapiens
aaagcagaagcaac

SEQ ID NO: 5076121 - DNA, 14 bp, Homo sapiens
aaagcagaagtctg

SEQ ID NO: 5076122 - DNA, 15 bp, Homo sapiens
aaagcagaattttaa

SEQ ID NO: 5076123 - DNA, 20 bp, Homo sapiens
aaagcagacagcaagggctt

SEQ ID NO: 5076124 - DNA, 17 bp, Homo sapiens
aaagcagacttttgtgt

SEQ ID NO: 5076125 - DNA, 20 bp, Homo sapiens
aaagcagagatgtattatgg

SEQ ID NO: 5076126 - DNA, 16 bp, Homo sapiens
aaagcagagattttca

SEQ ID NO: 5076127 - DNA, 20 bp, Homo sapiens
aaagcagagccaaggccacc

SEQ ID NO: 5076128 - DNA, 14 bp, Homo sapiens
aaagcagaggccaa

SEQ ID NO: 5076129 - DNA, 18 bp, Homo sapiens
aaagcagagtgaaattca

SEQ ID NO: 5076130 - DNA, 19 bp, Homo sapiens
aaagcagagtgaaattcaa

SEQ ID NO: 5076131 - DNA, 16 bp, Homo sapiens
aaagcagattttccta

SEQ ID NO: 5076132 - DNA, 13 bp, Homo sapiens
aaagcagcaaagg

SEQ ID NO: 5076133 - DNA, 20 bp, Homo sapiens
aaagcagcagctaggactga

SEQ ID NO: 5076134 - DNA, 21 bp, Homo sapiens
aaagcagcagctaggactgag

SEQ ID NO: 5076135 - DNA, 12 bp, Homo sapiens
aaagcagcagga

SEQ ID NO: 5076136 - DNA, 13 bp, Homo sapiens
aaagcagcatctg

SEQ ID NO: 5076137 - DNA, 21 bp, Homo sapiens
aaagcagcattctggagggga

SEQ ID NO: 5076138 - DNA, 16 bp, Homo sapiens
aaagcagcgtttctat

SEQ ID NO: 5076139 - DNA, 19 bp, Homo sapiens
aaagcagctttaaaaaaat

SEQ ID NO: 5076140 - DNA, 16 bp, Homo sapiens
aaagcaggaaatacca

SEQ ID NO: 5076141 - DNA, 17 bp, Homo sapiens
aaagcaggactgtgcct

SEQ ID NO: 5076142 - DNA, 19 bp, Homo sapiens
aaagcaggcagaactcatc

SEQ ID NO: 5076143 - DNA, 24 bp, Homo sapiens
aaagcaggcttgcccagtacattt

SEQ ID NO: 5076144 - DNA, 21 bp, Homo sapiens
aaagcaggcttgtgctttata

SEQ ID NO: 5076145 - DNA, 17 bp, Homo sapiens
aaagcagggaatttcta

SEQ ID NO: 5076146 - DNA, 13 bp, Homo sapiens
aaagcagggcagc

SEQ ID NO: 5076147 - DNA, 21 bp, Homo sapiens
aaagcaggggctacaagaggg

SEQ ID NO: 5076148 - DNA, 14 bp, Homo sapiens
aaagcaggttcttg

SEQ ID NO: 5076149 - DNA, 17 bp, Homo sapiens
aaagcaggttcttgttg

SEQ ID NO: 5076150 - DNA, 17 bp, Homo sapiens
aaagcaggtttcaagga

SEQ ID NO: 5076151 - DNA, 13 bp, Homo sapiens
aaagcaggttttt

SEQ ID NO: 5076152 - DNA, 15 bp, Homo sapiens
aaagcagtaaaataa

SEQ ID NO: 5076153 - DNA, 20 bp, Homo sapiens
aaagcagtaaaataaaaaac

SEQ ID NO: 5076154 - DNA, 20 bp, Homo sapiens
aaagcagtatataataactt

SEQ ID NO: 5076155 - DNA, 21 bp, Homo sapiens
aaagcagtatgtacaggctga

SEQ ID NO: 5076156 - DNA, 23 bp, Homo sapiens
aaagcagtatgtacaggctgaga

SEQ ID NO: 5076157 - DNA, 21 bp, Homo sapiens
aaagcagtcctcttattccta

SEQ ID NO: 5076158 - DNA, 17 bp, Homo sapiens
aaagcagtcctgttcaa

SEQ ID NO: 5076159 - DNA, 10 bp, Homo sapiens
aaagcagtgt

SEQ ID NO: 5076160 - DNA, 14 bp, Homo sapiens
aaagcagtgttttc

SEQ ID NO: 5076161 - DNA, 17 bp, Homo sapiens
aaactcctatttcaatg

SEQ ID NO: 5076162 - DNA, 16 bp, Homo sapiens
aaactcctgaaattca

SEQ ID NO: 5076163 - DNA, 11 bp, Homo sapiens
aaactcctgcc

SEQ ID NO: 5076164 - DNA, 14 bp, Homo sapiens
aaactcctgcccct

SEQ ID NO: 5076165 - DNA, 22 bp, Homo sapiens
aaactcctgcccctgttctctt

SEQ ID NO: 5076166 - DNA, 12 bp, Homo sapiens
aaactcctgtgt

SEQ ID NO: 5076167 - DNA, 14 bp, Homo sapiens
aaactccttcctgg

SEQ ID NO: 5076168 - DNA, 21 bp, Homo sapiens
aaactcctttactgcagcctg

SEQ ID NO: 5076169 - DNA, 14 bp, Homo sapiens
aaactcctttctta

SEQ ID NO: 5076170 - DNA, 14 bp, Homo sapiens
aaactcgaaaataa

SEQ ID NO: 5076171 - DNA, 16 bp, Homo sapiens
aaactcgaggactgta

SEQ ID NO: 5076172 - DNA, 19 bp, Homo sapiens
aaactcgaggactgtattt

SEQ ID NO: 5076173 - DNA, 23 bp, Homo sapiens
aaactcgaggactgtatttgtga

SEQ ID NO: 5076174 - DNA, 18 bp, Homo sapiens
aaactctaagtgtaaaaa

SEQ ID NO: 5076175 - DNA, 16 bp, Homo sapiens
aaactctagcagttgt

SEQ ID NO: 5076176 - DNA, 12 bp, Homo sapiens
aaactctataaa

SEQ ID NO: 5076177 - DNA, 22 bp, Homo sapiens
aaactctatcggagaacatgaa

SEQ ID NO: 5076178 - DNA, 13 bp, Homo sapiens
aaactctatggtc

SEQ ID NO: 5076179 - DNA, 21 bp, Homo sapiens
aaactctcatttatattgcag

SEQ ID NO: 5076180 - DNA, 11 bp, Homo sapiens
aaactctctag

SEQ ID NO: 5076181 - DNA, 14 bp, Homo sapiens
aaactctctcccag

SEQ ID NO: 5076182 - DNA, 12 bp, Homo sapiens
aaactctcttct

SEQ ID NO: 5076183 - DNA, 17 bp, Homo sapiens
aaactctcttcttccat

SEQ ID NO: 5076184 - DNA, 22 bp, Homo sapiens
aaactctcttcttccattagaa

SEQ ID NO: 5076185 - DNA, 23 bp, Homo sapiens
aaactctctttgggaatgtttgt

SEQ ID NO: 5076186 - DNA, 18 bp, Homo sapiens
aaactctgaaggagagga

SEQ ID NO: 5076187 - DNA, 13 bp, Homo sapiens
aaactctgagtgc

SEQ ID NO: 5076188 - DNA, 15 bp, Homo sapiens
aaactctgagtgcaa

SEQ ID NO: 5076189 - DNA, 14 bp, Homo sapiens
aaactctgccagaa

SEQ ID NO: 5076190 - DNA, 17 bp, Homo sapiens
aaactctgccagaaaaa

SEQ ID NO: 5076191 - DNA, 17 bp, Homo sapiens
aaactctggctcagcct

SEQ ID NO: 5076192 - DNA, 10 bp, Homo sapiens
aaactctggt

SEQ ID NO: 5076193 - DNA, 23 bp, Homo sapiens
aaactctggtgataaaaataaag

SEQ ID NO: 5076194 - DNA, 22 bp, Homo sapiens
aaactctgttacactttttgga

SEQ ID NO: 5076195 - DNA, 18 bp, Homo sapiens
aaactctgttgtaagtaa

SEQ ID NO: 5076196 - DNA, 17 bp, Homo sapiens
aaactcttaatctgtgt

SEQ ID NO: 5076197 - DNA, 13 bp, Homo sapiens
aaactcttatctc

SEQ ID NO: 5076198 - DNA, 15 bp, Homo sapiens
aaactcttatctcag

SEQ ID NO: 5076199 - DNA, 22 bp, Homo sapiens
aaactcttatctcagtcatgca

SEQ ID NO: 5076200 - DNA, 16 bp, Homo sapiens
aaactcttcaaggcca

SEQ ID NO: 5076201 - DNA, 17 bp, Homo sapiens
aaactcttcaaggccaa

SEQ ID NO: 5076202 - DNA, 18 bp, Homo sapiens
aaactcttcaaggccaag

SEQ ID NO: 5076203 - DNA, 12 bp, Homo sapiens
aaactcttcagt

SEQ ID NO: 5076204 - DNA, 14 bp, Homo sapiens
aaactcttcagtgc

SEQ ID NO: 5076205 - DNA, 14 bp, Homo sapiens
aaactcttctactt

SEQ ID NO: 5076206 - DNA, 16 bp, Homo sapiens
aaactctttaacttct

SEQ ID NO: 5076207 - DNA, 23 bp, Homo sapiens
aaactctttaacttgtaataaac

SEQ ID NO: 5076208 - DNA, 13 bp, Homo sapiens
aaactctttattt

SEQ ID NO: 5076209 - DNA, 20 bp, Homo sapiens
aaactcttttttaaaaatta

SEQ ID NO: 5076210 - DNA, 18 bp, Homo sapiens
aaactgaaaaattttatt

SEQ ID NO: 5076211 - DNA, 12 bp, Homo sapiens
aaactgaaaatc

SEQ ID NO: 5076212 - DNA, 13 bp, Homo sapiens
aaactgaaaatct

SEQ ID NO: 5076213 - DNA, 19 bp, Homo sapiens
aaactgaaaatctaatatt

SEQ ID NO: 5076214 - DNA, 15 bp, Homo sapiens
aaactgaaagtgttt

SEQ ID NO: 5076215 - DNA, 13 bp, Homo sapiens
aaactgaaccaca

SEQ ID NO: 5076216 - DNA, 20 bp, Homo sapiens
aaactgaacttgaagctaac

SEQ ID NO: 5076217 - DNA, 13 bp, Homo sapiens
aaactgaagaagg

SEQ ID NO: 5076218 - DNA, 14 bp, Homo sapiens
aaactgaagaagga

SEQ ID NO: 5076219 - DNA, 15 bp, Homo sapiens
aaactgaagaaggat

SEQ ID NO: 5076220 - DNA, 21 bp, Homo sapiens
aaactgaagcagcctctcccc

SEQ ID NO: 5076221 - DNA, 14 bp, Homo sapiens
aaactgaagccaga

SEQ ID NO: 5076222 - DNA, 17 bp, Homo sapiens
aaactgaagctttttat

SEQ ID NO: 5076223 - DNA, 14 bp, Homo sapiens
aaactgaaggtttt

SEQ ID NO: 5076224 - DNA, 15 bp, Homo sapiens
aaactgaagtctgaa

SEQ ID NO: 5076225 - DNA, 16 bp, Homo sapiens
aaactgaagtctgaaa

SEQ ID NO: 5076226 - DNA, 17 bp, Homo sapiens
aaactgaagtctgaaat

SEQ ID NO: 5076227 - DNA, 15 bp, Homo sapiens
aaactgaatataaag

SEQ ID NO: 5076228 - DNA, 17 bp, Homo sapiens
aaactgaatataaagct

SEQ ID NO: 5076229 - DNA, 19 bp, Homo sapiens
aaactgaatataaagctta

SEQ ID NO: 5076230 - DNA, 15 bp, Homo sapiens
aaactgaatattttg

SEQ ID NO: 5076231 - DNA, 16 bp, Homo sapiens
aaactgaatgaaaccc

SEQ ID NO: 5076232 - DNA, 12 bp, Homo sapiens
aaactgacaatt

SEQ ID NO: 5076233 - DNA, 18 bp, Homo sapiens
aaactgacaattttacct

SEQ ID NO: 5076234 - DNA, 12 bp, Homo sapiens
aaactgacagat

SEQ ID NO: 5076235 - DNA, 15 bp, Homo sapiens
aaactgacagatgct

SEQ ID NO: 5076236 - DNA, 18 bp, Homo sapiens
aaactgacagatgctttt

SEQ ID NO: 5076237 - DNA, 13 bp, Homo sapiens
aaactgactatca

SEQ ID NO: 5076238 - DNA, 13 bp, Homo sapiens
aaactgacttgct

SEQ ID NO: 5076239 - DNA, 13 bp, Homo sapiens
aaactgagaaatg

SEQ ID NO: 5076240 - DNA, 19 bp, Homo sapiens
aaactgagaccaagtctct

SEQ ID NO: 5076241 - DNA, 21 bp, Homo sapiens
aaactgagactcagacaggaa

SEQ ID NO: 5076242 - DNA, 23 bp, Homo sapiens
aaactgagactcagacaggaaag

SEQ ID NO: 5076243 - DNA, 15 bp, Homo sapiens
aaactgagagtaatt

SEQ ID NO: 5076244 - DNA, 11 bp, Homo sapiens
aaactgagcat

SEQ ID NO: 5076245 - DNA, 11 bp, Homo sapiens
aaactgagcct

SEQ ID NO: 5076246 - DNA, 18 bp, Homo sapiens
aaactgagcctcacttgc

SEQ ID NO: 5076247 - DNA, 22 bp, Homo sapiens
aaactgagcctcacttgccctc

SEQ ID NO: 5076248 - DNA, 14 bp, Homo sapiens
aaactgagcctctt

SEQ ID NO: 5076249 - DNA, 23 bp, Homo sapiens
aaactgagcctcttttcaattat

SEQ ID NO: 5076250 - DNA, 21 bp, Homo sapiens
aaactgagctcgcagcccccg

SEQ ID NO: 5076251 - DNA, 19 bp, Homo sapiens
aaactgaggaatttcacct

SEQ ID NO: 5076252 - DNA, 18 bp, Homo sapiens
aaactgaggaattttctt

SEQ ID NO: 5076253 - DNA, 16 bp, Homo sapiens
aaactgagtcactcac

SEQ ID NO: 5076254 - DNA, 17 bp, Homo sapiens
aaactgagtcactcaca

SEQ ID NO: 5076255 - DNA, 22 bp, Homo sapiens
aaactgagtcactcacattgag

SEQ ID NO: 5076256 - DNA, 18 bp, Homo sapiens
aaactgagtccatgaaaa

SEQ ID NO: 5076257 - DNA, 21 bp, Homo sapiens
aaactgagtccatgaaaatac

SEQ ID NO: 5076258 - DNA, 13 bp, Homo sapiens
aaactgagtcctg

SEQ ID NO: 5076259 - DNA, 16 bp, Homo sapiens
aaactgagtctgtgga

SEQ ID NO: 5076260 - DNA, 21 bp, Homo sapiens
aaactgagtttaagggggact

SEQ ID NO: 5076261 - DNA, 16 bp, Homo sapiens
aaactgatcaaaaata

SEQ ID NO: 5076262 - DNA, 20 bp, Homo sapiens
aaactgatcaaaaataaact

SEQ ID NO: 5076263 - DNA, 22 bp, Homo sapiens
aaactgatcaaaaataaactag

SEQ ID NO: 5076264 - DNA, 21 bp, Homo sapiens
aaactgatggaccgggtgggc

SEQ ID NO: 5076265 - DNA, 15 bp, Homo sapiens
aaactgatgtgaaac

SEQ ID NO: 5076266 - DNA, 19 bp, Homo sapiens
aaactgatgtttaaaagtc

SEQ ID NO: 5076267 - DNA, 11 bp, Homo sapiens
aaactgatttc

SEQ ID NO: 5076268 - DNA, 13 bp, Homo sapiens
aaactgatttctc

SEQ ID NO: 5076269 - DNA, 23 bp, Homo sapiens
aaactgcaagttcattttaaatg

SEQ ID NO: 5076270 - DNA, 22 bp, Homo sapiens
aaactgcaatagagactgtaga

SEQ ID NO: 5076271 - DNA, 16 bp, Homo sapiens
aaactgcacaataaaa

SEQ ID NO: 5076272 - DNA, 15 bp, Homo sapiens
aaactgcacagtgct

SEQ ID NO: 5076273 - DNA, 16 bp, Homo sapiens
aaactgcacagtgctg

SEQ ID NO: 5076274 - DNA, 12 bp, Homo sapiens
aaactgcacatc

SEQ ID NO: 5076275 - DNA, 20 bp, Homo sapiens
aaactgcacatgatttcaca

SEQ ID NO: 5076276 - DNA, 21 bp, Homo sapiens
aaactgcacatgatttcacaa

SEQ ID NO: 5076277 - DNA, 22 bp, Homo sapiens
aaactgcacatgatttcacaaa

SEQ ID NO: 5076278 - DNA, 11 bp, Homo sapiens
aaactgcagcc

SEQ ID NO: 5076279 - DNA, 23 bp, Homo sapiens
aaactgcagtcatcaacaatgat

SEQ ID NO: 5076280 - DNA, 16 bp, Homo sapiens
aaactgcatgaaaaat

SEQ ID NO: 5076281 - DNA, 17 bp, Homo sapiens
aaactgcatgaaaaatc

SEQ ID NO: 5076282 - DNA, 14 bp, Homo sapiens
aaactgcatttgtg

SEQ ID NO: 5076283 - DNA, 20 bp, Homo sapiens
aaactgcatttttaatcagt

SEQ ID NO: 5076284 - DNA, 11 bp, Homo sapiens
aaactgccaca

SEQ ID NO: 5076285 - DNA, 18 bp, Homo sapiens
aaactgccacaagcacaa

SEQ ID NO: 5076286 - DNA, 14 bp, Homo sapiens
aaactgccagcaac

SEQ ID NO: 5076287 - DNA, 20 bp, Homo sapiens
aaactgccagttttgtttcc

SEQ ID NO: 5076288 - DNA, 18 bp, Homo sapiens
aaactgccataacatacc

SEQ ID NO: 5076289 - DNA, 13 bp, Homo sapiens
aaactgccccctc

SEQ ID NO: 5076290 - DNA, 20 bp, Homo sapiens
aaactgccccctctgccctg

SEQ ID NO: 5076291 - DNA, 15 bp, Homo sapiens
aaactgccctggctc

SEQ ID NO: 5076292 - DNA, 17 bp, Homo sapiens
aaactgcctgaaagcaa

SEQ ID NO: 5076293 - DNA, 20 bp, Homo sapiens
aaactgcctttgatacaggc

SEQ ID NO: 5076294 - DNA, 21 bp, Homo sapiens
aaactgcgaggacatcaaagt

SEQ ID NO: 5076295 - DNA, 16 bp, Homo sapiens
aaactgctaaattcta

SEQ ID NO: 5076296 - DNA, 23 bp, Homo sapiens
aaactgctaaattctatgttaaa

SEQ ID NO: 5076297 - DNA, 16 bp, Homo sapiens
aaactgctaattacac

SEQ ID NO: 5076298 - DNA, 16 bp, Homo sapiens
aaactgctcatttcat

SEQ ID NO: 5076299 - DNA, 19 bp, Homo sapiens
aaactgctctaagcacacg

SEQ ID NO: 5076300 - DNA, 21 bp, Homo sapiens
aaactgctgaattcacctgtg

SEQ ID NO: 5076301 - DNA, 16 bp, Homo sapiens
aaactgctgcagatta

SEQ ID NO: 5076302 - DNA, 15 bp, Homo sapiens
aaactgctgcatact

SEQ ID NO: 5076303 - DNA, 21 bp, Homo sapiens
aaactgctggacgtctttctt

SEQ ID NO: 5076304 - DNA, 14 bp, Homo sapiens
aaactgctgtcaat

SEQ ID NO: 5076305 - DNA, 21 bp, Homo sapiens
aaactgctgtcaataaatgac

SEQ ID NO: 5076306 - DNA, 16 bp, Homo sapiens
aaactgctgtcgttgt

SEQ ID NO: 5076307 - DNA, 14 bp, Homo sapiens
aaactgctgtctct

SEQ ID NO: 5076308 - DNA, 17 bp, Homo sapiens
aaactgcttacagttta

SEQ ID NO: 5076309 - DNA, 22 bp, Homo sapiens
aaactgcttcccttactttgct

SEQ ID NO: 5076310 - DNA, 21 bp, Homo sapiens
aaactgcttttttttttccag

SEQ ID NO: 5076311 - DNA, 13 bp, Homo sapiens
aaactggaaacat

SEQ ID NO: 5076312 - DNA, 15 bp, Homo sapiens
aaactggaaacatct

SEQ ID NO: 5076313 - DNA, 21 bp, Homo sapiens
aaactggaaatactagatttg

SEQ ID NO: 5076314 - DNA, 19 bp, Homo sapiens
aaactggaaatctggattt

SEQ ID NO: 5076315 - DNA, 15 bp, Homo sapiens
aaactggaagttatt

SEQ ID NO: 5076316 - DNA, 15 bp, Homo sapiens
aaactggaattcttt

SEQ ID NO: 5076317 - DNA, 15 bp, Homo sapiens
aaactggactcacat

SEQ ID NO: 5076318 - DNA, 21 bp, Homo sapiens
aaactggagactgtgtgtgcc

SEQ ID NO: 5076319 - DNA, 16 bp, Homo sapiens
aaactggatactgtac

SEQ ID NO: 5076320 - DNA, 15 bp, Homo sapiens
aaactggatatttca

SEQ ID NO: 5076321 - DNA, 20 bp, Homo sapiens
aaactggatatttcaatctt

SEQ ID NO: 5076322 - DNA, 16 bp, Homo sapiens
aaactggattaaaaca

SEQ ID NO: 5076323 - DNA, 21 bp, Homo sapiens
aaactggcatctgacacaaaa

SEQ ID NO: 5076324 - DNA, 15 bp, Homo sapiens
aaactggcatctgct

SEQ ID NO: 5076325 - DNA, 18 bp, Homo sapiens
aaactggccatggcctgc

SEQ ID NO: 5076326 - DNA, 15 bp, Homo sapiens
aaactggcctgactt

SEQ ID NO: 5076327 - DNA, 9 bp, Homo sapiens
aaactggct

SEQ ID NO: 5076328 - DNA, 21 bp, Homo sapiens
aaactggctggcccagagttt

SEQ ID NO: 5076329 - DNA, 13 bp, Homo sapiens
aaactggctttgg

SEQ ID NO: 5076330 - DNA, 14 bp, Homo sapiens
aaactggctttggc

SEQ ID NO: 5076331 - DNA, 15 bp, Homo sapiens
aaactgggaaatgag

SEQ ID NO: 5076332 - DNA, 18 bp, Homo sapiens
aaactgggaacccctttc

SEQ ID NO: 5076333 - DNA, 19 bp, Homo sapiens
aaactgggataactgattt

SEQ ID NO: 5076334 - DNA, 21 bp, Homo sapiens
aaactgggataactgatttct

SEQ ID NO: 5076335 - DNA, 22 bp, Homo sapiens
aaactgggataactgatttcta

SEQ ID NO: 5076336 - DNA, 20 bp, Homo sapiens
aaactgggatgtaagtttgt

SEQ ID NO: 5076337 - DNA, 19 bp, Homo sapiens
aaactgggattaagaaacc

SEQ ID NO: 5076338 - DNA, 23 bp, Homo sapiens
aaactggggcctgtgtagccagt

SEQ ID NO: 5076339 - DNA, 21 bp, Homo sapiens
aaactgggtatgcgtttcatg

SEQ ID NO: 5076340 - DNA, 16 bp, Homo sapiens
aaactgggtcttcagc

SEQ ID NO: 5076341 - DNA, 21 bp, Homo sapiens
aaactgggtgttcaaggccct

SEQ ID NO: 5076342 - DNA, 15 bp, Homo sapiens
aaactgggttcctgc

SEQ ID NO: 5076343 - DNA, 16 bp, Homo sapiens
aaactgggttcctgca

SEQ ID NO: 5076344 - DNA, 20 bp, Homo sapiens
aaactggtatgaataattgc

SEQ ID NO: 5076345 - DNA, 19 bp, Homo sapiens
aaactggttctacaaattt

SEQ ID NO: 5076346 - DNA, 11 bp, Homo sapiens
aaactggttta

SEQ ID NO: 5076347 - DNA, 15 bp, Homo sapiens
aaactggtttataat

SEQ ID NO: 5076348 - DNA, 20 bp, Homo sapiens
aaactgtaaataaaatgtgt

SEQ ID NO: 5076349 - DNA, 23 bp, Homo sapiens
aaactgtaaataaaatgtgtaca

SEQ ID NO: 5076350 - DNA, 18 bp, Homo sapiens
aaactgtaaatacaaaat

SEQ ID NO: 5076351 - DNA, 17 bp, Homo sapiens
aaactgtaaatcataat

SEQ ID NO: 5076352 - DNA, 17 bp, Homo sapiens
aaactgtacaaatgaaa

SEQ ID NO: 5076353 - DNA, 13 bp, Homo sapiens
aaactgtacagtg

SEQ ID NO: 5076354 - DNA, 17 bp, Homo sapiens
aaactgtacatactgca

SEQ ID NO: 5076355 - DNA, 16 bp, Homo sapiens
aaactgtacatttaaa

SEQ ID NO: 5076356 - DNA, 17 bp, Homo sapiens
aaactgtacatttaaaa

SEQ ID NO: 5076357 - DNA, 22 bp, Homo sapiens
aaactgtacatttaaaattgct

SEQ ID NO: 5076358 - DNA, 18 bp, Homo sapiens
aaactgtaccctatgttc

SEQ ID NO: 5076359 - DNA, 14 bp, Homo sapiens
aaactgtactgtgt

SEQ ID NO: 5076360 - DNA, 12 bp, Homo sapiens
aaactgtacttt

SEQ ID NO: 5076361 - DNA, 14 bp, Homo sapiens
aaactgtactttga

SEQ ID NO: 5076362 - DNA, 18 bp, Homo sapiens
aaactgtactttgattca

SEQ ID NO: 5076363 - DNA, 15 bp, Homo sapiens
aaactgtagaaatga

SEQ ID NO: 5076364 - DNA, 20 bp, Homo sapiens
aaactgtagcgaccccagac

SEQ ID NO: 5076365 - DNA, 21 bp, Homo sapiens
aaactgtagcgaccccagact

SEQ ID NO: 5076366 - DNA, 15 bp, Homo sapiens
aaactgtagtctcag

SEQ ID NO: 5076367 - DNA, 18 bp, Homo sapiens
aaactgtatcaaatctgt

SEQ ID NO: 5076368 - DNA, 19 bp, Homo sapiens
aaactgtatcatctttgcc

SEQ ID NO: 5076369 - DNA, 22 bp, Homo sapiens
aaactgtattaaatcttaaaca

SEQ ID NO: 5076370 - DNA, 11 bp, Homo sapiens
aaactgtctct

SEQ ID NO: 5076371 - DNA, 15 bp, Homo sapiens
aaactgtctgtctcc

SEQ ID NO: 5076372 - DNA, 17 bp, Homo sapiens
aaactgtgaatgcttct

SEQ ID NO: 5076373 - DNA, 21 bp, Homo sapiens
aaactgtgacattccacagag

SEQ ID NO: 5076374 - DNA, 18 bp, Homo sapiens
aaactgtgagataaatat

SEQ ID NO: 5076375 - DNA, 17 bp, Homo sapiens
aaactgtgcaacttttt

SEQ ID NO: 5076376 - DNA, 14 bp, Homo sapiens
aaactgtgcatctc

SEQ ID NO: 5076377 - DNA, 14 bp, Homo sapiens
aaactgtgtaactg

SEQ ID NO: 5076378 - DNA, 17 bp, Homo sapiens
aaactgtgtaactgccc

SEQ ID NO: 5076379 - DNA, 20 bp, Homo sapiens
aaactgtgtaactgcccaaa

SEQ ID NO: 5076380 - DNA, 21 bp, Homo sapiens
aaactgtgtacataactgaaa

SEQ ID NO: 5076381 - DNA, 17 bp, Homo sapiens
aaactgtgtatcattaa

SEQ ID NO: 5076382 - DNA, 20 bp, Homo sapiens
aaactgtgtatcattaaaat

SEQ ID NO: 5076383 - DNA, 22 bp, Homo sapiens
aaactgtgtatcattaaaatat

SEQ ID NO: 5076384 - DNA, 16 bp, Homo sapiens
aaactgtgtattccaa

SEQ ID NO: 5076385 - DNA, 16 bp, Homo sapiens
aaactgtgtctgtccc

SEQ ID NO: 5076386 - DNA, 19 bp, Homo sapiens
aaactgtgtggactgtgat

SEQ ID NO: 5076387 - DNA, 20 bp, Homo sapiens
aaactgtgtggactgtgatg

SEQ ID NO: 5076388 - DNA, 15 bp, Homo sapiens
aaactgtgttgccac

SEQ ID NO: 5076389 - DNA, 17 bp, Homo sapiens
aaactgtgttgccacag

SEQ ID NO: 5076390 - DNA, 19 bp, Homo sapiens
aaactgttaatagttcagg

SEQ ID NO: 5076391 - DNA, 22 bp, Homo sapiens
aaactgttatttttacagcaaa

SEQ ID NO: 5076392 - DNA, 18 bp, Homo sapiens
aaactgttcttttgcatt

SEQ ID NO: 5076393 - DNA, 22 bp, Homo sapiens
aaactgttgccagagatggagg

SEQ ID NO: 5076394 - DNA, 18 bp, Homo sapiens
aaactgttgtctagtata

SEQ ID NO: 5076395 - DNA, 17 bp, Homo sapiens
aaactgtttcaagccct

SEQ ID NO: 5076396 - DNA, 23 bp, Homo sapiens
aaactgtttcaagccctcctccc

SEQ ID NO: 5076397 - DNA, 23 bp, Homo sapiens
aaactgtttcagattttttattt

SEQ ID NO: 5076398 - DNA, 22 bp, Homo sapiens
aaactgtttctcaggcacttga

SEQ ID NO: 5076399 - DNA, 14 bp, Homo sapiens
aaactgtttgaaaa

SEQ ID NO: 5076400 - DNA, 20 bp, Homo sapiens
aaactgttttagacctataa

SEQ ID NO: 5076401 - DNA, 15 bp, Homo sapiens
aaactgttttcatgt

SEQ ID NO: 5076402 - DNA, 17 bp, Homo sapiens
aaacttaaaaaaaaaat

SEQ ID NO: 5076403 - DNA, 15 bp, Homo sapiens
aaacttaaaaacaag

SEQ ID NO: 5076404 - DNA, 21 bp, Homo sapiens
aaacttaaaagtattcataca

SEQ ID NO: 5076405 - DNA, 15 bp, Homo sapiens
aaacttaaacaaaaa

SEQ ID NO: 5076406 - DNA, 12 bp, Homo sapiens
aaacttaaagca

SEQ ID NO: 5076407 - DNA, 13 bp, Homo sapiens
aaacttaaagcaa

SEQ ID NO: 5076408 - DNA, 15 bp, Homo sapiens
aaacttaaagcaaaa

SEQ ID NO: 5076409 - DNA, 16 bp, Homo sapiens
aaacttaaatattgta

SEQ ID NO: 5076410 - DNA, 22 bp, Homo sapiens
aaacttaaatattgtaatatga

SEQ ID NO: 5076411 - DNA, 18 bp, Homo sapiens
aaacttaaccgcatcaga

SEQ ID NO: 5076412 - DNA, 13 bp, Homo sapiens
aaacttaagatga

SEQ ID NO: 5076413 - DNA, 14 bp, Homo sapiens
aaacttaatctaaa

SEQ ID NO: 5076414 - DNA, 21 bp, Homo sapiens
aaacttaattacatccagaaa

SEQ ID NO: 5076415 - DNA, 16 bp, Homo sapiens
aaacttaatttaatat

SEQ ID NO: 5076416 - DNA, 19 bp, Homo sapiens
aaacttaccaattgatgtt

SEQ ID NO: 5076417 - DNA, 21 bp, Homo sapiens
aaacttacctataaattaaga

SEQ ID NO: 5076418 - DNA, 14 bp, Homo sapiens
aaacttactatttt

SEQ ID NO: 5076419 - DNA, 23 bp, Homo sapiens
aaacttactgtcagagaatatga

SEQ ID NO: 5076420 - DNA, 14 bp, Homo sapiens
aaacttagaaatat

SEQ ID NO: 5076421 - DNA, 17 bp, Homo sapiens
aaacttagaaatatgct

SEQ ID NO: 5076422 - DNA, 17 bp, Homo sapiens
aaacttagacccatgct

SEQ ID NO: 5076423 - DNA, 14 bp, Homo sapiens
aaacttagaggaaa

SEQ ID NO: 5076424 - DNA, 17 bp, Homo sapiens
aaacttagaggaaaagg

SEQ ID NO: 5076425 - DNA, 21 bp, Homo sapiens
aaacttagtgcggacaagttt

SEQ ID NO: 5076426 - DNA, 15 bp, Homo sapiens
aaacttagtttgtga

SEQ ID NO: 5076427 - DNA, 17 bp, Homo sapiens
aaacttagtttttatct

SEQ ID NO: 5076428 - DNA, 21 bp, Homo sapiens
aaacttagtttttatctttga

SEQ ID NO: 5076429 - DNA, 15 bp, Homo sapiens
aaacttataaatcat

SEQ ID NO: 5076430 - DNA, 22 bp, Homo sapiens
aaacttatctgagtcacttgaa

SEQ ID NO: 5076431 - DNA, 13 bp, Homo sapiens
aaacttatgaatg

SEQ ID NO: 5076432 - DNA, 14 bp, Homo sapiens
aaacttatgaatgt

SEQ ID NO: 5076433 - DNA, 18 bp, Homo sapiens
aaacttatgctagtttat

SEQ ID NO: 5076434 - DNA, 20 bp, Homo sapiens
aaacttatgctgatttattt

SEQ ID NO: 5076435 - DNA, 10 bp, Homo sapiens
aaacttattt

SEQ ID NO: 5076436 - DNA, 18 bp, Homo sapiens
aaacttattttatatttt

SEQ ID NO: 5076437 - DNA, 19 bp, Homo sapiens
aaacttatttttttctgat

SEQ ID NO: 5076438 - DNA, 22 bp, Homo sapiens
aaacttatttttttctgattgt

SEQ ID NO: 5076439 - DNA, 23 bp, Homo sapiens
aaacttatttttttctgattgta

SEQ ID NO: 5076440 - DNA, 18 bp, Homo sapiens
aaacttcaaagctgaata

SEQ ID NO: 5076441 - DNA, 18 bp, Homo sapiens
aaacttcaaggaaaataa

SEQ ID NO: 5076442 - DNA, 20 bp, Homo sapiens
aaacttcaaggaaaataagt

SEQ ID NO: 5076443 - DNA, 22 bp, Homo sapiens
aaacttcaaggaaaataagtga

SEQ ID NO: 5076444 - DNA, 17 bp, Homo sapiens
aaacttcacatttatgt

SEQ ID NO: 5076445 - DNA, 19 bp, Homo sapiens
aaacttcactccaaagaga

SEQ ID NO: 5076446 - DNA, 20 bp, Homo sapiens
aaacttcactccaaagagaa

SEQ ID NO: 5076447 - DNA, 12 bp, Homo sapiens
aaacttcagaag

SEQ ID NO: 5076448 - DNA, 20 bp, Homo sapiens
aaacttcagaagcaaacaat

SEQ ID NO: 5076449 - DNA, 19 bp, Homo sapiens
aaacttcagagaaattatg

SEQ ID NO: 5076450 - DNA, 20 bp, Homo sapiens
aaacttcagatgggaggaaa

SEQ ID NO: 5076451 - DNA, 13 bp, Homo sapiens
aaacttcagcacc

SEQ ID NO: 5076452 - DNA, 23 bp, Homo sapiens
aaacttcagcggtttatataagc

SEQ ID NO: 5076453 - DNA, 22 bp, Homo sapiens
aaacttcagtttcacagaaaat

SEQ ID NO: 5076454 - DNA, 18 bp, Homo sapiens
aaacttcagttttactgc

SEQ ID NO: 5076455 - DNA, 20 bp, Homo sapiens
aaacttcatgtaattttatt

SEQ ID NO: 5076456 - DNA, 17 bp, Homo sapiens
aaacttcattctcgtga

SEQ ID NO: 5076457 - DNA, 17 bp, Homo sapiens
aaacttccaaagaaagt

SEQ ID NO: 5076458 - DNA, 14 bp, Homo sapiens
aaacttccaaagct

SEQ ID NO: 5076459 - DNA, 16 bp, Homo sapiens
aaacttccaagacctg

SEQ ID NO: 5076460 - DNA, 23 bp, Homo sapiens
aaacttccagtgcaacactgaag

SEQ ID NO: 5076461 - DNA, 14 bp, Homo sapiens
aaacttcgtttaat

SEQ ID NO: 5076462 - DNA, 17 bp, Homo sapiens
aaacttcgtttaatgaa

SEQ ID NO: 5076463 - DNA, 16 bp, Homo sapiens
aaacttctaaatgttg

SEQ ID NO: 5076464 - DNA, 13 bp, Homo sapiens
aaacttctactga

SEQ ID NO: 5076465 - DNA, 16 bp, Homo sapiens
aaacttctagcttgga

SEQ ID NO: 5076466 - DNA, 15 bp, Homo sapiens
aaacttctatgtaaa

SEQ ID NO: 5076467 - DNA, 19 bp, Homo sapiens
aaacttctctgaagggagg

SEQ ID NO: 5076468 - DNA, 11 bp, Homo sapiens
aaacttctgaa

SEQ ID NO: 5076469 - DNA, 15 bp, Homo sapiens
aaacttctgaagact

SEQ ID NO: 5076470 - DNA, 13 bp, Homo sapiens
aaacttcttaaat

SEQ ID NO: 5076471 - DNA, 19 bp, Homo sapiens
aaacttcttaaatatcttt

SEQ ID NO: 5076472 - DNA, 17 bp, Homo sapiens
aaacttcttgtcagaca

SEQ ID NO: 5076473 - DNA, 20 bp, Homo sapiens
aaacttcttttctcttctac

SEQ ID NO: 5076474 - DNA, 11 bp, Homo sapiens
aaacttgaaaa

SEQ ID NO: 5076475 - DNA, 14 bp, Homo sapiens
aaacttgaaaatat

SEQ ID NO: 5076476 - DNA, 15 bp, Homo sapiens
aaacttgaaatatat

SEQ ID NO: 5076477 - DNA, 16 bp, Homo sapiens
aaacttgaacaagaaa

SEQ ID NO: 5076478 - DNA, 22 bp, Homo sapiens
aaacttgaacttgcaggcaagc

SEQ ID NO: 5076479 - DNA, 13 bp, Homo sapiens
aaacttgaatctg

SEQ ID NO: 5076480 - DNA, 17 bp, Homo sapiens
aaacttgagcccactcc

SEQ ID NO: 5076481 - DNA, 21 bp, Homo sapiens
aaacttgagttggagtactat

SEQ ID NO: 5076482 - DNA, 13 bp, Homo sapiens
aaacttgagtttg

SEQ ID NO: 5076483 - DNA, 22 bp, Homo sapiens
aaacttgatgtgttatctctta

SEQ ID NO: 5076484 - DNA, 16 bp, Homo sapiens
aaacttgctgagctgt

SEQ ID NO: 5076485 - DNA, 24 bp, Homo sapiens
aaacttggaagggggagacaggaa

SEQ ID NO: 5076486 - DNA, 15 bp, Homo sapiens
aaacttggacattta

SEQ ID NO: 5076487 - DNA, 17 bp, Homo sapiens
aaacttggacatttatg

SEQ ID NO: 5076488 - DNA, 23 bp, Homo sapiens
aaacttggatcagatagcaggag

SEQ ID NO: 5076489 - DNA, 20 bp, Homo sapiens
aaacttggctggaatttctg

SEQ ID NO: 5076490 - DNA, 12 bp, Homo sapiens
aaacttgggcac

SEQ ID NO: 5076491 - DNA, 18 bp, Homo sapiens
aaacttgtatctgaagac

SEQ ID NO: 5076492 - DNA, 18 bp, Homo sapiens
aaacttgtcacttgcatg

SEQ ID NO: 5076493 - DNA, 22 bp, Homo sapiens
aaacttgtcttttcaaaatatt

SEQ ID NO: 5076494 - DNA, 13 bp, Homo sapiens
aaacttgtgcctc

SEQ ID NO: 5076495 - DNA, 19 bp, Homo sapiens
aaacttgtgtatgatccaa

SEQ ID NO: 5076496 - DNA, 15 bp, Homo sapiens
aaacttgttagaaat

SEQ ID NO: 5076497 - DNA, 14 bp, Homo sapiens
aaacttgttattgt

SEQ ID NO: 5076498 - DNA, 17 bp, Homo sapiens
aaacttgttattgtgaa

SEQ ID NO: 5076499 - DNA, 19 bp, Homo sapiens
aaacttgttattgtgaatg

SEQ ID NO: 5076500 - DNA, 22 bp, Homo sapiens
aaacttgttattgtgaatgatt

SEQ ID NO: 5076501 - DNA, 15 bp, Homo sapiens
aaacttgttcattta

SEQ ID NO: 5076502 - DNA, 16 bp, Homo sapiens
aaacttgttcttccaa

SEQ ID NO: 5076503 - DNA, 12 bp, Homo sapiens
aaactttaaaaa

SEQ ID NO: 5076504 - DNA, 15 bp, Homo sapiens
aaactttaaaaggca

SEQ ID NO: 5076505 - DNA, 12 bp, Homo sapiens
aaactttaaaga

SEQ ID NO: 5076506 - DNA, 15 bp, Homo sapiens
aaactttaacttcca

SEQ ID NO: 5076507 - DNA, 22 bp, Homo sapiens
aaactttaacttccactttgta

SEQ ID NO: 5076508 - DNA, 18 bp, Homo sapiens
aaactttactaagatgac

SEQ ID NO: 5076509 - DNA, 19 bp, Homo sapiens
aaactttagggtaaaaatt

SEQ ID NO: 5076510 - DNA, 24 bp, Homo sapiens
aaactttaggtttttttaatgata

SEQ ID NO: 5076511 - DNA, 13 bp, Homo sapiens
aaactttatacat

SEQ ID NO: 5076512 - DNA, 12 bp, Homo sapiens
aaactttatgct

SEQ ID NO: 5076513 - DNA, 18 bp, Homo sapiens
aaactttatttaaatgca

SEQ ID NO: 5076514 - DNA, 20 bp, Homo sapiens
aaactttatttaaatgcatg

SEQ ID NO: 5076515 - DNA, 21 bp, Homo sapiens
aaactttcaagtattatattt

SEQ ID NO: 5076516 - DNA, 13 bp, Homo sapiens
aaactttcacttt

SEQ ID NO: 5076517 - DNA, 14 bp, Homo sapiens
aaactttccatgac

SEQ ID NO: 5076518 - DNA, 16 bp, Homo sapiens
aaactttccatgacag

SEQ ID NO: 5076519 - DNA, 12 bp, Homo sapiens
aaactttccttt

SEQ ID NO: 5076520 - DNA, 18 bp, Homo sapiens
aaactttctcataagcac

SEQ ID NO: 5076521 - DNA, 17 bp, Homo sapiens
aaaacacttctgtcctg

SEQ ID NO: 5076522 - DNA, 19 bp, Homo sapiens
aaaacacttgatgatgtgg

SEQ ID NO: 5076523 - DNA, 14 bp, Homo sapiens
aaaacactttccca

SEQ ID NO: 5076524 - DNA, 16 bp, Homo sapiens
aaaacactttcctgga

SEQ ID NO: 5076525 - DNA, 11 bp, Homo sapiens
aaaacagaaaa

SEQ ID NO: 5076526 - DNA, 16 bp, Homo sapiens
aaaacagaaaaaaaac

SEQ ID NO: 5076527 - DNA, 16 bp, Homo sapiens
aaaacagaaattggta

SEQ ID NO: 5076528 - DNA, 18 bp, Homo sapiens
aaaacagaacatcattag

SEQ ID NO: 5076529 - DNA, 15 bp, Homo sapiens
aaaacagaacatttc

SEQ ID NO: 5076530 - DNA, 13 bp, Homo sapiens
aaaacagaagcaa

SEQ ID NO: 5076531 - DNA, 13 bp, Homo sapiens
aaaacagaagcct

SEQ ID NO: 5076532 - DNA, 15 bp, Homo sapiens
aaaacagaatattga

SEQ ID NO: 5076533 - DNA, 16 bp, Homo sapiens
aaaacagaatttgaga

SEQ ID NO: 5076534 - DNA, 17 bp, Homo sapiens
aaaacagaatttgagaa

SEQ ID NO: 5076535 - DNA, 15 bp, Homo sapiens
aaaacagacaaaaca

SEQ ID NO: 5076536 - DNA, 15 bp, Homo sapiens
aaaacagacgggtct

SEQ ID NO: 5076537 - DNA, 18 bp, Homo sapiens
aaaacagagtaatcttgt

SEQ ID NO: 5076538 - DNA, 19 bp, Homo sapiens
aaaacagagtaatcttgtt

SEQ ID NO: 5076539 - DNA, 22 bp, Homo sapiens
aaaacagagtaatcttgttggt

SEQ ID NO: 5076540 - DNA, 12 bp, Homo sapiens
aaaacagatgag

SEQ ID NO: 5076541 - DNA, 19 bp, Homo sapiens
aaaacagatggtagagaga

SEQ ID NO: 5076542 - DNA, 21 bp, Homo sapiens
aaaacagccaccgtttcttcc

SEQ ID NO: 5076543 - DNA, 14 bp, Homo sapiens
aaaacagcccccac

SEQ ID NO: 5076544 - DNA, 19 bp, Homo sapiens
aaaacagctgcattagaaa

SEQ ID NO: 5076545 - DNA, 21 bp, Homo sapiens
aaaacagcttaaagagaaaaa

SEQ ID NO: 5076546 - DNA, 16 bp, Homo sapiens
aaaacagcttcctgtt

SEQ ID NO: 5076547 - DNA, 12 bp, Homo sapiens
aaaacaggaaaa

SEQ ID NO: 5076548 - DNA, 13 bp, Homo sapiens
aaaacaggaaaaa

SEQ ID NO: 5076549 - DNA, 19 bp, Homo sapiens
aaaacaggaaaaaaacttt

SEQ ID NO: 5076550 - DNA, 22 bp, Homo sapiens
aaaacaggagcaaatggcgttt

SEQ ID NO: 5076551 - DNA, 18 bp, Homo sapiens
aaaacaggcactgccctg

SEQ ID NO: 5076552 - DNA, 14 bp, Homo sapiens
aaaacaggctgctt

SEQ ID NO: 5076553 - DNA, 23 bp, Homo sapiens
aaaacagggccacatagatgctg

SEQ ID NO: 5076554 - DNA, 20 bp, Homo sapiens
aaaacagggtgggcaaactc

SEQ ID NO: 5076555 - DNA, 12 bp, Homo sapiens
aaaacaggtaga

SEQ ID NO: 5076556 - DNA, 22 bp, Homo sapiens
aaaacagtaactaagcacatta

SEQ ID NO: 5076557 - DNA, 16 bp, Homo sapiens
aaaacagtatttattt

SEQ ID NO: 5076558 - DNA, 17 bp, Homo sapiens
aaaacagtatttatttt

SEQ ID NO: 5076559 - DNA, 20 bp, Homo sapiens
aaaacagtatttattttgta

SEQ ID NO: 5076560 - DNA, 20 bp, Homo sapiens
aaaacagtccttcaaacttc

SEQ ID NO: 5076561 - DNA, 17 bp, Homo sapiens
aaaacagtgaatcttat

SEQ ID NO: 5076562 - DNA, 15 bp, Homo sapiens
aaaacagttctcaga

SEQ ID NO: 5076563 - DNA, 20 bp, Homo sapiens
aaaacagttggcatgcatcc

SEQ ID NO: 5076564 - DNA, 17 bp, Homo sapiens
aaaacataaaatataca

SEQ ID NO: 5076565 - DNA, 13 bp, Homo sapiens
aaaacataaagaa

SEQ ID NO: 5076566 - DNA, 14 bp, Homo sapiens
aaaacataagacga

SEQ ID NO: 5076567 - DNA, 17 bp, Homo sapiens
aaaacatacccagtgtt

SEQ ID NO: 5076568 - DNA, 23 bp, Homo sapiens
aaaacatacgaaaaagtgattgt

SEQ ID NO: 5076569 - DNA, 16 bp, Homo sapiens
aaaacatacttcaaaa

SEQ ID NO: 5076570 - DNA, 11 bp, Homo sapiens
aaaacatatca

SEQ ID NO: 5076571 - DNA, 23 bp, Homo sapiens
aaaacatatgaaatataaattat

SEQ ID NO: 5076572 - DNA, 15 bp, Homo sapiens
aaaacatatgtctgt

SEQ ID NO: 5076573 - DNA, 24 bp, Homo sapiens
aaaacatatgtctgtctttgcaaa

SEQ ID NO: 5076574 - DNA, 18 bp, Homo sapiens
aaaacatattcaaagcag

SEQ ID NO: 5076575 - DNA, 19 bp, Homo sapiens
aaaacatattcttgtgctt

SEQ ID NO: 5076576 - DNA, 14 bp, Homo sapiens
aaaacatatttcat

SEQ ID NO: 5076577 - DNA, 14 bp, Homo sapiens
aaaacatcaaaatg

SEQ ID NO: 5076578 - DNA, 21 bp, Homo sapiens
aaaacatcactatcaatttta

SEQ ID NO: 5076579 - DNA, 21 bp, Homo sapiens
aaaacatcattcctttttatt

SEQ ID NO: 5076580 - DNA, 22 bp, Homo sapiens
aaaacatcattcctttttattt

SEQ ID NO: 5076581 - DNA, 22 bp, Homo sapiens
aaaacatcccaaactttaaaat

SEQ ID NO: 5076582 - DNA, 23 bp, Homo sapiens
aaaacatcccaaactttaaaatg

SEQ ID NO: 5076583 - DNA, 16 bp, Homo sapiens
aaaacatctattctct

SEQ ID NO: 5076584 - DNA, 11 bp, Homo sapiens
aaaacatgaaa

SEQ ID NO: 5076585 - DNA, 21 bp, Homo sapiens
aaaacatgcagaacaaatgaa

SEQ ID NO: 5076586 - DNA, 22 bp, Homo sapiens
aaaacatgcgatgttagtttta

SEQ ID NO: 5076587 - DNA, 14 bp, Homo sapiens
aaaacatggtagaa

SEQ ID NO: 5076588 - DNA, 15 bp, Homo sapiens
aaaacatgtttattt

SEQ ID NO: 5076589 - DNA, 16 bp, Homo sapiens
aaaacattaagaaaat

SEQ ID NO: 5076590 - DNA, 21 bp, Homo sapiens
aaaacattagaagaaaacata

SEQ ID NO: 5076591 - DNA, 13 bp, Homo sapiens
aaaacattcatcc

SEQ ID NO: 5076592 - DNA, 11 bp, Homo sapiens
aaaacattcca

SEQ ID NO: 5076593 - DNA, 21 bp, Homo sapiens
aaaacattccccaattatctt

SEQ ID NO: 5076594 - DNA, 21 bp, Homo sapiens
aaaacattccgtttacatttt

SEQ ID NO: 5076595 - DNA, 22 bp, Homo sapiens
aaaacattccgtttacatttta

SEQ ID NO: 5076596 - DNA, 16 bp, Homo sapiens
aaaacattgaaatatt

SEQ ID NO: 5076597 - DNA, 22 bp, Homo sapiens
aaaacattgcctttgaatgtta

SEQ ID NO: 5076598 - DNA, 16 bp, Homo sapiens
aaaacattgcttttga

SEQ ID NO: 5076599 - DNA, 14 bp, Homo sapiens
aaaacatttaacat

SEQ ID NO: 5076600 - DNA, 16 bp, Homo sapiens
aaaacatttacatcaa

SEQ ID NO: 5076601 - DNA, 11 bp, Homo sapiens
aaaacatttca

SEQ ID NO: 5076602 - DNA, 17 bp, Homo sapiens
aaaacatttcaagttta

SEQ ID NO: 5076603 - DNA, 18 bp, Homo sapiens
aaaacatttcaagtttac

SEQ ID NO: 5076604 - DNA, 18 bp, Homo sapiens
aaaacatttcatgtattt

SEQ ID NO: 5076605 - DNA, 11 bp, Homo sapiens
aaaacatttct

SEQ ID NO: 5076606 - DNA, 13 bp, Homo sapiens
aaaacatttctaa

SEQ ID NO: 5076607 - DNA, 19 bp, Homo sapiens
aaaacatttctaagactac

SEQ ID NO: 5076608 - DNA, 18 bp, Homo sapiens
aaaacatttgattaataa

SEQ ID NO: 5076609 - DNA, 16 bp, Homo sapiens
aaaacatttgtttccc

SEQ ID NO: 5076610 - DNA, 18 bp, Homo sapiens
aaaacattttaaatgaaa

SEQ ID NO: 5076611 - DNA, 16 bp, Homo sapiens
aaaacattttaaatgg

SEQ ID NO: 5076612 - DNA, 19 bp, Homo sapiens
aaaacattttaaatggaca

SEQ ID NO: 5076613 - DNA, 14 bp, Homo sapiens
aaaacattttttag

SEQ ID NO: 5076614 - DNA, 18 bp, Homo sapiens
aaaacatttttttaagca

SEQ ID NO: 5076615 - DNA, 21 bp, Homo sapiens
aaaacattttttttttaaatc

SEQ ID NO: 5076616 - DNA, 20 bp, Homo sapiens
aaaaccaaaagtgcattcaa

SEQ ID NO: 5076617 - DNA, 20 bp, Homo sapiens
aaaaccaaaagttattaaaa

SEQ ID NO: 5076618 - DNA, 23 bp, Homo sapiens
aaaaccaaaagttattaaaattg

SEQ ID NO: 5076619 - DNA, 14 bp, Homo sapiens
aaaaccaaaatgac

SEQ ID NO: 5076620 - DNA, 16 bp, Homo sapiens
aaaaccaacaatgtga

SEQ ID NO: 5076621 - DNA, 12 bp, Homo sapiens
aaaaccaacagg

SEQ ID NO: 5076622 - DNA, 14 bp, Homo sapiens
aaaaccaagaagat

SEQ ID NO: 5076623 - DNA, 19 bp, Homo sapiens
aaaaccaagccgtggcttc

SEQ ID NO: 5076624 - DNA, 21 bp, Homo sapiens
aaaaccaatgttctctcttct

SEQ ID NO: 5076625 - DNA, 21 bp, Homo sapiens
aaaaccacaaaggccaaactg

SEQ ID NO: 5076626 - DNA, 16 bp, Homo sapiens
aaaaccacagaacagt

SEQ ID NO: 5076627 - DNA, 11 bp, Homo sapiens
aaaaccacagc

SEQ ID NO: 5076628 - DNA, 14 bp, Homo sapiens
aaaaccacagcagt

SEQ ID NO: 5076629 - DNA, 17 bp, Homo sapiens
aaaaccacccaagatga

SEQ ID NO: 5076630 - DNA, 16 bp, Homo sapiens
aaaaccactagaactc

SEQ ID NO: 5076631 - DNA, 17 bp, Homo sapiens
aaaaccagaatcataat

SEQ ID NO: 5076632 - DNA, 19 bp, Homo sapiens
aaaaccagaatcataattt

SEQ ID NO: 5076633 - DNA, 13 bp, Homo sapiens
aaaaccagctgct

SEQ ID NO: 5076634 - DNA, 21 bp, Homo sapiens
aaaaccagtgaagtgccacat

SEQ ID NO: 5076635 - DNA, 16 bp, Homo sapiens
aaaaccataaacattt

SEQ ID NO: 5076636 - DNA, 18 bp, Homo sapiens
aaaaccatctggcctggc

SEQ ID NO: 5076637 - DNA, 21 bp, Homo sapiens
aaaaccatcttctgtgtttat

SEQ ID NO: 5076638 - DNA, 17 bp, Homo sapiens
aaaaccatgtagtttta

SEQ ID NO: 5076639 - DNA, 19 bp, Homo sapiens
aaaaccattacaaaatctt

SEQ ID NO: 5076640 - DNA, 24 bp, Homo sapiens
aaaaccattatttaataagagtaa

SEQ ID NO: 5076641 - DNA, 17 bp, Homo sapiens
aaaaccattctgcttgg

SEQ ID NO: 5076642 - DNA, 15 bp, Homo sapiens
aaaaccattttagtt

SEQ ID NO: 5076643 - DNA, 14 bp, Homo sapiens
aaaacccaaacttc

SEQ ID NO: 5076644 - DNA, 17 bp, Homo sapiens
aaaacccaaagctctaa

SEQ ID NO: 5076645 - DNA, 21 bp, Homo sapiens
aaaacccacggtttttctttt

SEQ ID NO: 5076646 - DNA, 15 bp, Homo sapiens
aaaacccagagagga

SEQ ID NO: 5076647 - DNA, 19 bp, Homo sapiens
aaaacccagctgcacccct

SEQ ID NO: 5076648 - DNA, 19 bp, Homo sapiens
aaaaccccacagaaatctc

SEQ ID NO: 5076649 - DNA, 18 bp, Homo sapiens
aaaacccccaataaacct

SEQ ID NO: 5076650 - DNA, 19 bp, Homo sapiens
aaaacccctaaaaacaaaa

SEQ ID NO: 5076651 - DNA, 17 bp, Homo sapiens
aaaacccctaggtcatt

SEQ ID NO: 5076652 - DNA, 22 bp, Homo sapiens
aaaaccctcgatgttcatggaa

SEQ ID NO: 5076653 - DNA, 15 bp, Homo sapiens
aaaaccctgaagcca

SEQ ID NO: 5076654 - DNA, 19 bp, Homo sapiens
aaaacccttgggccagaag

SEQ ID NO: 5076655 - DNA, 18 bp, Homo sapiens
aaaaccggcaacctgtaa

SEQ ID NO: 5076656 - DNA, 23 bp, Homo sapiens
aaaaccgtgtttgtctcttctgg

SEQ ID NO: 5076657 - DNA, 13 bp, Homo sapiens
aaaacctaaaggt

SEQ ID NO: 5076658 - DNA, 18 bp, Homo sapiens
aaaacctaagcaaactta

SEQ ID NO: 5076659 - DNA, 21 bp, Homo sapiens
aaaacctaagtcctttatgtg

SEQ ID NO: 5076660 - DNA, 17 bp, Homo sapiens
aaaacctagaaatttat

SEQ ID NO: 5076661 - DNA, 21 bp, Homo sapiens
aaaacctagtacattactaaa

SEQ ID NO: 5076662 - DNA, 13 bp, Homo sapiens
aaaacctcagcta

SEQ ID NO: 5076663 - DNA, 20 bp, Homo sapiens
aaaacctcagctagctctgc

SEQ ID NO: 5076664 - DNA, 22 bp, Homo sapiens
aaaacctcagttaaactgtgaa

SEQ ID NO: 5076665 - DNA, 18 bp, Homo sapiens
aaaacctgagatttatta

SEQ ID NO: 5076666 - DNA, 15 bp, Homo sapiens
aaaacctgcagttaa

SEQ ID NO: 5076667 - DNA, 14 bp, Homo sapiens
aaaacctgtcaatg

SEQ ID NO: 5076668 - DNA, 15 bp, Homo sapiens
aaaacctgtttttaa

SEQ ID NO: 5076669 - DNA, 19 bp, Homo sapiens
aaaaccttaaaagtaataa

SEQ ID NO: 5076670 - DNA, 23 bp, Homo sapiens
aaaaccttaaaagtaataaagag

SEQ ID NO: 5076671 - DNA, 23 bp, Homo sapiens
aaaaccttagctccctcccgcac

SEQ ID NO: 5076672 - DNA, 19 bp, Homo sapiens
aaaaccttagtcatcagat

SEQ ID NO: 5076673 - DNA, 22 bp, Homo sapiens
aaaaccttccatgtcaagattc

SEQ ID NO: 5076674 - DNA, 13 bp, Homo sapiens
aaaaccttgattt

SEQ ID NO: 5076675 - DNA, 21 bp, Homo sapiens
aaaacgaagtctttttcattt

SEQ ID NO: 5076676 - DNA, 20 bp, Homo sapiens
aaaacgaatcccctaaacaa

SEQ ID NO: 5076677 - DNA, 15 bp, Homo sapiens
aaaacgatttaattt

SEQ ID NO: 5076678 - DNA, 17 bp, Homo sapiens
aaaacgatttaatttat

SEQ ID NO: 5076679 - DNA, 17 bp, Homo sapiens
aaaacgcaaagggctga

SEQ ID NO: 5076680 - DNA, 20 bp, Homo sapiens
aaaacgcaccaatcagcact

SEQ ID NO: 5076681 - DNA, 14 bp, Homo sapiens
aaaacgcatggagt

SEQ ID NO: 5076682 - DNA, 18 bp, Homo sapiens
aaaacgcatggagtgtgt

SEQ ID NO: 5076683 - DNA, 23 bp, Homo sapiens
aaaacgccctcaagaacatgatg

SEQ ID NO: 5076684 - DNA, 23 bp, Homo sapiens
aaaacgcctcttttccctctcta

SEQ ID NO: 5076685 - DNA, 14 bp, Homo sapiens
aaaacgcgcagatg

SEQ ID NO: 5076686 - DNA, 21 bp, Homo sapiens
aaaacgcgcagatgtgcagca

SEQ ID NO: 5076687 - DNA, 19 bp, Homo sapiens
aaaacgctgtcaaaagttg

SEQ ID NO: 5076688 - DNA, 18 bp, Homo sapiens
aaaacgggttactaagat

SEQ ID NO: 5076689 - DNA, 18 bp, Homo sapiens
aaaacggttaaaactgtc

SEQ ID NO: 5076690 - DNA, 16 bp, Homo sapiens
aaaacgtggctgcttc

SEQ ID NO: 5076691 - DNA, 21 bp, Homo sapiens
aaaacgtggctgcttcaagga

SEQ ID NO: 5076692 - DNA, 13 bp, Homo sapiens
aaaacgtgggtat

SEQ ID NO: 5076693 - DNA, 21 bp, Homo sapiens
aaaacgttttatgtgaatgtg

SEQ ID NO: 5076694 - DNA, 23 bp, Homo sapiens
aaaacgttttgtttgaaaaagca

SEQ ID NO: 5076695 - DNA, 13 bp, Homo sapiens
aaaactaaaaact

SEQ ID NO: 5076696 - DNA, 16 bp, Homo sapiens
aaaactaaaaactaga

SEQ ID NO: 5076697 - DNA, 16 bp, Homo sapiens
aaaactaaagcagttt

SEQ ID NO: 5076698 - DNA, 18 bp, Homo sapiens
aaaactaaagttgaaaat

SEQ ID NO: 5076699 - DNA, 18 bp, Homo sapiens
aaactttctccatttaag

SEQ ID NO: 5076700 - DNA, 17 bp, Homo sapiens
aaactttctctttgcca

SEQ ID NO: 5076701 - DNA, 21 bp, Homo sapiens
aaactttctctttgccatttc

SEQ ID NO: 5076702 - DNA, 15 bp, Homo sapiens
aaactttcttaatat

SEQ ID NO: 5076703 - DNA, 18 bp, Homo sapiens
aaactttgaaaaagatat

SEQ ID NO: 5076704 - DNA, 13 bp, Homo sapiens
aaactttgaaata

SEQ ID NO: 5076705 - DNA, 16 bp, Homo sapiens
aaactttgaagttagc

SEQ ID NO: 5076706 - DNA, 15 bp, Homo sapiens
aaactttgaataaaa

SEQ ID NO: 5076707 - DNA, 18 bp, Homo sapiens
aaactttgaataaaagaa

SEQ ID NO: 5076708 - DNA, 22 bp, Homo sapiens
aaactttgagatctaaaaataa

SEQ ID NO: 5076709 - DNA, 20 bp, Homo sapiens
aaactttgaggataactttt

SEQ ID NO: 5076710 - DNA, 22 bp, Homo sapiens
aaactttgaggataacttttta

SEQ ID NO: 5076711 - DNA, 15 bp, Homo sapiens
aaactttgattcttt

SEQ ID NO: 5076712 - DNA, 22 bp, Homo sapiens
aaactttgcttctccaaataca

SEQ ID NO: 5076713 - DNA, 22 bp, Homo sapiens
aaactttgctttgggtttgtgg

SEQ ID NO: 5076714 - DNA, 22 bp, Homo sapiens
aaactttggaagttttacttga

SEQ ID NO: 5076715 - DNA, 19 bp, Homo sapiens
aaactttgggaaaaggtgt

SEQ ID NO: 5076716 - DNA, 18 bp, Homo sapiens
aaactttggtgcattgtt

SEQ ID NO: 5076717 - DNA, 11 bp, Homo sapiens
aaactttgtca

SEQ ID NO: 5076718 - DNA, 12 bp, Homo sapiens
aaactttgtcac

SEQ ID NO: 5076719 - DNA, 22 bp, Homo sapiens
aaactttgtgtataagttgtat

SEQ ID NO: 5076720 - DNA, 19 bp, Homo sapiens
aaacttttaagatttctct

SEQ ID NO: 5076721 - DNA, 20 bp, Homo sapiens
aaacttttaagatttctcta

SEQ ID NO: 5076722 - DNA, 23 bp, Homo sapiens
aaacttttacatttttctgatgg

SEQ ID NO: 5076723 - DNA, 14 bp, Homo sapiens
aaacttttataaat

SEQ ID NO: 5076724 - DNA, 16 bp, Homo sapiens
aaacttttataaatta

SEQ ID NO: 5076725 - DNA, 17 bp, Homo sapiens
aaacttttataaattaa

SEQ ID NO: 5076726 - DNA, 18 bp, Homo sapiens
aaacttttataaattaaa

SEQ ID NO: 5076727 - DNA, 12 bp, Homo sapiens
aaacttttatgc

SEQ ID NO: 5076728 - DNA, 18 bp, Homo sapiens
aaacttttatgcgcaaat

SEQ ID NO: 5076729 - DNA, 18 bp, Homo sapiens
aaacttttcaaggcttat

SEQ ID NO: 5076730 - DNA, 12 bp, Homo sapiens
aaacttttctga

SEQ ID NO: 5076731 - DNA, 13 bp, Homo sapiens
aaacttttggcaa

SEQ ID NO: 5076732 - DNA, 22 bp, Homo sapiens
aaactttttaatggcaataatg

SEQ ID NO: 5076733 - DNA, 15 bp, Homo sapiens
aaactttttcaatgg

SEQ ID NO: 5076734 - DNA, 17 bp, Homo sapiens
aaactttttccagcaaa

SEQ ID NO: 5076735 - DNA, 20 bp, Homo sapiens
aaactttttccagcaaaatg

SEQ ID NO: 5076736 - DNA, 23 bp, Homo sapiens
aaactttttccagcaaaatggaa

SEQ ID NO: 5076737 - DNA, 16 bp, Homo sapiens
aaacttttttatatct

SEQ ID NO: 5076738 - DNA, 17 bp, Homo sapiens
aaacttttttatatctt

SEQ ID NO: 5076739 - DNA, 18 bp, Homo sapiens
aaacttttttatatcttt

SEQ ID NO: 5076740 - DNA, 20 bp, Homo sapiens
aaacttttttatatcttttg

SEQ ID NO: 5076741 - DNA, 24 bp, Homo sapiens
aaacttttttgaaataataaatct

SEQ ID NO: 5076742 - DNA, 18 bp, Homo sapiens
aaactttttttcaatgtg

SEQ ID NO: 5076743 - DNA, 19 bp, Homo sapiens
aaactttttttctgtacca

SEQ ID NO: 5076744 - DNA, 10 bp, Homo sapiens
aaagaaaaaa

SEQ ID NO: 5076745 - DNA, 18 bp, Homo sapiens
aaagaaaaaaaagaaagc

SEQ ID NO: 5076746 - DNA, 19 bp, Homo sapiens
aaagaaaaaaaaggcagta

SEQ ID NO: 5076747 - DNA, 13 bp, Homo sapiens
aaagaaaaaaaat

SEQ ID NO: 5076748 - DNA, 17 bp, Homo sapiens
aaagaaaaaaaccaaag

SEQ ID NO: 5076749 - DNA, 18 bp, Homo sapiens
aaagaaaaaaatgtattt

SEQ ID NO: 5076750 - DNA, 15 bp, Homo sapiens
aaagaaaaaaatgtc

SEQ ID NO: 5076751 - DNA, 18 bp, Homo sapiens
aaagaaaaaaattgaaat

SEQ ID NO: 5076752 - DNA, 21 bp, Homo sapiens
aaagaaaaaaattgaaatgta

SEQ ID NO: 5076753 - DNA, 19 bp, Homo sapiens
aaagaaaaaagtccttcag

SEQ ID NO: 5076754 - DNA, 13 bp, Homo sapiens
aaagaaaaaatca

SEQ ID NO: 5076755 - DNA, 17 bp, Homo sapiens
aaagaaaaaattttatt

SEQ ID NO: 5076756 - DNA, 14 bp, Homo sapiens
aaagaaaaacattt

SEQ ID NO: 5076757 - DNA, 14 bp, Homo sapiens
aaagaaaacaaaac

SEQ ID NO: 5076758 - DNA, 13 bp, Homo sapiens
aaagaaaacacac

SEQ ID NO: 5076759 - DNA, 17 bp, Homo sapiens
aaagaaaacattccaga

SEQ ID NO: 5076760 - DNA, 15 bp, Homo sapiens
aaagaaaacatttaa

SEQ ID NO: 5076761 - DNA, 13 bp, Homo sapiens
aaagaaaaccatt

SEQ ID NO: 5076762 - DNA, 16 bp, Homo sapiens
aaagaaaaccatttta

SEQ ID NO: 5076763 - DNA, 9 bp, Homo sapiens
aaagaaaag

SEQ ID NO: 5076764 - DNA, 13 bp, Homo sapiens
aaagaaaagatgc

SEQ ID NO: 5076765 - DNA, 14 bp, Homo sapiens
aaagaaaagatgca

SEQ ID NO: 5076766 - DNA, 15 bp, Homo sapiens
aaagaaaagatgcac

SEQ ID NO: 5076767 - DNA, 17 bp, Homo sapiens
aaagaaaagatgcactt

SEQ ID NO: 5076768 - DNA, 20 bp, Homo sapiens
aaagaaaagatgcactttgc

SEQ ID NO: 5076769 - DNA, 14 bp, Homo sapiens
aaagaaaagcctca

SEQ ID NO: 5076770 - DNA, 19 bp, Homo sapiens
aaagaaaaggaatgcaaga

SEQ ID NO: 5076771 - DNA, 13 bp, Homo sapiens
aaagaaaaggatt

SEQ ID NO: 5076772 - DNA, 14 bp, Homo sapiens
aaagaaaatatgca

SEQ ID NO: 5076773 - DNA, 15 bp, Homo sapiens
aaagaaaatatgcat

SEQ ID NO: 5076774 - DNA, 17 bp, Homo sapiens
aaagaaaatatgcatct

SEQ ID NO: 5076775 - DNA, 12 bp, Homo sapiens
aaagaaaatcaa

SEQ ID NO: 5076776 - DNA, 13 bp, Homo sapiens
aaagaaaatgaaa

SEQ ID NO: 5076777 - DNA, 18 bp, Homo sapiens
aaagaaaatgatacagca

SEQ ID NO: 5076778 - DNA, 16 bp, Homo sapiens
aaagaaaatggaaaga

SEQ ID NO: 5076779 - DNA, 21 bp, Homo sapiens
aaagaaaatggaaagaaggaa

SEQ ID NO: 5076780 - DNA, 13 bp, Homo sapiens
aaagaaaatggct

SEQ ID NO: 5076781 - DNA, 13 bp, Homo sapiens
aaagaaaattaca

SEQ ID NO: 5076782 - DNA, 13 bp, Homo sapiens
aaagaaaattata

SEQ ID NO: 5076783 - DNA, 13 bp, Homo sapiens
aaagaaaattctc

SEQ ID NO: 5076784 - DNA, 13 bp, Homo sapiens
aaagaaaattgca

SEQ ID NO: 5076785 - DNA, 21 bp, Homo sapiens
aaagaaaattgcatgaaacta

SEQ ID NO: 5076786 - DNA, 13 bp, Homo sapiens
aaagaaaattgcc

SEQ ID NO: 5076787 - DNA, 14 bp, Homo sapiens
aaagaaaattgcca

SEQ ID NO: 5076788 - DNA, 19 bp, Homo sapiens
aaagaaaattgccaaaata

SEQ ID NO: 5076789 - DNA, 23 bp, Homo sapiens
aaagaaaattgccaaaatatatt

SEQ ID NO: 5076790 - DNA, 19 bp, Homo sapiens
aaagaaaattttttttcaa

SEQ ID NO: 5076791 - DNA, 17 bp, Homo sapiens
aaagaaacaagctgtgc

SEQ ID NO: 5076792 - DNA, 18 bp, Homo sapiens
aaagaaacaagctgtgca

SEQ ID NO: 5076793 - DNA, 12 bp, Homo sapiens
aaagaaacacca

SEQ ID NO: 5076794 - DNA, 18 bp, Homo sapiens
aaagaaacaccagtgtta

SEQ ID NO: 5076795 - DNA, 13 bp, Homo sapiens
aaagaaacactaa

SEQ ID NO: 5076796 - DNA, 13 bp, Homo sapiens
aaagaaaccatga

SEQ ID NO: 5076797 - DNA, 20 bp, Homo sapiens
aaagaaaccgtaattttatt

SEQ ID NO: 5076798 - DNA, 22 bp, Homo sapiens
aaagaaaccgtaattttattat

SEQ ID NO: 5076799 - DNA, 16 bp, Homo sapiens
aaagaaactaagattt

SEQ ID NO: 5076800 - DNA, 15 bp, Homo sapiens
aaagaaactgacatg

SEQ ID NO: 5076801 - DNA, 14 bp, Homo sapiens
aaagaaacttgata

SEQ ID NO: 5076802 - DNA, 12 bp, Homo sapiens
aaagaaactttt

SEQ ID NO: 5076803 - DNA, 22 bp, Homo sapiens
aaagaaactttttaataaagta

SEQ ID NO: 5076804 - DNA, 13 bp, Homo sapiens
aaagaaagaaaaa

SEQ ID NO: 5076805 - DNA, 13 bp, Homo sapiens
aaagaaagaaaca

SEQ ID NO: 5076806 - DNA, 12 bp, Homo sapiens
aaagaaagactg

SEQ ID NO: 5076807 - DNA, 12 bp, Homo sapiens
aaagaaagagag

SEQ ID NO: 5076808 - DNA, 18 bp, Homo sapiens
aaagaaagagagaaaata

SEQ ID NO: 5076809 - DNA, 23 bp, Homo sapiens
aaagaaagatactcacatgagtt

SEQ ID NO: 5076810 - DNA, 15 bp, Homo sapiens
aaagaaagattgtaa

SEQ ID NO: 5076811 - DNA, 15 bp, Homo sapiens
aaagaaagattttat

SEQ ID NO: 5076812 - DNA, 14 bp, Homo sapiens
aaagaaagcaactt

SEQ ID NO: 5076813 - DNA, 16 bp, Homo sapiens
aaagaaagcatttgta

SEQ ID NO: 5076814 - DNA, 13 bp, Homo sapiens
aaagaaagctaat

SEQ ID NO: 5076815 - DNA, 14 bp, Homo sapiens
aaagaaagggaccc

SEQ ID NO: 5076816 - DNA, 15 bp, Homo sapiens
aaagaaagggaccca

SEQ ID NO: 5076817 - DNA, 15 bp, Homo sapiens
aaagaaagtacccag

SEQ ID NO: 5076818 - DNA, 12 bp, Homo sapiens
aaagaaagtggt

SEQ ID NO: 5076819 - DNA, 23 bp, Homo sapiens
aaagaaagttaggttataagaaa

SEQ ID NO: 5076820 - DNA, 21 bp, Homo sapiens
aaagaaataaccactgcaagt

SEQ ID NO: 5076821 - DNA, 15 bp, Homo sapiens
aaagaaataataata

SEQ ID NO: 5076822 - DNA, 21 bp, Homo sapiens
aaagaaatacacagggagggg

SEQ ID NO: 5076823 - DNA, 15 bp, Homo sapiens
aaagaaatataccta

SEQ ID NO: 5076824 - DNA, 12 bp, Homo sapiens
aaagaaatatga

SEQ ID NO: 5076825 - DNA, 17 bp, Homo sapiens
aaagaaatcagctttgt

SEQ ID NO: 5076826 - DNA, 14 bp, Homo sapiens
aaagaaatcatgtt

SEQ ID NO: 5076827 - DNA, 16 bp, Homo sapiens
aaagaaatccaaattt

SEQ ID NO: 5076828 - DNA, 23 bp, Homo sapiens
aaagaaatccatatcttaaagaa

SEQ ID NO: 5076829 - DNA, 15 bp, Homo sapiens
aaagaaatctataga

SEQ ID NO: 5076830 - DNA, 21 bp, Homo sapiens
aaagaaatctatagaaagtgt

SEQ ID NO: 5076831 - DNA, 13 bp, Homo sapiens
aaagaaatctgtt

SEQ ID NO: 5076832 - DNA, 15 bp, Homo sapiens
aaagaaatcttgctt

SEQ ID NO: 5076833 - DNA, 13 bp, Homo sapiens
aaagaaatgcaaa

SEQ ID NO: 5076834 - DNA, 14 bp, Homo sapiens
aaagaaatgcaaaa

SEQ ID NO: 5076835 - DNA, 15 bp, Homo sapiens
aaagaaatgcacaat

SEQ ID NO: 5076836 - DNA, 18 bp, Homo sapiens
aaagaaatgggcctgcct

SEQ ID NO: 5076837 - DNA, 15 bp, Homo sapiens
aaagaaatgtaaggg

SEQ ID NO: 5076838 - DNA, 17 bp, Homo sapiens
aaagaaatgtcttaatt

SEQ ID NO: 5076839 - DNA, 14 bp, Homo sapiens
aaagaaattagcct

SEQ ID NO: 5076840 - DNA, 22 bp, Homo sapiens
aaagaaattagggctctaattt

SEQ ID NO: 5076841 - DNA, 21 bp, Homo sapiens
aaagaaattatctttagttga

SEQ ID NO: 5076842 - DNA, 19 bp, Homo sapiens
aaagaaattccctggacca

SEQ ID NO: 5076843 - DNA, 18 bp, Homo sapiens
aaagaaattcgcatgttt

SEQ ID NO: 5076844 - DNA, 19 bp, Homo sapiens
aaagaaattcgcatgttta

SEQ ID NO: 5076845 - DNA, 18 bp, Homo sapiens
aaagaaattgtccttgaa

SEQ ID NO: 5076846 - DNA, 23 bp, Homo sapiens
aaagaaatttccggaagtaaata

SEQ ID NO: 5076847 - DNA, 18 bp, Homo sapiens
aaagaaatttgaaaaaac

SEQ ID NO: 5076848 - DNA, 19 bp, Homo sapiens
aaagaaatttgaaaaaact

SEQ ID NO: 5076849 - DNA, 23 bp, Homo sapiens
aaagaaatttgaaaaaactttct

SEQ ID NO: 5076850 - DNA, 16 bp, Homo sapiens
aaagaacaaaaaaatc

SEQ ID NO: 5076851 - DNA, 14 bp, Homo sapiens
aaagaacaaacaaa

SEQ ID NO: 5076852 - DNA, 15 bp, Homo sapiens
aaagaacagtaaaca

SEQ ID NO: 5076853 - DNA, 15 bp, Homo sapiens
aaagaacatacatga

SEQ ID NO: 5076854 - DNA, 22 bp, Homo sapiens
aaagaacatggacttgtatatt

SEQ ID NO: 5076855 - DNA, 23 bp, Homo sapiens
aaagaaccaacaacctcaactgc

SEQ ID NO: 5076856 - DNA, 24 bp, Homo sapiens
aaagaacccatttgccatgctgct

SEQ ID NO: 5076857 - DNA, 15 bp, Homo sapiens
aaagaaccttgaaga

SEQ ID NO: 5076858 - DNA, 20 bp, Homo sapiens
aaagaacgctgatttaaaga

SEQ ID NO: 5076859 - DNA, 15 bp, Homo sapiens
aaagaacggaagaag

SEQ ID NO: 5076860 - DNA, 19 bp, Homo sapiens
aaagaacggaagaagagat

SEQ ID NO: 5076861 - DNA, 18 bp, Homo sapiens
aaagaactatcttcatct

SEQ ID NO: 5076862 - DNA, 19 bp, Homo sapiens
aaagaacttgatttgcatg

SEQ ID NO: 5076863 - DNA, 16 bp, Homo sapiens
aaagaagaaaataacc

SEQ ID NO: 5076864 - DNA, 13 bp, Homo sapiens
aaagaagaaataa

SEQ ID NO: 5076865 - DNA, 12 bp, Homo sapiens
aaagaagaacag

SEQ ID NO: 5076866 - DNA, 16 bp, Homo sapiens
aaagaagaacagctgt

SEQ ID NO: 5076867 - DNA, 17 bp, Homo sapiens
aaagaagaacttgcatg

SEQ ID NO: 5076868 - DNA, 15 bp, Homo sapiens
aaagaagacacacag

SEQ ID NO: 5076869 - DNA, 18 bp, Homo sapiens
aaagaagacacacagcca

SEQ ID NO: 5076870 - DNA, 15 bp, Homo sapiens
aaagaagacatgttt

SEQ ID NO: 5076871 - DNA, 22 bp, Homo sapiens
aaagaagaccctttgttgaaaa

SEQ ID NO: 5076872 - DNA, 18 bp, Homo sapiens
aaagaagacctgagaatg

SEQ ID NO: 5076873 - DNA, 22 bp, Homo sapiens
aaagaagagaggggaagaattt

SEQ ID NO: 5076874 - DNA, 21 bp, Homo sapiens
aaagaagagccttcacatgaa

SEQ ID NO: 5076875 - DNA, 15 bp, Homo sapiens
aaagaagaggagaaa

SEQ ID NO: 5076876 - DNA, 19 bp, Homo sapiens
aaagaagatagctctctga

SEQ ID NO: 5076877 - DNA, 13 bp, Homo sapiens
aaagaagatgttt

SEQ ID NO: 5076878 - DNA, 15 bp, Homo sapiens
aaagaagatgtttaa

SEQ ID NO: 5076879 - DNA, 13 bp, Homo sapiens
aaagaagcaagac

SEQ ID NO: 5076880 - DNA, 13 bp, Homo sapiens
aaagaagcagacc

SEQ ID NO: 5076881 - DNA, 16 bp, Homo sapiens
aaagaagcccccagct

SEQ ID NO: 5076882 - DNA, 17 bp, Homo sapiens
aaagaagcctagaaaag

SEQ ID NO: 5076883 - DNA, 13 bp, Homo sapiens
aaagaagctgcat

SEQ ID NO: 5076884 - DNA, 18 bp, Homo sapiens
aaagaagctgtcttggaa

SEQ ID NO: 5076885 - DNA, 13 bp, Homo sapiens
aaagaagcttcat

SEQ ID NO: 5076886 - DNA, 12 bp, Homo sapiens
aaagaaggaagt

SEQ ID NO: 5076887 - DNA, 23 bp, Homo sapiens
aaagaaggcatggacttctggat

SEQ ID NO: 5076888 - DNA, 18 bp, Homo sapiens
aaagaaggtatttttcca

SEQ ID NO: 5076889 - DNA, 19 bp, Homo sapiens
aaagaaggtcaaactgtgg

SEQ ID NO: 5076890 - DNA, 16 bp, Homo sapiens
aaagaaggtgctgatc

SEQ ID NO: 5076891 - DNA, 13 bp, Homo sapiens
aaagaagtaaaag

SEQ ID NO: 5076892 - DNA, 15 bp, Homo sapiens
aaagaagtaaaagca

SEQ ID NO: 5076893 - DNA, 20 bp, Homo sapiens
aaagaagtaaatttgtccaa

SEQ ID NO: 5076894 - DNA, 18 bp, Homo sapiens
aaagaagtggggacagag

SEQ ID NO: 5076895 - DNA, 19 bp, Homo sapiens
aaagaagtgtccgagaact

SEQ ID NO: 5076896 - DNA, 21 bp, Homo sapiens
aaagaagtgtccgagaactaa

SEQ ID NO: 5076897 - DNA, 24 bp, Homo sapiens
aaagaagtgtggggattttcactg

SEQ ID NO: 5076898 - DNA, 16 bp, Homo sapiens
aaagaagttactttgt

SEQ ID NO: 5076899 - DNA, 18 bp, Homo sapiens
aaagaagttactttgtaa

SEQ ID NO: 5076900 - DNA, 19 bp, Homo sapiens
aaagaagttactttgtaat

SEQ ID NO: 5076901 - DNA, 15 bp, Homo sapiens
aaagaagtttgatat

SEQ ID NO: 5076902 - DNA, 20 bp, Homo sapiens
aaagaagtttgggctaacat

SEQ ID NO: 5076903 - DNA, 14 bp, Homo sapiens
aaagaataaaatgt

SEQ ID NO: 5076904 - DNA, 20 bp, Homo sapiens
aaagaataaaatgtttctct

SEQ ID NO: 5076905 - DNA, 20 bp, Homo sapiens
aaagaataaataagattgct

SEQ ID NO: 5076906 - DNA, 17 bp, Homo sapiens
aaagaatacagaaagat

SEQ ID NO: 5076907 - DNA, 18 bp, Homo sapiens
aaagaatactatttccaa

SEQ ID NO: 5076908 - DNA, 12 bp, Homo sapiens
aaagaatagaaa

SEQ ID NO: 5076909 - DNA, 14 bp, Homo sapiens
aaagaatagaaaga

SEQ ID NO: 5076910 - DNA, 16 bp, Homo sapiens
aaagaatagaagctaa

SEQ ID NO: 5076911 - DNA, 16 bp, Homo sapiens
aaagaatagtgcctca

SEQ ID NO: 5076912 - DNA, 21 bp, Homo sapiens
aaagaatagtgcctcagcgct

SEQ ID NO: 5076913 - DNA, 20 bp, Homo sapiens
aaagaatatgactttttata

SEQ ID NO: 5076914 - DNA, 15 bp, Homo sapiens
aaagaatattttgat

SEQ ID NO: 5076915 - DNA, 22 bp, Homo sapiens
aaagaatcacctaattaatttc

SEQ ID NO: 5076916 - DNA, 18 bp, Homo sapiens
aaagaatcattatttatt

SEQ ID NO: 5076917 - DNA, 19 bp, Homo sapiens
aaagaatcattatttatta

SEQ ID NO: 5076918 - DNA, 22 bp, Homo sapiens
aaagaatccaagacaaactaaa

SEQ ID NO: 5076919 - DNA, 15 bp, Homo sapiens
aaagaatccctgcag

SEQ ID NO: 5076920 - DNA, 22 bp, Homo sapiens
aaagaatccctgttcattgtaa

SEQ ID NO: 5076921 - DNA, 16 bp, Homo sapiens
aaagaatgaaagagta

SEQ ID NO: 5076922 - DNA, 13 bp, Homo sapiens
aaagaatgagaaa

SEQ ID NO: 5076923 - DNA, 14 bp, Homo sapiens
aaagaatgagaaag

SEQ ID NO: 5076924 - DNA, 14 bp, Homo sapiens
aaagaatgcagaga

SEQ ID NO: 5076925 - DNA, 16 bp, Homo sapiens
aaagaatgcatgttct

SEQ ID NO: 5076926 - DNA, 18 bp, Homo sapiens
aaagaatgccatttctca

SEQ ID NO: 5076927 - DNA, 22 bp, Homo sapiens
aaagaatggctacttttttcta

SEQ ID NO: 5076928 - DNA, 12 bp, Homo sapiens
aaagaatgggca

SEQ ID NO: 5076929 - DNA, 13 bp, Homo sapiens
aaagaatgttact

SEQ ID NO: 5076930 - DNA, 18 bp, Homo sapiens
aaagaatgttactgcctt

SEQ ID NO: 5076931 - DNA, 12 bp, Homo sapiens
aaagaatgttag

SEQ ID NO: 5076932 - DNA, 17 bp, Homo sapiens
aaagaatgttagagcac

SEQ ID NO: 5076933 - DNA, 20 bp, Homo sapiens
aaagaattacttgtgttact

SEQ ID NO: 5076934 - DNA, 16 bp, Homo sapiens
aaagaattatttgcct

SEQ ID NO: 5076935 - DNA, 21 bp, Homo sapiens
aaagaattcctgaagccagat

SEQ ID NO: 5076936 - DNA, 21 bp, Homo sapiens
aaagaattctattttgctgga

SEQ ID NO: 5076937 - DNA, 19 bp, Homo sapiens
aaagaattctggtcctgtt

SEQ ID NO: 5076938 - DNA, 19 bp, Homo sapiens
aaagaattcttatacacat

SEQ ID NO: 5076939 - DNA, 14 bp, Homo sapiens
aaagaatttagtat

SEQ ID NO: 5076940 - DNA, 21 bp, Homo sapiens
aaagaatttcaatttgttcag

SEQ ID NO: 5076941 - DNA, 12 bp, Homo sapiens
aaagaatttgta

SEQ ID NO: 5076942 - DNA, 13 bp, Homo sapiens
aaagaattttcat

SEQ ID NO: 5076943 - DNA, 12 bp, Homo sapiens
aaagaatttttg

SEQ ID NO: 5076944 - DNA, 20 bp, Homo sapiens
aaagaatttttgtttggact

SEQ ID NO: 5076945 - DNA, 19 bp, Homo sapiens
aaagacaaaaatcaaagaa

SEQ ID NO: 5076946 - DNA, 13 bp, Homo sapiens
aaagacaaaagaa

SEQ ID NO: 5076947 - DNA, 14 bp, Homo sapiens
aaagacaaaagaaa

SEQ ID NO: 5076948 - DNA, 17 bp, Homo sapiens
aaagacaaaagaaactt

SEQ ID NO: 5076949 - DNA, 14 bp, Homo sapiens
aaagacaaaatgtg

SEQ ID NO: 5076950 - DNA, 17 bp, Homo sapiens
aaagacaaagtgtgtaa

SEQ ID NO: 5076951 - DNA, 11 bp, Homo sapiens
aaagacaaata

SEQ ID NO: 5076952 - DNA, 18 bp, Homo sapiens
aaagacaaatagtaggca

SEQ ID NO: 5076953 - DNA, 13 bp, Homo sapiens
aaagacaaatttt

SEQ ID NO: 5076954 - DNA, 15 bp, Homo sapiens
aaagacaaattttgc

SEQ ID NO: 5076955 - DNA, 18 bp, Homo sapiens
aaagacaacaaaagaaat

SEQ ID NO: 5076956 - DNA, 14 bp, Homo sapiens
aaagacaagtacat

SEQ ID NO: 5076957 - DNA, 14 bp, Homo sapiens
aaagacaatcactg

SEQ ID NO: 5076958 - DNA, 20 bp, Homo sapiens
aaagacaatcactgaaacaa

SEQ ID NO: 5076959 - DNA, 17 bp, Homo sapiens
aaagacaatcactgcca

SEQ ID NO: 5076960 - DNA, 20 bp, Homo sapiens
aaagacaattctttatacaa

SEQ ID NO: 5076961 - DNA, 22 bp, Homo sapiens
aaagacacattttttaggaaat

SEQ ID NO: 5076962 - DNA, 17 bp, Homo sapiens
aaagacaccatttatct

SEQ ID NO: 5076963 - DNA, 19 bp, Homo sapiens
aaagacactgcctgggctg

SEQ ID NO: 5076964 - DNA, 15 bp, Homo sapiens
aaagacactggcaga

SEQ ID NO: 5076965 - DNA, 19 bp, Homo sapiens
aaagacactggcagagaga

SEQ ID NO: 5076966 - DNA, 22 bp, Homo sapiens
aaagacactggtgtatctcaga

SEQ ID NO: 5076967 - DNA, 13 bp, Homo sapiens
aaagacacttcaa

SEQ ID NO: 5076968 - DNA, 12 bp, Homo sapiens
aaagacagaatg

SEQ ID NO: 5076969 - DNA, 21 bp, Homo sapiens
aaagacagaatggtggagtgt

SEQ ID NO: 5076970 - DNA, 14 bp, Homo sapiens
aaagacagagctgg

SEQ ID NO: 5076971 - DNA, 22 bp, Homo sapiens
aaagacagcagacaaaatgaaa

SEQ ID NO: 5076972 - DNA, 18 bp, Homo sapiens
aaagacagcgataagctt

SEQ ID NO: 5076973 - DNA, 16 bp, Homo sapiens
aaagacagctgacaga

SEQ ID NO: 5076974 - DNA, 17 bp, Homo sapiens
aaagacagctggcggag

SEQ ID NO: 5076975 - DNA, 14 bp, Homo sapiens
aaagacaggaagac

SEQ ID NO: 5076976 - DNA, 13 bp, Homo sapiens
aaagacaggctga

SEQ ID NO: 5076977 - DNA, 16 bp, Homo sapiens
aaagacagggtgggag

SEQ ID NO: 5076978 - DNA, 20 bp, Homo sapiens
aaagacagggtgggagggag

SEQ ID NO: 5076979 - DNA, 23 bp, Homo sapiens
aaagacagggtgggagggaggag

SEQ ID NO: 5076980 - DNA, 22 bp, Homo sapiens
aaagacagtgactgtacagtta

SEQ ID NO: 5076981 - DNA, 20 bp, Homo sapiens
aaagacagtggatcatgaaa

SEQ ID NO: 5076982 - DNA, 14 bp, Homo sapiens
aaagacataaaaca

SEQ ID NO: 5076983 - DNA, 16 bp, Homo sapiens
aaagacataaaacaga

SEQ ID NO: 5076984 - DNA, 18 bp, Homo sapiens
aaagacataaaacagaat

SEQ ID NO: 5076985 - DNA, 13 bp, Homo sapiens
aaagacatcaatg

SEQ ID NO: 5076986 - DNA, 13 bp, Homo sapiens
aaagacatccaca

SEQ ID NO: 5076987 - DNA, 16 bp, Homo sapiens
aaagacatctgcctgt

SEQ ID NO: 5076988 - DNA, 17 bp, Homo sapiens
aaagacatggaaggtta

SEQ ID NO: 5076989 - DNA, 14 bp, Homo sapiens
aaagacattagaga

SEQ ID NO: 5076990 - DNA, 18 bp, Homo sapiens
aaagacattatttctcat

SEQ ID NO: 5076991 - DNA, 19 bp, Homo sapiens
aaagacattctgacatctt

SEQ ID NO: 5076992 - DNA, 16 bp, Homo sapiens
aaagacattcttagtt

SEQ ID NO: 5076993 - DNA, 14 bp, Homo sapiens
aaagacattcttcc

SEQ ID NO: 5076994 - DNA, 17 bp, Homo sapiens
aaagacattgaaagctc

SEQ ID NO: 5076995 - DNA, 12 bp, Homo sapiens
aaagacattgac

SEQ ID NO: 5076996 - DNA, 18 bp, Homo sapiens
aaagacattgacagcaat

SEQ ID NO: 5076997 - DNA, 22 bp, Homo sapiens
aaagacattgtttttaaaaaaa

SEQ ID NO: 5076998 - DNA, 15 bp, Homo sapiens
aaagacatttaaaat

SEQ ID NO: 5076999 - DNA, 16 bp, Homo sapiens
aaagacatttaaaata

SEQ ID NO: 5077000 - DNA, 23 bp, Homo sapiens
aaagacatttaaaatagttttct

SEQ ID NO: 5077001 - DNA, 13 bp, Homo sapiens
aaagacatttcat

SEQ ID NO: 5077002 - DNA, 23 bp, Homo sapiens
aaagacattttaagtttgtagta

SEQ ID NO: 5077003 - DNA, 15 bp, Homo sapiens
aaagaccaaaatgaa

SEQ ID NO: 5077004 - DNA, 13 bp, Homo sapiens
aaagaccaaactt

SEQ ID NO: 5077005 - DNA, 14 bp, Homo sapiens
aaagaccagaaatt

SEQ ID NO: 5077006 - DNA, 23 bp, Homo sapiens
aaagaccatgcattcagatctga

SEQ ID NO: 5077007 - DNA, 21 bp, Homo sapiens
aaagaccatgcatttaaagta

SEQ ID NO: 5077008 - DNA, 12 bp, Homo sapiens
aaagaccattta

SEQ ID NO: 5077009 - DNA, 13 bp, Homo sapiens
aaagaccatttaa

SEQ ID NO: 5077010 - DNA, 15 bp, Homo sapiens
aaagaccatttttcc

SEQ ID NO: 5077011 - DNA, 16 bp, Homo sapiens
aaagacccgggagctg

SEQ ID NO: 5077012 - DNA, 20 bp, Homo sapiens
aaagaccctgatgcaggtca

SEQ ID NO: 5077013 - DNA, 19 bp, Homo sapiens
aaagacctccacttgctta

SEQ ID NO: 5077014 - DNA, 14 bp, Homo sapiens
aaagacctggcctt

SEQ ID NO: 5077015 - DNA, 18 bp, Homo sapiens
aaagacctgtgaggggaa

SEQ ID NO: 5077016 - DNA, 13 bp, Homo sapiens
aaagaccttctcc

SEQ ID NO: 5077017 - DNA, 23 bp, Homo sapiens
aaagacgaccagcatttaaccaa

SEQ ID NO: 5077018 - DNA, 15 bp, Homo sapiens
aaagacgatgtttat

SEQ ID NO: 5077019 - DNA, 23 bp, Homo sapiens
aaagacgcactttggcttataat

SEQ ID NO: 5077020 - DNA, 22 bp, Homo sapiens
aaagacgctaataaaaatttat

SEQ ID NO: 5077021 - DNA, 14 bp, Homo sapiens
aaagacggattcta

SEQ ID NO: 5077022 - DNA, 20 bp, Homo sapiens
aaagacgtaataaaattaac

SEQ ID NO: 5077023 - DNA, 20 bp, Homo sapiens
aaagacgttttataagcatc

SEQ ID NO: 5077024 - DNA, 23 bp, Homo sapiens
aaagactagagcaaaataatgca

SEQ ID NO: 5077025 - DNA, 18 bp, Homo sapiens
aaagactagccagccagg

SEQ ID NO: 5077026 - DNA, 17 bp, Homo sapiens
aaagactatctaaatgt

SEQ ID NO: 5077027 - DNA, 17 bp, Homo sapiens
aaagactattcaaacag

SEQ ID NO: 5077028 - DNA, 19 bp, Homo sapiens
aaagactatttcaaaatgt

SEQ ID NO: 5077029 - DNA, 18 bp, Homo sapiens
aaagactcagccaagaca

SEQ ID NO: 5077030 - DNA, 10 bp, Homo sapiens
aaagactcca

SEQ ID NO: 5077031 - DNA, 13 bp, Homo sapiens
aaagactccaaag

SEQ ID NO: 5077032 - DNA, 20 bp, Homo sapiens
aaagactccagtactatttt

SEQ ID NO: 5077033 - DNA, 17 bp, Homo sapiens
aaagactctattctcaa

SEQ ID NO: 5077034 - DNA, 11 bp, Homo sapiens
aaagactctga

SEQ ID NO: 5077035 - DNA, 20 bp, Homo sapiens
aaagactgaaagaatacatt

SEQ ID NO: 5077036 - DNA, 14 bp, Homo sapiens
aaagactgaacatg

SEQ ID NO: 5077037 - DNA, 15 bp, Homo sapiens
aaagactgaacatgt

SEQ ID NO: 5077038 - DNA, 17 bp, Homo sapiens
aaagactgaacatgttt

SEQ ID NO: 5077039 - DNA, 19 bp, Homo sapiens
aaagactgaccaatattgt

SEQ ID NO: 5077040 - DNA, 16 bp, Homo sapiens
aaagactgagcagaac

SEQ ID NO: 5077041 - DNA, 16 bp, Homo sapiens
aaagactgagctcaag

SEQ ID NO: 5077042 - DNA, 12 bp, Homo sapiens
aaagactgcaga

SEQ ID NO: 5077043 - DNA, 15 bp, Homo sapiens
aaagactgcagaacc

SEQ ID NO: 5077044 - DNA, 13 bp, Homo sapiens
aaagactgcagct

SEQ ID NO: 5077045 - DNA, 16 bp, Homo sapiens
aaagactgcagctgct

SEQ ID NO: 5077046 - DNA, 15 bp, Homo sapiens
aaagactggttttct

SEQ ID NO: 5077047 - DNA, 17 bp, Homo sapiens
aaagactggttttctgc

SEQ ID NO: 5077048 - DNA, 13 bp, Homo sapiens
aaagactgtacaa

SEQ ID NO: 5077049 - DNA, 12 bp, Homo sapiens
aaagactgtact

SEQ ID NO: 5077050 - DNA, 18 bp, Homo sapiens
aaagactgtcaaatgaac

SEQ ID NO: 5077051 - DNA, 20 bp, Homo sapiens
aaagactgtcaaatgaactt

SEQ ID NO: 5077052 - DNA, 21 bp, Homo sapiens
aaagactgtcaaatgaacttt

SEQ ID NO: 5077053 - DNA, 23 bp, Homo sapiens
aaagactgtcaaatgaactttta

SEQ ID NO: 5077054 - DNA, 18 bp, Homo sapiens
aaagactgtgaacagctt

SEQ ID NO: 5077055 - DNA, 17 bp, Homo sapiens
aaagactgtgctgagaa

SEQ ID NO: 5077056 - DNA, 15 bp, Homo sapiens
aaagacttaagatta

SEQ ID NO: 5077057 - DNA, 14 bp, Homo sapiens
aaagacttaatcat

SEQ ID NO: 5077058 - DNA, 15 bp, Homo sapiens
aaagacttcatgttc

SEQ ID NO: 5077059 - DNA, 15 bp, Homo sapiens
aaagacttcatttaa

SEQ ID NO: 5077060 - DNA, 23 bp, Homo sapiens
aaagacttctctacccatcttaa

SEQ ID NO: 5077061 - DNA, 13 bp, Homo sapiens
aaagacttgagaa

SEQ ID NO: 5077062 - DNA, 21 bp, Homo sapiens
aaaactaaagttgaaaataca

SEQ ID NO: 5077063 - DNA, 17 bp, Homo sapiens
aaaactaaatatatgtc

SEQ ID NO: 5077064 - DNA, 14 bp, Homo sapiens
aaaactaaatttca

SEQ ID NO: 5077065 - DNA, 20 bp, Homo sapiens
aaaactaagctctttgagaa

SEQ ID NO: 5077066 - DNA, 20 bp, Homo sapiens
aaaactaaggatttttcaag

SEQ ID NO: 5077067 - DNA, 16 bp, Homo sapiens
aaaactaatgtactgt

SEQ ID NO: 5077068 - DNA, 13 bp, Homo sapiens
aaaactaatgtgt

SEQ ID NO: 5077069 - DNA, 23 bp, Homo sapiens
aaaactacaaacgtttgacaaac

SEQ ID NO: 5077070 - DNA, 14 bp, Homo sapiens
aaaactacatgtaa

SEQ ID NO: 5077071 - DNA, 15 bp, Homo sapiens
aaaactacattttaa

SEQ ID NO: 5077072 - DNA, 15 bp, Homo sapiens
aaaactactgaataa

SEQ ID NO: 5077073 - DNA, 22 bp, Homo sapiens
aaaactactgaataaatcatgt

SEQ ID NO: 5077074 - DNA, 14 bp, Homo sapiens
aaaactactgcctt

SEQ ID NO: 5077075 - DNA, 14 bp, Homo sapiens
aaaactacttagca

SEQ ID NO: 5077076 - DNA, 14 bp, Homo sapiens
aaaactagataact

SEQ ID NO: 5077077 - DNA, 17 bp, Homo sapiens
aaaactagcaactctta

SEQ ID NO: 5077078 - DNA, 13 bp, Homo sapiens
aaaactagcatta

SEQ ID NO: 5077079 - DNA, 21 bp, Homo sapiens
aaaactaggcatttgtaaata

SEQ ID NO: 5077080 - DNA, 22 bp, Homo sapiens
aaaactaggtaatgttttgtat

SEQ ID NO: 5077081 - DNA, 15 bp, Homo sapiens
aaaactagtagttct

SEQ ID NO: 5077082 - DNA, 23 bp, Homo sapiens
aaaactataaaaaagaaagaatt

SEQ ID NO: 5077083 - DNA, 21 bp, Homo sapiens
aaaactataaatacaaatctg

SEQ ID NO: 5077084 - DNA, 14 bp, Homo sapiens
aaaactataacatt

SEQ ID NO: 5077085 - DNA, 19 bp, Homo sapiens
aaaactataacattatata

SEQ ID NO: 5077086 - DNA, 19 bp, Homo sapiens
aaaactatatgtatggttt

SEQ ID NO: 5077087 - DNA, 16 bp, Homo sapiens
aaaactatcaactaca

SEQ ID NO: 5077088 - DNA, 17 bp, Homo sapiens
aaaactatccaattaaa

SEQ ID NO: 5077089 - DNA, 19 bp, Homo sapiens
aaaactatcctatgccttc

SEQ ID NO: 5077090 - DNA, 17 bp, Homo sapiens
aaaactatgcaagagaa

SEQ ID NO: 5077091 - DNA, 17 bp, Homo sapiens
aaaactatggttcccaa

SEQ ID NO: 5077092 - DNA, 15 bp, Homo sapiens
aaaactatgtattaa

SEQ ID NO: 5077093 - DNA, 22 bp, Homo sapiens
aaaactatgtgctatcacatgt

SEQ ID NO: 5077094 - DNA, 13 bp, Homo sapiens
aaaactatgtgtt

SEQ ID NO: 5077095 - DNA, 20 bp, Homo sapiens
aaaactattcatgctaccca

SEQ ID NO: 5077096 - DNA, 13 bp, Homo sapiens
aaaactatttaaa

SEQ ID NO: 5077097 - DNA, 21 bp, Homo sapiens
aaaactatttagtgttagtta

SEQ ID NO: 5077098 - DNA, 19 bp, Homo sapiens
aaaactatttattgtgctg

SEQ ID NO: 5077099 - DNA, 23 bp, Homo sapiens
aaaactcaagcaagatgagctgt

SEQ ID NO: 5077100 - DNA, 18 bp, Homo sapiens
aaaactcatcacataaag

SEQ ID NO: 5077101 - DNA, 17 bp, Homo sapiens
aaaactcatgatcaaga

SEQ ID NO: 5077102 - DNA, 17 bp, Homo sapiens
aaaactccactcagcac

SEQ ID NO: 5077103 - DNA, 20 bp, Homo sapiens
aaaactcccaatacaaagat

SEQ ID NO: 5077104 - DNA, 14 bp, Homo sapiens
aaaactcctgtgtc

SEQ ID NO: 5077105 - DNA, 22 bp, Homo sapiens
aaaactcgaggactgtatttgt

SEQ ID NO: 5077106 - DNA, 18 bp, Homo sapiens
aaaactctacttaatcca

SEQ ID NO: 5077107 - DNA, 19 bp, Homo sapiens
aaaactctatcaaatgtga

SEQ ID NO: 5077108 - DNA, 18 bp, Homo sapiens
aaaactctcctctgctgc

SEQ ID NO: 5077109 - DNA, 15 bp, Homo sapiens
aaaactctctcccag

SEQ ID NO: 5077110 - DNA, 12 bp, Homo sapiens
aaaactctgcca

SEQ ID NO: 5077111 - DNA, 17 bp, Homo sapiens
aaaactctggtgataaa

SEQ ID NO: 5077112 - DNA, 12 bp, Homo sapiens
aaaactctttaa

SEQ ID NO: 5077113 - DNA, 15 bp, Homo sapiens
aaaactctttcggta

SEQ ID NO: 5077114 - DNA, 22 bp, Homo sapiens
aaaactcttttgacctgtaact

SEQ ID NO: 5077115 - DNA, 19 bp, Homo sapiens
aaaactgaaaaattttatt

SEQ ID NO: 5077116 - DNA, 12 bp, Homo sapiens
aaaactgaagaa

SEQ ID NO: 5077117 - DNA, 17 bp, Homo sapiens
aaaactgaagtctgaaa

SEQ ID NO: 5077118 - DNA, 19 bp, Homo sapiens
aaaactgaagtctgaaatt

SEQ ID NO: 5077119 - DNA, 21 bp, Homo sapiens
aaaactgaagtctgaaatttg

SEQ ID NO: 5077120 - DNA, 15 bp, Homo sapiens
aaaactgacagagga

SEQ ID NO: 5077121 - DNA, 16 bp, Homo sapiens
aaaactgacagatgct

SEQ ID NO: 5077122 - DNA, 17 bp, Homo sapiens
aaaactgatcaaaaata

SEQ ID NO: 5077123 - DNA, 18 bp, Homo sapiens
aaaactgatcaaaaataa

SEQ ID NO: 5077124 - DNA, 17 bp, Homo sapiens
aaaactgcagtcatcaa

SEQ ID NO: 5077125 - DNA, 19 bp, Homo sapiens
aaaactgcagtcatcaaca

SEQ ID NO: 5077126 - DNA, 16 bp, Homo sapiens
aaaactgccacaagca

SEQ ID NO: 5077127 - DNA, 19 bp, Homo sapiens
aaaactgccacaagcacaa

SEQ ID NO: 5077128 - DNA, 11 bp, Homo sapiens
aaaactgcccc

SEQ ID NO: 5077129 - DNA, 18 bp, Homo sapiens
aaaactgcgaggacatca

SEQ ID NO: 5077130 - DNA, 20 bp, Homo sapiens
aaaactgcgaggacatcaaa

SEQ ID NO: 5077131 - DNA, 19 bp, Homo sapiens
aaaactgctcatatgatgt

SEQ ID NO: 5077132 - DNA, 18 bp, Homo sapiens
aaaactgctttgtgcata

SEQ ID NO: 5077133 - DNA, 20 bp, Homo sapiens
aaaactggaaacatctgatt

SEQ ID NO: 5077134 - DNA, 17 bp, Homo sapiens
aaaactggaaatctgga

SEQ ID NO: 5077135 - DNA, 20 bp, Homo sapiens
aaaactggaaatctggattt

SEQ ID NO: 5077136 - DNA, 16 bp, Homo sapiens
aaaactggacctgtat

SEQ ID NO: 5077137 - DNA, 20 bp, Homo sapiens
aaaactggatatttcaatct

SEQ ID NO: 5077138 - DNA, 23 bp, Homo sapiens
aaaactgggataactgatttcta

SEQ ID NO: 5077139 - DNA, 22 bp, Homo sapiens
aaaactgggattaagaaacctt

SEQ ID NO: 5077140 - DNA, 16 bp, Homo sapiens
aaaactgtaaaagtgt

SEQ ID NO: 5077141 - DNA, 13 bp, Homo sapiens
aaaactgtacctt

SEQ ID NO: 5077142 - DNA, 15 bp, Homo sapiens
aaaactgtactgtct

SEQ ID NO: 5077143 - DNA, 15 bp, Homo sapiens
aaaactgtactgtgt

SEQ ID NO: 5077144 - DNA, 15 bp, Homo sapiens
aaaactgtactttga

SEQ ID NO: 5077145 - DNA, 19 bp, Homo sapiens
aaaactgtactttgattca

SEQ ID NO: 5077146 - DNA, 20 bp, Homo sapiens
aaaactgtactttgattcac

SEQ ID NO: 5077147 - DNA, 18 bp, Homo sapiens
aaaactgtgacccaaaga

SEQ ID NO: 5077148 - DNA, 11 bp, Homo sapiens
aaaactgtgta

SEQ ID NO: 5077149 - DNA, 12 bp, Homo sapiens
aaaactgtgtaa

SEQ ID NO: 5077150 - DNA, 18 bp, Homo sapiens
aaaactgtgtaaaccaca

SEQ ID NO: 5077151 - DNA, 20 bp, Homo sapiens
aaaactgtgtatcattaaaa

SEQ ID NO: 5077152 - DNA, 21 bp, Homo sapiens
aaaactgtgtatcattaaaat

SEQ ID NO: 5077153 - DNA, 15 bp, Homo sapiens
aaaactgttcttttg

SEQ ID NO: 5077154 - DNA, 16 bp, Homo sapiens
aaaactgttcttttgc

SEQ ID NO: 5077155 - DNA, 22 bp, Homo sapiens
aaaactgttggttcatccagaa

SEQ ID NO: 5077156 - DNA, 23 bp, Homo sapiens
aaaactgttttgggtagctgcca

SEQ ID NO: 5077157 - DNA, 17 bp, Homo sapiens
aaaacttaaaaattaat

SEQ ID NO: 5077158 - DNA, 19 bp, Homo sapiens
aaaacttaaaaattaatat

SEQ ID NO: 5077159 - DNA, 16 bp, Homo sapiens
aaaacttaaaagtatt

SEQ ID NO: 5077160 - DNA, 14 bp, Homo sapiens
aaaacttaaagcaa

SEQ ID NO: 5077161 - DNA, 15 bp, Homo sapiens
aaaacttaaatattg

SEQ ID NO: 5077162 - DNA, 17 bp, Homo sapiens
aaaacttaacatattta

SEQ ID NO: 5077163 - DNA, 21 bp, Homo sapiens
aaaacttaaccgcatcagaag

SEQ ID NO: 5077164 - DNA, 14 bp, Homo sapiens
aaaacttataaatt

SEQ ID NO: 5077165 - DNA, 14 bp, Homo sapiens
aaaacttataattt

SEQ ID NO: 5077166 - DNA, 20 bp, Homo sapiens
aaaacttataatttccaaac

SEQ ID NO: 5077167 - DNA, 17 bp, Homo sapiens
aaaacttattttatcct

SEQ ID NO: 5077168 - DNA, 22 bp, Homo sapiens
aaaacttcaaagctgaatattt

SEQ ID NO: 5077169 - DNA, 23 bp, Homo sapiens
aaaacttcaacatgcatatgata

SEQ ID NO: 5077170 - DNA, 23 bp, Homo sapiens
aaaacttcaagacatcaccatca

SEQ ID NO: 5077171 - DNA, 21 bp, Homo sapiens
aaaacttcacatttatgtggc

SEQ ID NO: 5077172 - DNA, 15 bp, Homo sapiens
aaaacttcagaaaaa

SEQ ID NO: 5077173 - DNA, 13 bp, Homo sapiens
aaaacttcagaag

SEQ ID NO: 5077174 - DNA, 21 bp, Homo sapiens
aaaacttcagtttcacagaaa

SEQ ID NO: 5077175 - DNA, 19 bp, Homo sapiens
aaaacttccattctttctt

SEQ ID NO: 5077176 - DNA, 22 bp, Homo sapiens
aaaacttcgtaagaacatgtta

SEQ ID NO: 5077177 - DNA, 16 bp, Homo sapiens
aaaacttctaggtaat

SEQ ID NO: 5077178 - DNA, 15 bp, Homo sapiens
aaaacttctcttctg

SEQ ID NO: 5077179 - DNA, 10 bp, Homo sapiens
aaaacttctg

SEQ ID NO: 5077180 - DNA, 23 bp, Homo sapiens
aaaacttcttaaatatcttttat

SEQ ID NO: 5077181 - DNA, 18 bp, Homo sapiens
aaaacttcttgtcagaca

SEQ ID NO: 5077182 - DNA, 20 bp, Homo sapiens
aaaacttcttgtcagacata

SEQ ID NO: 5077183 - DNA, 24 bp, Homo sapiens
aaaacttcttgtcagacataaagc

SEQ ID NO: 5077184 - DNA, 20 bp, Homo sapiens
aaaacttgaaaatatatgat

SEQ ID NO: 5077185 - DNA, 18 bp, Homo sapiens
aaaacttgagcccactcc

SEQ ID NO: 5077186 - DNA, 22 bp, Homo sapiens
aaaacttgcacttgtttttctt

SEQ ID NO: 5077187 - DNA, 17 bp, Homo sapiens
aaaacttgcctttcagt

SEQ ID NO: 5077188 - DNA, 18 bp, Homo sapiens
aaaacttgctcccaggag

SEQ ID NO: 5077189 - DNA, 19 bp, Homo sapiens
aaaacttgctgaaaaacac

SEQ ID NO: 5077190 - DNA, 20 bp, Homo sapiens
aaaacttggacccttggaaa

SEQ ID NO: 5077191 - DNA, 17 bp, Homo sapiens
aaaacttggatggactt

SEQ ID NO: 5077192 - DNA, 17 bp, Homo sapiens
aaaacttgtaaatgctg

SEQ ID NO: 5077193 - DNA, 17 bp, Homo sapiens
aaaacttgtgctataaa

SEQ ID NO: 5077194 - DNA, 19 bp, Homo sapiens
aaaacttgtgtgaaatttt

SEQ ID NO: 5077195 - DNA, 18 bp, Homo sapiens
aaaactttaaaaggcaac

SEQ ID NO: 5077196 - DNA, 20 bp, Homo sapiens
aaaactttactaagatgaca

SEQ ID NO: 5077197 - DNA, 21 bp, Homo sapiens
aaaactttattgggtttttat

SEQ ID NO: 5077198 - DNA, 12 bp, Homo sapiens
aaaactttattt

SEQ ID NO: 5077199 - DNA, 13 bp, Homo sapiens
aaaactttatttt

SEQ ID NO: 5077200 - DNA, 12 bp, Homo sapiens
aaaactttcatt

SEQ ID NO: 5077201 - DNA, 21 bp, Homo sapiens
aaaactttccatgacagtagc

SEQ ID NO: 5077202 - DNA, 17 bp, Homo sapiens
aaaactttctctttgcc

SEQ ID NO: 5077203 - DNA, 19 bp, Homo sapiens
aaaactttgttaggccaaa

SEQ ID NO: 5077204 - DNA, 14 bp, Homo sapiens
aaaacttttaaact

SEQ ID NO: 5077205 - DNA, 13 bp, Homo sapiens
aaaacttttataa

SEQ ID NO: 5077206 - DNA, 18 bp, Homo sapiens
aaaacttttataaattaa

SEQ ID NO: 5077207 - DNA, 21 bp, Homo sapiens
aaaacttttataaattaaata

SEQ ID NO: 5077208 - DNA, 20 bp, Homo sapiens
aaaacttttcatttcagatt

SEQ ID NO: 5077209 - DNA, 22 bp, Homo sapiens
aaaacttttcatttcagatttt

SEQ ID NO: 5077210 - DNA, 15 bp, Homo sapiens
aaaacttttccaatg

SEQ ID NO: 5077211 - DNA, 15 bp, Homo sapiens
aaaacttttctgctg

SEQ ID NO: 5077212 - DNA, 14 bp, Homo sapiens
aaaacttttggcaa

SEQ ID NO: 5077213 - DNA, 21 bp, Homo sapiens
aaaacttttgtaaattattga

SEQ ID NO: 5077214 - DNA, 17 bp, Homo sapiens
aaaactttttatatttt

SEQ ID NO: 5077215 - DNA, 22 bp, Homo sapiens
aaaactttttgaccagtttctt

SEQ ID NO: 5077216 - DNA, 23 bp, Homo sapiens
aaaactttttgaccagtttcttt

SEQ ID NO: 5077217 - DNA, 14 bp, Homo sapiens
aaaacttttttctt

SEQ ID NO: 5077218 - DNA, 10 bp, Homo sapiens
aaaagaaaaa

SEQ ID NO: 5077219 - DNA, 21 bp, Homo sapiens
aaaagaaaaaaaaaagaagaa

SEQ ID NO: 5077220 - DNA, 14 bp, Homo sapiens
aaaagaaaaaaaga

SEQ ID NO: 5077221 - DNA, 17 bp, Homo sapiens
aaaagaaaaaaagaaaa

SEQ ID NO: 5077222 - DNA, 15 bp, Homo sapiens
aaaagaaaaaacaac

SEQ ID NO: 5077223 - DNA, 15 bp, Homo sapiens
aaaagaaaaacaagt

SEQ ID NO: 5077224 - DNA, 14 bp, Homo sapiens
aaaagaaaaaccac

SEQ ID NO: 5077225 - DNA, 16 bp, Homo sapiens
aaaagaaaacatttaa

SEQ ID NO: 5077226 - DNA, 17 bp, Homo sapiens
aaaagaaaacttaaaga

SEQ ID NO: 5077227 - DNA, 16 bp, Homo sapiens
aaaagaaaagtcaagg

SEQ ID NO: 5077228 - DNA, 14 bp, Homo sapiens
aaaagaaaataaaa

SEQ ID NO: 5077229 - DNA, 15 bp, Homo sapiens
aaaagaaaatttttg

SEQ ID NO: 5077230 - DNA, 18 bp, Homo sapiens
aaaagaaacaccagtgtt

SEQ ID NO: 5077231 - DNA, 14 bp, Homo sapiens
aaaagaaacattgt

SEQ ID NO: 5077232 - DNA, 11 bp, Homo sapiens
aaaagaaacta

SEQ ID NO: 5077233 - DNA, 11 bp, Homo sapiens
aaaagaaagaa

SEQ ID NO: 5077234 - DNA, 17 bp, Homo sapiens
aaaagaaagaaaatcag

SEQ ID NO: 5077235 - DNA, 21 bp, Homo sapiens
aaaagaaagaaatttgaaaaa

SEQ ID NO: 5077236 - DNA, 11 bp, Homo sapiens
aaaagaaatat

SEQ ID NO: 5077237 - DNA, 15 bp, Homo sapiens
aaaagaaatatacag

SEQ ID NO: 5077238 - DNA, 22 bp, Homo sapiens
aaaagaaatattaatatgtact

SEQ ID NO: 5077239 - DNA, 19 bp, Homo sapiens
aaaagaaatcatgtccata

SEQ ID NO: 5077240 - DNA, 22 bp, Homo sapiens
aaaagaaatctatagaaagtgt

SEQ ID NO: 5077241 - DNA, 19 bp, Homo sapiens
aaaagaaatctctagctca

SEQ ID NO: 5077242 - DNA, 12 bp, Homo sapiens
aaaagaaatctg

SEQ ID NO: 5077243 - DNA, 12 bp, Homo sapiens
aaaagaaatgca

SEQ ID NO: 5077244 - DNA, 15 bp, Homo sapiens
aaaagaaatgcacaa

SEQ ID NO: 5077245 - DNA, 13 bp, Homo sapiens
aaaagaaatgtca

SEQ ID NO: 5077246 - DNA, 14 bp, Homo sapiens
aaaagaaatgtcaa

SEQ ID NO: 5077247 - DNA, 15 bp, Homo sapiens
aaaagaaattatctt

SEQ ID NO: 5077248 - DNA, 19 bp, Homo sapiens
aaaagaaattatctttagt

SEQ ID NO: 5077249 - DNA, 20 bp, Homo sapiens
aaaagaaattccctggacca

SEQ ID NO: 5077250 - DNA, 12 bp, Homo sapiens
aaaagaaattct

SEQ ID NO: 5077251 - DNA, 22 bp, Homo sapiens
aaaagaaatttagagtcaattt

SEQ ID NO: 5077252 - DNA, 13 bp, Homo sapiens
aaaagaacatagg

SEQ ID NO: 5077253 - DNA, 14 bp, Homo sapiens
aaaagaacatagga

SEQ ID NO: 5077254 - DNA, 12 bp, Homo sapiens
aaaagaacttcc

SEQ ID NO: 5077255 - DNA, 14 bp, Homo sapiens
aaaagaagaaaaga

SEQ ID NO: 5077256 - DNA, 15 bp, Homo sapiens
aaaagaagaaaagat

SEQ ID NO: 5077257 - DNA, 17 bp, Homo sapiens
aaaagaagaaaagattc

SEQ ID NO: 5077258 - DNA, 12 bp, Homo sapiens
aaaagaagaaga

SEQ ID NO: 5077259 - DNA, 14 bp, Homo sapiens
aaaagaagacatct

SEQ ID NO: 5077260 - DNA, 13 bp, Homo sapiens
aaaagaagactgg

SEQ ID NO: 5077261 - DNA, 11 bp, Homo sapiens
aaaagaagagt

SEQ ID NO: 5077262 - DNA, 14 bp, Homo sapiens
aaaagaagcacttt

SEQ ID NO: 5077263 - DNA, 18 bp, Homo sapiens
aaaagaaggaaaaataag

SEQ ID NO: 5077264 - DNA, 11 bp, Homo sapiens
aaaagaagtaa

SEQ ID NO: 5077265 - DNA, 14 bp, Homo sapiens
aaaagaagttactt

SEQ ID NO: 5077266 - DNA, 15 bp, Homo sapiens
aaaagaagttacttt

SEQ ID NO: 5077267 - DNA, 18 bp, Homo sapiens
aaaagaagttactttgta

SEQ ID NO: 5077268 - DNA, 20 bp, Homo sapiens
aaaagaagttactttgtaat

SEQ ID NO: 5077269 - DNA, 16 bp, Homo sapiens
aaaagaagtttcagtt

SEQ ID NO: 5077270 - DNA, 16 bp, Homo sapiens
aaaagaatacagaaag

SEQ ID NO: 5077271 - DNA, 14 bp, Homo sapiens
aaaagaatattcag

SEQ ID NO: 5077272 - DNA, 21 bp, Homo sapiens
aaaagaatattcagagaatat

SEQ ID NO: 5077273 - DNA, 12 bp, Homo sapiens
aaaagaatattt

SEQ ID NO: 5077274 - DNA, 13 bp, Homo sapiens
aaaagaatatttt

SEQ ID NO: 5077275 - DNA, 10 bp, Homo sapiens
aaaagaatga

SEQ ID NO: 5077276 - DNA, 23 bp, Homo sapiens
aaaagaatgacgtttacatataa

SEQ ID NO: 5077277 - DNA, 20 bp, Homo sapiens
aaaagaatgagtgaagtatt

SEQ ID NO: 5077278 - DNA, 16 bp, Homo sapiens
aaaagaatgggcagtt

SEQ ID NO: 5077279 - DNA, 15 bp, Homo sapiens
aaaagaatgtcagaa

SEQ ID NO: 5077280 - DNA, 12 bp, Homo sapiens
aaaagaattacc

SEQ ID NO: 5077281 - DNA, 13 bp, Homo sapiens
aaaagaattgttg

SEQ ID NO: 5077282 - DNA, 22 bp, Homo sapiens
aaaagaattgttgggggttttt

SEQ ID NO: 5077283 - DNA, 17 bp, Homo sapiens
aaaagaatttaaattct

SEQ ID NO: 5077284 - DNA, 23 bp, Homo sapiens
aaaagaatttgtgacattttaaa

SEQ ID NO: 5077285 - DNA, 13 bp, Homo sapiens
aaaagaatttgtt

SEQ ID NO: 5077286 - DNA, 14 bp, Homo sapiens
aaaagacaaatgtg

SEQ ID NO: 5077287 - DNA, 14 bp, Homo sapiens
aaaagacaattctt

SEQ ID NO: 5077288 - DNA, 19 bp, Homo sapiens
aaaagacaattctttatac

SEQ ID NO: 5077289 - DNA, 15 bp, Homo sapiens
aaaagacactgcaga

SEQ ID NO: 5077290 - DNA, 18 bp, Homo sapiens
aaaagacacttgatactt

SEQ ID NO: 5077291 - DNA, 14 bp, Homo sapiens
aaaagacagggtgg

SEQ ID NO: 5077292 - DNA, 23 bp, Homo sapiens
aaaagacagggtgggagggagga

SEQ ID NO: 5077293 - DNA, 14 bp, Homo sapiens
aaaagacatccaca

SEQ ID NO: 5077294 - DNA, 13 bp, Homo sapiens
aaaagacatggaa

SEQ ID NO: 5077295 - DNA, 18 bp, Homo sapiens
aaaagacatggaaggtta

SEQ ID NO: 5077296 - DNA, 11 bp, Homo sapiens
aaaagacatta

SEQ ID NO: 5077297 - DNA, 15 bp, Homo sapiens
aaaagacattagaga

SEQ ID NO: 5077298 - DNA, 22 bp, Homo sapiens
aaaagacattagagaaaacctt

SEQ ID NO: 5077299 - DNA, 11 bp, Homo sapiens
aaaagacattt

SEQ ID NO: 5077300 - DNA, 20 bp, Homo sapiens
aaaagaccacagacttctgg

SEQ ID NO: 5077301 - DNA, 20 bp, Homo sapiens
aaaagaccatgcattcagat

SEQ ID NO: 5077302 - DNA, 21 bp, Homo sapiens
aaaagaccttctccctagccc

SEQ ID NO: 5077303 - DNA, 18 bp, Homo sapiens
aaaagacggatggcagga

SEQ ID NO: 5077304 - DNA, 23 bp, Homo sapiens
aaaagactattttctattttccc

SEQ ID NO: 5077305 - DNA, 16 bp, Homo sapiens
aaaagactcagtgttc

SEQ ID NO: 5077306 - DNA, 21 bp, Homo sapiens
aaaagactccagtactatttt

SEQ ID NO: 5077307 - DNA, 17 bp, Homo sapiens
aaaagactgaacatgtt

SEQ ID NO: 5077308 - DNA, 15 bp, Homo sapiens
aaaagactgaccttg

SEQ ID NO: 5077309 - DNA, 21 bp, Homo sapiens
aaaagactggatttgcagaag

SEQ ID NO: 5077310 - DNA, 18 bp, Homo sapiens
aaaagactgtcaaatgaa

SEQ ID NO: 5077311 - DNA, 21 bp, Homo sapiens
aaaagactgtcaaatgaactt

SEQ ID NO: 5077312 - DNA, 22 bp, Homo sapiens
aaaagactgtcaaatgaacttt

SEQ ID NO: 5077313 - DNA, 14 bp, Homo sapiens
aaaagacttcccta

SEQ ID NO: 5077314 - DNA, 20 bp, Homo sapiens
aaaagacttccctaacactt

SEQ ID NO: 5077315 - DNA, 12 bp, Homo sapiens
aaaagagaaaaa

SEQ ID NO: 5077316 - DNA, 18 bp, Homo sapiens
aaaagagaaaaaccaatg

SEQ ID NO: 5077317 - DNA, 14 bp, Homo sapiens
aaaagagaaaagaa

SEQ ID NO: 5077318 - DNA, 11 bp, Homo sapiens
aaaagagaaac

SEQ ID NO: 5077319 - DNA, 21 bp, Homo sapiens
aaaagagaaacaagtattttg

SEQ ID NO: 5077320 - DNA, 13 bp, Homo sapiens
aaaagagaaactt

SEQ ID NO: 5077321 - DNA, 14 bp, Homo sapiens
aaaagagaaactta

SEQ ID NO: 5077322 - DNA, 22 bp, Homo sapiens
aaaagagaacttttttcaaaat

SEQ ID NO: 5077323 - DNA, 16 bp, Homo sapiens
aaaagagaagctgtgt

SEQ ID NO: 5077324 - DNA, 12 bp, Homo sapiens
aaaagagaaggc

SEQ ID NO: 5077325 - DNA, 18 bp, Homo sapiens
aaaagagaattagattat

SEQ ID NO: 5077326 - DNA, 23 bp, Homo sapiens
aaaagagaattagattatattgg

SEQ ID NO: 5077327 - DNA, 20 bp, Homo sapiens
aaaagagaattgtagataat

SEQ ID NO: 5077328 - DNA, 11 bp, Homo sapiens
aaaagagactg

SEQ ID NO: 5077329 - DNA, 14 bp, Homo sapiens
aaaagagacttctc

SEQ ID NO: 5077330 - DNA, 14 bp, Homo sapiens
aaaagagagagcag

SEQ ID NO: 5077331 - DNA, 21 bp, Homo sapiens
aaaagagagcagagaatataa

SEQ ID NO: 5077332 - DNA, 22 bp, Homo sapiens
aaaagagagcagagaatataac

SEQ ID NO: 5077333 - DNA, 19 bp, Homo sapiens
aaaagagataataagatta

SEQ ID NO: 5077334 - DNA, 19 bp, Homo sapiens
aaaagagatctgggcatta

SEQ ID NO: 5077335 - DNA, 19 bp, Homo sapiens
aaaagagatggcctgagaa

SEQ ID NO: 5077336 - DNA, 21 bp, Homo sapiens
aaaagagcagcatttttaatt

SEQ ID NO: 5077337 - DNA, 21 bp, Homo sapiens
aaaagagcagtggtaagaata

SEQ ID NO: 5077338 - DNA, 18 bp, Homo sapiens
aaaagagcatatactggt

SEQ ID NO: 5077339 - DNA, 23 bp, Homo sapiens
aaaagagccctggctctgcccct

SEQ ID NO: 5077340 - DNA, 11 bp, Homo sapiens
aaaagagctgg

SEQ ID NO: 5077341 - DNA, 14 bp, Homo sapiens
aaaagagctgtctg

SEQ ID NO: 5077342 - DNA, 15 bp, Homo sapiens
aaaagagctgtctga

SEQ ID NO: 5077343 - DNA, 12 bp, Homo sapiens
aaaagagcttta

SEQ ID NO: 5077344 - DNA, 13 bp, Homo sapiens
aaaagagctttat

SEQ ID NO: 5077345 - DNA, 16 bp, Homo sapiens
aaaagagctttatccc

SEQ ID NO: 5077346 - DNA, 12 bp, Homo sapiens
aaaagagtaatt

SEQ ID NO: 5077347 - DNA, 13 bp, Homo sapiens
aaaagagtaattt

SEQ ID NO: 5077348 - DNA, 21 bp, Homo sapiens
aaaagagtagaaagcttgaaa

SEQ ID NO: 5077349 - DNA, 22 bp, Homo sapiens
aaaagagtctctacccctttct

SEQ ID NO: 5077350 - DNA, 15 bp, Homo sapiens
aaaagagtcttccaa

SEQ ID NO: 5077351 - DNA, 18 bp, Homo sapiens
aaaagagtgaatgtaata

SEQ ID NO: 5077352 - DNA, 14 bp, Homo sapiens
aaaagataaagatg

SEQ ID NO: 5077353 - DNA, 17 bp, Homo sapiens
aaaagataaagatgatc

SEQ ID NO: 5077354 - DNA, 14 bp, Homo sapiens
aaaagataaatatt

SEQ ID NO: 5077355 - DNA, 13 bp, Homo sapiens
aaaagataaattt

SEQ ID NO: 5077356 - DNA, 19 bp, Homo sapiens
aaaagataatattttacat

SEQ ID NO: 5077357 - DNA, 20 bp, Homo sapiens
aaaagatacgactttatttt

SEQ ID NO: 5077358 - DNA, 23 bp, Homo sapiens
aaaagatataagtgctgtataaa

SEQ ID NO: 5077359 - DNA, 11 bp, Homo sapiens
aaaagatatat

SEQ ID NO: 5077360 - DNA, 15 bp, Homo sapiens
aaaagatatatatat

SEQ ID NO: 5077361 - DNA, 18 bp, Homo sapiens
aaaagatatgtattctaa

SEQ ID NO: 5077362 - DNA, 21 bp, Homo sapiens
aaaagatattgtattatcata

SEQ ID NO: 5077363 - DNA, 23 bp, Homo sapiens
aaaagatattgtattatcatata

SEQ ID NO: 5077364 - DNA, 15 bp, Homo sapiens
aaaagatcaccttgt

SEQ ID NO: 5077365 - DNA, 14 bp, Homo sapiens
aaaagatcattaaa

SEQ ID NO: 5077366 - DNA, 17 bp, Homo sapiens
aaaagatccttcatttt

SEQ ID NO: 5077367 - DNA, 23 bp, Homo sapiens
aaaagatctgttttgaaggcaaa

SEQ ID NO: 5077368 - DNA, 17 bp, Homo sapiens
aaaagatctttcatttt

SEQ ID NO: 5077369 - DNA, 20 bp, Homo sapiens
aaaagatgaggactcagaag

SEQ ID NO: 5077370 - DNA, 22 bp, Homo sapiens
aaaagatgcactttgctttaat

SEQ ID NO: 5077371 - DNA, 13 bp, Homo sapiens
aaaagatgctttt

SEQ ID NO: 5077372 - DNA, 22 bp, Homo sapiens
aaaagatggatttgacacactc

SEQ ID NO: 5077373 - DNA, 14 bp, Homo sapiens
aaaagatgtatatt

SEQ ID NO: 5077374 - DNA, 23 bp, Homo sapiens
aaaagatgtatatttgcatattt

SEQ ID NO: 5077375 - DNA, 13 bp, Homo sapiens
aaaagattagcaa

SEQ ID NO: 5077376 - DNA, 23 bp, Homo sapiens
aaaagattatatatcataaagta

SEQ ID NO: 5077377 - DNA, 13 bp, Homo sapiens
aaaagattcattt

SEQ ID NO: 5077378 - DNA, 16 bp, Homo sapiens
aaaagattctgtgtca

SEQ ID NO: 5077379 - DNA, 12 bp, Homo sapiens
aaaagattcttc

SEQ ID NO: 5077380 - DNA, 16 bp, Homo sapiens
aaaagattcttcttaa

SEQ ID NO: 5077381 - DNA, 18 bp, Homo sapiens
aaaagattctttttctga

SEQ ID NO: 5077382 - DNA, 15 bp, Homo sapiens
aaaagattgcaaagg

SEQ ID NO: 5077383 - DNA, 15 bp, Homo sapiens
aaaagattgccaatt

SEQ ID NO: 5077384 - DNA, 17 bp, Homo sapiens
aaaagattgtattgctg

SEQ ID NO: 5077385 - DNA, 13 bp, Homo sapiens
aaaagatttaagc

SEQ ID NO: 5077386 - DNA, 14 bp, Homo sapiens
aaaagatttacatt

SEQ ID NO: 5077387 - DNA, 13 bp, Homo sapiens
aaaagatttgttt

SEQ ID NO: 5077388 - DNA, 14 bp, Homo sapiens
aaaagattttaatc

SEQ ID NO: 5077389 - DNA, 17 bp, Homo sapiens
aaaagattttgtgaaat

SEQ ID NO: 5077390 - DNA, 22 bp, Homo sapiens
aaaagattttgtgaaatttcat

SEQ ID NO: 5077391 - DNA, 15 bp, Homo sapiens
aaaagatttttattt

SEQ ID NO: 5077392 - DNA, 16 bp, Homo sapiens
aaaagcaaaaagcaag

SEQ ID NO: 5077393 - DNA, 13 bp, Homo sapiens
aaaagcaaaataa

SEQ ID NO: 5077394 - DNA, 12 bp, Homo sapiens
aaaagcaaaatc

SEQ ID NO: 5077395 - DNA, 18 bp, Homo sapiens
aaaagcaaaatttttaaa

SEQ ID NO: 5077396 - DNA, 17 bp, Homo sapiens
aaaagcaaatcagaaaa

SEQ ID NO: 5077397 - DNA, 21 bp, Homo sapiens
aaaagcaaatctacagatcct

SEQ ID NO: 5077398 - DNA, 22 bp, Homo sapiens
aaaagcaaatggaaaatgtata

SEQ ID NO: 5077399 - DNA, 12 bp, Homo sapiens
aaaagcaacttt

SEQ ID NO: 5077400 - DNA, 13 bp, Homo sapiens
aaaagcaactttt

SEQ ID NO: 5077401 - DNA, 12 bp, Homo sapiens
aaaagcaagact

SEQ ID NO: 5077402 - DNA, 14 bp, Homo sapiens
aaaagcaagactgt

SEQ ID NO: 5077403 - DNA, 17 bp, Homo sapiens
aaaagcaagatctacta

SEQ ID NO: 5077404 - DNA, 17 bp, Homo sapiens
aaaagcaagattgaaat

SEQ ID NO: 5077405 - DNA, 14 bp, Homo sapiens
aaaagcaaggtgtt

SEQ ID NO: 5077406 - DNA, 19 bp, Homo sapiens
aaaagcaaggtgtttaagt

SEQ ID NO: 5077407 - DNA, 22 bp, Homo sapiens
aaaagcaatctggaagaaagcc

SEQ ID NO: 5077408 - DNA, 15 bp, Homo sapiens
aaaagcaatggttga

SEQ ID NO: 5077409 - DNA, 16 bp, Homo sapiens
aaaagcaattccaacc

SEQ ID NO: 5077410 - DNA, 12 bp, Homo sapiens
aaaagcacaaaa

SEQ ID NO: 5077411 - DNA, 14 bp, Homo sapiens
aaaagcacaaaccc

SEQ ID NO: 5077412 - DNA, 14 bp, Homo sapiens
aaaagcacaagaag

SEQ ID NO: 5077413 - DNA, 22 bp, Homo sapiens
aaaagcacaatcactaaacttt

SEQ ID NO: 5077414 - DNA, 18 bp, Homo sapiens
aaaagcacacacaataaa

SEQ ID NO: 5077415 - DNA, 18 bp, Homo sapiens
aaaagcacagctgtatat

SEQ ID NO: 5077416 - DNA, 14 bp, Homo sapiens
aaaagcacctcttg

SEQ ID NO: 5077417 - DNA, 20 bp, Homo sapiens
aaaagcacttaaagtttttt

SEQ ID NO: 5077418 - DNA, 11 bp, Homo sapiens
aaaagcacttt

SEQ ID NO: 5077419 - DNA, 14 bp, Homo sapiens
aaaagcacttttgt

SEQ ID NO: 5077420 - DNA, 13 bp, Homo sapiens
aaaagcagacatt

SEQ ID NO: 5077421 - DNA, 23 bp, Homo sapiens
aaaagcagagagaagtacttttg

SEQ ID NO: 5077422 - DNA, 20 bp, Homo sapiens
aaaagcagatggacttgaaa

SEQ ID NO: 5077423 - DNA, 18 bp, Homo sapiens
aaaagcagcacaaggaat

SEQ ID NO: 5077424 - DNA, 15 bp, Homo sapiens
aaaagcagcagaggt

SEQ ID NO: 5077425 - DNA, 14 bp, Homo sapiens
aaaagcagcataaa

SEQ ID NO: 5077426 - DNA, 18 bp, Homo sapiens
aaaagcaggttgataaat

SEQ ID NO: 5077427 - DNA, 19 bp, Homo sapiens
aaaagcagtaaatttgcta

SEQ ID NO: 5077428 - DNA, 22 bp, Homo sapiens
aaaagcagtcctcttattccta

SEQ ID NO: 5077429 - DNA, 19 bp, Homo sapiens
aaaagcagtttttgaaaga

SEQ ID NO: 5077430 - DNA, 13 bp, Homo sapiens
aaaagcataaatg

SEQ ID NO: 5077431 - DNA, 15 bp, Homo sapiens
aaaagcataaatgca

SEQ ID NO: 5077432 - DNA, 19 bp, Homo sapiens
aaaagcatatataaaacaa

SEQ ID NO: 5077433 - DNA, 15 bp, Homo sapiens
aaaagcatgaaacat

SEQ ID NO: 5077434 - DNA, 14 bp, Homo sapiens
aaaagcatgaatat

SEQ ID NO: 5077435 - DNA, 20 bp, Homo sapiens
aaaagcatgaatatttctta

SEQ ID NO: 5077436 - DNA, 19 bp, Homo sapiens
aaaagcatgaattggaact

SEQ ID NO: 5077437 - DNA, 19 bp, Homo sapiens
aaaagcatgatgggaaaat

SEQ ID NO: 5077438 - DNA, 15 bp, Homo sapiens
aaaagcatgtacagt

SEQ ID NO: 5077439 - DNA, 19 bp, Homo sapiens
aaaagcatgtacagtgttc

SEQ ID NO: 5077440 - DNA, 22 bp, Homo sapiens
aaaagcatgtacagtgttctgt

SEQ ID NO: 5077441 - DNA, 15 bp, Homo sapiens
aaaagcattaaaaat

SEQ ID NO: 5077442 - DNA, 15 bp, Homo sapiens
aaaagcatttttatt

SEQ ID NO: 5077443 - DNA, 18 bp, Homo sapiens
aaaagcatttttattata

SEQ ID NO: 5077444 - DNA, 20 bp, Homo sapiens
aaaagcatttttattatatt

SEQ ID NO: 5077445 - DNA, 17 bp, Homo sapiens
aaaagcatttttcaata

SEQ ID NO: 5077446 - DNA, 21 bp, Homo sapiens
aaaagcatttttcaatatatt

SEQ ID NO: 5077447 - DNA, 16 bp, Homo sapiens
aaaagccaaaggtcaa

SEQ ID NO: 5077448 - DNA, 17 bp, Homo sapiens
aaaagccaaaggtcaaa

SEQ ID NO: 5077449 - DNA, 13 bp, Homo sapiens
aaaagccaaatta

SEQ ID NO: 5077450 - DNA, 11 bp, Homo sapiens
aaaagccaagc

SEQ ID NO: 5077451 - DNA, 17 bp, Homo sapiens
aaaagccaagtgtcctg

SEQ ID NO: 5077452 - DNA, 14 bp, Homo sapiens
aaaagccacagcag

SEQ ID NO: 5077453 - DNA, 14 bp, Homo sapiens
aaaagccacattac

SEQ ID NO: 5077454 - DNA, 17 bp, Homo sapiens
aaaagccactagactct

SEQ ID NO: 5077455 - DNA, 22 bp, Homo sapiens
aaaagccagcaggcttcaaact

SEQ ID NO: 5077456 - DNA, 12 bp, Homo sapiens
aaaagccagggc

SEQ ID NO: 5077457 - DNA, 17 bp, Homo sapiens
aaaagccataacttgaa

SEQ ID NO: 5077458 - DNA, 14 bp, Homo sapiens
aaaagccatatcta

SEQ ID NO: 5077459 - DNA, 20 bp, Homo sapiens
aaaagccatcatgtaaatta

SEQ ID NO: 5077460 - DNA, 11 bp, Homo sapiens
aaaagccatgt

SEQ ID NO: 5077461 - DNA, 22 bp, Homo sapiens
aaaagccatgtatttcagggac

SEQ ID NO: 5077462 - DNA, 10 bp, Homo sapiens
aaaagcccac

SEQ ID NO: 5077463 - DNA, 21 bp, Homo sapiens
aaaagcccacctgaaagcctg

SEQ ID NO: 5077464 - DNA, 17 bp, Homo sapiens
aaaagcccaggagccca

SEQ ID NO: 5077465 - DNA, 21 bp, Homo sapiens
aaaagcccagtgacctgaccg

SEQ ID NO: 5077466 - DNA, 15 bp, Homo sapiens
aaaagcccatgctta

SEQ ID NO: 5077467 - DNA, 18 bp, Homo sapiens
aaaagcccatgcttaaat

SEQ ID NO: 5077468 - DNA, 19 bp, Homo sapiens
aaaagccccagtctcacct

SEQ ID NO: 5077469 - DNA, 21 bp, Homo sapiens
aaaagccctatgtgaaaagat

SEQ ID NO: 5077470 - DNA, 14 bp, Homo sapiens
aaaagccctcttca

SEQ ID NO: 5077471 - DNA, 22 bp, Homo sapiens
aaaagccgaaagggttaatcat

SEQ ID NO: 5077472 - DNA, 17 bp, Homo sapiens
aaaagcctaagaaaaag

SEQ ID NO: 5077473 - DNA, 16 bp, Homo sapiens
aaaagcctaatcacag

SEQ ID NO: 5077474 - DNA, 21 bp, Homo sapiens
aaaagcctcaactagtcattt

SEQ ID NO: 5077475 - DNA, 11 bp, Homo sapiens
aaaagcctcct

SEQ ID NO: 5077476 - DNA, 15 bp, Homo sapiens
aaaagcctccttgtg

SEQ ID NO: 5077477 - DNA, 20 bp, Homo sapiens
aaaagcctctgttttgatat

SEQ ID NO: 5077478 - DNA, 13 bp, Homo sapiens
aaaagcctggttt

SEQ ID NO: 5077479 - DNA, 18 bp, Homo sapiens
aaaagcctgtttaagaga

SEQ ID NO: 5077480 - DNA, 18 bp, Homo sapiens
aaaagccttccagttttg

SEQ ID NO: 5077481 - DNA, 11 bp, Homo sapiens
aaaagccttgt

SEQ ID NO: 5077482 - DNA, 13 bp, Homo sapiens
aaaagccttgtgt

SEQ ID NO: 5077483 - DNA, 14 bp, Homo sapiens
aaaagccttgtgta

SEQ ID NO: 5077484 - DNA, 23 bp, Homo sapiens
aaaagccttgtgtatatttgtat

SEQ ID NO: 5077485 - DNA, 15 bp, Homo sapiens
aaaagcgctgtttcc

SEQ ID NO: 5077486 - DNA, 22 bp, Homo sapiens
aaaagcggaaagttagtgcttg

SEQ ID NO: 5077487 - DNA, 21 bp, Homo sapiens
aaaagcgggtaaaaaacctgg

SEQ ID NO: 5077488 - DNA, 21 bp, Homo sapiens
aaaagcgtctttaagagactc

SEQ ID NO: 5077489 - DNA, 23 bp, Homo sapiens
aaaagcgtgagcttaaaatacaa

SEQ ID NO: 5077490 - DNA, 17 bp, Homo sapiens
aaaagctataaagcagt

SEQ ID NO: 5077491 - DNA, 15 bp, Homo sapiens
aaaagctataaagta

SEQ ID NO: 5077492 - DNA, 22 bp, Homo sapiens
aaaagctatcttaaaatataga

SEQ ID NO: 5077493 - DNA, 15 bp, Homo sapiens
aaaagctattagcca

SEQ ID NO: 5077494 - DNA, 17 bp, Homo sapiens
aaaagctattagccagg

SEQ ID NO: 5077495 - DNA, 13 bp, Homo sapiens
aaaagctcagagt

SEQ ID NO: 5077496 - DNA, 14 bp, Homo sapiens
aaaagctcagatga

SEQ ID NO: 5077497 - DNA, 18 bp, Homo sapiens
aaaagctcatattttgta

SEQ ID NO: 5077498 - DNA, 15 bp, Homo sapiens
aaaagctcatttcat

SEQ ID NO: 5077499 - DNA, 12 bp, Homo sapiens
aaaagctcctgt

SEQ ID NO: 5077500 - DNA, 20 bp, Homo sapiens
aaaagctctctttggaatga

SEQ ID NO: 5077501 - DNA, 23 bp, Homo sapiens
aaaagctctgttccatgcaactg

SEQ ID NO: 5077502 - DNA, 20 bp, Homo sapiens
aaaagctcttacactacatt

SEQ ID NO: 5077503 - DNA, 13 bp, Homo sapiens
aaaagctctttta

SEQ ID NO: 5077504 - DNA, 16 bp, Homo sapiens
aaaagctgaacacatt

SEQ ID NO: 5077505 - DNA, 20 bp, Homo sapiens
aaaagctgaacacatttctt

SEQ ID NO: 5077506 - DNA, 14 bp, Homo sapiens
aaaagctgcttgac

SEQ ID NO: 5077507 - DNA, 21 bp, Homo sapiens
aaaagctgcttgactatcaca

SEQ ID NO: 5077508 - DNA, 23 bp, Homo sapiens
aaaagctgcttgactatcacata

SEQ ID NO: 5077509 - DNA, 17 bp, Homo sapiens
aaaagctggattttctt

SEQ ID NO: 5077510 - DNA, 21 bp, Homo sapiens
aaaagctgtaaattactatgg

SEQ ID NO: 5077511 - DNA, 17 bp, Homo sapiens
aaaagctgtaagaaaat

SEQ ID NO: 5077512 - DNA, 18 bp, Homo sapiens
aaaagctgtattttgaaa

SEQ ID NO: 5077513 - DNA, 19 bp, Homo sapiens
aaaagcttaataaattcca

SEQ ID NO: 5077514 - DNA, 21 bp, Homo sapiens
aaaagcttagctttagaaaca

SEQ ID NO: 5077515 - DNA, 23 bp, Homo sapiens
aaaagcttagctttagaaacagt

SEQ ID NO: 5077516 - DNA, 14 bp, Homo sapiens
aaaagcttccatga

SEQ ID NO: 5077517 - DNA, 20 bp, Homo sapiens
aaaagcttcttaattaattt

SEQ ID NO: 5077518 - DNA, 13 bp, Homo sapiens
aaaagctttactc

SEQ ID NO: 5077519 - DNA, 13 bp, Homo sapiens
aaaagctttagat

SEQ ID NO: 5077520 - DNA, 23 bp, Homo sapiens
aaaagctttagattgaaatttat

SEQ ID NO: 5077521 - DNA, 11 bp, Homo sapiens
aaaagctttat

SEQ ID NO: 5077522 - DNA, 17 bp, Homo sapiens
aaaagctttatgatttt

SEQ ID NO: 5077523 - DNA, 18 bp, Homo sapiens
aaaagctttatgattttc

SEQ ID NO: 5077524 - DNA, 19 bp, Homo sapiens
aaaagctttgtttgttctt

SEQ ID NO: 5077525 - DNA, 19 bp, Homo sapiens
aaaagcttttgttttgctt

SEQ ID NO: 5077526 - DNA, 14 bp, Homo sapiens
aaaaggaaaaataa

SEQ ID NO: 5077527 - DNA, 16 bp, Homo sapiens
aaaaggaaaagaaaaa

SEQ ID NO: 5077528 - DNA, 12 bp, Homo sapiens
aaaaggaaaatg

SEQ ID NO: 5077529 - DNA, 13 bp, Homo sapiens
aaaaggaaagctg

SEQ ID NO: 5077530 - DNA, 13 bp, Homo sapiens
aaaaggaaagtca

SEQ ID NO: 5077531 - DNA, 14 bp, Homo sapiens
aaaaggaaagtttg

SEQ ID NO: 5077532 - DNA, 13 bp, Homo sapiens
aaaaggaaatatt

SEQ ID NO: 5077533 - DNA, 12 bp, Homo sapiens
aaaaggaaattt

SEQ ID NO: 5077534 - DNA, 13 bp, Homo sapiens
aaaaggaaatttg

SEQ ID NO: 5077535 - DNA, 17 bp, Homo sapiens
aaaaggaaatttgtttg

SEQ ID NO: 5077536 - DNA, 20 bp, Homo sapiens
aaaaggaaatttgtttgtat

SEQ ID NO: 5077537 - DNA, 18 bp, Homo sapiens
aaaaggaacccaattttc

SEQ ID NO: 5077538 - DNA, 18 bp, Homo sapiens
aaaaggaacggcttcctc

SEQ ID NO: 5077539 - DNA, 18 bp, Homo sapiens
aaaaggaagccaaagagt

SEQ ID NO: 5077540 - DNA, 11 bp, Homo sapiens
aaaaggaagga

SEQ ID NO: 5077541 - DNA, 21 bp, Homo sapiens
aaaaggaagtttccagaaaag

SEQ ID NO: 5077542 - DNA, 15 bp, Homo sapiens
aaaaggaatgcaaga

SEQ ID NO: 5077543 - DNA, 17 bp, Homo sapiens
aaaaggaatgcaagaga

SEQ ID NO: 5077544 - DNA, 12 bp, Homo sapiens
aaaaggaatttt

SEQ ID NO: 5077545 - DNA, 20 bp, Homo sapiens
aaaaggacaggcagaaagag

SEQ ID NO: 5077546 - DNA, 17 bp, Homo sapiens
aaaaggacatcagcaaa

SEQ ID NO: 5077547 - DNA, 14 bp, Homo sapiens
aaaaggactctgga

SEQ ID NO: 5077548 - DNA, 18 bp, Homo sapiens
aaaaggactggaaaaatg

SEQ ID NO: 5077549 - DNA, 20 bp, Homo sapiens
aaaaggactggaaaaatgaa

SEQ ID NO: 5077550 - DNA, 19 bp, Homo sapiens
aaaaggagaactgtgctct

SEQ ID NO: 5077551 - DNA, 16 bp, Homo sapiens
aaaaggagagattatt

SEQ ID NO: 5077552 - DNA, 23 bp, Homo sapiens
aaaaggagagattattaaatcgt

SEQ ID NO: 5077553 - DNA, 23 bp, Homo sapiens
aaaaggagctcttcttgtgaaat

SEQ ID NO: 5077554 - DNA, 14 bp, Homo sapiens
aaaaggataagtga

SEQ ID NO: 5077555 - DNA, 15 bp, Homo sapiens
aaaaggataggaaaa

SEQ ID NO: 5077556 - DNA, 17 bp, Homo sapiens
aaaaggataggaaaaga

SEQ ID NO: 5077557 - DNA, 22 bp, Homo sapiens
aaaaggatagtatttttatcca

SEQ ID NO: 5077558 - DNA, 19 bp, Homo sapiens
aaaaggatattatctacct

SEQ ID NO: 5077559 - DNA, 21 bp, Homo sapiens
aaaaggatattatctacctgt

SEQ ID NO: 5077560 - DNA, 20 bp, Homo sapiens
aaaaggatctttgtggccaa

SEQ ID NO: 5077561 - DNA, 19 bp, Homo sapiens
aaaaggatgatggaaaaat

SEQ ID NO: 5077562 - DNA, 19 bp, Homo sapiens
aaaaggatgcacagagttg

SEQ ID NO: 5077563 - DNA, 18 bp, Homo sapiens
aaaaggatggaagaaaga

SEQ ID NO: 5077564 - DNA, 20 bp, Homo sapiens
aaaaggatggtggttatttt

SEQ ID NO: 5077565 - DNA, 18 bp, Homo sapiens
aaaaggattcctctttgt

SEQ ID NO: 5077566 - DNA, 16 bp, Homo sapiens
aaaaggcaaatgtgta

SEQ ID NO: 5077567 - DNA, 15 bp, Homo sapiens
aaaaggcactgcaca

SEQ ID NO: 5077568 - DNA, 15 bp, Homo sapiens
aaaaggcagcatttg

SEQ ID NO: 5077569 - DNA, 11 bp, Homo sapiens
aaaaggcagga

SEQ ID NO: 5077570 - DNA, 11 bp, Homo sapiens
aaaaggcaggt

SEQ ID NO: 5077571 - DNA, 23 bp, Homo sapiens
aaaaggcaggtgcttttggcaga

SEQ ID NO: 5077572 - DNA, 15 bp, Homo sapiens
aaaaggcatctgaac

SEQ ID NO: 5077573 - DNA, 17 bp, Homo sapiens
aaaaggcattgtttgag

SEQ ID NO: 5077574 - DNA, 15 bp, Homo sapiens
aaaaggccaaagata

SEQ ID NO: 5077575 - DNA, 11 bp, Homo sapiens
aaaaggcccag

SEQ ID NO: 5077576 - DNA, 14 bp, Homo sapiens
aaaaggcccatgta

SEQ ID NO: 5077577 - DNA, 23 bp, Homo sapiens
aaaaggccctagctaataaacct

SEQ ID NO: 5077578 - DNA, 22 bp, Homo sapiens
aaaaggcctcttgtaaagactg

SEQ ID NO: 5077579 - DNA, 13 bp, Homo sapiens
aaaaggcctgggg

SEQ ID NO: 5077580 - DNA, 14 bp, Homo sapiens
aaaaggctagttta

SEQ ID NO: 5077581 - DNA, 17 bp, Homo sapiens
aaaaggctcgtttggat

SEQ ID NO: 5077582 - DNA, 13 bp, Homo sapiens
aaaaggctgaaaa

SEQ ID NO: 5077583 - DNA, 15 bp, Homo sapiens
aaaaggctgaaaaga

SEQ ID NO: 5077584 - DNA, 21 bp, Homo sapiens
aaaaggctgctcacaagttct

SEQ ID NO: 5077585 - DNA, 19 bp, Homo sapiens
aaaaggctggatgtgcttt

SEQ ID NO: 5077586 - DNA, 16 bp, Homo sapiens
aaaaggctgtgctgcc

SEQ ID NO: 5077587 - DNA, 20 bp, Homo sapiens
aaaaggcttataaaacagag

SEQ ID NO: 5077588 - DNA, 13 bp, Homo sapiens
aaaaggcttccag

SEQ ID NO: 5077589 - DNA, 14 bp, Homo sapiens
aaaaggcttgaagc

SEQ ID NO: 5077590 - DNA, 15 bp, Homo sapiens
aaaagggaaaaaaga

SEQ ID NO: 5077591 - DNA, 14 bp, Homo sapiens
aaaagggaaaaaat

SEQ ID NO: 5077592 - DNA, 18 bp, Homo sapiens
aaaagggaaaaagacctc

SEQ ID NO: 5077593 - DNA, 14 bp, Homo sapiens
aaaagggaagtcta

SEQ ID NO: 5077594 - DNA, 14 bp, Homo sapiens
aaaagggacatgaa

SEQ ID NO: 5077595 - DNA, 16 bp, Homo sapiens
aaaagggactgagaaa

SEQ ID NO: 5077596 - DNA, 19 bp, Homo sapiens
aaaagggactgagaaattt

SEQ ID NO: 5077597 - DNA, 18 bp, Homo sapiens
aaaagggcaatcagcaat

SEQ ID NO: 5077598 - DNA, 15 bp, Homo sapiens
aaaagggcactctga

SEQ ID NO: 5077599 - DNA, 17 bp, Homo sapiens
aaaagggcagctgtgat

SEQ ID NO: 5077600 - DNA, 23 bp, Homo sapiens
aaaagggcatctcaatggcatgg

SEQ ID NO: 5077601 - DNA, 21 bp, Homo sapiens
aaaagggcggaagagttacaa

SEQ ID NO: 5077602 - DNA, 22 bp, Homo sapiens
aaaagggcttcggccacaggca

SEQ ID NO: 5077603 - DNA, 22 bp, Homo sapiens
aaaaggggaaataactgccttg

SEQ ID NO: 5077604 - DNA, 11 bp, Homo sapiens
aaaaggggccc

SEQ ID NO: 5077605 - DNA, 22 bp, Homo sapiens
aaaaggggtagggtttaaagat

SEQ ID NO: 5077606 - DNA, 17 bp, Homo sapiens
aaaagggtcaaacctgt

SEQ ID NO: 5077607 - DNA, 15 bp, Homo sapiens
aaaagggtgtatagt

SEQ ID NO: 5077608 - DNA, 14 bp, Homo sapiens
aaaaggtacaatgc

SEQ ID NO: 5077609 - DNA, 22 bp, Homo sapiens
aaaaggtagcttacctgacaca

SEQ ID NO: 5077610 - DNA, 14 bp, Homo sapiens
aaaaggtagttttt

SEQ ID NO: 5077611 - DNA, 15 bp, Homo sapiens
aaaaggtagtttttc

SEQ ID NO: 5077612 - DNA, 19 bp, Homo sapiens
aaaaggtatgcaatcaaat

SEQ ID NO: 5077613 - DNA, 14 bp, Homo sapiens
aaaaggtattatac

SEQ ID NO: 5077614 - DNA, 21 bp, Homo sapiens
aaaaggtattttgaataccat

SEQ ID NO: 5077615 - DNA, 14 bp, Homo sapiens
aaaaggtcctgtaa

SEQ ID NO: 5077616 - DNA, 19 bp, Homo sapiens
aaaaggtggagtttctctg

SEQ ID NO: 5077617 - DNA, 13 bp, Homo sapiens
aaaaggtgtaaaa

SEQ ID NO: 5077618 - DNA, 20 bp, Homo sapiens
aaaaggtgtaggcctgcctt

SEQ ID NO: 5077619 - DNA, 14 bp, Homo sapiens
aaaaggtgtccttt

SEQ ID NO: 5077620 - DNA, 17 bp, Homo sapiens
aaaaggttaacagtaaa

SEQ ID NO: 5077621 - DNA, 18 bp, Homo sapiens
aaaaggttaacagtaaaa

SEQ ID NO: 5077622 - DNA, 17 bp, Homo sapiens
aaaaggttaataaagta

SEQ ID NO: 5077623 - DNA, 19 bp, Homo sapiens
aaaaggttaatttttcctt

SEQ ID NO: 5077624 - DNA, 19 bp, Homo sapiens
aaaaggttcactaaagcag

SEQ ID NO: 5077625 - DNA, 20 bp, Homo sapiens
aaaaggttcttcttgggagt

SEQ ID NO: 5077626 - DNA, 20 bp, Homo sapiens
aaaaggttgcctgaaaaatg

SEQ ID NO: 5077627 - DNA, 14 bp, Homo sapiens
aaaaggtttacaga

SEQ ID NO: 5077628 - DNA, 16 bp, Homo sapiens
aaaaggtttacagaat

SEQ ID NO: 5077629 - DNA, 23 bp, Homo sapiens
aaaaggtttatgaaaaagaagaa

SEQ ID NO: 5077630 - DNA, 19 bp, Homo sapiens
aaaaggtttcccaaaacaa

SEQ ID NO: 5077631 - DNA, 20 bp, Homo sapiens
aaaaggtttcccaaaacaat

SEQ ID NO: 5077632 - DNA, 12 bp, Homo sapiens
aaaagtaaaatg

SEQ ID NO: 5077633 - DNA, 12 bp, Homo sapiens
aaaagtaaatgg

SEQ ID NO: 5077634 - DNA, 15 bp, Homo sapiens
aaaagtaaatgtaca

SEQ ID NO: 5077635 - DNA, 18 bp, Homo sapiens
aaaagtaactggttgtca

SEQ ID NO: 5077636 - DNA, 23 bp, Homo sapiens
aaaagtaagaacagctcatcttc

SEQ ID NO: 5077637 - DNA, 15 bp, Homo sapiens
aaaagtaagaatgca

SEQ ID NO: 5077638 - DNA, 15 bp, Homo sapiens
aaaagtaagggaata

SEQ ID NO: 5077639 - DNA, 13 bp, Homo sapiens
aaaagtaataaaa

SEQ ID NO: 5077640 - DNA, 16 bp, Homo sapiens
aaaagtaataaagaga

SEQ ID NO: 5077641 - DNA, 15 bp, Homo sapiens
aaaagtaatatttat

SEQ ID NO: 5077642 - DNA, 24 bp, Homo sapiens
aaaagtaatgaagaatcacgattt

SEQ ID NO: 5077643 - DNA, 21 bp, Homo sapiens
aaaagtaatgacttagaaact

SEQ ID NO: 5077644 - DNA, 13 bp, Homo sapiens
aaaagtaatgtaa

SEQ ID NO: 5077645 - DNA, 15 bp, Homo sapiens
aaaagtacaatttac

SEQ ID NO: 5077646 - DNA, 22 bp, Homo sapiens
aaaagtacatagtgaattttaa

SEQ ID NO: 5077647 - DNA, 21 bp, Homo sapiens
aaaagtacatatttattttct

SEQ ID NO: 5077648 - DNA, 21 bp, Homo sapiens
aaaagtacatttaatacagca

SEQ ID NO: 5077649 - DNA, 14 bp, Homo sapiens
aaaagtaccataga

SEQ ID NO: 5077650 - DNA, 16 bp, Homo sapiens
aaaagtactgaagacc

SEQ ID NO: 5077651 - DNA, 17 bp, Homo sapiens
aaaagtagaactttgta

SEQ ID NO: 5077652 - DNA, 20 bp, Homo sapiens
aaaagtagaactttgtatag

SEQ ID NO: 5077653 - DNA, 15 bp, Homo sapiens
aaaagtagaattata

SEQ ID NO: 5077654 - DNA, 22 bp, Homo sapiens
aaaagtagattaaaatatttgc

SEQ ID NO: 5077655 - DNA, 13 bp, Homo sapiens
aaaagtagcaatt

SEQ ID NO: 5077656 - DNA, 20 bp, Homo sapiens
aaaagtaggtttacattcat

SEQ ID NO: 5077657 - DNA, 15 bp, Homo sapiens
aaaagtagtaaattt

SEQ ID NO: 5077658 - DNA, 17 bp, Homo sapiens
aaaagtagttagccaat

SEQ ID NO: 5077659 - DNA, 22 bp, Homo sapiens
aaaagtagtttgaatgttttgt

SEQ ID NO: 5077660 - DNA, 13 bp, Homo sapiens
aaaagtatatgtt

SEQ ID NO: 5077661 - DNA, 18 bp, Homo sapiens
aaaagtatcactctaaaa

SEQ ID NO: 5077662 - DNA, 18 bp, Homo sapiens
aaaagtatctttaacaat

SEQ ID NO: 5077663 - DNA, 19 bp, Homo sapiens
aaaagtatgttagtgcaaa

SEQ ID NO: 5077664 - DNA, 23 bp, Homo sapiens
aaaagtatgttctaacctttaca

SEQ ID NO: 5077665 - DNA, 22 bp, Homo sapiens
aaaagtattattttccaaaagt

SEQ ID NO: 5077666 - DNA, 15 bp, Homo sapiens
aaaagtattctcaaa

SEQ ID NO: 5077667 - DNA, 14 bp, Homo sapiens
aaaagtattgccaa

SEQ ID NO: 5077668 - DNA, 12 bp, Homo sapiens
aaaagtattttg

SEQ ID NO: 5077669 - DNA, 15 bp, Homo sapiens
aaaagtattttgaag

SEQ ID NO: 5077670 - DNA, 16 bp, Homo sapiens
aaaagtattttgaagt

SEQ ID NO: 5077671 - DNA, 19 bp, Homo sapiens
aaaagtattttgaagttta

SEQ ID NO: 5077672 - DNA, 20 bp, Homo sapiens
aaaagtcaaagtgttgctgt

SEQ ID NO: 5077673 - DNA, 16 bp, Homo sapiens
aaaagtcaacaaactg

SEQ ID NO: 5077674 - DNA, 14 bp, Homo sapiens
aaaagtcacaatgt

SEQ ID NO: 5077675 - DNA, 16 bp, Homo sapiens
aaaagtcacacagaca

SEQ ID NO: 5077676 - DNA, 18 bp, Homo sapiens
aaaagtcacacagacaca

SEQ ID NO: 5077677 - DNA, 13 bp, Homo sapiens
aaaagtcacagtt

SEQ ID NO: 5077678 - DNA, 20 bp, Homo sapiens
aaaagtcaccattctgcatt

SEQ ID NO: 5077679 - DNA, 14 bp, Homo sapiens
aaaagtcagagtta

SEQ ID NO: 5077680 - DNA, 19 bp, Homo sapiens
aaaagtcagagttaaaata

SEQ ID NO: 5077681 - DNA, 22 bp, Homo sapiens
aaaagtcagagttaaaatatat

SEQ ID NO: 5077682 - DNA, 15 bp, Homo sapiens
aaaagtcagatgttt

SEQ ID NO: 5077683 - DNA, 19 bp, Homo sapiens
aaaagtcagcattttctta

SEQ ID NO: 5077684 - DNA, 21 bp, Homo sapiens
aaaagtcagtatcatattatt

SEQ ID NO: 5077685 - DNA, 16 bp, Homo sapiens
aaaagtcattattcct

SEQ ID NO: 5077686 - DNA, 23 bp, Homo sapiens
aaaagtccaatgttgtgtgcatg

SEQ ID NO: 5077687 - DNA, 18 bp, Homo sapiens
aaaagtccaattttaatt

SEQ ID NO: 5077688 - DNA, 20 bp, Homo sapiens
aaaagtccttcagtttagaa

SEQ ID NO: 5077689 - DNA, 23 bp, Homo sapiens
aaaagtccttcagtttagaacct

SEQ ID NO: 5077690 - DNA, 15 bp, Homo sapiens
aaaagtcgttttcca

SEQ ID NO: 5077691 - DNA, 16 bp, Homo sapiens
aaaagtcgttttccaa

SEQ ID NO: 5077692 - DNA, 19 bp, Homo sapiens
aaaagtcgttttccaaact

SEQ ID NO: 5077693 - DNA, 22 bp, Homo sapiens
aaaagtcgttttccaaactgac

SEQ ID NO: 5077694 - DNA, 13 bp, Homo sapiens
aaaagtctccaaa

SEQ ID NO: 5077695 - DNA, 13 bp, Homo sapiens
aaaagtctctatt

SEQ ID NO: 5077696 - DNA, 15 bp, Homo sapiens
aaaagtctctattta

SEQ ID NO: 5077697 - DNA, 12 bp, Homo sapiens
aaaagtctgatt

SEQ ID NO: 5077698 - DNA, 18 bp, Homo sapiens
aaaagtctgcattacatt

SEQ ID NO: 5077699 - DNA, 20 bp, Homo sapiens
aaaagtcttaacaacagctt

SEQ ID NO: 5077700 - DNA, 14 bp, Homo sapiens
aaaagtcttttaaa

SEQ ID NO: 5077701 - DNA, 20 bp, Homo sapiens
aaaagtgaaacgtaattgta

SEQ ID NO: 5077702 - DNA, 15 bp, Homo sapiens
aaaagtgaacttgat

SEQ ID NO: 5077703 - DNA, 17 bp, Homo sapiens
aaaagtgaacttttgta

SEQ ID NO: 5077704 - DNA, 15 bp, Homo sapiens
aaaagtgaagacaga

SEQ ID NO: 5077705 - DNA, 19 bp, Homo sapiens
aaaagtgaagtgaatctga

SEQ ID NO: 5077706 - DNA, 23 bp, Homo sapiens
aaaagtgaagtgaatctgattgc

SEQ ID NO: 5077707 - DNA, 17 bp, Homo sapiens
aaaagtgaatgaaagat

SEQ ID NO: 5077708 - DNA, 17 bp, Homo sapiens
aaaagtgacacagcagc

SEQ ID NO: 5077709 - DNA, 22 bp, Homo sapiens
aaaagtgagatgggaagggctt

SEQ ID NO: 5077710 - DNA, 22 bp, Homo sapiens
aaaagtgatcagcaatgaagaa

SEQ ID NO: 5077711 - DNA, 21 bp, Homo sapiens
aaaagtgatctgtcccctctc

SEQ ID NO: 5077712 - DNA, 20 bp, Homo sapiens
aaaagtgatgtattttcata

SEQ ID NO: 5077713 - DNA, 17 bp, Homo sapiens
aaaagtgatgtgattta

SEQ ID NO: 5077714 - DNA, 22 bp, Homo sapiens
aaaagtgatgtgatttatgcat

SEQ ID NO: 5077715 - DNA, 17 bp, Homo sapiens
aaaagtgattgttggca

SEQ ID NO: 5077716 - DNA, 13 bp, Homo sapiens
aaaagtgcaatgc

SEQ ID NO: 5077717 - DNA, 16 bp, Homo sapiens
aaaagtgcagtagtgt

SEQ ID NO: 5077718 - DNA, 16 bp, Homo sapiens
aaaagtgcatgatggt

SEQ ID NO: 5077719 - DNA, 20 bp, Homo sapiens
aaaagtgccattaacaaatg

SEQ ID NO: 5077720 - DNA, 16 bp, Homo sapiens
aaaagtgctccccaaa

SEQ ID NO: 5077721 - DNA, 20 bp, Homo sapiens
aaaagtgcttagaaagttat

SEQ ID NO: 5077722 - DNA, 16 bp, Homo sapiens
aaaagtggaaaacatc

SEQ ID NO: 5077723 - DNA, 23 bp, Homo sapiens
aaaagtggaatttcttgtttctc

SEQ ID NO: 5077724 - DNA, 17 bp, Homo sapiens
aaaagtggcatagagaa

SEQ ID NO: 5077725 - DNA, 21 bp, Homo sapiens
aaaagtgggccagtgtgggaa

SEQ ID NO: 5077726 - DNA, 17 bp, Homo sapiens
aaaagtgggcttgattc

SEQ ID NO: 5077727 - DNA, 18 bp, Homo sapiens
aaaagtgtacatgaagaa

SEQ ID NO: 5077728 - DNA, 21 bp, Homo sapiens
aaaagtgtattttattcagta

SEQ ID NO: 5077729 - DNA, 9 bp, Homo sapiens
aaaagtgtc

SEQ ID NO: 5077730 - DNA, 20 bp, Homo sapiens
aaaagtgtcaaggggcccta

SEQ ID NO: 5077731 - DNA, 17 bp, Homo sapiens
aaaagtgtctcaaagga

SEQ ID NO: 5077732 - DNA, 21 bp, Homo sapiens
aaaagtgtctcaaaggagctt

SEQ ID NO: 5077733 - DNA, 19 bp, Homo sapiens
aaaagtgtggcttgggcat

SEQ ID NO: 5077734 - DNA, 12 bp, Homo sapiens
aaaagtgttccc

SEQ ID NO: 5077735 - DNA, 13 bp, Homo sapiens
aaaagtgtttatt

SEQ ID NO: 5077736 - DNA, 15 bp, Homo sapiens
aaaagtgttttgaat

SEQ ID NO: 5077737 - DNA, 18 bp, Homo sapiens
aaaagttaaaaaaaataa

SEQ ID NO: 5077738 - DNA, 22 bp, Homo sapiens
aaaagttaaaaaaaataataaa

SEQ ID NO: 5077739 - DNA, 16 bp, Homo sapiens
aaaagttaaactactt

SEQ ID NO: 5077740 - DNA, 19 bp, Homo sapiens
aaaagttaataacagctcc

SEQ ID NO: 5077741 - DNA, 13 bp, Homo sapiens
aaaagttactgca

SEQ ID NO: 5077742 - DNA, 14 bp, Homo sapiens
aaaagttataagaa

SEQ ID NO: 5077743 - DNA, 22 bp, Homo sapiens
aaaagttatataaaggcaagga

SEQ ID NO: 5077744 - DNA, 17 bp, Homo sapiens
aaaagttattaaaattg

SEQ ID NO: 5077745 - DNA, 17 bp, Homo sapiens
aaaagttattaatattt

SEQ ID NO: 5077746 - DNA, 21 bp, Homo sapiens
aaaagttatttatgctataaa

SEQ ID NO: 5077747 - DNA, 22 bp, Homo sapiens
aaaagttccaagagtctaaaga

SEQ ID NO: 5077748 - DNA, 16 bp, Homo sapiens
aaaagttcttaaaaca

SEQ ID NO: 5077749 - DNA, 13 bp, Homo sapiens
aaaagttctttca

SEQ ID NO: 5077750 - DNA, 12 bp, Homo sapiens
aaaagttgaaat

SEQ ID NO: 5077751 - DNA, 20 bp, Homo sapiens
aaaagttgaaccattatact

SEQ ID NO: 5077752 - DNA, 13 bp, Homo sapiens
aaaagttgaattt

SEQ ID NO: 5077753 - DNA, 22 bp, Homo sapiens
aaaagttgataggagacttgta

SEQ ID NO: 5077754 - DNA, 21 bp, Homo sapiens
aaaagttgcagctgttttgtt

SEQ ID NO: 5077755 - DNA, 21 bp, Homo sapiens
aaaagttgcgtttaagttgta

SEQ ID NO: 5077756 - DNA, 20 bp, Homo sapiens
aaaagttggaaggatctgct

SEQ ID NO: 5077757 - DNA, 23 bp, Homo sapiens
aaaagttgggttttctccattca

SEQ ID NO: 5077758 - DNA, 15 bp, Homo sapiens
aaaagttggtatttt

SEQ ID NO: 5077759 - DNA, 21 bp, Homo sapiens
aaaagttggtattttataagc

SEQ ID NO: 5077760 - DNA, 19 bp, Homo sapiens
aaaagttgtaatagagaat

SEQ ID NO: 5077761 - DNA, 15 bp, Homo sapiens
aaaagttgtatgatc

SEQ ID NO: 5077762 - DNA, 12 bp, Homo sapiens
aaaagttgttca

SEQ ID NO: 5077763 - DNA, 18 bp, Homo sapiens
aaaagttgttcaactatt

SEQ ID NO: 5077764 - DNA, 13 bp, Homo sapiens
aaaagttgttctt

SEQ ID NO: 5077765 - DNA, 19 bp, Homo sapiens
aaaagttgtttaataagta

SEQ ID NO: 5077766 - DNA, 15 bp, Homo sapiens
aaaagtttaaaatgt

SEQ ID NO: 5077767 - DNA, 20 bp, Homo sapiens
aaaagtttaaaatgtataag

SEQ ID NO: 5077768 - DNA, 14 bp, Homo sapiens
aaaagtttaatatt

SEQ ID NO: 5077769 - DNA, 16 bp, Homo sapiens
aaaagtttaatattaa

SEQ ID NO: 5077770 - DNA, 20 bp, Homo sapiens
aaaagtttaatattaaagcc

SEQ ID NO: 5077771 - DNA, 22 bp, Homo sapiens
aaaagtttaatattaaagccat

SEQ ID NO: 5077772 - DNA, 14 bp, Homo sapiens
aaaagtttagaact

SEQ ID NO: 5077773 - DNA, 15 bp, Homo sapiens
aaaagtttagaactt

SEQ ID NO: 5077774 - DNA, 20 bp, Homo sapiens
aaaagtttctaatgttattt

SEQ ID NO: 5077775 - DNA, 15 bp, Homo sapiens
aaaagtttctattta

SEQ ID NO: 5077776 - DNA, 17 bp, Homo sapiens
aaaagtttctatttagt

SEQ ID NO: 5077777 - DNA, 22 bp, Homo sapiens
aaaagtttctatttagttattt

SEQ ID NO: 5077778 - DNA, 16 bp, Homo sapiens
aaaagtttgccagaag

SEQ ID NO: 5077779 - DNA, 23 bp, Homo sapiens
aaaagtttgtcctttaactatca

SEQ ID NO: 5077780 - DNA, 12 bp, Homo sapiens
aaaagttttcaa

SEQ ID NO: 5077781 - DNA, 19 bp, Homo sapiens
aaaagttttgatatttatt

SEQ ID NO: 5077782 - DNA, 14 bp, Homo sapiens
aaaagtttttgctt

SEQ ID NO: 5077783 - DNA, 21 bp, Homo sapiens
aaaagttttttttttgtttgt

SEQ ID NO: 5077784 - DNA, 20 bp, Homo sapiens
aaaataaaaaaatacagtaa

SEQ ID NO: 5077785 - DNA, 17 bp, Homo sapiens
aaaataaaaaacatata

SEQ ID NO: 5077786 - DNA, 19 bp, Homo sapiens
aaaataaaaaatctgaaga

SEQ ID NO: 5077787 - DNA, 17 bp, Homo sapiens
aaaataaaaacataaaa

SEQ ID NO: 5077788 - DNA, 13 bp, Homo sapiens
aaaataaaaacca

SEQ ID NO: 5077789 - DNA, 16 bp, Homo sapiens
aaaataaaaaccagaa

SEQ ID NO: 5077790 - DNA, 14 bp, Homo sapiens
aaaataaaaaccat

SEQ ID NO: 5077791 - DNA, 21 bp, Homo sapiens
aaaataaaaaccataaacatt

SEQ ID NO: 5077792 - DNA, 12 bp, Homo sapiens
aaaataaaaagt

SEQ ID NO: 5077793 - DNA, 14 bp, Homo sapiens
aaaataaaaagtta

SEQ ID NO: 5077794 - DNA, 18 bp, Homo sapiens
aaaataaaaatcaaacaa

SEQ ID NO: 5077795 - DNA, 15 bp, Homo sapiens
aaaataaaaatgcta

SEQ ID NO: 5077796 - DNA, 12 bp, Homo sapiens
aaaataaaacaa

SEQ ID NO: 5077797 - DNA, 13 bp, Homo sapiens
aaaataaaacaca

SEQ ID NO: 5077798 - DNA, 18 bp, Homo sapiens
aaaataaaacagtatctc

SEQ ID NO: 5077799 - DNA, 16 bp, Homo sapiens
aaaataaaacatagca

SEQ ID NO: 5077800 - DNA, 23 bp, Homo sapiens
aaaataaaacatcacctatttaa

SEQ ID NO: 5077801 - DNA, 22 bp, Homo sapiens
aaaataaaacattttaaatgga

SEQ ID NO: 5077802 - DNA, 14 bp, Homo sapiens
aaaataaaaccaga

SEQ ID NO: 5077803 - DNA, 16 bp, Homo sapiens
aaaataaaacctcagc

SEQ ID NO: 5077804 - DNA, 14 bp, Homo sapiens
aaaataaaactgtc

SEQ ID NO: 5077805 - DNA, 16 bp, Homo sapiens
aaaataaaataaatta

SEQ ID NO: 5077806 - DNA, 13 bp, Homo sapiens
aaaataaaataag

SEQ ID NO: 5077807 - DNA, 14 bp, Homo sapiens
aaaataaaatattc

SEQ ID NO: 5077808 - DNA, 16 bp, Homo sapiens
aaaataaaatattcac

SEQ ID NO: 5077809 - DNA, 11 bp, Homo sapiens
aaaataaaatg

SEQ ID NO: 5077810 - DNA, 18 bp, Homo sapiens
aaaataaaatgcatttaa

SEQ ID NO: 5077811 - DNA, 14 bp, Homo sapiens
aaaataaaatgttt

SEQ ID NO: 5077812 - DNA, 12 bp, Homo sapiens
aaaataaaatta

SEQ ID NO: 5077813 - DNA, 12 bp, Homo sapiens
aaaataaaattt

SEQ ID NO: 5077814 - DNA, 12 bp, Homo sapiens
aaaataaacaaa

SEQ ID NO: 5077815 - DNA, 15 bp, Homo sapiens
aaaataaacactaca

SEQ ID NO: 5077816 - DNA, 20 bp, Homo sapiens
aaaataaaccaaaggacatt

SEQ ID NO: 5077817 - DNA, 14 bp, Homo sapiens
aaaataaaccaaat

SEQ ID NO: 5077818 - DNA, 22 bp, Homo sapiens
aaaataaaccaaatatgttaaa

SEQ ID NO: 5077819 - DNA, 21 bp, Homo sapiens
aaaataaacgtggattttaaa

SEQ ID NO: 5077820 - DNA, 12 bp, Homo sapiens
aaaataaactag

SEQ ID NO: 5077821 - DNA, 14 bp, Homo sapiens
aaaataaactagtt

SEQ ID NO: 5077822 - DNA, 15 bp, Homo sapiens
aaaataaactagttt

SEQ ID NO: 5077823 - DNA, 21 bp, Homo sapiens
aaaataaactataaaacaaaa

SEQ ID NO: 5077824 - DNA, 12 bp, Homo sapiens
aaaataaacttc

SEQ ID NO: 5077825 - DNA, 15 bp, Homo sapiens
aaaataaacttctta

SEQ ID NO: 5077826 - DNA, 14 bp, Homo sapiens
aaaataaagaagta

SEQ ID NO: 5077827 - DNA, 20 bp, Homo sapiens
aaaataaagaatagcaatta

SEQ ID NO: 5077828 - DNA, 13 bp, Homo sapiens
aaaataaagaatg

SEQ ID NO: 5077829 - DNA, 16 bp, Homo sapiens
aaaataaagaatggaa

SEQ ID NO: 5077830 - DNA, 14 bp, Homo sapiens
aaaataaagcaatg

SEQ ID NO: 5077831 - DNA, 12 bp, Homo sapiens
aaaataaagcta

SEQ ID NO: 5077832 - DNA, 15 bp, Homo sapiens
aaaataaagctactg

SEQ ID NO: 5077833 - DNA, 17 bp, Homo sapiens
aaaataaagctgttctc

SEQ ID NO: 5077834 - DNA, 23 bp, Homo sapiens
aaaataaagcttttgcatagaat

SEQ ID NO: 5077835 - DNA, 22 bp, Homo sapiens
aaaataaaggataactctgtat

SEQ ID NO: 5077836 - DNA, 18 bp, Homo sapiens
aaaataaaggctctgtgc

SEQ ID NO: 5077837 - DNA, 11 bp, Homo sapiens
aaaataaagtg

SEQ ID NO: 5077838 - DNA, 12 bp, Homo sapiens
aaaataaataaa

SEQ ID NO: 5077839 - DNA, 22 bp, Homo sapiens
aaaataaataccaattatggaa

SEQ ID NO: 5077840 - DNA, 15 bp, Homo sapiens
aaaataaatagaaaa

SEQ ID NO: 5077841 - DNA, 12 bp, Homo sapiens
aaaataaatata

SEQ ID NO: 5077842 - DNA, 22 bp, Homo sapiens
aaaataaatataattgggattt

SEQ ID NO: 5077843 - DNA, 13 bp, Homo sapiens
aaaataaatatac

SEQ ID NO: 5077844 - DNA, 17 bp, Homo sapiens
aaaataaatatactaat

SEQ ID NO: 5077845 - DNA, 15 bp, Homo sapiens
aaaataaatatatat

SEQ ID NO: 5077846 - DNA, 23 bp, Homo sapiens
aaaataaatattgtctttttgta

SEQ ID NO: 5077847 - DNA, 19 bp, Homo sapiens
aaaataaatcttagtgttc

SEQ ID NO: 5077848 - DNA, 12 bp, Homo sapiens
aaaataaatgga

SEQ ID NO: 5077849 - DNA, 15 bp, Homo sapiens
aaaataaatggaaat

SEQ ID NO: 5077850 - DNA, 13 bp, Homo sapiens
aaaataaatgttt

SEQ ID NO: 5077851 - DNA, 14 bp, Homo sapiens
aaaataaattaata

SEQ ID NO: 5077852 - DNA, 14 bp, Homo sapiens
aaaataaattagaa

SEQ ID NO: 5077853 - DNA, 13 bp, Homo sapiens
aaaataaattatg

SEQ ID NO: 5077854 - DNA, 15 bp, Homo sapiens
aaaataaattttgaa

SEQ ID NO: 5077855 - DNA, 20 bp, Homo sapiens
aaaataaatttttataagga

SEQ ID NO: 5077856 - DNA, 21 bp, Homo sapiens
aaaataacaactaacttgttt

SEQ ID NO: 5077857 - DNA, 19 bp, Homo sapiens
aaaataacaactatttttg

SEQ ID NO: 5077858 - DNA, 13 bp, Homo sapiens
aaaataacatatt

SEQ ID NO: 5077859 - DNA, 16 bp, Homo sapiens
aaaataacatctgaaa

SEQ ID NO: 5077860 - DNA, 16 bp, Homo sapiens
aaaataaccccaaaat

SEQ ID NO: 5077861 - DNA, 20 bp, Homo sapiens
aaaataaccctttggttttt

SEQ ID NO: 5077862 - DNA, 12 bp, Homo sapiens
aaaataactatc

SEQ ID NO: 5077863 - DNA, 12 bp, Homo sapiens
aaaataactgta

SEQ ID NO: 5077864 - DNA, 13 bp, Homo sapiens
aaaataactgtaa

SEQ ID NO: 5077865 - DNA, 15 bp, Homo sapiens
aaaataacttatatc

SEQ ID NO: 5077866 - DNA, 15 bp, Homo sapiens
aaaataagaaaagat

SEQ ID NO: 5077867 - DNA, 15 bp, Homo sapiens
aaaataagaaagaat

SEQ ID NO: 5077868 - DNA, 23 bp, Homo sapiens
aaaataagaaagaattgcagtaa

SEQ ID NO: 5077869 - DNA, 22 bp, Homo sapiens
aaaataagagatagcagaggaa

SEQ ID NO: 5077870 - DNA, 20 bp, Homo sapiens
aaaataagtaacatataaat

SEQ ID NO: 5077871 - DNA, 12 bp, Homo sapiens
aaaataagtgaa

SEQ ID NO: 5077872 - DNA, 13 bp, Homo sapiens
aaaataagtgaat

SEQ ID NO: 5077873 - DNA, 21 bp, Homo sapiens
aaaataagtgaataataatta

SEQ ID NO: 5077874 - DNA, 16 bp, Homo sapiens
aaaataagttaaaggc

SEQ ID NO: 5077875 - DNA, 12 bp, Homo sapiens
aaaataagtttt

SEQ ID NO: 5077876 - DNA, 22 bp, Homo sapiens
aaaataataaagtggcatttct

SEQ ID NO: 5077877 - DNA, 13 bp, Homo sapiens
aaaataataataa

SEQ ID NO: 5077878 - DNA, 17 bp, Homo sapiens
aaaataataataaagtg

SEQ ID NO: 5077879 - DNA, 15 bp, Homo sapiens
aaaataataatagta

SEQ ID NO: 5077880 - DNA, 12 bp, Homo sapiens
aaaataataatt

SEQ ID NO: 5077881 - DNA, 23 bp, Homo sapiens
aaaataatactgctgagatacat

SEQ ID NO: 5077882 - DNA, 15 bp, Homo sapiens
aaaataatataaatg

SEQ ID NO: 5077883 - DNA, 23 bp, Homo sapiens
aaaataatattaatttatttaat

SEQ ID NO: 5077884 - DNA, 18 bp, Homo sapiens
aaaataatcaagtgcatt

SEQ ID NO: 5077885 - DNA, 14 bp, Homo sapiens
aaaataatctctga

SEQ ID NO: 5077886 - DNA, 13 bp, Homo sapiens
aaaataatctgaa

SEQ ID NO: 5077887 - DNA, 18 bp, Homo sapiens
aaaataatctggtgttct

SEQ ID NO: 5077888 - DNA, 20 bp, Homo sapiens
aaaataatggagaatcactt

SEQ ID NO: 5077889 - DNA, 19 bp, Homo sapiens
aaaataattaggtattttc

SEQ ID NO: 5077890 - DNA, 12 bp, Homo sapiens
aaaataattatc

SEQ ID NO: 5077891 - DNA, 14 bp, Homo sapiens
aaaataattattta

SEQ ID NO: 5077892 - DNA, 14 bp, Homo sapiens
aaaataattctaaa

SEQ ID NO: 5077893 - DNA, 22 bp, Homo sapiens
aaaataattgagactgaaagaa

SEQ ID NO: 5077894 - DNA, 13 bp, Homo sapiens
aaaataattgggt

SEQ ID NO: 5077895 - DNA, 22 bp, Homo sapiens
aaaataatttaactaatttaaa

SEQ ID NO: 5077896 - DNA, 18 bp, Homo sapiens
aaaataattttaaaaatg

SEQ ID NO: 5077897 - DNA, 20 bp, Homo sapiens
aaaataattttaaacaaagg

SEQ ID NO: 5077898 - DNA, 14 bp, Homo sapiens
aaaataattttatg

SEQ ID NO: 5077899 - DNA, 15 bp, Homo sapiens
aaaataattttatga

SEQ ID NO: 5077900 - DNA, 23 bp, Homo sapiens
aaaataatttttatatttgaaat

SEQ ID NO: 5077901 - DNA, 11 bp, Homo sapiens
aaaatacaact

SEQ ID NO: 5077902 - DNA, 17 bp, Homo sapiens
aaaatacaagactgcca

SEQ ID NO: 5077903 - DNA, 13 bp, Homo sapiens
aaaatacaatgtt

SEQ ID NO: 5077904 - DNA, 14 bp, Homo sapiens
aaaatacaattatt

SEQ ID NO: 5077905 - DNA, 15 bp, Homo sapiens
aaaatacaattttta

SEQ ID NO: 5077906 - DNA, 12 bp, Homo sapiens
aaaatacacacc

SEQ ID NO: 5077907 - DNA, 12 bp, Homo sapiens
aaaatacacatg

SEQ ID NO: 5077908 - DNA, 14 bp, Homo sapiens
aaaatacacatgaa

SEQ ID NO: 5077909 - DNA, 19 bp, Homo sapiens
aaaatacaccacgaatttg

SEQ ID NO: 5077910 - DNA, 17 bp, Homo sapiens
aaaatacacgtttatct

SEQ ID NO: 5077911 - DNA, 21 bp, Homo sapiens
aaaatacacgtttatcttaca

SEQ ID NO: 5077912 - DNA, 22 bp, Homo sapiens
aaaatacataaaagaatgtaca

SEQ ID NO: 5077913 - DNA, 14 bp, Homo sapiens
aaaatacatactat

SEQ ID NO: 5077914 - DNA, 16 bp, Homo sapiens
aaaatacatagtgaaa

SEQ ID NO: 5077915 - DNA, 12 bp, Homo sapiens
aaaatacattct

SEQ ID NO: 5077916 - DNA, 17 bp, Homo sapiens
aaaatacatttgtaagt

SEQ ID NO: 5077917 - DNA, 18 bp, Homo sapiens
aaaataccaaatgcctgt

SEQ ID NO: 5077918 - DNA, 16 bp, Homo sapiens
aaaataccaatcacaa

SEQ ID NO: 5077919 - DNA, 20 bp, Homo sapiens
aaaataccactgtaattgac

SEQ ID NO: 5077920 - DNA, 21 bp, Homo sapiens
aaaataccagagccttcaagt

SEQ ID NO: 5077921 - DNA, 23 bp, Homo sapiens
aaaataccagagccttcaagtgc

SEQ ID NO: 5077922 - DNA, 15 bp, Homo sapiens
aaaataccagtgttg

SEQ ID NO: 5077923 - DNA, 21 bp, Homo sapiens
aaaataccataggaagacata

SEQ ID NO: 5077924 - DNA, 17 bp, Homo sapiens
aaaataccattgaaatc

SEQ ID NO: 5077925 - DNA, 18 bp, Homo sapiens
aaaatacctcaggaaaga

SEQ ID NO: 5077926 - DNA, 20 bp, Homo sapiens
aaaatacctcaggaaagaat

SEQ ID NO: 5077927 - DNA, 24 bp, Homo sapiens
aaaatacctcaggaaagaatagaa

SEQ ID NO: 5077928 - DNA, 20 bp, Homo sapiens
aaaatacgatcggtttcata

SEQ ID NO: 5077929 - DNA, 20 bp, Homo sapiens
aaaatacgttttgtgtatat

SEQ ID NO: 5077930 - DNA, 22 bp, Homo sapiens
aaaatactatattaaattctga

SEQ ID NO: 5077931 - DNA, 22 bp, Homo sapiens
aaaatactattggacagacaca

SEQ ID NO: 5077932 - DNA, 16 bp, Homo sapiens
aaaatactatttaaga

SEQ ID NO: 5077933 - DNA, 22 bp, Homo sapiens
aaaatactatttttactgccac

SEQ ID NO: 5077934 - DNA, 15 bp, Homo sapiens
aaaatactctaattc

SEQ ID NO: 5077935 - DNA, 21 bp, Homo sapiens
aaaatactgggattacaggct

SEQ ID NO: 5077936 - DNA, 15 bp, Homo sapiens
aaaatactgtagata

SEQ ID NO: 5077937 - DNA, 12 bp, Homo sapiens
aaaatactgttt

SEQ ID NO: 5077938 - DNA, 19 bp, Homo sapiens
aaaatactgtttcactaat

SEQ ID NO: 5077939 - DNA, 15 bp, Homo sapiens
aaaatacttaaatgt

SEQ ID NO: 5077940 - DNA, 20 bp, Homo sapiens
aaaatacttaaatgttatgt

SEQ ID NO: 5077941 - DNA, 11 bp, Homo sapiens
aaaatacttct

SEQ ID NO: 5077942 - DNA, 21 bp, Homo sapiens
aaaatacttgtcaatatttaa

SEQ ID NO: 5077943 - DNA, 18 bp, Homo sapiens
aaaatactttgagttttg

SEQ ID NO: 5077944 - DNA, 18 bp, Homo sapiens
aaaatactttgattttta

SEQ ID NO: 5077945 - DNA, 14 bp, Homo sapiens
aaaatacttttgca

SEQ ID NO: 5077946 - DNA, 19 bp, Homo sapiens
aaaatactttttctaatga

SEQ ID NO: 5077947 - DNA, 17 bp, Homo sapiens
aaaatagaaaaagtgga

SEQ ID NO: 5077948 - DNA, 12 bp, Homo sapiens
aaaatagaaaag

SEQ ID NO: 5077949 - DNA, 15 bp, Homo sapiens
aaaatagaaacatat

SEQ ID NO: 5077950 - DNA, 13 bp, Homo sapiens
aaaatagaaatta

SEQ ID NO: 5077951 - DNA, 18 bp, Homo sapiens
aaaatagaagaagaggaa

SEQ ID NO: 5077952 - DNA, 14 bp, Homo sapiens
aaaatagaagaata

SEQ ID NO: 5077953 - DNA, 15 bp, Homo sapiens
aaaatagaagctgta

SEQ ID NO: 5077954 - DNA, 20 bp, Homo sapiens
aaaatagaatatagcatctt

SEQ ID NO: 5077955 - DNA, 15 bp, Homo sapiens
aaaatagaatatata

SEQ ID NO: 5077956 - DNA, 19 bp, Homo sapiens
aaaatagaatccaaaccca

SEQ ID NO: 5077957 - DNA, 15 bp, Homo sapiens
aaaatagagagagag

SEQ ID NO: 5077958 - DNA, 22 bp, Homo sapiens
aaaatagagagagaggtattta

SEQ ID NO: 5077959 - DNA, 21 bp, Homo sapiens
aaaatagagagtatacagtcc

SEQ ID NO: 5077960 - DNA, 20 bp, Homo sapiens
aaaatagagcaaaatcaaca

SEQ ID NO: 5077961 - DNA, 21 bp, Homo sapiens
aaaatagagcaaaatcaacat

SEQ ID NO: 5077962 - DNA, 13 bp, Homo sapiens
aaaatagagcaag

SEQ ID NO: 5077963 - DNA, 19 bp, Homo sapiens
aaaatagaggctttgagca

SEQ ID NO: 5077964 - DNA, 17 bp, Homo sapiens
aaaatagatgtctttta

SEQ ID NO: 5077965 - DNA, 14 bp, Homo sapiens
aaaatagatgtttt

SEQ ID NO: 5077966 - DNA, 22 bp, Homo sapiens
aaaatagatgttttaacttatt

SEQ ID NO: 5077967 - DNA, 19 bp, Homo sapiens
aaaatagcaaaatattatc

SEQ ID NO: 5077968 - DNA, 22 bp, Homo sapiens
aaaatagcacatccaccaaact

SEQ ID NO: 5077969 - DNA, 10 bp, Homo sapiens
aaaatagcca

SEQ ID NO: 5077970 - DNA, 16 bp, Homo sapiens
aaaatagcgttcttgt

SEQ ID NO: 5077971 - DNA, 20 bp, Homo sapiens
aaaatagcgttcttgtaatt

SEQ ID NO: 5077972 - DNA, 20 bp, Homo sapiens
aaaatagctaaatacctcaa

SEQ ID NO: 5077973 - DNA, 16 bp, Homo sapiens
aaaatagctataaata

SEQ ID NO: 5077974 - DNA, 17 bp, Homo sapiens
aaaatagctcttgcttt

SEQ ID NO: 5077975 - DNA, 12 bp, Homo sapiens
aaaatagcttgt

SEQ ID NO: 5077976 - DNA, 13 bp, Homo sapiens
aaaatagcttgta

SEQ ID NO: 5077977 - DNA, 19 bp, Homo sapiens
aaaatagcttgtatagtgt

SEQ ID NO: 5077978 - DNA, 15 bp, Homo sapiens
aaaataggatttgca

SEQ ID NO: 5077979 - DNA, 21 bp, Homo sapiens
aaaataggctttttaatcatg

SEQ ID NO: 5077980 - DNA, 22 bp, Homo sapiens
aaaataggctttttaggaactc

SEQ ID NO: 5077981 - DNA, 20 bp, Homo sapiens
aaaatagggtatattttcct

SEQ ID NO: 5077982 - DNA, 21 bp, Homo sapiens
aaaatagggtatattttccta

SEQ ID NO: 5077983 - DNA, 20 bp, Homo sapiens
aaaataggtgcaataatgat

SEQ ID NO: 5077984 - DNA, 18 bp, Homo sapiens
aaaatagtaaatgctttg

SEQ ID NO: 5077985 - DNA, 21 bp, Homo sapiens
aaaatagtagaacaagcaaca

SEQ ID NO: 5077986 - DNA, 15 bp, Homo sapiens
aaaatagtattgctg

SEQ ID NO: 5077987 - DNA, 17 bp, Homo sapiens
aaaatagtcatgattct

SEQ ID NO: 5077988 - DNA, 22 bp, Homo sapiens
aaaatagtcatgtttctgcagt

SEQ ID NO: 5077989 - DNA, 13 bp, Homo sapiens
aaaatagtctttt

SEQ ID NO: 5077990 - DNA, 18 bp, Homo sapiens
aaaatagtggtgtgattt

SEQ ID NO: 5077991 - DNA, 12 bp, Homo sapiens
aaaatagtgtaa

SEQ ID NO: 5077992 - DNA, 15 bp, Homo sapiens
aaaatagtgtaagaa

SEQ ID NO: 5077993 - DNA, 17 bp, Homo sapiens
aaaatagtgtaagaact

SEQ ID NO: 5077994 - DNA, 19 bp, Homo sapiens
aaaatagtgtaagaactgt

SEQ ID NO: 5077995 - DNA, 17 bp, Homo sapiens
aaaatagttctatttct

SEQ ID NO: 5077996 - DNA, 23 bp, Homo sapiens
aaaatagttctatttctatctgc

SEQ ID NO: 5077997 - DNA, 18 bp, Homo sapiens
aaaatagttgagccagca

SEQ ID NO: 5077998 - DNA, 20 bp, Homo sapiens
aaaatagtttaaaaatattc

SEQ ID NO: 5077999 - DNA, 16 bp, Homo sapiens
aaaatagtttggatat

SEQ ID NO: 5078000 - DNA, 22 bp, Homo sapiens
aaaatagtttggatatgtaaaa

SEQ ID NO: 5078001 - DNA, 15 bp, Homo sapiens
aaaatagttttacat

SEQ ID NO: 5078002 - DNA, 12 bp, Homo sapiens
aaaatagttttc

SEQ ID NO: 5078003 - DNA, 23 bp, Homo sapiens
aaaatagttttctaaatgtttct

SEQ ID NO: 5078004 - DNA, 13 bp, Homo sapiens
aaaatataaaata

SEQ ID NO: 5078005 - DNA, 17 bp, Homo sapiens
aaaatataaaatttctg

SEQ ID NO: 5078006 - DNA, 15 bp, Homo sapiens
aaaatataaacaaag

SEQ ID NO: 5078007 - DNA, 11 bp, Homo sapiens
aaaatataaat

SEQ ID NO: 5078008 - DNA, 15 bp, Homo sapiens
aaaatataaatgcat

SEQ ID NO: 5078009 - DNA, 13 bp, Homo sapiens
aaaatataaattg

SEQ ID NO: 5078010 - DNA, 10 bp, Homo sapiens
aaaatataac

SEQ ID NO: 5078011 - DNA, 19 bp, Homo sapiens
aaaatataaccattacatg

SEQ ID NO: 5078012 - DNA, 15 bp, Homo sapiens
aaaatataattgttt

SEQ ID NO: 5078013 - DNA, 14 bp, Homo sapiens
aaaatatacatttg

SEQ ID NO: 5078014 - DNA, 13 bp, Homo sapiens
aaaatatactgta

SEQ ID NO: 5078015 - DNA, 23 bp, Homo sapiens
aaaatatactgtaaagaaagaga

SEQ ID NO: 5078016 - DNA, 13 bp, Homo sapiens
aaaatatagctaa

SEQ ID NO: 5078017 - DNA, 21 bp, Homo sapiens
aaaatatagctgtacaaatat

SEQ ID NO: 5078018 - DNA, 21 bp, Homo sapiens
aaaatatagttaattgtggct

SEQ ID NO: 5078019 - DNA, 14 bp, Homo sapiens
aaaatatatactaa

SEQ ID NO: 5078020 - DNA, 21 bp, Homo sapiens
aaaatatatataaatatatat

SEQ ID NO: 5078021 - DNA, 23 bp, Homo sapiens
aaaatatatatagaaatatatac

SEQ ID NO: 5078022 - DNA, 15 bp, Homo sapiens
aaaatatatatataa

SEQ ID NO: 5078023 - DNA, 19 bp, Homo sapiens
aaaatatatatatatattt

SEQ ID NO: 5078024 - DNA, 18 bp, Homo sapiens
aaaatatatatgtgcagt

SEQ ID NO: 5078025 - DNA, 12 bp, Homo sapiens
aaaatatatgaa

SEQ ID NO: 5078026 - DNA, 17 bp, Homo sapiens
aaaatatatgaagacaa

SEQ ID NO: 5078027 - DNA, 11 bp, Homo sapiens
aaaatatatgt

SEQ ID NO: 5078028 - DNA, 14 bp, Homo sapiens
aaaatatatgtatt

SEQ ID NO: 5078029 - DNA, 16 bp, Homo sapiens
aaaatatatgtatttt

SEQ ID NO: 5078030 - DNA, 21 bp, Homo sapiens
aaaatatatgttctgcaagaa

SEQ ID NO: 5078031 - DNA, 16 bp, Homo sapiens
aaaatatatgttgaat

SEQ ID NO: 5078032 - DNA, 17 bp, Homo sapiens
aaaatatattaaaaata

SEQ ID NO: 5078033 - DNA, 13 bp, Homo sapiens
aaaatatattgaa

SEQ ID NO: 5078034 - DNA, 15 bp, Homo sapiens
aaaatatattgaata

SEQ ID NO: 5078035 - DNA, 14 bp, Homo sapiens
aaaatatatttaat

SEQ ID NO: 5078036 - DNA, 18 bp, Homo sapiens
aaaatatatttaatatgt

SEQ ID NO: 5078037 - DNA, 18 bp, Homo sapiens
aaaatatatttataagga

SEQ ID NO: 5078038 - DNA, 19 bp, Homo sapiens
aaaatatcaagtactacat

SEQ ID NO: 5078039 - DNA, 18 bp, Homo sapiens
aaaatatcacactgaata

SEQ ID NO: 5078040 - DNA, 19 bp, Homo sapiens
aaaatatcacactgaataa

SEQ ID NO: 5078041 - DNA, 21 bp, Homo sapiens
aaaatatccaagcccagccta

SEQ ID NO: 5078042 - DNA, 13 bp, Homo sapiens
aaaatatcccttt

SEQ ID NO: 5078043 - DNA, 14 bp, Homo sapiens
aaaatatctgaata

SEQ ID NO: 5078044 - DNA, 12 bp, Homo sapiens
aaaatatcttgg

SEQ ID NO: 5078045 - DNA, 15 bp, Homo sapiens
aaaatatctttgcat

SEQ ID NO: 5078046 - DNA, 12 bp, Homo sapiens
aaaatatgaaat

SEQ ID NO: 5078047 - DNA, 13 bp, Homo sapiens
aaaatatgatact

SEQ ID NO: 5078048 - DNA, 14 bp, Homo sapiens
aaaatatgcactaa

SEQ ID NO: 5078049 - DNA, 20 bp, Homo sapiens
aaaatatgggttgcatttgg

SEQ ID NO: 5078050 - DNA, 21 bp, Homo sapiens
aaaatatgtaagaacacattt

SEQ ID NO: 5078051 - DNA, 14 bp, Homo sapiens
aaaatatgtaattt

SEQ ID NO: 5078052 - DNA, 16 bp, Homo sapiens
aaaatatgtaatttca

SEQ ID NO: 5078053 - DNA, 13 bp, Homo sapiens
aaaatatgtatta

SEQ ID NO: 5078054 - DNA, 14 bp, Homo sapiens
aaaatatgtattaa

SEQ ID NO: 5078055 - DNA, 13 bp, Homo sapiens
aaaatatgtcaac

SEQ ID NO: 5078056 - DNA, 20 bp, Homo sapiens
aaaatatgtcccagaaatgt

SEQ ID NO: 5078057 - DNA, 13 bp, Homo sapiens
aaaatatgtgaag

SEQ ID NO: 5078058 - DNA, 18 bp, Homo sapiens
aaaatatgtgaagttttc

SEQ ID NO: 5078059 - DNA, 21 bp, Homo sapiens
aaaatatgtgagcatgaaact

SEQ ID NO: 5078060 - DNA, 14 bp, Homo sapiens
aaaatatgttcttt

SEQ ID NO: 5078061 - DNA, 23 bp, Homo sapiens
aaaatattactctagtttattct

SEQ ID NO: 5078062 - DNA, 19 bp, Homo sapiens
aaaatattacttatttatc

SEQ ID NO: 5078063 - DNA, 14 bp, Homo sapiens
aaaatattatattt

SEQ ID NO: 5078064 - DNA, 21 bp, Homo sapiens
aaaatattatctttgtaatta

SEQ ID NO: 5078065 - DNA, 20 bp, Homo sapiens
aaaatattcaataagagatt

SEQ ID NO: 5078066 - DNA, 12 bp, Homo sapiens
aaaatattcact

SEQ ID NO: 5078067 - DNA, 14 bp, Homo sapiens
aaaatattcatata

SEQ ID NO: 5078068 - DNA, 15 bp, Homo sapiens
aaaatattcctgcat

SEQ ID NO: 5078069 - DNA, 20 bp, Homo sapiens
aaaatattctaacatttgat

SEQ ID NO: 5078070 - DNA, 15 bp, Homo sapiens
aaaatattctgattg

SEQ ID NO: 5078071 - DNA, 19 bp, Homo sapiens
aaaatattcttctttgata

SEQ ID NO: 5078072 - DNA, 20 bp, Homo sapiens
aaaatattggtattaaagaa

SEQ ID NO: 5078073 - DNA, 20 bp, Homo sapiens
aaaatattgtgtaagaatca

SEQ ID NO: 5078074 - DNA, 22 bp, Homo sapiens
aaaatattgtgtaagaatcact

SEQ ID NO: 5078075 - DNA, 22 bp, Homo sapiens
aaaatattgtttctgcattcat

SEQ ID NO: 5078076 - DNA, 23 bp, Homo sapiens
aaaatattgtttctgcattcatt

SEQ ID NO: 5078077 - DNA, 16 bp, Homo sapiens
aaaatatttaaaaatg

SEQ ID NO: 5078078 - DNA, 17 bp, Homo sapiens
aaaatatttaatatcaa

SEQ ID NO: 5078079 - DNA, 18 bp, Homo sapiens
aaaatatttaatatcaaa

SEQ ID NO: 5078080 - DNA, 14 bp, Homo sapiens
aaaatatttatgaa

SEQ ID NO: 5078081 - DNA, 11 bp, Homo sapiens
aaaatatttca

SEQ ID NO: 5078082 - DNA, 14 bp, Homo sapiens
aaaatatttcagat

SEQ ID NO: 5078083 - DNA, 19 bp, Homo sapiens
aaaatatttcagatatcaa

SEQ ID NO: 5078084 - DNA, 20 bp, Homo sapiens
aaaatatttcccctagtttt

SEQ ID NO: 5078085 - DNA, 13 bp, Homo sapiens
aaaatatttctaa

SEQ ID NO: 5078086 - DNA, 17 bp, Homo sapiens
aaaatatttctaagctt

SEQ ID NO: 5078087 - DNA, 14 bp, Homo sapiens
aaaatatttgtgaa

SEQ ID NO: 5078088 - DNA, 23 bp, Homo sapiens
aaaatatttgtgaaagtgccaaa

SEQ ID NO: 5078089 - DNA, 16 bp, Homo sapiens
aaaatattttaagaaa

SEQ ID NO: 5078090 - DNA, 21 bp, Homo sapiens
aaaatattttaagaaagagaa

SEQ ID NO: 5078091 - DNA, 18 bp, Homo sapiens
aaaatattttacccaaat

SEQ ID NO: 5078092 - DNA, 17 bp, Homo sapiens
aaaatattttagatgtt

SEQ ID NO: 5078093 - DNA, 14 bp, Homo sapiens
aaaatattttatct

SEQ ID NO: 5078094 - DNA, 15 bp, Homo sapiens
aaaatattttatgat

SEQ ID NO: 5078095 - DNA, 20 bp, Homo sapiens
aaaatattttcatacagcat

SEQ ID NO: 5078096 - DNA, 12 bp, Homo sapiens
aaaatattttct

SEQ ID NO: 5078097 - DNA, 16 bp, Homo sapiens
aaaatattttctgaat

SEQ ID NO: 5078098 - DNA, 18 bp, Homo sapiens
aaaatattttctgtgtgt

SEQ ID NO: 5078099 - DNA, 23 bp, Homo sapiens
aaaatattttctgtgtgttcctg

SEQ ID NO: 5078100 - DNA, 15 bp, Homo sapiens
aaaatattttcttaa

SEQ ID NO: 5078101 - DNA, 18 bp, Homo sapiens
aaaatattttcttaatta

SEQ ID NO: 5078102 - DNA, 19 bp, Homo sapiens
aaaatattttcttaattat

SEQ ID NO: 5078103 - DNA, 15 bp, Homo sapiens
aaaatattttgatct

SEQ ID NO: 5078104 - DNA, 15 bp, Homo sapiens
aaaatatttttaaat

SEQ ID NO: 5078105 - DNA, 23 bp, Homo sapiens
aaaatattttttatatatacagt

SEQ ID NO: 5078106 - DNA, 13 bp, Homo sapiens
aaaatattttttg

SEQ ID NO: 5078107 - DNA, 19 bp, Homo sapiens
aaaatatttttttaagaaa

SEQ ID NO: 5078108 - DNA, 19 bp, Homo sapiens
aaaatatttttttcctttg

SEQ ID NO: 5078109 - DNA, 18 bp, Homo sapiens
aaaatcaaaacaaaaaaa

SEQ ID NO: 5078110 - DNA, 14 bp, Homo sapiens
aaaatcaaaacaag

SEQ ID NO: 5078111 - DNA, 16 bp, Homo sapiens
aaaatcaaaacaagtg

SEQ ID NO: 5078112 - DNA, 14 bp, Homo sapiens
aaaatcaaactgta

SEQ ID NO: 5078113 - DNA, 16 bp, Homo sapiens
aaaatcaaagaacaga

SEQ ID NO: 5078114 - DNA, 14 bp, Homo sapiens
aaaatcaaataata

SEQ ID NO: 5078115 - DNA, 12 bp, Homo sapiens
aaaatcaacttt

SEQ ID NO: 5078116 - DNA, 16 bp, Homo sapiens
aaaatcaacttttgaa

SEQ ID NO: 5078117 - DNA, 18 bp, Homo sapiens
aaaatcaatatgcagaat

SEQ ID NO: 5078118 - DNA, 14 bp, Homo sapiens
aaaatcaatcaatg

SEQ ID NO: 5078119 - DNA, 12 bp, Homo sapiens
aaaatcaattta

SEQ ID NO: 5078120 - DNA, 15 bp, Homo sapiens
aaaatcacaaaaaca

SEQ ID NO: 5078121 - DNA, 18 bp, Homo sapiens
aaaatcacaaaaacaaaa

SEQ ID NO: 5078122 - DNA, 17 bp, Homo sapiens
aaaatcacaagcaataa

SEQ ID NO: 5078123 - DNA, 22 bp, Homo sapiens
aaaatcacaagcaataattagg

SEQ ID NO: 5078124 - DNA, 23 bp, Homo sapiens
aaaatcacactgtaaatatgaat

SEQ ID NO: 5078125 - DNA, 16 bp, Homo sapiens
aaaatcacatcactac

SEQ ID NO: 5078126 - DNA, 15 bp, Homo sapiens
aaaatcactgtttgt

SEQ ID NO: 5078127 - DNA, 21 bp, Homo sapiens
aaaatcactttgtctaactca

SEQ ID NO: 5078128 - DNA, 12 bp, Homo sapiens
aaaatcagaagc

SEQ ID NO: 5078129 - DNA, 16 bp, Homo sapiens
aaaatcagatgaattg

SEQ ID NO: 5078130 - DNA, 17 bp, Homo sapiens
aaaatcagccaattatg

SEQ ID NO: 5078131 - DNA, 19 bp, Homo sapiens
aaaatcagccaattatgtt

SEQ ID NO: 5078132 - DNA, 18 bp, Homo sapiens
aaaatcaggagcctgcta

SEQ ID NO: 5078133 - DNA, 11 bp, Homo sapiens
aaaatcaggat

SEQ ID NO: 5078134 - DNA, 19 bp, Homo sapiens
aaaatcaggcagaaatatt

SEQ ID NO: 5078135 - DNA, 15 bp, Homo sapiens
aaaatcagtttttca

SEQ ID NO: 5078136 - DNA, 19 bp, Homo sapiens
aaaatcagtttttgactga

SEQ ID NO: 5078137 - DNA, 20 bp, Homo sapiens
aaaatcagtttttgttctta

SEQ ID NO: 5078138 - DNA, 21 bp, Homo sapiens
aaaatcagtttttgttcttaa

SEQ ID NO: 5078139 - DNA, 18 bp, Homo sapiens
aaaatcataacattgatt

SEQ ID NO: 5078140 - DNA, 21 bp, Homo sapiens
aaaatcataggaataaaatta

SEQ ID NO: 5078141 - DNA, 14 bp, Homo sapiens
aaaatcatattgct

SEQ ID NO: 5078142 - DNA, 17 bp, Homo sapiens
aaaatcatatttacctg

SEQ ID NO: 5078143 - DNA, 14 bp, Homo sapiens
aaaatcatcaaagt

SEQ ID NO: 5078144 - DNA, 20 bp, Homo sapiens
aaaatcatcaaagtgtttaa

SEQ ID NO: 5078145 - DNA, 13 bp, Homo sapiens
aaaatcatcagaa

SEQ ID NO: 5078146 - DNA, 19 bp, Homo sapiens
aaaatcatgaaaagaggaa

SEQ ID NO: 5078147 - DNA, 17 bp, Homo sapiens
aaaatcatgcttataag

SEQ ID NO: 5078148 - DNA, 15 bp, Homo sapiens
aaaatcatgtttatt

SEQ ID NO: 5078149 - DNA, 10 bp, Homo sapiens
aaaatcattt

SEQ ID NO: 5078150 - DNA, 11 bp, Homo sapiens
aaaatcatttc

SEQ ID NO: 5078151 - DNA, 15 bp, Homo sapiens
aaaatccaaaaagaa

SEQ ID NO: 5078152 - DNA, 15 bp, Homo sapiens
aaaatccaaaaagct

SEQ ID NO: 5078153 - DNA, 17 bp, Homo sapiens
aaaatccaaaaagctct

SEQ ID NO: 5078154 - DNA, 21 bp, Homo sapiens
aaaatccaaaaagctctgaaa

SEQ ID NO: 5078155 - DNA, 16 bp, Homo sapiens
aaaatccaaaatgaat

SEQ ID NO: 5078156 - DNA, 11 bp, Homo sapiens
aaaatccaaac

SEQ ID NO: 5078157 - DNA, 17 bp, Homo sapiens
aaaatccaaactgctgt

SEQ ID NO: 5078158 - DNA, 19 bp, Homo sapiens
aaaatccaaactgctgtct

SEQ ID NO: 5078159 - DNA, 16 bp, Homo sapiens
aaaatccaatattgta

SEQ ID NO: 5078160 - DNA, 12 bp, Homo sapiens
aaaatccactca

SEQ ID NO: 5078161 - DNA, 12 bp, Homo sapiens
aaaatccagaaa

SEQ ID NO: 5078162 - DNA, 18 bp, Homo sapiens
aaaatccagactttcttt

SEQ ID NO: 5078163 - DNA, 20 bp, Homo sapiens
aaaatccagactttcttttt

SEQ ID NO: 5078164 - DNA, 14 bp, Homo sapiens
aaaatccatggata

SEQ ID NO: 5078165 - DNA, 22 bp, Homo sapiens
aaaatccatgtgaccattctgc

SEQ ID NO: 5078166 - DNA, 19 bp, Homo sapiens
aaaatccattccaggtagc

SEQ ID NO: 5078167 - DNA, 22 bp, Homo sapiens
aaaatcccaaagtgccttctga

SEQ ID NO: 5078168 - DNA, 18 bp, Homo sapiens
aaaatcccaaattcactt

SEQ ID NO: 5078169 - DNA, 17 bp, Homo sapiens
aaaatcccccagcactt

SEQ ID NO: 5078170 - DNA, 17 bp, Homo sapiens
aaaatccccttcgctga

SEQ ID NO: 5078171 - DNA, 15 bp, Homo sapiens
aaaatcctcaggaaa

SEQ ID NO: 5078172 - DNA, 15 bp, Homo sapiens
aaaatcctgcccaaa

SEQ ID NO: 5078173 - DNA, 16 bp, Homo sapiens
aaaatccttacttcca

SEQ ID NO: 5078174 - DNA, 19 bp, Homo sapiens
aaaatccttacttccagca

SEQ ID NO: 5078175 - DNA, 15 bp, Homo sapiens
aaaatccttatgcat

SEQ ID NO: 5078176 - DNA, 15 bp, Homo sapiens
aaaatccttcagcaa

SEQ ID NO: 5078177 - DNA, 21 bp, Homo sapiens
aaaatccttccaaagaattct

SEQ ID NO: 5078178 - DNA, 14 bp, Homo sapiens
aaaatccttctaat

SEQ ID NO: 5078179 - DNA, 21 bp, Homo sapiens
aaaatccttgtgacttacaat

SEQ ID NO: 5078180 - DNA, 17 bp, Homo sapiens
aaaatccttttgaatga

SEQ ID NO: 5078181 - DNA, 18 bp, Homo sapiens
aaaatcgaggaagcacct

SEQ ID NO: 5078182 - DNA, 20 bp, Homo sapiens
aaaatcgtattctaattctt

SEQ ID NO: 5078183 - DNA, 22 bp, Homo sapiens
aaaatctaaaacaaaatctgaa

SEQ ID NO: 5078184 - DNA, 24 bp, Homo sapiens
aaaatctaaaatttcataattctg

SEQ ID NO: 5078185 - DNA, 17 bp, Homo sapiens
aaaatctacagaactac

SEQ ID NO: 5078186 - DNA, 20 bp, Homo sapiens
aaaatctaccttctgtagtt

SEQ ID NO: 5078187 - DNA, 12 bp, Homo sapiens
aaaatctacttt

SEQ ID NO: 5078188 - DNA, 18 bp, Homo sapiens
aaaatctagaagagtcta

SEQ ID NO: 5078189 - DNA, 16 bp, Homo sapiens
aaaatctagtatttgt

SEQ ID NO: 5078190 - DNA, 23 bp, Homo sapiens
aaaatctatatttgtcttccgat

SEQ ID NO: 5078191 - DNA, 15 bp, Homo sapiens
aaaatctatattttg

SEQ ID NO: 5078192 - DNA, 14 bp, Homo sapiens
aaaatctattctgt

SEQ ID NO: 5078193 - DNA, 15 bp, Homo sapiens
aaaatctcaaatttc

SEQ ID NO: 5078194 - DNA, 16 bp, Homo sapiens
aaaatctcaatatttc

SEQ ID NO: 5078195 - DNA, 15 bp, Homo sapiens
aaaatctcaattgaa

SEQ ID NO: 5078196 - DNA, 14 bp, Homo sapiens
aaaatctcattatt

SEQ ID NO: 5078197 - DNA, 19 bp, Homo sapiens
aaaatctcccattttggaa

SEQ ID NO: 5078198 - DNA, 19 bp, Homo sapiens
aaaatctctcatttgtgtg

SEQ ID NO: 5078199 - DNA, 16 bp, Homo sapiens
aaaatctctccacttt

SEQ ID NO: 5078200 - DNA, 19 bp, Homo sapiens
aaaatctctccactttcag

SEQ ID NO: 5078201 - DNA, 20 bp, Homo sapiens
aaaatctctccactttcagc

SEQ ID NO: 5078202 - DNA, 22 bp, Homo sapiens
aaaatctctccactttcagctg

SEQ ID NO: 5078203 - DNA, 16 bp, Homo sapiens
aaaatctctctctgtt

SEQ ID NO: 5078204 - DNA, 13 bp, Homo sapiens
aaaatctgaaaat

SEQ ID NO: 5078205 - DNA, 23 bp, Homo sapiens
aaaatctgaaaatgtgaataaaa

SEQ ID NO: 5078206 - DNA, 18 bp, Homo sapiens
aaaatctgaactctcaaa

SEQ ID NO: 5078207 - DNA, 22 bp, Homo sapiens
aaaatctgaactctcaaaagtc

SEQ ID NO: 5078208 - DNA, 14 bp, Homo sapiens
aaaatctgaagatt

SEQ ID NO: 5078209 - DNA, 22 bp, Homo sapiens
aaaatctgaagattgtttatct

SEQ ID NO: 5078210 - DNA, 19 bp, Homo sapiens
aaaatctgaattttgcaat

SEQ ID NO: 5078211 - DNA, 21 bp, Homo sapiens
aaaatctgaattttgcaatgt

SEQ ID NO: 5078212 - DNA, 21 bp, Homo sapiens
aaaatctgagggaaatgtttt

SEQ ID NO: 5078213 - DNA, 16 bp, Homo sapiens
aaaatctgattagaag

SEQ ID NO: 5078214 - DNA, 17 bp, Homo sapiens
aaaatctgatttaatgt

SEQ ID NO: 5078215 - DNA, 20 bp, Homo sapiens
aaaatctgatttaatgtttt

SEQ ID NO: 5078216 - DNA, 22 bp, Homo sapiens
aaaatctgatttaatgttttct

SEQ ID NO: 5078217 - DNA, 19 bp, Homo sapiens
aaaatctgcagaaggaaaa

SEQ ID NO: 5078218 - DNA, 17 bp, Homo sapiens
aaaatctgccacctgca

SEQ ID NO: 5078219 - DNA, 13 bp, Homo sapiens
aaaatctggaaat

SEQ ID NO: 5078220 - DNA, 18 bp, Homo sapiens
aaaatctgtagagcaggg

SEQ ID NO: 5078221 - DNA, 20 bp, Homo sapiens
aaaatctgtcacgtagaact

SEQ ID NO: 5078222 - DNA, 15 bp, Homo sapiens
aaaatctgtcataag

SEQ ID NO: 5078223 - DNA, 16 bp, Homo sapiens
aaaatctgtggtggtc

SEQ ID NO: 5078224 - DNA, 20 bp, Homo sapiens
aaaatcttaatactgttatt

SEQ ID NO: 5078225 - DNA, 22 bp, Homo sapiens
aaaatcttaatactgttattct

SEQ ID NO: 5078226 - DNA, 14 bp, Homo sapiens
aaaatcttaatgta

SEQ ID NO: 5078227 - DNA, 14 bp, Homo sapiens
aaaatcttataaaa

SEQ ID NO: 5078228 - DNA, 20 bp, Homo sapiens
aaaatcttatagttctaggc

SEQ ID NO: 5078229 - DNA, 13 bp, Homo sapiens
aaaatcttcactt

SEQ ID NO: 5078230 - DNA, 12 bp, Homo sapiens
aaaatcttcagc

SEQ ID NO: 5078231 - DNA, 16 bp, Homo sapiens
aaaatcttcagctggt

SEQ ID NO: 5078232 - DNA, 19 bp, Homo sapiens
aaaatcttcagctggtgga

SEQ ID NO: 5078233 - DNA, 15 bp, Homo sapiens
aaaatcttctgatga

SEQ ID NO: 5078234 - DNA, 23 bp, Homo sapiens
aaaatcttgatagctaaataact

SEQ ID NO: 5078235 - DNA, 20 bp, Homo sapiens
aaaatcttgcagttttgtaa

SEQ ID NO: 5078236 - DNA, 20 bp, Homo sapiens
aaaatcttggagaccctgca

SEQ ID NO: 5078237 - DNA, 18 bp, Homo sapiens
aaaatcttggcacagaaa

SEQ ID NO: 5078238 - DNA, 11 bp, Homo sapiens
aaaatcttgtg

SEQ ID NO: 5078239 - DNA, 19 bp, Homo sapiens
aaaatcttgtgctagaata

SEQ ID NO: 5078240 - DNA, 22 bp, Homo sapiens
aaaatcttgtgctagaatactt

SEQ ID NO: 5078241 - DNA, 12 bp, Homo sapiens
aaaatgaaaaat

SEQ ID NO: 5078242 - DNA, 15 bp, Homo sapiens
aaaatgaaaactttt

SEQ ID NO: 5078243 - DNA, 16 bp, Homo sapiens
aaaatgaaaacttttg

SEQ ID NO: 5078244 - DNA, 16 bp, Homo sapiens
aaaatgaaaagagaaa

SEQ ID NO: 5078245 - DNA, 13 bp, Homo sapiens
aaaatgaaaatta

SEQ ID NO: 5078246 - DNA, 13 bp, Homo sapiens
aaaatgaaagatg

SEQ ID NO: 5078247 - DNA, 18 bp, Homo sapiens
aaaatgaaagccaaattt

SEQ ID NO: 5078248 - DNA, 16 bp, Homo sapiens
aaaatgaaatgcatat

SEQ ID NO: 5078249 - DNA, 18 bp, Homo sapiens
aaaatgaaatgcatattt

SEQ ID NO: 5078250 - DNA, 17 bp, Homo sapiens
aaaatgaaatgcatttt

SEQ ID NO: 5078251 - DNA, 17 bp, Homo sapiens
aaaatgaaatttaagca

SEQ ID NO: 5078252 - DNA, 20 bp, Homo sapiens
aaaatgaacatctcttgaaa

SEQ ID NO: 5078253 - DNA, 16 bp, Homo sapiens
aaaatgaacattttgt

SEQ ID NO: 5078254 - DNA, 14 bp, Homo sapiens
aaaatgaactgtat

SEQ ID NO: 5078255 - DNA, 16 bp, Homo sapiens
aaaatgaactgtatat

SEQ ID NO: 5078256 - DNA, 19 bp, Homo sapiens
aaaatgaactgtatattat

SEQ ID NO: 5078257 - DNA, 19 bp, Homo sapiens
aaaatgaactgtattattg

SEQ ID NO: 5078258 - DNA, 21 bp, Homo sapiens
aaaatgaactgtattattgca

SEQ ID NO: 5078259 - DNA, 14 bp, Homo sapiens
aaaatgaagaattt

SEQ ID NO: 5078260 - DNA, 23 bp, Homo sapiens
aaaatgaagacaccagagtgtat

SEQ ID NO: 5078261 - DNA, 15 bp, Homo sapiens
aaaatgaagattatt

SEQ ID NO: 5078262 - DNA, 13 bp, Homo sapiens
aaaatgaagcaat

SEQ ID NO: 5078263 - DNA, 15 bp, Homo sapiens
aaaatgaagcaattt

SEQ ID NO: 5078264 - DNA, 22 bp, Homo sapiens
aaaatgaagcaatttatatctt

SEQ ID NO: 5078265 - DNA, 13 bp, Homo sapiens
aaaatgaagggat

SEQ ID NO: 5078266 - DNA, 15 bp, Homo sapiens
aaaatgaataaaagt

SEQ ID NO: 5078267 - DNA, 20 bp, Homo sapiens
aaaatgaatagcttgtttct

SEQ ID NO: 5078268 - DNA, 22 bp, Homo sapiens
aaaatgaatatctattaatata

SEQ ID NO: 5078269 - DNA, 21 bp, Homo sapiens
aaaatgaatgcaaaattgttt

SEQ ID NO: 5078270 - DNA, 13 bp, Homo sapiens
aaaatgaatgcat

SEQ ID NO: 5078271 - DNA, 15 bp, Homo sapiens
aaaatgaatgtaaaa

SEQ ID NO: 5078272 - DNA, 16 bp, Homo sapiens
aaaatgaattttttcc

SEQ ID NO: 5078273 - DNA, 16 bp, Homo sapiens
aaaatgacaaacatga

SEQ ID NO: 5078274 - DNA, 18 bp, Homo sapiens
aaaatgacaaacatgata

SEQ ID NO: 5078275 - DNA, 19 bp, Homo sapiens
aaaatgacaacagaaaaac

SEQ ID NO: 5078276 - DNA, 15 bp, Homo sapiens
aaaatgacaatatca

SEQ ID NO: 5078277 - DNA, 20 bp, Homo sapiens
aaaatgacaatcatgtgtgt

SEQ ID NO: 5078278 - DNA, 13 bp, Homo sapiens
aaaatgacaatga

SEQ ID NO: 5078279 - DNA, 19 bp, Homo sapiens
aaaatgacaccatctttta

SEQ ID NO: 5078280 - DNA, 17 bp, Homo sapiens
aaaatgacagatgttga

SEQ ID NO: 5078281 - DNA, 16 bp, Homo sapiens
aaaatgacatcttttt

SEQ ID NO: 5078282 - DNA, 19 bp, Homo sapiens
aaaatgaccagtaattgtg

SEQ ID NO: 5078283 - DNA, 19 bp, Homo sapiens
aaaatgactacttagcatc

SEQ ID NO: 5078284 - DNA, 14 bp, Homo sapiens
aaaatgactttgaa

SEQ ID NO: 5078285 - DNA, 17 bp, Homo sapiens
aaaatgactttgaactg

SEQ ID NO: 5078286 - DNA, 15 bp, Homo sapiens
aaaatgacttttatt

SEQ ID NO: 5078287 - DNA, 20 bp, Homo sapiens
aaaatgagaacatgttggta

SEQ ID NO: 5078288 - DNA, 17 bp, Homo sapiens
aaaatgagaatctgtgc

SEQ ID NO: 5078289 - DNA, 20 bp, Homo sapiens
aaaatgagaatctgtgcagt

SEQ ID NO: 5078290 - DNA, 13 bp, Homo sapiens
aaaatgagaattt

SEQ ID NO: 5078291 - DNA, 23 bp, Homo sapiens
aaaatgagagggcagtgtttcct

SEQ ID NO: 5078292 - DNA, 22 bp, Homo sapiens
aaaatgagagtgacggctggca

SEQ ID NO: 5078293 - DNA, 15 bp, Homo sapiens
aaaatgagatttctt

SEQ ID NO: 5078294 - DNA, 13 bp, Homo sapiens
aaaatgagccctg

SEQ ID NO: 5078295 - DNA, 14 bp, Homo sapiens
aaaatgagcctggc

SEQ ID NO: 5078296 - DNA, 22 bp, Homo sapiens
aaaatgagctacttcttattca

SEQ ID NO: 5078297 - DNA, 23 bp, Homo sapiens
aaaatgagctcgcatttgtcaat

SEQ ID NO: 5078298 - DNA, 17 bp, Homo sapiens
aaaatgaggaatccaaa

SEQ ID NO: 5078299 - DNA, 22 bp, Homo sapiens
aaaatgagtcaggcaattgatt

SEQ ID NO: 5078300 - DNA, 23 bp, Homo sapiens
aaaatgagtcatttgtttaaaca

SEQ ID NO: 5078301 - DNA, 22 bp, Homo sapiens
aaaatgagtttgtattattaca

SEQ ID NO: 5078302 - DNA, 15 bp, Homo sapiens
aaaatgatactgtgt

SEQ ID NO: 5078303 - DNA, 13 bp, Homo sapiens
aaaatgatgttat

SEQ ID NO: 5078304 - DNA, 16 bp, Homo sapiens
aaaatgatgttataca

SEQ ID NO: 5078305 - DNA, 23 bp, Homo sapiens
aaaatgattaatgcatttatcaa

SEQ ID NO: 5078306 - DNA, 14 bp, Homo sapiens
aaaatgattcctct

SEQ ID NO: 5078307 - DNA, 20 bp, Homo sapiens
aaaatgattgtaaaatagct

SEQ ID NO: 5078308 - DNA, 20 bp, Homo sapiens
aaaatgattgtctttttcct

SEQ ID NO: 5078309 - DNA, 23 bp, Homo sapiens
aaaatgattttacttagcaatgt

SEQ ID NO: 5078310 - DNA, 21 bp, Homo sapiens
aaaatgatttttaacattatg

SEQ ID NO: 5078311 - DNA, 15 bp, Homo sapiens
aaaatgcaaaataaa

SEQ ID NO: 5078312 - DNA, 17 bp, Homo sapiens
aaaatgcaaagctgaag

SEQ ID NO: 5078313 - DNA, 12 bp, Homo sapiens
aaaatgcaaata

SEQ ID NO: 5078314 - DNA, 14 bp, Homo sapiens
aaaatgcaaatcct

SEQ ID NO: 5078315 - DNA, 18 bp, Homo sapiens
aaaatgcaaatcctatgt

SEQ ID NO: 5078316 - DNA, 20 bp, Homo sapiens
aaaatgcaaatcctatgtga

SEQ ID NO: 5078317 - DNA, 13 bp, Homo sapiens
aaaatgcaaatga

SEQ ID NO: 5078318 - DNA, 17 bp, Homo sapiens
aaaatgcaacaaatgaa

SEQ ID NO: 5078319 - DNA, 15 bp, Homo sapiens
aaaatgcaatatttg

SEQ ID NO: 5078320 - DNA, 21 bp, Homo sapiens
aaaatgcaatcaatttaaatt

SEQ ID NO: 5078321 - DNA, 14 bp, Homo sapiens
aaaatgcacatagc

SEQ ID NO: 5078322 - DNA, 20 bp, Homo sapiens
aaaatgcacccatcagcact

SEQ ID NO: 5078323 - DNA, 22 bp, Homo sapiens
aaaatgcacccatcagcactct

SEQ ID NO: 5078324 - DNA, 14 bp, Homo sapiens
aaaatgcactgtga

SEQ ID NO: 5078325 - DNA, 17 bp, Homo sapiens
aaaatgcacttctattt

SEQ ID NO: 5078326 - DNA, 18 bp, Homo sapiens
aaaatgcacttctattta

SEQ ID NO: 5078327 - DNA, 18 bp, Homo sapiens
aaaatgcagcagggatgc

SEQ ID NO: 5078328 - DNA, 23 bp, Homo sapiens
aaaatgcagccttaaacagtgtc

SEQ ID NO: 5078329 - DNA, 20 bp, Homo sapiens
aaaatgcaggtgaacttttt

SEQ ID NO: 5078330 - DNA, 16 bp, Homo sapiens
aaaatgcagtccagaa

SEQ ID NO: 5078331 - DNA, 19 bp, Homo sapiens
aaaatgcatatttctatgt

SEQ ID NO: 5078332 - DNA, 16 bp, Homo sapiens
aaaatgcatgattgca

SEQ ID NO: 5078333 - DNA, 13 bp, Homo sapiens
aaaatgcattatt

SEQ ID NO: 5078334 - DNA, 22 bp, Homo sapiens
aaaatgcattgaaagaattaga

SEQ ID NO: 5078335 - DNA, 15 bp, Homo sapiens
aaaatgcatttaagt

SEQ ID NO: 5078336 - DNA, 14 bp, Homo sapiens
aaaatgcattttct

SEQ ID NO: 5078337 - DNA, 18 bp, Homo sapiens
aaaatgccacattttgct

SEQ ID NO: 5078338 - DNA, 16 bp, Homo sapiens
aaaatgccacttaaca

SEQ ID NO: 5078339 - DNA, 21 bp, Homo sapiens
aaaatgccataatacaaaagg

SEQ ID NO: 5078340 - DNA, 17 bp, Homo sapiens
aaaatgccatagtttgt

SEQ ID NO: 5078341 - DNA, 17 bp, Homo sapiens
aaaatgccatcaaatga

SEQ ID NO: 5078342 - DNA, 20 bp, Homo sapiens
aaaatgcccatttttgctaa

SEQ ID NO: 5078343 - DNA, 17 bp, Homo sapiens
aaaatgcccttaaatca

SEQ ID NO: 5078344 - DNA, 19 bp, Homo sapiens
aaaatgcctcagtgtattt

SEQ ID NO: 5078345 - DNA, 14 bp, Homo sapiens
aaaatgcctttgag

SEQ ID NO: 5078346 - DNA, 13 bp, Homo sapiens
aaaatgctaggtt

SEQ ID NO: 5078347 - DNA, 15 bp, Homo sapiens
aaaatgctaggttct

SEQ ID NO: 5078348 - DNA, 19 bp, Homo sapiens
aaaatgctcaatttcagca

SEQ ID NO: 5078349 - DNA, 18 bp, Homo sapiens
aaaatgctccccacagcg

SEQ ID NO: 5078350 - DNA, 21 bp, Homo sapiens
aaaatgctcctagaagtctta

SEQ ID NO: 5078351 - DNA, 20 bp, Homo sapiens
aaaatgctcttatttcatca

SEQ ID NO: 5078352 - DNA, 18 bp, Homo sapiens
aaaatgctgaacattgca

SEQ ID NO: 5078353 - DNA, 11 bp, Homo sapiens
aaaatgctggg

SEQ ID NO: 5078354 - DNA, 17 bp, Homo sapiens
aaaatgctgttaatgta

SEQ ID NO: 5078355 - DNA, 22 bp, Homo sapiens
aaaatgcttaaaaaataataca

SEQ ID NO: 5078356 - DNA, 23 bp, Homo sapiens
aaaatgcttaaaaaataatacaa

SEQ ID NO: 5078357 - DNA, 14 bp, Homo sapiens
aaaatgcttctgtt

SEQ ID NO: 5078358 - DNA, 16 bp, Homo sapiens
aaaatgcttctgttgt

SEQ ID NO: 5078359 - DNA, 18 bp, Homo sapiens
aaaatgctttttatttct

SEQ ID NO: 5078360 - DNA, 18 bp, Homo sapiens
aaaatggaaaaaaacata

SEQ ID NO: 5078361 - DNA, 17 bp, Homo sapiens
aaaatggaaagaaggaa

SEQ ID NO: 5078362 - DNA, 14 bp, Homo sapiens
aaaatggaacatta

SEQ ID NO: 5078363 - DNA, 14 bp, Homo sapiens
aaaatggaactgtg

SEQ ID NO: 5078364 - DNA, 13 bp, Homo sapiens
aaaatggaagacc

SEQ ID NO: 5078365 - DNA, 16 bp, Homo sapiens
aaaatggaagcaaaga

SEQ ID NO: 5078366 - DNA, 18 bp, Homo sapiens
aaaatggaagcaaagaca

SEQ ID NO: 5078367 - DNA, 19 bp, Homo sapiens
aaaatggaagcaaagacaa

SEQ ID NO: 5078368 - DNA, 17 bp, Homo sapiens
aaaatggacacaaattt

SEQ ID NO: 5078369 - DNA, 21 bp, Homo sapiens
aaaatggacgtgttatgactc

SEQ ID NO: 5078370 - DNA, 21 bp, Homo sapiens
aaaatggatattattagaaat

SEQ ID NO: 5078371 - DNA, 18 bp, Homo sapiens
aaaatggatgacaaagaa

SEQ ID NO: 5078372 - DNA, 23 bp, Homo sapiens
aaaatggatgccttgaataataa

SEQ ID NO: 5078373 - DNA, 15 bp, Homo sapiens
aaaatggcaaatgca

SEQ ID NO: 5078374 - DNA, 19 bp, Homo sapiens
aaaatggcaacaaactgca

SEQ ID NO: 5078375 - DNA, 16 bp, Homo sapiens
aaaatggcatttagca

SEQ ID NO: 5078376 - DNA, 17 bp, Homo sapiens
aaaatggcatttagcac

SEQ ID NO: 5078377 - DNA, 19 bp, Homo sapiens
aaaatggccatttgctttt

SEQ ID NO: 5078378 - DNA, 23 bp, Homo sapiens
aaaatggccatttgctttttcac

SEQ ID NO: 5078379 - DNA, 17 bp, Homo sapiens
aaaatggcgaacatgtg

SEQ ID NO: 5078380 - DNA, 17 bp, Homo sapiens
aaaatggctaataaact

SEQ ID NO: 5078381 - DNA, 19 bp, Homo sapiens
aaaatggctaataaactgt

SEQ ID NO: 5078382 - DNA, 15 bp, Homo sapiens
aaaatggctgaagaa

SEQ ID NO: 5078383 - DNA, 16 bp, Homo sapiens
aaaatggctgaagaaa

SEQ ID NO: 5078384 - DNA, 23 bp, Homo sapiens
aaaatggcttcagaattaaaact

SEQ ID NO: 5078385 - DNA, 17 bp, Homo sapiens
aaaatgggaaaaataaa

SEQ ID NO: 5078386 - DNA, 21 bp, Homo sapiens
aaaatgggaaaaataaaagaa

SEQ ID NO: 5078387 - DNA, 13 bp, Homo sapiens
aaaatgggaaata

SEQ ID NO: 5078388 - DNA, 15 bp, Homo sapiens
aaaatgggaagactg

SEQ ID NO: 5078389 - DNA, 15 bp, Homo sapiens
aaaatgggacttctt

SEQ ID NO: 5078390 - DNA, 19 bp, Homo sapiens
aaaatgggacttcttttca

SEQ ID NO: 5078391 - DNA, 21 bp, Homo sapiens
aaaatgggacttcttttcaca

SEQ ID NO: 5078392 - DNA, 22 bp, Homo sapiens
aaaatgggacttcttttcacat

SEQ ID NO: 5078393 - DNA, 21 bp, Homo sapiens
aaaatgggcgggggtggtgtg

SEQ ID NO: 5078394 - DNA, 17 bp, Homo sapiens
aaaatgggtcttttata

SEQ ID NO: 5078395 - DNA, 15 bp, Homo sapiens
aaaatggtataaaag

SEQ ID NO: 5078396 - DNA, 18 bp, Homo sapiens
aaaatggtataagtaact

SEQ ID NO: 5078397 - DNA, 23 bp, Homo sapiens
aaaatggtataagtaactttatt

SEQ ID NO: 5078398 - DNA, 13 bp, Homo sapiens
aaaatggtatcaa

SEQ ID NO: 5078399 - DNA, 23 bp, Homo sapiens
aaaatggtcagtattatctaaat

SEQ ID NO: 5078400 - DNA, 22 bp, Homo sapiens
aaaatggtccaattagtttcct

SEQ ID NO: 5078401 - DNA, 23 bp, Homo sapiens
aaaatggtcctatttttgtgaag

SEQ ID NO: 5078402 - DNA, 24 bp, Homo sapiens
aaaatggtcctatttttgtgaaga

SEQ ID NO: 5078403 - DNA, 14 bp, Homo sapiens
aaaatggtgcctga

SEQ ID NO: 5078404 - DNA, 18 bp, Homo sapiens
aaaatggtggcttcagct

SEQ ID NO: 5078405 - DNA, 21 bp, Homo sapiens
aaaatggtggcttcagctcca

SEQ ID NO: 5078406 - DNA, 22 bp, Homo sapiens
aaaatggtggtttgtcatatat

SEQ ID NO: 5078407 - DNA, 17 bp, Homo sapiens
aaaatggtgttttcatg

SEQ ID NO: 5078408 - DNA, 20 bp, Homo sapiens
aaaatggtgttttcatgtaa

SEQ ID NO: 5078409 - DNA, 23 bp, Homo sapiens
aaaatggttccgacttgtccctc

SEQ ID NO: 5078410 - DNA, 18 bp, Homo sapiens
aaaatggttgatggaaaa

SEQ ID NO: 5078411 - DNA, 22 bp, Homo sapiens
aaaatggttgatggaaaataaa

SEQ ID NO: 5078412 - DNA, 18 bp, Homo sapiens
aaaatggtttaaatggtc

SEQ ID NO: 5078413 - DNA, 18 bp, Homo sapiens
aaaatggtttattttgta

SEQ ID NO: 5078414 - DNA, 22 bp, Homo sapiens
aaaatggtttattttgtattgt

SEQ ID NO: 5078415 - DNA, 14 bp, Homo sapiens
aaaatggtttttgt

SEQ ID NO: 5078416 - DNA, 15 bp, Homo sapiens
aaaatgtaaaaaaca

SEQ ID NO: 5078417 - DNA, 16 bp, Homo sapiens
aaaatgtaaaaaacaa

SEQ ID NO: 5078418 - DNA, 18 bp, Homo sapiens
aaaatgtaaaaaacaaaa

SEQ ID NO: 5078419 - DNA, 18 bp, Homo sapiens
aaaatgtaaaggagggag

SEQ ID NO: 5078420 - DNA, 11 bp, Homo sapiens
aaaatgtaaca

SEQ ID NO: 5078421 - DNA, 22 bp, Homo sapiens
aaaatgtaacatcataattaca

SEQ ID NO: 5078422 - DNA, 15 bp, Homo sapiens
aaaatgtaactgtta

SEQ ID NO: 5078423 - DNA, 18 bp, Homo sapiens
aaaatgtaactgttacca

SEQ ID NO: 5078424 - DNA, 23 bp, Homo sapiens
aaaatgtaagattatagattcta

SEQ ID NO: 5078425 - DNA, 14 bp, Homo sapiens
aaaatgtaatttaa

SEQ ID NO: 5078426 - DNA, 19 bp, Homo sapiens
aaaatgtaatttaaatgaa

SEQ ID NO: 5078427 - DNA, 12 bp, Homo sapiens
aaaatgtacaaa

SEQ ID NO: 5078428 - DNA, 18 bp, Homo sapiens
aaaatgtactgagatttt

SEQ ID NO: 5078429 - DNA, 17 bp, Homo sapiens
aaaatgtagaagaaagc

SEQ ID NO: 5078430 - DNA, 21 bp, Homo sapiens
aaaatgtagactctgacttcc

SEQ ID NO: 5078431 - DNA, 21 bp, Homo sapiens
aaaatgtagcagcttcttagt

SEQ ID NO: 5078432 - DNA, 23 bp, Homo sapiens
aaaatgtagctgcgtcataagga

SEQ ID NO: 5078433 - DNA, 15 bp, Homo sapiens
aaaatgtagctttta

SEQ ID NO: 5078434 - DNA, 17 bp, Homo sapiens
aaaatgtaggagactgt

SEQ ID NO: 5078435 - DNA, 12 bp, Homo sapiens
aaaatgtatata

SEQ ID NO: 5078436 - DNA, 17 bp, Homo sapiens
aaaatgtatatgcactt

SEQ ID NO: 5078437 - DNA, 17 bp, Homo sapiens
aaaatgtatattttgat

SEQ ID NO: 5078438 - DNA, 19 bp, Homo sapiens
aaaatgtatccagaggaat

SEQ ID NO: 5078439 - DNA, 20 bp, Homo sapiens
aaaatgtatggatgaattct

SEQ ID NO: 5078440 - DNA, 18 bp, Homo sapiens
aaaatgtatgtgtaagta

SEQ ID NO: 5078441 - DNA, 21 bp, Homo sapiens
aaaatgtattcctttaaaata

SEQ ID NO: 5078442 - DNA, 12 bp, Homo sapiens
aaaatgtatttt

SEQ ID NO: 5078443 - DNA, 16 bp, Homo sapiens
aaaatgtatttttcta

SEQ ID NO: 5078444 - DNA, 22 bp, Homo sapiens
aaaatgtcaaaagtagaacttt

SEQ ID NO: 5078445 - DNA, 15 bp, Homo sapiens
aaaatgtcaaccttt

SEQ ID NO: 5078446 - DNA, 17 bp, Homo sapiens
aaaatgtcacattctat

SEQ ID NO: 5078447 - DNA, 13 bp, Homo sapiens
aaaatgtcactga

SEQ ID NO: 5078448 - DNA, 15 bp, Homo sapiens
aaaatgtcactgtta

SEQ ID NO: 5078449 - DNA, 16 bp, Homo sapiens
aaaatgtcactgttat

SEQ ID NO: 5078450 - DNA, 21 bp, Homo sapiens
aaaatgtcactgttataaatt

SEQ ID NO: 5078451 - DNA, 22 bp, Homo sapiens
aaaatgtcactgttataaattt

SEQ ID NO: 5078452 - DNA, 23 bp, Homo sapiens
aaaatgtccagtaagatcactgt

SEQ ID NO: 5078453 - DNA, 14 bp, Homo sapiens
aaaatgtccttgtg

SEQ ID NO: 5078454 - DNA, 15 bp, Homo sapiens
aaaatgtctcaatgg

SEQ ID NO: 5078455 - DNA, 11 bp, Homo sapiens
aaaatgtctgt

SEQ ID NO: 5078456 - DNA, 17 bp, Homo sapiens
aaaatgtctgtaataat

SEQ ID NO: 5078457 - DNA, 15 bp, Homo sapiens
aaaatgtcttcaagg

SEQ ID NO: 5078458 - DNA, 21 bp, Homo sapiens
aaaatgtcttcttattttggt

SEQ ID NO: 5078459 - DNA, 11 bp, Homo sapiens
aaaatgtcttg

SEQ ID NO: 5078460 - DNA, 14 bp, Homo sapiens
aaaatgtcttgtgt

SEQ ID NO: 5078461 - DNA, 13 bp, Homo sapiens
aaaatgtctttat

SEQ ID NO: 5078462 - DNA, 11 bp, Homo sapiens
aaaatgtgaaa

SEQ ID NO: 5078463 - DNA, 13 bp, Homo sapiens
aaaatgtgaaaaa

SEQ ID NO: 5078464 - DNA, 23 bp, Homo sapiens
aaaatgtgaaaaaaattattcat

SEQ ID NO: 5078465 - DNA, 12 bp, Homo sapiens
aaaatgtgaaat

SEQ ID NO: 5078466 - DNA, 15 bp, Homo sapiens
aaaatgtgaggggaa

SEQ ID NO: 5078467 - DNA, 19 bp, Homo sapiens
aaaatgtgatgttctaagg

SEQ ID NO: 5078468 - DNA, 21 bp, Homo sapiens
aaaatgtgatgttctaaggct

SEQ ID NO: 5078469 - DNA, 12 bp, Homo sapiens
aaaatgtgattt

SEQ ID NO: 5078470 - DNA, 11 bp, Homo sapiens
aaaatgtgtaa

SEQ ID NO: 5078471 - DNA, 15 bp, Homo sapiens
aaaatgtgtaattca

SEQ ID NO: 5078472 - DNA, 20 bp, Homo sapiens
aaaatgtgtaattttgttct

SEQ ID NO: 5078473 - DNA, 13 bp, Homo sapiens
aaaatgtgtacag

SEQ ID NO: 5078474 - DNA, 20 bp, Homo sapiens
aaaatgtgtatttttcaagg

SEQ ID NO: 5078475 - DNA, 12 bp, Homo sapiens
aaaatgtgtctg

SEQ ID NO: 5078476 - DNA, 22 bp, Homo sapiens
aaaatgtgtctgcaacatggat

SEQ ID NO: 5078477 - DNA, 11 bp, Homo sapiens
aaaatgtgtgg

SEQ ID NO: 5078478 - DNA, 23 bp, Homo sapiens
aaaatgtgtgtattcttaaaatg

SEQ ID NO: 5078479 - DNA, 20 bp, Homo sapiens
aaaatgttaaacccttacca

SEQ ID NO: 5078480 - DNA, 14 bp, Homo sapiens
aaaatgttaggaca

SEQ ID NO: 5078481 - DNA, 22 bp, Homo sapiens
aaaatgttatcttctcaagttc

SEQ ID NO: 5078482 - DNA, 22 bp, Homo sapiens
aaaatgttcattctatgacaat

SEQ ID NO: 5078483 - DNA, 18 bp, Homo sapiens
aaaatgttcccttgacca

SEQ ID NO: 5078484 - DNA, 20 bp, Homo sapiens
aaaatgttcccttgaccatt

SEQ ID NO: 5078485 - DNA, 11 bp, Homo sapiens
aaaatgttcta

SEQ ID NO: 5078486 - DNA, 18 bp, Homo sapiens
aaaatgttctatttaaca

SEQ ID NO: 5078487 - DNA, 11 bp, Homo sapiens
aaaatgttctc

SEQ ID NO: 5078488 - DNA, 15 bp, Homo sapiens
aaaatgttctttgga

SEQ ID NO: 5078489 - DNA, 19 bp, Homo sapiens
aaaatgttgaaaagtcaaa

SEQ ID NO: 5078490 - DNA, 14 bp, Homo sapiens
aaaatgttgagaat

SEQ ID NO: 5078491 - DNA, 15 bp, Homo sapiens
aaaatgttgctctgg

SEQ ID NO: 5078492 - DNA, 10 bp, Homo sapiens
aaaatgttta

SEQ ID NO: 5078493 - DNA, 11 bp, Homo sapiens
aaaatgtttaa

SEQ ID NO: 5078494 - DNA, 16 bp, Homo sapiens
aaaatgtttaagtatt

SEQ ID NO: 5078495 - DNA, 22 bp, Homo sapiens
aaaatgtttcaagcgcttaact

SEQ ID NO: 5078496 - DNA, 21 bp, Homo sapiens
aaaatgtttcattatgcactt

SEQ ID NO: 5078497 - DNA, 14 bp, Homo sapiens
aaaatgtttgagca

SEQ ID NO: 5078498 - DNA, 15 bp, Homo sapiens
aaaatgtttgagcac

SEQ ID NO: 5078499 - DNA, 15 bp, Homo sapiens
aaaatgtttggaatt

SEQ ID NO: 5078500 - DNA, 21 bp, Homo sapiens
aaaatgtttggaatttaagaa

SEQ ID NO: 5078501 - DNA, 12 bp, Homo sapiens
aaaatgttttcc

SEQ ID NO: 5078502 - DNA, 14 bp, Homo sapiens
aaaatgttttccaa

SEQ ID NO: 5078503 - DNA, 22 bp, Homo sapiens
aaaatgttttcccctaattttc

SEQ ID NO: 5078504 - DNA, 20 bp, Homo sapiens
aaaatgttttgtaagaaacc

SEQ ID NO: 5078505 - DNA, 13 bp, Homo sapiens
aaaatgtttttag

SEQ ID NO: 5078506 - DNA, 15 bp, Homo sapiens
aaaatgttttttcat

SEQ ID NO: 5078507 - DNA, 15 bp, Homo sapiens
aaaattaaaaaatga

SEQ ID NO: 5078508 - DNA, 13 bp, Homo sapiens
aaaattaaaagaa

SEQ ID NO: 5078509 - DNA, 14 bp, Homo sapiens
aaaattaaaatcca

SEQ ID NO: 5078510 - DNA, 18 bp, Homo sapiens
aaaattaaacacaaagtg

SEQ ID NO: 5078511 - DNA, 22 bp, Homo sapiens
aaaattaaataaatctttcagc

SEQ ID NO: 5078512 - DNA, 17 bp, Homo sapiens
aaaattaaataaatttt

SEQ ID NO: 5078513 - DNA, 14 bp, Homo sapiens
aaaattaaatttta

SEQ ID NO: 5078514 - DNA, 17 bp, Homo sapiens
aaaattaacaaatttct

SEQ ID NO: 5078515 - DNA, 22 bp, Homo sapiens
aaaattaacatgaatatttagt

SEQ ID NO: 5078516 - DNA, 13 bp, Homo sapiens
aaaattaactgct

SEQ ID NO: 5078517 - DNA, 15 bp, Homo sapiens
aaaattaactgctcc

SEQ ID NO: 5078518 - DNA, 18 bp, Homo sapiens
aaaattaagagatacatt

SEQ ID NO: 5078519 - DNA, 19 bp, Homo sapiens
aaaattaagagatacattc

SEQ ID NO: 5078520 - DNA, 15 bp, Homo sapiens
aaaattaagattatt

SEQ ID NO: 5078521 - DNA, 17 bp, Homo sapiens
aaaattaagattattgt

SEQ ID NO: 5078522 - DNA, 19 bp, Homo sapiens
aaaattaagtagaacaaaa

SEQ ID NO: 5078523 - DNA, 13 bp, Homo sapiens
aaaattaagtgtg

SEQ ID NO: 5078524 - DNA, 20 bp, Homo sapiens
aaaattaatatggtgtattt

SEQ ID NO: 5078525 - DNA, 23 bp, Homo sapiens
aaaattaatctgggccagaattt

SEQ ID NO: 5078526 - DNA, 17 bp, Homo sapiens
aaaattaatgtaataaa

SEQ ID NO: 5078527 - DNA, 19 bp, Homo sapiens
aaaattaatgtaataaagt

SEQ ID NO: 5078528 - DNA, 14 bp, Homo sapiens
aaaattaattatgt

SEQ ID NO: 5078529 - DNA, 16 bp, Homo sapiens
aaaattaattgaaata

SEQ ID NO: 5078530 - DNA, 19 bp, Homo sapiens
aaaattacactacaagttt

SEQ ID NO: 5078531 - DNA, 13 bp, Homo sapiens
aaaattacagaag

SEQ ID NO: 5078532 - DNA, 17 bp, Homo sapiens
aaaattacagatgtgaa

SEQ ID NO: 5078533 - DNA, 23 bp, Homo sapiens
aaaattacctgtgtgagatttta

SEQ ID NO: 5078534 - DNA, 20 bp, Homo sapiens
aaaattacctttaattttaa

SEQ ID NO: 5078535 - DNA, 21 bp, Homo sapiens
aaaattacgtttgttattcct

SEQ ID NO: 5078536 - DNA, 15 bp, Homo sapiens
aaaattactaatttt

SEQ ID NO: 5078537 - DNA, 19 bp, Homo sapiens
aaaattactgtgaattgtt

SEQ ID NO: 5078538 - DNA, 14 bp, Homo sapiens
aaaattactgttta

SEQ ID NO: 5078539 - DNA, 21 bp, Homo sapiens
aaaattacttagtattgcaaa

SEQ ID NO: 5078540 - DNA, 23 bp, Homo sapiens
aaaattacttctctctatctgga

SEQ ID NO: 5078541 - DNA, 17 bp, Homo sapiens
aaaattacttggctttt

SEQ ID NO: 5078542 - DNA, 14 bp, Homo sapiens
aaaattacttttct

SEQ ID NO: 5078543 - DNA, 20 bp, Homo sapiens
aaaattagaaaggacaacag

SEQ ID NO: 5078544 - DNA, 14 bp, Homo sapiens
aaaattagaaattg

SEQ ID NO: 5078545 - DNA, 23 bp, Homo sapiens
aaaattagactgtgattcagaaa

SEQ ID NO: 5078546 - DNA, 15 bp, Homo sapiens
aaaattagccaagtg

SEQ ID NO: 5078547 - DNA, 17 bp, Homo sapiens
aaaattagccagtaatc

SEQ ID NO: 5078548 - DNA, 12 bp, Homo sapiens
aaaattagtaat

SEQ ID NO: 5078549 - DNA, 22 bp, Homo sapiens
aaaattagtgagatttgtattt

SEQ ID NO: 5078550 - DNA, 12 bp, Homo sapiens
aaaattataaag

SEQ ID NO: 5078551 - DNA, 16 bp, Homo sapiens
aaaattataagaagag

SEQ ID NO: 5078552 - DNA, 21 bp, Homo sapiens
aaaattatactaacttattta

SEQ ID NO: 5078553 - DNA, 22 bp, Homo sapiens
aaaattatactaacttatttat

SEQ ID NO: 5078554 - DNA, 16 bp, Homo sapiens
aaaattatagaagttt

SEQ ID NO: 5078555 - DNA, 22 bp, Homo sapiens
aaaattatagatgggaatgaag

SEQ ID NO: 5078556 - DNA, 19 bp, Homo sapiens
aaaattatagctctaatgt

SEQ ID NO: 5078557 - DNA, 12 bp, Homo sapiens
aaaattatatag

SEQ ID NO: 5078558 - DNA, 16 bp, Homo sapiens
aaaattatcctctttg

SEQ ID NO: 5078559 - DNA, 12 bp, Homo sapiens
aaaattatctgt

SEQ ID NO: 5078560 - DNA, 18 bp, Homo sapiens
aaaattatctgttctatg

SEQ ID NO: 5078561 - DNA, 19 bp, Homo sapiens
aaaattatctgttctatgg

SEQ ID NO: 5078562 - DNA, 13 bp, Homo sapiens
aaaattatgaaaa

SEQ ID NO: 5078563 - DNA, 19 bp, Homo sapiens
aaaattatgaatctgattt

SEQ ID NO: 5078564 - DNA, 14 bp, Homo sapiens
aaaattatggaaac

SEQ ID NO: 5078565 - DNA, 15 bp, Homo sapiens
aaaattatggaaaca

SEQ ID NO: 5078566 - DNA, 22 bp, Homo sapiens
aaaattatggaatatcatctgt

SEQ ID NO: 5078567 - DNA, 15 bp, Homo sapiens
aaaattattcccatg

SEQ ID NO: 5078568 - DNA, 20 bp, Homo sapiens
aaaattattccctgaattgt

SEQ ID NO: 5078569 - DNA, 13 bp, Homo sapiens
aaaattatttaaa

SEQ ID NO: 5078570 - DNA, 13 bp, Homo sapiens
aaaattatttgca

SEQ ID NO: 5078571 - DNA, 14 bp, Homo sapiens
aaaattatttgcag

SEQ ID NO: 5078572 - DNA, 13 bp, Homo sapiens
aaaattatttgta

SEQ ID NO: 5078573 - DNA, 18 bp, Homo sapiens
aaaattcaaaaagtgttt

SEQ ID NO: 5078574 - DNA, 22 bp, Homo sapiens
aaaattcaaagcatggacattt

SEQ ID NO: 5078575 - DNA, 18 bp, Homo sapiens
aaaattcaacaaacattt

SEQ ID NO: 5078576 - DNA, 20 bp, Homo sapiens
aaaattcaaggccacaaaaa

SEQ ID NO: 5078577 - DNA, 22 bp, Homo sapiens
aaaattcaaggccacaaaaaca

SEQ ID NO: 5078578 - DNA, 13 bp, Homo sapiens
aaaattcacagag

SEQ ID NO: 5078579 - DNA, 14 bp, Homo sapiens
aaaattcacagagt

SEQ ID NO: 5078580 - DNA, 14 bp, Homo sapiens
aaaattcacataat

SEQ ID NO: 5078581 - DNA, 19 bp, Homo sapiens
aaaattcactaatcttgaa

SEQ ID NO: 5078582 - DNA, 15 bp, Homo sapiens
aaaattcagcggcag

SEQ ID NO: 5078583 - DNA, 16 bp, Homo sapiens
aaaattcagtttttgt

SEQ ID NO: 5078584 - DNA, 17 bp, Homo sapiens
aaaattcagtttttgta

SEQ ID NO: 5078585 - DNA, 18 bp, Homo sapiens
aaaattcagtttttgtat

SEQ ID NO: 5078586 - DNA, 20 bp, Homo sapiens
aaaattcagtttttgtatct

SEQ ID NO: 5078587 - DNA, 15 bp, Homo sapiens
aaaattcataaccaa

SEQ ID NO: 5078588 - DNA, 12 bp, Homo sapiens
aaaattcatagc

SEQ ID NO: 5078589 - DNA, 13 bp, Homo sapiens
aaaattcatataa

SEQ ID NO: 5078590 - DNA, 15 bp, Homo sapiens
aaaattcatataaag

SEQ ID NO: 5078591 - DNA, 22 bp, Homo sapiens
aaaattcatgatactcatttct

SEQ ID NO: 5078592 - DNA, 20 bp, Homo sapiens
aaaattcatggaactttcat

SEQ ID NO: 5078593 - DNA, 15 bp, Homo sapiens
aaaattcattccatt

SEQ ID NO: 5078594 - DNA, 15 bp, Homo sapiens
aaaattcatttctaa

SEQ ID NO: 5078595 - DNA, 20 bp, Homo sapiens
aaaattccaaatttttttct

SEQ ID NO: 5078596 - DNA, 12 bp, Homo sapiens
aaaattccagaa

SEQ ID NO: 5078597 - DNA, 21 bp, Homo sapiens
aaaattccatcccatcatctt

SEQ ID NO: 5078598 - DNA, 17 bp, Homo sapiens
aaaattcccttcctgtt

SEQ ID NO: 5078599 - DNA, 15 bp, Homo sapiens
aaaattcctatctca

SEQ ID NO: 5078600 - DNA, 17 bp, Homo sapiens
aaaattcctattgtgat

SEQ ID NO: 5078601 - DNA, 23 bp, Homo sapiens
aaaattcctgtgttcaatattta

SEQ ID NO: 5078602 - DNA, 16 bp, Homo sapiens
aaaattcgctttctaa

SEQ ID NO: 5078603 - DNA, 16 bp, Homo sapiens
aaaattcggaatggtt

SEQ ID NO: 5078604 - DNA, 15 bp, Homo sapiens
aaaattctaaatgta

SEQ ID NO: 5078605 - DNA, 16 bp, Homo sapiens
aaaattctactgtatg

SEQ ID NO: 5078606 - DNA, 12 bp, Homo sapiens
aaaattctagtc

SEQ ID NO: 5078607 - DNA, 20 bp, Homo sapiens
aaaattctagtctctgattt

SEQ ID NO: 5078608 - DNA, 15 bp, Homo sapiens
aaaattctcaagtga

SEQ ID NO: 5078609 - DNA, 16 bp, Homo sapiens
aaaattctgatgtttc

SEQ ID NO: 5078610 - DNA, 22 bp, Homo sapiens
aaaattctgatgtttctgtgaa

SEQ ID NO: 5078611 - DNA, 12 bp, Homo sapiens
aaaattctggaa

SEQ ID NO: 5078612 - DNA, 14 bp, Homo sapiens
aaaattctgtaatt

SEQ ID NO: 5078613 - DNA, 19 bp, Homo sapiens
aaaattctgtaatttgaat

SEQ ID NO: 5078614 - DNA, 23 bp, Homo sapiens
aaaattctgtgccttgttttttg

SEQ ID NO: 5078615 - DNA, 22 bp, Homo sapiens
aaaattctgttttgtaaatgta

SEQ ID NO: 5078616 - DNA, 11 bp, Homo sapiens
aaaattcttgt

SEQ ID NO: 5078617 - DNA, 13 bp, Homo sapiens
aaaattctttaga

SEQ ID NO: 5078618 - DNA, 15 bp, Homo sapiens
aaaattgaaaaataa

SEQ ID NO: 5078619 - DNA, 23 bp, Homo sapiens
aaaattgaaaacactaacaaaat

SEQ ID NO: 5078620 - DNA, 16 bp, Homo sapiens
aaaattgaaaatatgt

SEQ ID NO: 5078621 - DNA, 18 bp, Homo sapiens
aaaattgaaatgtaaggc

SEQ ID NO: 5078622 - DNA, 21 bp, Homo sapiens
aaaattgaaatgtaaggctgt

SEQ ID NO: 5078623 - DNA, 19 bp, Homo sapiens
aaaattgaacaaagactac

SEQ ID NO: 5078624 - DNA, 22 bp, Homo sapiens
aaaattgaactaatttatactt

SEQ ID NO: 5078625 - DNA, 12 bp, Homo sapiens
aaaattgaattt

SEQ ID NO: 5078626 - DNA, 20 bp, Homo sapiens
aaaattgaatttaacaatgc

SEQ ID NO: 5078627 - DNA, 21 bp, Homo sapiens
aaaattgaatttaacaatgcg

SEQ ID NO: 5078628 - DNA, 19 bp, Homo sapiens
aaaattgagagctttattg

SEQ ID NO: 5078629 - DNA, 20 bp, Homo sapiens
aaaattgagttctcatttaa

SEQ ID NO: 5078630 - DNA, 20 bp, Homo sapiens
aaaattgagttgcacttatt

SEQ ID NO: 5078631 - DNA, 14 bp, Homo sapiens
aaaattgagtttca

SEQ ID NO: 5078632 - DNA, 15 bp, Homo sapiens
aaaattgatattata

SEQ ID NO: 5078633 - DNA, 17 bp, Homo sapiens
aaaattgatattatatt

SEQ ID NO: 5078634 - DNA, 14 bp, Homo sapiens
aaaattgatgctaa

SEQ ID NO: 5078635 - DNA, 13 bp, Homo sapiens
aaaattgatttct

SEQ ID NO: 5078636 - DNA, 12 bp, Homo sapiens
aaaattgatttt

SEQ ID NO: 5078637 - DNA, 15 bp, Homo sapiens
aaaattgatttttct

SEQ ID NO: 5078638 - DNA, 13 bp, Homo sapiens
aaaattgcacaat

SEQ ID NO: 5078639 - DNA, 14 bp, Homo sapiens
aaaattgcacaatt

SEQ ID NO: 5078640 - DNA, 17 bp, Homo sapiens
aaaattgcacaatttga

SEQ ID NO: 5078641 - DNA, 15 bp, Homo sapiens
aaaattgcactaaat

SEQ ID NO: 5078642 - DNA, 22 bp, Homo sapiens
aaaattgcatttttacctttca

SEQ ID NO: 5078643 - DNA, 13 bp, Homo sapiens
aaaattgccaagt

SEQ ID NO: 5078644 - DNA, 13 bp, Homo sapiens
aaaattgccatat

SEQ ID NO: 5078645 - DNA, 14 bp, Homo sapiens
aaaattgccatatt

SEQ ID NO: 5078646 - DNA, 19 bp, Homo sapiens
aaaattgccatattgcaca

SEQ ID NO: 5078647 - DNA, 16 bp, Homo sapiens
aaaattgccattttat

SEQ ID NO: 5078648 - DNA, 12 bp, Homo sapiens
aaaattgccttt

SEQ ID NO: 5078649 - DNA, 23 bp, Homo sapiens
aaaattgctaacgttttttcttc

SEQ ID NO: 5078650 - DNA, 22 bp, Homo sapiens
aaaattgctctgtgtatatctc

SEQ ID NO: 5078651 - DNA, 20 bp, Homo sapiens
aaaattgctgactgtagctt

SEQ ID NO: 5078652 - DNA, 17 bp, Homo sapiens
aaaattgctgcaccaat

SEQ ID NO: 5078653 - DNA, 15 bp, Homo sapiens
aaaattgctgtgcct

SEQ ID NO: 5078654 - DNA, 19 bp, Homo sapiens
aaaattgcttctaaaacaa

SEQ ID NO: 5078655 - DNA, 20 bp, Homo sapiens
aaaattgcttctaaaacaat

SEQ ID NO: 5078656 - DNA, 19 bp, Homo sapiens
aaaattggcattaaaactt

SEQ ID NO: 5078657 - DNA, 16 bp, Homo sapiens
aaaattggccagagag

SEQ ID NO: 5078658 - DNA, 20 bp, Homo sapiens
aaaattggctagttgaatct

SEQ ID NO: 5078659 - DNA, 18 bp, Homo sapiens
aaaattggggattcttaa

SEQ ID NO: 5078660 - DNA, 23 bp, Homo sapiens
aaaattggggattcttaaagttg

SEQ ID NO: 5078661 - DNA, 17 bp, Homo sapiens
aaaattggtacttgttt

SEQ ID NO: 5078662 - DNA, 16 bp, Homo sapiens
aaaattggttaatgaa

SEQ ID NO: 5078663 - DNA, 15 bp, Homo sapiens
aaaattgtaaaattg

SEQ ID NO: 5078664 - DNA, 19 bp, Homo sapiens
aaaattgtaacctgcattt

SEQ ID NO: 5078665 - DNA, 18 bp, Homo sapiens
aaaattgtaagccagagt

SEQ ID NO: 5078666 - DNA, 19 bp, Homo sapiens
aaaattgtaagccagagtc

SEQ ID NO: 5078667 - DNA, 22 bp, Homo sapiens
aaaattgtaagccagagtcaac

SEQ ID NO: 5078668 - DNA, 16 bp, Homo sapiens
aaaattgtagcttttt

SEQ ID NO: 5078669 - DNA, 21 bp, Homo sapiens
aaaattgtataaattactttg

SEQ ID NO: 5078670 - DNA, 21 bp, Homo sapiens
aaaattgtataccaatgtgtt

SEQ ID NO: 5078671 - DNA, 15 bp, Homo sapiens
aaaattgtatagaga

SEQ ID NO: 5078672 - DNA, 20 bp, Homo sapiens
aaaattgtattgaaaacact

SEQ ID NO: 5078673 - DNA, 21 bp, Homo sapiens
aaaattgtcaaatgtcattat

SEQ ID NO: 5078674 - DNA, 16 bp, Homo sapiens
aaaattgtcttcatgt

SEQ ID NO: 5078675 - DNA, 15 bp, Homo sapiens
aaaattgtgaagcta

SEQ ID NO: 5078676 - DNA, 16 bp, Homo sapiens
aaaattgtgatgtgtc

SEQ ID NO: 5078677 - DNA, 15 bp, Homo sapiens
aaaattgtgatgttt

SEQ ID NO: 5078678 - DNA, 13 bp, Homo sapiens
aaaattgtgcata

SEQ ID NO: 5078679 - DNA, 16 bp, Homo sapiens
aaaattgtgttcttaa

SEQ ID NO: 5078680 - DNA, 17 bp, Homo sapiens
aaaattgtgttcttaaa

SEQ ID NO: 5078681 - DNA, 17 bp, Homo sapiens
aaaattgttacccattt

SEQ ID NO: 5078682 - DNA, 18 bp, Homo sapiens
aaaattgttagtaaacat

SEQ ID NO: 5078683 - DNA, 18 bp, Homo sapiens
aaaattgttataattaga

SEQ ID NO: 5078684 - DNA, 15 bp, Homo sapiens
aaaattgttatttca

SEQ ID NO: 5078685 - DNA, 14 bp, Homo sapiens
aaaattgttctact

SEQ ID NO: 5078686 - DNA, 19 bp, Homo sapiens
aaaattgtttccaaagtgc

SEQ ID NO: 5078687 - DNA, 13 bp, Homo sapiens
aaaattgttttca

SEQ ID NO: 5078688 - DNA, 16 bp, Homo sapiens
aaaattgttttcactt

SEQ ID NO: 5078689 - DNA, 21 bp, Homo sapiens
aaaattgttttgagctttcca

SEQ ID NO: 5078690 - DNA, 12 bp, Homo sapiens
aaaatttaaaaa

SEQ ID NO: 5078691 - DNA, 17 bp, Homo sapiens
aaaatttaaaaacttaa

SEQ ID NO: 5078692 - DNA, 14 bp, Homo sapiens
aaaatttaacatct

SEQ ID NO: 5078693 - DNA, 12 bp, Homo sapiens
aaaatttaactt

SEQ ID NO: 5078694 - DNA, 18 bp, Homo sapiens
aaaatttaagtgcgtgtg

SEQ ID NO: 5078695 - DNA, 19 bp, Homo sapiens
aaaatttaattgtgtaact

SEQ ID NO: 5078696 - DNA, 16 bp, Homo sapiens
aaaatttagtttttgt

SEQ ID NO: 5078697 - DNA, 12 bp, Homo sapiens
aaaatttataac

SEQ ID NO: 5078698 - DNA, 18 bp, Homo sapiens
aaaatttataacagttat

SEQ ID NO: 5078699 - DNA, 18 bp, Homo sapiens
aaaatttataagccaaag

SEQ ID NO: 5078700 - DNA, 20 bp, Homo sapiens
aaaatttatacaccagcaat

SEQ ID NO: 5078701 - DNA, 20 bp, Homo sapiens
aaaatttatattgtaaatat

SEQ ID NO: 5078702 - DNA, 13 bp, Homo sapiens
aaaatttatctta

SEQ ID NO: 5078703 - DNA, 12 bp, Homo sapiens
aaaatttattct

SEQ ID NO: 5078704 - DNA, 20 bp, Homo sapiens
aaaatttattctacttttaa

SEQ ID NO: 5078705 - DNA, 15 bp, Homo sapiens
aaaatttattctcag

SEQ ID NO: 5078706 - DNA, 13 bp, Homo sapiens
aaaatttcacatt

SEQ ID NO: 5078707 - DNA, 18 bp, Homo sapiens
aaaatttcccattaaaga

SEQ ID NO: 5078708 - DNA, 13 bp, Homo sapiens
aaaatttctaaga

SEQ ID NO: 5078709 - DNA, 15 bp, Homo sapiens
aaaatttctattaaa

SEQ ID NO: 5078710 - DNA, 23 bp, Homo sapiens
aaaatttctcaatctatgtgatt

SEQ ID NO: 5078711 - DNA, 14 bp, Homo sapiens
aaaatttgaaacat

SEQ ID NO: 5078712 - DNA, 17 bp, Homo sapiens
aaaatttgaaacattgc

SEQ ID NO: 5078713 - DNA, 16 bp, Homo sapiens
aaaatttgaacactgg

SEQ ID NO: 5078714 - DNA, 16 bp, Homo sapiens
aaaatttgaaccaaaa

SEQ ID NO: 5078715 - DNA, 20 bp, Homo sapiens
aaaatttgaaccaaaacatt

SEQ ID NO: 5078716 - DNA, 22 bp, Homo sapiens
aaaatttgaaccaaaacattcc

SEQ ID NO: 5078717 - DNA, 12 bp, Homo sapiens
aaaatttgaata

SEQ ID NO: 5078718 - DNA, 13 bp, Homo sapiens
aaaatttgagact

SEQ ID NO: 5078719 - DNA, 20 bp, Homo sapiens
aaaatttgatggtgaatatt

SEQ ID NO: 5078720 - DNA, 13 bp, Homo sapiens
aaaatttggaatt

SEQ ID NO: 5078721 - DNA, 18 bp, Homo sapiens
aaaatttgttattttgca

SEQ ID NO: 5078722 - DNA, 16 bp, Homo sapiens
aaaatttgttcttgta

SEQ ID NO: 5078723 - DNA, 15 bp, Homo sapiens
aaaattttaaaaatc

SEQ ID NO: 5078724 - DNA, 12 bp, Homo sapiens
aaaattttaaca

SEQ ID NO: 5078725 - DNA, 21 bp, Homo sapiens
aaaattttacctctctctggg

SEQ ID NO: 5078726 - DNA, 16 bp, Homo sapiens
aaaattttacttccat

SEQ ID NO: 5078727 - DNA, 19 bp, Homo sapiens
aaaattttacttttgttct

SEQ ID NO: 5078728 - DNA, 23 bp, Homo sapiens
aaaattttacttttgttctgtat

SEQ ID NO: 5078729 - DNA, 18 bp, Homo sapiens
aaaattttagaacagtcc

SEQ ID NO: 5078730 - DNA, 12 bp, Homo sapiens
aaaattttagct

SEQ ID NO: 5078731 - DNA, 14 bp, Homo sapiens
aaaattttatttta

SEQ ID NO: 5078732 - DNA, 17 bp, Homo sapiens
aaaattttattttaaat

SEQ ID NO: 5078733 - DNA, 12 bp, Homo sapiens
aaaattttcaaa

SEQ ID NO: 5078734 - DNA, 16 bp, Homo sapiens
aaaattttcaaacttt

SEQ ID NO: 5078735 - DNA, 23 bp, Homo sapiens
aaaattttctagaaatacacttt

SEQ ID NO: 5078736 - DNA, 19 bp, Homo sapiens
aaaattttctcattttctt

SEQ ID NO: 5078737 - DNA, 18 bp, Homo sapiens
aaaattttgcagaagcta

SEQ ID NO: 5078738 - DNA, 17 bp, Homo sapiens
aaaattttgcttttaat

SEQ ID NO: 5078739 - DNA, 18 bp, Homo sapiens
aaaattttggaatatttg

SEQ ID NO: 5078740 - DNA, 17 bp, Homo sapiens
aaaattttgtaaaacaa

SEQ ID NO: 5078741 - DNA, 18 bp, Homo sapiens
aaaattttgtaattttct

SEQ ID NO: 5078742 - DNA, 19 bp, Homo sapiens
aaaattttgtatgtcaata

SEQ ID NO: 5078743 - DNA, 21 bp, Homo sapiens
aaaattttgtatgtcaataac

SEQ ID NO: 5078744 - DNA, 23 bp, Homo sapiens
aaaattttgtatgtcaataactt

SEQ ID NO: 5078745 - DNA, 18 bp, Homo sapiens
aaaattttgtatgttaaa

SEQ ID NO: 5078746 - DNA, 23 bp, Homo sapiens
aaaattttgtattaatttctgat

SEQ ID NO: 5078747 - DNA, 20 bp, Homo sapiens
aaaattttgtgacattcctt

SEQ ID NO: 5078748 - DNA, 16 bp, Homo sapiens
aaaattttgtttataa

SEQ ID NO: 5078749 - DNA, 14 bp, Homo sapiens
aaaatttttataaa

SEQ ID NO: 5078750 - DNA, 17 bp, Homo sapiens
aaaatttttataaatta

SEQ ID NO: 5078751 - DNA, 19 bp, Homo sapiens
aaaatttttatgtaattat

SEQ ID NO: 5078752 - DNA, 14 bp, Homo sapiens
aaaatttttggatt

SEQ ID NO: 5078753 - DNA, 14 bp, Homo sapiens
aaaattttttactt

SEQ ID NO: 5078754 - DNA, 14 bp, Homo sapiens
aaaattttttgatt

SEQ ID NO: 5078755 - DNA, 17 bp, Homo sapiens
aaaatttttttaaggaa

SEQ ID NO: 5078756 - DNA, 15 bp, Homo sapiens
aaaatttttttcttt

SEQ ID NO: 5078757 - DNA, 21 bp, Homo sapiens
aaaatttttttggtctttttg

SEQ ID NO: 5078758 - DNA, 19 bp, Homo sapiens
aaaattttttttacaactt

SEQ ID NO: 5078759 - DNA, 19 bp, Homo sapiens
aaaattttttttcatgttt

SEQ ID NO: 5078760 - DNA, 18 bp, Homo sapiens
aaaatttttttttaacca

SEQ ID NO: 5078761 - DNA, 18 bp, Homo sapiens
aaaatttttttttctctt

SEQ ID NO: 5078762 - DNA, 15 bp, Homo sapiens
aaacaaaaaaaagaa

SEQ ID NO: 5078763 - DNA, 18 bp, Homo sapiens
aaacaaaaaaaatgttaa

SEQ ID NO: 5078764 - DNA, 18 bp, Homo sapiens
aaacaaaaaaactacaaa

SEQ ID NO: 5078765 - DNA, 13 bp, Homo sapiens
aaacaaaaaacaa

SEQ ID NO: 5078766 - DNA, 14 bp, Homo sapiens
aaacaaaaaacaat

SEQ ID NO: 5078767 - DNA, 16 bp, Homo sapiens
aaacaaaaaactgcct

SEQ ID NO: 5078768 - DNA, 14 bp, Homo sapiens
aaacaaaaaatgtg

SEQ ID NO: 5078769 - DNA, 14 bp, Homo sapiens
aaacaaaaactttc

SEQ ID NO: 5078770 - DNA, 17 bp, Homo sapiens
aaacaaaaactttccat

SEQ ID NO: 5078771 - DNA, 12 bp, Homo sapiens
aaacaaaaagaa

SEQ ID NO: 5078772 - DNA, 17 bp, Homo sapiens
aaacaaaaagaacaaaa

SEQ ID NO: 5078773 - DNA, 13 bp, Homo sapiens
aaacaaaaagcta

SEQ ID NO: 5078774 - DNA, 14 bp, Homo sapiens
aaacaaaaagctaa

SEQ ID NO: 5078775 - DNA, 21 bp, Homo sapiens
aaacaaaaattaggtattttg

SEQ ID NO: 5078776 - DNA, 18 bp, Homo sapiens
aaacaaaaattgctcaaa

SEQ ID NO: 5078777 - DNA, 16 bp, Homo sapiens
aaacaaaaattgtctt

SEQ ID NO: 5078778 - DNA, 9 bp, Homo sapiens
aaacaaaac

SEQ ID NO: 5078779 - DNA, 13 bp, Homo sapiens
aaacaaaacaaaa

SEQ ID NO: 5078780 - DNA, 16 bp, Homo sapiens
aaacaaaacaaaacaa

SEQ ID NO: 5078781 - DNA, 16 bp, Homo sapiens
aaacaaaacaaacaaa

SEQ ID NO: 5078782 - DNA, 12 bp, Homo sapiens
aaacaaaaccaa

SEQ ID NO: 5078783 - DNA, 21 bp, Homo sapiens
aaacaaaacccctaagagact

SEQ ID NO: 5078784 - DNA, 12 bp, Homo sapiens
aaacaaaactat

SEQ ID NO: 5078785 - DNA, 10 bp, Homo sapiens
aaacaaaaga

SEQ ID NO: 5078786 - DNA, 12 bp, Homo sapiens
aaacaaaaggca

SEQ ID NO: 5078787 - DNA, 20 bp, Homo sapiens
aaacaaaagggtgtatagtg

SEQ ID NO: 5078788 - DNA, 23 bp, Homo sapiens
aaacaaaagggtgtatagtgttc

SEQ ID NO: 5078789 - DNA, 15 bp, Homo sapiens
aaacaaaatataaat

SEQ ID NO: 5078790 - DNA, 13 bp, Homo sapiens
aaacaaaatattt

SEQ ID NO: 5078791 - DNA, 15 bp, Homo sapiens
aaacaaaatgaaaaa

SEQ ID NO: 5078792 - DNA, 21 bp, Homo sapiens
aaacaaaatgaaaatatcttc

SEQ ID NO: 5078793 - DNA, 16 bp, Homo sapiens
aaacaaaatgaaacaa

SEQ ID NO: 5078794 - DNA, 13 bp, Homo sapiens
aaacaaaatgaag

SEQ ID NO: 5078795 - DNA, 14 bp, Homo sapiens
aaacaaaatgtttt

SEQ ID NO: 5078796 - DNA, 20 bp, Homo sapiens
aaacaaaatttatgtcattt

SEQ ID NO: 5078797 - DNA, 17 bp, Homo sapiens
aaacaaaatttcacagt

SEQ ID NO: 5078798 - DNA, 15 bp, Homo sapiens
aaacaaaatttctat

SEQ ID NO: 5078799 - DNA, 12 bp, Homo sapiens
aaacaaaatttg

SEQ ID NO: 5078800 - DNA, 13 bp, Homo sapiens
aaacaaaatttga

SEQ ID NO: 5078801 - DNA, 17 bp, Homo sapiens
aaacaaaatttgactaa

SEQ ID NO: 5078802 - DNA, 14 bp, Homo sapiens
aaacaaacaacctg

SEQ ID NO: 5078803 - DNA, 14 bp, Homo sapiens
aaacaaacacacac

SEQ ID NO: 5078804 - DNA, 18 bp, Homo sapiens
aaacaaacaccttcttat

SEQ ID NO: 5078805 - DNA, 19 bp, Homo sapiens
aaacaaacatgcagtactt

SEQ ID NO: 5078806 - DNA, 22 bp, Homo sapiens
aaacaaacattgtgttgacatt

SEQ ID NO: 5078807 - DNA, 18 bp, Homo sapiens
aaacaaaccttgccttga

SEQ ID NO: 5078808 - DNA, 20 bp, Homo sapiens
aaacaaactcgttttttaca

SEQ ID NO: 5078809 - DNA, 13 bp, Homo sapiens
aaacaaacttcca

SEQ ID NO: 5078810 - DNA, 22 bp, Homo sapiens
aaacaaacttctcgcaactgaa

SEQ ID NO: 5078811 - DNA, 13 bp, Homo sapiens
aaacaaagacatt

SEQ ID NO: 5078812 - DNA, 16 bp, Homo sapiens
aaacaaagcaattctt

SEQ ID NO: 5078813 - DNA, 21 bp, Homo sapiens
aaacaaagcagctttaaaaaa

SEQ ID NO: 5078814 - DNA, 15 bp, Homo sapiens
aaacaaagcagtata

SEQ ID NO: 5078815 - DNA, 17 bp, Homo sapiens
aaacaaagctgatttcc

SEQ ID NO: 5078816 - DNA, 17 bp, Homo sapiens
aaacaaagcttagcagg

SEQ ID NO: 5078817 - DNA, 22 bp, Homo sapiens
aaacaaagcttagcaggagagg

SEQ ID NO: 5078818 - DNA, 16 bp, Homo sapiens
aaacaaaggaactaac

SEQ ID NO: 5078819 - DNA, 17 bp, Homo sapiens
aaacaaagggaaaaaag

SEQ ID NO: 5078820 - DNA, 16 bp, Homo sapiens
aaacaaagggttttct

SEQ ID NO: 5078821 - DNA, 13 bp, Homo sapiens
aaacaaagtcttt

SEQ ID NO: 5078822 - DNA, 20 bp, Homo sapiens
aaacaaagtgcaaagctgct

SEQ ID NO: 5078823 - DNA, 11 bp, Homo sapiens
aaacaaagtgg

SEQ ID NO: 5078824 - DNA, 13 bp, Homo sapiens
aaacaaataaaaa

SEQ ID NO: 5078825 - DNA, 13 bp, Homo sapiens
aaacaaataaaat

SEQ ID NO: 5078826 - DNA, 14 bp, Homo sapiens
aaacaaataaatat

SEQ ID NO: 5078827 - DNA, 16 bp, Homo sapiens
aaacaaataatcacat

SEQ ID NO: 5078828 - DNA, 17 bp, Homo sapiens
aaacaaataatcacatt

SEQ ID NO: 5078829 - DNA, 14 bp, Homo sapiens
aaacaaatatgcaa

SEQ ID NO: 5078830 - DNA, 12 bp, Homo sapiens
aaacaaatctca

SEQ ID NO: 5078831 - DNA, 12 bp, Homo sapiens
aaacaaatgaaa

SEQ ID NO: 5078832 - DNA, 16 bp, Homo sapiens
aaacaaatggaagaga

SEQ ID NO: 5078833 - DNA, 14 bp, Homo sapiens
aaacaaatgtgtaa

SEQ ID NO: 5078834 - DNA, 15 bp, Homo sapiens
aaacaaatgttagac

SEQ ID NO: 5078835 - DNA, 21 bp, Homo sapiens
aaacaaatgttagacttgtgt

SEQ ID NO: 5078836 - DNA, 17 bp, Homo sapiens
aaacaaattagcaatca

SEQ ID NO: 5078837 - DNA, 18 bp, Homo sapiens
aaacaaatttagaagaaa

SEQ ID NO: 5078838 - DNA, 14 bp, Homo sapiens
aaacaacaaaaaat

SEQ ID NO: 5078839 - DNA, 15 bp, Homo sapiens
aaacaacaaaaacca

SEQ ID NO: 5078840 - DNA, 21 bp, Homo sapiens
aaacaacaaaaacttagaatt

SEQ ID NO: 5078841 - DNA, 13 bp, Homo sapiens
aaacaacaaaaga

SEQ ID NO: 5078842 - DNA, 13 bp, Homo sapiens
aaacaacaaataa

SEQ ID NO: 5078843 - DNA, 14 bp, Homo sapiens
aaacaacaaataat

SEQ ID NO: 5078844 - DNA, 21 bp, Homo sapiens
aaacaacaacaatacaacaag

SEQ ID NO: 5078845 - DNA, 22 bp, Homo sapiens
aaacaacaatttctactttgaa

SEQ ID NO: 5078846 - DNA, 12 bp, Homo sapiens
aaacaacactgt

SEQ ID NO: 5078847 - DNA, 15 bp, Homo sapiens
aaacaacagaaactt

SEQ ID NO: 5078848 - DNA, 19 bp, Homo sapiens
aaacaacattttgagaaca

SEQ ID NO: 5078849 - DNA, 14 bp, Homo sapiens
aaacaaccgtcctg

SEQ ID NO: 5078850 - DNA, 16 bp, Homo sapiens
aaacaacctgaatctt

SEQ ID NO: 5078851 - DNA, 21 bp, Homo sapiens
aaacaacctgccacaatgtga

SEQ ID NO: 5078852 - DNA, 22 bp, Homo sapiens
aaacaacctgccacaatgtgat

SEQ ID NO: 5078853 - DNA, 17 bp, Homo sapiens
aaacaacgtgtatagtg

SEQ ID NO: 5078854 - DNA, 18 bp, Homo sapiens
aaacaacgtgtatagtgc

SEQ ID NO: 5078855 - DNA, 16 bp, Homo sapiens
aaacaacgttgctatt

SEQ ID NO: 5078856 - DNA, 17 bp, Homo sapiens
aaacaacgttgctattt

SEQ ID NO: 5078857 - DNA, 20 bp, Homo sapiens
aaacaacgttgctatttcca

SEQ ID NO: 5078858 - DNA, 21 bp, Homo sapiens
aaacaactgccaaataaaatg

SEQ ID NO: 5078859 - DNA, 17 bp, Homo sapiens
aaacaacttggcatttc

SEQ ID NO: 5078860 - DNA, 12 bp, Homo sapiens
aaacaacttgtg

SEQ ID NO: 5078861 - DNA, 16 bp, Homo sapiens
aaacaactttcacttc

SEQ ID NO: 5078862 - DNA, 19 bp, Homo sapiens
aaacaactttcacttcttc

SEQ ID NO: 5078863 - DNA, 17 bp, Homo sapiens
aaacaactttctcttgt

SEQ ID NO: 5078864 - DNA, 13 bp, Homo sapiens
aaacaagaaaaat

SEQ ID NO: 5078865 - DNA, 19 bp, Homo sapiens
aaacaagaaaaataaagaa

SEQ ID NO: 5078866 - DNA, 16 bp, Homo sapiens
aaacaagaaagtttcc

SEQ ID NO: 5078867 - DNA, 12 bp, Homo sapiens
aaacaagaaatc

SEQ ID NO: 5078868 - DNA, 17 bp, Homo sapiens
aaacaagaaccatttgc

SEQ ID NO: 5078869 - DNA, 12 bp, Homo sapiens
aaacaagaatga

SEQ ID NO: 5078870 - DNA, 23 bp, Homo sapiens
aaacaagaatgaaggtttttgta

SEQ ID NO: 5078871 - DNA, 17 bp, Homo sapiens
aaacaagactgcctccc

SEQ ID NO: 5078872 - DNA, 22 bp, Homo sapiens
aaacaagagttttcttccttgt

SEQ ID NO: 5078873 - DNA, 20 bp, Homo sapiens
aaacaagcatataaaatggc

SEQ ID NO: 5078874 - DNA, 16 bp, Homo sapiens
aaacaagccaacatat

SEQ ID NO: 5078875 - DNA, 13 bp, Homo sapiens
aaacaagctgata

SEQ ID NO: 5078876 - DNA, 20 bp, Homo sapiens
aaacaaggattctacctgaa

SEQ ID NO: 5078877 - DNA, 16 bp, Homo sapiens
aaacaaggttttcagt

SEQ ID NO: 5078878 - DNA, 19 bp, Homo sapiens
aaacaagtctagtcttctg

SEQ ID NO: 5078879 - DNA, 17 bp, Homo sapiens
aaacaagtgaccccagg

SEQ ID NO: 5078880 - DNA, 20 bp, Homo sapiens
aaacaagttggctagaagaa

SEQ ID NO: 5078881 - DNA, 22 bp, Homo sapiens
aaacaagttggctagaagaaag

SEQ ID NO: 5078882 - DNA, 18 bp, Homo sapiens
aaacaagtttagaaagct

SEQ ID NO: 5078883 - DNA, 21 bp, Homo sapiens
aaacaataaacgaaacacaga

SEQ ID NO: 5078884 - DNA, 15 bp, Homo sapiens
aaacaataaagagat

SEQ ID NO: 5078885 - DNA, 14 bp, Homo sapiens
aaacaataaagata

SEQ ID NO: 5078886 - DNA, 15 bp, Homo sapiens
aaacaataaatgtgc

SEQ ID NO: 5078887 - DNA, 15 bp, Homo sapiens
aaacaataagaacaa

SEQ ID NO: 5078888 - DNA, 21 bp, Homo sapiens
aaacaatactcataatgtgaa

SEQ ID NO: 5078889 - DNA, 22 bp, Homo sapiens
aaacaatagtaattctcaggcc

SEQ ID NO: 5078890 - DNA, 14 bp, Homo sapiens
aaacaatattgttt

SEQ ID NO: 5078891 - DNA, 15 bp, Homo sapiens
aaacaatattgtttc

SEQ ID NO: 5078892 - DNA, 22 bp, Homo sapiens
aaacaatatttaaccaaagaac

SEQ ID NO: 5078893 - DNA, 16 bp, Homo sapiens
aaacaatatttattgt

SEQ ID NO: 5078894 - DNA, 22 bp, Homo sapiens
aaacaatatttattgtatttta

SEQ ID NO: 5078895 - DNA, 16 bp, Homo sapiens
aaacaatcccagcagg

SEQ ID NO: 5078896 - DNA, 14 bp, Homo sapiens
aaacaatcctgtta

SEQ ID NO: 5078897 - DNA, 16 bp, Homo sapiens
aaacaatctatttaaa

SEQ ID NO: 5078898 - DNA, 15 bp, Homo sapiens
aaacaatctcttaaa

SEQ ID NO: 5078899 - DNA, 13 bp, Homo sapiens
aaacaatcttatt

SEQ ID NO: 5078900 - DNA, 20 bp, Homo sapiens
aaacaatctttcatgtcttg

SEQ ID NO: 5078901 - DNA, 17 bp, Homo sapiens
aaacaatgccatgaaca

SEQ ID NO: 5078902 - DNA, 19 bp, Homo sapiens
aaacaatgccatgaacaaa

SEQ ID NO: 5078903 - DNA, 18 bp, Homo sapiens
aaacaatggagtattctc

SEQ ID NO: 5078904 - DNA, 14 bp, Homo sapiens
aaacaatgtataaa

SEQ ID NO: 5078905 - DNA, 22 bp, Homo sapiens
aaacaatgtataaagattgtac

SEQ ID NO: 5078906 - DNA, 23 bp, Homo sapiens
aaacaatgtggagtctccctctg

SEQ ID NO: 5078907 - DNA, 18 bp, Homo sapiens
aaacaatgttgtccaaca

SEQ ID NO: 5078908 - DNA, 20 bp, Homo sapiens
aaacaatgttgtccaacaat

SEQ ID NO: 5078909 - DNA, 21 bp, Homo sapiens
aaacaatgttgtccaacaata

SEQ ID NO: 5078910 - DNA, 14 bp, Homo sapiens
aaacaatgtttaaa

SEQ ID NO: 5078911 - DNA, 16 bp, Homo sapiens
aaacaattactaatga

SEQ ID NO: 5078912 - DNA, 20 bp, Homo sapiens
aaacaattcaagctgagaaa

SEQ ID NO: 5078913 - DNA, 18 bp, Homo sapiens
aaacaattcaatcaaagc

SEQ ID NO: 5078914 - DNA, 22 bp, Homo sapiens
aaacaattcagtggtcttattt

SEQ ID NO: 5078915 - DNA, 15 bp, Homo sapiens
aaacaattcatgcct

SEQ ID NO: 5078916 - DNA, 23 bp, Homo sapiens
aaacaattcccttctttttcatc

SEQ ID NO: 5078917 - DNA, 15 bp, Homo sapiens
aaacaattctgatga

SEQ ID NO: 5078918 - DNA, 22 bp, Homo sapiens
aaacaattcttgtaactttctt

SEQ ID NO: 5078919 - DNA, 20 bp, Homo sapiens
aaacaatttaaattgttata

SEQ ID NO: 5078920 - DNA, 22 bp, Homo sapiens
aaacaattttaatgatggtgtt

SEQ ID NO: 5078921 - DNA, 20 bp, Homo sapiens
aaacaattttctgtaatctt

SEQ ID NO: 5078922 - DNA, 15 bp, Homo sapiens
aaacaattttttgtt

SEQ ID NO: 5078923 - DNA, 13 bp, Homo sapiens
aaacacaaaaaaa

SEQ ID NO: 5078924 - DNA, 18 bp, Homo sapiens
aaacacaaaaaaataata

SEQ ID NO: 5078925 - DNA, 22 bp, Homo sapiens
aaacacaaaacaacaaaaacca

SEQ ID NO: 5078926 - DNA, 20 bp, Homo sapiens
aaacacaaaagttagctgag

SEQ ID NO: 5078927 - DNA, 17 bp, Homo sapiens
aaacacaaaatgaataa

SEQ ID NO: 5078928 - DNA, 22 bp, Homo sapiens
aaacacaaagaagtttttcttt

SEQ ID NO: 5078929 - DNA, 19 bp, Homo sapiens
aaacacaaatgcagggatt

SEQ ID NO: 5078930 - DNA, 17 bp, Homo sapiens
aaacacaacacaagaaa

SEQ ID NO: 5078931 - DNA, 14 bp, Homo sapiens
aaacacaacttgtg

SEQ ID NO: 5078932 - DNA, 14 bp, Homo sapiens
aaacacaatatttt

SEQ ID NO: 5078933 - DNA, 21 bp, Homo sapiens
aaacacacaaaagattatgta

SEQ ID NO: 5078934 - DNA, 14 bp, Homo sapiens
aaacacacacacta

SEQ ID NO: 5078935 - DNA, 21 bp, Homo sapiens
aaacacacagatacacacaca

SEQ ID NO: 5078936 - DNA, 12 bp, Homo sapiens
aaacacacagta

SEQ ID NO: 5078937 - DNA, 16 bp, Homo sapiens
aaacacacagtattcg

SEQ ID NO: 5078938 - DNA, 16 bp, Homo sapiens
aaacacaccgatgcac

SEQ ID NO: 5078939 - DNA, 21 bp, Homo sapiens
aaacacacgcgcgcacacaca

SEQ ID NO: 5078940 - DNA, 15 bp, Homo sapiens
aaacacactcaaaag

SEQ ID NO: 5078941 - DNA, 17 bp, Homo sapiens
aaacacactgaaagctc

SEQ ID NO: 5078942 - DNA, 15 bp, Homo sapiens
aaacacactgaggca

SEQ ID NO: 5078943 - DNA, 16 bp, Homo sapiens
aaacacactgaggcag

SEQ ID NO: 5078944 - DNA, 17 bp, Homo sapiens
aaacacactgaggcagg

SEQ ID NO: 5078945 - DNA, 22 bp, Homo sapiens
aaacacactgtaaatatccaca

SEQ ID NO: 5078946 - DNA, 20 bp, Homo sapiens
aaacacactgttgtttagtt

SEQ ID NO: 5078947 - DNA, 21 bp, Homo sapiens
aaacacagacattctgccagg

SEQ ID NO: 5078948 - DNA, 15 bp, Homo sapiens
aaacacagagcggga

SEQ ID NO: 5078949 - DNA, 21 bp, Homo sapiens
aaacacagcatgcatttagca

SEQ ID NO: 5078950 - DNA, 11 bp, Homo sapiens
aaacacagctt

SEQ ID NO: 5078951 - DNA, 23 bp, Homo sapiens
aaacacagcttacaatcgcaaat

SEQ ID NO: 5078952 - DNA, 17 bp, Homo sapiens
aaacacagtattgtaga

SEQ ID NO: 5078953 - DNA, 20 bp, Homo sapiens
aaacacagtcaaaataattc

SEQ ID NO: 5078954 - DNA, 16 bp, Homo sapiens
aaacacagttacactt

SEQ ID NO: 5078955 - DNA, 15 bp, Homo sapiens
aaacacataaatgaa

SEQ ID NO: 5078956 - DNA, 18 bp, Homo sapiens
aaacacataattaacact

SEQ ID NO: 5078957 - DNA, 15 bp, Homo sapiens
aaacacatacaaaag

SEQ ID NO: 5078958 - DNA, 17 bp, Homo sapiens
aaacacatacaaaagaa

SEQ ID NO: 5078959 - DNA, 18 bp, Homo sapiens
aaacacatagattcacct

SEQ ID NO: 5078960 - DNA, 18 bp, Homo sapiens
aaacacatctagtagttg

SEQ ID NO: 5078961 - DNA, 14 bp, Homo sapiens
aaacacatcttccc

SEQ ID NO: 5078962 - DNA, 18 bp, Homo sapiens
aaacacatctttcctgtc

SEQ ID NO: 5078963 - DNA, 15 bp, Homo sapiens
aaacacattataaag

SEQ ID NO: 5078964 - DNA, 21 bp, Homo sapiens
aaacacattataaagttcaga

SEQ ID NO: 5078965 - DNA, 18 bp, Homo sapiens
aaacacattatgtatctt

SEQ ID NO: 5078966 - DNA, 23 bp, Homo sapiens
aaacacattcttattaattcttc

SEQ ID NO: 5078967 - DNA, 23 bp, Homo sapiens
aaacacattgcctaactactagt

SEQ ID NO: 5078968 - DNA, 16 bp, Homo sapiens
aaacacattgttattt

SEQ ID NO: 5078969 - DNA, 16 bp, Homo sapiens
aaacacatttccattc

SEQ ID NO: 5078970 - DNA, 11 bp, Homo sapiens
aaacacatttt

SEQ ID NO: 5078971 - DNA, 16 bp, Homo sapiens
aaacacatttttctta

SEQ ID NO: 5078972 - DNA, 18 bp, Homo sapiens
aaacaccaagagtacagg

SEQ ID NO: 5078973 - DNA, 12 bp, Homo sapiens
aaacaccacttt

SEQ ID NO: 5078974 - DNA, 16 bp, Homo sapiens
aaacaccactttgtaa

SEQ ID NO: 5078975 - DNA, 18 bp, Homo sapiens
aaacaccagctgtatata

SEQ ID NO: 5078976 - DNA, 12 bp, Homo sapiens
aaacaccagtgt

SEQ ID NO: 5078977 - DNA, 21 bp, Homo sapiens
aaacaccatcttcagctgtat

SEQ ID NO: 5078978 - DNA, 15 bp, Homo sapiens
aaacaccatggagat

SEQ ID NO: 5078979 - DNA, 12 bp, Homo sapiens
aaacaccattca

SEQ ID NO: 5078980 - DNA, 13 bp, Homo sapiens
aaacaccattttt

SEQ ID NO: 5078981 - DNA, 16 bp, Homo sapiens
aaacacccaagcacaa

SEQ ID NO: 5078982 - DNA, 18 bp, Homo sapiens
aaacacccaagcacaaac

SEQ ID NO: 5078983 - DNA, 22 bp, Homo sapiens
aaacacccaagcacaaactgtc

SEQ ID NO: 5078984 - DNA, 23 bp, Homo sapiens
aaacacccaagcacaaactgtcg

SEQ ID NO: 5078985 - DNA, 20 bp, Homo sapiens
aaacaccccaacttggcagc

SEQ ID NO: 5078986 - DNA, 13 bp, Homo sapiens
aaacaccccgctc

SEQ ID NO: 5078987 - DNA, 20 bp, Homo sapiens
aaacacccgacgtcatgtat

SEQ ID NO: 5078988 - DNA, 19 bp, Homo sapiens
aaacacctaagtgactacc

SEQ ID NO: 5078989 - DNA, 15 bp, Homo sapiens
aaacacctcacacct

SEQ ID NO: 5078990 - DNA, 21 bp, Homo sapiens
aaacacctcacacctcactct

SEQ ID NO: 5078991 - DNA, 22 bp, Homo sapiens
aaacacctcagctgcctcccca

SEQ ID NO: 5078992 - DNA, 14 bp, Homo sapiens
aaacacctcccagg

SEQ ID NO: 5078993 - DNA, 18 bp, Homo sapiens
aaacacctcctcatgtac

SEQ ID NO: 5078994 - DNA, 20 bp, Homo sapiens
aaacacctgagctggtggct

SEQ ID NO: 5078995 - DNA, 14 bp, Homo sapiens
aaacaccttctata

SEQ ID NO: 5078996 - DNA, 14 bp, Homo sapiens
aaacacgaaacttg

SEQ ID NO: 5078997 - DNA, 16 bp, Homo sapiens
aaacacgaaacttgtt

SEQ ID NO: 5078998 - DNA, 17 bp, Homo sapiens
aaacacgaaacttgtta

SEQ ID NO: 5078999 - DNA, 16 bp, Homo sapiens
aaacacggccctcctg

SEQ ID NO: 5079000 - DNA, 17 bp, Homo sapiens
aaacacggccctcctgg

SEQ ID NO: 5079001 - DNA, 24 bp, Homo sapiens
aaacacggcttctcatgctatttc

SEQ ID NO: 5079002 - DNA, 15 bp, Homo sapiens
aaacacgtttagaaa

SEQ ID NO: 5079003 - DNA, 14 bp, Homo sapiens
aaacactaaatgtt

SEQ ID NO: 5079004 - DNA, 16 bp, Homo sapiens
aaacactaaatgttaa

SEQ ID NO: 5079005 - DNA, 21 bp, Homo sapiens
aaacactaaatgttaaagatg

SEQ ID NO: 5079006 - DNA, 17 bp, Homo sapiens
aaacactaacaaaattt

SEQ ID NO: 5079007 - DNA, 23 bp, Homo sapiens
aaacactaacaaaatttgaataa

SEQ ID NO: 5079008 - DNA, 16 bp, Homo sapiens
aaacactaagctctct

SEQ ID NO: 5079009 - DNA, 15 bp, Homo sapiens
aaacactacacattt

SEQ ID NO: 5079010 - DNA, 19 bp, Homo sapiens
aaacactacacatttgaaa

SEQ ID NO: 5079011 - DNA, 13 bp, Homo sapiens
aaacactatttgt

SEQ ID NO: 5079012 - DNA, 20 bp, Homo sapiens
aaacactcagtccactgttg

SEQ ID NO: 5079013 - DNA, 17 bp, Homo sapiens
aaacactccacagtgtt

SEQ ID NO: 5079014 - DNA, 19 bp, Homo sapiens
aaacactccacagtgttta

SEQ ID NO: 5079015 - DNA, 22 bp, Homo sapiens
aaacactccaccccctccagct

SEQ ID NO: 5079016 - DNA, 16 bp, Homo sapiens
aaacactccttgcatc

SEQ ID NO: 5079017 - DNA, 19 bp, Homo sapiens
aaacactcgtgtgcatgag

SEQ ID NO: 5079018 - DNA, 13 bp, Homo sapiens
aaacactcttgaa

SEQ ID NO: 5079019 - DNA, 13 bp, Homo sapiens
aaacactgaatca

SEQ ID NO: 5079020 - DNA, 18 bp, Homo sapiens
aaacactgaggcagcctt

SEQ ID NO: 5079021 - DNA, 14 bp, Homo sapiens
aaacactgcaggca

SEQ ID NO: 5079022 - DNA, 15 bp, Homo sapiens
aaacactgcaggcat

SEQ ID NO: 5079023 - DNA, 18 bp, Homo sapiens
aaacactgcagtttcctg

SEQ ID NO: 5079024 - DNA, 13 bp, Homo sapiens
aaacactgccatc

SEQ ID NO: 5079025 - DNA, 22 bp, Homo sapiens
aaacactgcctatatatgtaaa

SEQ ID NO: 5079026 - DNA, 17 bp, Homo sapiens
aaacactgcctttttat

SEQ ID NO: 5079027 - DNA, 14 bp, Homo sapiens
aaacactgcgcttt

SEQ ID NO: 5079028 - DNA, 21 bp, Homo sapiens
aaacactgggagaaatgaaaa

SEQ ID NO: 5079029 - DNA, 19 bp, Homo sapiens
aaacactggttttaaatat

SEQ ID NO: 5079030 - DNA, 21 bp, Homo sapiens
aaacactgtaatcttaaaagt

SEQ ID NO: 5079031 - DNA, 23 bp, Homo sapiens
aaacactgtaatcttaaaagtgt

SEQ ID NO: 5079032 - DNA, 22 bp, Homo sapiens
aaacactgtattgtaagtggaa

SEQ ID NO: 5079033 - DNA, 16 bp, Homo sapiens
aaacactgttctctgc

SEQ ID NO: 5079034 - DNA, 22 bp, Homo sapiens
aaacactgttctctgccctcca

SEQ ID NO: 5079035 - DNA, 17 bp, Homo sapiens
aaacacttaggaagaaa

SEQ ID NO: 5079036 - DNA, 21 bp, Homo sapiens
aaacacttatcttctggatta

SEQ ID NO: 5079037 - DNA, 21 bp, Homo sapiens
aaacacttattgtttgaaaga

SEQ ID NO: 5079038 - DNA, 16 bp, Homo sapiens
aaacacttgtgacttt

SEQ ID NO: 5079039 - DNA, 23 bp, Homo sapiens
aaacactttacagttctggagga

SEQ ID NO: 5079040 - DNA, 14 bp, Homo sapiens
aaacactttctctt

SEQ ID NO: 5079041 - DNA, 11 bp, Homo sapiens
aaacagaaaaa

SEQ ID NO: 5079042 - DNA, 19 bp, Homo sapiens
aaacagaaaaacagacaaa

SEQ ID NO: 5079043 - DNA, 13 bp, Homo sapiens
aaacagaaaagag

SEQ ID NO: 5079044 - DNA, 23 bp, Homo sapiens
aaagacttgagacaatgttttct

SEQ ID NO: 5079045 - DNA, 18 bp, Homo sapiens
aaagacttgatgaataaa

SEQ ID NO: 5079046 - DNA, 20 bp, Homo sapiens
aaagacttgatgaataaaca

SEQ ID NO: 5079047 - DNA, 18 bp, Homo sapiens
aaagactttaaaagtgat

SEQ ID NO: 5079048 - DNA, 19 bp, Homo sapiens
aaagacttttccaaccctc

SEQ ID NO: 5079049 - DNA, 13 bp, Homo sapiens
aaagagaaaaaaa

SEQ ID NO: 5079050 - DNA, 17 bp, Homo sapiens
aaagagaaaaagaaatg

SEQ ID NO: 5079051 - DNA, 18 bp, Homo sapiens
aaagagaaaacatctcat

SEQ ID NO: 5079052 - DNA, 23 bp, Homo sapiens
aaagagaaaagggaaaaaagaaa

SEQ ID NO: 5079053 - DNA, 18 bp, Homo sapiens
aaagagaaaatatatatt

SEQ ID NO: 5079054 - DNA, 21 bp, Homo sapiens
aaagagaaaatgctttctcat

SEQ ID NO: 5079055 - DNA, 24 bp, Homo sapiens
aaagagaaaatgctttctcatgca

SEQ ID NO: 5079056 - DNA, 15 bp, Homo sapiens
aaagagaaaattgaa

SEQ ID NO: 5079057 - DNA, 22 bp, Homo sapiens
aaagagaaaattgaatttaaca

SEQ ID NO: 5079058 - DNA, 13 bp, Homo sapiens
aaagagaaacacg

SEQ ID NO: 5079059 - DNA, 14 bp, Homo sapiens
aaagagaaacacta

SEQ ID NO: 5079060 - DNA, 14 bp, Homo sapiens
aaagagaaactttg

SEQ ID NO: 5079061 - DNA, 21 bp, Homo sapiens
aaagagaaactttgtgctaca

SEQ ID NO: 5079062 - DNA, 19 bp, Homo sapiens
aaagagaaaggggcaagaa

SEQ ID NO: 5079063 - DNA, 21 bp, Homo sapiens
aaagagaaaggggcaagaaat

SEQ ID NO: 5079064 - DNA, 23 bp, Homo sapiens
aaagagaaatatatttgtcactt

SEQ ID NO: 5079065 - DNA, 14 bp, Homo sapiens
aaagagaaatgatg

SEQ ID NO: 5079066 - DNA, 18 bp, Homo sapiens
aaagagaaatgatgtgaa

SEQ ID NO: 5079067 - DNA, 19 bp, Homo sapiens
aaagagaaatgatgtgaaa

SEQ ID NO: 5079068 - DNA, 14 bp, Homo sapiens
aaagagaacaagag

SEQ ID NO: 5079069 - DNA, 18 bp, Homo sapiens
aaagagaacttccagatc

SEQ ID NO: 5079070 - DNA, 13 bp, Homo sapiens
aaagagaagaaga

SEQ ID NO: 5079071 - DNA, 14 bp, Homo sapiens
aaagagaagaagaa

SEQ ID NO: 5079072 - DNA, 19 bp, Homo sapiens
aaagagaagaagaaaaaaa

SEQ ID NO: 5079073 - DNA, 15 bp, Homo sapiens
aaagagaagtattat

SEQ ID NO: 5079074 - DNA, 18 bp, Homo sapiens
aaagagaataaagacttc

SEQ ID NO: 5079075 - DNA, 14 bp, Homo sapiens
aaagagaatgagtc

SEQ ID NO: 5079076 - DNA, 15 bp, Homo sapiens
aaagagaatgtattt

SEQ ID NO: 5079077 - DNA, 21 bp, Homo sapiens
aaagagaatttggagccagga

SEQ ID NO: 5079078 - DNA, 14 bp, Homo sapiens
aaagagacaaatag

SEQ ID NO: 5079079 - DNA, 21 bp, Homo sapiens
aaagagacagtgatattggaa

SEQ ID NO: 5079080 - DNA, 12 bp, Homo sapiens
aaagagacattt

SEQ ID NO: 5079081 - DNA, 23 bp, Homo sapiens
aaagagactaatagagacacaga

SEQ ID NO: 5079082 - DNA, 18 bp, Homo sapiens
aaagagacttctctgtaa

SEQ ID NO: 5079083 - DNA, 12 bp, Homo sapiens
aaagagagaaaa

SEQ ID NO: 5079084 - DNA, 18 bp, Homo sapiens
aaagagagaaaaacaaat

SEQ ID NO: 5079085 - DNA, 14 bp, Homo sapiens
aaagagagaaaata

SEQ ID NO: 5079086 - DNA, 15 bp, Homo sapiens
aaagagagaaaataa

SEQ ID NO: 5079087 - DNA, 17 bp, Homo sapiens
aaagagagaaaataaaa

SEQ ID NO: 5079088 - DNA, 18 bp, Homo sapiens
aaagagagaaacactgaa

SEQ ID NO: 5079089 - DNA, 23 bp, Homo sapiens
aaagagagaaccaagcttgtctt

SEQ ID NO: 5079090 - DNA, 19 bp, Homo sapiens
aaagagagaagccagccac

SEQ ID NO: 5079091 - DNA, 20 bp, Homo sapiens
aaagagagaagccagccaca

SEQ ID NO: 5079092 - DNA, 16 bp, Homo sapiens
aaagagagaccccagt

SEQ ID NO: 5079093 - DNA, 11 bp, Homo sapiens
aaagagagaga

SEQ ID NO: 5079094 - DNA, 20 bp, Homo sapiens
aaagagagagagagaaaaaa

SEQ ID NO: 5079095 - DNA, 20 bp, Homo sapiens
aaagagagatgggccaggca

SEQ ID NO: 5079096 - DNA, 13 bp, Homo sapiens
aaagagagcactg

SEQ ID NO: 5079097 - DNA, 20 bp, Homo sapiens
aaagagagcagagaatataa

SEQ ID NO: 5079098 - DNA, 12 bp, Homo sapiens
aaagagagctct

SEQ ID NO: 5079099 - DNA, 11 bp, Homo sapiens
aaagagaggtt

SEQ ID NO: 5079100 - DNA, 23 bp, Homo sapiens
aaagagagtttttaatagaacca

SEQ ID NO: 5079101 - DNA, 15 bp, Homo sapiens
aaagagataataaga

SEQ ID NO: 5079102 - DNA, 16 bp, Homo sapiens
aaagagatagttctaa

SEQ ID NO: 5079103 - DNA, 20 bp, Homo sapiens
aaagagatattttaaaatga

SEQ ID NO: 5079104 - DNA, 18 bp, Homo sapiens
aaagagatggcctgagaa

SEQ ID NO: 5079105 - DNA, 16 bp, Homo sapiens
aaagagatgtccttgt

SEQ ID NO: 5079106 - DNA, 20 bp, Homo sapiens
aaagagattagaacatttaa

SEQ ID NO: 5079107 - DNA, 22 bp, Homo sapiens
aaagagcacttcacacagacaa

SEQ ID NO: 5079108 - DNA, 19 bp, Homo sapiens
aaagagcaggatagctctt

SEQ ID NO: 5079109 - DNA, 14 bp, Homo sapiens
aaagagcagtcaga

SEQ ID NO: 5079110 - DNA, 14 bp, Homo sapiens
aaagagcatcctga

SEQ ID NO: 5079111 - DNA, 15 bp, Homo sapiens
aaagagcatcctgat

SEQ ID NO: 5079112 - DNA, 19 bp, Homo sapiens
aaagagcatggatgcattt

SEQ ID NO: 5079113 - DNA, 22 bp, Homo sapiens
aaagagcatggatgcatttcaa

SEQ ID NO: 5079114 - DNA, 22 bp, Homo sapiens
aaagagccactttcaagctgca

SEQ ID NO: 5079115 - DNA, 12 bp, Homo sapiens
aaagagccatgt

SEQ ID NO: 5079116 - DNA, 22 bp, Homo sapiens
aaagagccatgtgtcatgtaat

SEQ ID NO: 5079117 - DNA, 14 bp, Homo sapiens
aaagagccctggct

SEQ ID NO: 5079118 - DNA, 17 bp, Homo sapiens
aaagagccctggctctg

SEQ ID NO: 5079119 - DNA, 18 bp, Homo sapiens
aaagagccctggctctgc

SEQ ID NO: 5079120 - DNA, 19 bp, Homo sapiens
aaagagccctggctctgcc

SEQ ID NO: 5079121 - DNA, 20 bp, Homo sapiens
aaagagccttcactggttct

SEQ ID NO: 5079122 - DNA, 23 bp, Homo sapiens
aaagagctaggaaagagttgagc

SEQ ID NO: 5079123 - DNA, 17 bp, Homo sapiens
aaagagctcagacattt

SEQ ID NO: 5079124 - DNA, 20 bp, Homo sapiens
aaagagctcagacattttct

SEQ ID NO: 5079125 - DNA, 12 bp, Homo sapiens
aaagagctgcct

SEQ ID NO: 5079126 - DNA, 19 bp, Homo sapiens
aaagagctgcctggatgag

SEQ ID NO: 5079127 - DNA, 20 bp, Homo sapiens
aaagagctgggatcccacag

SEQ ID NO: 5079128 - DNA, 15 bp, Homo sapiens
aaagagctgttcttt

SEQ ID NO: 5079129 - DNA, 22 bp, Homo sapiens
aaagagctttcttcccgaaccc

SEQ ID NO: 5079130 - DNA, 11 bp, Homo sapiens
aaagaggaaaa

SEQ ID NO: 5079131 - DNA, 14 bp, Homo sapiens
aaagaggaaagaat

SEQ ID NO: 5079132 - DNA, 18 bp, Homo sapiens
aaagaggaaattaaataa

SEQ ID NO: 5079133 - DNA, 19 bp, Homo sapiens
aaagaggaaattaaataat

SEQ ID NO: 5079134 - DNA, 16 bp, Homo sapiens
aaagaggaagccttgc

SEQ ID NO: 5079135 - DNA, 22 bp, Homo sapiens
aaagaggaagccttgcccagca

SEQ ID NO: 5079136 - DNA, 21 bp, Homo sapiens
aaagaggactcgcttgtaaat

SEQ ID NO: 5079137 - DNA, 19 bp, Homo sapiens
aaagaggagaaaatttata

SEQ ID NO: 5079138 - DNA, 22 bp, Homo sapiens
aaagaggagaaggagagggagt

SEQ ID NO: 5079139 - DNA, 14 bp, Homo sapiens
aaagaggagccttt

SEQ ID NO: 5079140 - DNA, 22 bp, Homo sapiens
aaagaggagcctttccagaact

SEQ ID NO: 5079141 - DNA, 20 bp, Homo sapiens
aaagaggatgatttcagaag

SEQ ID NO: 5079142 - DNA, 20 bp, Homo sapiens
aaagaggcagcttgaaactg

SEQ ID NO: 5079143 - DNA, 12 bp, Homo sapiens
aaagaggcaggg

SEQ ID NO: 5079144 - DNA, 20 bp, Homo sapiens
aaagaggcagttgcccagcc

SEQ ID NO: 5079145 - DNA, 22 bp, Homo sapiens
aaagaggcccaagtgcaaaaga

SEQ ID NO: 5079146 - DNA, 19 bp, Homo sapiens
aaagaggcgtcttgtattt

SEQ ID NO: 5079147 - DNA, 21 bp, Homo sapiens
aaagaggctctggacagcaga

SEQ ID NO: 5079148 - DNA, 12 bp, Homo sapiens
aaagaggctgag

SEQ ID NO: 5079149 - DNA, 20 bp, Homo sapiens
aaagaggctgaggcctggac

SEQ ID NO: 5079150 - DNA, 21 bp, Homo sapiens
aaagaggctgaggcctggact

SEQ ID NO: 5079151 - DNA, 14 bp, Homo sapiens
aaagaggctgtgtg

SEQ ID NO: 5079152 - DNA, 14 bp, Homo sapiens
aaagaggcttccaa

SEQ ID NO: 5079153 - DNA, 19 bp, Homo sapiens
aaagagggaaaaagagctg

SEQ ID NO: 5079154 - DNA, 12 bp, Homo sapiens
aaagagggacag

SEQ ID NO: 5079155 - DNA, 23 bp, Homo sapiens
aaagagggagcaggtgcccccag

SEQ ID NO: 5079156 - DNA, 19 bp, Homo sapiens
aaagagggcttcctctaga

SEQ ID NO: 5079157 - DNA, 14 bp, Homo sapiens
aaagaggggcgctg

SEQ ID NO: 5079158 - DNA, 17 bp, Homo sapiens
aaagaggtgaaaatgaa

SEQ ID NO: 5079159 - DNA, 15 bp, Homo sapiens
aaagaggtgaacatt

SEQ ID NO: 5079160 - DNA, 20 bp, Homo sapiens
aaagaggtgaccccagggca

SEQ ID NO: 5079161 - DNA, 21 bp, Homo sapiens
aaagaggtgaccccagggcac

SEQ ID NO: 5079162 - DNA, 19 bp, Homo sapiens
aaagaggtttttcttaaat

SEQ ID NO: 5079163 - DNA, 17 bp, Homo sapiens
aaagagtaaatatactt

SEQ ID NO: 5079164 - DNA, 20 bp, Homo sapiens
aaagagtaatttcatttaaa

SEQ ID NO: 5079165 - DNA, 14 bp, Homo sapiens
aaagagtacactca

SEQ ID NO: 5079166 - DNA, 20 bp, Homo sapiens
aaagagtacactcagccact

SEQ ID NO: 5079167 - DNA, 13 bp, Homo sapiens
aaagagtagaaag

SEQ ID NO: 5079168 - DNA, 13 bp, Homo sapiens
aaagagtagaatt

SEQ ID NO: 5079169 - DNA, 22 bp, Homo sapiens
aaagagtatcaaaggcagaaag

SEQ ID NO: 5079170 - DNA, 14 bp, Homo sapiens
aaagagtcagccct

SEQ ID NO: 5079171 - DNA, 21 bp, Homo sapiens
aaagagtccattgtttaaaaa

SEQ ID NO: 5079172 - DNA, 23 bp, Homo sapiens
aaagagtcctccttcccagctct

SEQ ID NO: 5079173 - DNA, 21 bp, Homo sapiens
aaagagtctagattcaaaggt

SEQ ID NO: 5079174 - DNA, 17 bp, Homo sapiens
aaagagtctctggctca

SEQ ID NO: 5079175 - DNA, 14 bp, Homo sapiens
aaagagtctgggac

SEQ ID NO: 5079176 - DNA, 20 bp, Homo sapiens
aaagagtcttaattttctaa

SEQ ID NO: 5079177 - DNA, 22 bp, Homo sapiens
aaagagtcttaattttctaaaa

SEQ ID NO: 5079178 - DNA, 17 bp, Homo sapiens
aaagagtgaaatattgt

SEQ ID NO: 5079179 - DNA, 19 bp, Homo sapiens
aaagagtgaaatattgtaa

SEQ ID NO: 5079180 - DNA, 22 bp, Homo sapiens
aaagagtgaatgccatttagaa

SEQ ID NO: 5079181 - DNA, 22 bp, Homo sapiens
aaagagtgggctgcatctggga

SEQ ID NO: 5079182 - DNA, 18 bp, Homo sapiens
aaagagtgtaaaatattt

SEQ ID NO: 5079183 - DNA, 17 bp, Homo sapiens
aaagagtgtgttataaa

SEQ ID NO: 5079184 - DNA, 18 bp, Homo sapiens
aaagagtgttatcatatt

SEQ ID NO: 5079185 - DNA, 22 bp, Homo sapiens
aaagagttatatgacttcttgt

SEQ ID NO: 5079186 - DNA, 23 bp, Homo sapiens
aaagagttctggaaaagaactgt

SEQ ID NO: 5079187 - DNA, 24 bp, Homo sapiens
aaagagttctggaaaagaactgtt

SEQ ID NO: 5079188 - DNA, 16 bp, Homo sapiens
aaagagttcttaagga

SEQ ID NO: 5079189 - DNA, 17 bp, Homo sapiens
aaagagttgagcacagg

SEQ ID NO: 5079190 - DNA, 21 bp, Homo sapiens
aaagagttgtcctgatgtttt

SEQ ID NO: 5079191 - DNA, 15 bp, Homo sapiens
aaagagtttaaacaa

SEQ ID NO: 5079192 - DNA, 16 bp, Homo sapiens
aaagataaagacaaag

SEQ ID NO: 5079193 - DNA, 15 bp, Homo sapiens
aaagataaagatgat

SEQ ID NO: 5079194 - DNA, 16 bp, Homo sapiens
aaagataaatattata

SEQ ID NO: 5079195 - DNA, 15 bp, Homo sapiens
aaagataaatgatga

SEQ ID NO: 5079196 - DNA, 18 bp, Homo sapiens
aaagataaatgatgattc

SEQ ID NO: 5079197 - DNA, 21 bp, Homo sapiens
aaagataaattatatcaattt

SEQ ID NO: 5079198 - DNA, 18 bp, Homo sapiens
aaagataaatttgttgaa

SEQ ID NO: 5079199 - DNA, 14 bp, Homo sapiens
aaagataacgcagg

SEQ ID NO: 5079200 - DNA, 15 bp, Homo sapiens
aaagataacgcagga

SEQ ID NO: 5079201 - DNA, 17 bp, Homo sapiens
aaagataacgcaggaga

SEQ ID NO: 5079202 - DNA, 22 bp, Homo sapiens
aaagataacgcaggagagagag

SEQ ID NO: 5079203 - DNA, 15 bp, Homo sapiens
aaagataagaaatac

SEQ ID NO: 5079204 - DNA, 15 bp, Homo sapiens
aaagataagacttcc

SEQ ID NO: 5079205 - DNA, 21 bp, Homo sapiens
aaagataatattttacataca

SEQ ID NO: 5079206 - DNA, 19 bp, Homo sapiens
aaagataatctctcagctt

SEQ ID NO: 5079207 - DNA, 18 bp, Homo sapiens
aaagataatgcatatttt

SEQ ID NO: 5079208 - DNA, 21 bp, Homo sapiens
aaagataatgcatatttttgc

SEQ ID NO: 5079209 - DNA, 13 bp, Homo sapiens
aaagataatgtta

SEQ ID NO: 5079210 - DNA, 16 bp, Homo sapiens
aaagataatgttatac

SEQ ID NO: 5079211 - DNA, 20 bp, Homo sapiens
aaagataatttatttcaata

SEQ ID NO: 5079212 - DNA, 20 bp, Homo sapiens
aaagatacaaaatgttactg

SEQ ID NO: 5079213 - DNA, 17 bp, Homo sapiens
aaagatacaagaaaaag

SEQ ID NO: 5079214 - DNA, 21 bp, Homo sapiens
aaagataccatgtataatttt

SEQ ID NO: 5079215 - DNA, 22 bp, Homo sapiens
aaagataccatgtataattttc

SEQ ID NO: 5079216 - DNA, 16 bp, Homo sapiens
aaagatacgactttat

SEQ ID NO: 5079217 - DNA, 22 bp, Homo sapiens
aaagatacgactttattttctg

SEQ ID NO: 5079218 - DNA, 18 bp, Homo sapiens
aaagatacttgatgcact

SEQ ID NO: 5079219 - DNA, 15 bp, Homo sapiens
aaagatagggaggga

SEQ ID NO: 5079220 - DNA, 16 bp, Homo sapiens
aaagataggtatggaa

SEQ ID NO: 5079221 - DNA, 16 bp, Homo sapiens
aaagcagttaaactga

SEQ ID NO: 5079222 - DNA, 18 bp, Homo sapiens
aaagcagttaatttatat

SEQ ID NO: 5079223 - DNA, 14 bp, Homo sapiens
aaagcagttctgat

SEQ ID NO: 5079224 - DNA, 20 bp, Homo sapiens
aaagcagttctgatgcttac

SEQ ID NO: 5079225 - DNA, 20 bp, Homo sapiens
aaagcagttgagattctcta

SEQ ID NO: 5079226 - DNA, 21 bp, Homo sapiens
aaagcagttgggagtacatat

SEQ ID NO: 5079227 - DNA, 22 bp, Homo sapiens
aaagcagttgggagtacatatg

SEQ ID NO: 5079228 - DNA, 14 bp, Homo sapiens
aaagcataaaaaca

SEQ ID NO: 5079229 - DNA, 21 bp, Homo sapiens
aaagcataaagctcaaatgaa

SEQ ID NO: 5079230 - DNA, 22 bp, Homo sapiens
aaagcataaagctcaaatgaaa

SEQ ID NO: 5079231 - DNA, 15 bp, Homo sapiens
aaagcataaatgcaa

SEQ ID NO: 5079232 - DNA, 17 bp, Homo sapiens
aaagcatagatgttttg

SEQ ID NO: 5079233 - DNA, 18 bp, Homo sapiens
aaagcatatataaaacaa

SEQ ID NO: 5079234 - DNA, 22 bp, Homo sapiens
aaagcatatataaaacaaaaca

SEQ ID NO: 5079235 - DNA, 17 bp, Homo sapiens
aaagcatattgactttt

SEQ ID NO: 5079236 - DNA, 16 bp, Homo sapiens
aaagcatcacctcagg

SEQ ID NO: 5079237 - DNA, 16 bp, Homo sapiens
aaagcatcacttggga

SEQ ID NO: 5079238 - DNA, 16 bp, Homo sapiens
aaagcatcattacaat

SEQ ID NO: 5079239 - DNA, 17 bp, Homo sapiens
aaagcatccctcaccca

SEQ ID NO: 5079240 - DNA, 17 bp, Homo sapiens
aaagcatcctcctcctg

SEQ ID NO: 5079241 - DNA, 20 bp, Homo sapiens
aaagcatcggtcatgtgtgt

SEQ ID NO: 5079242 - DNA, 22 bp, Homo sapiens
aaagcatcggtcatgtgtgtat

SEQ ID NO: 5079243 - DNA, 22 bp, Homo sapiens
aaagcatcttgcattatgcaat

SEQ ID NO: 5079244 - DNA, 16 bp, Homo sapiens
aaagcatgaaatgtga

SEQ ID NO: 5079245 - DNA, 21 bp, Homo sapiens
aaagcatgaatatttcttaag

SEQ ID NO: 5079246 - DNA, 14 bp, Homo sapiens
aaagcatgaatggt

SEQ ID NO: 5079247 - DNA, 12 bp, Homo sapiens
aaagcatgaatt

SEQ ID NO: 5079248 - DNA, 15 bp, Homo sapiens
aaagcatgaattgga

SEQ ID NO: 5079249 - DNA, 16 bp, Homo sapiens
aaagcatgaattggaa

SEQ ID NO: 5079250 - DNA, 23 bp, Homo sapiens
aaagcatgaattggaactgcaat

SEQ ID NO: 5079251 - DNA, 16 bp, Homo sapiens
aaagcatgatgggaaa

SEQ ID NO: 5079252 - DNA, 22 bp, Homo sapiens
aaagcatgatgggaaaatattt

SEQ ID NO: 5079253 - DNA, 22 bp, Homo sapiens
aaagcatgcatatcattaaaca

SEQ ID NO: 5079254 - DNA, 13 bp, Homo sapiens
aaagcatgctcag

SEQ ID NO: 5079255 - DNA, 19 bp, Homo sapiens
aaagcatgctcagtattga

SEQ ID NO: 5079256 - DNA, 15 bp, Homo sapiens
aaagcatggacattt

SEQ ID NO: 5079257 - DNA, 13 bp, Homo sapiens
aaagcatggagag

SEQ ID NO: 5079258 - DNA, 18 bp, Homo sapiens
aaagcatggccctgctgc

SEQ ID NO: 5079259 - DNA, 23 bp, Homo sapiens
aaagcatggccctgctgcccctc

SEQ ID NO: 5079260 - DNA, 20 bp, Homo sapiens
aaagcatggtataattgaaa

SEQ ID NO: 5079261 - DNA, 22 bp, Homo sapiens
aaagcatggtataattgaaact

SEQ ID NO: 5079262 - DNA, 15 bp, Homo sapiens
aaagcatgtacagtg

SEQ ID NO: 5079263 - DNA, 16 bp, Homo sapiens
aaagcatgtacagtgt

SEQ ID NO: 5079264 - DNA, 13 bp, Homo sapiens
aaagcatgtatag

SEQ ID NO: 5079265 - DNA, 21 bp, Homo sapiens
aaagcatgtctctgcttccat

SEQ ID NO: 5079266 - DNA, 14 bp, Homo sapiens
aaagcatgttgtga

SEQ ID NO: 5079267 - DNA, 16 bp, Homo sapiens
aaagcattattttttg

SEQ ID NO: 5079268 - DNA, 14 bp, Homo sapiens
aaagcattgcagaa

SEQ ID NO: 5079269 - DNA, 18 bp, Homo sapiens
aaagcattgctgttatgt

SEQ ID NO: 5079270 - DNA, 17 bp, Homo sapiens
aaagcattgcttttatt

SEQ ID NO: 5079271 - DNA, 21 bp, Homo sapiens
aaagcattgcttttattttga

SEQ ID NO: 5079272 - DNA, 19 bp, Homo sapiens
aaagcattgtaaatgtgct

SEQ ID NO: 5079273 - DNA, 20 bp, Homo sapiens
aaagcattgtaaatgtgctt

SEQ ID NO: 5079274 - DNA, 15 bp, Homo sapiens
aaagcatttaggaga

SEQ ID NO: 5079275 - DNA, 13 bp, Homo sapiens
aaagcatttgaat

SEQ ID NO: 5079276 - DNA, 13 bp, Homo sapiens
aaagcattttgta

SEQ ID NO: 5079277 - DNA, 15 bp, Homo sapiens
aaagcattttgtaat

SEQ ID NO: 5079278 - DNA, 21 bp, Homo sapiens
aaagcattttgtaataataaa

SEQ ID NO: 5079279 - DNA, 20 bp, Homo sapiens
aaagcatttttattatattt

SEQ ID NO: 5079280 - DNA, 15 bp, Homo sapiens
aaagccaaaggtcaa

SEQ ID NO: 5079281 - DNA, 19 bp, Homo sapiens
aaagccaaaggtctagaaa

SEQ ID NO: 5079282 - DNA, 18 bp, Homo sapiens
aaagccaaagtttctgtt

SEQ ID NO: 5079283 - DNA, 20 bp, Homo sapiens
aaagccaaatcaaaatatgt

SEQ ID NO: 5079284 - DNA, 14 bp, Homo sapiens
aaagccaaatttat

SEQ ID NO: 5079285 - DNA, 15 bp, Homo sapiens
aaagccaaatttata

SEQ ID NO: 5079286 - DNA, 19 bp, Homo sapiens
aaagccaacaactctgcct

SEQ ID NO: 5079287 - DNA, 20 bp, Homo sapiens
aaagccaaccttcaaagaaa

SEQ ID NO: 5079288 - DNA, 22 bp, Homo sapiens
aaagccaaccttcaaagaaact

SEQ ID NO: 5079289 - DNA, 11 bp, Homo sapiens
aaagccaagaa

SEQ ID NO: 5079290 - DNA, 15 bp, Homo sapiens
aaagccaagaggctg

SEQ ID NO: 5079291 - DNA, 10 bp, Homo sapiens
aaagccaagc

SEQ ID NO: 5079292 - DNA, 12 bp, Homo sapiens
aaagccaagcct

SEQ ID NO: 5079293 - DNA, 22 bp, Homo sapiens
aaagccaaggagtcactgagac

SEQ ID NO: 5079294 - DNA, 13 bp, Homo sapiens
aaagccaaggtaa

SEQ ID NO: 5079295 - DNA, 23 bp, Homo sapiens
aaagccaagtttatatacaatta

SEQ ID NO: 5079296 - DNA, 15 bp, Homo sapiens
aaagccaatgtgaac

SEQ ID NO: 5079297 - DNA, 23 bp, Homo sapiens
aaagccacaattattttaatatt

SEQ ID NO: 5079298 - DNA, 17 bp, Homo sapiens
aaagccacagcagagca

SEQ ID NO: 5079299 - DNA, 18 bp, Homo sapiens
aaagccacagcagagcat

SEQ ID NO: 5079300 - DNA, 20 bp, Homo sapiens
aaagccacattatttctagt

SEQ ID NO: 5079301 - DNA, 14 bp, Homo sapiens
aaagccaccacaca

SEQ ID NO: 5079302 - DNA, 12 bp, Homo sapiens
aaagccacccca

SEQ ID NO: 5079303 - DNA, 19 bp, Homo sapiens
aaagccacctctgtcattt

SEQ ID NO: 5079304 - DNA, 20 bp, Homo sapiens
aaagccacctctgtcatttg

SEQ ID NO: 5079305 - DNA, 16 bp, Homo sapiens
aaagccactagactct

SEQ ID NO: 5079306 - DNA, 13 bp, Homo sapiens
aaagccactggaa

SEQ ID NO: 5079307 - DNA, 21 bp, Homo sapiens
aaagccactggaaggagcaca

SEQ ID NO: 5079308 - DNA, 17 bp, Homo sapiens
aaagccacttctggctt

SEQ ID NO: 5079309 - DNA, 12 bp, Homo sapiens
aaagccactttc

SEQ ID NO: 5079310 - DNA, 19 bp, Homo sapiens
aaagccagacaacttctgt

SEQ ID NO: 5079311 - DNA, 24 bp, Homo sapiens
aaagccagacaacttctgtttctt

SEQ ID NO: 5079312 - DNA, 13 bp, Homo sapiens
aaagccagagtgg

SEQ ID NO: 5079313 - DNA, 20 bp, Homo sapiens
aaagccagatgctagagcct

SEQ ID NO: 5079314 - DNA, 12 bp, Homo sapiens
aaagccagcctg

SEQ ID NO: 5079315 - DNA, 13 bp, Homo sapiens
aaagccagcctgg

SEQ ID NO: 5079316 - DNA, 20 bp, Homo sapiens
aaagccagcctgggggctgg

SEQ ID NO: 5079317 - DNA, 21 bp, Homo sapiens
aaagccagcgtcctcctctgt

SEQ ID NO: 5079318 - DNA, 13 bp, Homo sapiens
aaagccaggagca

SEQ ID NO: 5079319 - DNA, 21 bp, Homo sapiens
aaagccaggctcaggagaagc

SEQ ID NO: 5079320 - DNA, 16 bp, Homo sapiens
aaagccagggctggag

SEQ ID NO: 5079321 - DNA, 13 bp, Homo sapiens
aaagccagggtct

SEQ ID NO: 5079322 - DNA, 22 bp, Homo sapiens
aaagccagggtctctccctcag

SEQ ID NO: 5079323 - DNA, 19 bp, Homo sapiens
aaagccaggtccctctcat

SEQ ID NO: 5079324 - DNA, 14 bp, Homo sapiens
aaagccagtcttaa

SEQ ID NO: 5079325 - DNA, 16 bp, Homo sapiens
aaagccagtgactcca

SEQ ID NO: 5079326 - DNA, 17 bp, Homo sapiens
aaagccagtgctgtctg

SEQ ID NO: 5079327 - DNA, 22 bp, Homo sapiens
aaagccatatggacactgtgac

SEQ ID NO: 5079328 - DNA, 13 bp, Homo sapiens
aaagccatattcc

SEQ ID NO: 5079329 - DNA, 15 bp, Homo sapiens
aaagccatattccag

SEQ ID NO: 5079330 - DNA, 19 bp, Homo sapiens
aaagccatattccagcagt

SEQ ID NO: 5079331 - DNA, 20 bp, Homo sapiens
aaagccatattccagcagtg

SEQ ID NO: 5079332 - DNA, 22 bp, Homo sapiens
aaagccatattccagcagtgaa

SEQ ID NO: 5079333 - DNA, 17 bp, Homo sapiens
aaagccatattctaaat

SEQ ID NO: 5079334 - DNA, 22 bp, Homo sapiens
aaagccatccccgctcctggtt

SEQ ID NO: 5079335 - DNA, 18 bp, Homo sapiens
aaagccatgccaataaag

SEQ ID NO: 5079336 - DNA, 16 bp, Homo sapiens
aaagccatgtttaaga

SEQ ID NO: 5079337 - DNA, 17 bp, Homo sapiens
aaagccatgtttaagat

SEQ ID NO: 5079338 - DNA, 18 bp, Homo sapiens
aaagccatgtttaagatt

SEQ ID NO: 5079339 - DNA, 19 bp, Homo sapiens
aaagccatgtttaagattt

SEQ ID NO: 5079340 - DNA, 14 bp, Homo sapiens
aaagccatgtttat

SEQ ID NO: 5079341 - DNA, 17 bp, Homo sapiens
aaagccatgtttattac

SEQ ID NO: 5079342 - DNA, 23 bp, Homo sapiens
aaagccatgtttattacagtata

SEQ ID NO: 5079343 - DNA, 13 bp, Homo sapiens
aaagccattttgg

SEQ ID NO: 5079344 - DNA, 15 bp, Homo sapiens
aaagcccaaagtggt

SEQ ID NO: 5079345 - DNA, 18 bp, Homo sapiens
aaagcccaaagtggtata

SEQ ID NO: 5079346 - DNA, 23 bp, Homo sapiens
aaagcccaagggatctggtccta

SEQ ID NO: 5079347 - DNA, 14 bp, Homo sapiens
aaagcccacaggcc

SEQ ID NO: 5079348 - DNA, 15 bp, Homo sapiens
aaagcccacaggcct

SEQ ID NO: 5079349 - DNA, 16 bp, Homo sapiens
aaagcccacaggcctg

SEQ ID NO: 5079350 - DNA, 13 bp, Homo sapiens
aaagcccacctga

SEQ ID NO: 5079351 - DNA, 13 bp, Homo sapiens
aaagcccagactt

SEQ ID NO: 5079352 - DNA, 17 bp, Homo sapiens
aaagcccagactttagt

SEQ ID NO: 5079353 - DNA, 16 bp, Homo sapiens
aaagcccagcccggct

SEQ ID NO: 5079354 - DNA, 18 bp, Homo sapiens
aaagcccagcccggctga

SEQ ID NO: 5079355 - DNA, 15 bp, Homo sapiens
aaagcccaggagccc

SEQ ID NO: 5079356 - DNA, 14 bp, Homo sapiens
aaagcccatgccct

SEQ ID NO: 5079357 - DNA, 18 bp, Homo sapiens
aaagccccagcttggctc

SEQ ID NO: 5079358 - DNA, 19 bp, Homo sapiens
aaagccccatgctggagcc

SEQ ID NO: 5079359 - DNA, 21 bp, Homo sapiens
aaagccccatgctggagcctg

SEQ ID NO: 5079360 - DNA, 16 bp, Homo sapiens
aaagccccattaactg

SEQ ID NO: 5079361 - DNA, 19 bp, Homo sapiens
aaagcccccttctccatgg

SEQ ID NO: 5079362 - DNA, 18 bp, Homo sapiens
aaagcccctcacctcagg

SEQ ID NO: 5079363 - DNA, 16 bp, Homo sapiens
aaagccctatgtgaaa

SEQ ID NO: 5079364 - DNA, 13 bp, Homo sapiens
aaagccctcagat

SEQ ID NO: 5079365 - DNA, 21 bp, Homo sapiens
aaagccctcagatcccagggt

SEQ ID NO: 5079366 - DNA, 17 bp, Homo sapiens
aaagccctccctgtctg

SEQ ID NO: 5079367 - DNA, 12 bp, Homo sapiens
aaagccctgcct

SEQ ID NO: 5079368 - DNA, 17 bp, Homo sapiens
aaagccctgcctctgtg

SEQ ID NO: 5079369 - DNA, 18 bp, Homo sapiens
aaagccctgcctctgtgt

SEQ ID NO: 5079370 - DNA, 21 bp, Homo sapiens
aaagccctggtaaaagggata

SEQ ID NO: 5079371 - DNA, 12 bp, Homo sapiens
aaagccctgtcc

SEQ ID NO: 5079372 - DNA, 13 bp, Homo sapiens
aaagccctgtcct

SEQ ID NO: 5079373 - DNA, 21 bp, Homo sapiens
aaagcccttggaacaccctgg

SEQ ID NO: 5079374 - DNA, 22 bp, Homo sapiens
aaagcccttggaacaccctgga

SEQ ID NO: 5079375 - DNA, 15 bp, Homo sapiens
aaagccgggggaggg

SEQ ID NO: 5079376 - DNA, 20 bp, Homo sapiens
aaagcctaagaaaaaggaaa

SEQ ID NO: 5079377 - DNA, 16 bp, Homo sapiens
aaagcctaatcacagt

SEQ ID NO: 5079378 - DNA, 20 bp, Homo sapiens
aaagcctcaaggttttaggt

SEQ ID NO: 5079379 - DNA, 13 bp, Homo sapiens
aaagcctcagtga

SEQ ID NO: 5079380 - DNA, 15 bp, Homo sapiens
aaagcctccaagggt

SEQ ID NO: 5079381 - DNA, 19 bp, Homo sapiens
aaagcctccgcctgctgtg

SEQ ID NO: 5079382 - DNA, 10 bp, Homo sapiens
aaagcctcct

SEQ ID NO: 5079383 - DNA, 13 bp, Homo sapiens
aaagcctctctct

SEQ ID NO: 5079384 - DNA, 17 bp, Homo sapiens
aaagcctctctctccct

SEQ ID NO: 5079385 - DNA, 13 bp, Homo sapiens
aaagcctctggcc

SEQ ID NO: 5079386 - DNA, 21 bp, Homo sapiens
aaagcctctgtgtcactggct

SEQ ID NO: 5079387 - DNA, 17 bp, Homo sapiens
aaagcctctgttttgat

SEQ ID NO: 5079388 - DNA, 17 bp, Homo sapiens
aaagcctgaaaattcca

SEQ ID NO: 5079389 - DNA, 18 bp, Homo sapiens
aaagcctgaaaattccaa

SEQ ID NO: 5079390 - DNA, 18 bp, Homo sapiens
aaagcctgcaatttcata

SEQ ID NO: 5079391 - DNA, 13 bp, Homo sapiens
aaagcctgctcaa

SEQ ID NO: 5079392 - DNA, 20 bp, Homo sapiens
aaagcctgggtttggtgtat

SEQ ID NO: 5079393 - DNA, 14 bp, Homo sapiens
aaagcctggttttt

SEQ ID NO: 5079394 - DNA, 16 bp, Homo sapiens
aaagcctgttgtttaa

SEQ ID NO: 5079395 - DNA, 21 bp, Homo sapiens
aaagcctgttgtttaagtgac

SEQ ID NO: 5079396 - DNA, 16 bp, Homo sapiens
aaagcctgtttaagag

SEQ ID NO: 5079397 - DNA, 18 bp, Homo sapiens
aaagcctgtttaagagac

SEQ ID NO: 5079398 - DNA, 20 bp, Homo sapiens
aaagccttaaaaatatcctt

SEQ ID NO: 5079399 - DNA, 16 bp, Homo sapiens
aaagccttaagcaaat

SEQ ID NO: 5079400 - DNA, 17 bp, Homo sapiens
aaagccttaagcaaatt

SEQ ID NO: 5079401 - DNA, 10 bp, Homo sapiens
aaagccttac

SEQ ID NO: 5079402 - DNA, 15 bp, Homo sapiens
aaagccttagggaag

SEQ ID NO: 5079403 - DNA, 21 bp, Homo sapiens
aaagccttccagttttgtgga

SEQ ID NO: 5079404 - DNA, 12 bp, Homo sapiens
aaagccttgtgt

SEQ ID NO: 5079405 - DNA, 19 bp, Homo sapiens
aaagccttgtgtatatttg

SEQ ID NO: 5079406 - DNA, 13 bp, Homo sapiens
aaagcctttaaaa

SEQ ID NO: 5079407 - DNA, 17 bp, Homo sapiens
aaagcctttagtatcag

SEQ ID NO: 5079408 - DNA, 16 bp, Homo sapiens
aaagcctttatttgtt

SEQ ID NO: 5079409 - DNA, 17 bp, Homo sapiens
aaagcctttgaaaatac

SEQ ID NO: 5079410 - DNA, 16 bp, Homo sapiens
aaagcctttgtatctt

SEQ ID NO: 5079411 - DNA, 16 bp, Homo sapiens
aaagccttttaaatca

SEQ ID NO: 5079412 - DNA, 23 bp, Homo sapiens
aaagcgaaccgtgaggaggggtg

SEQ ID NO: 5079413 - DNA, 14 bp, Homo sapiens
aaagcgaattttaa

SEQ ID NO: 5079414 - DNA, 13 bp, Homo sapiens
aaagcgacagatt

SEQ ID NO: 5079415 - DNA, 19 bp, Homo sapiens
aaagcgagatcccatctct

SEQ ID NO: 5079416 - DNA, 17 bp, Homo sapiens
aaagcgatatacagatg

SEQ ID NO: 5079417 - DNA, 16 bp, Homo sapiens
aaagcgcgttgtgtat

SEQ ID NO: 5079418 - DNA, 15 bp, Homo sapiens
aaagcgctgtttcct

SEQ ID NO: 5079419 - DNA, 16 bp, Homo sapiens
aaagcggctgcctcca

SEQ ID NO: 5079420 - DNA, 16 bp, Homo sapiens
aaagcgggcagccccg

SEQ ID NO: 5079421 - DNA, 14 bp, Homo sapiens
aaagcggtccctgt

SEQ ID NO: 5079422 - DNA, 15 bp, Homo sapiens
aaagcggttgcttct

SEQ ID NO: 5079423 - DNA, 21 bp, Homo sapiens
aaagcggttgcttctggctcc

SEQ ID NO: 5079424 - DNA, 17 bp, Homo sapiens
aaagcgtccaattgact

SEQ ID NO: 5079425 - DNA, 16 bp, Homo sapiens
aaagcgtctttaagag

SEQ ID NO: 5079426 - DNA, 22 bp, Homo sapiens
aaagcgtgtgagtgagggagac

SEQ ID NO: 5079427 - DNA, 17 bp, Homo sapiens
aaagcgtttctttactt

SEQ ID NO: 5079428 - DNA, 19 bp, Homo sapiens
aaagcgtttctttacttct

SEQ ID NO: 5079429 - DNA, 12 bp, Homo sapiens
aaagctaaactg

SEQ ID NO: 5079430 - DNA, 15 bp, Homo sapiens
aaagctaaactgaat

SEQ ID NO: 5079431 - DNA, 14 bp, Homo sapiens
aaagctaacatctt

SEQ ID NO: 5079432 - DNA, 16 bp, Homo sapiens
aaagctaacatcttta

SEQ ID NO: 5079433 - DNA, 16 bp, Homo sapiens
aaagctaacccaggtc

SEQ ID NO: 5079434 - DNA, 21 bp, Homo sapiens
aaagctaaggctcgagttaaa

SEQ ID NO: 5079435 - DNA, 20 bp, Homo sapiens
aaagctaagtcttgtctcat

SEQ ID NO: 5079436 - DNA, 13 bp, Homo sapiens
aaagctaatacaa

SEQ ID NO: 5079437 - DNA, 22 bp, Homo sapiens
aaagctacaatattctctctta

SEQ ID NO: 5079438 - DNA, 13 bp, Homo sapiens
aaagctacagaac

SEQ ID NO: 5079439 - DNA, 21 bp, Homo sapiens
aaagctaccatgttaatacat

SEQ ID NO: 5079440 - DNA, 16 bp, Homo sapiens
aaagctacgcagacaa

SEQ ID NO: 5079441 - DNA, 22 bp, Homo sapiens
aaagctactgtagaaacaaagg

SEQ ID NO: 5079442 - DNA, 16 bp, Homo sapiens
aaagctacttattgta

SEQ ID NO: 5079443 - DNA, 18 bp, Homo sapiens
aaagctagaggagattgc

SEQ ID NO: 5079444 - DNA, 20 bp, Homo sapiens
aaagctaggaaaggcagaaa

SEQ ID NO: 5079445 - DNA, 14 bp, Homo sapiens
aaagctaggcctgg

SEQ ID NO: 5079446 - DNA, 16 bp, Homo sapiens
aaagctaggcctggcc

SEQ ID NO: 5079447 - DNA, 20 bp, Homo sapiens
aaagctataaagcagtattt

SEQ ID NO: 5079448 - DNA, 14 bp, Homo sapiens
aaagctatatatga

SEQ ID NO: 5079449 - DNA, 15 bp, Homo sapiens
aaagctatatatgaa

SEQ ID NO: 5079450 - DNA, 14 bp, Homo sapiens
aaagctatcttaaa

SEQ ID NO: 5079451 - DNA, 18 bp, Homo sapiens
aaagctatcttaaaatat

SEQ ID NO: 5079452 - DNA, 18 bp, Homo sapiens
aaagctatgaatgttact

SEQ ID NO: 5079453 - DNA, 15 bp, Homo sapiens
aaagctattaaagtt

SEQ ID NO: 5079454 - DNA, 23 bp, Homo sapiens
aaagctattacttggcaaattct

SEQ ID NO: 5079455 - DNA, 17 bp, Homo sapiens
aaagctattagccagga

SEQ ID NO: 5079456 - DNA, 20 bp, Homo sapiens
aaagctattagccaggatca

SEQ ID NO: 5079457 - DNA, 22 bp, Homo sapiens
aaagctattagccaggatcatg

SEQ ID NO: 5079458 - DNA, 19 bp, Homo sapiens
aaagctcaaatgaaatgta

SEQ ID NO: 5079459 - DNA, 20 bp, Homo sapiens
aaagctcaagatgacagctc

SEQ ID NO: 5079460 - DNA, 13 bp, Homo sapiens
aaagctcatattt

SEQ ID NO: 5079461 - DNA, 20 bp, Homo sapiens
aaagctcatttcatgctctg

SEQ ID NO: 5079462 - DNA, 13 bp, Homo sapiens
aaagctcccgcgg

SEQ ID NO: 5079463 - DNA, 22 bp, Homo sapiens
aaagctctctttggaatgaaca

SEQ ID NO: 5079464 - DNA, 17 bp, Homo sapiens
aaagctctgtagagcat

SEQ ID NO: 5079465 - DNA, 12 bp, Homo sapiens
aaagctcttcct

SEQ ID NO: 5079466 - DNA, 16 bp, Homo sapiens
aaagctgaaaatgtgt

SEQ ID NO: 5079467 - DNA, 19 bp, Homo sapiens
aaagctgaaattctcagaa

SEQ ID NO: 5079468 - DNA, 12 bp, Homo sapiens
aaagctgaagac

SEQ ID NO: 5079469 - DNA, 16 bp, Homo sapiens
aaagctgaatgtcaaa

SEQ ID NO: 5079470 - DNA, 18 bp, Homo sapiens
aaagctgacattgccaaa

SEQ ID NO: 5079471 - DNA, 19 bp, Homo sapiens
aaagctgacattgccaaaa

SEQ ID NO: 5079472 - DNA, 17 bp, Homo sapiens
aaagctgacgaggctgg

SEQ ID NO: 5079473 - DNA, 15 bp, Homo sapiens
aaagctgactgtttt

SEQ ID NO: 5079474 - DNA, 18 bp, Homo sapiens
aaagctgagaactcctga

SEQ ID NO: 5079475 - DNA, 20 bp, Homo sapiens
aaagctgagaactcctgact

SEQ ID NO: 5079476 - DNA, 17 bp, Homo sapiens
aaagctgagagaccctg

SEQ ID NO: 5079477 - DNA, 21 bp, Homo sapiens
aaagctgagagaccctggcct

SEQ ID NO: 5079478 - DNA, 15 bp, Homo sapiens
aaagctgagcctgca

SEQ ID NO: 5079479 - DNA, 12 bp, Homo sapiens
aaagctgccagc

SEQ ID NO: 5079480 - DNA, 22 bp, Homo sapiens
aaagctgccagccgagatagcc

SEQ ID NO: 5079481 - DNA, 17 bp, Homo sapiens
aaagctgccatttccct

SEQ ID NO: 5079482 - DNA, 17 bp, Homo sapiens
aaagctgctaaatctcc

SEQ ID NO: 5079483 - DNA, 15 bp, Homo sapiens
aaagctgctatccaa

SEQ ID NO: 5079484 - DNA, 16 bp, Homo sapiens
aaagctgctgggccag

SEQ ID NO: 5079485 - DNA, 14 bp, Homo sapiens
aaagctgctgtgat

SEQ ID NO: 5079486 - DNA, 14 bp, Homo sapiens
aaagctgcttgaat

SEQ ID NO: 5079487 - DNA, 19 bp, Homo sapiens
aaagctgctttccatggca

SEQ ID NO: 5079488 - DNA, 22 bp, Homo sapiens
aaagctgctttcttctctgcct

SEQ ID NO: 5079489 - DNA, 23 bp, Homo sapiens
aaagctggaacatttgatatttt

SEQ ID NO: 5079490 - DNA, 12 bp, Homo sapiens
aaagctggactg

SEQ ID NO: 5079491 - DNA, 13 bp, Homo sapiens
aaagctggactga

SEQ ID NO: 5079492 - DNA, 17 bp, Homo sapiens
aaagctggactgaccaa

SEQ ID NO: 5079493 - DNA, 23 bp, Homo sapiens
aaagctggctttcatccaactct

SEQ ID NO: 5079494 - DNA, 22 bp, Homo sapiens
aaagctgtgagcaaacagagga

SEQ ID NO: 5079495 - DNA, 17 bp, Homo sapiens
aaagctgtgcctttttt

SEQ ID NO: 5079496 - DNA, 21 bp, Homo sapiens
aaagctgtgttgttgcttctt

SEQ ID NO: 5079497 - DNA, 14 bp, Homo sapiens
aaagctgtgtttat

SEQ ID NO: 5079498 - DNA, 19 bp, Homo sapiens
aaagctgttaaaatacata

SEQ ID NO: 5079499 - DNA, 16 bp, Homo sapiens
aaagctgttaaactgt

SEQ ID NO: 5079500 - DNA, 19 bp, Homo sapiens
aaagctgttctcattcctg

SEQ ID NO: 5079501 - DNA, 17 bp, Homo sapiens
aaagctgttcttcctgg

SEQ ID NO: 5079502 - DNA, 20 bp, Homo sapiens
aaagctgtttttatagcaca

SEQ ID NO: 5079503 - DNA, 14 bp, Homo sapiens
aaagcttaaaaaaa

SEQ ID NO: 5079504 - DNA, 15 bp, Homo sapiens
aaagcttaaaaaaat

SEQ ID NO: 5079505 - DNA, 14 bp, Homo sapiens
aaagcttaaaactt

SEQ ID NO: 5079506 - DNA, 16 bp, Homo sapiens
aaagcttaatgattct

SEQ ID NO: 5079507 - DNA, 17 bp, Homo sapiens
aaagcttatttttatgt

SEQ ID NO: 5079508 - DNA, 22 bp, Homo sapiens
aaagcttatttttatgtggtct

SEQ ID NO: 5079509 - DNA, 16 bp, Homo sapiens
aaagcttcaaagttta

SEQ ID NO: 5079510 - DNA, 16 bp, Homo sapiens
aaagcttcacagtacc

SEQ ID NO: 5079511 - DNA, 14 bp, Homo sapiens
aaagcttcagggaa

SEQ ID NO: 5079512 - DNA, 20 bp, Homo sapiens
aaagcttcagtgctgccgat

SEQ ID NO: 5079513 - DNA, 18 bp, Homo sapiens
aaagcttccatgattcta

SEQ ID NO: 5079514 - DNA, 11 bp, Homo sapiens
aaagcttcccc

SEQ ID NO: 5079515 - DNA, 23 bp, Homo sapiens
aaagcttcctagcttatctccct

SEQ ID NO: 5079516 - DNA, 14 bp, Homo sapiens
aaagcttcgtgcca

SEQ ID NO: 5079517 - DNA, 12 bp, Homo sapiens
aaagcttctaaa

SEQ ID NO: 5079518 - DNA, 13 bp, Homo sapiens
aaagcttctgtgg

SEQ ID NO: 5079519 - DNA, 17 bp, Homo sapiens
aaagcttcttaattaat

SEQ ID NO: 5079520 - DNA, 14 bp, Homo sapiens
aaagcttcttcaga

SEQ ID NO: 5079521 - DNA, 23 bp, Homo sapiens
aaagcttgaaaagattctgaaac

SEQ ID NO: 5079522 - DNA, 19 bp, Homo sapiens
aaagcttgatttgatcttt

SEQ ID NO: 5079523 - DNA, 19 bp, Homo sapiens
aaagcttgcaacaaaattc

SEQ ID NO: 5079524 - DNA, 19 bp, Homo sapiens
aaagcttggattaaataca

SEQ ID NO: 5079525 - DNA, 18 bp, Homo sapiens
aaagcttggttctgtgaa

SEQ ID NO: 5079526 - DNA, 15 bp, Homo sapiens
aaagcttgtggccaa

SEQ ID NO: 5079527 - DNA, 20 bp, Homo sapiens
aaagcttgtggccaatggaa

SEQ ID NO: 5079528 - DNA, 20 bp, Homo sapiens
aaagctttactactgtggaa

SEQ ID NO: 5079529 - DNA, 20 bp, Homo sapiens
aaagctttactctttcatgc

SEQ ID NO: 5079530 - DNA, 21 bp, Homo sapiens
aaagctttagattgaaattta

SEQ ID NO: 5079531 - DNA, 13 bp, Homo sapiens
aaagctttatctt

SEQ ID NO: 5079532 - DNA, 17 bp, Homo sapiens
aaagctttatctttgtg

SEQ ID NO: 5079533 - DNA, 12 bp, Homo sapiens
aaagctttatga

SEQ ID NO: 5079534 - DNA, 20 bp, Homo sapiens
aaagctttatgattttcata

SEQ ID NO: 5079535 - DNA, 18 bp, Homo sapiens
aaagctttattaccagtg

SEQ ID NO: 5079536 - DNA, 13 bp, Homo sapiens
aaagctttcctgc

SEQ ID NO: 5079537 - DNA, 16 bp, Homo sapiens
aaagctttctgacaag

SEQ ID NO: 5079538 - DNA, 12 bp, Homo sapiens
aaagctttctgc

SEQ ID NO: 5079539 - DNA, 17 bp, Homo sapiens
aaagctttcttttctaa

SEQ ID NO: 5079540 - DNA, 14 bp, Homo sapiens
aaagctttgctaca

SEQ ID NO: 5079541 - DNA, 18 bp, Homo sapiens
aaagctttgctacaaatt

SEQ ID NO: 5079542 - DNA, 22 bp, Homo sapiens
aaagctttggaaaaatcttttt

SEQ ID NO: 5079543 - DNA, 18 bp, Homo sapiens
aaagctttggctgagacc

SEQ ID NO: 5079544 - DNA, 19 bp, Homo sapiens
aaagctttggctgagacct

SEQ ID NO: 5079545 - DNA, 14 bp, Homo sapiens
aaagcttttatgag

SEQ ID NO: 5079546 - DNA, 18 bp, Homo sapiens
aaagcttttgcatagaat

SEQ ID NO: 5079547 - DNA, 17 bp, Homo sapiens
aaagcttttgcatattg

SEQ ID NO: 5079548 - DNA, 17 bp, Homo sapiens
aaagctttttaaaattt

SEQ ID NO: 5079549 - DNA, 19 bp, Homo sapiens
aaagctttttattcctcct

SEQ ID NO: 5079550 - DNA, 16 bp, Homo sapiens
aaagctttttcctcct

SEQ ID NO: 5079551 - DNA, 17 bp, Homo sapiens
aaagctttttcctcctg

SEQ ID NO: 5079552 - DNA, 12 bp, Homo sapiens
aaaggaaaaaaa

SEQ ID NO: 5079553 - DNA, 20 bp, Homo sapiens
aaaggaaaaaaaaacagcca

SEQ ID NO: 5079554 - DNA, 17 bp, Homo sapiens
aaaggaaaaaaaacaca

SEQ ID NO: 5079555 - DNA, 16 bp, Homo sapiens
aaaggaaaaaaagact

SEQ ID NO: 5079556 - DNA, 20 bp, Homo sapiens
aaaggaaaaaatgcaaacgt

SEQ ID NO: 5079557 - DNA, 16 bp, Homo sapiens
aaaggaaaaacagaac

SEQ ID NO: 5079558 - DNA, 22 bp, Homo sapiens
aaaggaaaaacagaacatttct

SEQ ID NO: 5079559 - DNA, 16 bp, Homo sapiens
aaaggaaaaagcacaa

SEQ ID NO: 5079560 - DNA, 17 bp, Homo sapiens
aaaggaaaaagctccat

SEQ ID NO: 5079561 - DNA, 14 bp, Homo sapiens
aaaggaaaaataat

SEQ ID NO: 5079562 - DNA, 15 bp, Homo sapiens
aaaggaaaaataatc

SEQ ID NO: 5079563 - DNA, 15 bp, Homo sapiens
aaaggaaaaattttt

SEQ ID NO: 5079564 - DNA, 24 bp, Homo sapiens
aaaggaaaaatttttttgttgttt

SEQ ID NO: 5079565 - DNA, 18 bp, Homo sapiens
aaaggaaaactcaccatt

SEQ ID NO: 5079566 - DNA, 16 bp, Homo sapiens
aaaggaaaagaaaaaa

SEQ ID NO: 5079567 - DNA, 13 bp, Homo sapiens
aaaggaaaagaag

SEQ ID NO: 5079568 - DNA, 12 bp, Homo sapiens
aaaggaaaagac

SEQ ID NO: 5079569 - DNA, 16 bp, Homo sapiens
aaaggaaaagttaaac

SEQ ID NO: 5079570 - DNA, 18 bp, Homo sapiens
aaaggaaaatagtaatgt

SEQ ID NO: 5079571 - DNA, 16 bp, Homo sapiens
aaaggaaaatgtctgt

SEQ ID NO: 5079572 - DNA, 14 bp, Homo sapiens
aaaggaaagaagga

SEQ ID NO: 5079573 - DNA, 15 bp, Homo sapiens
aaaggaaagaaggag

SEQ ID NO: 5079574 - DNA, 11 bp, Homo sapiens
aaaggaaagag

SEQ ID NO: 5079575 - DNA, 21 bp, Homo sapiens
aaaggaaagccagaaggaaaa

SEQ ID NO: 5079576 - DNA, 17 bp, Homo sapiens
aaaggaaagttctatta

SEQ ID NO: 5079577 - DNA, 22 bp, Homo sapiens
aaaggaaagtttgccaggagga

SEQ ID NO: 5079578 - DNA, 9 bp, Homo sapiens
aaaggaaat

SEQ ID NO: 5079579 - DNA, 13 bp, Homo sapiens
aaaggaaatattt

SEQ ID NO: 5079580 - DNA, 15 bp, Homo sapiens
aaaggaaatcaaatg

SEQ ID NO: 5079581 - DNA, 17 bp, Homo sapiens
aaagataggtatggaaa

SEQ ID NO: 5079582 - DNA, 18 bp, Homo sapiens
aaagatagtatcttttaa

SEQ ID NO: 5079583 - DNA, 18 bp, Homo sapiens
aaagatataaggggaaag

SEQ ID NO: 5079584 - DNA, 21 bp, Homo sapiens
aaagatataaggggaaagata

SEQ ID NO: 5079585 - DNA, 15 bp, Homo sapiens
aaagatataagtgct

SEQ ID NO: 5079586 - DNA, 19 bp, Homo sapiens
aaagatatattaaaaatat

SEQ ID NO: 5079587 - DNA, 23 bp, Homo sapiens
aaagatatattaaaaatataaaa

SEQ ID NO: 5079588 - DNA, 20 bp, Homo sapiens
aaagatatctcatctcttct

SEQ ID NO: 5079589 - DNA, 14 bp, Homo sapiens
aaagatatggagaa

SEQ ID NO: 5079590 - DNA, 19 bp, Homo sapiens
aaagatatggagaattgct

SEQ ID NO: 5079591 - DNA, 23 bp, Homo sapiens
aaagatatggagaattgctgaag

SEQ ID NO: 5079592 - DNA, 12 bp, Homo sapiens
aaagatattatt

SEQ ID NO: 5079593 - DNA, 22 bp, Homo sapiens
aaagatattattcaccatgtaa

SEQ ID NO: 5079594 - DNA, 12 bp, Homo sapiens
aaagatattgta

SEQ ID NO: 5079595 - DNA, 23 bp, Homo sapiens
aaagatattgtattatcatatat

SEQ ID NO: 5079596 - DNA, 20 bp, Homo sapiens
aaagatattttgctttgtga

SEQ ID NO: 5079597 - DNA, 19 bp, Homo sapiens
aaagatatttttattcaaa

SEQ ID NO: 5079598 - DNA, 21 bp, Homo sapiens
aaagatatttttattcaaact

SEQ ID NO: 5079599 - DNA, 16 bp, Homo sapiens
aaagatcaaatgaaaa

SEQ ID NO: 5079600 - DNA, 19 bp, Homo sapiens
aaagatccatttaaaacaa

SEQ ID NO: 5079601 - DNA, 13 bp, Homo sapiens
aaagatcccaaat

SEQ ID NO: 5079602 - DNA, 15 bp, Homo sapiens
aaagatctacatgaa

SEQ ID NO: 5079603 - DNA, 14 bp, Homo sapiens
aaagatctcctgtg

SEQ ID NO: 5079604 - DNA, 12 bp, Homo sapiens
aaagatctctgt

SEQ ID NO: 5079605 - DNA, 18 bp, Homo sapiens
aaagatctctgtcacatc

SEQ ID NO: 5079606 - DNA, 20 bp, Homo sapiens
aaagatctgtcctcagcctt

SEQ ID NO: 5079607 - DNA, 21 bp, Homo sapiens
aaagatctgtcctcagccttg

SEQ ID NO: 5079608 - DNA, 14 bp, Homo sapiens
aaagatctttcatt

SEQ ID NO: 5079609 - DNA, 16 bp, Homo sapiens
aaagatgaaaatattt

SEQ ID NO: 5079610 - DNA, 15 bp, Homo sapiens
aaagatgaaaggcag

SEQ ID NO: 5079611 - DNA, 16 bp, Homo sapiens
aaagatgaagaagaaa

SEQ ID NO: 5079612 - DNA, 23 bp, Homo sapiens
aaagatgacttaaggtgaagtga

SEQ ID NO: 5079613 - DNA, 20 bp, Homo sapiens
aaagatgagctctgaacaaa

SEQ ID NO: 5079614 - DNA, 15 bp, Homo sapiens
aaagatgagtaggag

SEQ ID NO: 5079615 - DNA, 13 bp, Homo sapiens
aaagatgatatta

SEQ ID NO: 5079616 - DNA, 21 bp, Homo sapiens
aaagatgatcgctgtattttg

SEQ ID NO: 5079617 - DNA, 12 bp, Homo sapiens
aaagatgatgat

SEQ ID NO: 5079618 - DNA, 21 bp, Homo sapiens
aaagatgatgctcagttttaa

SEQ ID NO: 5079619 - DNA, 14 bp, Homo sapiens
aaagatgatggaaa

SEQ ID NO: 5079620 - DNA, 20 bp, Homo sapiens
aaagatgcaaggaccaggac

SEQ ID NO: 5079621 - DNA, 14 bp, Homo sapiens
aaagatgcaatgta

SEQ ID NO: 5079622 - DNA, 17 bp, Homo sapiens
aaagatgcactttgctt

SEQ ID NO: 5079623 - DNA, 21 bp, Homo sapiens
aaagatgcactttgctttaat

SEQ ID NO: 5079624 - DNA, 16 bp, Homo sapiens
aaagatgcagccgcct

SEQ ID NO: 5079625 - DNA, 20 bp, Homo sapiens
aaagatgcatgttactgcca

SEQ ID NO: 5079626 - DNA, 21 bp, Homo sapiens
aaagatgcattttgagtgttt

SEQ ID NO: 5079627 - DNA, 14 bp, Homo sapiens
aaagatgcattttt

SEQ ID NO: 5079628 - DNA, 14 bp, Homo sapiens
aaagatgccacatt

SEQ ID NO: 5079629 - DNA, 19 bp, Homo sapiens
aaagatgccatagcataat

SEQ ID NO: 5079630 - DNA, 21 bp, Homo sapiens
aaagatgcgtttgcctcctgg

SEQ ID NO: 5079631 - DNA, 18 bp, Homo sapiens
aaagatgctgtcggcacc

SEQ ID NO: 5079632 - DNA, 17 bp, Homo sapiens
aaagatgcttctcactg

SEQ ID NO: 5079633 - DNA, 19 bp, Homo sapiens
aaagatgcttctcactgcc

SEQ ID NO: 5079634 - DNA, 13 bp, Homo sapiens
aaagatgctttta

SEQ ID NO: 5079635 - DNA, 17 bp, Homo sapiens
aaagatggagtttctaa

SEQ ID NO: 5079636 - DNA, 21 bp, Homo sapiens
aaagatggataaactgagcct

SEQ ID NO: 5079637 - DNA, 20 bp, Homo sapiens
aaagatggatttgacacact

SEQ ID NO: 5079638 - DNA, 12 bp, Homo sapiens
aaagatggcctt

SEQ ID NO: 5079639 - DNA, 20 bp, Homo sapiens
aaagatggcgcacccggcag

SEQ ID NO: 5079640 - DNA, 21 bp, Homo sapiens
aaagatggctgtgcctctgcc

SEQ ID NO: 5079641 - DNA, 22 bp, Homo sapiens
aaagatggctgtgcctctgcct

SEQ ID NO: 5079642 - DNA, 17 bp, Homo sapiens
aaagatggcttatgtca

SEQ ID NO: 5079643 - DNA, 18 bp, Homo sapiens
aaagatgggaaactgctt

SEQ ID NO: 5079644 - DNA, 15 bp, Homo sapiens
aaagatgggaggaga

SEQ ID NO: 5079645 - DNA, 12 bp, Homo sapiens
aaagatggggag

SEQ ID NO: 5079646 - DNA, 18 bp, Homo sapiens
aaagatggggtctgtaaa

SEQ ID NO: 5079647 - DNA, 22 bp, Homo sapiens
aaagatggggtctgtaaaatct

SEQ ID NO: 5079648 - DNA, 18 bp, Homo sapiens
aaagatggtaaaaagaag

SEQ ID NO: 5079649 - DNA, 21 bp, Homo sapiens
aaagatggtaatcttttctga

SEQ ID NO: 5079650 - DNA, 17 bp, Homo sapiens
aaagatggtggctgtgt

SEQ ID NO: 5079651 - DNA, 23 bp, Homo sapiens
aaagatggtgtgggtgtcctgcc

SEQ ID NO: 5079652 - DNA, 17 bp, Homo sapiens
aaagatggttaaacatt

SEQ ID NO: 5079653 - DNA, 16 bp, Homo sapiens
aaagatggttgtagca

SEQ ID NO: 5079654 - DNA, 22 bp, Homo sapiens
aaagatggttgtagcatttaaa

SEQ ID NO: 5079655 - DNA, 20 bp, Homo sapiens
aaagatggtttatgcatgta

SEQ ID NO: 5079656 - DNA, 17 bp, Homo sapiens
aaagatgtatatttgca

SEQ ID NO: 5079657 - DNA, 23 bp, Homo sapiens
aaagatgtatggatttccagttt

SEQ ID NO: 5079658 - DNA, 17 bp, Homo sapiens
aaagatgtcccacaggg

SEQ ID NO: 5079659 - DNA, 23 bp, Homo sapiens
aaagatgtcccacagggaccaca

SEQ ID NO: 5079660 - DNA, 13 bp, Homo sapiens
aaagatgtgaaaa

SEQ ID NO: 5079661 - DNA, 22 bp, Homo sapiens
aaagatgtgctcccaccaggca

SEQ ID NO: 5079662 - DNA, 13 bp, Homo sapiens
aaagatgtgttgt

SEQ ID NO: 5079663 - DNA, 15 bp, Homo sapiens
aaagatgtgttttgt

SEQ ID NO: 5079664 - DNA, 17 bp, Homo sapiens
aaagatgttaaatggaa

SEQ ID NO: 5079665 - DNA, 19 bp, Homo sapiens
aaagatgttaaatggaatt

SEQ ID NO: 5079666 - DNA, 23 bp, Homo sapiens
aaagatgttaaatggaattcgtg

SEQ ID NO: 5079667 - DNA, 12 bp, Homo sapiens
aaagatgtttga

SEQ ID NO: 5079668 - DNA, 19 bp, Homo sapiens
aaagatgtttgaaaatgct

SEQ ID NO: 5079669 - DNA, 13 bp, Homo sapiens
aaagattaaacag

SEQ ID NO: 5079670 - DNA, 22 bp, Homo sapiens
aaagattactagggttttgcca

SEQ ID NO: 5079671 - DNA, 13 bp, Homo sapiens
aaagattagcaag

SEQ ID NO: 5079672 - DNA, 18 bp, Homo sapiens
aaagattagcaaggtcat

SEQ ID NO: 5079673 - DNA, 22 bp, Homo sapiens
aaagattagcaaggtcatttct

SEQ ID NO: 5079674 - DNA, 12 bp, Homo sapiens
aaagattatata

SEQ ID NO: 5079675 - DNA, 17 bp, Homo sapiens
aaagattatatatcata

SEQ ID NO: 5079676 - DNA, 22 bp, Homo sapiens
aaagattatatatcataaagta

SEQ ID NO: 5079677 - DNA, 20 bp, Homo sapiens
aaagattattacctttttaa

SEQ ID NO: 5079678 - DNA, 13 bp, Homo sapiens
aaagattatttaa

SEQ ID NO: 5079679 - DNA, 19 bp, Homo sapiens
aaagattcaggtatgttgc

SEQ ID NO: 5079680 - DNA, 15 bp, Homo sapiens
aaagattcatgattt

SEQ ID NO: 5079681 - DNA, 13 bp, Homo sapiens
aaagattcatttt

SEQ ID NO: 5079682 - DNA, 18 bp, Homo sapiens
aaagattccacagagatg

SEQ ID NO: 5079683 - DNA, 12 bp, Homo sapiens
aaagattctata

SEQ ID NO: 5079684 - DNA, 18 bp, Homo sapiens
aaagattctatagttcta

SEQ ID NO: 5079685 - DNA, 23 bp, Homo sapiens
aaagattctctttaaaaaagact

SEQ ID NO: 5079686 - DNA, 16 bp, Homo sapiens
aaagattctgaaacca

SEQ ID NO: 5079687 - DNA, 21 bp, Homo sapiens
aaagattctttatatctgaac

SEQ ID NO: 5079688 - DNA, 12 bp, Homo sapiens
aaagattctttt

SEQ ID NO: 5079689 - DNA, 23 bp, Homo sapiens
aaagattgaagtattttgctgga

SEQ ID NO: 5079690 - DNA, 18 bp, Homo sapiens
aaagattgacaccaggtt

SEQ ID NO: 5079691 - DNA, 14 bp, Homo sapiens
aaagattgcaaagg

SEQ ID NO: 5079692 - DNA, 14 bp, Homo sapiens
aaagattgtactta

SEQ ID NO: 5079693 - DNA, 22 bp, Homo sapiens
aaagattgtattgatacagaga

SEQ ID NO: 5079694 - DNA, 15 bp, Homo sapiens
aaagattgtattgct

SEQ ID NO: 5079695 - DNA, 13 bp, Homo sapiens
aaagattgtgtct

SEQ ID NO: 5079696 - DNA, 14 bp, Homo sapiens
aaagattgtgtctg

SEQ ID NO: 5079697 - DNA, 18 bp, Homo sapiens
aaagattgttaaattcaa

SEQ ID NO: 5079698 - DNA, 12 bp, Homo sapiens
aaagatttaatg

SEQ ID NO: 5079699 - DNA, 15 bp, Homo sapiens
aaagatttaatgtta

SEQ ID NO: 5079700 - DNA, 16 bp, Homo sapiens
aaagatttcaaataaa

SEQ ID NO: 5079701 - DNA, 17 bp, Homo sapiens
aaagatttcaaataaag

SEQ ID NO: 5079702 - DNA, 12 bp, Homo sapiens
aaagatttcagt

SEQ ID NO: 5079703 - DNA, 13 bp, Homo sapiens
aaagatttcagta

SEQ ID NO: 5079704 - DNA, 18 bp, Homo sapiens
aaagatttcagtagaatt

SEQ ID NO: 5079705 - DNA, 15 bp, Homo sapiens
aaagatttcatatct

SEQ ID NO: 5079706 - DNA, 16 bp, Homo sapiens
aaagatttcatatcta

SEQ ID NO: 5079707 - DNA, 19 bp, Homo sapiens
aaagatttctagtaggcag

SEQ ID NO: 5079708 - DNA, 19 bp, Homo sapiens
aaagatttggaaaattcac

SEQ ID NO: 5079709 - DNA, 22 bp, Homo sapiens
aaagatttgtactacagttctt

SEQ ID NO: 5079710 - DNA, 18 bp, Homo sapiens
aaagatttgtgaactgga

SEQ ID NO: 5079711 - DNA, 23 bp, Homo sapiens
aaagatttgtggtaactgaaggt

SEQ ID NO: 5079712 - DNA, 15 bp, Homo sapiens
aaagattttaatcaa

SEQ ID NO: 5079713 - DNA, 11 bp, Homo sapiens
aaagattttat

SEQ ID NO: 5079714 - DNA, 12 bp, Homo sapiens
aaagattttatg

SEQ ID NO: 5079715 - DNA, 21 bp, Homo sapiens
aaagattttatggttttataa

SEQ ID NO: 5079716 - DNA, 22 bp, Homo sapiens
aaagattttatggttttataac

SEQ ID NO: 5079717 - DNA, 19 bp, Homo sapiens
aaagattttatgtgcttga

SEQ ID NO: 5079718 - DNA, 18 bp, Homo sapiens
aaagattttattgtataa

SEQ ID NO: 5079719 - DNA, 19 bp, Homo sapiens
aaagattttatttatggaa

SEQ ID NO: 5079720 - DNA, 15 bp, Homo sapiens
aaagattttcagaaa

SEQ ID NO: 5079721 - DNA, 16 bp, Homo sapiens
aaagattttgatctca

SEQ ID NO: 5079722 - DNA, 12 bp, Homo sapiens
aaagattttgtg

SEQ ID NO: 5079723 - DNA, 13 bp, Homo sapiens
aaagattttgtga

SEQ ID NO: 5079724 - DNA, 14 bp, Homo sapiens
aaagattttgtttt

SEQ ID NO: 5079725 - DNA, 14 bp, Homo sapiens
aaagatttttacta

SEQ ID NO: 5079726 - DNA, 23 bp, Homo sapiens
aaagatttttactaatatatatt

SEQ ID NO: 5079727 - DNA, 17 bp, Homo sapiens
aaagcaaaaactcttgt

SEQ ID NO: 5079728 - DNA, 12 bp, Homo sapiens
aaagcaaaaatg

SEQ ID NO: 5079729 - DNA, 16 bp, Homo sapiens
aaagcaaaaatgacaa

SEQ ID NO: 5079730 - DNA, 17 bp, Homo sapiens
aaagcaaaaatgctaat

SEQ ID NO: 5079731 - DNA, 14 bp, Homo sapiens
aaagcaaaacaaaa

SEQ ID NO: 5079732 - DNA, 14 bp, Homo sapiens
aaagcaaaacattt

SEQ ID NO: 5079733 - DNA, 15 bp, Homo sapiens
aaagcaaaagaagta

SEQ ID NO: 5079734 - DNA, 15 bp, Homo sapiens
aaagcaaaagagaaa

SEQ ID NO: 5079735 - DNA, 17 bp, Homo sapiens
aaagcaaaaggctgaga

SEQ ID NO: 5079736 - DNA, 14 bp, Homo sapiens
aaagcaaaagtgct

SEQ ID NO: 5079737 - DNA, 13 bp, Homo sapiens
aaagcaaaataca

SEQ ID NO: 5079738 - DNA, 12 bp, Homo sapiens
aaagcaaaatag

SEQ ID NO: 5079739 - DNA, 12 bp, Homo sapiens
aaagcaaaatat

SEQ ID NO: 5079740 - DNA, 13 bp, Homo sapiens
aaagcaaaatatt

SEQ ID NO: 5079741 - DNA, 15 bp, Homo sapiens
aaagcaaacctgtaa

SEQ ID NO: 5079742 - DNA, 20 bp, Homo sapiens
aaagcaaaccttaatttgaa

SEQ ID NO: 5079743 - DNA, 21 bp, Homo sapiens
aaagcaaaccttaatttgaaa

SEQ ID NO: 5079744 - DNA, 13 bp, Homo sapiens
aaagcaaagaaaa

SEQ ID NO: 5079745 - DNA, 15 bp, Homo sapiens
aaagcaaagaaaata

SEQ ID NO: 5079746 - DNA, 17 bp, Homo sapiens
aaagcaaagcacagaga

SEQ ID NO: 5079747 - DNA, 13 bp, Homo sapiens
aaagcaaaggcag

SEQ ID NO: 5079748 - DNA, 13 bp, Homo sapiens
aaagcaaatactg

SEQ ID NO: 5079749 - DNA, 14 bp, Homo sapiens
aaagcaaatactga

SEQ ID NO: 5079750 - DNA, 15 bp, Homo sapiens
aaagcaaatcagaaa

SEQ ID NO: 5079751 - DNA, 13 bp, Homo sapiens
aaagcaaatgaga

SEQ ID NO: 5079752 - DNA, 23 bp, Homo sapiens
aaagcaaattactccaaggttta

SEQ ID NO: 5079753 - DNA, 16 bp, Homo sapiens
aaagcaacaaattaac

SEQ ID NO: 5079754 - DNA, 13 bp, Homo sapiens
aaagcaacagctg

SEQ ID NO: 5079755 - DNA, 13 bp, Homo sapiens
aaagcaacatcag

SEQ ID NO: 5079756 - DNA, 18 bp, Homo sapiens
aaagcaacccgctggagc

SEQ ID NO: 5079757 - DNA, 21 bp, Homo sapiens
aaagcaactgtctatttctgc

SEQ ID NO: 5079758 - DNA, 21 bp, Homo sapiens
aaagcaactgttatgaaataa

SEQ ID NO: 5079759 - DNA, 22 bp, Homo sapiens
aaagcaacttcatcccagctgc

SEQ ID NO: 5079760 - DNA, 14 bp, Homo sapiens
aaagcaagaatcag

SEQ ID NO: 5079761 - DNA, 17 bp, Homo sapiens
aaaggaaatcaaatgaa

SEQ ID NO: 5079762 - DNA, 15 bp, Homo sapiens
aaaggaaatgattga

SEQ ID NO: 5079763 - DNA, 19 bp, Homo sapiens
aaaggaaattcagattgtt

SEQ ID NO: 5079764 - DNA, 18 bp, Homo sapiens
aaaggaaatttgtttgta

SEQ ID NO: 5079765 - DNA, 18 bp, Homo sapiens
aaaggaacaaaaattaca

SEQ ID NO: 5079766 - DNA, 16 bp, Homo sapiens
aaaggaacatttaggg

SEQ ID NO: 5079767 - DNA, 13 bp, Homo sapiens
aaaggaagactgg

SEQ ID NO: 5079768 - DNA, 22 bp, Homo sapiens
aaaggaagacttggcccaggaa

SEQ ID NO: 5079769 - DNA, 14 bp, Homo sapiens
aaaggaagattctt

SEQ ID NO: 5079770 - DNA, 17 bp, Homo sapiens
aaaggaagcattgtaaa

SEQ ID NO: 5079771 - DNA, 22 bp, Homo sapiens
aaaggaagcattgtaaaataat

SEQ ID NO: 5079772 - DNA, 22 bp, Homo sapiens
aaaggaagctttctctgcttca

SEQ ID NO: 5079773 - DNA, 19 bp, Homo sapiens
aaaggaagggcaggaaatg

SEQ ID NO: 5079774 - DNA, 18 bp, Homo sapiens
aaaggaaggggttttccc

SEQ ID NO: 5079775 - DNA, 17 bp, Homo sapiens
aaaggaagggtggcttt

SEQ ID NO: 5079776 - DNA, 17 bp, Homo sapiens
aaaggaagtgccccctc

SEQ ID NO: 5079777 - DNA, 19 bp, Homo sapiens
aaaggaagtggggacagat

SEQ ID NO: 5079778 - DNA, 13 bp, Homo sapiens
aaaggaatgagaa

SEQ ID NO: 5079779 - DNA, 17 bp, Homo sapiens
aaaggaatgcaagagaa

SEQ ID NO: 5079780 - DNA, 19 bp, Homo sapiens
aaaggaatgcaagagaagg

SEQ ID NO: 5079781 - DNA, 14 bp, Homo sapiens
aaaggaatgtgaaa

SEQ ID NO: 5079782 - DNA, 16 bp, Homo sapiens
aaaggacaaacagtga

SEQ ID NO: 5079783 - DNA, 16 bp, Homo sapiens
aaaggacaaataaaac

SEQ ID NO: 5079784 - DNA, 22 bp, Homo sapiens
aaaggacaaatctaaaatgcaa

SEQ ID NO: 5079785 - DNA, 18 bp, Homo sapiens
aaaggacaacagttctga

SEQ ID NO: 5079786 - DNA, 22 bp, Homo sapiens
aaaggacaacagttctgagctg

SEQ ID NO: 5079787 - DNA, 16 bp, Homo sapiens
aaaggacaatttcaaa

SEQ ID NO: 5079788 - DNA, 13 bp, Homo sapiens
aaaggacactgga

SEQ ID NO: 5079789 - DNA, 14 bp, Homo sapiens
aaaggacactggat

SEQ ID NO: 5079790 - DNA, 14 bp, Homo sapiens
aaaggacagctcag

SEQ ID NO: 5079791 - DNA, 20 bp, Homo sapiens
aaaggacagctttgataatg

SEQ ID NO: 5079792 - DNA, 19 bp, Homo sapiens
aaaggacaggcagaaagag

SEQ ID NO: 5079793 - DNA, 14 bp, Homo sapiens
aaaggacatcagca

SEQ ID NO: 5079794 - DNA, 18 bp, Homo sapiens
aaaggacattatgtgtgc

SEQ ID NO: 5079795 - DNA, 19 bp, Homo sapiens
aaaggaccagctttgagct

SEQ ID NO: 5079796 - DNA, 22 bp, Homo sapiens
aaaggacccaagtactttccaa

SEQ ID NO: 5079797 - DNA, 15 bp, Homo sapiens
aaaggaccctgtttc

SEQ ID NO: 5079798 - DNA, 18 bp, Homo sapiens
aaaggaccctgtttctgt

SEQ ID NO: 5079799 - DNA, 19 bp, Homo sapiens
aaaggaccctgtttctgta

SEQ ID NO: 5079800 - DNA, 21 bp, Homo sapiens
aaaggacccttgagtaagtga

SEQ ID NO: 5079801 - DNA, 19 bp, Homo sapiens
aaaggacctcctaaataaa

SEQ ID NO: 5079802 - DNA, 15 bp, Homo sapiens
aaaggacgcactgag

SEQ ID NO: 5079803 - DNA, 21 bp, Homo sapiens
aaaggacgcctgcaggagaga

SEQ ID NO: 5079804 - DNA, 16 bp, Homo sapiens
aaaggacggctgagca

SEQ ID NO: 5079805 - DNA, 15 bp, Homo sapiens
aaaggacgtaaaatt

SEQ ID NO: 5079806 - DNA, 19 bp, Homo sapiens
aaaggactatttataacta

SEQ ID NO: 5079807 - DNA, 13 bp, Homo sapiens
aaaggactcagtg

SEQ ID NO: 5079808 - DNA, 12 bp, Homo sapiens
aaaggactctgg

SEQ ID NO: 5079809 - DNA, 21 bp, Homo sapiens
aaaggactctggaagattttc

SEQ ID NO: 5079810 - DNA, 13 bp, Homo sapiens
aaaggactgtaat

SEQ ID NO: 5079811 - DNA, 20 bp, Homo sapiens
aaaggactgttttttcctga

SEQ ID NO: 5079812 - DNA, 22 bp, Homo sapiens
aaaggactgttttttcctgagc

SEQ ID NO: 5079813 - DNA, 18 bp, Homo sapiens
aaaggagaaaaaaaacct

SEQ ID NO: 5079814 - DNA, 15 bp, Homo sapiens
aaaggagaaaggagc

SEQ ID NO: 5079815 - DNA, 13 bp, Homo sapiens
aaaggagaaatct

SEQ ID NO: 5079816 - DNA, 17 bp, Homo sapiens
aaaggagaactgtgctc

SEQ ID NO: 5079817 - DNA, 20 bp, Homo sapiens
aaaggagaattgaattctgg

SEQ ID NO: 5079818 - DNA, 19 bp, Homo sapiens
aaaggagacaagttccatg

SEQ ID NO: 5079819 - DNA, 12 bp, Homo sapiens
aaaggagacata

SEQ ID NO: 5079820 - DNA, 12 bp, Homo sapiens
aaaggagagaag

SEQ ID NO: 5079821 - DNA, 16 bp, Homo sapiens
aaaggagagaagaaag

SEQ ID NO: 5079822 - DNA, 23 bp, Homo sapiens
aaaggagagactcccatgaagcc

SEQ ID NO: 5079823 - DNA, 22 bp, Homo sapiens
aaaggagagattattaaatcgt

SEQ ID NO: 5079824 - DNA, 23 bp, Homo sapiens
aaaggagagattattaaatcgtt

SEQ ID NO: 5079825 - DNA, 13 bp, Homo sapiens
aaaggagagcatc

SEQ ID NO: 5079826 - DNA, 21 bp, Homo sapiens
aaaggagagctagcagcaggg

SEQ ID NO: 5079827 - DNA, 21 bp, Homo sapiens
aaaggagagtcttgcagtgat

SEQ ID NO: 5079828 - DNA, 14 bp, Homo sapiens
aaaggagataaatc

SEQ ID NO: 5079829 - DNA, 15 bp, Homo sapiens
aaaggagataaatct

SEQ ID NO: 5079830 - DNA, 17 bp, Homo sapiens
aaaggagattggaagga

SEQ ID NO: 5079831 - DNA, 20 bp, Homo sapiens
aaaggagcatttttttattc

SEQ ID NO: 5079832 - DNA, 22 bp, Homo sapiens
aaaggagccggaccaagatggg

SEQ ID NO: 5079833 - DNA, 13 bp, Homo sapiens
aaaggagccttga

SEQ ID NO: 5079834 - DNA, 22 bp, Homo sapiens
aaaggagccttgataatacttg

SEQ ID NO: 5079835 - DNA, 15 bp, Homo sapiens
aaaggagctttctca

SEQ ID NO: 5079836 - DNA, 18 bp, Homo sapiens
aaaggaggaccagtcagg

SEQ ID NO: 5079837 - DNA, 17 bp, Homo sapiens
aaaggaggatagaaaaa

SEQ ID NO: 5079838 - DNA, 21 bp, Homo sapiens
aaaggaggatagaaaaaggat

SEQ ID NO: 5079839 - DNA, 16 bp, Homo sapiens
aaaggaggcatgcctc

SEQ ID NO: 5079840 - DNA, 21 bp, Homo sapiens
aaaggaggccctgttccctgg

SEQ ID NO: 5079841 - DNA, 20 bp, Homo sapiens
aaaggagggaaaagcagatg

SEQ ID NO: 5079842 - DNA, 14 bp, Homo sapiens
aaaggaggggagaa

SEQ ID NO: 5079843 - DNA, 16 bp, Homo sapiens
aaaggagtcaaaacta

SEQ ID NO: 5079844 - DNA, 11 bp, Homo sapiens
aaaggagttta

SEQ ID NO: 5079845 - DNA, 19 bp, Homo sapiens
aaaggagtttaaaaacatt

SEQ ID NO: 5079846 - DNA, 19 bp, Homo sapiens
aaaggataaacttttagaa

SEQ ID NO: 5079847 - DNA, 13 bp, Homo sapiens
aaaggataaagaa

SEQ ID NO: 5079848 - DNA, 21 bp, Homo sapiens
aaaggatagtatttttatcca

SEQ ID NO: 5079849 - DNA, 16 bp, Homo sapiens
aaaggatataaaagga

SEQ ID NO: 5079850 - DNA, 18 bp, Homo sapiens
aaaggatattatctacct

SEQ ID NO: 5079851 - DNA, 21 bp, Homo sapiens
aaaggatatttaagaaaatac

SEQ ID NO: 5079852 - DNA, 23 bp, Homo sapiens
aaaggatatttaagaaaatacaa

SEQ ID NO: 5079853 - DNA, 21 bp, Homo sapiens
aaaggatatttcaaatgatta

SEQ ID NO: 5079854 - DNA, 12 bp, Homo sapiens
aaaggatatttt

SEQ ID NO: 5079855 - DNA, 15 bp, Homo sapiens
aaaggatattttctt

SEQ ID NO: 5079856 - DNA, 22 bp, Homo sapiens
aaaggatcaacaacatccactg

SEQ ID NO: 5079857 - DNA, 16 bp, Homo sapiens
aaaggatcatggtttt

SEQ ID NO: 5079858 - DNA, 20 bp, Homo sapiens
aaaggatctgtgattggctg

SEQ ID NO: 5079859 - DNA, 17 bp, Homo sapiens
aaaggatgagaatgtga

SEQ ID NO: 5079860 - DNA, 20 bp, Homo sapiens
aaaggatgatcaaaaataat

SEQ ID NO: 5079861 - DNA, 15 bp, Homo sapiens
aaaggatgatggaaa

SEQ ID NO: 5079862 - DNA, 16 bp, Homo sapiens
aaaggatgatggaaaa

SEQ ID NO: 5079863 - DNA, 20 bp, Homo sapiens
aaaggatgatggaaaaatca

SEQ ID NO: 5079864 - DNA, 16 bp, Homo sapiens
aaaggatgatttaaca

SEQ ID NO: 5079865 - DNA, 13 bp, Homo sapiens
aaaggatggaaga

SEQ ID NO: 5079866 - DNA, 20 bp, Homo sapiens
aaaggatgtaaacagtgcct

SEQ ID NO: 5079867 - DNA, 21 bp, Homo sapiens
aaaggatgtaaacagtgcctg

SEQ ID NO: 5079868 - DNA, 12 bp, Homo sapiens
aaaggatgtgat

SEQ ID NO: 5079869 - DNA, 14 bp, Homo sapiens
aaaggatgtgatat

SEQ ID NO: 5079870 - DNA, 23 bp, Homo sapiens
aaaggatgtgatatataagtgta

SEQ ID NO: 5079871 - DNA, 13 bp, Homo sapiens
aaaggattaagat

SEQ ID NO: 5079872 - DNA, 14 bp, Homo sapiens
aaaggattaatctg

SEQ ID NO: 5079873 - DNA, 13 bp, Homo sapiens
aaaggatttgaaa

SEQ ID NO: 5079874 - DNA, 16 bp, Homo sapiens
aaaggattttaccaaa

SEQ ID NO: 5079875 - DNA, 20 bp, Homo sapiens
aaaggattttaccaaagcat

SEQ ID NO: 5079876 - DNA, 14 bp, Homo sapiens
aaaggcaaaagact

SEQ ID NO: 5079877 - DNA, 22 bp, Homo sapiens
aaaggcaacataattcttcctt

SEQ ID NO: 5079878 - DNA, 16 bp, Homo sapiens
aaaggcaaccaataaa

SEQ ID NO: 5079879 - DNA, 13 bp, Homo sapiens
aaaggcaactcaa

SEQ ID NO: 5079880 - DNA, 20 bp, Homo sapiens
aaaggcaactcaaagatgat

SEQ ID NO: 5079881 - DNA, 14 bp, Homo sapiens
aaaggcaagcactt

SEQ ID NO: 5079882 - DNA, 13 bp, Homo sapiens
aaaggcaagcttg

SEQ ID NO: 5079883 - DNA, 23 bp, Homo sapiens
aaaggcaaggaaattaagaactg

SEQ ID NO: 5079884 - DNA, 13 bp, Homo sapiens
aaaggcaaggtcc

SEQ ID NO: 5079885 - DNA, 17 bp, Homo sapiens
aaaggcaattatatcta

SEQ ID NO: 5079886 - DNA, 20 bp, Homo sapiens
aaaggcaattatatctatta

SEQ ID NO: 5079887 - DNA, 21 bp, Homo sapiens
aaaggcacctataaaacaggt

SEQ ID NO: 5079888 - DNA, 14 bp, Homo sapiens
aaaggcactgcaca

SEQ ID NO: 5079889 - DNA, 13 bp, Homo sapiens
aaaggcactgtga

SEQ ID NO: 5079890 - DNA, 14 bp, Homo sapiens
aaaggcagaaagga

SEQ ID NO: 5079891 - DNA, 13 bp, Homo sapiens
aaaggcagacaca

SEQ ID NO: 5079892 - DNA, 23 bp, Homo sapiens
aaaggcagacacaccgcggccag

SEQ ID NO: 5079893 - DNA, 16 bp, Homo sapiens
aaaggcagagattggg

SEQ ID NO: 5079894 - DNA, 12 bp, Homo sapiens
aaaggcagagga

SEQ ID NO: 5079895 - DNA, 15 bp, Homo sapiens
aaaggcagatttcca

SEQ ID NO: 5079896 - DNA, 12 bp, Homo sapiens
aaaggcagcctt

SEQ ID NO: 5079897 - DNA, 10 bp, Homo sapiens
aaaggcagcg

SEQ ID NO: 5079898 - DNA, 17 bp, Homo sapiens
aaaggcagcgtgccgag

SEQ ID NO: 5079899 - DNA, 14 bp, Homo sapiens
aaaggcagctaaga

SEQ ID NO: 5079900 - DNA, 22 bp, Homo sapiens
aaaggcagctaagatagaaagc

SEQ ID NO: 5079901 - DNA, 23 bp, Homo sapiens
aaaggcagctcacccctgggcag

SEQ ID NO: 5079902 - DNA, 12 bp, Homo sapiens
aaaggcagctgc

SEQ ID NO: 5079903 - DNA, 14 bp, Homo sapiens
aaaggcagctgcct

SEQ ID NO: 5079904 - DNA, 16 bp, Homo sapiens
aaaggcagctgcctct

SEQ ID NO: 5079905 - DNA, 18 bp, Homo sapiens
aaaggcagctgcctctgc

SEQ ID NO: 5079906 - DNA, 19 bp, Homo sapiens
aaaggcaggaagggaagcg

SEQ ID NO: 5079907 - DNA, 22 bp, Homo sapiens
aaaggcaggtttcatttcttat

SEQ ID NO: 5079908 - DNA, 16 bp, Homo sapiens
aaaggcagtattccct

SEQ ID NO: 5079909 - DNA, 18 bp, Homo sapiens
aaaggcagtattttgtgt

SEQ ID NO: 5079910 - DNA, 23 bp, Homo sapiens
aaaggcagtttgcaaaaaatgtt

SEQ ID NO: 5079911 - DNA, 18 bp, Homo sapiens
aaaggcatcccagcctgg

SEQ ID NO: 5079912 - DNA, 21 bp, Homo sapiens
aaaggcatccttgtcttttga

SEQ ID NO: 5079913 - DNA, 15 bp, Homo sapiens
aaaggcatctccctt

SEQ ID NO: 5079914 - DNA, 16 bp, Homo sapiens
aaaggcatctttctga

SEQ ID NO: 5079915 - DNA, 22 bp, Homo sapiens
aaaggcatgcagtcatgagaat

SEQ ID NO: 5079916 - DNA, 22 bp, Homo sapiens
aaaggcattgcacagagtgaac

SEQ ID NO: 5079917 - DNA, 14 bp, Homo sapiens
aaaggccaaacctc

SEQ ID NO: 5079918 - DNA, 17 bp, Homo sapiens
aaaggccaaagataaaa

SEQ ID NO: 5079919 - DNA, 18 bp, Homo sapiens
aaaggccaaagataaaag

SEQ ID NO: 5079920 - DNA, 20 bp, Homo sapiens
aaaggccagacctgcagacg

SEQ ID NO: 5079921 - DNA, 20 bp, Homo sapiens
aaaggccagcagccttccag

SEQ ID NO: 5079922 - DNA, 21 bp, Homo sapiens
aaaggccagcagccttccagt

SEQ ID NO: 5079923 - DNA, 15 bp, Homo sapiens
aaaggccagcagctg

SEQ ID NO: 5079924 - DNA, 12 bp, Homo sapiens
aaaggccagctg

SEQ ID NO: 5079925 - DNA, 19 bp, Homo sapiens
aaaggccagtggaagaaac

SEQ ID NO: 5079926 - DNA, 14 bp, Homo sapiens
aaaggccatggaga

SEQ ID NO: 5079927 - DNA, 20 bp, Homo sapiens
aaaggcccaaaccaggggga

SEQ ID NO: 5079928 - DNA, 13 bp, Homo sapiens
aaaggccctgtgg

SEQ ID NO: 5079929 - DNA, 18 bp, Homo sapiens
aaaggcccttagagggaa

SEQ ID NO: 5079930 - DNA, 17 bp, Homo sapiens
aaaggccgccgtgacct

SEQ ID NO: 5079931 - DNA, 15 bp, Homo sapiens
aaaggcctcctcccc

SEQ ID NO: 5079932 - DNA, 21 bp, Homo sapiens
aaaggcctcctcccccacccc

SEQ ID NO: 5079933 - DNA, 11 bp, Homo sapiens
aaaggcctctt

SEQ ID NO: 5079934 - DNA, 15 bp, Homo sapiens
aaaggcctgcacaca

SEQ ID NO: 5079935 - DNA, 11 bp, Homo sapiens
aaaggcctggg

SEQ ID NO: 5079936 - DNA, 13 bp, Homo sapiens
aaaggcctggggt

SEQ ID NO: 5079937 - DNA, 17 bp, Homo sapiens
aaaggccttaacaaacg

SEQ ID NO: 5079938 - DNA, 12 bp, Homo sapiens
aaaggcctttaa

SEQ ID NO: 5079939 - DNA, 13 bp, Homo sapiens
aaaggcctttggg

SEQ ID NO: 5079940 - DNA, 20 bp, Homo sapiens
aaaggcctttgggatttgcc

SEQ ID NO: 5079941 - DNA, 22 bp, Homo sapiens
aaagcaagaccttgattgcacc

SEQ ID NO: 5079942 - DNA, 22 bp, Homo sapiens
aaagcaagcattcagaagaaaa

SEQ ID NO: 5079943 - DNA, 20 bp, Homo sapiens
aaagcaagctgattaaatga

SEQ ID NO: 5079944 - DNA, 14 bp, Homo sapiens
aaagcaaggactgc

SEQ ID NO: 5079945 - DNA, 15 bp, Homo sapiens
aaagcaaggactgcc

SEQ ID NO: 5079946 - DNA, 17 bp, Homo sapiens
aaagcaaggatctttca

SEQ ID NO: 5079947 - DNA, 15 bp, Homo sapiens
aaagcaagggagaaa

SEQ ID NO: 5079948 - DNA, 18 bp, Homo sapiens
aaagcaagggagaaaaga

SEQ ID NO: 5079949 - DNA, 19 bp, Homo sapiens
aaagcaagtgttcactgct

SEQ ID NO: 5079950 - DNA, 18 bp, Homo sapiens
aaagcaatacgtttgtgc

SEQ ID NO: 5079951 - DNA, 18 bp, Homo sapiens
aaagcaatcaagcaccag

SEQ ID NO: 5079952 - DNA, 22 bp, Homo sapiens
aaagcaatcaagcaccaggaag

SEQ ID NO: 5079953 - DNA, 15 bp, Homo sapiens
aaagcaatcattaag

SEQ ID NO: 5079954 - DNA, 20 bp, Homo sapiens
aaagcaatcattaagtgact

SEQ ID NO: 5079955 - DNA, 20 bp, Homo sapiens
aaagcaatctgattcagcat

SEQ ID NO: 5079956 - DNA, 16 bp, Homo sapiens
aaagcaattaaatgat

SEQ ID NO: 5079957 - DNA, 13 bp, Homo sapiens
aaagcaattatat

SEQ ID NO: 5079958 - DNA, 15 bp, Homo sapiens
aaagcaattccaacc

SEQ ID NO: 5079959 - DNA, 23 bp, Homo sapiens
aaagcaatttactgatgagagaa

SEQ ID NO: 5079960 - DNA, 14 bp, Homo sapiens
aaagcaattttcct

SEQ ID NO: 5079961 - DNA, 18 bp, Homo sapiens
aaagcaattttccttgaa

SEQ ID NO: 5079962 - DNA, 22 bp, Homo sapiens
aaagcaattttccttgaagccg

SEQ ID NO: 5079963 - DNA, 18 bp, Homo sapiens
aaagcacaaagttctcag

SEQ ID NO: 5079964 - DNA, 22 bp, Homo sapiens
aaagcacaaagttctcagagct

SEQ ID NO: 5079965 - DNA, 13 bp, Homo sapiens
aaagcacaagaag

SEQ ID NO: 5079966 - DNA, 15 bp, Homo sapiens
aaagcacaagactgg

SEQ ID NO: 5079967 - DNA, 19 bp, Homo sapiens
aaagcacaagactggccca

SEQ ID NO: 5079968 - DNA, 23 bp, Homo sapiens
aaagcacagctctcactggccag

SEQ ID NO: 5079969 - DNA, 20 bp, Homo sapiens
aaagcacagtgttaaatgaa

SEQ ID NO: 5079970 - DNA, 15 bp, Homo sapiens
aaagcacagtttgaa

SEQ ID NO: 5079971 - DNA, 16 bp, Homo sapiens
aaagcacagtttgaac

SEQ ID NO: 5079972 - DNA, 12 bp, Homo sapiens
aaagcacatcca

SEQ ID NO: 5079973 - DNA, 19 bp, Homo sapiens
aaagcacatgccagggaaa

SEQ ID NO: 5079974 - DNA, 15 bp, Homo sapiens
aaagcacatgcttag

SEQ ID NO: 5079975 - DNA, 17 bp, Homo sapiens
aaagcaccaaaataaga

SEQ ID NO: 5079976 - DNA, 23 bp, Homo sapiens
aaagcaccaaaataagaaaagat

SEQ ID NO: 5079977 - DNA, 14 bp, Homo sapiens
aaagcaccaaattc

SEQ ID NO: 5079978 - DNA, 18 bp, Homo sapiens
aaagcaccactgttctgt

SEQ ID NO: 5079979 - DNA, 21 bp, Homo sapiens
aaagcaccatcatcatagagg

SEQ ID NO: 5079980 - DNA, 21 bp, Homo sapiens
aaagcacctgaaccactgtgg

SEQ ID NO: 5079981 - DNA, 13 bp, Homo sapiens
aaagcacctgccg

SEQ ID NO: 5079982 - DNA, 17 bp, Homo sapiens
aaagcacgtgcaaggac

SEQ ID NO: 5079983 - DNA, 22 bp, Homo sapiens
aaagcactagagaatgcacaga

SEQ ID NO: 5079984 - DNA, 21 bp, Homo sapiens
aaagcactcccttaggcatta

SEQ ID NO: 5079985 - DNA, 22 bp, Homo sapiens
aaagcactcccttaggcattat

SEQ ID NO: 5079986 - DNA, 21 bp, Homo sapiens
aaagcactcctccctgatgta

SEQ ID NO: 5079987 - DNA, 17 bp, Homo sapiens
aaagcactggccttgcc

SEQ ID NO: 5079988 - DNA, 18 bp, Homo sapiens
aaagcacttaaagttttt

SEQ ID NO: 5079989 - DNA, 21 bp, Homo sapiens
aaagcacttacaccagtttga

SEQ ID NO: 5079990 - DNA, 17 bp, Homo sapiens
aaagcacttcttttcca

SEQ ID NO: 5079991 - DNA, 16 bp, Homo sapiens
aaagcacttggactct

SEQ ID NO: 5079992 - DNA, 22 bp, Homo sapiens
aaagcacttggactcttgctct

SEQ ID NO: 5079993 - DNA, 15 bp, Homo sapiens
aaagcacttttgtta

SEQ ID NO: 5079994 - DNA, 16 bp, Homo sapiens
aaagcacttttgttat

SEQ ID NO: 5079995 - DNA, 18 bp, Homo sapiens
aaagcacttttgttattc

SEQ ID NO: 5079996 - DNA, 23 bp, Homo sapiens
aaagcacttttgttattccatca

SEQ ID NO: 5079997 - DNA, 14 bp, Homo sapiens
aaagcactttttaa

SEQ ID NO: 5079998 - DNA, 19 bp, Homo sapiens
aaagcagaatagtattttt

SEQ ID NO: 5079999 - DNA, 17 bp, Homo sapiens
aaagcagaattttaatg

SEQ ID NO: 5080000 - DNA, 21 bp, Homo sapiens
aaagcagaattttaatgtgaa

SEQ ID NO: 5080001 - DNA, 23 bp, Homo sapiens
aaagcagaattttaatgtgaaga

SEQ ID NO: 5080002 - DNA, 14 bp, Homo sapiens
aaagcagagagaag

SEQ ID NO: 5080003 - DNA, 15 bp, Homo sapiens
aaagcagagccaagg

SEQ ID NO: 5080004 - DNA, 16 bp, Homo sapiens
aaagcagagccaaggc

SEQ ID NO: 5080005 - DNA, 16 bp, Homo sapiens
aaagcagagcctcctg

SEQ ID NO: 5080006 - DNA, 19 bp, Homo sapiens
aaagcagagcctcctggga

SEQ ID NO: 5080007 - DNA, 23 bp, Homo sapiens
aaagcagaggctggcctcagact

SEQ ID NO: 5080008 - DNA, 21 bp, Homo sapiens
aaagcagagtgaaattcaatt

SEQ ID NO: 5080009 - DNA, 17 bp, Homo sapiens
aaagcagagtggactgc

SEQ ID NO: 5080010 - DNA, 22 bp, Homo sapiens
aaagcagagtggactgcattta

SEQ ID NO: 5080011 - DNA, 16 bp, Homo sapiens
aaagcagagtgggact

SEQ ID NO: 5080012 - DNA, 10 bp, Homo sapiens
aaagcagcaa

SEQ ID NO: 5080013 - DNA, 15 bp, Homo sapiens
aaagcagcacaagga

SEQ ID NO: 5080014 - DNA, 18 bp, Homo sapiens
aaagcagcccttggccag

SEQ ID NO: 5080015 - DNA, 19 bp, Homo sapiens
aaagcagcctcattctgag

SEQ ID NO: 5080016 - DNA, 21 bp, Homo sapiens
aaagcagcctcattctgaggc

SEQ ID NO: 5080017 - DNA, 12 bp, Homo sapiens
aaagcagcctga

SEQ ID NO: 5080018 - DNA, 17 bp, Homo sapiens
aaagcagcctggccaac

SEQ ID NO: 5080019 - DNA, 22 bp, Homo sapiens
aaagcagcgctagtggagggtt

SEQ ID NO: 5080020 - DNA, 22 bp, Homo sapiens
aaagcagcgtttctatgacaca

SEQ ID NO: 5080021 - DNA, 21 bp, Homo sapiens
aaagcagctaaatgtaactta

SEQ ID NO: 5080022 - DNA, 11 bp, Homo sapiens
aaagcagcttt

SEQ ID NO: 5080023 - DNA, 21 bp, Homo sapiens
aaagcaggaaagatcccaagt

SEQ ID NO: 5080024 - DNA, 18 bp, Homo sapiens
aaagcaggaacccatcta

SEQ ID NO: 5080025 - DNA, 23 bp, Homo sapiens
aaagcaggacatatgagaaaact

SEQ ID NO: 5080026 - DNA, 17 bp, Homo sapiens
aaagcaggagcagctgt

SEQ ID NO: 5080027 - DNA, 21 bp, Homo sapiens
aaagcaggatgtagttctgcc

SEQ ID NO: 5080028 - DNA, 21 bp, Homo sapiens
aaagcaggggagtatgcaaaa

SEQ ID NO: 5080029 - DNA, 22 bp, Homo sapiens
aaagcaggggctacaagaggga

SEQ ID NO: 5080030 - DNA, 17 bp, Homo sapiens
aaagcaggtggcatctc

SEQ ID NO: 5080031 - DNA, 16 bp, Homo sapiens
aaagcaggttcttgtt

SEQ ID NO: 5080032 - DNA, 19 bp, Homo sapiens
aaagcagtaaaataaaaaa

SEQ ID NO: 5080033 - DNA, 22 bp, Homo sapiens
aaagcagtagaaataatatgca

SEQ ID NO: 5080034 - DNA, 18 bp, Homo sapiens
aaagcagtagacaatccc

SEQ ID NO: 5080035 - DNA, 13 bp, Homo sapiens
aaagcagtatgta

SEQ ID NO: 5080036 - DNA, 22 bp, Homo sapiens
aaagcagtgaagcaatttcagt

SEQ ID NO: 5080037 - DNA, 16 bp, Homo sapiens
aaagcagtgcatgctg

SEQ ID NO: 5080038 - DNA, 22 bp, Homo sapiens
aaagcagtgcatgctgtccctt

SEQ ID NO: 5080039 - DNA, 17 bp, Homo sapiens
aaagcagttaaactgat

SEQ ID NO: 5080040 - DNA, 23 bp, Homo sapiens
aaagcagttaactttaagactga

SEQ ID NO: 5080041 - DNA, 17 bp, Homo sapiens
aaagcagttaatttata

SEQ ID NO: 5080042 - DNA, 12 bp, Homo sapiens
aaagcagttcct

SEQ ID NO: 5080043 - DNA, 15 bp, Homo sapiens
aaagcagttctgatg

SEQ ID NO: 5080044 - DNA, 21 bp, Homo sapiens
aaagcagttctgatgcttaca

SEQ ID NO: 5080045 - DNA, 17 bp, Homo sapiens
aaagcagtttttccccc

SEQ ID NO: 5080046 - DNA, 21 bp, Homo sapiens
aaagcagtttttgaaagacaa

SEQ ID NO: 5080047 - DNA, 16 bp, Homo sapiens
aaagcataaaaacatt

SEQ ID NO: 5080048 - DNA, 14 bp, Homo sapiens
aaagcataaaactt

SEQ ID NO: 5080049 - DNA, 18 bp, Homo sapiens
aaagcataagtatacagt

SEQ ID NO: 5080050 - DNA, 20 bp, Homo sapiens
aaagcatagatgttttggta

SEQ ID NO: 5080051 - DNA, 16 bp, Homo sapiens
aaagcatatataaaac

SEQ ID NO: 5080052 - DNA, 21 bp, Homo sapiens
aaagcatattgtaccccctca

SEQ ID NO: 5080053 - DNA, 14 bp, Homo sapiens
aaagcatcaaataa

SEQ ID NO: 5080054 - DNA, 16 bp, Homo sapiens
aaagcatcaaataata

SEQ ID NO: 5080055 - DNA, 19 bp, Homo sapiens
aaagcatcaaataatacat

SEQ ID NO: 5080056 - DNA, 18 bp, Homo sapiens
aaagcatcacacagtggc

SEQ ID NO: 5080057 - DNA, 17 bp, Homo sapiens
aaagcatcacctcaggc

SEQ ID NO: 5080058 - DNA, 19 bp, Homo sapiens
aaagcatcactgccttggc

SEQ ID NO: 5080059 - DNA, 20 bp, Homo sapiens
aaagcatcatggctatctgt

SEQ ID NO: 5080060 - DNA, 15 bp, Homo sapiens
aaagcatccctcacc

SEQ ID NO: 5080061 - DNA, 18 bp, Homo sapiens
aaagcatctattcccaaa

SEQ ID NO: 5080062 - DNA, 14 bp, Homo sapiens
aaagcatgaaacat

SEQ ID NO: 5080063 - DNA, 17 bp, Homo sapiens
aaagcatgaaatgtgaa

SEQ ID NO: 5080064 - DNA, 13 bp, Homo sapiens
aaagcatgaatat

SEQ ID NO: 5080065 - DNA, 13 bp, Homo sapiens
aaagcatgaatgg

SEQ ID NO: 5080066 - DNA, 17 bp, Homo sapiens
aaagcatgaattggaac

SEQ ID NO: 5080067 - DNA, 20 bp, Homo sapiens
aaagcatgaattggaactgc

SEQ ID NO: 5080068 - DNA, 18 bp, Homo sapiens
aaagcatgatgggaaaat

SEQ ID NO: 5080069 - DNA, 19 bp, Homo sapiens
aaagcatgatgggaaaata

SEQ ID NO: 5080070 - DNA, 20 bp, Homo sapiens
aaagcatgatgggaaaatat

SEQ ID NO: 5080071 - DNA, 23 bp, Homo sapiens
aaagcatgatgggaaaatatttc

SEQ ID NO: 5080072 - DNA, 16 bp, Homo sapiens
aaagcatgatttttaa

SEQ ID NO: 5080073 - DNA, 20 bp, Homo sapiens
aaagcatgccgttctgcacc

SEQ ID NO: 5080074 - DNA, 12 bp, Homo sapiens
aaagcatggact

SEQ ID NO: 5080075 - DNA, 11 bp, Homo sapiens
aaagcatgtat

SEQ ID NO: 5080076 - DNA, 13 bp, Homo sapiens
aaagcatgtctca

SEQ ID NO: 5080077 - DNA, 22 bp, Homo sapiens
aaagcattaattttttttcatt

SEQ ID NO: 5080078 - DNA, 15 bp, Homo sapiens
aaagcattcttccct

SEQ ID NO: 5080079 - DNA, 16 bp, Homo sapiens
aaagcatttactttga

SEQ ID NO: 5080080 - DNA, 17 bp, Homo sapiens
aaagcatttactttgaa

SEQ ID NO: 5080081 - DNA, 12 bp, Homo sapiens
aaagcatttata

SEQ ID NO: 5080082 - DNA, 13 bp, Homo sapiens
aaagcatttccta

SEQ ID NO: 5080083 - DNA, 17 bp, Homo sapiens
aaagcatttcttttctc

SEQ ID NO: 5080084 - DNA, 17 bp, Homo sapiens
aaagcatttgaatgcat

SEQ ID NO: 5080085 - DNA, 19 bp, Homo sapiens
aaagcatttgaatgcattt

SEQ ID NO: 5080086 - DNA, 19 bp, Homo sapiens
aaagcattttcagtcttgt

SEQ ID NO: 5080087 - DNA, 14 bp, Homo sapiens
aaagcattttgtaa

SEQ ID NO: 5080088 - DNA, 11 bp, Homo sapiens
aaagcattttt

SEQ ID NO: 5080089 - DNA, 13 bp, Homo sapiens
aaagcatttttca

SEQ ID NO: 5080090 - DNA, 16 bp, Homo sapiens
aaagccaaacaaaact

SEQ ID NO: 5080091 - DNA, 23 bp, Homo sapiens
aaagccaacagtcaaaacagaga

SEQ ID NO: 5080092 - DNA, 15 bp, Homo sapiens
aaagccaaccagcct

SEQ ID NO: 5080093 - DNA, 23 bp, Homo sapiens
aaagccaagcaaaccaatggtga

SEQ ID NO: 5080094 - DNA, 15 bp, Homo sapiens
aaagccaaggcagcg

SEQ ID NO: 5080095 - DNA, 17 bp, Homo sapiens
aaagccaaggtgtcatt

SEQ ID NO: 5080096 - DNA, 19 bp, Homo sapiens
aaagccaataacacacagc

SEQ ID NO: 5080097 - DNA, 19 bp, Homo sapiens
aaagccacaaccacataca

SEQ ID NO: 5080098 - DNA, 21 bp, Homo sapiens
aaagccacaaggctggccagc

SEQ ID NO: 5080099 - DNA, 10 bp, Homo sapiens
aaagccacat

SEQ ID NO: 5080100 - DNA, 20 bp, Homo sapiens
aaagccacataaccagcggg

SEQ ID NO: 5080101 - DNA, 14 bp, Homo sapiens
aaagccacatcttg

SEQ ID NO: 5080102 - DNA, 17 bp, Homo sapiens
aaagccaccttgttaca

SEQ ID NO: 5080103 - DNA, 16 bp, Homo sapiens
aaagccacgccctccc

SEQ ID NO: 5080104 - DNA, 14 bp, Homo sapiens
aaagccactggaag

SEQ ID NO: 5080105 - DNA, 15 bp, Homo sapiens
aaagccactggaagg

SEQ ID NO: 5080106 - DNA, 14 bp, Homo sapiens
aaagccagaagctg

SEQ ID NO: 5080107 - DNA, 15 bp, Homo sapiens
aaagccagacaactt

SEQ ID NO: 5080108 - DNA, 11 bp, Homo sapiens
aaagccagcct

SEQ ID NO: 5080109 - DNA, 15 bp, Homo sapiens
aaagccaggaacagg

SEQ ID NO: 5080110 - DNA, 19 bp, Homo sapiens
aaagccaggagcagccctg

SEQ ID NO: 5080111 - DNA, 17 bp, Homo sapiens
aaagccaggctcaggag

SEQ ID NO: 5080112 - DNA, 23 bp, Homo sapiens
aaagccaggctcaggagaagcca

SEQ ID NO: 5080113 - DNA, 20 bp, Homo sapiens
aaagccagtcatcatctctt

SEQ ID NO: 5080114 - DNA, 13 bp, Homo sapiens
aaagccagtctta

SEQ ID NO: 5080115 - DNA, 13 bp, Homo sapiens
aaagccagtgaaa

SEQ ID NO: 5080116 - DNA, 17 bp, Homo sapiens
aaagccagtgactccag

SEQ ID NO: 5080117 - DNA, 23 bp, Homo sapiens
aaagccatatcatgctaaaattc

SEQ ID NO: 5080118 - DNA, 19 bp, Homo sapiens
aaagccatatggacactgt

SEQ ID NO: 5080119 - DNA, 13 bp, Homo sapiens
aaaggcgctgaga

SEQ ID NO: 5080120 - DNA, 18 bp, Homo sapiens
aaaggctaacaaatttta

SEQ ID NO: 5080121 - DNA, 23 bp, Homo sapiens
aaaggctaacaaattttaagtgc

SEQ ID NO: 5080122 - DNA, 14 bp, Homo sapiens
aaaggctacctttg

SEQ ID NO: 5080123 - DNA, 20 bp, Homo sapiens
aaaggctatgattgtctttg

SEQ ID NO: 5080124 - DNA, 21 bp, Homo sapiens
aaaggctcaatttggtgctca

SEQ ID NO: 5080125 - DNA, 12 bp, Homo sapiens
aaaggctcattt

SEQ ID NO: 5080126 - DNA, 17 bp, Homo sapiens
aaaggctcatttaaaac

SEQ ID NO: 5080127 - DNA, 18 bp, Homo sapiens
aaaggctcgattttgtat

SEQ ID NO: 5080128 - DNA, 23 bp, Homo sapiens
aaaggctcgattttgtatctgca

SEQ ID NO: 5080129 - DNA, 20 bp, Homo sapiens
aaaggctctgaaagccagct

SEQ ID NO: 5080130 - DNA, 14 bp, Homo sapiens
aaaggctctggaag

SEQ ID NO: 5080131 - DNA, 17 bp, Homo sapiens
aaaggctctgtgcttga

SEQ ID NO: 5080132 - DNA, 16 bp, Homo sapiens
aaaggctgaaaagaag

SEQ ID NO: 5080133 - DNA, 14 bp, Homo sapiens
aaaggctgaacata

SEQ ID NO: 5080134 - DNA, 17 bp, Homo sapiens
aaaggctgaacataaat

SEQ ID NO: 5080135 - DNA, 13 bp, Homo sapiens
aaaggctgagaag

SEQ ID NO: 5080136 - DNA, 16 bp, Homo sapiens
aaaggctgattactga

SEQ ID NO: 5080137 - DNA, 23 bp, Homo sapiens
aaaggctgcagctaatttgtgaa

SEQ ID NO: 5080138 - DNA, 19 bp, Homo sapiens
aaaggctggggtgggccct

SEQ ID NO: 5080139 - DNA, 17 bp, Homo sapiens
aaaggctggtggacaga

SEQ ID NO: 5080140 - DNA, 13 bp, Homo sapiens
aaaggctgtattc

SEQ ID NO: 5080141 - DNA, 18 bp, Homo sapiens
aaaggctgtgctgccctg

SEQ ID NO: 5080142 - DNA, 13 bp, Homo sapiens
aaaggctgttaaa

SEQ ID NO: 5080143 - DNA, 18 bp, Homo sapiens
aaaggctgttaaatacag

SEQ ID NO: 5080144 - DNA, 17 bp, Homo sapiens
aaaggcttataaaacag

SEQ ID NO: 5080145 - DNA, 18 bp, Homo sapiens
aaaggcttccagaggaga

SEQ ID NO: 5080146 - DNA, 13 bp, Homo sapiens
aaaggcttctcca

SEQ ID NO: 5080147 - DNA, 17 bp, Homo sapiens
aaaggcttctctctcac

SEQ ID NO: 5080148 - DNA, 16 bp, Homo sapiens
aaaggcttcttggctt

SEQ ID NO: 5080149 - DNA, 18 bp, Homo sapiens
aaaggcttgagtctggat

SEQ ID NO: 5080150 - DNA, 17 bp, Homo sapiens
aaaggcttgcagaactt

SEQ ID NO: 5080151 - DNA, 14 bp, Homo sapiens
aaaggcttggctgg

SEQ ID NO: 5080152 - DNA, 16 bp, Homo sapiens
aaagggaaaaaagaaa

SEQ ID NO: 5080153 - DNA, 13 bp, Homo sapiens
aaagggaaaaaat

SEQ ID NO: 5080154 - DNA, 16 bp, Homo sapiens
aaagggaaaaaataaa

SEQ ID NO: 5080155 - DNA, 13 bp, Homo sapiens
aaagggaaaaaga

SEQ ID NO: 5080156 - DNA, 20 bp, Homo sapiens
aaagggaacaggaaaagaaa

SEQ ID NO: 5080157 - DNA, 13 bp, Homo sapiens
aaagggaactaga

SEQ ID NO: 5080158 - DNA, 21 bp, Homo sapiens
aaagggaagttatttatattt

SEQ ID NO: 5080159 - DNA, 22 bp, Homo sapiens
aaagggaatcatttttcactgt

SEQ ID NO: 5080160 - DNA, 23 bp, Homo sapiens
aaagggacacccctacacacacc

SEQ ID NO: 5080161 - DNA, 23 bp, Homo sapiens
aaagggacactggatccagaagc

SEQ ID NO: 5080162 - DNA, 14 bp, Homo sapiens
aaagggacagtttg

SEQ ID NO: 5080163 - DNA, 16 bp, Homo sapiens
aaagggactgagaaat

SEQ ID NO: 5080164 - DNA, 21 bp, Homo sapiens
aaagggagaaggaagggcaga

SEQ ID NO: 5080165 - DNA, 16 bp, Homo sapiens
aaagggagaatggtgc

SEQ ID NO: 5080166 - DNA, 17 bp, Homo sapiens
aaagggagatgtcagga

SEQ ID NO: 5080167 - DNA, 20 bp, Homo sapiens
aaagggagatgtcaggatgt

SEQ ID NO: 5080168 - DNA, 20 bp, Homo sapiens
aaagggagcagaactgaacc

SEQ ID NO: 5080169 - DNA, 13 bp, Homo sapiens
aaagggagcgagg

SEQ ID NO: 5080170 - DNA, 17 bp, Homo sapiens
aaagggagggctctgag

SEQ ID NO: 5080171 - DNA, 18 bp, Homo sapiens
aaagggagggctctgagg

SEQ ID NO: 5080172 - DNA, 22 bp, Homo sapiens
aaagggagggctctgaggcgcc

SEQ ID NO: 5080173 - DNA, 17 bp, Homo sapiens
aaagggagtctgccagg

SEQ ID NO: 5080174 - DNA, 14 bp, Homo sapiens
aaagggatactttt

SEQ ID NO: 5080175 - DNA, 13 bp, Homo sapiens
aaagggatatttt

SEQ ID NO: 5080176 - DNA, 15 bp, Homo sapiens
aaagggatggacttg

SEQ ID NO: 5080177 - DNA, 16 bp, Homo sapiens
aaagggatggtcaggc

SEQ ID NO: 5080178 - DNA, 14 bp, Homo sapiens
aaagggattgctga

SEQ ID NO: 5080179 - DNA, 14 bp, Homo sapiens
aaagggatttgacc

SEQ ID NO: 5080180 - DNA, 18 bp, Homo sapiens
aaagggcacagcatctgt

SEQ ID NO: 5080181 - DNA, 20 bp, Homo sapiens
aaagggcactcccaaccctg

SEQ ID NO: 5080182 - DNA, 17 bp, Homo sapiens
aaagggcacttaatttg

SEQ ID NO: 5080183 - DNA, 23 bp, Homo sapiens
aaagggcacttaatttgtaaact

SEQ ID NO: 5080184 - DNA, 17 bp, Homo sapiens
aaagggcagcccctccc

SEQ ID NO: 5080185 - DNA, 19 bp, Homo sapiens
aaagggcagcccctcccca

SEQ ID NO: 5080186 - DNA, 20 bp, Homo sapiens
aaagggcagggcccacgtgt

SEQ ID NO: 5080187 - DNA, 15 bp, Homo sapiens
aaagggccagaaaaa

SEQ ID NO: 5080188 - DNA, 13 bp, Homo sapiens
aaagggccaggtg

SEQ ID NO: 5080189 - DNA, 14 bp, Homo sapiens
aaagggcggaagag

SEQ ID NO: 5080190 - DNA, 17 bp, Homo sapiens
aaagggctatggcaagg

SEQ ID NO: 5080191 - DNA, 22 bp, Homo sapiens
aaagggctgttataatctttca

SEQ ID NO: 5080192 - DNA, 17 bp, Homo sapiens
aaaggggaaagaacata

SEQ ID NO: 5080193 - DNA, 11 bp, Homo sapiens
aaaggggagac

SEQ ID NO: 5080194 - DNA, 14 bp, Homo sapiens
aaaggggaggagaa

SEQ ID NO: 5080195 - DNA, 19 bp, Homo sapiens
aaaggggatcataaagtta

SEQ ID NO: 5080196 - DNA, 22 bp, Homo sapiens
aaaggggatggagtgagcccat

SEQ ID NO: 5080197 - DNA, 16 bp, Homo sapiens
aaaggggcaagaaatt

SEQ ID NO: 5080198 - DNA, 18 bp, Homo sapiens
aaaggggcagaaaaactc

SEQ ID NO: 5080199 - DNA, 15 bp, Homo sapiens
aaaggggcctgcgca

SEQ ID NO: 5080200 - DNA, 13 bp, Homo sapiens
aaaggggggaggg

SEQ ID NO: 5080201 - DNA, 18 bp, Homo sapiens
aaaggggggagggggagg

SEQ ID NO: 5080202 - DNA, 23 bp, Homo sapiens
aaaggggggggcaatctctctct

SEQ ID NO: 5080203 - DNA, 19 bp, Homo sapiens
aaaggggggtgggagggga

SEQ ID NO: 5080204 - DNA, 20 bp, Homo sapiens
aaagggggtcccagtgggag

SEQ ID NO: 5080205 - DNA, 21 bp, Homo sapiens
aaagggggtcccagtgggagg

SEQ ID NO: 5080206 - DNA, 21 bp, Homo sapiens
aaaggggtagggtttaaagat

SEQ ID NO: 5080207 - DNA, 24 bp, Homo sapiens
aaaggggtcggctgaccatgctca

SEQ ID NO: 5080208 - DNA, 22 bp, Homo sapiens
aaaggggtgattgaaagaaaaa

SEQ ID NO: 5080209 - DNA, 18 bp, Homo sapiens
aaagggtaaattataaat

SEQ ID NO: 5080210 - DNA, 20 bp, Homo sapiens
aaagggtatgagctggagct

SEQ ID NO: 5080211 - DNA, 15 bp, Homo sapiens
aaagggtcaaacctg

SEQ ID NO: 5080212 - DNA, 13 bp, Homo sapiens
aaagggtcaggcc

SEQ ID NO: 5080213 - DNA, 17 bp, Homo sapiens
aaagggtcttgggaaat

SEQ ID NO: 5080214 - DNA, 10 bp, Homo sapiens
aaagggtgaa

SEQ ID NO: 5080215 - DNA, 17 bp, Homo sapiens
aaagggtgaaaattatt

SEQ ID NO: 5080216 - DNA, 21 bp, Homo sapiens
aaagggtgagactccatctca

SEQ ID NO: 5080217 - DNA, 13 bp, Homo sapiens
aaagggtggtagt

SEQ ID NO: 5080218 - DNA, 21 bp, Homo sapiens
aaagggtgtaggggccacctc

SEQ ID NO: 5080219 - DNA, 17 bp, Homo sapiens
aaagggtgtatagtgtt

SEQ ID NO: 5080220 - DNA, 16 bp, Homo sapiens
aaagggtgtttttctg

SEQ ID NO: 5080221 - DNA, 18 bp, Homo sapiens
aaagggttaatagccaga

SEQ ID NO: 5080222 - DNA, 16 bp, Homo sapiens
aaagggttttaatgta

SEQ ID NO: 5080223 - DNA, 14 bp, Homo sapiens
aaagggttttcttt

SEQ ID NO: 5080224 - DNA, 19 bp, Homo sapiens
aaaggtaaaatcacttcag

SEQ ID NO: 5080225 - DNA, 21 bp, Homo sapiens
aaaggtaaaatcacttcagat

SEQ ID NO: 5080226 - DNA, 14 bp, Homo sapiens
aaaggtaaatacaa

SEQ ID NO: 5080227 - DNA, 21 bp, Homo sapiens
aaaggtaaatggttaaatttt

SEQ ID NO: 5080228 - DNA, 22 bp, Homo sapiens
aaaggtaaatggttaaatttta

SEQ ID NO: 5080229 - DNA, 20 bp, Homo sapiens
aaaggtaagaaagctgatag

SEQ ID NO: 5080230 - DNA, 18 bp, Homo sapiens
aaaggtaatgcacatcct

SEQ ID NO: 5080231 - DNA, 22 bp, Homo sapiens
aaaggtacactggtatttatat

SEQ ID NO: 5080232 - DNA, 16 bp, Homo sapiens
aaaggtaccaaacaag

SEQ ID NO: 5080233 - DNA, 15 bp, Homo sapiens
aaaggtagagatgtg

SEQ ID NO: 5080234 - DNA, 16 bp, Homo sapiens
aaaggtagatcatctt

SEQ ID NO: 5080235 - DNA, 14 bp, Homo sapiens
aaaggtaggtgcat

SEQ ID NO: 5080236 - DNA, 15 bp, Homo sapiens
aaaggtaggttttaa

SEQ ID NO: 5080237 - DNA, 16 bp, Homo sapiens
aaaggtataattttat

SEQ ID NO: 5080238 - DNA, 14 bp, Homo sapiens
aaaggtatattgtg

SEQ ID NO: 5080239 - DNA, 20 bp, Homo sapiens
aaaggtattatacatgtgat

SEQ ID NO: 5080240 - DNA, 19 bp, Homo sapiens
aaaggtattccttgttctt

SEQ ID NO: 5080241 - DNA, 20 bp, Homo sapiens
aaaggtattccttgttcttc

SEQ ID NO: 5080242 - DNA, 23 bp, Homo sapiens
aaaggtattgagccattttttaa

SEQ ID NO: 5080243 - DNA, 13 bp, Homo sapiens
aaaggtatttaga

SEQ ID NO: 5080244 - DNA, 14 bp, Homo sapiens
aaaggtcaagactg

SEQ ID NO: 5080245 - DNA, 24 bp, Homo sapiens
aaaggtcacctcactcagcaccac

SEQ ID NO: 5080246 - DNA, 16 bp, Homo sapiens
aaaggtcagaattttg

SEQ ID NO: 5080247 - DNA, 17 bp, Homo sapiens
aaaggtcagaattttgt

SEQ ID NO: 5080248 - DNA, 23 bp, Homo sapiens
aaaggtcagcccgtttcagaagg

SEQ ID NO: 5080249 - DNA, 21 bp, Homo sapiens
aaaggtccacaggtctagact

SEQ ID NO: 5080250 - DNA, 17 bp, Homo sapiens
aaaggtccttgacttga

SEQ ID NO: 5080251 - DNA, 14 bp, Homo sapiens
aaaggtccttgcct

SEQ ID NO: 5080252 - DNA, 17 bp, Homo sapiens
aaaggtcgcacctcctt

SEQ ID NO: 5080253 - DNA, 18 bp, Homo sapiens
aaaggtcgggacagctgt

SEQ ID NO: 5080254 - DNA, 16 bp, Homo sapiens
aaaggtcttaaataat

SEQ ID NO: 5080255 - DNA, 23 bp, Homo sapiens
aaaggtcttggtgcctctgcagt

SEQ ID NO: 5080256 - DNA, 18 bp, Homo sapiens
aaaggtctttttaaacca

SEQ ID NO: 5080257 - DNA, 17 bp, Homo sapiens
aaaggtgaaacacacac

SEQ ID NO: 5080258 - DNA, 14 bp, Homo sapiens
aaaggtgaaggaat

SEQ ID NO: 5080259 - DNA, 16 bp, Homo sapiens
aaaggtgaaggaatat

SEQ ID NO: 5080260 - DNA, 23 bp, Homo sapiens
aaaggtgacatcggaaaaataat

SEQ ID NO: 5080261 - DNA, 18 bp, Homo sapiens
aaaggtgataaaatcata

SEQ ID NO: 5080262 - DNA, 16 bp, Homo sapiens
aaaggtgatgaattta

SEQ ID NO: 5080263 - DNA, 15 bp, Homo sapiens
aaaggtgattaaata

SEQ ID NO: 5080264 - DNA, 16 bp, Homo sapiens
aaaggtgcactccaga

SEQ ID NO: 5080265 - DNA, 13 bp, Homo sapiens
aaaggtgcctcat

SEQ ID NO: 5080266 - DNA, 16 bp, Homo sapiens
aaaggtgctcaaagat

SEQ ID NO: 5080267 - DNA, 18 bp, Homo sapiens
aaaggtggaataaacatt

SEQ ID NO: 5080268 - DNA, 19 bp, Homo sapiens
aaaggtggactggaagggg

SEQ ID NO: 5080269 - DNA, 18 bp, Homo sapiens
aaaggtggagtttctctg

SEQ ID NO: 5080270 - DNA, 19 bp, Homo sapiens
aaaggtggattttgtttaa

SEQ ID NO: 5080271 - DNA, 13 bp, Homo sapiens
aaaggtggtaaat

SEQ ID NO: 5080272 - DNA, 17 bp, Homo sapiens
aaaggtggtaaattcag

SEQ ID NO: 5080273 - DNA, 20 bp, Homo sapiens
aaaggtggtaaattcagaca

SEQ ID NO: 5080274 - DNA, 23 bp, Homo sapiens
aaaggtggtatgtaatttatgca

SEQ ID NO: 5080275 - DNA, 19 bp, Homo sapiens
aaaggtggtatgtgtgtgt

SEQ ID NO: 5080276 - DNA, 19 bp, Homo sapiens
aaaggtggttttattttcc

SEQ ID NO: 5080277 - DNA, 14 bp, Homo sapiens
aaaggtgtatttaa

SEQ ID NO: 5080278 - DNA, 15 bp, Homo sapiens
aaaggtgtatttaaa

SEQ ID NO: 5080279 - DNA, 19 bp, Homo sapiens
aaaggtgtccttttccttt

SEQ ID NO: 5080280 - DNA, 16 bp, Homo sapiens
aaaggtgtcttcctcc

SEQ ID NO: 5080281 - DNA, 13 bp, Homo sapiens
aaaggtgtgaaca

SEQ ID NO: 5080282 - DNA, 16 bp, Homo sapiens
aaaggttaacagtaaa

SEQ ID NO: 5080283 - DNA, 17 bp, Homo sapiens
aaaggttaacagtaaaa

SEQ ID NO: 5080284 - DNA, 21 bp, Homo sapiens
aaaggttaacagtaaaaattt

SEQ ID NO: 5080285 - DNA, 19 bp, Homo sapiens
aaaggttagagaataaatt

SEQ ID NO: 5080286 - DNA, 15 bp, Homo sapiens
aaaggttatgaaaca

SEQ ID NO: 5080287 - DNA, 19 bp, Homo sapiens
aaaggttatgttcattttt

SEQ ID NO: 5080288 - DNA, 17 bp, Homo sapiens
aaaggttcactaaagca

SEQ ID NO: 5080289 - DNA, 18 bp, Homo sapiens
aaaggttcagaaaattaa

SEQ ID NO: 5080290 - DNA, 18 bp, Homo sapiens
aaaggttcatgcaaactt

SEQ ID NO: 5080291 - DNA, 19 bp, Homo sapiens
aaaggttcctttgttccct

SEQ ID NO: 5080292 - DNA, 20 bp, Homo sapiens
aaaggttctaggtttcaaag

SEQ ID NO: 5080293 - DNA, 21 bp, Homo sapiens
aaaggttctaggtttcaaaga

SEQ ID NO: 5080294 - DNA, 14 bp, Homo sapiens
aaaggttcttctgg

SEQ ID NO: 5080295 - DNA, 19 bp, Homo sapiens
aaaggttgaataatatatg

SEQ ID NO: 5080296 - DNA, 17 bp, Homo sapiens
aaaggttgactcaagtt

SEQ ID NO: 5080297 - DNA, 18 bp, Homo sapiens
aaaggttgagtatgtgaa

SEQ ID NO: 5080298 - DNA, 21 bp, Homo sapiens
aaagccatattccagcagtga

SEQ ID NO: 5080299 - DNA, 16 bp, Homo sapiens
aaagccatcatgcctt

SEQ ID NO: 5080300 - DNA, 19 bp, Homo sapiens
aaagccatcatgccttgat

SEQ ID NO: 5080301 - DNA, 20 bp, Homo sapiens
aaagccatcatgtaaattac

SEQ ID NO: 5080302 - DNA, 22 bp, Homo sapiens
aaagccatgccaataaagtgat

SEQ ID NO: 5080303 - DNA, 20 bp, Homo sapiens
aaagccatgttaaatgactt

SEQ ID NO: 5080304 - DNA, 13 bp, Homo sapiens
aaagccatgttta

SEQ ID NO: 5080305 - DNA, 16 bp, Homo sapiens
aaagccatgtttatta

SEQ ID NO: 5080306 - DNA, 16 bp, Homo sapiens
aaagccattgtgtcct

SEQ ID NO: 5080307 - DNA, 17 bp, Homo sapiens
aaagccattttggtttt

SEQ ID NO: 5080308 - DNA, 20 bp, Homo sapiens
aaagcccaacctcttcctcc

SEQ ID NO: 5080309 - DNA, 18 bp, Homo sapiens
aaagcccaagggatctgg

SEQ ID NO: 5080310 - DNA, 12 bp, Homo sapiens
aaagcccacctg

SEQ ID NO: 5080311 - DNA, 18 bp, Homo sapiens
aaagcccacctgggctgg

SEQ ID NO: 5080312 - DNA, 14 bp, Homo sapiens
aaagcccaggagcc

SEQ ID NO: 5080313 - DNA, 11 bp, Homo sapiens
aaagccccacc

SEQ ID NO: 5080314 - DNA, 12 bp, Homo sapiens
aaagccccagct

SEQ ID NO: 5080315 - DNA, 15 bp, Homo sapiens
aaagccccatgctgg

SEQ ID NO: 5080316 - DNA, 21 bp, Homo sapiens
aaagcccccagagcccaggct

SEQ ID NO: 5080317 - DNA, 15 bp, Homo sapiens
aaagccccccagctc

SEQ ID NO: 5080318 - DNA, 21 bp, Homo sapiens
aaagccccccagctcccacac

SEQ ID NO: 5080319 - DNA, 21 bp, Homo sapiens
aaagcccccttctccatggag

SEQ ID NO: 5080320 - DNA, 20 bp, Homo sapiens
aaagcccctcacactgcaag

SEQ ID NO: 5080321 - DNA, 19 bp, Homo sapiens
aaagcccctcacctcagga

SEQ ID NO: 5080322 - DNA, 23 bp, Homo sapiens
aaagcccctcgttgcccagcact

SEQ ID NO: 5080323 - DNA, 18 bp, Homo sapiens
aaagcccgcttgctcgct

SEQ ID NO: 5080324 - DNA, 15 bp, Homo sapiens
aaagccctaaaatac

SEQ ID NO: 5080325 - DNA, 22 bp, Homo sapiens
aaagccctatgtgaaaagatcc

SEQ ID NO: 5080326 - DNA, 22 bp, Homo sapiens
aaagccctcagatcccagggta

SEQ ID NO: 5080327 - DNA, 15 bp, Homo sapiens
aaagccctccctgtc

SEQ ID NO: 5080328 - DNA, 13 bp, Homo sapiens
aaagccctcttca

SEQ ID NO: 5080329 - DNA, 13 bp, Homo sapiens
aaagccctgtgct

SEQ ID NO: 5080330 - DNA, 14 bp, Homo sapiens
aaagccctgtgctt

SEQ ID NO: 5080331 - DNA, 19 bp, Homo sapiens
aaagcccttaggaagaatt

SEQ ID NO: 5080332 - DNA, 22 bp, Homo sapiens
aaagcccttccatgtcgcctct

SEQ ID NO: 5080333 - DNA, 23 bp, Homo sapiens
aaagcccttccatgtcgcctctg

SEQ ID NO: 5080334 - DNA, 20 bp, Homo sapiens
aaagccgggggaggggccct

SEQ ID NO: 5080335 - DNA, 21 bp, Homo sapiens
aaagccgggggaggggccctc

SEQ ID NO: 5080336 - DNA, 18 bp, Homo sapiens
aaagccgtgctcttttaa

SEQ ID NO: 5080337 - DNA, 21 bp, Homo sapiens
aaagccgttgtttacttaaag

SEQ ID NO: 5080338 - DNA, 15 bp, Homo sapiens
aaagcctaagaaaaa

SEQ ID NO: 5080339 - DNA, 18 bp, Homo sapiens
aaagcctagacaaccttt

SEQ ID NO: 5080340 - DNA, 19 bp, Homo sapiens
aaagcctagtccagaaatc

SEQ ID NO: 5080341 - DNA, 17 bp, Homo sapiens
aaagcctatttttcaaa

SEQ ID NO: 5080342 - DNA, 16 bp, Homo sapiens
aaagcctcaaatcttc

SEQ ID NO: 5080343 - DNA, 15 bp, Homo sapiens
aaagcctcagaaagg

SEQ ID NO: 5080344 - DNA, 16 bp, Homo sapiens
aaagcctcatgtgtga

SEQ ID NO: 5080345 - DNA, 15 bp, Homo sapiens
aaagcctccagcatc

SEQ ID NO: 5080346 - DNA, 15 bp, Homo sapiens
aaagcctccttgtgc

SEQ ID NO: 5080347 - DNA, 19 bp, Homo sapiens
aaagcctctctctccctcc

SEQ ID NO: 5080348 - DNA, 13 bp, Homo sapiens
aaagcctctgtgt

SEQ ID NO: 5080349 - DNA, 24 bp, Homo sapiens
aaagcctctgtgtcactggctgcc

SEQ ID NO: 5080350 - DNA, 16 bp, Homo sapiens
aaagcctctgttttga

SEQ ID NO: 5080351 - DNA, 20 bp, Homo sapiens
aaagcctgaaaattccaatt

SEQ ID NO: 5080352 - DNA, 13 bp, Homo sapiens
aaagcctgaaggg

SEQ ID NO: 5080353 - DNA, 22 bp, Homo sapiens
aaagcctgtaagcctgcaagcc

SEQ ID NO: 5080354 - DNA, 14 bp, Homo sapiens
aaagccttaaaaat

SEQ ID NO: 5080355 - DNA, 18 bp, Homo sapiens
aaagccttaaaatgcatt

SEQ ID NO: 5080356 - DNA, 18 bp, Homo sapiens
aaagccttaactaagact

SEQ ID NO: 5080357 - DNA, 17 bp, Homo sapiens
aaagccttaagaagata

SEQ ID NO: 5080358 - DNA, 20 bp, Homo sapiens
aaagccttaagaagataaat

SEQ ID NO: 5080359 - DNA, 22 bp, Homo sapiens
aaagccttaagcaaattttgta

SEQ ID NO: 5080360 - DNA, 19 bp, Homo sapiens
aaagccttagggaagctgg

SEQ ID NO: 5080361 - DNA, 17 bp, Homo sapiens
aaagccttccagttttg

SEQ ID NO: 5080362 - DNA, 22 bp, Homo sapiens
aaagccttcttatatctgaaga

SEQ ID NO: 5080363 - DNA, 23 bp, Homo sapiens
aaagccttgaagaaaatgacttt

SEQ ID NO: 5080364 - DNA, 11 bp, Homo sapiens
aaagccttgtg

SEQ ID NO: 5080365 - DNA, 18 bp, Homo sapiens
aaagccttgtgtatattt

SEQ ID NO: 5080366 - DNA, 23 bp, Homo sapiens
aaagccttgtgtatatttgtata

SEQ ID NO: 5080367 - DNA, 21 bp, Homo sapiens
aaagccttgtgtctacagaga

SEQ ID NO: 5080368 - DNA, 17 bp, Homo sapiens
aaagcctttaaaaccag

SEQ ID NO: 5080369 - DNA, 13 bp, Homo sapiens
aaagcctttaaat

SEQ ID NO: 5080370 - DNA, 19 bp, Homo sapiens
aaagcctttgtatctttct

SEQ ID NO: 5080371 - DNA, 18 bp, Homo sapiens
aaagccttttaaatcatc

SEQ ID NO: 5080372 - DNA, 23 bp, Homo sapiens
aaagccttttgctttatgcttga

SEQ ID NO: 5080373 - DNA, 19 bp, Homo sapiens
aaagcgacttcaggtcagg

SEQ ID NO: 5080374 - DNA, 18 bp, Homo sapiens
aaagcgctgcagtagctg

SEQ ID NO: 5080375 - DNA, 16 bp, Homo sapiens
aaagcgggaaggacat

SEQ ID NO: 5080376 - DNA, 16 bp, Homo sapiens
aaagcggggggagggt

SEQ ID NO: 5080377 - DNA, 18 bp, Homo sapiens
aaagcggggggagggttg

SEQ ID NO: 5080378 - DNA, 15 bp, Homo sapiens
aaagcggtccctgtc

SEQ ID NO: 5080379 - DNA, 22 bp, Homo sapiens
aaagcggtttaaccacattaat

SEQ ID NO: 5080380 - DNA, 19 bp, Homo sapiens
aaagcgtctttaagagact

SEQ ID NO: 5080381 - DNA, 20 bp, Homo sapiens
aaagcgtctttaagagactc

SEQ ID NO: 5080382 - DNA, 21 bp, Homo sapiens
aaagcgtgtgagtgagggaga

SEQ ID NO: 5080383 - DNA, 18 bp, Homo sapiens
aaagcgttggatgtagca

SEQ ID NO: 5080384 - DNA, 16 bp, Homo sapiens
aaagctaaaataaaga

SEQ ID NO: 5080385 - DNA, 16 bp, Homo sapiens
aaagctaaaatatata

SEQ ID NO: 5080386 - DNA, 17 bp, Homo sapiens
aaagctaaaatgatttt

SEQ ID NO: 5080387 - DNA, 14 bp, Homo sapiens
aaagctaaattttg

SEQ ID NO: 5080388 - DNA, 17 bp, Homo sapiens
aaagctaacatctttac

SEQ ID NO: 5080389 - DNA, 14 bp, Homo sapiens
aaagctaagtatag

SEQ ID NO: 5080390 - DNA, 19 bp, Homo sapiens
aaagctaatacaaaactat

SEQ ID NO: 5080391 - DNA, 15 bp, Homo sapiens
aaagctaatgtgcag

SEQ ID NO: 5080392 - DNA, 23 bp, Homo sapiens
aaagctaccttttttttacggaa

SEQ ID NO: 5080393 - DNA, 15 bp, Homo sapiens
aaagctactgaattt

SEQ ID NO: 5080394 - DNA, 20 bp, Homo sapiens
aaagctactgaatttattgc

SEQ ID NO: 5080395 - DNA, 12 bp, Homo sapiens
aaagctactgta

SEQ ID NO: 5080396 - DNA, 15 bp, Homo sapiens
aaagctactgtagaa

SEQ ID NO: 5080397 - DNA, 17 bp, Homo sapiens
aaagctacttattgtag

SEQ ID NO: 5080398 - DNA, 14 bp, Homo sapiens
aaagctagaaatga

SEQ ID NO: 5080399 - DNA, 20 bp, Homo sapiens
aaagctagaattgagtgttt

SEQ ID NO: 5080400 - DNA, 17 bp, Homo sapiens
aaagctagatatgcctt

SEQ ID NO: 5080401 - DNA, 17 bp, Homo sapiens
aaagctaggcctggcca

SEQ ID NO: 5080402 - DNA, 18 bp, Homo sapiens
aaagctaggcctggccag

SEQ ID NO: 5080403 - DNA, 19 bp, Homo sapiens
aaagctagtcaacagtacc

SEQ ID NO: 5080404 - DNA, 23 bp, Homo sapiens
aaagctagtgtacctcctctcag

SEQ ID NO: 5080405 - DNA, 18 bp, Homo sapiens
aaagctatatctatttga

SEQ ID NO: 5080406 - DNA, 12 bp, Homo sapiens
aaagctatctta

SEQ ID NO: 5080407 - DNA, 20 bp, Homo sapiens
aaagctatcttaaaatatag

SEQ ID NO: 5080408 - DNA, 15 bp, Homo sapiens
aaagctatggtgaga

SEQ ID NO: 5080409 - DNA, 18 bp, Homo sapiens
aaagctattagccaggat

SEQ ID NO: 5080410 - DNA, 15 bp, Homo sapiens
aaagctattggagat

SEQ ID NO: 5080411 - DNA, 15 bp, Homo sapiens
aaagctatttaagtg

SEQ ID NO: 5080412 - DNA, 17 bp, Homo sapiens
aaagctcaaaggtttgg

SEQ ID NO: 5080413 - DNA, 14 bp, Homo sapiens
aaagctcaaatgaa

SEQ ID NO: 5080414 - DNA, 18 bp, Homo sapiens
aaagctcaaatgaaatgt

SEQ ID NO: 5080415 - DNA, 15 bp, Homo sapiens
aaagctcactttact

SEQ ID NO: 5080416 - DNA, 12 bp, Homo sapiens
aaagctcagagt

SEQ ID NO: 5080417 - DNA, 12 bp, Homo sapiens
aaagctcaggag

SEQ ID NO: 5080418 - DNA, 13 bp, Homo sapiens
aaagctcaggagg

SEQ ID NO: 5080419 - DNA, 19 bp, Homo sapiens
aaagctccatgtgcctctt

SEQ ID NO: 5080420 - DNA, 22 bp, Homo sapiens
aaagctccatgtgcctctttgt

SEQ ID NO: 5080421 - DNA, 17 bp, Homo sapiens
aaagctcctagcagaga

SEQ ID NO: 5080422 - DNA, 20 bp, Homo sapiens
aaagctcctggggcgtccag

SEQ ID NO: 5080423 - DNA, 19 bp, Homo sapiens
aaagctctaaggtaacaaa

SEQ ID NO: 5080424 - DNA, 18 bp, Homo sapiens
aaagctctagataaaact

SEQ ID NO: 5080425 - DNA, 20 bp, Homo sapiens
aaagctctcaaatgtgacca

SEQ ID NO: 5080426 - DNA, 19 bp, Homo sapiens
aaagctctctttggaatga

SEQ ID NO: 5080427 - DNA, 20 bp, Homo sapiens
aaagctctctttggaatgaa

SEQ ID NO: 5080428 - DNA, 14 bp, Homo sapiens
aaagctctgaaaac

SEQ ID NO: 5080429 - DNA, 22 bp, Homo sapiens
aaagctctgaattcaggtccca

SEQ ID NO: 5080430 - DNA, 12 bp, Homo sapiens
aaagctctttaa

SEQ ID NO: 5080431 - DNA, 15 bp, Homo sapiens
aaagctgaaaactgc

SEQ ID NO: 5080432 - DNA, 14 bp, Homo sapiens
aaagctgaaaatgt

SEQ ID NO: 5080433 - DNA, 23 bp, Homo sapiens
aaagctgaacacatttcttttta

SEQ ID NO: 5080434 - DNA, 18 bp, Homo sapiens
aaagctgaatttatattt

SEQ ID NO: 5080435 - DNA, 23 bp, Homo sapiens
aaagctgagagaccctggcctca

SEQ ID NO: 5080436 - DNA, 21 bp, Homo sapiens
aaagctgatttttgtctttta

SEQ ID NO: 5080437 - DNA, 13 bp, Homo sapiens
aaagctgcatatg

SEQ ID NO: 5080438 - DNA, 17 bp, Homo sapiens
aaagctgcatttaaatc

SEQ ID NO: 5080439 - DNA, 19 bp, Homo sapiens
aaagctgcatttaaatcaa

SEQ ID NO: 5080440 - DNA, 24 bp, Homo sapiens
aaagctgcccactgtttctcttga

SEQ ID NO: 5080441 - DNA, 15 bp, Homo sapiens
aaagctgcctgtagt

SEQ ID NO: 5080442 - DNA, 21 bp, Homo sapiens
aaagctgcctgtagttaggaa

SEQ ID NO: 5080443 - DNA, 13 bp, Homo sapiens
aaagctgctgaca

SEQ ID NO: 5080444 - DNA, 11 bp, Homo sapiens
aaagctgctgg

SEQ ID NO: 5080445 - DNA, 15 bp, Homo sapiens
aaagctgcttgaatc

SEQ ID NO: 5080446 - DNA, 14 bp, Homo sapiens
aaagctgctttctt

SEQ ID NO: 5080447 - DNA, 17 bp, Homo sapiens
aaagctgctttcttctc

SEQ ID NO: 5080448 - DNA, 21 bp, Homo sapiens
aaagctgctttcttctctgcc

SEQ ID NO: 5080449 - DNA, 15 bp, Homo sapiens
aaagctggaacattt

SEQ ID NO: 5080450 - DNA, 18 bp, Homo sapiens
aaagctggaacatttgat

SEQ ID NO: 5080451 - DNA, 19 bp, Homo sapiens
aaagctggacaagaagctg

SEQ ID NO: 5080452 - DNA, 20 bp, Homo sapiens
aaagctggacaagaagctgc

SEQ ID NO: 5080453 - DNA, 14 bp, Homo sapiens
aaagctggactgac

SEQ ID NO: 5080454 - DNA, 15 bp, Homo sapiens
aaagctggactgacc

SEQ ID NO: 5080455 - DNA, 16 bp, Homo sapiens
aaagctggactgacca

SEQ ID NO: 5080456 - DNA, 13 bp, Homo sapiens
aaagctggccctg

SEQ ID NO: 5080457 - DNA, 17 bp, Homo sapiens
aaagctggccctgcctc

SEQ ID NO: 5080458 - DNA, 20 bp, Homo sapiens
aaagctggccctgcctcctg

SEQ ID NO: 5080459 - DNA, 21 bp, Homo sapiens
aaagctgggaagaccctttca

SEQ ID NO: 5080460 - DNA, 23 bp, Homo sapiens
aaagctggtgggtgaaagaaatc

SEQ ID NO: 5080461 - DNA, 15 bp, Homo sapiens
aaagctggtttaatg

SEQ ID NO: 5080462 - DNA, 16 bp, Homo sapiens
aaagctggtttaatgt

SEQ ID NO: 5080463 - DNA, 15 bp, Homo sapiens
aaagctgtattttga

SEQ ID NO: 5080464 - DNA, 17 bp, Homo sapiens
aaagctgtattttgaaa

SEQ ID NO: 5080465 - DNA, 21 bp, Homo sapiens
aaagctgtgacagttctgttg

SEQ ID NO: 5080466 - DNA, 12 bp, Homo sapiens
aaagctgtgagc

SEQ ID NO: 5080467 - DNA, 23 bp, Homo sapiens
aaagctgtggccagcttgttatt

SEQ ID NO: 5080468 - DNA, 22 bp, Homo sapiens
aaagctgtggctcaacacatga

SEQ ID NO: 5080469 - DNA, 14 bp, Homo sapiens
aaagctgtgtggca

SEQ ID NO: 5080470 - DNA, 17 bp, Homo sapiens
aaagctgttaaaataca

SEQ ID NO: 5080471 - DNA, 22 bp, Homo sapiens
aaagctgttaaaatacataact

SEQ ID NO: 5080472 - DNA, 18 bp, Homo sapiens
aaagctgttaaactgtta

SEQ ID NO: 5080473 - DNA, 23 bp, Homo sapiens
aaagctgttaaactgttagcact

SEQ ID NO: 5080474 - DNA, 18 bp, Homo sapiens
aaagctgttattcttgtt

SEQ ID NO: 5080475 - DNA, 19 bp, Homo sapiens
aaagctgttattcttgtta

SEQ ID NO: 5080476 - DNA, 21 bp, Homo sapiens
aaaggttgagtatgtgaagat

SEQ ID NO: 5080477 - DNA, 17 bp, Homo sapiens
aaaggttgagttttcca

SEQ ID NO: 5080478 - DNA, 21 bp, Homo sapiens
aaaggtttaaatgaacaagag

SEQ ID NO: 5080479 - DNA, 22 bp, Homo sapiens
aaaggtttcactgttcatgaat

SEQ ID NO: 5080480 - DNA, 19 bp, Homo sapiens
aaaggtttggaaaactaac

SEQ ID NO: 5080481 - DNA, 21 bp, Homo sapiens
aaaggtttggaaggagcagaa

SEQ ID NO: 5080482 - DNA, 18 bp, Homo sapiens
aaaggttttattttgtaa

SEQ ID NO: 5080483 - DNA, 12 bp, Homo sapiens
aaaggttttgta

SEQ ID NO: 5080484 - DNA, 13 bp, Homo sapiens
aaaggttttgtat

SEQ ID NO: 5080485 - DNA, 14 bp, Homo sapiens
aaaggttttgtatt

SEQ ID NO: 5080486 - DNA, 18 bp, Homo sapiens
aaaggttttttttcagtt

SEQ ID NO: 5080487 - DNA, 13 bp, Homo sapiens
aaagtaaaaccat

SEQ ID NO: 5080488 - DNA, 12 bp, Homo sapiens
aaagtaaaagag

SEQ ID NO: 5080489 - DNA, 21 bp, Homo sapiens
aaagtaaaagttatatctaac

SEQ ID NO: 5080490 - DNA, 14 bp, Homo sapiens
aaagtaaaatgtct

SEQ ID NO: 5080491 - DNA, 16 bp, Homo sapiens
aaagtaaaattagagc

SEQ ID NO: 5080492 - DNA, 13 bp, Homo sapiens
aaagtaaagctaa

SEQ ID NO: 5080493 - DNA, 22 bp, Homo sapiens
aaagtaaaggcctcatctcctt

SEQ ID NO: 5080494 - DNA, 15 bp, Homo sapiens
aaagtaaatacaaga

SEQ ID NO: 5080495 - DNA, 18 bp, Homo sapiens
aaagtaaatacatgcata

SEQ ID NO: 5080496 - DNA, 20 bp, Homo sapiens
aaagtaaatgctacctctga

SEQ ID NO: 5080497 - DNA, 13 bp, Homo sapiens
aaagtaacacacc

SEQ ID NO: 5080498 - DNA, 12 bp, Homo sapiens
aaagtaacattt

SEQ ID NO: 5080499 - DNA, 14 bp, Homo sapiens
aaagtaactcattt

SEQ ID NO: 5080500 - DNA, 15 bp, Homo sapiens
aaagtaactcatttg

SEQ ID NO: 5080501 - DNA, 21 bp, Homo sapiens
aaagtaagggaataaattttt

SEQ ID NO: 5080502 - DNA, 13 bp, Homo sapiens
aaagtaagtcttt

SEQ ID NO: 5080503 - DNA, 22 bp, Homo sapiens
aaagtaagtggagcatttggaa

SEQ ID NO: 5080504 - DNA, 12 bp, Homo sapiens
aaagtaagttaa

SEQ ID NO: 5080505 - DNA, 15 bp, Homo sapiens
aaagtaagttaataa

SEQ ID NO: 5080506 - DNA, 17 bp, Homo sapiens
aaagtaagttaataatg

SEQ ID NO: 5080507 - DNA, 18 bp, Homo sapiens
aaagtaagttaataatgt

SEQ ID NO: 5080508 - DNA, 12 bp, Homo sapiens
aaagtaataaat

SEQ ID NO: 5080509 - DNA, 18 bp, Homo sapiens
aaagtaataactgttaga

SEQ ID NO: 5080510 - DNA, 23 bp, Homo sapiens
aaagtaatagtaaaatgcttaca

SEQ ID NO: 5080511 - DNA, 16 bp, Homo sapiens
aaagtaatctttaaac

SEQ ID NO: 5080512 - DNA, 21 bp, Homo sapiens
aaagtaatgacttagaaactg

SEQ ID NO: 5080513 - DNA, 16 bp, Homo sapiens
aaagtaatgatttctt

SEQ ID NO: 5080514 - DNA, 13 bp, Homo sapiens
aaagtaatgtaaa

SEQ ID NO: 5080515 - DNA, 22 bp, Homo sapiens
aaagtaatttcaagaatgtttc

SEQ ID NO: 5080516 - DNA, 18 bp, Homo sapiens
aaagtaatttctaaagca

SEQ ID NO: 5080517 - DNA, 22 bp, Homo sapiens
aaagtaatttggaaattaggtt

SEQ ID NO: 5080518 - DNA, 15 bp, Homo sapiens
aaagtaattttgtca

SEQ ID NO: 5080519 - DNA, 13 bp, Homo sapiens
aaagtacaaaatt

SEQ ID NO: 5080520 - DNA, 18 bp, Homo sapiens
aaagtacaaagcatattt

SEQ ID NO: 5080521 - DNA, 16 bp, Homo sapiens
aaagtacaatgtgttt

SEQ ID NO: 5080522 - DNA, 18 bp, Homo sapiens
aaagtacactgtttcaaa

SEQ ID NO: 5080523 - DNA, 21 bp, Homo sapiens
aaagtacagaaaaatactttg

SEQ ID NO: 5080524 - DNA, 16 bp, Homo sapiens
aaagtacagaacatat

SEQ ID NO: 5080525 - DNA, 13 bp, Homo sapiens
aaagtacagaatt

SEQ ID NO: 5080526 - DNA, 15 bp, Homo sapiens
aaagtacagaatttg

SEQ ID NO: 5080527 - DNA, 18 bp, Homo sapiens
aaagtacaggtactttgt

SEQ ID NO: 5080528 - DNA, 18 bp, Homo sapiens
aaagtacatagtgaattt

SEQ ID NO: 5080529 - DNA, 22 bp, Homo sapiens
aaagtacattctggggaaacaa

SEQ ID NO: 5080530 - DNA, 15 bp, Homo sapiens
aaagtacattgctta

SEQ ID NO: 5080531 - DNA, 15 bp, Homo sapiens
aaagtacattttttg

SEQ ID NO: 5080532 - DNA, 18 bp, Homo sapiens
aaagtaccacactgagtt

SEQ ID NO: 5080533 - DNA, 19 bp, Homo sapiens
aaagtaccacattccatga

SEQ ID NO: 5080534 - DNA, 18 bp, Homo sapiens
aaagtacctattgaacat

SEQ ID NO: 5080535 - DNA, 15 bp, Homo sapiens
aaagtacctttatgt

SEQ ID NO: 5080536 - DNA, 17 bp, Homo sapiens
aaagtactactgtagaa

SEQ ID NO: 5080537 - DNA, 12 bp, Homo sapiens
aaagtactgtaa

SEQ ID NO: 5080538 - DNA, 19 bp, Homo sapiens
aaagtacttctccaccctg

SEQ ID NO: 5080539 - DNA, 23 bp, Homo sapiens
aaagtacttctccaccctgctct

SEQ ID NO: 5080540 - DNA, 18 bp, Homo sapiens
aaagtacttgagtgtaat

SEQ ID NO: 5080541 - DNA, 14 bp, Homo sapiens
aaagtacttgtagt

SEQ ID NO: 5080542 - DNA, 16 bp, Homo sapiens
aaagtacttgtagttc

SEQ ID NO: 5080543 - DNA, 17 bp, Homo sapiens
aaagtagaactttgtat

SEQ ID NO: 5080544 - DNA, 18 bp, Homo sapiens
aaagtagaactttgtata

SEQ ID NO: 5080545 - DNA, 21 bp, Homo sapiens
aaagtagaactttgtatagtt

SEQ ID NO: 5080546 - DNA, 23 bp, Homo sapiens
aaagtagaactttgtatagttat

SEQ ID NO: 5080547 - DNA, 17 bp, Homo sapiens
aaagtagaattatatct

SEQ ID NO: 5080548 - DNA, 20 bp, Homo sapiens
aaagtagaattatatctaat

SEQ ID NO: 5080549 - DNA, 21 bp, Homo sapiens
aaagtagaattatatctaatt

SEQ ID NO: 5080550 - DNA, 22 bp, Homo sapiens
aaagtagaattatatctaattt

SEQ ID NO: 5080551 - DNA, 15 bp, Homo sapiens
aaagtagagaagtat

SEQ ID NO: 5080552 - DNA, 20 bp, Homo sapiens
aaagtagagaagtatccaat

SEQ ID NO: 5080553 - DNA, 23 bp, Homo sapiens
aaagtagattatggcctttttaa

SEQ ID NO: 5080554 - DNA, 15 bp, Homo sapiens
aaagtagattcatga

SEQ ID NO: 5080555 - DNA, 15 bp, Homo sapiens
aaagtagcaaaacaa

SEQ ID NO: 5080556 - DNA, 18 bp, Homo sapiens
aaagtagcaccaaataaa

SEQ ID NO: 5080557 - DNA, 20 bp, Homo sapiens
aaagtaggaactcttaagca

SEQ ID NO: 5080558 - DNA, 15 bp, Homo sapiens
aaagtaggattttga

SEQ ID NO: 5080559 - DNA, 18 bp, Homo sapiens
aaagtagggaagttttat

SEQ ID NO: 5080560 - DNA, 18 bp, Homo sapiens
aaagtagggatgcggatc

SEQ ID NO: 5080561 - DNA, 22 bp, Homo sapiens
aaagtagtcccccaaattaaca

SEQ ID NO: 5080562 - DNA, 22 bp, Homo sapiens
aaagtagtgcttattgtttgca

SEQ ID NO: 5080563 - DNA, 18 bp, Homo sapiens
aaagtagtgttgtccagg

SEQ ID NO: 5080564 - DNA, 13 bp, Homo sapiens
aaagtagttagtt

SEQ ID NO: 5080565 - DNA, 17 bp, Homo sapiens
aaagtagttattttata

SEQ ID NO: 5080566 - DNA, 11 bp, Homo sapiens
aaagtataatc

SEQ ID NO: 5080567 - DNA, 13 bp, Homo sapiens
aaagtataatgtt

SEQ ID NO: 5080568 - DNA, 14 bp, Homo sapiens
aaagtataatgttt

SEQ ID NO: 5080569 - DNA, 16 bp, Homo sapiens
aaagtataatgtttat

SEQ ID NO: 5080570 - DNA, 14 bp, Homo sapiens
aaagtataatttca

SEQ ID NO: 5080571 - DNA, 16 bp, Homo sapiens
aaagtatacttttgtt

SEQ ID NO: 5080572 - DNA, 22 bp, Homo sapiens
aaagtatacttttgtttcaggg

SEQ ID NO: 5080573 - DNA, 17 bp, Homo sapiens
aaagtatagagagaagt

SEQ ID NO: 5080574 - DNA, 18 bp, Homo sapiens
aaagtatatatagaatct

SEQ ID NO: 5080575 - DNA, 13 bp, Homo sapiens
aaagtatattcaa

SEQ ID NO: 5080576 - DNA, 21 bp, Homo sapiens
aaagtatcactctaaaaaaca

SEQ ID NO: 5080577 - DNA, 13 bp, Homo sapiens
aaagtatcacttt

SEQ ID NO: 5080578 - DNA, 16 bp, Homo sapiens
aaagtatcaggaatat

SEQ ID NO: 5080579 - DNA, 14 bp, Homo sapiens
aaagtatcatgcat

SEQ ID NO: 5080580 - DNA, 19 bp, Homo sapiens
aaagtatcgggggctgggg

SEQ ID NO: 5080581 - DNA, 13 bp, Homo sapiens
aaagtatctttaa

SEQ ID NO: 5080582 - DNA, 22 bp, Homo sapiens
aaagtatgaatatttcattttg

SEQ ID NO: 5080583 - DNA, 15 bp, Homo sapiens
aaagtatgcaaaata

SEQ ID NO: 5080584 - DNA, 20 bp, Homo sapiens
aaagtatgcaaaataaagaa

SEQ ID NO: 5080585 - DNA, 14 bp, Homo sapiens
aaagtatgcattat

SEQ ID NO: 5080586 - DNA, 23 bp, Homo sapiens
aaagtatgccaggggagtatgta

SEQ ID NO: 5080587 - DNA, 20 bp, Homo sapiens
aaagtatgtaaagtatgtaa

SEQ ID NO: 5080588 - DNA, 12 bp, Homo sapiens
aaagtatgttct

SEQ ID NO: 5080589 - DNA, 13 bp, Homo sapiens
aaagtatgttgta

SEQ ID NO: 5080590 - DNA, 16 bp, Homo sapiens
aaagtatgttgtatat

SEQ ID NO: 5080591 - DNA, 16 bp, Homo sapiens
aaagtatgttttactt

SEQ ID NO: 5080592 - DNA, 15 bp, Homo sapiens
aaagtattaaaatgc

SEQ ID NO: 5080593 - DNA, 19 bp, Homo sapiens
aaagtattaagcatatatt

SEQ ID NO: 5080594 - DNA, 17 bp, Homo sapiens
aaagtattatcattgct

SEQ ID NO: 5080595 - DNA, 15 bp, Homo sapiens
aaagtattattttcc

SEQ ID NO: 5080596 - DNA, 21 bp, Homo sapiens
aaagtattcaacaatttcaat

SEQ ID NO: 5080597 - DNA, 13 bp, Homo sapiens
aaagtattcagaa

SEQ ID NO: 5080598 - DNA, 18 bp, Homo sapiens
aaagtattcagaaattaa

SEQ ID NO: 5080599 - DNA, 22 bp, Homo sapiens
aaagtattcagaaattaaaata

SEQ ID NO: 5080600 - DNA, 14 bp, Homo sapiens
aaagtattccacct

SEQ ID NO: 5080601 - DNA, 14 bp, Homo sapiens
aaagtattctccat

SEQ ID NO: 5080602 - DNA, 18 bp, Homo sapiens
aaagtattgccaaacatt

SEQ ID NO: 5080603 - DNA, 19 bp, Homo sapiens
aaagtattgccaaacatta

SEQ ID NO: 5080604 - DNA, 15 bp, Homo sapiens
aaagtattggttact

SEQ ID NO: 5080605 - DNA, 21 bp, Homo sapiens
aaagtattgtaaattatattt

SEQ ID NO: 5080606 - DNA, 20 bp, Homo sapiens
aaagtattgtaatgagtgaa

SEQ ID NO: 5080607 - DNA, 14 bp, Homo sapiens
aaagtatttaaaga

SEQ ID NO: 5080608 - DNA, 17 bp, Homo sapiens
aaagtatttaattagtg

SEQ ID NO: 5080609 - DNA, 15 bp, Homo sapiens
aaagtatttactttt

SEQ ID NO: 5080610 - DNA, 18 bp, Homo sapiens
aaagtatttactttttaa

SEQ ID NO: 5080611 - DNA, 22 bp, Homo sapiens
aaagtatttataaaaatataaa

SEQ ID NO: 5080612 - DNA, 15 bp, Homo sapiens
aaagtatttatctcc

SEQ ID NO: 5080613 - DNA, 18 bp, Homo sapiens
aaagtattttaattttaa

SEQ ID NO: 5080614 - DNA, 21 bp, Homo sapiens
aaagtattttcctgtaaaaaa

SEQ ID NO: 5080615 - DNA, 12 bp, Homo sapiens
aaagtattttga

SEQ ID NO: 5080616 - DNA, 13 bp, Homo sapiens
aaagtattttgaa

SEQ ID NO: 5080617 - DNA, 17 bp, Homo sapiens
aaagtattttgaagttt

SEQ ID NO: 5080618 - DNA, 23 bp, Homo sapiens
aaagtattttgaagtttacattt

SEQ ID NO: 5080619 - DNA, 15 bp, Homo sapiens
aaagtatttttataa

SEQ ID NO: 5080620 - DNA, 20 bp, Homo sapiens
aaagtatttttataatgact

SEQ ID NO: 5080621 - DNA, 22 bp, Homo sapiens
aaagtcaaacgactaacctatc

SEQ ID NO: 5080622 - DNA, 15 bp, Homo sapiens
aaagtcaaatgccaa

SEQ ID NO: 5080623 - DNA, 23 bp, Homo sapiens
aaagtcaataaaagagctgtctg

SEQ ID NO: 5080624 - DNA, 16 bp, Homo sapiens
aaagtcaatgtacttg

SEQ ID NO: 5080625 - DNA, 18 bp, Homo sapiens
aaagtcaatgttttcagt

SEQ ID NO: 5080626 - DNA, 18 bp, Homo sapiens
aaagtcacaatgttcttt

SEQ ID NO: 5080627 - DNA, 20 bp, Homo sapiens
aaagtcacaatgttctttat

SEQ ID NO: 5080628 - DNA, 17 bp, Homo sapiens
aaagtcacacatttcta

SEQ ID NO: 5080629 - DNA, 20 bp, Homo sapiens
aaagtcacatataaaagtta

SEQ ID NO: 5080630 - DNA, 21 bp, Homo sapiens
aaagtcaccattctgcattta

SEQ ID NO: 5080631 - DNA, 16 bp, Homo sapiens
aaagtcacctacagga

SEQ ID NO: 5080632 - DNA, 20 bp, Homo sapiens
aaagtcagaccctaggaagc

SEQ ID NO: 5080633 - DNA, 15 bp, Homo sapiens
aaagtcagagacaga

SEQ ID NO: 5080634 - DNA, 18 bp, Homo sapiens
aaagtcagagacagatac

SEQ ID NO: 5080635 - DNA, 23 bp, Homo sapiens
aaagtcagagttaaaatatatat

SEQ ID NO: 5080636 - DNA, 14 bp, Homo sapiens
aaagtcagctacaa

SEQ ID NO: 5080637 - DNA, 17 bp, Homo sapiens
aaagtcaggccattcag

SEQ ID NO: 5080638 - DNA, 23 bp, Homo sapiens
aaagtcagttgctcaaaaagaaa

SEQ ID NO: 5080639 - DNA, 12 bp, Homo sapiens
aaagtcataaat

SEQ ID NO: 5080640 - DNA, 17 bp, Homo sapiens
aaagtcataattgcatt

SEQ ID NO: 5080641 - DNA, 20 bp, Homo sapiens
aaagtcatcccctctcagga

SEQ ID NO: 5080642 - DNA, 22 bp, Homo sapiens
aaagtcatcccctctcaggaga

SEQ ID NO: 5080643 - DNA, 15 bp, Homo sapiens
aaagtcatgaagctc

SEQ ID NO: 5080644 - DNA, 20 bp, Homo sapiens
aaagtcatgcaaaggctggg

SEQ ID NO: 5080645 - DNA, 14 bp, Homo sapiens
aaagtcatgtcaga

SEQ ID NO: 5080646 - DNA, 17 bp, Homo sapiens
aaagtcattaaagacag

SEQ ID NO: 5080647 - DNA, 16 bp, Homo sapiens
aaagtcatttgtgaaa

SEQ ID NO: 5080648 - DNA, 23 bp, Homo sapiens
aaagtccaagccgtaggacccag

SEQ ID NO: 5080649 - DNA, 20 bp, Homo sapiens
aaagtccaattttaatttag

SEQ ID NO: 5080650 - DNA, 15 bp, Homo sapiens
aaagtcccccctcgc

SEQ ID NO: 5080651 - DNA, 13 bp, Homo sapiens
aaagtccctccct

SEQ ID NO: 5080652 - DNA, 19 bp, Homo sapiens
aaagtccctccctgcctga

SEQ ID NO: 5080653 - DNA, 15 bp, Homo sapiens
aaagtcccttcctgc

SEQ ID NO: 5080654 - DNA, 17 bp, Homo sapiens
aaagtccgaaaagcaaa

SEQ ID NO: 5080655 - DNA, 12 bp, Homo sapiens
aaagctgttctt

SEQ ID NO: 5080656 - DNA, 15 bp, Homo sapiens
aaagctgtttcattt

SEQ ID NO: 5080657 - DNA, 18 bp, Homo sapiens
aaagctgtttcatttgtg

SEQ ID NO: 5080658 - DNA, 19 bp, Homo sapiens
aaagctgtttcatttgtgt

SEQ ID NO: 5080659 - DNA, 19 bp, Homo sapiens
aaagcttaaattgcttttg

SEQ ID NO: 5080660 - DNA, 19 bp, Homo sapiens
aaagcttacccttggtttg

SEQ ID NO: 5080661 - DNA, 14 bp, Homo sapiens
aaagcttatagaat

SEQ ID NO: 5080662 - DNA, 20 bp, Homo sapiens
aaagcttatccataaaaaaa

SEQ ID NO: 5080663 - DNA, 15 bp, Homo sapiens
aaagcttcaaaaact

SEQ ID NO: 5080664 - DNA, 20 bp, Homo sapiens
aaagcttcaaattatagaaa

SEQ ID NO: 5080665 - DNA, 13 bp, Homo sapiens
aaagcttctaaag

SEQ ID NO: 5080666 - DNA, 19 bp, Homo sapiens
aaagcttctatcccaggag

SEQ ID NO: 5080667 - DNA, 21 bp, Homo sapiens
aaagcttctatcccaggaggt

SEQ ID NO: 5080668 - DNA, 14 bp, Homo sapiens
aaagcttctctctg

SEQ ID NO: 5080669 - DNA, 12 bp, Homo sapiens
aaagcttctgtg

SEQ ID NO: 5080670 - DNA, 20 bp, Homo sapiens
aaagcttcttaattaatttg

SEQ ID NO: 5080671 - DNA, 20 bp, Homo sapiens
aaagcttgaagatcgttagt

SEQ ID NO: 5080672 - DNA, 22 bp, Homo sapiens
aaagcttgatttgatctttgtt

SEQ ID NO: 5080673 - DNA, 23 bp, Homo sapiens
aaagcttgtggccccttttactt

SEQ ID NO: 5080674 - DNA, 13 bp, Homo sapiens
aaagcttgtgtat

SEQ ID NO: 5080675 - DNA, 14 bp, Homo sapiens
aaagcttgtgtatc

SEQ ID NO: 5080676 - DNA, 15 bp, Homo sapiens
aaagcttgttaagat

SEQ ID NO: 5080677 - DNA, 20 bp, Homo sapiens
aaagctttaaaaaataaagc

SEQ ID NO: 5080678 - DNA, 15 bp, Homo sapiens
aaagctttactactg

SEQ ID NO: 5080679 - DNA, 16 bp, Homo sapiens
aaagctttactactgt

SEQ ID NO: 5080680 - DNA, 15 bp, Homo sapiens
aaagctttagattga

SEQ ID NO: 5080681 - DNA, 18 bp, Homo sapiens
aaagctttagattgaaat

SEQ ID NO: 5080682 - DNA, 11 bp, Homo sapiens
aaagctttata

SEQ ID NO: 5080683 - DNA, 16 bp, Homo sapiens
aaagctttatctttgt

SEQ ID NO: 5080684 - DNA, 19 bp, Homo sapiens
aaagctttatctttgtgta

SEQ ID NO: 5080685 - DNA, 13 bp, Homo sapiens
aaagctttatgat

SEQ ID NO: 5080686 - DNA, 21 bp, Homo sapiens
aaagctttatgattttcataa

SEQ ID NO: 5080687 - DNA, 13 bp, Homo sapiens
aaagctttcagaa

SEQ ID NO: 5080688 - DNA, 13 bp, Homo sapiens
aaagctttccccc

SEQ ID NO: 5080689 - DNA, 12 bp, Homo sapiens
aaagctttcctg

SEQ ID NO: 5080690 - DNA, 14 bp, Homo sapiens
aaagctttcctgga

SEQ ID NO: 5080691 - DNA, 13 bp, Homo sapiens
aaagctttgctac

SEQ ID NO: 5080692 - DNA, 16 bp, Homo sapiens
aaagctttgctacaaa

SEQ ID NO: 5080693 - DNA, 21 bp, Homo sapiens
aaagctttgcttatggtaata

SEQ ID NO: 5080694 - DNA, 19 bp, Homo sapiens
aaagctttggaaaaatctt

SEQ ID NO: 5080695 - DNA, 14 bp, Homo sapiens
aaagctttgtttgt

SEQ ID NO: 5080696 - DNA, 15 bp, Homo sapiens
aaagcttttagaaat

SEQ ID NO: 5080697 - DNA, 16 bp, Homo sapiens
aaagcttttattcctt

SEQ ID NO: 5080698 - DNA, 14 bp, Homo sapiens
aaagcttttctttt

SEQ ID NO: 5080699 - DNA, 13 bp, Homo sapiens
aaagcttttgcat

SEQ ID NO: 5080700 - DNA, 13 bp, Homo sapiens
aaagctttttgaa

SEQ ID NO: 5080701 - DNA, 11 bp, Homo sapiens
aaaggaaaaaa

SEQ ID NO: 5080702 - DNA, 15 bp, Homo sapiens
aaaggaaaaaagaaa

SEQ ID NO: 5080703 - DNA, 19 bp, Homo sapiens
aaaggaaaaagcacaagaa

SEQ ID NO: 5080704 - DNA, 21 bp, Homo sapiens
aaaggaaaaagtatcatggaa

SEQ ID NO: 5080705 - DNA, 19 bp, Homo sapiens
aaaggaaaaatttttttgt

SEQ ID NO: 5080706 - DNA, 21 bp, Homo sapiens
aaaggaaaacacctttatttt

SEQ ID NO: 5080707 - DNA, 13 bp, Homo sapiens
aaaggaaaagaaa

SEQ ID NO: 5080708 - DNA, 15 bp, Homo sapiens
aaaggaaaagaaaaa

SEQ ID NO: 5080709 - DNA, 23 bp, Homo sapiens
aaaggaaaaggttgttgttaatg

SEQ ID NO: 5080710 - DNA, 20 bp, Homo sapiens
aaaggaaacaaactctcaaa

SEQ ID NO: 5080711 - DNA, 15 bp, Homo sapiens
aaaggaaacaagctt

SEQ ID NO: 5080712 - DNA, 22 bp, Homo sapiens
aaaggaaacactaaggctgctt

SEQ ID NO: 5080713 - DNA, 13 bp, Homo sapiens
aaaggaaaccttt

SEQ ID NO: 5080714 - DNA, 22 bp, Homo sapiens
aaaggaaacttcagttgatctt

SEQ ID NO: 5080715 - DNA, 22 bp, Homo sapiens
aaaggaaagagggaggtaagga

SEQ ID NO: 5080716 - DNA, 18 bp, Homo sapiens
aaaggaaagctgtgttta

SEQ ID NO: 5080717 - DNA, 20 bp, Homo sapiens
aaaggaaagtcaagaagaat

SEQ ID NO: 5080718 - DNA, 15 bp, Homo sapiens
aaaggaaataattgc

SEQ ID NO: 5080719 - DNA, 19 bp, Homo sapiens
aaaggaaatatttttcaac

SEQ ID NO: 5080720 - DNA, 22 bp, Homo sapiens
aaaggaaattggacagttttga

SEQ ID NO: 5080721 - DNA, 12 bp, Homo sapiens
aaaggaaatttg

SEQ ID NO: 5080722 - DNA, 13 bp, Homo sapiens
aaaggaaatttgt

SEQ ID NO: 5080723 - DNA, 22 bp, Homo sapiens
aaaggaacaagactgactgggc

SEQ ID NO: 5080724 - DNA, 17 bp, Homo sapiens
aaaggaacacccggaaa

SEQ ID NO: 5080725 - DNA, 14 bp, Homo sapiens
aaaggaacactgac

SEQ ID NO: 5080726 - DNA, 12 bp, Homo sapiens
aaaggaacagaa

SEQ ID NO: 5080727 - DNA, 13 bp, Homo sapiens
aaaggaacaggct

SEQ ID NO: 5080728 - DNA, 12 bp, Homo sapiens
aaaggaacattt

SEQ ID NO: 5080729 - DNA, 17 bp, Homo sapiens
aaaggaacggcttcctc

SEQ ID NO: 5080730 - DNA, 16 bp, Homo sapiens
aaaggaagacagttct

SEQ ID NO: 5080731 - DNA, 16 bp, Homo sapiens
aaaggaagatgttctg

SEQ ID NO: 5080732 - DNA, 17 bp, Homo sapiens
aaaggaagatgttctgt

SEQ ID NO: 5080733 - DNA, 14 bp, Homo sapiens
aaaggaagccaaag

SEQ ID NO: 5080734 - DNA, 13 bp, Homo sapiens
aaaggaaggacca

SEQ ID NO: 5080735 - DNA, 19 bp, Homo sapiens
aaaggaagtagcaggccca

SEQ ID NO: 5080736 - DNA, 18 bp, Homo sapiens
aaaggaagtgccccctcc

SEQ ID NO: 5080737 - DNA, 14 bp, Homo sapiens
aaaggaagtgggga

SEQ ID NO: 5080738 - DNA, 16 bp, Homo sapiens
aaaggaataggtagga

SEQ ID NO: 5080739 - DNA, 19 bp, Homo sapiens
aaaggaataggtaggagac

SEQ ID NO: 5080740 - DNA, 20 bp, Homo sapiens
aaaggaatgaacttgttact

SEQ ID NO: 5080741 - DNA, 19 bp, Homo sapiens
aaaggaatgcaaagatgaa

SEQ ID NO: 5080742 - DNA, 14 bp, Homo sapiens
aaaggaatgcaaga

SEQ ID NO: 5080743 - DNA, 15 bp, Homo sapiens
aaaggaatggaggct

SEQ ID NO: 5080744 - DNA, 22 bp, Homo sapiens
aaaggaatgtgaaatttaaata

SEQ ID NO: 5080745 - DNA, 14 bp, Homo sapiens
aaaggaatgtgtaa

SEQ ID NO: 5080746 - DNA, 23 bp, Homo sapiens
aaaggaattggcatgtgtatgtt

SEQ ID NO: 5080747 - DNA, 13 bp, Homo sapiens
aaaggacaaacag

SEQ ID NO: 5080748 - DNA, 21 bp, Homo sapiens
aaaggacaaataaaacatggc

SEQ ID NO: 5080749 - DNA, 15 bp, Homo sapiens
aaaggacactggatc

SEQ ID NO: 5080750 - DNA, 14 bp, Homo sapiens
aaaggacaggagga

SEQ ID NO: 5080751 - DNA, 24 bp, Homo sapiens
aaaggacaggaggaggagatggcc

SEQ ID NO: 5080752 - DNA, 17 bp, Homo sapiens
aaaggacaggcagaaag

SEQ ID NO: 5080753 - DNA, 20 bp, Homo sapiens
aaaggacatgaacagacact

SEQ ID NO: 5080754 - DNA, 21 bp, Homo sapiens
aaaggacatgaacagacactt

SEQ ID NO: 5080755 - DNA, 15 bp, Homo sapiens
aaaggacattatgtg

SEQ ID NO: 5080756 - DNA, 17 bp, Homo sapiens
aaaggaccctgtttctg

SEQ ID NO: 5080757 - DNA, 22 bp, Homo sapiens
aaaggactaacataaaatctgt

SEQ ID NO: 5080758 - DNA, 15 bp, Homo sapiens
aaaggactattatgt

SEQ ID NO: 5080759 - DNA, 21 bp, Homo sapiens
aaaggactcctgaaaaaaaac

SEQ ID NO: 5080760 - DNA, 24 bp, Homo sapiens
aaaggactcttccatcagagatgg

SEQ ID NO: 5080761 - DNA, 18 bp, Homo sapiens
aaaggactgtaagcagat

SEQ ID NO: 5080762 - DNA, 13 bp, Homo sapiens
aaaggactgtgat

SEQ ID NO: 5080763 - DNA, 14 bp, Homo sapiens
aaaggactttgtgt

SEQ ID NO: 5080764 - DNA, 12 bp, Homo sapiens
aaaggagaaaaa

SEQ ID NO: 5080765 - DNA, 16 bp, Homo sapiens
aaaggagaactgtgct

SEQ ID NO: 5080766 - DNA, 20 bp, Homo sapiens
aaaggagacaagttccatgg

SEQ ID NO: 5080767 - DNA, 22 bp, Homo sapiens
aaaggagagactcccatgaagc

SEQ ID NO: 5080768 - DNA, 17 bp, Homo sapiens
aaaggagagctagcagc

SEQ ID NO: 5080769 - DNA, 17 bp, Homo sapiens
aaaggagattctttgag

SEQ ID NO: 5080770 - DNA, 16 bp, Homo sapiens
aaaggagcaagaactt

SEQ ID NO: 5080771 - DNA, 22 bp, Homo sapiens
aaaggagcatttttttattcag

SEQ ID NO: 5080772 - DNA, 23 bp, Homo sapiens
aaaggagcatttttttattcagc

SEQ ID NO: 5080773 - DNA, 19 bp, Homo sapiens
aaaggagcccttatctgtg

SEQ ID NO: 5080774 - DNA, 23 bp, Homo sapiens
aaaggagcccttatctgtgctca

SEQ ID NO: 5080775 - DNA, 23 bp, Homo sapiens
aaaggagcctgtgaacccaggac

SEQ ID NO: 5080776 - DNA, 16 bp, Homo sapiens
aaaggagcgggcaggg

SEQ ID NO: 5080777 - DNA, 22 bp, Homo sapiens
aaaggagctcttcttgtgaaat

SEQ ID NO: 5080778 - DNA, 18 bp, Homo sapiens
aaaggaggcatgcctctg

SEQ ID NO: 5080779 - DNA, 22 bp, Homo sapiens
aaaggaggccctgttccctgga

SEQ ID NO: 5080780 - DNA, 13 bp, Homo sapiens
aaaggaggctggc

SEQ ID NO: 5080781 - DNA, 18 bp, Homo sapiens
aaaggagtgagtgaaact

SEQ ID NO: 5080782 - DNA, 24 bp, Homo sapiens
aaaggagtttctttagctgacaga

SEQ ID NO: 5080783 - DNA, 20 bp, Homo sapiens
aaaggataaacttttagaaa

SEQ ID NO: 5080784 - DNA, 18 bp, Homo sapiens
aaaggataactctgtatt

SEQ ID NO: 5080785 - DNA, 14 bp, Homo sapiens
aaaggataggaaaa

SEQ ID NO: 5080786 - DNA, 15 bp, Homo sapiens
aaaggataggaaaag

SEQ ID NO: 5080787 - DNA, 21 bp, Homo sapiens
aaaggatagtaagcatagaaa

SEQ ID NO: 5080788 - DNA, 17 bp, Homo sapiens
aaaggatataaaaggat

SEQ ID NO: 5080789 - DNA, 23 bp, Homo sapiens
aaaggatataaaaggatgttaca

SEQ ID NO: 5080790 - DNA, 13 bp, Homo sapiens
aaaggatatttaa

SEQ ID NO: 5080791 - DNA, 19 bp, Homo sapiens
aaaggatatttaagaaaat

SEQ ID NO: 5080792 - DNA, 20 bp, Homo sapiens
aaaggatatttcaaatgatt

SEQ ID NO: 5080793 - DNA, 21 bp, Homo sapiens
aaaggatccagatagcctagg

SEQ ID NO: 5080794 - DNA, 17 bp, Homo sapiens
aaaggatctaagggaag

SEQ ID NO: 5080795 - DNA, 24 bp, Homo sapiens
aaaggatctaagggaagatcactg

SEQ ID NO: 5080796 - DNA, 15 bp, Homo sapiens
aaaggatctctgaga

SEQ ID NO: 5080797 - DNA, 13 bp, Homo sapiens
aaaggatctgtga

SEQ ID NO: 5080798 - DNA, 18 bp, Homo sapiens
aaaggatctttgtggcca

SEQ ID NO: 5080799 - DNA, 19 bp, Homo sapiens
aaaggatctttgtggccaa

SEQ ID NO: 5080800 - DNA, 15 bp, Homo sapiens
aaaggatgaagaaca

SEQ ID NO: 5080801 - DNA, 19 bp, Homo sapiens
aaaggatgaagaacacagc

SEQ ID NO: 5080802 - DNA, 16 bp, Homo sapiens
aaaggatgagaatgtg

SEQ ID NO: 5080803 - DNA, 18 bp, Homo sapiens
aaaggatgagaatgtgac

SEQ ID NO: 5080804 - DNA, 14 bp, Homo sapiens
aaaggatgagggtt

SEQ ID NO: 5080805 - DNA, 18 bp, Homo sapiens
aaaggatgatggaaaaat

SEQ ID NO: 5080806 - DNA, 21 bp, Homo sapiens
aaaggatgatggaaaaatcac

SEQ ID NO: 5080807 - DNA, 17 bp, Homo sapiens
aaaggatggaagaaaga

SEQ ID NO: 5080808 - DNA, 18 bp, Homo sapiens
aaaggatggaagaaagaa

SEQ ID NO: 5080809 - DNA, 21 bp, Homo sapiens
aaaggatggtggttattttaa

SEQ ID NO: 5080810 - DNA, 17 bp, Homo sapiens
aaaggatgtgatatata

SEQ ID NO: 5080811 - DNA, 19 bp, Homo sapiens
aaaggatgtgatatataag

SEQ ID NO: 5080812 - DNA, 16 bp, Homo sapiens
aaaggatgttacaagt

SEQ ID NO: 5080813 - DNA, 17 bp, Homo sapiens
aaaggatgttacaagtt

SEQ ID NO: 5080814 - DNA, 16 bp, Homo sapiens
aaaggatgttggtgtt

SEQ ID NO: 5080815 - DNA, 18 bp, Homo sapiens
aaaggatgttttgtccca

SEQ ID NO: 5080816 - DNA, 23 bp, Homo sapiens
aaaggattcagtggaggctggca

SEQ ID NO: 5080817 - DNA, 19 bp, Homo sapiens
aaaggatttaagcaaaggc

SEQ ID NO: 5080818 - DNA, 20 bp, Homo sapiens
aaaggatttgatgcttttct

SEQ ID NO: 5080819 - DNA, 23 bp, Homo sapiens
aaaggatttgatgcttttctctc

SEQ ID NO: 5080820 - DNA, 14 bp, Homo sapiens
aaaggattttacca

SEQ ID NO: 5080821 - DNA, 18 bp, Homo sapiens
aaaggattttaccaaagc

SEQ ID NO: 5080822 - DNA, 17 bp, Homo sapiens
aaaggattttggaaaag

SEQ ID NO: 5080823 - DNA, 18 bp, Homo sapiens
aaaggattttggaaaaga

SEQ ID NO: 5080824 - DNA, 17 bp, Homo sapiens
aaaggcaaaagactggt

SEQ ID NO: 5080825 - DNA, 16 bp, Homo sapiens
aaaggcaaacatttga

SEQ ID NO: 5080826 - DNA, 19 bp, Homo sapiens
aaaggcaaaccaatttgtt

SEQ ID NO: 5080827 - DNA, 12 bp, Homo sapiens
aaaggcaaaggc

SEQ ID NO: 5080828 - DNA, 13 bp, Homo sapiens
aaaggcaaataat

SEQ ID NO: 5080829 - DNA, 17 bp, Homo sapiens
aaaggcaaatattgaag

SEQ ID NO: 5080830 - DNA, 16 bp, Homo sapiens
aaaggcaaatctgact

SEQ ID NO: 5080831 - DNA, 19 bp, Homo sapiens
aaaggcaaatctgactttt

SEQ ID NO: 5080832 - DNA, 20 bp, Homo sapiens
aaaggcaatggtttgtgtca

SEQ ID NO: 5080833 - DNA, 22 bp, Homo sapiens
aaaggcaattatatctattatg

SEQ ID NO: 5080834 - DNA, 14 bp, Homo sapiens
aaagtcctcttccc

SEQ ID NO: 5080835 - DNA, 22 bp, Homo sapiens
aaagtcctgtcagttcagaaaa

SEQ ID NO: 5080836 - DNA, 21 bp, Homo sapiens
aaagtccttcagtttagaacc

SEQ ID NO: 5080837 - DNA, 16 bp, Homo sapiens
aaagtcctttttttcc

SEQ ID NO: 5080838 - DNA, 18 bp, Homo sapiens
aaagtcgttttccaaact

SEQ ID NO: 5080839 - DNA, 20 bp, Homo sapiens
aaagtctaaacaaaattgca

SEQ ID NO: 5080840 - DNA, 15 bp, Homo sapiens
aaagtctagttacct

SEQ ID NO: 5080841 - DNA, 22 bp, Homo sapiens
aaagtctagttacctacttttt

SEQ ID NO: 5080842 - DNA, 13 bp, Homo sapiens
aaagtctattttt

SEQ ID NO: 5080843 - DNA, 19 bp, Homo sapiens
aaagtctatttttttaact

SEQ ID NO: 5080844 - DNA, 18 bp, Homo sapiens
aaagtctcaatgaaatag

SEQ ID NO: 5080845 - DNA, 15 bp, Homo sapiens
aaagtctccagccca

SEQ ID NO: 5080846 - DNA, 12 bp, Homo sapiens
aaagtctctatt

SEQ ID NO: 5080847 - DNA, 13 bp, Homo sapiens
aaagtctctattt

SEQ ID NO: 5080848 - DNA, 20 bp, Homo sapiens
aaagtctctatttaaattct

SEQ ID NO: 5080849 - DNA, 23 bp, Homo sapiens
aaagtctctatttaaattctttt

SEQ ID NO: 5080850 - DNA, 22 bp, Homo sapiens
aaagtctctcattctaggcctc

SEQ ID NO: 5080851 - DNA, 19 bp, Homo sapiens
aaagtctctggaatttgaa

SEQ ID NO: 5080852 - DNA, 20 bp, Homo sapiens
aaagtctctggaatttgaaa

SEQ ID NO: 5080853 - DNA, 13 bp, Homo sapiens
aaagtctctgggt

SEQ ID NO: 5080854 - DNA, 15 bp, Homo sapiens
aaagtctgagaaata

SEQ ID NO: 5080855 - DNA, 16 bp, Homo sapiens
aaagtctgagaaattt

SEQ ID NO: 5080856 - DNA, 18 bp, Homo sapiens
aaagtctgagtgggcggc

SEQ ID NO: 5080857 - DNA, 14 bp, Homo sapiens
aaagtctgtcatgc

SEQ ID NO: 5080858 - DNA, 16 bp, Homo sapiens
aaagtctgtctttcct

SEQ ID NO: 5080859 - DNA, 19 bp, Homo sapiens
aaagtctgtgacttgaagt

SEQ ID NO: 5080860 - DNA, 23 bp, Homo sapiens
aaagtctgtgtgatgaactttct

SEQ ID NO: 5080861 - DNA, 23 bp, Homo sapiens
aaagtcttctcccaactcagcct

SEQ ID NO: 5080862 - DNA, 15 bp, Homo sapiens
aaagtcttggtttta

SEQ ID NO: 5080863 - DNA, 19 bp, Homo sapiens
aaagtcttgtgactagtgc

SEQ ID NO: 5080864 - DNA, 23 bp, Homo sapiens
aaagtctttggggtctacactgc

SEQ ID NO: 5080865 - DNA, 18 bp, Homo sapiens
aaagtcttttttttcctg

SEQ ID NO: 5080866 - DNA, 21 bp, Homo sapiens
aaagtgaaacgtaattgtaca

SEQ ID NO: 5080867 - DNA, 19 bp, Homo sapiens
aaagtgaaagacatttcaa

SEQ ID NO: 5080868 - DNA, 15 bp, Homo sapiens
aaagtgaactttgtt

SEQ ID NO: 5080869 - DNA, 18 bp, Homo sapiens
aaagtgaagaatttatct

SEQ ID NO: 5080870 - DNA, 14 bp, Homo sapiens
aaagtgaaggaaat

SEQ ID NO: 5080871 - DNA, 15 bp, Homo sapiens
aaagtgaataaaaat

SEQ ID NO: 5080872 - DNA, 16 bp, Homo sapiens
aaagtgaataaacttc

SEQ ID NO: 5080873 - DNA, 19 bp, Homo sapiens
aaagtgaataaacttcagc

SEQ ID NO: 5080874 - DNA, 22 bp, Homo sapiens
aaagtgaatgaaagattaaaca

SEQ ID NO: 5080875 - DNA, 18 bp, Homo sapiens
aaagtgaatttttaaaga

SEQ ID NO: 5080876 - DNA, 14 bp, Homo sapiens
aaagtgacacagca

SEQ ID NO: 5080877 - DNA, 18 bp, Homo sapiens
aaagtgacagagacccag

SEQ ID NO: 5080878 - DNA, 12 bp, Homo sapiens
aaagtgacattt

SEQ ID NO: 5080879 - DNA, 15 bp, Homo sapiens
aaagtgaccagcata

SEQ ID NO: 5080880 - DNA, 14 bp, Homo sapiens
aaagtgaccctgtt

SEQ ID NO: 5080881 - DNA, 11 bp, Homo sapiens
aaagtgacttt

SEQ ID NO: 5080882 - DNA, 19 bp, Homo sapiens
aaagtgagagccagcagca

SEQ ID NO: 5080883 - DNA, 20 bp, Homo sapiens
aaagtgagatgggaagggct

SEQ ID NO: 5080884 - DNA, 19 bp, Homo sapiens
aaagtgaggccactgaaga

SEQ ID NO: 5080885 - DNA, 20 bp, Homo sapiens
aaagtgagggccgagtgaga

SEQ ID NO: 5080886 - DNA, 16 bp, Homo sapiens
aaagtgagtactgtta

SEQ ID NO: 5080887 - DNA, 17 bp, Homo sapiens
aaagtgatcagcaatga

SEQ ID NO: 5080888 - DNA, 21 bp, Homo sapiens
aaagtgatcttaggtttgttt

SEQ ID NO: 5080889 - DNA, 17 bp, Homo sapiens
aaagtgatgtattttca

SEQ ID NO: 5080890 - DNA, 19 bp, Homo sapiens
aaagtgatgtattttcata

SEQ ID NO: 5080891 - DNA, 15 bp, Homo sapiens
aaagtgattaaacgt

SEQ ID NO: 5080892 - DNA, 19 bp, Homo sapiens
aaagtgattccttcttgct

SEQ ID NO: 5080893 - DNA, 12 bp, Homo sapiens
aaagtgatttct

SEQ ID NO: 5080894 - DNA, 14 bp, Homo sapiens
aaagtgcaaagctg

SEQ ID NO: 5080895 - DNA, 21 bp, Homo sapiens
aaagtgcaattgcacaaatac

SEQ ID NO: 5080896 - DNA, 13 bp, Homo sapiens
aaagtgcacacac

SEQ ID NO: 5080897 - DNA, 14 bp, Homo sapiens
aaagtgcacacaca

SEQ ID NO: 5080898 - DNA, 20 bp, Homo sapiens
aaagtgcacacctttattca

SEQ ID NO: 5080899 - DNA, 14 bp, Homo sapiens
aaagtgcactgtgt

SEQ ID NO: 5080900 - DNA, 17 bp, Homo sapiens
aaagtgcagcccttcct

SEQ ID NO: 5080901 - DNA, 19 bp, Homo sapiens
aaagtgcagcccttcctcc

SEQ ID NO: 5080902 - DNA, 15 bp, Homo sapiens
aaagtgcatgtcaca

SEQ ID NO: 5080903 - DNA, 15 bp, Homo sapiens
aaagtgccaaagaaa

SEQ ID NO: 5080904 - DNA, 21 bp, Homo sapiens
aaagtgccaaagaaagtggtc

SEQ ID NO: 5080905 - DNA, 19 bp, Homo sapiens
aaagtgccattaacaaatg

SEQ ID NO: 5080906 - DNA, 20 bp, Homo sapiens
aaagtgcctgacacactaac

SEQ ID NO: 5080907 - DNA, 12 bp, Homo sapiens
aaagtgcctggg

SEQ ID NO: 5080908 - DNA, 13 bp, Homo sapiens
aaagtgcctggga

SEQ ID NO: 5080909 - DNA, 15 bp, Homo sapiens
aaagtgccttctgag

SEQ ID NO: 5080910 - DNA, 16 bp, Homo sapiens
aaagtgccttctgagc

SEQ ID NO: 5080911 - DNA, 21 bp, Homo sapiens
aaagtgccttctgagctgtct

SEQ ID NO: 5080912 - DNA, 16 bp, Homo sapiens
aaagtgccttgctcat

SEQ ID NO: 5080913 - DNA, 21 bp, Homo sapiens
aaagtgcctttatctcagcca

SEQ ID NO: 5080914 - DNA, 23 bp, Homo sapiens
aaagtgcctttatctcagccatc

SEQ ID NO: 5080915 - DNA, 14 bp, Homo sapiens
aaagtgcctttcag

SEQ ID NO: 5080916 - DNA, 19 bp, Homo sapiens
aaagtgcgtgtgtgtatgt

SEQ ID NO: 5080917 - DNA, 18 bp, Homo sapiens
aaagtgctaaggttctaa

SEQ ID NO: 5080918 - DNA, 16 bp, Homo sapiens
aaagtgctacttgaga

SEQ ID NO: 5080919 - DNA, 22 bp, Homo sapiens
aaagtgctctatttattaagaa

SEQ ID NO: 5080920 - DNA, 21 bp, Homo sapiens
aaagtgctgcagggctttaaa

SEQ ID NO: 5080921 - DNA, 14 bp, Homo sapiens
aaagtgctgcggag

SEQ ID NO: 5080922 - DNA, 20 bp, Homo sapiens
aaagtgctggattgtccttg

SEQ ID NO: 5080923 - DNA, 19 bp, Homo sapiens
aaagtgctgggattacagg

SEQ ID NO: 5080924 - DNA, 21 bp, Homo sapiens
aaagtgcttaaggtttgtttt

SEQ ID NO: 5080925 - DNA, 16 bp, Homo sapiens
aaagtgcttagaaagt

SEQ ID NO: 5080926 - DNA, 23 bp, Homo sapiens
aaagtgcttgtgtaatttatgtg

SEQ ID NO: 5080927 - DNA, 18 bp, Homo sapiens
aaagtgctttgacttctt

SEQ ID NO: 5080928 - DNA, 23 bp, Homo sapiens
aaagtgctttgctggagtcctgt

SEQ ID NO: 5080929 - DNA, 20 bp, Homo sapiens
aaagtggaaaacaaggaagt

SEQ ID NO: 5080930 - DNA, 13 bp, Homo sapiens
aaagtggaacgaa

SEQ ID NO: 5080931 - DNA, 16 bp, Homo sapiens
aaagtggaaggaaaga

SEQ ID NO: 5080932 - DNA, 19 bp, Homo sapiens
aaagtggcaagaccaaaat

SEQ ID NO: 5080933 - DNA, 18 bp, Homo sapiens
aaagtggcaatttcttta

SEQ ID NO: 5080934 - DNA, 20 bp, Homo sapiens
aaagtggcacctgtctgctc

SEQ ID NO: 5080935 - DNA, 17 bp, Homo sapiens
aaagtggccatgccacc

SEQ ID NO: 5080936 - DNA, 14 bp, Homo sapiens
aaagtggcctcttt

SEQ ID NO: 5080937 - DNA, 22 bp, Homo sapiens
aaagtggcgtgggagccagcct

SEQ ID NO: 5080938 - DNA, 16 bp, Homo sapiens
aaagtggctaattcaa

SEQ ID NO: 5080939 - DNA, 23 bp, Homo sapiens
aaagtggctcttctaacctcagc

SEQ ID NO: 5080940 - DNA, 14 bp, Homo sapiens
aaagtgggaaagtt

SEQ ID NO: 5080941 - DNA, 23 bp, Homo sapiens
aaagtggggagggacaagggatt

SEQ ID NO: 5080942 - DNA, 21 bp, Homo sapiens
aaagtgggttttttagttgaa

SEQ ID NO: 5080943 - DNA, 16 bp, Homo sapiens
aaagtggtaaatactg

SEQ ID NO: 5080944 - DNA, 17 bp, Homo sapiens
aaagtggtaaatactgt

SEQ ID NO: 5080945 - DNA, 17 bp, Homo sapiens
aaagtggtacaggaagg

SEQ ID NO: 5080946 - DNA, 23 bp, Homo sapiens
aaagtggtaggtactttttgtga

SEQ ID NO: 5080947 - DNA, 16 bp, Homo sapiens
aaagtggtatagaaat

SEQ ID NO: 5080948 - DNA, 17 bp, Homo sapiens
aaagtggtctgaactgc

SEQ ID NO: 5080949 - DNA, 21 bp, Homo sapiens
aaagtggtgctcagttgtaga

SEQ ID NO: 5080950 - DNA, 13 bp, Homo sapiens
aaagtggttgtcc

SEQ ID NO: 5080951 - DNA, 13 bp, Homo sapiens
aaagtgtaaagca

SEQ ID NO: 5080952 - DNA, 22 bp, Homo sapiens
aaagtgtaaagcattccaacaa

SEQ ID NO: 5080953 - DNA, 15 bp, Homo sapiens
aaagtgtaacagata

SEQ ID NO: 5080954 - DNA, 18 bp, Homo sapiens
aaagtgtacaagttgctt

SEQ ID NO: 5080955 - DNA, 17 bp, Homo sapiens
aaagtgtacaattttca

SEQ ID NO: 5080956 - DNA, 13 bp, Homo sapiens
aaagtgtacattt

SEQ ID NO: 5080957 - DNA, 16 bp, Homo sapiens
aaagtgtacattttat

SEQ ID NO: 5080958 - DNA, 16 bp, Homo sapiens
aaagtgtagcaccctg

SEQ ID NO: 5080959 - DNA, 17 bp, Homo sapiens
aaagtgtatatttattc

SEQ ID NO: 5080960 - DNA, 20 bp, Homo sapiens
aaagtgtatatttattcata

SEQ ID NO: 5080961 - DNA, 15 bp, Homo sapiens
aaagtgtatttggaa

SEQ ID NO: 5080962 - DNA, 19 bp, Homo sapiens
aaagtgtattttataaaat

SEQ ID NO: 5080963 - DNA, 21 bp, Homo sapiens
aaagtgtcaccttttcttgcc

SEQ ID NO: 5080964 - DNA, 16 bp, Homo sapiens
aaagtgtcactccata

SEQ ID NO: 5080965 - DNA, 21 bp, Homo sapiens
aaagtgtccattgacatgtac

SEQ ID NO: 5080966 - DNA, 22 bp, Homo sapiens
aaagtgtccattgacatgtaca

SEQ ID NO: 5080967 - DNA, 17 bp, Homo sapiens
aaagtgtctagacatat

SEQ ID NO: 5080968 - DNA, 18 bp, Homo sapiens
aaagtgtctcaaaggagc

SEQ ID NO: 5080969 - DNA, 21 bp, Homo sapiens
aaagtgtctttgtttaaaatt

SEQ ID NO: 5080970 - DNA, 20 bp, Homo sapiens
aaagtgtcttttgacatttt

SEQ ID NO: 5080971 - DNA, 14 bp, Homo sapiens
aaagtgtgagcagt

SEQ ID NO: 5080972 - DNA, 22 bp, Homo sapiens
aaagtgtgagcagtgagttaca

SEQ ID NO: 5080973 - DNA, 13 bp, Homo sapiens
aaagtgtgtaaat

SEQ ID NO: 5080974 - DNA, 20 bp, Homo sapiens
aaagtgtgtaattatgtaaa

SEQ ID NO: 5080975 - DNA, 22 bp, Homo sapiens
aaagtgtgtaattatgtaaata

SEQ ID NO: 5080976 - DNA, 18 bp, Homo sapiens
aaagtgtgtatatatttt

SEQ ID NO: 5080977 - DNA, 13 bp, Homo sapiens
aaagtgtgtatta

SEQ ID NO: 5080978 - DNA, 15 bp, Homo sapiens
aaagtgtgtattaaa

SEQ ID NO: 5080979 - DNA, 15 bp, Homo sapiens
aaagtgtgtgtgttc

SEQ ID NO: 5080980 - DNA, 11 bp, Homo sapiens
aaagtgttact

SEQ ID NO: 5080981 - DNA, 19 bp, Homo sapiens
aaagtgttcaaattaaaaa

SEQ ID NO: 5080982 - DNA, 12 bp, Homo sapiens
aaagtgttcctt

SEQ ID NO: 5080983 - DNA, 14 bp, Homo sapiens
aaagtgttctgtgc

SEQ ID NO: 5080984 - DNA, 18 bp, Homo sapiens
aaagtgttctgttacaaa

SEQ ID NO: 5080985 - DNA, 19 bp, Homo sapiens
aaagtgttctgttacaaaa

SEQ ID NO: 5080986 - DNA, 19 bp, Homo sapiens
aaagtgttggctaatgaag

SEQ ID NO: 5080987 - DNA, 18 bp, Homo sapiens
aaagtgttggtctttcta

SEQ ID NO: 5080988 - DNA, 13 bp, Homo sapiens
aaagtgttgtatc

SEQ ID NO: 5080989 - DNA, 17 bp, Homo sapiens
aaagtgttgtcttattc

SEQ ID NO: 5080990 - DNA, 17 bp, Homo sapiens
aaagtgtttatgacaaa

SEQ ID NO: 5080991 - DNA, 18 bp, Homo sapiens
aaagtgttttattttcaa

SEQ ID NO: 5080992 - DNA, 15 bp, Homo sapiens
aaagtgttttcagag

SEQ ID NO: 5080993 - DNA, 16 bp, Homo sapiens
aaagtgttttgtacca

SEQ ID NO: 5080994 - DNA, 17 bp, Homo sapiens
aaagtgttttgtaccag

SEQ ID NO: 5080995 - DNA, 13 bp, Homo sapiens
aaagtgttttttc

SEQ ID NO: 5080996 - DNA, 12 bp, Homo sapiens
aaagttaaaagt

SEQ ID NO: 5080997 - DNA, 17 bp, Homo sapiens
aaagttaaaattgttat

SEQ ID NO: 5080998 - DNA, 16 bp, Homo sapiens
aaagttaaacattgaa

SEQ ID NO: 5080999 - DNA, 15 bp, Homo sapiens
aaagttaaactaaaa

SEQ ID NO: 5081000 - DNA, 15 bp, Homo sapiens
aaagttaacattaat

SEQ ID NO: 5081001 - DNA, 20 bp, Homo sapiens
aaagttaacctacctgtaac

SEQ ID NO: 5081002 - DNA, 20 bp, Homo sapiens
aaagttaactgacttcacta

SEQ ID NO: 5081003 - DNA, 20 bp, Homo sapiens
aaagttaaggcttgatacca

SEQ ID NO: 5081004 - DNA, 20 bp, Homo sapiens
aaagttaataacagctcctt

SEQ ID NO: 5081005 - DNA, 21 bp, Homo sapiens
aaagttaatatggtaattatg

SEQ ID NO: 5081006 - DNA, 16 bp, Homo sapiens
aaagttaatcttcatg

SEQ ID NO: 5081007 - DNA, 15 bp, Homo sapiens
aaagttaatgcttaa

SEQ ID NO: 5081008 - DNA, 14 bp, Homo sapiens
aaagttacagaaat

SEQ ID NO: 5081009 - DNA, 16 bp, Homo sapiens
aaagttaccagtgcct

SEQ ID NO: 5081010 - DNA, 13 bp, Homo sapiens
aaagttacccaaa

SEQ ID NO: 5081011 - DNA, 22 bp, Homo sapiens
aaagttacccaaagggcttatt

SEQ ID NO: 5081012 - DNA, 21 bp, Homo sapiens
aaagttactaatatatctgta

SEQ ID NO: 5081013 - DNA, 16 bp, Homo sapiens
aaaggcaattattctt

SEQ ID NO: 5081014 - DNA, 15 bp, Homo sapiens
aaaggcacatattgg

SEQ ID NO: 5081015 - DNA, 20 bp, Homo sapiens
aaaggcacatggaatatatt

SEQ ID NO: 5081016 - DNA, 21 bp, Homo sapiens
aaaggcacatggaatatattt

SEQ ID NO: 5081017 - DNA, 20 bp, Homo sapiens
aaaggcagctaagatagaaa

SEQ ID NO: 5081018 - DNA, 21 bp, Homo sapiens
aaaggcagctaagatagaaag

SEQ ID NO: 5081019 - DNA, 11 bp, Homo sapiens
aaaggcagctg

SEQ ID NO: 5081020 - DNA, 13 bp, Homo sapiens
aaaggcagctgcc

SEQ ID NO: 5081021 - DNA, 20 bp, Homo sapiens
aaaggcagctgcctctgctc

SEQ ID NO: 5081022 - DNA, 21 bp, Homo sapiens
aaaggcagctgcctctgctcc

SEQ ID NO: 5081023 - DNA, 23 bp, Homo sapiens
aaaggcagctgcctctgctccct

SEQ ID NO: 5081024 - DNA, 14 bp, Homo sapiens
aaaggcagctgtgt

SEQ ID NO: 5081025 - DNA, 22 bp, Homo sapiens
aaaggcagctgttgtctcttct

SEQ ID NO: 5081026 - DNA, 15 bp, Homo sapiens
aaaggcaggaggtgg

SEQ ID NO: 5081027 - DNA, 11 bp, Homo sapiens
aaaggcagggc

SEQ ID NO: 5081028 - DNA, 15 bp, Homo sapiens
aaaggcaggtgcttt

SEQ ID NO: 5081029 - DNA, 20 bp, Homo sapiens
aaaggcaggtttcatttctt

SEQ ID NO: 5081030 - DNA, 19 bp, Homo sapiens
aaaggcagtattttgtgtc

SEQ ID NO: 5081031 - DNA, 17 bp, Homo sapiens
aaaggcagtggggctgg

SEQ ID NO: 5081032 - DNA, 23 bp, Homo sapiens
aaaggcagttaccattaaaccat

SEQ ID NO: 5081033 - DNA, 13 bp, Homo sapiens
aaaggcagttttc

SEQ ID NO: 5081034 - DNA, 21 bp, Homo sapiens
aaaggcataagaccctaagcc

SEQ ID NO: 5081035 - DNA, 17 bp, Homo sapiens
aaaggcatctaagacat

SEQ ID NO: 5081036 - DNA, 21 bp, Homo sapiens
aaaggcatgcagtcatgagaa

SEQ ID NO: 5081037 - DNA, 12 bp, Homo sapiens
aaaggcatgctg

SEQ ID NO: 5081038 - DNA, 16 bp, Homo sapiens
aaaggcattctctgaa

SEQ ID NO: 5081039 - DNA, 18 bp, Homo sapiens
aaaggcattctctgaaga

SEQ ID NO: 5081040 - DNA, 14 bp, Homo sapiens
aaaggcattgtcca

SEQ ID NO: 5081041 - DNA, 20 bp, Homo sapiens
aaaggccaaacctctgttca

SEQ ID NO: 5081042 - DNA, 16 bp, Homo sapiens
aaaggccaaagataaa

SEQ ID NO: 5081043 - DNA, 16 bp, Homo sapiens
aaaggccacaggagac

SEQ ID NO: 5081044 - DNA, 15 bp, Homo sapiens
aaaggccacctagct

SEQ ID NO: 5081045 - DNA, 17 bp, Homo sapiens
aaaggccagacctgcag

SEQ ID NO: 5081046 - DNA, 14 bp, Homo sapiens
aaaggccagctggc

SEQ ID NO: 5081047 - DNA, 18 bp, Homo sapiens
aaaggccagtggaagaaa

SEQ ID NO: 5081048 - DNA, 16 bp, Homo sapiens
aaaggcccagccccta

SEQ ID NO: 5081049 - DNA, 18 bp, Homo sapiens
aaaggccgccgtgaccta

SEQ ID NO: 5081050 - DNA, 21 bp, Homo sapiens
aaaggcctaattctatgcctg

SEQ ID NO: 5081051 - DNA, 18 bp, Homo sapiens
aaaggcctcaagaacaaa

SEQ ID NO: 5081052 - DNA, 20 bp, Homo sapiens
aaaggcctcctcccccaccc

SEQ ID NO: 5081053 - DNA, 14 bp, Homo sapiens
aaaggcctctgtcc

SEQ ID NO: 5081054 - DNA, 11 bp, Homo sapiens
aaaggcctgga

SEQ ID NO: 5081055 - DNA, 12 bp, Homo sapiens
aaaggcctggaa

SEQ ID NO: 5081056 - DNA, 17 bp, Homo sapiens
aaaggccttcagacaca

SEQ ID NO: 5081057 - DNA, 21 bp, Homo sapiens
aaaggccttcagacacatgct

SEQ ID NO: 5081058 - DNA, 17 bp, Homo sapiens
aaaggcctttaaaattt

SEQ ID NO: 5081059 - DNA, 14 bp, Homo sapiens
aaaggctaaacata

SEQ ID NO: 5081060 - DNA, 19 bp, Homo sapiens
aaaggctagtttattttgt

SEQ ID NO: 5081061 - DNA, 22 bp, Homo sapiens
aaaggctattttcagatgaaat

SEQ ID NO: 5081062 - DNA, 21 bp, Homo sapiens
aaaggctcagtctcaggagca

SEQ ID NO: 5081063 - DNA, 15 bp, Homo sapiens
aaaggctcatttaaa

SEQ ID NO: 5081064 - DNA, 16 bp, Homo sapiens
aaaggctcatttaaaa

SEQ ID NO: 5081065 - DNA, 20 bp, Homo sapiens
aaaggctccaggagcagcca

SEQ ID NO: 5081066 - DNA, 22 bp, Homo sapiens
aaaggctccaggagcagccaca

SEQ ID NO: 5081067 - DNA, 20 bp, Homo sapiens
aaaggctccagttgggctga

SEQ ID NO: 5081068 - DNA, 18 bp, Homo sapiens
aaaggctcgtttggatct

SEQ ID NO: 5081069 - DNA, 12 bp, Homo sapiens
aaaggctctgtg

SEQ ID NO: 5081070 - DNA, 21 bp, Homo sapiens
aaaggctgacattcactgagt

SEQ ID NO: 5081071 - DNA, 17 bp, Homo sapiens
aaaggctgattactgaa

SEQ ID NO: 5081072 - DNA, 13 bp, Homo sapiens
aaaggctgccgag

SEQ ID NO: 5081073 - DNA, 12 bp, Homo sapiens
aaaggctggcaa

SEQ ID NO: 5081074 - DNA, 14 bp, Homo sapiens
aaaggctgtattca

SEQ ID NO: 5081075 - DNA, 18 bp, Homo sapiens
aaaggctgtattcagcaa

SEQ ID NO: 5081076 - DNA, 20 bp, Homo sapiens
aaaggctgttaaatacagga

SEQ ID NO: 5081077 - DNA, 22 bp, Homo sapiens
aaaggctgttaaatacaggaaa

SEQ ID NO: 5081078 - DNA, 13 bp, Homo sapiens
aaaggcttccagg

SEQ ID NO: 5081079 - DNA, 14 bp, Homo sapiens
aaaggcttctccac

SEQ ID NO: 5081080 - DNA, 15 bp, Homo sapiens
aaaggcttctctctc

SEQ ID NO: 5081081 - DNA, 17 bp, Homo sapiens
aaaggcttgaagctgtg

SEQ ID NO: 5081082 - DNA, 13 bp, Homo sapiens
aaaggcttggctg

SEQ ID NO: 5081083 - DNA, 19 bp, Homo sapiens
aaaggctttggcaacagaa

SEQ ID NO: 5081084 - DNA, 12 bp, Homo sapiens
aaaggcttttgg

SEQ ID NO: 5081085 - DNA, 13 bp, Homo sapiens
aaagggaaaaaag

SEQ ID NO: 5081086 - DNA, 15 bp, Homo sapiens
aaagggaaaaaagaa

SEQ ID NO: 5081087 - DNA, 14 bp, Homo sapiens
aaagggaaaaaata

SEQ ID NO: 5081088 - DNA, 16 bp, Homo sapiens
aaagggaaaagggaga

SEQ ID NO: 5081089 - DNA, 19 bp, Homo sapiens
aaagggaacaagatgctga

SEQ ID NO: 5081090 - DNA, 18 bp, Homo sapiens
aaagggaactagataaca

SEQ ID NO: 5081091 - DNA, 21 bp, Homo sapiens
aaagggaactgaacattccag

SEQ ID NO: 5081092 - DNA, 19 bp, Homo sapiens
aaagggaaggctgctgtgt

SEQ ID NO: 5081093 - DNA, 24 bp, Homo sapiens
aaagggaagtaacagacacacgat

SEQ ID NO: 5081094 - DNA, 20 bp, Homo sapiens
aaagggaatactcacatttt

SEQ ID NO: 5081095 - DNA, 14 bp, Homo sapiens
aaagggaattatga

SEQ ID NO: 5081096 - DNA, 21 bp, Homo sapiens
aaagggaattcgatgcccccc

SEQ ID NO: 5081097 - DNA, 22 bp, Homo sapiens
aaagggacacccctacacacac

SEQ ID NO: 5081098 - DNA, 14 bp, Homo sapiens
aaagggacactttt

SEQ ID NO: 5081099 - DNA, 16 bp, Homo sapiens
aaagggacagcatgcc

SEQ ID NO: 5081100 - DNA, 12 bp, Homo sapiens
aaagggacccac

SEQ ID NO: 5081101 - DNA, 21 bp, Homo sapiens
aaagggacccgaagcccaggc

SEQ ID NO: 5081102 - DNA, 20 bp, Homo sapiens
aaagggactgagaaatttat

SEQ ID NO: 5081103 - DNA, 22 bp, Homo sapiens
aaagggacttttgtaaaatcaa

SEQ ID NO: 5081104 - DNA, 16 bp, Homo sapiens
aaagggagaaatgcca

SEQ ID NO: 5081105 - DNA, 17 bp, Homo sapiens
aaagggagaaatgccag

SEQ ID NO: 5081106 - DNA, 21 bp, Homo sapiens
aaagggagaagtgacattgca

SEQ ID NO: 5081107 - DNA, 20 bp, Homo sapiens
aaagggagaatggtgctgtt

SEQ ID NO: 5081108 - DNA, 10 bp, Homo sapiens
aaagggagag

SEQ ID NO: 5081109 - DNA, 14 bp, Homo sapiens
aaagggagagaaaa

SEQ ID NO: 5081110 - DNA, 17 bp, Homo sapiens
aaagggagagagagagg

SEQ ID NO: 5081111 - DNA, 15 bp, Homo sapiens
aaagggagaggaaga

SEQ ID NO: 5081112 - DNA, 16 bp, Homo sapiens
aaagggagaggaagag

SEQ ID NO: 5081113 - DNA, 18 bp, Homo sapiens
aaagggagccatgctctt

SEQ ID NO: 5081114 - DNA, 15 bp, Homo sapiens
aaagggagtttttga

SEQ ID NO: 5081115 - DNA, 15 bp, Homo sapiens
aaagggattgaggag

SEQ ID NO: 5081116 - DNA, 13 bp, Homo sapiens
aaagggcaataaa

SEQ ID NO: 5081117 - DNA, 12 bp, Homo sapiens
aaagggcactta

SEQ ID NO: 5081118 - DNA, 17 bp, Homo sapiens
aaagggcagaggaagag

SEQ ID NO: 5081119 - DNA, 18 bp, Homo sapiens
aaagggcagccaggggct

SEQ ID NO: 5081120 - DNA, 22 bp, Homo sapiens
aaagggcagcccctccccatgg

SEQ ID NO: 5081121 - DNA, 12 bp, Homo sapiens
aaagggcagggc

SEQ ID NO: 5081122 - DNA, 13 bp, Homo sapiens
aaagggcagggcc

SEQ ID NO: 5081123 - DNA, 21 bp, Homo sapiens
aaagggcataccttgtgcatt

SEQ ID NO: 5081124 - DNA, 19 bp, Homo sapiens
aaagggcccaatgaattat

SEQ ID NO: 5081125 - DNA, 19 bp, Homo sapiens
aaagggcccacacctggtg

SEQ ID NO: 5081126 - DNA, 20 bp, Homo sapiens
aaagggccctttcatcttga

SEQ ID NO: 5081127 - DNA, 21 bp, Homo sapiens
aaagggcggaagagttacaat

SEQ ID NO: 5081128 - DNA, 13 bp, Homo sapiens
aaagggcgggcct

SEQ ID NO: 5081129 - DNA, 13 bp, Homo sapiens
aaagggctgagag

SEQ ID NO: 5081130 - DNA, 23 bp, Homo sapiens
aaagggctggctccccctcccca

SEQ ID NO: 5081131 - DNA, 20 bp, Homo sapiens
aaagggctgttataatcttt

SEQ ID NO: 5081132 - DNA, 14 bp, Homo sapiens
aaagggcttcattt

SEQ ID NO: 5081133 - DNA, 22 bp, Homo sapiens
aaagggcttcggccacaggcag

SEQ ID NO: 5081134 - DNA, 22 bp, Homo sapiens
aaaggggaaacgtctcccagat

SEQ ID NO: 5081135 - DNA, 20 bp, Homo sapiens
aaaggggacacctgtacatt

SEQ ID NO: 5081136 - DNA, 15 bp, Homo sapiens
aaaggggacaggcct

SEQ ID NO: 5081137 - DNA, 22 bp, Homo sapiens
aaaggggagaaactgaaagtgt

SEQ ID NO: 5081138 - DNA, 19 bp, Homo sapiens
aaaggggagagcctgctgg

SEQ ID NO: 5081139 - DNA, 19 bp, Homo sapiens
aaaggggagttgagtcaca

SEQ ID NO: 5081140 - DNA, 18 bp, Homo sapiens
aaaggggcgagggagggg

SEQ ID NO: 5081141 - DNA, 22 bp, Homo sapiens
aaagggggctattccctggaga

SEQ ID NO: 5081142 - DNA, 13 bp, Homo sapiens
aaagggggctgca

SEQ ID NO: 5081143 - DNA, 13 bp, Homo sapiens
aaaggggggtggg

SEQ ID NO: 5081144 - DNA, 18 bp, Homo sapiens
aaaggggggtgggagggg

SEQ ID NO: 5081145 - DNA, 23 bp, Homo sapiens
aaagggggtcccagtgggagggg

SEQ ID NO: 5081146 - DNA, 17 bp, Homo sapiens
aaagggggtccgtggaa

SEQ ID NO: 5081147 - DNA, 23 bp, Homo sapiens
aaaggggtcggctgaccatgctc

SEQ ID NO: 5081148 - DNA, 20 bp, Homo sapiens
aaaggggtgattgaaagaaa

SEQ ID NO: 5081149 - DNA, 21 bp, Homo sapiens
aaaggggtgattgaaagaaaa

SEQ ID NO: 5081150 - DNA, 15 bp, Homo sapiens
aaaggggtgctttta

SEQ ID NO: 5081151 - DNA, 20 bp, Homo sapiens
aaaggggttggggtgacagt

SEQ ID NO: 5081152 - DNA, 13 bp, Homo sapiens
aaagggtaaatta

SEQ ID NO: 5081153 - DNA, 21 bp, Homo sapiens
aaagggtaatttcctttgctt

SEQ ID NO: 5081154 - DNA, 21 bp, Homo sapiens
aaagggtagcctacaaatgtt

SEQ ID NO: 5081155 - DNA, 22 bp, Homo sapiens
aaagggtcaatgctatttttgt

SEQ ID NO: 5081156 - DNA, 15 bp, Homo sapiens
aaagggtcaggcccg

SEQ ID NO: 5081157 - DNA, 14 bp, Homo sapiens
aaagggtgaagcta

SEQ ID NO: 5081158 - DNA, 19 bp, Homo sapiens
aaagggtgaagctatttat

SEQ ID NO: 5081159 - DNA, 18 bp, Homo sapiens
aaagggtgctgcttccct

SEQ ID NO: 5081160 - DNA, 21 bp, Homo sapiens
aaagggtggtagttttcccta

SEQ ID NO: 5081161 - DNA, 17 bp, Homo sapiens
aaagggtgtaggggcca

SEQ ID NO: 5081162 - DNA, 23 bp, Homo sapiens
aaagggtgtaggggccacctcct

SEQ ID NO: 5081163 - DNA, 19 bp, Homo sapiens
aaagggtgtatagtgttca

SEQ ID NO: 5081164 - DNA, 21 bp, Homo sapiens
aaagggttcacataggctctc

SEQ ID NO: 5081165 - DNA, 15 bp, Homo sapiens
aaagggttgaaaatg

SEQ ID NO: 5081166 - DNA, 20 bp, Homo sapiens
aaagggttgaaaatgtgttt

SEQ ID NO: 5081167 - DNA, 21 bp, Homo sapiens
aaagggtttgagatgtacatc

SEQ ID NO: 5081168 - DNA, 20 bp, Homo sapiens
aaagggtttgtaatacttta

SEQ ID NO: 5081169 - DNA, 15 bp, Homo sapiens
aaaggtaaaatcact

SEQ ID NO: 5081170 - DNA, 16 bp, Homo sapiens
aaaggtaaaatcactt

SEQ ID NO: 5081171 - DNA, 23 bp, Homo sapiens
aaaggtaaaatcacttcagatct

SEQ ID NO: 5081172 - DNA, 22 bp, Homo sapiens
aaaggtaaaatggcagtttgaa

SEQ ID NO: 5081173 - DNA, 16 bp, Homo sapiens
aaaggtaaatggttaa

SEQ ID NO: 5081174 - DNA, 19 bp, Homo sapiens
aaaggtaaatggttaaatt

SEQ ID NO: 5081175 - DNA, 13 bp, Homo sapiens
aaaggtaactaac

SEQ ID NO: 5081176 - DNA, 22 bp, Homo sapiens
aaaggtacgattatacttgaga

SEQ ID NO: 5081177 - DNA, 20 bp, Homo sapiens
aaaggtagagatgtgtgtgt

SEQ ID NO: 5081178 - DNA, 14 bp, Homo sapiens
aaaggtagagtctt

SEQ ID NO: 5081179 - DNA, 18 bp, Homo sapiens
aaaggtagatcatcttga

SEQ ID NO: 5081180 - DNA, 16 bp, Homo sapiens
aaaggtcacctcactc

SEQ ID NO: 5081181 - DNA, 19 bp, Homo sapiens
aaaggtcacctcactcagc

SEQ ID NO: 5081182 - DNA, 20 bp, Homo sapiens
aaaggtcacctcactcagca

SEQ ID NO: 5081183 - DNA, 17 bp, Homo sapiens
aaaggtcattgtggcta

SEQ ID NO: 5081184 - DNA, 19 bp, Homo sapiens
aaaggtcattgtggctatc

SEQ ID NO: 5081185 - DNA, 17 bp, Homo sapiens
aaaggtccaaaactgta

SEQ ID NO: 5081186 - DNA, 14 bp, Homo sapiens
aaaggtcctgccct

SEQ ID NO: 5081187 - DNA, 15 bp, Homo sapiens
aaaggtcctgccctc

SEQ ID NO: 5081188 - DNA, 22 bp, Homo sapiens
aaaggtgagtttgagctgcctt

SEQ ID NO: 5081189 - DNA, 23 bp, Homo sapiens
aaaggtgagtttgagctgccttc

SEQ ID NO: 5081190 - DNA, 14 bp, Homo sapiens
aaaggtgatatcca

SEQ ID NO: 5081191 - DNA, 22 bp, Homo sapiens
aaagttactaatatatctgtaa

SEQ ID NO: 5081192 - DNA, 12 bp, Homo sapiens
aaagttactagg

SEQ ID NO: 5081193 - DNA, 15 bp, Homo sapiens
aaagttactaggtaa

SEQ ID NO: 5081194 - DNA, 20 bp, Homo sapiens
aaagttactaggtaacttca

SEQ ID NO: 5081195 - DNA, 22 bp, Homo sapiens
aaagttactgatcacaggacgt

SEQ ID NO: 5081196 - DNA, 13 bp, Homo sapiens
aaagttagaatct

SEQ ID NO: 5081197 - DNA, 15 bp, Homo sapiens
aaagttagaatctat

SEQ ID NO: 5081198 - DNA, 19 bp, Homo sapiens
aaagttagaatctattttc

SEQ ID NO: 5081199 - DNA, 18 bp, Homo sapiens
aaagttaggttataagaa

SEQ ID NO: 5081200 - DNA, 20 bp, Homo sapiens
aaagttagtatcttttgata

SEQ ID NO: 5081201 - DNA, 23 bp, Homo sapiens
aaagttagtgtgttgtctgtgca

SEQ ID NO: 5081202 - DNA, 18 bp, Homo sapiens
aaagttataataactgaa

SEQ ID NO: 5081203 - DNA, 13 bp, Homo sapiens
aaagttatatttc

SEQ ID NO: 5081204 - DNA, 24 bp, Homo sapiens
aaagttatatttcagatgtaatgt

SEQ ID NO: 5081205 - DNA, 23 bp, Homo sapiens
aaagttatggtttcctcatttta

SEQ ID NO: 5081206 - DNA, 13 bp, Homo sapiens
aaagttattatgt

SEQ ID NO: 5081207 - DNA, 12 bp, Homo sapiens
aaagttattctt

SEQ ID NO: 5081208 - DNA, 19 bp, Homo sapiens
aaagttattgtgatatcct

SEQ ID NO: 5081209 - DNA, 18 bp, Homo sapiens
aaagttattgtgttgcct

SEQ ID NO: 5081210 - DNA, 13 bp, Homo sapiens
aaagttatttatg

SEQ ID NO: 5081211 - DNA, 22 bp, Homo sapiens
aaagttatttatgctataaatt

SEQ ID NO: 5081212 - DNA, 20 bp, Homo sapiens
aaagttcaatactcttgaaa

SEQ ID NO: 5081213 - DNA, 17 bp, Homo sapiens
aaagttcaattgtgaaa

SEQ ID NO: 5081214 - DNA, 20 bp, Homo sapiens
aaagttcagagttttctggg

SEQ ID NO: 5081215 - DNA, 12 bp, Homo sapiens
aaagttcaggga

SEQ ID NO: 5081216 - DNA, 22 bp, Homo sapiens
aaagttcatagggtctcttcag

SEQ ID NO: 5081217 - DNA, 17 bp, Homo sapiens
aaagttccaaatgttta

SEQ ID NO: 5081218 - DNA, 20 bp, Homo sapiens
aaagttccaaatgtttataa

SEQ ID NO: 5081219 - DNA, 16 bp, Homo sapiens
aaagttccaagagtct

SEQ ID NO: 5081220 - DNA, 23 bp, Homo sapiens
aaagttccacttccaggtctgcc

SEQ ID NO: 5081221 - DNA, 21 bp, Homo sapiens
aaagttccagcagtttcatga

SEQ ID NO: 5081222 - DNA, 16 bp, Homo sapiens
aaagttccagttttgt

SEQ ID NO: 5081223 - DNA, 21 bp, Homo sapiens
aaagttccctacttcctgtga

SEQ ID NO: 5081224 - DNA, 23 bp, Homo sapiens
aaagttccctacttcctgtgact

SEQ ID NO: 5081225 - DNA, 18 bp, Homo sapiens
aaagttccctgaaacacg

SEQ ID NO: 5081226 - DNA, 16 bp, Homo sapiens
aaagttcctctccctt

SEQ ID NO: 5081227 - DNA, 14 bp, Homo sapiens
aaagttcctgttca

SEQ ID NO: 5081228 - DNA, 19 bp, Homo sapiens
aaagttcctgttcacctta

SEQ ID NO: 5081229 - DNA, 12 bp, Homo sapiens
aaagttccttaa

SEQ ID NO: 5081230 - DNA, 11 bp, Homo sapiens
aaagttctaag

SEQ ID NO: 5081231 - DNA, 18 bp, Homo sapiens
aaagttctaataatttct

SEQ ID NO: 5081232 - DNA, 19 bp, Homo sapiens
aaagttctaataatttcta

SEQ ID NO: 5081233 - DNA, 16 bp, Homo sapiens
aaagttctagtgaccg

SEQ ID NO: 5081234 - DNA, 13 bp, Homo sapiens
aaagttctattat

SEQ ID NO: 5081235 - DNA, 20 bp, Homo sapiens
aaagttctattatctgggtt

SEQ ID NO: 5081236 - DNA, 23 bp, Homo sapiens
aaagttctgcagataaacagtag

SEQ ID NO: 5081237 - DNA, 22 bp, Homo sapiens
aaagttctgctttctccccaat

SEQ ID NO: 5081238 - DNA, 13 bp, Homo sapiens
aaagttctgtgta

SEQ ID NO: 5081239 - DNA, 20 bp, Homo sapiens
aaagttctgtgtatttaatt

SEQ ID NO: 5081240 - DNA, 15 bp, Homo sapiens
aaagttcttaaaaca

SEQ ID NO: 5081241 - DNA, 18 bp, Homo sapiens
aaagttcttattttagta

SEQ ID NO: 5081242 - DNA, 13 bp, Homo sapiens
aaagttgaaaagc

SEQ ID NO: 5081243 - DNA, 20 bp, Homo sapiens
aaagttgaaccattatactt

SEQ ID NO: 5081244 - DNA, 17 bp, Homo sapiens
aaagttgaatattatat

SEQ ID NO: 5081245 - DNA, 19 bp, Homo sapiens
aaagttgaatattatatat

SEQ ID NO: 5081246 - DNA, 13 bp, Homo sapiens
aaagttgaattta

SEQ ID NO: 5081247 - DNA, 19 bp, Homo sapiens
aaagttgagagacagtaac

SEQ ID NO: 5081248 - DNA, 17 bp, Homo sapiens
aaagttgataaagattt

SEQ ID NO: 5081249 - DNA, 22 bp, Homo sapiens
aaagttgataggagacttgtac

SEQ ID NO: 5081250 - DNA, 13 bp, Homo sapiens
aaagttgatttct

SEQ ID NO: 5081251 - DNA, 18 bp, Homo sapiens
aaagttgattttgaactt

SEQ ID NO: 5081252 - DNA, 21 bp, Homo sapiens
aaagttgattttgaacttttt

SEQ ID NO: 5081253 - DNA, 17 bp, Homo sapiens
aaagttgcagatgtatt

SEQ ID NO: 5081254 - DNA, 18 bp, Homo sapiens
aaagttgcagatgtattg

SEQ ID NO: 5081255 - DNA, 17 bp, Homo sapiens
aaagttgcagctgtttt

SEQ ID NO: 5081256 - DNA, 18 bp, Homo sapiens
aaagttgcagctgttttg

SEQ ID NO: 5081257 - DNA, 20 bp, Homo sapiens
aaagttgcagctgttttgtt

SEQ ID NO: 5081258 - DNA, 13 bp, Homo sapiens
aaagttgcatttg

SEQ ID NO: 5081259 - DNA, 12 bp, Homo sapiens
aaagttgccatt

SEQ ID NO: 5081260 - DNA, 13 bp, Homo sapiens
aaagttgcctaaa

SEQ ID NO: 5081261 - DNA, 14 bp, Homo sapiens
aaagttgcctaaat

SEQ ID NO: 5081262 - DNA, 17 bp, Homo sapiens
aaagttgcctaaatcca

SEQ ID NO: 5081263 - DNA, 23 bp, Homo sapiens
aaagttgcctttatttgctgtta

SEQ ID NO: 5081264 - DNA, 21 bp, Homo sapiens
aaagttgctaactgggaagaa

SEQ ID NO: 5081265 - DNA, 12 bp, Homo sapiens
aaagttgctttg

SEQ ID NO: 5081266 - DNA, 18 bp, Homo sapiens
aaagttggaaggatctgc

SEQ ID NO: 5081267 - DNA, 13 bp, Homo sapiens
aaagttggactaa

SEQ ID NO: 5081268 - DNA, 15 bp, Homo sapiens
aaagttggagcttct

SEQ ID NO: 5081269 - DNA, 23 bp, Homo sapiens
aaagttggccatgtattatgaaa

SEQ ID NO: 5081270 - DNA, 19 bp, Homo sapiens
aaagttgggaaaagtgtta

SEQ ID NO: 5081271 - DNA, 21 bp, Homo sapiens
aaagttgggcagagaaataca

SEQ ID NO: 5081272 - DNA, 18 bp, Homo sapiens
aaagttgggcccctgagg

SEQ ID NO: 5081273 - DNA, 19 bp, Homo sapiens
aaagttgggcccctgagga

SEQ ID NO: 5081274 - DNA, 16 bp, Homo sapiens
aaagttggtaaacctt

SEQ ID NO: 5081275 - DNA, 17 bp, Homo sapiens
aaagttggtattaataa

SEQ ID NO: 5081276 - DNA, 15 bp, Homo sapiens
aaagttggtatttta

SEQ ID NO: 5081277 - DNA, 19 bp, Homo sapiens
aaagttggtattttataag

SEQ ID NO: 5081278 - DNA, 21 bp, Homo sapiens
aaagttggtattttataagca

SEQ ID NO: 5081279 - DNA, 13 bp, Homo sapiens
aaagttgtaaaat

SEQ ID NO: 5081280 - DNA, 14 bp, Homo sapiens
aaagttgtacatga

SEQ ID NO: 5081281 - DNA, 17 bp, Homo sapiens
aaagttgtacatgaaat

SEQ ID NO: 5081282 - DNA, 16 bp, Homo sapiens
aaagttgtacatgata

SEQ ID NO: 5081283 - DNA, 17 bp, Homo sapiens
aaagttgtactgcatct

SEQ ID NO: 5081284 - DNA, 14 bp, Homo sapiens
aaagttgtacttta

SEQ ID NO: 5081285 - DNA, 14 bp, Homo sapiens
aaagttgtatcagt

SEQ ID NO: 5081286 - DNA, 17 bp, Homo sapiens
aaagttgtatgatctgt

SEQ ID NO: 5081287 - DNA, 14 bp, Homo sapiens
aaagttgtctggct

SEQ ID NO: 5081288 - DNA, 18 bp, Homo sapiens
aaagttgtgattctttga

SEQ ID NO: 5081289 - DNA, 21 bp, Homo sapiens
aaagttgtgcatgtatgtata

SEQ ID NO: 5081290 - DNA, 16 bp, Homo sapiens
aaagttgttcaactat

SEQ ID NO: 5081291 - DNA, 12 bp, Homo sapiens
aaagttgtttaa

SEQ ID NO: 5081292 - DNA, 19 bp, Homo sapiens
aaagttgttttacagctgt

SEQ ID NO: 5081293 - DNA, 15 bp, Homo sapiens
aaagttgttttgatt

SEQ ID NO: 5081294 - DNA, 12 bp, Homo sapiens
aaagtttaaaat

SEQ ID NO: 5081295 - DNA, 14 bp, Homo sapiens
aaagtttaaagaag

SEQ ID NO: 5081296 - DNA, 15 bp, Homo sapiens
aaagtttaaatacca

SEQ ID NO: 5081297 - DNA, 17 bp, Homo sapiens
aaagtttaaataccagt

SEQ ID NO: 5081298 - DNA, 13 bp, Homo sapiens
aaagtttaaatgt

SEQ ID NO: 5081299 - DNA, 17 bp, Homo sapiens
aaagtttaaatgtattt

SEQ ID NO: 5081300 - DNA, 20 bp, Homo sapiens
aaagtttaacctaaataatt

SEQ ID NO: 5081301 - DNA, 13 bp, Homo sapiens
aaagtttaagctg

SEQ ID NO: 5081302 - DNA, 15 bp, Homo sapiens
aaagtttaataaatt

SEQ ID NO: 5081303 - DNA, 16 bp, Homo sapiens
aaagtttaatattaaa

SEQ ID NO: 5081304 - DNA, 19 bp, Homo sapiens
aaagtttaatattaaagcc

SEQ ID NO: 5081305 - DNA, 12 bp, Homo sapiens
aaagtttacaac

SEQ ID NO: 5081306 - DNA, 19 bp, Homo sapiens
aaagtttacaagtgtatat

SEQ ID NO: 5081307 - DNA, 18 bp, Homo sapiens
aaagtttacagtaaataa

SEQ ID NO: 5081308 - DNA, 21 bp, Homo sapiens
aaagtttacagtaaataaatt

SEQ ID NO: 5081309 - DNA, 21 bp, Homo sapiens
aaagtttagatctagaagctg

SEQ ID NO: 5081310 - DNA, 12 bp, Homo sapiens
aaagtttcaaaa

SEQ ID NO: 5081311 - DNA, 22 bp, Homo sapiens
aaagtttcacaacagatttcta

SEQ ID NO: 5081312 - DNA, 14 bp, Homo sapiens
aaagtttccatatg

SEQ ID NO: 5081313 - DNA, 18 bp, Homo sapiens
aaagtttccatgtggcct

SEQ ID NO: 5081314 - DNA, 22 bp, Homo sapiens
aaagtttccccaccagtgaatg

SEQ ID NO: 5081315 - DNA, 10 bp, Homo sapiens
aaagtttccg

SEQ ID NO: 5081316 - DNA, 20 bp, Homo sapiens
aaagtttcctaatcagaaat

SEQ ID NO: 5081317 - DNA, 22 bp, Homo sapiens
aaagtttcctaggatgtcatgt

SEQ ID NO: 5081318 - DNA, 21 bp, Homo sapiens
aaagtttcgacttatttctta

SEQ ID NO: 5081319 - DNA, 19 bp, Homo sapiens
aaagtttctaatgttattt

SEQ ID NO: 5081320 - DNA, 23 bp, Homo sapiens
aaagtttctaatgttattttcct

SEQ ID NO: 5081321 - DNA, 14 bp, Homo sapiens
aaagtttctatttt

SEQ ID NO: 5081322 - DNA, 12 bp, Homo sapiens
aaagtttctcag

SEQ ID NO: 5081323 - DNA, 15 bp, Homo sapiens
aaagtttctgttgaa

SEQ ID NO: 5081324 - DNA, 18 bp, Homo sapiens
aaagtttcttggtctcag

SEQ ID NO: 5081325 - DNA, 13 bp, Homo sapiens
aaagtttctttga

SEQ ID NO: 5081326 - DNA, 13 bp, Homo sapiens
aaagtttgatctt

SEQ ID NO: 5081327 - DNA, 24 bp, Homo sapiens
aaagtttgatcttcctctgctaaa

SEQ ID NO: 5081328 - DNA, 15 bp, Homo sapiens
aaagtttgccagaag

SEQ ID NO: 5081329 - DNA, 13 bp, Homo sapiens
aaagtttgccagg

SEQ ID NO: 5081330 - DNA, 23 bp, Homo sapiens
aaagtttgctgaaagatatgtat

SEQ ID NO: 5081331 - DNA, 16 bp, Homo sapiens
aaagtttgcttagaaa

SEQ ID NO: 5081332 - DNA, 18 bp, Homo sapiens
aaagtttggtattgtaaa

SEQ ID NO: 5081333 - DNA, 17 bp, Homo sapiens
aaagtttggttttgaca

SEQ ID NO: 5081334 - DNA, 18 bp, Homo sapiens
aaagtttgtagcattttt

SEQ ID NO: 5081335 - DNA, 19 bp, Homo sapiens
aaagtttgtagcatttttc

SEQ ID NO: 5081336 - DNA, 19 bp, Homo sapiens
aaagtttgtggtaatttgt

SEQ ID NO: 5081337 - DNA, 11 bp, Homo sapiens
aaagtttgttc

SEQ ID NO: 5081338 - DNA, 13 bp, Homo sapiens
aaagtttgttgaa

SEQ ID NO: 5081339 - DNA, 17 bp, Homo sapiens
aaagttttaatacctaa

SEQ ID NO: 5081340 - DNA, 15 bp, Homo sapiens
aaagttttacaaagg

SEQ ID NO: 5081341 - DNA, 14 bp, Homo sapiens
aaagttttacagag

SEQ ID NO: 5081342 - DNA, 22 bp, Homo sapiens
aaagttttacagagaggataca

SEQ ID NO: 5081343 - DNA, 16 bp, Homo sapiens
aaagttttatgtactt

SEQ ID NO: 5081344 - DNA, 16 bp, Homo sapiens
aaagttttatttttct

SEQ ID NO: 5081345 - DNA, 19 bp, Homo sapiens
aaagttttcaaattatttt

SEQ ID NO: 5081346 - DNA, 14 bp, Homo sapiens
aaagttttccagta

SEQ ID NO: 5081347 - DNA, 15 bp, Homo sapiens
aaagttttccagtat

SEQ ID NO: 5081348 - DNA, 18 bp, Homo sapiens
aaagttttgaaaagctat

SEQ ID NO: 5081349 - DNA, 19 bp, Homo sapiens
aaagttttgagtagatatt

SEQ ID NO: 5081350 - DNA, 23 bp, Homo sapiens
aaagttttgagtagatattactt

SEQ ID NO: 5081351 - DNA, 16 bp, Homo sapiens
aaagttttgatattta

SEQ ID NO: 5081352 - DNA, 16 bp, Homo sapiens
aaagttttgcaaaggg

SEQ ID NO: 5081353 - DNA, 13 bp, Homo sapiens
aaagttttgccta

SEQ ID NO: 5081354 - DNA, 13 bp, Homo sapiens
aaagttttgtaaa

SEQ ID NO: 5081355 - DNA, 18 bp, Homo sapiens
aaagttttgtaaaagaaa

SEQ ID NO: 5081356 - DNA, 17 bp, Homo sapiens
aaagttttgtacaaagt

SEQ ID NO: 5081357 - DNA, 19 bp, Homo sapiens
aaagtttttaatttgatgc

SEQ ID NO: 5081358 - DNA, 16 bp, Homo sapiens
aaagtttttacagtgt

SEQ ID NO: 5081359 - DNA, 19 bp, Homo sapiens
aaagtttttatggaagggt

SEQ ID NO: 5081360 - DNA, 11 bp, Homo sapiens
aaagtttttta

SEQ ID NO: 5081361 - DNA, 22 bp, Homo sapiens
aaataaaaaaaaaaggatgaaa

SEQ ID NO: 5081362 - DNA, 18 bp, Homo sapiens
aaataaaaaaagaaaaaa

SEQ ID NO: 5081363 - DNA, 18 bp, Homo sapiens
aaataaaaaaatacagta

SEQ ID NO: 5081364 - DNA, 19 bp, Homo sapiens
aaataaaaaaatacagtaa

SEQ ID NO: 5081365 - DNA, 23 bp, Homo sapiens
aaataaaaaaatacagtaaagtt

SEQ ID NO: 5081366 - DNA, 16 bp, Homo sapiens
aaataaaaaaattaaa

SEQ ID NO: 5081367 - DNA, 13 bp, Homo sapiens
aaataaaaaagtc

SEQ ID NO: 5081368 - DNA, 15 bp, Homo sapiens
aaataaaaaatattg

SEQ ID NO: 5081369 - DNA, 18 bp, Homo sapiens
aaataaaaacaaacgttt

SEQ ID NO: 5081370 - DNA, 22 bp, Homo sapiens
aaataaaaacacaccttaaaac

SEQ ID NO: 5081371 - DNA, 12 bp, Homo sapiens
aaaggtgattaa

SEQ ID NO: 5081372 - DNA, 14 bp, Homo sapiens
aaaggtgattttcc

SEQ ID NO: 5081373 - DNA, 15 bp, Homo sapiens
aaaggtgcactccag

SEQ ID NO: 5081374 - DNA, 22 bp, Homo sapiens
aaaggtgcctcatagcatagcc

SEQ ID NO: 5081375 - DNA, 12 bp, Homo sapiens
aaaggtgctcaa

SEQ ID NO: 5081376 - DNA, 13 bp, Homo sapiens
aaaggtgctcaaa

SEQ ID NO: 5081377 - DNA, 19 bp, Homo sapiens
aaaggtgctcaaagatgta

SEQ ID NO: 5081378 - DNA, 23 bp, Homo sapiens
aaaggtgctcaaagatgtactga

SEQ ID NO: 5081379 - DNA, 20 bp, Homo sapiens
aaaggtggaataaacattaa

SEQ ID NO: 5081380 - DNA, 18 bp, Homo sapiens
aaaggtggcaatgcttaa

SEQ ID NO: 5081381 - DNA, 15 bp, Homo sapiens
aaaggtggtaaattc

SEQ ID NO: 5081382 - DNA, 18 bp, Homo sapiens
aaaggtggtgaggcaata

SEQ ID NO: 5081383 - DNA, 12 bp, Homo sapiens
aaaggtggtggt

SEQ ID NO: 5081384 - DNA, 15 bp, Homo sapiens
aaaggtgtaaaacag

SEQ ID NO: 5081385 - DNA, 17 bp, Homo sapiens
aaaggtgtaaaacagta

SEQ ID NO: 5081386 - DNA, 12 bp, Homo sapiens
aaaggtgtcttc

SEQ ID NO: 5081387 - DNA, 15 bp, Homo sapiens
aaaggtgtgaggaga

SEQ ID NO: 5081388 - DNA, 14 bp, Homo sapiens
aaaggtgttgtccc

SEQ ID NO: 5081389 - DNA, 15 bp, Homo sapiens
aaaggttaacagtaa

SEQ ID NO: 5081390 - DNA, 14 bp, Homo sapiens
aaaggttactgttt

SEQ ID NO: 5081391 - DNA, 14 bp, Homo sapiens
aaaggttaggagag

SEQ ID NO: 5081392 - DNA, 15 bp, Homo sapiens
aaaggttcctttgtt

SEQ ID NO: 5081393 - DNA, 21 bp, Homo sapiens
aaaggttcctttgttccctaa

SEQ ID NO: 5081394 - DNA, 14 bp, Homo sapiens
aaaggttcttcatc

SEQ ID NO: 5081395 - DNA, 20 bp, Homo sapiens
aaaggttcttctggtgagtg

SEQ ID NO: 5081396 - DNA, 15 bp, Homo sapiens
aaaggttgaattaat

SEQ ID NO: 5081397 - DNA, 16 bp, Homo sapiens
aaaggtttacagaatt

SEQ ID NO: 5081398 - DNA, 16 bp, Homo sapiens
aaaggtttatgaaaaa

SEQ ID NO: 5081399 - DNA, 19 bp, Homo sapiens
aaaggtttatgaaaaagaa

SEQ ID NO: 5081400 - DNA, 16 bp, Homo sapiens
aaaggtttatttttct

SEQ ID NO: 5081401 - DNA, 21 bp, Homo sapiens
aaaggtttatttttctgttac

SEQ ID NO: 5081402 - DNA, 22 bp, Homo sapiens
aaaggtttcatgtagattttag

SEQ ID NO: 5081403 - DNA, 19 bp, Homo sapiens
aaaggtttgcattctcaca

SEQ ID NO: 5081404 - DNA, 16 bp, Homo sapiens
aaaggttttattttgt

SEQ ID NO: 5081405 - DNA, 15 bp, Homo sapiens
aaaggttttctcaaa

SEQ ID NO: 5081406 - DNA, 19 bp, Homo sapiens
aaaggtttttaaattgttt

SEQ ID NO: 5081407 - DNA, 23 bp, Homo sapiens
aaaggtttttgaaatccaggaat

SEQ ID NO: 5081408 - DNA, 16 bp, Homo sapiens
aaagtaaaaaaataat

SEQ ID NO: 5081409 - DNA, 16 bp, Homo sapiens
aaagtaaaaaagttaa

SEQ ID NO: 5081410 - DNA, 21 bp, Homo sapiens
aaagtaaaaacaaagaaatta

SEQ ID NO: 5081411 - DNA, 20 bp, Homo sapiens
aaagtaaaaagggaattatg

SEQ ID NO: 5081412 - DNA, 14 bp, Homo sapiens
aaagtaaaaattaa

SEQ ID NO: 5081413 - DNA, 14 bp, Homo sapiens
aaagtaaaaattga

SEQ ID NO: 5081414 - DNA, 19 bp, Homo sapiens
aaagtaaaaccataaacat

SEQ ID NO: 5081415 - DNA, 18 bp, Homo sapiens
aaagtaaaagaaccacga

SEQ ID NO: 5081416 - DNA, 16 bp, Homo sapiens
aaagtaaaaggcactg

SEQ ID NO: 5081417 - DNA, 12 bp, Homo sapiens
aaagtaaaatat

SEQ ID NO: 5081418 - DNA, 13 bp, Homo sapiens
aaagtaaaattat

SEQ ID NO: 5081419 - DNA, 13 bp, Homo sapiens
aaagtaaactgtg

SEQ ID NO: 5081420 - DNA, 12 bp, Homo sapiens
aaagtaaagcta

SEQ ID NO: 5081421 - DNA, 14 bp, Homo sapiens
aaagtaaagtacaa

SEQ ID NO: 5081422 - DNA, 13 bp, Homo sapiens
aaagtaaattatt

SEQ ID NO: 5081423 - DNA, 19 bp, Homo sapiens
aaagtaacaaggtgtcttt

SEQ ID NO: 5081424 - DNA, 18 bp, Homo sapiens
aaagtaactcatttgtta

SEQ ID NO: 5081425 - DNA, 22 bp, Homo sapiens
aaagtaactcatttgttaaaat

SEQ ID NO: 5081426 - DNA, 16 bp, Homo sapiens
aaagtaagaaaacaat

SEQ ID NO: 5081427 - DNA, 23 bp, Homo sapiens
aaagtaagaacagctcatcttca

SEQ ID NO: 5081428 - DNA, 18 bp, Homo sapiens
aaagtaagcatttccagc

SEQ ID NO: 5081429 - DNA, 14 bp, Homo sapiens
aaagtaaggtgcag

SEQ ID NO: 5081430 - DNA, 22 bp, Homo sapiens
aaagtaagttaataatgtattg

SEQ ID NO: 5081431 - DNA, 23 bp, Homo sapiens
aaagtaagttaataatgtattgt

SEQ ID NO: 5081432 - DNA, 16 bp, Homo sapiens
aaagtaataaagagaa

SEQ ID NO: 5081433 - DNA, 17 bp, Homo sapiens
aaagtaataatgtgcaa

SEQ ID NO: 5081434 - DNA, 18 bp, Homo sapiens
aaagtaatatttattaaa

SEQ ID NO: 5081435 - DNA, 13 bp, Homo sapiens
aaagtaatcactt

SEQ ID NO: 5081436 - DNA, 17 bp, Homo sapiens
aaagtaatgatctcaaa

SEQ ID NO: 5081437 - DNA, 12 bp, Homo sapiens
aaagtaatgtaa

SEQ ID NO: 5081438 - DNA, 19 bp, Homo sapiens
aaagtaatttaatttgtaa

SEQ ID NO: 5081439 - DNA, 16 bp, Homo sapiens
aaagtaatttcaagaa

SEQ ID NO: 5081440 - DNA, 22 bp, Homo sapiens
aaagtaatttcttctcaaaggg

SEQ ID NO: 5081441 - DNA, 13 bp, Homo sapiens
aaagtaattttgt

SEQ ID NO: 5081442 - DNA, 15 bp, Homo sapiens
aaagtacaaatgaag

SEQ ID NO: 5081443 - DNA, 17 bp, Homo sapiens
aaagtacaaatgaagaa

SEQ ID NO: 5081444 - DNA, 19 bp, Homo sapiens
aaagtacactgtttcaaac

SEQ ID NO: 5081445 - DNA, 19 bp, Homo sapiens
aaagtacagaaaaatactt

SEQ ID NO: 5081446 - DNA, 14 bp, Homo sapiens
aaagtacaggtact

SEQ ID NO: 5081447 - DNA, 20 bp, Homo sapiens
aaagtacaggtactttgtct

SEQ ID NO: 5081448 - DNA, 13 bp, Homo sapiens
aaagtacatagtg

SEQ ID NO: 5081449 - DNA, 20 bp, Homo sapiens
aaagtaccaactgagccaaa

SEQ ID NO: 5081450 - DNA, 17 bp, Homo sapiens
aaagtaccacacaaact

SEQ ID NO: 5081451 - DNA, 15 bp, Homo sapiens
aaagtaccacactga

SEQ ID NO: 5081452 - DNA, 16 bp, Homo sapiens
aaagtaccacactgag

SEQ ID NO: 5081453 - DNA, 17 bp, Homo sapiens
aaagtaccacactgagt

SEQ ID NO: 5081454 - DNA, 18 bp, Homo sapiens
aaagtaccacattccatg

SEQ ID NO: 5081455 - DNA, 15 bp, Homo sapiens
aaagtaccagcatgt

SEQ ID NO: 5081456 - DNA, 19 bp, Homo sapiens
aaagtaccatagaacagaa

SEQ ID NO: 5081457 - DNA, 17 bp, Homo sapiens
aaagtacgtgtttactt

SEQ ID NO: 5081458 - DNA, 19 bp, Homo sapiens
aaagtactaaaactagata

SEQ ID NO: 5081459 - DNA, 14 bp, Homo sapiens
aaagtactagctaa

SEQ ID NO: 5081460 - DNA, 14 bp, Homo sapiens
aaagtactctttaa

SEQ ID NO: 5081461 - DNA, 16 bp, Homo sapiens
aaagtactctttaaca

SEQ ID NO: 5081462 - DNA, 13 bp, Homo sapiens
aaagtactgagca

SEQ ID NO: 5081463 - DNA, 21 bp, Homo sapiens
aaagtacttgactacctactg

SEQ ID NO: 5081464 - DNA, 19 bp, Homo sapiens
aaagtactttcttataaat

SEQ ID NO: 5081465 - DNA, 15 bp, Homo sapiens
aaagtagaactttgt

SEQ ID NO: 5081466 - DNA, 16 bp, Homo sapiens
aaagtagaactttgta

SEQ ID NO: 5081467 - DNA, 20 bp, Homo sapiens
aaagtagaagagggttttag

SEQ ID NO: 5081468 - DNA, 20 bp, Homo sapiens
aaagtagaagtcttagatgt

SEQ ID NO: 5081469 - DNA, 22 bp, Homo sapiens
aaagtagaagtcttagatgtat

SEQ ID NO: 5081470 - DNA, 14 bp, Homo sapiens
aaagtagaattata

SEQ ID NO: 5081471 - DNA, 15 bp, Homo sapiens
aaagtagacaaatgg

SEQ ID NO: 5081472 - DNA, 20 bp, Homo sapiens
aaagtagacaatcattgttt

SEQ ID NO: 5081473 - DNA, 22 bp, Homo sapiens
aaagtagatcatgcatagagtg

SEQ ID NO: 5081474 - DNA, 20 bp, Homo sapiens
aaagtagattaaaatatttg

SEQ ID NO: 5081475 - DNA, 18 bp, Homo sapiens
aaagtagcaaaacaaatt

SEQ ID NO: 5081476 - DNA, 22 bp, Homo sapiens
aaagtagcaaaacaaattcaaa

SEQ ID NO: 5081477 - DNA, 23 bp, Homo sapiens
aaagtagcaaaacaaattcaaat

SEQ ID NO: 5081478 - DNA, 18 bp, Homo sapiens
aaagtagcaaatgtttac

SEQ ID NO: 5081479 - DNA, 22 bp, Homo sapiens
aaagtagcaaccttcattttac

SEQ ID NO: 5081480 - DNA, 23 bp, Homo sapiens
aaagtagcaaccttcattttaca

SEQ ID NO: 5081481 - DNA, 12 bp, Homo sapiens
aaagtagggggc

SEQ ID NO: 5081482 - DNA, 14 bp, Homo sapiens
aaagtagtaaaaat

SEQ ID NO: 5081483 - DNA, 12 bp, Homo sapiens
aaagtagtactt

SEQ ID NO: 5081484 - DNA, 20 bp, Homo sapiens
aaagtagtacttcttctgta

SEQ ID NO: 5081485 - DNA, 21 bp, Homo sapiens
aaagtagtacttcttctgtaa

SEQ ID NO: 5081486 - DNA, 16 bp, Homo sapiens
aaagtagtcctgtgaa

SEQ ID NO: 5081487 - DNA, 19 bp, Homo sapiens
aaagtataaaattatattt

SEQ ID NO: 5081488 - DNA, 14 bp, Homo sapiens
aaagtataatcttt

SEQ ID NO: 5081489 - DNA, 20 bp, Homo sapiens
aaagtataatgtttattaaa

SEQ ID NO: 5081490 - DNA, 17 bp, Homo sapiens
aaagtataatttcagtg

SEQ ID NO: 5081491 - DNA, 13 bp, Homo sapiens
aaagtatacatgt

SEQ ID NO: 5081492 - DNA, 14 bp, Homo sapiens
aaagtatagaaata

SEQ ID NO: 5081493 - DNA, 13 bp, Homo sapiens
aaagtatagagag

SEQ ID NO: 5081494 - DNA, 14 bp, Homo sapiens
aaagtatatacaga

SEQ ID NO: 5081495 - DNA, 15 bp, Homo sapiens
aaagtatatacagag

SEQ ID NO: 5081496 - DNA, 16 bp, Homo sapiens
aaagtatatacagagc

SEQ ID NO: 5081497 - DNA, 22 bp, Homo sapiens
aaagtatatatatatattatat

SEQ ID NO: 5081498 - DNA, 14 bp, Homo sapiens
aaagtatatattct

SEQ ID NO: 5081499 - DNA, 14 bp, Homo sapiens
aaagtatatattta

SEQ ID NO: 5081500 - DNA, 15 bp, Homo sapiens
aaagtatatatttat

SEQ ID NO: 5081501 - DNA, 23 bp, Homo sapiens
aaagtatatatttatttaagctt

SEQ ID NO: 5081502 - DNA, 12 bp, Homo sapiens
aaagtatatgtg

SEQ ID NO: 5081503 - DNA, 22 bp, Homo sapiens
aaagtatatgttctgattatgt

SEQ ID NO: 5081504 - DNA, 14 bp, Homo sapiens
aaagtatcaaagaa

SEQ ID NO: 5081505 - DNA, 17 bp, Homo sapiens
aaagtatcactctaaaa

SEQ ID NO: 5081506 - DNA, 15 bp, Homo sapiens
aaagtatcgggggct

SEQ ID NO: 5081507 - DNA, 17 bp, Homo sapiens
aaagtatctctactttc

SEQ ID NO: 5081508 - DNA, 21 bp, Homo sapiens
aaagtatctctactttcctga

SEQ ID NO: 5081509 - DNA, 18 bp, Homo sapiens
aaagtatctttaacaatt

SEQ ID NO: 5081510 - DNA, 12 bp, Homo sapiens
aaagtatgaatc

SEQ ID NO: 5081511 - DNA, 20 bp, Homo sapiens
aaagtatgcattattaaatt

SEQ ID NO: 5081512 - DNA, 19 bp, Homo sapiens
aaagtatgtaaagtatgta

SEQ ID NO: 5081513 - DNA, 17 bp, Homo sapiens
aaagtatgtattattta

SEQ ID NO: 5081514 - DNA, 16 bp, Homo sapiens
aaagtatgtccttcag

SEQ ID NO: 5081515 - DNA, 18 bp, Homo sapiens
aaagtattccaccttaaa

SEQ ID NO: 5081516 - DNA, 14 bp, Homo sapiens
aaagtattcgttac

SEQ ID NO: 5081517 - DNA, 20 bp, Homo sapiens
aaagtattctcaaagatgca

SEQ ID NO: 5081518 - DNA, 16 bp, Homo sapiens
aaagtattctccatcc

SEQ ID NO: 5081519 - DNA, 14 bp, Homo sapiens
aaagtattctcttt

SEQ ID NO: 5081520 - DNA, 13 bp, Homo sapiens
aaagtattctgat

SEQ ID NO: 5081521 - DNA, 20 bp, Homo sapiens
aaagtattcttcttttctta

SEQ ID NO: 5081522 - DNA, 18 bp, Homo sapiens
aaagtattctttttcttt

SEQ ID NO: 5081523 - DNA, 13 bp, Homo sapiens
aaagtattgccaa

SEQ ID NO: 5081524 - DNA, 14 bp, Homo sapiens
aaagtattgccaaa

SEQ ID NO: 5081525 - DNA, 16 bp, Homo sapiens
aaagtattggcattca

SEQ ID NO: 5081526 - DNA, 23 bp, Homo sapiens
aaagtattgtaaattatatttgt

SEQ ID NO: 5081527 - DNA, 18 bp, Homo sapiens
aaagtatttaattagtgc

SEQ ID NO: 5081528 - DNA, 21 bp, Homo sapiens
aaagtatttaattagtgctaa

SEQ ID NO: 5081529 - DNA, 23 bp, Homo sapiens
aaagtatttaattagtgctaagt

SEQ ID NO: 5081530 - DNA, 21 bp, Homo sapiens
aaagtatttactgactgctta

SEQ ID NO: 5081531 - DNA, 16 bp, Homo sapiens
aaagtattttaatttt

SEQ ID NO: 5081532 - DNA, 21 bp, Homo sapiens
aaagtattttaattttaaaga

SEQ ID NO: 5081533 - DNA, 19 bp, Homo sapiens
aaagtattttattcttatt

SEQ ID NO: 5081534 - DNA, 12 bp, Homo sapiens
aaagtattttcc

SEQ ID NO: 5081535 - DNA, 13 bp, Homo sapiens
aaagtattttcct

SEQ ID NO: 5081536 - DNA, 17 bp, Homo sapiens
aaagtattttcctgtaa

SEQ ID NO: 5081537 - DNA, 14 bp, Homo sapiens
aaagtattttcttt

SEQ ID NO: 5081538 - DNA, 14 bp, Homo sapiens
aaagtattttgaag

SEQ ID NO: 5081539 - DNA, 15 bp, Homo sapiens
aaagtattttgaagt

SEQ ID NO: 5081540 - DNA, 21 bp, Homo sapiens
aaagtattttgaagtttacat

SEQ ID NO: 5081541 - DNA, 22 bp, Homo sapiens
aaagtattttgaagtttacatt

SEQ ID NO: 5081542 - DNA, 12 bp, Homo sapiens
aaagtattttgg

SEQ ID NO: 5081543 - DNA, 18 bp, Homo sapiens
aaagtatttttataatga

SEQ ID NO: 5081544 - DNA, 21 bp, Homo sapiens
aaagtatttttttcttttttc

SEQ ID NO: 5081545 - DNA, 20 bp, Homo sapiens
aaagtcaaaaggtgcctgtg

SEQ ID NO: 5081546 - DNA, 17 bp, Homo sapiens
aaagtcaaatttacttt

SEQ ID NO: 5081547 - DNA, 20 bp, Homo sapiens
aaagtcaaatttactttaaa

SEQ ID NO: 5081548 - DNA, 15 bp, Homo sapiens
aaagtcacacagaca

SEQ ID NO: 5081549 - DNA, 17 bp, Homo sapiens
aaagtcacacagacaca

SEQ ID NO: 5081550 - DNA, 18 bp, Homo sapiens
aaagtcacacagacacac

SEQ ID NO: 5081551 - DNA, 12 bp, Homo sapiens
aaataaaaacca

SEQ ID NO: 5081552 - DNA, 17 bp, Homo sapiens
aaataaaaaccaaatta

SEQ ID NO: 5081553 - DNA, 15 bp, Homo sapiens
aaataaaaaccagaa

SEQ ID NO: 5081554 - DNA, 14 bp, Homo sapiens
aaataaaaactaaa

SEQ ID NO: 5081555 - DNA, 10 bp, Homo sapiens
aaataaaaag

SEQ ID NO: 5081556 - DNA, 12 bp, Homo sapiens
aaataaaaagag

SEQ ID NO: 5081557 - DNA, 13 bp, Homo sapiens
aaataaaaagaga

SEQ ID NO: 5081558 - DNA, 23 bp, Homo sapiens
aaataaaaagggcagccctcctt

SEQ ID NO: 5081559 - DNA, 14 bp, Homo sapiens
aaataaaaagtgac

SEQ ID NO: 5081560 - DNA, 21 bp, Homo sapiens
aaataaaaagtgacacagcag

SEQ ID NO: 5081561 - DNA, 19 bp, Homo sapiens
aaataaaaagttaaaaagt

SEQ ID NO: 5081562 - DNA, 14 bp, Homo sapiens
aaataaaaataata

SEQ ID NO: 5081563 - DNA, 16 bp, Homo sapiens
aaataaaaatattctc

SEQ ID NO: 5081564 - DNA, 14 bp, Homo sapiens
aaataaaaatattg

SEQ ID NO: 5081565 - DNA, 15 bp, Homo sapiens
aaataaaaatggata

SEQ ID NO: 5081566 - DNA, 17 bp, Homo sapiens
aaataaaaatggcaaat

SEQ ID NO: 5081567 - DNA, 22 bp, Homo sapiens
aaataaaaatggcaaatgcact

SEQ ID NO: 5081568 - DNA, 13 bp, Homo sapiens
aaataaaaattct

SEQ ID NO: 5081569 - DNA, 20 bp, Homo sapiens
aaataaaacaaagggcacag

SEQ ID NO: 5081570 - DNA, 17 bp, Homo sapiens
aaataaaacaagcctta

SEQ ID NO: 5081571 - DNA, 13 bp, Homo sapiens
aaataaaacaatg

SEQ ID NO: 5081572 - DNA, 12 bp, Homo sapiens
aaataaaacaca

SEQ ID NO: 5081573 - DNA, 18 bp, Homo sapiens
aaataaaacattttcaca

SEQ ID NO: 5081574 - DNA, 22 bp, Homo sapiens
aaataaaacattttcacacaat

SEQ ID NO: 5081575 - DNA, 14 bp, Homo sapiens
aaataaaaccagaa

SEQ ID NO: 5081576 - DNA, 21 bp, Homo sapiens
aaataaaacccgttgattact

SEQ ID NO: 5081577 - DNA, 19 bp, Homo sapiens
aaataaaacctcagctagc

SEQ ID NO: 5081578 - DNA, 12 bp, Homo sapiens
aaataaaacctt

SEQ ID NO: 5081579 - DNA, 13 bp, Homo sapiens
aaataaaaccttt

SEQ ID NO: 5081580 - DNA, 17 bp, Homo sapiens
aaataaaacctttcaaa

SEQ ID NO: 5081581 - DNA, 19 bp, Homo sapiens
aaataaaactaaggaaccc

SEQ ID NO: 5081582 - DNA, 21 bp, Homo sapiens
aaataaaactaaggaaccctg

SEQ ID NO: 5081583 - DNA, 18 bp, Homo sapiens
aaataaaacttgagccca

SEQ ID NO: 5081584 - DNA, 13 bp, Homo sapiens
aaataaaactttt

SEQ ID NO: 5081585 - DNA, 19 bp, Homo sapiens
aaataaaactttttaaaat

SEQ ID NO: 5081586 - DNA, 11 bp, Homo sapiens
aaataaaagaa

SEQ ID NO: 5081587 - DNA, 20 bp, Homo sapiens
aaataaaagaaatgcacaat

SEQ ID NO: 5081588 - DNA, 16 bp, Homo sapiens
aaataaaagagagaga

SEQ ID NO: 5081589 - DNA, 14 bp, Homo sapiens
aaataaaagctatt

SEQ ID NO: 5081590 - DNA, 19 bp, Homo sapiens
aaataaaaggactgtgatt

SEQ ID NO: 5081591 - DNA, 17 bp, Homo sapiens
aaataaaagtacagttt

SEQ ID NO: 5081592 - DNA, 12 bp, Homo sapiens
aaataaaataaa

SEQ ID NO: 5081593 - DNA, 14 bp, Homo sapiens
aaataaaataaagc

SEQ ID NO: 5081594 - DNA, 14 bp, Homo sapiens
aaataaaataaatt

SEQ ID NO: 5081595 - DNA, 12 bp, Homo sapiens
aaataaaataga

SEQ ID NO: 5081596 - DNA, 13 bp, Homo sapiens
aaataaaatataa

SEQ ID NO: 5081597 - DNA, 14 bp, Homo sapiens
aaataaaatattta

SEQ ID NO: 5081598 - DNA, 21 bp, Homo sapiens
aaataaaatcaccaaaaacat

SEQ ID NO: 5081599 - DNA, 15 bp, Homo sapiens
aaataaaatgaaaat

SEQ ID NO: 5081600 - DNA, 19 bp, Homo sapiens
aaataaaatgaaaattgta

SEQ ID NO: 5081601 - DNA, 16 bp, Homo sapiens
aaataaaatgaccagt

SEQ ID NO: 5081602 - DNA, 14 bp, Homo sapiens
aaataaaatgatgt

SEQ ID NO: 5081603 - DNA, 15 bp, Homo sapiens
aaataaaatggattt

SEQ ID NO: 5081604 - DNA, 16 bp, Homo sapiens
aaataaaatgtgtaca

SEQ ID NO: 5081605 - DNA, 14 bp, Homo sapiens
aaataaaatgtttc

SEQ ID NO: 5081606 - DNA, 12 bp, Homo sapiens
aaataaaattcc

SEQ ID NO: 5081607 - DNA, 15 bp, Homo sapiens
aaataaaatttgttg

SEQ ID NO: 5081608 - DNA, 17 bp, Homo sapiens
aaataaaatttgttgca

SEQ ID NO: 5081609 - DNA, 13 bp, Homo sapiens
aaataaaattttt

SEQ ID NO: 5081610 - DNA, 13 bp, Homo sapiens
aaataaacacagt

SEQ ID NO: 5081611 - DNA, 23 bp, Homo sapiens
aaataaacacatagattcacctg

SEQ ID NO: 5081612 - DNA, 11 bp, Homo sapiens
aaataaacact

SEQ ID NO: 5081613 - DNA, 13 bp, Homo sapiens
aaataaacactgg

SEQ ID NO: 5081614 - DNA, 20 bp, Homo sapiens
aaataaacactggtgccaac

SEQ ID NO: 5081615 - DNA, 12 bp, Homo sapiens
aaataaacagct

SEQ ID NO: 5081616 - DNA, 13 bp, Homo sapiens
aaataaacagcta

SEQ ID NO: 5081617 - DNA, 18 bp, Homo sapiens
aaataaacattttgtcca

SEQ ID NO: 5081618 - DNA, 22 bp, Homo sapiens
aaataaaccaaaggacattatg

SEQ ID NO: 5081619 - DNA, 14 bp, Homo sapiens
aaataaaccaaata

SEQ ID NO: 5081620 - DNA, 13 bp, Homo sapiens
aaataaaccactg

SEQ ID NO: 5081621 - DNA, 19 bp, Homo sapiens
aaataaaccattggacaga

SEQ ID NO: 5081622 - DNA, 12 bp, Homo sapiens
aaataaacctga

SEQ ID NO: 5081623 - DNA, 18 bp, Homo sapiens
aaataaacctgcactgaa

SEQ ID NO: 5081624 - DNA, 21 bp, Homo sapiens
aaataaaccttgtttctttct

SEQ ID NO: 5081625 - DNA, 15 bp, Homo sapiens
aaataaacgagtgaa

SEQ ID NO: 5081626 - DNA, 20 bp, Homo sapiens
aaataaacggactcagtgga

SEQ ID NO: 5081627 - DNA, 16 bp, Homo sapiens
aaataaacgtcttaaa

SEQ ID NO: 5081628 - DNA, 14 bp, Homo sapiens
aaataaacgtgcgc

SEQ ID NO: 5081629 - DNA, 18 bp, Homo sapiens
aaataaacgtggatttta

SEQ ID NO: 5081630 - DNA, 21 bp, Homo sapiens
aaataaactagggttttggcc

SEQ ID NO: 5081631 - DNA, 12 bp, Homo sapiens
aaataaactagt

SEQ ID NO: 5081632 - DNA, 14 bp, Homo sapiens
aaataaactctaaa

SEQ ID NO: 5081633 - DNA, 12 bp, Homo sapiens
aaataaactctt

SEQ ID NO: 5081634 - DNA, 17 bp, Homo sapiens
aaataaactgtaaacta

SEQ ID NO: 5081635 - DNA, 14 bp, Homo sapiens
aaataaactgttta

SEQ ID NO: 5081636 - DNA, 16 bp, Homo sapiens
aaataaactgttttca

SEQ ID NO: 5081637 - DNA, 14 bp, Homo sapiens
aaataaacttctta

SEQ ID NO: 5081638 - DNA, 11 bp, Homo sapiens
aaataaacttt

SEQ ID NO: 5081639 - DNA, 21 bp, Homo sapiens
aaataaactttcttaatattt

SEQ ID NO: 5081640 - DNA, 18 bp, Homo sapiens
aaataaactttttttcaa

SEQ ID NO: 5081641 - DNA, 20 bp, Homo sapiens
aaataaactttttttcaatg

SEQ ID NO: 5081642 - DNA, 22 bp, Homo sapiens
aaataaactttttttcaatgtg

SEQ ID NO: 5081643 - DNA, 20 bp, Homo sapiens
aaataaagaagaaaataacc

SEQ ID NO: 5081644 - DNA, 13 bp, Homo sapiens
aaataaagaagta

SEQ ID NO: 5081645 - DNA, 17 bp, Homo sapiens
aaataaagactcttgga

SEQ ID NO: 5081646 - DNA, 14 bp, Homo sapiens
aaataaagagagaa

SEQ ID NO: 5081647 - DNA, 22 bp, Homo sapiens
aaataaagagagaacaggacta

SEQ ID NO: 5081648 - DNA, 15 bp, Homo sapiens
aaataaagagccata

SEQ ID NO: 5081649 - DNA, 15 bp, Homo sapiens
aaataaagcatctca

SEQ ID NO: 5081650 - DNA, 11 bp, Homo sapiens
aaataaagcct

SEQ ID NO: 5081651 - DNA, 13 bp, Homo sapiens
aaataaagctact

SEQ ID NO: 5081652 - DNA, 17 bp, Homo sapiens
aaataaagctactgaat

SEQ ID NO: 5081653 - DNA, 18 bp, Homo sapiens
aaataaagctactgaatt

SEQ ID NO: 5081654 - DNA, 12 bp, Homo sapiens
aaataaagctgt

SEQ ID NO: 5081655 - DNA, 19 bp, Homo sapiens
aaataaaggaaaacaaaaa

SEQ ID NO: 5081656 - DNA, 20 bp, Homo sapiens
aaataaaggcgctaatttat

SEQ ID NO: 5081657 - DNA, 17 bp, Homo sapiens
aaataaaggctctgtgc

SEQ ID NO: 5081658 - DNA, 19 bp, Homo sapiens
aaataaagggaagaaagga

SEQ ID NO: 5081659 - DNA, 20 bp, Homo sapiens
aaataaaggtaaaatcactt

SEQ ID NO: 5081660 - DNA, 14 bp, Homo sapiens
aaataaagtaactt

SEQ ID NO: 5081661 - DNA, 13 bp, Homo sapiens
aaataaagtatat

SEQ ID NO: 5081662 - DNA, 16 bp, Homo sapiens
aaataaagtatatata

SEQ ID NO: 5081663 - DNA, 18 bp, Homo sapiens
aaataaagtatcatgcat

SEQ ID NO: 5081664 - DNA, 13 bp, Homo sapiens
aaataaagtgtgt

SEQ ID NO: 5081665 - DNA, 16 bp, Homo sapiens
aaataaagtgtgtgtg

SEQ ID NO: 5081666 - DNA, 19 bp, Homo sapiens
aaataaagttggtcttttg

SEQ ID NO: 5081667 - DNA, 10 bp, Homo sapiens
aaataaataa

SEQ ID NO: 5081668 - DNA, 14 bp, Homo sapiens
aaataaataaaagc

SEQ ID NO: 5081669 - DNA, 16 bp, Homo sapiens
aaataaataaaatgga

SEQ ID NO: 5081670 - DNA, 14 bp, Homo sapiens
aaataaataaactt

SEQ ID NO: 5081671 - DNA, 12 bp, Homo sapiens
aaataaataaat

SEQ ID NO: 5081672 - DNA, 11 bp, Homo sapiens
aaataaataat

SEQ ID NO: 5081673 - DNA, 16 bp, Homo sapiens
aaataaataatctcat

SEQ ID NO: 5081674 - DNA, 15 bp, Homo sapiens
aaataaatagaaaga

SEQ ID NO: 5081675 - DNA, 15 bp, Homo sapiens
aaataaatagatgta

SEQ ID NO: 5081676 - DNA, 16 bp, Homo sapiens
aaataaatagctatat

SEQ ID NO: 5081677 - DNA, 11 bp, Homo sapiens
aaataaatata

SEQ ID NO: 5081678 - DNA, 13 bp, Homo sapiens
aaataaatataat

SEQ ID NO: 5081679 - DNA, 14 bp, Homo sapiens
aaataaatataatt

SEQ ID NO: 5081680 - DNA, 15 bp, Homo sapiens
aaataaatatatata

SEQ ID NO: 5081681 - DNA, 15 bp, Homo sapiens
aaataaatattttac

SEQ ID NO: 5081682 - DNA, 14 bp, Homo sapiens
aaataaatcacaga

SEQ ID NO: 5081683 - DNA, 15 bp, Homo sapiens
aaataaatcacagat

SEQ ID NO: 5081684 - DNA, 17 bp, Homo sapiens
aaataaatcatcctcat

SEQ ID NO: 5081685 - DNA, 19 bp, Homo sapiens
aaataaatcttagtgttca

SEQ ID NO: 5081686 - DNA, 11 bp, Homo sapiens
aaataaatgaa

SEQ ID NO: 5081687 - DNA, 15 bp, Homo sapiens
aaataaatgaaactt

SEQ ID NO: 5081688 - DNA, 11 bp, Homo sapiens
aaataaatgct

SEQ ID NO: 5081689 - DNA, 21 bp, Homo sapiens
aaataaatggtttctgaaaat

SEQ ID NO: 5081690 - DNA, 11 bp, Homo sapiens
aaataaatgtt

SEQ ID NO: 5081691 - DNA, 15 bp, Homo sapiens
aaataaatgtttcaa

SEQ ID NO: 5081692 - DNA, 17 bp, Homo sapiens
aaataaatgtttttatt

SEQ ID NO: 5081693 - DNA, 16 bp, Homo sapiens
aaataaattacacttt

SEQ ID NO: 5081694 - DNA, 17 bp, Homo sapiens
aaataaattagttgtta

SEQ ID NO: 5081695 - DNA, 11 bp, Homo sapiens
aaataaattat

SEQ ID NO: 5081696 - DNA, 15 bp, Homo sapiens
aaataaattctctcc

SEQ ID NO: 5081697 - DNA, 16 bp, Homo sapiens
aaataaattctctcct

SEQ ID NO: 5081698 - DNA, 14 bp, Homo sapiens
aaataaattctgat

SEQ ID NO: 5081699 - DNA, 18 bp, Homo sapiens
aaataaattgtatattca

SEQ ID NO: 5081700 - DNA, 21 bp, Homo sapiens
aaataaattgtatattcactt

SEQ ID NO: 5081701 - DNA, 17 bp, Homo sapiens
aaataaattgtgaaaaa

SEQ ID NO: 5081702 - DNA, 13 bp, Homo sapiens
aaataaattgttt

SEQ ID NO: 5081703 - DNA, 13 bp, Homo sapiens
aaataaatttccc

SEQ ID NO: 5081704 - DNA, 13 bp, Homo sapiens
aaataaatttctg

SEQ ID NO: 5081705 - DNA, 19 bp, Homo sapiens
aaataaattttgtttcaga

SEQ ID NO: 5081706 - DNA, 14 bp, Homo sapiens
aaataacaaaaaag

SEQ ID NO: 5081707 - DNA, 19 bp, Homo sapiens
aaataacaaaaaagagaaa

SEQ ID NO: 5081708 - DNA, 20 bp, Homo sapiens
aaataacaaatgccaaatta

SEQ ID NO: 5081709 - DNA, 19 bp, Homo sapiens
aaataacaactatttttgt

SEQ ID NO: 5081710 - DNA, 22 bp, Homo sapiens
aaataacaactgagatgttaaa

SEQ ID NO: 5081711 - DNA, 22 bp, Homo sapiens
aaataacaatgtcttcttgaaa

SEQ ID NO: 5081712 - DNA, 17 bp, Homo sapiens
aaataacaatgtgctct

SEQ ID NO: 5081713 - DNA, 14 bp, Homo sapiens
aaataacaatgtta

SEQ ID NO: 5081714 - DNA, 18 bp, Homo sapiens
aaataacacagatattgt

SEQ ID NO: 5081715 - DNA, 23 bp, Homo sapiens
aaataacacagatattgttataa

SEQ ID NO: 5081716 - DNA, 19 bp, Homo sapiens
aaataacactgttggcact

SEQ ID NO: 5081717 - DNA, 14 bp, Homo sapiens
aaataacagtattt

SEQ ID NO: 5081718 - DNA, 17 bp, Homo sapiens
aaataacatattcttgc

SEQ ID NO: 5081719 - DNA, 13 bp, Homo sapiens
aaataacatcatt

SEQ ID NO: 5081720 - DNA, 20 bp, Homo sapiens
aaataacatcattgtattaa

SEQ ID NO: 5081721 - DNA, 13 bp, Homo sapiens
aaataacattgca

SEQ ID NO: 5081722 - DNA, 14 bp, Homo sapiens
aaataacattgcac

SEQ ID NO: 5081723 - DNA, 16 bp, Homo sapiens
aaataaccaaaaaatg

SEQ ID NO: 5081724 - DNA, 19 bp, Homo sapiens
aaataaccaatcctggaca

SEQ ID NO: 5081725 - DNA, 18 bp, Homo sapiens
aaataaccaatctacaat

SEQ ID NO: 5081726 - DNA, 15 bp, Homo sapiens
aaataacccataatt

SEQ ID NO: 5081727 - DNA, 19 bp, Homo sapiens
aaataacctataaagtgtt

SEQ ID NO: 5081728 - DNA, 17 bp, Homo sapiens
aaataacctctggccct

SEQ ID NO: 5081729 - DNA, 19 bp, Homo sapiens
aaataacctctggcccttg

SEQ ID NO: 5081730 - DNA, 21 bp, Homo sapiens
aaataactactgcaaaaagta

SEQ ID NO: 5081731 - DNA, 17 bp, Homo sapiens
aaataactagtgttgct

SEQ ID NO: 5081732 - DNA, 12 bp, Homo sapiens
aaataactatat

SEQ ID NO: 5081733 - DNA, 13 bp, Homo sapiens
aaataactatttt

SEQ ID NO: 5081734 - DNA, 20 bp, Homo sapiens
aaataactattttgttttaa

SEQ ID NO: 5081735 - DNA, 14 bp, Homo sapiens
aaataactgaacca

SEQ ID NO: 5081736 - DNA, 15 bp, Homo sapiens
aaagtcacaggaaga

SEQ ID NO: 5081737 - DNA, 22 bp, Homo sapiens
aaagtcaccattctgcatttag

SEQ ID NO: 5081738 - DNA, 19 bp, Homo sapiens
aaagtcacccaaacacttc

SEQ ID NO: 5081739 - DNA, 15 bp, Homo sapiens
aaagtcacctacagg

SEQ ID NO: 5081740 - DNA, 14 bp, Homo sapiens
aaagtcacttctcc

SEQ ID NO: 5081741 - DNA, 14 bp, Homo sapiens
aaagtcagaatcag

SEQ ID NO: 5081742 - DNA, 21 bp, Homo sapiens
aaagtcagaccctaggaagct

SEQ ID NO: 5081743 - DNA, 19 bp, Homo sapiens
aaagtcagagttaaaatat

SEQ ID NO: 5081744 - DNA, 15 bp, Homo sapiens
aaagtcagatgacta

SEQ ID NO: 5081745 - DNA, 21 bp, Homo sapiens
aaagtcagtgttgaattttat

SEQ ID NO: 5081746 - DNA, 11 bp, Homo sapiens
aaagtcatccc

SEQ ID NO: 5081747 - DNA, 19 bp, Homo sapiens
aaagtcatcccctctcagg

SEQ ID NO: 5081748 - DNA, 18 bp, Homo sapiens
aaagtcatgatgttttta

SEQ ID NO: 5081749 - DNA, 16 bp, Homo sapiens
aaagtcattaaagaca

SEQ ID NO: 5081750 - DNA, 12 bp, Homo sapiens
aaagtcattatt

SEQ ID NO: 5081751 - DNA, 15 bp, Homo sapiens
aaagtcattattcct

SEQ ID NO: 5081752 - DNA, 22 bp, Homo sapiens
aaagtcattgctgacagagccc

SEQ ID NO: 5081753 - DNA, 13 bp, Homo sapiens
aaagtcattggct

SEQ ID NO: 5081754 - DNA, 14 bp, Homo sapiens
aaagtcattggctt

SEQ ID NO: 5081755 - DNA, 23 bp, Homo sapiens
aaagtcattggctttatcctctt

SEQ ID NO: 5081756 - DNA, 15 bp, Homo sapiens
aaagtccaagtctgt

SEQ ID NO: 5081757 - DNA, 23 bp, Homo sapiens
aaagtccacacaaagattttcta

SEQ ID NO: 5081758 - DNA, 12 bp, Homo sapiens
aaagtccagatt

SEQ ID NO: 5081759 - DNA, 15 bp, Homo sapiens
aaagtccattgatgt

SEQ ID NO: 5081760 - DNA, 16 bp, Homo sapiens
aaagtccattgatgtc

SEQ ID NO: 5081761 - DNA, 12 bp, Homo sapiens
aaagtccccaga

SEQ ID NO: 5081762 - DNA, 22 bp, Homo sapiens
aaagtccccctcctcagccagc

SEQ ID NO: 5081763 - DNA, 14 bp, Homo sapiens
aaagtccctccctg

SEQ ID NO: 5081764 - DNA, 12 bp, Homo sapiens
aaagtcccttcc

SEQ ID NO: 5081765 - DNA, 21 bp, Homo sapiens
aaagtcccttcctgcttcctg

SEQ ID NO: 5081766 - DNA, 17 bp, Homo sapiens
aaagtcccttgagactc

SEQ ID NO: 5081767 - DNA, 20 bp, Homo sapiens
aaagtcctgaacctttcaaa

SEQ ID NO: 5081768 - DNA, 21 bp, Homo sapiens
aaagtcctgaacctttcaaaa

SEQ ID NO: 5081769 - DNA, 18 bp, Homo sapiens
aaagtcctgtcagttcag

SEQ ID NO: 5081770 - DNA, 13 bp, Homo sapiens
aaagtccttttct

SEQ ID NO: 5081771 - DNA, 18 bp, Homo sapiens
aaagtccttttcttgctt

SEQ ID NO: 5081772 - DNA, 18 bp, Homo sapiens
aaagtcctttttttccat

SEQ ID NO: 5081773 - DNA, 15 bp, Homo sapiens
aaagtcgttttccaa

SEQ ID NO: 5081774 - DNA, 12 bp, Homo sapiens
aaagtctaaagt

SEQ ID NO: 5081775 - DNA, 16 bp, Homo sapiens
aaagtctaaagtttac

SEQ ID NO: 5081776 - DNA, 14 bp, Homo sapiens
aaagtctaagcaag

SEQ ID NO: 5081777 - DNA, 19 bp, Homo sapiens
aaagtctaagcaagatgtt

SEQ ID NO: 5081778 - DNA, 14 bp, Homo sapiens
aaagtctagaaaat

SEQ ID NO: 5081779 - DNA, 14 bp, Homo sapiens
aaagtctatgctta

SEQ ID NO: 5081780 - DNA, 12 bp, Homo sapiens
aaagtctatttt

SEQ ID NO: 5081781 - DNA, 19 bp, Homo sapiens
aaagtctcaatgttccatt

SEQ ID NO: 5081782 - DNA, 12 bp, Homo sapiens
aaagtctccagc

SEQ ID NO: 5081783 - DNA, 14 bp, Homo sapiens
aaagtctcctgtat

SEQ ID NO: 5081784 - DNA, 18 bp, Homo sapiens
aaagtctctaattctatt

SEQ ID NO: 5081785 - DNA, 15 bp, Homo sapiens
aaagtctgagttctc

SEQ ID NO: 5081786 - DNA, 22 bp, Homo sapiens
aaagtctgtccttgaaggacta

SEQ ID NO: 5081787 - DNA, 18 bp, Homo sapiens
aaagtctgtctttcctga

SEQ ID NO: 5081788 - DNA, 20 bp, Homo sapiens
aaagtctgttgattaaagat

SEQ ID NO: 5081789 - DNA, 18 bp, Homo sapiens
aaagtcttgaatgttgaa

SEQ ID NO: 5081790 - DNA, 13 bp, Homo sapiens
aaagtcttgctgt

SEQ ID NO: 5081791 - DNA, 18 bp, Homo sapiens
aaagtcttggttttatct

SEQ ID NO: 5081792 - DNA, 17 bp, Homo sapiens
aaagtcttgtctggtga

SEQ ID NO: 5081793 - DNA, 18 bp, Homo sapiens
aaagtcttgtgactagtg

SEQ ID NO: 5081794 - DNA, 21 bp, Homo sapiens
aaagtcttgtgactagtgctg

SEQ ID NO: 5081795 - DNA, 14 bp, Homo sapiens
aaagtcttgttaat

SEQ ID NO: 5081796 - DNA, 23 bp, Homo sapiens
aaagtcttgttaattactatatt

SEQ ID NO: 5081797 - DNA, 15 bp, Homo sapiens
aaagtcttttaaaaa

SEQ ID NO: 5081798 - DNA, 12 bp, Homo sapiens
aaagtgaaatta

SEQ ID NO: 5081799 - DNA, 22 bp, Homo sapiens
aaagtgaaattagtattttgag

SEQ ID NO: 5081800 - DNA, 14 bp, Homo sapiens
aaagtgaacacaca

SEQ ID NO: 5081801 - DNA, 16 bp, Homo sapiens
aaagtgaactctattt

SEQ ID NO: 5081802 - DNA, 19 bp, Homo sapiens
aaagtgaactctattttga

SEQ ID NO: 5081803 - DNA, 15 bp, Homo sapiens
aaagtgaacttttgt

SEQ ID NO: 5081804 - DNA, 19 bp, Homo sapiens
aaagtgaacttttgtaatt

SEQ ID NO: 5081805 - DNA, 23 bp, Homo sapiens
aaagtgaacttttgtaatttgaa

SEQ ID NO: 5081806 - DNA, 23 bp, Homo sapiens
aaagtgaagcaaatcagaaactt

SEQ ID NO: 5081807 - DNA, 13 bp, Homo sapiens
aaagtgaaggaaa

SEQ ID NO: 5081808 - DNA, 15 bp, Homo sapiens
aaagtgaaggaaata

SEQ ID NO: 5081809 - DNA, 15 bp, Homo sapiens
aaagtgaataaactt

SEQ ID NO: 5081810 - DNA, 18 bp, Homo sapiens
aaagtgaataaacttcag

SEQ ID NO: 5081811 - DNA, 21 bp, Homo sapiens
aaagtgaataaacttcagcac

SEQ ID NO: 5081812 - DNA, 15 bp, Homo sapiens
aaagtgaatttgaat

SEQ ID NO: 5081813 - DNA, 17 bp, Homo sapiens
aaagtgaatttgaatga

SEQ ID NO: 5081814 - DNA, 15 bp, Homo sapiens
aaagtgacagagacc

SEQ ID NO: 5081815 - DNA, 17 bp, Homo sapiens
aaagtgacagatgttat

SEQ ID NO: 5081816 - DNA, 13 bp, Homo sapiens
aaagtgacatttg

SEQ ID NO: 5081817 - DNA, 23 bp, Homo sapiens
aaagtgaccaggctcacaactgt

SEQ ID NO: 5081818 - DNA, 16 bp, Homo sapiens
aaagtgagatgggaag

SEQ ID NO: 5081819 - DNA, 22 bp, Homo sapiens
aaagtgaggaagcctaaataaa

SEQ ID NO: 5081820 - DNA, 20 bp, Homo sapiens
aaagtgaggccactgaagag

SEQ ID NO: 5081821 - DNA, 18 bp, Homo sapiens
aaagtgagtactgttaag

SEQ ID NO: 5081822 - DNA, 20 bp, Homo sapiens
aaagtgagtctgaattgttg

SEQ ID NO: 5081823 - DNA, 15 bp, Homo sapiens
aaagtgataagtgca

SEQ ID NO: 5081824 - DNA, 19 bp, Homo sapiens
aaagtgatcagcaatgaag

SEQ ID NO: 5081825 - DNA, 22 bp, Homo sapiens
aaagtgatcagtatgctgtttt

SEQ ID NO: 5081826 - DNA, 23 bp, Homo sapiens
aaagtgatcagtatgctgtttta

SEQ ID NO: 5081827 - DNA, 20 bp, Homo sapiens
aaagtgatctgtcccctctc

SEQ ID NO: 5081828 - DNA, 21 bp, Homo sapiens
aaagtgatcttgagaaccttt

SEQ ID NO: 5081829 - DNA, 17 bp, Homo sapiens
aaagtgatgacatattt

SEQ ID NO: 5081830 - DNA, 20 bp, Homo sapiens
aaagtgatttgtaatatgat

SEQ ID NO: 5081831 - DNA, 19 bp, Homo sapiens
aaagtgattttatttttgc

SEQ ID NO: 5081832 - DNA, 23 bp, Homo sapiens
aaagtgattttatttttgcaaaa

SEQ ID NO: 5081833 - DNA, 15 bp, Homo sapiens
aaagtgcaaagctgc

SEQ ID NO: 5081834 - DNA, 14 bp, Homo sapiens
aaagtgcaatgcgt

SEQ ID NO: 5081835 - DNA, 16 bp, Homo sapiens
aaagtgcaattgcaca

SEQ ID NO: 5081836 - DNA, 15 bp, Homo sapiens
aaagtgcacacacac

SEQ ID NO: 5081837 - DNA, 21 bp, Homo sapiens
aaagtgcagcccttcctcctg

SEQ ID NO: 5081838 - DNA, 23 bp, Homo sapiens
aaagtgcagctccgtttggcagt

SEQ ID NO: 5081839 - DNA, 15 bp, Homo sapiens
aaagtgcatgatggt

SEQ ID NO: 5081840 - DNA, 19 bp, Homo sapiens
aaagtgcattattttattg

SEQ ID NO: 5081841 - DNA, 12 bp, Homo sapiens
aaagtgcattca

SEQ ID NO: 5081842 - DNA, 15 bp, Homo sapiens
aaagtgcatttaagg

SEQ ID NO: 5081843 - DNA, 14 bp, Homo sapiens
aaagtgcatttttg

SEQ ID NO: 5081844 - DNA, 20 bp, Homo sapiens
aaagtgccaaaataaagtct

SEQ ID NO: 5081845 - DNA, 19 bp, Homo sapiens
aaagtgccagcattccaga

SEQ ID NO: 5081846 - DNA, 15 bp, Homo sapiens
aaagtgccagtattt

SEQ ID NO: 5081847 - DNA, 19 bp, Homo sapiens
aaagtgccagtattttaaa

SEQ ID NO: 5081848 - DNA, 22 bp, Homo sapiens
aaagtgccagtttgcttagttc

SEQ ID NO: 5081849 - DNA, 12 bp, Homo sapiens
aaagtgcccagc

SEQ ID NO: 5081850 - DNA, 12 bp, Homo sapiens
aaagtgccctca

SEQ ID NO: 5081851 - DNA, 21 bp, Homo sapiens
aaagtgccgtgataatttttg

SEQ ID NO: 5081852 - DNA, 17 bp, Homo sapiens
aaagtgcctcaagagga

SEQ ID NO: 5081853 - DNA, 22 bp, Homo sapiens
aaagtgcctcaagaggaatgaa

SEQ ID NO: 5081854 - DNA, 21 bp, Homo sapiens
aaagtgccttatcaaataata

SEQ ID NO: 5081855 - DNA, 19 bp, Homo sapiens
aaagtgcctttcaggatct

SEQ ID NO: 5081856 - DNA, 20 bp, Homo sapiens
aaagtgcctttcaggatcta

SEQ ID NO: 5081857 - DNA, 23 bp, Homo sapiens
aaagtgcctttcaggatctattt

SEQ ID NO: 5081858 - DNA, 22 bp, Homo sapiens
aaagtgcgtgtgtgtatgtgtg

SEQ ID NO: 5081859 - DNA, 15 bp, Homo sapiens
aaagtgcgttctccc

SEQ ID NO: 5081860 - DNA, 17 bp, Homo sapiens
aaagtgctaaggttcta

SEQ ID NO: 5081861 - DNA, 21 bp, Homo sapiens
aaagtgctaaggttctaaggc

SEQ ID NO: 5081862 - DNA, 11 bp, Homo sapiens
aaagtgctctt

SEQ ID NO: 5081863 - DNA, 13 bp, Homo sapiens
aaagtgctgagat

SEQ ID NO: 5081864 - DNA, 20 bp, Homo sapiens
aaagtgctgcagggctttaa

SEQ ID NO: 5081865 - DNA, 22 bp, Homo sapiens
aaagtgctgcagggctttaaaa

SEQ ID NO: 5081866 - DNA, 15 bp, Homo sapiens
aaagtgctggaactt

SEQ ID NO: 5081867 - DNA, 17 bp, Homo sapiens
aaagtgctggattgtcc

SEQ ID NO: 5081868 - DNA, 18 bp, Homo sapiens
aaagtgctgggattacag

SEQ ID NO: 5081869 - DNA, 22 bp, Homo sapiens
aaagtgctgggattacaggcat

SEQ ID NO: 5081870 - DNA, 12 bp, Homo sapiens
aaagtgctgttt

SEQ ID NO: 5081871 - DNA, 12 bp, Homo sapiens
aaagtgcttaag

SEQ ID NO: 5081872 - DNA, 14 bp, Homo sapiens
aaagtgcttccttt

SEQ ID NO: 5081873 - DNA, 16 bp, Homo sapiens
aaagtgcttgtgtaat

SEQ ID NO: 5081874 - DNA, 23 bp, Homo sapiens
aaagtgctttgacttcttgcttc

SEQ ID NO: 5081875 - DNA, 13 bp, Homo sapiens
aaagtgctttttc

SEQ ID NO: 5081876 - DNA, 19 bp, Homo sapiens
aaagtggaaaacaaggaag

SEQ ID NO: 5081877 - DNA, 14 bp, Homo sapiens
aaagtggaaaacat

SEQ ID NO: 5081878 - DNA, 13 bp, Homo sapiens
aaagtggaaggaa

SEQ ID NO: 5081879 - DNA, 18 bp, Homo sapiens
aaagtggaatcactgtat

SEQ ID NO: 5081880 - DNA, 15 bp, Homo sapiens
aaagtggaatttctt

SEQ ID NO: 5081881 - DNA, 22 bp, Homo sapiens
aaagtggaatttcttgtttctc

SEQ ID NO: 5081882 - DNA, 17 bp, Homo sapiens
aaagtggagaagcacac

SEQ ID NO: 5081883 - DNA, 13 bp, Homo sapiens
aaagtggcaagct

SEQ ID NO: 5081884 - DNA, 22 bp, Homo sapiens
aaagtggcacctgtctgctcca

SEQ ID NO: 5081885 - DNA, 16 bp, Homo sapiens
aaagtggcagggaccg

SEQ ID NO: 5081886 - DNA, 15 bp, Homo sapiens
aaagtggcatagaga

SEQ ID NO: 5081887 - DNA, 18 bp, Homo sapiens
aaagtggcctctttgtct

SEQ ID NO: 5081888 - DNA, 21 bp, Homo sapiens
aaagtggcgtgggagccagcc

SEQ ID NO: 5081889 - DNA, 21 bp, Homo sapiens
aaagtggctcttctaacctca

SEQ ID NO: 5081890 - DNA, 16 bp, Homo sapiens
aaagtggctgcggtgt

SEQ ID NO: 5081891 - DNA, 21 bp, Homo sapiens
aaagtgggaggtcaggaaact

SEQ ID NO: 5081892 - DNA, 17 bp, Homo sapiens
aaagtgggctgcagcag

SEQ ID NO: 5081893 - DNA, 17 bp, Homo sapiens
aaagtgggcttgattct

SEQ ID NO: 5081894 - DNA, 14 bp, Homo sapiens
aaagtgggcttgga

SEQ ID NO: 5081895 - DNA, 14 bp, Homo sapiens
aaagtgggggtgga

SEQ ID NO: 5081896 - DNA, 16 bp, Homo sapiens
aaagtggggtacagta

SEQ ID NO: 5081897 - DNA, 18 bp, Homo sapiens
aaagtggggtacagtaaa

SEQ ID NO: 5081898 - DNA, 20 bp, Homo sapiens
aaagtgggtactttctgaaa

SEQ ID NO: 5081899 - DNA, 21 bp, Homo sapiens
aaagtgggtactttctgaaaa

SEQ ID NO: 5081900 - DNA, 16 bp, Homo sapiens
aaagtgggtttcaatt

SEQ ID NO: 5081901 - DNA, 17 bp, Homo sapiens
aaagtgggtttcaattt

SEQ ID NO: 5081902 - DNA, 20 bp, Homo sapiens
aaagtggtacttgatcattt

SEQ ID NO: 5081903 - DNA, 14 bp, Homo sapiens
aaagtggtctctgc

SEQ ID NO: 5081904 - DNA, 18 bp, Homo sapiens
aaagtggtctctgctggg

SEQ ID NO: 5081905 - DNA, 16 bp, Homo sapiens
aaagtggtctgaactg

SEQ ID NO: 5081906 - DNA, 12 bp, Homo sapiens
aaagtggtgaga

SEQ ID NO: 5081907 - DNA, 16 bp, Homo sapiens
aaagtggtgctcagtt

SEQ ID NO: 5081908 - DNA, 19 bp, Homo sapiens
aaagtggtgctcagttgta

SEQ ID NO: 5081909 - DNA, 19 bp, Homo sapiens
aaagtggttctctgccttt

SEQ ID NO: 5081910 - DNA, 12 bp, Homo sapiens
aaagtgtaaagc

SEQ ID NO: 5081911 - DNA, 22 bp, Homo sapiens
aaagtgtaattccacatcatgt

SEQ ID NO: 5081912 - DNA, 14 bp, Homo sapiens
aaagtgtacatgaa

SEQ ID NO: 5081913 - DNA, 10 bp, Homo sapiens
aaagtgtatt

SEQ ID NO: 5081914 - DNA, 16 bp, Homo sapiens
aaagtgtattgcaagt

SEQ ID NO: 5081915 - DNA, 20 bp, Homo sapiens
aaagtgtattgcaagtgaaa

SEQ ID NO: 5081916 - DNA, 17 bp, Homo sapiens
aaataactgaaccaaat

SEQ ID NO: 5081917 - DNA, 19 bp, Homo sapiens
aaataactgaaccaaattg

SEQ ID NO: 5081918 - DNA, 21 bp, Homo sapiens
aaataactgaaccaaattgca

SEQ ID NO: 5081919 - DNA, 13 bp, Homo sapiens
aaataactggaaa

SEQ ID NO: 5081920 - DNA, 15 bp, Homo sapiens
aaataactgtaatta

SEQ ID NO: 5081921 - DNA, 12 bp, Homo sapiens
aaataactgtga

SEQ ID NO: 5081922 - DNA, 12 bp, Homo sapiens
aaataactgtgc

SEQ ID NO: 5081923 - DNA, 18 bp, Homo sapiens
aaataacttcaagcaaac

SEQ ID NO: 5081924 - DNA, 14 bp, Homo sapiens
aaataacttcagtc

SEQ ID NO: 5081925 - DNA, 19 bp, Homo sapiens
aaataacttgtgttactaa

SEQ ID NO: 5081926 - DNA, 22 bp, Homo sapiens
aaataacttgtgttactaattt

SEQ ID NO: 5081927 - DNA, 15 bp, Homo sapiens
aaataactttttctg

SEQ ID NO: 5081928 - DNA, 12 bp, Homo sapiens
aaataagaaaag

SEQ ID NO: 5081929 - DNA, 12 bp, Homo sapiens
aaataagaaact

SEQ ID NO: 5081930 - DNA, 21 bp, Homo sapiens
aaataagaaacttttttattt

SEQ ID NO: 5081931 - DNA, 20 bp, Homo sapiens
aaataagaacgaggatttta

SEQ ID NO: 5081932 - DNA, 14 bp, Homo sapiens
aaataagaagaatg

SEQ ID NO: 5081933 - DNA, 13 bp, Homo sapiens
aaataagacaata

SEQ ID NO: 5081934 - DNA, 21 bp, Homo sapiens
aaataagacaatagtatttct

SEQ ID NO: 5081935 - DNA, 23 bp, Homo sapiens
aaataagacttctggtgctgctg

SEQ ID NO: 5081936 - DNA, 12 bp, Homo sapiens
aaataagagaga

SEQ ID NO: 5081937 - DNA, 13 bp, Homo sapiens
aaataagattcta

SEQ ID NO: 5081938 - DNA, 12 bp, Homo sapiens
aaataagcacta

SEQ ID NO: 5081939 - DNA, 13 bp, Homo sapiens
aaataagcaggtg

SEQ ID NO: 5081940 - DNA, 20 bp, Homo sapiens
aaataagccccctcaactac

SEQ ID NO: 5081941 - DNA, 19 bp, Homo sapiens
aaataagtaaataataaat

SEQ ID NO: 5081942 - DNA, 12 bp, Homo sapiens
aaataagtaaca

SEQ ID NO: 5081943 - DNA, 15 bp, Homo sapiens
aaataagtatttata

SEQ ID NO: 5081944 - DNA, 17 bp, Homo sapiens
aaataagtatttctgat

SEQ ID NO: 5081945 - DNA, 16 bp, Homo sapiens
aaataagtcaaaagga

SEQ ID NO: 5081946 - DNA, 21 bp, Homo sapiens
aaataagtcaacagtaaacca

SEQ ID NO: 5081947 - DNA, 22 bp, Homo sapiens
aaataagtcattttaataacta

SEQ ID NO: 5081948 - DNA, 20 bp, Homo sapiens
aaataagtcctaaagtgaag

SEQ ID NO: 5081949 - DNA, 22 bp, Homo sapiens
aaataagtgaatctaataaaat

SEQ ID NO: 5081950 - DNA, 17 bp, Homo sapiens
aaataagtggattttgt

SEQ ID NO: 5081951 - DNA, 21 bp, Homo sapiens
aaataagtggattttgtattt

SEQ ID NO: 5081952 - DNA, 20 bp, Homo sapiens
aaataagtgtattttgaaat

SEQ ID NO: 5081953 - DNA, 12 bp, Homo sapiens
aaataagttaaa

SEQ ID NO: 5081954 - DNA, 13 bp, Homo sapiens
aaataagttaaag

SEQ ID NO: 5081955 - DNA, 17 bp, Homo sapiens
aaataagttttatacat

SEQ ID NO: 5081956 - DNA, 19 bp, Homo sapiens
aaataagttttatacataa

SEQ ID NO: 5081957 - DNA, 13 bp, Homo sapiens
aaataagtttttg

SEQ ID NO: 5081958 - DNA, 16 bp, Homo sapiens
aaataagtttttgttt

SEQ ID NO: 5081959 - DNA, 19 bp, Homo sapiens
aaataagttttttttctgg

SEQ ID NO: 5081960 - DNA, 14 bp, Homo sapiens
aaataataaaaaga

SEQ ID NO: 5081961 - DNA, 13 bp, Homo sapiens
aaataataaaaga

SEQ ID NO: 5081962 - DNA, 16 bp, Homo sapiens
aaataataaaagaatc

SEQ ID NO: 5081963 - DNA, 15 bp, Homo sapiens
aaataataaaatgca

SEQ ID NO: 5081964 - DNA, 11 bp, Homo sapiens
aaataataaag

SEQ ID NO: 5081965 - DNA, 19 bp, Homo sapiens
aaataataaagatggtttt

SEQ ID NO: 5081966 - DNA, 14 bp, Homo sapiens
aaataataaaggtt

SEQ ID NO: 5081967 - DNA, 17 bp, Homo sapiens
aaataataaaggttcta

SEQ ID NO: 5081968 - DNA, 18 bp, Homo sapiens
aaataataaaggttctat

SEQ ID NO: 5081969 - DNA, 20 bp, Homo sapiens
aaataataaaggttctatga

SEQ ID NO: 5081970 - DNA, 12 bp, Homo sapiens
aaataataaatt

SEQ ID NO: 5081971 - DNA, 15 bp, Homo sapiens
aaataataaattaac

SEQ ID NO: 5081972 - DNA, 16 bp, Homo sapiens
aaataataacatatat

SEQ ID NO: 5081973 - DNA, 19 bp, Homo sapiens
aaataataatagtactatt

SEQ ID NO: 5081974 - DNA, 15 bp, Homo sapiens
aaataatacttcata

SEQ ID NO: 5081975 - DNA, 21 bp, Homo sapiens
aaataatatccatacagtcaa

SEQ ID NO: 5081976 - DNA, 13 bp, Homo sapiens
aaataatatgcat

SEQ ID NO: 5081977 - DNA, 18 bp, Homo sapiens
aaataatattactctatg

SEQ ID NO: 5081978 - DNA, 15 bp, Homo sapiens
aaataatattatatt

SEQ ID NO: 5081979 - DNA, 16 bp, Homo sapiens
aaataatattatattg

SEQ ID NO: 5081980 - DNA, 14 bp, Homo sapiens
aaataatattgatt

SEQ ID NO: 5081981 - DNA, 13 bp, Homo sapiens
aaataatattgcc

SEQ ID NO: 5081982 - DNA, 14 bp, Homo sapiens
aaataatattgcct

SEQ ID NO: 5081983 - DNA, 22 bp, Homo sapiens
aaataatattgccttgatgttt

SEQ ID NO: 5081984 - DNA, 16 bp, Homo sapiens
aaataatcacacacac

SEQ ID NO: 5081985 - DNA, 12 bp, Homo sapiens
aaataatctgaa

SEQ ID NO: 5081986 - DNA, 19 bp, Homo sapiens
aaataatgaatacatttcc

SEQ ID NO: 5081987 - DNA, 19 bp, Homo sapiens
aaataatgatcttccaaat

SEQ ID NO: 5081988 - DNA, 12 bp, Homo sapiens
aaataatgcaaa

SEQ ID NO: 5081989 - DNA, 13 bp, Homo sapiens
aaataatgctgtt

SEQ ID NO: 5081990 - DNA, 22 bp, Homo sapiens
aaataatgcttaacataaactt

SEQ ID NO: 5081991 - DNA, 12 bp, Homo sapiens
aaataatgcttt

SEQ ID NO: 5081992 - DNA, 16 bp, Homo sapiens
aaataatgctttgaaa

SEQ ID NO: 5081993 - DNA, 17 bp, Homo sapiens
aaataatgcttttctaa

SEQ ID NO: 5081994 - DNA, 23 bp, Homo sapiens
aaataatgtaagggtctgttgta

SEQ ID NO: 5081995 - DNA, 16 bp, Homo sapiens
aaataatgtcttgtta

SEQ ID NO: 5081996 - DNA, 13 bp, Homo sapiens
aaataatgtgaaa

SEQ ID NO: 5081997 - DNA, 14 bp, Homo sapiens
aaataatgtgaaac

SEQ ID NO: 5081998 - DNA, 13 bp, Homo sapiens
aaataattaaaac

SEQ ID NO: 5081999 - DNA, 13 bp, Homo sapiens
aaataattaaata

SEQ ID NO: 5082000 - DNA, 16 bp, Homo sapiens
aaataattaaatctct

SEQ ID NO: 5082001 - DNA, 22 bp, Homo sapiens
aaataattatataactgtattt

SEQ ID NO: 5082002 - DNA, 14 bp, Homo sapiens
aaataattatcaca

SEQ ID NO: 5082003 - DNA, 12 bp, Homo sapiens
aaataattattt

SEQ ID NO: 5082004 - DNA, 15 bp, Homo sapiens
aaataattcatatct

SEQ ID NO: 5082005 - DNA, 16 bp, Homo sapiens
aaataattcatatcta

SEQ ID NO: 5082006 - DNA, 14 bp, Homo sapiens
aaataattctaaag

SEQ ID NO: 5082007 - DNA, 15 bp, Homo sapiens
aaataattctaaagg

SEQ ID NO: 5082008 - DNA, 18 bp, Homo sapiens
aaataattcttttttatt

SEQ ID NO: 5082009 - DNA, 22 bp, Homo sapiens
aaataattcttttttattaatc

SEQ ID NO: 5082010 - DNA, 17 bp, Homo sapiens
aaataattgagactgaa

SEQ ID NO: 5082011 - DNA, 20 bp, Homo sapiens
aaataattgagactgaaaga

SEQ ID NO: 5082012 - DNA, 13 bp, Homo sapiens
aaataattgttgt

SEQ ID NO: 5082013 - DNA, 19 bp, Homo sapiens
aaataatttaactaccctt

SEQ ID NO: 5082014 - DNA, 16 bp, Homo sapiens
aaataatttactgtga

SEQ ID NO: 5082015 - DNA, 13 bp, Homo sapiens
aaataatttagaa

SEQ ID NO: 5082016 - DNA, 17 bp, Homo sapiens
aaataatttatatgcat

SEQ ID NO: 5082017 - DNA, 12 bp, Homo sapiens
aaataatttatc

SEQ ID NO: 5082018 - DNA, 13 bp, Homo sapiens
aaataatttatca

SEQ ID NO: 5082019 - DNA, 18 bp, Homo sapiens
aaataatttattttgctc

SEQ ID NO: 5082020 - DNA, 17 bp, Homo sapiens
aaataattttaaaaatg

SEQ ID NO: 5082021 - DNA, 20 bp, Homo sapiens
aaataattttaaaaatggtg

SEQ ID NO: 5082022 - DNA, 20 bp, Homo sapiens
aaataattttaaacaaaggt

SEQ ID NO: 5082023 - DNA, 13 bp, Homo sapiens
aaataattttaat

SEQ ID NO: 5082024 - DNA, 12 bp, Homo sapiens
aaataattttat

SEQ ID NO: 5082025 - DNA, 22 bp, Homo sapiens
aaataatttttatatttgaaat

SEQ ID NO: 5082026 - DNA, 23 bp, Homo sapiens
aaataatttttatatttgaaata

SEQ ID NO: 5082027 - DNA, 12 bp, Homo sapiens
aaatacaaaaac

SEQ ID NO: 5082028 - DNA, 22 bp, Homo sapiens
aaatacaaaaagcaaaacaaaa

SEQ ID NO: 5082029 - DNA, 16 bp, Homo sapiens
aaatacaaaaatgaat

SEQ ID NO: 5082030 - DNA, 17 bp, Homo sapiens
aaatacaaaataaaatt

SEQ ID NO: 5082031 - DNA, 16 bp, Homo sapiens
aaatacaaagtaaata

SEQ ID NO: 5082032 - DNA, 13 bp, Homo sapiens
aaatacaaagtta

SEQ ID NO: 5082033 - DNA, 17 bp, Homo sapiens
aaatacaaatctgtata

SEQ ID NO: 5082034 - DNA, 23 bp, Homo sapiens
aaatacaaattttgtataacttt

SEQ ID NO: 5082035 - DNA, 16 bp, Homo sapiens
aaatacaacacatcta

SEQ ID NO: 5082036 - DNA, 18 bp, Homo sapiens
aaatacaacacatctaat

SEQ ID NO: 5082037 - DNA, 15 bp, Homo sapiens
aaatacaagactgtt

SEQ ID NO: 5082038 - DNA, 18 bp, Homo sapiens
aaatacaagactgttgtg

SEQ ID NO: 5082039 - DNA, 19 bp, Homo sapiens
aaatacaagtttgaacagg

SEQ ID NO: 5082040 - DNA, 21 bp, Homo sapiens
aaatacaatggtttctgaaag

SEQ ID NO: 5082041 - DNA, 18 bp, Homo sapiens
aaatacaatttgtacttt

SEQ ID NO: 5082042 - DNA, 22 bp, Homo sapiens
aaatacaattttgtttctgtac

SEQ ID NO: 5082043 - DNA, 13 bp, Homo sapiens
aaatacaattttt

SEQ ID NO: 5082044 - DNA, 18 bp, Homo sapiens
aaatacacatacatatat

SEQ ID NO: 5082045 - DNA, 18 bp, Homo sapiens
aaatacacatagcatgta

SEQ ID NO: 5082046 - DNA, 16 bp, Homo sapiens
aaatacacatgaaaac

SEQ ID NO: 5082047 - DNA, 17 bp, Homo sapiens
aaatacacattatcact

SEQ ID NO: 5082048 - DNA, 12 bp, Homo sapiens
aaatacacattt

SEQ ID NO: 5082049 - DNA, 13 bp, Homo sapiens
aaatacacatttc

SEQ ID NO: 5082050 - DNA, 14 bp, Homo sapiens
aaatacacatttca

SEQ ID NO: 5082051 - DNA, 18 bp, Homo sapiens
aaatacacatttcacatt

SEQ ID NO: 5082052 - DNA, 21 bp, Homo sapiens
aaatacaccacgaatttggtg

SEQ ID NO: 5082053 - DNA, 14 bp, Homo sapiens
aaatacacgtgtat

SEQ ID NO: 5082054 - DNA, 17 bp, Homo sapiens
aaatacactacaaatgt

SEQ ID NO: 5082055 - DNA, 14 bp, Homo sapiens
aaatacactgtgaa

SEQ ID NO: 5082056 - DNA, 16 bp, Homo sapiens
aaatacagacactaag

SEQ ID NO: 5082057 - DNA, 22 bp, Homo sapiens
aaatacagacactaagttatag

SEQ ID NO: 5082058 - DNA, 11 bp, Homo sapiens
aaatacagata

SEQ ID NO: 5082059 - DNA, 20 bp, Homo sapiens
aaatacagataaatgattca

SEQ ID NO: 5082060 - DNA, 22 bp, Homo sapiens
aaatacagataaatgattcaaa

SEQ ID NO: 5082061 - DNA, 22 bp, Homo sapiens
aaatacagataattcatttgta

SEQ ID NO: 5082062 - DNA, 15 bp, Homo sapiens
aaatacagattttga

SEQ ID NO: 5082063 - DNA, 22 bp, Homo sapiens
aaatacagcatttctttggaaa

SEQ ID NO: 5082064 - DNA, 20 bp, Homo sapiens
aaatacagtaaagtttaaaa

SEQ ID NO: 5082065 - DNA, 17 bp, Homo sapiens
aaatacagtagtataat

SEQ ID NO: 5082066 - DNA, 22 bp, Homo sapiens
aaatacagtcttccatttgcaa

SEQ ID NO: 5082067 - DNA, 23 bp, Homo sapiens
aaatacagtcttccatttgcaag

SEQ ID NO: 5082068 - DNA, 16 bp, Homo sapiens
aaatacagtggatctc

SEQ ID NO: 5082069 - DNA, 14 bp, Homo sapiens
aaatacagttattt

SEQ ID NO: 5082070 - DNA, 22 bp, Homo sapiens
aaatacagtttgtcacatgaaa

SEQ ID NO: 5082071 - DNA, 19 bp, Homo sapiens
aaatacataaaagaatgta

SEQ ID NO: 5082072 - DNA, 16 bp, Homo sapiens
aaatacatacggtcag

SEQ ID NO: 5082073 - DNA, 23 bp, Homo sapiens
aaatacatcatatgttagataca

SEQ ID NO: 5082074 - DNA, 13 bp, Homo sapiens
aaatacatgacat

SEQ ID NO: 5082075 - DNA, 18 bp, Homo sapiens
aaatacatgctaagagaa

SEQ ID NO: 5082076 - DNA, 14 bp, Homo sapiens
aaatacatgtgtgg

SEQ ID NO: 5082077 - DNA, 17 bp, Homo sapiens
aaatacatgttgtaaat

SEQ ID NO: 5082078 - DNA, 23 bp, Homo sapiens
aaatacattattgaaaagcaaat

SEQ ID NO: 5082079 - DNA, 18 bp, Homo sapiens
aaatacattctttttgct

SEQ ID NO: 5082080 - DNA, 18 bp, Homo sapiens
aaatacatttaaaactta

SEQ ID NO: 5082081 - DNA, 14 bp, Homo sapiens
aaataccaaatgcc

SEQ ID NO: 5082082 - DNA, 15 bp, Homo sapiens
aaataccacaagcct

SEQ ID NO: 5082083 - DNA, 22 bp, Homo sapiens
aaataccacaagcctgagaact

SEQ ID NO: 5082084 - DNA, 16 bp, Homo sapiens
aaataccactgtaatt

SEQ ID NO: 5082085 - DNA, 17 bp, Homo sapiens
aaataccaggaccagtt

SEQ ID NO: 5082086 - DNA, 16 bp, Homo sapiens
aaataccagtacttga

SEQ ID NO: 5082087 - DNA, 18 bp, Homo sapiens
aaataccagtgaaccaaa

SEQ ID NO: 5082088 - DNA, 18 bp, Homo sapiens
aaataccataggaagaca

SEQ ID NO: 5082089 - DNA, 17 bp, Homo sapiens
aaataccattattatca

SEQ ID NO: 5082090 - DNA, 22 bp, Homo sapiens
aaataccatttagtaagaatac

SEQ ID NO: 5082091 - DNA, 18 bp, Homo sapiens
aaatacctaattgtggat

SEQ ID NO: 5082092 - DNA, 16 bp, Homo sapiens
aaatacctcaattttt

SEQ ID NO: 5082093 - DNA, 15 bp, Homo sapiens
aaatacctcaggaaa

SEQ ID NO: 5082094 - DNA, 17 bp, Homo sapiens
aaatacctcatgtttat

SEQ ID NO: 5082095 - DNA, 15 bp, Homo sapiens
aaatacctttgtagt

SEQ ID NO: 5082096 - DNA, 22 bp, Homo sapiens
aaatacgagaaaatctgcatgt

SEQ ID NO: 5082097 - DNA, 18 bp, Homo sapiens
aaagtgtattttattcag

SEQ ID NO: 5082098 - DNA, 20 bp, Homo sapiens
aaagtgtattttattcagta

SEQ ID NO: 5082099 - DNA, 21 bp, Homo sapiens
aaagtgtatttttttactaat

SEQ ID NO: 5082100 - DNA, 18 bp, Homo sapiens
aaagtgtcaccttttctt

SEQ ID NO: 5082101 - DNA, 19 bp, Homo sapiens
aaagtgtcactaagaatat

SEQ ID NO: 5082102 - DNA, 21 bp, Homo sapiens
aaagtgtcactccataaaaag

SEQ ID NO: 5082103 - DNA, 16 bp, Homo sapiens
aaagtgtccattgaca

SEQ ID NO: 5082104 - DNA, 19 bp, Homo sapiens
aaagtgtccattgacatgt

SEQ ID NO: 5082105 - DNA, 23 bp, Homo sapiens
aaagtgtccattgacatgtacag

SEQ ID NO: 5082106 - DNA, 19 bp, Homo sapiens
aaagtgtctagacatattt

SEQ ID NO: 5082107 - DNA, 14 bp, Homo sapiens
aaagtgtctcaaag

SEQ ID NO: 5082108 - DNA, 18 bp, Homo sapiens
aaagtgtctcattctcag

SEQ ID NO: 5082109 - DNA, 22 bp, Homo sapiens
aaagtgtcttttgacattttat

SEQ ID NO: 5082110 - DNA, 13 bp, Homo sapiens
aaagtgtgcttta

SEQ ID NO: 5082111 - DNA, 23 bp, Homo sapiens
aaagtgtgctttatgctgaaaca

SEQ ID NO: 5082112 - DNA, 14 bp, Homo sapiens
aaagtgtggaaagc

SEQ ID NO: 5082113 - DNA, 15 bp, Homo sapiens
aaagtgtggaaagca

SEQ ID NO: 5082114 - DNA, 19 bp, Homo sapiens
aaagtgtggtcccaacagg

SEQ ID NO: 5082115 - DNA, 16 bp, Homo sapiens
aaagtgtgtatatatt

SEQ ID NO: 5082116 - DNA, 14 bp, Homo sapiens
aaagtgtgtattaa

SEQ ID NO: 5082117 - DNA, 17 bp, Homo sapiens
aaagtgtgtattaaaaa

SEQ ID NO: 5082118 - DNA, 22 bp, Homo sapiens
aaagtgtgtattaaaaaaaaca

SEQ ID NO: 5082119 - DNA, 23 bp, Homo sapiens
aaagtgtgtgaaacctacagcat

SEQ ID NO: 5082120 - DNA, 18 bp, Homo sapiens
aaagtgtgtgtgttctgt

SEQ ID NO: 5082121 - DNA, 19 bp, Homo sapiens
aaagtgtgtgtgttctgta

SEQ ID NO: 5082122 - DNA, 14 bp, Homo sapiens
aaagtgttcaaatt

SEQ ID NO: 5082123 - DNA, 21 bp, Homo sapiens
aaagtgttcattgcacaatat

SEQ ID NO: 5082124 - DNA, 21 bp, Homo sapiens
aaagtgttctgtgtccttcta

SEQ ID NO: 5082125 - DNA, 9 bp, Homo sapiens
aaagtgttg

SEQ ID NO: 5082126 - DNA, 20 bp, Homo sapiens
aaagtgttgctgtggctcca

SEQ ID NO: 5082127 - DNA, 12 bp, Homo sapiens
aaagtgttggtc

SEQ ID NO: 5082128 - DNA, 22 bp, Homo sapiens
aaagtgttgtcttattcctaat

SEQ ID NO: 5082129 - DNA, 17 bp, Homo sapiens
aaagtgttgtgttcctg

SEQ ID NO: 5082130 - DNA, 20 bp, Homo sapiens
aaagtgtttaattgtataaa

SEQ ID NO: 5082131 - DNA, 15 bp, Homo sapiens
aaagtgtttagctgt

SEQ ID NO: 5082132 - DNA, 23 bp, Homo sapiens
aaagtgtttatgacaaatttagc

SEQ ID NO: 5082133 - DNA, 18 bp, Homo sapiens
aaagtgtttatttttcat

SEQ ID NO: 5082134 - DNA, 20 bp, Homo sapiens
aaagtgtttatttttcatat

SEQ ID NO: 5082135 - DNA, 13 bp, Homo sapiens
aaagtgtttcagc

SEQ ID NO: 5082136 - DNA, 21 bp, Homo sapiens
aaagtgtttcagctaagggaa

SEQ ID NO: 5082137 - DNA, 17 bp, Homo sapiens
aaagtgttttattttca

SEQ ID NO: 5082138 - DNA, 14 bp, Homo sapiens
aaagtgttttcaga

SEQ ID NO: 5082139 - DNA, 14 bp, Homo sapiens
aaagtgttttctct

SEQ ID NO: 5082140 - DNA, 14 bp, Homo sapiens
aaagtgttttgaat

SEQ ID NO: 5082141 - DNA, 14 bp, Homo sapiens
aaagtgtttttctt

SEQ ID NO: 5082142 - DNA, 22 bp, Homo sapiens
aaagttaaaaaaaataataaat

SEQ ID NO: 5082143 - DNA, 22 bp, Homo sapiens
aaagttaaacattgaagtaatg

SEQ ID NO: 5082144 - DNA, 12 bp, Homo sapiens
aaagttaaatgt

SEQ ID NO: 5082145 - DNA, 13 bp, Homo sapiens
aaagttaaatgta

SEQ ID NO: 5082146 - DNA, 21 bp, Homo sapiens
aaagttaaatgtgtgtaaaaa

SEQ ID NO: 5082147 - DNA, 14 bp, Homo sapiens
aaagttaaattgca

SEQ ID NO: 5082148 - DNA, 16 bp, Homo sapiens
aaagttaacagatttt

SEQ ID NO: 5082149 - DNA, 22 bp, Homo sapiens
aaagttaacattcagtacttta

SEQ ID NO: 5082150 - DNA, 16 bp, Homo sapiens
aaagttaactgacttc

SEQ ID NO: 5082151 - DNA, 17 bp, Homo sapiens
aaagttacaaattgctt

SEQ ID NO: 5082152 - DNA, 17 bp, Homo sapiens
aaagttacagaaatact

SEQ ID NO: 5082153 - DNA, 21 bp, Homo sapiens
aaagttacctggaatcaaata

SEQ ID NO: 5082154 - DNA, 19 bp, Homo sapiens
aaagttacgcttttctaag

SEQ ID NO: 5082155 - DNA, 18 bp, Homo sapiens
aaagttactaatatatct

SEQ ID NO: 5082156 - DNA, 19 bp, Homo sapiens
aaagttactaatatatctg

SEQ ID NO: 5082157 - DNA, 19 bp, Homo sapiens
aaagttactacctgtcaag

SEQ ID NO: 5082158 - DNA, 16 bp, Homo sapiens
aaagttactactgatt

SEQ ID NO: 5082159 - DNA, 18 bp, Homo sapiens
aaagttactactgatttt

SEQ ID NO: 5082160 - DNA, 14 bp, Homo sapiens
aaagttactgtaaa

SEQ ID NO: 5082161 - DNA, 15 bp, Homo sapiens
aaagttactgtaaat

SEQ ID NO: 5082162 - DNA, 20 bp, Homo sapiens
aaagttactttgtcagaggc

SEQ ID NO: 5082163 - DNA, 18 bp, Homo sapiens
aaagttagaatctatttt

SEQ ID NO: 5082164 - DNA, 20 bp, Homo sapiens
aaagttagcattgtttctag

SEQ ID NO: 5082165 - DNA, 23 bp, Homo sapiens
aaagttagcattgtttctagatt

SEQ ID NO: 5082166 - DNA, 18 bp, Homo sapiens
aaagttagcctttgaatg

SEQ ID NO: 5082167 - DNA, 20 bp, Homo sapiens
aaagttagggcatttttctt

SEQ ID NO: 5082168 - DNA, 23 bp, Homo sapiens
aaagttaggttataagaaacaga

SEQ ID NO: 5082169 - DNA, 18 bp, Homo sapiens
aaagttagtatcttttga

SEQ ID NO: 5082170 - DNA, 21 bp, Homo sapiens
aaagttagtatcttttgatat

SEQ ID NO: 5082171 - DNA, 18 bp, Homo sapiens
aaagttagtattaaaatc

SEQ ID NO: 5082172 - DNA, 19 bp, Homo sapiens
aaagttagtattaaaatct
